United States Patent 10,706,955 (BIOINFORMATIC PROCESSES FOR DETERMINATION OF PEPTIDE BINDING) - sequence listing, part 11

SEQ ID NO: 388380 - protein, 7 aa, Mycobacterium
GGSLKSS

SEQ ID NO: 388381 - protein, 5 aa, Mycobacterium
GGSTN

SEQ ID NO: 388382 - protein, 5 aa, Mycobacterium
GGSTY

SEQ ID NO: 388383 - protein, 7 aa, Mycobacterium
GGTDAKA

SEQ ID NO: 388384 - protein, 7 aa, Mycobacterium
GGTEAVE

SEQ ID NO: 388385 - protein, 4 aa, Mycobacterium
GGTG

SEQ ID NO: 388386 - protein, 5 aa, Mycobacterium
GGTPR

SEQ ID NO: 388387 - protein, 8 aa, Mycobacterium
GGTPSLLG

SEQ ID NO: 388388 - protein, 4 aa, Mycobacterium
GGTR

SEQ ID NO: 388389 - protein, 7 aa, Mycobacterium
GGTSEVQ

SEQ ID NO: 388390 - protein, 6 aa, Mycobacterium
GGTSLR

SEQ ID NO: 388391 - protein, 4 aa, Mycobacterium
GGTT

SEQ ID NO: 388392 - protein, 9 aa, Mycobacterium
GGTTGTPKL

SEQ ID NO: 388393 - protein, 5 aa, Mycobacterium
GGVGK

SEQ ID NO: 388394 - protein, 6 aa, Mycobacterium
GGVGKT

SEQ ID NO: 388395 - protein, 10 aa, Mycobacterium
GGVGKTTTAA

SEQ ID NO: 388396 - protein, 7 aa, Mycobacterium
GGVGTAS

SEQ ID NO: 388397 - protein, 4 aa, Mycobacterium
GGVP

SEQ ID NO: 388398 - protein, 5 aa, Mycobacterium
GGVPG

SEQ ID NO: 388399 - protein, 6 aa, Mycobacterium
GGVSSL

SEQ ID NO: 388400 - protein, 10 aa, Mycobacterium
GGVSTPSNQD

SEQ ID NO: 388401 - protein, 4 aa, Mycobacterium
GGYG

SEQ ID NO: 388402 - protein, 4 aa, Mycobacterium
GGYP

SEQ ID NO: 388403 - protein, 6 aa, Mycobacterium
GGYSES

SEQ ID NO: 388404 - protein, 8 aa, Mycobacterium
GHAGTLDP

SEQ ID NO: 388405 - protein, 9 aa, Mycobacterium
GHDSGLAGQ

SEQ ID NO: 388406 - protein, 12 aa, Mycobacterium
GHDTTSATISGG

SEQ ID NO: 388407 - protein, 6 aa, Mycobacterium
GHEGAG

SEQ ID NO: 388408 - protein, 7 aa, Mycobacterium
GHEGAGT

SEQ ID NO: 388409 - protein, 6 aa, Mycobacterium
GHEGSG

SEQ ID NO: 388410 - protein, 7 aa, Mycobacterium
GHKLSDD

SEQ ID NO: 388411 - protein, 12 aa, Mycobacterium
GHPDPSSGTIDA

SEQ ID NO: 388412 - protein, 13 aa, Mycobacterium
GHPDPSSGTIDAP

SEQ ID NO: 388413 - protein, 10 aa, Mycobacterium
GHPQRKDYPL

SEQ ID NO: 388414 - protein, 7 aa, Mycobacterium
GHSYGGR

SEQ ID NO: 388415 - protein, 6 aa, Mycobacterium
GHTPGS

SEQ ID NO: 388416 - protein, 4 aa, Mycobacterium
GIAG

SEQ ID NO: 388417 - protein, 5 aa, Mycobacterium
GIARD

SEQ ID NO: 388418 - protein, 4 aa, Mycobacterium
GIDP

SEQ ID NO: 388419 - protein, 6 aa, Mycobacterium
GIDPDD

SEQ ID NO: 388420 - protein, 13 aa, Mycobacterium
GIDSNNSPLPIPD

SEQ ID NO: 388421 - protein, 5 aa, Mycobacterium
GIDST

SEQ ID NO: 388422 - protein, 4 aa, Mycobacterium
GIEA

SEQ ID NO: 388423 - protein, 4 aa, Mycobacterium
GIGS

SEQ ID NO: 388424 - protein, 5 aa, Mycobacterium
GIGTA

SEQ ID NO: 388425 - protein, 7 aa, Mycobacterium
GIHPGGI

SEQ ID NO: 388426 - protein, 7 aa, Mycobacterium
GIPEDQA

SEQ ID NO: 388427 - protein, 5 aa, Mycobacterium
GIPPD

SEQ ID NO: 388428 - protein, 8 aa, Mycobacterium
GIRRGTPM

SEQ ID NO: 388429 - protein, 4 aa, Mycobacterium
GITA

SEQ ID NO: 388430 - protein, 9 aa, Mycobacterium
GKDKGAKGK

SEQ ID NO: 388431 - protein, 7 aa, Mycobacterium
GKDPRDA

SEQ ID NO: 388432 - protein, 5 aa, Mycobacterium
GKDRQ

SEQ ID NO: 388433 - protein, 5 aa, Mycobacterium
GKEGR

SEQ ID NO: 388434 - protein, 22 aa, Mycobacterium
GKFTGSGGNLEQTVTKNNLEAA

SEQ ID NO: 388435 - protein, 10 aa, Mycobacterium
GKFTSDESHT

SEQ ID NO: 388436 - protein, 7 aa, Mycobacterium
GKGEAKD

SEQ ID NO: 388437 - protein, 6 aa, Mycobacterium
GKGEYG

SEQ ID NO: 388438 - protein, 9 aa, Mycobacterium
GKGSSRPPR

SEQ ID NO: 388439 - protein, 8 aa, Mycobacterium
GKIPAGGG

SEQ ID NO: 388440 - protein, 5 aa, Mycobacterium
GKKET

SEQ ID NO: 388441 - protein, 8 aa, Mycobacterium
GKKREDGV

SEQ ID NO: 388442 - protein, 5 aa, Mycobacterium
GKLPS

SEQ ID NO: 388443 - protein, 7 aa, Mycobacterium
GKLSNKL

SEQ ID NO: 388444 - protein, 9 aa, Mycobacterium
GKNMSPANI

SEQ ID NO: 388445 - protein, 4 aa, Mycobacterium
GKNP

SEQ ID NO: 388446 - protein, 9 aa, Mycobacterium
GKPAPSVSQ

SEQ ID NO: 388447 - protein, 13 aa, Mycobacterium
GKPATRRHEANGG

SEQ ID NO: 388448 - protein, 4 aa, Mycobacterium
GKPL

SEQ ID NO: 388449 - protein, 13 aa, Mycobacterium
GKPTDQLPGPGRQ

SEQ ID NO: 388450 - protein, 6 aa, Mycobacterium
GKRPTV

SEQ ID NO: 388451 - protein, 4 aa, Mycobacterium
GKSA

SEQ ID NO: 388452 - protein, 5 aa, Mycobacterium
GKSAS

SEQ ID NO: 388453 - protein, 4 aa, Mycobacterium
GKSY

SEQ ID NO: 388454 - protein, 9 aa, Mycobacterium
GKTLSDPNR

SEQ ID NO: 388455 - protein, 7 aa, Mycobacterium
GKTTAMR

SEQ ID NO: 388456 - protein, 5 aa, Mycobacterium
GKVGV

SEQ ID NO: 388457 - protein, 8 aa, Mycobacterium
GKYPSTEF

SEQ ID NO: 388458 - protein, 6 aa, Mycobacterium
GLAAGK

SEQ ID NO: 388459 - protein, 5 aa, Mycobacterium
GLAET

SEQ ID NO: 388460 - protein, 8 aa, Mycobacterium
GLAKTTAA

SEQ ID NO: 388461 - protein, 6 aa, Mycobacterium
GLDGYS

SEQ ID NO: 388462 - protein, 16 aa, Mycobacterium
GLEGTAGGSSYNAAKG

SEQ ID NO: 388463 - protein, 12 aa, Mycobacterium
GLENGDLDRTHR

SEQ ID NO: 388464 - protein, 11 aa, Mycobacterium
GLGEDGPTHQP

SEQ ID NO: 388465 - protein, 4 aa, Mycobacterium
GLGG

SEQ ID NO: 388466 - protein, 5 aa, Mycobacterium
GLGGD

SEQ ID NO: 388467 - protein, 8 aa, Mycobacterium
GLGGQQRV

SEQ ID NO: 388468 - protein, 5 aa, Mycobacterium
GLGGT

SEQ ID NO: 388469 - protein, 10 aa, Mycobacterium
GLGKPDKKAV

SEQ ID NO: 388470 - protein, 4 aa, Mycobacterium
GLGN

SEQ ID NO: 388471 - protein, 5 aa, Mycobacterium
GLGNG

SEQ ID NO: 388472 - protein, 8 aa, Mycobacterium
GLPGAEGR

SEQ ID NO: 388473 - protein, 7 aa, Mycobacterium
GLPKGSV

SEQ ID NO: 388474 - protein, 7 aa, Mycobacterium
GLPRSSA

SEQ ID NO: 388475 - protein, 5 aa, Mycobacterium
GLRPS

SEQ ID NO: 388476 - protein, 8 aa, Mycobacterium
GLRTGPDG

SEQ ID NO: 388477 - protein, 4 aa, Mycobacterium
GLSE

SEQ ID NO: 388478 - protein, 4 aa, Mycobacterium
GLTA

SEQ ID NO: 388479 - protein, 5 aa, Mycobacterium
GLTPQ

SEQ ID NO: 388480 - protein, 5 aa, Mycobacterium
GLTPR

SEQ ID NO: 388481 - protein, 5 aa, Mycobacterium
GMGGT

SEQ ID NO: 388482 - protein, 6 aa, Mycobacterium
GMGREG

SEQ ID NO: 388483 - protein, 4 aa, Mycobacterium
GMGT

SEQ ID NO: 388484 - protein, 10 aa, Mycobacterium
GMSSDQPLAR

SEQ ID NO: 388485 - protein, 5 aa, Mycobacterium
GMTQD

SEQ ID NO: 388486 - protein, 7 aa, Mycobacterium
GNAMTDD

SEQ ID NO: 388487 - protein, 4 aa, Mycobacterium
GNCL

SEQ ID NO: 388488 - protein, 8 aa, Mycobacterium
GNETTRNA

SEQ ID NO: 388489 - protein, 4 aa, Mycobacterium
GNGA

SEQ ID NO: 388490 - protein, 8 aa, Mycobacterium
GNGGMTPK

SEQ ID NO: 388491 - protein, 24 aa, Mycobacterium
GNGGNGAAGTNPGVAGGAGGAAGL

SEQ ID NO: 388492 - protein, 6 aa, Mycobacterium
GNGLRR

SEQ ID NO: 388493 - protein, 9 aa, Mycobacterium
GNGPSFCSG

SEQ ID NO: 388494 - protein, 8 aa, Mycobacterium
GNLPTAPA

SEQ ID NO: 388495 - protein, 5 aa, Mycobacterium
GNNSS

SEQ ID NO: 388496 - protein, 10 aa, Mycobacterium
GNPNGHSSAY

SEQ ID NO: 388497 - protein, 10 aa, Mycobacterium
GNPPEFGGRN

SEQ ID NO: 388498 - protein, 9 aa, Mycobacterium
GNPTLGTVS

SEQ ID NO: 388499 - protein, 4 aa, Mycobacterium
GNPV

SEQ ID NO: 388500 - protein, 5 aa, Mycobacterium
GNPVS

SEQ ID NO: 388501 - protein, 8 aa, Mycobacterium
GNQGSGNI

SEQ ID NO: 388502 - protein, 15 aa, Mycobacterium
GNRAASSLSGGADTL

SEQ ID NO: 388503 - protein, 7 aa, Mycobacterium
GNRDERV

SEQ ID NO: 388504 - protein, 5 aa, Mycobacterium
GNTGR

SEQ ID NO: 388505 - protein, 11 aa, Mycobacterium
GNTTSAPSSGF

SEQ ID NO: 388506 - protein, 8 aa, Mycobacterium
GNVGKSSL

SEQ ID NO: 388507 - protein, 4 aa, Mycobacterium
GNVP

SEQ ID NO: 388508 - protein, 8 aa, Mycobacterium
GNVRGPYK

SEQ ID NO: 388509 - protein, 6 aa, Mycobacterium
GNVSSP

SEQ ID NO: 388510 - protein, 9 aa, Mycobacterium
GNYNPKTAR

SEQ ID NO: 388511 - protein, 8 aa, Mycobacterium
GPAASPLG

SEQ ID NO: 388512 - protein, 9 aa, Mycobacterium
GPAGTGKSH

SEQ ID NO: 388513 - protein, 6 aa, Mycobacterium
GPALAA

SEQ ID NO: 388514 - protein, 4 aa, Mycobacterium
GPAP

SEQ ID NO: 388515 - protein, 6 aa, Mycobacterium
GPDGSG

SEQ ID NO: 388516 - protein, 5 aa, Mycobacterium
GPDRE

SEQ ID NO: 388517 - protein, 4 aa, Mycobacterium
GPEA

SEQ ID NO: 388518 - protein, 4 aa, Mycobacterium
GPEP

SEQ ID NO: 388519 - protein, 4 aa, Mycobacterium
GPEY

SEQ ID NO: 388520 - protein, 5 aa, Mycobacterium
GPGDR

SEQ ID NO: 388521 - protein, 5 aa, Mycobacterium
GPGES

SEQ ID NO: 388522 - protein, 11 aa, Mycobacterium
GPGGPEGLPSP

SEQ ID NO: 388523 - protein, 9 aa, Mycobacterium
GPGHGGPGL

SEQ ID NO: 388524 - protein, 4 aa, Mycobacterium
GPGL

SEQ ID NO: 388525 - protein, 6 aa, Mycobacterium
GPGPFT

SEQ ID NO: 388526 - protein, 9 aa, Mycobacterium
GPGSGRETA

SEQ ID NO: 388527 - protein, 5 aa, Mycobacterium
GPGSV

SEQ ID NO: 388528 - protein, 10 aa, Mycobacterium
GPIAGRTDDA

SEQ ID NO: 388529 - protein, 4 aa, Mycobacterium
GPID

SEQ ID NO: 388530 - protein, 8 aa, Mycobacterium
GPKGGPGM

SEQ ID NO: 388531 - protein, 4 aa, Mycobacterium
GPLA

SEQ ID NO: 388532 - protein, 4 aa, Mycobacterium
GPLD

SEQ ID NO: 388533 - protein, 9 aa, Mycobacterium
GPLSGDPYR

SEQ ID NO: 388534 - protein, 9 aa, Mycobacterium
GPNGSGKTS

SEQ ID NO: 388535 - protein, 7 aa, Mycobacterium
GPNRIGQ

SEQ ID NO: 388536 - protein, 5 aa, Mycobacterium
GPPAY

SEQ ID NO: 388537 - protein, 4 aa, Mycobacterium
GPPG

SEQ ID NO: 388538 - protein, 8 aa, Mycobacterium
GPPGSGRS

SEQ ID NO: 388539 - protein, 9 aa, Mycobacterium
GPPGTGKTH

SEQ ID NO: 388540 - protein, 4 aa, Mycobacterium
GPPT

SEQ ID NO: 388541 - protein, 8 aa, Mycobacterium
GPQATGGN

SEQ ID NO: 388542 - protein, 11 aa, Mycobacterium
GPQSAKKTEAA

SEQ ID NO: 388543 - protein, 7 aa, Mycobacterium
GPREQAI

SEQ ID NO: 388544 - protein, 9 aa, Mycobacterium
GPRERSRDG

SEQ ID NO: 388545 - protein, 5 aa, Mycobacterium
GPRFS

SEQ ID NO: 388546 - protein, 9 aa, Mycobacterium
GPRHRSPEG

SEQ ID NO: 388547 - protein, 5 aa, Mycobacterium
GPRKA

SEQ ID NO: 388548 - protein, 6 aa, Mycobacterium
GPRPAE

SEQ ID NO: 388549 - protein, 5 aa, Mycobacterium
GPRPD

SEQ ID NO: 388550 - protein, 12 aa, Mycobacterium
GPRTYSDQRGHP

SEQ ID NO: 388551 - protein, 6 aa, Mycobacterium
GPSETT

SEQ ID NO: 388552 - protein, 8 aa, Mycobacterium
GPSGCGKS

SEQ ID NO: 388553 - protein, 10 aa, Mycobacterium
GPSGSGKSTL

SEQ ID NO: 388554 - protein, 9 aa, Mycobacterium
GPSGSGKTT

SEQ ID NO: 388555 - protein, 11 aa, Mycobacterium
GPSKDAQGTRR

SEQ ID NO: 388556 - protein, 8 aa, Mycobacterium
GPSPGGLR

SEQ ID NO: 388557 - protein, 8 aa, Mycobacterium
GPSRERSI

SEQ ID NO: 388558 - protein, 10 aa, Mycobacterium
GPSYTRPPSW

SEQ ID NO: 388559 - protein, 4 aa, Mycobacterium
GPTD

SEQ ID NO: 388560 - protein, 9 aa, Mycobacterium
GPTFTDSGG

SEQ ID NO: 388561 - protein, 7 aa, Mycobacterium
GPTGGAD

SEQ ID NO: 388562 - protein, 7 aa, Mycobacterium
GPTGGLG

SEQ ID NO: 388563 - protein, 8 aa, Mycobacterium
GPTPATRK

SEQ ID NO: 388564 - protein, 4 aa, Mycobacterium
GPVN

SEQ ID NO: 388565 - protein, 6 aa, Mycobacterium
GPWRDN

SEQ ID NO: 388566 - protein, 4 aa, Mycobacterium
GPYA

SEQ ID NO: 388567 - protein, 13 aa, Mycobacterium
GPYDDAPTAPGSA

SEQ ID NO: 388568 - protein, 13 aa, Mycobacterium
GQAGPEPRYTPST

SEQ ID NO: 388569 - protein, 9 aa, Mycobacterium
GQAGPPLAG

SEQ ID NO: 388570 - protein, 10 aa, Mycobacterium
GQATGRQVEN

SEQ ID NO: 388571 - protein, 8 aa, Mycobacterium
GQDPDKLP

SEQ ID NO: 388572 - protein, 6 aa, Mycobacterium
GQDTYE

SEQ ID NO: 388573 - protein, 7 aa, Mycobacterium
GQETTAK

SEQ ID NO: 388574 - protein, 4 aa, Mycobacterium
GQGA

SEQ ID NO: 388575 - protein, 14 aa, Mycobacterium
GQGEAGLRGAPSGD

SEQ ID NO: 388576 - protein, 9 aa, Mycobacterium
GQGGQRPGM

SEQ ID NO: 388577 - protein, 5 aa, Mycobacterium
GQGIS

SEQ ID NO: 388578 - protein, 6 aa, Mycobacterium
GQGPQL

SEQ ID NO: 388579 - protein, 9 aa, Mycobacterium
GQGSSRPPR

SEQ ID NO: 388580 - protein, 4 aa, Mycobacterium
GQGV

SEQ ID NO: 388581 - protein, 4 aa, Mycobacterium
GQHL

SEQ ID NO: 388582 - protein, 7 aa, Mycobacterium
GQHPGSA

SEQ ID NO: 388583 - protein, 4 aa, Mycobacterium
GQIE

SEQ ID NO: 388584 - protein, 6 aa, Mycobacterium
GQLPAQ

SEQ ID NO: 388585 - protein, 9 aa, Mycobacterium
GQLSDPGSG

SEQ ID NO: 388586 - protein, 6 aa, Mycobacterium
GQNAHT

SEQ ID NO: 388587 - protein, 4 aa, Mycobacterium
GQNR

SEQ ID NO: 388588 - protein, 4 aa, Mycobacterium
GQPG

SEQ ID NO: 388589 - protein, 4 aa, Mycobacterium
GQPI

SEQ ID NO: 388590 - protein, 10 aa, Mycobacterium
GQPPEFGGRN

SEQ ID NO: 388591 - protein, 6 aa, Mycobacterium
GQPTVT

SEQ ID NO: 388592 - protein, 9 aa, Mycobacterium
GQPVSLSPT

SEQ ID NO: 388593 - protein, 4 aa, Mycobacterium
GQRR

SEQ ID NO: 388594 - protein, 5 aa, Mycobacterium
GQSEA

SEQ ID NO: 388595 - protein, 5 aa, Mycobacterium
GQYEW

SEQ ID NO: 388596 - protein, 5 aa, Mycobacterium
GQYPR

SEQ ID NO: 388597 - protein, 4 aa, Mycobacterium
GRAA

SEQ ID NO: 388598 - protein, 7 aa, Mycobacterium
GRAAAAG

SEQ ID NO: 388599 - protein, 8 aa, Mycobacterium
GRAFSAGG

SEQ ID NO: 388600 - protein, 4 aa, Mycobacterium
GRAG

SEQ ID NO: 388601 - protein, 8 aa, Mycobacterium
GRAGGHHS

SEQ ID NO: 388602 - protein, 8 aa, Mycobacterium
GRALGDPH

SEQ ID NO: 388603 - protein, 10 aa, Mycobacterium
GRAPGSDPVT

SEQ ID NO: 388604 - protein, 4 aa, Mycobacterium
GRAT

SEQ ID NO: 388605 - protein, 6 aa, Mycobacterium
GRDGSV

SEQ ID NO: 388606 - protein, 6 aa, Mycobacterium
GRDPSF

SEQ ID NO: 388607 - protein, 4 aa, Mycobacterium
GRDV

SEQ ID NO: 388608 - protein, 4 aa, Mycobacterium
GRDY

SEQ ID NO: 388609 - protein, 5 aa, Mycobacterium
GRDYA

SEQ ID NO: 388610 - protein, 13 aa, Mycobacterium
GREARARTRMKEG

SEQ ID NO: 388611 - protein, 17 aa, Mycobacterium
GREATDEELAEESGIPV

SEQ ID NO: 388612 - protein, 5 aa, Mycobacterium
GRENP

SEQ ID NO: 388613 - protein, 10 aa, Mycobacterium
GRERASDDLT

SEQ ID NO: 388614 - protein, 4 aa, Mycobacterium
GRFS

SEQ ID NO: 388615 - protein, 8 aa, Mycobacterium
GRGAGPHK

SEQ ID NO: 388616 - protein, 9 aa, Mycobacterium
GRGAGPNKD

SEQ ID NO: 388617 - protein, 4 aa, Mycobacterium
GRGE

SEQ ID NO: 388618 - protein, 18 aa, Mycobacterium
GRGEKPGLSQVQDDPPTR

SEQ ID NO: 388619 - protein, 5 aa, Mycobacterium
GRGGE

SEQ ID NO: 388620 - protein, 4 aa, Mycobacterium
GRGI

SEQ ID NO: 388621 - protein, 10 aa, Mycobacterium
GRGKTGSGKT

SEQ ID NO: 388622 - protein, 4 aa, Mycobacterium
GRGV

SEQ ID NO: 388623 - protein, 11 aa, Mycobacterium
GRIPDGGGHRK

SEQ ID NO: 388624 - protein, 4 aa, Mycobacterium
GRKL

SEQ ID NO: 388625 - protein, 4 aa, Mycobacterium
GRLA

SEQ ID NO: 388626 - protein, 4 aa, Mycobacterium
GRLD

SEQ ID NO: 388627 - protein, 10 aa, Mycobacterium
GRLEGKSSLG

SEQ ID NO: 388628 - protein, 4 aa, Mycobacterium
GRLR

SEQ ID NO: 388629 - protein, 4 aa, Mycobacterium
GRMP

SEQ ID NO: 388630 - protein, 7 aa, Mycobacterium
GRNATTV

SEQ ID NO: 388631 - protein, 8 aa, Mycobacterium
GRNGESPV

SEQ ID NO: 388632 - protein, 4 aa, Mycobacterium
GRPA

SEQ ID NO: 388633 - protein, 6 aa, Mycobacterium
GRPEEV

SEQ ID NO: 388634 - protein, 8 aa, Mycobacterium
GRPQPGET

SEQ ID NO: 388635 - protein, 4 aa, Mycobacterium
GRPV

SEQ ID NO: 388636 - protein, 7 aa, Mycobacterium
GRPYEPQ

SEQ ID NO: 388637 - protein, 7 aa, Mycobacterium
GRQEYAT

SEQ ID NO: 388638 - protein, 4 aa, Mycobacterium
GRQG

SEQ ID NO: 388639 - protein, 4 aa, Mycobacterium
GRQV

SEQ ID NO: 388640 - protein, 9 aa, Mycobacterium
GRQVRSDVG

SEQ ID NO: 388641 - protein, 7 aa, Mycobacterium
GRRGASV

SEQ ID NO: 388642 - protein, 4 aa, Mycobacterium
GRRP

SEQ ID NO: 388643 - protein, 5 aa, Mycobacterium
GRRPG

SEQ ID NO: 388644 - protein, 4 aa, Mycobacterium
GRSH

SEQ ID NO: 388645 - protein, 7 aa, Mycobacterium
GRSIRRP

SEQ ID NO: 388646 - protein, 5 aa, Mycobacterium
GRSIT

SEQ ID NO: 388647 - protein, 4 aa, Mycobacterium
GRSR

SEQ ID NO: 388648 - protein, 4 aa, Mycobacterium
GRSS

SEQ ID NO: 388649 - protein, 8 aa, Mycobacterium
GRSTVEDA

SEQ ID NO: 388650 - protein, 12 aa, Mycobacterium
GRSVPAKSLSGF

SEQ ID NO: 388651 - protein, 6 aa, Mycobacterium
GRSVRS

SEQ ID NO: 388652 - protein, 7 aa, Mycobacterium
GRTAPSV

SEQ ID NO: 388653 - protein, 4 aa, Mycobacterium
GRTG

SEQ ID NO: 388654 - protein, 6 aa, Mycobacterium
GRTVEG

SEQ ID NO: 388655 - protein, 4 aa, Mycobacterium
GRVP

SEQ ID NO: 388656 - protein, 9 aa, Mycobacterium
GRVSAGGAT

SEQ ID NO: 388657 - protein, 11 aa, Mycobacterium
GRYGGTYAASK

SEQ ID NO: 388658 - protein, 5 aa, Mycobacterium
GSAAT

SEQ ID NO: 388659 - protein, 8 aa, Mycobacterium
GSADQQAT

SEQ ID NO: 388660 - protein, 4 aa, Mycobacterium
GSAL

SEQ ID NO: 388661 - protein, 6 aa, Mycobacterium
GSALEA

SEQ ID NO: 388662 - protein, 7 aa, Mycobacterium
GSANRDA

SEQ ID NO: 388663 - protein, 9 aa, Mycobacterium
GSAQSKQEL

SEQ ID NO: 388664 - protein, 4 aa, Mycobacterium
GSAR

SEQ ID NO: 388665 - protein, 6 aa, Mycobacterium
GSAYGL

SEQ ID NO: 388666 - protein, 7 aa, Mycobacterium
GSDEGLT

SEQ ID NO: 388667 - protein, 7 aa, Mycobacterium
GSDKPDL

SEQ ID NO: 388668 - protein, 7 aa, Mycobacterium
GSDKPDM

SEQ ID NO: 388669 - protein, 6 aa, Mycobacterium
GSDPNW

SEQ ID NO: 388670 - protein, 8 aa, Mycobacterium
GSDRVSAA

SEQ ID NO: 388671 - protein, 4 aa, Mycobacterium
GSEA

SEQ ID NO: 388672 - protein, 10 aa, Mycobacterium
GSEAQRERRK

SEQ ID NO: 388673 - protein, 7 aa, Mycobacterium
GSEDGYL

SEQ ID NO: 388674 - protein, 8 aa, Mycobacterium
GSEEALEA

SEQ ID NO: 388675 - protein, 6 aa, Mycobacterium
GSEGDF

SEQ ID NO: 388676 - protein, 5 aa, Mycobacterium
GSGAA

SEQ ID NO: 388677 - protein, 5 aa, Mycobacterium
GSGAL

SEQ ID NO: 388678 - protein, 7 aa, Mycobacterium
GSGENLN

SEQ ID NO: 388679 - protein, 4 aa, Mycobacterium
GSGF

SEQ ID NO: 388680 - protein, 7 aa, Mycobacterium
GSGGGGM

SEQ ID NO: 388681 - protein, 6 aa, Mycobacterium
GSGNGV

SEQ ID NO: 388682 - protein, 4 aa, Mycobacterium
GSGP

SEQ ID NO: 388683 - protein, 6 aa, Mycobacterium
GSGSAS

SEQ ID NO: 388684 - protein, 12 aa, Mycobacterium
GSGSSRHSPRNR

SEQ ID NO: 388685 - protein, 7 aa, Mycobacterium
GSHPAQL

SEQ ID NO: 388686 - protein, 9 aa, Mycobacterium
GSHQDAINK

SEQ ID NO: 388687 - protein, 4 aa, Mycobacterium
GSIP

SEQ ID NO: 388688 - protein, 10 aa, Mycobacterium
GSIYAGSNEI

SEQ ID NO: 388689 - protein, 6 aa, Mycobacterium
GSKALR

SEQ ID NO: 388690 - protein, 7 aa, Mycobacterium
GSKEDAI

SEQ ID NO: 388691 - protein, 5 aa, Mycobacterium
GSKER

SEQ ID NO: 388692 - protein, 4 aa, Mycobacterium
GSLG

SEQ ID NO: 388693 - protein, 5 aa, Mycobacterium
GSLRG

SEQ ID NO: 388694 - protein, 5 aa, Mycobacterium
GSMTD

SEQ ID NO: 388695 - protein, 16 aa, Mycobacterium
GSPGFRGDPAGPPISI

SEQ ID NO: 388696 - protein, 4 aa, Mycobacterium
GSPI

SEQ ID NO: 388697 - protein, 6 aa, Mycobacterium
GSPVPG

SEQ ID NO: 388698 - protein, 4 aa, Mycobacterium
GSPY

SEQ ID NO: 388699 - protein, 9 aa, Mycobacterium
GSQASNDQL

SEQ ID NO: 388700 - protein, 4 aa, Mycobacterium
GSQG

SEQ ID NO: 388701 - protein, 5 aa, Mycobacterium
GSQGT

SEQ ID NO: 388702 - protein, 5 aa, Mycobacterium
GSQWA

SEQ ID NO: 388703 - protein, 7 aa, Mycobacterium
GSQYTSR

SEQ ID NO: 388704 - protein, 4 aa, Mycobacterium
GSRE

SEQ ID NO: 388705 - protein, 10 aa, Mycobacterium
GSRGPRESKY

SEQ ID NO: 388706 - protein, 5 aa, Mycobacterium
GSRRK

SEQ ID NO: 388707 - protein, 7 aa, Mycobacterium
GSRTSQF

SEQ ID NO: 388708 - protein, 8 aa, Mycobacterium
GSSGKGGE

SEQ ID NO: 388709 - protein, 10 aa, Mycobacterium
GSSGKTSTKD

SEQ ID NO: 388710 - protein, 8 aa, Mycobacterium
GSSGPQGA

SEQ ID NO: 388711 - protein, 8 aa, Mycobacterium
GSSSKGNE

SEQ ID NO: 388712 - protein, 7 aa, Mycobacterium
GSSTYPG

SEQ ID NO: 388713 - protein, 4 aa, Mycobacterium
GSTA

SEQ ID NO: 388714 - protein, 15 aa, Mycobacterium
GSTAARHPNTTVTER

SEQ ID NO: 388715 - protein, 5 aa, Mycobacterium
GSTAL

SEQ ID NO: 388716 - protein, 7 aa, Mycobacterium
GSTATGR

SEQ ID NO: 388717 - protein, 7 aa, Mycobacterium
GSTENAT

SEQ ID NO: 388718 - protein, 8 aa, Mycobacterium
GSTGHPKP

SEQ ID NO: 388719 - protein, 9 aa, Mycobacterium
GSTHETNTL

SEQ ID NO: 388720 - protein, 7 aa, Mycobacterium
GSTRAGI

SEQ ID NO: 388721 - protein, 9 aa, Mycobacterium
GSVADAEAA

SEQ ID NO: 388722 - protein, 9 aa, Mycobacterium
GSVGGSTGV

SEQ ID NO: 388723 - protein, 6 aa, Mycobacterium
GSVGRN

SEQ ID NO: 388724 - protein, 8 aa, Mycobacterium
GSWGPEAA

SEQ ID NO: 388725 - protein, 4 aa, Mycobacterium
GTAD

SEQ ID NO: 388726 - protein, 4 aa, Mycobacterium
GTAE

SEQ ID NO: 388727 - protein, 7 aa, Mycobacterium
GTAESPG

SEQ ID NO: 388728 - protein, 9 aa, Mycobacterium
GTAGANDAA

SEQ ID NO: 388729 - protein, 4 aa, Mycobacterium
GTAL

SEQ ID NO: 388730 - protein, 6 aa, Mycobacterium
GTAPPH

SEQ ID NO: 388731 - protein, 11 aa, Mycobacterium
GTASTAALDRR

SEQ ID NO: 388732 - protein, 15 aa, Mycobacterium
GTAVGTGLNAPDGFG

SEQ ID NO: 388733 - protein, 7 aa, Mycobacterium
GTDEQKQ

SEQ ID NO: 388734 - protein, 7 aa, Mycobacterium
GTDEQKR

SEQ ID NO: 388735 - protein, 7 aa, Mycobacterium
GTDEVSE

SEQ ID NO: 388736 - protein, 4 aa, Mycobacterium
GTDT

SEQ ID NO: 388737 - protein, 5 aa, Mycobacterium
GTDTT

SEQ ID NO: 388738 - protein, 4 aa, Mycobacterium
GTDV

SEQ ID NO: 388739 - protein, 10 aa, Mycobacterium
GTEAGGHTGE

SEQ ID NO: 388740 - protein, 12 aa, Mycobacterium
GTEGFAGTTIGP

SEQ ID NO: 388741 - protein, 12 aa, Mycobacterium
GTEGPYTGNGGA

SEQ ID NO: 388742 - protein, 4 aa, Mycobacterium
GTFT

SEQ ID NO: 388743 - protein, 6 aa, Mycobacterium
GTGAGV

SEQ ID NO: 388744 - protein, 4 aa, Mycobacterium
GTGG

SEQ ID NO: 388745 - protein, 7 aa, Mycobacterium
GTGGTIT

SEQ ID NO: 388746 - protein, 4 aa, Mycobacterium
GTGL

SEQ ID NO: 388747 - protein, 4 aa, Mycobacterium
GTGN

SEQ ID NO: 388748 - protein, 8 aa, Mycobacterium
GTGSSGIQ

SEQ ID NO: 388749 - protein, 6 aa, Mycobacterium
GTGSTG

SEQ ID NO: 388750 - protein, 4 aa, Mycobacterium
GTGT

SEQ ID NO: 388751 - protein, 10 aa, Mycobacterium
GTGWPEPGGL

SEQ ID NO: 388752 - protein, 5 aa, Mycobacterium
GTGYG

SEQ ID NO: 388753 - protein, 10 aa, Mycobacterium
GTIEPGKKAD

SEQ ID NO: 388754 - protein, 15 aa, Mycobacterium
GTKEDIKEAQNNGGS

SEQ ID NO: 388755 - protein, 6 aa, Mycobacterium
GTLPEP

SEQ ID NO: 388756 - protein, 8 aa, Mycobacterium
GTLPPGQL

SEQ ID NO: 388757 - protein, 9 aa, Mycobacterium
GTLSEGERK

SEQ ID NO: 388758 - protein, 4 aa, Mycobacterium
GTLT

SEQ ID NO: 388759 - protein, 11 aa, Mycobacterium
GTNGKSTTTRM

SEQ ID NO: 388760 - protein, 8 aa, Mycobacterium
GTNGKTSV

SEQ ID NO: 388761 - protein, 14 aa, Mycobacterium
GTNTSPLAGKVSGH

SEQ ID NO: 388762 - protein, 14 aa, Mycobacterium
GTPAGVGPIEDGDT

SEQ ID NO: 388763 - protein, 4 aa, Mycobacterium
GTPD

SEQ ID NO: 388764 - protein, 4 aa, Mycobacterium
GTPF

SEQ ID NO: 388765 - protein, 8 aa, Mycobacterium
GTPFPTTA

SEQ ID NO: 388766 - protein, 9 aa, Mycobacterium
GTPGESDDD

SEQ ID NO: 388767 - protein, 8 aa, Mycobacterium
GTPGPAEV

SEQ ID NO: 388768 - protein, 7 aa, Mycobacterium
GTPPEAI

SEQ ID NO: 388769 - protein, 5 aa, Mycobacterium
GTPPL

SEQ ID NO: 388770 - protein, 9 aa, Mycobacterium
GTQQPNGYT

SEQ ID NO: 388771 - protein, 4 aa, Mycobacterium
GTRF

SEQ ID NO: 388772 - protein, 9 aa, Mycobacterium
GTRIPTGAT

SEQ ID NO: 388773 - protein, 9 aa, Mycobacterium
GTSGEPKAV

SEQ ID NO: 388774 - protein, 9 aa, Mycobacterium
GTSGNPKAV

SEQ ID NO: 388775 - protein, 4 aa, Mycobacterium
GTSL

SEQ ID NO: 388776 - protein, 4 aa, Mycobacterium
GTTA

SEQ ID NO: 388777 - protein, 4 aa, Mycobacterium
GTTG

SEQ ID NO: 388778 - protein, 6 aa, Mycobacterium
GTTGTL

SEQ ID NO: 388779 - protein, 6 aa, Mycobacterium
GTTLPG

SEQ ID NO: 388780 - protein, 6 aa, Mycobacterium
GTTNGR

SEQ ID NO: 388781 - protein, 9 aa, Mycobacterium
GTTSQPKAV

SEQ ID NO: 388782 - protein, 8 aa, Mycobacterium
GTTTEGDI

SEQ ID NO: 388783 - protein, 4 aa, Mycobacterium
GTVD

SEQ ID NO: 388784 - protein, 5 aa, Mycobacterium
GTVNG

SEQ ID NO: 388785 - protein, 4 aa, Mycobacterium
GTVQ

SEQ ID NO: 388786 - protein, 9 aa, Mycobacterium
GTVTATTSV

SEQ ID NO: 388787 - protein, 5 aa, Mycobacterium
GVAPG

SEQ ID NO: 388788 - protein, 4 aa, Mycobacterium
GVEA

SEQ ID NO: 388789 - protein, 4 aa, Mycobacterium
GVEK

SEQ ID NO: 388790 - protein, 5 aa, Mycobacterium
GVEPV

SEQ ID NO: 388791 - protein, 17 aa, Mycobacterium
GVERKDYNSFGSRRGNH

SEQ ID NO: 388792 - protein, 4 aa, Mycobacterium
GVGK

SEQ ID NO: 388793 - protein, 9 aa, Mycobacterium
GVGKTTTAA

SEQ ID NO: 388794 - protein, 6 aa, Mycobacterium
GVGNDQ

SEQ ID NO: 388795 - protein, 6 aa, Mycobacterium
GVGPTI

SEQ ID NO: 388796 - protein, 7 aa, Mycobacterium
GVGYSGV

SEQ ID NO: 388797 - protein, 5 aa, Mycobacterium
GVIPS

SEQ ID NO: 388798 - protein, 6 aa, Mycobacterium
GVNPRE

SEQ ID NO: 388799 - protein, 7 aa, Mycobacterium
GVPPFGP

SEQ ID NO: 388800 - protein, 7 aa, Mycobacterium
GVPQPET

SEQ ID NO: 388801 - protein, 10 aa, Mycobacterium
GVQGDGRTYG

SEQ ID NO: 388802 - protein, 8 aa, Mycobacterium
GVQTRAPR

SEQ ID NO: 388803 - protein, 15 aa, Mycobacterium
GVRGDGGVLKNSEGK

SEQ ID NO: 388804 - protein, 4 aa, Mycobacterium
GVRP

SEQ ID NO: 388805 - protein, 13 aa, Mycobacterium
GVRPDKSRNHKGS

SEQ ID NO: 388806 - protein, 4 aa, Mycobacterium
GVRT

SEQ ID NO: 388807 - protein, 21 aa, Mycobacterium
GVSQDSKDVTTLGRGGSDTTA

SEQ ID NO: 388808 - protein, 21 aa, Mycobacterium
GVSQDTRDVTTLGRGGSDTTA

SEQ ID NO: 388809 - protein, 8 aa, Mycobacterium
GVTAPAGF

SEQ ID NO: 388810 - protein, 9 aa, Mycobacterium
GVTKQAAQK

SEQ ID NO: 388811 - protein, 4 aa, Mycobacterium
GVTR

SEQ ID NO: 388812 - protein, 5 aa, Mycobacterium
GVTSL

SEQ ID NO: 388813 - protein, 4 aa, Mycobacterium
GWGS

SEQ ID NO: 388814 - protein, 6 aa, Mycobacterium
GYAPGD

SEQ ID NO: 388815 - protein, 6 aa, Mycobacterium
GYDSSG

SEQ ID NO: 388816 - protein, 9 aa, Mycobacterium
GYGYPEAGQ

SEQ ID NO: 388817 - protein, 7 aa, Mycobacterium
GYHRRED

SEQ ID NO: 388818 - protein, 9 aa, Mycobacterium
GYLPDTATA

SEQ ID NO: 388819 - protein, 5 aa, Mycobacterium
GYNGS

SEQ ID NO: 388820 - protein, 7 aa, Mycobacterium
GYPDTDS

SEQ ID NO: 388821 - protein, 5 aa, Mycobacterium
GYPPE

SEQ ID NO: 388822 - protein, 8 aa, Mycobacterium
GYQAGADR

SEQ ID NO: 388823 - protein, 5 aa, Mycobacterium
GYRDT

SEQ ID NO: 388824 - protein, 11 aa, Mycobacterium
GYRPDPATGAV

SEQ ID NO: 388825 - protein, 7 aa, Mycobacterium
GYSEQER

SEQ ID NO: 388826 - protein, 4 aa, Mycobacterium
GYSQ

SEQ ID NO: 388827 - protein, 5 aa, Mycobacterium
GYSRK

SEQ ID NO: 388828 - protein, 6 aa, Mycobacterium
GYTGAG

SEQ ID NO: 388829 - protein, 7 aa, Mycobacterium
GYTGEHG

SEQ ID NO: 388830 - protein, 6 aa, Mycobacterium
GYTKEH

SEQ ID NO: 388831 - protein, 5 aa, Mycobacterium
GYYEQ

SEQ ID NO: 388832 - protein, 6 aa, Mycobacterium
HAAEGF

SEQ ID NO: 388833 - protein, 8 aa, Mycobacterium
HADEEERD

SEQ ID NO: 388834 - protein, 5 aa, Mycobacterium
HADGR

SEQ ID NO: 388835 - protein, 7 aa, Mycobacterium
HAEADRL

SEQ ID NO: 388836 - protein, 6 aa, Mycobacterium
HAEPGT

SEQ ID NO: 388837 - protein, 4 aa, Mycobacterium
HAEY

SEQ ID NO: 388838 - protein, 4 aa, Mycobacterium
HAGD

SEQ ID NO: 388839 - protein, 10 aa, Mycobacterium
HAHGSPGHGA

SEQ ID NO: 388840 - protein, 4 aa, Mycobacterium
HAVT

SEQ ID NO: 388841 - protein, 5 aa, Mycobacterium
HDDDT

SEQ ID NO: 388842 - protein, 4 aa, Mycobacterium
HDDG

SEQ ID NO: 388843 - protein, 5 aa, Mycobacterium
HDEFD

SEQ ID NO: 388844 - protein, 4 aa, Mycobacterium
HDGR

SEQ ID NO: 388845 - protein, 6 aa, Mycobacterium
HDLNDP

SEQ ID NO: 388846 - protein, 6 aa, Mycobacterium
HDMGRD

SEQ ID NO: 388847 - protein, 4 aa, Mycobacterium
HDPA

SEQ ID NO: 388848 - protein, 7 aa, Mycobacterium
HDRSEAK

SEQ ID NO: 388849 - protein, 6 aa, Mycobacterium
HDTPDA

SEQ ID NO: 388850 - protein, 10 aa, Mycobacterium
HEENKKAFAG

SEQ ID NO: 388851 - protein, 14 aa, Mycobacterium
HEGDTAAAVAILET

SEQ ID NO: 388852 - protein, 7 aa, Mycobacterium
HESPVKG

SEQ ID NO: 388853 - protein, 10 aa, Mycobacterium
HETSRAGDPH

SEQ ID NO: 388854 - protein, 5 aa, Mycobacterium
HETTA

SEQ ID NO: 388855 - protein, 6 aa, Mycobacterium
HETTAA

SEQ ID NO: 388856 - protein, 4 aa, Mycobacterium
HGAQ

SEQ ID NO: 388857 - protein, 4 aa, Mycobacterium
HGDS

SEQ ID NO: 388858 - protein, 8 aa, Mycobacterium
HGEPDEEK

SEQ ID NO: 388859 - protein, 4 aa, Mycobacterium
HGGE

SEQ ID NO: 388860 - protein, 21 aa, Mycobacterium
HGGRNAHGRITTRHKGGGHKR

SEQ ID NO: 388861 - protein, 4 aa, Mycobacterium
HGHQ

SEQ ID NO: 388862 - protein, 5 aa, Mycobacterium
HGKPS

SEQ ID NO: 388863 - protein, 5 aa, Mycobacterium
HGLSE

SEQ ID NO: 388864 - protein, 4 aa, Mycobacterium
HGPD

SEQ ID NO: 388865 - protein, 15 aa, Mycobacterium
HGPKPRDYSQRTPKK

SEQ ID NO: 388866 - protein, 7 aa, Mycobacterium
HGPSAVG

SEQ ID NO: 388867 - protein, 4 aa, Mycobacterium
HGRA

SEQ ID NO: 388868 - protein, 5 aa, Mycobacterium
HGRAD

SEQ ID NO: 388869 - protein, 5 aa, Mycobacterium
HGRGG

SEQ ID NO: 388870 - protein, 10 aa, Mycobacterium
HGSEEHQPGW

SEQ ID NO: 388871 - protein, 7 aa, Mycobacterium
HGTPQGA

SEQ ID NO: 388872 - protein, 6 aa, Mycobacterium
HGTTQG

SEQ ID NO: 388873 - protein, 5 aa, Mycobacterium
HGVPT

SEQ ID NO: 388874 - protein, 15 aa, Mycobacterium
HHGAPEKARERARRK

SEQ ID NO: 388875 - protein, 9 aa, Mycobacterium
HHSGHDPDR

SEQ ID NO: 388876 - protein, 8 aa, Mycobacterium
HHTAGGMS

SEQ ID NO: 388877 - protein, 5 aa, Mycobacterium
HIGPS

SEQ ID NO: 388878 - protein, 11 aa, Mycobacterium
HKPTFAPNVDG

SEQ ID NO: 388879 - protein, 11 aa, Mycobacterium
HKPTFTPNVDG

SEQ ID NO: 388880 - protein, 5 aa, Mycobacterium
HLGTR

SEQ ID NO: 388881 - protein, 10 aa, Mycobacterium
HNGASHQDPG

SEQ ID NO: 388882 - protein, 4 aa, Mycobacterium
HPAA

SEQ ID NO: 388883 - protein, 16 aa, Mycobacterium
HPATTTHRAMGPEGRA

SEQ ID NO: 388884 - protein, 4 aa, Mycobacterium
HPAV

SEQ ID NO: 388885 - protein, 4 aa, Mycobacterium
HPDE

SEQ ID NO: 388886 - protein, 4 aa, Mycobacterium
HPDK

SEQ ID NO: 388887 - protein, 5 aa, Mycobacterium
HPDQR

SEQ ID NO: 388888 - protein, 4 aa, Mycobacterium
HPGG

SEQ ID NO: 388889 - protein, 5 aa, Mycobacterium
HPGGG

SEQ ID NO: 388890 - protein, 9 aa, Mycobacterium
HPGPTKTSM

SEQ ID NO: 388891 - protein, 4 aa, Mycobacterium
HPIG

SEQ ID NO: 388892 - protein, 7 aa, Mycobacterium
HPKEDPS

SEQ ID NO: 388893 - protein, 7 aa, Mycobacterium
HPKEEPS

SEQ ID NO: 388894 - protein, 4 aa, Mycobacterium
HPNA

SEQ ID NO: 388895 - protein, 4 aa, Mycobacterium
HPNQ

SEQ ID NO: 388896 - protein, 12 aa, Mycobacterium
HPPGKPERARTE

SEQ ID NO: 388897 - protein, 4 aa, Mycobacterium
HPPS

SEQ ID NO: 388898 - protein, 7 aa, Mycobacterium
HPTETRR

SEQ ID NO: 388899 - protein, 4 aa, Mycobacterium
HPTM

SEQ ID NO: 388900 - protein, 26 aa, Mycobacterium
HPYPPTPWNANPRDSYGTPGPYEDAV

SEQ ID NO: 388901 - protein, 7 aa, Mycobacterium
HQATAAA

SEQ ID NO: 388902 - protein, 6 aa, Mycobacterium
HQGGPL

SEQ ID NO: 388903 - protein, 13 aa, Mycobacterium
HQKAVKDARRGKE

SEQ ID NO: 388904 - protein, 9 aa, Mycobacterium
HQQPDGSVR

SEQ ID NO: 388905 - protein, 8 aa, Mycobacterium
HQSQPIAS

SEQ ID NO: 388906 - protein, 4 aa, Mycobacterium
HRAG

SEQ ID NO: 388907 - protein, 4 aa, Mycobacterium
HRDG

SEQ ID NO: 388908 - protein, 4 aa, Mycobacterium
HRGA

SEQ ID NO: 388909 - protein, 5 aa, Mycobacterium
HRGDG

SEQ ID NO: 388910 - protein, 10 aa, Mycobacterium
HRQRPGTAQG

SEQ ID NO: 388911 - protein, 6 aa, Mycobacterium
HRQRRD

SEQ ID NO: 388912 - protein, 13 aa, Mycobacterium
HRRPGSIGGCATP

SEQ ID NO: 388913 - protein, 15 aa, Mycobacterium
HRRPGSIGGCATPGR

SEQ ID NO: 388914 - protein, 8 aa, Mycobacterium
HRSTEPGH

SEQ ID NO: 388915 - protein, 8 aa, Mycobacterium
HSAGGGLA

SEQ ID NO: 388916 - protein, 8 aa, Mycobacterium
HSATSSLL

SEQ ID NO: 388917 - protein, 12 aa, Mycobacterium
HSETGIDAAGAS

SEQ ID NO: 388918 - protein, 6 aa, Mycobacterium
HSGDPY

SEQ ID NO: 388919 - protein, 4 aa, Mycobacterium
HSGK

SEQ ID NO: 388920 - protein, 9 aa, Mycobacterium
HSGKAEVKG

SEQ ID NO: 388921 - protein, 6 aa, Mycobacterium
HSNETV

SEQ ID NO: 388922 - protein, 6 aa, Mycobacterium
HSNNPE

SEQ ID NO: 388923 - protein, 9 aa, Mycobacterium
HSPDTAGGL

SEQ ID NO: 388924 - protein, 5 aa, Mycobacterium
HSQGE

SEQ ID NO: 388925 - protein, 8 aa, Mycobacterium
HSQSHYAA

SEQ ID NO: 388926 - protein, 4 aa, Mycobacterium
HSQT

SEQ ID NO: 388927 - protein, 14 aa, Mycobacterium
HSRPKVSNDNPYSE

SEQ ID NO: 388928 - protein, 8 aa, Mycobacterium
HSTGGVGD

SEQ ID NO: 388929 - protein, 6 aa, Mycobacterium
HSTQRQ

SEQ ID NO: 388930 - protein, 7 aa, Mycobacterium
HTDSPNL

SEQ ID NO: 388931 - protein, 5 aa, Mycobacterium
HTGCP

SEQ ID NO: 388932 - protein, 4 aa, Mycobacterium
HTGL

SEQ ID NO: 388933 - protein, 14 aa, Mycobacterium
HTGPLRPSETGRPI

SEQ ID NO: 388934 - protein, 9 aa, Mycobacterium
HTKKKEGEI

SEQ ID NO: 388935 - protein, 8 aa, Mycobacterium
HTPGHTRG

SEQ ID NO: 388936 - protein, 16 aa, Mycobacterium
HTPPPNHPTYESTHTK

SEQ ID NO: 388937 - protein, 4 aa, Mycobacterium
HTRG

SEQ ID NO: 388938 - protein, 6 aa, Mycobacterium
HTVEPP

SEQ ID NO: 388939 - protein, 5 aa, Mycobacterium
HYGPT

SEQ ID NO: 388940 - protein, 5 aa, Mycobacterium
HYPED

SEQ ID NO: 388941 - protein, 7 aa, Mycobacterium
IAATEAQ

SEQ ID NO: 388942 - protein, 9 aa, Mycobacterium
IADGQHDDQ

SEQ ID NO: 388943 - protein, 4 aa, Mycobacterium
IAEG

SEQ ID NO: 388944 - protein, 4 aa, Mycobacterium
IANG

SEQ ID NO: 388945 - protein, 8 aa, Mycobacterium
IANGSEPW

SEQ ID NO: 388946 - protein, 7 aa, Mycobacterium
IAPESAC

SEQ ID NO: 388947 - protein, 8 aa, Mycobacterium
IAPRARTA

SEQ ID NO: 388948 - protein, 5 aa, Mycobacterium
IARGR

SEQ ID NO: 388949 - protein, 4 aa, Mycobacterium
IASY

SEQ ID NO: 388950 - protein, 4 aa, Mycobacterium
IATG

SEQ ID NO: 388951 - protein, 4 aa, Mycobacterium
IAVT

SEQ ID NO: 388952 - protein, 8 aa, Mycobacterium
IDAGPTNN

SEQ ID NO: 388953 - protein, 15 aa, Mycobacterium
IDAGSRAGQTSEESE

SEQ ID NO: 388954 - protein, 4 aa, Mycobacterium
IDDA

SEQ ID NO: 388955 - protein, 14 aa, Mycobacterium
IDKEGADPAKIRGQ

SEQ ID NO: 388956 - protein, 9 aa, Mycobacterium
IDKSTEKTL

SEQ ID NO: 388957 - protein, 4 aa, Mycobacterium
IDPE

SEQ ID NO: 388958 - protein, 16 aa, Mycobacterium
IDQKSTNRNPRSTVGT

SEQ ID NO: 388959 - protein, 6 aa, Mycobacterium
IDRPRG

SEQ ID NO: 388960 - protein, 13 aa, Mycobacterium
IDYESAEASFQPS

SEQ ID NO: 388961 - protein, 9 aa, Mycobacterium
IEAAQQTFE

SEQ ID NO: 388962 - protein, 6 aa, Mycobacterium
IEGEMG

SEQ ID NO: 388963 - protein, 6 aa, Mycobacterium
IEGQKT

SEQ ID NO: 388964 - protein, 4 aa, Mycobacterium
IEPQ

SEQ ID NO: 388965 - protein, 7 aa, Mycobacterium
IEPRTGR

SEQ ID NO: 388966 - protein, 4 aa, Mycobacterium
IETE

SEQ ID NO: 388967 - protein, 4 aa, Mycobacterium
IGAD

SEQ ID NO: 388968 - protein, 8 aa, Mycobacterium
IGEPQPEL

SEQ ID NO: 388969 - protein, 5 aa, Mycobacterium
IGETK

SEQ ID NO: 388970 - protein, 6 aa, Mycobacterium
IGGQET

SEQ ID NO: 388971 - protein, 4 aa, Mycobacterium
IGGR

SEQ ID NO: 388972 - protein, 9 aa, Mycobacterium
IGGSDGAGG

SEQ ID NO: 388973 - protein, 7 aa, Mycobacterium
IGGTPEG

SEQ ID NO: 388974 - protein, 4 aa, Mycobacterium
IGND

SEQ ID NO: 388975 - protein, 23 aa, Mycobacterium
IGNGGAGGIGGAGGSGGAGGTGG

SEQ ID NO: 388976 - protein, 11 aa, Mycobacterium
IGNPGDAPGYT

SEQ ID NO: 388977 - protein, 5 aa, Mycobacterium
IGPAA

SEQ ID NO: 388978 - protein, 4 aa, Mycobacterium
IGPD

SEQ ID NO: 388979 - protein, 5 aa, Mycobacterium
IGPGD

SEQ ID NO: 388980 - protein, 5 aa, Mycobacterium
IGPGQ

SEQ ID NO: 388981 - protein, 4 aa, Mycobacterium
IGPH

SEQ ID NO: 388982 - protein, 5 aa, Mycobacterium
IGPPI

SEQ ID NO: 388983 - protein, 8 aa, Mycobacterium
IGRDPKEI

SEQ ID NO: 388984 - protein, 7 aa, Mycobacterium
IGRPGGG

SEQ ID NO: 388985 - protein, 4 aa, Mycobacterium
IGRT

SEQ ID NO: 388986 - protein, 10 aa, Mycobacterium
IGSDGAGSIR

SEQ ID NO: 388987 - protein, 13 aa, Mycobacterium
IGSDTGGSIRQPA

SEQ ID NO: 388988 - protein, 9 aa, Mycobacterium
IGTATPGRV

SEQ ID NO: 388989 - protein, 6 aa, Mycobacterium
IGTPES

SEQ ID NO: 388990 - protein, 11 aa, Mycobacterium
IKPQARTLATD

SEQ ID NO: 388991 - protein, 4 aa, Mycobacterium
IKRR

SEQ ID NO: 388992 - protein, 10 aa, Mycobacterium
INAARTQARQ

SEQ ID NO: 388993 - protein, 5 aa, Mycobacterium
INGSG

SEQ ID NO: 388994 - protein, 13 aa, Mycobacterium
INTANTAVAAPTA

SEQ ID NO: 388995 - protein, 4 aa, Mycobacterium
IPAS

SEQ ID NO: 388996 - protein, 6 aa, Mycobacterium
IPDSGV

SEQ ID NO: 388997 - protein, 6 aa, Mycobacterium
IPEAEK

SEQ ID NO: 388998 - protein, 8 aa, Mycobacterium
IPGAPPGL

SEQ ID NO: 388999 - protein, 9 aa, Mycobacterium
IPGPPIPGE

SEQ ID NO: 389000 - protein, 4 aa, Mycobacterium
IPGT

SEQ ID NO: 389001 - protein, 4 aa, Mycobacterium
IPPA

SEQ ID NO: 389002 - protein, 6 aa, Mycobacterium
IPPGEL

SEQ ID NO: 389003 - protein, 4 aa, Mycobacterium
IPPH

SEQ ID NO: 389004 - protein, 6 aa, Mycobacterium
IPPNGQ

SEQ ID NO: 389005 - protein, 7 aa, Mycobacterium
IPSQQSW

SEQ ID NO: 389006 - protein, 4 aa, Mycobacterium
IPTQ

SEQ ID NO: 389007 - protein, 11 aa, Mycobacterium
IQEGSGLSKEE

SEQ ID NO: 389008 - protein, 11 aa, Mycobacterium
IQGSTKNAERE

SEQ ID NO: 389009 - protein, 7 aa, Mycobacterium
IQHGSPP

SEQ ID NO: 389010 - protein, 5 aa, Mycobacterium
IQPNT

SEQ ID NO: 389011 - protein, 8 aa, Mycobacterium
IQRPDGIR

SEQ ID NO: 389012 - protein, 4 aa, Mycobacterium
IRGG

SEQ ID NO: 389013 - protein, 4 aa, Mycobacterium
IRHP

SEQ ID NO: 389014 - protein, 6 aa, Mycobacterium
IRPSTI

SEQ ID NO: 389015 - protein, 9 aa, Mycobacterium
IRPTDTAGD

SEQ ID NO: 389016 - protein, 10 aa, Mycobacterium
IRRPDGSPGI

SEQ ID NO: 389017 - protein, 11 aa, Mycobacterium
ISGNGKRSTTR

SEQ ID NO: 389018 - protein, 7 aa, Mycobacterium
ISGRPGG

SEQ ID NO: 389019 - protein, 4 aa, Mycobacterium
ISHS

SEQ ID NO: 389020 - protein, 8 aa, Mycobacterium
ISPDSYPT

SEQ ID NO: 389021 - protein, 6 aa, Mycobacterium
ISPGQR

SEQ ID NO: 389022 - protein, 7 aa, Mycobacterium
ISPRRSG

SEQ ID NO: 389023 - protein, 8 aa, Mycobacterium
ISREDQDH

SEQ ID NO: 389024 - protein, 4 aa, Mycobacterium
ISRG

SEQ ID NO: 389025 - protein, 11 aa, Mycobacterium
ITAPNARGERV

SEQ ID NO: 389026 - protein, 10 aa, Mycobacterium
ITEDPTPRGH

SEQ ID NO: 389027 - protein, 5 aa, Mycobacterium
ITERQ

SEQ ID NO: 389028 - protein, 11 aa, Mycobacterium
ITGPNGAGKST

SEQ ID NO: 389029 - protein, 8 aa, Mycobacterium
ITGTDRRG

SEQ ID NO: 389030 - protein, 7 aa, Mycobacterium
ITRTTTK

SEQ ID NO: 389031 - protein, 9 aa, Mycobacterium
ITSAGTAAG

SEQ ID NO: 389032 - protein, 6 aa, Mycobacterium
ITSPID

SEQ ID NO: 389033 - protein, 4 aa, Mycobacterium
IYDA

SEQ ID NO: 389034 - protein, 8 aa, Mycobacterium
IYGGSNEI

SEQ ID NO: 389035 - protein, 5 aa, Mycobacterium
KAAAE

SEQ ID NO: 389036 - protein, 10 aa, Mycobacterium
KAAPAGAGGT

SEQ ID NO: 389037 - protein, 7 aa, Mycobacterium
KAATSAR

SEQ ID NO: 389038 - protein, 5 aa, Mycobacterium
KADTV

SEQ ID NO: 389039 - protein, 5 aa, Mycobacterium
KAEEL

SEQ ID NO: 389040 - protein, 4 aa, Mycobacterium
KAEP

SEQ ID NO: 389041 - protein, 4 aa, Mycobacterium
KAGA

SEQ ID NO: 389042 - protein, 10 aa, Mycobacterium
KAGGAGTHDA

SEQ ID NO: 389043 - protein, 8 aa, Mycobacterium
KAGGPNLD

SEQ ID NO: 389044 - protein, 5 aa, Mycobacterium
KAGLP

SEQ ID NO: 389045 - protein, 7 aa, Mycobacterium
KAGTGGG

SEQ ID NO: 389046 - protein, 9 aa, Mycobacterium
KANSEEMPK

SEQ ID NO: 389047 - protein, 10 aa, Mycobacterium
KAPNAGPSRD

SEQ ID NO: 389048 - protein, 8 aa, Mycobacterium
KAREVRGS

SEQ ID NO: 389049 - protein, 4 aa, Mycobacterium
KARG

SEQ ID NO: 389050 - protein, 9 aa, Mycobacterium
KARGPVSDA

SEQ ID NO: 389051 - protein, 5 aa, Mycobacterium
KARKD

SEQ ID NO: 389052 - protein, 9 aa, Mycobacterium
KARRNEAAS

SEQ ID NO: 389053 - protein, 10 aa, Mycobacterium
KARRNEAQSA

SEQ ID NO: 389054 - protein, 5 aa, Mycobacterium
KATPL

SEQ ID NO: 389055 - protein, 9 aa, Mycobacterium
KATVEGRPK

SEQ ID NO: 389056 - protein, 7 aa, Mycobacterium
KAVRGDG

SEQ ID NO: 389057 - protein, 6 aa, Mycobacterium
KCGRPR

SEQ ID NO: 389058 - protein, 4 aa, Mycobacterium
KDAG

SEQ ID NO: 389059 - protein, 10 aa, Mycobacterium
KDEKKTAETF

SEQ ID NO: 389060 - protein, 7 aa, Mycobacterium
KDGGSVD

SEQ ID NO: 389061 - protein, 6 aa, Mycobacterium
KDLTEG

SEQ ID NO: 389062 - protein, 7 aa, Mycobacterium
KDPERAA

SEQ ID NO: 389063 - protein, 6 aa, Mycobacterium
KDPRMK

SEQ ID NO: 389064 - protein, 12 aa, Mycobacterium
KDPVGHKGARLT

SEQ ID NO: 389065 - protein, 13 aa, Mycobacterium
KDPVGHKGARLTT

SEQ ID NO: 389066 - protein, 7 aa, Mycobacterium
KDRHGEP

SEQ ID NO: 389067 - protein, 6 aa, Mycobacterium
KDRHGR

SEQ ID NO: 389068 - protein, 4 aa, Mycobacterium
KEGL

SEQ ID NO: 389069 - protein, 6 aa, Mycobacterium
KEGTYA

SEQ ID NO: 389070 - protein, 8 aa, Mycobacterium
KEHPATPM

SEQ ID NO: 389071 - protein, 8 aa, Mycobacterium
KENAELRR

SEQ ID NO: 389072 - protein, 9 aa, Mycobacterium
KERPETAAD

SEQ ID NO: 389073 - protein, 8 aa, Mycobacterium
KERRGEYL

SEQ ID NO: 389074 - protein, 6 aa, Mycobacterium
KESTRQ

SEQ ID NO: 389075 - protein, 5 aa, Mycobacterium
KEVGP

SEQ ID NO: 389076 - protein, 16 aa, Mycobacterium
KEYGSGSSRDWAAKGT

SEQ ID NO: 389077 - protein, 7 aa, Mycobacterium
KGAVADA

SEQ ID NO: 389078 - protein, 8 aa, Mycobacterium
KGDVGEDI

SEQ ID NO: 389079 - protein, 5 aa, Mycobacterium
KGGAM

SEQ ID NO: 389080 - protein, 7 aa, Mycobacterium
KGHQGAA

SEQ ID NO: 389081 - protein, 4 aa, Mycobacterium
KGIA

SEQ ID NO: 389082 - protein, 8 aa, Mycobacterium
KGKRSATI

SEQ ID NO: 389083 - protein, 6 aa, Mycobacterium
KGTDLS

SEQ ID NO: 389084 - protein, 5 aa, Mycobacterium
KGTRL

SEQ ID NO: 389085 - protein, 4 aa, Mycobacterium
KGVA

SEQ ID NO: 389086 - protein, 6 aa, Mycobacterium
KGVEKD

SEQ ID NO: 389087 - protein, 4 aa, Mycobacterium
KGVR

SEQ ID NO: 389088 - protein, 4 aa, Mycobacterium
KGYD

SEQ ID NO: 389089 - protein, 6 aa, Mycobacterium
KIDGDA

SEQ ID NO: 389090 - protein, 6 aa, Mycobacterium
KIRTGT

SEQ ID NO: 389091 - protein, 5 aa, Mycobacterium
KITPA

SEQ ID NO: 389092 - protein, 6 aa, Mycobacterium
KITPRE

SEQ ID NO: 389093 - protein, 8 aa, Mycobacterium
KKAAAGEI

SEQ ID NO: 389094 - protein, 6 aa, Mycobacterium
KKNKSV

SEQ ID NO: 389095 - protein, 13 aa, Mycobacterium
KKQAQESVAAEAT

SEQ ID NO: 389096 - protein, 13 aa, Mycobacterium
KKRGKNGKVGPPV

SEQ ID NO: 389097 - protein, 6 aa, Mycobacterium
KKRLGY

SEQ ID NO: 389098 - protein, 9 aa, Mycobacterium
KKSARGEYE

SEQ ID NO: 389099 - protein, 9 aa, Mycobacterium
KKSIGPDKV

SEQ ID NO: 389100 - protein, 6 aa, Mycobacterium
KKSVGQ

SEQ ID NO: 389101 - protein, 11 aa, Mycobacterium
KLGTRSVASGE

SEQ ID NO: 389102 - protein, 5 aa, Mycobacterium
KLNGL

SEQ ID NO: 389103 - protein, 4 aa, Mycobacterium
KLPN

SEQ ID NO: 389104 - protein, 8 aa, Mycobacterium
KLSGRGAQ

SEQ ID NO: 389105 - protein, 8 aa, Mycobacterium
KLTDAPRY

SEQ ID NO: 389106 - protein, 8 aa, Mycobacterium
KNAGPGGT

SEQ ID NO: 389107 - protein, 7 aa, Mycobacterium
KNAPATN

SEQ ID NO: 389108 - protein, 7 aa, Mycobacterium
KNDAEEA

SEQ ID NO: 389109 - protein, 7 aa, Mycobacterium
KNFAGDG

SEQ ID NO: 389110 - protein, 7 aa, Mycobacterium
KNFASDG

SEQ ID NO: 389111 - protein, 9 aa, Mycobacterium
KNGDSRVPT

SEQ ID NO: 389112 - protein, 8 aa, Mycobacterium
KNGPHPKN

SEQ ID NO: 389113 - protein, 5 aa, Mycobacterium
KNGPY

SEQ ID NO: 389114 - protein, 6 aa, Mycobacterium
KNGSYS

SEQ ID NO: 389115 - protein, 11 aa, Mycobacterium
KNLSDAERDGL

SEQ ID NO: 389116 - protein, 8 aa, Mycobacterium
KNPESQAQ

SEQ ID NO: 389117 - protein, 4 aa, Mycobacterium
KNPK

SEQ ID NO: 389118 - protein, 6 aa, Mycobacterium
KNREAG

SEQ ID NO: 389119 - protein, 6 aa, Mycobacterium
KPERQR

SEQ ID NO: 389120 - protein, 7 aa, Mycobacterium
KPERQRG

SEQ ID NO: 389121 - protein, 7 aa, Mycobacterium
KPESVDT

SEQ ID NO: 389122 - protein, 6 aa, Mycobacterium
KPFSPR

SEQ ID NO: 389123 - protein, 4 aa, Mycobacterium
KPGE

SEQ ID NO: 389124 - protein, 6 aa, Mycobacterium
KPPAFE

SEQ ID NO: 389125 - protein, 7 aa, Mycobacterium
KPPEGMT

SEQ ID NO: 389126 - protein, 7 aa, Mycobacterium
KPRPARP

SEQ ID NO: 389127 - protein, 5 aa, Mycobacterium
KPTVR

SEQ ID NO: 389128 - protein, 5 aa, Mycobacterium
KPYRA

SEQ ID NO: 389129 - protein, 5 aa, Mycobacterium
KQAGS

SEQ ID NO: 389130 - protein, 7 aa, Mycobacterium
KQGLDGM

SEQ ID NO: 389131 - protein, 5 aa, Mycobacterium
KQKAR

SEQ ID NO: 389132 - protein, 6 aa, Mycobacterium
KQLEED

SEQ ID NO: 389133 - protein, 6 aa, Mycobacterium
KQRGHK

SEQ ID NO: 389134 - protein, 8 aa, Mycobacterium
KRAAAAQR

SEQ ID NO: 389135 - protein, 4 aa, Mycobacterium
KRAG

SEQ ID NO: 389136 - protein, 20 aa, Mycobacterium
KRASPSAGSLATIADPAKLA

SEQ ID NO: 389137 - protein, 11 aa, Mycobacterium
KRDPYGRTARQ

SEQ ID NO: 389138 - protein, 6 aa, Mycobacterium
KREPGQ

SEQ ID NO: 389139 - protein, 8 aa, Mycobacterium
KRLGADKG

SEQ ID NO: 389140 - protein, 13 aa, Mycobacterium
KRLGARTTGYDVR

SEQ ID NO: 389141 - protein, 4 aa, Mycobacterium
KRPE

SEQ ID NO: 389142 - protein, 8 aa, Mycobacterium
KRPRGSQL

SEQ ID NO: 389143 - protein, 7 aa, Mycobacterium
KRRPEAS

SEQ ID NO: 389144 - protein, 8 aa, Mycobacterium
KRSGYGRE

SEQ ID NO: 389145 - protein, 10 aa, Mycobacterium
KRSPAGKPDY

SEQ ID NO: 389146 - protein, 11 aa, Mycobacterium
KRSPAGKPDYR

SEQ ID NO: 389147 - protein, 8 aa, Mycobacterium
KRTAQKVA

SEQ ID NO: 389148 - protein, 8 aa, Mycobacterium
KRTLQDNG

SEQ ID NO: 389149 - protein, 7 aa, Mycobacterium
KRTPRLA

SEQ ID NO: 389150 - protein, 7 aa, Mycobacterium
KSAHPSA

SEQ ID NO: 389151 - protein, 10 aa, Mycobacterium
KSAQTQVEQQ

SEQ ID NO: 389152 - protein, 6 aa, Mycobacterium
KSATGL

SEQ ID NO: 389153 - protein, 6 aa, Mycobacterium
KSAVMG

SEQ ID NO: 389154 - protein, 7 aa, Mycobacterium
KSCPSSA

SEQ ID NO: 389155 - protein, 9 aa, Mycobacterium
KSDMSTLTR

SEQ ID NO: 389156 - protein, 7 aa, Mycobacterium
KSKDYDD

SEQ ID NO: 389157 - protein, 6 aa, Mycobacterium
KSPAGA

SEQ ID NO: 389158 - protein, 7 aa, Mycobacterium
KSPEMTA

SEQ ID NO: 389159 - protein, 9 aa, Mycobacterium
KSQGSQADE

SEQ ID NO: 389160 - protein, 13 aa, Mycobacterium
KSRFTQGSSLADK

SEQ ID NO: 389161 - protein, 14 aa, Mycobacterium
KSRHRDRVKPAPLR

SEQ ID NO: 389162 - protein, 6 aa, Mycobacterium
KSRRPI

SEQ ID NO: 389163 - protein, 6 aa, Mycobacterium
KSRSLK

SEQ ID NO: 389164 - protein, 20 aa, Mycobacterium
KSRTVNDTPTEQEATPAALP

SEQ ID NO: 389165 - protein, 8 aa, Mycobacterium
KSRVQGAD

SEQ ID NO: 389166 - protein, 5 aa, Mycobacterium
KSSAG

SEQ ID NO: 389167 - protein, 4 aa, Mycobacterium
KSSD

SEQ ID NO: 389168 - protein, 6 aa, Mycobacterium
KSYGGA

SEQ ID NO: 389169 - protein, 4 aa, Mycobacterium
KTAG

SEQ ID NO: 389170 - protein, 7 aa, Mycobacterium
KTAVSSS

SEQ ID NO: 389171 - protein, 8 aa, Mycobacterium
KTEAEGEP

SEQ ID NO: 389172 - protein, 18 aa, Mycobacterium
KTESGSPIPSYDAAREEI

SEQ ID NO: 389173 - protein, 7 aa, Mycobacterium
KTGKPGH

SEQ ID NO: 389174 - protein, 5 aa, Mycobacterium
KTGQH

SEQ ID NO: 389175 - protein, 4 aa, Mycobacterium
KTGV

SEQ ID NO: 389176 - protein, 6 aa, Mycobacterium
KTGYTT

SEQ ID NO: 389177 - protein, 8 aa, Mycobacterium
KTHDVNST

SEQ ID NO: 389178 - protein, 4 aa, Mycobacterium
KTLI

SEQ ID NO: 389179 - protein, 5 aa, Mycobacterium
KTNIG

SEQ ID NO: 389180 - protein, 9 aa, Mycobacterium
KTNTPRNFA

SEQ ID NO: 389181 - protein, 6 aa, Mycobacterium
KTPEGY

SEQ ID NO: 389182 - protein, 5 aa, Mycobacterium
KTPEQ

SEQ ID NO: 389183 - protein, 5 aa, Mycobacterium
KTTSV

SEQ ID NO: 389184 - protein, 8 aa, Mycobacterium
KTVAPGPL

SEQ ID NO: 389185 - protein, 6 aa, Mycobacterium
KVAPAT

SEQ ID NO: 389186 - protein, 10 aa, Mycobacterium
KVDAKQPGDY

SEQ ID NO: 389187 - protein, 15 aa, Mycobacterium
KVGEAPKQSGVALPG

SEQ ID NO: 389188 - protein, 6 aa, Mycobacterium
KVPGRT

SEQ ID NO: 389189 - protein, 5 aa, Mycobacterium
KVPPA

SEQ ID NO: 389190 - protein, 5 aa, Mycobacterium
KVRSG

SEQ ID NO: 389191 - protein, 4 aa, Mycobacterium
KVTE

SEQ ID NO: 389192 - protein, 8 aa, Mycobacterium
KVVPKGAA

SEQ ID NO: 389193 - protein, 5 aa, Mycobacterium
KYDGR

SEQ ID NO: 389194 - protein, 6 aa, Mycobacterium
KYGNER

SEQ ID NO: 389195 - protein, 4 aa, Mycobacterium
KYPD

SEQ ID NO: 389196 - protein, 12 aa, Mycobacterium
LAADGKTKEDFG

SEQ ID NO: 389197 - protein, 4 aa, Mycobacterium
LADP

SEQ ID NO: 389198 - protein, 5 aa, Mycobacterium
LADPD

SEQ ID NO: 389199 - protein, 4 aa, Mycobacterium
LAED

SEQ ID NO: 389200 - protein, 4 aa, Mycobacterium
LAEG

SEQ ID NO: 389201 - protein, 6 aa, Mycobacterium
LAEGAG

SEQ ID NO: 389202 - protein, 6 aa, Mycobacterium
LAEGPV

SEQ ID NO: 389203 - protein, 4 aa, Mycobacterium
LAEQ

SEQ ID NO: 389204 - protein, 5 aa, Mycobacterium
LAERA

SEQ ID NO: 389205 - protein, 5 aa, Mycobacterium
LAGAP

SEQ ID NO: 389206 - protein, 13 aa, Mycobacterium
LAGPKGRHDQART

SEQ ID NO: 389207 - protein, 5 aa, Mycobacterium
LAGPN

SEQ ID NO: 389208 - protein, 4 aa, Mycobacterium
LAGQ

SEQ ID NO: 389209 - protein, 4 aa, Mycobacterium
LAGR

SEQ ID NO: 389210 - protein, 6 aa, Mycobacterium
LAGTGT

SEQ ID NO: 389211 - protein, 11 aa, Mycobacterium
LANATKTVPQL

SEQ ID NO: 389212 - protein, 8 aa, Mycobacterium
LANGATAE

SEQ ID NO: 389213 - protein, 6 aa, Mycobacterium
LAPADA

SEQ ID NO: 389214 - protein, 8 aa, Mycobacterium
LAPGPHET

SEQ ID NO: 389215 - protein, 6 aa, Mycobacterium
LAPHGL

SEQ ID NO: 389216 - protein, 14 aa, Mycobacterium
LAPRRGQSFDSGVT

SEQ ID NO: 389217 - protein, 12 aa, Mycobacterium
LAQANNRLATTE

SEQ ID NO: 389218 - protein, 13 aa, Mycobacterium
LAQHGDQRRSTTR

SEQ ID NO: 389219 - protein, 9 aa, Mycobacterium
LAQPPPGSI

SEQ ID NO: 389220 - protein, 7 aa, Mycobacterium
LAQTPDT

SEQ ID NO: 389221 - protein, 5 aa, Mycobacterium
LARGQ

SEQ ID NO: 389222 - protein, 4 aa, Mycobacterium
LART

SEQ ID NO: 389223 - protein, 4 aa, Mycobacterium
LASE

SEQ ID NO: 389224 - protein, 6 aa, Mycobacterium
LASSST

SEQ ID NO: 389225 - protein, 7 aa, Mycobacterium
LASSSTI

SEQ ID NO: 389226 - protein, 8 aa, Mycobacterium
LDAGDQAG

SEQ ID NO: 389227 - protein, 6 aa, Mycobacterium
LDDSQP

SEQ ID NO: 389228 - protein, 6 aa, Mycobacterium
LDDTGT

SEQ ID NO: 389229 - protein, 4 aa, Mycobacterium
LDGA

SEQ ID NO: 389230 - protein, 4 aa, Mycobacterium
LDGD

SEQ ID NO: 389231 - protein, 4 aa, Mycobacterium
LDGP

SEQ ID NO: 389232 - protein, 8 aa, Mycobacterium
LDGPPDGI

SEQ ID NO: 389233 - protein, 5 aa, Mycobacterium
LDGQD

SEQ ID NO: 389234 - protein, 10 aa, Mycobacterium
LDGRPTDLPG

SEQ ID NO: 389235 - protein, 15 aa, Mycobacterium
LDGSPAGGGSAAQGV

SEQ ID NO: 389236 - protein, 5 aa, Mycobacterium
LDGTL

SEQ ID NO: 389237 - protein, 5 aa, Mycobacterium
LDHPD

SEQ ID NO: 389238 - protein, 5 aa, Mycobacterium
LDPDE

SEQ ID NO: 389239 - protein, 9 aa, Mycobacterium
LDPGTGPGH

SEQ ID NO: 389240 - protein, 4 aa, Mycobacterium
LDPH

SEQ ID NO: 389241 - protein, 5 aa, Mycobacterium
LDPST

SEQ ID NO: 389242 - protein, 4 aa, Mycobacterium
LDPT

SEQ ID NO: 389243 - protein, 13 aa, Mycobacterium
LDPTGYLNAAVLF

SEQ ID NO: 389244 - protein, 11 aa, Mycobacterium
LDQSGPTVSQT

SEQ ID NO: 389245 - protein, 9 aa, Mycobacterium
LDRDGRGDV

SEQ ID NO: 389246 - protein, 9 aa, Mycobacterium
LDRTSTGAG

SEQ ID NO: 389247 - protein, 4 aa, Mycobacterium
LDSR

SEQ ID NO: 389248 - protein, 6 aa, Mycobacterium
LDTPKA

SEQ ID NO: 389249 - protein, 5 aa, Mycobacterium
LEAEG

SEQ ID NO: 389250 - protein, 4 aa, Mycobacterium
LEAG

SEQ ID NO: 389251 - protein, 5 aa, Mycobacterium
LEAPE

SEQ ID NO: 389252 - protein, 7 aa, Mycobacterium
LEEGGAM

SEQ ID NO: 389253 - protein, 6 aa, Mycobacterium
LEERAE

SEQ ID NO: 389254 - protein, 4 aa, Mycobacterium
LEGA

SEQ ID NO: 389255 - protein, 4 aa, Mycobacterium
LEGE

SEQ ID NO: 389256 - protein, 7 aa, Mycobacterium
LEGEMGD

SEQ ID NO: 389257 - protein, 5 aa, Mycobacterium
LEGQG

SEQ ID NO: 389258 - protein, 7 aa, Mycobacterium
LELGPSG

SEQ ID NO: 389259 - protein, 4 aa, Mycobacterium
LENP

SEQ ID NO: 389260 - protein, 8 aa, Mycobacterium
LENPGPDD

SEQ ID NO: 389261 - protein, 16 aa, Mycobacterium
LEPGGRPDAPEPGPSM

SEQ ID NO: 389262 - protein, 5 aa, Mycobacterium
LEQPH

SEQ ID NO: 389263 - protein, 6 aa, Mycobacterium
LETTHE

SEQ ID NO: 389264 - protein, 4 aa, Mycobacterium
LGAS

SEQ ID NO: 389265 - protein, 4 aa, Mycobacterium
LGDE

SEQ ID NO: 389266 - protein, 4 aa, Mycobacterium
LGDP

SEQ ID NO: 389267 - protein, 5 aa, Mycobacterium
LGEKD

SEQ ID NO: 389268 - protein, 4 aa, Mycobacterium
LGEN

SEQ ID NO: 389269 - protein, 5 aa, Mycobacterium
LGEPG

SEQ ID NO: 389270 - protein, 4 aa, Mycobacterium
LGGA

SEQ ID NO: 389271 - protein, 10 aa, Mycobacterium
LGGAGGELAD

SEQ ID NO: 389272 - protein, 6 aa, Mycobacterium
LGGDDF

SEQ ID NO: 389273 - protein, 7 aa, Mycobacterium
LGGDSLS

SEQ ID NO: 389274 - protein, 4 aa, Mycobacterium
LGGH

SEQ ID NO: 389275 - protein, 7 aa, Mycobacterium
LGGPGYG

SEQ ID NO: 389276 - protein, 5 aa, Mycobacterium
LGHTG

SEQ ID NO: 389277 - protein, 8 aa, Mycobacterium
LGNGKADY

SEQ ID NO: 389278 - protein, 15 aa, Mycobacterium
LGNHANASSEVEYDG

SEQ ID NO: 389279 - protein, 8 aa, Mycobacterium
LGPAATLA

SEQ ID NO: 389280 - protein, 6 aa, Mycobacterium
LGPEDC

SEQ ID NO: 389281 - protein, 5 aa, Mycobacterium
LGPEY

SEQ ID NO: 389282 - protein, 5 aa, Mycobacterium
LGPGH

SEQ ID NO: 389283 - protein, 4 aa, Mycobacterium
LGPK

SEQ ID NO: 389284 - protein, 4 aa, Mycobacterium
LGPN

SEQ ID NO: 389285 - protein, 10 aa, Mycobacterium
LGRAPTATEL

SEQ ID NO: 389286 - protein, 4 aa, Mycobacterium
LGRG

SEQ ID NO: 389287 - protein, 5 aa, Mycobacterium
LGRPH

SEQ ID NO: 389288 - protein, 6 aa, Mycobacterium
LGRQRD

SEQ ID NO: 389289 - protein, 4 aa, Mycobacterium
LGRR

SEQ ID NO: 389290 - protein, 18 aa, Mycobacterium
LGSEQTAAAEGKVGTVRR

SEQ ID NO: 389291 - protein, 6 aa, Mycobacterium
LGSGGL

SEQ ID NO: 389292 - protein, 8 aa, Mycobacterium
LGSPPKDV

SEQ ID NO: 389293 - protein, 4 aa, Mycobacterium
LGSR

SEQ ID NO: 389294 - protein, 4 aa, Mycobacterium
LGST

SEQ ID NO: 389295 - protein, 9 aa, Mycobacterium
LGSTSRAPR

SEQ ID NO: 389296 - protein, 4 aa, Mycobacterium
LGTS

SEQ ID NO: 389297 - protein, 11 aa, Mycobacterium
LGTSGGLRTDE

SEQ ID NO: 389298 - protein, 6 aa, Mycobacterium
LGTTDQ

SEQ ID NO: 389299 - protein, 4 aa, Mycobacterium
LGVD

SEQ ID NO: 389300 - protein, 5 aa, Mycobacterium
LGVDT

SEQ ID NO: 389301 - protein, 10 aa, Mycobacterium
LGVNPTNDGT

SEQ ID NO: 389302 - protein, 14 aa, Mycobacterium
LGVRGPDRDRGGFD

SEQ ID NO: 389303 - protein, 5 aa, Mycobacterium
LKAGQ

SEQ ID NO: 389304 - protein, 12 aa, Mycobacterium
LKDGTDAVGNRT

SEQ ID NO: 389305 - protein, 12 aa, Mycobacterium
LKDGTNAVGNRT

SEQ ID NO: 389306 - protein, 12 aa, Mycobacterium
LKGEGGSSWGNQ

SEQ ID NO: 389307 - protein, 6 aa, Mycobacterium
LKQKRS

SEQ ID NO: 389308 - protein, 7 aa, Mycobacterium
LKSASDL

SEQ ID NO: 389309 - protein, 10 aa, Mycobacterium
LKVPSDEVPA

SEQ ID NO: 389310 - protein, 6 aa, Mycobacterium
LNNTRE

SEQ ID NO: 389311 - protein, 5 aa, Mycobacterium
LNPAQ

SEQ ID NO: 389312 - protein, 7 aa, Mycobacterium
LNPQQRQ

SEQ ID NO: 389313 - protein, 7 aa, Mycobacterium
LNPRTRE

SEQ ID NO: 389314 - protein, 5 aa, Mycobacterium
LNQAE

SEQ ID NO: 389315 - protein, 7 aa, Mycobacterium
LNSGSGN

SEQ ID NO: 389316 - protein, 8 aa, Mycobacterium
LNSGSGNI

SEQ ID NO: 389317 - protein, 7 aa, Mycobacterium
LPADGTR

SEQ ID NO: 389318 - protein, 5 aa, Mycobacterium
LPAGT

SEQ ID NO: 389319 - protein, 6 aa, Mycobacterium
LPAKAR

SEQ ID NO: 389320 - protein, 4 aa, Mycobacterium
LPAP

SEQ ID NO: 389321 - protein, 4 aa, Mycobacterium
LPAR

SEQ ID NO: 389322 - protein, 9 aa, Mycobacterium
LPASAESSA

SEQ ID NO: 389323 - protein, 5 aa, Mycobacterium
LPDAE

SEQ ID NO: 389324 - protein, 6 aa, Mycobacterium
LPDAGS

SEQ ID NO: 389325 - protein, 5 aa, Mycobacterium
LPDGA

SEQ ID NO: 389326 - protein, 5 aa, Mycobacterium
LPDGG

SEQ ID NO: 389327 - protein, 6 aa, Mycobacterium
LPDGGT

SEQ ID NO: 389328 - protein, 5 aa, Mycobacterium
LPDGT

SEQ ID NO: 389329 - protein, 5 aa, Mycobacterium
LPDPR

SEQ ID NO: 389330 - protein, 5 aa, Mycobacterium
LPDPV

SEQ ID NO: 389331 - protein, 4 aa, Mycobacterium
LPDS

SEQ ID NO: 389332 - protein, 5 aa, Mycobacterium
LPEAK

SEQ ID NO: 389333 - protein, 5 aa, Mycobacterium
LPEAQ

SEQ ID NO: 389334 - protein, 12 aa, Mycobacterium
LPEDVNAPSGEA

SEQ ID NO: 389335 - protein, 5 aa, Mycobacterium
LPEGG

SEQ ID NO: 389336 - protein, 4 aa, Mycobacterium
LPEP

SEQ ID NO: 389337 - protein, 5 aa, Mycobacterium
LPEPK

SEQ ID NO: 389338 - protein, 8 aa, Mycobacterium
LPEPPLPG

SEQ ID NO: 389339 - protein, 4 aa, Mycobacterium
LPES

SEQ ID NO: 389340 - protein, 10 aa, Mycobacterium
LPGAASTNIE

SEQ ID NO: 389341 - protein, 9 aa, Mycobacterium
LPGARERLR

SEQ ID NO: 389342 - protein, 5 aa, Mycobacterium
LPGNG

SEQ ID NO: 389343 - protein, 16 aa, Mycobacterium
LPGQGEAGLRGAPSGD

SEQ ID NO: 389344 - protein, 5 aa, Mycobacterium
LPGTQ

SEQ ID NO: 389345 - protein, 4 aa, Mycobacterium
LPKR

SEQ ID NO: 389346 - protein, 6 aa, Mycobacterium
LPPAGK

SEQ ID NO: 389347 - protein, 5 aa, Mycobacterium
LPPAT

SEQ ID NO: 389348 - protein, 5 aa, Mycobacterium
LPPDH

SEQ ID NO: 389349 - protein, 6 aa, Mycobacterium
LPPDPH

SEQ ID NO: 389350 - protein, 5 aa, Mycobacterium
LPPEL

SEQ ID NO: 389351 - protein, 7 aa, Mycobacterium
LPPGHPE

SEQ ID NO: 389352 - protein, 5 aa, Mycobacterium
LPPGS

SEQ ID NO: 389353 - protein, 5 aa, Mycobacterium
LPPGV

SEQ ID NO: 389354 - protein, 7 aa, Mycobacterium
LPPPDAR

SEQ ID NO: 389355 - protein, 5 aa, Mycobacterium
LPPQA

SEQ ID NO: 389356 - protein, 5 aa, Mycobacterium
LPPQR

SEQ ID NO: 389357 - protein, 6 aa, Mycobacterium
LPPRER

SEQ ID NO: 389358 - protein, 6 aa, Mycobacterium
LPPSDR

SEQ ID NO: 389359 - protein, 10 aa, Mycobacterium
LPPSSWGSGK

SEQ ID NO: 389360 - protein, 6 aa, Mycobacterium
LPPSVS

SEQ ID NO: 389361 - protein, 9 aa, Mycobacterium
LPRGRQPIT

SEQ ID NO: 389362 - protein, 8 aa, Mycobacterium
LPRNAGGK

SEQ ID NO: 389363 - protein, 5 aa, Mycobacterium
LPRPE

SEQ ID NO: 389364 - protein, 4 aa, Mycobacterium
LPRR

SEQ ID NO: 389365 - protein, 8 aa, Mycobacterium
LPRTDTGK

SEQ ID NO: 389366 - protein, 4 aa, Mycobacterium
LPSN

SEQ ID NO: 389367 - protein, 8 aa, Mycobacterium
LPTPSGNT

SEQ ID NO: 389368 - protein, 6 aa, Mycobacterium
LPTRED

SEQ ID NO: 389369 - protein, 6 aa, Mycobacterium
LPTRPA

SEQ ID NO: 389370 - protein, 4 aa, Mycobacterium
LPTT

SEQ ID NO: 389371 - protein, 4 aa, Mycobacterium
LPYD

SEQ ID NO: 389372 - protein, 4 aa, Mycobacterium
LQAG

SEQ ID NO: 389373 - protein, 4 aa, Mycobacterium
LQAP

SEQ ID NO: 389374 - protein, 5 aa, Mycobacterium
LQDPV

SEQ ID NO: 389375 - protein, 4 aa, Mycobacterium
LQGK

SEQ ID NO: 389376 - protein, 5 aa, Mycobacterium
LQGNN

SEQ ID NO: 389377 - protein, 10 aa, Mycobacterium
LQGTTGGERD

SEQ ID NO: 389378 - protein, 7 aa, Mycobacterium
LQKAGYG

SEQ ID NO: 389379 - protein, 6 aa, Mycobacterium
LQNESS

SEQ ID NO: 389380 - protein, 12 aa, Mycobacterium
LQRAQETAAPIA

SEQ ID NO: 389381 - protein, 4 aa, Mycobacterium
LQRG

SEQ ID NO: 389382 - protein, 10 aa, Mycobacterium
LQRSSRDVTT

SEQ ID NO: 389383 - protein, 4 aa, Mycobacterium
LQSA

SEQ ID NO: 389384 - protein, 4 aa, Mycobacterium
LRAG

SEQ ID NO: 389385 - protein, 5 aa, Mycobacterium
LRATG

SEQ ID NO: 389386 - protein, 4 aa, Mycobacterium
LRDA

SEQ ID NO: 389387 - protein, 12 aa, Mycobacterium
LREGEDEDLERA

SEQ ID NO: 389388 - protein, 11 aa, Mycobacterium
LRGKSPYGAPQ

SEQ ID NO: 389389 - protein, 4 aa, Mycobacterium
LRGS

SEQ ID NO: 389390 - protein, 9 aa, Mycobacterium
LRGTSVNQV

SEQ ID NO: 389391 - protein, 5 aa, Mycobacterium
LRKGQ

SEQ ID NO: 389392 - protein, 6 aa, Mycobacterium
LRNYPD

SEQ ID NO: 389393 - protein, 5 aa, Mycobacterium
LRPAD

SEQ ID NO: 389394 - protein, 5 aa, Mycobacterium
LRPDD

SEQ ID NO: 389395 - protein, 9 aa, Mycobacterium
LRPEGRNGP

SEQ ID NO: 389396 - protein, 4 aa, Mycobacterium
LRPG

SEQ ID NO: 389397 - protein, 12 aa, Mycobacterium
LRPKDYSEARTI

SEQ ID NO: 389398 - protein, 5 aa, Mycobacterium
LRQED

SEQ ID NO: 389399 - protein, 4 aa, Mycobacterium
LRQT

SEQ ID NO: 389400 - protein, 4 aa, Mycobacterium
LRSG

SEQ ID NO: 389401 - protein, 5 aa, Mycobacterium
LRSRS

SEQ ID NO: 389402 - protein, 5 aa, Mycobacterium
LSADG

SEQ ID NO: 389403 - protein, 5 aa, Mycobacterium
LSAEQ

SEQ ID NO: 389404 - protein, 4 aa, Mycobacterium
LSAG

SEQ ID NO: 389405 - protein, 8 aa, Mycobacterium
LSAPGSRL

SEQ ID NO: 389406 - protein, 9 aa, Mycobacterium
LSAPGSRLA

SEQ ID NO: 389407 - protein, 8 aa, Mycobacterium
LSAPGSRV

SEQ ID NO: 389408 - protein, 4 aa, Mycobacterium
LSDA

SEQ ID NO: 389409 - protein, 8 aa, Mycobacterium
LSDGSERE

SEQ ID NO: 389410 - protein, 5 aa, Mycobacterium
LSEDK

SEQ ID NO: 389411 - protein, 9 aa, Mycobacterium
LSEGTIKGD

SEQ ID NO: 389412 - protein, 6 aa, Mycobacterium
LSESER

SEQ ID NO: 389413 - protein, 4 aa, Mycobacterium
LSGE

SEQ ID NO: 389414 - protein, 8 aa, Mycobacterium
LSGGEQQR

SEQ ID NO: 389415 - protein, 7 aa, Mycobacterium
LSGGERR

SEQ ID NO: 389416 - protein, 8 aa, Mycobacterium
LSGGGTEV

SEQ ID NO: 389417 - protein, 8 aa, Mycobacterium
LSGGQRQR

SEQ ID NO: 389418 - protein, 6 aa, Mycobacterium
LSGQGG

SEQ ID NO: 389419 - protein, 7 aa, Mycobacterium
LSGRTDT

SEQ ID NO: 389420 - protein, 4 aa, Mycobacterium
LSND

SEQ ID NO: 389421 - protein, 7 aa, Mycobacterium
LSNQKHN

SEQ ID NO: 389422 - protein, 9 aa, Mycobacterium
LSPDGARAQ

SEQ ID NO: 389423 - protein, 4 aa, Mycobacterium
LSPE

SEQ ID NO: 389424 - protein, 5 aa, Mycobacterium
LSPGI

SEQ ID NO: 389425 - protein, 6 aa, Mycobacterium
LSPKDI

SEQ ID NO: 389426 - protein, 4 aa, Mycobacterium
LSPR

SEQ ID NO: 389427 - protein, 6 aa, Mycobacterium
LSPRAA

SEQ ID NO: 389428 - protein, 4 aa, Mycobacterium
LSPT

SEQ ID NO: 389429 - protein, 10 aa, Mycobacterium
LSQSYPGATM

SEQ ID NO: 389430 - protein, 6 aa, Mycobacterium
LSRRGR

SEQ ID NO: 389431 - protein, 4 aa, Mycobacterium
LSSP

SEQ ID NO: 389432 - protein, 4 aa, Mycobacterium
LSTA

SEQ ID NO: 389433 - protein, 4 aa, Mycobacterium
LSTP

SEQ ID NO: 389434 - protein, 4 aa, Mycobacterium
LSTS

SEQ ID NO: 389435 - protein, 6 aa, Mycobacterium
LSTYPG

SEQ ID NO: 389436 - protein, 4 aa, Mycobacterium
LTAD

SEQ ID NO: 389437 - protein, 4 aa, Mycobacterium
LTAN

SEQ ID NO: 389438 - protein, 4 aa, Mycobacterium
LTDA

SEQ ID NO: 389439 - protein, 4 aa, Mycobacterium
LTDD

SEQ ID NO: 389440 - protein, 6 aa, Mycobacterium
LTDGDT

SEQ ID NO: 389441 - protein, 5 aa, Mycobacterium
LTDNA

SEQ ID NO: 389442 - protein, 7 aa, Mycobacterium
LTDTNNG

SEQ ID NO: 389443 - protein, 9 aa, Mycobacterium
LTEDATADR

SEQ ID NO: 389444 - protein, 10 aa, Mycobacterium
LTEDPTPRGH

SEQ ID NO: 389445 - protein, 4 aa, Mycobacterium
LTEG

SEQ ID NO: 389446 - protein, 9 aa, Mycobacterium
LTENDPAKL

SEQ ID NO: 389447 - protein, 9 aa, Mycobacterium
LTEPGRSSA

SEQ ID NO: 389448 - protein, 26 aa, Mycobacterium
LTERGATRADDRISEAGMEDRKRQGY

SEQ ID NO: 389449 - protein, 4 aa, Mycobacterium
LTET

SEQ ID NO: 389450 - protein, 5 aa, Mycobacterium
LTGEG

SEQ ID NO: 389451 - protein, 10 aa, Mycobacterium
LTNMRSSTAD

SEQ ID NO: 389452 - protein, 4 aa, Mycobacterium
LTNR

SEQ ID NO: 389453 - protein, 4 aa, Mycobacterium
LTPA

SEQ ID NO: 389454 - protein, 6 aa, Mycobacterium
LTPADY

SEQ ID NO: 389455 - protein, 7 aa, Mycobacterium
LTPDDDQ

SEQ ID NO: 389456 - protein, 18 aa, Mycobacterium
LTPGEYTQLTGRAGRRGI

SEQ ID NO: 389457 - protein, 4 aa, Mycobacterium
LTPR

SEQ ID NO: 389458 - protein, 4 aa, Mycobacterium
LTRR

SEQ ID NO: 389459 - protein, 5 aa, Mycobacterium
LTRSG

SEQ ID NO: 389460 - protein, 4 aa, Mycobacterium
LTSG

SEQ ID NO: 389461 - protein, 6 aa, Mycobacterium
LTSGSK

SEQ ID NO: 389462 - protein, 7 aa, Mycobacterium
LTSGYSP

SEQ ID NO: 389463 - protein, 5 aa, Mycobacterium
LTSSD

SEQ ID NO: 389464 - protein, 5 aa, Mycobacterium
LTTPE

SEQ ID NO: 389465 - protein, 6 aa, Mycobacterium
LTTRTE

SEQ ID NO: 389466 - protein, 13 aa, Mycobacterium
LVGSPGQGAYAAA

SEQ ID NO: 389467 - protein, 8 aa, Mycobacterium
LVPGPVAT

SEQ ID NO: 389468 - protein, 12 aa, Mycobacterium
LVSGSDAKESRG

SEQ ID NO: 389469 - protein, 6 aa, Mycobacterium
LYPANS

SEQ ID NO: 389470 - protein, 5 aa, Mycobacterium
LYPGA

SEQ ID NO: 389471 - protein, 8 aa, Mycobacterium
MADEGRND

SEQ ID NO: 389472 - protein, 10 aa, Mycobacterium
MAGGPGTPAL

SEQ ID NO: 389473 - protein, 9 aa, Mycobacterium
MAGKAGTFN

SEQ ID NO: 389474 - protein, 4 aa, Mycobacterium
MEPT

SEQ ID NO: 389475 - protein, 12 aa, Mycobacterium
MEQTGGFEGRTK

SEQ ID NO: 389476 - protein, 9 aa, Mycobacterium
MGPPADPEC

SEQ ID NO: 389477 - protein, 4 aa, Mycobacterium
MGRG

SEQ ID NO: 389478 - protein, 10 aa, Mycobacterium
MGSKRSTERM

SEQ ID NO: 389479 - protein, 7 aa, Mycobacterium
MKDDPEM

SEQ ID NO: 389480 - protein, 10 aa, Mycobacterium
MKPEAQAAKD

SEQ ID NO: 389481 - protein, 6 aa, Mycobacterium
MNPNGG

SEQ ID NO: 389482 - protein, 7 aa, Mycobacterium
MPDNATD

SEQ ID NO: 389483 - protein, 11 aa, Mycobacterium
MPGANAPSVAE

SEQ ID NO: 389484 - protein, 14 aa, Mycobacterium
MPGPNRHRPIPWPA

SEQ ID NO: 389485 - protein, 9 aa, Mycobacterium
MPPEADHDV

SEQ ID NO: 389486 - protein, 4 aa, Mycobacterium
MPPS

SEQ ID NO: 389487 - protein, 7 aa, Mycobacterium
MPVNTDG

SEQ ID NO: 389488 - protein, 8 aa, Mycobacterium
MRATGSND

SEQ ID NO: 389489 - protein, 12 aa, Mycobacterium
MRDGDDEDLERA

SEQ ID NO: 389490 - protein, 11 aa, Mycobacterium
MRGEGSPAPIW

SEQ ID NO: 389491 - protein, 4 aa, Mycobacterium
MRPG

SEQ ID NO: 389492 - protein, 11 aa, Mycobacterium
MSAGDDAQAAA

SEQ ID NO: 389493 - protein, 12 aa, Mycobacterium
MSEPGAGSDLAS

SEQ ID NO: 389494 - protein, 7 aa, Mycobacterium
MSGYAGT

SEQ ID NO: 389495 - protein, 6 aa, Mycobacterium
MSPARK

SEQ ID NO: 389496 - protein, 7 aa, Mycobacterium
MSPEFGS

SEQ ID NO: 389497 - protein, 5 aa, Mycobacterium
MSPQG

SEQ ID NO: 389498 - protein, 4 aa, Mycobacterium
MSPV

SEQ ID NO: 389499 - protein, 9 aa, Mycobacterium
MSRPDGERV

SEQ ID NO: 389500 - protein, 11 aa, Mycobacterium
MSSAGDKDAEL

SEQ ID NO: 389501 - protein, 6 aa, Mycobacterium
MTDDQR

SEQ ID NO: 389502 - protein, 5 aa, Mycobacterium
MTDGA

SEQ ID NO: 389503 - protein, 4 aa, Mycobacterium
MTDP

SEQ ID NO: 389504 - protein, 5 aa, Mycobacterium
MTPEA

SEQ ID NO: 389505 - protein, 9 aa, Mycobacterium
MTQRRDEPA

SEQ ID NO: 389506 - protein, 13 aa, Mycobacterium
MYETGAGGSAPKH

SEQ ID NO: 389507 - protein, 4 aa, Mycobacterium
NAAA

SEQ ID NO: 389508 - protein, 5 aa, Mycobacterium
NAAAR

SEQ ID NO: 389509 - protein, 9 aa, Mycobacterium
NADETPPHT

SEQ ID NO: 389510 - protein, 4 aa, Mycobacterium
NAEN

SEQ ID NO: 389511 - protein, 8 aa, Mycobacterium
NAFSTDAR

SEQ ID NO: 389512 - protein, 12 aa, Mycobacterium
NAGDGTHEHPTQ

SEQ ID NO: 389513 - protein, 9 aa, Mycobacterium
NAGGGETKS

SEQ ID NO: 389514 - protein, 9 aa, Mycobacterium
NAGTGGVSE

SEQ ID NO: 389515 - protein, 25 aa, Mycobacterium
NAHGQKVQSAGSNMASTDSAVGSSW

SEQ ID NO: 389516 - protein, 4 aa, Mycobacterium
NAIN

SEQ ID NO: 389517 - protein, 6 aa, Mycobacterium
NAIPQT

SEQ ID NO: 389518 - protein, 8 aa, Mycobacterium
NAKSPQAQ

SEQ ID NO: 389519 - protein, 7 aa, Mycobacterium
NANPSAR

SEQ ID NO: 389520 - protein, 4 aa, Mycobacterium
NAPA

SEQ ID NO: 389521 - protein, 7 aa, Mycobacterium
NARDRTM

SEQ ID NO: 389522 - protein, 10 aa, Mycobacterium
NARKAGTTVS

SEQ ID NO: 389523 - protein, 4 aa, Mycobacterium
NARN

SEQ ID NO: 389524 - protein, 6 aa, Mycobacterium
NARTTL

SEQ ID NO: 389525 - protein, 7 aa, Mycobacterium
NATQEST

SEQ ID NO: 389526 - protein, 12 aa, Mycobacterium
NAVPNDPRPPMV

SEQ ID NO: 389527 - protein, 12 aa, Mycobacterium
NAVQAGSLNRPG

SEQ ID NO: 389528 - protein, 6 aa, Mycobacterium
NAYGEA

SEQ ID NO: 389529 - protein, 7 aa, Mycobacterium
NCDPDEV

SEQ ID NO: 389530 - protein, 4 aa, Mycobacterium
NDEV

SEQ ID NO: 389531 - protein, 11 aa, Mycobacterium
NDGAPEGQRVN

SEQ ID NO: 389532 - protein, 4 aa, Mycobacterium
NDGS

SEQ ID NO: 389533 - protein, 4 aa, Mycobacterium
NDPE

SEQ ID NO: 389534 - protein, 13 aa, Mycobacterium
NDPRTLDERRNDA

SEQ ID NO: 389535 - protein, 5 aa, Mycobacterium
NDPSA

SEQ ID NO: 389536 - protein, 6 aa, Mycobacterium
NDSANN

SEQ ID NO: 389537 - protein, 7 aa, Mycobacterium
NDSPYGL

SEQ ID NO: 389538 - protein, 6 aa, Mycobacterium
NDTEYG

SEQ ID NO: 389539 - protein, 10 aa, Mycobacterium
NDTTRNSMSG

SEQ ID NO: 389540 - protein, 5 aa, Mycobacterium
NEAED

SEQ ID NO: 389541 - protein, 5 aa, Mycobacterium
NEDGR

SEQ ID NO: 389542 - protein, 9 aa, Mycobacterium
NEDGSNITK

SEQ ID NO: 389543 - protein, 5 aa, Mycobacterium
NEDSR

SEQ ID NO: 389544 - protein, 11 aa, Mycobacterium
NEGADSTHSPE

SEQ ID NO: 389545 - protein, 4 aa, Mycobacterium
NEGL

SEQ ID NO: 389546 - protein, 6 aa, Mycobacterium
NEIPSR

SEQ ID NO: 389547 - protein, 8 aa, Mycobacterium
NEKSQLQN

SEQ ID NO: 389548 - protein, 5 aa, Mycobacterium
NEPGL

SEQ ID NO: 389549 - protein, 9 aa, Mycobacterium
NEPGLSGAE

SEQ ID NO: 389550 - protein, 6 aa, Mycobacterium
NERGFS

SEQ ID NO: 389551 - protein, 6 aa, Mycobacterium
NESDAA

SEQ ID NO: 389552 - protein, 10 aa, Mycobacterium
NFKTRGGLTT

SEQ ID NO: 389553 - protein, 4 aa, Mycobacterium
NFPD

SEQ ID NO: 389554 - protein, 7 aa, Mycobacterium
NGAGKTT

SEQ ID NO: 389555 - protein, 17 aa, Mycobacterium
NGANGAPGTGANGGDGG

SEQ ID NO: 389556 - protein, 5 aa, Mycobacterium
NGDVD

SEQ ID NO: 389557 - protein, 5 aa, Mycobacterium
NGEGE

SEQ ID NO: 389558 - protein, 6 aa, Mycobacterium
NGFGKT

SEQ ID NO: 389559 - protein, 6 aa, Mycobacterium
NGGVPK

SEQ ID NO: 389560 - protein, 4 aa, Mycobacterium
NGIG

SEQ ID NO: 389561 - protein, 9 aa, Mycobacterium
NGKGAFTHT

SEQ ID NO: 389562 - protein, 6 aa, Mycobacterium
NGLDPE

SEQ ID NO: 389563 - protein, 6 aa, Mycobacterium
NGQAGV

SEQ ID NO: 389564 - protein, 4 aa, Mycobacterium
NGQL

SEQ ID NO: 389565 - protein, 5 aa, Mycobacterium
NGREA

SEQ ID NO: 389566 - protein, 5 aa, Mycobacterium
NGRGA

SEQ ID NO: 389567 - protein, 11 aa, Mycobacterium
NGRPDGDVTPY

SEQ ID NO: 389568 - protein, 8 aa, Mycobacterium
NGRRSAES

SEQ ID NO: 389569 - protein, 10 aa, Mycobacterium
NGRSYAPTIG

SEQ ID NO: 389570 - protein, 10 aa, Mycobacterium
NGSEPVSPAS

SEQ ID NO: 389571 - protein, 7 aa, Mycobacterium
NGSPRAL

SEQ ID NO: 389572 - protein, 8 aa, Mycobacterium
NGTIGEGG

SEQ ID NO: 389573 - protein, 5 aa, Mycobacterium
NGTKR

SEQ ID NO: 389574 - protein, 12 aa, Mycobacterium
NGWPTTDPDDHA

SEQ ID NO: 389575 - protein, 7 aa, Mycobacterium
NHDERNE

SEQ ID NO: 389576 - protein, 7 aa, Mycobacterium
NHPGRTK

SEQ ID NO: 389577 - protein, 4 aa, Mycobacterium
NHRP

SEQ ID NO: 389578 - protein, 4 aa, Mycobacterium
NIGG

SEQ ID NO: 389579 - protein, 13 aa, Mycobacterium
NIGHTESASGAAG

SEQ ID NO: 389580 - protein, 4 aa, Mycobacterium
NIGR

SEQ ID NO: 389581 - protein, 10 aa, Mycobacterium
NIPPSGIETP

SEQ ID NO: 389582 - protein, 11 aa, Mycobacterium
NKENPVETASA

SEQ ID NO: 389583 - protein, 5 aa, Mycobacterium
NKRSV

SEQ ID NO: 389584 - protein, 4 aa, Mycobacterium
NLDH

SEQ ID NO: 389585 - protein, 5 aa, Mycobacterium
NLGDA

SEQ ID NO: 389586 - protein, 6 aa, Mycobacterium
NLGDTV

SEQ ID NO: 389587 - protein, 13 aa, Mycobacterium
NLNPSQAHGSGDV

SEQ ID NO: 389588 - protein, 7 aa, Mycobacterium
NLPETTS

SEQ ID NO: 389589 - protein, 17 aa, Mycobacterium
NNKSPSRKTGELDNRGS

SEQ ID NO: 389590 - protein, 8 aa, Mycobacterium
NNKSVAEL

SEQ ID NO: 389591 - protein, 7 aa, Mycobacterium
NNRPLGD

SEQ ID NO: 389592 - protein, 7 aa, Mycobacterium
NNSGVRD

SEQ ID NO: 389593 - protein, 7 aa, Mycobacterium
NNSSRSL

SEQ ID NO: 389594 - protein, 13 aa, Mycobacterium
NNTASASGLGAGN

SEQ ID NO: 389595 - protein, 5 aa, Mycobacterium
NNTPF

SEQ ID NO: 389596 - protein, 9 aa, Mycobacterium
NNTSTASAL

SEQ ID NO: 389597 - protein, 8 aa, Mycobacterium
NPAASQGS

SEQ ID NO: 389598 - protein, 4 aa, Mycobacterium
NPAD

SEQ ID NO: 389599 - protein, 4 aa, Mycobacterium
NPAL

SEQ ID NO: 389600 - protein, 4 aa, Mycobacterium
NPAR

SEQ ID NO: 389601 - protein, 9 aa, Mycobacterium
NPATSGVDM

SEQ ID NO: 389602 - protein, 5 aa, Mycobacterium
NPEAT

SEQ ID NO: 389603 - protein, 8 aa, Mycobacterium
NPEATAEA

SEQ ID NO: 389604 - protein, 5 aa, Mycobacterium
NPEWQ

SEQ ID NO: 389605 - protein, 5 aa, Mycobacterium
NPFPT

SEQ ID NO: 389606 - protein, 5 aa, Mycobacterium
NPGYQ

SEQ ID NO: 389607 - protein, 8 aa, Mycobacterium
NPHTKPPD

SEQ ID NO: 389608 - protein, 6 aa, Mycobacterium
NPIPKL

SEQ ID NO: 389609 - protein, 8 aa, Mycobacterium
NPLESDEL

SEQ ID NO: 389610 - protein, 7 aa, Mycobacterium
NPNDDGL

SEQ ID NO: 389611 - protein, 7 aa, Mycobacterium
NPQLPTV

SEQ ID NO: 389612 - protein, 11 aa, Mycobacterium
NPRPTNPEGKM

SEQ ID NO: 389613 - protein, 10 aa, Mycobacterium
NPRRARPENL

SEQ ID NO: 389614 - protein, 6 aa, Mycobacterium
NPSPHI

SEQ ID NO: 389615 - protein, 8 aa, Mycobacterium
NPTRSRTH

SEQ ID NO: 389616 - protein, 5 aa, Mycobacterium
NPTSI

SEQ ID NO: 389617 - protein, 6 aa, Mycobacterium
NPTTGG

SEQ ID NO: 389618 - protein, 12 aa, Mycobacterium
NPTTSPFGNPIP

SEQ ID NO: 389619 - protein, 4 aa, Mycobacterium
NPVV

SEQ ID NO: 389620 - protein, 5 aa, Mycobacterium
NQHAR

SEQ ID NO: 389621 - protein, 12 aa, Mycobacterium
NQKGGVGKTTTA

SEQ ID NO: 389622 - protein, 4 aa, Mycobacterium
NQLR

SEQ ID NO: 389623 - protein, 9 aa, Mycobacterium
NRANPIDGK

SEQ ID NO: 389624 - protein, 4 aa, Mycobacterium
NRER

SEQ ID NO: 389625 - protein, 10 aa, Mycobacterium
NRGGENVSSV

SEQ ID NO: 389626 - protein, 7 aa, Mycobacterium
NRGTLGG

SEQ ID NO: 389627 - protein, 7 aa, Mycobacterium
NRKARHN

SEQ ID NO: 389628 - protein, 19 aa, Mycobacterium
NRKESRGGHAREDYPNRDD

SEQ ID NO: 389629 - protein, 21 aa, Mycobacterium
NRKESRGGHAREDYPNRDDTN

SEQ ID NO: 389630 - protein, 8 aa, Mycobacterium
NRKGDNAP

SEQ ID NO: 389631 - protein, 4 aa, Mycobacterium
NRKN

SEQ ID NO: 389632 - protein, 8 aa, Mycobacterium
NRPEKGNA

SEQ ID NO: 389633 - protein, 5 aa, Mycobacterium
NRRRA

SEQ ID NO: 389634 - protein, 6 aa, Mycobacterium
NRSRDL

SEQ ID NO: 389635 - protein, 8 aa, Mycobacterium
NRYSVPPE

SEQ ID NO: 389636 - protein, 5 aa, Mycobacterium
NSGRL

SEQ ID NO: 389637 - protein, 7 aa, Mycobacterium
NSGSGNV

SEQ ID NO: 389638 - protein, 17 aa, Mycobacterium
NSGTGSSSGFGNVGGGS

SEQ ID NO: 389639 - protein, 9 aa, Mycobacterium
NSGTNNTGI

SEQ ID NO: 389640 - protein, 4 aa, Mycobacterium
NSHG

SEQ ID NO: 389641 - protein, 7 aa, Mycobacterium
NSPGSAV

SEQ ID NO: 389642 - protein, 12 aa, Mycobacterium
NSRPERRDPPTR

SEQ ID NO: 389643 - protein, 9 aa, Mycobacterium
NSTAGGAYI

SEQ ID NO: 389644 - protein, 6 aa, Mycobacterium
NSTRGA

SEQ ID NO: 389645 - protein, 5 aa, Mycobacterium
NSTVP

SEQ ID NO: 389646 - protein, 5 aa, Mycobacterium
NSTWG

SEQ ID NO: 389647 - protein, 9 aa, Mycobacterium
NSVTPPGQM

SEQ ID NO: 389648 - protein, 4 aa, Mycobacterium
NSYV

SEQ ID NO: 389649 - protein, 10 aa, Mycobacterium
NTAAQKVRSG

SEQ ID NO: 389650 - protein, 6 aa, Mycobacterium
NTEARL

SEQ ID NO: 389651 - protein, 6 aa, Mycobacterium
NTGLGH

SEQ ID NO: 389652 - protein, 7 aa, Mycobacterium
NTGSNNI

SEQ ID NO: 389653 - protein, 7 aa, Mycobacterium
NTHPTGP

SEQ ID NO: 389654 - protein, 5 aa, Mycobacterium
NTHTV

SEQ ID NO: 389655 - protein, 6 aa, Mycobacterium
NTIRAH

SEQ ID NO: 389656 - protein, 6 aa, Mycobacterium
NTRSYG

SEQ ID NO: 389657 - protein, 9 aa, Mycobacterium
NTSAVDSRR

SEQ ID NO: 389658 - protein, 6 aa, Mycobacterium
NTSEDR

SEQ ID NO: 389659 - protein, 7 aa, Mycobacterium
NTSGALQ

SEQ ID NO: 389660 - protein, 23 aa, Mycobacterium
NTSSGAGLQGSVGQGNYSAAKAG

SEQ ID NO: 389661 - protein, 8 aa, Mycobacterium
NVAEGGRP

SEQ ID NO: 389662 - protein, 7 aa, Mycobacterium
NVATTQV

SEQ ID NO: 389663 - protein, 12 aa, Mycobacterium
NVDGKGASYGSH

SEQ ID NO: 389664 - protein, 12 aa, Mycobacterium
NVPGPRERGRVG

SEQ ID NO: 389665 - protein, 11 aa, Mycobacterium
NVREGEAGGIT

SEQ ID NO: 389666 - protein, 5 aa, Mycobacterium
NVVAS

SEQ ID NO: 389667 - protein, 4 aa, Mycobacterium
NYGK

SEQ ID NO: 389668 - protein, 5 aa, Mycobacterium
NYPDG

SEQ ID NO: 389669 - protein, 8 aa, Mycobacterium
NYPGRPRV

SEQ ID NO: 389670 - protein, 4 aa, Mycobacterium
PAAD

SEQ ID NO: 389671 - protein, 9 aa, Mycobacterium
PAAGEHGGQ

SEQ ID NO: 389672 - protein, 5 aa, Mycobacterium
PAAGL

SEQ ID NO: 389673 - protein, 4 aa, Mycobacterium
PAAI

SEQ ID NO: 389674 - protein, 4 aa, Mycobacterium
PAAL

SEQ ID NO: 389675 - protein, 4 aa, Mycobacterium
PAAP

SEQ ID NO: 389676 - protein, 5 aa, Mycobacterium
PAAVA

SEQ ID NO: 389677 - protein, 4 aa, Mycobacterium
PAAY

SEQ ID NO: 389678 - protein, 4 aa, Mycobacterium
PACP

SEQ ID NO: 389679 - protein, 4 aa, Mycobacterium
PADA

SEQ ID NO: 389680 - protein, 9 aa, Mycobacterium
PADEHRRAS

SEQ ID NO: 389681 - protein, 8 aa, Mycobacterium
PADGPIGD

SEQ ID NO: 389682 - protein, 9 aa, Mycobacterium
PADGPIGDS

SEQ ID NO: 389683 - protein, 4 aa, Mycobacterium
PADI

SEQ ID NO: 389684 - protein, 6 aa, Mycobacterium
PADLER

SEQ ID NO: 389685 - protein, 12 aa, Mycobacterium
PADPDAKPRPLA

SEQ ID NO: 389686 - protein, 4 aa, Mycobacterium
PADQ

SEQ ID NO: 389687 - protein, 7 aa, Mycobacterium
PAEAEAE

SEQ ID NO: 389688 - protein, 4 aa, Mycobacterium
PAEG

SEQ ID NO: 389689 - protein, 7 aa, Mycobacterium
PAEQTPV

SEQ ID NO: 389690 - protein, 4 aa, Mycobacterium
PAFK

SEQ ID NO: 389691 - protein, 6 aa, Mycobacterium
PAGGNR

SEQ ID NO: 389692 - protein, 5 aa, Mycobacterium
PAGGR

SEQ ID NO: 389693 - protein, 4 aa, Mycobacterium
PAGI

SEQ ID NO: 389694 - protein, 4 aa, Mycobacterium
PAGL

SEQ ID NO: 389695 - protein, 6 aa, Mycobacterium
PAGMTS

SEQ ID NO: 389696 - protein, 15 aa, Mycobacterium
PAGQSWAATAGSGDV

SEQ ID NO: 389697 - protein, 5 aa, Mycobacterium
PAGSF

SEQ ID NO: 389698 - protein, 7 aa, Mycobacterium
PAGTGKT

SEQ ID NO: 389699 - protein, 4 aa, Mycobacterium
PAGV

SEQ ID NO: 389700 - protein, 6 aa, Mycobacterium
PAHPDE

SEQ ID NO: 389701 - protein, 4 aa, Mycobacterium
PAID

SEQ ID NO: 389702 - protein, 4 aa, Mycobacterium
PAIT

SEQ ID NO: 389703 - protein, 15 aa, Mycobacterium
PAPARRTGGHPAKRT

SEQ ID NO: 389704 - protein, 6 aa, Mycobacterium
PAPDTP

SEQ ID NO: 389705 - protein, 5 aa, Mycobacterium
PAPEG

SEQ ID NO: 389706 - protein, 9 aa, Mycobacterium
PAPNSVVPS

SEQ ID NO: 389707 - protein, 7 aa, Mycobacterium
PAPPPRE

SEQ ID NO: 389708 - protein, 18 aa, Mycobacterium
PAPQYGATGSYRAPASPV

SEQ ID NO: 389709 - protein, 4 aa, Mycobacterium
PAPV

SEQ ID NO: 389710 - protein, 4 aa, Mycobacterium
PARD

SEQ ID NO: 389711 - protein, 4 aa, Mycobacterium
PARE

SEQ ID NO: 389712 - protein, 9 aa, Mycobacterium
PARGGSSIG

SEQ ID NO: 389713 - protein, 7 aa, Mycobacterium
PARIDTP

SEQ ID NO: 389714 - protein, 7 aa, Mycobacterium
PARRTRM

SEQ ID NO: 389715 - protein, 4 aa, Mycobacterium
PART

SEQ ID NO: 389716 - protein, 4 aa, Mycobacterium
PASA

SEQ ID NO: 389717 - protein, 5 aa, Mycobacterium
PASPH

SEQ ID NO: 389718 - protein, 4 aa, Mycobacterium
PATK

SEQ ID NO: 389719 - protein, 4 aa, Mycobacterium
PATL

SEQ ID NO: 389720 - protein, 6 aa, Mycobacterium
PATLPK

SEQ ID NO: 389721 - protein, 7 aa, Mycobacterium
PATPTTA

SEQ ID NO: 389722 - protein, 4 aa, Mycobacterium
PATT

SEQ ID NO: 389723 - protein, 4 aa, Mycobacterium
PAVA

SEQ ID NO: 389724 - protein, 4 aa, Mycobacterium
PAVG

SEQ ID NO: 389725 - protein, 8 aa, Mycobacterium
PAYQGQGI

SEQ ID NO: 389726 - protein, 6 aa, Mycobacterium
PAYRSS

SEQ ID NO: 389727 - protein, 9 aa, Mycobacterium
PDAAPGTSP

SEQ ID NO: 389728 - protein, 4 aa, Mycobacterium
PDAI

SEQ ID NO: 389729 - protein, 11 aa, Mycobacterium
PDAKPAATGLE

SEQ ID NO: 389730 - protein, 12 aa, Mycobacterium
PDANRLGPEGGG

SEQ ID NO: 389731 - protein, 4 aa, Mycobacterium
PDAQ

SEQ ID NO: 389732 - protein, 7 aa, Mycobacterium
PDAVDST

SEQ ID NO: 389733 - protein, 14 aa, Mycobacterium
PDDADSEPSPPLAK

SEQ ID NO: 389734 - protein, 13 aa, Mycobacterium
PDDARRAKDGGVD

SEQ ID NO: 389735 - protein, 4 aa, Mycobacterium
PDDD

SEQ ID NO: 389736 - protein, 8 aa, Mycobacterium
PDDGSEEV

SEQ ID NO: 389737 - protein, 4 aa, Mycobacterium
PDDL

SEQ ID NO: 389738 - protein, 4 aa, Mycobacterium
PDDN

SEQ ID NO: 389739 - protein, 8 aa, Mycobacterium
PDERTGER

SEQ ID NO: 389740 - protein, 4 aa, Mycobacterium
PDET

SEQ ID NO: 389741 - protein, 4 aa, Mycobacterium
PDEV

SEQ ID NO: 389742 - protein, 9 aa, Mycobacterium
PDGASASID

SEQ ID NO: 389743 - protein, 7 aa, Mycobacterium
PDGGASA

SEQ ID NO: 389744 - protein, 7 aa, Mycobacterium
PDGHTED

SEQ ID NO: 389745 - protein, 12 aa, Mycobacterium
PDGPDLRVQPGD

SEQ ID NO: 389746 - protein, 9 aa, Mycobacterium
PDGSPSWAD

SEQ ID NO: 389747 - protein, 10 aa, Mycobacterium
PDGSPSWADP

SEQ ID NO: 389748 - protein, 5 aa, Mycobacterium
PDGTR

SEQ ID NO: 389749 - protein, 4 aa, Mycobacterium
PDHP

SEQ ID NO: 389750 - protein, 4 aa, Mycobacterium
PDHT

SEQ ID NO: 389751 - protein, 11 aa, Mycobacterium
PDLARRGRGTP

SEQ ID NO: 389752 - protein, 4 aa, Mycobacterium
PDPD

SEQ ID NO: 389753 - protein, 5 aa, Mycobacterium
PDPGM

SEQ ID NO: 389754 - protein, 8 aa, Mycobacterium
PDPGPGEA

SEQ ID NO: 389755 - protein, 8 aa, Mycobacterium
PDPGTDPV

SEQ ID NO: 389756 - protein, 8 aa, Mycobacterium
PDPTEGVK

SEQ ID NO: 389757 - protein, 4 aa, Mycobacterium
PDPV

SEQ ID NO: 389758 - protein, 4 aa, Mycobacterium
PDPY

SEQ ID NO: 389759 - protein, 13 aa, Mycobacterium
PDQGRPLEVGEPA

SEQ ID NO: 389760 - protein, 7 aa, Mycobacterium
PDQLASV

SEQ ID NO: 389761 - protein, 7 aa, Mycobacterium
PDQRPPV

SEQ ID NO: 389762 - protein, 4 aa, Mycobacterium
PDVN

SEQ ID NO: 389763 - protein, 5 aa, Mycobacterium
PDVPE

SEQ ID NO: 389764 - protein, 10 aa, Mycobacterium
PDYPEEGALR

SEQ ID NO: 389765 - protein, 4 aa, Mycobacterium
PEAG

SEQ ID NO: 389766 - protein, 4 aa, Mycobacterium
PEAQ

SEQ ID NO: 389767 - protein, 4 aa, Mycobacterium
PEAR

SEQ ID NO: 389768 - protein, 4 aa, Mycobacterium
PEAT

SEQ ID NO: 389769 - protein, 4 aa, Mycobacterium
PEDD

SEQ ID NO: 389770 - protein, 5 aa, Mycobacterium
PEDEQ

SEQ ID NO: 389771 - protein, 9 aa, Mycobacterium
PEDGGGIPW

SEQ ID NO: 389772 - protein, 4 aa, Mycobacterium
PEER

SEQ ID NO: 389773 - protein, 6 aa, Mycobacterium
PEGLES

SEQ ID NO: 389774 - protein, 12 aa, Mycobacterium
PEGPEGKPDPIA

SEQ ID NO: 389775 - protein, 4 aa, Mycobacterium
PEGR

SEQ ID NO: 389776 - protein, 4 aa, Mycobacterium
PEKL

SEQ ID NO: 389777 - protein, 6 aa, Mycobacterium
PEKPGL

SEQ ID NO: 389778 - protein, 4 aa, Mycobacterium
PEMA

SEQ ID NO: 389779 - protein, 4 aa, Mycobacterium
PEPI

SEQ ID NO: 389780 - protein, 4 aa, Mycobacterium
PEPL

SEQ ID NO: 389781 - protein, 8 aa, Mycobacterium
PEPTGLDA

SEQ ID NO: 389782 - protein, 5 aa, Mycobacterium
PEQRR

SEQ ID NO: 389783 - protein, 4 aa, Mycobacterium
PERL

SEQ ID NO: 389784 - protein, 4 aa, Mycobacterium
PERM

SEQ ID NO: 389785 - protein, 8 aa, Mycobacterium
PERSEGDA

SEQ ID NO: 389786 - protein, 4 aa, Mycobacterium
PERT

SEQ ID NO: 389787 - protein, 4 aa, Mycobacterium
PERV

SEQ ID NO: 389788 - protein, 4 aa, Mycobacterium
PESA

SEQ ID NO: 389789 - protein, 20 aa, Mycobacterium
PESGTPAAVGYAQESGIPYG

SEQ ID NO: 389790 - protein, 4 aa, Mycobacterium
PESV

SEQ ID NO: 389791 - protein, 5 aa, Mycobacterium
PESVP

SEQ ID NO: 389792 - protein, 4 aa, Mycobacterium
PETA

SEQ ID NO: 389793 - protein, 5 aa, Mycobacterium
PETGE

SEQ ID NO: 389794 - protein, 6 aa, Mycobacterium
PETGER

SEQ ID NO: 389795 - protein, 4 aa, Mycobacterium
PETR

SEQ ID NO: 389796 - protein, 4 aa, Mycobacterium
PEVA

SEQ ID NO: 389797 - protein, 4 aa, Mycobacterium
PEVN

SEQ ID NO: 389798 - protein, 4 aa, Mycobacterium
PEWQ

SEQ ID NO: 389799 - protein, 4 aa, Mycobacterium
PEWY

SEQ ID NO: 389800 - protein, 4 aa, Mycobacterium
PFAT

SEQ ID NO: 389801 - protein, 7 aa, Mycobacterium
PFTPGGR

SEQ ID NO: 389802 - protein, 4 aa, Mycobacterium
PGAC

SEQ ID NO: 389803 - protein, 10 aa, Mycobacterium
PGADPTLTTT

SEQ ID NO: 389804 - protein, 5 aa, Mycobacterium
PGAMP

SEQ ID NO: 389805 - protein, 10 aa, Mycobacterium
PGAPLARAET

SEQ ID NO: 389806 - protein, 10 aa, Mycobacterium
PGARRQIPTE

SEQ ID NO: 389807 - protein, 6 aa, Mycobacterium
PGARTA

SEQ ID NO: 389808 - protein, 9 aa, Mycobacterium
PGASDTARF

SEQ ID NO: 389809 - protein, 7 aa, Mycobacterium
PGASGRI

SEQ ID NO: 389810 - protein, 9 aa, Mycobacterium
PGASQGRGL

SEQ ID NO: 389811 - protein, 4 aa, Mycobacterium
PGAV

SEQ ID NO: 389812 - protein, 5 aa, Mycobacterium
PGAVT

SEQ ID NO: 389813 - protein, 4 aa, Mycobacterium
PGDE

SEQ ID NO: 389814 - protein, 4 aa, Mycobacterium
PGDG

SEQ ID NO: 389815 - protein, 5 aa, Mycobacterium
PGDGG

SEQ ID NO: 389816 - protein, 13 aa, Mycobacterium
PGDLGTKGGIRTD

SEQ ID NO: 389817 - protein, 5 aa, Mycobacterium
PGDPA

SEQ ID NO: 389818 - protein, 10 aa, Mycobacterium
PGDPGPIGGD

SEQ ID NO: 389819 - protein, 8 aa, Mycobacterium
PGDSERTV

SEQ ID NO: 389820 - protein, 4 aa, Mycobacterium
PGEA

SEQ ID NO: 389821 - protein, 5 aa, Mycobacterium
PGFQA

SEQ ID NO: 389822 - protein, 6 aa, Mycobacterium
PGGCTT

SEQ ID NO: 389823 - protein, 4 aa, Mycobacterium
PGGG

SEQ ID NO: 389824 - protein, 7 aa, Mycobacterium
PGGGDQW

SEQ ID NO: 389825 - protein, 7 aa, Mycobacterium
PGGGGVA

SEQ ID NO: 389826 - protein, 7 aa, Mycobacterium
PGGGGVT

SEQ ID NO: 389827 - protein, 4 aa, Mycobacterium
PGGM

SEQ ID NO: 389828 - protein, 7 aa, Mycobacterium
PGGQTQF

SEQ ID NO: 389829 - protein, 6 aa, Mycobacterium
PGGSAN

SEQ ID NO: 389830 - protein, 9 aa, Mycobacterium
PGGTAPGQA

SEQ ID NO: 389831 - protein, 7 aa, Mycobacterium
PGGTPAK

SEQ ID NO: 389832 - protein, 5 aa, Mycobacterium
PGHAE

SEQ ID NO: 389833 - protein, 8 aa, Mycobacterium
PGHAEAGS

SEQ ID NO: 389834 - protein, 4 aa, Mycobacterium
PGHP

SEQ ID NO: 389835 - protein, 5 aa, Mycobacterium
PGIAT

SEQ ID NO: 389836 - protein, 8 aa, Mycobacterium
PGIDSGRT

SEQ ID NO: 389837 - protein, 5 aa, Mycobacterium
PGIPG

SEQ ID NO: 389838 - protein, 4 aa, Mycobacterium
PGLD

SEQ ID NO: 389839 - protein, 4 aa, Mycobacterium
PGLE

SEQ ID NO: 389840 - protein, 14 aa, Mycobacterium
PGMLPGSRSERAGV

SEQ ID NO: 389841 - protein, 6 aa, Mycobacterium
PGPGSV

SEQ ID NO: 389842 - protein, 4 aa, Mycobacterium
PGPL

SEQ ID NO: 389843 - protein, 5 aa, Mycobacterium
PGPPT

SEQ ID NO: 389844 - protein, 11 aa, Mycobacterium
PGPTDTPLAQA

SEQ ID NO: 389845 - protein, 4 aa, Mycobacterium
PGPV

SEQ ID NO: 389846 - protein, 7 aa, Mycobacterium
PGPVSAE

SEQ ID NO: 389847 - protein, 6 aa, Mycobacterium
PGPYPW

SEQ ID NO: 389848 - protein, 8 aa, Mycobacterium
PGQGEQAP

SEQ ID NO: 389849 - protein, 4 aa, Mycobacterium
PGQS

SEQ ID NO: 389850 - protein, 7 aa, Mycobacterium
PGREGFP

SEQ ID NO: 389851 - protein, 7 aa, Mycobacterium
PGRGGGF

SEQ ID NO: 389852 - protein, 4 aa, Mycobacterium
PGRL

SEQ ID NO: 389853 - protein, 4 aa, Mycobacterium
PGSD

SEQ ID NO: 389854 - protein, 4 aa, Mycobacterium
PGSE

SEQ ID NO: 389855 - protein, 9 aa, Mycobacterium
PGSFRPGRA

SEQ ID NO: 389856 - protein, 4 aa, Mycobacterium
PGSL

SEQ ID NO: 389857 - protein, 6 aa, Mycobacterium
PGTAQG

SEQ ID NO: 389858 - protein, 7 aa, Mycobacterium
PGTDQEY

SEQ ID NO: 389859 - protein, 7 aa, Mycobacterium
PGTGQEY

SEQ ID NO: 389860 - protein, 4 aa, Mycobacterium
PGTM

SEQ ID NO: 389861 - protein, 4 aa, Mycobacterium
PGTN

SEQ ID NO: 389862 - protein, 12 aa, Mycobacterium
PGTNWKSNPNAM

SEQ ID NO: 389863 - protein, 6 aa, Mycobacterium
PGTPGL

SEQ ID NO: 389864 - protein, 5 aa, Mycobacterium
PGTPM

SEQ ID NO: 389865 - protein, 4 aa, Mycobacterium
PGTS

SEQ ID NO: 389866 - protein, 4 aa, Mycobacterium
PGVA

SEQ ID NO: 389867 - protein, 4 aa, Mycobacterium
PGVD

SEQ ID NO: 389868 - protein, 4 aa, Mycobacterium
PGVE

SEQ ID NO: 389869 - protein, 13 aa, Mycobacterium
PGVNKGEKSAFPQ

SEQ ID NO: 389870 - protein, 12 aa, Mycobacterium
PGVSPDDVREAT

SEQ ID NO: 389871 - protein, 7 aa, Mycobacterium
PGVTRDR

SEQ ID NO: 389872 - protein, 4 aa, Mycobacterium
PGYT

SEQ ID NO: 389873 - protein, 4 aa, Mycobacterium
PHET

SEQ ID NO: 389874 - protein, 4 aa, Mycobacterium
PHGQ

SEQ ID NO: 389875 - protein, 11 aa, Mycobacterium
PHGTPEEPKGV

SEQ ID NO: 389876 - protein, 4 aa, Mycobacterium
PHGV

SEQ ID NO: 389877 - protein, 5 aa, Mycobacterium
PHSDS

SEQ ID NO: 389878 - protein, 4 aa, Mycobacterium
PHTG

SEQ ID NO: 389879 - protein, 4 aa, Mycobacterium
PHTQ

SEQ ID NO: 389880 - protein, 6 aa, Mycobacterium
PHTYTG

SEQ ID NO: 389881 - protein, 5 aa, Mycobacterium
PIEGR

SEQ ID NO: 389882 - protein, 5 aa, Mycobacterium
PIGEE

SEQ ID NO: 389883 - protein, 4 aa, Mycobacterium
PING

SEQ ID NO: 389884 - protein, 9 aa, Mycobacterium
PINPSGGLI

SEQ ID NO: 389885 - protein, 10 aa, Mycobacterium
PIPGNDDAIR

SEQ ID NO: 389886 - protein, 5 aa, Mycobacterium
PIPPG

SEQ ID NO: 389887 - protein, 15 aa, Mycobacterium
PIPQEDSGPLAGQGW

SEQ ID NO: 389888 - protein, 4 aa, Mycobacterium
PITD

SEQ ID NO: 389889 - protein, 7 aa, Mycobacterium
PITKASD

SEQ ID NO: 389890 - protein, 6 aa, Mycobacterium
PITRTP

SEQ ID NO: 389891 - protein, 4 aa, Mycobacterium
PKAI

SEQ ID NO: 389892 - protein, 6 aa, Mycobacterium
PKAPFE

SEQ ID NO: 389893 - protein, 11 aa, Mycobacterium
PKAQKRKDGAT

SEQ ID NO: 389894 - protein, 6 aa, Mycobacterium
PKAVPS

SEQ ID NO: 389895 - protein, 7 aa, Mycobacterium
PKAVPSR

SEQ ID NO: 389896 - protein, 7 aa, Mycobacterium
PKDVGRT

SEQ ID NO: 389897 - protein, 13 aa, Mycobacterium
PKDVQAVERTREF

SEQ ID NO: 389898 - protein, 8 aa, Mycobacterium
PKEERTRR

SEQ ID NO: 389899 - protein, 4 aa, Mycobacterium
PKGT

SEQ ID NO: 389900 - protein, 4 aa, Mycobacterium
PKLR

SEQ ID NO: 389901 - protein, 7 aa, Mycobacterium
PKNDAGK

SEQ ID NO: 389902 - protein, 7 aa, Mycobacterium
PKNPSGK

SEQ ID NO: 389903 - protein, 6 aa, Mycobacterium
PKNSYG

SEQ ID NO: 389904 - protein, 6 aa, Mycobacterium
PKPSIA

SEQ ID NO: 389905 - protein, 7 aa, Mycobacterium
PKSERSE

SEQ ID NO: 389906 - protein, 7 aa, Mycobacterium
PKSETRR

SEQ ID NO: 389907 - protein, 15 aa, Mycobacterium
PKSPWQRGTNENTNG

SEQ ID NO: 389908 - protein, 8 aa, Mycobacterium
PKTAETAA

SEQ ID NO: 389909 - protein, 7 aa, Mycobacterium
PKVPFDP

SEQ ID NO: 389910 - protein, 12 aa, Mycobacterium
PLAQPGTGDAGG

SEQ ID NO: 389911 - protein, 5 aa, Mycobacterium
PLDPE

SEQ ID NO: 389912 - protein, 12 aa, Mycobacterium
PLDYPEDKTELS

SEQ ID NO: 389913 - protein, 12 aa, Mycobacterium
PLDYPEDKTELT

SEQ ID NO: 389914 - protein, 4 aa, Mycobacterium
PLED

SEQ ID NO: 389915 - protein, 5 aa, Mycobacterium
PLGAS

SEQ ID NO: 389916 - protein, 7 aa, Mycobacterium
PLGSTGE

SEQ ID NO: 389917 - protein, 4 aa, Mycobacterium
PLPA

SEQ ID NO: 389918 - protein, 4 aa, Mycobacterium
PLPG

SEQ ID NO: 389919 - protein, 7 aa, Mycobacterium
PLPGKAP

SEQ ID NO: 389920 - protein, 4 aa, Mycobacterium
PLPP

SEQ ID NO: 389921 - protein, 4 aa, Mycobacterium
PLRD

SEQ ID NO: 389922 - protein, 5 aa, Mycobacterium
PLRPG

SEQ ID NO: 389923 - protein, 9 aa, Mycobacterium
PLSGVGPDQ

SEQ ID NO: 389924 - protein, 7 aa, Mycobacterium
PLTAGSG

SEQ ID NO: 389925 - protein, 4 aa, Mycobacterium
PMDA

SEQ ID NO: 389926 - protein, 4 aa, Mycobacterium
PMPD

SEQ ID NO: 389927 - protein, 11 aa, Mycobacterium
PMRDPGDGSVI

SEQ ID NO: 389928 - protein, 15 aa, Mycobacterium
PNEDAEVSKEIEKQY

SEQ ID NO: 389929 - protein, 10 aa, Mycobacterium
PNGAGKTTTV

SEQ ID NO: 389930 - protein, 4 aa, Mycobacterium
PNGR

SEQ ID NO: 389931 - protein, 9 aa, Mycobacterium
PNLAPEEAH

SEQ ID NO: 389932 - protein, 5 aa, Mycobacterium
PNLPP

SEQ ID NO: 389933 - protein, 7 aa, Mycobacterium
PNLSPAN

SEQ ID NO: 389934 - protein, 6 aa, Mycobacterium
PNPGLA

SEQ ID NO: 389935 - protein, 8 aa, Mycobacterium
PNPTPEQL

SEQ ID NO: 389936 - protein, 6 aa, Mycobacterium
PNRESA

SEQ ID NO: 389937 - protein, 4 aa, Mycobacterium
PNYP

SEQ ID NO: 389938 - protein, 8 aa, Mycobacterium
PNYPSERS

SEQ ID NO: 389939 - protein, 6 aa, Mycobacterium
PPAELV

SEQ ID NO: 389940 - protein, 8 aa, Mycobacterium
PPAEYDPV

SEQ ID NO: 389941 - protein, 7 aa, Mycobacterium
PPDAAAR

SEQ ID NO: 389942 - protein, 8 aa, Mycobacterium
PPDDPRVR

SEQ ID NO: 389943 - protein, 4 aa, Mycobacterium
PPDI

SEQ ID NO: 389944 - protein, 4 aa, Mycobacterium
PPDR

SEQ ID NO: 389945 - protein, 4 aa, Mycobacterium
PPDT

SEQ ID NO: 389946 - protein, 5 aa, Mycobacterium
PPEAL

SEQ ID NO: 389947 - protein, 5 aa, Mycobacterium
PPEAQ

SEQ ID NO: 389948 - protein, 4 aa, Mycobacterium
PPEG

SEQ ID NO: 389949 - protein, 5 aa, Mycobacterium
PPEGL

SEQ ID NO: 389950 - protein, 6 aa, Mycobacterium
PPGEIG

SEQ ID NO: 389951 - protein, 10 aa, Mycobacterium
PPGLDTGQAR

SEQ ID NO: 389952 - protein, 12 aa, Mycobacterium
PPGTGKTTTAEA

SEQ ID NO: 389953 - protein, 5 aa, Mycobacterium
PPGTV

SEQ ID NO: 389954 - protein, 14 aa, Mycobacterium
PPHGADPATGQPTT

SEQ ID NO: 389955 - protein, 7 aa, Mycobacterium
PPHPHTG

SEQ ID NO: 389956 - protein, 4 aa, Mycobacterium
PPLD

SEQ ID NO: 389957 - protein, 4 aa, Mycobacterium
PPLG

SEQ ID NO: 389958 - protein, 4 aa, Mycobacterium
PPLH

SEQ ID NO: 389959 - protein, 4 aa, Mycobacterium
PPNP

SEQ ID NO: 389960 - protein, 7 aa, Mycobacterium
PPQSRTD

SEQ ID NO: 389961 - protein, 5 aa, Mycobacterium
PPRFT

SEQ ID NO: 389962 - protein, 5 aa, Mycobacterium
PPRHR

SEQ ID NO: 389963 - protein, 4 aa, Mycobacterium
PPRK

SEQ ID NO: 389964 - protein, 7 aa, Mycobacterium
PPRQVPG

SEQ ID NO: 389965 - protein, 10 aa, Mycobacterium
PPRRGNRKGV

SEQ ID NO: 389966 - protein, 4 aa, Mycobacterium
PPRT

SEQ ID NO: 389967 - protein, 9 aa, Mycobacterium
PPSAEAALA

SEQ ID NO: 389968 - protein, 7 aa, Mycobacterium
PPSHTRG

SEQ ID NO: 389969 - protein, 8 aa, Mycobacterium
PPTATPTG

SEQ ID NO: 389970 - protein, 9 aa, Mycobacterium
PPTATPTGR

SEQ ID NO: 389971 - protein, 4 aa, Mycobacterium
PPTV

SEQ ID NO: 389972 - protein, 4 aa, Mycobacterium
PPVT

SEQ ID NO: 389973 - protein, 5 aa, Mycobacterium
PPVTV

SEQ ID NO: 389974 - protein, 5 aa, Mycobacterium
PPYDP

SEQ ID NO: 389975 - protein, 5 aa, Mycobacterium
PQDGA

SEQ ID NO: 389976 - protein, 6 aa, Mycobacterium
PQGALS

SEQ ID NO: 389977 - protein, 4 aa, Mycobacterium
PQPA

SEQ ID NO: 389978 - protein, 10 aa, Mycobacterium
PQPAQPGGSY

SEQ ID NO: 389979 - protein, 18 aa, Mycobacterium
PQQLPQVSQGTHPEPVDT

SEQ ID NO: 389980 - protein, 4 aa, Mycobacterium
PQRD

SEQ ID NO: 389981 - protein, 5 aa, Mycobacterium
PQRDR

SEQ ID NO: 389982 - protein, 4 aa, Mycobacterium
PQRR

SEQ ID NO: 389983 - protein, 5 aa, Mycobacterium
PQYQP

SEQ ID NO: 389984 - protein, 4 aa, Mycobacterium
PRAA

SEQ ID NO: 389985 - protein, 4 aa, Mycobacterium
PRAG

SEQ ID NO: 389986 - protein, 4 aa, Mycobacterium
PRAV

SEQ ID NO: 389987 - protein, 4 aa, Mycobacterium
PRDR

SEQ ID NO: 389988 - protein, 4 aa, Mycobacterium
PRED

SEQ ID NO: 389989 - protein, 7 aa, Mycobacterium
PRGMHST

SEQ ID NO: 389990 - protein, 4 aa, Mycobacterium
PRHD

SEQ ID NO: 389991 - protein, 4 aa, Mycobacterium
PRHV

SEQ ID NO: 389992 - protein, 4 aa, Mycobacterium
PRKA

SEQ ID NO: 389993 - protein, 4 aa, Mycobacterium
PRKG

SEQ ID NO: 389994 - protein, 5 aa, Mycobacterium
PRMTS

SEQ ID NO: 389995 - protein, 4 aa, Mycobacterium
PRPA

SEQ ID NO: 389996 - protein, 8 aa, Mycobacterium
PRPVEESI

SEQ ID NO: 389997 - protein, 7 aa, Mycobacterium
PRQSPGG

SEQ ID NO: 389998 - protein, 8 aa, Mycobacterium
PRRDGGER

SEQ ID NO: 389999 - protein, 8 aa, Mycobacterium
PRRGTANS

SEQ ID NO: 390000 - protein, 7 aa, Mycobacterium
PRRRTDR

SEQ ID NO: 390001 - protein, 6 aa, Mycobacterium
PRRSQR

SEQ ID NO: 390002 - protein, 10 aa, Mycobacterium
PRRTAPDGSN

SEQ ID NO: 390003 - protein, 13 aa, Mycobacterium
PRRTSGGGRRYSE

SEQ ID NO: 390004 - protein, 10 aa, Mycobacterium
PRSPTTTGKV

SEQ ID NO: 390005 - protein, 4 aa, Mycobacterium
PRTE

SEQ ID NO: 390006 - protein, 5 aa, Mycobacterium
PRTGT

SEQ ID NO: 390007 - protein, 4 aa, Mycobacterium
PRTL

SEQ ID NO: 390008 - protein, 4 aa, Mycobacterium
PRTS

SEQ ID NO: 390009 - protein, 4 aa, Mycobacterium
PSAA

SEQ ID NO: 390010 - protein, 7 aa, Mycobacterium
PSAGKSS

SEQ ID NO: 390011 - protein, 9 aa, Mycobacterium
PSAGKSSLV

SEQ ID NO: 390012 - protein, 11 aa, Mycobacterium
PSAGLHPADAE

SEQ ID NO: 390013 - protein, 7 aa, Mycobacterium
PSANPYL

SEQ ID NO: 390014 - protein, 4 aa, Mycobacterium
PSAQ

SEQ ID NO: 390015 - protein, 8 aa, Mycobacterium
PSDRTGSV

SEQ ID NO: 390016 - protein, 4 aa, Mycobacterium
PSEA

SEQ ID NO: 390017 - protein, 6 aa, Mycobacterium
PSGTEQ

SEQ ID NO: 390018 - protein, 5 aa, Mycobacterium
PSGTS

SEQ ID NO: 390019 - protein, 11 aa, Mycobacterium
PSHNPPRDGGF

SEQ ID NO: 390020 - protein, 4 aa, Mycobacterium
PSID

SEQ ID NO: 390021 - protein, 4 aa, Mycobacterium
PSLY

SEQ ID NO: 390022 - protein, 4 aa, Mycobacterium
PSNR

SEQ ID NO: 390023 - protein, 4 aa, Mycobacterium
PSNV

SEQ ID NO: 390024 - protein, 7 aa, Mycobacterium
PSPQRTP

SEQ ID NO: 390025 - protein, 4 aa, Mycobacterium
PSPS

SEQ ID NO: 390026 - protein, 10 aa, Mycobacterium
PSQKDVSDTI

SEQ ID NO: 390027 - protein, 5 aa, Mycobacterium
PSRAM

SEQ ID NO: 390028 - protein, 5 aa, Mycobacterium
PSRVA

SEQ ID NO: 390029 - protein, 8 aa, Mycobacterium
PSSPFSGG

SEQ ID NO: 390030 - protein, 4 aa, Mycobacterium
PSTG

SEQ ID NO: 390031 - protein, 5 aa, Mycobacterium
PSTPA

SEQ ID NO: 390032 - protein, 5 aa, Mycobacterium
PSTPS

SEQ ID NO: 390033 - protein, 4 aa, Mycobacterium
PSVP

SEQ ID NO: 390034 - protein, 4 aa, Mycobacterium
PSYG

SEQ ID NO: 390035 - protein, 5 aa, Mycobacterium
PTAEH

SEQ ID NO: 390036 - protein, 10 aa, Mycobacterium
PTAKDRRGNP

SEQ ID NO: 390037 - protein, 4 aa, Mycobacterium
PTAS

SEQ ID NO: 390038 - protein, 4 aa, Mycobacterium
PTAT

SEQ ID NO: 390039 - protein, 4 aa, Mycobacterium
PTDI

SEQ ID NO: 390040 - protein, 4 aa, Mycobacterium
PTDL

SEQ ID NO: 390041 - protein, 10 aa, Mycobacterium
PTDNTPDGEG

SEQ ID NO: 390042 - protein, 8 aa, Mycobacterium
PTDNTVGI

SEQ ID NO: 390043 - protein, 5 aa, Mycobacterium
PTDRP

SEQ ID NO: 390044 - protein, 12 aa, Mycobacterium
PTEDNQYQTSKM

SEQ ID NO: 390045 - protein, 4 aa, Mycobacterium
PTEH

SEQ ID NO: 390046 - protein, 6 aa, Mycobacterium
PTERGA

SEQ ID NO: 390047 - protein, 4 aa, Mycobacterium
PTES

SEQ ID NO: 390048 - protein, 4 aa, Mycobacterium
PTEV

SEQ ID NO: 390049 - protein, 7 aa, Mycobacterium
PTGAGKT

SEQ ID NO: 390050 - protein, 15 aa, Mycobacterium
PTGEPDADYDTYKHH

SEQ ID NO: 390051 - protein, 4 aa, Mycobacterium
PTGT

SEQ ID NO: 390052 - protein, 4 aa, Mycobacterium
PTKE

SEQ ID NO: 390053 - protein, 12 aa, Mycobacterium
PTLTNPPATTAA

SEQ ID NO: 390054 - protein, 4 aa, Mycobacterium
PTME

SEQ ID NO: 390055 - protein, 4 aa, Mycobacterium
PTNV

SEQ ID NO: 390056 - protein, 5 aa, Mycobacterium
PTPTA

SEQ ID NO: 390057 - protein, 6 aa, Mycobacterium
PTPTKW

SEQ ID NO: 390058 - protein, 4 aa, Mycobacterium
PTPY

SEQ ID NO: 390059 - protein, 6 aa, Mycobacterium
PTRGID

SEQ ID NO: 390060 - protein, 4 aa, Mycobacterium
PTRH

SEQ ID NO: 390061 - protein, 10 aa, Mycobacterium
PTRKAAEVTG

SEQ ID NO: 390062 - protein, 8 aa, Mycobacterium
PTSALDPE

SEQ ID NO: 390063 - protein, 7 aa, Mycobacterium
PTSGNTG

SEQ ID NO: 390064 - protein, 4 aa, Mycobacterium
PTSL

SEQ ID NO: 390065 - protein, 6 aa, Mycobacterium
PTSPQY

SEQ ID NO: 390066 - protein, 10 aa, Mycobacterium
PTTAQPPPLA

SEQ ID NO: 390067 - protein, 6 aa, Mycobacterium
PTTGLH

SEQ ID NO: 390068 - protein, 5 aa, Mycobacterium
PTVEA

SEQ ID NO: 390069 - protein, 8 aa, Mycobacterium
PTVQQPNS

SEQ ID NO: 390070 - protein, 12 aa, Mycobacterium
PTVRGGASNPYT

SEQ ID NO: 390071 - protein, 6 aa, Mycobacterium
PTVSPE

SEQ ID NO: 390072 - protein, 6 aa, Mycobacterium
PTYPED

SEQ ID NO: 390073 - protein, 4 aa, Mycobacterium
PVAP

SEQ ID NO: 390074 - protein, 6 aa, Mycobacterium
PVEGQT

SEQ ID NO: 390075 - protein, 7 aa, Mycobacterium
PVGATGG

SEQ ID NO: 390076 - protein, 4 aa, Mycobacterium
PVGE

SEQ ID NO: 390077 - protein, 4 aa, Mycobacterium
PVGG

SEQ ID NO: 390078 - protein, 8 aa, Mycobacterium
PVGNEEGE

SEQ ID NO: 390079 - protein, 8 aa, Mycobacterium
PVGSTGSR

SEQ ID NO: 390080 - protein, 6 aa, Mycobacterium
PVNDLS

SEQ ID NO: 390081 - protein, 7 aa, Mycobacterium
PVNPSGG

SEQ ID NO: 390082 - protein, 4 aa, Mycobacterium
PVPA

SEQ ID NO: 390083 - protein, 4 aa, Mycobacterium
PVPT

SEQ ID NO: 390084 - protein, 5 aa, Mycobacterium
PVSEI

SEQ ID NO: 390085 - protein, 4 aa, Mycobacterium
PVTA

SEQ ID NO: 390086 - protein, 21 aa, Mycobacterium
PWGPDKITDDGREQLRALGFT

SEQ ID NO: 390087 - protein, 21 aa, Mycobacterium
PWGPDKITEDGREQLRALGFT

SEQ ID NO: 390088 - protein, 4 aa, Mycobacterium
PWRA

SEQ ID NO: 390089 - protein, 5 aa, Mycobacterium
PWRDN

SEQ ID NO: 390090 - protein, 11 aa, Mycobacterium
PYGNSGPRVDG

SEQ ID NO: 390091 - protein, 10 aa, Mycobacterium
PYHGGPGNNY

SEQ ID NO: 390092 - protein, 4 aa, Mycobacterium
PYPD

SEQ ID NO: 390093 - protein, 4 aa, Mycobacterium
PYQN

SEQ ID NO: 390094 - protein, 5 aa, Mycobacterium
PYRND

SEQ ID NO: 390095 - protein, 7 aa, Mycobacterium
QAAGAAP

SEQ ID NO: 390096 - protein, 8 aa, Mycobacterium
QAAGAAPL

SEQ ID NO: 390097 - protein, 8 aa, Mycobacterium
QADPAEDL

SEQ ID NO: 390098 - protein, 4 aa, Mycobacterium
QAEA

SEQ ID NO: 390099 - protein, 7 aa, Mycobacterium
QAEAEGL

SEQ ID NO: 390100 - protein, 8 aa, Mycobacterium
QAERGNKI

SEQ ID NO: 390101 - protein, 5 aa, Mycobacterium
QAGGE

SEQ ID NO: 390102 - protein, 5 aa, Mycobacterium
QAGGI

SEQ ID NO: 390103 - protein, 5 aa, Mycobacterium
QAGPE

SEQ ID NO: 390104 - protein, 4 aa, Mycobacterium
QAGV

SEQ ID NO: 390105 - protein, 6 aa, Mycobacterium
QAGVSR

SEQ ID NO: 390106 - protein, 4 aa, Mycobacterium
QAHG

SEQ ID NO: 390107 - protein, 4 aa, Mycobacterium
QAHP

SEQ ID NO: 390108 - protein, 7 aa, Mycobacterium
QALGTGN

SEQ ID NO: 390109 - protein, 7 aa, Mycobacterium
QANYAAA

SEQ ID NO: 390110 - protein, 4 aa, Mycobacterium
QAPD

SEQ ID NO: 390111 - protein, 8 aa, Mycobacterium
QAPDSGNA

SEQ ID NO: 390112 - protein, 4 aa, Mycobacterium
QAPE

SEQ ID NO: 390113 - protein, 7 aa, Mycobacterium
QAPEGRG

SEQ ID NO: 390114 - protein, 4 aa, Mycobacterium
QAPP

SEQ ID NO: 390115 - protein, 10 aa, Mycobacterium
QAPTGSNSQG

SEQ ID NO: 390116 - protein, 11 aa, Mycobacterium
QARDKTGTDPV

SEQ ID NO: 390117 - protein, 10 aa, Mycobacterium
QARKDGYTST

SEQ ID NO: 390118 - protein, 9 aa, Mycobacterium
QARTSDPDI

SEQ ID NO: 390119 - protein, 21 aa, Mycobacterium
QASGLPVRRPQPRRYEHPAPG

SEQ ID NO: 390120 - protein, 4 aa, Mycobacterium
QATE

SEQ ID NO: 390121 - protein, 6 aa, Mycobacterium
QATGRR

SEQ ID NO: 390122 - protein, 9 aa, Mycobacterium
QATKARAPF

SEQ ID NO: 390123 - protein, 7 aa, Mycobacterium
QAVESTK

SEQ ID NO: 390124 - protein, 4 aa, Mycobacterium
QCPP

SEQ ID NO: 390125 - protein, 5 aa, Mycobacterium
QDAPI

SEQ ID NO: 390126 - protein, 9 aa, Mycobacterium
QDPGVPDGR

SEQ ID NO: 390127 - protein, 9 aa, Mycobacterium
QDPKGEGQA

SEQ ID NO: 390128 - protein, 4 aa, Mycobacterium
QDPY

SEQ ID NO: 390129 - protein, 7 aa, Mycobacterium
QDTDAGA

SEQ ID NO: 390130 - protein, 7 aa, Mycobacterium
QDTGHAQ

SEQ ID NO: 390131 - protein, 5 aa, Mycobacterium
QECGA

SEQ ID NO: 390132 - protein, 4 aa, Mycobacterium
QEDP

SEQ ID NO: 390133 - protein, 5 aa, Mycobacterium
QEEAL

SEQ ID NO: 390134 - protein, 5 aa, Mycobacterium
QEEAM

SEQ ID NO: 390135 - protein, 4 aa, Mycobacterium
QEGM

SEQ ID NO: 390136 - protein, 5 aa, Mycobacterium
QEHVS

SEQ ID NO: 390137 - protein, 6 aa, Mycobacterium
QENRSL

SEQ ID NO: 390138 - protein, 7 aa, Mycobacterium
QERAEEK

SEQ ID NO: 390139 - protein, 7 aa, Mycobacterium
QERPHDA

SEQ ID NO: 390140 - protein, 7 aa, Mycobacterium
QERSGGH

SEQ ID NO: 390141 - protein, 12 aa, Mycobacterium
QESGTTRPIDPW

SEQ ID NO: 390142 - protein, 23 aa, Mycobacterium
QETDYPSVGPDRPEYEPRGCPRG

SEQ ID NO: 390143 - protein, 4 aa, Mycobacterium
QFPG

SEQ ID NO: 390144 - protein, 5 aa, Mycobacterium
QGAAV

SEQ ID NO: 390145 - protein, 4 aa, Mycobacterium
QGAP

SEQ ID NO: 390146 - protein, 16 aa, Mycobacterium
QGGEAPTAASWGAANR

SEQ ID NO: 390147 - protein, 4 aa, Mycobacterium
QGGG

SEQ ID NO: 390148 - protein, 8 aa, Mycobacterium
QGKDGKRS

SEQ ID NO: 390149 - protein, 7 aa, Mycobacterium
QGNTNVS

SEQ ID NO: 390150 - protein, 4 aa, Mycobacterium
QGPD

SEQ ID NO: 390151 - protein, 6 aa, Mycobacterium
QGPSPV

SEQ ID NO: 390152 - protein, 4 aa, Mycobacterium
QGQI

SEQ ID NO: 390153 - protein, 11 aa, Mycobacterium
QGRGDAAEQTV

SEQ ID NO: 390154 - protein, 10 aa, Mycobacterium
QGSGKTTLAG

SEQ ID NO: 390155 - protein, 5 aa, Mycobacterium
QGSQW

SEQ ID NO: 390156 - protein, 4 aa, Mycobacterium
QGTD

SEQ ID NO: 390157 - protein, 4 aa, Mycobacterium
QGTT

SEQ ID NO: 390158 - protein, 5 aa, Mycobacterium
QHGGP

SEQ ID NO: 390159 - protein, 9 aa, Mycobacterium
QIPAADASL

SEQ ID NO: 390160 - protein, 7 aa, Mycobacterium
QISDGAS

SEQ ID NO: 390161 - protein, 9 aa, Mycobacterium
QKDAPPLPA

SEQ ID NO: 390162 - protein, 10 aa, Mycobacterium
QKDEGAMAQT

SEQ ID NO: 390163 - protein, 6 aa, Mycobacterium
QKDRDA

SEQ ID NO: 390164 - protein, 6 aa, Mycobacterium
QKPLDG

SEQ ID NO: 390165 - protein, 6 aa, Mycobacterium
QLEGPV

SEQ ID NO: 390166 - protein, 4 aa, Mycobacterium
QLHD

SEQ ID NO: 390167 - protein, 7 aa, Mycobacterium
QLTGEAD

SEQ ID NO: 390168 - protein, 5 aa, Mycobacterium
QNFPE

SEQ ID NO: 390169 - protein, 10 aa, Mycobacterium
QNKASGAEIG

SEQ ID NO: 390170 - protein, 11 aa, Mycobacterium
QNNGSKTTIAP

SEQ ID NO: 390171 - protein, 10 aa, Mycobacterium
QNRASGAEIG

SEQ ID NO: 390172 - protein, 4 aa, Mycobacterium
QNTP

SEQ ID NO: 390173 - protein, 11 aa, Mycobacterium
QPADSAEGLPA

SEQ ID NO: 390174 - protein, 13 aa, Mycobacterium
QPATELSGGEAQR

SEQ ID NO: 390175 - protein, 4 aa, Mycobacterium
QPAV

SEQ ID NO: 390176 - protein, 9 aa, Mycobacterium
QPDLGPKQW

SEQ ID NO: 390177 - protein, 11 aa, Mycobacterium
QPDLSPKARPR

SEQ ID NO: 390178 - protein, 4 aa, Mycobacterium
QPEL

SEQ ID NO: 390179 - protein, 6 aa, Mycobacterium
QPERRA

SEQ ID NO: 390180 - protein, 4 aa, Mycobacterium
QPET

SEQ ID NO: 390181 - protein, 4 aa, Mycobacterium
QPGD

SEQ ID NO: 390182 - protein, 4 aa, Mycobacterium
QPGV

SEQ ID NO: 390183 - protein, 15 aa, Mycobacterium
QPGYGHSDKRAEHGQ

SEQ ID NO: 390184 - protein, 8 aa, Mycobacterium
QPLTEQDQ

SEQ ID NO: 390185 - protein, 12 aa, Mycobacterium
QPNHPTDDPRGI

SEQ ID NO: 390186 - protein, 6 aa, Mycobacterium
QPPSAL

SEQ ID NO: 390187 - protein, 15 aa, Mycobacterium
QPSGSVARYESRVGD

SEQ ID NO: 390188 - protein, 4 aa, Mycobacterium
QPSS

SEQ ID NO: 390189 - protein, 7 aa, Mycobacterium
QPTPPPI

SEQ ID NO: 390190 - protein, 12 aa, Mycobacterium
QPTTSAGRHPDS

SEQ ID NO: 390191 - protein, 9 aa, Mycobacterium
QQATAAPVA

SEQ ID NO: 390192 - protein, 9 aa, Mycobacterium
QQNASRDSW

SEQ ID NO: 390193 - protein, 6 aa, Mycobacterium
QQPGRA

SEQ ID NO: 390194 - protein, 7 aa, Mycobacterium
QQRESFG

SEQ ID NO: 390195 - protein, 23 aa, Mycobacterium
QQTDYPSVGPDRPEYEPRGCPRG

SEQ ID NO: 390196 - protein, 7 aa, Mycobacterium
QQYPPDE

SEQ ID NO: 390197 - protein, 5 aa, Mycobacterium
QRARE

SEQ ID NO: 390198 - protein, 7 aa, Mycobacterium
QRARQVT

SEQ ID NO: 390199 - protein, 4 aa, Mycobacterium
QRAY

SEQ ID NO: 390200 - protein, 6 aa, Mycobacterium
QRDAGV

SEQ ID NO: 390201 - protein, 7 aa, Mycobacterium
QRDDSPR

SEQ ID NO: 390202 - protein, 7 aa, Mycobacterium
QRDRGPT

SEQ ID NO: 390203 - protein, 7 aa, Mycobacterium
QRGNPIE

SEQ ID NO: 390204 - protein, 5 aa, Mycobacterium
QRGRR

SEQ ID NO: 390205 - protein, 6 aa, Mycobacterium
QRPGAV

SEQ ID NO: 390206 - protein, 6 aa, Mycobacterium
QRPGVG

SEQ ID NO: 390207 - protein, 6 aa, Mycobacterium
QRPNGY

SEQ ID NO: 390208 - protein, 5 aa, Mycobacterium
QRPSM

SEQ ID NO: 390209 - protein, 5 aa, Mycobacterium
QRRRK

SEQ ID NO: 390210 - protein, 7 aa, Mycobacterium
QRRVDEE

SEQ ID NO: 390211 - protein, 4 aa, Mycobacterium
QRTE

SEQ ID NO: 390212 - protein, 5 aa, Mycobacterium
QRWTP

SEQ ID NO: 390213 - protein, 4 aa, Mycobacterium
QSEA

SEQ ID NO: 390214 - protein, 8 aa, Mycobacterium
QSEPQRQA

SEQ ID NO: 390215 - protein, 7 aa, Mycobacterium
QSGDTVR

SEQ ID NO: 390216 - protein, 4 aa, Mycobacterium
QSGE

SEQ ID NO: 390217 - protein, 4 aa, Mycobacterium
QSGH

SEQ ID NO: 390218 - protein, 4 aa, Mycobacterium
QSGK

SEQ ID NO: 390219 - protein, 7 aa, Mycobacterium
QSGVGRE

SEQ ID NO: 390220 - protein, 5 aa, Mycobacterium
QSKNP

SEQ ID NO: 390221 - protein, 8 aa, Mycobacterium
QSLSAQAA

SEQ ID NO: 390222 - protein, 13 aa, Mycobacterium
QSNPTHGETGEAL

SEQ ID NO: 390223 - protein, 5 aa, Mycobacterium
QSPGL

SEQ ID NO: 390224 - protein, 10 aa, Mycobacterium
QSPPDTPNPG

SEQ ID NO: 390225 - protein, 7 aa, Mycobacterium
QSPQYPQ

SEQ ID NO: 390226 - protein, 7 aa, Mycobacterium
QSPRGGT

SEQ ID NO: 390227 - protein, 4 aa, Mycobacterium
QSTV

SEQ ID NO: 390228 - protein, 4 aa, Mycobacterium
QSVG

SEQ ID NO: 390229 - protein, 22 aa, Mycobacterium
QSYPSRSKDPDPVDYSTGSVGI

SEQ ID NO: 390230 - protein, 4 aa, Mycobacterium
QTAE

SEQ ID NO: 390231 - protein, 4 aa, Mycobacterium
QTAR

SEQ ID NO: 390232 - protein, 6 aa, Mycobacterium
QTAYGA

SEQ ID NO: 390233 - protein, 6 aa, Mycobacterium
QTEAMT

SEQ ID NO: 390234 - protein, 4 aa, Mycobacterium
QTEK

SEQ ID NO: 390235 - protein, 5 aa, Mycobacterium
QTFGG

SEQ ID NO: 390236 - protein, 4 aa, Mycobacterium
QTGL

SEQ ID NO: 390237 - protein, 4 aa, Mycobacterium
QTGV

SEQ ID NO: 390238 - protein, 18 aa, Mycobacterium
QTHNRPRVSNDNPFSESE

SEQ ID NO: 390239 - protein, 4 aa, Mycobacterium
QTKR

SEQ ID NO: 390240 - protein, 7 aa, Mycobacterium
QTPTEGR

SEQ ID NO: 390241 - protein, 6 aa, Mycobacterium
QTRDAI

SEQ ID NO: 390242 - protein, 6 aa, Mycobacterium
QTRERA

SEQ ID NO: 390243 - protein, 4 aa, Mycobacterium
QTSL

SEQ ID NO: 390244 - protein, 8 aa, Mycobacterium
QVDEPASI

SEQ ID NO: 390245 - protein, 7 aa, Mycobacterium
QVDQPGT

SEQ ID NO: 390246 - protein, 4 aa, Mycobacterium
QVGD

SEQ ID NO: 390247 - protein, 6 aa, Mycobacterium
QVNQGA

SEQ ID NO: 390248 - protein, 5 aa, Mycobacterium
QVPPN

SEQ ID NO: 390249 - protein, 11 aa, Mycobacterium
QVRKAGRQTKG

SEQ ID NO: 390250 - protein, 6 aa, Mycobacterium
QVRPGQ

SEQ ID NO: 390251 - protein, 5 aa, Mycobacterium
QVTPA

SEQ ID NO: 390252 - protein, 15 aa, Mycobacterium
QVVGPREGDTPRTRL

SEQ ID NO: 390253 - protein, 10 aa, Mycobacterium
QYAKPRSADI

SEQ ID NO: 390254 - protein, 6 aa, Mycobacterium
QYKSPR

SEQ ID NO: 390255 - protein, 5 aa, Mycobacterium
RAAAA

SEQ ID NO: 390256 - protein, 8 aa, Mycobacterium
RAADRSGA

SEQ ID NO: 390257 - protein, 7 aa, Mycobacterium
RAAERGA

SEQ ID NO: 390258 - protein, 11 aa, Mycobacterium
RAAETESENPL

SEQ ID NO: 390259 - protein, 11 aa, Mycobacterium
RAAGRVEGVRP

SEQ ID NO: 390260 - protein, 6 aa, Mycobacterium
RAALGR

SEQ ID NO: 390261 - protein, 8 aa, Mycobacterium
RAAQDGAN

SEQ ID NO: 390262 - protein, 11 aa, Mycobacterium
RAARKRSQKPR

SEQ ID NO: 390263 - protein, 4 aa, Mycobacterium
RAAT

SEQ ID NO: 390264 - protein, 7 aa, Mycobacterium
RADGTVQ

SEQ ID NO: 390265 - protein, 8 aa, Mycobacterium
RADHPDEA

SEQ ID NO: 390266 - protein, 6 aa, Mycobacterium
RAEADR

SEQ ID NO: 390267 - protein, 4 aa, Mycobacterium
RAED

SEQ ID NO: 390268 - protein, 8 aa, Mycobacterium
RAESGGML

SEQ ID NO: 390269 - protein, 6 aa, Mycobacterium
RAGDDA

SEQ ID NO: 390270 - protein, 6 aa, Mycobacterium
RAGNPH

SEQ ID NO: 390271 - protein, 10 aa, Mycobacterium
RAGRSRNDQV

SEQ ID NO: 390272 - protein, 4 aa, Mycobacterium
RAGS

SEQ ID NO: 390273 - protein, 4 aa, Mycobacterium
RAGT

SEQ ID NO: 390274 - protein, 6 aa, Mycobacterium
RAGVGK

SEQ ID NO: 390275 - protein, 9 aa, Mycobacterium
RAGVSPASA

SEQ ID NO: 390276 - protein, 4 aa, Mycobacterium
RAKD

SEQ ID NO: 390277 - protein, 7 aa, Mycobacterium
RAKRGGS

SEQ ID NO: 390278 - protein, 13 aa, Mycobacterium
RALPAPDYTTTTE

SEQ ID NO: 390279 - protein, 9 aa, Mycobacterium
RAPAGTLPG

SEQ ID NO: 390280 - protein, 4 aa, Mycobacterium
RAPG

SEQ ID NO: 390281 - protein, 4 aa, Mycobacterium
RAPQ

SEQ ID NO: 390282 - protein, 9 aa, Mycobacterium
RAPQGTLPG

SEQ ID NO: 390283 - protein, 4 aa, Mycobacterium
RAPS

SEQ ID NO: 390284 - protein, 4 aa, Mycobacterium
RAQA

SEQ ID NO: 390285 - protein, 4 aa, Mycobacterium
RAQG

SEQ ID NO: 390286 - protein, 8 aa, Mycobacterium
RAQHGTKE

SEQ ID NO: 390287 - protein, 6 aa, Mycobacterium
RAQPGA

SEQ ID NO: 390288 - protein, 4 aa, Mycobacterium
RAQV

SEQ ID NO: 390289 - protein, 5 aa, Mycobacterium
RARGG

SEQ ID NO: 390290 - protein, 5 aa, Mycobacterium
RARGV

SEQ ID NO: 390291 - protein, 7 aa, Mycobacterium
RARHPRR

SEQ ID NO: 390292 - protein, 6 aa, Mycobacterium
RARNSG

SEQ ID NO: 390293 - protein, 5 aa, Mycobacterium
RARRK

SEQ ID NO: 390294 - protein, 8 aa, Mycobacterium
RARSAGAR

SEQ ID NO: 390295 - protein, 4 aa, Mycobacterium
RASG

SEQ ID NO: 390296 - protein, 7 aa, Mycobacterium
RASQSGV

SEQ ID NO: 390297 - protein, 5 aa, Mycobacterium
RASRN

SEQ ID NO: 390298 - protein, 7 aa, Mycobacterium
RASSTQE

SEQ ID NO: 390299 - protein, 7 aa, Mycobacterium
RATDPTP

SEQ ID NO: 390300 - protein, 10 aa, Mycobacterium
RATEARLSTE

SEQ ID NO: 390301 - protein, 9 aa, Mycobacterium
RATEERPSW

SEQ ID NO: 390302 - protein, 8 aa, Mycobacterium
RATPVTPT

SEQ ID NO: 390303 - protein, 5 aa, Mycobacterium
RCESG

SEQ ID NO: 390304 - protein, 10 aa, Mycobacterium
RDAAGKGGTI

SEQ ID NO: 390305 - protein, 4 aa, Mycobacterium
RDAD

SEQ ID NO: 390306 - protein, 4 aa, Mycobacterium
RDDP

SEQ ID NO: 390307 - protein, 10 aa, Mycobacterium
RDDPSSVDPS

SEQ ID NO: 390308 - protein, 5 aa, Mycobacterium
RDEDG

SEQ ID NO: 390309 - protein, 4 aa, Mycobacterium
RDGD

SEQ ID NO: 390310 - protein, 5 aa, Mycobacterium
RDGDD

SEQ ID NO: 390311 - protein, 8 aa, Mycobacterium
RDGDTARD

SEQ ID NO: 390312 - protein, 4 aa, Mycobacterium
RDGE

SEQ ID NO: 390313 - protein, 7 aa, Mycobacterium
RDGEQGR

SEQ ID NO: 390314 - protein, 5 aa, Mycobacterium
RDGIT

SEQ ID NO: 390315 - protein, 5 aa, Mycobacterium
RDGLP

SEQ ID NO: 390316 - protein, 4 aa, Mycobacterium
RDGR

SEQ ID NO: 390317 - protein, 5 aa, Mycobacterium
RDGRA

SEQ ID NO: 390318 - protein, 8 aa, Mycobacterium
RDGRPQLS

SEQ ID NO: 390319 - protein, 4 aa, Mycobacterium
RDIP

SEQ ID NO: 390320 - protein, 8 aa, Mycobacterium
RDKSATAL

SEQ ID NO: 390321 - protein, 7 aa, Mycobacterium
RDKTATA

SEQ ID NO: 390322 - protein, 8 aa, Mycobacterium
RDLDELSG

SEQ ID NO: 390323 - protein, 4 aa, Mycobacterium
RDNG

SEQ ID NO: 390324 - protein, 5 aa, Mycobacterium
RDPDG

SEQ ID NO: 390325 - protein, 4 aa, Mycobacterium
RDPG

SEQ ID NO: 390326 - protein, 8 aa, Mycobacterium
RDPRNGRN

SEQ ID NO: 390327 - protein, 7 aa, Mycobacterium
RDPRVPN

SEQ ID NO: 390328 - protein, 7 aa, Mycobacterium
RDRGYGH

SEQ ID NO: 390329 - protein, 4 aa, Mycobacterium
RDRR

SEQ ID NO: 390330 - protein, 4 aa, Mycobacterium
RDSA

SEQ ID NO: 390331 - protein, 6 aa, Mycobacterium
RDSAPS

SEQ ID NO: 390332 - protein, 4 aa, Mycobacterium
RDSD

SEQ ID NO: 390333 - protein, 6 aa, Mycobacterium
RDSGDE

SEQ ID NO: 390334 - protein, 8 aa, Mycobacterium
RDSGPTAV

SEQ ID NO: 390335 - protein, 5 aa, Mycobacterium
RDTKS

SEQ ID NO: 390336 - protein, 4 aa, Mycobacterium
RDTL

SEQ ID NO: 390337 - protein, 7 aa, Mycobacterium
RDTRGRE

SEQ ID NO: 390338 - protein, 8 aa, Mycobacterium
RDTRGREI

SEQ ID NO: 390339 - protein, 4 aa, Mycobacterium
RDVT

SEQ ID NO: 390340 - protein, 5 aa, Mycobacterium
RDVTG

SEQ ID NO: 390341 - protein, 6 aa, Mycobacterium
RDVTGR

SEQ ID NO: 390342 - protein, 6 aa, Mycobacterium
READRM

SEQ ID NO: 390343 - protein, 5 aa, Mycobacterium
REARR

SEQ ID NO: 390344 - protein, 6 aa, Mycobacterium
REDAAE

SEQ ID NO: 390345 - protein, 7 aa, Mycobacterium
REDVERG

SEQ ID NO: 390346 - protein, 6 aa, Mycobacterium
REEDRI

SEQ ID NO: 390347 - protein, 4 aa, Mycobacterium
REEG

SEQ ID NO: 390348 - protein, 7 aa, Mycobacterium
REERPDL

SEQ ID NO: 390349 - protein, 4 aa, Mycobacterium
REGD

SEQ ID NO: 390350 - protein, 7 aa, Mycobacterium
REGGIND

SEQ ID NO: 390351 - protein, 16 aa, Mycobacterium
REGNSDRRAPKAVKEY

SEQ ID NO: 390352 - protein, 6 aa, Mycobacterium
REGREG

SEQ ID NO: 390353 - protein, 4 aa, Mycobacterium
REGT

SEQ ID NO: 390354 - protein, 6 aa, Mycobacterium
REHGGG

SEQ ID NO: 390355 - protein, 4 aa, Mycobacterium
REHP

SEQ ID NO: 390356 - protein, 4 aa, Mycobacterium
REIA

SEQ ID NO: 390357 - protein, 9 aa, Mycobacterium
REIRDTAEA

SEQ ID NO: 390358 - protein, 4 aa, Mycobacterium
RENL

SEQ ID NO: 390359 - protein, 5 aa, Mycobacterium
REPGP

SEQ ID NO: 390360 - protein, 6 aa, Mycobacterium
REPGTP

SEQ ID NO: 390361 - protein, 8 aa, Mycobacterium
RERQAQIT

SEQ ID NO: 390362 - protein, 7 aa, Mycobacterium
RESPQWE

SEQ ID NO: 390363 - protein, 6 aa, Mycobacterium
RESTGF

SEQ ID NO: 390364 - protein, 4 aa, Mycobacterium
RETS

SEQ ID NO: 390365 - protein, 4 aa, Mycobacterium
REVA

SEQ ID NO: 390366 - protein, 5 aa, Mycobacterium
REYDP

SEQ ID NO: 390367 - protein, 8 aa, Mycobacterium
RFANPTPK

SEQ ID NO: 390368 - protein, 6 aa, Mycobacterium
RFATSD

SEQ ID NO: 390369 - protein, 4 aa, Mycobacterium
RFEP

SEQ ID NO: 390370 - protein, 5 aa, Mycobacterium
RFGAA

SEQ ID NO: 390371 - protein, 4 aa, Mycobacterium
RFPG

SEQ ID NO: 390372 - protein, 6 aa, Mycobacterium
RGADGG

SEQ ID NO: 390373 - protein, 7 aa, Mycobacterium
RGADGGV

SEQ ID NO: 390374 - protein, 13 aa, Mycobacterium
RGATATSSSETIT

SEQ ID NO: 390375 - protein, 4 aa, Mycobacterium
RGAV

SEQ ID NO: 390376 - protein, 7 aa, Mycobacterium
RGCTAPG

SEQ ID NO: 390377 - protein, 6 aa, Mycobacterium
RGDEIT

SEQ ID NO: 390378 - protein, 8 aa, Mycobacterium
RGDENLCP

SEQ ID NO: 390379 - protein, 4 aa, Mycobacterium
RGDH

SEQ ID NO: 390380 - protein, 4 aa, Mycobacterium
RGDL

SEQ ID NO: 390381 - protein, 19 aa, Mycobacterium
RGDPSDNLPGIPGVGEKTA

SEQ ID NO: 390382 - protein, 9 aa, Mycobacterium
RGDQNNASL

SEQ ID NO: 390383 - protein, 8 aa, Mycobacterium
RGDTPLPV

SEQ ID NO: 390384 - protein, 7 aa, Mycobacterium
RGEAKDF

SEQ ID NO: 390385 - protein, 4 aa, Mycobacterium
RGEF

SEQ ID NO: 390386 - protein, 8 aa, Mycobacterium
RGEGYQPG

SEQ ID NO: 390387 - protein, 5 aa, Mycobacterium
RGESL

SEQ ID NO: 390388 - protein, 6 aa, Mycobacterium
RGFPSP

SEQ ID NO: 390389 - protein, 4 aa, Mycobacterium
RGGI

SEQ ID NO: 390390 - protein, 9 aa, Mycobacterium
RGHGRSGGK

SEQ ID NO: 390391 - protein, 10 aa, Mycobacterium
RGHGRSGGKR

SEQ ID NO: 390392 - protein, 4 aa, Mycobacterium
RGIT

SEQ ID NO: 390393 - protein, 5 aa, Mycobacterium
RGITR

SEQ ID NO: 390394 - protein, 8 aa, Mycobacterium
RGLAPDGR

SEQ ID NO: 390395 - protein, 6 aa, Mycobacterium
RGLERT

SEQ ID NO: 390396 - protein, 5 aa, Mycobacterium
RGMGR

SEQ ID NO: 390397 - protein, 7 aa, Mycobacterium
RGPATRR

SEQ ID NO: 390398 - protein, 6 aa, Mycobacterium
RGPAVG

SEQ ID NO: 390399 - protein, 4 aa, Mycobacterium
RGPI

SEQ ID NO: 390400 - protein, 6 aa, Mycobacterium
RGPTGD

SEQ ID NO: 390401 - protein, 5 aa, Mycobacterium
RGQEA

SEQ ID NO: 390402 - protein, 6 aa, Mycobacterium
RGQSHS

SEQ ID NO: 390403 - protein, 5 aa, Mycobacterium
RGREV

SEQ ID NO: 390404 - protein, 5 aa, Mycobacterium
RGRIG

SEQ ID NO: 390405 - protein, 7 aa, Mycobacterium
RGRTEAL

SEQ ID NO: 390406 - protein, 4 aa, Mycobacterium
RGSD

SEQ ID NO: 390407 - protein, 8 aa, Mycobacterium
RGSGTYAD

SEQ ID NO: 390408 - protein, 6 aa, Mycobacterium
RGSQWA

SEQ ID NO: 390409 - protein, 9 aa, Mycobacterium
RGSRTGARV

SEQ ID NO: 390410 - protein, 8 aa, Mycobacterium
RGSTPADH

SEQ ID NO: 390411 - protein, 4 aa, Mycobacterium
RGSV

SEQ ID NO: 390412 - protein, 8 aa, Mycobacterium
RGTDDDAH

SEQ ID NO: 390413 - protein, 12 aa, Mycobacterium
RGTGVSSDVETT

SEQ ID NO: 390414 - protein, 5 aa, Mycobacterium
RGTLG

SEQ ID NO: 390415 - protein, 7 aa, Mycobacterium
RGTLGGS

SEQ ID NO: 390416 - protein, 10 aa, Mycobacterium
RGTSSKNQSR

SEQ ID NO: 390417 - protein, 9 aa, Mycobacterium
RGTSVNPVP

SEQ ID NO: 390418 - protein, 11 aa, Mycobacterium
RGTTQKANRIR

SEQ ID NO: 390419 - protein, 5 aa, Mycobacterium
RGVAP

SEQ ID NO: 390420 - protein, 4 aa, Mycobacterium
RGVD

SEQ ID NO: 390421 - protein, 4 aa, Mycobacterium
RGVR

SEQ ID NO: 390422 - protein, 16 aa, Mycobacterium
RGVSAGKVTERERDRA

SEQ ID NO: 390423 - protein, 4 aa, Mycobacterium
RGWG

SEQ ID NO: 390424 - protein, 11 aa, Mycobacterium
RHAGRRNRSGV

SEQ ID NO: 390425 - protein, 9 aa, Mycobacterium
RHDPDGPYG

SEQ ID NO: 390426 - protein, 5 aa, Mycobacterium
RHGGS

SEQ ID NO: 390427 - protein, 11 aa, Mycobacterium
RHGRERGSVTL

SEQ ID NO: 390428 - protein, 11 aa, Mycobacterium
RHGSGRPAAGA

SEQ ID NO: 390429 - protein, 6 aa, Mycobacterium
RHHTER

SEQ ID NO: 390430 - protein, 7 aa, Mycobacterium
RHLRPRS

SEQ ID NO: 390431 - protein, 4 aa, Mycobacterium
RHPD

SEQ ID NO: 390432 - protein, 4 aa, Mycobacterium
RHPE

SEQ ID NO: 390433 - protein, 7 aa, Mycobacterium
RHPGTSQ

SEQ ID NO: 390434 - protein, 8 aa, Mycobacterium
RHPSETDE

SEQ ID NO: 390435 - protein, 5 aa, Mycobacterium
RHPYG

SEQ ID NO: 390436 - protein, 6 aa, Mycobacterium
RHRDDT

SEQ ID NO: 390437 - protein, 5 aa, Mycobacterium
RHRGT

SEQ ID NO: 390438 - protein, 6 aa, Mycobacterium
RHRKGE

SEQ ID NO: 390439 - protein, 5 aa, Mycobacterium
RHTGS

SEQ ID NO: 390440 - protein, 6 aa, Mycobacterium
RHTGSL

SEQ ID NO: 390441 - protein, 4 aa, Mycobacterium
RIGA

SEQ ID NO: 390442 - protein, 8 aa, Mycobacterium
RIGPGKAQ

SEQ ID NO: 390443 - protein, 9 aa, Mycobacterium
RISSGTHST

SEQ ID NO: 390444 - protein, 5 aa, Mycobacterium
RITAP

SEQ ID NO: 390445 - protein, 5 aa, Mycobacterium
RKAGH

SEQ ID NO: 390446 - protein, 6 aa, Mycobacterium
RKAHGD

SEQ ID NO: 390447 - protein, 4 aa, Mycobacterium
RKAM

SEQ ID NO: 390448 - protein, 4 aa, Mycobacterium
RKEG

SEQ ID NO: 390449 - protein, 10 aa, Mycobacterium
RKENAEHPIE

SEQ ID NO: 390450 - protein, 5 aa, Mycobacterium
RKGAA

SEQ ID NO: 390451 - protein, 9 aa, Mycobacterium
RKGDADAYS

SEQ ID NO: 390452 - protein, 4 aa, Mycobacterium
RKGE

SEQ ID NO: 390453 - protein, 8 aa, Mycobacterium
RKNIDTGM

SEQ ID NO: 390454 - protein, 18 aa, Mycobacterium
RKNYAGTSPLTIASGRKR

SEQ ID NO: 390455 - protein, 6 aa, Mycobacterium
RKPEHQ

SEQ ID NO: 390456 - protein, 13 aa, Mycobacterium
RKPSQLSGGQRQR

SEQ ID NO: 390457 - protein, 7 aa, Mycobacterium
RKQFGKP

SEQ ID NO: 390458 - protein, 9 aa, Mycobacterium
RKRKEKAVR

SEQ ID NO: 390459 - protein, 7 aa, Mycobacterium
RKSPQMS

SEQ ID NO: 390460 - protein, 5 aa, Mycobacterium
RKSRS

SEQ ID NO: 390461 - protein, 4 aa, Mycobacterium
RKTK

SEQ ID NO: 390462 - protein, 9 aa, Mycobacterium
RKTKLSRTV

SEQ ID NO: 390463 - protein, 7 aa, Mycobacterium
RKVAEGR

SEQ ID NO: 390464 - protein, 12 aa, Mycobacterium
RLAGEERAPAPA

SEQ ID NO: 390465 - protein, 5 aa, Mycobacterium
RLDGQ

SEQ ID NO: 390466 - protein, 15 aa, Mycobacterium
RLDKPGGGLSGGQQQ

SEQ ID NO: 390467 - protein, 15 aa, Mycobacterium
RLDRPGGGLSGGQQQ

SEQ ID NO: 390468 - protein, 7 aa, Mycobacterium
RLESGKR

SEQ ID NO: 390469 - protein, 16 aa, Mycobacterium
RLESKKISKTQAVTSN

SEQ ID NO: 390470 - protein, 6 aa, Mycobacterium
RLGDDA

SEQ ID NO: 390471 - protein, 4 aa, Mycobacterium
RLPT

SEQ ID NO: 390472 - protein, 5 aa, Mycobacterium
RLQRT

SEQ ID NO: 390473 - protein, 7 aa, Mycobacterium
RLRDPRQ

SEQ ID NO: 390474 - protein, 10 aa, Mycobacterium
RLTDGQGRTV

SEQ ID NO: 390475 - protein, 5 aa, Mycobacterium
RLTDS

SEQ ID NO: 390476 - protein, 5 aa, Mycobacterium
RLTSH

SEQ ID NO: 390477 - protein, 7 aa, Mycobacterium
RNARERL

SEQ ID NO: 390478 - protein, 4 aa, Mycobacterium
RNGA

SEQ ID NO: 390479 - protein, 10 aa, Mycobacterium
RNGPNPVAEV

SEQ ID NO: 390480 - protein, 5 aa, Mycobacterium
RNKRS

SEQ ID NO: 390481 - protein, 18 aa, Mycobacterium
RNMGQTDQPAHDARYDHA

SEQ ID NO: 390482 - protein, 10 aa, Mycobacterium
RNNGSRNPEA

SEQ ID NO: 390483 - protein, 6 aa, Mycobacterium
RNQQAH

SEQ ID NO: 390484 - protein, 8 aa, Mycobacterium
RNRDDGVT

SEQ ID NO: 390485 - protein, 12 aa, Mycobacterium
RNRPRTKSPSPV

SEQ ID NO: 390486 - protein, 10 aa, Mycobacterium
RNTGGAPLEQ

SEQ ID NO: 390487 - protein, 7 aa, Mycobacterium
RNTPGVT

SEQ ID NO: 390488 - protein, 5 aa, Mycobacterium
RNTRD

SEQ ID NO: 390489 - protein, 5 aa, Mycobacterium
RPAAG

SEQ ID NO: 390490 - protein, 4 aa, Mycobacterium
RPAL

SEQ ID NO: 390491 - protein, 10 aa, Mycobacterium
RPAPGHTPGS

SEQ ID NO: 390492 - protein, 4 aa, Mycobacterium
RPDQ

SEQ ID NO: 390493 - protein, 8 aa, Mycobacterium
RPEARNAI

SEQ ID NO: 390494 - protein, 4 aa, Mycobacterium
RPED

SEQ ID NO: 390495 - protein, 8 aa, Mycobacterium
RPEEVAAR

SEQ ID NO: 390496 - protein, 7 aa, Mycobacterium
RPEGGWT

SEQ ID NO: 390497 - protein, 7 aa, Mycobacterium
RPEPKRA

SEQ ID NO: 390498 - protein, 5 aa, Mycobacterium
RPEQH

SEQ ID NO: 390499 - protein, 4 aa, Mycobacterium
RPER

SEQ ID NO: 390500 - protein, 6 aa, Mycobacterium
RPERFE

SEQ ID NO: 390501 - protein, 6 aa, Mycobacterium
RPERRR

SEQ ID NO: 390502 - protein, 9 aa, Mycobacterium
RPGDLSPGD

SEQ ID NO: 390503 - protein, 4 aa, Mycobacterium
RPGE

SEQ ID NO: 390504 - protein, 4 aa, Mycobacterium
RPGF

SEQ ID NO: 390505 - protein, 15 aa, Mycobacterium
RPGGGAKLARSAGSS

SEQ ID NO: 390506 - protein, 8 aa, Mycobacterium
RPGKFGGD

SEQ ID NO: 390507 - protein, 5 aa, Mycobacterium
RPGLS

SEQ ID NO: 390508 - protein, 5 aa, Mycobacterium
RPGLT

SEQ ID NO: 390509 - protein, 5 aa, Mycobacterium
RPGPD

SEQ ID NO: 390510 - protein, 6 aa, Mycobacterium
RPGSLG

SEQ ID NO: 390511 - protein, 8 aa, Mycobacterium
RPGVGKST

SEQ ID NO: 390512 - protein, 6 aa, Mycobacterium
RPGYEL

SEQ ID NO: 390513 - protein, 21 aa, Mycobacterium
RPHDGLRDPVTPGKALTPNEK

SEQ ID NO: 390514 - protein, 11 aa, Mycobacterium
RPKDYSEARTI

SEQ ID NO: 390515 - protein, 4 aa, Mycobacterium
RPKS

SEQ ID NO: 390516 - protein, 5 aa, Mycobacterium
RPLDT

SEQ ID NO: 390517 - protein, 6 aa, Mycobacterium
RPLPGF

SEQ ID NO: 390518 - protein, 6 aa, Mycobacterium
RPLPGR

SEQ ID NO: 390519 - protein, 11 aa, Mycobacterium
RPNDERRNRSL

SEQ ID NO: 390520 - protein, 4 aa, Mycobacterium
RPNS

SEQ ID NO: 390521 - protein, 6 aa, Mycobacterium
RPNTAP

SEQ ID NO: 390522 - protein, 8 aa, Mycobacterium
RPNTAPTV

SEQ ID NO: 390523 - protein, 7 aa, Mycobacterium
RPNVGKS

SEQ ID NO: 390524 - protein, 8 aa, Mycobacterium
RPNVGKST

SEQ ID NO: 390525 - protein, 4 aa, Mycobacterium
RPPA

SEQ ID NO: 390526 - protein, 5 aa, Mycobacterium
RPPAE

SEQ ID NO: 390527 - protein, 15 aa, Mycobacterium
RPPSWTDELTYEPVA

SEQ ID NO: 390528 - protein, 7 aa, Mycobacterium
RPPTNAL

SEQ ID NO: 390529 - protein, 4 aa, Mycobacterium
RPPV

SEQ ID NO: 390530 - protein, 6 aa, Mycobacterium
RPRKSL

SEQ ID NO: 390531 - protein, 11 aa, Mycobacterium
RPRNPEHGDYA

SEQ ID NO: 390532 - protein, 4 aa, Mycobacterium
RPRQ

SEQ ID NO: 390533 - protein, 4 aa, Mycobacterium
RPSG

SEQ ID NO: 390534 - protein, 7 aa, Mycobacterium
RPSRLKG

SEQ ID NO: 390535 - protein, 8 aa, Mycobacterium
RPSRRNSL

SEQ ID NO: 390536 - protein, 4 aa, Mycobacterium
RPSV

SEQ ID NO: 390537 - protein, 22 aa, Mycobacterium
RPTDITPPTSPSDGGQHAGTEV

SEQ ID NO: 390538 - protein, 5 aa, Mycobacterium
RPTPL

SEQ ID NO: 390539 - protein, 4 aa, Mycobacterium
RPVE

SEQ ID NO: 390540 - protein, 5 aa, Mycobacterium
RPVRG

SEQ ID NO: 390541 - protein, 6 aa, Mycobacterium
RPVSTP

SEQ ID NO: 390542 - protein, 4 aa, Mycobacterium
RPVT

SEQ ID NO: 390543 - protein, 5 aa, Mycobacterium
RPVTR

SEQ ID NO: 390544 - protein, 5 aa, Mycobacterium
RPYDE

SEQ ID NO: 390545 - protein, 13 aa, Mycobacterium
RPYREPGQRSRDE

SEQ ID NO: 390546 - protein, 6 aa, Mycobacterium
RQADPG

SEQ ID NO: 390547 - protein, 5 aa, Mycobacterium
RQAGL

SEQ ID NO: 390548 - protein, 4 aa, Mycobacterium
RQAL

SEQ ID NO: 390549 - protein, 6 aa, Mycobacterium
RQDEIG

SEQ ID NO: 390550 - protein, 4 aa, Mycobacterium
RQGD

SEQ ID NO: 390551 - protein, 4 aa, Mycobacterium
RQGL

SEQ ID NO: 390552 - protein, 16 aa, Mycobacterium
RQGNSDRRAPKAVKEY

SEQ ID NO: 390553 - protein, 8 aa, Mycobacterium
RQKARAAQ

SEQ ID NO: 390554 - protein, 7 aa, Mycobacterium
RQPDGSS

SEQ ID NO: 390555 - protein, 5 aa, Mycobacterium
RQQRR

SEQ ID NO: 390556 - protein, 6 aa, Mycobacterium
RQRDRI

SEQ ID NO: 390557 - protein, 7 aa, Mycobacterium
RQRREKT

SEQ ID NO: 390558 - protein, 9 aa, Mycobacterium
RQSGEWKDG

SEQ ID NO: 390559 - protein, 8 aa, Mycobacterium
RQSGTTPS

SEQ ID NO: 390560 - protein, 5 aa, Mycobacterium
RQTGD

SEQ ID NO: 390561 - protein, 4 aa, Mycobacterium
RRAA

SEQ ID NO: 390562 - protein, 4 aa, Mycobacterium
RRAD

SEQ ID NO: 390563 - protein, 4 aa, Mycobacterium
RRAT

SEQ ID NO: 390564 - protein, 7 aa, Mycobacterium
RRDARAP

SEQ ID NO: 390565 - protein, 5 aa, Mycobacterium
RRDEA

SEQ ID NO: 390566 - protein, 4 aa, Mycobacterium
RRDG

SEQ ID NO: 390567 - protein, 6 aa, Mycobacterium
RRDGDD

SEQ ID NO: 390568 - protein, 13 aa, Mycobacterium
RRDGIDAASEIAS

SEQ ID NO: 390569 - protein, 5 aa, Mycobacterium
RRDKI

SEQ ID NO: 390570 - protein, 4 aa, Mycobacterium
RRDP

SEQ ID NO: 390571 - protein, 4 aa, Mycobacterium
RREA

SEQ ID NO: 390572 - protein, 11 aa, Mycobacterium
RREKDDVTEVR

SEQ ID NO: 390573 - protein, 5 aa, Mycobacterium
RREPY

SEQ ID NO: 390574 - protein, 4 aa, Mycobacterium
RREY

SEQ ID NO: 390575 - protein, 4 aa, Mycobacterium
RRGA

SEQ ID NO: 390576 - protein, 7 aa, Mycobacterium
RRGAAST

SEQ ID NO: 390577 - protein, 7 aa, Mycobacterium
RRGGSAM

SEQ ID NO: 390578 - protein, 4 aa, Mycobacterium
RRGI

SEQ ID NO: 390579 - protein, 8 aa, Mycobacterium
RRGNRGGA

SEQ ID NO: 390580 - protein, 4 aa, Mycobacterium
RRGP

SEQ ID NO: 390581 - protein, 7 aa, Mycobacterium
RRGPGGG

SEQ ID NO: 390582 - protein, 6 aa, Mycobacterium
RRGPNG

SEQ ID NO: 390583 - protein, 6 aa, Mycobacterium
RRGSGY

SEQ ID NO: 390584 - protein, 4 aa, Mycobacterium
RRGT

SEQ ID NO: 390585 - protein, 4 aa, Mycobacterium
RRGV

SEQ ID NO: 390586 - protein, 4 aa, Mycobacterium
RRHP

SEQ ID NO: 390587 - protein, 6 aa, Mycobacterium
RRIAPS

SEQ ID NO: 390588 - protein, 9 aa, Mycobacterium
RRKPEAAAR

SEQ ID NO: 390589 - protein, 5 aa, Mycobacterium
RRLRQ

SEQ ID NO: 390590 - protein, 4 aa, Mycobacterium
RRLS

SEQ ID NO: 390591 - protein, 9 aa, Mycobacterium
RRNASTRTY

SEQ ID NO: 390592 - protein, 5 aa, Mycobacterium
RRPGE

SEQ ID NO: 390593 - protein, 8 aa, Mycobacterium
RRPNTDDL

SEQ ID NO: 390594 - protein, 6 aa, Mycobacterium
RRPQES

SEQ ID NO: 390595 - protein, 7 aa, Mycobacterium
RRPTDAE

SEQ ID NO: 390596 - protein, 7 aa, Mycobacterium
RRPTDTE

SEQ ID NO: 390597 - protein, 7 aa, Mycobacterium
RRQASLE

SEQ ID NO: 390598 - protein, 6 aa, Mycobacterium
RRRGEN

SEQ ID NO: 390599 - protein, 5 aa, Mycobacterium
RRRHP

SEQ ID NO: 390600 - protein, 4 aa, Mycobacterium
RRRL

SEQ ID NO: 390601 - protein, 5 aa, Mycobacterium
RRSAQ

SEQ ID NO: 390602 - protein, 10 aa, Mycobacterium
RRTANAEGRE

SEQ ID NO: 390603 - protein, 4 aa, Mycobacterium
RRTE

SEQ ID NO: 390604 - protein, 8 aa, Mycobacterium
RRTGGTDA

SEQ ID NO: 390605 - protein, 5 aa, Mycobacterium
RRTHE

SEQ ID NO: 390606 - protein, 4 aa, Mycobacterium
RRTP

SEQ ID NO: 390607 - protein, 27 aa, Mycobacterium
RRVGGRRRGRSGSGRGRGAIDREQSAA

SEQ ID NO: 390608 - protein, 8 aa, Mycobacterium
RRYDGDER

SEQ ID NO: 390609 - protein, 11 aa, Mycobacterium
RRYTGYSSRGA

SEQ ID NO: 390610 - protein, 4 aa, Mycobacterium
RSAE

SEQ ID NO: 390611 - protein, 4 aa, Mycobacterium
RSAG

SEQ ID NO: 390612 - protein, 4 aa, Mycobacterium
RSAQ

SEQ ID NO: 390613 - protein, 5 aa, Mycobacterium
RSAQA

SEQ ID NO: 390614 - protein, 4 aa, Mycobacterium
RSAR

SEQ ID NO: 390615 - protein, 4 aa, Mycobacterium
RSAS

SEQ ID NO: 390616 - protein, 5 aa, Mycobacterium
RSDDS

SEQ ID NO: 390617 - protein, 8 aa, Mycobacterium
RSDGASGV

SEQ ID NO: 390618 - protein, 4 aa, Mycobacterium
RSDS

SEQ ID NO: 390619 - protein, 7 aa, Mycobacterium
RSEEERE

SEQ ID NO: 390620 - protein, 4 aa, Mycobacterium
RSEG

SEQ ID NO: 390621 - protein, 7 aa, Mycobacterium
RSERGFS

SEQ ID NO: 390622 - protein, 9 aa, Mycobacterium
RSGAANTAA

SEQ ID NO: 390623 - protein, 7 aa, Mycobacterium
RSGEPFP

SEQ ID NO: 390624 - protein, 5 aa, Mycobacterium
RSGGF

SEQ ID NO: 390625 - protein, 5 aa, Mycobacterium
RSGGR

SEQ ID NO: 390626 - protein, 11 aa, Mycobacterium
RSGRARGRAEC

SEQ ID NO: 390627 - protein, 8 aa, Mycobacterium
RSKAPTTD

SEQ ID NO: 390628 - protein, 4 aa, Mycobacterium
RSLQ

SEQ ID NO: 390629 - protein, 4 aa, Mycobacterium
RSNG

SEQ ID NO: 390630 - protein, 4 aa, Mycobacterium
RSPD

SEQ ID NO: 390631 - protein, 13 aa, Mycobacterium
RSPGGRQGRKPSR

SEQ ID NO: 390632 - protein, 4 aa, Mycobacterium
RSPT

SEQ ID NO: 390633 - protein, 7 aa, Mycobacterium
RSQHTTV

SEQ ID NO: 390634 - protein, 5 aa, Mycobacterium
RSQYP

SEQ ID NO: 390635 - protein, 4 aa, Mycobacterium
RSRD

SEQ ID NO: 390636 - protein, 7 aa, Mycobacterium
RSRPALR

SEQ ID NO: 390637 - protein, 9 aa, Mycobacterium
RSSDTAELS

SEQ ID NO: 390638 - protein, 16 aa, Mycobacterium
RSSGKGGQGVNTTDSA

SEQ ID NO: 390639 - protein, 23 aa, Mycobacterium
RSTATRRAKPAPAPADRAPRPVP

SEQ ID NO: 390640 - protein, 4 aa, Mycobacterium
RSTF

SEQ ID NO: 390641 - protein, 4 aa, Mycobacterium
RSTG

SEQ ID NO: 390642 - protein, 4 aa, Mycobacterium
RSVR

SEQ ID NO: 390643 - protein, 4 aa, Mycobacterium
RSYP

SEQ ID NO: 390644 - protein, 4 aa, Mycobacterium
RTAD

SEQ ID NO: 390645 - protein, 4 aa, Mycobacterium
RTAE

SEQ ID NO: 390646 - protein, 6 aa, Mycobacterium
RTAEEL

SEQ ID NO: 390647 - protein, 4 aa, Mycobacterium
RTAG

SEQ ID NO: 390648 - protein, 7 aa, Mycobacterium
RTENGEE

SEQ ID NO: 390649 - protein, 4 aa, Mycobacterium
RTEP

SEQ ID NO: 390650 - protein, 4 aa, Mycobacterium
RTGG

SEQ ID NO: 390651 - protein, 7 aa, Mycobacterium
RTGPTVA

SEQ ID NO: 390652 - protein, 9 aa, Mycobacterium
RTGRAGRTG

SEQ ID NO: 390653 - protein, 4 aa, Mycobacterium
RTGS

SEQ ID NO: 390654 - protein, 10 aa, Mycobacterium
RTKDQAGEMS

SEQ ID NO: 390655 - protein, 5 aa, Mycobacterium
RTKLT

SEQ ID NO: 390656 - protein, 10 aa, Mycobacterium
RTKNGPALAG

SEQ ID NO: 390657 - protein, 14 aa, Mycobacterium
RTKRDAPGLDTSGL

SEQ ID NO: 390658 - protein, 8 aa, Mycobacterium
RTLSEETT

SEQ ID NO: 390659 - protein, 18 aa, Mycobacterium
RTNERARLRNKSVKSSLR

SEQ ID NO: 390660 - protein, 4 aa, Mycobacterium
RTPE

SEQ ID NO: 390661 - protein, 9 aa, Mycobacterium
RTPERDGYS

SEQ ID NO: 390662 - protein, 6 aa, Mycobacterium
RTPGRG

SEQ ID NO: 390663 - protein, 7 aa, Mycobacterium
RTPPGAA

SEQ ID NO: 390664 - protein, 4 aa, Mycobacterium
RTPS

SEQ ID NO: 390665 - protein, 4 aa, Mycobacterium
RTRA

SEQ ID NO: 390666 - protein, 4 aa, Mycobacterium
RTRG

SEQ ID NO: 390667 - protein, 7 aa, Mycobacterium
RTRTRGE

SEQ ID NO: 390668 - protein, 6 aa, Mycobacterium
RTSKRT

SEQ ID NO: 390669 - protein, 5 aa, Mycobacterium
RTTHP

SEQ ID NO: 390670 - protein, 4 aa, Mycobacterium
RTTV

SEQ ID NO: 390671 - protein, 8 aa, Mycobacterium
RTVADPGS

SEQ ID NO: 390672 - protein, 12 aa, Mycobacterium
RTYGTLSEGERK

SEQ ID NO: 390673 - protein, 5 aa, Mycobacterium
RVADG

SEQ ID NO: 390674 - protein, 8 aa, Mycobacterium
RVRTPTTT

SEQ ID NO: 390675 - protein, 6 aa, Mycobacterium
RVSSGD

SEQ ID NO: 390676 - protein, 4 aa, Mycobacterium
RVTR

SEQ ID NO: 390677 - protein, 8 aa, Mycobacterium
RWGGDNTD

SEQ ID NO: 390678 - protein, 9 aa, Mycobacterium
RYDRDGDQH

SEQ ID NO: 390679 - protein, 5 aa, Mycobacterium
RYPDR

SEQ ID NO: 390680 - protein, 7 aa, Mycobacterium
RYSRRTK

SEQ ID NO: 390681 - protein, 4 aa, Mycobacterium
SAAA

SEQ ID NO: 390682 - protein, 16 aa, Mycobacterium
SAAAEGARQSRSAKQQ

SEQ ID NO: 390683 - protein, 5 aa, Mycobacterium
SAAAP

SEQ ID NO: 390684 - protein, 18 aa, Mycobacterium
SAAINPPKPAEQETETEA

SEQ ID NO: 390685 - protein, 4 aa, Mycobacterium
SAAQ

SEQ ID NO: 390686 - protein, 5 aa, Mycobacterium
SAATG

SEQ ID NO: 390687 - protein, 8 aa, Mycobacterium
SAATGGAF

SEQ ID NO: 390688 - protein, 6 aa, Mycobacterium
SAATRG

SEQ ID NO: 390689 - protein, 7 aa, Mycobacterium
SADDLAA

SEQ ID NO: 390690 - protein, 4 aa, Mycobacterium
SADG

SEQ ID NO: 390691 - protein, 8 aa, Mycobacterium
SADIERSE

SEQ ID NO: 390692 - protein, 8 aa, Mycobacterium
SADPQTSL

SEQ ID NO: 390693 - protein, 7 aa, Mycobacterium
SADPRRG

SEQ ID NO: 390694 - protein, 7 aa, Mycobacterium
SADQQAT

SEQ ID NO: 390695 - protein, 6 aa, Mycobacterium
SADRPT

SEQ ID NO: 390696 - protein, 7 aa, Mycobacterium
SAEGTRD

SEQ ID NO: 390697 - protein, 8 aa, Mycobacterium
SAETTQAL

SEQ ID NO: 390698 - protein, 8 aa, Mycobacterium
SAETTRAL

SEQ ID NO: 390699 - protein, 8 aa, Mycobacterium
SAGAALSD

SEQ ID NO: 390700 - protein, 5 aa, Mycobacterium
SAGAG

SEQ ID NO: 390701 - protein, 5 aa, Mycobacterium
SAGFD

SEQ ID NO: 390702 - protein, 5 aa, Mycobacterium
SAGGH

SEQ ID NO: 390703 - protein, 7 aa, Mycobacterium
SAGHPPP

SEQ ID NO: 390704 - protein, 9 aa, Mycobacterium
SAGPGPALA

SEQ ID NO: 390705 - protein, 7 aa, Mycobacterium
SAGRPCD

SEQ ID NO: 390706 - protein, 4 aa, Mycobacterium
SAGS

SEQ ID NO: 390707 - protein, 5 aa, Mycobacterium
SAHAP

SEQ ID NO: 390708 - protein, 8 aa, Mycobacterium
SAKKNEPE

SEQ ID NO: 390709 - protein, 4 aa, Mycobacterium
SALA

SEQ ID NO: 390710 - protein, 4 aa, Mycobacterium
SALP

SEQ ID NO: 390711 - protein, 27 aa, Mycobacterium
SALPNGPKVSHGGALSPRGDWRAPSDM

SEQ ID NO: 390712 - protein, 8 aa, Mycobacterium
SAPGFSDE

SEQ ID NO: 390713 - protein, 4 aa, Mycobacterium
SAPI

SEQ ID NO: 390714 - protein, 4 aa, Mycobacterium
SAPL

SEQ ID NO: 390715 - protein, 5 aa, Mycobacterium
SAPLP

SEQ ID NO: 390716 - protein, 4 aa, Mycobacterium
SAPV

SEQ ID NO: 390717 - protein, 7 aa, Mycobacterium
SAQRSLR

SEQ ID NO: 390718 - protein, 7 aa, Mycobacterium
SARETSL

SEQ ID NO: 390719 - protein, 4 aa, Mycobacterium
SARG

SEQ ID NO: 390720 - protein, 10 aa, Mycobacterium
SASATPGGSV

SEQ ID NO: 390721 - protein, 4 aa, Mycobacterium
SASD

SEQ ID NO: 390722 - protein, 8 aa, Mycobacterium
SASDLQSV

SEQ ID NO: 390723 - protein, 7 aa, Mycobacterium
SASGQLD

SEQ ID NO: 390724 - protein, 8 aa, Mycobacterium
SATEADDV

SEQ ID NO: 390725 - protein, 8 aa, Mycobacterium
SATESDDV

SEQ ID NO: 390726 - protein, 5 aa, Mycobacterium
SATQY

SEQ ID NO: 390727 - protein, 8 aa, Mycobacterium
SATSMRTG

SEQ ID NO: 390728 - protein, 5 aa, Mycobacterium
SATVR

SEQ ID NO: 390729 - protein, 6 aa, Mycobacterium
SAVNGL

SEQ ID NO: 390730 - protein, 8 aa, Mycobacterium
SAYGSGDF

SEQ ID NO: 390731 - protein, 8 aa, Mycobacterium
SDAGSQFT

SEQ ID NO: 390732 - protein, 4 aa, Mycobacterium
SDDE

SEQ ID NO: 390733 - protein, 4 aa, Mycobacterium
SDEA

SEQ ID NO: 390734 - protein, 4 aa, Mycobacterium
SDEE

SEQ ID NO: 390735 - protein, 8 aa, Mycobacterium
SDEGYEGR

SEQ ID NO: 390736 - protein, 4 aa, Mycobacterium
SDGA

SEQ ID NO: 390737 - protein, 5 aa, Mycobacterium
SDGGA

SEQ ID NO: 390738 - protein, 8 aa, Mycobacterium
SDGIGAAA

SEQ ID NO: 390739 - protein, 9 aa, Mycobacterium
SDGQKMSKS

SEQ ID NO: 390740 - protein, 5 aa, Mycobacterium
SDGRA

SEQ ID NO: 390741 - protein, 13 aa, Mycobacterium
SDGTESALQHGSK

SEQ ID NO: 390742 - protein, 4 aa, Mycobacterium
SDLE

SEQ ID NO: 390743 - protein, 4 aa, Mycobacterium
SDPA

SEQ ID NO: 390744 - protein, 8 aa, Mycobacterium
SDPDEAVE

SEQ ID NO: 390745 - protein, 9 aa, Mycobacterium
SDPDEAVEK

SEQ ID NO: 390746 - protein, 5 aa, Mycobacterium
SDPNW

SEQ ID NO: 390747 - protein, 8 aa, Mycobacterium
SDPSDVAR

SEQ ID NO: 390748 - protein, 4 aa, Mycobacterium
SDRD

SEQ ID NO: 390749 - protein, 7 aa, Mycobacterium
SDRVSAT

SEQ ID NO: 390750 - protein, 7 aa, Mycobacterium
SDSQAMG

SEQ ID NO: 390751 - protein, 4 aa, Mycobacterium
SDTT

SEQ ID NO: 390752 - protein, 5 aa, Mycobacterium
SDVER

SEQ ID NO: 390753 - protein, 4 aa, Mycobacterium
SEAD

SEQ ID NO: 390754 - protein, 4 aa, Mycobacterium
SEAE

SEQ ID NO: 390755 - protein, 9 aa, Mycobacterium
SEDAKEGPL

SEQ ID NO: 390756 - protein, 5 aa, Mycobacterium
SEEQL

SEQ ID NO: 390757 - protein, 4 aa, Mycobacterium
SEFG

SEQ ID NO: 390758 - protein, 4 aa, Mycobacterium
SEGD

SEQ ID NO: 390759 - protein, 4 aa, Mycobacterium
SEGR

SEQ ID NO: 390760 - protein, 11 aa, Mycobacterium
SEHAGTGEFSD

SEQ ID NO: 390761 - protein, 8 aa, Mycobacterium
SEKPESVQ

SEQ ID NO: 390762 - protein, 6 aa, Mycobacterium
SELDGH

SEQ ID NO: 390763 - protein, 4 aa, Mycobacterium
SELG

SEQ ID NO: 390764 - protein, 10 aa, Mycobacterium
SELGTGRGGP

SEQ ID NO: 390765 - protein, 4 aa, Mycobacterium
SELP

SEQ ID NO: 390766 - protein, 4 aa, Mycobacterium
SELT

SEQ ID NO: 390767 - protein, 5 aa, Mycobacterium
SENTH

SEQ ID NO: 390768 - protein, 9 aa, Mycobacterium
SEPGAGSDL

SEQ ID NO: 390769 - protein, 22 aa, Mycobacterium
SEREAGSDAASMRTRAKADGDD

SEQ ID NO: 390770 - protein, 4 aa, Mycobacterium
SERG

SEQ ID NO: 390771 - protein, 6 aa, Mycobacterium
SERGRV

SEQ ID NO: 390772 - protein, 7 aa, Mycobacterium
SERTGSV

SEQ ID NO: 390773 - protein, 12 aa, Mycobacterium
SESADTDTPPTK

SEQ ID NO: 390774 - protein, 4 aa, Mycobacterium
SESL

SEQ ID NO: 390775 - protein, 6 aa, Mycobacterium
SEVAPY

SEQ ID NO: 390776 - protein, 14 aa, Mycobacterium
SEYEDRDGNRRSSL

SEQ ID NO: 390777 - protein, 4 aa, Mycobacterium
SFGT

SEQ ID NO: 390778 - protein, 15 aa, Mycobacterium
SFGTATPAGSDEEAD

SEQ ID NO: 390779 - protein, 12 aa, Mycobacterium
SFTSGDNRLDSQ

SEQ ID NO: 390780 - protein, 4 aa, Mycobacterium
SGAA

SEQ ID NO: 390781 - protein, 6 aa, Mycobacterium
SGADRN

SEQ ID NO: 390782 - protein, 4 aa, Mycobacterium
SGAE

SEQ ID NO: 390783 - protein, 7 aa, Mycobacterium
SGAGERA

SEQ ID NO: 390784 - protein, 7 aa, Mycobacterium
SGAGLPG

SEQ ID NO: 390785 - protein, 8 aa, Mycobacterium
SGAPRGSA

SEQ ID NO: 390786 - protein, 4 aa, Mycobacterium
SGAQ

SEQ ID NO: 390787 - protein, 10 aa, Mycobacterium
SGATGNFTQT

SEQ ID NO: 390788 - protein, 8 aa, Mycobacterium
SGATQSMP

SEQ ID NO: 390789 - protein, 8 aa, Mycobacterium
SGATSQRP

SEQ ID NO: 390790 - protein, 6 aa, Mycobacterium
SGCGKT

SEQ ID NO: 390791 - protein, 8 aa, Mycobacterium
SGCGKTTT

SEQ ID NO: 390792 - protein, 6 aa, Mycobacterium
SGDGQV

SEQ ID NO: 390793 - protein, 7 aa, Mycobacterium
SGDGQVG

SEQ ID NO: 390794 - protein, 8 aa, Mycobacterium
SGDPQTGP

SEQ ID NO: 390795 - protein, 4 aa, Mycobacterium
SGEG

SEQ ID NO: 390796 - protein, 6 aa, Mycobacterium
SGEQDA

SEQ ID NO: 390797 - protein, 4 aa, Mycobacterium
SGET

SEQ ID NO: 390798 - protein, 8 aa, Mycobacterium
SGEWAGET

SEQ ID NO: 390799 - protein, 5 aa, Mycobacterium
SGFGR

SEQ ID NO: 390800 - protein, 4 aa, Mycobacterium
SGGE

SEQ ID NO: 390801 - protein, 7 aa, Mycobacterium
SGGEKSL

SEQ ID NO: 390802 - protein, 6 aa, Mycobacterium
SGGGPY

SEQ ID NO: 390803 - protein, 7 aa, Mycobacterium
SGGGRSE

SEQ ID NO: 390804 - protein, 5 aa, Mycobacterium
SGGGV

SEQ ID NO: 390805 - protein, 4 aa, Mycobacterium
SGGI

SEQ ID NO: 390806 - protein, 15 aa, Mycobacterium
SGGKAVAEVGTGAGV

SEQ ID NO: 390807 - protein, 7 aa, Mycobacterium
SGGPFRG

SEQ ID NO: 390808 - protein, 7 aa, Mycobacterium
SGGQQQR

SEQ ID NO: 390809 - protein, 9 aa, Mycobacterium
SGGRGPAER

SEQ ID NO: 390810 - protein, 9 aa, Mycobacterium
SGGYAKRTA

SEQ ID NO: 390811 - protein, 6 aa, Mycobacterium
SGHGAQ

SEQ ID NO: 390812 - protein, 9 aa, Mycobacterium
SGLAKPDGI

SEQ ID NO: 390813 - protein, 6 aa, Mycobacterium
SGLPAD

SEQ ID NO: 390814 - protein, 4 aa, Mycobacterium
SGNG

SEQ ID NO: 390815 - protein, 4 aa, Mycobacterium
SGNI

SEQ ID NO: 390816 - protein, 5 aa, Mycobacterium
SGNIG

SEQ ID NO: 390817 - protein, 5 aa, Mycobacterium
SGPGE

SEQ ID NO: 390818 - protein, 8 aa, Mycobacterium
SGPGSGPM

SEQ ID NO: 390819 - protein, 6 aa, Mycobacterium
SGPGVG

SEQ ID NO: 390820 - protein, 8 aa, Mycobacterium
SGPNRIGQ

SEQ ID NO: 390821 - protein, 5 aa, Mycobacterium
SGPQV

SEQ ID NO: 390822 - protein, 6 aa, Mycobacterium
SGQDAG

SEQ ID NO: 390823 - protein, 11 aa, Mycobacterium
SGQDTRRGTFS

SEQ ID NO: 390824 - protein, 13 aa, Mycobacterium
SGQEQNPDLTGQS

SEQ ID NO: 390825 - protein, 4 aa, Mycobacterium
SGQH

SEQ ID NO: 390826 - protein, 4 aa, Mycobacterium
SGQR

SEQ ID NO: 390827 - protein, 5 aa, Mycobacterium
SGREL

SEQ ID NO: 390828 - protein, 6 aa, Mycobacterium
SGRFGA

SEQ ID NO: 390829 - protein, 4 aa, Mycobacterium
SGRG

SEQ ID NO: 390830 - protein, 10 aa, Mycobacterium
SGRGSTYSAS

SEQ ID NO: 390831 - protein, 12 aa, Mycobacterium
SGRISGVTEPGE

SEQ ID NO: 390832 - protein, 4 aa, Mycobacterium
SGRL

SEQ ID NO: 390833 - protein, 6 aa, Mycobacterium
SGRPGA

SEQ ID NO: 390834 - protein, 5 aa, Mycobacterium
SGRQV

SEQ ID NO: 390835 - protein, 5 aa, Mycobacterium
SGRVP

SEQ ID NO: 390836 - protein, 7 aa, Mycobacterium
SGSFNTG

SEQ ID NO: 390837 - protein, 7 aa, Mycobacterium
SGSGKSS

SEQ ID NO: 390838 - protein, 4 aa, Mycobacterium
SGSL

SEQ ID NO: 390839 - protein, 4 aa, Mycobacterium
SGSR

SEQ ID NO: 390840 - protein, 12 aa, Mycobacterium
SGSTGEPKGVEV

SEQ ID NO: 390841 - protein, 5 aa, Mycobacterium
SGSVS

SEQ ID NO: 390842 - protein, 4 aa, Mycobacterium
SGTC

SEQ ID NO: 390843 - protein, 15 aa, Mycobacterium
SGTGNWGVGNSGEFD

SEQ ID NO: 390844 - protein, 8 aa, Mycobacterium
SGTSNGRL

SEQ ID NO: 390845 - protein, 13 aa, Mycobacterium
SGTTGHPKGVPTT

SEQ ID NO: 390846 - protein, 11 aa, Mycobacterium
SGTTGKPKGVG

SEQ ID NO: 390847 - protein, 11 aa, Mycobacterium
SGTTGPSKAVA

SEQ ID NO: 390848 - protein, 10 aa, Mycobacterium
SGTTGRPKGA

SEQ ID NO: 390849 - protein, 10 aa, Mycobacterium
SGTTGRPKGV

SEQ ID NO: 390850 - protein, 8 aa, Mycobacterium
SGTTGVPK

SEQ ID NO: 390851 - protein, 7 aa, Mycobacterium
SGTYRGK

SEQ ID NO: 390852 - protein, 8 aa, Mycobacterium
SGVETGSV

SEQ ID NO: 390853 - protein, 6 aa, Mycobacterium
SGVRGT

SEQ ID NO: 390854 - protein, 8 aa, Mycobacterium
SGVSEPFS

SEQ ID NO: 390855 - protein, 8 aa, Mycobacterium
SGVTEPFS

SEQ ID NO: 390856 - protein, 5 aa, Mycobacterium
SGYKY

SEQ ID NO: 390857 - protein, 10 aa, Mycobacterium
SHADDGGRAD

SEQ ID NO: 390858 - protein, 6 aa, Mycobacterium
SHASAA

SEQ ID NO: 390859 - protein, 9 aa, Mycobacterium
SHATGRPLP

SEQ ID NO: 390860 - protein, 4 aa, Mycobacterium
SHET

SEQ ID NO: 390861 - protein, 5 aa, Mycobacterium
SHGGD

SEQ ID NO: 390862 - protein, 4 aa, Mycobacterium
SHGW

SEQ ID NO: 390863 - protein, 6 aa, Mycobacterium
SHPATG

SEQ ID NO: 390864 - protein, 6 aa, Mycobacterium
SHSGSL

SEQ ID NO: 390865 - protein, 8 aa, Mycobacterium
SHTSTHGA

SEQ ID NO: 390866 - protein, 6 aa, Mycobacterium
SIDGTR

SEQ ID NO: 390867 - protein, 8 aa, Mycobacterium
SIPAPGLG

SEQ ID NO: 390868 - protein, 5 aa, Mycobacterium
SIPGV

SEQ ID NO: 390869 - protein, 10 aa, Mycobacterium
SISARGNATF

SEQ ID NO: 390870 - protein, 5 aa, Mycobacterium
SITAD

SEQ ID NO: 390871 - protein, 7 aa, Mycobacterium
SKAALSA

SEQ ID NO: 390872 - protein, 7 aa, Mycobacterium
SKGGYEA

SEQ ID NO: 390873 - protein, 7 aa, Mycobacterium
SKITDRT

SEQ ID NO: 390874 - protein, 7 aa, Mycobacterium
SKITERT

SEQ ID NO: 390875 - protein, 4 aa, Mycobacterium
SKLS

SEQ ID NO: 390876 - protein, 8 aa, Mycobacterium
SKNPSDDL

SEQ ID NO: 390877 - protein, 6 aa, Mycobacterium
SKQGRW

SEQ ID NO: 390878 - protein, 6 aa, Mycobacterium
SKQRGR

SEQ ID NO: 390879 - protein, 9 aa, Mycobacterium
SKSDPQFAQ

SEQ ID NO: 390880 - protein, 5 aa, Mycobacterium
SKSPD

SEQ ID NO: 390881 - protein, 9 aa, Mycobacterium
SKSSSLAGY

SEQ ID NO: 390882 - protein, 7 aa, Mycobacterium
SKTPVPQ

SEQ ID NO: 390883 - protein, 8 aa, Mycobacterium
SKTPVPQG

SEQ ID NO: 390884 - protein, 6 aa, Mycobacterium
SKTQQD

SEQ ID NO: 390885 - protein, 8 aa, Mycobacterium
SKTSSLAG

SEQ ID NO: 390886 - protein, 6 aa, Mycobacterium
SLAPGG

SEQ ID NO: 390887 - protein, 6 aa, Mycobacterium
SLDAEY

SEQ ID NO: 390888 - protein, 8 aa, Mycobacterium
SLDQGGPC

SEQ ID NO: 390889 - protein, 9 aa, Mycobacterium
SLDQGGPCA

SEQ ID NO: 390890 - protein, 4 aa, Mycobacterium
SLED

SEQ ID NO: 390891 - protein, 8 aa, Mycobacterium
SLGEPGGH

SEQ ID NO: 390892 - protein, 20 aa, Mycobacterium
SLGGAVGASRAAVDSGYYPG

SEQ ID NO: 390893 - protein, 11 aa, Mycobacterium
SLGGPETHHKK

SEQ ID NO: 390894 - protein, 6 aa, Mycobacterium
SLGHPR

SEQ ID NO: 390895 - protein, 8 aa, Mycobacterium
SLGPETSK

SEQ ID NO: 390896 - protein, 8 aa, Mycobacterium
SLHGGANE

SEQ ID NO: 390897 - protein, 6 aa, Mycobacterium
SLHNSQ

SEQ ID NO: 390898 - protein, 4 aa, Mycobacterium
SLPA

SEQ ID NO: 390899 - protein, 8 aa, Mycobacterium
SLPDTPAL

SEQ ID NO: 390900 - protein, 10 aa, Mycobacterium
SLPEEAKSMA

SEQ ID NO: 390901 - protein, 4 aa, Mycobacterium
SLRG

SEQ ID NO: 390902 - protein, 6 aa, Mycobacterium
SLRSGE

SEQ ID NO: 390903 - protein, 10 aa, Mycobacterium
SLTEPGRSSA

SEQ ID NO: 390904 - protein, 10 aa, Mycobacterium
SLTGHAKGGA

SEQ ID NO: 390905 - protein, 6 aa, Mycobacterium
SLTSTD

SEQ ID NO: 390906 - protein, 10 aa, Mycobacterium
SMGQENDGLD

SEQ ID NO: 390907 - protein, 11 aa, Mycobacterium
SMGSGVGNVGD

SEQ ID NO: 390908 - protein, 5 aa, Mycobacterium
SMPYK

SEQ ID NO: 390909 - protein, 4 aa, Mycobacterium
SNGV

SEQ ID NO: 390910 - protein, 6 aa, Mycobacterium
SNIYPR

SEQ ID NO: 390911 - protein, 4 aa, Mycobacterium
SNPD

SEQ ID NO: 390912 - protein, 4 aa, Mycobacterium
SNPQ

SEQ ID NO: 390913 - protein, 7 aa, Mycobacterium
SNPQYSA

SEQ ID NO: 390914 - protein, 4 aa, Mycobacterium
SNPV

SEQ ID NO: 390915 - protein, 6 aa, Mycobacterium
SNREDM

SEQ ID NO: 390916 - protein, 5 aa, Mycobacterium
SNRHT

SEQ ID NO: 390917 - protein, 7 aa, Mycobacterium
SNRTNPR

SEQ ID NO: 390918 - protein, 7 aa, Mycobacterium
SNVQTGA

SEQ ID NO: 390919 - protein, 4 aa, Mycobacterium
SPAE

SEQ ID NO: 390920 - protein, 7 aa, Mycobacterium
SPAISNR

SEQ ID NO: 390921 - protein, 4 aa, Mycobacterium
SPAQ

SEQ ID NO: 390922 - protein, 4 aa, Mycobacterium
SPDA

SEQ ID NO: 390923 - protein, 4 aa, Mycobacterium
SPDE

SEQ ID NO: 390924 - protein, 6 aa, Mycobacterium
SPEKLA

SEQ ID NO: 390925 - protein, 6 aa, Mycobacterium
SPELGG

SEQ ID NO: 390926 - protein, 7 aa, Mycobacterium
SPERRAG

SEQ ID NO: 390927 - protein, 10 aa, Mycobacterium
SPESYTGTEL

SEQ ID NO: 390928 - protein, 4 aa, Mycobacterium
SPET

SEQ ID NO: 390929 - protein, 5 aa, Mycobacterium
SPETV

SEQ ID NO: 390930 - protein, 4 aa, Mycobacterium
SPFA

SEQ ID NO: 390931 - protein, 5 aa, Mycobacterium
SPFTD

SEQ ID NO: 390932 - protein, 4 aa, Mycobacterium
SPGD

SEQ ID NO: 390933 - protein, 6 aa, Mycobacterium
SPGGSF

SEQ ID NO: 390934 - protein, 8 aa, Mycobacterium
SPHNRNAL

SEQ ID NO: 390935 - protein, 10 aa, Mycobacterium
SPHPSPLSAS

SEQ ID NO: 390936 - protein, 7 aa, Mycobacterium
SPLDTQR

SEQ ID NO: 390937 - protein, 4 aa, Mycobacterium
SPLG

SEQ ID NO: 390938 - protein, 6 aa, Mycobacterium
SPLSIT

SEQ ID NO: 390939 - protein, 4 aa, Mycobacterium
SPMD

SEQ ID NO: 390940 - protein, 4 aa, Mycobacterium
SPML

SEQ ID NO: 390941 - protein, 4 aa, Mycobacterium
SPPM

SEQ ID NO: 390942 - protein, 5 aa, Mycobacterium
SPPPV

SEQ ID NO: 390943 - protein, 5 aa, Mycobacterium
SPQAF

SEQ ID NO: 390944 - protein, 7 aa, Mycobacterium
SPQSTVI

SEQ ID NO: 390945 - protein, 7 aa, Mycobacterium
SPRPHDT

SEQ ID NO: 390946 - protein, 4 aa, Mycobacterium
SPSP

SEQ ID NO: 390947 - protein, 6 aa, Mycobacterium
SPVGDL

SEQ ID NO: 390948 - protein, 5 aa, Mycobacterium
SPYEN

SEQ ID NO: 390949 - protein, 6 aa, Mycobacterium
SPYPRQ

SEQ ID NO: 390950 - protein, 6 aa, Mycobacterium
SQANVA

SEQ ID NO: 390951 - protein, 4 aa, Mycobacterium
SQDV

SEQ ID NO: 390952 - protein, 7 aa, Mycobacterium
SQFEKPE

SEQ ID NO: 390953 - protein, 4 aa, Mycobacterium
SQGA

SEQ ID NO: 390954 - protein, 6 aa, Mycobacterium
SQLPTE

SEQ ID NO: 390955 - protein, 4 aa, Mycobacterium
SQLR

SEQ ID NO: 390956 - protein, 6 aa, Mycobacterium
SQPPTL

SEQ ID NO: 390957 - protein, 7 aa, Mycobacterium
SQPPWRP

SEQ ID NO: 390958 - protein, 19 aa, Mycobacterium
SQRSRNRHVGEQLGAGKPI

SEQ ID NO: 390959 - protein, 6 aa, Mycobacterium
SQVPDD

SEQ ID NO: 390960 - protein, 6 aa, Mycobacterium
SRAAVR

SEQ ID NO: 390961 - protein, 4 aa, Mycobacterium
SRDA

SEQ ID NO: 390962 - protein, 10 aa, Mycobacterium
SRDGHDGEDL

SEQ ID NO: 390963 - protein, 5 aa, Mycobacterium
SRDPV

SEQ ID NO: 390964 - protein, 6 aa, Mycobacterium
SREQVP

SEQ ID NO: 390965 - protein, 11 aa, Mycobacterium
SRERDGKAYRY

SEQ ID NO: 390966 - protein, 4 aa, Mycobacterium
SREY

SEQ ID NO: 390967 - protein, 5 aa, Mycobacterium
SRGFP

SEQ ID NO: 390968 - protein, 4 aa, Mycobacterium
SRGG

SEQ ID NO: 390969 - protein, 5 aa, Mycobacterium
SRNPE

SEQ ID NO: 390970 - protein, 6 aa, Mycobacterium
SRPDGW

SEQ ID NO: 390971 - protein, 9 aa, Mycobacterium
SRPDPTAKR

SEQ ID NO: 390972 - protein, 4 aa, Mycobacterium
SRPG

SEQ ID NO: 390973 - protein, 4 aa, Mycobacterium
SRRL

SEQ ID NO: 390974 - protein, 14 aa, Mycobacterium
SRRPDREWTNRPIA

SEQ ID NO: 390975 - protein, 7 aa, Mycobacterium
SRRRTPP

SEQ ID NO: 390976 - protein, 13 aa, Mycobacterium
SRRTRSSKDVSTA

SEQ ID NO: 390977 - protein, 5 aa, Mycobacterium
SRSGS

SEQ ID NO: 390978 - protein, 19 aa, Mycobacterium
SRSVGQGAATLKGEKRSGL

SEQ ID NO: 390979 - protein, 5 aa, Mycobacterium
SRSVP

SEQ ID NO: 390980 - protein, 6 aa, Mycobacterium
SRTESD

SEQ ID NO: 390981 - protein, 7 aa, Mycobacterium
SRTFTGG

SEQ ID NO: 390982 - protein, 4 aa, Mycobacterium
SRTP

SEQ ID NO: 390983 - protein, 9 aa, Mycobacterium
SRTPGNGQV

SEQ ID NO: 390984 - protein, 6 aa, Mycobacterium
SRTTDF

SEQ ID NO: 390985 - protein, 6 aa, Mycobacterium
SRTTHT

SEQ ID NO: 390986 - protein, 6 aa, Mycobacterium
SRYDEG

SEQ ID NO: 390987 - protein, 4 aa, Mycobacterium
SSAE

SEQ ID NO: 390988 - protein, 7 aa, Mycobacterium
SSARTAA

SEQ ID NO: 390989 - protein, 4 aa, Mycobacterium
SSDT

SEQ ID NO: 390990 - protein, 12 aa, Mycobacterium
SSEPDAGSDVGA

SEQ ID NO: 390991 - protein, 7 aa, Mycobacterium
SSESQER

SEQ ID NO: 390992 - protein, 5 aa, Mycobacterium
SSFRE

SEQ ID NO: 390993 - protein, 4 aa, Mycobacterium
SSGG

SEQ ID NO: 390994 - protein, 5 aa, Mycobacterium
SSGIG

SEQ ID NO: 390995 - protein, 15 aa, Mycobacterium
SSGKGGQGVNTTDSA

SEQ ID NO: 390996 - protein, 9 aa, Mycobacterium
SSGPGPGPL

SEQ ID NO: 390997 - protein, 6 aa, Mycobacterium
SSHGTH

SEQ ID NO: 390998 - protein, 7 aa, Mycobacterium
SSIAPGA

SEQ ID NO: 390999 - protein, 7 aa, Mycobacterium
SSIKRSQ

SEQ ID NO: 391000 - protein, 10 aa, Mycobacterium
SSKNAAKLRG

SEQ ID NO: 391001 - protein, 5 aa, Mycobacterium
SSKTF

SEQ ID NO: 391002 - protein, 18 aa, Mycobacterium
SSPATYERNLTPATLPEA

SEQ ID NO: 391003 - protein, 6 aa, Mycobacterium
SSPDAM

SEQ ID NO: 391004 - protein, 9 aa, Mycobacterium
SSPGAFGEP

SEQ ID NO: 391005 - protein, 9 aa, Mycobacterium
SSPNTPGLR

SEQ ID NO: 391006 - protein, 6 aa, Mycobacterium
SSPTSM

SEQ ID NO: 391007 - protein, 6 aa, Mycobacterium
SSPWTY

SEQ ID NO: 391008 - protein, 5 aa, Mycobacterium
SSPYQ

SEQ ID NO: 391009 - protein, 4 aa, Mycobacterium
SSQP

SEQ ID NO: 391010 - protein, 5 aa, Mycobacterium
SSRRS

SEQ ID NO: 391011 - protein, 4 aa, Mycobacterium
SSSV

SEQ ID NO: 391012 - protein, 4 aa, Mycobacterium
SSTA

SEQ ID NO: 391013 - protein, 5 aa, Mycobacterium
SSTPG

SEQ ID NO: 391014 - protein, 4 aa, Mycobacterium
SSTV

SEQ ID NO: 391015 - protein, 7 aa, Mycobacterium
SSVGATA

SEQ ID NO: 391016 - protein, 8 aa, Mycobacterium
SSVGSGVR

SEQ ID NO: 391017 - protein, 6 aa, Mycobacterium
SSWDDY

SEQ ID NO: 391018 - protein, 4 aa, Mycobacterium
SSYR

SEQ ID NO: 391019 - protein, 4 aa, Mycobacterium
STAE

SEQ ID NO: 391020 - protein, 9 aa, Mycobacterium
STAGPSAIR

SEQ ID NO: 391021 - protein, 8 aa, Mycobacterium
STAGTGYT

SEQ ID NO: 391022 - protein, 4 aa, Mycobacterium
STAK

SEQ ID NO: 391023 - protein, 4 aa, Mycobacterium
STDA

SEQ ID NO: 391024 - protein, 10 aa, Mycobacterium
STDDPDEGEA

SEQ ID NO: 391025 - protein, 4 aa, Mycobacterium
STDL

SEQ ID NO: 391026 - protein, 6 aa, Mycobacterium
STDSND

SEQ ID NO: 391027 - protein, 16 aa, Mycobacterium
STEDAQDPEASRSWQK

SEQ ID NO: 391028 - protein, 7 aa, Mycobacterium
STGAKND

SEQ ID NO: 391029 - protein, 11 aa, Mycobacterium
STGGIRPDQPG

SEQ ID NO: 391030 - protein, 4 aa, Mycobacterium
STGP

SEQ ID NO: 391031 - protein, 9 aa, Mycobacterium
STGQKCTAT

SEQ ID NO: 391032 - protein, 6 aa, Mycobacterium
STGTQE

SEQ ID NO: 391033 - protein, 10 aa, Mycobacterium
STHSEEEATT

SEQ ID NO: 391034 - protein, 4 aa, Mycobacterium
STIP

SEQ ID NO: 391035 - protein, 11 aa, Mycobacterium
STIRTGRANPG

SEQ ID NO: 391036 - protein, 4 aa, Mycobacterium
STLG

SEQ ID NO: 391037 - protein, 5 aa, Mycobacterium
STPAY

SEQ ID NO: 391038 - protein, 4 aa, Mycobacterium
STPG

SEQ ID NO: 391039 - protein, 6 aa, Mycobacterium
STPHAA

SEQ ID NO: 391040 - protein, 7 aa, Mycobacterium
STPTRTA

SEQ ID NO: 391041 - protein, 6 aa, Mycobacterium
STPVSE

SEQ ID NO: 391042 - protein, 9 aa, Mycobacterium
STQGTGMGG

SEQ ID NO: 391043 - protein, 6 aa, Mycobacterium
STSASF

SEQ ID NO: 391044 - protein, 9 aa, Mycobacterium
STSELPGEL

SEQ ID NO: 391045 - protein, 4 aa, Mycobacterium
STSR

SEQ ID NO: 391046 - protein, 9 aa, Mycobacterium
SVADSSQSA

SEQ ID NO: 391047 - protein, 9 aa, Mycobacterium
SVAEPEGAA

SEQ ID NO: 391048 - protein, 9 aa, Mycobacterium
SVAPAGPTL

SEQ ID NO: 391049 - protein, 5 aa, Mycobacterium
SVGAT

SEQ ID NO: 391050 - protein, 6 aa, Mycobacterium
SVGDSF

SEQ ID NO: 391051 - protein, 6 aa, Mycobacterium
SVGPYA

SEQ ID NO: 391052 - protein, 7 aa, Mycobacterium
SVGRGRH

SEQ ID NO: 391053 - protein, 8 aa, Mycobacterium
SVNAASDA

SEQ ID NO: 391054 - protein, 9 aa, Mycobacterium
SVSAASAAI

SEQ ID NO: 391055 - protein, 6 aa, Mycobacterium
SVTGED

SEQ ID NO: 391056 - protein, 7 aa, Mycobacterium
SVTGEDV

SEQ ID NO: 391057 - protein, 10 aa, Mycobacterium
SVTSNTRADA

SEQ ID NO: 391058 - protein, 9 aa, Mycobacterium
SWKDSPPAE

SEQ ID NO: 391059 - protein, 10 aa, Mycobacterium
SWPDNASLDK

SEQ ID NO: 391060 - protein, 12 aa, Mycobacterium
SWTGRAEVERET

SEQ ID NO: 391061 - protein, 6 aa, Mycobacterium
SYAPMG

SEQ ID NO: 391062 - protein, 4 aa, Mycobacterium
SYGG

SEQ ID NO: 391063 - protein, 7 aa, Mycobacterium
SYGMSGT

SEQ ID NO: 391064 - protein, 6 aa, Mycobacterium
SYGTLG

SEQ ID NO: 391065 - protein, 4 aa, Mycobacterium
SYSE

SEQ ID NO: 391066 - protein, 4 aa, Mycobacterium
SYTM

SEQ ID NO: 391067 - protein, 4 aa, Mycobacterium
TAAD

SEQ ID NO: 391068 - protein, 5 aa, Mycobacterium
TAADT

SEQ ID NO: 391069 - protein, 8 aa, Mycobacterium
TAAGGNAA

SEQ ID NO: 391070 - protein, 11 aa, Mycobacterium
TAAPGNGAALG

SEQ ID NO: 391071 - protein, 9 aa, Mycobacterium
TADDTDPTE

SEQ ID NO: 391072 - protein, 10 aa, Mycobacterium
TADDTDPTER

SEQ ID NO: 391073 - protein, 7 aa, Mycobacterium
TADEPKL

SEQ ID NO: 391074 - protein, 7 aa, Mycobacterium
TADGPAL

SEQ ID NO: 391075 - protein, 6 aa, Mycobacterium
TADPAS

SEQ ID NO: 391076 - protein, 8 aa, Mycobacterium
TAEGNHLG

SEQ ID NO: 391077 - protein, 4 aa, Mycobacterium
TAEL

SEQ ID NO: 391078 - protein, 10 aa, Mycobacterium
TAEPGRDPIS

SEQ ID NO: 391079 - protein, 4 aa, Mycobacterium
TAEQ

SEQ ID NO: 391080 - protein, 6 aa, Mycobacterium
TAEREK

SEQ ID NO: 391081 - protein, 8 aa, Mycobacterium
TAERGGQV

SEQ ID NO: 391082 - protein, 4 aa, Mycobacterium
TAFG

SEQ ID NO: 391083 - protein, 5 aa, Mycobacterium
TAGAD

SEQ ID NO: 391084 - protein, 4 aa, Mycobacterium
TAGE

SEQ ID NO: 391085 - protein, 4 aa, Mycobacterium
TAGG

SEQ ID NO: 391086 - protein, 5 aa, Mycobacterium
TAGGV

SEQ ID NO: 391087 - protein, 8 aa, Mycobacterium
TAGPKEAR

SEQ ID NO: 391088 - protein, 4 aa, Mycobacterium
TAKN

SEQ ID NO: 391089 - protein, 6 aa, Mycobacterium
TAKPYF

SEQ ID NO: 391090 - protein, 10 aa, Mycobacterium
TALGTGRGEE

SEQ ID NO: 391091 - protein, 6 aa, Mycobacterium
TALKGP

SEQ ID NO: 391092 - protein, 9 aa, Mycobacterium
TANGKLDRR

SEQ ID NO: 391093 - protein, 7 aa, Mycobacterium
TANGPLA

SEQ ID NO: 391094 - protein, 12 aa, Mycobacterium
TAPEYSRSSEYC

SEQ ID NO: 391095 - protein, 6 aa, Mycobacterium
TAPFTD

SEQ ID NO: 391096 - protein, 6 aa, Mycobacterium
TAPGDL

SEQ ID NO: 391097 - protein, 6 aa, Mycobacterium
TAPGEL

SEQ ID NO: 391098 - protein, 7 aa, Mycobacterium
TAPGGRT

SEQ ID NO: 391099 - protein, 4 aa, Mycobacterium
TAPP

SEQ ID NO: 391100 - protein, 8 aa, Mycobacterium
TAPPGDGQ

SEQ ID NO: 391101 - protein, 9 aa, Mycobacterium
TAPTNGAAG

SEQ ID NO: 391102 - protein, 4 aa, Mycobacterium
TAQR

SEQ ID NO: 391103 - protein, 6 aa, Mycobacterium
TAREPH

SEQ ID NO: 391104 - protein, 4 aa, Mycobacterium
TARG

SEQ ID NO: 391105 - protein, 4 aa, Mycobacterium
TARQ

SEQ ID NO: 391106 - protein, 4 aa, Mycobacterium
TARR

SEQ ID NO: 391107 - protein, 4 aa, Mycobacterium
TARS

SEQ ID NO: 391108 - protein, 4 aa, Mycobacterium
TASG

SEQ ID NO: 391109 - protein, 8 aa, Mycobacterium
TATAGTDA

SEQ ID NO: 391110 - protein, 4 aa, Mycobacterium
TATD

SEQ ID NO: 391111 - protein, 4 aa, Mycobacterium
TATE

SEQ ID NO: 391112 - protein, 8 aa, Mycobacterium
TATGIAGT

SEQ ID NO: 391113 - protein, 7 aa, Mycobacterium
TATTGGK

SEQ ID NO: 391114 - protein, 9 aa, Mycobacterium
TAVRDGDSY

SEQ ID NO: 391115 - protein, 9 aa, Mycobacterium
TAVRGEAPK

SEQ ID NO: 391116 - protein, 8 aa, Mycobacterium
TCRPDNTL

SEQ ID NO: 391117 - protein, 6 aa, Mycobacterium
TDAESQ

SEQ ID NO: 391118 - protein, 8 aa, Mycobacterium
TDAETDEV

SEQ ID NO: 391119 - protein, 4 aa, Mycobacterium
TDAP

SEQ ID NO: 391120 - protein, 10 aa, Mycobacterium
TDAQRDSEES

SEQ ID NO: 391121 - protein, 24 aa, Mycobacterium
TDDGVPSPSQYDPARNRHRDPRGW

SEQ ID NO: 391122 - protein, 8 aa, Mycobacterium
TDDPGVQD

SEQ ID NO: 391123 - protein, 5 aa, Mycobacterium
TDEEA

SEQ ID NO: 391124 - protein, 4 aa, Mycobacterium
TDEQ

SEQ ID NO: 391125 - protein, 6 aa, Mycobacterium
TDEQAL

SEQ ID NO: 391126 - protein, 4 aa, Mycobacterium
TDEV

SEQ ID NO: 391127 - protein, 7 aa, Mycobacterium
TDGGIRD

SEQ ID NO: 391128 - protein, 6 aa, Mycobacterium
TDGPPV

SEQ ID NO: 391129 - protein, 10 aa, Mycobacterium
TDGSGRDAAA

SEQ ID NO: 391130 - protein, 6 aa, Mycobacterium
TDGSRI

SEQ ID NO: 391131 - protein, 6 aa, Mycobacterium
TDGSTA

SEQ ID NO: 391132 - protein, 5 aa, Mycobacterium
TDHPA

SEQ ID NO: 391133 - protein, 5 aa, Mycobacterium
TDNEA

SEQ ID NO: 391134 - protein, 10 aa, Mycobacterium
TDPDAPKHKG

SEQ ID NO: 391135 - protein, 9 aa, Mycobacterium
TDPDTAPAV

SEQ ID NO: 391136 - protein, 5 aa, Mycobacterium
TDPDV

SEQ ID NO: 391137 - protein, 8 aa, Mycobacterium
TDPEAGHK

SEQ ID NO: 391138 - protein, 7 aa, Mycobacterium
TDPEAVK

SEQ ID NO: 391139 - protein, 5 aa, Mycobacterium
TDPGA

SEQ ID NO: 391140 - protein, 6 aa, Mycobacterium
TDPNSV

SEQ ID NO: 391141 - protein, 9 aa, Mycobacterium
TDPSQGAAG

SEQ ID NO: 391142 - protein, 4 aa, Mycobacterium
TDRE

SEQ ID NO: 391143 - protein, 5 aa, Mycobacterium
TDTPG

SEQ ID NO: 391144 - protein, 6 aa, Mycobacterium
TDTPGF

SEQ ID NO: 391145 - protein, 5 aa, Mycobacterium
TDTQR

SEQ ID NO: 391146 - protein, 5 aa, Mycobacterium
TDVPN

SEQ ID NO: 391147 - protein, 4 aa, Mycobacterium
TDVT

SEQ ID NO: 391148 - protein, 7 aa, Mycobacterium
TDYPAAA

SEQ ID NO: 391149 - protein, 4 aa, Mycobacterium
TEAA

SEQ ID NO: 391150 - protein, 9 aa, Mycobacterium
TEAGETAIG

SEQ ID NO: 391151 - protein, 6 aa, Mycobacterium
TEAGVS

SEQ ID NO: 391152 - protein, 9 aa, Mycobacterium
TEDGANITK

SEQ ID NO: 391153 - protein, 9 aa, Mycobacterium
TEEAKTGKL

SEQ ID NO: 391154 - protein, 5 aa, Mycobacterium
TEFGG

SEQ ID NO: 391155 - protein, 11 aa, Mycobacterium
TEFSKESGRSE

SEQ ID NO: 391156 - protein, 4 aa, Mycobacterium
TEGI

SEQ ID NO: 391157 - protein, 4 aa, Mycobacterium
TEGL

SEQ ID NO: 391158 - protein, 5 aa, Mycobacterium
TEGNT

SEQ ID NO: 391159 - protein, 5 aa, Mycobacterium
TEGYT

SEQ ID NO: 391160 - protein, 5 aa, Mycobacterium
TELPD

SEQ ID NO: 391161 - protein, 7 aa, Mycobacterium
TELSPEH

SEQ ID NO: 391162 - protein, 5 aa, Mycobacterium
TEPAA

SEQ ID NO: 391163 - protein, 5 aa, Mycobacterium
TEPAE

SEQ ID NO: 391164 - protein, 4 aa, Mycobacterium
TEPE

SEQ ID NO: 391165 - protein, 12 aa, Mycobacterium
TEPGGGSDLQNM

SEQ ID NO: 391166 - protein, 12 aa, Mycobacterium
TEPGTGSDLQSV

SEQ ID NO: 391167 - protein, 4 aa, Mycobacterium
TEPH

SEQ ID NO: 391168 - protein, 11 aa, Mycobacterium
TEQTESLGPQS

SEQ ID NO: 391169 - protein, 11 aa, Mycobacterium
TERDSDYAGAL

SEQ ID NO: 391170 - protein, 4 aa, Mycobacterium
TERH

SEQ ID NO: 391171 - protein, 8 aa, Mycobacterium
TERPPAKP

SEQ ID NO: 391172 - protein, 5 aa, Mycobacterium
TESEC

SEQ ID NO: 391173 - protein, 12 aa, Mycobacterium
TESYQREPAPED

SEQ ID NO: 391174 - protein, 4 aa, Mycobacterium
TETE

SEQ ID NO: 391175 - protein, 6 aa, Mycobacterium
TETRDE

SEQ ID NO: 391176 - protein, 4 aa, Mycobacterium
TEVP

SEQ ID NO: 391177 - protein, 4 aa, Mycobacterium
TEYG

SEQ ID NO: 391178 - protein, 7 aa, Mycobacterium
TFDGSAK

SEQ ID NO: 391179 - protein, 13 aa, Mycobacterium
TGAAPSGAGPRVK

SEQ ID NO: 391180 - protein, 4 aa, Mycobacterium
TGAE

SEQ ID NO: 391181 - protein, 4 aa, Mycobacterium
TGAG

SEQ ID NO: 391182 - protein, 9 aa, Mycobacterium
TGAGSDDDL

SEQ ID NO: 391183 - protein, 6 aa, Mycobacterium
TGAKND

SEQ ID NO: 391184 - protein, 12 aa, Mycobacterium
TGALTGKTRRAL

SEQ ID NO: 391185 - protein, 5 aa, Mycobacterium
TGAPT

SEQ ID NO: 391186 - protein, 6 aa, Mycobacterium
TGAQTG

SEQ ID NO: 391187 - protein, 9 aa, Mycobacterium
TGASKGSIA

SEQ ID NO: 391188 - protein, 4 aa, Mycobacterium
TGAV

SEQ ID NO: 391189 - protein, 4 aa, Mycobacterium
TGDD

SEQ ID NO: 391190 - protein, 4 aa, Mycobacterium
TGDE

SEQ ID NO: 391191 - protein, 4 aa, Mycobacterium
TGDG

SEQ ID NO: 391192 - protein, 5 aa, Mycobacterium
TGDLA

SEQ ID NO: 391193 - protein, 4 aa, Mycobacterium
TGDP

SEQ ID NO: 391194 - protein, 8 aa, Mycobacterium
TGDRSGDQ

SEQ ID NO: 391195 - protein, 4 aa, Mycobacterium
TGDY

SEQ ID NO: 391196 - protein, 8 aa, Mycobacterium
TGEGKTLA

SEQ ID NO: 391197 - protein, 4 aa, Mycobacterium
TGEP

SEQ ID NO: 391198 - protein, 8 aa, Mycobacterium
TGEPLGSM

SEQ ID NO: 391199 - protein, 7 aa, Mycobacterium
TGETRGA

SEQ ID NO: 391200 - protein, 8 aa, Mycobacterium
TGFGTPSD

SEQ ID NO: 391201 - protein, 8 aa, Mycobacterium
TGFTPAPG

SEQ ID NO: 391202 - protein, 6 aa, Mycobacterium
TGGASN

SEQ ID NO: 391203 - protein, 5 aa, Mycobacterium
TGGET

SEQ ID NO: 391204 - protein, 4 aa, Mycobacterium
TGGG

SEQ ID NO: 391205 - protein, 10 aa, Mycobacterium
TGGGAGIGRG

SEQ ID NO: 391206 - protein, 6 aa, Mycobacterium
TGGGFG

SEQ ID NO: 391207 - protein, 5 aa, Mycobacterium
TGGSE

SEQ ID NO: 391208 - protein, 6 aa, Mycobacterium
TGGTIA

SEQ ID NO: 391209 - protein, 7 aa, Mycobacterium
TGHGTTM

SEQ ID NO: 391210 - protein, 7 aa, Mycobacterium
TGHHGGY

SEQ ID NO: 391211 - protein, 12 aa, Mycobacterium
TGHRGDALLIGV

SEQ ID NO: 391212 - protein, 10 aa, Mycobacterium
TGKAPPAARA

SEQ ID NO: 391213 - protein, 4 aa, Mycobacterium
TGKP

SEQ ID NO: 391214 - protein, 4 aa, Mycobacterium
TGLE

SEQ ID NO: 391215 - protein, 5 aa, Mycobacterium
TGLEQ

SEQ ID NO: 391216 - protein, 7 aa, Mycobacterium
TGLPRAT

SEQ ID NO: 391217 - protein, 5 aa, Mycobacterium
TGLRE

SEQ ID NO: 391218 - protein, 6 aa, Mycobacterium
TGMGRT

SEQ ID NO: 391219 - protein, 6 aa, Mycobacterium
TGMTDE

SEQ ID NO: 391220 - protein, 9 aa, Mycobacterium
TGNNPKAKR

SEQ ID NO: 391221 - protein, 11 aa, Mycobacterium
TGPGKGKSTAA

SEQ ID NO: 391222 - protein, 9 aa, Mycobacterium
TGPGPLTER

SEQ ID NO: 391223 - protein, 4 aa, Mycobacterium
TGQR

SEQ ID NO: 391224 - protein, 4 aa, Mycobacterium
TGQT

SEQ ID NO: 391225 - protein, 8 aa, Mycobacterium
TGRDAADT

SEQ ID NO: 391226 - protein, 10 aa, Mycobacterium
TGRDPTQPRD

SEQ ID NO: 391227 - protein, 10 aa, Mycobacterium
TGREQPGTAA

SEQ ID NO: 391228 - protein, 11 aa, Mycobacterium
TGRNGPTPTHV

SEQ ID NO: 391229 - protein, 4 aa, Mycobacterium
TGRP

SEQ ID NO: 391230 - protein, 4 aa, Mycobacterium
TGRR

SEQ ID NO: 391231 - protein, 5 aa, Mycobacterium
TGRTA

SEQ ID NO: 391232 - protein, 5 aa, Mycobacterium
TGRVD

SEQ ID NO: 391233 - protein, 7 aa, Mycobacterium
TGSATAA

SEQ ID NO: 391234 - protein, 10 aa, Mycobacterium
TGSDEDISRL

SEQ ID NO: 391235 - protein, 7 aa, Mycobacterium
TGSGQVG

SEQ ID NO: 391236 - protein, 18 aa, Mycobacterium
TGSNDPQKFDPDASRETL

SEQ ID NO: 391237 - protein, 9 aa, Mycobacterium
TGSNPKAKR

SEQ ID NO: 391238 - protein, 8 aa, Mycobacterium
TGSTEVGK

SEQ ID NO: 391239 - protein, 5 aa, Mycobacterium
TGTGF

SEQ ID NO: 391240 - protein, 8 aa, Mycobacterium
TGTGNSLN

SEQ ID NO: 391241 - protein, 4 aa, Mycobacterium
TGTP

SEQ ID NO: 391242 - protein, 8 aa, Mycobacterium
TGTQGEPM

SEQ ID NO: 391243 - protein, 9 aa, Mycobacterium
TGTQGEPMS

SEQ ID NO: 391244 - protein, 61 aa, Mycobacterium
TGVGNAGDYNSGSFNTGASNTGDLNAGDTNTGWANTGNLNTGFGNSGHLNTGGFNQGSQNN

SEQ ID NO: 391245 - protein, 4 aa, Mycobacterium
TGWG

SEQ ID NO: 391246 - protein, 6 aa, Mycobacterium
THCGGQ

SEQ ID NO: 391247 - protein, 10 aa, Mycobacterium
THDPATPYQA

SEQ ID NO: 391248 - protein, 5 aa, Mycobacterium
THGST

SEQ ID NO: 391249 - protein, 17 aa, Mycobacterium
THPATTTHRAMGPEGRA

SEQ ID NO: 391250 - protein, 4 aa, Mycobacterium
THPS

SEQ ID NO: 391251 - protein, 6 aa, Mycobacterium
THQRGS

SEQ ID NO: 391252 - protein, 10 aa, Mycobacterium
TIAQASPPDM

SEQ ID NO: 391253 - protein, 6 aa, Mycobacterium
TIPDKG

SEQ ID NO: 391254 - protein, 10 aa, Mycobacterium
TISERAGVAR

SEQ ID NO: 391255 - protein, 4 aa, Mycobacterium
TITA

SEQ ID NO: 391256 - protein, 5 aa, Mycobacterium
TKATG

SEQ ID NO: 391257 - protein, 8 aa, Mycobacterium
TKDPDKFV

SEQ ID NO: 391258 - protein, 10 aa, Mycobacterium
TKEHSAEYQS

SEQ ID NO: 391259 - protein, 13 aa, Mycobacterium
TKEHSAEYQSQAP

SEQ ID NO: 391260 - protein, 7 aa, Mycobacterium
TKKQGND

SEQ ID NO: 391261 - protein, 6 aa, Mycobacterium
TKTADW

SEQ ID NO: 391262 - protein, 8 aa, Mycobacterium
TKTKDEAM

SEQ ID NO: 391263 - protein, 9 aa, Mycobacterium
TLAGDDDCP

SEQ ID NO: 391264 - protein, 5 aa, Mycobacterium
TLAGR

SEQ ID NO: 391265 - protein, 4 aa, Mycobacterium
TLDP

SEQ ID NO: 391266 - protein, 7 aa, Mycobacterium
TLPNRDG

SEQ ID NO: 391267 - protein, 11 aa, Mycobacterium
TLTAPTTTPAI

SEQ ID NO: 391268 - protein, 4 aa, Mycobacterium
TLTH

SEQ ID NO: 391269 - protein, 12 aa, Mycobacterium
TLVTGGKRLDPG

SEQ ID NO: 391270 - protein, 6 aa, Mycobacterium
TLYDAG

SEQ ID NO: 391271 - protein, 11 aa, Mycobacterium
TMGNRGNSTGP

SEQ ID NO: 391272 - protein, 15 aa, Mycobacterium
TMNDGEGSGVAPTDA

SEQ ID NO: 391273 - protein, 4 aa, Mycobacterium
TNAG

SEQ ID NO: 391274 - protein, 6 aa, Mycobacterium
TNATAA

SEQ ID NO: 391275 - protein, 10 aa, Mycobacterium
TNDGGAARRF

SEQ ID NO: 391276 - protein, 6 aa, Mycobacterium
TNEGLR

SEQ ID NO: 391277 - protein, 5 aa, Mycobacterium
TNHLD

SEQ ID NO: 391278 - protein, 8 aa, Mycobacterium
TNHVDGNT

SEQ ID NO: 391279 - protein, 4 aa, Mycobacterium
TNLT

SEQ ID NO: 391280 - protein, 6 aa, Mycobacterium
TNNLPD

SEQ ID NO: 391281 - protein, 4 aa, Mycobacterium
TNPA

SEQ ID NO: 391282 - protein, 10 aa, Mycobacterium
TNPDAAAHQQ

SEQ ID NO: 391283 - protein, 10 aa, Mycobacterium
TNPDGTPTGG

SEQ ID NO: 391284 - protein, 8 aa, Mycobacterium
TNPDVPKH

SEQ ID NO: 391285 - protein, 9 aa, Mycobacterium
TNPEAKKHR

SEQ ID NO: 391286 - protein, 8 aa, Mycobacterium
TNPGQGVP

SEQ ID NO: 391287 - protein, 6 aa, Mycobacterium
TNPIES

SEQ ID NO: 391288 - protein, 6 aa, Mycobacterium
TNPQQQ

SEQ ID NO: 391289 - protein, 25 aa, Mycobacterium
TNPRPPVSDPLPQKHRAYPSRIDEA

SEQ ID NO: 391290 - protein, 11 aa, Mycobacterium
TNPTSAPTEPQ

SEQ ID NO: 391291 - protein, 9 aa, Mycobacterium
TNPVADSPV

SEQ ID NO: 391292 - protein, 17 aa, Mycobacterium
TNSEIPGVGPSESEVGP

SEQ ID NO: 391293 - protein, 8 aa, Mycobacterium
TNTPMTDD

SEQ ID NO: 391294 - protein, 7 aa, Mycobacterium
TNYSAAK

SEQ ID NO: 391295 - protein, 5 aa, Mycobacterium
TPADV

SEQ ID NO: 391296 - protein, 10 aa, Mycobacterium
TPAELGGVNP

SEQ ID NO: 391297 - protein, 4 aa, Mycobacterium
TPAG

SEQ ID NO: 391298 - protein, 4 aa, Mycobacterium
TPAR

SEQ ID NO: 391299 - protein, 8 aa, Mycobacterium
TPARNADA

SEQ ID NO: 391300 - protein, 5 aa, Mycobacterium
TPATL

SEQ ID NO: 391301 - protein, 4 aa, Mycobacterium
TPDA

SEQ ID NO: 391302 - protein, 7 aa, Mycobacterium
TPDAATD

SEQ ID NO: 391303 - protein, 6 aa, Mycobacterium
TPDDVE

SEQ ID NO: 391304 - protein, 5 aa, Mycobacterium
TPDQP

SEQ ID NO: 391305 - protein, 4 aa, Mycobacterium
TPEA

SEQ ID NO: 391306 - protein, 4 aa, Mycobacterium
TPED

SEQ ID NO: 391307 - protein, 6 aa, Mycobacterium
TPEFTT

SEQ ID NO: 391308 - protein, 7 aa, Mycobacterium
TPEGPNI

SEQ ID NO: 391309 - protein, 5 aa, Mycobacterium
TPEHQ

SEQ ID NO: 391310 - protein, 7 aa, Mycobacterium
TPEHTAR

SEQ ID NO: 391311 - protein, 8 aa, Mycobacterium
TPEPMRPG

SEQ ID NO: 391312 - protein, 7 aa, Mycobacterium
TPEPQTV

SEQ ID NO: 391313 - protein, 6 aa, Mycobacterium
TPEQQQ

SEQ ID NO: 391314 - protein, 5 aa, Mycobacterium
TPERF

SEQ ID NO: 391315 - protein, 12 aa, Mycobacterium
TPERPDDADNPL

SEQ ID NO: 391316 - protein, 5 aa, Mycobacterium
TPERR

SEQ ID NO: 391317 - protein, 4 aa, Mycobacterium
TPES

SEQ ID NO: 391318 - protein, 6 aa, Mycobacterium
TPETPL

SEQ ID NO: 391319 - protein, 4 aa, Mycobacterium
TPEY

SEQ ID NO: 391320 - protein, 4 aa, Mycobacterium
TPFT

SEQ ID NO: 391321 - protein, 4 aa, Mycobacterium
TPGT

SEQ ID NO: 391322 - protein, 4 aa, Mycobacterium
TPGY

SEQ ID NO: 391323 - protein, 5 aa, Mycobacterium
TPHEE

SEQ ID NO: 391324 - protein, 15 aa, Mycobacterium
TPIGTARKGTLRDTS

SEQ ID NO: 391325 - protein, 8 aa, Mycobacterium
TPIPGEDD

SEQ ID NO: 391326 - protein, 4 aa, Mycobacterium
TPKL

SEQ ID NO: 391327 - protein, 5 aa, Mycobacterium
TPKSS

SEQ ID NO: 391328 - protein, 4 aa, Mycobacterium
TPPA

SEQ ID NO: 391329 - protein, 5 aa, Mycobacterium
TPPAV

SEQ ID NO: 391330 - protein, 4 aa, Mycobacterium
TPPG

SEQ ID NO: 391331 - protein, 4 aa, Mycobacterium
TPPI

SEQ ID NO: 391332 - protein, 5 aa, Mycobacterium
TPQEG

SEQ ID NO: 391333 - protein, 10 aa, Mycobacterium
TPQERADPKI

SEQ ID NO: 391334 - protein, 5 aa, Mycobacterium
TPQSY

SEQ ID NO: 391335 - protein, 6 aa, Mycobacterium
TPQSYL

SEQ ID NO: 391336 - protein, 4 aa, Mycobacterium
TPRA

SEQ ID NO: 391337 - protein, 14 aa, Mycobacterium
TPRETLNDPQVEPN

SEQ ID NO: 391338 - protein, 4 aa, Mycobacterium
TPRM

SEQ ID NO: 391339 - protein, 4 aa, Mycobacterium
TPRT

SEQ ID NO: 391340 - protein, 4 aa, Mycobacterium
TPRW

SEQ ID NO: 391341 - protein, 14 aa, Mycobacterium
TPSGLGALSPQGLD

SEQ ID NO: 391342 - protein, 5 aa, Mycobacterium
TPSGV

SEQ ID NO: 391343 - protein, 4 aa, Mycobacterium
TPTA

SEQ ID NO: 391344 - protein, 10 aa, Mycobacterium
TPTAPTLPDT

SEQ ID NO: 391345 - protein, 7 aa, Mycobacterium
TPTDTRE

SEQ ID NO: 391346 - protein, 4 aa, Mycobacterium
TPTK

SEQ ID NO: 391347 - protein, 4 aa, Mycobacterium
TPTL

SEQ ID NO: 391348 - protein, 4 aa, Mycobacterium
TPTN

SEQ ID NO: 391349 - protein, 5 aa, Mycobacterium
TPWGT

SEQ ID NO: 391350 - protein, 6 aa, Mycobacterium
TQAAAR

SEQ ID NO: 391351 - protein, 9 aa, Mycobacterium
TQDPPTDQI

SEQ ID NO: 391352 - protein, 11 aa, Mycobacterium
TQGGGENNYER

SEQ ID NO: 391353 - protein, 5 aa, Mycobacterium
TQGYT

SEQ ID NO: 391354 - protein, 8 aa, Mycobacterium
TQLGPQSP

SEQ ID NO: 391355 - protein, 7 aa, Mycobacterium
TQLSPEH

SEQ ID NO: 391356 - protein, 4 aa, Mycobacterium
TQPG

SEQ ID NO: 391357 - protein, 4 aa, Mycobacterium
TRAA

SEQ ID NO: 391358 - protein, 5 aa, Mycobacterium
TRADG

SEQ ID NO: 391359 - protein, 10 aa, Mycobacterium
TRADGERRPG

SEQ ID NO: 391360 - protein, 4 aa, Mycobacterium
TRAE

SEQ ID NO: 391361 - protein, 9 aa, Mycobacterium
TRAGIDPKK

SEQ ID NO: 391362 - protein, 12 aa, Mycobacterium
TRDEPHADADKY

SEQ ID NO: 391363 - protein, 9 aa, Mycobacterium
TRDGGSFAT

SEQ ID NO: 391364 - protein, 4 aa, Mycobacterium
TRDL

SEQ ID NO: 391365 - protein, 7 aa, Mycobacterium
TRDTSPV

SEQ ID NO: 391366 - protein, 5 aa, Mycobacterium
TREEH

SEQ ID NO: 391367 - protein, 4 aa, Mycobacterium
TREG

SEQ ID NO: 391368 - protein, 4 aa, Mycobacterium
TREQ

SEQ ID NO: 391369 - protein, 11 aa, Mycobacterium
TRFKPAKAKEI

SEQ ID NO: 391370 - protein, 4 aa, Mycobacterium
TRGD

SEQ ID NO: 391371 - protein, 6 aa, Mycobacterium
TRHSPA

SEQ ID NO: 391372 - protein, 4 aa, Mycobacterium
TRIG

SEQ ID NO: 391373 - protein, 4 aa, Mycobacterium
TRKR

SEQ ID NO: 391374 - protein, 8 aa, Mycobacterium
TRMPAGPA

SEQ ID NO: 391375 - protein, 7 aa, Mycobacterium
TRPDGTE

SEQ ID NO: 391376 - protein, 4 aa, Mycobacterium
TRPR

SEQ ID NO: 391377 - protein, 4 aa, Mycobacterium
TRPT

SEQ ID NO: 391378 - protein, 6 aa, Mycobacterium
TRPTIG

SEQ ID NO: 391379 - protein, 4 aa, Mycobacterium
TRPV

SEQ ID NO: 391380 - protein, 4 aa, Mycobacterium
TRQV

SEQ ID NO: 391381 - protein, 4 aa, Mycobacterium
TRRA

SEQ ID NO: 391382 - protein, 8 aa, Mycobacterium
TRRAEARA

SEQ ID NO: 391383 - protein, 4 aa, Mycobacterium
TRRE

SEQ ID NO: 391384 - protein, 6 aa, Mycobacterium
TRREGT

SEQ ID NO: 391385 - protein, 4 aa, Mycobacterium
TRRP

SEQ ID NO: 391386 - protein, 4 aa, Mycobacterium
TRSD

SEQ ID NO: 391387 - protein, 8 aa, Mycobacterium
TRSTPEKS

SEQ ID NO: 391388 - protein, 7 aa, Mycobacterium
TRTASRQ

SEQ ID NO: 391389 - protein, 6 aa, Mycobacterium
TRTGAS

SEQ ID NO: 391390 - protein, 9 aa, Mycobacterium
TRTGDGYGG

SEQ ID NO: 391391 - protein, 4 aa, Mycobacterium
TRVS

SEQ ID NO: 391392 - protein, 9 aa, Mycobacterium
TSAAGKSPA

SEQ ID NO: 391393 - protein, 8 aa, Mycobacterium
TSAGERVD

SEQ ID NO: 391394 - protein, 7 aa, Mycobacterium
TSAPAAA

SEQ ID NO: 391395 - protein, 4 aa, Mycobacterium
TSDT

SEQ ID NO: 391396 - protein, 5 aa, Mycobacterium
TSDTA

SEQ ID NO: 391397 - protein, 7 aa, Mycobacterium
TSEHPHQ

SEQ ID NO: 391398 - protein, 7 aa, Mycobacterium
TSGAGGL

SEQ ID NO: 391399 - protein, 10 aa, Mycobacterium
TSGEPGQARG

SEQ ID NO: 391400 - protein, 7 aa, Mycobacterium
TSGIGAG

SEQ ID NO: 391401 - protein, 10 aa, Mycobacterium
TSGSTSDPKG

SEQ ID NO: 391402 - protein, 6 aa, Mycobacterium
TSGTID

SEQ ID NO: 391403 - protein, 9 aa, Mycobacterium
TSHGKDRTT

SEQ ID NO: 391404 - protein, 5 aa, Mycobacterium
TSIER

SEQ ID NO: 391405 - protein, 10 aa, Mycobacterium
TSNRPQTTRH

SEQ ID NO: 391406 - protein, 4 aa, Mycobacterium
TSPL

SEQ ID NO: 391407 - protein, 8 aa, Mycobacterium
TSPTNESK

SEQ ID NO: 391408 - protein, 4 aa, Mycobacterium
TSSE

SEQ ID NO: 391409 - protein, 9 aa, Mycobacterium
TSSIREGSR

SEQ ID NO: 391410 - protein, 20 aa, Mycobacterium
TSSNPTAGGAAVGSGIGPTR

SEQ ID NO: 391411 - protein, 7 aa, Mycobacterium
TSTMPGG

SEQ ID NO: 391412 - protein, 5 aa, Mycobacterium
TSTSG

SEQ ID NO: 391413 - protein, 16 aa, Mycobacterium
TSYGDGNTVTATNSLG

SEQ ID NO: 391414 - protein, 17 aa, Mycobacterium
TSYGDNNNVSATAPGIG

SEQ ID NO: 391415 - protein, 4 aa, Mycobacterium
TTAE

SEQ ID NO: 391416 - protein, 9 aa, Mycobacterium
TTASKNPKE

SEQ ID NO: 391417 - protein, 4 aa, Mycobacterium
TTDP

SEQ ID NO: 391418 - protein, 4 aa, Mycobacterium
TTEA

SEQ ID NO: 391419 - protein, 4 aa, Mycobacterium
TTEL

SEQ ID NO: 391420 - protein, 5 aa, Mycobacterium
TTELS

SEQ ID NO: 391421 - protein, 15 aa, Mycobacterium
TTGGSQKAVNADRGG

SEQ ID NO: 391422 - protein, 11 aa, Mycobacterium
TTGRKTGEPRV

SEQ ID NO: 391423 - protein, 7 aa, Mycobacterium
TTGSSGG

SEQ ID NO: 391424 - protein, 7 aa, Mycobacterium
TTHRETP

SEQ ID NO: 391425 - protein, 5 aa, Mycobacterium
TTKEQ

SEQ ID NO: 391426 - protein, 7 aa, Mycobacterium
TTNPPVE

SEQ ID NO: 391427 - protein, 15 aa, Mycobacterium
TTNTGEPETTKGEAE

SEQ ID NO: 391428 - protein, 4 aa, Mycobacterium
TTPA

SEQ ID NO: 391429 - protein, 4 aa, Mycobacterium
TTPD

SEQ ID NO: 391430 - protein, 17 aa, Mycobacterium
TTPDGDYQTYKANDGAY

SEQ ID NO: 391431 - protein, 6 aa, Mycobacterium
TTPEDY

SEQ ID NO: 391432 - protein, 5 aa, Mycobacterium
TTPGV

SEQ ID NO: 391433 - protein, 6 aa, Mycobacterium
TTSEGG

SEQ ID NO: 391434 - protein, 11 aa, Mycobacterium
TTSPDELGNIQ

SEQ ID NO: 391435 - protein, 12 aa, Mycobacterium
TTVADPANQKVP

SEQ ID NO: 391436 - protein, 8 aa, Mycobacterium
TTVGYQPK

SEQ ID NO: 391437 - protein, 4 aa, Mycobacterium
TTVS

SEQ ID NO: 391438 - protein, 13 aa, Mycobacterium
TVASQTRAVGERA

SEQ ID NO: 391439 - protein, 20 aa, Mycobacterium
TVDPTSSTTALAGSTEEGQF

SEQ ID NO: 391440 - protein, 5 aa, Mycobacterium
TVDRA

SEQ ID NO: 391441 - protein, 7 aa, Mycobacterium
TVGRRKE

SEQ ID NO: 391442 - protein, 5 aa, Mycobacterium
TVPEH

SEQ ID NO: 391443 - protein, 5 aa, Mycobacterium
TVPPP

SEQ ID NO: 391444 - protein, 4 aa, Mycobacterium
TVRD

SEQ ID NO: 391445 - protein, 7 aa, Mycobacterium
TVRDTKS

SEQ ID NO: 391446 - protein, 4 aa, Mycobacterium
TVRE

SEQ ID NO: 391447 - protein, 7 aa, Mycobacterium
TVRPPEE

SEQ ID NO: 391448 - protein, 8 aa, Mycobacterium
TVRTASRQ

SEQ ID NO: 391449 - protein, 8 aa, Mycobacterium
TVTATTSV

SEQ ID NO: 391450 - protein, 5 aa, Mycobacterium
TWRTR

SEQ ID NO: 391451 - protein, 8 aa, Mycobacterium
TYESPGDL

SEQ ID NO: 391452 - protein, 6 aa, Mycobacterium
TYGTNN

SEQ ID NO: 391453 - protein, 5 aa, Mycobacterium
TYITS

SEQ ID NO: 391454 - protein, 4 aa, Mycobacterium
VAAG

SEQ ID NO: 391455 - protein, 9 aa, Mycobacterium
VAASTPKGA

SEQ ID NO: 391456 - protein, 12 aa, Mycobacterium
VADQGKRNVSHG

SEQ ID NO: 391457 - protein, 7 aa, Mycobacterium
VAEASGV

SEQ ID NO: 391458 - protein, 8 aa, Mycobacterium
VAEEHDGD

SEQ ID NO: 391459 - protein, 9 aa, Mycobacterium
VAEREPGVA

SEQ ID NO: 391460 - protein, 7 aa, Mycobacterium
VAERTDE

SEQ ID NO: 391461 - protein, 6 aa, Mycobacterium
VAETTY

SEQ ID NO: 391462 - protein, 9 aa, Mycobacterium
VAGAAGTST

SEQ ID NO: 391463 - protein, 10 aa, Mycobacterium
VAGESAKFGI

SEQ ID NO: 391464 - protein, 15 aa, Mycobacterium
VAGRPKEEYGIEPTG

SEQ ID NO: 391465 - protein, 7 aa, Mycobacterium
VAKATRE

SEQ ID NO: 391466 - protein, 4 aa, Mycobacterium
VAPA

SEQ ID NO: 391467 - protein, 5 aa, Mycobacterium
VAPDG

SEQ ID NO: 391468 - protein, 5 aa, Mycobacterium
VAPED

SEQ ID NO: 391469 - protein, 5 aa, Mycobacterium
VAPGG

SEQ ID NO: 391470 - protein, 5 aa, Mycobacterium
VAPGP

SEQ ID NO: 391471 - protein, 5 aa, Mycobacterium
VAPGQ

SEQ ID NO: 391472 - protein, 6 aa, Mycobacterium
VAPPPQ

SEQ ID NO: 391473 - protein, 7 aa, Mycobacterium
VAPQGPV

SEQ ID NO: 391474 - protein, 6 aa, Mycobacterium
VARRQA

SEQ ID NO: 391475 - protein, 5 aa, Mycobacterium
VASPA

SEQ ID NO: 391476 - protein, 11 aa, Mycobacterium
VATESGEPVDP

SEQ ID NO: 391477 - protein, 11 aa, Mycobacterium
VCPTQGSANPA

SEQ ID NO: 391478 - protein, 10 aa, Mycobacterium
VDADTGAATV

SEQ ID NO: 391479 - protein, 4 aa, Mycobacterium
VDAG

SEQ ID NO: 391480 - protein, 6 aa, Mycobacterium
VDAGQG

SEQ ID NO: 391481 - protein, 4 aa, Mycobacterium
VDDA

SEQ ID NO: 391482 - protein, 4 aa, Mycobacterium
VDDG

SEQ ID NO: 391483 - protein, 7 aa, Mycobacterium
VDEPSAI

SEQ ID NO: 391484 - protein, 4 aa, Mycobacterium
VDGA

SEQ ID NO: 391485 - protein, 6 aa, Mycobacterium
VDGKPG

SEQ ID NO: 391486 - protein, 6 aa, Mycobacterium
VDNDPD

SEQ ID NO: 391487 - protein, 4 aa, Mycobacterium
VDPA

SEQ ID NO: 391488 - protein, 8 aa, Mycobacterium
VDPDARHA

SEQ ID NO: 391489 - protein, 5 aa, Mycobacterium
VDPDR

SEQ ID NO: 391490 - protein, 8 aa, Mycobacterium
VDPDSEIA

SEQ ID NO: 391491 - protein, 9 aa, Mycobacterium
VDPDSEIAQ

SEQ ID NO: 391492 - protein, 7 aa, Mycobacterium
VDPEFGT

SEQ ID NO: 391493 - protein, 4 aa, Mycobacterium
VDPG

SEQ ID NO: 391494 - protein, 7 aa, Mycobacterium
VDPGRAR

SEQ ID NO: 391495 - protein, 10 aa, Mycobacterium
VDPNERTPGT

SEQ ID NO: 391496 - protein, 5 aa, Mycobacterium
VDPPR

SEQ ID NO: 391497 - protein, 4 aa, Mycobacterium
VDPR

SEQ ID NO: 391498 - protein, 7 aa, Mycobacterium
VDSARAT

SEQ ID NO: 391499 - protein, 8 aa, Mycobacterium
VDSASGYK

SEQ ID NO: 391500 - protein, 6 aa, Mycobacterium
VDTGSA

SEQ ID NO: 391501 - protein, 7 aa, Mycobacterium
VDTPAEV

SEQ ID NO: 391502 - protein, 7 aa, Mycobacterium
VDTSRDI

SEQ ID NO: 391503 - protein, 7 aa, Mycobacterium
VDTTGAE

SEQ ID NO: 391504 - protein, 8 aa, Mycobacterium
VDTTGAGD

SEQ ID NO: 391505 - protein, 11 aa, Mycobacterium
VEASSGSTAVS

SEQ ID NO: 391506 - protein, 6 aa, Mycobacterium
VEDPDS

SEQ ID NO: 391507 - protein, 6 aa, Mycobacterium
VEDPEW

SEQ ID NO: 391508 - protein, 4 aa, Mycobacterium
VEES

SEQ ID NO: 391509 - protein, 9 aa, Mycobacterium
VEGPTDDPE

SEQ ID NO: 391510 - protein, 4 aa, Mycobacterium
VEGS

SEQ ID NO: 391511 - protein, 4 aa, Mycobacterium
VEGT

SEQ ID NO: 391512 - protein, 5 aa, Mycobacterium
VEPAS

SEQ ID NO: 391513 - protein, 10 aa, Mycobacterium
VEPPQGDNTR

SEQ ID NO: 391514 - protein, 5 aa, Mycobacterium
VEPPR

SEQ ID NO: 391515 - protein, 4 aa, Mycobacterium
VEPY

SEQ ID NO: 391516 - protein, 9 aa, Mycobacterium
VEQPGQDNV

SEQ ID NO: 391517 - protein, 11 aa, Mycobacterium
VERGRKEASSE

SEQ ID NO: 391518 - protein, 6 aa, Mycobacterium
VESDPG

SEQ ID NO: 391519 - protein, 11 aa, Mycobacterium
VESGSKTLKDA

SEQ ID NO: 391520 - protein, 5 aa, Mycobacterium
VFTDP

SEQ ID NO: 391521 - protein, 5 aa, Mycobacterium
VGAAE

SEQ ID NO: 391522 - protein, 7 aa, Mycobacterium
VGAGTGV

SEQ ID NO: 391523 - protein, 7 aa, Mycobacterium
VGANPRE

SEQ ID NO: 391524 - protein, 4 aa, Mycobacterium
VGDD

SEQ ID NO: 391525 - protein, 26 aa, Mycobacterium
VGDGNVGGANVGGANVGGANTGDGNW

SEQ ID NO: 391526 - protein, 16 aa, Mycobacterium
VGDGNVGGGNLGDGNV

SEQ ID NO: 391527 - protein, 5 aa, Mycobacterium
VGDGP

SEQ ID NO: 391528 - protein, 9 aa, Mycobacterium
VGDQGGDIA

SEQ ID NO: 391529 - protein, 4 aa, Mycobacterium
VGDT

SEQ ID NO: 391530 - protein, 4 aa, Mycobacterium
VGED

SEQ ID NO: 391531 - protein, 6 aa, Mycobacterium
VGEDDV

SEQ ID NO: 391532 - protein, 7 aa, Mycobacterium
VGEDQRQ

SEQ ID NO: 391533 - protein, 8 aa, Mycobacterium
VGGAAAEA

SEQ ID NO: 391534 - protein, 6 aa, Mycobacterium
VGGAKN

SEQ ID NO: 391535 - protein, 4 aa, Mycobacterium
VGGD

SEQ ID NO: 391536 - protein, 7 aa, Mycobacterium
VGGLGGP

SEQ ID NO: 391537 - protein, 6 aa, Mycobacterium
VGGLPD

SEQ ID NO: 391538 - protein, 7 aa, Mycobacterium
VGGNTPQ

SEQ ID NO: 391539 - protein, 9 aa, Mycobacterium
VGGSAAAAA

SEQ ID NO: 391540 - protein, 4 aa, Mycobacterium
VGGT

SEQ ID NO: 391541 - protein, 7 aa, Mycobacterium
VGGVTET

SEQ ID NO: 391542 - protein, 5 aa, Mycobacterium
VGHAK

SEQ ID NO: 391543 - protein, 4 aa, Mycobacterium
VGKG

SEQ ID NO: 391544 - protein, 4 aa, Mycobacterium
VGLP

SEQ ID NO: 391545 - protein, 4 aa, Mycobacterium
VGLS

SEQ ID NO: 391546 - protein, 7 aa, Mycobacterium
VGNGVGD

SEQ ID NO: 391547 - protein, 4 aa, Mycobacterium
VGPA

SEQ ID NO: 391548 - protein, 12 aa, Mycobacterium
VGPDGMGNSPEH

SEQ ID NO: 391549 - protein, 6 aa, Mycobacterium
VGPMDN

SEQ ID NO: 391550 - protein, 7 aa, Mycobacterium
VGPTHAS

SEQ ID NO: 391551 - protein, 4 aa, Mycobacterium
VGPV

SEQ ID NO: 391552 - protein, 4 aa, Mycobacterium
VGRG

SEQ ID NO: 391553 - protein, 5 aa, Mycobacterium
VGRGD

SEQ ID NO: 391554 - protein, 6 aa, Mycobacterium
VGRGDT

SEQ ID NO: 391555 - protein, 7 aa, Mycobacterium
VGRSPKT

SEQ ID NO: 391556 - protein, 5 aa, Mycobacterium
VGRTH

SEQ ID NO: 391557 - protein, 7 aa, Mycobacterium
VGSEVTK

SEQ ID NO: 391558 - protein, 10 aa, Mycobacterium
VGSGPAGLAA

SEQ ID NO: 391559 - protein, 10 aa, Mycobacterium
VGSGPGNVTA

SEQ ID NO: 391560 - protein, 11 aa, Mycobacterium
VGSSGQANYAA

SEQ ID NO: 391561 - protein, 4 aa, Mycobacterium
VGTA

SEQ ID NO: 391562 - protein, 6 aa, Mycobacterium
VGTAAE

SEQ ID NO: 391563 - protein, 13 aa, Mycobacterium
VGTNPTFSGRTRT

SEQ ID NO: 391564 - protein, 4 aa, Mycobacterium
VHDG

SEQ ID NO: 391565 - protein, 8 aa, Mycobacterium
VHGQAGGG

SEQ ID NO: 391566 - protein, 4 aa, Mycobacterium
VIGP

SEQ ID NO: 391567 - protein, 7 aa, Mycobacterium
VKAGERA

SEQ ID NO: 391568 - protein, 7 aa, Mycobacterium
VKDGDDA

SEQ ID NO: 391569 - protein, 4 aa, Mycobacterium
VKDQ

SEQ ID NO: 391570 - protein, 7 aa, Mycobacterium
VKEETGL

SEQ ID NO: 391571 - protein, 7 aa, Mycobacterium
VKGDPTE

SEQ ID NO: 391572 - protein, 5 aa, Mycobacterium
VKGGR

SEQ ID NO: 391573 - protein, 6 aa, Mycobacterium
VKGGRR

SEQ ID NO: 391574 - protein, 7 aa, Mycobacterium
VKKDDKV

SEQ ID NO: 391575 - protein, 13 aa, Mycobacterium
VKPTSVPAFRPGA

SEQ ID NO: 391576 - protein, 6 aa, Mycobacterium
VKPTVA

SEQ ID NO: 391577 - protein, 7 aa, Mycobacterium
VKSGETH

SEQ ID NO: 391578 - protein, 10 aa, Mycobacterium
VLGTKKAEAM

SEQ ID NO: 391579 - protein, 7 aa, Mycobacterium
VLPGGTG

SEQ ID NO: 391580 - protein, 5 aa, Mycobacterium
VLPPG

SEQ ID NO: 391581 - protein, 12 aa, Mycobacterium
VNARGGPGGAPG

SEQ ID NO: 391582 - protein, 12 aa, Mycobacterium
VNSASTSPRSRM

SEQ ID NO: 391583 - protein, 7 aa, Mycobacterium
VNSGETH

SEQ ID NO: 391584 - protein, 5 aa, Mycobacterium
VNSGY

SEQ ID NO: 391585 - protein, 4 aa, Mycobacterium
VNTA

SEQ ID NO: 391586 - protein, 5 aa, Mycobacterium
VPAAA

SEQ ID NO: 391587 - protein, 15 aa, Mycobacterium
VPANVSKEIIAKATG

SEQ ID NO: 391588 - protein, 11 aa, Mycobacterium
VPATKGNTRRL

SEQ ID NO: 391589 - protein, 6 aa, Mycobacterium
VPATRS

SEQ ID NO: 391590 - protein, 4 aa, Mycobacterium
VPDP

SEQ ID NO: 391591 - protein, 9 aa, Mycobacterium
VPDPRSGDQ

SEQ ID NO: 391592 - protein, 6 aa, Mycobacterium
VPDRAR

SEQ ID NO: 391593 - protein, 5 aa, Mycobacterium
VPEPV

SEQ ID NO: 391594 - protein, 5 aa, Mycobacterium
VPESA

SEQ ID NO: 391595 - protein, 6 aa, Mycobacterium
VPESYT

SEQ ID NO: 391596 - protein, 4 aa, Mycobacterium
VPGG

SEQ ID NO: 391597 - protein, 4 aa, Mycobacterium
VPGH

SEQ ID NO: 391598 - protein, 4 aa, Mycobacterium
VPGL

SEQ ID NO: 391599 - protein, 4 aa, Mycobacterium
VPGT

SEQ ID NO: 391600 - protein, 4 aa, Mycobacterium
VPGV

SEQ ID NO: 391601 - protein, 9 aa, Mycobacterium
VPKGTSDGR

SEQ ID NO: 391602 - protein, 7 aa, Mycobacterium
VPPGPGE

SEQ ID NO: 391603 - protein, 13 aa, Mycobacterium
VPPGTEGLSYTGN

SEQ ID NO: 391604 - protein, 4 aa, Mycobacterium
VPPQ

SEQ ID NO: 391605 - protein, 4 aa, Mycobacterium
VPPS

SEQ ID NO: 391606 - protein, 6 aa, Mycobacterium
VPQPLS

SEQ ID NO: 391607 - protein, 4 aa, Mycobacterium
VPSP

SEQ ID NO: 391608 - protein, 7 aa, Mycobacterium
VPSPTAA

SEQ ID NO: 391609 - protein, 6 aa, Mycobacterium
VPTPDN

SEQ ID NO: 391610 - protein, 11 aa, Mycobacterium
VQGVTEETTTG

SEQ ID NO: 391611 - protein, 4 aa, Mycobacterium
VQPE

SEQ ID NO: 391612 - protein, 19 aa, Mycobacterium
VQPELRKGRYPDRKTARRV

SEQ ID NO: 391613 - protein, 5 aa, Mycobacterium
VQPGD

SEQ ID NO: 391614 - protein, 11 aa, Mycobacterium
VQPHSGAQANA

SEQ ID NO: 391615 - protein, 7 aa, Mycobacterium
VQTPQGF

SEQ ID NO: 391616 - protein, 7 aa, Mycobacterium
VQWGPGS

SEQ ID NO: 391617 - protein, 4 aa, Mycobacterium
VRAR

SEQ ID NO: 391618 - protein, 12 aa, Mycobacterium
VRATPDARVSTP

SEQ ID NO: 391619 - protein, 5 aa, Mycobacterium
VRDGD

SEQ ID NO: 391620 - protein, 5 aa, Mycobacterium
VRDGG

SEQ ID NO: 391621 - protein, 5 aa, Mycobacterium
VRGEG

SEQ ID NO: 391622 - protein, 7 aa, Mycobacterium
VRGNSTR

SEQ ID NO: 391623 - protein, 5 aa, Mycobacterium
VRHPR

SEQ ID NO: 391624 - protein, 8 aa, Mycobacterium
VRNTPGVT

SEQ ID NO: 391625 - protein, 4 aa, Mycobacterium
VRPD

SEQ ID NO: 391626 - protein, 5 aa, Mycobacterium
VRPEE

SEQ ID NO: 391627 - protein, 5 aa, Mycobacterium
VRPGD

SEQ ID NO: 391628 - protein, 5 aa, Mycobacterium
VRPGE

SEQ ID NO: 391629 - protein, 5 aa, Mycobacterium
VRPNT

SEQ ID NO: 391630 - protein, 6 aa, Mycobacterium
VRPPSM

SEQ ID NO: 391631 - protein, 10 aa, Mycobacterium
VRQPGKTGEE

SEQ ID NO: 391632 - protein, 9 aa, Mycobacterium
VRRDNTGYD

SEQ ID NO: 391633 - protein, 9 aa, Mycobacterium
VRRDRSGKH

SEQ ID NO: 391634 - protein, 5 aa, Mycobacterium
VRSDS

SEQ ID NO: 391635 - protein, 4 aa, Mycobacterium
VRSE

SEQ ID NO: 391636 - protein, 9 aa, Mycobacterium
VRSTDRTGV

SEQ ID NO: 391637 - protein, 6 aa, Mycobacterium
VRTGSD

SEQ ID NO: 391638 - protein, 5 aa, Mycobacterium
VSATA

SEQ ID NO: 391639 - protein, 18 aa, Mycobacterium
VSATTTDGLGLTGRGEGL

SEQ ID NO: 391640 - protein, 4 aa, Mycobacterium
VSEA

SEQ ID NO: 391641 - protein, 7 aa, Mycobacterium
VSEAPGY

SEQ ID NO: 391642 - protein, 7 aa, Mycobacterium
VSEDKRN

SEQ ID NO: 391643 - protein, 4 aa, Mycobacterium
VSEE

SEQ ID NO: 391644 - protein, 4 aa, Mycobacterium
VSER

SEQ ID NO: 391645 - protein, 4 aa, Mycobacterium
VSES

SEQ ID NO: 391646 - protein, 9 aa, Mycobacterium
VSGERQGYY

SEQ ID NO: 391647 - protein, 9 aa, Mycobacterium
VSHGPEGSL

SEQ ID NO: 391648 - protein, 6 aa, Mycobacterium
VSHGPS

SEQ ID NO: 391649 - protein, 18 aa, Mycobacterium
VSIDQKSTNRNPRSTVGT

SEQ ID NO: 391650 - protein, 4 aa, Mycobacterium
VSND

SEQ ID NO: 391651 - protein, 4 aa, Mycobacterium
VSPE

SEQ ID NO: 391652 - protein, 4 aa, Mycobacterium
VSPG

SEQ ID NO: 391653 - protein, 5 aa, Mycobacterium
VSPGF

SEQ ID NO: 391654 - protein, 8 aa, Mycobacterium
VSPQNAQA

SEQ ID NO: 391655 - protein, 7 aa, Mycobacterium
VSPRGAT

SEQ ID NO: 391656 - protein, 4 aa, Mycobacterium
VSRG

SEQ ID NO: 391657 - protein, 7 aa, Mycobacterium
VSRNDDG

SEQ ID NO: 391658 - protein, 6 aa, Mycobacterium
VSRPAV

SEQ ID NO: 391659 - protein, 9 aa, Mycobacterium
VSRTSGASL

SEQ ID NO: 391660 - protein, 7 aa, Mycobacterium
VSSAPEL

SEQ ID NO: 391661 - protein, 4 aa, Mycobacterium
VSSG

SEQ ID NO: 391662 - protein, 7 aa, Mycobacterium
VSSNPEA

SEQ ID NO: 391663 - protein, 12 aa, Mycobacterium
VSSNSWEYTGDG

SEQ ID NO: 391664 - protein, 4 aa, Mycobacterium
VSSS

SEQ ID NO: 391665 - protein, 9 aa, Mycobacterium
VSVPGAPGV

SEQ ID NO: 391666 - protein, 4 aa, Mycobacterium
VTAE

SEQ ID NO: 391667 - protein, 6 aa, Mycobacterium
VTAEAG

SEQ ID NO: 391668 - protein, 9 aa, Mycobacterium
VTDPDNPVN

SEQ ID NO: 391669 - protein, 4 aa, Mycobacterium
VTEQ

SEQ ID NO: 391670 - protein, 4 aa, Mycobacterium
VTGE

SEQ ID NO: 391671 - protein, 9 aa, Mycobacterium
VTGGSPHAI

SEQ ID NO: 391672 - protein, 12 aa, Mycobacterium
VTGNSMKRAGAG

SEQ ID NO: 391673 - protein, 4 aa, Mycobacterium
VTGP

SEQ ID NO: 391674 - protein, 8 aa, Mycobacterium
VTINSGGE

SEQ ID NO: 391675 - protein, 5 aa, Mycobacterium
VTKGD

SEQ ID NO: 391676 - protein, 11 aa, Mycobacterium
VTKGPGSRAAG

SEQ ID NO: 391677 - protein, 9 aa, Mycobacterium
VTNPEGKRK

SEQ ID NO: 391678 - protein, 8 aa, Mycobacterium
VTPADSPL

SEQ ID NO: 391679 - protein, 8 aa, Mycobacterium
VTPAQRRK

SEQ ID NO: 391680 - protein, 7 aa, Mycobacterium
VTRNGEQ

SEQ ID NO: 391681 - protein, 9 aa, Mycobacterium
VTRPGQYEA

SEQ ID NO: 391682 - protein, 5 aa, Mycobacterium
VTSGP

SEQ ID NO: 391683 - protein, 10 aa, Mycobacterium
VTSRGYPPSI

SEQ ID NO: 391684 - protein, 20 aa, Mycobacterium
VTTDHISPAGAIKPGTPAAQ

SEQ ID NO: 391685 - protein, 7 aa, Mycobacterium
VTTPART

SEQ ID NO: 391686 - protein, 7 aa, Mycobacterium
VTTVDSG

SEQ ID NO: 391687 - protein, 13 aa, Mycobacterium
VVPATADTSSQLT

SEQ ID NO: 391688 - protein, 7 aa, Mycobacterium
WAPNGAN

SEQ ID NO: 391689 - protein, 9 aa, Mycobacterium
WDPKAQRPE

SEQ ID NO: 391690 - protein, 7 aa, Mycobacterium
WDTNPRW

SEQ ID NO: 391691 - protein, 5 aa, Mycobacterium
WEPMG

SEQ ID NO: 391692 - protein, 12 aa, Mycobacterium
WGNTGGGNIGWG

SEQ ID NO: 391693 - protein, 7 aa, Mycobacterium
WGPPPGE

SEQ ID NO: 391694 - protein, 4 aa, Mycobacterium
WGRA

SEQ ID NO: 391695 - protein, 8 aa, Mycobacterium
WGSGPGKL

SEQ ID NO: 391696 - protein, 6 aa, Mycobacterium
WGSRRK

SEQ ID NO: 391697 - protein, 22 aa, Mycobacterium
WKPDQYANPEGPASHYATTGPE

SEQ ID NO: 391698 - protein, 8 aa, Mycobacterium
WNSGSGNV

SEQ ID NO: 391699 - protein, 7 aa, Mycobacterium
WNTEARQ

SEQ ID NO: 391700 - protein, 8 aa, Mycobacterium
WPTPSGEH

SEQ ID NO: 391701 - protein, 12 aa, Mycobacterium
WQRDPKQLGRLG

SEQ ID NO: 391702 - protein, 5 aa, Mycobacterium
WREPD

SEQ ID NO: 391703 - protein, 8 aa, Mycobacterium
WSDGSAPI

SEQ ID NO: 391704 - protein, 6 aa, Mycobacterium
WSGREP

SEQ ID NO: 391705 - protein, 13 aa, Mycobacterium
WSKPNPKTATNAG

SEQ ID NO: 391706 - protein, 10 aa, Mycobacterium
WSTDPRSRVP

SEQ ID NO: 391707 - protein, 4 aa, Mycobacterium
YADG

SEQ ID NO: 391708 - protein, 6 aa, Mycobacterium
YAEPGQ

SEQ ID NO: 391709 - protein, 10 aa, Mycobacterium
YAGAGATIGP

SEQ ID NO: 391710 - protein, 9 aa, Mycobacterium
YAGPGSGPM

SEQ ID NO: 391711 - protein, 10 aa, Mycobacterium
YAQGGPTHAS

SEQ ID NO: 391712 - protein, 6 aa, Mycobacterium
YARDGD

SEQ ID NO: 391713 - protein, 6 aa, Mycobacterium
YASGGW

SEQ ID NO: 391714 - protein, 4 aa, Mycobacterium
YDDG

SEQ ID NO: 391715 - protein, 12 aa, Mycobacterium
YDEGDSFDQSAA

SEQ ID NO: 391716 - protein, 7 aa, Mycobacterium
YDPDPEL

SEQ ID NO: 391717 - protein, 5 aa, Mycobacterium
YDPDT

SEQ ID NO: 391718 - protein, 12 aa, Mycobacterium
YDPHPAIKAPVA

SEQ ID NO: 391719 - protein, 12 aa, Mycobacterium
YDSSDKGFDGAS

SEQ ID NO: 391720 - protein, 10 aa, Mycobacterium
YEEAGEQEAD

SEQ ID NO: 391721 - protein, 10 aa, Mycobacterium
YEEAGEQEAQ

SEQ ID NO: 391722 - protein, 9 aa, Mycobacterium
YEEDSRAEV

SEQ ID NO: 391723 - protein, 7 aa, Mycobacterium
YEGPQTA

SEQ ID NO: 391724 - protein, 5 aa, Mycobacterium
YELRP

SEQ ID NO: 391725 - protein, 10 aa, Mycobacterium
YENGGLPTNE

SEQ ID NO: 391726 - protein, 6 aa, Mycobacterium
YEPPEA

SEQ ID NO: 391727 - protein, 5 aa, Mycobacterium
YEQGT

SEQ ID NO: 391728 - protein, 6 aa, Mycobacterium
YERDGR

SEQ ID NO: 391729 - protein, 4 aa, Mycobacterium
YERE

SEQ ID NO: 391730 - protein, 4 aa, Mycobacterium
YETP

SEQ ID NO: 391731 - protein, 9 aa, Mycobacterium
YGAESEASR

SEQ ID NO: 391732 - protein, 10 aa, Mycobacterium
YGASGEHQSF

SEQ ID NO: 391733 - protein, 9 aa, Mycobacterium
YGDPDNPDD

SEQ ID NO: 391734 - protein, 11 aa, Mycobacterium
YGGGAAAATVQ

SEQ ID NO: 391735 - protein, 5 aa, Mycobacterium
YGGPD

SEQ ID NO: 391736 - protein, 6 aa, Mycobacterium
YGGYKA

SEQ ID NO: 391737 - protein, 5 aa, Mycobacterium
YGKTE

SEQ ID NO: 391738 - protein, 11 aa, Mycobacterium
YGPDGQRRGEG

SEQ ID NO: 391739 - protein, 4 aa, Mycobacterium
YGPR

SEQ ID NO: 391740 - protein, 9 aa, Mycobacterium
YGPSRERSI

SEQ ID NO: 391741 - protein, 8 aa, Mycobacterium
YGQVGDGR

SEQ ID NO: 391742 - protein, 11 aa, Mycobacterium
YGSRSTPVSGA

SEQ ID NO: 391743 - protein, 4 aa, Mycobacterium
YGSS

SEQ ID NO: 391744 - protein, 5 aa, Mycobacterium
YGSTA

SEQ ID NO: 391745 - protein, 5 aa, Mycobacterium
YHEQE

SEQ ID NO: 391746 - protein, 5 aa, Mycobacterium
YHQPR

SEQ ID NO: 391747 - protein, 10 aa, Mycobacterium
YNANPDSMRA

SEQ ID NO: 391748 - protein, 4 aa, Mycobacterium
YNGL

SEQ ID NO: 391749 - protein, 9 aa, Mycobacterium
YNNYTDADA

SEQ ID NO: 391750 - protein, 6 aa, Mycobacterium
YNPQRE

SEQ ID NO: 391751 - protein, 4 aa, Mycobacterium
YNRE

SEQ ID NO: 391752 - protein, 4 aa, Mycobacterium
YPAD

SEQ ID NO: 391753 - protein, 9 aa, Mycobacterium
YPDLNESRA

SEQ ID NO: 391754 - protein, 4 aa, Mycobacterium
YPEH

SEQ ID NO: 391755 - protein, 4 aa, Mycobacterium
YPER

SEQ ID NO: 391756 - protein, 6 aa, Mycobacterium
YPGEHT

SEQ ID NO: 391757 - protein, 4 aa, Mycobacterium
YPGT

SEQ ID NO: 391758 - protein, 4 aa, Mycobacterium
YPHS

SEQ ID NO: 391759 - protein, 5 aa, Mycobacterium
YPPEA

SEQ ID NO: 391760 - protein, 8 aa, Mycobacterium
YPPEEAQT

SEQ ID NO: 391761 - protein, 5 aa, Mycobacterium
YPPRL

SEQ ID NO: 391762 - protein, 5 aa, Mycobacterium
YPSGE

SEQ ID NO: 391763 - protein, 8 aa, Mycobacterium
YPSPEEER

SEQ ID NO: 391764 - protein, 4 aa, Mycobacterium
YPVG

SEQ ID NO: 391765 - protein, 24 aa, Mycobacterium
YQGKEAAEAGTGGRGGESGSPSTS

SEQ ID NO: 391766 - protein, 5 aa, Mycobacterium
YQGRG

SEQ ID NO: 391767 - protein, 9 aa, Mycobacterium
YQRYESSGE

SEQ ID NO: 391768 - protein, 9 aa, Mycobacterium
YQSRQDPAL

SEQ ID NO: 391769 - protein, 11 aa, Mycobacterium
YQVGRKGQSFL

SEQ ID NO: 391770 - protein, 7 aa, Mycobacterium
YRDAEST

SEQ ID NO: 391771 - protein, 9 aa, Mycobacterium
YRDEARPRA

SEQ ID NO: 391772 - protein, 4 aa, Mycobacterium
YRGT

SEQ ID NO: 391773 - protein, 9 aa, Mycobacterium
YRPGDPPLA

SEQ ID NO: 391774 - protein, 5 aa, Mycobacterium
YRRQD

SEQ ID NO: 391775 - protein, 5 aa, Mycobacterium
YRSAD

SEQ ID NO: 391776 - protein, 9 aa, Mycobacterium
YRSPGGAGI

SEQ ID NO: 391777 - protein, 8 aa, Mycobacterium
YRTENGEE

SEQ ID NO: 391778 - protein, 6 aa, Mycobacterium
YSGATT

SEQ ID NO: 391779 - protein, 7 aa, Mycobacterium
YSHEPNR

SEQ ID NO: 391780 - protein, 9 aa, Mycobacterium
YSHPGDNIP

SEQ ID NO: 391781 - protein, 15 aa, Mycobacterium
YSKGTTMKKSNQIQS

SEQ ID NO: 391782 - protein, 4 aa, Mycobacterium
YSPE

SEQ ID NO: 391783 - protein, 6 aa, Mycobacterium
YSPGPH

SEQ ID NO: 391784 - protein, 6 aa, Mycobacterium
YSSPAE

SEQ ID NO: 391785 - protein, 11 aa, Mycobacterium
YTGTGNSLNAR

SEQ ID NO: 391786 - protein, 9 aa, Mycobacterium
YTPPVPAQG

SEQ ID NO: 391787 - protein, 11 aa, Mycobacterium
YTSGSTRPPVG

SEQ ID NO: 391788 - protein, 7 aa, Mycobacterium
YTTPEDF

SEQ ID NO: 391789 - protein, 6 aa, Mycobacterium
YVPGGT

SEQ ID NO: 391790 - protein, 4 aa, Mycobacterium
YYGA

SEQ ID NO: 391791 - protein, 9 aa, Mycobacterium
AAAAAATTT

SEQ ID NO: 391792 - protein, 9 aa, Mycobacterium
AAAAAGAPV

SEQ ID NO: 391793 - protein, 9 aa, Mycobacterium
AAAAAGEPL

SEQ ID NO: 391794 - protein, 9 aa, Mycobacterium
AAAAAPPPL

SEQ ID NO: 391795 - protein, 10 aa, Mycobacterium
AAAAAPPPRD

SEQ ID NO: 391796 - protein, 5 aa, Mycobacterium
AAAAD

SEQ ID NO: 391797 - protein, 7 aa, Mycobacterium
AAAADGW

SEQ ID NO: 391798 - protein, 14 aa, Mycobacterium
AAAAEAAAIGDGLP

SEQ ID NO: 391799 - protein, 8 aa, Mycobacterium
AAAAGPGD

SEQ ID NO: 391800 - protein, 7 aa, Mycobacterium
AAAAGRP

SEQ ID NO: 391801 - protein, 6 aa, Mycobacterium
AAAAGY

SEQ ID NO: 391802 - protein, 7 aa, Mycobacterium
AAAAHRA

SEQ ID NO: 391803 - protein, 7 aa, Mycobacterium
AAAAPYA

SEQ ID NO: 391804 - protein, 6 aa, Mycobacterium
AAADAA

SEQ ID NO: 391805 - protein, 6 aa, Mycobacterium
AAADGA

SEQ ID NO: 391806 - protein, 6 aa, Mycobacterium
AAADGT

SEQ ID NO: 391807 - protein, 10 aa, Mycobacterium
AAADGTGWGE

SEQ ID NO: 391808 - protein, 6 aa, Mycobacterium
AAADGV

SEQ ID NO: 391809 - protein, 8 aa, Mycobacterium
AAADPTGF

SEQ ID NO: 391810 - protein, 9 aa, Mycobacterium
AAADPVSAQ

SEQ ID NO: 391811 - protein, 8 aa, Mycobacterium
AAADRPDV

SEQ ID NO: 391812 - protein, 8 aa, Mycobacterium
AAADSRTV

SEQ ID NO: 391813 - protein, 8 aa, Mycobacterium
AAADSTDD

SEQ ID NO: 391814 - protein, 7 aa, Mycobacterium
AAADTLR

SEQ ID NO: 391815 - protein, 10 aa, Mycobacterium
AAAEAAGRNV

SEQ ID NO: 391816 - protein, 6 aa, Mycobacterium
AAAEDD

SEQ ID NO: 391817 - protein, 8 aa, Mycobacterium
AAAEGRGD

SEQ ID NO: 391818 - protein, 5 aa, Mycobacterium
AAAEL

SEQ ID NO: 391819 - protein, 5 aa, Mycobacterium
AAAEP

SEQ ID NO: 391820 - protein, 5 aa, Mycobacterium
AAAGA

SEQ ID NO: 391821 - protein, 12 aa, Mycobacterium
AAAGAPPAGGGR

SEQ ID NO: 391822 - protein, 6 aa, Mycobacterium
AAAGEA

SEQ ID NO: 391823 - protein, 5 aa, Mycobacterium
AAAGG

SEQ ID NO: 391824 - protein, 24 aa, Mycobacterium
AAAGGPAADAKLTEASEAIARLVR

SEQ ID NO: 391825 - protein, 10 aa, Mycobacterium
AAAGGTTSLA

SEQ ID NO: 391826 - protein, 7 aa, Mycobacterium
AAAGHRT

SEQ ID NO: 391827 - protein, 6 aa, Mycobacterium
AAAGLG

SEQ ID NO: 391828 - protein, 7 aa, Mycobacterium
AAAGRRS

SEQ ID NO: 391829 - protein, 7 aa, Mycobacterium
AAAGTGL

SEQ ID NO: 391830 - protein, 5 aa, Mycobacterium
AAAGV

SEQ ID NO: 391831 - protein, 8 aa, Mycobacterium
AAAGVSGP

SEQ ID NO: 391832 - protein, 13 aa, Mycobacterium
AAAHGRAGEDGLG

SEQ ID NO: 391833 - protein, 5 aa, Mycobacterium
AAAKA

SEQ ID NO: 391834 - protein, 16 aa, Mycobacterium
AAAKAKSLLDQEGRDD

SEQ ID NO: 391835 - protein, 6 aa, Mycobacterium
AAAKLG

SEQ ID NO: 391836 - protein, 14 aa, Mycobacterium
AAAKPGSAMTPLPG

SEQ ID NO: 391837 - protein, 11 aa, Mycobacterium
AAAKSGANAIH

SEQ ID NO: 391838 - protein, 12 aa, Mycobacterium
AAAKSGANAVHP

SEQ ID NO: 391839 - protein, 7 aa, Mycobacterium
AAAMDPQ

SEQ ID NO: 391840 - protein, 14 aa, Mycobacterium
AAANAQNNEGLDPS

SEQ ID NO: 391841 - protein, 7 aa, Mycobacterium
AAANGLG

SEQ ID NO: 391842 - protein, 9 aa, Mycobacterium
AAAPDGLQD

SEQ ID NO: 391843 - protein, 5 aa, Mycobacterium
AAAPG

SEQ ID NO: 391844 - protein, 6 aa, Mycobacterium
AAAPGG

SEQ ID NO: 391845 - protein, 7 aa, Mycobacterium
AAAPGRL

SEQ ID NO: 391846 - protein, 5 aa, Mycobacterium
AAAPL

SEQ ID NO: 391847 - protein, 8 aa, Mycobacterium
AAAPRIPA

SEQ ID NO: 391848 - protein, 16 aa, Mycobacterium
AAAPWKGRNKPHRGDR

SEQ ID NO: 391849 - protein, 6 aa, Mycobacterium
AAAQRD

SEQ ID NO: 391850 - protein, 5 aa, Mycobacterium
AAAQT

SEQ ID NO: 391851 - protein, 7 aa, Mycobacterium
AAARAAG

SEQ ID NO: 391852 - protein, 5 aa, Mycobacterium
AAARG

SEQ ID NO: 391853 - protein, 14 aa, Mycobacterium
AAARRTGGHPAKRT

SEQ ID NO: 391854 - protein, 9 aa, Mycobacterium
AAARTAEQL

SEQ ID NO: 391855 - protein, 11 aa, Mycobacterium
AAARTQARIDS

SEQ ID NO: 391856 - protein, 6 aa, Mycobacterium
AAATDK

SEQ ID NO: 391857 - protein, 8 aa, Mycobacterium
AAATGKRA

SEQ ID NO: 391858 - protein, 17 aa, Mycobacterium
AAATKAKSLLDQEGRDD

SEQ ID NO: 391859 - protein, 5 aa, Mycobacterium
AAATR

SEQ ID NO: 391860 - protein, 8 aa, Mycobacterium
AAATRNTQ

SEQ ID NO: 391861 - protein, 8 aa, Mycobacterium
AAATSTDT

SEQ ID NO: 391862 - protein, 5 aa, Mycobacterium
AAATV

SEQ ID NO: 391863 - protein, 5 aa, Mycobacterium
AAAVD

SEQ ID NO: 391864 - protein, 6 aa, Mycobacterium
AADAGD

SEQ ID NO: 391865 - protein, 7 aa, Mycobacterium
AADAGRT

SEQ ID NO: 391866 - protein, 7 aa, Mycobacterium
AADATLE

SEQ ID NO: 391867 - protein, 7 aa, Mycobacterium
AADDGVG

SEQ ID NO: 391868 - protein, 4 aa, Mycobacterium
AADE

SEQ ID NO: 391869 - protein, 6 aa, Mycobacterium
AADEIS

SEQ ID NO: 391870 - protein, 7 aa, Mycobacterium
AADEVSA

SEQ ID NO: 391871 - protein, 5 aa, Mycobacterium
AADGR

SEQ ID NO: 391872 - protein, 10 aa, Mycobacterium
AADGRSPSSE

SEQ ID NO: 391873 - protein, 9 aa, Mycobacterium
AADGTGWGE

SEQ ID NO: 391874 - protein, 8 aa, Mycobacterium
AADGTRQR

SEQ ID NO: 391875 - protein, 5 aa, Mycobacterium
AADGV

SEQ ID NO: 391876 - protein, 5 aa, Mycobacterium
AADLG

SEQ ID NO: 391877 - protein, 7 aa, Mycobacterium
AADLPPG

SEQ ID NO: 391878 - protein, 6 aa, Mycobacterium
AADNAA

SEQ ID NO: 391879 - protein, 10 aa, Mycobacterium
AADPAADHSV

SEQ ID NO: 391880 - protein, 6 aa, Mycobacterium
AADPAT

SEQ ID NO: 391881 - protein, 5 aa, Mycobacterium
AADPD

SEQ ID NO: 391882 - protein, 7 aa, Mycobacterium
AADPGAR

SEQ ID NO: 391883 - protein, 5 aa, Mycobacterium
AADPL

SEQ ID NO: 391884 - protein, 5 aa, Mycobacterium
AADPV

SEQ ID NO: 391885 - protein, 5 aa, Mycobacterium
AADQA

SEQ ID NO: 391886 - protein, 8 aa, Mycobacterium
AADRAADG

SEQ ID NO: 391887 - protein, 6 aa, Mycobacterium
AADREA

SEQ ID NO: 391888 - protein, 7 aa, Mycobacterium
AADRPDV

SEQ ID NO: 391889 - protein, 5 aa, Mycobacterium
AADRS

SEQ ID NO: 391890 - protein, 5 aa, Mycobacterium
AADSG

SEQ ID NO: 391891 - protein, 6 aa, Mycobacterium
AADSGF

SEQ ID NO: 391892 - protein, 10 aa, Mycobacterium
AADSPPQTVA

SEQ ID NO: 391893 - protein, 4 aa, Mycobacterium
AADT

SEQ ID NO: 391894 - protein, 5 aa, Mycobacterium
AADTG

SEQ ID NO: 391895 - protein, 5 aa, Mycobacterium
AADTR

SEQ ID NO: 391896 - protein, 4 aa, Mycobacterium
AADY

SEQ ID NO: 391897 - protein, 6 aa, Mycobacterium
AADYAR

SEQ ID NO: 391898 - protein, 6 aa, Mycobacterium
AAEAGA

SEQ ID NO: 391899 - protein, 10 aa, Mycobacterium
AAEAQRRGTR

SEQ ID NO: 391900 - protein, 16 aa, Mycobacterium
AAEARGQQVDEEADAA

SEQ ID NO: 391901 - protein, 7 aa, Mycobacterium
AAEDARV

SEQ ID NO: 391902 - protein, 7 aa, Mycobacterium
AAEDPRV

SEQ ID NO: 391903 - protein, 7 aa, Mycobacterium
AAEDPTL

SEQ ID NO: 391904 - protein, 4 aa, Mycobacterium
AAEE

SEQ ID NO: 391905 - protein, 4 aa, Mycobacterium
AAEF

SEQ ID NO: 391906 - protein, 5 aa, Mycobacterium
AAEGR

SEQ ID NO: 391907 - protein, 6 aa, Mycobacterium
AAEHKP

SEQ ID NO: 391908 - protein, 7 aa, Mycobacterium
AAEHPDK

SEQ ID NO: 391909 - protein, 6 aa, Mycobacterium
AAEKEL

SEQ ID NO: 391910 - protein, 11 aa, Mycobacterium
AAEKSGANAIH

SEQ ID NO: 391911 - protein, 5 aa, Mycobacterium
AAELR

SEQ ID NO: 391912 - protein, 7 aa, Mycobacterium
AAEPATV

SEQ ID NO: 391913 - protein, 5 aa, Mycobacterium
AAEPE

SEQ ID NO: 391914 - protein, 6 aa, Mycobacterium
AAEPEP

SEQ ID NO: 391915 - protein, 13 aa, Mycobacterium
AAEPGGKDYGVPS

SEQ ID NO: 391916 - protein, 8 aa, Mycobacterium
AAEPGSDH

SEQ ID NO: 391917 - protein, 8 aa, Mycobacterium
AAEPSGFD

SEQ ID NO: 391918 - protein, 5 aa, Mycobacterium
AAEPY

SEQ ID NO: 391919 - protein, 4 aa, Mycobacterium
AAEQ

SEQ ID NO: 391920 - protein, 8 aa, Mycobacterium
AAERATGL

SEQ ID NO: 391921 - protein, 7 aa, Mycobacterium
AAERDPE

SEQ ID NO: 391922 - protein, 17 aa, Mycobacterium
AAERSSGFDPRAGWAGN

SEQ ID NO: 391923 - protein, 5 aa, Mycobacterium
AAERT

SEQ ID NO: 391924 - protein, 4 aa, Mycobacterium
AAES

SEQ ID NO: 391925 - protein, 6 aa, Mycobacterium
AAESRA

SEQ ID NO: 391926 - protein, 12 aa, Mycobacterium
AAETAQRAFGDA

SEQ ID NO: 391927 - protein, 5 aa, Mycobacterium
AAETP

SEQ ID NO: 391928 - protein, 6 aa, Mycobacterium
AAETPL

SEQ ID NO: 391929 - protein, 7 aa, Mycobacterium
AAETPLT

SEQ ID NO: 391930 - protein, 8 aa, Mycobacterium
AAGAAAEL

SEQ ID NO: 391931 - protein, 6 aa, Mycobacterium
AAGADD

SEQ ID NO: 391932 - protein, 9 aa, Mycobacterium
AAGADDSDI

SEQ ID NO: 391933 - protein, 24 aa, Mycobacterium
AAGAETAGYGDPQLRTDEAARKNV

SEQ ID NO: 391934 - protein, 5 aa, Mycobacterium
AAGAG

SEQ ID NO: 391935 - protein, 12 aa, Mycobacterium
AAGAGFDSSPGM

SEQ ID NO: 391936 - protein, 10 aa, Mycobacterium
AAGAGSRRDT

SEQ ID NO: 391937 - protein, 6 aa, Mycobacterium
AAGAPV

SEQ ID NO: 391938 - protein, 8 aa, Mycobacterium
AAGARRVT

SEQ ID NO: 391939 - protein, 9 aa, Mycobacterium
AAGASDSDI

SEQ ID NO: 391940 - protein, 6 aa, Mycobacterium
AAGCGS

SEQ ID NO: 391941 - protein, 8 aa, Mycobacterium
AAGDDGAR

SEQ ID NO: 391942 - protein, 11 aa, Mycobacterium
AAGDGRSDDVA

SEQ ID NO: 391943 - protein, 5 aa, Mycobacterium
AAGDT

SEQ ID NO: 391944 - protein, 7 aa, Mycobacterium
AAGEDGL

SEQ ID NO: 391945 - protein, 7 aa, Mycobacterium
AAGEGRG

SEQ ID NO: 391946 - protein, 6 aa, Mycobacterium
AAGEGV

SEQ ID NO: 391947 - protein, 8 aa, Mycobacterium
AAGEHPDW

SEQ ID NO: 391948 - protein, 6 aa, Mycobacterium
AAGFTK

SEQ ID NO: 391949 - protein, 6 aa, Mycobacterium
AAGGAT

SEQ ID NO: 391950 - protein, 6 aa, Mycobacterium
AAGGDV

SEQ ID NO: 391951 - protein, 6 aa, Mycobacterium
AAGGEY

SEQ ID NO: 391952 - protein, 8 aa, Mycobacterium
AAGGGQSA

SEQ ID NO: 391953 - protein, 10 aa, Mycobacterium
AAGGKTVPRK

SEQ ID NO: 391954 - protein, 9 aa, Mycobacterium
AAGGPTHAS

SEQ ID NO: 391955 - protein, 6 aa, Mycobacterium
AAGGRP

SEQ ID NO: 391956 - protein, 8 aa, Mycobacterium
AAGGRQTD

SEQ ID NO: 391957 - protein, 15 aa, Mycobacterium
AAGGTIVKPAEKTYW

SEQ ID NO: 391958 - protein, 5 aa, Mycobacterium
AAGIS

SEQ ID NO: 391959 - protein, 6 aa, Mycobacterium
AAGISR

SEQ ID NO: 391960 - protein, 15 aa, Mycobacterium
AAGKPGLSVGPGNAP

SEQ ID NO: 391961 - protein, 10 aa, Mycobacterium
AAGLDLGGRE

SEQ ID NO: 391962 - protein, 5 aa, Mycobacterium
AAGLT

SEQ ID NO: 391963 - protein, 4 aa, Mycobacterium
AAGM

SEQ ID NO: 391964 - protein, 19 aa, Mycobacterium
AAGPAAGGAPAEAAEEQSE

SEQ ID NO: 391965 - protein, 7 aa, Mycobacterium
AAGPDGT

SEQ ID NO: 391966 - protein, 6 aa, Mycobacterium
AAGPDR

SEQ ID NO: 391967 - protein, 6 aa, Mycobacterium
AAGPGD

SEQ ID NO: 391968 - protein, 9 aa, Mycobacterium
AAGPGTDAR

SEQ ID NO: 391969 - protein, 5 aa, Mycobacterium
AAGPL

SEQ ID NO: 391970 - protein, 6 aa, Mycobacterium
AAGPPV

SEQ ID NO: 391971 - protein, 6 aa, Mycobacterium
AAGQPL

SEQ ID NO: 391972 - protein, 7 aa, Mycobacterium
AAGQPQL

SEQ ID NO: 391973 - protein, 5 aa, Mycobacterium
AAGQR

SEQ ID NO: 391974 - protein, 10 aa, Mycobacterium
AAGRASKDVD

SEQ ID NO: 391975 - protein, 5 aa, Mycobacterium
AAGRD

SEQ ID NO: 391976 - protein, 7 aa, Mycobacterium
AAGRDIP

SEQ ID NO: 391977 - protein, 10 aa, Mycobacterium
AAGRQALDEA

SEQ ID NO: 391978 - protein, 9 aa, Mycobacterium
AAGRQRDYR

SEQ ID NO: 391979 - protein, 8 aa, Mycobacterium
AAGRTPGL

SEQ ID NO: 391980 - protein, 5 aa, Mycobacterium
AAGSG

SEQ ID NO: 391981 - protein, 8 aa, Mycobacterium
AAGSPELY

SEQ ID NO: 391982 - protein, 6 aa, Mycobacterium
AAGSPL

SEQ ID NO: 391983 - protein, 14 aa, Mycobacterium
AAGSSVGKGESLRD

SEQ ID NO: 391984 - protein, 5 aa, Mycobacterium
AAGST

SEQ ID NO: 391985 - protein, 6 aa, Mycobacterium
AAGSTG

SEQ ID NO: 391986 - protein, 5 aa, Mycobacterium
AAGTA

SEQ ID NO: 391987 - protein, 15 aa, Mycobacterium
AAGTDYADLTGEPPF

SEQ ID NO: 391988 - protein, 12 aa, Mycobacterium
AAGTLSGGEAQR

SEQ ID NO: 391989 - protein, 5 aa, Mycobacterium
AAGTP

SEQ ID NO: 391990 - protein, 6 aa, Mycobacterium
AAGVDA

SEQ ID NO: 391991 - protein, 5 aa, Mycobacterium
AAGVP

SEQ ID NO: 391992 - protein, 4 aa, Mycobacterium
AAGY

SEQ ID NO: 391993 - protein, 5 aa, Mycobacterium
AAHAA

SEQ ID NO: 391994 - protein, 6 aa, Mycobacterium
AAHEPG

SEQ ID NO: 391995 - protein, 10 aa, Mycobacterium
AAHGANRTGR

SEQ ID NO: 391996 - protein, 7 aa, Mycobacterium
AAHNRAT

SEQ ID NO: 391997 - protein, 5 aa, Mycobacterium
AAHPD

SEQ ID NO: 391998 - protein, 5 aa, Mycobacterium
AAHPE

SEQ ID NO: 391999 - protein, 8 aa, Mycobacterium
AAHPGRPE

SEQ ID NO: 392000 - protein, 5 aa, Mycobacterium
AAHQD

SEQ ID NO: 392001 - protein, 5 aa, Mycobacterium
AAIGR

SEQ ID NO: 392002 - protein, 5 aa, Mycobacterium
AAIGS

SEQ ID NO: 392003 - protein, 11 aa, Mycobacterium
AAINPGNSGGA

SEQ ID NO: 392004 - protein, 6 aa, Mycobacterium
AAIQTG

SEQ ID NO: 392005 - protein, 5 aa, Mycobacterium
AAKAG

SEQ ID NO: 392006 - protein, 6 aa, Mycobacterium
AAKAGA

SEQ ID NO: 392007 - protein, 7 aa, Mycobacterium
AAKAGRT

SEQ ID NO: 392008 - protein, 7 aa, Mycobacterium
AAKAWAA

SEQ ID NO: 392009 - protein, 4 aa, Mycobacterium
AAKD

SEQ ID NO: 392010 - protein, 7 aa, Mycobacterium
AAKEVKR

SEQ ID NO: 392011 - protein, 5 aa, Mycobacterium
AAKGG

SEQ ID NO: 392012 - protein, 8 aa, Mycobacterium
AAKGGINA

SEQ ID NO: 392013 - protein, 5 aa, Mycobacterium
AAKGI

SEQ ID NO: 392014 - protein, 4 aa, Mycobacterium
AAKL

SEQ ID NO: 392015 - protein, 5 aa, Mycobacterium
AAKLG

SEQ ID NO: 392016 - protein, 5 aa, Mycobacterium
AAKPD

SEQ ID NO: 392017 - protein, 5 aa, Mycobacterium
AAKPK

SEQ ID NO: 392018 - protein, 10 aa, Mycobacterium
AAKQRLTDSV

SEQ ID NO: 392019 - protein, 10 aa, Mycobacterium
AAKRDGDTLG

SEQ ID NO: 392020 - protein, 6 aa, Mycobacterium
AAKRQY

SEQ ID NO: 392021 - protein, 16 aa, Mycobacterium
AAKSDLERQENKTKTG

SEQ ID NO: 392022 - protein, 7 aa, Mycobacterium
AAKSGLN

SEQ ID NO: 392023 - protein, 4 aa, Mycobacterium
AALD

SEQ ID NO: 392024 - protein, 5 aa, Mycobacterium
AALEP

SEQ ID NO: 392025 - protein, 14 aa, Mycobacterium
AALGGNERARERHV

SEQ ID NO: 392026 - protein, 9 aa, Mycobacterium
AALPDDQRQ

SEQ ID NO: 392027 - protein, 6 aa, Mycobacterium
AALPTT

SEQ ID NO: 392028 - protein, 6 aa, Mycobacterium
AALSKA

SEQ ID NO: 392029 - protein, 6 aa, Mycobacterium
AANAES

SEQ ID NO: 392030 - protein, 5 aa, Mycobacterium
AANAG

SEQ ID NO: 392031 - protein, 7 aa, Mycobacterium
AANDAHT

SEQ ID NO: 392032 - protein, 6 aa, Mycobacterium
AANEAE

SEQ ID NO: 392033 - protein, 8 aa, Mycobacterium
AANEEAAE

SEQ ID NO: 392034 - protein, 7 aa, Mycobacterium
AANGKAD

SEQ ID NO: 392035 - protein, 11 aa, Mycobacterium
AANKQKAELDE

SEQ ID NO: 392036 - protein, 6 aa, Mycobacterium
AANPAP

SEQ ID NO: 392037 - protein, 5 aa, Mycobacterium
AANPD

SEQ ID NO: 392038 - protein, 6 aa, Mycobacterium
AANPDR

SEQ ID NO: 392039 - protein, 5 aa, Mycobacterium
AANPG

SEQ ID NO: 392040 - protein, 5 aa, Mycobacterium
AANPN

SEQ ID NO: 392041 - protein, 5 aa, Mycobacterium
AANPP

SEQ ID NO: 392042 - protein, 7 aa, Mycobacterium
AANPPLT

SEQ ID NO: 392043 - protein, 7 aa, Mycobacterium
AANPVSN

SEQ ID NO: 392044 - protein, 7 aa, Mycobacterium
AANQADG

SEQ ID NO: 392045 - protein, 10 aa, Mycobacterium
AANRDPRRFD

SEQ ID NO: 392046 - protein, 7 aa, Mycobacterium
AAPASDT

SEQ ID NO: 392047 - protein, 8 aa, Mycobacterium
AAPATVSE

SEQ ID NO: 392048 - protein, 6 aa, Mycobacterium
AAPDAI

SEQ ID NO: 392049 - protein, 7 aa, Mycobacterium
AAPDDST

SEQ ID NO: 392050 - protein, 7 aa, Mycobacterium
AAPDDVD

SEQ ID NO: 392051 - protein, 5 aa, Mycobacterium
AAPDG

SEQ ID NO: 392052 - protein, 6 aa, Mycobacterium
AAPDPE

SEQ ID NO: 392053 - protein, 10 aa, Mycobacterium
AAPDSGEQDL

SEQ ID NO: 392054 - protein, 8 aa, Mycobacterium
AAPDTGNM

SEQ ID NO: 392055 - protein, 5 aa, Mycobacterium
AAPER

SEQ ID NO: 392056 - protein, 6 aa, Mycobacterium
AAPGAT

SEQ ID NO: 392057 - protein, 7 aa, Mycobacterium
AAPGGFD

SEQ ID NO: 392058 - protein, 6 aa, Mycobacterium
AAPGPH

SEQ ID NO: 392059 - protein, 7 aa, Mycobacterium
AAPKTGG

SEQ ID NO: 392060 - protein, 7 aa, Mycobacterium
AAPPDPL

SEQ ID NO: 392061 - protein, 5 aa, Mycobacterium
AAPPE

SEQ ID NO: 392062 - protein, 8 aa, Mycobacterium
AAPPPAHT

SEQ ID NO: 392063 - protein, 7 aa, Mycobacterium
AAPPRPF

SEQ ID NO: 392064 - protein, 6 aa, Mycobacterium
AAPPTA

SEQ ID NO: 392065 - protein, 5 aa, Mycobacterium
AAPPV

SEQ ID NO: 392066 - protein, 5 aa, Mycobacterium
AAPRG

SEQ ID NO: 392067 - protein, 5 aa, Mycobacterium
AAPRL

SEQ ID NO: 392068 - protein, 5 aa, Mycobacterium
AAPRR

SEQ ID NO: 392069 - protein, 8 aa, Mycobacterium
AAPRYEEA

SEQ ID NO: 392070 - protein, 4 aa, Mycobacterium
AAPS

SEQ ID NO: 392071 - protein, 6 aa, Mycobacterium
AAPSAV

SEQ ID NO: 392072 - protein, 8 aa, Mycobacterium
AAPSETAQ

SEQ ID NO: 392073 - protein, 5 aa, Mycobacterium
AAPSF

SEQ ID NO: 392074 - protein, 7 aa, Mycobacterium
AAPTGAL

SEQ ID NO: 392075 - protein, 11 aa, Mycobacterium
AAPTGKAAARL

SEQ ID NO: 392076 - protein, 7 aa, Mycobacterium
AAPTIND

SEQ ID NO: 392077 - protein, 6 aa, Mycobacterium
AAPTRF

SEQ ID NO: 392078 - protein, 6 aa, Mycobacterium
AAPYTD

SEQ ID NO: 392079 - protein, 4 aa, Mycobacterium
AAQA

SEQ ID NO: 392080 - protein, 5 aa, Mycobacterium
AAQAA

SEQ ID NO: 392081 - protein, 16 aa, Mycobacterium
AAQAATEALRNHTQLP

SEQ ID NO: 392082 - protein, 7 aa, Mycobacterium
AAQEAGA

SEQ ID NO: 392083 - protein, 7 aa, Mycobacterium
AAQENGI

SEQ ID NO: 392084 - protein, 10 aa, Mycobacterium
AAQGDNSYFP

SEQ ID NO: 392085 - protein, 8 aa, Mycobacterium
AAQGRDRE

SEQ ID NO: 392086 - protein, 10 aa, Mycobacterium
AAQGSSPDQY

SEQ ID NO: 392087 - protein, 4 aa, Mycobacterium
AAQK

SEQ ID NO: 392088 - protein, 4 aa, Mycobacterium
AAQP

SEQ ID NO: 392089 - protein, 5 aa, Mycobacterium
AAQPE

SEQ ID NO: 392090 - protein, 5 aa, Mycobacterium
AAQRG

SEQ ID NO: 392091 - protein, 9 aa, Mycobacterium
AAQRGPDTA

SEQ ID NO: 392092 - protein, 9 aa, Mycobacterium
AAQRGRADE

SEQ ID NO: 392093 - protein, 5 aa, Mycobacterium
AAQRK

SEQ ID NO: 392094 - protein, 10 aa, Mycobacterium
AAQRYSGTAD

SEQ ID NO: 392095 - protein, 4 aa, Mycobacterium
AAQS

SEQ ID NO: 392096 - protein, 5 aa, Mycobacterium
AAQSL

SEQ ID NO: 392097 - protein, 5 aa, Mycobacterium
AAQTR

SEQ ID NO: 392098 - protein, 12 aa, Mycobacterium
AARAAGASASAK

SEQ ID NO: 392099 - protein, 9 aa, Mycobacterium
AARAAGHPG

SEQ ID NO: 392100 - protein, 6 aa, Mycobacterium
AARARG

SEQ ID NO: 392101 - protein, 6 aa, Mycobacterium
AARAVG

SEQ ID NO: 392102 - protein, 4 aa, Mycobacterium
AARD

SEQ ID NO: 392103 - protein, 9 aa, Mycobacterium
AARDAGAEV

SEQ ID NO: 392104 - protein, 15 aa, Mycobacterium
AARDPQARFGGPDTL

SEQ ID NO: 392105 - protein, 7 aa, Mycobacterium
AARDSLE

SEQ ID NO: 392106 - protein, 4 aa, Mycobacterium
AARE

SEQ ID NO: 392107 - protein, 5 aa, Mycobacterium
AAREA

SEQ ID NO: 392108 - protein, 8 aa, Mycobacterium
AAREASAT

SEQ ID NO: 392109 - protein, 5 aa, Mycobacterium
AAREL

SEQ ID NO: 392110 - protein, 13 aa, Mycobacterium
AARENAKSAREVT

SEQ ID NO: 392111 - protein, 14 aa, Mycobacterium
AARENAKSAREVTS

SEQ ID NO: 392112 - protein, 14 aa, Mycobacterium
AARENARGAREVTS

SEQ ID NO: 392113 - protein, 5 aa, Mycobacterium
AAREP

SEQ ID NO: 392114 - protein, 7 aa, Mycobacterium
AAREPRT

SEQ ID NO: 392115 - protein, 11 aa, Mycobacterium
AARETFNRRRG

SEQ ID NO: 392116 - protein, 5 aa, Mycobacterium
AARGA

SEQ ID NO: 392117 - protein, 8 aa, Mycobacterium
AARGDLEA

SEQ ID NO: 392118 - protein, 5 aa, Mycobacterium
AARGE

SEQ ID NO: 392119 - protein, 6 aa, Mycobacterium
AARGIG

SEQ ID NO: 392120 - protein, 7 aa, Mycobacterium
AARGQGA

SEQ ID NO: 392121 - protein, 8 aa, Mycobacterium
AARGQGRS

SEQ ID NO: 392122 - protein, 5 aa, Mycobacterium
AARHP

SEQ ID NO: 392123 - protein, 6 aa, Mycobacterium
AARHPE

SEQ ID NO: 392124 - protein, 4 aa, Mycobacterium
AARI

SEQ ID NO: 392125 - protein, 4 aa, Mycobacterium
AARN

SEQ ID NO: 392126 - protein, 5 aa, Mycobacterium
AARNL

SEQ ID NO: 392127 - protein, 7 aa, Mycobacterium
AARNPSR

SEQ ID NO: 392128 - protein, 6 aa, Mycobacterium
AARNRA

SEQ ID NO: 392129 - protein, 5 aa, Mycobacterium
AARNS

SEQ ID NO: 392130 - protein, 5 aa, Mycobacterium
AARPG

SEQ ID NO: 392131 - protein, 6 aa, Mycobacterium
AARPGE

SEQ ID NO: 392132 - protein, 12 aa, Mycobacterium
AARPGPTHRDNR

SEQ ID NO: 392133 - protein, 7 aa, Mycobacterium
AARQEAD

SEQ ID NO: 392134 - protein, 8 aa, Mycobacterium
AARRASPH

SEQ ID NO: 392135 - protein, 6 aa, Mycobacterium
AARSAG

SEQ ID NO: 392136 - protein, 5 aa, Mycobacterium
AARSV

SEQ ID NO: 392137 - protein, 8 aa, Mycobacterium
AARTAEQL

SEQ ID NO: 392138 - protein, 11 aa, Mycobacterium
AARTANGERPG

SEQ ID NO: 392139 - protein, 7 aa, Mycobacterium
AARTGGP

SEQ ID NO: 392140 - protein, 13 aa, Mycobacterium
AARVQPGTALQGN

SEQ ID NO: 392141 - protein, 4 aa, Mycobacterium
AARY

SEQ ID NO: 392142 - protein, 6 aa, Mycobacterium
AASAAS

SEQ ID NO: 392143 - protein, 14 aa, Mycobacterium
AASAQGAADPPPVP

SEQ ID NO: 392144 - protein, 10 aa, Mycobacterium
AASATGEVNR

SEQ ID NO: 392145 - protein, 6 aa, Mycobacterium
AASDGA

SEQ ID NO: 392146 - protein, 7 aa, Mycobacterium
AASDRPL

SEQ ID NO: 392147 - protein, 8 aa, Mycobacterium
AASEGLSK

SEQ ID NO: 392148 - protein, 21 aa, Mycobacterium
AASESASRRRAMKSATDNADD

SEQ ID NO: 392149 - protein, 13 aa, Mycobacterium
AASEWDEREETPW

SEQ ID NO: 392150 - protein, 5 aa, Mycobacterium
AASGG

SEQ ID NO: 392151 - protein, 6 aa, Mycobacterium
AASGID

SEQ ID NO: 392152 - protein, 11 aa, Mycobacterium
AASGIDPRDSA

SEQ ID NO: 392153 - protein, 5 aa, Mycobacterium
AASGL

SEQ ID NO: 392154 - protein, 6 aa, Mycobacterium
AASGSI

SEQ ID NO: 392155 - protein, 5 aa, Mycobacterium
AASKE

SEQ ID NO: 392156 - protein, 8 aa, Mycobacterium
AASKGGIQ

SEQ ID NO: 392157 - protein, 9 aa, Mycobacterium
AASLRDREK

SEQ ID NO: 392158 - protein, 5 aa, Mycobacterium
AASNT

SEQ ID NO: 392159 - protein, 5 aa, Mycobacterium
AASPP

SEQ ID NO: 392160 - protein, 7 aa, Mycobacterium
AASQPVG

SEQ ID NO: 392161 - protein, 5 aa, Mycobacterium
AASRC

SEQ ID NO: 392162 - protein, 11 aa, Mycobacterium
AASREAESAFG

SEQ ID NO: 392163 - protein, 13 aa, Mycobacterium
AASREAESAFGDP

SEQ ID NO: 392164 - protein, 15 aa, Mycobacterium
AASREVTRGGTPISL

SEQ ID NO: 392165 - protein, 5 aa, Mycobacterium
AASSA

SEQ ID NO: 392166 - protein, 7 aa, Mycobacterium
AASSPEK

SEQ ID NO: 392167 - protein, 10 aa, Mycobacterium
AASSPYGGEI

SEQ ID NO: 392168 - protein, 6 aa, Mycobacterium
AASTDA

SEQ ID NO: 392169 - protein, 4 aa, Mycobacterium
AASV

SEQ ID NO: 392170 - protein, 8 aa, Mycobacterium
AASVSGSQ

SEQ ID NO: 392171 - protein, 7 aa, Mycobacterium
AASYISG

SEQ ID NO: 392172 - protein, 5 aa, Mycobacterium
AATAE

SEQ ID NO: 392173 - protein, 14 aa, Mycobacterium
AATAGDKQTLGTNW

SEQ ID NO: 392174 - protein, 7 aa, Mycobacterium
AATARSE

SEQ ID NO: 392175 - protein, 10 aa, Mycobacterium
AATDPPWETR

SEQ ID NO: 392176 - protein, 10 aa, Mycobacterium
AATDTPGAMG

SEQ ID NO: 392177 - protein, 6 aa, Mycobacterium
AATEAE

SEQ ID NO: 392178 - protein, 9 aa, Mycobacterium
AATESQRGN

SEQ ID NO: 392179 - protein, 17 aa, Mycobacterium
AATETDLKKRKEAVEDA

SEQ ID NO: 392180 - protein, 5 aa, Mycobacterium
AATGA

SEQ ID NO: 392181 - protein, 9 aa, Mycobacterium
AATGAGHGT

SEQ ID NO: 392182 - protein, 7 aa, Mycobacterium
AATGDSD

SEQ ID NO: 392183 - protein, 5 aa, Mycobacterium
AATGG

SEQ ID NO: 392184 - protein, 7 aa, Mycobacterium
AATGGRG

SEQ ID NO: 392185 - protein, 5 aa, Mycobacterium
AATGP

SEQ ID NO: 392186 - protein, 8 aa, Mycobacterium
AATGTPLV

SEQ ID NO: 392187 - protein, 5 aa, Mycobacterium
AATGV

SEQ ID NO: 392188 - protein, 5 aa, Mycobacterium
AATIT

SEQ ID NO: 392189 - protein, 4 aa, Mycobacterium
AATK

SEQ ID NO: 392190 - protein, 6 aa, Mycobacterium
AATNDV

SEQ ID NO: 392191 - protein, 6 aa, Mycobacterium
AATPAG

SEQ ID NO: 392192 - protein, 8 aa, Mycobacterium
AATPNADR

SEQ ID NO: 392193 - protein, 19 aa, Mycobacterium
AATPTDAAKKVVPDTAAEQ

SEQ ID NO: 392194 - protein, 8 aa, Mycobacterium
AATQPSVE

SEQ ID NO: 392195 - protein, 5 aa, Mycobacterium
AATRA

SEQ ID NO: 392196 - protein, 7 aa, Mycobacterium
AATRGGW

SEQ ID NO: 392197 - protein, 6 aa, Mycobacterium
AATSAA

SEQ ID NO: 392198 - protein, 13 aa, Mycobacterium
AATSDGQVYGFAP

SEQ ID NO: 392199 - protein, 8 aa, Mycobacterium
AATTPPQK

SEQ ID NO: 392200 - protein, 6 aa, Mycobacterium
AATTSR

SEQ ID NO: 392201 - protein, 5 aa, Mycobacterium
AAVAA

SEQ ID NO: 392202 - protein, 8 aa, Mycobacterium
AAVAREDS

SEQ ID NO: 392203 - protein, 10 aa, Mycobacterium
AAVGDAELGQ

SEQ ID NO: 392204 - protein, 5 aa, Mycobacterium
AAVGE

SEQ ID NO: 392205 - protein, 4 aa, Mycobacterium
AAVP

SEQ ID NO: 392206 - protein, 4 aa, Mycobacterium
AAVS

SEQ ID NO: 392207 - protein, 7 aa, Mycobacterium
AAVSDGT

SEQ ID NO: 392208 - protein, 6 aa, Mycobacterium
AAVSPG

SEQ ID NO: 392209 - protein, 4 aa, Mycobacterium
AAVT

SEQ ID NO: 392210 - protein, 8 aa, Mycobacterium
AAYAQADN

SEQ ID NO: 392211 - protein, 8 aa, Mycobacterium
AAYGNEAA

SEQ ID NO: 392212 - protein, 9 aa, Mycobacterium
AAYGNEAAV

SEQ ID NO: 392213 - protein, 6 aa, Mycobacterium
AAYGSS

SEQ ID NO: 392214 - protein, 4 aa, Mycobacterium
AAYP

SEQ ID NO: 392215 - protein, 8 aa, Mycobacterium
ACAGDNGA

SEQ ID NO: 392216 - protein, 5 aa, Mycobacterium
ACPPD

SEQ ID NO: 392217 - protein, 5 aa, Mycobacterium
ACSSS

SEQ ID NO: 392218 - protein, 12 aa, Mycobacterium
ADAADAVRSGTV

SEQ ID NO: 392219 - protein, 7 aa, Mycobacterium
ADAAEGV

SEQ ID NO: 392220 - protein, 5 aa, Mycobacterium
ADAAG

SEQ ID NO: 392221 - protein, 5 aa, Mycobacterium
ADAAL

SEQ ID NO: 392222 - protein, 6 aa, Mycobacterium
ADAALR

SEQ ID NO: 392223 - protein, 7 aa, Mycobacterium
ADAAPIA

SEQ ID NO: 392224 - protein, 7 aa, Mycobacterium
ADAAPMA

SEQ ID NO: 392225 - protein, 6 aa, Mycobacterium
ADAASV

SEQ ID NO: 392226 - protein, 6 aa, Mycobacterium
ADADAD

SEQ ID NO: 392227 - protein, 7 aa, Mycobacterium
ADADRDA

SEQ ID NO: 392228 - protein, 10 aa, Mycobacterium
ADAEGIPYED

SEQ ID NO: 392229 - protein, 7 aa, Mycobacterium
ADAEGVT

SEQ ID NO: 392230 - protein, 12 aa, Mycobacterium
ADAESRARLEQR

SEQ ID NO: 392231 - protein, 9 aa, Mycobacterium
ADAGHGDSI

SEQ ID NO: 392232 - protein, 5 aa, Mycobacterium
ADAGL

SEQ ID NO: 392233 - protein, 6 aa, Mycobacterium
ADAGPQ

SEQ ID NO: 392234 - protein, 7 aa, Mycobacterium
ADAGPTL

SEQ ID NO: 392235 - protein, 8 aa, Mycobacterium
ADAGSGVA

SEQ ID NO: 392236 - protein, 5 aa, Mycobacterium
ADAGV

SEQ ID NO: 392237 - protein, 6 aa, Mycobacterium
ADALGG

SEQ ID NO: 392238 - protein, 8 aa, Mycobacterium
ADAPDTRR

SEQ ID NO: 392239 - protein, 4 aa, Mycobacterium
ADAR

SEQ ID NO: 392240 - protein, 8 aa, Mycobacterium
ADARPQDD

SEQ ID NO: 392241 - protein, 8 aa, Mycobacterium
ADARRNEQ

SEQ ID NO: 392242 - protein, 6 aa, Mycobacterium
ADARRR

SEQ ID NO: 392243 - protein, 5 aa, Mycobacterium
ADAST

SEQ ID NO: 392244 - protein, 9 aa, Mycobacterium
ADASTDDGI

SEQ ID NO: 392245 - protein, 9 aa, Mycobacterium
ADASTDEGI

SEQ ID NO: 392246 - protein, 14 aa, Mycobacterium
ADAVKQRRTRAYDQ

SEQ ID NO: 392247 - protein, 5 aa, Mycobacterium
ADDAA

SEQ ID NO: 392248 - protein, 8 aa, Mycobacterium
ADDAADAI

SEQ ID NO: 392249 - protein, 10 aa, Mycobacterium
ADDAAEVRSR

SEQ ID NO: 392250 - protein, 4 aa, Mycobacterium
ADDD

SEQ ID NO: 392251 - protein, 9 aa, Mycobacterium
ADDDARDRA

SEQ ID NO: 392252 - protein, 4 aa, Mycobacterium
ADDG

SEQ ID NO: 392253 - protein, 4 aa, Mycobacterium
ADDI

SEQ ID NO: 392254 - protein, 5 aa, Mycobacterium
ADDIG

SEQ ID NO: 392255 - protein, 5 aa, Mycobacterium
ADDPE

SEQ ID NO: 392256 - protein, 5 aa, Mycobacterium
ADDPH

SEQ ID NO: 392257 - protein, 6 aa, Mycobacterium
ADDPRF

SEQ ID NO: 392258 - protein, 7 aa, Mycobacterium
ADDTGDE

SEQ ID NO: 392259 - protein, 4 aa, Mycobacterium
ADDV

SEQ ID NO: 392260 - protein, 5 aa, Mycobacterium
ADDVA

SEQ ID NO: 392261 - protein, 5 aa, Mycobacterium
ADDVR

SEQ ID NO: 392262 - protein, 8 aa, Mycobacterium
ADDYQDKA

SEQ ID NO: 392263 - protein, 10 aa, Mycobacterium
ADEDGQTFTD

SEQ ID NO: 392264 - protein, 4 aa, Mycobacterium
ADEE

SEQ ID NO: 392265 - protein, 4 aa, Mycobacterium
ADEI

SEQ ID NO: 392266 - protein, 6 aa, Mycobacterium
ADENLR

SEQ ID NO: 392267 - protein, 8 aa, Mycobacterium
ADENSTVP

SEQ ID NO: 392268 - protein, 7 aa, Mycobacterium
ADERAEL

SEQ ID NO: 392269 - protein, 7 aa, Mycobacterium
ADERPGA

SEQ ID NO: 392270 - protein, 5 aa, Mycobacterium
ADERR

SEQ ID NO: 392271 - protein, 18 aa, Mycobacterium
ADESARSSGALHNVFLPT

SEQ ID NO: 392272 - protein, 6 aa, Mycobacterium
ADEVSA

SEQ ID NO: 392273 - protein, 6 aa, Mycobacterium
ADFGAR

SEQ ID NO: 392274 - protein, 5 aa, Mycobacterium
ADFPA

SEQ ID NO: 392275 - protein, 12 aa, Mycobacterium
ADGAEKRPATPI

SEQ ID NO: 392276 - protein, 5 aa, Mycobacterium
ADGDD

SEQ ID NO: 392277 - protein, 5 aa, Mycobacterium
ADGDP

SEQ ID NO: 392278 - protein, 5 aa, Mycobacterium
ADGDR

SEQ ID NO: 392279 - protein, 4 aa, Mycobacterium
ADGE

SEQ ID NO: 392280 - protein, 7 aa, Mycobacterium
ADGEEHT

SEQ ID NO: 392281 - protein, 6 aa, Mycobacterium
ADGEFS

SEQ ID NO: 392282 - protein, 8 aa, Mycobacterium
ADGEGRYI

SEQ ID NO: 392283 - protein, 8 aa, Mycobacterium
ADGEHAVE

SEQ ID NO: 392284 - protein, 8 aa, Mycobacterium
ADGEQEKL

SEQ ID NO: 392285 - protein, 5 aa, Mycobacterium
ADGER

SEQ ID NO: 392286 - protein, 7 aa, Mycobacterium
ADGGARV

SEQ ID NO: 392287 - protein, 5 aa, Mycobacterium
ADGGV

SEQ ID NO: 392288 - protein, 5 aa, Mycobacterium
ADGKL

SEQ ID NO: 392289 - protein, 5 aa, Mycobacterium
ADGLG

SEQ ID NO: 392290 - protein, 5 aa, Mycobacterium
ADGNR

SEQ ID NO: 392291 - protein, 6 aa, Mycobacterium
ADGPAL

SEQ ID NO: 392292 - protein, 6 aa, Mycobacterium
ADGPIT

SEQ ID NO: 392293 - protein, 7 aa, Mycobacterium
ADGPPVI

SEQ ID NO: 392294 - protein, 8 aa, Mycobacterium
ADGPRGAA

SEQ ID NO: 392295 - protein, 4 aa, Mycobacterium
ADGQ

SEQ ID NO: 392296 - protein, 7 aa, Mycobacterium
ADGRRSR

SEQ ID NO: 392297 - protein, 5 aa, Mycobacterium
ADGSA

SEQ ID NO: 392298 - protein, 6 aa, Mycobacterium
ADGSAM

SEQ ID NO: 392299 - protein, 9 aa, Mycobacterium
ADGSEYRGR

SEQ ID NO: 392300 - protein, 8 aa, Mycobacterium
ADGSHAPE

SEQ ID NO: 392301 - protein, 6 aa, Mycobacterium
ADGTAM

SEQ ID NO: 392302 - protein, 7 aa, Mycobacterium
ADGTELA

SEQ ID NO: 392303 - protein, 5 aa, Mycobacterium
ADGTQ

SEQ ID NO: 392304 - protein, 5 aa, Mycobacterium
ADGTS

SEQ ID NO: 392305 - protein, 6 aa, Mycobacterium
ADGTVA

SEQ ID NO: 392306 - protein, 4 aa, Mycobacterium
ADGV

SEQ ID NO: 392307 - protein, 6 aa, Mycobacterium
ADGVTV

SEQ ID NO: 392308 - protein, 4 aa, Mycobacterium
ADGW

SEQ ID NO: 392309 - protein, 4 aa, Mycobacterium
ADHA

SEQ ID NO: 392310 - protein, 12 aa, Mycobacterium
ADHERTNVHGSG

SEQ ID NO: 392311 - protein, 7 aa, Mycobacterium
ADHGTGR

SEQ ID NO: 392312 - protein, 4 aa, Mycobacterium
ADHP

SEQ ID NO: 392313 - protein, 10 aa, Mycobacterium
ADHPARSEQD

SEQ ID NO: 392314 - protein, 5 aa, Mycobacterium
ADHPG

SEQ ID NO: 392315 - protein, 10 aa, Mycobacterium
ADHRASDGHR

SEQ ID NO: 392316 - protein, 11 aa, Mycobacterium
ADIGEHSNIGA

SEQ ID NO: 392317 - protein, 5 aa, Mycobacterium
ADIKG

SEQ ID NO: 392318 - protein, 14 aa, Mycobacterium
ADKAGARDRADDLA

SEQ ID NO: 392319 - protein, 5 aa, Mycobacterium
ADKAL

SEQ ID NO: 392320 - protein, 4 aa, Mycobacterium
ADKG

SEQ ID NO: 392321 - protein, 5 aa, Mycobacterium
ADKGI

SEQ ID NO: 392322 - protein, 7 aa, Mycobacterium
ADKGLSG

SEQ ID NO: 392323 - protein, 4 aa, Mycobacterium
ADLA

SEQ ID NO: 392324 - protein, 6 aa, Mycobacterium
ADLAEK

SEQ ID NO: 392325 - protein, 12 aa, Mycobacterium
ADLAGSNNTTMD

SEQ ID NO: 392326 - protein, 18 aa, Mycobacterium
ADLAKGHPRAQERDDALS

SEQ ID NO: 392327 - protein, 6 aa, Mycobacterium
ADLGEY

SEQ ID NO: 392328 - protein, 4 aa, Mycobacterium
ADLN

SEQ ID NO: 392329 - protein, 5 aa, Mycobacterium
ADLPL

SEQ ID NO: 392330 - protein, 6 aa, Mycobacterium
ADLRGP

SEQ ID NO: 392331 - protein, 7 aa, Mycobacterium
ADLTNRS

SEQ ID NO: 392332 - protein, 9 aa, Mycobacterium
ADMGPGDEW

SEQ ID NO: 392333 - protein, 6 aa, Mycobacterium
ADMTSG

SEQ ID NO: 392334 - protein, 4 aa, Mycobacterium
ADNG

SEQ ID NO: 392335 - protein, 5 aa, Mycobacterium
ADNGW

SEQ ID NO: 392336 - protein, 8 aa, Mycobacterium
ADNPSDDI

SEQ ID NO: 392337 - protein, 7 aa, Mycobacterium
ADNSRAV

SEQ ID NO: 392338 - protein, 5 aa, Mycobacterium
ADPAA

SEQ ID NO: 392339 - protein, 7 aa, Mycobacterium
ADPAAEY

SEQ ID NO: 392340 - protein, 5 aa, Mycobacterium
ADPAD

SEQ ID NO: 392341 - protein, 5 aa, Mycobacterium
ADPAE

SEQ ID NO: 392342 - protein, 5 aa, Mycobacterium
ADPAG

SEQ ID NO: 392343 - protein, 5 aa, Mycobacterium
ADPAP

SEQ ID NO: 392344 - protein, 5 aa, Mycobacterium
ADPAR

SEQ ID NO: 392345 - protein, 8 aa, Mycobacterium
ADPARPLS

SEQ ID NO: 392346 - protein, 7 aa, Mycobacterium
ADPASAH

SEQ ID NO: 392347 - protein, 6 aa, Mycobacterium
ADPATA

SEQ ID NO: 392348 - protein, 8 aa, Mycobacterium
ADPDGGAT

SEQ ID NO: 392349 - protein, 7 aa, Mycobacterium
ADPDGGL

SEQ ID NO: 392350 - protein, 19 aa, Mycobacterium
ADPDGGNLADRAGRQSAAT

SEQ ID NO: 392351 - protein, 5 aa, Mycobacterium
ADPDV

SEQ ID NO: 392352 - protein, 5 aa, Mycobacterium
ADPEA

SEQ ID NO: 392353 - protein, 6 aa, Mycobacterium
ADPEEL

SEQ ID NO: 392354 - protein, 5 aa, Mycobacterium
ADPEH

SEQ ID NO: 392355 - protein, 7 aa, Mycobacterium
ADPERRA

SEQ ID NO: 392356 - protein, 5 aa, Mycobacterium
ADPEV

SEQ ID NO: 392357 - protein, 4 aa, Mycobacterium
ADPG

SEQ ID NO: 392358 - protein, 5 aa, Mycobacterium
ADPGA

SEQ ID NO: 392359 - protein, 7 aa, Mycobacterium
ADPGGPV

SEQ ID NO: 392360 - protein, 6 aa, Mycobacterium
ADPKLA

SEQ ID NO: 392361 - protein, 7 aa, Mycobacterium
ADPKTQV

SEQ ID NO: 392362 - protein, 5 aa, Mycobacterium
ADPLA

SEQ ID NO: 392363 - protein, 5 aa, Mycobacterium
ADPLD

SEQ ID NO: 392364 - protein, 6 aa, Mycobacterium
ADPLGG

SEQ ID NO: 392365 - protein, 4 aa, Mycobacterium
ADPM

SEQ ID NO: 392366 - protein, 5 aa, Mycobacterium
ADPNF

SEQ ID NO: 392367 - protein, 6 aa, Mycobacterium
ADPPEF

SEQ ID NO: 392368 - protein, 8 aa, Mycobacterium
ADPPPESL

SEQ ID NO: 392369 - protein, 7 aa, Mycobacterium
ADPQARD

SEQ ID NO: 392370 - protein, 5 aa, Mycobacterium
ADPRA

SEQ ID NO: 392371 - protein, 5 aa, Mycobacterium
ADPRL

SEQ ID NO: 392372 - protein, 4 aa, Mycobacterium
ADPS

SEQ ID NO: 392373 - protein, 5 aa, Mycobacterium
ADPSL

SEQ ID NO: 392374 - protein, 6 aa, Mycobacterium
ADPSMG

SEQ ID NO: 392375 - protein, 14 aa, Mycobacterium
ADPSQQLPRLSGEE

SEQ ID NO: 392376 - protein, 10 aa, Mycobacterium
ADPSRSAGNI

SEQ ID NO: 392377 - protein, 8 aa, Mycobacterium
ADPTETTN

SEQ ID NO: 392378 - protein, 7 aa, Mycobacterium
ADPVGSL

SEQ ID NO: 392379 - protein, 4 aa, Mycobacterium
ADQA

SEQ ID NO: 392380 - protein, 7 aa, Mycobacterium
ADQRQER

SEQ ID NO: 392381 - protein, 18 aa, Mycobacterium
ADQRRTDVTTTLGPGATV

SEQ ID NO: 392382 - protein, 7 aa, Mycobacterium
ADQTAAD

SEQ ID NO: 392383 - protein, 4 aa, Mycobacterium
ADQV

SEQ ID NO: 392384 - protein, 8 aa, Mycobacterium
ADRAAAIE

SEQ ID NO: 392385 - protein, 11 aa, Mycobacterium
ADRDGADQTVR

SEQ ID NO: 392386 - protein, 6 aa, Mycobacterium
ADRDGV

SEQ ID NO: 392387 - protein, 7 aa, Mycobacterium
ADREGRK

SEQ ID NO: 392388 - protein, 6 aa, Mycobacterium
ADRHPG

SEQ ID NO: 392389 - protein, 4 aa, Mycobacterium
ADRI

SEQ ID NO: 392390 - protein, 6 aa, Mycobacterium
ADRKGG

SEQ ID NO: 392391 - protein, 7 aa, Mycobacterium
ADRKGGH

SEQ ID NO: 392392 - protein, 4 aa, Mycobacterium
ADRM

SEQ ID NO: 392393 - protein, 5 aa, Mycobacterium
ADRNR

SEQ ID NO: 392394 - protein, 7 aa, Mycobacterium
ADRNTLR

SEQ ID NO: 392395 - protein, 5 aa, Mycobacterium
ADRRA

SEQ ID NO: 392396 - protein, 5 aa, Mycobacterium
ADRRY

SEQ ID NO: 392397 - protein, 4 aa, Mycobacterium
ADSA

SEQ ID NO: 392398 - protein, 6 aa, Mycobacterium
ADSGSV

SEQ ID NO: 392399 - protein, 4 aa, Mycobacterium
ADSL

SEQ ID NO: 392400 - protein, 6 aa, Mycobacterium
ADSPVG

SEQ ID NO: 392401 - protein, 8 aa, Mycobacterium
ADSPVHGN

SEQ ID NO: 392402 - protein, 4 aa, Mycobacterium
ADSR

SEQ ID NO: 392403 - protein, 6 aa, Mycobacterium
ADSSGC

SEQ ID NO: 392404 - protein, 5 aa, Mycobacterium
ADSTT

SEQ ID NO: 392405 - protein, 4 aa, Mycobacterium
ADSV

SEQ ID NO: 392406 - protein, 8 aa, Mycobacterium
ADTAESYS

SEQ ID NO: 392407 - protein, 7 aa, Mycobacterium
ADTAETA

SEQ ID NO: 392408 - protein, 11 aa, Mycobacterium
ADTAGKPSLGW

SEQ ID NO: 392409 - protein, 6 aa, Mycobacterium
ADTARG

SEQ ID NO: 392410 - protein, 6 aa, Mycobacterium
ADTARQ

SEQ ID NO: 392411 - protein, 6 aa, Mycobacterium
ADTDGY

SEQ ID NO: 392412 - protein, 11 aa, Mycobacterium
ADTERQRAQGK

SEQ ID NO: 392413 - protein, 8 aa, Mycobacterium
ADTGSGSI

SEQ ID NO: 392414 - protein, 7 aa, Mycobacterium
ADTKKRM

SEQ ID NO: 392415 - protein, 5 aa, Mycobacterium
ADTLA

SEQ ID NO: 392416 - protein, 11 aa, Mycobacterium
ADTNTNSGPQL

SEQ ID NO: 392417 - protein, 8 aa, Mycobacterium
ADTQARPV

SEQ ID NO: 392418 - protein, 4 aa, Mycobacterium
ADTR

SEQ ID NO: 392419 - protein, 13 aa, Mycobacterium
ADTTFDGRSRGQV

SEQ ID NO: 392420 - protein, 5 aa, Mycobacterium
ADVAA

SEQ ID NO: 392421 - protein, 12 aa, Mycobacterium
ADVDENSRFPQE

SEQ ID NO: 392422 - protein, 6 aa, Mycobacterium
ADVDTA

SEQ ID NO: 392423 - protein, 4 aa, Mycobacterium
ADVE

SEQ ID NO: 392424 - protein, 10 aa, Mycobacterium
ADVPPRDAAE

SEQ ID NO: 392425 - protein, 5 aa, Mycobacterium
ADVTG

SEQ ID NO: 392426 - protein, 6 aa, Mycobacterium
ADVVGS

SEQ ID NO: 392427 - protein, 4 aa, Mycobacterium
ADYA

SEQ ID NO: 392428 - protein, 4 aa, Mycobacterium
ADYE

SEQ ID NO: 392429 - protein, 6 aa, Mycobacterium
AEAAAG

SEQ ID NO: 392430 - protein, 8 aa, Mycobacterium
AEAAGSDR

SEQ ID NO: 392431 - protein, 5 aa, Mycobacterium
AEAAT

SEQ ID NO: 392432 - protein, 4 aa, Mycobacterium
AEAD

SEQ ID NO: 392433 - protein, 5 aa, Mycobacterium
AEADD

SEQ ID NO: 392434 - protein, 8 aa, Mycobacterium
AEADQDDM

SEQ ID NO: 392435 - protein, 6 aa, Mycobacterium
AEADRL

SEQ ID NO: 392436 - protein, 9 aa, Mycobacterium
AEADRREGL

SEQ ID NO: 392437 - protein, 5 aa, Mycobacterium
AEAEH

SEQ ID NO: 392438 - protein, 5 aa, Mycobacterium
AEAES

SEQ ID NO: 392439 - protein, 5 aa, Mycobacterium
AEAFT

SEQ ID NO: 392440 - protein, 17 aa, Mycobacterium
AEAGAEIARRSRGTPRI

SEQ ID NO: 392441 - protein, 5 aa, Mycobacterium
AEAGK

SEQ ID NO: 392442 - protein, 6 aa, Mycobacterium
AEAGMT

SEQ ID NO: 392443 - protein, 10 aa, Mycobacterium
AEAGNPPTRH

SEQ ID NO: 392444 - protein, 7 aa, Mycobacterium
AEAGPTE

SEQ ID NO: 392445 - protein, 8 aa, Mycobacterium
AEAGRSAA

SEQ ID NO: 392446 - protein, 8 aa, Mycobacterium
AEAGRSTA

SEQ ID NO: 392447 - protein, 9 aa, Mycobacterium
AEAGSSNKA

SEQ ID NO: 392448 - protein, 5 aa, Mycobacterium
AEAGT

SEQ ID NO: 392449 - protein, 5 aa, Mycobacterium
AEAIG

SEQ ID NO: 392450 - protein, 4 aa, Mycobacterium
AEAK

SEQ ID NO: 392451 - protein, 6 aa, Mycobacterium
AEARPD

SEQ ID NO: 392452 - protein, 11 aa, Mycobacterium
AEASDRAREAL

SEQ ID NO: 392453 - protein, 7 aa, Mycobacterium
AEASMSE

SEQ ID NO: 392454 - protein, 12 aa, Mycobacterium
AEDAAAASRYVG

SEQ ID NO: 392455 - protein, 5 aa, Mycobacterium
AEDAE

SEQ ID NO: 392456 - protein, 9 aa, Mycobacterium
AEDATGSTA

SEQ ID NO: 392457 - protein, 15 aa, Mycobacterium
AEDDDVNRYRASKQA

SEQ ID NO: 392458 - protein, 5 aa, Mycobacterium
AEDDY

SEQ ID NO: 392459 - protein, 7 aa, Mycobacterium
AEDEQDA

SEQ ID NO: 392460 - protein, 6 aa, Mycobacterium
AEDEVS

SEQ ID NO: 392461 - protein, 7 aa, Mycobacterium
AEDGSSV

SEQ ID NO: 392462 - protein, 10 aa, Mycobacterium
AEDGTPSVSA

SEQ ID NO: 392463 - protein, 13 aa, Mycobacterium
AEDGTVLGPGETG

SEQ ID NO: 392464 - protein, 5 aa, Mycobacterium
AEDPA

SEQ ID NO: 392465 - protein, 13 aa, Mycobacterium
AEDPADDYRPCTG

SEQ ID NO: 392466 - protein, 6 aa, Mycobacterium
AEDPAR

SEQ ID NO: 392467 - protein, 5 aa, Mycobacterium
AEDPR

SEQ ID NO: 392468 - protein, 7 aa, Mycobacterium
AEDPTKD

SEQ ID NO: 392469 - protein, 7 aa, Mycobacterium
AEDPTWE

SEQ ID NO: 392470 - protein, 8 aa, Mycobacterium
AEDREENI

SEQ ID NO: 392471 - protein, 7 aa, Mycobacterium
AEDTTVR

SEQ ID NO: 392472 - protein, 4 aa, Mycobacterium
AEDY

SEQ ID NO: 392473 - protein, 7 aa, Mycobacterium
AEEAARE

SEQ ID NO: 392474 - protein, 4 aa, Mycobacterium
AEEE

SEQ ID NO: 392475 - protein, 5 aa, Mycobacterium
AEEIG

SEQ ID NO: 392476 - protein, 9 aa, Mycobacterium
AEENRHSTA

SEQ ID NO: 392477 - protein, 20 aa, Mycobacterium
AEEQALADASADRASQIRTV

SEQ ID NO: 392478 - protein, 5 aa, Mycobacterium
AEEQV

SEQ ID NO: 392479 - protein, 5 aa, Mycobacterium
AEERA

SEQ ID NO: 392480 - protein, 5 aa, Mycobacterium
AEERS

SEQ ID NO: 392481 - protein, 14 aa, Mycobacterium
AEETAEAVGSTAGA

SEQ ID NO: 392482 - protein, 10 aa, Mycobacterium
AEFGNGTTTV

SEQ ID NO: 392483 - protein, 4 aa, Mycobacterium
AEFP

SEQ ID NO: 392484 - protein, 4 aa, Mycobacterium
AEFS

SEQ ID NO: 392485 - protein, 5 aa, Mycobacterium
AEGAA

SEQ ID NO: 392486 - protein, 5 aa, Mycobacterium
AEGAG

SEQ ID NO: 392487 - protein, 5 aa, Mycobacterium
AEGAP

SEQ ID NO: 392488 - protein, 6 aa, Mycobacterium
AEGAPD

SEQ ID NO: 392489 - protein, 6 aa, Mycobacterium
AEGAPV

SEQ ID NO: 392490 - protein, 6 aa, Mycobacterium
AEGARL

SEQ ID NO: 392491 - protein, 6 aa, Mycobacterium
AEGDAE

SEQ ID NO: 392492 - protein, 9 aa, Mycobacterium
AEGGDTATV

SEQ ID NO: 392493 - protein, 8 aa, Mycobacterium
AEGIPYDD

SEQ ID NO: 392494 - protein, 6 aa, Mycobacterium
AEGIRP

SEQ ID NO: 392495 - protein, 4 aa, Mycobacterium
AEGK

SEQ ID NO: 392496 - protein, 12 aa, Mycobacterium
AEGKATELANRE

SEQ ID NO: 392497 - protein, 9 aa, Mycobacterium
AEGKATKEA

SEQ ID NO: 392498 - protein, 9 aa, Mycobacterium
AEGKTGEEI

SEQ ID NO: 392499 - protein, 5 aa, Mycobacterium
AEGLP

SEQ ID NO: 392500 - protein, 8 aa, Mycobacterium
AEGNRQRS

SEQ ID NO: 392501 - protein, 4 aa, Mycobacterium
AEGP

SEQ ID NO: 392502 - protein, 5 aa, Mycobacterium
AEGPI

SEQ ID NO: 392503 - protein, 7 aa, Mycobacterium
AEGPRPV

SEQ ID NO: 392504 - protein, 5 aa, Mycobacterium
AEGPV

SEQ ID NO: 392505 - protein, 4 aa, Mycobacterium
AEGR

SEQ ID NO: 392506 - protein, 6 aa, Mycobacterium
AEGTDL

SEQ ID NO: 392507 - protein, 4 aa, Mycobacterium
AEHD

SEQ ID NO: 392508 - protein, 6 aa, Mycobacterium
AEHGAI

SEQ ID NO: 392509 - protein, 11 aa, Mycobacterium
AEHHSDSTESY

SEQ ID NO: 392510 - protein, 6 aa, Mycobacterium
AEHPGS

SEQ ID NO: 392511 - protein, 7 aa, Mycobacterium
AEHPSSG

SEQ ID NO: 392512 - protein, 5 aa, Mycobacterium
AEHRG

SEQ ID NO: 392513 - protein, 5 aa, Mycobacterium
AEING

SEQ ID NO: 392514 - protein, 4 aa, Mycobacterium
AEKA

SEQ ID NO: 392515 - protein, 6 aa, Mycobacterium
AEKDSI

SEQ ID NO: 392516 - protein, 9 aa, Mycobacterium
AEKGPKGFT

SEQ ID NO: 392517 - protein, 7 aa, Mycobacterium
AEKKKAI

SEQ ID NO: 392518 - protein, 5 aa, Mycobacterium
AEKPP

SEQ ID NO: 392519 - protein, 7 aa, Mycobacterium
AEKPRGF

SEQ ID NO: 392520 - protein, 10 aa, Mycobacterium
AEKSGVSNPY

SEQ ID NO: 392521 - protein, 10 aa, Mycobacterium
AEKTGTFTNA

SEQ ID NO: 392522 - protein, 7 aa, Mycobacterium
AEKVDRS

SEQ ID NO: 392523 - protein, 4 aa, Mycobacterium
AELA

SEQ ID NO: 392524 - protein, 6 aa, Mycobacterium
AELADA

SEQ ID NO: 392525 - protein, 6 aa, Mycobacterium
AELDEG

SEQ ID NO: 392526 - protein, 6 aa, Mycobacterium
AELGRG

SEQ ID NO: 392527 - protein, 8 aa, Mycobacterium
AELGYGSD

SEQ ID NO: 392528 - protein, 4 aa, Mycobacterium
AELP

SEQ ID NO: 392529 - protein, 12 aa, Mycobacterium
AELPGESATTDR

SEQ ID NO: 392530 - protein, 4 aa, Mycobacterium
AELQ

SEQ ID NO: 392531 - protein, 4 aa, Mycobacterium
AEMP

SEQ ID NO: 392532 - protein, 5 aa, Mycobacterium
AENAE

SEQ ID NO: 392533 - protein, 5 aa, Mycobacterium
AENGL

SEQ ID NO: 392534 - protein, 7 aa, Mycobacterium
AENPRDL

SEQ ID NO: 392535 - protein, 7 aa, Mycobacterium
AENPTWD

SEQ ID NO: 392536 - protein, 4 aa, Mycobacterium
AEPD

SEQ ID NO: 392537 - protein, 6 aa, Mycobacterium
AEPDRV

SEQ ID NO: 392538 - protein, 4 aa, Mycobacterium
AEPG

SEQ ID NO: 392539 - protein, 6 aa, Mycobacterium
AEPGHH

SEQ ID NO: 392540 - protein, 7 aa, Mycobacterium
AEPGLGA

SEQ ID NO: 392541 - protein, 5 aa, Mycobacterium
AEPGS

SEQ ID NO: 392542 - protein, 6 aa, Mycobacterium
AEPGTA

SEQ ID NO: 392543 - protein, 4 aa, Mycobacterium
AEPH

SEQ ID NO: 392544 - protein, 5 aa, Mycobacterium
AEPIE

SEQ ID NO: 392545 - protein, 7 aa, Mycobacterium
AEPNGLN

SEQ ID NO: 392546 - protein, 5 aa, Mycobacterium
AEPPC

SEQ ID NO: 392547 - protein, 7 aa, Mycobacterium
AEPPGSS

SEQ ID NO: 392548 - protein, 5 aa, Mycobacterium
AEPPH

SEQ ID NO: 392549 - protein, 5 aa, Mycobacterium
AEPPL

SEQ ID NO: 392550 - protein, 5 aa, Mycobacterium
AEPQM

SEQ ID NO: 392551 - protein, 4 aa, Mycobacterium
AEPV

SEQ ID NO: 392552 - protein, 5 aa, Mycobacterium
AEQAG

SEQ ID NO: 392553 - protein, 17 aa, Mycobacterium
AEQAGQVETVKRSEAGM

SEQ ID NO: 392554 - protein, 4 aa, Mycobacterium
AEQG

SEQ ID NO: 392555 - protein, 6 aa, Mycobacterium
AEQGLQ

SEQ ID NO: 392556 - protein, 5 aa, Mycobacterium
AEQGR

SEQ ID NO: 392557 - protein, 4 aa, Mycobacterium
AEQH

SEQ ID NO: 392558 - protein, 5 aa, Mycobacterium
AEQHR

SEQ ID NO: 392559 - protein, 4 aa, Mycobacterium
AEQI

SEQ ID NO: 392560 - protein, 6 aa, Mycobacterium
AEQLPF

SEQ ID NO: 392561 - protein, 5 aa, Mycobacterium
AEQRD

SEQ ID NO: 392562 - protein, 5 aa, Mycobacterium
AEQRE

SEQ ID NO: 392563 - protein, 8 aa, Mycobacterium
AEQSESTM

SEQ ID NO: 392564 - protein, 7 aa, Mycobacterium
AEQSVED

SEQ ID NO: 392565 - protein, 10 aa, Mycobacterium
AERAGITSGV

SEQ ID NO: 392566 - protein, 10 aa, Mycobacterium
AERAGRDPAD

SEQ ID NO: 392567 - protein, 8 aa, Mycobacterium
AERAGSDR

SEQ ID NO: 392568 - protein, 12 aa, Mycobacterium
AERARDLRQPPA

SEQ ID NO: 392569 - protein, 5 aa, Mycobacterium
AERDP

SEQ ID NO: 392570 - protein, 4 aa, Mycobacterium
AERE

SEQ ID NO: 392571 - protein, 11 aa, Mycobacterium
AERERAAKRLG

SEQ ID NO: 392572 - protein, 5 aa, Mycobacterium
AERGG

SEQ ID NO: 392573 - protein, 5 aa, Mycobacterium
AERGN

SEQ ID NO: 392574 - protein, 20 aa, Mycobacterium
AERGRELASTAAERGAPYAE

SEQ ID NO: 392575 - protein, 4 aa, Mycobacterium
AERL

SEQ ID NO: 392576 - protein, 8 aa, Mycobacterium
AERLGAPR

SEQ ID NO: 392577 - protein, 21 aa, Mycobacterium
AERLPRGADPNTHTKLGRGGL

SEQ ID NO: 392578 - protein, 7 aa, Mycobacterium
AERNPEL

SEQ ID NO: 392579 - protein, 5 aa, Mycobacterium
AERPD

SEQ ID NO: 392580 - protein, 7 aa, Mycobacterium
AERPGDA

SEQ ID NO: 392581 - protein, 5 aa, Mycobacterium
AERPR

SEQ ID NO: 392582 - protein, 7 aa, Mycobacterium
AERPRGV

SEQ ID NO: 392583 - protein, 7 aa, Mycobacterium
AERRGEP

SEQ ID NO: 392584 - protein, 4 aa, Mycobacterium
AERS

SEQ ID NO: 392585 - protein, 10 aa, Mycobacterium
AERSAGAHPY

SEQ ID NO: 392586 - protein, 7 aa, Mycobacterium
AERSGDD

SEQ ID NO: 392587 - protein, 6 aa, Mycobacterium
AERTAG

SEQ ID NO: 392588 - protein, 7 aa, Mycobacterium
AERTGEG

SEQ ID NO: 392589 - protein, 6 aa, Mycobacterium
AERTKR

SEQ ID NO: 392590 - protein, 4 aa, Mycobacterium
AERV

SEQ ID NO: 392591 - protein, 22 aa, Mycobacterium
AESAGAEVRQGAEVAGPEFDAN

SEQ ID NO: 392592 - protein, 16 aa, Mycobacterium
AESANKVAQTNDPTAH

SEQ ID NO: 392593 - protein, 8 aa, Mycobacterium
AESDGTVT

SEQ ID NO: 392594 - protein, 5 aa, Mycobacterium
AESDN

SEQ ID NO: 392595 - protein, 15 aa, Mycobacterium
AESDPDDEVAETTTK

SEQ ID NO: 392596 - protein, 8 aa, Mycobacterium
AESDPHRV

SEQ ID NO: 392597 - protein, 4 aa, Mycobacterium
AESE

SEQ ID NO: 392598 - protein, 6 aa, Mycobacterium
AESERI

SEQ ID NO: 392599 - protein, 6 aa, Mycobacterium
AESGAG

SEQ ID NO: 392600 - protein, 7 aa, Mycobacterium
AESGTPL

SEQ ID NO: 392601 - protein, 5 aa, Mycobacterium
AESIA

SEQ ID NO: 392602 - protein, 15 aa, Mycobacterium
AESIPTKSYDNAEGF

SEQ ID NO: 392603 - protein, 4 aa, Mycobacterium
AESN

SEQ ID NO: 392604 - protein, 7 aa, Mycobacterium
AESNAPA

SEQ ID NO: 392605 - protein, 7 aa, Mycobacterium
AESPSPL

SEQ ID NO: 392606 - protein, 9 aa, Mycobacterium
AESPTVGPT

SEQ ID NO: 392607 - protein, 7 aa, Mycobacterium
AESSAPA

SEQ ID NO: 392608 - protein, 14 aa, Mycobacterium
AESSDAAIAPDEGA

SEQ ID NO: 392609 - protein, 5 aa, Mycobacterium
AESTV

SEQ ID NO: 392610 - protein, 7 aa, Mycobacterium
AETAKEA

SEQ ID NO: 392611 - protein, 5 aa, Mycobacterium
AETAR

SEQ ID NO: 392612 - protein, 5 aa, Mycobacterium
AETDE

SEQ ID NO: 392613 - protein, 6 aa, Mycobacterium
AETDSG

SEQ ID NO: 392614 - protein, 7 aa, Mycobacterium
AETERPA

SEQ ID NO: 392615 - protein, 5 aa, Mycobacterium
AETGH

SEQ ID NO: 392616 - protein, 5 aa, Mycobacterium
AETGV

SEQ ID NO: 392617 - protein, 5 aa, Mycobacterium
AETNP

SEQ ID NO: 392618 - protein, 6 aa, Mycobacterium
AETPEL

SEQ ID NO: 392619 - protein, 4 aa, Mycobacterium
AETS

SEQ ID NO: 392620 - protein, 5 aa, Mycobacterium
AETSL

SEQ ID NO: 392621 - protein, 7 aa, Mycobacterium
AETSPNY

SEQ ID NO: 392622 - protein, 9 aa, Mycobacterium
AETTDVTGT

SEQ ID NO: 392623 - protein, 4 aa, Mycobacterium
AETV

SEQ ID NO: 392624 - protein, 6 aa, Mycobacterium
AETVND

SEQ ID NO: 392625 - protein, 4 aa, Mycobacterium
AEVA

SEQ ID NO: 392626 - protein, 5 aa, Mycobacterium
AEVGE

SEQ ID NO: 392627 - protein, 4 aa, Mycobacterium
AEVK

SEQ ID NO: 392628 - protein, 5 aa, Mycobacterium
AEVRD

SEQ ID NO: 392629 - protein, 11 aa, Mycobacterium
AEWDEREETPW

SEQ ID NO: 392630 - protein, 4 aa, Mycobacterium
AEWG

SEQ ID NO: 392631 - protein, 4 aa, Mycobacterium
AEYE

SEQ ID NO: 392632 - protein, 4 aa, Mycobacterium
AFAG

SEQ ID NO: 392633 - protein, 7 aa, Mycobacterium
AFGAAPG

SEQ ID NO: 392634 - protein, 4 aa, Mycobacterium
AFGG

SEQ ID NO: 392635 - protein, 10 aa, Mycobacterium
AFGGEQNLAG

SEQ ID NO: 392636 - protein, 6 aa, Mycobacterium
AFGGGA

SEQ ID NO: 392637 - protein, 5 aa, Mycobacterium
AFGSP

SEQ ID NO: 392638 - protein, 9 aa, Mycobacterium
AFKPDTANG

SEQ ID NO: 392639 - protein, 7 aa, Mycobacterium
AFKPSYG

SEQ ID NO: 392640 - protein, 6 aa, Mycobacterium
AFPDQD

SEQ ID NO: 392641 - protein, 6 aa, Mycobacterium
AFPDSH

SEQ ID NO: 392642 - protein, 4 aa, Mycobacterium
AFPG

SEQ ID NO: 392643 - protein, 7 aa, Mycobacterium
AFSPGDT

SEQ ID NO: 392644 - protein, 5 aa, Mycobacterium
AFTED

SEQ ID NO: 392645 - protein, 4 aa, Mycobacterium
AFTP

SEQ ID NO: 392646 - protein, 9 aa, Mycobacterium
AGAAAAKLA

SEQ ID NO: 392647 - protein, 7 aa, Mycobacterium
AGAAGFE

SEQ ID NO: 392648 - protein, 6 aa, Mycobacterium
AGAALS

SEQ ID NO: 392649 - protein, 8 aa, Mycobacterium
AGAAPAPG

SEQ ID NO: 392650 - protein, 7 aa, Mycobacterium
AGAARHG

SEQ ID NO: 392651 - protein, 12 aa, Mycobacterium
AGAARTLFGKDP

SEQ ID NO: 392652 - protein, 5 aa, Mycobacterium
AGADA

SEQ ID NO: 392653 - protein, 12 aa, Mycobacterium
AGADDVGRAEED

SEQ ID NO: 392654 - protein, 8 aa, Mycobacterium
AGADGADV

SEQ ID NO: 392655 - protein, 9 aa, Mycobacterium
AGADPDDYT

SEQ ID NO: 392656 - protein, 6 aa, Mycobacterium
AGADSL

SEQ ID NO: 392657 - protein, 5 aa, Mycobacterium
AGAEA

SEQ ID NO: 392658 - protein, 8 aa, Mycobacterium
AGAEPDDY

SEQ ID NO: 392659 - protein, 5 aa, Mycobacterium
AGAEQ

SEQ ID NO: 392660 - protein, 8 aa, Mycobacterium
AGAETGVD

SEQ ID NO: 392661 - protein, 6 aa, Mycobacterium
AGAETV

SEQ ID NO: 392662 - protein, 8 aa, Mycobacterium
AGAGGREA

SEQ ID NO: 392663 - protein, 8 aa, Mycobacterium
AGAGGTSW

SEQ ID NO: 392664 - protein, 7 aa, Mycobacterium
AGAGIGA

SEQ ID NO: 392665 - protein, 7 aa, Mycobacterium
AGAGQAA

SEQ ID NO: 392666 - protein, 11 aa, Mycobacterium
AGAGSDDAESI

SEQ ID NO: 392667 - protein, 8 aa, Mycobacterium
AGAGSGAL

SEQ ID NO: 392668 - protein, 7 aa, Mycobacterium
AGAIGRR

SEQ ID NO: 392669 - protein, 9 aa, Mycobacterium
AGAKQIDGS

SEQ ID NO: 392670 - protein, 6 aa, Mycobacterium
AGANPL

SEQ ID NO: 392671 - protein, 25 aa, Mycobacterium
AGAPARHPHVGTRTPVLSDDGSDLA

SEQ ID NO: 392672 - protein, 6 aa, Mycobacterium
AGAPGL

SEQ ID NO: 392673 - protein, 8 aa, Mycobacterium
AGAPPDEF

SEQ ID NO: 392674 - protein, 6 aa, Mycobacterium
AGAPQL

SEQ ID NO: 392675 - protein, 8 aa, Mycobacterium
AGAPRNDP

SEQ ID NO: 392676 - protein, 5 aa, Mycobacterium
AGAPT

SEQ ID NO: 392677 - protein, 9 aa, Mycobacterium
AGAPTPDDL

SEQ ID NO: 392678 - protein, 6 aa, Mycobacterium
AGARAD

SEQ ID NO: 392679 - protein, 5 aa, Mycobacterium
AGARD

SEQ ID NO: 392680 - protein, 6 aa, Mycobacterium
AGAREQ

SEQ ID NO: 392681 - protein, 13 aa, Mycobacterium
AGARSGDKGGSAN

SEQ ID NO: 392682 - protein, 6 aa, Mycobacterium
AGASGW

SEQ ID NO: 392683 - protein, 5 aa, Mycobacterium
AGATE

SEQ ID NO: 392684 - protein, 9 aa, Mycobacterium
AGATEDVAE

SEQ ID NO: 392685 - protein, 5 aa, Mycobacterium
AGATG

SEQ ID NO: 392686 - protein, 11 aa, Mycobacterium
AGATGESAMDA

SEQ ID NO: 392687 - protein, 6 aa, Mycobacterium
AGATSV

SEQ ID NO: 392688 - protein, 6 aa, Mycobacterium
AGATVG

SEQ ID NO: 392689 - protein, 11 aa, Mycobacterium
AGATVTQSDDG

SEQ ID NO: 392690 - protein, 8 aa, Mycobacterium
AGATWAAD

SEQ ID NO: 392691 - protein, 4 aa, Mycobacterium
AGAV

SEQ ID NO: 392692 - protein, 5 aa, Mycobacterium
AGAVG

SEQ ID NO: 392693 - protein, 4 aa, Mycobacterium
AGDA

SEQ ID NO: 392694 - protein, 13 aa, Mycobacterium
AGDAADTAGPPLT

SEQ ID NO: 392695 - protein, 8 aa, Mycobacterium
AGDAATRE

SEQ ID NO: 392696 - protein, 5 aa, Mycobacterium
AGDAG

SEQ ID NO: 392697 - protein, 6 aa, Mycobacterium
AGDARR

SEQ ID NO: 392698 - protein, 7 aa, Mycobacterium
AGDARRA

SEQ ID NO: 392699 - protein, 5 aa, Mycobacterium
AGDDP

SEQ ID NO: 392700 - protein, 8 aa, Mycobacterium
AGDDPADV

SEQ ID NO: 392701 - protein, 7 aa, Mycobacterium
AGDERGT

SEQ ID NO: 392702 - protein, 6 aa, Mycobacterium
AGDGGA

SEQ ID NO: 392703 - protein, 17 aa, Mycobacterium
AGDGKPGVRARPDPDPF

SEQ ID NO: 392704 - protein, 4 aa, Mycobacterium
AGDI

SEQ ID NO: 392705 - protein, 6 aa, Mycobacterium
AGDKSF

SEQ ID NO: 392706 - protein, 5 aa, Mycobacterium
AGDPA

SEQ ID NO: 392707 - protein, 5 aa, Mycobacterium
AGDRF

SEQ ID NO: 392708 - protein, 6 aa, Mycobacterium
AGDRIE

SEQ ID NO: 392709 - protein, 6 aa, Mycobacterium
AGDRPD

SEQ ID NO: 392710 - protein, 11 aa, Mycobacterium
AGDSDDGGYNT

SEQ ID NO: 392711 - protein, 6 aa, Mycobacterium
AGDSGF

SEQ ID NO: 392712 - protein, 6 aa, Mycobacterium
AGDSGI

SEQ ID NO: 392713 - protein, 6 aa, Mycobacterium
AGDSGV

SEQ ID NO: 392714 - protein, 11 aa, Mycobacterium
AGDSPGSKYDK

SEQ ID NO: 392715 - protein, 15 aa, Mycobacterium
AGDSPLAADAVTASP

SEQ ID NO: 392716 - protein, 7 aa, Mycobacterium
AGDTELA

SEQ ID NO: 392717 - protein, 8 aa, Mycobacterium
AGDTITGA

SEQ ID NO: 392718 - protein, 6 aa, Mycobacterium
AGDTLD

SEQ ID NO: 392719 - protein, 13 aa, Mycobacterium
AGDVTTATGSITS

SEQ ID NO: 392720 - protein, 8 aa, Mycobacterium
AGDYLPPY

SEQ ID NO: 392721 - protein, 5 aa, Mycobacterium
AGEAA

SEQ ID NO: 392722 - protein, 5 aa, Mycobacterium
AGEAE

SEQ ID NO: 392723 - protein, 12 aa, Mycobacterium
AGEAGGKMVVVL

SEQ ID NO: 392724 - protein, 5 aa, Mycobacterium
AGEAT

SEQ ID NO: 392725 - protein, 12 aa, Mycobacterium
AGEDLDAYPRTL

SEQ ID NO: 392726 - protein, 4 aa, Mycobacterium
AGEE

SEQ ID NO: 392727 - protein, 5 aa, Mycobacterium
AGEFR

SEQ ID NO: 392728 - protein, 5 aa, Mycobacterium
AGEGA

SEQ ID NO: 392729 - protein, 9 aa, Mycobacterium
AGEGEPEQV

SEQ ID NO: 392730 - protein, 4 aa, Mycobacterium
AGEK

SEQ ID NO: 392731 - protein, 5 aa, Mycobacterium
AGEKI

SEQ ID NO: 392732 - protein, 6 aa, Mycobacterium
AGELAS

SEQ ID NO: 392733 - protein, 7 aa, Mycobacterium
AGENPWN

SEQ ID NO: 392734 - protein, 6 aa, Mycobacterium
AGEPCR

SEQ ID NO: 392735 - protein, 9 aa, Mycobacterium
AGEPGAGTR

SEQ ID NO: 392736 - protein, 14 aa, Mycobacterium
AGEPQASGKTYKVT

SEQ ID NO: 392737 - protein, 5 aa, Mycobacterium
AGEPW

SEQ ID NO: 392738 - protein, 6 aa, Mycobacterium
AGEQAG

SEQ ID NO: 392739 - protein, 6 aa, Mycobacterium
AGERGL

SEQ ID NO: 392740 - protein, 13 aa, Mycobacterium
AGERGSPDTWRDP

SEQ ID NO: 392741 - protein, 5 aa, Mycobacterium
AGERH

SEQ ID NO: 392742 - protein, 9 aa, Mycobacterium
AGERLPSPL

SEQ ID NO: 392743 - protein, 8 aa, Mycobacterium
AGESTASL

SEQ ID NO: 392744 - protein, 16 aa, Mycobacterium
AGETGGNCELTEPGKT

SEQ ID NO: 392745 - protein, 17 aa, Mycobacterium
AGEYRDHEATAPWTRPE

SEQ ID NO: 392746 - protein, 4 aa, Mycobacterium
AGFG

SEQ ID NO: 392747 - protein, 4 aa, Mycobacterium
AGFR

SEQ ID NO: 392748 - protein, 6 aa, Mycobacterium
AGFSAR

SEQ ID NO: 392749 - protein, 5 aa, Mycobacterium
AGGAN

SEQ ID NO: 392750 - protein, 5 aa, Mycobacterium
AGGAS

SEQ ID NO: 392751 - protein, 7 aa, Mycobacterium
AGGATEH

SEQ ID NO: 392752 - protein, 6 aa, Mycobacterium
AGGATV

SEQ ID NO: 392753 - protein, 6 aa, Mycobacterium
AGGDAS

SEQ ID NO: 392754 - protein, 7 aa, Mycobacterium
AGGDEVS

SEQ ID NO: 392755 - protein, 6 aa, Mycobacterium
AGGDPW

SEQ ID NO: 392756 - protein, 12 aa, Mycobacterium
AGGDSEADSPLT

SEQ ID NO: 392757 - protein, 4 aa, Mycobacterium
AGGE

SEQ ID NO: 392758 - protein, 9 aa, Mycobacterium
AGGEDVSPQ

SEQ ID NO: 392759 - protein, 5 aa, Mycobacterium
AGGEE

SEQ ID NO: 392760 - protein, 9 aa, Mycobacterium
AGGESTASL

SEQ ID NO: 392761 - protein, 23 aa, Mycobacterium
AGGFGGASGFGTGGAGGVGGAGG

SEQ ID NO: 392762 - protein, 8 aa, Mycobacterium
AGGGAEHA

SEQ ID NO: 392763 - protein, 5 aa, Mycobacterium
AGGGD

SEQ ID NO: 392764 - protein, 11 aa, Mycobacterium
AGGGELGAESS

SEQ ID NO: 392765 - protein, 5 aa, Mycobacterium
AGGGH

SEQ ID NO: 392766 - protein, 18 aa, Mycobacterium
AGGGIAKRTLTKSGPHDL

SEQ ID NO: 392767 - protein, 8 aa, Mycobacterium
AGGGPPDV

SEQ ID NO: 392768 - protein, 7 aa, Mycobacterium
AGGGQVT

SEQ ID NO: 392769 - protein, 4 aa, Mycobacterium
AGGI

SEQ ID NO: 392770 - protein, 4 aa, Mycobacterium
AGGK

SEQ ID NO: 392771 - protein, 4 aa, Mycobacterium
AGGL

SEQ ID NO: 392772 - protein, 5 aa, Mycobacterium
AGGLG

SEQ ID NO: 392773 - protein, 8 aa, Mycobacterium
AGGLNPAG

SEQ ID NO: 392774 - protein, 6 aa, Mycobacterium
AGGLRP

SEQ ID NO: 392775 - protein, 5 aa, Mycobacterium
AGGNT

SEQ ID NO: 392776 - protein, 4 aa, Mycobacterium
AGGP

SEQ ID NO: 392777 - protein, 11 aa, Mycobacterium
AGGPGRPAGLD

SEQ ID NO: 392778 - protein, 6 aa, Mycobacterium
AGGPPR

SEQ ID NO: 392779 - protein, 13 aa, Mycobacterium
AGGQGGQLAEEPQ

SEQ ID NO: 392780 - protein, 6 aa, Mycobacterium
AGGQVR

SEQ ID NO: 392781 - protein, 4 aa, Mycobacterium
AGGR

SEQ ID NO: 392782 - protein, 9 aa, Mycobacterium
AGGREAGKN

SEQ ID NO: 392783 - protein, 5 aa, Mycobacterium
AGGRT

SEQ ID NO: 392784 - protein, 6 aa, Mycobacterium
AGGSHG

SEQ ID NO: 392785 - protein, 9 aa, Mycobacterium
AGGSQADPE

SEQ ID NO: 392786 - protein, 5 aa, Mycobacterium
AGGST

SEQ ID NO: 392787 - protein, 6 aa, Mycobacterium
AGGSTY

SEQ ID NO: 392788 - protein, 15 aa, Mycobacterium
AGGTDPVEKAIPGTI

SEQ ID NO: 392789 - protein, 16 aa, Mycobacterium
AGGTDPVEKATPGTIR

SEQ ID NO: 392790 - protein, 6 aa, Mycobacterium
AGGTGD

SEQ ID NO: 392791 - protein, 10 aa, Mycobacterium
AGGTSQINKN

SEQ ID NO: 392792 - protein, 14 aa, Mycobacterium
AGGVDTTSDPPIGL

SEQ ID NO: 392793 - protein, 6 aa, Mycobacterium
AGGVGS

SEQ ID NO: 392794 - protein, 9 aa, Mycobacterium
AGGWSDPEV

SEQ ID NO: 392795 - protein, 5 aa, Mycobacterium
AGGYA

SEQ ID NO: 392796 - protein, 12 aa, Mycobacterium
AGHDTTKDAISG

SEQ ID NO: 392797 - protein, 11 aa, Mycobacterium
AGHDTTSAAIS

SEQ ID NO: 392798 - protein, 6 aa, Mycobacterium
AGHDYG

SEQ ID NO: 392799 - protein, 4 aa, Mycobacterium
AGHG

SEQ ID NO: 392800 - protein, 7 aa, Mycobacterium
AGHGIND

SEQ ID NO: 392801 - protein, 26 aa, Mycobacterium
AGHHRQARGDRERGGAGRSGSPPSGP

SEQ ID NO: 392802 - protein, 4 aa, Mycobacterium
AGHP

SEQ ID NO: 392803 - protein, 11 aa, Mycobacterium
AGHRERGVKQE

SEQ ID NO: 392804 - protein, 4 aa, Mycobacterium
AGHS

SEQ ID NO: 392805 - protein, 5 aa, Mycobacterium
AGIES

SEQ ID NO: 392806 - protein, 4 aa, Mycobacterium
AGIG

SEQ ID NO: 392807 - protein, 5 aa, Mycobacterium
AGIPT

SEQ ID NO: 392808 - protein, 7 aa, Mycobacterium
AGIRPED

SEQ ID NO: 392809 - protein, 4 aa, Mycobacterium
AGIT

SEQ ID NO: 392810 - protein, 6 aa, Mycobacterium
AGITPP

SEQ ID NO: 392811 - protein, 7 aa, Mycobacterium
AGKAGLV

SEQ ID NO: 392812 - protein, 7 aa, Mycobacterium
AGKATAL

SEQ ID NO: 392813 - protein, 9 aa, Mycobacterium
AGKETVTTL

SEQ ID NO: 392814 - protein, 4 aa, Mycobacterium
AGKG

SEQ ID NO: 392815 - protein, 11 aa, Mycobacterium
AGKGGAEPRSA

SEQ ID NO: 392816 - protein, 11 aa, Mycobacterium
AGKGLTGTGYD

SEQ ID NO: 392817 - protein, 12 aa, Mycobacterium
AGKGSAEPRNSR

SEQ ID NO: 392818 - protein, 6 aa, Mycobacterium
AGKPRE

SEQ ID NO: 392819 - protein, 4 aa, Mycobacterium
AGKR

SEQ ID NO: 392820 - protein, 8 aa, Mycobacterium
AGKSALSA

SEQ ID NO: 392821 - protein, 6 aa, Mycobacterium
AGKSLR

SEQ ID NO: 392822 - protein, 5 aa, Mycobacterium
AGKSV

SEQ ID NO: 392823 - protein, 12 aa, Mycobacterium
AGKTSSGKGAGR

SEQ ID NO: 392824 - protein, 8 aa, Mycobacterium
AGKYGTSV

SEQ ID NO: 392825 - protein, 6 aa, Mycobacterium
AGKYGV

SEQ ID NO: 392826 - protein, 4 aa, Mycobacterium
AGLA

SEQ ID NO: 392827 - protein, 16 aa, Mycobacterium
AGLAGVGSPDAGSVGY

SEQ ID NO: 392828 - protein, 9 aa, Mycobacterium
AGLDDEQRE

SEQ ID NO: 392829 - protein, 9 aa, Mycobacterium
AGLDGEKET

SEQ ID NO: 392830 - protein, 9 aa, Mycobacterium
AGLDGTKET

SEQ ID NO: 392831 - protein, 4 aa, Mycobacterium
AGLG

SEQ ID NO: 392832 - protein, 11 aa, Mycobacterium
AGLGNAGWENS

SEQ ID NO: 392833 - protein, 12 aa, Mycobacterium
AGLGTDPAHEGF

SEQ ID NO: 392834 - protein, 7 aa, Mycobacterium
AGLKPSD

SEQ ID NO: 392835 - protein, 5 aa, Mycobacterium
AGLPE

SEQ ID NO: 392836 - protein, 5 aa, Mycobacterium
AGLPK

SEQ ID NO: 392837 - protein, 6 aa, Mycobacterium
AGLPNA

SEQ ID NO: 392838 - protein, 7 aa, Mycobacterium
AGLPPLS

SEQ ID NO: 392839 - protein, 9 aa, Mycobacterium
AGLQSNPGI

SEQ ID NO: 392840 - protein, 9 aa, Mycobacterium
AGLSPSDVD

SEQ ID NO: 392841 - protein, 12 aa, Mycobacterium
AGLSREGRRGPM

SEQ ID NO: 392842 - protein, 4 aa, Mycobacterium
AGLT

SEQ ID NO: 392843 - protein, 7 aa, Mycobacterium
AGLTPAD

SEQ ID NO: 392844 - protein, 4 aa, Mycobacterium
AGMD

SEQ ID NO: 392845 - protein, 10 aa, Mycobacterium
AGMDTGGAEP

SEQ ID NO: 392846 - protein, 23 aa, Mycobacterium
AGMSTDSGIPDYRGPDSPPSNPM

SEQ ID NO: 392847 - protein, 4 aa, Mycobacterium
AGMT

SEQ ID NO: 392848 - protein, 4 aa, Mycobacterium
AGNG

SEQ ID NO: 392849 - protein, 7 aa, Mycobacterium
AGNGGSI

SEQ ID NO: 392850 - protein, 11 aa, Mycobacterium
AGNGMAGHTAP

SEQ ID NO: 392851 - protein, 11 aa, Mycobacterium
AGNGMAGHTTP

SEQ ID NO: 392852 - protein, 6 aa, Mycobacterium
AGNPPY

SEQ ID NO: 392853 - protein, 9 aa, Mycobacterium
AGNSSGVVD

SEQ ID NO: 392854 - protein, 4 aa, Mycobacterium
AGNT

SEQ ID NO: 392855 - protein, 4 aa, Mycobacterium
AGNV

SEQ ID NO: 392856 - protein, 8 aa, Mycobacterium
AGPAEPAT

SEQ ID NO: 392857 - protein, 6 aa, Mycobacterium
AGPAEQ

SEQ ID NO: 392858 - protein, 6 aa, Mycobacterium
AGPAPY

SEQ ID NO: 392859 - protein, 6 aa, Mycobacterium
AGPDGR

SEQ ID NO: 392860 - protein, 9 aa, Mycobacterium
AGPDTSATY

SEQ ID NO: 392861 - protein, 5 aa, Mycobacterium
AGPDV

SEQ ID NO: 392862 - protein, 4 aa, Mycobacterium
AGPF

SEQ ID NO: 392863 - protein, 8 aa, Mycobacterium
AGPGAHGH

SEQ ID NO: 392864 - protein, 5 aa, Mycobacterium
AGPGE

SEQ ID NO: 392865 - protein, 5 aa, Mycobacterium
AGPGG

SEQ ID NO: 392866 - protein, 6 aa, Mycobacterium
AGPGGL

SEQ ID NO: 392867 - protein, 6 aa, Mycobacterium
AGPGGY

SEQ ID NO: 392868 - protein, 13 aa, Mycobacterium
AGPHPNPAKANLG

SEQ ID NO: 392869 - protein, 14 aa, Mycobacterium
AGPHPNPAKASLGQ

SEQ ID NO: 392870 - protein, 4 aa, Mycobacterium
AGPI

SEQ ID NO: 392871 - protein, 8 aa, Mycobacterium
AGPKGTSV

SEQ ID NO: 392872 - protein, 6 aa, Mycobacterium
AGPKKI

SEQ ID NO: 392873 - protein, 8 aa, Mycobacterium
AGPKPGDV

SEQ ID NO: 392874 - protein, 13 aa, Mycobacterium
AGPNSAIPHHRPT

SEQ ID NO: 392875 - protein, 4 aa, Mycobacterium
AGPQ

SEQ ID NO: 392876 - protein, 5 aa, Mycobacterium
AGPQF

SEQ ID NO: 392877 - protein, 6 aa, Mycobacterium
AGPRAM

SEQ ID NO: 392878 - protein, 7 aa, Mycobacterium
AGPRLGK

SEQ ID NO: 392879 - protein, 8 aa, Mycobacterium
AGPRLGKD

SEQ ID NO: 392880 - protein, 5 aa, Mycobacterium
AGPRQ

SEQ ID NO: 392881 - protein, 5 aa, Mycobacterium
AGPRR

SEQ ID NO: 392882 - protein, 6 aa, Mycobacterium
AGPSGL

SEQ ID NO: 392883 - protein, 7 aa, Mycobacterium
AGPSGLS

SEQ ID NO: 392884 - protein, 4 aa, Mycobacterium
AGPT

SEQ ID NO: 392885 - protein, 7 aa, Mycobacterium
AGPTAGY

SEQ ID NO: 392886 - protein, 7 aa, Mycobacterium
AGPTPRL

SEQ ID NO: 392887 - protein, 5 aa, Mycobacterium
AGPVA

SEQ ID NO: 392888 - protein, 5 aa, Mycobacterium
AGPVD

SEQ ID NO: 392889 - protein, 5 aa, Mycobacterium
AGPVS

SEQ ID NO: 392890 - protein, 4 aa, Mycobacterium
AGQA

SEQ ID NO: 392891 - protein, 13 aa, Mycobacterium
AGQAAAAASQARV

SEQ ID NO: 392892 - protein, 5 aa, Mycobacterium
AGQAG

SEQ ID NO: 392893 - protein, 4 aa, Mycobacterium
AGQG

SEQ ID NO: 392894 - protein, 8 aa, Mycobacterium
AGQGGTED

SEQ ID NO: 392895 - protein, 5 aa, Mycobacterium
AGQHG

SEQ ID NO: 392896 - protein, 4 aa, Mycobacterium
AGQP

SEQ ID NO: 392897 - protein, 10 aa, Mycobacterium
AGQPGRYRKP

SEQ ID NO: 392898 - protein, 8 aa, Mycobacterium
AGQPNGAA

SEQ ID NO: 392899 - protein, 4 aa, Mycobacterium
AGQR

SEQ ID NO: 392900 - protein, 4 aa, Mycobacterium
AGQS

SEQ ID NO: 392901 - protein, 7 aa, Mycobacterium
AGQTRST

SEQ ID NO: 392902 - protein, 14 aa, Mycobacterium
AGRAAGKKINVDDG

SEQ ID NO: 392903 - protein, 6 aa, Mycobacterium
AGRAQA

SEQ ID NO: 392904 - protein, 5 aa, Mycobacterium
AGRAT

SEQ ID NO: 392905 - protein, 6 aa, Mycobacterium
AGRDQA

SEQ ID NO: 392906 - protein, 5 aa, Mycobacterium
AGREA

SEQ ID NO: 392907 - protein, 8 aa, Mycobacterium
AGRGATRG

SEQ ID NO: 392908 - protein, 19 aa, Mycobacterium
AGRGFSSGADHKSAGSVPH

SEQ ID NO: 392909 - protein, 7 aa, Mycobacterium
AGRGIGR

SEQ ID NO: 392910 - protein, 6 aa, Mycobacterium
AGRGTR

SEQ ID NO: 392911 - protein, 15 aa, Mycobacterium
AGRGYGDLKKDTAEA

SEQ ID NO: 392912 - protein, 4 aa, Mycobacterium
AGRL

SEQ ID NO: 392913 - protein, 11 aa, Mycobacterium
AGRNPKLGYDN

SEQ ID NO: 392914 - protein, 10 aa, Mycobacterium
AGRPTRANFR

SEQ ID NO: 392915 - protein, 9 aa, Mycobacterium
AGRQGQTDH

SEQ ID NO: 392916 - protein, 8 aa, Mycobacterium
AGRRGPQA

SEQ ID NO: 392917 - protein, 9 aa, Mycobacterium
AGRSGGTNI

SEQ ID NO: 392918 - protein, 7 aa, Mycobacterium
AGRSRES

SEQ ID NO: 392919 - protein, 6 aa, Mycobacterium
AGRSTD

SEQ ID NO: 392920 - protein, 13 aa, Mycobacterium
AGRSTGPTEGPAI

SEQ ID NO: 392921 - protein, 18 aa, Mycobacterium
AGRTFGEDEIRARYGVPR

SEQ ID NO: 392922 - protein, 5 aa, Mycobacterium
AGRTR

SEQ ID NO: 392923 - protein, 4 aa, Mycobacterium
AGRV

SEQ ID NO: 392924 - protein, 6 aa, Mycobacterium
AGRYSS

SEQ ID NO: 392925 - protein, 7 aa, Mycobacterium
AGSDSPL

SEQ ID NO: 392926 - protein, 5 aa, Mycobacterium
AGSDT

SEQ ID NO: 392927 - protein, 9 aa, Mycobacterium
AGSDTRPVQ

SEQ ID NO: 392928 - protein, 6 aa, Mycobacterium
AGSEPM

SEQ ID NO: 392929 - protein, 6 aa, Mycobacterium
AGSETV

SEQ ID NO: 392930 - protein, 4 aa, Mycobacterium
AGSF

SEQ ID NO: 392931 - protein, 5 aa, Mycobacterium
AGSGE

SEQ ID NO: 392932 - protein, 5 aa, Mycobacterium
AGSGG

SEQ ID NO: 392933 - protein, 8 aa, Mycobacterium
AGSGGDFN

SEQ ID NO: 392934 - protein, 8 aa, Mycobacterium
AGSGKTAV

SEQ ID NO: 392935 - protein, 5 aa, Mycobacterium
AGSGP

SEQ ID NO: 392936 - protein, 6 aa, Mycobacterium
AGSGPM

SEQ ID NO: 392937 - protein, 6 aa, Mycobacterium
AGSGSI

SEQ ID NO: 392938 - protein, 12 aa, Mycobacterium
AGSKPIDLFGAP

SEQ ID NO: 392939 - protein, 9 aa, Mycobacterium
AGSLRPTPD

SEQ ID NO: 392940 - protein, 7 aa, Mycobacterium
AGSNPQM

SEQ ID NO: 392941 - protein, 7 aa, Mycobacterium
AGSPEAD

SEQ ID NO: 392942 - protein, 5 aa, Mycobacterium
AGSPM

SEQ ID NO: 392943 - protein, 7 aa, Mycobacterium
AGSPQRR

SEQ ID NO: 392944 - protein, 6 aa, Mycobacterium
AGSPYD

SEQ ID NO: 392945 - protein, 11 aa, Mycobacterium
AGSRGSADTVR

SEQ ID NO: 392946 - protein, 8 aa, Mycobacterium
AGSRTGRV

SEQ ID NO: 392947 - protein, 7 aa, Mycobacterium
AGSSAGA

SEQ ID NO: 392948 - protein, 9 aa, Mycobacterium
AGSSTTADF

SEQ ID NO: 392949 - protein, 5 aa, Mycobacterium
AGSTV

SEQ ID NO: 392950 - protein, 4 aa, Mycobacterium
AGSW

SEQ ID NO: 392951 - protein, 15 aa, Mycobacterium
AGSYAATEAANAATI

SEQ ID NO: 392952 - protein, 9 aa, Mycobacterium
AGTAGYSEQ

SEQ ID NO: 392953 - protein, 7 aa, Mycobacterium
AGTAPGA

SEQ ID NO: 392954 - protein, 5 aa, Mycobacterium
AGTDA

SEQ ID NO: 392955 - protein, 14 aa, Mycobacterium
AGTDEQHPDAQGRI

SEQ ID NO: 392956 - protein, 8 aa, Mycobacterium
AGTDEVSA

SEQ ID NO: 392957 - protein, 8 aa, Mycobacterium
AGTDTGPI

SEQ ID NO: 392958 - protein, 5 aa, Mycobacterium
AGTEP

SEQ ID NO: 392959 - protein, 6 aa, Mycobacterium
AGTEPV

SEQ ID NO: 392960 - protein, 19 aa, Mycobacterium
AGTERPFTGEYTDTKTEGV

SEQ ID NO: 392961 - protein, 6 aa, Mycobacterium
AGTETV

SEQ ID NO: 392962 - protein, 9 aa, Mycobacterium
AGTGEPVPE

SEQ ID NO: 392963 - protein, 11 aa, Mycobacterium
AGTGIGSTTAR

SEQ ID NO: 392964 - protein, 6 aa, Mycobacterium
AGTGIS

SEQ ID NO: 392965 - protein, 10 aa, Mycobacterium
AGTGKTRTIT

SEQ ID NO: 392966 - protein, 5 aa, Mycobacterium
AGTGL

SEQ ID NO: 392967 - protein, 11 aa, Mycobacterium
AGTGNASIPAA

SEQ ID NO: 392968 - protein, 6 aa, Mycobacterium
AGTGRD

SEQ ID NO: 392969 - protein, 6 aa, Mycobacterium
AGTGRI

SEQ ID NO: 392970 - protein, 7 aa, Mycobacterium
AGTGTAT

SEQ ID NO: 392971 - protein, 13 aa, Mycobacterium
AGTGTPQPRPAGD

SEQ ID NO: 392972 - protein, 7 aa, Mycobacterium
AGTKDRM

SEQ ID NO: 392973 - protein, 6 aa, Mycobacterium
AGTKGV

SEQ ID NO: 392974 - protein, 7 aa, Mycobacterium
AGTLSTG

SEQ ID NO: 392975 - protein, 9 aa, Mycobacterium
AGTPEPRHD

SEQ ID NO: 392976 - protein, 10 aa, Mycobacterium
AGTPEPRHDE

SEQ ID NO: 392977 - protein, 6 aa, Mycobacterium
AGTPSV

SEQ ID NO: 392978 - protein, 11 aa, Mycobacterium
AGTTGDLDAQA

SEQ ID NO: 392979 - protein, 8 aa, Mycobacterium
AGVAPSEV

SEQ ID NO: 392980 - protein, 5 aa, Mycobacterium
AGVAT

SEQ ID NO: 392981 - protein, 5 aa, Mycobacterium
AGVDA

SEQ ID NO: 392982 - protein, 11 aa, Mycobacterium
AGVDGSNVGRD

SEQ ID NO: 392983 - protein, 5 aa, Mycobacterium
AGVDT

SEQ ID NO: 392984 - protein, 6 aa, Mycobacterium
AGVGAR

SEQ ID NO: 392985 - protein, 7 aa, Mycobacterium
AGVGGAD

SEQ ID NO: 392986 - protein, 12 aa, Mycobacterium
AGVGHGVSEAPR

SEQ ID NO: 392987 - protein, 5 aa, Mycobacterium
AGVGR

SEQ ID NO: 392988 - protein, 9 aa, Mycobacterium
AGVNGSGKH

SEQ ID NO: 392989 - protein, 5 aa, Mycobacterium
AGVPA

SEQ ID NO: 392990 - protein, 6 aa, Mycobacterium
AGVPPG

SEQ ID NO: 392991 - protein, 5 aa, Mycobacterium
AGVSH

SEQ ID NO: 392992 - protein, 6 aa, Mycobacterium
AGVSRP

SEQ ID NO: 392993 - protein, 6 aa, Mycobacterium
AGVSRS

SEQ ID NO: 392994 - protein, 6 aa, Mycobacterium
AGVTSL

SEQ ID NO: 392995 - protein, 4 aa, Mycobacterium
AGWG

SEQ ID NO: 392996 - protein, 7 aa, Mycobacterium
AGWQGGE

SEQ ID NO: 392997 - protein, 12 aa, Mycobacterium
AGYGRAGAARPP

SEQ ID NO: 392998 - protein, 4 aa, Mycobacterium
AGYI

SEQ ID NO: 392999 - protein, 5 aa, Mycobacterium
AGYKY

SEQ ID NO: 393000 - protein, 6 aa, Mycobacterium
AGYTKG

SEQ ID NO: 393001 - protein, 5 aa, Mycobacterium
AGYTR

SEQ ID NO: 393002 - protein, 5 aa, Mycobacterium
AHADS

SEQ ID NO: 393003 - protein, 4 aa, Mycobacterium
AHAG

SEQ ID NO: 393004 - protein, 7 aa, Mycobacterium
AHANGAR

SEQ ID NO: 393005 - protein, 6 aa, Mycobacterium
AHAPPD

SEQ ID NO: 393006 - protein, 4 aa, Mycobacterium
AHAR

SEQ ID NO: 393007 - protein, 13 aa, Mycobacterium
AHDADDAATYPPD

SEQ ID NO: 393008 - protein, 7 aa, Mycobacterium
AHDAPQG

SEQ ID NO: 393009 - protein, 6 aa, Mycobacterium
AHDGPF

SEQ ID NO: 393010 - protein, 7 aa, Mycobacterium
AHDPDAK

SEQ ID NO: 393011 - protein, 7 aa, Mycobacterium
AHENHDK

SEQ ID NO: 393012 - protein, 8 aa, Mycobacterium
AHEPPETA

SEQ ID NO: 393013 - protein, 8 aa, Mycobacterium
AHGDHRAA

SEQ ID NO: 393014 - protein, 7 aa, Mycobacterium
AHGGTVT

SEQ ID NO: 393015 - protein, 8 aa, Mycobacterium
AHGMDSAT

SEQ ID NO: 393016 - protein, 5 aa, Mycobacterium
AHGTD

SEQ ID NO: 393017 - protein, 7 aa, Mycobacterium
AHHTNAS

SEQ ID NO: 393018 - protein, 5 aa, Mycobacterium
AHKDE

SEQ ID NO: 393019 - protein, 4 aa, Mycobacterium
AHPD

SEQ ID NO: 393020 - protein, 5 aa, Mycobacterium
AHPDR

SEQ ID NO: 393021 - protein, 10 aa, Mycobacterium
AHPGGSNTEL

SEQ ID NO: 393022 - protein, 5 aa, Mycobacterium
AHPGH

SEQ ID NO: 393023 - protein, 6 aa, Mycobacterium
AHPGLT

SEQ ID NO: 393024 - protein, 7 aa, Mycobacterium
AHPPSPR

SEQ ID NO: 393025 - protein, 7 aa, Mycobacterium
AHPRPDF

SEQ ID NO: 393026 - protein, 6 aa, Mycobacterium
AHPSAA

SEQ ID NO: 393027 - protein, 4 aa, Mycobacterium
AHRA

SEQ ID NO: 393028 - protein, 5 aa, Mycobacterium
AHRAG

SEQ ID NO: 393029 - protein, 5 aa, Mycobacterium
AHRPD

SEQ ID NO: 393030 - protein, 9 aa, Mycobacterium
AHRQGAASV

SEQ ID NO: 393031 - protein, 5 aa, Mycobacterium
AHSAP

SEQ ID NO: 393032 - protein, 5 aa, Mycobacterium
AHSRG

SEQ ID NO: 393033 - protein, 8 aa, Mycobacterium
AHTEPPDL

SEQ ID NO: 393034 - protein, 19 aa, Mycobacterium
AIAAGKADGARLSAAVKER

SEQ ID NO: 393035 - protein, 6 aa, Mycobacterium
AIAEAE

SEQ ID NO: 393036 - protein, 8 aa, Mycobacterium
AIAGDERR

SEQ ID NO: 393037 - protein, 9 aa, Mycobacterium
AIANGSEPW

SEQ ID NO: 393038 - protein, 4 aa, Mycobacterium
AIDE

SEQ ID NO: 393039 - protein, 5 aa, Mycobacterium
AIEQA

SEQ ID NO: 393040 - protein, 4 aa, Mycobacterium
AIGS

SEQ ID NO: 393041 - protein, 4 aa, Mycobacterium
AIKE

SEQ ID NO: 393042 - protein, 6 aa, Mycobacterium
AINDND

SEQ ID NO: 393043 - protein, 21 aa, Mycobacterium
AINNDGSAKMGYAAPNPAAQA

SEQ ID NO: 393044 - protein, 8 aa, Mycobacterium
AIREKTRA

SEQ ID NO: 393045 - protein, 5 aa, Mycobacterium
AIRGG

SEQ ID NO: 393046 - protein, 7 aa, Mycobacterium
AIRQSPD

SEQ ID NO: 393047 - protein, 4 aa, Mycobacterium
AISQ

SEQ ID NO: 393048 - protein, 5 aa, Mycobacterium
AISRG

SEQ ID NO: 393049 - protein, 6 aa, Mycobacterium
AISTGG

SEQ ID NO: 393050 - protein, 6 aa, Mycobacterium
AITASY

SEQ ID NO: 393051 - protein, 6 aa, Mycobacterium
AITERQ

SEQ ID NO: 393052 - protein, 4 aa, Mycobacterium
AKAA

SEQ ID NO: 393053 - protein, 6 aa, Mycobacterium
AKAAGV

SEQ ID NO: 393054 - protein, 9 aa, Mycobacterium
AKAAPASAS

SEQ ID NO: 393055 - protein, 13 aa, Mycobacterium
AKADAADDTRDAL

SEQ ID NO: 393056 - protein, 6 aa, Mycobacterium
AKAEAE

SEQ ID NO: 393057 - protein, 17 aa, Mycobacterium
AKAEGRDVDSAIMEASR

SEQ ID NO: 393058 - protein, 18 aa, Mycobacterium
AKAERASGFDPRAGWAGN

SEQ ID NO: 393059 - protein, 4 aa, Mycobacterium
AKAN

SEQ ID NO: 393060 - protein, 5 aa, Mycobacterium
AKANG

SEQ ID NO: 393061 - protein, 7 aa, Mycobacterium
AKAPAAF

SEQ ID NO: 393062 - protein, 8 aa, Mycobacterium
AKAPSAFA

SEQ ID NO: 393063 - protein, 5 aa, Mycobacterium
AKAQA

SEQ ID NO: 393064 - protein, 7 aa, Mycobacterium
AKARGAD

SEQ ID NO: 393065 - protein, 6 aa, Mycobacterium
AKASPY

SEQ ID NO: 393066 - protein, 8 aa, Mycobacterium
AKAVTDRP

SEQ ID NO: 393067 - protein, 7 aa, Mycobacterium
AKDGLGA

SEQ ID NO: 393068 - protein, 8 aa, Mycobacterium
AKDGSPKI

SEQ ID NO: 393069 - protein, 6 aa, Mycobacterium
AKDPAR

SEQ ID NO: 393070 - protein, 7 aa, Mycobacterium
AKDPRMK

SEQ ID NO: 393071 - protein, 4 aa, Mycobacterium
AKDR

SEQ ID NO: 393072 - protein, 8 aa, Mycobacterium
AKEAPGWQ

SEQ ID NO: 393073 - protein, 6 aa, Mycobacterium
AKEHDA

SEQ ID NO: 393074 - protein, 6 aa, Mycobacterium
AKENDL

SEQ ID NO: 393075 - protein, 7 aa, Mycobacterium
AKENSYA

SEQ ID NO: 393076 - protein, 6 aa, Mycobacterium
AKEQGV

SEQ ID NO: 393077 - protein, 7 aa, Mycobacterium
AKEQLRA

SEQ ID NO: 393078 - protein, 11 aa, Mycobacterium
AKESGRKSARI

SEQ ID NO: 393079 - protein, 24 aa, Mycobacterium
AKEVETKEQIAATAGISAGDQSIG

SEQ ID NO: 393080 - protein, 6 aa, Mycobacterium
AKFADP

SEQ ID NO: 393081 - protein, 5 aa, Mycobacterium
AKFGI

SEQ ID NO: 393082 - protein, 15 aa, Mycobacterium
AKGAPPERIQHDPLW

SEQ ID NO: 393083 - protein, 5 aa, Mycobacterium
AKGGK

SEQ ID NO: 393084 - protein, 8 aa, Mycobacterium
AKGKLTAR

SEQ ID NO: 393085 - protein, 4 aa, Mycobacterium
AKGN

SEQ ID NO: 393086 - protein, 10 aa, Mycobacterium
AKGPGVNPFG

SEQ ID NO: 393087 - protein, 4 aa, Mycobacterium
AKGR

SEQ ID NO: 393088 - protein, 7 aa, Mycobacterium
AKGSDRR

SEQ ID NO: 393089 - protein, 4 aa, Mycobacterium
AKGT

SEQ ID NO: 393090 - protein, 5 aa, Mycobacterium
AKHAR

SEQ ID NO: 393091 - protein, 8 aa, Mycobacterium
AKHDEEHS

SEQ ID NO: 393092 - protein, 9 aa, Mycobacterium
AKHKGEEAR

SEQ ID NO: 393093 - protein, 20 aa, Mycobacterium
AKIEGIPDTESAVTPDLLED

SEQ ID NO: 393094 - protein, 11 aa, Mycobacterium
AKIGPDKDIPH

SEQ ID NO: 393095 - protein, 6 aa, Mycobacterium
AKKDAD

SEQ ID NO: 393096 - protein, 7 aa, Mycobacterium
AKKGGQH

SEQ ID NO: 393097 - protein, 5 aa, Mycobacterium
AKKGI

SEQ ID NO: 393098 - protein, 14 aa, Mycobacterium
AKLAERQGEKSYAQ

SEQ ID NO: 393099 - protein, 6 aa, Mycobacterium
AKLGEK

SEQ ID NO: 393100 - protein, 7 aa, Mycobacterium
AKLTNTA

SEQ ID NO: 393101 - protein, 4 aa, Mycobacterium
AKNA

SEQ ID NO: 393102 - protein, 8 aa, Mycobacterium
AKNAAKLR

SEQ ID NO: 393103 - protein, 5 aa, Mycobacterium
AKNAF

SEQ ID NO: 393104 - protein, 4 aa, Mycobacterium
AKND

SEQ ID NO: 393105 - protein, 8 aa, Mycobacterium
AKNPSDDL

SEQ ID NO: 393106 - protein, 14 aa, Mycobacterium
AKNTDTREHDIADS

SEQ ID NO: 393107 - protein, 17 aa, Mycobacterium
AKPGEPSWPTPWGRGRP

SEQ ID NO: 393108 - protein, 13 aa, Mycobacterium
AKPGRLEGPDPSL

SEQ ID NO: 393109 - protein, 4 aa, Mycobacterium
AKPI

SEQ ID NO: 393110 - protein, 7 aa, Mycobacterium
AKPKIAD

SEQ ID NO: 393111 - protein, 10 aa, Mycobacterium
AKPPPGGSPG

SEQ ID NO: 393112 - protein, 5 aa, Mycobacterium
AKPQI

SEQ ID NO: 393113 - protein, 10 aa, Mycobacterium
AKPSSSKGRY

SEQ ID NO: 393114 - protein, 4 aa, Mycobacterium
AKPV

SEQ ID NO: 393115 - protein, 8 aa, Mycobacterium
AKQASGLE

SEQ ID NO: 393116 - protein, 7 aa, Mycobacterium
AKQGTNI

SEQ ID NO: 393117 - protein, 4 aa, Mycobacterium
AKQH

SEQ ID NO: 393118 - protein, 4 aa, Mycobacterium
AKQQ

SEQ ID NO: 393119 - protein, 4 aa, Mycobacterium
AKRA

SEQ ID NO: 393120 - protein, 9 aa, Mycobacterium
AKRDDGGRR

SEQ ID NO: 393121 - protein, 12 aa, Mycobacterium
AKRESKSRPGEG

SEQ ID NO: 393122 - protein, 4 aa, Mycobacterium
AKRG

SEQ ID NO: 393123 - protein, 8 aa, Mycobacterium
AKRGGGAI

SEQ ID NO: 393124 - protein, 5 aa, Mycobacterium
AKRRN

SEQ ID NO: 393125 - protein, 7 aa, Mycobacterium
AKRTPGA

SEQ ID NO: 393126 - protein, 17 aa, Mycobacterium
AKRTPKTARTRSWTTDV

SEQ ID NO: 393127 - protein, 4 aa, Mycobacterium
AKRY

SEQ ID NO: 393128 - protein, 9 aa, Mycobacterium
AKSASGGEL

SEQ ID NO: 393129 - protein, 7 aa, Mycobacterium
AKSDQLA

SEQ ID NO: 393130 - protein, 4 aa, Mycobacterium
AKSG

SEQ ID NO: 393131 - protein, 10 aa, Mycobacterium
AKSGGAMNAA

SEQ ID NO: 393132 - protein, 7 aa, Mycobacterium
AKSGVRR

SEQ ID NO: 393133 - protein, 8 aa, Mycobacterium
AKSLKSVG

SEQ ID NO: 393134 - protein, 6 aa, Mycobacterium
AKSNVD

SEQ ID NO: 393135 - protein, 5 aa, Mycobacterium
AKSPV

SEQ ID NO: 393136 - protein, 6 aa, Mycobacterium
AKSSHE

SEQ ID NO: 393137 - protein, 7 aa, Mycobacterium
AKTADKL

SEQ ID NO: 393138 - protein, 7 aa, Mycobacterium
AKTDDGD

SEQ ID NO: 393139 - protein, 7 aa, Mycobacterium
AKTDTED

SEQ ID NO: 393140 - protein, 9 aa, Mycobacterium
AKTEPIGEE

SEQ ID NO: 393141 - protein, 6 aa, Mycobacterium
AKTGNL

SEQ ID NO: 393142 - protein, 8 aa, Mycobacterium
AKTPDDRT

SEQ ID NO: 393143 - protein, 14 aa, Mycobacterium
AKTREAGPDHDPSS

SEQ ID NO: 393144 - protein, 11 aa, Mycobacterium
AKTRHNEVAPG

SEQ ID NO: 393145 - protein, 4 aa, Mycobacterium
AKTV

SEQ ID NO: 393146 - protein, 8 aa, Mycobacterium
AKVAPATA

SEQ ID NO: 393147 - protein, 4 aa, Mycobacterium
AKVD

SEQ ID NO: 393148 - protein, 7 aa, Mycobacterium
AKVKPGY

SEQ ID NO: 393149 - protein, 7 aa, Mycobacterium
AKVSTGY

SEQ ID NO: 393150 - protein, 8 aa, Mycobacterium
AKVTTDAA

SEQ ID NO: 393151 - protein, 10 aa, Mycobacterium
AKYPDGSTPE

SEQ ID NO: 393152 - protein, 6 aa, Mycobacterium
AKYPDT

SEQ ID NO: 393153 - protein, 6 aa, Mycobacterium
AKYPKA

SEQ ID NO: 393154 - protein, 7 aa, Mycobacterium
ALADDQA

SEQ ID NO: 393155 - protein, 5 aa, Mycobacterium
ALADG

SEQ ID NO: 393156 - protein, 11 aa, Mycobacterium
ALADGAGDHGM

SEQ ID NO: 393157 - protein, 12 aa, Mycobacterium
ALAETPPWQGGG

SEQ ID NO: 393158 - protein, 4 aa, Mycobacterium
ALAG

SEQ ID NO: 393159 - protein, 17 aa, Mycobacterium
ALAPGAAGRRHRDPSIA

SEQ ID NO: 393160 - protein, 7 aa, Mycobacterium
ALAPSTV

SEQ ID NO: 393161 - protein, 7 aa, Mycobacterium
ALDEEQI

SEQ ID NO: 393162 - protein, 8 aa, Mycobacterium
ALDGPDAP

SEQ ID NO: 393163 - protein, 6 aa, Mycobacterium
ALDPDQ

SEQ ID NO: 393164 - protein, 7 aa, Mycobacterium
ALDSPDE

SEQ ID NO: 393165 - protein, 9 aa, Mycobacterium
ALDSPDSPR

SEQ ID NO: 393166 - protein, 7 aa, Mycobacterium
ALEDPNG

SEQ ID NO: 393167 - protein, 7 aa, Mycobacterium
ALEEGGA

SEQ ID NO: 393168 - protein, 5 aa, Mycobacterium
ALEGD

SEQ ID NO: 393169 - protein, 7 aa, Mycobacterium
ALEGDPK

SEQ ID NO: 393170 - protein, 6 aa, Mycobacterium
ALEPQR

SEQ ID NO: 393171 - protein, 4 aa, Mycobacterium
ALGA

SEQ ID NO: 393172 - protein, 9 aa, Mycobacterium
ALGDEAGQQ

SEQ ID NO: 393173 - protein, 5 aa, Mycobacterium
ALGEP

SEQ ID NO: 393174 - protein, 4 aa, Mycobacterium
ALGG

SEQ ID NO: 393175 - protein, 6 aa, Mycobacterium
ALGGAQ

SEQ ID NO: 393176 - protein, 10 aa, Mycobacterium
ALGKPDKKAV

SEQ ID NO: 393177 - protein, 5 aa, Mycobacterium
ALGND

SEQ ID NO: 393178 - protein, 4 aa, Mycobacterium
ALGP

SEQ ID NO: 393179 - protein, 7 aa, Mycobacterium
ALGPSIE

SEQ ID NO: 393180 - protein, 9 aa, Mycobacterium
ALGSQGGAV

SEQ ID NO: 393181 - protein, 13 aa, Mycobacterium
ALHSKSESEGQRR

SEQ ID NO: 393182 - protein, 5 aa, Mycobacterium
ALNAG

SEQ ID NO: 393183 - protein, 4 aa, Mycobacterium
ALPA

SEQ ID NO: 393184 - protein, 5 aa, Mycobacterium
ALPAD

SEQ ID NO: 393185 - protein, 5 aa, Mycobacterium
ALPAQ

SEQ ID NO: 393186 - protein, 9 aa, Mycobacterium
ALPASRESA

SEQ ID NO: 393187 - protein, 5 aa, Mycobacterium
ALPDA

SEQ ID NO: 393188 - protein, 6 aa, Mycobacterium
ALPDAP

SEQ ID NO: 393189 - protein, 5 aa, Mycobacterium
ALPDG

SEQ ID NO: 393190 - protein, 5 aa, Mycobacterium
ALPDT

SEQ ID NO: 393191 - protein, 9 aa, Mycobacterium
ALPDTQSER

SEQ ID NO: 393192 - protein, 6 aa, Mycobacterium
ALPEKV

SEQ ID NO: 393193 - protein, 7 aa, Mycobacterium
ALPEPGR

SEQ ID NO: 393194 - protein, 5 aa, Mycobacterium
ALPGA

SEQ ID NO: 393195 - protein, 9 aa, Mycobacterium
ALPGEDVTD

SEQ ID NO: 393196 - protein, 6 aa, Mycobacterium
ALPGGA

SEQ ID NO: 393197 - protein, 7 aa, Mycobacterium
ALPGPLT

SEQ ID NO: 393198 - protein, 6 aa, Mycobacterium
ALPPAA

SEQ ID NO: 393199 - protein, 7 aa, Mycobacterium
ALPPESG

SEQ ID NO: 393200 - protein, 7 aa, Mycobacterium
ALPPTEP

SEQ ID NO: 393201 - protein, 11 aa, Mycobacterium
ALPSEKEIDRR

SEQ ID NO: 393202 - protein, 10 aa, Mycobacterium
ALPSPGSDEQ

SEQ ID NO: 393203 - protein, 4 aa, Mycobacterium
ALPT

SEQ ID NO: 393204 - protein, 4 aa, Mycobacterium
ALQN

SEQ ID NO: 393205 - protein, 13 aa, Mycobacterium
ALQPDDPRSSGDN

SEQ ID NO: 393206 - protein, 9 aa, Mycobacterium
ALQSPTAPS

SEQ ID NO: 393207 - protein, 4 aa, Mycobacterium
ALRD

SEQ ID NO: 393208 - protein, 7 aa, Mycobacterium
ALREGKG

SEQ ID NO: 393209 - protein, 4 aa, Mycobacterium
ALRG

SEQ ID NO: 393210 - protein, 5 aa, Mycobacterium
ALRPG

SEQ ID NO: 393211 - protein, 5 aa, Mycobacterium
ALRPP

SEQ ID NO: 393212 - protein, 5 aa, Mycobacterium
ALSDT

SEQ ID NO: 393213 - protein, 4 aa, Mycobacterium
ALSE

SEQ ID NO: 393214 - protein, 12 aa, Mycobacterium
ALSEEEKADAGI

SEQ ID NO: 393215 - protein, 7 aa, Mycobacterium
ALSEPAW

SEQ ID NO: 393216 - protein, 4 aa, Mycobacterium
ALSS

SEQ ID NO: 393217 - protein, 9 aa, Mycobacterium
ALSSPSGVG

SEQ ID NO: 393218 - protein, 8 aa, Mycobacterium
ALSSPSSM

SEQ ID NO: 393219 - protein, 6 aa, Mycobacterium
ALTEPT

SEQ ID NO: 393220 - protein, 7 aa, Mycobacterium
ALTGGPG

SEQ ID NO: 393221 - protein, 4 aa, Mycobacterium
ALTP

SEQ ID NO: 393222 - protein, 7 aa, Mycobacterium
ALTPENT

SEQ ID NO: 393223 - protein, 5 aa, Mycobacterium
ALTPG

SEQ ID NO: 393224 - protein, 7 aa, Mycobacterium
AMADGPD

SEQ ID NO: 393225 - protein, 10 aa, Mycobacterium
AMDNARDATQ

SEQ ID NO: 393226 - protein, 12 aa, Mycobacterium
AMDNARDATQIH

SEQ ID NO: 393227 - protein, 4 aa, Mycobacterium
AMEP

SEQ ID NO: 393228 - protein, 5 aa, Mycobacterium
AMKPG

SEQ ID NO: 393229 - protein, 6 aa, Mycobacterium
AMPDKE

SEQ ID NO: 393230 - protein, 6 aa, Mycobacterium
AMPSPD

SEQ ID NO: 393231 - protein, 5 aa, Mycobacterium
AMRPG

SEQ ID NO: 393232 - protein, 9 aa, Mycobacterium
AMRTSGDDI

SEQ ID NO: 393233 - protein, 8 aa, Mycobacterium
AMSPAGGV

SEQ ID NO: 393234 - protein, 8 aa, Mycobacterium
AMSRSKRE

SEQ ID NO: 393235 - protein, 15 aa, Mycobacterium
AMTEDAAAEAGVSSP

SEQ ID NO: 393236 - protein, 6 aa, Mycobacterium
AMTGGL

SEQ ID NO: 393237 - protein, 15 aa, Mycobacterium
AMTPGNKNGWSQEQG

SEQ ID NO: 393238 - protein, 5 aa, Mycobacterium
AMTYP

SEQ ID NO: 393239 - protein, 10 aa, Mycobacterium
ANAAGDGFAD

SEQ ID NO: 393240 - protein, 8 aa, Mycobacterium
ANAALNPT

SEQ ID NO: 393241 - protein, 10 aa, Mycobacterium
ANAARLRSSA

SEQ ID NO: 393242 - protein, 9 aa, Mycobacterium
ANAATAGSI

SEQ ID NO: 393243 - protein, 6 aa, Mycobacterium
ANADND

SEQ ID NO: 393244 - protein, 7 aa, Mycobacterium
ANAEATR

SEQ ID NO: 393245 - protein, 8 aa, Mycobacterium
ANAMGRPG

SEQ ID NO: 393246 - protein, 6 aa, Mycobacterium
ANARGK

SEQ ID NO: 393247 - protein, 10 aa, Mycobacterium
ANASIPTPQP

SEQ ID NO: 393248 - protein, 4 aa, Mycobacterium
ANAT

SEQ ID NO: 393249 - protein, 5 aa, Mycobacterium
ANDAD

SEQ ID NO: 393250 - protein, 6 aa, Mycobacterium
ANDADE

SEQ ID NO: 393251 - protein, 6 aa, Mycobacterium
ANDEGK

SEQ ID NO: 393252 - protein, 12 aa, Mycobacterium
ANDHEDGNGQFE

SEQ ID NO: 393253 - protein, 7 aa, Mycobacterium
ANDPERA

SEQ ID NO: 393254 - protein, 4 aa, Mycobacterium
ANDV

SEQ ID NO: 393255 - protein, 7 aa, Mycobacterium
ANEAVEQ

SEQ ID NO: 393256 - protein, 7 aa, Mycobacterium
ANERAEV

SEQ ID NO: 393257 - protein, 13 aa, Mycobacterium
ANEYSGQPRPPAV

SEQ ID NO: 393258 - protein, 4 aa, Mycobacterium
ANGC

SEQ ID NO: 393259 - protein, 8 aa, Mycobacterium
ANGDPTVD

SEQ ID NO: 393260 - protein, 5 aa, Mycobacterium
ANGEE

SEQ ID NO: 393261 - protein, 7 aa, Mycobacterium
ANGGLGE

SEQ ID NO: 393262 - protein, 19 aa, Mycobacterium
ANGQAQNAKTKRTQQDDRA

SEQ ID NO: 393263 - protein, 10 aa, Mycobacterium
ANGRPRRAGV

SEQ ID NO: 393264 - protein, 8 aa, Mycobacterium
ANGTGQAT

SEQ ID NO: 393265 - protein, 5 aa, Mycobacterium
ANHPP

SEQ ID NO: 393266 - protein, 17 aa, Mycobacterium
ANKTRESLQATAQLTQT

SEQ ID NO: 393267 - protein, 12 aa, Mycobacterium
ANLGPVATPYTR

SEQ ID NO: 393268 - protein, 6 aa, Mycobacterium
ANLPLS

SEQ ID NO: 393269 - protein, 13 aa, Mycobacterium
ANLTRNTADFGGS

SEQ ID NO: 393270 - protein, 18 aa, Mycobacterium
ANNDGIVSPDNVDDAALS

SEQ ID NO: 393271 - protein, 7 aa, Mycobacterium
ANNRVRI

SEQ ID NO: 393272 - protein, 16 aa, Mycobacterium
ANNYEQQEQASQQILS

SEQ ID NO: 393273 - protein, 16 aa, Mycobacterium
ANNYEQQEQASQQVLG

SEQ ID NO: 393274 - protein, 16 aa, Mycobacterium
ANNYEQQEQASQQVLR

SEQ ID NO: 393275 - protein, 4 aa, Mycobacterium
ANPA

SEQ ID NO: 393276 - protein, 8 aa, Mycobacterium
ANPAAQDL

SEQ ID NO: 393277 - protein, 5 aa, Mycobacterium
ANPAG

SEQ ID NO: 393278 - protein, 5 aa, Mycobacterium
ANPDR

SEQ ID NO: 393279 - protein, 8 aa, Mycobacterium
ANPGPVDV

SEQ ID NO: 393280 - protein, 10 aa, Mycobacterium
ANPKPVQRPH

SEQ ID NO: 393281 - protein, 6 aa, Mycobacterium
ANPKVS

SEQ ID NO: 393282 - protein, 18 aa, Mycobacterium
ANQADKYPAQLSGGQQQR

SEQ ID NO: 393283 - protein, 16 aa, Mycobacterium
ANQEAAESSTWSTDST

SEQ ID NO: 393284 - protein, 6 aa, Mycobacterium
ANQLPD

SEQ ID NO: 393285 - protein, 7 aa, Mycobacterium
ANRDEEI

SEQ ID NO: 393286 - protein, 6 aa, Mycobacterium
ANRDER

SEQ ID NO: 393287 - protein, 8 aa, Mycobacterium
ANRDETKF

SEQ ID NO: 393288 - protein, 8 aa, Mycobacterium
ANRDPAIY

SEQ ID NO: 393289 - protein, 6 aa, Mycobacterium
ANRENA

SEQ ID NO: 393290 - protein, 4 aa, Mycobacterium
ANRG

SEQ ID NO: 393291 - protein, 7 aa, Mycobacterium
ANRGLGR

SEQ ID NO: 393292 - protein, 5 aa, Mycobacterium
ANRPA

SEQ ID NO: 393293 - protein, 9 aa, Mycobacterium
ANRPDSDSL

SEQ ID NO: 393294 - protein, 7 aa, Mycobacterium
ANSAEGW

SEQ ID NO: 393295 - protein, 7 aa, Mycobacterium
ANSAGQA

SEQ ID NO: 393296 - protein, 13 aa, Mycobacterium
ANSFEAQAARDGL

SEQ ID NO: 393297 - protein, 5 aa, Mycobacterium
ANSGL

SEQ ID NO: 393298 - protein, 9 aa, Mycobacterium
ANSLGDHVS

SEQ ID NO: 393299 - protein, 4 aa, Mycobacterium
ANSP

SEQ ID NO: 393300 - protein, 8 aa, Mycobacterium
ANSQSAAM

SEQ ID NO: 393301 - protein, 5 aa, Mycobacterium
ANTAT

SEQ ID NO: 393302 - protein, 5 aa, Mycobacterium
ANTCR

SEQ ID NO: 393303 - protein, 4 aa, Mycobacterium
ANTG

SEQ ID NO: 393304 - protein, 7 aa, Mycobacterium
ANTGDGI

SEQ ID NO: 393305 - protein, 6 aa, Mycobacterium
ANTGLG

SEQ ID NO: 393306 - protein, 8 aa, Mycobacterium
ANTGSNNI

SEQ ID NO: 393307 - protein, 4 aa, Mycobacterium
ANTP

SEQ ID NO: 393308 - protein, 4 aa, Mycobacterium
ANTY

SEQ ID NO: 393309 - protein, 4 aa, Mycobacterium
APAA

SEQ ID NO: 393310 - protein, 8 aa, Mycobacterium
APAAAAAT

SEQ ID NO: 393311 - protein, 5 aa, Mycobacterium
APAAV

SEQ ID NO: 393312 - protein, 11 aa, Mycobacterium
APAERQRELQD

SEQ ID NO: 393313 - protein, 4 aa, Mycobacterium
APAG

SEQ ID NO: 393314 - protein, 11 aa, Mycobacterium
APAGAGKTTSM

SEQ ID NO: 393315 - protein, 6 aa, Mycobacterium
APAGAQ

SEQ ID NO: 393316 - protein, 5 aa, Mycobacterium
APAGD

SEQ ID NO: 393317 - protein, 10 aa, Mycobacterium
APAGGGPGPH

SEQ ID NO: 393318 - protein, 6 aa, Mycobacterium
APAGGW

SEQ ID NO: 393319 - protein, 17 aa, Mycobacterium
APAGPADPTISQTLKGG

SEQ ID NO: 393320 - protein, 7 aa, Mycobacterium
APAGSAG

SEQ ID NO: 393321 - protein, 10 aa, Mycobacterium
APAGTGKTTA

SEQ ID NO: 393322 - protein, 6 aa, Mycobacterium
APAGYT

SEQ ID NO: 393323 - protein, 10 aa, Mycobacterium
APAKDDPRLV

SEQ ID NO: 393324 - protein, 4 aa, Mycobacterium
APAL

SEQ ID NO: 393325 - protein, 6 aa, Mycobacterium
APALPG

SEQ ID NO: 393326 - protein, 4 aa, Mycobacterium
APAN

SEQ ID NO: 393327 - protein, 5 aa, Mycobacterium
APAPG

SEQ ID NO: 393328 - protein, 13 aa, Mycobacterium
APAPLGRKREGRD

SEQ ID NO: 393329 - protein, 7 aa, Mycobacterium
APAPPPL

SEQ ID NO: 393330 - protein, 5 aa, Mycobacterium
APAPV

SEQ ID NO: 393331 - protein, 5 aa, Mycobacterium
APAQG

SEQ ID NO: 393332 - protein, 14 aa, Mycobacterium
APAQIKGPVAGTGA

SEQ ID NO: 393333 - protein, 5 aa, Mycobacterium
APAQV

SEQ ID NO: 393334 - protein, 5 aa, Mycobacterium
APARA

SEQ ID NO: 393335 - protein, 5 aa, Mycobacterium
APARP

SEQ ID NO: 393336 - protein, 6 aa, Mycobacterium
APARRL

SEQ ID NO: 393337 - protein, 7 aa, Mycobacterium
APASDED

SEQ ID NO: 393338 - protein, 7 aa, Mycobacterium
APATDPD

SEQ ID NO: 393339 - protein, 4 aa, Mycobacterium
APAW

SEQ ID NO: 393340 - protein, 12 aa, Mycobacterium
APDAAAREHDPS

SEQ ID NO: 393341 - protein, 5 aa, Mycobacterium
APDAG

SEQ ID NO: 393342 - protein, 5 aa, Mycobacterium
APDAV

SEQ ID NO: 393343 - protein, 4 aa, Mycobacterium
APDD

SEQ ID NO: 393344 - protein, 8 aa, Mycobacterium
APDDRKRL

SEQ ID NO: 393345 - protein, 5 aa, Mycobacterium
APDDV

SEQ ID NO: 393346 - protein, 5 aa, Mycobacterium
APDET

SEQ ID NO: 393347 - protein, 6 aa, Mycobacterium
APDETT

SEQ ID NO: 393348 - protein, 5 aa, Mycobacterium
APDGR

SEQ ID NO: 393349 - protein, 8 aa, Mycobacterium
APDGTPQQ

SEQ ID NO: 393350 - protein, 6 aa, Mycobacterium
APDHPE

SEQ ID NO: 393351 - protein, 11 aa, Mycobacterium
APDHRVQGEEM

SEQ ID NO: 393352 - protein, 4 aa, Mycobacterium
APDK

SEQ ID NO: 393353 - protein, 6 aa, Mycobacterium
APDKTE

SEQ ID NO: 393354 - protein, 9 aa, Mycobacterium
APDPAQDSL

SEQ ID NO: 393355 - protein, 6 aa, Mycobacterium
APDPDF

SEQ ID NO: 393356 - protein, 7 aa, Mycobacterium
APDPDGG

SEQ ID NO: 393357 - protein, 6 aa, Mycobacterium
APDPFE

SEQ ID NO: 393358 - protein, 6 aa, Mycobacterium
APDPTW

SEQ ID NO: 393359 - protein, 4 aa, Mycobacterium
APDT

SEQ ID NO: 393360 - protein, 7 aa, Mycobacterium
APDTPWQ

SEQ ID NO: 393361 - protein, 5 aa, Mycobacterium
APDWP

SEQ ID NO: 393362 - protein, 5 aa, Mycobacterium
APEAA

SEQ ID NO: 393363 - protein, 4 aa, Mycobacterium
APEE

SEQ ID NO: 393364 - protein, 6 aa, Mycobacterium
APEEFK

SEQ ID NO: 393365 - protein, 5 aa, Mycobacterium
APEEQ

SEQ ID NO: 393366 - protein, 8 aa, Mycobacterium
APEESPRS

SEQ ID NO: 393367 - protein, 4 aa, Mycobacterium
APEG

SEQ ID NO: 393368 - protein, 5 aa, Mycobacterium
APEGG

SEQ ID NO: 393369 - protein, 6 aa, Mycobacterium
APEHTR

SEQ ID NO: 393370 - protein, 6 aa, Mycobacterium
APEKAD

SEQ ID NO: 393371 - protein, 5 aa, Mycobacterium
APELA

SEQ ID NO: 393372 - protein, 9 aa, Mycobacterium
APEPDAETL

SEQ ID NO: 393373 - protein, 7 aa, Mycobacterium
APEPGLA

SEQ ID NO: 393374 - protein, 7 aa, Mycobacterium
APEPPRV

SEQ ID NO: 393375 - protein, 7 aa, Mycobacterium
APEQTGV

SEQ ID NO: 393376 - protein, 6 aa, Mycobacterium
APERFR

SEQ ID NO: 393377 - protein, 4 aa, Mycobacterium
APES

SEQ ID NO: 393378 - protein, 9 aa, Mycobacterium
APETPRGER

SEQ ID NO: 393379 - protein, 6 aa, Mycobacterium
APGADI

SEQ ID NO: 393380 - protein, 5 aa, Mycobacterium
APGAL

SEQ ID NO: 393381 - protein, 5 aa, Mycobacterium
APGAY

SEQ ID NO: 393382 - protein, 4 aa, Mycobacterium
APGD

SEQ ID NO: 393383 - protein, 14 aa, Mycobacterium
APGDPNFASAPAEI

SEQ ID NO: 393384 - protein, 5 aa, Mycobacterium
APGDV

SEQ ID NO: 393385 - protein, 6 aa, Mycobacterium
APGEPA

SEQ ID NO: 393386 - protein, 5 aa, Mycobacterium
APGEV

SEQ ID NO: 393387 - protein, 12 aa, Mycobacterium
APGFNGQPSVIN

SEQ ID NO: 393388 - protein, 5 aa, Mycobacterium
APGGA

SEQ ID NO: 393389 - protein, 8 aa, Mycobacterium
APGGDAAA

SEQ ID NO: 393390 - protein, 5 aa, Mycobacterium
APGGL

SEQ ID NO: 393391 - protein, 9 aa, Mycobacterium
APGGTRTPR

SEQ ID NO: 393392 - protein, 5 aa, Mycobacterium
APGHA

SEQ ID NO: 393393 - protein, 6 aa, Mycobacterium
APGHPE

SEQ ID NO: 393394 - protein, 5 aa, Mycobacterium
APGIT

SEQ ID NO: 393395 - protein, 4 aa, Mycobacterium
APGL

SEQ ID NO: 393396 - protein, 5 aa, Mycobacterium
APGLG

SEQ ID NO: 393397 - protein, 7 aa, Mycobacterium
APGLPDE

SEQ ID NO: 393398 - protein, 13 aa, Mycobacterium
APGPDGEPRPVAR

SEQ ID NO: 393399 - protein, 6 aa, Mycobacterium
APGPGQ

SEQ ID NO: 393400 - protein, 7 aa, Mycobacterium
APGPHET

SEQ ID NO: 393401 - protein, 19 aa, Mycobacterium
APGPTHPVQPSPYTPSSRR

SEQ ID NO: 393402 - protein, 7 aa, Mycobacterium
APGQAAY

SEQ ID NO: 393403 - protein, 7 aa, Mycobacterium
APGQPAR

SEQ ID NO: 393404 - protein, 8 aa, Mycobacterium
APGQPSPY

SEQ ID NO: 393405 - protein, 4 aa, Mycobacterium
APGR

SEQ ID NO: 393406 - protein, 14 aa, Mycobacterium
APGRTDASQENTDV

SEQ ID NO: 393407 - protein, 4 aa, Mycobacterium
APGS

SEQ ID NO: 393408 - protein, 5 aa, Mycobacterium
APGSP

SEQ ID NO: 393409 - protein, 8 aa, Mycobacterium
APGTIDTP

SEQ ID NO: 393410 - protein, 5 aa, Mycobacterium
APGVP

SEQ ID NO: 393411 - protein, 4 aa, Mycobacterium
APHA

SEQ ID NO: 393412 - protein, 4 aa, Mycobacterium
APHG

SEQ ID NO: 393413 - protein, 6 aa, Mycobacterium
APHNAA

SEQ ID NO: 393414 - protein, 5 aa, Mycobacterium
APHRE

SEQ ID NO: 393415 - protein, 10 aa, Mycobacterium
APIADPPGGA

SEQ ID NO: 393416 - protein, 4 aa, Mycobacterium
APIR

SEQ ID NO: 393417 - protein, 12 aa, Mycobacterium
APKAAANSADDE

SEQ ID NO: 393418 - protein, 5 aa, Mycobacterium
APKAL

SEQ ID NO: 393419 - protein, 5 aa, Mycobacterium
APKAT

SEQ ID NO: 393420 - protein, 5 aa, Mycobacterium
APKPL

SEQ ID NO: 393421 - protein, 4 aa, Mycobacterium
APLA

SEQ ID NO: 393422 - protein, 9 aa, Mycobacterium
APLAQRATK

SEQ ID NO: 393423 - protein, 11 aa, Mycobacterium
APLDDASRNRL

SEQ ID NO: 393424 - protein, 10 aa, Mycobacterium
APLDEASRNR

SEQ ID NO: 393425 - protein, 13 aa, Mycobacterium
APLEEGQKDVPWP

SEQ ID NO: 393426 - protein, 7 aa, Mycobacterium
APLESNA

SEQ ID NO: 393427 - protein, 7 aa, Mycobacterium
APLNTPG

SEQ ID NO: 393428 - protein, 4 aa, Mycobacterium
APLS

SEQ ID NO: 393429 - protein, 14 aa, Mycobacterium
APLVPGTPDPVKDA

SEQ ID NO: 393430 - protein, 18 aa, Mycobacterium
APMGGMGQSGVGRRHGPE

SEQ ID NO: 393431 - protein, 7 aa, Mycobacterium
APNADEN

SEQ ID NO: 393432 - protein, 4 aa, Mycobacterium
APNG

SEQ ID NO: 393433 - protein, 4 aa, Mycobacterium
APNT

SEQ ID NO: 393434 - protein, 8 aa, Mycobacterium
APNTGGES

SEQ ID NO: 393435 - protein, 4 aa, Mycobacterium
APPA

SEQ ID NO: 393436 - protein, 5 aa, Mycobacterium
APPAA

SEQ ID NO: 393437 - protein, 8 aa, Mycobacterium
APPDPDGK

SEQ ID NO: 393438 - protein, 6 aa, Mycobacterium
APPEDW

SEQ ID NO: 393439 - protein, 7 aa, Mycobacterium
APPEPLA

SEQ ID NO: 393440 - protein, 5 aa, Mycobacterium
APPGF

SEQ ID NO: 393441 - protein, 6 aa, Mycobacterium
APPGLI

SEQ ID NO: 393442 - protein, 18 aa, Mycobacterium
APPGPAYGDTISGTNLAG

SEQ ID NO: 393443 - protein, 5 aa, Mycobacterium
APPGY

SEQ ID NO: 393444 - protein, 5 aa, Mycobacterium
APPHG

SEQ ID NO: 393445 - protein, 9 aa, Mycobacterium
APPKGSPRK

SEQ ID NO: 393446 - protein, 6 aa, Mycobacterium
APPNLV

SEQ ID NO: 393447 - protein, 8 aa, Mycobacterium
APPPEVSS

SEQ ID NO: 393448 - protein, 10 aa, Mycobacterium
APPPQETPPR

SEQ ID NO: 393449 - protein, 8 aa, Mycobacterium
APPRDRRG

SEQ ID NO: 393450 - protein, 5 aa, Mycobacterium
APPRR

SEQ ID NO: 393451 - protein, 6 aa, Mycobacterium
APPRSP

SEQ ID NO: 393452 - protein, 6 aa, Mycobacterium
APPTGR

SEQ ID NO: 393453 - protein, 4 aa, Mycobacterium
APPV

SEQ ID NO: 393454 - protein, 5 aa, Mycobacterium
APQGL

SEQ ID NO: 393455 - protein, 19 aa, Mycobacterium
APQIGNTGWNDEDAESRGD

SEQ ID NO: 393456 - protein, 9 aa, Mycobacterium
APQPAQPWS

SEQ ID NO: 393457 - protein, 8 aa, Mycobacterium
APQPPERW

SEQ ID NO: 393458 - protein, 5 aa, Mycobacterium
APQQR

SEQ ID NO: 393459 - protein, 4 aa, Mycobacterium
APQT

SEQ ID NO: 393460 - protein, 14 aa, Mycobacterium
APQTGPAPGFAEQT

SEQ ID NO: 393461 - protein, 4 aa, Mycobacterium
APRA

SEQ ID NO: 393462 - protein, 5 aa, Mycobacterium
APRAA

SEQ ID NO: 393463 - protein, 13 aa, Mycobacterium
APRAAHEREGHEK

SEQ ID NO: 393464 - protein, 6 aa, Mycobacterium
APRDGA

SEQ ID NO: 393465 - protein, 11 aa, Mycobacterium
APRGENESPAA

SEQ ID NO: 393466 - protein, 8 aa, Mycobacterium
APRGGGGV

SEQ ID NO: 393467 - protein, 4 aa, Mycobacterium
APRL

SEQ ID NO: 393468 - protein, 5 aa, Mycobacterium
APRNP

SEQ ID NO: 393469 - protein, 8 aa, Mycobacterium
APRPTTPF

SEQ ID NO: 393470 - protein, 11 aa, Mycobacterium
APRQLPAPEAV

SEQ ID NO: 393471 - protein, 6 aa, Mycobacterium
APRRSG

SEQ ID NO: 393472 - protein, 6 aa, Mycobacterium
APRRTA

SEQ ID NO: 393473 - protein, 4 aa, Mycobacterium
APRS

SEQ ID NO: 393474 - protein, 5 aa, Mycobacterium
APRSA

SEQ ID NO: 393475 - protein, 8 aa, Mycobacterium
APRSPSDC

SEQ ID NO: 393476 - protein, 5 aa, Mycobacterium
APRTP

SEQ ID NO: 393477 - protein, 5 aa, Mycobacterium
APRVS

SEQ ID NO: 393478 - protein, 5 aa, Mycobacterium
APSPH

SEQ ID NO: 393479 - protein, 6 aa, Mycobacterium
APSPSS

SEQ ID NO: 393480 - protein, 6 aa, Mycobacterium
APSQYQ

SEQ ID NO: 393481 - protein, 4 aa, Mycobacterium
APSR

SEQ ID NO: 393482 - protein, 5 aa, Mycobacterium
APSTE

SEQ ID NO: 393483 - protein, 5 aa, Mycobacterium
APSTV

SEQ ID NO: 393484 - protein, 4 aa, Mycobacterium
APSV

SEQ ID NO: 393485 - protein, 4 aa, Mycobacterium
APTD

SEQ ID NO: 393486 - protein, 6 aa, Mycobacterium
APTDED

SEQ ID NO: 393487 - protein, 5 aa, Mycobacterium
APTEA

SEQ ID NO: 393488 - protein, 4 aa, Mycobacterium
APTG

SEQ ID NO: 393489 - protein, 10 aa, Mycobacterium
APTGKAAARL

SEQ ID NO: 393490 - protein, 6 aa, Mycobacterium
APTKHE

SEQ ID NO: 393491 - protein, 6 aa, Mycobacterium
APTKHQ

SEQ ID NO: 393492 - protein, 10 aa, Mycobacterium
APTLAPRRKT

SEQ ID NO: 393493 - protein, 6 aa, Mycobacterium
APTLGA

SEQ ID NO: 393494 - protein, 6 aa, Mycobacterium
APTNHQ

SEQ ID NO: 393495 - protein, 7 aa, Mycobacterium
APTQTGG

SEQ ID NO: 393496 - protein, 5 aa, Mycobacterium
APTRE

SEQ ID NO: 393497 - protein, 4 aa, Mycobacterium
APTS

SEQ ID NO: 393498 - protein, 11 aa, Mycobacterium
APTTGWAGTED

SEQ ID NO: 393499 - protein, 15 aa, Mycobacterium
APTTSLPETPQGERN

SEQ ID NO: 393500 - protein, 5 aa, Mycobacterium
APVAA

SEQ ID NO: 393501 - protein, 9 aa, Mycobacterium
APVANGANI

SEQ ID NO: 393502 - protein, 9 aa, Mycobacterium
APVANGANV

SEQ ID NO: 393503 - protein, 5 aa, Mycobacterium
APVKA

SEQ ID NO: 393504 - protein, 5 aa, Mycobacterium
APVKE

SEQ ID NO: 393505 - protein, 4 aa, Mycobacterium
APVP

SEQ ID NO: 393506 - protein, 11 aa, Mycobacterium
APVPGYRGSRS

SEQ ID NO: 393507 - protein, 4 aa, Mycobacterium
APVR

SEQ ID NO: 393508 - protein, 4 aa, Mycobacterium
APVS

SEQ ID NO: 393509 - protein, 5 aa, Mycobacterium
APVTG

SEQ ID NO: 393510 - protein, 11 aa, Mycobacterium
APVTSDGPHYP

SEQ ID NO: 393511 - protein, 8 aa, Mycobacterium
APWSTGHT

SEQ ID NO: 393512 - protein, 4 aa, Mycobacterium
APYA

SEQ ID NO: 393513 - protein, 10 aa, Mycobacterium
APYDPDSQRE

SEQ ID NO: 393514 - protein, 6 aa, Mycobacterium
APYGSG

SEQ ID NO: 393515 - protein, 7 aa, Mycobacterium
APYSGAS

SEQ ID NO: 393516 - protein, 4 aa, Mycobacterium
AQAA

SEQ ID NO: 393517 - protein, 9 aa, Mycobacterium
AQAAASKLA

SEQ ID NO: 393518 - protein, 8 aa, Mycobacterium
AQADVAED

SEQ ID NO: 393519 - protein, 7 aa, Mycobacterium
AQAEHPG

SEQ ID NO: 393520 - protein, 7 aa, Mycobacterium
AQAERAA

SEQ ID NO: 393521 - protein, 11 aa, Mycobacterium
AQAERSREPIA

SEQ ID NO: 393522 - protein, 8 aa, Mycobacterium
AQAESEGL

SEQ ID NO: 393523 - protein, 4 aa, Mycobacterium
AQAG

SEQ ID NO: 393524 - protein, 4 aa, Mycobacterium
AQAH

SEQ ID NO: 393525 - protein, 5 aa, Mycobacterium
AQAMG

SEQ ID NO: 393526 - protein, 9 aa, Mycobacterium
AQANGDTPV

SEQ ID NO: 393527 - protein, 4 aa, Mycobacterium
AQAR

SEQ ID NO: 393528 - protein, 6 aa, Mycobacterium
AQARSA

SEQ ID NO: 393529 - protein, 9 aa, Mycobacterium
AQATEEQRR

SEQ ID NO: 393530 - protein, 9 aa, Mycobacterium
AQATGDTPV

SEQ ID NO: 393531 - protein, 6 aa, Mycobacterium
AQAVPS

SEQ ID NO: 393532 - protein, 4 aa, Mycobacterium
AQAY

SEQ ID NO: 393533 - protein, 9 aa, Mycobacterium
AQDDNQGKF

SEQ ID NO: 393534 - protein, 7 aa, Mycobacterium
AQDDTVR

SEQ ID NO: 393535 - protein, 6 aa, Mycobacterium
AQDDYN

SEQ ID NO: 393536 - protein, 6 aa, Mycobacterium
AQDEVS

SEQ ID NO: 393537 - protein, 8 aa, Mycobacterium
AQDGKADS

SEQ ID NO: 393538 - protein, 14 aa, Mycobacterium
AQDISDSDLAGRYE

SEQ ID NO: 393539 - protein, 14 aa, Mycobacterium
AQDISDSDLSGRYE

SEQ ID NO: 393540 - protein, 6 aa, Mycobacterium
AQDPAA

SEQ ID NO: 393541 - protein, 15 aa, Mycobacterium
AQDRLAELESGLDID

SEQ ID NO: 393542 - protein, 7 aa, Mycobacterium
AQDTSEL

SEQ ID NO: 393543 - protein, 7 aa, Mycobacterium
AQDTTRY

SEQ ID NO: 393544 - protein, 6 aa, Mycobacterium
AQEAGN

SEQ ID NO: 393545 - protein, 7 aa, Mycobacterium
AQEEVWG

SEQ ID NO: 393546 - protein, 8 aa, Mycobacterium
AQEGAKYN

SEQ ID NO: 393547 - protein, 12 aa, Mycobacterium
AQEGSLSQIDED

SEQ ID NO: 393548 - protein, 13 aa, Mycobacterium
AQEPNYDAALAAA

SEQ ID NO: 393549 - protein, 11 aa, Mycobacterium
AQERAEREARL

SEQ ID NO: 393550 - protein, 5 aa, Mycobacterium
AQETP

SEQ ID NO: 393551 - protein, 11 aa, Mycobacterium
AQGAKAPERLD

SEQ ID NO: 393552 - protein, 4 aa, Mycobacterium
AQGE

SEQ ID NO: 393553 - protein, 8 aa, Mycobacterium
AQGPGKIA

SEQ ID NO: 393554 - protein, 8 aa, Mycobacterium
AQGPTATP

SEQ ID NO: 393555 - protein, 4 aa, Mycobacterium
AQGQ

SEQ ID NO: 393556 - protein, 8 aa, Mycobacterium
AQGRGLGE

SEQ ID NO: 393557 - protein, 5 aa, Mycobacterium
AQGRR

SEQ ID NO: 393558 - protein, 4 aa, Mycobacterium
AQGT

SEQ ID NO: 393559 - protein, 8 aa, Mycobacterium
AQGTIKGD

SEQ ID NO: 393560 - protein, 4 aa, Mycobacterium
AQGV

SEQ ID NO: 393561 - protein, 7 aa, Mycobacterium
AQGVESG

SEQ ID NO: 393562 - protein, 10 aa, Mycobacterium
AQGYSDSQGI

SEQ ID NO: 393563 - protein, 4 aa, Mycobacterium
AQIG

SEQ ID NO: 393564 - protein, 12 aa, Mycobacterium
AQIPPPDERRAY

SEQ ID NO: 393565 - protein, 12 aa, Mycobacterium
AQIPPPDERRGY

SEQ ID NO: 393566 - protein, 4 aa, Mycobacterium
AQIR

SEQ ID NO: 393567 - protein, 18 aa, Mycobacterium
AQKEQGRYGAATTTEESQ

SEQ ID NO: 393568 - protein, 4 aa, Mycobacterium
AQLA

SEQ ID NO: 393569 - protein, 8 aa, Mycobacterium
AQLGAEGA

SEQ ID NO: 393570 - protein, 5 aa, Mycobacterium
AQNAA

SEQ ID NO: 393571 - protein, 6 aa, Mycobacterium
AQNAFG

SEQ ID NO: 393572 - protein, 6 aa, Mycobacterium
AQNATK

SEQ ID NO: 393573 - protein, 6 aa, Mycobacterium
AQNSVR

SEQ ID NO: 393574 - protein, 7 aa, Mycobacterium
AQNTDAQ

SEQ ID NO: 393575 - protein, 6 aa, Mycobacterium
AQPATA

SEQ ID NO: 393576 - protein, 8 aa, Mycobacterium
AQPATIPP

SEQ ID NO: 393577 - protein, 6 aa, Mycobacterium
AQPDDI

SEQ ID NO: 393578 - protein, 4 aa, Mycobacterium
AQPE

SEQ ID NO: 393579 - protein, 4 aa, Mycobacterium
AQPG

SEQ ID NO: 393580 - protein, 6 aa, Mycobacterium
AQPGTP

SEQ ID NO: 393581 - protein, 8 aa, Mycobacterium
AQPPENHA

SEQ ID NO: 393582 - protein, 7 aa, Mycobacterium
AQPPPFD

SEQ ID NO: 393583 - protein, 12 aa, Mycobacterium
AQQPPKKHGNIP

SEQ ID NO: 393584 - protein, 4 aa, Mycobacterium
AQRA

SEQ ID NO: 393585 - protein, 6 aa, Mycobacterium
AQRAGD

SEQ ID NO: 393586 - protein, 6 aa, Mycobacterium
AQRALD

SEQ ID NO: 393587 - protein, 6 aa, Mycobacterium
AQRDRV

SEQ ID NO: 393588 - protein, 5 aa, Mycobacterium
AQRGA

SEQ ID NO: 393589 - protein, 6 aa, Mycobacterium
AQRGDQ

SEQ ID NO: 393590 - protein, 17 aa, Mycobacterium
AQRGHGSTSTPSVGRRP

SEQ ID NO: 393591 - protein, 7 aa, Mycobacterium
AQRGMGR

SEQ ID NO: 393592 - protein, 9 aa, Mycobacterium
AQRLSSQPR

SEQ ID NO: 393593 - protein, 5 aa, Mycobacterium
AQRNP

SEQ ID NO: 393594 - protein, 4 aa, Mycobacterium
AQRP

SEQ ID NO: 393595 - protein, 9 aa, Mycobacterium
AQRPDRADT

SEQ ID NO: 393596 - protein, 5 aa, Mycobacterium
AQRQK

SEQ ID NO: 393597 - protein, 7 aa, Mycobacterium
AQRQPDE

SEQ ID NO: 393598 - protein, 6 aa, Mycobacterium
AQRQQW

SEQ ID NO: 393599 - protein, 10 aa, Mycobacterium
AQRRDHRKLG

SEQ ID NO: 393600 - protein, 5 aa, Mycobacterium
AQRRK

SEQ ID NO: 393601 - protein, 8 aa, Mycobacterium
AQRRYQTG

SEQ ID NO: 393602 - protein, 5 aa, Mycobacterium
AQRTP

SEQ ID NO: 393603 - protein, 4 aa, Mycobacterium
AQRV

SEQ ID NO: 393604 - protein, 5 aa, Mycobacterium
AQRVR

SEQ ID NO: 393605 - protein, 9 aa, Mycobacterium
AQRVSGADH

SEQ ID NO: 393606 - protein, 6 aa, Mycobacterium
AQRWST

SEQ ID NO: 393607 - protein, 4 aa, Mycobacterium
AQRY

SEQ ID NO: 393608 - protein, 5 aa, Mycobacterium
AQSGY

SEQ ID NO: 393609 - protein, 33 aa, Mycobacterium
AQSPDIAQGVDTAHEARVEGAADPLDAQGAGDQ

SEQ ID NO: 393610 - protein, 11 aa, Mycobacterium
AQSSPATSVYD

SEQ ID NO: 393611 - protein, 6 aa, Mycobacterium
AQSTQL

SEQ ID NO: 393612 - protein, 4 aa, Mycobacterium
AQTA

SEQ ID NO: 393613 - protein, 5 aa, Mycobacterium
AQTGY

SEQ ID NO: 393614 - protein, 4 aa, Mycobacterium
AQTK

SEQ ID NO: 393615 - protein, 4 aa, Mycobacterium
AQTL

SEQ ID NO: 393616 - protein, 7 aa, Mycobacterium
AQTPAEV

SEQ ID NO: 393617 - protein, 8 aa, Mycobacterium
AQTPIERK

SEQ ID NO: 393618 - protein, 7 aa, Mycobacterium
AQTRAEP

SEQ ID NO: 393619 - protein, 14 aa, Mycobacterium
AQTRRRKAADPRHH

SEQ ID NO: 393620 - protein, 28 aa, Mycobacterium
AQTRSETQLRQAQEKADALQADAERKHS

SEQ ID NO: 393621 - protein, 9 aa, Mycobacterium
AQTSARTIG

SEQ ID NO: 393622 - protein, 6 aa, Mycobacterium
AQTTAD

SEQ ID NO: 393623 - protein, 5 aa, Mycobacterium
AQWNE

SEQ ID NO: 393624 - protein, 13 aa, Mycobacterium
AQYRNDAASTPEV

SEQ ID NO: 393625 - protein, 6 aa, Mycobacterium
ARAAEQ

SEQ ID NO: 393626 - protein, 6 aa, Mycobacterium
ARAAGV

SEQ ID NO: 393627 - protein, 12 aa, Mycobacterium
ARAAGYTGSDRN

SEQ ID NO: 393628 - protein, 4 aa, Mycobacterium
ARAC

SEQ ID NO: 393629 - protein, 7 aa, Mycobacterium
ARADAAR

SEQ ID NO: 393630 - protein, 6 aa, Mycobacterium
ARAEQG

SEQ ID NO: 393631 - protein, 8 aa, Mycobacterium
ARAGETED

SEQ ID NO: 393632 - protein, 9 aa, Mycobacterium
ARAGNRPLQ

SEQ ID NO: 393633 - protein, 6 aa, Mycobacterium
ARAGVG

SEQ ID NO: 393634 - protein, 4 aa, Mycobacterium
ARAI

SEQ ID NO: 393635 - protein, 9 aa, Mycobacterium
ARAKEQDTE

SEQ ID NO: 393636 - protein, 7 aa, Mycobacterium
ARAKMSG

SEQ ID NO: 393637 - protein, 7 aa, Mycobacterium
ARAKSDR

SEQ ID NO: 393638 - protein, 6 aa, Mycobacterium
ARAPRV

SEQ ID NO: 393639 - protein, 4 aa, Mycobacterium
ARAQ

SEQ ID NO: 393640 - protein, 16 aa, Mycobacterium
ARARSGNLKPDELAGG

SEQ ID NO: 393641 - protein, 17 aa, Mycobacterium
ARARSGNLKPDELSGGT

SEQ ID NO: 393642 - protein, 10 aa, Mycobacterium
ARASARAATW

SEQ ID NO: 393643 - protein, 4 aa, Mycobacterium
ARAT

SEQ ID NO: 393644 - protein, 39 aa, Mycobacterium
ARATDEQRRRRERANAEKKAGALRAQAAKMGAKATKAVA

SEQ ID NO: 393645 - protein, 39 aa, Mycobacterium; identical to SEQ ID NO: 30132

SEQ ID NO: 393646 - protein, 7 aa, Mycobacterium
ARATGKS

SEQ ID NO: 393647 - protein, 4 aa, Mycobacterium
ARAV

SEQ ID NO: 393648 - protein, 5 aa, Mycobacterium
ARDAT

SEQ ID NO: 393649 - protein, 9 aa, Mycobacterium
ARDDLKTPF

SEQ ID NO: 393650 - protein, 4 aa, Mycobacterium
ARDE

SEQ ID NO: 393651 - protein, 5 aa, Mycobacterium
ARDGQ

SEQ ID NO: 393652 - protein, 5 aa, Mycobacterium
ARDHR

SEQ ID NO: 393653 - protein, 4 aa, Mycobacterium
ARDI

SEQ ID NO: 393654 - protein, 14 aa, Mycobacterium
ARDIATNAVEKASD

SEQ ID NO: 393655 - protein, 4 aa, Mycobacterium
ARDL

SEQ ID NO: 393656 - protein, 6 aa, Mycobacterium
ARDPGR

SEQ ID NO: 393657 - protein, 9 aa, Mycobacterium
ARDSSDPRP

SEQ ID NO: 393658 - protein, 18 aa, Mycobacterium
ARDTATVGGMASTNAGGL

SEQ ID NO: 393659 - protein, 4 aa, Mycobacterium
ARDV

SEQ ID NO: 393660 - protein, 6 aa, Mycobacterium
ARDVTG

SEQ ID NO: 393661 - protein, 10 aa, Mycobacterium
AREAGEPMAE

SEQ ID NO: 393662 - protein, 13 aa, Mycobacterium
AREAGVSLPGPGG

SEQ ID NO: 393663 - protein, 7 aa, Mycobacterium
AREDARA

SEQ ID NO: 393664 - protein, 11 aa, Mycobacterium
AREEREGESLD

SEQ ID NO: 393665 - protein, 7 aa, Mycobacterium
AREGGLS

SEQ ID NO: 393666 - protein, 7 aa, Mycobacterium
AREGQSV

SEQ ID NO: 393667 - protein, 6 aa, Mycobacterium
AREHGG

SEQ ID NO: 393668 - protein, 7 aa, Mycobacterium
AREHGGG

SEQ ID NO: 393669 - protein, 4 aa, Mycobacterium
AREL

SEQ ID NO: 393670 - protein, 5 aa, Mycobacterium
AREPD

SEQ ID NO: 393671 - protein, 11 aa, Mycobacterium
ARERDPAAPTT

SEQ ID NO: 393672 - protein, 4 aa, Mycobacterium
ARET

SEQ ID NO: 393673 - protein, 5 aa, Mycobacterium
ARETG

SEQ ID NO: 393674 - protein, 8 aa, Mycobacterium
ARETGATP

SEQ ID NO: 393675 - protein, 5 aa, Mycobacterium
ARFGD

SEQ ID NO: 393676 - protein, 17 aa, Mycobacterium
ARGASSAASAASATVDA

SEQ ID NO: 393677 - protein, 7 aa, Mycobacterium
ARGDASA

SEQ ID NO: 393678 - protein, 5 aa, Mycobacterium
ARGDD

SEQ ID NO: 393679 - protein, 6 aa, Mycobacterium
ARGGGS

SEQ ID NO: 393680 - protein, 7 aa, Mycobacterium
ARGGQAA

SEQ ID NO: 393681 - protein, 6 aa, Mycobacterium
ARGGQT

SEQ ID NO: 393682 - protein, 6 aa, Mycobacterium
ARGIGR

SEQ ID NO: 393683 - protein, 4 aa, Mycobacterium
ARGN

SEQ ID NO: 393684 - protein, 6 aa, Mycobacterium
ARGPGN

SEQ ID NO: 393685 - protein, 10 aa, Mycobacterium
ARGRGPVSRA

SEQ ID NO: 393686 - protein, 4 aa, Mycobacterium
ARGS

SEQ ID NO: 393687 - protein, 4 aa, Mycobacterium
ARGT

SEQ ID NO: 393688 - protein, 13 aa, Mycobacterium
ARGTKYPDEVERE

SEQ ID NO: 393689 - protein, 11 aa, Mycobacterium
ARGYKDVRANT

SEQ ID NO: 393690 - protein, 11 aa, Mycobacterium
ARGYRGRPDLT

SEQ ID NO: 393691 - protein, 5 aa, Mycobacterium
ARHIT

SEQ ID NO: 393692 - protein, 6 aa, Mycobacterium
ARHPPV

SEQ ID NO: 393693 - protein, 6 aa, Mycobacterium
ARIQPE

SEQ ID NO: 393694 - protein, 4 aa, Mycobacterium
ARIS

SEQ ID NO: 393695 - protein, 5 aa, Mycobacterium
ARITE

SEQ ID NO: 393696 - protein, 9 aa, Mycobacterium
ARITTDEEI

SEQ ID NO: 393697 - protein, 16 aa, Mycobacterium
ARKAGTTVTHEDKGGR

SEQ ID NO: 393698 - protein, 9 aa, Mycobacterium
ARKDGAEAR

SEQ ID NO: 393699 - protein, 9 aa, Mycobacterium
ARKGKRARE

SEQ ID NO: 393700 - protein, 4 aa, Mycobacterium
ARLA

SEQ ID NO: 393701 - protein, 4 aa, Mycobacterium
ARMA

SEQ ID NO: 393702 - protein, 5 aa, Mycobacterium
ARMSP

SEQ ID NO: 393703 - protein, 4 aa, Mycobacterium
ARNA

SEQ ID NO: 393704 - protein, 5 aa, Mycobacterium
ARNDG

SEQ ID NO: 393705 - protein, 5 aa, Mycobacterium
ARNGY

SEQ ID NO: 393706 - protein, 7 aa, Mycobacterium
ARNKSSV

SEQ ID NO: 393707 - protein, 5 aa, Mycobacterium
ARNPV

SEQ ID NO: 393708 - protein, 4 aa, Mycobacterium
ARNR

SEQ ID NO: 393709 - protein, 6 aa, Mycobacterium
ARPADA

SEQ ID NO: 393710 - protein, 5 aa, Mycobacterium
ARPDR

SEQ ID NO: 393711 - protein, 5 aa, Mycobacterium
ARPER

SEQ ID NO: 393712 - protein, 4 aa, Mycobacterium
ARPF

SEQ ID NO: 393713 - protein, 5 aa, Mycobacterium
ARPGD

SEQ ID NO: 393714 - protein, 5 aa, Mycobacterium
ARPGE

SEQ ID NO: 393715 - protein, 5 aa, Mycobacterium
ARPGG

SEQ ID NO: 393716 - protein, 7 aa, Mycobacterium
ARPGGEC

SEQ ID NO: 393717 - protein, 12 aa, Mycobacterium
ARPGPPSSDYTR

SEQ ID NO: 393718 - protein, 14 aa, Mycobacterium
ARPGRTGAARSGPM

SEQ ID NO: 393719 - protein, 12 aa, Mycobacterium
ARPGTPLHDPGK

SEQ ID NO: 393720 - protein, 5 aa, Mycobacterium
ARPHQ

SEQ ID NO: 393721 - protein, 4 aa, Mycobacterium
ARPP

SEQ ID NO: 393722 - protein, 7 aa, Mycobacterium
ARPPHNW

SEQ ID NO: 393723 - protein, 6 aa, Mycobacterium
ARPQAT

SEQ ID NO: 393724 - protein, 9 aa, Mycobacterium
ARPRDDEPT

SEQ ID NO: 393725 - protein, 5 aa, Mycobacterium
ARPRL

SEQ ID NO: 393726 - protein, 4 aa, Mycobacterium
ARPT

SEQ ID NO: 393727 - protein, 6 aa, Mycobacterium
ARPYGV

SEQ ID NO: 393728 - protein, 6 aa, Mycobacterium
ARQGAA

SEQ ID NO: 393729 - protein, 12 aa, Mycobacterium
ARQGDPAPGGIG

SEQ ID NO: 393730 - protein, 5 aa, Mycobacterium
ARQGV

SEQ ID NO: 393731 - protein, 7 aa, Mycobacterium
ARQPAEV

SEQ ID NO: 393732 - protein, 4 aa, Mycobacterium
ARQQ

SEQ ID NO: 393733 - protein, 5 aa, Mycobacterium
ARQRV

SEQ ID NO: 393734 - protein, 8 aa, Mycobacterium
ARRAADAG

SEQ ID NO: 393735 - protein, 11 aa, Mycobacterium
ARRAAGPDAPE

SEQ ID NO: 393736 - protein, 6 aa, Mycobacterium
ARRAER

SEQ ID NO: 393737 - protein, 18 aa, Mycobacterium
ARRAGGRRRFDPRAYTPA

SEQ ID NO: 393738 - protein, 11 aa, Mycobacterium
ARRAGVSAAAP

SEQ ID NO: 393739 - protein, 5 aa, Mycobacterium
ARRAR

SEQ ID NO: 393740 - protein, 10 aa, Mycobacterium
ARRARAGKHR

SEQ ID NO: 393741 - protein, 4 aa, Mycobacterium
ARRD

SEQ ID NO: 393742 - protein, 8 aa, Mycobacterium
ARRDDAAR

SEQ ID NO: 393743 - protein, 9 aa, Mycobacterium
ARRDPAAAA

SEQ ID NO: 393744 - protein, 4 aa, Mycobacterium
ARRE

SEQ ID NO: 393745 - protein, 5 aa, Mycobacterium
ARREP

SEQ ID NO: 393746 - protein, 9 aa, Mycobacterium
ARREPADGE

SEQ ID NO: 393747 - protein, 9 aa, Mycobacterium
ARRGGTNPY

SEQ ID NO: 393748 - protein, 6 aa, Mycobacterium
ARRGRS

SEQ ID NO: 393749 - protein, 5 aa, Mycobacterium
ARRHG

SEQ ID NO: 393750 - protein, 4 aa, Mycobacterium
ARRL

SEQ ID NO: 393751 - protein, 5 aa, Mycobacterium
ARRNS

SEQ ID NO: 393752 - protein, 6 aa, Mycobacterium
ARRPEV

SEQ ID NO: 393753 - protein, 4 aa, Mycobacterium
ARRQ

SEQ ID NO: 393754 - protein, 4 aa, Mycobacterium
ARRR

SEQ ID NO: 393755 - protein, 5 aa, Mycobacterium
ARRRA

SEQ ID NO: 393756 - protein, 6 aa, Mycobacterium
ARRRGI

SEQ ID NO: 393757 - protein, 7 aa, Mycobacterium
ARRRQAR

SEQ ID NO: 393758 - protein, 13 aa, Mycobacterium
ARRRRGSAPPGPL

SEQ ID NO: 393759 - protein, 6 aa, Mycobacterium
ARRSAD

SEQ ID NO: 393760 - protein, 10 aa, Mycobacterium
ARRSGASWTD

SEQ ID NO: 393761 - protein, 9 aa, Mycobacterium
ARRSGDTGA

SEQ ID NO: 393762 - protein, 5 aa, Mycobacterium
ARRTG

SEQ ID NO: 393763 - protein, 8 aa, Mycobacterium
ARRTQSAG

SEQ ID NO: 393764 - protein, 4 aa, Mycobacterium
ARRV

SEQ ID NO: 393765 - protein, 7 aa, Mycobacterium
ARSAEDV

SEQ ID NO: 393766 - protein, 10 aa, Mycobacterium
ARSAKRAVKS

SEQ ID NO: 393767 - protein, 5 aa, Mycobacterium
ARSAP

SEQ ID NO: 393768 - protein, 5 aa, Mycobacterium
ARSDR

SEQ ID NO: 393769 - protein, 5 aa, Mycobacterium
ARSEL

SEQ ID NO: 393770 - protein, 10 aa, Mycobacterium
ARSESEGQRR

SEQ ID NO: 393771 - protein, 4 aa, Mycobacterium
ARSG

SEQ ID NO: 393772 - protein, 4 aa, Mycobacterium
ARSI

SEQ ID NO: 393773 - protein, 9 aa, Mycobacterium
ARSNDNGQN

SEQ ID NO: 393774 - protein, 7 aa, Mycobacterium
ARSPEAL

SEQ ID NO: 393775 - protein, 6 aa, Mycobacterium
ARSPIP

SEQ ID NO: 393776 - protein, 6 aa, Mycobacterium
ARSPKD

SEQ ID NO: 393777 - protein, 6 aa, Mycobacterium
ARSREI

SEQ ID NO: 393778 - protein, 10 aa, Mycobacterium
ARSSADRGTK

SEQ ID NO: 393779 - protein, 8 aa, Mycobacterium
ARSTPFTQ

SEQ ID NO: 393780 - protein, 4 aa, Mycobacterium
ARSV

SEQ ID NO: 393781 - protein, 5 aa, Mycobacterium
ARTAE

SEQ ID NO: 393782 - protein, 6 aa, Mycobacterium
ARTAEA

SEQ ID NO: 393783 - protein, 6 aa, Mycobacterium
ARTDGE

SEQ ID NO: 393784 - protein, 8 aa, Mycobacterium
ARTDGGGH

SEQ ID NO: 393785 - protein, 4 aa, Mycobacterium
ARTG

SEQ ID NO: 393786 - protein, 7 aa, Mycobacterium
ARTGDRD

SEQ ID NO: 393787 - protein, 5 aa, Mycobacterium
ARTGR

SEQ ID NO: 393788 - protein, 4 aa, Mycobacterium
ARTI

SEQ ID NO: 393789 - protein, 14 aa, Mycobacterium
ARTKETDLSVPTRQ

SEQ ID NO: 393790 - protein, 14 aa, Mycobacterium
ARTKETDLSVPTRR

SEQ ID NO: 393791 - protein, 13 aa, Mycobacterium
ARTLGTDAVDEAG

SEQ ID NO: 393792 - protein, 5 aa, Mycobacterium
ARTPA

SEQ ID NO: 393793 - protein, 5 aa, Mycobacterium
ARTPE

SEQ ID NO: 393794 - protein, 13 aa, Mycobacterium
ARTPEATAITDGD

SEQ ID NO: 393795 - protein, 5 aa, Mycobacterium
ARTPV

SEQ ID NO: 393796 - protein, 7 aa, Mycobacterium
ARTRSPI

SEQ ID NO: 393797 - protein, 7 aa, Mycobacterium
ARTSDVP

SEQ ID NO: 393798 - protein, 8 aa, Mycobacterium
ARTSGAIE

SEQ ID NO: 393799 - protein, 7 aa, Mycobacterium
ARTSKRT

SEQ ID NO: 393800 - protein, 9 aa, Mycobacterium
ARTSPARAA

SEQ ID NO: 393801 - protein, 6 aa, Mycobacterium
ARTSQF

SEQ ID NO: 393802 - protein, 6 aa, Mycobacterium
ARVSDQ

SEQ ID NO: 393803 - protein, 7 aa, Mycobacterium
ARYDEAT

SEQ ID NO: 393804 - protein, 5 aa, Mycobacterium
ARYEA

SEQ ID NO: 393805 - protein, 4 aa, Mycobacterium
ARYG

SEQ ID NO: 393806 - protein, 5 aa, Mycobacterium
ASAAA

SEQ ID NO: 393807 - protein, 8 aa, Mycobacterium
ASAAAEAR

SEQ ID NO: 393808 - protein, 5 aa, Mycobacterium
ASAAG

SEQ ID NO: 393809 - protein, 8 aa, Mycobacterium
ASAAGPDL

SEQ ID NO: 393810 - protein, 5 aa, Mycobacterium
ASAAT

SEQ ID NO: 393811 - protein, 4 aa, Mycobacterium
ASAD

SEQ ID NO: 393812 - protein, 10 aa, Mycobacterium
ASADPGRPTN

SEQ ID NO: 393813 - protein, 8 aa, Mycobacterium
ASADSRAI

SEQ ID NO: 393814 - protein, 5 aa, Mycobacterium
ASAEA

SEQ ID NO: 393815 - protein, 7 aa, Mycobacterium
ASAESRS

SEQ ID NO: 393816 - protein, 5 aa, Mycobacterium
ASAGG

SEQ ID NO: 393817 - protein, 6 aa, Mycobacterium
ASAGLS

SEQ ID NO: 393818 - protein, 9 aa, Mycobacterium
ASAIQQTAD

SEQ ID NO: 393819 - protein, 11 aa, Mycobacterium
ASAKQRLTDSV

SEQ ID NO: 393820 - protein, 4 aa, Mycobacterium
ASAL

SEQ ID NO: 393821 - protein, 4 aa, Mycobacterium
ASAP

SEQ ID NO: 393822 - protein, 11 aa, Mycobacterium
ASAPGGDSYAE

SEQ ID NO: 393823 - protein, 8 aa, Mycobacterium
ASAPSYRF

SEQ ID NO: 393824 - protein, 10 aa, Mycobacterium
ASAQAKAAES

SEQ ID NO: 393825 - protein, 6 aa, Mycobacterium
ASARGV

SEQ ID NO: 393826 - protein, 5 aa, Mycobacterium
ASARS

SEQ ID NO: 393827 - protein, 7 aa, Mycobacterium
ASARSGS

SEQ ID NO: 393828 - protein, 9 aa, Mycobacterium
ASASGQHVP

SEQ ID NO: 393829 - protein, 8 aa, Mycobacterium
ASASTQIS

SEQ ID NO: 393830 - protein, 8 aa, Mycobacterium
ASATNLPR

SEQ ID NO: 393831 - protein, 8 aa, Mycobacterium
ASATTGLP

SEQ ID NO: 393832 - protein, 4 aa, Mycobacterium
ASDA

SEQ ID NO: 393833 - protein, 9 aa, Mycobacterium
ASDGEFGTD

SEQ ID NO: 393834 - protein, 7 aa, Mycobacterium
ASDGVGA

SEQ ID NO: 393835 - protein, 4 aa, Mycobacterium
ASDN

SEQ ID NO: 393836 - protein, 7 aa, Mycobacterium
ASDPARE

SEQ ID NO: 393837 - protein, 7 aa, Mycobacterium
ASDPARL

SEQ ID NO: 393838 - protein, 6 aa, Mycobacterium
ASDPNR

SEQ ID NO: 393839 - protein, 9 aa, Mycobacterium
ASDPQSKGI

SEQ ID NO: 393840 - protein, 6 aa, Mycobacterium
ASDPTV

SEQ ID NO: 393841 - protein, 8 aa, Mycobacterium
ASDQDVTD

SEQ ID NO: 393842 - protein, 4 aa, Mycobacterium
ASDR

SEQ ID NO: 393843 - protein, 6 aa, Mycobacterium
ASDSVP

SEQ ID NO: 393844 - protein, 5 aa, Mycobacterium
ASEDR

SEQ ID NO: 393845 - protein, 7 aa, Mycobacterium
ASEEGRA

SEQ ID NO: 393846 - protein, 5 aa, Mycobacterium
ASEGA

SEQ ID NO: 393847 - protein, 5 aa, Mycobacterium
ASEPA

SEQ ID NO: 393848 - protein, 7 aa, Mycobacterium
ASEQPAS

SEQ ID NO: 393849 - protein, 10 aa, Mycobacterium
ASESERIGRP

SEQ ID NO: 393850 - protein, 8 aa, Mycobacterium
ASEYEING

SEQ ID NO: 393851 - protein, 6 aa, Mycobacterium
ASFTAK

SEQ ID NO: 393852 - protein, 5 aa, Mycobacterium
ASGAA

SEQ ID NO: 393853 - protein, 11 aa, Mycobacterium
ASGAERDEDGS

SEQ ID NO: 393854 - protein, 10 aa, Mycobacterium
ASGATTPADA

SEQ ID NO: 393855 - protein, 9 aa, Mycobacterium
ASGEDPQRL

SEQ ID NO: 393856 - protein, 9 aa, Mycobacterium
ASGEDPRRL

SEQ ID NO: 393857 - protein, 8 aa, Mycobacterium
ASGEETRQ

SEQ ID NO: 393858 - protein, 6 aa, Mycobacterium
ASGELD

SEQ ID NO: 393859 - protein, 5 aa, Mycobacterium
ASGGG

SEQ ID NO: 393860 - protein, 6 aa, Mycobacterium
ASGIGL

SEQ ID NO: 393861 - protein, 6 aa, Mycobacterium
ASGIGS

SEQ ID NO: 393862 - protein, 5 aa, Mycobacterium
ASGIP

SEQ ID NO: 393863 - protein, 10 aa, Mycobacterium
ASGIPKAGGV

SEQ ID NO: 393864 - protein, 4 aa, Mycobacterium
ASGL

SEQ ID NO: 393865 - protein, 7 aa, Mycobacterium
ASGLGQP

SEQ ID NO: 393866 - protein, 7 aa, Mycobacterium
ASGMGRA

SEQ ID NO: 393867 - protein, 8 aa, Mycobacterium
ASGMGRAS

SEQ ID NO: 393868 - protein, 8 aa, Mycobacterium
ASGNVEGD

SEQ ID NO: 393869 - protein, 11 aa, Mycobacterium
ASGPVPPFDPQ

SEQ ID NO: 393870 - protein, 11 aa, Mycobacterium
ASGPWSGPASV

SEQ ID NO: 393871 - protein, 5 aa, Mycobacterium
ASGQT

SEQ ID NO: 393872 - protein, 9 aa, Mycobacterium
ASGRPARHL

SEQ ID NO: 393873 - protein, 8 aa, Mycobacterium
ASGRRRTQ

SEQ ID NO: 393874 - protein, 8 aa, Mycobacterium
ASGSRMRP

SEQ ID NO: 393875 - protein, 4 aa, Mycobacterium
ASGT

SEQ ID NO: 393876 - protein, 6 aa, Mycobacterium
ASGTFT

SEQ ID NO: 393877 - protein, 6 aa, Mycobacterium
ASGTGR

SEQ ID NO: 393878 - protein, 5 aa, Mycobacterium
ASGTV

SEQ ID NO: 393879 - protein, 5 aa, Mycobacterium
ASGVP

SEQ ID NO: 393880 - protein, 6 aa, Mycobacterium
ASGVPR

SEQ ID NO: 393881 - protein, 7 aa, Mycobacterium
ASHDQSL

SEQ ID NO: 393882 - protein, 7 aa, Mycobacterium
ASHEESA

SEQ ID NO: 393883 - protein, 10 aa, Mycobacterium
ASHPFGQAPA

SEQ ID NO: 393884 - protein, 5 aa, Mycobacterium
ASIEA

SEQ ID NO: 393885 - protein, 7 aa, Mycobacterium
ASISGAE

SEQ ID NO: 393886 - protein, 9 aa, Mycobacterium
ASISSQSEL

SEQ ID NO: 393887 - protein, 7 aa, Mycobacterium
ASKAVPA

SEQ ID NO: 393888 - protein, 8 aa, Mycobacterium
ASKAYGPD

SEQ ID NO: 393889 - protein, 7 aa, Mycobacterium
ASKGKWD

SEQ ID NO: 393890 - protein, 4 aa, Mycobacterium
ASLD

SEQ ID NO: 393891 - protein, 6 aa, Mycobacterium
ASLEAE

SEQ ID NO: 393892 - protein, 9 aa, Mycobacterium
ASLEKGPRL

SEQ ID NO: 393893 - protein, 16 aa, Mycobacterium
ASLNEATSDADGFHRR

SEQ ID NO: 393894 - protein, 4 aa, Mycobacterium
ASLP

SEQ ID NO: 393895 - protein, 5 aa, Mycobacterium
ASLPA

SEQ ID NO: 393896 - protein, 7 aa, Mycobacterium
ASLPEEA

SEQ ID NO: 393897 - protein, 5 aa, Mycobacterium
ASLQR

SEQ ID NO: 393898 - protein, 7 aa, Mycobacterium
ASLRDRE

SEQ ID NO: 393899 - protein, 7 aa, Mycobacterium
ASLRPRS

SEQ ID NO: 393900 - protein, 7 aa, Mycobacterium
ASLSDDE

SEQ ID NO: 393901 - protein, 6 aa, Mycobacterium
ASLSDF

SEQ ID NO: 393902 - protein, 8 aa, Mycobacterium
ASLSGDEA

SEQ ID NO: 393903 - protein, 13 aa, Mycobacterium
ASNGGVARGVPTG

SEQ ID NO: 393904 - protein, 6 aa, Mycobacterium
ASNNPM

SEQ ID NO: 393905 - protein, 6 aa, Mycobacterium
ASPDTV

SEQ ID NO: 393906 - protein, 4 aa, Mycobacterium
ASPE

SEQ ID NO: 393907 - protein, 4 aa, Mycobacterium
ASPG

SEQ ID NO: 393908 - protein, 5 aa, Mycobacterium
ASPGA

SEQ ID NO: 393909 - protein, 15 aa, Mycobacterium
ASPGGTGAAKFGGNY

SEQ ID NO: 393910 - protein, 4 aa, Mycobacterium
ASPL

SEQ ID NO: 393911 - protein, 6 aa, Mycobacterium
ASPNAL

SEQ ID NO: 393912 - protein, 9 aa, Mycobacterium
ASPNGARRA

SEQ ID NO: 393913 - protein, 6 aa, Mycobacterium
ASPPEL

SEQ ID NO: 393914 - protein, 5 aa, Mycobacterium
ASPSA

SEQ ID NO: 393915 - protein, 6 aa, Mycobacterium
ASPSLR

SEQ ID NO: 393916 - protein, 10 aa, Mycobacterium
ASQAAPGLEL

SEQ ID NO: 393917 - protein, 6 aa, Mycobacterium
ASQGRP

SEQ ID NO: 393918 - protein, 17 aa, Mycobacterium
ASQSDAPVGAPRQFGST

SEQ ID NO: 393919 - protein, 5 aa, Mycobacterium
ASQTE

SEQ ID NO: 393920 - protein, 5 aa, Mycobacterium
ASRAA

SEQ ID NO: 393921 - protein, 9 aa, Mycobacterium
ASRAALDRG

SEQ ID NO: 393922 - protein, 4 aa, Mycobacterium
ASRD

SEQ ID NO: 393923 - protein, 13 aa, Mycobacterium
ASRDNAAKALRSG

SEQ ID NO: 393924 - protein, 6 aa, Mycobacterium
ASRELP

SEQ ID NO: 393925 - protein, 9 aa, Mycobacterium
ASRENAAAA

SEQ ID NO: 393926 - protein, 5 aa, Mycobacterium
ASRFD

SEQ ID NO: 393927 - protein, 5 aa, Mycobacterium
ASRGA

SEQ ID NO: 393928 - protein, 7 aa, Mycobacterium
ASRGGIR

SEQ ID NO: 393929 - protein, 5 aa, Mycobacterium
ASRGI

SEQ ID NO: 393930 - protein, 7 aa, Mycobacterium
ASRPLQV

SEQ ID NO: 393931 - protein, 7 aa, Mycobacterium
ASRQGAQ

SEQ ID NO: 393932 - protein, 10 aa, Mycobacterium
ASRREHPTED

SEQ ID NO: 393933 - protein, 5 aa, Mycobacterium
ASRRG

SEQ ID NO: 393934 - protein, 6 aa, Mycobacterium
ASRRGA

SEQ ID NO: 393935 - protein, 5 aa, Mycobacterium
ASRRR

SEQ ID NO: 393936 - protein, 4 aa, Mycobacterium
ASRS

SEQ ID NO: 393937 - protein, 6 aa, Mycobacterium
ASRVGT

SEQ ID NO: 393938 - protein, 16 aa, Mycobacterium
ASSFTTGSILRADGGI

SEQ ID NO: 393939 - protein, 7 aa, Mycobacterium
ASSGIGA

SEQ ID NO: 393940 - protein, 10 aa, Mycobacterium
ASSGIGEAAA

SEQ ID NO: 393941 - protein, 6 aa, Mycobacterium
ASSGYK

SEQ ID NO: 393942 - protein, 8 aa, Mycobacterium
ASSIKAPI

SEQ ID NO: 393943 - protein, 4 aa, Mycobacterium
ASSR

SEQ ID NO: 393944 - protein, 5 aa, Mycobacterium
ASSRI

SEQ ID NO: 393945 - protein, 7 aa, Mycobacterium
ASSRLEE

SEQ ID NO: 393946 - protein, 8 aa, Mycobacterium
ASSSGRST

SEQ ID NO: 393947 - protein, 7 aa, Mycobacterium
ASSSRDV

SEQ ID NO: 393948 - protein, 7 aa, Mycobacterium
ASSSSSF

SEQ ID NO: 393949 - protein, 4 aa, Mycobacterium
ASST

SEQ ID NO: 393950 - protein, 5 aa, Mycobacterium
ASSVA

SEQ ID NO: 393951 - protein, 6 aa, Mycobacterium
ASSVDE

SEQ ID NO: 393952 - protein, 4 aa, Mycobacterium
ASTA

SEQ ID NO: 393953 - protein, 6 aa, Mycobacterium
ASTAQW

SEQ ID NO: 393954 - protein, 6 aa, Mycobacterium
ASTDPV

SEQ ID NO: 393955 - protein, 6 aa, Mycobacterium
ASTEEM

SEQ ID NO: 393956 - protein, 7 aa, Mycobacterium
ASTEGGV

SEQ ID NO: 393957 - protein, 10 aa, Mycobacterium
ASTEVRADST

SEQ ID NO: 393958 - protein, 7 aa, Mycobacterium
ASTGAGA

SEQ ID NO: 393959 - protein, 7 aa, Mycobacterium
ASTHESN

SEQ ID NO: 393960 - protein, 7 aa, Mycobacterium
ASTKDRF

SEQ ID NO: 393961 - protein, 14 aa, Mycobacterium
ASTLDDKHPRENAE

SEQ ID NO: 393962 - protein, 10 aa, Mycobacterium
ASTPESLTAT

SEQ ID NO: 393963 - protein, 8 aa, Mycobacterium
ASTPLDRS

SEQ ID NO: 393964 - protein, 4 aa, Mycobacterium
ASTR

SEQ ID NO: 393965 - protein, 7 aa, Mycobacterium
ASTSPSK

SEQ ID NO: 393966 - protein, 7 aa, Mycobacterium
ASTSSDH

SEQ ID NO: 393967 - protein, 9 aa, Mycobacterium
ASTTPTHRA

SEQ ID NO: 393968 - protein, 4 aa, Mycobacterium
ASTV

SEQ ID NO: 393969 - protein, 5 aa, Mycobacterium
ASTVT

SEQ ID NO: 393970 - protein, 4 aa, Mycobacterium
ASTY

SEQ ID NO: 393971 - protein, 10 aa, Mycobacterium
ASVANTGQVA

SEQ ID NO: 393972 - protein, 6 aa, Mycobacterium
ASVAPG

SEQ ID NO: 393973 - protein, 4 aa, Mycobacterium
ASVP

SEQ ID NO: 393974 - protein, 4 aa, Mycobacterium
ASVR

SEQ ID NO: 393975 - protein, 13 aa, Mycobacterium
ASYAPRSGGSAAL

SEQ ID NO: 393976 - protein, 12 aa, Mycobacterium
ASYAPRSGGTAA

SEQ ID NO: 393977 - protein, 13 aa, Mycobacterium
ASYGAEYQHESTS

SEQ ID NO: 393978 - protein, 6 aa, Mycobacterium
ASYGGA

SEQ ID NO: 393979 - protein, 4 aa, Mycobacterium
ASYI

SEQ ID NO: 393980 - protein, 10 aa, Mycobacterium
ASYNEQTKEI

SEQ ID NO: 393981 - protein, 4 aa, Mycobacterium
ASYY

SEQ ID NO: 393982 - protein, 5 aa, Mycobacterium
ATAAE

SEQ ID NO: 393983 - protein, 6 aa, Mycobacterium
ATAAGT

SEQ ID NO: 393984 - protein, 5 aa, Mycobacterium
ATAAI

SEQ ID NO: 393985 - protein, 15 aa, Mycobacterium
ATAAIGAGRYQRTDG

SEQ ID NO: 393986 - protein, 5 aa, Mycobacterium
ATADG

SEQ ID NO: 393987 - protein, 8 aa, Mycobacterium
ATADTASR

SEQ ID NO: 393988 - protein, 6 aa, Mycobacterium
ATADTD

SEQ ID NO: 393989 - protein, 7 aa, Mycobacterium
ATADTSM

SEQ ID NO: 393990 - protein, 6 aa, Mycobacterium
ATAEEV

SEQ ID NO: 393991 - protein, 6 aa, Mycobacterium
ATAELS

SEQ ID NO: 393992 - protein, 6 aa, Mycobacterium
ATAETF

SEQ ID NO: 393993 - protein, 5 aa, Mycobacterium
ATAGR

SEQ ID NO: 393994 - protein, 5 aa, Mycobacterium
ATAKS

SEQ ID NO: 393995 - protein, 8 aa, Mycobacterium
ATAPGATL

SEQ ID NO: 393996 - protein, 7 aa, Mycobacterium
ATAQNSI

SEQ ID NO: 393997 - protein, 7 aa, Mycobacterium
ATAQRPD

SEQ ID NO: 393998 - protein, 5 aa, Mycobacterium
ATAQS

SEQ ID NO: 393999 - protein, 8 aa, Mycobacterium
ATARDGGY

SEQ ID NO: 394000 - protein, 7 aa, Mycobacterium
ATAREEL

SEQ ID NO: 394001 - protein, 6 aa, Mycobacterium
ATARPL

SEQ ID NO: 394002 - protein, 8 aa, Mycobacterium
ATASGRRF

SEQ ID NO: 394003 - protein, 10 aa, Mycobacterium
ATASPSPHRH

SEQ ID NO: 394004 - protein, 6 aa, Mycobacterium
ATATEI

SEQ ID NO: 394005 - protein, 6 aa, Mycobacterium
ATATGL

SEQ ID NO: 394006 - protein, 7 aa, Mycobacterium
ATATGLP

SEQ ID NO: 394007 - protein, 6 aa, Mycobacterium
ATATGY

SEQ ID NO: 394008 - protein, 6 aa, Mycobacterium
ATATNL

SEQ ID NO: 394009 - protein, 8 aa, Mycobacterium
ATATNPAF

SEQ ID NO: 394010 - protein, 13 aa, Mycobacterium
ATCSGADKPRYGN

SEQ ID NO: 394011 - protein, 9 aa, Mycobacterium
ATDAALSET

SEQ ID NO: 394012 - protein, 5 aa, Mycobacterium
ATDAF

SEQ ID NO: 394013 - protein, 5 aa, Mycobacterium
ATDHI

SEQ ID NO: 394014 - protein, 6 aa, Mycobacterium
ATDNPI

SEQ ID NO: 394015 - protein, 7 aa, Mycobacterium
ATDNPVG

SEQ ID NO: 394016 - protein, 9 aa, Mycobacterium
ATDPANPYG

SEQ ID NO: 394017 - protein, 6 aa, Mycobacterium
ATDPAR

SEQ ID NO: 394018 - protein, 10 aa, Mycobacterium
ATDPDPRRRF

SEQ ID NO: 394019 - protein, 5 aa, Mycobacterium
ATDPR

SEQ ID NO: 394020 - protein, 9 aa, Mycobacterium
ATDPVSRQT

SEQ ID NO: 394021 - protein, 5 aa, Mycobacterium
ATDRG

SEQ ID NO: 394022 - protein, 10 aa, Mycobacterium
ATDRTGALSP

SEQ ID NO: 394023 - protein, 4 aa, Mycobacterium
ATDT

SEQ ID NO: 394024 - protein, 8 aa, Mycobacterium
ATDTRESL

SEQ ID NO: 394025 - protein, 15 aa, Mycobacterium
ATDTRPDELKTQGVR

SEQ ID NO: 394026 - protein, 9 aa, Mycobacterium
ATEAGRHSG

SEQ ID NO: 394027 - protein, 10 aa, Mycobacterium
ATEAYPSRTD

SEQ ID NO: 394028 - protein, 9 aa, Mycobacterium
ATEDQSEGM

SEQ ID NO: 394029 - protein, 4 aa, Mycobacterium
ATEE

SEQ ID NO: 394030 - protein, 4 aa, Mycobacterium
ATEF

SEQ ID NO: 394031 - protein, 7 aa, Mycobacterium
ATEGADG

SEQ ID NO: 394032 - protein, 8 aa, Mycobacterium
ATEGADGI

SEQ ID NO: 394033 - protein, 8 aa, Mycobacterium
ATELGEKG

SEQ ID NO: 394034 - protein, 4 aa, Mycobacterium
ATEP

SEQ ID NO: 394035 - protein, 5 aa, Mycobacterium
ATEPA

SEQ ID NO: 394036 - protein, 6 aa, Mycobacterium
ATEPAL

SEQ ID NO: 394037 - protein, 10 aa, Mycobacterium
ATEPLTKTTI

SEQ ID NO: 394038 - protein, 4 aa, Mycobacterium
ATEQ

SEQ ID NO: 394039 - protein, 7 aa, Mycobacterium
ATESLRR

SEQ ID NO: 394040 - protein, 13 aa, Mycobacterium
ATESTPDANGISR

SEQ ID NO: 394041 - protein, 4 aa, Mycobacterium
ATEY

SEQ ID NO: 394042 - protein, 5 aa, Mycobacterium
ATFDR

SEQ ID NO: 394043 - protein, 4 aa, Mycobacterium
ATFT

SEQ ID NO: 394044 - protein, 8 aa, Mycobacterium
ATGAERAE

SEQ ID NO: 394045 - protein, 10 aa, Mycobacterium
ATGAKEAPFT

SEQ ID NO: 394046 - protein, 5 aa, Mycobacterium
ATGAT

SEQ ID NO: 394047 - protein, 6 aa, Mycobacterium
ATGDDR

SEQ ID NO: 394048 - protein, 5 aa, Mycobacterium
ATGDL

SEQ ID NO: 394049 - protein, 6 aa, Mycobacterium
ATGDQH

SEQ ID NO: 394050 - protein, 10 aa, Mycobacterium
ATGDRTKRNA

SEQ ID NO: 394051 - protein, 9 aa, Mycobacterium
ATGEDTVKG

SEQ ID NO: 394052 - protein, 6 aa, Mycobacterium
ATGELD

SEQ ID NO: 394053 - protein, 5 aa, Mycobacterium
ATGEP

SEQ ID NO: 394054 - protein, 6 aa, Mycobacterium
ATGERP

SEQ ID NO: 394055 - protein, 5 aa, Mycobacterium
ATGKE

SEQ ID NO: 394056 - protein, 4 aa, Mycobacterium
ATGL

SEQ ID NO: 394057 - protein, 15 aa, Mycobacterium
ATGMGAAAAKSAAEL

SEQ ID NO: 394058 - protein, 21 aa, Mycobacterium
ATGMIGDPRDVGERTLNEADT

SEQ ID NO: 394059 - protein, 5 aa, Mycobacterium
ATGNK

SEQ ID NO: 394060 - protein, 7 aa, Mycobacterium
ATGPALG

SEQ ID NO: 394061 - protein, 7 aa, Mycobacterium
ATGPDAQ

SEQ ID NO: 394062 - protein, 5 aa, Mycobacterium
ATGQL

SEQ ID NO: 394063 - protein, 5 aa, Mycobacterium
ATGQR

SEQ ID NO: 394064 - protein, 12 aa, Mycobacterium
ATGRLSSTEPNL

SEQ ID NO: 394065 - protein, 5 aa, Mycobacterium
ATGRP

SEQ ID NO: 394066 - protein, 5 aa, Mycobacterium
ATGRR

SEQ ID NO: 394067 - protein, 4 aa, Mycobacterium
ATGS

SEQ ID NO: 394068 - protein, 5 aa, Mycobacterium
ATGTS

SEQ ID NO: 394069 - protein, 9 aa, Mycobacterium
ATGTSGYQA

SEQ ID NO: 394070 - protein, 6 aa, Mycobacterium
ATGTVH

SEQ ID NO: 394071 - protein, 7 aa, Mycobacterium
ATGVPRA

SEQ ID NO: 394072 - protein, 7 aa, Mycobacterium
ATHEEST

SEQ ID NO: 394073 - protein, 5 aa, Mycobacterium
ATHGS

SEQ ID NO: 394074 - protein, 21 aa, Mycobacterium
ATHTRSDRESVKGRLSGRTQE

SEQ ID NO: 394075 - protein, 21 aa, Mycobacterium
ATHTRSDRESVKGRVGGRTQE

SEQ ID NO: 394076 - protein, 9 aa, Mycobacterium
ATIASGAYQ

SEQ ID NO: 394077 - protein, 10 aa, Mycobacterium
ATIDNGSFGT

SEQ ID NO: 394078 - protein, 7 aa, Mycobacterium
ATIGNAD

SEQ ID NO: 394079 - protein, 4 aa, Mycobacterium
ATIP

SEQ ID NO: 394080 - protein, 12 aa, Mycobacterium
ATKAALGDHDEN

SEQ ID NO: 394081 - protein, 6 aa, Mycobacterium
ATKAGI

SEQ ID NO: 394082 - protein, 13 aa, Mycobacterium
ATKATRPEVRGGL

SEQ ID NO: 394083 - protein, 5 aa, Mycobacterium
ATKDG

SEQ ID NO: 394084 - protein, 4 aa, Mycobacterium
ATKG

SEQ ID NO: 394085 - protein, 7 aa, Mycobacterium
ATKPDRL

SEQ ID NO: 394086 - protein, 6 aa, Mycobacterium
ATKRGA

SEQ ID NO: 394087 - protein, 8 aa, Mycobacterium
ATLEDPVG

SEQ ID NO: 394088 - protein, 15 aa, Mycobacterium
ATLPSGEYRQISGNT

SEQ ID NO: 394089 - protein, 5 aa, Mycobacterium
ATLSP

SEQ ID NO: 394090 - protein, 13 aa, Mycobacterium
ATLTGSEPAGQSV

SEQ ID NO: 394091 - protein, 6 aa, Mycobacterium
ATMGPG

SEQ ID NO: 394092 - protein, 10 aa, Mycobacterium
ATNAEGANMD

SEQ ID NO: 394093 - protein, 5 aa, Mycobacterium
ATNAG

SEQ ID NO: 394094 - protein, 5 aa, Mycobacterium
ATNDV

SEQ ID NO: 394095 - protein, 17 aa, Mycobacterium
ATNGAQALDRAREARPD

SEQ ID NO: 394096 - protein, 5 aa, Mycobacterium
ATNRY

SEQ ID NO: 394097 - protein, 4 aa, Mycobacterium
ATNT

SEQ ID NO: 394098 - protein, 5 aa, Mycobacterium
ATPAE

SEQ ID NO: 394099 - protein, 5 aa, Mycobacterium
ATPAG

SEQ ID NO: 394100 - protein, 6 aa, Mycobacterium
ATPAHA

SEQ ID NO: 394101 - protein, 4 aa, Mycobacterium
ATPD

SEQ ID NO: 394102 - protein, 5 aa, Mycobacterium
ATPDD

SEQ ID NO: 394103 - protein, 5 aa, Mycobacterium
ATPDL

SEQ ID NO: 394104 - protein, 7 aa, Mycobacterium
ATPEQTI

SEQ ID NO: 394105 - protein, 4 aa, Mycobacterium
ATPG

SEQ ID NO: 394106 - protein, 5 aa, Mycobacterium
ATPGG

SEQ ID NO: 394107 - protein, 14 aa, Mycobacterium
ATPGPYELSQSGGE

SEQ ID NO: 394108 - protein, 5 aa, Mycobacterium
ATPHA

SEQ ID NO: 394109 - protein, 18 aa, Mycobacterium
ATPIPAGLTDAQAAAVTT

SEQ ID NO: 394110 - protein, 12 aa, Mycobacterium
ATPIPTADPDLR

SEQ ID NO: 394111 - protein, 9 aa, Mycobacterium
ATPLRSGDQ

SEQ ID NO: 394112 - protein, 4 aa, Mycobacterium
ATPM

SEQ ID NO: 394113 - protein, 4 aa, Mycobacterium
ATPP

SEQ ID NO: 394114 - protein, 6 aa, Mycobacterium
ATPPDG

SEQ ID NO: 394115 - protein, 9 aa, Mycobacterium
ATPPGPGAH

SEQ ID NO: 394116 - protein, 5 aa, Mycobacterium
ATPPL

SEQ ID NO: 394117 - protein, 5 aa, Mycobacterium
ATPPS

SEQ ID NO: 394118 - protein, 14 aa, Mycobacterium
ATPQFGYESGYDRE

SEQ ID NO: 394119 - protein, 5 aa, Mycobacterium
ATPRQ

SEQ ID NO: 394120 - protein, 8 aa, Mycobacterium
ATPVPGRT

SEQ ID NO: 394121 - protein, 9 aa, Mycobacterium
ATPVSGKDA

SEQ ID NO: 394122 - protein, 5 aa, Mycobacterium
ATPYN

SEQ ID NO: 394123 - protein, 6 aa, Mycobacterium
ATQEST

SEQ ID NO: 394124 - protein, 5 aa, Mycobacterium
ATQHR

SEQ ID NO: 394125 - protein, 6 aa, Mycobacterium
ATQHRA

SEQ ID NO: 394126 - protein, 4 aa, Mycobacterium
ATQL

SEQ ID NO: 394127 - protein, 8 aa, Mycobacterium
ATQRTQFG

SEQ ID NO: 394128 - protein, 9 aa, Mycobacterium
ATQSAGRWS

SEQ ID NO: 394129 - protein, 6 aa, Mycobacterium
ATQSGL

SEQ ID NO: 394130 - protein, 6 aa, Mycobacterium
ATQTPD

SEQ ID NO: 394131 - protein, 14 aa, Mycobacterium
ATRADTAGDPATGT

SEQ ID NO: 394132 - protein, 9 aa, Mycobacterium
ATRAELESK

SEQ ID NO: 394133 - protein, 9 aa, Mycobacterium
ATRAEPDRV

SEQ ID NO: 394134 - protein, 4 aa, Mycobacterium
ATRD

SEQ ID NO: 394135 - protein, 6 aa, Mycobacterium
ATRDGD

SEQ ID NO: 394136 - protein, 5 aa, Mycobacterium
ATRDL

SEQ ID NO: 394137 - protein, 11 aa, Mycobacterium
ATREPEKFGMP

SEQ ID NO: 394138 - protein, 4 aa, Mycobacterium
ATRH

SEQ ID NO: 394139 - protein, 6 aa, Mycobacterium
ATRPGA

SEQ ID NO: 394140 - protein, 5 aa, Mycobacterium
ATRPL

SEQ ID NO: 394141 - protein, 4 aa, Mycobacterium
ATRQ

SEQ ID NO: 394142 - protein, 7 aa, Mycobacterium
ATRRTDI

SEQ ID NO: 394143 - protein, 5 aa, Mycobacterium
ATRRY

SEQ ID NO: 394144 - protein, 10 aa, Mycobacterium
ATRTAPSGRV

SEQ ID NO: 394145 - protein, 11 aa, Mycobacterium
ATRTIGVTPGS

SEQ ID NO: 394146 - protein, 5 aa, Mycobacterium
ATRTL

SEQ ID NO: 394147 - protein, 7 aa, Mycobacterium
ATRTPTI

SEQ ID NO: 394148 - protein, 17 aa, Mycobacterium
ATSAKGSISEDPGPDLA

SEQ ID NO: 394149 - protein, 6 aa, Mycobacterium
ATSEDL

SEQ ID NO: 394150 - protein, 7 aa, Mycobacterium
ATSGGGA

SEQ ID NO: 394151 - protein, 5 aa, Mycobacterium
ATSGI

SEQ ID NO: 394152 - protein, 4 aa, Mycobacterium
ATSH

SEQ ID NO: 394153 - protein, 8 aa, Mycobacterium
ATSNAGGL

SEQ ID NO: 394154 - protein, 14 aa, Mycobacterium
ATSNTLPEQLGEGR

SEQ ID NO: 394155 - protein, 5 aa, Mycobacterium
ATSPP

SEQ ID NO: 394156 - protein, 5 aa, Mycobacterium
ATSQG

SEQ ID NO: 394157 - protein, 13 aa, Mycobacterium
ATSQISYTASKGG

SEQ ID NO: 394158 - protein, 4 aa, Mycobacterium
ATSR

SEQ ID NO: 394159 - protein, 6 aa, Mycobacterium
ATSRDF

SEQ ID NO: 394160 - protein, 17 aa, Mycobacterium
ATSSDTVRSRSMTGKPA

SEQ ID NO: 394161 - protein, 8 aa, Mycobacterium
ATSSLGQA

SEQ ID NO: 394162 - protein, 8 aa, Mycobacterium
ATSSTQPI

SEQ ID NO: 394163 - protein, 5 aa, Mycobacterium
ATTAA

SEQ ID NO: 394164 - protein, 11 aa, Mycobacterium
ATTAAATPAEL

SEQ ID NO: 394165 - protein, 7 aa, Mycobacterium
ATTAELD

SEQ ID NO: 394166 - protein, 7 aa, Mycobacterium
ATTAGLP

SEQ ID NO: 394167 - protein, 9 aa, Mycobacterium
ATTDARNEE

SEQ ID NO: 394168 - protein, 6 aa, Mycobacterium
ATTDDF

SEQ ID NO: 394169 - protein, 8 aa, Mycobacterium
ATTDFSEA

SEQ ID NO: 394170 - protein, 6 aa, Mycobacterium
ATTDQP

SEQ ID NO: 394171 - protein, 11 aa, Mycobacterium
ATTDSPGATAA

SEQ ID NO: 394172 - protein, 13 aa, Mycobacterium
ATTDYAKGGLTDA

SEQ ID NO: 394173 - protein, 12 aa, Mycobacterium
ATTEDGERFSDE

SEQ ID NO: 394174 - protein, 6 aa, Mycobacterium
ATTHPI

SEQ ID NO: 394175 - protein, 4 aa, Mycobacterium
ATTI

SEQ ID NO: 394176 - protein, 8 aa, Mycobacterium
ATTPGQRH

SEQ ID NO: 394177 - protein, 7 aa, Mycobacterium
ATTRNGR

SEQ ID NO: 394178 - protein, 5 aa, Mycobacterium
ATTSA

SEQ ID NO: 394179 - protein, 6 aa, Mycobacterium
ATTTVY

SEQ ID NO: 394180 - protein, 4 aa, Mycobacterium
ATTY

SEQ ID NO: 394181 - protein, 5 aa, Mycobacterium
ATTYE

SEQ ID NO: 394182 - protein, 6 aa, Mycobacterium
ATVAAS

SEQ ID NO: 394183 - protein, 8 aa, Mycobacterium
ATVASGTI

SEQ ID NO: 394184 - protein, 8 aa, Mycobacterium
ATVEDPVG

SEQ ID NO: 394185 - protein, 10 aa, Mycobacterium
ATVGGTTAVS

SEQ ID NO: 394186 - protein, 6 aa, Mycobacterium
ATVGPD

SEQ ID NO: 394187 - protein, 7 aa, Mycobacterium
ATVNGAA

SEQ ID NO: 394188 - protein, 4 aa, Mycobacterium
ATVP

SEQ ID NO: 394189 - protein, 8 aa, Mycobacterium
ATVQQSGE

SEQ ID NO: 394190 - protein, 4 aa, Mycobacterium
ATVR

SEQ ID NO: 394191 - protein, 12 aa, Mycobacterium
ATVSPSAPSYED

SEQ ID NO: 394192 - protein, 16 aa, Mycobacterium
ATVTEEPPSTAASRYQ

SEQ ID NO: 394193 - protein, 12 aa, Mycobacterium
ATVTTGPADTTL

SEQ ID NO: 394194 - protein, 6 aa, Mycobacterium
ATYAAT

SEQ ID NO: 394195 - protein, 9 aa, Mycobacterium
ATYDGAGTN

SEQ ID NO: 394196 - protein, 10 aa, Mycobacterium
AVAPGVTTDE

SEQ ID NO: 394197 - protein, 4 aa, Mycobacterium
AVDA

SEQ ID NO: 394198 - protein, 6 aa, Mycobacterium
AVDADG

SEQ ID NO: 394199 - protein, 8 aa, Mycobacterium
AVDGGVEQ

SEQ ID NO: 394200 - protein, 6 aa, Mycobacterium
AVDNSA

SEQ ID NO: 394201 - protein, 4 aa, Mycobacterium
AVDP

SEQ ID NO: 394202 - protein, 4 aa, Mycobacterium
AVDR

SEQ ID NO: 394203 - protein, 5 aa, Mycobacterium
AVDRG

SEQ ID NO: 394204 - protein, 8 aa, Mycobacterium
AVDSGVEQ

SEQ ID NO: 394205 - protein, 6 aa, Mycobacterium
AVDTGA

SEQ ID NO: 394206 - protein, 10 aa, Mycobacterium
AVEDPAEREA

SEQ ID NO: 394207 - protein, 17 aa, Mycobacterium
AVEDQRDADLEARAQKL

SEQ ID NO: 394208 - protein, 6 aa, Mycobacterium
AVEEGS

SEQ ID NO: 394209 - protein, 10 aa, Mycobacterium
AVEKGLTTKP

SEQ ID NO: 394210 - protein, 4 aa, Mycobacterium
AVER

SEQ ID NO: 394211 - protein, 9 aa, Mycobacterium
AVESPGAEG

SEQ ID NO: 394212 - protein, 11 aa, Mycobacterium
AVGAQLGAAQG

SEQ ID NO: 394213 - protein, 4 aa, Mycobacterium
AVGD

SEQ ID NO: 394214 - protein, 7 aa, Mycobacterium
AVGESGR

SEQ ID NO: 394215 - protein, 6 aa, Mycobacterium
AVGGAA

SEQ ID NO: 394216 - protein, 7 aa, Mycobacterium
AVGGAKN

SEQ ID NO: 394217 - protein, 9 aa, Mycobacterium
AVGGTVGRY

SEQ ID NO: 394218 - protein, 9 aa, Mycobacterium
AVGKRNGAL

SEQ ID NO: 394219 - protein, 11 aa, Mycobacterium
AVGKRNGGLSG

SEQ ID NO: 394220 - protein, 14 aa, Mycobacterium
AVGPSSAVRTPGAA

SEQ ID NO: 394221 - protein, 4 aa, Mycobacterium
AVGQ

SEQ ID NO: 394222 - protein, 4 aa, Mycobacterium
AVHR

SEQ ID NO: 394223 - protein, 8 aa, Mycobacterium
AVKPSYGL

SEQ ID NO: 394224 - protein, 10 aa, Mycobacterium
AVNPGTVDAA

SEQ ID NO: 394225 - protein, 20 aa, Mycobacterium
AVNQDGASNGLSAPNGPAQQ

SEQ ID NO: 394226 - protein, 20 aa, Mycobacterium
AVNQDGASSGLTVPNGGAQQ

SEQ ID NO: 394227 - protein, 4 aa, Mycobacterium
AVPD

SEQ ID NO: 394228 - protein, 10 aa, Mycobacterium
AVPDGRSDTV

SEQ ID NO: 394229 - protein, 5 aa, Mycobacterium
AVPGC

SEQ ID NO: 394230 - protein, 4 aa, Mycobacterium
AVPH

SEQ ID NO: 394231 - protein, 6 aa, Mycobacterium
AVPIPY

SEQ ID NO: 394232 - protein, 11 aa, Mycobacterium
AVPKDGPSAGV

SEQ ID NO: 394233 - protein, 7 aa, Mycobacterium
AVPPDRL

SEQ ID NO: 394234 - protein, 17 aa, Mycobacterium
AVPQASGRGLGHTGGTL

SEQ ID NO: 394235 - protein, 6 aa, Mycobacterium
AVPQGL

SEQ ID NO: 394236 - protein, 6 aa, Mycobacterium
AVPRAA

SEQ ID NO: 394237 - protein, 4 aa, Mycobacterium
AVPS

SEQ ID NO: 394238 - protein, 8 aa, Mycobacterium
AVPTPGSL

SEQ ID NO: 394239 - protein, 7 aa, Mycobacterium
AVQGPNA

SEQ ID NO: 394240 - protein, 4 aa, Mycobacterium
AVRD

SEQ ID NO: 394241 - protein, 5 aa, Mycobacterium
AVRDA

SEQ ID NO: 394242 - protein, 8 aa, Mycobacterium
AVREADGS

SEQ ID NO: 394243 - protein, 8 aa, Mycobacterium
AVREGAGE

SEQ ID NO: 394244 - protein, 5 aa, Mycobacterium
AVRGE

SEQ ID NO: 394245 - protein, 5 aa, Mycobacterium
AVRPE

SEQ ID NO: 394246 - protein, 12 aa, Mycobacterium
AVRRRQERAAGR

SEQ ID NO: 394247 - protein, 9 aa, Mycobacterium
AVRTPSGYR

SEQ ID NO: 394248 - protein, 4 aa, Mycobacterium
AVSD

SEQ ID NO: 394249 - protein, 6 aa, Mycobacterium
AVSDGT

SEQ ID NO: 394250 - protein, 6 aa, Mycobacterium
AVSEPV

SEQ ID NO: 394251 - protein, 7 aa, Mycobacterium
AVSGSGP

SEQ ID NO: 394252 - protein, 7 aa, Mycobacterium
AVSPTTA

SEQ ID NO: 394253 - protein, 4 aa, Mycobacterium
AVTA

SEQ ID NO: 394254 - protein, 7 aa, Mycobacterium
AVTDTGV

SEQ ID NO: 394255 - protein, 4 aa, Mycobacterium
AVTG

SEQ ID NO: 394256 - protein, 7 aa, Mycobacterium
AVTGGPL

SEQ ID NO: 394257 - protein, 12 aa, Mycobacterium
AVTPEQAGAHPT

SEQ ID NO: 394258 - protein, 4 aa, Mycobacterium
AWEE

SEQ ID NO: 394259 - protein, 7 aa, Mycobacterium
AWGPRSS

SEQ ID NO: 394260 - protein, 10 aa, Mycobacterium
AWPGSSDRNF

SEQ ID NO: 394261 - protein, 6 aa, Mycobacterium
AWPPAG

SEQ ID NO: 394262 - protein, 5 aa, Mycobacterium
AWQAG

SEQ ID NO: 394263 - protein, 11 aa, Mycobacterium
AWTNDEAEQQR

SEQ ID NO: 394264 - protein, 4 aa, Mycobacterium
AYAD

SEQ ID NO: 394265 - protein, 6 aa, Mycobacterium
AYADAG

SEQ ID NO: 394266 - protein, 5 aa, Mycobacterium
AYAGA

SEQ ID NO: 394267 - protein, 13 aa, Mycobacterium
AYAGNQAQRIAIT

SEQ ID NO: 394268 - protein, 13 aa, Mycobacterium
AYARGGEKTPEGV

SEQ ID NO: 394269 - protein, 5 aa, Mycobacterium
AYDSP

SEQ ID NO: 394270 - protein, 11 aa, Mycobacterium
AYEAAGIGPED

SEQ ID NO: 394271 - protein, 10 aa, Mycobacterium
AYEDTGGDGP

SEQ ID NO: 394272 - protein, 6 aa, Mycobacterium
AYEENK

SEQ ID NO: 394273 - protein, 8 aa, Mycobacterium
AYEGPPGH

SEQ ID NO: 394274 - protein, 7 aa, Mycobacterium
AYEGPPK

SEQ ID NO: 394275 - protein, 17 aa, Mycobacterium
AYEPRRGPRLPVQQIHS

SEQ ID NO: 394276 - protein, 11 aa, Mycobacterium
AYGAQKAGVDK

SEQ ID NO: 394277 - protein, 5 aa, Mycobacterium
AYGEA

SEQ ID NO: 394278 - protein, 7 aa, Mycobacterium
AYGGSPV

SEQ ID NO: 394279 - protein, 6 aa, Mycobacterium
AYGIDG

SEQ ID NO: 394280 - protein, 4 aa, Mycobacterium
AYPA

SEQ ID NO: 394281 - protein, 5 aa, Mycobacterium
AYPDD

SEQ ID NO: 394282 - protein, 13 aa, Mycobacterium
AYPELPDAPTPDL

SEQ ID NO: 394283 - protein, 9 aa, Mycobacterium
AYPENPTER

SEQ ID NO: 394284 - protein, 4 aa, Mycobacterium
AYPG

SEQ ID NO: 394285 - protein, 9 aa, Mycobacterium
AYPGGFDKS

SEQ ID NO: 394286 - protein, 6 aa, Mycobacterium
AYPPRL

SEQ ID NO: 394287 - protein, 5 aa, Mycobacterium
AYPRN

SEQ ID NO: 394288 - protein, 5 aa, Mycobacterium
AYPTV

SEQ ID NO: 394289 - protein, 8 aa, Mycobacterium
AYQASKGA

SEQ ID NO: 394290 - protein, 7 aa, Mycobacterium
AYRRSKD

SEQ ID NO: 394291 - protein, 5 aa, Mycobacterium
AYSPR

SEQ ID NO: 394292 - protein, 15 aa, Mycobacterium
AYSSGNPALGVGPGN

SEQ ID NO: 394293 - protein, 10 aa, Mycobacterium
AYTASGLSRN

SEQ ID NO: 394294 - protein, 5 aa, Mycobacterium
AYTEA

SEQ ID NO: 394295 - protein, 4 aa, Mycobacterium
AYTP

SEQ ID NO: 394296 - protein, 17 aa, Mycobacterium
CAAGQAAVQSAAASVRA

SEQ ID NO: 394297 - protein, 7 aa, Mycobacterium
CAGTNAV

SEQ ID NO: 394298 - protein, 12 aa, Mycobacterium
CARTRGKSDPID

SEQ ID NO: 394299 - protein, 9 aa, Mycobacterium
CASGSEGIA

SEQ ID NO: 394300 - protein, 9 aa, Mycobacterium
CASGSEGVA

SEQ ID NO: 394301 - protein, 6 aa, Mycobacterium
CASGSV

SEQ ID NO: 394302 - protein, 6 aa, Mycobacterium
CCDGSS

SEQ ID NO: 394303 - protein, 12 aa, Mycobacterium
CDAATNPRPPRE

SEQ ID NO: 394304 - protein, 7 aa, Mycobacterium
CDDTRDS

SEQ ID NO: 394305 - protein, 4 aa, Mycobacterium
CDGE

SEQ ID NO: 394306 - protein, 5 aa, Mycobacterium
CDKGN

SEQ ID NO: 394307 - protein, 8 aa, Mycobacterium
CDKPADRC

SEQ ID NO: 394308 - protein, 6 aa, Mycobacterium
CDPEGT

SEQ ID NO: 394309 - protein, 4 aa, Mycobacterium
CEEL

SEQ ID NO: 394310 - protein, 4 aa, Mycobacterium
CEGG

SEQ ID NO: 394311 - protein, 9 aa, Mycobacterium
CEQRDDTRL

SEQ ID NO: 394312 - protein, 10 aa, Mycobacterium
CERRDPKGLY

SEQ ID NO: 394313 - protein, 5 aa, Mycobacterium
CESGT

SEQ ID NO: 394314 - protein, 20 aa, Mycobacterium
CGAAEGPYGFTGTSNSFASG

SEQ ID NO: 394315 - protein, 4 aa, Mycobacterium
CGAT

SEQ ID NO: 394316 - protein, 4 aa, Mycobacterium
CGEA

SEQ ID NO: 394317 - protein, 5 aa, Mycobacterium
CGEGA

SEQ ID NO: 394318 - protein, 6 aa, Mycobacterium
CGGAGA

SEQ ID NO: 394319 - protein, 6 aa, Mycobacterium
CGPHSG

SEQ ID NO: 394320 - protein, 7 aa, Mycobacterium
CGSDAAL

SEQ ID NO: 394321 - protein, 8 aa, Mycobacterium
CGSGFGTG

SEQ ID NO: 394322 - protein, 7 aa, Mycobacterium
CGSGQQA

SEQ ID NO: 394323 - protein, 9 aa, Mycobacterium
CGSGQQANG

SEQ ID NO: 394324 - protein, 10 aa, Mycobacterium
CGSSDSADIG

SEQ ID NO: 394325 - protein, 6 aa, Mycobacterium
CGTDAA

SEQ ID NO: 394326 - protein, 5 aa, Mycobacterium
CGTER

SEQ ID NO: 394327 - protein, 8 aa, Mycobacterium
CGTGASTA

SEQ ID NO: 394328 - protein, 4 aa, Mycobacterium
CGTP

SEQ ID NO: 394329 - protein, 7 aa, Mycobacterium
CGTPGAP

SEQ ID NO: 394330 - protein, 8 aa, Mycobacterium
CHEGGTSF

SEQ ID NO: 394331 - protein, 5 aa, Mycobacterium
CHGGP

SEQ ID NO: 394332 - protein, 5 aa, Mycobacterium
CHSTD

SEQ ID NO: 394333 - protein, 11 aa, Mycobacterium
CKGTGVTTRTR

SEQ ID NO: 394334 - protein, 5 aa, Mycobacterium
CLDDP

SEQ ID NO: 394335 - protein, 6 aa, Mycobacterium
CNPKSD

SEQ ID NO: 394336 - protein, 5 aa, Mycobacterium
CPAPG

SEQ ID NO: 394337 - protein, 11 aa, Mycobacterium
CPDAADPRPAV

SEQ ID NO: 394338 - protein, 5 aa, Mycobacterium
CPEHT

SEQ ID NO: 394339 - protein, 7 aa, Mycobacterium
CPEHTEK

SEQ ID NO: 394340 - protein, 7 aa, Mycobacterium
CPGGEFP

SEQ ID NO: 394341 - protein, 5 aa, Mycobacterium
CPKDK

SEQ ID NO: 394342 - protein, 4 aa, Mycobacterium
CPPG

SEQ ID NO: 394343 - protein, 4 aa, Mycobacterium
CPPV

SEQ ID NO: 394344 - protein, 5 aa, Mycobacterium
CPSDI

SEQ ID NO: 394345 - protein, 14 aa, Mycobacterium
CPTGAVTVNMPYLL

SEQ ID NO: 394346 - protein, 9 aa, Mycobacterium
CQGRDVDDD

SEQ ID NO: 394347 - protein, 13 aa, Mycobacterium
CQGTVEGRPDDGC

SEQ ID NO: 394348 - protein, 12 aa, Mycobacterium
CRGGAPGTRETD

SEQ ID NO: 394349 - protein, 6 aa, Mycobacterium
CRPAPN

SEQ ID NO: 394350 - protein, 8 aa, Mycobacterium
CRPESGTD

SEQ ID NO: 394351 - protein, 4 aa, Mycobacterium
CRPV

SEQ ID NO: 394352 - protein, 4 aa, Mycobacterium
CRTP

SEQ ID NO: 394353 - protein, 4 aa, Mycobacterium
CRTT

SEQ ID NO: 394354 - protein, 7 aa, Mycobacterium
CSASGDW

SEQ ID NO: 394355 - protein, 8 aa, Mycobacterium
CSGNGGFA

SEQ ID NO: 394356 - protein, 13 aa, Mycobacterium
CSPARSWSAPEAD

SEQ ID NO: 394357 - protein, 9 aa, Mycobacterium
CSTGPEDLG

SEQ ID NO: 394358 - protein, 6 aa, Mycobacterium
CTAEAD

SEQ ID NO: 394359 - protein, 8 aa, Mycobacterium
CTKSDTVD

SEQ ID NO: 394360 - protein, 4 aa, Mycobacterium
CTND

SEQ ID NO: 394361 - protein, 18 aa, Mycobacterium
CTPGYYNNEGGGGGEGIR

SEQ ID NO: 394362 - protein, 8 aa, Mycobacterium
CTPTTTGK

SEQ ID NO: 394363 - protein, 4 aa, Mycobacterium
CTSH

SEQ ID NO: 394364 - protein, 6 aa, Mycobacterium
CTSTGK

SEQ ID NO: 394365 - protein, 6 aa, Mycobacterium
DAAAAA

SEQ ID NO: 394366 - protein, 6 aa, Mycobacterium
DAAAGA

SEQ ID NO: 394367 - protein, 5 aa, Mycobacterium
DAAAR

SEQ ID NO: 394368 - protein, 5 aa, Mycobacterium
DAAAV

SEQ ID NO: 394369 - protein, 4 aa, Mycobacterium
DAAD

SEQ ID NO: 394370 - protein, 8 aa, Mycobacterium
DAADAGDR

SEQ ID NO: 394371 - protein, 7 aa, Mycobacterium
DAAERGE

SEQ ID NO: 394372 - protein, 6 aa, Mycobacterium
DAAGHT

SEQ ID NO: 394373 - protein, 7 aa, Mycobacterium
DAAGIEG

SEQ ID NO: 394374 - protein, 7 aa, Mycobacterium
DAAGQAA

SEQ ID NO: 394375 - protein, 6 aa, Mycobacterium
DAAGRG

SEQ ID NO: 394376 - protein, 6 aa, Mycobacterium
DAAGRR

SEQ ID NO: 394377 - protein, 7 aa, Mycobacterium
DAAGSTL

SEQ ID NO: 394378 - protein, 5 aa, Mycobacterium
DAAGY

SEQ ID NO: 394379 - protein, 10 aa, Mycobacterium
DAAPAEPTAA

SEQ ID NO: 394380 - protein, 7 aa, Mycobacterium
DAAPDDI

SEQ ID NO: 394381 - protein, 9 aa, Mycobacterium
DAAPDRARE

SEQ ID NO: 394382 - protein, 5 aa, Mycobacterium
DAARA

SEQ ID NO: 394383 - protein, 5 aa, Mycobacterium
DAARN

SEQ ID NO: 394384 - protein, 6 aa, Mycobacterium
DAARSA

SEQ ID NO: 394385 - protein, 8 aa, Mycobacterium
DAARTTYR

SEQ ID NO: 394386 - protein, 6 aa, Mycobacterium
DAATER

SEQ ID NO: 394387 - protein, 5 aa, Mycobacterium
DAATG

SEQ ID NO: 394388 - protein, 7 aa, Mycobacterium
DAATQKA

SEQ ID NO: 394389 - protein, 4 aa, Mycobacterium
DAAV

SEQ ID NO: 394390 - protein, 7 aa, Mycobacterium
DADAADK

SEQ ID NO: 394391 - protein, 10 aa, Mycobacterium
DADAPLGPGQ

SEQ ID NO: 394392 - protein, 5 aa, Mycobacterium
DADAT

SEQ ID NO: 394393 - protein, 6 aa, Mycobacterium
DADDDY

SEQ ID NO: 394394 - protein, 7 aa, Mycobacterium
DADGADA

SEQ ID NO: 394395 - protein, 5 aa, Mycobacterium
DADGR

SEQ ID NO: 394396 - protein, 8 aa, Mycobacterium
DADGSPAY

SEQ ID NO: 394397 - protein, 7 aa, Mycobacterium
DADHYEA

SEQ ID NO: 394398 - protein, 10 aa, Mycobacterium
DADPDGGNIN

SEQ ID NO: 394399 - protein, 5 aa, Mycobacterium
DADPR

SEQ ID NO: 394400 - protein, 4 aa, Mycobacterium
DADR

SEQ ID NO: 394401 - protein, 5 aa, Mycobacterium
DADSV

SEQ ID NO: 394402 - protein, 7 aa, Mycobacterium
DADTEEL

SEQ ID NO: 394403 - protein, 6 aa, Mycobacterium
DADTGT

SEQ ID NO: 394404 - protein, 7 aa, Mycobacterium
DADTIGA

SEQ ID NO: 394405 - protein, 9 aa, Mycobacterium
DAEAADKAG

SEQ ID NO: 394406 - protein, 8 aa, Mycobacterium
DAEDGPDA

SEQ ID NO: 394407 - protein, 9 aa, Mycobacterium
DAEETAAAD

SEQ ID NO: 394408 - protein, 4 aa, Mycobacterium
DAEH

SEQ ID NO: 394409 - protein, 4 aa, Mycobacterium
DAEN

SEQ ID NO: 394410 - protein, 5 aa, Mycobacterium
DAEPA

SEQ ID NO: 394411 - protein, 5 aa, Mycobacterium
DAEPH

SEQ ID NO: 394412 - protein, 6 aa, Mycobacterium
DAEPRH

SEQ ID NO: 394413 - protein, 7 aa, Mycobacterium
DAETAAT

SEQ ID NO: 394414 - protein, 6 aa, Mycobacterium
DAETRA

SEQ ID NO: 394415 - protein, 13 aa, Mycobacterium
DAFERDDPRGGEA

SEQ ID NO: 394416 - protein, 4 aa, Mycobacterium
DAFP

SEQ ID NO: 394417 - protein, 8 aa, Mycobacterium
DAGAEPGG

SEQ ID NO: 394418 - protein, 7 aa, Mycobacterium
DAGAQDA

SEQ ID NO: 394419 - protein, 5 aa, Mycobacterium
DAGAR

SEQ ID NO: 394420 - protein, 10 aa, Mycobacterium
DAGARKVEKA

SEQ ID NO: 394421 - protein, 5 aa, Mycobacterium
DAGAS

SEQ ID NO: 394422 - protein, 7 aa, Mycobacterium
DAGATAV

SEQ ID NO: 394423 - protein, 7 aa, Mycobacterium
DAGDSLA

SEQ ID NO: 394424 - protein, 4 aa, Mycobacterium
DAGE

SEQ ID NO: 394425 - protein, 5 aa, Mycobacterium
DAGEG

SEQ ID NO: 394426 - protein, 7 aa, Mycobacterium
DAGETRK

SEQ ID NO: 394427 - protein, 6 aa, Mycobacterium
DAGGAA

SEQ ID NO: 394428 - protein, 7 aa, Mycobacterium
DAGGASK

SEQ ID NO: 394429 - protein, 7 aa, Mycobacterium
DAGGYKA

SEQ ID NO: 394430 - protein, 4 aa, Mycobacterium
DAGI

SEQ ID NO: 394431 - protein, 5 aa, Mycobacterium
DAGLG

SEQ ID NO: 394432 - protein, 5 aa, Mycobacterium
DAGLN

SEQ ID NO: 394433 - protein, 5 aa, Mycobacterium
DAGLV

SEQ ID NO: 394434 - protein, 8 aa, Mycobacterium
DAGPALTE

SEQ ID NO: 394435 - protein, 7 aa, Mycobacterium
DAGPELE

SEQ ID NO: 394436 - protein, 5 aa, Mycobacterium
DAGPG

SEQ ID NO: 394437 - protein, 7 aa, Mycobacterium
DAGPHTE

SEQ ID NO: 394438 - protein, 10 aa, Mycobacterium
DAGQGEKELS

SEQ ID NO: 394439 - protein, 8 aa, Mycobacterium
DAGSDKPL

SEQ ID NO: 394440 - protein, 7 aa, Mycobacterium
DAGSQYT

SEQ ID NO: 394441 - protein, 4 aa, Mycobacterium
DAGT

SEQ ID NO: 394442 - protein, 11 aa, Mycobacterium
DAGTTYRPGTR

SEQ ID NO: 394443 - protein, 6 aa, Mycobacterium
DAGYGA

SEQ ID NO: 394444 - protein, 8 aa, Mycobacterium
DAGYSNRG

SEQ ID NO: 394445 - protein, 6 aa, Mycobacterium
DAHAAG

SEQ ID NO: 394446 - protein, 10 aa, Mycobacterium
DAHGAAQGHE

SEQ ID NO: 394447 - protein, 9 aa, Mycobacterium
DAHNREQRF

SEQ ID NO: 394448 - protein, 4 aa, Mycobacterium
DAHR

SEQ ID NO: 394449 - protein, 11 aa, Mycobacterium
DAIKNPDGSPS

SEQ ID NO: 394450 - protein, 9 aa, Mycobacterium
DAKAQADRM

SEQ ID NO: 394451 - protein, 6 aa, Mycobacterium
DAKDVG

SEQ ID NO: 394452 - protein, 4 aa, Mycobacterium
DAKF

SEQ ID NO: 394453 - protein, 6 aa, Mycobacterium
DAKFGL

SEQ ID NO: 394454 - protein, 10 aa, Mycobacterium
DAKGNAAYTG

SEQ ID NO: 394455 - protein, 9 aa, Mycobacterium
DAKPKTTRR

SEQ ID NO: 394456 - protein, 6 aa, Mycobacterium
DALDPD

SEQ ID NO: 394457 - protein, 6 aa, Mycobacterium
DAMQKG

SEQ ID NO: 394458 - protein, 5 aa, Mycobacterium
DAMTQ

SEQ ID NO: 394459 - protein, 6 aa, Mycobacterium
DANADR

SEQ ID NO: 394460 - protein, 4 aa, Mycobacterium
DANG

SEQ ID NO: 394461 - protein, 8 aa, Mycobacterium
DANPETAR

SEQ ID NO: 394462 - protein, 5 aa, Mycobacterium
DANPL

SEQ ID NO: 394463 - protein, 7 aa, Mycobacterium
DAPDNDA

SEQ ID NO: 394464 - protein, 5 aa, Mycobacterium
DAPGF

SEQ ID NO: 394465 - protein, 6 aa, Mycobacterium
DAPGFT

SEQ ID NO: 394466 - protein, 6 aa, Mycobacterium
DAPGQT

SEQ ID NO: 394467 - protein, 12 aa, Mycobacterium
DAPGRPASRALA

SEQ ID NO: 394468 - protein, 4 aa, Mycobacterium
DAPI

SEQ ID NO: 394469 - protein, 5 aa, Mycobacterium
DAPID

SEQ ID NO: 394470 - protein, 5 aa, Mycobacterium
DAPIR

SEQ ID NO: 394471 - protein, 5 aa, Mycobacterium
DAPKL

SEQ ID NO: 394472 - protein, 4 aa, Mycobacterium
DAPL

SEQ ID NO: 394473 - protein, 6 aa, Mycobacterium
DAPLES

SEQ ID NO: 394474 - protein, 5 aa, Mycobacterium
DAPPR

SEQ ID NO: 394475 - protein, 6 aa, Mycobacterium
DAPSNA

SEQ ID NO: 394476 - protein, 8 aa, Mycobacterium
DAPTGDVA

SEQ ID NO: 394477 - protein, 7 aa, Mycobacterium
DAPTTDR

SEQ ID NO: 394478 - protein, 7 aa, Mycobacterium
DAPTTER

SEQ ID NO: 394479 - protein, 6 aa, Mycobacterium
DAQETR

SEQ ID NO: 394480 - protein, 4 aa, Mycobacterium
DAQG

SEQ ID NO: 394481 - protein, 4 aa, Mycobacterium
DAQI

SEQ ID NO: 394482 - protein, 10 aa, Mycobacterium
DAQNEKNTKQ

SEQ ID NO: 394483 - protein, 4 aa, Mycobacterium
DAQQ

SEQ ID NO: 394484 - protein, 5 aa, Mycobacterium
DARAA

SEQ ID NO: 394485 - protein, 9 aa, Mycobacterium
DARAATGLD

SEQ ID NO: 394486 - protein, 13 aa, Mycobacterium
DARARGRGRIPDR

SEQ ID NO: 394487 - protein, 4 aa, Mycobacterium
DARC

SEQ ID NO: 394488 - protein, 4 aa, Mycobacterium
DARD

SEQ ID NO: 394489 - protein, 6 aa, Mycobacterium
DARDLA

SEQ ID NO: 394490 - protein, 7 aa, Mycobacterium
DARGTTH

SEQ ID NO: 394491 - protein, 10 aa, Mycobacterium
DARKQGETEQ

SEQ ID NO: 394492 - protein, 6 aa, Mycobacterium
DARNRI

SEQ ID NO: 394493 - protein, 6 aa, Mycobacterium
DARRQG

SEQ ID NO: 394494 - protein, 11 aa, Mycobacterium
DARSSGATVTT

SEQ ID NO: 394495 - protein, 4 aa, Mycobacterium
DASA

SEQ ID NO: 394496 - protein, 7 aa, Mycobacterium
DASDDRM

SEQ ID NO: 394497 - protein, 8 aa, Mycobacterium
DASGPQPY

SEQ ID NO: 394498 - protein, 8 aa, Mycobacterium
DASKQVTR

SEQ ID NO: 394499 - protein, 4 aa, Mycobacterium
DASP

SEQ ID NO: 394500 - protein, 7 aa, Mycobacterium
DASQQVT

SEQ ID NO: 394501 - protein, 7 aa, Mycobacterium
DASRATY

SEQ ID NO: 394502 - protein, 19 aa, Mycobacterium
DASTYNRYRNQQARDEVRN

SEQ ID NO: 394503 - protein, 7 aa, Mycobacterium
DATARGR

SEQ ID NO: 394504 - protein, 7 aa, Mycobacterium
DATDEAA

SEQ ID NO: 394505 - protein, 6 aa, Mycobacterium
DATDEQ

SEQ ID NO: 394506 - protein, 7 aa, Mycobacterium
DATDVTA

SEQ ID NO: 394507 - protein, 6 aa, Mycobacterium
DATEAS

SEQ ID NO: 394508 - protein, 5 aa, Mycobacterium
DATEE

SEQ ID NO: 394509 - protein, 6 aa, Mycobacterium
DATETA

SEQ ID NO: 394510 - protein, 11 aa, Mycobacterium
DATGDKAAMPS

SEQ ID NO: 394511 - protein, 7 aa, Mycobacterium
DATGDSA

SEQ ID NO: 394512 - protein, 8 aa, Mycobacterium
DATGRPVE

SEQ ID NO: 394513 - protein, 4 aa, Mycobacterium
DATL

SEQ ID NO: 394514 - protein, 5 aa, Mycobacterium
DATPE

SEQ ID NO: 394515 - protein, 6 aa, Mycobacterium
DATPIE

SEQ ID NO: 394516 - protein, 4 aa, Mycobacterium
DAVA

SEQ ID NO: 394517 - protein, 11 aa, Mycobacterium
DAVADKGARAT

SEQ ID NO: 394518 - protein, 7 aa, Mycobacterium
DAVDANG

SEQ ID NO: 394519 - protein, 5 aa, Mycobacterium
DAVDP

SEQ ID NO: 394520 - protein, 10 aa, Mycobacterium
DAVRDKDGIS

SEQ ID NO: 394521 - protein, 13 aa, Mycobacterium
DCTNAESLQQQSE

SEQ ID NO: 394522 - protein, 9 aa, Mycobacterium
DDAARDKAV

SEQ ID NO: 394523 - protein, 10 aa, Mycobacterium
DDADTRAAVT

SEQ ID NO: 394524 - protein, 11 aa, Mycobacterium
DDADTRAAVTA

SEQ ID NO: 394525 - protein, 12 aa, Mycobacterium
DDADTRASVTAE

SEQ ID NO: 394526 - protein, 6 aa, Mycobacterium
DDAEFT

SEQ ID NO: 394527 - protein, 4 aa, Mycobacterium
DDAG

SEQ ID NO: 394528 - protein, 11 aa, Mycobacterium
DDAKAKGAKVI

SEQ ID NO: 394529 - protein, 4 aa, Mycobacterium
DDAM

SEQ ID NO: 394530 - protein, 7 aa, Mycobacterium
DDANGAL

SEQ ID NO: 394531 - protein, 8 aa, Mycobacterium
DDAPAGTR

SEQ ID NO: 394532 - protein, 7 aa, Mycobacterium
DDAQDAR

SEQ ID NO: 394533 - protein, 9 aa, Mycobacterium
DDAQEGPAA

SEQ ID NO: 394534 - protein, 8 aa, Mycobacterium
DDAQRDGD

SEQ ID NO: 394535 - protein, 7 aa, Mycobacterium
DDASYIS

SEQ ID NO: 394536 - protein, 5 aa, Mycobacterium
DDAVQ

SEQ ID NO: 394537 - protein, 5 aa, Mycobacterium
DDAVT

SEQ ID NO: 394538 - protein, 5 aa, Mycobacterium
DDDDA

SEQ ID NO: 394539 - protein, 7 aa, Mycobacterium
DDDDAVR

SEQ ID NO: 394540 - protein, 10 aa, Mycobacterium
DDDDVDPRRL

SEQ ID NO: 394541 - protein, 7 aa, Mycobacterium
DDDEAAA

SEQ ID NO: 394542 - protein, 7 aa, Mycobacterium
DDDEAVR

SEQ ID NO: 394543 - protein, 8 aa, Mycobacterium
DDDELHRN

SEQ ID NO: 394544 - protein, 8 aa, Mycobacterium
DDDENDTE

SEQ ID NO: 394545 - protein, 7 aa, Mycobacterium
DDDGTEL

SEQ ID NO: 394546 - protein, 4 aa, Mycobacterium
DDDP

SEQ ID NO: 394547 - protein, 9 aa, Mycobacterium
DDDPRRVSD

SEQ ID NO: 394548 - protein, 5 aa, Mycobacterium
DDDRI

SEQ ID NO: 394549 - protein, 21 aa, Mycobacterium
DDDSGDGAAKARAYERSATEA

SEQ ID NO: 394550 - protein, 4 aa, Mycobacterium
DDDV

SEQ ID NO: 394551 - protein, 6 aa, Mycobacterium
DDDYRE

SEQ ID NO: 394552 - protein, 6 aa, Mycobacterium
DDECPG

SEQ ID NO: 394553 - protein, 7 aa, Mycobacterium
DDEDKPL

SEQ ID NO: 394554 - protein, 4 aa, Mycobacterium
DDEE

SEQ ID NO: 394555 - protein, 7 aa, Mycobacterium
DDEEARR

SEQ ID NO: 394556 - protein, 4 aa, Mycobacterium
DDEG

SEQ ID NO: 394557 - protein, 5 aa, Mycobacterium
DDEMG

SEQ ID NO: 394558 - protein, 4 aa, Mycobacterium
DDER

SEQ ID NO: 394559 - protein, 5 aa, Mycobacterium
DDERR

SEQ ID NO: 394560 - protein, 5 aa, Mycobacterium
DDETF

SEQ ID NO: 394561 - protein, 6 aa, Mycobacterium
DDEWED

SEQ ID NO: 394562 - protein, 7 aa, Mycobacterium
DDGAGGW

SEQ ID NO: 394563 - protein, 8 aa, Mycobacterium
DDGEHPGL

SEQ ID NO: 394564 - protein, 7 aa, Mycobacterium
DDGESMT

SEQ ID NO: 394565 - protein, 6 aa, Mycobacterium
DDGGTA

SEQ ID NO: 394566 - protein, 9 aa, Mycobacterium
DDGHGGSVE

SEQ ID NO: 394567 - protein, 5 aa, Mycobacterium
DDGLP

SEQ ID NO: 394568 - protein, 9 aa, Mycobacterium
DDGNPCPPG

SEQ ID NO: 394569 - protein, 7 aa, Mycobacterium
DDGNPLA

SEQ ID NO: 394570 - protein, 7 aa, Mycobacterium
DDGPRPT

SEQ ID NO: 394571 - protein, 4 aa, Mycobacterium
DDGQ

SEQ ID NO: 394572 - protein, 6 aa, Mycobacterium
DDGRGI

SEQ ID NO: 394573 - protein, 5 aa, Mycobacterium
DDGRI

SEQ ID NO: 394574 - protein, 8 aa, Mycobacterium
DDGRPQDS

SEQ ID NO: 394575 - protein, 8 aa, Mycobacterium
DDGRPSQL

SEQ ID NO: 394576 - protein, 8 aa, Mycobacterium
DDGRPSQV

SEQ ID NO: 394577 - protein, 5 aa, Mycobacterium
DDGRR

SEQ ID NO: 394578 - protein, 12 aa, Mycobacterium
DDGRRAVDAGAA

SEQ ID NO: 394579 - protein, 6 aa, Mycobacterium
DDGRVT

SEQ ID NO: 394580 - protein, 6 aa, Mycobacterium
DDGSAG

SEQ ID NO: 394581 - protein, 9 aa, Mycobacterium
DDGSGRTYQ

SEQ ID NO: 394582 - protein, 4 aa, Mycobacterium
DDGT

SEQ ID NO: 394583 - protein, 8 aa, Mycobacterium
DDGTRQSY

SEQ ID NO: 394584 - protein, 6 aa, Mycobacterium
DDGTYV

SEQ ID NO: 394585 - protein, 5 aa, Mycobacterium
DDGVD

SEQ ID NO: 394586 - protein, 5 aa, Mycobacterium
DDGVG

SEQ ID NO: 394587 - protein, 8 aa, Mycobacterium
DDGYAEAI

SEQ ID NO: 394588 - protein, 6 aa, Mycobacterium
DDHGEK

SEQ ID NO: 394589 - protein, 7 aa, Mycobacterium
DDIDGGL

SEQ ID NO: 394590 - protein, 10 aa, Mycobacterium
DDKPVASASI

SEQ ID NO: 394591 - protein, 6 aa, Mycobacterium
DDKQLD

SEQ ID NO: 394592 - protein, 10 aa, Mycobacterium
DDLAQAQGIP

SEQ ID NO: 394593 - protein, 7 aa, Mycobacterium
DDLKSTV

SEQ ID NO: 394594 - protein, 4 aa, Mycobacterium
DDLP

SEQ ID NO: 394595 - protein, 4 aa, Mycobacterium
DDMP

SEQ ID NO: 394596 - protein, 4 aa, Mycobacterium
DDMT

SEQ ID NO: 394597 - protein, 4 aa, Mycobacterium
DDMV

SEQ ID NO: 394598 - protein, 10 aa, Mycobacterium
DDNPGRRKQP

SEQ ID NO: 394599 - protein, 4 aa, Mycobacterium
DDNT

SEQ ID NO: 394600 - protein, 6 aa, Mycobacterium
DDPAAD

SEQ ID NO: 394601 - protein, 8 aa, Mycobacterium
DDPAGDHD

SEQ ID NO: 394602 - protein, 7 aa, Mycobacterium
DDPAYPR

SEQ ID NO: 394603 - protein, 4 aa, Mycobacterium
DDPD

SEQ ID NO: 394604 - protein, 5 aa, Mycobacterium
DDPDA

SEQ ID NO: 394605 - protein, 6 aa, Mycobacterium
DDPDKL

SEQ ID NO: 394606 - protein, 6 aa, Mycobacterium
DDPDRI

SEQ ID NO: 394607 - protein, 5 aa, Mycobacterium
DDPEI

SEQ ID NO: 394608 - protein, 6 aa, Mycobacterium
DDPEQV

SEQ ID NO: 394609 - protein, 6 aa, Mycobacterium
DDPFYQ

SEQ ID NO: 394610 - protein, 8 aa, Mycobacterium
DDPGSHAY

SEQ ID NO: 394611 - protein, 8 aa, Mycobacterium
DDPGSQAY

SEQ ID NO: 394612 - protein, 9 aa, Mycobacterium
DDPGSSARI

SEQ ID NO: 394613 - protein, 6 aa, Mycobacterium
DDPGVS

SEQ ID NO: 394614 - protein, 6 aa, Mycobacterium
DDPLGV

SEQ ID NO: 394615 - protein, 5 aa, Mycobacterium
DDPRI

SEQ ID NO: 394616 - protein, 9 aa, Mycobacterium
DDPSGSANV

SEQ ID NO: 394617 - protein, 9 aa, Mycobacterium
DDPSTWTEP

SEQ ID NO: 394618 - protein, 5 aa, Mycobacterium
DDPSV

SEQ ID NO: 394619 - protein, 8 aa, Mycobacterium
DDPTDEAF

SEQ ID NO: 394620 - protein, 9 aa, Mycobacterium
DDPTELSEE

SEQ ID NO: 394621 - protein, 6 aa, Mycobacterium
DDPVTR

SEQ ID NO: 394622 - protein, 5 aa, Mycobacterium
DDPWP

SEQ ID NO: 394623 - protein, 4 aa, Mycobacterium
DDPY

SEQ ID NO: 394624 - protein, 11 aa, Mycobacterium
DDPYEAPARPE

SEQ ID NO: 394625 - protein, 4 aa, Mycobacterium
DDQV

SEQ ID NO: 394626 - protein, 4 aa, Mycobacterium
DDRA

SEQ ID NO: 394627 - protein, 4 aa, Mycobacterium
DDRD

SEQ ID NO: 394628 - protein, 5 aa, Mycobacterium
DDRDK

SEQ ID NO: 394629 - protein, 4 aa, Mycobacterium
DDRF

SEQ ID NO: 394630 - protein, 5 aa, Mycobacterium
DDRGA

SEQ ID NO: 394631 - protein, 6 aa, Mycobacterium
DDRGDG

SEQ ID NO: 394632 - protein, 11 aa, Mycobacterium
DDRLSKGIGTG

SEQ ID NO: 394633 - protein, 9 aa, Mycobacterium
DDRPAPGLV

SEQ ID NO: 394634 - protein, 7 aa, Mycobacterium
DDRPGRV

SEQ ID NO: 394635 - protein, 4 aa, Mycobacterium
DDSD

SEQ ID NO: 394636 - protein, 8 aa, Mycobacterium
DDSGNELL

SEQ ID NO: 394637 - protein, 8 aa, Mycobacterium
DDSGVTGP

SEQ ID NO: 394638 - protein, 4 aa, Mycobacterium
DDST

SEQ ID NO: 394639 - protein, 5 aa, Mycobacterium
DDTAE

SEQ ID NO: 394640 - protein, 5 aa, Mycobacterium
DDTGE

SEQ ID NO: 394641 - protein, 9 aa, Mycobacterium
DDTPWGGKP

SEQ ID NO: 394642 - protein, 4 aa, Mycobacterium
DDTS

SEQ ID NO: 394643 - protein, 4 aa, Mycobacterium
DDVD

SEQ ID NO: 394644 - protein, 6 aa, Mycobacterium
DDVDTA

SEQ ID NO: 394645 - protein, 9 aa, Mycobacterium
DDVKPANSH

SEQ ID NO: 394646 - protein, 7 aa, Mycobacterium
DDYDDQP

SEQ ID NO: 394647 - protein, 6 aa, Mycobacterium
DDYGPD

SEQ ID NO: 394648 - protein, 7 aa, Mycobacterium
DDYQGRG

SEQ ID NO: 394649 - protein, 8 aa, Mycobacterium
DEAAAKAH

SEQ ID NO: 394650 - protein, 12 aa, Mycobacterium
DEAADKAAELAS

SEQ ID NO: 394651 - protein, 7 aa, Mycobacterium
DEAADLS

SEQ ID NO: 394652 - protein, 6 aa, Mycobacterium
DEAAQR

SEQ ID NO: 394653 - protein, 9 aa, Mycobacterium
DEAETAESF

SEQ ID NO: 394654 - protein, 5 aa, Mycobacterium
DEAGG

SEQ ID NO: 394655 - protein, 7 aa, Mycobacterium
DEAGGDD

SEQ ID NO: 394656 - protein, 5 aa, Mycobacterium
DEAGH

SEQ ID NO: 394657 - protein, 17 aa, Mycobacterium
DEAGPGAHEAAGAAVGQ

SEQ ID NO: 394658 - protein, 8 aa, Mycobacterium
DEAGVSRS

SEQ ID NO: 394659 - protein, 10 aa, Mycobacterium
DEAKSTARRC

SEQ ID NO: 394660 - protein, 14 aa, Mycobacterium
DEAMGRARKPEVYS

SEQ ID NO: 394661 - protein, 7 aa, Mycobacterium
DEAPGLD

SEQ ID NO: 394662 - protein, 4 aa, Mycobacterium
DEAR

SEQ ID NO: 394663 - protein, 5 aa, Mycobacterium
DEASC

SEQ ID NO: 394664 - protein, 7 aa, Mycobacterium
DEATTDA

SEQ ID NO: 394665 - protein, 8 aa, Mycobacterium
DEDEDEIK

SEQ ID NO: 394666 - protein, 4 aa, Mycobacterium
DEDF

SEQ ID NO: 394667 - protein, 4 aa, Mycobacterium
DEDG

SEQ ID NO: 394668 - protein, 4 aa, Mycobacterium
DEDL

SEQ ID NO: 394669 - protein, 8 aa, Mycobacterium
DEDPEAAL

SEQ ID NO: 394670 - protein, 21 aa, Mycobacterium
DEDRARSRGVTLGNQQADGMS

SEQ ID NO: 394671 - protein, 11 aa, Mycobacterium
DEDTDDDIRAD

SEQ ID NO: 394672 - protein, 5 aa, Mycobacterium
DEELA

SEQ ID NO: 394673 - protein, 7 aa, Mycobacterium
DEELDQA

SEQ ID NO: 394674 - protein, 5 aa, Mycobacterium
DEEPD

SEQ ID NO: 394675 - protein, 4 aa, Mycobacterium
DEER

SEQ ID NO: 394676 - protein, 4 aa, Mycobacterium
DEET

SEQ ID NO: 394677 - protein, 6 aa, Mycobacterium
DEEWED

SEQ ID NO: 394678 - protein, 13 aa, Mycobacterium
DEFGQDREGAELE

SEQ ID NO: 394679 - protein, 4 aa, Mycobacterium
DEFR

SEQ ID NO: 394680 - protein, 4 aa, Mycobacterium
DEGI

SEQ ID NO: 394681 - protein, 7 aa, Mycobacterium
DEGIPEE

SEQ ID NO: 394682 - protein, 15 aa, Mycobacterium
DEGPTAKRIRPRAQG

SEQ ID NO: 394683 - protein, 5 aa, Mycobacterium
DEGRA

SEQ ID NO: 394684 - protein, 5 aa, Mycobacterium
DEGRI

SEQ ID NO: 394685 - protein, 5 aa, Mycobacterium
DEGRL

SEQ ID NO: 394686 - protein, 4 aa, Mycobacterium
DEGS

SEQ ID NO: 394687 - protein, 4 aa, Mycobacterium
DEGT

SEQ ID NO: 394688 - protein, 4 aa, Mycobacterium
DEGY

SEQ ID NO: 394689 - protein, 5 aa, Mycobacterium
DEHGR

SEQ ID NO: 394690 - protein, 6 aa, Mycobacterium
DEHGVP

SEQ ID NO: 394691 - protein, 5 aa, Mycobacterium
DEHPG

SEQ ID NO: 394692 - protein, 7 aa, Mycobacterium
DEHSGSE

SEQ ID NO: 394693 - protein, 6 aa, Mycobacterium
DEIDGP

SEQ ID NO: 394694 - protein, 4 aa, Mycobacterium
DEIE

SEQ ID NO: 394695 - protein, 5 aa, Mycobacterium
DEIGP

SEQ ID NO: 394696 - protein, 13 aa, Mycobacterium
DEIPDPQDPATFE

SEQ ID NO: 394697 - protein, 4 aa, Mycobacterium
DEIT

SEQ ID NO: 394698 - protein, 6 aa, Mycobacterium
DEKAHQ

SEQ ID NO: 394699 - protein, 6 aa, Mycobacterium
DEKERA

SEQ ID NO: 394700 - protein, 8 aa, Mycobacterium
DEKGGDDK

SEQ ID NO: 394701 - protein, 5 aa, Mycobacterium
DEKGI

SEQ ID NO: 394702 - protein, 9 aa, Mycobacterium
DEKPTASDD

SEQ ID NO: 394703 - protein, 4 aa, Mycobacterium
DELA

SEQ ID NO: 394704 - protein, 5 aa, Mycobacterium
DELGP

SEQ ID NO: 394705 - protein, 4 aa, Mycobacterium
DELR

SEQ ID NO: 394706 - protein, 9 aa, Mycobacterium
DELVPSGQA

SEQ ID NO: 394707 - protein, 4 aa, Mycobacterium
DEND

SEQ ID NO: 394708 - protein, 16 aa, Mycobacterium
DENGTTVAAASSIEDD

SEQ ID NO: 394709 - protein, 6 aa, Mycobacterium
DENRFS

SEQ ID NO: 394710 - protein, 4 aa, Mycobacterium
DENT

SEQ ID NO: 394711 - protein, 16 aa, Mycobacterium
DENTRKTKPHNNAQTA

SEQ ID NO: 394712 - protein, 4 aa, Mycobacterium
DEPA

SEQ ID NO: 394713 - protein, 5 aa, Mycobacterium
DEPDG

SEQ ID NO: 394714 - protein, 7 aa, Mycobacterium
DEPEVSA

SEQ ID NO: 394715 - protein, 6 aa, Mycobacterium
DEPMPL

SEQ ID NO: 394716 - protein, 6 aa, Mycobacterium
DEPNAR

SEQ ID NO: 394717 - protein, 5 aa, Mycobacterium
DEPRM

SEQ ID NO: 394718 - protein, 6 aa, Mycobacterium
DEPSAI

SEQ ID NO: 394719 - protein, 8 aa, Mycobacterium
DEPSGQVD

SEQ ID NO: 394720 - protein, 7 aa, Mycobacterium
DEPSPHV

SEQ ID NO: 394721 - protein, 13 aa, Mycobacterium
DEPTANLDHRTGE

SEQ ID NO: 394722 - protein, 7 aa, Mycobacterium
DEPTSAL

SEQ ID NO: 394723 - protein, 10 aa, Mycobacterium
DEPVSSKGAT

SEQ ID NO: 394724 - protein, 7 aa, Mycobacterium
DEPWSTT

SEQ ID NO: 394725 - protein, 5 aa, Mycobacterium
DEQAL

SEQ ID NO: 394726 - protein, 5 aa, Mycobacterium
DEQGV

SEQ ID NO: 394727 - protein, 7 aa, Mycobacterium
DEQKSTY

SEQ ID NO: 394728 - protein, 6 aa, Mycobacterium
DEQLDN

SEQ ID NO: 394729 - protein, 6 aa, Mycobacterium
DEQRAE

SEQ ID NO: 394730 - protein, 7 aa, Mycobacterium
DEQRPKL

SEQ ID NO: 394731 - protein, 5 aa, Mycobacterium
DEQRR

SEQ ID NO: 394732 - protein, 5 aa, Mycobacterium
DERAA

SEQ ID NO: 394733 - protein, 9 aa, Mycobacterium
DERAGTPGL

SEQ ID NO: 394734 - protein, 6 aa, Mycobacterium
DERASQ

SEQ ID NO: 394735 - protein, 7 aa, Mycobacterium
DERASTT

SEQ ID NO: 394736 - protein, 10 aa, Mycobacterium
DERDASIERT

SEQ ID NO: 394737 - protein, 7 aa, Mycobacterium
DERDEGV

SEQ ID NO: 394738 - protein, 7 aa, Mycobacterium
DEREGNS

SEQ ID NO: 394739 - protein, 4 aa, Mycobacterium
DERF

SEQ ID NO: 394740 - protein, 6 aa, Mycobacterium
DERNAS

SEQ ID NO: 394741 - protein, 4 aa, Mycobacterium
DERR

SEQ ID NO: 394742 - protein, 4 aa, Mycobacterium
DERT

SEQ ID NO: 394743 - protein, 5 aa, Mycobacterium
DERTP

SEQ ID NO: 394744 - protein, 8 aa, Mycobacterium
DERVSADT

SEQ ID NO: 394745 - protein, 10 aa, Mycobacterium
DESARGTRRE

SEQ ID NO: 394746 - protein, 11 aa, Mycobacterium
DESDPTKRDPE

SEQ ID NO: 394747 - protein, 8 aa, Mycobacterium
DESERDAA

SEQ ID NO: 394748 - protein, 4 aa, Mycobacterium
DESG

SEQ ID NO: 394749 - protein, 6 aa, Mycobacterium
DESGRI

SEQ ID NO: 394750 - protein, 9 aa, Mycobacterium
DESGTTDNF

SEQ ID NO: 394751 - protein, 4 aa, Mycobacterium
DESI

SEQ ID NO: 394752 - protein, 6 aa, Mycobacterium
DESPMQ

SEQ ID NO: 394753 - protein, 4 aa, Mycobacterium
DESS

SEQ ID NO: 394754 - protein, 8 aa, Mycobacterium
DESSATRL

SEQ ID NO: 394755 - protein, 6 aa, Mycobacterium
DESSPN

SEQ ID NO: 394756 - protein, 9 aa, Mycobacterium
DESSYATGS

SEQ ID NO: 394757 - protein, 6 aa, Mycobacterium
DESYQI

SEQ ID NO: 394758 - protein, 8 aa, Mycobacterium
DETAEYSL

SEQ ID NO: 394759 - protein, 8 aa, Mycobacterium
DETAPGDS

SEQ ID NO: 394760 - protein, 8 aa, Mycobacterium
DETATTAA

SEQ ID NO: 394761 - protein, 9 aa, Mycobacterium
DETDWSRNT

SEQ ID NO: 394762 - protein, 10 aa, Mycobacterium
DETDWSTNRE

SEQ ID NO: 394763 - protein, 9 aa, Mycobacterium
DETGSTNAD

SEQ ID NO: 394764 - protein, 17 aa, Mycobacterium
DETPPAPARAPEHGQHT

SEQ ID NO: 394765 - protein, 4 aa, Mycobacterium
DETR

SEQ ID NO: 394766 - protein, 5 aa, Mycobacterium
DETRA

SEQ ID NO: 394767 - protein, 13 aa, Mycobacterium
DETRKSLGVAGPR

SEQ ID NO: 394768 - protein, 8 aa, Mycobacterium
DETRRRAE

SEQ ID NO: 394769 - protein, 6 aa, Mycobacterium
DETTGR

SEQ ID NO: 394770 - protein, 7 aa, Mycobacterium
DEVANAQ

SEQ ID NO: 394771 - protein, 8 aa, Mycobacterium
DEVGRGAC

SEQ ID NO: 394772 - protein, 5 aa, Mycobacterium
DEVST

SEQ ID NO: 394773 - protein, 5 aa, Mycobacterium
DEYGR

SEQ ID NO: 394774 - protein, 4 aa, Mycobacterium
DEYR

SEQ ID NO: 394775 - protein, 20 aa, Mycobacterium
DEYSAQSHERAAAAQDAGAF

SEQ ID NO: 394776 - protein, 4 aa, Mycobacterium
DFAG

SEQ ID NO: 394777 - protein, 4 aa, Mycobacterium
DFES

SEQ ID NO: 394778 - protein, 7 aa, Mycobacterium
DFETQRR

SEQ ID NO: 394779 - protein, 7 aa, Mycobacterium
DFGDDKD

SEQ ID NO: 394780 - protein, 4 aa, Mycobacterium
DFGG

SEQ ID NO: 394781 - protein, 6 aa, Mycobacterium
DFHPPA

SEQ ID NO: 394782 - protein, 5 aa, Mycobacterium
DFLPN

SEQ ID NO: 394783 - protein, 8 aa, Mycobacterium
DFPAPDDP

SEQ ID NO: 394784 - protein, 11 aa, Mycobacterium
DFQDGKPHSIE

SEQ ID NO: 394785 - protein, 4 aa, Mycobacterium
DFST

SEQ ID NO: 394786 - protein, 4 aa, Mycobacterium
DFTE

SEQ ID NO: 394787 - protein, 4 aa, Mycobacterium
DGAA

SEQ ID NO: 394788 - protein, 5 aa, Mycobacterium
DGAAT

SEQ ID NO: 394789 - protein, 4 aa, Mycobacterium
DGAD

SEQ ID NO: 394790 - protein, 6 aa, Mycobacterium
DGAEAR

SEQ ID NO: 394791 - protein, 9 aa, Mycobacterium
DGAGDAGYE

SEQ ID NO: 394792 - protein, 4 aa, Mycobacterium
DGAL

SEQ ID NO: 394793 - protein, 5 aa, Mycobacterium
DGALS

SEQ ID NO: 394794 - protein, 8 aa, Mycobacterium
DGAPDMGP

SEQ ID NO: 394795 - protein, 5 aa, Mycobacterium
DGAPG

SEQ ID NO: 394796 - protein, 7 aa, Mycobacterium
DGAPRYP

SEQ ID NO: 394797 - protein, 4 aa, Mycobacterium
DGAQ

SEQ ID NO: 394798 - protein, 5 aa, Mycobacterium
DGAQA

SEQ ID NO: 394799 - protein, 5 aa, Mycobacterium
DGARV

SEQ ID NO: 394800 - protein, 9 aa, Mycobacterium
DGATNTGSF

SEQ ID NO: 394801 - protein, 9 aa, Mycobacterium
DGATSEGDV

SEQ ID NO: 394802 - protein, 5 aa, Mycobacterium
DGATT

SEQ ID NO: 394803 - protein, 6 aa, Mycobacterium
DGATTI

SEQ ID NO: 394804 - protein, 4 aa, Mycobacterium
DGAV

SEQ ID NO: 394805 - protein, 5 aa, Mycobacterium
DGAVS

SEQ ID NO: 394806 - protein, 11 aa, Mycobacterium
DGCAGHSDGDV

SEQ ID NO: 394807 - protein, 7 aa, Mycobacterium
DGCGSTH

SEQ ID NO: 394808 - protein, 8 aa, Mycobacterium
DGCRPTAG

SEQ ID NO: 394809 - protein, 8 aa, Mycobacterium
DGDAGTVA

SEQ ID NO: 394810 - protein, 10 aa, Mycobacterium
DGDEQARARP

SEQ ID NO: 394811 - protein, 4 aa, Mycobacterium
DGDF

SEQ ID NO: 394812 - protein, 4 aa, Mycobacterium
DGDG

SEQ ID NO: 394813 - protein, 15 aa, Mycobacterium
DGDGQGDLAGHGGEQ

SEQ ID NO: 394814 - protein, 4 aa, Mycobacterium
DGDQ

SEQ ID NO: 394815 - protein, 4 aa, Mycobacterium
DGDR

SEQ ID NO: 394816 - protein, 7 aa, Mycobacterium
DGDRITA

SEQ ID NO: 394817 - protein, 8 aa, Mycobacterium
DGDRLTDD

SEQ ID NO: 394818 - protein, 4 aa, Mycobacterium
DGDS

SEQ ID NO: 394819 - protein, 4 aa, Mycobacterium
DGDT

SEQ ID NO: 394820 - protein, 7 aa, Mycobacterium
DGDVADE

SEQ ID NO: 394821 - protein, 5 aa, Mycobacterium
DGEGC

SEQ ID NO: 394822 - protein, 7 aa, Mycobacterium
DGEGGPF

SEQ ID NO: 394823 - protein, 4 aa, Mycobacterium
DGEL

SEQ ID NO: 394824 - protein, 7 aa, Mycobacterium
DGEPAPD

SEQ ID NO: 394825 - protein, 6 aa, Mycobacterium
DGEPGF

SEQ ID NO: 394826 - protein, 5 aa, Mycobacterium
DGEPL

SEQ ID NO: 394827 - protein, 6 aa, Mycobacterium
DGEPLG

SEQ ID NO: 394828 - protein, 6 aa, Mycobacterium
DGEQEK

SEQ ID NO: 394829 - protein, 7 aa, Mycobacterium
DGEQRLG

SEQ ID NO: 394830 - protein, 5 aa, Mycobacterium
DGERF

SEQ ID NO: 394831 - protein, 13 aa, Mycobacterium
DGERGRARAQREM

SEQ ID NO: 394832 - protein, 5 aa, Mycobacterium
DGETG

SEQ ID NO: 394833 - protein, 5 aa, Mycobacterium
DGETH

SEQ ID NO: 394834 - protein, 5 aa, Mycobacterium
DGFGP

SEQ ID NO: 394835 - protein, 5 aa, Mycobacterium
DGGAD

SEQ ID NO: 394836 - protein, 5 aa, Mycobacterium
DGGAE

SEQ ID NO: 394837 - protein, 5 aa, Mycobacterium
DGGEE

SEQ ID NO: 394838 - protein, 10 aa, Mycobacterium
DGGEGGTGAA

SEQ ID NO: 394839 - protein, 9 aa, Mycobacterium
DGGEPVDAG

SEQ ID NO: 394840 - protein, 4 aa, Mycobacterium
DGGG

SEQ ID NO: 394841 - protein, 11 aa, Mycobacterium
DGGGPSGQAGA

SEQ ID NO: 394842 - protein, 5 aa, Mycobacterium
DGGLD

SEQ ID NO: 394843 - protein, 21 aa, Mycobacterium
DGGPGAAATATSAAGRGGDAG

SEQ ID NO: 394844 - protein, 5 aa, Mycobacterium
DGGPL

SEQ ID NO: 394845 - protein, 7 aa, Mycobacterium
DGGQQAR

SEQ ID NO: 394846 - protein, 6 aa, Mycobacterium
DGGRLP

SEQ ID NO: 394847 - protein, 6 aa, Mycobacterium
DGGSID

SEQ ID NO: 394848 - protein, 5 aa, Mycobacterium
DGGSV

SEQ ID NO: 394849 - protein, 4 aa, Mycobacterium
DGGT

SEQ ID NO: 394850 - protein, 8 aa, Mycobacterium
DGGTTLGA

SEQ ID NO: 394851 - protein, 7 aa, Mycobacterium
DGHSDDQ

SEQ ID NO: 394852 - protein, 8 aa, Mycobacterium
DGIEPSDD

SEQ ID NO: 394853 - protein, 6 aa, Mycobacterium
DGIGDP

SEQ ID NO: 394854 - protein, 4 aa, Mycobacterium
DGIP

SEQ ID NO: 394855 - protein, 6 aa, Mycobacterium
DGIPPK

SEQ ID NO: 394856 - protein, 13 aa, Mycobacterium
DGKISQRNFGGHT

SEQ ID NO: 394857 - protein, 7 aa, Mycobacterium
DGKLGTR

SEQ ID NO: 394858 - protein, 6 aa, Mycobacterium
DGKLTG

SEQ ID NO: 394859 - protein, 4 aa, Mycobacterium
DGKR

SEQ ID NO: 394860 - protein, 7 aa, Mycobacterium
DGKRATT

SEQ ID NO: 394861 - protein, 7 aa, Mycobacterium
DGKRSYA

SEQ ID NO: 394862 - protein, 5 aa, Mycobacterium
DGKRT

SEQ ID NO: 394863 - protein, 13 aa, Mycobacterium
DGKTVEAEAAHGT

SEQ ID NO: 394864 - protein, 14 aa, Mycobacterium
DGKTVEAEAAHGTV

SEQ ID NO: 394865 - protein, 7 aa, Mycobacterium
DGKWTDS

SEQ ID NO: 394866 - protein, 4 aa, Mycobacterium
DGLP

SEQ ID NO: 394867 - protein, 6 aa, Mycobacterium
DGLPDR

SEQ ID NO: 394868 - protein, 8 aa, Mycobacterium
DGLPEDER

SEQ ID NO: 394869 - protein, 4 aa, Mycobacterium
DGLT

SEQ ID NO: 394870 - protein, 11 aa, Mycobacterium
DGLTTRARRNA

SEQ ID NO: 394871 - protein, 5 aa, Mycobacterium
DGMHG

SEQ ID NO: 394872 - protein, 4 aa, Mycobacterium
DGMP

SEQ ID NO: 394873 - protein, 4 aa, Mycobacterium
DGMR

SEQ ID NO: 394874 - protein, 4 aa, Mycobacterium
DGND

SEQ ID NO: 394875 - protein, 6 aa, Mycobacterium
DGNGRD

SEQ ID NO: 394876 - protein, 4 aa, Mycobacterium
DGNL

SEQ ID NO: 394877 - protein, 7 aa, Mycobacterium
DGNPDAL

SEQ ID NO: 394878 - protein, 4 aa, Mycobacterium
DGNQ

SEQ ID NO: 394879 - protein, 6 aa, Mycobacterium
DGNRSY

SEQ ID NO: 394880 - protein, 4 aa, Mycobacterium
DGNY

SEQ ID NO: 394881 - protein, 4 aa, Mycobacterium
DGPA

SEQ ID NO: 394882 - protein, 7 aa, Mycobacterium
DGPAGPG

SEQ ID NO: 394883 - protein, 8 aa, Mycobacterium
DGPAGPGM

SEQ ID NO: 394884 - protein, 10 aa, Mycobacterium
DGPAPEPAKH

SEQ ID NO: 394885 - protein, 10 aa, Mycobacterium
DGPAPEPVTR

SEQ ID NO: 394886 - protein, 9 aa, Mycobacterium
DGPCTQNGE

SEQ ID NO: 394887 - protein, 8 aa, Mycobacterium
DGPDPECV

SEQ ID NO: 394888 - protein, 25 aa, Mycobacterium
DGPEPDDTERARKRGLTKGKQRPDG

SEQ ID NO: 394889 - protein, 4 aa, Mycobacterium
DGPH

SEQ ID NO: 394890 - protein, 4 aa, Mycobacterium
DGPI

SEQ ID NO: 394891 - protein, 4 aa, Mycobacterium
DGPQ

SEQ ID NO: 394892 - protein, 6 aa, Mycobacterium
DGPRGG

SEQ ID NO: 394893 - protein, 6 aa, Mycobacterium
DGPTEV

SEQ ID NO: 394894 - protein, 6 aa, Mycobacterium
DGPVPA

SEQ ID NO: 394895 - protein, 8 aa, Mycobacterium
DGPVTSPS

SEQ ID NO: 394896 - protein, 4 aa, Mycobacterium
DGPW

SEQ ID NO: 394897 - protein, 10 aa, Mycobacterium
DGPWQGPSAA

SEQ ID NO: 394898 - protein, 4 aa, Mycobacterium
DGPY

SEQ ID NO: 394899 - protein, 7 aa, Mycobacterium
DGQAGTF

SEQ ID NO: 394900 - protein, 4 aa, Mycobacterium
DGQG

SEQ ID NO: 394901 - protein, 5 aa, Mycobacterium
DGQLA

SEQ ID NO: 394902 - protein, 4 aa, Mycobacterium
DGQP

SEQ ID NO: 394903 - protein, 7 aa, Mycobacterium
DGQPRTL

SEQ ID NO: 394904 - protein, 4 aa, Mycobacterium
DGQR

SEQ ID NO: 394905 - protein, 4 aa, Mycobacterium
DGQV

SEQ ID NO: 394906 - protein, 4 aa, Mycobacterium
DGQY

SEQ ID NO: 394907 - protein, 9 aa, Mycobacterium
DGRATTHPI

SEQ ID NO: 394908 - protein, 5 aa, Mycobacterium
DGREL

SEQ ID NO: 394909 - protein, 5 aa, Mycobacterium
DGRGA

SEQ ID NO: 394910 - protein, 10 aa, Mycobacterium
DGRGGGGQGM

SEQ ID NO: 394911 - protein, 8 aa, Mycobacterium
DGRGLPDG

SEQ ID NO: 394912 - protein, 7 aa, Mycobacterium
DGRGLPE

SEQ ID NO: 394913 - protein, 11 aa, Mycobacterium
DGRGPGSPPAT

SEQ ID NO: 394914 - protein, 6 aa, Mycobacterium
DGRGQA

SEQ ID NO: 394915 - protein, 4 aa, Mycobacterium
DGRH

SEQ ID NO: 394916 - protein, 4 aa, Mycobacterium
DGRI

SEQ ID NO: 394917 - protein, 11 aa, Mycobacterium
DGRPAGSAPAT

SEQ ID NO: 394918 - protein, 5 aa, Mycobacterium
DGRPH

SEQ ID NO: 394919 - protein, 6 aa, Mycobacterium
DGRRAT

SEQ ID NO: 394920 - protein, 4 aa, Mycobacterium
DGRT

SEQ ID NO: 394921 - protein, 4 aa, Mycobacterium
DGRV

SEQ ID NO: 394922 - protein, 14 aa, Mycobacterium
DGRVEDPVGSRPHV

SEQ ID NO: 394923 - protein, 8 aa, Mycobacterium
DGSAGNSF

SEQ ID NO: 394924 - protein, 4 aa, Mycobacterium
DGSC

SEQ ID NO: 394925 - protein, 6 aa, Mycobacterium
DGSDCG

SEQ ID NO: 394926 - protein, 6 aa, Mycobacterium
DGSDDL

SEQ ID NO: 394927 - protein, 10 aa, Mycobacterium
DGSDNDYQRY

SEQ ID NO: 394928 - protein, 8 aa, Mycobacterium
DGSDSSLR

SEQ ID NO: 394929 - protein, 10 aa, Mycobacterium
DGSDVGGGAS

SEQ ID NO: 394930 - protein, 5 aa, Mycobacterium
DGSES

SEQ ID NO: 394931 - protein, 4 aa, Mycobacterium
DGSL

SEQ ID NO: 394932 - protein, 10 aa, Mycobacterium
DGSPASERAT

SEQ ID NO: 394933 - protein, 8 aa, Mycobacterium
DGSPASNA

SEQ ID NO: 394934 - protein, 5 aa, Mycobacterium
DGSPV

SEQ ID NO: 394935 - protein, 10 aa, Mycobacterium
DGSTDGTGDI

SEQ ID NO: 394936 - protein, 13 aa, Mycobacterium
DGSTLAQASPPDM

SEQ ID NO: 394937 - protein, 8 aa, Mycobacterium
DGSTNLGA

SEQ ID NO: 394938 - protein, 6 aa, Mycobacterium
DGSVSA

SEQ ID NO: 394939 - protein, 4 aa, Mycobacterium
DGTA

SEQ ID NO: 394940 - protein, 4 aa, Mycobacterium
DGTC

SEQ ID NO: 394941 - protein, 5 aa, Mycobacterium
DGTDA

SEQ ID NO: 394942 - protein, 17 aa, Mycobacterium
DGTEDYWSDEYRDLIEL

SEQ ID NO: 394943 - protein, 5 aa, Mycobacterium
DGTEL

SEQ ID NO: 394944 - protein, 6 aa, Mycobacterium
DGTELA

SEQ ID NO: 394945 - protein, 13 aa, Mycobacterium
DGTEVATSPLATE

SEQ ID NO: 394946 - protein, 4 aa, Mycobacterium
DGTF

SEQ ID NO: 394947 - protein, 8 aa, Mycobacterium
DGTGGYRG

SEQ ID NO: 394948 - protein, 8 aa, Mycobacterium
DGTGQVDV

SEQ ID NO: 394949 - protein, 8 aa, Mycobacterium
DGTGSELT

SEQ ID NO: 394950 - protein, 12 aa, Mycobacterium
DGTHGGTGGGNH

SEQ ID NO: 394951 - protein, 5 aa, Mycobacterium
DGTLP

SEQ ID NO: 394952 - protein, 9 aa, Mycobacterium
DGTLPPAAG

SEQ ID NO: 394953 - protein, 4 aa, Mycobacterium
DGTN

SEQ ID NO: 394954 - protein, 5 aa, Mycobacterium
DGTPF

SEQ ID NO: 394955 - protein, 5 aa, Mycobacterium
DGTPI

SEQ ID NO: 394956 - protein, 6 aa, Mycobacterium
DGTQTE

SEQ ID NO: 394957 - protein, 5 aa, Mycobacterium
DGTQV

SEQ ID NO: 394958 - protein, 6 aa, Mycobacterium
DGTRLK

SEQ ID NO: 394959 - protein, 5 aa, Mycobacterium
DGTTK

SEQ ID NO: 394960 - protein, 5 aa, Mycobacterium
DGTVS

SEQ ID NO: 394961 - protein, 5 aa, Mycobacterium
DGVGG

SEQ ID NO: 394962 - protein, 7 aa, Mycobacterium
DGVGWGE

SEQ ID NO: 394963 - protein, 5 aa, Mycobacterium
DGVRT

SEQ ID NO: 394964 - protein, 6 aa, Mycobacterium
DGVRTP

SEQ ID NO: 394965 - protein, 18 aa, Mycobacterium
DGVSGGQLADRARRQAEK

SEQ ID NO: 394966 - protein, 5 aa, Mycobacterium
DGVTA

SEQ ID NO: 394967 - protein, 10 aa, Mycobacterium
DGVTDVPASA

SEQ ID NO: 394968 - protein, 7 aa, Mycobacterium
DGYNGTM

SEQ ID NO: 394969 - protein, 4 aa, Mycobacterium
DGYQ

SEQ ID NO: 394970 - protein, 5 aa, Mycobacterium
DGYSE

SEQ ID NO: 394971 - protein, 6 aa, Mycobacterium
DGYTGR

SEQ ID NO: 394972 - protein, 6 aa, Mycobacterium
DGYVRG

SEQ ID NO: 394973 - protein, 8 aa, Mycobacterium
DHATPTAL

SEQ ID NO: 394974 - protein, 7 aa, Mycobacterium
DHDKDQS

SEQ ID NO: 394975 - protein, 7 aa, Mycobacterium
DHDQTDR

SEQ ID NO: 394976 - protein, 7 aa, Mycobacterium
DHDQTER

SEQ ID NO: 394977 - protein, 6 aa, Mycobacterium
DHDTEG

SEQ ID NO: 394978 - protein, 4 aa, Mycobacterium
DHEN

SEQ ID NO: 394979 - protein, 9 aa, Mycobacterium
DHETFSSAQ

SEQ ID NO: 394980 - protein, 9 aa, Mycobacterium
DHGDERVGQ

SEQ ID NO: 394981 - protein, 5 aa, Mycobacterium
DHGEV

SEQ ID NO: 394982 - protein, 11 aa, Mycobacterium
DHNGASHQDPG

SEQ ID NO: 394983 - protein, 8 aa, Mycobacterium
DHNPIHTN

SEQ ID NO: 394984 - protein, 5 aa, Mycobacterium
DHPAG

SEQ ID NO: 394985 - protein, 7 aa, Mycobacterium
DHPAPSQ

SEQ ID NO: 394986 - protein, 8 aa, Mycobacterium
DHPAPSQR

SEQ ID NO: 394987 - protein, 7 aa, Mycobacterium
DHPDTAE

SEQ ID NO: 394988 - protein, 4 aa, Mycobacterium
DHPG

SEQ ID NO: 394989 - protein, 7 aa, Mycobacterium
DHPGDPR

SEQ ID NO: 394990 - protein, 7 aa, Mycobacterium
DHPLNDP

SEQ ID NO: 394991 - protein, 10 aa, Mycobacterium
DHPPQTTRAR

SEQ ID NO: 394992 - protein, 4 aa, Mycobacterium
DHTG

SEQ ID NO: 394993 - protein, 7 aa, Mycobacterium
DIARAAG

SEQ ID NO: 394994 - protein, 5 aa, Mycobacterium
DIDPE

SEQ ID NO: 394995 - protein, 9 aa, Mycobacterium
DIDPEETSE

SEQ ID NO: 394996 - protein, 7 aa, Mycobacterium
DIEAGTV

SEQ ID NO: 394997 - protein, 9 aa, Mycobacterium
DIGQPASVR

SEQ ID NO: 394998 - protein, 12 aa, Mycobacterium
DIGRGRHTSTQS

SEQ ID NO: 394999 - protein, 6 aa, Mycobacterium
DIGSSE

SEQ ID NO: 395000 - protein, 7 aa, Mycobacterium
DIGTGTW

SEQ ID NO: 395001 - protein, 19 aa, Mycobacterium
DIKPRSRDVTDGLEKAAAR

SEQ ID NO: 395002 - protein, 8 aa, Mycobacterium
DIPAADRY

SEQ ID NO: 395003 - protein, 7 aa, Mycobacterium
DIPDGGT

SEQ ID NO: 395004 - protein, 5 aa, Mycobacterium
DIPEG

SEQ ID NO: 395005 - protein, 12 aa, Mycobacterium
DIPESGKMTGRP

SEQ ID NO: 395006 - protein, 13 aa, Mycobacterium
DIPSALTTPEAPA

SEQ ID NO: 395007 - protein, 6 aa, Mycobacterium
DIPTPA

SEQ ID NO: 395008 - protein, 5 aa, Mycobacterium
DIRDP

SEQ ID NO: 395009 - protein, 8 aa, Mycobacterium
DISGETPF

SEQ ID NO: 395010 - protein, 10 aa, Mycobacterium
DISGPDTTSY

SEQ ID NO: 395011 - protein, 11 aa, Mycobacterium
DISQRSTADEL

SEQ ID NO: 395012 - protein, 6 aa, Mycobacterium
DISSTD

SEQ ID NO: 395013 - protein, 4 aa, Mycobacterium
DITA

SEQ ID NO: 395014 - protein, 6 aa, Mycobacterium
DITPTG

SEQ ID NO: 395015 - protein, 15 aa, Mycobacterium
DKAEQAQAAGADIVG

SEQ ID NO: 395016 - protein, 18 aa, Mycobacterium
DKAGAAALAPTRRAQDAF

SEQ ID NO: 395017 - protein, 7 aa, Mycobacterium
DKANTKD

SEQ ID NO: 395018 - protein, 4 aa, Mycobacterium
DKDG

SEQ ID NO: 395019 - protein, 7 aa, Mycobacterium
DKDGVNA

SEQ ID NO: 395020 - protein, 5 aa, Mycobacterium
DKEGT

SEQ ID NO: 395021 - protein, 6 aa, Mycobacterium
DKENNV

SEQ ID NO: 395022 - protein, 4 aa, Mycobacterium
DKER

SEQ ID NO: 395023 - protein, 6 aa, Mycobacterium
DKFTRD

SEQ ID NO: 395024 - protein, 6 aa, Mycobacterium
DKFTRE

SEQ ID NO: 395025 - protein, 4 aa, Mycobacterium
DKGI

SEQ ID NO: 395026 - protein, 4 aa, Mycobacterium
DKGK

SEQ ID NO: 395027 - protein, 8 aa, Mycobacterium
DKGTATFS

SEQ ID NO: 395028 - protein, 4 aa, Mycobacterium
DKGV

SEQ ID NO: 395029 - protein, 7 aa, Mycobacterium
DKHGNPV

SEQ ID NO: 395030 - protein, 6 aa, Mycobacterium
DKLNGL

SEQ ID NO: 395031 - protein, 4 aa, Mycobacterium
DKMG

SEQ ID NO: 395032 - protein, 4 aa, Mycobacterium
DKPA

SEQ ID NO: 395033 - protein, 5 aa, Mycobacterium
DKPAV

SEQ ID NO: 395034 - protein, 6 aa, Mycobacterium
DKPDDV

SEQ ID NO: 395035 - protein, 6 aa, Mycobacterium
DKPGVA

SEQ ID NO: 395036 - protein, 7 aa, Mycobacterium
DKPHPRG

SEQ ID NO: 395037 - protein, 8 aa, Mycobacterium
DKPNNGDA

SEQ ID NO: 395038 - protein, 8 aa, Mycobacterium
DKPNNGEA

SEQ ID NO: 395039 - protein, 7 aa, Mycobacterium
DKPPGVA

SEQ ID NO: 395040 - protein, 7 aa, Mycobacterium
DKPRPHR

SEQ ID NO: 395041 - protein, 6 aa, Mycobacterium
DKPTVG

SEQ ID NO: 395042 - protein, 4 aa, Mycobacterium
DKQL

SEQ ID NO: 395043 - protein, 4 aa, Mycobacterium
DKRK

SEQ ID NO: 395044 - protein, 9 aa, Mycobacterium
DKSGADDPE

SEQ ID NO: 395045 - protein, 18 aa, Mycobacterium
DKTRQARPRRATARPLAT

SEQ ID NO: 395046 - protein, 13 aa, Mycobacterium
DKVDTEIPSPAAG

SEQ ID NO: 395047 - protein, 12 aa, Mycobacterium
DKVDTEIPSPVA

SEQ ID NO: 395048 - protein, 8 aa, Mycobacterium
DKVGRDAG

SEQ ID NO: 395049 - protein, 5 aa, Mycobacterium
DKVSI

SEQ ID NO: 395050 - protein, 6 aa, Mycobacterium
DKVSVN

SEQ ID NO: 395051 - protein, 4 aa, Mycobacterium
DLAE

SEQ ID NO: 395052 - protein, 4 aa, Mycobacterium
DLAS

SEQ ID NO: 395053 - protein, 12 aa, Mycobacterium
DLATLDSAEGVP

SEQ ID NO: 395054 - protein, 13 aa, Mycobacterium
DLDATSKAQLDRG

SEQ ID NO: 395055 - protein, 13 aa, Mycobacterium
DLDATSKAQLERG

SEQ ID NO: 395056 - protein, 9 aa, Mycobacterium
DLDGREAVD

SEQ ID NO: 395057 - protein, 7 aa, Mycobacterium
DLDGSDP

SEQ ID NO: 395058 - protein, 7 aa, Mycobacterium
DLEPAGT

SEQ ID NO: 395059 - protein, 4 aa, Mycobacterium
DLES

SEQ ID NO: 395060 - protein, 8 aa, Mycobacterium
DLGAPYQP

SEQ ID NO: 395061 - protein, 6 aa, Mycobacterium
DLGDPA

SEQ ID NO: 395062 - protein, 5 aa, Mycobacterium
DLGGA

SEQ ID NO: 395063 - protein, 7 aa, Mycobacterium
DLGGSDP

SEQ ID NO: 395064 - protein, 9 aa, Mycobacterium
DLGGTDPEL

SEQ ID NO: 395065 - protein, 15 aa, Mycobacterium
DLGPGTSTSAATRAL

SEQ ID NO: 395066 - protein, 7 aa, Mycobacterium
DLGQGQD

SEQ ID NO: 395067 - protein, 13 aa, Mycobacterium
DLGSARESGPTFD

SEQ ID NO: 395068 - protein, 4 aa, Mycobacterium
DLGT

SEQ ID NO: 395069 - protein, 8 aa, Mycobacterium
DLKDKAPR

SEQ ID NO: 395070 - protein, 5 aa, Mycobacterium
DLNDP

SEQ ID NO: 395071 - protein, 6 aa, Mycobacterium
DLPADV

SEQ ID NO: 395072 - protein, 10 aa, Mycobacterium
DLPDESDPVE

SEQ ID NO: 395073 - protein, 7 aa, Mycobacterium
DLPDPPR

SEQ ID NO: 395074 - protein, 5 aa, Mycobacterium
DLPGD

SEQ ID NO: 395075 - protein, 8 aa, Mycobacterium
DLPGPGAI

SEQ ID NO: 395076 - protein, 5 aa, Mycobacterium
DLPPL

SEQ ID NO: 395077 - protein, 5 aa, Mycobacterium
DLPPR

SEQ ID NO: 395078 - protein, 6 aa, Mycobacterium
DLPPSH

SEQ ID NO: 395079 - protein, 6 aa, Mycobacterium
DLPRGD

SEQ ID NO: 395080 - protein, 12 aa, Mycobacterium
DLPSRELNPNET

SEQ ID NO: 395081 - protein, 9 aa, Mycobacterium
DLPTAEADI

SEQ ID NO: 395082 - protein, 8 aa, Mycobacterium
DLPTPAGF

SEQ ID NO: 395083 - protein, 9 aa, Mycobacterium
DLPTPAGFA

SEQ ID NO: 395084 - protein, 5 aa, Mycobacterium
DLRPG

SEQ ID NO: 395085 - protein, 4 aa, Mycobacterium
DLSR

SEQ ID NO: 395086 - protein, 8 aa, Mycobacterium
DLSRPTPC

SEQ ID NO: 395087 - protein, 7 aa, Mycobacterium
DLSSTDM

SEQ ID NO: 395088 - protein, 7 aa, Mycobacterium
DLTDRRN

SEQ ID NO: 395089 - protein, 7 aa, Mycobacterium
DLTGRRP

SEQ ID NO: 395090 - protein, 8 aa, Mycobacterium
DLTPKNQE

SEQ ID NO: 395091 - protein, 7 aa, Mycobacterium
DLTPQNQ

SEQ ID NO: 395092 - protein, 6 aa, Mycobacterium
DMANNQ

SEQ ID NO: 395093 - protein, 4 aa, Mycobacterium
DMDG

SEQ ID NO: 395094 - protein, 5 aa, Mycobacterium
DMKSG

SEQ ID NO: 395095 - protein, 5 aa, Mycobacterium
DMNTD

SEQ ID NO: 395096 - protein, 6 aa, Mycobacterium
DMSGYA

SEQ ID NO: 395097 - protein, 8 aa, Mycobacterium
DMSGYAGT

SEQ ID NO: 395098 - protein, 7 aa, Mycobacterium
DMTKDND

SEQ ID NO: 395099 - protein, 4 aa, Mycobacterium
DMTS

SEQ ID NO: 395100 - protein, 9 aa, Mycobacterium
DNADEATRN

SEQ ID NO: 395101 - protein, 5 aa, Mycobacterium
DNADM

SEQ ID NO: 395102 - protein, 6 aa, Mycobacterium
DNAQLE

SEQ ID NO: 395103 - protein, 8 aa, Mycobacterium
DNASGVNA

SEQ ID NO: 395104 - protein, 8 aa, Mycobacterium
DNEASDKA

SEQ ID NO: 395105 - protein, 9 aa, Mycobacterium
DNEASDKAA

SEQ ID NO: 395106 - protein, 4 aa, Mycobacterium
DNET

SEQ ID NO: 395107 - protein, 8 aa, Mycobacterium
DNGAGKST

SEQ ID NO: 395108 - protein, 6 aa, Mycobacterium
DNGGGA

SEQ ID NO: 395109 - protein, 4 aa, Mycobacterium
DNGI

SEQ ID NO: 395110 - protein, 4 aa, Mycobacterium
DNGV

SEQ ID NO: 395111 - protein, 6 aa, Mycobacterium
DNHAEE

SEQ ID NO: 395112 - protein, 9 aa, Mycobacterium
DNLGSGADL

SEQ ID NO: 395113 - protein, 4 aa, Mycobacterium
DNLT

SEQ ID NO: 395114 - protein, 8 aa, Mycobacterium
DNNLHSRG

SEQ ID NO: 395115 - protein, 4 aa, Mycobacterium
DNNP

SEQ ID NO: 395116 - protein, 7 aa, Mycobacterium
DNPASRI

SEQ ID NO: 395117 - protein, 4 aa, Mycobacterium
DNPE

SEQ ID NO: 395118 - protein, 9 aa, Mycobacterium
DNPLRGAPH

SEQ ID NO: 395119 - protein, 6 aa, Mycobacterium
DNPTSL

SEQ ID NO: 395120 - protein, 4 aa, Mycobacterium
DNQM

SEQ ID NO: 395121 - protein, 5 aa, Mycobacterium
DNRDE

SEQ ID NO: 395122 - protein, 9 aa, Mycobacterium
DNRNRAAGE

SEQ ID NO: 395123 - protein, 7 aa, Mycobacterium
DNSDNAL

SEQ ID NO: 395124 - protein, 4 aa, Mycobacterium
DNSK

SEQ ID NO: 395125 - protein, 4 aa, Mycobacterium
DNST

SEQ ID NO: 395126 - protein, 10 aa, Mycobacterium
DNSTAAPPLT

SEQ ID NO: 395127 - protein, 6 aa, Mycobacterium
DNSTTW

SEQ ID NO: 395128 - protein, 8 aa, Mycobacterium
DNTSTVPG

SEQ ID NO: 395129 - protein, 4 aa, Mycobacterium
DNYA

SEQ ID NO: 395130 - protein, 13 aa, Mycobacterium
DNYQPESMAGAQP

SEQ ID NO: 395131 - protein, 7 aa, Mycobacterium
DPAAHVG

SEQ ID NO: 395132 - protein, 9 aa, Mycobacterium
DPAATAAAI

SEQ ID NO: 395133 - protein, 4 aa, Mycobacterium
DPAD

SEQ ID NO: 395134 - protein, 7 aa, Mycobacterium
DPADTRT

SEQ ID NO: 395135 - protein, 5 aa, Mycobacterium
DPAET

SEQ ID NO: 395136 - protein, 6 aa, Mycobacterium
DPAETR

SEQ ID NO: 395137 - protein, 5 aa, Mycobacterium
DPAGL

SEQ ID NO: 395138 - protein, 6 aa, Mycobacterium
DPAGTT

SEQ ID NO: 395139 - protein, 4 aa, Mycobacterium
DPAI

SEQ ID NO: 395140 - protein, 9 aa, Mycobacterium
DPAKPKALH

SEQ ID NO: 395141 - protein, 4 aa, Mycobacterium
DPAP

SEQ ID NO: 395142 - protein, 5 aa, Mycobacterium
DPAPP

SEQ ID NO: 395143 - protein, 4 aa, Mycobacterium
DPAQ

SEQ ID NO: 395144 - protein, 5 aa, Mycobacterium
DPARA

SEQ ID NO: 395145 - protein, 7 aa, Mycobacterium
DPARGGV

SEQ ID NO: 395146 - protein, 5 aa, Mycobacterium
DPARR

SEQ ID NO: 395147 - protein, 8 aa, Mycobacterium
DPARRGET

SEQ ID NO: 395148 - protein, 5 aa, Mycobacterium
DPART

SEQ ID NO: 395149 - protein, 4 aa, Mycobacterium
DPAS

SEQ ID NO: 395150 - protein, 6 aa, Mycobacterium
DPASID

SEQ ID NO: 395151 - protein, 8 aa, Mycobacterium
DPASLTPE

SEQ ID NO: 395152 - protein, 8 aa, Mycobacterium
DPATDYTG

SEQ ID NO: 395153 - protein, 7 aa, Mycobacterium
DPATKTL

SEQ ID NO: 395154 - protein, 10 aa, Mycobacterium
DPATQAPSAE

SEQ ID NO: 395155 - protein, 4 aa, Mycobacterium
DPAV

SEQ ID NO: 395156 - protein, 7 aa, Mycobacterium
DPAYQTE

SEQ ID NO: 395157 - protein, 9 aa, Mycobacterium
DPDADDPHI

SEQ ID NO: 395158 - protein, 9 aa, Mycobacterium
DPDAPKHKG

SEQ ID NO: 395159 - protein, 7 aa, Mycobacterium
DPDAPSL

SEQ ID NO: 395160 - protein, 8 aa, Mycobacterium
DPDARTAD

SEQ ID NO: 395161 - protein, 9 aa, Mycobacterium
DPDASAAAL

SEQ ID NO: 395162 - protein, 5 aa, Mycobacterium
DPDAV

SEQ ID NO: 395163 - protein, 4 aa, Mycobacterium
DPDD

SEQ ID NO: 395164 - protein, 36 aa, Mycobacterium
DPDDASRPEPGTSARAQQGDRGPRTRSVDDADTSVD

SEQ ID NO: 395165 - protein, 6 aa, Mycobacterium
DPDDLD

SEQ ID NO: 395166 - protein, 7 aa, Mycobacterium
DPDFQAG

SEQ ID NO: 395167 - protein, 5 aa, Mycobacterium
DPDGG

SEQ ID NO: 395168 - protein, 6 aa, Mycobacterium
DPDGRT

SEQ ID NO: 395169 - protein, 5 aa, Mycobacterium
DPDGT

SEQ ID NO: 395170 - protein, 6 aa, Mycobacterium
DPDHTI

SEQ ID NO: 395171 - protein, 4 aa, Mycobacterium
DPDI

SEQ ID NO: 395172 - protein, 14 aa, Mycobacterium
DPDLGKKVEEGVRG

SEQ ID NO: 395173 - protein, 7 aa, Mycobacterium
DPDLTPA

SEQ ID NO: 395174 - protein, 4 aa, Mycobacterium
DPDN

SEQ ID NO: 395175 - protein, 11 aa, Mycobacterium
DPDPANVGRQF

SEQ ID NO: 395176 - protein, 8 aa, Mycobacterium
DPDPDALG

SEQ ID NO: 395177 - protein, 8 aa, Mycobacterium
DPDPDGPL

SEQ ID NO: 395178 - protein, 17 aa, Mycobacterium
DPDPDTPHKSYASTGGF

SEQ ID NO: 395179 - protein, 6 aa, Mycobacterium
DPDPDV

SEQ ID NO: 395180 - protein, 5 aa, Mycobacterium
DPDQV

SEQ ID NO: 395181 - protein, 4 aa, Mycobacterium
DPDR

SEQ ID NO: 395182 - protein, 8 aa, Mycobacterium
DPDRDKPS

SEQ ID NO: 395183 - protein, 5 aa, Mycobacterium
DPDRK

SEQ ID NO: 395184 - protein, 8 aa, Mycobacterium
DPDRPLSD

SEQ ID NO: 395185 - protein, 5 aa, Mycobacterium
DPDRS

SEQ ID NO: 395186 - protein, 5 aa, Mycobacterium
DPDRV

SEQ ID NO: 395187 - protein, 9 aa, Mycobacterium
DPDTAREYH

SEQ ID NO: 395188 - protein, 7 aa, Mycobacterium
DPDTATT

SEQ ID NO: 395189 - protein, 8 aa, Mycobacterium
DPDTGRAT

SEQ ID NO: 395190 - protein, 7 aa, Mycobacterium
DPDTVTQ

SEQ ID NO: 395191 - protein, 12 aa, Mycobacterium
DPDYARSQGQRT

SEQ ID NO: 395192 - protein, 6 aa, Mycobacterium
DPEAAA

SEQ ID NO: 395193 - protein, 4 aa, Mycobacterium
DPED

SEQ ID NO: 395194 - protein, 20 aa, Mycobacterium
DPEDLARGQDVDPAAGPGYA

SEQ ID NO: 395195 - protein, 8 aa, Mycobacterium
DPEDSEDV

SEQ ID NO: 395196 - protein, 5 aa, Mycobacterium
DPEGA

SEQ ID NO: 395197 - protein, 5 aa, Mycobacterium
DPEGV

SEQ ID NO: 395198 - protein, 6 aa, Mycobacterium
DPEIAR

SEQ ID NO: 395199 - protein, 4 aa, Mycobacterium
DPEL

SEQ ID NO: 395200 - protein, 5 aa, Mycobacterium
DPEPG

SEQ ID NO: 395201 - protein, 10 aa, Mycobacterium
DPEPGAPGKV

SEQ ID NO: 395202 - protein, 11 aa, Mycobacterium
DPEPGVPGRSV

SEQ ID NO: 395203 - protein, 5 aa, Mycobacterium
DPEQA

SEQ ID NO: 395204 - protein, 5 aa, Mycobacterium
DPESA

SEQ ID NO: 395205 - protein, 5 aa, Mycobacterium
DPETN

SEQ ID NO: 395206 - protein, 5 aa, Mycobacterium
DPEVD

SEQ ID NO: 395207 - protein, 8 aa, Mycobacterium
DPEYADNT

SEQ ID NO: 395208 - protein, 6 aa, Mycobacterium
DPGADD

SEQ ID NO: 395209 - protein, 10 aa, Mycobacterium
DPGAQSPRES

SEQ ID NO: 395210 - protein, 6 aa, Mycobacterium
DPGAVT

SEQ ID NO: 395211 - protein, 11 aa, Mycobacterium
DPGEGTQAKRR

SEQ ID NO: 395212 - protein, 12 aa, Mycobacterium
DPGEGTQAKRRA

SEQ ID NO: 395213 - protein, 5 aa, Mycobacterium
DPGEL

SEQ ID NO: 395214 - protein, 9 aa, Mycobacterium
DPGGGYGHP

SEQ ID NO: 395215 - protein, 5 aa, Mycobacterium
DPGLD

SEQ ID NO: 395216 - protein, 4 aa, Mycobacterium
DPGM

SEQ ID NO: 395217 - protein, 10 aa, Mycobacterium
DPGMRTAAPP

SEQ ID NO: 395218 - protein, 9 aa, Mycobacterium
DPGNPAVAA

SEQ ID NO: 395219 - protein, 10 aa, Mycobacterium
DPGPCGPASR

SEQ ID NO: 395220 - protein, 9 aa, Mycobacterium
DPGPDDDEH

SEQ ID NO: 395221 - protein, 7 aa, Mycobacterium
DPGPRDM

SEQ ID NO: 395222 - protein, 4 aa, Mycobacterium
DPGQ

SEQ ID NO: 395223 - protein, 15 aa, Mycobacterium
DPGQKSDDVSGSGSY

SEQ ID NO: 395224 - protein, 9 aa, Mycobacterium
DPGRGGSDH

SEQ ID NO: 395225 - protein, 11 aa, Mycobacterium
DPGRPPRSGAD

SEQ ID NO: 395226 - protein, 9 aa, Mycobacterium
DPGSGRVTA

SEQ ID NO: 395227 - protein, 5 aa, Mycobacterium
DPGSP

SEQ ID NO: 395228 - protein, 4 aa, Mycobacterium
DPGT

SEQ ID NO: 395229 - protein, 7 aa, Mycobacterium
DPHATPR

SEQ ID NO: 395230 - protein, 9 aa, Mycobacterium
DPHESGTAV

SEQ ID NO: 395231 - protein, 4 aa, Mycobacterium
DPHG

SEQ ID NO: 395232 - protein, 8 aa, Mycobacterium
DPHGPLDR

SEQ ID NO: 395233 - protein, 4 aa, Mycobacterium
DPHI

SEQ ID NO: 395234 - protein, 4 aa, Mycobacterium
DPHR

SEQ ID NO: 395235 - protein, 5 aa, Mycobacterium
DPHTG

SEQ ID NO: 395236 - protein, 19 aa, Mycobacterium
DPIGPSAFDPEGKGHRGRD

SEQ ID NO: 395237 - protein, 8 aa, Mycobacterium
DPIPGNDA

SEQ ID NO: 395238 - protein, 6 aa, Mycobacterium
DPITAA

SEQ ID NO: 395239 - protein, 4 aa, Mycobacterium
DPIY

SEQ ID NO: 395240 - protein, 8 aa, Mycobacterium
DPKAEPSI

SEQ ID NO: 395241 - protein, 9 aa, Mycobacterium
DPKAPSLTD

SEQ ID NO: 395242 - protein, 4 aa, Mycobacterium
DPKH

SEQ ID NO: 395243 - protein, 4 aa, Mycobacterium
DPKI

SEQ ID NO: 395244 - protein, 5 aa, Mycobacterium
DPKIS

SEQ ID NO: 395245 - protein, 6 aa, Mycobacterium
DPKLTA

SEQ ID NO: 395246 - protein, 4 aa, Mycobacterium
DPLD

SEQ ID NO: 395247 - protein, 5 aa, Mycobacterium
DPLGG

SEQ ID NO: 395248 - protein, 6 aa, Mycobacterium
DPLGPY

SEQ ID NO: 395249 - protein, 7 aa, Mycobacterium
DPLRDDG

SEQ ID NO: 395250 - protein, 5 aa, Mycobacterium
DPLRP

SEQ ID NO: 395251 - protein, 7 aa, Mycobacterium
DPLSEDD

SEQ ID NO: 395252 - protein, 8 aa, Mycobacterium
DPLSEDDW

SEQ ID NO: 395253 - protein, 5 aa, Mycobacterium
DPNAP

SEQ ID NO: 395254 - protein, 9 aa, Mycobacterium
DPNGGYGHP

SEQ ID NO: 395255 - protein, 15 aa, Mycobacterium
DPNGIAGGGAGRLSA

SEQ ID NO: 395256 - protein, 9 aa, Mycobacterium
DPNGRLTPL

SEQ ID NO: 395257 - protein, 8 aa, Mycobacterium
DPNNEPGR

SEQ ID NO: 395258 - protein, 8 aa, Mycobacterium
DPNPINAG

SEQ ID NO: 395259 - protein, 12 aa, Mycobacterium
DPNPPGPESDYR

SEQ ID NO: 395260 - protein, 8 aa, Mycobacterium
DPNTGQVQ

SEQ ID NO: 395261 - protein, 4 aa, Mycobacterium
DPNV

SEQ ID NO: 395262 - protein, 4 aa, Mycobacterium
DPPA

SEQ ID NO: 395263 - protein, 5 aa, Mycobacterium
DPPDH

SEQ ID NO: 395264 - protein, 5 aa, Mycobacterium
DPPES

SEQ ID NO: 395265 - protein, 4 aa, Mycobacterium
DPPH

SEQ ID NO: 395266 - protein, 7 aa, Mycobacterium
DPPWPED

SEQ ID NO: 395267 - protein, 4 aa, Mycobacterium
DPQF

SEQ ID NO: 395268 - protein, 9 aa, Mycobacterium
DPQGNASTA

SEQ ID NO: 395269 - protein, 10 aa, Mycobacterium
DPQIARREAA

SEQ ID NO: 395270 - protein, 5 aa, Mycobacterium
DPQLR

SEQ ID NO: 395271 - protein, 9 aa, Mycobacterium
DPQPGTGFA

SEQ ID NO: 395272 - protein, 6 aa, Mycobacterium
DPQPGV

SEQ ID NO: 395273 - protein, 4 aa, Mycobacterium
DPQQ

SEQ ID NO: 395274 - protein, 4 aa, Mycobacterium
DPQR

SEQ ID NO: 395275 - protein, 5 aa, Mycobacterium
DPQRL

SEQ ID NO: 395276 - protein, 8 aa, Mycobacterium
DPQTARPV

SEQ ID NO: 395277 - protein, 4 aa, Mycobacterium
DPRA

SEQ ID NO: 395278 - protein, 4 aa, Mycobacterium
DPRG

SEQ ID NO: 395279 - protein, 5 aa, Mycobacterium
DPRHT

SEQ ID NO: 395280 - protein, 13 aa, Mycobacterium
DPRIGDGGRGYRR

SEQ ID NO: 395281 - protein, 5 aa, Mycobacterium
DPRLD

SEQ ID NO: 395282 - protein, 6 aa, Mycobacterium
DPRLTA

SEQ ID NO: 395283 - protein, 4 aa, Mycobacterium
DPRQ

SEQ ID NO: 395284 - protein, 4 aa, Mycobacterium
DPRR

SEQ ID NO: 395285 - protein, 5 aa, Mycobacterium
DPRRL

SEQ ID NO: 395286 - protein, 7 aa, Mycobacterium
DPRSGER

SEQ ID NO: 395287 - protein, 12 aa, Mycobacterium
DPRTREQRRADA

SEQ ID NO: 395288 - protein, 7 aa, Mycobacterium
DPRTVNS

SEQ ID NO: 395289 - protein, 6 aa, Mycobacterium
DPRVGP

SEQ ID NO: 395290 - protein, 5 aa, Mycobacterium
DPSAL

SEQ ID NO: 395291 - protein, 4 aa, Mycobacterium
DPSE

SEQ ID NO: 395292 - protein, 4 aa, Mycobacterium
DPSG

SEQ ID NO: 395293 - protein, 5 aa, Mycobacterium
DPSGN

SEQ ID NO: 395294 - protein, 6 aa, Mycobacterium
DPSGNP

SEQ ID NO: 395295 - protein, 4 aa, Mycobacterium
DPSI

SEQ ID NO: 395296 - protein, 22 aa, Mycobacterium
DPSIPTDESGTRHRSAERTAIQ

SEQ ID NO: 395297 - protein, 12 aa, Mycobacterium
DPSKTAASRDKH

SEQ ID NO: 395298 - protein, 4 aa, Mycobacterium
DPSL

SEQ ID NO: 395299 - protein, 7 aa, Mycobacterium
DPSLPSA

SEQ ID NO: 395300 - protein, 5 aa, Mycobacterium
DPSLR

SEQ ID NO: 395301 - protein, 8 aa, Mycobacterium
DPSPAAQV

SEQ ID NO: 395302 - protein, 6 aa, Mycobacterium
DPSPAI

SEQ ID NO: 395303 - protein, 11 aa, Mycobacterium
DPSPGTPDGPW

SEQ ID NO: 395304 - protein, 8 aa, Mycobacterium
DPSQGMGP

SEQ ID NO: 395305 - protein, 10 aa, Mycobacterium
DPSSPYSGGA

SEQ ID NO: 395306 - protein, 11 aa, Mycobacterium
DPSSTRTGGSI

SEQ ID NO: 395307 - protein, 5 aa, Mycobacterium
DPSTD

SEQ ID NO: 395308 - protein, 6 aa, Mycobacterium
DPTAAS

SEQ ID NO: 395309 - protein, 7 aa, Mycobacterium
DPTAGAA

SEQ ID NO: 395310 - protein, 5 aa, Mycobacterium
DPTAI

SEQ ID NO: 395311 - protein, 7 aa, Mycobacterium
DPTAPSL

SEQ ID NO: 395312 - protein, 6 aa, Mycobacterium
DPTDAA

SEQ ID NO: 395313 - protein, 4 aa, Mycobacterium
DPTE

SEQ ID NO: 395314 - protein, 6 aa, Mycobacterium
DPTGPC

SEQ ID NO: 395315 - protein, 4 aa, Mycobacterium
DPTI

SEQ ID NO: 395316 - protein, 4 aa, Mycobacterium
DPTL

SEQ ID NO: 395317 - protein, 7 aa, Mycobacterium
DPTLPTE

SEQ ID NO: 395318 - protein, 6 aa, Mycobacterium
DPTLQP

SEQ ID NO: 395319 - protein, 10 aa, Mycobacterium
DPTNDSEINE

SEQ ID NO: 395320 - protein, 5 aa, Mycobacterium
DPTRF

SEQ ID NO: 395321 - protein, 6 aa, Mycobacterium
DPTRFD

SEQ ID NO: 395322 - protein, 5 aa, Mycobacterium
DPTRQ

SEQ ID NO: 395323 - protein, 16 aa, Mycobacterium
DPTWERSGHTERGRDK

SEQ ID NO: 395324 - protein, 7 aa, Mycobacterium
DPVDQPD

SEQ ID NO: 395325 - protein, 4 aa, Mycobacterium
DPVE

SEQ ID NO: 395326 - protein, 4 aa, Mycobacterium
DPVK

SEQ ID NO: 395327 - protein, 5 aa, Mycobacterium
DPVKV

SEQ ID NO: 395328 - protein, 5 aa, Mycobacterium
DPVPA

SEQ ID NO: 395329 - protein, 6 aa, Mycobacterium
DPVPDS

SEQ ID NO: 395330 - protein, 5 aa, Mycobacterium
DPVPE

SEQ ID NO: 395331 - protein, 7 aa, Mycobacterium
DPVPGPG

SEQ ID NO: 395332 - protein, 4 aa, Mycobacterium
DPVQ

SEQ ID NO: 395333 - protein, 4 aa, Mycobacterium
DPVR

SEQ ID NO: 395334 - protein, 4 aa, Mycobacterium
DPVS

SEQ ID NO: 395335 - protein, 5 aa, Mycobacterium
DPVTA

SEQ ID NO: 395336 - protein, 5 aa, Mycobacterium
DPVTG

SEQ ID NO: 395337 - protein, 4 aa, Mycobacterium
DPWE

SEQ ID NO: 395338 - protein, 4 aa, Mycobacterium
DPWT

SEQ ID NO: 395339 - protein, 9 aa, Mycobacterium
DPYADEPRL

SEQ ID NO: 395340 - protein, 4 aa, Mycobacterium
DPYP

SEQ ID NO: 395341 - protein, 4 aa, Mycobacterium
DPYY

SEQ ID NO: 395342 - protein, 6 aa, Mycobacterium
DQAIDY

SEQ ID NO: 395343 - protein, 7 aa, Mycobacterium
DQAQPAR

SEQ ID NO: 395344 - protein, 6 aa, Mycobacterium
DQDTGE

SEQ ID NO: 395345 - protein, 6 aa, Mycobacterium
DQESGE

SEQ ID NO: 395346 - protein, 9 aa, Mycobacterium
DQESWDRAK

SEQ ID NO: 395347 - protein, 7 aa, Mycobacterium
DQEWQQS

SEQ ID NO: 395348 - protein, 7 aa, Mycobacterium
DQGMDRA

SEQ ID NO: 395349 - protein, 13 aa, Mycobacterium
DQGTRKVRDHPDF

SEQ ID NO: 395350 - protein, 7 aa, Mycobacterium
DQGTTST

SEQ ID NO: 395351 - protein, 11 aa, Mycobacterium
DQHPESDAARD

SEQ ID NO: 395352 - protein, 5 aa, Mycobacterium
DQIAP

SEQ ID NO: 395353 - protein, 7 aa, Mycobacterium
DQIGEGD

SEQ ID NO: 395354 - protein, 7 aa, Mycobacterium
DQNQQRV

SEQ ID NO: 395355 - protein, 6 aa, Mycobacterium
DQPGLE

SEQ ID NO: 395356 - protein, 6 aa, Mycobacterium
DQPGRL

SEQ ID NO: 395357 - protein, 9 aa, Mycobacterium
DQPLADTAN

SEQ ID NO: 395358 - protein, 7 aa, Mycobacterium
DQPNNGD

SEQ ID NO: 395359 - protein, 4 aa, Mycobacterium
DQPT

SEQ ID NO: 395360 - protein, 5 aa, Mycobacterium
DQPWM

SEQ ID NO: 395361 - protein, 5 aa, Mycobacterium
DQPYW

SEQ ID NO: 395362 - protein, 14 aa, Mycobacterium
DQRGYGGSSRPEAI

SEQ ID NO: 395363 - protein, 6 aa, Mycobacterium
DQRPGF

SEQ ID NO: 395364 - protein, 8 aa, Mycobacterium
DQRTNACA

SEQ ID NO: 395365 - protein, 5 aa, Mycobacterium
DQSAR

SEQ ID NO: 395366 - protein, 8 aa, Mycobacterium
DQSEGTGP

SEQ ID NO: 395367 - protein, 4 aa, Mycobacterium
DQSV

SEQ ID NO: 395368 - protein, 5 aa, Mycobacterium
DQTAR

SEQ ID NO: 395369 - protein, 10 aa, Mycobacterium
DQVESTAGSL

SEQ ID NO: 395370 - protein, 4 aa, Mycobacterium
DQVP

SEQ ID NO: 395371 - protein, 19 aa, Mycobacterium
DRAAAEEKLDGVGGGSVSG

SEQ ID NO: 395372 - protein, 7 aa, Mycobacterium
DRAAAGA

SEQ ID NO: 395373 - protein, 9 aa, Mycobacterium
DRAAGRRTQ

SEQ ID NO: 395374 - protein, 8 aa, Mycobacterium
DRAAGTRR

SEQ ID NO: 395375 - protein, 5 aa, Mycobacterium
DRAAL

SEQ ID NO: 395376 - protein, 5 aa, Mycobacterium
DRAEA

SEQ ID NO: 395377 - protein, 10 aa, Mycobacterium
DRAEAETEEL

SEQ ID NO: 395378 - protein, 4 aa, Mycobacterium
DRAG

SEQ ID NO: 395379 - protein, 6 aa, Mycobacterium
DRAGER

SEQ ID NO: 395380 - protein, 6 aa, Mycobacterium
DRAGGE

SEQ ID NO: 395381 - protein, 6 aa, Mycobacterium
DRAGTI

SEQ ID NO: 395382 - protein, 4 aa, Mycobacterium
DRAH

SEQ ID NO: 395383 - protein, 16 aa, Mycobacterium
DRAKGAEVSGALNPAQ

SEQ ID NO: 395384 - protein, 9 aa, Mycobacterium
DRAKPAVPF

SEQ ID NO: 395385 - protein, 6 aa, Mycobacterium
DRAPDA

SEQ ID NO: 395386 - protein, 7 aa, Mycobacterium
DRAPLTP

SEQ ID NO: 395387 - protein, 14 aa, Mycobacterium
DRAPQERGDAARNR

SEQ ID NO: 395388 - protein, 8 aa, Mycobacterium
DRAREDPR

SEQ ID NO: 395389 - protein, 9 aa, Mycobacterium
DRARELREN

SEQ ID NO: 395390 - protein, 5 aa, Mycobacterium
DRATA

SEQ ID NO: 395391 - protein, 6 aa, Mycobacterium
DRATDL

SEQ ID NO: 395392 - protein, 8 aa, Mycobacterium
DRAVTDDR

SEQ ID NO: 395393 - protein, 8 aa, Mycobacterium
DRAYPEST

SEQ ID NO: 395394 - protein, 5 aa, Mycobacterium
DRDEA

SEQ ID NO: 395395 - protein, 8 aa, Mycobacterium
DRDGDKLD

SEQ ID NO: 395396 - protein, 12 aa, Mycobacterium
DRDGTPTHGGYS

SEQ ID NO: 395397 - protein, 6 aa, Mycobacterium
DRDGVR

SEQ ID NO: 395398 - protein, 12 aa, Mycobacterium
DRDKAQAKGSKD

SEQ ID NO: 395399 - protein, 6 aa, Mycobacterium
DRDPGV

SEQ ID NO: 395400 - protein, 4 aa, Mycobacterium
DRDS

SEQ ID NO: 395401 - protein, 5 aa, Mycobacterium
DREAM

SEQ ID NO: 395402 - protein, 14 aa, Mycobacterium
DREDQPYKESYGMA

SEQ ID NO: 395403 - protein, 8 aa, Mycobacterium
DREERPRS

SEQ ID NO: 395404 - protein, 4 aa, Mycobacterium
DREG

SEQ ID NO: 395405 - protein, 5 aa, Mycobacterium
DREGR

SEQ ID NO: 395406 - protein, 8 aa, Mycobacterium
DREPAPDL

SEQ ID NO: 395407 - protein, 8 aa, Mycobacterium
DREQRPRS

SEQ ID NO: 395408 - protein, 4 aa, Mycobacterium
DRFT

SEQ ID NO: 395409 - protein, 5 aa, Mycobacterium
DRGAG

SEQ ID NO: 395410 - protein, 5 aa, Mycobacterium
DRGAR

SEQ ID NO: 395411 - protein, 4 aa, Mycobacterium
DRGD

SEQ ID NO: 395412 - protein, 11 aa, Mycobacterium
DRGEAHPDVDP

SEQ ID NO: 395413 - protein, 7 aa, Mycobacterium
DRGETAR

SEQ ID NO: 395414 - protein, 4 aa, Mycobacterium
DRGH

SEQ ID NO: 395415 - protein, 5 aa, Mycobacterium
DRGLA

SEQ ID NO: 395416 - protein, 11 aa, Mycobacterium
DRGQPRTNSYH

SEQ ID NO: 395417 - protein, 7 aa, Mycobacterium
DRGQTWE

SEQ ID NO: 395418 - protein, 5 aa, Mycobacterium
DRGRW

SEQ ID NO: 395419 - protein, 5 aa, Mycobacterium
DRHGR

SEQ ID NO: 395420 - protein, 4 aa, Mycobacterium
DRIA

SEQ ID NO: 395421 - protein, 6 aa, Mycobacterium
DRKDGA

SEQ ID NO: 395422 - protein, 4 aa, Mycobacterium
DRKG

SEQ ID NO: 395423 - protein, 8 aa, Mycobacterium
DRKRGEKL

SEQ ID NO: 395424 - protein, 6 aa, Mycobacterium
DRLPAG

SEQ ID NO: 395425 - protein, 14 aa, Mycobacterium
DRLRGDSSAPPSYP

SEQ ID NO: 395426 - protein, 4 aa, Mycobacterium
DRLS

SEQ ID NO: 395427 - protein, 11 aa, Mycobacterium
DRNPTGSIKDR

SEQ ID NO: 395428 - protein, 7 aa, Mycobacterium
DRNQQYQ

SEQ ID NO: 395429 - protein, 4 aa, Mycobacterium
DRNR

SEQ ID NO: 395430 - protein, 4 aa, Mycobacterium
DRPA

SEQ ID NO: 395431 - protein, 13 aa, Mycobacterium
DRPAEANDRAVPG

SEQ ID NO: 395432 - protein, 7 aa, Mycobacterium
DRPATHA

SEQ ID NO: 395433 - protein, 12 aa, Mycobacterium
DRPDEMSPYAPR

SEQ ID NO: 395434 - protein, 9 aa, Mycobacterium
DRPDIQQQL

SEQ ID NO: 395435 - protein, 5 aa, Mycobacterium
DRPED

SEQ ID NO: 395436 - protein, 8 aa, Mycobacterium
DRPEDRWP

SEQ ID NO: 395437 - protein, 9 aa, Mycobacterium
DRPEERWPE

SEQ ID NO: 395438 - protein, 6 aa, Mycobacterium
DRPGFR

SEQ ID NO: 395439 - protein, 7 aa, Mycobacterium
DRPHPRG

SEQ ID NO: 395440 - protein, 12 aa, Mycobacterium
DRPISKADAVEG

SEQ ID NO: 395441 - protein, 6 aa, Mycobacterium
DRPPDA

SEQ ID NO: 395442 - protein, 6 aa, Mycobacterium
DRPPLS

SEQ ID NO: 395443 - protein, 7 aa, Mycobacterium
DRPPLSK

SEQ ID NO: 395444 - protein, 12 aa, Mycobacterium
DRPRPPQQSFRG

SEQ ID NO: 395445 - protein, 11 aa, Mycobacterium
DRPSSGPGGVA

SEQ ID NO: 395446 - protein, 4 aa, Mycobacterium
DRPV

SEQ ID NO: 395447 - protein, 7 aa, Mycobacterium
DRQAAQG

SEQ ID NO: 395448 - protein, 17 aa, Mycobacterium
DRQAARQGVGGEVLAYV

SEQ ID NO: 395449 - protein, 8 aa, Mycobacterium
DRQHPDGT

SEQ ID NO: 395450 - protein, 6 aa, Mycobacterium
DRQRAQ

SEQ ID NO: 395451 - protein, 5 aa, Mycobacterium
DRRAT

SEQ ID NO: 395452 - protein, 6 aa, Mycobacterium
DRRDGA

SEQ ID NO: 395453 - protein, 4 aa, Mycobacterium
DRRG

SEQ ID NO: 395454 - protein, 6 aa, Mycobacterium
DRRGND

SEQ ID NO: 395455 - protein, 4 aa, Mycobacterium
DRRR

SEQ ID NO: 395456 - protein, 6 aa, Mycobacterium
DRRTNQ

SEQ ID NO: 395457 - protein, 7 aa, Mycobacterium
DRRTTED

SEQ ID NO: 395458 - protein, 11 aa, Mycobacterium
DRSKAEAGDTD

SEQ ID NO: 395459 - protein, 12 aa, Mycobacterium
DRSKDVIKSGGE

SEQ ID NO: 395460 - protein, 9 aa, Mycobacterium
DRSKNNSGV

SEQ ID NO: 395461 - protein, 8 aa, Mycobacterium
DRSKVPAA

SEQ ID NO: 395462 - protein, 7 aa, Mycobacterium
DRSPGDR

SEQ ID NO: 395463 - protein, 8 aa, Mycobacterium
DRSRHDPR

SEQ ID NO: 395464 - protein, 10 aa, Mycobacterium
DRSRKVADGR

SEQ ID NO: 395465 - protein, 4 aa, Mycobacterium
DRTA

SEQ ID NO: 395466 - protein, 7 aa, Mycobacterium
DRTAARA

SEQ ID NO: 395467 - protein, 4 aa, Mycobacterium
DRTD

SEQ ID NO: 395468 - protein, 4 aa, Mycobacterium
DRTG

SEQ ID NO: 395469 - protein, 5 aa, Mycobacterium
DRTGA

SEQ ID NO: 395470 - protein, 5 aa, Mycobacterium
DRTPV

SEQ ID NO: 395471 - protein, 4 aa, Mycobacterium
DRTR

SEQ ID NO: 395472 - protein, 5 aa, Mycobacterium
DRTRR

SEQ ID NO: 395473 - protein, 4 aa, Mycobacterium
DRTV

SEQ ID NO: 395474 - protein, 4 aa, Mycobacterium
DRVD

SEQ ID NO: 395475 - protein, 6 aa, Mycobacterium
DRVGGR

SEQ ID NO: 395476 - protein, 7 aa, Mycobacterium
DRVGGRT

SEQ ID NO: 395477 - protein, 8 aa, Mycobacterium
DRVGKRGL

SEQ ID NO: 395478 - protein, 5 aa, Mycobacterium
DRVSP

SEQ ID NO: 395479 - protein, 5 aa, Mycobacterium
DRVTG

SEQ ID NO: 395480 - protein, 6 aa, Mycobacterium
DRWEPE

SEQ ID NO: 395481 - protein, 5 aa, Mycobacterium
DRYPN

SEQ ID NO: 395482 - protein, 4 aa, Mycobacterium
DRYR

SEQ ID NO: 395483 - protein, 9 aa, Mycobacterium
DSAASSNDG

SEQ ID NO: 395484 - protein, 6 aa, Mycobacterium
DSADPL

SEQ ID NO: 395485 - protein, 7 aa, Mycobacterium
DSAEGRV

SEQ ID NO: 395486 - protein, 7 aa, Mycobacterium
DSAEGVP

SEQ ID NO: 395487 - protein, 6 aa, Mycobacterium
DSAEGY

SEQ ID NO: 395488 - protein, 5 aa, Mycobacterium
DSAEY

SEQ ID NO: 395489 - protein, 4 aa, Mycobacterium
DSAG

SEQ ID NO: 395490 - protein, 12 aa, Mycobacterium
DSAGARIQDTAT

SEQ ID NO: 395491 - protein, 6 aa, Mycobacterium
DSAGGH

SEQ ID NO: 395492 - protein, 7 aa, Mycobacterium
DSAGQRY

SEQ ID NO: 395493 - protein, 5 aa, Mycobacterium
DSARQ

SEQ ID NO: 395494 - protein, 5 aa, Mycobacterium
DSASN

SEQ ID NO: 395495 - protein, 4 aa, Mycobacterium
DSDD

SEQ ID NO: 395496 - protein, 6 aa, Mycobacterium
DSDDSR

SEQ ID NO: 395497 - protein, 5 aa, Mycobacterium
DSDER

SEQ ID NO: 395498 - protein, 4 aa, Mycobacterium
DSDF

SEQ ID NO: 395499 - protein, 11 aa, Mycobacterium
DSDGAPREGAQ

SEQ ID NO: 395500 - protein, 12 aa, Mycobacterium
DSDGHSDKRTRS

SEQ ID NO: 395501 - protein, 7 aa, Mycobacterium
DSDPFYS

SEQ ID NO: 395502 - protein, 5 aa, Mycobacterium
DSDPH

SEQ ID NO: 395503 - protein, 7 aa, Mycobacterium
DSDRAGL

SEQ ID NO: 395504 - protein, 7 aa, Mycobacterium
DSDRNGL

SEQ ID NO: 395505 - protein, 6 aa, Mycobacterium
DSDYGL

SEQ ID NO: 395506 - protein, 5 aa, Mycobacterium
DSEGC

SEQ ID NO: 395507 - protein, 7 aa, Mycobacterium
DSELNQA

SEQ ID NO: 395508 - protein, 6 aa, Mycobacterium
DSESSV

SEQ ID NO: 395509 - protein, 7 aa, Mycobacterium
DSEYNGY

SEQ ID NO: 395510 - protein, 4 aa, Mycobacterium
DSFG

SEQ ID NO: 395511 - protein, 4 aa, Mycobacterium
DSGA

SEQ ID NO: 395512 - protein, 5 aa, Mycobacterium
DSGAV

SEQ ID NO: 395513 - protein, 8 aa, Mycobacterium
DSGDRYAD

SEQ ID NO: 395514 - protein, 6 aa, Mycobacterium
DSGGAI

SEQ ID NO: 395515 - protein, 8 aa, Mycobacterium
DSGGARIQ

SEQ ID NO: 395516 - protein, 6 aa, Mycobacterium
DSGGDG

SEQ ID NO: 395517 - protein, 4 aa, Mycobacterium
DSGI

SEQ ID NO: 395518 - protein, 4 aa, Mycobacterium
DSGL

SEQ ID NO: 395519 - protein, 15 aa, Mycobacterium
DSGLRGRGGAGFSTG

SEQ ID NO: 395520 - protein, 5 aa, Mycobacterium
DSGPG

SEQ ID NO: 395521 - protein, 5 aa, Mycobacterium
DSGTR

SEQ ID NO: 395522 - protein, 5 aa, Mycobacterium
DSHKS

SEQ ID NO: 395523 - protein, 9 aa, Mycobacterium
DSHTSTHGA

SEQ ID NO: 395524 - protein, 12 aa, Mycobacterium
DSIGKPDNEGMS

SEQ ID NO: 395525 - protein, 11 aa, Mycobacterium
DSKATNPHAAE

SEQ ID NO: 395526 - protein, 9 aa, Mycobacterium
DSLATGPGV

SEQ ID NO: 395527 - protein, 7 aa, Mycobacterium
DSLDAEY

SEQ ID NO: 395528 - protein, 9 aa, Mycobacterium
DSLPSPLPT

SEQ ID NO: 395529 - protein, 9 aa, Mycobacterium
DSMAPDATT

SEQ ID NO: 395530 - protein, 6 aa, Mycobacterium
DSNERL

SEQ ID NO: 395531 - protein, 7 aa, Mycobacterium
DSNERLV

SEQ ID NO: 395532 - protein, 4 aa, Mycobacterium
DSNT

SEQ ID NO: 395533 - protein, 9 aa, Mycobacterium
DSPAQGLSR

SEQ ID NO: 395534 - protein, 6 aa, Mycobacterium
DSPDLP

SEQ ID NO: 395535 - protein, 4 aa, Mycobacterium
DSPE

SEQ ID NO: 395536 - protein, 5 aa, Mycobacterium
DSPGF

SEQ ID NO: 395537 - protein, 9 aa, Mycobacterium
DSPHNRNAL

SEQ ID NO: 395538 - protein, 8 aa, Mycobacterium
DSPLAERR

SEQ ID NO: 395539 - protein, 23 aa, Mycobacterium
DSPPPPRSGDESLGDARPGLSQA

SEQ ID NO: 395540 - protein, 7 aa, Mycobacterium
DSPPTGR

SEQ ID NO: 395541 - protein, 4 aa, Mycobacterium
DSPT

SEQ ID NO: 395542 - protein, 5 aa, Mycobacterium
DSPVG

SEQ ID NO: 395543 - protein, 5 aa, Mycobacterium
DSPVN

SEQ ID NO: 395544 - protein, 13 aa, Mycobacterium
DSPYQRPKNPDLR

SEQ ID NO: 395545 - protein, 11 aa, Mycobacterium
DSQAKTAVSSR

SEQ ID NO: 395546 - protein, 7 aa, Mycobacterium
DSQSGEQ

SEQ ID NO: 395547 - protein, 22 aa, Mycobacterium
DSRDAAGSGADRHANFGTGQID

SEQ ID NO: 395548 - protein, 10 aa, Mycobacterium
DSRDPDPRAA

SEQ ID NO: 395549 - protein, 10 aa, Mycobacterium
DSRDPDPRAS

SEQ ID NO: 395550 - protein, 7 aa, Mycobacterium
DSRPDAV

SEQ ID NO: 395551 - protein, 8 aa, Mycobacterium
DSRPLDDD

SEQ ID NO: 395552 - protein, 13 aa, Mycobacterium
DSRPTGQIGPREY

SEQ ID NO: 395553 - protein, 4 aa, Mycobacterium
DSRT

SEQ ID NO: 395554 - protein, 7 aa, Mycobacterium
DSRTTDF

SEQ ID NO: 395555 - protein, 6 aa, Mycobacterium
DSSLGD

SEQ ID NO: 395556 - protein, 14 aa, Mycobacterium
DSSNRQVREAAERA

SEQ ID NO: 395557 - protein, 7 aa, Mycobacterium
DSSPRSS

SEQ ID NO: 395558 - protein, 9 aa, Mycobacterium
DSSSRMSRI

SEQ ID NO: 395559 - protein, 4 aa, Mycobacterium
DSST

SEQ ID NO: 395560 - protein, 5 aa, Mycobacterium
DSSVP

SEQ ID NO: 395561 - protein, 4 aa, Mycobacterium
DSTA

SEQ ID NO: 395562 - protein, 8 aa, Mycobacterium
DSTGADYA

SEQ ID NO: 395563 - protein, 14 aa, Mycobacterium
DSTGASLAYSGDTG

SEQ ID NO: 395564 - protein, 9 aa, Mycobacterium
DSTTLSESA

SEQ ID NO: 395565 - protein, 6 aa, Mycobacterium
DSVEDR

SEQ ID NO: 395566 - protein, 7 aa, Mycobacterium
DSVSERV

SEQ ID NO: 395567 - protein, 12 aa, Mycobacterium
DSVTKSKFDNKY

SEQ ID NO: 395568 - protein, 8 aa, Mycobacterium
DSVTQNDI

SEQ ID NO: 395569 - protein, 6 aa, Mycobacterium
DSYGGG

SEQ ID NO: 395570 - protein, 6 aa, Mycobacterium
DTAAGW

SEQ ID NO: 395571 - protein, 4 aa, Mycobacterium
DTAD

SEQ ID NO: 395572 - protein, 12 aa, Mycobacterium
DTADNAPETRSE

SEQ ID NO: 395573 - protein, 6 aa, Mycobacterium
DTAEEA

SEQ ID NO: 395574 - protein, 7 aa, Mycobacterium
DTAGKGG

SEQ ID NO: 395575 - protein, 5 aa, Mycobacterium
DTAGL

SEQ ID NO: 395576 - protein, 13 aa, Mycobacterium
DTAGTAPPPLTRE

SEQ ID NO: 395577 - protein, 5 aa, Mycobacterium
DTAGV

SEQ ID NO: 395578 - protein, 31 aa, Mycobacterium
DTANQARQASMDRQAAGGGLGEYYSEGDTRV

SEQ ID NO: 395579 - protein, 4 aa, Mycobacterium
DTAP

SEQ ID NO: 395580 - protein, 4 aa, Mycobacterium
DTAR

SEQ ID NO: 395581 - protein, 6 aa, Mycobacterium
DTASTQ

SEQ ID NO: 395582 - protein, 6 aa, Mycobacterium
DTASVH

SEQ ID NO: 395583 - protein, 4 aa, Mycobacterium
DTAT

SEQ ID NO: 395584 - protein, 4 aa, Mycobacterium
DTAV

SEQ ID NO: 395585 - protein, 6 aa, Mycobacterium
DTAYGL

SEQ ID NO: 395586 - protein, 14 aa, Mycobacterium
DTDDTATLKYPGGE

SEQ ID NO: 395587 - protein, 8 aa, Mycobacterium
DTDEGPDA

SEQ ID NO: 395588 - protein, 6 aa, Mycobacterium
DTDGAG

SEQ ID NO: 395589 - protein, 8 aa, Mycobacterium
DTDGGIRD

SEQ ID NO: 395590 - protein, 5 aa, Mycobacterium
DTDGR

SEQ ID NO: 395591 - protein, 4 aa, Mycobacterium
DTDH

SEQ ID NO: 395592 - protein, 4 aa, Mycobacterium
DTDL

SEQ ID NO: 395593 - protein, 6 aa, Mycobacterium
DTDPDG

SEQ ID NO: 395594 - protein, 7 aa, Mycobacterium
DTDRGGK

SEQ ID NO: 395595 - protein, 9 aa, Mycobacterium
DTDSKNSTR

SEQ ID NO: 395596 - protein, 4 aa, Mycobacterium
DTDT

SEQ ID NO: 395597 - protein, 7 aa, Mycobacterium
DTDTTNT

SEQ ID NO: 395598 - protein, 5 aa, Mycobacterium
DTEAA

SEQ ID NO: 395599 - protein, 8 aa, Mycobacterium
DTEEGPDA

SEQ ID NO: 395600 - protein, 7 aa, Mycobacterium
DTEGTVA

SEQ ID NO: 395601 - protein, 4 aa, Mycobacterium
DTEN

SEQ ID NO: 395602 - protein, 5 aa, Mycobacterium
DTERS

SEQ ID NO: 395603 - protein, 8 aa, Mycobacterium
DTFGPGGS

SEQ ID NO: 395604 - protein, 6 aa, Mycobacterium
DTFQGP

SEQ ID NO: 395605 - protein, 4 aa, Mycobacterium
DTGA

SEQ ID NO: 395606 - protein, 4 aa, Mycobacterium
DTGE

SEQ ID NO: 395607 - protein, 14 aa, Mycobacterium
DTGEEFDSSWNRGE

SEQ ID NO: 395608 - protein, 8 aa, Mycobacterium
DTGEVPGG

SEQ ID NO: 395609 - protein, 10 aa, Mycobacterium
DTGGKTPLAE

SEQ ID NO: 395610 - protein, 7 aa, Mycobacterium
DTGGTIA

SEQ ID NO: 395611 - protein, 10 aa, Mycobacterium
DTGIGRRDKH

SEQ ID NO: 395612 - protein, 5 aa, Mycobacterium
DTGLS

SEQ ID NO: 395613 - protein, 10 aa, Mycobacterium
DTGPAAVPGQ

SEQ ID NO: 395614 - protein, 5 aa, Mycobacterium
DTGQP

SEQ ID NO: 395615 - protein, 5 aa, Mycobacterium
DTGRL

SEQ ID NO: 395616 - protein, 8 aa, Mycobacterium
DTGRRPED

SEQ ID NO: 395617 - protein, 6 aa, Mycobacterium
DTGRTN

SEQ ID NO: 395618 - protein, 12 aa, Mycobacterium
DTGTLTARPGAQ

SEQ ID NO: 395619 - protein, 5 aa, Mycobacterium
DTGVS

SEQ ID NO: 395620 - protein, 5 aa, Mycobacterium
DTGYV

SEQ ID NO: 395621 - protein, 4 aa, Mycobacterium
DTHP

SEQ ID NO: 395622 - protein, 5 aa, Mycobacterium
DTKAR

SEQ ID NO: 395623 - protein, 5 aa, Mycobacterium
DTKMD

SEQ ID NO: 395624 - protein, 4 aa, Mycobacterium
DTNA

SEQ ID NO: 395625 - protein, 6 aa, Mycobacterium
DTNGTV

SEQ ID NO: 395626 - protein, 9 aa, Mycobacterium
DTNRRNPGA

SEQ ID NO: 395627 - protein, 7 aa, Mycobacterium
DTNRSRQ

SEQ ID NO: 395628 - protein, 4 aa, Mycobacterium
DTNT

SEQ ID NO: 395629 - protein, 7 aa, Mycobacterium
DTPADLA

SEQ ID NO: 395630 - protein, 14 aa, Mycobacterium
DTPAQRMAALLSQA

SEQ ID NO: 395631 - protein, 6 aa, Mycobacterium
DTPHGP

SEQ ID NO: 395632 - protein, 4 aa, Mycobacterium
DTPP

SEQ ID NO: 395633 - protein, 8 aa, Mycobacterium
DTPPGTAQ

SEQ ID NO: 395634 - protein, 7 aa, Mycobacterium
DTPPGVV

SEQ ID NO: 395635 - protein, 5 aa, Mycobacterium
DTPVR

SEQ ID NO: 395636 - protein, 4 aa, Mycobacterium
DTPW

SEQ ID NO: 395637 - protein, 4 aa, Mycobacterium
DTPY

SEQ ID NO: 395638 - protein, 7 aa, Mycobacterium
DTQARPV

SEQ ID NO: 395639 - protein, 4 aa, Mycobacterium
DTQG

SEQ ID NO: 395640 - protein, 6 aa, Mycobacterium
DTQTED

SEQ ID NO: 395641 - protein, 5 aa, Mycobacterium
DTRAG

SEQ ID NO: 395642 - protein, 6 aa, Mycobacterium
DTRDRQ

SEQ ID NO: 395643 - protein, 4 aa, Mycobacterium
DTRE

SEQ ID NO: 395644 - protein, 6 aa, Mycobacterium
DTREHA

SEQ ID NO: 395645 - protein, 5 aa, Mycobacterium
DTRSR

SEQ ID NO: 395646 - protein, 6 aa, Mycobacterium
DTRTRT

SEQ ID NO: 395647 - protein, 4 aa, Mycobacterium
DTSA

SEQ ID NO: 395648 - protein, 6 aa, Mycobacterium
DTSATY

SEQ ID NO: 395649 - protein, 4 aa, Mycobacterium
DTSG

SEQ ID NO: 395650 - protein, 7 aa, Mycobacterium
DTSTPVA

SEQ ID NO: 395651 - protein, 9 aa, Mycobacterium
DTSTSTATT

SEQ ID NO: 395652 - protein, 7 aa, Mycobacterium
DTSTSTM

SEQ ID NO: 395653 - protein, 9 aa, Mycobacterium
DTSTSTTTT

SEQ ID NO: 395654 - protein, 10 aa, Mycobacterium
DTSTTGNSAL

SEQ ID NO: 395655 - protein, 7 aa, Mycobacterium
DTTAEDL

SEQ ID NO: 395656 - protein, 6 aa, Mycobacterium
DTTATA

SEQ ID NO: 395657 - protein, 4 aa, Mycobacterium
DTTD

SEQ ID NO: 395658 - protein, 5 aa, Mycobacterium
DTTPR

SEQ ID NO: 395659 - protein, 6 aa, Mycobacterium
DTTPTE

SEQ ID NO: 395660 - protein, 7 aa, Mycobacterium
DTTTPDW

SEQ ID NO: 395661 - protein, 13 aa, Mycobacterium
DTVATSSVTAYGP

SEQ ID NO: 395662 - protein, 4 aa, Mycobacterium
DTVP

SEQ ID NO: 395663 - protein, 4 aa, Mycobacterium
DTVR

SEQ ID NO: 395664 - protein, 4 aa, Mycobacterium
DTYG

SEQ ID NO: 395665 - protein, 7 aa, Mycobacterium
DTYPGRI

SEQ ID NO: 395666 - protein, 4 aa, Mycobacterium
DTYR

SEQ ID NO: 395667 - protein, 5 aa, Mycobacterium
DVAAG

SEQ ID NO: 395668 - protein, 7 aa, Mycobacterium
DVAESED

SEQ ID NO: 395669 - protein, 8 aa, Mycobacterium
DVAGGSGK

SEQ ID NO: 395670 - protein, 7 aa, Mycobacterium
DVARTGA

SEQ ID NO: 395671 - protein, 4 aa, Mycobacterium
DVDA

SEQ ID NO: 395672 - protein, 8 aa, Mycobacterium
DVDAKPAQ

SEQ ID NO: 395673 - protein, 9 aa, Mycobacterium
DVDDPHPIS

SEQ ID NO: 395674 - protein, 5 aa, Mycobacterium
DVDPR

SEQ ID NO: 395675 - protein, 4 aa, Mycobacterium
DVEA

SEQ ID NO: 395676 - protein, 4 aa, Mycobacterium
DVEE

SEQ ID NO: 395677 - protein, 8 aa, Mycobacterium
DVGAGKSL

SEQ ID NO: 395678 - protein, 5 aa, Mycobacterium
DVGER

SEQ ID NO: 395679 - protein, 8 aa, Mycobacterium
DVGGSGLR

SEQ ID NO: 395680 - protein, 8 aa, Mycobacterium
DVGNGAVQ

SEQ ID NO: 395681 - protein, 4 aa, Mycobacterium
DVGR

SEQ ID NO: 395682 - protein, 5 aa, Mycobacterium
DVGRE

SEQ ID NO: 395683 - protein, 7 aa, Mycobacterium
DVGSNRV

SEQ ID NO: 395684 - protein, 4 aa, Mycobacterium
DVIK

SEQ ID NO: 395685 - protein, 8 aa, Mycobacterium
DVIKSGGE

SEQ ID NO: 395686 - protein, 8 aa, Mycobacterium
DVKDPRGR

SEQ ID NO: 395687 - protein, 6 aa, Mycobacterium
DVMPPR

SEQ ID NO: 395688 - protein, 6 aa, Mycobacterium
DVPAAR

SEQ ID NO: 395689 - protein, 5 aa, Mycobacterium
DVPAD

SEQ ID NO: 395690 - protein, 7 aa, Mycobacterium
DVPEPLK

SEQ ID NO: 395691 - protein, 6 aa, Mycobacterium
DVPEPV

SEQ ID NO: 395692 - protein, 6 aa, Mycobacterium
DVPGGS

SEQ ID NO: 395693 - protein, 5 aa, Mycobacterium
DVPGP

SEQ ID NO: 395694 - protein, 5 aa, Mycobacterium
DVPGY

SEQ ID NO: 395695 - protein, 5 aa, Mycobacterium
DVPPE

SEQ ID NO: 395696 - protein, 6 aa, Mycobacterium
DVPTPA

SEQ ID NO: 395697 - protein, 4 aa, Mycobacterium
DVPV

SEQ ID NO: 395698 - protein, 5 aa, Mycobacterium
DVQGY

SEQ ID NO: 395699 - protein, 5 aa, Mycobacterium
DVSAG

SEQ ID NO: 395700 - protein, 19 aa, Mycobacterium
DVSARDQQKADGQWTRAKG

SEQ ID NO: 395701 - protein, 4 aa, Mycobacterium
DVSE

SEQ ID NO: 395702 - protein, 5 aa, Mycobacterium
DVSGT

SEQ ID NO: 395703 - protein, 12 aa, Mycobacterium
DVTDGLEKAAAR

SEQ ID NO: 395704 - protein, 4 aa, Mycobacterium
DVTE

SEQ ID NO: 395705 - protein, 4 aa, Mycobacterium
DVTS

SEQ ID NO: 395706 - protein, 7 aa, Mycobacterium
DWEPSDV

SEQ ID NO: 395707 - protein, 19 aa, Mycobacterium
DWPGPGEALPSGYAEQNQR

SEQ ID NO: 395708 - protein, 5 aa, Mycobacterium
DWTEP

SEQ ID NO: 395709 - protein, 8 aa, Mycobacterium
DWTPSYQR

SEQ ID NO: 395710 - protein, 10 aa, Mycobacterium
DYANKQGSPN

SEQ ID NO: 395711 - protein, 8 aa, Mycobacterium
DYARGGSA

SEQ ID NO: 395712 - protein, 4 aa, Mycobacterium
DYDD

SEQ ID NO: 395713 - protein, 4 aa, Mycobacterium
DYGS

SEQ ID NO: 395714 - protein, 4 aa, Mycobacterium
DYGT

SEQ ID NO: 395715 - protein, 5 aa, Mycobacterium
DYPDV

SEQ ID NO: 395716 - protein, 10 aa, Mycobacterium
DYPDVSPPRG

SEQ ID NO: 395717 - protein, 8 aa, Mycobacterium
DYPGVGPE

SEQ ID NO: 395718 - protein, 7 aa, Mycobacterium
DYRSTPQ

SEQ ID NO: 395719 - protein, 11 aa, Mycobacterium
DYSRRKHTEAG

SEQ ID NO: 395720 - protein, 6 aa, Mycobacterium
DYTEHA

SEQ ID NO: 395721 - protein, 4 aa, Mycobacterium
DYTG

SEQ ID NO: 395722 - protein, 7 aa, Mycobacterium
DYVPPDS

SEQ ID NO: 395723 - protein, 8 aa, Mycobacterium
EAAADDSV

SEQ ID NO: 395724 - protein, 5 aa, Mycobacterium
EAAAR

SEQ ID NO: 395725 - protein, 5 aa, Mycobacterium
EAADG

SEQ ID NO: 395726 - protein, 5 aa, Mycobacterium
EAAEA

SEQ ID NO: 395727 - protein, 8 aa, Mycobacterium
EAAEAGAE

SEQ ID NO: 395728 - protein, 5 aa, Mycobacterium
EAAGG

SEQ ID NO: 395729 - protein, 7 aa, Mycobacterium
EAAGGKG

SEQ ID NO: 395730 - protein, 14 aa, Mycobacterium
EAAGGVSTPATQDA

SEQ ID NO: 395731 - protein, 5 aa, Mycobacterium
EAAGK

SEQ ID NO: 395732 - protein, 5 aa, Mycobacterium
EAAGR

SEQ ID NO: 395733 - protein, 6 aa, Mycobacterium
EAAGRY

SEQ ID NO: 395734 - protein, 7 aa, Mycobacterium
EAAKPGS

SEQ ID NO: 395735 - protein, 11 aa, Mycobacterium
EAANGSGAISY

SEQ ID NO: 395736 - protein, 6 aa, Mycobacterium
EAAPDL

SEQ ID NO: 395737 - protein, 9 aa, Mycobacterium
EAAPTAGLM

SEQ ID NO: 395738 - protein, 6 aa, Mycobacterium
EAAPYA

SEQ ID NO: 395739 - protein, 5 aa, Mycobacterium
EAAQA

SEQ ID NO: 395740 - protein, 17 aa, Mycobacterium
EAAQKARESRRNQQQTV

SEQ ID NO: 395741 - protein, 13 aa, Mycobacterium
EAAQKGKGYSEKL

SEQ ID NO: 395742 - protein, 6 aa, Mycobacterium
EAAQLG

SEQ ID NO: 395743 - protein, 5 aa, Mycobacterium
EAARD

SEQ ID NO: 395744 - protein, 8 aa, Mycobacterium
EAARNPSR

SEQ ID NO: 395745 - protein, 13 aa, Mycobacterium
EAARREAQSAFGD

SEQ ID NO: 395746 - protein, 7 aa, Mycobacterium
EAASDID

SEQ ID NO: 395747 - protein, 5 aa, Mycobacterium
EAASG

SEQ ID NO: 395748 - protein, 10 aa, Mycobacterium
EAATKKRRGE

SEQ ID NO: 395749 - protein, 4 aa, Mycobacterium
EAAY

SEQ ID NO: 395750 - protein, 5 aa, Mycobacterium
EAAYD

SEQ ID NO: 395751 - protein, 5 aa, Mycobacterium
EADAR

SEQ ID NO: 395752 - protein, 4 aa, Mycobacterium
EADE

SEQ ID NO: 395753 - protein, 9 aa, Mycobacterium
EADEQRSGF

SEQ ID NO: 395754 - protein, 9 aa, Mycobacterium
EADESDGSL

SEQ ID NO: 395755 - protein, 5 aa, Mycobacterium
EADRL

SEQ ID NO: 395756 - protein, 8 aa, Mycobacterium
EADRPQLA

SEQ ID NO: 395757 - protein, 4 aa, Mycobacterium
EADS

SEQ ID NO: 395758 - protein, 7 aa, Mycobacterium
EADSDRD

SEQ ID NO: 395759 - protein, 4 aa, Mycobacterium
EADT

SEQ ID NO: 395760 - protein, 4 aa, Mycobacterium
EADV

SEQ ID NO: 395761 - protein, 6 aa, Mycobacterium
EAEAEA

SEQ ID NO: 395762 - protein, 4 aa, Mycobacterium
EAEE

SEQ ID NO: 395763 - protein, 7 aa, Mycobacterium
EAEGADT

SEQ ID NO: 395764 - protein, 7 aa, Mycobacterium
EAEKGSQ

SEQ ID NO: 395765 - protein, 8 aa, Mycobacterium
EAEKTRKL

SEQ ID NO: 395766 - protein, 7 aa, Mycobacterium
EAEPPGD

SEQ ID NO: 395767 - protein, 4 aa, Mycobacterium
EAER

SEQ ID NO: 395768 - protein, 7 aa, Mycobacterium
EAERDGV

SEQ ID NO: 395769 - protein, 10 aa, Mycobacterium
EAERSKGGKV

SEQ ID NO: 395770 - protein, 4 aa, Mycobacterium
EAES

SEQ ID NO: 395771 - protein, 4 aa, Mycobacterium
EAET

SEQ ID NO: 395772 - protein, 4 aa, Mycobacterium
EAEY

SEQ ID NO: 395773 - protein, 8 aa, Mycobacterium
EAGAESMP

SEQ ID NO: 395774 - protein, 5 aa, Mycobacterium
EAGAL

SEQ ID NO: 395775 - protein, 6 aa, Mycobacterium
EAGAPS

SEQ ID NO: 395776 - protein, 5 aa, Mycobacterium
EAGAT

SEQ ID NO: 395777 - protein, 5 aa, Mycobacterium
EAGEV

SEQ ID NO: 395778 - protein, 6 aa, Mycobacterium
EAGGAT

SEQ ID NO: 395779 - protein, 7 aa, Mycobacterium
EAGGDPW

SEQ ID NO: 395780 - protein, 5 aa, Mycobacterium
EAGGH

SEQ ID NO: 395781 - protein, 6 aa, Mycobacterium
EAGHGD

SEQ ID NO: 395782 - protein, 8 aa, Mycobacterium
EAGIAPQD

SEQ ID NO: 395783 - protein, 5 aa, Mycobacterium
EAGIG

SEQ ID NO: 395784 - protein, 4 aa, Mycobacterium
EAGL

SEQ ID NO: 395785 - protein, 5 aa, Mycobacterium
EAGLN

SEQ ID NO: 395786 - protein, 8 aa, Mycobacterium
EAGPAFQG

SEQ ID NO: 395787 - protein, 8 aa, Mycobacterium
EAGPRART

SEQ ID NO: 395788 - protein, 5 aa, Mycobacterium
EAGPV

SEQ ID NO: 395789 - protein, 4 aa, Mycobacterium
EAGR

SEQ ID NO: 395790 - protein, 5 aa, Mycobacterium
EAGSA

SEQ ID NO: 395791 - protein, 5 aa, Mycobacterium
EAGSV

SEQ ID NO: 395792 - protein, 7 aa, Mycobacterium
EAGSVSE

SEQ ID NO: 395793 - protein, 4 aa, Mycobacterium
EAGT

SEQ ID NO: 395794 - protein, 5 aa, Mycobacterium
EAGVP

SEQ ID NO: 395795 - protein, 10 aa, Mycobacterium
EAGVPPPRRS

SEQ ID NO: 395796 - protein, 6 aa, Mycobacterium
EAGVPS

SEQ ID NO: 395797 - protein, 6 aa, Mycobacterium
EAGVTE

SEQ ID NO: 395798 - protein, 20 aa, Mycobacterium
EAHAEEDRKRREEADVRNQA

SEQ ID NO: 395799 - protein, 7 aa, Mycobacterium
EAHNAQN

SEQ ID NO: 395800 - protein, 4 aa, Mycobacterium
EAIA

SEQ ID NO: 395801 - protein, 6 aa, Mycobacterium
EAIGTR

SEQ ID NO: 395802 - protein, 7 aa, Mycobacterium
EAKADAV

SEQ ID NO: 395803 - protein, 12 aa, Mycobacterium
EAKGRNGVPHPH

SEQ ID NO: 395804 - protein, 8 aa, Mycobacterium
EALAPKRE

SEQ ID NO: 395805 - protein, 4 aa, Mycobacterium
EALG

SEQ ID NO: 395806 - protein, 7 aa, Mycobacterium
EALPGEI

SEQ ID NO: 395807 - protein, 7 aa, Mycobacterium
EALPGEV

SEQ ID NO: 395808 - protein, 10 aa, Mycobacterium
EALPGTDIDP

SEQ ID NO: 395809 - protein, 4 aa, Mycobacterium
EANA

SEQ ID NO: 395810 - protein, 9 aa, Mycobacterium
EANGPLEQQ

SEQ ID NO: 395811 - protein, 16 aa, Mycobacterium
EAPALDENKQPTSERV

SEQ ID NO: 395812 - protein, 6 aa, Mycobacterium
EAPGGA

SEQ ID NO: 395813 - protein, 7 aa, Mycobacterium
EAPGGAH

SEQ ID NO: 395814 - protein, 7 aa, Mycobacterium
EAPNGAH

SEQ ID NO: 395815 - protein, 4 aa, Mycobacterium
EAPP

SEQ ID NO: 395816 - protein, 11 aa, Mycobacterium
EAPQEGTPPFR

SEQ ID NO: 395817 - protein, 7 aa, Mycobacterium
EAPSPVV

SEQ ID NO: 395818 - protein, 7 aa, Mycobacterium
EAPTFAD

SEQ ID NO: 395819 - protein, 4 aa, Mycobacterium
EAPY

SEQ ID NO: 395820 - protein, 4 aa, Mycobacterium
EAQD

SEQ ID NO: 395821 - protein, 8 aa, Mycobacterium
EAQRERRK

SEQ ID NO: 395822 - protein, 5 aa, Mycobacterium
EARAG

SEQ ID NO: 395823 - protein, 11 aa, Mycobacterium
EARDAGEPMAE

SEQ ID NO: 395824 - protein, 8 aa, Mycobacterium
EAREEAAR

SEQ ID NO: 395825 - protein, 6 aa, Mycobacterium
EAREES

SEQ ID NO: 395826 - protein, 5 aa, Mycobacterium
EARHR

SEQ ID NO: 395827 - protein, 4 aa, Mycobacterium
EARN

SEQ ID NO: 395828 - protein, 7 aa, Mycobacterium
EARPTAE

SEQ ID NO: 395829 - protein, 8 aa, Mycobacterium
EARQHSER

SEQ ID NO: 395830 - protein, 5 aa, Mycobacterium
EARRR

SEQ ID NO: 395831 - protein, 4 aa, Mycobacterium
EASQ

SEQ ID NO: 395832 - protein, 6 aa, Mycobacterium
EASRRR

SEQ ID NO: 395833 - protein, 5 aa, Mycobacterium
EASSG

SEQ ID NO: 395834 - protein, 7 aa, Mycobacterium
EASSLTG

SEQ ID NO: 395835 - protein, 4 aa, Mycobacterium
EAST

SEQ ID NO: 395836 - protein, 5 aa, Mycobacterium
EASYA

SEQ ID NO: 395837 - protein, 5 aa, Mycobacterium
EASYF

SEQ ID NO: 395838 - protein, 6 aa, Mycobacterium
EATDDR

SEQ ID NO: 395839 - protein, 5 aa, Mycobacterium
EATEF

SEQ ID NO: 395840 - protein, 8 aa, Mycobacterium
EATGDRGK

SEQ ID NO: 395841 - protein, 5 aa, Mycobacterium
EATGL

SEQ ID NO: 395842 - protein, 5 aa, Mycobacterium
EATGR

SEQ ID NO: 395843 - protein, 7 aa, Mycobacterium
EATHEPG

SEQ ID NO: 395844 - protein, 7 aa, Mycobacterium
EATSLPV

SEQ ID NO: 395845 - protein, 12 aa, Mycobacterium
EAVEKANDTEYG

SEQ ID NO: 395846 - protein, 6 aa, Mycobacterium
EAVGDT

SEQ ID NO: 395847 - protein, 12 aa, Mycobacterium
EAVGGGGGDGAD

SEQ ID NO: 395848 - protein, 4 aa, Mycobacterium
EAVT

SEQ ID NO: 395849 - protein, 5 aa, Mycobacterium
EAVTE

SEQ ID NO: 395850 - protein, 17 aa, Mycobacterium
EAYSRDPRNVARKAENY

SEQ ID NO: 395851 - protein, 5 aa, Mycobacterium
ECNLG

SEQ ID NO: 395852 - protein, 8 aa, Mycobacterium
EDAAEGPK

SEQ ID NO: 395853 - protein, 9 aa, Mycobacterium
EDAAPSDAE

SEQ ID NO: 395854 - protein, 8 aa, Mycobacterium
EDAAQPQL

SEQ ID NO: 395855 - protein, 5 aa, Mycobacterium
EDADR

SEQ ID NO: 395856 - protein, 6 aa, Mycobacterium
EDADRH

SEQ ID NO: 395857 - protein, 7 aa, Mycobacterium
EDAEAEH

SEQ ID NO: 395858 - protein, 6 aa, Mycobacterium
EDAERM

SEQ ID NO: 395859 - protein, 11 aa, Mycobacterium
EDAETADPSGL

SEQ ID NO: 395860 - protein, 4 aa, Mycobacterium
EDAL

SEQ ID NO: 395861 - protein, 6 aa, Mycobacterium
EDAMEG

SEQ ID NO: 395862 - protein, 8 aa, Mycobacterium
EDANSDSN

SEQ ID NO: 395863 - protein, 15 aa, Mycobacterium
EDAQALTEADPYSQA

SEQ ID NO: 395864 - protein, 5 aa, Mycobacterium
EDASY

SEQ ID NO: 395865 - protein, 6 aa, Mycobacterium
EDATDM

SEQ ID NO: 395866 - protein, 4 aa, Mycobacterium
EDCP

SEQ ID NO: 395867 - protein, 5 aa, Mycobacterium
EDCPP

SEQ ID NO: 395868 - protein, 6 aa, Mycobacterium
EDDAVR

SEQ ID NO: 395869 - protein, 4 aa, Mycobacterium
EDDE

SEQ ID NO: 395870 - protein, 10 aa, Mycobacterium
EDDGGSRNQI

SEQ ID NO: 395871 - protein, 8 aa, Mycobacterium
EDDGPGIA

SEQ ID NO: 395872 - protein, 10 aa, Mycobacterium
EDDHPHREQR

SEQ ID NO: 395873 - protein, 6 aa, Mycobacterium
EDDLGG

SEQ ID NO: 395874 - protein, 8 aa, Mycobacterium
EDDPRYDA

SEQ ID NO: 395875 - protein, 5 aa, Mycobacterium
EDEGH

SEQ ID NO: 395876 - protein, 6 aa, Mycobacterium
EDEGRK

SEQ ID NO: 395877 - protein, 4 aa, Mycobacterium
EDEL

SEQ ID NO: 395878 - protein, 5 aa, Mycobacterium
EDEPG

SEQ ID NO: 395879 - protein, 7 aa, Mycobacterium
EDEPLSP

SEQ ID NO: 395880 - protein, 8 aa, Mycobacterium
EDEPQFSR

SEQ ID NO: 395881 - protein, 4 aa, Mycobacterium
EDER

SEQ ID NO: 395882 - protein, 8 aa, Mycobacterium
EDETGTVR

SEQ ID NO: 395883 - protein, 14 aa, Mycobacterium
EDGGRRSPQANQRV

SEQ ID NO: 395884 - protein, 28 aa, Mycobacterium
EDGKAPFANPRNSAAGSLRQKNPAVTAR

SEQ ID NO: 395885 - protein, 11 aa, Mycobacterium
EDGKPGEPDYH

SEQ ID NO: 395886 - protein, 12 aa, Mycobacterium
EDGKPVPQGEPG

SEQ ID NO: 395887 - protein, 5 aa, Mycobacterium
EDGPA

SEQ ID NO: 395888 - protein, 8 aa, Mycobacterium
EDGPPETV

SEQ ID NO: 395889 - protein, 4 aa, Mycobacterium
EDGR

SEQ ID NO: 395890 - protein, 6 aa, Mycobacterium
EDGREY

SEQ ID NO: 395891 - protein, 8 aa, Mycobacterium
EDGSERVL

SEQ ID NO: 395892 - protein, 9 aa, Mycobacterium
EDGSERVLS

SEQ ID NO: 395893 - protein, 15 aa, Mycobacterium
EDGSPVRGVSGGTAR

SEQ ID NO: 395894 - protein, 4 aa, Mycobacterium
EDGT

SEQ ID NO: 395895 - protein, 8 aa, Mycobacterium
EDGTITKG

SEQ ID NO: 395896 - protein, 13 aa, Mycobacterium
EDGTPKTKHNTTN

SEQ ID NO: 395897 - protein, 7 aa, Mycobacterium
EDGVGGT

SEQ ID NO: 395898 - protein, 9 aa, Mycobacterium
EDGYSTGRG

SEQ ID NO: 395899 - protein, 4 aa, Mycobacterium
EDHP

SEQ ID NO: 395900 - protein, 9 aa, Mycobacterium
EDHTTTDST

SEQ ID NO: 395901 - protein, 4 aa, Mycobacterium
EDID

SEQ ID NO: 395902 - protein, 8 aa, Mycobacterium
EDLGGGDL

SEQ ID NO: 395903 - protein, 6 aa, Mycobacterium
EDLPEQ

SEQ ID NO: 395904 - protein, 4 aa, Mycobacterium
EDPA

SEQ ID NO: 395905 - protein, 15 aa, Mycobacterium
EDPDRGGLRDTPARV

SEQ ID NO: 395906 - protein, 15 aa, Mycobacterium
EDPDRHGLRETPARV

SEQ ID NO: 395907 - protein, 5 aa, Mycobacterium
EDPEA

SEQ ID NO: 395908 - protein, 9 aa, Mycobacterium
EDPEGAARE

SEQ ID NO: 395909 - protein, 8 aa, Mycobacterium
EDPGSGDM

SEQ ID NO: 395910 - protein, 6 aa, Mycobacterium
EDPGYA

SEQ ID NO: 395911 - protein, 7 aa, Mycobacterium
EDPGYTT

SEQ ID NO: 395912 - protein, 4 aa, Mycobacterium
EDPL

SEQ ID NO: 395913 - protein, 5 aa, Mycobacterium
EDPLA

SEQ ID NO: 395914 - protein, 5 aa, Mycobacterium
EDPPM

SEQ ID NO: 395915 - protein, 4 aa, Mycobacterium
EDPT

SEQ ID NO: 395916 - protein, 6 aa, Mycobacterium
EDPTKD

SEQ ID NO: 395917 - protein, 4 aa, Mycobacterium
EDPV

SEQ ID NO: 395918 - protein, 6 aa, Mycobacterium
EDPYEK

SEQ ID NO: 395919 - protein, 8 aa, Mycobacterium
EDQGPGIA

SEQ ID NO: 395920 - protein, 4 aa, Mycobacterium
EDQH

SEQ ID NO: 395921 - protein, 5 aa, Mycobacterium
EDQSW

SEQ ID NO: 395922 - protein, 5 aa, Mycobacterium
EDRGE

SEQ ID NO: 395923 - protein, 7 aa, Mycobacterium
EDRGPEL

SEQ ID NO: 395924 - protein, 5 aa, Mycobacterium
EDRPA

SEQ ID NO: 395925 - protein, 11 aa, Mycobacterium
EDRPVQHDGRW

SEQ ID NO: 395926 - protein, 5 aa, Mycobacterium
EDRRG

SEQ ID NO: 395927 - protein, 12 aa, Mycobacterium
EDRSGGPGLAGD

SEQ ID NO: 395928 - protein, 9 aa, Mycobacterium
EDRSSRPHR

SEQ ID NO: 395929 - protein, 9 aa, Mycobacterium
EDSAPSDAE

SEQ ID NO: 395930 - protein, 8 aa, Mycobacterium
EDSDDVQD

SEQ ID NO: 395931 - protein, 8 aa, Mycobacterium
EDSGYRGM

SEQ ID NO: 395932 - protein, 4 aa, Mycobacterium
EDSR

SEQ ID NO: 395933 - protein, 11 aa, Mycobacterium
EDSRPTTHDDP

SEQ ID NO: 395934 - protein, 4 aa, Mycobacterium
EDTD

SEQ ID NO: 395935 - protein, 5 aa, Mycobacterium
EDTGY

SEQ ID NO: 395936 - protein, 4 aa, Mycobacterium
EDTT

SEQ ID NO: 395937 - protein, 4 aa, Mycobacterium
EDTV

SEQ ID NO: 395938 - protein, 15 aa, Mycobacterium
EDTVRAAGSPEVPSH

SEQ ID NO: 395939 - protein, 4 aa, Mycobacterium
EDVE

SEQ ID NO: 395940 - protein, 5 aa, Mycobacterium
EDVER

SEQ ID NO: 395941 - protein, 7 aa, Mycobacterium
EDVERGQ

SEQ ID NO: 395942 - protein, 6 aa, Mycobacterium
EDVKTS

SEQ ID NO: 395943 - protein, 7 aa, Mycobacterium
EDVPPGA

SEQ ID NO: 395944 - protein, 7 aa, Mycobacterium
EDYAELG

SEQ ID NO: 395945 - protein, 5 aa, Mycobacterium
EEAAD

SEQ ID NO: 395946 - protein, 5 aa, Mycobacterium
EEAAT

SEQ ID NO: 395947 - protein, 15 aa, Mycobacterium
EEAEAENRASYGGPL

SEQ ID NO: 395948 - protein, 4 aa, Mycobacterium
EEAG

SEQ ID NO: 395949 - protein, 5 aa, Mycobacterium
EEAPS

SEQ ID NO: 395950 - protein, 12 aa, Mycobacterium
EEAQRTHQALTQ

SEQ ID NO: 395951 - protein, 7 aa, Mycobacterium
EEASYDG

SEQ ID NO: 395952 - protein, 6 aa, Mycobacterium
EEDPPM

SEQ ID NO: 395953 - protein, 4 aa, Mycobacterium
EEDY

SEQ ID NO: 395954 - protein, 16 aa, Mycobacterium
EEEADGSGMFQPANAP

SEQ ID NO: 395955 - protein, 6 aa, Mycobacterium
EEEGIG

SEQ ID NO: 395956 - protein, 6 aa, Mycobacterium
EEEPGL

SEQ ID NO: 395957 - protein, 4 aa, Mycobacterium
EEEQ

SEQ ID NO: 395958 - protein, 4 aa, Mycobacterium
EEFG

SEQ ID NO: 395959 - protein, 5 aa, Mycobacterium
EEFGE

SEQ ID NO: 395960 - protein, 7 aa, Mycobacterium
EEGEDAE

SEQ ID NO: 395961 - protein, 5 aa, Mycobacterium
EEGGR

SEQ ID NO: 395962 - protein, 26 aa, Mycobacterium
EEGKHTFGSARTRRSLAKQPDGPFGT

SEQ ID NO: 395963 - protein, 12 aa, Mycobacterium
EEGNEVKPGSGV

SEQ ID NO: 395964 - protein, 8 aa, Mycobacterium
EEGQEVAA

SEQ ID NO: 395965 - protein, 10 aa, Mycobacterium
EEGQQVKRTG

SEQ ID NO: 395966 - protein, 7 aa, Mycobacterium
EEGRRRH

SEQ ID NO: 395967 - protein, 11 aa, Mycobacterium
EEGYQSVGSGS

SEQ ID NO: 395968 - protein, 6 aa, Mycobacterium
EEHGGR

SEQ ID NO: 395969 - protein, 4 aa, Mycobacterium
EEIE

SEQ ID NO: 395970 - protein, 9 aa, Mycobacterium
EEKKQELKD

SEQ ID NO: 395971 - protein, 4 aa, Mycobacterium
EEKN

SEQ ID NO: 395972 - protein, 19 aa, Mycobacterium
EELETTNEELQSTNEELET

SEQ ID NO: 395973 - protein, 14 aa, Mycobacterium
EELGNTPAVARGSY

SEQ ID NO: 395974 - protein, 6 aa, Mycobacterium
EELPPQ

SEQ ID NO: 395975 - protein, 5 aa, Mycobacterium
EEPDS

SEQ ID NO: 395976 - protein, 4 aa, Mycobacterium
EEPE

SEQ ID NO: 395977 - protein, 7 aa, Mycobacterium
EEPEGPV

SEQ ID NO: 395978 - protein, 5 aa, Mycobacterium
EEPFT

SEQ ID NO: 395979 - protein, 4 aa, Mycobacterium
EEPG

SEQ ID NO: 395980 - protein, 4 aa, Mycobacterium
EEPI

SEQ ID NO: 395981 - protein, 4 aa, Mycobacterium
EEPK

SEQ ID NO: 395982 - protein, 5 aa, Mycobacterium
EEPPY

SEQ ID NO: 395983 - protein, 4 aa, Mycobacterium
EEQG

SEQ ID NO: 395984 - protein, 5 aa, Mycobacterium
EEQGL

SEQ ID NO: 395985 - protein, 4 aa, Mycobacterium
EEQL

SEQ ID NO: 395986 - protein, 5 aa, Mycobacterium
EEQLQ

SEQ ID NO: 395987 - protein, 6 aa, Mycobacterium
EEQRAA

SEQ ID NO: 395988 - protein, 5 aa, Mycobacterium
EEQRK

SEQ ID NO: 395989 - protein, 7 aa, Mycobacterium
EEQRVPD

SEQ ID NO: 395990 - protein, 4 aa, Mycobacterium
EEQS

SEQ ID NO: 395991 - protein, 15 aa, Mycobacterium
EERERKAQRAEQSRE

SEQ ID NO: 395992 - protein, 7 aa, Mycobacterium
EERPDEV

SEQ ID NO: 395993 - protein, 6 aa, Mycobacterium
EERSAI

SEQ ID NO: 395994 - protein, 5 aa, Mycobacterium
EESAN

SEQ ID NO: 395995 - protein, 10 aa, Mycobacterium
EESGDQLTEE

SEQ ID NO: 395996 - protein, 6 aa, Mycobacterium
EESIRR

SEQ ID NO: 395997 - protein, 16 aa, Mycobacterium
EESTSWPGVTRPTNLG

SEQ ID NO: 395998 - protein, 7 aa, Mycobacterium
EESVTQD

SEQ ID NO: 395999 - protein, 5 aa, Mycobacterium
EETAL

SEQ ID NO: 396000 - protein, 4 aa, Mycobacterium
EETD

SEQ ID NO: 396001 - protein, 5 aa, Mycobacterium
EETHP

SEQ ID NO: 396002 - protein, 4 aa, Mycobacterium
EETS

SEQ ID NO: 396003 - protein, 9 aa, Mycobacterium
EETSAGRYS

SEQ ID NO: 396004 - protein, 7 aa, Mycobacterium
EETSDRT

SEQ ID NO: 396005 - protein, 9 aa, Mycobacterium
EETTRARAP

SEQ ID NO: 396006 - protein, 11 aa, Mycobacterium
EEVGNGDGPEC

SEQ ID NO: 396007 - protein, 6 aa, Mycobacterium
EEVPTR

SEQ ID NO: 396008 - protein, 5 aa, Mycobacterium
EEWGP

SEQ ID NO: 396009 - protein, 5 aa, Mycobacterium
EEYGG

SEQ ID NO: 396010 - protein, 6 aa, Mycobacterium
EEYNGE

SEQ ID NO: 396011 - protein, 6 aa, Mycobacterium
EFADRD

SEQ ID NO: 396012 - protein, 5 aa, Mycobacterium
EFARR

SEQ ID NO: 396013 - protein, 8 aa, Mycobacterium
EFDPERAG

SEQ ID NO: 396014 - protein, 10 aa, Mycobacterium
EFGGQARPPM

SEQ ID NO: 396015 - protein, 7 aa, Mycobacterium
EFGGTDV

SEQ ID NO: 396016 - protein, 9 aa, Mycobacterium
EFRPGDDLG

SEQ ID NO: 396017 - protein, 5 aa, Mycobacterium
EGADA

SEQ ID NO: 396018 - protein, 5 aa, Mycobacterium
EGAEL

SEQ ID NO: 396019 - protein, 4 aa, Mycobacterium
EGAG

SEQ ID NO: 396020 - protein, 10 aa, Mycobacterium
EGAHESAERG

SEQ ID NO: 396021 - protein, 9 aa, Mycobacterium
EGAKGKAKE

SEQ ID NO: 396022 - protein, 4 aa, Mycobacterium
EGAP

SEQ ID NO: 396023 - protein, 5 aa, Mycobacterium
EGAPE

SEQ ID NO: 396024 - protein, 5 aa, Mycobacterium
EGAPI

SEQ ID NO: 396025 - protein, 5 aa, Mycobacterium
EGASI

SEQ ID NO: 396026 - protein, 8 aa, Mycobacterium
EGATSDEW

SEQ ID NO: 396027 - protein, 6 aa, Mycobacterium
EGATTI

SEQ ID NO: 396028 - protein, 4 aa, Mycobacterium
EGDD

SEQ ID NO: 396029 - protein, 6 aa, Mycobacterium
EGDGPP

SEQ ID NO: 396030 - protein, 7 aa, Mycobacterium
EGDLAPL

SEQ ID NO: 396031 - protein, 7 aa, Mycobacterium
EGDPSNV

SEQ ID NO: 396032 - protein, 4 aa, Mycobacterium
EGDT

SEQ ID NO: 396033 - protein, 15 aa, Mycobacterium
EGEDFGSGGDLPEQR

SEQ ID NO: 396034 - protein, 8 aa, Mycobacterium
EGEKDDAP

SEQ ID NO: 396035 - protein, 15 aa, Mycobacterium
EGEPATQPSGIPGDR

SEQ ID NO: 396036 - protein, 8 aa, Mycobacterium
EGETVSAG

SEQ ID NO: 396037 - protein, 4 aa, Mycobacterium
EGEV

SEQ ID NO: 396038 - protein, 4 aa, Mycobacterium
EGFG

SEQ ID NO: 396039 - protein, 9 aa, Mycobacterium
EGFGRPDGF

SEQ ID NO: 396040 - protein, 9 aa, Mycobacterium
EGGALDDPA

SEQ ID NO: 396041 - protein, 5 aa, Mycobacterium
EGGEN

SEQ ID NO: 396042 - protein, 7 aa, Mycobacterium
EGGERVA

SEQ ID NO: 396043 - protein, 13 aa, Mycobacterium
EGGGQANATIVEL

SEQ ID NO: 396044 - protein, 8 aa, Mycobacterium
EGGGRQVA

SEQ ID NO: 396045 - protein, 7 aa, Mycobacterium
EGGIADD

SEQ ID NO: 396046 - protein, 8 aa, Mycobacterium
EGGIAPEE

SEQ ID NO: 396047 - protein, 5 aa, Mycobacterium
EGGPG

SEQ ID NO: 396048 - protein, 5 aa, Mycobacterium
EGGPT

SEQ ID NO: 396049 - protein, 4 aa, Mycobacterium
EGGR

SEQ ID NO: 396050 - protein, 4 aa, Mycobacterium
EGGV

SEQ ID NO: 396051 - protein, 15 aa, Mycobacterium
EGHRPDLSDLPANKR

SEQ ID NO: 396052 - protein, 4 aa, Mycobacterium
EGHS

SEQ ID NO: 396053 - protein, 6 aa, Mycobacterium
EGIGGA

SEQ ID NO: 396054 - protein, 4 aa, Mycobacterium
EGKA

SEQ ID NO: 396055 - protein, 10 aa, Mycobacterium
EGKAFSSGGS

SEQ ID NO: 396056 - protein, 5 aa, Mycobacterium
EGKNL

SEQ ID NO: 396057 - protein, 4 aa, Mycobacterium
EGKP

SEQ ID NO: 396058 - protein, 6 aa, Mycobacterium
EGKQSL

SEQ ID NO: 396059 - protein, 8 aa, Mycobacterium
EGLPPCQP

SEQ ID NO: 396060 - protein, 4 aa, Mycobacterium
EGLR

SEQ ID NO: 396061 - protein, 19 aa, Mycobacterium
EGLRRQAGGVAAEQSGQAI

SEQ ID NO: 396062 - protein, 4 aa, Mycobacterium
EGLS

SEQ ID NO: 396063 - protein, 10 aa, Mycobacterium
EGMAGAEGEH

SEQ ID NO: 396064 - protein, 4 aa, Mycobacterium
EGMP

SEQ ID NO: 396065 - protein, 4 aa, Mycobacterium
EGNA

SEQ ID NO: 396066 - protein, 7 aa, Mycobacterium
EGNGNRR

SEQ ID NO: 396067 - protein, 10 aa, Mycobacterium
EGNPDSPISR

SEQ ID NO: 396068 - protein, 9 aa, Mycobacterium
EGNPPQPEV

SEQ ID NO: 396069 - protein, 8 aa, Mycobacterium
EGPADGPP

SEQ ID NO: 396070 - protein, 4 aa, Mycobacterium
EGPI

SEQ ID NO: 396071 - protein, 5 aa, Mycobacterium
EGPLT

SEQ ID NO: 396072 - protein, 4 aa, Mycobacterium
EGPN

SEQ ID NO: 396073 - protein, 4 aa, Mycobacterium
EGPQ

SEQ ID NO: 396074 - protein, 6 aa, Mycobacterium
EGPSEA

SEQ ID NO: 396075 - protein, 8 aa, Mycobacterium
EGPSTDPE

SEQ ID NO: 396076 - protein, 4 aa, Mycobacterium
EGPV

SEQ ID NO: 396077 - protein, 5 aa, Mycobacterium
EGPVD

SEQ ID NO: 396078 - protein, 6 aa, Mycobacterium
EGQARG

SEQ ID NO: 396079 - protein, 4 aa, Mycobacterium
EGQH

SEQ ID NO: 396080 - protein, 7 aa, Mycobacterium
EGQSSRH

SEQ ID NO: 396081 - protein, 4 aa, Mycobacterium
EGRA

SEQ ID NO: 396082 - protein, 9 aa, Mycobacterium
EGRAKRDDT

SEQ ID NO: 396083 - protein, 4 aa, Mycobacterium
EGRD

SEQ ID NO: 396084 - protein, 8 aa, Mycobacterium
EGRDADDD

SEQ ID NO: 396085 - protein, 5 aa, Mycobacterium
EGREG

SEQ ID NO: 396086 - protein, 8 aa, Mycobacterium
EGRFDEQS

SEQ ID NO: 396087 - protein, 8 aa, Mycobacterium
EGRGPYAD

SEQ ID NO: 396088 - protein, 7 aa, Mycobacterium
EGRKAVR

SEQ ID NO: 396089 - protein, 4 aa, Mycobacterium
EGRN

SEQ ID NO: 396090 - protein, 8 aa, Mycobacterium
EGRNATHQ

SEQ ID NO: 396091 - protein, 7 aa, Mycobacterium
EGRPGVG

SEQ ID NO: 396092 - protein, 7 aa, Mycobacterium
EGRRTRY

SEQ ID NO: 396093 - protein, 5 aa, Mycobacterium
EGRSD

SEQ ID NO: 396094 - protein, 4 aa, Mycobacterium
EGRT

SEQ ID NO: 396095 - protein, 5 aa, Mycobacterium
EGRTF

SEQ ID NO: 396096 - protein, 4 aa, Mycobacterium
EGRV

SEQ ID NO: 396097 - protein, 8 aa, Mycobacterium
EGSEERRI

SEQ ID NO: 396098 - protein, 6 aa, Mycobacterium
EGSEGL

SEQ ID NO: 396099 - protein, 7 aa, Mycobacterium
EGSEGLR

SEQ ID NO: 396100 - protein, 8 aa, Mycobacterium
EGSGNTEG

SEQ ID NO: 396101 - protein, 7 aa, Mycobacterium
EGSISED

SEQ ID NO: 396102 - protein, 5 aa, Mycobacterium
EGSPS

SEQ ID NO: 396103 - protein, 5 aa, Mycobacterium
EGSSE

SEQ ID NO: 396104 - protein, 5 aa, Mycobacterium
EGSSN

SEQ ID NO: 396105 - protein, 4 aa, Mycobacterium
EGTA

SEQ ID NO: 396106 - protein, 4 aa, Mycobacterium
EGTD

SEQ ID NO: 396107 - protein, 6 aa, Mycobacterium
EGTFGA

SEQ ID NO: 396108 - protein, 4 aa, Mycobacterium
EGTR

SEQ ID NO: 396109 - protein, 15 aa, Mycobacterium
EGTRLDTTEVGPFKK

SEQ ID NO: 396110 - protein, 5 aa, Mycobacterium
EGTSE

SEQ ID NO: 396111 - protein, 5 aa, Mycobacterium
EGTSI

SEQ ID NO: 396112 - protein, 5 aa, Mycobacterium
EGTTA

SEQ ID NO: 396113 - protein, 4 aa, Mycobacterium
EGVA

SEQ ID NO: 396114 - protein, 13 aa, Mycobacterium
EGVERSATDEAVA

SEQ ID NO: 396115 - protein, 9 aa, Mycobacterium
EGVKSEFPD

SEQ ID NO: 396116 - protein, 7 aa, Mycobacterium
EGVPSPV

SEQ ID NO: 396117 - protein, 4 aa, Mycobacterium
EGVR

SEQ ID NO: 396118 - protein, 8 aa, Mycobacterium
EGVRDGKP

SEQ ID NO: 396119 - protein, 8 aa, Mycobacterium
EGVRGTGP

SEQ ID NO: 396120 - protein, 11 aa, Mycobacterium
EGVRRTGGSTV

SEQ ID NO: 396121 - protein, 6 aa, Mycobacterium
EGVSGR

SEQ ID NO: 396122 - protein, 6 aa, Mycobacterium
EGVTSA

SEQ ID NO: 396123 - protein, 7 aa, Mycobacterium
EGYGPNG

SEQ ID NO: 396124 - protein, 5 aa, Mycobacterium
EGYPS

SEQ ID NO: 396125 - protein, 10 aa, Mycobacterium
EHAKARGAKP

SEQ ID NO: 396126 - protein, 16 aa, Mycobacterium
EHARTDWDNGGVPRRE

SEQ ID NO: 396127 - protein, 13 aa, Mycobacterium
EHDGQPQYRTRKH

SEQ ID NO: 396128 - protein, 11 aa, Mycobacterium
EHDSSHDLGVD

SEQ ID NO: 396129 - protein, 6 aa, Mycobacterium
EHDTEG

SEQ ID NO: 396130 - protein, 17 aa, Mycobacterium
EHELGTKGPGQDGPGRE

SEQ ID NO: 396131 - protein, 4 aa, Mycobacterium
EHGD

SEQ ID NO: 396132 - protein, 15 aa, Mycobacterium
EHGKTLADAKGDIQR

SEQ ID NO: 396133 - protein, 5 aa, Mycobacterium
EHGPD

SEQ ID NO: 396134 - protein, 5 aa, Mycobacterium
EHGRS

SEQ ID NO: 396135 - protein, 6 aa, Mycobacterium
EHNHRH

SEQ ID NO: 396136 - protein, 6 aa, Mycobacterium
EHPAQR

SEQ ID NO: 396137 - protein, 7 aa, Mycobacterium
EHPDGRR

SEQ ID NO: 396138 - protein, 6 aa, Mycobacterium
EHPDQR

SEQ ID NO: 396139 - protein, 9 aa, Mycobacterium
EHPDQRREV

SEQ ID NO: 396140 - protein, 4 aa, Mycobacterium
EHPG

SEQ ID NO: 396141 - protein, 8 aa, Mycobacterium
EHPLSDEQ

SEQ ID NO: 396142 - protein, 10 aa, Mycobacterium
EHPRRDTTVE

SEQ ID NO: 396143 - protein, 6 aa, Mycobacterium
EHPSDD

SEQ ID NO: 396144 - protein, 7 aa, Mycobacterium
EHPSTAR

SEQ ID NO: 396145 - protein, 13 aa, Mycobacterium
EHPTSPDTAPTLT

SEQ ID NO: 396146 - protein, 5 aa, Mycobacterium
EHPYP

SEQ ID NO: 396147 - protein, 6 aa, Mycobacterium
EHPYPA

SEQ ID NO: 396148 - protein, 7 aa, Mycobacterium
EHPYPAP

SEQ ID NO: 396149 - protein, 14 aa, Mycobacterium
EHRARIAEEYRAAD

SEQ ID NO: 396150 - protein, 4 aa, Mycobacterium
EHRP

SEQ ID NO: 396151 - protein, 6 aa, Mycobacterium
EHRSTV

SEQ ID NO: 396152 - protein, 14 aa, Mycobacterium
EHSHPGGGLPSYPH

SEQ ID NO: 396153 - protein, 8 aa, Mycobacterium
EIAGAPPE

SEQ ID NO: 396154 - protein, 7 aa, Mycobacterium
EIAGGEA

SEQ ID NO: 396155 - protein, 11 aa, Mycobacterium
EIAQSRAAGDG

SEQ ID NO: 396156 - protein, 5 aa, Mycobacterium
EIASA

SEQ ID NO: 396157 - protein, 8 aa, Mycobacterium
EIGERPGM

SEQ ID NO: 396158 - protein, 5 aa, Mycobacterium
EIGGG

SEQ ID NO: 396159 - protein, 5 aa, Mycobacterium
EIGPG

SEQ ID NO: 396160 - protein, 4 aa, Mycobacterium
EIGT

SEQ ID NO: 396161 - protein, 7 aa, Mycobacterium
EIGTTPL

SEQ ID NO: 396162 - protein, 5 aa, Mycobacterium
EIGYG

SEQ ID NO: 396163 - protein, 9 aa, Mycobacterium
EIPADRPAL

SEQ ID NO: 396164 - protein, 6 aa, Mycobacterium
EIPNAG

SEQ ID NO: 396165 - protein, 6 aa, Mycobacterium
EIPPGT

SEQ ID NO: 396166 - protein, 16 aa, Mycobacterium
EIPSFAPPKDLQPGEY

SEQ ID NO: 396167 - protein, 4 aa, Mycobacterium
EIRE

SEQ ID NO: 396168 - protein, 6 aa, Mycobacterium
EIREGR

SEQ ID NO: 396169 - protein, 4 aa, Mycobacterium
EIRG

SEQ ID NO: 396170 - protein, 6 aa, Mycobacterium
EIRPEA

SEQ ID NO: 396171 - protein, 5 aa, Mycobacterium
EISDE

SEQ ID NO: 396172 - protein, 6 aa, Mycobacterium
EISEEQ

SEQ ID NO: 396173 - protein, 4 aa, Mycobacterium
EISG

SEQ ID NO: 396174 - protein, 4 aa, Mycobacterium
EISP

SEQ ID NO: 396175 - protein, 4 aa, Mycobacterium
EITP

SEQ ID NO: 396176 - protein, 11 aa, Mycobacterium
EITTGPLGQGL

SEQ ID NO: 396177 - protein, 12 aa, Mycobacterium
EIYGGTKSAWDY

SEQ ID NO: 396178 - protein, 4 aa, Mycobacterium
EKAA

SEQ ID NO: 396179 - protein, 8 aa, Mycobacterium
EKAAGPRR

SEQ ID NO: 396180 - protein, 7 aa, Mycobacterium
EKAEEYR

SEQ ID NO: 396181 - protein, 7 aa, Mycobacterium
EKAGFTV

SEQ ID NO: 396182 - protein, 8 aa, Mycobacterium
EKAKPRKI

SEQ ID NO: 396183 - protein, 8 aa, Mycobacterium
EKAKPRRI

SEQ ID NO: 396184 - protein, 5 aa, Mycobacterium
EKAMR

SEQ ID NO: 396185 - protein, 4 aa, Mycobacterium
EKAN

SEQ ID NO: 396186 - protein, 14 aa, Mycobacterium
EKANAQDQKLAEEV

SEQ ID NO: 396187 - protein, 4 aa, Mycobacterium
EKAP

SEQ ID NO: 396188 - protein, 6 aa, Mycobacterium
EKAQEL

SEQ ID NO: 396189 - protein, 10 aa, Mycobacterium
EKASGRDLSD

SEQ ID NO: 396190 - protein, 6 aa, Mycobacterium
EKAYDA

SEQ ID NO: 396191 - protein, 8 aa, Mycobacterium
EKDREAAK

SEQ ID NO: 396192 - protein, 7 aa, Mycobacterium
EKGGSAR

SEQ ID NO: 396193 - protein, 5 aa, Mycobacterium
EKGPE

SEQ ID NO: 396194 - protein, 10 aa, Mycobacterium
EKGQADNLER

SEQ ID NO: 396195 - protein, 10 aa, Mycobacterium
EKKPKDAETK

SEQ ID NO: 396196 - protein, 4 aa, Mycobacterium
EKLK

SEQ ID NO: 396197 - protein, 7 aa, Mycobacterium
EKMSKSV

SEQ ID NO: 396198 - protein, 7 aa, Mycobacterium
EKPEAVD

SEQ ID NO: 396199 - protein, 12 aa, Mycobacterium
EKPGRDPRPAFT

SEQ ID NO: 396200 - protein, 10 aa, Mycobacterium
EKPKAEDAPS

SEQ ID NO: 396201 - protein, 5 aa, Mycobacterium
EKPVK

SEQ ID NO: 396202 - protein, 12 aa, Mycobacterium
EKPVTSDGPHYP

SEQ ID NO: 396203 - protein, 8 aa, Mycobacterium
EKQRDKVD

SEQ ID NO: 396204 - protein, 13 aa, Mycobacterium
EKRDPDWSRFPRY

SEQ ID NO: 396205 - protein, 4 aa, Mycobacterium
EKRI

SEQ ID NO: 396206 - protein, 9 aa, Mycobacterium
EKRRAESTD

SEQ ID NO: 396207 - protein, 9 aa, Mycobacterium
EKRRNPTDD

SEQ ID NO: 396208 - protein, 7 aa, Mycobacterium
EKRTGQR

SEQ ID NO: 396209 - protein, 4 aa, Mycobacterium
EKSL

SEQ ID NO: 396210 - protein, 8 aa, Mycobacterium
EKVEGSDF

SEQ ID NO: 396211 - protein, 9 aa, Mycobacterium
EKVREDPRW

SEQ ID NO: 396212 - protein, 10 aa, Mycobacterium
EKYEAPLAEG

SEQ ID NO: 396213 - protein, 5 aa, Mycobacterium
ELADP

SEQ ID NO: 396214 - protein, 5 aa, Mycobacterium
ELAEQ

SEQ ID NO: 396215 - protein, 6 aa, Mycobacterium
ELAKSG

SEQ ID NO: 396216 - protein, 6 aa, Mycobacterium
ELAPDG

SEQ ID NO: 396217 - protein, 8 aa, Mycobacterium
ELAPPDGG

SEQ ID NO: 396218 - protein, 7 aa, Mycobacterium
ELASPDA

SEQ ID NO: 396219 - protein, 6 aa, Mycobacterium
ELDAGD

SEQ ID NO: 396220 - protein, 4 aa, Mycobacterium
ELDE

SEQ ID NO: 396221 - protein, 6 aa, Mycobacterium
ELDPAA

SEQ ID NO: 396222 - protein, 7 aa, Mycobacterium
ELDSAGA

SEQ ID NO: 396223 - protein, 4 aa, Mycobacterium
ELEE

SEQ ID NO: 396224 - protein, 9 aa, Mycobacterium
ELEEAGGQA

SEQ ID NO: 396225 - protein, 5 aa, Mycobacterium
ELEGE

SEQ ID NO: 396226 - protein, 6 aa, Mycobacterium
ELERTG

SEQ ID NO: 396227 - protein, 7 aa, Mycobacterium
ELGEAAE

SEQ ID NO: 396228 - protein, 4 aa, Mycobacterium
ELGG

SEQ ID NO: 396229 - protein, 5 aa, Mycobacterium
ELGGK

SEQ ID NO: 396230 - protein, 12 aa, Mycobacterium
ELGGSDAQARYG

SEQ ID NO: 396231 - protein, 4 aa, Mycobacterium
ELGI

SEQ ID NO: 396232 - protein, 9 aa, Mycobacterium
ELGPDAPVE

SEQ ID NO: 396233 - protein, 6 aa, Mycobacterium
ELGPDE

SEQ ID NO: 396234 - protein, 7 aa, Mycobacterium
ELGPDGV

SEQ ID NO: 396235 - protein, 11 aa, Mycobacterium
ELGRTQNGNNN

SEQ ID NO: 396236 - protein, 4 aa, Mycobacterium
ELGT

SEQ ID NO: 396237 - protein, 15 aa, Mycobacterium
ELGTGPVSYEDSISP

SEQ ID NO: 396238 - protein, 5 aa, Mycobacterium
ELKGA

SEQ ID NO: 396239 - protein, 14 aa, Mycobacterium
ELPDGRRGTSEKTR

SEQ ID NO: 396240 - protein, 6 aa, Mycobacterium
ELPDGS

SEQ ID NO: 396241 - protein, 4 aa, Mycobacterium
ELPE

SEQ ID NO: 396242 - protein, 5 aa, Mycobacterium
ELPGA

SEQ ID NO: 396243 - protein, 5 aa, Mycobacterium
ELPKP

SEQ ID NO: 396244 - protein, 6 aa, Mycobacterium
ELPRND

SEQ ID NO: 396245 - protein, 9 aa, Mycobacterium
ELQKRSTGR

SEQ ID NO: 396246 - protein, 9 aa, Mycobacterium
ELQSTNDEL

SEQ ID NO: 396247 - protein, 19 aa, Mycobacterium
ELQSTNEELETTNEELQST

SEQ ID NO: 396248 - protein, 4 aa, Mycobacterium
ELRP

SEQ ID NO: 396249 - protein, 7 aa, Mycobacterium
ELRSKPG

SEQ ID NO: 396250 - protein, 4 aa, Mycobacterium
ELSD

SEQ ID NO: 396251 - protein, 6 aa, Mycobacterium
ELSEST

SEQ ID NO: 396252 - protein, 6 aa, Mycobacterium
ELSGTG

SEQ ID NO: 396253 - protein, 10 aa, Mycobacterium
ELSPGERTRA

SEQ ID NO: 396254 - protein, 9 aa, Mycobacterium
ELSPSPDEV

SEQ ID NO: 396255 - protein, 10 aa, Mycobacterium
ELSTDESPGF

SEQ ID NO: 396256 - protein, 4 aa, Mycobacterium
ELTA

SEQ ID NO: 396257 - protein, 11 aa, Mycobacterium
ELTAEAAQASV

SEQ ID NO: 396258 - protein, 4 aa, Mycobacterium
ELTE

SEQ ID NO: 396259 - protein, 4 aa, Mycobacterium
ELTG

SEQ ID NO: 396260 - protein, 9 aa, Mycobacterium
ELTGGRDDV

SEQ ID NO: 396261 - protein, 7 aa, Mycobacterium
ELTGGRG

SEQ ID NO: 396262 - protein, 5 aa, Mycobacterium
ELTPS

SEQ ID NO: 396263 - protein, 5 aa, Mycobacterium
ELTRE

SEQ ID NO: 396264 - protein, 10 aa, Mycobacterium
ELTSTSNCTT

SEQ ID NO: 396265 - protein, 7 aa, Mycobacterium
EMGPSYP

SEQ ID NO: 396266 - protein, 8 aa, Mycobacterium
EMGSPRSF

SEQ ID NO: 396267 - protein, 6 aa, Mycobacterium
EMPDGD

SEQ ID NO: 396268 - protein, 8 aa, Mycobacterium
EMRGATAP

SEQ ID NO: 396269 - protein, 6 aa, Mycobacterium
EMSGGR

SEQ ID NO: 396270 - protein, 6 aa, Mycobacterium
EMTGNI

SEQ ID NO: 396271 - protein, 4 aa, Mycobacterium
ENAD

SEQ ID NO: 396272 - protein, 4 aa, Mycobacterium
ENAP

SEQ ID NO: 396273 - protein, 7 aa, Mycobacterium
ENAPDSA

SEQ ID NO: 396274 - protein, 4 aa, Mycobacterium
ENAR

SEQ ID NO: 396275 - protein, 6 aa, Mycobacterium
ENATSE

SEQ ID NO: 396276 - protein, 4 aa, Mycobacterium
ENDP

SEQ ID NO: 396277 - protein, 8 aa, Mycobacterium
ENGAGKST

SEQ ID NO: 396278 - protein, 6 aa, Mycobacterium
ENGDVD

SEQ ID NO: 396279 - protein, 8 aa, Mycobacterium
ENGPDSSH

SEQ ID NO: 396280 - protein, 4 aa, Mycobacterium
ENGW

SEQ ID NO: 396281 - protein, 4 aa, Mycobacterium
ENGY

SEQ ID NO: 396282 - protein, 8 aa, Mycobacterium
ENHTPPQR

SEQ ID NO: 396283 - protein, 7 aa, Mycobacterium
ENISPKE

SEQ ID NO: 396284 - protein, 4 aa, Mycobacterium
ENLD

SEQ ID NO: 396285 - protein, 7 aa, Mycobacterium
ENLGAAP

SEQ ID NO: 396286 - protein, 8 aa, Mycobacterium
ENLGDEPR

SEQ ID NO: 396287 - protein, 11 aa, Mycobacterium
ENLGQRPARFA

SEQ ID NO: 396288 - protein, 8 aa, Mycobacterium
ENLPSDGA

SEQ ID NO: 396289 - protein, 16 aa, Mycobacterium
ENPANPEIHRKTTAEE

SEQ ID NO: 396290 - protein, 5 aa, Mycobacterium
ENPDL

SEQ ID NO: 396291 - protein, 5 aa, Mycobacterium
ENPEL

SEQ ID NO: 396292 - protein, 7 aa, Mycobacterium
ENPEYPP

SEQ ID NO: 396293 - protein, 6 aa, Mycobacterium
ENPHQQ

SEQ ID NO: 396294 - protein, 4 aa, Mycobacterium
ENPI

SEQ ID NO: 396295 - protein, 5 aa, Mycobacterium
ENPLH

SEQ ID NO: 396296 - protein, 8 aa, Mycobacterium
ENPPTDTR

SEQ ID NO: 396297 - protein, 7 aa, Mycobacterium
ENQAEHV

SEQ ID NO: 396298 - protein, 7 aa, Mycobacterium
ENQHDET

SEQ ID NO: 396299 - protein, 10 aa, Mycobacterium
ENRELGDTST

SEQ ID NO: 396300 - protein, 4 aa, Mycobacterium
ENRS

SEQ ID NO: 396301 - protein, 5 aa, Mycobacterium
ENSAF

SEQ ID NO: 396302 - protein, 8 aa, Mycobacterium
ENSANLGG

SEQ ID NO: 396303 - protein, 7 aa, Mycobacterium
ENSRENF

SEQ ID NO: 396304 - protein, 7 aa, Mycobacterium
ENTGASF

SEQ ID NO: 396305 - protein, 9 aa, Mycobacterium
ENVAESLTR

SEQ ID NO: 396306 - protein, 4 aa, Mycobacterium
ENVG

SEQ ID NO: 396307 - protein, 4 aa, Mycobacterium
ENVT

SEQ ID NO: 396308 - protein, 5 aa, Mycobacterium
ENVYP

SEQ ID NO: 396309 - protein, 4 aa, Mycobacterium
ENYD

SEQ ID NO: 396310 - protein, 10 aa, Mycobacterium
ENYPSLDPQG

SEQ ID NO: 396311 - protein, 5 aa, Mycobacterium
EPAAV

SEQ ID NO: 396312 - protein, 5 aa, Mycobacterium
EPAEA

SEQ ID NO: 396313 - protein, 6 aa, Mycobacterium
EPAEGE

SEQ ID NO: 396314 - protein, 4 aa, Mycobacterium
EPAM

SEQ ID NO: 396315 - protein, 5 aa, Mycobacterium
EPATI

SEQ ID NO: 396316 - protein, 6 aa, Mycobacterium
EPAYLG

SEQ ID NO: 396317 - protein, 21 aa, Mycobacterium
EPDAGSDVGAGRAKAIEQPDG

SEQ ID NO: 396318 - protein, 23 aa, Mycobacterium
EPDAGSDVGAGRTKAVKQDDGSW

SEQ ID NO: 396319 - protein, 20 aa, Mycobacterium
EPDAGSNSHKITTTARRDGS

SEQ ID NO: 396320 - protein, 21 aa, Mycobacterium
EPDAGSNSHNISTTAKRDGDD

SEQ ID NO: 396321 - protein, 20 aa, Mycobacterium
EPDAGSNSHRITTTARRDGS

SEQ ID NO: 396322 - protein, 4 aa, Mycobacterium
EPDE

SEQ ID NO: 396323 - protein, 5 aa, Mycobacterium
EPDGT

SEQ ID NO: 396324 - protein, 10 aa, Mycobacterium
EPDKVEGGMR

SEQ ID NO: 396325 - protein, 4 aa, Mycobacterium
EPDL

SEQ ID NO: 396326 - protein, 8 aa, Mycobacterium
EPDPDDVA

SEQ ID NO: 396327 - protein, 5 aa, Mycobacterium
EPDPL

SEQ ID NO: 396328 - protein, 5 aa, Mycobacterium
EPDVA

SEQ ID NO: 396329 - protein, 20 aa, Mycobacterium
EPDVGSDPAAMKTRARRDGS

SEQ ID NO: 396330 - protein, 19 aa, Mycobacterium
EPEAGSDAASVKTRATRVD

SEQ ID NO: 396331 - protein, 5 aa, Mycobacterium
EPEAV

SEQ ID NO: 396332 - protein, 6 aa, Mycobacterium
EPEDES

SEQ ID NO: 396333 - protein, 8 aa, Mycobacterium
EPEHSAYR

SEQ ID NO: 396334 - protein, 4 aa, Mycobacterium
EPEI

SEQ ID NO: 396335 - protein, 8 aa, Mycobacterium
EPEITPTD

SEQ ID NO: 396336 - protein, 10 aa, Mycobacterium
EPEMGTAQQQ

SEQ ID NO: 396337 - protein, 7 aa, Mycobacterium
EPETDLD

SEQ ID NO: 396338 - protein, 4 aa, Mycobacterium
EPEY

SEQ ID NO: 396339 - protein, 5 aa, Mycobacterium
EPFAS

SEQ ID NO: 396340 - protein, 5 aa, Mycobacterium
EPGAA

SEQ ID NO: 396341 - protein, 22 aa, Mycobacterium
EPGAGSDLAGLSTKATRTDGGW

SEQ ID NO: 396342 - protein, 10 aa, Mycobacterium
EPGAGSDLAS

SEQ ID NO: 396343 - protein, 6 aa, Mycobacterium
EPGDPL

SEQ ID NO: 396344 - protein, 8 aa, Mycobacterium
EPGEPNAE

SEQ ID NO: 396345 - protein, 4 aa, Mycobacterium
EPGF

SEQ ID NO: 396346 - protein, 7 aa, Mycobacterium
EPGQARD

SEQ ID NO: 396347 - protein, 6 aa, Mycobacterium
EPGQRY

SEQ ID NO: 396348 - protein, 5 aa, Mycobacterium
EPGRR

SEQ ID NO: 396349 - protein, 4 aa, Mycobacterium
EPGS

SEQ ID NO: 396350 - protein, 4 aa, Mycobacterium
EPGT

SEQ ID NO: 396351 - protein, 6 aa, Mycobacterium
EPGTDH

SEQ ID NO: 396352 - protein, 5 aa, Mycobacterium
EPGVV

SEQ ID NO: 396353 - protein, 7 aa, Mycobacterium
EPHPSRE

SEQ ID NO: 396354 - protein, 12 aa, Mycobacterium
EPHRSGRYQPNG

SEQ ID NO: 396355 - protein, 4 aa, Mycobacterium
EPID

SEQ ID NO: 396356 - protein, 4 aa, Mycobacterium
EPKQ

SEQ ID NO: 396357 - protein, 13 aa, Mycobacterium
EPKTKSDQEKLGT

SEQ ID NO: 396358 - protein, 5 aa, Mycobacterium
EPLDT

SEQ ID NO: 396359 - protein, 5 aa, Mycobacterium
EPLNP

SEQ ID NO: 396360 - protein, 4 aa, Mycobacterium
EPLP

SEQ ID NO: 396361 - protein, 4 aa, Mycobacterium
EPMP

SEQ ID NO: 396362 - protein, 5 aa, Mycobacterium
EPNGG

SEQ ID NO: 396363 - protein, 8 aa, Mycobacterium
EPNGPTEK

SEQ ID NO: 396364 - protein, 6 aa, Mycobacterium
EPNLED

SEQ ID NO: 396365 - protein, 7 aa, Mycobacterium
EPNLKPG

SEQ ID NO: 396366 - protein, 4 aa, Mycobacterium
EPNP

SEQ ID NO: 396367 - protein, 9 aa, Mycobacterium
EPNPDDARS

SEQ ID NO: 396368 - protein, 7 aa, Mycobacterium
EPNPGWT

SEQ ID NO: 396369 - protein, 4 aa, Mycobacterium
EPNT

SEQ ID NO: 396370 - protein, 7 aa, Mycobacterium
EPPAGLR

SEQ ID NO: 396371 - protein, 6 aa, Mycobacterium
EPPAPH

SEQ ID NO: 396372 - protein, 5 aa, Mycobacterium
EPPAT

SEQ ID NO: 396373 - protein, 7 aa, Mycobacterium
EPPATAL

SEQ ID NO: 396374 - protein, 6 aa, Mycobacterium
EPPDHT

SEQ ID NO: 396375 - protein, 6 aa, Mycobacterium
EPPDTF

SEQ ID NO: 396376 - protein, 7 aa, Mycobacterium
EPPDTFT

SEQ ID NO: 396377 - protein, 10 aa, Mycobacterium
EPPGAPDPLR

SEQ ID NO: 396378 - protein, 8 aa, Mycobacterium
EPPGGPAL

SEQ ID NO: 396379 - protein, 5 aa, Mycobacterium
EPPGP

SEQ ID NO: 396380 - protein, 4 aa, Mycobacterium
EPPI

SEQ ID NO: 396381 - protein, 7 aa, Mycobacterium
EPPSPVQ

SEQ ID NO: 396382 - protein, 17 aa, Mycobacterium
EPQFEGQTKTKLGNTEV

SEQ ID NO: 396383 - protein, 9 aa, Mycobacterium
EPQGGADPR

SEQ ID NO: 396384 - protein, 10 aa, Mycobacterium
EPQGGADPRV

SEQ ID NO: 396385 - protein, 4 aa, Mycobacterium
EPQL

SEQ ID NO: 396386 - protein, 10 aa, Mycobacterium
EPQSAGACGS

SEQ ID NO: 396387 - protein, 8 aa, Mycobacterium
EPQYGPPP

SEQ ID NO: 396388 - protein, 4 aa, Mycobacterium
EPRA

SEQ ID NO: 396389 - protein, 5 aa, Mycobacterium
EPRGA

SEQ ID NO: 396390 - protein, 6 aa, Mycobacterium
EPRGPQ

SEQ ID NO: 396391 - protein, 4 aa, Mycobacterium
EPRK

SEQ ID NO: 396392 - protein, 8 aa, Mycobacterium
EPRPGYGS

SEQ ID NO: 396393 - protein, 11 aa, Mycobacterium
EPRPSWGDPKY

SEQ ID NO: 396394 - protein, 4 aa, Mycobacterium
EPRR

SEQ ID NO: 396395 - protein, 7 aa, Mycobacterium
EPRSENS

SEQ ID NO: 396396 - protein, 6 aa, Mycobacterium
EPSAPL

SEQ ID NO: 396397 - protein, 6 aa, Mycobacterium
EPSAVS

SEQ ID NO: 396398 - protein, 8 aa, Mycobacterium
EPSETSQV

SEQ ID NO: 396399 - protein, 4 aa, Mycobacterium
EPSF

SEQ ID NO: 396400 - protein, 9 aa, Mycobacterium
EPSSPLQPY

SEQ ID NO: 396401 - protein, 5 aa, Mycobacterium
EPSVA

SEQ ID NO: 396402 - protein, 6 aa, Mycobacterium
EPSVED

SEQ ID NO: 396403 - protein, 6 aa, Mycobacterium
EPTETA

SEQ ID NO: 396404 - protein, 15 aa, Mycobacterium
EPTGAATGHLATEGA

SEQ ID NO: 396405 - protein, 4 aa, Mycobacterium
EPTL

SEQ ID NO: 396406 - protein, 4 aa, Mycobacterium
EPTN

SEQ ID NO: 396407 - protein, 7 aa, Mycobacterium
EPTPPPI

SEQ ID NO: 396408 - protein, 4 aa, Mycobacterium
EPTS

SEQ ID NO: 396409 - protein, 4 aa, Mycobacterium
EPTT

SEQ ID NO: 396410 - protein, 5 aa, Mycobacterium
EPTVE

SEQ ID NO: 396411 - protein, 7 aa, Mycobacterium
EPVAPSR

SEQ ID NO: 396412 - protein, 7 aa, Mycobacterium
EPVGNVD

SEQ ID NO: 396413 - protein, 4 aa, Mycobacterium
EPVP

SEQ ID NO: 396414 - protein, 6 aa, Mycobacterium
EPVPPN

SEQ ID NO: 396415 - protein, 5 aa, Mycobacterium
EPWRG

SEQ ID NO: 396416 - protein, 5 aa, Mycobacterium
EPYEV

SEQ ID NO: 396417 - protein, 10 aa, Mycobacterium
EQAAARRRDP

SEQ ID NO: 396418 - protein, 5 aa, Mycobacterium
EQAAD

SEQ ID NO: 396419 - protein, 6 aa, Mycobacterium
EQAGPD

SEQ ID NO: 396420 - protein, 7 aa, Mycobacterium
EQAPTEE

SEQ ID NO: 396421 - protein, 6 aa, Mycobacterium
EQATGA

SEQ ID NO: 396422 - protein, 4 aa, Mycobacterium
EQEM

SEQ ID NO: 396423 - protein, 4 aa, Mycobacterium
EQEV

SEQ ID NO: 396424 - protein, 4 aa, Mycobacterium
EQGE

SEQ ID NO: 396425 - protein, 8 aa, Mycobacterium
EQGKTEWA

SEQ ID NO: 396426 - protein, 6 aa, Mycobacterium
EQGTGG

SEQ ID NO: 396427 - protein, 5 aa, Mycobacterium
EQIER

SEQ ID NO: 396428 - protein, 4 aa, Mycobacterium
EQIR

SEQ ID NO: 396429 - protein, 7 aa, Mycobacterium
EQLGSEP

SEQ ID NO: 396430 - protein, 4 aa, Mycobacterium
EQLR

SEQ ID NO: 396431 - protein, 4 aa, Mycobacterium
EQLS

SEQ ID NO: 396432 - protein, 6 aa, Mycobacterium
EQLSEA

SEQ ID NO: 396433 - protein, 8 aa, Mycobacterium
EQNAKDAA

SEQ ID NO: 396434 - protein, 7 aa, Mycobacterium
EQNPEAA

SEQ ID NO: 396435 - protein, 6 aa, Mycobacterium
EQNPET

SEQ ID NO: 396436 - protein, 4 aa, Mycobacterium
EQNV

SEQ ID NO: 396437 - protein, 6 aa, Mycobacterium
EQPAAV

SEQ ID NO: 396438 - protein, 7 aa, Mycobacterium
EQPAAVS

SEQ ID NO: 396439 - protein, 5 aa, Mycobacterium
EQPDL

SEQ ID NO: 396440 - protein, 6 aa, Mycobacterium
EQPDLN

SEQ ID NO: 396441 - protein, 9 aa, Mycobacterium
EQPVRPISA

SEQ ID NO: 396442 - protein, 5 aa, Mycobacterium
EQQAA

SEQ ID NO: 396443 - protein, 4 aa, Mycobacterium
EQQG

SEQ ID NO: 396444 - protein, 11 aa, Mycobacterium
EQQSAGDGPGV

SEQ ID NO: 396445 - protein, 4 aa, Mycobacterium
EQRA

SEQ ID NO: 396446 - protein, 10 aa, Mycobacterium
EQRDDPALRG

SEQ ID NO: 396447 - protein, 10 aa, Mycobacterium
EQRDDPSLRG

SEQ ID NO: 396448 - protein, 16 aa, Mycobacterium
EQREAEGGSKVPEDTL

SEQ ID NO: 396449 - protein, 4 aa, Mycobacterium
EQRG

SEQ ID NO: 396450 - protein, 5 aa, Mycobacterium
EQRPD

SEQ ID NO: 396451 - protein, 4 aa, Mycobacterium
EQSD

SEQ ID NO: 396452 - protein, 7 aa, Mycobacterium
EQSRGVA

SEQ ID NO: 396453 - protein, 5 aa, Mycobacterium
EQTAA

SEQ ID NO: 396454 - protein, 6 aa, Mycobacterium
EQTARS

SEQ ID NO: 396455 - protein, 4 aa, Mycobacterium
EQTE

SEQ ID NO: 396456 - protein, 11 aa, Mycobacterium
EQTGGFEGRTK

SEQ ID NO: 396457 - protein, 9 aa, Mycobacterium
EQTGSTNAD

SEQ ID NO: 396458 - protein, 7 aa, Mycobacterium
EQTHGAD

SEQ ID NO: 396459 - protein, 8 aa, Mycobacterium
EQTQTDAE

SEQ ID NO: 396460 - protein, 4 aa, Mycobacterium
EQTR

SEQ ID NO: 396461 - protein, 8 aa, Mycobacterium
EQVEASAE

SEQ ID NO: 396462 - protein, 12 aa, Mycobacterium
EQVPGESYEHGN

SEQ ID NO: 396463 - protein, 6 aa, Mycobacterium
EQVPSA

SEQ ID NO: 396464 - protein, 4 aa, Mycobacterium
EQVR

SEQ ID NO: 396465 - protein, 5 aa, Mycobacterium
EQVTT

SEQ ID NO: 396466 - protein, 4 aa, Mycobacterium
EQYG

SEQ ID NO: 396467 - protein, 10 aa, Mycobacterium
EQYGGGGGGI

SEQ ID NO: 396468 - protein, 13 aa, Mycobacterium
EQYGPDVLELVRG

SEQ ID NO: 396469 - protein, 7 aa, Mycobacterium
ERAAELG

SEQ ID NO: 396470 - protein, 5 aa, Mycobacterium
ERAAG

SEQ ID NO: 396471 - protein, 14 aa, Mycobacterium
ERAATRGDGRVGED

SEQ ID NO: 396472 - protein, 4 aa, Mycobacterium
ERAD

SEQ ID NO: 396473 - protein, 5 aa, Mycobacterium
ERADG

SEQ ID NO: 396474 - protein, 8 aa, Mycobacterium
ERAEEAER

SEQ ID NO: 396475 - protein, 5 aa, Mycobacterium
ERAEN

SEQ ID NO: 396476 - protein, 6 aa, Mycobacterium
ERAGVS

SEQ ID NO: 396477 - protein, 10 aa, Mycobacterium
ERAHDTATPQ

SEQ ID NO: 396478 - protein, 4 aa, Mycobacterium
ERAK

SEQ ID NO: 396479 - protein, 11 aa, Mycobacterium
ERAKAGGDRIG

SEQ ID NO: 396480 - protein, 8 aa, Mycobacterium
ERAPVTGA

SEQ ID NO: 396481 - protein, 19 aa, Mycobacterium
ERAQSRASRLQRRQAASDA

SEQ ID NO: 396482 - protein, 7 aa, Mycobacterium
ERARQAG

SEQ ID NO: 396483 - protein, 4 aa, Mycobacterium
ERAT

SEQ ID NO: 396484 - protein, 7 aa, Mycobacterium
ERAVTDQ

SEQ ID NO: 396485 - protein, 4 aa, Mycobacterium
ERDG

SEQ ID NO: 396486 - protein, 8 aa, Mycobacterium
ERDLGDAE

SEQ ID NO: 396487 - protein, 5 aa, Mycobacterium
ERDPE

SEQ ID NO: 396488 - protein, 7 aa, Mycobacterium
EREGEDD

SEQ ID NO: 396489 - protein, 9 aa, Mycobacterium
EREGGDSTV

SEQ ID NO: 396490 - protein, 19 aa, Mycobacterium
EREPSLARTTTSDQQSISV

SEQ ID NO: 396491 - protein, 12 aa, Mycobacterium
ERESSSPADELE

SEQ ID NO: 396492 - protein, 4 aa, Mycobacterium
ERFS

SEQ ID NO: 396493 - protein, 7 aa, Mycobacterium
ERGAEPD

SEQ ID NO: 396494 - protein, 8 aa, Mycobacterium
ERGAPTPV

SEQ ID NO: 396495 - protein, 14 aa, Mycobacterium
ERGARNEPATPDDI

SEQ ID NO: 396496 - protein, 9 aa, Mycobacterium
ERGCSAPGC

SEQ ID NO: 396497 - protein, 5 aa, Mycobacterium
ERGEL

SEQ ID NO: 396498 - protein, 4 aa, Mycobacterium
ERGF

SEQ ID NO: 396499 - protein, 11 aa, Mycobacterium
ERGGDRVRGAV

SEQ ID NO: 396500 - protein, 8 aa, Mycobacterium
ERGGEGLA

SEQ ID NO: 396501 - protein, 9 aa, Mycobacterium
ERGGTPLRS

SEQ ID NO: 396502 - protein, 14 aa, Mycobacterium
ERGGYDAQGHGNSV

SEQ ID NO: 396503 - protein, 6 aa, Mycobacterium
ERGLAA

SEQ ID NO: 396504 - protein, 6 aa, Mycobacterium
ERGLPN

SEQ ID NO: 396505 - protein, 11 aa, Mycobacterium
ERGPDAVSTDD

SEQ ID NO: 396506 - protein, 5 aa, Mycobacterium
ERGQE

SEQ ID NO: 396507 - protein, 7 aa, Mycobacterium
ERGQGGT

SEQ ID NO: 396508 - protein, 7 aa, Mycobacterium
ERGVTDE

SEQ ID NO: 396509 - protein, 4 aa, Mycobacterium
ERHA

SEQ ID NO: 396510 - protein, 10 aa, Mycobacterium
ERHAQKNERP

SEQ ID NO: 396511 - protein, 4 aa, Mycobacterium
ERHG

SEQ ID NO: 396512 - protein, 4 aa, Mycobacterium
ERIG

SEQ ID NO: 396513 - protein, 6 aa, Mycobacterium
ERIGAD

SEQ ID NO: 396514 - protein, 8 aa, Mycobacterium
ERLGGDGL

SEQ ID NO: 396515 - protein, 10 aa, Mycobacterium
ERLGGDGVGL

SEQ ID NO: 396516 - protein, 5 aa, Mycobacterium
ERLGP

SEQ ID NO: 396517 - protein, 4 aa, Mycobacterium
ERLS

SEQ ID NO: 396518 - protein, 5 aa, Mycobacterium
ERLTD

SEQ ID NO: 396519 - protein, 4 aa, Mycobacterium
ERMA

SEQ ID NO: 396520 - protein, 6 aa, Mycobacterium
ERNKER

SEQ ID NO: 396521 - protein, 4 aa, Mycobacterium
ERNL

SEQ ID NO: 396522 - protein, 4 aa, Mycobacterium
ERNP

SEQ ID NO: 396523 - protein, 6 aa, Mycobacterium
ERNPEL

SEQ ID NO: 396524 - protein, 6 aa, Mycobacterium
ERNSGL

SEQ ID NO: 396525 - protein, 7 aa, Mycobacterium
ERPADEP

SEQ ID NO: 396526 - protein, 10 aa, Mycobacterium
ERPASSGETL

SEQ ID NO: 396527 - protein, 7 aa, Mycobacterium
ERPDSGG

SEQ ID NO: 396528 - protein, 4 aa, Mycobacterium
ERPE

SEQ ID NO: 396529 - protein, 7 aa, Mycobacterium
ERPEETD

SEQ ID NO: 396530 - protein, 6 aa, Mycobacterium
ERPGTD

SEQ ID NO: 396531 - protein, 5 aa, Mycobacterium
ERPKA

SEQ ID NO: 396532 - protein, 8 aa, Mycobacterium
ERPKMPDI

SEQ ID NO: 396533 - protein, 4 aa, Mycobacterium
ERPS

SEQ ID NO: 396534 - protein, 6 aa, Mycobacterium
ERPTFS

SEQ ID NO: 396535 - protein, 4 aa, Mycobacterium
ERPV

SEQ ID NO: 396536 - protein, 4 aa, Mycobacterium
ERQE

SEQ ID NO: 396537 - protein, 4 aa, Mycobacterium
ERQG

SEQ ID NO: 396538 - protein, 7 aa, Mycobacterium
ERQPDGT

SEQ ID NO: 396539 - protein, 5 aa, Mycobacterium
ERQPE

SEQ ID NO: 396540 - protein, 4 aa, Mycobacterium
ERQR

SEQ ID NO: 396541 - protein, 8 aa, Mycobacterium
ERQRDKVD

SEQ ID NO: 396542 - protein, 9 aa, Mycobacterium
ERRAPDAVT

SEQ ID NO: 396543 - protein, 6 aa, Mycobacterium
ERRDEP

SEQ ID NO: 396544 - protein, 4 aa, Mycobacterium
ERRE

SEQ ID NO: 396545 - protein, 6 aa, Mycobacterium
ERRGAR

SEQ ID NO: 396546 - protein, 9 aa, Mycobacterium
ERRQPTTTL

SEQ ID NO: 396547 - protein, 4 aa, Mycobacterium
ERRR

SEQ ID NO: 396548 - protein, 5 aa, Mycobacterium
ERRRL

SEQ ID NO: 396549 - protein, 7 aa, Mycobacterium
ERRTRES

SEQ ID NO: 396550 - protein, 5 aa, Mycobacterium
ERRTT

SEQ ID NO: 396551 - protein, 4 aa, Mycobacterium
ERSD

SEQ ID NO: 396552 - protein, 4 aa, Mycobacterium
ERSE

SEQ ID NO: 396553 - protein, 4 aa, Mycobacterium
ERSG

SEQ ID NO: 396554 - protein, 8 aa, Mycobacterium
ERSGPARA

SEQ ID NO: 396555 - protein, 8 aa, Mycobacterium
ERSGPSRA

SEQ ID NO: 396556 - protein, 9 aa, Mycobacterium
ERSGVSNPY

SEQ ID NO: 396557 - protein, 4 aa, Mycobacterium
ERSP

SEQ ID NO: 396558 - protein, 7 aa, Mycobacterium
ERSPNTV

SEQ ID NO: 396559 - protein, 5 aa, Mycobacterium
ERSPT

SEQ ID NO: 396560 - protein, 10 aa, Mycobacterium
ERSPVTTTSP

SEQ ID NO: 396561 - protein, 4 aa, Mycobacterium
ERSR

SEQ ID NO: 396562 - protein, 7 aa, Mycobacterium
ERTDQST

SEQ ID NO: 396563 - protein, 7 aa, Mycobacterium
ERTDQTT

SEQ ID NO: 396564 - protein, 10 aa, Mycobacterium
ERTEDGFGQG

SEQ ID NO: 396565 - protein, 11 aa, Mycobacterium
ERTGAPYASTM

SEQ ID NO: 396566 - protein, 7 aa, Mycobacterium
ERTGDAR

SEQ ID NO: 396567 - protein, 8 aa, Mycobacterium
ERTGDARG

SEQ ID NO: 396568 - protein, 8 aa, Mycobacterium
ERTGEPTI

SEQ ID NO: 396569 - protein, 8 aa, Mycobacterium
ERTGTGQL

SEQ ID NO: 396570 - protein, 5 aa, Mycobacterium
ERTHA

SEQ ID NO: 396571 - protein, 10 aa, Mycobacterium
ERTKNPGEDL

SEQ ID NO: 396572 - protein, 6 aa, Mycobacterium
ERTPGE

SEQ ID NO: 396573 - protein, 6 aa, Mycobacterium
ERVQGA

SEQ ID NO: 396574 - protein, 6 aa, Mycobacterium
ERVQPA

SEQ ID NO: 396575 - protein, 6 aa, Mycobacterium
ERVRPE

SEQ ID NO: 396576 - protein, 9 aa, Mycobacterium
ERYDSGERC

SEQ ID NO: 396577 - protein, 6 aa, Mycobacterium
ERYRRS

SEQ ID NO: 396578 - protein, 5 aa, Mycobacterium
ESADE

SEQ ID NO: 396579 - protein, 4 aa, Mycobacterium
ESAE

SEQ ID NO: 396580 - protein, 5 aa, Mycobacterium
ESAGA

SEQ ID NO: 396581 - protein, 7 aa, Mycobacterium
ESAGATS

SEQ ID NO: 396582 - protein, 5 aa, Mycobacterium
ESAGL

SEQ ID NO: 396583 - protein, 7 aa, Mycobacterium
ESAPGDT

SEQ ID NO: 396584 - protein, 4 aa, Mycobacterium
ESAR

SEQ ID NO: 396585 - protein, 5 aa, Mycobacterium
ESARP

SEQ ID NO: 396586 - protein, 10 aa, Mycobacterium
ESARQFATRS

SEQ ID NO: 396587 - protein, 5 aa, Mycobacterium
ESCPP

SEQ ID NO: 396588 - protein, 9 aa, Mycobacterium
ESDAGHAAA

SEQ ID NO: 396589 - protein, 7 aa, Mycobacterium
ESDDAEN

SEQ ID NO: 396590 - protein, 6 aa, Mycobacterium
ESDDLR

SEQ ID NO: 396591 - protein, 10 aa, Mycobacterium
ESDEAAPARQ

SEQ ID NO: 396592 - protein, 4 aa, Mycobacterium
ESDG

SEQ ID NO: 396593 - protein, 8 aa, Mycobacterium
ESDIRRSA

SEQ ID NO: 396594 - protein, 4 aa, Mycobacterium
ESDL

SEQ ID NO: 396595 - protein, 4 aa, Mycobacterium
ESDR

SEQ ID NO: 396596 - protein, 8 aa, Mycobacterium
ESEKEELR

SEQ ID NO: 396597 - protein, 4 aa, Mycobacterium
ESEP

SEQ ID NO: 396598 - protein, 4 aa, Mycobacterium
ESEQ

SEQ ID NO: 396599 - protein, 24 aa, Mycobacterium
ESEQVSVRDANDANLRTKPGAPLK

SEQ ID NO: 396600 - protein, 7 aa, Mycobacterium
ESERHPV

SEQ ID NO: 396601 - protein, 4 aa, Mycobacterium
ESEW

SEQ ID NO: 396602 - protein, 6 aa, Mycobacterium
ESGDGV

SEQ ID NO: 396603 - protein, 8 aa, Mycobacterium
ESGDLTPS

SEQ ID NO: 396604 - protein, 7 aa, Mycobacterium
ESGDMEP

SEQ ID NO: 396605 - protein, 6 aa, Mycobacterium
ESGDYD

SEQ ID NO: 396606 - protein, 8 aa, Mycobacterium
ESGEREEL

SEQ ID NO: 396607 - protein, 6 aa, Mycobacterium
ESGFGS

SEQ ID NO: 396608 - protein, 5 aa, Mycobacterium
ESGFS

SEQ ID NO: 396609 - protein, 14 aa, Mycobacterium
ESGGPELADELEEN

SEQ ID NO: 396610 - protein, 10 aa, Mycobacterium
ESGHSARKLQ

SEQ ID NO: 396611 - protein, 9 aa, Mycobacterium
ESGPKTNEL

SEQ ID NO: 396612 - protein, 7 aa, Mycobacterium
ESGPSVA

SEQ ID NO: 396613 - protein, 5 aa, Mycobacterium
ESGPV

SEQ ID NO: 396614 - protein, 4 aa, Mycobacterium
ESGR

SEQ ID NO: 396615 - protein, 6 aa, Mycobacterium
ESGRGR

SEQ ID NO: 396616 - protein, 7 aa, Mycobacterium
ESGRGRT

SEQ ID NO: 396617 - protein, 7 aa, Mycobacterium
ESGTGLG

SEQ ID NO: 396618 - protein, 11 aa, Mycobacterium
ESGTTRPIDPW

SEQ ID NO: 396619 - protein, 4 aa, Mycobacterium
ESGV

SEQ ID NO: 396620 - protein, 9 aa, Mycobacterium
ESGVSKSEV

SEQ ID NO: 396621 - protein, 4 aa, Mycobacterium
ESGW

SEQ ID NO: 396622 - protein, 4 aa, Mycobacterium
ESGY

SEQ ID NO: 396623 - protein, 11 aa, Mycobacterium
ESIPDPVRETE

SEQ ID NO: 396624 - protein, 14 aa, Mycobacterium
ESKDQARAELAGEP

SEQ ID NO: 396625 - protein, 4 aa, Mycobacterium
ESLA

SEQ ID NO: 396626 - protein, 13 aa, Mycobacterium
ESLAAGGDALTDR

SEQ ID NO: 396627 - protein, 5 aa, Mycobacterium
ESLGS

SEQ ID NO: 396628 - protein, 4 aa, Mycobacterium
ESLR

SEQ ID NO: 396629 - protein, 5 aa, Mycobacterium
ESLSG

SEQ ID NO: 396630 - protein, 6 aa, Mycobacterium
ESLTPG

SEQ ID NO: 396631 - protein, 6 aa, Mycobacterium
ESMDPA

SEQ ID NO: 396632 - protein, 22 aa, Mycobacterium
ESMSRTPMGSSLANGGNPYGES

SEQ ID NO: 396633 - protein, 18 aa, Mycobacterium
ESNGKSTRADGTPVTTDT

SEQ ID NO: 396634 - protein, 8 aa, Mycobacterium
ESNLASTK

SEQ ID NO: 396635 - protein, 12 aa, Mycobacterium
ESNSVDQRSGVS

SEQ ID NO: 396636 - protein, 4 aa, Mycobacterium
ESNW

SEQ ID NO: 396637 - protein, 5 aa, Mycobacterium
ESPDG

SEQ ID NO: 396638 - protein, 6 aa, Mycobacterium
ESPPGA

SEQ ID NO: 396639 - protein, 6 aa, Mycobacterium
ESPRGE

SEQ ID NO: 396640 - protein, 4 aa, Mycobacterium
ESPT

SEQ ID NO: 396641 - protein, 4 aa, Mycobacterium
ESPV

SEQ ID NO: 396642 - protein, 4 aa, Mycobacterium
ESQD

SEQ ID NO: 396643 - protein, 6 aa, Mycobacterium
ESQIGT

SEQ ID NO: 396644 - protein, 5 aa, Mycobacterium
ESQTI

SEQ ID NO: 396645 - protein, 7 aa, Mycobacterium
ESRPEDR

SEQ ID NO: 396646 - protein, 7 aa, Mycobacterium
ESRPGDV

SEQ ID NO: 396647 - protein, 9 aa, Mycobacterium
ESRPTRTEL

SEQ ID NO: 396648 - protein, 15 aa, Mycobacterium
ESRRRSAATGGESRI

SEQ ID NO: 396649 - protein, 4 aa, Mycobacterium
ESRS

SEQ ID NO: 396650 - protein, 9 aa, Mycobacterium
ESRYEGPTG

SEQ ID NO: 396651 - protein, 5 aa, Mycobacterium
ESRYV

SEQ ID NO: 396652 - protein, 9 aa, Mycobacterium
ESSVGSGVR

SEQ ID NO: 396653 - protein, 4 aa, Mycobacterium
ESTG

SEQ ID NO: 396654 - protein, 6 aa, Mycobacterium
ESTGDL

SEQ ID NO: 396655 - protein, 7 aa, Mycobacterium
ESTGDLS

SEQ ID NO: 396656 - protein, 7 aa, Mycobacterium
ESTHITG

SEQ ID NO: 396657 - protein, 7 aa, Mycobacterium
ESTPVDA

SEQ ID NO: 396658 - protein, 8 aa, Mycobacterium
ESTSGQRA

SEQ ID NO: 396659 - protein, 15 aa, Mycobacterium
ESTSWPGVTRPTNLG

SEQ ID NO: 396660 - protein, 25 aa, Mycobacterium
ESTTNARRAHATSRTSLEIGKESEV

SEQ ID NO: 396661 - protein, 5 aa, Mycobacterium
ESTVP

SEQ ID NO: 396662 - protein, 6 aa, Mycobacterium
ESTVTD

SEQ ID NO: 396663 - protein, 4 aa, Mycobacterium
ESVE

SEQ ID NO: 396664 - protein, 4 aa, Mycobacterium
ESVG

SEQ ID NO: 396665 - protein, 9 aa, Mycobacterium
ESVGGDGAT

SEQ ID NO: 396666 - protein, 4 aa, Mycobacterium
ESVL

SEQ ID NO: 396667 - protein, 9 aa, Mycobacterium
ESVRNSYDV

SEQ ID NO: 396668 - protein, 8 aa, Mycobacterium
ESVTEGTV

SEQ ID NO: 396669 - protein, 7 aa, Mycobacterium
ESYGSNG

SEQ ID NO: 396670 - protein, 11 aa, Mycobacterium
ETAAESGRGFD

SEQ ID NO: 396671 - protein, 4 aa, Mycobacterium
ETAD

SEQ ID NO: 396672 - protein, 6 aa, Mycobacterium
ETADDN

SEQ ID NO: 396673 - protein, 4 aa, Mycobacterium
ETAG

SEQ ID NO: 396674 - protein, 8 aa, Mycobacterium
ETAGDRPI

SEQ ID NO: 396675 - protein, 9 aa, Mycobacterium
ETAGDRPIP

SEQ ID NO: 396676 - protein, 8 aa, Mycobacterium
ETAGEEAR

SEQ ID NO: 396677 - protein, 7 aa, Mycobacterium
ETAPDGV

SEQ ID NO: 396678 - protein, 4 aa, Mycobacterium
ETAT

SEQ ID NO: 396679 - protein, 6 aa, Mycobacterium
ETATED

SEQ ID NO: 396680 - protein, 10 aa, Mycobacterium
ETCPSSDGAA

SEQ ID NO: 396681 - protein, 4 aa, Mycobacterium
ETDA

SEQ ID NO: 396682 - protein, 12 aa, Mycobacterium
ETDDGLSGEEGT

SEQ ID NO: 396683 - protein, 5 aa, Mycobacterium
ETDDL

SEQ ID NO: 396684 - protein, 4 aa, Mycobacterium
ETDE

SEQ ID NO: 396685 - protein, 10 aa, Mycobacterium
ETDEQAEDPA

SEQ ID NO: 396686 - protein, 5 aa, Mycobacterium
ETDIP

SEQ ID NO: 396687 - protein, 5 aa, Mycobacterium
ETDPW

SEQ ID NO: 396688 - protein, 7 aa, Mycobacterium
ETDPWGG

SEQ ID NO: 396689 - protein, 6 aa, Mycobacterium
ETDTGV

SEQ ID NO: 396690 - protein, 8 aa, Mycobacterium
ETEKPDDV

SEQ ID NO: 396691 - protein, 10 aa, Mycobacterium
ETELSTGTVS

SEQ ID NO: 396692 - protein, 4 aa, Mycobacterium
ETEP

SEQ ID NO: 396693 - protein, 6 aa, Mycobacterium
ETERPT

SEQ ID NO: 396694 - protein, 12 aa, Mycobacterium
ETETAAAAAVAD

SEQ ID NO: 396695 - protein, 14 aa, Mycobacterium
ETETAKWRDPTGTV

SEQ ID NO: 396696 - protein, 5 aa, Mycobacterium
ETETG

SEQ ID NO: 396697 - protein, 8 aa, Mycobacterium
ETFGPGGS

SEQ ID NO: 396698 - protein, 5 aa, Mycobacterium
ETFPA

SEQ ID NO: 396699 - protein, 5 aa, Mycobacterium
ETFSP

SEQ ID NO: 396700 - protein, 10 aa, Mycobacterium
ETGAGQHGVA

SEQ ID NO: 396701 - protein, 6 aa, Mycobacterium
ETGAIK

SEQ ID NO: 396702 - protein, 7 aa, Mycobacterium
ETGAVPS

SEQ ID NO: 396703 - protein, 6 aa, Mycobacterium
ETGDDN

SEQ ID NO: 396704 - protein, 9 aa, Mycobacterium
ETGEPGERN

SEQ ID NO: 396705 - protein, 8 aa, Mycobacterium
ETGPDADR

SEQ ID NO: 396706 - protein, 18 aa, Mycobacterium
ETGQGKADIAEVTASQDR

SEQ ID NO: 396707 - protein, 6 aa, Mycobacterium
ETGQKG

SEQ ID NO: 396708 - protein, 4 aa, Mycobacterium
ETGR

SEQ ID NO: 396709 - protein, 4 aa, Mycobacterium
ETGT

SEQ ID NO: 396710 - protein, 4 aa, Mycobacterium
ETGV

SEQ ID NO: 396711 - protein, 5 aa, Mycobacterium
ETGVP

SEQ ID NO: 396712 - protein, 5 aa, Mycobacterium
ETHHT

SEQ ID NO: 396713 - protein, 8 aa, Mycobacterium
ETHPSEPN

SEQ ID NO: 396714 - protein, 4 aa, Mycobacterium
ETLY

SEQ ID NO: 396715 - protein, 4 aa, Mycobacterium
ETMT

SEQ ID NO: 396716 - protein, 4 aa, Mycobacterium
ETNV

SEQ ID NO: 396717 - protein, 4 aa, Mycobacterium
ETPD

SEQ ID NO: 396718 - protein, 6 aa, Mycobacterium
ETPEEV

SEQ ID NO: 396719 - protein, 5 aa, Mycobacterium
ETPGI

SEQ ID NO: 396720 - protein, 6 aa, Mycobacterium
ETPLSS

SEQ ID NO: 396721 - protein, 8 aa, Mycobacterium
ETPTSGDV

SEQ ID NO: 396722 - protein, 4 aa, Mycobacterium
ETPV

SEQ ID NO: 396723 - protein, 6 aa, Mycobacterium
ETQPDG

SEQ ID NO: 396724 - protein, 4 aa, Mycobacterium
ETRA

SEQ ID NO: 396725 - protein, 7 aa, Mycobacterium
ETRAEQL

SEQ ID NO: 396726 - protein, 6 aa, Mycobacterium
ETRGNP

SEQ ID NO: 396727 - protein, 4 aa, Mycobacterium
ETRR

SEQ ID NO: 396728 - protein, 7 aa, Mycobacterium
ETRTQGR

SEQ ID NO: 396729 - protein, 9 aa, Mycobacterium
ETSAAERAE

SEQ ID NO: 396730 - protein, 5 aa, Mycobacterium
ETSLT

SEQ ID NO: 396731 - protein, 5 aa, Mycobacterium
ETSPE

SEQ ID NO: 396732 - protein, 6 aa, Mycobacterium
ETSPLA

SEQ ID NO: 396733 - protein, 5 aa, Mycobacterium
ETSPM

SEQ ID NO: 396734 - protein, 9 aa, Mycobacterium
ETSPREKAT

SEQ ID NO: 396735 - protein, 7 aa, Mycobacterium
ETSRCGD

SEQ ID NO: 396736 - protein, 5 aa, Mycobacterium
ETSTP

SEQ ID NO: 396737 - protein, 9 aa, Mycobacterium
ETSVAGEPI

SEQ ID NO: 396738 - protein, 6 aa, Mycobacterium
ETSVGK

SEQ ID NO: 396739 - protein, 5 aa, Mycobacterium
ETTAN

SEQ ID NO: 396740 - protein, 5 aa, Mycobacterium
ETTAT

SEQ ID NO: 396741 - protein, 4 aa, Mycobacterium
ETTN

SEQ ID NO: 396742 - protein, 8 aa, Mycobacterium
ETTPDRLT

SEQ ID NO: 396743 - protein, 7 aa, Mycobacterium
ETTTDEM

SEQ ID NO: 396744 - protein, 6 aa, Mycobacterium
ETVDDP

SEQ ID NO: 396745 - protein, 4 aa, Mycobacterium
ETVG

SEQ ID NO: 396746 - protein, 10 aa, Mycobacterium
ETVSAKTATH

SEQ ID NO: 396747 - protein, 5 aa, Mycobacterium
ETVTE

SEQ ID NO: 396748 - protein, 8 aa, Mycobacterium
ETVTGLGN

SEQ ID NO: 396749 - protein, 4 aa, Mycobacterium
ETYG

SEQ ID NO: 396750 - protein, 5 aa, Mycobacterium
EVADG

SEQ ID NO: 396751 - protein, 9 aa, Mycobacterium
EVAESGGVS

SEQ ID NO: 396752 - protein, 4 aa, Mycobacterium
EVAS

SEQ ID NO: 396753 - protein, 7 aa, Mycobacterium
EVDAGDP

SEQ ID NO: 396754 - protein, 5 aa, Mycobacterium
EVDGT

SEQ ID NO: 396755 - protein, 7 aa, Mycobacterium
EVEEPRK

SEQ ID NO: 396756 - protein, 9 aa, Mycobacterium
EVENETRGG

SEQ ID NO: 396757 - protein, 6 aa, Mycobacterium
EVERSG

SEQ ID NO: 396758 - protein, 4 aa, Mycobacterium
EVGA

SEQ ID NO: 396759 - protein, 4 aa, Mycobacterium
EVGD

SEQ ID NO: 396760 - protein, 4 aa, Mycobacterium
EVGG

SEQ ID NO: 396761 - protein, 6 aa, Mycobacterium
EVGSGK

SEQ ID NO: 396762 - protein, 14 aa, Mycobacterium
EVGSRVDSPTGTGR

SEQ ID NO: 396763 - protein, 4 aa, Mycobacterium
EVGT

SEQ ID NO: 396764 - protein, 7 aa, Mycobacterium
EVKPTQK

SEQ ID NO: 396765 - protein, 7 aa, Mycobacterium
EVNAEQQ

SEQ ID NO: 396766 - protein, 8 aa, Mycobacterium
EVNAEQQK

SEQ ID NO: 396767 - protein, 8 aa, Mycobacterium
EVNGEQQK

SEQ ID NO: 396768 - protein, 12 aa, Mycobacterium
EVNGEVKQHSRT

SEQ ID NO: 396769 - protein, 16 aa, Mycobacterium
EVPANVSKEIIAKATG

SEQ ID NO: 396770 - protein, 7 aa, Mycobacterium
EVPATSR

SEQ ID NO: 396771 - protein, 4 aa, Mycobacterium
EVPG

SEQ ID NO: 396772 - protein, 7 aa, Mycobacterium
EVPGGQA

SEQ ID NO: 396773 - protein, 10 aa, Mycobacterium
EVPPPTPVDR

SEQ ID NO: 396774 - protein, 7 aa, Mycobacterium
EVPPTSR

SEQ ID NO: 396775 - protein, 12 aa, Mycobacterium
EVRGQRGYGVFR

SEQ ID NO: 396776 - protein, 7 aa, Mycobacterium
EVSATGS

SEQ ID NO: 396777 - protein, 4 aa, Mycobacterium
EVSG

SEQ ID NO: 396778 - protein, 12 aa, Mycobacterium
EVTADGRSERGN

SEQ ID NO: 396779 - protein, 5 aa, Mycobacterium
EVTAT

SEQ ID NO: 396780 - protein, 7 aa, Mycobacterium
EVTEEAN

SEQ ID NO: 396781 - protein, 5 aa, Mycobacterium
EVTGD

SEQ ID NO: 396782 - protein, 6 aa, Mycobacterium
EVTGDR

SEQ ID NO: 396783 - protein, 12 aa, Mycobacterium
EVTGSLDDGQLR

SEQ ID NO: 396784 - protein, 4 aa, Mycobacterium
EVTP

SEQ ID NO: 396785 - protein, 5 aa, Mycobacterium
EVTTD

SEQ ID NO: 396786 - protein, 5 aa, Mycobacterium
EWAGP

SEQ ID NO: 396787 - protein, 9 aa, Mycobacterium
EWDDPQGVP

SEQ ID NO: 396788 - protein, 7 aa, Mycobacterium
EWDGGDK

SEQ ID NO: 396789 - protein, 6 aa, Mycobacterium
EWGTHT

SEQ ID NO: 396790 - protein, 5 aa, Mycobacterium
EWSGR

SEQ ID NO: 396791 - protein, 8 aa, Mycobacterium
EWSSQGVR

SEQ ID NO: 396792 - protein, 13 aa, Mycobacterium
EYAGRAQGKWDPG

SEQ ID NO: 396793 - protein, 5 aa, Mycobacterium
EYAHD

SEQ ID NO: 396794 - protein, 10 aa, Mycobacterium
EYDESPERQA

SEQ ID NO: 396795 - protein, 5 aa, Mycobacterium
EYDPD

SEQ ID NO: 396796 - protein, 7 aa, Mycobacterium
EYEGYPD

SEQ ID NO: 396797 - protein, 5 aa, Mycobacterium
EYGDD

SEQ ID NO: 396798 - protein, 6 aa, Mycobacterium
EYGEKH

SEQ ID NO: 396799 - protein, 4 aa, Mycobacterium
EYGG

SEQ ID NO: 396800 - protein, 14 aa, Mycobacterium
EYGPDDAPKAPSQA

SEQ ID NO: 396801 - protein, 4 aa, Mycobacterium
EYGT

SEQ ID NO: 396802 - protein, 7 aa, Mycobacterium
EYHDPAD

SEQ ID NO: 396803 - protein, 10 aa, Mycobacterium
EYSEGAGPGI

SEQ ID NO: 396804 - protein, 4 aa, Mycobacterium
EYSH

SEQ ID NO: 396805 - protein, 4 aa, Mycobacterium
EYSR

SEQ ID NO: 396806 - protein, 14 aa, Mycobacterium
EYYDPEPGVPGRSV

SEQ ID NO: 396807 - protein, 4 aa, Mycobacterium
FAAT

SEQ ID NO: 396808 - protein, 11 aa, Mycobacterium
FAATGGGSVVP

SEQ ID NO: 396809 - protein, 4 aa, Mycobacterium
FADP

SEQ ID NO: 396810 - protein, 12 aa, Mycobacterium
FADSDGDGVGDL

SEQ ID NO: 396811 - protein, 9 aa, Mycobacterium
FAEESPEAY

SEQ ID NO: 396812 - protein, 11 aa, Mycobacterium
FAGEKSKDDPF

SEQ ID NO: 396813 - protein, 7 aa, Mycobacterium
FAGPSRR

SEQ ID NO: 396814 - protein, 10 aa, Mycobacterium
FAGSGQAAGY

SEQ ID NO: 396815 - protein, 7 aa, Mycobacterium
FAPDPDF

SEQ ID NO: 396816 - protein, 12 aa, Mycobacterium
FAPGQVGSSAMP

SEQ ID NO: 396817 - protein, 14 aa, Mycobacterium
FAPGTGTPEIGGMT

SEQ ID NO: 396818 - protein, 7 aa, Mycobacterium
FAPRGAE

SEQ ID NO: 396819 - protein, 4 aa, Mycobacterium
FAPS

SEQ ID NO: 396820 - protein, 12 aa, Mycobacterium
FARPGARRSRED

SEQ ID NO: 396821 - protein, 11 aa, Mycobacterium
FARPGARRTRE

SEQ ID NO: 396822 - protein, 4 aa, Mycobacterium
FDAA

SEQ ID NO: 396823 - protein, 7 aa, Mycobacterium
FDEDPDL

SEQ ID NO: 396824 - protein, 4 aa, Mycobacterium
FDET

SEQ ID NO: 396825 - protein, 5 aa, Mycobacterium
FDETA

SEQ ID NO: 396826 - protein, 4 aa, Mycobacterium
FDGA

SEQ ID NO: 396827 - protein, 6 aa, Mycobacterium
FDGDGT

SEQ ID NO: 396828 - protein, 5 aa, Mycobacterium
FDGRS

SEQ ID NO: 396829 - protein, 15 aa, Mycobacterium
FDNGPWPTTPPKERA

SEQ ID NO: 396830 - protein, 7 aa, Mycobacterium
FDPAQPT

SEQ ID NO: 396831 - protein, 4 aa, Mycobacterium
FDPE

SEQ ID NO: 396832 - protein, 6 aa, Mycobacterium
FDPEPR

SEQ ID NO: 396833 - protein, 8 aa, Mycobacterium
FDPGDRPH

SEQ ID NO: 396834 - protein, 5 aa, Mycobacterium
FDPQS

SEQ ID NO: 396835 - protein, 10 aa, Mycobacterium
FDQAPAATAI

SEQ ID NO: 396836 - protein, 5 aa, Mycobacterium
FDRSG

SEQ ID NO: 396837 - protein, 6 aa, Mycobacterium
FDSATQ

SEQ ID NO: 396838 - protein, 9 aa, Mycobacterium
FDSGGDTNT

SEQ ID NO: 396839 - protein, 9 aa, Mycobacterium
FDSRTNGSF

SEQ ID NO: 396840 - protein, 4 aa, Mycobacterium
FDST

SEQ ID NO: 396841 - protein, 6 aa, Mycobacterium
FDTGDT

SEQ ID NO: 396842 - protein, 10 aa, Mycobacterium
FDTGGKTPLA

SEQ ID NO: 396843 - protein, 5 aa, Mycobacterium
FDTGR

SEQ ID NO: 396844 - protein, 6 aa, Mycobacterium
FDYSGT

SEQ ID NO: 396845 - protein, 4 aa, Mycobacterium
FEDD

SEQ ID NO: 396846 - protein, 4 aa, Mycobacterium
FEET

SEQ ID NO: 396847 - protein, 4 aa, Mycobacterium
FEGG

SEQ ID NO: 396848 - protein, 4 aa, Mycobacterium
FEGQ

SEQ ID NO: 396849 - protein, 4 aa, Mycobacterium
FEGT

SEQ ID NO: 396850 - protein, 18 aa, Mycobacterium
FEGTTARIREKQKAGDFA

SEQ ID NO: 396851 - protein, 25 aa, Mycobacterium
FEPESLPPDWHPPPQDRADPDEPPP

SEQ ID NO: 396852 - protein, 10 aa, Mycobacterium
FETARRRGSV

SEQ ID NO: 396853 - protein, 6 aa, Mycobacterium
FETDPA

SEQ ID NO: 396854 - protein, 8 aa, Mycobacterium
FGAEGEDF

SEQ ID NO: 396855 - protein, 4 aa, Mycobacterium
FGAT

SEQ ID NO: 396856 - protein, 4 aa, Mycobacterium
FGDA

SEQ ID NO: 396857 - protein, 8 aa, Mycobacterium
FGDTPEAN

SEQ ID NO: 396858 - protein, 5 aa, Mycobacterium
FGEEP

SEQ ID NO: 396859 - protein, 5 aa, Mycobacterium
FGEPL

SEQ ID NO: 396860 - protein, 8 aa, Mycobacterium
FGGANGEL

SEQ ID NO: 396861 - protein, 7 aa, Mycobacterium
FGGDPGR

SEQ ID NO: 396862 - protein, 5 aa, Mycobacterium
FGGGA

SEQ ID NO: 396863 - protein, 8 aa, Mycobacterium
FGGPGNNY

SEQ ID NO: 396864 - protein, 10 aa, Mycobacterium
FGGVNGPRGW

SEQ ID NO: 396865 - protein, 5 aa, Mycobacterium
FGKPE

SEQ ID NO: 396866 - protein, 7 aa, Mycobacterium
FGKPEEK

SEQ ID NO: 396867 - protein, 11 aa, Mycobacterium
FGLPKNSRLGY

SEQ ID NO: 396868 - protein, 8 aa, Mycobacterium
FGNHGNNN

SEQ ID NO: 396869 - protein, 9 aa, Mycobacterium
FGNNGNNNI

SEQ ID NO: 396870 - protein, 19 aa, Mycobacterium
FGNTGDGNIGFGNTGDGNI

SEQ ID NO: 396871 - protein, 9 aa, Mycobacterium
FGPAGAEAF

SEQ ID NO: 396872 - protein, 7 aa, Mycobacterium
FGPEART

SEQ ID NO: 396873 - protein, 8 aa, Mycobacterium
FGPGGSSA

SEQ ID NO: 396874 - protein, 13 aa, Mycobacterium
FGPGGSTAGAGGA

SEQ ID NO: 396875 - protein, 8 aa, Mycobacterium
FGPPAGQA

SEQ ID NO: 396876 - protein, 4 aa, Mycobacterium
FGPQ

SEQ ID NO: 396877 - protein, 4 aa, Mycobacterium
FGPR

SEQ ID NO: 396878 - protein, 10 aa, Mycobacterium
FGPSGSGKST

SEQ ID NO: 396879 - protein, 5 aa, Mycobacterium
FGPST

SEQ ID NO: 396880 - protein, 7 aa, Mycobacterium
FGQTETT

SEQ ID NO: 396881 - protein, 4 aa, Mycobacterium
FGRG

SEQ ID NO: 396882 - protein, 11 aa, Mycobacterium
FGRGGATDYQQ

SEQ ID NO: 396883 - protein, 10 aa, Mycobacterium
FGRGSDVSTR

SEQ ID NO: 396884 - protein, 4 aa, Mycobacterium
FGRP

SEQ ID NO: 396885 - protein, 9 aa, Mycobacterium
FGRRRDERV

SEQ ID NO: 396886 - protein, 8 aa, Mycobacterium
FGSAPGQY

SEQ ID NO: 396887 - protein, 9 aa, Mycobacterium
FGSEGDRYR

SEQ ID NO: 396888 - protein, 9 aa, Mycobacterium
FGSGTGHSQ

SEQ ID NO: 396889 - protein, 4 aa, Mycobacterium
FGSP

SEQ ID NO: 396890 - protein, 12 aa, Mycobacterium
FGSPGQSNYATA

SEQ ID NO: 396891 - protein, 9 aa, Mycobacterium
FGSSPDGAI

SEQ ID NO: 396892 - protein, 6 aa, Mycobacterium
FGTAEA

SEQ ID NO: 396893 - protein, 7 aa, Mycobacterium
FGTEEQK

SEQ ID NO: 396894 - protein, 4 aa, Mycobacterium
FGTP

SEQ ID NO: 396895 - protein, 4 aa, Mycobacterium
FGTT

SEQ ID NO: 396896 - protein, 6 aa, Mycobacterium
FGVGGT

SEQ ID NO: 396897 - protein, 6 aa, Mycobacterium
FGVSGT

SEQ ID NO: 396898 - protein, 5 aa, Mycobacterium
FHGPG

SEQ ID NO: 396899 - protein, 9 aa, Mycobacterium
FKASDNTHT

SEQ ID NO: 396900 - protein, 8 aa, Mycobacterium
FKASPRSD

SEQ ID NO: 396901 - protein, 9 aa, Mycobacterium
FKEETETDL

SEQ ID NO: 396902 - protein, 14 aa, Mycobacterium
FKPESDDVRDSPAL

SEQ ID NO: 396903 - protein, 7 aa, Mycobacterium
FKSRGFP

SEQ ID NO: 396904 - protein, 19 aa, Mycobacterium
FNASGDNTAAGSSAGRRTV

SEQ ID NO: 396905 - protein, 11 aa, Mycobacterium
FNGQAAPTKYP

SEQ ID NO: 396906 - protein, 12 aa, Mycobacterium
FNPGPNPFGPPP

SEQ ID NO: 396907 - protein, 7 aa, Mycobacterium
FNPSGGV

SEQ ID NO: 396908 - protein, 4 aa, Mycobacterium
FNSP

SEQ ID NO: 396909 - protein, 5 aa, Mycobacterium
FPDAK

SEQ ID NO: 396910 - protein, 8 aa, Mycobacterium
FPDKSVRS

SEQ ID NO: 396911 - protein, 11 aa, Mycobacterium
FPEPGSAVEQG

SEQ ID NO: 396912 - protein, 6 aa, Mycobacterium
FPGDPH

SEQ ID NO: 396913 - protein, 7 aa, Mycobacterium
FPGDRGW

SEQ ID NO: 396914 - protein, 4 aa, Mycobacterium
FPGG

SEQ ID NO: 396915 - protein, 7 aa, Mycobacterium
FPGPNGL

SEQ ID NO: 396916 - protein, 11 aa, Mycobacterium
FPGPTGANAVE

SEQ ID NO: 396917 - protein, 12 aa, Mycobacterium
FPNHEANPLDPA

SEQ ID NO: 396918 - protein, 8 aa, Mycobacterium
FPPAGTLT

SEQ ID NO: 396919 - protein, 13 aa, Mycobacterium
FPPDAAAREHDPS

SEQ ID NO: 396920 - protein, 8 aa, Mycobacterium
FPPGAKAR

SEQ ID NO: 396921 - protein, 5 aa, Mycobacterium
FPPGL

SEQ ID NO: 396922 - protein, 13 aa, Mycobacterium
FPPGSGVGTQGPD

SEQ ID NO: 396923 - protein, 9 aa, Mycobacterium
FPPIRDGGR

SEQ ID NO: 396924 - protein, 4 aa, Mycobacterium
FPPV

SEQ ID NO: 396925 - protein, 24 aa, Mycobacterium
FPQRDPHGDPIPASDGQVPTPPAR

SEQ ID NO: 396926 - protein, 7 aa, Mycobacterium
FPRPQTQ

SEQ ID NO: 396927 - protein, 5 aa, Mycobacterium
FPRSE

SEQ ID NO: 396928 - protein, 11 aa, Mycobacterium
FPRSRGDDGFD

SEQ ID NO: 396929 - protein, 4 aa, Mycobacterium
FPSA

SEQ ID NO: 396930 - protein, 4 aa, Mycobacterium
FPTA

SEQ ID NO: 396931 - protein, 6 aa, Mycobacterium
FPTDRG

SEQ ID NO: 396932 - protein, 4 aa, Mycobacterium
FPTS

SEQ ID NO: 396933 - protein, 4 aa, Mycobacterium
FPTT

SEQ ID NO: 396934 - protein, 4 aa, Mycobacterium
FPVG

SEQ ID NO: 396935 - protein, 6 aa, Mycobacterium
FQGGQA

SEQ ID NO: 396936 - protein, 8 aa, Mycobacterium
FQTDQEGI

SEQ ID NO: 396937 - protein, 11 aa, Mycobacterium
FQTDQSGIEHQ

SEQ ID NO: 396938 - protein, 8 aa, Mycobacterium
FRAPEADE

SEQ ID NO: 396939 - protein, 4 aa, Mycobacterium
FRGP

SEQ ID NO: 396940 - protein, 10 aa, Mycobacterium
FRKEQAEALA

SEQ ID NO: 396941 - protein, 9 aa, Mycobacterium
FRPGKAPRK

SEQ ID NO: 396942 - protein, 4 aa, Mycobacterium
FRPP

SEQ ID NO: 396943 - protein, 5 aa, Mycobacterium
FRQDT

SEQ ID NO: 396944 - protein, 11 aa, Mycobacterium
FRTGPGRGVRR

SEQ ID NO: 396945 - protein, 11 aa, Mycobacterium
FRTSGDDIAAN

SEQ ID NO: 396946 - protein, 12 aa, Mycobacterium
FSAASDEALGDI

SEQ ID NO: 396947 - protein, 5 aa, Mycobacterium
FSDQH

SEQ ID NO: 396948 - protein, 4 aa, Mycobacterium
FSEP

SEQ ID NO: 396949 - protein, 8 aa, Mycobacterium
FSGKAQIG

SEQ ID NO: 396950 - protein, 10 aa, Mycobacterium
FSGKPTNAGW

SEQ ID NO: 396951 - protein, 8 aa, Mycobacterium
FSGPKKIA

SEQ ID NO: 396952 - protein, 4 aa, Mycobacterium
FSGR

SEQ ID NO: 396953 - protein, 6 aa, Mycobacterium
FSGSNG

SEQ ID NO: 396954 - protein, 4 aa, Mycobacterium
FSHT

SEQ ID NO: 396955 - protein, 17 aa, Mycobacterium
FSNPTQKATEDYISGRF

SEQ ID NO: 396956 - protein, 7 aa, Mycobacterium
FSPDSGA

SEQ ID NO: 396957 - protein, 10 aa, Mycobacterium
FSPGRDTPLN

SEQ ID NO: 396958 - protein, 6 aa, Mycobacterium
FSPGRR

SEQ ID NO: 396959 - protein, 8 aa, Mycobacterium
FSPPGATA

SEQ ID NO: 396960 - protein, 4 aa, Mycobacterium
FSPT

SEQ ID NO: 396961 - protein, 4 aa, Mycobacterium
FSRA

SEQ ID NO: 396962 - protein, 4 aa, Mycobacterium
FSSA

SEQ ID NO: 396963 - protein, 9 aa, Mycobacterium
FSSAPTDHA

SEQ ID NO: 396964 - protein, 7 aa, Mycobacterium
FSTGADM

SEQ ID NO: 396965 - protein, 7 aa, Mycobacterium
FTAGGPN

SEQ ID NO: 396966 - protein, 6 aa, Mycobacterium
FTAQTR

SEQ ID NO: 396967 - protein, 9 aa, Mycobacterium
FTDDPLPDE

SEQ ID NO: 396968 - protein, 4 aa, Mycobacterium
FTDS

SEQ ID NO: 396969 - protein, 4 aa, Mycobacterium
FTEA

SEQ ID NO: 396970 - protein, 4 aa, Mycobacterium
FTEP

SEQ ID NO: 396971 - protein, 12 aa, Mycobacterium
FTGDSNGKAPTA

SEQ ID NO: 396972 - protein, 4 aa, Mycobacterium
FTGE

SEQ ID NO: 396973 - protein, 4 aa, Mycobacterium
FTGP

SEQ ID NO: 396974 - protein, 11 aa, Mycobacterium
FTGQPGSTVPV

SEQ ID NO: 396975 - protein, 5 aa, Mycobacterium
FTGRP

SEQ ID NO: 396976 - protein, 11 aa, Mycobacterium
FTGSTAAGRAV

SEQ ID NO: 396977 - protein, 9 aa, Mycobacterium
FTGTEETLQ

SEQ ID NO: 396978 - protein, 5 aa, Mycobacterium
FTGYD

SEQ ID NO: 396979 - protein, 4 aa, Mycobacterium
FTKP

SEQ ID NO: 396980 - protein, 5 aa, Mycobacterium
FTNQR

SEQ ID NO: 396981 - protein, 4 aa, Mycobacterium
FTPD

SEQ ID NO: 396982 - protein, 19 aa, Mycobacterium
FTPDDQKALSKTVRTYPKT

SEQ ID NO: 396983 - protein, 12 aa, Mycobacterium
FTPDDQKALTKT

SEQ ID NO: 396984 - protein, 7 aa, Mycobacterium
FTPDSSR

SEQ ID NO: 396985 - protein, 7 aa, Mycobacterium
FTPEATA

SEQ ID NO: 396986 - protein, 11 aa, Mycobacterium
FTPEGDDITEQ

SEQ ID NO: 396987 - protein, 4 aa, Mycobacterium
FTPG

SEQ ID NO: 396988 - protein, 5 aa, Mycobacterium
FTPGA

SEQ ID NO: 396989 - protein, 18 aa, Mycobacterium
FTPGERRDAADKSSSAAR

SEQ ID NO: 396990 - protein, 6 aa, Mycobacterium
FTPGPG

SEQ ID NO: 396991 - protein, 9 aa, Mycobacterium
FTPSWGEPY

SEQ ID NO: 396992 - protein, 7 aa, Mycobacterium
FTPTDEP

SEQ ID NO: 396993 - protein, 8 aa, Mycobacterium
FTQDGAPQ

SEQ ID NO: 396994 - protein, 6 aa, Mycobacterium
FTQSAE

SEQ ID NO: 396995 - protein, 10 aa, Mycobacterium
FTSGENRLDS

SEQ ID NO: 396996 - protein, 12 aa, Mycobacterium
FTTAEPDYRRDE

SEQ ID NO: 396997 - protein, 9 aa, Mycobacterium
FTTTTRAGN

SEQ ID NO: 396998 - protein, 11 aa, Mycobacterium
FYAAGGGPLYT

SEQ ID NO: 396999 - protein, 7 aa, Mycobacterium
FYGPGEV

SEQ ID NO: 397000 - protein, 7 aa, Mycobacterium
FYGPRGA

SEQ ID NO: 397001 - protein, 5 aa, Mycobacterium
FYTGR

SEQ ID NO: 397002 - protein, 9 aa, Mycobacterium
GAAAAARRR

SEQ ID NO: 397003 - protein, 11 aa, Mycobacterium
GAAAGRPAITT

SEQ ID NO: 397004 - protein, 9 aa, Mycobacterium
GAAAVSSAA

SEQ ID NO: 397005 - protein, 5 aa, Mycobacterium
GAADA

SEQ ID NO: 397006 - protein, 11 aa, Mycobacterium
GAADGTSWSEG

SEQ ID NO: 397007 - protein, 6 aa, Mycobacterium
GAADGV

SEQ ID NO: 397008 - protein, 6 aa, Mycobacterium
GAADPH

SEQ ID NO: 397009 - protein, 8 aa, Mycobacterium
GAADPTAQ

SEQ ID NO: 397010 - protein, 10 aa, Mycobacterium
GAADRDQERY

SEQ ID NO: 397011 - protein, 6 aa, Mycobacterium
GAADRP

SEQ ID NO: 397012 - protein, 5 aa, Mycobacterium
GAAGD

SEQ ID NO: 397013 - protein, 5 aa, Mycobacterium
GAAGI

SEQ ID NO: 397014 - protein, 5 aa, Mycobacterium
GAAGL

SEQ ID NO: 397015 - protein, 5 aa, Mycobacterium
GAAGQ

SEQ ID NO: 397016 - protein, 10 aa, Mycobacterium
GAAGRDDRDI

SEQ ID NO: 397017 - protein, 7 aa, Mycobacterium
GAAGSEA

SEQ ID NO: 397018 - protein, 9 aa, Mycobacterium
GAAGSGSQR

SEQ ID NO: 397019 - protein, 10 aa, Mycobacterium
GAAGTLAATT

SEQ ID NO: 397020 - protein, 16 aa, Mycobacterium
GAAGVAGVDGGAGQAG

SEQ ID NO: 397021 - protein, 7 aa, Mycobacterium
GAAIQTG

SEQ ID NO: 397022 - protein, 13 aa, Mycobacterium
GAAITQGTVIAEI

SEQ ID NO: 397023 - protein, 13 aa, Mycobacterium
GAAITQGTVLAEI

SEQ ID NO: 397024 - protein, 4 aa, Mycobacterium
GAAK

SEQ ID NO: 397025 - protein, 5 aa, Mycobacterium
GAAPA

SEQ ID NO: 397026 - protein, 16 aa, Mycobacterium
GAAPEPLNGDVDGSDP

SEQ ID NO: 397027 - protein, 8 aa, Mycobacterium
GAARAERA

SEQ ID NO: 397028 - protein, 5 aa, Mycobacterium
GAARD

SEQ ID NO: 397029 - protein, 9 aa, Mycobacterium
GAASGIGRA

SEQ ID NO: 397030 - protein, 6 aa, Mycobacterium
GAASPI

SEQ ID NO: 397031 - protein, 5 aa, Mycobacterium
GAATA

SEQ ID NO: 397032 - protein, 12 aa, Mycobacterium
GAATARRVGTDA

SEQ ID NO: 397033 - protein, 6 aa, Mycobacterium
GAATRR

SEQ ID NO: 397034 - protein, 15 aa, Mycobacterium
GAATSVQRDRGSRSR

SEQ ID NO: 397035 - protein, 6 aa, Mycobacterium
GAAVGA

SEQ ID NO: 397036 - protein, 18 aa, Mycobacterium
GAAVGASRAAVDSGYYPG

SEQ ID NO: 397037 - protein, 4 aa, Mycobacterium
GACG

SEQ ID NO: 397038 - protein, 6 aa, Mycobacterium
GACGRG

SEQ ID NO: 397039 - protein, 8 aa, Mycobacterium
GADDPKLG

SEQ ID NO: 397040 - protein, 8 aa, Mycobacterium
GADEADAL

SEQ ID NO: 397041 - protein, 6 aa, Mycobacterium
GADEIS

SEQ ID NO: 397042 - protein, 7 aa, Mycobacterium
GADEPGR

SEQ ID NO: 397043 - protein, 7 aa, Mycobacterium
GADEVST

SEQ ID NO: 397044 - protein, 5 aa, Mycobacterium
GADFD

SEQ ID NO: 397045 - protein, 5 aa, Mycobacterium
GADGE

SEQ ID NO: 397046 - protein, 5 aa, Mycobacterium
GADGR

SEQ ID NO: 397047 - protein, 17 aa, Mycobacterium
GADGRQKDTKAVNPEST

SEQ ID NO: 397048 - protein, 17 aa, Mycobacterium
GADGRTKDTKAVNPEST

SEQ ID NO: 397049 - protein, 4 aa, Mycobacterium
GADI

SEQ ID NO: 397050 - protein, 6 aa, Mycobacterium
GADINS

SEQ ID NO: 397051 - protein, 8 aa, Mycobacterium
GADLSGEE

SEQ ID NO: 397052 - protein, 5 aa, Mycobacterium
GADNP

SEQ ID NO: 397053 - protein, 16 aa, Mycobacterium
GADNTEELRYSPGERY

SEQ ID NO: 397054 - protein, 7 aa, Mycobacterium
GADPAAL

SEQ ID NO: 397055 - protein, 9 aa, Mycobacterium
GADPATGKP

SEQ ID NO: 397056 - protein, 9 aa, Mycobacterium
GADPATQTM

SEQ ID NO: 397057 - protein, 9 aa, Mycobacterium
GADPETVRQ

SEQ ID NO: 397058 - protein, 6 aa, Mycobacterium
GADPQH

SEQ ID NO: 397059 - protein, 6 aa, Mycobacterium
GADPQQ

SEQ ID NO: 397060 - protein, 7 aa, Mycobacterium
GADQPDV

SEQ ID NO: 397061 - protein, 5 aa, Mycobacterium
GADRD

SEQ ID NO: 397062 - protein, 8 aa, Mycobacterium
GADRDAEQ

SEQ ID NO: 397063 - protein, 6 aa, Mycobacterium
GADRDG

SEQ ID NO: 397064 - protein, 9 aa, Mycobacterium
GADSAPADV

SEQ ID NO: 397065 - protein, 7 aa, Mycobacterium
GADSSRG

SEQ ID NO: 397066 - protein, 9 aa, Mycobacterium
GADTNTGDA

SEQ ID NO: 397067 - protein, 4 aa, Mycobacterium
GAEA

SEQ ID NO: 397068 - protein, 8 aa, Mycobacterium
GAEDYAQR

SEQ ID NO: 397069 - protein, 5 aa, Mycobacterium
GAEGD

SEQ ID NO: 397070 - protein, 9 aa, Mycobacterium
GAEGGGHGE

SEQ ID NO: 397071 - protein, 4 aa, Mycobacterium
GAEI

SEQ ID NO: 397072 - protein, 5 aa, Mycobacterium
GAENA

SEQ ID NO: 397073 - protein, 4 aa, Mycobacterium
GAEP

SEQ ID NO: 397074 - protein, 6 aa, Mycobacterium
GAEPGD

SEQ ID NO: 397075 - protein, 10 aa, Mycobacterium
GAEPTAERRT

SEQ ID NO: 397076 - protein, 5 aa, Mycobacterium
GAERA

SEQ ID NO: 397077 - protein, 6 aa, Mycobacterium
GAERAR

SEQ ID NO: 397078 - protein, 5 aa, Mycobacterium
GAERD

SEQ ID NO: 397079 - protein, 5 aa, Mycobacterium
GAESG

SEQ ID NO: 397080 - protein, 5 aa, Mycobacterium
GAESM

SEQ ID NO: 397081 - protein, 7 aa, Mycobacterium
GAESMSN

SEQ ID NO: 397082 - protein, 9 aa, Mycobacterium
GAESPEQEL

SEQ ID NO: 397083 - protein, 8 aa, Mycobacterium
GAGAGMPG

SEQ ID NO: 397084 - protein, 7 aa, Mycobacterium
GAGAHPN

SEQ ID NO: 397085 - protein, 8 aa, Mycobacterium
GAGASAYR

SEQ ID NO: 397086 - protein, 7 aa, Mycobacterium
GAGDAFG

SEQ ID NO: 397087 - protein, 12 aa, Mycobacterium
GAGDLPEGIEGG

SEQ ID NO: 397088 - protein, 6 aa, Mycobacterium
GAGETL

SEQ ID NO: 397089 - protein, 12 aa, Mycobacterium
GAGGAGGAGWAN

SEQ ID NO: 397090 - protein, 40 aa, Mycobacterium
GAGGAGGASGLGDGGAGGTGGAGGLLGGNGGGGGAGGAGA

SEQ ID NO: 397091 - protein, 9 aa, Mycobacterium
GAGGAGKTR

SEQ ID NO: 397092 - protein, 13 aa, Mycobacterium
GAGGDNPADGPLT

SEQ ID NO: 397093 - protein, 7 aa, Mycobacterium
GAGGEDL

SEQ ID NO: 397094 - protein, 9 aa, Mycobacterium
GAGGGIGQA

SEQ ID NO: 397095 - protein, 9 aa, Mycobacterium
GAGGKASAA

SEQ ID NO: 397096 - protein, 9 aa, Mycobacterium
GAGGNRDSP

SEQ ID NO: 397097 - protein, 13 aa, Mycobacterium
GAGGQGDALILRA

SEQ ID NO: 397098 - protein, 10 aa, Mycobacterium
GAGGTAVASE

SEQ ID NO: 397099 - protein, 5 aa, Mycobacterium
GAGGV

SEQ ID NO: 397100 - protein, 30 aa, Mycobacterium
GAGGVGGTGVGFPTDPGLSFGGQGGAGGRG

SEQ ID NO: 397101 - protein, 8 aa, Mycobacterium
GAGGVGKT

SEQ ID NO: 397102 - protein, 4 aa, Mycobacterium
GAGI

SEQ ID NO: 397103 - protein, 7 aa, Mycobacterium
GAGKGTR

SEQ ID NO: 397104 - protein, 6 aa, Mycobacterium
GAGKST

SEQ ID NO: 397105 - protein, 5 aa, Mycobacterium
GAGLG

SEQ ID NO: 397106 - protein, 8 aa, Mycobacterium
GAGLGPAD

SEQ ID NO: 397107 - protein, 10 aa, Mycobacterium
GAGNAPGARV

SEQ ID NO: 397108 - protein, 8 aa, Mycobacterium
GAGNETTA

SEQ ID NO: 397109 - protein, 7 aa, Mycobacterium
GAGNGPL

SEQ ID NO: 397110 - protein, 7 aa, Mycobacterium
GAGPEYS

SEQ ID NO: 397111 - protein, 5 aa, Mycobacterium
GAGPG

SEQ ID NO: 397112 - protein, 7 aa, Mycobacterium
GAGPGKL

SEQ ID NO: 397113 - protein, 6 aa, Mycobacterium
GAGPGQ

SEQ ID NO: 397114 - protein, 6 aa, Mycobacterium
GAGPGT

SEQ ID NO: 397115 - protein, 6 aa, Mycobacterium
GAGPNG

SEQ ID NO: 397116 - protein, 9 aa, Mycobacterium
GAGQQHGPA

SEQ ID NO: 397117 - protein, 5 aa, Mycobacterium
GAGRA

SEQ ID NO: 397118 - protein, 5 aa, Mycobacterium
GAGRD

SEQ ID NO: 397119 - protein, 6 aa, Mycobacterium
GAGRGL

SEQ ID NO: 397120 - protein, 6 aa, Mycobacterium
GAGRPP

SEQ ID NO: 397121 - protein, 6 aa, Mycobacterium
GAGRQL

SEQ ID NO: 397122 - protein, 8 aa, Mycobacterium
GAGSGIGR

SEQ ID NO: 397123 - protein, 10 aa, Mycobacterium
GAGSSTTEAF

SEQ ID NO: 397124 - protein, 5 aa, Mycobacterium
GAGTG

SEQ ID NO: 397125 - protein, 8 aa, Mycobacterium
GAGTGKLT

SEQ ID NO: 397126 - protein, 7 aa, Mycobacterium
GAGTGRN

SEQ ID NO: 397127 - protein, 7 aa, Mycobacterium
GAGTGTN

SEQ ID NO: 397128 - protein, 5 aa, Mycobacterium
GAGTN

SEQ ID NO: 397129 - protein, 8 aa, Mycobacterium
GAGTTGLG

SEQ ID NO: 397130 - protein, 5 aa, Mycobacterium
GAGTV

SEQ ID NO: 397131 - protein, 5 aa, Mycobacterium
GAGVR

SEQ ID NO: 397132 - protein, 6 aa, Mycobacterium
GAGVRR

SEQ ID NO: 397133 - protein, 7 aa, Mycobacterium
GAHADTA

SEQ ID NO: 397134 - protein, 5 aa, Mycobacterium
GAHDT

SEQ ID NO: 397135 - protein, 7 aa, Mycobacterium
GAHGGTV

SEQ ID NO: 397136 - protein, 5 aa, Mycobacterium
GAHNA

SEQ ID NO: 397137 - protein, 6 aa, Mycobacterium
GAHPTA

SEQ ID NO: 397138 - protein, 6 aa, Mycobacterium
GAHYPG

SEQ ID NO: 397139 - protein, 8 aa, Mycobacterium
GAKAPKLI

SEQ ID NO: 397140 - protein, 15 aa, Mycobacterium
GAKDVGKRAERATAE

SEQ ID NO: 397141 - protein, 11 aa, Mycobacterium
GAKEIADQHGK

SEQ ID NO: 397142 - protein, 5 aa, Mycobacterium
GAKGK

SEQ ID NO: 397143 - protein, 6 aa, Mycobacterium
GAKGKN

SEQ ID NO: 397144 - protein, 5 aa, Mycobacterium
GAKGR

SEQ ID NO: 397145 - protein, 8 aa, Mycobacterium
GAKGSGEF

SEQ ID NO: 397146 - protein, 15 aa, Mycobacterium
GAKIGSKGRPLPGAG

SEQ ID NO: 397147 - protein, 4 aa, Mycobacterium
GAKN

SEQ ID NO: 397148 - protein, 9 aa, Mycobacterium
GAKPAEGSM

SEQ ID NO: 397149 - protein, 8 aa, Mycobacterium
GAKPVAGS

SEQ ID NO: 397150 - protein, 9 aa, Mycobacterium
GAKTLRGGK

SEQ ID NO: 397151 - protein, 4 aa, Mycobacterium
GALD

SEQ ID NO: 397152 - protein, 4 aa, Mycobacterium
GALE

SEQ ID NO: 397153 - protein, 12 aa, Mycobacterium
GALNGQTATMTG

SEQ ID NO: 397154 - protein, 7 aa, Mycobacterium
GALPDRY

SEQ ID NO: 397155 - protein, 10 aa, Mycobacterium
GALPITKASD

SEQ ID NO: 397156 - protein, 7 aa, Mycobacterium
GALPPAA

SEQ ID NO: 397157 - protein, 8 aa, Mycobacterium
GALPPTAG

SEQ ID NO: 397158 - protein, 9 aa, Mycobacterium
GALTNAGDL

SEQ ID NO: 397159 - protein, 8 aa, Mycobacterium
GAMGGPAT

SEQ ID NO: 397160 - protein, 14 aa, Mycobacterium
GANEYSGQARPPAV

SEQ ID NO: 397161 - protein, 10 aa, Mycobacterium
GANGTGKSSL

SEQ ID NO: 397162 - protein, 10 aa, Mycobacterium
GANGTGKSSV

SEQ ID NO: 397163 - protein, 9 aa, Mycobacterium
GANHGGSKH

SEQ ID NO: 397164 - protein, 6 aa, Mycobacterium
GANQTF

SEQ ID NO: 397165 - protein, 7 aa, Mycobacterium
GANRGLG

SEQ ID NO: 397166 - protein, 8 aa, Mycobacterium
GANSAGQA

SEQ ID NO: 397167 - protein, 6 aa, Mycobacterium
GANSGL

SEQ ID NO: 397168 - protein, 8 aa, Mycobacterium
GANTGLGL

SEQ ID NO: 397169 - protein, 8 aa, Mycobacterium
GAPADEDR

SEQ ID NO: 397170 - protein, 8 aa, Mycobacterium
GAPAGTAQ

SEQ ID NO: 397171 - protein, 10 aa, Mycobacterium
GAPAHRTPSA

SEQ ID NO: 397172 - protein, 11 aa, Mycobacterium
GAPARTSKPKF

SEQ ID NO: 397173 - protein, 8 aa, Mycobacterium
GAPDETNF

SEQ ID NO: 397174 - protein, 10 aa, Mycobacterium
GAPDTQRGVA

SEQ ID NO: 397175 - protein, 6 aa, Mycobacterium
GAPGEG

SEQ ID NO: 397176 - protein, 5 aa, Mycobacterium
GAPGL

SEQ ID NO: 397177 - protein, 7 aa, Mycobacterium
GAPGNAI

SEQ ID NO: 397178 - protein, 10 aa, Mycobacterium
GAPGQGNYAA

SEQ ID NO: 397179 - protein, 12 aa, Mycobacterium
GAPGTAAATILT

SEQ ID NO: 397180 - protein, 12 aa, Mycobacterium
GAPGTAGATILT

SEQ ID NO: 397181 - protein, 5 aa, Mycobacterium
GAPMP

SEQ ID NO: 397182 - protein, 10 aa, Mycobacterium
GAPPGIPAPP

SEQ ID NO: 397183 - protein, 16 aa, Mycobacterium
GAPPLPSTEDGFRSAG

SEQ ID NO: 397184 - protein, 5 aa, Mycobacterium
GAPPV

SEQ ID NO: 397185 - protein, 5 aa, Mycobacterium
GAPQG

SEQ ID NO: 397186 - protein, 6 aa, Mycobacterium
GAPQTS

SEQ ID NO: 397187 - protein, 5 aa, Mycobacterium
GAPRE

SEQ ID NO: 397188 - protein, 6 aa, Mycobacterium
GAPREA

SEQ ID NO: 397189 - protein, 5 aa, Mycobacterium
GAPRP

SEQ ID NO: 397190 - protein, 4 aa, Mycobacterium
GAPS

SEQ ID NO: 397191 - protein, 7 aa, Mycobacterium
GAPSGAY

SEQ ID NO: 397192 - protein, 5 aa, Mycobacterium
GAPVP

SEQ ID NO: 397193 - protein, 5 aa, Mycobacterium
GAPYY

SEQ ID NO: 397194 - protein, 8 aa, Mycobacterium
GAQEGDTT

SEQ ID NO: 397195 - protein, 7 aa, Mycobacterium
GAQEGEL

SEQ ID NO: 397196 - protein, 8 aa, Mycobacterium
GAQPTSDS

SEQ ID NO: 397197 - protein, 4 aa, Mycobacterium
GAQR

SEQ ID NO: 397198 - protein, 6 aa, Mycobacterium
GAQVTA

SEQ ID NO: 397199 - protein, 6 aa, Mycobacterium
GAQYAG

SEQ ID NO: 397200 - protein, 7 aa, Mycobacterium
GARDGRT

SEQ ID NO: 397201 - protein, 4 aa, Mycobacterium
GARN

SEQ ID NO: 397202 - protein, 5 aa, Mycobacterium
GARPG

SEQ ID NO: 397203 - protein, 7 aa, Mycobacterium
GARPRPL

SEQ ID NO: 397204 - protein, 13 aa, Mycobacterium
GARRDEEKARAKE

SEQ ID NO: 397205 - protein, 14 aa, Mycobacterium
GARRGGAVSGIGGH

SEQ ID NO: 397206 - protein, 7 aa, Mycobacterium
GARRGTG

SEQ ID NO: 397207 - protein, 5 aa, Mycobacterium
GARRI

SEQ ID NO: 397208 - protein, 8 aa, Mycobacterium
GARSRGVT

SEQ ID NO: 397209 - protein, 5 aa, Mycobacterium
GARTG

SEQ ID NO: 397210 - protein, 24 aa, Mycobacterium
GARTPSRLQPRQAARVQTGAPMPT

SEQ ID NO: 397211 - protein, 6 aa, Mycobacterium
GARVGA

SEQ ID NO: 397212 - protein, 7 aa, Mycobacterium
GARYDSD

SEQ ID NO: 397213 - protein, 5 aa, Mycobacterium
GASAA

SEQ ID NO: 397214 - protein, 9 aa, Mycobacterium
GASAAATRL

SEQ ID NO: 397215 - protein, 10 aa, Mycobacterium
GASADRPEHT

SEQ ID NO: 397216 - protein, 8 aa, Mycobacterium
GASAGGGL

SEQ ID NO: 397217 - protein, 5 aa, Mycobacterium
GASGF

SEQ ID NO: 397218 - protein, 8 aa, Mycobacterium
GASGGVGS

SEQ ID NO: 397219 - protein, 10 aa, Mycobacterium
GASGSGKSSL

SEQ ID NO: 397220 - protein, 8 aa, Mycobacterium
GASKGSIA

SEQ ID NO: 397221 - protein, 12 aa, Mycobacterium
GASMEGTNTGSF

SEQ ID NO: 397222 - protein, 4 aa, Mycobacterium
GASP

SEQ ID NO: 397223 - protein, 8 aa, Mycobacterium
GASPDGEC

SEQ ID NO: 397224 - protein, 10 aa, Mycobacterium
GASPGASTAV

SEQ ID NO: 397225 - protein, 6 aa, Mycobacterium
GASPRV

SEQ ID NO: 397226 - protein, 4 aa, Mycobacterium
GASR

SEQ ID NO: 397227 - protein, 4 aa, Mycobacterium
GASS

SEQ ID NO: 397228 - protein, 10 aa, Mycobacterium
GASSGLGAET

SEQ ID NO: 397229 - protein, 8 aa, Mycobacterium
GASSRKAR

SEQ ID NO: 397230 - protein, 16 aa, Mycobacterium
GASTSEAQDRAGTDVA

SEQ ID NO: 397231 - protein, 4 aa, Mycobacterium
GASV

SEQ ID NO: 397232 - protein, 7 aa, Mycobacterium
GASYGGA

SEQ ID NO: 397233 - protein, 15 aa, Mycobacterium
GATAEVNDAVRGAGS

SEQ ID NO: 397234 - protein, 4 aa, Mycobacterium
GATD

SEQ ID NO: 397235 - protein, 10 aa, Mycobacterium
GATDEEAAAK

SEQ ID NO: 397236 - protein, 8 aa, Mycobacterium
GATDPDIE

SEQ ID NO: 397237 - protein, 4 aa, Mycobacterium
GATE

SEQ ID NO: 397238 - protein, 5 aa, Mycobacterium
GATEA

SEQ ID NO: 397239 - protein, 6 aa, Mycobacterium
GATGDA

SEQ ID NO: 397240 - protein, 8 aa, Mycobacterium
GATGGVGS

SEQ ID NO: 397241 - protein, 10 aa, Mycobacterium
GATGLTDKQI

SEQ ID NO: 397242 - protein, 11 aa, Mycobacterium
GATGSGKTTQL

SEQ ID NO: 397243 - protein, 12 aa, Mycobacterium
GATGSRLVTGDT

SEQ ID NO: 397244 - protein, 4 aa, Mycobacterium
GATI

SEQ ID NO: 397245 - protein, 4 aa, Mycobacterium
GATL

SEQ ID NO: 397246 - protein, 7 aa, Mycobacterium
GATPEWA

SEQ ID NO: 397247 - protein, 9 aa, Mycobacterium
GATPPFDSE

SEQ ID NO: 397248 - protein, 4 aa, Mycobacterium
GATR

SEQ ID NO: 397249 - protein, 8 aa, Mycobacterium
GATREATA

SEQ ID NO: 397250 - protein, 8 aa, Mycobacterium
GATSGHTQ

SEQ ID NO: 397251 - protein, 9 aa, Mycobacterium
GATSGHTQR

SEQ ID NO: 397252 - protein, 8 aa, Mycobacterium
GATSRAPR

SEQ ID NO: 397253 - protein, 8 aa, Mycobacterium
GATTIGGR

SEQ ID NO: 397254 - protein, 6 aa, Mycobacterium
GATTVP

SEQ ID NO: 397255 - protein, 6 aa, Mycobacterium
GATYSD

SEQ ID NO: 397256 - protein, 8 aa, Mycobacterium
GAVDAGGR

SEQ ID NO: 397257 - protein, 4 aa, Mycobacterium
GAVE

SEQ ID NO: 397258 - protein, 4 aa, Mycobacterium
GAVG

SEQ ID NO: 397259 - protein, 6 aa, Mycobacterium
GAVPAD

SEQ ID NO: 397260 - protein, 8 aa, Mycobacterium
GAVQGPQA

SEQ ID NO: 397261 - protein, 10 aa, Mycobacterium
GAVRDPDTGA

SEQ ID NO: 397262 - protein, 11 aa, Mycobacterium
GAVRDPDTGDW

SEQ ID NO: 397263 - protein, 7 aa, Mycobacterium
GAVRGPY

SEQ ID NO: 397264 - protein, 5 aa, Mycobacterium
GAVRK

SEQ ID NO: 397265 - protein, 8 aa, Mycobacterium
GAVSAAGR

SEQ ID NO: 397266 - protein, 4 aa, Mycobacterium
GAWE

SEQ ID NO: 397267 - protein, 19 aa, Mycobacterium
GAYAGSLDDAEDALEGQLW

SEQ ID NO: 397268 - protein, 7 aa, Mycobacterium
GAYPPGK

SEQ ID NO: 397269 - protein, 11 aa, Mycobacterium
GCAGHSDGDVG

SEQ ID NO: 397270 - protein, 7 aa, Mycobacterium
GCCDGSS

SEQ ID NO: 397271 - protein, 7 aa, Mycobacterium
GCDAGDC

SEQ ID NO: 397272 - protein, 9 aa, Mycobacterium
GCFPPPPGY

SEQ ID NO: 397273 - protein, 5 aa, Mycobacterium
GCGGA

SEQ ID NO: 397274 - protein, 7 aa, Mycobacterium
GCGNPTA

SEQ ID NO: 397275 - protein, 5 aa, Mycobacterium
GCGTG

SEQ ID NO: 397276 - protein, 6 aa, Mycobacterium
GCHGGP

SEQ ID NO: 397277 - protein, 4 aa, Mycobacterium
GCPN

SEQ ID NO: 397278 - protein, 11 aa, Mycobacterium
GCTRPGCTANG

SEQ ID NO: 397279 - protein, 5 aa, Mycobacterium
GDAAA

SEQ ID NO: 397280 - protein, 8 aa, Mycobacterium
GDAAATDA

SEQ ID NO: 397281 - protein, 8 aa, Mycobacterium
GDAAATEA

SEQ ID NO: 397282 - protein, 5 aa, Mycobacterium
GDAAG

SEQ ID NO: 397283 - protein, 7 aa, Mycobacterium
GDAAKIQ

SEQ ID NO: 397284 - protein, 7 aa, Mycobacterium
GDAARYA

SEQ ID NO: 397285 - protein, 7 aa, Mycobacterium
GDAEDVA

SEQ ID NO: 397286 - protein, 6 aa, Mycobacterium
GDAEND

SEQ ID NO: 397287 - protein, 6 aa, Mycobacterium
GDAGRV

SEQ ID NO: 397288 - protein, 7 aa, Mycobacterium
GDAKGDL

SEQ ID NO: 397289 - protein, 8 aa, Mycobacterium
GDAMPSAA

SEQ ID NO: 397290 - protein, 5 aa, Mycobacterium
GDATA

SEQ ID NO: 397291 - protein, 5 aa, Mycobacterium
GDDAL

SEQ ID NO: 397292 - protein, 20 aa, Mycobacterium
GDDALARDPMTGERDIRSED

SEQ ID NO: 397293 - protein, 4 aa, Mycobacterium
GDDD

SEQ ID NO: 397294 - protein, 7 aa, Mycobacterium
GDDDNEA

SEQ ID NO: 397295 - protein, 4 aa, Mycobacterium
GDDG

SEQ ID NO: 397296 - protein, 9 aa, Mycobacterium
GDDGSHSAE

SEQ ID NO: 397297 - protein, 9 aa, Mycobacterium
GDDGTHSAE

SEQ ID NO: 397298 - protein, 5 aa, Mycobacterium
GDDHY

SEQ ID NO: 397299 - protein, 5 aa, Mycobacterium
GDDLR

SEQ ID NO: 397300 - protein, 8 aa, Mycobacterium
GDDPDRDF

SEQ ID NO: 397301 - protein, 5 aa, Mycobacterium
GDDPE

SEQ ID NO: 397302 - protein, 4 aa, Mycobacterium
GDDR

SEQ ID NO: 397303 - protein, 5 aa, Mycobacterium
GDDRD

SEQ ID NO: 397304 - protein, 8 aa, Mycobacterium
GDDSCRPQ

SEQ ID NO: 397305 - protein, 8 aa, Mycobacterium
GDDSRIGA

SEQ ID NO: 397306 - protein, 4 aa, Mycobacterium
GDDT

SEQ ID NO: 397307 - protein, 8 aa, Mycobacterium
GDDTGGEL

SEQ ID NO: 397308 - protein, 9 aa, Mycobacterium
GDDVQPGDV

SEQ ID NO: 397309 - protein, 4 aa, Mycobacterium
GDEA

SEQ ID NO: 397310 - protein, 13 aa, Mycobacterium
GDEAKAETVSAER

SEQ ID NO: 397311 - protein, 6 aa, Mycobacterium
GDEFGG

SEQ ID NO: 397312 - protein, 5 aa, Mycobacterium
GDEGF

SEQ ID NO: 397313 - protein, 6 aa, Mycobacterium
GDEGHH

SEQ ID NO: 397314 - protein, 4 aa, Mycobacterium
GDEI

SEQ ID NO: 397315 - protein, 7 aa, Mycobacterium
GDEPGVG

SEQ ID NO: 397316 - protein, 4 aa, Mycobacterium
GDFP

SEQ ID NO: 397317 - protein, 4 aa, Mycobacterium
GDGA

SEQ ID NO: 397318 - protein, 5 aa, Mycobacterium
GDGAA

SEQ ID NO: 397319 - protein, 7 aa, Mycobacterium
GDGEKKT

SEQ ID NO: 397320 - protein, 5 aa, Mycobacterium
GDGEV

SEQ ID NO: 397321 - protein, 4 aa, Mycobacterium
GDGG

SEQ ID NO: 397322 - protein, 6 aa, Mycobacterium
GDGIAG

SEQ ID NO: 397323 - protein, 7 aa, Mycobacterium
GDGKPHA

SEQ ID NO: 397324 - protein, 8 aa, Mycobacterium
GDGKWTDS

SEQ ID NO: 397325 - protein, 4 aa, Mycobacterium
GDGL

SEQ ID NO: 397326 - protein, 8 aa, Mycobacterium
GDGLGGSS

SEQ ID NO: 397327 - protein, 4 aa, Mycobacterium
GDGP

SEQ ID NO: 397328 - protein, 6 aa, Mycobacterium
GDGPQL

SEQ ID NO: 397329 - protein, 4 aa, Mycobacterium
GDGQ

SEQ ID NO: 397330 - protein, 5 aa, Mycobacterium
GDGRA

SEQ ID NO: 397331 - protein, 5 aa, Mycobacterium
GDGRC

SEQ ID NO: 397332 - protein, 13 aa, Mycobacterium
GDGRGYDVRPDVT

SEQ ID NO: 397333 - protein, 12 aa, Mycobacterium
GDGTTRTANDEA

SEQ ID NO: 397334 - protein, 6 aa, Mycobacterium
GDGTVN

SEQ ID NO: 397335 - protein, 6 aa, Mycobacterium
GDGTVS

SEQ ID NO: 397336 - protein, 7 aa, Mycobacterium
GDGTVSG

SEQ ID NO: 397337 - protein, 5 aa, Mycobacterium
GDGVG

SEQ ID NO: 397338 - protein, 6 aa, Mycobacterium
GDGVPA

SEQ ID NO: 397339 - protein, 5 aa, Mycobacterium
GDGVS

SEQ ID NO: 397340 - protein, 12 aa, Mycobacterium
GDHGDAAEAIQR

SEQ ID NO: 397341 - protein, 4 aa, Mycobacterium
GDHR

SEQ ID NO: 397342 - protein, 4 aa, Mycobacterium
GDHS

SEQ ID NO: 397343 - protein, 4 aa, Mycobacterium
GDIE

SEQ ID NO: 397344 - protein, 5 aa, Mycobacterium
GDIGS

SEQ ID NO: 397345 - protein, 5 aa, Mycobacterium
GDIPD

SEQ ID NO: 397346 - protein, 6 aa, Mycobacterium
GDIPEG

SEQ ID NO: 397347 - protein, 10 aa, Mycobacterium
GDKDGAAKVV

SEQ ID NO: 397348 - protein, 8 aa, Mycobacterium
GDKGEADL

SEQ ID NO: 397349 - protein, 8 aa, Mycobacterium
GDKGQPCW

SEQ ID NO: 397350 - protein, 6 aa, Mycobacterium
GDKTAV

SEQ ID NO: 397351 - protein, 11 aa, Mycobacterium
GDLDDPDSPIA

SEQ ID NO: 397352 - protein, 8 aa, Mycobacterium
GDLGDQQA

SEQ ID NO: 397353 - protein, 5 aa, Mycobacterium
GDLPR

SEQ ID NO: 397354 - protein, 5 aa, Mycobacterium
GDLPS

SEQ ID NO: 397355 - protein, 4 aa, Mycobacterium
GDLR

SEQ ID NO: 397356 - protein, 9 aa, Mycobacterium
GDNDTEKFD

SEQ ID NO: 397357 - protein, 8 aa, Mycobacterium
GDNNDAFT

SEQ ID NO: 397358 - protein, 6 aa, Mycobacterium
GDNTDI

SEQ ID NO: 397359 - protein, 7 aa, Mycobacterium
GDPAAVE

SEQ ID NO: 397360 - protein, 7 aa, Mycobacterium
GDPADRD

SEQ ID NO: 397361 - protein, 8 aa, Mycobacterium
GDPADRRR

SEQ ID NO: 397362 - protein, 5 aa, Mycobacterium
GDPAG

SEQ ID NO: 397363 - protein, 8 aa, Mycobacterium
GDPALPSA

SEQ ID NO: 397364 - protein, 5 aa, Mycobacterium
GDPAR

SEQ ID NO: 397365 - protein, 9 aa, Mycobacterium
GDPDAFPAS

SEQ ID NO: 397366 - protein, 7 aa, Mycobacterium
GDPEDGY

SEQ ID NO: 397367 - protein, 6 aa, Mycobacterium
GDPGDL

SEQ ID NO: 397368 - protein, 7 aa, Mycobacterium
GDPGPFT

SEQ ID NO: 397369 - protein, 4 aa, Mycobacterium
GDPL

SEQ ID NO: 397370 - protein, 5 aa, Mycobacterium
GDPLS

SEQ ID NO: 397371 - protein, 16 aa, Mycobacterium
GDPNYGYSTSPANVPT

SEQ ID NO: 397372 - protein, 8 aa, Mycobacterium
GDPPQVPI

SEQ ID NO: 397373 - protein, 6 aa, Mycobacterium
GDPPRL

SEQ ID NO: 397374 - protein, 6 aa, Mycobacterium
GDPRAP

SEQ ID NO: 397375 - protein, 7 aa, Mycobacterium
GDPRPPL

SEQ ID NO: 397376 - protein, 5 aa, Mycobacterium
GDPRW

SEQ ID NO: 397377 - protein, 8 aa, Mycobacterium
GDPSRDRD

SEQ ID NO: 397378 - protein, 8 aa, Mycobacterium
GDPSVPSG

SEQ ID NO: 397379 - protein, 8 aa, Mycobacterium
GDPTGGKA

SEQ ID NO: 397380 - protein, 5 aa, Mycobacterium
GDPTI

SEQ ID NO: 397381 - protein, 5 aa, Mycobacterium
GDPVK

SEQ ID NO: 397382 - protein, 5 aa, Mycobacterium
GDPWT

SEQ ID NO: 397383 - protein, 5 aa, Mycobacterium
GDQET

SEQ ID NO: 397384 - protein, 5 aa, Mycobacterium
GDQGV

SEQ ID NO: 397385 - protein, 8 aa, Mycobacterium
GDQQRADA

SEQ ID NO: 397386 - protein, 11 aa, Mycobacterium
GDRAAQTGQQI

SEQ ID NO: 397387 - protein, 5 aa, Mycobacterium
GDRAF

SEQ ID NO: 397388 - protein, 5 aa, Mycobacterium
GDRDA

SEQ ID NO: 397389 - protein, 5 aa, Mycobacterium
GDRGF

SEQ ID NO: 397390 - protein, 4 aa, Mycobacterium
GDRH

SEQ ID NO: 397391 - protein, 5 aa, Mycobacterium
GDRHG

SEQ ID NO: 397392 - protein, 8 aa, Mycobacterium
GDRLDPTL

SEQ ID NO: 397393 - protein, 5 aa, Mycobacterium
GDRLG

SEQ ID NO: 397394 - protein, 5 aa, Mycobacterium
GDRLP

SEQ ID NO: 397395 - protein, 6 aa, Mycobacterium
GDRNGG

SEQ ID NO: 397396 - protein, 6 aa, Mycobacterium
GDRNGS

SEQ ID NO: 397397 - protein, 4 aa, Mycobacterium
GDRP

SEQ ID NO: 397398 - protein, 6 aa, Mycobacterium
GDRPAE

SEQ ID NO: 397399 - protein, 4 aa, Mycobacterium
GDRT

SEQ ID NO: 397400 - protein, 7 aa, Mycobacterium
GDRVEAG

SEQ ID NO: 397401 - protein, 5 aa, Mycobacterium
GDRVT

SEQ ID NO: 397402 - protein, 7 aa, Mycobacterium
GDRVTHD

SEQ ID NO: 397403 - protein, 7 aa, Mycobacterium
GDSAVPR

SEQ ID NO: 397404 - protein, 9 aa, Mycobacterium
GDSEGQPRQ

SEQ ID NO: 397405 - protein, 10 aa, Mycobacterium
GDSPETAALA

SEQ ID NO: 397406 - protein, 4 aa, Mycobacterium
GDSR

SEQ ID NO: 397407 - protein, 6 aa, Mycobacterium
GDSREP

SEQ ID NO: 397408 - protein, 6 aa, Mycobacterium
GDSSTE

SEQ ID NO: 397409 - protein, 9 aa, Mycobacterium
GDSSYGTRS

SEQ ID NO: 397410 - protein, 5 aa, Mycobacterium
GDTAL

SEQ ID NO: 397411 - protein, 4 aa, Mycobacterium
GDTD

SEQ ID NO: 397412 - protein, 4 aa, Mycobacterium
GDTL

SEQ ID NO: 397413 - protein, 4 aa, Mycobacterium
GDTM

SEQ ID NO: 397414 - protein, 4 aa, Mycobacterium
GDTN

SEQ ID NO: 397415 - protein, 8 aa, Mycobacterium
GDTNTETG

SEQ ID NO: 397416 - protein, 6 aa, Mycobacterium
GDTPGI

SEQ ID NO: 397417 - protein, 7 aa, Mycobacterium
GDTPHEN

SEQ ID NO: 397418 - protein, 6 aa, Mycobacterium
GDTRNV

SEQ ID NO: 397419 - protein, 8 aa, Mycobacterium
GDTSGIDE

SEQ ID NO: 397420 - protein, 7 aa, Mycobacterium
GDTSMSQ

SEQ ID NO: 397421 - protein, 5 aa, Mycobacterium
GDTTA

SEQ ID NO: 397422 - protein, 6 aa, Mycobacterium
GDTTDE

SEQ ID NO: 397423 - protein, 4 aa, Mycobacterium
GDTV

SEQ ID NO: 397424 - protein, 4 aa, Mycobacterium
GDVA

SEQ ID NO: 397425 - protein, 5 aa, Mycobacterium
GDVDK

SEQ ID NO: 397426 - protein, 6 aa, Mycobacterium
GDVDTG

SEQ ID NO: 397427 - protein, 9 aa, Mycobacterium
GDYDSATTH

SEQ ID NO: 397428 - protein, 6 aa, Mycobacterium
GDYEEM

SEQ ID NO: 397429 - protein, 6 aa, Mycobacterium
GEAAAY

SEQ ID NO: 397430 - protein, 11 aa, Mycobacterium
GEAAGFGGGGV

SEQ ID NO: 397431 - protein, 7 aa, Mycobacterium
GEAATAV

SEQ ID NO: 397432 - protein, 8 aa, Mycobacterium
GEADPAKR

SEQ ID NO: 397433 - protein, 6 aa, Mycobacterium
GEAFGR

SEQ ID NO: 397434 - protein, 4 aa, Mycobacterium
GEAG

SEQ ID NO: 397435 - protein, 10 aa, Mycobacterium
GEAGQSFDTP

SEQ ID NO: 397436 - protein, 8 aa, Mycobacterium
GEAGVTPA

SEQ ID NO: 397437 - protein, 9 aa, Mycobacterium
GEANPRADI

SEQ ID NO: 397438 - protein, 6 aa, Mycobacterium
GEAPGQ

SEQ ID NO: 397439 - protein, 8 aa, Mycobacterium
GEAPNKWT

SEQ ID NO: 397440 - protein, 4 aa, Mycobacterium
GEAR

SEQ ID NO: 397441 - protein, 5 aa, Mycobacterium
GEARA

SEQ ID NO: 397442 - protein, 7 aa, Mycobacterium
GEARDRG

SEQ ID NO: 397443 - protein, 4 aa, Mycobacterium
GEAS

SEQ ID NO: 397444 - protein, 4 aa, Mycobacterium
GEAT

SEQ ID NO: 397445 - protein, 7 aa, Mycobacterium
GEATANP

SEQ ID NO: 397446 - protein, 9 aa, Mycobacterium
GEATPAGGM

SEQ ID NO: 397447 - protein, 4 aa, Mycobacterium
GEAV

SEQ ID NO: 397448 - protein, 6 aa, Mycobacterium
GEAYNT

SEQ ID NO: 397449 - protein, 6 aa, Mycobacterium
GECPGT

SEQ ID NO: 397450 - protein, 4 aa, Mycobacterium
GEDA

SEQ ID NO: 397451 - protein, 8 aa, Mycobacterium
GEDGGKSV

SEQ ID NO: 397452 - protein, 5 aa, Mycobacterium
GEDGV

SEQ ID NO: 397453 - protein, 4 aa, Mycobacterium
GEDH

SEQ ID NO: 397454 - protein, 4 aa, Mycobacterium
GEDI

SEQ ID NO: 397455 - protein, 4 aa, Mycobacterium
GEDL

SEQ ID NO: 397456 - protein, 10 aa, Mycobacterium
GEDQHQDTGA

SEQ ID NO: 397457 - protein, 6 aa, Mycobacterium
GEDQRQ

SEQ ID NO: 397458 - protein, 4 aa, Mycobacterium
GEDR

SEQ ID NO: 397459 - protein, 6 aa, Mycobacterium
GEDTYE

SEQ ID NO: 397460 - protein, 7 aa, Mycobacterium
GEEDDRI

SEQ ID NO: 397461 - protein, 6 aa, Mycobacterium
GEEEHG

SEQ ID NO: 397462 - protein, 6 aa, Mycobacterium
GEEGGG

SEQ ID NO: 397463 - protein, 6 aa, Mycobacterium
GEENGG

SEQ ID NO: 397464 - protein, 4 aa, Mycobacterium
GEEV

SEQ ID NO: 397465 - protein, 4 aa, Mycobacterium
GEFT

SEQ ID NO: 397466 - protein, 5 aa, Mycobacterium
GEGAR

SEQ ID NO: 397467 - protein, 10 aa, Mycobacterium
GEGDTAPGRK

SEQ ID NO: 397468 - protein, 4 aa, Mycobacterium
GEGE

SEQ ID NO: 397469 - protein, 12 aa, Mycobacterium
GEGEGRGHDGDY

SEQ ID NO: 397470 - protein, 4 aa, Mycobacterium
GEGI

SEQ ID NO: 397471 - protein, 5 aa, Mycobacterium
GEGKL

SEQ ID NO: 397472 - protein, 4 aa, Mycobacterium
GEGN

SEQ ID NO: 397473 - protein, 14 aa, Mycobacterium
GEGNKKLSKRDPQS

SEQ ID NO: 397474 - protein, 6 aa, Mycobacterium
GEGNKL

SEQ ID NO: 397475 - protein, 4 aa, Mycobacterium
GEGR

SEQ ID NO: 397476 - protein, 5 aa, Mycobacterium
GEGRA

SEQ ID NO: 397477 - protein, 6 aa, Mycobacterium
GEGSAV

SEQ ID NO: 397478 - protein, 9 aa, Mycobacterium
GEGSGQPLD

SEQ ID NO: 397479 - protein, 5 aa, Mycobacterium
GEGTT

SEQ ID NO: 397480 - protein, 4 aa, Mycobacterium
GEHA

SEQ ID NO: 397481 - protein, 7 aa, Mycobacterium
GEHDTRT

SEQ ID NO: 397482 - protein, 5 aa, Mycobacterium
GEHGD

SEQ ID NO: 397483 - protein, 11 aa, Mycobacterium
GEHGSTFGGNP

SEQ ID NO: 397484 - protein, 5 aa, Mycobacterium
GEHNA

SEQ ID NO: 397485 - protein, 8 aa, Mycobacterium
GEHPGRDS

SEQ ID NO: 397486 - protein, 13 aa, Mycobacterium
GEHPYSPITPESI

SEQ ID NO: 397487 - protein, 4 aa, Mycobacterium
GEHQ

SEQ ID NO: 397488 - protein, 16 aa, Mycobacterium
GEIAGAGHASATGRFD

SEQ ID NO: 397489 - protein, 4 aa, Mycobacterium
GEID

SEQ ID NO: 397490 - protein, 6 aa, Mycobacterium
GEIEAA

SEQ ID NO: 397491 - protein, 7 aa, Mycobacterium
GEIETPN

SEQ ID NO: 397492 - protein, 4 aa, Mycobacterium
GEIG

SEQ ID NO: 397493 - protein, 5 aa, Mycobacterium
GEIPT

SEQ ID NO: 397494 - protein, 4 aa, Mycobacterium
GEKD

SEQ ID NO: 397495 - protein, 8 aa, Mycobacterium
GEKGEPCW

SEQ ID NO: 397496 - protein, 6 aa, Mycobacterium
GEKPGI

SEQ ID NO: 397497 - protein, 5 aa, Mycobacterium
GEKVY

SEQ ID NO: 397498 - protein, 9 aa, Mycobacterium
GELAAPDDD

SEQ ID NO: 397499 - protein, 8 aa, Mycobacterium
GELEESAN

SEQ ID NO: 397500 - protein, 5 aa, Mycobacterium
GELGA

SEQ ID NO: 397501 - protein, 4 aa, Mycobacterium
GELP

SEQ ID NO: 397502 - protein, 8 aa, Mycobacterium
GELPPGVS

SEQ ID NO: 397503 - protein, 4 aa, Mycobacterium
GELR

SEQ ID NO: 397504 - protein, 17 aa, Mycobacterium
GELSESGPPAPPRSDGL

SEQ ID NO: 397505 - protein, 9 aa, Mycobacterium
GELSGGQRR

SEQ ID NO: 397506 - protein, 8 aa, Mycobacterium
GELTGSGR

SEQ ID NO: 397507 - protein, 5 aa, Mycobacterium
GELTR

SEQ ID NO: 397508 - protein, 4 aa, Mycobacterium
GELV

SEQ ID NO: 397509 - protein, 9 aa, Mycobacterium
GEMDEPESR

SEQ ID NO: 397510 - protein, 12 aa, Mycobacterium
GENDWDHPKRTS

SEQ ID NO: 397511 - protein, 8 aa, Mycobacterium
GENPHQKA

SEQ ID NO: 397512 - protein, 8 aa, Mycobacterium
GENPHQQA

SEQ ID NO: 397513 - protein, 7 aa, Mycobacterium
GENTSAL

SEQ ID NO: 397514 - protein, 9 aa, Mycobacterium
GEPASGPRR

SEQ ID NO: 397515 - protein, 11 aa, Mycobacterium
GEPDESGEEKI

SEQ ID NO: 397516 - protein, 7 aa, Mycobacterium
GEPEPGQ

SEQ ID NO: 397517 - protein, 4 aa, Mycobacterium
GEPG

SEQ ID NO: 397518 - protein, 8 aa, Mycobacterium
GEPGAGTR

SEQ ID NO: 397519 - protein, 5 aa, Mycobacterium
GEPIP

SEQ ID NO: 397520 - protein, 12 aa, Mycobacterium
GEPITSSTLTEE

SEQ ID NO: 397521 - protein, 6 aa, Mycobacterium
GEPLNP

SEQ ID NO: 397522 - protein, 5 aa, Mycobacterium
GEPLP

SEQ ID NO: 397523 - protein, 11 aa, Mycobacterium
GEPLTAEQTAR

SEQ ID NO: 397524 - protein, 4 aa, Mycobacterium
GEPR

SEQ ID NO: 397525 - protein, 8 aa, Mycobacterium
GEPRSGTT

SEQ ID NO: 397526 - protein, 7 aa, Mycobacterium
GEPSGGY

SEQ ID NO: 397527 - protein, 5 aa, Mycobacterium
GEPTA

SEQ ID NO: 397528 - protein, 23 aa, Mycobacterium
GEPTAAQLATAQKATRPSKPEQL

SEQ ID NO: 397529 - protein, 8 aa, Mycobacterium
GEPTDGIT

SEQ ID NO: 397530 - protein, 7 aa, Mycobacterium
GEPTGGY

SEQ ID NO: 397531 - protein, 5 aa, Mycobacterium
GEPVA

SEQ ID NO: 397532 - protein, 5 aa, Mycobacterium
GEPVG

SEQ ID NO: 397533 - protein, 9 aa, Mycobacterium
GEPVSLSPT

SEQ ID NO: 397534 - protein, 5 aa, Mycobacterium
GEPVT

SEQ ID NO: 397535 - protein, 4 aa, Mycobacterium
GEQA

SEQ ID NO: 397536 - protein, 11 aa, Mycobacterium
GEQAADAELTG

SEQ ID NO: 397537 - protein, 10 aa, Mycobacterium
GEQAAHRSES

SEQ ID NO: 397538 - protein, 7 aa, Mycobacterium
GEQDRPL

SEQ ID NO: 397539 - protein, 9 aa, Mycobacterium
GEQDRPLSE

SEQ ID NO: 397540 - protein, 4 aa, Mycobacterium
GEQL

SEQ ID NO: 397541 - protein, 8 aa, Mycobacterium
GEQTVPGL

SEQ ID NO: 397542 - protein, 6 aa, Mycobacterium
GERADG

SEQ ID NO: 397543 - protein, 6 aa, Mycobacterium
GERAGG

SEQ ID NO: 397544 - protein, 4 aa, Mycobacterium
GERD

SEQ ID NO: 397545 - protein, 5 aa, Mycobacterium
GERGG

SEQ ID NO: 397546 - protein, 7 aa, Mycobacterium
GERGRGY

SEQ ID NO: 397547 - protein, 4 aa, Mycobacterium
GERK

SEQ ID NO: 397548 - protein, 5 aa, Mycobacterium
GERQV

SEQ ID NO: 397549 - protein, 16 aa, Mycobacterium
GERRAQIGAGASGPGA

SEQ ID NO: 397550 - protein, 6 aa, Mycobacterium
GERVEA

SEQ ID NO: 397551 - protein, 4 aa, Mycobacterium
GERY

SEQ ID NO: 397552 - protein, 7 aa, Mycobacterium
GESATVS

SEQ ID NO: 397553 - protein, 4 aa, Mycobacterium
GESD

SEQ ID NO: 397554 - protein, 4 aa, Mycobacterium
GESG

SEQ ID NO: 397555 - protein, 10 aa, Mycobacterium
GESGSGKSTT

SEQ ID NO: 397556 - protein, 11 aa, Mycobacterium
GESGSGKSTTA

SEQ ID NO: 397557 - protein, 12 aa, Mycobacterium
GESGSGKSTTAA

SEQ ID NO: 397558 - protein, 10 aa, Mycobacterium
GESGSGKSVS

SEQ ID NO: 397559 - protein, 10 aa, Mycobacterium
GESGSGKTTL

SEQ ID NO: 397560 - protein, 9 aa, Mycobacterium
GESHDTPKT

SEQ ID NO: 397561 - protein, 6 aa, Mycobacterium
GESPRA

SEQ ID NO: 397562 - protein, 6 aa, Mycobacterium
GESRQQ

SEQ ID NO: 397563 - protein, 8 aa, Mycobacterium
GESSGYDL

SEQ ID NO: 397564 - protein, 7 aa, Mycobacterium
GESTADR

SEQ ID NO: 397565 - protein, 8 aa, Mycobacterium
GETALGEK

SEQ ID NO: 397566 - protein, 4 aa, Mycobacterium
GETD

SEQ ID NO: 397567 - protein, 11 aa, Mycobacterium
GETHDGASTTD

SEQ ID NO: 397568 - protein, 4 aa, Mycobacterium
GETI

SEQ ID NO: 397569 - protein, 9 aa, Mycobacterium
GETKLGETY

SEQ ID NO: 397570 - protein, 20 aa, Mycobacterium
GETKVTGQGLLSTPSWHWGN

SEQ ID NO: 397571 - protein, 4 aa, Mycobacterium
GETL

SEQ ID NO: 397572 - protein, 5 aa, Mycobacterium
GETLT

SEQ ID NO: 397573 - protein, 6 aa, Mycobacterium
GETRQQ

SEQ ID NO: 397574 - protein, 5 aa, Mycobacterium
GETRS

SEQ ID NO: 397575 - protein, 4 aa, Mycobacterium
GETS

SEQ ID NO: 397576 - protein, 4 aa, Mycobacterium
GETV

SEQ ID NO: 397577 - protein, 5 aa, Mycobacterium
GEVER

SEQ ID NO: 397578 - protein, 6 aa, Mycobacterium
GEVEYV

SEQ ID NO: 397579 - protein, 14 aa, Mycobacterium
GEVGNKKTYDPRSY

SEQ ID NO: 397580 - protein, 13 aa, Mycobacterium
GEVGNKKVYDPRS

SEQ ID NO: 397581 - protein, 4 aa, Mycobacterium
GEVP

SEQ ID NO: 397582 - protein, 5 aa, Mycobacterium
GEVSA

SEQ ID NO: 397583 - protein, 12 aa, Mycobacterium
GEVSDDESLGGA

SEQ ID NO: 397584 - protein, 8 aa, Mycobacterium
GEVSGGDL

SEQ ID NO: 397585 - protein, 5 aa, Mycobacterium
GEYDD

SEQ ID NO: 397586 - protein, 6 aa, Mycobacterium
GEYGEV

SEQ ID NO: 397587 - protein, 7 aa, Mycobacterium
GFADGRG

SEQ ID NO: 397588 - protein, 10 aa, Mycobacterium
GFAKDSTTET

SEQ ID NO: 397589 - protein, 4 aa, Mycobacterium
GFAT

SEQ ID NO: 397590 - protein, 6 aa, Mycobacterium
GFATSG

SEQ ID NO: 397591 - protein, 4 aa, Mycobacterium
GFDG

SEQ ID NO: 397592 - protein, 8 aa, Mycobacterium
GFDPAEPT

SEQ ID NO: 397593 - protein, 11 aa, Mycobacterium
GFDPAQPTAWS

SEQ ID NO: 397594 - protein, 12 aa, Mycobacterium
GFDPQAPSAWSA

SEQ ID NO: 397595 - protein, 4 aa, Mycobacterium
GFDR

SEQ ID NO: 397596 - protein, 6 aa, Mycobacterium
GFDTPS

SEQ ID NO: 397597 - protein, 5 aa, Mycobacterium
GFERG

SEQ ID NO: 397598 - protein, 11 aa, Mycobacterium
GFESIDKGDLR

SEQ ID NO: 397599 - protein, 7 aa, Mycobacterium
GFGEGGV

SEQ ID NO: 397600 - protein, 4 aa, Mycobacterium
GFGG

SEQ ID NO: 397601 - protein, 5 aa, Mycobacterium
GFGGS

SEQ ID NO: 397602 - protein, 6 aa, Mycobacterium
GFGNTG

SEQ ID NO: 397603 - protein, 11 aa, Mycobacterium
GFGPGDAPFGG

SEQ ID NO: 397604 - protein, 4 aa, Mycobacterium
GFGR

SEQ ID NO: 397605 - protein, 4 aa, Mycobacterium
GFGS

SEQ ID NO: 397606 - protein, 5 aa, Mycobacterium
GFGSE

SEQ ID NO: 397607 - protein, 8 aa, Mycobacterium
GFGSTEGG

SEQ ID NO: 397608 - protein, 6 aa, Mycobacterium
GFGTSG

SEQ ID NO: 397609 - protein, 6 aa, Mycobacterium
GFHQPR

SEQ ID NO: 397610 - protein, 5 aa, Mycobacterium
GFPER

SEQ ID NO: 397611 - protein, 14 aa, Mycobacterium
GFPGTKPNPYRERS

SEQ ID NO: 397612 - protein, 4 aa, Mycobacterium
GFPP

SEQ ID NO: 397613 - protein, 12 aa, Mycobacterium
GFRGQGAAHGAQ

SEQ ID NO: 397614 - protein, 5 aa, Mycobacterium
GFSDR

SEQ ID NO: 397615 - protein, 11 aa, Mycobacterium
GFSPGQNQQGD

SEQ ID NO: 397616 - protein, 13 aa, Mycobacterium
GFSPGQNRQGGDE

SEQ ID NO: 397617 - protein, 9 aa, Mycobacterium
GFSRDDAKE

SEQ ID NO: 397618 - protein, 11 aa, Mycobacterium
GFTDPAPANME

SEQ ID NO: 397619 - protein, 5 aa, Mycobacterium
GFTPR

SEQ ID NO: 397620 - protein, 7 aa, Mycobacterium
GFTSDGL

SEQ ID NO: 397621 - protein, 8 aa, Mycobacterium
GGAAPSTW

SEQ ID NO: 397622 - protein, 7 aa, Mycobacterium
GGADGDE

SEQ ID NO: 397623 - protein, 10 aa, Mycobacterium
GGADGEGAGF

SEQ ID NO: 397624 - protein, 7 aa, Mycobacterium
GGAEFAS

SEQ ID NO: 397625 - protein, 5 aa, Mycobacterium
GGAEL

SEQ ID NO: 397626 - protein, 6 aa, Mycobacterium
GGAERQ

SEQ ID NO: 397627 - protein, 5 aa, Mycobacterium
GGAEV

SEQ ID NO: 397628 - protein, 7 aa, Mycobacterium
GGAGDSL

SEQ ID NO: 397629 - protein, 8 aa, Mycobacterium
GGAGGDGG

SEQ ID NO: 397630 - protein, 16 aa, Mycobacterium
GGAGGQGGVAGTPDGV

SEQ ID NO: 397631 - protein, 6 aa, Mycobacterium
GGAGTA

SEQ ID NO: 397632 - protein, 10 aa, Mycobacterium
GGAGTTAAGL

SEQ ID NO: 397633 - protein, 14 aa, Mycobacterium
GGAGYTAAKHAQGA

SEQ ID NO: 397634 - protein, 4 aa, Mycobacterium
GGAK

SEQ ID NO: 397635 - protein, 5 aa, Mycobacterium
GGALD

SEQ ID NO: 397636 - protein, 4 aa, Mycobacterium
GGAM

SEQ ID NO: 397637 - protein, 10 aa, Mycobacterium
GGAPAPGELG

SEQ ID NO: 397638 - protein, 6 aa, Mycobacterium
GGAPNP

SEQ ID NO: 397639 - protein, 6 aa, Mycobacterium
GGAPYY

SEQ ID NO: 397640 - protein, 5 aa, Mycobacterium
GGAQL

SEQ ID NO: 397641 - protein, 14 aa, Mycobacterium
GGARDGTGAGSAMA

SEQ ID NO: 397642 - protein, 13 aa, Mycobacterium
GGARGRAKAFRPS

SEQ ID NO: 397643 - protein, 6 aa, Mycobacterium
GGARLR

SEQ ID NO: 397644 - protein, 4 aa, Mycobacterium
GGAS

SEQ ID NO: 397645 - protein, 5 aa, Mycobacterium
GGASA

SEQ ID NO: 397646 - protein, 6 aa, Mycobacterium
GGASEI

SEQ ID NO: 397647 - protein, 7 aa, Mycobacterium
GGATDTV

SEQ ID NO: 397648 - protein, 7 aa, Mycobacterium
GGATETA

SEQ ID NO: 397649 - protein, 8 aa, Mycobacterium
GGATETPV

SEQ ID NO: 397650 - protein, 5 aa, Mycobacterium
GGATI

SEQ ID NO: 397651 - protein, 4 aa, Mycobacterium
GGAY

SEQ ID NO: 397652 - protein, 9 aa, Mycobacterium
GGDAEERAA

SEQ ID NO: 397653 - protein, 6 aa, Mycobacterium
GGDAVG

SEQ ID NO: 397654 - protein, 8 aa, Mycobacterium
GGDDGLDP

SEQ ID NO: 397655 - protein, 6 aa, Mycobacterium
GGDDPA

SEQ ID NO: 397656 - protein, 19 aa, Mycobacterium
GGDDPIELGKNNSGRGVGG

SEQ ID NO: 397657 - protein, 5 aa, Mycobacterium
GGDEP

SEQ ID NO: 397658 - protein, 5 aa, Mycobacterium
GGDGS

SEQ ID NO: 397659 - protein, 9 aa, Mycobacterium
GGDLATPKG

SEQ ID NO: 397660 - protein, 11 aa, Mycobacterium
GGDLPPGPPFS

SEQ ID NO: 397661 - protein, 5 aa, Mycobacterium
GGDPA

SEQ ID NO: 397662 - protein, 8 aa, Mycobacterium
GGDPGVTA

SEQ ID NO: 397663 - protein, 8 aa, Mycobacterium
GGDSAMEE

SEQ ID NO: 397664 - protein, 5 aa, Mycobacterium
GGDTG

SEQ ID NO: 397665 - protein, 7 aa, Mycobacterium
GGDTGAD

SEQ ID NO: 397666 - protein, 4 aa, Mycobacterium
GGDY

SEQ ID NO: 397667 - protein, 13 aa, Mycobacterium
GGDYTDDAERRAA

SEQ ID NO: 397668 - protein, 15 aa, Mycobacterium
GGEAPTAASWGAANR

SEQ ID NO: 397669 - protein, 4 aa, Mycobacterium
GGED

SEQ ID NO: 397670 - protein, 11 aa, Mycobacterium
GGEEDGVANEI

SEQ ID NO: 397671 - protein, 7 aa, Mycobacterium
GGEEEHG

SEQ ID NO: 397672 - protein, 7 aa, Mycobacterium
GGEEVPG

SEQ ID NO: 397673 - protein, 6 aa, Mycobacterium
GGEGKR

SEQ ID NO: 397674 - protein, 7 aa, Mycobacterium
GGEHDRL

SEQ ID NO: 397675 - protein, 6 aa, Mycobacterium
GGENVS

SEQ ID NO: 397676 - protein, 7 aa, Mycobacterium
GGEPAGL

SEQ ID NO: 397677 - protein, 9 aa, Mycobacterium
GGEPHEQRA

SEQ ID NO: 397678 - protein, 6 aa, Mycobacterium
GGEPVD

SEQ ID NO: 397679 - protein, 6 aa, Mycobacterium
GGEQAA

SEQ ID NO: 397680 - protein, 12 aa, Mycobacterium
GGEQYAEEHESY

SEQ ID NO: 397681 - protein, 6 aa, Mycobacterium
GGERGE

SEQ ID NO: 397682 - protein, 14 aa, Mycobacterium
GGERVNEKAPKDRD

SEQ ID NO: 397683 - protein, 7 aa, Mycobacterium
GGETEFA

SEQ ID NO: 397684 - protein, 5 aa, Mycobacterium
GGETL

SEQ ID NO: 397685 - protein, 6 aa, Mycobacterium
GGETRD

SEQ ID NO: 397686 - protein, 4 aa, Mycobacterium
GGEV

SEQ ID NO: 397687 - protein, 8 aa, Mycobacterium
GGFPGTAR

SEQ ID NO: 397688 - protein, 5 aa, Mycobacterium
GGGAA

SEQ ID NO: 397689 - protein, 8 aa, Mycobacterium
GGGAAAGT

SEQ ID NO: 397690 - protein, 8 aa, Mycobacterium
GGGAATDV

SEQ ID NO: 397691 - protein, 8 aa, Mycobacterium
GGGADDGL

SEQ ID NO: 397692 - protein, 8 aa, Mycobacterium
GGGAPEAV

SEQ ID NO: 397693 - protein, 9 aa, Mycobacterium
GGGAPSLAE

SEQ ID NO: 397694 - protein, 7 aa, Mycobacterium
GGGDGTV

SEQ ID NO: 397695 - protein, 9 aa, Mycobacterium
GGGDGTVAA

SEQ ID NO: 397696 - protein, 14 aa, Mycobacterium
GGGDTEVSSEPWVP

SEQ ID NO: 397697 - protein, 5 aa, Mycobacterium
GGGDV

SEQ ID NO: 397698 - protein, 7 aa, Mycobacterium
GGGEAVE

SEQ ID NO: 397699 - protein, 8 aa, Mycobacterium
GGGEAVES

SEQ ID NO: 397700 - protein, 7 aa, Mycobacterium
GGGEKKT

SEQ ID NO: 397701 - protein, 6 aa, Mycobacterium
GGGFGA

SEQ ID NO: 397702 - protein, 12 aa, Mycobacterium
GGGFGSKGAPHA

SEQ ID NO: 397703 - protein, 11 aa, Mycobacterium
GGGGYPAARAG

SEQ ID NO: 397704 - protein, 5 aa, Mycobacterium
GGGHG

SEQ ID NO: 397705 - protein, 5 aa, Mycobacterium
GGGLD

SEQ ID NO: 397706 - protein, 4 aa, Mycobacterium
GGGM

SEQ ID NO: 397707 - protein, 12 aa, Mycobacterium
GGGMANATIIER

SEQ ID NO: 397708 - protein, 6 aa, Mycobacterium
GGGPAG

SEQ ID NO: 397709 - protein, 5 aa, Mycobacterium
GGGPL

SEQ ID NO: 397710 - protein, 7 aa, Mycobacterium
GGGPRSC

SEQ ID NO: 397711 - protein, 10 aa, Mycobacterium
GGGPSGQAGA

SEQ ID NO: 397712 - protein, 9 aa, Mycobacterium
GGGRAKALA

SEQ ID NO: 397713 - protein, 9 aa, Mycobacterium
GGGSGIGKG

SEQ ID NO: 397714 - protein, 10 aa, Mycobacterium
GGGSGIGKGV

SEQ ID NO: 397715 - protein, 9 aa, Mycobacterium
GGGSGIGRG

SEQ ID NO: 397716 - protein, 15 aa, Mycobacterium
GGGSGMARPGAVSRA

SEQ ID NO: 397717 - protein, 5 aa, Mycobacterium
GGGSI

SEQ ID NO: 397718 - protein, 7 aa, Mycobacterium
GGGSNLA

SEQ ID NO: 397719 - protein, 5 aa, Mycobacterium
GGGTR

SEQ ID NO: 397720 - protein, 6 aa, Mycobacterium
GGGTSV

SEQ ID NO: 397721 - protein, 5 aa, Mycobacterium
GGGTT

SEQ ID NO: 397722 - protein, 6 aa, Mycobacterium
GGGTTE

SEQ ID NO: 397723 - protein, 5 aa, Mycobacterium
GGGVD

SEQ ID NO: 397724 - protein, 5 aa, Mycobacterium
GGGVG

SEQ ID NO: 397725 - protein, 5 aa, Mycobacterium
GGGVS

SEQ ID NO: 397726 - protein, 6 aa, Mycobacterium
GGHPPT

SEQ ID NO: 397727 - protein, 4 aa, Mycobacterium
GGHT

SEQ ID NO: 397728 - protein, 7 aa, Mycobacterium
GGHTRGE

SEQ ID NO: 397729 - protein, 8 aa, Mycobacterium
GGHTRGEF

SEQ ID NO: 397730 - protein, 7 aa, Mycobacterium
GGIDTGR

SEQ ID NO: 397731 - protein, 5 aa, Mycobacterium
GGIES

SEQ ID NO: 397732 - protein, 9 aa, Mycobacterium
GGIRDDESL

SEQ ID NO: 397733 - protein, 4 aa, Mycobacterium
GGIT

SEQ ID NO: 397734 - protein, 13 aa, Mycobacterium
GGITADSDPDREW

SEQ ID NO: 397735 - protein, 5 aa, Mycobacterium
GGITS

SEQ ID NO: 397736 - protein, 4 aa, Mycobacterium
GGKA

SEQ ID NO: 397737 - protein, 5 aa, Mycobacterium
GGKGA

SEQ ID NO: 397738 - protein, 9 aa, Mycobacterium
GGKNAAEVV

SEQ ID NO: 397739 - protein, 9 aa, Mycobacterium
GGKPHDPAV

SEQ ID NO: 397740 - protein, 5 aa, Mycobacterium
GGLAA

SEQ ID NO: 397741 - protein, 13 aa, Mycobacterium
GGLADQESAGKVS

SEQ ID NO: 397742 - protein, 5 aa, Mycobacterium
GGLGA

SEQ ID NO: 397743 - protein, 5 aa, Mycobacterium
GGLGH

SEQ ID NO: 397744 - protein, 6 aa, Mycobacterium
GGLGPD

SEQ ID NO: 397745 - protein, 5 aa, Mycobacterium
GGLGR

SEQ ID NO: 397746 - protein, 6 aa, Mycobacterium
GGLNPA

SEQ ID NO: 397747 - protein, 4 aa, Mycobacterium
GGLP

SEQ ID NO: 397748 - protein, 7 aa, Mycobacterium
GGLPTNE

SEQ ID NO: 397749 - protein, 14 aa, Mycobacterium
GGLRPGRTEREVSR

SEQ ID NO: 397750 - protein, 5 aa, Mycobacterium
GGLTG

SEQ ID NO: 397751 - protein, 6 aa, Mycobacterium
GGLTPK

SEQ ID NO: 397752 - protein, 19 aa, Mycobacterium
GGMDTDAAKELKELREQNA

SEQ ID NO: 397753 - protein, 9 aa, Mycobacterium
GGMESGHAY

SEQ ID NO: 397754 - protein, 6 aa, Mycobacterium
GGMPPM

SEQ ID NO: 397755 - protein, 6 aa, Mycobacterium
GGNDAG

SEQ ID NO: 397756 - protein, 5 aa, Mycobacterium
GGNDP

SEQ ID NO: 397757 - protein, 7 aa, Mycobacterium
GGNDTVT

SEQ ID NO: 397758 - protein, 4 aa, Mycobacterium
GGNG

SEQ ID NO: 397759 - protein, 27 aa, Mycobacterium
GGNGGTGGFSGPLSAGAGGGDGGAGGG

SEQ ID NO: 397760 - protein, 11 aa, Mycobacterium
GGNGVDYPPTF

SEQ ID NO: 397761 - protein, 7 aa, Mycobacterium
GGNPHHD

SEQ ID NO: 397762 - protein, 4 aa, Mycobacterium
GGNR

SEQ ID NO: 397763 - protein, 4 aa, Mycobacterium
GGNV

SEQ ID NO: 397764 - protein, 8 aa, Mycobacterium
GGNVPGKK

SEQ ID NO: 397765 - protein, 10 aa, Mycobacterium
GGPAAQQAAS

SEQ ID NO: 397766 - protein, 6 aa, Mycobacterium
GGPAAT

SEQ ID NO: 397767 - protein, 10 aa, Mycobacterium
GGPAEQQAAS

SEQ ID NO: 397768 - protein, 5 aa, Mycobacterium
GGPAF

SEQ ID NO: 397769 - protein, 4 aa, Mycobacterium
GGPG

SEQ ID NO: 397770 - protein, 8 aa, Mycobacterium
GGPGAASW

SEQ ID NO: 397771 - protein, 5 aa, Mycobacterium
GGPGV

SEQ ID NO: 397772 - protein, 4 aa, Mycobacterium
GGPH

SEQ ID NO: 397773 - protein, 7 aa, Mycobacterium
GGPKPAG

SEQ ID NO: 397774 - protein, 5 aa, Mycobacterium
GGPLR

SEQ ID NO: 397775 - protein, 8 aa, Mycobacterium
GGPPEGRR

SEQ ID NO: 397776 - protein, 9 aa, Mycobacterium
GGPPTPETA

SEQ ID NO: 397777 - protein, 7 aa, Mycobacterium
GGPRAAS

SEQ ID NO: 397778 - protein, 9 aa, Mycobacterium
GGPSGQAGA

SEQ ID NO: 397779 - protein, 15 aa, Mycobacterium
GGPSSVYADGAPQLD

SEQ ID NO: 397780 - protein, 6 aa, Mycobacterium
GGPTDG

SEQ ID NO: 397781 - protein, 9 aa, Mycobacterium
GGPVPIPED

SEQ ID NO: 397782 - protein, 4 aa, Mycobacterium
GGPY

SEQ ID NO: 397783 - protein, 6 aa, Mycobacterium
GGQAGN

SEQ ID NO: 397784 - protein, 10 aa, Mycobacterium
GGQDGLASTD

SEQ ID NO: 397785 - protein, 8 aa, Mycobacterium
GGQESMTK

SEQ ID NO: 397786 - protein, 5 aa, Mycobacterium
GGQET

SEQ ID NO: 397787 - protein, 5 aa, Mycobacterium
GGQFE

SEQ ID NO: 397788 - protein, 5 aa, Mycobacterium
GGQGS

SEQ ID NO: 397789 - protein, 10 aa, Mycobacterium
GGQLSHGRTH

SEQ ID NO: 397790 - protein, 7 aa, Mycobacterium
GGQNAHT

SEQ ID NO: 397791 - protein, 8 aa, Mycobacterium
GGQPGQGF

SEQ ID NO: 397792 - protein, 7 aa, Mycobacterium
GGQRGLG

SEQ ID NO: 397793 - protein, 6 aa, Mycobacterium
GGQRQR

SEQ ID NO: 397794 - protein, 6 aa, Mycobacterium
GGQSRH

SEQ ID NO: 397795 - protein, 4 aa, Mycobacterium
GGQT

SEQ ID NO: 397796 - protein, 9 aa, Mycobacterium
GGQTPTSPL

SEQ ID NO: 397797 - protein, 9 aa, Mycobacterium
GGQTRRSWG

SEQ ID NO: 397798 - protein, 8 aa, Mycobacterium
GGQTSAES

SEQ ID NO: 397799 - protein, 4 aa, Mycobacterium
GGRA

SEQ ID NO: 397800 - protein, 4 aa, Mycobacterium
GGRD

SEQ ID NO: 397801 - protein, 12 aa, Mycobacterium
GGRGMRPESKFD

SEQ ID NO: 397802 - protein, 8 aa, Mycobacterium
GGRGPAER

SEQ ID NO: 397803 - protein, 9 aa, Mycobacterium
GGRGVGSAD

SEQ ID NO: 397804 - protein, 9 aa, Mycobacterium
GGRGVGSAE

SEQ ID NO: 397805 - protein, 10 aa, Mycobacterium
GGRGVGSAEN

SEQ ID NO: 397806 - protein, 5 aa, Mycobacterium
GGRHE

SEQ ID NO: 397807 - protein, 5 aa, Mycobacterium
GGRIE

SEQ ID NO: 397808 - protein, 11 aa, Mycobacterium
GGRLDPGETAV

SEQ ID NO: 397809 - protein, 9 aa, Mycobacterium
GGRLTPDQA

SEQ ID NO: 397810 - protein, 6 aa, Mycobacterium
GGRNLA

SEQ ID NO: 397811 - protein, 6 aa, Mycobacterium
GGRNRE

SEQ ID NO: 397812 - protein, 11 aa, Mycobacterium
GGRPTAAHRPR

SEQ ID NO: 397813 - protein, 5 aa, Mycobacterium
GGRPV

SEQ ID NO: 397814 - protein, 6 aa, Mycobacterium
GGRSMT

SEQ ID NO: 397815 - protein, 5 aa, Mycobacterium
GGRSV

SEQ ID NO: 397816 - protein, 5 aa, Mycobacterium
GGRYT

SEQ ID NO: 397817 - protein, 7 aa, Mycobacterium
GGSAGAH

SEQ ID NO: 397818 - protein, 5 aa, Mycobacterium
GGSAP

SEQ ID NO: 397819 - protein, 9 aa, Mycobacterium
GGSAQDAGH

SEQ ID NO: 397820 - protein, 6 aa, Mycobacterium
GGSATA

SEQ ID NO: 397821 - protein, 6 aa, Mycobacterium
GGSAVD

SEQ ID NO: 397822 - protein, 7 aa, Mycobacterium
GGSAYGL

SEQ ID NO: 397823 - protein, 9 aa, Mycobacterium
GGSCTDSTT

SEQ ID NO: 397824 - protein, 9 aa, Mycobacterium
GGSETIGPI

SEQ ID NO: 397825 - protein, 4 aa, Mycobacterium
GGSF

SEQ ID NO: 397826 - protein, 4 aa, Mycobacterium
GGSG

SEQ ID NO: 397827 - protein, 6 aa, Mycobacterium
GGSGAI

SEQ ID NO: 397828 - protein, 9 aa, Mycobacterium
GGSGGARDS

SEQ ID NO: 397829 - protein, 6 aa, Mycobacterium
GGSGIK

SEQ ID NO: 397830 - protein, 6 aa, Mycobacterium
GGSGIT

SEQ ID NO: 397831 - protein, 5 aa, Mycobacterium
GGSGN

SEQ ID NO: 397832 - protein, 6 aa, Mycobacterium
GGSGQL

SEQ ID NO: 397833 - protein, 9 aa, Mycobacterium
GGSGRSMAE

SEQ ID NO: 397834 - protein, 10 aa, Mycobacterium
GGSGSEAYQQ

SEQ ID NO: 397835 - protein, 10 aa, Mycobacterium
GGSGTTAAGL

SEQ ID NO: 397836 - protein, 4 aa, Mycobacterium
GGSI

SEQ ID NO: 397837 - protein, 4 aa, Mycobacterium
GGSL

SEQ ID NO: 397838 - protein, 5 aa, Mycobacterium
GGSMR

SEQ ID NO: 397839 - protein, 8 aa, Mycobacterium
GGSPAAMR

SEQ ID NO: 397840 - protein, 7 aa, Mycobacterium
GGSPTSF

SEQ ID NO: 397841 - protein, 6 aa, Mycobacterium
GGSSEY

SEQ ID NO: 397842 - protein, 6 aa, Mycobacterium
GGSTAT

SEQ ID NO: 397843 - protein, 15 aa, Mycobacterium
GGSTATTVSFVVSKG

SEQ ID NO: 397844 - protein, 8 aa, Mycobacterium
GGSTPEVV

SEQ ID NO: 397845 - protein, 10 aa, Mycobacterium
GGSVGDAEAA

SEQ ID NO: 397846 - protein, 6 aa, Mycobacterium
GGTAGL

SEQ ID NO: 397847 - protein, 8 aa, Mycobacterium
GGTDAKSF

SEQ ID NO: 397848 - protein, 5 aa, Mycobacterium
GGTGA

SEQ ID NO: 397849 - protein, 13 aa, Mycobacterium
GGTGGAGGTGGTA

SEQ ID NO: 397850 - protein, 11 aa, Mycobacterium
GGTGGTGGDAV

SEQ ID NO: 397851 - protein, 16 aa, Mycobacterium
GGTGPAEGSKATTVTP

SEQ ID NO: 397852 - protein, 12 aa, Mycobacterium
GGTGQLESTVSD

SEQ ID NO: 397853 - protein, 9 aa, Mycobacterium
GGTGRRYHP

SEQ ID NO: 397854 - protein, 7 aa, Mycobacterium
GGTHDNW

SEQ ID NO: 397855 - protein, 4 aa, Mycobacterium
GGTI

SEQ ID NO: 397856 - protein, 7 aa, Mycobacterium
GGTNEIQ

SEQ ID NO: 397857 - protein, 9 aa, Mycobacterium
GGTNGKTSV

SEQ ID NO: 397858 - protein, 10 aa, Mycobacterium
GGTPAQVENA

SEQ ID NO: 397859 - protein, 6 aa, Mycobacterium
GGTPEG

SEQ ID NO: 397860 - protein, 7 aa, Mycobacterium
GGTPSLL

SEQ ID NO: 397861 - protein, 7 aa, Mycobacterium
GGTRGIG

SEQ ID NO: 397862 - protein, 14 aa, Mycobacterium
GGTRMRATADGRSA

SEQ ID NO: 397863 - protein, 4 aa, Mycobacterium
GGTS

SEQ ID NO: 397864 - protein, 6 aa, Mycobacterium
GGTSEI

SEQ ID NO: 397865 - protein, 8 aa, Mycobacterium
GGTTAGLG

SEQ ID NO: 397866 - protein, 8 aa, Mycobacterium
GGTTGTPK

SEQ ID NO: 397867 - protein, 5 aa, Mycobacterium
GGTTQ

SEQ ID NO: 397868 - protein, 5 aa, Mycobacterium
GGTTY

SEQ ID NO: 397869 - protein, 4 aa, Mycobacterium
GGTV

SEQ ID NO: 397870 - protein, 6 aa, Mycobacterium
GGTVEG

SEQ ID NO: 397871 - protein, 12 aa, Mycobacterium
GGTVGRGGGPSY

SEQ ID NO: 397872 - protein, 13 aa, Mycobacterium
GGTVGRGGGPSYQ

SEQ ID NO: 397873 - protein, 4 aa, Mycobacterium
GGVA

SEQ ID NO: 397874 - protein, 4 aa, Mycobacterium
GGVD

SEQ ID NO: 397875 - protein, 13 aa, Mycobacterium
GGVDDRDRNADLG

SEQ ID NO: 397876 - protein, 7 aa, Mycobacterium
GGVDSAD

SEQ ID NO: 397877 - protein, 7 aa, Mycobacterium
GGVDTRI

SEQ ID NO: 397878 - protein, 12 aa, Mycobacterium
GGVGEDITGGLP

SEQ ID NO: 397879 - protein, 64 aa, Mycobacterium
GGVGGAGGAGGISTSSSVNNGGAGGAGGNAGGLFGSGGAGGIGGAVGTGGTVAGAGGDGGGAGW

SEQ ID NO: 397880 - protein, 7 aa, Mycobacterium
GGVGKTA

SEQ ID NO: 397881 - protein, 8 aa, Mycobacterium
GGVGKTTI

SEQ ID NO: 397882 - protein, 11 aa, Mycobacterium
GGVGKTTITAT

SEQ ID NO: 397883 - protein, 11 aa, Mycobacterium
GGVPDGPWPDA

SEQ ID NO: 397884 - protein, 4 aa, Mycobacterium
GGVR

SEQ ID NO: 397885 - protein, 6 aa, Mycobacterium
GGVRSV

SEQ ID NO: 397886 - protein, 9 aa, Mycobacterium
GGVSGGTAA

SEQ ID NO: 397887 - protein, 8 aa, Mycobacterium
GGVSGGTV

SEQ ID NO: 397888 - protein, 11 aa, Mycobacterium
GGVSTPATQDA

SEQ ID NO: 397889 - protein, 4 aa, Mycobacterium
GGVT

SEQ ID NO: 397890 - protein, 8 aa, Mycobacterium
GGVTGGAD

SEQ ID NO: 397891 - protein, 6 aa, Mycobacterium
GGVTGK

SEQ ID NO: 397892 - protein, 9 aa, Mycobacterium
GGVYDPQSH

SEQ ID NO: 397893 - protein, 5 aa, Mycobacterium
GGYAQ

SEQ ID NO: 397894 - protein, 5 aa, Mycobacterium
GGYGE

SEQ ID NO: 397895 - protein, 4 aa, Mycobacterium
GGYR

SEQ ID NO: 397896 - protein, 5 aa, Mycobacterium
GGYRD

SEQ ID NO: 397897 - protein, 6 aa, Mycobacterium
GGYRIG

SEQ ID NO: 397898 - protein, 9 aa, Mycobacterium
GGYSREEAN

SEQ ID NO: 397899 - protein, 4 aa, Mycobacterium
GGYT

SEQ ID NO: 397900 - protein, 6 aa, Mycobacterium
GHAGQS

SEQ ID NO: 397901 - protein, 8 aa, Mycobacterium
GHAGSPAE

SEQ ID NO: 397902 - protein, 7 aa, Mycobacterium
GHASAGD

SEQ ID NO: 397903 - protein, 15 aa, Mycobacterium
GHATPQSRSRPDRGP

SEQ ID NO: 397904 - protein, 5 aa, Mycobacterium
GHDDP

SEQ ID NO: 397905 - protein, 6 aa, Mycobacterium
GHDDRG

SEQ ID NO: 397906 - protein, 6 aa, Mycobacterium
GHDPRR

SEQ ID NO: 397907 - protein, 4 aa, Mycobacterium
GHDR

SEQ ID NO: 397908 - protein, 5 aa, Mycobacterium
GHDRE

SEQ ID NO: 397909 - protein, 11 aa, Mycobacterium
GHDTTSATISG

SEQ ID NO: 397910 - protein, 4 aa, Mycobacterium
GHEP

SEQ ID NO: 397911 - protein, 21 aa, Mycobacterium
GHEPDETADHAPVTASPPEID

SEQ ID NO: 397912 - protein, 6 aa, Mycobacterium
GHERDQ

SEQ ID NO: 397913 - protein, 5 aa, Mycobacterium
GHEYR

SEQ ID NO: 397914 - protein, 7 aa, Mycobacterium
GHGADGT

SEQ ID NO: 397915 - protein, 13 aa, Mycobacterium
GHGESDWSDEGDY

SEQ ID NO: 397916 - protein, 6 aa, Mycobacterium
GHGGGA

SEQ ID NO: 397917 - protein, 7 aa, Mycobacterium
GHGPHEA

SEQ ID NO: 397918 - protein, 8 aa, Mycobacterium
GHGRAEEL

SEQ ID NO: 397919 - protein, 8 aa, Mycobacterium
GHGRHEEL

SEQ ID NO: 397920 - protein, 9 aa, Mycobacterium
GHGRHEELG

SEQ ID NO: 397921 - protein, 5 aa, Mycobacterium
GHGRS

SEQ ID NO: 397922 - protein, 12 aa, Mycobacterium
GHGTGTTLGDPI

SEQ ID NO: 397923 - protein, 13 aa, Mycobacterium
GHGTGTTLGDPIE

SEQ ID NO: 397924 - protein, 13 aa, Mycobacterium
GHNEGDDPSMTNP

SEQ ID NO: 397925 - protein, 12 aa, Mycobacterium
GHNEGDDPSMTQ

SEQ ID NO: 397926 - protein, 9 aa, Mycobacterium
GHPDRPPTH

SEQ ID NO: 397927 - protein, 4 aa, Mycobacterium
GHPG

SEQ ID NO: 397928 - protein, 4 aa, Mycobacterium
GHPH

SEQ ID NO: 397929 - protein, 5 aa, Mycobacterium
GHPRA

SEQ ID NO: 397930 - protein, 4 aa, Mycobacterium
GHPT

SEQ ID NO: 397931 - protein, 4 aa, Mycobacterium
GHPV

SEQ ID NO: 397932 - protein, 10 aa, Mycobacterium
GHRANPVATG

SEQ ID NO: 397933 - protein, 4 aa, Mycobacterium
GHRG

SEQ ID NO: 397934 - protein, 14 aa, Mycobacterium
GHRPKTVSTTSGDI

SEQ ID NO: 397935 - protein, 4 aa, Mycobacterium
GHSD

SEQ ID NO: 397936 - protein, 8 aa, Mycobacterium
GHSTPTVT

SEQ ID NO: 397937 - protein, 9 aa, Mycobacterium
GHSYGGRQT

SEQ ID NO: 397938 - protein, 6 aa, Mycobacterium
GHTAGA

SEQ ID NO: 397939 - protein, 5 aa, Mycobacterium
GHTHA

SEQ ID NO: 397940 - protein, 14 aa, Mycobacterium
GHTPSAEVPTPRDL

SEQ ID NO: 397941 - protein, 8 aa, Mycobacterium
GHTRGDDL

SEQ ID NO: 397942 - protein, 7 aa, Mycobacterium
GIADTGI

SEQ ID NO: 397943 - protein, 10 aa, Mycobacterium
GIARKRRGKG

SEQ ID NO: 397944 - protein, 7 aa, Mycobacterium
GIASPRS

SEQ ID NO: 397945 - protein, 7 aa, Mycobacterium
GIASRRA

SEQ ID NO: 397946 - protein, 5 aa, Mycobacterium
GIATG

SEQ ID NO: 397947 - protein, 10 aa, Mycobacterium
GIDADSDEAL

SEQ ID NO: 397948 - protein, 12 aa, Mycobacterium
GIDPPEGPLRAL

SEQ ID NO: 397949 - protein, 7 aa, Mycobacterium
GIDTDEP

SEQ ID NO: 397950 - protein, 5 aa, Mycobacterium
GIEEG

SEQ ID NO: 397951 - protein, 5 aa, Mycobacterium
GIEPG

SEQ ID NO: 397952 - protein, 12 aa, Mycobacterium
GIEPGALRGSAT

SEQ ID NO: 397953 - protein, 4 aa, Mycobacterium
GIES

SEQ ID NO: 397954 - protein, 4 aa, Mycobacterium
GIGA

SEQ ID NO: 397955 - protein, 13 aa, Mycobacterium
GIGATENAEGFTT

SEQ ID NO: 397956 - protein, 4 aa, Mycobacterium
GIGE

SEQ ID NO: 397957 - protein, 4 aa, Mycobacterium
GIGG

SEQ ID NO: 397958 - protein, 5 aa, Mycobacterium
GIGGT

SEQ ID NO: 397959 - protein, 7 aa, Mycobacterium
GIGLPDE

SEQ ID NO: 397960 - protein, 5 aa, Mycobacterium
GIGPG

SEQ ID NO: 397961 - protein, 5 aa, Mycobacterium
GIGPV

SEQ ID NO: 397962 - protein, 4 aa, Mycobacterium
GIGR

SEQ ID NO: 397963 - protein, 5 aa, Mycobacterium
GIGSD

SEQ ID NO: 397964 - protein, 6 aa, Mycobacterium
GIGTAA

SEQ ID NO: 397965 - protein, 7 aa, Mycobacterium
GIGTGRQ

SEQ ID NO: 397966 - protein, 4 aa, Mycobacterium
GIGY

SEQ ID NO: 397967 - protein, 7 aa, Mycobacterium
GIKDTSD

SEQ ID NO: 397968 - protein, 8 aa, Mycobacterium
GIKDTSDQ

SEQ ID NO: 397969 - protein, 6 aa, Mycobacterium
GIPADD

SEQ ID NO: 397970 - protein, 5 aa, Mycobacterium
GIPDE

SEQ ID NO: 397971 - protein, 7 aa, Mycobacterium
GIPEAEK

SEQ ID NO: 397972 - protein, 13 aa, Mycobacterium
GIPGSAGATPVQN

SEQ ID NO: 397973 - protein, 4 aa, Mycobacterium
GIPN

SEQ ID NO: 397974 - protein, 4 aa, Mycobacterium
GIPP

SEQ ID NO: 397975 - protein, 4 aa, Mycobacterium
GIPT

SEQ ID NO: 397976 - protein, 5 aa, Mycobacterium
GIQAG

SEQ ID NO: 397977 - protein, 5 aa, Mycobacterium
GIRKN

SEQ ID NO: 397978 - protein, 6 aa, Mycobacterium
GIRKST

SEQ ID NO: 397979 - protein, 5 aa, Mycobacterium
GIRKT

SEQ ID NO: 397980 - protein, 5 aa, Mycobacterium
GIRPA

SEQ ID NO: 397981 - protein, 10 aa, Mycobacterium
GIRPAPGYPA

SEQ ID NO: 397982 - protein, 14 aa, Mycobacterium
GISDSKFSRANDRR

SEQ ID NO: 397983 - protein, 5 aa, Mycobacterium
GISGP

SEQ ID NO: 397984 - protein, 7 aa, Mycobacterium
GISGRES

SEQ ID NO: 397985 - protein, 4 aa, Mycobacterium
GISI

SEQ ID NO: 397986 - protein, 8 aa, Mycobacterium
GISPPEDD

SEQ ID NO: 397987 - protein, 6 aa, Mycobacterium
GISREG

SEQ ID NO: 397988 - protein, 5 aa, Mycobacterium
GISSG

SEQ ID NO: 397989 - protein, 5 aa, Mycobacterium
GISSP

SEQ ID NO: 397990 - protein, 8 aa, Mycobacterium
GITDPAGL

SEQ ID NO: 397991 - protein, 11 aa, Mycobacterium
GITGPDGASHN

SEQ ID NO: 397992 - protein, 6 aa, Mycobacterium
GITGRD

SEQ ID NO: 397993 - protein, 12 aa, Mycobacterium
GITGSDGASHNG

SEQ ID NO: 397994 - protein, 6 aa, Mycobacterium
GITRDA

SEQ ID NO: 397995 - protein, 8 aa, Mycobacterium
GITTPEGL

SEQ ID NO: 397996 - protein, 6 aa, Mycobacterium
GKAAAV

SEQ ID NO: 397997 - protein, 8 aa, Mycobacterium
GKAAPDDL

SEQ ID NO: 397998 - protein, 8 aa, Mycobacterium
GKAAPDDV

SEQ ID NO: 397999 - protein, 4 aa, Mycobacterium
GKAK

SEQ ID NO: 398000 - protein, 8 aa, Mycobacterium
GKAQPGQI

SEQ ID NO: 398001 - protein, 9 aa, Mycobacterium
GKAQPGQVA

SEQ ID NO: 398002 - protein, 10 aa, Mycobacterium
GKATGDQGQA

SEQ ID NO: 398003 - protein, 5 aa, Mycobacterium
GKATL

SEQ ID NO: 398004 - protein, 8 aa, Mycobacterium
GKAVPIPY

SEQ ID NO: 398005 - protein, 7 aa, Mycobacterium
GKDGNAG

SEQ ID NO: 398006 - protein, 8 aa, Mycobacterium
GKDPLNPD

SEQ ID NO: 398007 - protein, 9 aa, Mycobacterium
GKDTEPLEN

SEQ ID NO: 398008 - protein, 6 aa, Mycobacterium
GKEGRK

SEQ ID NO: 398009 - protein, 5 aa, Mycobacterium
GKESI

SEQ ID NO: 398010 - protein, 10 aa, Mycobacterium
GKEVDRRPGD

SEQ ID NO: 398011 - protein, 14 aa, Mycobacterium
GKGAEISVEPRDVP

SEQ ID NO: 398012 - protein, 14 aa, Mycobacterium
GKGCAESLAGQGAR

SEQ ID NO: 398013 - protein, 9 aa, Mycobacterium
GKGRGGDHS

SEQ ID NO: 398014 - protein, 7 aa, Mycobacterium
GKGSVTV

SEQ ID NO: 398015 - protein, 7 aa, Mycobacterium
GKGTEEA

SEQ ID NO: 398016 - protein, 9 aa, Mycobacterium
GKGTQAQKL

SEQ ID NO: 398017 - protein, 10 aa, Mycobacterium
GKGTQAQKLS

SEQ ID NO: 398018 - protein, 8 aa, Mycobacterium
GKHAQAGA

SEQ ID NO: 398019 - protein, 5 aa, Mycobacterium
GKHTG

SEQ ID NO: 398020 - protein, 9 aa, Mycobacterium
GKKHESRQV

SEQ ID NO: 398021 - protein, 8 aa, Mycobacterium
GKKVESRQ

SEQ ID NO: 398022 - protein, 8 aa, Mycobacterium
GKLDDTPE

SEQ ID NO: 398023 - protein, 6 aa, Mycobacterium
GKLDRR

SEQ ID NO: 398024 - protein, 4 aa, Mycobacterium
GKLE

SEQ ID NO: 398025 - protein, 8 aa, Mycobacterium
GKLGSDPA

SEQ ID NO: 398026 - protein, 8 aa, Mycobacterium
GKNGTKGK

SEQ ID NO: 398027 - protein, 6 aa, Mycobacterium
GKNIHE

SEQ ID NO: 398028 - protein, 5 aa, Mycobacterium
GKNTY

SEQ ID NO: 398029 - protein, 5 aa, Mycobacterium
GKPAR

SEQ ID NO: 398030 - protein, 8 aa, Mycobacterium
GKPDPTVG

SEQ ID NO: 398031 - protein, 6 aa, Mycobacterium
GKPEEL

SEQ ID NO: 398032 - protein, 7 aa, Mycobacterium
GKPFKKE

SEQ ID NO: 398033 - protein, 11 aa, Mycobacterium
GKPGYETPNGT

SEQ ID NO: 398034 - protein, 9 aa, Mycobacterium
GKPRPGNYE

SEQ ID NO: 398035 - protein, 4 aa, Mycobacterium
GKPS

SEQ ID NO: 398036 - protein, 5 aa, Mycobacterium
GKPVG

SEQ ID NO: 398037 - protein, 5 aa, Mycobacterium
GKRDP

SEQ ID NO: 398038 - protein, 10 aa, Mycobacterium
GKRGAPARQR

SEQ ID NO: 398039 - protein, 8 aa, Mycobacterium
GKRGTTTD

SEQ ID NO: 398040 - protein, 4 aa, Mycobacterium
GKRL

SEQ ID NO: 398041 - protein, 8 aa, Mycobacterium
GKRTLSEG

SEQ ID NO: 398042 - protein, 7 aa, Mycobacterium
GKRTLTN

SEQ ID NO: 398043 - protein, 5 aa, Mycobacterium
GKSKK

SEQ ID NO: 398044 - protein, 11 aa, Mycobacterium
GKSLKNSISPD

SEQ ID NO: 398045 - protein, 19 aa, Mycobacterium
GKSSSASRAIDTESNLGQY

SEQ ID NO: 398046 - protein, 5 aa, Mycobacterium
GKSTL

SEQ ID NO: 398047 - protein, 6 aa, Mycobacterium
GKSVPL

SEQ ID NO: 398048 - protein, 8 aa, Mycobacterium
GKTAQRVA

SEQ ID NO: 398049 - protein, 5 aa, Mycobacterium
GKTGI

SEQ ID NO: 398050 - protein, 4 aa, Mycobacterium
GKTL

SEQ ID NO: 398051 - protein, 9 aa, Mycobacterium
GKTLSDPTR

SEQ ID NO: 398052 - protein, 6 aa, Mycobacterium
GKTPPC

SEQ ID NO: 398053 - protein, 7 aa, Mycobacterium
GKYQGRI

SEQ ID NO: 398054 - protein, 5 aa, Mycobacterium
GLAAG

SEQ ID NO: 398055 - protein, 8 aa, Mycobacterium
GLAASPSA

SEQ ID NO: 398056 - protein, 8 aa, Mycobacterium
GLAESPSA

SEQ ID NO: 398057 - protein, 12 aa, Mycobacterium
GLAGQARRKWPD

SEQ ID NO: 398058 - protein, 7 aa, Mycobacterium
GLAKPDG

SEQ ID NO: 398059 - protein, 7 aa, Mycobacterium
GLAPDGR

SEQ ID NO: 398060 - protein, 5 aa, Mycobacterium
GLAPG

SEQ ID NO: 398061 - protein, 9 aa, Mycobacterium
GLAPGTQFE

SEQ ID NO: 398062 - protein, 6 aa, Mycobacterium
GLAPST

SEQ ID NO: 398063 - protein, 7 aa, Mycobacterium
GLAQGQK

SEQ ID NO: 398064 - protein, 6 aa, Mycobacterium
GLARPG

SEQ ID NO: 398065 - protein, 9 aa, Mycobacterium
GLARPQGDR

SEQ ID NO: 398066 - protein, 5 aa, Mycobacterium
GLASG

SEQ ID NO: 398067 - protein, 4 aa, Mycobacterium
GLAT

SEQ ID NO: 398068 - protein, 4 aa, Mycobacterium
GLDA

SEQ ID NO: 398069 - protein, 8 aa, Mycobacterium
GLDAPGAA

SEQ ID NO: 398070 - protein, 4 aa, Mycobacterium
GLDG

SEQ ID NO: 398071 - protein, 8 aa, Mycobacterium
GLDGGADD

SEQ ID NO: 398072 - protein, 5 aa, Mycobacterium
GLEGE

SEQ ID NO: 398073 - protein, 5 aa, Mycobacterium
GLEPQ

SEQ ID NO: 398074 - protein, 6 aa, Mycobacterium
GLGDRG

SEQ ID NO: 398075 - protein, 4 aa, Mycobacterium
GLGE

SEQ ID NO: 398076 - protein, 7 aa, Mycobacterium
GLGENTA

SEQ ID NO: 398077 - protein, 7 aa, Mycobacterium
GLGGGEK

SEQ ID NO: 398078 - protein, 10 aa, Mycobacterium
GLGGPGREHE

SEQ ID NO: 398079 - protein, 6 aa, Mycobacterium
GLGPAA

SEQ ID NO: 398080 - protein, 6 aa, Mycobacterium
GLGQQE

SEQ ID NO: 398081 - protein, 4 aa, Mycobacterium
GLGR

SEQ ID NO: 398082 - protein, 6 aa, Mycobacterium
GLGRKG

SEQ ID NO: 398083 - protein, 8 aa, Mycobacterium
GLGRRRPD

SEQ ID NO: 398084 - protein, 5 aa, Mycobacterium
GLGTA

SEQ ID NO: 398085 - protein, 6 aa, Mycobacterium
GLHSNG

SEQ ID NO: 398086 - protein, 7 aa, Mycobacterium
GLKPQDI

SEQ ID NO: 398087 - protein, 13 aa, Mycobacterium
GLPADSEEAMNAA

SEQ ID NO: 398088 - protein, 6 aa, Mycobacterium
GLPAPT

SEQ ID NO: 398089 - protein, 5 aa, Mycobacterium
GLPDE

SEQ ID NO: 398090 - protein, 6 aa, Mycobacterium
GLPDVS

SEQ ID NO: 398091 - protein, 4 aa, Mycobacterium
GLPE

SEQ ID NO: 398092 - protein, 5 aa, Mycobacterium
GLPEA

SEQ ID NO: 398093 - protein, 12 aa, Mycobacterium
GLPEGDPLPPLP

SEQ ID NO: 398094 - protein, 6 aa, Mycobacterium
GLPEPT

SEQ ID NO: 398095 - protein, 9 aa, Mycobacterium
GLPGAEGTL

SEQ ID NO: 398096 - protein, 19 aa, Mycobacterium
GLPGLNGGNGGNGGAGGAA

SEQ ID NO: 398097 - protein, 6 aa, Mycobacterium
GLPGQR

SEQ ID NO: 398098 - protein, 5 aa, Mycobacterium
GLPGV

SEQ ID NO: 398099 - protein, 13 aa, Mycobacterium
GLPKGDPPPPLPE

SEQ ID NO: 398100 - protein, 4 aa, Mycobacterium
GLPP

SEQ ID NO: 398101 - protein, 5 aa, Mycobacterium
GLPPA

SEQ ID NO: 398102 - protein, 16 aa, Mycobacterium
GLPPIGSGLAPGTGIR

SEQ ID NO: 398103 - protein, 5 aa, Mycobacterium
GLPPS

SEQ ID NO: 398104 - protein, 6 aa, Mycobacterium
GLPRAT

SEQ ID NO: 398105 - protein, 4 aa, Mycobacterium
GLPS

SEQ ID NO: 398106 - protein, 7 aa, Mycobacterium
GLPSATA

SEQ ID NO: 398107 - protein, 6 aa, Mycobacterium
GLPSPL

SEQ ID NO: 398108 - protein, 9 aa, Mycobacterium
GLPSSPWHE

SEQ ID NO: 398109 - protein, 7 aa, Mycobacterium
GLPTDPS

SEQ ID NO: 398110 - protein, 15 aa, Mycobacterium
GLPTGRGGKFTAGEI

SEQ ID NO: 398111 - protein, 15 aa, Mycobacterium
GLPTGRGGKFTASEI

SEQ ID NO: 398112 - protein, 6 aa, Mycobacterium
GLPTSP

SEQ ID NO: 398113 - protein, 4 aa, Mycobacterium
GLPV

SEQ ID NO: 398114 - protein, 25 aa, Mycobacterium
GLQARAGVGRGDGKPEAEAAEPLPE

SEQ ID NO: 398115 - protein, 6 aa, Mycobacterium
GLRDDE

SEQ ID NO: 398116 - protein, 7 aa, Mycobacterium
GLRDDEG

SEQ ID NO: 398117 - protein, 5 aa, Mycobacterium
GLRGA

SEQ ID NO: 398118 - protein, 18 aa, Mycobacterium
GLRGKGRLTDADIDATTR

SEQ ID NO: 398119 - protein, 4 aa, Mycobacterium
GLRP

SEQ ID NO: 398120 - protein, 5 aa, Mycobacterium
GLRPE

SEQ ID NO: 398121 - protein, 15 aa, Mycobacterium
GLRPGSIADANDEAQ

SEQ ID NO: 398122 - protein, 10 aa, Mycobacterium
GLRRTEGHKM

SEQ ID NO: 398123 - protein, 5 aa, Mycobacterium
GLRTA

SEQ ID NO: 398124 - protein, 7 aa, Mycobacterium
GLSAQVT

SEQ ID NO: 398125 - protein, 5 aa, Mycobacterium
GLSGT

SEQ ID NO: 398126 - protein, 10 aa, Mycobacterium
GLSPDGSASY

SEQ ID NO: 398127 - protein, 6 aa, Mycobacterium
GLSPQR

SEQ ID NO: 398128 - protein, 7 aa, Mycobacterium
GLSPSAP

SEQ ID NO: 398129 - protein, 5 aa, Mycobacterium
GLSSP

SEQ ID NO: 398130 - protein, 14 aa, Mycobacterium
GLSSSALSQRIPDD

SEQ ID NO: 398131 - protein, 4 aa, Mycobacterium
GLTD

SEQ ID NO: 398132 - protein, 9 aa, Mycobacterium
GLTETSSAI

SEQ ID NO: 398133 - protein, 6 aa, Mycobacterium
GLTSPE

SEQ ID NO: 398134 - protein, 8 aa, Mycobacterium
GLTSTSSV

SEQ ID NO: 398135 - protein, 4 aa, Mycobacterium
GLTT

SEQ ID NO: 398136 - protein, 8 aa, Mycobacterium
GLVGRGGA

SEQ ID NO: 398137 - protein, 5 aa, Mycobacterium
GLVPG

SEQ ID NO: 398138 - protein, 7 aa, Mycobacterium
GLYPPGS

SEQ ID NO: 398139 - protein, 5 aa, Mycobacterium
GMADP

SEQ ID NO: 398140 - protein, 4 aa, Mycobacterium
GMAE

SEQ ID NO: 398141 - protein, 5 aa, Mycobacterium
GMAGD

SEQ ID NO: 398142 - protein, 8 aa, Mycobacterium
GMATPDDL

SEQ ID NO: 398143 - protein, 9 aa, Mycobacterium
GMGGSQRLT

SEQ ID NO: 398144 - protein, 8 aa, Mycobacterium
GMNAGKDV

SEQ ID NO: 398145 - protein, 10 aa, Mycobacterium
GMNPDDLRKA

SEQ ID NO: 398146 - protein, 7 aa, Mycobacterium
GMSDGDV

SEQ ID NO: 398147 - protein, 7 aa, Mycobacterium
GMSPPKD

SEQ ID NO: 398148 - protein, 11 aa, Mycobacterium
GMTGTAETEAA

SEQ ID NO: 398149 - protein, 11 aa, Mycobacterium
GMTGTAQTEAA

SEQ ID NO: 398150 - protein, 8 aa, Mycobacterium
GMTSTGDM

SEQ ID NO: 398151 - protein, 14 aa, Mycobacterium
GMTTGMPTPDGKPQ

SEQ ID NO: 398152 - protein, 6 aa, Mycobacterium
GNAITG

SEQ ID NO: 398153 - protein, 4 aa, Mycobacterium
GNAV

SEQ ID NO: 398154 - protein, 7 aa, Mycobacterium
GNDGNPY

SEQ ID NO: 398155 - protein, 7 aa, Mycobacterium
GNDNPAV

SEQ ID NO: 398156 - protein, 12 aa, Mycobacterium
GNDTTRQSTSHA

SEQ ID NO: 398157 - protein, 9 aa, Mycobacterium
GNDTTRQTI

SEQ ID NO: 398158 - protein, 11 aa, Mycobacterium
GNDTTRQTTSH

SEQ ID NO: 398159 - protein, 7 aa, Mycobacterium
GNEDGAH

SEQ ID NO: 398160 - protein, 8 aa, Mycobacterium
GNEDGSHD

SEQ ID NO: 398161 - protein, 7 aa, Mycobacterium
GNESPAE

SEQ ID NO: 398162 - protein, 11 aa, Mycobacterium
GNESTDGVGGA

SEQ ID NO: 398163 - protein, 10 aa, Mycobacterium
GNETSRNSIT

SEQ ID NO: 398164 - protein, 9 aa, Mycobacterium
GNETTRNTL

SEQ ID NO: 398165 - protein, 6 aa, Mycobacterium
GNGDGD

SEQ ID NO: 398166 - protein, 11 aa, Mycobacterium
GNGGSAAEAQH

SEQ ID NO: 398167 - protein, 5 aa, Mycobacterium
GNGPL

SEQ ID NO: 398168 - protein, 6 aa, Mycobacterium
GNGSTI

SEQ ID NO: 398169 - protein, 17 aa, Mycobacterium
GNGTPGAAGSGADGTAG

SEQ ID NO: 398170 - protein, 6 aa, Mycobacterium
GNGVGD

SEQ ID NO: 398171 - protein, 4 aa, Mycobacterium
GNIP

SEQ ID NO: 398172 - protein, 5 aa, Mycobacterium
GNIPV

SEQ ID NO: 398173 - protein, 8 aa, Mycobacterium
GNKARQQL

SEQ ID NO: 398174 - protein, 15 aa, Mycobacterium
GNKPVTESLHPSSPD

SEQ ID NO: 398175 - protein, 4 aa, Mycobacterium
GNLS

SEQ ID NO: 398176 - protein, 7 aa, Mycobacterium
GNNDVSR

SEQ ID NO: 398177 - protein, 4 aa, Mycobacterium
GNNH

SEQ ID NO: 398178 - protein, 9 aa, Mycobacterium
GNNKSVAEL

SEQ ID NO: 398179 - protein, 4 aa, Mycobacterium
GNNN

SEQ ID NO: 398180 - protein, 6 aa, Mycobacterium
GNNQDA

SEQ ID NO: 398181 - protein, 6 aa, Mycobacterium
GNNQNA

SEQ ID NO: 398182 - protein, 5 aa, Mycobacterium
GNNQV

SEQ ID NO: 398183 - protein, 8 aa, Mycobacterium
GNPDTAAN

SEQ ID NO: 398184 - protein, 6 aa, Mycobacterium
GNPENV

SEQ ID NO: 398185 - protein, 5 aa, Mycobacterium
GNPIP

SEQ ID NO: 398186 - protein, 13 aa, Mycobacterium
GNPPDYEPTPDRT

SEQ ID NO: 398187 - protein, 9 aa, Mycobacterium
GNPPEFGGR

SEQ ID NO: 398188 - protein, 9 aa, Mycobacterium
GNPSGRAGG

SEQ ID NO: 398189 - protein, 5 aa, Mycobacterium
GNPTL

SEQ ID NO: 398190 - protein, 13 aa, Mycobacterium
GNPVEHRPETTAD

SEQ ID NO: 398191 - protein, 5 aa, Mycobacterium
GNPYG

SEQ ID NO: 398192 - protein, 6 aa, Mycobacterium
GNPYGA

SEQ ID NO: 398193 - protein, 11 aa, Mycobacterium
GNQAQGAQQRA

SEQ ID NO: 398194 - protein, 4 aa, Mycobacterium
GNQP

SEQ ID NO: 398195 - protein, 15 aa, Mycobacterium
GNRAASSLAGGADTL

SEQ ID NO: 398196 - protein, 9 aa, Mycobacterium
GNRADAEDL

SEQ ID NO: 398197 - protein, 11 aa, Mycobacterium
GNRGIRPESKF

SEQ ID NO: 398198 - protein, 10 aa, Mycobacterium
GNRNFEGRIS

SEQ ID NO: 398199 - protein, 6 aa, Mycobacterium
GNRQVP

SEQ ID NO: 398200 - protein, 5 aa, Mycobacterium
GNRSY

SEQ ID NO: 398201 - protein, 11 aa, Mycobacterium
GNRTSDQPRPL

SEQ ID NO: 398202 - protein, 4 aa, Mycobacterium
GNSA

SEQ ID NO: 398203 - protein, 6 aa, Mycobacterium
GNSDAA

SEQ ID NO: 398204 - protein, 10 aa, Mycobacterium
GNSSQISDGA

SEQ ID NO: 398205 - protein, 4 aa, Mycobacterium
GNTD

SEQ ID NO: 398206 - protein, 12 aa, Mycobacterium
GNTHESSNGYKT

SEQ ID NO: 398207 - protein, 5 aa, Mycobacterium
GNTNF

SEQ ID NO: 398208 - protein, 7 aa, Mycobacterium
GNTSDLD

SEQ ID NO: 398209 - protein, 6 aa, Mycobacterium
GNTYDT

SEQ ID NO: 398210 - protein, 6 aa, Mycobacterium
GNTYYR

SEQ ID NO: 398211 - protein, 4 aa, Mycobacterium
GNVA

SEQ ID NO: 398212 - protein, 7 aa, Mycobacterium
GNVRGPY

SEQ ID NO: 398213 - protein, 9 aa, Mycobacterium
GNVRPQISE

SEQ ID NO: 398214 - protein, 6 aa, Mycobacterium
GPAAGV

SEQ ID NO: 398215 - protein, 5 aa, Mycobacterium
GPAAR

SEQ ID NO: 398216 - protein, 7 aa, Mycobacterium
GPADGAS

SEQ ID NO: 398217 - protein, 8 aa, Mycobacterium
GPADHAGP

SEQ ID NO: 398218 - protein, 4 aa, Mycobacterium
GPAE

SEQ ID NO: 398219 - protein, 5 aa, Mycobacterium
GPAGA

SEQ ID NO: 398220 - protein, 6 aa, Mycobacterium
GPAGPG

SEQ ID NO: 398221 - protein, 5 aa, Mycobacterium
GPAGV

SEQ ID NO: 398222 - protein, 6 aa, Mycobacterium
GPAGYT

SEQ ID NO: 398223 - protein, 4 aa, Mycobacterium
GPAL

SEQ ID NO: 398224 - protein, 15 aa, Mycobacterium
GPALPRAKSTLYDAG

SEQ ID NO: 398225 - protein, 5 aa, Mycobacterium
GPALS

SEQ ID NO: 398226 - protein, 6 aa, Mycobacterium
GPAPGM

SEQ ID NO: 398227 - protein, 6 aa, Mycobacterium
GPAPTE

SEQ ID NO: 398228 - protein, 4 aa, Mycobacterium
GPCG

SEQ ID NO: 398229 - protein, 8 aa, Mycobacterium
GPDATQTV

SEQ ID NO: 398230 - protein, 19 aa, Mycobacterium
GPDATREAFTSEAKAFSQD

SEQ ID NO: 398231 - protein, 5 aa, Mycobacterium
GPDEI

SEQ ID NO: 398232 - protein, 8 aa, Mycobacterium
GPDGEKYA

SEQ ID NO: 398233 - protein, 4 aa, Mycobacterium
GPDH

SEQ ID NO: 398234 - protein, 4 aa, Mycobacterium
GPDI

SEQ ID NO: 398235 - protein, 22 aa, Mycobacterium
GPDNRLAETGWTTRTNARGETE

SEQ ID NO: 398236 - protein, 13 aa, Mycobacterium
GPDNRSVTEGGWT

SEQ ID NO: 398237 - protein, 11 aa, Mycobacterium
GPDPEPHYRPS

SEQ ID NO: 398238 - protein, 7 aa, Mycobacterium
GPDTTSY

SEQ ID NO: 398239 - protein, 4 aa, Mycobacterium
GPDV

SEQ ID NO: 398240 - protein, 7 aa, Mycobacterium
GPDVQEG

SEQ ID NO: 398241 - protein, 10 aa, Mycobacterium
GPDVTDHQVG

SEQ ID NO: 398242 - protein, 4 aa, Mycobacterium
GPED

SEQ ID NO: 398243 - protein, 4 aa, Mycobacterium
GPEE

SEQ ID NO: 398244 - protein, 4 aa, Mycobacterium
GPEF

SEQ ID NO: 398245 - protein, 11 aa, Mycobacterium
GPEGGAEGGTV

SEQ ID NO: 398246 - protein, 5 aa, Mycobacterium
GPEGL

SEQ ID NO: 398247 - protein, 20 aa, Mycobacterium
GPEHPHTAQQPVPFEIKQVA

SEQ ID NO: 398248 - protein, 4 aa, Mycobacterium
GPEI

SEQ ID NO: 398249 - protein, 6 aa, Mycobacterium
GPEIGG

SEQ ID NO: 398250 - protein, 8 aa, Mycobacterium
GPEPHGAA

SEQ ID NO: 398251 - protein, 4 aa, Mycobacterium
GPEQ

SEQ ID NO: 398252 - protein, 8 aa, Mycobacterium
GPERGPNW

SEQ ID NO: 398253 - protein, 6 aa, Mycobacterium
GPERGS

SEQ ID NO: 398254 - protein, 5 aa, Mycobacterium
GPERL

SEQ ID NO: 398255 - protein, 17 aa, Mycobacterium
GPERPSEEAQGATRTRP

SEQ ID NO: 398256 - protein, 4 aa, Mycobacterium
GPEV

SEQ ID NO: 398257 - protein, 9 aa, Mycobacterium
GPFAEGAEV

SEQ ID NO: 398258 - protein, 10 aa, Mycobacterium
GPFGRNAPAA

SEQ ID NO: 398259 - protein, 8 aa, Mycobacterium
GPFPEADP

SEQ ID NO: 398260 - protein, 5 aa, Mycobacterium
GPGAE

SEQ ID NO: 398261 - protein, 20 aa, Mycobacterium
GPGAEANGYAEGTETPPDLK

SEQ ID NO: 398262 - protein, 8 aa, Mycobacterium
GPGAGELG

SEQ ID NO: 398263 - protein, 5 aa, Mycobacterium
GPGAT

SEQ ID NO: 398264 - protein, 6 aa, Mycobacterium
GPGDDA

SEQ ID NO: 398265 - protein, 9 aa, Mycobacterium
GPGDDPRVT

SEQ ID NO: 398266 - protein, 5 aa, Mycobacterium
GPGDH

SEQ ID NO: 398267 - protein, 7 aa, Mycobacterium
GPGDTWS

SEQ ID NO: 398268 - protein, 4 aa, Mycobacterium
GPGE

SEQ ID NO: 398269 - protein, 9 aa, Mycobacterium
GPGEAPKLI

SEQ ID NO: 398270 - protein, 5 aa, Mycobacterium
GPGGL

SEQ ID NO: 398271 - protein, 11 aa, Mycobacterium
GPGGMTEQDDM

SEQ ID NO: 398272 - protein, 8 aa, Mycobacterium
GPGHGGPG

SEQ ID NO: 398273 - protein, 4 aa, Mycobacterium
GPGN

SEQ ID NO: 398274 - protein, 5 aa, Mycobacterium
GPGNI

SEQ ID NO: 398275 - protein, 4 aa, Mycobacterium
GPGP

SEQ ID NO: 398276 - protein, 11 aa, Mycobacterium
GPGPVDVAEGD

SEQ ID NO: 398277 - protein, 4 aa, Mycobacterium
GPGR

SEQ ID NO: 398278 - protein, 17 aa, Mycobacterium
GPGREQTIVRRDVLAAR

SEQ ID NO: 398279 - protein, 4 aa, Mycobacterium
GPGS

SEQ ID NO: 398280 - protein, 7 aa, Mycobacterium
GPGSPSV

SEQ ID NO: 398281 - protein, 4 aa, Mycobacterium
GPGT

SEQ ID NO: 398282 - protein, 5 aa, Mycobacterium
GPGTD

SEQ ID NO: 398283 - protein, 11 aa, Mycobacterium
GPGTRMRSDTP

SEQ ID NO: 398284 - protein, 5 aa, Mycobacterium
GPGVE

SEQ ID NO: 398285 - protein, 4 aa, Mycobacterium
GPGW

SEQ ID NO: 398286 - protein, 5 aa, Mycobacterium
GPGWP

SEQ ID NO: 398287 - protein, 11 aa, Mycobacterium
GPHGADPHHEC

SEQ ID NO: 398288 - protein, 5 aa, Mycobacterium
GPHGI

SEQ ID NO: 398289 - protein, 5 aa, Mycobacterium
GPHGP

SEQ ID NO: 398290 - protein, 4 aa, Mycobacterium
GPIA

SEQ ID NO: 398291 - protein, 4 aa, Mycobacterium
GPIE

SEQ ID NO: 398292 - protein, 7 aa, Mycobacterium
GPITSAA

SEQ ID NO: 398293 - protein, 9 aa, Mycobacterium
GPKALQDNG

SEQ ID NO: 398294 - protein, 5 aa, Mycobacterium
GPKFS

SEQ ID NO: 398295 - protein, 4 aa, Mycobacterium
GPKG

SEQ ID NO: 398296 - protein, 5 aa, Mycobacterium
GPKGV

SEQ ID NO: 398297 - protein, 8 aa, Mycobacterium
GPKQTGLG

SEQ ID NO: 398298 - protein, 7 aa, Mycobacterium
GPKTAKK

SEQ ID NO: 398299 - protein, 6 aa, Mycobacterium
GPKTIR

SEQ ID NO: 398300 - protein, 7 aa, Mycobacterium
GPKTTKK

SEQ ID NO: 398301 - protein, 4 aa, Mycobacterium
GPLE

SEQ ID NO: 398302 - protein, 5 aa, Mycobacterium
GPLGG

SEQ ID NO: 398303 - protein, 7 aa, Mycobacterium
GPLKAPK

SEQ ID NO: 398304 - protein, 5 aa, Mycobacterium
GPLTG

SEQ ID NO: 398305 - protein, 4 aa, Mycobacterium
GPMG

SEQ ID NO: 398306 - protein, 7 aa, Mycobacterium
GPMGGTD

SEQ ID NO: 398307 - protein, 8 aa, Mycobacterium
GPNGAGKT

SEQ ID NO: 398308 - protein, 9 aa, Mycobacterium
GPNGSGKTT

SEQ ID NO: 398309 - protein, 8 aa, Mycobacterium
GPNGVGKT

SEQ ID NO: 398310 - protein, 9 aa, Mycobacterium
GPNRPGPKG

SEQ ID NO: 398311 - protein, 5 aa, Mycobacterium
GPNRY

SEQ ID NO: 398312 - protein, 4 aa, Mycobacterium
GPNV

SEQ ID NO: 398313 - protein, 5 aa, Mycobacterium
GPPDG

SEQ ID NO: 398314 - protein, 7 aa, Mycobacterium
GPPEAPD

SEQ ID NO: 398315 - protein, 7 aa, Mycobacterium
GPPEEFA

SEQ ID NO: 398316 - protein, 15 aa, Mycobacterium
GPPGAADAGLGEDDT

SEQ ID NO: 398317 - protein, 6 aa, Mycobacterium
GPPGIG

SEQ ID NO: 398318 - protein, 8 aa, Mycobacterium
GPPGIGKT

SEQ ID NO: 398319 - protein, 8 aa, Mycobacterium
GPPGRRTD

SEQ ID NO: 398320 - protein, 8 aa, Mycobacterium
GPPGTGKT

SEQ ID NO: 398321 - protein, 11 aa, Mycobacterium
GPPGTGKTSVA

SEQ ID NO: 398322 - protein, 12 aa, Mycobacterium
GPPGTGKTSVAR

SEQ ID NO: 398323 - protein, 7 aa, Mycobacterium
GPPGVGK

SEQ ID NO: 398324 - protein, 4 aa, Mycobacterium
GPPI

SEQ ID NO: 398325 - protein, 9 aa, Mycobacterium
GPPKSSRAL

SEQ ID NO: 398326 - protein, 4 aa, Mycobacterium
GPPM

SEQ ID NO: 398327 - protein, 9 aa, Mycobacterium
GPPNQPDTS

SEQ ID NO: 398328 - protein, 4 aa, Mycobacterium
GPPP

SEQ ID NO: 398329 - protein, 5 aa, Mycobacterium
GPPRH

SEQ ID NO: 398330 - protein, 8 aa, Mycobacterium
GPPSHPAT

SEQ ID NO: 398331 - protein, 5 aa, Mycobacterium
GPPSY

SEQ ID NO: 398332 - protein, 5 aa, Mycobacterium
GPPTC

SEQ ID NO: 398333 - protein, 4 aa, Mycobacterium
GPQA

SEQ ID NO: 398334 - protein, 5 aa, Mycobacterium
GPQGW

SEQ ID NO: 398335 - protein, 4 aa, Mycobacterium
GPQH

SEQ ID NO: 398336 - protein, 4 aa, Mycobacterium
GPQL

SEQ ID NO: 398337 - protein, 11 aa, Mycobacterium
GPQNGPGDPGI

SEQ ID NO: 398338 - protein, 5 aa, Mycobacterium
GPQTY

SEQ ID NO: 398339 - protein, 4 aa, Mycobacterium
GPQW

SEQ ID NO: 398340 - protein, 5 aa, Mycobacterium
GPRFA

SEQ ID NO: 398341 - protein, 11 aa, Mycobacterium
GPRHNAPATPG

SEQ ID NO: 398342 - protein, 17 aa, Mycobacterium
GPRHTRGTPPNVVETDP

SEQ ID NO: 398343 - protein, 9 aa, Mycobacterium
GPRNPYPGR

SEQ ID NO: 398344 - protein, 7 aa, Mycobacterium
GPRPPRV

SEQ ID NO: 398345 - protein, 4 aa, Mycobacterium
GPRR

SEQ ID NO: 398346 - protein, 5 aa, Mycobacterium
GPRSD

SEQ ID NO: 398347 - protein, 12 aa, Mycobacterium
GPRTYSDRRGHP

SEQ ID NO: 398348 - protein, 12 aa, Mycobacterium
GPRTYSEQRGHP

SEQ ID NO: 398349 - protein, 8 aa, Mycobacterium
GPSATSDI

SEQ ID NO: 398350 - protein, 4 aa, Mycobacterium
GPSE

SEQ ID NO: 398351 - protein, 8 aa, Mycobacterium
GPSETVDA

SEQ ID NO: 398352 - protein, 4 aa, Mycobacterium
GPSG

SEQ ID NO: 398353 - protein, 11 aa, Mycobacterium
GPSGVGKTELS

SEQ ID NO: 398354 - protein, 13 aa, Mycobacterium
GPSITPRPPQGQP

SEQ ID NO: 398355 - protein, 9 aa, Mycobacterium
GPSKGGGYW

SEQ ID NO: 398356 - protein, 8 aa, Mycobacterium
GPSPLRAG

SEQ ID NO: 398357 - protein, 7 aa, Mycobacterium
GPSRAGV

SEQ ID NO: 398358 - protein, 10 aa, Mycobacterium
GPSSSHTVGP

SEQ ID NO: 398359 - protein, 4 aa, Mycobacterium
GPSV

SEQ ID NO: 398360 - protein, 5 aa, Mycobacterium
GPTAA

SEQ ID NO: 398361 - protein, 8 aa, Mycobacterium
GPTDIAGA

SEQ ID NO: 398362 - protein, 5 aa, Mycobacterium
GPTEA

SEQ ID NO: 398363 - protein, 5 aa, Mycobacterium
GPTEP

SEQ ID NO: 398364 - protein, 9 aa, Mycobacterium
GPTEPTPRR

SEQ ID NO: 398365 - protein, 5 aa, Mycobacterium
GPTER

SEQ ID NO: 398366 - protein, 11 aa, Mycobacterium
GPTGGYVAPGG

SEQ ID NO: 398367 - protein, 17 aa, Mycobacterium
GPTGVIGTNKKDSQDTV

SEQ ID NO: 398368 - protein, 6 aa, Mycobacterium
GPTHPS

SEQ ID NO: 398369 - protein, 5 aa, Mycobacterium
GPTLD

SEQ ID NO: 398370 - protein, 9 aa, Mycobacterium
GPTLPDGLR

SEQ ID NO: 398371 - protein, 8 aa, Mycobacterium
GPTPATKK

SEQ ID NO: 398372 - protein, 6 aa, Mycobacterium
GPTPDA

SEQ ID NO: 398373 - protein, 14 aa, Mycobacterium
GPTPDGTQETQDRH

SEQ ID NO: 398374 - protein, 6 aa, Mycobacterium
GPTPSE

SEQ ID NO: 398375 - protein, 5 aa, Mycobacterium
GPTQA

SEQ ID NO: 398376 - protein, 5 aa, Mycobacterium
GPTRQ

SEQ ID NO: 398377 - protein, 6 aa, Mycobacterium
GPTTFA

SEQ ID NO: 398378 - protein, 7 aa, Mycobacterium
GPTTGDR

SEQ ID NO: 398379 - protein, 4 aa, Mycobacterium
GPTV

SEQ ID NO: 398380 - protein, 5 aa, Mycobacterium
GPTVR

SEQ ID NO: 398381 - protein, 4 aa, Mycobacterium
GPTY

SEQ ID NO: 398382 - protein, 4 aa, Mycobacterium
GPVE

SEQ ID NO: 398383 - protein, 4 aa, Mycobacterium
GPVG

SEQ ID NO: 398384 - protein, 8 aa, Mycobacterium
GPVGSGKT

SEQ ID NO: 398385 - protein, 7 aa, Mycobacterium
GPVQSTA

SEQ ID NO: 398386 - protein, 6 aa, Mycobacterium
GPVRTG

SEQ ID NO: 398387 - protein, 4 aa, Mycobacterium
GPVT

SEQ ID NO: 398388 - protein, 6 aa, Mycobacterium
GPVTAD

SEQ ID NO: 398389 - protein, 9 aa, Mycobacterium
GPVTPDPAR

SEQ ID NO: 398390 - protein, 4 aa, Mycobacterium
GPVV

SEQ ID NO: 398391 - protein, 4 aa, Mycobacterium
GPWV

SEQ ID NO: 398392 - protein, 5 aa, Mycobacterium
GPYGP

SEQ ID NO: 398393 - protein, 12 aa, Mycobacterium
GQAAYSSSKGGV

SEQ ID NO: 398394 - protein, 9 aa, Mycobacterium
GQANYGAAK

SEQ ID NO: 398395 - protein, 4 aa, Mycobacterium
GQAP

SEQ ID NO: 398396 - protein, 9 aa, Mycobacterium
GQAPSDYPD

SEQ ID NO: 398397 - protein, 4 aa, Mycobacterium
GQAR

SEQ ID NO: 398398 - protein, 5 aa, Mycobacterium
GQART

SEQ ID NO: 398399 - protein, 4 aa, Mycobacterium
GQDC

SEQ ID NO: 398400 - protein, 9 aa, Mycobacterium
GQDGSYSED

SEQ ID NO: 398401 - protein, 5 aa, Mycobacterium
GQDLS

SEQ ID NO: 398402 - protein, 5 aa, Mycobacterium
GQEDL

SEQ ID NO: 398403 - protein, 5 aa, Mycobacterium
GQEES

SEQ ID NO: 398404 - protein, 4 aa, Mycobacterium
GQEF

SEQ ID NO: 398405 - protein, 6 aa, Mycobacterium
GQEGYR

SEQ ID NO: 398406 - protein, 7 aa, Mycobacterium
GQENQGW

SEQ ID NO: 398407 - protein, 7 aa, Mycobacterium
GQETTTK

SEQ ID NO: 398408 - protein, 4 aa, Mycobacterium
GQGD

SEQ ID NO: 398409 - protein, 6 aa, Mycobacterium
GQGGED

SEQ ID NO: 398410 - protein, 5 aa, Mycobacterium
GQGPQ

SEQ ID NO: 398411 - protein, 4 aa, Mycobacterium
GQGS

SEQ ID NO: 398412 - protein, 7 aa, Mycobacterium
GQHGQDT

SEQ ID NO: 398413 - protein, 15 aa, Mycobacterium
GQIGPESAKPGYGRV

SEQ ID NO: 398414 - protein, 4 aa, Mycobacterium
GQIP

SEQ ID NO: 398415 - protein, 4 aa, Mycobacterium
GQIR

SEQ ID NO: 398416 - protein, 4 aa, Mycobacterium
GQKV

SEQ ID NO: 398417 - protein, 10 aa, Mycobacterium
GQLAKADGAR

SEQ ID NO: 398418 - protein, 4 aa, Mycobacterium
GQLG

SEQ ID NO: 398419 - protein, 10 aa, Mycobacterium
GQLGGADNAT

SEQ ID NO: 398420 - protein, 8 aa, Mycobacterium
GQLSNNRR

SEQ ID NO: 398421 - protein, 14 aa, Mycobacterium
GQNTPAIAATEAQY

SEQ ID NO: 398422 - protein, 6 aa, Mycobacterium
GQPAPD

SEQ ID NO: 398423 - protein, 4 aa, Mycobacterium
GQPE

SEQ ID NO: 398424 - protein, 9 aa, Mycobacterium
GQPGGEAGF

SEQ ID NO: 398425 - protein, 15 aa, Mycobacterium
GQPIDGRGDIEAETR

SEQ ID NO: 398426 - protein, 7 aa, Mycobacterium
GQPLPST

SEQ ID NO: 398427 - protein, 6 aa, Mycobacterium
GQPLTP

SEQ ID NO: 398428 - protein, 17 aa, Mycobacterium
GQPTAENTRECGADGDL

SEQ ID NO: 398429 - protein, 5 aa, Mycobacterium
GQPTF

SEQ ID NO: 398430 - protein, 11 aa, Mycobacterium
GQPVDDPEIPA

SEQ ID NO: 398431 - protein, 5 aa, Mycobacterium
GQPVH

SEQ ID NO: 398432 - protein, 6 aa, Mycobacterium
GQPYPD

SEQ ID NO: 398433 - protein, 5 aa, Mycobacterium
GQQAM

SEQ ID NO: 398434 - protein, 10 aa, Mycobacterium
GQQGDGSAKL

SEQ ID NO: 398435 - protein, 7 aa, Mycobacterium
GQQITEG

SEQ ID NO: 398436 - protein, 10 aa, Mycobacterium
GQREPDGAGF

SEQ ID NO: 398437 - protein, 8 aa, Mycobacterium
GQRESMGN

SEQ ID NO: 398438 - protein, 4 aa, Mycobacterium
GQRF

SEQ ID NO: 398439 - protein, 6 aa, Mycobacterium
GQRKPL

SEQ ID NO: 398440 - protein, 6 aa, Mycobacterium
GQRSGV

SEQ ID NO: 398441 - protein, 6 aa, Mycobacterium
GQSGYF

SEQ ID NO: 398442 - protein, 14 aa, Mycobacterium
GQSPKGPQATGVRA

SEQ ID NO: 398443 - protein, 10 aa, Mycobacterium
GQSRRAARKA

SEQ ID NO: 398444 - protein, 8 aa, Mycobacterium
GQSSGGKF

SEQ ID NO: 398445 - protein, 5 aa, Mycobacterium
GQTAK

SEQ ID NO: 398446 - protein, 4 aa, Mycobacterium
GQTL

SEQ ID NO: 398447 - protein, 6 aa, Mycobacterium
GQTLEP

SEQ ID NO: 398448 - protein, 7 aa, Mycobacterium
GQTLEPD

SEQ ID NO: 398449 - protein, 8 aa, Mycobacterium
GQTPGTRM

SEQ ID NO: 398450 - protein, 5 aa, Mycobacterium
GQTPL

SEQ ID NO: 398451 - protein, 8 aa, Mycobacterium
GQTPSTGE

SEQ ID NO: 398452 - protein, 10 aa, Mycobacterium
GQTPSTKSAK

SEQ ID NO: 398453 - protein, 7 aa, Mycobacterium
GQTQGYR

SEQ ID NO: 398454 - protein, 7 aa, Mycobacterium
GQTRGYR

SEQ ID NO: 398455 - protein, 7 aa, Mycobacterium
GQTVPAG

SEQ ID NO: 398456 - protein, 8 aa, Mycobacterium
GQVDDDED

SEQ ID NO: 398457 - protein, 7 aa, Mycobacterium
GRAAAAA

SEQ ID NO: 398458 - protein, 4 aa, Mycobacterium
GRAD

SEQ ID NO: 398459 - protein, 5 aa, Mycobacterium
GRADA

SEQ ID NO: 398460 - protein, 5 aa, Mycobacterium
GRADT

SEQ ID NO: 398461 - protein, 4 aa, Mycobacterium
GRAE

SEQ ID NO: 398462 - protein, 8 aa, Mycobacterium
GRAEADDT

SEQ ID NO: 398463 - protein, 9 aa, Mycobacterium
GRAFSGGYD

SEQ ID NO: 398464 - protein, 9 aa, Mycobacterium
GRAGHQVGE

SEQ ID NO: 398465 - protein, 9 aa, Mycobacterium
GRAGSNTAA

SEQ ID NO: 398466 - protein, 10 aa, Mycobacterium
GRAKRTAPPL

SEQ ID NO: 398467 - protein, 12 aa, Mycobacterium
GRAPESAAGPDL

SEQ ID NO: 398468 - protein, 11 aa, Mycobacterium
GRAPGSDPVTS

SEQ ID NO: 398469 - protein, 9 aa, Mycobacterium
GRAPSRDTY

SEQ ID NO: 398470 - protein, 4 aa, Mycobacterium
GRAR

SEQ ID NO: 398471 - protein, 4 aa, Mycobacterium
GRAS

SEQ ID NO: 398472 - protein, 5 aa, Mycobacterium
GRASV

SEQ ID NO: 398473 - protein, 12 aa, Mycobacterium
GRAYGGAGGTIG

SEQ ID NO: 398474 - protein, 12 aa, Mycobacterium
GRCEACSGDGTI

SEQ ID NO: 398475 - protein, 4 aa, Mycobacterium
GRDA

SEQ ID NO: 398476 - protein, 9 aa, Mycobacterium
GRDADPARA

SEQ ID NO: 398477 - protein, 5 aa, Mycobacterium
GRDAL

SEQ ID NO: 398478 - protein, 7 aa, Mycobacterium
GRDDGGL

SEQ ID NO: 398479 - protein, 6 aa, Mycobacterium
GRDDPA

SEQ ID NO: 398480 - protein, 5 aa, Mycobacterium
GRDEA

SEQ ID NO: 398481 - protein, 11 aa, Mycobacterium
GRDEATETARR

SEQ ID NO: 398482 - protein, 19 aa, Mycobacterium
GRDGAAQLDAGQAFSDAGL

SEQ ID NO: 398483 - protein, 5 aa, Mycobacterium
GRDNP

SEQ ID NO: 398484 - protein, 7 aa, Mycobacterium
GRDPNKH

SEQ ID NO: 398485 - protein, 5 aa, Mycobacterium
GRDPY

SEQ ID NO: 398486 - protein, 14 aa, Mycobacterium
GRDQVSPQAGRDAA

SEQ ID NO: 398487 - protein, 5 aa, Mycobacterium
GRDRG

SEQ ID NO: 398488 - protein, 5 aa, Mycobacterium
GRDRT

SEQ ID NO: 398489 - protein, 4 aa, Mycobacterium
GRDT

SEQ ID NO: 398490 - protein, 6 aa, Mycobacterium
GRDTPA

SEQ ID NO: 398491 - protein, 5 aa, Mycobacterium
GRDVT

SEQ ID NO: 398492 - protein, 6 aa, Mycobacterium
GRDYPD

SEQ ID NO: 398493 - protein, 17 aa, Mycobacterium
GREATDEELAAESGIPV

SEQ ID NO: 398494 - protein, 6 aa, Mycobacterium
GREDAR

SEQ ID NO: 398495 - protein, 4 aa, Mycobacterium
GREP

SEQ ID NO: 398496 - protein, 5 aa, Mycobacterium
GREPE

SEQ ID NO: 398497 - protein, 9 aa, Mycobacterium
GRERATDEL

SEQ ID NO: 398498 - protein, 9 aa, Mycobacterium
GRETQPHIP

SEQ ID NO: 398499 - protein, 7 aa, Mycobacterium
GRFATSD

SEQ ID NO: 398500 - protein, 5 aa, Mycobacterium
GRFGP

SEQ ID NO: 398501 - protein, 22 aa, Mycobacterium
GRGAQEGRTALSAPGGGTRVGE

SEQ ID NO: 398502 - protein, 4 aa, Mycobacterium
GRGD

SEQ ID NO: 398503 - protein, 6 aa, Mycobacterium
GRGDLT

SEQ ID NO: 398504 - protein, 8 aa, Mycobacterium
GRGGASPH

SEQ ID NO: 398505 - protein, 7 aa, Mycobacterium
GRGGQVD

SEQ ID NO: 398506 - protein, 6 aa, Mycobacterium
GRGGRN

SEQ ID NO: 398507 - protein, 4 aa, Mycobacterium
GRGH

SEQ ID NO: 398508 - protein, 11 aa, Mycobacterium
GRGKDESDAVN

SEQ ID NO: 398509 - protein, 7 aa, Mycobacterium
GRGNPDG

SEQ ID NO: 398510 - protein, 4 aa, Mycobacterium
GRGR

SEQ ID NO: 398511 - protein, 7 aa, Mycobacterium
GRGSGEA

SEQ ID NO: 398512 - protein, 8 aa, Mycobacterium
GRGTETPE

SEQ ID NO: 398513 - protein, 6 aa, Mycobacterium
GRHRGG

SEQ ID NO: 398514 - protein, 5 aa, Mycobacterium
GRIAG

SEQ ID NO: 398515 - protein, 4 aa, Mycobacterium
GRID

SEQ ID NO: 398516 - protein, 15 aa, Mycobacterium
GRIDPAKRRRRRSDY

SEQ ID NO: 398517 - protein, 8 aa, Mycobacterium
GRIEPAPR

SEQ ID NO: 398518 - protein, 6 aa, Mycobacterium
GRIPAD

SEQ ID NO: 398519 - protein, 5 aa, Mycobacterium
GRKAP

SEQ ID NO: 398520 - protein, 9 aa, Mycobacterium
GRKDGLSRV

SEQ ID NO: 398521 - protein, 7 aa, Mycobacterium
GRKGGLI

SEQ ID NO: 398522 - protein, 6 aa, Mycobacterium
GRKPEH

SEQ ID NO: 398523 - protein, 6 aa, Mycobacterium
GRKPSR

SEQ ID NO: 398524 - protein, 4 aa, Mycobacterium
GRKR

SEQ ID NO: 398525 - protein, 5 aa, Mycobacterium
GRKSA

SEQ ID NO: 398526 - protein, 13 aa, Mycobacterium
GRKTGQPRSTPMT

SEQ ID NO: 398527 - protein, 7 aa, Mycobacterium
GRLGSDP

SEQ ID NO: 398528 - protein, 4 aa, Mycobacterium
GRLP

SEQ ID NO: 398529 - protein, 4 aa, Mycobacterium
GRLQ

SEQ ID NO: 398530 - protein, 5 aa, Mycobacterium
GRLQP

SEQ ID NO: 398531 - protein, 5 aa, Mycobacterium
GRLRP

SEQ ID NO: 398532 - protein, 6 aa, Mycobacterium
GRLSGT

SEQ ID NO: 398533 - protein, 6 aa, Mycobacterium
GRLSRQ

SEQ ID NO: 398534 - protein, 11 aa, Mycobacterium
GRLTDGQGRTV

SEQ ID NO: 398535 - protein, 5 aa, Mycobacterium
GRMTS

SEQ ID NO: 398536 - protein, 4 aa, Mycobacterium
GRNG

SEQ ID NO: 398537 - protein, 7 aa, Mycobacterium
GRNPTGV

SEQ ID NO: 398538 - protein, 9 aa, Mycobacterium
GRNQRRSAA

SEQ ID NO: 398539 - protein, 4 aa, Mycobacterium
GRNV

SEQ ID NO: 398540 - protein, 6 aa, Mycobacterium
GRPAHT

SEQ ID NO: 398541 - protein, 5 aa, Mycobacterium
GRPAL

SEQ ID NO: 398542 - protein, 14 aa, Mycobacterium
GRPATRKRWPNGVE

SEQ ID NO: 398543 - protein, 7 aa, Mycobacterium
GRPDPAL

SEQ ID NO: 398544 - protein, 14 aa, Mycobacterium
GRPDPVRDARAEYH

SEQ ID NO: 398545 - protein, 4 aa, Mycobacterium
GRPE

SEQ ID NO: 398546 - protein, 5 aa, Mycobacterium
GRPEA

SEQ ID NO: 398547 - protein, 6 aa, Mycobacterium
GRPGLT

SEQ ID NO: 398548 - protein, 4 aa, Mycobacterium
GRPH

SEQ ID NO: 398549 - protein, 6 aa, Mycobacterium
GRPHGL

SEQ ID NO: 398550 - protein, 5 aa, Mycobacterium
GRPIS

SEQ ID NO: 398551 - protein, 4 aa, Mycobacterium
GRPP

SEQ ID NO: 398552 - protein, 6 aa, Mycobacterium
GRPPFG

SEQ ID NO: 398553 - protein, 7 aa, Mycobacterium
GRPSDRL

SEQ ID NO: 398554 - protein, 7 aa, Mycobacterium
GRPSELA

SEQ ID NO: 398555 - protein, 4 aa, Mycobacterium
GRPT

SEQ ID NO: 398556 - protein, 6 aa, Mycobacterium
GRPVSS

SEQ ID NO: 398557 - protein, 17 aa, Mycobacterium
GRPYEDVEKELALAFSR

SEQ ID NO: 398558 - protein, 8 aa, Mycobacterium
GRQGEALG

SEQ ID NO: 398559 - protein, 4 aa, Mycobacterium
GRRD

SEQ ID NO: 398560 - protein, 6 aa, Mycobacterium
GRREPI

SEQ ID NO: 398561 - protein, 6 aa, Mycobacterium
GRREPL

SEQ ID NO: 398562 - protein, 9 aa, Mycobacterium
GRRGGRTVR

SEQ ID NO: 398563 - protein, 15 aa, Mycobacterium
GRRGPDRDRPAYDDT

SEQ ID NO: 398564 - protein, 8 aa, Mycobacterium
GRRGSSVS

SEQ ID NO: 398565 - protein, 12 aa, Mycobacterium
GRRKPRSTEHPA

SEQ ID NO: 398566 - protein, 5 aa, Mycobacterium
GRRSG

SEQ ID NO: 398567 - protein, 11 aa, Mycobacterium
GRRSGKPYRTP

SEQ ID NO: 398568 - protein, 6 aa, Mycobacterium
GRSAAH

SEQ ID NO: 398569 - protein, 5 aa, Mycobacterium
GRSAD

SEQ ID NO: 398570 - protein, 5 aa, Mycobacterium
GRSAE

SEQ ID NO: 398571 - protein, 12 aa, Mycobacterium
GRSAHDAATPQF

SEQ ID NO: 398572 - protein, 4 aa, Mycobacterium
GRSC

SEQ ID NO: 398573 - protein, 12 aa, Mycobacterium
GRSGAADRRSHT

SEQ ID NO: 398574 - protein, 5 aa, Mycobacterium
GRSGD

SEQ ID NO: 398575 - protein, 7 aa, Mycobacterium
GRSNAGI

SEQ ID NO: 398576 - protein, 6 aa, Mycobacterium
GRSNEH

SEQ ID NO: 398577 - protein, 6 aa, Mycobacterium
GRSSEH

SEQ ID NO: 398578 - protein, 4 aa, Mycobacterium
GRST

SEQ ID NO: 398579 - protein, 9 aa, Mycobacterium
GRSTVEDAT

SEQ ID NO: 398580 - protein, 4 aa, Mycobacterium
GRTA

SEQ ID NO: 398581 - protein, 13 aa, Mycobacterium
GRTAEALNAQAER

SEQ ID NO: 398582 - protein, 4 aa, Mycobacterium
GRTE

SEQ ID NO: 398583 - protein, 4 aa, Mycobacterium
GRTL

SEQ ID NO: 398584 - protein, 5 aa, Mycobacterium
GRTLT

SEQ ID NO: 398585 - protein, 10 aa, Mycobacterium
GRTNYRNPET

SEQ ID NO: 398586 - protein, 5 aa, Mycobacterium
GRTPE

SEQ ID NO: 398587 - protein, 7 aa, Mycobacterium
GRTPNGI

SEQ ID NO: 398588 - protein, 7 aa, Mycobacterium
GRTPNGV

SEQ ID NO: 398589 - protein, 8 aa, Mycobacterium
GRTPVTGA

SEQ ID NO: 398590 - protein, 4 aa, Mycobacterium
GRTR

SEQ ID NO: 398591 - protein, 9 aa, Mycobacterium
GRTSRSELE

SEQ ID NO: 398592 - protein, 4 aa, Mycobacterium
GRTT

SEQ ID NO: 398593 - protein, 7 aa, Mycobacterium
GRTTYTS

SEQ ID NO: 398594 - protein, 5 aa, Mycobacterium
GRVAG

SEQ ID NO: 398595 - protein, 4 aa, Mycobacterium
GRVG

SEQ ID NO: 398596 - protein, 7 aa, Mycobacterium
GRVPNGD

SEQ ID NO: 398597 - protein, 11 aa, Mycobacterium
GRVSDSGEGRW

SEQ ID NO: 398598 - protein, 17 aa, Mycobacterium
GRWATQRGLGRTEGHKM

SEQ ID NO: 398599 - protein, 4 aa, Mycobacterium
GRWP

SEQ ID NO: 398600 - protein, 4 aa, Mycobacterium
GRYA

SEQ ID NO: 398601 - protein, 4 aa, Mycobacterium
GRYD

SEQ ID NO: 398602 - protein, 4 aa, Mycobacterium
GRYI

SEQ ID NO: 398603 - protein, 13 aa, Mycobacterium
GRYNAARKHRSPG

SEQ ID NO: 398604 - protein, 5 aa, Mycobacterium
GRYQP

SEQ ID NO: 398605 - protein, 4 aa, Mycobacterium
GRYR

SEQ ID NO: 398606 - protein, 4 aa, Mycobacterium
GRYT

SEQ ID NO: 398607 - protein, 4 aa, Mycobacterium
GSAA

SEQ ID NO: 398608 - protein, 12 aa, Mycobacterium
GSAAGNSPIPYN

SEQ ID NO: 398609 - protein, 5 aa, Mycobacterium
GSAAV

SEQ ID NO: 398610 - protein, 4 aa, Mycobacterium
GSAD

SEQ ID NO: 398611 - protein, 9 aa, Mycobacterium
GSADSTLEQ

SEQ ID NO: 398612 - protein, 9 aa, Mycobacterium
GSAEPAANR

SEQ ID NO: 398613 - protein, 20 aa, Mycobacterium
GSAGATAAQARRSRGDRQRE

SEQ ID NO: 398614 - protein, 5 aa, Mycobacterium
GSAIG

SEQ ID NO: 398615 - protein, 4 aa, Mycobacterium
GSAM

SEQ ID NO: 398616 - protein, 30 aa, Mycobacterium
GSANVGDANLGSANVGSANVGGGNVGDGNV

SEQ ID NO: 398617 - protein, 11 aa, Mycobacterium
GSAPGSELGAD

SEQ ID NO: 398618 - protein, 9 aa, Mycobacterium
GSAPTSPEL

SEQ ID NO: 398619 - protein, 6 aa, Mycobacterium
GSAQQA

SEQ ID NO: 398620 - protein, 9 aa, Mycobacterium
GSASAPAVR

SEQ ID NO: 398621 - protein, 4 aa, Mycobacterium
GSAT

SEQ ID NO: 398622 - protein, 5 aa, Mycobacterium
GSATG

SEQ ID NO: 398623 - protein, 4 aa, Mycobacterium
GSCN

SEQ ID NO: 398624 - protein, 8 aa, Mycobacterium
GSDANPLA

SEQ ID NO: 398625 - protein, 8 aa, Mycobacterium
GSDAPSAL

SEQ ID NO: 398626 - protein, 5 aa, Mycobacterium
GSDAQ

SEQ ID NO: 398627 - protein, 10 aa, Mycobacterium
GSDEGGHDAV

SEQ ID NO: 398628 - protein, 4 aa, Mycobacterium
GSDT

SEQ ID NO: 398629 - protein, 8 aa, Mycobacterium
GSDTAARA

SEQ ID NO: 398630 - protein, 9 aa, Mycobacterium
GSDTGGSIR

SEQ ID NO: 398631 - protein, 8 aa, Mycobacterium
GSDTTKNA

SEQ ID NO: 398632 - protein, 5 aa, Mycobacterium
GSDYP

SEQ ID NO: 398633 - protein, 5 aa, Mycobacterium
GSEAD

SEQ ID NO: 398634 - protein, 6 aa, Mycobacterium
GSEAND

SEQ ID NO: 398635 - protein, 8 aa, Mycobacterium
GSEANYTY

SEQ ID NO: 398636 - protein, 8 aa, Mycobacterium
GSEEQKNE

SEQ ID NO: 398637 - protein, 8 aa, Mycobacterium
GSEPDIDA

SEQ ID NO: 398638 - protein, 6 aa, Mycobacterium
GSETVS

SEQ ID NO: 398639 - protein, 7 aa, Mycobacterium
GSEVSGQ

SEQ ID NO: 398640 - protein, 6 aa, Mycobacterium
GSEVTN

SEQ ID NO: 398641 - protein, 4 aa, Mycobacterium
GSFA

SEQ ID NO: 398642 - protein, 6 aa, Mycobacterium
GSFAPT

SEQ ID NO: 398643 - protein, 7 aa, Mycobacterium
GSFGSGK

SEQ ID NO: 398644 - protein, 4 aa, Mycobacterium
GSFT

SEQ ID NO: 398645 - protein, 8 aa, Mycobacterium
GSGAGLPG

SEQ ID NO: 398646 - protein, 5 aa, Mycobacterium
GSGAM

SEQ ID NO: 398647 - protein, 10 aa, Mycobacterium
GSGDPSEPRK

SEQ ID NO: 398648 - protein, 6 aa, Mycobacterium
GSGDPV

SEQ ID NO: 398649 - protein, 9 aa, Mycobacterium
GSGDSAVPR

SEQ ID NO: 398650 - protein, 12 aa, Mycobacterium
GSGDWDQTKDDV

SEQ ID NO: 398651 - protein, 9 aa, Mycobacterium
GSGEKKTIP

SEQ ID NO: 398652 - protein, 8 aa, Mycobacterium
GSGETVAD

SEQ ID NO: 398653 - protein, 6 aa, Mycobacterium
GSGGEF

SEQ ID NO: 398654 - protein, 5 aa, Mycobacterium
GSGGG

SEQ ID NO: 398655 - protein, 16 aa, Mycobacterium
GSGGGGVTGAYTAARE

SEQ ID NO: 398656 - protein, 9 aa, Mycobacterium
GSGGGIGQA

SEQ ID NO: 398657 - protein, 9 aa, Mycobacterium
GSGGTAPAA

SEQ ID NO: 398658 - protein, 9 aa, Mycobacterium
GSGGYGDSK

SEQ ID NO: 398659 - protein, 5 aa, Mycobacterium
GSGIG

SEQ ID NO: 398660 - protein, 4 aa, Mycobacterium
GSGK

SEQ ID NO: 398661 - protein, 4 aa, Mycobacterium
GSGN

SEQ ID NO: 398662 - protein, 6 aa, Mycobacterium
GSGNVG

SEQ ID NO: 398663 - protein, 5 aa, Mycobacterium
GSGPM

SEQ ID NO: 398664 - protein, 5 aa, Mycobacterium
GSGPP

SEQ ID NO: 398665 - protein, 5 aa, Mycobacterium
GSGPR

SEQ ID NO: 398666 - protein, 9 aa, Mycobacterium
GSGRRRGKL

SEQ ID NO: 398667 - protein, 6 aa, Mycobacterium
GSGRTE

SEQ ID NO: 398668 - protein, 5 aa, Mycobacterium
GSGSA

SEQ ID NO: 398669 - protein, 16 aa, Mycobacterium
GSGSASRATAYICRPS

SEQ ID NO: 398670 - protein, 9 aa, Mycobacterium
GSGSLKSEI

SEQ ID NO: 398671 - protein, 11 aa, Mycobacterium
GSGSLKSEIED

SEQ ID NO: 398672 - protein, 9 aa, Mycobacterium
GSGSRPGHP

SEQ ID NO: 398673 - protein, 16 aa, Mycobacterium
GSGTGTGGEPKWGGYA

SEQ ID NO: 398674 - protein, 7 aa, Mycobacterium
GSGTSTL

SEQ ID NO: 398675 - protein, 7 aa, Mycobacterium
GSGTYAD

SEQ ID NO: 398676 - protein, 7 aa, Mycobacterium
GSGVPHP

SEQ ID NO: 398677 - protein, 16 aa, Mycobacterium
GSGWSGQAQATSYDTM

SEQ ID NO: 398678 - protein, 8 aa, Mycobacterium
GSGYGGNA

SEQ ID NO: 398679 - protein, 5 aa, Mycobacterium
GSHPA

SEQ ID NO: 398680 - protein, 5 aa, Mycobacterium
GSHQG

SEQ ID NO: 398681 - protein, 12 aa, Mycobacterium
GSIDGARSASAT

SEQ ID NO: 398682 - protein, 6 aa, Mycobacterium
GSIPVE

SEQ ID NO: 398683 - protein, 4 aa, Mycobacterium
GSKI

SEQ ID NO: 398684 - protein, 6 aa, Mycobacterium
GSKIES

SEQ ID NO: 398685 - protein, 6 aa, Mycobacterium
GSKVSD

SEQ ID NO: 398686 - protein, 11 aa, Mycobacterium
GSLAAGPALSA

SEQ ID NO: 398687 - protein, 5 aa, Mycobacterium
GSLDP

SEQ ID NO: 398688 - protein, 8 aa, Mycobacterium
GSLDRPAL

SEQ ID NO: 398689 - protein, 6 aa, Mycobacterium
GSLKSS

SEQ ID NO: 398690 - protein, 4 aa, Mycobacterium
GSLS

SEQ ID NO: 398691 - protein, 5 aa, Mycobacterium
GSLSG

SEQ ID NO: 398692 - protein, 6 aa, Mycobacterium
GSMPGD

SEQ ID NO: 398693 - protein, 7 aa, Mycobacterium
GSNNSAH

SEQ ID NO: 398694 - protein, 4 aa, Mycobacterium
GSNS

SEQ ID NO: 398695 - protein, 5 aa, Mycobacterium
GSPAA

SEQ ID NO: 398696 - protein, 7 aa, Mycobacterium
GSPAFTA

SEQ ID NO: 398697 - protein, 5 aa, Mycobacterium
GSPAG

SEQ ID NO: 398698 - protein, 5 aa, Mycobacterium
GSPDD

SEQ ID NO: 398699 - protein, 8 aa, Mycobacterium
GSPEVTNY

SEQ ID NO: 398700 - protein, 28 aa, Mycobacterium
GSPGGAAKVGMTENDPQVVKDLPPQGEG

SEQ ID NO: 398701 - protein, 6 aa, Mycobacterium
GSPGGS

SEQ ID NO: 398702 - protein, 5 aa, Mycobacterium
GSPGL

SEQ ID NO: 398703 - protein, 8 aa, Mycobacterium
GSPGRNNP

SEQ ID NO: 398704 - protein, 9 aa, Mycobacterium
GSPLAGDSV

SEQ ID NO: 398705 - protein, 5 aa, Mycobacterium
GSPLN

SEQ ID NO: 398706 - protein, 7 aa, Mycobacterium
GSPPAEL

SEQ ID NO: 398707 - protein, 6 aa, Mycobacterium
GSPPGA

SEQ ID NO: 398708 - protein, 8 aa, Mycobacterium
GSPPGTLS

SEQ ID NO: 398709 - protein, 10 aa, Mycobacterium
GSPPRTPDVE

SEQ ID NO: 398710 - protein, 5 aa, Mycobacterium
GSPPV

SEQ ID NO: 398711 - protein, 18 aa, Mycobacterium
GSPRIGPKRELKRATEGY

SEQ ID NO: 398712 - protein, 8 aa, Mycobacterium
GSPTDAPG

SEQ ID NO: 398713 - protein, 4 aa, Mycobacterium
GSPW

SEQ ID NO: 398714 - protein, 6 aa, Mycobacterium
GSQAIP

SEQ ID NO: 398715 - protein, 8 aa, Mycobacterium
GSQIESPI

SEQ ID NO: 398716 - protein, 8 aa, Mycobacterium
GSQQAYDA

SEQ ID NO: 398717 - protein, 4 aa, Mycobacterium
GSQW

SEQ ID NO: 398718 - protein, 5 aa, Mycobacterium
GSRAA

SEQ ID NO: 398719 - protein, 7 aa, Mycobacterium
GSRAGAD

SEQ ID NO: 398720 - protein, 9 aa, Mycobacterium
GSRLPSERA

SEQ ID NO: 398721 - protein, 4 aa, Mycobacterium
GSRP

SEQ ID NO: 398722 - protein, 7 aa, Mycobacterium
GSRRSGF

SEQ ID NO: 398723 - protein, 15 aa, Mycobacterium
GSRSRADTFGPDGGE

SEQ ID NO: 398724 - protein, 4 aa, Mycobacterium
GSRT

SEQ ID NO: 398725 - protein, 4 aa, Mycobacterium
GSRV

SEQ ID NO: 398726 - protein, 4 aa, Mycobacterium
GSRY

SEQ ID NO: 398727 - protein, 5 aa, Mycobacterium
GSRYA

SEQ ID NO: 398728 - protein, 4 aa, Mycobacterium
GSSA

SEQ ID NO: 398729 - protein, 7 aa, Mycobacterium
GSSASEL

SEQ ID NO: 398730 - protein, 12 aa, Mycobacterium
GSSAVGKEIGRR

SEQ ID NO: 398731 - protein, 8 aa, Mycobacterium
GSSDPFGT

SEQ ID NO: 398732 - protein, 6 aa, Mycobacterium
GSSETW

SEQ ID NO: 398733 - protein, 17 aa, Mycobacterium
GSSGSSPSTTDDAPPDV

SEQ ID NO: 398734 - protein, 5 aa, Mycobacterium
GSSHT

SEQ ID NO: 398735 - protein, 6 aa, Mycobacterium
GSSIEG

SEQ ID NO: 398736 - protein, 5 aa, Mycobacterium
GSSKH

SEQ ID NO: 398737 - protein, 4 aa, Mycobacterium
GSSL

SEQ ID NO: 398738 - protein, 6 aa, Mycobacterium
GSSNRA

SEQ ID NO: 398739 - protein, 5 aa, Mycobacterium
GSSPG

SEQ ID NO: 398740 - protein, 8 aa, Mycobacterium
GSSPLQDR

SEQ ID NO: 398741 - protein, 6 aa, Mycobacterium
GSSRPP

SEQ ID NO: 398742 - protein, 8 aa, Mycobacterium
GSSRRYAG

SEQ ID NO: 398743 - protein, 4 aa, Mycobacterium
GSSV

SEQ ID NO: 398744 - protein, 4 aa, Mycobacterium
GSSY

SEQ ID NO: 398745 - protein, 6 aa, Mycobacterium
GSTAVG

SEQ ID NO: 398746 - protein, 9 aa, Mycobacterium
GSTEQHGPH

SEQ ID NO: 398747 - protein, 4 aa, Mycobacterium
GSTG

SEQ ID NO: 398748 - protein, 7 aa, Mycobacterium
GSTGPLN

SEQ ID NO: 398749 - protein, 8 aa, Mycobacterium
GSTGSGPL

SEQ ID NO: 398750 - protein, 5 aa, Mycobacterium
GSTGT

SEQ ID NO: 398751 - protein, 4 aa, Mycobacterium
GSTH

SEQ ID NO: 398752 - protein, 4 aa, Mycobacterium
GSTR

SEQ ID NO: 398753 - protein, 11 aa, Mycobacterium
GSTRPAHCTST

SEQ ID NO: 398754 - protein, 4 aa, Mycobacterium
GSTS

SEQ ID NO: 398755 - protein, 11 aa, Mycobacterium
GSTSGVTTSDE

SEQ ID NO: 398756 - protein, 5 aa, Mycobacterium
GSTSL

SEQ ID NO: 398757 - protein, 5 aa, Mycobacterium
GSTVA

SEQ ID NO: 398758 - protein, 5 aa, Mycobacterium
GSVAQ

SEQ ID NO: 398759 - protein, 7 aa, Mycobacterium
GSVGDSF

SEQ ID NO: 398760 - protein, 8 aa, Mycobacterium
GSVGGSTA

SEQ ID NO: 398761 - protein, 4 aa, Mycobacterium
GSVP

SEQ ID NO: 398762 - protein, 4 aa, Mycobacterium
GSVR

SEQ ID NO: 398763 - protein, 10 aa, Mycobacterium
GSVRSTGPGL

SEQ ID NO: 398764 - protein, 7 aa, Mycobacterium
GSVSPSA

SEQ ID NO: 398765 - protein, 24 aa, Mycobacterium
GSVSVADDGRGLPVDTDPTTGKNG

SEQ ID NO: 398766 - protein, 6 aa, Mycobacterium
GSVTTT

SEQ ID NO: 398767 - protein, 4 aa, Mycobacterium
GSWP

SEQ ID NO: 398768 - protein, 13 aa, Mycobacterium
GSWSNDSVSCPRS

SEQ ID NO: 398769 - protein, 4 aa, Mycobacterium
GSYA

SEQ ID NO: 398770 - protein, 4 aa, Mycobacterium
GSYS

SEQ ID NO: 398771 - protein, 4 aa, Mycobacterium
GSYT

SEQ ID NO: 398772 - protein, 4 aa, Mycobacterium
GTAA

SEQ ID NO: 398773 - protein, 5 aa, Mycobacterium
GTAAA

SEQ ID NO: 398774 - protein, 8 aa, Mycobacterium
GTAAEVRE

SEQ ID NO: 398775 - protein, 7 aa, Mycobacterium
GTAARGQ

SEQ ID NO: 398776 - protein, 5 aa, Mycobacterium
GTADP

SEQ ID NO: 398777 - protein, 8 aa, Mycobacterium
GTADPAEI

SEQ ID NO: 398778 - protein, 9 aa, Mycobacterium
GTADPAEVR

SEQ ID NO: 398779 - protein, 10 aa, Mycobacterium
GTADPAGARA

SEQ ID NO: 398780 - protein, 5 aa, Mycobacterium
GTAED

SEQ ID NO: 398781 - protein, 6 aa, Mycobacterium
GTAEEI

SEQ ID NO: 398782 - protein, 5 aa, Mycobacterium
GTAGI

SEQ ID NO: 398783 - protein, 7 aa, Mycobacterium
GTAGTAT

SEQ ID NO: 398784 - protein, 8 aa, Mycobacterium
GTAKMGRD

SEQ ID NO: 398785 - protein, 7 aa, Mycobacterium
GTALGNP

SEQ ID NO: 398786 - protein, 5 aa, Mycobacterium
GTALS

SEQ ID NO: 398787 - protein, 4 aa, Mycobacterium
GTAN

SEQ ID NO: 398788 - protein, 5 aa, Mycobacterium
GTAPD

SEQ ID NO: 398789 - protein, 5 aa, Mycobacterium
GTATF

SEQ ID NO: 398790 - protein, 6 aa, Mycobacterium
GTATFG

SEQ ID NO: 398791 - protein, 4 aa, Mycobacterium
GTDA

SEQ ID NO: 398792 - protein, 15 aa, Mycobacterium
GTDAPAIPHGKNADE

SEQ ID NO: 398793 - protein, 14 aa, Mycobacterium
GTDAPAIPHGRNAD

SEQ ID NO: 398794 - protein, 4 aa, Mycobacterium
GTDD

SEQ ID NO: 398795 - protein, 8 aa, Mycobacterium
GTDEEAPL

SEQ ID NO: 398796 - protein, 7 aa, Mycobacterium
GTDEIST

SEQ ID NO: 398797 - protein, 8 aa, Mycobacterium
GTDEQKER

SEQ ID NO: 398798 - protein, 7 aa, Mycobacterium
GTDEQKH

SEQ ID NO: 398799 - protein, 8 aa, Mycobacterium
GTDEQKSR

SEQ ID NO: 398800 - protein, 7 aa, Mycobacterium
GTDEQPA

SEQ ID NO: 398801 - protein, 7 aa, Mycobacterium
GTDEQRK

SEQ ID NO: 398802 - protein, 5 aa, Mycobacterium
GTDGR

SEQ ID NO: 398803 - protein, 6 aa, Mycobacterium
GTDPQH

SEQ ID NO: 398804 - protein, 9 aa, Mycobacterium
GTDPSPEAA

SEQ ID NO: 398805 - protein, 13 aa, Mycobacterium
GTDTAGSGRVPAG

SEQ ID NO: 398806 - protein, 12 aa, Mycobacterium
GTDTGGSIRQPA

SEQ ID NO: 398807 - protein, 9 aa, Mycobacterium
GTDTTRNQV

SEQ ID NO: 398808 - protein, 5 aa, Mycobacterium
GTDVK

SEQ ID NO: 398809 - protein, 7 aa, Mycobacterium
GTDVPHT

SEQ ID NO: 398810 - protein, 9 aa, Mycobacterium
GTEAGGHCG

SEQ ID NO: 398811 - protein, 5 aa, Mycobacterium
GTEDG

SEQ ID NO: 398812 - protein, 6 aa, Mycobacterium
GTEEQK

SEQ ID NO: 398813 - protein, 7 aa, Mycobacterium
GTEEQKK

SEQ ID NO: 398814 - protein, 8 aa, Mycobacterium
GTEEQKQR

SEQ ID NO: 398815 - protein, 7 aa, Mycobacterium
GTEEQKR

SEQ ID NO: 398816 - protein, 7 aa, Mycobacterium
GTEEQRD

SEQ ID NO: 398817 - protein, 7 aa, Mycobacterium
GTEIRVP

SEQ ID NO: 398818 - protein, 5 aa, Mycobacterium
GTELP

SEQ ID NO: 398819 - protein, 6 aa, Mycobacterium
GTENEG

SEQ ID NO: 398820 - protein, 6 aa, Mycobacterium
GTEPGS

SEQ ID NO: 398821 - protein, 7 aa, Mycobacterium
GTEPPAE

SEQ ID NO: 398822 - protein, 4 aa, Mycobacterium
GTEQ

SEQ ID NO: 398823 - protein, 7 aa, Mycobacterium
GTEQGTV

SEQ ID NO: 398824 - protein, 4 aa, Mycobacterium
GTER

SEQ ID NO: 398825 - protein, 18 aa, Mycobacterium
GTERPFTGEYTDTKTEGV

SEQ ID NO: 398826 - protein, 7 aa, Mycobacterium
GTERTRV

SEQ ID NO: 398827 - protein, 5 aa, Mycobacterium
GTESS

SEQ ID NO: 398828 - protein, 6 aa, Mycobacterium
GTETSA

SEQ ID NO: 398829 - protein, 9 aa, Mycobacterium
GTFGSGGEF

SEQ ID NO: 398830 - protein, 4 aa, Mycobacterium
GTGA

SEQ ID NO: 398831 - protein, 8 aa, Mycobacterium
GTGAGKTT

SEQ ID NO: 398832 - protein, 6 aa, Mycobacterium
GTGASG

SEQ ID NO: 398833 - protein, 4 aa, Mycobacterium
GTGF

SEQ ID NO: 398834 - protein, 6 aa, Mycobacterium
GTGGAG

SEQ ID NO: 398835 - protein, 5 aa, Mycobacterium
GTGGG

SEQ ID NO: 398836 - protein, 8 aa, Mycobacterium
GTGGHSAG

SEQ ID NO: 398837 - protein, 10 aa, Mycobacterium
GTGGHSSGVG

SEQ ID NO: 398838 - protein, 7 aa, Mycobacterium
GTGGYRS

SEQ ID NO: 398839 - protein, 6 aa, Mycobacterium
GTGKLA

SEQ ID NO: 398840 - protein, 5 aa, Mycobacterium
GTGQM

SEQ ID NO: 398841 - protein, 7 aa, Mycobacterium
GTGQTKY

SEQ ID NO: 398842 - protein, 8 aa, Mycobacterium
GTGSTAAQ

SEQ ID NO: 398843 - protein, 9 aa, Mycobacterium
GTGSTASQL

SEQ ID NO: 398844 - protein, 9 aa, Mycobacterium
GTGTPLGDP

SEQ ID NO: 398845 - protein, 9 aa, Mycobacterium
GTGTPVGDP

SEQ ID NO: 398846 - protein, 5 aa, Mycobacterium
GTGVA

SEQ ID NO: 398847 - protein, 5 aa, Mycobacterium
GTHDP

SEQ ID NO: 398848 - protein, 4 aa, Mycobacterium
GTHG

SEQ ID NO: 398849 - protein, 4 aa, Mycobacterium
GTHP

SEQ ID NO: 398850 - protein, 6 aa, Mycobacterium
GTHPGA

SEQ ID NO: 398851 - protein, 4 aa, Mycobacterium
GTIK

SEQ ID NO: 398852 - protein, 4 aa, Mycobacterium
GTIN

SEQ ID NO: 398853 - protein, 4 aa, Mycobacterium
GTIP

SEQ ID NO: 398854 - protein, 8 aa, Mycobacterium
GTIPSKTL

SEQ ID NO: 398855 - protein, 9 aa, Mycobacterium
GTITGEHGV

SEQ ID NO: 398856 - protein, 15 aa, Mycobacterium
GTKEDIKEAQNNGGE

SEQ ID NO: 398857 - protein, 5 aa, Mycobacterium
GTKGP

SEQ ID NO: 398858 - protein, 8 aa, Mycobacterium
GTKKAEAM

SEQ ID NO: 398859 - protein, 5 aa, Mycobacterium
GTKNA

SEQ ID NO: 398860 - protein, 4 aa, Mycobacterium
GTKR

SEQ ID NO: 398861 - protein, 10 aa, Mycobacterium
GTKSMPGADR

SEQ ID NO: 398862 - protein, 5 aa, Mycobacterium
GTLGT

SEQ ID NO: 398863 - protein, 10 aa, Mycobacterium
GTLSGGEKTR

SEQ ID NO: 398864 - protein, 21 aa, Mycobacterium
GTLSNAPSTTPPTKPLPGPQA

SEQ ID NO: 398865 - protein, 5 aa, Mycobacterium
GTLTG

SEQ ID NO: 398866 - protein, 11 aa, Mycobacterium
GTMDTEAGPQL

SEQ ID NO: 398867 - protein, 8 aa, Mycobacterium
GTNRYGTR

SEQ ID NO: 398868 - protein, 5 aa, Mycobacterium
GTPAQ

SEQ ID NO: 398869 - protein, 5 aa, Mycobacterium
GTPAW

SEQ ID NO: 398870 - protein, 7 aa, Mycobacterium
GTPEEFA

SEQ ID NO: 398871 - protein, 7 aa, Mycobacterium
GTPEQKR

SEQ ID NO: 398872 - protein, 7 aa, Mycobacterium
GTPEQQQ

SEQ ID NO: 398873 - protein, 6 aa, Mycobacterium
GTPEVA

SEQ ID NO: 398874 - protein, 7 aa, Mycobacterium
GTPFPAT

SEQ ID NO: 398875 - protein, 10 aa, Mycobacterium
GTPFRSDDSP

SEQ ID NO: 398876 - protein, 9 aa, Mycobacterium
GTPGEAPGF

SEQ ID NO: 398877 - protein, 9 aa, Mycobacterium
GTPGETDDD

SEQ ID NO: 398878 - protein, 6 aa, Mycobacterium
GTPGFE

SEQ ID NO: 398879 - protein, 6 aa, Mycobacterium
GTPHER

SEQ ID NO: 398880 - protein, 24 aa, Mycobacterium
GTPHTPRLTPTTTETTTTSPPLEF

SEQ ID NO: 398881 - protein, 5 aa, Mycobacterium
GTPLQ

SEQ ID NO: 398882 - protein, 9 aa, Mycobacterium
GTPNTPDEH

SEQ ID NO: 398883 - protein, 11 aa, Mycobacterium
GTPQKKGEYGA

SEQ ID NO: 398884 - protein, 4 aa, Mycobacterium
GTPR

SEQ ID NO: 398885 - protein, 9 aa, Mycobacterium
GTPRPVSEQ

SEQ ID NO: 398886 - protein, 6 aa, Mycobacterium
GTPTVT

SEQ ID NO: 398887 - protein, 6 aa, Mycobacterium
GTPVDP

SEQ ID NO: 398888 - protein, 5 aa, Mycobacterium
GTPVP

SEQ ID NO: 398889 - protein, 6 aa, Mycobacterium
GTQDGT

SEQ ID NO: 398890 - protein, 5 aa, Mycobacterium
GTQIP

SEQ ID NO: 398891 - protein, 9 aa, Mycobacterium
GTRANRPAV

SEQ ID NO: 398892 - protein, 4 aa, Mycobacterium
GTRE

SEQ ID NO: 398893 - protein, 5 aa, Mycobacterium
GTREF

SEQ ID NO: 398894 - protein, 12 aa, Mycobacterium
GTREFSTPGRDD

SEQ ID NO: 398895 - protein, 11 aa, Mycobacterium
GTREGTSVRGG

SEQ ID NO: 398896 - protein, 12 aa, Mycobacterium
GTRGGGGAPGFE

SEQ ID NO: 398897 - protein, 12 aa, Mycobacterium
GTRGGGGAPRFE

SEQ ID NO: 398898 - protein, 9 aa, Mycobacterium
GTRGGRPAL

SEQ ID NO: 398899 - protein, 4 aa, Mycobacterium
GTRN

SEQ ID NO: 398900 - protein, 6 aa, Mycobacterium
GTRPYG

SEQ ID NO: 398901 - protein, 4 aa, Mycobacterium
GTRR

SEQ ID NO: 398902 - protein, 10 aa, Mycobacterium
GTRSPRSDAE

SEQ ID NO: 398903 - protein, 9 aa, Mycobacterium
GTRSRTGKM

SEQ ID NO: 398904 - protein, 5 aa, Mycobacterium
GTRTG

SEQ ID NO: 398905 - protein, 9 aa, Mycobacterium
GTSAGSAVA

SEQ ID NO: 398906 - protein, 7 aa, Mycobacterium
GTSGDPK

SEQ ID NO: 398907 - protein, 8 aa, Mycobacterium
GTSGDPKA

SEQ ID NO: 398908 - protein, 9 aa, Mycobacterium
GTSGGLRTD

SEQ ID NO: 398909 - protein, 10 aa, Mycobacterium
GTSGHRGSSL

SEQ ID NO: 398910 - protein, 7 aa, Mycobacterium
GTSPRGD

SEQ ID NO: 398911 - protein, 8 aa, Mycobacterium
GTSRANAA

SEQ ID NO: 398912 - protein, 8 aa, Mycobacterium
GTSTEGDI

SEQ ID NO: 398913 - protein, 14 aa, Mycobacterium
GTTGASKAVKCSQG

SEQ ID NO: 398914 - protein, 7 aa, Mycobacterium
GTTGDGI

SEQ ID NO: 398915 - protein, 7 aa, Mycobacterium
GTTGEPK

SEQ ID NO: 398916 - protein, 7 aa, Mycobacterium
GTTGFPK

SEQ ID NO: 398917 - protein, 8 aa, Mycobacterium
GTTGLPKG

SEQ ID NO: 398918 - protein, 9 aa, Mycobacterium
GTTGRSKGA

SEQ ID NO: 398919 - protein, 6 aa, Mycobacterium
GTTKET

SEQ ID NO: 398920 - protein, 5 aa, Mycobacterium
GTTPA

SEQ ID NO: 398921 - protein, 6 aa, Mycobacterium
GTTPAK

SEQ ID NO: 398922 - protein, 4 aa, Mycobacterium
GTTR

SEQ ID NO: 398923 - protein, 5 aa, Mycobacterium
GTTSV

SEQ ID NO: 398924 - protein, 5 aa, Mycobacterium
GTTTT

SEQ ID NO: 398925 - protein, 23 aa, Mycobacterium
GTTTTYPTPDQGKPIDGGGVPCV

SEQ ID NO: 398926 - protein, 5 aa, Mycobacterium
GTVAQ

SEQ ID NO: 398927 - protein, 10 aa, Mycobacterium
GTVDGATGHV

SEQ ID NO: 398928 - protein, 7 aa, Mycobacterium
GTVEPEV

SEQ ID NO: 398929 - protein, 4 aa, Mycobacterium
GTVG

SEQ ID NO: 398930 - protein, 11 aa, Mycobacterium
GTVKSRCARGR

SEQ ID NO: 398931 - protein, 11 aa, Mycobacterium
GTVSEHNATRN

SEQ ID NO: 398932 - protein, 4 aa, Mycobacterium
GTVT

SEQ ID NO: 398933 - protein, 22 aa, Mycobacterium
GTYPPGATERLDSDAFSPNTTI

SEQ ID NO: 398934 - protein, 5 aa, Mycobacterium
GTYSR

SEQ ID NO: 398935 - protein, 4 aa, Mycobacterium
GVAD

SEQ ID NO: 398936 - protein, 14 aa, Mycobacterium
GVADAELNGDPART

SEQ ID NO: 398937 - protein, 4 aa, Mycobacterium
GVAG

SEQ ID NO: 398938 - protein, 5 aa, Mycobacterium
GVAGA

SEQ ID NO: 398939 - protein, 6 aa, Mycobacterium
GVAGDE

SEQ ID NO: 398940 - protein, 4 aa, Mycobacterium
GVAK

SEQ ID NO: 398941 - protein, 6 aa, Mycobacterium
GVAPDE

SEQ ID NO: 398942 - protein, 10 aa, Mycobacterium
GVAPGGPGNF

SEQ ID NO: 398943 - protein, 4 aa, Mycobacterium
GVAR

SEQ ID NO: 398944 - protein, 10 aa, Mycobacterium
GVASGNGKGQ

SEQ ID NO: 398945 - protein, 17 aa, Mycobacterium
GVASSTRLDAQAKGLGE

SEQ ID NO: 398946 - protein, 4 aa, Mycobacterium
GVAT

SEQ ID NO: 398947 - protein, 9 aa, Mycobacterium
GVDATGEFA

SEQ ID NO: 398948 - protein, 8 aa, Mycobacterium
GVDDQGRR

SEQ ID NO: 398949 - protein, 8 aa, Mycobacterium
GVDGEHGP

SEQ ID NO: 398950 - protein, 4 aa, Mycobacterium
GVDP

SEQ ID NO: 398951 - protein, 5 aa, Mycobacterium
GVDPA

SEQ ID NO: 398952 - protein, 5 aa, Mycobacterium
GVDPD

SEQ ID NO: 398953 - protein, 9 aa, Mycobacterium
GVDPERGWG

SEQ ID NO: 398954 - protein, 5 aa, Mycobacterium
GVDSA

SEQ ID NO: 398955 - protein, 8 aa, Mycobacterium
GVDTPSAY

SEQ ID NO: 398956 - protein, 5 aa, Mycobacterium
GVEAG

SEQ ID NO: 398957 - protein, 5 aa, Mycobacterium
GVEEG

SEQ ID NO: 398958 - protein, 9 aa, Mycobacterium
GVEGQAYSA

SEQ ID NO: 398959 - protein, 5 aa, Mycobacterium
GVEPL

SEQ ID NO: 398960 - protein, 4 aa, Mycobacterium
GVER

SEQ ID NO: 398961 - protein, 4 aa, Mycobacterium
GVEV

SEQ ID NO: 398962 - protein, 4 aa, Mycobacterium
GVGA

SEQ ID NO: 398963 - protein, 5 aa, Mycobacterium
GVGEN

SEQ ID NO: 398964 - protein, 6 aa, Mycobacterium
GVGESG

SEQ ID NO: 398965 - protein, 7 aa, Mycobacterium
GVGGGSL

SEQ ID NO: 398966 - protein, 4 aa, Mycobacterium
GVGH

SEQ ID NO: 398967 - protein, 4 aa, Mycobacterium
GVGN

SEQ ID NO: 398968 - protein, 6 aa, Mycobacterium
GVGPDE

SEQ ID NO: 398969 - protein, 8 aa, Mycobacterium
GVGPEQLE

SEQ ID NO: 398970 - protein, 6 aa, Mycobacterium
GVGPGS

SEQ ID NO: 398971 - protein, 5 aa, Mycobacterium
GVGPK

SEQ ID NO: 398972 - protein, 5 aa, Mycobacterium
GVGPT

SEQ ID NO: 398973 - protein, 5 aa, Mycobacterium
GVGQA

SEQ ID NO: 398974 - protein, 5 aa, Mycobacterium
GVGSG

SEQ ID NO: 398975 - protein, 15 aa, Mycobacterium
GVGSPKPLHETDDET

SEQ ID NO: 398976 - protein, 7 aa, Mycobacterium
GVGTEAD

SEQ ID NO: 398977 - protein, 5 aa, Mycobacterium
GVGTQ

SEQ ID NO: 398978 - protein, 6 aa, Mycobacterium
GVHATG

SEQ ID NO: 398979 - protein, 19 aa, Mycobacterium
GVHSESEGVEPSRRVVVLH

SEQ ID NO: 398980 - protein, 10 aa, Mycobacterium
GVKGTSGMRK

SEQ ID NO: 398981 - protein, 4 aa, Mycobacterium
GVKP

SEQ ID NO: 398982 - protein, 16 aa, Mycobacterium
GVKPATASAGGDDDSW

SEQ ID NO: 398983 - protein, 5 aa, Mycobacterium
GVMPQ

SEQ ID NO: 398984 - protein, 4 aa, Mycobacterium
GVNR

SEQ ID NO: 398985 - protein, 5 aa, Mycobacterium
GVPGA

SEQ ID NO: 398986 - protein, 5 aa, Mycobacterium
GVPGE

SEQ ID NO: 398987 - protein, 5 aa, Mycobacterium
GVPGG

SEQ ID NO: 398988 - protein, 7 aa, Mycobacterium
GVPGPDR

SEQ ID NO: 398989 - protein, 12 aa, Mycobacterium
GVPGVGKSTTIE

SEQ ID NO: 398990 - protein, 11 aa, Mycobacterium
GVPKEGEPPLD

SEQ ID NO: 398991 - protein, 13 aa, Mycobacterium
GVPKGSGEPHKTK

SEQ ID NO: 398992 - protein, 9 aa, Mycobacterium
GVPNAPSGW

SEQ ID NO: 398993 - protein, 5 aa, Mycobacterium
GVPND

SEQ ID NO: 398994 - protein, 4 aa, Mycobacterium
GVPR

SEQ ID NO: 398995 - protein, 4 aa, Mycobacterium
GVPS

SEQ ID NO: 398996 - protein, 9 aa, Mycobacterium
GVPTFRDDK

SEQ ID NO: 398997 - protein, 5 aa, Mycobacterium
GVPTG

SEQ ID NO: 398998 - protein, 9 aa, Mycobacterium
GVPTSSPER

SEQ ID NO: 398999 - protein, 4 aa, Mycobacterium
GVQA

SEQ ID NO: 399000 - protein, 12 aa, Mycobacterium
GVQAGKSDRLTG

SEQ ID NO: 399001 - protein, 9 aa, Mycobacterium
GVQAGRAGN

SEQ ID NO: 399002 - protein, 10 aa, Mycobacterium
GVQGDNRTYG

SEQ ID NO: 399003 - protein, 6 aa, Mycobacterium
GVQPAL

SEQ ID NO: 399004 - protein, 4 aa, Mycobacterium
GVRA

SEQ ID NO: 399005 - protein, 5 aa, Mycobacterium
GVRDD

SEQ ID NO: 399006 - protein, 10 aa, Mycobacterium
GVREAGGQQV

SEQ ID NO: 399007 - protein, 7 aa, Mycobacterium
GVRGGGR

SEQ ID NO: 399008 - protein, 12 aa, Mycobacterium
GVRRTRSKFGSR

SEQ ID NO: 399009 - protein, 6 aa, Mycobacterium
GVSDDD

SEQ ID NO: 399010 - protein, 5 aa, Mycobacterium
GVSGA

SEQ ID NO: 399011 - protein, 5 aa, Mycobacterium
GVSGG

SEQ ID NO: 399012 - protein, 5 aa, Mycobacterium
GVSGK

SEQ ID NO: 399013 - protein, 9 aa, Mycobacterium
GVSGSGKST

SEQ ID NO: 399014 - protein, 9 aa, Mycobacterium
GVSPDSYPT

SEQ ID NO: 399015 - protein, 16 aa, Mycobacterium
GVSPLTPDHVNPERPW

SEQ ID NO: 399016 - protein, 5 aa, Mycobacterium
GVSRD

SEQ ID NO: 399017 - protein, 5 aa, Mycobacterium
GVSSG

SEQ ID NO: 399018 - protein, 4 aa, Mycobacterium
GVST

SEQ ID NO: 399019 - protein, 4 aa, Mycobacterium
GVSV

SEQ ID NO: 399020 - protein, 4 aa, Mycobacterium
GVTA

SEQ ID NO: 399021 - protein, 6 aa, Mycobacterium
GVTAEQ

SEQ ID NO: 399022 - protein, 5 aa, Mycobacterium
GVTGA

SEQ ID NO: 399023 - protein, 8 aa, Mycobacterium
GVTGPDAE

SEQ ID NO: 399024 - protein, 6 aa, Mycobacterium
GVTGQG

SEQ ID NO: 399025 - protein, 10 aa, Mycobacterium
GVTPGNDGRG

SEQ ID NO: 399026 - protein, 6 aa, Mycobacterium
GVTRPR

SEQ ID NO: 399027 - protein, 4 aa, Mycobacterium
GVTT

SEQ ID NO: 399028 - protein, 5 aa, Mycobacterium
GWDRT

SEQ ID NO: 399029 - protein, 7 aa, Mycobacterium
GWETDGG

SEQ ID NO: 399030 - protein, 7 aa, Mycobacterium
GWGRPDT

SEQ ID NO: 399031 - protein, 13 aa, Mycobacterium
GWPEPTGVQATND

SEQ ID NO: 399032 - protein, 4 aa, Mycobacterium
GWPS

SEQ ID NO: 399033 - protein, 6 aa, Mycobacterium
GWQPGD

SEQ ID NO: 399034 - protein, 7 aa, Mycobacterium
GWSDDGM

SEQ ID NO: 399035 - protein, 5 aa, Mycobacterium
GWSPE

SEQ ID NO: 399036 - protein, 6 aa, Mycobacterium
GWSTDQ

SEQ ID NO: 399037 - protein, 4 aa, Mycobacterium
GWTG

SEQ ID NO: 399038 - protein, 4 aa, Mycobacterium
GWTL

SEQ ID NO: 399039 - protein, 4 aa, Mycobacterium
GWVT

SEQ ID NO: 399040 - protein, 11 aa, Mycobacterium
GYAGPDPVARS

SEQ ID NO: 399041 - protein, 7 aa, Mycobacterium
GYANTTV

SEQ ID NO: 399042 - protein, 10 aa, Mycobacterium
GYDNSRPVRI

SEQ ID NO: 399043 - protein, 5 aa, Mycobacterium
GYDSA

SEQ ID NO: 399044 - protein, 5 aa, Mycobacterium
GYDSS

SEQ ID NO: 399045 - protein, 4 aa, Mycobacterium
GYEP

SEQ ID NO: 399046 - protein, 4 aa, Mycobacterium
GYGP

SEQ ID NO: 399047 - protein, 6 aa, Mycobacterium
GYGPGD

SEQ ID NO: 399048 - protein, 12 aa, Mycobacterium
GYGQDGPLAGHA

SEQ ID NO: 399049 - protein, 4 aa, Mycobacterium
GYHD

SEQ ID NO: 399050 - protein, 6 aa, Mycobacterium
GYHRRE

SEQ ID NO: 399051 - protein, 13 aa, Mycobacterium
GYKPNTKPHNRQI

SEQ ID NO: 399052 - protein, 10 aa, Mycobacterium
GYKQSGIGRE

SEQ ID NO: 399053 - protein, 8 aa, Mycobacterium
GYKQSGWG

SEQ ID NO: 399054 - protein, 7 aa, Mycobacterium
GYPAGQL

SEQ ID NO: 399055 - protein, 7 aa, Mycobacterium
GYPAPRP

SEQ ID NO: 399056 - protein, 5 aa, Mycobacterium
GYPDR

SEQ ID NO: 399057 - protein, 4 aa, Mycobacterium
GYPR

SEQ ID NO: 399058 - protein, 7 aa, Mycobacterium
GYPRPGK

SEQ ID NO: 399059 - protein, 9 aa, Mycobacterium
GYPTEHRAA

SEQ ID NO: 399060 - protein, 8 aa, Mycobacterium
GYRESAES

SEQ ID NO: 399061 - protein, 7 aa, Mycobacterium
GYRETGM

SEQ ID NO: 399062 - protein, 8 aa, Mycobacterium
GYRPETPA

SEQ ID NO: 399063 - protein, 10 aa, Mycobacterium
GYRRRTDSKD

SEQ ID NO: 399064 - protein, 5 aa, Mycobacterium
GYSEL

SEQ ID NO: 399065 - protein, 5 aa, Mycobacterium
GYSKE

SEQ ID NO: 399066 - protein, 7 aa, Mycobacterium
GYSPHSF

SEQ ID NO: 399067 - protein, 16 aa, Mycobacterium
GYSSLTKDKLVAKLRN

SEQ ID NO: 399068 - protein, 4 aa, Mycobacterium
GYSV

SEQ ID NO: 399069 - protein, 7 aa, Mycobacterium
GYTEDDK

SEQ ID NO: 399070 - protein, 11 aa, Mycobacterium
GYTEDSGEGRW

SEQ ID NO: 399071 - protein, 19 aa, Mycobacterium
GYTGGDVPNATYRNHGTHA

SEQ ID NO: 399072 - protein, 19 aa, Mycobacterium
GYTGGQNDHPTYRNHPGHA

SEQ ID NO: 399073 - protein, 5 aa, Mycobacterium
GYTPR

SEQ ID NO: 399074 - protein, 14 aa, Mycobacterium
GYTSPGRSKETAQD

SEQ ID NO: 399075 - protein, 14 aa, Mycobacterium
GYTSPGRVKETAED

SEQ ID NO: 399076 - protein, 11 aa, Mycobacterium
GYTSTVATNSE

SEQ ID NO: 399077 - protein, 8 aa, Mycobacterium
GYVEDSGM

SEQ ID NO: 399078 - protein, 15 aa, Mycobacterium
HAAAPAWGKTAPAER

SEQ ID NO: 399079 - protein, 6 aa, Mycobacterium
HAAATG

SEQ ID NO: 399080 - protein, 5 aa, Mycobacterium
HAAPS

SEQ ID NO: 399081 - protein, 8 aa, Mycobacterium
HAAPTTFG

SEQ ID NO: 399082 - protein, 6 aa, Mycobacterium
HAARNP

SEQ ID NO: 399083 - protein, 9 aa, Mycobacterium
HADDNDMDA

SEQ ID NO: 399084 - protein, 9 aa, Mycobacterium
HADDNDMEA

SEQ ID NO: 399085 - protein, 5 aa, Mycobacterium
HADGI

SEQ ID NO: 399086 - protein, 8 aa, Mycobacterium
HAELPTER

SEQ ID NO: 399087 - protein, 8 aa, Mycobacterium
HAEPDEEK

SEQ ID NO: 399088 - protein, 6 aa, Mycobacterium
HAEQLT

SEQ ID NO: 399089 - protein, 6 aa, Mycobacterium
HAETEV

SEQ ID NO: 399090 - protein, 7 aa, Mycobacterium
HAGETGG

SEQ ID NO: 399091 - protein, 5 aa, Mycobacterium
HAGGE

SEQ ID NO: 399092 - protein, 7 aa, Mycobacterium
HAGHRES

SEQ ID NO: 399093 - protein, 13 aa, Mycobacterium
HAGQQPDSATNAR

SEQ ID NO: 399094 - protein, 9 aa, Mycobacterium
HAKTDEDKL

SEQ ID NO: 399095 - protein, 20 aa, Mycobacterium
HALSDDGHCRPYSAQASGTV

SEQ ID NO: 399096 - protein, 6 aa, Mycobacterium
HANEGG

SEQ ID NO: 399097 - protein, 11 aa, Mycobacterium
HAPAGDQPAAI

SEQ ID NO: 399098 - protein, 12 aa, Mycobacterium
HAPGAGAGLGGV

SEQ ID NO: 399099 - protein, 8 aa, Mycobacterium
HAPGDETQ

SEQ ID NO: 399100 - protein, 5 aa, Mycobacterium
HAPKT

SEQ ID NO: 399101 - protein, 4 aa, Mycobacterium
HASG

SEQ ID NO: 399102 - protein, 5 aa, Mycobacterium
HASGT

SEQ ID NO: 399103 - protein, 7 aa, Mycobacterium
HASPAAV

SEQ ID NO: 399104 - protein, 6 aa, Mycobacterium
HATADN

SEQ ID NO: 399105 - protein, 7 aa, Mycobacterium
HATDPTP

SEQ ID NO: 399106 - protein, 11 aa, Mycobacterium
HATESNPTAAS

SEQ ID NO: 399107 - protein, 18 aa, Mycobacterium
HATPDRAGGKTSAENGLG

SEQ ID NO: 399108 - protein, 5 aa, Mycobacterium
HATRP

SEQ ID NO: 399109 - protein, 15 aa, Mycobacterium
HDAGDPGSGEASNMA

SEQ ID NO: 399110 - protein, 8 aa, Mycobacterium
HDAGPENI

SEQ ID NO: 399111 - protein, 4 aa, Mycobacterium
HDAS

SEQ ID NO: 399112 - protein, 5 aa, Mycobacterium
HDASL

SEQ ID NO: 399113 - protein, 4 aa, Mycobacterium
HDAT

SEQ ID NO: 399114 - protein, 6 aa, Mycobacterium
HDDPLA

SEQ ID NO: 399115 - protein, 5 aa, Mycobacterium
HDDRD

SEQ ID NO: 399116 - protein, 7 aa, Mycobacterium
HDDSASI

SEQ ID NO: 399117 - protein, 9 aa, Mycobacterium
HDGDDDAVR

SEQ ID NO: 399118 - protein, 6 aa, Mycobacterium
HDGDTV

SEQ ID NO: 399119 - protein, 6 aa, Mycobacterium
HDGEEG

SEQ ID NO: 399120 - protein, 6 aa, Mycobacterium
HDHHSR

SEQ ID NO: 399121 - protein, 4 aa, Mycobacterium
HDHP

SEQ ID NO: 399122 - protein, 6 aa, Mycobacterium
HDHPDG

SEQ ID NO: 399123 - protein, 4 aa, Mycobacterium
HDLR

SEQ ID NO: 399124 - protein, 5 aa, Mycobacterium
HDPAG

SEQ ID NO: 399125 - protein, 7 aa, Mycobacterium
HDPLRDD

SEQ ID NO: 399126 - protein, 8 aa, Mycobacterium
HDPLRDDG

SEQ ID NO: 399127 - protein, 6 aa, Mycobacterium
HDPRLA

SEQ ID NO: 399128 - protein, 5 aa, Mycobacterium
HDPSR

SEQ ID NO: 399129 - protein, 7 aa, Mycobacterium
HDRGEAK

SEQ ID NO: 399130 - protein, 6 aa, Mycobacterium
HDRSEA

SEQ ID NO: 399131 - protein, 10 aa, Mycobacterium
HDRSTATTVR

SEQ ID NO: 399132 - protein, 7 aa, Mycobacterium
HDTLDND

SEQ ID NO: 399133 - protein, 10 aa, Mycobacterium
HDVGRGRGGV

SEQ ID NO: 399134 - protein, 4 aa, Mycobacterium
HDVH

SEQ ID NO: 399135 - protein, 4 aa, Mycobacterium
HEAF

SEQ ID NO: 399136 - protein, 5 aa, Mycobacterium
HEDDT

SEQ ID NO: 399137 - protein, 7 aa, Mycobacterium
HEDPEES

SEQ ID NO: 399138 - protein, 5 aa, Mycobacterium
HEEDG

SEQ ID NO: 399139 - protein, 4 aa, Mycobacterium
HEGA

SEQ ID NO: 399140 - protein, 5 aa, Mycobacterium
HEGGP

SEQ ID NO: 399141 - protein, 10 aa, Mycobacterium
HEGGSSAQEI

SEQ ID NO: 399142 - protein, 8 aa, Mycobacterium
HEGGTPSH

SEQ ID NO: 399143 - protein, 8 aa, Mycobacterium
HEGPTAAR

SEQ ID NO: 399144 - protein, 14 aa, Mycobacterium
HEKAAAAQDSGAFD

SEQ ID NO: 399145 - protein, 5 aa, Mycobacterium
HEPAA

SEQ ID NO: 399146 - protein, 5 aa, Mycobacterium
HEPDI

SEQ ID NO: 399147 - protein, 9 aa, Mycobacterium
HEPDRSDAA

SEQ ID NO: 399148 - protein, 7 aa, Mycobacterium
HEPRGPQ

SEQ ID NO: 399149 - protein, 9 aa, Mycobacterium
HEPVGSNPL

SEQ ID NO: 399150 - protein, 4 aa, Mycobacterium
HEQE

SEQ ID NO: 399151 - protein, 6 aa, Mycobacterium
HEQTAT

SEQ ID NO: 399152 - protein, 8 aa, Mycobacterium
HERPGDQW

SEQ ID NO: 399153 - protein, 8 aa, Mycobacterium
HERVPGET

SEQ ID NO: 399154 - protein, 4 aa, Mycobacterium
HETD

SEQ ID NO: 399155 - protein, 5 aa, Mycobacterium
HETDR

SEQ ID NO: 399156 - protein, 5 aa, Mycobacterium
HETGR

SEQ ID NO: 399157 - protein, 7 aa, Mycobacterium
HETTAST

SEQ ID NO: 399158 - protein, 7 aa, Mycobacterium
HETTSGA

SEQ ID NO: 399159 - protein, 6 aa, Mycobacterium
HFTKQE

SEQ ID NO: 399160 - protein, 8 aa, Mycobacterium
HGATGLPV

SEQ ID NO: 399161 - protein, 7 aa, Mycobacterium
HGDDRRT

SEQ ID NO: 399162 - protein, 13 aa, Mycobacterium
HGDDVEEALPSRP

SEQ ID NO: 399163 - protein, 4 aa, Mycobacterium
HGDP

SEQ ID NO: 399164 - protein, 8 aa, Mycobacterium
HGEDAASL

SEQ ID NO: 399165 - protein, 5 aa, Mycobacterium
HGGAG

SEQ ID NO: 399166 - protein, 11 aa, Mycobacterium
HGGASAAAAQL

SEQ ID NO: 399167 - protein, 16 aa, Mycobacterium
HGGGEPPPYLAASSAN

SEQ ID NO: 399168 - protein, 22 aa, Mycobacterium
HGGHGASSPKDKRDQTGQESLY

SEQ ID NO: 399169 - protein, 6 aa, Mycobacterium
HGGPEA

SEQ ID NO: 399170 - protein, 7 aa, Mycobacterium
HGGRPPV

SEQ ID NO: 399171 - protein, 10 aa, Mycobacterium
HGGRQANGGL

SEQ ID NO: 399172 - protein, 5 aa, Mycobacterium
HGGRT

SEQ ID NO: 399173 - protein, 4 aa, Mycobacterium
HGGS

SEQ ID NO: 399174 - protein, 4 aa, Mycobacterium
HGGT

SEQ ID NO: 399175 - protein, 6 aa, Mycobacterium
HGHEPP

SEQ ID NO: 399176 - protein, 12 aa, Mycobacterium
HGHGPVSPLFRL

SEQ ID NO: 399177 - protein, 12 aa, Mycobacterium
HGKSDKPRADYS

SEQ ID NO: 399178 - protein, 11 aa, Mycobacterium
HGKSDRPGRNQ

SEQ ID NO: 399179 - protein, 8 aa, Mycobacterium
HGLDSEEA

SEQ ID NO: 399180 - protein, 6 aa, Mycobacterium
HGNGTQ

SEQ ID NO: 399181 - protein, 7 aa, Mycobacterium
HGNQPQY

SEQ ID NO: 399182 - protein, 14 aa, Mycobacterium
HGPEIDKGARWDPA

SEQ ID NO: 399183 - protein, 4 aa, Mycobacterium
HGPG

SEQ ID NO: 399184 - protein, 5 aa, Mycobacterium
HGPGW

SEQ ID NO: 399185 - protein, 12 aa, Mycobacterium
HGPPGTGKTHTA

SEQ ID NO: 399186 - protein, 15 aa, Mycobacterium
HGPQPRDYSQRTPKK

SEQ ID NO: 399187 - protein, 4 aa, Mycobacterium
HGPR

SEQ ID NO: 399188 - protein, 8 aa, Mycobacterium
HGQPRTNT

SEQ ID NO: 399189 - protein, 10 aa, Mycobacterium
HGQPRTNTYH

SEQ ID NO: 399190 - protein, 6 aa, Mycobacterium
HGRGGL

SEQ ID NO: 399191 - protein, 6 aa, Mycobacterium
HGRLDP

SEQ ID NO: 399192 - protein, 11 aa, Mycobacterium
HGRSDKPRADY

SEQ ID NO: 399193 - protein, 12 aa, Mycobacterium
HGRSDKPRADYS

SEQ ID NO: 399194 - protein, 5 aa, Mycobacterium
HGRSG

SEQ ID NO: 399195 - protein, 6 aa, Mycobacterium
HGRWPQ

SEQ ID NO: 399196 - protein, 4 aa, Mycobacterium
HGRY

SEQ ID NO: 399197 - protein, 4 aa, Mycobacterium
HGTG

SEQ ID NO: 399198 - protein, 11 aa, Mycobacterium
HGTGTPVGDPI

SEQ ID NO: 399199 - protein, 12 aa, Mycobacterium
HGTGTRLGDPIE

SEQ ID NO: 399200 - protein, 12 aa, Mycobacterium
HGTGTRLGDRTE

SEQ ID NO: 399201 - protein, 10 aa, Mycobacterium
HGTGTSLGDP

SEQ ID NO: 399202 - protein, 10 aa, Mycobacterium
HGTGTTLGDP

SEQ ID NO: 399203 - protein, 12 aa, Mycobacterium
HGTGTTLGDPIE

SEQ ID NO: 399204 - protein, 7 aa, Mycobacterium
HGTPTQV

SEQ ID NO: 399205 - protein, 4 aa, Mycobacterium
HGVP

SEQ ID NO: 399206 - protein, 8 aa, Mycobacterium
HGVPPARR

SEQ ID NO: 399207 - protein, 8 aa, Mycobacterium
HGVSEAPR

SEQ ID NO: 399208 - protein, 5 aa, Mycobacterium
HHDPH

SEQ ID NO: 399209 - protein, 10 aa, Mycobacterium
HHGDGTPGST

SEQ ID NO: 399210 - protein, 5 aa, Mycobacterium
HHGGK

SEQ ID NO: 399211 - protein, 8 aa, Mycobacterium
HHHGDSET

SEQ ID NO: 399212 - protein, 5 aa, Mycobacterium
HHNPH

SEQ ID NO: 399213 - protein, 7 aa, Mycobacterium
HHPPGRP

SEQ ID NO: 399214 - protein, 6 aa, Mycobacterium
HIGDSR

SEQ ID NO: 399215 - protein, 7 aa, Mycobacterium
HIGDSRS

SEQ ID NO: 399216 - protein, 4 aa, Mycobacterium
HIGP

SEQ ID NO: 399217 - protein, 4 aa, Mycobacterium
HIPT

SEQ ID NO: 399218 - protein, 8 aa, Mycobacterium
HISDSRSL

SEQ ID NO: 399219 - protein, 10 aa, Mycobacterium
HKADGKSTPI

SEQ ID NO: 399220 - protein, 5 aa, Mycobacterium
HKGRL

SEQ ID NO: 399221 - protein, 8 aa, Mycobacterium
HKHSPDEL

SEQ ID NO: 399222 - protein, 6 aa, Mycobacterium
HKIGPG

SEQ ID NO: 399223 - protein, 14 aa, Mycobacterium
HKKARTYSKGNRQK

SEQ ID NO: 399224 - protein, 10 aa, Mycobacterium
HKKQTGGSGQ

SEQ ID NO: 399225 - protein, 9 aa, Mycobacterium
HKLGPDTSI

SEQ ID NO: 399226 - protein, 6 aa, Mycobacterium
HKVGPG

SEQ ID NO: 399227 - protein, 7 aa, Mycobacterium
HKYPNES

SEQ ID NO: 399228 - protein, 12 aa, Mycobacterium
HLAGPPDDPRIP

SEQ ID NO: 399229 - protein, 6 aa, Mycobacterium
HLDPQA

SEQ ID NO: 399230 - protein, 12 aa, Mycobacterium
HLDSTRAVSPLR

SEQ ID NO: 399231 - protein, 6 aa, Mycobacterium
HLPGGD

SEQ ID NO: 399232 - protein, 4 aa, Mycobacterium
HLPP

SEQ ID NO: 399233 - protein, 9 aa, Mycobacterium
HLPRERADQ

SEQ ID NO: 399234 - protein, 10 aa, Mycobacterium
HLPYDRPPLS

SEQ ID NO: 399235 - protein, 7 aa, Mycobacterium
HLRSGEE

SEQ ID NO: 399236 - protein, 6 aa, Mycobacterium
HMSPPT

SEQ ID NO: 399237 - protein, 9 aa, Mycobacterium
HNAPSRSPF

SEQ ID NO: 399238 - protein, 7 aa, Mycobacterium
HNDDGGE

SEQ ID NO: 399239 - protein, 8 aa, Mycobacterium
HNGAGKTT

SEQ ID NO: 399240 - protein, 6 aa, Mycobacterium
HNGPKV

SEQ ID NO: 399241 - protein, 8 aa, Mycobacterium
HNGSPRAL

SEQ ID NO: 399242 - protein, 5 aa, Mycobacterium
HNHPS

SEQ ID NO: 399243 - protein, 5 aa, Mycobacterium
HNLTP

SEQ ID NO: 399244 - protein, 9 aa, Mycobacterium
HNPRTGEKD

SEQ ID NO: 399245 - protein, 7 aa, Mycobacterium
HNQPRVA

SEQ ID NO: 399246 - protein, 11 aa, Mycobacterium
HNRAYSEGDRE

SEQ ID NO: 399247 - protein, 8 aa, Mycobacterium
HNVPPGRR

SEQ ID NO: 399248 - protein, 8 aa, Mycobacterium
HPAATKAD

SEQ ID NO: 399249 - protein, 6 aa, Mycobacterium
HPADGR

SEQ ID NO: 399250 - protein, 8 aa, Mycobacterium
HPAPPGAP

SEQ ID NO: 399251 - protein, 6 aa, Mycobacterium
HPARGA

SEQ ID NO: 399252 - protein, 10 aa, Mycobacterium
HPDAGKSTLT

SEQ ID NO: 399253 - protein, 9 aa, Mycobacterium
HPDAPKPKR

SEQ ID NO: 399254 - protein, 6 aa, Mycobacterium
HPDDER

SEQ ID NO: 399255 - protein, 7 aa, Mycobacterium
HPDDETL

SEQ ID NO: 399256 - protein, 8 aa, Mycobacterium
HPDDGGQH

SEQ ID NO: 399257 - protein, 8 aa, Mycobacterium
HPDGLSDP

SEQ ID NO: 399258 - protein, 8 aa, Mycobacterium
HPDPEQRA

SEQ ID NO: 399259 - protein, 9 aa, Mycobacterium
HPEDTSMSG

SEQ ID NO: 399260 - protein, 4 aa, Mycobacterium
HPEE

SEQ ID NO: 399261 - protein, 4 aa, Mycobacterium
HPEG

SEQ ID NO: 399262 - protein, 5 aa, Mycobacterium
HPELA

SEQ ID NO: 399263 - protein, 17 aa, Mycobacterium
HPENLSPDLNQSPTYPN

SEQ ID NO: 399264 - protein, 14 aa, Mycobacterium
HPEPLRRGADRTIT

SEQ ID NO: 399265 - protein, 7 aa, Mycobacterium
HPEQDDP

SEQ ID NO: 399266 - protein, 4 aa, Mycobacterium
HPGA

SEQ ID NO: 399267 - protein, 5 aa, Mycobacterium
HPGAL

SEQ ID NO: 399268 - protein, 14 aa, Mycobacterium
HPGASPESGPGDPV

SEQ ID NO: 399269 - protein, 11 aa, Mycobacterium
HPGDGGRGRYT

SEQ ID NO: 399270 - protein, 6 aa, Mycobacterium
HPGDPY

SEQ ID NO: 399271 - protein, 4 aa, Mycobacterium
HPGE

SEQ ID NO: 399272 - protein, 8 aa, Mycobacterium
HPGPDAPE

SEQ ID NO: 399273 - protein, 8 aa, Mycobacterium
HPGPEAPE

SEQ ID NO: 399274 - protein, 6 aa, Mycobacterium
HPGQTP

SEQ ID NO: 399275 - protein, 8 aa, Mycobacterium
HPGSQQRA

SEQ ID NO: 399276 - protein, 4 aa, Mycobacterium
HPGW

SEQ ID NO: 399277 - protein, 4 aa, Mycobacterium
HPGY

SEQ ID NO: 399278 - protein, 35 aa, Mycobacterium; identical to SEQ ID NO: 37313

SEQ ID NO: 399279 - protein, 35 aa, Mycobacterium
HPHGGGEGKTSGGRHPVSPWGKPEGRTRKPNKASD

SEQ ID NO: 399280 - protein, 4 aa, Mycobacterium
HPIP

SEQ ID NO: 399281 - protein, 4 aa, Mycobacterium
HPLA

SEQ ID NO: 399282 - protein, 5 aa, Mycobacterium
HPLGA

SEQ ID NO: 399283 - protein, 6 aa, Mycobacterium
HPNGAD

SEQ ID NO: 399284 - protein, 5 aa, Mycobacterium
HPNPH

SEQ ID NO: 399285 - protein, 6 aa, Mycobacterium
HPPELG

SEQ ID NO: 399286 - protein, 5 aa, Mycobacterium
HPPEQ

SEQ ID NO: 399287 - protein, 8 aa, Mycobacterium
HPPNPKAT

SEQ ID NO: 399288 - protein, 11 aa, Mycobacterium
HPPYGHNGERA

SEQ ID NO: 399289 - protein, 5 aa, Mycobacterium
HPRDD

SEQ ID NO: 399290 - protein, 6 aa, Mycobacterium
HPRPDF

SEQ ID NO: 399291 - protein, 8 aa, Mycobacterium
HPRRDTTM

SEQ ID NO: 399292 - protein, 5 aa, Mycobacterium
HPRSG

SEQ ID NO: 399293 - protein, 4 aa, Mycobacterium
HPSA

SEQ ID NO: 399294 - protein, 5 aa, Mycobacterium
HPSAS

SEQ ID NO: 399295 - protein, 9 aa, Mycobacterium
HPSKNPVRT

SEQ ID NO: 399296 - protein, 5 aa, Mycobacterium
HPTEI

SEQ ID NO: 399297 - protein, 5 aa, Mycobacterium
HPTES

SEQ ID NO: 399298 - protein, 8 aa, Mycobacterium
HPTETRRR

SEQ ID NO: 399299 - protein, 5 aa, Mycobacterium
HPTQS

SEQ ID NO: 399300 - protein, 11 aa, Mycobacterium
HPTTSPFGNPI

SEQ ID NO: 399301 - protein, 4 aa, Mycobacterium
HQAH

SEQ ID NO: 399302 - protein, 4 aa, Mycobacterium
HQAT

SEQ ID NO: 399303 - protein, 11 aa, Mycobacterium
HQDSHGGGGLI

SEQ ID NO: 399304 - protein, 4 aa, Mycobacterium
HQGE

SEQ ID NO: 399305 - protein, 15 aa, Mycobacterium
HQGEGVATGKRDQRD

SEQ ID NO: 399306 - protein, 10 aa, Mycobacterium
HQGESAAAFQ

SEQ ID NO: 399307 - protein, 13 aa, Mycobacterium
HQNGDHPINDSAE

SEQ ID NO: 399308 - protein, 17 aa, Mycobacterium
HQNGDHPINDSAEVQRT

SEQ ID NO: 399309 - protein, 10 aa, Mycobacterium
HQNKPDFPPT

SEQ ID NO: 399310 - protein, 10 aa, Mycobacterium
HQQPDGSVRV

SEQ ID NO: 399311 - protein, 8 aa, Mycobacterium
HQSVSTGL

SEQ ID NO: 399312 - protein, 5 aa, Mycobacterium
HQWPT

SEQ ID NO: 399313 - protein, 15 aa, Mycobacterium
HRAEPDLKSGRGGLR

SEQ ID NO: 399314 - protein, 6 aa, Mycobacterium
HRARRE

SEQ ID NO: 399315 - protein, 4 aa, Mycobacterium
HRDA

SEQ ID NO: 399316 - protein, 4 aa, Mycobacterium
HRDR

SEQ ID NO: 399317 - protein, 7 aa, Mycobacterium
HRDTERS

SEQ ID NO: 399318 - protein, 8 aa, Mycobacterium
HRDTTRQR

SEQ ID NO: 399319 - protein, 5 aa, Mycobacterium
HRGAR

SEQ ID NO: 399320 - protein, 5 aa, Mycobacterium
HRGAS

SEQ ID NO: 399321 - protein, 7 aa, Mycobacterium
HRGGDRP

SEQ ID NO: 399322 - protein, 8 aa, Mycobacterium
HRGREGGY

SEQ ID NO: 399323 - protein, 4 aa, Mycobacterium
HRKA

SEQ ID NO: 399324 - protein, 4 aa, Mycobacterium
HRKR

SEQ ID NO: 399325 - protein, 10 aa, Mycobacterium
HRKTDNTTGV

SEQ ID NO: 399326 - protein, 5 aa, Mycobacterium
HRPEV

SEQ ID NO: 399327 - protein, 4 aa, Mycobacterium
HRPG

SEQ ID NO: 399328 - protein, 13 aa, Mycobacterium
HRPGDLSGGQQQR

SEQ ID NO: 399329 - protein, 9 aa, Mycobacterium
HRPGTPSSY

SEQ ID NO: 399330 - protein, 4 aa, Mycobacterium
HRPP

SEQ ID NO: 399331 - protein, 10 aa, Mycobacterium
HRPPDGEPGI

SEQ ID NO: 399332 - protein, 8 aa, Mycobacterium
HRPPYGAS

SEQ ID NO: 399333 - protein, 4 aa, Mycobacterium
HRPQ

SEQ ID NO: 399334 - protein, 6 aa, Mycobacterium
HRQAPV

SEQ ID NO: 399335 - protein, 9 aa, Mycobacterium
HRQRPATAQ

SEQ ID NO: 399336 - protein, 6 aa, Mycobacterium
HRSGGQ

SEQ ID NO: 399337 - protein, 20 aa, Mycobacterium
HRSREAAGLPPAAANVAAAS

SEQ ID NO: 399338 - protein, 8 aa, Mycobacterium
HRSTEPAH

SEQ ID NO: 399339 - protein, 6 aa, Mycobacterium
HRSTNF

SEQ ID NO: 399340 - protein, 5 aa, Mycobacterium
HRSTV

SEQ ID NO: 399341 - protein, 4 aa, Mycobacterium
HRTP

SEQ ID NO: 399342 - protein, 9 aa, Mycobacterium
HRVSGPKGD

SEQ ID NO: 399343 - protein, 6 aa, Mycobacterium
HSAAGL

SEQ ID NO: 399344 - protein, 10 aa, Mycobacterium
HSAETRSEPS

SEQ ID NO: 399345 - protein, 8 aa, Mycobacterium
HSAGSEII

SEQ ID NO: 399346 - protein, 10 aa, Mycobacterium
HSDPKRGEQL

SEQ ID NO: 399347 - protein, 4 aa, Mycobacterium
HSET

SEQ ID NO: 399348 - protein, 12 aa, Mycobacterium
HSETAIDAAGAS

SEQ ID NO: 399349 - protein, 4 aa, Mycobacterium
HSGA

SEQ ID NO: 399350 - protein, 7 aa, Mycobacterium
HSGAARM

SEQ ID NO: 399351 - protein, 9 aa, Mycobacterium
HSGDSTDVG

SEQ ID NO: 399352 - protein, 7 aa, Mycobacterium
HSGLSDR

SEQ ID NO: 399353 - protein, 11 aa, Mycobacterium
HSGPAPQEEYG

SEQ ID NO: 399354 - protein, 5 aa, Mycobacterium
HSGQP

SEQ ID NO: 399355 - protein, 9 aa, Mycobacterium
HSHRRTRRR

SEQ ID NO: 399356 - protein, 10 aa, Mycobacterium
HSHRRTSRRW

SEQ ID NO: 399357 - protein, 6 aa, Mycobacterium
HSNVSY

SEQ ID NO: 399358 - protein, 6 aa, Mycobacterium
HSPEPR

SEQ ID NO: 399359 - protein, 6 aa, Mycobacterium
HSPEYR

SEQ ID NO: 399360 - protein, 15 aa, Mycobacterium
HSPPRAQHHVVWPVQ

SEQ ID NO: 399361 - protein, 9 aa, Mycobacterium
HSPSHPDAT

SEQ ID NO: 399362 - protein, 6 aa, Mycobacterium
HSQADI

SEQ ID NO: 399363 - protein, 7 aa, Mycobacterium
HSQDTSE

SEQ ID NO: 399364 - protein, 6 aa, Mycobacterium
HSRHAP

SEQ ID NO: 399365 - protein, 4 aa, Mycobacterium
HSRR

SEQ ID NO: 399366 - protein, 9 aa, Mycobacterium
HSTAPEGGT

SEQ ID NO: 399367 - protein, 13 aa, Mycobacterium
HSTAPGAQQYSDA

SEQ ID NO: 399368 - protein, 6 aa, Mycobacterium
HSTPGV

SEQ ID NO: 399369 - protein, 6 aa, Mycobacterium
HSTPQA

SEQ ID NO: 399370 - protein, 6 aa, Mycobacterium
HSTSAR

SEQ ID NO: 399371 - protein, 4 aa, Mycobacterium
HSWQ

SEQ ID NO: 399372 - protein, 4 aa, Mycobacterium
HTDP

SEQ ID NO: 399373 - protein, 4 aa, Mycobacterium
HTDQ

SEQ ID NO: 399374 - protein, 5 aa, Mycobacterium
HTEEG

SEQ ID NO: 399375 - protein, 6 aa, Mycobacterium
HTEEPI

SEQ ID NO: 399376 - protein, 4 aa, Mycobacterium
HTGA

SEQ ID NO: 399377 - protein, 9 aa, Mycobacterium
HTGPVHEGD

SEQ ID NO: 399378 - protein, 10 aa, Mycobacterium
HTGPVHEGDT

SEQ ID NO: 399379 - protein, 6 aa, Mycobacterium
HTGQPA

SEQ ID NO: 399380 - protein, 4 aa, Mycobacterium
HTGS

SEQ ID NO: 399381 - protein, 5 aa, Mycobacterium
HTHGR

SEQ ID NO: 399382 - protein, 9 aa, Mycobacterium
HTKKKESEI

SEQ ID NO: 399383 - protein, 4 aa, Mycobacterium
HTPF

SEQ ID NO: 399384 - protein, 6 aa, Mycobacterium
HTQPGD

SEQ ID NO: 399385 - protein, 6 aa, Mycobacterium
HTRAES

SEQ ID NO: 399386 - protein, 7 aa, Mycobacterium
HTRPEDV

SEQ ID NO: 399387 - protein, 6 aa, Mycobacterium
HTSEGW

SEQ ID NO: 399388 - protein, 9 aa, Mycobacterium
HTSTAGTDA

SEQ ID NO: 399389 - protein, 5 aa, Mycobacterium
HTSVN

SEQ ID NO: 399390 - protein, 4 aa, Mycobacterium
HTTE

SEQ ID NO: 399391 - protein, 6 aa, Mycobacterium
HVPGQS

SEQ ID NO: 399392 - protein, 5 aa, Mycobacterium
HVTTE

SEQ ID NO: 399393 - protein, 12 aa, Mycobacterium
HYGGSTARSGGG

SEQ ID NO: 399394 - protein, 6 aa, Mycobacterium
HYPSDN

SEQ ID NO: 399395 - protein, 7 aa, Mycobacterium
IAAATGD

SEQ ID NO: 399396 - protein, 9 aa, Mycobacterium
IAADGGTAI

SEQ ID NO: 399397 - protein, 8 aa, Mycobacterium
IAAEEGAA

SEQ ID NO: 399398 - protein, 5 aa, Mycobacterium
IAAGQ

SEQ ID NO: 399399 - protein, 5 aa, Mycobacterium
IAAGR

SEQ ID NO: 399400 - protein, 10 aa, Mycobacterium
IAAKESNQLM

SEQ ID NO: 399401 - protein, 7 aa, Mycobacterium
IAATEAE

SEQ ID NO: 399402 - protein, 9 aa, Mycobacterium
IADGRHDDQ

SEQ ID NO: 399403 - protein, 4 aa, Mycobacterium
IADP

SEQ ID NO: 399404 - protein, 7 aa, Mycobacterium
IAEAEGA

SEQ ID NO: 399405 - protein, 6 aa, Mycobacterium
IAEATG

SEQ ID NO: 399406 - protein, 4 aa, Mycobacterium
IAED

SEQ ID NO: 399407 - protein, 6 aa, Mycobacterium
IAEGGT

SEQ ID NO: 399408 - protein, 15 aa, Mycobacterium
IAETKKADLNANDID

SEQ ID NO: 399409 - protein, 7 aa, Mycobacterium
IAGEKLP

SEQ ID NO: 399410 - protein, 5 aa, Mycobacterium
IAGGL

SEQ ID NO: 399411 - protein, 8 aa, Mycobacterium
IAGGTSEI

SEQ ID NO: 399412 - protein, 14 aa, Mycobacterium
IAGNRGQTNYATTK

SEQ ID NO: 399413 - protein, 14 aa, Mycobacterium
IAGNRGQTNYGATK

SEQ ID NO: 399414 - protein, 5 aa, Mycobacterium
IAGPD

SEQ ID NO: 399415 - protein, 5 aa, Mycobacterium
IAGPG

SEQ ID NO: 399416 - protein, 10 aa, Mycobacterium
IAGPNADGDD

SEQ ID NO: 399417 - protein, 15 aa, Mycobacterium
IAGRPAASIEQHDGQ

SEQ ID NO: 399418 - protein, 6 aa, Mycobacterium
IAKAPK

SEQ ID NO: 399419 - protein, 5 aa, Mycobacterium
IAPGA

SEQ ID NO: 399420 - protein, 9 aa, Mycobacterium
IAPPPQEAL

SEQ ID NO: 399421 - protein, 6 aa, Mycobacterium
IAQNAA

SEQ ID NO: 399422 - protein, 10 aa, Mycobacterium
IAQSRAAGDG

SEQ ID NO: 399423 - protein, 4 aa, Mycobacterium
IARR

SEQ ID NO: 399424 - protein, 4 aa, Mycobacterium
IASE

SEQ ID NO: 399425 - protein, 14 aa, Mycobacterium
IATDSTAAVPAPDR

SEQ ID NO: 399426 - protein, 14 aa, Mycobacterium
IATDSTAVVPGPDR

SEQ ID NO: 399427 - protein, 5 aa, Mycobacterium
IATGA

SEQ ID NO: 399428 - protein, 7 aa, Mycobacterium
IATNEPK

SEQ ID NO: 399429 - protein, 8 aa, Mycobacterium
IATNPRAQ

SEQ ID NO: 399430 - protein, 8 aa, Mycobacterium
IATPGDGQ

SEQ ID NO: 399431 - protein, 8 aa, Mycobacterium
IATTASYQ

SEQ ID NO: 399432 - protein, 8 aa, Mycobacterium
IATTGERI

SEQ ID NO: 399433 - protein, 13 aa, Mycobacterium
IATTRAAAGPGPL

SEQ ID NO: 399434 - protein, 4 aa, Mycobacterium
IDAG

SEQ ID NO: 399435 - protein, 4 aa, Mycobacterium
IDAS

SEQ ID NO: 399436 - protein, 4 aa, Mycobacterium
IDDE

SEQ ID NO: 399437 - protein, 5 aa, Mycobacterium
IDDGP

SEQ ID NO: 399438 - protein, 6 aa, Mycobacterium
IDEAGG

SEQ ID NO: 399439 - protein, 5 aa, Mycobacterium
IDEGA

SEQ ID NO: 399440 - protein, 20 aa, Mycobacterium
IDEGTKPGRTTGESGELREA

SEQ ID NO: 399441 - protein, 4 aa, Mycobacterium
IDES

SEQ ID NO: 399442 - protein, 9 aa, Mycobacterium
IDGEKLSDD

SEQ ID NO: 399443 - protein, 9 aa, Mycobacterium
IDGEKLSDE

SEQ ID NO: 399444 - protein, 14 aa, Mycobacterium
IDGGQRHGATSEEL

SEQ ID NO: 399445 - protein, 4 aa, Mycobacterium
IDGP

SEQ ID NO: 399446 - protein, 6 aa, Mycobacterium
IDGPRS

SEQ ID NO: 399447 - protein, 4 aa, Mycobacterium
IDGQ

SEQ ID NO: 399448 - protein, 9 aa, Mycobacterium
IDGSVTPTL

SEQ ID NO: 399449 - protein, 6 aa, Mycobacterium
IDGTGY

SEQ ID NO: 399450 - protein, 7 aa, Mycobacterium
IDGYPEG

SEQ ID NO: 399451 - protein, 7 aa, Mycobacterium
IDHETGR

SEQ ID NO: 399452 - protein, 11 aa, Mycobacterium
IDKEGADPAKI

SEQ ID NO: 399453 - protein, 7 aa, Mycobacterium
IDKSTEK

SEQ ID NO: 399454 - protein, 7 aa, Mycobacterium
IDNGRDP

SEQ ID NO: 399455 - protein, 6 aa, Mycobacterium
IDNPDS

SEQ ID NO: 399456 - protein, 9 aa, Mycobacterium
IDPDPRRRF

SEQ ID NO: 399457 - protein, 8 aa, Mycobacterium
IDPEETSE

SEQ ID NO: 399458 - protein, 6 aa, Mycobacterium
IDPRNG

SEQ ID NO: 399459 - protein, 8 aa, Mycobacterium
IDPTPGLA

SEQ ID NO: 399460 - protein, 16 aa, Mycobacterium
IDQAEEDLAERSTPTT

SEQ ID NO: 399461 - protein, 5 aa, Mycobacterium
IDQDR

SEQ ID NO: 399462 - protein, 5 aa, Mycobacterium
IDRSQ

SEQ ID NO: 399463 - protein, 4 aa, Mycobacterium
IDST

SEQ ID NO: 399464 - protein, 6 aa, Mycobacterium
IDTGDK

SEQ ID NO: 399465 - protein, 6 aa, Mycobacterium
IDTGRE

SEQ ID NO: 399466 - protein, 11 aa, Mycobacterium
IDTSAYPPMGP

SEQ ID NO: 399467 - protein, 8 aa, Mycobacterium
IEADSDRD

SEQ ID NO: 399468 - protein, 5 aa, Mycobacterium
IEATA

SEQ ID NO: 399469 - protein, 4 aa, Mycobacterium
IEDP

SEQ ID NO: 399470 - protein, 15 aa, Mycobacterium
IEDPDYAPTPEALGQ

SEQ ID NO: 399471 - protein, 7 aa, Mycobacterium
IEGERGN

SEQ ID NO: 399472 - protein, 7 aa, Mycobacterium
IEGGRGG

SEQ ID NO: 399473 - protein, 7 aa, Mycobacterium
IEGRESF

SEQ ID NO: 399474 - protein, 5 aa, Mycobacterium
IENDA

SEQ ID NO: 399475 - protein, 8 aa, Mycobacterium
IENGTKLG

SEQ ID NO: 399476 - protein, 4 aa, Mycobacterium
IEPD

SEQ ID NO: 399477 - protein, 7 aa, Mycobacterium
IEPGQRY

SEQ ID NO: 399478 - protein, 5 aa, Mycobacterium
IEPNT

SEQ ID NO: 399479 - protein, 8 aa, Mycobacterium
IEPTRRQP

SEQ ID NO: 399480 - protein, 7 aa, Mycobacterium
IEQTRAH

SEQ ID NO: 399481 - protein, 4 aa, Mycobacterium
IERQ

SEQ ID NO: 399482 - protein, 7 aa, Mycobacterium
IERSGRS

SEQ ID NO: 399483 - protein, 10 aa, Mycobacterium
IESSANGLGR

SEQ ID NO: 399484 - protein, 4 aa, Mycobacterium
IETS

SEQ ID NO: 399485 - protein, 4 aa, Mycobacterium
IGAA

SEQ ID NO: 399486 - protein, 6 aa, Mycobacterium
IGADPA

SEQ ID NO: 399487 - protein, 6 aa, Mycobacterium
IGAERD

SEQ ID NO: 399488 - protein, 7 aa, Mycobacterium
IGAERDI

SEQ ID NO: 399489 - protein, 8 aa, Mycobacterium
IGAGGFDD

SEQ ID NO: 399490 - protein, 11 aa, Mycobacterium
IGAGQNGLADN

SEQ ID NO: 399491 - protein, 5 aa, Mycobacterium
IGAHG

SEQ ID NO: 399492 - protein, 4 aa, Mycobacterium
IGAN

SEQ ID NO: 399493 - protein, 12 aa, Mycobacterium
IGASKKDGQRAK

SEQ ID NO: 399494 - protein, 4 aa, Mycobacterium
IGAT

SEQ ID NO: 399495 - protein, 12 aa, Mycobacterium
IGATKKDGQRAK

SEQ ID NO: 399496 - protein, 7 aa, Mycobacterium
IGDHGEE

SEQ ID NO: 399497 - protein, 7 aa, Mycobacterium
IGDPDRV

SEQ ID NO: 399498 - protein, 7 aa, Mycobacterium
IGDPNLG

SEQ ID NO: 399499 - protein, 9 aa, Mycobacterium
IGDSPETGV

SEQ ID NO: 399500 - protein, 5 aa, Mycobacterium
IGDVD

SEQ ID NO: 399501 - protein, 4 aa, Mycobacterium
IGEG

SEQ ID NO: 399502 - protein, 5 aa, Mycobacterium
IGENT

SEQ ID NO: 399503 - protein, 15 aa, Mycobacterium
IGEPEPAGRPADPPF

SEQ ID NO: 399504 - protein, 9 aa, Mycobacterium
IGEPGNAGT

SEQ ID NO: 399505 - protein, 4 aa, Mycobacterium
IGES

SEQ ID NO: 399506 - protein, 5 aa, Mycobacterium
IGESR

SEQ ID NO: 399507 - protein, 14 aa, Mycobacterium
IGFPPTPSGHTRTY

SEQ ID NO: 399508 - protein, 5 aa, Mycobacterium
IGGAR

SEQ ID NO: 399509 - protein, 6 aa, Mycobacterium
IGGASD

SEQ ID NO: 399510 - protein, 6 aa, Mycobacterium
IGGDDA

SEQ ID NO: 399511 - protein, 6 aa, Mycobacterium
IGGDPV

SEQ ID NO: 399512 - protein, 6 aa, Mycobacterium
IGGEDA

SEQ ID NO: 399513 - protein, 8 aa, Mycobacterium
IGGENRAK

SEQ ID NO: 399514 - protein, 14 aa, Mycobacterium
IGGKAERDARTDEL

SEQ ID NO: 399515 - protein, 4 aa, Mycobacterium
IGGP

SEQ ID NO: 399516 - protein, 7 aa, Mycobacterium
IGGPQPV

SEQ ID NO: 399517 - protein, 6 aa, Mycobacterium
IGGPTA

SEQ ID NO: 399518 - protein, 7 aa, Mycobacterium
IGGQGPQ

SEQ ID NO: 399519 - protein, 8 aa, Mycobacterium
IGGSEDIG

SEQ ID NO: 399520 - protein, 4 aa, Mycobacterium
IGGT

SEQ ID NO: 399521 - protein, 4 aa, Mycobacterium
IGGV

SEQ ID NO: 399522 - protein, 5 aa, Mycobacterium
IGHTG

SEQ ID NO: 399523 - protein, 8 aa, Mycobacterium
IGHTQPRR

SEQ ID NO: 399524 - protein, 4 aa, Mycobacterium
IGKT

SEQ ID NO: 399525 - protein, 22 aa, Mycobacterium
IGNGGAGGTGGSGAAGGNGGAG

SEQ ID NO: 399526 - protein, 7 aa, Mycobacterium
IGNGVGD

SEQ ID NO: 399527 - protein, 8 aa, Mycobacterium
IGNSGTNN

SEQ ID NO: 399528 - protein, 5 aa, Mycobacterium
IGNTR

SEQ ID NO: 399529 - protein, 7 aa, Mycobacterium
IGNTTPA

SEQ ID NO: 399530 - protein, 4 aa, Mycobacterium
IGPA

SEQ ID NO: 399531 - protein, 5 aa, Mycobacterium
IGPDT

SEQ ID NO: 399532 - protein, 5 aa, Mycobacterium
IGPDV

SEQ ID NO: 399533 - protein, 8 aa, Mycobacterium
IGPEEYPA

SEQ ID NO: 399534 - protein, 6 aa, Mycobacterium
IGPESV

SEQ ID NO: 399535 - protein, 4 aa, Mycobacterium
IGPG

SEQ ID NO: 399536 - protein, 6 aa, Mycobacterium
IGPGNL

SEQ ID NO: 399537 - protein, 6 aa, Mycobacterium
IGPGSV

SEQ ID NO: 399538 - protein, 5 aa, Mycobacterium
IGPQL

SEQ ID NO: 399539 - protein, 11 aa, Mycobacterium
IGPSGSGKSTL

SEQ ID NO: 399540 - protein, 9 aa, Mycobacterium
IGPSPAEAD

SEQ ID NO: 399541 - protein, 23 aa, Mycobacterium
IGPTTRTASISPDVNDPGARNVS

SEQ ID NO: 399542 - protein, 12 aa, Mycobacterium
IGQGKGKDSGVT

SEQ ID NO: 399543 - protein, 11 aa, Mycobacterium
IGQPKAGATTA

SEQ ID NO: 399544 - protein, 10 aa, Mycobacterium
IGRDPKEIAR

SEQ ID NO: 399545 - protein, 6 aa, Mycobacterium
IGRGEH

SEQ ID NO: 399546 - protein, 7 aa, Mycobacterium
IGRGQDA

SEQ ID NO: 399547 - protein, 6 aa, Mycobacterium
IGRGRH

SEQ ID NO: 399548 - protein, 5 aa, Mycobacterium
IGRKT

SEQ ID NO: 399549 - protein, 4 aa, Mycobacterium
IGRR

SEQ ID NO: 399550 - protein, 4 aa, Mycobacterium
IGRS

SEQ ID NO: 399551 - protein, 9 aa, Mycobacterium
IGRSSTEDT

SEQ ID NO: 399552 - protein, 4 aa, Mycobacterium
IGSD

SEQ ID NO: 399553 - protein, 11 aa, Mycobacterium
IGSETGRIHGA

SEQ ID NO: 399554 - protein, 10 aa, Mycobacterium
IGSGLSSSAA

SEQ ID NO: 399555 - protein, 4 aa, Mycobacterium
IGSH

SEQ ID NO: 399556 - protein, 4 aa, Mycobacterium
IGTA

SEQ ID NO: 399557 - protein, 4 aa, Mycobacterium
IGTD

SEQ ID NO: 399558 - protein, 4 aa, Mycobacterium
IGTP

SEQ ID NO: 399559 - protein, 29 aa, Mycobacterium
IGTSGAEIGGAFGGEKETGGGRESGSDSW

SEQ ID NO: 399560 - protein, 28 aa, Mycobacterium
IGTSGAEIGGAFGGEKQTGGGRESGSDA

SEQ ID NO: 399561 - protein, 6 aa, Mycobacterium
IGTSKA

SEQ ID NO: 399562 - protein, 5 aa, Mycobacterium
IHPTG

SEQ ID NO: 399563 - protein, 7 aa, Mycobacterium
IKDPELR

SEQ ID NO: 399564 - protein, 6 aa, Mycobacterium
IKDSLS

SEQ ID NO: 399565 - protein, 7 aa, Mycobacterium
IKETGAD

SEQ ID NO: 399566 - protein, 8 aa, Mycobacterium
IKGSDTAA

SEQ ID NO: 399567 - protein, 10 aa, Mycobacterium
IKNAQGPEIE

SEQ ID NO: 399568 - protein, 4 aa, Mycobacterium
IKNG

SEQ ID NO: 399569 - protein, 7 aa, Mycobacterium
IKPQART

SEQ ID NO: 399570 - protein, 7 aa, Mycobacterium
IKRPGTD

SEQ ID NO: 399571 - protein, 11 aa, Mycobacterium
INATKGKKERL

SEQ ID NO: 399572 - protein, 4 aa, Mycobacterium
INDP

SEQ ID NO: 399573 - protein, 4 aa, Mycobacterium
INGD

SEQ ID NO: 399574 - protein, 18 aa, Mycobacterium
INGGPAKPTDKPPRPFEE

SEQ ID NO: 399575 - protein, 8 aa, Mycobacterium
INGKSPQA

SEQ ID NO: 399576 - protein, 4 aa, Mycobacterium
INPG

SEQ ID NO: 399577 - protein, 5 aa, Mycobacterium
INPGF

SEQ ID NO: 399578 - protein, 6 aa, Mycobacterium
INPQAD

SEQ ID NO: 399579 - protein, 13 aa, Mycobacterium
INSRPERRDPPTR

SEQ ID NO: 399580 - protein, 9 aa, Mycobacterium
INTHGGQLG

SEQ ID NO: 399581 - protein, 7 aa, Mycobacterium
INTSEDR

SEQ ID NO: 399582 - protein, 7 aa, Mycobacterium
INTVTGN

SEQ ID NO: 399583 - protein, 4 aa, Mycobacterium
IPAA

SEQ ID NO: 399584 - protein, 4 aa, Mycobacterium
IPAD

SEQ ID NO: 399585 - protein, 9 aa, Mycobacterium
IPADPGGGI

SEQ ID NO: 399586 - protein, 4 aa, Mycobacterium
IPAE

SEQ ID NO: 399587 - protein, 5 aa, Mycobacterium
IPAGG

SEQ ID NO: 399588 - protein, 8 aa, Mycobacterium
IPAGRTDE

SEQ ID NO: 399589 - protein, 17 aa, Mycobacterium
IPAPKIKSGSANPSPKL

SEQ ID NO: 399590 - protein, 6 aa, Mycobacterium
IPAPPT

SEQ ID NO: 399591 - protein, 5 aa, Mycobacterium
IPATQ

SEQ ID NO: 399592 - protein, 14 aa, Mycobacterium
IPATQKALKKSGLS

SEQ ID NO: 399593 - protein, 9 aa, Mycobacterium
IPEAASDEW

SEQ ID NO: 399594 - protein, 6 aa, Mycobacterium
IPEGTV

SEQ ID NO: 399595 - protein, 6 aa, Mycobacterium
IPENEH

SEQ ID NO: 399596 - protein, 4 aa, Mycobacterium
IPER

SEQ ID NO: 399597 - protein, 6 aa, Mycobacterium
IPERGG

SEQ ID NO: 399598 - protein, 4 aa, Mycobacterium
IPGA

SEQ ID NO: 399599 - protein, 9 aa, Mycobacterium
IPGATVEEA

SEQ ID NO: 399600 - protein, 6 aa, Mycobacterium
IPGDEP

SEQ ID NO: 399601 - protein, 4 aa, Mycobacterium
IPGG

SEQ ID NO: 399602 - protein, 6 aa, Mycobacterium
IPGGQL

SEQ ID NO: 399603 - protein, 7 aa, Mycobacterium
IPGPASL

SEQ ID NO: 399604 - protein, 5 aa, Mycobacterium
IPGPR

SEQ ID NO: 399605 - protein, 4 aa, Mycobacterium
IPGQ

SEQ ID NO: 399606 - protein, 6 aa, Mycobacterium
IPGRNG

SEQ ID NO: 399607 - protein, 6 aa, Mycobacterium
IPKPTV

SEQ ID NO: 399608 - protein, 7 aa, Mycobacterium
IPLPDNS

SEQ ID NO: 399609 - protein, 4 aa, Mycobacterium
IPPD

SEQ ID NO: 399610 - protein, 4 aa, Mycobacterium
IPPE

SEQ ID NO: 399611 - protein, 4 aa, Mycobacterium
IPPG

SEQ ID NO: 399612 - protein, 5 aa, Mycobacterium
IPPPV

SEQ ID NO: 399613 - protein, 5 aa, Mycobacterium
IPPQQ

SEQ ID NO: 399614 - protein, 4 aa, Mycobacterium
IPPR

SEQ ID NO: 399615 - protein, 7 aa, Mycobacterium
IPPTADE

SEQ ID NO: 399616 - protein, 5 aa, Mycobacterium
IPRDE

SEQ ID NO: 399617 - protein, 10 aa, Mycobacterium
IPRGAGGELQ

SEQ ID NO: 399618 - protein, 4 aa, Mycobacterium
IPSE

SEQ ID NO: 399619 - protein, 9 aa, Mycobacterium
IPSPGRPSV

SEQ ID NO: 399620 - protein, 5 aa, Mycobacterium
IPSPH

SEQ ID NO: 399621 - protein, 4 aa, Mycobacterium
IPTG

SEQ ID NO: 399622 - protein, 5 aa, Mycobacterium
IPTTA

SEQ ID NO: 399623 - protein, 10 aa, Mycobacterium
IPTTRRAEAR

SEQ ID NO: 399624 - protein, 9 aa, Mycobacterium
IQAATGRPL

SEQ ID NO: 399625 - protein, 13 aa, Mycobacterium
IQANGDTDFAGSR

SEQ ID NO: 399626 - protein, 12 aa, Mycobacterium
IQEAREACGGAG

SEQ ID NO: 399627 - protein, 4 aa, Mycobacterium
IQGE

SEQ ID NO: 399628 - protein, 15 aa, Mycobacterium
IQGEPDASSFPSGGL

SEQ ID NO: 399629 - protein, 17 aa, Mycobacterium
IQPEDDQDTSEFTDEQR

SEQ ID NO: 399630 - protein, 4 aa, Mycobacterium
IQPG

SEQ ID NO: 399631 - protein, 7 aa, Mycobacterium
IQPGEAA

SEQ ID NO: 399632 - protein, 7 aa, Mycobacterium
IQPPGKK

SEQ ID NO: 399633 - protein, 14 aa, Mycobacterium
IQRDRPDEAGYRGE

SEQ ID NO: 399634 - protein, 7 aa, Mycobacterium
IQRGEDR

SEQ ID NO: 399635 - protein, 6 aa, Mycobacterium
IQRQSP

SEQ ID NO: 399636 - protein, 5 aa, Mycobacterium
IRAGE

SEQ ID NO: 399637 - protein, 5 aa, Mycobacterium
IRGGA

SEQ ID NO: 399638 - protein, 7 aa, Mycobacterium
IRGGDAD

SEQ ID NO: 399639 - protein, 6 aa, Mycobacterium
IRKEGK

SEQ ID NO: 399640 - protein, 5 aa, Mycobacterium
IRKGQ

SEQ ID NO: 399641 - protein, 6 aa, Mycobacterium
IRNGAD

SEQ ID NO: 399642 - protein, 6 aa, Mycobacterium
IRPDGQ

SEQ ID NO: 399643 - protein, 7 aa, Mycobacterium
IRPGKGE

SEQ ID NO: 399644 - protein, 6 aa, Mycobacterium
IRPPQR

SEQ ID NO: 399645 - protein, 4 aa, Mycobacterium
IRTG

SEQ ID NO: 399646 - protein, 5 aa, Mycobacterium
ISAGG

SEQ ID NO: 399647 - protein, 12 aa, Mycobacterium
ISAGSDAATALR

SEQ ID NO: 399648 - protein, 17 aa, Mycobacterium
ISDNKQRAKVATGFAKP

SEQ ID NO: 399649 - protein, 7 aa, Mycobacterium
ISDTEGR

SEQ ID NO: 399650 - protein, 6 aa, Mycobacterium
ISEDDW

SEQ ID NO: 399651 - protein, 11 aa, Mycobacterium
ISEGGGVYSRE

SEQ ID NO: 399652 - protein, 9 aa, Mycobacterium
ISEPGNAGT

SEQ ID NO: 399653 - protein, 10 aa, Mycobacterium
ISEPKTTRVG

SEQ ID NO: 399654 - protein, 11 aa, Mycobacterium
ISGDPTVTDGS

SEQ ID NO: 399655 - protein, 25 aa, Mycobacterium
ISGGEEGALNGPSIMPGGPAESYES

SEQ ID NO: 399656 - protein, 8 aa, Mycobacterium
ISGNKGDS

SEQ ID NO: 399657 - protein, 8 aa, Mycobacterium
ISGPTDQI

SEQ ID NO: 399658 - protein, 4 aa, Mycobacterium
ISGT

SEQ ID NO: 399659 - protein, 10 aa, Mycobacterium
ISGTGYDRTY

SEQ ID NO: 399660 - protein, 8 aa, Mycobacterium
ISKGERVS

SEQ ID NO: 399661 - protein, 6 aa, Mycobacterium
ISLGDG

SEQ ID NO: 399662 - protein, 7 aa, Mycobacterium
ISPEKAA

SEQ ID NO: 399663 - protein, 5 aa, Mycobacterium
ISPEQ

SEQ ID NO: 399664 - protein, 9 aa, Mycobacterium
ISPSGPRLA

SEQ ID NO: 399665 - protein, 6 aa, Mycobacterium
ISPTET

SEQ ID NO: 399666 - protein, 4 aa, Mycobacterium
ISPV

SEQ ID NO: 399667 - protein, 7 aa, Mycobacterium
ISPYPVS

SEQ ID NO: 399668 - protein, 5 aa, Mycobacterium
ISRDP

SEQ ID NO: 399669 - protein, 5 aa, Mycobacterium
ISRKA

SEQ ID NO: 399670 - protein, 7 aa, Mycobacterium
ISSANGR

SEQ ID NO: 399671 - protein, 18 aa, Mycobacterium
ISSSSEIPPSTPDDLAET

SEQ ID NO: 399672 - protein, 8 aa, Mycobacterium
ISTAGARA

SEQ ID NO: 399673 - protein, 7 aa, Mycobacterium
ISTEEAK

SEQ ID NO: 399674 - protein, 10 aa, Mycobacterium
ISTEEAKEQM

SEQ ID NO: 399675 - protein, 6 aa, Mycobacterium
ISTPRY

SEQ ID NO: 399676 - protein, 12 aa, Mycobacterium
ITAADLDGEPTL

SEQ ID NO: 399677 - protein, 4 aa, Mycobacterium
ITAE

SEQ ID NO: 399678 - protein, 8 aa, Mycobacterium
ITAGGTKL

SEQ ID NO: 399679 - protein, 4 aa, Mycobacterium
ITDE

SEQ ID NO: 399680 - protein, 4 aa, Mycobacterium
ITDP

SEQ ID NO: 399681 - protein, 7 aa, Mycobacterium
ITDPGRI

SEQ ID NO: 399682 - protein, 10 aa, Mycobacterium
ITDTEGLTTL

SEQ ID NO: 399683 - protein, 14 aa, Mycobacterium
ITEETGAQISIEDD

SEQ ID NO: 399684 - protein, 6 aa, Mycobacterium
ITGEPL

SEQ ID NO: 399685 - protein, 10 aa, Mycobacterium
ITGGDSGIGR

SEQ ID NO: 399686 - protein, 5 aa, Mycobacterium
ITGPA

SEQ ID NO: 399687 - protein, 5 aa, Mycobacterium
ITGPG

SEQ ID NO: 399688 - protein, 8 aa, Mycobacterium
ITGPITGY

SEQ ID NO: 399689 - protein, 5 aa, Mycobacterium
ITNGQ

SEQ ID NO: 399690 - protein, 9 aa, Mycobacterium
ITNSGTDIT

SEQ ID NO: 399691 - protein, 4 aa, Mycobacterium
ITPA

SEQ ID NO: 399692 - protein, 7 aa, Mycobacterium
ITPDDDE

SEQ ID NO: 399693 - protein, 6 aa, Mycobacterium
ITPDEA

SEQ ID NO: 399694 - protein, 7 aa, Mycobacterium
ITPDEAR

SEQ ID NO: 399695 - protein, 7 aa, Mycobacterium
ITPDGGK

SEQ ID NO: 399696 - protein, 8 aa, Mycobacterium
ITPYPPGI

SEQ ID NO: 399697 - protein, 10 aa, Mycobacterium
ITQPDGPSFT

SEQ ID NO: 399698 - protein, 7 aa, Mycobacterium
ITQPQPA

SEQ ID NO: 399699 - protein, 5 aa, Mycobacterium
ITRDA

SEQ ID NO: 399700 - protein, 4 aa, Mycobacterium
ITRE

SEQ ID NO: 399701 - protein, 8 aa, Mycobacterium
ITREGAPP

SEQ ID NO: 399702 - protein, 7 aa, Mycobacterium
ITRGDAE

SEQ ID NO: 399703 - protein, 8 aa, Mycobacterium
ITRGDAEA

SEQ ID NO: 399704 - protein, 13 aa, Mycobacterium
ITRTGRALGPGPL

SEQ ID NO: 399705 - protein, 10 aa, Mycobacterium
ITSAGRHPDS

SEQ ID NO: 399706 - protein, 4 aa, Mycobacterium
ITSG

SEQ ID NO: 399707 - protein, 5 aa, Mycobacterium
ITSGP

SEQ ID NO: 399708 - protein, 10 aa, Mycobacterium
ITSVAGRKGY

SEQ ID NO: 399709 - protein, 10 aa, Mycobacterium
ITTGPLGQGL

SEQ ID NO: 399710 - protein, 4 aa, Mycobacterium
ITVD

SEQ ID NO: 399711 - protein, 8 aa, Mycobacterium
ITVEPGGA

SEQ ID NO: 399712 - protein, 10 aa, Mycobacterium
IYSNPASSFP

SEQ ID NO: 399713 - protein, 4 aa, Mycobacterium
KAAA

SEQ ID NO: 399714 - protein, 5 aa, Mycobacterium
KAAAA

SEQ ID NO: 399715 - protein, 8 aa, Mycobacterium
KAAAANPP

SEQ ID NO: 399716 - protein, 8 aa, Mycobacterium
KAAADSAE

SEQ ID NO: 399717 - protein, 8 aa, Mycobacterium
KAAAPGQI

SEQ ID NO: 399718 - protein, 8 aa, Mycobacterium
KAADAGRP

SEQ ID NO: 399719 - protein, 6 aa, Mycobacterium
KAAGAA

SEQ ID NO: 399720 - protein, 8 aa, Mycobacterium
KAALKDSA

SEQ ID NO: 399721 - protein, 14 aa, Mycobacterium
KAANEDGTFKSDEE

SEQ ID NO: 399722 - protein, 8 aa, Mycobacterium
KAAQQSWP

SEQ ID NO: 399723 - protein, 4 aa, Mycobacterium
KAAR

SEQ ID NO: 399724 - protein, 6 aa, Mycobacterium
KAASDA

SEQ ID NO: 399725 - protein, 15 aa, Mycobacterium
KAATEAGAETASQVG

SEQ ID NO: 399726 - protein, 8 aa, Mycobacterium
KAATLGDD

SEQ ID NO: 399727 - protein, 8 aa, Mycobacterium
KAATSARL

SEQ ID NO: 399728 - protein, 13 aa, Mycobacterium
KADAPSGTAARTA

SEQ ID NO: 399729 - protein, 5 aa, Mycobacterium
KADEV

SEQ ID NO: 399730 - protein, 13 aa, Mycobacterium
KADGIASAEVAGP

SEQ ID NO: 399731 - protein, 8 aa, Mycobacterium
KADLHSGG

SEQ ID NO: 399732 - protein, 7 aa, Mycobacterium
KADNSEL

SEQ ID NO: 399733 - protein, 9 aa, Mycobacterium
KADYGPSIG

SEQ ID NO: 399734 - protein, 7 aa, Mycobacterium
KAEAEEK

SEQ ID NO: 399735 - protein, 9 aa, Mycobacterium
KAEDRQRRE

SEQ ID NO: 399736 - protein, 4 aa, Mycobacterium
KAEN

SEQ ID NO: 399737 - protein, 7 aa, Mycobacterium
KAENQTL

SEQ ID NO: 399738 - protein, 6 aa, Mycobacterium
KAFAAG

SEQ ID NO: 399739 - protein, 7 aa, Mycobacterium
KAFAAGA

SEQ ID NO: 399740 - protein, 5 aa, Mycobacterium
KAGAA

SEQ ID NO: 399741 - protein, 11 aa, Mycobacterium
KAGDPTDPGTI

SEQ ID NO: 399742 - protein, 4 aa, Mycobacterium
KAGH

SEQ ID NO: 399743 - protein, 14 aa, Mycobacterium
KAGKKINKEDGIQR

SEQ ID NO: 399744 - protein, 5 aa, Mycobacterium
KAGLI

SEQ ID NO: 399745 - protein, 5 aa, Mycobacterium
KAGLN

SEQ ID NO: 399746 - protein, 8 aa, Mycobacterium
KAGLNNLT

SEQ ID NO: 399747 - protein, 4 aa, Mycobacterium
KAGN

SEQ ID NO: 399748 - protein, 7 aa, Mycobacterium
KAGNPDI

SEQ ID NO: 399749 - protein, 18 aa, Mycobacterium
KAGSRDTVRSRSFTGKPA

SEQ ID NO: 399750 - protein, 6 aa, Mycobacterium
KAGSRN

SEQ ID NO: 399751 - protein, 4 aa, Mycobacterium
KAHG

SEQ ID NO: 399752 - protein, 5 aa, Mycobacterium
KAHGD

SEQ ID NO: 399753 - protein, 8 aa, Mycobacterium
KAHSTAPA

SEQ ID NO: 399754 - protein, 4 aa, Mycobacterium
KAIT

SEQ ID NO: 399755 - protein, 6 aa, Mycobacterium
KAKAAP

SEQ ID NO: 399756 - protein, 7 aa, Mycobacterium
KAKALGL

SEQ ID NO: 399757 - protein, 8 aa, Mycobacterium
KAKDNRDD

SEQ ID NO: 399758 - protein, 8 aa, Mycobacterium
KAKEVPAA

SEQ ID NO: 399759 - protein, 28 aa, Mycobacterium
KAKKSSVPNENIERARKRGAGEEAGGAD

SEQ ID NO: 399760 - protein, 29 aa, Mycobacterium
KAKKTSVPNDNIERARKRGAGEEAGGADY

SEQ ID NO: 399761 - protein, 9 aa, Mycobacterium
KAKPGRSVD

SEQ ID NO: 399762 - protein, 5 aa, Mycobacterium
KAKSL

SEQ ID NO: 399763 - protein, 9 aa, Mycobacterium
KAKSQKAVN

SEQ ID NO: 399764 - protein, 8 aa, Mycobacterium
KALESGLA

SEQ ID NO: 399765 - protein, 8 aa, Mycobacterium
KALGSQGG

SEQ ID NO: 399766 - protein, 14 aa, Mycobacterium
KALQRGKTTEEKSK

SEQ ID NO: 399767 - protein, 4 aa, Mycobacterium
KAND

SEQ ID NO: 399768 - protein, 6 aa, Mycobacterium
KANMAY

SEQ ID NO: 399769 - protein, 10 aa, Mycobacterium
KANRAAYDPR

SEQ ID NO: 399770 - protein, 4 aa, Mycobacterium
KANV

SEQ ID NO: 399771 - protein, 6 aa, Mycobacterium
KAPEAF

SEQ ID NO: 399772 - protein, 4 aa, Mycobacterium
KAPG

SEQ ID NO: 399773 - protein, 10 aa, Mycobacterium
KAPGQRIPRT

SEQ ID NO: 399774 - protein, 20 aa, Mycobacterium
KAPRVNDRRVDPDTGERKRF

SEQ ID NO: 399775 - protein, 9 aa, Mycobacterium
KAPTGSNAQ

SEQ ID NO: 399776 - protein, 11 aa, Mycobacterium
KAPTQGNLPPP

SEQ ID NO: 399777 - protein, 10 aa, Mycobacterium
KAQRDSDRNA

SEQ ID NO: 399778 - protein, 4 aa, Mycobacterium
KAQV

SEQ ID NO: 399779 - protein, 4 aa, Mycobacterium
KARA

SEQ ID NO: 399780 - protein, 7 aa, Mycobacterium
KARAGEI

SEQ ID NO: 399781 - protein, 7 aa, Mycobacterium
KARDRAR

SEQ ID NO: 399782 - protein, 8 aa, Mycobacterium
KAREVRGA

SEQ ID NO: 399783 - protein, 6 aa, Mycobacterium
KARGAD

SEQ ID NO: 399784 - protein, 6 aa, Mycobacterium
KARLGD

SEQ ID NO: 399785 - protein, 6 aa, Mycobacterium
KARRTL

SEQ ID NO: 399786 - protein, 4 aa, Mycobacterium
KASD

SEQ ID NO: 399787 - protein, 5 aa, Mycobacterium
KASDL

SEQ ID NO: 399788 - protein, 8 aa, Mycobacterium
KASKVART

SEQ ID NO: 399789 - protein, 7 aa, Mycobacterium
KASLNGP

SEQ ID NO: 399790 - protein, 7 aa, Mycobacterium
KASRATV

SEQ ID NO: 399791 - protein, 7 aa, Mycobacterium
KATDGRI

SEQ ID NO: 399792 - protein, 4 aa, Mycobacterium
KATG

SEQ ID NO: 399793 - protein, 7 aa, Mycobacterium
KATGVTV

SEQ ID NO: 399794 - protein, 7 aa, Mycobacterium
KATRDDI

SEQ ID NO: 399795 - protein, 8 aa, Mycobacterium
KATVEGRP

SEQ ID NO: 399796 - protein, 13 aa, Mycobacterium
KATVGEATGLDGA

SEQ ID NO: 399797 - protein, 11 aa, Mycobacterium
KAVAEKAKRLE

SEQ ID NO: 399798 - protein, 9 aa, Mycobacterium
KAVGTDTQA

SEQ ID NO: 399799 - protein, 7 aa, Mycobacterium
KAVPIPY

SEQ ID NO: 399800 - protein, 7 aa, Mycobacterium
KAWTGGD

SEQ ID NO: 399801 - protein, 4 aa, Mycobacterium
KAYA

SEQ ID NO: 399802 - protein, 6 aa, Mycobacterium
KAYEGM

SEQ ID NO: 399803 - protein, 4 aa, Mycobacterium
KAYP

SEQ ID NO: 399804 - protein, 7 aa, Mycobacterium
KCSTSRK

SEQ ID NO: 399805 - protein, 5 aa, Mycobacterium
KCTPC

SEQ ID NO: 399806 - protein, 5 aa, Mycobacterium
KDAGE

SEQ ID NO: 399807 - protein, 9 aa, Mycobacterium
KDAPTETDS

SEQ ID NO: 399808 - protein, 4 aa, Mycobacterium
KDAR

SEQ ID NO: 399809 - protein, 9 aa, Mycobacterium
KDCEKAGDW

SEQ ID NO: 399810 - protein, 7 aa, Mycobacterium
KDEDGNL

SEQ ID NO: 399811 - protein, 11 aa, Mycobacterium
KDEDGNPRFSA

SEQ ID NO: 399812 - protein, 9 aa, Mycobacterium
KDGEALARQ

SEQ ID NO: 399813 - protein, 7 aa, Mycobacterium
KDGESMP

SEQ ID NO: 399814 - protein, 7 aa, Mycobacterium
KDGGTVD

SEQ ID NO: 399815 - protein, 5 aa, Mycobacterium
KDGIE

SEQ ID NO: 399816 - protein, 10 aa, Mycobacterium
KDGKSEELKA

SEQ ID NO: 399817 - protein, 9 aa, Mycobacterium
KDGRPKPTA

SEQ ID NO: 399818 - protein, 9 aa, Mycobacterium
KDGRPKPTP

SEQ ID NO: 399819 - protein, 10 aa, Mycobacterium
KDGRPKPTPV

SEQ ID NO: 399820 - protein, 10 aa, Mycobacterium
KDIDAARAEK

SEQ ID NO: 399821 - protein, 6 aa, Mycobacterium
KDKKNR

SEQ ID NO: 399822 - protein, 5 aa, Mycobacterium
KDKSM

SEQ ID NO: 399823 - protein, 10 aa, Mycobacterium
KDLPTADDPR

SEQ ID NO: 399824 - protein, 5 aa, Mycobacterium
KDPAR

SEQ ID NO: 399825 - protein, 7 aa, Mycobacterium
KDPEGMK

SEQ ID NO: 399826 - protein, 4 aa, Mycobacterium
KDPL

SEQ ID NO: 399827 - protein, 8 aa, Mycobacterium
KDPSTPKI

SEQ ID NO: 399828 - protein, 8 aa, Mycobacterium
KDPTLRDE

SEQ ID NO: 399829 - protein, 7 aa, Mycobacterium
KDQDGNV

SEQ ID NO: 399830 - protein, 4 aa, Mycobacterium
KDRA

SEQ ID NO: 399831 - protein, 4 aa, Mycobacterium
KDRE

SEQ ID NO: 399832 - protein, 5 aa, Mycobacterium
KDREL

SEQ ID NO: 399833 - protein, 5 aa, Mycobacterium
KDRQS

SEQ ID NO: 399834 - protein, 6 aa, Mycobacterium
KDRTGF

SEQ ID NO: 399835 - protein, 4 aa, Mycobacterium
KDSI

SEQ ID NO: 399836 - protein, 6 aa, Mycobacterium
KDSPLR

SEQ ID NO: 399837 - protein, 6 aa, Mycobacterium
KDSVIP

SEQ ID NO: 399838 - protein, 4 aa, Mycobacterium
KDTE

SEQ ID NO: 399839 - protein, 5 aa, Mycobacterium
KDVKE

SEQ ID NO: 399840 - protein, 9 aa, Mycobacterium
KDWKGRTPN

SEQ ID NO: 399841 - protein, 6 aa, Mycobacterium
KDWTEP

SEQ ID NO: 399842 - protein, 20 aa, Mycobacterium
KEAADDAKAKLEAAGATVTV

SEQ ID NO: 399843 - protein, 6 aa, Mycobacterium
KEDGID

SEQ ID NO: 399844 - protein, 8 aa, Mycobacterium
KEDLKSTV

SEQ ID NO: 399845 - protein, 9 aa, Mycobacterium
KEDSPRRMP

SEQ ID NO: 399846 - protein, 8 aa, Mycobacterium
KEERPGRK

SEQ ID NO: 399847 - protein, 5 aa, Mycobacterium
KEGAD

SEQ ID NO: 399848 - protein, 5 aa, Mycobacterium
KEGAS

SEQ ID NO: 399849 - protein, 6 aa, Mycobacterium
KEGLRK

SEQ ID NO: 399850 - protein, 23 aa, Mycobacterium
KEGLSTGLGDEGGFAPDVAGTTA

SEQ ID NO: 399851 - protein, 6 aa, Mycobacterium
KEGNER

SEQ ID NO: 399852 - protein, 4 aa, Mycobacterium
KEGQ

SEQ ID NO: 399853 - protein, 8 aa, Mycobacterium
KEGREEAV

SEQ ID NO: 399854 - protein, 10 aa, Mycobacterium
KEHGGGGGSV

SEQ ID NO: 399855 - protein, 6 aa, Mycobacterium
KEHHDH

SEQ ID NO: 399856 - protein, 6 aa, Mycobacterium
KEIPED

SEQ ID NO: 399857 - protein, 7 aa, Mycobacterium
KEIPEDG

SEQ ID NO: 399858 - protein, 8 aa, Mycobacterium
KELAAQNP

SEQ ID NO: 399859 - protein, 5 aa, Mycobacterium
KELDD

SEQ ID NO: 399860 - protein, 10 aa, Mycobacterium
KELEEAGGQA

SEQ ID NO: 399861 - protein, 8 aa, Mycobacterium
KELRNGST

SEQ ID NO: 399862 - protein, 5 aa, Mycobacterium
KENAE

SEQ ID NO: 399863 - protein, 10 aa, Mycobacterium
KENPVERASA

SEQ ID NO: 399864 - protein, 5 aa, Mycobacterium
KEQKV

SEQ ID NO: 399865 - protein, 5 aa, Mycobacterium
KEQLR

SEQ ID NO: 399866 - protein, 8 aa, Mycobacterium
KERAAELG

SEQ ID NO: 399867 - protein, 11 aa, Mycobacterium
KERELPEPDDE

SEQ ID NO: 399868 - protein, 5 aa, Mycobacterium
KERGI

SEQ ID NO: 399869 - protein, 8 aa, Mycobacterium
KERREGDV

SEQ ID NO: 399870 - protein, 4 aa, Mycobacterium
KERV

SEQ ID NO: 399871 - protein, 8 aa, Mycobacterium
KESDGGRA

SEQ ID NO: 399872 - protein, 4 aa, Mycobacterium
KESV

SEQ ID NO: 399873 - protein, 6 aa, Mycobacterium
KETGKE

SEQ ID NO: 399874 - protein, 4 aa, Mycobacterium
KETV

SEQ ID NO: 399875 - protein, 4 aa, Mycobacterium
KEYP

SEQ ID NO: 399876 - protein, 7 aa, Mycobacterium
KFAKDNK

SEQ ID NO: 399877 - protein, 13 aa, Mycobacterium
KFGGDSLTETRRN

SEQ ID NO: 399878 - protein, 9 aa, Mycobacterium
KFSRPNDRR

SEQ ID NO: 399879 - protein, 4 aa, Mycobacterium
KGAE

SEQ ID NO: 399880 - protein, 5 aa, Mycobacterium
KGAGG

SEQ ID NO: 399881 - protein, 10 aa, Mycobacterium
KGDAAKTAKT

SEQ ID NO: 399882 - protein, 9 aa, Mycobacterium
KGDVGEDIP

SEQ ID NO: 399883 - protein, 10 aa, Mycobacterium
KGEDGRYRPA

SEQ ID NO: 399884 - protein, 8 aa, Mycobacterium
KGEDRKQR

SEQ ID NO: 399885 - protein, 14 aa, Mycobacterium
KGEENSGGADKSSI

SEQ ID NO: 399886 - protein, 4 aa, Mycobacterium
KGEY

SEQ ID NO: 399887 - protein, 12 aa, Mycobacterium
KGGDHQVPNARK

SEQ ID NO: 399888 - protein, 7 aa, Mycobacterium
KGGDYLA

SEQ ID NO: 399889 - protein, 5 aa, Mycobacterium
KGGEV

SEQ ID NO: 399890 - protein, 14 aa, Mycobacterium
KGGGSVKCCTLELH

SEQ ID NO: 399891 - protein, 14 aa, Mycobacterium
KGGGSVKCCTLEVF

SEQ ID NO: 399892 - protein, 5 aa, Mycobacterium
KGGLE

SEQ ID NO: 399893 - protein, 6 aa, Mycobacterium
KGGPGW

SEQ ID NO: 399894 - protein, 7 aa, Mycobacterium
KGGPYLA

SEQ ID NO: 399895 - protein, 12 aa, Mycobacterium
KGGVGKTTSTIN

SEQ ID NO: 399896 - protein, 11 aa, Mycobacterium
KGGVGKTTTTI

SEQ ID NO: 399897 - protein, 15 aa, Mycobacterium
KGHGAADWSKRPLPD

SEQ ID NO: 399898 - protein, 6 aa, Mycobacterium
KGISRD

SEQ ID NO: 399899 - protein, 7 aa, Mycobacterium
KGKAQIG

SEQ ID NO: 399900 - protein, 10 aa, Mycobacterium
KGKDKQWDAQ

SEQ ID NO: 399901 - protein, 6 aa, Mycobacterium
KGKLPS

SEQ ID NO: 399902 - protein, 5 aa, Mycobacterium
KGKRV

SEQ ID NO: 399903 - protein, 7 aa, Mycobacterium
KGKRYNS

SEQ ID NO: 399904 - protein, 4 aa, Mycobacterium
KGLA

SEQ ID NO: 399905 - protein, 7 aa, Mycobacterium
KGLSGGM

SEQ ID NO: 399906 - protein, 7 aa, Mycobacterium
KGLSTHD

SEQ ID NO: 399907 - protein, 7 aa, Mycobacterium
KGLSTHE

SEQ ID NO: 399908 - protein, 7 aa, Mycobacterium
KGLTTGE

SEQ ID NO: 399909 - protein, 6 aa, Mycobacterium
KGPDFP

SEQ ID NO: 399910 - protein, 13 aa, Mycobacterium
KGPETEHLLALAG

SEQ ID NO: 399911 - protein, 7 aa, Mycobacterium
KGPEYDR

SEQ ID NO: 399912 - protein, 8 aa, Mycobacterium
KGPGATSI

SEQ ID NO: 399913 - protein, 14 aa, Mycobacterium
KGPSITPRPPQGQP

SEQ ID NO: 399914 - protein, 6 aa, Mycobacterium
KGQETY

SEQ ID NO: 399915 - protein, 8 aa, Mycobacterium
KGQVGAGG

SEQ ID NO: 399916 - protein, 21 aa, Mycobacterium
KGQYSPTSEVGKITKSTPMGS

SEQ ID NO: 399917 - protein, 21 aa, Mycobacterium
KGQYSPTSEVGKVTKSTPMGS

SEQ ID NO: 399918 - protein, 6 aa, Mycobacterium
KGSGDY

SEQ ID NO: 399919 - protein, 6 aa, Mycobacterium
KGSGEV

SEQ ID NO: 399920 - protein, 8 aa, Mycobacterium
KGTAGAAI

SEQ ID NO: 399921 - protein, 4 aa, Mycobacterium
KGTG

SEQ ID NO: 399922 - protein, 8 aa, Mycobacterium
KGTGGAAV

SEQ ID NO: 399923 - protein, 10 aa, Mycobacterium
KGTGVTTRTR

SEQ ID NO: 399924 - protein, 10 aa, Mycobacterium
KGTIDSATKA

SEQ ID NO: 399925 - protein, 10 aa, Mycobacterium
KGTISDGSRY

SEQ ID NO: 399926 - protein, 7 aa, Mycobacterium
KGTPGFE

SEQ ID NO: 399927 - protein, 9 aa, Mycobacterium
KGTRGELAG

SEQ ID NO: 399928 - protein, 15 aa, Mycobacterium
KGTRPDGARYDADDP

SEQ ID NO: 399929 - protein, 12 aa, Mycobacterium
KGTSPSRCTQVG

SEQ ID NO: 399930 - protein, 7 aa, Mycobacterium
KGTTSGY

SEQ ID NO: 399931 - protein, 9 aa, Mycobacterium
KGVAADADY

SEQ ID NO: 399932 - protein, 7 aa, Mycobacterium
KGYGGRT

SEQ ID NO: 399933 - protein, 17 aa, Mycobacterium
KHAHDKRQDLARRDAQR

SEQ ID NO: 399934 - protein, 7 aa, Mycobacterium
KHAPAVT

SEQ ID NO: 399935 - protein, 6 aa, Mycobacterium
KHDREH

SEQ ID NO: 399936 - protein, 4 aa, Mycobacterium
KHDT

SEQ ID NO: 399937 - protein, 9 aa, Mycobacterium
KHESIDDGI

SEQ ID NO: 399938 - protein, 4 aa, Mycobacterium
KHFS

SEQ ID NO: 399939 - protein, 12 aa, Mycobacterium
KHGHPAKNNYGS

SEQ ID NO: 399940 - protein, 10 aa, Mycobacterium
KHGHPPPNGL

SEQ ID NO: 399941 - protein, 5 aa, Mycobacterium
KHGLT

SEQ ID NO: 399942 - protein, 8 aa, Mycobacterium
KHGQGSPF

SEQ ID NO: 399943 - protein, 6 aa, Mycobacterium
KHLSDD

SEQ ID NO: 399944 - protein, 11 aa, Mycobacterium
KHPAPQTYEEA

SEQ ID NO: 399945 - protein, 7 aa, Mycobacterium
KHPERGY

SEQ ID NO: 399946 - protein, 13 aa, Mycobacterium
KHPGDTAPEDRYI

SEQ ID NO: 399947 - protein, 6 aa, Mycobacterium
KHPGEQ

SEQ ID NO: 399948 - protein, 9 aa, Mycobacterium
KHPRGAFTE

SEQ ID NO: 399949 - protein, 6 aa, Mycobacterium
KHREPI

SEQ ID NO: 399950 - protein, 12 aa, Mycobacterium
KHRGRTSGKPYE

SEQ ID NO: 399951 - protein, 9 aa, Mycobacterium
KHSTGGVGD

SEQ ID NO: 399952 - protein, 6 aa, Mycobacterium
KHSVNN

SEQ ID NO: 399953 - protein, 9 aa, Mycobacterium
KHSVNNPYA

SEQ ID NO: 399954 - protein, 13 aa, Mycobacterium
KIAKDRGIGGPIE

SEQ ID NO: 399955 - protein, 12 aa, Mycobacterium
KIAKDRGIGGPV

SEQ ID NO: 399956 - protein, 11 aa, Mycobacterium
KIDPSHTRSKL

SEQ ID NO: 399957 - protein, 8 aa, Mycobacterium
KIEDGKTD

SEQ ID NO: 399958 - protein, 5 aa, Mycobacterium
KIGPA

SEQ ID NO: 399959 - protein, 12 aa, Mycobacterium
KIGQPKAGATTA

SEQ ID NO: 399960 - protein, 7 aa, Mycobacterium
KIGSTVS

SEQ ID NO: 399961 - protein, 11 aa, Mycobacterium
KIGTTGRGIGP

SEQ ID NO: 399962 - protein, 5 aa, Mycobacterium
KIQGI

SEQ ID NO: 399963 - protein, 7 aa, Mycobacterium
KIRDDPR

SEQ ID NO: 399964 - protein, 5 aa, Mycobacterium
KIRTR

SEQ ID NO: 399965 - protein, 12 aa, Mycobacterium
KISEAPVNSEER

SEQ ID NO: 399966 - protein, 6 aa, Mycobacterium
KITNEG

SEQ ID NO: 399967 - protein, 6 aa, Mycobacterium
KIVRSD

SEQ ID NO: 399968 - protein, 5 aa, Mycobacterium
KKGDQ

SEQ ID NO: 399969 - protein, 6 aa, Mycobacterium
KKGEPV

SEQ ID NO: 399970 - protein, 7 aa, Mycobacterium
KKGGPGW

SEQ ID NO: 399971 - protein, 18 aa, Mycobacterium
KKGQKTRRREKKNVPHGA

SEQ ID NO: 399972 - protein, 6 aa, Mycobacterium
KKHGGL

SEQ ID NO: 399973 - protein, 7 aa, Mycobacterium
KKHRDHR

SEQ ID NO: 399974 - protein, 7 aa, Mycobacterium
KKPETIN

SEQ ID NO: 399975 - protein, 8 aa, Mycobacterium
KKPHPSGD

SEQ ID NO: 399976 - protein, 5 aa, Mycobacterium
KKPKF

SEQ ID NO: 399977 - protein, 6 aa, Mycobacterium
KKRRSV

SEQ ID NO: 399978 - protein, 6 aa, Mycobacterium
KKRRTV

SEQ ID NO: 399979 - protein, 10 aa, Mycobacterium
KKSANNAPYH

SEQ ID NO: 399980 - protein, 15 aa, Mycobacterium
KKTPESFPGGDPVEE

SEQ ID NO: 399981 - protein, 8 aa, Mycobacterium
KKTSADFE

SEQ ID NO: 399982 - protein, 8 aa, Mycobacterium
KKTYDPDS

SEQ ID NO: 399983 - protein, 8 aa, Mycobacterium
KLAEEEGW

SEQ ID NO: 399984 - protein, 6 aa, Mycobacterium
KLAGEQ

SEQ ID NO: 399985 - protein, 9 aa, Mycobacterium
KLAPKGTGA

SEQ ID NO: 399986 - protein, 9 aa, Mycobacterium
KLASKQRGI

SEQ ID NO: 399987 - protein, 4 aa, Mycobacterium
KLDG

SEQ ID NO: 399988 - protein, 17 aa, Mycobacterium
KLENGAKAIYNPHYEIQ

SEQ ID NO: 399989 - protein, 17 aa, Mycobacterium
KLENGSKAIYNPHYEIQ

SEQ ID NO: 399990 - protein, 6 aa, Mycobacterium
KLEPGR

SEQ ID NO: 399991 - protein, 7 aa, Mycobacterium
KLGAPGM

SEQ ID NO: 399992 - protein, 9 aa, Mycobacterium
KLGEESQAL

SEQ ID NO: 399993 - protein, 17 aa, Mycobacterium
KLLKDKDPNLTGDDIRE

SEQ ID NO: 399994 - protein, 5 aa, Mycobacterium
KLPAS

SEQ ID NO: 399995 - protein, 5 aa, Mycobacterium
KLPPD

SEQ ID NO: 399996 - protein, 6 aa, Mycobacterium
KLPSGA

SEQ ID NO: 399997 - protein, 8 aa, Mycobacterium
KLSPTVDM

SEQ ID NO: 399998 - protein, 12 aa, Mycobacterium
KLTDFDSNRSGG

SEQ ID NO: 399999 - protein, 8 aa, Mycobacterium
KLTKEQAE

SEQ ID NO: 400000 - protein, 4 aa, Mycobacterium
KMPS

SEQ ID NO: 400001 - protein, 7 aa, Mycobacterium
KMQEQVS

SEQ ID NO: 400002 - protein, 8 aa, Mycobacterium
KMSGSNIR

SEQ ID NO: 400003 - protein, 7 aa, Mycobacterium
KNAAGVS

SEQ ID NO: 400004 - protein, 8 aa, Mycobacterium
KNADESKL

SEQ ID NO: 400005 - protein, 7 aa, Mycobacterium
KNAEAAY

SEQ ID NO: 400006 - protein, 8 aa, Mycobacterium
KNDAEEAQ

SEQ ID NO: 400007 - protein, 6 aa, Mycobacterium
KNDLPT

SEQ ID NO: 400008 - protein, 6 aa, Mycobacterium
KNFGKG

SEQ ID NO: 400009 - protein, 13 aa, Mycobacterium
KNFRNGALNPNAF

SEQ ID NO: 400010 - protein, 7 aa, Mycobacterium
KNGFSGN

SEQ ID NO: 400011 - protein, 6 aa, Mycobacterium
KNGPYL

SEQ ID NO: 400012 - protein, 11 aa, Mycobacterium
KNGTGPAAANG

SEQ ID NO: 400013 - protein, 10 aa, Mycobacterium
KNMDGSDDLT

SEQ ID NO: 400014 - protein, 12 aa, Mycobacterium
KNPFASSPVERS

SEQ ID NO: 400015 - protein, 7 aa, Mycobacterium
KNQPYKH

SEQ ID NO: 400016 - protein, 9 aa, Mycobacterium
KNQTYNTPA

SEQ ID NO: 400017 - protein, 6 aa, Mycobacterium
KNREDG

SEQ ID NO: 400018 - protein, 5 aa, Mycobacterium
KNRLG

SEQ ID NO: 400019 - protein, 8 aa, Mycobacterium
KNSDESKL

SEQ ID NO: 400020 - protein, 10 aa, Mycobacterium
KNVPTSRSES

SEQ ID NO: 400021 - protein, 4 aa, Mycobacterium
KNVV

SEQ ID NO: 400022 - protein, 8 aa, Mycobacterium
KNYDGSWT

SEQ ID NO: 400023 - protein, 6 aa, Mycobacterium
KPAAYT

SEQ ID NO: 400024 - protein, 13 aa, Mycobacterium
KPAEGVPGTERTP

SEQ ID NO: 400025 - protein, 7 aa, Mycobacterium
KPAPDTP

SEQ ID NO: 400026 - protein, 10 aa, Mycobacterium
KPARGGSSIG

SEQ ID NO: 400027 - protein, 6 aa, Mycobacterium
KPATVS

SEQ ID NO: 400028 - protein, 6 aa, Mycobacterium
KPEDRA

SEQ ID NO: 400029 - protein, 4 aa, Mycobacterium
KPEG

SEQ ID NO: 400030 - protein, 15 aa, Mycobacterium
KPEPHNEIPQAQSAH

SEQ ID NO: 400031 - protein, 4 aa, Mycobacterium
KPER

SEQ ID NO: 400032 - protein, 4 aa, Mycobacterium
KPFG

SEQ ID NO: 400033 - protein, 5 aa, Mycobacterium
KPFGL

SEQ ID NO: 400034 - protein, 6 aa, Mycobacterium
KPFKKE

SEQ ID NO: 400035 - protein, 6 aa, Mycobacterium
KPFSRA

SEQ ID NO: 400036 - protein, 5 aa, Mycobacterium
KPFSS

SEQ ID NO: 400037 - protein, 9 aa, Mycobacterium
KPGAGSLSV

SEQ ID NO: 400038 - protein, 4 aa, Mycobacterium
KPGL

SEQ ID NO: 400039 - protein, 7 aa, Mycobacterium
KPGPYPW

SEQ ID NO: 400040 - protein, 4 aa, Mycobacterium
KPGQ

SEQ ID NO: 400041 - protein, 10 aa, Mycobacterium
KPGSGDAPSV

SEQ ID NO: 400042 - protein, 10 aa, Mycobacterium
KPGSMGRPLP

SEQ ID NO: 400043 - protein, 5 aa, Mycobacterium
KPGVG

SEQ ID NO: 400044 - protein, 4 aa, Mycobacterium
KPGW

SEQ ID NO: 400045 - protein, 6 aa, Mycobacterium
KPHSGD

SEQ ID NO: 400046 - protein, 4 aa, Mycobacterium
KPID

SEQ ID NO: 400047 - protein, 6 aa, Mycobacterium
KPIPDA

SEQ ID NO: 400048 - protein, 9 aa, Mycobacterium
KPKAPQSGY

SEQ ID NO: 400049 - protein, 16 aa, Mycobacterium
KPLGGPDGGNGGRGGS

SEQ ID NO: 400050 - protein, 7 aa, Mycobacterium
KPMPNWG

SEQ ID NO: 400051 - protein, 7 aa, Mycobacterium
KPNPRWS

SEQ ID NO: 400052 - protein, 4 aa, Mycobacterium
KPPH

SEQ ID NO: 400053 - protein, 4 aa, Mycobacterium
KPRE

SEQ ID NO: 400054 - protein, 5 aa, Mycobacterium
KPRGR

SEQ ID NO: 400055 - protein, 4 aa, Mycobacterium
KPRI

SEQ ID NO: 400056 - protein, 6 aa, Mycobacterium
KPRLPA

SEQ ID NO: 400057 - protein, 10 aa, Mycobacterium
KPSEKDPSAS

SEQ ID NO: 400058 - protein, 7 aa, Mycobacterium
KPSRGRL

SEQ ID NO: 400059 - protein, 8 aa, Mycobacterium
KPTERERT

SEQ ID NO: 400060 - protein, 4 aa, Mycobacterium
KPTI

SEQ ID NO: 400061 - protein, 12 aa, Mycobacterium
KPTRGEQGKGIT

SEQ ID NO: 400062 - protein, 5 aa, Mycobacterium
KPWPY

SEQ ID NO: 400063 - protein, 9 aa, Mycobacterium
KQAEEATDK

SEQ ID NO: 400064 - protein, 6 aa, Mycobacterium
KQAGVT

SEQ ID NO: 400065 - protein, 8 aa, Mycobacterium
KQARQAAR

SEQ ID NO: 400066 - protein, 8 aa, Mycobacterium
KQATEEVA

SEQ ID NO: 400067 - protein, 10 aa, Mycobacterium
KQGHGEPNPT

SEQ ID NO: 400068 - protein, 4 aa, Mycobacterium
KQHN

SEQ ID NO: 400069 - protein, 7 aa, Mycobacterium
KQHNDGD

SEQ ID NO: 400070 - protein, 4 aa, Mycobacterium
KQKH

SEQ ID NO: 400071 - protein, 6 aa, Mycobacterium
KQNASS

SEQ ID NO: 400072 - protein, 6 aa, Mycobacterium
KQPERQ

SEQ ID NO: 400073 - protein, 9 aa, Mycobacterium
KQPGEARDQ

SEQ ID NO: 400074 - protein, 16 aa, Mycobacterium
KQPKTAPLAGNSIATD

SEQ ID NO: 400075 - protein, 6 aa, Mycobacterium
KQREEW

SEQ ID NO: 400076 - protein, 4 aa, Mycobacterium
KQRR

SEQ ID NO: 400077 - protein, 13 aa, Mycobacterium
KQSAGGLEVRGPQ

SEQ ID NO: 400078 - protein, 6 aa, Mycobacterium
KQSVTA

SEQ ID NO: 400079 - protein, 4 aa, Mycobacterium
KRAA

SEQ ID NO: 400080 - protein, 9 aa, Mycobacterium
KRAAAAQRF

SEQ ID NO: 400081 - protein, 5 aa, Mycobacterium
KRAET

SEQ ID NO: 400082 - protein, 6 aa, Mycobacterium
KRAGVS

SEQ ID NO: 400083 - protein, 13 aa, Mycobacterium
KRAIKQGTELAAR

SEQ ID NO: 400084 - protein, 9 aa, Mycobacterium
KRAPSTISR

SEQ ID NO: 400085 - protein, 6 aa, Mycobacterium
KRAVNQ

SEQ ID NO: 400086 - protein, 5 aa, Mycobacterium
KRDGA

SEQ ID NO: 400087 - protein, 5 aa, Mycobacterium
KRDRQ

SEQ ID NO: 400088 - protein, 5 aa, Mycobacterium
KRDSE

SEQ ID NO: 400089 - protein, 8 aa, Mycobacterium
KREGGEDR

SEQ ID NO: 400090 - protein, 7 aa, Mycobacterium
KRGGGAI

SEQ ID NO: 400091 - protein, 7 aa, Mycobacterium
KRGPGIQ

SEQ ID NO: 400092 - protein, 8 aa, Mycobacterium
KRGVRKTY

SEQ ID NO: 400093 - protein, 8 aa, Mycobacterium
KRGYGTAA

SEQ ID NO: 400094 - protein, 10 aa, Mycobacterium
KRLGENRKRD

SEQ ID NO: 400095 - protein, 7 aa, Mycobacterium
KRNRGGK

SEQ ID NO: 400096 - protein, 8 aa, Mycobacterium
KRPGPGMK

SEQ ID NO: 400097 - protein, 6 aa, Mycobacterium
KRPPGQ

SEQ ID NO: 400098 - protein, 7 aa, Mycobacterium
KRPQVQE

SEQ ID NO: 400099 - protein, 7 aa, Mycobacterium
KRPSMSN

SEQ ID NO: 400100 - protein, 6 aa, Mycobacterium
KRPYDE

SEQ ID NO: 400101 - protein, 8 aa, Mycobacterium
KRQRQMDR

SEQ ID NO: 400102 - protein, 20 aa, Mycobacterium
KRREDTHKMAEANRAFAHYR

SEQ ID NO: 400103 - protein, 13 aa, Mycobacterium
KRREESLHPVGEE

SEQ ID NO: 400104 - protein, 6 aa, Mycobacterium
KRRERM

SEQ ID NO: 400105 - protein, 7 aa, Mycobacterium
KRRPPGQ

SEQ ID NO: 400106 - protein, 4 aa, Mycobacterium
KRRS

SEQ ID NO: 400107 - protein, 9 aa, Mycobacterium
KRRTPKAAF

SEQ ID NO: 400108 - protein, 11 aa, Mycobacterium
KRSARGQGHTT

SEQ ID NO: 400109 - protein, 4 aa, Mycobacterium
KRTE

SEQ ID NO: 400110 - protein, 4 aa, Mycobacterium
KRTG

SEQ ID NO: 400111 - protein, 5 aa, Mycobacterium
KRTPA

SEQ ID NO: 400112 - protein, 6 aa, Mycobacterium
KRTRVG

SEQ ID NO: 400113 - protein, 8 aa, Mycobacterium
KRVEAEAK

SEQ ID NO: 400114 - protein, 10 aa, Mycobacterium
KRWPEERTTW

SEQ ID NO: 400115 - protein, 9 aa, Mycobacterium
KRYATAGKQ

SEQ ID NO: 400116 - protein, 9 aa, Mycobacterium
KRYGSTTAV

SEQ ID NO: 400117 - protein, 7 aa, Mycobacterium
KSAAMGT

SEQ ID NO: 400118 - protein, 8 aa, Mycobacterium
KSAHGGPF

SEQ ID NO: 400119 - protein, 8 aa, Mycobacterium
KSAVMGGT

SEQ ID NO: 400120 - protein, 7 aa, Mycobacterium
KSAVMGP

SEQ ID NO: 400121 - protein, 8 aa, Mycobacterium
KSDAPYQG

SEQ ID NO: 400122 - protein, 7 aa, Mycobacterium
KSDPVDD

SEQ ID NO: 400123 - protein, 4 aa, Mycobacterium
KSDR

SEQ ID NO: 400124 - protein, 5 aa, Mycobacterium
KSDSL

SEQ ID NO: 400125 - protein, 8 aa, Mycobacterium
KSELSGDR

SEQ ID NO: 400126 - protein, 5 aa, Mycobacterium
KSFGS

SEQ ID NO: 400127 - protein, 6 aa, Mycobacterium
KSGAAR

SEQ ID NO: 400128 - protein, 11 aa, Mycobacterium
KSGASARGQAA

SEQ ID NO: 400129 - protein, 4 aa, Mycobacterium
KSGD

SEQ ID NO: 400130 - protein, 7 aa, Mycobacterium
KSGDGAL

SEQ ID NO: 400131 - protein, 10 aa, Mycobacterium
KSGDPAQRAA

SEQ ID NO: 400132 - protein, 4 aa, Mycobacterium
KSGE

SEQ ID NO: 400133 - protein, 8 aa, Mycobacterium
KSGEGRYV

SEQ ID NO: 400134 - protein, 5 aa, Mycobacterium
KSGGE

SEQ ID NO: 400135 - protein, 6 aa, Mycobacterium
KSGGRK

SEQ ID NO: 400136 - protein, 10 aa, Mycobacterium
KSGNPEQRAA

SEQ ID NO: 400137 - protein, 10 aa, Mycobacterium
KSGSALGAQA

SEQ ID NO: 400138 - protein, 7 aa, Mycobacterium
KSKGYDD

SEQ ID NO: 400139 - protein, 8 aa, Mycobacterium
KSKYASGE

SEQ ID NO: 400140 - protein, 4 aa, Mycobacterium
KSLG

SEQ ID NO: 400141 - protein, 6 aa, Mycobacterium
KSLGGD

SEQ ID NO: 400142 - protein, 7 aa, Mycobacterium
KSLKSVG

SEQ ID NO: 400143 - protein, 4 aa, Mycobacterium
KSLN

SEQ ID NO: 400144 - protein, 25 aa, Mycobacterium
KSLPRSSQALAAGGQPVATTEVQPG

SEQ ID NO: 400145 - protein, 8 aa, Mycobacterium
KSLSGGMR

SEQ ID NO: 400146 - protein, 12 aa, Mycobacterium
KSMTPTSLGGTP

SEQ ID NO: 400147 - protein, 8 aa, Mycobacterium
KSPAGLEA

SEQ ID NO: 400148 - protein, 9 aa, Mycobacterium
KSPTGSARM

SEQ ID NO: 400149 - protein, 5 aa, Mycobacterium
KSRGV

SEQ ID NO: 400150 - protein, 6 aa, Mycobacterium
KSRSVP

SEQ ID NO: 400151 - protein, 14 aa, Mycobacterium
KSRSVPADLSDHPR

SEQ ID NO: 400152 - protein, 7 aa, Mycobacterium
KSSAGTL

SEQ ID NO: 400153 - protein, 9 aa, Mycobacterium
KSSARPALD

SEQ ID NO: 400154 - protein, 15 aa, Mycobacterium
KSSITPRDALASAGK

SEQ ID NO: 400155 - protein, 7 aa, Mycobacterium
KSYQPTL

SEQ ID NO: 400156 - protein, 11 aa, Mycobacterium
KSYVGTDEQVE

SEQ ID NO: 400157 - protein, 8 aa, Mycobacterium
KTAADSGK

SEQ ID NO: 400158 - protein, 8 aa, Mycobacterium
KTAGDSGK

SEQ ID NO: 400159 - protein, 6 aa, Mycobacterium
KTAGGL

SEQ ID NO: 400160 - protein, 5 aa, Mycobacterium
KTAKA

SEQ ID NO: 400161 - protein, 7 aa, Mycobacterium
KTANTYS

SEQ ID NO: 400162 - protein, 4 aa, Mycobacterium
KTAP

SEQ ID NO: 400163 - protein, 5 aa, Mycobacterium
KTAQS

SEQ ID NO: 400164 - protein, 7 aa, Mycobacterium
KTARNHV

SEQ ID NO: 400165 - protein, 5 aa, Mycobacterium
KTATG

SEQ ID NO: 400166 - protein, 7 aa, Mycobacterium
KTATGQA

SEQ ID NO: 400167 - protein, 10 aa, Mycobacterium
KTDRAGAEQA

SEQ ID NO: 400168 - protein, 5 aa, Mycobacterium
KTDRF

SEQ ID NO: 400169 - protein, 4 aa, Mycobacterium
KTDT

SEQ ID NO: 400170 - protein, 9 aa, Mycobacterium
KTEADGEPR

SEQ ID NO: 400171 - protein, 10 aa, Mycobacterium
KTEDPPTDQI

SEQ ID NO: 400172 - protein, 10 aa, Mycobacterium
KTEHLGDRSP

SEQ ID NO: 400173 - protein, 6 aa, Mycobacterium
KTFAKD

SEQ ID NO: 400174 - protein, 7 aa, Mycobacterium
KTFTAPA

SEQ ID NO: 400175 - protein, 4 aa, Mycobacterium
KTGA

SEQ ID NO: 400176 - protein, 7 aa, Mycobacterium
KTGADNF

SEQ ID NO: 400177 - protein, 11 aa, Mycobacterium
KTGEAEFPGGS

SEQ ID NO: 400178 - protein, 7 aa, Mycobacterium
KTGQGYA

SEQ ID NO: 400179 - protein, 5 aa, Mycobacterium
KTGQP

SEQ ID NO: 400180 - protein, 5 aa, Mycobacterium
KTGVR

SEQ ID NO: 400181 - protein, 8 aa, Mycobacterium
KTKETAGL

SEQ ID NO: 400182 - protein, 5 aa, Mycobacterium
KTKTN

SEQ ID NO: 400183 - protein, 6 aa, Mycobacterium
KTLPTE

SEQ ID NO: 400184 - protein, 4 aa, Mycobacterium
KTMA

SEQ ID NO: 400185 - protein, 7 aa, Mycobacterium
KTPARVA

SEQ ID NO: 400186 - protein, 5 aa, Mycobacterium
KTPRS

SEQ ID NO: 400187 - protein, 11 aa, Mycobacterium
KTPSSASEPDR

SEQ ID NO: 400188 - protein, 8 aa, Mycobacterium
KTPYGQPE

SEQ ID NO: 400189 - protein, 6 aa, Mycobacterium
KTRASL

SEQ ID NO: 400190 - protein, 5 aa, Mycobacterium
KTRDG

SEQ ID NO: 400191 - protein, 13 aa, Mycobacterium
KTRHSSVTVPPNE

SEQ ID NO: 400192 - protein, 6 aa, Mycobacterium
KTRRGL

SEQ ID NO: 400193 - protein, 5 aa, Mycobacterium
KTRRR

SEQ ID NO: 400194 - protein, 5 aa, Mycobacterium
KTRSL

SEQ ID NO: 400195 - protein, 5 aa, Mycobacterium
KTSIE

SEQ ID NO: 400196 - protein, 5 aa, Mycobacterium
KTSPA

SEQ ID NO: 400197 - protein, 7 aa, Mycobacterium
KTSPTVA

SEQ ID NO: 400198 - protein, 4 aa, Mycobacterium
KTSQ

SEQ ID NO: 400199 - protein, 7 aa, Mycobacterium
KTSSSEL

SEQ ID NO: 400200 - protein, 5 aa, Mycobacterium
KTSYV

SEQ ID NO: 400201 - protein, 4 aa, Mycobacterium
KTTV

SEQ ID NO: 400202 - protein, 8 aa, Mycobacterium
KTVADPGS

SEQ ID NO: 400203 - protein, 8 aa, Mycobacterium
KTVESGSL

SEQ ID NO: 400204 - protein, 4 aa, Mycobacterium
KTVG

SEQ ID NO: 400205 - protein, 22 aa, Mycobacterium
KTVTSRWPSGIKDGAEFVIPTM

SEQ ID NO: 400206 - protein, 7 aa, Mycobacterium
KTWQPGD

SEQ ID NO: 400207 - protein, 7 aa, Mycobacterium
KTYDPDS

SEQ ID NO: 400208 - protein, 11 aa, Mycobacterium
KVAEPGQSLAD

SEQ ID NO: 400209 - protein, 4 aa, Mycobacterium
KVDD

SEQ ID NO: 400210 - protein, 10 aa, Mycobacterium
KVDPAADPAV

SEQ ID NO: 400211 - protein, 6 aa, Mycobacterium
KVDSGN

SEQ ID NO: 400212 - protein, 4 aa, Mycobacterium
KVGE

SEQ ID NO: 400213 - protein, 15 aa, Mycobacterium
KVGEAPTQSGVALPG

SEQ ID NO: 400214 - protein, 6 aa, Mycobacterium
KVGNEG

SEQ ID NO: 400215 - protein, 10 aa, Mycobacterium
KVGNGHPGTA

SEQ ID NO: 400216 - protein, 4 aa, Mycobacterium
KVGQ

SEQ ID NO: 400217 - protein, 4 aa, Mycobacterium
KVGR

SEQ ID NO: 400218 - protein, 6 aa, Mycobacterium
KVGTDG

SEQ ID NO: 400219 - protein, 7 aa, Mycobacterium
KVPGTAM

SEQ ID NO: 400220 - protein, 7 aa, Mycobacterium
KVPKDRV

SEQ ID NO: 400221 - protein, 10 aa, Mycobacterium
KVPPKDFAPQ

SEQ ID NO: 400222 - protein, 8 aa, Mycobacterium
KVPPTGSR

SEQ ID NO: 400223 - protein, 9 aa, Mycobacterium
KVPSEEVPA

SEQ ID NO: 400224 - protein, 7 aa, Mycobacterium
KVPTPLP

SEQ ID NO: 400225 - protein, 8 aa, Mycobacterium
KVPVETPA

SEQ ID NO: 400226 - protein, 5 aa, Mycobacterium
KVRGN

SEQ ID NO: 400227 - protein, 8 aa, Mycobacterium
KVRKATEA

SEQ ID NO: 400228 - protein, 6 aa, Mycobacterium
KVRTRA

SEQ ID NO: 400229 - protein, 4 aa, Mycobacterium
KVSG

SEQ ID NO: 400230 - protein, 6 aa, Mycobacterium
KVSSRE

SEQ ID NO: 400231 - protein, 6 aa, Mycobacterium
KVTGRE

SEQ ID NO: 400232 - protein, 7 aa, Mycobacterium
KVTSAEL

SEQ ID NO: 400233 - protein, 5 aa, Mycobacterium
KWGQD

SEQ ID NO: 400234 - protein, 6 aa, Mycobacterium
KWGSDR

SEQ ID NO: 400235 - protein, 4 aa, Mycobacterium
KWQE

SEQ ID NO: 400236 - protein, 5 aa, Mycobacterium
KWQER

SEQ ID NO: 400237 - protein, 4 aa, Mycobacterium
KYGE

SEQ ID NO: 400238 - protein, 6 aa, Mycobacterium
KYGNKI

SEQ ID NO: 400239 - protein, 13 aa, Mycobacterium
KYNPARTWTPENA

SEQ ID NO: 400240 - protein, 5 aa, Mycobacterium
KYRDE

SEQ ID NO: 400241 - protein, 7 aa, Mycobacterium
KYRGEFE

SEQ ID NO: 400242 - protein, 6 aa, Mycobacterium
LAAADG

SEQ ID NO: 400243 - protein, 9 aa, Mycobacterium
LAAAGRARA

SEQ ID NO: 400244 - protein, 9 aa, Mycobacterium
LAAASDTDL

SEQ ID NO: 400245 - protein, 6 aa, Mycobacterium
LAAAST

SEQ ID NO: 400246 - protein, 6 aa, Mycobacterium
LAAATG

SEQ ID NO: 400247 - protein, 6 aa, Mycobacterium
LAAATT

SEQ ID NO: 400248 - protein, 5 aa, Mycobacterium
LAADG

SEQ ID NO: 400249 - protein, 7 aa, Mycobacterium
LAAEGKR

SEQ ID NO: 400250 - protein, 8 aa, Mycobacterium
LAAGASTT

SEQ ID NO: 400251 - protein, 6 aa, Mycobacterium
LAAGGD

SEQ ID NO: 400252 - protein, 4 aa, Mycobacterium
LAAK

SEQ ID NO: 400253 - protein, 6 aa, Mycobacterium
LAAKQG

SEQ ID NO: 400254 - protein, 7 aa, Mycobacterium
LAAKTAA

SEQ ID NO: 400255 - protein, 10 aa, Mycobacterium
LAANGTPEQL

SEQ ID NO: 400256 - protein, 6 aa, Mycobacterium
LAAPGL

SEQ ID NO: 400257 - protein, 6 aa, Mycobacterium
LAAPGQ

SEQ ID NO: 400258 - protein, 7 aa, Mycobacterium
LAAPSTA

SEQ ID NO: 400259 - protein, 4 aa, Mycobacterium
LAAR

SEQ ID NO: 400260 - protein, 4 aa, Mycobacterium
LAAT

SEQ ID NO: 400261 - protein, 4 aa, Mycobacterium
LADE

SEQ ID NO: 400262 - protein, 4 aa, Mycobacterium
LADQ

SEQ ID NO: 400263 - protein, 4 aa, Mycobacterium
LADT

SEQ ID NO: 400264 - protein, 9 aa, Mycobacterium
LADTGQLTQ

SEQ ID NO: 400265 - protein, 6 aa, Mycobacterium
LADTGR

SEQ ID NO: 400266 - protein, 9 aa, Mycobacterium
LADTPEKIR

SEQ ID NO: 400267 - protein, 15 aa, Mycobacterium
LADTPEKVRAEGIRP

SEQ ID NO: 400268 - protein, 6 aa, Mycobacterium
LAEGTG

SEQ ID NO: 400269 - protein, 4 aa, Mycobacterium
LAEP

SEQ ID NO: 400270 - protein, 8 aa, Mycobacterium
LAESAEAL

SEQ ID NO: 400271 - protein, 9 aa, Mycobacterium
LAESDGDFD

SEQ ID NO: 400272 - protein, 10 aa, Mycobacterium
LAESDGDFDK

SEQ ID NO: 400273 - protein, 9 aa, Mycobacterium
LAESPMESE

SEQ ID NO: 400274 - protein, 7 aa, Mycobacterium
LAESRNE

SEQ ID NO: 400275 - protein, 8 aa, Mycobacterium
LAETPSPD

SEQ ID NO: 400276 - protein, 8 aa, Mycobacterium
LAGAKSTE

SEQ ID NO: 400277 - protein, 4 aa, Mycobacterium
LAGD

SEQ ID NO: 400278 - protein, 7 aa, Mycobacterium
LAGEDSR

SEQ ID NO: 400279 - protein, 7 aa, Mycobacterium
LAGEPIT

SEQ ID NO: 400280 - protein, 4 aa, Mycobacterium
LAGG

SEQ ID NO: 400281 - protein, 5 aa, Mycobacterium
LAGGG

SEQ ID NO: 400282 - protein, 6 aa, Mycobacterium
LAGPGG

SEQ ID NO: 400283 - protein, 6 aa, Mycobacterium
LAGQPD

SEQ ID NO: 400284 - protein, 11 aa, Mycobacterium
LAGRPSPEADT

SEQ ID NO: 400285 - protein, 4 aa, Mycobacterium
LAGS

SEQ ID NO: 400286 - protein, 6 aa, Mycobacterium
LAGSGR

SEQ ID NO: 400287 - protein, 6 aa, Mycobacterium
LAGTGA

SEQ ID NO: 400288 - protein, 5 aa, Mycobacterium
LAGTT

SEQ ID NO: 400289 - protein, 14 aa, Mycobacterium
LAKETSSKKQDATV

SEQ ID NO: 400290 - protein, 9 aa, Mycobacterium
LANGASAEE

SEQ ID NO: 400291 - protein, 10 aa, Mycobacterium
LANPKGWTHN

SEQ ID NO: 400292 - protein, 12 aa, Mycobacterium
LANPPKDKADRD

SEQ ID NO: 400293 - protein, 9 aa, Mycobacterium
LANTRAASL

SEQ ID NO: 400294 - protein, 6 aa, Mycobacterium
LAPADR

SEQ ID NO: 400295 - protein, 8 aa, Mycobacterium
LAPAEAAA

SEQ ID NO: 400296 - protein, 8 aa, Mycobacterium
LAPDEPAV

SEQ ID NO: 400297 - protein, 5 aa, Mycobacterium
LAPDF

SEQ ID NO: 400298 - protein, 6 aa, Mycobacterium
LAPDFD

SEQ ID NO: 400299 - protein, 7 aa, Mycobacterium
LAPDPGI

SEQ ID NO: 400300 - protein, 5 aa, Mycobacterium
LAPEL

SEQ ID NO: 400301 - protein, 5 aa, Mycobacterium
LAPEP

SEQ ID NO: 400302 - protein, 6 aa, Mycobacterium
LAPGGT

SEQ ID NO: 400303 - protein, 9 aa, Mycobacterium
LAPGTGLRD

SEQ ID NO: 400304 - protein, 11 aa, Mycobacterium
LAPKGSGTEVT

SEQ ID NO: 400305 - protein, 7 aa, Mycobacterium
LAPKGTG

SEQ ID NO: 400306 - protein, 10 aa, Mycobacterium
LAPNPDAQAE

SEQ ID NO: 400307 - protein, 10 aa, Mycobacterium
LAPQGPTEKT

SEQ ID NO: 400308 - protein, 4 aa, Mycobacterium
LAPR

SEQ ID NO: 400309 - protein, 5 aa, Mycobacterium
LAPRT

SEQ ID NO: 400310 - protein, 7 aa, Mycobacterium
LAPRTPT

SEQ ID NO: 400311 - protein, 15 aa, Mycobacterium
LAPSDASELKARAEA

SEQ ID NO: 400312 - protein, 4 aa, Mycobacterium
LAPT

SEQ ID NO: 400313 - protein, 17 aa, Mycobacterium
LAPTGDRRMSANPHANG

SEQ ID NO: 400314 - protein, 9 aa, Mycobacterium
LAQAKGSKD

SEQ ID NO: 400315 - protein, 7 aa, Mycobacterium
LAQGAQN

SEQ ID NO: 400316 - protein, 5 aa, Mycobacterium
LAQGG

SEQ ID NO: 400317 - protein, 6 aa, Mycobacterium
LAQRAD

SEQ ID NO: 400318 - protein, 4 aa, Mycobacterium
LAQT

SEQ ID NO: 400319 - protein, 5 aa, Mycobacterium
LARAE

SEQ ID NO: 400320 - protein, 4 aa, Mycobacterium
LARE

SEQ ID NO: 400321 - protein, 7 aa, Mycobacterium
LAREHNN

SEQ ID NO: 400322 - protein, 6 aa, Mycobacterium
LARGDL

SEQ ID NO: 400323 - protein, 6 aa, Mycobacterium
LARPDR

SEQ ID NO: 400324 - protein, 7 aa, Mycobacterium
LARPGGT

SEQ ID NO: 400325 - protein, 4 aa, Mycobacterium
LARR

SEQ ID NO: 400326 - protein, 5 aa, Mycobacterium
LARRG

SEQ ID NO: 400327 - protein, 6 aa, Mycobacterium
LARRNS

SEQ ID NO: 400328 - protein, 4 aa, Mycobacterium
LARS

SEQ ID NO: 400329 - protein, 5 aa, Mycobacterium
LARSG

SEQ ID NO: 400330 - protein, 6 aa, Mycobacterium
LARSGA

SEQ ID NO: 400331 - protein, 5 aa, Mycobacterium
LASDP

SEQ ID NO: 400332 - protein, 11 aa, Mycobacterium
LASGTSSRSSK

SEQ ID NO: 400333 - protein, 5 aa, Mycobacterium
LASPA

SEQ ID NO: 400334 - protein, 10 aa, Mycobacterium
LASRARKAPG

SEQ ID NO: 400335 - protein, 11 aa, Mycobacterium
LASRSTKRGER

SEQ ID NO: 400336 - protein, 11 aa, Mycobacterium
LATDGEKAAAR

SEQ ID NO: 400337 - protein, 7 aa, Mycobacterium
LATDTGV

SEQ ID NO: 400338 - protein, 5 aa, Mycobacterium
LATGT

SEQ ID NO: 400339 - protein, 5 aa, Mycobacterium
LATKP

SEQ ID NO: 400340 - protein, 6 aa, Mycobacterium
LATRGF

SEQ ID NO: 400341 - protein, 8 aa, Mycobacterium
LATSPNTA

SEQ ID NO: 400342 - protein, 8 aa, Mycobacterium
LDAANADQ

SEQ ID NO: 400343 - protein, 12 aa, Mycobacterium
LDAASKAQLDRG

SEQ ID NO: 400344 - protein, 5 aa, Mycobacterium
LDAED

SEQ ID NO: 400345 - protein, 6 aa, Mycobacterium
LDAHDR

SEQ ID NO: 400346 - protein, 8 aa, Mycobacterium
LDAPQGTR

SEQ ID NO: 400347 - protein, 8 aa, Mycobacterium
LDAQSPAA

SEQ ID NO: 400348 - protein, 7 aa, Mycobacterium
LDDDEVA

SEQ ID NO: 400349 - protein, 10 aa, Mycobacterium
LDDEPDYAAA

SEQ ID NO: 400350 - protein, 5 aa, Mycobacterium
LDDFE

SEQ ID NO: 400351 - protein, 4 aa, Mycobacterium
LDDG

SEQ ID NO: 400352 - protein, 4 aa, Mycobacterium
LDDP

SEQ ID NO: 400353 - protein, 5 aa, Mycobacterium
LDDPA

SEQ ID NO: 400354 - protein, 12 aa, Mycobacterium
LDDRQREATEEV

SEQ ID NO: 400355 - protein, 6 aa, Mycobacterium
LDDSAR

SEQ ID NO: 400356 - protein, 4 aa, Mycobacterium
LDDT

SEQ ID NO: 400357 - protein, 8 aa, Mycobacterium
LDDTSKSA

SEQ ID NO: 400358 - protein, 4 aa, Mycobacterium
LDEA

SEQ ID NO: 400359 - protein, 5 aa, Mycobacterium
LDENG

SEQ ID NO: 400360 - protein, 5 aa, Mycobacterium
LDEPS

SEQ ID NO: 400361 - protein, 5 aa, Mycobacterium
LDEPT

SEQ ID NO: 400362 - protein, 7 aa, Mycobacterium
LDEQPAA

SEQ ID NO: 400363 - protein, 6 aa, Mycobacterium
LDERGD

SEQ ID NO: 400364 - protein, 9 aa, Mycobacterium
LDGEPQYKT

SEQ ID NO: 400365 - protein, 4 aa, Mycobacterium
LDGG

SEQ ID NO: 400366 - protein, 8 aa, Mycobacterium
LDGGDDPA

SEQ ID NO: 400367 - protein, 8 aa, Mycobacterium
LDGGFADT

SEQ ID NO: 400368 - protein, 5 aa, Mycobacterium
LDGNY

SEQ ID NO: 400369 - protein, 5 aa, Mycobacterium
LDGPT

SEQ ID NO: 400370 - protein, 7 aa, Mycobacterium
LDGQPAA

SEQ ID NO: 400371 - protein, 11 aa, Mycobacterium
LDGRPTDLPGM

SEQ ID NO: 400372 - protein, 9 aa, Mycobacterium
LDGRRGPQV

SEQ ID NO: 400373 - protein, 5 aa, Mycobacterium
LDGRT

SEQ ID NO: 400374 - protein, 4 aa, Mycobacterium
LDGS

SEQ ID NO: 400375 - protein, 6 aa, Mycobacterium
LDGSYP

SEQ ID NO: 400376 - protein, 4 aa, Mycobacterium
LDGT

SEQ ID NO: 400377 - protein, 6 aa, Mycobacterium
LDHGAS

SEQ ID NO: 400378 - protein, 8 aa, Mycobacterium
LDKGEKEQ

SEQ ID NO: 400379 - protein, 12 aa, Mycobacterium
LDPASRGPHASK

SEQ ID NO: 400380 - protein, 5 aa, Mycobacterium
LDPAT

SEQ ID NO: 400381 - protein, 9 aa, Mycobacterium
LDPDRGGVE

SEQ ID NO: 400382 - protein, 8 aa, Mycobacterium
LDPDTEKL

SEQ ID NO: 400383 - protein, 5 aa, Mycobacterium
LDPDY

SEQ ID NO: 400384 - protein, 7 aa, Mycobacterium
LDPEDVE

SEQ ID NO: 400385 - protein, 6 aa, Mycobacterium
LDPERG

SEQ ID NO: 400386 - protein, 9 aa, Mycobacterium
LDPETEKLR

SEQ ID NO: 400387 - protein, 7 aa, Mycobacterium
LDPGKLP

SEQ ID NO: 400388 - protein, 9 aa, Mycobacterium
LDPGTGPGY

SEQ ID NO: 400389 - protein, 5 aa, Mycobacterium
LDPHG

SEQ ID NO: 400390 - protein, 4 aa, Mycobacterium
LDPP

SEQ ID NO: 400391 - protein, 7 aa, Mycobacterium
LDPPKAG

SEQ ID NO: 400392 - protein, 5 aa, Mycobacterium
LDPPW

SEQ ID NO: 400393 - protein, 5 aa, Mycobacterium
LDPRT

SEQ ID NO: 400394 - protein, 6 aa, Mycobacterium
LDPRTS

SEQ ID NO: 400395 - protein, 4 aa, Mycobacterium
LDPS

SEQ ID NO: 400396 - protein, 6 aa, Mycobacterium
LDPSAP

SEQ ID NO: 400397 - protein, 5 aa, Mycobacterium
LDPSR

SEQ ID NO: 400398 - protein, 5 aa, Mycobacterium
LDPVT

SEQ ID NO: 400399 - protein, 8 aa, Mycobacterium
LDQEGRDD

SEQ ID NO: 400400 - protein, 5 aa, Mycobacterium
LDRQS

SEQ ID NO: 400401 - protein, 8 aa, Mycobacterium
LDSAEGVP

SEQ ID NO: 400402 - protein, 4 aa, Mycobacterium
LDSD

SEQ ID NO: 400403 - protein, 6 aa, Mycobacterium
LDSGFG

SEQ ID NO: 400404 - protein, 7 aa, Mycobacterium
LDSSPEM

SEQ ID NO: 400405 - protein, 10 aa, Mycobacterium
LDTSDDAAVR

SEQ ID NO: 400406 - protein, 10 aa, Mycobacterium
LDTSDPAAVR

SEQ ID NO: 400407 - protein, 4 aa, Mycobacterium
LDTT

SEQ ID NO: 400408 - protein, 5 aa, Mycobacterium
LDVDT

SEQ ID NO: 400409 - protein, 22 aa, Mycobacterium
LEAEGAKADARRKVRDGGEREM

SEQ ID NO: 400410 - protein, 7 aa, Mycobacterium
LEAGGAP

SEQ ID NO: 400411 - protein, 8 aa, Mycobacterium
LEANGGPR

SEQ ID NO: 400412 - protein, 11 aa, Mycobacterium
LEAQKPDPLAV

SEQ ID NO: 400413 - protein, 8 aa, Mycobacterium
LEARGKKT

SEQ ID NO: 400414 - protein, 7 aa, Mycobacterium
LEARGKT

SEQ ID NO: 400415 - protein, 11 aa, Mycobacterium
LEATPDKRTTT

SEQ ID NO: 400416 - protein, 4 aa, Mycobacterium
LEDA

SEQ ID NO: 400417 - protein, 9 aa, Mycobacterium
LEDDPSHPK

SEQ ID NO: 400418 - protein, 4 aa, Mycobacterium
LEDG

SEQ ID NO: 400419 - protein, 6 aa, Mycobacterium
LEDKGV

SEQ ID NO: 400420 - protein, 5 aa, Mycobacterium
LEDPR

SEQ ID NO: 400421 - protein, 7 aa, Mycobacterium
LEEAQRA

SEQ ID NO: 400422 - protein, 7 aa, Mycobacterium
LEEAQYA

SEQ ID NO: 400423 - protein, 6 aa, Mycobacterium
LEGEGI

SEQ ID NO: 400424 - protein, 7 aa, Mycobacterium
LEGGEGP

SEQ ID NO: 400425 - protein, 9 aa, Mycobacterium
LEGKEGDRG

SEQ ID NO: 400426 - protein, 20 aa, Mycobacterium
LEGQARGWAQAEASASAHKH

SEQ ID NO: 400427 - protein, 4 aa, Mycobacterium
LEGR

SEQ ID NO: 400428 - protein, 4 aa, Mycobacterium
LEKR

SEQ ID NO: 400429 - protein, 12 aa, Mycobacterium
LENATDEDRQRV

SEQ ID NO: 400430 - protein, 15 aa, Mycobacterium
LENRTAKGKVVLRVR

SEQ ID NO: 400431 - protein, 15 aa, Mycobacterium
LEPGGRPDAPEPGPA

SEQ ID NO: 400432 - protein, 5 aa, Mycobacterium
LEPGS

SEQ ID NO: 400433 - protein, 5 aa, Mycobacterium
LEPHD

SEQ ID NO: 400434 - protein, 4 aa, Mycobacterium
LEPI

SEQ ID NO: 400435 - protein, 10 aa, Mycobacterium
LEPTSGNTGI

SEQ ID NO: 400436 - protein, 6 aa, Mycobacterium
LEQAES

SEQ ID NO: 400437 - protein, 5 aa, Mycobacterium
LEQPR

SEQ ID NO: 400438 - protein, 11 aa, Mycobacterium
LEQSGPTVSQT

SEQ ID NO: 400439 - protein, 7 aa, Mycobacterium
LEQTQEG

SEQ ID NO: 400440 - protein, 5 aa, Mycobacterium
LEQYG

SEQ ID NO: 400441 - protein, 6 aa, Mycobacterium
LERDAA

SEQ ID NO: 400442 - protein, 6 aa, Mycobacterium
LERENA

SEQ ID NO: 400443 - protein, 7 aa, Mycobacterium
LERGDPV

SEQ ID NO: 400444 - protein, 7 aa, Mycobacterium
LERGRDA

SEQ ID NO: 400445 - protein, 17 aa, Mycobacterium
LERRQKSRQTRASRDAL

SEQ ID NO: 400446 - protein, 12 aa, Mycobacterium
LERSRPVGVSPV

SEQ ID NO: 400447 - protein, 12 aa, Mycobacterium
LERSSDQSPESG

SEQ ID NO: 400448 - protein, 16 aa, Mycobacterium
LESANGSGNISYEPKN

SEQ ID NO: 400449 - protein, 5 aa, Mycobacterium
LESGA

SEQ ID NO: 400450 - protein, 8 aa, Mycobacterium
LESGSRVR

SEQ ID NO: 400451 - protein, 15 aa, Mycobacterium
LESRAGVGTTGGGTV

SEQ ID NO: 400452 - protein, 6 aa, Mycobacterium
LETSDS

SEQ ID NO: 400453 - protein, 4 aa, Mycobacterium
LGAA

SEQ ID NO: 400454 - protein, 9 aa, Mycobacterium
LGAEQSGHV

SEQ ID NO: 400455 - protein, 8 aa, Mycobacterium
LGAGGHSE

SEQ ID NO: 400456 - protein, 20 aa, Mycobacterium
LGAGGTGKGTAGAMRGAAGA

SEQ ID NO: 400457 - protein, 30 aa, Mycobacterium
LGAGPTPPSAPGALGPGTAPTGRPLGAGPM

SEQ ID NO: 400458 - protein, 6 aa, Mycobacterium
LGAQPR

SEQ ID NO: 400459 - protein, 6 aa, Mycobacterium
LGARPS

SEQ ID NO: 400460 - protein, 4 aa, Mycobacterium
LGAT

SEQ ID NO: 400461 - protein, 6 aa, Mycobacterium
LGATGT

SEQ ID NO: 400462 - protein, 6 aa, Mycobacterium
LGATGV

SEQ ID NO: 400463 - protein, 9 aa, Mycobacterium
LGDDAARPR

SEQ ID NO: 400464 - protein, 6 aa, Mycobacterium
LGDDGK

SEQ ID NO: 400465 - protein, 9 aa, Mycobacterium
LGDEAAVDA

SEQ ID NO: 400466 - protein, 4 aa, Mycobacterium
LGDG

SEQ ID NO: 400467 - protein, 5 aa, Mycobacterium
LGDGP

SEQ ID NO: 400468 - protein, 5 aa, Mycobacterium
LGDPH

SEQ ID NO: 400469 - protein, 10 aa, Mycobacterium
LGDPKLGAHN

SEQ ID NO: 400470 - protein, 6 aa, Mycobacterium
LGDPQA

SEQ ID NO: 400471 - protein, 9 aa, Mycobacterium
LGDQAAVDA

SEQ ID NO: 400472 - protein, 6 aa, Mycobacterium
LGDRAD

SEQ ID NO: 400473 - protein, 14 aa, Mycobacterium
LGDRQRKALLEKFG

SEQ ID NO: 400474 - protein, 15 aa, Mycobacterium
LGDRQRKALLEKFGS

SEQ ID NO: 400475 - protein, 4 aa, Mycobacterium
LGDS

SEQ ID NO: 400476 - protein, 12 aa, Mycobacterium
LGDSDGDWGDGS

SEQ ID NO: 400477 - protein, 8 aa, Mycobacterium
LGDTAAPA

SEQ ID NO: 400478 - protein, 6 aa, Mycobacterium
LGDTDA

SEQ ID NO: 400479 - protein, 9 aa, Mycobacterium
LGDTPAADV

SEQ ID NO: 400480 - protein, 10 aa, Mycobacterium
LGDTTELPDI

SEQ ID NO: 400481 - protein, 4 aa, Mycobacterium
LGED

SEQ ID NO: 400482 - protein, 5 aa, Mycobacterium
LGEEI

SEQ ID NO: 400483 - protein, 11 aa, Mycobacterium
LGEGGYIGRED

SEQ ID NO: 400484 - protein, 4 aa, Mycobacterium
LGEK

SEQ ID NO: 400485 - protein, 6 aa, Mycobacterium
LGEPGQ

SEQ ID NO: 400486 - protein, 4 aa, Mycobacterium
LGET

SEQ ID NO: 400487 - protein, 5 aa, Mycobacterium
LGGAD

SEQ ID NO: 400488 - protein, 9 aa, Mycobacterium
LGGAGGELA

SEQ ID NO: 400489 - protein, 8 aa, Mycobacterium
LGGAPKNP

SEQ ID NO: 400490 - protein, 6 aa, Mycobacterium
LGGDSL

SEQ ID NO: 400491 - protein, 14 aa, Mycobacterium
LGGEESATVYAGTG

SEQ ID NO: 400492 - protein, 4 aa, Mycobacterium
LGGL

SEQ ID NO: 400493 - protein, 9 aa, Mycobacterium
LGGLGRGEE

SEQ ID NO: 400494 - protein, 4 aa, Mycobacterium
LGGN

SEQ ID NO: 400495 - protein, 7 aa, Mycobacterium
LGGNPTV

SEQ ID NO: 400496 - protein, 14 aa, Mycobacterium
LGGRAGDPAARDAE

SEQ ID NO: 400497 - protein, 7 aa, Mycobacterium
LGGSNPS

SEQ ID NO: 400498 - protein, 6 aa, Mycobacterium
LGGSSS

SEQ ID NO: 400499 - protein, 5 aa, Mycobacterium
LGGTQ

SEQ ID NO: 400500 - protein, 6 aa, Mycobacterium
LGGTRD

SEQ ID NO: 400501 - protein, 7 aa, Mycobacterium
LGNGGTA

SEQ ID NO: 400502 - protein, 9 aa, Mycobacterium
LGNGKPNYR

SEQ ID NO: 400503 - protein, 6 aa, Mycobacterium
LGNGPT

SEQ ID NO: 400504 - protein, 6 aa, Mycobacterium
LGNKDI

SEQ ID NO: 400505 - protein, 4 aa, Mycobacterium
LGNR

SEQ ID NO: 400506 - protein, 9 aa, Mycobacterium
LGPAAARES

SEQ ID NO: 400507 - protein, 6 aa, Mycobacterium
LGPAGR

SEQ ID NO: 400508 - protein, 5 aa, Mycobacterium
LGPAQ

SEQ ID NO: 400509 - protein, 5 aa, Mycobacterium
LGPDA

SEQ ID NO: 400510 - protein, 7 aa, Mycobacterium
LGPDAPL

SEQ ID NO: 400511 - protein, 7 aa, Mycobacterium
LGPDATQ

SEQ ID NO: 400512 - protein, 5 aa, Mycobacterium
LGPDL

SEQ ID NO: 400513 - protein, 10 aa, Mycobacterium
LGPDPDGEGD

SEQ ID NO: 400514 - protein, 8 aa, Mycobacterium
LGPDRVRP

SEQ ID NO: 400515 - protein, 5 aa, Mycobacterium
LGPDS

SEQ ID NO: 400516 - protein, 5 aa, Mycobacterium
LGPEH

SEQ ID NO: 400517 - protein, 6 aa, Mycobacterium
LGPGDA

SEQ ID NO: 400518 - protein, 7 aa, Mycobacterium
LGPGDDA

SEQ ID NO: 400519 - protein, 8 aa, Mycobacterium
LGPGQPPA

SEQ ID NO: 400520 - protein, 5 aa, Mycobacterium
LGPGR

SEQ ID NO: 400521 - protein, 5 aa, Mycobacterium
LGPKG

SEQ ID NO: 400522 - protein, 4 aa, Mycobacterium
LGPP

SEQ ID NO: 400523 - protein, 7 aa, Mycobacterium
LGPPPAD

SEQ ID NO: 400524 - protein, 5 aa, Mycobacterium
LGPPQ

SEQ ID NO: 400525 - protein, 4 aa, Mycobacterium
LGPS

SEQ ID NO: 400526 - protein, 12 aa, Mycobacterium
LGPSGKRPGAIA

SEQ ID NO: 400527 - protein, 9 aa, Mycobacterium
LGPSTAGQI

SEQ ID NO: 400528 - protein, 4 aa, Mycobacterium
LGPT

SEQ ID NO: 400529 - protein, 23 aa, Mycobacterium
LGPTTRTASISPDVNDPGARNVS

SEQ ID NO: 400530 - protein, 6 aa, Mycobacterium
LGPYKG

SEQ ID NO: 400531 - protein, 4 aa, Mycobacterium
LGRA

SEQ ID NO: 400532 - protein, 6 aa, Mycobacterium
LGRAGM

SEQ ID NO: 400533 - protein, 10 aa, Mycobacterium
LGRAGQPAEL

SEQ ID NO: 400534 - protein, 7 aa, Mycobacterium
LGREPRG

SEQ ID NO: 400535 - protein, 5 aa, Mycobacterium
LGRGG

SEQ ID NO: 400536 - protein, 10 aa, Mycobacterium
LGRNGKTKLS

SEQ ID NO: 400537 - protein, 5 aa, Mycobacterium
LGRSG

SEQ ID NO: 400538 - protein, 8 aa, Mycobacterium
LGRTPPYE

SEQ ID NO: 400539 - protein, 14 aa, Mycobacterium
LGRTQNGNNNGYCQ

SEQ ID NO: 400540 - protein, 5 aa, Mycobacterium
LGSAE

SEQ ID NO: 400541 - protein, 5 aa, Mycobacterium
LGSAS

SEQ ID NO: 400542 - protein, 11 aa, Mycobacterium
LGSDRRQATAA

SEQ ID NO: 400543 - protein, 8 aa, Mycobacterium
LGSGQTTK

SEQ ID NO: 400544 - protein, 8 aa, Mycobacterium
LGSKGTKR

SEQ ID NO: 400545 - protein, 11 aa, Mycobacterium
LGSPGQGAYAA

SEQ ID NO: 400546 - protein, 12 aa, Mycobacterium
LGSPGQGAYAAA

SEQ ID NO: 400547 - protein, 7 aa, Mycobacterium
LGSPLTA

SEQ ID NO: 400548 - protein, 6 aa, Mycobacterium
LGSQGV

SEQ ID NO: 400549 - protein, 8 aa, Mycobacterium
LGSVPDGD

SEQ ID NO: 400550 - protein, 4 aa, Mycobacterium
LGTE

SEQ ID NO: 400551 - protein, 7 aa, Mycobacterium
LGTERSA

SEQ ID NO: 400552 - protein, 9 aa, Mycobacterium
LGTGGARAV

SEQ ID NO: 400553 - protein, 6 aa, Mycobacterium
LGTGGL

SEQ ID NO: 400554 - protein, 5 aa, Mycobacterium
LGTGS

SEQ ID NO: 400555 - protein, 17 aa, Mycobacterium
LGTNPRKSTKTGAGERD

SEQ ID NO: 400556 - protein, 7 aa, Mycobacterium
LGTPKQR

SEQ ID NO: 400557 - protein, 6 aa, Mycobacterium
LGTPLG

SEQ ID NO: 400558 - protein, 4 aa, Mycobacterium
LGTR

SEQ ID NO: 400559 - protein, 7 aa, Mycobacterium
LGTSDIS

SEQ ID NO: 400560 - protein, 7 aa, Mycobacterium
LGTTPAR

SEQ ID NO: 400561 - protein, 9 aa, Mycobacterium
LGTTSRAPR

SEQ ID NO: 400562 - protein, 4 aa, Mycobacterium
LGTV

SEQ ID NO: 400563 - protein, 25 aa, Mycobacterium
LGVSESAASYTTGDMQAAAAYMIAR

SEQ ID NO: 400564 - protein, 19 aa, Mycobacterium
LGVTNPGYRPGDTATALPA

SEQ ID NO: 400565 - protein, 5 aa, Mycobacterium
LGYGR

SEQ ID NO: 400566 - protein, 15 aa, Mycobacterium
LHPDANPDNPAAGER

SEQ ID NO: 400567 - protein, 9 aa, Mycobacterium
LHPHGGASM

SEQ ID NO: 400568 - protein, 8 aa, Mycobacterium
LKADGSTA

SEQ ID NO: 400569 - protein, 10 aa, Mycobacterium
LKDKQSPEQL

SEQ ID NO: 400570 - protein, 7 aa, Mycobacterium
LKDSTRQ

SEQ ID NO: 400571 - protein, 12 aa, Mycobacterium
LKEAEDALRDYQ

SEQ ID NO: 400572 - protein, 7 aa, Mycobacterium
LKEDPGF

SEQ ID NO: 400573 - protein, 12 aa, Mycobacterium
LKGDGGSSWGNQ

SEQ ID NO: 400574 - protein, 8 aa, Mycobacterium
LKGGSQNT

SEQ ID NO: 400575 - protein, 10 aa, Mycobacterium
LKNQTYNTPA

SEQ ID NO: 400576 - protein, 6 aa, Mycobacterium
LKPETV

SEQ ID NO: 400577 - protein, 17 aa, Mycobacterium
LKPGGTIVEPTSGNTGV

SEQ ID NO: 400578 - protein, 6 aa, Mycobacterium
LKPPEL

SEQ ID NO: 400579 - protein, 6 aa, Mycobacterium
LKPPVE

SEQ ID NO: 400580 - protein, 8 aa, Mycobacterium
LKPYTRDT

SEQ ID NO: 400581 - protein, 5 aa, Mycobacterium
LKSGE

SEQ ID NO: 400582 - protein, 6 aa, Mycobacterium
LKTEPA

SEQ ID NO: 400583 - protein, 15 aa, Mycobacterium
LKVDSRDGSYLGRVN

SEQ ID NO: 400584 - protein, 15 aa, Mycobacterium
LKVDTRDGSYLGRVN

SEQ ID NO: 400585 - protein, 4 aa, Mycobacterium
LMPG

SEQ ID NO: 400586 - protein, 9 aa, Mycobacterium
LNAATGEYE

SEQ ID NO: 400587 - protein, 10 aa, Mycobacterium
LNADKTVEQV

SEQ ID NO: 400588 - protein, 4 aa, Mycobacterium
LNAG

SEQ ID NO: 400589 - protein, 8 aa, Mycobacterium
LNAGGGAV

SEQ ID NO: 400590 - protein, 5 aa, Mycobacterium
LNDDS

SEQ ID NO: 400591 - protein, 7 aa, Mycobacterium
LNGARNP

SEQ ID NO: 400592 - protein, 4 aa, Mycobacterium
LNGS

SEQ ID NO: 400593 - protein, 9 aa, Mycobacterium
LNKPSNSDV

SEQ ID NO: 400594 - protein, 8 aa, Mycobacterium
LNNAQQKN

SEQ ID NO: 400595 - protein, 8 aa, Mycobacterium
LNPAPTRE

SEQ ID NO: 400596 - protein, 4 aa, Mycobacterium
LNPD

SEQ ID NO: 400597 - protein, 4 aa, Mycobacterium
LNPE

SEQ ID NO: 400598 - protein, 14 aa, Mycobacterium
LNPGAVATPMGTGR

SEQ ID NO: 400599 - protein, 8 aa, Mycobacterium
LNPGPESC

SEQ ID NO: 400600 - protein, 6 aa, Mycobacterium
LNPSTG

SEQ ID NO: 400601 - protein, 21 aa, Mycobacterium
LNQPSGGTELATGAMRIDVGS

SEQ ID NO: 400602 - protein, 6 aa, Mycobacterium
LNRGPQ

SEQ ID NO: 400603 - protein, 4 aa, Mycobacterium
LNRP

SEQ ID NO: 400604 - protein, 4 aa, Mycobacterium
LNSG

SEQ ID NO: 400605 - protein, 10 aa, Mycobacterium
LNSGKTPKTV

SEQ ID NO: 400606 - protein, 11 aa, Mycobacterium
LNTDRRQATAA

SEQ ID NO: 400607 - protein, 14 aa, Mycobacterium
LNTHGGQLSHGRTH

SEQ ID NO: 400608 - protein, 6 aa, Mycobacterium
LNTPKA

SEQ ID NO: 400609 - protein, 7 aa, Mycobacterium
LPAAPSY

SEQ ID NO: 400610 - protein, 8 aa, Mycobacterium
LPAATGYP

SEQ ID NO: 400611 - protein, 5 aa, Mycobacterium
LPADE

SEQ ID NO: 400612 - protein, 5 aa, Mycobacterium
LPADP

SEQ ID NO: 400613 - protein, 14 aa, Mycobacterium
LPADTANLREGANL

SEQ ID NO: 400614 - protein, 5 aa, Mycobacterium
LPAEG

SEQ ID NO: 400615 - protein, 6 aa, Mycobacterium
LPAEGR

SEQ ID NO: 400616 - protein, 8 aa, Mycobacterium
LPAGGTSF

SEQ ID NO: 400617 - protein, 5 aa, Mycobacterium
LPAGP

SEQ ID NO: 400618 - protein, 8 aa, Mycobacterium
LPAGPQGH

SEQ ID NO: 400619 - protein, 6 aa, Mycobacterium
LPAGSP

SEQ ID NO: 400620 - protein, 5 aa, Mycobacterium
LPAKA

SEQ ID NO: 400621 - protein, 6 aa, Mycobacterium
LPAPGA

SEQ ID NO: 400622 - protein, 12 aa, Mycobacterium
LPAPIKPTAAPL

SEQ ID NO: 400623 - protein, 12 aa, Mycobacterium
LPAPIKPTAAPQ

SEQ ID NO: 400624 - protein, 5 aa, Mycobacterium
LPAPR

SEQ ID NO: 400625 - protein, 11 aa, Mycobacterium
LPAPSTDAGQI

SEQ ID NO: 400626 - protein, 5 aa, Mycobacterium
LPAPT

SEQ ID NO: 400627 - protein, 4 aa, Mycobacterium
LPAQ

SEQ ID NO: 400628 - protein, 5 aa, Mycobacterium
LPARG

SEQ ID NO: 400629 - protein, 11 aa, Mycobacterium
LPASPAKAVQE

SEQ ID NO: 400630 - protein, 6 aa, Mycobacterium
LPASQH

SEQ ID NO: 400631 - protein, 6 aa, Mycobacterium
LPATGG

SEQ ID NO: 400632 - protein, 5 aa, Mycobacterium
LPDAR

SEQ ID NO: 400633 - protein, 13 aa, Mycobacterium
LPDGSTTDVSTQT

SEQ ID NO: 400634 - protein, 9 aa, Mycobacterium
LPDPSPRAG

SEQ ID NO: 400635 - protein, 4 aa, Mycobacterium
LPDR

SEQ ID NO: 400636 - protein, 5 aa, Mycobacterium
LPDSA

SEQ ID NO: 400637 - protein, 15 aa, Mycobacterium
LPDTDLTQPPTHKAQ

SEQ ID NO: 400638 - protein, 6 aa, Mycobacterium
LPDTEI

SEQ ID NO: 400639 - protein, 8 aa, Mycobacterium
LPDTKAGD

SEQ ID NO: 400640 - protein, 6 aa, Mycobacterium
LPDTPA

SEQ ID NO: 400641 - protein, 8 aa, Mycobacterium
LPDTPEVR

SEQ ID NO: 400642 - protein, 26 aa, Mycobacterium
LPEEAQASLGKQVPHPARLGDPDEYG

SEQ ID NO: 400643 - protein, 5 aa, Mycobacterium
LPEGT

SEQ ID NO: 400644 - protein, 5 aa, Mycobacterium
LPEGY

SEQ ID NO: 400645 - protein, 8 aa, Mycobacterium
LPENATPA

SEQ ID NO: 400646 - protein, 8 aa, Mycobacterium
LPENDPRT

SEQ ID NO: 400647 - protein, 5 aa, Mycobacterium
LPEPL

SEQ ID NO: 400648 - protein, 8 aa, Mycobacterium
LPEPSLPG

SEQ ID NO: 400649 - protein, 10 aa, Mycobacterium
LPEPTASAAF

SEQ ID NO: 400650 - protein, 4 aa, Mycobacterium
LPEQ

SEQ ID NO: 400651 - protein, 4 aa, Mycobacterium
LPER

SEQ ID NO: 400652 - protein, 11 aa, Mycobacterium
LPERAEQGRNY

SEQ ID NO: 400653 - protein, 7 aa, Mycobacterium
LPERQRQ

SEQ ID NO: 400654 - protein, 4 aa, Mycobacterium
LPGA

SEQ ID NO: 400655 - protein, 8 aa, Mycobacterium
LPGAAQRA

SEQ ID NO: 400656 - protein, 4 aa, Mycobacterium
LPGD

SEQ ID NO: 400657 - protein, 5 aa, Mycobacterium
LPGDF

SEQ ID NO: 400658 - protein, 5 aa, Mycobacterium
LPGDG

SEQ ID NO: 400659 - protein, 4 aa, Mycobacterium
LPGE

SEQ ID NO: 400660 - protein, 7 aa, Mycobacterium
LPGEPIG

SEQ ID NO: 400661 - protein, 11 aa, Mycobacterium
LPGFSRDEAKE

SEQ ID NO: 400662 - protein, 6 aa, Mycobacterium
LPGGAE

SEQ ID NO: 400663 - protein, 6 aa, Mycobacterium
LPGGAG

SEQ ID NO: 400664 - protein, 8 aa, Mycobacterium
LPGGGFGH

SEQ ID NO: 400665 - protein, 6 aa, Mycobacterium
LPGGQG

SEQ ID NO: 400666 - protein, 10 aa, Mycobacterium
LPGHPESGEE

SEQ ID NO: 400667 - protein, 4 aa, Mycobacterium
LPGL

SEQ ID NO: 400668 - protein, 6 aa, Mycobacterium
LPGNGS

SEQ ID NO: 400669 - protein, 13 aa, Mycobacterium
LPGNRSDIRERST

SEQ ID NO: 400670 - protein, 8 aa, Mycobacterium
LPGPAGDI

SEQ ID NO: 400671 - protein, 6 aa, Mycobacterium
LPGPRL

SEQ ID NO: 400672 - protein, 5 aa, Mycobacterium
LPGPT

SEQ ID NO: 400673 - protein, 4 aa, Mycobacterium
LPGQ

SEQ ID NO: 400674 - protein, 4 aa, Mycobacterium
LPGR

SEQ ID NO: 400675 - protein, 6 aa, Mycobacterium
LPGRER

SEQ ID NO: 400676 - protein, 8 aa, Mycobacterium
LPGRGAAT

SEQ ID NO: 400677 - protein, 4 aa, Mycobacterium
LPGS

SEQ ID NO: 400678 - protein, 11 aa, Mycobacterium
LPGSASPVAID

SEQ ID NO: 400679 - protein, 11 aa, Mycobacterium
LPGSESDKMGP

SEQ ID NO: 400680 - protein, 11 aa, Mycobacterium
LPGSGTDTHAV

SEQ ID NO: 400681 - protein, 9 aa, Mycobacterium
LPGSSAAET

SEQ ID NO: 400682 - protein, 8 aa, Mycobacterium
LPGTATAT

SEQ ID NO: 400683 - protein, 8 aa, Mycobacterium
LPGTGTAT

SEQ ID NO: 400684 - protein, 4 aa, Mycobacterium
LPGV

SEQ ID NO: 400685 - protein, 4 aa, Mycobacterium
LPHR

SEQ ID NO: 400686 - protein, 20 aa, Mycobacterium
LPIGGGKGGSDFDPKGRSDA

SEQ ID NO: 400687 - protein, 4 aa, Mycobacterium
LPIR

SEQ ID NO: 400688 - protein, 5 aa, Mycobacterium
LPKRQ

SEQ ID NO: 400689 - protein, 7 aa, Mycobacterium
LPKRRPV

SEQ ID NO: 400690 - protein, 10 aa, Mycobacterium
LPKSGTKRPW

SEQ ID NO: 400691 - protein, 8 aa, Mycobacterium
LPKTRSGK

SEQ ID NO: 400692 - protein, 4 aa, Mycobacterium
LPMG

SEQ ID NO: 400693 - protein, 4 aa, Mycobacterium
LPNG

SEQ ID NO: 400694 - protein, 4 aa, Mycobacterium
LPPA

SEQ ID NO: 400695 - protein, 5 aa, Mycobacterium
LPPAA

SEQ ID NO: 400696 - protein, 6 aa, Mycobacterium
LPPDTF

SEQ ID NO: 400697 - protein, 5 aa, Mycobacterium
LPPEA

SEQ ID NO: 400698 - protein, 16 aa, Mycobacterium
LPPEEAANIPQAPTQL

SEQ ID NO: 400699 - protein, 6 aa, Mycobacterium
LPPEGR

SEQ ID NO: 400700 - protein, 5 aa, Mycobacterium
LPPEQ

SEQ ID NO: 400701 - protein, 7 aa, Mycobacterium
LPPGAGE

SEQ ID NO: 400702 - protein, 5 aa, Mycobacterium
LPPGD

SEQ ID NO: 400703 - protein, 5 aa, Mycobacterium
LPPGG

SEQ ID NO: 400704 - protein, 6 aa, Mycobacterium
LPPGGR

SEQ ID NO: 400705 - protein, 18 aa, Mycobacterium
LPPGPAYYPDGELTDEPE

SEQ ID NO: 400706 - protein, 6 aa, Mycobacterium
LPPGSE

SEQ ID NO: 400707 - protein, 16 aa, Mycobacterium
LPPGSLVGTSSPRRAA

SEQ ID NO: 400708 - protein, 6 aa, Mycobacterium
LPPGSP

SEQ ID NO: 400709 - protein, 5 aa, Mycobacterium
LPPGT

SEQ ID NO: 400710 - protein, 6 aa, Mycobacterium
LPPGTL

SEQ ID NO: 400711 - protein, 8 aa, Mycobacterium
LPPIEDPD

SEQ ID NO: 400712 - protein, 5 aa, Mycobacterium
LPPLP

SEQ ID NO: 400713 - protein, 5 aa, Mycobacterium
LPPPI

SEQ ID NO: 400714 - protein, 11 aa, Mycobacterium
LPPQPDAPEED

SEQ ID NO: 400715 - protein, 5 aa, Mycobacterium
LPPQV

SEQ ID NO: 400716 - protein, 5 aa, Mycobacterium
LPPRD

SEQ ID NO: 400717 - protein, 6 aa, Mycobacterium
LPPREQ

SEQ ID NO: 400718 - protein, 16 aa, Mycobacterium
LPPSPDGGPRRPPQHI

SEQ ID NO: 400719 - protein, 5 aa, Mycobacterium
LPPSV

SEQ ID NO: 400720 - protein, 4 aa, Mycobacterium
LPPT

SEQ ID NO: 400721 - protein, 5 aa, Mycobacterium
LPPTE

SEQ ID NO: 400722 - protein, 4 aa, Mycobacterium
LPPV

SEQ ID NO: 400723 - protein, 4 aa, Mycobacterium
LPQG

SEQ ID NO: 400724 - protein, 4 aa, Mycobacterium
LPRD

SEQ ID NO: 400725 - protein, 7 aa, Mycobacterium
LPRDGKA

SEQ ID NO: 400726 - protein, 8 aa, Mycobacterium
LPRDPNGK

SEQ ID NO: 400727 - protein, 7 aa, Mycobacterium
LPRGGAD

SEQ ID NO: 400728 - protein, 8 aa, Mycobacterium
LPRGRQPI

SEQ ID NO: 400729 - protein, 8 aa, Mycobacterium
LPRGSTGK

SEQ ID NO: 400730 - protein, 8 aa, Mycobacterium
LPRNASGK

SEQ ID NO: 400731 - protein, 7 aa, Mycobacterium
LPRPTTQ

SEQ ID NO: 400732 - protein, 6 aa, Mycobacterium
LPRQPQ

SEQ ID NO: 400733 - protein, 4 aa, Mycobacterium
LPRT

SEQ ID NO: 400734 - protein, 8 aa, Mycobacterium
LPRTDAGK

SEQ ID NO: 400735 - protein, 9 aa, Mycobacterium
LPSAGKGTS

SEQ ID NO: 400736 - protein, 9 aa, Mycobacterium
LPSDPAAQI

SEQ ID NO: 400737 - protein, 6 aa, Mycobacterium
LPSDRS

SEQ ID NO: 400738 - protein, 6 aa, Mycobacterium
LPSEGR

SEQ ID NO: 400739 - protein, 5 aa, Mycobacterium
LPSGG

SEQ ID NO: 400740 - protein, 23 aa, Mycobacterium
LPSGPRRRYAAQTSDISYGPGGR

SEQ ID NO: 400741 - protein, 8 aa, Mycobacterium
LPSPKARE

SEQ ID NO: 400742 - protein, 5 aa, Mycobacterium
LPSPT

SEQ ID NO: 400743 - protein, 7 aa, Mycobacterium
LPSRPTV

SEQ ID NO: 400744 - protein, 8 aa, Mycobacterium
LPSSGDVT

SEQ ID NO: 400745 - protein, 7 aa, Mycobacterium
LPSTATH

SEQ ID NO: 400746 - protein, 10 aa, Mycobacterium
LPSTRQPLGA

SEQ ID NO: 400747 - protein, 6 aa, Mycobacterium
LPTASP

SEQ ID NO: 400748 - protein, 8 aa, Mycobacterium
LPTDARRT

SEQ ID NO: 400749 - protein, 5 aa, Mycobacterium
LPTGG

SEQ ID NO: 400750 - protein, 6 aa, Mycobacterium
LPTGIK

SEQ ID NO: 400751 - protein, 4 aa, Mycobacterium
LPTP

SEQ ID NO: 400752 - protein, 11 aa, Mycobacterium
LPTPDYTTSAQ

SEQ ID NO: 400753 - protein, 5 aa, Mycobacterium
LPTPY

SEQ ID NO: 400754 - protein, 11 aa, Mycobacterium
LPTSPGYTGNT

SEQ ID NO: 400755 - protein, 6 aa, Mycobacterium
LPTSSG

SEQ ID NO: 400756 - protein, 10 aa, Mycobacterium
LPTSTGNSGV

SEQ ID NO: 400757 - protein, 11 aa, Mycobacterium
LPTSTGTGSGV

SEQ ID NO: 400758 - protein, 6 aa, Mycobacterium
LPTSTT

SEQ ID NO: 400759 - protein, 8 aa, Mycobacterium
LPTTPTGK

SEQ ID NO: 400760 - protein, 5 aa, Mycobacterium
LPTTV

SEQ ID NO: 400761 - protein, 9 aa, Mycobacterium
LPTVEGTGS

SEQ ID NO: 400762 - protein, 4 aa, Mycobacterium
LPVG

SEQ ID NO: 400763 - protein, 7 aa, Mycobacterium
LPVTGSN

SEQ ID NO: 400764 - protein, 5 aa, Mycobacterium
LPWDE

SEQ ID NO: 400765 - protein, 6 aa, Mycobacterium
LPYATT

SEQ ID NO: 400766 - protein, 8 aa, Mycobacterium
LPYPSAGA

SEQ ID NO: 400767 - protein, 7 aa, Mycobacterium
LPYSPPE

SEQ ID NO: 400768 - protein, 4 aa, Mycobacterium
LPYT

SEQ ID NO: 400769 - protein, 10 aa, Mycobacterium
LQAKSKEMSE

SEQ ID NO: 400770 - protein, 6 aa, Mycobacterium
LQAPSH

SEQ ID NO: 400771 - protein, 15 aa, Mycobacterium
LQAQGRQLGGRGPAT

SEQ ID NO: 400772 - protein, 6 aa, Mycobacterium
LQDESS

SEQ ID NO: 400773 - protein, 4 aa, Mycobacterium
LQDP

SEQ ID NO: 400774 - protein, 8 aa, Mycobacterium
LQDTDAGA

SEQ ID NO: 400775 - protein, 12 aa, Mycobacterium
LQGATDEDRQRV

SEQ ID NO: 400776 - protein, 4 aa, Mycobacterium
LQPA

SEQ ID NO: 400777 - protein, 11 aa, Mycobacterium
LQPGEDATEAA

SEQ ID NO: 400778 - protein, 4 aa, Mycobacterium
LQPH

SEQ ID NO: 400779 - protein, 11 aa, Mycobacterium
LQPNAGSQGEY

SEQ ID NO: 400780 - protein, 22 aa, Mycobacterium
LQQETEAAVRTRSDLDTPAGAR

SEQ ID NO: 400781 - protein, 6 aa, Mycobacterium
LQRAKR

SEQ ID NO: 400782 - protein, 6 aa, Mycobacterium
LQRGSS

SEQ ID NO: 400783 - protein, 4 aa, Mycobacterium
LQRT

SEQ ID NO: 400784 - protein, 10 aa, Mycobacterium
LQSGPDIKNP

SEQ ID NO: 400785 - protein, 38 aa, Mycobacterium
LQSPSGAGAPASAAAAGGVAAGGGAARGTGAAAGRGGM

SEQ ID NO: 400786 - protein, 6 aa, Mycobacterium
LQTHGG

SEQ ID NO: 400787 - protein, 7 aa, Mycobacterium
LQTLGGS

SEQ ID NO: 400788 - protein, 6 aa, Mycobacterium
LQTTRR

SEQ ID NO: 400789 - protein, 4 aa, Mycobacterium
LRAA

SEQ ID NO: 400790 - protein, 4 aa, Mycobacterium
LRAE

SEQ ID NO: 400791 - protein, 8 aa, Mycobacterium
LRAEREQG

SEQ ID NO: 400792 - protein, 11 aa, Mycobacterium
LRAGRSRNDQV

SEQ ID NO: 400793 - protein, 4 aa, Mycobacterium
LRAR

SEQ ID NO: 400794 - protein, 9 aa, Mycobacterium
LRASPKEVA

SEQ ID NO: 400795 - protein, 8 aa, Mycobacterium
LRDDGTTT

SEQ ID NO: 400796 - protein, 5 aa, Mycobacterium
LRDDP

SEQ ID NO: 400797 - protein, 6 aa, Mycobacterium
LRDPRQ

SEQ ID NO: 400798 - protein, 13 aa, Mycobacterium
LRDQQAAADRAKA

SEQ ID NO: 400799 - protein, 7 aa, Mycobacterium
LRDSEPT

SEQ ID NO: 400800 - protein, 5 aa, Mycobacterium
LRDSG

SEQ ID NO: 400801 - protein, 4 aa, Mycobacterium
LRDT

SEQ ID NO: 400802 - protein, 5 aa, Mycobacterium
LREAG

SEQ ID NO: 400803 - protein, 4 aa, Mycobacterium
LREP

SEQ ID NO: 400804 - protein, 4 aa, Mycobacterium
LRES

SEQ ID NO: 400805 - protein, 6 aa, Mycobacterium
LRETGT

SEQ ID NO: 400806 - protein, 4 aa, Mycobacterium
LRGD

SEQ ID NO: 400807 - protein, 7 aa, Mycobacterium
LRGDARE

SEQ ID NO: 400808 - protein, 5 aa, Mycobacterium
LRGGA

SEQ ID NO: 400809 - protein, 11 aa, Mycobacterium
LRGPVRGGPDA

SEQ ID NO: 400810 - protein, 8 aa, Mycobacterium
LRGSRTPD

SEQ ID NO: 400811 - protein, 8 aa, Mycobacterium
LRGYPEDP

SEQ ID NO: 400812 - protein, 8 aa, Mycobacterium
LRNGESSL

SEQ ID NO: 400813 - protein, 10 aa, Mycobacterium
LRNPGDPVTR

SEQ ID NO: 400814 - protein, 19 aa, Mycobacterium
LRPAPVGAYPAGASAYGAE

SEQ ID NO: 400815 - protein, 6 aa, Mycobacterium
LRPDDV

SEQ ID NO: 400816 - protein, 8 aa, Mycobacterium
LRPDGADP

SEQ ID NO: 400817 - protein, 5 aa, Mycobacterium
LRPEA

SEQ ID NO: 400818 - protein, 9 aa, Mycobacterium
LRPEERKTT

SEQ ID NO: 400819 - protein, 6 aa, Mycobacterium
LRPGGR

SEQ ID NO: 400820 - protein, 4 aa, Mycobacterium
LRPL

SEQ ID NO: 400821 - protein, 6 aa, Mycobacterium
LRPPDL

SEQ ID NO: 400822 - protein, 5 aa, Mycobacterium
LRPPK

SEQ ID NO: 400823 - protein, 21 aa, Mycobacterium
LRPPTRDPARRARTDATARDY

SEQ ID NO: 400824 - protein, 7 aa, Mycobacterium
LRPRPAV

SEQ ID NO: 400825 - protein, 4 aa, Mycobacterium
LRPT

SEQ ID NO: 400826 - protein, 5 aa, Mycobacterium
LRPTR

SEQ ID NO: 400827 - protein, 4 aa, Mycobacterium
LRPW

SEQ ID NO: 400828 - protein, 16 aa, Mycobacterium
LRQQAATGQPGPEGAG

SEQ ID NO: 400829 - protein, 7 aa, Mycobacterium
LRRDEDS

SEQ ID NO: 400830 - protein, 7 aa, Mycobacterium
LRRGENG

SEQ ID NO: 400831 - protein, 4 aa, Mycobacterium
LRRK

SEQ ID NO: 400832 - protein, 4 aa, Mycobacterium
LRRR

SEQ ID NO: 400833 - protein, 6 aa, Mycobacterium
LRRRRG

SEQ ID NO: 400834 - protein, 9 aa, Mycobacterium
LRSDGASGV

SEQ ID NO: 400835 - protein, 5 aa, Mycobacterium
LRSGG

SEQ ID NO: 400836 - protein, 9 aa, Mycobacterium
LRSGRRQRA

SEQ ID NO: 400837 - protein, 6 aa, Mycobacterium
LRSKPG

SEQ ID NO: 400838 - protein, 9 aa, Mycobacterium
LRTDTGESV

SEQ ID NO: 400839 - protein, 7 aa, Mycobacterium
LRTGPDG

SEQ ID NO: 400840 - protein, 8 aa, Mycobacterium
LRTRKAGA

SEQ ID NO: 400841 - protein, 10 aa, Mycobacterium
LRTTTDNRGR

SEQ ID NO: 400842 - protein, 11 aa, Mycobacterium
LRTTTDNRQRL

SEQ ID NO: 400843 - protein, 6 aa, Mycobacterium
LSADEA

SEQ ID NO: 400844 - protein, 4 aa, Mycobacterium
LSAE

SEQ ID NO: 400845 - protein, 10 aa, Mycobacterium
LSAGPGTRAN

SEQ ID NO: 400846 - protein, 8 aa, Mycobacterium
LSAPGSTI

SEQ ID NO: 400847 - protein, 17 aa, Mycobacterium
LSAPSPIRVPGRDPDWR

SEQ ID NO: 400848 - protein, 7 aa, Mycobacterium
LSAPTDT

SEQ ID NO: 400849 - protein, 4 aa, Mycobacterium
LSAQ

SEQ ID NO: 400850 - protein, 4 aa, Mycobacterium
LSAR

SEQ ID NO: 400851 - protein, 6 aa, Mycobacterium
LSARDV

SEQ ID NO: 400852 - protein, 8 aa, Mycobacterium
LSASGSRL

SEQ ID NO: 400853 - protein, 5 aa, Mycobacterium
LSATE

SEQ ID NO: 400854 - protein, 8 aa, Mycobacterium
LSDAEQQA

SEQ ID NO: 400855 - protein, 10 aa, Mycobacterium
LSDDETERAV

SEQ ID NO: 400856 - protein, 5 aa, Mycobacterium
LSDDP

SEQ ID NO: 400857 - protein, 8 aa, Mycobacterium
LSDGPPVS

SEQ ID NO: 400858 - protein, 9 aa, Mycobacterium
LSDKPPEPY

SEQ ID NO: 400859 - protein, 4 aa, Mycobacterium
LSDP

SEQ ID NO: 400860 - protein, 7 aa, Mycobacterium
LSDPAAE

SEQ ID NO: 400861 - protein, 9 aa, Mycobacterium
LSDPTQAKA

SEQ ID NO: 400862 - protein, 4 aa, Mycobacterium
LSDR

SEQ ID NO: 400863 - protein, 5 aa, Mycobacterium
LSDRA

SEQ ID NO: 400864 - protein, 9 aa, Mycobacterium
LSDRARNGR

SEQ ID NO: 400865 - protein, 6 aa, Mycobacterium
LSEANA

SEQ ID NO: 400866 - protein, 9 aa, Mycobacterium
LSEAPKIKP

SEQ ID NO: 400867 - protein, 4 aa, Mycobacterium
LSED

SEQ ID NO: 400868 - protein, 10 aa, Mycobacterium
LSEDAEGPGA

SEQ ID NO: 400869 - protein, 8 aa, Mycobacterium
LSEDASPA

SEQ ID NO: 400870 - protein, 8 aa, Mycobacterium
LSEEDKQL

SEQ ID NO: 400871 - protein, 7 aa, Mycobacterium
LSEEELD

SEQ ID NO: 400872 - protein, 8 aa, Mycobacterium
LSEGYGDD

SEQ ID NO: 400873 - protein, 11 aa, Mycobacterium
LSEHDSPGEAT

SEQ ID NO: 400874 - protein, 9 aa, Mycobacterium
LSEHPLDTT

SEQ ID NO: 400875 - protein, 6 aa, Mycobacterium
LSEKTG

SEQ ID NO: 400876 - protein, 6 aa, Mycobacterium
LSEPAT

SEQ ID NO: 400877 - protein, 11 aa, Mycobacterium
LSEPQAGSDAA

SEQ ID NO: 400878 - protein, 5 aa, Mycobacterium
LSEPR

SEQ ID NO: 400879 - protein, 4 aa, Mycobacterium
LSET

SEQ ID NO: 400880 - protein, 4 aa, Mycobacterium
LSEV

SEQ ID NO: 400881 - protein, 5 aa, Mycobacterium
LSEYT

SEQ ID NO: 400882 - protein, 4 aa, Mycobacterium
LSGA

SEQ ID NO: 400883 - protein, 5 aa, Mycobacterium
LSGDA

SEQ ID NO: 400884 - protein, 7 aa, Mycobacterium
LSGDEKD

SEQ ID NO: 400885 - protein, 4 aa, Mycobacterium
LSGG

SEQ ID NO: 400886 - protein, 7 aa, Mycobacterium
LSGGGTQ

SEQ ID NO: 400887 - protein, 7 aa, Mycobacterium
LSGGHGA

SEQ ID NO: 400888 - protein, 5 aa, Mycobacterium
LSGGQ

SEQ ID NO: 400889 - protein, 7 aa, Mycobacterium
LSGGQKQ

SEQ ID NO: 400890 - protein, 7 aa, Mycobacterium
LSGGQRQ

SEQ ID NO: 400891 - protein, 9 aa, Mycobacterium
LSGGTEGIH

SEQ ID NO: 400892 - protein, 11 aa, Mycobacterium
LSGKANRLPHE

SEQ ID NO: 400893 - protein, 7 aa, Mycobacterium
LSGKTRS

SEQ ID NO: 400894 - protein, 4 aa, Mycobacterium
LSGL

SEQ ID NO: 400895 - protein, 4 aa, Mycobacterium
LSGP

SEQ ID NO: 400896 - protein, 5 aa, Mycobacterium
LSGPA

SEQ ID NO: 400897 - protein, 6 aa, Mycobacterium
LSGPAR

SEQ ID NO: 400898 - protein, 4 aa, Mycobacterium
LSGR

SEQ ID NO: 400899 - protein, 25 aa, Mycobacterium
LSGRHGERDTRRAGAAGELTGATRP

SEQ ID NO: 400900 - protein, 7 aa, Mycobacterium
LSGRPDT

SEQ ID NO: 400901 - protein, 7 aa, Mycobacterium
LSGRRGR

SEQ ID NO: 400902 - protein, 9 aa, Mycobacterium
LSGSGKSSL

SEQ ID NO: 400903 - protein, 4 aa, Mycobacterium
LSGT

SEQ ID NO: 400904 - protein, 8 aa, Mycobacterium
LSGTEQIR

SEQ ID NO: 400905 - protein, 4 aa, Mycobacterium
LSGY

SEQ ID NO: 400906 - protein, 5 aa, Mycobacterium
LSGYD

SEQ ID NO: 400907 - protein, 7 aa, Mycobacterium
LSHAQGE

SEQ ID NO: 400908 - protein, 8 aa, Mycobacterium
LSHERAGA

SEQ ID NO: 400909 - protein, 17 aa, Mycobacterium
LSIGGDDDDVDVPPFMR

SEQ ID NO: 400910 - protein, 15 aa, Mycobacterium
LSPAGSRVSAETAPM

SEQ ID NO: 400911 - protein, 4 aa, Mycobacterium
LSPD

SEQ ID NO: 400912 - protein, 5 aa, Mycobacterium
LSPDV

SEQ ID NO: 400913 - protein, 5 aa, Mycobacterium
LSPET

SEQ ID NO: 400914 - protein, 8 aa, Mycobacterium
LSPGADVQ

SEQ ID NO: 400915 - protein, 6 aa, Mycobacterium
LSPGAP

SEQ ID NO: 400916 - protein, 5 aa, Mycobacterium
LSPGE

SEQ ID NO: 400917 - protein, 7 aa, Mycobacterium
LSPPSVN

SEQ ID NO: 400918 - protein, 4 aa, Mycobacterium
LSPQ

SEQ ID NO: 400919 - protein, 6 aa, Mycobacterium
LSPQNT

SEQ ID NO: 400920 - protein, 6 aa, Mycobacterium
LSPRAL

SEQ ID NO: 400921 - protein, 12 aa, Mycobacterium
LSPREGAAIGTA

SEQ ID NO: 400922 - protein, 8 aa, Mycobacterium
LSPSKPIL

SEQ ID NO: 400923 - protein, 5 aa, Mycobacterium
LSPTD

SEQ ID NO: 400924 - protein, 6 aa, Mycobacterium
LSPTRD

SEQ ID NO: 400925 - protein, 4 aa, Mycobacterium
LSQA

SEQ ID NO: 400926 - protein, 8 aa, Mycobacterium
LSQPARER

SEQ ID NO: 400927 - protein, 7 aa, Mycobacterium
LSQYTRG

SEQ ID NO: 400928 - protein, 4 aa, Mycobacterium
LSRD

SEQ ID NO: 400929 - protein, 10 aa, Mycobacterium
LSRDPNPHVS

SEQ ID NO: 400930 - protein, 5 aa, Mycobacterium
LSRQI

SEQ ID NO: 400931 - protein, 4 aa, Mycobacterium
LSRT

SEQ ID NO: 400932 - protein, 4 aa, Mycobacterium
LSSA

SEQ ID NO: 400933 - protein, 7 aa, Mycobacterium
LSSAKGD

SEQ ID NO: 400934 - protein, 4 aa, Mycobacterium
LSSK

SEQ ID NO: 400935 - protein, 8 aa, Mycobacterium
LSSNPIGA

SEQ ID NO: 400936 - protein, 8 aa, Mycobacterium
LSTDPAKA

SEQ ID NO: 400937 - protein, 6 aa, Mycobacterium
LSTEAI

SEQ ID NO: 400938 - protein, 5 aa, Mycobacterium
LSTGN

SEQ ID NO: 400939 - protein, 5 aa, Mycobacterium
LSTPA

SEQ ID NO: 400940 - protein, 4 aa, Mycobacterium
LSTR

SEQ ID NO: 400941 - protein, 5 aa, Mycobacterium
LSTRS

SEQ ID NO: 400942 - protein, 4 aa, Mycobacterium
LSVH

SEQ ID NO: 400943 - protein, 6 aa, Mycobacterium
LTAEQA

SEQ ID NO: 400944 - protein, 4 aa, Mycobacterium
LTAG

SEQ ID NO: 400945 - protein, 9 aa, Mycobacterium
LTAGGDDYV

SEQ ID NO: 400946 - protein, 6 aa, Mycobacterium
LTAGSG

SEQ ID NO: 400947 - protein, 11 aa, Mycobacterium
LTAKGRATRDR

SEQ ID NO: 400948 - protein, 4 aa, Mycobacterium
LTAP

SEQ ID NO: 400949 - protein, 6 aa, Mycobacterium
LTAPPA

SEQ ID NO: 400950 - protein, 4 aa, Mycobacterium
LTAT

SEQ ID NO: 400951 - protein, 5 aa, Mycobacterium
LTDDE

SEQ ID NO: 400952 - protein, 6 aa, Mycobacterium
LTDEDA

SEQ ID NO: 400953 - protein, 11 aa, Mycobacterium
LTDFDSNRSGG

SEQ ID NO: 400954 - protein, 10 aa, Mycobacterium
LTDGRGSDSV

SEQ ID NO: 400955 - protein, 9 aa, Mycobacterium
LTDPKAGPL

SEQ ID NO: 400956 - protein, 9 aa, Mycobacterium
LTDPKAGPM

SEQ ID NO: 400957 - protein, 11 aa, Mycobacterium
LTDTSPSPHAM

SEQ ID NO: 400958 - protein, 9 aa, Mycobacterium
LTEADGPTV

SEQ ID NO: 400959 - protein, 8 aa, Mycobacterium
LTEDPEQL

SEQ ID NO: 400960 - protein, 14 aa, Mycobacterium
LTEGPRGWDAPTPA

SEQ ID NO: 400961 - protein, 5 aa, Mycobacterium
LTEGT

SEQ ID NO: 400962 - protein, 5 aa, Mycobacterium
LTETA

SEQ ID NO: 400963 - protein, 6 aa, Mycobacterium
LTETRR

SEQ ID NO: 400964 - protein, 10 aa, Mycobacterium
LTGKSRDEVQ

SEQ ID NO: 400965 - protein, 4 aa, Mycobacterium
LTGN

SEQ ID NO: 400966 - protein, 7 aa, Mycobacterium
LTGPANL

SEQ ID NO: 400967 - protein, 13 aa, Mycobacterium
LTGPPGAQHYSDE

SEQ ID NO: 400968 - protein, 6 aa, Mycobacterium
LTGQGG

SEQ ID NO: 400969 - protein, 14 aa, Mycobacterium
LTGQPSKQAPFEPL

SEQ ID NO: 400970 - protein, 4 aa, Mycobacterium
LTGR

SEQ ID NO: 400971 - protein, 5 aa, Mycobacterium
LTGRQ

SEQ ID NO: 400972 - protein, 9 aa, Mycobacterium
LTGRQAESA

SEQ ID NO: 400973 - protein, 9 aa, Mycobacterium
LTGSRTTAA

SEQ ID NO: 400974 - protein, 8 aa, Mycobacterium
LTHPDGRS

SEQ ID NO: 400975 - protein, 7 aa, Mycobacterium
LTMPPST

SEQ ID NO: 400976 - protein, 4 aa, Mycobacterium
LTNY

SEQ ID NO: 400977 - protein, 5 aa, Mycobacterium
LTPAE

SEQ ID NO: 400978 - protein, 7 aa, Mycobacterium
LTPDEAA

SEQ ID NO: 400979 - protein, 9 aa, Mycobacterium
LTPDGPTAT

SEQ ID NO: 400980 - protein, 9 aa, Mycobacterium
LTPDGYERT

SEQ ID NO: 400981 - protein, 4 aa, Mycobacterium
LTPG

SEQ ID NO: 400982 - protein, 6 aa, Mycobacterium
LTPGGG

SEQ ID NO: 400983 - protein, 12 aa, Mycobacterium
LTPGGLATQYSS

SEQ ID NO: 400984 - protein, 13 aa, Mycobacterium
LTPGGLATQYSSA

SEQ ID NO: 400985 - protein, 5 aa, Mycobacterium
LTPGR

SEQ ID NO: 400986 - protein, 9 aa, Mycobacterium
LTPNEPRFQ

SEQ ID NO: 400987 - protein, 5 aa, Mycobacterium
LTPQE

SEQ ID NO: 400988 - protein, 7 aa, Mycobacterium
LTPQGTL

SEQ ID NO: 400989 - protein, 5 aa, Mycobacterium
LTPQQ

SEQ ID NO: 400990 - protein, 5 aa, Mycobacterium
LTPRA

SEQ ID NO: 400991 - protein, 5 aa, Mycobacterium
LTPRE

SEQ ID NO: 400992 - protein, 6 aa, Mycobacterium
LTPRGG

SEQ ID NO: 400993 - protein, 4 aa, Mycobacterium
LTPS

SEQ ID NO: 400994 - protein, 9 aa, Mycobacterium
LTPSEDQPQ

SEQ ID NO: 400995 - protein, 6 aa, Mycobacterium
LTPSYR

SEQ ID NO: 400996 - protein, 7 aa, Mycobacterium
LTPTQYP

SEQ ID NO: 400997 - protein, 7 aa, Mycobacterium
LTQPGTT

SEQ ID NO: 400998 - protein, 12 aa, Mycobacterium
LTQTHPDIPEQL

SEQ ID NO: 400999 - protein, 16 aa, Mycobacterium
LTRASTRGDGRTGEDV

SEQ ID NO: 401000 - protein, 4 aa, Mycobacterium
LTRD

SEQ ID NO: 401001 - protein, 5 aa, Mycobacterium
LTRPT

SEQ ID NO: 401002 - protein, 4 aa, Mycobacterium
LTRT

SEQ ID NO: 401003 - protein, 5 aa, Mycobacterium
LTRTG

SEQ ID NO: 401004 - protein, 11 aa, Mycobacterium
LTSEAADKAQH

SEQ ID NO: 401005 - protein, 7 aa, Mycobacterium
LTSGEEL

SEQ ID NO: 401006 - protein, 7 aa, Mycobacterium
LTSGNRI

SEQ ID NO: 401007 - protein, 4 aa, Mycobacterium
LTSP

SEQ ID NO: 401008 - protein, 7 aa, Mycobacterium
LTSSPVA

SEQ ID NO: 401009 - protein, 7 aa, Mycobacterium
LTTESGA

SEQ ID NO: 401010 - protein, 4 aa, Mycobacterium
LTTP

SEQ ID NO: 401011 - protein, 12 aa, Mycobacterium
LTTPNSTNTEHQ

SEQ ID NO: 401012 - protein, 4 aa, Mycobacterium
LTTR

SEQ ID NO: 401013 - protein, 8 aa, Mycobacterium
LTTTPSQE

SEQ ID NO: 401014 - protein, 7 aa, Mycobacterium
LVEDPQR

SEQ ID NO: 401015 - protein, 6 aa, Mycobacterium
LVPDPS

SEQ ID NO: 401016 - protein, 5 aa, Mycobacterium
LVPDS

SEQ ID NO: 401017 - protein, 7 aa, Mycobacterium
LVTGGTD

SEQ ID NO: 401018 - protein, 7 aa, Mycobacterium
LYPANSV

SEQ ID NO: 401019 - protein, 7 aa, Mycobacterium
MAAPPPL

SEQ ID NO: 401020 - protein, 4 aa, Mycobacterium
MADP

SEQ ID NO: 401021 - protein, 10 aa, Mycobacterium
MADSYDEQGN

SEQ ID NO: 401022 - protein, 7 aa, Mycobacterium
MAEQRDS

SEQ ID NO: 401023 - protein, 4 aa, Mycobacterium
MAER

SEQ ID NO: 401024 - protein, 5 aa, Mycobacterium
MAPGS

SEQ ID NO: 401025 - protein, 5 aa, Mycobacterium
MARPE

SEQ ID NO: 401026 - protein, 6 aa, Mycobacterium
MATSQR

SEQ ID NO: 401027 - protein, 13 aa, Mycobacterium
MDAGADKAAELAN

SEQ ID NO: 401028 - protein, 5 aa, Mycobacterium
MDERR

SEQ ID NO: 401029 - protein, 12 aa, Mycobacterium
MDGTAQREAGMT

SEQ ID NO: 401030 - protein, 4 aa, Mycobacterium
MDPL

SEQ ID NO: 401031 - protein, 5 aa, Mycobacterium
MDPQQ

SEQ ID NO: 401032 - protein, 7 aa, Mycobacterium
MDQSGAN

SEQ ID NO: 401033 - protein, 7 aa, Mycobacterium
MDRGGAR

SEQ ID NO: 401034 - protein, 7 aa, Mycobacterium
MDRGGTR

SEQ ID NO: 401035 - protein, 8 aa, Mycobacterium
MDSPRRKE

SEQ ID NO: 401036 - protein, 21 aa, Mycobacterium
MDSSFGKNAANRVEESYGDAK

SEQ ID NO: 401037 - protein, 10 aa, Mycobacterium
MEDGYSTGRG

SEQ ID NO: 401038 - protein, 8 aa, Mycobacterium
MEERSGAR

SEQ ID NO: 401039 - protein, 5 aa, Mycobacterium
MEGAQ

SEQ ID NO: 401040 - protein, 11 aa, Mycobacterium
MENPAEDAVSD

SEQ ID NO: 401041 - protein, 9 aa, Mycobacterium
MEQDRHNEA

SEQ ID NO: 401042 - protein, 4 aa, Mycobacterium
MERA

SEQ ID NO: 401043 - protein, 7 aa, Mycobacterium
MESGHAY

SEQ ID NO: 401044 - protein, 5 aa, Mycobacterium
MESTG

SEQ ID NO: 401045 - protein, 7 aa, Mycobacterium
METPSAL

SEQ ID NO: 401046 - protein, 7 aa, Mycobacterium
MGDDSRA

SEQ ID NO: 401047 - protein, 4 aa, Mycobacterium
MGGG

SEQ ID NO: 401048 - protein, 38 aa, Mycobacterium
MGGMGSASKAGLAAASGVPGGPALKPAALGGGAGAGAA

SEQ ID NO: 401049 - protein, 6 aa, Mycobacterium
MGGPGL

SEQ ID NO: 401050 - protein, 4 aa, Mycobacterium
MGPA

SEQ ID NO: 401051 - protein, 5 aa, Mycobacterium
MGPEQ

SEQ ID NO: 401052 - protein, 5 aa, Mycobacterium
MGPEY

SEQ ID NO: 401053 - protein, 9 aa, Mycobacterium
MGQEPKDPD

SEQ ID NO: 401054 - protein, 7 aa, Mycobacterium
MGQGAAA

SEQ ID NO: 401055 - protein, 4 aa, Mycobacterium
MGRA

SEQ ID NO: 401056 - protein, 9 aa, Mycobacterium
MGSASTNYY

SEQ ID NO: 401057 - protein, 6 aa, Mycobacterium
MGTPED

SEQ ID NO: 401058 - protein, 4 aa, Mycobacterium
MKAG

SEQ ID NO: 401059 - protein, 8 aa, Mycobacterium
MKEAGRGS

SEQ ID NO: 401060 - protein, 7 aa, Mycobacterium
MKERSTA

SEQ ID NO: 401061 - protein, 7 aa, Mycobacterium
MKETGAN

SEQ ID NO: 401062 - protein, 4 aa, Mycobacterium
MKPG

SEQ ID NO: 401063 - protein, 9 aa, Mycobacterium
MNAKSTAVG

SEQ ID NO: 401064 - protein, 10 aa, Mycobacterium
MNEGGPRKVS

SEQ ID NO: 401065 - protein, 5 aa, Mycobacterium
MNPNG

SEQ ID NO: 401066 - protein, 6 aa, Mycobacterium
MNPRTS

SEQ ID NO: 401067 - protein, 5 aa, Mycobacterium
MPCTP

SEQ ID NO: 401068 - protein, 4 aa, Mycobacterium
MPDE

SEQ ID NO: 401069 - protein, 5 aa, Mycobacterium
MPDGD

SEQ ID NO: 401070 - protein, 4 aa, Mycobacterium
MPGR

SEQ ID NO: 401071 - protein, 6 aa, Mycobacterium
MPNGAA

SEQ ID NO: 401072 - protein, 7 aa, Mycobacterium
MPPPERH

SEQ ID NO: 401073 - protein, 8 aa, Mycobacterium
MPPRPGER

SEQ ID NO: 401074 - protein, 4 aa, Mycobacterium
MPTR

SEQ ID NO: 401075 - protein, 6 aa, Mycobacterium
MPTTGA

SEQ ID NO: 401076 - protein, 5 aa, Mycobacterium
MQEAT

SEQ ID NO: 401077 - protein, 12 aa, Mycobacterium
MQGAARPGKQTT

SEQ ID NO: 401078 - protein, 6 aa, Mycobacterium
MQNTEG

SEQ ID NO: 401079 - protein, 4 aa, Mycobacterium
MQPG

SEQ ID NO: 401080 - protein, 6 aa, Mycobacterium
MQPGGY

SEQ ID NO: 401081 - protein, 11 aa, Mycobacterium
MRGGDGSANPY

SEQ ID NO: 401082 - protein, 7 aa, Mycobacterium
MRGTGSH

SEQ ID NO: 401083 - protein, 7 aa, Mycobacterium
MRPDTTM

SEQ ID NO: 401084 - protein, 8 aa, Mycobacterium
MRPQTTRH

SEQ ID NO: 401085 - protein, 13 aa, Mycobacterium
MRQPQREDPGEHL

SEQ ID NO: 401086 - protein, 10 aa, Mycobacterium
MSAEDGAALD

SEQ ID NO: 401087 - protein, 10 aa, Mycobacterium
MSAGEEAQAA

SEQ ID NO: 401088 - protein, 7 aa, Mycobacterium
MSAKGIP

SEQ ID NO: 401089 - protein, 6 aa, Mycobacterium
MSAPNE

SEQ ID NO: 401090 - protein, 8 aa, Mycobacterium
MSDDRGRP

SEQ ID NO: 401091 - protein, 9 aa, Mycobacterium
MSDDRGRPC

SEQ ID NO: 401092 - protein, 4 aa, Mycobacterium
MSDE

SEQ ID NO: 401093 - protein, 7 aa, Mycobacterium
MSETAGG

SEQ ID NO: 401094 - protein, 4 aa, Mycobacterium
MSGA

SEQ ID NO: 401095 - protein, 5 aa, Mycobacterium
MSGAG

SEQ ID NO: 401096 - protein, 7 aa, Mycobacterium
MSGGHAE

SEQ ID NO: 401097 - protein, 6 aa, Mycobacterium
MSGSNI

SEQ ID NO: 401098 - protein, 4 aa, Mycobacterium
MSGT

SEQ ID NO: 401099 - protein, 9 aa, Mycobacterium
MSGTPGPAY

SEQ ID NO: 401100 - protein, 4 aa, Mycobacterium
MSHG

SEQ ID NO: 401101 - protein, 4 aa, Mycobacterium
MSNP

SEQ ID NO: 401102 - protein, 4 aa, Mycobacterium
MSPG

SEQ ID NO: 401103 - protein, 6 aa, Mycobacterium
MSPQRK

SEQ ID NO: 401104 - protein, 4 aa, Mycobacterium
MSPY

SEQ ID NO: 401105 - protein, 7 aa, Mycobacterium
MSRGEHR

SEQ ID NO: 401106 - protein, 4 aa, Mycobacterium
MTAA

SEQ ID NO: 401107 - protein, 6 aa, Mycobacterium
MTDGGA

SEQ ID NO: 401108 - protein, 7 aa, Mycobacterium
MTEEQTS

SEQ ID NO: 401109 - protein, 16 aa, Mycobacterium
MTGATAASTAAARMNG

SEQ ID NO: 401110 - protein, 15 aa, Mycobacterium
MTGGKEPNKGVNPDE

SEQ ID NO: 401111 - protein, 9 aa, Mycobacterium
MTGGRGPDA

SEQ ID NO: 401112 - protein, 8 aa, Mycobacterium
MTGPRDDP

SEQ ID NO: 401113 - protein, 8 aa, Mycobacterium
MTGTEDPE

SEQ ID NO: 401114 - protein, 12 aa, Mycobacterium
MTPPERDTTADG

SEQ ID NO: 401115 - protein, 4 aa, Mycobacterium
MTPR

SEQ ID NO: 401116 - protein, 7 aa, Mycobacterium
MTPTSDT

SEQ ID NO: 401117 - protein, 7 aa, Mycobacterium
MTSGYSP

SEQ ID NO: 401118 - protein, 10 aa, Mycobacterium
MYSGPGSGPM

SEQ ID NO: 401119 - protein, 10 aa, Mycobacterium
MYTGPGSGPL

SEQ ID NO: 401120 - protein, 9 aa, Mycobacterium
NAADPTRWT

SEQ ID NO: 401121 - protein, 5 aa, Mycobacterium
NAAEG

SEQ ID NO: 401122 - protein, 15 aa, Mycobacterium
NAAERAAGKPLPGAR

SEQ ID NO: 401123 - protein, 6 aa, Mycobacterium
NAAQDI

SEQ ID NO: 401124 - protein, 6 aa, Mycobacterium
NAASLG

SEQ ID NO: 401125 - protein, 6 aa, Mycobacterium
NAAYSA

SEQ ID NO: 401126 - protein, 9 aa, Mycobacterium
NACGANDGA

SEQ ID NO: 401127 - protein, 4 aa, Mycobacterium
NADA

SEQ ID NO: 401128 - protein, 6 aa, Mycobacterium
NADEGR

SEQ ID NO: 401129 - protein, 8 aa, Mycobacterium
NADGAGDL

SEQ ID NO: 401130 - protein, 8 aa, Mycobacterium
NADGKEIA

SEQ ID NO: 401131 - protein, 7 aa, Mycobacterium
NADPTEL

SEQ ID NO: 401132 - protein, 6 aa, Mycobacterium
NAEALP

SEQ ID NO: 401133 - protein, 5 aa, Mycobacterium
NAEGY

SEQ ID NO: 401134 - protein, 12 aa, Mycobacterium
NAEHSSTGLRSA

SEQ ID NO: 401135 - protein, 12 aa, Mycobacterium
NAEQAGVTGPLP

SEQ ID NO: 401136 - protein, 6 aa, Mycobacterium
NAESRS

SEQ ID NO: 401137 - protein, 4 aa, Mycobacterium
NAEV

SEQ ID NO: 401138 - protein, 11 aa, Mycobacterium
NAGDGTHEHPT

SEQ ID NO: 401139 - protein, 6 aa, Mycobacterium
NAGDHN

SEQ ID NO: 401140 - protein, 9 aa, Mycobacterium
NAGEGLPPL

SEQ ID NO: 401141 - protein, 12 aa, Mycobacterium
NAGGSIPPPPGY

SEQ ID NO: 401142 - protein, 7 aa, Mycobacterium
NAGLREG

SEQ ID NO: 401143 - protein, 5 aa, Mycobacterium
NAGLS

SEQ ID NO: 401144 - protein, 5 aa, Mycobacterium
NAGNI

SEQ ID NO: 401145 - protein, 7 aa, Mycobacterium
NAGPGKK

SEQ ID NO: 401146 - protein, 25 aa, Mycobacterium
NAHGQKVQAAGNNMASTDSAVGSSW

SEQ ID NO: 401147 - protein, 6 aa, Mycobacterium
NAIAGS

SEQ ID NO: 401148 - protein, 9 aa, Mycobacterium
NAIAGSYAE

SEQ ID NO: 401149 - protein, 8 aa, Mycobacterium
NAKAAVEE

SEQ ID NO: 401150 - protein, 7 aa, Mycobacterium
NANHTEG

SEQ ID NO: 401151 - protein, 6 aa, Mycobacterium
NANPAA

SEQ ID NO: 401152 - protein, 7 aa, Mycobacterium
NANPDCT

SEQ ID NO: 401153 - protein, 6 aa, Mycobacterium
NAPAIA

SEQ ID NO: 401154 - protein, 9 aa, Mycobacterium
NAPASTSPL

SEQ ID NO: 401155 - protein, 6 aa, Mycobacterium
NAPDDV

SEQ ID NO: 401156 - protein, 5 aa, Mycobacterium
NAPGA

SEQ ID NO: 401157 - protein, 4 aa, Mycobacterium
NAPL

SEQ ID NO: 401158 - protein, 13 aa, Mycobacterium
NAPLTRPRPGHAD

SEQ ID NO: 401159 - protein, 5 aa, Mycobacterium
NAPPA

SEQ ID NO: 401160 - protein, 7 aa, Mycobacterium
NAQGAEA

SEQ ID NO: 401161 - protein, 4 aa, Mycobacterium
NAQR

SEQ ID NO: 401162 - protein, 7 aa, Mycobacterium
NAQRSIT

SEQ ID NO: 401163 - protein, 6 aa, Mycobacterium
NAQTVR

SEQ ID NO: 401164 - protein, 7 aa, Mycobacterium
NARAGLA

SEQ ID NO: 401165 - protein, 8 aa, Mycobacterium
NARDRTMA

SEQ ID NO: 401166 - protein, 4 aa, Mycobacterium
NARG

SEQ ID NO: 401167 - protein, 19 aa, Mycobacterium
NARHGLANPNARYRKEATL

SEQ ID NO: 401168 - protein, 6 aa, Mycobacterium
NARQPN

SEQ ID NO: 401169 - protein, 12 aa, Mycobacterium
NARRNPNAQTRG

SEQ ID NO: 401170 - protein, 11 aa, Mycobacterium
NASGRSPAAWT

SEQ ID NO: 401171 - protein, 4 aa, Mycobacterium
NASP

SEQ ID NO: 401172 - protein, 6 aa, Mycobacterium
NASQHE

SEQ ID NO: 401173 - protein, 6 aa, Mycobacterium
NATESL

SEQ ID NO: 401174 - protein, 7 aa, Mycobacterium
NATPSTL

SEQ ID NO: 401175 - protein, 15 aa, Mycobacterium
NAVPGIDGDCGGEAA

SEQ ID NO: 401176 - protein, 8 aa, Mycobacterium
NAWQDPAE

SEQ ID NO: 401177 - protein, 5 aa, Mycobacterium
NAYAP

SEQ ID NO: 401178 - protein, 6 aa, Mycobacterium
NCGSTH

SEQ ID NO: 401179 - protein, 4 aa, Mycobacterium
NCPN

SEQ ID NO: 401180 - protein, 4 aa, Mycobacterium
NDAE

SEQ ID NO: 401181 - protein, 11 aa, Mycobacterium
NDAGDAASDAV

SEQ ID NO: 401182 - protein, 5 aa, Mycobacterium
NDAPI

SEQ ID NO: 401183 - protein, 8 aa, Mycobacterium
NDARPARE

SEQ ID NO: 401184 - protein, 4 aa, Mycobacterium
NDAT

SEQ ID NO: 401185 - protein, 10 aa, Mycobacterium
NDDGAYEEPW

SEQ ID NO: 401186 - protein, 10 aa, Mycobacterium
NDDHGDPANI

SEQ ID NO: 401187 - protein, 6 aa, Mycobacterium
NDDQGI

SEQ ID NO: 401188 - protein, 8 aa, Mycobacterium
NDDQPYPL

SEQ ID NO: 401189 - protein, 5 aa, Mycobacterium
NDEEL

SEQ ID NO: 401190 - protein, 7 aa, Mycobacterium
NDEVGGT

SEQ ID NO: 401191 - protein, 5 aa, Mycobacterium
NDGGT

SEQ ID NO: 401192 - protein, 9 aa, Mycobacterium
NDGPLGHQT

SEQ ID NO: 401193 - protein, 8 aa, Mycobacterium
NDGRPSQL

SEQ ID NO: 401194 - protein, 6 aa, Mycobacterium
NDGSAA

SEQ ID NO: 401195 - protein, 13 aa, Mycobacterium
NDHTAGGLQTNTA

SEQ ID NO: 401196 - protein, 9 aa, Mycobacterium
NDIDEGAAP

SEQ ID NO: 401197 - protein, 10 aa, Mycobacterium
NDKASGAGRS

SEQ ID NO: 401198 - protein, 8 aa, Mycobacterium
NDKKRARV

SEQ ID NO: 401199 - protein, 5 aa, Mycobacterium
NDLSG

SEQ ID NO: 401200 - protein, 9 aa, Mycobacterium
NDNDPRGTR

SEQ ID NO: 401201 - protein, 12 aa, Mycobacterium
NDPATGQPITTS

SEQ ID NO: 401202 - protein, 5 aa, Mycobacterium
NDPDA

SEQ ID NO: 401203 - protein, 9 aa, Mycobacterium
NDPDANAER

SEQ ID NO: 401204 - protein, 10 aa, Mycobacterium
NDPDRRNAVT

SEQ ID NO: 401205 - protein, 5 aa, Mycobacterium
NDPNV

SEQ ID NO: 401206 - protein, 5 aa, Mycobacterium
NDPRN

SEQ ID NO: 401207 - protein, 10 aa, Mycobacterium
NDRDRTPIRP

SEQ ID NO: 401208 - protein, 7 aa, Mycobacterium
NDSDYGL

SEQ ID NO: 401209 - protein, 7 aa, Mycobacterium
NDSEYGL

SEQ ID NO: 401210 - protein, 5 aa, Mycobacterium
NDSRY

SEQ ID NO: 401211 - protein, 7 aa, Mycobacterium
NDTDRDA

SEQ ID NO: 401212 - protein, 6 aa, Mycobacterium
NDTPYG

SEQ ID NO: 401213 - protein, 10 aa, Mycobacterium
NDTSLSRNGY

SEQ ID NO: 401214 - protein, 11 aa, Mycobacterium
NDYVGKGLSGG

SEQ ID NO: 401215 - protein, 9 aa, Mycobacterium
NEAADGADT

SEQ ID NO: 401216 - protein, 8 aa, Mycobacterium
NEAEKAAD

SEQ ID NO: 401217 - protein, 10 aa, Mycobacterium
NEAGSTASFT

SEQ ID NO: 401218 - protein, 6 aa, Mycobacterium
NEAGSV

SEQ ID NO: 401219 - protein, 9 aa, Mycobacterium
NEANDKDIE

SEQ ID NO: 401220 - protein, 9 aa, Mycobacterium
NEANEKDIE

SEQ ID NO: 401221 - protein, 11 aa, Mycobacterium
NEATDGTGGAV

SEQ ID NO: 401222 - protein, 8 aa, Mycobacterium
NEATDRDI

SEQ ID NO: 401223 - protein, 14 aa, Mycobacterium
NEDAKRKAAAQLEQ

SEQ ID NO: 401224 - protein, 8 aa, Mycobacterium
NEDGDRAT

SEQ ID NO: 401225 - protein, 8 aa, Mycobacterium
NEDGSDTW

SEQ ID NO: 401226 - protein, 7 aa, Mycobacterium
NEDTKDL

SEQ ID NO: 401227 - protein, 6 aa, Mycobacterium
NEEQGV

SEQ ID NO: 401228 - protein, 7 aa, Mycobacterium
NEGAVSR

SEQ ID NO: 401229 - protein, 12 aa, Mycobacterium
NEGFSGGEKKRH

SEQ ID NO: 401230 - protein, 4 aa, Mycobacterium
NEGR

SEQ ID NO: 401231 - protein, 6 aa, Mycobacterium
NEHEAK

SEQ ID NO: 401232 - protein, 5 aa, Mycobacterium
NEHER

SEQ ID NO: 401233 - protein, 4 aa, Mycobacterium
NEIE

SEQ ID NO: 401234 - protein, 21 aa, Mycobacterium
NEKHNEANGEDNRDGESHNRS

SEQ ID NO: 401235 - protein, 5 aa, Mycobacterium
NEQAR

SEQ ID NO: 401236 - protein, 15 aa, Mycobacterium
NERPGLANHEPQPTA

SEQ ID NO: 401237 - protein, 5 aa, Mycobacterium
NESAN

SEQ ID NO: 401238 - protein, 4 aa, Mycobacterium
NESI

SEQ ID NO: 401239 - protein, 4 aa, Mycobacterium
NETF

SEQ ID NO: 401240 - protein, 6 aa, Mycobacterium
NETFSS

SEQ ID NO: 401241 - protein, 5 aa, Mycobacterium
NETGM

SEQ ID NO: 401242 - protein, 6 aa, Mycobacterium
NETIEG

SEQ ID NO: 401243 - protein, 8 aa, Mycobacterium
NETRPGDR

SEQ ID NO: 401244 - protein, 4 aa, Mycobacterium
NEVA

SEQ ID NO: 401245 - protein, 4 aa, Mycobacterium
NEVP

SEQ ID NO: 401246 - protein, 6 aa, Mycobacterium
NFDAGP

SEQ ID NO: 401247 - protein, 10 aa, Mycobacterium
NFDPTRRSGR

SEQ ID NO: 401248 - protein, 5 aa, Mycobacterium
NFEAG

SEQ ID NO: 401249 - protein, 10 aa, Mycobacterium
NFKTQSGLTT

SEQ ID NO: 401250 - protein, 7 aa, Mycobacterium
NFNPPAA

SEQ ID NO: 401251 - protein, 30 aa, Mycobacterium
NGAAGGAGGAGGASQTFTGAGGAGGTGGAG

SEQ ID NO: 401252 - protein, 6 aa, Mycobacterium
NGAEGA

SEQ ID NO: 401253 - protein, 8 aa, Mycobacterium
NGAGKTTT

SEQ ID NO: 401254 - protein, 9 aa, Mycobacterium
NGAGKTTTI

SEQ ID NO: 401255 - protein, 15 aa, Mycobacterium
NGAGVIGTPERAREQ

SEQ ID NO: 401256 - protein, 9 aa, Mycobacterium
NGARDPLRL

SEQ ID NO: 401257 - protein, 8 aa, Mycobacterium
NGDEAHAE

SEQ ID NO: 401258 - protein, 8 aa, Mycobacterium
NGDEGGRW

SEQ ID NO: 401259 - protein, 5 aa, Mycobacterium
NGDEI

SEQ ID NO: 401260 - protein, 15 aa, Mycobacterium
NGDELSEQARANPDA

SEQ ID NO: 401261 - protein, 7 aa, Mycobacterium
NGDHGTY

SEQ ID NO: 401262 - protein, 12 aa, Mycobacterium
NGDIPQGQRERT

SEQ ID NO: 401263 - protein, 9 aa, Mycobacterium
NGDKSDTET

SEQ ID NO: 401264 - protein, 6 aa, Mycobacterium
NGDPVN

SEQ ID NO: 401265 - protein, 4 aa, Mycobacterium
NGDT

SEQ ID NO: 401266 - protein, 4 aa, Mycobacterium
NGDV

SEQ ID NO: 401267 - protein, 8 aa, Mycobacterium
NGDYNRDD

SEQ ID NO: 401268 - protein, 10 aa, Mycobacterium
NGEEGEPASI

SEQ ID NO: 401269 - protein, 6 aa, Mycobacterium
NGEKNV

SEQ ID NO: 401270 - protein, 6 aa, Mycobacterium
NGEPAR

SEQ ID NO: 401271 - protein, 20 aa, Mycobacterium
NGEYLSKTGGEFGVTTGRRR

SEQ ID NO: 401272 - protein, 5 aa, Mycobacterium
NGGAG

SEQ ID NO: 401273 - protein, 14 aa, Mycobacterium
NGGAGGAGGAGAPG

SEQ ID NO: 401274 - protein, 9 aa, Mycobacterium
NGGEGLGGT

SEQ ID NO: 401275 - protein, 7 aa, Mycobacterium
NGGEIDG

SEQ ID NO: 401276 - protein, 12 aa, Mycobacterium
NGGGSRPDGIEP

SEQ ID NO: 401277 - protein, 4 aa, Mycobacterium
NGGI

SEQ ID NO: 401278 - protein, 15 aa, Mycobacterium
NGGILSEQTTLILEG

SEQ ID NO: 401279 - protein, 7 aa, Mycobacterium
NGGMTPK

SEQ ID NO: 401280 - protein, 21 aa, Mycobacterium
NGGNGGSGAAGQAGGAGGAAG

SEQ ID NO: 401281 - protein, 6 aa, Mycobacterium
NGGQPT

SEQ ID NO: 401282 - protein, 4 aa, Mycobacterium
NGGR

SEQ ID NO: 401283 - protein, 10 aa, Mycobacterium
NGGSSGNSLE

SEQ ID NO: 401284 - protein, 7 aa, Mycobacterium
NGGSSTL

SEQ ID NO: 401285 - protein, 6 aa, Mycobacterium
NGGSTA

SEQ ID NO: 401286 - protein, 6 aa, Mycobacterium
NGGTAQ

SEQ ID NO: 401287 - protein, 4 aa, Mycobacterium
NGHN

SEQ ID NO: 401288 - protein, 5 aa, Mycobacterium
NGKPE

SEQ ID NO: 401289 - protein, 7 aa, Mycobacterium
NGKPVRE

SEQ ID NO: 401290 - protein, 8 aa, Mycobacterium
NGKRPQAY

SEQ ID NO: 401291 - protein, 4 aa, Mycobacterium
NGLG

SEQ ID NO: 401292 - protein, 6 aa, Mycobacterium
NGLRGN

SEQ ID NO: 401293 - protein, 4 aa, Mycobacterium
NGLV

SEQ ID NO: 401294 - protein, 12 aa, Mycobacterium
NGMYDDESPGAG

SEQ ID NO: 401295 - protein, 4 aa, Mycobacterium
NGNC

SEQ ID NO: 401296 - protein, 8 aa, Mycobacterium
NGNTPDQF

SEQ ID NO: 401297 - protein, 4 aa, Mycobacterium
NGPA

SEQ ID NO: 401298 - protein, 10 aa, Mycobacterium
NGPGDPATAD

SEQ ID NO: 401299 - protein, 4 aa, Mycobacterium
NGPK

SEQ ID NO: 401300 - protein, 5 aa, Mycobacterium
NGPKA

SEQ ID NO: 401301 - protein, 6 aa, Mycobacterium
NGPNPR

SEQ ID NO: 401302 - protein, 5 aa, Mycobacterium
NGPRA

SEQ ID NO: 401303 - protein, 4 aa, Mycobacterium
NGPT

SEQ ID NO: 401304 - protein, 6 aa, Mycobacterium
NGPTSV

SEQ ID NO: 401305 - protein, 6 aa, Mycobacterium
NGQPAA

SEQ ID NO: 401306 - protein, 7 aa, Mycobacterium
NGQPAPV

SEQ ID NO: 401307 - protein, 10 aa, Mycobacterium
NGQVRQRSRT

SEQ ID NO: 401308 - protein, 8 aa, Mycobacterium
NGRGTEQL

SEQ ID NO: 401309 - protein, 8 aa, Mycobacterium
NGSATSRP

SEQ ID NO: 401310 - protein, 8 aa, Mycobacterium
NGSIGEGG

SEQ ID NO: 401311 - protein, 14 aa, Mycobacterium
NGSNGGNGGNGGAA

SEQ ID NO: 401312 - protein, 8 aa, Mycobacterium
NGSPRAAG

SEQ ID NO: 401313 - protein, 10 aa, Mycobacterium
NGTASRETDA

SEQ ID NO: 401314 - protein, 11 aa, Mycobacterium
NGTASRETDAL

SEQ ID NO: 401315 - protein, 5 aa, Mycobacterium
NGTRR

SEQ ID NO: 401316 - protein, 6 aa, Mycobacterium
NGTTLA

SEQ ID NO: 401317 - protein, 4 aa, Mycobacterium
NGVA

SEQ ID NO: 401318 - protein, 4 aa, Mycobacterium
NGVD

SEQ ID NO: 401319 - protein, 6 aa, Mycobacterium
NGWEIP

SEQ ID NO: 401320 - protein, 11 aa, Mycobacterium
NGWTGADEKAQ

SEQ ID NO: 401321 - protein, 5 aa, Mycobacterium
NGYRR

SEQ ID NO: 401322 - protein, 6 aa, Mycobacterium
NHNPTG

SEQ ID NO: 401323 - protein, 8 aa, Mycobacterium
NHPDGQAD

SEQ ID NO: 401324 - protein, 11 aa, Mycobacterium
NHPHPSGKPVT

SEQ ID NO: 401325 - protein, 7 aa, Mycobacterium
NHRKGDK

SEQ ID NO: 401326 - protein, 5 aa, Mycobacterium
NHSDV

SEQ ID NO: 401327 - protein, 6 aa, Mycobacterium
NHSPGA

SEQ ID NO: 401328 - protein, 6 aa, Mycobacterium
NHYPDD

SEQ ID NO: 401329 - protein, 5 aa, Mycobacterium
NHYPQ

SEQ ID NO: 401330 - protein, 6 aa, Mycobacterium
NIAGAG

SEQ ID NO: 401331 - protein, 6 aa, Mycobacterium
NIDTVP

SEQ ID NO: 401332 - protein, 4 aa, Mycobacterium
NIEA

SEQ ID NO: 401333 - protein, 6 aa, Mycobacterium
NIESRG

SEQ ID NO: 401334 - protein, 11 aa, Mycobacterium
NIGHTSAAAGV

SEQ ID NO: 401335 - protein, 9 aa, Mycobacterium
NISTRAGSI

SEQ ID NO: 401336 - protein, 13 aa, Mycobacterium
NKADAPSGTATRT

SEQ ID NO: 401337 - protein, 6 aa, Mycobacterium
NKASTN

SEQ ID NO: 401338 - protein, 4 aa, Mycobacterium
NKKA

SEQ ID NO: 401339 - protein, 10 aa, Mycobacterium
NKPKTHVSVP

SEQ ID NO: 401340 - protein, 10 aa, Mycobacterium
NKTAGDAEKL

SEQ ID NO: 401341 - protein, 6 aa, Mycobacterium
NKTPID

SEQ ID NO: 401342 - protein, 7 aa, Mycobacterium
NKTPIDK

SEQ ID NO: 401343 - protein, 6 aa, Mycobacterium
NKVPGA

SEQ ID NO: 401344 - protein, 4 aa, Mycobacterium
NLAS

SEQ ID NO: 401345 - protein, 12 aa, Mycobacterium
NLDEGEPYGLPG

SEQ ID NO: 401346 - protein, 5 aa, Mycobacterium
NLDTS

SEQ ID NO: 401347 - protein, 6 aa, Mycobacterium
NLGDAK

SEQ ID NO: 401348 - protein, 6 aa, Mycobacterium
NLGEPA

SEQ ID NO: 401349 - protein, 5 aa, Mycobacterium
NLGNS

SEQ ID NO: 401350 - protein, 12 aa, Mycobacterium
NLNPSQAHGSGD

SEQ ID NO: 401351 - protein, 11 aa, Mycobacterium
NLPRQQKGLHS

SEQ ID NO: 401352 - protein, 5 aa, Mycobacterium
NLPSY

SEQ ID NO: 401353 - protein, 7 aa, Mycobacterium
NLPTAPA

SEQ ID NO: 401354 - protein, 11 aa, Mycobacterium
NLRPDSSAEKL

SEQ ID NO: 401355 - protein, 6 aa, Mycobacterium
NLTAQR

SEQ ID NO: 401356 - protein, 5 aa, Mycobacterium
NLTSA

SEQ ID NO: 401357 - protein, 6 aa, Mycobacterium
NMGHAQ

SEQ ID NO: 401358 - protein, 5 aa, Mycobacterium
NMGTG

SEQ ID NO: 401359 - protein, 5 aa, Mycobacterium
NMPKG

SEQ ID NO: 401360 - protein, 13 aa, Mycobacterium
NMPSATAQRPGDV

SEQ ID NO: 401361 - protein, 13 aa, Mycobacterium
NMPSSTAQRPGDV

SEQ ID NO: 401362 - protein, 7 aa, Mycobacterium
NNAQRTL

SEQ ID NO: 401363 - protein, 6 aa, Mycobacterium
NNATAF

SEQ ID NO: 401364 - protein, 8 aa, Mycobacterium
NNCSTGST

SEQ ID NO: 401365 - protein, 6 aa, Mycobacterium
NNDESR

SEQ ID NO: 401366 - protein, 8 aa, Mycobacterium
NNDGPELR

SEQ ID NO: 401367 - protein, 7 aa, Mycobacterium
NNETGAI

SEQ ID NO: 401368 - protein, 7 aa, Mycobacterium
NNKRGVS

SEQ ID NO: 401369 - protein, 17 aa, Mycobacterium
NNKSPSRKAGELDNRGS

SEQ ID NO: 401370 - protein, 5 aa, Mycobacterium
NNRIR

SEQ ID NO: 401371 - protein, 7 aa, Mycobacterium
NNSQYGL

SEQ ID NO: 401372 - protein, 7 aa, Mycobacterium
NNVEEGR

SEQ ID NO: 401373 - protein, 7 aa, Mycobacterium
NNVPDDE

SEQ ID NO: 401374 - protein, 4 aa, Mycobacterium
NPAA

SEQ ID NO: 401375 - protein, 5 aa, Mycobacterium
NPAAM

SEQ ID NO: 401376 - protein, 6 aa, Mycobacterium
NPAAMG

SEQ ID NO: 401377 - protein, 5 aa, Mycobacterium
NPAAT

SEQ ID NO: 401378 - protein, 9 aa, Mycobacterium
NPAATKRSA

SEQ ID NO: 401379 - protein, 9 aa, Mycobacterium
NPAATRRSA

SEQ ID NO: 401380 - protein, 4 aa, Mycobacterium
NPAG

SEQ ID NO: 401381 - protein, 6 aa, Mycobacterium
NPAKKG

SEQ ID NO: 401382 - protein, 11 aa, Mycobacterium
NPATDSPQATA

SEQ ID NO: 401383 - protein, 5 aa, Mycobacterium
NPATG

SEQ ID NO: 401384 - protein, 9 aa, Mycobacterium
NPATGEAAR

SEQ ID NO: 401385 - protein, 8 aa, Mycobacterium
NPATPNGG

SEQ ID NO: 401386 - protein, 8 aa, Mycobacterium
NPATSGVD

SEQ ID NO: 401387 - protein, 4 aa, Mycobacterium
NPAV

SEQ ID NO: 401388 - protein, 5 aa, Mycobacterium
NPAVS

SEQ ID NO: 401389 - protein, 5 aa, Mycobacterium
NPDLA

SEQ ID NO: 401390 - protein, 6 aa, Mycobacterium
NPDLAD

SEQ ID NO: 401391 - protein, 11 aa, Mycobacterium
NPDNPNQPPYS

SEQ ID NO: 401392 - protein, 5 aa, Mycobacterium
NPEFD

SEQ ID NO: 401393 - protein, 4 aa, Mycobacterium
NPEK

SEQ ID NO: 401394 - protein, 4 aa, Mycobacterium
NPEL

SEQ ID NO: 401395 - protein, 5 aa, Mycobacterium
NPEQA

SEQ ID NO: 401396 - protein, 4 aa, Mycobacterium
NPER

SEQ ID NO: 401397 - protein, 4 aa, Mycobacterium
NPEV

SEQ ID NO: 401398 - protein, 14 aa, Mycobacterium
NPGAFKGKIGTPAY

SEQ ID NO: 401399 - protein, 9 aa, Mycobacterium
NPGDNYART

SEQ ID NO: 401400 - protein, 7 aa, Mycobacterium
NPGHGGT

SEQ ID NO: 401401 - protein, 11 aa, Mycobacterium
NPGKDDEGNIY

SEQ ID NO: 401402 - protein, 4 aa, Mycobacterium
NPGL

SEQ ID NO: 401403 - protein, 6 aa, Mycobacterium
NPGMGH

SEQ ID NO: 401404 - protein, 11 aa, Mycobacterium
NPGNEVAPAYQ

SEQ ID NO: 401405 - protein, 11 aa, Mycobacterium
NPGSPTDRRRQ

SEQ ID NO: 401406 - protein, 12 aa, Mycobacterium
NPGSPTDRRRQP

SEQ ID NO: 401407 - protein, 10 aa, Mycobacterium
NPHAASDALG

SEQ ID NO: 401408 - protein, 8 aa, Mycobacterium
NPHAWSSA

SEQ ID NO: 401409 - protein, 4 aa, Mycobacterium
NPIE

SEQ ID NO: 401410 - protein, 6 aa, Mycobacterium
NPIEQE

SEQ ID NO: 401411 - protein, 11 aa, Mycobacterium
NPIPASSGNTI

SEQ ID NO: 401412 - protein, 8 aa, Mycobacterium
NPKPVRDR

SEQ ID NO: 401413 - protein, 4 aa, Mycobacterium
NPLD

SEQ ID NO: 401414 - protein, 8 aa, Mycobacterium
NPLPGRPA

SEQ ID NO: 401415 - protein, 10 aa, Mycobacterium
NPMGSRGAGE

SEQ ID NO: 401416 - protein, 5 aa, Mycobacterium
NPNGN

SEQ ID NO: 401417 - protein, 8 aa, Mycobacterium
NPNSGIRG

SEQ ID NO: 401418 - protein, 9 aa, Mycobacterium
NPPNAYYSS

SEQ ID NO: 401419 - protein, 6 aa, Mycobacterium
NPQDRP

SEQ ID NO: 401420 - protein, 4 aa, Mycobacterium
NPQG

SEQ ID NO: 401421 - protein, 7 aa, Mycobacterium
NPQGSVS

SEQ ID NO: 401422 - protein, 4 aa, Mycobacterium
NPQL

SEQ ID NO: 401423 - protein, 5 aa, Mycobacterium
NPQLA

SEQ ID NO: 401424 - protein, 6 aa, Mycobacterium
NPQLPK

SEQ ID NO: 401425 - protein, 6 aa, Mycobacterium
NPQPAR

SEQ ID NO: 401426 - protein, 5 aa, Mycobacterium
NPQRR

SEQ ID NO: 401427 - protein, 5 aa, Mycobacterium
NPRDG

SEQ ID NO: 401428 - protein, 8 aa, Mycobacterium
NPREDRDD

SEQ ID NO: 401429 - protein, 11 aa, Mycobacterium
NPRGTPGGPQH

SEQ ID NO: 401430 - protein, 5 aa, Mycobacterium
NPRLA

SEQ ID NO: 401431 - protein, 6 aa, Mycobacterium
NPRPGI

SEQ ID NO: 401432 - protein, 12 aa, Mycobacterium
NPRQGHPSTPGR

SEQ ID NO: 401433 - protein, 6 aa, Mycobacterium
NPSMTG

SEQ ID NO: 401434 - protein, 8 aa, Mycobacterium
NPSPGAAL

SEQ ID NO: 401435 - protein, 8 aa, Mycobacterium
NPSSPVSL

SEQ ID NO: 401436 - protein, 4 aa, Mycobacterium
NPTF

SEQ ID NO: 401437 - protein, 5 aa, Mycobacterium
NPTGI

SEQ ID NO: 401438 - protein, 5 aa, Mycobacterium
NPTGV

SEQ ID NO: 401439 - protein, 4 aa, Mycobacterium
NPTL

SEQ ID NO: 401440 - protein, 7 aa, Mycobacterium
NPTNPTS

SEQ ID NO: 401441 - protein, 17 aa, Mycobacterium
NPTPGSDWDASPKPVER

SEQ ID NO: 401442 - protein, 6 aa, Mycobacterium
NPTRSL

SEQ ID NO: 401443 - protein, 5 aa, Mycobacterium
NPTSL

SEQ ID NO: 401444 - protein, 5 aa, Mycobacterium
NPTSS

SEQ ID NO: 401445 - protein, 11 aa, Mycobacterium
NPTTSPFGNPI

SEQ ID NO: 401446 - protein, 13 aa, Mycobacterium
NPVSQGPAQEKTM

SEQ ID NO: 401447 - protein, 6 aa, Mycobacterium
NPWGYS

SEQ ID NO: 401448 - protein, 10 aa, Mycobacterium
NPYSAAKAIG

SEQ ID NO: 401449 - protein, 11 aa, Mycobacterium
NPYSAAKAIGT

SEQ ID NO: 401450 - protein, 5 aa, Mycobacterium
NQAAH

SEQ ID NO: 401451 - protein, 6 aa, Mycobacterium
NQAQES

SEQ ID NO: 401452 - protein, 9 aa, Mycobacterium
NQDGTDATI

SEQ ID NO: 401453 - protein, 6 aa, Mycobacterium
NQGAPM

SEQ ID NO: 401454 - protein, 7 aa, Mycobacterium
NQGLRGT

SEQ ID NO: 401455 - protein, 7 aa, Mycobacterium
NQGRTAD

SEQ ID NO: 401456 - protein, 4 aa, Mycobacterium
NQGV

SEQ ID NO: 401457 - protein, 7 aa, Mycobacterium
NQHAPGV

SEQ ID NO: 401458 - protein, 6 aa, Mycobacterium
NQHDET

SEQ ID NO: 401459 - protein, 6 aa, Mycobacterium
NQHGPA

SEQ ID NO: 401460 - protein, 6 aa, Mycobacterium
NQPGRS

SEQ ID NO: 401461 - protein, 12 aa, Mycobacterium
NQPNLGGSGGYS

SEQ ID NO: 401462 - protein, 4 aa, Mycobacterium
NQRE

SEQ ID NO: 401463 - protein, 11 aa, Mycobacterium
NQSFDSAEGSM

SEQ ID NO: 401464 - protein, 5 aa, Mycobacterium
NQSLG

SEQ ID NO: 401465 - protein, 8 aa, Mycobacterium
NQTGSTAI

SEQ ID NO: 401466 - protein, 4 aa, Mycobacterium
NQTM

SEQ ID NO: 401467 - protein, 7 aa, Mycobacterium
NQTQEST

SEQ ID NO: 401468 - protein, 6 aa, Mycobacterium
NQYPPG

SEQ ID NO: 401469 - protein, 8 aa, Mycobacterium
NRAASPSM

SEQ ID NO: 401470 - protein, 9 aa, Mycobacterium
NRANPIEGK

SEQ ID NO: 401471 - protein, 6 aa, Mycobacterium
NRAPGV

SEQ ID NO: 401472 - protein, 6 aa, Mycobacterium
NRARST

SEQ ID NO: 401473 - protein, 4 aa, Mycobacterium
NRAT

SEQ ID NO: 401474 - protein, 4 aa, Mycobacterium
NRDA

SEQ ID NO: 401475 - protein, 7 aa, Mycobacterium
NRDPAHF

SEQ ID NO: 401476 - protein, 5 aa, Mycobacterium
NREEM

SEQ ID NO: 401477 - protein, 9 aa, Mycobacterium
NRGDNSGSA

SEQ ID NO: 401478 - protein, 5 aa, Mycobacterium
NRGKR

SEQ ID NO: 401479 - protein, 6 aa, Mycobacterium
NRGKRS

SEQ ID NO: 401480 - protein, 7 aa, Mycobacterium
NRGRGSR

SEQ ID NO: 401481 - protein, 8 aa, Mycobacterium
NRGRPVRG

SEQ ID NO: 401482 - protein, 8 aa, Mycobacterium
NRGTDALI

SEQ ID NO: 401483 - protein, 6 aa, Mycobacterium
NRGVGS

SEQ ID NO: 401484 - protein, 7 aa, Mycobacterium
NRLGRRG

SEQ ID NO: 401485 - protein, 6 aa, Mycobacterium
NRLPDA

SEQ ID NO: 401486 - protein, 6 aa, Mycobacterium
NRLPEA

SEQ ID NO: 401487 - protein, 7 aa, Mycobacterium
NRNAAGQ

SEQ ID NO: 401488 - protein, 9 aa, Mycobacterium
NRNKDYSQR

SEQ ID NO: 401489 - protein, 5 aa, Mycobacterium
NRNKS

SEQ ID NO: 401490 - protein, 4 aa, Mycobacterium
NRNN

SEQ ID NO: 401491 - protein, 8 aa, Mycobacterium
NRNRAAGE

SEQ ID NO: 401492 - protein, 8 aa, Mycobacterium
NRNRAASE

SEQ ID NO: 401493 - protein, 5 aa, Mycobacterium
NRPAF

SEQ ID NO: 401494 - protein, 7 aa, Mycobacterium
NRPDQLS

SEQ ID NO: 401495 - protein, 6 aa, Mycobacterium
NRPGGT

SEQ ID NO: 401496 - protein, 13 aa, Mycobacterium
NRPKVGPRRAEAQ

SEQ ID NO: 401497 - protein, 7 aa, Mycobacterium
NRPNPYP

SEQ ID NO: 401498 - protein, 11 aa, Mycobacterium
NRPQSRNALSS

SEQ ID NO: 401499 - protein, 5 aa, Mycobacterium
NRPRR

SEQ ID NO: 401500 - protein, 10 aa, Mycobacterium
NRPRRKNAIN

SEQ ID NO: 401501 - protein, 8 aa, Mycobacterium
NRQPEAEA

SEQ ID NO: 401502 - protein, 4 aa, Mycobacterium
NRQQ

SEQ ID NO: 401503 - protein, 6 aa, Mycobacterium
NRRGRT

SEQ ID NO: 401504 - protein, 8 aa, Mycobacterium
NRRPPEPN

SEQ ID NO: 401505 - protein, 4 aa, Mycobacterium
NRRR

SEQ ID NO: 401506 - protein, 4 aa, Mycobacterium
NRRV

SEQ ID NO: 401507 - protein, 5 aa, Mycobacterium
NRSKR

SEQ ID NO: 401508 - protein, 8 aa, Mycobacterium
NRSNPIAG

SEQ ID NO: 401509 - protein, 4 aa, Mycobacterium
NRTP

SEQ ID NO: 401510 - protein, 4 aa, Mycobacterium
NRTS

SEQ ID NO: 401511 - protein, 6 aa, Mycobacterium
NRTTRA

SEQ ID NO: 401512 - protein, 9 aa, Mycobacterium
NRYSVPPEL

SEQ ID NO: 401513 - protein, 5 aa, Mycobacterium
NSAAD

SEQ ID NO: 401514 - protein, 4 aa, Mycobacterium
NSAG

SEQ ID NO: 401515 - protein, 6 aa, Mycobacterium
NSDESR

SEQ ID NO: 401516 - protein, 4 aa, Mycobacterium
NSDG

SEQ ID NO: 401517 - protein, 4 aa, Mycobacterium
NSDI

SEQ ID NO: 401518 - protein, 5 aa, Mycobacterium
NSDLR

SEQ ID NO: 401519 - protein, 7 aa, Mycobacterium
NSDLRQR

SEQ ID NO: 401520 - protein, 7 aa, Mycobacterium
NSDPYGA

SEQ ID NO: 401521 - protein, 7 aa, Mycobacterium
NSDPYGE

SEQ ID NO: 401522 - protein, 4 aa, Mycobacterium
NSEH

SEQ ID NO: 401523 - protein, 9 aa, Mycobacterium
NSEPRTGLS

SEQ ID NO: 401524 - protein, 9 aa, Mycobacterium
NSEPRTGMS

SEQ ID NO: 401525 - protein, 9 aa, Mycobacterium
NSESAEKSA

SEQ ID NO: 401526 - protein, 8 aa, Mycobacterium
NSGAQRAT

SEQ ID NO: 401527 - protein, 11 aa, Mycobacterium
NSGHSVQSDQP

SEQ ID NO: 401528 - protein, 12 aa, Mycobacterium
NSGINPDDLAGH

SEQ ID NO: 401529 - protein, 6 aa, Mycobacterium
NSGMRA

SEQ ID NO: 401530 - protein, 7 aa, Mycobacterium
NSGPGSF

SEQ ID NO: 401531 - protein, 9 aa, Mycobacterium
NSGPLPEDI

SEQ ID NO: 401532 - protein, 6 aa, Mycobacterium
NSGRIQ

SEQ ID NO: 401533 - protein, 9 aa, Mycobacterium
NSGSEAVEN

SEQ ID NO: 401534 - protein, 8 aa, Mycobacterium
NSGSSSAR

SEQ ID NO: 401535 - protein, 6 aa, Mycobacterium
NSGTDN

SEQ ID NO: 401536 - protein, 4 aa, Mycobacterium
NSGY

SEQ ID NO: 401537 - protein, 4 aa, Mycobacterium
NSHE

SEQ ID NO: 401538 - protein, 5 aa, Mycobacterium
NSIAP

SEQ ID NO: 401539 - protein, 8 aa, Mycobacterium
NSKGEPYT

SEQ ID NO: 401540 - protein, 9 aa, Mycobacterium
NSKGEPYTI

SEQ ID NO: 401541 - protein, 16 aa, Mycobacterium
NSNPARFDQKKADALN

SEQ ID NO: 401542 - protein, 6 aa, Mycobacterium
NSPATE

SEQ ID NO: 401543 - protein, 4 aa, Mycobacterium
NSPD

SEQ ID NO: 401544 - protein, 12 aa, Mycobacterium
NSPGAVAPHGQA

SEQ ID NO: 401545 - protein, 9 aa, Mycobacterium
NSPLAGNPD

SEQ ID NO: 401546 - protein, 9 aa, Mycobacterium
NSPLDGQAA

SEQ ID NO: 401547 - protein, 5 aa, Mycobacterium
NSPRA

SEQ ID NO: 401548 - protein, 9 aa, Mycobacterium
NSQAGNRAL

SEQ ID NO: 401549 - protein, 5 aa, Mycobacterium
NSSQP

SEQ ID NO: 401550 - protein, 10 aa, Mycobacterium
NSTAGGAYVP

SEQ ID NO: 401551 - protein, 8 aa, Mycobacterium
NSTTLSNK

SEQ ID NO: 401552 - protein, 4 aa, Mycobacterium
NSTW

SEQ ID NO: 401553 - protein, 6 aa, Mycobacterium
NSVGPG

SEQ ID NO: 401554 - protein, 8 aa, Mycobacterium
NSVTPPGQ

SEQ ID NO: 401555 - protein, 4 aa, Mycobacterium
NSYM

SEQ ID NO: 401556 - protein, 7 aa, Mycobacterium
NTAAGSM

SEQ ID NO: 401557 - protein, 18 aa, Mycobacterium
NTAANAFGTTYPGAGATI

SEQ ID NO: 401558 - protein, 7 aa, Mycobacterium
NTAGGSM

SEQ ID NO: 401559 - protein, 6 aa, Mycobacterium
NTAGRV

SEQ ID NO: 401560 - protein, 4 aa, Mycobacterium
NTAN

SEQ ID NO: 401561 - protein, 4 aa, Mycobacterium
NTAP

SEQ ID NO: 401562 - protein, 9 aa, Mycobacterium
NTASTKSAI

SEQ ID NO: 401563 - protein, 7 aa, Mycobacterium
NTATPVD

SEQ ID NO: 401564 - protein, 8 aa, Mycobacterium
NTDGKPYG

SEQ ID NO: 401565 - protein, 5 aa, Mycobacterium
NTEGR

SEQ ID NO: 401566 - protein, 11 aa, Mycobacterium
NTELASAAGLS

SEQ ID NO: 401567 - protein, 4 aa, Mycobacterium
NTGG

SEQ ID NO: 401568 - protein, 4 aa, Mycobacterium
NTGL

SEQ ID NO: 401569 - protein, 5 aa, Mycobacterium
NTGLG

SEQ ID NO: 401570 - protein, 6 aa, Mycobacterium
NTGNNN

SEQ ID NO: 401571 - protein, 7 aa, Mycobacterium
NTGNNNI

SEQ ID NO: 401572 - protein, 6 aa, Mycobacterium
NTGPAH

SEQ ID NO: 401573 - protein, 5 aa, Mycobacterium
NTKPV

SEQ ID NO: 401574 - protein, 21 aa, Mycobacterium
NTLQRGQAALTGPVARGDAAA

SEQ ID NO: 401575 - protein, 6 aa, Mycobacterium
NTLTNE

SEQ ID NO: 401576 - protein, 19 aa, Mycobacterium
NTMAAPSGTAYPGGGNPIG

SEQ ID NO: 401577 - protein, 7 aa, Mycobacterium
NTNVGSG

SEQ ID NO: 401578 - protein, 6 aa, Mycobacterium
NTPADG

SEQ ID NO: 401579 - protein, 6 aa, Mycobacterium
NTPAIA

SEQ ID NO: 401580 - protein, 9 aa, Mycobacterium
NTPAIAATE

SEQ ID NO: 401581 - protein, 6 aa, Mycobacterium
NTPPET

SEQ ID NO: 401582 - protein, 8 aa, Mycobacterium
NTPTTSQT

SEQ ID NO: 401583 - protein, 7 aa, Mycobacterium
NTRSYGG

SEQ ID NO: 401584 - protein, 7 aa, Mycobacterium
NTSAPVM

SEQ ID NO: 401585 - protein, 6 aa, Mycobacterium
NTTGSG

SEQ ID NO: 401586 - protein, 4 aa, Mycobacterium
NTTI

SEQ ID NO: 401587 - protein, 6 aa, Mycobacterium
NTTTIQ

SEQ ID NO: 401588 - protein, 5 aa, Mycobacterium
NVAGT

SEQ ID NO: 401589 - protein, 8 aa, Mycobacterium
NVATRSAA

SEQ ID NO: 401590 - protein, 7 aa, Mycobacterium
NVATTEV

SEQ ID NO: 401591 - protein, 12 aa, Mycobacterium
NVDGKGASYGAH

SEQ ID NO: 401592 - protein, 12 aa, Mycobacterium
NVEGGNKQLEQL

SEQ ID NO: 401593 - protein, 6 aa, Mycobacterium
NVEPTT

SEQ ID NO: 401594 - protein, 4 aa, Mycobacterium
NVGA

SEQ ID NO: 401595 - protein, 11 aa, Mycobacterium
NVGDRSEHTRR

SEQ ID NO: 401596 - protein, 7 aa, Mycobacterium
NVGKPQV

SEQ ID NO: 401597 - protein, 4 aa, Mycobacterium
NVGR

SEQ ID NO: 401598 - protein, 7 aa, Mycobacterium
NVPDDEI

SEQ ID NO: 401599 - protein, 7 aa, Mycobacterium
NVPGPRQ

SEQ ID NO: 401600 - protein, 4 aa, Mycobacterium
NVPT

SEQ ID NO: 401601 - protein, 4 aa, Mycobacterium
NVSA

SEQ ID NO: 401602 - protein, 6 aa, Mycobacterium
NVSGSR

SEQ ID NO: 401603 - protein, 6 aa, Mycobacterium
NVTRED

SEQ ID NO: 401604 - protein, 6 aa, Mycobacterium
NVYGPE

SEQ ID NO: 401605 - protein, 4 aa, Mycobacterium
NWDT

SEQ ID NO: 401606 - protein, 13 aa, Mycobacterium
NWQSDPKQLGRLG

SEQ ID NO: 401607 - protein, 14 aa, Mycobacterium
NWSASGTDLKGDAY

SEQ ID NO: 401608 - protein, 4 aa, Mycobacterium
NYAR

SEQ ID NO: 401609 - protein, 12 aa, Mycobacterium
NYGETTEAFGTT

SEQ ID NO: 401610 - protein, 9 aa, Mycobacterium
NYGPGDPNL

SEQ ID NO: 401611 - protein, 6 aa, Mycobacterium
NYPPEV

SEQ ID NO: 401612 - protein, 12 aa, Mycobacterium
NYTDGLDANGQL

SEQ ID NO: 401613 - protein, 10 aa, Mycobacterium
NYTTPGGRHG

SEQ ID NO: 401614 - protein, 9 aa, Mycobacterium
PAAAGWTPA

SEQ ID NO: 401615 - protein, 9 aa, Mycobacterium
PAAAGWTPR

SEQ ID NO: 401616 - protein, 5 aa, Mycobacterium
PAAAT

SEQ ID NO: 401617 - protein, 10 aa, Mycobacterium
PAADPDRYAG

SEQ ID NO: 401618 - protein, 4 aa, Mycobacterium
PAAE

SEQ ID NO: 401619 - protein, 16 aa, Mycobacterium
PAAEPNPGSLHRPTPC

SEQ ID NO: 401620 - protein, 8 aa, Mycobacterium
PAAFATAS

SEQ ID NO: 401621 - protein, 5 aa, Mycobacterium
PAAGV

SEQ ID NO: 401622 - protein, 10 aa, Mycobacterium
PAAISSGTYS

SEQ ID NO: 401623 - protein, 6 aa, Mycobacterium
PAANPD

SEQ ID NO: 401624 - protein, 6 aa, Mycobacterium
PAANSP

SEQ ID NO: 401625 - protein, 4 aa, Mycobacterium
PAAR

SEQ ID NO: 401626 - protein, 14 aa, Mycobacterium
PAARSPQSQDTATT

SEQ ID NO: 401627 - protein, 7 aa, Mycobacterium
PAARTRM

SEQ ID NO: 401628 - protein, 7 aa, Mycobacterium
PAATRTE

SEQ ID NO: 401629 - protein, 6 aa, Mycobacterium
PAAVGA

SEQ ID NO: 401630 - protein, 5 aa, Mycobacterium
PAAVT

SEQ ID NO: 401631 - protein, 6 aa, Mycobacterium
PACSPT

SEQ ID NO: 401632 - protein, 11 aa, Mycobacterium
PADAANRVSGP

SEQ ID NO: 401633 - protein, 5 aa, Mycobacterium
PADAG

SEQ ID NO: 401634 - protein, 8 aa, Mycobacterium
PADAGQTV

SEQ ID NO: 401635 - protein, 8 aa, Mycobacterium
PADANETA

SEQ ID NO: 401636 - protein, 6 aa, Mycobacterium
PADAPA

SEQ ID NO: 401637 - protein, 9 aa, Mycobacterium
PADAPPEPG

SEQ ID NO: 401638 - protein, 5 aa, Mycobacterium
PADAV

SEQ ID NO: 401639 - protein, 4 aa, Mycobacterium
PADD

SEQ ID NO: 401640 - protein, 4 aa, Mycobacterium
PADE

SEQ ID NO: 401641 - protein, 17 aa, Mycobacterium
PADEATAAGDVAVGSGA

SEQ ID NO: 401642 - protein, 5 aa, Mycobacterium
PADEH

SEQ ID NO: 401643 - protein, 5 aa, Mycobacterium
PADGR

SEQ ID NO: 401644 - protein, 6 aa, Mycobacterium
PADGRR

SEQ ID NO: 401645 - protein, 4 aa, Mycobacterium
PADL

SEQ ID NO: 401646 - protein, 4 aa, Mycobacterium
PADS

SEQ ID NO: 401647 - protein, 4 aa, Mycobacterium
PADV

SEQ ID NO: 401648 - protein, 7 aa, Mycobacterium
PADWRPG

SEQ ID NO: 401649 - protein, 4 aa, Mycobacterium
PADY

SEQ ID NO: 401650 - protein, 5 aa, Mycobacterium
PAEDR

SEQ ID NO: 401651 - protein, 8 aa, Mycobacterium
PAEERNRA

SEQ ID NO: 401652 - protein, 7 aa, Mycobacterium
PAEETPL

SEQ ID NO: 401653 - protein, 5 aa, Mycobacterium
PAEGE

SEQ ID NO: 401654 - protein, 13 aa, Mycobacterium
PAEGGSNTAVATA

SEQ ID NO: 401655 - protein, 8 aa, Mycobacterium
PAEGQHPG

SEQ ID NO: 401656 - protein, 12 aa, Mycobacterium
PAEHGALPGQPN

SEQ ID NO: 401657 - protein, 5 aa, Mycobacterium
PAEPA

SEQ ID NO: 401658 - protein, 4 aa, Mycobacterium
PAEQ

SEQ ID NO: 401659 - protein, 8 aa, Mycobacterium
PAEQAPKA

SEQ ID NO: 401660 - protein, 12 aa, Mycobacterium
PAEQASGASAAL

SEQ ID NO: 401661 - protein, 7 aa, Mycobacterium
PAERDAS

SEQ ID NO: 401662 - protein, 4 aa, Mycobacterium
PAES

SEQ ID NO: 401663 - protein, 5 aa, Mycobacterium
PAESE

SEQ ID NO: 401664 - protein, 4 aa, Mycobacterium
PAEY

SEQ ID NO: 401665 - protein, 4 aa, Mycobacterium
PAFS

SEQ ID NO: 401666 - protein, 6 aa, Mycobacterium
PAFSAA

SEQ ID NO: 401667 - protein, 4 aa, Mycobacterium
PAGA

SEQ ID NO: 401668 - protein, 5 aa, Mycobacterium
PAGAA

SEQ ID NO: 401669 - protein, 7 aa, Mycobacterium
PAGARTT

SEQ ID NO: 401670 - protein, 4 aa, Mycobacterium
PAGC

SEQ ID NO: 401671 - protein, 10 aa, Mycobacterium
PAGDGTDVTE

SEQ ID NO: 401672 - protein, 7 aa, Mycobacterium
PAGDNKF

SEQ ID NO: 401673 - protein, 7 aa, Mycobacterium
PAGGDEV

SEQ ID NO: 401674 - protein, 5 aa, Mycobacterium
PAGGL

SEQ ID NO: 401675 - protein, 13 aa, Mycobacterium
PAGGRRLDQTADG

SEQ ID NO: 401676 - protein, 8 aa, Mycobacterium
PAGHGIND

SEQ ID NO: 401677 - protein, 8 aa, Mycobacterium
PAGHPDAG

SEQ ID NO: 401678 - protein, 5 aa, Mycobacterium
PAGPA

SEQ ID NO: 401679 - protein, 8 aa, Mycobacterium
PAGPGARS

SEQ ID NO: 401680 - protein, 7 aa, Mycobacterium
PAGPRFG

SEQ ID NO: 401681 - protein, 7 aa, Mycobacterium
PAGPRRL

SEQ ID NO: 401682 - protein, 10 aa, Mycobacterium
PAGPSGSPLR

SEQ ID NO: 401683 - protein, 7 aa, Mycobacterium
PAGRTAG

SEQ ID NO: 401684 - protein, 7 aa, Mycobacterium
PAGSTPV

SEQ ID NO: 401685 - protein, 11 aa, Mycobacterium
PAGSTTPPPGV

SEQ ID NO: 401686 - protein, 7 aa, Mycobacterium
PAGTDKK

SEQ ID NO: 401687 - protein, 5 aa, Mycobacterium
PAGTR

SEQ ID NO: 401688 - protein, 6 aa, Mycobacterium
PAGVTA

SEQ ID NO: 401689 - protein, 6 aa, Mycobacterium
PAGVTE

SEQ ID NO: 401690 - protein, 4 aa, Mycobacterium
PAGY

SEQ ID NO: 401691 - protein, 7 aa, Mycobacterium
PAHERAR

SEQ ID NO: 401692 - protein, 16 aa, Mycobacterium
PAHPDQPTDKPKVERT

SEQ ID NO: 401693 - protein, 10 aa, Mycobacterium
PAKANRSAHG

SEQ ID NO: 401694 - protein, 7 aa, Mycobacterium
PAKLSAA

SEQ ID NO: 401695 - protein, 6 aa, Mycobacterium
PALAAG

SEQ ID NO: 401696 - protein, 19 aa, Mycobacterium
PALAGQPATAPAPGPEPED

SEQ ID NO: 401697 - protein, 4 aa, Mycobacterium
PALG

SEQ ID NO: 401698 - protein, 8 aa, Mycobacterium
PALGPSRE

SEQ ID NO: 401699 - protein, 5 aa, Mycobacterium
PALGT

SEQ ID NO: 401700 - protein, 5 aa, Mycobacterium
PALKD

SEQ ID NO: 401701 - protein, 8 aa, Mycobacterium
PALPRNRG

SEQ ID NO: 401702 - protein, 4 aa, Mycobacterium
PALR

SEQ ID NO: 401703 - protein, 4 aa, Mycobacterium
PALS

SEQ ID NO: 401704 - protein, 8 aa, Mycobacterium
PALSAKKI

SEQ ID NO: 401705 - protein, 5 aa, Mycobacterium
PALSS

SEQ ID NO: 401706 - protein, 6 aa, Mycobacterium
PAMTGR

SEQ ID NO: 401707 - protein, 6 aa, Mycobacterium
PANDRI

SEQ ID NO: 401708 - protein, 4 aa, Mycobacterium
PANG

SEQ ID NO: 401709 - protein, 10 aa, Mycobacterium
PANGEFPCSD

SEQ ID NO: 401710 - protein, 9 aa, Mycobacterium
PANRPGRAV

SEQ ID NO: 401711 - protein, 4 aa, Mycobacterium
PANS

SEQ ID NO: 401712 - protein, 10 aa, Mycobacterium
PANSEPRTGL

SEQ ID NO: 401713 - protein, 17 aa, Mycobacterium
PANVSRRAKVDVLIVHT

SEQ ID NO: 401714 - protein, 4 aa, Mycobacterium
PAPA

SEQ ID NO: 401715 - protein, 12 aa, Mycobacterium
PAPADANPPDDE

SEQ ID NO: 401716 - protein, 9 aa, Mycobacterium
PAPATTDSD

SEQ ID NO: 401717 - protein, 8 aa, Mycobacterium
PAPDTPFN

SEQ ID NO: 401718 - protein, 7 aa, Mycobacterium
PAPDTPW

SEQ ID NO: 401719 - protein, 4 aa, Mycobacterium
PAPE

SEQ ID NO: 401720 - protein, 6 aa, Mycobacterium
PAPEGV

SEQ ID NO: 401721 - protein, 7 aa, Mycobacterium
PAPESPL

SEQ ID NO: 401722 - protein, 4 aa, Mycobacterium
PAPG

SEQ ID NO: 401723 - protein, 9 aa, Mycobacterium
PAPGDGRTI

SEQ ID NO: 401724 - protein, 7 aa, Mycobacterium
PAPGPVT

SEQ ID NO: 401725 - protein, 7 aa, Mycobacterium
PAPGSYA

SEQ ID NO: 401726 - protein, 5 aa, Mycobacterium
PAPLA

SEQ ID NO: 401727 - protein, 8 aa, Mycobacterium
PAPNTPFN

SEQ ID NO: 401728 - protein, 7 aa, Mycobacterium
PAPPEVK

SEQ ID NO: 401729 - protein, 7 aa, Mycobacterium
PAPPGAP

SEQ ID NO: 401730 - protein, 13 aa, Mycobacterium
PAPPPGVSPPPLW

SEQ ID NO: 401731 - protein, 4 aa, Mycobacterium
PAPS

SEQ ID NO: 401732 - protein, 11 aa, Mycobacterium
PAPSGDPEAPL

SEQ ID NO: 401733 - protein, 6 aa, Mycobacterium
PAPSGT

SEQ ID NO: 401734 - protein, 4 aa, Mycobacterium
PAPT

SEQ ID NO: 401735 - protein, 9 aa, Mycobacterium
PAPTERERG

SEQ ID NO: 401736 - protein, 4 aa, Mycobacterium
PAQA

SEQ ID NO: 401737 - protein, 4 aa, Mycobacterium
PAQG

SEQ ID NO: 401738 - protein, 4 aa, Mycobacterium
PAQL

SEQ ID NO: 401739 - protein, 4 aa, Mycobacterium
PAQP

SEQ ID NO: 401740 - protein, 6 aa, Mycobacterium
PAQTDY

SEQ ID NO: 401741 - protein, 4 aa, Mycobacterium
PARA

SEQ ID NO: 401742 - protein, 10 aa, Mycobacterium
PARARKPQRR

SEQ ID NO: 401743 - protein, 5 aa, Mycobacterium
PARGL

SEQ ID NO: 401744 - protein, 7 aa, Mycobacterium
PARIPEA

SEQ ID NO: 401745 - protein, 4 aa, Mycobacterium
PARP

SEQ ID NO: 401746 - protein, 5 aa, Mycobacterium
PARTW

SEQ ID NO: 401747 - protein, 5 aa, Mycobacterium
PASGE

SEQ ID NO: 401748 - protein, 9 aa, Mycobacterium
PASGRTAER

SEQ ID NO: 401749 - protein, 10 aa, Mycobacterium
PASGSGTGAR

SEQ ID NO: 401750 - protein, 7 aa, Mycobacterium
PASKTRT

SEQ ID NO: 401751 - protein, 8 aa, Mycobacterium
PASKTRTW

SEQ ID NO: 401752 - protein, 4 aa, Mycobacterium
PASL

SEQ ID NO: 401753 - protein, 11 aa, Mycobacterium
PASLGAGGLGS

SEQ ID NO: 401754 - protein, 5 aa, Mycobacterium
PASLP

SEQ ID NO: 401755 - protein, 7 aa, Mycobacterium
PASPHAA

SEQ ID NO: 401756 - protein, 4 aa, Mycobacterium
PASR

SEQ ID NO: 401757 - protein, 4 aa, Mycobacterium
PAST

SEQ ID NO: 401758 - protein, 7 aa, Mycobacterium
PASTGAP

SEQ ID NO: 401759 - protein, 4 aa, Mycobacterium
PASV

SEQ ID NO: 401760 - protein, 4 aa, Mycobacterium
PASW

SEQ ID NO: 401761 - protein, 4 aa, Mycobacterium
PASY

SEQ ID NO: 401762 - protein, 7 aa, Mycobacterium
PATDPAV

SEQ ID NO: 401763 - protein, 7 aa, Mycobacterium
PATEETI

SEQ ID NO: 401764 - protein, 5 aa, Mycobacterium
PATGA

SEQ ID NO: 401765 - protein, 8 aa, Mycobacterium
PATGTTKR

SEQ ID NO: 401766 - protein, 9 aa, Mycobacterium
PATGTTKSD

SEQ ID NO: 401767 - protein, 6 aa, Mycobacterium
PATIGG

SEQ ID NO: 401768 - protein, 4 aa, Mycobacterium
PATY

SEQ ID NO: 401769 - protein, 7 aa, Mycobacterium
PAVGRRG

SEQ ID NO: 401770 - protein, 11 aa, Mycobacterium
PAVGSSAPAFT

SEQ ID NO: 401771 - protein, 4 aa, Mycobacterium
PAVK

SEQ ID NO: 401772 - protein, 4 aa, Mycobacterium
PAVP

SEQ ID NO: 401773 - protein, 5 aa, Mycobacterium
PAWGD

SEQ ID NO: 401774 - protein, 4 aa, Mycobacterium
PAYA

SEQ ID NO: 401775 - protein, 4 aa, Mycobacterium
PAYD

SEQ ID NO: 401776 - protein, 7 aa, Mycobacterium
PAYGGRG

SEQ ID NO: 401777 - protein, 5 aa, Mycobacterium
PCPPA

SEQ ID NO: 401778 - protein, 4 aa, Mycobacterium
PCTA

SEQ ID NO: 401779 - protein, 10 aa, Mycobacterium
PDAAPGQVDE

SEQ ID NO: 401780 - protein, 8 aa, Mycobacterium
PDAARSLG

SEQ ID NO: 401781 - protein, 9 aa, Mycobacterium
PDAEAGKDL

SEQ ID NO: 401782 - protein, 5 aa, Mycobacterium
PDAGS

SEQ ID NO: 401783 - protein, 5 aa, Mycobacterium
PDAGT

SEQ ID NO: 401784 - protein, 4 aa, Mycobacterium
PDAN

SEQ ID NO: 401785 - protein, 5 aa, Mycobacterium
PDAPG

SEQ ID NO: 401786 - protein, 9 aa, Mycobacterium
PDAPLPAQT

SEQ ID NO: 401787 - protein, 5 aa, Mycobacterium
PDAQD

SEQ ID NO: 401788 - protein, 7 aa, Mycobacterium
PDARTAD

SEQ ID NO: 401789 - protein, 4 aa, Mycobacterium
PDAS

SEQ ID NO: 401790 - protein, 5 aa, Mycobacterium
PDAVE

SEQ ID NO: 401791 - protein, 10 aa, Mycobacterium
PDAVRRTRNA

SEQ ID NO: 401792 - protein, 4 aa, Mycobacterium
PDDA

SEQ ID NO: 401793 - protein, 16 aa, Mycobacterium
PDDCTVPAGADVMHSG

SEQ ID NO: 401794 - protein, 5 aa, Mycobacterium
PDDDA

SEQ ID NO: 401795 - protein, 4 aa, Mycobacterium
PDDE

SEQ ID NO: 401796 - protein, 10 aa, Mycobacterium
PDDESLSNGA

SEQ ID NO: 401797 - protein, 4 aa, Mycobacterium
PDDG

SEQ ID NO: 401798 - protein, 5 aa, Mycobacterium
PDDHR

SEQ ID NO: 401799 - protein, 5 aa, Mycobacterium
PDDID

SEQ ID NO: 401800 - protein, 6 aa, Mycobacterium
PDDIPG

SEQ ID NO: 401801 - protein, 4 aa, Mycobacterium
PDDK

SEQ ID NO: 401802 - protein, 6 aa, Mycobacterium
PDDPHQ

SEQ ID NO: 401803 - protein, 7 aa, Mycobacterium
PDDPRTL

SEQ ID NO: 401804 - protein, 13 aa, Mycobacterium
PDDPRTMDQRRAD

SEQ ID NO: 401805 - protein, 6 aa, Mycobacterium
PDDPVE

SEQ ID NO: 401806 - protein, 6 aa, Mycobacterium
PDDSTA

SEQ ID NO: 401807 - protein, 4 aa, Mycobacterium
PDDV

SEQ ID NO: 401808 - protein, 15 aa, Mycobacterium
PDEAAALGDELKGVT

SEQ ID NO: 401809 - protein, 17 aa, Mycobacterium
PDEAAALGDELKGVTSS

SEQ ID NO: 401810 - protein, 4 aa, Mycobacterium
PDED

SEQ ID NO: 401811 - protein, 9 aa, Mycobacterium
PDEDRPEIR

SEQ ID NO: 401812 - protein, 5 aa, Mycobacterium
PDEGA

SEQ ID NO: 401813 - protein, 4 aa, Mycobacterium
PDEH

SEQ ID NO: 401814 - protein, 4 aa, Mycobacterium
PDEI

SEQ ID NO: 401815 - protein, 19 aa, Mycobacterium
PDELDEAVTSASREAAAAF

SEQ ID NO: 401816 - protein, 5 aa, Mycobacterium
PDELR

SEQ ID NO: 401817 - protein, 5 aa, Mycobacterium
PDEPW

SEQ ID NO: 401818 - protein, 8 aa, Mycobacterium
PDETAAAV

SEQ ID NO: 401819 - protein, 6 aa, Mycobacterium
PDFAPY

SEQ ID NO: 401820 - protein, 4 aa, Mycobacterium
PDFG

SEQ ID NO: 401821 - protein, 4 aa, Mycobacterium
PDFS

SEQ ID NO: 401822 - protein, 5 aa, Mycobacterium
PDGAE

SEQ ID NO: 401823 - protein, 14 aa, Mycobacterium
PDGAIYPSARHQPS

SEQ ID NO: 401824 - protein, 8 aa, Mycobacterium
PDGANGEA

SEQ ID NO: 401825 - protein, 5 aa, Mycobacterium
PDGAR

SEQ ID NO: 401826 - protein, 4 aa, Mycobacterium
PDGE

SEQ ID NO: 401827 - protein, 8 aa, Mycobacterium
PDGESIGR

SEQ ID NO: 401828 - protein, 6 aa, Mycobacterium
PDGGAS

SEQ ID NO: 401829 - protein, 5 aa, Mycobacterium
PDGGP

SEQ ID NO: 401830 - protein, 4 aa, Mycobacterium
PDGH

SEQ ID NO: 401831 - protein, 5 aa, Mycobacterium
PDGKE

SEQ ID NO: 401832 - protein, 5 aa, Mycobacterium
PDGLG

SEQ ID NO: 401833 - protein, 4 aa, Mycobacterium
PDGN

SEQ ID NO: 401834 - protein, 7 aa, Mycobacterium
PDGPAPY

SEQ ID NO: 401835 - protein, 7 aa, Mycobacterium
PDGPSLG

SEQ ID NO: 401836 - protein, 4 aa, Mycobacterium
PDGQ

SEQ ID NO: 401837 - protein, 7 aa, Mycobacterium
PDGQPEY

SEQ ID NO: 401838 - protein, 5 aa, Mycobacterium
PDGSR

SEQ ID NO: 401839 - protein, 5 aa, Mycobacterium
PDGSV

SEQ ID NO: 401840 - protein, 6 aa, Mycobacterium
PDGSVK

SEQ ID NO: 401841 - protein, 13 aa, Mycobacterium
PDGSVSGSVSGGC

SEQ ID NO: 401842 - protein, 5 aa, Mycobacterium
PDGTL

SEQ ID NO: 401843 - protein, 7 aa, Mycobacterium
PDGTRAD

SEQ ID NO: 401844 - protein, 5 aa, Mycobacterium
PDGTV

SEQ ID NO: 401845 - protein, 10 aa, Mycobacterium
PDGTYSAFGS

SEQ ID NO: 401846 - protein, 5 aa, Mycobacterium
PDHEG

SEQ ID NO: 401847 - protein, 8 aa, Mycobacterium
PDKFDPER

SEQ ID NO: 401848 - protein, 10 aa, Mycobacterium
PDKPNNYNPI

SEQ ID NO: 401849 - protein, 9 aa, Mycobacterium
PDKVGRDAG

SEQ ID NO: 401850 - protein, 4 aa, Mycobacterium
PDLH

SEQ ID NO: 401851 - protein, 4 aa, Mycobacterium
PDLP

SEQ ID NO: 401852 - protein, 4 aa, Mycobacterium
PDLS

SEQ ID NO: 401853 - protein, 10 aa, Mycobacterium
PDLSRSSGIE

SEQ ID NO: 401854 - protein, 4 aa, Mycobacterium
PDNG

SEQ ID NO: 401855 - protein, 4 aa, Mycobacterium
PDNN

SEQ ID NO: 401856 - protein, 8 aa, Mycobacterium
PDNPPYDE

SEQ ID NO: 401857 - protein, 11 aa, Mycobacterium
PDPDAAASWEE

SEQ ID NO: 401858 - protein, 8 aa, Mycobacterium
PDPERTLA

SEQ ID NO: 401859 - protein, 7 aa, Mycobacterium
PDPGPGE

SEQ ID NO: 401860 - protein, 6 aa, Mycobacterium
PDPGPM

SEQ ID NO: 401861 - protein, 5 aa, Mycobacterium
PDPGT

SEQ ID NO: 401862 - protein, 4 aa, Mycobacterium
PDPL

SEQ ID NO: 401863 - protein, 8 aa, Mycobacterium
PDPPESWG

SEQ ID NO: 401864 - protein, 8 aa, Mycobacterium
PDPPRARR

SEQ ID NO: 401865 - protein, 8 aa, Mycobacterium
PDPQYAPG

SEQ ID NO: 401866 - protein, 8 aa, Mycobacterium
PDPRVPAT

SEQ ID NO: 401867 - protein, 7 aa, Mycobacterium
PDPRYGQ

SEQ ID NO: 401868 - protein, 4 aa, Mycobacterium
PDPS

SEQ ID NO: 401869 - protein, 9 aa, Mycobacterium
PDPSTPGKV

SEQ ID NO: 401870 - protein, 7 aa, Mycobacterium
PDPTAEQ

SEQ ID NO: 401871 - protein, 9 aa, Mycobacterium
PDPTAPEVQ

SEQ ID NO: 401872 - protein, 7 aa, Mycobacterium
PDPTEGV

SEQ ID NO: 401873 - protein, 10 aa, Mycobacterium
PDPTTPEAQQ

SEQ ID NO: 401874 - protein, 5 aa, Mycobacterium
PDPVA

SEQ ID NO: 401875 - protein, 4 aa, Mycobacterium
PDQP

SEQ ID NO: 401876 - protein, 6 aa, Mycobacterium
PDQRPA

SEQ ID NO: 401877 - protein, 4 aa, Mycobacterium
PDRD

SEQ ID NO: 401878 - protein, 7 aa, Mycobacterium
PDRDTAD

SEQ ID NO: 401879 - protein, 10 aa, Mycobacterium
PDREKHGALR

SEQ ID NO: 401880 - protein, 4 aa, Mycobacterium
PDRG

SEQ ID NO: 401881 - protein, 14 aa, Mycobacterium
PDRNAGFSKANPGR

SEQ ID NO: 401882 - protein, 13 aa, Mycobacterium
PDRNAGFSTANPG

SEQ ID NO: 401883 - protein, 8 aa, Mycobacterium
PDRPYTDR

SEQ ID NO: 401884 - protein, 5 aa, Mycobacterium
PDRRL

SEQ ID NO: 401885 - protein, 4 aa, Mycobacterium
PDRS

SEQ ID NO: 401886 - protein, 4 aa, Mycobacterium
PDRT

SEQ ID NO: 401887 - protein, 16 aa, Mycobacterium
PDRTLTEDDASAARDA

SEQ ID NO: 401888 - protein, 16 aa, Mycobacterium
PDRVPGISSPGAIPGI

SEQ ID NO: 401889 - protein, 4 aa, Mycobacterium
PDRY

SEQ ID NO: 401890 - protein, 5 aa, Mycobacterium
PDSGV

SEQ ID NO: 401891 - protein, 4 aa, Mycobacterium
PDSL

SEQ ID NO: 401892 - protein, 8 aa, Mycobacterium
PDSTIAGR

SEQ ID NO: 401893 - protein, 5 aa, Mycobacterium
PDSTL

SEQ ID NO: 401894 - protein, 14 aa, Mycobacterium
PDSTTEATTEEDEV

SEQ ID NO: 401895 - protein, 10 aa, Mycobacterium
PDTAEARTNV

SEQ ID NO: 401896 - protein, 5 aa, Mycobacterium
PDTGE

SEQ ID NO: 401897 - protein, 10 aa, Mycobacterium
PDTGELGPRN

SEQ ID NO: 401898 - protein, 7 aa, Mycobacterium
PDTPEVR

SEQ ID NO: 401899 - protein, 5 aa, Mycobacterium
PDTPP

SEQ ID NO: 401900 - protein, 4 aa, Mycobacterium
PDTR

SEQ ID NO: 401901 - protein, 6 aa, Mycobacterium
PDTSVA

SEQ ID NO: 401902 - protein, 5 aa, Mycobacterium
PDTTL

SEQ ID NO: 401903 - protein, 6 aa, Mycobacterium
PDVAQD

SEQ ID NO: 401904 - protein, 4 aa, Mycobacterium
PDVI

SEQ ID NO: 401905 - protein, 12 aa, Mycobacterium
PDVNPDEAAQAK

SEQ ID NO: 401906 - protein, 4 aa, Mycobacterium
PDVR

SEQ ID NO: 401907 - protein, 6 aa, Mycobacterium
PDVSAY

SEQ ID NO: 401908 - protein, 16 aa, Mycobacterium
PDVTANAFDPDGYYRT

SEQ ID NO: 401909 - protein, 8 aa, Mycobacterium
PDWTGPDD

SEQ ID NO: 401910 - protein, 4 aa, Mycobacterium
PEAA

SEQ ID NO: 401911 - protein, 4 aa, Mycobacterium
PEAD

SEQ ID NO: 401912 - protein, 8 aa, Mycobacterium
PEAERTRR

SEQ ID NO: 401913 - protein, 4 aa, Mycobacterium
PEAK

SEQ ID NO: 401914 - protein, 4 aa, Mycobacterium
PEAL

SEQ ID NO: 401915 - protein, 7 aa, Mycobacterium
PEARNAI

SEQ ID NO: 401916 - protein, 4 aa, Mycobacterium
PEAS

SEQ ID NO: 401917 - protein, 7 aa, Mycobacterium
PEATAAD

SEQ ID NO: 401918 - protein, 7 aa, Mycobacterium
PEATEAD

SEQ ID NO: 401919 - protein, 4 aa, Mycobacterium
PEDA

SEQ ID NO: 401920 - protein, 9 aa, Mycobacterium
PEDAEDELH

SEQ ID NO: 401921 - protein, 10 aa, Mycobacterium
PEDEQRKLPY

SEQ ID NO: 401922 - protein, 5 aa, Mycobacterium
PEDER

SEQ ID NO: 401923 - protein, 22 aa, Mycobacterium
PEDFPDPDAFKPDRYNKPEQAD

SEQ ID NO: 401924 - protein, 4 aa, Mycobacterium
PEDG

SEQ ID NO: 401925 - protein, 7 aa, Mycobacterium
PEDRPAL

SEQ ID NO: 401926 - protein, 4 aa, Mycobacterium
PEDV

SEQ ID NO: 401927 - protein, 7 aa, Mycobacterium
PEEAEAG

SEQ ID NO: 401928 - protein, 4 aa, Mycobacterium
PEEL

SEQ ID NO: 401929 - protein, 5 aa, Mycobacterium
PEELR

SEQ ID NO: 401930 - protein, 4 aa, Mycobacterium
PEEP

SEQ ID NO: 401931 - protein, 4 aa, Mycobacterium
PEEQ

SEQ ID NO: 401932 - protein, 5 aa, Mycobacterium
PEERD

SEQ ID NO: 401933 - protein, 6 aa, Mycobacterium
PEERRT

SEQ ID NO: 401934 - protein, 9 aa, Mycobacterium
PEETDEEEL

SEQ ID NO: 401935 - protein, 4 aa, Mycobacterium
PEEV

SEQ ID NO: 401936 - protein, 5 aa, Mycobacterium
PEEYR

SEQ ID NO: 401937 - protein, 7 aa, Mycobacterium
PEFPDRP

SEQ ID NO: 401938 - protein, 8 aa, Mycobacterium
PEGADAWD

SEQ ID NO: 401939 - protein, 11 aa, Mycobacterium
PEGAPDSTRGV

SEQ ID NO: 401940 - protein, 9 aa, Mycobacterium
PEGASASID

SEQ ID NO: 401941 - protein, 7 aa, Mycobacterium
PEGDDDR

SEQ ID NO: 401942 - protein, 5 aa, Mycobacterium
PEGGA

SEQ ID NO: 401943 - protein, 10 aa, Mycobacterium
PEGGAGGGTV

SEQ ID NO: 401944 - protein, 4 aa, Mycobacterium
PEGL

SEQ ID NO: 401945 - protein, 5 aa, Mycobacterium
PEGLS

SEQ ID NO: 401946 - protein, 4 aa, Mycobacterium
PEGP

SEQ ID NO: 401947 - protein, 5 aa, Mycobacterium
PEGPH

SEQ ID NO: 401948 - protein, 14 aa, Mycobacterium
PEGQRADGENTETD

SEQ ID NO: 401949 - protein, 5 aa, Mycobacterium
PEGRA

SEQ ID NO: 401950 - protein, 7 aa, Mycobacterium
PEGTPSE

SEQ ID NO: 401951 - protein, 18 aa, Mycobacterium
PEGTRSPDGRLYKGKTGL

SEQ ID NO: 401952 - protein, 4 aa, Mycobacterium
PEGV

SEQ ID NO: 401953 - protein, 7 aa, Mycobacterium
PEGVDPA

SEQ ID NO: 401954 - protein, 5 aa, Mycobacterium
PEHEP

SEQ ID NO: 401955 - protein, 5 aa, Mycobacterium
PEHGP

SEQ ID NO: 401956 - protein, 8 aa, Mycobacterium
PEHPYPAA

SEQ ID NO: 401957 - protein, 4 aa, Mycobacterium
PEHQ

SEQ ID NO: 401958 - protein, 5 aa, Mycobacterium
PEHQP

SEQ ID NO: 401959 - protein, 4 aa, Mycobacterium
PEHS

SEQ ID NO: 401960 - protein, 4 aa, Mycobacterium
PEIG

SEQ ID NO: 401961 - protein, 8 aa, Mycobacterium
PEINGEAN

SEQ ID NO: 401962 - protein, 4 aa, Mycobacterium
PEIT

SEQ ID NO: 401963 - protein, 5 aa, Mycobacterium
PEKEG

SEQ ID NO: 401964 - protein, 8 aa, Mycobacterium
PEKFDPER

SEQ ID NO: 401965 - protein, 11 aa, Mycobacterium
PEKGGSTREAK

SEQ ID NO: 401966 - protein, 9 aa, Mycobacterium
PEKKSTVSE

SEQ ID NO: 401967 - protein, 9 aa, Mycobacterium
PEKKSTVTE

SEQ ID NO: 401968 - protein, 4 aa, Mycobacterium
PELD

SEQ ID NO: 401969 - protein, 12 aa, Mycobacterium
PELPGGSALGST

SEQ ID NO: 401970 - protein, 12 aa, Mycobacterium
PELPGGSELGST

SEQ ID NO: 401971 - protein, 4 aa, Mycobacterium
PEMG

SEQ ID NO: 401972 - protein, 6 aa, Mycobacterium
PENGST

SEQ ID NO: 401973 - protein, 7 aa, Mycobacterium
PENPQNI

SEQ ID NO: 401974 - protein, 7 aa, Mycobacterium
PENPRNV

SEQ ID NO: 401975 - protein, 4 aa, Mycobacterium
PENV

SEQ ID NO: 401976 - protein, 4 aa, Mycobacterium
PEPA

SEQ ID NO: 401977 - protein, 6 aa, Mycobacterium
PEPARA

SEQ ID NO: 401978 - protein, 6 aa, Mycobacterium
PEPDPG

SEQ ID NO: 401979 - protein, 8 aa, Mycobacterium
PEPDRDQV

SEQ ID NO: 401980 - protein, 5 aa, Mycobacterium
PEPET

SEQ ID NO: 401981 - protein, 4 aa, Mycobacterium
PEPF

SEQ ID NO: 401982 - protein, 6 aa, Mycobacterium
PEPGQT

SEQ ID NO: 401983 - protein, 4 aa, Mycobacterium
PEPH

SEQ ID NO: 401984 - protein, 5 aa, Mycobacterium
PEPHR

SEQ ID NO: 401985 - protein, 4 aa, Mycobacterium
PEPM

SEQ ID NO: 401986 - protein, 5 aa, Mycobacterium
PEPQL

SEQ ID NO: 401987 - protein, 7 aa, Mycobacterium
PEPYPTR

SEQ ID NO: 401988 - protein, 5 aa, Mycobacterium
PEPYT

SEQ ID NO: 401989 - protein, 5 aa, Mycobacterium
PEQAR

SEQ ID NO: 401990 - protein, 7 aa, Mycobacterium
PEQGGWT

SEQ ID NO: 401991 - protein, 5 aa, Mycobacterium
PEQIA

SEQ ID NO: 401992 - protein, 4 aa, Mycobacterium
PEQL

SEQ ID NO: 401993 - protein, 5 aa, Mycobacterium
PEQLP

SEQ ID NO: 401994 - protein, 9 aa, Mycobacterium
PEQQRDDAR

SEQ ID NO: 401995 - protein, 4 aa, Mycobacterium
PEQR

SEQ ID NO: 401996 - protein, 5 aa, Mycobacterium
PEQSM

SEQ ID NO: 401997 - protein, 10 aa, Mycobacterium
PEQYGKPYRE

SEQ ID NO: 401998 - protein, 11 aa, Mycobacterium
PERAAKGPFGT

SEQ ID NO: 401999 - protein, 4 aa, Mycobacterium
PERD

SEQ ID NO: 402000 - protein, 8 aa, Mycobacterium
PERISGNR

SEQ ID NO: 402001 - protein, 4 aa, Mycobacterium
PERP

SEQ ID NO: 402002 - protein, 8 aa, Mycobacterium
PERQPTSR

SEQ ID NO: 402003 - protein, 8 aa, Mycobacterium
PERQRTSR

SEQ ID NO: 402004 - protein, 4 aa, Mycobacterium
PERS

SEQ ID NO: 402005 - protein, 5 aa, Mycobacterium
PESAG

SEQ ID NO: 402006 - protein, 10 aa, Mycobacterium
PESAGGDGAT

SEQ ID NO: 402007 - protein, 4 aa, Mycobacterium
PESD

SEQ ID NO: 402008 - protein, 6 aa, Mycobacterium
PESDYA

SEQ ID NO: 402009 - protein, 8 aa, Mycobacterium
PESEGLAR

SEQ ID NO: 402010 - protein, 4 aa, Mycobacterium
PESG

SEQ ID NO: 402011 - protein, 9 aa, Mycobacterium
PESIPGTTV

SEQ ID NO: 402012 - protein, 4 aa, Mycobacterium
PESP

SEQ ID NO: 402013 - protein, 4 aa, Mycobacterium
PESQ

SEQ ID NO: 402014 - protein, 19 aa, Mycobacterium
PESVPGTTVDRQCGSSQQA

SEQ ID NO: 402015 - protein, 8 aa, Mycobacterium
PESYTGTE

SEQ ID NO: 402016 - protein, 4 aa, Mycobacterium
PETG

SEQ ID NO: 402017 - protein, 5 aa, Mycobacterium
PETGL

SEQ ID NO: 402018 - protein, 27 aa, Mycobacterium
PETIEARKDPWDPDSAPTRAQTEAARH

SEQ ID NO: 402019 - protein, 9 aa, Mycobacterium
PETKIEPSL

SEQ ID NO: 402020 - protein, 5 aa, Mycobacterium
PETLE

SEQ ID NO: 402021 - protein, 4 aa, Mycobacterium
PETV

SEQ ID NO: 402022 - protein, 5 aa, Mycobacterium
PETVA

SEQ ID NO: 402023 - protein, 5 aa, Mycobacterium
PEVAN

SEQ ID NO: 402024 - protein, 4 aa, Mycobacterium
PEVG

SEQ ID NO: 402025 - protein, 10 aa, Mycobacterium
PEVRGTPEAT

SEQ ID NO: 402026 - protein, 4 aa, Mycobacterium
PEVS

SEQ ID NO: 402027 - protein, 4 aa, Mycobacterium
PEVT

SEQ ID NO: 402028 - protein, 4 aa, Mycobacterium
PEWG

SEQ ID NO: 402029 - protein, 4 aa, Mycobacterium
PEWT

SEQ ID NO: 402030 - protein, 4 aa, Mycobacterium
PEYA

SEQ ID NO: 402031 - protein, 4 aa, Mycobacterium
PEYR

SEQ ID NO: 402032 - protein, 7 aa, Mycobacterium
PFAATGG

SEQ ID NO: 402033 - protein, 4 aa, Mycobacterium
PFAG

SEQ ID NO: 402034 - protein, 5 aa, Mycobacterium
PFDPN

SEQ ID NO: 402035 - protein, 7 aa, Mycobacterium
PFDPSSR

SEQ ID NO: 402036 - protein, 4 aa, Mycobacterium
PFEG

SEQ ID NO: 402037 - protein, 12 aa, Mycobacterium
PFESPQSNPELA

SEQ ID NO: 402038 - protein, 4 aa, Mycobacterium
PFGG

SEQ ID NO: 402039 - protein, 7 aa, Mycobacterium
PFGGPGA

SEQ ID NO: 402040 - protein, 7 aa, Mycobacterium
PFGPEDG

SEQ ID NO: 402041 - protein, 8 aa, Mycobacterium
PFGTPNFT

SEQ ID NO: 402042 - protein, 4 aa, Mycobacterium
PFTD

SEQ ID NO: 402043 - protein, 5 aa, Mycobacterium
PFTPE

SEQ ID NO: 402044 - protein, 13 aa, Mycobacterium
PFTPEQRAHREAE

SEQ ID NO: 402045 - protein, 5 aa, Mycobacterium
PGAAE

SEQ ID NO: 402046 - protein, 7 aa, Mycobacterium
PGAARSL

SEQ ID NO: 402047 - protein, 4 aa, Mycobacterium
PGAD

SEQ ID NO: 402048 - protein, 8 aa, Mycobacterium
PGADCTED

SEQ ID NO: 402049 - protein, 8 aa, Mycobacterium
PGADGMAG

SEQ ID NO: 402050 - protein, 5 aa, Mycobacterium
PGADT

SEQ ID NO: 402051 - protein, 4 aa, Mycobacterium
PGAE

SEQ ID NO: 402052 - protein, 10 aa, Mycobacterium
PGAEEEKRGI

SEQ ID NO: 402053 - protein, 4 aa, Mycobacterium
PGAG

SEQ ID NO: 402054 - protein, 11 aa, Mycobacterium
PGAGRPRDPRI

SEQ ID NO: 402055 - protein, 7 aa, Mycobacterium
PGALPTR

SEQ ID NO: 402056 - protein, 6 aa, Mycobacterium
PGAMER

SEQ ID NO: 402057 - protein, 10 aa, Mycobacterium
PGANAPSVAE

SEQ ID NO: 402058 - protein, 5 aa, Mycobacterium
PGAPA

SEQ ID NO: 402059 - protein, 7 aa, Mycobacterium
PGAPDPE

SEQ ID NO: 402060 - protein, 7 aa, Mycobacterium
PGAPEQL

SEQ ID NO: 402061 - protein, 7 aa, Mycobacterium
PGAPIDT

SEQ ID NO: 402062 - protein, 11 aa, Mycobacterium
PGAPLARAETR

SEQ ID NO: 402063 - protein, 9 aa, Mycobacterium
PGASEGRGL

SEQ ID NO: 402064 - protein, 7 aa, Mycobacterium
PGASSVE

SEQ ID NO: 402065 - protein, 13 aa, Mycobacterium
PGATAHQRSLRPH

SEQ ID NO: 402066 - protein, 5 aa, Mycobacterium
PGAVS

SEQ ID NO: 402067 - protein, 4 aa, Mycobacterium
PGAW

SEQ ID NO: 402068 - protein, 4 aa, Mycobacterium
PGCG

SEQ ID NO: 402069 - protein, 7 aa, Mycobacterium
PGDAKER

SEQ ID NO: 402070 - protein, 4 aa, Mycobacterium
PGDD

SEQ ID NO: 402071 - protein, 4 aa, Mycobacterium
PGDI

SEQ ID NO: 402072 - protein, 14 aa, Mycobacterium
PGDLGTKGGIRTDV

SEQ ID NO: 402073 - protein, 4 aa, Mycobacterium
PGDP

SEQ ID NO: 402074 - protein, 6 aa, Mycobacterium
PGDPAW

SEQ ID NO: 402075 - protein, 24 aa, Mycobacterium
PGDPEFGDPLSTAGDGGPRAAARA

SEQ ID NO: 402076 - protein, 25 aa, Mycobacterium
PGDPEFGDPLSTAGDGGPRAAARAA

SEQ ID NO: 402077 - protein, 6 aa, Mycobacterium
PGDRER

SEQ ID NO: 402078 - protein, 7 aa, Mycobacterium
PGDSLNG

SEQ ID NO: 402079 - protein, 9 aa, Mycobacterium
PGEAGPQAT

SEQ ID NO: 402080 - protein, 4 aa, Mycobacterium
PGEE

SEQ ID NO: 402081 - protein, 4 aa, Mycobacterium
PGEG

SEQ ID NO: 402082 - protein, 7 aa, Mycobacterium
PGEGTQR

SEQ ID NO: 402083 - protein, 5 aa, Mycobacterium
PGENQ

SEQ ID NO: 402084 - protein, 6 aa, Mycobacterium
PGERER

SEQ ID NO: 402085 - protein, 5 aa, Mycobacterium
PGERR

SEQ ID NO: 402086 - protein, 7 aa, Mycobacterium
PGERTGI

SEQ ID NO: 402087 - protein, 5 aa, Mycobacterium
PGERV

SEQ ID NO: 402088 - protein, 4 aa, Mycobacterium
PGET

SEQ ID NO: 402089 - protein, 7 aa, Mycobacterium
PGETYRR

SEQ ID NO: 402090 - protein, 4 aa, Mycobacterium
PGFG

SEQ ID NO: 402091 - protein, 5 aa, Mycobacterium
PGFGN

SEQ ID NO: 402092 - protein, 4 aa, Mycobacterium
PGFP

SEQ ID NO: 402093 - protein, 4 aa, Mycobacterium
PGGA

SEQ ID NO: 402094 - protein, 5 aa, Mycobacterium
PGGAQ

SEQ ID NO: 402095 - protein, 5 aa, Mycobacterium
PGGEG

SEQ ID NO: 402096 - protein, 7 aa, Mycobacterium
PGGESGF

SEQ ID NO: 402097 - protein, 7 aa, Mycobacterium
PGGESTA

SEQ ID NO: 402098 - protein, 7 aa, Mycobacterium
PGGESTT

SEQ ID NO: 402099 - protein, 8 aa, Mycobacterium
PGGESTTM

SEQ ID NO: 402100 - protein, 5 aa, Mycobacterium
PGGFT

SEQ ID NO: 402101 - protein, 8 aa, Mycobacterium
PGGGEEGA

SEQ ID NO: 402102 - protein, 6 aa, Mycobacterium
PGGGGM

SEQ ID NO: 402103 - protein, 4 aa, Mycobacterium
PGGH

SEQ ID NO: 402104 - protein, 14 aa, Mycobacterium
PGGHKLDDATEDRI

SEQ ID NO: 402105 - protein, 5 aa, Mycobacterium
PGGIE

SEQ ID NO: 402106 - protein, 5 aa, Mycobacterium
PGGKL

SEQ ID NO: 402107 - protein, 4 aa, Mycobacterium
PGGL

SEQ ID NO: 402108 - protein, 8 aa, Mycobacterium
PGGPGASA

SEQ ID NO: 402109 - protein, 7 aa, Mycobacterium
PGGPGQT

SEQ ID NO: 402110 - protein, 13 aa, Mycobacterium
PGGPGRTTRPEDF

SEQ ID NO: 402111 - protein, 10 aa, Mycobacterium
PGGPLTAQQV

SEQ ID NO: 402112 - protein, 7 aa, Mycobacterium
PGGPTAV

SEQ ID NO: 402113 - protein, 4 aa, Mycobacterium
PGGQ

SEQ ID NO: 402114 - protein, 6 aa, Mycobacterium
PGGQAQ

SEQ ID NO: 402115 - protein, 12 aa, Mycobacterium
PGGQGDDVVSGS

SEQ ID NO: 402116 - protein, 5 aa, Mycobacterium
PGGSA

SEQ ID NO: 402117 - protein, 4 aa, Mycobacterium
PGHA

SEQ ID NO: 402118 - protein, 7 aa, Mycobacterium
PGHGDDT

SEQ ID NO: 402119 - protein, 23 aa, Mycobacterium
PGHGDDTTLGAERPHLAEWRERG

SEQ ID NO: 402120 - protein, 6 aa, Mycobacterium
PGHPLA

SEQ ID NO: 402121 - protein, 5 aa, Mycobacterium
PGHTE

SEQ ID NO: 402122 - protein, 47 aa, Mycobacterium
PGHTLSAGSTKPAGPAGRADTTDPAGATVTAQDTTHATGPAHAAGPA

SEQ ID NO: 402123 - protein, 8 aa, Mycobacterium
PGIDPAKD

SEQ ID NO: 402124 - protein, 11 aa, Mycobacterium
PGIGATSTGTL

SEQ ID NO: 402125 - protein, 7 aa, Mycobacterium
PGIGTSQ

SEQ ID NO: 402126 - protein, 4 aa, Mycobacterium
PGIP

SEQ ID NO: 402127 - protein, 4 aa, Mycobacterium
PGIS

SEQ ID NO: 402128 - protein, 4 aa, Mycobacterium
PGIT

SEQ ID NO: 402129 - protein, 7 aa, Mycobacterium
PGKAGTD

SEQ ID NO: 402130 - protein, 4 aa, Mycobacterium
PGKG

SEQ ID NO: 402131 - protein, 4 aa, Mycobacterium
PGKP

SEQ ID NO: 402132 - protein, 4 aa, Mycobacterium
PGLA

SEQ ID NO: 402133 - protein, 6 aa, Mycobacterium
PGLDAA

SEQ ID NO: 402134 - protein, 4 aa, Mycobacterium
PGLN

SEQ ID NO: 402135 - protein, 5 aa, Mycobacterium
PGLPA

SEQ ID NO: 402136 - protein, 17 aa, Mycobacterium
PGLPEKATHDYQRNGTA

SEQ ID NO: 402137 - protein, 7 aa, Mycobacterium
PGLSRRD

SEQ ID NO: 402138 - protein, 5 aa, Mycobacterium
PGLTP

SEQ ID NO: 402139 - protein, 5 aa, Mycobacterium
PGLTT

SEQ ID NO: 402140 - protein, 4 aa, Mycobacterium
PGMC

SEQ ID NO: 402141 - protein, 7 aa, Mycobacterium
PGNARIS

SEQ ID NO: 402142 - protein, 4 aa, Mycobacterium
PGNF

SEQ ID NO: 402143 - protein, 7 aa, Mycobacterium
PGNQAPL

SEQ ID NO: 402144 - protein, 4 aa, Mycobacterium
PGNR

SEQ ID NO: 402145 - protein, 7 aa, Mycobacterium
PGNRAPL

SEQ ID NO: 402146 - protein, 8 aa, Mycobacterium
PGNRPTTS

SEQ ID NO: 402147 - protein, 12 aa, Mycobacterium
PGNRSDIRERST

SEQ ID NO: 402148 - protein, 4 aa, Mycobacterium
PGNY

SEQ ID NO: 402149 - protein, 6 aa, Mycobacterium
PGPAAY

SEQ ID NO: 402150 - protein, 9 aa, Mycobacterium
PGPAGACES

SEQ ID NO: 402151 - protein, 11 aa, Mycobacterium
PGPAGATESEL

SEQ ID NO: 402152 - protein, 5 aa, Mycobacterium
PGPEV

SEQ ID NO: 402153 - protein, 5 aa, Mycobacterium
PGPGA

SEQ ID NO: 402154 - protein, 5 aa, Mycobacterium
PGPGL

SEQ ID NO: 402155 - protein, 19 aa, Mycobacterium
PGPGSEPGESREYQPGDDV

SEQ ID NO: 402156 - protein, 16 aa, Mycobacterium
PGPIDTEANRTTTPQE

SEQ ID NO: 402157 - protein, 7 aa, Mycobacterium
PGPSAVT

SEQ ID NO: 402158 - protein, 5 aa, Mycobacterium
PGPSG

SEQ ID NO: 402159 - protein, 4 aa, Mycobacterium
PGPT

SEQ ID NO: 402160 - protein, 7 aa, Mycobacterium
PGPTDTP

SEQ ID NO: 402161 - protein, 5 aa, Mycobacterium
PGPVA

SEQ ID NO: 402162 - protein, 5 aa, Mycobacterium
PGPVE

SEQ ID NO: 402163 - protein, 8 aa, Mycobacterium
PGQAPSYA

SEQ ID NO: 402164 - protein, 4 aa, Mycobacterium
PGQG

SEQ ID NO: 402165 - protein, 4 aa, Mycobacterium
PGQL

SEQ ID NO: 402166 - protein, 12 aa, Mycobacterium
PGQQTEAHRHTS

SEQ ID NO: 402167 - protein, 4 aa, Mycobacterium
PGQT

SEQ ID NO: 402168 - protein, 9 aa, Mycobacterium
PGQTATLSG

SEQ ID NO: 402169 - protein, 4 aa, Mycobacterium
PGQV

SEQ ID NO: 402170 - protein, 8 aa, Mycobacterium
PGRAISAR

SEQ ID NO: 402171 - protein, 4 aa, Mycobacterium
PGRE

SEQ ID NO: 402172 - protein, 6 aa, Mycobacterium
PGRGPE

SEQ ID NO: 402173 - protein, 7 aa, Mycobacterium
PGRGSGF

SEQ ID NO: 402174 - protein, 10 aa, Mycobacterium
PGRGSTYSAS

SEQ ID NO: 402175 - protein, 16 aa, Mycobacterium
PGRPLASGYAEQNQRE

SEQ ID NO: 402176 - protein, 6 aa, Mycobacterium
PGRPPL

SEQ ID NO: 402177 - protein, 8 aa, Mycobacterium
PGRPRRAG

SEQ ID NO: 402178 - protein, 4 aa, Mycobacterium
PGRS

SEQ ID NO: 402179 - protein, 13 aa, Mycobacterium
PGRTDASQENTDV

SEQ ID NO: 402180 - protein, 8 aa, Mycobacterium
PGRTVTEA

SEQ ID NO: 402181 - protein, 22 aa, Mycobacterium
PGSAAPPATDRRRDGFARRSGQ

SEQ ID NO: 402182 - protein, 7 aa, Mycobacterium
PGSDAPE

SEQ ID NO: 402183 - protein, 7 aa, Mycobacterium
PGSDTGA

SEQ ID NO: 402184 - protein, 5 aa, Mycobacterium
PGSGF

SEQ ID NO: 402185 - protein, 4 aa, Mycobacterium
PGSH

SEQ ID NO: 402186 - protein, 7 aa, Mycobacterium
PGSIASE

SEQ ID NO: 402187 - protein, 8 aa, Mycobacterium
PGSVGKPL

SEQ ID NO: 402188 - protein, 9 aa, Mycobacterium
PGSVGKPMG

SEQ ID NO: 402189 - protein, 9 aa, Mycobacterium
PGSVGKPMQ

SEQ ID NO: 402190 - protein, 9 aa, Mycobacterium
PGSVGRGFR

SEQ ID NO: 402191 - protein, 7 aa, Mycobacterium
PGSVGRP

SEQ ID NO: 402192 - protein, 7 aa, Mycobacterium
PGTARIS

SEQ ID NO: 402193 - protein, 6 aa, Mycobacterium
PGTARR

SEQ ID NO: 402194 - protein, 6 aa, Mycobacterium
PGTARS

SEQ ID NO: 402195 - protein, 6 aa, Mycobacterium
PGTEAP

SEQ ID NO: 402196 - protein, 11 aa, Mycobacterium
PGTGGSVSGTA

SEQ ID NO: 402197 - protein, 8 aa, Mycobacterium
PGTGSDDD

SEQ ID NO: 402198 - protein, 10 aa, Mycobacterium
PGTGSDDDYV

SEQ ID NO: 402199 - protein, 5 aa, Mycobacterium
PGTIN

SEQ ID NO: 402200 - protein, 7 aa, Mycobacterium
PGTLPEP

SEQ ID NO: 402201 - protein, 8 aa, Mycobacterium
PGTNGQVS

SEQ ID NO: 402202 - protein, 6 aa, Mycobacterium
PGTPMR

SEQ ID NO: 402203 - protein, 4 aa, Mycobacterium
PGTR

SEQ ID NO: 402204 - protein, 5 aa, Mycobacterium
PGTSL

SEQ ID NO: 402205 - protein, 7 aa, Mycobacterium
PGTWGPN

SEQ ID NO: 402206 - protein, 9 aa, Mycobacterium
PGVDPGSVD

SEQ ID NO: 402207 - protein, 5 aa, Mycobacterium
PGVKP

SEQ ID NO: 402208 - protein, 5 aa, Mycobacterium
PGVQQ

SEQ ID NO: 402209 - protein, 5 aa, Mycobacterium
PGVRP

SEQ ID NO: 402210 - protein, 4 aa, Mycobacterium
PGVS

SEQ ID NO: 402211 - protein, 17 aa, Mycobacterium
PHAAPTRPSTPPAPCAT

SEQ ID NO: 402212 - protein, 16 aa, Mycobacterium
PHATAEQVEAARHDSK

SEQ ID NO: 402213 - protein, 4 aa, Mycobacterium
PHDA

SEQ ID NO: 402214 - protein, 9 aa, Mycobacterium
PHDAPPATR

SEQ ID NO: 402215 - protein, 4 aa, Mycobacterium
PHDI

SEQ ID NO: 402216 - protein, 4 aa, Mycobacterium
PHDP

SEQ ID NO: 402217 - protein, 7 aa, Mycobacterium
PHDPGTT

SEQ ID NO: 402218 - protein, 5 aa, Mycobacterium
PHDVG

SEQ ID NO: 402219 - protein, 5 aa, Mycobacterium
PHEPG

SEQ ID NO: 402220 - protein, 6 aa, Mycobacterium
PHETGR

SEQ ID NO: 402221 - protein, 13 aa, Mycobacterium
PHFGGSTARSGGG

SEQ ID NO: 402222 - protein, 12 aa, Mycobacterium
PHGEGLADPTSF

SEQ ID NO: 402223 - protein, 11 aa, Mycobacterium
PHGGGAAAGTV

SEQ ID NO: 402224 - protein, 7 aa, Mycobacterium
PHHEQGP

SEQ ID NO: 402225 - protein, 15 aa, Mycobacterium
PHKKARTYSKGNRQK

SEQ ID NO: 402226 - protein, 9 aa, Mycobacterium
PHKTSSRRI

SEQ ID NO: 402227 - protein, 6 aa, Mycobacterium
PHNKAG

SEQ ID NO: 402228 - protein, 4 aa, Mycobacterium
PHPA

SEQ ID NO: 402229 - protein, 6 aa, Mycobacterium
PHPEGL

SEQ ID NO: 402230 - protein, 7 aa, Mycobacterium
PHPEGTW

SEQ ID NO: 402231 - protein, 8 aa, Mycobacterium
PHPEGTWP

SEQ ID NO: 402232 - protein, 6 aa, Mycobacterium
PHPHTG

SEQ ID NO: 402233 - protein, 4 aa, Mycobacterium
PHPI

SEQ ID NO: 402234 - protein, 5 aa, Mycobacterium
PHPPY

SEQ ID NO: 402235 - protein, 4 aa, Mycobacterium
PHPV

SEQ ID NO: 402236 - protein, 5 aa, Mycobacterium
PHPVR

SEQ ID NO: 402237 - protein, 19 aa, Mycobacterium
PHRDRGRERTRDQGYGLEL

SEQ ID NO: 402238 - protein, 5 aa, Mycobacterium
PHRRN

SEQ ID NO: 402239 - protein, 6 aa, Mycobacterium
PHRYSQ

SEQ ID NO: 402240 - protein, 4 aa, Mycobacterium
PHSA

SEQ ID NO: 402241 - protein, 7 aa, Mycobacterium
PHSEEPV

SEQ ID NO: 402242 - protein, 11 aa, Mycobacterium
PHTGIGGKTPI

SEQ ID NO: 402243 - protein, 5 aa, Mycobacterium
PHTPN

SEQ ID NO: 402244 - protein, 7 aa, Mycobacterium
PHTSSGK

SEQ ID NO: 402245 - protein, 4 aa, Mycobacterium
PIAK

SEQ ID NO: 402246 - protein, 5 aa, Mycobacterium
PIDQP

SEQ ID NO: 402247 - protein, 4 aa, Mycobacterium
PIDT

SEQ ID NO: 402248 - protein, 7 aa, Mycobacterium
PIEQGDE

SEQ ID NO: 402249 - protein, 5 aa, Mycobacterium
PIESE

SEQ ID NO: 402250 - protein, 7 aa, Mycobacterium
PIGEPER

SEQ ID NO: 402251 - protein, 4 aa, Mycobacterium
PIPA

SEQ ID NO: 402252 - protein, 13 aa, Mycobacterium
PIPDPNRAGPSTL

SEQ ID NO: 402253 - protein, 9 aa, Mycobacterium
PIPEPGPGE

SEQ ID NO: 402254 - protein, 7 aa, Mycobacterium
PIPPGSY

SEQ ID NO: 402255 - protein, 4 aa, Mycobacterium
PIPQ

SEQ ID NO: 402256 - protein, 12 aa, Mycobacterium
PISQSDVGSVEA

SEQ ID NO: 402257 - protein, 7 aa, Mycobacterium
PISSRGA

SEQ ID NO: 402258 - protein, 5 aa, Mycobacterium
PITAT

SEQ ID NO: 402259 - protein, 4 aa, Mycobacterium
PITE

SEQ ID NO: 402260 - protein, 10 aa, Mycobacterium
PIVPGANDNL

SEQ ID NO: 402261 - protein, 5 aa, Mycobacterium
PKAAG

SEQ ID NO: 402262 - protein, 4 aa, Mycobacterium
PKAT

SEQ ID NO: 402263 - protein, 9 aa, Mycobacterium
PKATHPETA

SEQ ID NO: 402264 - protein, 10 aa, Mycobacterium
PKATPAQTQA

SEQ ID NO: 402265 - protein, 8 aa, Mycobacterium
PKDALGAG

SEQ ID NO: 402266 - protein, 7 aa, Mycobacterium
PKDVQAV

SEQ ID NO: 402267 - protein, 4 aa, Mycobacterium
PKEN

SEQ ID NO: 402268 - protein, 6 aa, Mycobacterium
PKGEAE

SEQ ID NO: 402269 - protein, 13 aa, Mycobacterium
PKGKVDPGETAPV

SEQ ID NO: 402270 - protein, 7 aa, Mycobacterium
PKGPTGK

SEQ ID NO: 402271 - protein, 8 aa, Mycobacterium
PKGWTGPK

SEQ ID NO: 402272 - protein, 9 aa, Mycobacterium
PKGWTGPKV

SEQ ID NO: 402273 - protein, 11 aa, Mycobacterium
PKIDEDSDVDR

SEQ ID NO: 402274 - protein, 8 aa, Mycobacterium
PKKPGKQL

SEQ ID NO: 402275 - protein, 6 aa, Mycobacterium
PKLAEA

SEQ ID NO: 402276 - protein, 8 aa, Mycobacterium
PKLGREGA

SEQ ID NO: 402277 - protein, 7 aa, Mycobacterium
PKNPNKQ

SEQ ID NO: 402278 - protein, 5 aa, Mycobacterium
PKPDW

SEQ ID NO: 402279 - protein, 6 aa, Mycobacterium
PKPDWR

SEQ ID NO: 402280 - protein, 9 aa, Mycobacterium
PKPLQKPHP

SEQ ID NO: 402281 - protein, 4 aa, Mycobacterium
PKPP

SEQ ID NO: 402282 - protein, 4 aa, Mycobacterium
PKPR

SEQ ID NO: 402283 - protein, 7 aa, Mycobacterium
PKPVAGE

SEQ ID NO: 402284 - protein, 12 aa, Mycobacterium
PKREGKLPPTSK

SEQ ID NO: 402285 - protein, 5 aa, Mycobacterium
PKSAQ

SEQ ID NO: 402286 - protein, 8 aa, Mycobacterium
PKSDGGGA

SEQ ID NO: 402287 - protein, 7 aa, Mycobacterium
PKSDRSE

SEQ ID NO: 402288 - protein, 9 aa, Mycobacterium
PKSEGHRGG

SEQ ID NO: 402289 - protein, 5 aa, Mycobacterium
PKSGA

SEQ ID NO: 402290 - protein, 10 aa, Mycobacterium
PKSGPSKEEL

SEQ ID NO: 402291 - protein, 4 aa, Mycobacterium
PKSI

SEQ ID NO: 402292 - protein, 7 aa, Mycobacterium
PKSIGVG

SEQ ID NO: 402293 - protein, 12 aa, Mycobacterium
PKSWDPAAAEGA

SEQ ID NO: 402294 - protein, 7 aa, Mycobacterium
PKTAETA

SEQ ID NO: 402295 - protein, 5 aa, Mycobacterium
PKTEK

SEQ ID NO: 402296 - protein, 8 aa, Mycobacterium
PKTSGGRG

SEQ ID NO: 402297 - protein, 8 aa, Mycobacterium
PKTSGSRG

SEQ ID NO: 402298 - protein, 6 aa, Mycobacterium
PKYNPW

SEQ ID NO: 402299 - protein, 10 aa, Mycobacterium
PLAAAEADGA

SEQ ID NO: 402300 - protein, 10 aa, Mycobacterium
PLAAAQADGA

SEQ ID NO: 402301 - protein, 10 aa, Mycobacterium
PLAAPDGPLR

SEQ ID NO: 402302 - protein, 4 aa, Mycobacterium
PLAT

SEQ ID NO: 402303 - protein, 7 aa, Mycobacterium
PLDDGSA

SEQ ID NO: 402304 - protein, 7 aa, Mycobacterium
PLDDGTA

SEQ ID NO: 402305 - protein, 14 aa, Mycobacterium
PLDGSRDAPPDEKK

SEQ ID NO: 402306 - protein, 6 aa, Mycobacterium
PLDPRF

SEQ ID NO: 402307 - protein, 4 aa, Mycobacterium
PLEE

SEQ ID NO: 402308 - protein, 7 aa, Mycobacterium
PLEPAAE

SEQ ID NO: 402309 - protein, 12 aa, Mycobacterium
PLGATYDGSGTN

SEQ ID NO: 402310 - protein, 11 aa, Mycobacterium
PLGEQRAAETG

SEQ ID NO: 402311 - protein, 5 aa, Mycobacterium
PLGGP

SEQ ID NO: 402312 - protein, 6 aa, Mycobacterium
PLGGPR

SEQ ID NO: 402313 - protein, 5 aa, Mycobacterium
PLGRA

SEQ ID NO: 402314 - protein, 7 aa, Mycobacterium
PLGRQAE

SEQ ID NO: 402315 - protein, 4 aa, Mycobacterium
PLGT

SEQ ID NO: 402316 - protein, 6 aa, Mycobacterium
PLPAGA

SEQ ID NO: 402317 - protein, 7 aa, Mycobacterium
PLPAPDD

SEQ ID NO: 402318 - protein, 5 aa, Mycobacterium
PLPDA

SEQ ID NO: 402319 - protein, 5 aa, Mycobacterium
PLPDG

SEQ ID NO: 402320 - protein, 4 aa, Mycobacterium
PLPE

SEQ ID NO: 402321 - protein, 10 aa, Mycobacterium
PLPGGETGND

SEQ ID NO: 402322 - protein, 6 aa, Mycobacterium
PLPGGY

SEQ ID NO: 402323 - protein, 6 aa, Mycobacterium
PLPGTR

SEQ ID NO: 402324 - protein, 4 aa, Mycobacterium
PLPK

SEQ ID NO: 402325 - protein, 12 aa, Mycobacterium
PLPNTAGCRGAA

SEQ ID NO: 402326 - protein, 5 aa, Mycobacterium
PLPPG

SEQ ID NO: 402327 - protein, 5 aa, Mycobacterium
PLPSL

SEQ ID NO: 402328 - protein, 5 aa, Mycobacterium
PLPTE

SEQ ID NO: 402329 - protein, 9 aa, Mycobacterium
PLPTHPDED

SEQ ID NO: 402330 - protein, 6 aa, Mycobacterium
PLPTTT

SEQ ID NO: 402331 - protein, 4 aa, Mycobacterium
PLPV

SEQ ID NO: 402332 - protein, 4 aa, Mycobacterium
PLRP

SEQ ID NO: 402333 - protein, 4 aa, Mycobacterium
PLRT

SEQ ID NO: 402334 - protein, 4 aa, Mycobacterium
PLSA

SEQ ID NO: 402335 - protein, 5 aa, Mycobacterium
PLSAT

SEQ ID NO: 402336 - protein, 8 aa, Mycobacterium
PLSESESL

SEQ ID NO: 402337 - protein, 8 aa, Mycobacterium
PLSGDPYR

SEQ ID NO: 402338 - protein, 8 aa, Mycobacterium
PLSGIGPE

SEQ ID NO: 402339 - protein, 5 aa, Mycobacterium
PLSGV

SEQ ID NO: 402340 - protein, 4 aa, Mycobacterium
PLSP

SEQ ID NO: 402341 - protein, 8 aa, Mycobacterium
PLSPRGVK

SEQ ID NO: 402342 - protein, 10 aa, Mycobacterium
PLSTKDSDGR

SEQ ID NO: 402343 - protein, 11 aa, Mycobacterium
PLTAETAQALQ

SEQ ID NO: 402344 - protein, 4 aa, Mycobacterium
PLTG

SEQ ID NO: 402345 - protein, 5 aa, Mycobacterium
PLTPG

SEQ ID NO: 402346 - protein, 16 aa, Mycobacterium
PMETDEDGRIVSPKAA

SEQ ID NO: 402347 - protein, 6 aa, Mycobacterium
PMGGTD

SEQ ID NO: 402348 - protein, 5 aa, Mycobacterium
PMGQA

SEQ ID NO: 402349 - protein, 6 aa, Mycobacterium
PMNPNG

SEQ ID NO: 402350 - protein, 5 aa, Mycobacterium
PMTNE

SEQ ID NO: 402351 - protein, 9 aa, Mycobacterium
PNASGGTDI

SEQ ID NO: 402352 - protein, 9 aa, Mycobacterium
PNDEPEAGK

SEQ ID NO: 402353 - protein, 4 aa, Mycobacterium
PNDG

SEQ ID NO: 402354 - protein, 9 aa, Mycobacterium
PNEETSGTC

SEQ ID NO: 402355 - protein, 4 aa, Mycobacterium
PNEV

SEQ ID NO: 402356 - protein, 8 aa, Mycobacterium
PNGAGKTT

SEQ ID NO: 402357 - protein, 4 aa, Mycobacterium
PNGF

SEQ ID NO: 402358 - protein, 4 aa, Mycobacterium
PNGH

SEQ ID NO: 402359 - protein, 8 aa, Mycobacterium
PNGTITAG

SEQ ID NO: 402360 - protein, 6 aa, Mycobacterium
PNKPGI

SEQ ID NO: 402361 - protein, 6 aa, Mycobacterium
PNLRPQ

SEQ ID NO: 402362 - protein, 11 aa, Mycobacterium
PNLSRHRPTGI

SEQ ID NO: 402363 - protein, 7 aa, Mycobacterium
PNNDLSR

SEQ ID NO: 402364 - protein, 10 aa, Mycobacterium
PNNITGKGPI

SEQ ID NO: 402365 - protein, 4 aa, Mycobacterium
PNPA

SEQ ID NO: 402366 - protein, 5 aa, Mycobacterium
PNPEI

SEQ ID NO: 402367 - protein, 4 aa, Mycobacterium
PNPF

SEQ ID NO: 402368 - protein, 10 aa, Mycobacterium
PNPHATAEEV

SEQ ID NO: 402369 - protein, 11 aa, Mycobacterium
PNPRRTGPAPW

SEQ ID NO: 402370 - protein, 4 aa, Mycobacterium
PNPT

SEQ ID NO: 402371 - protein, 5 aa, Mycobacterium
PNPVV

SEQ ID NO: 402372 - protein, 4 aa, Mycobacterium
PNRV

SEQ ID NO: 402373 - protein, 5 aa, Mycobacterium
PNSFT

SEQ ID NO: 402374 - protein, 8 aa, Mycobacterium
PNSGPGHN

SEQ ID NO: 402375 - protein, 10 aa, Mycobacterium
PNSGQSCNAP

SEQ ID NO: 402376 - protein, 5 aa, Mycobacterium
PNSPL

SEQ ID NO: 402377 - protein, 8 aa, Mycobacterium
PNTNQGGN

SEQ ID NO: 402378 - protein, 5 aa, Mycobacterium
PPAAA

SEQ ID NO: 402379 - protein, 5 aa, Mycobacterium
PPAAD

SEQ ID NO: 402380 - protein, 8 aa, Mycobacterium
PPAADPVS

SEQ ID NO: 402381 - protein, 9 aa, Mycobacterium
PPAADPVSV

SEQ ID NO: 402382 - protein, 15 aa, Mycobacterium
PPAANPGLTDDERRT

SEQ ID NO: 402383 - protein, 5 aa, Mycobacterium
PPAEH

SEQ ID NO: 402384 - protein, 14 aa, Mycobacterium
PPAGGITDPTEEEQ

SEQ ID NO: 402385 - protein, 7 aa, Mycobacterium
PPAGPAL

SEQ ID NO: 402386 - protein, 7 aa, Mycobacterium
PPAGSYA

SEQ ID NO: 402387 - protein, 7 aa, Mycobacterium
PPAGTLT

SEQ ID NO: 402388 - protein, 6 aa, Mycobacterium
PPAGVG

SEQ ID NO: 402389 - protein, 12 aa, Mycobacterium
PPAHPRPTSDKT

SEQ ID NO: 402390 - protein, 4 aa, Mycobacterium
PPAI

SEQ ID NO: 402391 - protein, 14 aa, Mycobacterium
PPAPADANPPEDRR

SEQ ID NO: 402392 - protein, 7 aa, Mycobacterium
PPAPGYN

SEQ ID NO: 402393 - protein, 4 aa, Mycobacterium
PPAQ

SEQ ID NO: 402394 - protein, 4 aa, Mycobacterium
PPAV

SEQ ID NO: 402395 - protein, 10 aa, Mycobacterium
PPAVGRSGRT

SEQ ID NO: 402396 - protein, 17 aa, Mycobacterium
PPAWRPDPGRGGDPDAP

SEQ ID NO: 402397 - protein, 4 aa, Mycobacterium
PPDA

SEQ ID NO: 402398 - protein, 8 aa, Mycobacterium
PPDARSIR

SEQ ID NO: 402399 - protein, 11 aa, Mycobacterium
PPDHPARSEQD

SEQ ID NO: 402400 - protein, 12 aa, Mycobacterium
PPDHPARSEQDT

SEQ ID NO: 402401 - protein, 5 aa, Mycobacterium
PPDPA

SEQ ID NO: 402402 - protein, 6 aa, Mycobacterium
PPDREM

SEQ ID NO: 402403 - protein, 6 aa, Mycobacterium
PPDRGR

SEQ ID NO: 402404 - protein, 9 aa, Mycobacterium
PPDRRSVRD

SEQ ID NO: 402405 - protein, 4 aa, Mycobacterium
PPEA

SEQ ID NO: 402406 - protein, 4 aa, Mycobacterium
PPEE

SEQ ID NO: 402407 - protein, 8 aa, Mycobacterium
PPEHDKAR

SEQ ID NO: 402408 - protein, 6 aa, Mycobacterium
PPEHTR

SEQ ID NO: 402409 - protein, 4 aa, Mycobacterium
PPEI

SEQ ID NO: 402410 - protein, 6 aa, Mycobacterium
PPEINS

SEQ ID NO: 402411 - protein, 5 aa, Mycobacterium
PPEIT

SEQ ID NO: 402412 - protein, 6 aa, Mycobacterium
PPEITD

SEQ ID NO: 402413 - protein, 5 aa, Mycobacterium
PPEKL

SEQ ID NO: 402414 - protein, 4 aa, Mycobacterium
PPEL

SEQ ID NO: 402415 - protein, 4 aa, Mycobacterium
PPEQ

SEQ ID NO: 402416 - protein, 10 aa, Mycobacterium
PPFSGPQGPF

SEQ ID NO: 402417 - protein, 6 aa, Mycobacterium
PPGCGK

SEQ ID NO: 402418 - protein, 6 aa, Mycobacterium
PPGDGP

SEQ ID NO: 402419 - protein, 11 aa, Mycobacterium
PPGGGPAEPFA

SEQ ID NO: 402420 - protein, 5 aa, Mycobacterium
PPGGL

SEQ ID NO: 402421 - protein, 6 aa, Mycobacterium
PPGGLA

SEQ ID NO: 402422 - protein, 4 aa, Mycobacterium
PPGL

SEQ ID NO: 402423 - protein, 5 aa, Mycobacterium
PPGPH

SEQ ID NO: 402424 - protein, 7 aa, Mycobacterium
PPGPQVG

SEQ ID NO: 402425 - protein, 4 aa, Mycobacterium
PPGR

SEQ ID NO: 402426 - protein, 4 aa, Mycobacterium
PPGS

SEQ ID NO: 402427 - protein, 7 aa, Mycobacterium
PPGTGDV

SEQ ID NO: 402428 - protein, 8 aa, Mycobacterium
PPGTGKTH

SEQ ID NO: 402429 - protein, 7 aa, Mycobacterium
PPGTPWN

SEQ ID NO: 402430 - protein, 4 aa, Mycobacterium
PPHD

SEQ ID NO: 402431 - protein, 5 aa, Mycobacterium
PPHDP

SEQ ID NO: 402432 - protein, 6 aa, Mycobacterium
PPHEEL

SEQ ID NO: 402433 - protein, 6 aa, Mycobacterium
PPHSPD

SEQ ID NO: 402434 - protein, 4 aa, Mycobacterium
PPIG

SEQ ID NO: 402435 - protein, 7 aa, Mycobacterium
PPIGRSG

SEQ ID NO: 402436 - protein, 9 aa, Mycobacterium
PPKDEQPEW

SEQ ID NO: 402437 - protein, 10 aa, Mycobacterium
PPKDEQPEWA

SEQ ID NO: 402438 - protein, 11 aa, Mycobacterium
PPKEADPATGL

SEQ ID NO: 402439 - protein, 10 aa, Mycobacterium
PPLGPGAPPL

SEQ ID NO: 402440 - protein, 17 aa, Mycobacterium
PPLNEEKTVRGNVEEGL

SEQ ID NO: 402441 - protein, 4 aa, Mycobacterium
PPLP

SEQ ID NO: 402442 - protein, 5 aa, Mycobacterium
PPLPG

SEQ ID NO: 402443 - protein, 19 aa, Mycobacterium
PPLPTGDAAADRDATRAEG

SEQ ID NO: 402444 - protein, 4 aa, Mycobacterium
PPLR

SEQ ID NO: 402445 - protein, 4 aa, Mycobacterium
PPLS

SEQ ID NO: 402446 - protein, 5 aa, Mycobacterium
PPLSQ

SEQ ID NO: 402447 - protein, 4 aa, Mycobacterium
PPLT

SEQ ID NO: 402448 - protein, 4 aa, Mycobacterium
PPMD

SEQ ID NO: 402449 - protein, 4 aa, Mycobacterium
PPMG

SEQ ID NO: 402450 - protein, 5 aa, Mycobacterium
PPNLV

SEQ ID NO: 402451 - protein, 4 aa, Mycobacterium
PPPD

SEQ ID NO: 402452 - protein, 4 aa, Mycobacterium
PPPE

SEQ ID NO: 402453 - protein, 7 aa, Mycobacterium
PPPGAID

SEQ ID NO: 402454 - protein, 9 aa, Mycobacterium
PPPGTPEDQ

SEQ ID NO: 402455 - protein, 9 aa, Mycobacterium
PPPGTPPDR

SEQ ID NO: 402456 - protein, 6 aa, Mycobacterium
PPPGTV

SEQ ID NO: 402457 - protein, 6 aa, Mycobacterium
PPPHGP

SEQ ID NO: 402458 - protein, 7 aa, Mycobacterium
PPPKLGR

SEQ ID NO: 402459 - protein, 4 aa, Mycobacterium
PPPW

SEQ ID NO: 402460 - protein, 5 aa, Mycobacterium
PPPYR

SEQ ID NO: 402461 - protein, 6 aa, Mycobacterium
PPQHDL

SEQ ID NO: 402462 - protein, 4 aa, Mycobacterium
PPQP

SEQ ID NO: 402463 - protein, 5 aa, Mycobacterium
PPQPW

SEQ ID NO: 402464 - protein, 5 aa, Mycobacterium
PPRAG

SEQ ID NO: 402465 - protein, 5 aa, Mycobacterium
PPRGH

SEQ ID NO: 402466 - protein, 4 aa, Mycobacterium
PPRL

SEQ ID NO: 402467 - protein, 7 aa, Mycobacterium
PPRPGGI

SEQ ID NO: 402468 - protein, 11 aa, Mycobacterium
PPRRTAPDGSN

SEQ ID NO: 402469 - protein, 26 aa, Mycobacterium
PPSGGVGCSSPVGNYSPSGRASAPAI

SEQ ID NO: 402470 - protein, 6 aa, Mycobacterium
PPSHTR

SEQ ID NO: 402471 - protein, 8 aa, Mycobacterium
PPSQDSVY

SEQ ID NO: 402472 - protein, 5 aa, Mycobacterium
PPSRS

SEQ ID NO: 402473 - protein, 4 aa, Mycobacterium
PPST

SEQ ID NO: 402474 - protein, 4 aa, Mycobacterium
PPSW

SEQ ID NO: 402475 - protein, 5 aa, Mycobacterium
PPSYT

SEQ ID NO: 402476 - protein, 4 aa, Mycobacterium
PPTA

SEQ ID NO: 402477 - protein, 5 aa, Mycobacterium
PPTAG

SEQ ID NO: 402478 - protein, 6 aa, Mycobacterium
PPTDEQ

SEQ ID NO: 402479 - protein, 5 aa, Mycobacterium
PPTEI

SEQ ID NO: 402480 - protein, 4 aa, Mycobacterium
PPTG

SEQ ID NO: 402481 - protein, 6 aa, Mycobacterium
PPTHTE

SEQ ID NO: 402482 - protein, 8 aa, Mycobacterium
PPTSSAHI

SEQ ID NO: 402483 - protein, 4 aa, Mycobacterium
PPTW

SEQ ID NO: 402484 - protein, 4 aa, Mycobacterium
PPVP

SEQ ID NO: 402485 - protein, 5 aa, Mycobacterium
PPYIP

SEQ ID NO: 402486 - protein, 6 aa, Mycobacterium
PPYPPS

SEQ ID NO: 402487 - protein, 7 aa, Mycobacterium
PPYTGGS

SEQ ID NO: 402488 - protein, 7 aa, Mycobacterium
PQAPIPQ

SEQ ID NO: 402489 - protein, 5 aa, Mycobacterium
PQAQR

SEQ ID NO: 402490 - protein, 6 aa, Mycobacterium
PQDDRD

SEQ ID NO: 402491 - protein, 7 aa, Mycobacterium
PQDPEAL

SEQ ID NO: 402492 - protein, 5 aa, Mycobacterium
PQDPT

SEQ ID NO: 402493 - protein, 4 aa, Mycobacterium
PQED

SEQ ID NO: 402494 - protein, 4 aa, Mycobacterium
PQEL

SEQ ID NO: 402495 - protein, 14 aa, Mycobacterium
PQFDEPSLNSGGQA

SEQ ID NO: 402496 - protein, 12 aa, Mycobacterium
PQFDEPSVVNGG

SEQ ID NO: 402497 - protein, 7 aa, Mycobacterium
PQGAPAL

SEQ ID NO: 402498 - protein, 10 aa, Mycobacterium
PQGDEQPTDL

SEQ ID NO: 402499 - protein, 4 aa, Mycobacterium
PQGH

SEQ ID NO: 402500 - protein, 10 aa, Mycobacterium
PQGQQSFGQL

SEQ ID NO: 402501 - protein, 4 aa, Mycobacterium
PQGT

SEQ ID NO: 402502 - protein, 9 aa, Mycobacterium
PQHDALGTD

SEQ ID NO: 402503 - protein, 4 aa, Mycobacterium
PQKV

SEQ ID NO: 402504 - protein, 4 aa, Mycobacterium
PQLS

SEQ ID NO: 402505 - protein, 10 aa, Mycobacterium
PQPAQEGGSY

SEQ ID NO: 402506 - protein, 5 aa, Mycobacterium
PQPDI

SEQ ID NO: 402507 - protein, 4 aa, Mycobacterium
PQPG

SEQ ID NO: 402508 - protein, 5 aa, Mycobacterium
PQPGG

SEQ ID NO: 402509 - protein, 4 aa, Mycobacterium
PQPI

SEQ ID NO: 402510 - protein, 5 aa, Mycobacterium
PQPLT

SEQ ID NO: 402511 - protein, 10 aa, Mycobacterium
PQPRPPRETW

SEQ ID NO: 402512 - protein, 4 aa, Mycobacterium
PQPW

SEQ ID NO: 402513 - protein, 4 aa, Mycobacterium
PQQA

SEQ ID NO: 402514 - protein, 6 aa, Mycobacterium
PQRGRI

SEQ ID NO: 402515 - protein, 9 aa, Mycobacterium
PQRKGDPIE

SEQ ID NO: 402516 - protein, 7 aa, Mycobacterium
PQRSIPP

SEQ ID NO: 402517 - protein, 4 aa, Mycobacterium
PQRV

SEQ ID NO: 402518 - protein, 8 aa, Mycobacterium
PQSRRELA

SEQ ID NO: 402519 - protein, 9 aa, Mycobacterium
PQSSGIGGG

SEQ ID NO: 402520 - protein, 7 aa, Mycobacterium
PQSVNGL

SEQ ID NO: 402521 - protein, 6 aa, Mycobacterium
PQSVNS

SEQ ID NO: 402522 - protein, 6 aa, Mycobacterium
PQTDPG

SEQ ID NO: 402523 - protein, 7 aa, Mycobacterium
PQTEALA

SEQ ID NO: 402524 - protein, 9 aa, Mycobacterium
PQTEALATA

SEQ ID NO: 402525 - protein, 7 aa, Mycobacterium
PQTFTDR

SEQ ID NO: 402526 - protein, 4 aa, Mycobacterium
PQTR

SEQ ID NO: 402527 - protein, 7 aa, Mycobacterium
PQVETDS

SEQ ID NO: 402528 - protein, 11 aa, Mycobacterium
PQVNGTQRERL

SEQ ID NO: 402529 - protein, 4 aa, Mycobacterium
PQWG

SEQ ID NO: 402530 - protein, 4 aa, Mycobacterium
PRAE

SEQ ID NO: 402531 - protein, 8 aa, Mycobacterium
PRAGEHGG

SEQ ID NO: 402532 - protein, 7 aa, Mycobacterium
PRAIERK

SEQ ID NO: 402533 - protein, 5 aa, Mycobacterium
PRAKA

SEQ ID NO: 402534 - protein, 6 aa, Mycobacterium
PRAKTK

SEQ ID NO: 402535 - protein, 4 aa, Mycobacterium
PRAP

SEQ ID NO: 402536 - protein, 25 aa, Mycobacterium
PRAPFGGAKASGLGREFSPASLDSY

SEQ ID NO: 402537 - protein, 11 aa, Mycobacterium
PRAPKRMAGGE

SEQ ID NO: 402538 - protein, 8 aa, Mycobacterium
PRARTRSK

SEQ ID NO: 402539 - protein, 4 aa, Mycobacterium
PRAT

SEQ ID NO: 402540 - protein, 6 aa, Mycobacterium
PRAVPR

SEQ ID NO: 402541 - protein, 4 aa, Mycobacterium
PRDG

SEQ ID NO: 402542 - protein, 7 aa, Mycobacterium
PRDKDPD

SEQ ID NO: 402543 - protein, 6 aa, Mycobacterium
PRDPDP

SEQ ID NO: 402544 - protein, 10 aa, Mycobacterium
PREAAAMDPQ

SEQ ID NO: 402545 - protein, 7 aa, Mycobacterium
PREDRTQ

SEQ ID NO: 402546 - protein, 6 aa, Mycobacterium
PREEPY

SEQ ID NO: 402547 - protein, 9 aa, Mycobacterium
PREHGGRSL

SEQ ID NO: 402548 - protein, 6 aa, Mycobacterium
PREPGG

SEQ ID NO: 402549 - protein, 5 aa, Mycobacterium
PRGGA

SEQ ID NO: 402550 - protein, 4 aa, Mycobacterium
PRGL

SEQ ID NO: 402551 - protein, 5 aa, Mycobacterium
PRGLG

SEQ ID NO: 402552 - protein, 5 aa, Mycobacterium
PRGMH

SEQ ID NO: 402553 - protein, 4 aa, Mycobacterium
PRGR

SEQ ID NO: 402554 - protein, 7 aa, Mycobacterium
PRGRAVH

SEQ ID NO: 402555 - protein, 5 aa, Mycobacterium
PRGRR

SEQ ID NO: 402556 - protein, 5 aa, Mycobacterium
PRGTT

SEQ ID NO: 402557 - protein, 12 aa, Mycobacterium
PRGWTDRQHPDG

SEQ ID NO: 402558 - protein, 4 aa, Mycobacterium
PRHS

SEQ ID NO: 402559 - protein, 5 aa, Mycobacterium
PRHSQ

SEQ ID NO: 402560 - protein, 5 aa, Mycobacterium
PRKAR

SEQ ID NO: 402561 - protein, 5 aa, Mycobacterium
PRKGQ

SEQ ID NO: 402562 - protein, 13 aa, Mycobacterium
PRKPSRTERRDKS

SEQ ID NO: 402563 - protein, 9 aa, Mycobacterium
PRKSVSGSL

SEQ ID NO: 402564 - protein, 11 aa, Mycobacterium
PRLGDGGRGYR

SEQ ID NO: 402565 - protein, 5 aa, Mycobacterium
PRLPA

SEQ ID NO: 402566 - protein, 12 aa, Mycobacterium
PRLSGASPMTNL

SEQ ID NO: 402567 - protein, 4 aa, Mycobacterium
PRNA

SEQ ID NO: 402568 - protein, 6 aa, Mycobacterium
PRNADG

SEQ ID NO: 402569 - protein, 8 aa, Mycobacterium
PRNPSGKV

SEQ ID NO: 402570 - protein, 7 aa, Mycobacterium
PRPAQAR

SEQ ID NO: 402571 - protein, 4 aa, Mycobacterium
PRPD

SEQ ID NO: 402572 - protein, 4 aa, Mycobacterium
PRPE

SEQ ID NO: 402573 - protein, 6 aa, Mycobacterium
PRPERM

SEQ ID NO: 402574 - protein, 5 aa, Mycobacterium
PRPGR

SEQ ID NO: 402575 - protein, 10 aa, Mycobacterium
PRPGYTPRYD

SEQ ID NO: 402576 - protein, 5 aa, Mycobacterium
PRPPA

SEQ ID NO: 402577 - protein, 6 aa, Mycobacterium
PRPPRL

SEQ ID NO: 402578 - protein, 6 aa, Mycobacterium
PRPPSI

SEQ ID NO: 402579 - protein, 14 aa, Mycobacterium
PRPSLTGPALPPQL

SEQ ID NO: 402580 - protein, 5 aa, Mycobacterium
PRPTL

SEQ ID NO: 402581 - protein, 6 aa, Mycobacterium
PRPVPT

SEQ ID NO: 402582 - protein, 4 aa, Mycobacterium
PRQM

SEQ ID NO: 402583 - protein, 4 aa, Mycobacterium
PRRG

SEQ ID NO: 402584 - protein, 8 aa, Mycobacterium
PRRGIGDR

SEQ ID NO: 402585 - protein, 5 aa, Mycobacterium
PRRHR

SEQ ID NO: 402586 - protein, 4 aa, Mycobacterium
PRRK

SEQ ID NO: 402587 - protein, 5 aa, Mycobacterium
PRRLA

SEQ ID NO: 402588 - protein, 5 aa, Mycobacterium
PRRSA

SEQ ID NO: 402589 - protein, 4 aa, Mycobacterium
PRRT

SEQ ID NO: 402590 - protein, 7 aa, Mycobacterium
PRRTEEV

SEQ ID NO: 402591 - protein, 4 aa, Mycobacterium
PRRV

SEQ ID NO: 402592 - protein, 5 aa, Mycobacterium
PRSEI

SEQ ID NO: 402593 - protein, 7 aa, Mycobacterium
PRSFTTA

SEQ ID NO: 402594 - protein, 4 aa, Mycobacterium
PRSG

SEQ ID NO: 402595 - protein, 6 aa, Mycobacterium
PRSGRS

SEQ ID NO: 402596 - protein, 9 aa, Mycobacterium
PRSRGGDHS

SEQ ID NO: 402597 - protein, 9 aa, Mycobacterium
PRSRGGEHS

SEQ ID NO: 402598 - protein, 6 aa, Mycobacterium
PRSRYD

SEQ ID NO: 402599 - protein, 21 aa, Mycobacterium
PRSTAEAFPGLARTAALVRLV

SEQ ID NO: 402600 - protein, 4 aa, Mycobacterium
PRSV

SEQ ID NO: 402601 - protein, 6 aa, Mycobacterium
PRSVEQ

SEQ ID NO: 402602 - protein, 5 aa, Mycobacterium
PRSVP

SEQ ID NO: 402603 - protein, 4 aa, Mycobacterium
PRTA

SEQ ID NO: 402604 - protein, 18 aa, Mycobacterium
PRTAATKVNRSAMIAARG

SEQ ID NO: 402605 - protein, 4 aa, Mycobacterium
PRTD

SEQ ID NO: 402606 - protein, 5 aa, Mycobacterium
PRTEA

SEQ ID NO: 402607 - protein, 8 aa, Mycobacterium
PRTGGRAG

SEQ ID NO: 402608 - protein, 5 aa, Mycobacterium
PRTGS

SEQ ID NO: 402609 - protein, 7 aa, Mycobacterium
PRTGSTA

SEQ ID NO: 402610 - protein, 4 aa, Mycobacterium
PRTR

SEQ ID NO: 402611 - protein, 7 aa, Mycobacterium
PRTSTGK

SEQ ID NO: 402612 - protein, 28 aa, Mycobacterium
PRTSVGKYDKKAIRARHSAGEYLIEIET

SEQ ID NO: 402613 - protein, 5 aa, Mycobacterium
PRTTV

SEQ ID NO: 402614 - protein, 4 aa, Mycobacterium
PRVE

SEQ ID NO: 402615 - protein, 4 aa, Mycobacterium
PRVP

SEQ ID NO: 402616 - protein, 18 aa, Mycobacterium
PRVPDSGASTLDCVSEPV

SEQ ID NO: 402617 - protein, 10 aa, Mycobacterium
PRVPSTEEMA

SEQ ID NO: 402618 - protein, 13 aa, Mycobacterium
PRVTRAKAAADLG

SEQ ID NO: 402619 - protein, 4 aa, Mycobacterium
PRYN

SEQ ID NO: 402620 - protein, 4 aa, Mycobacterium
PSAG

SEQ ID NO: 402621 - protein, 7 aa, Mycobacterium
PSANLDP

SEQ ID NO: 402622 - protein, 6 aa, Mycobacterium
PSAPDL

SEQ ID NO: 402623 - protein, 6 aa, Mycobacterium
PSAPIP

SEQ ID NO: 402624 - protein, 4 aa, Mycobacterium
PSAR

SEQ ID NO: 402625 - protein, 4 aa, Mycobacterium
PSAS

SEQ ID NO: 402626 - protein, 9 aa, Mycobacterium
PSATGSAQQ

SEQ ID NO: 402627 - protein, 9 aa, Mycobacterium
PSATKPGLS

SEQ ID NO: 402628 - protein, 11 aa, Mycobacterium
PSAVPPAPPYY

SEQ ID NO: 402629 - protein, 4 aa, Mycobacterium
PSAY

SEQ ID NO: 402630 - protein, 8 aa, Mycobacterium
PSAYQQAA

SEQ ID NO: 402631 - protein, 4 aa, Mycobacterium
PSCP

SEQ ID NO: 402632 - protein, 7 aa, Mycobacterium
PSDAPGC

SEQ ID NO: 402633 - protein, 6 aa, Mycobacterium
PSDAQD

SEQ ID NO: 402634 - protein, 8 aa, Mycobacterium
PSDEEFAE

SEQ ID NO: 402635 - protein, 9 aa, Mycobacterium
PSDGEPTVQ

SEQ ID NO: 402636 - protein, 9 aa, Mycobacterium
PSDLEASDA

SEQ ID NO: 402637 - protein, 13 aa, Mycobacterium
PSDPAAYDEASEQ

SEQ ID NO: 402638 - protein, 8 aa, Mycobacterium
PSDWPEGK

SEQ ID NO: 402639 - protein, 4 aa, Mycobacterium
PSEL

SEQ ID NO: 402640 - protein, 7 aa, Mycobacterium
PSERGRV

SEQ ID NO: 402641 - protein, 5 aa, Mycobacterium
PSETV

SEQ ID NO: 402642 - protein, 4 aa, Mycobacterium
PSEY

SEQ ID NO: 402643 - protein, 7 aa, Mycobacterium
PSEYGAD

SEQ ID NO: 402644 - protein, 4 aa, Mycobacterium
PSGA

SEQ ID NO: 402645 - protein, 8 aa, Mycobacterium
PSGAGKTT

SEQ ID NO: 402646 - protein, 7 aa, Mycobacterium
PSGASAV

SEQ ID NO: 402647 - protein, 9 aa, Mycobacterium
PSGCGKSTT

SEQ ID NO: 402648 - protein, 7 aa, Mycobacterium
PSGCGKT

SEQ ID NO: 402649 - protein, 8 aa, Mycobacterium
PSGCGKTT

SEQ ID NO: 402650 - protein, 5 aa, Mycobacterium
PSGGI

SEQ ID NO: 402651 - protein, 11 aa, Mycobacterium
PSGLQSSSEVQ

SEQ ID NO: 402652 - protein, 11 aa, Mycobacterium
PSGLSPDDGLP

SEQ ID NO: 402653 - protein, 10 aa, Mycobacterium
PSGRRSAKEI

SEQ ID NO: 402654 - protein, 9 aa, Mycobacterium
PSGSGKSTL

SEQ ID NO: 402655 - protein, 8 aa, Mycobacterium
PSGTEPKL

SEQ ID NO: 402656 - protein, 4 aa, Mycobacterium
PSGV

SEQ ID NO: 402657 - protein, 6 aa, Mycobacterium
PSGVRA

SEQ ID NO: 402658 - protein, 4 aa, Mycobacterium
PSGW

SEQ ID NO: 402659 - protein, 11 aa, Mycobacterium
PSHNPPPDGGF

SEQ ID NO: 402660 - protein, 4 aa, Mycobacterium
PSIQ

SEQ ID NO: 402661 - protein, 7 aa, Mycobacterium
PSKAEGV

SEQ ID NO: 402662 - protein, 8 aa, Mycobacterium
PSKVPALA

SEQ ID NO: 402663 - protein, 4 aa, Mycobacterium
PSLA

SEQ ID NO: 402664 - protein, 4 aa, Mycobacterium
PSLD

SEQ ID NO: 402665 - protein, 5 aa, Mycobacterium
PSLTT

SEQ ID NO: 402666 - protein, 4 aa, Mycobacterium
PSMA

SEQ ID NO: 402667 - protein, 9 aa, Mycobacterium
PSPDEPGFA

SEQ ID NO: 402668 - protein, 4 aa, Mycobacterium
PSPG

SEQ ID NO: 402669 - protein, 5 aa, Mycobacterium
PSPHL

SEQ ID NO: 402670 - protein, 7 aa, Mycobacterium
PSPLTPL

SEQ ID NO: 402671 - protein, 4 aa, Mycobacterium
PSPT

SEQ ID NO: 402672 - protein, 15 aa, Mycobacterium
PSPTAGRAGAGGHPC

SEQ ID NO: 402673 - protein, 4 aa, Mycobacterium
PSPV

SEQ ID NO: 402674 - protein, 5 aa, Mycobacterium
PSPVK

SEQ ID NO: 402675 - protein, 4 aa, Mycobacterium
PSQL

SEQ ID NO: 402676 - protein, 4 aa, Mycobacterium
PSRA

SEQ ID NO: 402677 - protein, 4 aa, Mycobacterium
PSRF

SEQ ID NO: 402678 - protein, 7 aa, Mycobacterium
PSRLKQN

SEQ ID NO: 402679 - protein, 13 aa, Mycobacterium
PSRRTRSSQDVST

SEQ ID NO: 402680 - protein, 4 aa, Mycobacterium
PSRT

SEQ ID NO: 402681 - protein, 8 aa, Mycobacterium
PSSEAPAI

SEQ ID NO: 402682 - protein, 4 aa, Mycobacterium
PSSP

SEQ ID NO: 402683 - protein, 6 aa, Mycobacterium
PSSPMA

SEQ ID NO: 402684 - protein, 6 aa, Mycobacterium
PSSPTS

SEQ ID NO: 402685 - protein, 10 aa, Mycobacterium
PSSRKGDHNH

SEQ ID NO: 402686 - protein, 7 aa, Mycobacterium
PSSTPQR

SEQ ID NO: 402687 - protein, 16 aa, Mycobacterium
PSTAEAQDSAMSSRGY

SEQ ID NO: 402688 - protein, 5 aa, Mycobacterium
PSTAQ

SEQ ID NO: 402689 - protein, 11 aa, Mycobacterium
PSTAVRTPGAA

SEQ ID NO: 402690 - protein, 4 aa, Mycobacterium
PSTD

SEQ ID NO: 402691 - protein, 4 aa, Mycobacterium
PSTI

SEQ ID NO: 402692 - protein, 9 aa, Mycobacterium
PSTPRDGKG

SEQ ID NO: 402693 - protein, 11 aa, Mycobacterium
PSTRQPTGARH

SEQ ID NO: 402694 - protein, 10 aa, Mycobacterium
PSTSPVSRDF

SEQ ID NO: 402695 - protein, 7 aa, Mycobacterium
PSTTPTS

SEQ ID NO: 402696 - protein, 4 aa, Mycobacterium
PSTV

SEQ ID NO: 402697 - protein, 5 aa, Mycobacterium
PSVPE

SEQ ID NO: 402698 - protein, 4 aa, Mycobacterium
PSVR

SEQ ID NO: 402699 - protein, 4 aa, Mycobacterium
PSVS

SEQ ID NO: 402700 - protein, 11 aa, Mycobacterium
PSVSDNKKSVK

SEQ ID NO: 402701 - protein, 4 aa, Mycobacterium
PSVT

SEQ ID NO: 402702 - protein, 7 aa, Mycobacterium
PSWTEPK

SEQ ID NO: 402703 - protein, 4 aa, Mycobacterium
PSYD

SEQ ID NO: 402704 - protein, 7 aa, Mycobacterium
PSYGPVH

SEQ ID NO: 402705 - protein, 4 aa, Mycobacterium
PSYT

SEQ ID NO: 402706 - protein, 7 aa, Mycobacterium
PTAANAG

SEQ ID NO: 402707 - protein, 4 aa, Mycobacterium
PTAD

SEQ ID NO: 402708 - protein, 6 aa, Mycobacterium
PTADQQ

SEQ ID NO: 402709 - protein, 4 aa, Mycobacterium
PTAE

SEQ ID NO: 402710 - protein, 10 aa, Mycobacterium
PTAGAEGFEA

SEQ ID NO: 402711 - protein, 9 aa, Mycobacterium
PTAGGKTEA

SEQ ID NO: 402712 - protein, 8 aa, Mycobacterium
PTANLDPA

SEQ ID NO: 402713 - protein, 5 aa, Mycobacterium
PTAPV

SEQ ID NO: 402714 - protein, 6 aa, Mycobacterium
PTAPVS

SEQ ID NO: 402715 - protein, 7 aa, Mycobacterium
PTAQKAG

SEQ ID NO: 402716 - protein, 4 aa, Mycobacterium
PTAR

SEQ ID NO: 402717 - protein, 6 aa, Mycobacterium
PTATDT

SEQ ID NO: 402718 - protein, 8 aa, Mycobacterium
PTAVPTDP

SEQ ID NO: 402719 - protein, 4 aa, Mycobacterium
PTDG

SEQ ID NO: 402720 - protein, 5 aa, Mycobacterium
PTDRD

SEQ ID NO: 402721 - protein, 6 aa, Mycobacterium
PTDREI

SEQ ID NO: 402722 - protein, 6 aa, Mycobacterium
PTDRPY

SEQ ID NO: 402723 - protein, 9 aa, Mycobacterium
PTDSDDPLE

SEQ ID NO: 402724 - protein, 7 aa, Mycobacterium
PTEESTT

SEQ ID NO: 402725 - protein, 7 aa, Mycobacterium
PTEETTT

SEQ ID NO: 402726 - protein, 7 aa, Mycobacterium
PTEGIQP

SEQ ID NO: 402727 - protein, 8 aa, Mycobacterium
PTESESLA

SEQ ID NO: 402728 - protein, 8 aa, Mycobacterium
PTESETLT

SEQ ID NO: 402729 - protein, 4 aa, Mycobacterium
PTFG

SEQ ID NO: 402730 - protein, 12 aa, Mycobacterium
PTFQASSEKHPD

SEQ ID NO: 402731 - protein, 6 aa, Mycobacterium
PTFSQP

SEQ ID NO: 402732 - protein, 6 aa, Mycobacterium
PTFTDA

SEQ ID NO: 402733 - protein, 4 aa, Mycobacterium
PTGA

SEQ ID NO: 402734 - protein, 6 aa, Mycobacterium
PTGDHQ

SEQ ID NO: 402735 - protein, 9 aa, Mycobacterium
PTGDPPLTP

SEQ ID NO: 402736 - protein, 4 aa, Mycobacterium
PTGE

SEQ ID NO: 402737 - protein, 15 aa, Mycobacterium
PTGEPDAEYDTYKHH

SEQ ID NO: 402738 - protein, 5 aa, Mycobacterium
PTGER

SEQ ID NO: 402739 - protein, 9 aa, Mycobacterium
PTGGHSAGI

SEQ ID NO: 402740 - protein, 6 aa, Mycobacterium
PTGPVT

SEQ ID NO: 402741 - protein, 8 aa, Mycobacterium
PTGQSPTV

SEQ ID NO: 402742 - protein, 4 aa, Mycobacterium
PTGR

SEQ ID NO: 402743 - protein, 5 aa, Mycobacterium
PTGRN

SEQ ID NO: 402744 - protein, 7 aa, Mycobacterium
PTGTAVD

SEQ ID NO: 402745 - protein, 5 aa, Mycobacterium
PTGVA

SEQ ID NO: 402746 - protein, 13 aa, Mycobacterium
PTGYHVGRANHRI

SEQ ID NO: 402747 - protein, 5 aa, Mycobacterium
PTHNS

SEQ ID NO: 402748 - protein, 4 aa, Mycobacterium
PTHP

SEQ ID NO: 402749 - protein, 4 aa, Mycobacterium
PTHT

SEQ ID NO: 402750 - protein, 4 aa, Mycobacterium
PTIG

SEQ ID NO: 402751 - protein, 5 aa, Mycobacterium
PTKAR

SEQ ID NO: 402752 - protein, 4 aa, Mycobacterium
PTKD

SEQ ID NO: 402753 - protein, 9 aa, Mycobacterium
PTKDPEAAA

SEQ ID NO: 402754 - protein, 12 aa, Mycobacterium
PTLTNPPATTAV

SEQ ID NO: 402755 - protein, 12 aa, Mycobacterium
PTLTRSTPEGAR

SEQ ID NO: 402756 - protein, 6 aa, Mycobacterium
PTNDQL

SEQ ID NO: 402757 - protein, 6 aa, Mycobacterium
PTNDQM

SEQ ID NO: 402758 - protein, 4 aa, Mycobacterium
PTNN

SEQ ID NO: 402759 - protein, 4 aa, Mycobacterium
PTNR

SEQ ID NO: 402760 - protein, 9 aa, Mycobacterium
PTPAPCGRT

SEQ ID NO: 402761 - protein, 6 aa, Mycobacterium
PTPARW

SEQ ID NO: 402762 - protein, 4 aa, Mycobacterium
PTPD

SEQ ID NO: 402763 - protein, 15 aa, Mycobacterium
PTPEALAASGQPAPD

SEQ ID NO: 402764 - protein, 4 aa, Mycobacterium
PTPF

SEQ ID NO: 402765 - protein, 16 aa, Mycobacterium
PTPGFGNSGGAPSSGF

SEQ ID NO: 402766 - protein, 4 aa, Mycobacterium
PTPL

SEQ ID NO: 402767 - protein, 6 aa, Mycobacterium
PTPNGL

SEQ ID NO: 402768 - protein, 4 aa, Mycobacterium
PTPP

SEQ ID NO: 402769 - protein, 12 aa, Mycobacterium
PTPSATAAASAA

SEQ ID NO: 402770 - protein, 4 aa, Mycobacterium
PTPT

SEQ ID NO: 402771 - protein, 12 aa, Mycobacterium
PTPTKPGRPAPG

SEQ ID NO: 402772 - protein, 5 aa, Mycobacterium
PTQIG

SEQ ID NO: 402773 - protein, 4 aa, Mycobacterium
PTQP

SEQ ID NO: 402774 - protein, 4 aa, Mycobacterium
PTRD

SEQ ID NO: 402775 - protein, 7 aa, Mycobacterium
PTRDEAL

SEQ ID NO: 402776 - protein, 10 aa, Mycobacterium
PTRGEQGKGI

SEQ ID NO: 402777 - protein, 7 aa, Mycobacterium
PTRGQTA

SEQ ID NO: 402778 - protein, 4 aa, Mycobacterium
PTRI

SEQ ID NO: 402779 - protein, 5 aa, Mycobacterium
PTRPL

SEQ ID NO: 402780 - protein, 10 aa, Mycobacterium
PTRRAAAEAR

SEQ ID NO: 402781 - protein, 7 aa, Mycobacterium
PTRRQVD

SEQ ID NO: 402782 - protein, 4 aa, Mycobacterium
PTRT

SEQ ID NO: 402783 - protein, 4 aa, Mycobacterium
PTSA

SEQ ID NO: 402784 - protein, 7 aa, Mycobacterium
PTSAPER

SEQ ID NO: 402785 - protein, 8 aa, Mycobacterium
PTSAVDAE

SEQ ID NO: 402786 - protein, 8 aa, Mycobacterium
PTSEDSER

SEQ ID NO: 402787 - protein, 5 aa, Mycobacterium
PTSGL

SEQ ID NO: 402788 - protein, 6 aa, Mycobacterium
PTSGLD

SEQ ID NO: 402789 - protein, 10 aa, Mycobacterium
PTSGLDPVNA

SEQ ID NO: 402790 - protein, 5 aa, Mycobacterium
PTSGT

SEQ ID NO: 402791 - protein, 6 aa, Mycobacterium
PTSNIH

SEQ ID NO: 402792 - protein, 6 aa, Mycobacterium
PTSPGQ

SEQ ID NO: 402793 - protein, 6 aa, Mycobacterium
PTTAGS

SEQ ID NO: 402794 - protein, 5 aa, Mycobacterium
PTTGG

SEQ ID NO: 402795 - protein, 11 aa, Mycobacterium
PTTGLDPRSRR

SEQ ID NO: 402796 - protein, 5 aa, Mycobacterium
PTTKA

SEQ ID NO: 402797 - protein, 16 aa, Mycobacterium
PTTKDRQGNDRGPSYR

SEQ ID NO: 402798 - protein, 6 aa, Mycobacterium
PTTNPV

SEQ ID NO: 402799 - protein, 7 aa, Mycobacterium
PTTPIGK

SEQ ID NO: 402800 - protein, 12 aa, Mycobacterium
PTTSGTGSEVSP

SEQ ID NO: 402801 - protein, 5 aa, Mycobacterium
PTTVT

SEQ ID NO: 402802 - protein, 4 aa, Mycobacterium
PTVA

SEQ ID NO: 402803 - protein, 4 aa, Mycobacterium
PTVT

SEQ ID NO: 402804 - protein, 10 aa, Mycobacterium
PTVTEGYRQD

SEQ ID NO: 402805 - protein, 4 aa, Mycobacterium
PVAA

SEQ ID NO: 402806 - protein, 11 aa, Mycobacterium
PVADSTASQAR

SEQ ID NO: 402807 - protein, 5 aa, Mycobacterium
PVATT

SEQ ID NO: 402808 - protein, 4 aa, Mycobacterium
PVDD

SEQ ID NO: 402809 - protein, 5 aa, Mycobacterium
PVDDA

SEQ ID NO: 402810 - protein, 8 aa, Mycobacterium
PVDESTSD

SEQ ID NO: 402811 - protein, 8 aa, Mycobacterium
PVEASRSR

SEQ ID NO: 402812 - protein, 8 aa, Mycobacterium
PVEQGEGD

SEQ ID NO: 402813 - protein, 5 aa, Mycobacterium
PVGAG

SEQ ID NO: 402814 - protein, 8 aa, Mycobacterium
PVGAGAGG

SEQ ID NO: 402815 - protein, 5 aa, Mycobacterium
PVGDP

SEQ ID NO: 402816 - protein, 10 aa, Mycobacterium
PVGDQGGDIA

SEQ ID NO: 402817 - protein, 12 aa, Mycobacterium
PVGDQGGDIART

SEQ ID NO: 402818 - protein, 4 aa, Mycobacterium
PVGR

SEQ ID NO: 402819 - protein, 4 aa, Mycobacterium
PVGS

SEQ ID NO: 402820 - protein, 7 aa, Mycobacterium
PVGSTGA

SEQ ID NO: 402821 - protein, 6 aa, Mycobacterium
PVGTAP

SEQ ID NO: 402822 - protein, 7 aa, Mycobacterium
PVGTDPR

SEQ ID NO: 402823 - protein, 7 aa, Mycobacterium
PVGTEPR

SEQ ID NO: 402824 - protein, 7 aa, Mycobacterium
PVGTPLS

SEQ ID NO: 402825 - protein, 17 aa, Mycobacterium
PVKPTRSPAKYGPQEWP

SEQ ID NO: 402826 - protein, 6 aa, Mycobacterium
PVNASG

SEQ ID NO: 402827 - protein, 5 aa, Mycobacterium
PVNDP

SEQ ID NO: 402828 - protein, 10 aa, Mycobacterium
PVNPSGGLAS

SEQ ID NO: 402829 - protein, 16 aa, Mycobacterium
PVNPSGGVLSSNPIGA

SEQ ID NO: 402830 - protein, 6 aa, Mycobacterium
PVNTDG

SEQ ID NO: 402831 - protein, 7 aa, Mycobacterium
PVNTDGG

SEQ ID NO: 402832 - protein, 4 aa, Mycobacterium
PVPE

SEQ ID NO: 402833 - protein, 5 aa, Mycobacterium
PVPEK

SEQ ID NO: 402834 - protein, 5 aa, Mycobacterium
PVPGP

SEQ ID NO: 402835 - protein, 18 aa, Mycobacterium
PVPGPVPTSPANNDFKPG

SEQ ID NO: 402836 - protein, 5 aa, Mycobacterium
PVPGT

SEQ ID NO: 402837 - protein, 7 aa, Mycobacterium
PVPPPRE

SEQ ID NO: 402838 - protein, 7 aa, Mycobacterium
PVPRPER

SEQ ID NO: 402839 - protein, 4 aa, Mycobacterium
PVQG

SEQ ID NO: 402840 - protein, 35 aa, Mycobacterium
PVQPPRPPAAPTHNDPKPPPPLPPLPPGGDPTLPF

SEQ ID NO: 402841 - protein, 12 aa, Mycobacterium
PVRNYRDTSHKP

SEQ ID NO: 402842 - protein, 4 aa, Mycobacterium
PVRS

SEQ ID NO: 402843 - protein, 4 aa, Mycobacterium
PVRT

SEQ ID NO: 402844 - protein, 6 aa, Mycobacterium
PVRTPG

SEQ ID NO: 402845 - protein, 10 aa, Mycobacterium
PVSEGGYGFD

SEQ ID NO: 402846 - protein, 5 aa, Mycobacterium
PVSEY

SEQ ID NO: 402847 - protein, 14 aa, Mycobacterium
PVSGGAAAAAKGEL

SEQ ID NO: 402848 - protein, 8 aa, Mycobacterium
PVSGGEPM

SEQ ID NO: 402849 - protein, 10 aa, Mycobacterium
PVSGGPHDIA

SEQ ID NO: 402850 - protein, 17 aa, Mycobacterium
PVSRDSGKRTGRLPHPQ

SEQ ID NO: 402851 - protein, 4 aa, Mycobacterium
PVTD

SEQ ID NO: 402852 - protein, 9 aa, Mycobacterium
PVTGGSTMP

SEQ ID NO: 402853 - protein, 7 aa, Mycobacterium
PVTRTPD

SEQ ID NO: 402854 - protein, 11 aa, Mycobacterium
PVWTNPDTTFE

SEQ ID NO: 402855 - protein, 5 aa, Mycobacterium
PWAPD

SEQ ID NO: 402856 - protein, 5 aa, Mycobacterium
PWPDP

SEQ ID NO: 402857 - protein, 5 aa, Mycobacterium
PWPED

SEQ ID NO: 402858 - protein, 10 aa, Mycobacterium
PWPKTSGSRG

SEQ ID NO: 402859 - protein, 7 aa, Mycobacterium
PWPPPGR

SEQ ID NO: 402860 - protein, 4 aa, Mycobacterium
PWPT

SEQ ID NO: 402861 - protein, 11 aa, Mycobacterium
PWQRGTNENTN

SEQ ID NO: 402862 - protein, 13 aa, Mycobacterium
PYAPQGVAKPVDG

SEQ ID NO: 402863 - protein, 4 aa, Mycobacterium
PYAT

SEQ ID NO: 402864 - protein, 8 aa, Mycobacterium
PYDTDDDA

SEQ ID NO: 402865 - protein, 5 aa, Mycobacterium
PYGAC

SEQ ID NO: 402866 - protein, 7 aa, Mycobacterium
PYGDNGG

SEQ ID NO: 402867 - protein, 6 aa, Mycobacterium
PYGGPD

SEQ ID NO: 402868 - protein, 4 aa, Mycobacterium
PYGL

SEQ ID NO: 402869 - protein, 12 aa, Mycobacterium
PYGSGALHGKPA

SEQ ID NO: 402870 - protein, 4 aa, Mycobacterium
PYNG

SEQ ID NO: 402871 - protein, 4 aa, Mycobacterium
PYPA

SEQ ID NO: 402872 - protein, 5 aa, Mycobacterium
PYPAG

SEQ ID NO: 402873 - protein, 6 aa, Mycobacterium
PYPAGH

SEQ ID NO: 402874 - protein, 10 aa, Mycobacterium
PYPAGPTHAS

SEQ ID NO: 402875 - protein, 14 aa, Mycobacterium
PYPATTSAGDDGQQ

SEQ ID NO: 402876 - protein, 9 aa, Mycobacterium
PYPDGTIPE

SEQ ID NO: 402877 - protein, 5 aa, Mycobacterium
PYPDT

SEQ ID NO: 402878 - protein, 4 aa, Mycobacterium
PYPE

SEQ ID NO: 402879 - protein, 6 aa, Mycobacterium
PYPGTP

SEQ ID NO: 402880 - protein, 10 aa, Mycobacterium
PYQPEISQGR

SEQ ID NO: 402881 - protein, 12 aa, Mycobacterium
PYSRDPRNIARK

SEQ ID NO: 402882 - protein, 11 aa, Mycobacterium
PYSRRTPKLAR

SEQ ID NO: 402883 - protein, 19 aa, Mycobacterium
PYSTGETGRVGSPKRREIG

SEQ ID NO: 402884 - protein, 6 aa, Mycobacterium
PYTGGS

SEQ ID NO: 402885 - protein, 4 aa, Mycobacterium
PYVE

SEQ ID NO: 402886 - protein, 4 aa, Mycobacterium
QAAA

SEQ ID NO: 402887 - protein, 18 aa, Mycobacterium
QAAAETLRRATTGTRQAL

SEQ ID NO: 402888 - protein, 7 aa, Mycobacterium
QAAEPTG

SEQ ID NO: 402889 - protein, 6 aa, Mycobacterium
QAAGAA

SEQ ID NO: 402890 - protein, 12 aa, Mycobacterium
QAAGQAKKAVEQ

SEQ ID NO: 402891 - protein, 4 aa, Mycobacterium
QAAK

SEQ ID NO: 402892 - protein, 8 aa, Mycobacterium
QAALQDSN

SEQ ID NO: 402893 - protein, 4 aa, Mycobacterium
QAAQ

SEQ ID NO: 402894 - protein, 7 aa, Mycobacterium
QAAQTGA

SEQ ID NO: 402895 - protein, 6 aa, Mycobacterium
QAARGL

SEQ ID NO: 402896 - protein, 8 aa, Mycobacterium
QAATAPSR

SEQ ID NO: 402897 - protein, 8 aa, Mycobacterium
QAATGGSW

SEQ ID NO: 402898 - protein, 5 aa, Mycobacterium
QAATV

SEQ ID NO: 402899 - protein, 11 aa, Mycobacterium
QAAYSASKGGV

SEQ ID NO: 402900 - protein, 5 aa, Mycobacterium
QACAA

SEQ ID NO: 402901 - protein, 6 aa, Mycobacterium
QADAAN

SEQ ID NO: 402902 - protein, 4 aa, Mycobacterium
QADP

SEQ ID NO: 402903 - protein, 6 aa, Mycobacterium
QADRAE

SEQ ID NO: 402904 - protein, 7 aa, Mycobacterium
QAEAAYR

SEQ ID NO: 402905 - protein, 16 aa, Mycobacterium
QAELGGAADESVNPVP

SEQ ID NO: 402906 - protein, 9 aa, Mycobacterium
QAENGADGY

SEQ ID NO: 402907 - protein, 6 aa, Mycobacterium
QAEPPQ

SEQ ID NO: 402908 - protein, 7 aa, Mycobacterium
QAESGAH

SEQ ID NO: 402909 - protein, 4 aa, Mycobacterium
QAEV

SEQ ID NO: 402910 - protein, 5 aa, Mycobacterium
QAEVA

SEQ ID NO: 402911 - protein, 4 aa, Mycobacterium
QAFG

SEQ ID NO: 402912 - protein, 7 aa, Mycobacterium
QAFGSPS

SEQ ID NO: 402913 - protein, 4 aa, Mycobacterium
QAGD

SEQ ID NO: 402914 - protein, 6 aa, Mycobacterium
QAGDRE

SEQ ID NO: 402915 - protein, 4 aa, Mycobacterium
QAGE

SEQ ID NO: 402916 - protein, 14 aa, Mycobacterium
QAGEKGRDSRHEPV

SEQ ID NO: 402917 - protein, 7 aa, Mycobacterium
QAGEPTY

SEQ ID NO: 402918 - protein, 5 aa, Mycobacterium
QAGGT

SEQ ID NO: 402919 - protein, 16 aa, Mycobacterium
QAGHSAMQASAAAAAY

SEQ ID NO: 402920 - protein, 4 aa, Mycobacterium
QAGI

SEQ ID NO: 402921 - protein, 7 aa, Mycobacterium
QAGKPGA

SEQ ID NO: 402922 - protein, 11 aa, Mycobacterium
QAGKPTSTNPI

SEQ ID NO: 402923 - protein, 6 aa, Mycobacterium
QAGNPF

SEQ ID NO: 402924 - protein, 4 aa, Mycobacterium
QAGP

SEQ ID NO: 402925 - protein, 6 aa, Mycobacterium
QAGPDE

SEQ ID NO: 402926 - protein, 4 aa, Mycobacterium
QAGR

SEQ ID NO: 402927 - protein, 7 aa, Mycobacterium
QAGSAEY

SEQ ID NO: 402928 - protein, 9 aa, Mycobacterium
QAGSDLESV

SEQ ID NO: 402929 - protein, 6 aa, Mycobacterium
QAGSPF

SEQ ID NO: 402930 - protein, 6 aa, Mycobacterium
QAGVGH

SEQ ID NO: 402931 - protein, 7 aa, Mycobacterium
QAHSTKG

SEQ ID NO: 402932 - protein, 10 aa, Mycobacterium
QAKDPSGGYA

SEQ ID NO: 402933 - protein, 9 aa, Mycobacterium
QAKKTMSDA

SEQ ID NO: 402934 - protein, 11 aa, Mycobacterium
QAKSKGEDAKV

SEQ ID NO: 402935 - protein, 11 aa, Mycobacterium
QALGDKKGIRR

SEQ ID NO: 402936 - protein, 10 aa, Mycobacterium
QALGDKRGIR

SEQ ID NO: 402937 - protein, 7 aa, Mycobacterium
QALGGAK

SEQ ID NO: 402938 - protein, 6 aa, Mycobacterium
QALKPG

SEQ ID NO: 402939 - protein, 9 aa, Mycobacterium
QAMQAGQSA

SEQ ID NO: 402940 - protein, 12 aa, Mycobacterium
QANEDYTEEFDP

SEQ ID NO: 402941 - protein, 11 aa, Mycobacterium
QANREAGEQLH

SEQ ID NO: 402942 - protein, 4 aa, Mycobacterium
QAPA

SEQ ID NO: 402943 - protein, 7 aa, Mycobacterium
QAPARGT

SEQ ID NO: 402944 - protein, 9 aa, Mycobacterium
QAPAVQGDQ

SEQ ID NO: 402945 - protein, 9 aa, Mycobacterium
QAPDSGNSE

SEQ ID NO: 402946 - protein, 5 aa, Mycobacterium
QAPFG

SEQ ID NO: 402947 - protein, 8 aa, Mycobacterium
QAPLTETA

SEQ ID NO: 402948 - protein, 5 aa, Mycobacterium
QAPPA

SEQ ID NO: 402949 - protein, 23 aa, Mycobacterium
QAPPGRHPSPYTVPQGYREEAAV

SEQ ID NO: 402950 - protein, 7 aa, Mycobacterium
QAPPNLV

SEQ ID NO: 402951 - protein, 7 aa, Mycobacterium
QAPPRGT

SEQ ID NO: 402952 - protein, 6 aa, Mycobacterium
QAPRAG

SEQ ID NO: 402953 - protein, 9 aa, Mycobacterium
QAPTGSNAQ

SEQ ID NO: 402954 - protein, 6 aa, Mycobacterium
QAPTRA

SEQ ID NO: 402955 - protein, 4 aa, Mycobacterium
QAQD

SEQ ID NO: 402956 - protein, 8 aa, Mycobacterium
QAQPDDVS

SEQ ID NO: 402957 - protein, 4 aa, Mycobacterium
QAQT

SEQ ID NO: 402958 - protein, 11 aa, Mycobacterium
QARAAAAGDDE

SEQ ID NO: 402959 - protein, 6 aa, Mycobacterium
QARDAL

SEQ ID NO: 402960 - protein, 8 aa, Mycobacterium
QARDAPQG

SEQ ID NO: 402961 - protein, 11 aa, Mycobacterium
QAREKTGTDPV

SEQ ID NO: 402962 - protein, 8 aa, Mycobacterium
QARERGEQ

SEQ ID NO: 402963 - protein, 7 aa, Mycobacterium
QARHVDG

SEQ ID NO: 402964 - protein, 6 aa, Mycobacterium
QARPAV

SEQ ID NO: 402965 - protein, 5 aa, Mycobacterium
QARPW

SEQ ID NO: 402966 - protein, 7 aa, Mycobacterium
QASAENL

SEQ ID NO: 402967 - protein, 7 aa, Mycobacterium
QASNDQL

SEQ ID NO: 402968 - protein, 6 aa, Mycobacterium
QATADK

SEQ ID NO: 402969 - protein, 5 aa, Mycobacterium
QATER

SEQ ID NO: 402970 - protein, 5 aa, Mycobacterium
QATTT

SEQ ID NO: 402971 - protein, 6 aa, Mycobacterium
QATYDI

SEQ ID NO: 402972 - protein, 4 aa, Mycobacterium
QAVG

SEQ ID NO: 402973 - protein, 9 aa, Mycobacterium
QAVSGSGLA

SEQ ID NO: 402974 - protein, 4 aa, Mycobacterium
QAYR

SEQ ID NO: 402975 - protein, 6 aa, Mycobacterium
QAYSSA

SEQ ID NO: 402976 - protein, 7 aa, Mycobacterium
QCGSSQQ

SEQ ID NO: 402977 - protein, 14 aa, Mycobacterium
QCGYDSDDPEFGEE

SEQ ID NO: 402978 - protein, 6 aa, Mycobacterium
QDAGGE

SEQ ID NO: 402979 - protein, 9 aa, Mycobacterium
QDAPKVDDI

SEQ ID NO: 402980 - protein, 6 aa, Mycobacterium
QDCTAA

SEQ ID NO: 402981 - protein, 6 aa, Mycobacterium
QDDAEA

SEQ ID NO: 402982 - protein, 5 aa, Mycobacterium
QDDAV

SEQ ID NO: 402983 - protein, 6 aa, Mycobacterium
QDDGGL

SEQ ID NO: 402984 - protein, 5 aa, Mycobacterium
QDDTR

SEQ ID NO: 402985 - protein, 6 aa, Mycobacterium
QDEGSQ

SEQ ID NO: 402986 - protein, 6 aa, Mycobacterium
QDEKDA

SEQ ID NO: 402987 - protein, 7 aa, Mycobacterium
QDEQLQR

SEQ ID NO: 402988 - protein, 4 aa, Mycobacterium
QDGA

SEQ ID NO: 402989 - protein, 4 aa, Mycobacterium
QDGL

SEQ ID NO: 402990 - protein, 4 aa, Mycobacterium
QDGR

SEQ ID NO: 402991 - protein, 4 aa, Mycobacterium
QDGS

SEQ ID NO: 402992 - protein, 5 aa, Mycobacterium
QDGVR

SEQ ID NO: 402993 - protein, 7 aa, Mycobacterium
QDHYDNS

SEQ ID NO: 402994 - protein, 11 aa, Mycobacterium
QDKKHRGREPI

SEQ ID NO: 402995 - protein, 7 aa, Mycobacterium
QDLPGDT

SEQ ID NO: 402996 - protein, 5 aa, Mycobacterium
QDNEV

SEQ ID NO: 402997 - protein, 10 aa, Mycobacterium
QDPHNTDRRF

SEQ ID NO: 402998 - protein, 7 aa, Mycobacterium
QDPKSRV

SEQ ID NO: 402999 - protein, 4 aa, Mycobacterium
QDPM

SEQ ID NO: 403000 - protein, 5 aa, Mycobacterium
QDPRA

SEQ ID NO: 403001 - protein, 5 aa, Mycobacterium
QDPRS

SEQ ID NO: 403002 - protein, 6 aa, Mycobacterium
QDPRSR

SEQ ID NO: 403003 - protein, 9 aa, Mycobacterium
QDPTGKGEA

SEQ ID NO: 403004 - protein, 16 aa, Mycobacterium
QDPTSKMSKSASTDAG

SEQ ID NO: 403005 - protein, 8 aa, Mycobacterium
QDRAAAQA

SEQ ID NO: 403006 - protein, 8 aa, Mycobacterium
QDREPGRP

SEQ ID NO: 403007 - protein, 5 aa, Mycobacterium
QDRRG

SEQ ID NO: 403008 - protein, 4 aa, Mycobacterium
QDTA

SEQ ID NO: 403009 - protein, 18 aa, Mycobacterium
QDTADRLTSTAKAESDKM

SEQ ID NO: 403010 - protein, 11 aa, Mycobacterium
QDTGARPISDD

SEQ ID NO: 403011 - protein, 8 aa, Mycobacterium
QDTGHSQR

SEQ ID NO: 403012 - protein, 11 aa, Mycobacterium
QDYRSTTTREI

SEQ ID NO: 403013 - protein, 4 aa, Mycobacterium
QEAG

SEQ ID NO: 403014 - protein, 5 aa, Mycobacterium
QEAGA

SEQ ID NO: 403015 - protein, 6 aa, Mycobacterium
QEARAA

SEQ ID NO: 403016 - protein, 4 aa, Mycobacterium
QEDQ

SEQ ID NO: 403017 - protein, 4 aa, Mycobacterium
QEEA

SEQ ID NO: 403018 - protein, 7 aa, Mycobacterium
QEEGEDV

SEQ ID NO: 403019 - protein, 7 aa, Mycobacterium
QEGDGTS

SEQ ID NO: 403020 - protein, 6 aa, Mycobacterium
QEGQHS

SEQ ID NO: 403021 - protein, 10 aa, Mycobacterium
QEGSGLSKEE

SEQ ID NO: 403022 - protein, 8 aa, Mycobacterium
QEGVSADA

SEQ ID NO: 403023 - protein, 4 aa, Mycobacterium
QEHG

SEQ ID NO: 403024 - protein, 4 aa, Mycobacterium
QELS

SEQ ID NO: 403025 - protein, 4 aa, Mycobacterium
QEPE

SEQ ID NO: 403026 - protein, 9 aa, Mycobacterium
QEPTDQPYG

SEQ ID NO: 403027 - protein, 8 aa, Mycobacterium
QEQERGIT

SEQ ID NO: 403028 - protein, 5 aa, Mycobacterium
QEQGA

SEQ ID NO: 403029 - protein, 4 aa, Mycobacterium
QEQT

SEQ ID NO: 403030 - protein, 4 aa, Mycobacterium
QERR

SEQ ID NO: 403031 - protein, 7 aa, Mycobacterium
QERRPNK

SEQ ID NO: 403032 - protein, 5 aa, Mycobacterium
QETES

SEQ ID NO: 403033 - protein, 6 aa, Mycobacterium
QFGEPY

SEQ ID NO: 403034 - protein, 5 aa, Mycobacterium
QFGKP

SEQ ID NO: 403035 - protein, 6 aa, Mycobacterium
QFPYTT

SEQ ID NO: 403036 - protein, 8 aa, Mycobacterium
QGAATGVG

SEQ ID NO: 403037 - protein, 10 aa, Mycobacterium
QGAGKTTLAG

SEQ ID NO: 403038 - protein, 9 aa, Mycobacterium
QGAKPGGGG

SEQ ID NO: 403039 - protein, 10 aa, Mycobacterium
QGAKTLRGGK

SEQ ID NO: 403040 - protein, 4 aa, Mycobacterium
QGAQ

SEQ ID NO: 403041 - protein, 5 aa, Mycobacterium
QGARE

SEQ ID NO: 403042 - protein, 4 aa, Mycobacterium
QGAT

SEQ ID NO: 403043 - protein, 4 aa, Mycobacterium
QGDR

SEQ ID NO: 403044 - protein, 7 aa, Mycobacterium
QGDRSGV

SEQ ID NO: 403045 - protein, 10 aa, Mycobacterium
QGDTGAAAKP

SEQ ID NO: 403046 - protein, 5 aa, Mycobacterium
QGDYR

SEQ ID NO: 403047 - protein, 6 aa, Mycobacterium
QGEAPM

SEQ ID NO: 403048 - protein, 4 aa, Mycobacterium
QGEG

SEQ ID NO: 403049 - protein, 6 aa, Mycobacterium
QGEGGL

SEQ ID NO: 403050 - protein, 9 aa, Mycobacterium
QGEHRAAYN

SEQ ID NO: 403051 - protein, 4 aa, Mycobacterium
QGET

SEQ ID NO: 403052 - protein, 5 aa, Mycobacterium
QGGDL

SEQ ID NO: 403053 - protein, 12 aa, Mycobacterium
QGGEGGGHTGPI

SEQ ID NO: 403054 - protein, 6 aa, Mycobacterium
QGGGGS

SEQ ID NO: 403055 - protein, 7 aa, Mycobacterium
QGGGGSI

SEQ ID NO: 403056 - protein, 5 aa, Mycobacterium
QGGGS

SEQ ID NO: 403057 - protein, 5 aa, Mycobacterium
QGGGT

SEQ ID NO: 403058 - protein, 11 aa, Mycobacterium
QGGPGATGRSF

SEQ ID NO: 403059 - protein, 7 aa, Mycobacterium
QGGQYPA

SEQ ID NO: 403060 - protein, 7 aa, Mycobacterium
QGGRATN

SEQ ID NO: 403061 - protein, 6 aa, Mycobacterium
QGGRTS

SEQ ID NO: 403062 - protein, 6 aa, Mycobacterium
QGGTGL

SEQ ID NO: 403063 - protein, 5 aa, Mycobacterium
QGHAP

SEQ ID NO: 403064 - protein, 6 aa, Mycobacterium
QGHAPN

SEQ ID NO: 403065 - protein, 4 aa, Mycobacterium
QGIP

SEQ ID NO: 403066 - protein, 4 aa, Mycobacterium
QGIT

SEQ ID NO: 403067 - protein, 9 aa, Mycobacterium
QGKEEFDTE

SEQ ID NO: 403068 - protein, 5 aa, Mycobacterium
QGKGT

SEQ ID NO: 403069 - protein, 14 aa, Mycobacterium
QGKGTNGDSAPVPC

SEQ ID NO: 403070 - protein, 5 aa, Mycobacterium
QGKTP

SEQ ID NO: 403071 - protein, 10 aa, Mycobacterium
QGKTSGTTVN

SEQ ID NO: 403072 - protein, 5 aa, Mycobacterium
QGLEG

SEQ ID NO: 403073 - protein, 6 aa, Mycobacterium
QGMTEP

SEQ ID NO: 403074 - protein, 7 aa, Mycobacterium
QGNPVRV

SEQ ID NO: 403075 - protein, 4 aa, Mycobacterium
QGPG

SEQ ID NO: 403076 - protein, 8 aa, Mycobacterium
QGPGAVTA

SEQ ID NO: 403077 - protein, 7 aa, Mycobacterium
QGPRGVL

SEQ ID NO: 403078 - protein, 5 aa, Mycobacterium
QGPSV

SEQ ID NO: 403079 - protein, 4 aa, Mycobacterium
QGQP

SEQ ID NO: 403080 - protein, 4 aa, Mycobacterium
QGRD

SEQ ID NO: 403081 - protein, 11 aa, Mycobacterium
QGRGDAAEQTI

SEQ ID NO: 403082 - protein, 4 aa, Mycobacterium
QGRI

SEQ ID NO: 403083 - protein, 5 aa, Mycobacterium
QGRPL

SEQ ID NO: 403084 - protein, 10 aa, Mycobacterium
QGRRTARPVT

SEQ ID NO: 403085 - protein, 4 aa, Mycobacterium
QGRS

SEQ ID NO: 403086 - protein, 4 aa, Mycobacterium
QGSA

SEQ ID NO: 403087 - protein, 5 aa, Mycobacterium
QGSEV

SEQ ID NO: 403088 - protein, 10 aa, Mycobacterium
QGSGKTSLAG

SEQ ID NO: 403089 - protein, 10 aa, Mycobacterium
QGSTRTKERE

SEQ ID NO: 403090 - protein, 8 aa, Mycobacterium
QGSYPTVG

SEQ ID NO: 403091 - protein, 13 aa, Mycobacterium
QGTGEGATFPRST

SEQ ID NO: 403092 - protein, 20 aa, Mycobacterium
QGTKEYSTQNASGGSSGPFY

SEQ ID NO: 403093 - protein, 13 aa, Mycobacterium
QGTRPPTRTVRGL

SEQ ID NO: 403094 - protein, 12 aa, Mycobacterium
QGTVAGRPDDGC

SEQ ID NO: 403095 - protein, 9 aa, Mycobacterium
QGVEPARPL

SEQ ID NO: 403096 - protein, 6 aa, Mycobacterium
QGVEQS

SEQ ID NO: 403097 - protein, 8 aa, Mycobacterium
QGVTADTT

SEQ ID NO: 403098 - protein, 4 aa, Mycobacterium
QGVV

SEQ ID NO: 403099 - protein, 12 aa, Mycobacterium
QGYSPEFPGADD

SEQ ID NO: 403100 - protein, 5 aa, Mycobacterium
QHAGD

SEQ ID NO: 403101 - protein, 4 aa, Mycobacterium
QHDP

SEQ ID NO: 403102 - protein, 9 aa, Mycobacterium
QHDTTGTEM

SEQ ID NO: 403103 - protein, 4 aa, Mycobacterium
QHEA

SEQ ID NO: 403104 - protein, 6 aa, Mycobacterium
QHGGPV

SEQ ID NO: 403105 - protein, 7 aa, Mycobacterium
QHGQTTS

SEQ ID NO: 403106 - protein, 16 aa, Mycobacterium
QHHPRQRGIASGGTAV

SEQ ID NO: 403107 - protein, 5 aa, Mycobacterium
QHPDR

SEQ ID NO: 403108 - protein, 5 aa, Mycobacterium
QHPTD

SEQ ID NO: 403109 - protein, 4 aa, Mycobacterium
QHRG

SEQ ID NO: 403110 - protein, 4 aa, Mycobacterium
QHSM

SEQ ID NO: 403111 - protein, 7 aa, Mycobacterium
QHTEESE

SEQ ID NO: 403112 - protein, 7 aa, Mycobacterium
QHTNDRE

SEQ ID NO: 403113 - protein, 6 aa, Mycobacterium
QHTTEE

SEQ ID NO: 403114 - protein, 11 aa, Mycobacterium
QIAEPDQGTSF

SEQ ID NO: 403115 - protein, 10 aa, Mycobacterium
QIAGGTVQGI

SEQ ID NO: 403116 - protein, 5 aa, Mycobacterium
QIDRN

SEQ ID NO: 403117 - protein, 8 aa, Mycobacterium
QIGPTPAA

SEQ ID NO: 403118 - protein, 5 aa, Mycobacterium
QIGSG

SEQ ID NO: 403119 - protein, 12 aa, Mycobacterium
QIPGHDPAHEKL

SEQ ID NO: 403120 - protein, 5 aa, Mycobacterium
QIQKD

SEQ ID NO: 403121 - protein, 9 aa, Mycobacterium
QIRDTGGTT

SEQ ID NO: 403122 - protein, 12 aa, Mycobacterium
QISGPSHGREKP

SEQ ID NO: 403123 - protein, 5 aa, Mycobacterium
QITNP

SEQ ID NO: 403124 - protein, 11 aa, Mycobacterium
QKDEGSMAQTD

SEQ ID NO: 403125 - protein, 4 aa, Mycobacterium
QKGG

SEQ ID NO: 403126 - protein, 6 aa, Mycobacterium
QKHKVP

SEQ ID NO: 403127 - protein, 6 aa, Mycobacterium
QKLGEE

SEQ ID NO: 403128 - protein, 10 aa, Mycobacterium
QKPPRPLEAT

SEQ ID NO: 403129 - protein, 7 aa, Mycobacterium
QKTGERS

SEQ ID NO: 403130 - protein, 4 aa, Mycobacterium
QLAE

SEQ ID NO: 403131 - protein, 13 aa, Mycobacterium
QLAPKDEAERRKA

SEQ ID NO: 403132 - protein, 13 aa, Mycobacterium
QLDETKTVRENVE

SEQ ID NO: 403133 - protein, 16 aa, Mycobacterium
QLDQPAGTLSGGEKTR

SEQ ID NO: 403134 - protein, 6 aa, Mycobacterium
QLEEDP

SEQ ID NO: 403135 - protein, 16 aa, Mycobacterium
QLEQPAGTLSGGEKTR

SEQ ID NO: 403136 - protein, 6 aa, Mycobacterium
QLETEG

SEQ ID NO: 403137 - protein, 4 aa, Mycobacterium
QLGD

SEQ ID NO: 403138 - protein, 5 aa, Mycobacterium
QLGGG

SEQ ID NO: 403139 - protein, 5 aa, Mycobacterium
QLGGP

SEQ ID NO: 403140 - protein, 8 aa, Mycobacterium
QLGPEPDA

SEQ ID NO: 403141 - protein, 4 aa, Mycobacterium
QLGS

SEQ ID NO: 403142 - protein, 9 aa, Mycobacterium
QLGTDPNRT

SEQ ID NO: 403143 - protein, 4 aa, Mycobacterium
QLPE

SEQ ID NO: 403144 - protein, 4 aa, Mycobacterium
QLPG

SEQ ID NO: 403145 - protein, 5 aa, Mycobacterium
QLPGG

SEQ ID NO: 403146 - protein, 5 aa, Mycobacterium
QLPGR

SEQ ID NO: 403147 - protein, 6 aa, Mycobacterium
QLPGWD

SEQ ID NO: 403148 - protein, 6 aa, Mycobacterium
QLPRTG

SEQ ID NO: 403149 - protein, 7 aa, Mycobacterium
QLRGEGR

SEQ ID NO: 403150 - protein, 4 aa, Mycobacterium
QLSG

SEQ ID NO: 403151 - protein, 26 aa, Mycobacterium
QLSGRRGERDHRRAGAAGELTGATRP

SEQ ID NO: 403152 - protein, 7 aa, Mycobacterium
QLSPTDK

SEQ ID NO: 403153 - protein, 8 aa, Mycobacterium
QLTDAPRY

SEQ ID NO: 403154 - protein, 7 aa, Mycobacterium
QLTDSQR

SEQ ID NO: 403155 - protein, 5 aa, Mycobacterium
QLTRA

SEQ ID NO: 403156 - protein, 9 aa, Mycobacterium
QMADARGTT

SEQ ID NO: 403157 - protein, 6 aa, Mycobacterium
QMRGGG

SEQ ID NO: 403158 - protein, 9 aa, Mycobacterium
QMTDKTAPR

SEQ ID NO: 403159 - protein, 4 aa, Mycobacterium
QNAA

SEQ ID NO: 403160 - protein, 4 aa, Mycobacterium
QNAE

SEQ ID NO: 403161 - protein, 13 aa, Mycobacterium
QNAPAIAATEAQY

SEQ ID NO: 403162 - protein, 4 aa, Mycobacterium
QNAQ

SEQ ID NO: 403163 - protein, 9 aa, Mycobacterium
QNGGPDDFT

SEQ ID NO: 403164 - protein, 4 aa, Mycobacterium
QNGL

SEQ ID NO: 403165 - protein, 8 aa, Mycobacterium
QNGNGYDA

SEQ ID NO: 403166 - protein, 19 aa, Mycobacterium
QNIAGAGWSGTAQATSYDT

SEQ ID NO: 403167 - protein, 6 aa, Mycobacterium
QNIKSA

SEQ ID NO: 403168 - protein, 10 aa, Mycobacterium
QNKKQGEASA

SEQ ID NO: 403169 - protein, 4 aa, Mycobacterium
QNPD

SEQ ID NO: 403170 - protein, 5 aa, Mycobacterium
QNPGL

SEQ ID NO: 403171 - protein, 6 aa, Mycobacterium
QNPGVT

SEQ ID NO: 403172 - protein, 5 aa, Mycobacterium
QNPRS

SEQ ID NO: 403173 - protein, 5 aa, Mycobacterium
QNQET

SEQ ID NO: 403174 - protein, 7 aa, Mycobacterium
QNQPATA

SEQ ID NO: 403175 - protein, 6 aa, Mycobacterium
QNSDVH

SEQ ID NO: 403176 - protein, 4 aa, Mycobacterium
QNTA

SEQ ID NO: 403177 - protein, 5 aa, Mycobacterium
QNTFA

SEQ ID NO: 403178 - protein, 6 aa, Mycobacterium
QNTPAI

SEQ ID NO: 403179 - protein, 7 aa, Mycobacterium
QNTPAIA

SEQ ID NO: 403180 - protein, 9 aa, Mycobacterium
QNTPAIAAT

SEQ ID NO: 403181 - protein, 10 aa, Mycobacterium
QNTPAIAATE

SEQ ID NO: 403182 - protein, 12 aa, Mycobacterium
QNTPAIAATEAQ

SEQ ID NO: 403183 - protein, 13 aa, Mycobacterium
QNTPAIAATEAQY

SEQ ID NO: 403184 - protein, 22 aa, Mycobacterium
QNTTDIPTRTDRGADADPIRNG

SEQ ID NO: 403185 - protein, 11 aa, Mycobacterium
QPAKGFASHGE

SEQ ID NO: 403186 - protein, 9 aa, Mycobacterium
QPAKNQAVT

SEQ ID NO: 403187 - protein, 13 aa, Mycobacterium
QPAPESSGAVAGP

SEQ ID NO: 403188 - protein, 4 aa, Mycobacterium
QPDA

SEQ ID NO: 403189 - protein, 5 aa, Mycobacterium
QPDAR

SEQ ID NO: 403190 - protein, 4 aa, Mycobacterium
QPDP

SEQ ID NO: 403191 - protein, 5 aa, Mycobacterium
QPDQW

SEQ ID NO: 403192 - protein, 4 aa, Mycobacterium
QPDR

SEQ ID NO: 403193 - protein, 5 aa, Mycobacterium
QPDRR

SEQ ID NO: 403194 - protein, 6 aa, Mycobacterium
QPDSRA

SEQ ID NO: 403195 - protein, 8 aa, Mycobacterium
QPEDGGQH

SEQ ID NO: 403196 - protein, 6 aa, Mycobacterium
QPEEYR

SEQ ID NO: 403197 - protein, 6 aa, Mycobacterium
QPEEYS

SEQ ID NO: 403198 - protein, 4 aa, Mycobacterium
QPEH

SEQ ID NO: 403199 - protein, 4 aa, Mycobacterium
QPER

SEQ ID NO: 403200 - protein, 5 aa, Mycobacterium
QPERQ

SEQ ID NO: 403201 - protein, 5 aa, Mycobacterium
QPETI

SEQ ID NO: 403202 - protein, 17 aa, Mycobacterium
QPFGGSRGSGTNDKAGS

SEQ ID NO: 403203 - protein, 16 aa, Mycobacterium
QPGDSLQIDGEGAHGP

SEQ ID NO: 403204 - protein, 5 aa, Mycobacterium
QPGGA

SEQ ID NO: 403205 - protein, 5 aa, Mycobacterium
QPGGE

SEQ ID NO: 403206 - protein, 5 aa, Mycobacterium
QPGLR

SEQ ID NO: 403207 - protein, 4 aa, Mycobacterium
QPGQ

SEQ ID NO: 403208 - protein, 5 aa, Mycobacterium
QPGQA

SEQ ID NO: 403209 - protein, 8 aa, Mycobacterium
QPGRGPGR

SEQ ID NO: 403210 - protein, 5 aa, Mycobacterium
QPGSA

SEQ ID NO: 403211 - protein, 5 aa, Mycobacterium
QPGSL

SEQ ID NO: 403212 - protein, 17 aa, Mycobacterium
QPGSLGGGAQDRESPMG

SEQ ID NO: 403213 - protein, 5 aa, Mycobacterium
QPGVS

SEQ ID NO: 403214 - protein, 6 aa, Mycobacterium
QPGYLP

SEQ ID NO: 403215 - protein, 4 aa, Mycobacterium
QPHL

SEQ ID NO: 403216 - protein, 4 aa, Mycobacterium
QPIR

SEQ ID NO: 403217 - protein, 4 aa, Mycobacterium
QPKG

SEQ ID NO: 403218 - protein, 4 aa, Mycobacterium
QPKW

SEQ ID NO: 403219 - protein, 6 aa, Mycobacterium
QPLAAQ

SEQ ID NO: 403220 - protein, 4 aa, Mycobacterium
QPLD

SEQ ID NO: 403221 - protein, 4 aa, Mycobacterium
QPLG

SEQ ID NO: 403222 - protein, 12 aa, Mycobacterium
QPLGGKAQFGGQ

SEQ ID NO: 403223 - protein, 11 aa, Mycobacterium
QPLGTDKEGKD

SEQ ID NO: 403224 - protein, 5 aa, Mycobacterium
QPNCK

SEQ ID NO: 403225 - protein, 4 aa, Mycobacterium
QPPA

SEQ ID NO: 403226 - protein, 7 aa, Mycobacterium
QPPAATS

SEQ ID NO: 403227 - protein, 5 aa, Mycobacterium
QPPEA

SEQ ID NO: 403228 - protein, 9 aa, Mycobacterium
QPPEFGGRN

SEQ ID NO: 403229 - protein, 8 aa, Mycobacterium
QPPGAVNG

SEQ ID NO: 403230 - protein, 8 aa, Mycobacterium
QPPGAVSG

SEQ ID NO: 403231 - protein, 5 aa, Mycobacterium
QPPSA

SEQ ID NO: 403232 - protein, 4 aa, Mycobacterium
QPQL

SEQ ID NO: 403233 - protein, 8 aa, Mycobacterium
QPQPETLD

SEQ ID NO: 403234 - protein, 7 aa, Mycobacterium
QPRHPDD

SEQ ID NO: 403235 - protein, 5 aa, Mycobacterium
QPRYV

SEQ ID NO: 403236 - protein, 5 aa, Mycobacterium
QPSPF

SEQ ID NO: 403237 - protein, 4 aa, Mycobacterium
QPVE

SEQ ID NO: 403238 - protein, 9 aa, Mycobacterium
QPVEEGRRR

SEQ ID NO: 403239 - protein, 4 aa, Mycobacterium
QPVP

SEQ ID NO: 403240 - protein, 5 aa, Mycobacterium
QPVRD

SEQ ID NO: 403241 - protein, 4 aa, Mycobacterium
QPVT

SEQ ID NO: 403242 - protein, 7 aa, Mycobacterium
QPVTTAN

SEQ ID NO: 403243 - protein, 14 aa, Mycobacterium
QPWPAESAGDRVRR

SEQ ID NO: 403244 - protein, 5 aa, Mycobacterium
QPWSD

SEQ ID NO: 403245 - protein, 6 aa, Mycobacterium
QPWSTG

SEQ ID NO: 403246 - protein, 5 aa, Mycobacterium
QQAAA

SEQ ID NO: 403247 - protein, 7 aa, Mycobacterium
QQAAAAD

SEQ ID NO: 403248 - protein, 9 aa, Mycobacterium
QQAERGNKI

SEQ ID NO: 403249 - protein, 10 aa, Mycobacterium
QQAKTTPQRA

SEQ ID NO: 403250 - protein, 6 aa, Mycobacterium
QQEERG

SEQ ID NO: 403251 - protein, 6 aa, Mycobacterium
QQFGQP

SEQ ID NO: 403252 - protein, 7 aa, Mycobacterium
QQFTGSS

SEQ ID NO: 403253 - protein, 5 aa, Mycobacterium
QQGEH

SEQ ID NO: 403254 - protein, 13 aa, Mycobacterium
QQGEHRDGIPNRS

SEQ ID NO: 403255 - protein, 5 aa, Mycobacterium
QQGEY

SEQ ID NO: 403256 - protein, 6 aa, Mycobacterium
QQGTEA

SEQ ID NO: 403257 - protein, 4 aa, Mycobacterium
QQHD

SEQ ID NO: 403258 - protein, 7 aa, Mycobacterium
QQLDPQA

SEQ ID NO: 403259 - protein, 4 aa, Mycobacterium
QQLG

SEQ ID NO: 403260 - protein, 6 aa, Mycobacterium
QQPGTL

SEQ ID NO: 403261 - protein, 5 aa, Mycobacterium
QQPQH

SEQ ID NO: 403262 - protein, 4 aa, Mycobacterium
QQPR

SEQ ID NO: 403263 - protein, 4 aa, Mycobacterium
QQPV

SEQ ID NO: 403264 - protein, 6 aa, Mycobacterium
QQRETA

SEQ ID NO: 403265 - protein, 9 aa, Mycobacterium
QQRETFGKP

SEQ ID NO: 403266 - protein, 4 aa, Mycobacterium
QQRY

SEQ ID NO: 403267 - protein, 4 aa, Mycobacterium
QQTN

SEQ ID NO: 403268 - protein, 4 aa, Mycobacterium
QQVV

SEQ ID NO: 403269 - protein, 16 aa, Mycobacterium
QQWADESAARGTYPSL

SEQ ID NO: 403270 - protein, 4 aa, Mycobacterium
QRAA

SEQ ID NO: 403271 - protein, 46 aa, Mycobacterium; identical to SEQ ID NO: 42607

SEQ ID NO: 403272 - protein, 4 aa, Mycobacterium
QRAD

SEQ ID NO: 403273 - protein, 4 aa, Mycobacterium
QRAG

SEQ ID NO: 403274 - protein, 7 aa, Mycobacterium
QRAGDDE

SEQ ID NO: 403275 - protein, 4 aa, Mycobacterium
QRAP

SEQ ID NO: 403276 - protein, 4 aa, Mycobacterium
QRAR

SEQ ID NO: 403277 - protein, 7 aa, Mycobacterium
QRARAED

SEQ ID NO: 403278 - protein, 5 aa, Mycobacterium
QRCES

SEQ ID NO: 403279 - protein, 4 aa, Mycobacterium
QRDG

SEQ ID NO: 403280 - protein, 4 aa, Mycobacterium
QRDL

SEQ ID NO: 403281 - protein, 4 aa, Mycobacterium
QRDN

SEQ ID NO: 403282 - protein, 4 aa, Mycobacterium
QRDP

SEQ ID NO: 403283 - protein, 8 aa, Mycobacterium
QRDPKGLY

SEQ ID NO: 403284 - protein, 4 aa, Mycobacterium
QRDR

SEQ ID NO: 403285 - protein, 11 aa, Mycobacterium
QRDRAALTEDE

SEQ ID NO: 403286 - protein, 13 aa, Mycobacterium
QRDRPDEAGYRGD

SEQ ID NO: 403287 - protein, 7 aa, Mycobacterium
QREPERK

SEQ ID NO: 403288 - protein, 7 aa, Mycobacterium
QRESMGN

SEQ ID NO: 403289 - protein, 8 aa, Mycobacterium
QRESTGQP

SEQ ID NO: 403290 - protein, 5 aa, Mycobacterium
QRGDW

SEQ ID NO: 403291 - protein, 8 aa, Mycobacterium
QRGEDRQK

SEQ ID NO: 403292 - protein, 8 aa, Mycobacterium
QRGEDRQR

SEQ ID NO: 403293 - protein, 6 aa, Mycobacterium
QRGNPI

SEQ ID NO: 403294 - protein, 4 aa, Mycobacterium
QRGR

SEQ ID NO: 403295 - protein, 6 aa, Mycobacterium
QRHATQ

SEQ ID NO: 403296 - protein, 7 aa, Mycobacterium
QRIAKGE

SEQ ID NO: 403297 - protein, 8 aa, Mycobacterium
QRLRSGPI

SEQ ID NO: 403298 - protein, 6 aa, Mycobacterium
QRNPNS

SEQ ID NO: 403299 - protein, 12 aa, Mycobacterium
QRPDPPPPGPGQ

SEQ ID NO: 403300 - protein, 7 aa, Mycobacterium
QRPEGAT

SEQ ID NO: 403301 - protein, 7 aa, Mycobacterium
QRPEIRR

SEQ ID NO: 403302 - protein, 6 aa, Mycobacterium
QRPNAR

SEQ ID NO: 403303 - protein, 10 aa, Mycobacterium
QRPPEVDDRA

SEQ ID NO: 403304 - protein, 4 aa, Mycobacterium
QRPS

SEQ ID NO: 403305 - protein, 5 aa, Mycobacterium
QRPVS

SEQ ID NO: 403306 - protein, 6 aa, Mycobacterium
QRRAAA

SEQ ID NO: 403307 - protein, 15 aa, Mycobacterium
QRRGTATSRSTVGTV

SEQ ID NO: 403308 - protein, 9 aa, Mycobacterium
QRRKTSRNA

SEQ ID NO: 403309 - protein, 4 aa, Mycobacterium
QRRL

SEQ ID NO: 403310 - protein, 6 aa, Mycobacterium
QRRPSA

SEQ ID NO: 403311 - protein, 15 aa, Mycobacterium
QRRRAKADAAARKHA

SEQ ID NO: 403312 - protein, 4 aa, Mycobacterium
QRSG

SEQ ID NO: 403313 - protein, 6 aa, Mycobacterium
QRSGRG

SEQ ID NO: 403314 - protein, 7 aa, Mycobacterium
QRSSGRG

SEQ ID NO: 403315 - protein, 7 aa, Mycobacterium
QRTEAEV

SEQ ID NO: 403316 - protein, 6 aa, Mycobacterium
QRTSAR

SEQ ID NO: 403317 - protein, 6 aa, Mycobacterium
QRTSTI

SEQ ID NO: 403318 - protein, 6 aa, Mycobacterium
QRTTAR

SEQ ID NO: 403319 - protein, 10 aa, Mycobacterium
QSADPDGGEW

SEQ ID NO: 403320 - protein, 5 aa, Mycobacterium
QSAGV

SEQ ID NO: 403321 - protein, 8 aa, Mycobacterium
QSAPPGAG

SEQ ID NO: 403322 - protein, 4 aa, Mycobacterium
QSAT

SEQ ID NO: 403323 - protein, 4 aa, Mycobacterium
QSAV

SEQ ID NO: 403324 - protein, 13 aa, Mycobacterium
QSDQQRAAGELRL

SEQ ID NO: 403325 - protein, 9 aa, Mycobacterium
QSEGGAAGA

SEQ ID NO: 403326 - protein, 4 aa, Mycobacterium
QSEL

SEQ ID NO: 403327 - protein, 5 aa, Mycobacterium
QSEPL

SEQ ID NO: 403328 - protein, 7 aa, Mycobacterium
QSFETRK

SEQ ID NO: 403329 - protein, 6 aa, Mycobacterium
QSGDTV

SEQ ID NO: 403330 - protein, 7 aa, Mycobacterium
QSGDTVK

SEQ ID NO: 403331 - protein, 7 aa, Mycobacterium
QSGETAD

SEQ ID NO: 403332 - protein, 5 aa, Mycobacterium
QSGGE

SEQ ID NO: 403333 - protein, 11 aa, Mycobacterium
QSGIGREFGPE

SEQ ID NO: 403334 - protein, 7 aa, Mycobacterium
QSGPKDL

SEQ ID NO: 403335 - protein, 8 aa, Mycobacterium
QSGRRGRV

SEQ ID NO: 403336 - protein, 9 aa, Mycobacterium
QSKSAYQAE

SEQ ID NO: 403337 - protein, 14 aa, Mycobacterium
QSKSAYQAEIDSPC

SEQ ID NO: 403338 - protein, 11 aa, Mycobacterium
QSLGGNGLTKE

SEQ ID NO: 403339 - protein, 8 aa, Mycobacterium
QSLPGKAI

SEQ ID NO: 403340 - protein, 6 aa, Mycobacterium
QSPDGL

SEQ ID NO: 403341 - protein, 5 aa, Mycobacterium
QSPTK

SEQ ID NO: 403342 - protein, 10 aa, Mycobacterium
QSQAAGGPAM

SEQ ID NO: 403343 - protein, 4 aa, Mycobacterium
QSQI

SEQ ID NO: 403344 - protein, 5 aa, Mycobacterium
QSRDT

SEQ ID NO: 403345 - protein, 8 aa, Mycobacterium
QSREPYGK

SEQ ID NO: 403346 - protein, 4 aa, Mycobacterium
QSRR

SEQ ID NO: 403347 - protein, 5 aa, Mycobacterium
QSRRR

SEQ ID NO: 403348 - protein, 5 aa, Mycobacterium
QSTFG

SEQ ID NO: 403349 - protein, 8 aa, Mycobacterium
QSTPPGAG

SEQ ID NO: 403350 - protein, 6 aa, Mycobacterium
QSVQNT

SEQ ID NO: 403351 - protein, 9 aa, Mycobacterium
QSVSEPLQT

SEQ ID NO: 403352 - protein, 12 aa, Mycobacterium
QSYDEVTKKTDG

SEQ ID NO: 403353 - protein, 6 aa, Mycobacterium
QSYGNV

SEQ ID NO: 403354 - protein, 9 aa, Mycobacterium
QSYQEPAAN

SEQ ID NO: 403355 - protein, 5 aa, Mycobacterium
QTADG

SEQ ID NO: 403356 - protein, 4 aa, Mycobacterium
QTAP

SEQ ID NO: 403357 - protein, 4 aa, Mycobacterium
QTAT

SEQ ID NO: 403358 - protein, 4 aa, Mycobacterium
QTDK

SEQ ID NO: 403359 - protein, 5 aa, Mycobacterium
QTDPY

SEQ ID NO: 403360 - protein, 6 aa, Mycobacterium
QTDTQI

SEQ ID NO: 403361 - protein, 4 aa, Mycobacterium
QTEL

SEQ ID NO: 403362 - protein, 4 aa, Mycobacterium
QTER

SEQ ID NO: 403363 - protein, 14 aa, Mycobacterium
QTEYNAGSRMQGQL

SEQ ID NO: 403364 - protein, 4 aa, Mycobacterium
QTGA

SEQ ID NO: 403365 - protein, 8 aa, Mycobacterium
QTGAPLPT

SEQ ID NO: 403366 - protein, 4 aa, Mycobacterium
QTGG

SEQ ID NO: 403367 - protein, 5 aa, Mycobacterium
QTGLP

SEQ ID NO: 403368 - protein, 7 aa, Mycobacterium
QTGTGPT

SEQ ID NO: 403369 - protein, 11 aa, Mycobacterium
QTHGGNGLATE

SEQ ID NO: 403370 - protein, 11 aa, Mycobacterium
QTHGGNGMATE

SEQ ID NO: 403371 - protein, 4 aa, Mycobacterium
QTKV

SEQ ID NO: 403372 - protein, 6 aa, Mycobacterium
QTLDDN

SEQ ID NO: 403373 - protein, 6 aa, Mycobacterium
QTLEDN

SEQ ID NO: 403374 - protein, 6 aa, Mycobacterium
QTLGGS

SEQ ID NO: 403375 - protein, 14 aa, Mycobacterium
QTNGSGRIAEPDEI

SEQ ID NO: 403376 - protein, 8 aa, Mycobacterium
QTNYSAAK

SEQ ID NO: 403377 - protein, 4 aa, Mycobacterium
QTPA

SEQ ID NO: 403378 - protein, 7 aa, Mycobacterium
QTPAERD

SEQ ID NO: 403379 - protein, 6 aa, Mycobacterium
QTPQGF

SEQ ID NO: 403380 - protein, 4 aa, Mycobacterium
QTPR

SEQ ID NO: 403381 - protein, 10 aa, Mycobacterium
QTQGQGHETT

SEQ ID NO: 403382 - protein, 7 aa, Mycobacterium
QTQRGRA

SEQ ID NO: 403383 - protein, 6 aa, Mycobacterium
QTQRIA

SEQ ID NO: 403384 - protein, 6 aa, Mycobacterium
QTRAEP

SEQ ID NO: 403385 - protein, 5 aa, Mycobacterium
QTRPA

SEQ ID NO: 403386 - protein, 7 aa, Mycobacterium
QTSVQPP

SEQ ID NO: 403387 - protein, 5 aa, Mycobacterium
QTTPY

SEQ ID NO: 403388 - protein, 6 aa, Mycobacterium
QTVPEG

SEQ ID NO: 403389 - protein, 4 aa, Mycobacterium
QTVV

SEQ ID NO: 403390 - protein, 7 aa, Mycobacterium
QVADYAR

SEQ ID NO: 403391 - protein, 11 aa, Mycobacterium
QVARDDARAEL

SEQ ID NO: 403392 - protein, 11 aa, Mycobacterium
QVEGAGSPTMT

SEQ ID NO: 403393 - protein, 4 aa, Mycobacterium
QVGR

SEQ ID NO: 403394 - protein, 7 aa, Mycobacterium
QVNPKRC

SEQ ID NO: 403395 - protein, 5 aa, Mycobacterium
QVPDA

SEQ ID NO: 403396 - protein, 7 aa, Mycobacterium
QVPDGED

SEQ ID NO: 403397 - protein, 5 aa, Mycobacterium
QVPGR

SEQ ID NO: 403398 - protein, 4 aa, Mycobacterium
QVPT

SEQ ID NO: 403399 - protein, 5 aa, Mycobacterium
QVRGP

SEQ ID NO: 403400 - protein, 11 aa, Mycobacterium
QVRGTSHNQVD

SEQ ID NO: 403401 - protein, 4 aa, Mycobacterium
QVSG

SEQ ID NO: 403402 - protein, 7 aa, Mycobacterium
QVSGRYT

SEQ ID NO: 403403 - protein, 8 aa, Mycobacterium
QVSGRYTG

SEQ ID NO: 403404 - protein, 5 aa, Mycobacterium
QVSSG

SEQ ID NO: 403405 - protein, 8 aa, Mycobacterium
QVTDADSA

SEQ ID NO: 403406 - protein, 4 aa, Mycobacterium
QVTR

SEQ ID NO: 403407 - protein, 6 aa, Mycobacterium
QVTTDR

SEQ ID NO: 403408 - protein, 4 aa, Mycobacterium
QWPG

SEQ ID NO: 403409 - protein, 11 aa, Mycobacterium
QYAKPRSSDVD

SEQ ID NO: 403410 - protein, 11 aa, Mycobacterium
QYANDARSEAA

SEQ ID NO: 403411 - protein, 5 aa, Mycobacterium
QYDRP

SEQ ID NO: 403412 - protein, 7 aa, Mycobacterium
QYEDPKT

SEQ ID NO: 403413 - protein, 12 aa, Mycobacterium
QYEHGRDTAPVV

SEQ ID NO: 403414 - protein, 12 aa, Mycobacterium
QYGQGPGPGENI

SEQ ID NO: 403415 - protein, 7 aa, Mycobacterium
QYGSTAE

SEQ ID NO: 403416 - protein, 19 aa, Mycobacterium
QYPAPTASALATTSLGGPF

SEQ ID NO: 403417 - protein, 8 aa, Mycobacterium
QYPDDPGK

SEQ ID NO: 403418 - protein, 5 aa, Mycobacterium
QYPGA

SEQ ID NO: 403419 - protein, 4 aa, Mycobacterium
QYPQ

SEQ ID NO: 403420 - protein, 5 aa, Mycobacterium
QYPSV

SEQ ID NO: 403421 - protein, 11 aa, Mycobacterium
QYQNPDNVDAY

SEQ ID NO: 403422 - protein, 6 aa, Mycobacterium
QYQSSV

SEQ ID NO: 403423 - protein, 4 aa, Mycobacterium
QYSD

SEQ ID NO: 403424 - protein, 9 aa, Mycobacterium
QYTKEEAAK

SEQ ID NO: 403425 - protein, 4 aa, Mycobacterium
RAAA

SEQ ID NO: 403426 - protein, 8 aa, Mycobacterium
RAAADGAN

SEQ ID NO: 403427 - protein, 5 aa, Mycobacterium
RAAAT

SEQ ID NO: 403428 - protein, 5 aa, Mycobacterium
RAAAY

SEQ ID NO: 403429 - protein, 7 aa, Mycobacterium
RAADEDL

SEQ ID NO: 403430 - protein, 6 aa, Mycobacterium
RAADEG

SEQ ID NO: 403431 - protein, 9 aa, Mycobacterium
RAADGTGEL

SEQ ID NO: 403432 - protein, 5 aa, Mycobacterium
RAAED

SEQ ID NO: 403433 - protein, 6 aa, Mycobacterium
RAAELA

SEQ ID NO: 403434 - protein, 10 aa, Mycobacterium
RAAGADAVHP

SEQ ID NO: 403435 - protein, 18 aa, Mycobacterium
RAAGAKAGISVKPGTPLE

SEQ ID NO: 403436 - protein, 6 aa, Mycobacterium
RAAGGQ

SEQ ID NO: 403437 - protein, 9 aa, Mycobacterium
RAAGRRDGL

SEQ ID NO: 403438 - protein, 4 aa, Mycobacterium
RAAP

SEQ ID NO: 403439 - protein, 4 aa, Mycobacterium
RAAQ

SEQ ID NO: 403440 - protein, 13 aa, Mycobacterium
RAARASSVLDGGP

SEQ ID NO: 403441 - protein, 6 aa, Mycobacterium
RAARRD

SEQ ID NO: 403442 - protein, 10 aa, Mycobacterium
RAASDATGRA

SEQ ID NO: 403443 - protein, 5 aa, Mycobacterium
RAATA

SEQ ID NO: 403444 - protein, 7 aa, Mycobacterium
RAATAYG

SEQ ID NO: 403445 - protein, 5 aa, Mycobacterium
RAATD

SEQ ID NO: 403446 - protein, 7 aa, Mycobacterium
RAATDGQ

SEQ ID NO: 403447 - protein, 6 aa, Mycobacterium
RAATEA

SEQ ID NO: 403448 - protein, 7 aa, Mycobacterium
RAATEAA

SEQ ID NO: 403449 - protein, 8 aa, Mycobacterium
RAATEAAL

SEQ ID NO: 403450 - protein, 5 aa, Mycobacterium
RAATG

SEQ ID NO: 403451 - protein, 7 aa, Mycobacterium
RAATSGQ

SEQ ID NO: 403452 - protein, 6 aa, Mycobacterium
RADAAE

SEQ ID NO: 403453 - protein, 9 aa, Mycobacterium
RADAPDKVN

SEQ ID NO: 403454 - protein, 8 aa, Mycobacterium
RADAVNPR

SEQ ID NO: 403455 - protein, 4 aa, Mycobacterium
RADD

SEQ ID NO: 403456 - protein, 4 aa, Mycobacterium
RADE

SEQ ID NO: 403457 - protein, 5 aa, Mycobacterium
RADER

SEQ ID NO: 403458 - protein, 5 aa, Mycobacterium
RADGR

SEQ ID NO: 403459 - protein, 4 aa, Mycobacterium
RADT

SEQ ID NO: 403460 - protein, 5 aa, Mycobacterium
RADTI

SEQ ID NO: 403461 - protein, 7 aa, Mycobacterium
RADTYSQ

SEQ ID NO: 403462 - protein, 7 aa, Mycobacterium
RAEADPA

SEQ ID NO: 403463 - protein, 5 aa, Mycobacterium
RAEDP

SEQ ID NO: 403464 - protein, 6 aa, Mycobacterium
RAEDPV

SEQ ID NO: 403465 - protein, 5 aa, Mycobacterium
RAEDR

SEQ ID NO: 403466 - protein, 4 aa, Mycobacterium
RAEE

SEQ ID NO: 403467 - protein, 7 aa, Mycobacterium
RAEFGAR

SEQ ID NO: 403468 - protein, 4 aa, Mycobacterium
RAEG

SEQ ID NO: 403469 - protein, 6 aa, Mycobacterium
RAEGIP

SEQ ID NO: 403470 - protein, 6 aa, Mycobacterium
RAEGIS

SEQ ID NO: 403471 - protein, 5 aa, Mycobacterium
RAEKA

SEQ ID NO: 403472 - protein, 7 aa, Mycobacterium
RAEKEQI

SEQ ID NO: 403473 - protein, 7 aa, Mycobacterium
RAELGNP

SEQ ID NO: 403474 - protein, 7 aa, Mycobacterium
RAERAMS

SEQ ID NO: 403475 - protein, 5 aa, Mycobacterium
RAERD

SEQ ID NO: 403476 - protein, 60 aa, Mycobacterium
RAERGPDTQQDPPAARRAAARARSIPEPSWPHPSVEGTNQNQEPSEVSTDRPANSDDDDL

SEQ ID NO: 403477 - protein, 6 aa, Mycobacterium
RAESAG

SEQ ID NO: 403478 - protein, 5 aa, Mycobacterium
RAESS

SEQ ID NO: 403479 - protein, 9 aa, Mycobacterium
RAETPEQQQ

SEQ ID NO: 403480 - protein, 6 aa, Mycobacterium
RAEVSP

SEQ ID NO: 403481 - protein, 7 aa, Mycobacterium
RAEVSQA

SEQ ID NO: 403482 - protein, 4 aa, Mycobacterium
RAFP

SEQ ID NO: 403483 - protein, 6 aa, Mycobacterium
RAFSAG

SEQ ID NO: 403484 - protein, 4 aa, Mycobacterium
RAGA

SEQ ID NO: 403485 - protein, 6 aa, Mycobacterium
RAGAAA

SEQ ID NO: 403486 - protein, 8 aa, Mycobacterium
RAGAQGVG

SEQ ID NO: 403487 - protein, 4 aa, Mycobacterium
RAGD

SEQ ID NO: 403488 - protein, 9 aa, Mycobacterium
RAGDFNARS

SEQ ID NO: 403489 - protein, 8 aa, Mycobacterium
RAGDPREI

SEQ ID NO: 403490 - protein, 7 aa, Mycobacterium
RAGEATS

SEQ ID NO: 403491 - protein, 10 aa, Mycobacterium
RAGEGSDEHY

SEQ ID NO: 403492 - protein, 8 aa, Mycobacterium
RAGEPSEV

SEQ ID NO: 403493 - protein, 9 aa, Mycobacterium
RAGERGALE

SEQ ID NO: 403494 - protein, 5 aa, Mycobacterium
RAGFR

SEQ ID NO: 403495 - protein, 5 aa, Mycobacterium
RAGGD

SEQ ID NO: 403496 - protein, 5 aa, Mycobacterium
RAGGT

SEQ ID NO: 403497 - protein, 9 aa, Mycobacterium
RAGHDSTNM

SEQ ID NO: 403498 - protein, 6 aa, Mycobacterium
RAGHET

SEQ ID NO: 403499 - protein, 4 aa, Mycobacterium
RAGI

SEQ ID NO: 403500 - protein, 12 aa, Mycobacterium
RAGKTNSGKGAA

SEQ ID NO: 403501 - protein, 10 aa, Mycobacterium
RAGNGGNGCA

SEQ ID NO: 403502 - protein, 10 aa, Mycobacterium
RAGPTYTKDT

SEQ ID NO: 403503 - protein, 8 aa, Mycobacterium
RAGRDQAA

SEQ ID NO: 403504 - protein, 5 aa, Mycobacterium
RAGRI

SEQ ID NO: 403505 - protein, 6 aa, Mycobacterium
RAGRQD

SEQ ID NO: 403506 - protein, 10 aa, Mycobacterium
RAGSGGNGCA

SEQ ID NO: 403507 - protein, 5 aa, Mycobacterium
RAGTG

SEQ ID NO: 403508 - protein, 7 aa, Mycobacterium
RAGVGER

SEQ ID NO: 403509 - protein, 8 aa, Mycobacterium
RAGVGKPT

SEQ ID NO: 403510 - protein, 6 aa, Mycobacterium
RAHEHT

SEQ ID NO: 403511 - protein, 4 aa, Mycobacterium
RAHG

SEQ ID NO: 403512 - protein, 6 aa, Mycobacterium
RAHPEE

SEQ ID NO: 403513 - protein, 7 aa, Mycobacterium
RAHTGKA

SEQ ID NO: 403514 - protein, 7 aa, Mycobacterium
RAKEHGA

SEQ ID NO: 403515 - protein, 7 aa, Mycobacterium
RAKELGM

SEQ ID NO: 403516 - protein, 8 aa, Mycobacterium
RAKGEAAI

SEQ ID NO: 403517 - protein, 4 aa, Mycobacterium
RAKP

SEQ ID NO: 403518 - protein, 7 aa, Mycobacterium
RAKPNDI

SEQ ID NO: 403519 - protein, 5 aa, Mycobacterium
RALDA

SEQ ID NO: 403520 - protein, 5 aa, Mycobacterium
RALPP

SEQ ID NO: 403521 - protein, 6 aa, Mycobacterium
RALTPP

SEQ ID NO: 403522 - protein, 5 aa, Mycobacterium
RAMPP

SEQ ID NO: 403523 - protein, 9 aa, Mycobacterium
RANAELNPT

SEQ ID NO: 403524 - protein, 5 aa, Mycobacterium
RANDK

SEQ ID NO: 403525 - protein, 11 aa, Mycobacterium
RANGGGATAIS

SEQ ID NO: 403526 - protein, 5 aa, Mycobacterium
RANQW

SEQ ID NO: 403527 - protein, 4 aa, Mycobacterium
RANT

SEQ ID NO: 403528 - protein, 5 aa, Mycobacterium
RAPAD

SEQ ID NO: 403529 - protein, 7 aa, Mycobacterium
RAPAGRW

SEQ ID NO: 403530 - protein, 7 aa, Mycobacterium
RAPDADA

SEQ ID NO: 403531 - protein, 6 aa, Mycobacterium
RAPGAH

SEQ ID NO: 403532 - protein, 13 aa, Mycobacterium
RAPKRVRRQSREY

SEQ ID NO: 403533 - protein, 4 aa, Mycobacterium
RAPL

SEQ ID NO: 403534 - protein, 6 aa, Mycobacterium
RAPLSR

SEQ ID NO: 403535 - protein, 6 aa, Mycobacterium
RAPLTD

SEQ ID NO: 403536 - protein, 9 aa, Mycobacterium
RAPNGGNTQ

SEQ ID NO: 403537 - protein, 6 aa, Mycobacterium
RAPRGE

SEQ ID NO: 403538 - protein, 10 aa, Mycobacterium
RAPSPLPPHP

SEQ ID NO: 403539 - protein, 8 aa, Mycobacterium
RAPSVHNT

SEQ ID NO: 403540 - protein, 4 aa, Mycobacterium
RAPT

SEQ ID NO: 403541 - protein, 6 aa, Mycobacterium
RAPTIA

SEQ ID NO: 403542 - protein, 5 aa, Mycobacterium
RAPVS

SEQ ID NO: 403543 - protein, 10 aa, Mycobacterium
RAQASAAIAD

SEQ ID NO: 403544 - protein, 8 aa, Mycobacterium
RAQATEDL

SEQ ID NO: 403545 - protein, 4 aa, Mycobacterium
RAQE

SEQ ID NO: 403546 - protein, 5 aa, Mycobacterium
RAQEP

SEQ ID NO: 403547 - protein, 4 aa, Mycobacterium
RAQR

SEQ ID NO: 403548 - protein, 6 aa, Mycobacterium
RAQRRR

SEQ ID NO: 403549 - protein, 7 aa, Mycobacterium
RAQTAKR

SEQ ID NO: 403550 - protein, 8 aa, Mycobacterium
RAQTAKRE

SEQ ID NO: 403551 - protein, 5 aa, Mycobacterium
RARAM

SEQ ID NO: 403552 - protein, 8 aa, Mycobacterium
RARASARR

SEQ ID NO: 403553 - protein, 8 aa, Mycobacterium
RARATRDG

SEQ ID NO: 403554 - protein, 4 aa, Mycobacterium
RARG

SEQ ID NO: 403555 - protein, 4 aa, Mycobacterium
RARH

SEQ ID NO: 403556 - protein, 4 aa, Mycobacterium
RARI

SEQ ID NO: 403557 - protein, 5 aa, Mycobacterium
RARLG

SEQ ID NO: 403558 - protein, 11 aa, Mycobacterium
RARNSAERRRV

SEQ ID NO: 403559 - protein, 7 aa, Mycobacterium
RARPPEL

SEQ ID NO: 403560 - protein, 12 aa, Mycobacterium
RARRAALAAAGA

SEQ ID NO: 403561 - protein, 6 aa, Mycobacterium
RARRKG

SEQ ID NO: 403562 - protein, 7 aa, Mycobacterium
RARSRGL

SEQ ID NO: 403563 - protein, 4 aa, Mycobacterium
RART

SEQ ID NO: 403564 - protein, 5 aa, Mycobacterium
RARTG

SEQ ID NO: 403565 - protein, 10 aa, Mycobacterium
RASAAERDVT

SEQ ID NO: 403566 - protein, 11 aa, Mycobacterium
RASAAERDVTT

SEQ ID NO: 403567 - protein, 4 aa, Mycobacterium
RASD

SEQ ID NO: 403568 - protein, 9 aa, Mycobacterium
RASGEDSGA

SEQ ID NO: 403569 - protein, 5 aa, Mycobacterium
RASLS

SEQ ID NO: 403570 - protein, 16 aa, Mycobacterium
RASPGGTGAAKFGGNY

SEQ ID NO: 403571 - protein, 6 aa, Mycobacterium
RASQRS

SEQ ID NO: 403572 - protein, 8 aa, Mycobacterium
RASRSMQR

SEQ ID NO: 403573 - protein, 13 aa, Mycobacterium
RASSQPAAASLPD

SEQ ID NO: 403574 - protein, 4 aa, Mycobacterium
RATA

SEQ ID NO: 403575 - protein, 6 aa, Mycobacterium
RATAAG

SEQ ID NO: 403576 - protein, 14 aa, Mycobacterium
RATADQIGTQSTQV

SEQ ID NO: 403577 - protein, 10 aa, Mycobacterium
RATAEGRKAE

SEQ ID NO: 403578 - protein, 9 aa, Mycobacterium
RATAEQTRE

SEQ ID NO: 403579 - protein, 7 aa, Mycobacterium
RATAPGS

SEQ ID NO: 403580 - protein, 6 aa, Mycobacterium
RATDPD

SEQ ID NO: 403581 - protein, 6 aa, Mycobacterium
RATEAE

SEQ ID NO: 403582 - protein, 9 aa, Mycobacterium
RATEGQLHE

SEQ ID NO: 403583 - protein, 4 aa, Mycobacterium
RATG

SEQ ID NO: 403584 - protein, 10 aa, Mycobacterium
RATGAAEAIE

SEQ ID NO: 403585 - protein, 5 aa, Mycobacterium
RATPV

SEQ ID NO: 403586 - protein, 15 aa, Mycobacterium
RATSGDNHLGGDDWD

SEQ ID NO: 403587 - protein, 6 aa, Mycobacterium
RAVKQG

SEQ ID NO: 403588 - protein, 4 aa, Mycobacterium
RAVT

SEQ ID NO: 403589 - protein, 7 aa, Mycobacterium
RAYRPDG

SEQ ID NO: 403590 - protein, 4 aa, Mycobacterium
RCEG

SEQ ID NO: 403591 - protein, 5 aa, Mycobacterium
RCPQA

SEQ ID NO: 403592 - protein, 7 aa, Mycobacterium
RCSTSRK

SEQ ID NO: 403593 - protein, 6 aa, Mycobacterium
RCTAEA

SEQ ID NO: 403594 - protein, 5 aa, Mycobacterium
RDAAE

SEQ ID NO: 403595 - protein, 10 aa, Mycobacterium
RDAAGKGGAI

SEQ ID NO: 403596 - protein, 6 aa, Mycobacterium
RDADGL

SEQ ID NO: 403597 - protein, 5 aa, Mycobacterium
RDAEG

SEQ ID NO: 403598 - protein, 4 aa, Mycobacterium
RDAF

SEQ ID NO: 403599 - protein, 8 aa, Mycobacterium
RDAGYDDV

SEQ ID NO: 403600 - protein, 5 aa, Mycobacterium
RDATA

SEQ ID NO: 403601 - protein, 9 aa, Mycobacterium
RDATDEERA

SEQ ID NO: 403602 - protein, 10 aa, Mycobacterium
RDAVDDTDAA

SEQ ID NO: 403603 - protein, 5 aa, Mycobacterium
RDAVG

SEQ ID NO: 403604 - protein, 7 aa, Mycobacterium
RDAVSRE

SEQ ID NO: 403605 - protein, 4 aa, Mycobacterium
RDCP

SEQ ID NO: 403606 - protein, 5 aa, Mycobacterium
RDDAA

SEQ ID NO: 403607 - protein, 7 aa, Mycobacterium
RDDAADD

SEQ ID NO: 403608 - protein, 5 aa, Mycobacterium
RDDDA

SEQ ID NO: 403609 - protein, 13 aa, Mycobacterium
RDDDGKDVPWDGQ

SEQ ID NO: 403610 - protein, 14 aa, Mycobacterium
RDDEFGGSLQNRAK

SEQ ID NO: 403611 - protein, 4 aa, Mycobacterium
RDDG

SEQ ID NO: 403612 - protein, 5 aa, Mycobacterium
RDDGT

SEQ ID NO: 403613 - protein, 9 aa, Mycobacterium
RDDGTNRRA

SEQ ID NO: 403614 - protein, 6 aa, Mycobacterium
RDDPNH

SEQ ID NO: 403615 - protein, 7 aa, Mycobacterium
RDDVPED

SEQ ID NO: 403616 - protein, 4 aa, Mycobacterium
RDEA

SEQ ID NO: 403617 - protein, 7 aa, Mycobacterium
RDEGADI

SEQ ID NO: 403618 - protein, 7 aa, Mycobacterium
RDEGIAS

SEQ ID NO: 403619 - protein, 5 aa, Mycobacterium
RDELP

SEQ ID NO: 403620 - protein, 4 aa, Mycobacterium
RDEN

SEQ ID NO: 403621 - protein, 4 aa, Mycobacterium
RDEQ

SEQ ID NO: 403622 - protein, 8 aa, Mycobacterium
RDERTRAK

SEQ ID NO: 403623 - protein, 12 aa, Mycobacterium
RDESERIGDGPL

SEQ ID NO: 403624 - protein, 6 aa, Mycobacterium
RDESGE

SEQ ID NO: 403625 - protein, 5 aa, Mycobacterium
RDGAG

SEQ ID NO: 403626 - protein, 11 aa, Mycobacterium
RDGAGKGGTIK

SEQ ID NO: 403627 - protein, 6 aa, Mycobacterium
RDGDDL

SEQ ID NO: 403628 - protein, 6 aa, Mycobacterium
RDGEAD

SEQ ID NO: 403629 - protein, 9 aa, Mycobacterium
RDGEIDPSV

SEQ ID NO: 403630 - protein, 8 aa, Mycobacterium
RDGEWTTN

SEQ ID NO: 403631 - protein, 15 aa, Mycobacterium
RDGGDRYGGKGVKKA

SEQ ID NO: 403632 - protein, 9 aa, Mycobacterium
RDGGPAPVR

SEQ ID NO: 403633 - protein, 5 aa, Mycobacterium
RDGGQ

SEQ ID NO: 403634 - protein, 5 aa, Mycobacterium
RDGGS

SEQ ID NO: 403635 - protein, 5 aa, Mycobacterium
RDGHE

SEQ ID NO: 403636 - protein, 4 aa, Mycobacterium
RDGL

SEQ ID NO: 403637 - protein, 9 aa, Mycobacterium
RDGLSNPEI

SEQ ID NO: 403638 - protein, 4 aa, Mycobacterium
RDGN

SEQ ID NO: 403639 - protein, 11 aa, Mycobacterium
RDGNGDPLPAE

SEQ ID NO: 403640 - protein, 11 aa, Mycobacterium
RDGNGGPLPAE

SEQ ID NO: 403641 - protein, 7 aa, Mycobacterium
RDGPASA

SEQ ID NO: 403642 - protein, 8 aa, Mycobacterium
RDGPGGEL

SEQ ID NO: 403643 - protein, 5 aa, Mycobacterium
RDGQI

SEQ ID NO: 403644 - protein, 7 aa, Mycobacterium
RDGQPRW

SEQ ID NO: 403645 - protein, 18 aa, Mycobacterium
RDGQRRHPSDNTDEPARA

SEQ ID NO: 403646 - protein, 8 aa, Mycobacterium
RDGRARSI

SEQ ID NO: 403647 - protein, 14 aa, Mycobacterium
RDGTGITLNEALHA

SEQ ID NO: 403648 - protein, 5 aa, Mycobacterium
RDGVR

SEQ ID NO: 403649 - protein, 6 aa, Mycobacterium
RDGVTA

SEQ ID NO: 403650 - protein, 9 aa, Mycobacterium
RDGVTASRA

SEQ ID NO: 403651 - protein, 6 aa, Mycobacterium
RDIAKG

SEQ ID NO: 403652 - protein, 7 aa, Mycobacterium
RDIPPEA

SEQ ID NO: 403653 - protein, 5 aa, Mycobacterium
RDIQG

SEQ ID NO: 403654 - protein, 4 aa, Mycobacterium
RDKT

SEQ ID NO: 403655 - protein, 4 aa, Mycobacterium
RDLA

SEQ ID NO: 403656 - protein, 4 aa, Mycobacterium
RDLS

SEQ ID NO: 403657 - protein, 6 aa, Mycobacterium
RDNAGR

SEQ ID NO: 403658 - protein, 14 aa, Mycobacterium
RDNPQRSVRLSFLE

SEQ ID NO: 403659 - protein, 5 aa, Mycobacterium
RDPAG

SEQ ID NO: 403660 - protein, 13 aa, Mycobacterium
RDPAGNLIRIQEL

SEQ ID NO: 403661 - protein, 6 aa, Mycobacterium
RDPATP

SEQ ID NO: 403662 - protein, 4 aa, Mycobacterium
RDPD

SEQ ID NO: 403663 - protein, 5 aa, Mycobacterium
RDPDA

SEQ ID NO: 403664 - protein, 14 aa, Mycobacterium
RDPDTGEPGQWTEP

SEQ ID NO: 403665 - protein, 4 aa, Mycobacterium
RDPE

SEQ ID NO: 403666 - protein, 5 aa, Mycobacterium
RDPKD

SEQ ID NO: 403667 - protein, 6 aa, Mycobacterium
RDPKGL

SEQ ID NO: 403668 - protein, 5 aa, Mycobacterium
RDPNA

SEQ ID NO: 403669 - protein, 5 aa, Mycobacterium
RDPNK

SEQ ID NO: 403670 - protein, 7 aa, Mycobacterium
RDPNPHL

SEQ ID NO: 403671 - protein, 5 aa, Mycobacterium
RDPQL

SEQ ID NO: 403672 - protein, 6 aa, Mycobacterium
RDPRDA

SEQ ID NO: 403673 - protein, 7 aa, Mycobacterium
RDPRDAA

SEQ ID NO: 403674 - protein, 17 aa, Mycobacterium
RDPSPRASNWRATGTLE

SEQ ID NO: 403675 - protein, 9 aa, Mycobacterium
RDPSPRQQA

SEQ ID NO: 403676 - protein, 10 aa, Mycobacterium
RDPYGRTARQ

SEQ ID NO: 403677 - protein, 4 aa, Mycobacterium
RDQL

SEQ ID NO: 403678 - protein, 13 aa, Mycobacterium
RDQLRAKARPGVT

SEQ ID NO: 403679 - protein, 5 aa, Mycobacterium
RDQMS

SEQ ID NO: 403680 - protein, 6 aa, Mycobacterium
RDQMSN

SEQ ID NO: 403681 - protein, 6 aa, Mycobacterium
RDQPAR

SEQ ID NO: 403682 - protein, 5 aa, Mycobacterium
RDQRE

SEQ ID NO: 403683 - protein, 5 aa, Mycobacterium
RDQTG

SEQ ID NO: 403684 - protein, 4 aa, Mycobacterium
RDRA

SEQ ID NO: 403685 - protein, 6 aa, Mycobacterium
RDRDEG

SEQ ID NO: 403686 - protein, 4 aa, Mycobacterium
RDRE

SEQ ID NO: 403687 - protein, 10 aa, Mycobacterium
RDRETGDNFD

SEQ ID NO: 403688 - protein, 4 aa, Mycobacterium
RDRP

SEQ ID NO: 403689 - protein, 9 aa, Mycobacterium
RDRRARKGE

SEQ ID NO: 403690 - protein, 5 aa, Mycobacterium
RDRRP

SEQ ID NO: 403691 - protein, 8 aa, Mycobacterium
RDRRSATD

SEQ ID NO: 403692 - protein, 8 aa, Mycobacterium
RDRTEAQN

SEQ ID NO: 403693 - protein, 4 aa, Mycobacterium
RDRV

SEQ ID NO: 403694 - protein, 9 aa, Mycobacterium
RDRYTPTPA

SEQ ID NO: 403695 - protein, 5 aa, Mycobacterium
RDSAT

SEQ ID NO: 403696 - protein, 10 aa, Mycobacterium
RDSEDGSITE

SEQ ID NO: 403697 - protein, 9 aa, Mycobacterium
RDSEPDWGP

SEQ ID NO: 403698 - protein, 4 aa, Mycobacterium
RDSG

SEQ ID NO: 403699 - protein, 15 aa, Mycobacterium
RDSIEGGADAELSAA

SEQ ID NO: 403700 - protein, 4 aa, Mycobacterium
RDSR

SEQ ID NO: 403701 - protein, 10 aa, Mycobacterium
RDSRAGDPDL

SEQ ID NO: 403702 - protein, 7 aa, Mycobacterium
RDSSPTL

SEQ ID NO: 403703 - protein, 7 aa, Mycobacterium
RDTANPT

SEQ ID NO: 403704 - protein, 5 aa, Mycobacterium
RDTED

SEQ ID NO: 403705 - protein, 7 aa, Mycobacterium
RDTGGTL

SEQ ID NO: 403706 - protein, 5 aa, Mycobacterium
RDTGV

SEQ ID NO: 403707 - protein, 4 aa, Mycobacterium
RDTP

SEQ ID NO: 403708 - protein, 4 aa, Mycobacterium
RDTT

SEQ ID NO: 403709 - protein, 5 aa, Mycobacterium
RDTVR

SEQ ID NO: 403710 - protein, 8 aa, Mycobacterium
RDVDDDEH

SEQ ID NO: 403711 - protein, 9 aa, Mycobacterium
RDVDPAVAG

SEQ ID NO: 403712 - protein, 4 aa, Mycobacterium
RDVE

SEQ ID NO: 403713 - protein, 5 aa, Mycobacterium
RDVQA

SEQ ID NO: 403714 - protein, 11 aa, Mycobacterium
RDWGSPSIPEK

SEQ ID NO: 403715 - protein, 4 aa, Mycobacterium
REAA

SEQ ID NO: 403716 - protein, 5 aa, Mycobacterium
REAAD

SEQ ID NO: 403717 - protein, 5 aa, Mycobacterium
REAAQ

SEQ ID NO: 403718 - protein, 4 aa, Mycobacterium
REAL

SEQ ID NO: 403719 - protein, 7 aa, Mycobacterium
REALESA

SEQ ID NO: 403720 - protein, 10 aa, Mycobacterium
REALGDPTAH

SEQ ID NO: 403721 - protein, 4 aa, Mycobacterium
REAR

SEQ ID NO: 403722 - protein, 4 aa, Mycobacterium
REAS

SEQ ID NO: 403723 - protein, 4 aa, Mycobacterium
REDF

SEQ ID NO: 403724 - protein, 5 aa, Mycobacterium
REDGA

SEQ ID NO: 403725 - protein, 8 aa, Mycobacterium
REDGREGD

SEQ ID NO: 403726 - protein, 10 aa, Mycobacterium
REDGTHGDTS

SEQ ID NO: 403727 - protein, 9 aa, Mycobacterium
REDNAQTRG

SEQ ID NO: 403728 - protein, 8 aa, Mycobacterium
REDNARRA

SEQ ID NO: 403729 - protein, 4 aa, Mycobacterium
REDP

SEQ ID NO: 403730 - protein, 4 aa, Mycobacterium
REDR

SEQ ID NO: 403731 - protein, 8 aa, Mycobacterium
REDRPGDK

SEQ ID NO: 403732 - protein, 4 aa, Mycobacterium
REDW

SEQ ID NO: 403733 - protein, 7 aa, Mycobacterium
REEAPSV

SEQ ID NO: 403734 - protein, 5 aa, Mycobacterium
REEDL

SEQ ID NO: 403735 - protein, 4 aa, Mycobacterium
REEP

SEQ ID NO: 403736 - protein, 6 aa, Mycobacterium
REERPD

SEQ ID NO: 403737 - protein, 5 aa, Mycobacterium
REFPA

SEQ ID NO: 403738 - protein, 6 aa, Mycobacterium
REFTEG

SEQ ID NO: 403739 - protein, 4 aa, Mycobacterium
REGE

SEQ ID NO: 403740 - protein, 6 aa, Mycobacterium
REGGIN

SEQ ID NO: 403741 - protein, 10 aa, Mycobacterium
REGNSKLSRV

SEQ ID NO: 403742 - protein, 6 aa, Mycobacterium
REGPAA

SEQ ID NO: 403743 - protein, 7 aa, Mycobacterium
REGPGNA

SEQ ID NO: 403744 - protein, 7 aa, Mycobacterium
REGPGRR

SEQ ID NO: 403745 - protein, 4 aa, Mycobacterium
REGR

SEQ ID NO: 403746 - protein, 5 aa, Mycobacterium
REGRA

SEQ ID NO: 403747 - protein, 5 aa, Mycobacterium
REGRE

SEQ ID NO: 403748 - protein, 5 aa, Mycobacterium
REGRH

SEQ ID NO: 403749 - protein, 7 aa, Mycobacterium
REGRLSA

SEQ ID NO: 403750 - protein, 5 aa, Mycobacterium
REGSE

SEQ ID NO: 403751 - protein, 9 aa, Mycobacterium
REGSEEYLD

SEQ ID NO: 403752 - protein, 10 aa, Mycobacterium
REGSEEYLDS

SEQ ID NO: 403753 - protein, 8 aa, Mycobacterium
REGTDEAT

SEQ ID NO: 403754 - protein, 5 aa, Mycobacterium
REGTS

SEQ ID NO: 403755 - protein, 5 aa, Mycobacterium
REGTT

SEQ ID NO: 403756 - protein, 4 aa, Mycobacterium
REGV

SEQ ID NO: 403757 - protein, 4 aa, Mycobacterium
REHD

SEQ ID NO: 403758 - protein, 4 aa, Mycobacterium
REHG

SEQ ID NO: 403759 - protein, 5 aa, Mycobacterium
REHGE

SEQ ID NO: 403760 - protein, 6 aa, Mycobacterium
REHGGS

SEQ ID NO: 403761 - protein, 5 aa, Mycobacterium
REHNA

SEQ ID NO: 403762 - protein, 4 aa, Mycobacterium
REHR

SEQ ID NO: 403763 - protein, 7 aa, Mycobacterium
REIRDTA

SEQ ID NO: 403764 - protein, 4 aa, Mycobacterium
REKP

SEQ ID NO: 403765 - protein, 4 aa, Mycobacterium
RELG

SEQ ID NO: 403766 - protein, 6 aa, Mycobacterium
RELGGQ

SEQ ID NO: 403767 - protein, 8 aa, Mycobacterium
RENADNKL

SEQ ID NO: 403768 - protein, 4 aa, Mycobacterium
RENP

SEQ ID NO: 403769 - protein, 5 aa, Mycobacterium
REPEL

SEQ ID NO: 403770 - protein, 13 aa, Mycobacterium
REPETTIDRASDE

SEQ ID NO: 403771 - protein, 8 aa, Mycobacterium
REPGAGGL

SEQ ID NO: 403772 - protein, 6 aa, Mycobacterium
REPGGD

SEQ ID NO: 403773 - protein, 5 aa, Mycobacterium
REPQL

SEQ ID NO: 403774 - protein, 13 aa, Mycobacterium
REPRGPWGPGRAV

SEQ ID NO: 403775 - protein, 7 aa, Mycobacterium
REPRPYP

SEQ ID NO: 403776 - protein, 4 aa, Mycobacterium
REPV

SEQ ID NO: 403777 - protein, 4 aa, Mycobacterium
REPY

SEQ ID NO: 403778 - protein, 4 aa, Mycobacterium
REQA

SEQ ID NO: 403779 - protein, 16 aa, Mycobacterium
REQASGFGATHTAASM

SEQ ID NO: 403780 - protein, 6 aa, Mycobacterium
REQFGR

SEQ ID NO: 403781 - protein, 16 aa, Mycobacterium
REQGYDGSWTGDENID

SEQ ID NO: 403782 - protein, 5 aa, Mycobacterium
REQHS

SEQ ID NO: 403783 - protein, 4 aa, Mycobacterium
REQR

SEQ ID NO: 403784 - protein, 10 aa, Mycobacterium
REQYGKQIGS

SEQ ID NO: 403785 - protein, 6 aa, Mycobacterium
RERAER

SEQ ID NO: 403786 - protein, 5 aa, Mycobacterium
RERDR

SEQ ID NO: 403787 - protein, 7 aa, Mycobacterium
RERGVDA

SEQ ID NO: 403788 - protein, 4 aa, Mycobacterium
RERL

SEQ ID NO: 403789 - protein, 31 aa, Mycobacterium
RERRAASRDSRRARQLPATKPAKLTPERQEQ

SEQ ID NO: 403790 - protein, 8 aa, Mycobacterium
RESDERMA

SEQ ID NO: 403791 - protein, 6 aa, Mycobacterium
RESEEV

SEQ ID NO: 403792 - protein, 9 aa, Mycobacterium
RESGGTIGG

SEQ ID NO: 403793 - protein, 5 aa, Mycobacterium
RESGL

SEQ ID NO: 403794 - protein, 6 aa, Mycobacterium
RESGRG

SEQ ID NO: 403795 - protein, 4 aa, Mycobacterium
RESL

SEQ ID NO: 403796 - protein, 5 aa, Mycobacterium
RESYQ

SEQ ID NO: 403797 - protein, 7 aa, Mycobacterium
RETAPTQ

SEQ ID NO: 403798 - protein, 5 aa, Mycobacterium
RETGA

SEQ ID NO: 403799 - protein, 6 aa, Mycobacterium
RETGEC

SEQ ID NO: 403800 - protein, 7 aa, Mycobacterium
RETGPTQ

SEQ ID NO: 403801 - protein, 4 aa, Mycobacterium
RETT

SEQ ID NO: 403802 - protein, 16 aa, Mycobacterium
RETTLDVPTKTSTGYP

SEQ ID NO: 403803 - protein, 9 aa, Mycobacterium
REYGGQELP

SEQ ID NO: 403804 - protein, 6 aa, Mycobacterium
RFAGAP

SEQ ID NO: 403805 - protein, 5 aa, Mycobacterium
RFATS

SEQ ID NO: 403806 - protein, 7 aa, Mycobacterium
RFEGKSS

SEQ ID NO: 403807 - protein, 17 aa, Mycobacterium
RFGKGNSDSWPDTKNPI

SEQ ID NO: 403808 - protein, 10 aa, Mycobacterium
RFGSKEPDKF

SEQ ID NO: 403809 - protein, 6 aa, Mycobacterium
RFPGGS

SEQ ID NO: 403810 - protein, 5 aa, Mycobacterium
RFRSH

SEQ ID NO: 403811 - protein, 4 aa, Mycobacterium
RFTG

SEQ ID NO: 403812 - protein, 4 aa, Mycobacterium
RGAA

SEQ ID NO: 403813 - protein, 5 aa, Mycobacterium
RGAAA

SEQ ID NO: 403814 - protein, 6 aa, Mycobacterium
RGAAGA

SEQ ID NO: 403815 - protein, 14 aa, Mycobacterium
RGAAGAEPNSGDGA

SEQ ID NO: 403816 - protein, 14 aa, Mycobacterium
RGAAGAEPRSGDGA

SEQ ID NO: 403817 - protein, 9 aa, Mycobacterium
RGADPVTEA

SEQ ID NO: 403818 - protein, 8 aa, Mycobacterium
RGAEIGPG

SEQ ID NO: 403819 - protein, 5 aa, Mycobacterium
RGAEP

SEQ ID NO: 403820 - protein, 6 aa, Mycobacterium
RGAGVP

SEQ ID NO: 403821 - protein, 14 aa, Mycobacterium
RGAPTGRLASLVWM

SEQ ID NO: 403822 - protein, 14 aa, Mycobacterium
RGAQGAEPNTGDGA

SEQ ID NO: 403823 - protein, 14 aa, Mycobacterium
RGAQGAEPRSGDGA

SEQ ID NO: 403824 - protein, 14 aa, Mycobacterium
RGARSTTALPARPE

SEQ ID NO: 403825 - protein, 7 aa, Mycobacterium
RGASDAE

SEQ ID NO: 403826 - protein, 7 aa, Mycobacterium
RGASEAE

SEQ ID NO: 403827 - protein, 4 aa, Mycobacterium
RGAT

SEQ ID NO: 403828 - protein, 6 aa, Mycobacterium
RGAYDD

SEQ ID NO: 403829 - protein, 7 aa, Mycobacterium
RGCSHPG

SEQ ID NO: 403830 - protein, 7 aa, Mycobacterium
RGCTRPG

SEQ ID NO: 403831 - protein, 4 aa, Mycobacterium
RGDA

SEQ ID NO: 403832 - protein, 6 aa, Mycobacterium
RGDAGA

SEQ ID NO: 403833 - protein, 7 aa, Mycobacterium
RGDARDV

SEQ ID NO: 403834 - protein, 7 aa, Mycobacterium
RGDARNV

SEQ ID NO: 403835 - protein, 5 aa, Mycobacterium
RGDDF

SEQ ID NO: 403836 - protein, 6 aa, Mycobacterium
RGDDGI

SEQ ID NO: 403837 - protein, 7 aa, Mycobacterium
RGDEALG

SEQ ID NO: 403838 - protein, 5 aa, Mycobacterium
RGDGA

SEQ ID NO: 403839 - protein, 5 aa, Mycobacterium
RGDGE

SEQ ID NO: 403840 - protein, 8 aa, Mycobacterium
RGDGPLAG

SEQ ID NO: 403841 - protein, 9 aa, Mycobacterium
RGDGSTAVD

SEQ ID NO: 403842 - protein, 8 aa, Mycobacterium
RGDGYQPG

SEQ ID NO: 403843 - protein, 6 aa, Mycobacterium
RGDIGG

SEQ ID NO: 403844 - protein, 9 aa, Mycobacterium
RGDPGDRRR

SEQ ID NO: 403845 - protein, 20 aa, Mycobacterium
RGDPSDNLPGIPGVGEKTAT

SEQ ID NO: 403846 - protein, 5 aa, Mycobacterium
RGDRA

SEQ ID NO: 403847 - protein, 4 aa, Mycobacterium
RGDT

SEQ ID NO: 403848 - protein, 10 aa, Mycobacterium
RGEAPPPTYK

SEQ ID NO: 403849 - protein, 9 aa, Mycobacterium
RGEASRRVA

SEQ ID NO: 403850 - protein, 4 aa, Mycobacterium
RGEH

SEQ ID NO: 403851 - protein, 5 aa, Mycobacterium
RGEID

SEQ ID NO: 403852 - protein, 5 aa, Mycobacterium
RGEIT

SEQ ID NO: 403853 - protein, 6 aa, Mycobacterium
RGELPA

SEQ ID NO: 403854 - protein, 7 aa, Mycobacterium
RGELPAK

SEQ ID NO: 403855 - protein, 7 aa, Mycobacterium
RGEPADA

SEQ ID NO: 403856 - protein, 8 aa, Mycobacterium
RGEPGDPV

SEQ ID NO: 403857 - protein, 13 aa, Mycobacterium
RGEQITDTEPDDC

SEQ ID NO: 403858 - protein, 9 aa, Mycobacterium
RGESENLAP

SEQ ID NO: 403859 - protein, 6 aa, Mycobacterium
RGESLK

SEQ ID NO: 403860 - protein, 4 aa, Mycobacterium
RGFG

SEQ ID NO: 403861 - protein, 6 aa, Mycobacterium
RGFSTG

SEQ ID NO: 403862 - protein, 6 aa, Mycobacterium
RGGAGR

SEQ ID NO: 403863 - protein, 7 aa, Mycobacterium
RGGAGRT

SEQ ID NO: 403864 - protein, 9 aa, Mycobacterium
RGGAGSGKT

SEQ ID NO: 403865 - protein, 8 aa, Mycobacterium
RGGDPSAP

SEQ ID NO: 403866 - protein, 10 aa, Mycobacterium
RGGEKISPER

SEQ ID NO: 403867 - protein, 11 aa, Mycobacterium
RGGEKISPERV

SEQ ID NO: 403868 - protein, 5 aa, Mycobacterium
RGGEQ

SEQ ID NO: 403869 - protein, 4 aa, Mycobacterium
RGGF

SEQ ID NO: 403870 - protein, 5 aa, Mycobacterium
RGGGE

SEQ ID NO: 403871 - protein, 7 aa, Mycobacterium
RGGGELG

SEQ ID NO: 403872 - protein, 10 aa, Mycobacterium
RGGGEYGPGW

SEQ ID NO: 403873 - protein, 5 aa, Mycobacterium
RGGGI

SEQ ID NO: 403874 - protein, 14 aa, Mycobacterium
RGGGTTYKLPPGSF

SEQ ID NO: 403875 - protein, 5 aa, Mycobacterium
RGGIA

SEQ ID NO: 403876 - protein, 4 aa, Mycobacterium
RGGL

SEQ ID NO: 403877 - protein, 14 aa, Mycobacterium
RGGQGIALNEDLHA

SEQ ID NO: 403878 - protein, 4 aa, Mycobacterium
RGGR

SEQ ID NO: 403879 - protein, 4 aa, Mycobacterium
RGGS

SEQ ID NO: 403880 - protein, 20 aa, Mycobacterium
RGGSARPSRPRRGNDLETET

SEQ ID NO: 403881 - protein, 5 aa, Mycobacterium
RGGTA

SEQ ID NO: 403882 - protein, 8 aa, Mycobacterium
RGGTPDEV

SEQ ID NO: 403883 - protein, 7 aa, Mycobacterium
RGGTYSH

SEQ ID NO: 403884 - protein, 8 aa, Mycobacterium
RGGWGPSL

SEQ ID NO: 403885 - protein, 5 aa, Mycobacterium
RGGYA

SEQ ID NO: 403886 - protein, 7 aa, Mycobacterium
RGGYDGR

SEQ ID NO: 403887 - protein, 7 aa, Mycobacterium
RGHDRHD

SEQ ID NO: 403888 - protein, 14 aa, Mycobacterium
RGHNEGDDPSMTNP

SEQ ID NO: 403889 - protein, 5 aa, Mycobacterium
RGHTA

SEQ ID NO: 403890 - protein, 4 aa, Mycobacterium
RGIA

SEQ ID NO: 403891 - protein, 6 aa, Mycobacterium
RGIAND

SEQ ID NO: 403892 - protein, 6 aa, Mycobacterium
RGITRE

SEQ ID NO: 403893 - protein, 12 aa, Mycobacterium
RGKARLKSDDHE

SEQ ID NO: 403894 - protein, 7 aa, Mycobacterium
RGKELSA

SEQ ID NO: 403895 - protein, 6 aa, Mycobacterium
RGKKSV

SEQ ID NO: 403896 - protein, 8 aa, Mycobacterium
RGKSGALP

SEQ ID NO: 403897 - protein, 13 aa, Mycobacterium
RGLDGDKKARSVR

SEQ ID NO: 403898 - protein, 8 aa, Mycobacterium
RGLGRPER

SEQ ID NO: 403899 - protein, 5 aa, Mycobacterium
RGLGS

SEQ ID NO: 403900 - protein, 7 aa, Mycobacterium
RGLPSKR

SEQ ID NO: 403901 - protein, 4 aa, Mycobacterium
RGLR

SEQ ID NO: 403902 - protein, 4 aa, Mycobacterium
RGLT

SEQ ID NO: 403903 - protein, 11 aa, Mycobacterium
RGMTSEAAERQ

SEQ ID NO: 403904 - protein, 4 aa, Mycobacterium
RGNC

SEQ ID NO: 403905 - protein, 4 aa, Mycobacterium
RGNT

SEQ ID NO: 403906 - protein, 5 aa, Mycobacterium
RGNTL

SEQ ID NO: 403907 - protein, 7 aa, Mycobacterium
RGPAGHG

SEQ ID NO: 403908 - protein, 5 aa, Mycobacterium
RGPGY

SEQ ID NO: 403909 - protein, 5 aa, Mycobacterium
RGPIV

SEQ ID NO: 403910 - protein, 8 aa, Mycobacterium
RGPLDHDE

SEQ ID NO: 403911 - protein, 5 aa, Mycobacterium
RGPLR

SEQ ID NO: 403912 - protein, 5 aa, Mycobacterium
RGPLS

SEQ ID NO: 403913 - protein, 15 aa, Mycobacterium
RGPRLASREDEDVSA

SEQ ID NO: 403914 - protein, 5 aa, Mycobacterium
RGPRR

SEQ ID NO: 403915 - protein, 6 aa, Mycobacterium
RGPRSA

SEQ ID NO: 403916 - protein, 4 aa, Mycobacterium
RGPS

SEQ ID NO: 403917 - protein, 8 aa, Mycobacterium
RGPSGERE

SEQ ID NO: 403918 - protein, 8 aa, Mycobacterium
RGPSGFIG

SEQ ID NO: 403919 - protein, 9 aa, Mycobacterium
RGQDTIAAT

SEQ ID NO: 403920 - protein, 8 aa, Mycobacterium
RGQEAAQI

SEQ ID NO: 403921 - protein, 7 aa, Mycobacterium
RGQEGPF

SEQ ID NO: 403922 - protein, 7 aa, Mycobacterium
RGQGRSH

SEQ ID NO: 403923 - protein, 7 aa, Mycobacterium
RGQPGVH

SEQ ID NO: 403924 - protein, 4 aa, Mycobacterium
RGQR

SEQ ID NO: 403925 - protein, 7 aa, Mycobacterium
RGQRSLA

SEQ ID NO: 403926 - protein, 6 aa, Mycobacterium
RGQSQS

SEQ ID NO: 403927 - protein, 5 aa, Mycobacterium
RGRAA

SEQ ID NO: 403928 - protein, 6 aa, Mycobacterium
RGRDRT

SEQ ID NO: 403929 - protein, 6 aa, Mycobacterium
RGRGGT

SEQ ID NO: 403930 - protein, 6 aa, Mycobacterium
RGRGPF

SEQ ID NO: 403931 - protein, 9 aa, Mycobacterium
RGRGVPPER

SEQ ID NO: 403932 - protein, 5 aa, Mycobacterium
RGRHA

SEQ ID NO: 403933 - protein, 4 aa, Mycobacterium
RGRI

SEQ ID NO: 403934 - protein, 4 aa, Mycobacterium
RGRK

SEQ ID NO: 403935 - protein, 4 aa, Mycobacterium
RGRL

SEQ ID NO: 403936 - protein, 8 aa, Mycobacterium
RGRNQDEL

SEQ ID NO: 403937 - protein, 4 aa, Mycobacterium
RGRQ

SEQ ID NO: 403938 - protein, 6 aa, Mycobacterium
RGRQTN

SEQ ID NO: 403939 - protein, 4 aa, Mycobacterium
RGRS

SEQ ID NO: 403940 - protein, 5 aa, Mycobacterium
RGRTG

SEQ ID NO: 403941 - protein, 6 aa, Mycobacterium
RGRVAG

SEQ ID NO: 403942 - protein, 10 aa, Mycobacterium
RGRVDNDATV

SEQ ID NO: 403943 - protein, 5 aa, Mycobacterium
RGRVG

SEQ ID NO: 403944 - protein, 6 aa, Mycobacterium
RGRYGG

SEQ ID NO: 403945 - protein, 5 aa, Mycobacterium
RGSEM

SEQ ID NO: 403946 - protein, 8 aa, Mycobacterium
RGSGARSI

SEQ ID NO: 403947 - protein, 9 aa, Mycobacterium
RGSGPRSIA

SEQ ID NO: 403948 - protein, 9 aa, Mycobacterium
RGSPGNTIN

SEQ ID NO: 403949 - protein, 6 aa, Mycobacterium
RGSQFR

SEQ ID NO: 403950 - protein, 6 aa, Mycobacterium
RGSRGV

SEQ ID NO: 403951 - protein, 7 aa, Mycobacterium
RGSTGGQ

SEQ ID NO: 403952 - protein, 7 aa, Mycobacterium
RGSTRGA

SEQ ID NO: 403953 - protein, 6 aa, Mycobacterium
RGTDAG

SEQ ID NO: 403954 - protein, 11 aa, Mycobacterium
RGTDPSKHKQF

SEQ ID NO: 403955 - protein, 7 aa, Mycobacterium
RGTDSLN

SEQ ID NO: 403956 - protein, 4 aa, Mycobacterium
RGTG

SEQ ID NO: 403957 - protein, 4 aa, Mycobacterium
RGTL

SEQ ID NO: 403958 - protein, 5 aa, Mycobacterium
RGTPA

SEQ ID NO: 403959 - protein, 7 aa, Mycobacterium
RGTPLAE

SEQ ID NO: 403960 - protein, 4 aa, Mycobacterium
RGTR

SEQ ID NO: 403961 - protein, 5 aa, Mycobacterium
RGVDT

SEQ ID NO: 403962 - protein, 4 aa, Mycobacterium
RGVE

SEQ ID NO: 403963 - protein, 5 aa, Mycobacterium
RGVGE

SEQ ID NO: 403964 - protein, 9 aa, Mycobacterium
RGVGRPERA

SEQ ID NO: 403965 - protein, 12 aa, Mycobacterium
RGVPKRSGGNGD

SEQ ID NO: 403966 - protein, 12 aa, Mycobacterium
RGVPKRSGGSGD

SEQ ID NO: 403967 - protein, 6 aa, Mycobacterium
RGVPPT

SEQ ID NO: 403968 - protein, 5 aa, Mycobacterium
RGVPR

SEQ ID NO: 403969 - protein, 7 aa, Mycobacterium
RGVSKGE

SEQ ID NO: 403970 - protein, 6 aa, Mycobacterium
RGVTDE

SEQ ID NO: 403971 - protein, 5 aa, Mycobacterium
RGVTP

SEQ ID NO: 403972 - protein, 5 aa, Mycobacterium
RGYAP

SEQ ID NO: 403973 - protein, 8 aa, Mycobacterium
RGYEGTSI

SEQ ID NO: 403974 - protein, 8 aa, Mycobacterium
RGYGYGPA

SEQ ID NO: 403975 - protein, 7 aa, Mycobacterium
RHAENGV

SEQ ID NO: 403976 - protein, 4 aa, Mycobacterium
RHAP

SEQ ID NO: 403977 - protein, 5 aa, Mycobacterium
RHAPD

SEQ ID NO: 403978 - protein, 30 aa, Mycobacterium
RHASRGEPKTGYVKRSDDRSDSQTGEIGGD

SEQ ID NO: 403979 - protein, 10 aa, Mycobacterium
RHDLGNPGGY

SEQ ID NO: 403980 - protein, 8 aa, Mycobacterium
RHDLGSKT

SEQ ID NO: 403981 - protein, 6 aa, Mycobacterium
RHDPSD

SEQ ID NO: 403982 - protein, 5 aa, Mycobacterium
RHGGR

SEQ ID NO: 403983 - protein, 14 aa, Mycobacterium
RHGKGSRRKGPKPR

SEQ ID NO: 403984 - protein, 6 aa, Mycobacterium
RHGRDF

SEQ ID NO: 403985 - protein, 13 aa, Mycobacterium
RHHPGGLGNAGGH

SEQ ID NO: 403986 - protein, 5 aa, Mycobacterium
RHKTP

SEQ ID NO: 403987 - protein, 5 aa, Mycobacterium
RHNTP

SEQ ID NO: 403988 - protein, 6 aa, Mycobacterium
RHPATE

SEQ ID NO: 403989 - protein, 5 aa, Mycobacterium
RHPDE

SEQ ID NO: 403990 - protein, 6 aa, Mycobacterium
RHPGEQ

SEQ ID NO: 403991 - protein, 7 aa, Mycobacterium
RHPGGAT

SEQ ID NO: 403992 - protein, 7 aa, Mycobacterium
RHPGKRS

SEQ ID NO: 403993 - protein, 9 aa, Mycobacterium
RHPQPVPPI

SEQ ID NO: 403994 - protein, 4 aa, Mycobacterium
RHRS

SEQ ID NO: 403995 - protein, 18 aa, Mycobacterium
RHTGKDAATVRKDTDRDK

SEQ ID NO: 403996 - protein, 7 aa, Mycobacterium
RHTGTAP

SEQ ID NO: 403997 - protein, 5 aa, Mycobacterium
RHTPD

SEQ ID NO: 403998 - protein, 15 aa, Mycobacterium
RHTPGGSSGGSAAAV

SEQ ID NO: 403999 - protein, 5 aa, Mycobacterium
RIATA

SEQ ID NO: 404000 - protein, 9 aa, Mycobacterium
RIDDDPDKR

SEQ ID NO: 404001 - protein, 6 aa, Mycobacterium
RIDENR

SEQ ID NO: 404002 - protein, 8 aa, Mycobacterium
RIEDQESL

SEQ ID NO: 404003 - protein, 4 aa, Mycobacterium
RIER

SEQ ID NO: 404004 - protein, 4 aa, Mycobacterium
RIGG

SEQ ID NO: 404005 - protein, 6 aa, Mycobacterium
RIGPGD

SEQ ID NO: 404006 - protein, 5 aa, Mycobacterium
RIGVT

SEQ ID NO: 404007 - protein, 4 aa, Mycobacterium
RIPA

SEQ ID NO: 404008 - protein, 6 aa, Mycobacterium
RIPADG

SEQ ID NO: 404009 - protein, 4 aa, Mycobacterium
RIPD

SEQ ID NO: 404010 - protein, 9 aa, Mycobacterium
RIPDHAPSR

SEQ ID NO: 404011 - protein, 15 aa, Mycobacterium
RIPERQPHAKGGGAF

SEQ ID NO: 404012 - protein, 6 aa, Mycobacterium
RIPPDV

SEQ ID NO: 404013 - protein, 5 aa, Mycobacterium
RIPPG

SEQ ID NO: 404014 - protein, 5 aa, Mycobacterium
RIRAN

SEQ ID NO: 404015 - protein, 4 aa, Mycobacterium
RIRE

SEQ ID NO: 404016 - protein, 10 aa, Mycobacterium
RITPGSGEKR

SEQ ID NO: 404017 - protein, 11 aa, Mycobacterium
RITSTRGRSIT

SEQ ID NO: 404018 - protein, 11 aa, Mycobacterium
RKAESSGRSHR

SEQ ID NO: 404019 - protein, 5 aa, Mycobacterium
RKAMG

SEQ ID NO: 404020 - protein, 27 aa, Mycobacterium
RKAPDNDKIRRRAASESSEKQAQKVRQ

SEQ ID NO: 404021 - protein, 6 aa, Mycobacterium
RKATTK

SEQ ID NO: 404022 - protein, 6 aa, Mycobacterium
RKDDPR

SEQ ID NO: 404023 - protein, 7 aa, Mycobacterium
RKDDPRV

SEQ ID NO: 404024 - protein, 7 aa, Mycobacterium
RKDGVEA

SEQ ID NO: 404025 - protein, 7 aa, Mycobacterium
RKDRPEP

SEQ ID NO: 404026 - protein, 7 aa, Mycobacterium
RKEEDVA

SEQ ID NO: 404027 - protein, 7 aa, Mycobacterium
RKEGAEE

SEQ ID NO: 404028 - protein, 8 aa, Mycobacterium
RKEGAEER

SEQ ID NO: 404029 - protein, 8 aa, Mycobacterium
RKEGRALG

SEQ ID NO: 404030 - protein, 8 aa, Mycobacterium
RKGDADAF

SEQ ID NO: 404031 - protein, 8 aa, Mycobacterium
RKGEAPLR

SEQ ID NO: 404032 - protein, 16 aa, Mycobacterium
RKGGKRRIHQKPGRTE

SEQ ID NO: 404033 - protein, 4 aa, Mycobacterium
RKGL

SEQ ID NO: 404034 - protein, 8 aa, Mycobacterium
RKGPGRPP

SEQ ID NO: 404035 - protein, 8 aa, Mycobacterium
RKGSGQGW

SEQ ID NO: 404036 - protein, 4 aa, Mycobacterium
RKGW

SEQ ID NO: 404037 - protein, 10 aa, Mycobacterium
RKHAAKNPKA

SEQ ID NO: 404038 - protein, 14 aa, Mycobacterium
RKKQRQPAEYPTEE

SEQ ID NO: 404039 - protein, 6 aa, Mycobacterium
RKLGGD

SEQ ID NO: 404040 - protein, 10 aa, Mycobacterium
RKMSKSKGNV

SEQ ID NO: 404041 - protein, 8 aa, Mycobacterium
RKNAHGDT

SEQ ID NO: 404042 - protein, 7 aa, Mycobacterium
RKNIDTG

SEQ ID NO: 404043 - protein, 6 aa, Mycobacterium
RKNNGA

SEQ ID NO: 404044 - protein, 13 aa, Mycobacterium
RKPANLSGGQRQR

SEQ ID NO: 404045 - protein, 6 aa, Mycobacterium
RKPEIA

SEQ ID NO: 404046 - protein, 6 aa, Mycobacterium
RKPGPL

SEQ ID NO: 404047 - protein, 13 aa, Mycobacterium
RKPGQLSGGQRQR

SEQ ID NO: 404048 - protein, 13 aa, Mycobacterium
RKPKDLSGGQQQR

SEQ ID NO: 404049 - protein, 7 aa, Mycobacterium
RKPNPHL

SEQ ID NO: 404050 - protein, 44 aa, Mycobacterium
RKPNSSRGQTQPAPKRTAREKTLAKQAARAAAGKVARKPVKRGK

SEQ ID NO: 404051 - protein, 13 aa, Mycobacterium
RKPSKLSGGQRQR

SEQ ID NO: 404052 - protein, 5 aa, Mycobacterium
RKPSL

SEQ ID NO: 404053 - protein, 9 aa, Mycobacterium
RKPTRSPNQ

SEQ ID NO: 404054 - protein, 6 aa, Mycobacterium
RKQMQA

SEQ ID NO: 404055 - protein, 9 aa, Mycobacterium
RKRDADGAL

SEQ ID NO: 404056 - protein, 14 aa, Mycobacterium
RKRGKNGKPGPPVH

SEQ ID NO: 404057 - protein, 4 aa, Mycobacterium
RKRP

SEQ ID NO: 404058 - protein, 7 aa, Mycobacterium
RKSGALP

SEQ ID NO: 404059 - protein, 6 aa, Mycobacterium
RKSHPL

SEQ ID NO: 404060 - protein, 4 aa, Mycobacterium
RKSR

SEQ ID NO: 404061 - protein, 5 aa, Mycobacterium
RKSRT

SEQ ID NO: 404062 - protein, 8 aa, Mycobacterium
RKSTGLDV

SEQ ID NO: 404063 - protein, 8 aa, Mycobacterium
RKSTGLEV

SEQ ID NO: 404064 - protein, 9 aa, Mycobacterium
RKTLNDDTA

SEQ ID NO: 404065 - protein, 8 aa, Mycobacterium
RKTPPKGA

SEQ ID NO: 404066 - protein, 4 aa, Mycobacterium
RKTT

SEQ ID NO: 404067 - protein, 5 aa, Mycobacterium
RLAAG

SEQ ID NO: 404068 - protein, 8 aa, Mycobacterium
RLADSTGA

SEQ ID NO: 404069 - protein, 5 aa, Mycobacterium
RLAPG

SEQ ID NO: 404070 - protein, 16 aa, Mycobacterium
RLASEKNGLMICTDCA

SEQ ID NO: 404071 - protein, 16 aa, Mycobacterium
RLASEKNGVMICTDCA

SEQ ID NO: 404072 - protein, 5 aa, Mycobacterium
RLDNG

SEQ ID NO: 404073 - protein, 9 aa, Mycobacterium
RLEDGSDLD

SEQ ID NO: 404074 - protein, 5 aa, Mycobacterium
RLEPG

SEQ ID NO: 404075 - protein, 4 aa, Mycobacterium
RLGG

SEQ ID NO: 404076 - protein, 4 aa, Mycobacterium
RLGL

SEQ ID NO: 404077 - protein, 5 aa, Mycobacterium
RLGPG

SEQ ID NO: 404078 - protein, 11 aa, Mycobacterium
RLGRATQALPN

SEQ ID NO: 404079 - protein, 5 aa, Mycobacterium
RLKEN

SEQ ID NO: 404080 - protein, 6 aa, Mycobacterium
RLKENE

SEQ ID NO: 404081 - protein, 8 aa, Mycobacterium
RLNGAKNP

SEQ ID NO: 404082 - protein, 7 aa, Mycobacterium
RLNNPDF

SEQ ID NO: 404083 - protein, 4 aa, Mycobacterium
RLPA

SEQ ID NO: 404084 - protein, 6 aa, Mycobacterium
RLPAGN

SEQ ID NO: 404085 - protein, 4 aa, Mycobacterium
RLPG

SEQ ID NO: 404086 - protein, 6 aa, Mycobacterium
RLPNTG

SEQ ID NO: 404087 - protein, 7 aa, Mycobacterium
RLPRTGS

SEQ ID NO: 404088 - protein, 5 aa, Mycobacterium
RLPTE

SEQ ID NO: 404089 - protein, 8 aa, Mycobacterium
RLPTEDEV

SEQ ID NO: 404090 - protein, 5 aa, Mycobacterium
RLQEN

SEQ ID NO: 404091 - protein, 13 aa, Mycobacterium
RLQPDNQGDIQGV

SEQ ID NO: 404092 - protein, 12 aa, Mycobacterium
RLRDNRNGMTIP

SEQ ID NO: 404093 - protein, 10 aa, Mycobacterium
RLRKEGSKQY

SEQ ID NO: 404094 - protein, 5 aa, Mycobacterium
RLSGE

SEQ ID NO: 404095 - protein, 10 aa, Mycobacterium
RLSSDNAQQE

SEQ ID NO: 404096 - protein, 5 aa, Mycobacterium
RLTPK

SEQ ID NO: 404097 - protein, 4 aa, Mycobacterium
RLTS

SEQ ID NO: 404098 - protein, 6 aa, Mycobacterium
RMAPPD

SEQ ID NO: 404099 - protein, 7 aa, Mycobacterium
RMASGGT

SEQ ID NO: 404100 - protein, 5 aa, Mycobacterium
RMGSK

SEQ ID NO: 404101 - protein, 6 aa, Mycobacterium
RMGSRS

SEQ ID NO: 404102 - protein, 5 aa, Mycobacterium
RMKAG

SEQ ID NO: 404103 - protein, 7 aa, Mycobacterium
RMPAGPA

SEQ ID NO: 404104 - protein, 9 aa, Mycobacterium
RMPGDTTAV

SEQ ID NO: 404105 - protein, 4 aa, Mycobacterium
RMPS

SEQ ID NO: 404106 - protein, 7 aa, Mycobacterium
RMTGGGF

SEQ ID NO: 404107 - protein, 8 aa, Mycobacterium
RNAAPTVK

SEQ ID NO: 404108 - protein, 9 aa, Mycobacterium
RNADNSIGA

SEQ ID NO: 404109 - protein, 8 aa, Mycobacterium
RNAENSIG

SEQ ID NO: 404110 - protein, 8 aa, Mycobacterium
RNAGRREK

SEQ ID NO: 404111 - protein, 6 aa, Mycobacterium
RNAPET

SEQ ID NO: 404112 - protein, 9 aa, Mycobacterium
RNAQTNARL

SEQ ID NO: 404113 - protein, 12 aa, Mycobacterium
RNATSGPGGTAA

SEQ ID NO: 404114 - protein, 6 aa, Mycobacterium
RNDDTV

SEQ ID NO: 404115 - protein, 7 aa, Mycobacterium
RNDPAFS

SEQ ID NO: 404116 - protein, 5 aa, Mycobacterium
RNEAG

SEQ ID NO: 404117 - protein, 8 aa, Mycobacterium
RNEDPGCP

SEQ ID NO: 404118 - protein, 5 aa, Mycobacterium
RNEET

SEQ ID NO: 404119 - protein, 6 aa, Mycobacterium
RNEETR

SEQ ID NO: 404120 - protein, 4 aa, Mycobacterium
RNEG

SEQ ID NO: 404121 - protein, 8 aa, Mycobacterium
RNEPDLDD

SEQ ID NO: 404122 - protein, 6 aa, Mycobacterium
RNERTD

SEQ ID NO: 404123 - protein, 9 aa, Mycobacterium
RNESMDPAR

SEQ ID NO: 404124 - protein, 8 aa, Mycobacterium
RNGDGKSS

SEQ ID NO: 404125 - protein, 13 aa, Mycobacterium
RNGERADRLRSYA

SEQ ID NO: 404126 - protein, 7 aa, Mycobacterium
RNGESPV

SEQ ID NO: 404127 - protein, 9 aa, Mycobacterium
RNGGEACTA

SEQ ID NO: 404128 - protein, 6 aa, Mycobacterium
RNGGGA

SEQ ID NO: 404129 - protein, 11 aa, Mycobacterium
RNGGNMADPGS

SEQ ID NO: 404130 - protein, 4 aa, Mycobacterium
RNGH

SEQ ID NO: 404131 - protein, 8 aa, Mycobacterium
RNGNAGPT

SEQ ID NO: 404132 - protein, 8 aa, Mycobacterium
RNGPPYSP

SEQ ID NO: 404133 - protein, 8 aa, Mycobacterium
RNGQEPVT

SEQ ID NO: 404134 - protein, 4 aa, Mycobacterium
RNGR

SEQ ID NO: 404135 - protein, 8 aa, Mycobacterium
RNGRGNRL

SEQ ID NO: 404136 - protein, 5 aa, Mycobacterium
RNGSY

SEQ ID NO: 404137 - protein, 11 aa, Mycobacterium
RNGVGDALTTE

SEQ ID NO: 404138 - protein, 7 aa, Mycobacterium
RNKARSV

SEQ ID NO: 404139 - protein, 8 aa, Mycobacterium
RNKDYSQQ

SEQ ID NO: 404140 - protein, 7 aa, Mycobacterium
RNKPNDI

SEQ ID NO: 404141 - protein, 4 aa, Mycobacterium
RNKS

SEQ ID NO: 404142 - protein, 7 aa, Mycobacterium
RNLGGAG

SEQ ID NO: 404143 - protein, 7 aa, Mycobacterium
RNNGPEL

SEQ ID NO: 404144 - protein, 7 aa, Mycobacterium
RNNGPQL

SEQ ID NO: 404145 - protein, 20 aa, Mycobacterium
RNNPSQPQTTTWQTQGGREV

SEQ ID NO: 404146 - protein, 4 aa, Mycobacterium
RNPE

SEQ ID NO: 404147 - protein, 8 aa, Mycobacterium
RNPESQAQ

SEQ ID NO: 404148 - protein, 7 aa, Mycobacterium
RNPGKAA

SEQ ID NO: 404149 - protein, 5 aa, Mycobacterium
RNPGQ

SEQ ID NO: 404150 - protein, 14 aa, Mycobacterium
RNPNRHRAFGGGPH

SEQ ID NO: 404151 - protein, 8 aa, Mycobacterium
RNRARDRL

SEQ ID NO: 404152 - protein, 5 aa, Mycobacterium
RNRAV

SEQ ID NO: 404153 - protein, 5 aa, Mycobacterium
RNRPL

SEQ ID NO: 404154 - protein, 7 aa, Mycobacterium
RNRPTDT

SEQ ID NO: 404155 - protein, 7 aa, Mycobacterium
RNRRERA

SEQ ID NO: 404156 - protein, 6 aa, Mycobacterium
RNSPDQ

SEQ ID NO: 404157 - protein, 4 aa, Mycobacterium
RNTV

SEQ ID NO: 404158 - protein, 13 aa, Mycobacterium
RPAEHGPDDPGGV

SEQ ID NO: 404159 - protein, 13 aa, Mycobacterium
RPAEHGPQDPGGV

SEQ ID NO: 404160 - protein, 8 aa, Mycobacterium
RPAESREV

SEQ ID NO: 404161 - protein, 4 aa, Mycobacterium
RPAG

SEQ ID NO: 404162 - protein, 5 aa, Mycobacterium
RPAGT

SEQ ID NO: 404163 - protein, 4 aa, Mycobacterium
RPAH

SEQ ID NO: 404164 - protein, 4 aa, Mycobacterium
RPAN

SEQ ID NO: 404165 - protein, 4 aa, Mycobacterium
RPAP

SEQ ID NO: 404166 - protein, 6 aa, Mycobacterium
RPAPDT

SEQ ID NO: 404167 - protein, 7 aa, Mycobacterium
RPAPDTM

SEQ ID NO: 404168 - protein, 5 aa, Mycobacterium
RPARS

SEQ ID NO: 404169 - protein, 6 aa, Mycobacterium
RPARTA

SEQ ID NO: 404170 - protein, 4 aa, Mycobacterium
RPAS

SEQ ID NO: 404171 - protein, 4 aa, Mycobacterium
RPAT

SEQ ID NO: 404172 - protein, 5 aa, Mycobacterium
RPCQS

SEQ ID NO: 404173 - protein, 6 aa, Mycobacterium
RPDAAP

SEQ ID NO: 404174 - protein, 5 aa, Mycobacterium
RPDAQ

SEQ ID NO: 404175 - protein, 8 aa, Mycobacterium
RPDARNAL

SEQ ID NO: 404176 - protein, 9 aa, Mycobacterium
RPDATAEAF

SEQ ID NO: 404177 - protein, 6 aa, Mycobacterium
RPDDDE

SEQ ID NO: 404178 - protein, 8 aa, Mycobacterium
RPDERAHR

SEQ ID NO: 404179 - protein, 5 aa, Mycobacterium
RPDEV

SEQ ID NO: 404180 - protein, 9 aa, Mycobacterium
RPDGKTQVT

SEQ ID NO: 404181 - protein, 9 aa, Mycobacterium
RPDGLGSNH

SEQ ID NO: 404182 - protein, 5 aa, Mycobacterium
RPDGT

SEQ ID NO: 404183 - protein, 5 aa, Mycobacterium
RPDKL

SEQ ID NO: 404184 - protein, 4 aa, Mycobacterium
RPDP

SEQ ID NO: 404185 - protein, 5 aa, Mycobacterium
RPDPA

SEQ ID NO: 404186 - protein, 5 aa, Mycobacterium
RPDRT

SEQ ID NO: 404187 - protein, 4 aa, Mycobacterium
RPDT

SEQ ID NO: 404188 - protein, 12 aa, Mycobacterium
RPEAANAQNPEL

SEQ ID NO: 404189 - protein, 8 aa, Mycobacterium
RPEARNAL

SEQ ID NO: 404190 - protein, 7 aa, Mycobacterium
RPEEVAA

SEQ ID NO: 404191 - protein, 13 aa, Mycobacterium
RPEGNANPEIATG

SEQ ID NO: 404192 - protein, 8 aa, Mycobacterium
RPELATDD

SEQ ID NO: 404193 - protein, 6 aa, Mycobacterium
RPERFA

SEQ ID NO: 404194 - protein, 5 aa, Mycobacterium
RPETE

SEQ ID NO: 404195 - protein, 4 aa, Mycobacterium
RPEV

SEQ ID NO: 404196 - protein, 8 aa, Mycobacterium
RPFTPPPS

SEQ ID NO: 404197 - protein, 7 aa, Mycobacterium
RPGAQED

SEQ ID NO: 404198 - protein, 9 aa, Mycobacterium
RPGDANETA

SEQ ID NO: 404199 - protein, 9 aa, Mycobacterium
RPGDLGPGD

SEQ ID NO: 404200 - protein, 10 aa, Mycobacterium
RPGDPNETAY

SEQ ID NO: 404201 - protein, 7 aa, Mycobacterium
RPGEKAP

SEQ ID NO: 404202 - protein, 17 aa, Mycobacterium
RPGEPSWPSPFGDGRPG

SEQ ID NO: 404203 - protein, 5 aa, Mycobacterium
RPGET

SEQ ID NO: 404204 - protein, 12 aa, Mycobacterium
RPGIGSSTPHRY

SEQ ID NO: 404205 - protein, 5 aa, Mycobacterium
RPGPR

SEQ ID NO: 404206 - protein, 5 aa, Mycobacterium
RPGQI

SEQ ID NO: 404207 - protein, 7 aa, Mycobacterium
RPGRFGG

SEQ ID NO: 404208 - protein, 8 aa, Mycobacterium
RPGRTITE

SEQ ID NO: 404209 - protein, 4 aa, Mycobacterium
RPGS

SEQ ID NO: 404210 - protein, 7 aa, Mycobacterium
RPGTDGA

SEQ ID NO: 404211 - protein, 13 aa, Mycobacterium
RPGTPASHRGKGW

SEQ ID NO: 404212 - protein, 7 aa, Mycobacterium
RPGTQQR

SEQ ID NO: 404213 - protein, 6 aa, Mycobacterium
RPGTRY

SEQ ID NO: 404214 - protein, 7 aa, Mycobacterium
RPGTRYD

SEQ ID NO: 404215 - protein, 6 aa, Mycobacterium
RPGTTV

SEQ ID NO: 404216 - protein, 5 aa, Mycobacterium
RPGVT

SEQ ID NO: 404217 - protein, 4 aa, Mycobacterium
RPGY

SEQ ID NO: 404218 - protein, 5 aa, Mycobacterium
RPGYE

SEQ ID NO: 404219 - protein, 6 aa, Mycobacterium
RPHPGQ

SEQ ID NO: 404220 - protein, 8 aa, Mycobacterium
RPHPSYNP

SEQ ID NO: 404221 - protein, 5 aa, Mycobacterium
RPIED

SEQ ID NO: 404222 - protein, 4 aa, Mycobacterium
RPIT

SEQ ID NO: 404223 - protein, 4 aa, Mycobacterium
RPKA

SEQ ID NO: 404224 - protein, 4 aa, Mycobacterium
RPKT

SEQ ID NO: 404225 - protein, 7 aa, Mycobacterium
RPLDKSR

SEQ ID NO: 404226 - protein, 7 aa, Mycobacterium
RPLEERQ

SEQ ID NO: 404227 - protein, 8 aa, Mycobacterium
RPLGYDDS

SEQ ID NO: 404228 - protein, 5 aa, Mycobacterium
RPLPR

SEQ ID NO: 404229 - protein, 6 aa, Mycobacterium
RPLSAT

SEQ ID NO: 404230 - protein, 14 aa, Mycobacterium
RPLSESSQNDEVAN

SEQ ID NO: 404231 - protein, 4 aa, Mycobacterium
RPLT

SEQ ID NO: 404232 - protein, 8 aa, Mycobacterium
RPMPEPGL

SEQ ID NO: 404233 - protein, 6 aa, Mycobacterium
RPMTPD

SEQ ID NO: 404234 - protein, 4 aa, Mycobacterium
RPND

SEQ ID NO: 404235 - protein, 10 aa, Mycobacterium
RPNDERRNRS

SEQ ID NO: 404236 - protein, 5 aa, Mycobacterium
RPNTG

SEQ ID NO: 404237 - protein, 5 aa, Mycobacterium
RPPAP

SEQ ID NO: 404238 - protein, 5 aa, Mycobacterium
RPPDV

SEQ ID NO: 404239 - protein, 5 aa, Mycobacterium
RPPEL

SEQ ID NO: 404240 - protein, 6 aa, Mycobacterium
RPPERF

SEQ ID NO: 404241 - protein, 13 aa, Mycobacterium
RPPETRADSTPWP

SEQ ID NO: 404242 - protein, 4 aa, Mycobacterium
RPPF

SEQ ID NO: 404243 - protein, 9 aa, Mycobacterium
RPPGQTKPL

SEQ ID NO: 404244 - protein, 8 aa, Mycobacterium
RPPGREAF

SEQ ID NO: 404245 - protein, 5 aa, Mycobacterium
RPPHV

SEQ ID NO: 404246 - protein, 4 aa, Mycobacterium
RPPM

SEQ ID NO: 404247 - protein, 5 aa, Mycobacterium
RPPQR

SEQ ID NO: 404248 - protein, 6 aa, Mycobacterium
RPPRRG

SEQ ID NO: 404249 - protein, 4 aa, Mycobacterium
RPPY

SEQ ID NO: 404250 - protein, 4 aa, Mycobacterium
RPQA

SEQ ID NO: 404251 - protein, 13 aa, Mycobacterium
RPQAELDESSRAA

SEQ ID NO: 404252 - protein, 14 aa, Mycobacterium
RPQAELDESSRAAA

SEQ ID NO: 404253 - protein, 6 aa, Mycobacterium
RPQDGA

SEQ ID NO: 404254 - protein, 14 aa, Mycobacterium
RPQEELDESSRAAA

SEQ ID NO: 404255 - protein, 6 aa, Mycobacterium
RPRAPL

SEQ ID NO: 404256 - protein, 5 aa, Mycobacterium
RPRDE

SEQ ID NO: 404257 - protein, 6 aa, Mycobacterium
RPRDRG

SEQ ID NO: 404258 - protein, 4 aa, Mycobacterium
RPRG

SEQ ID NO: 404259 - protein, 9 aa, Mycobacterium
RPRGPGMER

SEQ ID NO: 404260 - protein, 7 aa, Mycobacterium
RPRPIPA

SEQ ID NO: 404261 - protein, 4 aa, Mycobacterium
RPRR

SEQ ID NO: 404262 - protein, 8 aa, Mycobacterium
RPRRNADA

SEQ ID NO: 404263 - protein, 8 aa, Mycobacterium
RPRSGKVD

SEQ ID NO: 404264 - protein, 9 aa, Mycobacterium
RPRSSDDVG

SEQ ID NO: 404265 - protein, 7 aa, Mycobacterium
RPRTQSS

SEQ ID NO: 404266 - protein, 4 aa, Mycobacterium
RPRW

SEQ ID NO: 404267 - protein, 5 aa, Mycobacterium
RPSHV

SEQ ID NO: 404268 - protein, 5 aa, Mycobacterium
RPSLR

SEQ ID NO: 404269 - protein, 4 aa, Mycobacterium
RPSM

SEQ ID NO: 404270 - protein, 12 aa, Mycobacterium
RPSNPASHRGKG

SEQ ID NO: 404271 - protein, 13 aa, Mycobacterium
RPSNPASHRGKGW

SEQ ID NO: 404272 - protein, 8 aa, Mycobacterium
RPSPGSVY

SEQ ID NO: 404273 - protein, 18 aa, Mycobacterium
RPSPTSGTLGGVAKATRE

SEQ ID NO: 404274 - protein, 6 aa, Mycobacterium
RPSRED

SEQ ID NO: 404275 - protein, 5 aa, Mycobacterium
RPSRG

SEQ ID NO: 404276 - protein, 4 aa, Mycobacterium
RPTA

SEQ ID NO: 404277 - protein, 5 aa, Mycobacterium
RPTAW

SEQ ID NO: 404278 - protein, 4 aa, Mycobacterium
RPTD

SEQ ID NO: 404279 - protein, 4 aa, Mycobacterium
RPTG

SEQ ID NO: 404280 - protein, 4 aa, Mycobacterium
RPTP

SEQ ID NO: 404281 - protein, 8 aa, Mycobacterium
RPTRASAP

SEQ ID NO: 404282 - protein, 6 aa, Mycobacterium
RPTSRG

SEQ ID NO: 404283 - protein, 27 aa, Mycobacterium
RPTSTASTWRTRSRRDRSPTSSTTSCR

SEQ ID NO: 404284 - protein, 4 aa, Mycobacterium
RPTT

SEQ ID NO: 404285 - protein, 4 aa, Mycobacterium
RPVP

SEQ ID NO: 404286 - protein, 21 aa, Mycobacterium
RPWPTSELRSTSGPVLNQGPH

SEQ ID NO: 404287 - protein, 8 aa, Mycobacterium
RPYGERGA

SEQ ID NO: 404288 - protein, 4 aa, Mycobacterium
RQAA

SEQ ID NO: 404289 - protein, 8 aa, Mycobacterium
RQAARPDA

SEQ ID NO: 404290 - protein, 22 aa, Mycobacterium
RQADKPAQRAVSRKPVSRRSGS

SEQ ID NO: 404291 - protein, 5 aa, Mycobacterium
RQAEA

SEQ ID NO: 404292 - protein, 5 aa, Mycobacterium
RQAET

SEQ ID NO: 404293 - protein, 7 aa, Mycobacterium
RQATGRP

SEQ ID NO: 404294 - protein, 8 aa, Mycobacterium
RQATGSAA

SEQ ID NO: 404295 - protein, 5 aa, Mycobacterium
RQDEE

SEQ ID NO: 404296 - protein, 7 aa, Mycobacterium
RQDEIGT

SEQ ID NO: 404297 - protein, 4 aa, Mycobacterium
RQDR

SEQ ID NO: 404298 - protein, 4 aa, Mycobacterium
RQEP

SEQ ID NO: 404299 - protein, 6 aa, Mycobacterium
RQEPGL

SEQ ID NO: 404300 - protein, 5 aa, Mycobacterium
RQEPR

SEQ ID NO: 404301 - protein, 8 aa, Mycobacterium
RQESQTGG

SEQ ID NO: 404302 - protein, 9 aa, Mycobacterium
RQGMAAGSP

SEQ ID NO: 404303 - protein, 6 aa, Mycobacterium
RQGNQF

SEQ ID NO: 404304 - protein, 7 aa, Mycobacterium
RQGPAGG

SEQ ID NO: 404305 - protein, 5 aa, Mycobacterium
RQGSA

SEQ ID NO: 404306 - protein, 5 aa, Mycobacterium
RQGSG

SEQ ID NO: 404307 - protein, 4 aa, Mycobacterium
RQGT

SEQ ID NO: 404308 - protein, 5 aa, Mycobacterium
RQGTD

SEQ ID NO: 404309 - protein, 5 aa, Mycobacterium
RQHRD

SEQ ID NO: 404310 - protein, 6 aa, Mycobacterium
RQHSER

SEQ ID NO: 404311 - protein, 13 aa, Mycobacterium
RQISEAAGQGNNA

SEQ ID NO: 404312 - protein, 6 aa, Mycobacterium
RQLPEN

SEQ ID NO: 404313 - protein, 4 aa, Mycobacterium
RQLS

SEQ ID NO: 404314 - protein, 7 aa, Mycobacterium
RQMSGGG

SEQ ID NO: 404315 - protein, 6 aa, Mycobacterium
RQPGEL

SEQ ID NO: 404316 - protein, 4 aa, Mycobacterium
RQPV

SEQ ID NO: 404317 - protein, 5 aa, Mycobacterium
RQPVG

SEQ ID NO: 404318 - protein, 4 aa, Mycobacterium
RQQP

SEQ ID NO: 404319 - protein, 5 aa, Mycobacterium
RQRDK

SEQ ID NO: 404320 - protein, 5 aa, Mycobacterium
RQRED

SEQ ID NO: 404321 - protein, 7 aa, Mycobacterium
RQRNGKA

SEQ ID NO: 404322 - protein, 4 aa, Mycobacterium
RQRQ

SEQ ID NO: 404323 - protein, 6 aa, Mycobacterium
RQRREK

SEQ ID NO: 404324 - protein, 10 aa, Mycobacterium
RQRTAERDEL

SEQ ID NO: 404325 - protein, 7 aa, Mycobacterium
RQRTYTE

SEQ ID NO: 404326 - protein, 17 aa, Mycobacterium
RQSGEPAIKGSAVVQVA

SEQ ID NO: 404327 - protein, 7 aa, Mycobacterium
RQSLDSA

SEQ ID NO: 404328 - protein, 5 aa, Mycobacterium
RQSRR

SEQ ID NO: 404329 - protein, 4 aa, Mycobacterium
RQST

SEQ ID NO: 404330 - protein, 14 aa, Mycobacterium
RQTGSLGGGSSEMA

SEQ ID NO: 404331 - protein, 5 aa, Mycobacterium
RQTHE

SEQ ID NO: 404332 - protein, 6 aa, Mycobacterium
RQVSAP

SEQ ID NO: 404333 - protein, 7 aa, Mycobacterium
RRAADAG

SEQ ID NO: 404334 - protein, 5 aa, Mycobacterium
RRADA

SEQ ID NO: 404335 - protein, 6 aa, Mycobacterium
RRADKA

SEQ ID NO: 404336 - protein, 4 aa, Mycobacterium
RRAE

SEQ ID NO: 404337 - protein, 8 aa, Mycobacterium
RRAEREPV

SEQ ID NO: 404338 - protein, 10 aa, Mycobacterium
RRAGHDVGRD

SEQ ID NO: 404339 - protein, 8 aa, Mycobacterium
RRAGLEPP

SEQ ID NO: 404340 - protein, 9 aa, Mycobacterium
RRAGSLTSD

SEQ ID NO: 404341 - protein, 8 aa, Mycobacterium
RRAGVSRT

SEQ ID NO: 404342 - protein, 10 aa, Mycobacterium
RRAGYDVGRD

SEQ ID NO: 404343 - protein, 16 aa, Mycobacterium
RRAGYKPARREGTREG

SEQ ID NO: 404344 - protein, 8 aa, Mycobacterium
RRALGTTR

SEQ ID NO: 404345 - protein, 10 aa, Mycobacterium
RRAQGLPATG

SEQ ID NO: 404346 - protein, 4 aa, Mycobacterium
RRAR

SEQ ID NO: 404347 - protein, 12 aa, Mycobacterium
RRARRPKTAKLV

SEQ ID NO: 404348 - protein, 6 aa, Mycobacterium
RRARTS

SEQ ID NO: 404349 - protein, 14 aa, Mycobacterium
RRASKASRSNPDAR

SEQ ID NO: 404350 - protein, 10 aa, Mycobacterium
RRASQRDRDA

SEQ ID NO: 404351 - protein, 8 aa, Mycobacterium
RRATEGAV

SEQ ID NO: 404352 - protein, 8 aa, Mycobacterium
RRATRVDE

SEQ ID NO: 404353 - protein, 5 aa, Mycobacterium
RRDAD

SEQ ID NO: 404354 - protein, 6 aa, Mycobacterium
RRDAEL

SEQ ID NO: 404355 - protein, 6 aa, Mycobacterium
RRDAVG

SEQ ID NO: 404356 - protein, 4 aa, Mycobacterium
RRDE

SEQ ID NO: 404357 - protein, 7 aa, Mycobacterium
RRDEARK

SEQ ID NO: 404358 - protein, 6 aa, Mycobacterium
RRDGLD

SEQ ID NO: 404359 - protein, 7 aa, Mycobacterium
RRDHPDE

SEQ ID NO: 404360 - protein, 17 aa, Mycobacterium
RRDHPDRPLRPIPPGRD

SEQ ID NO: 404361 - protein, 4 aa, Mycobacterium
RRDK

SEQ ID NO: 404362 - protein, 6 aa, Mycobacterium
RRDKIA

SEQ ID NO: 404363 - protein, 19 aa, Mycobacterium
RRDKPDPSTYIGSGKAAEL

SEQ ID NO: 404364 - protein, 5 aa, Mycobacterium
RRDPD

SEQ ID NO: 404365 - protein, 8 aa, Mycobacterium
RRDPEAAR

SEQ ID NO: 404366 - protein, 7 aa, Mycobacterium
RRDPTDV

SEQ ID NO: 404367 - protein, 4 aa, Mycobacterium
RRDR

SEQ ID NO: 404368 - protein, 7 aa, Mycobacterium
RRDTDGY

SEQ ID NO: 404369 - protein, 5 aa, Mycobacterium
RREGK

SEQ ID NO: 404370 - protein, 9 aa, Mycobacterium
RREGVGKES

SEQ ID NO: 404371 - protein, 4 aa, Mycobacterium
RREL

SEQ ID NO: 404372 - protein, 6 aa, Mycobacterium
RRELDG

SEQ ID NO: 404373 - protein, 10 aa, Mycobacterium
RREPAPRPVR

SEQ ID NO: 404374 - protein, 6 aa, Mycobacterium
RRFNGS

SEQ ID NO: 404375 - protein, 7 aa, Mycobacterium
RRFSDEE

SEQ ID NO: 404376 - protein, 12 aa, Mycobacterium
RRFTPTPNTIPG

SEQ ID NO: 404377 - protein, 6 aa, Mycobacterium
RRGEGL

SEQ ID NO: 404378 - protein, 5 aa, Mycobacterium
RRGEL

SEQ ID NO: 404379 - protein, 5 aa, Mycobacterium
RRGGD

SEQ ID NO: 404380 - protein, 6 aa, Mycobacterium
RRGGNT

SEQ ID NO: 404381 - protein, 5 aa, Mycobacterium
RRGGR

SEQ ID NO: 404382 - protein, 5 aa, Mycobacterium
RRGGT

SEQ ID NO: 404383 - protein, 5 aa, Mycobacterium
RRGGV

SEQ ID NO: 404384 - protein, 5 aa, Mycobacterium
RRGLD

SEQ ID NO: 404385 - protein, 5 aa, Mycobacterium
RRGMT

SEQ ID NO: 404386 - protein, 4 aa, Mycobacterium
RRGN

SEQ ID NO: 404387 - protein, 8 aa, Mycobacterium
RRGPAQSA

SEQ ID NO: 404388 - protein, 6 aa, Mycobacterium
RRGPGG

SEQ ID NO: 404389 - protein, 4 aa, Mycobacterium
RRGR

SEQ ID NO: 404390 - protein, 6 aa, Mycobacterium
RRGRGD

SEQ ID NO: 404391 - protein, 9 aa, Mycobacterium
RRGRPEEQA

SEQ ID NO: 404392 - protein, 7 aa, Mycobacterium
RRGSGYG

SEQ ID NO: 404393 - protein, 8 aa, Mycobacterium
RRGWGEGG

SEQ ID NO: 404394 - protein, 9 aa, Mycobacterium
RRGWGSGGA

SEQ ID NO: 404395 - protein, 18 aa, Mycobacterium
RRIAEETAKAEGKPEQAL

SEQ ID NO: 404396 - protein, 8 aa, Mycobacterium
RRKEPRDD

SEQ ID NO: 404397 - protein, 4 aa, Mycobacterium
RRKP

SEQ ID NO: 404398 - protein, 10 aa, Mycobacterium
RRKRMSKKKH

SEQ ID NO: 404399 - protein, 9 aa, Mycobacterium
RRKSGNYTV

SEQ ID NO: 404400 - protein, 8 aa, Mycobacterium
RRKTAGTV

SEQ ID NO: 404401 - protein, 8 aa, Mycobacterium
RRKTSGTV

SEQ ID NO: 404402 - protein, 8 aa, Mycobacterium
RRKTSRNA

SEQ ID NO: 404403 - protein, 9 aa, Mycobacterium
RRLDDAQPW

SEQ ID NO: 404404 - protein, 6 aa, Mycobacterium
RRLKQK

SEQ ID NO: 404405 - protein, 10 aa, Mycobacterium
RRLSGRDMPA

SEQ ID NO: 404406 - protein, 7 aa, Mycobacterium
RRMGSKS

SEQ ID NO: 404407 - protein, 6 aa, Mycobacterium
RRNAAR

SEQ ID NO: 404408 - protein, 10 aa, Mycobacterium
RRNDPTAYRS

SEQ ID NO: 404409 - protein, 9 aa, Mycobacterium
RRNEDEPAE

SEQ ID NO: 404410 - protein, 11 aa, Mycobacterium
RRNGGKVGGQF

SEQ ID NO: 404411 - protein, 9 aa, Mycobacterium
RRNGLSNDE

SEQ ID NO: 404412 - protein, 7 aa, Mycobacterium
RRNPGDD

SEQ ID NO: 404413 - protein, 6 aa, Mycobacterium
RRPDEL

SEQ ID NO: 404414 - protein, 7 aa, Mycobacterium
RRPDELA

SEQ ID NO: 404415 - protein, 11 aa, Mycobacterium
RRPDGSLQHPP

SEQ ID NO: 404416 - protein, 7 aa, Mycobacterium
RRPDLRG

SEQ ID NO: 404417 - protein, 4 aa, Mycobacterium
RRPE

SEQ ID NO: 404418 - protein, 5 aa, Mycobacterium
RRPEA

SEQ ID NO: 404419 - protein, 7 aa, Mycobacterium
RRPENAG

SEQ ID NO: 404420 - protein, 5 aa, Mycobacterium
RRPGD

SEQ ID NO: 404421 - protein, 7 aa, Mycobacterium
RRPGETA

SEQ ID NO: 404422 - protein, 5 aa, Mycobacterium
RRPGG

SEQ ID NO: 404423 - protein, 10 aa, Mycobacterium
RRPGMPDHGH

SEQ ID NO: 404424 - protein, 16 aa, Mycobacterium
RRPKDLATKQAAASVG

SEQ ID NO: 404425 - protein, 9 aa, Mycobacterium
RRPNATQDE

SEQ ID NO: 404426 - protein, 16 aa, Mycobacterium
RRPRDLATKQAAASVG

SEQ ID NO: 404427 - protein, 5 aa, Mycobacterium
RRPRL

SEQ ID NO: 404428 - protein, 9 aa, Mycobacterium
RRPRPFAPD

SEQ ID NO: 404429 - protein, 8 aa, Mycobacterium
RRPRTGPA

SEQ ID NO: 404430 - protein, 9 aa, Mycobacterium
RRPTALERP

SEQ ID NO: 404431 - protein, 4 aa, Mycobacterium
RRPV

SEQ ID NO: 404432 - protein, 10 aa, Mycobacterium
RRQAKPGDFD

SEQ ID NO: 404433 - protein, 6 aa, Mycobacterium
RRQASL

SEQ ID NO: 404434 - protein, 15 aa, Mycobacterium
RRQDATGQRDGVSFS

SEQ ID NO: 404435 - protein, 5 aa, Mycobacterium
RRQLG

SEQ ID NO: 404436 - protein, 8 aa, Mycobacterium
RRQPADVP

SEQ ID NO: 404437 - protein, 7 aa, Mycobacterium
RRQPEDD

SEQ ID NO: 404438 - protein, 4 aa, Mycobacterium
RRQR

SEQ ID NO: 404439 - protein, 9 aa, Mycobacterium
RRQTSADIR

SEQ ID NO: 404440 - protein, 4 aa, Mycobacterium
RRRA

SEQ ID NO: 404441 - protein, 12 aa, Mycobacterium
RRRASGGPAEQT

SEQ ID NO: 404442 - protein, 12 aa, Mycobacterium
RRRATGGPAEQT

SEQ ID NO: 404443 - protein, 16 aa, Mycobacterium
RRRDPFDDPGIDRDQL

SEQ ID NO: 404444 - protein, 8 aa, Mycobacterium
RRREAAAR

SEQ ID NO: 404445 - protein, 8 aa, Mycobacterium
RRREPRGD

SEQ ID NO: 404446 - protein, 6 aa, Mycobacterium
RRRHPQ

SEQ ID NO: 404447 - protein, 4 aa, Mycobacterium
RRRI

SEQ ID NO: 404448 - protein, 4 aa, Mycobacterium
RRRP

SEQ ID NO: 404449 - protein, 6 aa, Mycobacterium
RRRPEA

SEQ ID NO: 404450 - protein, 9 aa, Mycobacterium
RRRPEPGLD

SEQ ID NO: 404451 - protein, 6 aa, Mycobacterium
RRRPGV

SEQ ID NO: 404452 - protein, 8 aa, Mycobacterium
RRRQPRDD

SEQ ID NO: 404453 - protein, 5 aa, Mycobacterium
RRRRE

SEQ ID NO: 404454 - protein, 7 aa, Mycobacterium
RRRRQAG

SEQ ID NO: 404455 - protein, 4 aa, Mycobacterium
RRRS

SEQ ID NO: 404456 - protein, 10 aa, Mycobacterium
RRRTGGSDAG

SEQ ID NO: 404457 - protein, 14 aa, Mycobacterium
RRRTRTQDRATRIA

SEQ ID NO: 404458 - protein, 9 aa, Mycobacterium
RRSAGAHPY

SEQ ID NO: 404459 - protein, 4 aa, Mycobacterium
RRSE

SEQ ID NO: 404460 - protein, 6 aa, Mycobacterium
RRSEIT

SEQ ID NO: 404461 - protein, 4 aa, Mycobacterium
RRSG

SEQ ID NO: 404462 - protein, 6 aa, Mycobacterium
RRSGEP

SEQ ID NO: 404463 - protein, 9 aa, Mycobacterium
RRSGPRKDG

SEQ ID NO: 404464 - protein, 5 aa, Mycobacterium
RRSKS

SEQ ID NO: 404465 - protein, 6 aa, Mycobacterium
RRSRAA

SEQ ID NO: 404466 - protein, 9 aa, Mycobacterium
RRSRAQRWG

SEQ ID NO: 404467 - protein, 9 aa, Mycobacterium
RRTAERDEL

SEQ ID NO: 404468 - protein, 8 aa, Mycobacterium
RRTASAGQ

SEQ ID NO: 404469 - protein, 9 aa, Mycobacterium
RRTATADKA

SEQ ID NO: 404470 - protein, 5 aa, Mycobacterium
RRTDR

SEQ ID NO: 404471 - protein, 9 aa, Mycobacterium
RRTEPGDDT

SEQ ID NO: 404472 - protein, 7 aa, Mycobacterium
RRTESRG

SEQ ID NO: 404473 - protein, 5 aa, Mycobacterium
RRTGR

SEQ ID NO: 404474 - protein, 6 aa, Mycobacterium
RRTNNN

SEQ ID NO: 404475 - protein, 5 aa, Mycobacterium
RRTRR

SEQ ID NO: 404476 - protein, 4 aa, Mycobacterium
RRTT

SEQ ID NO: 404477 - protein, 5 aa, Mycobacterium
RRTVT

SEQ ID NO: 404478 - protein, 8 aa, Mycobacterium
RRVGGATY

SEQ ID NO: 404479 - protein, 9 aa, Mycobacterium
RRVPDAATS

SEQ ID NO: 404480 - protein, 4 aa, Mycobacterium
RRWT

SEQ ID NO: 404481 - protein, 4 aa, Mycobacterium
RRYA

SEQ ID NO: 404482 - protein, 6 aa, Mycobacterium
RRYSGR

SEQ ID NO: 404483 - protein, 6 aa, Mycobacterium
RSAADA

SEQ ID NO: 404484 - protein, 7 aa, Mycobacterium
RSAADAL

SEQ ID NO: 404485 - protein, 7 aa, Mycobacterium
RSAALGY

SEQ ID NO: 404486 - protein, 9 aa, Mycobacterium
RSAARQSRR

SEQ ID NO: 404487 - protein, 4 aa, Mycobacterium
RSAD

SEQ ID NO: 404488 - protein, 9 aa, Mycobacterium
RSAEESGGR

SEQ ID NO: 404489 - protein, 7 aa, Mycobacterium
RSAGLSL

SEQ ID NO: 404490 - protein, 6 aa, Mycobacterium
RSAGRE

SEQ ID NO: 404491 - protein, 7 aa, Mycobacterium
RSAHTRR

SEQ ID NO: 404492 - protein, 4 aa, Mycobacterium
RSAT

SEQ ID NO: 404493 - protein, 10 aa, Mycobacterium
RSATDPDGFS

SEQ ID NO: 404494 - protein, 12 aa, Mycobacterium
RSATELSEVTAE

SEQ ID NO: 404495 - protein, 8 aa, Mycobacterium
RSATGGRG

SEQ ID NO: 404496 - protein, 4 aa, Mycobacterium
RSCE

SEQ ID NO: 404497 - protein, 6 aa, Mycobacterium
RSCPAQ

SEQ ID NO: 404498 - protein, 9 aa, Mycobacterium
RSDDPQIAE

SEQ ID NO: 404499 - protein, 4 aa, Mycobacterium
RSDE

SEQ ID NO: 404500 - protein, 5 aa, Mycobacterium
RSDES

SEQ ID NO: 404501 - protein, 7 aa, Mycobacterium
RSDGSPH

SEQ ID NO: 404502 - protein, 10 aa, Mycobacterium
RSDPPQSLAE

SEQ ID NO: 404503 - protein, 7 aa, Mycobacterium
RSDRDAA

SEQ ID NO: 404504 - protein, 5 aa, Mycobacterium
RSDRV

SEQ ID NO: 404505 - protein, 7 aa, Mycobacterium
RSDSTLN

SEQ ID NO: 404506 - protein, 4 aa, Mycobacterium
RSDV

SEQ ID NO: 404507 - protein, 7 aa, Mycobacterium
RSEARKG

SEQ ID NO: 404508 - protein, 5 aa, Mycobacterium
RSEAT

SEQ ID NO: 404509 - protein, 8 aa, Mycobacterium
RSEEEREY

SEQ ID NO: 404510 - protein, 5 aa, Mycobacterium
RSEGL

SEQ ID NO: 404511 - protein, 9 aa, Mycobacterium
RSENLTSTS

SEQ ID NO: 404512 - protein, 7 aa, Mycobacterium
RSEPEFA

SEQ ID NO: 404513 - protein, 5 aa, Mycobacterium
RSEPR

SEQ ID NO: 404514 - protein, 4 aa, Mycobacterium
RSER

SEQ ID NO: 404515 - protein, 7 aa, Mycobacterium
RSERRRP

SEQ ID NO: 404516 - protein, 5 aa, Mycobacterium
RSESA

SEQ ID NO: 404517 - protein, 4 aa, Mycobacterium
RSFE

SEQ ID NO: 404518 - protein, 5 aa, Mycobacterium
RSGAK

SEQ ID NO: 404519 - protein, 6 aa, Mycobacterium
RSGAYD

SEQ ID NO: 404520 - protein, 8 aa, Mycobacterium
RSGDDDEL

SEQ ID NO: 404521 - protein, 10 aa, Mycobacterium
RSGEAREKYD

SEQ ID NO: 404522 - protein, 8 aa, Mycobacterium
RSGETEDT

SEQ ID NO: 404523 - protein, 6 aa, Mycobacterium
RSGFGR

SEQ ID NO: 404524 - protein, 10 aa, Mycobacterium
RSGGNAARMD

SEQ ID NO: 404525 - protein, 4 aa, Mycobacterium
RSGI

SEQ ID NO: 404526 - protein, 4 aa, Mycobacterium
RSGL

SEQ ID NO: 404527 - protein, 10 aa, Mycobacterium
RSGLPKVPTS

SEQ ID NO: 404528 - protein, 11 aa, Mycobacterium
RSGPDAPGADD

SEQ ID NO: 404529 - protein, 4 aa, Mycobacterium
RSGQ

SEQ ID NO: 404530 - protein, 8 aa, Mycobacterium
RSGRAPAD

SEQ ID NO: 404531 - protein, 9 aa, Mycobacterium
RSGRMSDDD

SEQ ID NO: 404532 - protein, 9 aa, Mycobacterium
RSGRMTDDD

SEQ ID NO: 404533 - protein, 6 aa, Mycobacterium
RSGSPV

SEQ ID NO: 404534 - protein, 10 aa, Mycobacterium
RSGSTTISTG

SEQ ID NO: 404535 - protein, 7 aa, Mycobacterium
RSGTTTY

SEQ ID NO: 404536 - protein, 5 aa, Mycobacterium
RSGVD

SEQ ID NO: 404537 - protein, 6 aa, Mycobacterium
RSGYAP

SEQ ID NO: 404538 - protein, 4 aa, Mycobacterium
RSHA

SEQ ID NO: 404539 - protein, 4 aa, Mycobacterium
RSHG

SEQ ID NO: 404540 - protein, 4 aa, Mycobacterium
RSHV

SEQ ID NO: 404541 - protein, 8 aa, Mycobacterium
RSKAARKV

SEQ ID NO: 404542 - protein, 7 aa, Mycobacterium
RSKENLD

SEQ ID NO: 404543 - protein, 7 aa, Mycobacterium
RSKIPAA

SEQ ID NO: 404544 - protein, 11 aa, Mycobacterium
RSKRSKRMTAS

SEQ ID NO: 404545 - protein, 8 aa, Mycobacterium
RSKYASGE

SEQ ID NO: 404546 - protein, 11 aa, Mycobacterium
RSLAGDRAAYN

SEQ ID NO: 404547 - protein, 4 aa, Mycobacterium
RSLR

SEQ ID NO: 404548 - protein, 14 aa, Mycobacterium
RSLSGSNIGGIAET

SEQ ID NO: 404549 - protein, 15 aa, Mycobacterium
RSNHGTCANQSPIVD

SEQ ID NO: 404550 - protein, 5 aa, Mycobacterium
RSNLD

SEQ ID NO: 404551 - protein, 4 aa, Mycobacterium
RSPA

SEQ ID NO: 404552 - protein, 4 aa, Mycobacterium
RSPG

SEQ ID NO: 404553 - protein, 4 aa, Mycobacterium
RSPN

SEQ ID NO: 404554 - protein, 4 aa, Mycobacterium
RSPS

SEQ ID NO: 404555 - protein, 4 aa, Mycobacterium
RSPV

SEQ ID NO: 404556 - protein, 6 aa, Mycobacterium
RSPYAT

SEQ ID NO: 404557 - protein, 4 aa, Mycobacterium
RSRA

SEQ ID NO: 404558 - protein, 4 aa, Mycobacterium
RSRE

SEQ ID NO: 404559 - protein, 10 aa, Mycobacterium
RSREQAAEIG

SEQ ID NO: 404560 - protein, 24 aa, Mycobacterium
RSRGLTGETIHPDGGFSLGPPPQR

SEQ ID NO: 404561 - protein, 4 aa, Mycobacterium
RSRL

SEQ ID NO: 404562 - protein, 4 aa, Mycobacterium
RSRR

SEQ ID NO: 404563 - protein, 5 aa, Mycobacterium
RSRSD

SEQ ID NO: 404564 - protein, 5 aa, Mycobacterium
RSRTK

SEQ ID NO: 404565 - protein, 4 aa, Mycobacterium
RSSA

SEQ ID NO: 404566 - protein, 18 aa, Mycobacterium
RSSATAEDLPTASFAGQQ

SEQ ID NO: 404567 - protein, 7 aa, Mycobacterium
RSSDPAT

SEQ ID NO: 404568 - protein, 4 aa, Mycobacterium
RSSE

SEQ ID NO: 404569 - protein, 4 aa, Mycobacterium
RSSF

SEQ ID NO: 404570 - protein, 4 aa, Mycobacterium
RSSG

SEQ ID NO: 404571 - protein, 6 aa, Mycobacterium
RSSGYA

SEQ ID NO: 404572 - protein, 17 aa, Mycobacterium
RSSRPHRSPGRLPQRRE

SEQ ID NO: 404573 - protein, 9 aa, Mycobacterium
RSTDLDRSH

SEQ ID NO: 404574 - protein, 8 aa, Mycobacterium
RSTDRTGV

SEQ ID NO: 404575 - protein, 6 aa, Mycobacterium
RSTGAS

SEQ ID NO: 404576 - protein, 5 aa, Mycobacterium
RSTQE

SEQ ID NO: 404577 - protein, 4 aa, Mycobacterium
RSTV

SEQ ID NO: 404578 - protein, 13 aa, Mycobacterium
RSVDERVKRLIAS

SEQ ID NO: 404579 - protein, 11 aa, Mycobacterium
RSWPRERTRAK

SEQ ID NO: 404580 - protein, 4 aa, Mycobacterium
RSYR

SEQ ID NO: 404581 - protein, 4 aa, Mycobacterium
RSYT

SEQ ID NO: 404582 - protein, 8 aa, Mycobacterium
RTAATDGS

SEQ ID NO: 404583 - protein, 6 aa, Mycobacterium
RTAGGR

SEQ ID NO: 404584 - protein, 13 aa, Mycobacterium
RTAHGDEDHSGPL

SEQ ID NO: 404585 - protein, 4 aa, Mycobacterium
RTAK

SEQ ID NO: 404586 - protein, 4 aa, Mycobacterium
RTAL

SEQ ID NO: 404587 - protein, 19 aa, Mycobacterium
RTAPPQTPHPPEPHPQIPT

SEQ ID NO: 404588 - protein, 6 aa, Mycobacterium
RTAQAA

SEQ ID NO: 404589 - protein, 4 aa, Mycobacterium
RTAR

SEQ ID NO: 404590 - protein, 10 aa, Mycobacterium
RTARSDESAQ

SEQ ID NO: 404591 - protein, 8 aa, Mycobacterium
RTASPGVK

SEQ ID NO: 404592 - protein, 9 aa, Mycobacterium
RTATERPNS

SEQ ID NO: 404593 - protein, 6 aa, Mycobacterium
RTATKA

SEQ ID NO: 404594 - protein, 6 aa, Mycobacterium
RTDAGE

SEQ ID NO: 404595 - protein, 7 aa, Mycobacterium
RTDDTPV

SEQ ID NO: 404596 - protein, 4 aa, Mycobacterium
RTDE

SEQ ID NO: 404597 - protein, 10 aa, Mycobacterium
RTDPDAAKHR

SEQ ID NO: 404598 - protein, 10 aa, Mycobacterium
RTDPNAPKHN

SEQ ID NO: 404599 - protein, 4 aa, Mycobacterium
RTDQ

SEQ ID NO: 404600 - protein, 4 aa, Mycobacterium
RTDR

SEQ ID NO: 404601 - protein, 6 aa, Mycobacterium
RTDRGD

SEQ ID NO: 404602 - protein, 5 aa, Mycobacterium
RTDRR

SEQ ID NO: 404603 - protein, 8 aa, Mycobacterium
RTDTGESV

SEQ ID NO: 404604 - protein, 5 aa, Mycobacterium
RTDVS

SEQ ID NO: 404605 - protein, 6 aa, Mycobacterium
RTEADV

SEQ ID NO: 404606 - protein, 8 aa, Mycobacterium
RTEDARVG

SEQ ID NO: 404607 - protein, 4 aa, Mycobacterium
RTER

SEQ ID NO: 404608 - protein, 4 aa, Mycobacterium
RTET

SEQ ID NO: 404609 - protein, 5 aa, Mycobacterium
RTFPG

SEQ ID NO: 404610 - protein, 15 aa, Mycobacterium
RTGAEALGSMGTDTP

SEQ ID NO: 404611 - protein, 12 aa, Mycobacterium
RTGATVRSAGSG

SEQ ID NO: 404612 - protein, 11 aa, Mycobacterium
RTGDDGTTGLS

SEQ ID NO: 404613 - protein, 5 aa, Mycobacterium
RTGDT

SEQ ID NO: 404614 - protein, 5 aa, Mycobacterium
RTGDV

SEQ ID NO: 404615 - protein, 8 aa, Mycobacterium
RTGEQPEQ

SEQ ID NO: 404616 - protein, 5 aa, Mycobacterium
RTGFT

SEQ ID NO: 404617 - protein, 4 aa, Mycobacterium
RTGI

SEQ ID NO: 404618 - protein, 5 aa, Mycobacterium
RTGIE

SEQ ID NO: 404619 - protein, 5 aa, Mycobacterium
RTGIP

SEQ ID NO: 404620 - protein, 6 aa, Mycobacterium
RTGKPH

SEQ ID NO: 404621 - protein, 5 aa, Mycobacterium
RTGLG

SEQ ID NO: 404622 - protein, 9 aa, Mycobacterium
RTGNPTRAA

SEQ ID NO: 404623 - protein, 4 aa, Mycobacterium
RTGP

SEQ ID NO: 404624 - protein, 7 aa, Mycobacterium
RTGQGQE

SEQ ID NO: 404625 - protein, 4 aa, Mycobacterium
RTGR

SEQ ID NO: 404626 - protein, 9 aa, Mycobacterium
RTGRAGKTG

SEQ ID NO: 404627 - protein, 10 aa, Mycobacterium
RTGRAGKTGV

SEQ ID NO: 404628 - protein, 9 aa, Mycobacterium
RTGRAGRSG

SEQ ID NO: 404629 - protein, 8 aa, Mycobacterium
RTGRANPG

SEQ ID NO: 404630 - protein, 5 aa, Mycobacterium
RTGRG

SEQ ID NO: 404631 - protein, 5 aa, Mycobacterium
RTGRP

SEQ ID NO: 404632 - protein, 5 aa, Mycobacterium
RTGRT

SEQ ID NO: 404633 - protein, 7 aa, Mycobacterium
RTGTALG

SEQ ID NO: 404634 - protein, 7 aa, Mycobacterium
RTGTARV

SEQ ID NO: 404635 - protein, 6 aa, Mycobacterium
RTGTGT

SEQ ID NO: 404636 - protein, 6 aa, Mycobacterium
RTGVGG

SEQ ID NO: 404637 - protein, 7 aa, Mycobacterium
RTHPGTT

SEQ ID NO: 404638 - protein, 12 aa, Mycobacterium
RTHQAPPVPGAQ

SEQ ID NO: 404639 - protein, 9 aa, Mycobacterium
RTINGSYAQ

SEQ ID NO: 404640 - protein, 10 aa, Mycobacterium
RTKAEAGDTD

SEQ ID NO: 404641 - protein, 11 aa, Mycobacterium
RTKDQAGEMSE

SEQ ID NO: 404642 - protein, 7 aa, Mycobacterium
RTKSPIQ

SEQ ID NO: 404643 - protein, 6 aa, Mycobacterium
RTLPDE

SEQ ID NO: 404644 - protein, 4 aa, Mycobacterium
RTLQ

SEQ ID NO: 404645 - protein, 4 aa, Mycobacterium
RTNG

SEQ ID NO: 404646 - protein, 7 aa, Mycobacterium
RTNITGS

SEQ ID NO: 404647 - protein, 7 aa, Mycobacterium
RTNSESI

SEQ ID NO: 404648 - protein, 7 aa, Mycobacterium
RTPADGL

SEQ ID NO: 404649 - protein, 6 aa, Mycobacterium
RTPAME

SEQ ID NO: 404650 - protein, 5 aa, Mycobacterium
RTPDD

SEQ ID NO: 404651 - protein, 7 aa, Mycobacterium
RTPEGKT

SEQ ID NO: 404652 - protein, 6 aa, Mycobacterium
RTPGAD

SEQ ID NO: 404653 - protein, 9 aa, Mycobacterium
RTPGGGSHL

SEQ ID NO: 404654 - protein, 5 aa, Mycobacterium
RTPGR

SEQ ID NO: 404655 - protein, 6 aa, Mycobacterium
RTPKPH

SEQ ID NO: 404656 - protein, 4 aa, Mycobacterium
RTPP

SEQ ID NO: 404657 - protein, 7 aa, Mycobacterium
RTPPGGA

SEQ ID NO: 404658 - protein, 8 aa, Mycobacterium
RTPPGGAN

SEQ ID NO: 404659 - protein, 10 aa, Mycobacterium
RTPPYPTATS

SEQ ID NO: 404660 - protein, 7 aa, Mycobacterium
RTPRGRV

SEQ ID NO: 404661 - protein, 5 aa, Mycobacterium
RTPRR

SEQ ID NO: 404662 - protein, 7 aa, Mycobacterium
RTPRVNP

SEQ ID NO: 404663 - protein, 6 aa, Mycobacterium
RTPRVT

SEQ ID NO: 404664 - protein, 9 aa, Mycobacterium
RTPSDAPLA

SEQ ID NO: 404665 - protein, 8 aa, Mycobacterium
RTPTAARA

SEQ ID NO: 404666 - protein, 5 aa, Mycobacterium
RTPTT

SEQ ID NO: 404667 - protein, 7 aa, Mycobacterium
RTPVTAA

SEQ ID NO: 404668 - protein, 9 aa, Mycobacterium
RTQKPPEFG

SEQ ID NO: 404669 - protein, 5 aa, Mycobacterium
RTQPT

SEQ ID NO: 404670 - protein, 5 aa, Mycobacterium
RTQTQ

SEQ ID NO: 404671 - protein, 5 aa, Mycobacterium
RTRDA

SEQ ID NO: 404672 - protein, 19 aa, Mycobacterium
RTREANDDHMGEEEREGLS

SEQ ID NO: 404673 - protein, 8 aa, Mycobacterium
RTRHGEQA

SEQ ID NO: 404674 - protein, 9 aa, Mycobacterium
RTRPTRGEV

SEQ ID NO: 404675 - protein, 4 aa, Mycobacterium
RTRR

SEQ ID NO: 404676 - protein, 7 aa, Mycobacterium
RTRSEDI

SEQ ID NO: 404677 - protein, 5 aa, Mycobacterium
RTRTI

SEQ ID NO: 404678 - protein, 4 aa, Mycobacterium
RTRY

SEQ ID NO: 404679 - protein, 5 aa, Mycobacterium
RTSPS

SEQ ID NO: 404680 - protein, 10 aa, Mycobacterium
RTSSQTGPAY

SEQ ID NO: 404681 - protein, 4 aa, Mycobacterium
RTTA

SEQ ID NO: 404682 - protein, 7 aa, Mycobacterium
RTTATSI

SEQ ID NO: 404683 - protein, 4 aa, Mycobacterium
RTTD

SEQ ID NO: 404684 - protein, 4 aa, Mycobacterium
RTTG

SEQ ID NO: 404685 - protein, 12 aa, Mycobacterium
RTTGAIESREMD

SEQ ID NO: 404686 - protein, 4 aa, Mycobacterium
RTTP

SEQ ID NO: 404687 - protein, 4 aa, Mycobacterium
RTTQ

SEQ ID NO: 404688 - protein, 14 aa, Mycobacterium
RTTTPGPVSDYTGK

SEQ ID NO: 404689 - protein, 4 aa, Mycobacterium
RTVA

SEQ ID NO: 404690 - protein, 14 aa, Mycobacterium
RTVPPGSVPTPSGW

SEQ ID NO: 404691 - protein, 6 aa, Mycobacterium
RTYPKT

SEQ ID NO: 404692 - protein, 9 aa, Mycobacterium
RVDGEPLSD

SEQ ID NO: 404693 - protein, 5 aa, Mycobacterium
RVDPA

SEQ ID NO: 404694 - protein, 4 aa, Mycobacterium
RVEE

SEQ ID NO: 404695 - protein, 5 aa, Mycobacterium
RVEEA

SEQ ID NO: 404696 - protein, 5 aa, Mycobacterium
RVEGE

SEQ ID NO: 404697 - protein, 4 aa, Mycobacterium
RVGG

SEQ ID NO: 404698 - protein, 6 aa, Mycobacterium
RVGGAA

SEQ ID NO: 404699 - protein, 10 aa, Mycobacterium
RVGPGDGAWR

SEQ ID NO: 404700 - protein, 4 aa, Mycobacterium
RVGT

SEQ ID NO: 404701 - protein, 8 aa, Mycobacterium
RVNKNGLP

SEQ ID NO: 404702 - protein, 6 aa, Mycobacterium
RVPDPS

SEQ ID NO: 404703 - protein, 4 aa, Mycobacterium
RVPE

SEQ ID NO: 404704 - protein, 4 aa, Mycobacterium
RVPG

SEQ ID NO: 404705 - protein, 11 aa, Mycobacterium
RVPGQRPDSAL

SEQ ID NO: 404706 - protein, 4 aa, Mycobacterium
RVPL

SEQ ID NO: 404707 - protein, 8 aa, Mycobacterium
RVPPGPGQ

SEQ ID NO: 404708 - protein, 7 aa, Mycobacterium
RVPPQRR

SEQ ID NO: 404709 - protein, 8 aa, Mycobacterium
RVPRPDGK

SEQ ID NO: 404710 - protein, 4 aa, Mycobacterium
RVQA

SEQ ID NO: 404711 - protein, 6 aa, Mycobacterium
RVQGAD

SEQ ID NO: 404712 - protein, 9 aa, Mycobacterium
RVQNNGQSC

SEQ ID NO: 404713 - protein, 4 aa, Mycobacterium
RVQT

SEQ ID NO: 404714 - protein, 6 aa, Mycobacterium
RVRAGD

SEQ ID NO: 404715 - protein, 4 aa, Mycobacterium
RVRG

SEQ ID NO: 404716 - protein, 4 aa, Mycobacterium
RVRS

SEQ ID NO: 404717 - protein, 8 aa, Mycobacterium
RVRSSESV

SEQ ID NO: 404718 - protein, 6 aa, Mycobacterium
RVSEGD

SEQ ID NO: 404719 - protein, 7 aa, Mycobacterium
RVSGTPV

SEQ ID NO: 404720 - protein, 8 aa, Mycobacterium
RVSKNDPR

SEQ ID NO: 404721 - protein, 4 aa, Mycobacterium
RVTA

SEQ ID NO: 404722 - protein, 4 aa, Mycobacterium
RVTG

SEQ ID NO: 404723 - protein, 6 aa, Mycobacterium
RVTPSS

SEQ ID NO: 404724 - protein, 4 aa, Mycobacterium
RVTQ

SEQ ID NO: 404725 - protein, 5 aa, Mycobacterium
RVTTG

SEQ ID NO: 404726 - protein, 10 aa, Mycobacterium
RWAPPYAEAG

SEQ ID NO: 404727 - protein, 5 aa, Mycobacterium
RWPRA

SEQ ID NO: 404728 - protein, 5 aa, Mycobacterium
RWPSG

SEQ ID NO: 404729 - protein, 4 aa, Mycobacterium
RYAG

SEQ ID NO: 404730 - protein, 6 aa, Mycobacterium
RYAGTR

SEQ ID NO: 404731 - protein, 6 aa, Mycobacterium
RYAHPA

SEQ ID NO: 404732 - protein, 5 aa, Mycobacterium
RYDEM

SEQ ID NO: 404733 - protein, 7 aa, Mycobacterium
RYDSGQR

SEQ ID NO: 404734 - protein, 6 aa, Mycobacterium
RYDTSS

SEQ ID NO: 404735 - protein, 6 aa, Mycobacterium
RYEKGQ

SEQ ID NO: 404736 - protein, 4 aa, Mycobacterium
RYER

SEQ ID NO: 404737 - protein, 4 aa, Mycobacterium
RYGD

SEQ ID NO: 404738 - protein, 4 aa, Mycobacterium
RYGG

SEQ ID NO: 404739 - protein, 7 aa, Mycobacterium
RYPDKRS

SEQ ID NO: 404740 - protein, 4 aa, Mycobacterium
RYPE

SEQ ID NO: 404741 - protein, 10 aa, Mycobacterium
RYPGADRPAL

SEQ ID NO: 404742 - protein, 7 aa, Mycobacterium
RYPQTNG

SEQ ID NO: 404743 - protein, 7 aa, Mycobacterium
RYSDKTR

SEQ ID NO: 404744 - protein, 10 aa, Mycobacterium
RYSGRGNPAL

SEQ ID NO: 404745 - protein, 10 aa, Mycobacterium
RYTSKGPSGL

SEQ ID NO: 404746 - protein, 4 aa, Mycobacterium
RYTT

SEQ ID NO: 404747 - protein, 5 aa, Mycobacterium
SAAAE

SEQ ID NO: 404748 - protein, 6 aa, Mycobacterium
SAAARR

SEQ ID NO: 404749 - protein, 4 aa, Mycobacterium
SAAD

SEQ ID NO: 404750 - protein, 6 aa, Mycobacterium
SAADAA

SEQ ID NO: 404751 - protein, 10 aa, Mycobacterium
SAADGGKPAF

SEQ ID NO: 404752 - protein, 5 aa, Mycobacterium
SAADI

SEQ ID NO: 404753 - protein, 4 aa, Mycobacterium
SAAE

SEQ ID NO: 404754 - protein, 6 aa, Mycobacterium
SAAEED

SEQ ID NO: 404755 - protein, 9 aa, Mycobacterium
SAAETGSHE

SEQ ID NO: 404756 - protein, 7 aa, Mycobacterium
SAAGEVD

SEQ ID NO: 404757 - protein, 20 aa, Mycobacterium
SAAGQQGAPRQGHYSATKGG

SEQ ID NO: 404758 - protein, 5 aa, Mycobacterium
SAAGT

SEQ ID NO: 404759 - protein, 5 aa, Mycobacterium
SAAGV

SEQ ID NO: 404760 - protein, 7 aa, Mycobacterium
SAAGVPS

SEQ ID NO: 404761 - protein, 10 aa, Mycobacterium
SAAHRRETYT

SEQ ID NO: 404762 - protein, 4 aa, Mycobacterium
SAAP

SEQ ID NO: 404763 - protein, 8 aa, Mycobacterium
SAASEVDQ

SEQ ID NO: 404764 - protein, 6 aa, Mycobacterium
SAASPF

SEQ ID NO: 404765 - protein, 17 aa, Mycobacterium
SAASPGEPGHDHPDPGV

SEQ ID NO: 404766 - protein, 4 aa, Mycobacterium
SAAV

SEQ ID NO: 404767 - protein, 9 aa, Mycobacterium
SACTDGGQG

SEQ ID NO: 404768 - protein, 4 aa, Mycobacterium
SADA

SEQ ID NO: 404769 - protein, 6 aa, Mycobacterium
SADDFE

SEQ ID NO: 404770 - protein, 5 aa, Mycobacterium
SADEL

SEQ ID NO: 404771 - protein, 6 aa, Mycobacterium
SADENL

SEQ ID NO: 404772 - protein, 10 aa, Mycobacterium
SADGLSPREQ

SEQ ID NO: 404773 - protein, 10 aa, Mycobacterium
SADGLTPREQ

SEQ ID NO: 404774 - protein, 8 aa, Mycobacterium
SADGPDRV

SEQ ID NO: 404775 - protein, 10 aa, Mycobacterium
SADPAEKAFG

SEQ ID NO: 404776 - protein, 7 aa, Mycobacterium
SADPDLR

SEQ ID NO: 404777 - protein, 9 aa, Mycobacterium
SADPGRPTN

SEQ ID NO: 404778 - protein, 6 aa, Mycobacterium
SADRST

SEQ ID NO: 404779 - protein, 4 aa, Mycobacterium
SADS

SEQ ID NO: 404780 - protein, 9 aa, Mycobacterium
SADYPDGLR

SEQ ID NO: 404781 - protein, 18 aa, Mycobacterium
SADYPDGLRQARAGDAMS

SEQ ID NO: 404782 - protein, 8 aa, Mycobacterium
SAEARRRS

SEQ ID NO: 404783 - protein, 4 aa, Mycobacterium
SAEE

SEQ ID NO: 404784 - protein, 4 aa, Mycobacterium
SAEF

SEQ ID NO: 404785 - protein, 4 aa, Mycobacterium
SAEG

SEQ ID NO: 404786 - protein, 8 aa, Mycobacterium
SAEHPRLG

SEQ ID NO: 404787 - protein, 4 aa, Mycobacterium
SAEL

SEQ ID NO: 404788 - protein, 4 aa, Mycobacterium
SAEP

SEQ ID NO: 404789 - protein, 10 aa, Mycobacterium
SAERTAVPGV

SEQ ID NO: 404790 - protein, 13 aa, Mycobacterium
SAESGVPTFRDDK

SEQ ID NO: 404791 - protein, 5 aa, Mycobacterium
SAETG

SEQ ID NO: 404792 - protein, 12 aa, Mycobacterium
SAGADDVGRAEE

SEQ ID NO: 404793 - protein, 7 aa, Mycobacterium
SAGAEPQ

SEQ ID NO: 404794 - protein, 5 aa, Mycobacterium
SAGAH

SEQ ID NO: 404795 - protein, 5 aa, Mycobacterium
SAGAP

SEQ ID NO: 404796 - protein, 7 aa, Mycobacterium
SAGARGR

SEQ ID NO: 404797 - protein, 8 aa, Mycobacterium
SAGDLQSV

SEQ ID NO: 404798 - protein, 4 aa, Mycobacterium
SAGE

SEQ ID NO: 404799 - protein, 7 aa, Mycobacterium
SAGERAD

SEQ ID NO: 404800 - protein, 7 aa, Mycobacterium
SAGNAGI

SEQ ID NO: 404801 - protein, 8 aa, Mycobacterium
SAGNHAQG

SEQ ID NO: 404802 - protein, 8 aa, Mycobacterium
SAGPEYGG

SEQ ID NO: 404803 - protein, 7 aa, Mycobacterium
SAGPQSW

SEQ ID NO: 404804 - protein, 7 aa, Mycobacterium
SAGRPPC

SEQ ID NO: 404805 - protein, 7 aa, Mycobacterium
SAGSEII

SEQ ID NO: 404806 - protein, 7 aa, Mycobacterium
SAGSTHA

SEQ ID NO: 404807 - protein, 10 aa, Mycobacterium
SAGTQDGSHT

SEQ ID NO: 404808 - protein, 5 aa, Mycobacterium
SAGVA

SEQ ID NO: 404809 - protein, 18 aa, Mycobacterium
SAGVQARNPKYSSYLPTK

SEQ ID NO: 404810 - protein, 5 aa, Mycobacterium
SAGWD

SEQ ID NO: 404811 - protein, 4 aa, Mycobacterium
SAHG

SEQ ID NO: 404812 - protein, 15 aa, Mycobacterium
SAHKRRDGGISREGS

SEQ ID NO: 404813 - protein, 5 aa, Mycobacterium
SAHRD

SEQ ID NO: 404814 - protein, 4 aa, Mycobacterium
SAIP

SEQ ID NO: 404815 - protein, 9 aa, Mycobacterium
SAKAGLDGF

SEQ ID NO: 404816 - protein, 6 aa, Mycobacterium
SAKGIP

SEQ ID NO: 404817 - protein, 4 aa, Mycobacterium
SAKQ

SEQ ID NO: 404818 - protein, 5 aa, Mycobacterium
SAKQI

SEQ ID NO: 404819 - protein, 5 aa, Mycobacterium
SALDP

SEQ ID NO: 404820 - protein, 4 aa, Mycobacterium
SALG

SEQ ID NO: 404821 - protein, 15 aa, Mycobacterium
SALGPRGEESVKGGY

SEQ ID NO: 404822 - protein, 6 aa, Mycobacterium
SALGTI

SEQ ID NO: 404823 - protein, 4 aa, Mycobacterium
SANP

SEQ ID NO: 404824 - protein, 5 aa, Mycobacterium
SANPD

SEQ ID NO: 404825 - protein, 8 aa, Mycobacterium
SANRSDEP

SEQ ID NO: 404826 - protein, 5 aa, Mycobacterium
SAPAA

SEQ ID NO: 404827 - protein, 11 aa, Mycobacterium
SAPAGAGKTHS

SEQ ID NO: 404828 - protein, 5 aa, Mycobacterium
SAPAL

SEQ ID NO: 404829 - protein, 6 aa, Mycobacterium
SAPAVK

SEQ ID NO: 404830 - protein, 5 aa, Mycobacterium
SAPFT

SEQ ID NO: 404831 - protein, 4 aa, Mycobacterium
SAPG

SEQ ID NO: 404832 - protein, 5 aa, Mycobacterium
SAPLA

SEQ ID NO: 404833 - protein, 4 aa, Mycobacterium
SAPN

SEQ ID NO: 404834 - protein, 9 aa, Mycobacterium
SAPPAEEVK

SEQ ID NO: 404835 - protein, 4 aa, Mycobacterium
SAPS

SEQ ID NO: 404836 - protein, 7 aa, Mycobacterium
SAPTSDI

SEQ ID NO: 404837 - protein, 7 aa, Mycobacterium
SAPTVAG

SEQ ID NO: 404838 - protein, 7 aa, Mycobacterium
SAQEQAE

SEQ ID NO: 404839 - protein, 4 aa, Mycobacterium
SAQP

SEQ ID NO: 404840 - protein, 8 aa, Mycobacterium
SAQSKQEL

SEQ ID NO: 404841 - protein, 4 aa, Mycobacterium
SARA

SEQ ID NO: 404842 - protein, 7 aa, Mycobacterium
SARAEES

SEQ ID NO: 404843 - protein, 5 aa, Mycobacterium
SAREL

SEQ ID NO: 404844 - protein, 6 aa, Mycobacterium
SARELN

SEQ ID NO: 404845 - protein, 9 aa, Mycobacterium
SARGDGRAL

SEQ ID NO: 404846 - protein, 9 aa, Mycobacterium
SARGEGRSL

SEQ ID NO: 404847 - protein, 6 aa, Mycobacterium
SARLDN

SEQ ID NO: 404848 - protein, 6 aa, Mycobacterium
SARNGA

SEQ ID NO: 404849 - protein, 6 aa, Mycobacterium
SARPDQ

SEQ ID NO: 404850 - protein, 8 aa, Mycobacterium
SARPDQLD

SEQ ID NO: 404851 - protein, 4 aa, Mycobacterium
SARR

SEQ ID NO: 404852 - protein, 6 aa, Mycobacterium
SARRDP

SEQ ID NO: 404853 - protein, 10 aa, Mycobacterium
SARSSGKNYR

SEQ ID NO: 404854 - protein, 5 aa, Mycobacterium
SARTA

SEQ ID NO: 404855 - protein, 6 aa, Mycobacterium
SARTAA

SEQ ID NO: 404856 - protein, 5 aa, Mycobacterium
SARTI

SEQ ID NO: 404857 - protein, 8 aa, Mycobacterium
SASDAESA

SEQ ID NO: 404858 - protein, 7 aa, Mycobacterium
SASDTEA

SEQ ID NO: 404859 - protein, 15 aa, Mycobacterium
SASGSSVAKGESLRD

SEQ ID NO: 404860 - protein, 7 aa, Mycobacterium
SASGTLG

SEQ ID NO: 404861 - protein, 6 aa, Mycobacterium
SASKAA

SEQ ID NO: 404862 - protein, 5 aa, Mycobacterium
SASLR

SEQ ID NO: 404863 - protein, 9 aa, Mycobacterium
SASTASESI

SEQ ID NO: 404864 - protein, 4 aa, Mycobacterium
SATA

SEQ ID NO: 404865 - protein, 5 aa, Mycobacterium
SATAA

SEQ ID NO: 404866 - protein, 8 aa, Mycobacterium
SATDAALT

SEQ ID NO: 404867 - protein, 5 aa, Mycobacterium
SATDR

SEQ ID NO: 404868 - protein, 4 aa, Mycobacterium
SATF

SEQ ID NO: 404869 - protein, 6 aa, Mycobacterium
SATGRE

SEQ ID NO: 404870 - protein, 6 aa, Mycobacterium
SATHER

SEQ ID NO: 404871 - protein, 16 aa, Mycobacterium
SATNDHRLGANEAPPA

SEQ ID NO: 404872 - protein, 11 aa, Mycobacterium
SATPDAAQQKD

SEQ ID NO: 404873 - protein, 7 aa, Mycobacterium
SATPVYD

SEQ ID NO: 404874 - protein, 9 aa, Mycobacterium
SATRDAANR

SEQ ID NO: 404875 - protein, 5 aa, Mycobacterium
SATRR

SEQ ID NO: 404876 - protein, 7 aa, Mycobacterium
SATRSVE

SEQ ID NO: 404877 - protein, 9 aa, Mycobacterium
SATTDDEGR

SEQ ID NO: 404878 - protein, 9 aa, Mycobacterium
SATTDEEGR

SEQ ID NO: 404879 - protein, 10 aa, Mycobacterium
SATVTTTGPA

SEQ ID NO: 404880 - protein, 21 aa, Mycobacterium
SAVNQDGASHGLTAPNGPAQQ

SEQ ID NO: 404881 - protein, 22 aa, Mycobacterium
SAVNQDGASNGLTAPNGPSQQR

SEQ ID NO: 404882 - protein, 9 aa, Mycobacterium
SAVPKTSTV

SEQ ID NO: 404883 - protein, 4 aa, Mycobacterium
SAVS

SEQ ID NO: 404884 - protein, 5 aa, Mycobacterium
SAVTS

SEQ ID NO: 404885 - protein, 9 aa, Mycobacterium
SAWQGDTGV

SEQ ID NO: 404886 - protein, 14 aa, Mycobacterium
SAYADAAEARGTWD

SEQ ID NO: 404887 - protein, 8 aa, Mycobacterium
SAYGESPY

SEQ ID NO: 404888 - protein, 4 aa, Mycobacterium
SAYS

SEQ ID NO: 404889 - protein, 9 aa, Mycobacterium
SAYSASKGG

SEQ ID NO: 404890 - protein, 8 aa, Mycobacterium
SAYTAAGK

SEQ ID NO: 404891 - protein, 8 aa, Mycobacterium
SCAGNDNL

SEQ ID NO: 404892 - protein, 7 aa, Mycobacterium
SCDKGNA

SEQ ID NO: 404893 - protein, 5 aa, Mycobacterium
SCGPG

SEQ ID NO: 404894 - protein, 6 aa, Mycobacterium
SCPPRD

SEQ ID NO: 404895 - protein, 10 aa, Mycobacterium
SCTNTSNPSV

SEQ ID NO: 404896 - protein, 5 aa, Mycobacterium
SDAAE

SEQ ID NO: 404897 - protein, 4 aa, Mycobacterium
SDAD

SEQ ID NO: 404898 - protein, 6 aa, Mycobacterium
SDADAD

SEQ ID NO: 404899 - protein, 5 aa, Mycobacterium
SDADR

SEQ ID NO: 404900 - protein, 5 aa, Mycobacterium
SDAEN

SEQ ID NO: 404901 - protein, 6 aa, Mycobacterium
SDAEPV

SEQ ID NO: 404902 - protein, 9 aa, Mycobacterium
SDAEQSNTS

SEQ ID NO: 404903 - protein, 8 aa, Mycobacterium
SDAERDGD

SEQ ID NO: 404904 - protein, 8 aa, Mycobacterium
SDAFTGEN

SEQ ID NO: 404905 - protein, 4 aa, Mycobacterium
SDAG

SEQ ID NO: 404906 - protein, 11 aa, Mycobacterium
SDAGTFGPPWP

SEQ ID NO: 404907 - protein, 7 aa, Mycobacterium
SDAHRSA

SEQ ID NO: 404908 - protein, 12 aa, Mycobacterium
SDAKAGKDAAEL

SEQ ID NO: 404909 - protein, 5 aa, Mycobacterium
SDAQR

SEQ ID NO: 404910 - protein, 10 aa, Mycobacterium
SDAQSGGPGA

SEQ ID NO: 404911 - protein, 9 aa, Mycobacterium
SDARANADQ

SEQ ID NO: 404912 - protein, 6 aa, Mycobacterium
SDDERP

SEQ ID NO: 404913 - protein, 5 aa, Mycobacterium
SDDLD

SEQ ID NO: 404914 - protein, 5 aa, Mycobacterium
SDDPA

SEQ ID NO: 404915 - protein, 5 aa, Mycobacterium
SDDPR

SEQ ID NO: 404916 - protein, 5 aa, Mycobacterium
SDDSR

SEQ ID NO: 404917 - protein, 6 aa, Mycobacterium
SDDTII

SEQ ID NO: 404918 - protein, 12 aa, Mycobacterium
SDEAGAKSVRNL

SEQ ID NO: 404919 - protein, 7 aa, Mycobacterium
SDEAGSH

SEQ ID NO: 404920 - protein, 5 aa, Mycobacterium
SDEAL

SEQ ID NO: 404921 - protein, 4 aa, Mycobacterium
SDED

SEQ ID NO: 404922 - protein, 4 aa, Mycobacterium
SDEI

SEQ ID NO: 404923 - protein, 5 aa, Mycobacterium
SDEID

SEQ ID NO: 404924 - protein, 10 aa, Mycobacterium
SDELGGGSLT

SEQ ID NO: 404925 - protein, 9 aa, Mycobacterium
SDELGGGSM

SEQ ID NO: 404926 - protein, 7 aa, Mycobacterium
SDEPVDA

SEQ ID NO: 404927 - protein, 5 aa, Mycobacterium
SDEQE

SEQ ID NO: 404928 - protein, 7 aa, Mycobacterium
SDEREDV

SEQ ID NO: 404929 - protein, 5 aa, Mycobacterium
SDESA

SEQ ID NO: 404930 - protein, 8 aa, Mycobacterium
SDESTPVG

SEQ ID NO: 404931 - protein, 13 aa, Mycobacterium
SDFTSASRTAFNN

SEQ ID NO: 404932 - protein, 12 aa, Mycobacterium
SDGAYAEASNQD

SEQ ID NO: 404933 - protein, 12 aa, Mycobacterium
SDGAYANASNQD

SEQ ID NO: 404934 - protein, 4 aa, Mycobacterium
SDGD

SEQ ID NO: 404935 - protein, 9 aa, Mycobacterium
SDGEPTEDQ

SEQ ID NO: 404936 - protein, 8 aa, Mycobacterium
SDGETDRG

SEQ ID NO: 404937 - protein, 4 aa, Mycobacterium
SDGG

SEQ ID NO: 404938 - protein, 7 aa, Mycobacterium
SDGIGAA

SEQ ID NO: 404939 - protein, 9 aa, Mycobacterium
SDGKPTRVG

SEQ ID NO: 404940 - protein, 5 aa, Mycobacterium
SDGPG

SEQ ID NO: 404941 - protein, 5 aa, Mycobacterium
SDGPS

SEQ ID NO: 404942 - protein, 7 aa, Mycobacterium
SDGSAPI

SEQ ID NO: 404943 - protein, 6 aa, Mycobacterium
SDGSRI

SEQ ID NO: 404944 - protein, 6 aa, Mycobacterium
SDGSVP

SEQ ID NO: 404945 - protein, 4 aa, Mycobacterium
SDHG

SEQ ID NO: 404946 - protein, 7 aa, Mycobacterium
SDHRETY

SEQ ID NO: 404947 - protein, 5 aa, Mycobacterium
SDKPD

SEQ ID NO: 404948 - protein, 14 aa, Mycobacterium
SDLAKGGPVHSQAE

SEQ ID NO: 404949 - protein, 6 aa, Mycobacterium
SDLNDP

SEQ ID NO: 404950 - protein, 4 aa, Mycobacterium
SDLS

SEQ ID NO: 404951 - protein, 7 aa, Mycobacterium
SDMEKPV

SEQ ID NO: 404952 - protein, 6 aa, Mycobacterium
SDNARY

SEQ ID NO: 404953 - protein, 11 aa, Mycobacterium
SDNKHGATPTW

SEQ ID NO: 404954 - protein, 9 aa, Mycobacterium
SDPAAPFGG

SEQ ID NO: 404955 - protein, 12 aa, Mycobacterium
SDPAKRKEYDET

SEQ ID NO: 404956 - protein, 5 aa, Mycobacterium
SDPDD

SEQ ID NO: 404957 - protein, 8 aa, Mycobacterium
SDPDHPAV

SEQ ID NO: 404958 - protein, 8 aa, Mycobacterium
SDPEVPPA

SEQ ID NO: 404959 - protein, 6 aa, Mycobacterium
SDPGEI

SEQ ID NO: 404960 - protein, 5 aa, Mycobacterium
SDPGR

SEQ ID NO: 404961 - protein, 4 aa, Mycobacterium
SDPH

SEQ ID NO: 404962 - protein, 7 aa, Mycobacterium
SDPITGP

SEQ ID NO: 404963 - protein, 7 aa, Mycobacterium
SDPNHPA

SEQ ID NO: 404964 - protein, 6 aa, Mycobacterium
SDPPFE

SEQ ID NO: 404965 - protein, 5 aa, Mycobacterium
SDPSV

SEQ ID NO: 404966 - protein, 4 aa, Mycobacterium
SDPT

SEQ ID NO: 404967 - protein, 4 aa, Mycobacterium
SDPV

SEQ ID NO: 404968 - protein, 4 aa, Mycobacterium
SDPY

SEQ ID NO: 404969 - protein, 4 aa, Mycobacterium
SDQG

SEQ ID NO: 404970 - protein, 4 aa, Mycobacterium
SDQL

SEQ ID NO: 404971 - protein, 9 aa, Mycobacterium
SDRDAADAL

SEQ ID NO: 404972 - protein, 4 aa, Mycobacterium
SDRG

SEQ ID NO: 404973 - protein, 9 aa, Mycobacterium
SDRGQPQTY

SEQ ID NO: 404974 - protein, 4 aa, Mycobacterium
SDRL

SEQ ID NO: 404975 - protein, 5 aa, Mycobacterium
SDRPD

SEQ ID NO: 404976 - protein, 6 aa, Mycobacterium
SDSEDF

SEQ ID NO: 404977 - protein, 6 aa, Mycobacterium
SDSGRA

SEQ ID NO: 404978 - protein, 6 aa, Mycobacterium
SDSGYS

SEQ ID NO: 404979 - protein, 10 aa, Mycobacterium
SDSKGVERIT

SEQ ID NO: 404980 - protein, 10 aa, Mycobacterium
SDSNKDGGYL

SEQ ID NO: 404981 - protein, 7 aa, Mycobacterium
SDTAEFG

SEQ ID NO: 404982 - protein, 5 aa, Mycobacterium
SDTAR

SEQ ID NO: 404983 - protein, 5 aa, Mycobacterium
SDTEY

SEQ ID NO: 404984 - protein, 5 aa, Mycobacterium
SDTPV

SEQ ID NO: 404985 - protein, 6 aa, Mycobacterium
SDTPVD

SEQ ID NO: 404986 - protein, 13 aa, Mycobacterium
SDVAGASAQRGLS

SEQ ID NO: 404987 - protein, 5 aa, Mycobacterium
SDVNP

SEQ ID NO: 404988 - protein, 8 aa, Mycobacterium
SDVPGTGA

SEQ ID NO: 404989 - protein, 5 aa, Mycobacterium
SDVQA

SEQ ID NO: 404990 - protein, 4 aa, Mycobacterium
SDYA

SEQ ID NO: 404991 - protein, 7 aa, Mycobacterium
SDYGPGL

SEQ ID NO: 404992 - protein, 4 aa, Mycobacterium
SEAA

SEQ ID NO: 404993 - protein, 6 aa, Mycobacterium
SEAADK

SEQ ID NO: 404994 - protein, 5 aa, Mycobacterium
SEAER

SEQ ID NO: 404995 - protein, 10 aa, Mycobacterium
SEAGASVYSA

SEQ ID NO: 404996 - protein, 7 aa, Mycobacterium
SEAGLPD

SEQ ID NO: 404997 - protein, 5 aa, Mycobacterium
SEAGV

SEQ ID NO: 404998 - protein, 6 aa, Mycobacterium
SEAPGY

SEQ ID NO: 404999 - protein, 7 aa, Mycobacterium
SECTEPD

SEQ ID NO: 405000 - protein, 15 aa, Mycobacterium
SEDAERGVSPIGGPL

SEQ ID NO: 405001 - protein, 6 aa, Mycobacterium
SEDDRG

SEQ ID NO: 405002 - protein, 4 aa, Mycobacterium
SEDE

SEQ ID NO: 405003 - protein, 6 aa, Mycobacterium
SEDGAT

SEQ ID NO: 405004 - protein, 9 aa, Mycobacterium
SEDGPCVPS

SEQ ID NO: 405005 - protein, 5 aa, Mycobacterium
SEDSR

SEQ ID NO: 405006 - protein, 4 aa, Mycobacterium
SEEA

SEQ ID NO: 405007 - protein, 10 aa, Mycobacterium
SEEDAAGINS

SEQ ID NO: 405008 - protein, 11 aa, Mycobacterium
SEEDKARARAE

SEQ ID NO: 405009 - protein, 6 aa, Mycobacterium
SEEDRP

SEQ ID NO: 405010 - protein, 4 aa, Mycobacterium
SEEG

SEQ ID NO: 405011 - protein, 5 aa, Mycobacterium
SEEGI

SEQ ID NO: 405012 - protein, 9 aa, Mycobacterium
SEEGVDDPV

SEQ ID NO: 405013 - protein, 11 aa, Mycobacterium
SEEKDEATMAE

SEQ ID NO: 405014 - protein, 9 aa, Mycobacterium
SEESGGSDL

SEQ ID NO: 405015 - protein, 4 aa, Mycobacterium
SEET

SEQ ID NO: 405016 - protein, 17 aa, Mycobacterium
SEETAKDINENHRNSRY

SEQ ID NO: 405017 - protein, 6 aa, Mycobacterium
SEETGL

SEQ ID NO: 405018 - protein, 4 aa, Mycobacterium
SEFR

SEQ ID NO: 405019 - protein, 4 aa, Mycobacterium
SEGG

SEQ ID NO: 405020 - protein, 5 aa, Mycobacterium
SEGGI

SEQ ID NO: 405021 - protein, 5 aa, Mycobacterium
SEGGT

SEQ ID NO: 405022 - protein, 4 aa, Mycobacterium
SEGI

SEQ ID NO: 405023 - protein, 7 aa, Mycobacterium
SEGKGLS

SEQ ID NO: 405024 - protein, 23 aa, Mycobacterium
SEGKNYKALGGQDWDPEQSKLSE

SEQ ID NO: 405025 - protein, 5 aa, Mycobacterium
SEGNS

SEQ ID NO: 405026 - protein, 9 aa, Mycobacterium
SEGRSTATA

SEQ ID NO: 405027 - protein, 7 aa, Mycobacterium
SEGWPGE

SEQ ID NO: 405028 - protein, 6 aa, Mycobacterium
SEHAGG

SEQ ID NO: 405029 - protein, 6 aa, Mycobacterium
SEHAGS

SEQ ID NO: 405030 - protein, 7 aa, Mycobacterium
SEHDQQA

SEQ ID NO: 405031 - protein, 6 aa, Mycobacterium
SEHEYG

SEQ ID NO: 405032 - protein, 15 aa, Mycobacterium
SEIENSDSDYDREKL

SEQ ID NO: 405033 - protein, 6 aa, Mycobacterium
SEKGSL

SEQ ID NO: 405034 - protein, 5 aa, Mycobacterium
SELAP

SEQ ID NO: 405035 - protein, 21 aa, Mycobacterium
SELGTGRGGPRCMSCPAARDP

SEQ ID NO: 405036 - protein, 4 aa, Mycobacterium
SELN

SEQ ID NO: 405037 - protein, 5 aa, Mycobacterium
SEMTE

SEQ ID NO: 405038 - protein, 10 aa, Mycobacterium
SEMTKEQQGT

SEQ ID NO: 405039 - protein, 6 aa, Mycobacterium
SENETE

SEQ ID NO: 405040 - protein, 4 aa, Mycobacterium
SENL

SEQ ID NO: 405041 - protein, 6 aa, Mycobacterium
SENPEA

SEQ ID NO: 405042 - protein, 8 aa, Mycobacterium
SENPSAMG

SEQ ID NO: 405043 - protein, 7 aa, Mycobacterium
SENTPVQ

SEQ ID NO: 405044 - protein, 4 aa, Mycobacterium
SEPA

SEQ ID NO: 405045 - protein, 8 aa, Mycobacterium
SEPDERGM

SEQ ID NO: 405046 - protein, 10 aa, Mycobacterium
SEPDSGSDLA

SEQ ID NO: 405047 - protein, 11 aa, Mycobacterium
SEPDSGSDLAS

SEQ ID NO: 405048 - protein, 7 aa, Mycobacterium
SEPERYA

SEQ ID NO: 405049 - protein, 10 aa, Mycobacterium
SEPESGSDLA

SEQ ID NO: 405050 - protein, 10 aa, Mycobacterium
SEPGAGSDLA

SEQ ID NO: 405051 - protein, 20 aa, Mycobacterium
SEPGAGSDLASLTTTARLEG

SEQ ID NO: 405052 - protein, 8 aa, Mycobacterium
SEPGNAGT

SEQ ID NO: 405053 - protein, 6 aa, Mycobacterium
SEPGTL

SEQ ID NO: 405054 - protein, 4 aa, Mycobacterium
SEPI

SEQ ID NO: 405055 - protein, 18 aa, Mycobacterium
SEPQFEGQTKTKLGNTEV

SEQ ID NO: 405056 - protein, 9 aa, Mycobacterium
SEPSPQRTP

SEQ ID NO: 405057 - protein, 16 aa, Mycobacterium
SEPTDDLPTADGTGSM

SEQ ID NO: 405058 - protein, 4 aa, Mycobacterium
SEPV

SEQ ID NO: 405059 - protein, 5 aa, Mycobacterium
SEQDL

SEQ ID NO: 405060 - protein, 14 aa, Mycobacterium
SEQGAAPAKTLRAD

SEQ ID NO: 405061 - protein, 7 aa, Mycobacterium
SEQQAAE

SEQ ID NO: 405062 - protein, 4 aa, Mycobacterium
SEQR

SEQ ID NO: 405063 - protein, 4 aa, Mycobacterium
SERA

SEQ ID NO: 405064 - protein, 4 aa, Mycobacterium
SERD

SEQ ID NO: 405065 - protein, 6 aa, Mycobacterium
SERDAY

SEQ ID NO: 405066 - protein, 8 aa, Mycobacterium
SERKNIDG

SEQ ID NO: 405067 - protein, 4 aa, Mycobacterium
SERP

SEQ ID NO: 405068 - protein, 7 aa, Mycobacterium
SERPRGV

SEQ ID NO: 405069 - protein, 10 aa, Mycobacterium
SERSTRDERH

SEQ ID NO: 405070 - protein, 5 aa, Mycobacterium
SERTG

SEQ ID NO: 405071 - protein, 4 aa, Mycobacterium
SESA

SEQ ID NO: 405072 - protein, 4 aa, Mycobacterium
SESH

SEQ ID NO: 405073 - protein, 8 aa, Mycobacterium
SESLDSEP

SEQ ID NO: 405074 - protein, 9 aa, Mycobacterium
SESRPGANF

SEQ ID NO: 405075 - protein, 4 aa, Mycobacterium
SEST

SEQ ID NO: 405076 - protein, 5 aa, Mycobacterium
SESVN

SEQ ID NO: 405077 - protein, 4 aa, Mycobacterium
SETI

SEQ ID NO: 405078 - protein, 10 aa, Mycobacterium
SETKGSEGVI

SEQ ID NO: 405079 - protein, 6 aa, Mycobacterium
SETPEY

SEQ ID NO: 405080 - protein, 4 aa, Mycobacterium
SETS

SEQ ID NO: 405081 - protein, 4 aa, Mycobacterium
SEVE

SEQ ID NO: 405082 - protein, 6 aa, Mycobacterium
SEVGED

SEQ ID NO: 405083 - protein, 12 aa, Mycobacterium
SEVKAGRGSPHG

SEQ ID NO: 405084 - protein, 5 aa, Mycobacterium
SFDEK

SEQ ID NO: 405085 - protein, 14 aa, Mycobacterium
SFGPPSISTKDYTA

SEQ ID NO: 405086 - protein, 15 aa, Mycobacterium
SFGTAAPAGSDEEAD

SEQ ID NO: 405087 - protein, 13 aa, Mycobacterium
SFPNHEANPLDPA

SEQ ID NO: 405088 - protein, 6 aa, Mycobacterium
SFPPTG

SEQ ID NO: 405089 - protein, 6 aa, Mycobacterium
SFPTEP

SEQ ID NO: 405090 - protein, 7 aa, Mycobacterium
SFSPSGQ

SEQ ID NO: 405091 - protein, 7 aa, Mycobacterium
SGAADPR

SEQ ID NO: 405092 - protein, 8 aa, Mycobacterium
SGAAGSWA

SEQ ID NO: 405093 - protein, 7 aa, Mycobacterium
SGAATAA

SEQ ID NO: 405094 - protein, 7 aa, Mycobacterium
SGAEEAE

SEQ ID NO: 405095 - protein, 5 aa, Mycobacterium
SGAGA

SEQ ID NO: 405096 - protein, 7 aa, Mycobacterium
SGAGAAG

SEQ ID NO: 405097 - protein, 6 aa, Mycobacterium
SGAGAS

SEQ ID NO: 405098 - protein, 19 aa, Mycobacterium
SGAGGNIGIGGAPQTGKST

SEQ ID NO: 405099 - protein, 12 aa, Mycobacterium
SGAGHPAGSPTL

SEQ ID NO: 405100 - protein, 10 aa, Mycobacterium
SGAGLSASTI

SEQ ID NO: 405101 - protein, 8 aa, Mycobacterium
SGAGSGPL

SEQ ID NO: 405102 - protein, 16 aa, Mycobacterium
SGAKVGSKGRPLPGAG

SEQ ID NO: 405103 - protein, 5 aa, Mycobacterium
SGANG

SEQ ID NO: 405104 - protein, 6 aa, Mycobacterium
SGANGV

SEQ ID NO: 405105 - protein, 9 aa, Mycobacterium
SGANNNERH

SEQ ID NO: 405106 - protein, 5 aa, Mycobacterium
SGAPL

SEQ ID NO: 405107 - protein, 6 aa, Mycobacterium
SGASAT

SEQ ID NO: 405108 - protein, 7 aa, Mycobacterium
SGASDPR

SEQ ID NO: 405109 - protein, 5 aa, Mycobacterium
SGASL

SEQ ID NO: 405110 - protein, 8 aa, Mycobacterium
SGATNTGL

SEQ ID NO: 405111 - protein, 8 aa, Mycobacterium
SGCGKSTT

SEQ ID NO: 405112 - protein, 5 aa, Mycobacterium
SGDAA

SEQ ID NO: 405113 - protein, 9 aa, Mycobacterium
SGDDVPMAG

SEQ ID NO: 405114 - protein, 6 aa, Mycobacterium
SGDGAL

SEQ ID NO: 405115 - protein, 6 aa, Mycobacterium
SGDGIG

SEQ ID NO: 405116 - protein, 12 aa, Mycobacterium
SGDGKARAWPEL

SEQ ID NO: 405117 - protein, 6 aa, Mycobacterium
SGDGRV

SEQ ID NO: 405118 - protein, 8 aa, Mycobacterium
SGDGVSGF

SEQ ID NO: 405119 - protein, 4 aa, Mycobacterium
SGDL

SEQ ID NO: 405120 - protein, 5 aa, Mycobacterium
SGDLS

SEQ ID NO: 405121 - protein, 5 aa, Mycobacterium
SGDNN

SEQ ID NO: 405122 - protein, 4 aa, Mycobacterium
SGDP

SEQ ID NO: 405123 - protein, 6 aa, Mycobacterium
SGDPEV

SEQ ID NO: 405124 - protein, 8 aa, Mycobacterium
SGDPGAVT

SEQ ID NO: 405125 - protein, 8 aa, Mycobacterium
SGDQRQER

SEQ ID NO: 405126 - protein, 5 aa, Mycobacterium
SGDSL

SEQ ID NO: 405127 - protein, 8 aa, Mycobacterium
SGDVATAR

SEQ ID NO: 405128 - protein, 7 aa, Mycobacterium
SGDVNTG

SEQ ID NO: 405129 - protein, 5 aa, Mycobacterium
SGDVS

SEQ ID NO: 405130 - protein, 13 aa, Mycobacterium
SGDVTPKPNVARL

SEQ ID NO: 405131 - protein, 5 aa, Mycobacterium
SGEAL

SEQ ID NO: 405132 - protein, 6 aa, Mycobacterium
SGEEVQ

SEQ ID NO: 405133 - protein, 4 aa, Mycobacterium
SGEF

SEQ ID NO: 405134 - protein, 8 aa, Mycobacterium
SGEGGEES

SEQ ID NO: 405135 - protein, 12 aa, Mycobacterium
SGEINSRQLPEN

SEQ ID NO: 405136 - protein, 4 aa, Mycobacterium
SGEK

SEQ ID NO: 405137 - protein, 4 aa, Mycobacterium
SGEP

SEQ ID NO: 405138 - protein, 9 aa, Mycobacterium
SGEPGPGRR

SEQ ID NO: 405139 - protein, 7 aa, Mycobacterium
SGEQRAS

SEQ ID NO: 405140 - protein, 9 aa, Mycobacterium
SGESENTLP

SEQ ID NO: 405141 - protein, 5 aa, Mycobacterium
SGETI

SEQ ID NO: 405142 - protein, 7 aa, Mycobacterium
SGFRPGQ

SEQ ID NO: 405143 - protein, 4 aa, Mycobacterium
SGFS

SEQ ID NO: 405144 - protein, 9 aa, Mycobacterium
SGGAESLNV

SEQ ID NO: 405145 - protein, 8 aa, Mycobacterium
SGGAGAAE

SEQ ID NO: 405146 - protein, 6 aa, Mycobacterium
SGGDYR

SEQ ID NO: 405147 - protein, 8 aa, Mycobacterium
SGGENSYP

SEQ ID NO: 405148 - protein, 6 aa, Mycobacterium
SGGERR

SEQ ID NO: 405149 - protein, 9 aa, Mycobacterium
SGGGGRGMR

SEQ ID NO: 405150 - protein, 7 aa, Mycobacterium
SGGGNRI

SEQ ID NO: 405151 - protein, 8 aa, Mycobacterium
SGGGPDTR

SEQ ID NO: 405152 - protein, 6 aa, Mycobacterium
SGGGPG

SEQ ID NO: 405153 - protein, 8 aa, Mycobacterium
SGGGPYAL

SEQ ID NO: 405154 - protein, 7 aa, Mycobacterium
SGGGPYT

SEQ ID NO: 405155 - protein, 5 aa, Mycobacterium
SGGGR

SEQ ID NO: 405156 - protein, 5 aa, Mycobacterium
SGGHL

SEQ ID NO: 405157 - protein, 8 aa, Mycobacterium
SGGKDSTA

SEQ ID NO: 405158 - protein, 15 aa, Mycobacterium
SGGLTPSGVILLRAD

SEQ ID NO: 405159 - protein, 5 aa, Mycobacterium
SGGML

SEQ ID NO: 405160 - protein, 5 aa, Mycobacterium
SGGPD

SEQ ID NO: 405161 - protein, 7 aa, Mycobacterium
SGGPRAV

SEQ ID NO: 405162 - protein, 7 aa, Mycobacterium
SGGQAAR

SEQ ID NO: 405163 - protein, 8 aa, Mycobacterium
SGGQAQRV

SEQ ID NO: 405164 - protein, 7 aa, Mycobacterium
SGGQRQR

SEQ ID NO: 405165 - protein, 7 aa, Mycobacterium
SGGQRTR

SEQ ID NO: 405166 - protein, 4 aa, Mycobacterium
SGGS

SEQ ID NO: 405167 - protein, 11 aa, Mycobacterium
SGGSDRKPSTL

SEQ ID NO: 405168 - protein, 12 aa, Mycobacterium
SGGSDRKPSTLE

SEQ ID NO: 405169 - protein, 7 aa, Mycobacterium
SGGSFSS

SEQ ID NO: 405170 - protein, 4 aa, Mycobacterium
SGGT

SEQ ID NO: 405171 - protein, 8 aa, Mycobacterium
SGGTAPAA

SEQ ID NO: 405172 - protein, 5 aa, Mycobacterium
SGGTD

SEQ ID NO: 405173 - protein, 16 aa, Mycobacterium
SGGTGISPSDSTPDQT

SEQ ID NO: 405174 - protein, 14 aa, Mycobacterium
SGGTTGAPKRTAQL

SEQ ID NO: 405175 - protein, 5 aa, Mycobacterium
SGGVL

SEQ ID NO: 405176 - protein, 7 aa, Mycobacterium
SGGVSSL

SEQ ID NO: 405177 - protein, 6 aa, Mycobacterium
SGHEPI

SEQ ID NO: 405178 - protein, 5 aa, Mycobacterium
SGHLG

SEQ ID NO: 405179 - protein, 4 aa, Mycobacterium
SGHP

SEQ ID NO: 405180 - protein, 6 aa, Mycobacterium
SGINPD

SEQ ID NO: 405181 - protein, 4 aa, Mycobacterium
SGIP

SEQ ID NO: 405182 - protein, 4 aa, Mycobacterium
SGKA

SEQ ID NO: 405183 - protein, 14 aa, Mycobacterium
SGKGGSQDARPVGG

SEQ ID NO: 405184 - protein, 12 aa, Mycobacterium
SGKGGVGKSSVT

SEQ ID NO: 405185 - protein, 4 aa, Mycobacterium
SGKH

SEQ ID NO: 405186 - protein, 8 aa, Mycobacterium
SGKLPPPV

SEQ ID NO: 405187 - protein, 8 aa, Mycobacterium
SGKQIPAD

SEQ ID NO: 405188 - protein, 6 aa, Mycobacterium
SGKVPT

SEQ ID NO: 405189 - protein, 5 aa, Mycobacterium
SGLAE

SEQ ID NO: 405190 - protein, 14 aa, Mycobacterium
SGLAGAGQAWQGAA

SEQ ID NO: 405191 - protein, 8 aa, Mycobacterium
SGLARTGR

SEQ ID NO: 405192 - protein, 5 aa, Mycobacterium
SGLAS

SEQ ID NO: 405193 - protein, 9 aa, Mycobacterium
SGLESDPRM

SEQ ID NO: 405194 - protein, 4 aa, Mycobacterium
SGLG

SEQ ID NO: 405195 - protein, 10 aa, Mycobacterium
SGLGREGGGI

SEQ ID NO: 405196 - protein, 4 aa, Mycobacterium
SGLN

SEQ ID NO: 405197 - protein, 9 aa, Mycobacterium
SGLPGPTGR

SEQ ID NO: 405198 - protein, 8 aa, Mycobacterium
SGLPNETN

SEQ ID NO: 405199 - protein, 8 aa, Mycobacterium
SGLPNKTD

SEQ ID NO: 405200 - protein, 5 aa, Mycobacterium
SGLPP

SEQ ID NO: 405201 - protein, 9 aa, Mycobacterium
SGLPSPTGR

SEQ ID NO: 405202 - protein, 4 aa, Mycobacterium
SGLR

SEQ ID NO: 405203 - protein, 5 aa, Mycobacterium
SGLRP

SEQ ID NO: 405204 - protein, 6 aa, Mycobacterium
SGLRPE

SEQ ID NO: 405205 - protein, 5 aa, Mycobacterium
SGMAR

SEQ ID NO: 405206 - protein, 10 aa, Mycobacterium
SGMDNSPRWD

SEQ ID NO: 405207 - protein, 5 aa, Mycobacterium
SGMTN

SEQ ID NO: 405208 - protein, 11 aa, Mycobacterium
SGNAGSNTASD

SEQ ID NO: 405209 - protein, 6 aa, Mycobacterium
SGNGGV

SEQ ID NO: 405210 - protein, 5 aa, Mycobacterium
SGNGT

SEQ ID NO: 405211 - protein, 5 aa, Mycobacterium
SGNIS

SEQ ID NO: 405212 - protein, 6 aa, Mycobacterium
SGNPNA

SEQ ID NO: 405213 - protein, 4 aa, Mycobacterium
SGPA

SEQ ID NO: 405214 - protein, 6 aa, Mycobacterium
SGPARK

SEQ ID NO: 405215 - protein, 6 aa, Mycobacterium
SGPEPL

SEQ ID NO: 405216 - protein, 7 aa, Mycobacterium
SGPERDA

SEQ ID NO: 405217 - protein, 4 aa, Mycobacterium
SGPG

SEQ ID NO: 405218 - protein, 10 aa, Mycobacterium
SGPGGQKAAI

SEQ ID NO: 405219 - protein, 16 aa, Mycobacterium
SGPGGQKAAIASAKLG

SEQ ID NO: 405220 - protein, 8 aa, Mycobacterium
SGPGPGPL

SEQ ID NO: 405221 - protein, 5 aa, Mycobacterium
SGPGS

SEQ ID NO: 405222 - protein, 7 aa, Mycobacterium
SGPGSAP

SEQ ID NO: 405223 - protein, 6 aa, Mycobacterium
SGPPLL

SEQ ID NO: 405224 - protein, 5 aa, Mycobacterium
SGPRL

SEQ ID NO: 405225 - protein, 5 aa, Mycobacterium
SGPTF

SEQ ID NO: 405226 - protein, 6 aa, Mycobacterium
SGPVDR

SEQ ID NO: 405227 - protein, 5 aa, Mycobacterium
SGPVG

SEQ ID NO: 405228 - protein, 4 aa, Mycobacterium
SGPW

SEQ ID NO: 405229 - protein, 4 aa, Mycobacterium
SGQA

SEQ ID NO: 405230 - protein, 6 aa, Mycobacterium
SGQAKA

SEQ ID NO: 405231 - protein, 7 aa, Mycobacterium
SGQEVPV

SEQ ID NO: 405232 - protein, 6 aa, Mycobacterium
SGQFGA

SEQ ID NO: 405233 - protein, 4 aa, Mycobacterium
SGQP

SEQ ID NO: 405234 - protein, 8 aa, Mycobacterium
SGQTYGAE

SEQ ID NO: 405235 - protein, 4 aa, Mycobacterium
SGQV

SEQ ID NO: 405236 - protein, 4 aa, Mycobacterium
SGRA

SEQ ID NO: 405237 - protein, 5 aa, Mycobacterium
SGRDY

SEQ ID NO: 405238 - protein, 8 aa, Mycobacterium
SGRGNPDG

SEQ ID NO: 405239 - protein, 5 aa, Mycobacterium
SGRGT

SEQ ID NO: 405240 - protein, 7 aa, Mycobacterium
SGRGTDV

SEQ ID NO: 405241 - protein, 4 aa, Mycobacterium
SGRH

SEQ ID NO: 405242 - protein, 11 aa, Mycobacterium
SGRHGDDAANT

SEQ ID NO: 405243 - protein, 5 aa, Mycobacterium
SGRID

SEQ ID NO: 405244 - protein, 5 aa, Mycobacterium
SGRLP

SEQ ID NO: 405245 - protein, 6 aa, Mycobacterium
SGRNKV

SEQ ID NO: 405246 - protein, 4 aa, Mycobacterium
SGRP

SEQ ID NO: 405247 - protein, 5 aa, Mycobacterium
SGRPG

SEQ ID NO: 405248 - protein, 6 aa, Mycobacterium
SGRPGP

SEQ ID NO: 405249 - protein, 4 aa, Mycobacterium
SGRR

SEQ ID NO: 405250 - protein, 10 aa, Mycobacterium
SGRSTSEITE

SEQ ID NO: 405251 - protein, 5 aa, Mycobacterium
SGRTA

SEQ ID NO: 405252 - protein, 6 aa, Mycobacterium
SGRTGV

SEQ ID NO: 405253 - protein, 5 aa, Mycobacterium
SGRVD

SEQ ID NO: 405254 - protein, 5 aa, Mycobacterium
SGSAR

SEQ ID NO: 405255 - protein, 7 aa, Mycobacterium
SGSEASD

SEQ ID NO: 405256 - protein, 9 aa, Mycobacterium
SGSEEDETA

SEQ ID NO: 405257 - protein, 8 aa, Mycobacterium
SGSERAQS

SEQ ID NO: 405258 - protein, 6 aa, Mycobacterium
SGSGDL

SEQ ID NO: 405259 - protein, 7 aa, Mycobacterium
SGSGISS

SEQ ID NO: 405260 - protein, 10 aa, Mycobacterium
SGSGKGGAKY

SEQ ID NO: 405261 - protein, 9 aa, Mycobacterium
SGSGKSTVA

SEQ ID NO: 405262 - protein, 9 aa, Mycobacterium
SGSGPLRPA

SEQ ID NO: 405263 - protein, 7 aa, Mycobacterium
SGSGSEV

SEQ ID NO: 405264 - protein, 5 aa, Mycobacterium
SGSNN

SEQ ID NO: 405265 - protein, 5 aa, Mycobacterium
SGSPM

SEQ ID NO: 405266 - protein, 7 aa, Mycobacterium
SGSSGSV

SEQ ID NO: 405267 - protein, 8 aa, Mycobacterium
SGSSGSVV

SEQ ID NO: 405268 - protein, 16 aa, Mycobacterium
SGSSGTAAAKKEALEA

SEQ ID NO: 405269 - protein, 17 aa, Mycobacterium
SGSSGTAAAKKEALEAA

SEQ ID NO: 405270 - protein, 9 aa, Mycobacterium
SGSTADPKG

SEQ ID NO: 405271 - protein, 9 aa, Mycobacterium
SGSTGAPKG

SEQ ID NO: 405272 - protein, 16 aa, Mycobacterium
SGSTGAPKGAMYPQSN

SEQ ID NO: 405273 - protein, 11 aa, Mycobacterium
SGSTGLPKGVP

SEQ ID NO: 405274 - protein, 10 aa, Mycobacterium
SGSTGTPKGV

SEQ ID NO: 405275 - protein, 5 aa, Mycobacterium
SGSWP

SEQ ID NO: 405276 - protein, 4 aa, Mycobacterium
SGTA

SEQ ID NO: 405277 - protein, 4 aa, Mycobacterium
SGTG

SEQ ID NO: 405278 - protein, 8 aa, Mycobacterium
SGTGGQVD

SEQ ID NO: 405279 - protein, 5 aa, Mycobacterium
SGTGM

SEQ ID NO: 405280 - protein, 17 aa, Mycobacterium
SGTGNVGIGNSGTGNWG

SEQ ID NO: 405281 - protein, 15 aa, Mycobacterium
SGTGVPTSGLILAPA

SEQ ID NO: 405282 - protein, 7 aa, Mycobacterium
SGTKGLS

SEQ ID NO: 405283 - protein, 11 aa, Mycobacterium
SGTKGSPPPDT

SEQ ID NO: 405284 - protein, 4 aa, Mycobacterium
SGTL

SEQ ID NO: 405285 - protein, 4 aa, Mycobacterium
SGTN

SEQ ID NO: 405286 - protein, 7 aa, Mycobacterium
SGTPASE

SEQ ID NO: 405287 - protein, 6 aa, Mycobacterium
SGTPGA

SEQ ID NO: 405288 - protein, 7 aa, Mycobacterium
SGTPGAT

SEQ ID NO: 405289 - protein, 9 aa, Mycobacterium
SGTTGDPKG

SEQ ID NO: 405290 - protein, 11 aa, Mycobacterium
SGTTGKPKGIV

SEQ ID NO: 405291 - protein, 17 aa, Mycobacterium
SGTTGKPKGIVRDNGGH

SEQ ID NO: 405292 - protein, 8 aa, Mycobacterium
SGTTGLPK

SEQ ID NO: 405293 - protein, 10 aa, Mycobacterium
SGTTGPPKGV

SEQ ID NO: 405294 - protein, 10 aa, Mycobacterium
SGTTGPPKRV

SEQ ID NO: 405295 - protein, 8 aa, Mycobacterium
SGTTGRAK

SEQ ID NO: 405296 - protein, 10 aa, Mycobacterium
SGTTGRPKAV

SEQ ID NO: 405297 - protein, 10 aa, Mycobacterium
SGTTGRSKGV

SEQ ID NO: 405298 - protein, 9 aa, Mycobacterium
SGTTGTAKG

SEQ ID NO: 405299 - protein, 10 aa, Mycobacterium
SGTTGTPKGA

SEQ ID NO: 405300 - protein, 10 aa, Mycobacterium
SGTTSRPKAV

SEQ ID NO: 405301 - protein, 4 aa, Mycobacterium
SGTV

SEQ ID NO: 405302 - protein, 6 aa, Mycobacterium
SGTVNV

SEQ ID NO: 405303 - protein, 8 aa, Mycobacterium
SGVADSTQ

SEQ ID NO: 405304 - protein, 13 aa, Mycobacterium
SGVDEDFGRGDEA

SEQ ID NO: 405305 - protein, 7 aa, Mycobacterium
SGVEAGS

SEQ ID NO: 405306 - protein, 12 aa, Mycobacterium
SGVPAAARTEEL

SEQ ID NO: 405307 - protein, 7 aa, Mycobacterium
SGVRGTG

SEQ ID NO: 405308 - protein, 9 aa, Mycobacterium
SGVRSRNGR

SEQ ID NO: 405309 - protein, 5 aa, Mycobacterium
SGVTR

SEQ ID NO: 405310 - protein, 4 aa, Mycobacterium
SGYA

SEQ ID NO: 405311 - protein, 6 aa, Mycobacterium
SGYAGL

SEQ ID NO: 405312 - protein, 10 aa, Mycobacterium
SGYDESTGIP

SEQ ID NO: 405313 - protein, 4 aa, Mycobacterium
SGYG

SEQ ID NO: 405314 - protein, 8 aa, Mycobacterium
SGYPAAAD

SEQ ID NO: 405315 - protein, 8 aa, Mycobacterium
SGYPGGLR

SEQ ID NO: 405316 - protein, 4 aa, Mycobacterium
SGYS

SEQ ID NO: 405317 - protein, 5 aa, Mycobacterium
SHAAG

SEQ ID NO: 405318 - protein, 6 aa, Mycobacterium
SHAQGE

SEQ ID NO: 405319 - protein, 5 aa, Mycobacterium
SHDAD

SEQ ID NO: 405320 - protein, 9 aa, Mycobacterium
SHDTHDAEA

SEQ ID NO: 405321 - protein, 10 aa, Mycobacterium
SHEVSNPDAV

SEQ ID NO: 405322 - protein, 6 aa, Mycobacterium
SHGGDP

SEQ ID NO: 405323 - protein, 5 aa, Mycobacterium
SHGHD

SEQ ID NO: 405324 - protein, 12 aa, Mycobacterium
SHGPDSEPVEEE

SEQ ID NO: 405325 - protein, 6 aa, Mycobacterium
SHKPGL

SEQ ID NO: 405326 - protein, 9 aa, Mycobacterium
SHNPATDNG

SEQ ID NO: 405327 - protein, 10 aa, Mycobacterium
SHNPPADNGY

SEQ ID NO: 405328 - protein, 7 aa, Mycobacterium
SHPEYAT

SEQ ID NO: 405329 - protein, 11 aa, Mycobacterium
SHPITTDGGTM

SEQ ID NO: 405330 - protein, 10 aa, Mycobacterium
SHPPSPRQVE

SEQ ID NO: 405331 - protein, 6 aa, Mycobacterium
SHPPTY

SEQ ID NO: 405332 - protein, 6 aa, Mycobacterium
SHPTRH

SEQ ID NO: 405333 - protein, 8 aa, Mycobacterium
SHRAAADR

SEQ ID NO: 405334 - protein, 13 aa, Mycobacterium
SHRNTGKACAEPV

SEQ ID NO: 405335 - protein, 13 aa, Mycobacterium
SHRNTGKACNDPV

SEQ ID NO: 405336 - protein, 4 aa, Mycobacterium
SHRP

SEQ ID NO: 405337 - protein, 8 aa, Mycobacterium
SHRVGTDA

SEQ ID NO: 405338 - protein, 5 aa, Mycobacterium
SHSAQ

SEQ ID NO: 405339 - protein, 4 aa, Mycobacterium
SHSE

SEQ ID NO: 405340 - protein, 4 aa, Mycobacterium
SHSG

SEQ ID NO: 405341 - protein, 6 aa, Mycobacterium
SHSGIA

SEQ ID NO: 405342 - protein, 13 aa, Mycobacterium
SHSHRRTSRRWDP

SEQ ID NO: 405343 - protein, 7 aa, Mycobacterium
SHSPQVE

SEQ ID NO: 405344 - protein, 6 aa, Mycobacterium
SHTPQV

SEQ ID NO: 405345 - protein, 7 aa, Mycobacterium
SHTSTHG

SEQ ID NO: 405346 - protein, 6 aa, Mycobacterium
SHYDKS

SEQ ID NO: 405347 - protein, 12 aa, Mycobacterium
SHYGTAGVATGA

SEQ ID NO: 405348 - protein, 5 aa, Mycobacterium
SHYSD

SEQ ID NO: 405349 - protein, 11 aa, Mycobacterium
SIAGPKRPQDR

SEQ ID NO: 405350 - protein, 8 aa, Mycobacterium
SIAPESAC

SEQ ID NO: 405351 - protein, 12 aa, Mycobacterium
SIASKGDSADGV

SEQ ID NO: 405352 - protein, 7 aa, Mycobacterium
SIDADEA

SEQ ID NO: 405353 - protein, 9 aa, Mycobacterium
SIEPAKDGY

SEQ ID NO: 405354 - protein, 11 aa, Mycobacterium
SIEQGNNESHA

SEQ ID NO: 405355 - protein, 5 aa, Mycobacterium
SIGPA

SEQ ID NO: 405356 - protein, 11 aa, Mycobacterium
SIGPGGNSKRY

SEQ ID NO: 405357 - protein, 5 aa, Mycobacterium
SIGSD

SEQ ID NO: 405358 - protein, 9 aa, Mycobacterium
SIGSIGDSF

SEQ ID NO: 405359 - protein, 6 aa, Mycobacterium
SIGSND

SEQ ID NO: 405360 - protein, 6 aa, Mycobacterium
SIGSSE

SEQ ID NO: 405361 - protein, 8 aa, Mycobacterium
SILPTDGR

SEQ ID NO: 405362 - protein, 7 aa, Mycobacterium
SIPAGGI

SEQ ID NO: 405363 - protein, 7 aa, Mycobacterium
SIPAPGL

SEQ ID NO: 405364 - protein, 5 aa, Mycobacterium
SIPDE

SEQ ID NO: 405365 - protein, 4 aa, Mycobacterium
SIPG

SEQ ID NO: 405366 - protein, 5 aa, Mycobacterium
SIPGG

SEQ ID NO: 405367 - protein, 12 aa, Mycobacterium
SIPITTSGKVRR

SEQ ID NO: 405368 - protein, 10 aa, Mycobacterium
SIPKGLSTSA

SEQ ID NO: 405369 - protein, 9 aa, Mycobacterium
SIPNEKIKD

SEQ ID NO: 405370 - protein, 4 aa, Mycobacterium
SIPT

SEQ ID NO: 405371 - protein, 7 aa, Mycobacterium
SIPTASR

SEQ ID NO: 405372 - protein, 12 aa, Mycobacterium
SISGPKRPQDRI

SEQ ID NO: 405373 - protein, 5 aa, Mycobacterium
SISGY

SEQ ID NO: 405374 - protein, 11 aa, Mycobacterium
SITAPDGRPVN

SEQ ID NO: 405375 - protein, 4 aa, Mycobacterium
SITT

SEQ ID NO: 405376 - protein, 13 aa, Mycobacterium
SITTFGPYSPGQA

SEQ ID NO: 405377 - protein, 20 aa, Mycobacterium
SIYGGSNEVQRNIIASTILG

SEQ ID NO: 405378 - protein, 6 aa, Mycobacterium
SIYPGN

SEQ ID NO: 405379 - protein, 7 aa, Mycobacterium
SKAALST

SEQ ID NO: 405380 - protein, 8 aa, Mycobacterium
SKAERHQR

SEQ ID NO: 405381 - protein, 7 aa, Mycobacterium
SKAGLNA

SEQ ID NO: 405382 - protein, 8 aa, Mycobacterium
SKAGRRRY

SEQ ID NO: 405383 - protein, 6 aa, Mycobacterium
SKANVT

SEQ ID NO: 405384 - protein, 10 aa, Mycobacterium
SKASGTPGAL

SEQ ID NO: 405385 - protein, 5 aa, Mycobacterium
SKDGL

SEQ ID NO: 405386 - protein, 16 aa, Mycobacterium
SKGEAGTGDVSNATTH

SEQ ID NO: 405387 - protein, 8 aa, Mycobacterium
SKGPTDKL

SEQ ID NO: 405388 - protein, 6 aa, Mycobacterium
SKKPGV

SEQ ID NO: 405389 - protein, 9 aa, Mycobacterium
SKKSGSQTV

SEQ ID NO: 405390 - protein, 7 aa, Mycobacterium
SKLEPTA

SEQ ID NO: 405391 - protein, 6 aa, Mycobacterium
SKPCTD

SEQ ID NO: 405392 - protein, 11 aa, Mycobacterium
SKPNPRTATNA

SEQ ID NO: 405393 - protein, 6 aa, Mycobacterium
SKQGRF

SEQ ID NO: 405394 - protein, 7 aa, Mycobacterium
SKQRGRF

SEQ ID NO: 405395 - protein, 8 aa, Mycobacterium
SKREARRH

SEQ ID NO: 405396 - protein, 4 aa, Mycobacterium
SKRQ

SEQ ID NO: 405397 - protein, 16 aa, Mycobacterium
SKRRTREMIASLATEL

SEQ ID NO: 405398 - protein, 10 aa, Mycobacterium
SKRSKRMTAS

SEQ ID NO: 405399 - protein, 6 aa, Mycobacterium
SKSGTV

SEQ ID NO: 405400 - protein, 6 aa, Mycobacterium
SKSIRG

SEQ ID NO: 405401 - protein, 8 aa, Mycobacterium
SKSRRYST

SEQ ID NO: 405402 - protein, 4 aa, Mycobacterium
SKST

SEQ ID NO: 405403 - protein, 11 aa, Mycobacterium
SLAAAKSKSAL

SEQ ID NO: 405404 - protein, 6 aa, Mycobacterium
SLAEGG

SEQ ID NO: 405405 - protein, 8 aa, Mycobacterium
SLAESGTP

SEQ ID NO: 405406 - protein, 8 aa, Mycobacterium
SLAGGSSM

SEQ ID NO: 405407 - protein, 9 aa, Mycobacterium
SLASGQKPT

SEQ ID NO: 405408 - protein, 6 aa, Mycobacterium
SLEGED

SEQ ID NO: 405409 - protein, 14 aa, Mycobacterium
SLGAGKPASGAGIS

SEQ ID NO: 405410 - protein, 22 aa, Mycobacterium
SLGAGKPASGAGISKALESGLA

SEQ ID NO: 405411 - protein, 4 aa, Mycobacterium
SLGD

SEQ ID NO: 405412 - protein, 10 aa, Mycobacterium
SLGDQRPGSI

SEQ ID NO: 405413 - protein, 5 aa, Mycobacterium
SLGGS

SEQ ID NO: 405414 - protein, 8 aa, Mycobacterium
SLGPETTK

SEQ ID NO: 405415 - protein, 8 aa, Mycobacterium
SLGPGPDN

SEQ ID NO: 405416 - protein, 8 aa, Mycobacterium
SLGRSDGA

SEQ ID NO: 405417 - protein, 8 aa, Mycobacterium
SLGRSEGA

SEQ ID NO: 405418 - protein, 13 aa, Mycobacterium
SLGVDPQGPLRAM

SEQ ID NO: 405419 - protein, 11 aa, Mycobacterium
SLHPPSDQVRS

SEQ ID NO: 405420 - protein, 28 aa, Mycobacterium
SLKPRKSGESVRTGNAPTPTPPRPPQRE

SEQ ID NO: 405421 - protein, 5 aa, Mycobacterium
SLPAR

SEQ ID NO: 405422 - protein, 6 aa, Mycobacterium
SLPDQG

SEQ ID NO: 405423 - protein, 9 aa, Mycobacterium
SLPEKQKQH

SEQ ID NO: 405424 - protein, 5 aa, Mycobacterium
SLPES

SEQ ID NO: 405425 - protein, 5 aa, Mycobacterium
SLPET

SEQ ID NO: 405426 - protein, 4 aa, Mycobacterium
SLPG

SEQ ID NO: 405427 - protein, 5 aa, Mycobacterium
SLPGS

SEQ ID NO: 405428 - protein, 6 aa, Mycobacterium
SLPGTL

SEQ ID NO: 405429 - protein, 9 aa, Mycobacterium
SLPKRGAGS

SEQ ID NO: 405430 - protein, 4 aa, Mycobacterium
SLPR

SEQ ID NO: 405431 - protein, 5 aa, Mycobacterium
SLPRG

SEQ ID NO: 405432 - protein, 10 aa, Mycobacterium
SLPRTSSGKL

SEQ ID NO: 405433 - protein, 4 aa, Mycobacterium
SLQD

SEQ ID NO: 405434 - protein, 4 aa, Mycobacterium
SLRP

SEQ ID NO: 405435 - protein, 4 aa, Mycobacterium
SLSD

SEQ ID NO: 405436 - protein, 6 aa, Mycobacterium
SLSDDE

SEQ ID NO: 405437 - protein, 9 aa, Mycobacterium
SLSDGETRQ

SEQ ID NO: 405438 - protein, 6 aa, Mycobacterium
SLSEYT

SEQ ID NO: 405439 - protein, 9 aa, Mycobacterium
SLSGGAKEQ

SEQ ID NO: 405440 - protein, 9 aa, Mycobacterium
SLSPDQRAE

SEQ ID NO: 405441 - protein, 25 aa, Mycobacterium
SLSRSGPTTGTPVLPPDGIASATAA

SEQ ID NO: 405442 - protein, 4 aa, Mycobacterium
SLST

SEQ ID NO: 405443 - protein, 8 aa, Mycobacterium
SLSTEGNN

SEQ ID NO: 405444 - protein, 7 aa, Mycobacterium
SLTAPSD

SEQ ID NO: 405445 - protein, 17 aa, Mycobacterium
SLTEDEIGEYSGERKEI

SEQ ID NO: 405446 - protein, 4 aa, Mycobacterium
SLTG

SEQ ID NO: 405447 - protein, 5 aa, Mycobacterium
SLTGS

SEQ ID NO: 405448 - protein, 4 aa, Mycobacterium
SLTP

SEQ ID NO: 405449 - protein, 5 aa, Mycobacterium
SLTPA

SEQ ID NO: 405450 - protein, 10 aa, Mycobacterium
SLTSPRGKRQ

SEQ ID NO: 405451 - protein, 5 aa, Mycobacterium
SMGGG

SEQ ID NO: 405452 - protein, 8 aa, Mycobacterium
SMHTSGRV

SEQ ID NO: 405453 - protein, 4 aa, Mycobacterium
SMRH

SEQ ID NO: 405454 - protein, 5 aa, Mycobacterium
SMSDE

SEQ ID NO: 405455 - protein, 9 aa, Mycobacterium
SNAASDMAS

SEQ ID NO: 405456 - protein, 6 aa, Mycobacterium
SNAATA

SEQ ID NO: 405457 - protein, 4 aa, Mycobacterium
SNAG

SEQ ID NO: 405458 - protein, 8 aa, Mycobacterium
SNDAKEGA

SEQ ID NO: 405459 - protein, 6 aa, Mycobacterium
SNDFTP

SEQ ID NO: 405460 - protein, 7 aa, Mycobacterium
SNDGGAS

SEQ ID NO: 405461 - protein, 5 aa, Mycobacterium
SNERL

SEQ ID NO: 405462 - protein, 5 aa, Mycobacterium
SNFES

SEQ ID NO: 405463 - protein, 8 aa, Mycobacterium
SNGAGKTT

SEQ ID NO: 405464 - protein, 6 aa, Mycobacterium
SNGDGL

SEQ ID NO: 405465 - protein, 9 aa, Mycobacterium
SNGDHTHGN

SEQ ID NO: 405466 - protein, 5 aa, Mycobacterium
SNGDR

SEQ ID NO: 405467 - protein, 5 aa, Mycobacterium
SNGDV

SEQ ID NO: 405468 - protein, 6 aa, Mycobacterium
SNGLGA

SEQ ID NO: 405469 - protein, 12 aa, Mycobacterium
SNGPIDPSASVK

SEQ ID NO: 405470 - protein, 7 aa, Mycobacterium
SNHYPDD

SEQ ID NO: 405471 - protein, 18 aa, Mycobacterium
SNIAQDGKGYASGTQLGE

SEQ ID NO: 405472 - protein, 7 aa, Mycobacterium
SNIPDGQ

SEQ ID NO: 405473 - protein, 4 aa, Mycobacterium
SNKR

SEQ ID NO: 405474 - protein, 9 aa, Mycobacterium
SNKTNGVTP

SEQ ID NO: 405475 - protein, 6 aa, Mycobacterium
SNLLGP

SEQ ID NO: 405476 - protein, 8 aa, Mycobacterium
SNLPAGHG

SEQ ID NO: 405477 - protein, 6 aa, Mycobacterium
SNLPDT

SEQ ID NO: 405478 - protein, 12 aa, Mycobacterium
SNNGLGERNYTE

SEQ ID NO: 405479 - protein, 4 aa, Mycobacterium
SNPA

SEQ ID NO: 405480 - protein, 7 aa, Mycobacterium
SNPATGY

SEQ ID NO: 405481 - protein, 5 aa, Mycobacterium
SNPEI

SEQ ID NO: 405482 - protein, 15 aa, Mycobacterium
SNRGVAGIDGTVSTA

SEQ ID NO: 405483 - protein, 4 aa, Mycobacterium
SNRP

SEQ ID NO: 405484 - protein, 5 aa, Mycobacterium
SNRQI

SEQ ID NO: 405485 - protein, 7 aa, Mycobacterium
SNSAGLG

SEQ ID NO: 405486 - protein, 6 aa, Mycobacterium
SNSEEL

SEQ ID NO: 405487 - protein, 10 aa, Mycobacterium
SNSERIRGAD

SEQ ID NO: 405488 - protein, 4 aa, Mycobacterium
SNSL

SEQ ID NO: 405489 - protein, 15 aa, Mycobacterium
SNSRRRTADGGWEPG

SEQ ID NO: 405490 - protein, 5 aa, Mycobacterium
SNSRS

SEQ ID NO: 405491 - protein, 7 aa, Mycobacterium
SNSTTTV

SEQ ID NO: 405492 - protein, 10 aa, Mycobacterium
SNSWEYTGDG

SEQ ID NO: 405493 - protein, 13 aa, Mycobacterium
SNVTSREGKRGGT

SEQ ID NO: 405494 - protein, 5 aa, Mycobacterium
SPAAA

SEQ ID NO: 405495 - protein, 8 aa, Mycobacterium
SPAAAEVN

SEQ ID NO: 405496 - protein, 6 aa, Mycobacterium
SPAAEG

SEQ ID NO: 405497 - protein, 9 aa, Mycobacterium
SPAAKQTLS

SEQ ID NO: 405498 - protein, 5 aa, Mycobacterium
SPAAS

SEQ ID NO: 405499 - protein, 6 aa, Mycobacterium
SPAEQA

SEQ ID NO: 405500 - protein, 4 aa, Mycobacterium
SPAG

SEQ ID NO: 405501 - protein, 6 aa, Mycobacterium
SPAGIR

SEQ ID NO: 405502 - protein, 4 aa, Mycobacterium
SPAK

SEQ ID NO: 405503 - protein, 5 aa, Mycobacterium
SPALQ

SEQ ID NO: 405504 - protein, 5 aa, Mycobacterium
SPANV

SEQ ID NO: 405505 - protein, 5 aa, Mycobacterium
SPAPI

SEQ ID NO: 405506 - protein, 6 aa, Mycobacterium
SPAQTR

SEQ ID NO: 405507 - protein, 4 aa, Mycobacterium
SPAR

SEQ ID NO: 405508 - protein, 11 aa, Mycobacterium
SPASISSGTYS

SEQ ID NO: 405509 - protein, 12 aa, Mycobacterium
SPATPELPPDTR

SEQ ID NO: 405510 - protein, 8 aa, Mycobacterium
SPATPTTA

SEQ ID NO: 405511 - protein, 5 aa, Mycobacterium
SPDDA

SEQ ID NO: 405512 - protein, 19 aa, Mycobacterium
SPDEYTGKRTHMPEYPEEG

SEQ ID NO: 405513 - protein, 4 aa, Mycobacterium
SPDG

SEQ ID NO: 405514 - protein, 9 aa, Mycobacterium
SPDGNGITD

SEQ ID NO: 405515 - protein, 7 aa, Mycobacterium
SPDPGPV

SEQ ID NO: 405516 - protein, 8 aa, Mycobacterium
SPDPIEAT

SEQ ID NO: 405517 - protein, 4 aa, Mycobacterium
SPDR

SEQ ID NO: 405518 - protein, 8 aa, Mycobacterium
SPDSARGR

SEQ ID NO: 405519 - protein, 8 aa, Mycobacterium
SPDTAGGL

SEQ ID NO: 405520 - protein, 5 aa, Mycobacterium
SPDTL

SEQ ID NO: 405521 - protein, 5 aa, Mycobacterium
SPDWD

SEQ ID NO: 405522 - protein, 9 aa, Mycobacterium
SPEAAAGGP

SEQ ID NO: 405523 - protein, 8 aa, Mycobacterium
SPEARADL

SEQ ID NO: 405524 - protein, 4 aa, Mycobacterium
SPEE

SEQ ID NO: 405525 - protein, 6 aa, Mycobacterium
SPEGDR

SEQ ID NO: 405526 - protein, 10 aa, Mycobacterium
SPEGDTGKST

SEQ ID NO: 405527 - protein, 11 aa, Mycobacterium
SPEPKASEGLG

SEQ ID NO: 405528 - protein, 5 aa, Mycobacterium
SPETI

SEQ ID NO: 405529 - protein, 5 aa, Mycobacterium
SPFGQ

SEQ ID NO: 405530 - protein, 4 aa, Mycobacterium
SPGG

SEQ ID NO: 405531 - protein, 5 aa, Mycobacterium
SPGGA

SEQ ID NO: 405532 - protein, 11 aa, Mycobacterium
SPGGHTSRPHL

SEQ ID NO: 405533 - protein, 9 aa, Mycobacterium
SPGGRTEGN

SEQ ID NO: 405534 - protein, 4 aa, Mycobacterium
SPGL

SEQ ID NO: 405535 - protein, 8 aa, Mycobacterium
SPGMPERK

SEQ ID NO: 405536 - protein, 5 aa, Mycobacterium
SPGPH

SEQ ID NO: 405537 - protein, 6 aa, Mycobacterium
SPGPID

SEQ ID NO: 405538 - protein, 7 aa, Mycobacterium
SPGPSEG

SEQ ID NO: 405539 - protein, 13 aa, Mycobacterium
SPIGKRNGGLSGV

SEQ ID NO: 405540 - protein, 6 aa, Mycobacterium
SPIGRA

SEQ ID NO: 405541 - protein, 8 aa, Mycobacterium
SPKGSATL

SEQ ID NO: 405542 - protein, 13 aa, Mycobacterium
SPLAQPGTGDAGG

SEQ ID NO: 405543 - protein, 14 aa, Mycobacterium
SPLATTISTPGAAP

SEQ ID NO: 405544 - protein, 5 aa, Mycobacterium
SPLGQ

SEQ ID NO: 405545 - protein, 4 aa, Mycobacterium
SPLP

SEQ ID NO: 405546 - protein, 5 aa, Mycobacterium
SPLPG

SEQ ID NO: 405547 - protein, 4 aa, Mycobacterium
SPLV

SEQ ID NO: 405548 - protein, 4 aa, Mycobacterium
SPNA

SEQ ID NO: 405549 - protein, 12 aa, Mycobacterium
SPNGVRTADGVE

SEQ ID NO: 405550 - protein, 4 aa, Mycobacterium
SPNT

SEQ ID NO: 405551 - protein, 7 aa, Mycobacterium
SPPAASS

SEQ ID NO: 405552 - protein, 9 aa, Mycobacterium
SPPKQLADD

SEQ ID NO: 405553 - protein, 9 aa, Mycobacterium
SPPPETVDD

SEQ ID NO: 405554 - protein, 7 aa, Mycobacterium
SPPQAQF

SEQ ID NO: 405555 - protein, 9 aa, Mycobacterium
SPPQQLPDD

SEQ ID NO: 405556 - protein, 8 aa, Mycobacterium
SPPQSGCE

SEQ ID NO: 405557 - protein, 9 aa, Mycobacterium
SPPSGPGVR

SEQ ID NO: 405558 - protein, 11 aa, Mycobacterium
SPQEYTGERTH

SEQ ID NO: 405559 - protein, 4 aa, Mycobacterium
SPQG

SEQ ID NO: 405560 - protein, 5 aa, Mycobacterium
SPQGL

SEQ ID NO: 405561 - protein, 6 aa, Mycobacterium
SPQPPS

SEQ ID NO: 405562 - protein, 7 aa, Mycobacterium
SPQRSRA

SEQ ID NO: 405563 - protein, 4 aa, Mycobacterium
SPRA

SEQ ID NO: 405564 - protein, 6 aa, Mycobacterium
SPRDVA

SEQ ID NO: 405565 - protein, 4 aa, Mycobacterium
SPRE

SEQ ID NO: 405566 - protein, 5 aa, Mycobacterium
SPREE

SEQ ID NO: 405567 - protein, 4 aa, Mycobacterium
SPRG

SEQ ID NO: 405568 - protein, 6 aa, Mycobacterium
SPRGAT

SEQ ID NO: 405569 - protein, 5 aa, Mycobacterium
SPRHA

SEQ ID NO: 405570 - protein, 5 aa, Mycobacterium
SPRHV

SEQ ID NO: 405571 - protein, 5 aa, Mycobacterium
SPRQT

SEQ ID NO: 405572 - protein, 4 aa, Mycobacterium
SPRR

SEQ ID NO: 405573 - protein, 4 aa, Mycobacterium
SPRY

SEQ ID NO: 405574 - protein, 4 aa, Mycobacterium
SPSA

SEQ ID NO: 405575 - protein, 6 aa, Mycobacterium
SPSAEG

SEQ ID NO: 405576 - protein, 4 aa, Mycobacterium
SPSG

SEQ ID NO: 405577 - protein, 14 aa, Mycobacterium
SPSGRQYTTVPGSH

SEQ ID NO: 405578 - protein, 4 aa, Mycobacterium
SPSL

SEQ ID NO: 405579 - protein, 8 aa, Mycobacterium
SPSNPTGA

SEQ ID NO: 405580 - protein, 6 aa, Mycobacterium
SPSPPS

SEQ ID NO: 405581 - protein, 7 aa, Mycobacterium
SPSPSEG

SEQ ID NO: 405582 - protein, 4 aa, Mycobacterium
SPSV

SEQ ID NO: 405583 - protein, 5 aa, Mycobacterium
SPTAP

SEQ ID NO: 405584 - protein, 4 aa, Mycobacterium
SPTE

SEQ ID NO: 405585 - protein, 4 aa, Mycobacterium
SPTF

SEQ ID NO: 405586 - protein, 7 aa, Mycobacterium
SPTGTPH

SEQ ID NO: 405587 - protein, 11 aa, Mycobacterium
SPTIGGHEGSG

SEQ ID NO: 405588 - protein, 5 aa, Mycobacterium
SPTKF

SEQ ID NO: 405589 - protein, 6 aa, Mycobacterium
SPTNRK

SEQ ID NO: 405590 - protein, 9 aa, Mycobacterium
SPTNRRVAG

SEQ ID NO: 405591 - protein, 19 aa, Mycobacterium
SPTPTARKDYIGGAAETAT

SEQ ID NO: 405592 - protein, 5 aa, Mycobacterium
SPTRS

SEQ ID NO: 405593 - protein, 8 aa, Mycobacterium
SPVEQGDE

SEQ ID NO: 405594 - protein, 4 aa, Mycobacterium
SPVG

SEQ ID NO: 405595 - protein, 5 aa, Mycobacterium
SPVGD

SEQ ID NO: 405596 - protein, 7 aa, Mycobacterium
SPVGGGG

SEQ ID NO: 405597 - protein, 6 aa, Mycobacterium
SPVRSL

SEQ ID NO: 405598 - protein, 4 aa, Mycobacterium
SPYD

SEQ ID NO: 405599 - protein, 6 aa, Mycobacterium
SPYENV

SEQ ID NO: 405600 - protein, 5 aa, Mycobacterium
SPYGA

SEQ ID NO: 405601 - protein, 6 aa, Mycobacterium
SQAADR

SEQ ID NO: 405602 - protein, 8 aa, Mycobacterium
SQAEQEAM

SEQ ID NO: 405603 - protein, 4 aa, Mycobacterium
SQAG

SEQ ID NO: 405604 - protein, 5 aa, Mycobacterium
SQAGI

SEQ ID NO: 405605 - protein, 7 aa, Mycobacterium
SQAPHAH

SEQ ID NO: 405606 - protein, 4 aa, Mycobacterium
SQAR

SEQ ID NO: 405607 - protein, 12 aa, Mycobacterium
SQASAAQRAGRC

SEQ ID NO: 405608 - protein, 17 aa, Mycobacterium
SQASAAQRAGRSGRTAP

SEQ ID NO: 405609 - protein, 7 aa, Mycobacterium
SQASRTH

SEQ ID NO: 405610 - protein, 5 aa, Mycobacterium
SQASY

SEQ ID NO: 405611 - protein, 6 aa, Mycobacterium
SQDEGL

SEQ ID NO: 405612 - protein, 4 aa, Mycobacterium
SQDI

SEQ ID NO: 405613 - protein, 4 aa, Mycobacterium
SQDP

SEQ ID NO: 405614 - protein, 4 aa, Mycobacterium
SQDT

SEQ ID NO: 405615 - protein, 5 aa, Mycobacterium
SQENN

SEQ ID NO: 405616 - protein, 6 aa, Mycobacterium
SQERAD

SEQ ID NO: 405617 - protein, 5 aa, Mycobacterium
SQETN

SEQ ID NO: 405618 - protein, 4 aa, Mycobacterium
SQGG

SEQ ID NO: 405619 - protein, 6 aa, Mycobacterium
SQGGFD

SEQ ID NO: 405620 - protein, 10 aa, Mycobacterium
SQGKATTYRA

SEQ ID NO: 405621 - protein, 13 aa, Mycobacterium
SQGLTGRGGDGSA

SEQ ID NO: 405622 - protein, 6 aa, Mycobacterium
SQHDRY

SEQ ID NO: 405623 - protein, 8 aa, Mycobacterium
SQISDGAS

SEQ ID NO: 405624 - protein, 4 aa, Mycobacterium
SQLA

SEQ ID NO: 405625 - protein, 11 aa, Mycobacterium
SQNADKVETAI

SEQ ID NO: 405626 - protein, 9 aa, Mycobacterium
SQNPDDEAA

SEQ ID NO: 405627 - protein, 7 aa, Mycobacterium
SQNPDQL

SEQ ID NO: 405628 - protein, 5 aa, Mycobacterium
SQPEF

SEQ ID NO: 405629 - protein, 6 aa, Mycobacterium
SQPGAA

SEQ ID NO: 405630 - protein, 7 aa, Mycobacterium
SQPLAAQ

SEQ ID NO: 405631 - protein, 4 aa, Mycobacterium
SQPP

SEQ ID NO: 405632 - protein, 5 aa, Mycobacterium
SQPTL

SEQ ID NO: 405633 - protein, 4 aa, Mycobacterium
SQRP

SEQ ID NO: 405634 - protein, 8 aa, Mycobacterium
SQSPASDD

SEQ ID NO: 405635 - protein, 7 aa, Mycobacterium
SQTPSAA

SEQ ID NO: 405636 - protein, 7 aa, Mycobacterium
SQTPSAF

SEQ ID NO: 405637 - protein, 4 aa, Mycobacterium
SQYG

SEQ ID NO: 405638 - protein, 5 aa, Mycobacterium
SQYGL

SEQ ID NO: 405639 - protein, 6 aa, Mycobacterium
SQYTRG

SEQ ID NO: 405640 - protein, 4 aa, Mycobacterium
SRAA

SEQ ID NO: 405641 - protein, 6 aa, Mycobacterium
SRAARR

SEQ ID NO: 405642 - protein, 6 aa, Mycobacterium
SRADGG

SEQ ID NO: 405643 - protein, 15 aa, Mycobacterium
SRAETGDTLSDKSEP

SEQ ID NO: 405644 - protein, 9 aa, Mycobacterium
SRAGIDPKK

SEQ ID NO: 405645 - protein, 9 aa, Mycobacterium
SRAPSLHNS

SEQ ID NO: 405646 - protein, 4 aa, Mycobacterium
SRAQ

SEQ ID NO: 405647 - protein, 5 aa, Mycobacterium
SRASR

SEQ ID NO: 405648 - protein, 4 aa, Mycobacterium
SRAT

SEQ ID NO: 405649 - protein, 8 aa, Mycobacterium
SRAYDRAG

SEQ ID NO: 405650 - protein, 6 aa, Mycobacterium
SRDQDR

SEQ ID NO: 405651 - protein, 4 aa, Mycobacterium
SRDR

SEQ ID NO: 405652 - protein, 5 aa, Mycobacterium
SRDRS

SEQ ID NO: 405653 - protein, 4 aa, Mycobacterium
SRDT

SEQ ID NO: 405654 - protein, 7 aa, Mycobacterium
SREERSA

SEQ ID NO: 405655 - protein, 8 aa, Mycobacterium
SREPLGVP

SEQ ID NO: 405656 - protein, 8 aa, Mycobacterium
SREPNTQI

SEQ ID NO: 405657 - protein, 6 aa, Mycobacterium
SREQAI

SEQ ID NO: 405658 - protein, 6 aa, Mycobacterium
SREQIP

SEQ ID NO: 405659 - protein, 4 aa, Mycobacterium
SRGE

SEQ ID NO: 405660 - protein, 5 aa, Mycobacterium
SRGEH

SEQ ID NO: 405661 - protein, 7 aa, Mycobacterium
SRGGADA

SEQ ID NO: 405662 - protein, 7 aa, Mycobacterium
SRGGATR

SEQ ID NO: 405663 - protein, 6 aa, Mycobacterium
SRGGDI

SEQ ID NO: 405664 - protein, 10 aa, Mycobacterium
SRGGRPDLAG

SEQ ID NO: 405665 - protein, 8 aa, Mycobacterium
SRGGSDAS

SEQ ID NO: 405666 - protein, 6 aa, Mycobacterium
SRGPIV

SEQ ID NO: 405667 - protein, 4 aa, Mycobacterium
SRGR

SEQ ID NO: 405668 - protein, 10 aa, Mycobacterium
SRGRADDTDD

SEQ ID NO: 405669 - protein, 5 aa, Mycobacterium
SRGRI

SEQ ID NO: 405670 - protein, 6 aa, Mycobacterium
SRGRSA

SEQ ID NO: 405671 - protein, 5 aa, Mycobacterium
SRGSM

SEQ ID NO: 405672 - protein, 4 aa, Mycobacterium
SRHG

SEQ ID NO: 405673 - protein, 12 aa, Mycobacterium
SRIEGIGRPRVE

SEQ ID NO: 405674 - protein, 6 aa, Mycobacterium
SRIGRS

SEQ ID NO: 405675 - protein, 11 aa, Mycobacterium
SRKDQDGNDLP

SEQ ID NO: 405676 - protein, 8 aa, Mycobacterium
SRKGDHNH

SEQ ID NO: 405677 - protein, 8 aa, Mycobacterium
SRKTRHGR

SEQ ID NO: 405678 - protein, 4 aa, Mycobacterium
SRLD

SEQ ID NO: 405679 - protein, 6 aa, Mycobacterium
SRLETT

SEQ ID NO: 405680 - protein, 6 aa, Mycobacterium
SRLNPA

SEQ ID NO: 405681 - protein, 8 aa, Mycobacterium
SRLPTGGH

SEQ ID NO: 405682 - protein, 7 aa, Mycobacterium
SRMTGKP

SEQ ID NO: 405683 - protein, 5 aa, Mycobacterium
SRNAP

SEQ ID NO: 405684 - protein, 11 aa, Mycobacterium
SRNSTTINPGT

SEQ ID NO: 405685 - protein, 4 aa, Mycobacterium
SRPD

SEQ ID NO: 405686 - protein, 9 aa, Mycobacterium
SRPDSPNVA

SEQ ID NO: 405687 - protein, 8 aa, Mycobacterium
SRPDTSSR

SEQ ID NO: 405688 - protein, 6 aa, Mycobacterium
SRPGDV

SEQ ID NO: 405689 - protein, 6 aa, Mycobacterium
SRPGND

SEQ ID NO: 405690 - protein, 11 aa, Mycobacterium
SRPGRSALAGN

SEQ ID NO: 405691 - protein, 4 aa, Mycobacterium
SRPL

SEQ ID NO: 405692 - protein, 4 aa, Mycobacterium
SRPV

SEQ ID NO: 405693 - protein, 5 aa, Mycobacterium
SRPVI

SEQ ID NO: 405694 - protein, 5 aa, Mycobacterium
SRQAR

SEQ ID NO: 405695 - protein, 10 aa, Mycobacterium
SRQESEEGVA

SEQ ID NO: 405696 - protein, 5 aa, Mycobacterium
SRQYG

SEQ ID NO: 405697 - protein, 4 aa, Mycobacterium
SRRA

SEQ ID NO: 405698 - protein, 6 aa, Mycobacterium
SRREPG

SEQ ID NO: 405699 - protein, 7 aa, Mycobacterium
SRRGLDP

SEQ ID NO: 405700 - protein, 8 aa, Mycobacterium
SRRPGTGR

SEQ ID NO: 405701 - protein, 4 aa, Mycobacterium
SRRQ

SEQ ID NO: 405702 - protein, 9 aa, Mycobacterium
SRSAPSQKA

SEQ ID NO: 405703 - protein, 5 aa, Mycobacterium
SRSDV

SEQ ID NO: 405704 - protein, 11 aa, Mycobacterium
SRSGAADRRAH

SEQ ID NO: 405705 - protein, 8 aa, Mycobacterium
SRSGEAGA

SEQ ID NO: 405706 - protein, 8 aa, Mycobacterium
SRSGNRQL

SEQ ID NO: 405707 - protein, 4 aa, Mycobacterium
SRSL

SEQ ID NO: 405708 - protein, 6 aa, Mycobacterium
SRSNSQ

SEQ ID NO: 405709 - protein, 10 aa, Mycobacterium
SRSPNPHVGF

SEQ ID NO: 405710 - protein, 8 aa, Mycobacterium
SRSSGNSF

SEQ ID NO: 405711 - protein, 8 aa, Mycobacterium
SRSSPRVG

SEQ ID NO: 405712 - protein, 9 aa, Mycobacterium
SRSTPRAGD

SEQ ID NO: 405713 - protein, 4 aa, Mycobacterium
SRTA

SEQ ID NO: 405714 - protein, 5 aa, Mycobacterium
SRTEH

SEQ ID NO: 405715 - protein, 6 aa, Mycobacterium
SRTPVE

SEQ ID NO: 405716 - protein, 4 aa, Mycobacterium
SRTS

SEQ ID NO: 405717 - protein, 6 aa, Mycobacterium
SRTSVP

SEQ ID NO: 405718 - protein, 5 aa, Mycobacterium
SRTTA

SEQ ID NO: 405719 - protein, 7 aa, Mycobacterium
SRTTHSR

SEQ ID NO: 405720 - protein, 6 aa, Mycobacterium
SRVERA

SEQ ID NO: 405721 - protein, 4 aa, Mycobacterium
SRVG

SEQ ID NO: 405722 - protein, 7 aa, Mycobacterium
SRVRAQS

SEQ ID NO: 405723 - protein, 5 aa, Mycobacterium
SRYAE

SEQ ID NO: 405724 - protein, 5 aa, Mycobacterium
SRYDE

SEQ ID NO: 405725 - protein, 6 aa, Mycobacterium
SRYGAA

SEQ ID NO: 405726 - protein, 21 aa, Mycobacterium
SRYLGGSAATTVGATAVGPSI

SEQ ID NO: 405727 - protein, 8 aa, Mycobacterium
SRYPLDRG

SEQ ID NO: 405728 - protein, 16 aa, Mycobacterium
SRYRSNALAQEKTGEA

SEQ ID NO: 405729 - protein, 8 aa, Mycobacterium
SSAEETAK

SEQ ID NO: 405730 - protein, 6 aa, Mycobacterium
SSAFER

SEQ ID NO: 405731 - protein, 6 aa, Mycobacterium
SSAGAA

SEQ ID NO: 405732 - protein, 6 aa, Mycobacterium
SSANAH

SEQ ID NO: 405733 - protein, 4 aa, Mycobacterium
SSAP

SEQ ID NO: 405734 - protein, 13 aa, Mycobacterium
SSAPPGSGLGSSS

SEQ ID NO: 405735 - protein, 9 aa, Mycobacterium
SSAQRGSPF

SEQ ID NO: 405736 - protein, 7 aa, Mycobacterium
SSARDAV

SEQ ID NO: 405737 - protein, 12 aa, Mycobacterium
SSASAGPGTRAN

SEQ ID NO: 405738 - protein, 11 aa, Mycobacterium
SSASKSKVIAD

SEQ ID NO: 405739 - protein, 6 aa, Mycobacterium
SSASSY

SEQ ID NO: 405740 - protein, 9 aa, Mycobacterium
SSATTESES

SEQ ID NO: 405741 - protein, 6 aa, Mycobacterium
SSATVR

SEQ ID NO: 405742 - protein, 5 aa, Mycobacterium
SSDDG

SEQ ID NO: 405743 - protein, 7 aa, Mycobacterium
SSDDSAA

SEQ ID NO: 405744 - protein, 4 aa, Mycobacterium
SSDL

SEQ ID NO: 405745 - protein, 6 aa, Mycobacterium
SSDPAA

SEQ ID NO: 405746 - protein, 7 aa, Mycobacterium
SSDPAEV

SEQ ID NO: 405747 - protein, 7 aa, Mycobacterium
SSDPALR

SEQ ID NO: 405748 - protein, 8 aa, Mycobacterium
SSEPSASV

SEQ ID NO: 405749 - protein, 5 aa, Mycobacterium
SSEQA

SEQ ID NO: 405750 - protein, 5 aa, Mycobacterium
SSERS

SEQ ID NO: 405751 - protein, 4 aa, Mycobacterium
SSFM

SEQ ID NO: 405752 - protein, 6 aa, Mycobacterium
SSFNGT

SEQ ID NO: 405753 - protein, 7 aa, Mycobacterium
SSFSGTE

SEQ ID NO: 405754 - protein, 4 aa, Mycobacterium
SSFV

SEQ ID NO: 405755 - protein, 4 aa, Mycobacterium
SSFY

SEQ ID NO: 405756 - protein, 7 aa, Mycobacterium
SSFYPGR

SEQ ID NO: 405757 - protein, 12 aa, Mycobacterium
SSGKRDPRELST

SEQ ID NO: 405758 - protein, 14 aa, Mycobacterium
SSGKRDPRELSTQQ

SEQ ID NO: 405759 - protein, 4 aa, Mycobacterium
SSGM

SEQ ID NO: 405760 - protein, 7 aa, Mycobacterium
SSGNHAQ

SEQ ID NO: 405761 - protein, 9 aa, Mycobacterium
SSGSGKTTA

SEQ ID NO: 405762 - protein, 8 aa, Mycobacterium
SSGSTGVP

SEQ ID NO: 405763 - protein, 8 aa, Mycobacterium
SSGSTRLP

SEQ ID NO: 405764 - protein, 10 aa, Mycobacterium
SSGSTRTPTG

SEQ ID NO: 405765 - protein, 16 aa, Mycobacterium
SSGSYAATEAANAAAA

SEQ ID NO: 405766 - protein, 5 aa, Mycobacterium
SSGTC

SEQ ID NO: 405767 - protein, 7 aa, Mycobacterium
SSHASAA

SEQ ID NO: 405768 - protein, 6 aa, Mycobacterium
SSIESN

SEQ ID NO: 405769 - protein, 7 aa, Mycobacterium
SSIGSGV

SEQ ID NO: 405770 - protein, 4 aa, Mycobacterium
SSIH

SEQ ID NO: 405771 - protein, 4 aa, Mycobacterium
SSIQ

SEQ ID NO: 405772 - protein, 8 aa, Mycobacterium
SSKPENVP

SEQ ID NO: 405773 - protein, 4 aa, Mycobacterium
SSLA

SEQ ID NO: 405774 - protein, 5 aa, Mycobacterium
SSLER

SEQ ID NO: 405775 - protein, 5 aa, Mycobacterium
SSNFE

SEQ ID NO: 405776 - protein, 5 aa, Mycobacterium
SSNGV

SEQ ID NO: 405777 - protein, 4 aa, Mycobacterium
SSNK

SEQ ID NO: 405778 - protein, 6 aa, Mycobacterium
SSNLSQ

SEQ ID NO: 405779 - protein, 8 aa, Mycobacterium
SSNPDRTA

SEQ ID NO: 405780 - protein, 19 aa, Mycobacterium
SSNPTAGGAAVGSGIGPTR

SEQ ID NO: 405781 - protein, 11 aa, Mycobacterium
SSNTLHGGQET

SEQ ID NO: 405782 - protein, 8 aa, Mycobacterium
SSPARALR

SEQ ID NO: 405783 - protein, 5 aa, Mycobacterium
SSPDA

SEQ ID NO: 405784 - protein, 8 aa, Mycobacterium
SSPEGCQT

SEQ ID NO: 405785 - protein, 4 aa, Mycobacterium
SSPG

SEQ ID NO: 405786 - protein, 9 aa, Mycobacterium
SSPGSGKTT

SEQ ID NO: 405787 - protein, 10 aa, Mycobacterium
SSPGSGKTTV

SEQ ID NO: 405788 - protein, 5 aa, Mycobacterium
SSPGY

SEQ ID NO: 405789 - protein, 6 aa, Mycobacterium
SSPHLD

SEQ ID NO: 405790 - protein, 5 aa, Mycobacterium
SSPNA

SEQ ID NO: 405791 - protein, 15 aa, Mycobacterium
SSPTAGRAGAGGHPC

SEQ ID NO: 405792 - protein, 5 aa, Mycobacterium
SSPTG

SEQ ID NO: 405793 - protein, 4 aa, Mycobacterium
SSPW

SEQ ID NO: 405794 - protein, 5 aa, Mycobacterium
SSPWT

SEQ ID NO: 405795 - protein, 9 aa, Mycobacterium
SSQGGGSKD

SEQ ID NO: 405796 - protein, 7 aa, Mycobacterium
SSREMTH

SEQ ID NO: 405797 - protein, 5 aa, Mycobacterium
SSRGH

SEQ ID NO: 405798 - protein, 4 aa, Mycobacterium
SSRH

SEQ ID NO: 405799 - protein, 6 aa, Mycobacterium
SSRRAE

SEQ ID NO: 405800 - protein, 4 aa, Mycobacterium
SSRT

SEQ ID NO: 405801 - protein, 8 aa, Mycobacterium
SSSANTRE

SEQ ID NO: 405802 - protein, 10 aa, Mycobacterium
SSSGRDESYR

SEQ ID NO: 405803 - protein, 7 aa, Mycobacterium
SSSLGVH

SEQ ID NO: 405804 - protein, 6 aa, Mycobacterium
SSSMGA

SEQ ID NO: 405805 - protein, 5 aa, Mycobacterium
SSSPV

SEQ ID NO: 405806 - protein, 7 aa, Mycobacterium
SSSSAAD

SEQ ID NO: 405807 - protein, 8 aa, Mycobacterium
SSSSTAES

SEQ ID NO: 405808 - protein, 10 aa, Mycobacterium
SSSSTHSGAP

SEQ ID NO: 405809 - protein, 11 aa, Mycobacterium
SSSSTHSGQPY

SEQ ID NO: 405810 - protein, 5 aa, Mycobacterium
SSSTV

SEQ ID NO: 405811 - protein, 8 aa, Mycobacterium
SSTDGVGT

SEQ ID NO: 405812 - protein, 4 aa, Mycobacterium
SSTG

SEQ ID NO: 405813 - protein, 7 aa, Mycobacterium
SSTPERL

SEQ ID NO: 405814 - protein, 7 aa, Mycobacterium
SSVASGR

SEQ ID NO: 405815 - protein, 9 aa, Mycobacterium
SSVDPDQAS

SEQ ID NO: 405816 - protein, 10 aa, Mycobacterium
SSVDPDQASR

SEQ ID NO: 405817 - protein, 14 aa, Mycobacterium
SSVERRGKNADQDA

SEQ ID NO: 405818 - protein, 4 aa, Mycobacterium
SSVT

SEQ ID NO: 405819 - protein, 6 aa, Mycobacterium
SSVTSE

SEQ ID NO: 405820 - protein, 4 aa, Mycobacterium
SSYA

SEQ ID NO: 405821 - protein, 6 aa, Mycobacterium
STAAAV

SEQ ID NO: 405822 - protein, 8 aa, Mycobacterium
STAAESNA

SEQ ID NO: 405823 - protein, 5 aa, Mycobacterium
STAAP

SEQ ID NO: 405824 - protein, 10 aa, Mycobacterium
STADGSGTTI

SEQ ID NO: 405825 - protein, 7 aa, Mycobacterium
STAEAVG

SEQ ID NO: 405826 - protein, 8 aa, Mycobacterium
STAESAAT

SEQ ID NO: 405827 - protein, 7 aa, Mycobacterium
STAGLRG

SEQ ID NO: 405828 - protein, 4 aa, Mycobacterium
STAR

SEQ ID NO: 405829 - protein, 6 aa, Mycobacterium
STASSY

SEQ ID NO: 405830 - protein, 8 aa, Mycobacterium
STDASGRY

SEQ ID NO: 405831 - protein, 4 aa, Mycobacterium
STDE

SEQ ID NO: 405832 - protein, 8 aa, Mycobacterium
STDIPAQA

SEQ ID NO: 405833 - protein, 7 aa, Mycobacterium
STDPDGR

SEQ ID NO: 405834 - protein, 15 aa, Mycobacterium
STDTRPEELKSQGVR

SEQ ID NO: 405835 - protein, 4 aa, Mycobacterium
STDV

SEQ ID NO: 405836 - protein, 11 aa, Mycobacterium
STEDGQRFSDS

SEQ ID NO: 405837 - protein, 7 aa, Mycobacterium
STEDGTG

SEQ ID NO: 405838 - protein, 6 aa, Mycobacterium
STEPAV

SEQ ID NO: 405839 - protein, 8 aa, Mycobacterium
STEQHGPH

SEQ ID NO: 405840 - protein, 17 aa, Mycobacterium
STEQSAQLKAALRKGRR

SEQ ID NO: 405841 - protein, 16 aa, Mycobacterium
STEQSVTGGRETFGEP

SEQ ID NO: 405842 - protein, 4 aa, Mycobacterium
STES

SEQ ID NO: 405843 - protein, 10 aa, Mycobacterium
STESPPGTLD

SEQ ID NO: 405844 - protein, 7 aa, Mycobacterium
STFGGNP

SEQ ID NO: 405845 - protein, 5 aa, Mycobacterium
STGGE

SEQ ID NO: 405846 - protein, 7 aa, Mycobacterium
STGGSPL

SEQ ID NO: 405847 - protein, 4 aa, Mycobacterium
STGR

SEQ ID NO: 405848 - protein, 17 aa, Mycobacterium
STGSSIMPQKKNPDIAE

SEQ ID NO: 405849 - protein, 10 aa, Mycobacterium
STGSTAKTIA

SEQ ID NO: 405850 - protein, 7 aa, Mycobacterium
STHEDGS

SEQ ID NO: 405851 - protein, 5 aa, Mycobacterium
STIDD

SEQ ID NO: 405852 - protein, 6 aa, Mycobacterium
STIGGY

SEQ ID NO: 405853 - protein, 13 aa, Mycobacterium
STKAKTATAENIS

SEQ ID NO: 405854 - protein, 4 aa, Mycobacterium
STKH

SEQ ID NO: 405855 - protein, 4 aa, Mycobacterium
STLA

SEQ ID NO: 405856 - protein, 14 aa, Mycobacterium
STLNPPGSLTAPMP

SEQ ID NO: 405857 - protein, 8 aa, Mycobacterium
STLPTPAL

SEQ ID NO: 405858 - protein, 9 aa, Mycobacterium
STLTRRDQG

SEQ ID NO: 405859 - protein, 8 aa, Mycobacterium
STMDSPVT

SEQ ID NO: 405860 - protein, 9 aa, Mycobacterium
STNDAATLD

SEQ ID NO: 405861 - protein, 5 aa, Mycobacterium
STPDG

SEQ ID NO: 405862 - protein, 7 aa, Mycobacterium
STPDGDE

SEQ ID NO: 405863 - protein, 17 aa, Mycobacterium
STPDGDYQTYKANDGAY

SEQ ID NO: 405864 - protein, 8 aa, Mycobacterium
STPGFSDE

SEQ ID NO: 405865 - protein, 4 aa, Mycobacterium
STPL

SEQ ID NO: 405866 - protein, 7 aa, Mycobacterium
STPLDRS

SEQ ID NO: 405867 - protein, 9 aa, Mycobacterium
STPMPPGED

SEQ ID NO: 405868 - protein, 4 aa, Mycobacterium
STRA

SEQ ID NO: 405869 - protein, 4 aa, Mycobacterium
STRE

SEQ ID NO: 405870 - protein, 5 aa, Mycobacterium
STRGE

SEQ ID NO: 405871 - protein, 9 aa, Mycobacterium
STRRPDGTR

SEQ ID NO: 405872 - protein, 5 aa, Mycobacterium
STRTE

SEQ ID NO: 405873 - protein, 9 aa, Mycobacterium
STSGNSPNL

SEQ ID NO: 405874 - protein, 6 aa, Mycobacterium
STSGTL

SEQ ID NO: 405875 - protein, 5 aa, Mycobacterium
STSPP

SEQ ID NO: 405876 - protein, 6 aa, Mycobacterium
STSRTM

SEQ ID NO: 405877 - protein, 4 aa, Mycobacterium
STST

SEQ ID NO: 405878 - protein, 4 aa, Mycobacterium
STTD

SEQ ID NO: 405879 - protein, 6 aa, Mycobacterium
STTFPV

SEQ ID NO: 405880 - protein, 5 aa, Mycobacterium
STTGF

SEQ ID NO: 405881 - protein, 20 aa, Mycobacterium
STTHAQLSPAEQLSTGVSPG

SEQ ID NO: 405882 - protein, 12 aa, Mycobacterium
STTTEFERRPRV

SEQ ID NO: 405883 - protein, 5 aa, Mycobacterium
STTVE

SEQ ID NO: 405884 - protein, 6 aa, Mycobacterium
STVATA

SEQ ID NO: 405885 - protein, 5 aa, Mycobacterium
STVDE

SEQ ID NO: 405886 - protein, 4 aa, Mycobacterium
STVE

SEQ ID NO: 405887 - protein, 14 aa, Mycobacterium
STVEAQDRAGTDVA

SEQ ID NO: 405888 - protein, 4 aa, Mycobacterium
STVP

SEQ ID NO: 405889 - protein, 5 aa, Mycobacterium
STVPE

SEQ ID NO: 405890 - protein, 11 aa, Mycobacterium
STYESAETQTA

SEQ ID NO: 405891 - protein, 17 aa, Mycobacterium
STYPGGGNLGGFGEGGV

SEQ ID NO: 405892 - protein, 5 aa, Mycobacterium
STYVR

SEQ ID NO: 405893 - protein, 7 aa, Mycobacterium
SVADADR

SEQ ID NO: 405894 - protein, 7 aa, Mycobacterium
SVADAED

SEQ ID NO: 405895 - protein, 8 aa, Mycobacterium
SVAEGGKR

SEQ ID NO: 405896 - protein, 12 aa, Mycobacterium
SVARGGGRTSYR

SEQ ID NO: 405897 - protein, 5 aa, Mycobacterium
SVASG

SEQ ID NO: 405898 - protein, 4 aa, Mycobacterium
SVDA

SEQ ID NO: 405899 - protein, 11 aa, Mycobacterium
SVDTGTPTGRA

SEQ ID NO: 405900 - protein, 11 aa, Mycobacterium
SVEVADNGRGI

SEQ ID NO: 405901 - protein, 8 aa, Mycobacterium
SVGATSPP

SEQ ID NO: 405902 - protein, 6 aa, Mycobacterium
SVGEIQ

SEQ ID NO: 405903 - protein, 6 aa, Mycobacterium
SVGGGV

SEQ ID NO: 405904 - protein, 5 aa, Mycobacterium
SVGPT

SEQ ID NO: 405905 - protein, 8 aa, Mycobacterium
SVGRGRHQ

SEQ ID NO: 405906 - protein, 6 aa, Mycobacterium
SVHNSQ

SEQ ID NO: 405907 - protein, 8 aa, Mycobacterium
SVKEPLQT

SEQ ID NO: 405908 - protein, 4 aa, Mycobacterium
SVLD

SEQ ID NO: 405909 - protein, 4 aa, Mycobacterium
SVNP

SEQ ID NO: 405910 - protein, 7 aa, Mycobacterium
SVNRGAA

SEQ ID NO: 405911 - protein, 10 aa, Mycobacterium
SVPDPAPQDG

SEQ ID NO: 405912 - protein, 9 aa, Mycobacterium
SVPDTSHLP

SEQ ID NO: 405913 - protein, 6 aa, Mycobacterium
SVPEPA

SEQ ID NO: 405914 - protein, 5 aa, Mycobacterium
SVPGA

SEQ ID NO: 405915 - protein, 12 aa, Mycobacterium
SVPGDRARWDAD

SEQ ID NO: 405916 - protein, 5 aa, Mycobacterium
SVPPQ

SEQ ID NO: 405917 - protein, 8 aa, Mycobacterium
SVPTPADV

SEQ ID NO: 405918 - protein, 5 aa, Mycobacterium
SVQEA

SEQ ID NO: 405919 - protein, 8 aa, Mycobacterium
SVQGPFAG

SEQ ID NO: 405920 - protein, 4 aa, Mycobacterium
SVRA

SEQ ID NO: 405921 - protein, 9 aa, Mycobacterium
SVRDPDTTV

SEQ ID NO: 405922 - protein, 6 aa, Mycobacterium
SVRDPR

SEQ ID NO: 405923 - protein, 9 aa, Mycobacterium
SVRGKVGDA

SEQ ID NO: 405924 - protein, 6 aa, Mycobacterium
SVRPDD

SEQ ID NO: 405925 - protein, 4 aa, Mycobacterium
SVSV

SEQ ID NO: 405926 - protein, 7 aa, Mycobacterium
SVTDEYR

SEQ ID NO: 405927 - protein, 8 aa, Mycobacterium
SVTQGMET

SEQ ID NO: 405928 - protein, 4 aa, Mycobacterium
SVTS

SEQ ID NO: 405929 - protein, 5 aa, Mycobacterium
SVTTE

SEQ ID NO: 405930 - protein, 7 aa, Mycobacterium
SVWTPEP

SEQ ID NO: 405931 - protein, 5 aa, Mycobacterium
SWADY

SEQ ID NO: 405932 - protein, 11 aa, Mycobacterium
SWDNGKPIRET

SEQ ID NO: 405933 - protein, 4 aa, Mycobacterium
SWGA

SEQ ID NO: 405934 - protein, 9 aa, Mycobacterium
SWGATGPDA

SEQ ID NO: 405935 - protein, 5 aa, Mycobacterium
SWPLG

SEQ ID NO: 405936 - protein, 6 aa, Mycobacterium
SWPPGT

SEQ ID NO: 405937 - protein, 6 aa, Mycobacterium
SYAGRG

SEQ ID NO: 405938 - protein, 4 aa, Mycobacterium
SYDG

SEQ ID NO: 405939 - protein, 15 aa, Mycobacterium
SYDGQGCSISQAATS

SEQ ID NO: 405940 - protein, 16 aa, Mycobacterium
SYDGQGCSISQASTSV

SEQ ID NO: 405941 - protein, 8 aa, Mycobacterium
SYESKPYR

SEQ ID NO: 405942 - protein, 6 aa, Mycobacterium
SYETSF

SEQ ID NO: 405943 - protein, 13 aa, Mycobacterium
SYGPQSDGSLGPE

SEQ ID NO: 405944 - protein, 4 aa, Mycobacterium
SYGV

SEQ ID NO: 405945 - protein, 10 aa, Mycobacterium
SYPDDADEFG

SEQ ID NO: 405946 - protein, 5 aa, Mycobacterium
SYPDE

SEQ ID NO: 405947 - protein, 6 aa, Mycobacterium
SYPGAR

SEQ ID NO: 405948 - protein, 6 aa, Mycobacterium
SYPGHH

SEQ ID NO: 405949 - protein, 7 aa, Mycobacterium
SYPTFTP

SEQ ID NO: 405950 - protein, 4 aa, Mycobacterium
SYRA

SEQ ID NO: 405951 - protein, 6 aa, Mycobacterium
SYSGTE

SEQ ID NO: 405952 - protein, 5 aa, Mycobacterium
TAAAQ

SEQ ID NO: 405953 - protein, 4 aa, Mycobacterium
TAAE

SEQ ID NO: 405954 - protein, 15 aa, Mycobacterium
TAAGKSQIGGASNAG

SEQ ID NO: 405955 - protein, 10 aa, Mycobacterium
TAAGSGCSAA

SEQ ID NO: 405956 - protein, 7 aa, Mycobacterium
TAAGTGE

SEQ ID NO: 405957 - protein, 7 aa, Mycobacterium
TAAGTSC

SEQ ID NO: 405958 - protein, 9 aa, Mycobacterium
TAAGVGAQA

SEQ ID NO: 405959 - protein, 4 aa, Mycobacterium
TAAK

SEQ ID NO: 405960 - protein, 4 aa, Mycobacterium
TAAL

SEQ ID NO: 405961 - protein, 5 aa, Mycobacterium
TAALG

SEQ ID NO: 405962 - protein, 4 aa, Mycobacterium
TAAN

SEQ ID NO: 405963 - protein, 9 aa, Mycobacterium
TAANQDGHT

SEQ ID NO: 405964 - protein, 10 aa, Mycobacterium
TAANQDGRTV

SEQ ID NO: 405965 - protein, 5 aa, Mycobacterium
TAAPL

SEQ ID NO: 405966 - protein, 4 aa, Mycobacterium
TAAQ

SEQ ID NO: 405967 - protein, 6 aa, Mycobacterium
TAAQRG

SEQ ID NO: 405968 - protein, 5 aa, Mycobacterium
TAARQ

SEQ ID NO: 405969 - protein, 6 aa, Mycobacterium
TAASSA

SEQ ID NO: 405970 - protein, 4 aa, Mycobacterium
TAAT

SEQ ID NO: 405971 - protein, 9 aa, Mycobacterium
TAATITPAG

SEQ ID NO: 405972 - protein, 8 aa, Mycobacterium
TADFTGST

SEQ ID NO: 405973 - protein, 4 aa, Mycobacterium
TADG

SEQ ID NO: 405974 - protein, 16 aa, Mycobacterium
TADGAGGAGGAGGSGG

SEQ ID NO: 405975 - protein, 8 aa, Mycobacterium
TADGKEIA

SEQ ID NO: 405976 - protein, 13 aa, Mycobacterium
TADGRDGYPVEPG

SEQ ID NO: 405977 - protein, 4 aa, Mycobacterium
TADI

SEQ ID NO: 405978 - protein, 4 aa, Mycobacterium
TADL

SEQ ID NO: 405979 - protein, 6 aa, Mycobacterium
TADNGA

SEQ ID NO: 405980 - protein, 5 aa, Mycobacterium
TADNN

SEQ ID NO: 405981 - protein, 6 aa, Mycobacterium
TADPAH

SEQ ID NO: 405982 - protein, 8 aa, Mycobacterium
TADPASAS

SEQ ID NO: 405983 - protein, 4 aa, Mycobacterium
TADQ

SEQ ID NO: 405984 - protein, 7 aa, Mycobacterium
TADRSRP

SEQ ID NO: 405985 - protein, 10 aa, Mycobacterium
TADVPEPAAA

SEQ ID NO: 405986 - protein, 6 aa, Mycobacterium
TAEAPN

SEQ ID NO: 405987 - protein, 4 aa, Mycobacterium
TAED

SEQ ID NO: 405988 - protein, 6 aa, Mycobacterium
TAEDDV

SEQ ID NO: 405989 - protein, 5 aa, Mycobacterium
TAEEA

SEQ ID NO: 405990 - protein, 8 aa, Mycobacterium
TAEEAKDY

SEQ ID NO: 405991 - protein, 5 aa, Mycobacterium
TAEEL

SEQ ID NO: 405992 - protein, 5 aa, Mycobacterium
TAEEV

SEQ ID NO: 405993 - protein, 10 aa, Mycobacterium
TAEGDEMQAA

SEQ ID NO: 405994 - protein, 12 aa, Mycobacterium
TAEGSPATADGV

SEQ ID NO: 405995 - protein, 4 aa, Mycobacterium
TAEH

SEQ ID NO: 405996 - protein, 6 aa, Mycobacterium
TAELSQ

SEQ ID NO: 405997 - protein, 5 aa, Mycobacterium
TAEPE

SEQ ID NO: 405998 - protein, 8 aa, Mycobacterium
TAEPPGLG

SEQ ID NO: 405999 - protein, 5 aa, Mycobacterium
TAEQA

SEQ ID NO: 406000 - protein, 8 aa, Mycobacterium
TAERRAAT

SEQ ID NO: 406001 - protein, 7 aa, Mycobacterium
TAESGPA

SEQ ID NO: 406002 - protein, 7 aa, Mycobacterium
TAESPQR

SEQ ID NO: 406003 - protein, 4 aa, Mycobacterium
TAEV

SEQ ID NO: 406004 - protein, 6 aa, Mycobacterium
TAEVGD

SEQ ID NO: 406005 - protein, 6 aa, Mycobacterium
TAEVGE

SEQ ID NO: 406006 - protein, 4 aa, Mycobacterium
TAFP

SEQ ID NO: 406007 - protein, 6 aa, Mycobacterium
TAFPTD

SEQ ID NO: 406008 - protein, 6 aa, Mycobacterium
TAGADR

SEQ ID NO: 406009 - protein, 7 aa, Mycobacterium
TAGCEKR

SEQ ID NO: 406010 - protein, 5 aa, Mycobacterium
TAGEP

SEQ ID NO: 406011 - protein, 4 aa, Mycobacterium
TAGF

SEQ ID NO: 406012 - protein, 19 aa, Mycobacterium
TAGGGIAKRTLTKSGPHDL

SEQ ID NO: 406013 - protein, 10 aa, Mycobacterium
TAGGSQADPE

SEQ ID NO: 406014 - protein, 4 aa, Mycobacterium
TAGM

SEQ ID NO: 406015 - protein, 13 aa, Mycobacterium
TAGNSSGTNDAAA

SEQ ID NO: 406016 - protein, 4 aa, Mycobacterium
TAGP

SEQ ID NO: 406017 - protein, 6 aa, Mycobacterium
TAGPDA

SEQ ID NO: 406018 - protein, 8 aa, Mycobacterium
TAGPGQPF

SEQ ID NO: 406019 - protein, 6 aa, Mycobacterium
TAGPVD

SEQ ID NO: 406020 - protein, 13 aa, Mycobacterium
TAGPWESEQTHDS

SEQ ID NO: 406021 - protein, 7 aa, Mycobacterium
TAGSAEK

SEQ ID NO: 406022 - protein, 8 aa, Mycobacterium
TAGSVGRN

SEQ ID NO: 406023 - protein, 12 aa, Mycobacterium
TAGTSSQISDGA

SEQ ID NO: 406024 - protein, 5 aa, Mycobacterium
TAGVD

SEQ ID NO: 406025 - protein, 4 aa, Mycobacterium
TAIG

SEQ ID NO: 406026 - protein, 17 aa, Mycobacterium
TAISDGDSVTILPAVAG

SEQ ID NO: 406027 - protein, 5 aa, Mycobacterium
TAKPY

SEQ ID NO: 406028 - protein, 7 aa, Mycobacterium
TAKSPDE

SEQ ID NO: 406029 - protein, 6 aa, Mycobacterium
TALAGG

SEQ ID NO: 406030 - protein, 6 aa, Mycobacterium
TALGNP

SEQ ID NO: 406031 - protein, 11 aa, Mycobacterium
TALGTGRGEEL

SEQ ID NO: 406032 - protein, 5 aa, Mycobacterium
TALRD

SEQ ID NO: 406033 - protein, 9 aa, Mycobacterium
TALTTPSGV

SEQ ID NO: 406034 - protein, 8 aa, Mycobacterium
TAMPPGED

SEQ ID NO: 406035 - protein, 14 aa, Mycobacterium
TAMTSYSSTSAAAR

SEQ ID NO: 406036 - protein, 13 aa, Mycobacterium
TANGKAHGLADPT

SEQ ID NO: 406037 - protein, 14 aa, Mycobacterium
TANGKAHGLGDPSG

SEQ ID NO: 406038 - protein, 17 aa, Mycobacterium
TANGKLDRRGLPAPQFS

SEQ ID NO: 406039 - protein, 5 aa, Mycobacterium
TANRT

SEQ ID NO: 406040 - protein, 5 aa, Mycobacterium
TAPAA

SEQ ID NO: 406041 - protein, 8 aa, Mycobacterium
TAPAEYDQ

SEQ ID NO: 406042 - protein, 8 aa, Mycobacterium
TAPAPHHT

SEQ ID NO: 406043 - protein, 9 aa, Mycobacterium
TAPAPHHTR

SEQ ID NO: 406044 - protein, 4 aa, Mycobacterium
TAPD

SEQ ID NO: 406045 - protein, 6 aa, Mycobacterium
TAPDGS

SEQ ID NO: 406046 - protein, 4 aa, Mycobacterium
TAPG

SEQ ID NO: 406047 - protein, 7 aa, Mycobacterium
TAPGHDG

SEQ ID NO: 406048 - protein, 10 aa, Mycobacterium
TAPKSNAVTT

SEQ ID NO: 406049 - protein, 11 aa, Mycobacterium
TAPKSNAVTTA

SEQ ID NO: 406050 - protein, 6 aa, Mycobacterium
TAPRAR

SEQ ID NO: 406051 - protein, 6 aa, Mycobacterium
TAPTEV

SEQ ID NO: 406052 - protein, 7 aa, Mycobacterium
TAPTLGA

SEQ ID NO: 406053 - protein, 4 aa, Mycobacterium
TAQA

SEQ ID NO: 406054 - protein, 7 aa, Mycobacterium
TAQAERA

SEQ ID NO: 406055 - protein, 4 aa, Mycobacterium
TAQE

SEQ ID NO: 406056 - protein, 10 aa, Mycobacterium
TAQQHGQHGE

SEQ ID NO: 406057 - protein, 7 aa, Mycobacterium
TAQRALD

SEQ ID NO: 406058 - protein, 6 aa, Mycobacterium
TAQRDR

SEQ ID NO: 406059 - protein, 4 aa, Mycobacterium
TAQS

SEQ ID NO: 406060 - protein, 7 aa, Mycobacterium
TAQSDRI

SEQ ID NO: 406061 - protein, 4 aa, Mycobacterium
TARA

SEQ ID NO: 406062 - protein, 5 aa, Mycobacterium
TARAA

SEQ ID NO: 406063 - protein, 6 aa, Mycobacterium
TARAAE

SEQ ID NO: 406064 - protein, 8 aa, Mycobacterium
TARAAGVT

SEQ ID NO: 406065 - protein, 5 aa, Mycobacterium
TARAT

SEQ ID NO: 406066 - protein, 6 aa, Mycobacterium
TAREEL

SEQ ID NO: 406067 - protein, 6 aa, Mycobacterium
TARGDD

SEQ ID NO: 406068 - protein, 13 aa, Mycobacterium
TARRGTPAQAATA

SEQ ID NO: 406069 - protein, 6 aa, Mycobacterium
TARRTY

SEQ ID NO: 406070 - protein, 4 aa, Mycobacterium
TARV

SEQ ID NO: 406071 - protein, 8 aa, Mycobacterium
TASAEEKA

SEQ ID NO: 406072 - protein, 8 aa, Mycobacterium
TASEAGLV

SEQ ID NO: 406073 - protein, 9 aa, Mycobacterium
TASGRTPGL

SEQ ID NO: 406074 - protein, 4 aa, Mycobacterium
TASL

SEQ ID NO: 406075 - protein, 9 aa, Mycobacterium
TASNPGPVV

SEQ ID NO: 406076 - protein, 5 aa, Mycobacterium
TASRI

SEQ ID NO: 406077 - protein, 10 aa, Mycobacterium
TASSGAGALR

SEQ ID NO: 406078 - protein, 25 aa, Mycobacterium
TASTGRPHRRKERIPPGPAAKAAAA

SEQ ID NO: 406079 - protein, 8 aa, Mycobacterium
TATAAGAR

SEQ ID NO: 406080 - protein, 6 aa, Mycobacterium
TATAKK

SEQ ID NO: 406081 - protein, 6 aa, Mycobacterium
TATAPN

SEQ ID NO: 406082 - protein, 5 aa, Mycobacterium
TATER

SEQ ID NO: 406083 - protein, 6 aa, Mycobacterium
TATGAP

SEQ ID NO: 406084 - protein, 6 aa, Mycobacterium
TATGAY

SEQ ID NO: 406085 - protein, 7 aa, Mycobacterium
TATGEPD

SEQ ID NO: 406086 - protein, 13 aa, Mycobacterium
TATGGQAGQSSRI

SEQ ID NO: 406087 - protein, 5 aa, Mycobacterium
TATGL

SEQ ID NO: 406088 - protein, 6 aa, Mycobacterium
TATGSV

SEQ ID NO: 406089 - protein, 6 aa, Mycobacterium
TATPGY

SEQ ID NO: 406090 - protein, 4 aa, Mycobacterium
TATR

SEQ ID NO: 406091 - protein, 9 aa, Mycobacterium
TATRQSRKG

SEQ ID NO: 406092 - protein, 8 aa, Mycobacterium
TATSGSDP

SEQ ID NO: 406093 - protein, 6 aa, Mycobacterium
TATTES

SEQ ID NO: 406094 - protein, 5 aa, Mycobacterium
TAVAG

SEQ ID NO: 406095 - protein, 7 aa, Mycobacterium
TAVRDGD

SEQ ID NO: 406096 - protein, 7 aa, Mycobacterium
TAYEPGT

SEQ ID NO: 406097 - protein, 12 aa, Mycobacterium
TAYGEGGPYSDR

SEQ ID NO: 406098 - protein, 10 aa, Mycobacterium
TAYGSNDTVY

SEQ ID NO: 406099 - protein, 7 aa, Mycobacterium
TCPSSDG

SEQ ID NO: 406100 - protein, 5 aa, Mycobacterium
TCRTP

SEQ ID NO: 406101 - protein, 8 aa, Mycobacterium
TDADPSMA

SEQ ID NO: 406102 - protein, 5 aa, Mycobacterium
TDADT

SEQ ID NO: 406103 - protein, 7 aa, Mycobacterium
TDAEAAN

SEQ ID NO: 406104 - protein, 8 aa, Mycobacterium
TDAEPGRR

SEQ ID NO: 406105 - protein, 6 aa, Mycobacterium
TDAEST

SEQ ID NO: 406106 - protein, 4 aa, Mycobacterium
TDAG

SEQ ID NO: 406107 - protein, 6 aa, Mycobacterium
TDAGRR

SEQ ID NO: 406108 - protein, 4 aa, Mycobacterium
TDAH

SEQ ID NO: 406109 - protein, 8 aa, Mycobacterium
TDAKPGVS

SEQ ID NO: 406110 - protein, 13 aa, Mycobacterium
TDAPAIPHGRNAD

SEQ ID NO: 406111 - protein, 7 aa, Mycobacterium
TDAPGEL

SEQ ID NO: 406112 - protein, 6 aa, Mycobacterium
TDASAN

SEQ ID NO: 406113 - protein, 6 aa, Mycobacterium
TDASGN

SEQ ID NO: 406114 - protein, 6 aa, Mycobacterium
TDASLT

SEQ ID NO: 406115 - protein, 9 aa, Mycobacterium
TDDAGAAVE

SEQ ID NO: 406116 - protein, 4 aa, Mycobacterium
TDDD

SEQ ID NO: 406117 - protein, 9 aa, Mycobacterium
TDDDAPQRI

SEQ ID NO: 406118 - protein, 8 aa, Mycobacterium
TDDDPRFN

SEQ ID NO: 406119 - protein, 4 aa, Mycobacterium
TDDE

SEQ ID NO: 406120 - protein, 7 aa, Mycobacterium
TDDGERS

SEQ ID NO: 406121 - protein, 8 aa, Mycobacterium
TDDGPSPA

SEQ ID NO: 406122 - protein, 4 aa, Mycobacterium
TDDH

SEQ ID NO: 406123 - protein, 6 aa, Mycobacterium
TDDPAV

SEQ ID NO: 406124 - protein, 7 aa, Mycobacterium
TDDPTAR

SEQ ID NO: 406125 - protein, 5 aa, Mycobacterium
TDDTK

SEQ ID NO: 406126 - protein, 6 aa, Mycobacterium
TDEAAV

SEQ ID NO: 406127 - protein, 4 aa, Mycobacterium
TDEG

SEQ ID NO: 406128 - protein, 11 aa, Mycobacterium
TDEGADKPHRN

SEQ ID NO: 406129 - protein, 6 aa, Mycobacterium
TDEKGR

SEQ ID NO: 406130 - protein, 4 aa, Mycobacterium
TDER

SEQ ID NO: 406131 - protein, 5 aa, Mycobacterium
TDERA

SEQ ID NO: 406132 - protein, 9 aa, Mycobacterium
TDETGATKR

SEQ ID NO: 406133 - protein, 11 aa, Mycobacterium
TDFPGGDSDEM

SEQ ID NO: 406134 - protein, 12 aa, Mycobacterium
TDFSKNSGRSEL

SEQ ID NO: 406135 - protein, 4 aa, Mycobacterium
TDGA

SEQ ID NO: 406136 - protein, 5 aa, Mycobacterium
TDGAG

SEQ ID NO: 406137 - protein, 5 aa, Mycobacterium
TDGDR

SEQ ID NO: 406138 - protein, 4 aa, Mycobacterium
TDGE

SEQ ID NO: 406139 - protein, 11 aa, Mycobacterium
TDGEGGEVSPK

SEQ ID NO: 406140 - protein, 9 aa, Mycobacterium
TDGGEESQC

SEQ ID NO: 406141 - protein, 11 aa, Mycobacterium
TDGGGYPTGQE

SEQ ID NO: 406142 - protein, 4 aa, Mycobacterium
TDGI

SEQ ID NO: 406143 - protein, 6 aa, Mycobacterium
TDGPAA

SEQ ID NO: 406144 - protein, 5 aa, Mycobacterium
TDGPV

SEQ ID NO: 406145 - protein, 7 aa, Mycobacterium
TDGRKRR

SEQ ID NO: 406146 - protein, 7 aa, Mycobacterium
TDGRRTV

SEQ ID NO: 406147 - protein, 11 aa, Mycobacterium
TDGSGRDAATA

SEQ ID NO: 406148 - protein, 5 aa, Mycobacterium
TDGYP

SEQ ID NO: 406149 - protein, 4 aa, Mycobacterium
TDHG

SEQ ID NO: 406150 - protein, 6 aa, Mycobacterium
TDHPAG

SEQ ID NO: 406151 - protein, 6 aa, Mycobacterium
TDHPGY

SEQ ID NO: 406152 - protein, 5 aa, Mycobacterium
TDHRD

SEQ ID NO: 406153 - protein, 7 aa, Mycobacterium
TDHRPVA

SEQ ID NO: 406154 - protein, 4 aa, Mycobacterium
TDIP

SEQ ID NO: 406155 - protein, 6 aa, Mycobacterium
TDKGEA

SEQ ID NO: 406156 - protein, 4 aa, Mycobacterium
TDKL

SEQ ID NO: 406157 - protein, 7 aa, Mycobacterium
TDKPTMR

SEQ ID NO: 406158 - protein, 12 aa, Mycobacterium
TDKVDTEIPSPV

SEQ ID NO: 406159 - protein, 6 aa, Mycobacterium
TDLSSA

SEQ ID NO: 406160 - protein, 9 aa, Mycobacterium
TDMGNAEDA

SEQ ID NO: 406161 - protein, 6 aa, Mycobacterium
TDNEKQ

SEQ ID NO: 406162 - protein, 6 aa, Mycobacterium
TDNEPA

SEQ ID NO: 406163 - protein, 5 aa, Mycobacterium
TDNGE

SEQ ID NO: 406164 - protein, 8 aa, Mycobacterium
TDNPDSIV

SEQ ID NO: 406165 - protein, 8 aa, Mycobacterium
TDNPHAYR

SEQ ID NO: 406166 - protein, 5 aa, Mycobacterium
TDPAA

SEQ ID NO: 406167 - protein, 10 aa, Mycobacterium
TDPAAKRHRG

SEQ ID NO: 406168 - protein, 6 aa, Mycobacterium
TDPAAN

SEQ ID NO: 406169 - protein, 9 aa, Mycobacterium
TDPAKSRQL

SEQ ID NO: 406170 - protein, 7 aa, Mycobacterium
TDPDEVA

SEQ ID NO: 406171 - protein, 9 aa, Mycobacterium
TDPDHHEAS

SEQ ID NO: 406172 - protein, 9 aa, Mycobacterium
TDPDKGAQG

SEQ ID NO: 406173 - protein, 6 aa, Mycobacterium
TDPDQW

SEQ ID NO: 406174 - protein, 8 aa, Mycobacterium
TDPDRVPP

SEQ ID NO: 406175 - protein, 5 aa, Mycobacterium
TDPDS

SEQ ID NO: 406176 - protein, 6 aa, Mycobacterium
TDPDSR

SEQ ID NO: 406177 - protein, 7 aa, Mycobacterium
TDPDTLA

SEQ ID NO: 406178 - protein, 8 aa, Mycobacterium
TDPDVPKH

SEQ ID NO: 406179 - protein, 9 aa, Mycobacterium
TDPEAAKHK

SEQ ID NO: 406180 - protein, 9 aa, Mycobacterium
TDPEAPKHK

SEQ ID NO: 406181 - protein, 9 aa, Mycobacterium
TDPEKGAQG

SEQ ID NO: 406182 - protein, 7 aa, Mycobacterium
TDPHNSE

SEQ ID NO: 406183 - protein, 4 aa, Mycobacterium
TDPL

SEQ ID NO: 406184 - protein, 6 aa, Mycobacterium
TDPNSR

SEQ ID NO: 406185 - protein, 4 aa, Mycobacterium
TDPP

SEQ ID NO: 406186 - protein, 4 aa, Mycobacterium
TDPR

SEQ ID NO: 406187 - protein, 9 aa, Mycobacterium
TDPSAPKHK

SEQ ID NO: 406188 - protein, 4 aa, Mycobacterium
TDPT

SEQ ID NO: 406189 - protein, 4 aa, Mycobacterium
TDPV

SEQ ID NO: 406190 - protein, 5 aa, Mycobacterium
TDPVA

SEQ ID NO: 406191 - protein, 6 aa, Mycobacterium
TDPVGA

SEQ ID NO: 406192 - protein, 6 aa, Mycobacterium
TDPVQS

SEQ ID NO: 406193 - protein, 4 aa, Mycobacterium
TDQD

SEQ ID NO: 406194 - protein, 4 aa, Mycobacterium
TDQG

SEQ ID NO: 406195 - protein, 6 aa, Mycobacterium
TDQVPE

SEQ ID NO: 406196 - protein, 4 aa, Mycobacterium
TDRA

SEQ ID NO: 406197 - protein, 5 aa, Mycobacterium
TDRAA

SEQ ID NO: 406198 - protein, 5 aa, Mycobacterium
TDRNG

SEQ ID NO: 406199 - protein, 4 aa, Mycobacterium
TDRP

SEQ ID NO: 406200 - protein, 10 aa, Mycobacterium
TDRPGSSDYV

SEQ ID NO: 406201 - protein, 8 aa, Mycobacterium
TDRPRHTQ

SEQ ID NO: 406202 - protein, 13 aa, Mycobacterium
TDRPRPPQQSFRG

SEQ ID NO: 406203 - protein, 5 aa, Mycobacterium
TDRTG

SEQ ID NO: 406204 - protein, 6 aa, Mycobacterium
TDSAAV

SEQ ID NO: 406205 - protein, 4 aa, Mycobacterium
TDSE

SEQ ID NO: 406206 - protein, 8 aa, Mycobacterium
TDSHAPGQ

SEQ ID NO: 406207 - protein, 8 aa, Mycobacterium
TDSKDSTR

SEQ ID NO: 406208 - protein, 4 aa, Mycobacterium
TDST

SEQ ID NO: 406209 - protein, 4 aa, Mycobacterium
TDTA

SEQ ID NO: 406210 - protein, 12 aa, Mycobacterium
TDTAGTAPPPLT

SEQ ID NO: 406211 - protein, 7 aa, Mycobacterium
TDTARSC

SEQ ID NO: 406212 - protein, 9 aa, Mycobacterium
TDTASSYAK

SEQ ID NO: 406213 - protein, 4 aa, Mycobacterium
TDTD

SEQ ID NO: 406214 - protein, 4 aa, Mycobacterium
TDTE

SEQ ID NO: 406215 - protein, 4 aa, Mycobacterium
TDTR

SEQ ID NO: 406216 - protein, 4 aa, Mycobacterium
TDTT

SEQ ID NO: 406217 - protein, 5 aa, Mycobacterium
TDTTG

SEQ ID NO: 406218 - protein, 8 aa, Mycobacterium
TDTTRNQL

SEQ ID NO: 406219 - protein, 6 aa, Mycobacterium
TDVAGR

SEQ ID NO: 406220 - protein, 4 aa, Mycobacterium
TDVE

SEQ ID NO: 406221 - protein, 12 aa, Mycobacterium
TDYAHGGNTNID

SEQ ID NO: 406222 - protein, 14 aa, Mycobacterium
TEAARRQLEETDDT

SEQ ID NO: 406223 - protein, 4 aa, Mycobacterium
TEAD

SEQ ID NO: 406224 - protein, 5 aa, Mycobacterium
TEAEQ

SEQ ID NO: 406225 - protein, 4 aa, Mycobacterium
TEAG

SEQ ID NO: 406226 - protein, 11 aa, Mycobacterium
TEAGEPAGIGG

SEQ ID NO: 406227 - protein, 6 aa, Mycobacterium
TEAGIS

SEQ ID NO: 406228 - protein, 6 aa, Mycobacterium
TEAGRR

SEQ ID NO: 406229 - protein, 4 aa, Mycobacterium
TEAI

SEQ ID NO: 406230 - protein, 4 aa, Mycobacterium
TEAL

SEQ ID NO: 406231 - protein, 4 aa, Mycobacterium
TEAQ

SEQ ID NO: 406232 - protein, 12 aa, Mycobacterium
TEAYGATKRPED

SEQ ID NO: 406233 - protein, 14 aa, Mycobacterium
TEDEAPNAKGGVDK

SEQ ID NO: 406234 - protein, 8 aa, Mycobacterium
TEDGTERE

SEQ ID NO: 406235 - protein, 9 aa, Mycobacterium
TEDHKTGNL

SEQ ID NO: 406236 - protein, 7 aa, Mycobacterium
TEDPAAT

SEQ ID NO: 406237 - protein, 6 aa, Mycobacterium
TEDQTE

SEQ ID NO: 406238 - protein, 4 aa, Mycobacterium
TEDV

SEQ ID NO: 406239 - protein, 12 aa, Mycobacterium
TEEEADRALKAG

SEQ ID NO: 406240 - protein, 4 aa, Mycobacterium
TEEL

SEQ ID NO: 406241 - protein, 4 aa, Mycobacterium
TEEP

SEQ ID NO: 406242 - protein, 5 aa, Mycobacterium
TEEPE

SEQ ID NO: 406243 - protein, 13 aa, Mycobacterium
TEETGAQISIEDD

SEQ ID NO: 406244 - protein, 15 aa, Mycobacterium
TEEVSGKQAKELSDD

SEQ ID NO: 406245 - protein, 4 aa, Mycobacterium
TEFH

SEQ ID NO: 406246 - protein, 13 aa, Mycobacterium
TEFNAGSRMQGQL

SEQ ID NO: 406247 - protein, 5 aa, Mycobacterium
TEFNG

SEQ ID NO: 406248 - protein, 10 aa, Mycobacterium
TEGFTAEPAY

SEQ ID NO: 406249 - protein, 6 aa, Mycobacterium
TEGTAE

SEQ ID NO: 406250 - protein, 4 aa, Mycobacterium
TEGV

SEQ ID NO: 406251 - protein, 9 aa, Mycobacterium
TEHPSSGTA

SEQ ID NO: 406252 - protein, 5 aa, Mycobacterium
TEHRG

SEQ ID NO: 406253 - protein, 5 aa, Mycobacterium
TEKGA

SEQ ID NO: 406254 - protein, 11 aa, Mycobacterium
TEKGRAEAVRS

SEQ ID NO: 406255 - protein, 11 aa, Mycobacterium
TEKQAASWDDL

SEQ ID NO: 406256 - protein, 8 aa, Mycobacterium
TEKQAREE

SEQ ID NO: 406257 - protein, 4 aa, Mycobacterium
TEKY

SEQ ID NO: 406258 - protein, 4 aa, Mycobacterium
TELG

SEQ ID NO: 406259 - protein, 5 aa, Mycobacterium
TELTG

SEQ ID NO: 406260 - protein, 6 aa, Mycobacterium
TEMTPP

SEQ ID NO: 406261 - protein, 6 aa, Mycobacterium
TENEAV

SEQ ID NO: 406262 - protein, 4 aa, Mycobacterium
TENG

SEQ ID NO: 406263 - protein, 7 aa, Mycobacterium
TENLGGQ

SEQ ID NO: 406264 - protein, 4 aa, Mycobacterium
TENP

SEQ ID NO: 406265 - protein, 6 aa, Mycobacterium
TENPAG

SEQ ID NO: 406266 - protein, 6 aa, Mycobacterium
TENPLH

SEQ ID NO: 406267 - protein, 7 aa, Mycobacterium
TENPNPA

SEQ ID NO: 406268 - protein, 6 aa, Mycobacterium
TENREA

SEQ ID NO: 406269 - protein, 10 aa, Mycobacterium
TENSGRERTT

SEQ ID NO: 406270 - protein, 9 aa, Mycobacterium
TEPAPGTAN

SEQ ID NO: 406271 - protein, 18 aa, Mycobacterium
TEPAYAARGGVGASAQRD

SEQ ID NO: 406272 - protein, 4 aa, Mycobacterium
TEPD

SEQ ID NO: 406273 - protein, 9 aa, Mycobacterium
TEPDPGLAG

SEQ ID NO: 406274 - protein, 7 aa, Mycobacterium
TEPERYA

SEQ ID NO: 406275 - protein, 9 aa, Mycobacterium
TEPGGGSDL

SEQ ID NO: 406276 - protein, 5 aa, Mycobacterium
TEPGQ

SEQ ID NO: 406277 - protein, 9 aa, Mycobacterium
TEPGTGSDL

SEQ ID NO: 406278 - protein, 4 aa, Mycobacterium
TEPI

SEQ ID NO: 406279 - protein, 11 aa, Mycobacterium
TEPLAPVPATP

SEQ ID NO: 406280 - protein, 5 aa, Mycobacterium
TEPQV

SEQ ID NO: 406281 - protein, 13 aa, Mycobacterium
TEPSLSGPGREEL

SEQ ID NO: 406282 - protein, 4 aa, Mycobacterium
TEPT

SEQ ID NO: 406283 - protein, 5 aa, Mycobacterium
TERAD

SEQ ID NO: 406284 - protein, 11 aa, Mycobacterium
TERAKAVTRGI

SEQ ID NO: 406285 - protein, 5 aa, Mycobacterium
TERPA

SEQ ID NO: 406286 - protein, 9 aa, Mycobacterium
TERPPEDSF

SEQ ID NO: 406287 - protein, 4 aa, Mycobacterium
TERR

SEQ ID NO: 406288 - protein, 7 aa, Mycobacterium
TERREMD

SEQ ID NO: 406289 - protein, 17 aa, Mycobacterium
TERSSATSLPEPRTSHN

SEQ ID NO: 406290 - protein, 4 aa, Mycobacterium
TESE

SEQ ID NO: 406291 - protein, 8 aa, Mycobacterium
TESGNESA

SEQ ID NO: 406292 - protein, 7 aa, Mycobacterium
TESGPFR

SEQ ID NO: 406293 - protein, 5 aa, Mycobacterium
TESMT

SEQ ID NO: 406294 - protein, 4 aa, Mycobacterium
TEST

SEQ ID NO: 406295 - protein, 7 aa, Mycobacterium
TETADEW

SEQ ID NO: 406296 - protein, 5 aa, Mycobacterium
TETER

SEQ ID NO: 406297 - protein, 10 aa, Mycobacterium
TETKASEGVI

SEQ ID NO: 406298 - protein, 6 aa, Mycobacterium
TETSPV

SEQ ID NO: 406299 - protein, 4 aa, Mycobacterium
TEVE

SEQ ID NO: 406300 - protein, 4 aa, Mycobacterium
TEWA

SEQ ID NO: 406301 - protein, 13 aa, Mycobacterium
TEYDRRGWGSGGA

SEQ ID NO: 406302 - protein, 5 aa, Mycobacterium
TEYGG

SEQ ID NO: 406303 - protein, 4 aa, Mycobacterium
TEYP

SEQ ID NO: 406304 - protein, 4 aa, Mycobacterium
TFAP

SEQ ID NO: 406305 - protein, 7 aa, Mycobacterium
TFAQDGV

SEQ ID NO: 406306 - protein, 7 aa, Mycobacterium
TFDDTSH

SEQ ID NO: 406307 - protein, 6 aa, Mycobacterium
TFDGSA

SEQ ID NO: 406308 - protein, 8 aa, Mycobacterium
TFDSGDPK

SEQ ID NO: 406309 - protein, 4 aa, Mycobacterium
TFGG

SEQ ID NO: 406310 - protein, 5 aa, Mycobacterium
TFGIS

SEQ ID NO: 406311 - protein, 7 aa, Mycobacterium
TFGPGGS

SEQ ID NO: 406312 - protein, 5 aa, Mycobacterium
TFNTS

SEQ ID NO: 406313 - protein, 4 aa, Mycobacterium
TFPD

SEQ ID NO: 406314 - protein, 15 aa, Mycobacterium
TFPDGTKLVTVHHPI

SEQ ID NO: 406315 - protein, 4 aa, Mycobacterium
TFPN

SEQ ID NO: 406316 - protein, 9 aa, Mycobacterium
TFPSSSPDE

SEQ ID NO: 406317 - protein, 9 aa, Mycobacterium
TFPSSSPNE

SEQ ID NO: 406318 - protein, 9 aa, Mycobacterium
TFPSSSPTE

SEQ ID NO: 406319 - protein, 21 aa, Mycobacterium
TFRSERYPEYKANRSSTPDEF

SEQ ID NO: 406320 - protein, 11 aa, Mycobacterium
TFTGGSPGAFQ

SEQ ID NO: 406321 - protein, 8 aa, Mycobacterium
TGAAGAVG

SEQ ID NO: 406322 - protein, 8 aa, Mycobacterium
TGAAKAGD

SEQ ID NO: 406323 - protein, 13 aa, Mycobacterium
TGAAPSAAGPRVK

SEQ ID NO: 406324 - protein, 7 aa, Mycobacterium
TGAAQGC

SEQ ID NO: 406325 - protein, 8 aa, Mycobacterium
TGAAQGCV

SEQ ID NO: 406326 - protein, 9 aa, Mycobacterium
TGAATGREA

SEQ ID NO: 406327 - protein, 6 aa, Mycobacterium
TGADMN

SEQ ID NO: 406328 - protein, 10 aa, Mycobacterium
TGADTDPTVD

SEQ ID NO: 406329 - protein, 5 aa, Mycobacterium
TGADV

SEQ ID NO: 406330 - protein, 11 aa, Mycobacterium
TGAGKGKSTAA

SEQ ID NO: 406331 - protein, 8 aa, Mycobacterium
TGAGSDHD

SEQ ID NO: 406332 - protein, 11 aa, Mycobacterium
TGAKSGQPRVS

SEQ ID NO: 406333 - protein, 8 aa, Mycobacterium
TGASGEPG

SEQ ID NO: 406334 - protein, 10 aa, Mycobacterium
TGASKGSIAA

SEQ ID NO: 406335 - protein, 7 aa, Mycobacterium
TGASKYG

SEQ ID NO: 406336 - protein, 6 aa, Mycobacterium
TGASPL

SEQ ID NO: 406337 - protein, 9 aa, Mycobacterium
TGASQNIGE

SEQ ID NO: 406338 - protein, 9 aa, Mycobacterium
TGASSGIGA

SEQ ID NO: 406339 - protein, 5 aa, Mycobacterium
TGATS

SEQ ID NO: 406340 - protein, 4 aa, Mycobacterium
TGDA

SEQ ID NO: 406341 - protein, 5 aa, Mycobacterium
TGDAR

SEQ ID NO: 406342 - protein, 5 aa, Mycobacterium
TGDDP

SEQ ID NO: 406343 - protein, 9 aa, Mycobacterium
TGDEATGAN

SEQ ID NO: 406344 - protein, 6 aa, Mycobacterium
TGDGGI

SEQ ID NO: 406345 - protein, 11 aa, Mycobacterium
TGDGKGKSTAA

SEQ ID NO: 406346 - protein, 7 aa, Mycobacterium
TGDGSQH

SEQ ID NO: 406347 - protein, 7 aa, Mycobacterium
TGDHSLE

SEQ ID NO: 406348 - protein, 4 aa, Mycobacterium
TGDM

SEQ ID NO: 406349 - protein, 5 aa, Mycobacterium
TGDPE

SEQ ID NO: 406350 - protein, 14 aa, Mycobacterium
TGDPRRWPNDHGNA

SEQ ID NO: 406351 - protein, 4 aa, Mycobacterium
TGDQ

SEQ ID NO: 406352 - protein, 5 aa, Mycobacterium
TGDQG

SEQ ID NO: 406353 - protein, 7 aa, Mycobacterium
TGDRPVQ

SEQ ID NO: 406354 - protein, 8 aa, Mycobacterium
TGDRPVQV

SEQ ID NO: 406355 - protein, 5 aa, Mycobacterium
TGDRS

SEQ ID NO: 406356 - protein, 16 aa, Mycobacterium
TGDTNTGLGNSGNINT

SEQ ID NO: 406357 - protein, 4 aa, Mycobacterium
TGDV

SEQ ID NO: 406358 - protein, 9 aa, Mycobacterium
TGDVAPPQR

SEQ ID NO: 406359 - protein, 11 aa, Mycobacterium
TGEAGAQHYSD

SEQ ID NO: 406360 - protein, 6 aa, Mycobacterium
TGEAPT

SEQ ID NO: 406361 - protein, 4 aa, Mycobacterium
TGEE

SEQ ID NO: 406362 - protein, 14 aa, Mycobacterium
TGEGTTGLGKPLKP

SEQ ID NO: 406363 - protein, 5 aa, Mycobacterium
TGEPA

SEQ ID NO: 406364 - protein, 11 aa, Mycobacterium
TGEPPRGPEAM

SEQ ID NO: 406365 - protein, 5 aa, Mycobacterium
TGEPS

SEQ ID NO: 406366 - protein, 4 aa, Mycobacterium
TGEQ

SEQ ID NO: 406367 - protein, 5 aa, Mycobacterium
TGEQA

SEQ ID NO: 406368 - protein, 6 aa, Mycobacterium
TGEQRR

SEQ ID NO: 406369 - protein, 8 aa, Mycobacterium
TGERTKEG

SEQ ID NO: 406370 - protein, 4 aa, Mycobacterium
TGES

SEQ ID NO: 406371 - protein, 9 aa, Mycobacterium
TGETGAGKT

SEQ ID NO: 406372 - protein, 6 aa, Mycobacterium
TGETPT

SEQ ID NO: 406373 - protein, 7 aa, Mycobacterium
TGETSPY

SEQ ID NO: 406374 - protein, 4 aa, Mycobacterium
TGEY

SEQ ID NO: 406375 - protein, 5 aa, Mycobacterium
TGFGE

SEQ ID NO: 406376 - protein, 7 aa, Mycobacterium
TGFTDER

SEQ ID NO: 406377 - protein, 5 aa, Mycobacterium
TGGAQ

SEQ ID NO: 406378 - protein, 6 aa, Mycobacterium
TGGAQG

SEQ ID NO: 406379 - protein, 9 aa, Mycobacterium
TGGASGIGL

SEQ ID NO: 406380 - protein, 4 aa, Mycobacterium
TGGD

SEQ ID NO: 406381 - protein, 9 aa, Mycobacterium
TGGEGPRGI

SEQ ID NO: 406382 - protein, 7 aa, Mycobacterium
TGGERGD

SEQ ID NO: 406383 - protein, 9 aa, Mycobacterium
TGGGDAPGL

SEQ ID NO: 406384 - protein, 10 aa, Mycobacterium
TGGGGGIGAA

SEQ ID NO: 406385 - protein, 6 aa, Mycobacterium
TGGGTG

SEQ ID NO: 406386 - protein, 4 aa, Mycobacterium
TGGH

SEQ ID NO: 406387 - protein, 7 aa, Mycobacterium
TGGHLGP

SEQ ID NO: 406388 - protein, 6 aa, Mycobacterium
TGGHPP

SEQ ID NO: 406389 - protein, 8 aa, Mycobacterium
TGGNSGIG

SEQ ID NO: 406390 - protein, 5 aa, Mycobacterium
TGGRG

SEQ ID NO: 406391 - protein, 4 aa, Mycobacterium
TGGS

SEQ ID NO: 406392 - protein, 20 aa, Mycobacterium
TGGSGRMYKTTSNAHTLTGD

SEQ ID NO: 406393 - protein, 9 aa, Mycobacterium
TGGTGMAGS

SEQ ID NO: 406394 - protein, 7 aa, Mycobacterium
TGGTLAA

SEQ ID NO: 406395 - protein, 5 aa, Mycobacterium
TGGTR

SEQ ID NO: 406396 - protein, 8 aa, Mycobacterium
TGGTSGIG

SEQ ID NO: 406397 - protein, 14 aa, Mycobacterium
TGGTTGKPKGVMGT

SEQ ID NO: 406398 - protein, 4 aa, Mycobacterium
TGGY

SEQ ID NO: 406399 - protein, 20 aa, Mycobacterium
TGHDGGAGTVHANSPAEVPA

SEQ ID NO: 406400 - protein, 8 aa, Mycobacterium
TGHEGADA

SEQ ID NO: 406401 - protein, 6 aa, Mycobacterium
TGHGNA

SEQ ID NO: 406402 - protein, 14 aa, Mycobacterium
TGIEPDKNTPADWR

SEQ ID NO: 406403 - protein, 6 aa, Mycobacterium
TGIGRT

SEQ ID NO: 406404 - protein, 7 aa, Mycobacterium
TGISEPM

SEQ ID NO: 406405 - protein, 5 aa, Mycobacterium
TGKEI

SEQ ID NO: 406406 - protein, 6 aa, Mycobacterium
TGKLER

SEQ ID NO: 406407 - protein, 5 aa, Mycobacterium
TGKNL

SEQ ID NO: 406408 - protein, 16 aa, Mycobacterium
TGKPADLDRDEPRRVA

SEQ ID NO: 406409 - protein, 5 aa, Mycobacterium
TGKSQ

SEQ ID NO: 406410 - protein, 15 aa, Mycobacterium
TGKTPVSKDDAQQHA

SEQ ID NO: 406411 - protein, 6 aa, Mycobacterium
TGLGSA

SEQ ID NO: 406412 - protein, 10 aa, Mycobacterium
TGLPNGDQPM

SEQ ID NO: 406413 - protein, 4 aa, Mycobacterium
TGLR

SEQ ID NO: 406414 - protein, 4 aa, Mycobacterium
TGLT

SEQ ID NO: 406415 - protein, 5 aa, Mycobacterium
TGLTD

SEQ ID NO: 406416 - protein, 6 aa, Mycobacterium
TGLTDD

SEQ ID NO: 406417 - protein, 6 aa, Mycobacterium
TGMAGS

SEQ ID NO: 406418 - protein, 4 aa, Mycobacterium
TGMG

SEQ ID NO: 406419 - protein, 4 aa, Mycobacterium
TGMT

SEQ ID NO: 406420 - protein, 6 aa, Mycobacterium
TGMTDD

SEQ ID NO: 406421 - protein, 5 aa, Mycobacterium
TGNAV

SEQ ID NO: 406422 - protein, 22 aa, Mycobacterium
TGNPPTRERIQSPTDRARYDDT

SEQ ID NO: 406423 - protein, 5 aa, Mycobacterium
TGNSA

SEQ ID NO: 406424 - protein, 10 aa, Mycobacterium
TGNYNSKTAR

SEQ ID NO: 406425 - protein, 24 aa, Mycobacterium
TGPAAPSWRKGPRHIAGRGPRDTY

SEQ ID NO: 406426 - protein, 7 aa, Mycobacterium
TGPAGEK

SEQ ID NO: 406427 - protein, 5 aa, Mycobacterium
TGPAM

SEQ ID NO: 406428 - protein, 6 aa, Mycobacterium
TGPDGR

SEQ ID NO: 406429 - protein, 7 aa, Mycobacterium
TGPGGER

SEQ ID NO: 406430 - protein, 9 aa, Mycobacterium
TGPGVTETP

SEQ ID NO: 406431 - protein, 7 aa, Mycobacterium
TGPPDDV

SEQ ID NO: 406432 - protein, 12 aa, Mycobacterium
TGPPGAGKSTTI

SEQ ID NO: 406433 - protein, 13 aa, Mycobacterium
TGPPGAGKSTTVG

SEQ ID NO: 406434 - protein, 4 aa, Mycobacterium
TGPQ

SEQ ID NO: 406435 - protein, 12 aa, Mycobacterium
TGPTRPPYTEVP

SEQ ID NO: 406436 - protein, 5 aa, Mycobacterium
TGPTT

SEQ ID NO: 406437 - protein, 13 aa, Mycobacterium
TGPTTTHSTNSTH

SEQ ID NO: 406438 - protein, 5 aa, Mycobacterium
TGPTV

SEQ ID NO: 406439 - protein, 6 aa, Mycobacterium
TGPYTD

SEQ ID NO: 406440 - protein, 6 aa, Mycobacterium
TGPYTE

SEQ ID NO: 406441 - protein, 4 aa, Mycobacterium
TGQA

SEQ ID NO: 406442 - protein, 5 aa, Mycobacterium
TGQAK

SEQ ID NO: 406443 - protein, 8 aa, Mycobacterium
TGQAPAAY

SEQ ID NO: 406444 - protein, 19 aa, Mycobacterium
TGQAPAAYIGDNTRPDAIR

SEQ ID NO: 406445 - protein, 9 aa, Mycobacterium
TGQDCTAAT

SEQ ID NO: 406446 - protein, 5 aa, Mycobacterium
TGQDF

SEQ ID NO: 406447 - protein, 25 aa, Mycobacterium
TGQDTKPYRGGKGIYRSTDRGSSWV

SEQ ID NO: 406448 - protein, 4 aa, Mycobacterium
TGQE

SEQ ID NO: 406449 - protein, 5 aa, Mycobacterium
TGQGG

SEQ ID NO: 406450 - protein, 6 aa, Mycobacterium
TGQIAT

SEQ ID NO: 406451 - protein, 4 aa, Mycobacterium
TGQP

SEQ ID NO: 406452 - protein, 5 aa, Mycobacterium
TGQPL

SEQ ID NO: 406453 - protein, 6 aa, Mycobacterium
TGQPLG

SEQ ID NO: 406454 - protein, 4 aa, Mycobacterium
TGQS

SEQ ID NO: 406455 - protein, 11 aa, Mycobacterium
TGQSSSVASGR

SEQ ID NO: 406456 - protein, 5 aa, Mycobacterium
TGRAR

SEQ ID NO: 406457 - protein, 5 aa, Mycobacterium
TGRDA

SEQ ID NO: 406458 - protein, 5 aa, Mycobacterium
TGRDD

SEQ ID NO: 406459 - protein, 5 aa, Mycobacterium
TGRDF

SEQ ID NO: 406460 - protein, 6 aa, Mycobacterium
TGRDVS

SEQ ID NO: 406461 - protein, 5 aa, Mycobacterium
TGREA

SEQ ID NO: 406462 - protein, 9 aa, Mycobacterium
TGREADDLT

SEQ ID NO: 406463 - protein, 4 aa, Mycobacterium
TGRN

SEQ ID NO: 406464 - protein, 8 aa, Mycobacterium
TGRNQHGD

SEQ ID NO: 406465 - protein, 7 aa, Mycobacterium
TGRPEGR

SEQ ID NO: 406466 - protein, 20 aa, Mycobacterium
TGRPPRAIPEPQPRTSHGPA

SEQ ID NO: 406467 - protein, 10 aa, Mycobacterium
TGRPVPAAHP

SEQ ID NO: 406468 - protein, 7 aa, Mycobacterium
TGRRRPV

SEQ ID NO: 406469 - protein, 10 aa, Mycobacterium
TGRRTGKERT

SEQ ID NO: 406470 - protein, 4 aa, Mycobacterium
TGRS

SEQ ID NO: 406471 - protein, 4 aa, Mycobacterium
TGRW

SEQ ID NO: 406472 - protein, 10 aa, Mycobacterium
TGSAPGAFDS

SEQ ID NO: 406473 - protein, 18 aa, Mycobacterium
TGSGDPQKFDPDASRETL

SEQ ID NO: 406474 - protein, 8 aa, Mycobacterium
TGSGGRSL

SEQ ID NO: 406475 - protein, 4 aa, Mycobacterium
TGSH

SEQ ID NO: 406476 - protein, 4 aa, Mycobacterium
TGSL

SEQ ID NO: 406477 - protein, 10 aa, Mycobacterium
TGSPADPATL

SEQ ID NO: 406478 - protein, 8 aa, Mycobacterium
TGSPDTSA

SEQ ID NO: 406479 - protein, 9 aa, Mycobacterium
TGSTATGRA

SEQ ID NO: 406480 - protein, 6 aa, Mycobacterium
TGSTAV

SEQ ID NO: 406481 - protein, 7 aa, Mycobacterium
TGSTGVG

SEQ ID NO: 406482 - protein, 10 aa, Mycobacterium
TGTAEGGNQV

SEQ ID NO: 406483 - protein, 5 aa, Mycobacterium
TGTAS

SEQ ID NO: 406484 - protein, 7 aa, Mycobacterium
TGTGNSL

SEQ ID NO: 406485 - protein, 11 aa, Mycobacterium
TGTGNSLNARH

SEQ ID NO: 406486 - protein, 6 aa, Mycobacterium
TGTGQR

SEQ ID NO: 406487 - protein, 5 aa, Mycobacterium
TGTGR

SEQ ID NO: 406488 - protein, 7 aa, Mycobacterium
TGTGRRG

SEQ ID NO: 406489 - protein, 7 aa, Mycobacterium
TGTGTRS

SEQ ID NO: 406490 - protein, 9 aa, Mycobacterium
TGTIPSKTL

SEQ ID NO: 406491 - protein, 8 aa, Mycobacterium
TGTPAEDV

SEQ ID NO: 406492 - protein, 5 aa, Mycobacterium
TGTPH

SEQ ID NO: 406493 - protein, 7 aa, Mycobacterium
TGTPPMP

SEQ ID NO: 406494 - protein, 4 aa, Mycobacterium
TGTQ

SEQ ID NO: 406495 - protein, 9 aa, Mycobacterium
TGTRAHSAR

SEQ ID NO: 406496 - protein, 6 aa, Mycobacterium
TGTSTA

SEQ ID NO: 406497 - protein, 4 aa, Mycobacterium
TGTV

SEQ ID NO: 406498 - protein, 20 aa, Mycobacterium
TGTWSTEAAYDDQDYAETEQ

SEQ ID NO: 406499 - protein, 4 aa, Mycobacterium
TGVG

SEQ ID NO: 406500 - protein, 8 aa, Mycobacterium
TGVGKTEL

SEQ ID NO: 406501 - protein, 5 aa, Mycobacterium
TGVRE

SEQ ID NO: 406502 - protein, 4 aa, Mycobacterium
TGVS

SEQ ID NO: 406503 - protein, 10 aa, Mycobacterium
TGWDADGGYA

SEQ ID NO: 406504 - protein, 6 aa, Mycobacterium
TGYASN

SEQ ID NO: 406505 - protein, 4 aa, Mycobacterium
TGYD

SEQ ID NO: 406506 - protein, 7 aa, Mycobacterium
TGYEGEW

SEQ ID NO: 406507 - protein, 5 aa, Mycobacterium
TGYND

SEQ ID NO: 406508 - protein, 15 aa, Mycobacterium
TGYSEQQSTRPQTVG

SEQ ID NO: 406509 - protein, 11 aa, Mycobacterium
THDTKRGEDVR

SEQ ID NO: 406510 - protein, 6 aa, Mycobacterium
THDVNT

SEQ ID NO: 406511 - protein, 5 aa, Mycobacterium
THEHR

SEQ ID NO: 406512 - protein, 4 aa, Mycobacterium
THGA

SEQ ID NO: 406513 - protein, 5 aa, Mycobacterium
THGAD

SEQ ID NO: 406514 - protein, 5 aa, Mycobacterium
THGAE

SEQ ID NO: 406515 - protein, 5 aa, Mycobacterium
THPSI

SEQ ID NO: 406516 - protein, 6 aa, Mycobacterium
THRDPE

SEQ ID NO: 406517 - protein, 4 aa, Mycobacterium
THRR

SEQ ID NO: 406518 - protein, 11 aa, Mycobacterium
TIAPGSNSKRY

SEQ ID NO: 406519 - protein, 13 aa, Mycobacterium
TIDNDLDKTTSTF

SEQ ID NO: 406520 - protein, 4 aa, Mycobacterium
TIDP

SEQ ID NO: 406521 - protein, 4 aa, Mycobacterium
TIDT

SEQ ID NO: 406522 - protein, 5 aa, Mycobacterium
TIEPE

SEQ ID NO: 406523 - protein, 5 aa, Mycobacterium
TIEPQ

SEQ ID NO: 406524 - protein, 4 aa, Mycobacterium
TIGP

SEQ ID NO: 406525 - protein, 4 aa, Mycobacterium
TIHP

SEQ ID NO: 406526 - protein, 8 aa, Mycobacterium
TINEEPAL

SEQ ID NO: 406527 - protein, 7 aa, Mycobacterium
TINSGGE

SEQ ID NO: 406528 - protein, 13 aa, Mycobacterium
TINSGGEKIHPEE

SEQ ID NO: 406529 - protein, 13 aa, Mycobacterium
TIPASTPEDLAET

SEQ ID NO: 406530 - protein, 4 aa, Mycobacterium
TIPD

SEQ ID NO: 406531 - protein, 6 aa, Mycobacterium
TIPQGD

SEQ ID NO: 406532 - protein, 5 aa, Mycobacterium
TIPRG

SEQ ID NO: 406533 - protein, 13 aa, Mycobacterium
TIPRTSSGKIGRR

SEQ ID NO: 406534 - protein, 7 aa, Mycobacterium
TITAGEI

SEQ ID NO: 406535 - protein, 4 aa, Mycobacterium
TITE

SEQ ID NO: 406536 - protein, 13 aa, Mycobacterium
TKAAADAGRPAPR

SEQ ID NO: 406537 - protein, 4 aa, Mycobacterium
TKAD

SEQ ID NO: 406538 - protein, 7 aa, Mycobacterium
TKAHPTV

SEQ ID NO: 406539 - protein, 4 aa, Mycobacterium
TKAR

SEQ ID NO: 406540 - protein, 9 aa, Mycobacterium
TKDADGNDT

SEQ ID NO: 406541 - protein, 4 aa, Mycobacterium
TKDD

SEQ ID NO: 406542 - protein, 10 aa, Mycobacterium
TKDGTLGGPN

SEQ ID NO: 406543 - protein, 8 aa, Mycobacterium
TKDPEKFV

SEQ ID NO: 406544 - protein, 6 aa, Mycobacterium
TKDQAE

SEQ ID NO: 406545 - protein, 10 aa, Mycobacterium
TKDRKQFGKS

SEQ ID NO: 406546 - protein, 16 aa, Mycobacterium
TKDRKQFGRPVSDNQG

SEQ ID NO: 406547 - protein, 4 aa, Mycobacterium
TKEL

SEQ ID NO: 406548 - protein, 5 aa, Mycobacterium
TKETP

SEQ ID NO: 406549 - protein, 4 aa, Mycobacterium
TKFH

SEQ ID NO: 406550 - protein, 5 aa, Mycobacterium
TKGVD

SEQ ID NO: 406551 - protein, 8 aa, Mycobacterium
TKHPGTGG

SEQ ID NO: 406552 - protein, 9 aa, Mycobacterium
TKITGEEEA

SEQ ID NO: 406553 - protein, 7 aa, Mycobacterium
TKKAGND

SEQ ID NO: 406554 - protein, 8 aa, Mycobacterium
TKLADQVA

SEQ ID NO: 406555 - protein, 5 aa, Mycobacterium
TKLDG

SEQ ID NO: 406556 - protein, 8 aa, Mycobacterium
TKNDDPVG

SEQ ID NO: 406557 - protein, 10 aa, Mycobacterium
TKPDQGDKAL

SEQ ID NO: 406558 - protein, 12 aa, Mycobacterium
TKPGTTTPHTEF

SEQ ID NO: 406559 - protein, 4 aa, Mycobacterium
TKQC

SEQ ID NO: 406560 - protein, 10 aa, Mycobacterium
TKRDGGRLSD

SEQ ID NO: 406561 - protein, 6 aa, Mycobacterium
TKRGIT

SEQ ID NO: 406562 - protein, 5 aa, Mycobacterium
TKRPP

SEQ ID NO: 406563 - protein, 4 aa, Mycobacterium
TKSL

SEQ ID NO: 406564 - protein, 8 aa, Mycobacterium
TKSREAEA

SEQ ID NO: 406565 - protein, 7 aa, Mycobacterium
TLAGRER

SEQ ID NO: 406566 - protein, 9 aa, Mycobacterium
TLAPAAAQR

SEQ ID NO: 406567 - protein, 5 aa, Mycobacterium
TLAQK

SEQ ID NO: 406568 - protein, 4 aa, Mycobacterium
TLDE

SEQ ID NO: 406569 - protein, 4 aa, Mycobacterium
TLDG

SEQ ID NO: 406570 - protein, 14 aa, Mycobacterium
TLDPAGILNPGKLI

SEQ ID NO: 406571 - protein, 5 aa, Mycobacterium
TLDPD

SEQ ID NO: 406572 - protein, 9 aa, Mycobacterium
TLDPPTHTN

SEQ ID NO: 406573 - protein, 10 aa, Mycobacterium
TLDPPTHTNH

SEQ ID NO: 406574 - protein, 18 aa, Mycobacterium
TLDTNTNPTTTPRNDRQT

SEQ ID NO: 406575 - protein, 4 aa, Mycobacterium
TLGA

SEQ ID NO: 406576 - protein, 6 aa, Mycobacterium
TLGAER

SEQ ID NO: 406577 - protein, 8 aa, Mycobacterium
TLGGGRSG

SEQ ID NO: 406578 - protein, 8 aa, Mycobacterium
TLGGPTSH

SEQ ID NO: 406579 - protein, 5 aa, Mycobacterium
TLGGS

SEQ ID NO: 406580 - protein, 5 aa, Mycobacterium
TLGGY

SEQ ID NO: 406581 - protein, 4 aa, Mycobacterium
TLGP

SEQ ID NO: 406582 - protein, 9 aa, Mycobacterium
TLGPAATLA

SEQ ID NO: 406583 - protein, 4 aa, Mycobacterium
TLGT

SEQ ID NO: 406584 - protein, 8 aa, Mycobacterium
TLGTTSKR

SEQ ID NO: 406585 - protein, 4 aa, Mycobacterium
TLNN

SEQ ID NO: 406586 - protein, 4 aa, Mycobacterium
TLNP

SEQ ID NO: 406587 - protein, 8 aa, Mycobacterium
TLNTRDSI

SEQ ID NO: 406588 - protein, 11 aa, Mycobacterium
TLNTRDTIARG

SEQ ID NO: 406589 - protein, 5 aa, Mycobacterium
TLPGA

SEQ ID NO: 406590 - protein, 7 aa, Mycobacterium
TLPGDPT

SEQ ID NO: 406591 - protein, 9 aa, Mycobacterium
TLPGGTPFN

SEQ ID NO: 406592 - protein, 4 aa, Mycobacterium
TLPT

SEQ ID NO: 406593 - protein, 9 aa, Mycobacterium
TLQDPPSDD

SEQ ID NO: 406594 - protein, 4 aa, Mycobacterium
TLRD

SEQ ID NO: 406595 - protein, 4 aa, Mycobacterium
TLRG

SEQ ID NO: 406596 - protein, 10 aa, Mycobacterium
TLRTDTGESV

SEQ ID NO: 406597 - protein, 10 aa, Mycobacterium
TLSKDGPFPL

SEQ ID NO: 406598 - protein, 6 aa, Mycobacterium
TLSSST

SEQ ID NO: 406599 - protein, 4 aa, Mycobacterium
TLST

SEQ ID NO: 406600 - protein, 4 aa, Mycobacterium
TLTD

SEQ ID NO: 406601 - protein, 6 aa, Mycobacterium
TLTDSA

SEQ ID NO: 406602 - protein, 8 aa, Mycobacterium
TLTDSAEG

SEQ ID NO: 406603 - protein, 7 aa, Mycobacterium
TLTGGEL

SEQ ID NO: 406604 - protein, 5 aa, Mycobacterium
TMHGR

SEQ ID NO: 406605 - protein, 4 aa, Mycobacterium
TMPG

SEQ ID NO: 406606 - protein, 5 aa, Mycobacterium
TMPPS

SEQ ID NO: 406607 - protein, 9 aa, Mycobacterium
TMPQRAPAL

SEQ ID NO: 406608 - protein, 9 aa, Mycobacterium
TMPRRAPAL

SEQ ID NO: 406609 - protein, 15 aa, Mycobacterium
TMSTTEADGVTGGVT

SEQ ID NO: 406610 - protein, 12 aa, Mycobacterium
TNADSANPGVSD

SEQ ID NO: 406611 - protein, 7 aa, Mycobacterium
TNAGKSS

SEQ ID NO: 406612 - protein, 5 aa, Mycobacterium
TNEAG

SEQ ID NO: 406613 - protein, 4 aa, Mycobacterium
TNED

SEQ ID NO: 406614 - protein, 8 aa, Mycobacterium
TNEGLRSR

SEQ ID NO: 406615 - protein, 11 aa, Mycobacterium
TNENPHPPSKA

SEQ ID NO: 406616 - protein, 10 aa, Mycobacterium
TNENPHPPTQ

SEQ ID NO: 406617 - protein, 5 aa, Mycobacterium
TNEVP

SEQ ID NO: 406618 - protein, 5 aa, Mycobacterium
TNEYP

SEQ ID NO: 406619 - protein, 6 aa, Mycobacterium
TNGAVR

SEQ ID NO: 406620 - protein, 4 aa, Mycobacterium
TNGI

SEQ ID NO: 406621 - protein, 6 aa, Mycobacterium
TNGNGV

SEQ ID NO: 406622 - protein, 4 aa, Mycobacterium
TNGR

SEQ ID NO: 406623 - protein, 9 aa, Mycobacterium
TNGRGTEQL

SEQ ID NO: 406624 - protein, 6 aa, Mycobacterium
TNGRHS

SEQ ID NO: 406625 - protein, 4 aa, Mycobacterium
TNGY

SEQ ID NO: 406626 - protein, 8 aa, Mycobacterium
TNHEPRRN

SEQ ID NO: 406627 - protein, 9 aa, Mycobacterium
TNHNGKGKP

SEQ ID NO: 406628 - protein, 6 aa, Mycobacterium
TNHSPG

SEQ ID NO: 406629 - protein, 8 aa, Mycobacterium
TNITRDTG

SEQ ID NO: 406630 - protein, 6 aa, Mycobacterium
TNKKGL

SEQ ID NO: 406631 - protein, 4 aa, Mycobacterium
TNLN

SEQ ID NO: 406632 - protein, 9 aa, Mycobacterium
TNMRSSTAD

SEQ ID NO: 406633 - protein, 6 aa, Mycobacterium
TNNADN

SEQ ID NO: 406634 - protein, 7 aa, Mycobacterium
TNNETAV

SEQ ID NO: 406635 - protein, 4 aa, Mycobacterium
TNPD

SEQ ID NO: 406636 - protein, 9 aa, Mycobacterium
TNPGQGVPL

SEQ ID NO: 406637 - protein, 6 aa, Mycobacterium
TNPKGE

SEQ ID NO: 406638 - protein, 7 aa, Mycobacterium
TNPPGTV

SEQ ID NO: 406639 - protein, 4 aa, Mycobacterium
TNPQ

SEQ ID NO: 406640 - protein, 4 aa, Mycobacterium
TNPS

SEQ ID NO: 406641 - protein, 11 aa, Mycobacterium
TNPTAHGGRAE

SEQ ID NO: 406642 - protein, 6 aa, Mycobacterium
TNRAGT

SEQ ID NO: 406643 - protein, 5 aa, Mycobacterium
TNRET

SEQ ID NO: 406644 - protein, 7 aa, Mycobacterium
TNRGGRT

SEQ ID NO: 406645 - protein, 4 aa, Mycobacterium
TNRQ

SEQ ID NO: 406646 - protein, 4 aa, Mycobacterium
TNRY

SEQ ID NO: 406647 - protein, 8 aa, Mycobacterium
TNRYPNES

SEQ ID NO: 406648 - protein, 8 aa, Mycobacterium
TNTDPNKV

SEQ ID NO: 406649 - protein, 5 aa, Mycobacterium
TNTEQ

SEQ ID NO: 406650 - protein, 8 aa, Mycobacterium
TNTPEFGA

SEQ ID NO: 406651 - protein, 5 aa, Mycobacterium
TPAAL

SEQ ID NO: 406652 - protein, 5 aa, Mycobacterium
TPADG

SEQ ID NO: 406653 - protein, 8 aa, Mycobacterium
TPADGSEP

SEQ ID NO: 406654 - protein, 5 aa, Mycobacterium
TPAEA

SEQ ID NO: 406655 - protein, 10 aa, Mycobacterium
TPAEEAGGGK

SEQ ID NO: 406656 - protein, 10 aa, Mycobacterium
TPAEESGGGK

SEQ ID NO: 406657 - protein, 6 aa, Mycobacterium
TPAEFQ

SEQ ID NO: 406658 - protein, 6 aa, Mycobacterium
TPAEGY

SEQ ID NO: 406659 - protein, 10 aa, Mycobacterium
TPAERADPKI

SEQ ID NO: 406660 - protein, 4 aa, Mycobacterium
TPAI

SEQ ID NO: 406661 - protein, 8 aa, Mycobacterium
TPAIGAPA

SEQ ID NO: 406662 - protein, 12 aa, Mycobacterium
TPANISGPGPVG

SEQ ID NO: 406663 - protein, 6 aa, Mycobacterium
TPAPVR

SEQ ID NO: 406664 - protein, 5 aa, Mycobacterium
TPAQR

SEQ ID NO: 406665 - protein, 6 aa, Mycobacterium
TPARPD

SEQ ID NO: 406666 - protein, 15 aa, Mycobacterium
TPASRHEAACASGSV

SEQ ID NO: 406667 - protein, 4 aa, Mycobacterium
TPAV

SEQ ID NO: 406668 - protein, 5 aa, Mycobacterium
TPAVT

SEQ ID NO: 406669 - protein, 12 aa, Mycobacterium
TPCNKREPGSGC

SEQ ID NO: 406670 - protein, 6 aa, Mycobacterium
TPDDDQ

SEQ ID NO: 406671 - protein, 5 aa, Mycobacterium
TPDEL

SEQ ID NO: 406672 - protein, 4 aa, Mycobacterium
TPDP

SEQ ID NO: 406673 - protein, 5 aa, Mycobacterium
TPDPG

SEQ ID NO: 406674 - protein, 8 aa, Mycobacterium
TPDSSRYW

SEQ ID NO: 406675 - protein, 9 aa, Mycobacterium
TPDSSRYWP

SEQ ID NO: 406676 - protein, 6 aa, Mycobacterium
TPDSYK

SEQ ID NO: 406677 - protein, 7 aa, Mycobacterium
TPDTSVA

SEQ ID NO: 406678 - protein, 7 aa, Mycobacterium
TPEERRA

SEQ ID NO: 406679 - protein, 5 aa, Mycobacterium
TPEEV

SEQ ID NO: 406680 - protein, 5 aa, Mycobacterium
TPEGE

SEQ ID NO: 406681 - protein, 7 aa, Mycobacterium
TPEGPGE

SEQ ID NO: 406682 - protein, 4 aa, Mycobacterium
TPEH

SEQ ID NO: 406683 - protein, 16 aa, Mycobacterium
TPEHAPEREKINEQHR

SEQ ID NO: 406684 - protein, 5 aa, Mycobacterium
TPEIP

SEQ ID NO: 406685 - protein, 4 aa, Mycobacterium
TPEK

SEQ ID NO: 406686 - protein, 11 aa, Mycobacterium
TPEKVGKDAGE

SEQ ID NO: 406687 - protein, 4 aa, Mycobacterium
TPEQ

SEQ ID NO: 406688 - protein, 5 aa, Mycobacterium
TPEQI

SEQ ID NO: 406689 - protein, 5 aa, Mycobacterium
TPEQL

SEQ ID NO: 406690 - protein, 12 aa, Mycobacterium
TPERAARDAEGV

SEQ ID NO: 406691 - protein, 6 aa, Mycobacterium
TPERAG

SEQ ID NO: 406692 - protein, 10 aa, Mycobacterium
TPETNGEPNR

SEQ ID NO: 406693 - protein, 13 aa, Mycobacterium
TPFDHEDPAAGGW

SEQ ID NO: 406694 - protein, 6 aa, Mycobacterium
TPFPGT

SEQ ID NO: 406695 - protein, 8 aa, Mycobacterium
TPGAGKTT

SEQ ID NO: 406696 - protein, 9 aa, Mycobacterium
TPGARSEQA

SEQ ID NO: 406697 - protein, 10 aa, Mycobacterium
TPGASDTARF

SEQ ID NO: 406698 - protein, 4 aa, Mycobacterium
TPGC

SEQ ID NO: 406699 - protein, 4 aa, Mycobacterium
TPGE

SEQ ID NO: 406700 - protein, 17 aa, Mycobacterium
TPGEYTQLTGRAGRRGI

SEQ ID NO: 406701 - protein, 9 aa, Mycobacterium
TPGGSSTPL

SEQ ID NO: 406702 - protein, 5 aa, Mycobacterium
TPGHE

SEQ ID NO: 406703 - protein, 8 aa, Mycobacterium
TPGHTPES

SEQ ID NO: 406704 - protein, 4 aa, Mycobacterium
TPGI

SEQ ID NO: 406705 - protein, 9 aa, Mycobacterium
TPGPPRPGY

SEQ ID NO: 406706 - protein, 4 aa, Mycobacterium
TPGQ

SEQ ID NO: 406707 - protein, 5 aa, Mycobacterium
TPGQR

SEQ ID NO: 406708 - protein, 4 aa, Mycobacterium
TPGR

SEQ ID NO: 406709 - protein, 4 aa, Mycobacterium
TPGS

SEQ ID NO: 406710 - protein, 4 aa, Mycobacterium
TPGV

SEQ ID NO: 406711 - protein, 7 aa, Mycobacterium
TPGYQAP

SEQ ID NO: 406712 - protein, 4 aa, Mycobacterium
TPHA

SEQ ID NO: 406713 - protein, 5 aa, Mycobacterium
TPHAA

SEQ ID NO: 406714 - protein, 4 aa, Mycobacterium
TPHE

SEQ ID NO: 406715 - protein, 4 aa, Mycobacterium
TPHL

SEQ ID NO: 406716 - protein, 5 aa, Mycobacterium
TPIES

SEQ ID NO: 406717 - protein, 12 aa, Mycobacterium
TPIGDDGPGGAV

SEQ ID NO: 406718 - protein, 6 aa, Mycobacterium
TPIPPV

SEQ ID NO: 406719 - protein, 4 aa, Mycobacterium
TPKI

SEQ ID NO: 406720 - protein, 4 aa, Mycobacterium
TPLA

SEQ ID NO: 406721 - protein, 5 aa, Mycobacterium
TPLGP

SEQ ID NO: 406722 - protein, 4 aa, Mycobacterium
TPLN

SEQ ID NO: 406723 - protein, 4 aa, Mycobacterium
TPLS

SEQ ID NO: 406724 - protein, 7 aa, Mycobacterium
TPLTEDQ

SEQ ID NO: 406725 - protein, 4 aa, Mycobacterium
TPLV

SEQ ID NO: 406726 - protein, 6 aa, Mycobacterium
TPNGPV

SEQ ID NO: 406727 - protein, 6 aa, Mycobacterium
TPNMTD

SEQ ID NO: 406728 - protein, 5 aa, Mycobacterium
TPNPH

SEQ ID NO: 406729 - protein, 9 aa, Mycobacterium
TPPAGSGLK

SEQ ID NO: 406730 - protein, 6 aa, Mycobacterium
TPPIPD

SEQ ID NO: 406731 - protein, 8 aa, Mycobacterium
TPPQPKQI

SEQ ID NO: 406732 - protein, 11 aa, Mycobacterium
TPPRARKPQRR

SEQ ID NO: 406733 - protein, 7 aa, Mycobacterium
TPPSRNA

SEQ ID NO: 406734 - protein, 4 aa, Mycobacterium
TPPT

SEQ ID NO: 406735 - protein, 5 aa, Mycobacterium
TPPTP

SEQ ID NO: 406736 - protein, 7 aa, Mycobacterium
TPPTRAE

SEQ ID NO: 406737 - protein, 4 aa, Mycobacterium
TPPV

SEQ ID NO: 406738 - protein, 5 aa, Mycobacterium
TPPVG

SEQ ID NO: 406739 - protein, 6 aa, Mycobacterium
TPPVGV

SEQ ID NO: 406740 - protein, 11 aa, Mycobacterium
TPQPATPSAVA

SEQ ID NO: 406741 - protein, 8 aa, Mycobacterium
TPQPPQSD

SEQ ID NO: 406742 - protein, 4 aa, Mycobacterium
TPQQ

SEQ ID NO: 406743 - protein, 11 aa, Mycobacterium
TPQSAPGYEDE

SEQ ID NO: 406744 - protein, 4 aa, Mycobacterium
TPQT

SEQ ID NO: 406745 - protein, 6 aa, Mycobacterium
TPRAEE

SEQ ID NO: 406746 - protein, 5 aa, Mycobacterium
TPRAR

SEQ ID NO: 406747 - protein, 4 aa, Mycobacterium
TPRD

SEQ ID NO: 406748 - protein, 9 aa, Mycobacterium
TPRDRGGYG

SEQ ID NO: 406749 - protein, 4 aa, Mycobacterium
TPRE

SEQ ID NO: 406750 - protein, 12 aa, Mycobacterium
TPRGKQRGGALN

SEQ ID NO: 406751 - protein, 13 aa, Mycobacterium
TPRGKQRNGSLNE

SEQ ID NO: 406752 - protein, 4 aa, Mycobacterium
TPRI

SEQ ID NO: 406753 - protein, 5 aa, Mycobacterium
TPRIY

SEQ ID NO: 406754 - protein, 5 aa, Mycobacterium
TPRRL

SEQ ID NO: 406755 - protein, 4 aa, Mycobacterium
TPRS

SEQ ID NO: 406756 - protein, 4 aa, Mycobacterium
TPRV

SEQ ID NO: 406757 - protein, 4 aa, Mycobacterium
TPSA

SEQ ID NO: 406758 - protein, 5 aa, Mycobacterium
TPSAH

SEQ ID NO: 406759 - protein, 6 aa, Mycobacterium
TPSDYR

SEQ ID NO: 406760 - protein, 7 aa, Mycobacterium
TPSEFND

SEQ ID NO: 406761 - protein, 4 aa, Mycobacterium
TPSG

SEQ ID NO: 406762 - protein, 5 aa, Mycobacterium
TPSGA

SEQ ID NO: 406763 - protein, 8 aa, Mycobacterium
TPSGRGGA

SEQ ID NO: 406764 - protein, 6 aa, Mycobacterium
TPSGVT

SEQ ID NO: 406765 - protein, 14 aa, Mycobacterium
TPSIPTADQPGTAF

SEQ ID NO: 406766 - protein, 9 aa, Mycobacterium
TPSRERVDS

SEQ ID NO: 406767 - protein, 9 aa, Mycobacterium
TPSVDPPLE

SEQ ID NO: 406768 - protein, 5 aa, Mycobacterium
TPTAA

SEQ ID NO: 406769 - protein, 5 aa, Mycobacterium
TPTDE

SEQ ID NO: 406770 - protein, 5 aa, Mycobacterium
TPTDN

SEQ ID NO: 406771 - protein, 4 aa, Mycobacterium
TPTQ

SEQ ID NO: 406772 - protein, 4 aa, Mycobacterium
TPTR

SEQ ID NO: 406773 - protein, 15 aa, Mycobacterium
TPTRAPTPVGASTYN

SEQ ID NO: 406774 - protein, 4 aa, Mycobacterium
TPTY

SEQ ID NO: 406775 - protein, 4 aa, Mycobacterium
TPVD

SEQ ID NO: 406776 - protein, 7 aa, Mycobacterium
TPVDEPE

SEQ ID NO: 406777 - protein, 5 aa, Mycobacterium
TPVGN

SEQ ID NO: 406778 - protein, 16 aa, Mycobacterium
TPWAPRSAAPELGQHT

SEQ ID NO: 406779 - protein, 4 aa, Mycobacterium
TPWL

SEQ ID NO: 406780 - protein, 5 aa, Mycobacterium
TPYNG

SEQ ID NO: 406781 - protein, 6 aa, Mycobacterium
TPYPPA

SEQ ID NO: 406782 - protein, 7 aa, Mycobacterium
TPYPPAR

SEQ ID NO: 406783 - protein, 13 aa, Mycobacterium
TPYPYTKDGERRW

SEQ ID NO: 406784 - protein, 4 aa, Mycobacterium
TPYT

SEQ ID NO: 406785 - protein, 7 aa, Mycobacterium
TQADVDA

SEQ ID NO: 406786 - protein, 4 aa, Mycobacterium
TQAS

SEQ ID NO: 406787 - protein, 6 aa, Mycobacterium
TQASQG

SEQ ID NO: 406788 - protein, 7 aa, Mycobacterium
TQATGGN

SEQ ID NO: 406789 - protein, 7 aa, Mycobacterium
TQDPRSW

SEQ ID NO: 406790 - protein, 4 aa, Mycobacterium
TQDV

SEQ ID NO: 406791 - protein, 4 aa, Mycobacterium
TQGA

SEQ ID NO: 406792 - protein, 10 aa, Mycobacterium
TQGHEASGTI

SEQ ID NO: 406793 - protein, 13 aa, Mycobacterium
TQGMRNHAKTDRA

SEQ ID NO: 406794 - protein, 5 aa, Mycobacterium
TQGPI

SEQ ID NO: 406795 - protein, 8 aa, Mycobacterium
TQGRARRT

SEQ ID NO: 406796 - protein, 7 aa, Mycobacterium
TQGTGEW

SEQ ID NO: 406797 - protein, 15 aa, Mycobacterium
TQGTYRELTSTSNCT

SEQ ID NO: 406798 - protein, 7 aa, Mycobacterium
TQGWNPD

SEQ ID NO: 406799 - protein, 4 aa, Mycobacterium
TQIG

SEQ ID NO: 406800 - protein, 7 aa, Mycobacterium
TQMGRNR

SEQ ID NO: 406801 - protein, 7 aa, Mycobacterium
TQNEHPN

SEQ ID NO: 406802 - protein, 4 aa, Mycobacterium
TQNP

SEQ ID NO: 406803 - protein, 5 aa, Mycobacterium
TQPAA

SEQ ID NO: 406804 - protein, 13 aa, Mycobacterium
TQPFPPVPANLRA

SEQ ID NO: 406805 - protein, 4 aa, Mycobacterium
TQPR

SEQ ID NO: 406806 - protein, 7 aa, Mycobacterium
TQPTHRA

SEQ ID NO: 406807 - protein, 8 aa, Mycobacterium
TQPTPADL

SEQ ID NO: 406808 - protein, 7 aa, Mycobacterium
TQQTAAP

SEQ ID NO: 406809 - protein, 4 aa, Mycobacterium
TQRN

SEQ ID NO: 406810 - protein, 4 aa, Mycobacterium
TQRR

SEQ ID NO: 406811 - protein, 4 aa, Mycobacterium
TQSK

SEQ ID NO: 406812 - protein, 8 aa, Mycobacterium
TQTHPDIP

SEQ ID NO: 406813 - protein, 10 aa, Mycobacterium
TQTHPGIPEQ

SEQ ID NO: 406814 - protein, 4 aa, Mycobacterium
TQYG

SEQ ID NO: 406815 - protein, 7 aa, Mycobacterium
TRAERDG

SEQ ID NO: 406816 - protein, 14 aa, Mycobacterium
TRAGEADHEHADPI

SEQ ID NO: 406817 - protein, 5 aa, Mycobacterium
TRAGV

SEQ ID NO: 406818 - protein, 12 aa, Mycobacterium
TRALTQGAQLDE

SEQ ID NO: 406819 - protein, 9 aa, Mycobacterium
TRAPQASEH

SEQ ID NO: 406820 - protein, 5 aa, Mycobacterium
TRARI

SEQ ID NO: 406821 - protein, 8 aa, Mycobacterium
TRARTTAV

SEQ ID NO: 406822 - protein, 12 aa, Mycobacterium
TRATRPEVRGGL

SEQ ID NO: 406823 - protein, 6 aa, Mycobacterium
TRAVRD

SEQ ID NO: 406824 - protein, 4 aa, Mycobacterium
TRDA

SEQ ID NO: 406825 - protein, 6 aa, Mycobacterium
TRDDDE

SEQ ID NO: 406826 - protein, 6 aa, Mycobacterium
TRDEFD

SEQ ID NO: 406827 - protein, 4 aa, Mycobacterium
TRDG

SEQ ID NO: 406828 - protein, 4 aa, Mycobacterium
TRDP

SEQ ID NO: 406829 - protein, 5 aa, Mycobacterium
TRDPA

SEQ ID NO: 406830 - protein, 5 aa, Mycobacterium
TRDQA

SEQ ID NO: 406831 - protein, 7 aa, Mycobacterium
TRDTELG

SEQ ID NO: 406832 - protein, 8 aa, Mycobacterium
TRDTIGQA

SEQ ID NO: 406833 - protein, 6 aa, Mycobacterium
TRDYDE

SEQ ID NO: 406834 - protein, 4 aa, Mycobacterium
TREA

SEQ ID NO: 406835 - protein, 5 aa, Mycobacterium
TREDV

SEQ ID NO: 406836 - protein, 6 aa, Mycobacterium
TREDVP

SEQ ID NO: 406837 - protein, 11 aa, Mycobacterium
TREEALARSRR

SEQ ID NO: 406838 - protein, 5 aa, Mycobacterium
TREGA

SEQ ID NO: 406839 - protein, 14 aa, Mycobacterium
TREHQDHRSYAGTV

SEQ ID NO: 406840 - protein, 4 aa, Mycobacterium
TREL

SEQ ID NO: 406841 - protein, 6 aa, Mycobacterium
TRFNAP

SEQ ID NO: 406842 - protein, 5 aa, Mycobacterium
TRFPG

SEQ ID NO: 406843 - protein, 5 aa, Mycobacterium
TRFPN

SEQ ID NO: 406844 - protein, 8 aa, Mycobacterium
TRGAGLAS

SEQ ID NO: 406845 - protein, 8 aa, Mycobacterium
TRGEGDAT

SEQ ID NO: 406846 - protein, 15 aa, Mycobacterium
TRGHGDSDWDPSGQY

SEQ ID NO: 406847 - protein, 4 aa, Mycobacterium
TRGS

SEQ ID NO: 406848 - protein, 4 aa, Mycobacterium
TRHD

SEQ ID NO: 406849 - protein, 5 aa, Mycobacterium
TRHPR

SEQ ID NO: 406850 - protein, 5 aa, Mycobacterium
TRHQE

SEQ ID NO: 406851 - protein, 8 aa, Mycobacterium
TRHSTPGV

SEQ ID NO: 406852 - protein, 4 aa, Mycobacterium
TRID

SEQ ID NO: 406853 - protein, 4 aa, Mycobacterium
TRIQ

SEQ ID NO: 406854 - protein, 5 aa, Mycobacterium
TRLGG

SEQ ID NO: 406855 - protein, 5 aa, Mycobacterium
TRLGL

SEQ ID NO: 406856 - protein, 6 aa, Mycobacterium
TRLPAG

SEQ ID NO: 406857 - protein, 5 aa, Mycobacterium
TRLPD

SEQ ID NO: 406858 - protein, 5 aa, Mycobacterium
TRLPS

SEQ ID NO: 406859 - protein, 12 aa, Mycobacterium
TRNGGNMADPGS

SEQ ID NO: 406860 - protein, 5 aa, Mycobacterium
TRPEH

SEQ ID NO: 406861 - protein, 5 aa, Mycobacterium
TRPEQ

SEQ ID NO: 406862 - protein, 4 aa, Mycobacterium
TRPG

SEQ ID NO: 406863 - protein, 5 aa, Mycobacterium
TRPGT

SEQ ID NO: 406864 - protein, 14 aa, Mycobacterium
TRPNPDDPTGKSTM

SEQ ID NO: 406865 - protein, 14 aa, Mycobacterium
TRPNPDDPTGRSTM

SEQ ID NO: 406866 - protein, 5 aa, Mycobacterium
TRPTT

SEQ ID NO: 406867 - protein, 4 aa, Mycobacterium
TRQA

SEQ ID NO: 406868 - protein, 5 aa, Mycobacterium
TRQPF

SEQ ID NO: 406869 - protein, 4 aa, Mycobacterium
TRRD

SEQ ID NO: 406870 - protein, 8 aa, Mycobacterium
TRRDVAGT

SEQ ID NO: 406871 - protein, 5 aa, Mycobacterium
TRRPE

SEQ ID NO: 406872 - protein, 7 aa, Mycobacterium
TRSAQPE

SEQ ID NO: 406873 - protein, 9 aa, Mycobacterium
TRSGDIDPS

SEQ ID NO: 406874 - protein, 8 aa, Mycobacterium
TRSGDVDP

SEQ ID NO: 406875 - protein, 7 aa, Mycobacterium
TRSRPND

SEQ ID NO: 406876 - protein, 10 aa, Mycobacterium
TRSRTHRRTP

SEQ ID NO: 406877 - protein, 7 aa, Mycobacterium
TRSSETL

SEQ ID NO: 406878 - protein, 7 aa, Mycobacterium
TRSTAPP

SEQ ID NO: 406879 - protein, 8 aa, Mycobacterium
TRTAPARA

SEQ ID NO: 406880 - protein, 6 aa, Mycobacterium
TRTDDR

SEQ ID NO: 406881 - protein, 6 aa, Mycobacterium
TRTDSI

SEQ ID NO: 406882 - protein, 4 aa, Mycobacterium
TRTV

SEQ ID NO: 406883 - protein, 4 aa, Mycobacterium
TRTY

SEQ ID NO: 406884 - protein, 5 aa, Mycobacterium
TRVDP

SEQ ID NO: 406885 - protein, 8 aa, Mycobacterium
TRVEQRTD

SEQ ID NO: 406886 - protein, 4 aa, Mycobacterium
TRVP

SEQ ID NO: 406887 - protein, 6 aa, Mycobacterium
TRYGSD

SEQ ID NO: 406888 - protein, 11 aa, Mycobacterium
TRYPPDGVSAE

SEQ ID NO: 406889 - protein, 4 aa, Mycobacterium
TSAA

SEQ ID NO: 406890 - protein, 7 aa, Mycobacterium
TSADSGD

SEQ ID NO: 406891 - protein, 5 aa, Mycobacterium
TSADV

SEQ ID NO: 406892 - protein, 4 aa, Mycobacterium
TSAE

SEQ ID NO: 406893 - protein, 9 aa, Mycobacterium
TSAGAAARV

SEQ ID NO: 406894 - protein, 63 aa, Mycobacterium
TSAIAERPTLRPGTTRTASRNTDGVADAGRPRGPEAGTAGGRESGSGRSDGGSDVDGVPAGTN

SEQ ID NO: 406895 - protein, 8 aa, Mycobacterium
TSALDSRR

SEQ ID NO: 406896 - protein, 5 aa, Mycobacterium
TSAPA

SEQ ID NO: 406897 - protein, 6 aa, Mycobacterium
TSAPDQ

SEQ ID NO: 406898 - protein, 14 aa, Mycobacterium
TSAPLDEDASPTVY

SEQ ID NO: 406899 - protein, 5 aa, Mycobacterium
TSAQA

SEQ ID NO: 406900 - protein, 5 aa, Mycobacterium
TSARP

SEQ ID NO: 406901 - protein, 5 aa, Mycobacterium
TSAST

SEQ ID NO: 406902 - protein, 6 aa, Mycobacterium
TSASVD

SEQ ID NO: 406903 - protein, 8 aa, Mycobacterium
TSATPARA

SEQ ID NO: 406904 - protein, 8 aa, Mycobacterium
TSAVDSRR

SEQ ID NO: 406905 - protein, 10 aa, Mycobacterium
TSDAGHGDSI

SEQ ID NO: 406906 - protein, 5 aa, Mycobacterium
TSDGR

SEQ ID NO: 406907 - protein, 5 aa, Mycobacterium
TSDRR

SEQ ID NO: 406908 - protein, 10 aa, Mycobacterium
TSDTAREEVG

SEQ ID NO: 406909 - protein, 8 aa, Mycobacterium
TSEPSPHD

SEQ ID NO: 406910 - protein, 6 aa, Mycobacterium
TSERYT

SEQ ID NO: 406911 - protein, 10 aa, Mycobacterium
TSEVYGSSAH

SEQ ID NO: 406912 - protein, 11 aa, Mycobacterium
TSEVYGSSPHD

SEQ ID NO: 406913 - protein, 12 aa, Mycobacterium
TSEVYGSSSRDP

SEQ ID NO: 406914 - protein, 4 aa, Mycobacterium
TSFG

SEQ ID NO: 406915 - protein, 8 aa, Mycobacterium
TSGAGGLP

SEQ ID NO: 406916 - protein, 7 aa, Mycobacterium
TSGANGV

SEQ ID NO: 406917 - protein, 10 aa, Mycobacterium
TSGDPPRPAW

SEQ ID NO: 406918 - protein, 8 aa, Mycobacterium
TSGEGAGF

SEQ ID NO: 406919 - protein, 4 aa, Mycobacterium
TSGG

SEQ ID NO: 406920 - protein, 7 aa, Mycobacterium
TSGGGLQ

SEQ ID NO: 406921 - protein, 7 aa, Mycobacterium
TSGGTSF

SEQ ID NO: 406922 - protein, 7 aa, Mycobacterium
TSGGVWG

SEQ ID NO: 406923 - protein, 7 aa, Mycobacterium
TSGHPIP

SEQ ID NO: 406924 - protein, 9 aa, Mycobacterium
TSGHRGSAL

SEQ ID NO: 406925 - protein, 6 aa, Mycobacterium
TSGNPC

SEQ ID NO: 406926 - protein, 7 aa, Mycobacterium
TSGNPSF

SEQ ID NO: 406927 - protein, 4 aa, Mycobacterium
TSGP

SEQ ID NO: 406928 - protein, 9 aa, Mycobacterium
TSGPALERA

SEQ ID NO: 406929 - protein, 17 aa, Mycobacterium
TSGPALQQNLVAVLEGK

SEQ ID NO: 406930 - protein, 17 aa, Mycobacterium
TSGPALQQNLVAVMEGK

SEQ ID NO: 406931 - protein, 5 aa, Mycobacterium
TSGPG

SEQ ID NO: 406932 - protein, 6 aa, Mycobacterium
TSGPGA

SEQ ID NO: 406933 - protein, 9 aa, Mycobacterium
TSGPGFGHT

SEQ ID NO: 406934 - protein, 18 aa, Mycobacterium
TSGRANKARLNRSPVRSA

SEQ ID NO: 406935 - protein, 11 aa, Mycobacterium
TSGSTRAPAGV

SEQ ID NO: 406936 - protein, 10 aa, Mycobacterium
TSGSTRSPAG

SEQ ID NO: 406937 - protein, 10 aa, Mycobacterium
TSGSTRTPAG

SEQ ID NO: 406938 - protein, 10 aa, Mycobacterium
TSGSTRTPTG

SEQ ID NO: 406939 - protein, 11 aa, Mycobacterium
TSGSTRTPTGV

SEQ ID NO: 406940 - protein, 11 aa, Mycobacterium
TSGTTGAPKGA

SEQ ID NO: 406941 - protein, 7 aa, Mycobacterium
TSGTTGL

SEQ ID NO: 406942 - protein, 14 aa, Mycobacterium
TSGVDDEITTTAGP

SEQ ID NO: 406943 - protein, 8 aa, Mycobacterium
TSGVPERQ

SEQ ID NO: 406944 - protein, 4 aa, Mycobacterium
TSHE

SEQ ID NO: 406945 - protein, 7 aa, Mycobacterium
TSHGSTL

SEQ ID NO: 406946 - protein, 6 aa, Mycobacterium
TSKLER

SEQ ID NO: 406947 - protein, 7 aa, Mycobacterium
TSKSYAA

SEQ ID NO: 406948 - protein, 7 aa, Mycobacterium
TSKTRDT

SEQ ID NO: 406949 - protein, 4 aa, Mycobacterium
TSLE

SEQ ID NO: 406950 - protein, 5 aa, Mycobacterium
TSLED

SEQ ID NO: 406951 - protein, 15 aa, Mycobacterium
TSLNNTQAQADPDGK

SEQ ID NO: 406952 - protein, 6 aa, Mycobacterium
TSLPGV

SEQ ID NO: 406953 - protein, 10 aa, Mycobacterium
TSLRDGSHHK

SEQ ID NO: 406954 - protein, 15 aa, Mycobacterium
TSMEQANGGPSDNDR

SEQ ID NO: 406955 - protein, 6 aa, Mycobacterium
TSMNSS

SEQ ID NO: 406956 - protein, 8 aa, Mycobacterium
TSMSPQPR

SEQ ID NO: 406957 - protein, 7 aa, Mycobacterium
TSNAQNA

SEQ ID NO: 406958 - protein, 7 aa, Mycobacterium
TSNGFGG

SEQ ID NO: 406959 - protein, 6 aa, Mycobacterium
TSNTAG

SEQ ID NO: 406960 - protein, 7 aa, Mycobacterium
TSPARTA

SEQ ID NO: 406961 - protein, 4 aa, Mycobacterium
TSPD

SEQ ID NO: 406962 - protein, 10 aa, Mycobacterium
TSPDEPKYDA

SEQ ID NO: 406963 - protein, 19 aa, Mycobacterium
TSPDTAPTKAGSIDQTPRP

SEQ ID NO: 406964 - protein, 6 aa, Mycobacterium
TSPEAT

SEQ ID NO: 406965 - protein, 4 aa, Mycobacterium
TSPI

SEQ ID NO: 406966 - protein, 5 aa, Mycobacterium
TSPIR

SEQ ID NO: 406967 - protein, 5 aa, Mycobacterium
TSPNA

SEQ ID NO: 406968 - protein, 15 aa, Mycobacterium
TSPSPSKRRTATRDV

SEQ ID NO: 406969 - protein, 6 aa, Mycobacterium
TSPTGH

SEQ ID NO: 406970 - protein, 9 aa, Mycobacterium
TSPTSWEQA

SEQ ID NO: 406971 - protein, 6 aa, Mycobacterium
TSPWPA

SEQ ID NO: 406972 - protein, 7 aa, Mycobacterium
TSPWPED

SEQ ID NO: 406973 - protein, 4 aa, Mycobacterium
TSQL

SEQ ID NO: 406974 - protein, 6 aa, Mycobacterium
TSRDRG

SEQ ID NO: 406975 - protein, 6 aa, Mycobacterium
TSRLDD

SEQ ID NO: 406976 - protein, 6 aa, Mycobacterium
TSRLGP

SEQ ID NO: 406977 - protein, 13 aa, Mycobacterium
TSRNGAGPAPDSE

SEQ ID NO: 406978 - protein, 5 aa, Mycobacterium
TSSDA

SEQ ID NO: 406979 - protein, 23 aa, Mycobacterium
TSSEAGLSGPVGQPNYGAAKAGI

SEQ ID NO: 406980 - protein, 7 aa, Mycobacterium
TSSETIN

SEQ ID NO: 406981 - protein, 7 aa, Mycobacterium
TSSETVN

SEQ ID NO: 406982 - protein, 13 aa, Mycobacterium
TSSGEIPTNWPGP

SEQ ID NO: 406983 - protein, 8 aa, Mycobacterium
TSSGERVD

SEQ ID NO: 406984 - protein, 7 aa, Mycobacterium
TSSGGGM

SEQ ID NO: 406985 - protein, 6 aa, Mycobacterium
TSSPGS

SEQ ID NO: 406986 - protein, 14 aa, Mycobacterium
TSSPVAADSRGLGT

SEQ ID NO: 406987 - protein, 9 aa, Mycobacterium
TSSRPGECE

SEQ ID NO: 406988 - protein, 10 aa, Mycobacterium
TSSTSGPTID

SEQ ID NO: 406989 - protein, 5 aa, Mycobacterium
TSSYG

SEQ ID NO: 406990 - protein, 8 aa, Mycobacterium
TSTAGGLG

SEQ ID NO: 406991 - protein, 11 aa, Mycobacterium
TSTDPDNRRKG

SEQ ID NO: 406992 - protein, 5 aa, Mycobacterium
TSTEA

SEQ ID NO: 406993 - protein, 5 aa, Mycobacterium
TSTEI

SEQ ID NO: 406994 - protein, 10 aa, Mycobacterium
TSTGPDHDKE

SEQ ID NO: 406995 - protein, 7 aa, Mycobacterium
TSTMGGS

SEQ ID NO: 406996 - protein, 9 aa, Mycobacterium
TSTNDSGRG

SEQ ID NO: 406997 - protein, 8 aa, Mycobacterium
TSTPSADE

SEQ ID NO: 406998 - protein, 9 aa, Mycobacterium
TSTRQSRKG

SEQ ID NO: 406999 - protein, 8 aa, Mycobacterium
TSTTAAGR

SEQ ID NO: 407000 - protein, 8 aa, Mycobacterium
TSTTPAGR

SEQ ID NO: 407001 - protein, 6 aa, Mycobacterium
TSTTWP

SEQ ID NO: 407002 - protein, 4 aa, Mycobacterium
TSTV

SEQ ID NO: 407003 - protein, 4 aa, Mycobacterium
TSTW

SEQ ID NO: 407004 - protein, 4 aa, Mycobacterium
TSVA

SEQ ID NO: 407005 - protein, 6 aa, Mycobacterium
TSVGPD

SEQ ID NO: 407006 - protein, 7 aa, Mycobacterium
TSVGPDV

SEQ ID NO: 407007 - protein, 5 aa, Mycobacterium
TSVGS

SEQ ID NO: 407008 - protein, 6 aa, Mycobacterium
TSYAGQ

SEQ ID NO: 407009 - protein, 8 aa, Mycobacterium
TSYATHNE

SEQ ID NO: 407010 - protein, 7 aa, Mycobacterium
TSYPSPV

SEQ ID NO: 407011 - protein, 5 aa, Mycobacterium
TTAEG

SEQ ID NO: 407012 - protein, 5 aa, Mycobacterium
TTAER

SEQ ID NO: 407013 - protein, 7 aa, Mycobacterium
TTAGGSM

SEQ ID NO: 407014 - protein, 11 aa, Mycobacterium
TTAGPEADELT

SEQ ID NO: 407015 - protein, 4 aa, Mycobacterium
TTAL

SEQ ID NO: 407016 - protein, 4 aa, Mycobacterium
TTAN

SEQ ID NO: 407017 - protein, 6 aa, Mycobacterium
TTAPAN

SEQ ID NO: 407018 - protein, 7 aa, Mycobacterium
TTAVRDG

SEQ ID NO: 407019 - protein, 16 aa, Mycobacterium
TTDPGRPLSATDALDA

SEQ ID NO: 407020 - protein, 5 aa, Mycobacterium
TTDPS

SEQ ID NO: 407021 - protein, 4 aa, Mycobacterium
TTDQ

SEQ ID NO: 407022 - protein, 7 aa, Mycobacterium
TTEAAEG

SEQ ID NO: 407023 - protein, 6 aa, Mycobacterium
TTEDGT

SEQ ID NO: 407024 - protein, 7 aa, Mycobacterium
TTEDGTG

SEQ ID NO: 407025 - protein, 15 aa, Mycobacterium
TTEDPANGFRPDTGR

SEQ ID NO: 407026 - protein, 16 aa, Mycobacterium
TTEDPANGFRPDTGRI

SEQ ID NO: 407027 - protein, 6 aa, Mycobacterium
TTEPIA

SEQ ID NO: 407028 - protein, 7 aa, Mycobacterium
TTEPITT

SEQ ID NO: 407029 - protein, 8 aa, Mycobacterium
TTERDGYS

SEQ ID NO: 407030 - protein, 6 aa, Mycobacterium
TTERTA

SEQ ID NO: 407031 - protein, 4 aa, Mycobacterium
TTFR

SEQ ID NO: 407032 - protein, 6 aa, Mycobacterium
TTFTKR

SEQ ID NO: 407033 - protein, 4 aa, Mycobacterium
TTGA

SEQ ID NO: 407034 - protein, 5 aa, Mycobacterium
TTGAA

SEQ ID NO: 407035 - protein, 9 aa, Mycobacterium
TTGATARES

SEQ ID NO: 407036 - protein, 4 aa, Mycobacterium
TTGD

SEQ ID NO: 407037 - protein, 4 aa, Mycobacterium
TTGE

SEQ ID NO: 407038 - protein, 6 aa, Mycobacterium
TTGFPK

SEQ ID NO: 407039 - protein, 15 aa, Mycobacterium
TTGGSQKAVNAERGG

SEQ ID NO: 407040 - protein, 4 aa, Mycobacterium
TTGI

SEQ ID NO: 407041 - protein, 13 aa, Mycobacterium
TTGIDGGPGGAGY

SEQ ID NO: 407042 - protein, 4 aa, Mycobacterium
TTGL

SEQ ID NO: 407043 - protein, 5 aa, Mycobacterium
TTGLG

SEQ ID NO: 407044 - protein, 4 aa, Mycobacterium
TTGN

SEQ ID NO: 407045 - protein, 9 aa, Mycobacterium
TTGPLGQGL

SEQ ID NO: 407046 - protein, 16 aa, Mycobacterium
TTGSAGESHTLSDDEY

SEQ ID NO: 407047 - protein, 6 aa, Mycobacterium
TTGSSG

SEQ ID NO: 407048 - protein, 6 aa, Mycobacterium
TTGTSV

SEQ ID NO: 407049 - protein, 12 aa, Mycobacterium
TTHDTKRGEDVR

SEQ ID NO: 407050 - protein, 4 aa, Mycobacterium
TTHP

SEQ ID NO: 407051 - protein, 6 aa, Mycobacterium
TTHPGT

SEQ ID NO: 407052 - protein, 5 aa, Mycobacterium
TTIPG

SEQ ID NO: 407053 - protein, 4 aa, Mycobacterium
TTKA

SEQ ID NO: 407054 - protein, 5 aa, Mycobacterium
TTKEK

SEQ ID NO: 407055 - protein, 7 aa, Mycobacterium
TTKTFTG

SEQ ID NO: 407056 - protein, 6 aa, Mycobacterium
TTLDSG

SEQ ID NO: 407057 - protein, 5 aa, Mycobacterium
TTLNN

SEQ ID NO: 407058 - protein, 12 aa, Mycobacterium
TTLRNDPKYATQ

SEQ ID NO: 407059 - protein, 6 aa, Mycobacterium
TTNPLQ

SEQ ID NO: 407060 - protein, 8 aa, Mycobacterium
TTNPNAEL

SEQ ID NO: 407061 - protein, 5 aa, Mycobacterium
TTPDW

SEQ ID NO: 407062 - protein, 5 aa, Mycobacterium
TTPEG

SEQ ID NO: 407063 - protein, 7 aa, Mycobacterium
TTPEQQQ

SEQ ID NO: 407064 - protein, 7 aa, Mycobacterium
TTPGKPA

SEQ ID NO: 407065 - protein, 8 aa, Mycobacterium
TTPGKPAL

SEQ ID NO: 407066 - protein, 6 aa, Mycobacterium
TTPGPV

SEQ ID NO: 407067 - protein, 5 aa, Mycobacterium
TTPLT

SEQ ID NO: 407068 - protein, 5 aa, Mycobacterium
TTPMH

SEQ ID NO: 407069 - protein, 4 aa, Mycobacterium
TTPP

SEQ ID NO: 407070 - protein, 9 aa, Mycobacterium
TTPRAPVGV

SEQ ID NO: 407071 - protein, 7 aa, Mycobacterium
TTPSRPA

SEQ ID NO: 407072 - protein, 6 aa, Mycobacterium
TTPTAV

SEQ ID NO: 407073 - protein, 6 aa, Mycobacterium
TTQIDP

SEQ ID NO: 407074 - protein, 4 aa, Mycobacterium
TTRA

SEQ ID NO: 407075 - protein, 5 aa, Mycobacterium
TTRAG

SEQ ID NO: 407076 - protein, 6 aa, Mycobacterium
TTRANE

SEQ ID NO: 407077 - protein, 4 aa, Mycobacterium
TTRD

SEQ ID NO: 407078 - protein, 9 aa, Mycobacterium
TTRGPNGVG

SEQ ID NO: 407079 - protein, 5 aa, Mycobacterium
TTRGR

SEQ ID NO: 407080 - protein, 9 aa, Mycobacterium
TTRGSQLTP

SEQ ID NO: 407081 - protein, 5 aa, Mycobacterium
TTRNG

SEQ ID NO: 407082 - protein, 5 aa, Mycobacterium
TTRPY

SEQ ID NO: 407083 - protein, 5 aa, Mycobacterium
TTRRE

SEQ ID NO: 407084 - protein, 11 aa, Mycobacterium
TTRSGALTGPL

SEQ ID NO: 407085 - protein, 4 aa, Mycobacterium
TTSA

SEQ ID NO: 407086 - protein, 6 aa, Mycobacterium
TTSDAP

SEQ ID NO: 407087 - protein, 5 aa, Mycobacterium
TTSGD

SEQ ID NO: 407088 - protein, 9 aa, Mycobacterium
TTSGNSPNV

SEQ ID NO: 407089 - protein, 15 aa, Mycobacterium
TTSGVDDEITTTAGP

SEQ ID NO: 407090 - protein, 16 aa, Mycobacterium
TTSPHDLAPDPAQAAT

SEQ ID NO: 407091 - protein, 14 aa, Mycobacterium
TTSQAPRVDEGRAE

SEQ ID NO: 407092 - protein, 9 aa, Mycobacterium
TTSQPPQPR

SEQ ID NO: 407093 - protein, 4 aa, Mycobacterium
TTSR

SEQ ID NO: 407094 - protein, 6 aa, Mycobacterium
TTSTTR

SEQ ID NO: 407095 - protein, 7 aa, Mycobacterium
TTTAKEA

SEQ ID NO: 407096 - protein, 4 aa, Mycobacterium
TTTG

SEQ ID NO: 407097 - protein, 13 aa, Mycobacterium
TTTGTGLDTTDIR

SEQ ID NO: 407098 - protein, 5 aa, Mycobacterium
TTTHA

SEQ ID NO: 407099 - protein, 4 aa, Mycobacterium
TTTI

SEQ ID NO: 407100 - protein, 5 aa, Mycobacterium
TTTRS

SEQ ID NO: 407101 - protein, 9 aa, Mycobacterium
TTTTRAGNA

SEQ ID NO: 407102 - protein, 14 aa, Mycobacterium
TTTTTHKSLRGPRG

SEQ ID NO: 407103 - protein, 6 aa, Mycobacterium
TTVAPD

SEQ ID NO: 407104 - protein, 7 aa, Mycobacterium
TTVQGSG

SEQ ID NO: 407105 - protein, 4 aa, Mycobacterium
TTYR

SEQ ID NO: 407106 - protein, 4 aa, Mycobacterium
TVAE

SEQ ID NO: 407107 - protein, 8 aa, Mycobacterium
TVDPGDAR

SEQ ID NO: 407108 - protein, 10 aa, Mycobacterium
TVDPQPGEDD

SEQ ID NO: 407109 - protein, 8 aa, Mycobacterium
TVDSGASI

SEQ ID NO: 407110 - protein, 19 aa, Mycobacterium
TVDTPRTETNNKRGGNHNA

SEQ ID NO: 407111 - protein, 4 aa, Mycobacterium
TVGA

SEQ ID NO: 407112 - protein, 4 aa, Mycobacterium
TVGQ

SEQ ID NO: 407113 - protein, 4 aa, Mycobacterium
TVGR

SEQ ID NO: 407114 - protein, 6 aa, Mycobacterium
TVGRPV

SEQ ID NO: 407115 - protein, 4 aa, Mycobacterium
TVGY

SEQ ID NO: 407116 - protein, 4 aa, Mycobacterium
TVHP

SEQ ID NO: 407117 - protein, 4 aa, Mycobacterium
TVKR

SEQ ID NO: 407118 - protein, 13 aa, Mycobacterium
TVLGGESANLEQA

SEQ ID NO: 407119 - protein, 4 aa, Mycobacterium
TVPA

SEQ ID NO: 407120 - protein, 5 aa, Mycobacterium
TVPAG

SEQ ID NO: 407121 - protein, 6 aa, Mycobacterium
TVPDGP

SEQ ID NO: 407122 - protein, 5 aa, Mycobacterium
TVPER

SEQ ID NO: 407123 - protein, 4 aa, Mycobacterium
TVPG

SEQ ID NO: 407124 - protein, 11 aa, Mycobacterium
TVPGSKSQTNR

SEQ ID NO: 407125 - protein, 9 aa, Mycobacterium
TVPPNDGGL

SEQ ID NO: 407126 - protein, 5 aa, Mycobacterium
TVPQP

SEQ ID NO: 407127 - protein, 7 aa, Mycobacterium
TVPRGGV

SEQ ID NO: 407128 - protein, 6 aa, Mycobacterium
TVPRGL

SEQ ID NO: 407129 - protein, 6 aa, Mycobacterium
TVPVGT

SEQ ID NO: 407130 - protein, 8 aa, Mycobacterium
TVQESTAQ

SEQ ID NO: 407131 - protein, 10 aa, Mycobacterium
TVRGATLNGR

SEQ ID NO: 407132 - protein, 4 aa, Mycobacterium
TVSG

SEQ ID NO: 407133 - protein, 7 aa, Mycobacterium
TVSNAEE

SEQ ID NO: 407134 - protein, 14 aa, Mycobacterium
TVSQPSLQKGRRAG

SEQ ID NO: 407135 - protein, 9 aa, Mycobacterium
TVTAEPRDT

SEQ ID NO: 407136 - protein, 6 aa, Mycobacterium
TVTDTK

SEQ ID NO: 407137 - protein, 4 aa, Mycobacterium
TVTE

SEQ ID NO: 407138 - protein, 9 aa, Mycobacterium
TVTGQESTL

SEQ ID NO: 407139 - protein, 6 aa, Mycobacterium
TVTGTA

SEQ ID NO: 407140 - protein, 6 aa, Mycobacterium
TVTPRY

SEQ ID NO: 407141 - protein, 6 aa, Mycobacterium
TVTRRT

SEQ ID NO: 407142 - protein, 12 aa, Mycobacterium
TVTSPGGTTAAG

SEQ ID NO: 407143 - protein, 11 aa, Mycobacterium
TWGGSSTTENV

SEQ ID NO: 407144 - protein, 12 aa, Mycobacterium
TWQPDSPPVTAA

SEQ ID NO: 407145 - protein, 4 aa, Mycobacterium
TYAG

SEQ ID NO: 407146 - protein, 5 aa, Mycobacterium
TYAGG

SEQ ID NO: 407147 - protein, 10 aa, Mycobacterium
TYAGTDRQVR

SEQ ID NO: 407148 - protein, 6 aa, Mycobacterium
TYASSA

SEQ ID NO: 407149 - protein, 9 aa, Mycobacterium
TYCESGSST

SEQ ID NO: 407150 - protein, 10 aa, Mycobacterium
TYEGREKEVS

SEQ ID NO: 407151 - protein, 7 aa, Mycobacterium
TYESPGD

SEQ ID NO: 407152 - protein, 4 aa, Mycobacterium
TYGG

SEQ ID NO: 407153 - protein, 6 aa, Mycobacterium
TYGPDR

SEQ ID NO: 407154 - protein, 9 aa, Mycobacterium
TYGSSAPYM

SEQ ID NO: 407155 - protein, 6 aa, Mycobacterium
TYGTPV

SEQ ID NO: 407156 - protein, 4 aa, Mycobacterium
TYGV

SEQ ID NO: 407157 - protein, 7 aa, Mycobacterium
TYKPYGP

SEQ ID NO: 407158 - protein, 15 aa, Mycobacterium
TYNEPNTNLTSPETA

SEQ ID NO: 407159 - protein, 15 aa, Mycobacterium
TYNEPNTNLTSPETT

SEQ ID NO: 407160 - protein, 5 aa, Mycobacterium
TYPAG

SEQ ID NO: 407161 - protein, 5 aa, Mycobacterium
TYQAG

SEQ ID NO: 407162 - protein, 11 aa, Mycobacterium
TYRGPYTPGSA

SEQ ID NO: 407163 - protein, 6 aa, Mycobacterium
TYRPSD

SEQ ID NO: 407164 - protein, 6 aa, Mycobacterium
TYRPTV

SEQ ID NO: 407165 - protein, 7 aa, Mycobacterium
TYSSARG

SEQ ID NO: 407166 - protein, 4 aa, Mycobacterium
VAAA

SEQ ID NO: 407167 - protein, 4 aa, Mycobacterium
VAAD

SEQ ID NO: 407168 - protein, 6 aa, Mycobacterium
VAAEGG

SEQ ID NO: 407169 - protein, 6 aa, Mycobacterium
VAAGAQ

SEQ ID NO: 407170 - protein, 7 aa, Mycobacterium
VAAGGDQ

SEQ ID NO: 407171 - protein, 17 aa, Mycobacterium
VAAGPDSTLQSQPANAI

SEQ ID NO: 407172 - protein, 7 aa, Mycobacterium
VAAGRAG

SEQ ID NO: 407173 - protein, 5 aa, Mycobacterium
VAAPD

SEQ ID NO: 407174 - protein, 6 aa, Mycobacterium
VAAPDR

SEQ ID NO: 407175 - protein, 5 aa, Mycobacterium
VAARG

SEQ ID NO: 407176 - protein, 4 aa, Mycobacterium
VAAS

SEQ ID NO: 407177 - protein, 6 aa, Mycobacterium
VAASGG

SEQ ID NO: 407178 - protein, 7 aa, Mycobacterium
VADHTGV

SEQ ID NO: 407179 - protein, 7 aa, Mycobacterium
VADPGGG

SEQ ID NO: 407180 - protein, 7 aa, Mycobacterium
VADPLGG

SEQ ID NO: 407181 - protein, 7 aa, Mycobacterium
VADPRDI

SEQ ID NO: 407182 - protein, 11 aa, Mycobacterium
VADSVARSGGL

SEQ ID NO: 407183 - protein, 8 aa, Mycobacterium
VADYPTDR

SEQ ID NO: 407184 - protein, 4 aa, Mycobacterium
VAEG

SEQ ID NO: 407185 - protein, 4 aa, Mycobacterium
VAER

SEQ ID NO: 407186 - protein, 5 aa, Mycobacterium
VAERA

SEQ ID NO: 407187 - protein, 6 aa, Mycobacterium
VAERAG

SEQ ID NO: 407188 - protein, 7 aa, Mycobacterium
VAERAGS

SEQ ID NO: 407189 - protein, 8 aa, Mycobacterium
VAESPADT

SEQ ID NO: 407190 - protein, 4 aa, Mycobacterium
VAET

SEQ ID NO: 407191 - protein, 5 aa, Mycobacterium
VAGEE

SEQ ID NO: 407192 - protein, 8 aa, Mycobacterium
VAGERSGR

SEQ ID NO: 407193 - protein, 4 aa, Mycobacterium
VAGP

SEQ ID NO: 407194 - protein, 8 aa, Mycobacterium
VAGPGTEI

SEQ ID NO: 407195 - protein, 4 aa, Mycobacterium
VAGR

SEQ ID NO: 407196 - protein, 16 aa, Mycobacterium
VAGRPKEEYGLEPQGL

SEQ ID NO: 407197 - protein, 5 aa, Mycobacterium
VAGRT

SEQ ID NO: 407198 - protein, 8 aa, Mycobacterium
VAGSAADG

SEQ ID NO: 407199 - protein, 7 aa, Mycobacterium
VAGSPED

SEQ ID NO: 407200 - protein, 5 aa, Mycobacterium
VAGTR

SEQ ID NO: 407201 - protein, 4 aa, Mycobacterium
VAHG

SEQ ID NO: 407202 - protein, 6 aa, Mycobacterium
VAMPGG

SEQ ID NO: 407203 - protein, 6 aa, Mycobacterium
VANEIE

SEQ ID NO: 407204 - protein, 4 aa, Mycobacterium
VANR

SEQ ID NO: 407205 - protein, 4 aa, Mycobacterium
VAPD

SEQ ID NO: 407206 - protein, 8 aa, Mycobacterium
VAPDGASV

SEQ ID NO: 407207 - protein, 6 aa, Mycobacterium
VAPDGV

SEQ ID NO: 407208 - protein, 10 aa, Mycobacterium
VAPDHQNTKR

SEQ ID NO: 407209 - protein, 5 aa, Mycobacterium
VAPGA

SEQ ID NO: 407210 - protein, 8 aa, Mycobacterium
VAPGGTVT

SEQ ID NO: 407211 - protein, 11 aa, Mycobacterium
VAPGRNVPYTS

SEQ ID NO: 407212 - protein, 4 aa, Mycobacterium
VAPP

SEQ ID NO: 407213 - protein, 8 aa, Mycobacterium
VAPPKPSK

SEQ ID NO: 407214 - protein, 6 aa, Mycobacterium
VAPRDA

SEQ ID NO: 407215 - protein, 6 aa, Mycobacterium
VAPRTA

SEQ ID NO: 407216 - protein, 5 aa, Mycobacterium
VAPSK

SEQ ID NO: 407217 - protein, 5 aa, Mycobacterium
VAPTV

SEQ ID NO: 407218 - protein, 4 aa, Mycobacterium
VAPV

SEQ ID NO: 407219 - protein, 6 aa, Mycobacterium
VAQRPQ

SEQ ID NO: 407220 - protein, 4 aa, Mycobacterium
VARE

SEQ ID NO: 407221 - protein, 7 aa, Mycobacterium
VARETEL

SEQ ID NO: 407222 - protein, 8 aa, Mycobacterium
VARSRSDA

SEQ ID NO: 407223 - protein, 4 aa, Mycobacterium
VASG

SEQ ID NO: 407224 - protein, 8 aa, Mycobacterium
VASGYAPR

SEQ ID NO: 407225 - protein, 4 aa, Mycobacterium
VASK

SEQ ID NO: 407226 - protein, 7 aa, Mycobacterium
VASRAGQ

SEQ ID NO: 407227 - protein, 4 aa, Mycobacterium
VATG

SEQ ID NO: 407228 - protein, 17 aa, Mycobacterium
VATKTNDVAGDGTTTAT

SEQ ID NO: 407229 - protein, 8 aa, Mycobacterium
VATNPRAQ

SEQ ID NO: 407230 - protein, 7 aa, Mycobacterium
VATQDTV

SEQ ID NO: 407231 - protein, 7 aa, Mycobacterium
VATRSAA

SEQ ID NO: 407232 - protein, 4 aa, Mycobacterium
VATT

SEQ ID NO: 407233 - protein, 10 aa, Mycobacterium
VATTTRVGGP

SEQ ID NO: 407234 - protein, 7 aa, Mycobacterium
VAVPAET

SEQ ID NO: 407235 - protein, 4 aa, Mycobacterium
VDAD

SEQ ID NO: 407236 - protein, 7 aa, Mycobacterium
VDAEGRR

SEQ ID NO: 407237 - protein, 6 aa, Mycobacterium
VDAGGR

SEQ ID NO: 407238 - protein, 6 aa, Mycobacterium
VDAPED

SEQ ID NO: 407239 - protein, 4 aa, Mycobacterium
VDAR

SEQ ID NO: 407240 - protein, 4 aa, Mycobacterium
VDAS

SEQ ID NO: 407241 - protein, 7 aa, Mycobacterium
VDASGRR

SEQ ID NO: 407242 - protein, 4 aa, Mycobacterium
VDAT

SEQ ID NO: 407243 - protein, 11 aa, Mycobacterium
VDDAPYGGGPG

SEQ ID NO: 407244 - protein, 4 aa, Mycobacterium
VDDD

SEQ ID NO: 407245 - protein, 8 aa, Mycobacterium
VDDGPTAL

SEQ ID NO: 407246 - protein, 19 aa, Mycobacterium
VDDGSGETDEDQKLRNESR

SEQ ID NO: 407247 - protein, 10 aa, Mycobacterium
VDDQGRRYSA

SEQ ID NO: 407248 - protein, 5 aa, Mycobacterium
VDDRQ

SEQ ID NO: 407249 - protein, 11 aa, Mycobacterium
VDDSPYGGGPG

SEQ ID NO: 407250 - protein, 6 aa, Mycobacterium
VDDVPR

SEQ ID NO: 407251 - protein, 8 aa, Mycobacterium
VDEATGCA

SEQ ID NO: 407252 - protein, 7 aa, Mycobacterium
VDEEAAR

SEQ ID NO: 407253 - protein, 11 aa, Mycobacterium
VDEGPRESSLE

SEQ ID NO: 407254 - protein, 4 aa, Mycobacterium
VDES

SEQ ID NO: 407255 - protein, 11 aa, Mycobacterium
VDESESAESFE

SEQ ID NO: 407256 - protein, 4 aa, Mycobacterium
VDEV

SEQ ID NO: 407257 - protein, 8 aa, Mycobacterium
VDEYADPK

SEQ ID NO: 407258 - protein, 5 aa, Mycobacterium
VDGAE

SEQ ID NO: 407259 - protein, 9 aa, Mycobacterium
VDGERLSSS

SEQ ID NO: 407260 - protein, 12 aa, Mycobacterium
VDGKPTAVTPAH

SEQ ID NO: 407261 - protein, 10 aa, Mycobacterium
VDGKTKEDFG

SEQ ID NO: 407262 - protein, 8 aa, Mycobacterium
VDGNTEAG

SEQ ID NO: 407263 - protein, 23 aa, Mycobacterium
VDGRGGGKADLAQGSGKKPAGID

SEQ ID NO: 407264 - protein, 10 aa, Mycobacterium
VDGSDQQGEV

SEQ ID NO: 407265 - protein, 6 aa, Mycobacterium
VDGSDY

SEQ ID NO: 407266 - protein, 10 aa, Mycobacterium
VDGSDYPDLR

SEQ ID NO: 407267 - protein, 10 aa, Mycobacterium
VDGSDYPNLR

SEQ ID NO: 407268 - protein, 4 aa, Mycobacterium
VDGT

SEQ ID NO: 407269 - protein, 5 aa, Mycobacterium
VDGTT

SEQ ID NO: 407270 - protein, 7 aa, Mycobacterium
VDGVTGA

SEQ ID NO: 407271 - protein, 9 aa, Mycobacterium
VDLSNPDNF

SEQ ID NO: 407272 - protein, 6 aa, Mycobacterium
VDNDPE

SEQ ID NO: 407273 - protein, 4 aa, Mycobacterium
VDNP

SEQ ID NO: 407274 - protein, 4 aa, Mycobacterium
VDNR

SEQ ID NO: 407275 - protein, 8 aa, Mycobacterium
VDPAATGL

SEQ ID NO: 407276 - protein, 5 aa, Mycobacterium
VDPAG

SEQ ID NO: 407277 - protein, 6 aa, Mycobacterium
VDPATG

SEQ ID NO: 407278 - protein, 8 aa, Mycobacterium
VDPDGADA

SEQ ID NO: 407279 - protein, 10 aa, Mycobacterium
VDPDNRRPVD

SEQ ID NO: 407280 - protein, 9 aa, Mycobacterium
VDPDRPLSE

SEQ ID NO: 407281 - protein, 8 aa, Mycobacterium
VDPDSQVA

SEQ ID NO: 407282 - protein, 4 aa, Mycobacterium
VDPE

SEQ ID NO: 407283 - protein, 8 aa, Mycobacterium
VDPEAARS

SEQ ID NO: 407284 - protein, 11 aa, Mycobacterium
VDPEGPVSVQP

SEQ ID NO: 407285 - protein, 5 aa, Mycobacterium
VDPGQ

SEQ ID NO: 407286 - protein, 10 aa, Mycobacterium
VDPNERAPGT

SEQ ID NO: 407287 - protein, 4 aa, Mycobacterium
VDPQ

SEQ ID NO: 407288 - protein, 5 aa, Mycobacterium
VDPQQ

SEQ ID NO: 407289 - protein, 7 aa, Mycobacterium
VDPRRAQ

SEQ ID NO: 407290 - protein, 10 aa, Mycobacterium
VDPTANEEAR

SEQ ID NO: 407291 - protein, 6 aa, Mycobacterium
VDPTEV

SEQ ID NO: 407292 - protein, 8 aa, Mycobacterium
VDPTGAGD

SEQ ID NO: 407293 - protein, 4 aa, Mycobacterium
VDPV

SEQ ID NO: 407294 - protein, 5 aa, Mycobacterium
VDPYN

SEQ ID NO: 407295 - protein, 5 aa, Mycobacterium
VDQDG

SEQ ID NO: 407296 - protein, 9 aa, Mycobacterium
VDQSRIGEG

SEQ ID NO: 407297 - protein, 8 aa, Mycobacterium
VDREDPDV

SEQ ID NO: 407298 - protein, 12 aa, Mycobacterium
VDRGEAHPDVDP

SEQ ID NO: 407299 - protein, 10 aa, Mycobacterium
VDRPATQRFT

SEQ ID NO: 407300 - protein, 4 aa, Mycobacterium
VDRR

SEQ ID NO: 407301 - protein, 4 aa, Mycobacterium
VDRS

SEQ ID NO: 407302 - protein, 4 aa, Mycobacterium
VDSA

SEQ ID NO: 407303 - protein, 6 aa, Mycobacterium
VDSGRE

SEQ ID NO: 407304 - protein, 7 aa, Mycobacterium
VDSGVEQ

SEQ ID NO: 407305 - protein, 4 aa, Mycobacterium
VDSN

SEQ ID NO: 407306 - protein, 4 aa, Mycobacterium
VDTD

SEQ ID NO: 407307 - protein, 5 aa, Mycobacterium
VDTDH

SEQ ID NO: 407308 - protein, 5 aa, Mycobacterium
VDTGG

SEQ ID NO: 407309 - protein, 7 aa, Mycobacterium
VDTPSAY

SEQ ID NO: 407310 - protein, 7 aa, Mycobacterium
VDTRNGS

SEQ ID NO: 407311 - protein, 19 aa, Mycobacterium
VDVSPEERRRIAETGFYAY

SEQ ID NO: 407312 - protein, 8 aa, Mycobacterium
VEAARSGA

SEQ ID NO: 407313 - protein, 5 aa, Mycobacterium
VEAEG

SEQ ID NO: 407314 - protein, 6 aa, Mycobacterium
VEAGTA

SEQ ID NO: 407315 - protein, 9 aa, Mycobacterium
VEATDNPLK

SEQ ID NO: 407316 - protein, 5 aa, Mycobacterium
VEDPG

SEQ ID NO: 407317 - protein, 11 aa, Mycobacterium
VEDPGTQAHSI

SEQ ID NO: 407318 - protein, 11 aa, Mycobacterium
VEDPGTQAHSV

SEQ ID NO: 407319 - protein, 7 aa, Mycobacterium
VEDSNQK

SEQ ID NO: 407320 - protein, 6 aa, Mycobacterium
VEDTGY

SEQ ID NO: 407321 - protein, 7 aa, Mycobacterium
VEDTGYS

SEQ ID NO: 407322 - protein, 8 aa, Mycobacterium
VEDTSAPA

SEQ ID NO: 407323 - protein, 8 aa, Mycobacterium
VEEANEAG

SEQ ID NO: 407324 - protein, 11 aa, Mycobacterium
VEEDEATGSAA

SEQ ID NO: 407325 - protein, 10 aa, Mycobacterium
VEEKPYTRRP

SEQ ID NO: 407326 - protein, 4 aa, Mycobacterium
VEER

SEQ ID NO: 407327 - protein, 8 aa, Mycobacterium
VEESSTLN

SEQ ID NO: 407328 - protein, 7 aa, Mycobacterium
VEETGTK

SEQ ID NO: 407329 - protein, 4 aa, Mycobacterium
VEGD

SEQ ID NO: 407330 - protein, 6 aa, Mycobacterium
VEGGEN

SEQ ID NO: 407331 - protein, 7 aa, Mycobacterium
VEGGGFK

SEQ ID NO: 407332 - protein, 15 aa, Mycobacterium
VEGGSAVTTGERVSA

SEQ ID NO: 407333 - protein, 8 aa, Mycobacterium
VEGNTEAG

SEQ ID NO: 407334 - protein, 11 aa, Mycobacterium
VEGPTDDPDIT

SEQ ID NO: 407335 - protein, 8 aa, Mycobacterium
VEGSETVN

SEQ ID NO: 407336 - protein, 10 aa, Mycobacterium
VEKAGTFTQT

SEQ ID NO: 407337 - protein, 9 aa, Mycobacterium
VEKDPENPQ

SEQ ID NO: 407338 - protein, 9 aa, Mycobacterium
VEKEGTPIA

SEQ ID NO: 407339 - protein, 4 aa, Mycobacterium
VELP

SEQ ID NO: 407340 - protein, 11 aa, Mycobacterium
VELTSSTEERV

SEQ ID NO: 407341 - protein, 5 aa, Mycobacterium
VENGS

SEQ ID NO: 407342 - protein, 4 aa, Mycobacterium
VEPA

SEQ ID NO: 407343 - protein, 7 aa, Mycobacterium
VEPAGAA

SEQ ID NO: 407344 - protein, 9 aa, Mycobacterium
VEPLTGGTQ

SEQ ID NO: 407345 - protein, 4 aa, Mycobacterium
VEPN

SEQ ID NO: 407346 - protein, 11 aa, Mycobacterium
VEPPGAPDPLR

SEQ ID NO: 407347 - protein, 9 aa, Mycobacterium
VEPPPSELA

SEQ ID NO: 407348 - protein, 9 aa, Mycobacterium
VEPPQGDPL

SEQ ID NO: 407349 - protein, 5 aa, Mycobacterium
VEPSR

SEQ ID NO: 407350 - protein, 5 aa, Mycobacterium
VEPTG

SEQ ID NO: 407351 - protein, 4 aa, Mycobacterium
VEQT

SEQ ID NO: 407352 - protein, 12 aa, Mycobacterium
VEQTSKDRGHDY

SEQ ID NO: 407353 - protein, 4 aa, Mycobacterium
VERE

SEQ ID NO: 407354 - protein, 9 aa, Mycobacterium
VERGGPGEH

SEQ ID NO: 407355 - protein, 5 aa, Mycobacterium
VERPA

SEQ ID NO: 407356 - protein, 6 aa, Mycobacterium
VERPDS

SEQ ID NO: 407357 - protein, 5 aa, Mycobacterium
VERPP

SEQ ID NO: 407358 - protein, 5 aa, Mycobacterium
VESAD

SEQ ID NO: 407359 - protein, 7 aa, Mycobacterium
VESAGRT

SEQ ID NO: 407360 - protein, 6 aa, Mycobacterium
VESAGT

SEQ ID NO: 407361 - protein, 4 aa, Mycobacterium
VESD

SEQ ID NO: 407362 - protein, 4 aa, Mycobacterium
VESG

SEQ ID NO: 407363 - protein, 7 aa, Mycobacterium
VESPADT

SEQ ID NO: 407364 - protein, 7 aa, Mycobacterium
VESPDSA

SEQ ID NO: 407365 - protein, 7 aa, Mycobacterium
VESPRGE

SEQ ID NO: 407366 - protein, 5 aa, Mycobacterium
VESTP

SEQ ID NO: 407367 - protein, 7 aa, Mycobacterium
VETGPAG

SEQ ID NO: 407368 - protein, 9 aa, Mycobacterium
VEVDGKTER

SEQ ID NO: 407369 - protein, 11 aa, Mycobacterium
VEVGGSSGGAV

SEQ ID NO: 407370 - protein, 8 aa, Mycobacterium
VEYEQDRR

SEQ ID NO: 407371 - protein, 4 aa, Mycobacterium
VGAA

SEQ ID NO: 407372 - protein, 6 aa, Mycobacterium
VGAEPG

SEQ ID NO: 407373 - protein, 5 aa, Mycobacterium
VGAGN

SEQ ID NO: 407374 - protein, 5 aa, Mycobacterium
VGAGR

SEQ ID NO: 407375 - protein, 10 aa, Mycobacterium
VGAGRGKGGT

SEQ ID NO: 407376 - protein, 6 aa, Mycobacterium
VGANPG

SEQ ID NO: 407377 - protein, 4 aa, Mycobacterium
VGAP

SEQ ID NO: 407378 - protein, 8 aa, Mycobacterium
VGAPGARE

SEQ ID NO: 407379 - protein, 8 aa, Mycobacterium
VGAPNSGW

SEQ ID NO: 407380 - protein, 5 aa, Mycobacterium
VGATA

SEQ ID NO: 407381 - protein, 6 aa, Mycobacterium
VGATGG

SEQ ID NO: 407382 - protein, 10 aa, Mycobacterium
VGATTADEAA

SEQ ID NO: 407383 - protein, 5 aa, Mycobacterium
VGDDA

SEQ ID NO: 407384 - protein, 11 aa, Mycobacterium
VGDDAERTAAL

SEQ ID NO: 407385 - protein, 8 aa, Mycobacterium
VGDDKDKA

SEQ ID NO: 407386 - protein, 4 aa, Mycobacterium
VGDE

SEQ ID NO: 407387 - protein, 4 aa, Mycobacterium
VGDG

SEQ ID NO: 407388 - protein, 4 aa, Mycobacterium
VGDP

SEQ ID NO: 407389 - protein, 5 aa, Mycobacterium
VGDPK

SEQ ID NO: 407390 - protein, 5 aa, Mycobacterium
VGEAM

SEQ ID NO: 407391 - protein, 5 aa, Mycobacterium
VGEDG

SEQ ID NO: 407392 - protein, 5 aa, Mycobacterium
VGEDR

SEQ ID NO: 407393 - protein, 8 aa, Mycobacterium
VGEENKGW

SEQ ID NO: 407394 - protein, 8 aa, Mycobacterium
VGEENQGW

SEQ ID NO: 407395 - protein, 4 aa, Mycobacterium
VGEG

SEQ ID NO: 407396 - protein, 14 aa, Mycobacterium
VGEGDTGPNTGGMG

SEQ ID NO: 407397 - protein, 8 aa, Mycobacterium
VGEQTADR

SEQ ID NO: 407398 - protein, 4 aa, Mycobacterium
VGER

SEQ ID NO: 407399 - protein, 10 aa, Mycobacterium
VGESTVSPSF

SEQ ID NO: 407400 - protein, 6 aa, Mycobacterium
VGETRS

SEQ ID NO: 407401 - protein, 7 aa, Mycobacterium
VGGAASH

SEQ ID NO: 407402 - protein, 9 aa, Mycobacterium
VGGASAGGH

SEQ ID NO: 407403 - protein, 11 aa, Mycobacterium
VGGEPDAPMKY

SEQ ID NO: 407404 - protein, 8 aa, Mycobacterium
VGGESAKS

SEQ ID NO: 407405 - protein, 9 aa, Mycobacterium
VGGGDSAAA

SEQ ID NO: 407406 - protein, 6 aa, Mycobacterium
VGGGTD

SEQ ID NO: 407407 - protein, 5 aa, Mycobacterium
VGGLP

SEQ ID NO: 407408 - protein, 24 aa, Mycobacterium
VGGNGAWGAGGIGGDGGVGGAGSA

SEQ ID NO: 407409 - protein, 8 aa, Mycobacterium
VGGNVPQS

SEQ ID NO: 407410 - protein, 5 aa, Mycobacterium
VGGPE

SEQ ID NO: 407411 - protein, 9 aa, Mycobacterium
VGGPNPDGN

SEQ ID NO: 407412 - protein, 30 aa, Mycobacterium; identical to SEQ ID NO: 190873

SEQ ID NO: 407413 - protein, 30 aa, Mycobacterium
VGGPRSDAALQASSGRTATTKAMGKGSTQH

SEQ ID NO: 407414 - protein, 5 aa, Mycobacterium
VGGQE

SEQ ID NO: 407415 - protein, 4 aa, Mycobacterium
VGGR

SEQ ID NO: 407416 - protein, 6 aa, Mycobacterium
VGGSPL

SEQ ID NO: 407417 - protein, 13 aa, Mycobacterium
VGGSTAPAVLGTG

SEQ ID NO: 407418 - protein, 8 aa, Mycobacterium
VGGSTGLS

SEQ ID NO: 407419 - protein, 11 aa, Mycobacterium
VGHGASHGLPA

SEQ ID NO: 407420 - protein, 5 aa, Mycobacterium
VGKGD

SEQ ID NO: 407421 - protein, 9 aa, Mycobacterium
VGKPAPTVR

SEQ ID NO: 407422 - protein, 18 aa, Mycobacterium
VGKTPSETAKLAREILQS

SEQ ID NO: 407423 - protein, 7 aa, Mycobacterium
VGLRPEQ

SEQ ID NO: 407424 - protein, 11 aa, Mycobacterium
VGNGPKELRDA

SEQ ID NO: 407425 - protein, 7 aa, Mycobacterium
VGPEGKP

SEQ ID NO: 407426 - protein, 5 aa, Mycobacterium
VGPER

SEQ ID NO: 407427 - protein, 4 aa, Mycobacterium
VGPG

SEQ ID NO: 407428 - protein, 7 aa, Mycobacterium
VGPGQSL

SEQ ID NO: 407429 - protein, 11 aa, Mycobacterium
VGPGSLPSDSS

SEQ ID NO: 407430 - protein, 5 aa, Mycobacterium
VGPGV

SEQ ID NO: 407431 - protein, 11 aa, Mycobacterium
VGPGVEDIAPG

SEQ ID NO: 407432 - protein, 7 aa, Mycobacterium
VGPGVTR

SEQ ID NO: 407433 - protein, 9 aa, Mycobacterium
VGPKQTALG

SEQ ID NO: 407434 - protein, 4 aa, Mycobacterium
VGPP

SEQ ID NO: 407435 - protein, 7 aa, Mycobacterium
VGPRDEQ

SEQ ID NO: 407436 - protein, 10 aa, Mycobacterium
VGPRERGHFG

SEQ ID NO: 407437 - protein, 4 aa, Mycobacterium
VGPT

SEQ ID NO: 407438 - protein, 5 aa, Mycobacterium
VGPTQ

SEQ ID NO: 407439 - protein, 6 aa, Mycobacterium
VGPYGA

SEQ ID NO: 407440 - protein, 5 aa, Mycobacterium
VGQAG

SEQ ID NO: 407441 - protein, 9 aa, Mycobacterium
VGQNAPYAQ

SEQ ID NO: 407442 - protein, 7 aa, Mycobacterium
VGQPGNR

SEQ ID NO: 407443 - protein, 29 aa, Mycobacterium
VGRDSTRGLGAGADPEVGRKAAEDAKDDI

SEQ ID NO: 407444 - protein, 29 aa, Mycobacterium
VGRDSTRGLGAGADPEVGRKAAEDAKDEI

SEQ ID NO: 407445 - protein, 29 aa, Mycobacterium
VGRDSTRGLGAGADPEVGRRAAEDAKDEI

SEQ ID NO: 407446 - protein, 6 aa, Mycobacterium
VGRDTV

SEQ ID NO: 407447 - protein, 6 aa, Mycobacterium
VGRGQP

SEQ ID NO: 407448 - protein, 17 aa, Mycobacterium
VGRGSPQGLAASKALTT

SEQ ID NO: 407449 - protein, 9 aa, Mycobacterium
VGRGSPWAT

SEQ ID NO: 407450 - protein, 6 aa, Mycobacterium
VGRKPK

SEQ ID NO: 407451 - protein, 4 aa, Mycobacterium
VGRP

SEQ ID NO: 407452 - protein, 6 aa, Mycobacterium
VGRPRA

SEQ ID NO: 407453 - protein, 8 aa, Mycobacterium
VGRQRGST

SEQ ID NO: 407454 - protein, 4 aa, Mycobacterium
VGRR

SEQ ID NO: 407455 - protein, 6 aa, Mycobacterium
VGRRKE

SEQ ID NO: 407456 - protein, 10 aa, Mycobacterium
VGRRQADAAA

SEQ ID NO: 407457 - protein, 8 aa, Mycobacterium
VGRTPNGV

SEQ ID NO: 407458 - protein, 6 aa, Mycobacterium
VGSEDA

SEQ ID NO: 407459 - protein, 5 aa, Mycobacterium
VGSER

SEQ ID NO: 407460 - protein, 10 aa, Mycobacterium
VGSQSPAVGQ

SEQ ID NO: 407461 - protein, 10 aa, Mycobacterium
VGSQSPGVGQ

SEQ ID NO: 407462 - protein, 9 aa, Mycobacterium
VGSSETGAQ

SEQ ID NO: 407463 - protein, 4 aa, Mycobacterium
VGTD

SEQ ID NO: 407464 - protein, 6 aa, Mycobacterium
VGTEAH

SEQ ID NO: 407465 - protein, 7 aa, Mycobacterium
VGTGAQL

SEQ ID NO: 407466 - protein, 6 aa, Mycobacterium
VGTGAR

SEQ ID NO: 407467 - protein, 6 aa, Mycobacterium
VGTGFD

SEQ ID NO: 407468 - protein, 12 aa, Mycobacterium
VGTNPTFSGRTR

SEQ ID NO: 407469 - protein, 4 aa, Mycobacterium
VGTS

SEQ ID NO: 407470 - protein, 20 aa, Mycobacterium
VGTSSLNTVRSSSRLLLPVL

SEQ ID NO: 407471 - protein, 11 aa, Mycobacterium
VGVQGDNRTYG

SEQ ID NO: 407472 - protein, 6 aa, Mycobacterium
VGYTPY

SEQ ID NO: 407473 - protein, 8 aa, Mycobacterium
VHDPTARR

SEQ ID NO: 407474 - protein, 8 aa, Mycobacterium
VHPAPKRG

SEQ ID NO: 407475 - protein, 6 aa, Mycobacterium
VHPDAE

SEQ ID NO: 407476 - protein, 5 aa, Mycobacterium
VHPGD

SEQ ID NO: 407477 - protein, 10 aa, Mycobacterium
VHSPAGGQGM

SEQ ID NO: 407478 - protein, 10 aa, Mycobacterium
VHTGDTTGMG

SEQ ID NO: 407479 - protein, 7 aa, Mycobacterium
VKAGELS

SEQ ID NO: 407480 - protein, 9 aa, Mycobacterium
VKEPKPSKL

SEQ ID NO: 407481 - protein, 10 aa, Mycobacterium
VKGAAADADY

SEQ ID NO: 407482 - protein, 9 aa, Mycobacterium
VKGDPSASV

SEQ ID NO: 407483 - protein, 5 aa, Mycobacterium
VKGED

SEQ ID NO: 407484 - protein, 14 aa, Mycobacterium
VKGPETEHLLALAG

SEQ ID NO: 407485 - protein, 8 aa, Mycobacterium
VKGRGGAG

SEQ ID NO: 407486 - protein, 13 aa, Mycobacterium
VKNAQEAHEAIRP

SEQ ID NO: 407487 - protein, 4 aa, Mycobacterium
VKPG

SEQ ID NO: 407488 - protein, 10 aa, Mycobacterium
VKPGGAGDFY

SEQ ID NO: 407489 - protein, 7 aa, Mycobacterium
VKPPPGF

SEQ ID NO: 407490 - protein, 7 aa, Mycobacterium
VKPPRTF

SEQ ID NO: 407491 - protein, 12 aa, Mycobacterium
VKPTSVPAFRPG

SEQ ID NO: 407492 - protein, 7 aa, Mycobacterium
VKSGSDY

SEQ ID NO: 407493 - protein, 7 aa, Mycobacterium
VKSTNGD

SEQ ID NO: 407494 - protein, 6 aa, Mycobacterium
VKTAEE

SEQ ID NO: 407495 - protein, 9 aa, Mycobacterium
VKYPPGGSY

SEQ ID NO: 407496 - protein, 5 aa, Mycobacterium
VLEPG

SEQ ID NO: 407497 - protein, 10 aa, Mycobacterium
VLGTKKAEAI

SEQ ID NO: 407498 - protein, 13 aa, Mycobacterium
VLPGGDTTGLSAE

SEQ ID NO: 407499 - protein, 28 aa, Mycobacterium
VLSPGSLAHPPTRPPPAVPPCPGPTGER

SEQ ID NO: 407500 - protein, 10 aa, Mycobacterium
VLSTPGGDKL

SEQ ID NO: 407501 - protein, 5 aa, Mycobacterium
VLTER

SEQ ID NO: 407502 - protein, 7 aa, Mycobacterium
VNAANKG

SEQ ID NO: 407503 - protein, 5 aa, Mycobacterium
VNAGD

SEQ ID NO: 407504 - protein, 16 aa, Mycobacterium
VNAGERAAGKPLPGAR

SEQ ID NO: 407505 - protein, 6 aa, Mycobacterium
VNAKNV

SEQ ID NO: 407506 - protein, 4 aa, Mycobacterium
VNAT

SEQ ID NO: 407507 - protein, 8 aa, Mycobacterium
VNDAPALA

SEQ ID NO: 407508 - protein, 4 aa, Mycobacterium
VNDG

SEQ ID NO: 407509 - protein, 5 aa, Mycobacterium
VNDRP

SEQ ID NO: 407510 - protein, 20 aa, Mycobacterium
VNEAADTTFYDSPATEKPVG

SEQ ID NO: 407511 - protein, 11 aa, Mycobacterium
VNETTKTRVSA

SEQ ID NO: 407512 - protein, 9 aa, Mycobacterium
VNGGNRTVP

SEQ ID NO: 407513 - protein, 16 aa, Mycobacterium
VNGGSVEDAKKRPDFS

SEQ ID NO: 407514 - protein, 16 aa, Mycobacterium
VNGGSVEDAKKRPEFG

SEQ ID NO: 407515 - protein, 6 aa, Mycobacterium
VNGNEE

SEQ ID NO: 407516 - protein, 6 aa, Mycobacterium
VNGPGS

SEQ ID NO: 407517 - protein, 4 aa, Mycobacterium
VNGR

SEQ ID NO: 407518 - protein, 9 aa, Mycobacterium
VNHDGRSNG

SEQ ID NO: 407519 - protein, 4 aa, Mycobacterium
VNPD

SEQ ID NO: 407520 - protein, 5 aa, Mycobacterium
VNPGA

SEQ ID NO: 407521 - protein, 5 aa, Mycobacterium
VNPGN

SEQ ID NO: 407522 - protein, 8 aa, Mycobacterium
VNPNATAV

SEQ ID NO: 407523 - protein, 9 aa, Mycobacterium
VNPSGTRKD

SEQ ID NO: 407524 - protein, 4 aa, Mycobacterium
VNQT

SEQ ID NO: 407525 - protein, 17 aa, Mycobacterium
VNSNPARFDQKKADAIN

SEQ ID NO: 407526 - protein, 17 aa, Mycobacterium
VNSNPARFDQKKADALN

SEQ ID NO: 407527 - protein, 4 aa, Mycobacterium
VNSQ

SEQ ID NO: 407528 - protein, 5 aa, Mycobacterium
VNSTE

SEQ ID NO: 407529 - protein, 5 aa, Mycobacterium
VNTKD

SEQ ID NO: 407530 - protein, 7 aa, Mycobacterium
VNTPPET

SEQ ID NO: 407531 - protein, 6 aa, Mycobacterium
VPAANG

SEQ ID NO: 407532 - protein, 4 aa, Mycobacterium
VPAD

SEQ ID NO: 407533 - protein, 5 aa, Mycobacterium
VPADE

SEQ ID NO: 407534 - protein, 5 aa, Mycobacterium
VPAEG

SEQ ID NO: 407535 - protein, 9 aa, Mycobacterium
VPAGEQSSL

SEQ ID NO: 407536 - protein, 7 aa, Mycobacterium
VPAHNPR

SEQ ID NO: 407537 - protein, 9 aa, Mycobacterium
VPANASSAQ

SEQ ID NO: 407538 - protein, 10 aa, Mycobacterium
VPANASSAQR

SEQ ID NO: 407539 - protein, 4 aa, Mycobacterium
VPAP

SEQ ID NO: 407540 - protein, 10 aa, Mycobacterium
VPAPANADFA

SEQ ID NO: 407541 - protein, 9 aa, Mycobacterium
VPAPESTHA

SEQ ID NO: 407542 - protein, 9 aa, Mycobacterium
VPAPGGRRE

SEQ ID NO: 407543 - protein, 5 aa, Mycobacterium
VPAPQ

SEQ ID NO: 407544 - protein, 7 aa, Mycobacterium
VPAPRGH

SEQ ID NO: 407545 - protein, 5 aa, Mycobacterium
VPARP

SEQ ID NO: 407546 - protein, 8 aa, Mycobacterium
VPDAANPN

SEQ ID NO: 407547 - protein, 5 aa, Mycobacterium
VPDGA

SEQ ID NO: 407548 - protein, 5 aa, Mycobacterium
VPDNP

SEQ ID NO: 407549 - protein, 5 aa, Mycobacterium
VPDQW

SEQ ID NO: 407550 - protein, 6 aa, Mycobacterium
VPDRGR

SEQ ID NO: 407551 - protein, 6 aa, Mycobacterium
VPDSAL

SEQ ID NO: 407552 - protein, 9 aa, Mycobacterium
VPDSGEVDE

SEQ ID NO: 407553 - protein, 5 aa, Mycobacterium
VPEEE

SEQ ID NO: 407554 - protein, 4 aa, Mycobacterium
VPEQ

SEQ ID NO: 407555 - protein, 4 aa, Mycobacterium
VPES

SEQ ID NO: 407556 - protein, 4 aa, Mycobacterium
VPET

SEQ ID NO: 407557 - protein, 6 aa, Mycobacterium
VPGAAR

SEQ ID NO: 407558 - protein, 5 aa, Mycobacterium
VPGAD

SEQ ID NO: 407559 - protein, 7 aa, Mycobacterium
VPGAPGV

SEQ ID NO: 407560 - protein, 5 aa, Mycobacterium
VPGDS

SEQ ID NO: 407561 - protein, 10 aa, Mycobacterium
VPGDTVNTRD

SEQ ID NO: 407562 - protein, 5 aa, Mycobacterium
VPGGA

SEQ ID NO: 407563 - protein, 5 aa, Mycobacterium
VPGGR

SEQ ID NO: 407564 - protein, 13 aa, Mycobacterium
VPGIDGDCGGEAA

SEQ ID NO: 407565 - protein, 5 aa, Mycobacterium
VPGKP

SEQ ID NO: 407566 - protein, 6 aa, Mycobacterium
VPGKPR

SEQ ID NO: 407567 - protein, 5 aa, Mycobacterium
VPGPD

SEQ ID NO: 407568 - protein, 13 aa, Mycobacterium
VPGPDDDKYTQGV

SEQ ID NO: 407569 - protein, 5 aa, Mycobacterium
VPGPH

SEQ ID NO: 407570 - protein, 6 aa, Mycobacterium
VPGPHF

SEQ ID NO: 407571 - protein, 8 aa, Mycobacterium
VPGPTQPI

SEQ ID NO: 407572 - protein, 8 aa, Mycobacterium
VPGQRDHS

SEQ ID NO: 407573 - protein, 4 aa, Mycobacterium
VPGR

SEQ ID NO: 407574 - protein, 6 aa, Mycobacterium
VPGRAD

SEQ ID NO: 407575 - protein, 6 aa, Mycobacterium
VPGRDL

SEQ ID NO: 407576 - protein, 5 aa, Mycobacterium
VPGRE

SEQ ID NO: 407577 - protein, 11 aa, Mycobacterium
VPGRGSTYSAS

SEQ ID NO: 407578 - protein, 4 aa, Mycobacterium
VPID

SEQ ID NO: 407579 - protein, 7 aa, Mycobacterium
VPLGGPR

SEQ ID NO: 407580 - protein, 6 aa, Mycobacterium
VPLPAD

SEQ ID NO: 407581 - protein, 8 aa, Mycobacterium
VPLRPSTT

SEQ ID NO: 407582 - protein, 8 aa, Mycobacterium
VPLRPTTT

SEQ ID NO: 407583 - protein, 11 aa, Mycobacterium
VPNNPGAATPI

SEQ ID NO: 407584 - protein, 8 aa, Mycobacterium
VPNTEKLP

SEQ ID NO: 407585 - protein, 7 aa, Mycobacterium
VPNTSGL

SEQ ID NO: 407586 - protein, 8 aa, Mycobacterium
VPPADTDE

SEQ ID NO: 407587 - protein, 9 aa, Mycobacterium
VPPAGGEES

SEQ ID NO: 407588 - protein, 5 aa, Mycobacterium
VPPAV

SEQ ID NO: 407589 - protein, 9 aa, Mycobacterium
VPPDHPDSY

SEQ ID NO: 407590 - protein, 4 aa, Mycobacterium
VPPE

SEQ ID NO: 407591 - protein, 9 aa, Mycobacterium
VPPEHPDSY

SEQ ID NO: 407592 - protein, 5 aa, Mycobacterium
VPPGL

SEQ ID NO: 407593 - protein, 6 aa, Mycobacterium
VPPGRL

SEQ ID NO: 407594 - protein, 7 aa, Mycobacterium
VPPNDGG

SEQ ID NO: 407595 - protein, 5 aa, Mycobacterium
VPPPL

SEQ ID NO: 407596 - protein, 5 aa, Mycobacterium
VPPQG

SEQ ID NO: 407597 - protein, 6 aa, Mycobacterium
VPPRTV

SEQ ID NO: 407598 - protein, 8 aa, Mycobacterium
VPPSGPMD

SEQ ID NO: 407599 - protein, 5 aa, Mycobacterium
VPPTE

SEQ ID NO: 407600 - protein, 16 aa, Mycobacterium
VPQAAGRGLGHTGGTL

SEQ ID NO: 407601 - protein, 7 aa, Mycobacterium
VPQGGSG

SEQ ID NO: 407602 - protein, 7 aa, Mycobacterium
VPQKHPD

SEQ ID NO: 407603 - protein, 9 aa, Mycobacterium
VPQPDDTRL

SEQ ID NO: 407604 - protein, 8 aa, Mycobacterium
VPQQGHSV

SEQ ID NO: 407605 - protein, 5 aa, Mycobacterium
VPQRP

SEQ ID NO: 407606 - protein, 5 aa, Mycobacterium
VPRDG

SEQ ID NO: 407607 - protein, 11 aa, Mycobacterium
VPREESRQRFN

SEQ ID NO: 407608 - protein, 4 aa, Mycobacterium
VPRG

SEQ ID NO: 407609 - protein, 11 aa, Mycobacterium
VPRGKAPIADV

SEQ ID NO: 407610 - protein, 5 aa, Mycobacterium
VPRPE

SEQ ID NO: 407611 - protein, 8 aa, Mycobacterium
VPRPSEIR

SEQ ID NO: 407612 - protein, 4 aa, Mycobacterium
VPRR

SEQ ID NO: 407613 - protein, 4 aa, Mycobacterium
VPSA

SEQ ID NO: 407614 - protein, 8 aa, Mycobacterium
VPSASTTA

SEQ ID NO: 407615 - protein, 4 aa, Mycobacterium
VPSE

SEQ ID NO: 407616 - protein, 18 aa, Mycobacterium
VPSGEEEELQSSEAKVGP

SEQ ID NO: 407617 - protein, 11 aa, Mycobacterium
VPSPNAMEVGP

SEQ ID NO: 407618 - protein, 4 aa, Mycobacterium
VPSS

SEQ ID NO: 407619 - protein, 5 aa, Mycobacterium
VPTAR

SEQ ID NO: 407620 - protein, 8 aa, Mycobacterium
VPTASTTA

SEQ ID NO: 407621 - protein, 4 aa, Mycobacterium
VPTD

SEQ ID NO: 407622 - protein, 8 aa, Mycobacterium
VPTDEATH

SEQ ID NO: 407623 - protein, 8 aa, Mycobacterium
VPTGEATH

SEQ ID NO: 407624 - protein, 10 aa, Mycobacterium
VPTGGDDPTK

SEQ ID NO: 407625 - protein, 4 aa, Mycobacterium
VPTL

SEQ ID NO: 407626 - protein, 6 aa, Mycobacterium
VPTPND

SEQ ID NO: 407627 - protein, 5 aa, Mycobacterium
VPTRG

SEQ ID NO: 407628 - protein, 4 aa, Mycobacterium
VPTS

SEQ ID NO: 407629 - protein, 4 aa, Mycobacterium
VPTT

SEQ ID NO: 407630 - protein, 18 aa, Mycobacterium
VPTTPGRVTDTAEGAREI

SEQ ID NO: 407631 - protein, 6 aa, Mycobacterium
VPVAPE

SEQ ID NO: 407632 - protein, 11 aa, Mycobacterium
VPVPGDTGGAS

SEQ ID NO: 407633 - protein, 5 aa, Mycobacterium
VPVPP

SEQ ID NO: 407634 - protein, 4 aa, Mycobacterium
VPYG

SEQ ID NO: 407635 - protein, 5 aa, Mycobacterium
VPYNP

SEQ ID NO: 407636 - protein, 7 aa, Mycobacterium
VQDAADT

SEQ ID NO: 407637 - protein, 7 aa, Mycobacterium
VQDANGP

SEQ ID NO: 407638 - protein, 4 aa, Mycobacterium
VQDH

SEQ ID NO: 407639 - protein, 7 aa, Mycobacterium
VQDRNGP

SEQ ID NO: 407640 - protein, 6 aa, Mycobacterium
VQEAGA

SEQ ID NO: 407641 - protein, 7 aa, Mycobacterium
VQEAGAG

SEQ ID NO: 407642 - protein, 10 aa, Mycobacterium
VQGDPNHPMT

SEQ ID NO: 407643 - protein, 5 aa, Mycobacterium
VQGDT

SEQ ID NO: 407644 - protein, 6 aa, Mycobacterium
VQGESV

SEQ ID NO: 407645 - protein, 7 aa, Mycobacterium
VQGGRTS

SEQ ID NO: 407646 - protein, 4 aa, Mycobacterium
VQGQ

SEQ ID NO: 407647 - protein, 7 aa, Mycobacterium
VQNASGA

SEQ ID NO: 407648 - protein, 13 aa, Mycobacterium
VQQAARDARRAAG

SEQ ID NO: 407649 - protein, 4 aa, Mycobacterium
VQQS

SEQ ID NO: 407650 - protein, 4 aa, Mycobacterium
VQRD

SEQ ID NO: 407651 - protein, 7 aa, Mycobacterium
VQRPGKQ

SEQ ID NO: 407652 - protein, 6 aa, Mycobacterium
VQRSQE

SEQ ID NO: 407653 - protein, 4 aa, Mycobacterium
VQSR

SEQ ID NO: 407654 - protein, 4 aa, Mycobacterium
VQTE

SEQ ID NO: 407655 - protein, 8 aa, Mycobacterium
VRAAEQLG

SEQ ID NO: 407656 - protein, 6 aa, Mycobacterium
VRAAGR

SEQ ID NO: 407657 - protein, 5 aa, Mycobacterium
VRAGD

SEQ ID NO: 407658 - protein, 10 aa, Mycobacterium
VRATPDARVS

SEQ ID NO: 407659 - protein, 6 aa, Mycobacterium
VRATSD

SEQ ID NO: 407660 - protein, 9 aa, Mycobacterium
VRDGGPAAL

SEQ ID NO: 407661 - protein, 4 aa, Mycobacterium
VRDQ

SEQ ID NO: 407662 - protein, 5 aa, Mycobacterium
VRDRA

SEQ ID NO: 407663 - protein, 15 aa, Mycobacterium
VREPGDTGDVPTGRA

SEQ ID NO: 407664 - protein, 8 aa, Mycobacterium
VREQNGDE

SEQ ID NO: 407665 - protein, 5 aa, Mycobacterium
VRERA

SEQ ID NO: 407666 - protein, 5 aa, Mycobacterium
VRGAD

SEQ ID NO: 407667 - protein, 4 aa, Mycobacterium
VRGG

SEQ ID NO: 407668 - protein, 7 aa, Mycobacterium
VRGGGGS

SEQ ID NO: 407669 - protein, 7 aa, Mycobacterium
VRGNATR

SEQ ID NO: 407670 - protein, 5 aa, Mycobacterium
VRGPG

SEQ ID NO: 407671 - protein, 7 aa, Mycobacterium
VRGPGAA

SEQ ID NO: 407672 - protein, 4 aa, Mycobacterium
VRGR

SEQ ID NO: 407673 - protein, 7 aa, Mycobacterium
VRGREDG

SEQ ID NO: 407674 - protein, 7 aa, Mycobacterium
VRGREDS

SEQ ID NO: 407675 - protein, 5 aa, Mycobacterium
VRHDP

SEQ ID NO: 407676 - protein, 10 aa, Mycobacterium
VRKAGRQTKG

SEQ ID NO: 407677 - protein, 7 aa, Mycobacterium
VRKGGTV

SEQ ID NO: 407678 - protein, 7 aa, Mycobacterium
VRNNGPE

SEQ ID NO: 407679 - protein, 5 aa, Mycobacterium
VRPAR

SEQ ID NO: 407680 - protein, 6 aa, Mycobacterium
VRPDPE

SEQ ID NO: 407681 - protein, 5 aa, Mycobacterium
VRPHT

SEQ ID NO: 407682 - protein, 10 aa, Mycobacterium
VRPPTPGRRL

SEQ ID NO: 407683 - protein, 7 aa, Mycobacterium
VRPTPIA

SEQ ID NO: 407684 - protein, 4 aa, Mycobacterium
VRQG

SEQ ID NO: 407685 - protein, 29 aa, Mycobacterium
VRQSKVGDTVTTARKGATEALTGYREPKP

SEQ ID NO: 407686 - protein, 12 aa, Mycobacterium
VRRGAPSANARW

SEQ ID NO: 407687 - protein, 6 aa, Mycobacterium
VRRPDG

SEQ ID NO: 407688 - protein, 13 aa, Mycobacterium
VRRTGDDVQPGDV

SEQ ID NO: 407689 - protein, 6 aa, Mycobacterium
VRSGAD

SEQ ID NO: 407690 - protein, 5 aa, Mycobacterium
VRSGH

SEQ ID NO: 407691 - protein, 5 aa, Mycobacterium
VRSPE

SEQ ID NO: 407692 - protein, 5 aa, Mycobacterium
VRSSW

SEQ ID NO: 407693 - protein, 5 aa, Mycobacterium
VRSTR

SEQ ID NO: 407694 - protein, 5 aa, Mycobacterium
VRTAA

SEQ ID NO: 407695 - protein, 4 aa, Mycobacterium
VRTE

SEQ ID NO: 407696 - protein, 4 aa, Mycobacterium
VRTG

SEQ ID NO: 407697 - protein, 8 aa, Mycobacterium
VRTGGYGQ

SEQ ID NO: 407698 - protein, 6 aa, Mycobacterium
VRTGTY

SEQ ID NO: 407699 - protein, 7 aa, Mycobacterium
VRTYPKT

SEQ ID NO: 407700 - protein, 10 aa, Mycobacterium
VRYDRDGDQH

SEQ ID NO: 407701 - protein, 8 aa, Mycobacterium
VSADGRGV

SEQ ID NO: 407702 - protein, 4 aa, Mycobacterium
VSAP

SEQ ID NO: 407703 - protein, 5 aa, Mycobacterium
VSAQP

SEQ ID NO: 407704 - protein, 6 aa, Mycobacterium
VSARRE

SEQ ID NO: 407705 - protein, 8 aa, Mycobacterium
VSATANRR

SEQ ID NO: 407706 - protein, 4 aa, Mycobacterium
VSDA

SEQ ID NO: 407707 - protein, 4 aa, Mycobacterium
VSDD

SEQ ID NO: 407708 - protein, 6 aa, Mycobacterium
VSDDDA

SEQ ID NO: 407709 - protein, 5 aa, Mycobacterium
VSDDE

SEQ ID NO: 407710 - protein, 8 aa, Mycobacterium
VSDEDPVA

SEQ ID NO: 407711 - protein, 6 aa, Mycobacterium
VSDLPR

SEQ ID NO: 407712 - protein, 5 aa, Mycobacterium
VSDNE

SEQ ID NO: 407713 - protein, 12 aa, Mycobacterium
VSDPASAKAMAD

SEQ ID NO: 407714 - protein, 5 aa, Mycobacterium
VSDRA

SEQ ID NO: 407715 - protein, 6 aa, Mycobacterium
VSDRAA

SEQ ID NO: 407716 - protein, 9 aa, Mycobacterium
VSDRSGTIT

SEQ ID NO: 407717 - protein, 6 aa, Mycobacterium
VSDTYG

SEQ ID NO: 407718 - protein, 6 aa, Mycobacterium
VSEDKR

SEQ ID NO: 407719 - protein, 6 aa, Mycobacterium
VSELPD

SEQ ID NO: 407720 - protein, 5 aa, Mycobacterium
VSEPV

SEQ ID NO: 407721 - protein, 14 aa, Mycobacterium
VSESDTVANPDPST

SEQ ID NO: 407722 - protein, 10 aa, Mycobacterium
VSETETRTQA

SEQ ID NO: 407723 - protein, 9 aa, Mycobacterium
VSETTEHGY

SEQ ID NO: 407724 - protein, 4 aa, Mycobacterium
VSGA

SEQ ID NO: 407725 - protein, 13 aa, Mycobacterium
VSGAEDANGGGRV

SEQ ID NO: 407726 - protein, 5 aa, Mycobacterium
VSGDG

SEQ ID NO: 407727 - protein, 10 aa, Mycobacterium
VSGDNAKFGA

SEQ ID NO: 407728 - protein, 7 aa, Mycobacterium
VSGDRSH

SEQ ID NO: 407729 - protein, 10 aa, Mycobacterium
VSGDVRDPYT

SEQ ID NO: 407730 - protein, 5 aa, Mycobacterium
VSGEL

SEQ ID NO: 407731 - protein, 8 aa, Mycobacterium
VSGERQGY

SEQ ID NO: 407732 - protein, 8 aa, Mycobacterium
VSGGPHDI

SEQ ID NO: 407733 - protein, 5 aa, Mycobacterium
VSGGR

SEQ ID NO: 407734 - protein, 9 aa, Mycobacterium
VSGGSPHAI

SEQ ID NO: 407735 - protein, 7 aa, Mycobacterium
VSGGTRR

SEQ ID NO: 407736 - protein, 4 aa, Mycobacterium
VSGL

SEQ ID NO: 407737 - protein, 5 aa, Mycobacterium
VSGQG

SEQ ID NO: 407738 - protein, 8 aa, Mycobacterium
VSGRNYEV

SEQ ID NO: 407739 - protein, 11 aa, Mycobacterium
VSGRPADLAGA

SEQ ID NO: 407740 - protein, 10 aa, Mycobacterium
VSGRPTELAG

SEQ ID NO: 407741 - protein, 9 aa, Mycobacterium
VSGSARTAE

SEQ ID NO: 407742 - protein, 9 aa, Mycobacterium
VSGSGKSSL

SEQ ID NO: 407743 - protein, 4 aa, Mycobacterium
VSGT

SEQ ID NO: 407744 - protein, 10 aa, Mycobacterium
VSGTGPQGAV

SEQ ID NO: 407745 - protein, 10 aa, Mycobacterium
VSGVAGAPFG

SEQ ID NO: 407746 - protein, 6 aa, Mycobacterium
VSHPET

SEQ ID NO: 407747 - protein, 9 aa, Mycobacterium
VSIGGSGSF

SEQ ID NO: 407748 - protein, 8 aa, Mycobacterium
VSNTDHRA

SEQ ID NO: 407749 - protein, 5 aa, Mycobacterium
VSPAT

SEQ ID NO: 407750 - protein, 4 aa, Mycobacterium
VSPD

SEQ ID NO: 407751 - protein, 5 aa, Mycobacterium
VSPDG

SEQ ID NO: 407752 - protein, 10 aa, Mycobacterium
VSPDSPPAVV

SEQ ID NO: 407753 - protein, 10 aa, Mycobacterium
VSPDYADNTK

SEQ ID NO: 407754 - protein, 10 aa, Mycobacterium
VSPQNAQALT

SEQ ID NO: 407755 - protein, 10 aa, Mycobacterium
VSPSPRQYTR

SEQ ID NO: 407756 - protein, 12 aa, Mycobacterium
VSPSPVSDTYLS

SEQ ID NO: 407757 - protein, 4 aa, Mycobacterium
VSPT

SEQ ID NO: 407758 - protein, 4 aa, Mycobacterium
VSPV

SEQ ID NO: 407759 - protein, 13 aa, Mycobacterium
VSPVGSHKTNSAV

SEQ ID NO: 407760 - protein, 5 aa, Mycobacterium
VSQDG

SEQ ID NO: 407761 - protein, 5 aa, Mycobacterium
VSRAA

SEQ ID NO: 407762 - protein, 11 aa, Mycobacterium
VSRAAGAGGAV

SEQ ID NO: 407763 - protein, 5 aa, Mycobacterium
VSRGA

SEQ ID NO: 407764 - protein, 12 aa, Mycobacterium
VSRGPKATGALR

SEQ ID NO: 407765 - protein, 11 aa, Mycobacterium
VSRPGTPLHDP

SEQ ID NO: 407766 - protein, 4 aa, Mycobacterium
VSRR

SEQ ID NO: 407767 - protein, 8 aa, Mycobacterium
VSRTDDGL

SEQ ID NO: 407768 - protein, 11 aa, Mycobacterium
VSSDASPEEIK

SEQ ID NO: 407769 - protein, 6 aa, Mycobacterium
VSSERA

SEQ ID NO: 407770 - protein, 6 aa, Mycobacterium
VSSPGY

SEQ ID NO: 407771 - protein, 5 aa, Mycobacterium
VSSRD

SEQ ID NO: 407772 - protein, 5 aa, Mycobacterium
VSSRR

SEQ ID NO: 407773 - protein, 8 aa, Mycobacterium
VSTAPDED

SEQ ID NO: 407774 - protein, 6 aa, Mycobacterium
VSTGGE

SEQ ID NO: 407775 - protein, 8 aa, Mycobacterium
VSTPGGQE

SEQ ID NO: 407776 - protein, 10 aa, Mycobacterium
VSTRAQAAAL

SEQ ID NO: 407777 - protein, 21 aa, Mycobacterium
VSTTTGPGIPVDPSVTRNFTE

SEQ ID NO: 407778 - protein, 4 aa, Mycobacterium
VSVD

SEQ ID NO: 407779 - protein, 6 aa, Mycobacterium
VSVPEQ

SEQ ID NO: 407780 - protein, 6 aa, Mycobacterium
VSYEAG

SEQ ID NO: 407781 - protein, 10 aa, Mycobacterium
VTAAPADTYR

SEQ ID NO: 407782 - protein, 4 aa, Mycobacterium
VTAG

SEQ ID NO: 407783 - protein, 7 aa, Mycobacterium
VTARQDG

SEQ ID NO: 407784 - protein, 10 aa, Mycobacterium
VTASGKQRSR

SEQ ID NO: 407785 - protein, 5 aa, Mycobacterium
VTATG

SEQ ID NO: 407786 - protein, 5 aa, Mycobacterium
VTATT

SEQ ID NO: 407787 - protein, 4 aa, Mycobacterium
VTDA

SEQ ID NO: 407788 - protein, 10 aa, Mycobacterium
VTDAANADER

SEQ ID NO: 407789 - protein, 9 aa, Mycobacterium
VTDAPDGTR

SEQ ID NO: 407790 - protein, 5 aa, Mycobacterium
VTDEA

SEQ ID NO: 407791 - protein, 6 aa, Mycobacterium
VTDEKA

SEQ ID NO: 407792 - protein, 14 aa, Mycobacterium
VTDGNGYPPPAYPP

SEQ ID NO: 407793 - protein, 5 aa, Mycobacterium
VTDPE

SEQ ID NO: 407794 - protein, 5 aa, Mycobacterium
VTDPG

SEQ ID NO: 407795 - protein, 5 aa, Mycobacterium
VTDPH

SEQ ID NO: 407796 - protein, 4 aa, Mycobacterium
VTDQ

SEQ ID NO: 407797 - protein, 5 aa, Mycobacterium
VTDRV

SEQ ID NO: 407798 - protein, 7 aa, Mycobacterium
VTEETSG

SEQ ID NO: 407799 - protein, 15 aa, Mycobacterium
VTEEYPEKPGPVAPR

SEQ ID NO: 407800 - protein, 8 aa, Mycobacterium
VTEGGSDN

SEQ ID NO: 407801 - protein, 7 aa, Mycobacterium
VTEGHPD

SEQ ID NO: 407802 - protein, 4 aa, Mycobacterium
VTEP

SEQ ID NO: 407803 - protein, 5 aa, Mycobacterium
VTERA

SEQ ID NO: 407804 - protein, 4 aa, Mycobacterium
VTES

SEQ ID NO: 407805 - protein, 5 aa, Mycobacterium
VTGAA

SEQ ID NO: 407806 - protein, 5 aa, Mycobacterium
VTGAD

SEQ ID NO: 407807 - protein, 6 aa, Mycobacterium
VTGAGG

SEQ ID NO: 407808 - protein, 7 aa, Mycobacterium
VTGAQTG

SEQ ID NO: 407809 - protein, 8 aa, Mycobacterium
VTGERSGR

SEQ ID NO: 407810 - protein, 4 aa, Mycobacterium
VTGG

SEQ ID NO: 407811 - protein, 5 aa, Mycobacterium
VTGGG

SEQ ID NO: 407812 - protein, 11 aa, Mycobacterium
VTGGSKGIGRG

SEQ ID NO: 407813 - protein, 9 aa, Mycobacterium
VTGNPANTN

SEQ ID NO: 407814 - protein, 8 aa, Mycobacterium
VTGPPDRL

SEQ ID NO: 407815 - protein, 6 aa, Mycobacterium
VTGRGQ

SEQ ID NO: 407816 - protein, 4 aa, Mycobacterium
VTGS

SEQ ID NO: 407817 - protein, 10 aa, Mycobacterium
VTGSGAPTAN

SEQ ID NO: 407818 - protein, 4 aa, Mycobacterium
VTGT

SEQ ID NO: 407819 - protein, 8 aa, Mycobacterium
VTGTEGRK

SEQ ID NO: 407820 - protein, 10 aa, Mycobacterium
VTGTGVGGRI

SEQ ID NO: 407821 - protein, 8 aa, Mycobacterium
VTGTNGKK

SEQ ID NO: 407822 - protein, 13 aa, Mycobacterium
VTGTSKGKGFAGT

SEQ ID NO: 407823 - protein, 4 aa, Mycobacterium
VTGV

SEQ ID NO: 407824 - protein, 10 aa, Mycobacterium
VTHRSGTTTY

SEQ ID NO: 407825 - protein, 7 aa, Mycobacterium
VTKPGDR

SEQ ID NO: 407826 - protein, 11 aa, Mycobacterium
VTKRGGGAALP

SEQ ID NO: 407827 - protein, 6 aa, Mycobacterium
VTKSGL

SEQ ID NO: 407828 - protein, 4 aa, Mycobacterium
VTKT

SEQ ID NO: 407829 - protein, 4 aa, Mycobacterium
VTKY

SEQ ID NO: 407830 - protein, 6 aa, Mycobacterium
VTNASR

SEQ ID NO: 407831 - protein, 5 aa, Mycobacterium
VTNGD

SEQ ID NO: 407832 - protein, 6 aa, Mycobacterium
VTNPTS

SEQ ID NO: 407833 - protein, 7 aa, Mycobacterium
VTNQRET

SEQ ID NO: 407834 - protein, 4 aa, Mycobacterium
VTPD

SEQ ID NO: 407835 - protein, 7 aa, Mycobacterium
VTPDGGL

SEQ ID NO: 407836 - protein, 10 aa, Mycobacterium
VTPEHRPGIP

SEQ ID NO: 407837 - protein, 5 aa, Mycobacterium
VTPEK

SEQ ID NO: 407838 - protein, 10 aa, Mycobacterium
VTPERTASGY

SEQ ID NO: 407839 - protein, 5 aa, Mycobacterium
VTPHE

SEQ ID NO: 407840 - protein, 5 aa, Mycobacterium
VTPSA

SEQ ID NO: 407841 - protein, 4 aa, Mycobacterium
VTPT

SEQ ID NO: 407842 - protein, 8 aa, Mycobacterium
VTRPATDR

SEQ ID NO: 407843 - protein, 7 aa, Mycobacterium
VTRQGEQ

SEQ ID NO: 407844 - protein, 7 aa, Mycobacterium
VTSGASV

SEQ ID NO: 407845 - protein, 5 aa, Mycobacterium
VTSGE

SEQ ID NO: 407846 - protein, 7 aa, Mycobacterium
VTSGGGA

SEQ ID NO: 407847 - protein, 9 aa, Mycobacterium
VTSKKRDDL

SEQ ID NO: 407848 - protein, 7 aa, Mycobacterium
VTSPGRL

SEQ ID NO: 407849 - protein, 5 aa, Mycobacterium
VTSPL

SEQ ID NO: 407850 - protein, 7 aa, Mycobacterium
VTSQQSV

SEQ ID NO: 407851 - protein, 6 aa, Mycobacterium
VTSTAT

SEQ ID NO: 407852 - protein, 4 aa, Mycobacterium
VTSY

SEQ ID NO: 407853 - protein, 8 aa, Mycobacterium
VTTADGRG

SEQ ID NO: 407854 - protein, 7 aa, Mycobacterium
VTTAKTI

SEQ ID NO: 407855 - protein, 5 aa, Mycobacterium
VTTAQ

SEQ ID NO: 407856 - protein, 10 aa, Mycobacterium
VTTDEARERA

SEQ ID NO: 407857 - protein, 7 aa, Mycobacterium
VTTKDGD

SEQ ID NO: 407858 - protein, 7 aa, Mycobacterium
VTTKDGN

SEQ ID NO: 407859 - protein, 7 aa, Mycobacterium
VTTPAEL

SEQ ID NO: 407860 - protein, 6 aa, Mycobacterium
VTTPFP

SEQ ID NO: 407861 - protein, 7 aa, Mycobacterium
VTTPTEL

SEQ ID NO: 407862 - protein, 4 aa, Mycobacterium
VTTR

SEQ ID NO: 407863 - protein, 7 aa, Mycobacterium
VTTSGGN

SEQ ID NO: 407864 - protein, 7 aa, Mycobacterium
VTTSNDR

SEQ ID NO: 407865 - protein, 13 aa, Mycobacterium
VTTSQVDDDVRKD

SEQ ID NO: 407866 - protein, 8 aa, Mycobacterium
VTVHPNDD

SEQ ID NO: 407867 - protein, 4 aa, Mycobacterium
VTVP

SEQ ID NO: 407868 - protein, 5 aa, Mycobacterium
VVPDE

SEQ ID NO: 407869 - protein, 4 aa, Mycobacterium
VVPG

SEQ ID NO: 407870 - protein, 8 aa, Mycobacterium
VVPNDGGR

SEQ ID NO: 407871 - protein, 12 aa, Mycobacterium
VVPPAEEDDSAE

SEQ ID NO: 407872 - protein, 5 aa, Mycobacterium
VVSPE

SEQ ID NO: 407873 - protein, 5 aa, Mycobacterium
VVTGR

SEQ ID NO: 407874 - protein, 12 aa, Mycobacterium
VVTPTGNGYRRT

SEQ ID NO: 407875 - protein, 6 aa, Mycobacterium
VWTTDK

SEQ ID NO: 407876 - protein, 5 aa, Mycobacterium
VYGDA

SEQ ID NO: 407877 - protein, 8 aa, Mycobacterium
WADDRPGA

SEQ ID NO: 407878 - protein, 10 aa, Mycobacterium
WAPHGGESRV

SEQ ID NO: 407879 - protein, 6 aa, Mycobacterium
WAPRIP

SEQ ID NO: 407880 - protein, 10 aa, Mycobacterium
WDNGKPIRET

SEQ ID NO: 407881 - protein, 8 aa, Mycobacterium
WDPKAQRP

SEQ ID NO: 407882 - protein, 6 aa, Mycobacterium
WDPPVT

SEQ ID NO: 407883 - protein, 7 aa, Mycobacterium
WDPPVTA

SEQ ID NO: 407884 - protein, 10 aa, Mycobacterium
WDRTDPSYAR

SEQ ID NO: 407885 - protein, 9 aa, Mycobacterium
WDSQGRDSH

SEQ ID NO: 407886 - protein, 8 aa, Mycobacterium
WEGPGERG

SEQ ID NO: 407887 - protein, 4 aa, Mycobacterium
WEPG

SEQ ID NO: 407888 - protein, 7 aa, Mycobacterium
WEPKTDK

SEQ ID NO: 407889 - protein, 8 aa, Mycobacterium
WEPSAEGD

SEQ ID NO: 407890 - protein, 10 aa, Mycobacterium
WETRDETSAA

SEQ ID NO: 407891 - protein, 7 aa, Mycobacterium
WETTPEL

SEQ ID NO: 407892 - protein, 9 aa, Mycobacterium
WGEKQVPAD

SEQ ID NO: 407893 - protein, 5 aa, Mycobacterium
WGGPP

SEQ ID NO: 407894 - protein, 11 aa, Mycobacterium
WGPDENPYPDF

SEQ ID NO: 407895 - protein, 4 aa, Mycobacterium
WGPG

SEQ ID NO: 407896 - protein, 5 aa, Mycobacterium
WGQPN

SEQ ID NO: 407897 - protein, 13 aa, Mycobacterium
WGQTGPRSQQAGH

SEQ ID NO: 407898 - protein, 7 aa, Mycobacterium
WGSTPAA

SEQ ID NO: 407899 - protein, 7 aa, Mycobacterium
WGTTPAA

SEQ ID NO: 407900 - protein, 8 aa, Mycobacterium
WKESPPAE

SEQ ID NO: 407901 - protein, 9 aa, Mycobacterium
WKPDNSAAL

SEQ ID NO: 407902 - protein, 8 aa, Mycobacterium
WKPQPDTD

SEQ ID NO: 407903 - protein, 9 aa, Mycobacterium
WKPSPGSVY

SEQ ID NO: 407904 - protein, 7 aa, Mycobacterium
WKRSPEE

SEQ ID NO: 407905 - protein, 8 aa, Mycobacterium
WNDPDTDF

SEQ ID NO: 407906 - protein, 4 aa, Mycobacterium
WNGT

SEQ ID NO: 407907 - protein, 7 aa, Mycobacterium
WNGTDER

SEQ ID NO: 407908 - protein, 14 aa, Mycobacterium
WNGTDERVDEAYDD

SEQ ID NO: 407909 - protein, 10 aa, Mycobacterium
WNPGDETTAG

SEQ ID NO: 407910 - protein, 7 aa, Mycobacterium
WNSGSGN

SEQ ID NO: 407911 - protein, 5 aa, Mycobacterium
WPASY

SEQ ID NO: 407912 - protein, 4 aa, Mycobacterium
WPDD

SEQ ID NO: 407913 - protein, 8 aa, Mycobacterium
WPDESPQL

SEQ ID NO: 407914 - protein, 12 aa, Mycobacterium
WPDTGRARTAGI

SEQ ID NO: 407915 - protein, 6 aa, Mycobacterium
WPETVP

SEQ ID NO: 407916 - protein, 7 aa, Mycobacterium
WPGRTEE

SEQ ID NO: 407917 - protein, 12 aa, Mycobacterium
WPGSQGGTYGAN

SEQ ID NO: 407918 - protein, 11 aa, Mycobacterium
WPHPEGLAEPT

SEQ ID NO: 407919 - protein, 9 aa, Mycobacterium
WPKTSGSRG

SEQ ID NO: 407920 - protein, 18 aa, Mycobacterium
WPPKGTDRGKGDAVARST

SEQ ID NO: 407921 - protein, 4 aa, Mycobacterium
WPSE

SEQ ID NO: 407922 - protein, 4 aa, Mycobacterium
WPTN

SEQ ID NO: 407923 - protein, 9 aa, Mycobacterium
WQPGPGRGG

SEQ ID NO: 407924 - protein, 13 aa, Mycobacterium
WQQAQQPDASDAA

SEQ ID NO: 407925 - protein, 12 aa, Mycobacterium
WQRDPKQLGKLG

SEQ ID NO: 407926 - protein, 5 aa, Mycobacterium
WQRSG

SEQ ID NO: 407927 - protein, 11 aa, Mycobacterium
WRAPSAKNRQP

SEQ ID NO: 407928 - protein, 4 aa, Mycobacterium
WRDR

SEQ ID NO: 407929 - protein, 13 aa, Mycobacterium
WRGPRPTDRMVDR

SEQ ID NO: 407930 - protein, 6 aa, Mycobacterium
WRNPPR

SEQ ID NO: 407931 - protein, 10 aa, Mycobacterium
WRPAHDEDTD

SEQ ID NO: 407932 - protein, 9 aa, Mycobacterium
WRPSPGSVY

SEQ ID NO: 407933 - protein, 4 aa, Mycobacterium
WRSG

SEQ ID NO: 407934 - protein, 4 aa, Mycobacterium
WRST

SEQ ID NO: 407935 - protein, 7 aa, Mycobacterium
WSDLDDA

SEQ ID NO: 407936 - protein, 4 aa, Mycobacterium
WSLS

SEQ ID NO: 407937 - protein, 10 aa, Mycobacterium
WSQPPWRPDR

SEQ ID NO: 407938 - protein, 7 aa, Mycobacterium
WSQRSTR

SEQ ID NO: 407939 - protein, 8 aa, Mycobacterium
WSRPGGEC

SEQ ID NO: 407940 - protein, 9 aa, Mycobacterium
WSRPPRQMA

SEQ ID NO: 407941 - protein, 18 aa, Mycobacterium
WSTGSSIMPQKKNPDIAE

SEQ ID NO: 407942 - protein, 8 aa, Mycobacterium
WTEPSTSE

SEQ ID NO: 407943 - protein, 4 aa, Mycobacterium
WTER

SEQ ID NO: 407944 - protein, 4 aa, Mycobacterium
WTEY

SEQ ID NO: 407945 - protein, 7 aa, Mycobacterium
WTGNDAP

SEQ ID NO: 407946 - protein, 6 aa, Mycobacterium
WTGNDG

SEQ ID NO: 407947 - protein, 7 aa, Mycobacterium
WTNRPGT

SEQ ID NO: 407948 - protein, 7 aa, Mycobacterium
WTNRSGT

SEQ ID NO: 407949 - protein, 4 aa, Mycobacterium
WTPA

SEQ ID NO: 407950 - protein, 4 aa, Mycobacterium
WTPG

SEQ ID NO: 407951 - protein, 5 aa, Mycobacterium
WTPGG

SEQ ID NO: 407952 - protein, 10 aa, Mycobacterium
WTPQPAMPGQ

SEQ ID NO: 407953 - protein, 15 aa, Mycobacterium
YAAATSRRVAAEAGV

SEQ ID NO: 407954 - protein, 8 aa, Mycobacterium
YAAGEASV

SEQ ID NO: 407955 - protein, 6 aa, Mycobacterium
YAAREL

SEQ ID NO: 407956 - protein, 16 aa, Mycobacterium
YAEADPTADVEGYDAA

SEQ ID NO: 407957 - protein, 4 aa, Mycobacterium
YAEG

SEQ ID NO: 407958 - protein, 6 aa, Mycobacterium
YAEGTI

SEQ ID NO: 407959 - protein, 5 aa, Mycobacterium
YAERQ

SEQ ID NO: 407960 - protein, 9 aa, Mycobacterium
YAESGGQIA

SEQ ID NO: 407961 - protein, 10 aa, Mycobacterium
YAETEEEADQ

SEQ ID NO: 407962 - protein, 9 aa, Mycobacterium
YAETEQEAD

SEQ ID NO: 407963 - protein, 5 aa, Mycobacterium
YAGNP

SEQ ID NO: 407964 - protein, 10 aa, Mycobacterium
YAGPAGRDWT

SEQ ID NO: 407965 - protein, 8 aa, Mycobacterium
YAGPGAGS

SEQ ID NO: 407966 - protein, 9 aa, Mycobacterium
YAGPGSAPL

SEQ ID NO: 407967 - protein, 9 aa, Mycobacterium
YAGPGSAPM

SEQ ID NO: 407968 - protein, 15 aa, Mycobacterium
YAGRGYGDLKKETAE

SEQ ID NO: 407969 - protein, 9 aa, Mycobacterium
YAGTDRQVR

SEQ ID NO: 407970 - protein, 5 aa, Mycobacterium
YAGTL

SEQ ID NO: 407971 - protein, 12 aa, Mycobacterium
YAGTSFATPDKL

SEQ ID NO: 407972 - protein, 22 aa, Mycobacterium
YAKDKKLLKDKDPNLTGDDIRE

SEQ ID NO: 407973 - protein, 13 aa, Mycobacterium
YAKERQSFGQPIG

SEQ ID NO: 407974 - protein, 11 aa, Mycobacterium
YAKPRSADTDA

SEQ ID NO: 407975 - protein, 9 aa, Mycobacterium
YAPDNEAIS

SEQ ID NO: 407976 - protein, 4 aa, Mycobacterium
YAPE

SEQ ID NO: 407977 - protein, 6 aa, Mycobacterium
YAPNRT

SEQ ID NO: 407978 - protein, 5 aa, Mycobacterium
YAPQA

SEQ ID NO: 407979 - protein, 5 aa, Mycobacterium
YAPRR

SEQ ID NO: 407980 - protein, 7 aa, Mycobacterium
YAPRRQK

SEQ ID NO: 407981 - protein, 12 aa, Mycobacterium
YAPTSRLGTPDD

SEQ ID NO: 407982 - protein, 4 aa, Mycobacterium
YAPV

SEQ ID NO: 407983 - protein, 8 aa, Mycobacterium
YAQQPADH

SEQ ID NO: 407984 - protein, 6 aa, Mycobacterium
YARAER

SEQ ID NO: 407985 - protein, 7 aa, Mycobacterium
YARAERD

SEQ ID NO: 407986 - protein, 9 aa, Mycobacterium
YARGETPNP

SEQ ID NO: 407987 - protein, 5 aa, Mycobacterium
YASGK

SEQ ID NO: 407988 - protein, 4 aa, Mycobacterium
YASP

SEQ ID NO: 407989 - protein, 8 aa, Mycobacterium
YASREQEN

SEQ ID NO: 407990 - protein, 5 aa, Mycobacterium
YASRG

SEQ ID NO: 407991 - protein, 10 aa, Mycobacterium
YATAETNRTV

SEQ ID NO: 407992 - protein, 6 aa, Mycobacterium
YATDAG

SEQ ID NO: 407993 - protein, 14 aa, Mycobacterium
YATEEDTAQGAASL

SEQ ID NO: 407994 - protein, 5 aa, Mycobacterium
YATGA

SEQ ID NO: 407995 - protein, 5 aa, Mycobacterium
YATND

SEQ ID NO: 407996 - protein, 4 aa, Mycobacterium
YATQ

SEQ ID NO: 407997 - protein, 13 aa, Mycobacterium
YCGTSGATAAGGN

SEQ ID NO: 407998 - protein, 8 aa, Mycobacterium
YDDEGVAA

SEQ ID NO: 407999 - protein, 8 aa, Mycobacterium
YDDESFDE

SEQ ID NO: 408000 - protein, 8 aa, Mycobacterium
YDEAENDD

SEQ ID NO: 408001 - protein, 12 aa, Mycobacterium
YDEGDTFDQSAA

SEQ ID NO: 408002 - protein, 9 aa, Mycobacterium
YDEGYTPDF

SEQ ID NO: 408003 - protein, 7 aa, Mycobacterium
YDEPKSI

SEQ ID NO: 408004 - protein, 8 aa, Mycobacterium
YDEPNGGL

SEQ ID NO: 408005 - protein, 4 aa, Mycobacterium
YDET

SEQ ID NO: 408006 - protein, 4 aa, Mycobacterium
YDGE

SEQ ID NO: 408007 - protein, 12 aa, Mycobacterium
YDGEQHRNDRRQ

SEQ ID NO: 408008 - protein, 7 aa, Mycobacterium
YDPDGNR

SEQ ID NO: 408009 - protein, 6 aa, Mycobacterium
YDPDNT

SEQ ID NO: 408010 - protein, 12 aa, Mycobacterium
YDPNPDDSQRQR

SEQ ID NO: 408011 - protein, 8 aa, Mycobacterium
YDPPNEKL

SEQ ID NO: 408012 - protein, 7 aa, Mycobacterium
YDPSVPD

SEQ ID NO: 408013 - protein, 10 aa, Mycobacterium
YDQPGQTRAA

SEQ ID NO: 408014 - protein, 6 aa, Mycobacterium
YDRETK

SEQ ID NO: 408015 - protein, 6 aa, Mycobacterium
YDREYG

SEQ ID NO: 408016 - protein, 7 aa, Mycobacterium
YDRPGTT

SEQ ID NO: 408017 - protein, 10 aa, Mycobacterium
YDTAAAAAKA

SEQ ID NO: 408018 - protein, 9 aa, Mycobacterium
YDTATTAAR

SEQ ID NO: 408019 - protein, 7 aa, Mycobacterium
YDTDPEL

SEQ ID NO: 408020 - protein, 4 aa, Mycobacterium
YDTS

SEQ ID NO: 408021 - protein, 4 aa, Mycobacterium
YEDA

SEQ ID NO: 408022 - protein, 8 aa, Mycobacterium
YEDPNAAT

SEQ ID NO: 408023 - protein, 4 aa, Mycobacterium
YEDQ

SEQ ID NO: 408024 - protein, 8 aa, Mycobacterium
YEEDARAE

SEQ ID NO: 408025 - protein, 7 aa, Mycobacterium
YEETGAY

SEQ ID NO: 408026 - protein, 4 aa, Mycobacterium
YEGD

SEQ ID NO: 408027 - protein, 7 aa, Mycobacterium
YEGDYEK

SEQ ID NO: 408028 - protein, 6 aa, Mycobacterium
YEGGAS

SEQ ID NO: 408029 - protein, 6 aa, Mycobacterium
YEGPPG

SEQ ID NO: 408030 - protein, 7 aa, Mycobacterium
YEGPQSA

SEQ ID NO: 408031 - protein, 8 aa, Mycobacterium
YENAPGHQ

SEQ ID NO: 408032 - protein, 8 aa, Mycobacterium
YEPAANRI

SEQ ID NO: 408033 - protein, 5 aa, Mycobacterium
YEPPE

SEQ ID NO: 408034 - protein, 6 aa, Mycobacterium
YESRVG

SEQ ID NO: 408035 - protein, 10 aa, Mycobacterium
YESTESGEFT

SEQ ID NO: 408036 - protein, 18 aa, Mycobacterium
YETAQKARESRKNQQQTV

SEQ ID NO: 408037 - protein, 4 aa, Mycobacterium
YGAA

SEQ ID NO: 408038 - protein, 4 aa, Mycobacterium
YGAD

SEQ ID NO: 408039 - protein, 6 aa, Mycobacterium
YGADIA

SEQ ID NO: 408040 - protein, 4 aa, Mycobacterium
YGAG

SEQ ID NO: 408041 - protein, 9 aa, Mycobacterium
YGAGQGPRL

SEQ ID NO: 408042 - protein, 8 aa, Mycobacterium
YGATTDKA

SEQ ID NO: 408043 - protein, 4 aa, Mycobacterium
YGDA

SEQ ID NO: 408044 - protein, 6 aa, Mycobacterium
YGDATR

SEQ ID NO: 408045 - protein, 11 aa, Mycobacterium
YGDEPTPTQEQ

SEQ ID NO: 408046 - protein, 9 aa, Mycobacterium
YGDPDNPED

SEQ ID NO: 408047 - protein, 6 aa, Mycobacterium
YGDPEG

SEQ ID NO: 408048 - protein, 4 aa, Mycobacterium
YGDR

SEQ ID NO: 408049 - protein, 10 aa, Mycobacterium
YGDSTVGAAA

SEQ ID NO: 408050 - protein, 5 aa, Mycobacterium
YGEDD

SEQ ID NO: 408051 - protein, 12 aa, Mycobacterium
YGETGPDADRAA

SEQ ID NO: 408052 - protein, 8 aa, Mycobacterium
YGETKAPE

SEQ ID NO: 408053 - protein, 9 aa, Mycobacterium
YGETKPPEL

SEQ ID NO: 408054 - protein, 4 aa, Mycobacterium
YGGA

SEQ ID NO: 408055 - protein, 4 aa, Mycobacterium
YGGE

SEQ ID NO: 408056 - protein, 18 aa, Mycobacterium
YGGEVKGELEGYGLTGST

SEQ ID NO: 408057 - protein, 4 aa, Mycobacterium
YGGG

SEQ ID NO: 408058 - protein, 5 aa, Mycobacterium
YGGGA

SEQ ID NO: 408059 - protein, 5 aa, Mycobacterium
YGGLG

SEQ ID NO: 408060 - protein, 6 aa, Mycobacterium
YGGQLS

SEQ ID NO: 408061 - protein, 4 aa, Mycobacterium
YGGS

SEQ ID NO: 408062 - protein, 9 aa, Mycobacterium
YGGSDEAAI

SEQ ID NO: 408063 - protein, 5 aa, Mycobacterium
YGGSK

SEQ ID NO: 408064 - protein, 5 aa, Mycobacterium
YGGTA

SEQ ID NO: 408065 - protein, 7 aa, Mycobacterium
YGGTAEV

SEQ ID NO: 408066 - protein, 6 aa, Mycobacterium
YGGTDI

SEQ ID NO: 408067 - protein, 9 aa, Mycobacterium
YGGTEIKYN

SEQ ID NO: 408068 - protein, 14 aa, Mycobacterium
YGGTGYPAGKGAVN

SEQ ID NO: 408069 - protein, 15 aa, Mycobacterium
YGGTSEIMKEIISRS

SEQ ID NO: 408070 - protein, 14 aa, Mycobacterium
YGLKKARKAPQYSK

SEQ ID NO: 408071 - protein, 18 aa, Mycobacterium
YGLTEAGTATLSRPGDSF

SEQ ID NO: 408072 - protein, 6 aa, Mycobacterium
YGNAGS

SEQ ID NO: 408073 - protein, 10 aa, Mycobacterium
YGNPAEPDTA

SEQ ID NO: 408074 - protein, 4 aa, Mycobacterium
YGPA

SEQ ID NO: 408075 - protein, 4 aa, Mycobacterium
YGPD

SEQ ID NO: 408076 - protein, 4 aa, Mycobacterium
YGPG

SEQ ID NO: 408077 - protein, 6 aa, Mycobacterium
YGPHPA

SEQ ID NO: 408078 - protein, 17 aa, Mycobacterium
YGPRTGGKSKVSGSLRG

SEQ ID NO: 408079 - protein, 7 aa, Mycobacterium
YGPSGIR

SEQ ID NO: 408080 - protein, 7 aa, Mycobacterium
YGPTEGT

SEQ ID NO: 408081 - protein, 8 aa, Mycobacterium
YGPTETTI

SEQ ID NO: 408082 - protein, 5 aa, Mycobacterium
YGPTI

SEQ ID NO: 408083 - protein, 13 aa, Mycobacterium
YGQDRGSAGAAGK

SEQ ID NO: 408084 - protein, 9 aa, Mycobacterium
YGQDRPADR

SEQ ID NO: 408085 - protein, 11 aa, Mycobacterium
YGQNPQAACDG

SEQ ID NO: 408086 - protein, 6 aa, Mycobacterium
YGQVPE

SEQ ID NO: 408087 - protein, 12 aa, Mycobacterium
YGRGTADDKAGI

SEQ ID NO: 408088 - protein, 6 aa, Mycobacterium
YGSDAL

SEQ ID NO: 408089 - protein, 7 aa, Mycobacterium
YGSEDPV

SEQ ID NO: 408090 - protein, 9 aa, Mycobacterium
YGSGAPQHS

SEQ ID NO: 408091 - protein, 12 aa, Mycobacterium
YGSPDHSRGPFP

SEQ ID NO: 408092 - protein, 8 aa, Mycobacterium
YGSSETGN

SEQ ID NO: 408093 - protein, 9 aa, Mycobacterium
YGSSETGNM

SEQ ID NO: 408094 - protein, 9 aa, Mycobacterium
YGSSNAAHD

SEQ ID NO: 408095 - protein, 10 aa, Mycobacterium
YGSSNAPHDI

SEQ ID NO: 408096 - protein, 9 aa, Mycobacterium
YGSSTSSSG

SEQ ID NO: 408097 - protein, 7 aa, Mycobacterium
YGSTEAG

SEQ ID NO: 408098 - protein, 5 aa, Mycobacterium
YGTAK

SEQ ID NO: 408099 - protein, 6 aa, Mycobacterium
YGTAKA

SEQ ID NO: 408100 - protein, 16 aa, Mycobacterium
YGTGARGAAIDTEETR

SEQ ID NO: 408101 - protein, 6 aa, Mycobacterium
YGTQPG

SEQ ID NO: 408102 - protein, 4 aa, Mycobacterium
YGTT

SEQ ID NO: 408103 - protein, 6 aa, Mycobacterium
YGTTAE

SEQ ID NO: 408104 - protein, 7 aa, Mycobacterium
YGTTKET

SEQ ID NO: 408105 - protein, 7 aa, Mycobacterium
YGTYDDS

SEQ ID NO: 408106 - protein, 11 aa, Mycobacterium
YGVDNRPGGVR

SEQ ID NO: 408107 - protein, 8 aa, Mycobacterium
YGVTPKGW

SEQ ID NO: 408108 - protein, 9 aa, Mycobacterium
YGYGPQADR

SEQ ID NO: 408109 - protein, 4 aa, Mycobacterium
YHDR

SEQ ID NO: 408110 - protein, 7 aa, Mycobacterium
YHGGTET

SEQ ID NO: 408111 - protein, 7 aa, Mycobacterium
YHSNEGG

SEQ ID NO: 408112 - protein, 4 aa, Mycobacterium
YITS

SEQ ID NO: 408113 - protein, 10 aa, Mycobacterium
YKSSARPALD

SEQ ID NO: 408114 - protein, 5 aa, Mycobacterium
YLPEG

SEQ ID NO: 408115 - protein, 9 aa, Mycobacterium
YLSSDEREN

SEQ ID NO: 408116 - protein, 7 aa, Mycobacterium
YNAPATL

SEQ ID NO: 408117 - protein, 9 aa, Mycobacterium
YNAPTSTSP

SEQ ID NO: 408118 - protein, 12 aa, Mycobacterium
YNPHRPRPTDLD

SEQ ID NO: 408119 - protein, 10 aa, Mycobacterium
YNQSDPYARS

SEQ ID NO: 408120 - protein, 11 aa, Mycobacterium
YNSPDGQMPQL

SEQ ID NO: 408121 - protein, 4 aa, Mycobacterium
YPAG

SEQ ID NO: 408122 - protein, 5 aa, Mycobacterium
YPAGE

SEQ ID NO: 408123 - protein, 13 aa, Mycobacterium
YPAQLSGGEQQRV

SEQ ID NO: 408124 - protein, 4 aa, Mycobacterium
YPAS

SEQ ID NO: 408125 - protein, 4 aa, Mycobacterium
YPDA

SEQ ID NO: 408126 - protein, 12 aa, Mycobacterium
YPDAAKYAPGAI

SEQ ID NO: 408127 - protein, 5 aa, Mycobacterium
YPDAE

SEQ ID NO: 408128 - protein, 8 aa, Mycobacterium
YPDGRPHH

SEQ ID NO: 408129 - protein, 7 aa, Mycobacterium
YPDNASV

SEQ ID NO: 408130 - protein, 11 aa, Mycobacterium
YPDQPKNYQIS

SEQ ID NO: 408131 - protein, 8 aa, Mycobacterium
YPDQSQYS

SEQ ID NO: 408132 - protein, 10 aa, Mycobacterium
YPEGVPPTDT

SEQ ID NO: 408133 - protein, 5 aa, Mycobacterium
YPEHG

SEQ ID NO: 408134 - protein, 6 aa, Mycobacterium
YPGDGI

SEQ ID NO: 408135 - protein, 7 aa, Mycobacterium
YPGGAGF

SEQ ID NO: 408136 - protein, 8 aa, Mycobacterium
YPGGAGFA

SEQ ID NO: 408137 - protein, 5 aa, Mycobacterium
YPGGK

SEQ ID NO: 408138 - protein, 4 aa, Mycobacterium
YPGH

SEQ ID NO: 408139 - protein, 11 aa, Mycobacterium
YPHNESTFGYS

SEQ ID NO: 408140 - protein, 12 aa, Mycobacterium
YPHNESTFGYSE

SEQ ID NO: 408141 - protein, 14 aa, Mycobacterium
YPHNESTYGYSEKS

SEQ ID NO: 408142 - protein, 4 aa, Mycobacterium
YPHT

SEQ ID NO: 408143 - protein, 4 aa, Mycobacterium
YPKP

SEQ ID NO: 408144 - protein, 4 aa, Mycobacterium
YPLD

SEQ ID NO: 408145 - protein, 4 aa, Mycobacterium
YPLG

SEQ ID NO: 408146 - protein, 7 aa, Mycobacterium
YPPDDQL

SEQ ID NO: 408147 - protein, 8 aa, Mycobacterium
YPPEEATT

SEQ ID NO: 408148 - protein, 8 aa, Mycobacterium
YPPGTRPD

SEQ ID NO: 408149 - protein, 7 aa, Mycobacterium
YPPGVRP

SEQ ID NO: 408150 - protein, 4 aa, Mycobacterium
YPPL

SEQ ID NO: 408151 - protein, 8 aa, Mycobacterium
YPPQEAQT

SEQ ID NO: 408152 - protein, 4 aa, Mycobacterium
YPQL

SEQ ID NO: 408153 - protein, 4 aa, Mycobacterium
YPQP

SEQ ID NO: 408154 - protein, 5 aa, Mycobacterium
YPQYQ

SEQ ID NO: 408155 - protein, 8 aa, Mycobacterium
YPRESPGG

SEQ ID NO: 408156 - protein, 5 aa, Mycobacterium
YPSGD

SEQ ID NO: 408157 - protein, 6 aa, Mycobacterium
YPSGDG

SEQ ID NO: 408158 - protein, 6 aa, Mycobacterium
YPSGEG

SEQ ID NO: 408159 - protein, 5 aa, Mycobacterium
YPSPA

SEQ ID NO: 408160 - protein, 4 aa, Mycobacterium
YPTA

SEQ ID NO: 408161 - protein, 4 aa, Mycobacterium
YPTG

SEQ ID NO: 408162 - protein, 6 aa, Mycobacterium
YPTPTQ

SEQ ID NO: 408163 - protein, 4 aa, Mycobacterium
YPTR

SEQ ID NO: 408164 - protein, 5 aa, Mycobacterium
YPTRD

SEQ ID NO: 408165 - protein, 15 aa, Mycobacterium
YPTRKDLTPDTLRRV

SEQ ID NO: 408166 - protein, 19 aa, Mycobacterium
YPYQSDSKYPYTPDGNREF

SEQ ID NO: 408167 - protein, 4 aa, Mycobacterium
YQDH

SEQ ID NO: 408168 - protein, 10 aa, Mycobacterium
YQETLTDPSY

SEQ ID NO: 408169 - protein, 4 aa, Mycobacterium
YQGN

SEQ ID NO: 408170 - protein, 8 aa, Mycobacterium
YQGSPLGG

SEQ ID NO: 408171 - protein, 17 aa, Mycobacterium
YQPHPRTSARDADARRV

SEQ ID NO: 408172 - protein, 20 aa, Mycobacterium
YQQTHEENFSAASDEALGDI

SEQ ID NO: 408173 - protein, 5 aa, Mycobacterium
YQSPI

SEQ ID NO: 408174 - protein, 8 aa, Mycobacterium
YQSSPVPG

SEQ ID NO: 408175 - protein, 8 aa, Mycobacterium
YQTSDGGT

SEQ ID NO: 408176 - protein, 14 aa, Mycobacterium
YRAGTAAAARGGHA

SEQ ID NO: 408177 - protein, 6 aa, Mycobacterium
YRAPTS

SEQ ID NO: 408178 - protein, 12 aa, Mycobacterium
YRDDAKGPSASV

SEQ ID NO: 408179 - protein, 10 aa, Mycobacterium
YRDEARPRAG

SEQ ID NO: 408180 - protein, 6 aa, Mycobacterium
YRDESG

SEQ ID NO: 408181 - protein, 14 aa, Mycobacterium
YRDETGSKVHTPEQ

SEQ ID NO: 408182 - protein, 6 aa, Mycobacterium
YRDGDL

SEQ ID NO: 408183 - protein, 5 aa, Mycobacterium
YRDRG

SEQ ID NO: 408184 - protein, 7 aa, Mycobacterium
YRGAANE

SEQ ID NO: 408185 - protein, 7 aa, Mycobacterium
YRGAPNE

SEQ ID NO: 408186 - protein, 6 aa, Mycobacterium
YRGARG

SEQ ID NO: 408187 - protein, 9 aa, Mycobacterium
YRGEPAYRQ

SEQ ID NO: 408188 - protein, 9 aa, Mycobacterium
YRGPRDERE

SEQ ID NO: 408189 - protein, 4 aa, Mycobacterium
YRGR

SEQ ID NO: 408190 - protein, 11 aa, Mycobacterium
YRPDPAEPTQA

SEQ ID NO: 408191 - protein, 6 aa, Mycobacterium
YRPGDY

SEQ ID NO: 408192 - protein, 5 aa, Mycobacterium
YRPGT

SEQ ID NO: 408193 - protein, 5 aa, Mycobacterium
YRPRD

SEQ ID NO: 408194 - protein, 4 aa, Mycobacterium
YRPS

SEQ ID NO: 408195 - protein, 9 aa, Mycobacterium
YRSGRGTTA

SEQ ID NO: 408196 - protein, 4 aa, Mycobacterium
YRSS

SEQ ID NO: 408197 - protein, 5 aa, Mycobacterium
YRSTQ

SEQ ID NO: 408198 - protein, 6 aa, Mycobacterium
YRTPAE

SEQ ID NO: 408199 - protein, 9 aa, Mycobacterium
YRTPRPNPR

SEQ ID NO: 408200 - protein, 4 aa, Mycobacterium
YRYQ

SEQ ID NO: 408201 - protein, 14 aa, Mycobacterium
YSDSDGKSGGQKEK

SEQ ID NO: 408202 - protein, 4 aa, Mycobacterium
YSEP

SEQ ID NO: 408203 - protein, 6 aa, Mycobacterium
YSGPDN

SEQ ID NO: 408204 - protein, 9 aa, Mycobacterium
YSGPGAGPL

SEQ ID NO: 408205 - protein, 9 aa, Mycobacterium
YSGPGSGPL

SEQ ID NO: 408206 - protein, 4 aa, Mycobacterium
YSGS

SEQ ID NO: 408207 - protein, 8 aa, Mycobacterium
YSKPPQSG

SEQ ID NO: 408208 - protein, 4 aa, Mycobacterium
YSLT

SEQ ID NO: 408209 - protein, 15 aa, Mycobacterium
YSNTGGQMSKSTPLG

SEQ ID NO: 408210 - protein, 4 aa, Mycobacterium
YSPA

SEQ ID NO: 408211 - protein, 5 aa, Mycobacterium
YSPDH

SEQ ID NO: 408212 - protein, 12 aa, Mycobacterium
YSPDLDGRADPG

SEQ ID NO: 408213 - protein, 4 aa, Mycobacterium
YSPG

SEQ ID NO: 408214 - protein, 6 aa, Mycobacterium
YSQGAA

SEQ ID NO: 408215 - protein, 17 aa, Mycobacterium
YSRADDEQQQALSSQMG

SEQ ID NO: 408216 - protein, 4 aa, Mycobacterium
YSRE

SEQ ID NO: 408217 - protein, 8 aa, Mycobacterium
YSSPHDQI

SEQ ID NO: 408218 - protein, 4 aa, Mycobacterium
YSSR

SEQ ID NO: 408219 - protein, 15 aa, Mycobacterium
YSTDLTARAREGKLD

SEQ ID NO: 408220 - protein, 9 aa, Mycobacterium
YSTPESPVS

SEQ ID NO: 408221 - protein, 11 aa, Mycobacterium
YSTTGSTTWEN

SEQ ID NO: 408222 - protein, 4 aa, Mycobacterium
YTAN

SEQ ID NO: 408223 - protein, 4 aa, Mycobacterium
YTDE

SEQ ID NO: 408224 - protein, 5 aa, Mycobacterium
YTESW

SEQ ID NO: 408225 - protein, 4 aa, Mycobacterium
YTGD

SEQ ID NO: 408226 - protein, 4 aa, Mycobacterium
YTGR

SEQ ID NO: 408227 - protein, 8 aa, Mycobacterium
YTGRESHA

SEQ ID NO: 408228 - protein, 4 aa, Mycobacterium
YTPD

SEQ ID NO: 408229 - protein, 10 aa, Mycobacterium
YTPPEHRGHG

SEQ ID NO: 408230 - protein, 16 aa, Mycobacterium
YTQNGRGELAANEHAE

SEQ ID NO: 408231 - protein, 4 aa, Mycobacterium
YTRD

SEQ ID NO: 408232 - protein, 7 aa, Mycobacterium
YTREREA

SEQ ID NO: 408233 - protein, 10 aa, Mycobacterium
YTSPKGSRVE

SEQ ID NO: 408234 - protein, 9 aa, Mycobacterium
YTTTTSGAR

SEQ ID NO: 408235 - protein, 7 aa, Mycobacterium
YVPEGDS

SEQ ID NO: 408236 - protein, 7 aa, Mycobacterium
YVTTPGS

SEQ ID NO: 408237 - protein, 11 aa, Mycobacterium
YYATSDPETFD

SEQ ID NO: 408238 - protein, 4 aa, Mycobacterium
YYGP

SEQ ID NO: 408239 - protein, 9 aa, Mycobacterium
YYNKGSEAL

SEQ ID NO: 408240 - protein, 6 aa, Mycobacterium
YYPETN

SEQ ID NO: 408241 - protein, 8 aa, Mycobacterium
YYRSGGGR

SEQ ID NO: 408242 - protein, 5 aa, Mycobacterium
AAAAA

SEQ ID NO: 408243 - protein, 17 aa, Mycobacterium
AAAAAADPGPGKAPISA

SEQ ID NO: 408244 - protein, 13 aa, Mycobacterium
AAAAAAGKAAREF

SEQ ID NO: 408245 - protein, 11 aa, Mycobacterium
AAAAAAGRAAP

SEQ ID NO: 408246 - protein, 13 aa, Mycobacterium
AAAAAAKAGEGPV

SEQ ID NO: 408247 - protein, 8 aa, Mycobacterium
AAAAAANK

SEQ ID NO: 408248 - protein, 6 aa, Mycobacterium
AAAAAD

SEQ ID NO: 408249 - protein, 7 aa, Mycobacterium
AAAAADD

SEQ ID NO: 408250 - protein, 8 aa, Mycobacterium
AAAAADDE

SEQ ID NO: 408251 - protein, 10 aa, Mycobacterium
AAAAADEGRD

SEQ ID NO: 408252 - protein, 8 aa, Mycobacterium
AAAAADGW

SEQ ID NO: 408253 - protein, 9 aa, Mycobacterium
AAAAADPSQ

SEQ ID NO: 408254 - protein, 14 aa, Mycobacterium
AAAAADRSDGQLAS

SEQ ID NO: 408255 - protein, 12 aa, Mycobacterium
AAAAAEPAASAF

SEQ ID NO: 408256 - protein, 14 aa, Mycobacterium
AAAAAFGAAGPGRR

SEQ ID NO: 408257 - protein, 7 aa, Mycobacterium
AAAAAGA

SEQ ID NO: 408258 - protein, 15 aa, Mycobacterium
AAAAAGDAALRAEYG

SEQ ID NO: 408259 - protein, 10 aa, Mycobacterium
AAAAAGDPVA

SEQ ID NO: 408260 - protein, 8 aa, Mycobacterium
AAAAAGEA

SEQ ID NO: 408261 - protein, 11 aa, Mycobacterium
AAAAAGGSNCG

SEQ ID NO: 408262 - protein, 14 aa, Mycobacterium
AAAAAKAEAGAFES

SEQ ID NO: 408263 - protein, 12 aa, Mycobacterium
AAAAAKPSDTAA

SEQ ID NO: 408264 - protein, 12 aa, Mycobacterium
AAAAAPGAVDGS

SEQ ID NO: 408265 - protein, 8 aa, Mycobacterium
AAAAAPLT

SEQ ID NO: 408266 - protein, 9 aa, Mycobacterium
AAAAAQADE

SEQ ID NO: 408267 - protein, 9 aa, Mycobacterium
AAAAAQATA

SEQ ID NO: 408268 - protein, 19 aa, Mycobacterium
AAAAAQSATQATEAAAAYE

SEQ ID NO: 408269 - protein, 12 aa, Mycobacterium
AAAAAQVAAEHP

SEQ ID NO: 408270 - protein, 17 aa, Mycobacterium
AAAAAQVGKRAAEPADD

SEQ ID NO: 408271 - protein, 10 aa, Mycobacterium
AAAAARAPKQ

SEQ ID NO: 408272 - protein, 10 aa, Mycobacterium
AAAAARGLAD

SEQ ID NO: 408273 - protein, 8 aa, Mycobacterium
AAAAARRR

SEQ ID NO: 408274 - protein, 26 aa, Mycobacterium
AAAAARTEIPTGQSTDPATASARTEA

SEQ ID NO: 408275 - protein, 9 aa, Mycobacterium
AAAAARTTG

SEQ ID NO: 408276 - protein, 8 aa, Mycobacterium
AAAAASDG

SEQ ID NO: 408277 - protein, 11 aa, Mycobacterium
AAAAASSSTTR

SEQ ID NO: 408278 - protein, 17 aa, Mycobacterium
AAAAATARHASRSGRGR

SEQ ID NO: 408279 - protein, 11 aa, Mycobacterium
AAAAATNAQTA

SEQ ID NO: 408280 - protein, 7 aa, Mycobacterium
AAAAATR

SEQ ID NO: 408281 - protein, 31 aa, Mycobacterium
AAAAATSTARSLAAPTVTNEATDEVADDEAV

SEQ ID NO: 408282 - protein, 9 aa, Mycobacterium
AAAAATTGV

SEQ ID NO: 408283 - protein, 6 aa, Mycobacterium
AAAAAY

SEQ ID NO: 408284 - protein, 16 aa, Mycobacterium
AAAADAAAAAKHASEA

SEQ ID NO: 408285 - protein, 10 aa, Mycobacterium
AAAADAPNAL

SEQ ID NO: 408286 - protein, 18 aa, Mycobacterium
AAAADATRRAIAGGAPAV

SEQ ID NO: 408287 - protein, 12 aa, Mycobacterium
AAAADAVPPETA

SEQ ID NO: 408288 - protein, 6 aa, Mycobacterium
AAAADD

SEQ ID NO: 408289 - protein, 12 aa, Mycobacterium
AAAADEDRLPDQ

SEQ ID NO: 408290 - protein, 8 aa, Mycobacterium
AAAADEVS

SEQ ID NO: 408291 - protein, 7 aa, Mycobacterium
AAAADGF

SEQ ID NO: 408292 - protein, 7 aa, Mycobacterium
AAAADGR

SEQ ID NO: 408293 - protein, 10 aa, Mycobacterium
AAAADHEREA

SEQ ID NO: 408294 - protein, 8 aa, Mycobacterium
AAAADLAA

SEQ ID NO: 408295 - protein, 9 aa, Mycobacterium
AAAADLPAS

SEQ ID NO: 408296 - protein, 7 aa, Mycobacterium
AAAADNV

SEQ ID NO: 408297 - protein, 8 aa, Mycobacterium
AAAADPAH

SEQ ID NO: 408298 - protein, 7 aa, Mycobacterium
AAAADQS

SEQ ID NO: 408299 - protein, 7 aa, Mycobacterium
AAAADRP

SEQ ID NO: 408300 - protein, 9 aa, Mycobacterium
AAAADRPDV

SEQ ID NO: 408301 - protein, 7 aa, Mycobacterium
AAAADSE

SEQ ID NO: 408302 - protein, 5 aa, Mycobacterium
AAAAE

SEQ ID NO: 408303 - protein, 14 aa, Mycobacterium
AAAAEAITKATGVS

SEQ ID NO: 408304 - protein, 11 aa, Mycobacterium
AAAAEASSGGL

SEQ ID NO: 408305 - protein, 7 aa, Mycobacterium
AAAAEDA

SEQ ID NO: 408306 - protein, 6 aa, Mycobacterium
AAAAEG

SEQ ID NO: 408307 - protein, 9 aa, Mycobacterium
AAAAEGALP

SEQ ID NO: 408308 - protein, 9 aa, Mycobacterium
AAAAEHERE

SEQ ID NO: 408309 - protein, 8 aa, Mycobacterium
AAAAEIPT

SEQ ID NO: 408310 - protein, 11 aa, Mycobacterium
AAAAEKAFTGD

SEQ ID NO: 408311 - protein, 15 aa, Mycobacterium
AAAAELGETAQPGPV

SEQ ID NO: 408312 - protein, 11 aa, Mycobacterium
AAAAELSSPAA

SEQ ID NO: 408313 - protein, 10 aa, Mycobacterium
AAAAEPAQAA

SEQ ID NO: 408314 - protein, 9 aa, Mycobacterium
AAAAEPIKA

SEQ ID NO: 408315 - protein, 8 aa, Mycobacterium
AAAAEPRA

SEQ ID NO: 408316 - protein, 7 aa, Mycobacterium
AAAAEQA

SEQ ID NO: 408317 - protein, 8 aa, Mycobacterium
AAAAEQAG

SEQ ID NO: 408318 - protein, 12 aa, Mycobacterium
AAAAEQGRDPRS

SEQ ID NO: 408319 - protein, 7 aa, Mycobacterium
AAAAEQH

SEQ ID NO: 408320 - protein, 10 aa, Mycobacterium
AAAAEQSFSG

SEQ ID NO: 408321 - protein, 6 aa, Mycobacterium
AAAAER

SEQ ID NO: 408322 - protein, 10 aa, Mycobacterium
AAAAERAFTG

SEQ ID NO: 408323 - protein, 29 aa, Mycobacterium
AAAAERNSAANPAQAVDAASAGAEPAPVN

SEQ ID NO: 408324 - protein, 6 aa, Mycobacterium
AAAAGA

SEQ ID NO: 408325 - protein, 7 aa, Mycobacterium
AAAAGAE

SEQ ID NO: 408326 - protein, 7 aa, Mycobacterium
AAAAGAQ

SEQ ID NO: 408327 - protein, 8 aa, Mycobacterium
AAAAGARK

SEQ ID NO: 408328 - protein, 11 aa, Mycobacterium
AAAAGASDPLR

SEQ ID NO: 408329 - protein, 7 aa, Mycobacterium
AAAAGDA

SEQ ID NO: 408330 - protein, 19 aa, Mycobacterium
AAAAGDLAGGAGGSVAPAA

SEQ ID NO: 408331 - protein, 8 aa, Mycobacterium
AAAAGGAA

SEQ ID NO: 408332 - protein, 8 aa, Mycobacterium
AAAAGGAQ

SEQ ID NO: 408333 - protein, 8 aa, Mycobacterium
AAAAGGRY

SEQ ID NO: 408334 - protein, 8 aa, Mycobacterium
AAAAGGSS

SEQ ID NO: 408335 - protein, 9 aa, Mycobacterium
AAAAGGTAE

SEQ ID NO: 408336 - protein, 6 aa, Mycobacterium
AAAAGH

SEQ ID NO: 408337 - protein, 10 aa, Mycobacterium
AAAAGKPGLE

SEQ ID NO: 408338 - protein, 11 aa, Mycobacterium
AAAAGLPATAP

SEQ ID NO: 408339 - protein, 13 aa, Mycobacterium
AAAAGLTADAGRY

SEQ ID NO: 408340 - protein, 6 aa, Mycobacterium
AAAAGN

SEQ ID NO: 408341 - protein, 7 aa, Mycobacterium
AAAAGNA

SEQ ID NO: 408342 - protein, 9 aa, Mycobacterium
AAAAGNANL

SEQ ID NO: 408343 - protein, 7 aa, Mycobacterium
AAAAGNL

SEQ ID NO: 408344 - protein, 10 aa, Mycobacterium
AAAAGNLQEI

SEQ ID NO: 408345 - protein, 35 aa, Mycobacterium
AAAAGPDATVTQKVTDRSRASVRVPSDQQAKDGVL

SEQ ID NO: 408346 - protein, 15 aa, Mycobacterium
AAAAGPIAPAAAGAP

SEQ ID NO: 408347 - protein, 8 aa, Mycobacterium
AAAAGQAF

SEQ ID NO: 408348 - protein, 8 aa, Mycobacterium
AAAAGQGL

SEQ ID NO: 408349 - protein, 7 aa, Mycobacterium
AAAAGQT

SEQ ID NO: 408350 - protein, 11 aa, Mycobacterium
AAAAGRATAGA

SEQ ID NO: 408351 - protein, 9 aa, Mycobacterium
AAAAGRAVS

SEQ ID NO: 408352 - protein, 7 aa, Mycobacterium
AAAAGRV

SEQ ID NO: 408353 - protein, 8 aa, Mycobacterium
AAAAGSDH

SEQ ID NO: 408354 - protein, 8 aa, Mycobacterium
AAAAGSGD

SEQ ID NO: 408355 - protein, 11 aa, Mycobacterium
AAAAGSGPTRA

SEQ ID NO: 408356 - protein, 8 aa, Mycobacterium
AAAAGSSV

SEQ ID NO: 408357 - protein, 6 aa, Mycobacterium
AAAAGT

SEQ ID NO: 408358 - protein, 13 aa, Mycobacterium
AAAAGVPRIADDT

SEQ ID NO: 408359 - protein, 6 aa, Mycobacterium
AAAAGW

SEQ ID NO: 408360 - protein, 9 aa, Mycobacterium
AAAAGYSSE

SEQ ID NO: 408361 - protein, 5 aa, Mycobacterium
AAAAH

SEQ ID NO: 408362 - protein, 5 aa, Mycobacterium
AAAAI

SEQ ID NO: 408363 - protein, 13 aa, Mycobacterium
AAAAIEAGANTRA

SEQ ID NO: 408364 - protein, 8 aa, Mycobacterium
AAAAKAKA

SEQ ID NO: 408365 - protein, 7 aa, Mycobacterium
AAAAKAS

SEQ ID NO: 408366 - protein, 97 aa, Mycobacterium
AAAAKASDSAAKPDSGSVATKERAEAERPAPALRAKGIDNEAPPLTYTGPSEDGTAQVQRSGNGGRHAAPAGGSRRERREAARKQAKADRPAKSHRK

SEQ ID NO: 408367 - protein, 24 aa, Mycobacterium
AAAAKPAEKPSAKIATKPTAADRA

SEQ ID NO: 408368 - protein, 12 aa, Mycobacterium
AAAAKSIDEAVG

SEQ ID NO: 408369 - protein, 5 aa, Mycobacterium
AAAAL

SEQ ID NO: 408370 - protein, 6 aa, Mycobacterium
AAAALE

SEQ ID NO: 408371 - protein, 10 aa, Mycobacterium
AAAALGDDGE

SEQ ID NO: 408372 - protein, 13 aa, Mycobacterium
AAAANAAAGAEQI

SEQ ID NO: 408373 - protein, 19 aa, Mycobacterium
AAAANAAGYTESANQIAQQ

SEQ ID NO: 408374 - protein, 7 aa, Mycobacterium
AAAANGL

SEQ ID NO: 408375 - protein, 10 aa, Mycobacterium
AAAANGRGDL

SEQ ID NO: 408376 - protein, 11 aa, Mycobacterium
AAAANRNTDDI

SEQ ID NO: 408377 - protein, 5 aa, Mycobacterium
AAAAP

SEQ ID NO: 408378 - protein, 13 aa, Mycobacterium
AAAAPADTVTRAR

SEQ ID NO: 408379 - protein, 63 aa, Mycobacterium
AAAAPAGADRPRRERPSGTRPRRSGASGTTATSTDAGRAATEEAPATDAAATAPAAGQPETTE

SEQ ID NO: 408380 - protein, 64 aa, Mycobacterium
AAAAPAGADRPRRERPSGTRPRRSGASGTTATSTEAGRAAAGAEESAAPPAAEAAPAAEPQSTE

SEQ ID NO: 408381 - protein, 11 aa, Mycobacterium
AAAAPARRLRP

SEQ ID NO: 408382 - protein, 12 aa, Mycobacterium
AAAAPARTELPR

SEQ ID NO: 408383 - protein, 10 aa, Mycobacterium
AAAAPATTPV

SEQ ID NO: 408384 - protein, 17 aa, Mycobacterium
AAAAPEAAAAAAGAAGL

SEQ ID NO: 408385 - protein, 10 aa, Mycobacterium
AAAAPEEREA

SEQ ID NO: 408386 - protein, 9 aa, Mycobacterium
AAAAPGAGV

SEQ ID NO: 408387 - protein, 17 aa, Mycobacterium
AAAAPGPPPRPPDRDYP

SEQ ID NO: 408388 - protein, 6 aa, Mycobacterium
AAAAPL

SEQ ID NO: 408389 - protein, 8 aa, Mycobacterium
AAAAPNDP

SEQ ID NO: 408390 - protein, 6 aa, Mycobacterium
AAAAPR

SEQ ID NO: 408391 - protein, 11 aa, Mycobacterium
AAAAPRAARPI

SEQ ID NO: 408392 - protein, 8 aa, Mycobacterium
AAAAPRNG

SEQ ID NO: 408393 - protein, 16 aa, Mycobacterium
AAAAPSAAAAAESTAV

SEQ ID NO: 408394 - protein, 16 aa, Mycobacterium
AAAAPSPVARSTPTGA

SEQ ID NO: 408395 - protein, 7 aa, Mycobacterium
AAAAPTE

SEQ ID NO: 408396 - protein, 9 aa, Mycobacterium
AAAAPTSPF

SEQ ID NO: 408397 - protein, 8 aa, Mycobacterium
AAAAPTTG

SEQ ID NO: 408398 - protein, 11 aa, Mycobacterium
AAAAPVAAASP

SEQ ID NO: 408399 - protein, 7 aa, Mycobacterium
AAAAQAA

SEQ ID NO: 408400 - protein, 49 aa, Mycobacterium
AAAAQAAAQQNPAAQQPQQQEGEQPQPPEPVARRSAQGSAMQQLRTITG

SEQ ID NO: 408401 - protein, 8 aa, Mycobacterium
AAAAQAAG

SEQ ID NO: 408402 - protein, 26 aa, Mycobacterium
AAAAQAASKDKGPKHTPANPKVRGRR

SEQ ID NO: 408403 - protein, 36 aa, Mycobacterium
AAAAQAQAQEQQQSNPPAARRGAGGSAMQQLRSSTS

SEQ ID NO: 408404 - protein, 8 aa, Mycobacterium
AAAAQEAG

SEQ ID NO: 408405 - protein, 24 aa, Mycobacterium
AAAAQEGGAGPKTAAAREEAPSRL

SEQ ID NO: 408406 - protein, 7 aa, Mycobacterium
AAAAQLG

SEQ ID NO: 408407 - protein, 45 aa, Mycobacterium
AAAAQQAAQLADAQQSEDQQAPADQPAARRSADGSAMQQLRTTTG

SEQ ID NO: 408408 - protein, 39 aa, Mycobacterium
AAAAQQAQQHDEAQQGANEPAARRSADGSAMQQLRTTTG

SEQ ID NO: 408409 - protein, 13 aa, Mycobacterium
AAAAQQYRTPDPH

SEQ ID NO: 408410 - protein, 22 aa, Mycobacterium
AAAAQRAREVATAGQAATPEFP

SEQ ID NO: 408411 - protein, 14 aa, Mycobacterium
AAAAQRDGKLGGES

SEQ ID NO: 408412 - protein, 13 aa, Mycobacterium
AAAAQSAAWAQTS

SEQ ID NO: 408413 - protein, 13 aa, Mycobacterium
AAAAQSASLGRLS

SEQ ID NO: 408414 - protein, 8 aa, Mycobacterium
AAAAQSEQ

SEQ ID NO: 408415 - protein, 9 aa, Mycobacterium
AAAAQVEDR

SEQ ID NO: 408416 - protein, 7 aa, Mycobacterium
AAAARAR

SEQ ID NO: 408417 - protein, 8 aa, Mycobacterium
AAAARDAG

SEQ ID NO: 408418 - protein, 12 aa, Mycobacterium
AAAARDQPGDRR

SEQ ID NO: 408419 - protein, 22 aa, Mycobacterium
AAAAREEARRRRRKRKTERGYG

SEQ ID NO: 408420 - protein, 16 aa, Mycobacterium
AAAARGDGKPGVTPVG

SEQ ID NO: 408421 - protein, 13 aa, Mycobacterium
AAAARGDVKPVGG

SEQ ID NO: 408422 - protein, 17 aa, Mycobacterium
AAAARGQQVDDAADAAL

SEQ ID NO: 408423 - protein, 10 aa, Mycobacterium
AAAARNAPLD

SEQ ID NO: 408424 - protein, 6 aa, Mycobacterium
AAAARP

SEQ ID NO: 408425 - protein, 11 aa, Mycobacterium
AAAARRARAEL

SEQ ID NO: 408426 - protein, 7 aa, Mycobacterium
AAAARRE

SEQ ID NO: 408427 - protein, 12 aa, Mycobacterium
AAAARSAAESAL

SEQ ID NO: 408428 - protein, 25 aa, Mycobacterium
AAAARSAISGTSDAAAASARAESAA

SEQ ID NO: 408429 - protein, 7 aa, Mycobacterium
AAAARYA

SEQ ID NO: 408430 - protein, 5 aa, Mycobacterium
AAAAS

SEQ ID NO: 408431 - protein, 10 aa, Mycobacterium
AAAASAASAA

SEQ ID NO: 408432 - protein, 12 aa, Mycobacterium
AAAASATEHAKT

SEQ ID NO: 408433 - protein, 21 aa, Mycobacterium
AAAASATVQRLGGRPDLTALK

SEQ ID NO: 408434 - protein, 27 aa, Mycobacterium
AAAASDLATIGSTIGAATAAAATPTTN

SEQ ID NO: 408435 - protein, 14 aa, Mycobacterium
AAAASGPAGEDGLG

SEQ ID NO: 408436 - protein, 10 aa, Mycobacterium
AAAASGRVSA

SEQ ID NO: 408437 - protein, 12 aa, Mycobacterium
AAAASGSSGVFG

SEQ ID NO: 408438 - protein, 14 aa, Mycobacterium
AAAASGVAGEDGLG

SEQ ID NO: 408439 - protein, 7 aa, Mycobacterium
AAAASHG

SEQ ID NO: 408440 - protein, 16 aa, Mycobacterium
AAAASLASAAPASAAV

SEQ ID NO: 408441 - protein, 10 aa, Mycobacterium
AAAASPGAEE

SEQ ID NO: 408442 - protein, 9 aa, Mycobacterium
AAAASPTTA

SEQ ID NO: 408443 - protein, 7 aa, Mycobacterium
AAAASRQ

SEQ ID NO: 408444 - protein, 9 aa, Mycobacterium
AAAASRRTT

SEQ ID NO: 408445 - protein, 7 aa, Mycobacterium
AAAASWA

SEQ ID NO: 408446 - protein, 6 aa, Mycobacterium
AAAASY

SEQ ID NO: 408447 - protein, 25 aa, Mycobacterium
AAAASYANQEATAAGEMAAVTQVRV

SEQ ID NO: 408448 - protein, 7 aa, Mycobacterium
AAAASYR

SEQ ID NO: 408449 - protein, 6 aa, Mycobacterium
AAAATA

SEQ ID NO: 408450 - protein, 30 aa, Mycobacterium
AAAATASAAEPGEARRRARHQPGAAGRHHQ

SEQ ID NO: 408451 - protein, 8 aa, Mycobacterium
AAAATDNV

SEQ ID NO: 408452 - protein, 19 aa, Mycobacterium
AAAATDVDDPDIMGAAWRR

SEQ ID NO: 408453 - protein, 9 aa, Mycobacterium
AAAATGDAG

SEQ ID NO: 408454 - protein, 9 aa, Mycobacterium
AAAATGDYA

SEQ ID NO: 408455 - protein, 9 aa, Mycobacterium
AAAATGTHD

SEQ ID NO: 408456 - protein, 6 aa, Mycobacterium
AAAATK

SEQ ID NO: 408457 - protein, 17 aa, Mycobacterium
AAAATNASAGLEVHRMA

SEQ ID NO: 408458 - protein, 11 aa, Mycobacterium
AAAATPTTGAL

SEQ ID NO: 408459 - protein, 6 aa, Mycobacterium
AAAATR

SEQ ID NO: 408460 - protein, 9 aa, Mycobacterium
AAAATRRAF

SEQ ID NO: 408461 - protein, 12 aa, Mycobacterium
AAAATSDAYDDA

SEQ ID NO: 408462 - protein, 6 aa, Mycobacterium
AAAATV

SEQ ID NO: 408463 - protein, 12 aa, Mycobacterium
AAAAVASYDALS

SEQ ID NO: 408464 - protein, 8 aa, Mycobacterium
AAAAVGAS

SEQ ID NO: 408465 - protein, 5 aa, Mycobacterium
AAAAY

SEQ ID NO: 408466 - protein, 6 aa, Mycobacterium
AAAAYS

SEQ ID NO: 408467 - protein, 18 aa, Mycobacterium
AAADAADLTDHLARYLAT

SEQ ID NO: 408468 - protein, 10 aa, Mycobacterium
AAADAADPGR

SEQ ID NO: 408469 - protein, 24 aa, Mycobacterium
AAADAAPLKQGGKSSDKSAVPQPS

SEQ ID NO: 408470 - protein, 6 aa, Mycobacterium
AAADAD

SEQ ID NO: 408471 - protein, 8 aa, Mycobacterium
AAADADTL

SEQ ID NO: 408472 - protein, 8 aa, Mycobacterium
AAADAGAE

SEQ ID NO: 408473 - protein, 11 aa, Mycobacterium
AAADAGAEGVS

SEQ ID NO: 408474 - protein, 7 aa, Mycobacterium
AAADAGR

SEQ ID NO: 408475 - protein, 11 aa, Mycobacterium
AAADAGREDEV

SEQ ID NO: 408476 - protein, 12 aa, Mycobacterium
AAADAGRPDGSV

SEQ ID NO: 408477 - protein, 9 aa, Mycobacterium
AAADAGVEG

SEQ ID NO: 408478 - protein, 10 aa, Mycobacterium
AAADAHDALS

SEQ ID NO: 408479 - protein, 9 aa, Mycobacterium
AAADAPKPP

SEQ ID NO: 408480 - protein, 7 aa, Mycobacterium
AAADASA

SEQ ID NO: 408481 - protein, 5 aa, Mycobacterium
AAADD

SEQ ID NO: 408482 - protein, 7 aa, Mycobacterium
AAADDAA

SEQ ID NO: 408483 - protein, 11 aa, Mycobacterium
AAADDANRDPY

SEQ ID NO: 408484 - protein, 6 aa, Mycobacterium
AAADDD

SEQ ID NO: 408485 - protein, 9 aa, Mycobacterium
AAADDDAVA

SEQ ID NO: 408486 - protein, 8 aa, Mycobacterium
AAADDIER

SEQ ID NO: 408487 - protein, 12 aa, Mycobacterium
AAADDLSKDRHT

SEQ ID NO: 408488 - protein, 12 aa, Mycobacterium
AAADDPTKDRHT

SEQ ID NO: 408489 - protein, 5 aa, Mycobacterium
AAADE

SEQ ID NO: 408490 - protein, 6 aa, Mycobacterium
AAADEA

SEQ ID NO: 408491 - protein, 7 aa, Mycobacterium
AAADEAG

SEQ ID NO: 408492 - protein, 10 aa, Mycobacterium
AAADEAREAL

SEQ ID NO: 408493 - protein, 7 aa, Mycobacterium
AAADEIS

SEQ ID NO: 408494 - protein, 7 aa, Mycobacterium
AAADEQL

SEQ ID NO: 408495 - protein, 7 aa, Mycobacterium
AAADERH

SEQ ID NO: 408496 - protein, 8 aa, Mycobacterium
AAADEVER

SEQ ID NO: 408497 - protein, 9 aa, Mycobacterium
AAADEVSAA

SEQ ID NO: 408498 - protein, 8 aa, Mycobacterium
AAADEVSG

SEQ ID NO: 408499 - protein, 5 aa, Mycobacterium
AAADG

SEQ ID NO: 408500 - protein, 8 aa, Mycobacterium
AAADGAGI

SEQ ID NO: 408501 - protein, 8 aa, Mycobacterium
AAADGDGV

SEQ ID NO: 408502 - protein, 8 aa, Mycobacterium
AAADGHAK

SEQ ID NO: 408503 - protein, 17 aa, Mycobacterium
AAADGHTVTTAEEPKDV

SEQ ID NO: 408504 - protein, 7 aa, Mycobacterium
AAADGKL

SEQ ID NO: 408505 - protein, 7 aa, Mycobacterium
AAADGPL

SEQ ID NO: 408506 - protein, 12 aa, Mycobacterium
AAADGSGPPVGA

SEQ ID NO: 408507 - protein, 5 aa, Mycobacterium
AAADH

SEQ ID NO: 408508 - protein, 16 aa, Mycobacterium
AAADHAADAGASGAAG

SEQ ID NO: 408509 - protein, 9 aa, Mycobacterium
AAADIDDPR

SEQ ID NO: 408510 - protein, 5 aa, Mycobacterium
AAADP

SEQ ID NO: 408511 - protein, 6 aa, Mycobacterium
AAADPA

SEQ ID NO: 408512 - protein, 8 aa, Mycobacterium
AAADPAGF

SEQ ID NO: 408513 - protein, 7 aa, Mycobacterium
AAADPAH

SEQ ID NO: 408514 - protein, 12 aa, Mycobacterium
AAADPDDFSDDT

SEQ ID NO: 408515 - protein, 12 aa, Mycobacterium
AAADPDDYADEA

SEQ ID NO: 408516 - protein, 7 aa, Mycobacterium
AAADPDG

SEQ ID NO: 408517 - protein, 7 aa, Mycobacterium
AAADPEA

SEQ ID NO: 408518 - protein, 20 aa, Mycobacterium
AAADPELARRYGGGSRWNAG

SEQ ID NO: 408519 - protein, 6 aa, Mycobacterium
AAADPF

SEQ ID NO: 408520 - protein, 6 aa, Mycobacterium
AAADPG

SEQ ID NO: 408521 - protein, 7 aa, Mycobacterium
AAADPGR

SEQ ID NO: 408522 - protein, 8 aa, Mycobacterium
AAADPQEN

SEQ ID NO: 408523 - protein, 6 aa, Mycobacterium
AAADPR

SEQ ID NO: 408524 - protein, 18 aa, Mycobacterium
AAADPRAAAASLRGSTRR

SEQ ID NO: 408525 - protein, 19 aa, Mycobacterium
AAADPRAAARRLRSALAAA

SEQ ID NO: 408526 - protein, 7 aa, Mycobacterium
AAADPRV

SEQ ID NO: 408527 - protein, 6 aa, Mycobacterium
AAADPW

SEQ ID NO: 408528 - protein, 7 aa, Mycobacterium
AAADQGT

SEQ ID NO: 408529 - protein, 6 aa, Mycobacterium
AAADQH

SEQ ID NO: 408530 - protein, 5 aa, Mycobacterium
AAADR

SEQ ID NO: 408531 - protein, 13 aa, Mycobacterium
AAADRAAKGRSPV

SEQ ID NO: 408532 - protein, 22 aa, Mycobacterium
AAADRGDSAAVATDLDRPRADL

SEQ ID NO: 408533 - protein, 8 aa, Mycobacterium
AAADRGGD

SEQ ID NO: 408534 - protein, 8 aa, Mycobacterium
AAADRRNE

SEQ ID NO: 408535 - protein, 10 aa, Mycobacterium
AAADRRSRAT

SEQ ID NO: 408536 - protein, 6 aa, Mycobacterium
AAADSK

SEQ ID NO: 408537 - protein, 11 aa, Mycobacterium
AAADSPARDRM

SEQ ID NO: 408538 - protein, 10 aa, Mycobacterium
AAADSRYERN

SEQ ID NO: 408539 - protein, 8 aa, Mycobacterium
AAADSTDE

SEQ ID NO: 408540 - protein, 7 aa, Mycobacterium
AAADSYP

SEQ ID NO: 408541 - protein, 5 aa, Mycobacterium
AAADT

SEQ ID NO: 408542 - protein, 6 aa, Mycobacterium
AAADTD

SEQ ID NO: 408543 - protein, 7 aa, Mycobacterium
AAADTGM

SEQ ID NO: 408544 - protein, 6 aa, Mycobacterium
AAADTR

SEQ ID NO: 408545 - protein, 13 aa, Mycobacterium
AAADTSDFPGDPW

SEQ ID NO: 408546 - protein, 8 aa, Mycobacterium
AAADVPAK

SEQ ID NO: 408547 - protein, 16 aa, Mycobacterium
AAAEAAAAGALGSAGM

SEQ ID NO: 408548 - protein, 14 aa, Mycobacterium
AAAEAAADSTITPR

SEQ ID NO: 408549 - protein, 13 aa, Mycobacterium
AAAEAAAERAPGV

SEQ ID NO: 408550 - protein, 11 aa, Mycobacterium
AAAEAAAERVP

SEQ ID NO: 408551 - protein, 16 aa, Mycobacterium
AAAEAELSTRPAEQQR

SEQ ID NO: 408552 - protein, 11 aa, Mycobacterium
AAAEAESDTAE

SEQ ID NO: 408553 - protein, 6 aa, Mycobacterium
AAAEAG

SEQ ID NO: 408554 - protein, 7 aa, Mycobacterium
AAAEAGA

SEQ ID NO: 408555 - protein, 8 aa, Mycobacterium
AAAEAGRE

SEQ ID NO: 408556 - protein, 8 aa, Mycobacterium
AAAEAGTV

SEQ ID NO: 408557 - protein, 9 aa, Mycobacterium
AAAEAKRQN

SEQ ID NO: 408558 - protein, 12 aa, Mycobacterium
AAAEASARSVDQ

SEQ ID NO: 408559 - protein, 9 aa, Mycobacterium
AAAEASGGA

SEQ ID NO: 408560 - protein, 11 aa, Mycobacterium
AAAEASTRAVD

SEQ ID NO: 408561 - protein, 11 aa, Mycobacterium
AAAEATNAGQA

SEQ ID NO: 408562 - protein, 10 aa, Mycobacterium
AAAEATQRAI

SEQ ID NO: 408563 - protein, 5 aa, Mycobacterium
AAAED

SEQ ID NO: 408564 - protein, 6 aa, Mycobacterium
AAAEDG

SEQ ID NO: 408565 - protein, 10 aa, Mycobacterium
AAAEDPRDLD

SEQ ID NO: 408566 - protein, 12 aa, Mycobacterium
AAAEDSRFRRRG

SEQ ID NO: 408567 - protein, 8 aa, Mycobacterium
AAAEEERA

SEQ ID NO: 408568 - protein, 7 aa, Mycobacterium
AAAEEGL

SEQ ID NO: 408569 - protein, 6 aa, Mycobacterium
AAAEEL

SEQ ID NO: 408570 - protein, 6 aa, Mycobacterium
AAAEEN

SEQ ID NO: 408571 - protein, 6 aa, Mycobacterium
AAAEES

SEQ ID NO: 408572 - protein, 6 aa, Mycobacterium
AAAEGE

SEQ ID NO: 408573 - protein, 7 aa, Mycobacterium
AAAEGEG

SEQ ID NO: 408574 - protein, 8 aa, Mycobacterium
AAAEGGDA

SEQ ID NO: 408575 - protein, 6 aa, Mycobacterium
AAAEGK

SEQ ID NO: 408576 - protein, 7 aa, Mycobacterium
AAAEGKL

SEQ ID NO: 408577 - protein, 13 aa, Mycobacterium
AAAEGLDDAYEAP

SEQ ID NO: 408578 - protein, 7 aa, Mycobacterium
AAAEGPL

SEQ ID NO: 408579 - protein, 7 aa, Mycobacterium
AAAEGPM

SEQ ID NO: 408580 - protein, 6 aa, Mycobacterium
AAAEGR

SEQ ID NO: 408581 - protein, 7 aa, Mycobacterium
AAAEGRL

SEQ ID NO: 408582 - protein, 8 aa, Mycobacterium
AAAEGVPC

SEQ ID NO: 408583 - protein, 7 aa, Mycobacterium
AAAEGYA

SEQ ID NO: 408584 - protein, 8 aa, Mycobacterium
AAAEHERE

SEQ ID NO: 408585 - protein, 15 aa, Mycobacterium
AAAEIARRSRGTPRI

SEQ ID NO: 408586 - protein, 11 aa, Mycobacterium
AAAELDNDPGI

SEQ ID NO: 408587 - protein, 6 aa, Mycobacterium
AAAELG

SEQ ID NO: 408588 - protein, 10 aa, Mycobacterium
AAAELGTPAD

SEQ ID NO: 408589 - protein, 11 aa, Mycobacterium
AAAELGTPADL

SEQ ID NO: 408590 - protein, 14 aa, Mycobacterium
AAAELQDSNAVTPE

SEQ ID NO: 408591 - protein, 8 aa, Mycobacterium
AAAELSVT

SEQ ID NO: 408592 - protein, 24 aa, Mycobacterium
AAAENATKITAREPAVAGDRPELT

SEQ ID NO: 408593 - protein, 8 aa, Mycobacterium
AAAENRLG

SEQ ID NO: 408594 - protein, 7 aa, Mycobacterium
AAAEPAK

SEQ ID NO: 408595 - protein, 7 aa, Mycobacterium
AAAEPGE

SEQ ID NO: 408596 - protein, 7 aa, Mycobacterium
AAAEPRS

SEQ ID NO: 408597 - protein, 16 aa, Mycobacterium
AAAEPSESMPRRDPEE

SEQ ID NO: 408598 - protein, 12 aa, Mycobacterium
AAAEPVSRTLIM

SEQ ID NO: 408599 - protein, 6 aa, Mycobacterium
AAAEPY

SEQ ID NO: 408600 - protein, 12 aa, Mycobacterium
AAAEQAAGKARL

SEQ ID NO: 408601 - protein, 8 aa, Mycobacterium
AAAEQLRE

SEQ ID NO: 408602 - protein, 7 aa, Mycobacterium
AAAEQQD

SEQ ID NO: 408603 - protein, 7 aa, Mycobacterium
AAAEQRP

SEQ ID NO: 408604 - protein, 8 aa, Mycobacterium
AAAEQTGA

SEQ ID NO: 408605 - protein, 8 aa, Mycobacterium
AAAERGAG

SEQ ID NO: 408606 - protein, 8 aa, Mycobacterium
AAAERGDQ

SEQ ID NO: 408607 - protein, 13 aa, Mycobacterium
AAAERLRDQVAYL

SEQ ID NO: 408608 - protein, 18 aa, Mycobacterium
AAAERSSGFNPRAGWAGN

SEQ ID NO: 408609 - protein, 9 aa, Mycobacterium
AAAESAGAD

SEQ ID NO: 408610 - protein, 9 aa, Mycobacterium
AAAESAGAE

SEQ ID NO: 408611 - protein, 20 aa, Mycobacterium
AAAESAISAETEAAASAASP

SEQ ID NO: 408612 - protein, 8 aa, Mycobacterium
AAAESARA

SEQ ID NO: 408613 - protein, 8 aa, Mycobacterium
AAAESGIA

SEQ ID NO: 408614 - protein, 6 aa, Mycobacterium
AAAESQ

SEQ ID NO: 408615 - protein, 9 aa, Mycobacterium
AAAESRDPR

SEQ ID NO: 408616 - protein, 13 aa, Mycobacterium
AAAESRGDGKAHI

SEQ ID NO: 408617 - protein, 7 aa, Mycobacterium
AAAESRR

SEQ ID NO: 408618 - protein, 6 aa, Mycobacterium
AAAETA

SEQ ID NO: 408619 - protein, 9 aa, Mycobacterium
AAAETGATE

SEQ ID NO: 408620 - protein, 12 aa, Mycobacterium
AAAETLIDQALA

SEQ ID NO: 408621 - protein, 63 aa, Mycobacterium
AAAETPDTAMPPRGQADTAAPPRATPARPADSAAPPRGQADTARRPAALEPAPEPAAAPSELN

SEQ ID NO: 408622 - protein, 8 aa, Mycobacterium
AAAETQPE

SEQ ID NO: 408623 - protein, 15 aa, Mycobacterium
AAAETSARDEFSTGD

SEQ ID NO: 408624 - protein, 8 aa, Mycobacterium
AAAETTGV

SEQ ID NO: 408625 - protein, 11 aa, Mycobacterium
AAAETVPQPGL

SEQ ID NO: 408626 - protein, 6 aa, Mycobacterium
AAAEYG

SEQ ID NO: 408627 - protein, 10 aa, Mycobacterium
AAAFGEDPAT

SEQ ID NO: 408628 - protein, 13 aa, Mycobacterium
AAAFGGRAGPLSC

SEQ ID NO: 408629 - protein, 16 aa, Mycobacterium
AAAFGGRAGPLSCPTD

SEQ ID NO: 408630 - protein, 14 aa, Mycobacterium
AAAGAAGHEATGAV

SEQ ID NO: 408631 - protein, 15 aa, Mycobacterium
AAAGAASGQPAGPVN

SEQ ID NO: 408632 - protein, 7 aa, Mycobacterium
AAAGAAT

SEQ ID NO: 408633 - protein, 8 aa, Mycobacterium
AAAGAAYG

SEQ ID NO: 408634 - protein, 8 aa, Mycobacterium
AAAGADAG

SEQ ID NO: 408635 - protein, 14 aa, Mycobacterium
AAAGADGIELVEEN

SEQ ID NO: 408636 - protein, 11 aa, Mycobacterium
AAAGADHPQLP

SEQ ID NO: 408637 - protein, 9 aa, Mycobacterium
AAAGADPLV

SEQ ID NO: 408638 - protein, 12 aa, Mycobacterium
AAAGAEIRSPAR

SEQ ID NO: 408639 - protein, 15 aa, Mycobacterium
AAAGAENPGKGRYSD

SEQ ID NO: 408640 - protein, 6 aa, Mycobacterium
AAAGAG

SEQ ID NO: 408641 - protein, 13 aa, Mycobacterium
AAAGAGPLRGNAR

SEQ ID NO: 408642 - protein, 16 aa, Mycobacterium
AAAGALKGPLHGGANE

SEQ ID NO: 408643 - protein, 14 aa, Mycobacterium
AAAGALPGLTQPAA

SEQ ID NO: 408644 - protein, 12 aa, Mycobacterium
AAAGANAGWAGT

SEQ ID NO: 408645 - protein, 7 aa, Mycobacterium
AAAGAPV

SEQ ID NO: 408646 - protein, 8 aa, Mycobacterium
AAAGAQIA

SEQ ID NO: 408647 - protein, 6 aa, Mycobacterium
AAAGAR

SEQ ID NO: 408648 - protein, 10 aa, Mycobacterium
AAAGARAAEV

SEQ ID NO: 408649 - protein, 16 aa, Mycobacterium
AAAGARADEQIRNGAP

SEQ ID NO: 408650 - protein, 10 aa, Mycobacterium
AAAGARAERP

SEQ ID NO: 408651 - protein, 8 aa, Mycobacterium
AAAGATSQ

SEQ ID NO: 408652 - protein, 6 aa, Mycobacterium
AAAGAV

SEQ ID NO: 408653 - protein, 7 aa, Mycobacterium
AAAGAVD

SEQ ID NO: 408654 - protein, 5 aa, Mycobacterium
AAAGD

SEQ ID NO: 408655 - protein, 10 aa, Mycobacterium
AAAGDDEAMS

SEQ ID NO: 408656 - protein, 9 aa, Mycobacterium
AAAGDDGGQ

SEQ ID NO: 408657 - protein, 7 aa, Mycobacterium
AAAGDDY

SEQ ID NO: 408658 - protein, 8 aa, Mycobacterium
AAAGDEVS

SEQ ID NO: 408659 - protein, 9 aa, Mycobacterium
AAAGDGGRA

SEQ ID NO: 408660 - protein, 6 aa, Mycobacterium
AAAGDL

SEQ ID NO: 408661 - protein, 8 aa, Mycobacterium
AAAGDRPE

SEQ ID NO: 408662 - protein, 7 aa, Mycobacterium
AAAGDTS

SEQ ID NO: 408663 - protein, 19 aa, Mycobacterium
AAAGDTSAAQAHATRAAQI

SEQ ID NO: 408664 - protein, 13 aa, Mycobacterium
AAAGDTTAAQSHA

SEQ ID NO: 408665 - protein, 11 aa, Mycobacterium
AAAGEADPLNG

SEQ ID NO: 408666 - protein, 7 aa, Mycobacterium
AAAGEAS

SEQ ID NO: 408667 - protein, 6 aa, Mycobacterium
AAAGED

SEQ ID NO: 408668 - protein, 7 aa, Mycobacterium
AAAGEDI

SEQ ID NO: 408669 - protein, 18 aa, Mycobacterium
AAAGEDPDFGRGRSAYDR

SEQ ID NO: 408670 - protein, 9 aa, Mycobacterium
AAAGEELGH

SEQ ID NO: 408671 - protein, 12 aa, Mycobacterium
AAAGEFGKAGTH

SEQ ID NO: 408672 - protein, 6 aa, Mycobacterium
AAAGEG

SEQ ID NO: 408673 - protein, 7 aa, Mycobacterium
AAAGEGN

SEQ ID NO: 408674 - protein, 20 aa, Mycobacterium
AAAGEIPTAASREIERGNAD

SEQ ID NO: 408675 - protein, 7 aa, Mycobacterium
AAAGENL

SEQ ID NO: 408676 - protein, 9 aa, Mycobacterium
AAAGETIGQ

SEQ ID NO: 408677 - protein, 10 aa, Mycobacterium
AAAGETSRAQ

SEQ ID NO: 408678 - protein, 28 aa, Mycobacterium
AAAGEYRDVPTASARMGGRTKNAFTPIP

SEQ ID NO: 408679 - protein, 6 aa, Mycobacterium
AAAGGA

SEQ ID NO: 408680 - protein, 26 aa, Mycobacterium
AAAGGAGSLGGLGAKGTWVPAVDTGV

SEQ ID NO: 408681 - protein, 18 aa, Mycobacterium
AAAGGDLEAGEVSRPPGD

SEQ ID NO: 408682 - protein, 17 aa, Mycobacterium
AAAGGEPAGLGARDTLR

SEQ ID NO: 408683 - protein, 14 aa, Mycobacterium
AAAGGGGTPQETKV

SEQ ID NO: 408684 - protein, 10 aa, Mycobacterium
AAAGGGPAAQ

SEQ ID NO: 408685 - protein, 7 aa, Mycobacterium
AAAGGGT

SEQ ID NO: 408686 - protein, 11 aa, Mycobacterium
AAAGGGVGEDE

SEQ ID NO: 408687 - protein, 8 aa, Mycobacterium
AAAGGHAK

SEQ ID NO: 408688 - protein, 6 aa, Mycobacterium
AAAGGI

SEQ ID NO: 408689 - protein, 14 aa, Mycobacterium
AAAGGNFSSAAERN

SEQ ID NO: 408690 - protein, 16 aa, Mycobacterium
AAAGGPMSLHQLCVIR

SEQ ID NO: 408691 - protein, 10 aa, Mycobacterium
AAAGGQVPPE

SEQ ID NO: 408692 - protein, 7 aa, Mycobacterium
AAAGGRG

SEQ ID NO: 408693 - protein, 8 aa, Mycobacterium
AAAGGRPI

SEQ ID NO: 408694 - protein, 14 aa, Mycobacterium
AAAGGSSSADAQGA

SEQ ID NO: 408695 - protein, 9 aa, Mycobacterium
AAAGGTDDD

SEQ ID NO: 408696 - protein, 8 aa, Mycobacterium
AAAGGTDR

SEQ ID NO: 408697 - protein, 10 aa, Mycobacterium
AAAGGTSAMA

SEQ ID NO: 408698 - protein, 10 aa, Mycobacterium
AAAGGTTSMA

SEQ ID NO: 408699 - protein, 8 aa, Mycobacterium
AAAGGVPI

SEQ ID NO: 408700 - protein, 26 aa, Mycobacterium
AAAGHDVSTRPRSQHKSGERTSILVE

SEQ ID NO: 408701 - protein, 8 aa, Mycobacterium
AAAGHSPF

SEQ ID NO: 408702 - protein, 15 aa, Mycobacterium
AAAGIAGTQKDSLAR

SEQ ID NO: 408703 - protein, 9 aa, Mycobacterium
AAAGIESET

SEQ ID NO: 408704 - protein, 12 aa, Mycobacterium
AAAGISTSPGGV

SEQ ID NO: 408705 - protein, 5 aa, Mycobacterium
AAAGK

SEQ ID NO: 408706 - protein, 6 aa, Mycobacterium
AAAGKP

SEQ ID NO: 408707 - protein, 10 aa, Mycobacterium
AAAGKSLSHS

SEQ ID NO: 408708 - protein, 17 aa, Mycobacterium
AAAGKTNEEIAAEREVS

SEQ ID NO: 408709 - protein, 17 aa, Mycobacterium
AAAGKYASAEVANASPL

SEQ ID NO: 408710 - protein, 5 aa, Mycobacterium
AAAGL

SEQ ID NO: 408711 - protein, 7 aa, Mycobacterium
AAAGLDP

SEQ ID NO: 408712 - protein, 6 aa, Mycobacterium
AAAGLE

SEQ ID NO: 408713 - protein, 8 aa, Mycobacterium
AAAGLGRA

SEQ ID NO: 408714 - protein, 6 aa, Mycobacterium
AAAGLP

SEQ ID NO: 408715 - protein, 8 aa, Mycobacterium
AAAGLQEE

SEQ ID NO: 408716 - protein, 23 aa, Mycobacterium
AAAGMTAPAARREKTRAPHDPDL

SEQ ID NO: 408717 - protein, 10 aa, Mycobacterium
AAAGNSGVQN

SEQ ID NO: 408718 - protein, 13 aa, Mycobacterium
AAAGNSRRGTPPM

SEQ ID NO: 408719 - protein, 11 aa, Mycobacterium
AAAGPASDDIP

SEQ ID NO: 408720 - protein, 9 aa, Mycobacterium
AAAGPASRH

SEQ ID NO: 408721 - protein, 11 aa, Mycobacterium
AAAGPASTGDA

SEQ ID NO: 408722 - protein, 8 aa, Mycobacterium
AAAGPEAL

SEQ ID NO: 408723 - protein, 7 aa, Mycobacterium
AAAGPEG

SEQ ID NO: 408724 - protein, 11 aa, Mycobacterium
AAAGPESAADP

SEQ ID NO: 408725 - protein, 12 aa, Mycobacterium
AAAGPFRAGRGQ

SEQ ID NO: 408726 - protein, 7 aa, Mycobacterium
AAAGPGT

SEQ ID NO: 408727 - protein, 7 aa, Mycobacterium
AAAGPKL

SEQ ID NO: 408728 - protein, 7 aa, Mycobacterium
AAAGPQS

SEQ ID NO: 408729 - protein, 11 aa, Mycobacterium
AAAGPQVRSGS

SEQ ID NO: 408730 - protein, 8 aa, Mycobacterium
AAAGPRDV

SEQ ID NO: 408731 - protein, 7 aa, Mycobacterium
AAAGPRL

SEQ ID NO: 408732 - protein, 11 aa, Mycobacterium
AAAGPRSAGDP

SEQ ID NO: 408733 - protein, 11 aa, Mycobacterium
AAAGPSADKAV

SEQ ID NO: 408734 - protein, 10 aa, Mycobacterium
AAAGPSADRA

SEQ ID NO: 408735 - protein, 10 aa, Mycobacterium
AAAGPSGDRA

SEQ ID NO: 408736 - protein, 10 aa, Mycobacterium
AAAGPTPEFR

SEQ ID NO: 408737 - protein, 7 aa, Mycobacterium
AAAGPVS

SEQ ID NO: 408738 - protein, 5 aa, Mycobacterium
AAAGQ

SEQ ID NO: 408739 - protein, 7 aa, Mycobacterium
AAAGQAA

SEQ ID NO: 408740 - protein, 12 aa, Mycobacterium
AAAGQAFGSAYD

SEQ ID NO: 408741 - protein, 8 aa, Mycobacterium
AAAGQDHT

SEQ ID NO: 408742 - protein, 10 aa, Mycobacterium
AAAGQDSLRG

SEQ ID NO: 408743 - protein, 12 aa, Mycobacterium
AAAGQFGKAGTH

SEQ ID NO: 408744 - protein, 10 aa, Mycobacterium
AAAGQGLTGA

SEQ ID NO: 408745 - protein, 11 aa, Mycobacterium
AAAGQGLTGGG

SEQ ID NO: 408746 - protein, 10 aa, Mycobacterium
AAAGQGWTRD

SEQ ID NO: 408747 - protein, 9 aa, Mycobacterium
AAAGQLDGA

SEQ ID NO: 408748 - protein, 18 aa, Mycobacterium
AAAGQPGPDGRRPMDDDS

SEQ ID NO: 408749 - protein, 6 aa, Mycobacterium
AAAGQR

SEQ ID NO: 408750 - protein, 9 aa, Mycobacterium
AAAGQSGTL

SEQ ID NO: 408751 - protein, 21 aa, Mycobacterium
AAAGRAAVAPSVRQPAGQEVP

SEQ ID NO: 408752 - protein, 14 aa, Mycobacterium
AAAGRAGAPLPTRT

SEQ ID NO: 408753 - protein, 6 aa, Mycobacterium
AAAGRD

SEQ ID NO: 408754 - protein, 11 aa, Mycobacterium
AAAGRDGNDIE

SEQ ID NO: 408755 - protein, 13 aa, Mycobacterium
AAAGRDYPSHGDA

SEQ ID NO: 408756 - protein, 19 aa, Mycobacterium
AAAGRGQSVASGPDDIGPA

SEQ ID NO: 408757 - protein, 10 aa, Mycobacterium
AAAGRNPDSV

SEQ ID NO: 408758 - protein, 8 aa, Mycobacterium
AAAGRPAG

SEQ ID NO: 408759 - protein, 8 aa, Mycobacterium
AAAGRPTR

SEQ ID NO: 408760 - protein, 8 aa, Mycobacterium
AAAGRSRA

SEQ ID NO: 408761 - protein, 8 aa, Mycobacterium
AAAGRTRA

SEQ ID NO: 408762 - protein, 13 aa, Mycobacterium
AAAGSAPGQPGRD

SEQ ID NO: 408763 - protein, 19 aa, Mycobacterium
AAAGSAPGYPTTHGTTALR

SEQ ID NO: 408764 - protein, 19 aa, Mycobacterium
AAAGSASGYPATAGTPRLR

SEQ ID NO: 408765 - protein, 6 aa, Mycobacterium
AAAGSD

SEQ ID NO: 408766 - protein, 7 aa, Mycobacterium
AAAGSDG

SEQ ID NO: 408767 - protein, 16 aa, Mycobacterium
AAAGSDLKRLPTEDEV

SEQ ID NO: 408768 - protein, 6 aa, Mycobacterium
AAAGSG

SEQ ID NO: 408769 - protein, 14 aa, Mycobacterium
AAAGSGAGTENYPA

SEQ ID NO: 408770 - protein, 8 aa, Mycobacterium
AAAGSGDI

SEQ ID NO: 408771 - protein, 9 aa, Mycobacterium
AAAGSKGVA

SEQ ID NO: 408772 - protein, 10 aa, Mycobacterium
AAAGSKGVTV

SEQ ID NO: 408773 - protein, 6 aa, Mycobacterium
AAAGSS

SEQ ID NO: 408774 - protein, 36 aa, Mycobacterium
AAAGSSATSGAAPVGGTGLGRAAGAGESSRPGPAVS

SEQ ID NO: 408775 - protein, 16 aa, Mycobacterium
AAAGSSGGAAAFPGEP

SEQ ID NO: 408776 - protein, 10 aa, Mycobacterium
AAAGSSIPAH

SEQ ID NO: 408777 - protein, 9 aa, Mycobacterium
AAAGSTTSI

SEQ ID NO: 408778 - protein, 5 aa, Mycobacterium
AAAGT

SEQ ID NO: 408779 - protein, 6 aa, Mycobacterium
AAAGTA

SEQ ID NO: 408780 - protein, 12 aa, Mycobacterium
AAAGTARRGVPP

SEQ ID NO: 408781 - protein, 17 aa, Mycobacterium
AAAGTARSTLARRTSSV

SEQ ID NO: 408782 - protein, 7 aa, Mycobacterium
AAAGTDE

SEQ ID NO: 408783 - protein, 10 aa, Mycobacterium
AAAGTDEVSR

SEQ ID NO: 408784 - protein, 9 aa, Mycobacterium
AAAGTDTGT

SEQ ID NO: 408785 - protein, 11 aa, Mycobacterium
AAAGTDTGVGG

SEQ ID NO: 408786 - protein, 10 aa, Mycobacterium
AAAGTELGPT

SEQ ID NO: 408787 - protein, 7 aa, Mycobacterium
AAAGTGA

SEQ ID NO: 408788 - protein, 8 aa, Mycobacterium
AAAGTGAG

SEQ ID NO: 408789 - protein, 10 aa, Mycobacterium
AAAGTGPAVG

SEQ ID NO: 408790 - protein, 6 aa, Mycobacterium
AAAGTI

SEQ ID NO: 408791 - protein, 7 aa, Mycobacterium
AAAGTKQ

SEQ ID NO: 408792 - protein, 6 aa, Mycobacterium
AAAGTP

SEQ ID NO: 408793 - protein, 8 aa, Mycobacterium
AAAGTPLV

SEQ ID NO: 408794 - protein, 13 aa, Mycobacterium
AAAGTSAQTPDAR

SEQ ID NO: 408795 - protein, 7 aa, Mycobacterium
AAAGTSL

SEQ ID NO: 408796 - protein, 7 aa, Mycobacterium
AAAGTST

SEQ ID NO: 408797 - protein, 6 aa, Mycobacterium
AAAGVS

SEQ ID NO: 408798 - protein, 5 aa, Mycobacterium
AAAGW

SEQ ID NO: 408799 - protein, 24 aa, Mycobacterium
AAAGWPAQYADAANSSYTATGGAT

SEQ ID NO: 408800 - protein, 23 aa, Mycobacterium
AAAHASREFGRRGERGNELEAST

SEQ ID NO: 408801 - protein, 10 aa, Mycobacterium
AAAHDGARAR

SEQ ID NO: 408802 - protein, 21 aa, Mycobacterium
AAAHGARVQREPYEDHGTRNA

SEQ ID NO: 408803 - protein, 10 aa, Mycobacterium
AAAHGRDPGS

SEQ ID NO: 408804 - protein, 11 aa, Mycobacterium
AAAHPGAKARE

SEQ ID NO: 408805 - protein, 8 aa, Mycobacterium
AAAHPGQP

SEQ ID NO: 408806 - protein, 7 aa, Mycobacterium
AAAHPTR

SEQ ID NO: 408807 - protein, 6 aa, Mycobacterium
AAAHRA

SEQ ID NO: 408808 - protein, 7 aa, Mycobacterium
AAAHRGH

SEQ ID NO: 408809 - protein, 6 aa, Mycobacterium
AAAHSG

SEQ ID NO: 408810 - protein, 7 aa, Mycobacterium
AAAHSPD

SEQ ID NO: 408811 - protein, 16 aa, Mycobacterium
AAAHSSPLQAAYGQTI

SEQ ID NO: 408812 - protein, 6 aa, Mycobacterium
AAAIDG

SEQ ID NO: 408813 - protein, 12 aa, Mycobacterium
AAAIEAGAGTRA

SEQ ID NO: 408814 - protein, 7 aa, Mycobacterium
AAAIPAG

SEQ ID NO: 408815 - protein, 7 aa, Mycobacterium
AAAIPSV

SEQ ID NO: 408816 - protein, 4 aa, Mycobacterium
AAAK

SEQ ID NO: 408817 - protein, 11 aa, Mycobacterium
AAAKAAGKVRM

SEQ ID NO: 408818 - protein, 10 aa, Mycobacterium
AAAKAAPKPL

SEQ ID NO: 408819 - protein, 7 aa, Mycobacterium
AAAKANG

SEQ ID NO: 408820 - protein, 9 aa, Mycobacterium
AAAKAPEGA

SEQ ID NO: 408821 - protein, 9 aa, Mycobacterium
AAAKATDVD

SEQ ID NO: 408822 - protein, 10 aa, Mycobacterium
AAAKATNPEV

SEQ ID NO: 408823 - protein, 10 aa, Mycobacterium
AAAKDAGLTP

SEQ ID NO: 408824 - protein, 8 aa, Mycobacterium
AAAKDETI

SEQ ID NO: 408825 - protein, 11 aa, Mycobacterium
AAAKDPDVGRG

SEQ ID NO: 408826 - protein, 10 aa, Mycobacterium
AAAKEHAADG

SEQ ID NO: 408827 - protein, 9 aa, Mycobacterium
AAAKESEAR

SEQ ID NO: 408828 - protein, 11 aa, Mycobacterium
AAAKEYASSGI

SEQ ID NO: 408829 - protein, 6 aa, Mycobacterium
AAAKGA

SEQ ID NO: 408830 - protein, 12 aa, Mycobacterium
AAAKGEDATSLR

SEQ ID NO: 408831 - protein, 30 aa, Mycobacterium
AAAKGGESPTDTSELDKRSETFVQATRGIH

SEQ ID NO: 408832 - protein, 7 aa, Mycobacterium
AAAKGLT

SEQ ID NO: 408833 - protein, 5 aa, Mycobacterium
AAAKI

SEQ ID NO: 408834 - protein, 11 aa, Mycobacterium
AAAKIESHGGR

SEQ ID NO: 408835 - protein, 5 aa, Mycobacterium
AAAKK

SEQ ID NO: 408836 - protein, 110 aa, Mycobacterium
AAAKKAAKKAPAKKAATKTAAKKAATKAPAKKAATKAPAKKAATKAPAKKAVTKVTKAPAKKVTKATVKKTAAKAPVRKAATKAPAKKAAAKRPATKAPAKKATSTRRGR

SEQ ID NO: 408837 - protein, 8 aa, Mycobacterium
AAAKKGAT

SEQ ID NO: 408838 - protein, 25 aa, Mycobacterium
AAAKKPGKATAASTAAAEVGATERP

SEQ ID NO: 408839 - protein, 7 aa, Mycobacterium
AAAKLGK

SEQ ID NO: 408840 - protein, 14 aa, Mycobacterium
AAAKNKIDGKPEEL

SEQ ID NO: 408841 - protein, 27 aa, Mycobacterium
AAAKPAAPKPVAQPGTKPTAADRAQQM

SEQ ID NO: 408842 - protein, 9 aa, Mycobacterium
AAAKPDPAI

SEQ ID NO: 408843 - protein, 9 aa, Mycobacterium
AAAKPGSAM

SEQ ID NO: 408844 - protein, 14 aa, Mycobacterium
AAAKPGSAMRPLPG

SEQ ID NO: 408845 - protein, 18 aa, Mycobacterium
AAAKPVTDRDGKVDQQKV

SEQ ID NO: 408846 - protein, 13 aa, Mycobacterium
AAAKSGAQQGEPM

SEQ ID NO: 408847 - protein, 9 aa, Mycobacterium
AAAKSKSAL

SEQ ID NO: 408848 - protein, 12 aa, Mycobacterium
AAAKSLTASSQT

SEQ ID NO: 408849 - protein, 7 aa, Mycobacterium
AAAKSNG

SEQ ID NO: 408850 - protein, 14 aa, Mycobacterium
AAAKTQTVRLPGEQ

SEQ ID NO: 408851 - protein, 10 aa, Mycobacterium
AAALAATSEP

SEQ ID NO: 408852 - protein, 7 aa, Mycobacterium
AAALAGS

SEQ ID NO: 408853 - protein, 13 aa, Mycobacterium
AAALAGSAKNRYE

SEQ ID NO: 408854 - protein, 6 aa, Mycobacterium
AAALAT

SEQ ID NO: 408855 - protein, 8 aa, Mycobacterium
AAALDKAK

SEQ ID NO: 408856 - protein, 17 aa, Mycobacterium
AAALEKAAAARRARAEL

SEQ ID NO: 408857 - protein, 10 aa, Mycobacterium
AAALGDDPDT

SEQ ID NO: 408858 - protein, 26 aa, Mycobacterium
AAALGEATGVASGTAAATDAVAPPSG

SEQ ID NO: 408859 - protein, 22 aa, Mycobacterium
AAALGRAKATMADPAAAERSSG

SEQ ID NO: 408860 - protein, 7 aa, Mycobacterium
AAALGRN

SEQ ID NO: 408861 - protein, 15 aa, Mycobacterium
AAALKSAELARRSAA

SEQ ID NO: 408862 - protein, 8 aa, Mycobacterium
AAALPASM

SEQ ID NO: 408863 - protein, 6 aa, Mycobacterium
AAALPD

SEQ ID NO: 408864 - protein, 8 aa, Mycobacterium
AAALPTDP

SEQ ID NO: 408865 - protein, 12 aa, Mycobacterium
AAALSAARTGRF

SEQ ID NO: 408866 - protein, 17 aa, Mycobacterium
AAALSAGALNGARGNSG

SEQ ID NO: 408867 - protein, 7 aa, Mycobacterium
AAALSSA

SEQ ID NO: 408868 - protein, 11 aa, Mycobacterium
AAALSTAAAER

SEQ ID NO: 408869 - protein, 9 aa, Mycobacterium
AAALTESRT

SEQ ID NO: 408870 - protein, 6 aa, Mycobacterium
AAAMNQ

SEQ ID NO: 408871 - protein, 4 aa, Mycobacterium
AAAN

SEQ ID NO: 408872 - protein, 11 aa, Mycobacterium
AAANAETDTAE

SEQ ID NO: 408873 - protein, 15 aa, Mycobacterium
AAANAQNNDGLDPST

SEQ ID NO: 408874 - protein, 13 aa, Mycobacterium
AAANAQNNNGLDP

SEQ ID NO: 408875 - protein, 14 aa, Mycobacterium
AAANAQNNNGLDPA

SEQ ID NO: 408876 - protein, 14 aa, Mycobacterium
AAANAQNNNGLDPS

SEQ ID NO: 408877 - protein, 14 aa, Mycobacterium
AAANAQNNNGLDPT

SEQ ID NO: 408878 - protein, 8 aa, Mycobacterium
AAANASGV

SEQ ID NO: 408879 - protein, 6 aa, Mycobacterium
AAANAT

SEQ ID NO: 408880 - protein, 8 aa, Mycobacterium
AAANDGKL

SEQ ID NO: 408881 - protein, 22 aa, Mycobacterium
AAANEAGKGEPIDGGDERAHVG

SEQ ID NO: 408882 - protein, 16 aa, Mycobacterium
AAANESATQVRAAGAA

SEQ ID NO: 408883 - protein, 12 aa, Mycobacterium
AAANGAAAGPTT

SEQ ID NO: 408884 - protein, 10 aa, Mycobacterium
AAANGDGRSI

SEQ ID NO: 408885 - protein, 8 aa, Mycobacterium
AAANGGSC

SEQ ID NO: 408886 - protein, 8 aa, Mycobacterium
AAANGLGR

SEQ ID NO: 408887 - protein, 11 aa, Mycobacterium
AAANGRDPEDI

SEQ ID NO: 408888 - protein, 9 aa, Mycobacterium
AAANGVQGS

SEQ ID NO: 408889 - protein, 15 aa, Mycobacterium
AAANNAVDGKPEELY

SEQ ID NO: 408890 - protein, 9 aa, Mycobacterium
AAANNVADP

SEQ ID NO: 408891 - protein, 6 aa, Mycobacterium
AAANPA

SEQ ID NO: 408892 - protein, 8 aa, Mycobacterium
AAANPAGF

SEQ ID NO: 408893 - protein, 9 aa, Mycobacterium
AAANPDVAP

SEQ ID NO: 408894 - protein, 7 aa, Mycobacterium
AAANPEA

SEQ ID NO: 408895 - protein, 8 aa, Mycobacterium
AAANPGRP

SEQ ID NO: 408896 - protein, 8 aa, Mycobacterium
AAANPRIG

SEQ ID NO: 408897 - protein, 14 aa, Mycobacterium
AAANPSGPASVEGM

SEQ ID NO: 408898 - protein, 13 aa, Mycobacterium
AAANRDPDAYPHP

SEQ ID NO: 408899 - protein, 9 aa, Mycobacterium
AAANRDPQV

SEQ ID NO: 408900 - protein, 7 aa, Mycobacterium
AAANRNF

SEQ ID NO: 408901 - protein, 6 aa, Mycobacterium
AAANRP

SEQ ID NO: 408902 - protein, 8 aa, Mycobacterium
AAANSPVP

SEQ ID NO: 408903 - protein, 9 aa, Mycobacterium
AAANTADAG

SEQ ID NO: 408904 - protein, 29 aa, Mycobacterium
AAAPAASADTAAPAVSTVGAGAEAKGSGL

SEQ ID NO: 408905 - protein, 19 aa, Mycobacterium
AAAPADNAPRIGDLPDDPR

SEQ ID NO: 408906 - protein, 19 aa, Mycobacterium
AAAPADNSPRIGELPDDPR

SEQ ID NO: 408907 - protein, 10 aa, Mycobacterium
AAAPALDAGR

SEQ ID NO: 408908 - protein, 29 aa, Mycobacterium
AAAPANGAPASTSDQPQPKRVAPEQLTGA

SEQ ID NO: 408909 - protein, 7 aa, Mycobacterium
AAAPANV

SEQ ID NO: 408910 - protein, 11 aa, Mycobacterium
AAAPAPARRRR

SEQ ID NO: 408911 - protein, 7 aa, Mycobacterium
AAAPASA

SEQ ID NO: 408912 - protein, 6 aa, Mycobacterium
AAAPAV

SEQ ID NO: 408913 - protein, 14 aa, Mycobacterium
AAAPAWGKAAPAER

SEQ ID NO: 408914 - protein, 15 aa, Mycobacterium
AAAPAWGKTAPAERA

SEQ ID NO: 408915 - protein, 14 aa, Mycobacterium
AAAPAWGKTSAAER

SEQ ID NO: 408916 - protein, 10 aa, Mycobacterium
AAAPCEDGSL

SEQ ID NO: 408917 - protein, 5 aa, Mycobacterium
AAAPD

SEQ ID NO: 408918 - protein, 6 aa, Mycobacterium
AAAPDA

SEQ ID NO: 408919 - protein, 8 aa, Mycobacterium
AAAPDARD

SEQ ID NO: 408920 - protein, 10 aa, Mycobacterium
AAAPDEALAG

SEQ ID NO: 408921 - protein, 8 aa, Mycobacterium
AAAPDGLQ

SEQ ID NO: 408922 - protein, 6 aa, Mycobacterium
AAAPDL

SEQ ID NO: 408923 - protein, 18 aa, Mycobacterium
AAAPDNAARIGPDADGNR

SEQ ID NO: 408924 - protein, 8 aa, Mycobacterium
AAAPDRDG

SEQ ID NO: 408925 - protein, 9 aa, Mycobacterium
AAAPDRRRT

SEQ ID NO: 408926 - protein, 6 aa, Mycobacterium
AAAPEA

SEQ ID NO: 408927 - protein, 8 aa, Mycobacterium
AAAPEAVD

SEQ ID NO: 408928 - protein, 9 aa, Mycobacterium
AAAPEDGRQ

SEQ ID NO: 408929 - protein, 6 aa, Mycobacterium
AAAPEG

SEQ ID NO: 408930 - protein, 9 aa, Mycobacterium
AAAPEHERE

SEQ ID NO: 408931 - protein, 6 aa, Mycobacterium
AAAPEI

SEQ ID NO: 408932 - protein, 8 aa, Mycobacterium
AAAPEPSA

SEQ ID NO: 408933 - protein, 8 aa, Mycobacterium
AAAPEPVD

SEQ ID NO: 408934 - protein, 6 aa, Mycobacterium
AAAPET

SEQ ID NO: 408935 - protein, 7 aa, Mycobacterium
AAAPETH

SEQ ID NO: 408936 - protein, 9 aa, Mycobacterium
AAAPETPMP

SEQ ID NO: 408937 - protein, 7 aa, Mycobacterium
AAAPETV

SEQ ID NO: 408938 - protein, 13 aa, Mycobacterium
AAAPGAFDGADDF

SEQ ID NO: 408939 - protein, 7 aa, Mycobacterium
AAAPGAR

SEQ ID NO: 408940 - protein, 7 aa, Mycobacterium
AAAPGAS

SEQ ID NO: 408941 - protein, 11 aa, Mycobacterium
AAAPGATDETI

SEQ ID NO: 408942 - protein, 16 aa, Mycobacterium
AAAPGATITTDRTRPL

SEQ ID NO: 408943 - protein, 8 aa, Mycobacterium
AAAPGAVQ

SEQ ID NO: 408944 - protein, 7 aa, Mycobacterium
AAAPGFA

SEQ ID NO: 408945 - protein, 24 aa, Mycobacterium
AAAPGFAEYQSKTSRVIPLFELQP

SEQ ID NO: 408946 - protein, 15 aa, Mycobacterium
AAAPGGTTELGRGTA

SEQ ID NO: 408947 - protein, 8 aa, Mycobacterium
AAAPGGVA

SEQ ID NO: 408948 - protein, 16 aa, Mycobacterium
AAAPGGVAQAAPASLD

SEQ ID NO: 408949 - protein, 10 aa, Mycobacterium
AAAPGIKAGS

SEQ ID NO: 408950 - protein, 6 aa, Mycobacterium
AAAPGP

SEQ ID NO: 408951 - protein, 7 aa, Mycobacterium
AAAPGPA

SEQ ID NO: 408952 - protein, 9 aa, Mycobacterium
AAAPGPVAE

SEQ ID NO: 408953 - protein, 9 aa, Mycobacterium
AAAPGPVQE

SEQ ID NO: 408954 - protein, 7 aa, Mycobacterium
AAAPGQI

SEQ ID NO: 408955 - protein, 6 aa, Mycobacterium
AAAPGR

SEQ ID NO: 408956 - protein, 8 aa, Mycobacterium
AAAPGRAA

SEQ ID NO: 408957 - protein, 14 aa, Mycobacterium
AAAPGRPGPAANTA

SEQ ID NO: 408958 - protein, 7 aa, Mycobacterium
AAAPGSR

SEQ ID NO: 408959 - protein, 9 aa, Mycobacterium
AAAPGSSLG

SEQ ID NO: 408960 - protein, 22 aa, Mycobacterium
AAAPGTDRTARRTSIRCRRQGA

SEQ ID NO: 408961 - protein, 7 aa, Mycobacterium
AAAPGTR

SEQ ID NO: 408962 - protein, 7 aa, Mycobacterium
AAAPHRE

SEQ ID NO: 408963 - protein, 7 aa, Mycobacterium
AAAPIGE

SEQ ID NO: 408964 - protein, 8 aa, Mycobacterium
AAAPLDGA

SEQ ID NO: 408965 - protein, 7 aa, Mycobacterium
AAAPLHP

SEQ ID NO: 408966 - protein, 12 aa, Mycobacterium
AAAPLKPGKGPI

SEQ ID NO: 408967 - protein, 7 aa, Mycobacterium
AAAPMGI

SEQ ID NO: 408968 - protein, 6 aa, Mycobacterium
AAAPNE

SEQ ID NO: 408969 - protein, 6 aa, Mycobacterium
AAAPNL

SEQ ID NO: 408970 - protein, 14 aa, Mycobacterium
AAAPNLPRATGTPH

SEQ ID NO: 408971 - protein, 18 aa, Mycobacterium
AAAPPAPVATPVKANAEE

SEQ ID NO: 408972 - protein, 10 aa, Mycobacterium
AAAPPARVPR

SEQ ID NO: 408973 - protein, 7 aa, Mycobacterium
AAAPPEL

SEQ ID NO: 408974 - protein, 11 aa, Mycobacterium
AAAPPETDAVT

SEQ ID NO: 408975 - protein, 7 aa, Mycobacterium
AAAPPGA

SEQ ID NO: 408976 - protein, 7 aa, Mycobacterium
AAAPPHR

SEQ ID NO: 408977 - protein, 13 aa, Mycobacterium
AAAPPREQSRQGM

SEQ ID NO: 408978 - protein, 9 aa, Mycobacterium
AAAPQAAPG

SEQ ID NO: 408979 - protein, 9 aa, Mycobacterium
AAAPQAAPR

SEQ ID NO: 408980 - protein, 7 aa, Mycobacterium
AAAPQGR

SEQ ID NO: 408981 - protein, 8 aa, Mycobacterium
AAAPQGRV

SEQ ID NO: 408982 - protein, 7 aa, Mycobacterium
AAAPQGV

SEQ ID NO: 408983 - protein, 7 aa, Mycobacterium
AAAPQRR

SEQ ID NO: 408984 - protein, 15 aa, Mycobacterium
AAAPQVASGGPRGLR

SEQ ID NO: 408985 - protein, 5 aa, Mycobacterium
AAAPR

SEQ ID NO: 408986 - protein, 10 aa, Mycobacterium
AAAPRDATRL

SEQ ID NO: 408987 - protein, 8 aa, Mycobacterium
AAAPRDPV

SEQ ID NO: 408988 - protein, 7 aa, Mycobacterium
AAAPRGE

SEQ ID NO: 408989 - protein, 6 aa, Mycobacterium
AAAPRH

SEQ ID NO: 408990 - protein, 11 aa, Mycobacterium
AAAPRPPSAAE

SEQ ID NO: 408991 - protein, 13 aa, Mycobacterium
AAAPSERSSRAAE

SEQ ID NO: 408992 - protein, 7 aa, Mycobacterium
AAAPSGL

SEQ ID NO: 408993 - protein, 25 aa, Mycobacterium
AAAPSIGADPGPASMSAELISGGNM

SEQ ID NO: 408994 - protein, 15 aa, Mycobacterium
AAAPSKPVATPGAGR

SEQ ID NO: 408995 - protein, 12 aa, Mycobacterium
AAAPSLPGPSAE

SEQ ID NO: 408996 - protein, 13 aa, Mycobacterium
AAAPSLPKPATEV

SEQ ID NO: 408997 - protein, 13 aa, Mycobacterium
AAAPSLPKPTAEV

SEQ ID NO: 408998 - protein, 15 aa, Mycobacterium
AAAPSNPVATPGAGT

SEQ ID NO: 408999 - protein, 16 aa, Mycobacterium
AAAPSNPVATPGAGTL

SEQ ID NO: 409000 - protein, 15 aa, Mycobacterium
AAAPSRQAARGGTRR

SEQ ID NO: 409001 - protein, 31 aa, Mycobacterium
AAAPSSSPVPGPTPAPPPQPMARGKREISTR

SEQ ID NO: 409002 - protein, 6 aa, Mycobacterium
AAAPTA

SEQ ID NO: 409003 - protein, 12 aa, Mycobacterium
AAAPTAGLPGEA

SEQ ID NO: 409004 - protein, 9 aa, Mycobacterium
AAAPTEPVT

SEQ ID NO: 409005 - protein, 7 aa, Mycobacterium
AAAPTFG

SEQ ID NO: 409006 - protein, 7 aa, Mycobacterium
AAAPTGA

SEQ ID NO: 409007 - protein, 22 aa, Mycobacterium
AAAPTGPDPEELEAQAERVAEQ

SEQ ID NO: 409008 - protein, 6 aa, Mycobacterium
AAAPTM

SEQ ID NO: 409009 - protein, 12 aa, Mycobacterium
AAAPTPAGPGEV

SEQ ID NO: 409010 - protein, 11 aa, Mycobacterium
AAAPTPGPTVS

SEQ ID NO: 409011 - protein, 7 aa, Mycobacterium
AAAPTRH

SEQ ID NO: 409012 - protein, 7 aa, Mycobacterium
AAAPTTS

SEQ ID NO: 409013 - protein, 5 aa, Mycobacterium
AAAPV

SEQ ID NO: 409014 - protein, 8 aa, Mycobacterium
AAAPVKAG

SEQ ID NO: 409015 - protein, 8 aa, Mycobacterium
AAAPVTEE

SEQ ID NO: 409016 - protein, 6 aa, Mycobacterium
AAAPYA

SEQ ID NO: 409017 - protein, 7 aa, Mycobacterium
AAAPYSG

SEQ ID NO: 409018 - protein, 6 aa, Mycobacterium
AAAPYT

SEQ ID NO: 409019 - protein, 5 aa, Mycobacterium
AAAQA

SEQ ID NO: 409020 - protein, 6 aa, Mycobacterium
AAAQAA

SEQ ID NO: 409021 - protein, 28 aa, Mycobacterium
AAAQAAGREFDHEADAKRTKEIEEQIDR

SEQ ID NO: 409022 - protein, 11 aa, Mycobacterium
AAAQAAGRNAA

SEQ ID NO: 409023 - protein, 9 aa, Mycobacterium
AAAQAAGVP

SEQ ID NO: 409024 - protein, 10 aa, Mycobacterium
AAAQAAHGEL

SEQ ID NO: 409025 - protein, 6 aa, Mycobacterium
AAAQAG

SEQ ID NO: 409026 - protein, 11 aa, Mycobacterium
AAAQAKKAVEQ

SEQ ID NO: 409027 - protein, 11 aa, Mycobacterium
AAAQAKRAVEQ

SEQ ID NO: 409028 - protein, 12 aa, Mycobacterium
AAAQAKRDAADL

SEQ ID NO: 409029 - protein, 10 aa, Mycobacterium
AAAQAPGDSE

SEQ ID NO: 409030 - protein, 7 aa, Mycobacterium
AAAQAQP

SEQ ID NO: 409031 - protein, 10 aa, Mycobacterium
AAAQARGELG

SEQ ID NO: 409032 - protein, 24 aa, Mycobacterium
AAAQASDDDDDDELDDFYAGALEE

SEQ ID NO: 409033 - protein, 9 aa, Mycobacterium
AAAQDLPAT

SEQ ID NO: 409034 - protein, 8 aa, Mycobacterium
AAAQDSHS

SEQ ID NO: 409035 - protein, 10 aa, Mycobacterium
AAAQDVETIG

SEQ ID NO: 409036 - protein, 5 aa, Mycobacterium
AAAQE

SEQ ID NO: 409037 - protein, 9 aa, Mycobacterium
AAAQENAKA

SEQ ID NO: 409038 - protein, 11 aa, Mycobacterium
AAAQETLNGGT

SEQ ID NO: 409039 - protein, 7 aa, Mycobacterium
AAAQEYA

SEQ ID NO: 409040 - protein, 5 aa, Mycobacterium
AAAQG

SEQ ID NO: 409041 - protein, 9 aa, Mycobacterium
AAAQGPEMG

SEQ ID NO: 409042 - protein, 7 aa, Mycobacterium
AAAQGRA

SEQ ID NO: 409043 - protein, 7 aa, Mycobacterium
AAAQGRL

SEQ ID NO: 409044 - protein, 9 aa, Mycobacterium
AAAQGSGDF

SEQ ID NO: 409045 - protein, 5 aa, Mycobacterium
AAAQH

SEQ ID NO: 409046 - protein, 34 aa, Mycobacterium
AAAQHEQGQQEPDQPAPRRGAEGSAMQQLRSTTG

SEQ ID NO: 409047 - protein, 8 aa, Mycobacterium
AAAQHGRA

SEQ ID NO: 409048 - protein, 15 aa, Mycobacterium
AAAQKATRPRKPESL

SEQ ID NO: 409049 - protein, 15 aa, Mycobacterium
AAAQKELAATGAKLA

SEQ ID NO: 409050 - protein, 17 aa, Mycobacterium
AAAQKELAGTSAKLGND

SEQ ID NO: 409051 - protein, 8 aa, Mycobacterium
AAAQKGAT

SEQ ID NO: 409052 - protein, 8 aa, Mycobacterium
AAAQPGEP

SEQ ID NO: 409053 - protein, 9 aa, Mycobacterium
AAAQPGTAV

SEQ ID NO: 409054 - protein, 8 aa, Mycobacterium
AAAQPSLY

SEQ ID NO: 409055 - protein, 8 aa, Mycobacterium
AAAQQEGF

SEQ ID NO: 409056 - protein, 15 aa, Mycobacterium
AAAQQGAEGGSFPGS

SEQ ID NO: 409057 - protein, 86 aa, Mycobacterium
AAAQQGGTTTAVREEAPSTLRAKGIDNQAPALTYSGPSEDGSAQVQRNGGDAKTPAGVPAGASRRERRAAARQQGRGAKPPKSVKR

SEQ ID NO: 409058 - protein, 77 aa, Mycobacterium
AAAQQGSVATKERPTGGLRAKGIDDQSRPLTYTGPSEDGTPEVKRSENAPAASTGMTRKERREAARQQQKAGRHAKR

SEQ ID NO: 409059 - protein, 7 aa, Mycobacterium
AAAQRAA

SEQ ID NO: 409060 - protein, 11 aa, Mycobacterium
AAAQRAGAIGS

SEQ ID NO: 409061 - protein, 12 aa, Mycobacterium
AAAQRAGDLGAG

SEQ ID NO: 409062 - protein, 13 aa, Mycobacterium
AAAQREAQSAFGD

SEQ ID NO: 409063 - protein, 8 aa, Mycobacterium
AAAQRHGG

SEQ ID NO: 409064 - protein, 6 aa, Mycobacterium
AAAQRL

SEQ ID NO: 409065 - protein, 12 aa, Mycobacterium
AAAQRPDRLPGV

SEQ ID NO: 409066 - protein, 6 aa, Mycobacterium
AAAQRR

SEQ ID NO: 409067 - protein, 6 aa, Mycobacterium
AAAQRY

SEQ ID NO: 409068 - protein, 5 aa, Mycobacterium
AAAQS

SEQ ID NO: 409069 - protein, 13 aa, Mycobacterium
AAAQSAGAAGQAR

SEQ ID NO: 409070 - protein, 8 aa, Mycobacterium
AAAQSDDV

SEQ ID NO: 409071 - protein, 11 aa, Mycobacterium
AAAQSGATRAG

SEQ ID NO: 409072 - protein, 16 aa, Mycobacterium
AAAQSGPAQPATTHGQ

SEQ ID NO: 409073 - protein, 7 aa, Mycobacterium
AAAQSHD

SEQ ID NO: 409074 - protein, 10 aa, Mycobacterium
AAAQSKYDAA

SEQ ID NO: 409075 - protein, 9 aa, Mycobacterium
AAAQSQAIR

SEQ ID NO: 409076 - protein, 9 aa, Mycobacterium
AAAQSRAVR

SEQ ID NO: 409077 - protein, 9 aa, Mycobacterium
AAAQSRDIA

SEQ ID NO: 409078 - protein, 9 aa, Mycobacterium
AAAQSTDFT

SEQ ID NO: 409079 - protein, 9 aa, Mycobacterium
AAAQSTDIV

SEQ ID NO: 409080 - protein, 12 aa, Mycobacterium
AAAQTAQAATHG

SEQ ID NO: 409081 - protein, 10 aa, Mycobacterium
AAAQTSSGVG

SEQ ID NO: 409082 - protein, 6 aa, Mycobacterium
AAAQTT

SEQ ID NO: 409083 - protein, 6 aa, Mycobacterium
AAAQVG

SEQ ID NO: 409084 - protein, 6 aa, Mycobacterium
AAARAA

SEQ ID NO: 409085 - protein, 15 aa, Mycobacterium
AAARAAAASAQAKAV

SEQ ID NO: 409086 - protein, 12 aa, Mycobacterium
AAARAAEAAGQA

SEQ ID NO: 409087 - protein, 20 aa, Mycobacterium
AAARAAEAIEDTAHRCRRPV

SEQ ID NO: 409088 - protein, 6 aa, Mycobacterium
AAARAD

SEQ ID NO: 409089 - protein, 6 aa, Mycobacterium
AAARAF

SEQ ID NO: 409090 - protein, 14 aa, Mycobacterium
AAARAGDKPSPAAE

SEQ ID NO: 409091 - protein, 7 aa, Mycobacterium
AAARAGL

SEQ ID NO: 409092 - protein, 9 aa, Mycobacterium
AAARAGLEK

SEQ ID NO: 409093 - protein, 8 aa, Mycobacterium
AAARAQNA

SEQ ID NO: 409094 - protein, 18 aa, Mycobacterium
AAARARQDTLTKPRGALG

SEQ ID NO: 409095 - protein, 12 aa, Mycobacterium
AAARARRGDGPT

SEQ ID NO: 409096 - protein, 9 aa, Mycobacterium
AAARAVKGD

SEQ ID NO: 409097 - protein, 21 aa, Mycobacterium
AAARAVKGDVQKSLKNFVELY

SEQ ID NO: 409098 - protein, 6 aa, Mycobacterium
AAARDA

SEQ ID NO: 409099 - protein, 5 aa, Mycobacterium
AAARE

SEQ ID NO: 409100 - protein, 12 aa, Mycobacterium
AAARENLEKSGV

SEQ ID NO: 409101 - protein, 8 aa, Mycobacterium
AAAREPEL

SEQ ID NO: 409102 - protein, 9 aa, Mycobacterium
AAARERANR

SEQ ID NO: 409103 - protein, 17 aa, Mycobacterium
AAARESAVAQGITGGDR

SEQ ID NO: 409104 - protein, 12 aa, Mycobacterium
AAARESTQAAGM

SEQ ID NO: 409105 - protein, 9 aa, Mycobacterium
AAARETDQG

SEQ ID NO: 409106 - protein, 7 aa, Mycobacterium
AAAREVG

SEQ ID NO: 409107 - protein, 8 aa, Mycobacterium
AAARFGAE

SEQ ID NO: 409108 - protein, 18 aa, Mycobacterium
AAARGARGIAASSGDDIG

SEQ ID NO: 409109 - protein, 6 aa, Mycobacterium
AAARGD

SEQ ID NO: 409110 - protein, 7 aa, Mycobacterium
AAARGDS

SEQ ID NO: 409111 - protein, 16 aa, Mycobacterium
AAARGDSAHSGVATGT

SEQ ID NO: 409112 - protein, 6 aa, Mycobacterium
AAARGE

SEQ ID NO: 409113 - protein, 13 aa, Mycobacterium
AAARGEAAPDVGA

SEQ ID NO: 409114 - protein, 10 aa, Mycobacterium
AAARGEGAAK

SEQ ID NO: 409115 - protein, 8 aa, Mycobacterium
AAARGELR

SEQ ID NO: 409116 - protein, 9 aa, Mycobacterium
AAARGGEPF

SEQ ID NO: 409117 - protein, 7 aa, Mycobacterium
AAARGLS

SEQ ID NO: 409118 - protein, 10 aa, Mycobacterium
AAARGLSDAT

SEQ ID NO: 409119 - protein, 19 aa, Mycobacterium
AAARGQASGEIAAAQQTAQ

SEQ ID NO: 409120 - protein, 7 aa, Mycobacterium
AAARGRV

SEQ ID NO: 409121 - protein, 9 aa, Mycobacterium
AAARGSGDF

SEQ ID NO: 409122 - protein, 7 aa, Mycobacterium
AAARGSL

SEQ ID NO: 409123 - protein, 16 aa, Mycobacterium
AAARGVPAQAEMGGKN

SEQ ID NO: 409124 - protein, 5 aa, Mycobacterium
AAARH

SEQ ID NO: 409125 - protein, 17 aa, Mycobacterium
AAARKELDGTTSKLGND

SEQ ID NO: 409126 - protein, 24 aa, Mycobacterium
AAARKRGDDAAAERISAATKPTTA

SEQ ID NO: 409127 - protein, 12 aa, Mycobacterium
AAARLSDTKDPN

SEQ ID NO: 409128 - protein, 13 aa, Mycobacterium
AAARNSAGFGAPR

SEQ ID NO: 409129 - protein, 18 aa, Mycobacterium
AAARPAPNPLGGQAWEDA

SEQ ID NO: 409130 - protein, 7 aa, Mycobacterium
AAARPDA

SEQ ID NO: 409131 - protein, 8 aa, Mycobacterium
AAARPVQR

SEQ ID NO: 409132 - protein, 8 aa, Mycobacterium
AAARQGNS

SEQ ID NO: 409133 - protein, 7 aa, Mycobacterium
AAARQGV

SEQ ID NO: 409134 - protein, 8 aa, Mycobacterium
AAARQLAS

SEQ ID NO: 409135 - protein, 7 aa, Mycobacterium
AAARQPF

SEQ ID NO: 409136 - protein, 5 aa, Mycobacterium
AAARR

SEQ ID NO: 409137 - protein, 8 aa, Mycobacterium
AAARRAGR

SEQ ID NO: 409138 - protein, 7 aa, Mycobacterium
AAARRAL

SEQ ID NO: 409139 - protein, 8 aa, Mycobacterium
AAARRENE

SEQ ID NO: 409140 - protein, 7 aa, Mycobacterium
AAARRGA

SEQ ID NO: 409141 - protein, 11 aa, Mycobacterium
AAARRGDSVAE

SEQ ID NO: 409142 - protein, 15 aa, Mycobacterium
AAARRLASASAPGRR

SEQ ID NO: 409143 - protein, 14 aa, Mycobacterium
AAARRLGRAGATRR

SEQ ID NO: 409144 - protein, 7 aa, Mycobacterium
AAARSEL

SEQ ID NO: 409145 - protein, 17 aa, Mycobacterium
AAARSGAGASSQATSSI

SEQ ID NO: 409146 - protein, 10 aa, Mycobacterium
AAARSGKREY

SEQ ID NO: 409147 - protein, 7 aa, Mycobacterium
AAARSGV

SEQ ID NO: 409148 - protein, 9 aa, Mycobacterium
AAARSKGLT

SEQ ID NO: 409149 - protein, 12 aa, Mycobacterium
AAARSKYGELVD

SEQ ID NO: 409150 - protein, 7 aa, Mycobacterium
AAARSLG

SEQ ID NO: 409151 - protein, 12 aa, Mycobacterium
AAARSRRPDIDP

SEQ ID NO: 409152 - protein, 8 aa, Mycobacterium
AAARTAEH

SEQ ID NO: 409153 - protein, 7 aa, Mycobacterium
AAARTDA

SEQ ID NO: 409154 - protein, 9 aa, Mycobacterium
AAARTGAHR

SEQ ID NO: 409155 - protein, 8 aa, Mycobacterium
AAARTGPI

SEQ ID NO: 409156 - protein, 11 aa, Mycobacterium
AAARTGSQAIH

SEQ ID NO: 409157 - protein, 16 aa, Mycobacterium
AAARTQARIDSGAQPV

SEQ ID NO: 409158 - protein, 16 aa, Mycobacterium
AAARTQARIDSGRQPV

SEQ ID NO: 409159 - protein, 14 aa, Mycobacterium
AAARVEPGTALQGN

SEQ ID NO: 409160 - protein, 5 aa, Mycobacterium
AAARY

SEQ ID NO: 409161 - protein, 4 aa, Mycobacterium
AAAS

SEQ ID NO: 409162 - protein, 5 aa, Mycobacterium
AAASA

SEQ ID NO: 409163 - protein, 8 aa, Mycobacterium
AAASAAAG

SEQ ID NO: 409164 - protein, 8 aa, Mycobacterium
AAASAAAL

SEQ ID NO: 409165 - protein, 12 aa, Mycobacterium
AAASAAGLAPPA

SEQ ID NO: 409166 - protein, 11 aa, Mycobacterium
AAASADNERNS

SEQ ID NO: 409167 - protein, 6 aa, Mycobacterium
AAASAE

SEQ ID NO: 409168 - protein, 12 aa, Mycobacterium
AAASAGDGPGTF

SEQ ID NO: 409169 - protein, 7 aa, Mycobacterium
AAASAGS

SEQ ID NO: 409170 - protein, 10 aa, Mycobacterium
AAASAGSTLA

SEQ ID NO: 409171 - protein, 11 aa, Mycobacterium
AAASAGSTLGE

SEQ ID NO: 409172 - protein, 8 aa, Mycobacterium
AAASAGTE

SEQ ID NO: 409173 - protein, 10 aa, Mycobacterium
AAASAGTSLA

SEQ ID NO: 409174 - protein, 20 aa, Mycobacterium
AAASAPTDAAAGAPEPTPTE

SEQ ID NO: 409175 - protein, 21 aa, Mycobacterium
AAASAPTDAAAGTPEPTTTES

SEQ ID NO: 409176 - protein, 11 aa, Mycobacterium
AAASARDEGIR

SEQ ID NO: 409177 - protein, 14 aa, Mycobacterium
AAASDAGRDPMSIT

SEQ ID NO: 409178 - protein, 9 aa, Mycobacterium
AAASDDLAD

SEQ ID NO: 409179 - protein, 9 aa, Mycobacterium
AAASDDSLR

SEQ ID NO: 409180 - protein, 11 aa, Mycobacterium
AAASDELADTY

SEQ ID NO: 409181 - protein, 7 aa, Mycobacterium
AAASDET

SEQ ID NO: 409182 - protein, 9 aa, Mycobacterium
AAASDEVST

SEQ ID NO: 409183 - protein, 6 aa, Mycobacterium
AAASDG

SEQ ID NO: 409184 - protein, 8 aa, Mycobacterium
AAASDKAA

SEQ ID NO: 409185 - protein, 8 aa, Mycobacterium
AAASDLTG

SEQ ID NO: 409186 - protein, 7 aa, Mycobacterium
AAASDRV

SEQ ID NO: 409187 - protein, 26 aa, Mycobacterium
AAASDVAGIGTTISSANAAASAPTTG

SEQ ID NO: 409188 - protein, 10 aa, Mycobacterium
AAASEAKRQN

SEQ ID NO: 409189 - protein, 6 aa, Mycobacterium
AAASER

SEQ ID NO: 409190 - protein, 12 aa, Mycobacterium
AAASERARSEFS

SEQ ID NO: 409191 - protein, 18 aa, Mycobacterium
AAASESSDPWNNAGTGHS

SEQ ID NO: 409192 - protein, 5 aa, Mycobacterium
AAASG

SEQ ID NO: 409193 - protein, 15 aa, Mycobacterium
AAASGAADGTDEQRI

SEQ ID NO: 409194 - protein, 8 aa, Mycobacterium
AAASGAEQ

SEQ ID NO: 409195 - protein, 11 aa, Mycobacterium
AAASGAGPQSL

SEQ ID NO: 409196 - protein, 9 aa, Mycobacterium
AAASGAKLD

SEQ ID NO: 409197 - protein, 7 aa, Mycobacterium
AAASGAR

SEQ ID NO: 409198 - protein, 9 aa, Mycobacterium
AAASGARYD

SEQ ID NO: 409199 - protein, 7 aa, Mycobacterium
AAASGFN

SEQ ID NO: 409200 - protein, 18 aa, Mycobacterium
AAASGGYAEYATAPASFT

SEQ ID NO: 409201 - protein, 11 aa, Mycobacterium
AAASGKNLGPR

SEQ ID NO: 409202 - protein, 7 aa, Mycobacterium
AAASGLT

SEQ ID NO: 409203 - protein, 9 aa, Mycobacterium
AAASGSDIS

SEQ ID NO: 409204 - protein, 9 aa, Mycobacterium
AAASGSDVS

SEQ ID NO: 409205 - protein, 24 aa, Mycobacterium
AAASGSSVAARSTVAADSVEEGMT

SEQ ID NO: 409206 - protein, 12 aa, Mycobacterium
AAASGTDPRDSA

SEQ ID NO: 409207 - protein, 7 aa, Mycobacterium
AAASGYD

SEQ ID NO: 409208 - protein, 6 aa, Mycobacterium
AAASHQ

SEQ ID NO: 409209 - protein, 8 aa, Mycobacterium
AAASISPA

SEQ ID NO: 409210 - protein, 9 aa, Mycobacterium
AAASKPRKP

SEQ ID NO: 409211 - protein, 8 aa, Mycobacterium
AAASLNNY

SEQ ID NO: 409212 - protein, 17 aa, Mycobacterium
AAASLRDGQLPGGPGRL

SEQ ID NO: 409213 - protein, 19 aa, Mycobacterium
AAASLSDPNVLGASDPAKV

SEQ ID NO: 409214 - protein, 12 aa, Mycobacterium
AAASNAAGAPQL

SEQ ID NO: 409215 - protein, 7 aa, Mycobacterium
AAASPAE

SEQ ID NO: 409216 - protein, 9 aa, Mycobacterium
AAASPAGTD

SEQ ID NO: 409217 - protein, 9 aa, Mycobacterium
AAASPDAVA

SEQ ID NO: 409218 - protein, 8 aa, Mycobacterium
AAASPDDV

SEQ ID NO: 409219 - protein, 11 aa, Mycobacterium
AAASPDEPQPF

SEQ ID NO: 409220 - protein, 8 aa, Mycobacterium
AAASPGGF

SEQ ID NO: 409221 - protein, 9 aa, Mycobacterium
AAASPPRQV

SEQ ID NO: 409222 - protein, 9 aa, Mycobacterium
AAASPTATA

SEQ ID NO: 409223 - protein, 7 aa, Mycobacterium
AAASQVG

SEQ ID NO: 409224 - protein, 7 aa, Mycobacterium
AAASRDH

SEQ ID NO: 409225 - protein, 19 aa, Mycobacterium
AAASRGEWRTEVGDDGRLG

SEQ ID NO: 409226 - protein, 9 aa, Mycobacterium
AAASRPPSS

SEQ ID NO: 409227 - protein, 11 aa, Mycobacterium
AAASRSARAKL

SEQ ID NO: 409228 - protein, 8 aa, Mycobacterium
AAASRWRT

SEQ ID NO: 409229 - protein, 12 aa, Mycobacterium
AAASSPAAVGGA

SEQ ID NO: 409230 - protein, 10 aa, Mycobacterium
AAASSPAEAL

SEQ ID NO: 409231 - protein, 10 aa, Mycobacterium
AAASSRGAGA

SEQ ID NO: 409232 - protein, 10 aa, Mycobacterium
AAASSRGGAA

SEQ ID NO: 409233 - protein, 15 aa, Mycobacterium
AAASSSLTSLGSSIR

SEQ ID NO: 409234 - protein, 8 aa, Mycobacterium
AAASTALR

SEQ ID NO: 409235 - protein, 10 aa, Mycobacterium
AAASTENERT

SEQ ID NO: 409236 - protein, 7 aa, Mycobacterium
AAASTGL

SEQ ID NO: 409237 - protein, 8 aa, Mycobacterium
AAASTQGP

SEQ ID NO: 409238 - protein, 9 aa, Mycobacterium
AAASTSLRR

SEQ ID NO: 409239 - protein, 8 aa, Mycobacterium
AAASTSPL

SEQ ID NO: 409240 - protein, 7 aa, Mycobacterium
AAASTTT

SEQ ID NO: 409241 - protein, 5 aa, Mycobacterium
AAASV

SEQ ID NO: 409242 - protein, 24 aa, Mycobacterium
AAASVEPAELTARQEGLRADDPAT

SEQ ID NO: 409243 - protein, 9 aa, Mycobacterium
AAASVNTPR

SEQ ID NO: 409244 - protein, 10 aa, Mycobacterium
AAASWDGADT

SEQ ID NO: 409245 - protein, 10 aa, Mycobacterium
AAASYTGAEA

SEQ ID NO: 409246 - protein, 8 aa, Mycobacterium
AAATAAED

SEQ ID NO: 409247 - protein, 15 aa, Mycobacterium
AAATAAEKGRDATES

SEQ ID NO: 409248 - protein, 11 aa, Mycobacterium
AAATAAGATHA

SEQ ID NO: 409249 - protein, 8 aa, Mycobacterium
AAATAAGI

SEQ ID NO: 409250 - protein, 7 aa, Mycobacterium
AAATAGA

SEQ ID NO: 409251 - protein, 9 aa, Mycobacterium
AAATAGGAS

SEQ ID NO: 409252 - protein, 8 aa, Mycobacterium
AAATAGPQ

SEQ ID NO: 409253 - protein, 10 aa, Mycobacterium
AAATAGPRDV

SEQ ID NO: 409254 - protein, 9 aa, Mycobacterium
AAATAIKEH

SEQ ID NO: 409255 - protein, 11 aa, Mycobacterium
AAATAIPAATA

SEQ ID NO: 409256 - protein, 8 aa, Mycobacterium
AAATANAT

SEQ ID NO: 409257 - protein, 8 aa, Mycobacterium
AAATAPER

SEQ ID NO: 409258 - protein, 8 aa, Mycobacterium
AAATAPGD

SEQ ID NO: 409259 - protein, 6 aa, Mycobacterium
AAATAR

SEQ ID NO: 409260 - protein, 6 aa, Mycobacterium
AAATAS

SEQ ID NO: 409261 - protein, 42 aa, Mycobacterium
AAATATAVRTKQAAGTVTASTASTAGTAGTAGHASGAPDPAV

SEQ ID NO: 409262 - protein, 5 aa, Mycobacterium
AAATD

SEQ ID NO: 409263 - protein, 7 aa, Mycobacterium
AAATDAG

SEQ ID NO: 409264 - protein, 12 aa, Mycobacterium
AAATDDLTDTYD

SEQ ID NO: 409265 - protein, 6 aa, Mycobacterium
AAATDE

SEQ ID NO: 409266 - protein, 8 aa, Mycobacterium
AAATDGEW

SEQ ID NO: 409267 - protein, 14 aa, Mycobacterium
AAATDGSSWRPPRR

SEQ ID NO: 409268 - protein, 8 aa, Mycobacterium
AAATDQLA

SEQ ID NO: 409269 - protein, 7 aa, Mycobacterium
AAATDSR

SEQ ID NO: 409270 - protein, 10 aa, Mycobacterium
AAATDSTPVE

SEQ ID NO: 409271 - protein, 7 aa, Mycobacterium
AAATEAA

SEQ ID NO: 409272 - protein, 16 aa, Mycobacterium
AAATEARWTEDQPAWS

SEQ ID NO: 409273 - protein, 7 aa, Mycobacterium
AAATEDA

SEQ ID NO: 409274 - protein, 17 aa, Mycobacterium
AAATEDRYSDGSGSGAI

SEQ ID NO: 409275 - protein, 8 aa, Mycobacterium
AAATEQAG

SEQ ID NO: 409276 - protein, 15 aa, Mycobacterium
AAATEQSASKARIAA

SEQ ID NO: 409277 - protein, 7 aa, Mycobacterium
AAATEQV

SEQ ID NO: 409278 - protein, 24 aa, Mycobacterium
AAATERPDRLPGVGSSSQVPSLPG

SEQ ID NO: 409279 - protein, 10 aa, Mycobacterium
AAATESARAV

SEQ ID NO: 409280 - protein, 10 aa, Mycobacterium
AAATESEERW

SEQ ID NO: 409281 - protein, 6 aa, Mycobacterium
AAATEV

SEQ ID NO: 409282 - protein, 6 aa, Mycobacterium
AAATEY

SEQ ID NO: 409283 - protein, 5 aa, Mycobacterium
AAATG

SEQ ID NO: 409284 - protein, 27 aa, Mycobacterium
AAATGAASTGVAPGPTAAEQQRGLTAG

SEQ ID NO: 409285 - protein, 15 aa, Mycobacterium
AAATGADKVSERAKA

SEQ ID NO: 409286 - protein, 11 aa, Mycobacterium
AAATGAGSDSV

SEQ ID NO: 409287 - protein, 15 aa, Mycobacterium
AAATGANGVAQQAKA

SEQ ID NO: 409288 - protein, 15 aa, Mycobacterium
AAATGEAKVSERAKA

SEQ ID NO: 409289 - protein, 6 aa, Mycobacterium
AAATGF

SEQ ID NO: 409290 - protein, 14 aa, Mycobacterium
AAATGHSPAPVREH

SEQ ID NO: 409291 - protein, 8 aa, Mycobacterium
AAATGKGA

SEQ ID NO: 409292 - protein, 10 aa, Mycobacterium
AAATGKTTAI

SEQ ID NO: 409293 - protein, 10 aa, Mycobacterium
AAATGKTTAV

SEQ ID NO: 409294 - protein, 11 aa, Mycobacterium
AAATGLPDAST

SEQ ID NO: 409295 - protein, 7 aa, Mycobacterium
AAATGYG

SEQ ID NO: 409296 - protein, 6 aa, Mycobacterium
AAATIG

SEQ ID NO: 409297 - protein, 7 aa, Mycobacterium
AAATKNA

SEQ ID NO: 409298 - protein, 14 aa, Mycobacterium
AAATKTSAAMASTA

SEQ ID NO: 409299 - protein, 8 aa, Mycobacterium
AAATLSSA

SEQ ID NO: 409300 - protein, 19 aa, Mycobacterium
AAATMGGLKPGDPDKPGTI

SEQ ID NO: 409301 - protein, 19 aa, Mycobacterium
AAATMGSLKPGDPAKPGTI

SEQ ID NO: 409302 - protein, 6 aa, Mycobacterium
AAATNG

SEQ ID NO: 409303 - protein, 8 aa, Mycobacterium
AAATNSRE

SEQ ID NO: 409304 - protein, 9 aa, Mycobacterium
AAATNSSPL

SEQ ID NO: 409305 - protein, 6 aa, Mycobacterium
AAATNT

SEQ ID NO: 409306 - protein, 21 aa, Mycobacterium
AAATNYDNTDSTEAGNIDTCG

SEQ ID NO: 409307 - protein, 24 aa, Mycobacterium
AAATPAGPPVMSTGDSGTASVTPA

SEQ ID NO: 409308 - protein, 10 aa, Mycobacterium
AAATPDSNGI

SEQ ID NO: 409309 - protein, 9 aa, Mycobacterium
AAATPGARL

SEQ ID NO: 409310 - protein, 15 aa, Mycobacterium
AAATPGTADKIVVTF

SEQ ID NO: 409311 - protein, 25 aa, Mycobacterium
AAATPKALGETQFRPDADGYDSSMP

SEQ ID NO: 409312 - protein, 5 aa, Mycobacterium
AAATQ

SEQ ID NO: 409313 - protein, 8 aa, Mycobacterium
AAATQGPS

SEQ ID NO: 409314 - protein, 8 aa, Mycobacterium
AAATQGVR

SEQ ID NO: 409315 - protein, 8 aa, Mycobacterium
AAATQIGE

SEQ ID NO: 409316 - protein, 6 aa, Mycobacterium
AAATQL

SEQ ID NO: 409317 - protein, 22 aa, Mycobacterium
AAATQRPDRLPGVGAQGADGSH

SEQ ID NO: 409318 - protein, 20 aa, Mycobacterium
AAATQRPDRLPGVGSSSHIP

SEQ ID NO: 409319 - protein, 20 aa, Mycobacterium
AAATQRPDRLPGVGSSSHVP

SEQ ID NO: 409320 - protein, 22 aa, Mycobacterium
AAATQRPDRLPGVGSSTHIPPL

SEQ ID NO: 409321 - protein, 20 aa, Mycobacterium
AAATQRPGRLPGVGSSSHVP

SEQ ID NO: 409322 - protein, 9 aa, Mycobacterium
AAATQVGGD

SEQ ID NO: 409323 - protein, 11 aa, Mycobacterium
AAATRGGDAVP

SEQ ID NO: 409324 - protein, 7 aa, Mycobacterium
AAATRNA

SEQ ID NO: 409325 - protein, 8 aa, Mycobacterium
AAATRNEQ

SEQ ID NO: 409326 - protein, 10 aa, Mycobacterium
AAATRRPQPV

SEQ ID NO: 409327 - protein, 9 aa, Mycobacterium
AAATRRSRP

SEQ ID NO: 409328 - protein, 5 aa, Mycobacterium
AAATS

SEQ ID NO: 409329 - protein, 7 aa, Mycobacterium
AAATSAI

SEQ ID NO: 409330 - protein, 12 aa, Mycobacterium
AAATSKTSGLIF

SEQ ID NO: 409331 - protein, 13 aa, Mycobacterium
AAATSLDKGVDNG

SEQ ID NO: 409332 - protein, 10 aa, Mycobacterium
AAATSLGGDG

SEQ ID NO: 409333 - protein, 13 aa, Mycobacterium
AAATSLPAADARA

SEQ ID NO: 409334 - protein, 9 aa, Mycobacterium
AAATSPGRL

SEQ ID NO: 409335 - protein, 10 aa, Mycobacterium
AAATSTARLG

SEQ ID NO: 409336 - protein, 11 aa, Mycobacterium
AAATSTDYDEA

SEQ ID NO: 409337 - protein, 9 aa, Mycobacterium
AAATTAGAL

SEQ ID NO: 409338 - protein, 7 aa, Mycobacterium
AAATTAL

SEQ ID NO: 409339 - protein, 16 aa, Mycobacterium
AAATTALDASRTPGLH

SEQ ID NO: 409340 - protein, 7 aa, Mycobacterium
AAATTAS

SEQ ID NO: 409341 - protein, 12 aa, Mycobacterium
AAATTDAYDDAL

SEQ ID NO: 409342 - protein, 9 aa, Mycobacterium
AAATTTASV

SEQ ID NO: 409343 - protein, 6 aa, Mycobacterium
AAATTY

SEQ ID NO: 409344 - protein, 9 aa, Mycobacterium
AAATVNAGQ

SEQ ID NO: 409345 - protein, 13 aa, Mycobacterium
AAAVEGPSAAIDR

SEQ ID NO: 409346 - protein, 7 aa, Mycobacterium
AAAVNPK

SEQ ID NO: 409347 - protein, 6 aa, Mycobacterium
AAAVPT

SEQ ID NO: 409348 - protein, 7 aa, Mycobacterium
AAAVQGV

SEQ ID NO: 409349 - protein, 13 aa, Mycobacterium
AAAVQRGSGPDRA

SEQ ID NO: 409350 - protein, 16 aa, Mycobacterium
AAAVSAPLRADTASGR

SEQ ID NO: 409351 - protein, 8 aa, Mycobacterium
AAAVSDPV

SEQ ID NO: 409352 - protein, 9 aa, Mycobacterium
AAAVSKSTV

SEQ ID NO: 409353 - protein, 10 aa, Mycobacterium
AAAVSNEQAA

SEQ ID NO: 409354 - protein, 9 aa, Mycobacterium
AAAVSPDDV

SEQ ID NO: 409355 - protein, 6 aa, Mycobacterium
AAAVSS

SEQ ID NO: 409356 - protein, 19 aa, Mycobacterium
AAAVTEASANSAGNQSSTL

SEQ ID NO: 409357 - protein, 4 aa, Mycobacterium
AAAY

SEQ ID NO: 409358 - protein, 7 aa, Mycobacterium
AAAYEPD

SEQ ID NO: 409359 - protein, 14 aa, Mycobacterium
AAAYERGRPSYPPE

SEQ ID NO: 409360 - protein, 12 aa, Mycobacterium
AAAYGDARDADR

SEQ ID NO: 409361 - protein, 12 aa, Mycobacterium
AAAYGGSRDADR

SEQ ID NO: 409362 - protein, 11 aa, Mycobacterium
AAAYGPDQQEG

SEQ ID NO: 409363 - protein, 12 aa, Mycobacterium
AAAYGPGTNEDN

SEQ ID NO: 409364 - protein, 9 aa, Mycobacterium
AAAYPDPAL

SEQ ID NO: 409365 - protein, 9 aa, Mycobacterium
AAAYPNENY

SEQ ID NO: 409366 - protein, 6 aa, Mycobacterium
AAAYQA

SEQ ID NO: 409367 - protein, 6 aa, Mycobacterium
AAAYQT

SEQ ID NO: 409368 - protein, 6 aa, Mycobacterium
AAAYRS

SEQ ID NO: 409369 - protein, 5 aa, Mycobacterium
AAAYT

SEQ ID NO: 409370 - protein, 8 aa, Mycobacterium
AAAYTAAE

SEQ ID NO: 409371 - protein, 6 aa, Mycobacterium
AACGPP

SEQ ID NO: 409372 - protein, 7 aa, Mycobacterium
AACPPEA

SEQ ID NO: 409373 - protein, 12 aa, Mycobacterium
AACTPTDAPADV

SEQ ID NO: 409374 - protein, 5 aa, Mycobacterium
AADAA

SEQ ID NO: 409375 - protein, 6 aa, Mycobacterium
AADAAA

SEQ ID NO: 409376 - protein, 7 aa, Mycobacterium
AADAAAA

SEQ ID NO: 409377 - protein, 11 aa, Mycobacterium
AADAAAALTDA

SEQ ID NO: 409378 - protein, 12 aa, Mycobacterium
AADAAAQARRCG

SEQ ID NO: 409379 - protein, 6 aa, Mycobacterium
AADAAE

SEQ ID NO: 409380 - protein, 7 aa, Mycobacterium
AADAAGA

SEQ ID NO: 409381 - protein, 8 aa, Mycobacterium
AADAAGLA

SEQ ID NO: 409382 - protein, 17 aa, Mycobacterium
AADAAGRIKHVEALREL

SEQ ID NO: 409383 - protein, 6 aa, Mycobacterium
AADAAR

SEQ ID NO: 409384 - protein, 19 aa, Mycobacterium
AADAARGAARGIAADAARA

SEQ ID NO: 409385 - protein, 7 aa, Mycobacterium
AADAARK

SEQ ID NO: 409386 - protein, 7 aa, Mycobacterium
AADAATV

SEQ ID NO: 409387 - protein, 5 aa, Mycobacterium
AADAD

SEQ ID NO: 409388 - protein, 6 aa, Mycobacterium
AADADA

SEQ ID NO: 409389 - protein, 11 aa, Mycobacterium
AADADADDMGR

SEQ ID NO: 409390 - protein, 7 aa, Mycobacterium
AADADAL

SEQ ID NO: 409391 - protein, 7 aa, Mycobacterium
AADADDV

SEQ ID NO: 409392 - protein, 7 aa, Mycobacterium
AADADEA

SEQ ID NO: 409393 - protein, 10 aa, Mycobacterium
AADADGRVTA

SEQ ID NO: 409394 - protein, 9 aa, Mycobacterium
AADADQGPA

SEQ ID NO: 409395 - protein, 10 aa, Mycobacterium
AADAEAETVA

SEQ ID NO: 409396 - protein, 7 aa, Mycobacterium
AADAEAG

SEQ ID NO: 409397 - protein, 8 aa, Mycobacterium
AADAEAVE

SEQ ID NO: 409398 - protein, 8 aa, Mycobacterium
AADAEDAV

SEQ ID NO: 409399 - protein, 9 aa, Mycobacterium
AADAEEGPA

SEQ ID NO: 409400 - protein, 11 aa, Mycobacterium
AADAEESPAYC

SEQ ID NO: 409401 - protein, 7 aa, Mycobacterium
AADAEGL

SEQ ID NO: 409402 - protein, 9 aa, Mycobacterium
AADAEQGPA

SEQ ID NO: 409403 - protein, 10 aa, Mycobacterium
AADAESGEPR

SEQ ID NO: 409404 - protein, 7 aa, Mycobacterium
AADAGAA

SEQ ID NO: 409405 - protein, 11 aa, Mycobacterium
AADAGADATAR

SEQ ID NO: 409406 - protein, 7 aa, Mycobacterium
AADAGAH

SEQ ID NO: 409407 - protein, 11 aa, Mycobacterium
AADAGATAMTD

SEQ ID NO: 409408 - protein, 7 aa, Mycobacterium
AADAGAV

SEQ ID NO: 409409 - protein, 9 aa, Mycobacterium
AADAGDAGA

SEQ ID NO: 409410 - protein, 7 aa, Mycobacterium
AADAGDT

SEQ ID NO: 409411 - protein, 7 aa, Mycobacterium
AADAGEI

SEQ ID NO: 409412 - protein, 7 aa, Mycobacterium
AADAGGV

SEQ ID NO: 409413 - protein, 8 aa, Mycobacterium
AADAGLTG

SEQ ID NO: 409414 - protein, 6 aa, Mycobacterium
AADAGM

SEQ ID NO: 409415 - protein, 9 aa, Mycobacterium
AADAGPETV

SEQ ID NO: 409416 - protein, 8 aa, Mycobacterium
AADAGSDH

SEQ ID NO: 409417 - protein, 8 aa, Mycobacterium
AADAGTAV

SEQ ID NO: 409418 - protein, 6 aa, Mycobacterium
AADAHR

SEQ ID NO: 409419 - protein, 15 aa, Mycobacterium
AADALAETAASVGGT

SEQ ID NO: 409420 - protein, 5 aa, Mycobacterium
AADAP

SEQ ID NO: 409421 - protein, 16 aa, Mycobacterium
AADAPAPFGAGPAAEI

SEQ ID NO: 409422 - protein, 7 aa, Mycobacterium
AADAPAR

SEQ ID NO: 409423 - protein, 14 aa, Mycobacterium
AADAPEQPETFPRD

SEQ ID NO: 409424 - protein, 17 aa, Mycobacterium
AADAPEWAYPPDGRPGV

SEQ ID NO: 409425 - protein, 9 aa, Mycobacterium
AADAPGASV

SEQ ID NO: 409426 - protein, 9 aa, Mycobacterium
AADAPGHLT

SEQ ID NO: 409427 - protein, 7 aa, Mycobacterium
AADAPGL

SEQ ID NO: 409428 - protein, 10 aa, Mycobacterium
AADAPTQPLR

SEQ ID NO: 409429 - protein, 8 aa, Mycobacterium
AADAPTVA

SEQ ID NO: 409430 - protein, 9 aa, Mycobacterium
AADAPTVTA

SEQ ID NO: 409431 - protein, 9 aa, Mycobacterium
AADARDAVR

SEQ ID NO: 409432 - protein, 6 aa, Mycobacterium
AADASA

SEQ ID NO: 409433 - protein, 7 aa, Mycobacterium
AADASAL

SEQ ID NO: 409434 - protein, 15 aa, Mycobacterium
AADASDDDAAGETEA

SEQ ID NO: 409435 - protein, 19 aa, Mycobacterium
AADASGAGHFGPNPATNPN

SEQ ID NO: 409436 - protein, 9 aa, Mycobacterium
AADASRATY

SEQ ID NO: 409437 - protein, 5 aa, Mycobacterium
AADAT

SEQ ID NO: 409438 - protein, 7 aa, Mycobacterium
AADATDA

SEQ ID NO: 409439 - protein, 8 aa, Mycobacterium
AADATGLD

SEQ ID NO: 409440 - protein, 8 aa, Mycobacterium
AADATGRL

SEQ ID NO: 409441 - protein, 7 aa, Mycobacterium
AADATYA

SEQ ID NO: 409442 - protein, 16 aa, Mycobacterium
AADAVDGGVRRVDIPD

SEQ ID NO: 409443 - protein, 4 aa, Mycobacterium
AADD

SEQ ID NO: 409444 - protein, 7 aa, Mycobacterium
AADDAER

SEQ ID NO: 409445 - protein, 7 aa, Mycobacterium
AADDAQG

SEQ ID NO: 409446 - protein, 8 aa, Mycobacterium
AADDATQD

SEQ ID NO: 409447 - protein, 13 aa, Mycobacterium
AADDDDPDDPDHE

SEQ ID NO: 409448 - protein, 8 aa, Mycobacterium
AADDEATY

SEQ ID NO: 409449 - protein, 5 aa, Mycobacterium
AADDG

SEQ ID NO: 409450 - protein, 9 aa, Mycobacterium
AADDGDDAA

SEQ ID NO: 409451 - protein, 9 aa, Mycobacterium
AADDGQAYG

SEQ ID NO: 409452 - protein, 11 aa, Mycobacterium
AADDIGETDEY

SEQ ID NO: 409453 - protein, 9 aa, Mycobacterium
AADDIQTGI

SEQ ID NO: 409454 - protein, 7 aa, Mycobacterium
AADDKDA

SEQ ID NO: 409455 - protein, 6 aa, Mycobacterium
AADDKV

SEQ ID NO: 409456 - protein, 18 aa, Mycobacterium
AADDLGIDSSAASAYDTP

SEQ ID NO: 409457 - protein, 14 aa, Mycobacterium
AADDLTAGYPQRTE

SEQ ID NO: 409458 - protein, 5 aa, Mycobacterium
AADDP

SEQ ID NO: 409459 - protein, 8 aa, Mycobacterium
AADDPAAA

SEQ ID NO: 409460 - protein, 9 aa, Mycobacterium
AADDPAGAE

SEQ ID NO: 409461 - protein, 11 aa, Mycobacterium
AADDPAQDTLE

SEQ ID NO: 409462 - protein, 7 aa, Mycobacterium
AADDPDL

SEQ ID NO: 409463 - protein, 9 aa, Mycobacterium
AADDPHGTN

SEQ ID NO: 409464 - protein, 19 aa, Mycobacterium
AADDPKAAAEDLKAAISAA

SEQ ID NO: 409465 - protein, 19 aa, Mycobacterium
AADDPKAAAQQLRSALPAA

SEQ ID NO: 409466 - protein, 11 aa, Mycobacterium
AADDPKSGLAK

SEQ ID NO: 409467 - protein, 19 aa, Mycobacterium
AADDPREAAAKLKSELLAA

SEQ ID NO: 409468 - protein, 9 aa, Mycobacterium
AADDPSSAG

SEQ ID NO: 409469 - protein, 7 aa, Mycobacterium
AADDPTL

SEQ ID NO: 409470 - protein, 50 aa, Mycobacterium
AADDQEGRQDLAPGTQSADVQTGAAPGSRPLQSADVQTGAAAGSRPPATQ

SEQ ID NO: 409471 - protein, 5 aa, Mycobacterium
AADDR

SEQ ID NO: 409472 - protein, 6 aa, Mycobacterium
AADDRG

SEQ ID NO: 409473 - protein, 8 aa, Mycobacterium
AADDRPSR

SEQ ID NO: 409474 - protein, 8 aa, Mycobacterium
AADDRRDV

SEQ ID NO: 409475 - protein, 8 aa, Mycobacterium
AADDRYDK

SEQ ID NO: 409476 - protein, 5 aa, Mycobacterium
AADDT

SEQ ID NO: 409477 - protein, 5 aa, Mycobacterium
AADDV

SEQ ID NO: 409478 - protein, 6 aa, Mycobacterium
AADDYP

SEQ ID NO: 409479 - protein, 5 aa, Mycobacterium
AADEA

SEQ ID NO: 409480 - protein, 10 aa, Mycobacterium
AADEAAAQVT

SEQ ID NO: 409481 - protein, 7 aa, Mycobacterium
AADEAAV

SEQ ID NO: 409482 - protein, 7 aa, Mycobacterium
AADEAEA

SEQ ID NO: 409483 - protein, 8 aa, Mycobacterium
AADEAGLP

SEQ ID NO: 409484 - protein, 15 aa, Mycobacterium
AADEAGRLSERELQA

SEQ ID NO: 409485 - protein, 8 aa, Mycobacterium
AADEAGVP

SEQ ID NO: 409486 - protein, 10 aa, Mycobacterium
AADEAGVSRG

SEQ ID NO: 409487 - protein, 13 aa, Mycobacterium
AADEAQEFSREVG

SEQ ID NO: 409488 - protein, 10 aa, Mycobacterium
AADEARRTEL

SEQ ID NO: 409489 - protein, 11 aa, Mycobacterium
AADEASKEPVG

SEQ ID NO: 409490 - protein, 5 aa, Mycobacterium
AADED

SEQ ID NO: 409491 - protein, 9 aa, Mycobacterium
AADEDAVRD

SEQ ID NO: 409492 - protein, 8 aa, Mycobacterium
AADEDGTL

SEQ ID NO: 409493 - protein, 7 aa, Mycobacterium
AADEDTY

SEQ ID NO: 409494 - protein, 14 aa, Mycobacterium
AADEEADGGKGAQW

SEQ ID NO: 409495 - protein, 6 aa, Mycobacterium
AADEHG

SEQ ID NO: 409496 - protein, 9 aa, Mycobacterium
AADEKESAL

SEQ ID NO: 409497 - protein, 9 aa, Mycobacterium
AADEKESQL

SEQ ID NO: 409498 - protein, 5 aa, Mycobacterium
AADEL

SEQ ID NO: 409499 - protein, 6 aa, Mycobacterium
AADELG

SEQ ID NO: 409500 - protein, 10 aa, Mycobacterium
AADEPAPGDL

SEQ ID NO: 409501 - protein, 6 aa, Mycobacterium
AADEPD

SEQ ID NO: 409502 - protein, 8 aa, Mycobacterium
AADEPDPV

SEQ ID NO: 409503 - protein, 7 aa, Mycobacterium
AADEPLD

SEQ ID NO: 409504 - protein, 5 aa, Mycobacterium
AADER

SEQ ID NO: 409505 - protein, 5 aa, Mycobacterium
AADES

SEQ ID NO: 409506 - protein, 13 aa, Mycobacterium
AADESLAEFRVVA

SEQ ID NO: 409507 - protein, 18 aa, Mycobacterium
AADETASSLSGSGHESAR

SEQ ID NO: 409508 - protein, 6 aa, Mycobacterium
AADETL

SEQ ID NO: 409509 - protein, 11 aa, Mycobacterium
AADETPAPPWR

SEQ ID NO: 409510 - protein, 9 aa, Mycobacterium
AADEVGQGR

SEQ ID NO: 409511 - protein, 7 aa, Mycobacterium
AADEVST

SEQ ID NO: 409512 - protein, 7 aa, Mycobacterium
AADFDDE

SEQ ID NO: 409513 - protein, 7 aa, Mycobacterium
AADFPAN

SEQ ID NO: 409514 - protein, 7 aa, Mycobacterium
AADGADT

SEQ ID NO: 409515 - protein, 15 aa, Mycobacterium
AADGAGGAGDDGVGP

SEQ ID NO: 409516 - protein, 8 aa, Mycobacterium
AADGAGLS

SEQ ID NO: 409517 - protein, 14 aa, Mycobacterium
AADGAGNTEKRWDT

SEQ ID NO: 409518 - protein, 8 aa, Mycobacterium
AADGATPV

SEQ ID NO: 409519 - protein, 7 aa, Mycobacterium
AADGDAR

SEQ ID NO: 409520 - protein, 6 aa, Mycobacterium
AADGDE

SEQ ID NO: 409521 - protein, 10 aa, Mycobacterium
AADGDGGYIG

SEQ ID NO: 409522 - protein, 11 aa, Mycobacterium
AADGDTPADTA

SEQ ID NO: 409523 - protein, 10 aa, Mycobacterium
AADGDTRVRT

SEQ ID NO: 409524 - protein, 6 aa, Mycobacterium
AADGEA

SEQ ID NO: 409525 - protein, 9 aa, Mycobacterium
AADGEALTE

SEQ ID NO: 409526 - protein, 7 aa, Mycobacterium
AADGEGK

SEQ ID NO: 409527 - protein, 6 aa, Mycobacterium
AADGEL

SEQ ID NO: 409528 - protein, 11 aa, Mycobacterium
AADGEQGRRDS

SEQ ID NO: 409529 - protein, 5 aa, Mycobacterium
AADGG

SEQ ID NO: 409530 - protein, 9 aa, Mycobacterium
AADGGDGNA

SEQ ID NO: 409531 - protein, 12 aa, Mycobacterium
AADGGDTGSGAH

SEQ ID NO: 409532 - protein, 8 aa, Mycobacterium
AADGGEPF

SEQ ID NO: 409533 - protein, 15 aa, Mycobacterium
AADGGGAVAAAAAIA

SEQ ID NO: 409534 - protein, 17 aa, Mycobacterium
AADGGLGRPRADAGIGP

SEQ ID NO: 409535 - protein, 6 aa, Mycobacterium
AADGGV

SEQ ID NO: 409536 - protein, 12 aa, Mycobacterium
AADGGYLGQSLL

SEQ ID NO: 409537 - protein, 6 aa, Mycobacterium
AADGHP

SEQ ID NO: 409538 - protein, 8 aa, Mycobacterium
AADGHQPV

SEQ ID NO: 409539 - protein, 6 aa, Mycobacterium
AADGLE

SEQ ID NO: 409540 - protein, 7 aa, Mycobacterium
AADGLRG

SEQ ID NO: 409541 - protein, 11 aa, Mycobacterium
AADGMARGEGR

SEQ ID NO: 409542 - protein, 8 aa, Mycobacterium
AADGPASA

SEQ ID NO: 409543 - protein, 7 aa, Mycobacterium
AADGPME

SEQ ID NO: 409544 - protein, 6 aa, Mycobacterium
AADGRD

SEQ ID NO: 409545 - protein, 6 aa, Mycobacterium
AADGRE

SEQ ID NO: 409546 - protein, 7 aa, Mycobacterium
AADGRPA

SEQ ID NO: 409547 - protein, 9 aa, Mycobacterium
AADGRPPAS

SEQ ID NO: 409548 - protein, 8 aa, Mycobacterium
AADGRVSQ

SEQ ID NO: 409549 - protein, 12 aa, Mycobacterium
AADGSDSNSGAR

SEQ ID NO: 409550 - protein, 11 aa, Mycobacterium
AADGSFSPDYG

SEQ ID NO: 409551 - protein, 8 aa, Mycobacterium
AADGSGDY

SEQ ID NO: 409552 - protein, 6 aa, Mycobacterium
AADGSI

SEQ ID NO: 409553 - protein, 9 aa, Mycobacterium
AADGSLDPV

SEQ ID NO: 409554 - protein, 15 aa, Mycobacterium
AADGSLETLFSAPVS

SEQ ID NO: 409555 - protein, 9 aa, Mycobacterium
AADGSRASA

SEQ ID NO: 409556 - protein, 8 aa, Mycobacterium
AADGSRQR

SEQ ID NO: 409557 - protein, 9 aa, Mycobacterium
AADGSRRDT

SEQ ID NO: 409558 - protein, 8 aa, Mycobacterium
AADGSRRR

SEQ ID NO: 409559 - protein, 7 aa, Mycobacterium
AADGSSV

SEQ ID NO: 409560 - protein, 6 aa, Mycobacterium
AADGST

SEQ ID NO: 409561 - protein, 13 aa, Mycobacterium
AADGSTESSSPRI

SEQ ID NO: 409562 - protein, 17 aa, Mycobacterium
AADGSTVNVSGTLTGPQ

SEQ ID NO: 409563 - protein, 8 aa, Mycobacterium
AADGSTVR

SEQ ID NO: 409564 - protein, 12 aa, Mycobacterium
AADGSVDHAEAE

SEQ ID NO: 409565 - protein, 10 aa, Mycobacterium
AADGSVSPAA

SEQ ID NO: 409566 - protein, 5 aa, Mycobacterium
AADGT

SEQ ID NO: 409567 - protein, 6 aa, Mycobacterium
AADGTA

SEQ ID NO: 409568 - protein, 8 aa, Mycobacterium
AADGTDVD

SEQ ID NO: 409569 - protein, 9 aa, Mycobacterium
AADGTGFAE

SEQ ID NO: 409570 - protein, 10 aa, Mycobacterium
AADGTGWGEG

SEQ ID NO: 409571 - protein, 6 aa, Mycobacterium
AADGTL

SEQ ID NO: 409572 - protein, 7 aa, Mycobacterium
AADGTLQ

SEQ ID NO: 409573 - protein, 7 aa, Mycobacterium
AADGTPL

SEQ ID NO: 409574 - protein, 9 aa, Mycobacterium
AADGTRDGL

SEQ ID NO: 409575 - protein, 8 aa, Mycobacterium
AADGTRKQ

SEQ ID NO: 409576 - protein, 6 aa, Mycobacterium
AADGTW

SEQ ID NO: 409577 - protein, 10 aa, Mycobacterium
AADGVAAAAA

SEQ ID NO: 409578 - protein, 7 aa, Mycobacterium
AADGVPG

SEQ ID NO: 409579 - protein, 10 aa, Mycobacterium
AADGVRSLPG

SEQ ID NO: 409580 - protein, 10 aa, Mycobacterium
AADGVSPPTA

SEQ ID NO: 409581 - protein, 7 aa, Mycobacterium
AADGYEA

SEQ ID NO: 409582 - protein, 4 aa, Mycobacterium
AADH

SEQ ID NO: 409583 - protein, 11 aa, Mycobacterium
AADHAASAERL

SEQ ID NO: 409584 - protein, 7 aa, Mycobacterium
AADHGAS

SEQ ID NO: 409585 - protein, 8 aa, Mycobacterium
AADHKAAR

SEQ ID NO: 409586 - protein, 6 aa, Mycobacterium
AADHRP

SEQ ID NO: 409587 - protein, 4 aa, Mycobacterium
AADI

SEQ ID NO: 409588 - protein, 7 aa, Mycobacterium
AADIPPG

SEQ ID NO: 409589 - protein, 20 aa, Mycobacterium
AADKATADKMNRIQQGLVGH

SEQ ID NO: 409590 - protein, 7 aa, Mycobacterium
AADKGAR

SEQ ID NO: 409591 - protein, 13 aa, Mycobacterium
AADKGKALADELG

SEQ ID NO: 409592 - protein, 14 aa, Mycobacterium
AADKHKVAGKPEEI

SEQ ID NO: 409593 - protein, 6 aa, Mycobacterium
AADKLE

SEQ ID NO: 409594 - protein, 21 aa, Mycobacterium
AADKPDSGQSTYAATKGGLES

SEQ ID NO: 409595 - protein, 9 aa, Mycobacterium
AADKRQVDR

SEQ ID NO: 409596 - protein, 10 aa, Mycobacterium
AADKRQVEGV

SEQ ID NO: 409597 - protein, 16 aa, Mycobacterium
AADKYPQEFSGGQRQR

SEQ ID NO: 409598 - protein, 6 aa, Mycobacterium
AADLDE

SEQ ID NO: 409599 - protein, 15 aa, Mycobacterium
AADLDEREKALQRRE

SEQ ID NO: 409600 - protein, 9 aa, Mycobacterium
AADLDGAGI

SEQ ID NO: 409601 - protein, 10 aa, Mycobacterium
AADLESPNDF

SEQ ID NO: 409602 - protein, 6 aa, Mycobacterium
AADLGA

SEQ ID NO: 409603 - protein, 13 aa, Mycobacterium
AADLGAADTTPDN

SEQ ID NO: 409604 - protein, 9 aa, Mycobacterium
AADLGASTV

SEQ ID NO: 409605 - protein, 9 aa, Mycobacterium
AADLGGGDI

SEQ ID NO: 409606 - protein, 9 aa, Mycobacterium
AADLGGPYG

SEQ ID NO: 409607 - protein, 30 aa, Mycobacterium
AADLGPRRALTGEPLAPQLSATAAAQRDGL

SEQ ID NO: 409608 - protein, 8 aa, Mycobacterium
AADLGTRR

SEQ ID NO: 409609 - protein, 6 aa, Mycobacterium
AADLGY

SEQ ID NO: 409610 - protein, 11 aa, Mycobacterium
AADLGYSGLPA

SEQ ID NO: 409611 - protein, 5 aa, Mycobacterium
AADLP

SEQ ID NO: 409612 - protein, 7 aa, Mycobacterium
AADLPGA

SEQ ID NO: 409613 - protein, 7 aa, Mycobacterium
AADLPRG

SEQ ID NO: 409614 - protein, 16 aa, Mycobacterium
AADLPSAIDGPTIGSN

SEQ ID NO: 409615 - protein, 7 aa, Mycobacterium
AADLPTD

SEQ ID NO: 409616 - protein, 14 aa, Mycobacterium
AADLTKGIGDCSSA

SEQ ID NO: 409617 - protein, 11 aa, Mycobacterium
AADNAGRPAPR

SEQ ID NO: 409618 - protein, 7 aa, Mycobacterium
AADNAKY

SEQ ID NO: 409619 - protein, 7 aa, Mycobacterium
AADNFSA

SEQ ID NO: 409620 - protein, 7 aa, Mycobacterium
AADNGQW

SEQ ID NO: 409621 - protein, 9 aa, Mycobacterium
AADNPNSPH

SEQ ID NO: 409622 - protein, 6 aa, Mycobacterium
AADNPQ

SEQ ID NO: 409623 - protein, 11 aa, Mycobacterium
AADNPSPLAGL

SEQ ID NO: 409624 - protein, 8 aa, Mycobacterium
AADNPVGV

SEQ ID NO: 409625 - protein, 15 aa, Mycobacterium
AADNSIDATSSRDFA

SEQ ID NO: 409626 - protein, 8 aa, Mycobacterium
AADPAEIR

SEQ ID NO: 409627 - protein, 7 aa, Mycobacterium
AADPAGL

SEQ ID NO: 409628 - protein, 14 aa, Mycobacterium
AADPAGQTARRQRE

SEQ ID NO: 409629 - protein, 11 aa, Mycobacterium
AADPAGSGSPL

SEQ ID NO: 409630 - protein, 10 aa, Mycobacterium
AADPAGTATV

SEQ ID NO: 409631 - protein, 9 aa, Mycobacterium
AADPAPRSL

SEQ ID NO: 409632 - protein, 7 aa, Mycobacterium
AADPAQL

SEQ ID NO: 409633 - protein, 7 aa, Mycobacterium
AADPARR

SEQ ID NO: 409634 - protein, 10 aa, Mycobacterium
AADPARTRWN

SEQ ID NO: 409635 - protein, 9 aa, Mycobacterium
AADPATAAL

SEQ ID NO: 409636 - protein, 8 aa, Mycobacterium
AADPATAG

SEQ ID NO: 409637 - protein, 8 aa, Mycobacterium
AADPATAQ

SEQ ID NO: 409638 - protein, 9 aa, Mycobacterium
AADPATATL

SEQ ID NO: 409639 - protein, 10 aa, Mycobacterium
AADPATRRGH

SEQ ID NO: 409640 - protein, 6 aa, Mycobacterium
AADPAV

SEQ ID NO: 409641 - protein, 8 aa, Mycobacterium
AADPDAAT

SEQ ID NO: 409642 - protein, 11 aa, Mycobacterium
AADPDDPARTV

SEQ ID NO: 409643 - protein, 11 aa, Mycobacterium
AADPDDWNPPQ

SEQ ID NO: 409644 - protein, 8 aa, Mycobacterium
AADPDGRT

SEQ ID NO: 409645 - protein, 6 aa, Mycobacterium
AADPDQ

SEQ ID NO: 409646 - protein, 10 aa, Mycobacterium
AADPDRPAVS

SEQ ID NO: 409647 - protein, 9 aa, Mycobacterium
AADPDRRLS

SEQ ID NO: 409648 - protein, 9 aa, Mycobacterium
AADPDSGTP

SEQ ID NO: 409649 - protein, 8 aa, Mycobacterium
AADPEARY

SEQ ID NO: 409650 - protein, 6 aa, Mycobacterium
AADPEN

SEQ ID NO: 409651 - protein, 14 aa, Mycobacterium
AADPEQFPEAGEPW

SEQ ID NO: 409652 - protein, 7 aa, Mycobacterium
AADPESL

SEQ ID NO: 409653 - protein, 6 aa, Mycobacterium
AADPGC

SEQ ID NO: 409654 - protein, 14 aa, Mycobacterium
AADPGLRDKVDGKI

SEQ ID NO: 409655 - protein, 6 aa, Mycobacterium
AADPGQ

SEQ ID NO: 409656 - protein, 8 aa, Mycobacterium
AADPGRPL

SEQ ID NO: 409657 - protein, 8 aa, Mycobacterium
AADPGRPM

SEQ ID NO: 409658 - protein, 8 aa, Mycobacterium
AADPGSPI

SEQ ID NO: 409659 - protein, 7 aa, Mycobacterium
AADPGTE

SEQ ID NO: 409660 - protein, 10 aa, Mycobacterium
AADPGTGNAA

SEQ ID NO: 409661 - protein, 7 aa, Mycobacterium
AADPGVL

SEQ ID NO: 409662 - protein, 16 aa, Mycobacterium
AADPHGQAVDNCPDGT

SEQ ID NO: 409663 - protein, 10 aa, Mycobacterium
AADPHSPAPS

SEQ ID NO: 409664 - protein, 5 aa, Mycobacterium
AADPI

SEQ ID NO: 409665 - protein, 7 aa, Mycobacterium
AADPLAE

SEQ ID NO: 409666 - protein, 24 aa, Mycobacterium
AADPMAAAGASGGHGGPGGVGGVG

SEQ ID NO: 409667 - protein, 6 aa, Mycobacterium
AADPNE

SEQ ID NO: 409668 - protein, 10 aa, Mycobacterium
AADPPDQAFG

SEQ ID NO: 409669 - protein, 7 aa, Mycobacterium
AADPPHI

SEQ ID NO: 409670 - protein, 5 aa, Mycobacterium
AADPQ

SEQ ID NO: 409671 - protein, 18 aa, Mycobacterium
AADPQAAAQFNSSPESGA

SEQ ID NO: 409672 - protein, 13 aa, Mycobacterium
AADPQSVDYRPGT

SEQ ID NO: 409673 - protein, 10 aa, Mycobacterium
AADPRIGEVR

SEQ ID NO: 409674 - protein, 9 aa, Mycobacterium
AADPRKWTP

SEQ ID NO: 409675 - protein, 6 aa, Mycobacterium
AADPRP

SEQ ID NO: 409676 - protein, 10 aa, Mycobacterium
AADPRSAARV

SEQ ID NO: 409677 - protein, 6 aa, Mycobacterium
AADPRT

SEQ ID NO: 409678 - protein, 5 aa, Mycobacterium
AADPS

SEQ ID NO: 409679 - protein, 8 aa, Mycobacterium
AADPSDAA

SEQ ID NO: 409680 - protein, 7 aa, Mycobacterium
AADPSHH

SEQ ID NO: 409681 - protein, 12 aa, Mycobacterium
AADPSLRERQPY

SEQ ID NO: 409682 - protein, 25 aa, Mycobacterium
AADPSMPISGHKQSGWGGERGRKGI

SEQ ID NO: 409683 - protein, 11 aa, Mycobacterium
AADPSNTPQQA

SEQ ID NO: 409684 - protein, 10 aa, Mycobacterium
AADPSPVMST

SEQ ID NO: 409685 - protein, 8 aa, Mycobacterium
AADPSRPV

SEQ ID NO: 409686 - protein, 14 aa, Mycobacterium
AADPSVSLPQDGIE

SEQ ID NO: 409687 - protein, 8 aa, Mycobacterium
AADPTAIR

SEQ ID NO: 409688 - protein, 7 aa, Mycobacterium
AADPTEL

SEQ ID NO: 409689 - protein, 9 aa, Mycobacterium
AADPTGPKA

SEQ ID NO: 409690 - protein, 6 aa, Mycobacterium
AADPTL

SEQ ID NO: 409691 - protein, 7 aa, Mycobacterium
AADPTLR

SEQ ID NO: 409692 - protein, 10 aa, Mycobacterium
AADPTPEGAR

SEQ ID NO: 409693 - protein, 8 aa, Mycobacterium
AADPTPRT

SEQ ID NO: 409694 - protein, 37 aa, Mycobacterium
AADPTRGALTKPAEPAAAADPQQPPAAPAVSAGPAHA

SEQ ID NO: 409695 - protein, 13 aa, Mycobacterium
AADPVQDAREMSS

SEQ ID NO: 409696 - protein, 4 aa, Mycobacterium
AADQ

SEQ ID NO: 409697 - protein, 9 aa, Mycobacterium
AADQDDPAA

SEQ ID NO: 409698 - protein, 8 aa, Mycobacterium
AADQGPRL

SEQ ID NO: 409699 - protein, 7 aa, Mycobacterium
AADQGRE

SEQ ID NO: 409700 - protein, 7 aa, Mycobacterium
AADQLDE

SEQ ID NO: 409701 - protein, 6 aa, Mycobacterium
AADQNA

SEQ ID NO: 409702 - protein, 6 aa, Mycobacterium
AADQQA

SEQ ID NO: 409703 - protein, 7 aa, Mycobacterium
AADQRLE

SEQ ID NO: 409704 - protein, 5 aa, Mycobacterium
AADRA

SEQ ID NO: 409705 - protein, 8 aa, Mycobacterium
AADRAAAG

SEQ ID NO: 409706 - protein, 9 aa, Mycobacterium
AADRAENVR

SEQ ID NO: 409707 - protein, 11 aa, Mycobacterium
AADRAGRDPAS

SEQ ID NO: 409708 - protein, 8 aa, Mycobacterium
AADRASGQ

SEQ ID NO: 409709 - protein, 7 aa, Mycobacterium
AADRASR

SEQ ID NO: 409710 - protein, 7 aa, Mycobacterium
AADRDAL

SEQ ID NO: 409711 - protein, 6 aa, Mycobacterium
AADRDE

SEQ ID NO: 409712 - protein, 8 aa, Mycobacterium
AADRDQAI

SEQ ID NO: 409713 - protein, 14 aa, Mycobacterium
AADRDRPDLEATSR

SEQ ID NO: 409714 - protein, 11 aa, Mycobacterium
AADRDSHANPL

SEQ ID NO: 409715 - protein, 18 aa, Mycobacterium
AADRDSTYIDDGDALRKR

SEQ ID NO: 409716 - protein, 9 aa, Mycobacterium
AADRDVSEI

SEQ ID NO: 409717 - protein, 6 aa, Mycobacterium
AADRGA

SEQ ID NO: 409718 - protein, 9 aa, Mycobacterium
AADRGATDV

SEQ ID NO: 409719 - protein, 9 aa, Mycobacterium
AADRGDGHQ

SEQ ID NO: 409720 - protein, 6 aa, Mycobacterium
AADRGI

SEQ ID NO: 409721 - protein, 7 aa, Mycobacterium
AADRGIS

SEQ ID NO: 409722 - protein, 10 aa, Mycobacterium
AADRGTDAAL

SEQ ID NO: 409723 - protein, 13 aa, Mycobacterium
AADRLDGSTRDSI

SEQ ID NO: 409724 - protein, 12 aa, Mycobacterium
AADRNGADVRPV

SEQ ID NO: 409725 - protein, 7 aa, Mycobacterium
AADRPAD

SEQ ID NO: 409726 - protein, 6 aa, Mycobacterium
AADRPV

SEQ ID NO: 409727 - protein, 13 aa, Mycobacterium
AADRPVRSYSGGM

SEQ ID NO: 409728 - protein, 20 aa, Mycobacterium
AADRQSPASTIGFVTAVRST

SEQ ID NO: 409729 - protein, 7 aa, Mycobacterium
AADRQVS

SEQ ID NO: 409730 - protein, 5 aa, Mycobacterium
AADRR

SEQ ID NO: 409731 - protein, 8 aa, Mycobacterium
AADRRARV

SEQ ID NO: 409732 - protein, 9 aa, Mycobacterium
AADRRRTAQ

SEQ ID NO: 409733 - protein, 7 aa, Mycobacterium
AADRSGA

SEQ ID NO: 409734 - protein, 8 aa, Mycobacterium
AADRSRAL

SEQ ID NO: 409735 - protein, 10 aa, Mycobacterium
AADRTGALSP

SEQ ID NO: 409736 - protein, 13 aa, Mycobacterium
AADRTGIDNDATH

SEQ ID NO: 409737 - protein, 7 aa, Mycobacterium
AADRTGR

SEQ ID NO: 409738 - protein, 8 aa, Mycobacterium
AADRTRRY

SEQ ID NO: 409739 - protein, 4 aa, Mycobacterium
AADS

SEQ ID NO: 409740 - protein, 12 aa, Mycobacterium
AADSAAASSYTA

SEQ ID NO: 409741 - protein, 15 aa, Mycobacterium
AADSAADDDVEAAAE

SEQ ID NO: 409742 - protein, 10 aa, Mycobacterium
AADSAAEAQR

SEQ ID NO: 409743 - protein, 8 aa, Mycobacterium
AADSAERS

SEQ ID NO: 409744 - protein, 9 aa, Mycobacterium
AADSDDEVA

SEQ ID NO: 409745 - protein, 16 aa, Mycobacterium
AADSDERTATWHWSRE

SEQ ID NO: 409746 - protein, 8 aa, Mycobacterium
AADSDRVD

SEQ ID NO: 409747 - protein, 18 aa, Mycobacterium
AADSEGVTDAEDRVDELA

SEQ ID NO: 409748 - protein, 7 aa, Mycobacterium
AADSFAS

SEQ ID NO: 409749 - protein, 16 aa, Mycobacterium
AADSFRKEHGGTGDVG

SEQ ID NO: 409750 - protein, 8 aa, Mycobacterium
AADSGADP

SEQ ID NO: 409751 - protein, 10 aa, Mycobacterium
AADSGAGTNQ

SEQ ID NO: 409752 - protein, 7 aa, Mycobacterium
AADSGRD

SEQ ID NO: 409753 - protein, 8 aa, Mycobacterium
AADSGSLE

SEQ ID NO: 409754 - protein, 14 aa, Mycobacterium
AADSGTSSGVGSNP

SEQ ID NO: 409755 - protein, 21 aa, Mycobacterium
AADSIEKQYQRGKLDKGERNE

SEQ ID NO: 409756 - protein, 11 aa, Mycobacterium
AADSIGETDEY

SEQ ID NO: 409757 - protein, 10 aa, Mycobacterium
AADSLDGLSP

SEQ ID NO: 409758 - protein, 15 aa, Mycobacterium
AADSNAAEGTESQKI

SEQ ID NO: 409759 - protein, 6 aa, Mycobacterium
AADSPE

SEQ ID NO: 409760 - protein, 8 aa, Mycobacterium
AADSPEAL

SEQ ID NO: 409761 - protein, 7 aa, Mycobacterium
AADSPEC

SEQ ID NO: 409762 - protein, 24 aa, Mycobacterium
AADSPGSHDRSEPLDPLAPSPLET

SEQ ID NO: 409763 - protein, 8 aa, Mycobacterium
AADSQAAT

SEQ ID NO: 409764 - protein, 16 aa, Mycobacterium
AADSQETLSEYRVPVL

SEQ ID NO: 409765 - protein, 10 aa, Mycobacterium
AADSRDVAEQ

SEQ ID NO: 409766 - protein, 6 aa, Mycobacterium
AADSRR

SEQ ID NO: 409767 - protein, 8 aa, Mycobacterium
AADSSDEI

SEQ ID NO: 409768 - protein, 8 aa, Mycobacterium
AADSSLEQ

SEQ ID NO: 409769 - protein, 19 aa, Mycobacterium
AADSTDSRAAGPAGPADTA

SEQ ID NO: 409770 - protein, 12 aa, Mycobacterium
AADSTERGRSTL

SEQ ID NO: 409771 - protein, 8 aa, Mycobacterium
AADSTLEQ

SEQ ID NO: 409772 - protein, 16 aa, Mycobacterium
AADSTPPADWDKPLDG

SEQ ID NO: 409773 - protein, 14 aa, Mycobacterium
AADSTSISARSEWA

SEQ ID NO: 409774 - protein, 12 aa, Mycobacterium
AADSTVGQGFQS

SEQ ID NO: 409775 - protein, 5 aa, Mycobacterium
AADSV

SEQ ID NO: 409776 - protein, 15 aa, Mycobacterium
AADSVPATSPAPPLL

SEQ ID NO: 409777 - protein, 24 aa, Mycobacterium
AADTAAETSTQPGASTSGLANPTL

SEQ ID NO: 409778 - protein, 23 aa, Mycobacterium
AADTAAVAEAGGGLEKARAKPGL

SEQ ID NO: 409779 - protein, 7 aa, Mycobacterium
AADTAGR

SEQ ID NO: 409780 - protein, 6 aa, Mycobacterium
AADTAN

SEQ ID NO: 409781 - protein, 28 aa, Mycobacterium
AADTANGTEDDPGNSPGNDPENGTDPRG

SEQ ID NO: 409782 - protein, 6 aa, Mycobacterium
AADTAR

SEQ ID NO: 409783 - protein, 5 aa, Mycobacterium
AADTD

SEQ ID NO: 409784 - protein, 8 aa, Mycobacterium
AADTDGNL

SEQ ID NO: 409785 - protein, 6 aa, Mycobacterium
AADTDM

SEQ ID NO: 409786 - protein, 8 aa, Mycobacterium
AADTDPQA

SEQ ID NO: 409787 - protein, 9 aa, Mycobacterium
AADTEDGRS

SEQ ID NO: 409788 - protein, 7 aa, Mycobacterium
AADTEEA

SEQ ID NO: 409789 - protein, 9 aa, Mycobacterium
AADTEEGRS

SEQ ID NO: 409790 - protein, 10 aa, Mycobacterium
AADTEEHGRD

SEQ ID NO: 409791 - protein, 10 aa, Mycobacterium
AADTGALDDP

SEQ ID NO: 409792 - protein, 8 aa, Mycobacterium
AADTGHGV

SEQ ID NO: 409793 - protein, 11 aa, Mycobacterium
AADTGLPDSSA

SEQ ID NO: 409794 - protein, 8 aa, Mycobacterium
AADTGLPI

SEQ ID NO: 409795 - protein, 19 aa, Mycobacterium
AADTGTKKPAPDRSRFIDT

SEQ ID NO: 409796 - protein, 10 aa, Mycobacterium
AADTIGETDE

SEQ ID NO: 409797 - protein, 7 aa, Mycobacterium
AADTKKT

SEQ ID NO: 409798 - protein, 6 aa, Mycobacterium
AADTLE

SEQ ID NO: 409799 - protein, 10 aa, Mycobacterium
AADTLGERGV

SEQ ID NO: 409800 - protein, 15 aa, Mycobacterium
AADTPAGDATAITPR

SEQ ID NO: 409801 - protein, 8 aa, Mycobacterium
AADTPDPV

SEQ ID NO: 409802 - protein, 7 aa, Mycobacterium
AADTPIP

SEQ ID NO: 409803 - protein, 12 aa, Mycobacterium
AADTSGGRTPSL

SEQ ID NO: 409804 - protein, 12 aa, Mycobacterium
AADTSSGRTPSL

SEQ ID NO: 409805 - protein, 14 aa, Mycobacterium
AADTTFDERSRGQV

SEQ ID NO: 409806 - protein, 12 aa, Mycobacterium
AADTTGATDPVP

SEQ ID NO: 409807 - protein, 5 aa, Mycobacterium
AADTV

SEQ ID NO: 409808 - protein, 5 aa, Mycobacterium
AADVD

SEQ ID NO: 409809 - protein, 15 aa, Mycobacterium
AADVDAARQGGTPEA

SEQ ID NO: 409810 - protein, 5 aa, Mycobacterium
AADVE

SEQ ID NO: 409811 - protein, 19 aa, Mycobacterium
AADVEADRSLRKARKDNKV

SEQ ID NO: 409812 - protein, 8 aa, Mycobacterium
AADVGRSL

SEQ ID NO: 409813 - protein, 8 aa, Mycobacterium
AADVKTRS

SEQ ID NO: 409814 - protein, 7 aa, Mycobacterium
AADVPAS

SEQ ID NO: 409815 - protein, 7 aa, Mycobacterium
AADVQGP

SEQ ID NO: 409816 - protein, 12 aa, Mycobacterium
AADVSAAARTTG

SEQ ID NO: 409817 - protein, 7 aa, Mycobacterium
AADVSGA

SEQ ID NO: 409818 - protein, 10 aa, Mycobacterium
AADVSGEQQA

SEQ ID NO: 409819 - protein, 6 aa, Mycobacterium
AADVTD

SEQ ID NO: 409820 - protein, 7 aa, Mycobacterium
AADVTPR

SEQ ID NO: 409821 - protein, 9 aa, Mycobacterium
AADVTSADI

SEQ ID NO: 409822 - protein, 14 aa, Mycobacterium
AADWNNPVSSGWRP

SEQ ID NO: 409823 - protein, 6 aa, Mycobacterium
AADWTT

SEQ ID NO: 409824 - protein, 7 aa, Mycobacterium
AADYAKE

SEQ ID NO: 409825 - protein, 5 aa, Mycobacterium
AADYH

SEQ ID NO: 409826 - protein, 6 aa, Mycobacterium
AAEAAA

SEQ ID NO: 409827 - protein, 18 aa, Mycobacterium
AAEAAATTWGRTSPSERA

SEQ ID NO: 409828 - protein, 7 aa, Mycobacterium
AAEAADA

SEQ ID NO: 409829 - protein, 12 aa, Mycobacterium
AAEAAGALAGKA

SEQ ID NO: 409830 - protein, 17 aa, Mycobacterium
AAEAAGRGLAALKQALH

SEQ ID NO: 409831 - protein, 9 aa, Mycobacterium
AAEAAGRKV

SEQ ID NO: 409832 - protein, 9 aa, Mycobacterium
AAEAAGSGL

SEQ ID NO: 409833 - protein, 7 aa, Mycobacterium
AAEAAGY

SEQ ID NO: 409834 - protein, 17 aa, Mycobacterium
AAEAAQTAGQAYSAAAA

SEQ ID NO: 409835 - protein, 6 aa, Mycobacterium
AAEAAR

SEQ ID NO: 409836 - protein, 20 aa, Mycobacterium
AAEAARPHSGRTVTATLTSQ

SEQ ID NO: 409837 - protein, 11 aa, Mycobacterium
AAEAARSAEVE

SEQ ID NO: 409838 - protein, 10 aa, Mycobacterium
AAEAATGTRC

SEQ ID NO: 409839 - protein, 10 aa, Mycobacterium
AAEAATRSVD

SEQ ID NO: 409840 - protein, 15 aa, Mycobacterium
AAEACGQARADHART

SEQ ID NO: 409841 - protein, 5 aa, Mycobacterium
AAEAD

SEQ ID NO: 409842 - protein, 11 aa, Mycobacterium
AAEADHHRSRA

SEQ ID NO: 409843 - protein, 18 aa, Mycobacterium
AAEADPAAATIIVIPCIE

SEQ ID NO: 409844 - protein, 6 aa, Mycobacterium
AAEADQ

SEQ ID NO: 409845 - protein, 11 aa, Mycobacterium
AAEADRPPPEI

SEQ ID NO: 409846 - protein, 11 aa, Mycobacterium
AAEADSGRLNA

SEQ ID NO: 409847 - protein, 31 aa, Mycobacterium
AAEAEAANAPVSNGSSRSEESSGGTLASDAQ

SEQ ID NO: 409848 - protein, 13 aa, Mycobacterium
AAEAEKLAEASGL

SEQ ID NO: 409849 - protein, 9 aa, Mycobacterium
AAEAELGDT

SEQ ID NO: 409850 - protein, 7 aa, Mycobacterium
AAEAEPS

SEQ ID NO: 409851 - protein, 10 aa, Mycobacterium
AAEAERAGQH

SEQ ID NO: 409852 - protein, 16 aa, Mycobacterium
AAEAERERRQEATRHT

SEQ ID NO: 409853 - protein, 7 aa, Mycobacterium
AAEAESL

SEQ ID NO: 409854 - protein, 8 aa, Mycobacterium
AAEAESLT

SEQ ID NO: 409855 - protein, 5 aa, Mycobacterium
AAEAG

SEQ ID NO: 409856 - protein, 15 aa, Mycobacterium
AAEAGAAGDPAGDEY

SEQ ID NO: 409857 - protein, 7 aa, Mycobacterium
AAEAGAD

SEQ ID NO: 409858 - protein, 13 aa, Mycobacterium
AAEAGEDASGAAV

SEQ ID NO: 409859 - protein, 6 aa, Mycobacterium
AAEAGG

SEQ ID NO: 409860 - protein, 7 aa, Mycobacterium
AAEAGHP

SEQ ID NO: 409861 - protein, 7 aa, Mycobacterium
AAEAGIE

SEQ ID NO: 409862 - protein, 7 aa, Mycobacterium
AAEAGKE

SEQ ID NO: 409863 - protein, 7 aa, Mycobacterium
AAEAGKQ

SEQ ID NO: 409864 - protein, 9 aa, Mycobacterium
AAEAGPRGV

SEQ ID NO: 409865 - protein, 13 aa, Mycobacterium
AAEAGRDAGSITP

SEQ ID NO: 409866 - protein, 9 aa, Mycobacterium
AAEAGREPG

SEQ ID NO: 409867 - protein, 9 aa, Mycobacterium
AAEAGSDHQ

SEQ ID NO: 409868 - protein, 12 aa, Mycobacterium
AAEAGTDPRDSA

SEQ ID NO: 409869 - protein, 12 aa, Mycobacterium
AAEAGTPGGDHD

SEQ ID NO: 409870 - protein, 13 aa, Mycobacterium
AAEAHAAAAAGAA

SEQ ID NO: 409871 - protein, 5 aa, Mycobacterium
AAEAK

SEQ ID NO: 409872 - protein, 6 aa, Mycobacterium
AAEAKD

SEQ ID NO: 409873 - protein, 7 aa, Mycobacterium
AAEAKEY

SEQ ID NO: 409874 - protein, 11 aa, Mycobacterium
AAEAKIAEGIG

SEQ ID NO: 409875 - protein, 6 aa, Mycobacterium
AAEALD

SEQ ID NO: 409876 - protein, 21 aa, Mycobacterium
AAEALGASATYTPQQAAAAGV

SEQ ID NO: 409877 - protein, 6 aa, Mycobacterium
AAEANY

SEQ ID NO: 409878 - protein, 9 aa, Mycobacterium
AAEAPTQRV

SEQ ID NO: 409879 - protein, 5 aa, Mycobacterium
AAEAR

SEQ ID NO: 409880 - protein, 24 aa, Mycobacterium
AAEARAEERAAERSAERAAAEQTI

SEQ ID NO: 409881 - protein, 6 aa, Mycobacterium
AAEARD

SEQ ID NO: 409882 - protein, 15 aa, Mycobacterium
AAEARGQQVDEAADA

SEQ ID NO: 409883 - protein, 17 aa, Mycobacterium
AAEARGQQVDEAADSAM

SEQ ID NO: 409884 - protein, 16 aa, Mycobacterium
AAEARGQTVDEDADAA

SEQ ID NO: 409885 - protein, 16 aa, Mycobacterium
AAEARRKRKRGMLPPR

SEQ ID NO: 409886 - protein, 9 aa, Mycobacterium
AAEARRRDP

SEQ ID NO: 409887 - protein, 10 aa, Mycobacterium
AAEARRSDPI

SEQ ID NO: 409888 - protein, 7 aa, Mycobacterium
AAEASAA

SEQ ID NO: 409889 - protein, 16 aa, Mycobacterium
AAEASASVRRPRGAPR

SEQ ID NO: 409890 - protein, 10 aa, Mycobacterium
AAEASDELSS

SEQ ID NO: 409891 - protein, 21 aa, Mycobacterium
AAEASTGAARFAGGAGRHGAP

SEQ ID NO: 409892 - protein, 6 aa, Mycobacterium
AAEASW

SEQ ID NO: 409893 - protein, 5 aa, Mycobacterium
AAEAT

SEQ ID NO: 409894 - protein, 7 aa, Mycobacterium
AAEATAE

SEQ ID NO: 409895 - protein, 9 aa, Mycobacterium
AAEATAGLA

SEQ ID NO: 409896 - protein, 11 aa, Mycobacterium
AAEATEPVATS

SEQ ID NO: 409897 - protein, 7 aa, Mycobacterium
AAEATGV

SEQ ID NO: 409898 - protein, 12 aa, Mycobacterium
AAEATQSETEAA

SEQ ID NO: 409899 - protein, 17 aa, Mycobacterium
AAEATSRGLAALRKVLH

SEQ ID NO: 409900 - protein, 15 aa, Mycobacterium
AAEAWGNTSAAERSN

SEQ ID NO: 409901 - protein, 7 aa, Mycobacterium
AAEDDEL

SEQ ID NO: 409902 - protein, 7 aa, Mycobacterium
AAEDDRV

SEQ ID NO: 409903 - protein, 7 aa, Mycobacterium
AAEDEDL

SEQ ID NO: 409904 - protein, 8 aa, Mycobacterium
AAEDEIST

SEQ ID NO: 409905 - protein, 7 aa, Mycobacterium
AAEDEVS

SEQ ID NO: 409906 - protein, 8 aa, Mycobacterium
AAEDEVSA

SEQ ID NO: 409907 - protein, 26 aa, Mycobacterium
AAEDGAHRGERVAGDPAGPDQFPQRG

SEQ ID NO: 409908 - protein, 12 aa, Mycobacterium
AAEDGVKQQTVD

SEQ ID NO: 409909 - protein, 15 aa, Mycobacterium
AAEDKPVESHTTDHG

SEQ ID NO: 409910 - protein, 5 aa, Mycobacterium
AAEDL

SEQ ID NO: 409911 - protein, 7 aa, Mycobacterium
AAEDNGK

SEQ ID NO: 409912 - protein, 7 aa, Mycobacterium
AAEDPQC

SEQ ID NO: 409913 - protein, 19 aa, Mycobacterium
AAEDPRAAAEQLAGMLDSA

SEQ ID NO: 409914 - protein, 8 aa, Mycobacterium
AAEDPRGT

SEQ ID NO: 409915 - protein, 6 aa, Mycobacterium
AAEDPT

SEQ ID NO: 409916 - protein, 12 aa, Mycobacterium
AAEDSDSGFRDR

SEQ ID NO: 409917 - protein, 7 aa, Mycobacterium
AAEEAAR

SEQ ID NO: 409918 - protein, 14 aa, Mycobacterium
AAEEADEAATYPPD

SEQ ID NO: 409919 - protein, 7 aa, Mycobacterium
AAEEARD

SEQ ID NO: 409920 - protein, 15 aa, Mycobacterium
AAEEARTIAASTNVG

SEQ ID NO: 409921 - protein, 41 aa, Mycobacterium
AAEEATDEESTDEATPAPRTPPTRTPSPLSAPVGATPPVQQ

SEQ ID NO: 409922 - protein, 16 aa, Mycobacterium
AAEEATIHQGRKAQRV

SEQ ID NO: 409923 - protein, 10 aa, Mycobacterium
AAEECGTTHR

SEQ ID NO: 409924 - protein, 5 aa, Mycobacterium
AAEED

SEQ ID NO: 409925 - protein, 7 aa, Mycobacterium
AAEEDRL

SEQ ID NO: 409926 - protein, 22 aa, Mycobacterium
AAEEEAERAKAAVADHEARVDA

SEQ ID NO: 409927 - protein, 8 aa, Mycobacterium
AAEEERAR

SEQ ID NO: 409928 - protein, 17 aa, Mycobacterium
AAEEFDKAGPDGGTPRL

SEQ ID NO: 409929 - protein, 18 aa, Mycobacterium
AAEEGRITDEDIERAKGQ

SEQ ID NO: 409930 - protein, 9 aa, Mycobacterium
AAEEGSGDF

SEQ ID NO: 409931 - protein, 8 aa, Mycobacterium
AAEEGSTL

SEQ ID NO: 409932 - protein, 5 aa, Mycobacterium
AAEEH

SEQ ID NO: 409933 - protein, 6 aa, Mycobacterium
AAEEIT

SEQ ID NO: 409934 - protein, 5 aa, Mycobacterium
AAEEK

SEQ ID NO: 409935 - protein, 15 aa, Mycobacterium
AAEEKPVESRTAEHG

SEQ ID NO: 409936 - protein, 7 aa, Mycobacterium
AAEEKTL

SEQ ID NO: 409937 - protein, 15 aa, Mycobacterium
AAEEKYAAKLAGIPR

SEQ ID NO: 409938 - protein, 5 aa, Mycobacterium
AAEEL

SEQ ID NO: 409939 - protein, 41 aa, Mycobacterium
AAEEPDVPDDIEPVDDGPRRAHRGQIDGAPEDGDSLYDVVD

SEQ ID NO: 409940 - protein, 46 aa, Mycobacterium
AAEEPDVTDAVGTPDADTERAEGAGRHRGQVDGAPEDGESLYTVVE

SEQ ID NO: 409941 - protein, 8 aa, Mycobacterium
AAEEQRPP

SEQ ID NO: 409942 - protein, 6 aa, Mycobacterium
AAEERD

SEQ ID NO: 409943 - protein, 17 aa, Mycobacterium
AAEERGYTATKHQREVG

SEQ ID NO: 409944 - protein, 8 aa, Mycobacterium
AAEESAAS

SEQ ID NO: 409945 - protein, 7 aa, Mycobacterium
AAEESGF

SEQ ID NO: 409946 - protein, 8 aa, Mycobacterium
AAEESGFD

SEQ ID NO: 409947 - protein, 10 aa, Mycobacterium
AAEESGGYRS

SEQ ID NO: 409948 - protein, 8 aa, Mycobacterium
AAEESRPP

SEQ ID NO: 409949 - protein, 10 aa, Mycobacterium
AAEETAQIPP

SEQ ID NO: 409950 - protein, 15 aa, Mycobacterium
AAEETDETPPGAQRP

SEQ ID NO: 409951 - protein, 9 aa, Mycobacterium
AAEETGLDA

SEQ ID NO: 409952 - protein, 7 aa, Mycobacterium
AAEFDDE

SEQ ID NO: 409953 - protein, 5 aa, Mycobacterium
AAEFG

SEQ ID NO: 409954 - protein, 6 aa, Mycobacterium
AAEFTE

SEQ ID NO: 409955 - protein, 4 aa, Mycobacterium
AAEG

SEQ ID NO: 409956 - protein, 6 aa, Mycobacterium
AAEGAD

SEQ ID NO: 409957 - protein, 8 aa, Mycobacterium
AAEGADIE

SEQ ID NO: 409958 - protein, 20 aa, Mycobacterium
AAEGAEVSGAERGSVTATGD

SEQ ID NO: 409959 - protein, 6 aa, Mycobacterium
AAEGAG

SEQ ID NO: 409960 - protein, 8 aa, Mycobacterium
AAEGAPDT

SEQ ID NO: 409961 - protein, 8 aa, Mycobacterium
AAEGAQYR

SEQ ID NO: 409962 - protein, 5 aa, Mycobacterium
AAEGD

SEQ ID NO: 409963 - protein, 9 aa, Mycobacterium
AAEGDAHEN

SEQ ID NO: 409964 - protein, 6 aa, Mycobacterium
AAEGDL

SEQ ID NO: 409965 - protein, 14 aa, Mycobacterium
AAEGDLREGLDPGA

SEQ ID NO: 409966 - protein, 8 aa, Mycobacterium
AAEGDPRV

SEQ ID NO: 409967 - protein, 8 aa, Mycobacterium
AAEGDRVG

SEQ ID NO: 409968 - protein, 28 aa, Mycobacterium
AAEGDVAQAAGSAESAAAAAGAASLGEA

SEQ ID NO: 409969 - protein, 12 aa, Mycobacterium
AAEGEHPDQESD

SEQ ID NO: 409970 - protein, 24 aa, Mycobacterium
AAEGEKESEAHAAGRASRFREETR

SEQ ID NO: 409971 - protein, 9 aa, Mycobacterium
AAEGEYIRS

SEQ ID NO: 409972 - protein, 19 aa, Mycobacterium
AAEGEYSVDDDNQLQPEDT

SEQ ID NO: 409973 - protein, 10 aa, Mycobacterium
AAEGEYVRSP

SEQ ID NO: 409974 - protein, 5 aa, Mycobacterium
AAEGF

SEQ ID NO: 409975 - protein, 17 aa, Mycobacterium
AAEGGAHQSIKTPSIGI

SEQ ID NO: 409976 - protein, 11 aa, Mycobacterium
AAEGGAPATTL

SEQ ID NO: 409977 - protein, 11 aa, Mycobacterium
AAEGGDQAHAK

SEQ ID NO: 409978 - protein, 7 aa, Mycobacterium
AAEGGGL

SEQ ID NO: 409979 - protein, 8 aa, Mycobacterium
AAEGGGNI

SEQ ID NO: 409980 - protein, 56 aa, Mycobacterium
AAEGGPTTEAAKPKKKSPAKKAAKGAQEVGATPEAGAAAEKTEAPAEGAQQSEPTE

SEQ ID NO: 409981 - protein, 49 aa, Mycobacterium
AAEGGPTTEATKPKKKSPAKKAKGGEGDADAAAEKVEASAEGEQTESAE

SEQ ID NO: 409982 - protein, 7 aa, Mycobacterium
AAEGGTD

SEQ ID NO: 409983 - protein, 7 aa, Mycobacterium
AAEGIGT

SEQ ID NO: 409984 - protein, 8 aa, Mycobacterium
AAEGIPTA

SEQ ID NO: 409985 - protein, 5 aa, Mycobacterium
AAEGK

SEQ ID NO: 409986 - protein, 8 aa, Mycobacterium
AAEGLPEA

SEQ ID NO: 409987 - protein, 10 aa, Mycobacterium
AAEGPAARPT

SEQ ID NO: 409988 - protein, 10 aa, Mycobacterium
AAEGPGATLG

SEQ ID NO: 409989 - protein, 5 aa, Mycobacterium
AAEGQ

SEQ ID NO: 409990 - protein, 24 aa, Mycobacterium
AAEGQEQTLRATAKPLPGSTFDEF

SEQ ID NO: 409991 - protein, 7 aa, Mycobacterium
AAEGRGD

SEQ ID NO: 409992 - protein, 7 aa, Mycobacterium
AAEGRKL

SEQ ID NO: 409993 - protein, 6 aa, Mycobacterium
AAEGRL

SEQ ID NO: 409994 - protein, 6 aa, Mycobacterium
AAEGRP

SEQ ID NO: 409995 - protein, 16 aa, Mycobacterium
AAEGRTQDLGYPAAGS

SEQ ID NO: 409996 - protein, 6 aa, Mycobacterium
AAEGSE

SEQ ID NO: 409997 - protein, 34 aa, Mycobacterium
AAEGSVGAAESPASDPQPRESSSRSRSRKVKPGR

SEQ ID NO: 409998 - protein, 8 aa, Mycobacterium
AAEGTGIP

SEQ ID NO: 409999 - protein, 7 aa, Mycobacterium
AAEGTGL

SEQ ID NO: 410000 - protein, 6 aa, Mycobacterium
AAEGTL

SEQ ID NO: 410001 - protein, 5 aa, Mycobacterium
AAEGY

SEQ ID NO: 410002 - protein, 6 aa, Mycobacterium
AAEHAG

SEQ ID NO: 410003 - protein, 8 aa, Mycobacterium
AAEHAPAG

SEQ ID NO: 410004 - protein, 20 aa, Mycobacterium
AAEHARSYDSEGDMSTNEGS

SEQ ID NO: 410005 - protein, 17 aa, Mycobacterium
AAEHDGAPDGDNKDIPS

SEQ ID NO: 410006 - protein, 8 aa, Mycobacterium
AAEHPEPG

SEQ ID NO: 410007 - protein, 6 aa, Mycobacterium
AAEHPP

SEQ ID NO: 410008 - protein, 7 aa, Mycobacterium
AAEHPQV

SEQ ID NO: 410009 - protein, 19 aa, Mycobacterium
AAEHREARRGEPPARPGEW

SEQ ID NO: 410010 - protein, 6 aa, Mycobacterium
AAEHRG

SEQ ID NO: 410011 - protein, 8 aa, Mycobacterium
AAEIEASR

SEQ ID NO: 410012 - protein, 5 aa, Mycobacterium
AAEIG

SEQ ID NO: 410013 - protein, 6 aa, Mycobacterium
AAEIGA

SEQ ID NO: 410014 - protein, 5 aa, Mycobacterium
AAEIR

SEQ ID NO: 410015 - protein, 9 aa, Mycobacterium
AAEKAETEP

SEQ ID NO: 410016 - protein, 6 aa, Mycobacterium
AAEKAG

SEQ ID NO: 410017 - protein, 13 aa, Mycobacterium
AAEKARKHGYQPV

SEQ ID NO: 410018 - protein, 8 aa, Mycobacterium
AAEKELER

SEQ ID NO: 410019 - protein, 8 aa, Mycobacterium
AAEKGDQL

SEQ ID NO: 410020 - protein, 34 aa, Mycobacterium
AAEKKKERPEAKPAAAQASAPASPSKAAAPAAAA

SEQ ID NO: 410021 - protein, 11 aa, Mycobacterium
AAEKPRGRRKT

SEQ ID NO: 410022 - protein, 13 aa, Mycobacterium
AAEKQERQERRAN

SEQ ID NO: 410023 - protein, 5 aa, Mycobacterium
AAEKR

SEQ ID NO: 410024 - protein, 21 aa, Mycobacterium
AAEKRTGTRTSRTGNTIRGWV

SEQ ID NO: 410025 - protein, 5 aa, Mycobacterium
AAEKS

SEQ ID NO: 410026 - protein, 34 aa, Mycobacterium
AAEKSKAPKEDAPKAEPAAEAPGKTTQAPAPEGA

SEQ ID NO: 410027 - protein, 5 aa, Mycobacterium
AAELA

SEQ ID NO: 410028 - protein, 7 aa, Mycobacterium
AAELARQ

SEQ ID NO: 410029 - protein, 23 aa, Mycobacterium
AAELARRENAYRGGRPPADPAGK

SEQ ID NO: 410030 - protein, 10 aa, Mycobacterium
AAELDAEPGV

SEQ ID NO: 410031 - protein, 12 aa, Mycobacterium
AAELDEQRTDVR

SEQ ID NO: 410032 - protein, 10 aa, Mycobacterium
AAELDGASAT

SEQ ID NO: 410033 - protein, 10 aa, Mycobacterium
AAELDKDPGV

SEQ ID NO: 410034 - protein, 12 aa, Mycobacterium
AAELEELRAQEV

SEQ ID NO: 410035 - protein, 7 aa, Mycobacterium
AAELGDT

SEQ ID NO: 410036 - protein, 34 aa, Mycobacterium
AAELGERRALTGEPLAPQLGATAAAQRGGHIGEG

SEQ ID NO: 410037 - protein, 6 aa, Mycobacterium
AAELGP

SEQ ID NO: 410038 - protein, 7 aa, Mycobacterium
AAELGPR

SEQ ID NO: 410039 - protein, 15 aa, Mycobacterium
AAELGPRRALSGEPL

SEQ ID NO: 410040 - protein, 16 aa, Mycobacterium
AAELGPRRALSGEPLP

SEQ ID NO: 410041 - protein, 6 aa, Mycobacterium
AAELGR

SEQ ID NO: 410042 - protein, 13 aa, Mycobacterium
AAELGSADTTPDN

SEQ ID NO: 410043 - protein, 11 aa, Mycobacterium
AAELGSGNPRH

SEQ ID NO: 410044 - protein, 7 aa, Mycobacterium
AAELGVQ

SEQ ID NO: 410045 - protein, 5 aa, Mycobacterium
AAELP

SEQ ID NO: 410046 - protein, 12 aa, Mycobacterium
AAELPMAQRYFL

SEQ ID NO: 410047 - protein, 27 aa, Mycobacterium
AAELPNTSLPAADGREISELDRVQSLL

SEQ ID NO: 410048 - protein, 8 aa, Mycobacterium
AAELPTPW

SEQ ID NO: 410049 - protein, 7 aa, Mycobacterium
AAELSGS

SEQ ID NO: 410050 - protein, 14 aa, Mycobacterium
AAELSKTRARAAKR

SEQ ID NO: 410051 - protein, 12 aa, Mycobacterium
AAELSSTDPEVA

SEQ ID NO: 410052 - protein, 13 aa, Mycobacterium
AAELTAPEGPRPV

SEQ ID NO: 410053 - protein, 4 aa, Mycobacterium
AAEM

SEQ ID NO: 410054 - protein, 5 aa, Mycobacterium
AAEMA

SEQ ID NO: 410055 - protein, 12 aa, Mycobacterium
AAEMAEQQGVRS

SEQ ID NO: 410056 - protein, 10 aa, Mycobacterium
AAENEAGGPL

SEQ ID NO: 410057 - protein, 5 aa, Mycobacterium
AAENG

SEQ ID NO: 410058 - protein, 6 aa, Mycobacterium
AAENGA

SEQ ID NO: 410059 - protein, 6 aa, Mycobacterium
AAENKL

SEQ ID NO: 410060 - protein, 14 aa, Mycobacterium
AAENMPSARRRGAH

SEQ ID NO: 410061 - protein, 9 aa, Mycobacterium
AAENPDTAA

SEQ ID NO: 410062 - protein, 6 aa, Mycobacterium
AAENRI

SEQ ID NO: 410063 - protein, 9 aa, Mycobacterium
AAENRTDED

SEQ ID NO: 410064 - protein, 8 aa, Mycobacterium
AAENSTVA

SEQ ID NO: 410065 - protein, 7 aa, Mycobacterium
AAENYDR

SEQ ID NO: 410066 - protein, 24 aa, Mycobacterium
AAENYGERTQPETDPRPVRDRGEL

SEQ ID NO: 410067 - protein, 22 aa, Mycobacterium
AAEPAATPTPAKAAAPAADPVA

SEQ ID NO: 410068 - protein, 14 aa, Mycobacterium
AAEPAGLAVMAARA

SEQ ID NO: 410069 - protein, 7 aa, Mycobacterium
AAEPAGP

SEQ ID NO: 410070 - protein, 8 aa, Mycobacterium
AAEPARVN

SEQ ID NO: 410071 - protein, 6 aa, Mycobacterium
AAEPAV

SEQ ID NO: 410072 - protein, 8 aa, Mycobacterium
AAEPDAAT

SEQ ID NO: 410073 - protein, 11 aa, Mycobacterium
AAEPDGLPLDP

SEQ ID NO: 410074 - protein, 8 aa, Mycobacterium
AAEPDGPG

SEQ ID NO: 410075 - protein, 8 aa, Mycobacterium
AAEPDGTG

SEQ ID NO: 410076 - protein, 14 aa, Mycobacterium
AAEPDSTAALPEGG

SEQ ID NO: 410077 - protein, 8 aa, Mycobacterium
AAEPDVVQ

SEQ ID NO: 410078 - protein, 8 aa, Mycobacterium
AAEPERGP

SEQ ID NO: 410079 - protein, 9 aa, Mycobacterium
AAEPFGRGG

SEQ ID NO: 410080 - protein, 8 aa, Mycobacterium
AAEPGERV

SEQ ID NO: 410081 - protein, 8 aa, Mycobacterium
AAEPGGEV

SEQ ID NO: 410082 - protein, 12 aa, Mycobacterium
AAEPGGKDYGVP

SEQ ID NO: 410083 - protein, 6 aa, Mycobacterium
AAEPGH

SEQ ID NO: 410084 - protein, 6 aa, Mycobacterium
AAEPGL

SEQ ID NO: 410085 - protein, 6 aa, Mycobacterium
AAEPGQ

SEQ ID NO: 410086 - protein, 6 aa, Mycobacterium
AAEPGR

SEQ ID NO: 410087 - protein, 7 aa, Mycobacterium
AAEPGRE

SEQ ID NO: 410088 - protein, 11 aa, Mycobacterium
AAEPGTTTSGA

SEQ ID NO: 410089 - protein, 6 aa, Mycobacterium
AAEPGY

SEQ ID NO: 410090 - protein, 10 aa, Mycobacterium
AAEPIPDDAD

SEQ ID NO: 410091 - protein, 5 aa, Mycobacterium
AAEPM

SEQ ID NO: 410092 - protein, 6 aa, Mycobacterium
AAEPPG

SEQ ID NO: 410093 - protein, 22 aa, Mycobacterium
AAEPPPAPGQHNEEFLTAPQTT

SEQ ID NO: 410094 - protein, 13 aa, Mycobacterium
AAEPPVGADAADG

SEQ ID NO: 410095 - protein, 5 aa, Mycobacterium
AAEPR

SEQ ID NO: 410096 - protein, 11 aa, Mycobacterium
AAEPREDGERG

SEQ ID NO: 410097 - protein, 7 aa, Mycobacterium
AAEPRSY

SEQ ID NO: 410098 - protein, 6 aa, Mycobacterium
AAEPSG

SEQ ID NO: 410099 - protein, 10 aa, Mycobacterium
AAEPSSRQTG

SEQ ID NO: 410100 - protein, 8 aa, Mycobacterium
AAEPSVSG

SEQ ID NO: 410101 - protein, 7 aa, Mycobacterium
AAEPTGL

SEQ ID NO: 410102 - protein, 7 aa, Mycobacterium
AAEPTGM

SEQ ID NO: 410103 - protein, 7 aa, Mycobacterium
AAEPTLA

SEQ ID NO: 410104 - protein, 11 aa, Mycobacterium
AAEPVGTAPGL

SEQ ID NO: 410105 - protein, 13 aa, Mycobacterium
AAEPVMGPPGLEQ

SEQ ID NO: 410106 - protein, 14 aa, Mycobacterium
AAEQAAADKNASAS

SEQ ID NO: 410107 - protein, 8 aa, Mycobacterium
AAEQAAAH

SEQ ID NO: 410108 - protein, 7 aa, Mycobacterium
AAEQADA

SEQ ID NO: 410109 - protein, 13 aa, Mycobacterium
AAEQAGQPLPSRD

SEQ ID NO: 410110 - protein, 11 aa, Mycobacterium
AAEQAPQSHRG

SEQ ID NO: 410111 - protein, 27 aa, Mycobacterium
AAEQEAAAQAISTAKAEVRRERRDLAE

SEQ ID NO: 410112 - protein, 6 aa, Mycobacterium
AAEQGA

SEQ ID NO: 410113 - protein, 7 aa, Mycobacterium
AAEQGNS

SEQ ID NO: 410114 - protein, 14 aa, Mycobacterium
AAEQGQDPSPADVA

SEQ ID NO: 410115 - protein, 7 aa, Mycobacterium
AAEQIDK

SEQ ID NO: 410116 - protein, 31 aa, Mycobacterium
AAEQKKPAGQAPAPAPAPAAKAAAPSAPAPA

SEQ ID NO: 410117 - protein, 5 aa, Mycobacterium
AAEQL

SEQ ID NO: 410118 - protein, 16 aa, Mycobacterium
AAEQLEAARNAHAGRA

SEQ ID NO: 410119 - protein, 9 aa, Mycobacterium
AAEQLPHTA

SEQ ID NO: 410120 - protein, 19 aa, Mycobacterium
AAEQNSLRVGPREAHDTGE

SEQ ID NO: 410121 - protein, 16 aa, Mycobacterium
AAEQQSPAAAPGEAEI

SEQ ID NO: 410122 - protein, 12 aa, Mycobacterium
AAEQRAETTGAS

SEQ ID NO: 410123 - protein, 8 aa, Mycobacterium
AAEQSADI

SEQ ID NO: 410124 - protein, 8 aa, Mycobacterium
AAEQSGFD

SEQ ID NO: 410125 - protein, 8 aa, Mycobacterium
AAEQSHDP

SEQ ID NO: 410126 - protein, 5 aa, Mycobacterium
AAEQV

SEQ ID NO: 410127 - protein, 24 aa, Mycobacterium
AAEQVRVGSPDDATAIGPVASRAQ

SEQ ID NO: 410128 - protein, 17 aa, Mycobacterium
AAERAAAAAGGDPGAYV

SEQ ID NO: 410129 - protein, 10 aa, Mycobacterium
AAERAAERQV

SEQ ID NO: 410130 - protein, 10 aa, Mycobacterium
AAERAAPSTV

SEQ ID NO: 410131 - protein, 11 aa, Mycobacterium
AAERADAPLRR

SEQ ID NO: 410132 - protein, 6 aa, Mycobacterium
AAERAG

SEQ ID NO: 410133 - protein, 35 aa, Mycobacterium
AAERAGLTRDTPDPKGARFGRDARGDLDGTAEETG

SEQ ID NO: 410134 - protein, 8 aa, Mycobacterium
AAERAGNA

SEQ ID NO: 410135 - protein, 14 aa, Mycobacterium
AAERAGRDPQAITP

SEQ ID NO: 410136 - protein, 16 aa, Mycobacterium
AAERARELRDAGATGV

SEQ ID NO: 410137 - protein, 13 aa, Mycobacterium
AAERARPHSGRTV

SEQ ID NO: 410138 - protein, 12 aa, Mycobacterium
AAERARRGEGPT

SEQ ID NO: 410139 - protein, 6 aa, Mycobacterium
AAERAS

SEQ ID NO: 410140 - protein, 17 aa, Mycobacterium
AAERASGFDPRAGWAGN

SEQ ID NO: 410141 - protein, 9 aa, Mycobacterium
AAERASGHL

SEQ ID NO: 410142 - protein, 10 aa, Mycobacterium
AAERATPEDV

SEQ ID NO: 410143 - protein, 11 aa, Mycobacterium
AAERAVATGVQ

SEQ ID NO: 410144 - protein, 5 aa, Mycobacterium
AAERC

SEQ ID NO: 410145 - protein, 6 aa, Mycobacterium
AAERDE

SEQ ID NO: 410146 - protein, 29 aa, Mycobacterium
AAERDKADADAALSERRAQRTAARQRRDE

SEQ ID NO: 410147 - protein, 7 aa, Mycobacterium
AAEREGV

SEQ ID NO: 410148 - protein, 6 aa, Mycobacterium
AAEREH

SEQ ID NO: 410149 - protein, 6 aa, Mycobacterium
AAEREQ

SEQ ID NO: 410150 - protein, 14 aa, Mycobacterium
AAERERGRETSRPR

SEQ ID NO: 410151 - protein, 30 aa, Mycobacterium
AAERESQHQLDDYTADAARLGAPDVRVGVT

SEQ ID NO: 410152 - protein, 5 aa, Mycobacterium
AAERG

SEQ ID NO: 410153 - protein, 6 aa, Mycobacterium
AAERGA

SEQ ID NO: 410154 - protein, 7 aa, Mycobacterium
AAERGAA

SEQ ID NO: 410155 - protein, 11 aa, Mycobacterium
AAERGAEGPLP

SEQ ID NO: 410156 - protein, 8 aa, Mycobacterium
AAERGDVP

SEQ ID NO: 410157 - protein, 8 aa, Mycobacterium
AAERGGLE

SEQ ID NO: 410158 - protein, 12 aa, Mycobacterium
AAERGGPAGLGS

SEQ ID NO: 410159 - protein, 10 aa, Mycobacterium
AAERGGPQAA

SEQ ID NO: 410160 - protein, 8 aa, Mycobacterium
AAERGIAE

SEQ ID NO: 410161 - protein, 6 aa, Mycobacterium
AAERGL

SEQ ID NO: 410162 - protein, 7 aa, Mycobacterium
AAERGQR

SEQ ID NO: 410163 - protein, 6 aa, Mycobacterium
AAERGV

SEQ ID NO: 410164 - protein, 9 aa, Mycobacterium
AAERGYEGT

SEQ ID NO: 410165 - protein, 5 aa, Mycobacterium
AAERL

SEQ ID NO: 410166 - protein, 6 aa, Mycobacterium
AAERLG

SEQ ID NO: 410167 - protein, 12 aa, Mycobacterium
AAERMRDAVAYL

SEQ ID NO: 410168 - protein, 5 aa, Mycobacterium
AAERN

SEQ ID NO: 410169 - protein, 7 aa, Mycobacterium
AAERNAH

SEQ ID NO: 410170 - protein, 5 aa, Mycobacterium
AAERP

SEQ ID NO: 410171 - protein, 7 aa, Mycobacterium
AAERPAH

SEQ ID NO: 410172 - protein, 7 aa, Mycobacterium
AAERPAP

SEQ ID NO: 410173 - protein, 7 aa, Mycobacterium
AAERPTT

SEQ ID NO: 410174 - protein, 10 aa, Mycobacterium
AAERQRELQD

SEQ ID NO: 410175 - protein, 11 aa, Mycobacterium
AAERQVRKAQR

SEQ ID NO: 410176 - protein, 5 aa, Mycobacterium
AAERR

SEQ ID NO: 410177 - protein, 6 aa, Mycobacterium
AAERRA

SEQ ID NO: 410178 - protein, 11 aa, Mycobacterium
AAERRDRPGDD

SEQ ID NO: 410179 - protein, 11 aa, Mycobacterium
AAERRENPGND

SEQ ID NO: 410180 - protein, 8 aa, Mycobacterium
AAERRGAE

SEQ ID NO: 410181 - protein, 10 aa, Mycobacterium
AAERRNRSDV

SEQ ID NO: 410182 - protein, 13 aa, Mycobacterium
AAERRQRQEERAN

SEQ ID NO: 410183 - protein, 9 aa, Mycobacterium
AAERRRAAD

SEQ ID NO: 410184 - protein, 15 aa, Mycobacterium
AAERRTAVADNASEG

SEQ ID NO: 410185 - protein, 10 aa, Mycobacterium
AAERSAQAAV

SEQ ID NO: 410186 - protein, 15 aa, Mycobacterium
AAERSQDDDQHWRAL

SEQ ID NO: 410187 - protein, 14 aa, Mycobacterium
AAERSQPQPDDPKW

SEQ ID NO: 410188 - protein, 7 aa, Mycobacterium
AAERSRE

SEQ ID NO: 410189 - protein, 7 aa, Mycobacterium
AAERSRP

SEQ ID NO: 410190 - protein, 41 aa, Mycobacterium
AAERSRREEHRAAQTARKEALAAEAEELGANSTQWKAAGDR

SEQ ID NO: 410191 - protein, 15 aa, Mycobacterium
AAERSSAASPSQAAA

SEQ ID NO: 410192 - protein, 7 aa, Mycobacterium
AAERTEV

SEQ ID NO: 410193 - protein, 12 aa, Mycobacterium
AAERTGAELESA

SEQ ID NO: 410194 - protein, 7 aa, Mycobacterium
AAERTHD

SEQ ID NO: 410195 - protein, 8 aa, Mycobacterium
AAERTTGL

SEQ ID NO: 410196 - protein, 12 aa, Mycobacterium
AAERTVNGRSAL

SEQ ID NO: 410197 - protein, 22 aa, Mycobacterium
AAESAAAAPPTTAIAPAAADEI

SEQ ID NO: 410198 - protein, 8 aa, Mycobacterium
AAESAGAE

SEQ ID NO: 410199 - protein, 9 aa, Mycobacterium
AAESAGRDV

SEQ ID NO: 410200 - protein, 10 aa, Mycobacterium
AAESAKEAAG

SEQ ID NO: 410201 - protein, 15 aa, Mycobacterium
AAESARSATARDEAG

SEQ ID NO: 410202 - protein, 12 aa, Mycobacterium
AAESATSGPGAT

SEQ ID NO: 410203 - protein, 6 aa, Mycobacterium
AAESDA

SEQ ID NO: 410204 - protein, 8 aa, Mycobacterium
AAESDRVG

SEQ ID NO: 410205 - protein, 10 aa, Mycobacterium
AAESDSVDKA

SEQ ID NO: 410206 - protein, 7 aa, Mycobacterium
AAESDTA

SEQ ID NO: 410207 - protein, 8 aa, Mycobacterium
AAESDTSM

SEQ ID NO: 410208 - protein, 7 aa, Mycobacterium
AAESESL

SEQ ID NO: 410209 - protein, 6 aa, Mycobacterium
AAESGA

SEQ ID NO: 410210 - protein, 7 aa, Mycobacterium
AAESGAD

SEQ ID NO: 410211 - protein, 8 aa, Mycobacterium
AAESGASR

SEQ ID NO: 410212 - protein, 17 aa, Mycobacterium
AAESGDKATYLTPAAAG

SEQ ID NO: 410213 - protein, 8 aa, Mycobacterium
AAESGGAA

SEQ ID NO: 410214 - protein, 8 aa, Mycobacterium
AAESGGEL

SEQ ID NO: 410215 - protein, 52 aa, Mycobacterium
AAESGGGDAPSQPEPEAEPAAAAQPEPEAEPEPQPEAKPQSGGSSAAGGDAT

SEQ ID NO: 410216 - protein, 9 aa, Mycobacterium
AAESGIDNP

SEQ ID NO: 410217 - protein, 8 aa, Mycobacterium
AAESGSRV

SEQ ID NO: 410218 - protein, 6 aa, Mycobacterium
AAESGY

SEQ ID NO: 410219 - protein, 7 aa, Mycobacterium
AAESLRA

SEQ ID NO: 410220 - protein, 6 aa, Mycobacterium
AAESNG

SEQ ID NO: 410221 - protein, 10 aa, Mycobacterium
AAESNHPPPE

SEQ ID NO: 410222 - protein, 16 aa, Mycobacterium
AAESPPPPAQATQRSV

SEQ ID NO: 410223 - protein, 8 aa, Mycobacterium
AAESQRAG

SEQ ID NO: 410224 - protein, 8 aa, Mycobacterium
AAESQTMS

SEQ ID NO: 410225 - protein, 13 aa, Mycobacterium
AAESRHDGSGAAT

SEQ ID NO: 410226 - protein, 7 aa, Mycobacterium
AAESRIE

SEQ ID NO: 410227 - protein, 8 aa, Mycobacterium
AAESRRED

SEQ ID NO: 410228 - protein, 6 aa, Mycobacterium
AAESRT

SEQ ID NO: 410229 - protein, 16 aa, Mycobacterium
AAESSGPWNNAGTGHS

SEQ ID NO: 410230 - protein, 11 aa, Mycobacterium
AAESSTGAGLS

SEQ ID NO: 410231 - protein, 5 aa, Mycobacterium
AAEST

SEQ ID NO: 410232 - protein, 5 aa, Mycobacterium
AAESV

SEQ ID NO: 410233 - protein, 5 aa, Mycobacterium
AAETA

SEQ ID NO: 410234 - protein, 6 aa, Mycobacterium
AAETAG

SEQ ID NO: 410235 - protein, 12 aa, Mycobacterium
AAETAGDSLESL

SEQ ID NO: 410236 - protein, 16 aa, Mycobacterium
AAETAGNHADERREQM

SEQ ID NO: 410237 - protein, 6 aa, Mycobacterium
AAETAR

SEQ ID NO: 410238 - protein, 9 aa, Mycobacterium
AAETASEQD

SEQ ID NO: 410239 - protein, 9 aa, Mycobacterium
AAETDGATD

SEQ ID NO: 410240 - protein, 31 aa, Mycobacterium
AAETDPTTDPEPPAEPLPTNFPGPRPAFGTP

SEQ ID NO: 410241 - protein, 7 aa, Mycobacterium
AAETDRV

SEQ ID NO: 410242 - protein, 11 aa, Mycobacterium
AAETEDPDQAA

SEQ ID NO: 410243 - protein, 7 aa, Mycobacterium
AAETEPT

SEQ ID NO: 410244 - protein, 54 aa, Mycobacterium
AAETGGAEAADTADTTGAGDPDIGASTAGSASAAVAAGDPGATDPSGTAGAAGS

SEQ ID NO: 410245 - protein, 14 aa, Mycobacterium
AAETGGKRPAPTPL

SEQ ID NO: 410246 - protein, 12 aa, Mycobacterium
AAETGLPDASSD

SEQ ID NO: 410247 - protein, 9 aa, Mycobacterium
AAETGRSAE

SEQ ID NO: 410248 - protein, 8 aa, Mycobacterium
AAETGRSV

SEQ ID NO: 410249 - protein, 6 aa, Mycobacterium
AAETGS

SEQ ID NO: 410250 - protein, 8 aa, Mycobacterium
AAETGSHD

SEQ ID NO: 410251 - protein, 17 aa, Mycobacterium
AAETGSKLREAKGINVP

SEQ ID NO: 410252 - protein, 7 aa, Mycobacterium
AAETGSL

SEQ ID NO: 410253 - protein, 6 aa, Mycobacterium
AAETMQ

SEQ ID NO: 410254 - protein, 6 aa, Mycobacterium
AAETPD

SEQ ID NO: 410255 - protein, 18 aa, Mycobacterium
AAETPGDADAIGDHRPLT

SEQ ID NO: 410256 - protein, 13 aa, Mycobacterium
AAETPGSIHEGGE

SEQ ID NO: 410257 - protein, 8 aa, Mycobacterium
AAETPLSA

SEQ ID NO: 410258 - protein, 9 aa, Mycobacterium
AAETPLSAN

SEQ ID NO: 410259 - protein, 8 aa, Mycobacterium
AAETPLTA

SEQ ID NO: 410260 - protein, 9 aa, Mycobacterium
AAETPSGAA

SEQ ID NO: 410261 - protein, 6 aa, Mycobacterium
AAETQD

SEQ ID NO: 410262 - protein, 9 aa, Mycobacterium
AAETRSAEH

SEQ ID NO: 410263 - protein, 14 aa, Mycobacterium
AAETRVRGEPDEPA

SEQ ID NO: 410264 - protein, 8 aa, Mycobacterium
AAETSTAV

SEQ ID NO: 410265 - protein, 9 aa, Mycobacterium
AAETTGTSP

SEQ ID NO: 410266 - protein, 7 aa, Mycobacterium
AAETTGV

SEQ ID NO: 410267 - protein, 15 aa, Mycobacterium
AAETTRKAGSTVLSG

SEQ ID NO: 410268 - protein, 5 aa, Mycobacterium
AAETV

SEQ ID NO: 410269 - protein, 4 aa, Mycobacterium
AAEV

SEQ ID NO: 410270 - protein, 25 aa, Mycobacterium
AAEVAEELGPGSVADLDDSARRARL

SEQ ID NO: 410271 - protein, 11 aa, Mycobacterium
AAEVDGGTDTI

SEQ ID NO: 410272 - protein, 8 aa, Mycobacterium
AAEVDGIP

SEQ ID NO: 410273 - protein, 14 aa, Mycobacterium
AAEVGAAANDLGNQ

SEQ ID NO: 410274 - protein, 30 aa, Mycobacterium
AAEVGINDGAPSPVGVEPAAGGAPAEGASL

SEQ ID NO: 410275 - protein, 9 aa, Mycobacterium
AAEVGRTAT

SEQ ID NO: 410276 - protein, 7 aa, Mycobacterium
AAEVNAR

SEQ ID NO: 410277 - protein, 8 aa, Mycobacterium
AAEVPDEL

SEQ ID NO: 410278 - protein, 13 aa, Mycobacterium
AAEVPLPDGPRPV

SEQ ID NO: 410279 - protein, 12 aa, Mycobacterium
AAEVTEKKAGAA

SEQ ID NO: 410280 - protein, 11 aa, Mycobacterium
AAEVTRDGEDA

SEQ ID NO: 410281 - protein, 16 aa, Mycobacterium
AAEVTYAGAEAAPSVD

SEQ ID NO: 410282 - protein, 7 aa, Mycobacterium
AAEWGTP

SEQ ID NO: 410283 - protein, 4 aa, Mycobacterium
AAEY

SEQ ID NO: 410284 - protein, 10 aa, Mycobacterium
AAEYASRRHT

SEQ ID NO: 410285 - protein, 6 aa, Mycobacterium
AAEYDE

SEQ ID NO: 410286 - protein, 7 aa, Mycobacterium
AAEYEKR

SEQ ID NO: 410287 - protein, 7 aa, Mycobacterium
AAFASAG

SEQ ID NO: 410288 - protein, 4 aa, Mycobacterium
AAFD

SEQ ID NO: 410289 - protein, 8 aa, Mycobacterium
AAFDPAGQ

SEQ ID NO: 410290 - protein, 29 aa, Mycobacterium
AAFDPVPAPTQPRKTRQSPVRRNGKRPAM

SEQ ID NO: 410291 - protein, 6 aa, Mycobacterium
AAFDSR

SEQ ID NO: 410292 - protein, 12 aa, Mycobacterium
AAFDTGDWATDT

SEQ ID NO: 410293 - protein, 4 aa, Mycobacterium
AAFE

SEQ ID NO: 410294 - protein, 19 aa, Mycobacterium
AAFEPEPLPEPVDPPADQW

SEQ ID NO: 410295 - protein, 6 aa, Mycobacterium
AAFGAK

SEQ ID NO: 410296 - protein, 9 aa, Mycobacterium
AAFGEDPAT

SEQ ID NO: 410297 - protein, 7 aa, Mycobacterium
AAFGGRT

SEQ ID NO: 410298 - protein, 7 aa, Mycobacterium
AAFGGTA

SEQ ID NO: 410299 - protein, 6 aa, Mycobacterium
AAFGPA

SEQ ID NO: 410300 - protein, 11 aa, Mycobacterium
AAFGPNPLDPG

SEQ ID NO: 410301 - protein, 7 aa, Mycobacterium
AAFGRDG

SEQ ID NO: 410302 - protein, 7 aa, Mycobacterium
AAFGSVT

SEQ ID NO: 410303 - protein, 4 aa, Mycobacterium
AAFK

SEQ ID NO: 410304 - protein, 12 aa, Mycobacterium
AAFNAENNRRRH

SEQ ID NO: 410305 - protein, 17 aa, Mycobacterium
AAFPGGAADPDDRSPVH

SEQ ID NO: 410306 - protein, 18 aa, Mycobacterium
AAFPGGAADPTDDGPVAT

SEQ ID NO: 410307 - protein, 19 aa, Mycobacterium
AAFPGGASDPDDEGPVGTA

SEQ ID NO: 410308 - protein, 17 aa, Mycobacterium
AAFPGGASDPGDDGPVA

SEQ ID NO: 410309 - protein, 17 aa, Mycobacterium
AAFPGGASDPGDQGPVA

SEQ ID NO: 410310 - protein, 17 aa, Mycobacterium
AAFPGGATDPGDTGPVA

SEQ ID NO: 410311 - protein, 6 aa, Mycobacterium
AAFPKR

SEQ ID NO: 410312 - protein, 14 aa, Mycobacterium
AAFPKRLGKPDEYA

SEQ ID NO: 410313 - protein, 6 aa, Mycobacterium
AAFPTT

SEQ ID NO: 410314 - protein, 4 aa, Mycobacterium
AAFQ

SEQ ID NO: 410315 - protein, 20 aa, Mycobacterium
AAFQGEPARPAYATAKAGIG

SEQ ID NO: 410316 - protein, 8 aa, Mycobacterium
AAFQPTPG

SEQ ID NO: 410317 - protein, 13 aa, Mycobacterium
AAFRAQGTPLSPG

SEQ ID NO: 410318 - protein, 5 aa, Mycobacterium
AAFRR

SEQ ID NO: 410319 - protein, 10 aa, Mycobacterium
AAGAAASGVM

SEQ ID NO: 410320 - protein, 10 aa, Mycobacterium
AAGAAASKLA

SEQ ID NO: 410321 - protein, 6 aa, Mycobacterium
AAGAAE

SEQ ID NO: 410322 - protein, 9 aa, Mycobacterium
AAGAAEAAR

SEQ ID NO: 410323 - protein, 9 aa, Mycobacterium
AAGAAEATV

SEQ ID NO: 410324 - protein, 18 aa, Mycobacterium
AAGAAGAALPTATAGTSI

SEQ ID NO: 410325 - protein, 11 aa, Mycobacterium
AAGAAGHSSTL

SEQ ID NO: 410326 - protein, 7 aa, Mycobacterium
AAGAAGL

SEQ ID NO: 410327 - protein, 12 aa, Mycobacterium
AAGAAGLPPTAP

SEQ ID NO: 410328 - protein, 25 aa, Mycobacterium
AAGAAGSSGAAGVSGAAGEAGSCGG

SEQ ID NO: 410329 - protein, 26 aa, Mycobacterium
AAGAAGSSGAAGVSGAAGEAGSCGGV

SEQ ID NO: 410330 - protein, 10 aa, Mycobacterium
AAGAAGYSGD

SEQ ID NO: 410331 - protein, 6 aa, Mycobacterium
AAGAAH

SEQ ID NO: 410332 - protein, 9 aa, Mycobacterium
AAGAAKNPS

SEQ ID NO: 410333 - protein, 12 aa, Mycobacterium
AAGAAKRDPALG

SEQ ID NO: 410334 - protein, 7 aa, Mycobacterium
AAGAAMA

SEQ ID NO: 410335 - protein, 11 aa, Mycobacterium
AAGAAPPQRSW

SEQ ID NO: 410336 - protein, 7 aa, Mycobacterium
AAGAAQP

SEQ ID NO: 410337 - protein, 11 aa, Mycobacterium
AAGAAQPAAGE

SEQ ID NO: 410338 - protein, 7 aa, Mycobacterium
AAGAASL

SEQ ID NO: 410339 - protein, 8 aa, Mycobacterium
AAGAASPL

SEQ ID NO: 410340 - protein, 7 aa, Mycobacterium
AAGAASV

SEQ ID NO: 410341 - protein, 7 aa, Mycobacterium
AAGAATD

SEQ ID NO: 410342 - protein, 9 aa, Mycobacterium
AAGAATPKH

SEQ ID NO: 410343 - protein, 13 aa, Mycobacterium
AAGAAVGTPQRRG

SEQ ID NO: 410344 - protein, 13 aa, Mycobacterium
AAGAAVRAAEARG

SEQ ID NO: 410345 - protein, 17 aa, Mycobacterium
AAGAAYAQAEAANTAAM

SEQ ID NO: 410346 - protein, 9 aa, Mycobacterium
AAGADAETL

SEQ ID NO: 410347 - protein, 9 aa, Mycobacterium
AAGADDPLL

SEQ ID NO: 410348 - protein, 10 aa, Mycobacterium
AAGADDSLDP

SEQ ID NO: 410349 - protein, 8 aa, Mycobacterium
AAGADELG

SEQ ID NO: 410350 - protein, 8 aa, Mycobacterium
AAGADEVS

SEQ ID NO: 410351 - protein, 10 aa, Mycobacterium
AAGADGLRAK

SEQ ID NO: 410352 - protein, 7 aa, Mycobacterium
AAGADGT

SEQ ID NO: 410353 - protein, 6 aa, Mycobacterium
AAGADI

SEQ ID NO: 410354 - protein, 12 aa, Mycobacterium
AAGADLADDPVT

SEQ ID NO: 410355 - protein, 7 aa, Mycobacterium
AAGADLG

SEQ ID NO: 410356 - protein, 9 aa, Mycobacterium
AAGADPDSL

SEQ ID NO: 410357 - protein, 11 aa, Mycobacterium
AAGADPRRAAE

SEQ ID NO: 410358 - protein, 15 aa, Mycobacterium
AAGADPTAPRAAGGA

SEQ ID NO: 410359 - protein, 6 aa, Mycobacterium
AAGADR

SEQ ID NO: 410360 - protein, 7 aa, Mycobacterium
AAGADTD

SEQ ID NO: 410361 - protein, 7 aa, Mycobacterium
AAGADTR

SEQ ID NO: 410362 - protein, 6 aa, Mycobacterium
AAGADV

SEQ ID NO: 410363 - protein, 14 aa, Mycobacterium
AAGADVRSASGFRD

SEQ ID NO: 410364 - protein, 5 aa, Mycobacterium
AAGAE

SEQ ID NO: 410365 - protein, 8 aa, Mycobacterium
AAGAEADG

SEQ ID NO: 410366 - protein, 11 aa, Mycobacterium
AAGAEGAAAGH

SEQ ID NO: 410367 - protein, 13 aa, Mycobacterium
AAGAELAGSAEQV

SEQ ID NO: 410368 - protein, 8 aa, Mycobacterium
AAGAEQQQ

SEQ ID NO: 410369 - protein, 17 aa, Mycobacterium
AAGAESETIDVPSGTTV

SEQ ID NO: 410370 - protein, 6 aa, Mycobacterium
AAGAET

SEQ ID NO: 410371 - protein, 24 aa, Mycobacterium
AAGAETAGYGDPQLRTEEAARKNM

SEQ ID NO: 410372 - protein, 5 aa, Mycobacterium
AAGAF

SEQ ID NO: 410373 - protein, 16 aa, Mycobacterium
AAGAGAARTTLARRTS

SEQ ID NO: 410374 - protein, 7 aa, Mycobacterium
AAGAGDR

SEQ ID NO: 410375 - protein, 6 aa, Mycobacterium
AAGAGE

SEQ ID NO: 410376 - protein, 11 aa, Mycobacterium
AAGAGESTTDL

SEQ ID NO: 410377 - protein, 13 aa, Mycobacterium
AAGAGGDFRPNPS

SEQ ID NO: 410378 - protein, 11 aa, Mycobacterium
AAGAGGFEGNA

SEQ ID NO: 410379 - protein, 17 aa, Mycobacterium
AAGAGGGAAVTAQPTQA

SEQ ID NO: 410380 - protein, 7 aa, Mycobacterium
AAGAGPL

SEQ ID NO: 410381 - protein, 11 aa, Mycobacterium
AAGAGRAEPEP

SEQ ID NO: 410382 - protein, 11 aa, Mycobacterium
AAGAGRAEPGP

SEQ ID NO: 410383 - protein, 13 aa, Mycobacterium
AAGAGRHGAQASH

SEQ ID NO: 410384 - protein, 7 aa, Mycobacterium
AAGAGRL

SEQ ID NO: 410385 - protein, 11 aa, Mycobacterium
AAGAGSRRDTR

SEQ ID NO: 410386 - protein, 10 aa, Mycobacterium
AAGAGSRRET

SEQ ID NO: 410387 - protein, 6 aa, Mycobacterium
AAGAGT

SEQ ID NO: 410388 - protein, 6 aa, Mycobacterium
AAGAGV

SEQ ID NO: 410389 - protein, 16 aa, Mycobacterium
AAGAGVTAGPEDDPEQ

SEQ ID NO: 410390 - protein, 6 aa, Mycobacterium
AAGAIE

SEQ ID NO: 410391 - protein, 11 aa, Mycobacterium
AAGAKAPTKAM

SEQ ID NO: 410392 - protein, 6 aa, Mycobacterium
AAGAKS

SEQ ID NO: 410393 - protein, 13 aa, Mycobacterium
AAGALDESGNADP

SEQ ID NO: 410394 - protein, 7 aa, Mycobacterium
AAGAMPG

SEQ ID NO: 410395 - protein, 7 aa, Mycobacterium
AAGANPI

SEQ ID NO: 410396 - protein, 8 aa, Mycobacterium
AAGANPIA

SEQ ID NO: 410397 - protein, 8 aa, Mycobacterium
AAGANPLG

SEQ ID NO: 410398 - protein, 11 aa, Mycobacterium
AAGANRIAEDD

SEQ ID NO: 410399 - protein, 5 aa, Mycobacterium
AAGAP

SEQ ID NO: 410400 - protein, 8 aa, Mycobacterium
AAGAPDAV

SEQ ID NO: 410401 - protein, 7 aa, Mycobacterium
AAGAPDG

SEQ ID NO: 410402 - protein, 6 aa, Mycobacterium
AAGAPG

SEQ ID NO: 410403 - protein, 8 aa, Mycobacterium
AAGAPGLD

SEQ ID NO: 410404 - protein, 15 aa, Mycobacterium
AAGAPISEVLEAPDA

SEQ ID NO: 410405 - protein, 7 aa, Mycobacterium
AAGAPPL

SEQ ID NO: 410406 - protein, 18 aa, Mycobacterium
AAGAPSDPSMNKGAADAL

SEQ ID NO: 410407 - protein, 8 aa, Mycobacterium
AAGAPSPL

SEQ ID NO: 410408 - protein, 9 aa, Mycobacterium
AAGAPVGGT

SEQ ID NO: 410409 - protein, 12 aa, Mycobacterium
AAGAPVGGTPKN

SEQ ID NO: 410410 - protein, 20 aa, Mycobacterium
AAGAPVPARPTAADQPTGAA

SEQ ID NO: 410411 - protein, 6 aa, Mycobacterium
AAGAQG

SEQ ID NO: 410412 - protein, 13 aa, Mycobacterium
AAGAQGGARSARD

SEQ ID NO: 410413 - protein, 6 aa, Mycobacterium
AAGAQN

SEQ ID NO: 410414 - protein, 6 aa, Mycobacterium
AAGAQR

SEQ ID NO: 410415 - protein, 7 aa, Mycobacterium
AAGAQRV

SEQ ID NO: 410416 - protein, 15 aa, Mycobacterium
AAGAQSASVQAGTAA

SEQ ID NO: 410417 - protein, 7 aa, Mycobacterium
AAGARDA

SEQ ID NO: 410418 - protein, 17 aa, Mycobacterium
AAGARDRDLGDENPFDE

SEQ ID NO: 410419 - protein, 8 aa, Mycobacterium
AAGARHGS

SEQ ID NO: 410420 - protein, 13 aa, Mycobacterium
AAGARRADRGPLL

SEQ ID NO: 410421 - protein, 10 aa, Mycobacterium
AAGARYRGDR

SEQ ID NO: 410422 - protein, 5 aa, Mycobacterium
AAGAS

SEQ ID NO: 410423 - protein, 9 aa, Mycobacterium
AAGASDHSR

SEQ ID NO: 410424 - protein, 7 aa, Mycobacterium
AAGASGA

SEQ ID NO: 410425 - protein, 25 aa, Mycobacterium
AAGASNDDAAGGQAVRTKSTPTDPV

SEQ ID NO: 410426 - protein, 11 aa, Mycobacterium
AAGASNPRSLG

SEQ ID NO: 410427 - protein, 8 aa, Mycobacterium
AAGASRAK

SEQ ID NO: 410428 - protein, 6 aa, Mycobacterium
AAGASS

SEQ ID NO: 410429 - protein, 11 aa, Mycobacterium
AAGASTTKDVA

SEQ ID NO: 410430 - protein, 6 aa, Mycobacterium
AAGASY

SEQ ID NO: 410431 - protein, 5 aa, Mycobacterium
AAGAT

SEQ ID NO: 410432 - protein, 7 aa, Mycobacterium
AAGATAV

SEQ ID NO: 410433 - protein, 6 aa, Mycobacterium
AAGATE

SEQ ID NO: 410434 - protein, 7 aa, Mycobacterium
AAGATEV

SEQ ID NO: 410435 - protein, 8 aa, Mycobacterium
AAGATEVE

SEQ ID NO: 410436 - protein, 6 aa, Mycobacterium
AAGATG

SEQ ID NO: 410437 - protein, 7 aa, Mycobacterium
AAGATGA

SEQ ID NO: 410438 - protein, 9 aa, Mycobacterium
AAGATGSIA

SEQ ID NO: 410439 - protein, 61 aa, Mycobacterium
AAGATGTTGATGTTGAEQRSGVSADSADSAGVAQSQPASSAGPAGTEESRGPTSPAIAPGE

SEQ ID NO: 410440 - protein, 7 aa, Mycobacterium
AAGATGV

SEQ ID NO: 410441 - protein, 9 aa, Mycobacterium
AAGATMPDS

SEQ ID NO: 410442 - protein, 6 aa, Mycobacterium
AAGATN

SEQ ID NO: 410443 - protein, 9 aa, Mycobacterium
AAGATNKDI

SEQ ID NO: 410444 - protein, 15 aa, Mycobacterium
AAGATPPAPGQPFQA

SEQ ID NO: 410445 - protein, 9 aa, Mycobacterium
AAGATTTPL

SEQ ID NO: 410446 - protein, 21 aa, Mycobacterium
AAGATVSGDRYSDTSWLSVGR

SEQ ID NO: 410447 - protein, 5 aa, Mycobacterium
AAGAV

SEQ ID NO: 410448 - protein, 7 aa, Mycobacterium
AAGAVEK

SEQ ID NO: 410449 - protein, 8 aa, Mycobacterium
AAGAVGRE

SEQ ID NO: 410450 - protein, 8 aa, Mycobacterium
AAGAVREN

SEQ ID NO: 410451 - protein, 7 aa, Mycobacterium
AAGAVSE

SEQ ID NO: 410452 - protein, 31 aa, Mycobacterium
AAGAYQKIEEQKAAELSRQMNGSDAPPPAAE

SEQ ID NO: 410453 - protein, 9 aa, Mycobacterium
AAGCGGGAA

SEQ ID NO: 410454 - protein, 5 aa, Mycobacterium
AAGDA

SEQ ID NO: 410455 - protein, 6 aa, Mycobacterium
AAGDAA

SEQ ID NO: 410456 - protein, 7 aa, Mycobacterium
AAGDAAL

SEQ ID NO: 410457 - protein, 15 aa, Mycobacterium
AAGDAAPDPKDRVAE

SEQ ID NO: 410458 - protein, 7 aa, Mycobacterium
AAGDADG

SEQ ID NO: 410459 - protein, 14 aa, Mycobacterium
AAGDADQPITPSPD

SEQ ID NO: 410460 - protein, 19 aa, Mycobacterium
AAGDAEPRLARADPGTEAL

SEQ ID NO: 410461 - protein, 10 aa, Mycobacterium
AAGDAGAHYP

SEQ ID NO: 410462 - protein, 11 aa, Mycobacterium
AAGDAGVASEH

SEQ ID NO: 410463 - protein, 8 aa, Mycobacterium
AAGDASDD

SEQ ID NO: 410464 - protein, 8 aa, Mycobacterium
AAGDATAA

SEQ ID NO: 410465 - protein, 6 aa, Mycobacterium
AAGDDA

SEQ ID NO: 410466 - protein, 9 aa, Mycobacterium
AAGDDERGT

SEQ ID NO: 410467 - protein, 22 aa, Mycobacterium
AAGDDSFDAEQSGAEARSQGKA

SEQ ID NO: 410468 - protein, 6 aa, Mycobacterium
AAGDDY

SEQ ID NO: 410469 - protein, 7 aa, Mycobacterium
AAGDEPG

SEQ ID NO: 410470 - protein, 8 aa, Mycobacterium
AAGDETEA

SEQ ID NO: 410471 - protein, 8 aa, Mycobacterium
AAGDEVSA

SEQ ID NO: 410472 - protein, 14 aa, Mycobacterium
AAGDGQAATAAATL

SEQ ID NO: 410473 - protein, 23 aa, Mycobacterium
AAGDGRAATAARTALGEGPTGER

SEQ ID NO: 410474 - protein, 11 aa, Mycobacterium
AAGDHDGVRIE

SEQ ID NO: 410475 - protein, 8 aa, Mycobacterium
AAGDKASL

SEQ ID NO: 410476 - protein, 5 aa, Mycobacterium
AAGDP

SEQ ID NO: 410477 - protein, 6 aa, Mycobacterium
AAGDPA

SEQ ID NO: 410478 - protein, 9 aa, Mycobacterium
AAGDPAATV

SEQ ID NO: 410479 - protein, 25 aa, Mycobacterium
AAGDPARSFPAPTELPRVTSRRASP

SEQ ID NO: 410480 - protein, 8 aa, Mycobacterium
AAGDPARV

SEQ ID NO: 410481 - protein, 8 aa, Mycobacterium
AAGDPDAY

SEQ ID NO: 410482 - protein, 8 aa, Mycobacterium
AAGDPDEL

SEQ ID NO: 410483 - protein, 8 aa, Mycobacterium
AAGDPDLA

SEQ ID NO: 410484 - protein, 8 aa, Mycobacterium
AAGDPDMP

SEQ ID NO: 410485 - protein, 9 aa, Mycobacterium
AAGDPDTRY

SEQ ID NO: 410486 - protein, 6 aa, Mycobacterium
AAGDPE

SEQ ID NO: 410487 - protein, 8 aa, Mycobacterium
AAGDPGLP

SEQ ID NO: 410488 - protein, 7 aa, Mycobacterium
AAGDPGR

SEQ ID NO: 410489 - protein, 6 aa, Mycobacterium
AAGDPH

SEQ ID NO: 410490 - protein, 8 aa, Mycobacterium
AAGDPHET

SEQ ID NO: 410491 - protein, 11 aa, Mycobacterium
AAGDPQRTAKL

SEQ ID NO: 410492 - protein, 9 aa, Mycobacterium
AAGDPRSDL

SEQ ID NO: 410493 - protein, 6 aa, Mycobacterium
AAGDQS

SEQ ID NO: 410494 - protein, 7 aa, Mycobacterium
AAGDQSI

SEQ ID NO: 410495 - protein, 10 aa, Mycobacterium
AAGDQTRGTI

SEQ ID NO: 410496 - protein, 8 aa, Mycobacterium
AAGDREAH

SEQ ID NO: 410497 - protein, 6 aa, Mycobacterium
AAGDRF

SEQ ID NO: 410498 - protein, 9 aa, Mycobacterium
AAGDRGPDR

SEQ ID NO: 410499 - protein, 12 aa, Mycobacterium
AAGDRGTPLRVP

SEQ ID NO: 410500 - protein, 6 aa, Mycobacterium
AAGDRL

SEQ ID NO: 410501 - protein, 8 aa, Mycobacterium
AAGDRPAA

SEQ ID NO: 410502 - protein, 11 aa, Mycobacterium
AAGDRVPRPVR

SEQ ID NO: 410503 - protein, 11 aa, Mycobacterium
AAGDSLATDAD

SEQ ID NO: 410504 - protein, 7 aa, Mycobacterium
AAGDSVP

SEQ ID NO: 410505 - protein, 8 aa, Mycobacterium
AAGDTASR

SEQ ID NO: 410506 - protein, 12 aa, Mycobacterium
AAGDTGALSGTE

SEQ ID NO: 410507 - protein, 6 aa, Mycobacterium
AAGDVN

SEQ ID NO: 410508 - protein, 15 aa, Mycobacterium
AAGDWPSAVRSPDTQ

SEQ ID NO: 410509 - protein, 11 aa, Mycobacterium
AAGDYGQPGTH

SEQ ID NO: 410510 - protein, 7 aa, Mycobacterium
AAGDYRA

SEQ ID NO: 410511 - protein, 5 aa, Mycobacterium
AAGEA

SEQ ID NO: 410512 - protein, 15 aa, Mycobacterium
AAGEAAGHADDRDRL

SEQ ID NO: 410513 - protein, 7 aa, Mycobacterium
AAGEAAS

SEQ ID NO: 410514 - protein, 7 aa, Mycobacterium
AAGEADT

SEQ ID NO: 410515 - protein, 10 aa, Mycobacterium
AAGEAGRRQE

SEQ ID NO: 410516 - protein, 14 aa, Mycobacterium
AAGEDDAEFEEVIP

SEQ ID NO: 410517 - protein, 7 aa, Mycobacterium
AAGEDEV

SEQ ID NO: 410518 - protein, 9 aa, Mycobacterium
AAGEDPDFH

SEQ ID NO: 410519 - protein, 15 aa, Mycobacterium
AAGEDVPTSFSERRY

SEQ ID NO: 410520 - protein, 5 aa, Mycobacterium
AAGEE

SEQ ID NO: 410521 - protein, 14 aa, Mycobacterium
AAGEFGHSKTAAAA

SEQ ID NO: 410522 - protein, 5 aa, Mycobacterium
AAGEG

SEQ ID NO: 410523 - protein, 14 aa, Mycobacterium
AAGEGAGQAWLLAR

SEQ ID NO: 410524 - protein, 14 aa, Mycobacterium
AAGEGDGRAWLLAR

SEQ ID NO: 410525 - protein, 23 aa, Mycobacterium
AAGEGGYARELSEAERAQQQQAL

SEQ ID NO: 410526 - protein, 23 aa, Mycobacterium
AAGEGGYARELTDEERAQQQKAL

SEQ ID NO: 410527 - protein, 23 aa, Mycobacterium
AAGEGGYARELTDEERAQQQQAL

SEQ ID NO: 410528 - protein, 24 aa, Mycobacterium
AAGEGGYARELTDEERQKQQQALE

SEQ ID NO: 410529 - protein, 24 aa, Mycobacterium
AAGEGGYARELTEDERAQQQKSLE

SEQ ID NO: 410530 - protein, 6 aa, Mycobacterium
AAGEGP

SEQ ID NO: 410531 - protein, 9 aa, Mycobacterium
AAGEGYSGT

SEQ ID NO: 410532 - protein, 9 aa, Mycobacterium
AAGEHARRE

SEQ ID NO: 410533 - protein, 12 aa, Mycobacterium
AAGEHYGRTPTD

SEQ ID NO: 410534 - protein, 5 aa, Mycobacterium
AAGEI

SEQ ID NO: 410535 - protein, 5 aa, Mycobacterium
AAGEL

SEQ ID NO: 410536 - protein, 6 aa, Mycobacterium
AAGELG

SEQ ID NO: 410537 - protein, 15 aa, Mycobacterium
AAGELGRKAGQGFYS

SEQ ID NO: 410538 - protein, 7 aa, Mycobacterium
AAGEMRG

SEQ ID NO: 410539 - protein, 10 aa, Mycobacterium
AAGEPDPPMP

SEQ ID NO: 410540 - protein, 9 aa, Mycobacterium
AAGEPEPDT

SEQ ID NO: 410541 - protein, 7 aa, Mycobacterium
AAGEPGA

SEQ ID NO: 410542 - protein, 9 aa, Mycobacterium
AAGEPGAGV

SEQ ID NO: 410543 - protein, 8 aa, Mycobacterium
AAGEPGDL

SEQ ID NO: 410544 - protein, 8 aa, Mycobacterium
AAGEPGST

SEQ ID NO: 410545 - protein, 6 aa, Mycobacterium
AAGEPH

SEQ ID NO: 410546 - protein, 8 aa, Mycobacterium
AAGEPIPP

SEQ ID NO: 410547 - protein, 20 aa, Mycobacterium
AAGEPKPEKRGGASGGLGDL

SEQ ID NO: 410548 - protein, 18 aa, Mycobacterium
AAGEPKPVTSAPEGLRPD

SEQ ID NO: 410549 - protein, 8 aa, Mycobacterium
AAGEPLPV

SEQ ID NO: 410550 - protein, 7 aa, Mycobacterium
AAGEPMT

SEQ ID NO: 410551 - protein, 11 aa, Mycobacterium
AAGEPPQDSRL

SEQ ID NO: 410552 - protein, 7 aa, Mycobacterium
AAGEPSF

SEQ ID NO: 410553 - protein, 10 aa, Mycobacterium
AAGEQLPSPL

SEQ ID NO: 410554 - protein, 6 aa, Mycobacterium
AAGERA

SEQ ID NO: 410555 - protein, 11 aa, Mycobacterium
AAGERDERGWE

SEQ ID NO: 410556 - protein, 6 aa, Mycobacterium
AAGERG

SEQ ID NO: 410557 - protein, 9 aa, Mycobacterium
AAGERGDYR

SEQ ID NO: 410558 - protein, 8 aa, Mycobacterium
AAGERGQV

SEQ ID NO: 410559 - protein, 8 aa, Mycobacterium
AAGERGTD

SEQ ID NO: 410560 - protein, 6 aa, Mycobacterium
AAGERL

SEQ ID NO: 410561 - protein, 8 aa, Mycobacterium
AAGERPAE

SEQ ID NO: 410562 - protein, 8 aa, Mycobacterium
AAGERTAG

SEQ ID NO: 410563 - protein, 5 aa, Mycobacterium
AAGES

SEQ ID NO: 410564 - protein, 20 aa, Mycobacterium
AAGESAPGVVAPRDGSVGPG

SEQ ID NO: 410565 - protein, 18 aa, Mycobacterium
AAGESGLARATYDGRPGH

SEQ ID NO: 410566 - protein, 9 aa, Mycobacterium
AAGESGPTV

SEQ ID NO: 410567 - protein, 7 aa, Mycobacterium
AAGESHA

SEQ ID NO: 410568 - protein, 6 aa, Mycobacterium
AAGESL

SEQ ID NO: 410569 - protein, 20 aa, Mycobacterium
AAGESRDPLPAAVSPTANGI

SEQ ID NO: 410570 - protein, 15 aa, Mycobacterium
AAGETAVDDLDGSDP

SEQ ID NO: 410571 - protein, 8 aa, Mycobacterium
AAGETIGQ

SEQ ID NO: 410572 - protein, 10 aa, Mycobacterium
AAGETLPSPL

SEQ ID NO: 410573 - protein, 12 aa, Mycobacterium
AAGETPETYPTG

SEQ ID NO: 410574 - protein, 10 aa, Mycobacterium
AAGETRPDVA

SEQ ID NO: 410575 - protein, 13 aa, Mycobacterium
AAGETRPGFDQQP

SEQ ID NO: 410576 - protein, 5 aa, Mycobacterium
AAGEV

SEQ ID NO: 410577 - protein, 10 aa, Mycobacterium
AAGEVTGDSE

SEQ ID NO: 410578 - protein, 11 aa, Mycobacterium
AAGFGDYQART

SEQ ID NO: 410579 - protein, 12 aa, Mycobacterium
AAGFGQSSTTPT

SEQ ID NO: 410580 - protein, 10 aa, Mycobacterium
AAGFNPSEKA

SEQ ID NO: 410581 - protein, 10 aa, Mycobacterium
AAGFNPSEKS

SEQ ID NO: 410582 - protein, 10 aa, Mycobacterium
AAGFSDSAHA

SEQ ID NO: 410583 - protein, 12 aa, Mycobacterium
AAGFSDSSHANR

SEQ ID NO: 410584 - protein, 11 aa, Mycobacterium
AAGFTPSEKDS

SEQ ID NO: 410585 - protein, 7 aa, Mycobacterium
AAGFTSV

SEQ ID NO: 410586 - protein, 5 aa, Mycobacterium
AAGGA

SEQ ID NO: 410587 - protein, 6 aa, Mycobacterium
AAGGAA

SEQ ID NO: 410588 - protein, 12 aa, Mycobacterium
AAGGAAAQERAR

SEQ ID NO: 410589 - protein, 12 aa, Mycobacterium
AAGGAAAQERAS

SEQ ID NO: 410590 - protein, 23 aa, Mycobacterium
AAGGADADAKLAEASAAIARLVR

SEQ ID NO: 410591 - protein, 18 aa, Mycobacterium
AAGGADTEGEGEGEGKSL

SEQ ID NO: 410592 - protein, 15 aa, Mycobacterium
AAGGAEPAAEFPDPD

SEQ ID NO: 410593 - protein, 13 aa, Mycobacterium
AAGGAIPDLPAPF

SEQ ID NO: 410594 - protein, 7 aa, Mycobacterium
AAGGAPC

SEQ ID NO: 410595 - protein, 6 aa, Mycobacterium
AAGGAR

SEQ ID NO: 410596 - protein, 7 aa, Mycobacterium
AAGGASQ

SEQ ID NO: 410597 - protein, 5 aa, Mycobacterium
AAGGD

SEQ ID NO: 410598 - protein, 6 aa, Mycobacterium
AAGGDA

SEQ ID NO: 410599 - protein, 7 aa, Mycobacterium
AAGGDAQ

SEQ ID NO: 410600 - protein, 15 aa, Mycobacterium
AAGGDPARTPSCPRL

SEQ ID NO: 410601 - protein, 6 aa, Mycobacterium
AAGGDT

SEQ ID NO: 410602 - protein, 7 aa, Mycobacterium
AAGGDTA

SEQ ID NO: 410603 - protein, 5 aa, Mycobacterium
AAGGE

SEQ ID NO: 410604 - protein, 6 aa, Mycobacterium
AAGGEA

SEQ ID NO: 410605 - protein, 11 aa, Mycobacterium
AAGGEAGPVRS

SEQ ID NO: 410606 - protein, 14 aa, Mycobacterium
AAGGEDYRRSDPNI

SEQ ID NO: 410607 - protein, 14 aa, Mycobacterium
AAGGEIRADTDVEA

SEQ ID NO: 410608 - protein, 16 aa, Mycobacterium
AAGGEPAGLGARDTLR

SEQ ID NO: 410609 - protein, 13 aa, Mycobacterium
AAGGEPDANVEMD

SEQ ID NO: 410610 - protein, 8 aa, Mycobacterium
AAGGESAE

SEQ ID NO: 410611 - protein, 11 aa, Mycobacterium
AAGGETPTDTA

SEQ ID NO: 410612 - protein, 5 aa, Mycobacterium
AAGGG

SEQ ID NO: 410613 - protein, 6 aa, Mycobacterium
AAGGGA

SEQ ID NO: 410614 - protein, 7 aa, Mycobacterium
AAGGGAA

SEQ ID NO: 410615 - protein, 8 aa, Mycobacterium
AAGGGALP

SEQ ID NO: 410616 - protein, 6 aa, Mycobacterium
AAGGGC

SEQ ID NO: 410617 - protein, 6 aa, Mycobacterium
AAGGGD

SEQ ID NO: 410618 - protein, 14 aa, Mycobacterium
AAGGGDATDATDTV

SEQ ID NO: 410619 - protein, 7 aa, Mycobacterium
AAGGGDI

SEQ ID NO: 410620 - protein, 10 aa, Mycobacterium
AAGGGFDTHP

SEQ ID NO: 410621 - protein, 6 aa, Mycobacterium
AAGGGG

SEQ ID NO: 410622 - protein, 12 aa, Mycobacterium
AAGGGGSDGPLD

SEQ ID NO: 410623 - protein, 8 aa, Mycobacterium
AAGGGIGT

SEQ ID NO: 410624 - protein, 9 aa, Mycobacterium
AAGGGIGTT

SEQ ID NO: 410625 - protein, 8 aa, Mycobacterium
AAGGGNPE

SEQ ID NO: 410626 - protein, 10 aa, Mycobacterium
AAGGGPELDR

SEQ ID NO: 410627 - protein, 27 aa, Mycobacterium
AAGGGPNPTTGGARPRRPHGAPRRPRR

SEQ ID NO: 410628 - protein, 16 aa, Mycobacterium
AAGGGQSEPATTPTPT

SEQ ID NO: 410629 - protein, 7 aa, Mycobacterium
AAGGGRF

SEQ ID NO: 410630 - protein, 9 aa, Mycobacterium
AAGGGRMRR

SEQ ID NO: 410631 - protein, 7 aa, Mycobacterium
AAGGGSM

SEQ ID NO: 410632 - protein, 8 aa, Mycobacterium
AAGGGSRK

SEQ ID NO: 410633 - protein, 8 aa, Mycobacterium
AAGGGSRR

SEQ ID NO: 410634 - protein, 20 aa, Mycobacterium
AAGGGSYAAAEAASAASITS

SEQ ID NO: 410635 - protein, 7 aa, Mycobacterium
AAGGGTM

SEQ ID NO: 410636 - protein, 5 aa, Mycobacterium
AAGGH

SEQ ID NO: 410637 - protein, 8 aa, Mycobacterium
AAGGHHGM

SEQ ID NO: 410638 - protein, 9 aa, Mycobacterium
AAGGHHGMP

SEQ ID NO: 410639 - protein, 7 aa, Mycobacterium
AAGGHPL

SEQ ID NO: 410640 - protein, 9 aa, Mycobacterium
AAGGHPQDR

SEQ ID NO: 410641 - protein, 6 aa, Mycobacterium
AAGGHV

SEQ ID NO: 410642 - protein, 7 aa, Mycobacterium
AAGGIPR

SEQ ID NO: 410643 - protein, 5 aa, Mycobacterium
AAGGK

SEQ ID NO: 410644 - protein, 9 aa, Mycobacterium
AAGGKGGDA

SEQ ID NO: 410645 - protein, 6 aa, Mycobacterium
AAGGKL

SEQ ID NO: 410646 - protein, 18 aa, Mycobacterium
AAGGKPEPYEAGTWGPDS

SEQ ID NO: 410647 - protein, 16 aa, Mycobacterium
AAGGKRRIHKTPSRTE

SEQ ID NO: 410648 - protein, 6 aa, Mycobacterium
AAGGLD

SEQ ID NO: 410649 - protein, 7 aa, Mycobacterium
AAGGLRP

SEQ ID NO: 410650 - protein, 9 aa, Mycobacterium
AAGGLRPEY

SEQ ID NO: 410651 - protein, 7 aa, Mycobacterium
AAGGLTP

SEQ ID NO: 410652 - protein, 8 aa, Mycobacterium
AAGGMGAE

SEQ ID NO: 410653 - protein, 7 aa, Mycobacterium
AAGGNIA

SEQ ID NO: 410654 - protein, 7 aa, Mycobacterium
AAGGNVR

SEQ ID NO: 410655 - protein, 5 aa, Mycobacterium
AAGGP

SEQ ID NO: 410656 - protein, 24 aa, Mycobacterium
AAGGPAGGGRIPAGGRGRRRRRGG

SEQ ID NO: 410657 - protein, 7 aa, Mycobacterium
AAGGPAL

SEQ ID NO: 410658 - protein, 8 aa, Mycobacterium
AAGGPDSA

SEQ ID NO: 410659 - protein, 8 aa, Mycobacterium
AAGGPELD

SEQ ID NO: 410660 - protein, 7 aa, Mycobacterium
AAGGPGE

SEQ ID NO: 410661 - protein, 17 aa, Mycobacterium
AAGGPISDPKPAVQGGR

SEQ ID NO: 410662 - protein, 7 aa, Mycobacterium
AAGGPIT

SEQ ID NO: 410663 - protein, 10 aa, Mycobacterium
AAGGPNLDKR

SEQ ID NO: 410664 - protein, 9 aa, Mycobacterium
AAGGPPEIT

SEQ ID NO: 410665 - protein, 7 aa, Mycobacterium
AAGGPPK

SEQ ID NO: 410666 - protein, 8 aa, Mycobacterium
AAGGPTDV

SEQ ID NO: 410667 - protein, 8 aa, Mycobacterium
AAGGPTVE

SEQ ID NO: 410668 - protein, 7 aa, Mycobacterium
AAGGPVA

SEQ ID NO: 410669 - protein, 5 aa, Mycobacterium
AAGGQ

SEQ ID NO: 410670 - protein, 6 aa, Mycobacterium
AAGGQA

SEQ ID NO: 410671 - protein, 7 aa, Mycobacterium
AAGGQAL

SEQ ID NO: 410672 - protein, 6 aa, Mycobacterium
AAGGQG

SEQ ID NO: 410673 - protein, 7 aa, Mycobacterium
AAGGQGI

SEQ ID NO: 410674 - protein, 12 aa, Mycobacterium
AAGGQSNVPRLA

SEQ ID NO: 410675 - protein, 6 aa, Mycobacterium
AAGGRA

SEQ ID NO: 410676 - protein, 20 aa, Mycobacterium
AAGGRGAGGRGRRLRSAGRA

SEQ ID NO: 410677 - protein, 12 aa, Mycobacterium
AAGGRKAARRHA

SEQ ID NO: 410678 - protein, 6 aa, Mycobacterium
AAGGRL

SEQ ID NO: 410679 - protein, 9 aa, Mycobacterium
AAGGRRRDG

SEQ ID NO: 410680 - protein, 6 aa, Mycobacterium
AAGGRT

SEQ ID NO: 410681 - protein, 15 aa, Mycobacterium
AAGGRTDSVKPAKSI

SEQ ID NO: 410682 - protein, 11 aa, Mycobacterium
AAGGSADSIGG

SEQ ID NO: 410683 - protein, 7 aa, Mycobacterium
AAGGSRE

SEQ ID NO: 410684 - protein, 99 aa, Mycobacterium
AAGGSRGAEQGQRAPAQPTGPGGDRSKSDPAGAAGPAVAQQPAAHAAGSASDTAGAADSTVTDQPGTAAGPSPLTHRTRPARTAVAPQNPAGPTGLPGA

SEQ ID NO: 410685 - protein, 10 aa, Mycobacterium
AAGGSSYTGV

SEQ ID NO: 410686 - protein, 11 aa, Mycobacterium
AAGGSTPAQAD

SEQ ID NO: 410687 - protein, 33 aa, Mycobacterium
AAGGSYAAAEAANASPCRPSNSRCSPLSTHQPK

SEQ ID NO: 410688 - protein, 5 aa, Mycobacterium
AAGGT

SEQ ID NO: 410689 - protein, 10 aa, Mycobacterium
AAGGTAPTAQ

SEQ ID NO: 410690 - protein, 8 aa, Mycobacterium
AAGGTASA

SEQ ID NO: 410691 - protein, 6 aa, Mycobacterium
AAGGTG

SEQ ID NO: 410692 - protein, 56 aa, Mycobacterium
AAGGTGSIGAGGAAGAGGAGGAGGAGGAGGTAQGSGASGGTGANGHTGLDGAPGQP

SEQ ID NO: 410693 - protein, 13 aa, Mycobacterium
AAGGTRGRDGAQG

SEQ ID NO: 410694 - protein, 8 aa, Mycobacterium
AAGGTRYD

SEQ ID NO: 410695 - protein, 7 aa, Mycobacterium
AAGGTSA

SEQ ID NO: 410696 - protein, 10 aa, Mycobacterium
AAGGTTGYDH

SEQ ID NO: 410697 - protein, 9 aa, Mycobacterium
AAGGTTNHN

SEQ ID NO: 410698 - protein, 7 aa, Mycobacterium
AAGGTTP

SEQ ID NO: 410699 - protein, 9 aa, Mycobacterium
AAGGTVTTL

SEQ ID NO: 410700 - protein, 6 aa, Mycobacterium
AAGGTW

SEQ ID NO: 410701 - protein, 5 aa, Mycobacterium
AAGGV

SEQ ID NO: 410702 - protein, 9 aa, Mycobacterium
AAGGVANAD

SEQ ID NO: 410703 - protein, 8 aa, Mycobacterium
AAGGVEPS

SEQ ID NO: 410704 - protein, 7 aa, Mycobacterium
AAGGVGS

SEQ ID NO: 410705 - protein, 6 aa, Mycobacterium
AAGGVP

SEQ ID NO: 410706 - protein, 7 aa, Mycobacterium
AAGGVPR

SEQ ID NO: 410707 - protein, 8 aa, Mycobacterium
AAGGWGAP

SEQ ID NO: 410708 - protein, 9 aa, Mycobacterium
AAGGYGLDP

SEQ ID NO: 410709 - protein, 11 aa, Mycobacterium
AAGHAVSASTA

SEQ ID NO: 410710 - protein, 7 aa, Mycobacterium
AAGHDAE

SEQ ID NO: 410711 - protein, 9 aa, Mycobacterium
AAGHDRARR

SEQ ID NO: 410712 - protein, 6 aa, Mycobacterium
AAGHER

SEQ ID NO: 410713 - protein, 10 aa, Mycobacterium
AAGHGDDEIS

SEQ ID NO: 410714 - protein, 7 aa, Mycobacterium
AAGHGDP

SEQ ID NO: 410715 - protein, 10 aa, Mycobacterium
AAGHGSYGTV

SEQ ID NO: 410716 - protein, 7 aa, Mycobacterium
AAGHRDV

SEQ ID NO: 410717 - protein, 16 aa, Mycobacterium
AAGHRGSHGKSEQPAT

SEQ ID NO: 410718 - protein, 9 aa, Mycobacterium
AAGHSADQA

SEQ ID NO: 410719 - protein, 21 aa, Mycobacterium
AAGHSAKANYTGAMSTNFTMW

SEQ ID NO: 410720 - protein, 5 aa, Mycobacterium
AAGHT

SEQ ID NO: 410721 - protein, 19 aa, Mycobacterium
AAGHTTTDGPYTETKEQLG

SEQ ID NO: 410722 - protein, 13 aa, Mycobacterium
AAGIATAEPTTTL

SEQ ID NO: 410723 - protein, 5 aa, Mycobacterium
AAGID

SEQ ID NO: 410724 - protein, 8 aa, Mycobacterium
AAGIDDSQ

SEQ ID NO: 410725 - protein, 8 aa, Mycobacterium
AAGIDPDG

SEQ ID NO: 410726 - protein, 6 aa, Mycobacterium
AAGIEG

SEQ ID NO: 410727 - protein, 7 aa, Mycobacterium
AAGIETE

SEQ ID NO: 410728 - protein, 20 aa, Mycobacterium
AAGIGEHTSPPTPGSTNNLD

SEQ ID NO: 410729 - protein, 20 aa, Mycobacterium
AAGIKGSPLHTPYTASKAGV

SEQ ID NO: 410730 - protein, 7 aa, Mycobacterium
AAGIPED

SEQ ID NO: 410731 - protein, 7 aa, Mycobacterium
AAGISGP

SEQ ID NO: 410732 - protein, 8 aa, Mycobacterium
AAGKAGAE

SEQ ID NO: 410733 - protein, 8 aa, Mycobacterium
AAGKARPI

SEQ ID NO: 410734 - protein, 11 aa, Mycobacterium
AAGKATPALGK

SEQ ID NO: 410735 - protein, 5 aa, Mycobacterium
AAGKD

SEQ ID NO: 410736 - protein, 8 aa, Mycobacterium
AAGKDDTL

SEQ ID NO: 410737 - protein, 8 aa, Mycobacterium
AAGKDPAR

SEQ ID NO: 410738 - protein, 7 aa, Mycobacterium
AAGKIGE

SEQ ID NO: 410739 - protein, 14 aa, Mycobacterium
AAGKNKVDGKAEEI

SEQ ID NO: 410740 - protein, 8 aa, Mycobacterium
AAGKPASV

SEQ ID NO: 410741 - protein, 8 aa, Mycobacterium
AAGKPTIS

SEQ ID NO: 410742 - protein, 15 aa, Mycobacterium
AAGKSHRAPGRADKR

SEQ ID NO: 410743 - protein, 9 aa, Mycobacterium
AAGKTAQEH

SEQ ID NO: 410744 - protein, 8 aa, Mycobacterium
AAGKTPVP

SEQ ID NO: 410745 - protein, 10 aa, Mycobacterium
AAGKTQEEIA

SEQ ID NO: 410746 - protein, 8 aa, Mycobacterium
AAGKYPTY

SEQ ID NO: 410747 - protein, 17 aa, Mycobacterium
AAGLATRRADGAEAWGG

SEQ ID NO: 410748 - protein, 22 aa, Mycobacterium
AAGLDGAARDVESGGGKALTIP

SEQ ID NO: 410749 - protein, 9 aa, Mycobacterium
AAGLDLGGR

SEQ ID NO: 410750 - protein, 22 aa, Mycobacterium
AAGLDPDASGPADWDRDPSAHL

SEQ ID NO: 410751 - protein, 18 aa, Mycobacterium
AAGLEGAARDVENGGGKA

SEQ ID NO: 410752 - protein, 5 aa, Mycobacterium
AAGLG

SEQ ID NO: 410753 - protein, 9 aa, Mycobacterium
AAGLGDADT

SEQ ID NO: 410754 - protein, 8 aa, Mycobacterium
AAGLGGST

SEQ ID NO: 410755 - protein, 8 aa, Mycobacterium
AAGLGPTT

SEQ ID NO: 410756 - protein, 5 aa, Mycobacterium
AAGLP

SEQ ID NO: 410757 - protein, 7 aa, Mycobacterium
AAGLPDV

SEQ ID NO: 410758 - protein, 9 aa, Mycobacterium
AAGLPEELS

SEQ ID NO: 410759 - protein, 6 aa, Mycobacterium
AAGLPG

SEQ ID NO: 410760 - protein, 7 aa, Mycobacterium
AAGLPGI

SEQ ID NO: 410761 - protein, 7 aa, Mycobacterium
AAGLPGV

SEQ ID NO: 410762 - protein, 15 aa, Mycobacterium
AAGLPPAERSLLRHA

SEQ ID NO: 410763 - protein, 16 aa, Mycobacterium
AAGLPRARGSLPGSVA

SEQ ID NO: 410764 - protein, 16 aa, Mycobacterium
AAGLPSAIDGPTIGSN

SEQ ID NO: 410765 - protein, 11 aa, Mycobacterium
AAGLPTRQGMS

SEQ ID NO: 410766 - protein, 12 aa, Mycobacterium
AAGLSTEDVSDL

SEQ ID NO: 410767 - protein, 9 aa, Mycobacterium
AAGLTPATY

SEQ ID NO: 410768 - protein, 8 aa, Mycobacterium
AAGMDKEY

SEQ ID NO: 410769 - protein, 10 aa, Mycobacterium
AAGMPGATTS

SEQ ID NO: 410770 - protein, 4 aa, Mycobacterium
AAGN

SEQ ID NO: 410771 - protein, 5 aa, Mycobacterium
AAGNA

SEQ ID NO: 410772 - protein, 15 aa, Mycobacterium
AAGNAAGDLHTPAPV

SEQ ID NO: 410773 - protein, 11 aa, Mycobacterium
AAGNAARALDG

SEQ ID NO: 410774 - protein, 7 aa, Mycobacterium
AAGNAKR

SEQ ID NO: 410775 - protein, 6 aa, Mycobacterium
AAGNAL

SEQ ID NO: 410776 - protein, 9 aa, Mycobacterium
AAGNEMPEG

SEQ ID NO: 410777 - protein, 8 aa, Mycobacterium
AAGNERRT

SEQ ID NO: 410778 - protein, 15 aa, Mycobacterium
AAGNMGTVAPGPDFN

SEQ ID NO: 410779 - protein, 6 aa, Mycobacterium
AAGNPL

SEQ ID NO: 410780 - protein, 17 aa, Mycobacterium
AAGNPLTAGSARSVDPA

SEQ ID NO: 410781 - protein, 17 aa, Mycobacterium
AAGNPLTAGSPRPVDPR

SEQ ID NO: 410782 - protein, 15 aa, Mycobacterium
AAGNPLTAGSVRPVD

SEQ ID NO: 410783 - protein, 7 aa, Mycobacterium
AAGNPNR

SEQ ID NO: 410784 - protein, 8 aa, Mycobacterium
AAGNPNRP

SEQ ID NO: 410785 - protein, 7 aa, Mycobacterium
AAGNSTV

SEQ ID NO: 410786 - protein, 6 aa, Mycobacterium
AAGNTS

SEQ ID NO: 410787 - protein, 4 aa, Mycobacterium
AAGP

SEQ ID NO: 410788 - protein, 19 aa, Mycobacterium
AAGPAAGGGAAEAAEEQSE

SEQ ID NO: 410789 - protein, 12 aa, Mycobacterium
AAGPADAAAGGT

SEQ ID NO: 410790 - protein, 12 aa, Mycobacterium
AAGPADEPGREL

SEQ ID NO: 410791 - protein, 8 aa, Mycobacterium
AAGPADVE

SEQ ID NO: 410792 - protein, 21 aa, Mycobacterium
AAGPAEFDEAAAAARAAQPGW

SEQ ID NO: 410793 - protein, 10 aa, Mycobacterium
AAGPAGAPRD

SEQ ID NO: 410794 - protein, 12 aa, Mycobacterium
AAGPAGASDTAY

SEQ ID NO: 410795 - protein, 12 aa, Mycobacterium
AAGPAGPADTSM

SEQ ID NO: 410796 - protein, 10 aa, Mycobacterium
AAGPAKDRLT

SEQ ID NO: 410797 - protein, 11 aa, Mycobacterium
AAGPAPQAPPM

SEQ ID NO: 410798 - protein, 16 aa, Mycobacterium
AAGPATETLASNTAQL

SEQ ID NO: 410799 - protein, 9 aa, Mycobacterium
AAGPATTSR

SEQ ID NO: 410800 - protein, 13 aa, Mycobacterium
AAGPAVDLGGRTS

SEQ ID NO: 410801 - protein, 6 aa, Mycobacterium
AAGPCS

SEQ ID NO: 410802 - protein, 7 aa, Mycobacterium
AAGPCSG

SEQ ID NO: 410803 - protein, 5 aa, Mycobacterium
AAGPD

SEQ ID NO: 410804 - protein, 26 aa, Mycobacterium
AAGPDAAAAAELESSAARARSRGGAC

SEQ ID NO: 410805 - protein, 6 aa, Mycobacterium
AAGPDD

SEQ ID NO: 410806 - protein, 8 aa, Mycobacterium
AAGPDDHP

SEQ ID NO: 410807 - protein, 6 aa, Mycobacterium
AAGPDG

SEQ ID NO: 410808 - protein, 7 aa, Mycobacterium
AAGPDLS

SEQ ID NO: 410809 - protein, 7 aa, Mycobacterium
AAGPDNL

SEQ ID NO: 410810 - protein, 8 aa, Mycobacterium
AAGPDPAV

SEQ ID NO: 410811 - protein, 9 aa, Mycobacterium
AAGPEALAS

SEQ ID NO: 410812 - protein, 10 aa, Mycobacterium
AAGPEDPERR

SEQ ID NO: 410813 - protein, 8 aa, Mycobacterium
AAGPEDVD

SEQ ID NO: 410814 - protein, 8 aa, Mycobacterium
AAGPENEA

SEQ ID NO: 410815 - protein, 7 aa, Mycobacterium
AAGPERV

SEQ ID NO: 410816 - protein, 32 aa, Mycobacterium
AAGPESPVGKRRGDTAVAAGAPSAPSASGAPI

SEQ ID NO: 410817 - protein, 11 aa, Mycobacterium
AAGPGGPARAR

SEQ ID NO: 410818 - protein, 8 aa, Mycobacterium
AAGPGHNL

SEQ ID NO: 410819 - protein, 23 aa, Mycobacterium
AAGPGIRPRAAGAPRWSGRSARN

SEQ ID NO: 410820 - protein, 7 aa, Mycobacterium
AAGPGLE

SEQ ID NO: 410821 - protein, 8 aa, Mycobacterium
AAGPGLTR

SEQ ID NO: 410822 - protein, 6 aa, Mycobacterium
AAGPGM

SEQ ID NO: 410823 - protein, 8 aa, Mycobacterium
AAGPGQIQ

SEQ ID NO: 410824 - protein, 8 aa, Mycobacterium
AAGPGRPC

SEQ ID NO: 410825 - protein, 7 aa, Mycobacterium
AAGPGRR

SEQ ID NO: 410826 - protein, 10 aa, Mycobacterium
AAGPGTEARE

SEQ ID NO: 410827 - protein, 10 aa, Mycobacterium
AAGPKDPTFK

SEQ ID NO: 410828 - protein, 10 aa, Mycobacterium
AAGPKSGTRV

SEQ ID NO: 410829 - protein, 10 aa, Mycobacterium
AAGPLTKEEL

SEQ ID NO: 410830 - protein, 10 aa, Mycobacterium
AAGPMNRPPD

SEQ ID NO: 410831 - protein, 7 aa, Mycobacterium
AAGPNNL

SEQ ID NO: 410832 - protein, 7 aa, Mycobacterium
AAGPNVQ

SEQ ID NO: 410833 - protein, 6 aa, Mycobacterium
AAGPPA

SEQ ID NO: 410834 - protein, 8 aa, Mycobacterium
AAGPPALY

SEQ ID NO: 410835 - protein, 9 aa, Mycobacterium
AAGPPDWAG

SEQ ID NO: 410836 - protein, 18 aa, Mycobacterium
AAGPPEQVARAKQSRTAP

SEQ ID NO: 410837 - protein, 6 aa, Mycobacterium
AAGPPF

SEQ ID NO: 410838 - protein, 33 aa, Mycobacterium
AAGPPGPTGPAAAIKQTAGAARAAGSAGAAGTA

SEQ ID NO: 410839 - protein, 6 aa, Mycobacterium
AAGPPI

SEQ ID NO: 410840 - protein, 11 aa, Mycobacterium
AAGPPRPGEGS

SEQ ID NO: 410841 - protein, 7 aa, Mycobacterium
AAGPPVY

SEQ ID NO: 410842 - protein, 5 aa, Mycobacterium
AAGPQ

SEQ ID NO: 410843 - protein, 7 aa, Mycobacterium
AAGPQAG

SEQ ID NO: 410844 - protein, 7 aa, Mycobacterium
AAGPQTF

SEQ ID NO: 410845 - protein, 5 aa, Mycobacterium
AAGPR

SEQ ID NO: 410846 - protein, 7 aa, Mycobacterium
AAGPRDI

SEQ ID NO: 410847 - protein, 20 aa, Mycobacterium
AAGPRGRAYQPHATRPGGPV

SEQ ID NO: 410848 - protein, 20 aa, Mycobacterium
AAGPRGRAYQPHVTKPGGPV

SEQ ID NO: 410849 - protein, 8 aa, Mycobacterium
AAGPRGRV

SEQ ID NO: 410850 - protein, 7 aa, Mycobacterium
AAGPRPV

SEQ ID NO: 410851 - protein, 7 aa, Mycobacterium
AAGPRTR

SEQ ID NO: 410852 - protein, 16 aa, Mycobacterium
AAGPSKPRAGRDPVNQ

SEQ ID NO: 410853 - protein, 10 aa, Mycobacterium
AAGPTAHSTS

SEQ ID NO: 410854 - protein, 10 aa, Mycobacterium
AAGPTARARA

SEQ ID NO: 410855 - protein, 7 aa, Mycobacterium
AAGPTAT

SEQ ID NO: 410856 - protein, 8 aa, Mycobacterium
AAGPTAVR

SEQ ID NO: 410857 - protein, 10 aa, Mycobacterium
AAGPTGLEGA

SEQ ID NO: 410858 - protein, 17 aa, Mycobacterium
AAGPTGPTHTGCARTGA

SEQ ID NO: 410859 - protein, 7 aa, Mycobacterium
AAGPTHA

SEQ ID NO: 410860 - protein, 15 aa, Mycobacterium
AAGPTRGTDAGYGTA

SEQ ID NO: 410861 - protein, 10 aa, Mycobacterium
AAGPTTPTGR

SEQ ID NO: 410862 - protein, 7 aa, Mycobacterium
AAGPTVA

SEQ ID NO: 410863 - protein, 19 aa, Mycobacterium
AAGPTVAAPEPTEAPPGEA

SEQ ID NO: 410864 - protein, 31 aa, Mycobacterium
AAGPVGGKGAPVGATVPGGPTPGVPTPAGPQ

SEQ ID NO: 410865 - protein, 6 aa, Mycobacterium
AAGPVV

SEQ ID NO: 410866 - protein, 5 aa, Mycobacterium
AAGPW

SEQ ID NO: 410867 - protein, 27 aa, Mycobacterium
AAGPWNKRTDRGPMPSGLNPTRSEKYG

SEQ ID NO: 410868 - protein, 9 aa, Mycobacterium
AAGPYETTG

SEQ ID NO: 410869 - protein, 12 aa, Mycobacterium
AAGQAAQAGAQA

SEQ ID NO: 410870 - protein, 26 aa, Mycobacterium
AAGQADPGDTASDPGGGSGAPRGVGG

SEQ ID NO: 410871 - protein, 22 aa, Mycobacterium
AAGQADPGGRLTSSGAPTGVGG

SEQ ID NO: 410872 - protein, 19 aa, Mycobacterium
AAGQAELTAGQARAAAAAY

SEQ ID NO: 410873 - protein, 18 aa, Mycobacterium
AAGQAESAANQARTAATA

SEQ ID NO: 410874 - protein, 9 aa, Mycobacterium
AAGQDADRA

SEQ ID NO: 410875 - protein, 10 aa, Mycobacterium
AAGQDADRAR

SEQ ID NO: 410876 - protein, 7 aa, Mycobacterium
AAGQDGM

SEQ ID NO: 410877 - protein, 7 aa, Mycobacterium
AAGQEHP

SEQ ID NO: 410878 - protein, 5 aa, Mycobacterium
AAGQG

SEQ ID NO: 410879 - protein, 37 aa, Mycobacterium
AAGQGGRPQPRRHPGRGRLAGGRRRARGHAAGPERQR

SEQ ID NO: 410880 - protein, 6 aa, Mycobacterium
AAGQGI

SEQ ID NO: 410881 - protein, 6 aa, Mycobacterium
AAGQGR

SEQ ID NO: 410882 - protein, 7 aa, Mycobacterium
AAGQGRQ

SEQ ID NO: 410883 - protein, 10 aa, Mycobacterium
AAGQGRSDDV

SEQ ID NO: 410884 - protein, 14 aa, Mycobacterium
AAGQHRQEDEDQHF

SEQ ID NO: 410885 - protein, 7 aa, Mycobacterium
AAGQIKA

SEQ ID NO: 410886 - protein, 6 aa, Mycobacterium
AAGQIR

SEQ ID NO: 410887 - protein, 5 aa, Mycobacterium
AAGQL

SEQ ID NO: 410888 - protein, 11 aa, Mycobacterium
AAGQLRSGAKQ

SEQ ID NO: 410889 - protein, 12 aa, Mycobacterium
AAGQMSAGTDWR

SEQ ID NO: 410890 - protein, 13 aa, Mycobacterium
AAGQMSAGTGWRA

SEQ ID NO: 410891 - protein, 5 aa, Mycobacterium
AAGQP

SEQ ID NO: 410892 - protein, 6 aa, Mycobacterium
AAGQPG

SEQ ID NO: 410893 - protein, 8 aa, Mycobacterium
AAGQPTGV

SEQ ID NO: 410894 - protein, 5 aa, Mycobacterium
AAGQQ

SEQ ID NO: 410895 - protein, 7 aa, Mycobacterium
AAGQQPT

SEQ ID NO: 410896 - protein, 9 aa, Mycobacterium
AAGQQPTPF

SEQ ID NO: 410897 - protein, 5 aa, Mycobacterium
AAGQS

SEQ ID NO: 410898 - protein, 6 aa, Mycobacterium
AAGQSE

SEQ ID NO: 410899 - protein, 10 aa, Mycobacterium
AAGQTGGANI

SEQ ID NO: 410900 - protein, 8 aa, Mycobacterium
AAGQTPVA

SEQ ID NO: 410901 - protein, 7 aa, Mycobacterium
AAGQTVP

SEQ ID NO: 410902 - protein, 7 aa, Mycobacterium
AAGQYDP

SEQ ID NO: 410903 - protein, 7 aa, Mycobacterium
AAGRAAE

SEQ ID NO: 410904 - protein, 10 aa, Mycobacterium
AAGRAAKDVD

SEQ ID NO: 410905 - protein, 10 aa, Mycobacterium
AAGRADEATF

SEQ ID NO: 410906 - protein, 9 aa, Mycobacterium
AAGRADGAY

SEQ ID NO: 410907 - protein, 7 aa, Mycobacterium
AAGRADY

SEQ ID NO: 410908 - protein, 11 aa, Mycobacterium
AAGRAGRPAPR

SEQ ID NO: 410909 - protein, 10 aa, Mycobacterium
AAGRAGVTAT

SEQ ID NO: 410910 - protein, 8 aa, Mycobacterium
AAGRAKLE

SEQ ID NO: 410911 - protein, 11 aa, Mycobacterium
AAGRAKLGHSY

SEQ ID NO: 410912 - protein, 6 aa, Mycobacterium
AAGRAP

SEQ ID NO: 410913 - protein, 9 aa, Mycobacterium
AAGRAPEAI

SEQ ID NO: 410914 - protein, 9 aa, Mycobacterium
AAGRAPGLA

SEQ ID NO: 410915 - protein, 11 aa, Mycobacterium
AAGRAPRETDD

SEQ ID NO: 410916 - protein, 7 aa, Mycobacterium
AAGRASA

SEQ ID NO: 410917 - protein, 25 aa, Mycobacterium
AAGRASAQRLRGGSPPLQVTSDGTV

SEQ ID NO: 410918 - protein, 12 aa, Mycobacterium
AAGRATGAAVQA

SEQ ID NO: 410919 - protein, 18 aa, Mycobacterium
AAGRATHRDLASPGEQIS

SEQ ID NO: 410920 - protein, 19 aa, Mycobacterium
AAGRAVSAEPGAGAAGGIG

SEQ ID NO: 410921 - protein, 12 aa, Mycobacterium
AAGRDGLWPLIT

SEQ ID NO: 410922 - protein, 6 aa, Mycobacterium
AAGRDI

SEQ ID NO: 410923 - protein, 8 aa, Mycobacterium
AAGRDNHP

SEQ ID NO: 410924 - protein, 8 aa, Mycobacterium
AAGRDNNP

SEQ ID NO: 410925 - protein, 11 aa, Mycobacterium
AAGRDPETIQN

SEQ ID NO: 410926 - protein, 8 aa, Mycobacterium
AAGRDQST

SEQ ID NO: 410927 - protein, 9 aa, Mycobacterium
AAGRDTDAT

SEQ ID NO: 410928 - protein, 12 aa, Mycobacterium
AAGREDAGMPVP

SEQ ID NO: 410929 - protein, 10 aa, Mycobacterium
AAGREQFGRP

SEQ ID NO: 410930 - protein, 14 aa, Mycobacterium
AAGRERSVVRGPDE

SEQ ID NO: 410931 - protein, 7 aa, Mycobacterium
AAGRESG

SEQ ID NO: 410932 - protein, 9 aa, Mycobacterium
AAGREVPED

SEQ ID NO: 410933 - protein, 5 aa, Mycobacterium
AAGRG

SEQ ID NO: 410934 - protein, 7 aa, Mycobacterium
AAGRGAR

SEQ ID NO: 410935 - protein, 8 aa, Mycobacterium
AAGRGATA

SEQ ID NO: 410936 - protein, 9 aa, Mycobacterium
AAGRGEDLE

SEQ ID NO: 410937 - protein, 13 aa, Mycobacterium
AAGRGGKDSDLAR

SEQ ID NO: 410938 - protein, 18 aa, Mycobacterium
AAGRGGKWSTRPVASDAA

SEQ ID NO: 410939 - protein, 11 aa, Mycobacterium
AAGRGKLDHSY

SEQ ID NO: 410940 - protein, 6 aa, Mycobacterium
AAGRGS

SEQ ID NO: 410941 - protein, 7 aa, Mycobacterium
AAGRGSR

SEQ ID NO: 410942 - protein, 7 aa, Mycobacterium
AAGRGTG

SEQ ID NO: 410943 - protein, 7 aa, Mycobacterium
AAGRGTR

SEQ ID NO: 410944 - protein, 12 aa, Mycobacterium
AAGRIPKLASGT

SEQ ID NO: 410945 - protein, 5 aa, Mycobacterium
AAGRK

SEQ ID NO: 410946 - protein, 8 aa, Mycobacterium
AAGRKPHR

SEQ ID NO: 410947 - protein, 6 aa, Mycobacterium
AAGRLG

SEQ ID NO: 410948 - protein, 18 aa, Mycobacterium
AAGRLGATADVADRPARR

SEQ ID NO: 410949 - protein, 5 aa, Mycobacterium
AAGRN

SEQ ID NO: 410950 - protein, 14 aa, Mycobacterium
AAGRNDRLARGGYR

SEQ ID NO: 410951 - protein, 5 aa, Mycobacterium
AAGRP

SEQ ID NO: 410952 - protein, 7 aa, Mycobacterium
AAGRPAD

SEQ ID NO: 410953 - protein, 10 aa, Mycobacterium
AAGRPADSMT

SEQ ID NO: 410954 - protein, 17 aa, Mycobacterium
AAGRPAPGGEKADPGTV

SEQ ID NO: 410955 - protein, 8 aa, Mycobacterium
AAGRPDDE

SEQ ID NO: 410956 - protein, 8 aa, Mycobacterium
AAGRPDRP

SEQ ID NO: 410957 - protein, 8 aa, Mycobacterium
AAGRPELY

SEQ ID NO: 410958 - protein, 7 aa, Mycobacterium
AAGRPGP

SEQ ID NO: 410959 - protein, 8 aa, Mycobacterium
AAGRPGVA

SEQ ID NO: 410960 - protein, 8 aa, Mycobacterium
AAGRPHGY

SEQ ID NO: 410961 - protein, 11 aa, Mycobacterium
AAGRPQPEAGE

SEQ ID NO: 410962 - protein, 9 aa, Mycobacterium
AAGRPTDRI

SEQ ID NO: 410963 - protein, 6 aa, Mycobacterium
AAGRPV

SEQ ID NO: 410964 - protein, 44 aa, Mycobacterium
AAGRQGTHSTKTRGLVSGGGKKPYRQKGTGRARQGSTRAPQFTG

SEQ ID NO: 410965 - protein, 8 aa, Mycobacterium
AAGRQLKT

SEQ ID NO: 410966 - protein, 9 aa, Mycobacterium
AAGRQPDDI

SEQ ID NO: 410967 - protein, 9 aa, Mycobacterium
AAGRQRNLD

SEQ ID NO: 410968 - protein, 5 aa, Mycobacterium
AAGRR

SEQ ID NO: 410969 - protein, 6 aa, Mycobacterium
AAGRRD

SEQ ID NO: 410970 - protein, 12 aa, Mycobacterium
AAGRRDDPAEQA

SEQ ID NO: 410971 - protein, 11 aa, Mycobacterium
AAGRREQAERL

SEQ ID NO: 410972 - protein, 10 aa, Mycobacterium
AAGRRGAARG

SEQ ID NO: 410973 - protein, 12 aa, Mycobacterium
AAGRRGEDVPEE

SEQ ID NO: 410974 - protein, 9 aa, Mycobacterium
AAGRRPDAA

SEQ ID NO: 410975 - protein, 7 aa, Mycobacterium
AAGRRPR

SEQ ID NO: 410976 - protein, 8 aa, Mycobacterium
AAGRRRAA

SEQ ID NO: 410977 - protein, 6 aa, Mycobacterium
AAGRRT

SEQ ID NO: 410978 - protein, 8 aa, Mycobacterium
AAGRSAPV

SEQ ID NO: 410979 - protein, 7 aa, Mycobacterium
AAGRSDA

SEQ ID NO: 410980 - protein, 9 aa, Mycobacterium
AAGRSGAQL

SEQ ID NO: 410981 - protein, 23 aa, Mycobacterium
AAGRSPAAQSAGTPQPSQTRDVR

SEQ ID NO: 410982 - protein, 9 aa, Mycobacterium
AAGRSPDTI

SEQ ID NO: 410983 - protein, 9 aa, Mycobacterium
AAGRSPEAI

SEQ ID NO: 410984 - protein, 9 aa, Mycobacterium
AAGRSPRDL

SEQ ID NO: 410985 - protein, 9 aa, Mycobacterium
AAGRSRPAA

SEQ ID NO: 410986 - protein, 8 aa, Mycobacterium
AAGRSTLR

SEQ ID NO: 410987 - protein, 13 aa, Mycobacterium
AAGRTDAGVHATG

SEQ ID NO: 410988 - protein, 14 aa, Mycobacterium
AAGRTDSGVHATGQ

SEQ ID NO: 410989 - protein, 22 aa, Mycobacterium
AAGRTGADSPQAAIDEAWTEVG

SEQ ID NO: 410990 - protein, 8 aa, Mycobacterium
AAGRTNTV

SEQ ID NO: 410991 - protein, 7 aa, Mycobacterium
AAGRTPV

SEQ ID NO: 410992 - protein, 4 aa, Mycobacterium
AAGS

SEQ ID NO: 410993 - protein, 19 aa, Mycobacterium
AAGSAASAPVTEAPATADL

SEQ ID NO: 410994 - protein, 14 aa, Mycobacterium
AAGSAEAATSVLGA

SEQ ID NO: 410995 - protein, 10 aa, Mycobacterium
AAGSAEAGRC

SEQ ID NO: 410996 - protein, 9 aa, Mycobacterium
AAGSAGLSP

SEQ ID NO: 410997 - protein, 11 aa, Mycobacterium
AAGSAGSTLGE

SEQ ID NO: 410998 - protein, 7 aa, Mycobacterium
AAGSALK

SEQ ID NO: 410999 - protein, 44 aa, Mycobacterium
AAGSANSTGTAGTASSAVTPGGSAVAAGTAGTTLTAVTTVLAGF

SEQ ID NO: 411000 - protein, 16 aa, Mycobacterium
AAGSAPGVEAQRDDKG

SEQ ID NO: 411001 - protein, 16 aa, Mycobacterium
AAGSAPGYPATAGTAR

SEQ ID NO: 411002 - protein, 10 aa, Mycobacterium
AAGSARPVPV

SEQ ID NO: 411003 - protein, 9 aa, Mycobacterium
AAGSASEDA

SEQ ID NO: 411004 - protein, 7 aa, Mycobacterium
AAGSATY

SEQ ID NO: 411005 - protein, 5 aa, Mycobacterium
AAGSD

SEQ ID NO: 411006 - protein, 9 aa, Mycobacterium
AAGSDGRPL

SEQ ID NO: 411007 - protein, 11 aa, Mycobacterium
AAGSDPGAIKN

SEQ ID NO: 411008 - protein, 6 aa, Mycobacterium
AAGSDR

SEQ ID NO: 411009 - protein, 6 aa, Mycobacterium
AAGSDV

SEQ ID NO: 411010 - protein, 7 aa, Mycobacterium
AAGSEMP

SEQ ID NO: 411011 - protein, 12 aa, Mycobacterium
AAGSEQERNAAL

SEQ ID NO: 411012 - protein, 11 aa, Mycobacterium
AAGSERASLPE

SEQ ID NO: 411013 - protein, 15 aa, Mycobacterium
AAGSETCCGKEPSDA

SEQ ID NO: 411014 - protein, 14 aa, Mycobacterium
AAGSETRSAAAQNP

SEQ ID NO: 411015 - protein, 8 aa, Mycobacterium
AAGSGAAA

SEQ ID NO: 411016 - protein, 18 aa, Mycobacterium
AAGSGAAASVVASFLEEE

SEQ ID NO: 411017 - protein, 7 aa, Mycobacterium
AAGSGAD

SEQ ID NO: 411018 - protein, 12 aa, Mycobacterium
AAGSGDKIKKSA

SEQ ID NO: 411019 - protein, 8 aa, Mycobacterium
AAGSGERL

SEQ ID NO: 411020 - protein, 9 aa, Mycobacterium
AAGSGERLA

SEQ ID NO: 411021 - protein, 52 aa, Mycobacterium
AAGSGGAGGDGAMNGGDGGNGGTGLGVGGAGGAGGTGNINGGDGGNGGNGGK

SEQ ID NO: 411022 - protein, 83 aa, Mycobacterium
AAGSGGAGGVGGDGSQGGDGGDGGAGGSSPGATGGWGGQGGLGGVGTAGVGGHGGDGGDAGDSGSSAFGVGSPGGGGGQGGFG

SEQ ID NO: 411023 - protein, 10 aa, Mycobacterium
AAGSGPDAGA

SEQ ID NO: 411024 - protein, 7 aa, Mycobacterium
AAGSGPT

SEQ ID NO: 411025 - protein, 9 aa, Mycobacterium
AAGSGQRLA

SEQ ID NO: 411026 - protein, 6 aa, Mycobacterium
AAGSGV

SEQ ID NO: 411027 - protein, 23 aa, Mycobacterium
AAGSGVDDADLRRRSGALSNRDP

SEQ ID NO: 411028 - protein, 6 aa, Mycobacterium
AAGSHK

SEQ ID NO: 411029 - protein, 9 aa, Mycobacterium
AAGSHPQDR

SEQ ID NO: 411030 - protein, 7 aa, Mycobacterium
AAGSHTA

SEQ ID NO: 411031 - protein, 12 aa, Mycobacterium
AAGSLTGGTPTI

SEQ ID NO: 411032 - protein, 5 aa, Mycobacterium
AAGSP

SEQ ID NO: 411033 - protein, 7 aa, Mycobacterium
AAGSPIE

SEQ ID NO: 411034 - protein, 7 aa, Mycobacterium
AAGSPKL

SEQ ID NO: 411035 - protein, 7 aa, Mycobacterium
AAGSPSL

SEQ ID NO: 411036 - protein, 6 aa, Mycobacterium
AAGSPV

SEQ ID NO: 411037 - protein, 7 aa, Mycobacterium
AAGSPVT

SEQ ID NO: 411038 - protein, 8 aa, Mycobacterium
AAGSPYAP

SEQ ID NO: 411039 - protein, 5 aa, Mycobacterium
AAGSR

SEQ ID NO: 411040 - protein, 6 aa, Mycobacterium
AAGSRL

SEQ ID NO: 411041 - protein, 15 aa, Mycobacterium
AAGSRTQAAFKPTRP

SEQ ID NO: 411042 - protein, 14 aa, Mycobacterium
AAGSRTSRQDAIAG

SEQ ID NO: 411043 - protein, 5 aa, Mycobacterium
AAGSS

SEQ ID NO: 411044 - protein, 10 aa, Mycobacterium
AAGSSADVAG

SEQ ID NO: 411045 - protein, 9 aa, Mycobacterium
AAGSSASQL

SEQ ID NO: 411046 - protein, 7 aa, Mycobacterium
AAGSSEA

SEQ ID NO: 411047 - protein, 8 aa, Mycobacterium
AAGSSFDA

SEQ ID NO: 411048 - protein, 24 aa, Mycobacterium
AAGSSGALATPDNYQRIDSPSDGI

SEQ ID NO: 411049 - protein, 13 aa, Mycobacterium
AAGSSGVSSHRAD

SEQ ID NO: 411050 - protein, 26 aa, Mycobacterium
AAGSSHGYDVTDPTAVSAELGGADGL

SEQ ID NO: 411051 - protein, 7 aa, Mycobacterium
AAGSSLA

SEQ ID NO: 411052 - protein, 11 aa, Mycobacterium
AAGSSRPDYTV

SEQ ID NO: 411053 - protein, 19 aa, Mycobacterium
AAGSSSPGYPTTAGTPELR

SEQ ID NO: 411054 - protein, 19 aa, Mycobacterium
AAGSSTAVIGPSGSGKSTL

SEQ ID NO: 411055 - protein, 7 aa, Mycobacterium
AAGSTAT

SEQ ID NO: 411056 - protein, 7 aa, Mycobacterium
AAGSTRT

SEQ ID NO: 411057 - protein, 7 aa, Mycobacterium
AAGSTTI

SEQ ID NO: 411058 - protein, 6 aa, Mycobacterium
AAGSTV

SEQ ID NO: 411059 - protein, 17 aa, Mycobacterium
AAGSVAEPLAASGDNDS

SEQ ID NO: 411060 - protein, 13 aa, Mycobacterium
AAGSVGDCDYPGD

SEQ ID NO: 411061 - protein, 13 aa, Mycobacterium
AAGSYGRAESAGA

SEQ ID NO: 411062 - protein, 10 aa, Mycobacterium
AAGTAADLSS

SEQ ID NO: 411063 - protein, 9 aa, Mycobacterium
AAGTAGAAA

SEQ ID NO: 411064 - protein, 34 aa, Mycobacterium
AAGTAGTASSADAPGTAVGAGEPTRADERDAGAT

SEQ ID NO: 411065 - protein, 20 aa, Mycobacterium
AAGTAHAASSGLPAGFTVAA

SEQ ID NO: 411066 - protein, 6 aa, Mycobacterium
AAGTAR

SEQ ID NO: 411067 - protein, 6 aa, Mycobacterium
AAGTDA

SEQ ID NO: 411068 - protein, 17 aa, Mycobacterium
AAGTDAAPRGAASIGRG

SEQ ID NO: 411069 - protein, 10 aa, Mycobacterium
AAGTDEQARD

SEQ ID NO: 411070 - protein, 8 aa, Mycobacterium
AAGTDMDG

SEQ ID NO: 411071 - protein, 8 aa, Mycobacterium
AAGTERRT

SEQ ID NO: 411072 - protein, 5 aa, Mycobacterium
AAGTF

SEQ ID NO: 411073 - protein, 6 aa, Mycobacterium
AAGTFS

SEQ ID NO: 411074 - protein, 15 aa, Mycobacterium
AAGTGAKPSGKPGGR

SEQ ID NO: 411075 - protein, 10 aa, Mycobacterium
AAGTGDARKI

SEQ ID NO: 411076 - protein, 12 aa, Mycobacterium
AAGTGDARKIRA

SEQ ID NO: 411077 - protein, 12 aa, Mycobacterium
AAGTGDSVERAR

SEQ ID NO: 411078 - protein, 6 aa, Mycobacterium
AAGTGM

SEQ ID NO: 411079 - protein, 8 aa, Mycobacterium
AAGTGNAM

SEQ ID NO: 411080 - protein, 8 aa, Mycobacterium
AAGTGRKA

SEQ ID NO: 411081 - protein, 17 aa, Mycobacterium
AAGTGTDWAASQDPADP

SEQ ID NO: 411082 - protein, 6 aa, Mycobacterium
AAGTHK

SEQ ID NO: 411083 - protein, 8 aa, Mycobacterium
AAGTHSGA

SEQ ID NO: 411084 - protein, 6 aa, Mycobacterium
AAGTHW

SEQ ID NO: 411085 - protein, 5 aa, Mycobacterium
AAGTI

SEQ ID NO: 411086 - protein, 7 aa, Mycobacterium
AAGTKPK

SEQ ID NO: 411087 - protein, 8 aa, Mycobacterium
AAGTPDLD

SEQ ID NO: 411088 - protein, 10 aa, Mycobacterium
AAGTPESEWD

SEQ ID NO: 411089 - protein, 6 aa, Mycobacterium
AAGTPF

SEQ ID NO: 411090 - protein, 49 aa, Mycobacterium
AAGTPGAAGSADSAGATTAAVPEEQRSLTARPACTAADAAGAAVSAEAH

SEQ ID NO: 411091 - protein, 12 aa, Mycobacterium
AAGTPIAEVLAG

SEQ ID NO: 411092 - protein, 16 aa, Mycobacterium
AAGTPSELMQSGAENQ

SEQ ID NO: 411093 - protein, 16 aa, Mycobacterium
AAGTPTELTRTGAKDQ

SEQ ID NO: 411094 - protein, 6 aa, Mycobacterium
AAGTPV

SEQ ID NO: 411095 - protein, 8 aa, Mycobacterium
AAGTRGVA

SEQ ID NO: 411096 - protein, 6 aa, Mycobacterium
AAGTRR

SEQ ID NO: 411097 - protein, 8 aa, Mycobacterium
AAGTRRRA

SEQ ID NO: 411098 - protein, 8 aa, Mycobacterium
AAGTSATS

SEQ ID NO: 411099 - protein, 9 aa, Mycobacterium
AAGTSDEAD

SEQ ID NO: 411100 - protein, 9 aa, Mycobacterium
AAGTSECTC

SEQ ID NO: 411101 - protein, 9 aa, Mycobacterium
AAGTSGGLS

SEQ ID NO: 411102 - protein, 13 aa, Mycobacterium
AAGTSHADPKPAI

SEQ ID NO: 411103 - protein, 7 aa, Mycobacterium
AAGTSKP

SEQ ID NO: 411104 - protein, 13 aa, Mycobacterium
AAGTSRADPRPAV

SEQ ID NO: 411105 - protein, 13 aa, Mycobacterium
AAGTSRDDPQPAI

SEQ ID NO: 411106 - protein, 17 aa, Mycobacterium
AAGTSRGKVCLVPDGNA

SEQ ID NO: 411107 - protein, 6 aa, Mycobacterium
AAGTSV

SEQ ID NO: 411108 - protein, 5 aa, Mycobacterium
AAGTT

SEQ ID NO: 411109 - protein, 6 aa, Mycobacterium
AAGTTD

SEQ ID NO: 411110 - protein, 16 aa, Mycobacterium
AAGTTEPQPHGVEPFQ

SEQ ID NO: 411111 - protein, 6 aa, Mycobacterium
AAGTTG

SEQ ID NO: 411112 - protein, 12 aa, Mycobacterium
AAGTTLGRGIMT

SEQ ID NO: 411113 - protein, 8 aa, Mycobacterium
AAGTTMQP

SEQ ID NO: 411114 - protein, 9 aa, Mycobacterium
AAGTTNRIA

SEQ ID NO: 411115 - protein, 17 aa, Mycobacterium
AAGTVEAVGEGVTNVAP

SEQ ID NO: 411116 - protein, 17 aa, Mycobacterium
AAGTVEAVGPGVTTVEP

SEQ ID NO: 411117 - protein, 7 aa, Mycobacterium
AAGTVGS

SEQ ID NO: 411118 - protein, 6 aa, Mycobacterium
AAGVAK

SEQ ID NO: 411119 - protein, 10 aa, Mycobacterium
AAGVAPPRRS

SEQ ID NO: 411120 - protein, 8 aa, Mycobacterium
AAGVAPRA

SEQ ID NO: 411121 - protein, 6 aa, Mycobacterium
AAGVDP

SEQ ID NO: 411122 - protein, 14 aa, Mycobacterium
AAGVDRRRSIPPLA

SEQ ID NO: 411123 - protein, 15 aa, Mycobacterium
AAGVDYGGDVDDDTL

SEQ ID NO: 411124 - protein, 15 aa, Mycobacterium
AAGVGDYGTYQGPLP

SEQ ID NO: 411125 - protein, 18 aa, Mycobacterium
AAGVGNPSSAVRDNVTST

SEQ ID NO: 411126 - protein, 7 aa, Mycobacterium
AAGVGRS

SEQ ID NO: 411127 - protein, 10 aa, Mycobacterium
AAGVGSPRVD

SEQ ID NO: 411128 - protein, 17 aa, Mycobacterium
AAGVKGSPLHTPYTASK

SEQ ID NO: 411129 - protein, 6 aa, Mycobacterium
AAGVNP

SEQ ID NO: 411130 - protein, 8 aa, Mycobacterium
AAGVNPRE

SEQ ID NO: 411131 - protein, 6 aa, Mycobacterium
AAGVPH

SEQ ID NO: 411132 - protein, 8 aa, Mycobacterium
AAGVPKER

SEQ ID NO: 411133 - protein, 9 aa, Mycobacterium
AAGVPSGTV

SEQ ID NO: 411134 - protein, 6 aa, Mycobacterium
AAGVPT

SEQ ID NO: 411135 - protein, 14 aa, Mycobacterium
AAGVPTDVTDYSSV

SEQ ID NO: 411136 - protein, 7 aa, Mycobacterium
AAGVPTG

SEQ ID NO: 411137 - protein, 8 aa, Mycobacterium
AAGVSDDT

SEQ ID NO: 411138 - protein, 8 aa, Mycobacterium
AAGVSPDE

SEQ ID NO: 411139 - protein, 7 aa, Mycobacterium
AAGVSPR

SEQ ID NO: 411140 - protein, 7 aa, Mycobacterium
AAGVSRQ

SEQ ID NO: 411141 - protein, 5 aa, Mycobacterium
AAGVT

SEQ ID NO: 411142 - protein, 6 aa, Mycobacterium
AAGVTP

SEQ ID NO: 411143 - protein, 8 aa, Mycobacterium
AAGVTPAD

SEQ ID NO: 411144 - protein, 6 aa, Mycobacterium
AAGVTR

SEQ ID NO: 411145 - protein, 6 aa, Mycobacterium
AAGWPE

SEQ ID NO: 411146 - protein, 5 aa, Mycobacterium
AAGWS

SEQ ID NO: 411147 - protein, 5 aa, Mycobacterium
AAGYA

SEQ ID NO: 411148 - protein, 5 aa, Mycobacterium
AAGYG

SEQ ID NO: 411149 - protein, 7 aa, Mycobacterium
AAGYGDG

SEQ ID NO: 411150 - protein, 6 aa, Mycobacterium
AAGYGT

SEQ ID NO: 411151 - protein, 6 aa, Mycobacterium
AAGYRD

SEQ ID NO: 411152 - protein, 5 aa, Mycobacterium
AAGYS

SEQ ID NO: 411153 - protein, 7 aa, Mycobacterium
AAGYSPA

SEQ ID NO: 411154 - protein, 5 aa, Mycobacterium
AAGYT

SEQ ID NO: 411155 - protein, 7 aa, Mycobacterium
AAGYTAA

SEQ ID NO: 411156 - protein, 6 aa, Mycobacterium
AAGYTR

SEQ ID NO: 411157 - protein, 16 aa, Mycobacterium
AAHAAAGDDWDTAVEE

SEQ ID NO: 411158 - protein, 9 aa, Mycobacterium
AAHAAGQDT

SEQ ID NO: 411159 - protein, 13 aa, Mycobacterium
AAHAAQGLGPGDG

SEQ ID NO: 411160 - protein, 17 aa, Mycobacterium
AAHAASERLAEERGPFP

SEQ ID NO: 411161 - protein, 6 aa, Mycobacterium
AAHADN

SEQ ID NO: 411162 - protein, 7 aa, Mycobacterium
AAHAEEM

SEQ ID NO: 411163 - protein, 18 aa, Mycobacterium
AAHAERDAEFKANAAAKE

SEQ ID NO: 411164 - protein, 29 aa, Mycobacterium
AAHAQRAAEQALATAAGYEAARSASVPPT

SEQ ID NO: 411165 - protein, 9 aa, Mycobacterium
AAHARGGRT

SEQ ID NO: 411166 - protein, 10 aa, Mycobacterium
AAHATGAASE

SEQ ID NO: 411167 - protein, 5 aa, Mycobacterium
AAHAY

SEQ ID NO: 411168 - protein, 7 aa, Mycobacterium
AAHDAAG

SEQ ID NO: 411169 - protein, 13 aa, Mycobacterium
AAHDADEAATYPQ

SEQ ID NO: 411170 - protein, 7 aa, Mycobacterium
AAHDAGK

SEQ ID NO: 411171 - protein, 7 aa, Mycobacterium
AAHDAPA

SEQ ID NO: 411172 - protein, 7 aa, Mycobacterium
AAHDDGS

SEQ ID NO: 411173 - protein, 12 aa, Mycobacterium
AAHDELASADPA

SEQ ID NO: 411174 - protein, 16 aa, Mycobacterium
AAHDHDHDHGGDPTPI

SEQ ID NO: 411175 - protein, 5 aa, Mycobacterium
AAHDQ

SEQ ID NO: 411176 - protein, 9 aa, Mycobacterium
AAHDQSDHV

SEQ ID NO: 411177 - protein, 6 aa, Mycobacterium
AAHDRE

SEQ ID NO: 411178 - protein, 5 aa, Mycobacterium
AAHDS

SEQ ID NO: 411179 - protein, 4 aa, Mycobacterium
AAHE

SEQ ID NO: 411180 - protein, 8 aa, Mycobacterium
AAHEAAEE

SEQ ID NO: 411181 - protein, 5 aa, Mycobacterium
AAHEP

SEQ ID NO: 411182 - protein, 11 aa, Mycobacterium
AAHEPDPAKSL

SEQ ID NO: 411183 - protein, 20 aa, Mycobacterium
AAHEPMPARTAYSASKAGMN

SEQ ID NO: 411184 - protein, 5 aa, Mycobacterium
AAHER

SEQ ID NO: 411185 - protein, 6 aa, Mycobacterium
AAHGAL

SEQ ID NO: 411186 - protein, 6 aa, Mycobacterium
AAHGDR

SEQ ID NO: 411187 - protein, 8 aa, Mycobacterium
AAHGEAPD

SEQ ID NO: 411188 - protein, 7 aa, Mycobacterium
AAHGKPN

SEQ ID NO: 411189 - protein, 11 aa, Mycobacterium
AAHGKRSQCFG

SEQ ID NO: 411190 - protein, 12 aa, Mycobacterium
AAHGKRSQCFGG

SEQ ID NO: 411191 - protein, 8 aa, Mycobacterium
AAHGPDDY

SEQ ID NO: 411192 - protein, 12 aa, Mycobacterium
AAHGRAGDDGLG

SEQ ID NO: 411193 - protein, 9 aa, Mycobacterium
AAHGREPTH

SEQ ID NO: 411194 - protein, 6 aa, Mycobacterium
AAHGRS

SEQ ID NO: 411195 - protein, 17 aa, Mycobacterium
AAHGYAADQSDWTTPEG

SEQ ID NO: 411196 - protein, 10 aa, Mycobacterium
AAHKAGTDPL

SEQ ID NO: 411197 - protein, 12 aa, Mycobacterium
AAHKGPATATAD

SEQ ID NO: 411198 - protein, 5 aa, Mycobacterium
AAHNR

SEQ ID NO: 411199 - protein, 8 aa, Mycobacterium
AAHNRSAA

SEQ ID NO: 411200 - protein, 5 aa, Mycobacterium
AAHPG

SEQ ID NO: 411201 - protein, 11 aa, Mycobacterium
AAHPGASNTEL

SEQ ID NO: 411202 - protein, 7 aa, Mycobacterium
AAHPGDS

SEQ ID NO: 411203 - protein, 14 aa, Mycobacterium
AAHPGGSNTELGRY

SEQ ID NO: 411204 - protein, 8 aa, Mycobacterium
AAHPGLTK

SEQ ID NO: 411205 - protein, 7 aa, Mycobacterium
AAHPGQP

SEQ ID NO: 411206 - protein, 14 aa, Mycobacterium
AAHPGTGGAELPDD

SEQ ID NO: 411207 - protein, 18 aa, Mycobacterium
AAHPGTIGAPYADADDTG

SEQ ID NO: 411208 - protein, 11 aa, Mycobacterium
AAHPGTTYRGR

SEQ ID NO: 411209 - protein, 5 aa, Mycobacterium
AAHPQ

SEQ ID NO: 411210 - protein, 26 aa, Mycobacterium
AAHPQTPPAASAADGDDSGDDSEENT

SEQ ID NO: 411211 - protein, 5 aa, Mycobacterium
AAHPR

SEQ ID NO: 411212 - protein, 7 aa, Mycobacterium
AAHPSAS

SEQ ID NO: 411213 - protein, 14 aa, Mycobacterium
AAHPTTGDESLPDD

SEQ ID NO: 411214 - protein, 15 aa, Mycobacterium
AAHPTTGDESLPDDR

SEQ ID NO: 411215 - protein, 15 aa, Mycobacterium
AAHPTTGDSSLPDDR

SEQ ID NO: 411216 - protein, 9 aa, Mycobacterium
AAHQAGSRL

SEQ ID NO: 411217 - protein, 11 aa, Mycobacterium
AAHQPTAQRRG

SEQ ID NO: 411218 - protein, 7 aa, Mycobacterium
AAHQSWP

SEQ ID NO: 411219 - protein, 4 aa, Mycobacterium
AAHR

SEQ ID NO: 411220 - protein, 6 aa, Mycobacterium
AAHRAD

SEQ ID NO: 411221 - protein, 7 aa, Mycobacterium
AAHREEV

SEQ ID NO: 411222 - protein, 5 aa, Mycobacterium
AAHRG

SEQ ID NO: 411223 - protein, 17 aa, Mycobacterium
AAHRKGTRLSHQPARTM

SEQ ID NO: 411224 - protein, 8 aa, Mycobacterium
AAHRRESY

SEQ ID NO: 411225 - protein, 9 aa, Mycobacterium
AAHRSGGAL

SEQ ID NO: 411226 - protein, 5 aa, Mycobacterium
AAHSD

SEQ ID NO: 411227 - protein, 10 aa, Mycobacterium
AAHSEAYDDA

SEQ ID NO: 411228 - protein, 11 aa, Mycobacterium
AAHSGDKEKAA

SEQ ID NO: 411229 - protein, 8 aa, Mycobacterium
AAHSNADV

SEQ ID NO: 411230 - protein, 5 aa, Mycobacterium
AAHSP

SEQ ID NO: 411231 - protein, 8 aa, Mycobacterium
AAHSPGKP

SEQ ID NO: 411232 - protein, 7 aa, Mycobacterium
AAHSRPD

SEQ ID NO: 411233 - protein, 7 aa, Mycobacterium
AAHSYQP

SEQ ID NO: 411234 - protein, 7 aa, Mycobacterium
AAHTASK

SEQ ID NO: 411235 - protein, 16 aa, Mycobacterium
AAHTASKIQQIINQTT

SEQ ID NO: 411236 - protein, 11 aa, Mycobacterium
AAHTATADQQQ

SEQ ID NO: 411237 - protein, 9 aa, Mycobacterium
AAHTDRDIE

SEQ ID NO: 411238 - protein, 6 aa, Mycobacterium
AAHTKG

SEQ ID NO: 411239 - protein, 12 aa, Mycobacterium
AAHTRAGKYSKG

SEQ ID NO: 411240 - protein, 6 aa, Mycobacterium
AAHTRQ

SEQ ID NO: 411241 - protein, 8 aa, Mycobacterium
AAHTTAHT

SEQ ID NO: 411242 - protein, 5 aa, Mycobacterium
AAHYE

SEQ ID NO: 411243 - protein, 13 aa, Mycobacterium
AAIAAANNAPDRA

SEQ ID NO: 411244 - protein, 9 aa, Mycobacterium
AAIAPPPPG

SEQ ID NO: 411245 - protein, 6 aa, Mycobacterium
AAIATN

SEQ ID NO: 411246 - protein, 11 aa, Mycobacterium
AAIDNGDVPAR

SEQ ID NO: 411247 - protein, 7 aa, Mycobacterium
AAIDPAD

SEQ ID NO: 411248 - protein, 6 aa, Mycobacterium
AAIDPD

SEQ ID NO: 411249 - protein, 15 aa, Mycobacterium
AAIDPEDRYRKAEEA

SEQ ID NO: 411250 - protein, 19 aa, Mycobacterium
AAIDTSRRPGRPRAAPPVR

SEQ ID NO: 411251 - protein, 4 aa, Mycobacterium
AAIE

SEQ ID NO: 411252 - protein, 9 aa, Mycobacterium
AAIGETAAA

SEQ ID NO: 411253 - protein, 19 aa, Mycobacterium
AAIGTEASLGTTGATTPLS

SEQ ID NO: 411254 - protein, 4 aa, Mycobacterium
AAIN

SEQ ID NO: 411255 - protein, 5 aa, Mycobacterium
AAIPA

SEQ ID NO: 411256 - protein, 12 aa, Mycobacterium
AAIPADGDPRLH

SEQ ID NO: 411257 - protein, 7 aa, Mycobacterium
AAIPPPA

SEQ ID NO: 411258 - protein, 4 aa, Mycobacterium
AAIR

SEQ ID NO: 411259 - protein, 25 aa, Mycobacterium
AAISAGTAGPAGTAGDALAAGTPLS

SEQ ID NO: 411260 - protein, 6 aa, Mycobacterium
AAISPG

SEQ ID NO: 411261 - protein, 4 aa, Mycobacterium
AAIT

SEQ ID NO: 411262 - protein, 9 aa, Mycobacterium
AAITPSEPT

SEQ ID NO: 411263 - protein, 12 aa, Mycobacterium
AAITQGTVLAEI

SEQ ID NO: 411264 - protein, 20 aa, Mycobacterium
AAITSAAKPGAAGRRARTKD

SEQ ID NO: 411265 - protein, 10 aa, Mycobacterium
AAKAAAEGGQ

SEQ ID NO: 411266 - protein, 9 aa, Mycobacterium
AAKAAEGGV

SEQ ID NO: 411267 - protein, 17 aa, Mycobacterium
AAKAAGAAVTAASTHGH

SEQ ID NO: 411268 - protein, 9 aa, Mycobacterium
AAKAAGHPG

SEQ ID NO: 411269 - protein, 10 aa, Mycobacterium
AAKAAGHPGI

SEQ ID NO: 411270 - protein, 9 aa, Mycobacterium
AAKAAGLEP

SEQ ID NO: 411271 - protein, 12 aa, Mycobacterium
AAKAARAEIATR

SEQ ID NO: 411272 - protein, 21 aa, Mycobacterium
AAKAASGLATGVDAGARALGA

SEQ ID NO: 411273 - protein, 11 aa, Mycobacterium
AAKAATRYTGI

SEQ ID NO: 411274 - protein, 11 aa, Mycobacterium
AAKAEAQAQGD

SEQ ID NO: 411275 - protein, 7 aa, Mycobacterium
AAKAEPL

SEQ ID NO: 411276 - protein, 10 aa, Mycobacterium
AAKAGAAGDL

SEQ ID NO: 411277 - protein, 9 aa, Mycobacterium
AAKAGGATV

SEQ ID NO: 411278 - protein, 7 aa, Mycobacterium
AAKAGKL

SEQ ID NO: 411279 - protein, 8 aa, Mycobacterium
AAKAGRTV

SEQ ID NO: 411280 - protein, 8 aa, Mycobacterium
AAKAGVST

SEQ ID NO: 411281 - protein, 9 aa, Mycobacterium
AAKAGYSRP

SEQ ID NO: 411282 - protein, 5 aa, Mycobacterium
AAKAI

SEQ ID NO: 411283 - protein, 8 aa, Mycobacterium
AAKALDPQ

SEQ ID NO: 411284 - protein, 10 aa, Mycobacterium
AAKALSDTVT

SEQ ID NO: 411285 - protein, 12 aa, Mycobacterium
AAKALSDTVTPA

SEQ ID NO: 411286 - protein, 8 aa, Mycobacterium
AAKANAKD

SEQ ID NO: 411287 - protein, 16 aa, Mycobacterium
AAKAPPSLDSVGPPGV

SEQ ID NO: 411288 - protein, 20 aa, Mycobacterium
AAKAQADGAEGGAGSADSDV

SEQ ID NO: 411289 - protein, 15 aa, Mycobacterium
AAKASADAMVTPGST

SEQ ID NO: 411290 - protein, 28 aa, Mycobacterium
AAKASGLGAVRKGGDTRFAQGGTGGAAA

SEQ ID NO: 411291 - protein, 7 aa, Mycobacterium
AAKATAE

SEQ ID NO: 411292 - protein, 20 aa, Mycobacterium
AAKATAERIADRASQTAGAR

SEQ ID NO: 411293 - protein, 5 aa, Mycobacterium
AAKAY

SEQ ID NO: 411294 - protein, 56 aa, Mycobacterium
AAKAYGEVDSESATALNSDGSGTVEAQSAGGAGGDSSAGLQDTPTVAAAGDPDFTD

SEQ ID NO: 411295 - protein, 25 aa, Mycobacterium
AAKDAGSKEKGPKHTPANPKVRGRR

SEQ ID NO: 411296 - protein, 7 aa, Mycobacterium
AAKDAIT

SEQ ID NO: 411297 - protein, 6 aa, Mycobacterium
AAKDDR

SEQ ID NO: 411298 - protein, 6 aa, Mycobacterium
AAKDEA

SEQ ID NO: 411299 - protein, 7 aa, Mycobacterium
AAKDERS

SEQ ID NO: 411300 - protein, 5 aa, Mycobacterium
AAKDG

SEQ ID NO: 411301 - protein, 8 aa, Mycobacterium
AAKDGHPV

SEQ ID NO: 411302 - protein, 8 aa, Mycobacterium
AAKDQARE

SEQ ID NO: 411303 - protein, 8 aa, Mycobacterium
AAKDVDPA

SEQ ID NO: 411304 - protein, 7 aa, Mycobacterium
AAKEAGA

SEQ ID NO: 411305 - protein, 11 aa, Mycobacterium
AAKEAGPNATA

SEQ ID NO: 411306 - protein, 9 aa, Mycobacterium
AAKEAGRDL

SEQ ID NO: 411307 - protein, 8 aa, Mycobacterium
AAKEASEV

SEQ ID NO: 411308 - protein, 7 aa, Mycobacterium
AAKECGH

SEQ ID NO: 411309 - protein, 8 aa, Mycobacterium
AAKEEPTF

SEQ ID NO: 411310 - protein, 8 aa, Mycobacterium
AAKEGAFD

SEQ ID NO: 411311 - protein, 8 aa, Mycobacterium
AAKEGIRG

SEQ ID NO: 411312 - protein, 20 aa, Mycobacterium
AAKEGSGGGPSNNNSERQYP

SEQ ID NO: 411313 - protein, 5 aa, Mycobacterium
AAKEH

SEQ ID NO: 411314 - protein, 6 aa, Mycobacterium
AAKELG

SEQ ID NO: 411315 - protein, 11 aa, Mycobacterium
AAKELTDPNFD

SEQ ID NO: 411316 - protein, 9 aa, Mycobacterium
AAKEPDRHG

SEQ ID NO: 411317 - protein, 6 aa, Mycobacterium
AAKEQD

SEQ ID NO: 411318 - protein, 6 aa, Mycobacterium
AAKEQL

SEQ ID NO: 411319 - protein, 6 aa, Mycobacterium
AAKERK

SEQ ID NO: 411320 - protein, 4 aa, Mycobacterium
AAKG

SEQ ID NO: 411321 - protein, 10 aa, Mycobacterium
AAKGAGASAR

SEQ ID NO: 411322 - protein, 8 aa, Mycobacterium
AAKGAKDV

SEQ ID NO: 411323 - protein, 14 aa, Mycobacterium
AAKGDGPGPAAQTK

SEQ ID NO: 411324 - protein, 5 aa, Mycobacterium
AAKGF

SEQ ID NO: 411325 - protein, 8 aa, Mycobacterium
AAKGGHPV

SEQ ID NO: 411326 - protein, 6 aa, Mycobacterium
AAKGIG

SEQ ID NO: 411327 - protein, 8 aa, Mycobacterium
AAKGSAAE

SEQ ID NO: 411328 - protein, 6 aa, Mycobacterium
AAKGSL

SEQ ID NO: 411329 - protein, 6 aa, Mycobacterium
AAKGSR

SEQ ID NO: 411330 - protein, 7 aa, Mycobacterium
AAKGSVA

SEQ ID NO: 411331 - protein, 7 aa, Mycobacterium
AAKGTGR

SEQ ID NO: 411332 - protein, 6 aa, Mycobacterium
AAKGTT

SEQ ID NO: 411333 - protein, 6 aa, Mycobacterium
AAKGVA

SEQ ID NO: 411334 - protein, 11 aa, Mycobacterium
AAKGVKGTLDA

SEQ ID NO: 411335 - protein, 5 aa, Mycobacterium
AAKHA

SEQ ID NO: 411336 - protein, 6 aa, Mycobacterium
AAKHAK

SEQ ID NO: 411337 - protein, 8 aa, Mycobacterium
AAKHGDGW

SEQ ID NO: 411338 - protein, 10 aa, Mycobacterium
AAKKPSKGTV

SEQ ID NO: 411339 - protein, 8 aa, Mycobacterium
AAKKSYEP

SEQ ID NO: 411340 - protein, 8 aa, Mycobacterium
AAKKTPVP

SEQ ID NO: 411341 - protein, 9 aa, Mycobacterium
AAKKVGGKI

SEQ ID NO: 411342 - protein, 4 aa, Mycobacterium
AAKM

SEQ ID NO: 411343 - protein, 13 aa, Mycobacterium
AAKMRSEQLRITS

SEQ ID NO: 411344 - protein, 10 aa, Mycobacterium
AAKMTEAAAP

SEQ ID NO: 411345 - protein, 5 aa, Mycobacterium
AAKND

SEQ ID NO: 411346 - protein, 11 aa, Mycobacterium
AAKNGDPAPQG

SEQ ID NO: 411347 - protein, 13 aa, Mycobacterium
AAKNKAAGKAEEI

SEQ ID NO: 411348 - protein, 15 aa, Mycobacterium
AAKNPYSSAPTERSV

SEQ ID NO: 411349 - protein, 4 aa, Mycobacterium
AAKP

SEQ ID NO: 411350 - protein, 11 aa, Mycobacterium
AAKPAHPSDDE

SEQ ID NO: 411351 - protein, 8 aa, Mycobacterium
AAKPDAPL

SEQ ID NO: 411352 - protein, 7 aa, Mycobacterium
AAKPGQR

SEQ ID NO: 411353 - protein, 6 aa, Mycobacterium
AAKPGS

SEQ ID NO: 411354 - protein, 8 aa, Mycobacterium
AAKPGSPV

SEQ ID NO: 411355 - protein, 8 aa, Mycobacterium
AAKPKIAD

SEQ ID NO: 411356 - protein, 6 aa, Mycobacterium
AAKPKR

SEQ ID NO: 411357 - protein, 8 aa, Mycobacterium
AAKPLSPG

SEQ ID NO: 411358 - protein, 16 aa, Mycobacterium
AAKPPAGAPPPKTTVT

SEQ ID NO: 411359 - protein, 11 aa, Mycobacterium
AAKPPSATQGT

SEQ ID NO: 411360 - protein, 11 aa, Mycobacterium
AAKPPTATQGT

SEQ ID NO: 411361 - protein, 6 aa, Mycobacterium
AAKPSL

SEQ ID NO: 411362 - protein, 11 aa, Mycobacterium
AAKPTTATQGT

SEQ ID NO: 411363 - protein, 5 aa, Mycobacterium
AAKPV

SEQ ID NO: 411364 - protein, 4 aa, Mycobacterium
AAKQ

SEQ ID NO: 411365 - protein, 5 aa, Mycobacterium
AAKQH

SEQ ID NO: 411366 - protein, 9 aa, Mycobacterium
AAKQLGDAL

SEQ ID NO: 411367 - protein, 5 aa, Mycobacterium
AAKQN

SEQ ID NO: 411368 - protein, 5 aa, Mycobacterium
AAKQP

SEQ ID NO: 411369 - protein, 9 aa, Mycobacterium
AAKQTFADT

SEQ ID NO: 411370 - protein, 10 aa, Mycobacterium
AAKQTREVSP

SEQ ID NO: 411371 - protein, 18 aa, Mycobacterium
AAKRDYEASVGRAQAEAD

SEQ ID NO: 411372 - protein, 44 aa, Mycobacterium
AAKRERDGSKGSLSTTAGGAGRAGSIPPWATPPGGSGGGNGDPI

SEQ ID NO: 411373 - protein, 19 aa, Mycobacterium
AAKREYEASTGRAKAEADR

SEQ ID NO: 411374 - protein, 6 aa, Mycobacterium
AAKRGA

SEQ ID NO: 411375 - protein, 7 aa, Mycobacterium
AAKRGRT

SEQ ID NO: 411376 - protein, 11 aa, Mycobacterium
AAKRLGKDPRT

SEQ ID NO: 411377 - protein, 9 aa, Mycobacterium
AAKRPVDER

SEQ ID NO: 411378 - protein, 12 aa, Mycobacterium
AAKRQSPKAAEQ

SEQ ID NO: 411379 - protein, 10 aa, Mycobacterium
AAKRRGTTAP

SEQ ID NO: 411380 - protein, 9 aa, Mycobacterium
AAKRRNEAV

SEQ ID NO: 411381 - protein, 9 aa, Mycobacterium
AAKRRNTVD

SEQ ID NO: 411382 - protein, 8 aa, Mycobacterium
AAKRSAQA

SEQ ID NO: 411383 - protein, 8 aa, Mycobacterium
AAKRTAAK

SEQ ID NO: 411384 - protein, 7 aa, Mycobacterium
AAKRTSE

SEQ ID NO: 411385 - protein, 18 aa, Mycobacterium
AAKSDLERQENKEKTGVF

SEQ ID NO: 411386 - protein, 9 aa, Mycobacterium
AAKSEQNVA

SEQ ID NO: 411387 - protein, 9 aa, Mycobacterium
AAKSERAWS

SEQ ID NO: 411388 - protein, 8 aa, Mycobacterium
AAKSETLT

SEQ ID NO: 411389 - protein, 12 aa, Mycobacterium
AAKSGAEQGDPL

SEQ ID NO: 411390 - protein, 9 aa, Mycobacterium
AAKSGANAI

SEQ ID NO: 411391 - protein, 12 aa, Mycobacterium
AAKSGAQQGDPL

SEQ ID NO: 411392 - protein, 12 aa, Mycobacterium
AAKSGAQQGDPM

SEQ ID NO: 411393 - protein, 8 aa, Mycobacterium
AAKSGLDG

SEQ ID NO: 411394 - protein, 12 aa, Mycobacterium
AAKSIAGDFASL

SEQ ID NO: 411395 - protein, 8 aa, Mycobacterium
AAKSLQPE

SEQ ID NO: 411396 - protein, 9 aa, Mycobacterium
AAKSNTPVS

SEQ ID NO: 411397 - protein, 18 aa, Mycobacterium
AAKSNTPVSKAVVIRLER

SEQ ID NO: 411398 - protein, 13 aa, Mycobacterium
AAKSRSEQLRITS

SEQ ID NO: 411399 - protein, 14 aa, Mycobacterium
AAKSSDYAPIPATE

SEQ ID NO: 411400 - protein, 8 aa, Mycobacterium
AAKSSRAL

SEQ ID NO: 411401 - protein, 11 aa, Mycobacterium
AAKSVEAEARD

SEQ ID NO: 411402 - protein, 6 aa, Mycobacterium
AAKTAA

SEQ ID NO: 411403 - protein, 8 aa, Mycobacterium
AAKTAAAA

SEQ ID NO: 411404 - protein, 13 aa, Mycobacterium
AAKTDFEMVEIAR

SEQ ID NO: 411405 - protein, 13 aa, Mycobacterium
AAKTDFEMVEVAR

SEQ ID NO: 411406 - protein, 10 aa, Mycobacterium
AAKTGAPVSD

SEQ ID NO: 411407 - protein, 6 aa, Mycobacterium
AAKTGL

SEQ ID NO: 411408 - protein, 5 aa, Mycobacterium
AAKTL

SEQ ID NO: 411409 - protein, 8 aa, Mycobacterium
AAKTLRES

SEQ ID NO: 411410 - protein, 13 aa, Mycobacterium
AAKTRSEQLGITS

SEQ ID NO: 411411 - protein, 7 aa, Mycobacterium
AAKVDKG

SEQ ID NO: 411412 - protein, 7 aa, Mycobacterium
AAKVPTS

SEQ ID NO: 411413 - protein, 8 aa, Mycobacterium
AAKVTDPG

SEQ ID NO: 411414 - protein, 7 aa, Mycobacterium
AAKYPDR

SEQ ID NO: 411415 - protein, 5 aa, Mycobacterium
AALAA

SEQ ID NO: 411416 - protein, 75 aa, Mycobacterium
AALADPSQASASGASGAGGAAAAAGAAGGASGAGAGGPAAAAAAAGAGGGTSTRPSSGGNTTATGPNTGSVPGTY

SEQ ID NO: 411417 - protein, 33 aa, Mycobacterium
AALAGDGDDSAHDGFSAAGAVGQARSALENTDD

SEQ ID NO: 411418 - protein, 10 aa, Mycobacterium
AALAGDGKGG

SEQ ID NO: 411419 - protein, 16 aa, Mycobacterium
AALAGGDVAEAQVASE

SEQ ID NO: 411420 - protein, 11 aa, Mycobacterium
AALAGKPSPRI

SEQ ID NO: 411421 - protein, 17 aa, Mycobacterium
AALAGSPLSGGYAGAKA

SEQ ID NO: 411422 - protein, 8 aa, Mycobacterium
AALANGEQ

SEQ ID NO: 411423 - protein, 8 aa, Mycobacterium
AALAPAKF

SEQ ID NO: 411424 - protein, 11 aa, Mycobacterium
AALAPESPLPD

SEQ ID NO: 411425 - protein, 13 aa, Mycobacterium
AALAQQNSASSQL

SEQ ID NO: 411426 - protein, 7 aa, Mycobacterium
AALARKP

SEQ ID NO: 411427 - protein, 7 aa, Mycobacterium
AALASVT

SEQ ID NO: 411428 - protein, 7 aa, Mycobacterium
AALDDGD

SEQ ID NO: 411429 - protein, 6 aa, Mycobacterium
AALDES

SEQ ID NO: 411430 - protein, 11 aa, Mycobacterium
AALDGDVSRVT

SEQ ID NO: 411431 - protein, 6 aa, Mycobacterium
AALDGT

SEQ ID NO: 411432 - protein, 5 aa, Mycobacterium
AALDR

SEQ ID NO: 411433 - protein, 9 aa, Mycobacterium
AALDRAKGA

SEQ ID NO: 411434 - protein, 9 aa, Mycobacterium
AALDRTPTQ

SEQ ID NO: 411435 - protein, 17 aa, Mycobacterium
AALDSAARQIRSAGAPE

SEQ ID NO: 411436 - protein, 18 aa, Mycobacterium
AALDSASPQRRITGRGGD

SEQ ID NO: 411437 - protein, 11 aa, Mycobacterium
AALDSGTTAPL

SEQ ID NO: 411438 - protein, 9 aa, Mycobacterium
AALDSGVTA

SEQ ID NO: 411439 - protein, 6 aa, Mycobacterium
AALEAD

SEQ ID NO: 411440 - protein, 8 aa, Mycobacterium
AALEQSGF

SEQ ID NO: 411441 - protein, 6 aa, Mycobacterium
AALESA

SEQ ID NO: 411442 - protein, 4 aa, Mycobacterium
AALG

SEQ ID NO: 411443 - protein, 10 aa, Mycobacterium
AALGAAATGL

SEQ ID NO: 411444 - protein, 6 aa, Mycobacterium
AALGAV

SEQ ID NO: 411445 - protein, 8 aa, Mycobacterium
AALGDEEV

SEQ ID NO: 411446 - protein, 11 aa, Mycobacterium
AALGDNGFSAG

SEQ ID NO: 411447 - protein, 13 aa, Mycobacterium
AALGDPKRWPGPR

SEQ ID NO: 411448 - protein, 8 aa, Mycobacterium
AALGERAE

SEQ ID NO: 411449 - protein, 8 aa, Mycobacterium
AALGERAP

SEQ ID NO: 411450 - protein, 6 aa, Mycobacterium
AALGES

SEQ ID NO: 411451 - protein, 6 aa, Mycobacterium
AALGGA

SEQ ID NO: 411452 - protein, 13 aa, Mycobacterium
AALGGKARSGPEF

SEQ ID NO: 411453 - protein, 15 aa, Mycobacterium
AALGGPERARERHVG

SEQ ID NO: 411454 - protein, 14 aa, Mycobacterium
AALGGSQRARERHV

SEQ ID NO: 411455 - protein, 24 aa, Mycobacterium
AALGGSTTAGGAGTSHVSAGGSGV

SEQ ID NO: 411456 - protein, 7 aa, Mycobacterium
AALGKGA

SEQ ID NO: 411457 - protein, 9 aa, Mycobacterium
AALGLSEDR

SEQ ID NO: 411458 - protein, 20 aa, Mycobacterium
AALGRSTSAYTHALDNASEK

SEQ ID NO: 411459 - protein, 6 aa, Mycobacterium
AALGSG

SEQ ID NO: 411460 - protein, 9 aa, Mycobacterium
AALGTPANV

SEQ ID NO: 411461 - protein, 10 aa, Mycobacterium
AALHDTGADV

SEQ ID NO: 411462 - protein, 9 aa, Mycobacterium
AALKGNGMP

SEQ ID NO: 411463 - protein, 11 aa, Mycobacterium
AALKGSPQRRG

SEQ ID NO: 411464 - protein, 12 aa, Mycobacterium
AALKNGELTEAE

SEQ ID NO: 411465 - protein, 5 aa, Mycobacterium
AALNA

SEQ ID NO: 411466 - protein, 5 aa, Mycobacterium
AALNE

SEQ ID NO: 411467 - protein, 7 aa, Mycobacterium
AALNGPW

SEQ ID NO: 411468 - protein, 4 aa, Mycobacterium
AALP

SEQ ID NO: 411469 - protein, 10 aa, Mycobacterium
AALPAAEARE

SEQ ID NO: 411470 - protein, 7 aa, Mycobacterium
AALPADP

SEQ ID NO: 411471 - protein, 8 aa, Mycobacterium
AALPAPEQ

SEQ ID NO: 411472 - protein, 19 aa, Mycobacterium
AALPAVQPDTDTHASAGRF

SEQ ID NO: 411473 - protein, 5 aa, Mycobacterium
AALPD

SEQ ID NO: 411474 - protein, 6 aa, Mycobacterium
AALPDA

SEQ ID NO: 411475 - protein, 7 aa, Mycobacterium
AALPDGS

SEQ ID NO: 411476 - protein, 6 aa, Mycobacterium
AALPDT

SEQ ID NO: 411477 - protein, 7 aa, Mycobacterium
AALPEDV

SEQ ID NO: 411478 - protein, 8 aa, Mycobacterium
AALPESLS

SEQ ID NO: 411479 - protein, 8 aa, Mycobacterium
AALPETAA

SEQ ID NO: 411480 - protein, 6 aa, Mycobacterium
AALPGP

SEQ ID NO: 411481 - protein, 10 aa, Mycobacterium
AALPGRATPI

SEQ ID NO: 411482 - protein, 18 aa, Mycobacterium
AALPGSRTITGAGTPGLD

SEQ ID NO: 411483 - protein, 17 aa, Mycobacterium
AALPGSRTTTSAGTPAL

SEQ ID NO: 411484 - protein, 10 aa, Mycobacterium
AALPGYTGAA

SEQ ID NO: 411485 - protein, 8 aa, Mycobacterium
AALPKNLN

SEQ ID NO: 411486 - protein, 5 aa, Mycobacterium
AALPN

SEQ ID NO: 411487 - protein, 17 aa, Mycobacterium
AALPNGLDAANAAPSLL

SEQ ID NO: 411488 - protein, 6 aa, Mycobacterium
AALPPA

SEQ ID NO: 411489 - protein, 8 aa, Mycobacterium
AALPPPGI

SEQ ID NO: 411490 - protein, 6 aa, Mycobacterium
AALPPS

SEQ ID NO: 411491 - protein, 7 aa, Mycobacterium
AALPPSA

SEQ ID NO: 411492 - protein, 7 aa, Mycobacterium
AALPQPA

SEQ ID NO: 411493 - protein, 7 aa, Mycobacterium
AALPQTP

SEQ ID NO: 411494 - protein, 6 aa, Mycobacterium
AALPRN

SEQ ID NO: 411495 - protein, 7 aa, Mycobacterium
AALPSVG

SEQ ID NO: 411496 - protein, 15 aa, Mycobacterium
AALPTAPDDWGTSRS

SEQ ID NO: 411497 - protein, 7 aa, Mycobacterium
AALPTDP

SEQ ID NO: 411498 - protein, 11 aa, Mycobacterium
AALQASDARVS

SEQ ID NO: 411499 - protein, 10 aa, Mycobacterium
AALQDNGFGV

SEQ ID NO: 411500 - protein, 8 aa, Mycobacterium
AALQQPGA

SEQ ID NO: 411501 - protein, 5 aa, Mycobacterium
AALQT

SEQ ID NO: 411502 - protein, 10 aa, Mycobacterium
AALQTADARV

SEQ ID NO: 411503 - protein, 12 aa, Mycobacterium
AALQTTDSRAAQ

SEQ ID NO: 411504 - protein, 4 aa, Mycobacterium
AALR

SEQ ID NO: 411505 - protein, 5 aa, Mycobacterium
AALRA

SEQ ID NO: 411506 - protein, 6 aa, Mycobacterium
AALRAS

SEQ ID NO: 411507 - protein, 8 aa, Mycobacterium
AALRDKEK

SEQ ID NO: 411508 - protein, 6 aa, Mycobacterium
AALREG

SEQ ID NO: 411509 - protein, 5 aa, Mycobacterium
AALRG

SEQ ID NO: 411510 - protein, 6 aa, Mycobacterium
AALRGD

SEQ ID NO: 411511 - protein, 6 aa, Mycobacterium
AALRNG

SEQ ID NO: 411512 - protein, 5 aa, Mycobacterium
AALRQ

SEQ ID NO: 411513 - protein, 6 aa, Mycobacterium
AALRSG

SEQ ID NO: 411514 - protein, 7 aa, Mycobacterium
AALRTYS

SEQ ID NO: 411515 - protein, 6 aa, Mycobacterium
AALSAG

SEQ ID NO: 411516 - protein, 6 aa, Mycobacterium
AALSDE

SEQ ID NO: 411517 - protein, 12 aa, Mycobacterium
AALSDGSESSVS

SEQ ID NO: 411518 - protein, 10 aa, Mycobacterium
AALSESAPAP

SEQ ID NO: 411519 - protein, 12 aa, Mycobacterium
AALSGAPDDTFG

SEQ ID NO: 411520 - protein, 6 aa, Mycobacterium
AALSKT

SEQ ID NO: 411521 - protein, 5 aa, Mycobacterium
AALSP

SEQ ID NO: 411522 - protein, 6 aa, Mycobacterium
AALSPA

SEQ ID NO: 411523 - protein, 7 aa, Mycobacterium
AALSPAG

SEQ ID NO: 411524 - protein, 7 aa, Mycobacterium
AALSQRS

SEQ ID NO: 411525 - protein, 12 aa, Mycobacterium
AALSRSAEGDDN

SEQ ID NO: 411526 - protein, 7 aa, Mycobacterium
AALSTEE

SEQ ID NO: 411527 - protein, 7 aa, Mycobacterium
AALSTEQ

SEQ ID NO: 411528 - protein, 14 aa, Mycobacterium
AALSVGSDGGGSIR

SEQ ID NO: 411529 - protein, 4 aa, Mycobacterium
AALT

SEQ ID NO: 411530 - protein, 13 aa, Mycobacterium
AALTAKRAGGNQI

SEQ ID NO: 411531 - protein, 11 aa, Mycobacterium
AALTDETGTFS

SEQ ID NO: 411532 - protein, 5 aa, Mycobacterium
AALTE

SEQ ID NO: 411533 - protein, 7 aa, Mycobacterium
AALTEGD

SEQ ID NO: 411534 - protein, 20 aa, Mycobacterium
AALTPGEYTQLTGRAGRRGI

SEQ ID NO: 411535 - protein, 6 aa, Mycobacterium
AALTRP

SEQ ID NO: 411536 - protein, 8 aa, Mycobacterium
AALTSAEA

SEQ ID NO: 411537 - protein, 7 aa, Mycobacterium
AALTSGA

SEQ ID NO: 411538 - protein, 13 aa, Mycobacterium
AALTSGGVDTDRI

SEQ ID NO: 411539 - protein, 4 aa, Mycobacterium
AAMA

SEQ ID NO: 411540 - protein, 16 aa, Mycobacterium
AAMAGSPLSGGYAGAK

SEQ ID NO: 411541 - protein, 8 aa, Mycobacterium
AAMAPATF

SEQ ID NO: 411542 - protein, 7 aa, Mycobacterium
AAMATGG

SEQ ID NO: 411543 - protein, 11 aa, Mycobacterium
AAMDNARDATQ

SEQ ID NO: 411544 - protein, 13 aa, Mycobacterium
AAMDNARDATQVH

SEQ ID NO: 411545 - protein, 25 aa, Mycobacterium
AAMGDGAAAPLDGSGGLGGAGGLGE

SEQ ID NO: 411546 - protein, 7 aa, Mycobacterium
AAMGGAA

SEQ ID NO: 411547 - protein, 6 aa, Mycobacterium
AAMGPG

SEQ ID NO: 411548 - protein, 9 aa, Mycobacterium
AAMKPDDPL

SEQ ID NO: 411549 - protein, 8 aa, Mycobacterium
AAMPGPSA

SEQ ID NO: 411550 - protein, 8 aa, Mycobacterium
AAMPSGAA

SEQ ID NO: 411551 - protein, 6 aa, Mycobacterium
AAMRAD

SEQ ID NO: 411552 - protein, 14 aa, Mycobacterium
AAMRRHSRRTRDAE

SEQ ID NO: 411553 - protein, 4 aa, Mycobacterium
AAMS

SEQ ID NO: 411554 - protein, 10 aa, Mycobacterium
AAMSAAAAPY

SEQ ID NO: 411555 - protein, 16 aa, Mycobacterium
AAMSAGALNGARGNSG

SEQ ID NO: 411556 - protein, 14 aa, Mycobacterium
AAMTPQPPRRYSQA

SEQ ID NO: 411557 - protein, 6 aa, Mycobacterium
AAMTRP

SEQ ID NO: 411558 - protein, 4 aa, Mycobacterium
AANA

SEQ ID NO: 411559 - protein, 11 aa, Mycobacterium
AANAAAAARTA

SEQ ID NO: 411560 - protein, 11 aa, Mycobacterium
AANAAAAGPTT

SEQ ID NO: 411561 - protein, 14 aa, Mycobacterium
AANAAAAGPTTGLA

SEQ ID NO: 411562 - protein, 13 aa, Mycobacterium
AANAAAAPPTTGI

SEQ ID NO: 411563 - protein, 10 aa, Mycobacterium
AANAAAATQI

SEQ ID NO: 411564 - protein, 7 aa, Mycobacterium
AANAAEG

SEQ ID NO: 411565 - protein, 14 aa, Mycobacterium
AANAAGAAASGAAN

SEQ ID NO: 411566 - protein, 9 aa, Mycobacterium
AANAAGRKV

SEQ ID NO: 411567 - protein, 8 aa, Mycobacterium
AANAATRT

SEQ ID NO: 411568 - protein, 14 aa, Mycobacterium
AANAAVDETEAQQP

SEQ ID NO: 411569 - protein, 13 aa, Mycobacterium
AANADGSDSRSVL

SEQ ID NO: 411570 - protein, 5 aa, Mycobacterium
AANAE

SEQ ID NO: 411571 - protein, 8 aa, Mycobacterium
AANAEATR

SEQ ID NO: 411572 - protein, 7 aa, Mycobacterium
AANAEDR

SEQ ID NO: 411573 - protein, 7 aa, Mycobacterium
AANAEGH

SEQ ID NO: 411574 - protein, 7 aa, Mycobacterium
AANAGID

SEQ ID NO: 411575 - protein, 6 aa, Mycobacterium
AANAGS

SEQ ID NO: 411576 - protein, 13 aa, Mycobacterium
AANAGTPGSGGLT

SEQ ID NO: 411577 - protein, 8 aa, Mycobacterium
AANAITGS

SEQ ID NO: 411578 - protein, 6 aa, Mycobacterium
AANALS

SEQ ID NO: 411579 - protein, 5 aa, Mycobacterium
AANAN

SEQ ID NO: 411580 - protein, 7 aa, Mycobacterium
AANAPQI

SEQ ID NO: 411581 - protein, 8 aa, Mycobacterium
AANAPRIR

SEQ ID NO: 411582 - protein, 17 aa, Mycobacterium
AANAPSGYQTSGITQPP

SEQ ID NO: 411583 - protein, 12 aa, Mycobacterium
AANAPVIADIWG

SEQ ID NO: 411584 - protein, 8 aa, Mycobacterium
AANAQPAV

SEQ ID NO: 411585 - protein, 9 aa, Mycobacterium
AANAQPAVA

SEQ ID NO: 411586 - protein, 6 aa, Mycobacterium
AANASA

SEQ ID NO: 411587 - protein, 8 aa, Mycobacterium
AANASPFQ

SEQ ID NO: 411588 - protein, 8 aa, Mycobacterium
AANASPLQ

SEQ ID NO: 411589 - protein, 9 aa, Mycobacterium
AANATEDEL

SEQ ID NO: 411590 - protein, 21 aa, Mycobacterium
AANATYSAGRRGYGPAAPGNF

SEQ ID NO: 411591 - protein, 14 aa, Mycobacterium
AANDDVDHPAGTSI

SEQ ID NO: 411592 - protein, 8 aa, Mycobacterium
AANDEARK

SEQ ID NO: 411593 - protein, 8 aa, Mycobacterium
AANDEGTY

SEQ ID NO: 411594 - protein, 8 aa, Mycobacterium
AANDERVA

SEQ ID NO: 411595 - protein, 5 aa, Mycobacterium
AANDP

SEQ ID NO: 411596 - protein, 9 aa, Mycobacterium
AANDPDRMR

SEQ ID NO: 411597 - protein, 7 aa, Mycobacterium
AANDPER

SEQ ID NO: 411598 - protein, 9 aa, Mycobacterium
AANDPTLPH

SEQ ID NO: 411599 - protein, 5 aa, Mycobacterium
AANDS

SEQ ID NO: 411600 - protein, 6 aa, Mycobacterium
AANDSA

SEQ ID NO: 411601 - protein, 4 aa, Mycobacterium
AANE

SEQ ID NO: 411602 - protein, 7 aa, Mycobacterium
AANEADA

SEQ ID NO: 411603 - protein, 7 aa, Mycobacterium
AANEAEY

SEQ ID NO: 411604 - protein, 19 aa, Mycobacterium
AANEATRAAAAKWPNRPDP

SEQ ID NO: 411605 - protein, 8 aa, Mycobacterium
AANEEAAQ

SEQ ID NO: 411606 - protein, 7 aa, Mycobacterium
AANEPER

SEQ ID NO: 411607 - protein, 8 aa, Mycobacterium
AANEPGFE

SEQ ID NO: 411608 - protein, 9 aa, Mycobacterium
AANESRPSR

SEQ ID NO: 411609 - protein, 7 aa, Mycobacterium
AANETAA

SEQ ID NO: 411610 - protein, 6 aa, Mycobacterium
AANFGE

SEQ ID NO: 411611 - protein, 4 aa, Mycobacterium
AANG

SEQ ID NO: 411612 - protein, 21 aa, Mycobacterium
AANGADGRPTKPVTVKSDEHG

SEQ ID NO: 411613 - protein, 6 aa, Mycobacterium
AANGAG

SEQ ID NO: 411614 - protein, 7 aa, Mycobacterium
AANGASV

SEQ ID NO: 411615 - protein, 10 aa, Mycobacterium
AANGDHTGAA

SEQ ID NO: 411616 - protein, 21 aa, Mycobacterium
AANGDPSAPGAPTWRPYDASR

SEQ ID NO: 411617 - protein, 10 aa, Mycobacterium
AANGDQATPS

SEQ ID NO: 411618 - protein, 7 aa, Mycobacterium
AANGGHK

SEQ ID NO: 411619 - protein, 11 aa, Mycobacterium
AANGHNSLKPV

SEQ ID NO: 411620 - protein, 21 aa, Mycobacterium
AANGKDEDGEDGQDGEERDDV

SEQ ID NO: 411621 - protein, 42 aa, Mycobacterium
AANGKHEGDEDHEDHEDHETAEDTTAAEVRDDTRDEHDADER

SEQ ID NO: 411622 - protein, 5 aa, Mycobacterium
AANGL

SEQ ID NO: 411623 - protein, 8 aa, Mycobacterium
AANGLQGS

SEQ ID NO: 411624 - protein, 7 aa, Mycobacterium
AANGPLA

SEQ ID NO: 411625 - protein, 8 aa, Mycobacterium
AANGSNAQ

SEQ ID NO: 411626 - protein, 9 aa, Mycobacterium
AANGSNQQS

SEQ ID NO: 411627 - protein, 8 aa, Mycobacterium
AANGYREY

SEQ ID NO: 411628 - protein, 8 aa, Mycobacterium
AANHESTE

SEQ ID NO: 411629 - protein, 17 aa, Mycobacterium
AANHPDAGSVGSTEAFR

SEQ ID NO: 411630 - protein, 7 aa, Mycobacterium
AANHSGK

SEQ ID NO: 411631 - protein, 9 aa, Mycobacterium
AANKATEAG

SEQ ID NO: 411632 - protein, 5 aa, Mycobacterium
AANKG

SEQ ID NO: 411633 - protein, 11 aa, Mycobacterium
AANKQKAELEE

SEQ ID NO: 411634 - protein, 4 aa, Mycobacterium
AANL

SEQ ID NO: 411635 - protein, 9 aa, Mycobacterium
AANLAGGGR

SEQ ID NO: 411636 - protein, 13 aa, Mycobacterium
AANLGSADTTPDN

SEQ ID NO: 411637 - protein, 16 aa, Mycobacterium
AANLPSAIDGPTIGTN

SEQ ID NO: 411638 - protein, 6 aa, Mycobacterium
AANMSA

SEQ ID NO: 411639 - protein, 21 aa, Mycobacterium
AANNEADHEATVAAVASISAG

SEQ ID NO: 411640 - protein, 6 aa, Mycobacterium
AANNLP

SEQ ID NO: 411641 - protein, 6 aa, Mycobacterium
AANNNL

SEQ ID NO: 411642 - protein, 5 aa, Mycobacterium
AANNV

SEQ ID NO: 411643 - protein, 4 aa, Mycobacterium
AANP

SEQ ID NO: 411644 - protein, 5 aa, Mycobacterium
AANPA

SEQ ID NO: 411645 - protein, 8 aa, Mycobacterium
AANPADRE

SEQ ID NO: 411646 - protein, 10 aa, Mycobacterium
AANPAGHEKQ

SEQ ID NO: 411647 - protein, 10 aa, Mycobacterium
AANPALSDDP

SEQ ID NO: 411648 - protein, 7 aa, Mycobacterium
AANPDAP

SEQ ID NO: 411649 - protein, 5 aa, Mycobacterium
AANPE

SEQ ID NO: 411650 - protein, 7 aa, Mycobacterium
AANPEAE

SEQ ID NO: 411651 - protein, 6 aa, Mycobacterium
AANPEL

SEQ ID NO: 411652 - protein, 8 aa, Mycobacterium
AANPENAR

SEQ ID NO: 411653 - protein, 8 aa, Mycobacterium
AANPENMR

SEQ ID NO: 411654 - protein, 7 aa, Mycobacterium
AANPEVA

SEQ ID NO: 411655 - protein, 9 aa, Mycobacterium
AANPGAAVG

SEQ ID NO: 411656 - protein, 7 aa, Mycobacterium
AANPGKL

SEQ ID NO: 411657 - protein, 9 aa, Mycobacterium
AANPHQVPQ

SEQ ID NO: 411658 - protein, 21 aa, Mycobacterium
AANPHRRSKVGNGSLDQVRPT

SEQ ID NO: 411659 - protein, 7 aa, Mycobacterium
AANPIGS

SEQ ID NO: 411660 - protein, 11 aa, Mycobacterium
AANPIGSGLTP

SEQ ID NO: 411661 - protein, 8 aa, Mycobacterium
AANPIQGG

SEQ ID NO: 411662 - protein, 6 aa, Mycobacterium
AANPNT

SEQ ID NO: 411663 - protein, 6 aa, Mycobacterium
AANPPA

SEQ ID NO: 411664 - protein, 8 aa, Mycobacterium
AANPPHTV

SEQ ID NO: 411665 - protein, 6 aa, Mycobacterium
AANPPL

SEQ ID NO: 411666 - protein, 8 aa, Mycobacterium
AANPPQAL

SEQ ID NO: 411667 - protein, 5 aa, Mycobacterium
AANPQ

SEQ ID NO: 411668 - protein, 8 aa, Mycobacterium
AANPQGVR

SEQ ID NO: 411669 - protein, 10 aa, Mycobacterium
AANPQMANDP

SEQ ID NO: 411670 - protein, 6 aa, Mycobacterium
AANPQT

SEQ ID NO: 411671 - protein, 7 aa, Mycobacterium
AANPREL

SEQ ID NO: 411672 - protein, 13 aa, Mycobacterium
AANPRGGTGYAVG

SEQ ID NO: 411673 - protein, 7 aa, Mycobacterium
AANPTGV

SEQ ID NO: 411674 - protein, 7 aa, Mycobacterium
AANPTTC

SEQ ID NO: 411675 - protein, 5 aa, Mycobacterium
AANPV

SEQ ID NO: 411676 - protein, 6 aa, Mycobacterium
AANPVE

SEQ ID NO: 411677 - protein, 9 aa, Mycobacterium
AANPVSPGD

SEQ ID NO: 411678 - protein, 9 aa, Mycobacterium
AANQARGAA

SEQ ID NO: 411679 - protein, 5 aa, Mycobacterium
AANQG

SEQ ID NO: 411680 - protein, 7 aa, Mycobacterium
AANQQAV

SEQ ID NO: 411681 - protein, 4 aa, Mycobacterium
AANR

SEQ ID NO: 411682 - protein, 13 aa, Mycobacterium
AANRDERRFDDPD

SEQ ID NO: 411683 - protein, 15 aa, Mycobacterium
AANRDPAVYDDPDRV

SEQ ID NO: 411684 - protein, 7 aa, Mycobacterium
AANRDPD

SEQ ID NO: 411685 - protein, 9 aa, Mycobacterium
AANRDPRRF

SEQ ID NO: 411686 - protein, 12 aa, Mycobacterium
AANRDPRRFDDP

SEQ ID NO: 411687 - protein, 23 aa, Mycobacterium
AANRDPRRFEDPDTFDPERKNAR

SEQ ID NO: 411688 - protein, 23 aa, Mycobacterium
AANRDPRRFENPDDFDPARKNAR

SEQ ID NO: 411689 - protein, 19 aa, Mycobacterium
AANRDSARYPDPDRFDPAR

SEQ ID NO: 411690 - protein, 15 aa, Mycobacterium
AANRGGLPTGTDNVR

SEQ ID NO: 411691 - protein, 5 aa, Mycobacterium
AANRS

SEQ ID NO: 411692 - protein, 10 aa, Mycobacterium
AANSAAAGPT

SEQ ID NO: 411693 - protein, 10 aa, Mycobacterium
AANSAPTRSV

SEQ ID NO: 411694 - protein, 15 aa, Mycobacterium
AANSDLKRLPTTDEV

SEQ ID NO: 411695 - protein, 14 aa, Mycobacterium
AANSFEAQAARDGL

SEQ ID NO: 411696 - protein, 14 aa, Mycobacterium
AANSPGAGLSASVA

SEQ ID NO: 411697 - protein, 10 aa, Mycobacterium
AANSPSATLG

SEQ ID NO: 411698 - protein, 7 aa, Mycobacterium
AANSTAL

SEQ ID NO: 411699 - protein, 4 aa, Mycobacterium
AANT

SEQ ID NO: 411700 - protein, 6 aa, Mycobacterium
AANTAD

SEQ ID NO: 411701 - protein, 8 aa, Mycobacterium
AANTADRE

SEQ ID NO: 411702 - protein, 7 aa, Mycobacterium
AANTAGK

SEQ ID NO: 411703 - protein, 7 aa, Mycobacterium
AANTAKG

SEQ ID NO: 411704 - protein, 8 aa, Mycobacterium
AANTATAS

SEQ ID NO: 411705 - protein, 9 aa, Mycobacterium
AANTDDGRS

SEQ ID NO: 411706 - protein, 11 aa, Mycobacterium
AANTDPAEFAD

SEQ ID NO: 411707 - protein, 12 aa, Mycobacterium
AANTDPAEFPDP

SEQ ID NO: 411708 - protein, 9 aa, Mycobacterium
AANTDYDTG

SEQ ID NO: 411709 - protein, 9 aa, Mycobacterium
AANTEAQRI

SEQ ID NO: 411710 - protein, 9 aa, Mycobacterium
AANTEDGRS

SEQ ID NO: 411711 - protein, 9 aa, Mycobacterium
AANTEETQA

SEQ ID NO: 411712 - protein, 17 aa, Mycobacterium
AANTGAAPSYGADPITQ

SEQ ID NO: 411713 - protein, 7 aa, Mycobacterium
AANTGNY

SEQ ID NO: 411714 - protein, 26 aa, Mycobacterium
AANTPKTNVGGEHPNVDTSDNGDHDP

SEQ ID NO: 411715 - protein, 26 aa, Mycobacterium
AANTPRTNVGGEHPDINTADNGAHDP

SEQ ID NO: 411716 - protein, 6 aa, Mycobacterium
AANTSA

SEQ ID NO: 411717 - protein, 6 aa, Mycobacterium
AANTTV

SEQ ID NO: 411718 - protein, 5 aa, Mycobacterium
AANTY

SEQ ID NO: 411719 - protein, 4 aa, Mycobacterium
AANV

SEQ ID NO: 411720 - protein, 14 aa, Mycobacterium
AANVPSGTTSNHFR

SEQ ID NO: 411721 - protein, 15 aa, Mycobacterium
AANVTAETAEHQSET

SEQ ID NO: 411722 - protein, 6 aa, Mycobacterium
AANVTP

SEQ ID NO: 411723 - protein, 12 aa, Mycobacterium
AANWDDQAGHVD

SEQ ID NO: 411724 - protein, 23 aa, Mycobacterium
AANYSSSPDSPLTSIGQQQAENV

SEQ ID NO: 411725 - protein, 10 aa, Mycobacterium
AAPAAAFSGE

SEQ ID NO: 411726 - protein, 7 aa, Mycobacterium
AAPAAAL

SEQ ID NO: 411727 - protein, 9 aa, Mycobacterium
AAPAAAPLD

SEQ ID NO: 411728 - protein, 17 aa, Mycobacterium
AAPAAAPQQAAVPGSGL

SEQ ID NO: 411729 - protein, 16 aa, Mycobacterium
AAPAADDPTGRRDTLL

SEQ ID NO: 411730 - protein, 6 aa, Mycobacterium
AAPAAE

SEQ ID NO: 411731 - protein, 6 aa, Mycobacterium
AAPAAG

SEQ ID NO: 411732 - protein, 16 aa, Mycobacterium
AAPAAGAASTSGPAFD

SEQ ID NO: 411733 - protein, 9 aa, Mycobacterium
AAPAALAAS

SEQ ID NO: 411734 - protein, 10 aa, Mycobacterium
AAPAALAGEE

SEQ ID NO: 411735 - protein, 7 aa, Mycobacterium
AAPAALP

SEQ ID NO: 411736 - protein, 33 aa, Mycobacterium
AAPAAPAPAPPPAEAPGEPAASTSETSSEITLP

SEQ ID NO: 411737 - protein, 6 aa, Mycobacterium
AAPAAR

SEQ ID NO: 411738 - protein, 10 aa, Mycobacterium
AAPAATLAGE

SEQ ID NO: 411739 - protein, 12 aa, Mycobacterium
AAPAATSSMPDP

SEQ ID NO: 411740 - protein, 11 aa, Mycobacterium
AAPADADSEWR

SEQ ID NO: 411741 - protein, 11 aa, Mycobacterium
AAPADANAPVD

SEQ ID NO: 411742 - protein, 8 aa, Mycobacterium
AAPADDGL

SEQ ID NO: 411743 - protein, 8 aa, Mycobacterium
AAPADRAG

SEQ ID NO: 411744 - protein, 9 aa, Mycobacterium
AAPADTGSF

SEQ ID NO: 411745 - protein, 19 aa, Mycobacterium
AAPADTRPATALPAPSPED

SEQ ID NO: 411746 - protein, 7 aa, Mycobacterium
AAPAEAV

SEQ ID NO: 411747 - protein, 6 aa, Mycobacterium
AAPAED

SEQ ID NO: 411748 - protein, 7 aa, Mycobacterium
AAPAEDV

SEQ ID NO: 411749 - protein, 6 aa, Mycobacterium
AAPAEL

SEQ ID NO: 411750 - protein, 18 aa, Mycobacterium
AAPAEPLGDATDASETIS

SEQ ID NO: 411751 - protein, 17 aa, Mycobacterium
AAPAEPLGEAADASRAV

SEQ ID NO: 411752 - protein, 7 aa, Mycobacterium
AAPAERA

SEQ ID NO: 411753 - protein, 11 aa, Mycobacterium
AAPAGAGKTHS

SEQ ID NO: 411754 - protein, 12 aa, Mycobacterium
AAPAGASTEEHH

SEQ ID NO: 411755 - protein, 15 aa, Mycobacterium
AAPAGPASACGATGA

SEQ ID NO: 411756 - protein, 12 aa, Mycobacterium
AAPAGPLLGTPN

SEQ ID NO: 411757 - protein, 7 aa, Mycobacterium
AAPAGQD

SEQ ID NO: 411758 - protein, 7 aa, Mycobacterium
AAPAGRD

SEQ ID NO: 411759 - protein, 18 aa, Mycobacterium
AAPAGRGLTAGQRRRRAI

SEQ ID NO: 411760 - protein, 8 aa, Mycobacterium
AAPAGRTI

SEQ ID NO: 411761 - protein, 8 aa, Mycobacterium
AAPAHGRD

SEQ ID NO: 411762 - protein, 6 aa, Mycobacterium
AAPALE

SEQ ID NO: 411763 - protein, 6 aa, Mycobacterium
AAPALG

SEQ ID NO: 411764 - protein, 13 aa, Mycobacterium
AAPALPRATGTPR

SEQ ID NO: 411765 - protein, 15 aa, Mycobacterium
AAPALTSGTTALDGS

SEQ ID NO: 411766 - protein, 5 aa, Mycobacterium
AAPAP

SEQ ID NO: 411767 - protein, 19 aa, Mycobacterium
AAPAPAAKEPTGPAAPEVK

SEQ ID NO: 411768 - protein, 14 aa, Mycobacterium
AAPAPEPAPEDVTP

SEQ ID NO: 411769 - protein, 7 aa, Mycobacterium
AAPAPGE

SEQ ID NO: 411770 - protein, 14 aa, Mycobacterium
AAPAPGLDPTAHAD

SEQ ID NO: 411771 - protein, 14 aa, Mycobacterium
AAPAPLPAASELTD

SEQ ID NO: 411772 - protein, 6 aa, Mycobacterium
AAPAPT

SEQ ID NO: 411773 - protein, 7 aa, Mycobacterium
AAPAPTV

SEQ ID NO: 411774 - protein, 7 aa, Mycobacterium
AAPAQRA

SEQ ID NO: 411775 - protein, 13 aa, Mycobacterium
AAPAQSVQETATA

SEQ ID NO: 411776 - protein, 5 aa, Mycobacterium
AAPAR

SEQ ID NO: 411777 - protein, 8 aa, Mycobacterium
AAPARSTR

SEQ ID NO: 411778 - protein, 5 aa, Mycobacterium
AAPAS

SEQ ID NO: 411779 - protein, 11 aa, Mycobacterium
AAPASPPRESR

SEQ ID NO: 411780 - protein, 11 aa, Mycobacterium
AAPASTVPPSY

SEQ ID NO: 411781 - protein, 19 aa, Mycobacterium
AAPASVGDEIRGATAEQAS

SEQ ID NO: 411782 - protein, 7 aa, Mycobacterium
AAPASVT

SEQ ID NO: 411783 - protein, 7 aa, Mycobacterium
AAPATEE

SEQ ID NO: 411784 - protein, 8 aa, Mycobacterium
AAPATEGV

SEQ ID NO: 411785 - protein, 7 aa, Mycobacterium
AAPATER

SEQ ID NO: 411786 - protein, 9 aa, Mycobacterium
AAPATFASA

SEQ ID NO: 411787 - protein, 6 aa, Mycobacterium
AAPATG

SEQ ID NO: 411788 - protein, 10 aa, Mycobacterium
AAPATPAKKN

SEQ ID NO: 411789 - protein, 14 aa, Mycobacterium
AAPATRAGDARTSI

SEQ ID NO: 411790 - protein, 17 aa, Mycobacterium
AAPATVGNELQGATVEQ

SEQ ID NO: 411791 - protein, 7 aa, Mycobacterium
AAPAYAE

SEQ ID NO: 411792 - protein, 6 aa, Mycobacterium
AAPAYR

SEQ ID NO: 411793 - protein, 6 aa, Mycobacterium
AAPCPT

SEQ ID NO: 411794 - protein, 5 aa, Mycobacterium
AAPDA

SEQ ID NO: 411795 - protein, 7 aa, Mycobacterium
AAPDADA

SEQ ID NO: 411796 - protein, 7 aa, Mycobacterium
AAPDADL

SEQ ID NO: 411797 - protein, 8 aa, Mycobacterium
AAPDADRF

SEQ ID NO: 411798 - protein, 7 aa, Mycobacterium
AAPDAGL

SEQ ID NO: 411799 - protein, 7 aa, Mycobacterium
AAPDAHL

SEQ ID NO: 411800 - protein, 13 aa, Mycobacterium
AAPDAPPKDTRPF

SEQ ID NO: 411801 - protein, 14 aa, Mycobacterium
AAPDAPPKDTRPFE

SEQ ID NO: 411802 - protein, 7 aa, Mycobacterium
AAPDARY

SEQ ID NO: 411803 - protein, 6 aa, Mycobacterium
AAPDAT

SEQ ID NO: 411804 - protein, 7 aa, Mycobacterium
AAPDDAA

SEQ ID NO: 411805 - protein, 8 aa, Mycobacterium
AAPDDDGS

SEQ ID NO: 411806 - protein, 7 aa, Mycobacterium
AAPDDIE

SEQ ID NO: 411807 - protein, 9 aa, Mycobacterium
AAPDDPVRS

SEQ ID NO: 411808 - protein, 10 aa, Mycobacterium
AAPDDTDAVA

SEQ ID NO: 411809 - protein, 5 aa, Mycobacterium
AAPDE

SEQ ID NO: 411810 - protein, 7 aa, Mycobacterium
AAPDENA

SEQ ID NO: 411811 - protein, 16 aa, Mycobacterium
AAPDEPWESGTEVGPE

SEQ ID NO: 411812 - protein, 7 aa, Mycobacterium
AAPDEQG

SEQ ID NO: 411813 - protein, 10 aa, Mycobacterium
AAPDESASAA

SEQ ID NO: 411814 - protein, 10 aa, Mycobacterium
AAPDESSRQL

SEQ ID NO: 411815 - protein, 9 aa, Mycobacterium
AAPDGDPHI

SEQ ID NO: 411816 - protein, 6 aa, Mycobacterium
AAPDGL

SEQ ID NO: 411817 - protein, 15 aa, Mycobacterium
AAPDGQGVPSHESFP

SEQ ID NO: 411818 - protein, 7 aa, Mycobacterium
AAPDGRT

SEQ ID NO: 411819 - protein, 10 aa, Mycobacterium
AAPDGTADAA

SEQ ID NO: 411820 - protein, 5 aa, Mycobacterium
AAPDL

SEQ ID NO: 411821 - protein, 5 aa, Mycobacterium
AAPDP

SEQ ID NO: 411822 - protein, 9 aa, Mycobacterium
AAPDPATAS

SEQ ID NO: 411823 - protein, 9 aa, Mycobacterium
AAPDPDPVS

SEQ ID NO: 411824 - protein, 12 aa, Mycobacterium
AAPDPDRPDTAS

SEQ ID NO: 411825 - protein, 9 aa, Mycobacterium
AAPDPVPPG

SEQ ID NO: 411826 - protein, 5 aa, Mycobacterium
AAPDQ

SEQ ID NO: 411827 - protein, 9 aa, Mycobacterium
AAPDQPGAH

SEQ ID NO: 411828 - protein, 5 aa, Mycobacterium
AAPDR

SEQ ID NO: 411829 - protein, 6 aa, Mycobacterium
AAPDRA

SEQ ID NO: 411830 - protein, 6 aa, Mycobacterium
AAPDRP

SEQ ID NO: 411831 - protein, 6 aa, Mycobacterium
AAPDSL

SEQ ID NO: 411832 - protein, 7 aa, Mycobacterium
AAPDSLA

SEQ ID NO: 411833 - protein, 8 aa, Mycobacterium
AAPDSRYG

SEQ ID NO: 411834 - protein, 9 aa, Mycobacterium
AAPDTEKGL

SEQ ID NO: 411835 - protein, 10 aa, Mycobacterium
AAPDTGEQDL

SEQ ID NO: 411836 - protein, 10 aa, Mycobacterium
AAPDTGEQEL

SEQ ID NO: 411837 - protein, 6 aa, Mycobacterium
AAPDVE

SEQ ID NO: 411838 - protein, 11 aa, Mycobacterium
AAPDWPRGHDN

SEQ ID NO: 411839 - protein, 12 aa, Mycobacterium
AAPDWPSGHDND

SEQ ID NO: 411840 - protein, 47 aa, Mycobacterium
AAPDYGQAPPDYGQAPSDYGQAPPEYGQPAGGGYGGYGQSGYGAAGS

SEQ ID NO: 411841 - protein, 7 aa, Mycobacterium
AAPEAHE

SEQ ID NO: 411842 - protein, 9 aa, Mycobacterium
AAPEAQAQR

SEQ ID NO: 411843 - protein, 7 aa, Mycobacterium
AAPEDAV

SEQ ID NO: 411844 - protein, 30 aa, Mycobacterium
AAPEDSGTEQSPARGKGRASRFREETRSER

SEQ ID NO: 411845 - protein, 9 aa, Mycobacterium
AAPEESAAS

SEQ ID NO: 411846 - protein, 8 aa, Mycobacterium
AAPEGDGV

SEQ ID NO: 411847 - protein, 12 aa, Mycobacterium
AAPEGGYTPSQA

SEQ ID NO: 411848 - protein, 5 aa, Mycobacterium
AAPEL

SEQ ID NO: 411849 - protein, 7 aa, Mycobacterium
AAPELQA

SEQ ID NO: 411850 - protein, 19 aa, Mycobacterium
AAPENPAATAPSDPAQSRT

SEQ ID NO: 411851 - protein, 22 aa, Mycobacterium
AAPEPAPKRRRREPIASGDPMV

SEQ ID NO: 411852 - protein, 6 aa, Mycobacterium
AAPEPL

SEQ ID NO: 411853 - protein, 8 aa, Mycobacterium
AAPEPPRV

SEQ ID NO: 411854 - protein, 7 aa, Mycobacterium
AAPEPRR

SEQ ID NO: 411855 - protein, 9 aa, Mycobacterium
AAPEQARGD

SEQ ID NO: 411856 - protein, 12 aa, Mycobacterium
AAPEQGKGYQAG

SEQ ID NO: 411857 - protein, 6 aa, Mycobacterium
AAPERA

SEQ ID NO: 411858 - protein, 8 aa, Mycobacterium
AAPERAAQ

SEQ ID NO: 411859 - protein, 12 aa, Mycobacterium
AAPERAISHGQR

SEQ ID NO: 411860 - protein, 12 aa, Mycobacterium
AAPERPTGACPF

SEQ ID NO: 411861 - protein, 10 aa, Mycobacterium
AAPESGEQEL

SEQ ID NO: 411862 - protein, 6 aa, Mycobacterium
AAPESP

SEQ ID NO: 411863 - protein, 7 aa, Mycobacterium
AAPESSC

SEQ ID NO: 411864 - protein, 7 aa, Mycobacterium
AAPESTR

SEQ ID NO: 411865 - protein, 9 aa, Mycobacterium
AAPESVAAG

SEQ ID NO: 411866 - protein, 10 aa, Mycobacterium
AAPESVGGGG

SEQ ID NO: 411867 - protein, 5 aa, Mycobacterium
AAPET

SEQ ID NO: 411868 - protein, 14 aa, Mycobacterium
AAPETASDPEDSAA

SEQ ID NO: 411869 - protein, 10 aa, Mycobacterium
AAPETGDQEL

SEQ ID NO: 411870 - protein, 6 aa, Mycobacterium
AAPEVR

SEQ ID NO: 411871 - protein, 12 aa, Mycobacterium
AAPFGDAPTCGF

SEQ ID NO: 411872 - protein, 12 aa, Mycobacterium
AAPFKTTTQYRD

SEQ ID NO: 411873 - protein, 19 aa, Mycobacterium
AAPGAAAGGAAEAAEEQSE

SEQ ID NO: 411874 - protein, 31 aa, Mycobacterium
AAPGACHPDDDNPVLEPDPERRDTRSQCQRQ

SEQ ID NO: 411875 - protein, 26 aa, Mycobacterium
AAPGADATERPVRSITSGPRGYEGEG

SEQ ID NO: 411876 - protein, 8 aa, Mycobacterium
AAPGAEAG

SEQ ID NO: 411877 - protein, 12 aa, Mycobacterium
AAPGAFDGPDDF

SEQ ID NO: 411878 - protein, 6 aa, Mycobacterium
AAPGAG

SEQ ID NO: 411879 - protein, 8 aa, Mycobacterium
AAPGAGRL

SEQ ID NO: 411880 - protein, 7 aa, Mycobacterium
AAPGAQE

SEQ ID NO: 411881 - protein, 7 aa, Mycobacterium
AAPGASV

SEQ ID NO: 411882 - protein, 7 aa, Mycobacterium
AAPGATL

SEQ ID NO: 411883 - protein, 6 aa, Mycobacterium
AAPGCG

SEQ ID NO: 411884 - protein, 9 aa, Mycobacterium
AAPGDGGKI

SEQ ID NO: 411885 - protein, 7 aa, Mycobacterium
AAPGDIT

SEQ ID NO: 411886 - protein, 6 aa, Mycobacterium
AAPGEP

SEQ ID NO: 411887 - protein, 7 aa, Mycobacterium
AAPGEPV

SEQ ID NO: 411888 - protein, 6 aa, Mycobacterium
AAPGER

SEQ ID NO: 411889 - protein, 6 aa, Mycobacterium
AAPGES

SEQ ID NO: 411890 - protein, 6 aa, Mycobacterium
AAPGFE

SEQ ID NO: 411891 - protein, 16 aa, Mycobacterium
AAPGFGNSTTSPSSGF

SEQ ID NO: 411892 - protein, 6 aa, Mycobacterium
AAPGFV

SEQ ID NO: 411893 - protein, 7 aa, Mycobacterium
AAPGGDA

SEQ ID NO: 411894 - protein, 16 aa, Mycobacterium
AAPGGIGAAKTGGNYA

SEQ ID NO: 411895 - protein, 7 aa, Mycobacterium
AAPGGLD

SEQ ID NO: 411896 - protein, 18 aa, Mycobacterium
AAPGGRHRPKKLTTGKGP

SEQ ID NO: 411897 - protein, 12 aa, Mycobacterium
AAPGGSSRPAAP

SEQ ID NO: 411898 - protein, 10 aa, Mycobacterium
AAPGHTPGSS

SEQ ID NO: 411899 - protein, 5 aa, Mycobacterium
AAPGI

SEQ ID NO: 411900 - protein, 8 aa, Mycobacterium
AAPGIASG

SEQ ID NO: 411901 - protein, 14 aa, Mycobacterium
AAPGLAGTAGIQPQ

SEQ ID NO: 411902 - protein, 10 aa, Mycobacterium
AAPGLGASPS

SEQ ID NO: 411903 - protein, 38 aa, Mycobacterium
AAPGMGNPESQTLSVDGTPSQEAIDTDTRSAPQRNHDA

SEQ ID NO: 411904 - protein, 8 aa, Mycobacterium
AAPGMTSQ

SEQ ID NO: 411905 - protein, 12 aa, Mycobacterium
AAPGNTPSLDEV

SEQ ID NO: 411906 - protein, 6 aa, Mycobacterium
AAPGNV

SEQ ID NO: 411907 - protein, 9 aa, Mycobacterium
AAPGNVPSL

SEQ ID NO: 411908 - protein, 10 aa, Mycobacterium
AAPGNVPSLD

SEQ ID NO: 411909 - protein, 12 aa, Mycobacterium
AAPGPATPVTPA

SEQ ID NO: 411910 - protein, 10 aa, Mycobacterium
AAPGPDEDVA

SEQ ID NO: 411911 - protein, 12 aa, Mycobacterium
AAPGPDGRPRAV

SEQ ID NO: 411912 - protein, 7 aa, Mycobacterium
AAPGPGE

SEQ ID NO: 411913 - protein, 9 aa, Mycobacterium
AAPGPGTAH

SEQ ID NO: 411914 - protein, 15 aa, Mycobacterium
AAPGPSSDPVGLTPS

SEQ ID NO: 411915 - protein, 12 aa, Mycobacterium
AAPGQAPSRGIR

SEQ ID NO: 411916 - protein, 6 aa, Mycobacterium
AAPGQG

SEQ ID NO: 411917 - protein, 7 aa, Mycobacterium
AAPGQGE

SEQ ID NO: 411918 - protein, 6 aa, Mycobacterium
AAPGQI

SEQ ID NO: 411919 - protein, 10 aa, Mycobacterium
AAPGQRLSSR

SEQ ID NO: 411920 - protein, 6 aa, Mycobacterium
AAPGQV

SEQ ID NO: 411921 - protein, 6 aa, Mycobacterium
AAPGRP

SEQ ID NO: 411922 - protein, 7 aa, Mycobacterium
AAPGRRR

SEQ ID NO: 411923 - protein, 6 aa, Mycobacterium
AAPGSA

SEQ ID NO: 411924 - protein, 6 aa, Mycobacterium
AAPGSE

SEQ ID NO: 411925 - protein, 6 aa, Mycobacterium
AAPGSG

SEQ ID NO: 411926 - protein, 8 aa, Mycobacterium
AAPGSRGR

SEQ ID NO: 411927 - protein, 8 aa, Mycobacterium
AAPGSTAV

SEQ ID NO: 411928 - protein, 14 aa, Mycobacterium
AAPGTGPGAGPPNH

SEQ ID NO: 411929 - protein, 11 aa, Mycobacterium
AAPGTTPSLDE

SEQ ID NO: 411930 - protein, 6 aa, Mycobacterium
AAPGTV

SEQ ID NO: 411931 - protein, 5 aa, Mycobacterium
AAPGV

SEQ ID NO: 411932 - protein, 7 aa, Mycobacterium
AAPGVAT

SEQ ID NO: 411933 - protein, 8 aa, Mycobacterium
AAPGVGTA

SEQ ID NO: 411934 - protein, 4 aa, Mycobacterium
AAPH

SEQ ID NO: 411935 - protein, 5 aa, Mycobacterium
AAPHA

SEQ ID NO: 411936 - protein, 7 aa, Mycobacterium
AAPHGQG

SEQ ID NO: 411937 - protein, 13 aa, Mycobacterium
AAPHGRNEGSRCA

SEQ ID NO: 411938 - protein, 9 aa, Mycobacterium
AAPHGTGGN

SEQ ID NO: 411939 - protein, 6 aa, Mycobacterium
AAPHQP

SEQ ID NO: 411940 - protein, 10 aa, Mycobacterium
AAPHRDRNSL

SEQ ID NO: 411941 - protein, 10 aa, Mycobacterium
AAPHSDTHAK

SEQ ID NO: 411942 - protein, 5 aa, Mycobacterium
AAPHV

SEQ ID NO: 411943 - protein, 4 aa, Mycobacterium
AAPI

SEQ ID NO: 411944 - protein, 5 aa, Mycobacterium
AAPIA

SEQ ID NO: 411945 - protein, 7 aa, Mycobacterium
AAPIAGR

SEQ ID NO: 411946 - protein, 11 aa, Mycobacterium
AAPIGPDNPYG

SEQ ID NO: 411947 - protein, 7 aa, Mycobacterium
AAPIPGG

SEQ ID NO: 411948 - protein, 6 aa, Mycobacterium
AAPISE

SEQ ID NO: 411949 - protein, 8 aa, Mycobacterium
AAPKIDRA

SEQ ID NO: 411950 - protein, 9 aa, Mycobacterium
AAPKIQRND

SEQ ID NO: 411951 - protein, 29 aa, Mycobacterium
AAPKISNDTAPATQSAAVTSATTNSTATN

SEQ ID NO: 411952 - protein, 10 aa, Mycobacterium
AAPKPADAAD

SEQ ID NO: 411953 - protein, 15 aa, Mycobacterium
AAPKQTTNTNGTAMQ

SEQ ID NO: 411954 - protein, 7 aa, Mycobacterium
AAPKTAG

SEQ ID NO: 411955 - protein, 7 aa, Mycobacterium
AAPKYAA

SEQ ID NO: 411956 - protein, 8 aa, Mycobacterium
AAPKYAEA

SEQ ID NO: 411957 - protein, 8 aa, Mycobacterium
AAPKYEAA

SEQ ID NO: 411958 - protein, 10 aa, Mycobacterium
AAPLASGSWK

SEQ ID NO: 411959 - protein, 8 aa, Mycobacterium
AAPLDEQL

SEQ ID NO: 411960 - protein, 8 aa, Mycobacterium
AAPLDGGS

SEQ ID NO: 411961 - protein, 6 aa, Mycobacterium
AAPLGG

SEQ ID NO: 411962 - protein, 9 aa, Mycobacterium
AAPLGSGDT

SEQ ID NO: 411963 - protein, 11 aa, Mycobacterium
AAPLKPGKGPI

SEQ ID NO: 411964 - protein, 12 aa, Mycobacterium
AAPLPAESAGAP

SEQ ID NO: 411965 - protein, 5 aa, Mycobacterium
AAPLR

SEQ ID NO: 411966 - protein, 7 aa, Mycobacterium
AAPLSAH

SEQ ID NO: 411967 - protein, 5 aa, Mycobacterium
AAPLT

SEQ ID NO: 411968 - protein, 7 aa, Mycobacterium
AAPLTTR

SEQ ID NO: 411969 - protein, 4 aa, Mycobacterium
AAPM

SEQ ID NO: 411970 - protein, 7 aa, Mycobacterium
AAPMDAE

SEQ ID NO: 411971 - protein, 5 aa, Mycobacterium
AAPNA

SEQ ID NO: 411972 - protein, 7 aa, Mycobacterium
AAPNISH

SEQ ID NO: 411973 - protein, 50 aa, Mycobacterium
AAPNSAAQEATPGERAASGAAPDAAPTATGEQPSAPARQVSTGTGGRRRR

SEQ ID NO: 411974 - protein, 9 aa, Mycobacterium
AAPNSPTGT

SEQ ID NO: 411975 - protein, 8 aa, Mycobacterium
AAPNTGSI

SEQ ID NO: 411976 - protein, 4 aa, Mycobacterium
AAPP

SEQ ID NO: 411977 - protein, 19 aa, Mycobacterium
AAPPAAGGRHEDRYEGRYD

SEQ ID NO: 411978 - protein, 9 aa, Mycobacterium
AAPPAAQTR

SEQ ID NO: 411979 - protein, 18 aa, Mycobacterium
AAPPADEIARSPVEPAAT

SEQ ID NO: 411980 - protein, 10 aa, Mycobacterium
AAPPADEIPR

SEQ ID NO: 411981 - protein, 8 aa, Mycobacterium
AAPPADQI

SEQ ID NO: 411982 - protein, 17 aa, Mycobacterium
AAPPADQIARKPVEPAH

SEQ ID NO: 411983 - protein, 7 aa, Mycobacterium
AAPPAEL

SEQ ID NO: 411984 - protein, 8 aa, Mycobacterium
AAPPAELG

SEQ ID NO: 411985 - protein, 8 aa, Mycobacterium
AAPPAELS

SEQ ID NO: 411986 - protein, 8 aa, Mycobacterium
AAPPAGHG

SEQ ID NO: 411987 - protein, 9 aa, Mycobacterium
AAPPAGTRT

SEQ ID NO: 411988 - protein, 13 aa, Mycobacterium
AAPPAKTRYLTSD

SEQ ID NO: 411989 - protein, 7 aa, Mycobacterium
AAPPAMS

SEQ ID NO: 411990 - protein, 11 aa, Mycobacterium
AAPPANGNPHV

SEQ ID NO: 411991 - protein, 15 aa, Mycobacterium
AAPPAVHESPDPATR

SEQ ID NO: 411992 - protein, 21 aa, Mycobacterium
AAPPDARLTEQRERFLDLMLS

SEQ ID NO: 411993 - protein, 9 aa, Mycobacterium
AAPPDDDGN

SEQ ID NO: 411994 - protein, 9 aa, Mycobacterium
AAPPDDDGS

SEQ ID NO: 411995 - protein, 10 aa, Mycobacterium
AAPPDPAHPD

SEQ ID NO: 411996 - protein, 14 aa, Mycobacterium
AAPPDVVTSAQSAA

SEQ ID NO: 411997 - protein, 7 aa, Mycobacterium
AAPPEAE

SEQ ID NO: 411998 - protein, 15 aa, Mycobacterium
AAPPEAPRPDSQARH

SEQ ID NO: 411999 - protein, 7 aa, Mycobacterium
AAPPEEI

SEQ ID NO: 412000 - protein, 29 aa, Mycobacterium
AAPPEGIPPGDIAPPDAAIPGGPSPVSNT

SEQ ID NO: 412001 - protein, 6 aa, Mycobacterium
AAPPEL

SEQ ID NO: 412002 - protein, 6 aa, Mycobacterium
AAPPER

SEQ ID NO: 412003 - protein, 8 aa, Mycobacterium
AAPPERGE

SEQ ID NO: 412004 - protein, 8 aa, Mycobacterium
AAPPERQP

SEQ ID NO: 412005 - protein, 7 aa, Mycobacterium
AAPPERR

SEQ ID NO: 412006 - protein, 7 aa, Mycobacterium
AAPPETL

SEQ ID NO: 412007 - protein, 5 aa, Mycobacterium
AAPPF

SEQ ID NO: 412008 - protein, 6 aa, Mycobacterium
AAPPGA

SEQ ID NO: 412009 - protein, 16 aa, Mycobacterium
AAPPGGGFAGSDPEFA

SEQ ID NO: 412010 - protein, 7 aa, Mycobacterium
AAPPGLI

SEQ ID NO: 412011 - protein, 20 aa, Mycobacterium
AAPPGNPHDTRHAAGHRQGT

SEQ ID NO: 412012 - protein, 18 aa, Mycobacterium
AAPPGPKGRMEPSPYLPT

SEQ ID NO: 412013 - protein, 10 aa, Mycobacterium
AAPPGSAKAV

SEQ ID NO: 412014 - protein, 9 aa, Mycobacterium
AAPPGSVSD

SEQ ID NO: 412015 - protein, 6 aa, Mycobacterium
AAPPGT

SEQ ID NO: 412016 - protein, 10 aa, Mycobacterium
AAPPGTNPTI

SEQ ID NO: 412017 - protein, 6 aa, Mycobacterium
AAPPGY

SEQ ID NO: 412018 - protein, 6 aa, Mycobacterium
AAPPHI

SEQ ID NO: 412019 - protein, 11 aa, Mycobacterium
AAPPHTPDQPT

SEQ ID NO: 412020 - protein, 10 aa, Mycobacterium
AAPPHYKQDS

SEQ ID NO: 412021 - protein, 10 aa, Mycobacterium
AAPPIAENPD

SEQ ID NO: 412022 - protein, 12 aa, Mycobacterium
AAPPKDSAPEGL

SEQ ID NO: 412023 - protein, 27 aa, Mycobacterium
AAPPKVDINPKTNAVTPPDISGLNKEQ

SEQ ID NO: 412024 - protein, 5 aa, Mycobacterium
AAPPL

SEQ ID NO: 412025 - protein, 12 aa, Mycobacterium
AAPPLTDEQRTR

SEQ ID NO: 412026 - protein, 8 aa, Mycobacterium
AAPPNAAD

SEQ ID NO: 412027 - protein, 8 aa, Mycobacterium
AAPPNSEL

SEQ ID NO: 412028 - protein, 9 aa, Mycobacterium
AAPPPAATR

SEQ ID NO: 412029 - protein, 9 aa, Mycobacterium
AAPPPAETR

SEQ ID NO: 412030 - protein, 9 aa, Mycobacterium
AAPPPETAR

SEQ ID NO: 412031 - protein, 12 aa, Mycobacterium
AAPPPETAVLFR

SEQ ID NO: 412032 - protein, 9 aa, Mycobacterium
AAPPPGDRR

SEQ ID NO: 412033 - protein, 8 aa, Mycobacterium
AAPPPGHG

SEQ ID NO: 412034 - protein, 9 aa, Mycobacterium
AAPPPGHGP

SEQ ID NO: 412035 - protein, 8 aa, Mycobacterium
AAPPPGLP

SEQ ID NO: 412036 - protein, 10 aa, Mycobacterium
AAPPPGSGLK

SEQ ID NO: 412037 - protein, 14 aa, Mycobacterium
AAPPPNGTQPAEHP

SEQ ID NO: 412038 - protein, 26 aa, Mycobacterium
AAPPPSDTTVAGRPVTSNSRPTAQRA

SEQ ID NO: 412039 - protein, 9 aa, Mycobacterium
AAPPPVQTV

SEQ ID NO: 412040 - protein, 18 aa, Mycobacterium
AAPPQAEHRDGVASGPVS

SEQ ID NO: 412041 - protein, 10 aa, Mycobacterium
AAPPQGRARF

SEQ ID NO: 412042 - protein, 6 aa, Mycobacterium
AAPPQY

SEQ ID NO: 412043 - protein, 8 aa, Mycobacterium
AAPPRGAE

SEQ ID NO: 412044 - protein, 6 aa, Mycobacterium
AAPPRV

SEQ ID NO: 412045 - protein, 22 aa, Mycobacterium
AAPPSPLDVPSDPGLPVVVGQL

SEQ ID NO: 412046 - protein, 7 aa, Mycobacterium
AAPPTAF

SEQ ID NO: 412047 - protein, 6 aa, Mycobacterium
AAPPTL

SEQ ID NO: 412048 - protein, 12 aa, Mycobacterium
AAPPVNLETAAR

SEQ ID NO: 412049 - protein, 73 aa, Mycobacterium
AAPPVQPLDSPSPGIAQGDNNPKKAPPQEEDSSKSTPLQEGSDQSPPAMSPTDSAGTSTTQPGIKSVTSDEGI

SEQ ID NO: 412050 - protein, 8 aa, Mycobacterium
AAPPWAPP

SEQ ID NO: 412051 - protein, 8 aa, Mycobacterium
AAPPYDPT

SEQ ID NO: 412052 - protein, 4 aa, Mycobacterium
AAPQ

SEQ ID NO: 412053 - protein, 9 aa, Mycobacterium
AAPQAAAAA

SEQ ID NO: 412054 - protein, 66 aa, Mycobacterium
AAPQAAVEPEEAVGPTADEVTETEAEETPEVSEATAAEAAAEEKHDEAVAARAEAERAAEADEADE

SEQ ID NO: 412055 - protein, 10 aa, Mycobacterium
AAPQAGTGTV

SEQ ID NO: 412056 - protein, 7 aa, Mycobacterium
AAPQAQR

SEQ ID NO: 412057 - protein, 6 aa, Mycobacterium
AAPQAR

SEQ ID NO: 412058 - protein, 10 aa, Mycobacterium
AAPQDDADVR

SEQ ID NO: 412059 - protein, 12 aa, Mycobacterium
AAPQDQIATKTQ

SEQ ID NO: 412060 - protein, 9 aa, Mycobacterium
AAPQDVPGM

SEQ ID NO: 412061 - protein, 8 aa, Mycobacterium
AAPQEDYG

SEQ ID NO: 412062 - protein, 10 aa, Mycobacterium
AAPQGEDEGD

SEQ ID NO: 412063 - protein, 13 aa, Mycobacterium
AAPQGGGLTPVQR

SEQ ID NO: 412064 - protein, 15 aa, Mycobacterium
AAPQGHRGIQDPRTT

SEQ ID NO: 412065 - protein, 9 aa, Mycobacterium
AAPQGPAAV

SEQ ID NO: 412066 - protein, 11 aa, Mycobacterium
AAPQKKSNSAQ

SEQ ID NO: 412067 - protein, 9 aa, Mycobacterium
AAPQPGSRR

SEQ ID NO: 412068 - protein, 24 aa, Mycobacterium
AAPQPPAVTAGRPVTSASFPTAQR

SEQ ID NO: 412069 - protein, 8 aa, Mycobacterium
AAPQQEYG

SEQ ID NO: 412070 - protein, 18 aa, Mycobacterium
AAPQQPQVAPQAPPPTLS

SEQ ID NO: 412071 - protein, 18 aa, Mycobacterium
AAPQQTTNQSGTTNQNSA

SEQ ID NO: 412072 - protein, 16 aa, Mycobacterium
AAPQRSYQSPSRTTDV

SEQ ID NO: 412073 - protein, 8 aa, Mycobacterium
AAPQSWAK

SEQ ID NO: 412074 - protein, 9 aa, Mycobacterium
AAPQSWSRG

SEQ ID NO: 412075 - protein, 9 aa, Mycobacterium
AAPQSWTNG

SEQ ID NO: 412076 - protein, 5 aa, Mycobacterium
AAPQT

SEQ ID NO: 412077 - protein, 9 aa, Mycobacterium
AAPQTGAGT

SEQ ID NO: 412078 - protein, 40 aa, Mycobacterium
AAPQTGYQATGTEPVAPQQQLAQTQPIPPMGADGTQAPVE

SEQ ID NO: 412079 - protein, 9 aa, Mycobacterium
AAPQTTREA

SEQ ID NO: 412080 - protein, 14 aa, Mycobacterium
AAPQTTTPDGESQQ

SEQ ID NO: 412081 - protein, 5 aa, Mycobacterium
AAPQV

SEQ ID NO: 412082 - protein, 6 aa, Mycobacterium
AAPQVT

SEQ ID NO: 412083 - protein, 6 aa, Mycobacterium
AAPQYT

SEQ ID NO: 412084 - protein, 4 aa, Mycobacterium
AAPR

SEQ ID NO: 412085 - protein, 5 aa, Mycobacterium
AAPRA

SEQ ID NO: 412086 - protein, 7 aa, Mycobacterium
AAPRAHD

SEQ ID NO: 412087 - protein, 9 aa, Mycobacterium
AAPRAVTDK

SEQ ID NO: 412088 - protein, 9 aa, Mycobacterium
AAPRAYRAA

SEQ ID NO: 412089 - protein, 5 aa, Mycobacterium
AAPRD

SEQ ID NO: 412090 - protein, 8 aa, Mycobacterium
AAPRDAPG

SEQ ID NO: 412091 - protein, 9 aa, Mycobacterium
AAPREGARV

SEQ ID NO: 412092 - protein, 18 aa, Mycobacterium
AAPRGALAGAPRSPGPRY

SEQ ID NO: 412093 - protein, 11 aa, Mycobacterium
AAPRHTDPTGR

SEQ ID NO: 412094 - protein, 15 aa, Mycobacterium
AAPRLLPGTTRGPRV

SEQ ID NO: 412095 - protein, 21 aa, Mycobacterium
AAPRNERQLTRDQQIASEQPG

SEQ ID NO: 412096 - protein, 9 aa, Mycobacterium
AAPRPPGPL

SEQ ID NO: 412097 - protein, 9 aa, Mycobacterium
AAPRPVPAE

SEQ ID NO: 412098 - protein, 9 aa, Mycobacterium
AAPRPVPTG

SEQ ID NO: 412099 - protein, 7 aa, Mycobacterium
AAPRPYR

SEQ ID NO: 412100 - protein, 6 aa, Mycobacterium
AAPRRL

SEQ ID NO: 412101 - protein, 7 aa, Mycobacterium
AAPRRQW

SEQ ID NO: 412102 - protein, 7 aa, Mycobacterium
AAPRRRP

SEQ ID NO: 412103 - protein, 5 aa, Mycobacterium
AAPRS

SEQ ID NO: 412104 - protein, 17 aa, Mycobacterium
AAPRSGLTGPGRSVGPR

SEQ ID NO: 412105 - protein, 8 aa, Mycobacterium
AAPRSRLD

SEQ ID NO: 412106 - protein, 7 aa, Mycobacterium
AAPRSSA

SEQ ID NO: 412107 - protein, 8 aa, Mycobacterium
AAPRSSTV

SEQ ID NO: 412108 - protein, 5 aa, Mycobacterium
AAPRT

SEQ ID NO: 412109 - protein, 8 aa, Mycobacterium
AAPRTADV

SEQ ID NO: 412110 - protein, 7 aa, Mycobacterium
AAPRVAE

SEQ ID NO: 412111 - protein, 6 aa, Mycobacterium
AAPRVP

SEQ ID NO: 412112 - protein, 6 aa, Mycobacterium
AAPRVT

SEQ ID NO: 412113 - protein, 5 aa, Mycobacterium
AAPRY

SEQ ID NO: 412114 - protein, 7 aa, Mycobacterium
AAPRYAE

SEQ ID NO: 412115 - protein, 12 aa, Mycobacterium
AAPSAGTPEGPW

SEQ ID NO: 412116 - protein, 7 aa, Mycobacterium
AAPSALP

SEQ ID NO: 412117 - protein, 11 aa, Mycobacterium
AAPSANRRRAV

SEQ ID NO: 412118 - protein, 6 aa, Mycobacterium
AAPSAR

SEQ ID NO: 412119 - protein, 10 aa, Mycobacterium
AAPSARGHQH

SEQ ID NO: 412120 - protein, 11 aa, Mycobacterium
AAPSARGHQKD

SEQ ID NO: 412121 - protein, 5 aa, Mycobacterium
AAPSD

SEQ ID NO: 412122 - protein, 7 aa, Mycobacterium
AAPSDGV

SEQ ID NO: 412123 - protein, 19 aa, Mycobacterium
AAPSDSAWASALDALCSVL

SEQ ID NO: 412124 - protein, 7 aa, Mycobacterium
AAPSEHG

SEQ ID NO: 412125 - protein, 7 aa, Mycobacterium
AAPSESY

SEQ ID NO: 412126 - protein, 9 aa, Mycobacterium
AAPSFEPGR

SEQ ID NO: 412127 - protein, 12 aa, Mycobacterium
AAPSGGAWPPSR

SEQ ID NO: 412128 - protein, 18 aa, Mycobacterium
AAPSGRRAREVNAAEARR

SEQ ID NO: 412129 - protein, 13 aa, Mycobacterium
AAPSIGRPTRQSR

SEQ ID NO: 412130 - protein, 7 aa, Mycobacterium
AAPSLPK

SEQ ID NO: 412131 - protein, 90 aa, Mycobacterium
AAPSLTDPSLANPALTSPIGATPGLTTPGLTTPGLTTPGLTDPALASPGLTTPALTDPGLTTPGLTTPGLTTPGLTTPGLTTPAALTDPA

SEQ ID NO: 412132 - protein, 10 aa, Mycobacterium
AAPSPDPATG

SEQ ID NO: 412133 - protein, 9 aa, Mycobacterium
AAPSPGGAP

SEQ ID NO: 412134 - protein, 8 aa, Mycobacterium
AAPSPLGR

SEQ ID NO: 412135 - protein, 10 aa, Mycobacterium
AAPSPPQPRP

SEQ ID NO: 412136 - protein, 8 aa, Mycobacterium
AAPSQGES

SEQ ID NO: 412137 - protein, 14 aa, Mycobacterium
AAPSQSEPGFPPLS

SEQ ID NO: 412138 - protein, 7 aa, Mycobacterium
AAPSQSY

SEQ ID NO: 412139 - protein, 10 aa, Mycobacterium
AAPSRPDQRR

SEQ ID NO: 412140 - protein, 6 aa, Mycobacterium
AAPSSQ

SEQ ID NO: 412141 - protein, 7 aa, Mycobacterium
AAPSTRH

SEQ ID NO: 412142 - protein, 5 aa, Mycobacterium
AAPSV

SEQ ID NO: 412143 - protein, 6 aa, Mycobacterium
AAPSVA

SEQ ID NO: 412144 - protein, 7 aa, Mycobacterium
AAPSVGM

SEQ ID NO: 412145 - protein, 12 aa, Mycobacterium
AAPSVNRSASSI

SEQ ID NO: 412146 - protein, 14 aa, Mycobacterium
AAPSVPPEPVPSGL

SEQ ID NO: 412147 - protein, 6 aa, Mycobacterium
AAPSVT

SEQ ID NO: 412148 - protein, 5 aa, Mycobacterium
AAPSY

SEQ ID NO: 412149 - protein, 4 aa, Mycobacterium
AAPT

SEQ ID NO: 412150 - protein, 5 aa, Mycobacterium
AAPTA

SEQ ID NO: 412151 - protein, 10 aa, Mycobacterium
AAPTAAEGAP

SEQ ID NO: 412152 - protein, 6 aa, Mycobacterium
AAPTAD

SEQ ID NO: 412153 - protein, 7 aa, Mycobacterium
AAPTAER

SEQ ID NO: 412154 - protein, 11 aa, Mycobacterium
AAPTAGSQSRM

SEQ ID NO: 412155 - protein, 10 aa, Mycobacterium
AAPTAQPEAP

SEQ ID NO: 412156 - protein, 14 aa, Mycobacterium
AAPTATPLIIDRLP

SEQ ID NO: 412157 - protein, 6 aa, Mycobacterium
AAPTDL

SEQ ID NO: 412158 - protein, 7 aa, Mycobacterium
AAPTDTA

SEQ ID NO: 412159 - protein, 13 aa, Mycobacterium
AAPTEAATKHYNE

SEQ ID NO: 412160 - protein, 13 aa, Mycobacterium
AAPTETAEEADRI

SEQ ID NO: 412161 - protein, 73 aa, Mycobacterium
AAPTGATIPAGPGVAASPGARDTRAGGAVRAGPAIAAGPAGATVTADARTVGGLSPNAAGTSRAAVGARRGAA

SEQ ID NO: 412162 - protein, 7 aa, Mycobacterium
AAPTHGT

SEQ ID NO: 412163 - protein, 8 aa, Mycobacterium
AAPTKADK

SEQ ID NO: 412164 - protein, 12 aa, Mycobacterium
AAPTLPGPSAEV

SEQ ID NO: 412165 - protein, 12 aa, Mycobacterium
AAPTLSDRDAAA

SEQ ID NO: 412166 - protein, 14 aa, Mycobacterium
AAPTPGRAPTDPAI

SEQ ID NO: 412167 - protein, 13 aa, Mycobacterium
AAPTPLTLRPASV

SEQ ID NO: 412168 - protein, 11 aa, Mycobacterium
AAPTPPQEGTL

SEQ ID NO: 412169 - protein, 6 aa, Mycobacterium
AAPTPV

SEQ ID NO: 412170 - protein, 6 aa, Mycobacterium
AAPTQA

SEQ ID NO: 412171 - protein, 8 aa, Mycobacterium
AAPTQSAF

SEQ ID NO: 412172 - protein, 9 aa, Mycobacterium
AAPTQSAFE

SEQ ID NO: 412173 - protein, 5 aa, Mycobacterium
AAPTR

SEQ ID NO: 412174 - protein, 6 aa, Mycobacterium
AAPTRA

SEQ ID NO: 412175 - protein, 12 aa, Mycobacterium
AAPTRADPDTER

SEQ ID NO: 412176 - protein, 7 aa, Mycobacterium
AAPTREL

SEQ ID NO: 412177 - protein, 15 aa, Mycobacterium
AAPTRPIEPSPYLPT

SEQ ID NO: 412178 - protein, 15 aa, Mycobacterium
AAPTRPRPSERIREA

SEQ ID NO: 412179 - protein, 7 aa, Mycobacterium
AAPTRQA

SEQ ID NO: 412180 - protein, 6 aa, Mycobacterium
AAPTSA

SEQ ID NO: 412181 - protein, 7 aa, Mycobacterium
AAPTSAN

SEQ ID NO: 412182 - protein, 5 aa, Mycobacterium
AAPTT

SEQ ID NO: 412183 - protein, 15 aa, Mycobacterium
AAPTTPMEPSPYLPT

SEQ ID NO: 412184 - protein, 13 aa, Mycobacterium
AAPTTTAAGEDQT

SEQ ID NO: 412185 - protein, 15 aa, Mycobacterium
AAPTVAAQAAPSGLA

SEQ ID NO: 412186 - protein, 15 aa, Mycobacterium
AAPTYTAYAATKGAV

SEQ ID NO: 412187 - protein, 4 aa, Mycobacterium
AAPV

SEQ ID NO: 412188 - protein, 16 aa, Mycobacterium
AAPVAARRGDRRKVAR

SEQ ID NO: 412189 - protein, 6 aa, Mycobacterium
AAPVAD

SEQ ID NO: 412190 - protein, 5 aa, Mycobacterium
AAPVD

SEQ ID NO: 412191 - protein, 27 aa, Mycobacterium
AAPVEAAPPAPRAPEPARDAAQRAEEE

SEQ ID NO: 412192 - protein, 17 aa, Mycobacterium
AAPVGSPPKAPAPGVKA

SEQ ID NO: 412193 - protein, 8 aa, Mycobacterium
AAPVGTGP

SEQ ID NO: 412194 - protein, 5 aa, Mycobacterium
AAPVI

SEQ ID NO: 412195 - protein, 8 aa, Mycobacterium
AAPVPPRR

SEQ ID NO: 412196 - protein, 30 aa, Mycobacterium
AAPVPSAPEPVRGGPAEPPPQPDGDDEESM

SEQ ID NO: 412197 - protein, 7 aa, Mycobacterium
AAPVQAS

SEQ ID NO: 412198 - protein, 6 aa, Mycobacterium
AAPVRA

SEQ ID NO: 412199 - protein, 54 aa, Mycobacterium
AAPVTAPVADPNALADPDAVPGAPATPAAGAPAAADPNAPASPAPGVPGLPPLP

SEQ ID NO: 412200 - protein, 15 aa, Mycobacterium
AAPWPGPEGDRRRAA

SEQ ID NO: 412201 - protein, 6 aa, Mycobacterium
AAPYAA

SEQ ID NO: 412202 - protein, 7 aa, Mycobacterium
AAPYPAL

SEQ ID NO: 412203 - protein, 5 aa, Mycobacterium
AAPYT

SEQ ID NO: 412204 - protein, 8 aa, Mycobacterium
AAQAAAAP

SEQ ID NO: 412205 - protein, 10 aa, Mycobacterium
AAQAAASGTP

SEQ ID NO: 412206 - protein, 60 aa, Mycobacterium
AAQAADELAEEPEEPAEEEAEEAEEAVDESAAESADEEDTEAAELESDDADEDAEEEEAA

SEQ ID NO: 412207 - protein, 14 aa, Mycobacterium
AAQAAGTAGRASAA

SEQ ID NO: 412208 - protein, 7 aa, Mycobacterium
AAQAAKD

SEQ ID NO: 412209 - protein, 11 aa, Mycobacterium
AAQAAKKAQNM

SEQ ID NO: 412210 - protein, 12 aa, Mycobacterium
AAQAAKSPADHA

SEQ ID NO: 412211 - protein, 13 aa, Mycobacterium
AAQAANRAVNTHR

SEQ ID NO: 412212 - protein, 6 aa, Mycobacterium
AAQAAQ

SEQ ID NO: 412213 - protein, 19 aa, Mycobacterium
AAQAAQAATQATAAATAYE

SEQ ID NO: 412214 - protein, 14 aa, Mycobacterium
AAQAAQTAAQATQA

SEQ ID NO: 412215 - protein, 11 aa, Mycobacterium
AAQAAQTAEQA

SEQ ID NO: 412216 - protein, 7 aa, Mycobacterium
AAQAARA

SEQ ID NO: 412217 - protein, 11 aa, Mycobacterium
AAQAASTTPEK

SEQ ID NO: 412218 - protein, 19 aa, Mycobacterium
AAQAATRAATNATDGPASE

SEQ ID NO: 412219 - protein, 12 aa, Mycobacterium
AAQADGAGPPTA

SEQ ID NO: 412220 - protein, 10 aa, Mycobacterium
AAQADKRPGR

SEQ ID NO: 412221 - protein, 10 aa, Mycobacterium
AAQADLSRPG

SEQ ID NO: 412222 - protein, 9 aa, Mycobacterium
AAQADVEGK

SEQ ID NO: 412223 - protein, 5 aa, Mycobacterium
AAQAE

SEQ ID NO: 412224 - protein, 19 aa, Mycobacterium
AAQAEEAAAQAQAAAAAYE

SEQ ID NO: 412225 - protein, 12 aa, Mycobacterium
AAQAEEVSHQAS

SEQ ID NO: 412226 - protein, 17 aa, Mycobacterium
AAQAELAAGQAKAAAAA

SEQ ID NO: 412227 - protein, 8 aa, Mycobacterium
AAQAEPSF

SEQ ID NO: 412228 - protein, 7 aa, Mycobacterium
AAQAEPT

SEQ ID NO: 412229 - protein, 11 aa, Mycobacterium
AAQAEQAAAQA

SEQ ID NO: 412230 - protein, 20 aa, Mycobacterium
AAQAEQAAAQAISAANAYES

SEQ ID NO: 412231 - protein, 15 aa, Mycobacterium
AAQAEQAAAQASTAV

SEQ ID NO: 412232 - protein, 19 aa, Mycobacterium
AAQAEQAATSARAAAGAYE

SEQ ID NO: 412233 - protein, 10 aa, Mycobacterium
AAQAEQAGMQ

SEQ ID NO: 412234 - protein, 19 aa, Mycobacterium
AAQAEQIANQARAAAAAYE

SEQ ID NO: 412235 - protein, 10 aa, Mycobacterium
AAQAEQTANQ

SEQ ID NO: 412236 - protein, 12 aa, Mycobacterium
AAQAEQTASQAR

SEQ ID NO: 412237 - protein, 12 aa, Mycobacterium
AAQAEQTATQAR

SEQ ID NO: 412238 - protein, 18 aa, Mycobacterium
AAQAEQVGRQAAAAASAY

SEQ ID NO: 412239 - protein, 11 aa, Mycobacterium
AAQAEQVSTQA

SEQ ID NO: 412240 - protein, 8 aa, Mycobacterium
AAQAERAA

SEQ ID NO: 412241 - protein, 9 aa, Mycobacterium
AAQAETAGA

SEQ ID NO: 412242 - protein, 7 aa, Mycobacterium
AAQAFKN

SEQ ID NO: 412243 - protein, 11 aa, Mycobacterium
AAQAGADEAGA

SEQ ID NO: 412244 - protein, 11 aa, Mycobacterium
AAQAGATAMTD

SEQ ID NO: 412245 - protein, 13 aa, Mycobacterium
AAQAGAWEGPAAA

SEQ ID NO: 412246 - protein, 6 aa, Mycobacterium
AAQAGG

SEQ ID NO: 412247 - protein, 10 aa, Mycobacterium
AAQAGPDQEA

SEQ ID NO: 412248 - protein, 10 aa, Mycobacterium
AAQAGQAATQ

SEQ ID NO: 412249 - protein, 14 aa, Mycobacterium
AAQAGRQAGPEGSI

SEQ ID NO: 412250 - protein, 6 aa, Mycobacterium
AAQAGT

SEQ ID NO: 412251 - protein, 7 aa, Mycobacterium
AAQAHPD

SEQ ID NO: 412252 - protein, 10 aa, Mycobacterium
AAQAKGVPNG

SEQ ID NO: 412253 - protein, 7 aa, Mycobacterium
AAQAKQP

SEQ ID NO: 412254 - protein, 8 aa, Mycobacterium
AAQALASP

SEQ ID NO: 412255 - protein, 7 aa, Mycobacterium
AAQAPAL

SEQ ID NO: 412256 - protein, 8 aa, Mycobacterium
AAQAPAPP

SEQ ID NO: 412257 - protein, 6 aa, Mycobacterium
AAQAPD

SEQ ID NO: 412258 - protein, 14 aa, Mycobacterium
AAQAPVEKDLTGGL

SEQ ID NO: 412259 - protein, 15 aa, Mycobacterium
AAQAQQTATQARAAA

SEQ ID NO: 412260 - protein, 16 aa, Mycobacterium
AAQARAAVAERRQPVT

SEQ ID NO: 412261 - protein, 6 aa, Mycobacterium
AAQARD

SEQ ID NO: 412262 - protein, 7 aa, Mycobacterium
AAQAREE

SEQ ID NO: 412263 - protein, 15 aa, Mycobacterium
AAQARGGSHEAAAGK

SEQ ID NO: 412264 - protein, 15 aa, Mycobacterium
AAQARGGSHESAAGK

SEQ ID NO: 412265 - protein, 15 aa, Mycobacterium
AAQARGVTADPSNDR

SEQ ID NO: 412266 - protein, 5 aa, Mycobacterium
AAQAS

SEQ ID NO: 412267 - protein, 7 aa, Mycobacterium
AAQASAA

SEQ ID NO: 412268 - protein, 9 aa, Mycobacterium
AAQASAERT

SEQ ID NO: 412269 - protein, 10 aa, Mycobacterium
AAQASEQSRS

SEQ ID NO: 412270 - protein, 17 aa, Mycobacterium
AAQASHDWAQAKRGELL

SEQ ID NO: 412271 - protein, 10 aa, Mycobacterium
AAQASLSTRQ

SEQ ID NO: 412272 - protein, 11 aa, Mycobacterium
AAQATAAATAY

SEQ ID NO: 412273 - protein, 17 aa, Mycobacterium
AAQATAQARAAAQPSRI

SEQ ID NO: 412274 - protein, 11 aa, Mycobacterium
AAQATDEQRRE

SEQ ID NO: 412275 - protein, 6 aa, Mycobacterium
AAQAVE

SEQ ID NO: 412276 - protein, 11 aa, Mycobacterium
AAQAVGAAGAA

SEQ ID NO: 412277 - protein, 4 aa, Mycobacterium
AAQD

SEQ ID NO: 412278 - protein, 26 aa, Mycobacterium
AAQDAAAIGTSLSTANAAAASSTTGV

SEQ ID NO: 412279 - protein, 15 aa, Mycobacterium
AAQDAADAATYLGAG

SEQ ID NO: 412280 - protein, 10 aa, Mycobacterium
AAQDADLPPG

SEQ ID NO: 412281 - protein, 6 aa, Mycobacterium
AAQDDR

SEQ ID NO: 412282 - protein, 6 aa, Mycobacterium
AAQDEA

SEQ ID NO: 412283 - protein, 5 aa, Mycobacterium
AAQDG

SEQ ID NO: 412284 - protein, 5 aa, Mycobacterium
AAQDN

SEQ ID NO: 412285 - protein, 10 aa, Mycobacterium
AAQDPGGWTS

SEQ ID NO: 412286 - protein, 9 aa, Mycobacterium
AAQDPQDNL

SEQ ID NO: 412287 - protein, 7 aa, Mycobacterium
AAQDPQL

SEQ ID NO: 412288 - protein, 9 aa, Mycobacterium
AAQDPRGLG

SEQ ID NO: 412289 - protein, 8 aa, Mycobacterium
AAQEAAGD

SEQ ID NO: 412290 - protein, 6 aa, Mycobacterium
AAQEAC

SEQ ID NO: 412291 - protein, 10 aa, Mycobacterium
AAQEALSKAA

SEQ ID NO: 412292 - protein, 6 aa, Mycobacterium
AAQEEL

SEQ ID NO: 412293 - protein, 11 aa, Mycobacterium
AAQEELRRAGE

SEQ ID NO: 412294 - protein, 8 aa, Mycobacterium
AAQEEMAR

SEQ ID NO: 412295 - protein, 7 aa, Mycobacterium
AAQEGVD

SEQ ID NO: 412296 - protein, 15 aa, Mycobacterium
AAQESLRAKPASRDQ

SEQ ID NO: 412297 - protein, 8 aa, Mycobacterium
AAQESSGA

SEQ ID NO: 412298 - protein, 7 aa, Mycobacterium
AAQETGS

SEQ ID NO: 412299 - protein, 9 aa, Mycobacterium
AAQETSAPS

SEQ ID NO: 412300 - protein, 7 aa, Mycobacterium
AAQETYD

SEQ ID NO: 412301 - protein, 10 aa, Mycobacterium
AAQGAEADIG

SEQ ID NO: 412302 - protein, 11 aa, Mycobacterium
AAQGAGRPAPR

SEQ ID NO: 412303 - protein, 11 aa, Mycobacterium
AAQGAGTVRPD

SEQ ID NO: 412304 - protein, 7 aa, Mycobacterium
AAQGEKP

SEQ ID NO: 412305 - protein, 8 aa, Mycobacterium
AAQGEKPF

SEQ ID NO: 412306 - protein, 7 aa, Mycobacterium
AAQGEKR

SEQ ID NO: 412307 - protein, 16 aa, Mycobacterium
AAQGGESQFASGPAAH

SEQ ID NO: 412308 - protein, 6 aa, Mycobacterium
AAQGGS

SEQ ID NO: 412309 - protein, 11 aa, Mycobacterium
AAQGGVDRDQV

SEQ ID NO: 412310 - protein, 9 aa, Mycobacterium
AAQGGVTHE

SEQ ID NO: 412311 - protein, 8 aa, Mycobacterium
AAQGLPAY

SEQ ID NO: 412312 - protein, 54 aa, Mycobacterium
AAQGPAPTRQESKDRRVAGRTRATATPAWPRPPDTAEPCDEEPPPGGDEDADDI

SEQ ID NO: 412313 - protein, 6 aa, Mycobacterium
AAQGPL

SEQ ID NO: 412314 - protein, 7 aa, Mycobacterium
AAQGPRR

SEQ ID NO: 412315 - protein, 9 aa, Mycobacterium
AAQGPSVKL

SEQ ID NO: 412316 - protein, 12 aa, Mycobacterium
AAQGQGSSTITG

SEQ ID NO: 412317 - protein, 8 aa, Mycobacterium
AAQGQGTY

SEQ ID NO: 412318 - protein, 13 aa, Mycobacterium
AAQGQPDGPGADL

SEQ ID NO: 412319 - protein, 8 aa, Mycobacterium
AAQGRDQY

SEQ ID NO: 412320 - protein, 8 aa, Mycobacterium
AAQGRDRQ

SEQ ID NO: 412321 - protein, 9 aa, Mycobacterium
AAQGSGADQ

SEQ ID NO: 412322 - protein, 5 aa, Mycobacterium
AAQGT

SEQ ID NO: 412323 - protein, 6 aa, Mycobacterium
AAQGTE

SEQ ID NO: 412324 - protein, 8 aa, Mycobacterium
AAQGTGPW

SEQ ID NO: 412325 - protein, 8 aa, Mycobacterium
AAQGTTGP

SEQ ID NO: 412326 - protein, 8 aa, Mycobacterium
AAQGVGKG

SEQ ID NO: 412327 - protein, 11 aa, Mycobacterium
AAQGVGKGTAA

SEQ ID NO: 412328 - protein, 5 aa, Mycobacterium
AAQHA

SEQ ID NO: 412329 - protein, 9 aa, Mycobacterium
AAQHANKPA

SEQ ID NO: 412330 - protein, 7 aa, Mycobacterium
AAQHDPE

SEQ ID NO: 412331 - protein, 7 aa, Mycobacterium
AAQHGAG

SEQ ID NO: 412332 - protein, 8 aa, Mycobacterium
AAQHGQNG

SEQ ID NO: 412333 - protein, 8 aa, Mycobacterium
AAQHGVPT

SEQ ID NO: 412334 - protein, 8 aa, Mycobacterium
AAQHPDKV

SEQ ID NO: 412335 - protein, 12 aa, Mycobacterium
AAQHTPEAFDSE

SEQ ID NO: 412336 - protein, 4 aa, Mycobacterium
AAQI

SEQ ID NO: 412337 - protein, 12 aa, Mycobacterium
AAQITGGPNAPV

SEQ ID NO: 412338 - protein, 6 aa, Mycobacterium
AAQKAF

SEQ ID NO: 412339 - protein, 9 aa, Mycobacterium
AAQKAGADA

SEQ ID NO: 412340 - protein, 6 aa, Mycobacterium
AAQKGQ

SEQ ID NO: 412341 - protein, 17 aa, Mycobacterium
AAQKTPGDGATKRTPKI

SEQ ID NO: 412342 - protein, 6 aa, Mycobacterium
AAQLDG

SEQ ID NO: 412343 - protein, 15 aa, Mycobacterium
AAQLGDAVSKRAPEA

SEQ ID NO: 412344 - protein, 8 aa, Mycobacterium
AAQLGTPG

SEQ ID NO: 412345 - protein, 7 aa, Mycobacterium
AAQLGTS

SEQ ID NO: 412346 - protein, 20 aa, Mycobacterium
AAQLRSGTDLKSMRERATAM

SEQ ID NO: 412347 - protein, 4 aa, Mycobacterium
AAQN

SEQ ID NO: 412348 - protein, 12 aa, Mycobacterium
AAQNAGAASATT

SEQ ID NO: 412349 - protein, 7 aa, Mycobacterium
AAQNARQ

SEQ ID NO: 412350 - protein, 10 aa, Mycobacterium
AAQNDDEDLR

SEQ ID NO: 412351 - protein, 8 aa, Mycobacterium
AAQNDQAA

SEQ ID NO: 412352 - protein, 6 aa, Mycobacterium
AAQNDR

SEQ ID NO: 412353 - protein, 9 aa, Mycobacterium
AAQNEDQQL

SEQ ID NO: 412354 - protein, 9 aa, Mycobacterium
AAQNEPEGL

SEQ ID NO: 412355 - protein, 5 aa, Mycobacterium
AAQNP

SEQ ID NO: 412356 - protein, 8 aa, Mycobacterium
AAQNRAPA

SEQ ID NO: 412357 - protein, 15 aa, Mycobacterium
AAQPAAAQPIPDGPA

SEQ ID NO: 412358 - protein, 9 aa, Mycobacterium
AAQPAAVPR

SEQ ID NO: 412359 - protein, 7 aa, Mycobacterium
AAQPAMS

SEQ ID NO: 412360 - protein, 7 aa, Mycobacterium
AAQPATV

SEQ ID NO: 412361 - protein, 10 aa, Mycobacterium
AAQPDGPSIL

SEQ ID NO: 412362 - protein, 15 aa, Mycobacterium
AAQPEDTYATAGQLS

SEQ ID NO: 412363 - protein, 7 aa, Mycobacterium
AAQPEIV

SEQ ID NO: 412364 - protein, 6 aa, Mycobacterium
AAQPGG

SEQ ID NO: 412365 - protein, 13 aa, Mycobacterium
AAQPGGEVVQPEQ

SEQ ID NO: 412366 - protein, 8 aa, Mycobacterium
AAQPGSDH

SEQ ID NO: 412367 - protein, 11 aa, Mycobacterium
AAQPGSKKSIG

SEQ ID NO: 412368 - protein, 13 aa, Mycobacterium
AAQPISAGWSGTE

SEQ ID NO: 412369 - protein, 12 aa, Mycobacterium
AAQPKASTPASP

SEQ ID NO: 412370 - protein, 6 aa, Mycobacterium
AAQPLA

SEQ ID NO: 412371 - protein, 8 aa, Mycobacterium
AAQPPELA

SEQ ID NO: 412372 - protein, 18 aa, Mycobacterium
AAQPPGSVAGEEGEEHAP

SEQ ID NO: 412373 - protein, 8 aa, Mycobacterium
AAQPPKTL

SEQ ID NO: 412374 - protein, 8 aa, Mycobacterium
AAQPPQLG

SEQ ID NO: 412375 - protein, 12 aa, Mycobacterium
AAQPQQGADPID

SEQ ID NO: 412376 - protein, 6 aa, Mycobacterium
AAQPRT

SEQ ID NO: 412377 - protein, 9 aa, Mycobacterium
AAQPSGYTE

SEQ ID NO: 412378 - protein, 9 aa, Mycobacterium
AAQPVDPGA

SEQ ID NO: 412379 - protein, 8 aa, Mycobacterium
AAQPVRPG

SEQ ID NO: 412380 - protein, 4 aa, Mycobacterium
AAQQ

SEQ ID NO: 412381 - protein, 22 aa, Mycobacterium
AAQQAAEKKHSEDAAAAEQARA

SEQ ID NO: 412382 - protein, 7 aa, Mycobacterium
AAQQAAT

SEQ ID NO: 412383 - protein, 8 aa, Mycobacterium
AAQQARDA

SEQ ID NO: 412384 - protein, 7 aa, Mycobacterium
AAQQDRL

SEQ ID NO: 412385 - protein, 9 aa, Mycobacterium
AAQQESGGK

SEQ ID NO: 412386 - protein, 6 aa, Mycobacterium
AAQQGV

SEQ ID NO: 412387 - protein, 7 aa, Mycobacterium
AAQQHEE

SEQ ID NO: 412388 - protein, 12 aa, Mycobacterium
AAQQLNKPDQGV

SEQ ID NO: 412389 - protein, 8 aa, Mycobacterium
AAQQLTEK

SEQ ID NO: 412390 - protein, 53 aa, Mycobacterium
AAQQQAAAQQQQAATEQQPPAQQQPPAQQEPPQPNARRSAPGSAMQQLRTITG

SEQ ID NO: 412391 - protein, 19 aa, Mycobacterium
AAQQQGASTISGALRSRDT

SEQ ID NO: 412392 - protein, 8 aa, Mycobacterium
AAQQQSED

SEQ ID NO: 412393 - protein, 9 aa, Mycobacterium
AAQQQSNGR

SEQ ID NO: 412394 - protein, 6 aa, Mycobacterium
AAQQSV

SEQ ID NO: 412395 - protein, 15 aa, Mycobacterium
AAQQSVTEAMPDSPA

SEQ ID NO: 412396 - protein, 6 aa, Mycobacterium
AAQQTA

SEQ ID NO: 412397 - protein, 5 aa, Mycobacterium
AAQRA

SEQ ID NO: 412398 - protein, 14 aa, Mycobacterium
AAQRAAETLQPPAR

SEQ ID NO: 412399 - protein, 6 aa, Mycobacterium
AAQRAE

SEQ ID NO: 412400 - protein, 9 aa, Mycobacterium
AAQRAEEGE

SEQ ID NO: 412401 - protein, 11 aa, Mycobacterium
AAQRAHEGEVP

SEQ ID NO: 412402 - protein, 19 aa, Mycobacterium
AAQRARRYDAATHMWRLWS

SEQ ID NO: 412403 - protein, 29 aa, Mycobacterium
AAQRARSRAEADPGRARDSYERDDELQRR

SEQ ID NO: 412404 - protein, 9 aa, Mycobacterium
AAQRASGHL

SEQ ID NO: 412405 - protein, 10 aa, Mycobacterium
AAQRATEGEI

SEQ ID NO: 412406 - protein, 9 aa, Mycobacterium
AAQRCPDRP

SEQ ID NO: 412407 - protein, 10 aa, Mycobacterium
AAQRDDPREG

SEQ ID NO: 412408 - protein, 18 aa, Mycobacterium
AAQRDGEVDAGIDTEATT

SEQ ID NO: 412409 - protein, 9 aa, Mycobacterium
AAQRDHDQA

SEQ ID NO: 412410 - protein, 8 aa, Mycobacterium
AAQRDPDV

SEQ ID NO: 412411 - protein, 12 aa, Mycobacterium
AAQREAQSAFGD

SEQ ID NO: 412412 - protein, 6 aa, Mycobacterium
AAQREG

SEQ ID NO: 412413 - protein, 7 aa, Mycobacterium
AAQREGA

SEQ ID NO: 412414 - protein, 7 aa, Mycobacterium
AAQRGRH

SEQ ID NO: 412415 - protein, 9 aa, Mycobacterium
AAQRGRQAY

SEQ ID NO: 412416 - protein, 8 aa, Mycobacterium
AAQRGTYP

SEQ ID NO: 412417 - protein, 6 aa, Mycobacterium
AAQRGV

SEQ ID NO: 412418 - protein, 5 aa, Mycobacterium
AAQRH

SEQ ID NO: 412419 - protein, 11 aa, Mycobacterium
AAQRKAAPLPV

SEQ ID NO: 412420 - protein, 11 aa, Mycobacterium
AAQRKSHTSGE

SEQ ID NO: 412421 - protein, 5 aa, Mycobacterium
AAQRL

SEQ ID NO: 412422 - protein, 5 aa, Mycobacterium
AAQRP

SEQ ID NO: 412423 - protein, 5 aa, Mycobacterium
AAQRQ

SEQ ID NO: 412424 - protein, 10 aa, Mycobacterium
AAQRQAGEYE

SEQ ID NO: 412425 - protein, 6 aa, Mycobacterium
AAQRQV

SEQ ID NO: 412426 - protein, 11 aa, Mycobacterium
AAQRRDEDDIE

SEQ ID NO: 412427 - protein, 6 aa, Mycobacterium
AAQRRG

SEQ ID NO: 412428 - protein, 9 aa, Mycobacterium
AAQRRRSDR

SEQ ID NO: 412429 - protein, 9 aa, Mycobacterium
AAQRSRDDL

SEQ ID NO: 412430 - protein, 9 aa, Mycobacterium
AAQRSSERR

SEQ ID NO: 412431 - protein, 15 aa, Mycobacterium
AAQRSWAATTPQQRS

SEQ ID NO: 412432 - protein, 9 aa, Mycobacterium
AAQRTPYRT

SEQ ID NO: 412433 - protein, 5 aa, Mycobacterium
AAQRV

SEQ ID NO: 412434 - protein, 11 aa, Mycobacterium
AAQRVSDAARE

SEQ ID NO: 412435 - protein, 16 aa, Mycobacterium
AAQRVTDGLRAEGATA

SEQ ID NO: 412436 - protein, 11 aa, Mycobacterium
AAQRYSGSADW

SEQ ID NO: 412437 - protein, 11 aa, Mycobacterium
AAQRYSGTADW

SEQ ID NO: 412438 - protein, 7 aa, Mycobacterium
AAQSADI

SEQ ID NO: 412439 - protein, 6 aa, Mycobacterium
AAQSAL

SEQ ID NO: 412440 - protein, 8 aa, Mycobacterium
AAQSATIT

SEQ ID NO: 412441 - protein, 5 aa, Mycobacterium
AAQSD

SEQ ID NO: 412442 - protein, 7 aa, Mycobacterium
AAQSDSG

SEQ ID NO: 412443 - protein, 7 aa, Mycobacterium
AAQSDWS

SEQ ID NO: 412444 - protein, 10 aa, Mycobacterium
AAQSEATGAG

SEQ ID NO: 412445 - protein, 5 aa, Mycobacterium
AAQSG

SEQ ID NO: 412446 - protein, 7 aa, Mycobacterium
AAQSGAT

SEQ ID NO: 412447 - protein, 36 aa, Mycobacterium
AAQSGDGDTDATSQPAAVSALSDDDLGSSAQRERRK

SEQ ID NO: 412448 - protein, 24 aa, Mycobacterium
AAQSGTGGRQRSGGGGSLSESVPM

SEQ ID NO: 412449 - protein, 13 aa, Mycobacterium
AAQSHEQEPPPAE

SEQ ID NO: 412450 - protein, 5 aa, Mycobacterium
AAQSI

SEQ ID NO: 412451 - protein, 6 aa, Mycobacterium
AAQSPT

SEQ ID NO: 412452 - protein, 7 aa, Mycobacterium
AAQSRGA

SEQ ID NO: 412453 - protein, 8 aa, Mycobacterium
AAQSSGVR

SEQ ID NO: 412454 - protein, 5 aa, Mycobacterium
AAQSV

SEQ ID NO: 412455 - protein, 4 aa, Mycobacterium
AAQT

SEQ ID NO: 412456 - protein, 6 aa, Mycobacterium
AAQTAA

SEQ ID NO: 412457 - protein, 15 aa, Mycobacterium
AAQTAAASAAGVSDP

SEQ ID NO: 412458 - protein, 7 aa, Mycobacterium
AAQTAVG

SEQ ID NO: 412459 - protein, 11 aa, Mycobacterium
AAQTEDHAQLP

SEQ ID NO: 412460 - protein, 8 aa, Mycobacterium
AAQTEKAM

SEQ ID NO: 412461 - protein, 5 aa, Mycobacterium
AAQTG

SEQ ID NO: 412462 - protein, 6 aa, Mycobacterium
AAQTGG

SEQ ID NO: 412463 - protein, 9 aa, Mycobacterium
AAQTGLTDF

SEQ ID NO: 412464 - protein, 10 aa, Mycobacterium
AAQTGVSDDE

SEQ ID NO: 412465 - protein, 20 aa, Mycobacterium
AAQTIAGAATAQAQLVGAFG

SEQ ID NO: 412466 - protein, 17 aa, Mycobacterium
AAQTLRPGLPDDPDSFY

SEQ ID NO: 412467 - protein, 6 aa, Mycobacterium
AAQTPD

SEQ ID NO: 412468 - protein, 9 aa, Mycobacterium
AAQTPGWDE

SEQ ID NO: 412469 - protein, 10 aa, Mycobacterium
AAQTPSPVRR

SEQ ID NO: 412470 - protein, 6 aa, Mycobacterium
AAQTRA

SEQ ID NO: 412471 - protein, 10 aa, Mycobacterium
AAQTSTADFG

SEQ ID NO: 412472 - protein, 10 aa, Mycobacterium
AAQTSTSDTL

SEQ ID NO: 412473 - protein, 12 aa, Mycobacterium
AAQTTSKTRRDL

SEQ ID NO: 412474 - protein, 6 aa, Mycobacterium
AAQTTT

SEQ ID NO: 412475 - protein, 5 aa, Mycobacterium
AAQTV

SEQ ID NO: 412476 - protein, 6 aa, Mycobacterium
AAQTVD

SEQ ID NO: 412477 - protein, 8 aa, Mycobacterium
AAQTVPAG

SEQ ID NO: 412478 - protein, 7 aa, Mycobacterium
AAQTVRA

SEQ ID NO: 412479 - protein, 4 aa, Mycobacterium
AAQV

SEQ ID NO: 412480 - protein, 8 aa, Mycobacterium
AAQVDEDH

SEQ ID NO: 412481 - protein, 18 aa, Mycobacterium
AAQVDPQNQGVDEKADDI

SEQ ID NO: 412482 - protein, 9 aa, Mycobacterium
AAQVGSGVG

SEQ ID NO: 412483 - protein, 28 aa, Mycobacterium
AAQVPGGPGGPAGSDRAPAPTAAPRAEQ

SEQ ID NO: 412484 - protein, 6 aa, Mycobacterium
AAQVRG

SEQ ID NO: 412485 - protein, 5 aa, Mycobacterium
AAQWS

SEQ ID NO: 412486 - protein, 6 aa, Mycobacterium
AAQYAR

SEQ ID NO: 412487 - protein, 7 aa, Mycobacterium
AAQYSGE

SEQ ID NO: 412488 - protein, 6 aa, Mycobacterium
AARAAA

SEQ ID NO: 412489 - protein, 14 aa, Mycobacterium
AARAAADGGTPGKC

SEQ ID NO: 412490 - protein, 16 aa, Mycobacterium
AARAAAPGSRERQSLA

SEQ ID NO: 412491 - protein, 58 aa, Mycobacterium
AARAADAAIPAASAGAADAAGAASPAEATVADQPPAMAASPAGAAHSADTAGRSHGTV

SEQ ID NO: 412492 - protein, 14 aa, Mycobacterium
AARAADDPRAVAEQ

SEQ ID NO: 412493 - protein, 14 aa, Mycobacterium
AARAAGAAAQARAA

SEQ ID NO: 412494 - protein, 11 aa, Mycobacterium
AARAAGAAGQA

SEQ ID NO: 412495 - protein, 13 aa, Mycobacterium
AARAAGAAGQAQA

SEQ ID NO: 412496 - protein, 9 aa, Mycobacterium
AARAAGHGG

SEQ ID NO: 412497 - protein, 35 aa, Mycobacterium
AARAAGLTRDTPDPKGAKYGRDANGDLDGTAEESA

SEQ ID NO: 412498 - protein, 18 aa, Mycobacterium
AARAAGPAWASSTPVDRS

SEQ ID NO: 412499 - protein, 31 aa, Mycobacterium
AARAAGTTSPAGAAGTSGARDRSGAALTGPA

SEQ ID NO: 412500 - protein, 6 aa, Mycobacterium
AARAAL

SEQ ID NO: 412501 - protein, 19 aa, Mycobacterium
AARAALDSGPWGKADPAER

SEQ ID NO: 412502 - protein, 8 aa, Mycobacterium
AARAARPD

SEQ ID NO: 412503 - protein, 13 aa, Mycobacterium
AARAASSGGGLRR

SEQ ID NO: 412504 - protein, 10 aa, Mycobacterium
AARAATTGPI

SEQ ID NO: 412505 - protein, 16 aa, Mycobacterium
AARAAVDAARASESGE

SEQ ID NO: 412506 - protein, 16 aa, Mycobacterium
AARADALQSARGADQD

SEQ ID NO: 412507 - protein, 8 aa, Mycobacterium
AARADRLG

SEQ ID NO: 412508 - protein, 15 aa, Mycobacterium
AARAEAGQQAADERI

SEQ ID NO: 412509 - protein, 6 aa, Mycobacterium
AARAEE

SEQ ID NO: 412510 - protein, 10 aa, Mycobacterium
AARAELAGRG

SEQ ID NO: 412511 - protein, 9 aa, Mycobacterium
AARAENRAA

SEQ ID NO: 412512 - protein, 32 aa, Mycobacterium
AARAEPAEYEQLGRDADAYATYTSGTTGPPKA

SEQ ID NO: 412513 - protein, 8 aa, Mycobacterium
AARAERDL

SEQ ID NO: 412514 - protein, 12 aa, Mycobacterium
AARAETQQARSS

SEQ ID NO: 412515 - protein, 13 aa, Mycobacterium
AARAGAAADKPVG

SEQ ID NO: 412516 - protein, 10 aa, Mycobacterium
AARAGAAGDL

SEQ ID NO: 412517 - protein, 9 aa, Mycobacterium
AARAGARRR

SEQ ID NO: 412518 - protein, 17 aa, Mycobacterium
AARAGASVAGAAAHGAT

SEQ ID NO: 412519 - protein, 9 aa, Mycobacterium
AARAGDDWN

SEQ ID NO: 412520 - protein, 12 aa, Mycobacterium
AARAGDDYGATK

SEQ ID NO: 412521 - protein, 11 aa, Mycobacterium
AARAGDKKQRV

SEQ ID NO: 412522 - protein, 9 aa, Mycobacterium
AARAGDSND

SEQ ID NO: 412523 - protein, 8 aa, Mycobacterium
AARAGELR

SEQ ID NO: 412524 - protein, 7 aa, Mycobacterium
AARAGEP

SEQ ID NO: 412525 - protein, 8 aa, Mycobacterium
AARAGLPA

SEQ ID NO: 412526 - protein, 9 aa, Mycobacterium
AARAGNSND

SEQ ID NO: 412527 - protein, 21 aa, Mycobacterium
AARAGPAQQGRPGRDRRGAAG

SEQ ID NO: 412528 - protein, 10 aa, Mycobacterium
AARAGRAPSD

SEQ ID NO: 412529 - protein, 8 aa, Mycobacterium
AARAGRTH

SEQ ID NO: 412530 - protein, 13 aa, Mycobacterium
AARAGRTPTRGPV

SEQ ID NO: 412531 - protein, 8 aa, Mycobacterium
AARAGRYA

SEQ ID NO: 412532 - protein, 8 aa, Mycobacterium
AARAGSGE

SEQ ID NO: 412533 - protein, 9 aa, Mycobacterium
AARAGTNPG

SEQ ID NO: 412534 - protein, 7 aa, Mycobacterium
AARAHES

SEQ ID NO: 412535 - protein, 7 aa, Mycobacterium
AARAHNA

SEQ ID NO: 412536 - protein, 5 aa, Mycobacterium
AARAK

SEQ ID NO: 412537 - protein, 7 aa, Mycobacterium
AARAKYG

SEQ ID NO: 412538 - protein, 14 aa, Mycobacterium
AARALNQTGGYAGG

SEQ ID NO: 412539 - protein, 5 aa, Mycobacterium
AARAN

SEQ ID NO: 412540 - protein, 13 aa, Mycobacterium
AARANGGEPDAGR

SEQ ID NO: 412541 - protein, 7 aa, Mycobacterium
AARAPEA

SEQ ID NO: 412542 - protein, 7 aa, Mycobacterium
AARAPER

SEQ ID NO: 412543 - protein, 9 aa, Mycobacterium
AARAPERID

SEQ ID NO: 412544 - protein, 6 aa, Mycobacterium
AARAPF

SEQ ID NO: 412545 - protein, 10 aa, Mycobacterium
AARAPGGPAI

SEQ ID NO: 412546 - protein, 6 aa, Mycobacterium
AARAPR

SEQ ID NO: 412547 - protein, 5 aa, Mycobacterium
AARAQ

SEQ ID NO: 412548 - protein, 7 aa, Mycobacterium
AARAQDI

SEQ ID NO: 412549 - protein, 12 aa, Mycobacterium
AARAQEDGADDE

SEQ ID NO: 412550 - protein, 20 aa, Mycobacterium
AARAQGAHEAYTPQQTVDAG

SEQ ID NO: 412551 - protein, 9 aa, Mycobacterium
AARAQGRSH

SEQ ID NO: 412552 - protein, 12 aa, Mycobacterium
AARAQQRQLPEA

SEQ ID NO: 412553 - protein, 13 aa, Mycobacterium
AARAQQTASQLGS

SEQ ID NO: 412554 - protein, 5 aa, Mycobacterium
AARAR

SEQ ID NO: 412555 - protein, 12 aa, Mycobacterium
AARARAGDGPTL

SEQ ID NO: 412556 - protein, 7 aa, Mycobacterium
AARARDA

SEQ ID NO: 412557 - protein, 24 aa, Mycobacterium
AARARDASRAHHARSGRSGGNGSL

SEQ ID NO: 412558 - protein, 8 aa, Mycobacterium
AARARDEG

SEQ ID NO: 412559 - protein, 9 aa, Mycobacterium
AARARDEGL

SEQ ID NO: 412560 - protein, 8 aa, Mycobacterium
AARARDNG

SEQ ID NO: 412561 - protein, 7 aa, Mycobacterium
AARARDV

SEQ ID NO: 412562 - protein, 12 aa, Mycobacterium
AARARGRVGGRP

SEQ ID NO: 412563 - protein, 12 aa, Mycobacterium
AARARQSTRINA

SEQ ID NO: 412564 - protein, 7 aa, Mycobacterium
AARARSS

SEQ ID NO: 412565 - protein, 14 aa, Mycobacterium
AARASEKASAPALA

SEQ ID NO: 412566 - protein, 14 aa, Mycobacterium
AARASENGEPPALR

SEQ ID NO: 412567 - protein, 9 aa, Mycobacterium
AARASESGQ

SEQ ID NO: 412568 - protein, 8 aa, Mycobacterium
AARASETG

SEQ ID NO: 412569 - protein, 6 aa, Mycobacterium
AARASG

SEQ ID NO: 412570 - protein, 8 aa, Mycobacterium
AARASRTL

SEQ ID NO: 412571 - protein, 12 aa, Mycobacterium
AARASSSDDDPV

SEQ ID NO: 412572 - protein, 9 aa, Mycobacterium
AARASVTER

SEQ ID NO: 412573 - protein, 8 aa, Mycobacterium
AARATAAA

SEQ ID NO: 412574 - protein, 10 aa, Mycobacterium
AARATASADQ

SEQ ID NO: 412575 - protein, 8 aa, Mycobacterium
AARATELA

SEQ ID NO: 412576 - protein, 9 aa, Mycobacterium
AARATELAD

SEQ ID NO: 412577 - protein, 10 aa, Mycobacterium
AARATGMPYG

SEQ ID NO: 412578 - protein, 7 aa, Mycobacterium
AARATQP

SEQ ID NO: 412579 - protein, 6 aa, Mycobacterium
AARATT

SEQ ID NO: 412580 - protein, 13 aa, Mycobacterium
AARATTGDREEHR

SEQ ID NO: 412581 - protein, 12 aa, Mycobacterium
AARAYQEADAAG

SEQ ID NO: 412582 - protein, 8 aa, Mycobacterium
AARDAEGV

SEQ ID NO: 412583 - protein, 6 aa, Mycobacterium
AARDAG

SEQ ID NO: 412584 - protein, 9 aa, Mycobacterium
AARDAGADV

SEQ ID NO: 412585 - protein, 12 aa, Mycobacterium
AARDAGQNVYGE

SEQ ID NO: 412586 - protein, 11 aa, Mycobacterium
AARDAQASRSV

SEQ ID NO: 412587 - protein, 6 aa, Mycobacterium
AARDAR

SEQ ID NO: 412588 - protein, 7 aa, Mycobacterium
AARDDAA

SEQ ID NO: 412589 - protein, 7 aa, Mycobacterium
AARDDAT

SEQ ID NO: 412590 - protein, 8 aa, Mycobacterium
AARDDGGA

SEQ ID NO: 412591 - protein, 8 aa, Mycobacterium
AARDDSAA

SEQ ID NO: 412592 - protein, 5 aa, Mycobacterium
AARDE

SEQ ID NO: 412593 - protein, 7 aa, Mycobacterium
AARDEGH

SEQ ID NO: 412594 - protein, 5 aa, Mycobacterium
AARDG

SEQ ID NO: 412595 - protein, 6 aa, Mycobacterium
AARDGA

SEQ ID NO: 412596 - protein, 10 aa, Mycobacterium
AARDGDEAAA

SEQ ID NO: 412597 - protein, 6 aa, Mycobacterium
AARDGL

SEQ ID NO: 412598 - protein, 7 aa, Mycobacterium
AARDGLE

SEQ ID NO: 412599 - protein, 6 aa, Mycobacterium
AARDGQ

SEQ ID NO: 412600 - protein, 8 aa, Mycobacterium
AARDGTPA

SEQ ID NO: 412601 - protein, 16 aa, Mycobacterium
AARDIQTAVDTSGSTL

SEQ ID NO: 412602 - protein, 8 aa, Mycobacterium
AARDLAKP

SEQ ID NO: 412603 - protein, 8 aa, Mycobacterium
AARDNDRL

SEQ ID NO: 412604 - protein, 8 aa, Mycobacterium
AARDNSSR

SEQ ID NO: 412605 - protein, 7 aa, Mycobacterium
AARDPAA

SEQ ID NO: 412606 - protein, 5 aa, Mycobacterium
AARDR

SEQ ID NO: 412607 - protein, 12 aa, Mycobacterium
AARDRAQRQGSE

SEQ ID NO: 412608 - protein, 17 aa, Mycobacterium
AARDRARQQTDALPPEL

SEQ ID NO: 412609 - protein, 21 aa, Mycobacterium
AARDREHGRSRPYRPQTNGKV

SEQ ID NO: 412610 - protein, 6 aa, Mycobacterium
AARDRV

SEQ ID NO: 412611 - protein, 6 aa, Mycobacterium
AARDSL

SEQ ID NO: 412612 - protein, 5 aa, Mycobacterium
AARDT

SEQ ID NO: 412613 - protein, 7 aa, Mycobacterium
AARDTAR

SEQ ID NO: 412614 - protein, 8 aa, Mycobacterium
AARDTDRD

SEQ ID NO: 412615 - protein, 6 aa, Mycobacterium
AARDTE

SEQ ID NO: 412616 - protein, 10 aa, Mycobacterium
AARDTEKSTR

SEQ ID NO: 412617 - protein, 7 aa, Mycobacterium
AARDTEV

SEQ ID NO: 412618 - protein, 10 aa, Mycobacterium
AARDTFNRRR

SEQ ID NO: 412619 - protein, 8 aa, Mycobacterium
AARDTPDR

SEQ ID NO: 412620 - protein, 12 aa, Mycobacterium
AARDTQRPAPAA

SEQ ID NO: 412621 - protein, 7 aa, Mycobacterium
AARDTRI

SEQ ID NO: 412622 - protein, 6 aa, Mycobacterium
AARDVA

SEQ ID NO: 412623 - protein, 8 aa, Mycobacterium
AARDVSNR

SEQ ID NO: 412624 - protein, 10 aa, Mycobacterium
AAREAAPPMP

SEQ ID NO: 412625 - protein, 6 aa, Mycobacterium
AAREAF

SEQ ID NO: 412626 - protein, 6 aa, Mycobacterium
AAREAG

SEQ ID NO: 412627 - protein, 17 aa, Mycobacterium
AAREAPAVRAAPPPGCS

SEQ ID NO: 412628 - protein, 9 aa, Mycobacterium
AAREARAAG

SEQ ID NO: 412629 - protein, 10 aa, Mycobacterium
AAREASDTIA

SEQ ID NO: 412630 - protein, 8 aa, Mycobacterium
AAREDSPH

SEQ ID NO: 412631 - protein, 11 aa, Mycobacterium
AAREDVERTGA

SEQ ID NO: 412632 - protein, 17 aa, Mycobacterium
AAREDVPALETGERRRP

SEQ ID NO: 412633 - protein, 5 aa, Mycobacterium
AAREE

SEQ ID NO: 412634 - protein, 11 aa, Mycobacterium
AAREEAQAGAR

SEQ ID NO: 412635 - protein, 7 aa, Mycobacterium
AAREEER

SEQ ID NO: 412636 - protein, 6 aa, Mycobacterium
AAREEL

SEQ ID NO: 412637 - protein, 15 aa, Mycobacterium
AAREELRATETQVGE

SEQ ID NO: 412638 - protein, 7 aa, Mycobacterium
AAREELS

SEQ ID NO: 412639 - protein, 7 aa, Mycobacterium
AAREGAD

SEQ ID NO: 412640 - protein, 6 aa, Mycobacterium
AAREGI

SEQ ID NO: 412641 - protein, 10 aa, Mycobacterium
AAREGSDTIA

SEQ ID NO: 412642 - protein, 9 aa, Mycobacterium
AAREIDTST

SEQ ID NO: 412643 - protein, 17 aa, Mycobacterium
AARELGEETGLRVGSGE

SEQ ID NO: 412644 - protein, 17 aa, Mycobacterium
AAREPDPSAGLSARPDD

SEQ ID NO: 412645 - protein, 7 aa, Mycobacterium
AAREPGR

SEQ ID NO: 412646 - protein, 26 aa, Mycobacterium
AAREPNRQARQAGRAALAGPGRQAAQ

SEQ ID NO: 412647 - protein, 15 aa, Mycobacterium
AAREPWRRGLPATAA

SEQ ID NO: 412648 - protein, 8 aa, Mycobacterium
AAREQAEI

SEQ ID NO: 412649 - protein, 5 aa, Mycobacterium
AARER

SEQ ID NO: 412650 - protein, 6 aa, Mycobacterium
AARERG

SEQ ID NO: 412651 - protein, 12 aa, Mycobacterium
AARERHGQANSW

SEQ ID NO: 412652 - protein, 13 aa, Mycobacterium
AARESADAAGMPP

SEQ ID NO: 412653 - protein, 8 aa, Mycobacterium
AARESGSS

SEQ ID NO: 412654 - protein, 23 aa, Mycobacterium
AARESLTEGLRTSGSSAGQREPI

SEQ ID NO: 412655 - protein, 10 aa, Mycobacterium
AARETFNRRR

SEQ ID NO: 412656 - protein, 8 aa, Mycobacterium
AARETPPD

SEQ ID NO: 412657 - protein, 11 aa, Mycobacterium
AARETVRPSLD

SEQ ID NO: 412658 - protein, 24 aa, Mycobacterium
AARETVRPSLDPAQVESLRAFAKA

SEQ ID NO: 412659 - protein, 11 aa, Mycobacterium
AARGAAADAIA

SEQ ID NO: 412660 - protein, 10 aa, Mycobacterium
AARGAAEERW

SEQ ID NO: 412661 - protein, 10 aa, Mycobacterium
AARGAAERTD

SEQ ID NO: 412662 - protein, 8 aa, Mycobacterium
AARGAAGA

SEQ ID NO: 412663 - protein, 19 aa, Mycobacterium
AARGAAPRGPLNQRVSRSR

SEQ ID NO: 412664 - protein, 9 aa, Mycobacterium
AARGAERVA

SEQ ID NO: 412665 - protein, 18 aa, Mycobacterium
AARGAGLDDLAPDEVPIV

SEQ ID NO: 412666 - protein, 18 aa, Mycobacterium
AARGAGLGGLAGDEVPVG

SEQ ID NO: 412667 - protein, 10 aa, Mycobacterium
AARGAGPRDV

SEQ ID NO: 412668 - protein, 9 aa, Mycobacterium
AARGAIDRG

SEQ ID NO: 412669 - protein, 6 aa, Mycobacterium
AARGAL

SEQ ID NO: 412670 - protein, 11 aa, Mycobacterium
AARGASGTLDA

SEQ ID NO: 412671 - protein, 6 aa, Mycobacterium
AARGAT

SEQ ID NO: 412672 - protein, 7 aa, Mycobacterium
AARGATG

SEQ ID NO: 412673 - protein, 7 aa, Mycobacterium
AARGATP

SEQ ID NO: 412674 - protein, 5 aa, Mycobacterium
AARGD

SEQ ID NO: 412675 - protein, 11 aa, Mycobacterium
AARGDAEPARE

SEQ ID NO: 412676 - protein, 10 aa, Mycobacterium
AARGDAEPVR

SEQ ID NO: 412677 - protein, 9 aa, Mycobacterium
AARGDEPGF

SEQ ID NO: 412678 - protein, 6 aa, Mycobacterium
AARGDF

SEQ ID NO: 412679 - protein, 9 aa, Mycobacterium
AARGDGGAA

SEQ ID NO: 412680 - protein, 13 aa, Mycobacterium
AARGDHDGARTEL

SEQ ID NO: 412681 - protein, 10 aa, Mycobacterium
AARGDHDRAA

SEQ ID NO: 412682 - protein, 12 aa, Mycobacterium
AARGDSETGLGR

SEQ ID NO: 412683 - protein, 11 aa, Mycobacterium
AARGDVRPEVT

SEQ ID NO: 412684 - protein, 15 aa, Mycobacterium
AARGEAAYYDETKES

SEQ ID NO: 412685 - protein, 10 aa, Mycobacterium
AARGEDDTAA

SEQ ID NO: 412686 - protein, 8 aa, Mycobacterium
AARGEDPL

SEQ ID NO: 412687 - protein, 7 aa, Mycobacterium
AARGEKA

SEQ ID NO: 412688 - protein, 8 aa, Mycobacterium
AARGEVRD

SEQ ID NO: 412689 - protein, 11 aa, Mycobacterium
AARGEVRPDVT

SEQ ID NO: 412690 - protein, 16 aa, Mycobacterium
AARGFNPAAMGDPSEM

SEQ ID NO: 412691 - protein, 5 aa, Mycobacterium
AARGG

SEQ ID NO: 412692 - protein, 6 aa, Mycobacterium
AARGGA

SEQ ID NO: 412693 - protein, 9 aa, Mycobacterium
AARGGAAGF

SEQ ID NO: 412694 - protein, 8 aa, Mycobacterium
AARGGDII

SEQ ID NO: 412695 - protein, 8 aa, Mycobacterium
AARGGGVT

SEQ ID NO: 412696 - protein, 11 aa, Mycobacterium
AARGGNESARE

SEQ ID NO: 412697 - protein, 15 aa, Mycobacterium
AARGGRVAGAGPHSA

SEQ ID NO: 412698 - protein, 7 aa, Mycobacterium
AARGGSA

SEQ ID NO: 412699 - protein, 8 aa, Mycobacterium
AARGGSDP

SEQ ID NO: 412700 - protein, 9 aa, Mycobacterium
AARGGSGTV

SEQ ID NO: 412701 - protein, 6 aa, Mycobacterium
AARGGV

SEQ ID NO: 412702 - protein, 10 aa, Mycobacterium
AARGGVADPA

SEQ ID NO: 412703 - protein, 5 aa, Mycobacterium
AARGH

SEQ ID NO: 412704 - protein, 8 aa, Mycobacterium
AARGIGKG

SEQ ID NO: 412705 - protein, 6 aa, Mycobacterium
AARGIR

SEQ ID NO: 412706 - protein, 5 aa, Mycobacterium
AARGL

SEQ ID NO: 412707 - protein, 8 aa, Mycobacterium
AARGNGAM

SEQ ID NO: 412708 - protein, 5 aa, Mycobacterium
AARGP

SEQ ID NO: 412709 - protein, 8 aa, Mycobacterium
AARGPDDI

SEQ ID NO: 412710 - protein, 10 aa, Mycobacterium
AARGPETYFD

SEQ ID NO: 412711 - protein, 6 aa, Mycobacterium
AARGPF

SEQ ID NO: 412712 - protein, 10 aa, Mycobacterium
AARGPGRRRR

SEQ ID NO: 412713 - protein, 6 aa, Mycobacterium
AARGPL

SEQ ID NO: 412714 - protein, 9 aa, Mycobacterium
AARGQGRAE

SEQ ID NO: 412715 - protein, 8 aa, Mycobacterium
AARGQGRQ

SEQ ID NO: 412716 - protein, 8 aa, Mycobacterium
AARGQGSL

SEQ ID NO: 412717 - protein, 6 aa, Mycobacterium
AARGQV

SEQ ID NO: 412718 - protein, 13 aa, Mycobacterium
AARGRADDEDPIT

SEQ ID NO: 412719 - protein, 6 aa, Mycobacterium
AARGRD

SEQ ID NO: 412720 - protein, 18 aa, Mycobacterium
AARGRKQRRFPVSDGAPV

SEQ ID NO: 412721 - protein, 6 aa, Mycobacterium
AARGRP

SEQ ID NO: 412722 - protein, 10 aa, Mycobacterium
AARGRPAPTW

SEQ ID NO: 412723 - protein, 8 aa, Mycobacterium
AARGRPDD

SEQ ID NO: 412724 - protein, 29 aa, Mycobacterium
AARGRQADHRAAPMPTPSGTHSTTPASLR

SEQ ID NO: 412725 - protein, 6 aa, Mycobacterium
AARGRT

SEQ ID NO: 412726 - protein, 9 aa, Mycobacterium
AARGSATQV

SEQ ID NO: 412727 - protein, 13 aa, Mycobacterium
AARGSEDIQGARS

SEQ ID NO: 412728 - protein, 55 aa, Mycobacterium
AARGSGSAPAPTTGAPSAGGGGAAAAARPAANTPSVPAAAAAANIPGLPSGLPPG

SEQ ID NO: 412729 - protein, 6 aa, Mycobacterium
AARGSV

SEQ ID NO: 412730 - protein, 10 aa, Mycobacterium
AARGTADDIE

SEQ ID NO: 412731 - protein, 8 aa, Mycobacterium
AARGTQRL

SEQ ID NO: 412732 - protein, 11 aa, Mycobacterium
AARGTSQEGFD

SEQ ID NO: 412733 - protein, 7 aa, Mycobacterium
AARGVPA

SEQ ID NO: 412734 - protein, 12 aa, Mycobacterium
AARGVPDHTTEE

SEQ ID NO: 412735 - protein, 7 aa, Mycobacterium
AARHADP

SEQ ID NO: 412736 - protein, 6 aa, Mycobacterium
AARHGA

SEQ ID NO: 412737 - protein, 11 aa, Mycobacterium
AARHGAEITTG

SEQ ID NO: 412738 - protein, 20 aa, Mycobacterium
AARHGAGKASRHYSSATHTA

SEQ ID NO: 412739 - protein, 7 aa, Mycobacterium
AARHGDR

SEQ ID NO: 412740 - protein, 8 aa, Mycobacterium
AARHGERG

SEQ ID NO: 412741 - protein, 7 aa, Mycobacterium
AARHGRA

SEQ ID NO: 412742 - protein, 12 aa, Mycobacterium
AARHRAAELTGA

SEQ ID NO: 412743 - protein, 11 aa, Mycobacterium
AARHRPRDQDP

SEQ ID NO: 412744 - protein, 9 aa, Mycobacterium
AARHRTTRD

SEQ ID NO: 412745 - protein, 7 aa, Mycobacterium
AARHTGR

SEQ ID NO: 412746 - protein, 13 aa, Mycobacterium
AARIDTAAANPFR

SEQ ID NO: 412747 - protein, 8 aa, Mycobacterium
AARIGPAT

SEQ ID NO: 412748 - protein, 14 aa, Mycobacterium
AARITAGKQCEDQR

SEQ ID NO: 412749 - protein, 10 aa, Mycobacterium
AARITPEQAD

SEQ ID NO: 412750 - protein, 9 aa, Mycobacterium
AARKGGKVS

SEQ ID NO: 412751 - protein, 11 aa, Mycobacterium
AARKKPDAAQN

SEQ ID NO: 412752 - protein, 14 aa, Mycobacterium
AARKPPPRDKKSGR

SEQ ID NO: 412753 - protein, 27 aa, Mycobacterium
AARKPQSAAAHSLRTNGAGRIKGNPLD

SEQ ID NO: 412754 - protein, 11 aa, Mycobacterium
AARKPRERAEV

SEQ ID NO: 412755 - protein, 8 aa, Mycobacterium
AARKRGKR

SEQ ID NO: 412756 - protein, 12 aa, Mycobacterium
AARLDNTGQACN

SEQ ID NO: 412757 - protein, 5 aa, Mycobacterium
AARLG

SEQ ID NO: 412758 - protein, 8 aa, Mycobacterium
AARLGPAT

SEQ ID NO: 412759 - protein, 10 aa, Mycobacterium
AARLGRDPRS

SEQ ID NO: 412760 - protein, 7 aa, Mycobacterium
AARLQDE

SEQ ID NO: 412761 - protein, 10 aa, Mycobacterium
AARNADPGER

SEQ ID NO: 412762 - protein, 10 aa, Mycobacterium
AARNAGADAI

SEQ ID NO: 412763 - protein, 9 aa, Mycobacterium
AARNETRRY

SEQ ID NO: 412764 - protein, 8 aa, Mycobacterium
AARNGEQV

SEQ ID NO: 412765 - protein, 6 aa, Mycobacterium
AARNGL

SEQ ID NO: 412766 - protein, 6 aa, Mycobacterium
AARNGV

SEQ ID NO: 412767 - protein, 5 aa, Mycobacterium
AARNH

SEQ ID NO: 412768 - protein, 6 aa, Mycobacterium
AARNHG

SEQ ID NO: 412769 - protein, 6 aa, Mycobacterium
AARNLT

SEQ ID NO: 412770 - protein, 7 aa, Mycobacterium
AARNQGA

SEQ ID NO: 412771 - protein, 8 aa, Mycobacterium
AARNQRPD

SEQ ID NO: 412772 - protein, 5 aa, Mycobacterium
AARNR

SEQ ID NO: 412773 - protein, 6 aa, Mycobacterium
AARNRE

SEQ ID NO: 412774 - protein, 9 aa, Mycobacterium
AARNRVSGA

SEQ ID NO: 412775 - protein, 6 aa, Mycobacterium
AARNSK

SEQ ID NO: 412776 - protein, 9 aa, Mycobacterium
AARNTTQPT

SEQ ID NO: 412777 - protein, 14 aa, Mycobacterium
AARNVAEGAGQAGL

SEQ ID NO: 412778 - protein, 16 aa, Mycobacterium
AARNVPKVGADATRLP

SEQ ID NO: 412779 - protein, 7 aa, Mycobacterium
AARNVSG

SEQ ID NO: 412780 - protein, 8 aa, Mycobacterium
AARNYSGK

SEQ ID NO: 412781 - protein, 5 aa, Mycobacterium
AARPA

SEQ ID NO: 412782 - protein, 10 aa, Mycobacterium
AARPADGDDL

SEQ ID NO: 412783 - protein, 8 aa, Mycobacterium
AARPAGSA

SEQ ID NO: 412784 - protein, 6 aa, Mycobacterium
AARPAQ

SEQ ID NO: 412785 - protein, 8 aa, Mycobacterium
AARPASES

SEQ ID NO: 412786 - protein, 21 aa, Mycobacterium
AARPASKPASKPALSPSRAAD

SEQ ID NO: 412787 - protein, 12 aa, Mycobacterium
AARPAWKPRTLP

SEQ ID NO: 412788 - protein, 5 aa, Mycobacterium
AARPD

SEQ ID NO: 412789 - protein, 10 aa, Mycobacterium
AARPDAGLPD

SEQ ID NO: 412790 - protein, 27 aa, Mycobacterium
AARPDDSAPLTLPSGQTVHAGSSGTDV

SEQ ID NO: 412791 - protein, 8 aa, Mycobacterium
AARPDGEW

SEQ ID NO: 412792 - protein, 7 aa, Mycobacterium
AARPDLA

SEQ ID NO: 412793 - protein, 8 aa, Mycobacterium
AARPDLDK

SEQ ID NO: 412794 - protein, 7 aa, Mycobacterium
AARPEEI

SEQ ID NO: 412795 - protein, 6 aa, Mycobacterium
AARPEH

SEQ ID NO: 412796 - protein, 8 aa, Mycobacterium
AARPELAT

SEQ ID NO: 412797 - protein, 7 aa, Mycobacterium
AARPEPI

SEQ ID NO: 412798 - protein, 9 aa, Mycobacterium
AARPEPVKT

SEQ ID NO: 412799 - protein, 7 aa, Mycobacterium
AARPEVV

SEQ ID NO: 412800 - protein, 6 aa, Mycobacterium
AARPGA

SEQ ID NO: 412801 - protein, 7 aa, Mycobacterium
AARPGDA

SEQ ID NO: 412802 - protein, 8 aa, Mycobacterium
AARPGDAV

SEQ ID NO: 412803 - protein, 23 aa, Mycobacterium
AARPGDRPRAAGRRGAPAQAGAA

SEQ ID NO: 412804 - protein, 28 aa, Mycobacterium
AARPGEDWSGSQRFSGDDPLGMGEGAQA

SEQ ID NO: 412805 - protein, 29 aa, Mycobacterium
AARPGEDWTGSEEFSGDNPFGMGEGTQAL

SEQ ID NO: 412806 - protein, 28 aa, Mycobacterium
AARPGEDWTGSEQFSGDNPFGMGEGTQA

SEQ ID NO: 412807 - protein, 29 aa, Mycobacterium
AARPGEDWTGSEQFSGDNPFGMGEGTQAL

SEQ ID NO: 412808 - protein, 11 aa, Mycobacterium
AARPGPTHRDN

SEQ ID NO: 412809 - protein, 13 aa, Mycobacterium
AARPGPTNRDNRA

SEQ ID NO: 412810 - protein, 13 aa, Mycobacterium
AARPGPTQRDNRA

SEQ ID NO: 412811 - protein, 8 aa, Mycobacterium
AARPGQHI

SEQ ID NO: 412812 - protein, 13 aa, Mycobacterium
AARPGSLVSRSPD

SEQ ID NO: 412813 - protein, 6 aa, Mycobacterium
AARPGV

SEQ ID NO: 412814 - protein, 8 aa, Mycobacterium
AARPKALH

SEQ ID NO: 412815 - protein, 6 aa, Mycobacterium
AARPLE

SEQ ID NO: 412816 - protein, 7 aa, Mycobacterium
AARPNTK

SEQ ID NO: 412817 - protein, 6 aa, Mycobacterium
AARPPA

SEQ ID NO: 412818 - protein, 8 aa, Mycobacterium
AARPPGDV

SEQ ID NO: 412819 - protein, 39 aa, Mycobacterium
AARPPGTGHRDGGDGQHRHDEQHREQGLTAAGNPDTEVQ

SEQ ID NO: 412820 - protein, 10 aa, Mycobacterium
AARPQAAPRR

SEQ ID NO: 412821 - protein, 11 aa, Mycobacterium
AARPQPARDDK

SEQ ID NO: 412822 - protein, 9 aa, Mycobacterium
AARPQYTDP

SEQ ID NO: 412823 - protein, 6 aa, Mycobacterium
AARPRG

SEQ ID NO: 412824 - protein, 9 aa, Mycobacterium
AARPRRGSP

SEQ ID NO: 412825 - protein, 5 aa, Mycobacterium
AARPS

SEQ ID NO: 412826 - protein, 11 aa, Mycobacterium
AARPSGGDGAL

SEQ ID NO: 412827 - protein, 7 aa, Mycobacterium
AARPSTA

SEQ ID NO: 412828 - protein, 5 aa, Mycobacterium
AARPT

SEQ ID NO: 412829 - protein, 6 aa, Mycobacterium
AARPTD

SEQ ID NO: 412830 - protein, 6 aa, Mycobacterium
AARPVQ

SEQ ID NO: 412831 - protein, 4 aa, Mycobacterium
AARQ

SEQ ID NO: 412832 - protein, 5 aa, Mycobacterium
AARQA

SEQ ID NO: 412833 - protein, 10 aa, Mycobacterium
AARQAADKVA

SEQ ID NO: 412834 - protein, 8 aa, Mycobacterium
AARQAASY

SEQ ID NO: 412835 - protein, 14 aa, Mycobacterium
AARQAGRKPSRAAA

SEQ ID NO: 412836 - protein, 9 aa, Mycobacterium
AARQARSAG

SEQ ID NO: 412837 - protein, 8 aa, Mycobacterium
AARQDPAA

SEQ ID NO: 412838 - protein, 11 aa, Mycobacterium
AARQGIAPSGA

SEQ ID NO: 412839 - protein, 34 aa, Mycobacterium
AARQNKNPPVDAEPPNGPPPPARWSRRKPEAAAR

SEQ ID NO: 412840 - protein, 12 aa, Mycobacterium
AARQPDQGLPPG

SEQ ID NO: 412841 - protein, 7 aa, Mycobacterium
AARQPGL

SEQ ID NO: 412842 - protein, 12 aa, Mycobacterium
AARQRDPARPTT

SEQ ID NO: 412843 - protein, 10 aa, Mycobacterium
AARQRENAAS

SEQ ID NO: 412844 - protein, 6 aa, Mycobacterium
AARQRG

SEQ ID NO: 412845 - protein, 9 aa, Mycobacterium
AARQRRSAQ

SEQ ID NO: 412846 - protein, 6 aa, Mycobacterium
AARQRY

SEQ ID NO: 412847 - protein, 10 aa, Mycobacterium
AARQTASPIS

SEQ ID NO: 412848 - protein, 6 aa, Mycobacterium
AARQTG

SEQ ID NO: 412849 - protein, 6 aa, Mycobacterium
AARQVT

SEQ ID NO: 412850 - protein, 19 aa, Mycobacterium
AARRAARQARREGSRQPFD

SEQ ID NO: 412851 - protein, 7 aa, Mycobacterium
AARRADL

SEQ ID NO: 412852 - protein, 12 aa, Mycobacterium
AARRAFDNGPWP

SEQ ID NO: 412853 - protein, 9 aa, Mycobacterium
AARRAGAPL

SEQ ID NO: 412854 - protein, 7 aa, Mycobacterium
AARRAGR

SEQ ID NO: 412855 - protein, 6 aa, Mycobacterium
AARRAR

SEQ ID NO: 412856 - protein, 12 aa, Mycobacterium
AARRARSAARGL

SEQ ID NO: 412857 - protein, 7 aa, Mycobacterium
AARRARV

SEQ ID NO: 412858 - protein, 8 aa, Mycobacterium
AARRATRK

SEQ ID NO: 412859 - protein, 5 aa, Mycobacterium
AARRD

SEQ ID NO: 412860 - protein, 11 aa, Mycobacterium
AARRDGETDLD

SEQ ID NO: 412861 - protein, 6 aa, Mycobacterium
AARRDR

SEQ ID NO: 412862 - protein, 7 aa, Mycobacterium
AARRDYD

SEQ ID NO: 412863 - protein, 12 aa, Mycobacterium
AARREAQSAFGD

SEQ ID NO: 412864 - protein, 6 aa, Mycobacterium
AARREE

SEQ ID NO: 412865 - protein, 6 aa, Mycobacterium
AARRGA

SEQ ID NO: 412866 - protein, 7 aa, Mycobacterium
AARRGDT

SEQ ID NO: 412867 - protein, 9 aa, Mycobacterium
AARRGGADD

SEQ ID NO: 412868 - protein, 9 aa, Mycobacterium
AARRGGGAK

SEQ ID NO: 412869 - protein, 10 aa, Mycobacterium
AARRGGPEQL

SEQ ID NO: 412870 - protein, 6 aa, Mycobacterium
AARRGM

SEQ ID NO: 412871 - protein, 6 aa, Mycobacterium
AARRGV

SEQ ID NO: 412872 - protein, 6 aa, Mycobacterium
AARRHD

SEQ ID NO: 412873 - protein, 5 aa, Mycobacterium
AARRL

SEQ ID NO: 412874 - protein, 6 aa, Mycobacterium
AARRNG

SEQ ID NO: 412875 - protein, 8 aa, Mycobacterium
AARRNGAR

SEQ ID NO: 412876 - protein, 8 aa, Mycobacterium
AARRPETL

SEQ ID NO: 412877 - protein, 10 aa, Mycobacterium
AARRPQPIDT

SEQ ID NO: 412878 - protein, 17 aa, Mycobacterium
AARRPTLTAQQSGSGAV

SEQ ID NO: 412879 - protein, 9 aa, Mycobacterium
AARRQEDGW

SEQ ID NO: 412880 - protein, 9 aa, Mycobacterium
AARRQLAGQ

SEQ ID NO: 412881 - protein, 24 aa, Mycobacterium
AARRQRIDDERRKPMHGHPGTPEY

SEQ ID NO: 412882 - protein, 7 aa, Mycobacterium
AARRRDA

SEQ ID NO: 412883 - protein, 11 aa, Mycobacterium
AARRRKPGAGE

SEQ ID NO: 412884 - protein, 7 aa, Mycobacterium
AARRRPS

SEQ ID NO: 412885 - protein, 7 aa, Mycobacterium
AARRRTI

SEQ ID NO: 412886 - protein, 17 aa, Mycobacterium
AARRSKDDEIRQQGRLE

SEQ ID NO: 412887 - protein, 6 aa, Mycobacterium
AARRTA

SEQ ID NO: 412888 - protein, 22 aa, Mycobacterium
AARRTAEDAANWSGPGTTADGH

SEQ ID NO: 412889 - protein, 9 aa, Mycobacterium
AARRTAPDT

SEQ ID NO: 412890 - protein, 8 aa, Mycobacterium
AARRTDAE

SEQ ID NO: 412891 - protein, 12 aa, Mycobacterium
AARRTDAQAVHP

SEQ ID NO: 412892 - protein, 6 aa, Mycobacterium
AARRTG

SEQ ID NO: 412893 - protein, 13 aa, Mycobacterium
AARRTGGHPAKRT

SEQ ID NO: 412894 - protein, 12 aa, Mycobacterium
AARRTNTAQPQR

SEQ ID NO: 412895 - protein, 6 aa, Mycobacterium
AARRTT

SEQ ID NO: 412896 - protein, 7 aa, Mycobacterium
AARRTWP

SEQ ID NO: 412897 - protein, 16 aa, Mycobacterium
AARRYGPRAGAQKAYA

SEQ ID NO: 412898 - protein, 6 aa, Mycobacterium
AARSAA

SEQ ID NO: 412899 - protein, 10 aa, Mycobacterium
AARSADGSPL

SEQ ID NO: 412900 - protein, 10 aa, Mycobacterium
AARSAGAHPY

SEQ ID NO: 412901 - protein, 10 aa, Mycobacterium
AARSAGQRAE

SEQ ID NO: 412902 - protein, 14 aa, Mycobacterium
AARSAPERSGAAEV

SEQ ID NO: 412903 - protein, 82 aa, Mycobacterium
AARSAPGAGGRGNPMAPAPSQPSEPLREQDKATEHASAGPAGAAAGPRAGAAAPVGQKPSSAPIRPAAATTRAAAKTGPTIG

SEQ ID NO: 412904 - protein, 15 aa, Mycobacterium
AARSAPGTGRASWPG

SEQ ID NO: 412905 - protein, 14 aa, Mycobacterium
AARSAPRTLAASAG

SEQ ID NO: 412906 - protein, 11 aa, Mycobacterium
AARSAQASFDS

SEQ ID NO: 412907 - protein, 7 aa, Mycobacterium
AARSAQL

SEQ ID NO: 412908 - protein, 5 aa, Mycobacterium
AARSD

SEQ ID NO: 412909 - protein, 10 aa, Mycobacterium
AARSDDLADT

SEQ ID NO: 412910 - protein, 8 aa, Mycobacterium
AARSDSAR

SEQ ID NO: 412911 - protein, 5 aa, Mycobacterium
AARSG

SEQ ID NO: 412912 - protein, 12 aa, Mycobacterium
AARSGDDAPRPE

SEQ ID NO: 412913 - protein, 11 aa, Mycobacterium
AARSGENSARP

SEQ ID NO: 412914 - protein, 6 aa, Mycobacterium
AARSGG

SEQ ID NO: 412915 - protein, 19 aa, Mycobacterium
AARSGIPVAQNDNASALRR

SEQ ID NO: 412916 - protein, 13 aa, Mycobacterium
AARSGQKDAARDA

SEQ ID NO: 412917 - protein, 13 aa, Mycobacterium
AARSGRAPTRGPV

SEQ ID NO: 412918 - protein, 7 aa, Mycobacterium
AARSGRL

SEQ ID NO: 412919 - protein, 13 aa, Mycobacterium
AARSGRLPDRGPV

SEQ ID NO: 412920 - protein, 11 aa, Mycobacterium
AARSGRTPDRR

SEQ ID NO: 412921 - protein, 8 aa, Mycobacterium
AARSGVPQ

SEQ ID NO: 412922 - protein, 8 aa, Mycobacterium
AARSHGGY

SEQ ID NO: 412923 - protein, 6 aa, Mycobacterium
AARSKL

SEQ ID NO: 412924 - protein, 8 aa, Mycobacterium
AARSLGSA

SEQ ID NO: 412925 - protein, 7 aa, Mycobacterium
AARSMQK

SEQ ID NO: 412926 - protein, 7 aa, Mycobacterium
AARSMQR

SEQ ID NO: 412927 - protein, 8 aa, Mycobacterium
AARSNAAT

SEQ ID NO: 412928 - protein, 7 aa, Mycobacterium
AARSPDA

SEQ ID NO: 412929 - protein, 8 aa, Mycobacterium
AARSPDAA

SEQ ID NO: 412930 - protein, 9 aa, Mycobacterium
AARSPLATA

SEQ ID NO: 412931 - protein, 27 aa, Mycobacterium
AARSQQQEALSSSTRKGVLRGGGKRPA

SEQ ID NO: 412932 - protein, 5 aa, Mycobacterium
AARSR

SEQ ID NO: 412933 - protein, 7 aa, Mycobacterium
AARSRAG

SEQ ID NO: 412934 - protein, 12 aa, Mycobacterium
AARSRDELATER

SEQ ID NO: 412935 - protein, 20 aa, Mycobacterium
AARSRPRPREPARESAPREL

SEQ ID NO: 412936 - protein, 11 aa, Mycobacterium
AARSRQVTASS

SEQ ID NO: 412937 - protein, 10 aa, Mycobacterium
AARSSIDGLP

SEQ ID NO: 412938 - protein, 10 aa, Mycobacterium
AARSSPAGPL

SEQ ID NO: 412939 - protein, 8 aa, Mycobacterium
AARSTEFS

SEQ ID NO: 412940 - protein, 7 aa, Mycobacterium
AARSVQP

SEQ ID NO: 412941 - protein, 8 aa, Mycobacterium
AARSYPAR

SEQ ID NO: 412942 - protein, 4 aa, Mycobacterium
AART

SEQ ID NO: 412943 - protein, 9 aa, Mycobacterium
AARTAAEGA

SEQ ID NO: 412944 - protein, 7 aa, Mycobacterium
AARTADE

SEQ ID NO: 412945 - protein, 6 aa, Mycobacterium
AARTAE

SEQ ID NO: 412946 - protein, 11 aa, Mycobacterium
AARTAGAHTTG

SEQ ID NO: 412947 - protein, 10 aa, Mycobacterium
AARTAGPRDV

SEQ ID NO: 412948 - protein, 6 aa, Mycobacterium
AARTAY

SEQ ID NO: 412949 - protein, 5 aa, Mycobacterium
AARTD

SEQ ID NO: 412950 - protein, 7 aa, Mycobacterium
AARTDLS

SEQ ID NO: 412951 - protein, 5 aa, Mycobacterium
AARTE

SEQ ID NO: 412952 - protein, 7 aa, Mycobacterium
AARTEER

SEQ ID NO: 412953 - protein, 8 aa, Mycobacterium
AARTEPEL

SEQ ID NO: 412954 - protein, 11 aa, Mycobacterium
AARTERNDAKM

SEQ ID NO: 412955 - protein, 12 aa, Mycobacterium
AARTESSREALS

SEQ ID NO: 412956 - protein, 20 aa, Mycobacterium
AARTETAERETVGPDGRAAT

SEQ ID NO: 412957 - protein, 6 aa, Mycobacterium
AARTGA

SEQ ID NO: 412958 - protein, 11 aa, Mycobacterium
AARTGAGEEPG

SEQ ID NO: 412959 - protein, 8 aa, Mycobacterium
AARTGAQA

SEQ ID NO: 412960 - protein, 7 aa, Mycobacterium
AARTGEA

SEQ ID NO: 412961 - protein, 8 aa, Mycobacterium
AARTGEQR

SEQ ID NO: 412962 - protein, 10 aa, Mycobacterium
AARTGLEPGT

SEQ ID NO: 412963 - protein, 11 aa, Mycobacterium
AARTGNDRHAP

SEQ ID NO: 412964 - protein, 28 aa, Mycobacterium
AARTGPRDLSNRLDSPAAEQTRQASRRV

SEQ ID NO: 412965 - protein, 6 aa, Mycobacterium
AARTGR

SEQ ID NO: 412966 - protein, 18 aa, Mycobacterium
AARTGSDHDLKAAGRLSQ

SEQ ID NO: 412967 - protein, 9 aa, Mycobacterium
AARTGSPGE

SEQ ID NO: 412968 - protein, 8 aa, Mycobacterium
AARTGVPD

SEQ ID NO: 412969 - protein, 15 aa, Mycobacterium
AARTKAKELGADPGW

SEQ ID NO: 412970 - protein, 21 aa, Mycobacterium
AARTLRGPDYPIGSDLDDADR

SEQ ID NO: 412971 - protein, 12 aa, Mycobacterium
AARTNGAPPPEI

SEQ ID NO: 412972 - protein, 18 aa, Mycobacterium
AARTNPRGLTGGQAEALA

SEQ ID NO: 412973 - protein, 5 aa, Mycobacterium
AARTP

SEQ ID NO: 412974 - protein, 7 aa, Mycobacterium
AARTPDA

SEQ ID NO: 412975 - protein, 10 aa, Mycobacterium
AARTPGASDA

SEQ ID NO: 412976 - protein, 7 aa, Mycobacterium
AARTPPE

SEQ ID NO: 412977 - protein, 6 aa, Mycobacterium
AARTPR

SEQ ID NO: 412978 - protein, 5 aa, Mycobacterium
AARTQ

SEQ ID NO: 412979 - protein, 13 aa, Mycobacterium
AARTQAQQAYDDR

SEQ ID NO: 412980 - protein, 5 aa, Mycobacterium
AARTR

SEQ ID NO: 412981 - protein, 25 aa, Mycobacterium
AARTRDPRDTPTDKLPRISSGGVHR

SEQ ID NO: 412982 - protein, 8 aa, Mycobacterium
AARTRPWQ

SEQ ID NO: 412983 - protein, 11 aa, Mycobacterium
AARTSDSRHAE

SEQ ID NO: 412984 - protein, 10 aa, Mycobacterium
AARTSKSVAE

SEQ ID NO: 412985 - protein, 7 aa, Mycobacterium
AARTSTF

SEQ ID NO: 412986 - protein, 9 aa, Mycobacterium
AARTTRTRL

SEQ ID NO: 412987 - protein, 7 aa, Mycobacterium
AARTTYR

SEQ ID NO: 412988 - protein, 13 aa, Mycobacterium
AARTVDRSKAPTA

SEQ ID NO: 412989 - protein, 6 aa, Mycobacterium
AARTYE

SEQ ID NO: 412990 - protein, 6 aa, Mycobacterium
AARVDT

SEQ ID NO: 412991 - protein, 21 aa, Mycobacterium
AARVGDSEVARERGDRPPVGG

SEQ ID NO: 412992 - protein, 9 aa, Mycobacterium
AARVGKQTT

SEQ ID NO: 412993 - protein, 8 aa, Mycobacterium
AARVGKRT

SEQ ID NO: 412994 - protein, 5 aa, Mycobacterium
AARVR

SEQ ID NO: 412995 - protein, 5 aa, Mycobacterium
AARYG

SEQ ID NO: 412996 - protein, 19 aa, Mycobacterium
AARYRGDEEPLDPRAGHIP

SEQ ID NO: 412997 - protein, 8 aa, Mycobacterium
AARYSDPV

SEQ ID NO: 412998 - protein, 7 aa, Mycobacterium
AARYTAS

SEQ ID NO: 412999 - protein, 18 aa, Mycobacterium
AARYTASQLGYGGAPQPQ

SEQ ID NO: 413000 - protein, 14 aa, Mycobacterium
AASAAAAERGLSEK

SEQ ID NO: 413001 - protein, 29 aa, Mycobacterium
AASAAAGAADAVATRTASAAGAAGAAGGA

SEQ ID NO: 413002 - protein, 18 aa, Mycobacterium
AASAADAAATALERTPQQ

SEQ ID NO: 413003 - protein, 7 aa, Mycobacterium
AASAAED

SEQ ID NO: 413004 - protein, 7 aa, Mycobacterium
AASAAGF

SEQ ID NO: 413005 - protein, 9 aa, Mycobacterium
AASAAPPRY

SEQ ID NO: 413006 - protein, 6 aa, Mycobacterium
AASAAQ

SEQ ID NO: 413007 - protein, 6 aa, Mycobacterium
AASAAR

SEQ ID NO: 413008 - protein, 29 aa, Mycobacterium
AASAASTAISAAATAGSFGAGGQAGGAAS

SEQ ID NO: 413009 - protein, 7 aa, Mycobacterium
AASAATA

SEQ ID NO: 413010 - protein, 14 aa, Mycobacterium
AASAAVAGPTTGVA

SEQ ID NO: 413011 - protein, 8 aa, Mycobacterium
AASADAAK

SEQ ID NO: 413012 - protein, 6 aa, Mycobacterium
AASADH

SEQ ID NO: 413013 - protein, 11 aa, Mycobacterium
AASADRPGPPT

SEQ ID NO: 413014 - protein, 9 aa, Mycobacterium
AASADRQAT

SEQ ID NO: 413015 - protein, 10 aa, Mycobacterium
AASAEAAGAE

SEQ ID NO: 413016 - protein, 8 aa, Mycobacterium
AASAEATR

SEQ ID NO: 413017 - protein, 8 aa, Mycobacterium
AASAEPLS

SEQ ID NO: 413018 - protein, 8 aa, Mycobacterium
AASAEPVR

SEQ ID NO: 413019 - protein, 6 aa, Mycobacterium
AASAEV

SEQ ID NO: 413020 - protein, 5 aa, Mycobacterium
AASAG

SEQ ID NO: 413021 - protein, 8 aa, Mycobacterium
AASAGAQA

SEQ ID NO: 413022 - protein, 30 aa, Mycobacterium
AASAGASALPPFDQPPSTTNPAGEGGQAAA

SEQ ID NO: 413023 - protein, 10 aa, Mycobacterium
AASAGASENH

SEQ ID NO: 413024 - protein, 10 aa, Mycobacterium
AASAGGTTAM

SEQ ID NO: 413025 - protein, 7 aa, Mycobacterium
AASAGLG

SEQ ID NO: 413026 - protein, 9 aa, Mycobacterium
AASAGNAQL

SEQ ID NO: 413027 - protein, 18 aa, Mycobacterium
AASAGSTSEQLADAAGLE

SEQ ID NO: 413028 - protein, 8 aa, Mycobacterium
AASAGTAI

SEQ ID NO: 413029 - protein, 8 aa, Mycobacterium
AASAHAEL

SEQ ID NO: 413030 - protein, 14 aa, Mycobacterium
AASAHGRAGQDGLG

SEQ ID NO: 413031 - protein, 23 aa, Mycobacterium
AASALGAAKASMAQPADAERTTG

SEQ ID NO: 413032 - protein, 11 aa, Mycobacterium
AASALKENGPR

SEQ ID NO: 413033 - protein, 9 aa, Mycobacterium
AASALTGPL

SEQ ID NO: 413034 - protein, 11 aa, Mycobacterium
AASAPRPAGDA

SEQ ID NO: 413035 - protein, 9 aa, Mycobacterium
AASAPTTGV

SEQ ID NO: 413036 - protein, 9 aa, Mycobacterium
AASAPTVPV

SEQ ID NO: 413037 - protein, 11 aa, Mycobacterium
AASAQAKAAES

SEQ ID NO: 413038 - protein, 15 aa, Mycobacterium
AASAQGAADAPPAPL

SEQ ID NO: 413039 - protein, 15 aa, Mycobacterium
AASAQGAADPSPVPL

SEQ ID NO: 413040 - protein, 15 aa, Mycobacterium
AASAQGATDMPPEPL

SEQ ID NO: 413041 - protein, 5 aa, Mycobacterium
AASAR

SEQ ID NO: 413042 - protein, 8 aa, Mycobacterium
AASARENA

SEQ ID NO: 413043 - protein, 12 aa, Mycobacterium
AASARPVTAPAS

SEQ ID NO: 413044 - protein, 30 aa, Mycobacterium
AASARQLASRARRAVADAPPPVDDNTHNEI

SEQ ID NO: 413045 - protein, 16 aa, Mycobacterium
AASARSKAAESARLQQ

SEQ ID NO: 413046 - protein, 11 aa, Mycobacterium
AASASAHPLSY

SEQ ID NO: 413047 - protein, 7 aa, Mycobacterium
AASASRP

SEQ ID NO: 413048 - protein, 8 aa, Mycobacterium
AASASTQL

SEQ ID NO: 413049 - protein, 9 aa, Mycobacterium
AASASTQLG

SEQ ID NO: 413050 - protein, 9 aa, Mycobacterium
AASASTQLS

SEQ ID NO: 413051 - protein, 10 aa, Mycobacterium
AASATGSRIA

SEQ ID NO: 413052 - protein, 8 aa, Mycobacterium
AASATSTS

SEQ ID NO: 413053 - protein, 13 aa, Mycobacterium
AASAVAPRAYRAA

SEQ ID NO: 413054 - protein, 13 aa, Mycobacterium
AASAVGPRAYRAA

SEQ ID NO: 413055 - protein, 37 aa, Mycobacterium
AASAVPAKRPAATAASTSAKSIGAKSTAQNKIAERAA

SEQ ID NO: 413056 - protein, 11 aa, Mycobacterium
AASAVQQTADT

SEQ ID NO: 413057 - protein, 7 aa, Mycobacterium
AASAVTT

SEQ ID NO: 413058 - protein, 6 aa, Mycobacterium
AASAWG

SEQ ID NO: 413059 - protein, 16 aa, Mycobacterium
AASAYAQAEATASNAL

SEQ ID NO: 413060 - protein, 11 aa, Mycobacterium
AASAYRENRAV

SEQ ID NO: 413061 - protein, 20 aa, Mycobacterium
AASCATASETPKATGAATGN

SEQ ID NO: 413062 - protein, 16 aa, Mycobacterium
AASCPANGRDASGAGI

SEQ ID NO: 413063 - protein, 16 aa, Mycobacterium
AASDAAAAAVANQSGS

SEQ ID NO: 413064 - protein, 7 aa, Mycobacterium
AASDADS

SEQ ID NO: 413065 - protein, 8 aa, Mycobacterium
AASDAEID

SEQ ID NO: 413066 - protein, 12 aa, Mycobacterium
AASDAFDSGKAI

SEQ ID NO: 413067 - protein, 7 aa, Mycobacterium
AASDALG

SEQ ID NO: 413068 - protein, 6 aa, Mycobacterium
AASDAP

SEQ ID NO: 413069 - protein, 9 aa, Mycobacterium
AASDATGRA

SEQ ID NO: 413070 - protein, 5 aa, Mycobacterium
AASDD

SEQ ID NO: 413071 - protein, 7 aa, Mycobacterium
AASDDSL

SEQ ID NO: 413072 - protein, 19 aa, Mycobacterium
AASDEEGTAVLRMVDAGRL

SEQ ID NO: 413073 - protein, 9 aa, Mycobacterium
AASDEGELD

SEQ ID NO: 413074 - protein, 7 aa, Mycobacterium
AASDERV

SEQ ID NO: 413075 - protein, 6 aa, Mycobacterium
AASDFG

SEQ ID NO: 413076 - protein, 8 aa, Mycobacterium
AASDGDIA

SEQ ID NO: 413077 - protein, 7 aa, Mycobacterium
AASDGEI

SEQ ID NO: 413078 - protein, 23 aa, Mycobacterium
AASDGGAAVEADAPGAPGASGAA

SEQ ID NO: 413079 - protein, 8 aa, Mycobacterium
AASDGGDA

SEQ ID NO: 413080 - protein, 11 aa, Mycobacterium
AASDGHRAPTE

SEQ ID NO: 413081 - protein, 11 aa, Mycobacterium
AASDGIASGRY

SEQ ID NO: 413082 - protein, 10 aa, Mycobacterium
AASDGKVGAN

SEQ ID NO: 413083 - protein, 16 aa, Mycobacterium
AASDGPVAEGNVGGGT

SEQ ID NO: 413084 - protein, 7 aa, Mycobacterium
AASDGVQ

SEQ ID NO: 413085 - protein, 7 aa, Mycobacterium
AASDIDA

SEQ ID NO: 413086 - protein, 8 aa, Mycobacterium
AASDIGQP

SEQ ID NO: 413087 - protein, 17 aa, Mycobacterium
AASDLPGYPATAGTPAL

SEQ ID NO: 413088 - protein, 15 aa, Mycobacterium
AASDPDNELDETTTK

SEQ ID NO: 413089 - protein, 14 aa, Mycobacterium
AASDPHLRQRLLDK

SEQ ID NO: 413090 - protein, 19 aa, Mycobacterium
AASDPRAAARRLSSALAAA

SEQ ID NO: 413091 - protein, 13 aa, Mycobacterium
AASDPRRDGQAAA

SEQ ID NO: 413092 - protein, 13 aa, Mycobacterium
AASDPRRDGQAAG

SEQ ID NO: 413093 - protein, 13 aa, Mycobacterium
AASDPRRDGQAVA

SEQ ID NO: 413094 - protein, 8 aa, Mycobacterium
AASDPSLN

SEQ ID NO: 413095 - protein, 8 aa, Mycobacterium
AASDPSPT

SEQ ID NO: 413096 - protein, 8 aa, Mycobacterium
AASDPSPV

SEQ ID NO: 413097 - protein, 16 aa, Mycobacterium
AASDPTGANFNLSSLR

SEQ ID NO: 413098 - protein, 11 aa, Mycobacterium
AASDSDPADLT

SEQ ID NO: 413099 - protein, 20 aa, Mycobacterium
AASDTDPEALEAEAERVAAA

SEQ ID NO: 413100 - protein, 9 aa, Mycobacterium
AASDTTGRA

SEQ ID NO: 413101 - protein, 6 aa, Mycobacterium
AASDVN

SEQ ID NO: 413102 - protein, 7 aa, Mycobacterium
AASDVTG

SEQ ID NO: 413103 - protein, 4 aa, Mycobacterium
AASE

SEQ ID NO: 413104 - protein, 40 aa, Mycobacterium
AASEAAKAAAAPAAAASVSTGTAGVAGPTLASTGSASAVG

SEQ ID NO: 413105 - protein, 8 aa, Mycobacterium
AASEAGID

SEQ ID NO: 413106 - protein, 9 aa, Mycobacterium
AASEAGVDG

SEQ ID NO: 413107 - protein, 9 aa, Mycobacterium
AASEAGVEG

SEQ ID NO: 413108 - protein, 8 aa, Mycobacterium
AASEASNR

SEQ ID NO: 413109 - protein, 17 aa, Mycobacterium
AASEDLSPADASAAKVY

SEQ ID NO: 413110 - protein, 10 aa, Mycobacterium
AASEDYNDQR

SEQ ID NO: 413111 - protein, 7 aa, Mycobacterium
AASEEEL

SEQ ID NO: 413112 - protein, 13 aa, Mycobacterium
AASEETLGPDATR

SEQ ID NO: 413113 - protein, 5 aa, Mycobacterium
AASEF

SEQ ID NO: 413114 - protein, 9 aa, Mycobacterium
AASEGPPHV

SEQ ID NO: 413115 - protein, 8 aa, Mycobacterium
AASEGSVR

SEQ ID NO: 413116 - protein, 6 aa, Mycobacterium
AASEIG

SEQ ID NO: 413117 - protein, 7 aa, Mycobacterium
AASEIGG

SEQ ID NO: 413118 - protein, 8 aa, Mycobacterium
AASEPGAY

SEQ ID NO: 413119 - protein, 8 aa, Mycobacterium
AASEPSAQ

SEQ ID NO: 413120 - protein, 5 aa, Mycobacterium
AASER

SEQ ID NO: 413121 - protein, 7 aa, Mycobacterium
AASERAV

SEQ ID NO: 413122 - protein, 6 aa, Mycobacterium
AASERP

SEQ ID NO: 413123 - protein, 16 aa, Mycobacterium
AASERPAPRSPATPLE

SEQ ID NO: 413124 - protein, 11 aa, Mycobacterium
AASESASRRRA

SEQ ID NO: 413125 - protein, 52 aa, Mycobacterium
AASESASTLAPFDEPPQTTNPAGQGAQAQTVAQAAAQNTTGVTQQLASTNAT

SEQ ID NO: 413126 - protein, 7 aa, Mycobacterium
AASESPP

SEQ ID NO: 413127 - protein, 19 aa, Mycobacterium
AASETPSGRQDLCFQPPTP

SEQ ID NO: 413128 - protein, 8 aa, Mycobacterium
AASETYQE

SEQ ID NO: 413129 - protein, 5 aa, Mycobacterium
AASEV

SEQ ID NO: 413130 - protein, 13 aa, Mycobacterium
AASEVGPRAYRAA

SEQ ID NO: 413131 - protein, 9 aa, Mycobacterium
AASFGSAPR

SEQ ID NO: 413132 - protein, 12 aa, Mycobacterium
AASFKASGDDYW

SEQ ID NO: 413133 - protein, 6 aa, Mycobacterium
AASFKE

SEQ ID NO: 413134 - protein, 7 aa, Mycobacterium
AASFKEG

SEQ ID NO: 413135 - protein, 16 aa, Mycobacterium
AASFTTGSILRADGGI

SEQ ID NO: 413136 - protein, 5 aa, Mycobacterium
AASGA

SEQ ID NO: 413137 - protein, 7 aa, Mycobacterium
AASGADA

SEQ ID NO: 413138 - protein, 8 aa, Mycobacterium
AASGADVA

SEQ ID NO: 413139 - protein, 6 aa, Mycobacterium
AASGAG

SEQ ID NO: 413140 - protein, 7 aa, Mycobacterium
AASGAGA

SEQ ID NO: 413141 - protein, 16 aa, Mycobacterium
AASGAGATVREANGLQ

SEQ ID NO: 413142 - protein, 19 aa, Mycobacterium
AASGAPVRSSRGLLAGILG

SEQ ID NO: 413143 - protein, 10 aa, Mycobacterium
AASGASVHGE

SEQ ID NO: 413144 - protein, 8 aa, Mycobacterium
AASGATPV

SEQ ID NO: 413145 - protein, 7 aa, Mycobacterium
AASGATV

SEQ ID NO: 413146 - protein, 6 aa, Mycobacterium
AASGAV

SEQ ID NO: 413147 - protein, 16 aa, Mycobacterium
AASGAVQTARQAATSA

SEQ ID NO: 413148 - protein, 16 aa, Mycobacterium
AASGAYAGAEAANVTP

SEQ ID NO: 413149 - protein, 10 aa, Mycobacterium
AASGDGAHAA

SEQ ID NO: 413150 - protein, 24 aa, Mycobacterium
AASGDPHGVPGQPSPDTPVGRYIS

SEQ ID NO: 413151 - protein, 6 aa, Mycobacterium
AASGDV

SEQ ID NO: 413152 - protein, 6 aa, Mycobacterium
AASGEA

SEQ ID NO: 413153 - protein, 11 aa, Mycobacterium
AASGEPDPPMP

SEQ ID NO: 413154 - protein, 8 aa, Mycobacterium
AASGETDA

SEQ ID NO: 413155 - protein, 8 aa, Mycobacterium
AASGFEQA

SEQ ID NO: 413156 - protein, 7 aa, Mycobacterium
AASGGAI

SEQ ID NO: 413157 - protein, 8 aa, Mycobacterium
AASGGKLD

SEQ ID NO: 413158 - protein, 8 aa, Mycobacterium
AASGGRLD

SEQ ID NO: 413159 - protein, 6 aa, Mycobacterium
AASGGY

SEQ ID NO: 413160 - protein, 6 aa, Mycobacterium
AASGIG

SEQ ID NO: 413161 - protein, 7 aa, Mycobacterium
AASGIGA

SEQ ID NO: 413162 - protein, 7 aa, Mycobacterium
AASGIGK

SEQ ID NO: 413163 - protein, 7 aa, Mycobacterium
AASGKEA

SEQ ID NO: 413164 - protein, 9 aa, Mycobacterium
AASGKEREK

SEQ ID NO: 413165 - protein, 19 aa, Mycobacterium
AASGKQGMGSNRDGAAGAD

SEQ ID NO: 413166 - protein, 6 aa, Mycobacterium
AASGLD

SEQ ID NO: 413167 - protein, 14 aa, Mycobacterium
AASGLHGANRLGGN

SEQ ID NO: 413168 - protein, 8 aa, Mycobacterium
AASGLSDD

SEQ ID NO: 413169 - protein, 9 aa, Mycobacterium
AASGLTTDE

SEQ ID NO: 413170 - protein, 10 aa, Mycobacterium
AASGNDPRDS

SEQ ID NO: 413171 - protein, 20 aa, Mycobacterium
AASGNEPLGSMGTDTPTAVL

SEQ ID NO: 413172 - protein, 9 aa, Mycobacterium
AASGNGAEP

SEQ ID NO: 413173 - protein, 8 aa, Mycobacterium
AASGPACE

SEQ ID NO: 413174 - protein, 8 aa, Mycobacterium
AASGPLEG

SEQ ID NO: 413175 - protein, 6 aa, Mycobacterium
AASGPR

SEQ ID NO: 413176 - protein, 10 aa, Mycobacterium
AASGQATPDV

SEQ ID NO: 413177 - protein, 7 aa, Mycobacterium
AASGQGN

SEQ ID NO: 413178 - protein, 8 aa, Mycobacterium
AASGQLDR

SEQ ID NO: 413179 - protein, 7 aa, Mycobacterium
AASGRAK

SEQ ID NO: 413180 - protein, 9 aa, Mycobacterium
AASGRNGGF

SEQ ID NO: 413181 - protein, 11 aa, Mycobacterium
AASGRQPPDGD

SEQ ID NO: 413182 - protein, 9 aa, Mycobacterium
AASGRSPHR

SEQ ID NO: 413183 - protein, 12 aa, Mycobacterium
AASGSAGDVGAH

SEQ ID NO: 413184 - protein, 8 aa, Mycobacterium
AASGSARG

SEQ ID NO: 413185 - protein, 7 aa, Mycobacterium
AASGSGV

SEQ ID NO: 413186 - protein, 6 aa, Mycobacterium
AASGSH

SEQ ID NO: 413187 - protein, 9 aa, Mycobacterium
AASGSNAVQ

SEQ ID NO: 413188 - protein, 8 aa, Mycobacterium
AASGSPVP

SEQ ID NO: 413189 - protein, 8 aa, Mycobacterium
AASGSSSL

SEQ ID NO: 413190 - protein, 9 aa, Mycobacterium
AASGTAPTA

SEQ ID NO: 413191 - protein, 101 aa, Mycobacterium
AASGTDGLSGSVGQPGGAGADGNPGQQGGTGGTGGTSGVAAGSGGTGGTGGVGAPGGTGGTGGISISPNQAGGGGTGGTGGIGAPGGTGGHGGDGGAGGRG

SEQ ID NO: 413192 - protein, 7 aa, Mycobacterium
AASGTEV

SEQ ID NO: 413193 - protein, 6 aa, Mycobacterium
AASGTF

SEQ ID NO: 413194 - protein, 10 aa, Mycobacterium
AASGTPEVGR

SEQ ID NO: 413195 - protein, 6 aa, Mycobacterium
AASGTR

SEQ ID NO: 413196 - protein, 6 aa, Mycobacterium
AASGTV

SEQ ID NO: 413197 - protein, 8 aa, Mycobacterium
AASGWRRG

SEQ ID NO: 413198 - protein, 9 aa, Mycobacterium
AASGYQDTI

SEQ ID NO: 413199 - protein, 5 aa, Mycobacterium
AASHA

SEQ ID NO: 413200 - protein, 8 aa, Mycobacterium
AASHAQDA

SEQ ID NO: 413201 - protein, 14 aa, Mycobacterium
AASHDKAARATKDG

SEQ ID NO: 413202 - protein, 14 aa, Mycobacterium
AASHEKAARATKEG

SEQ ID NO: 413203 - protein, 13 aa, Mycobacterium
AASHGGVDDTREL

SEQ ID NO: 413204 - protein, 6 aa, Mycobacterium
AASHPS

SEQ ID NO: 413205 - protein, 4 aa, Mycobacterium
AASI

SEQ ID NO: 413206 - protein, 9 aa, Mycobacterium
AASIDGRSR

SEQ ID NO: 413207 - protein, 6 aa, Mycobacterium
AASIDK

SEQ ID NO: 413208 - protein, 6 aa, Mycobacterium
AASIPP

SEQ ID NO: 413209 - protein, 5 aa, Mycobacterium
AASKA

SEQ ID NO: 413210 - protein, 6 aa, Mycobacterium
AASKAT

SEQ ID NO: 413211 - protein, 6 aa, Mycobacterium
AASKEM

SEQ ID NO: 413212 - protein, 8 aa, Mycobacterium
AASKGGVQ

SEQ ID NO: 413213 - protein, 12 aa, Mycobacterium
AASKLPSDPSGV

SEQ ID NO: 413214 - protein, 21 aa, Mycobacterium
AASKPGARPTARAQRAPRRTV

SEQ ID NO: 413215 - protein, 8 aa, Mycobacterium
AASKPGVH

SEQ ID NO: 413216 - protein, 5 aa, Mycobacterium
AASKS

SEQ ID NO: 413217 - protein, 7 aa, Mycobacterium
AASKSHL

SEQ ID NO: 413218 - protein, 9 aa, Mycobacterium
AASLADGTA

SEQ ID NO: 413219 - protein, 9 aa, Mycobacterium
AASLDAASA

SEQ ID NO: 413220 - protein, 8 aa, Mycobacterium
AASLDRLS

SEQ ID NO: 413221 - protein, 11 aa, Mycobacterium
AASLGDIPAEA

SEQ ID NO: 413222 - protein, 7 aa, Mycobacterium
AASLGPV

SEQ ID NO: 413223 - protein, 15 aa, Mycobacterium
AASLPEQSFDARPGT

SEQ ID NO: 413224 - protein, 7 aa, Mycobacterium
AASLPGV

SEQ ID NO: 413225 - protein, 15 aa, Mycobacterium
AASLPSAIDGPTIGS

SEQ ID NO: 413226 - protein, 7 aa, Mycobacterium
AASLTRR

SEQ ID NO: 413227 - protein, 5 aa, Mycobacterium
AASMG

SEQ ID NO: 413228 - protein, 5 aa, Mycobacterium
AASNA

SEQ ID NO: 413229 - protein, 20 aa, Mycobacterium
AASNAAAESRRTDPRLNNGQ

SEQ ID NO: 413230 - protein, 17 aa, Mycobacterium
AASNAAVASRKSDPRLH

SEQ ID NO: 413231 - protein, 12 aa, Mycobacterium
AASNAGRDPGDI

SEQ ID NO: 413232 - protein, 18 aa, Mycobacterium
AASNEAVASRKKDPRLHN

SEQ ID NO: 413233 - protein, 10 aa, Mycobacterium
AASNGQRPGS

SEQ ID NO: 413234 - protein, 7 aa, Mycobacterium
AASNNAR

SEQ ID NO: 413235 - protein, 8 aa, Mycobacterium
AASNPDLA

SEQ ID NO: 413236 - protein, 10 aa, Mycobacterium
AASNRTDADL

SEQ ID NO: 413237 - protein, 9 aa, Mycobacterium
AASNSAARE

SEQ ID NO: 413238 - protein, 11 aa, Mycobacterium
AASNSADDDGM

SEQ ID NO: 413239 - protein, 8 aa, Mycobacterium
AASNTLQA

SEQ ID NO: 413240 - protein, 8 aa, Mycobacterium
AASNTPMR

SEQ ID NO: 413241 - protein, 16 aa, Mycobacterium
AASPAEADAGLDPNET

SEQ ID NO: 413242 - protein, 7 aa, Mycobacterium
AASPAGR

SEQ ID NO: 413243 - protein, 7 aa, Mycobacterium
AASPAGW

SEQ ID NO: 413244 - protein, 10 aa, Mycobacterium
AASPANTASF

SEQ ID NO: 413245 - protein, 9 aa, Mycobacterium
AASPASDAQ

SEQ ID NO: 413246 - protein, 10 aa, Mycobacterium
AASPASPESL

SEQ ID NO: 413247 - protein, 10 aa, Mycobacterium
AASPATTVAG

SEQ ID NO: 413248 - protein, 9 aa, Mycobacterium
AASPDAQLP

SEQ ID NO: 413249 - protein, 8 aa, Mycobacterium
AASPDARG

SEQ ID NO: 413250 - protein, 11 aa, Mycobacterium
AASPDFERTTA

SEQ ID NO: 413251 - protein, 7 aa, Mycobacterium
AASPDRR

SEQ ID NO: 413252 - protein, 23 aa, Mycobacterium
AASPEDPAEHLKTESNEAQWGFT

SEQ ID NO: 413253 - protein, 7 aa, Mycobacterium
AASPEGL

SEQ ID NO: 413254 - protein, 13 aa, Mycobacterium
AASPEHTPEPFDA

SEQ ID NO: 413255 - protein, 13 aa, Mycobacterium
AASPEHTPQPFDA

SEQ ID NO: 413256 - protein, 15 aa, Mycobacterium
AASPGAAAAEEQAPV

SEQ ID NO: 413257 - protein, 18 aa, Mycobacterium
AASPGATYRSTLTANATA

SEQ ID NO: 413258 - protein, 8 aa, Mycobacterium
AASPGFTD

SEQ ID NO: 413259 - protein, 23 aa, Mycobacterium
AASPGGSSCRPAPGSRLSAPGPC

SEQ ID NO: 413260 - protein, 14 aa, Mycobacterium
AASPGLAPYNATKA

SEQ ID NO: 413261 - protein, 8 aa, Mycobacterium
AASPGQTR

SEQ ID NO: 413262 - protein, 6 aa, Mycobacterium
AASPGR

SEQ ID NO: 413263 - protein, 7 aa, Mycobacterium
AASPGTI

SEQ ID NO: 413264 - protein, 7 aa, Mycobacterium
AASPGTL

SEQ ID NO: 413265 - protein, 6 aa, Mycobacterium
AASPGV

SEQ ID NO: 413266 - protein, 5 aa, Mycobacterium
AASPI

SEQ ID NO: 413267 - protein, 10 aa, Mycobacterium
AASPLDPFGN

SEQ ID NO: 413268 - protein, 11 aa, Mycobacterium
AASPPPSQADA

SEQ ID NO: 413269 - protein, 6 aa, Mycobacterium
AASPPR

SEQ ID NO: 413270 - protein, 7 aa, Mycobacterium
AASPQDI

SEQ ID NO: 413271 - protein, 6 aa, Mycobacterium
AASPRF

SEQ ID NO: 413272 - protein, 15 aa, Mycobacterium
AASPRVDRLEPGNNV

SEQ ID NO: 413273 - protein, 6 aa, Mycobacterium
AASPST

SEQ ID NO: 413274 - protein, 15 aa, Mycobacterium
AASPSTGVNTLTGAG

SEQ ID NO: 413275 - protein, 14 aa, Mycobacterium
AASPTAQRPRTRSR

SEQ ID NO: 413276 - protein, 10 aa, Mycobacterium
AASPTGTWDD

SEQ ID NO: 413277 - protein, 5 aa, Mycobacterium
AASPV

SEQ ID NO: 413278 - protein, 17 aa, Mycobacterium
AASPVLSGGQKGPHPIQ

SEQ ID NO: 413279 - protein, 6 aa, Mycobacterium
AASPVP

SEQ ID NO: 413280 - protein, 4 aa, Mycobacterium
AASQ

SEQ ID NO: 413281 - protein, 5 aa, Mycobacterium
AASQA

SEQ ID NO: 413282 - protein, 8 aa, Mycobacterium
AASQAESV

SEQ ID NO: 413283 - protein, 12 aa, Mycobacterium
AASQAETEATAA

SEQ ID NO: 413284 - protein, 9 aa, Mycobacterium
AASQASRDR

SEQ ID NO: 413285 - protein, 13 aa, Mycobacterium
AASQAVRGTGPAE

SEQ ID NO: 413286 - protein, 17 aa, Mycobacterium
AASQEAKRRGLSNATFQ

SEQ ID NO: 413287 - protein, 9 aa, Mycobacterium
AASQEHEGE

SEQ ID NO: 413288 - protein, 6 aa, Mycobacterium
AASQGL

SEQ ID NO: 413289 - protein, 7 aa, Mycobacterium
AASQGLT

SEQ ID NO: 413290 - protein, 7 aa, Mycobacterium
AASQGRD

SEQ ID NO: 413291 - protein, 9 aa, Mycobacterium
AASQGRTQP

SEQ ID NO: 413292 - protein, 11 aa, Mycobacterium
AASQGSSPDQY

SEQ ID NO: 413293 - protein, 5 aa, Mycobacterium
AASQL

SEQ ID NO: 413294 - protein, 5 aa, Mycobacterium
AASQM

SEQ ID NO: 413295 - protein, 17 aa, Mycobacterium
AASQQQEIDTMQKLLAS

SEQ ID NO: 413296 - protein, 8 aa, Mycobacterium
AASRAGER

SEQ ID NO: 413297 - protein, 7 aa, Mycobacterium
AASRAPV

SEQ ID NO: 413298 - protein, 18 aa, Mycobacterium
AASRASADGQSPKLNQDD

SEQ ID NO: 413299 - protein, 16 aa, Mycobacterium
AASRASANGRPPELNQ

SEQ ID NO: 413300 - protein, 16 aa, Mycobacterium
AASRASTDGQPPELNQ

SEQ ID NO: 413301 - protein, 16 aa, Mycobacterium
AASRASTDGRPPELSQ

SEQ ID NO: 413302 - protein, 6 aa, Mycobacterium
AASRDH

SEQ ID NO: 413303 - protein, 9 aa, Mycobacterium
AASRDTPLD

SEQ ID NO: 413304 - protein, 12 aa, Mycobacterium
AASREAESAFGD

SEQ ID NO: 413305 - protein, 21 aa, Mycobacterium
AASRLAGAYGDEAAAEITAVL

SEQ ID NO: 413306 - protein, 8 aa, Mycobacterium
AASRLESG

SEQ ID NO: 413307 - protein, 8 aa, Mycobacterium
AASRLESS

SEQ ID NO: 413308 - protein, 8 aa, Mycobacterium
AASRLETT

SEQ ID NO: 413309 - protein, 6 aa, Mycobacterium
AASRPE

SEQ ID NO: 413310 - protein, 8 aa, Mycobacterium
AASRPNTK

SEQ ID NO: 413311 - protein, 10 aa, Mycobacterium
AASRPTETAG

SEQ ID NO: 413312 - protein, 18 aa, Mycobacterium
AASRPTLPTGALTSASAA

SEQ ID NO: 413313 - protein, 5 aa, Mycobacterium
AASRS

SEQ ID NO: 413314 - protein, 14 aa, Mycobacterium
AASRSIDPDTAAGA

SEQ ID NO: 413315 - protein, 8 aa, Mycobacterium
AASRTAEI

SEQ ID NO: 413316 - protein, 9 aa, Mycobacterium
AASRTKQIR

SEQ ID NO: 413317 - protein, 8 aa, Mycobacterium
AASRYAAT

SEQ ID NO: 413318 - protein, 4 aa, Mycobacterium
AASS

SEQ ID NO: 413319 - protein, 44 aa, Mycobacterium
AASSAASALAPFTEPPQTTNSSAQADQARALTQAAGNATSARTQ

SEQ ID NO: 413320 - protein, 19 aa, Mycobacterium
AASSAELPHSVENPTATQA

SEQ ID NO: 413321 - protein, 10 aa, Mycobacterium
AASSAGTTLG

SEQ ID NO: 413322 - protein, 6 aa, Mycobacterium
AASSAL

SEQ ID NO: 413323 - protein, 17 aa, Mycobacterium
AASSAPGYPATAGTARL

SEQ ID NO: 413324 - protein, 7 aa, Mycobacterium
AASSARR

SEQ ID NO: 413325 - protein, 7 aa, Mycobacterium
AASSAVE

SEQ ID NO: 413326 - protein, 7 aa, Mycobacterium
AASSDDI

SEQ ID NO: 413327 - protein, 8 aa, Mycobacterium
AASSDIPQ

SEQ ID NO: 413328 - protein, 8 aa, Mycobacterium
AASSDNEV

SEQ ID NO: 413329 - protein, 9 aa, Mycobacterium
AASSEKHPD

SEQ ID NO: 413330 - protein, 14 aa, Mycobacterium
AASSGFGGAIADPD

SEQ ID NO: 413331 - protein, 10 aa, Mycobacterium
AASSGGISTT

SEQ ID NO: 413332 - protein, 6 aa, Mycobacterium
AASSGL

SEQ ID NO: 413333 - protein, 11 aa, Mycobacterium
AASSGPGVEPL

SEQ ID NO: 413334 - protein, 8 aa, Mycobacterium
AASSIARD

SEQ ID NO: 413335 - protein, 8 aa, Mycobacterium
AASSPDKL

SEQ ID NO: 413336 - protein, 11 aa, Mycobacterium
AASSPEGGEID

SEQ ID NO: 413337 - protein, 8 aa, Mycobacterium
AASSPEKL

SEQ ID NO: 413338 - protein, 9 aa, Mycobacterium
AASSPFGGE

SEQ ID NO: 413339 - protein, 7 aa, Mycobacterium
AASSRVA

SEQ ID NO: 413340 - protein, 18 aa, Mycobacterium
AASSSDTVRSRSMTGKPA

SEQ ID NO: 413341 - protein, 10 aa, Mycobacterium
AASSSGATTL

SEQ ID NO: 413342 - protein, 10 aa, Mycobacterium
AASSSIGGNV

SEQ ID NO: 413343 - protein, 7 aa, Mycobacterium
AASSSIP

SEQ ID NO: 413344 - protein, 6 aa, Mycobacterium
AASSSL

SEQ ID NO: 413345 - protein, 19 aa, Mycobacterium
AASSSLDGLHDPEALPPLT

SEQ ID NO: 413346 - protein, 21 aa, Mycobacterium
AASSSPALSRSESRDGTGAAL

SEQ ID NO: 413347 - protein, 10 aa, Mycobacterium
AASSTLGTVP

SEQ ID NO: 413348 - protein, 6 aa, Mycobacterium
AASSTM

SEQ ID NO: 413349 - protein, 9 aa, Mycobacterium
AASSTPGPL

SEQ ID NO: 413350 - protein, 12 aa, Mycobacterium
AASTADDFTKPG

SEQ ID NO: 413351 - protein, 7 aa, Mycobacterium
AASTAKV

SEQ ID NO: 413352 - protein, 6 aa, Mycobacterium
AASTAL

SEQ ID NO: 413353 - protein, 7 aa, Mycobacterium
AASTAPL

SEQ ID NO: 413354 - protein, 6 aa, Mycobacterium
AASTDK

SEQ ID NO: 413355 - protein, 10 aa, Mycobacterium
AASTELQERN

SEQ ID NO: 413356 - protein, 6 aa, Mycobacterium
AASTGA

SEQ ID NO: 413357 - protein, 11 aa, Mycobacterium
AASTGLPDGSA

SEQ ID NO: 413358 - protein, 8 aa, Mycobacterium
AASTGVEH

SEQ ID NO: 413359 - protein, 7 aa, Mycobacterium
AASTNNM

SEQ ID NO: 413360 - protein, 8 aa, Mycobacterium
AASTPAPV

SEQ ID NO: 413361 - protein, 15 aa, Mycobacterium
AASTPASGAGIYGAT

SEQ ID NO: 413362 - protein, 12 aa, Mycobacterium
AASTPDEPQPFG

SEQ ID NO: 413363 - protein, 11 aa, Mycobacterium
AASTPEGARRL

SEQ ID NO: 413364 - protein, 8 aa, Mycobacterium
AASTPITD

SEQ ID NO: 413365 - protein, 8 aa, Mycobacterium
AASTPKGA

SEQ ID NO: 413366 - protein, 14 aa, Mycobacterium
AASTPRTSEAPDPL

SEQ ID NO: 413367 - protein, 9 aa, Mycobacterium
AASTPTVAT

SEQ ID NO: 413368 - protein, 6 aa, Mycobacterium
AASTPW

SEQ ID NO: 413369 - protein, 9 aa, Mycobacterium
AASTQLAGT

SEQ ID NO: 413370 - protein, 6 aa, Mycobacterium
AASTQQ

SEQ ID NO: 413371 - protein, 5 aa, Mycobacterium
AASTR

SEQ ID NO: 413372 - protein, 15 aa, Mycobacterium
AASTRAAAAATQAKA

SEQ ID NO: 413373 - protein, 30 aa, Mycobacterium
AASTRADDAARAAQSSALAARTAAEQASAV

SEQ ID NO: 413374 - protein, 8 aa, Mycobacterium
AASTREPL

SEQ ID NO: 413375 - protein, 8 aa, Mycobacterium
AASTSDDE

SEQ ID NO: 413376 - protein, 14 aa, Mycobacterium
AASTTAAVTGTRRD

SEQ ID NO: 413377 - protein, 6 aa, Mycobacterium
AASTTF

SEQ ID NO: 413378 - protein, 25 aa, Mycobacterium
AASTTGGNYTDRKSGGRLGTATQTA

SEQ ID NO: 413379 - protein, 9 aa, Mycobacterium
AASTTPDSP

SEQ ID NO: 413380 - protein, 5 aa, Mycobacterium
AASTV

SEQ ID NO: 413381 - protein, 5 aa, Mycobacterium
AASTW

SEQ ID NO: 413382 - protein, 7 aa, Mycobacterium
AASVASA

SEQ ID NO: 413383 - protein, 9 aa, Mycobacterium
AASVASRDL

SEQ ID NO: 413384 - protein, 9 aa, Mycobacterium
AASVEDRRA

SEQ ID NO: 413385 - protein, 9 aa, Mycobacterium
AASVGAARA

SEQ ID NO: 413386 - protein, 9 aa, Mycobacterium
AASVQAAAD

SEQ ID NO: 413387 - protein, 12 aa, Mycobacterium
AASVRANHPDMA

SEQ ID NO: 413388 - protein, 12 aa, Mycobacterium
AASVTGPLNDAA

SEQ ID NO: 413389 - protein, 9 aa, Mycobacterium
AASWPDGQE

SEQ ID NO: 413390 - protein, 4 aa, Mycobacterium
AASY

SEQ ID NO: 413391 - protein, 14 aa, Mycobacterium
AASYAGMEADAGQS

SEQ ID NO: 413392 - protein, 16 aa, Mycobacterium
AASYATAEAANASPLQ

SEQ ID NO: 413393 - protein, 8 aa, Mycobacterium
AASYDEYR

SEQ ID NO: 413394 - protein, 5 aa, Mycobacterium
AASYG

SEQ ID NO: 413395 - protein, 6 aa, Mycobacterium
AASYGH

SEQ ID NO: 413396 - protein, 7 aa, Mycobacterium
AASYHGR

SEQ ID NO: 413397 - protein, 6 aa, Mycobacterium
AASYIS

SEQ ID NO: 413398 - protein, 18 aa, Mycobacterium
AASYRNSDKRGGANGGRI

SEQ ID NO: 413399 - protein, 5 aa, Mycobacterium
AASYS

SEQ ID NO: 413400 - protein, 9 aa, Mycobacterium
AASYTTTDL

SEQ ID NO: 413401 - protein, 5 aa, Mycobacterium
AATAA

SEQ ID NO: 413402 - protein, 6 aa, Mycobacterium
AATAAA

SEQ ID NO: 413403 - protein, 15 aa, Mycobacterium
AATAAAERIGGASGP

SEQ ID NO: 413404 - protein, 11 aa, Mycobacterium
AATAAAHGYAT

SEQ ID NO: 413405 - protein, 9 aa, Mycobacterium
AATAAAPNA

SEQ ID NO: 413406 - protein, 10 aa, Mycobacterium
AATAAESARV

SEQ ID NO: 413407 - protein, 7 aa, Mycobacterium
AATAAEV

SEQ ID NO: 413408 - protein, 7 aa, Mycobacterium
AATAAGA

SEQ ID NO: 413409 - protein, 10 aa, Mycobacterium
AATAAGASYA

SEQ ID NO: 413410 - protein, 9 aa, Mycobacterium
AATAALTTG

SEQ ID NO: 413411 - protein, 8 aa, Mycobacterium
AATAAPAA

SEQ ID NO: 413412 - protein, 10 aa, Mycobacterium
AATAAPAGIS

SEQ ID NO: 413413 - protein, 16 aa, Mycobacterium
AATAAPAGYALGGGDP

SEQ ID NO: 413414 - protein, 22 aa, Mycobacterium
AATAAPALAESAAATAETAEAA

SEQ ID NO: 413415 - protein, 16 aa, Mycobacterium
AATAAPGIATAGVPGR

SEQ ID NO: 413416 - protein, 15 aa, Mycobacterium
AATAAPRSAELPRAP

SEQ ID NO: 413417 - protein, 15 aa, Mycobacterium
AATAASAWRALTALG

SEQ ID NO: 413418 - protein, 7 aa, Mycobacterium
AATAASD

SEQ ID NO: 413419 - protein, 14 aa, Mycobacterium
AATAASKVADRAKA

SEQ ID NO: 413420 - protein, 6 aa, Mycobacterium
AATAAT

SEQ ID NO: 413421 - protein, 8 aa, Mycobacterium
AATADGRE

SEQ ID NO: 413422 - protein, 7 aa, Mycobacterium
AATADPA

SEQ ID NO: 413423 - protein, 7 aa, Mycobacterium
AATADSD

SEQ ID NO: 413424 - protein, 7 aa, Mycobacterium
AATADTG

SEQ ID NO: 413425 - protein, 16 aa, Mycobacterium
AATAEAAAAARHASKA

SEQ ID NO: 413426 - protein, 10 aa, Mycobacterium
AATAEAAQAA

SEQ ID NO: 413427 - protein, 9 aa, Mycobacterium
AATAEAGRR

SEQ ID NO: 413428 - protein, 10 aa, Mycobacterium
AATAEAKRQN

SEQ ID NO: 413429 - protein, 6 aa, Mycobacterium
AATAED

SEQ ID NO: 413430 - protein, 7 aa, Mycobacterium
AATAEFD

SEQ ID NO: 413431 - protein, 6 aa, Mycobacterium
AATAEH

SEQ ID NO: 413432 - protein, 7 aa, Mycobacterium
AATAEHH

SEQ ID NO: 413433 - protein, 14 aa, Mycobacterium
AATAENKGEKRITE

SEQ ID NO: 413434 - protein, 6 aa, Mycobacterium
AATAEQ

SEQ ID NO: 413435 - protein, 9 aa, Mycobacterium
AATAERDAE

SEQ ID NO: 413436 - protein, 18 aa, Mycobacterium
AATAERDAEFRANAEAKE

SEQ ID NO: 413437 - protein, 10 aa, Mycobacterium
AATAESAADA

SEQ ID NO: 413438 - protein, 5 aa, Mycobacterium
AATAG

SEQ ID NO: 413439 - protein, 9 aa, Mycobacterium
AATAGDLGP

SEQ ID NO: 413440 - protein, 13 aa, Mycobacterium
AATAGEDDAADDA

SEQ ID NO: 413441 - protein, 17 aa, Mycobacterium
AATAGGIEQDGPERERA

SEQ ID NO: 413442 - protein, 9 aa, Mycobacterium
AATAGGYER

SEQ ID NO: 413443 - protein, 8 aa, Mycobacterium
AATAGLSE

SEQ ID NO: 413444 - protein, 9 aa, Mycobacterium
AATAGPRDV

SEQ ID NO: 413445 - protein, 8 aa, Mycobacterium
AATAGRDH

SEQ ID NO: 413446 - protein, 7 aa, Mycobacterium
AATAGRE

SEQ ID NO: 413447 - protein, 7 aa, Mycobacterium
AATAGTG

SEQ ID NO: 413448 - protein, 6 aa, Mycobacterium
AATAGW

SEQ ID NO: 413449 - protein, 5 aa, Mycobacterium
AATAI

SEQ ID NO: 413450 - protein, 10 aa, Mycobacterium
AATAIEAQER

SEQ ID NO: 413451 - protein, 30 aa, Mycobacterium
AATAITAATAGPANAGLSRGNTARPAGAAC

SEQ ID NO: 413452 - protein, 14 aa, Mycobacterium
AATALPALLQALAP

SEQ ID NO: 413453 - protein, 10 aa, Mycobacterium
AATAPAEQAG

SEQ ID NO: 413454 - protein, 5 aa, Mycobacterium
AATAQ

SEQ ID NO: 413455 - protein, 7 aa, Mycobacterium
AATAQMA

SEQ ID NO: 413456 - protein, 14 aa, Mycobacterium
AATARAAGARNVEE

SEQ ID NO: 413457 - protein, 7 aa, Mycobacterium
AATARAL

SEQ ID NO: 413458 - protein, 7 aa, Mycobacterium
AATAREN

SEQ ID NO: 413459 - protein, 8 aa, Mycobacterium
AATARENA

SEQ ID NO: 413460 - protein, 7 aa, Mycobacterium
AATARGA

SEQ ID NO: 413461 - protein, 5 aa, Mycobacterium
AATAS

SEQ ID NO: 413462 - protein, 9 aa, Mycobacterium
AATASATGV

SEQ ID NO: 413463 - protein, 21 aa, Mycobacterium
AATASDELPDTARDVESRGRR

SEQ ID NO: 413464 - protein, 9 aa, Mycobacterium
AATASGAWA

SEQ ID NO: 413465 - protein, 16 aa, Mycobacterium
AATASRLGVRPPGRAA

SEQ ID NO: 413466 - protein, 9 aa, Mycobacterium
AATASRSPI

SEQ ID NO: 413467 - protein, 11 aa, Mycobacterium
AATASRTPPGL

SEQ ID NO: 413468 - protein, 16 aa, Mycobacterium
AATATANGDPVPASAR

SEQ ID NO: 413469 - protein, 12 aa, Mycobacterium
AATATDTDQPVI

SEQ ID NO: 413470 - protein, 10 aa, Mycobacterium
AATATELARP

SEQ ID NO: 413471 - protein, 15 aa, Mycobacterium
AATATGMEDIPGQSV

SEQ ID NO: 413472 - protein, 7 aa, Mycobacterium
AATATHG

SEQ ID NO: 413473 - protein, 11 aa, Mycobacterium
AATATQGGAEI

SEQ ID NO: 413474 - protein, 11 aa, Mycobacterium
AATATQGGAPI

SEQ ID NO: 413475 - protein, 12 aa, Mycobacterium
AATATQGGQPIG

SEQ ID NO: 413476 - protein, 12 aa, Mycobacterium
AATATQGGTPIG

SEQ ID NO: 413477 - protein, 12 aa, Mycobacterium
AATATSAGALPA

SEQ ID NO: 413478 - protein, 15 aa, Mycobacterium
AATATSRSSTGTPGA

SEQ ID NO: 413479 - protein, 13 aa, Mycobacterium
AATAVADRSGTEP

SEQ ID NO: 413480 - protein, 9 aa, Mycobacterium
AATAVPAAR

SEQ ID NO: 413481 - protein, 8 aa, Mycobacterium
AATAVPAT

SEQ ID NO: 413482 - protein, 13 aa, Mycobacterium
AATAYTEAEAANA

SEQ ID NO: 413483 - protein, 4 aa, Mycobacterium
AATD

SEQ ID NO: 413484 - protein, 6 aa, Mycobacterium
AATDAA

SEQ ID NO: 413485 - protein, 11 aa, Mycobacterium
AATDAEVDPDR

SEQ ID NO: 413486 - protein, 12 aa, Mycobacterium
AATDAGTSLRSR

SEQ ID NO: 413487 - protein, 19 aa, Mycobacterium
AATDAHLRTGKRPSGYPPP

SEQ ID NO: 413488 - protein, 8 aa, Mycobacterium
AATDAPEV

SEQ ID NO: 413489 - protein, 9 aa, Mycobacterium
AATDAQPGW

SEQ ID NO: 413490 - protein, 9 aa, Mycobacterium
AATDARNEE

SEQ ID NO: 413491 - protein, 7 aa, Mycobacterium
AATDAVA

SEQ ID NO: 413492 - protein, 5 aa, Mycobacterium
AATDD

SEQ ID NO: 413493 - protein, 8 aa, Mycobacterium
AATDDLSG

SEQ ID NO: 413494 - protein, 6 aa, Mycobacterium
AATDDP

SEQ ID NO: 413495 - protein, 7 aa, Mycobacterium
AATDDPI

SEQ ID NO: 413496 - protein, 8 aa, Mycobacterium
AATDDTEA

SEQ ID NO: 413497 - protein, 5 aa, Mycobacterium
AATDE

SEQ ID NO: 413498 - protein, 8 aa, Mycobacterium
AATDEDLK

SEQ ID NO: 413499 - protein, 14 aa, Mycobacterium
AATDEQHPDAQGRI

SEQ ID NO: 413500 - protein, 8 aa, Mycobacterium
AATDEVST

SEQ ID NO: 413501 - protein, 14 aa, Mycobacterium
AATDHANADQEACH

SEQ ID NO: 413502 - protein, 12 aa, Mycobacterium
AATDLSRSAPLL

SEQ ID NO: 413503 - protein, 15 aa, Mycobacterium
AATDPAALGGQYYGP

SEQ ID NO: 413504 - protein, 8 aa, Mycobacterium
AATDPARA

SEQ ID NO: 413505 - protein, 7 aa, Mycobacterium
AATDPAV

SEQ ID NO: 413506 - protein, 13 aa, Mycobacterium
AATDPDVEGGQYF

SEQ ID NO: 413507 - protein, 10 aa, Mycobacterium
AATDPGALGG

SEQ ID NO: 413508 - protein, 17 aa, Mycobacterium
AATDPGVKGGQYYGPDG

SEQ ID NO: 413509 - protein, 8 aa, Mycobacterium
AATDPPQK

SEQ ID NO: 413510 - protein, 11 aa, Mycobacterium
AATDPPWETRS

SEQ ID NO: 413511 - protein, 12 aa, Mycobacterium
AATDPRRAKARA

SEQ ID NO: 413512 - protein, 15 aa, Mycobacterium
AATDPSVAGGQYYGP

SEQ ID NO: 413513 - protein, 17 aa, Mycobacterium
AATDPSVAGGQYYGPDG

SEQ ID NO: 413514 - protein, 16 aa, Mycobacterium
AATDPTGAPFNLSSLQ

SEQ ID NO: 413515 - protein, 8 aa, Mycobacterium
AATDPTGV

SEQ ID NO: 413516 - protein, 10 aa, Mycobacterium
AATDQRPDWT

SEQ ID NO: 413517 - protein, 5 aa, Mycobacterium
AATDR

SEQ ID NO: 413518 - protein, 8 aa, Mycobacterium
AATDRAQQ

SEQ ID NO: 413519 - protein, 10 aa, Mycobacterium
AATDRGAARF

SEQ ID NO: 413520 - protein, 10 aa, Mycobacterium
AATDRGRLPD

SEQ ID NO: 413521 - protein, 8 aa, Mycobacterium
AATDRPDR

SEQ ID NO: 413522 - protein, 8 aa, Mycobacterium
AATDSAVG

SEQ ID NO: 413523 - protein, 17 aa, Mycobacterium
AATDSEPQVAGKPAPAL

SEQ ID NO: 413524 - protein, 18 aa, Mycobacterium
AATDSGISLTSPVADTSI

SEQ ID NO: 413525 - protein, 10 aa, Mycobacterium
AATDSTEDTL

SEQ ID NO: 413526 - protein, 6 aa, Mycobacterium
AATDSV

SEQ ID NO: 413527 - protein, 15 aa, Mycobacterium
AATDTADRAVTTDTA

SEQ ID NO: 413528 - protein, 7 aa, Mycobacterium
AATDTLA

SEQ ID NO: 413529 - protein, 14 aa, Mycobacterium
AATDTTDVQELAGT

SEQ ID NO: 413530 - protein, 7 aa, Mycobacterium
AATDVAS

SEQ ID NO: 413531 - protein, 6 aa, Mycobacterium
AATDVD

SEQ ID NO: 413532 - protein, 7 aa, Mycobacterium
AATDVDG

SEQ ID NO: 413533 - protein, 4 aa, Mycobacterium
AATE

SEQ ID NO: 413534 - protein, 5 aa, Mycobacterium
AATEA

SEQ ID NO: 413535 - protein, 6 aa, Mycobacterium
AATEAF

SEQ ID NO: 413536 - protein, 11 aa, Mycobacterium
AATEALATSSE

SEQ ID NO: 413537 - protein, 7 aa, Mycobacterium
AATEAQY

SEQ ID NO: 413538 - protein, 15 aa, Mycobacterium
AATEARGNTYDDATD

SEQ ID NO: 413539 - protein, 17 aa, Mycobacterium
AATEATERGLEALRAAL

SEQ ID NO: 413540 - protein, 6 aa, Mycobacterium
AATEDE

SEQ ID NO: 413541 - protein, 24 aa, Mycobacterium
AATEDRFNTAGLSSAGGGSGSGAI

SEQ ID NO: 413542 - protein, 17 aa, Mycobacterium
AATEDRYTDGSGSGSIT

SEQ ID NO: 413543 - protein, 17 aa, Mycobacterium
AATEERFSDGSGSGSIT

SEQ ID NO: 413544 - protein, 17 aa, Mycobacterium
AATEERFSDGSGTGSIT

SEQ ID NO: 413545 - protein, 17 aa, Mycobacterium
AATEERFTDGSGSGSIT

SEQ ID NO: 413546 - protein, 16 aa, Mycobacterium
AATEERYSDGSGTGSI

SEQ ID NO: 413547 - protein, 11 aa, Mycobacterium
AATEGATGPDM

SEQ ID NO: 413548 - protein, 11 aa, Mycobacterium
AATEGDKQRYL

SEQ ID NO: 413549 - protein, 7 aa, Mycobacterium
AATEGTR

SEQ ID NO: 413550 - protein, 6 aa, Mycobacterium
AATEHE

SEQ ID NO: 413551 - protein, 10 aa, Mycobacterium
AATEHKGQPT

SEQ ID NO: 413552 - protein, 7 aa, Mycobacterium
AATELHD

SEQ ID NO: 413553 - protein, 13 aa, Mycobacterium
AATELKKPRRNQL

SEQ ID NO: 413554 - protein, 9 aa, Mycobacterium
AATENQRGQ

SEQ ID NO: 413555 - protein, 7 aa, Mycobacterium
AATEPEL

SEQ ID NO: 413556 - protein, 29 aa, Mycobacterium
AATEPPPPTTAPPAAPLIPPSTVPATGAG

SEQ ID NO: 413557 - protein, 5 aa, Mycobacterium
AATEQ

SEQ ID NO: 413558 - protein, 29 aa, Mycobacterium
AATERGEHDAADRYQQHHNQASAQTERVD

SEQ ID NO: 413559 - protein, 40 aa, Mycobacterium
AATERLTQERESAGDGDLAAAADAALQAARAAESRHTELS

SEQ ID NO: 413560 - protein, 7 aa, Mycobacterium
AATERRG

SEQ ID NO: 413561 - protein, 7 aa, Mycobacterium
AATERSR

SEQ ID NO: 413562 - protein, 18 aa, Mycobacterium
AATETALKERKESVEDAV

SEQ ID NO: 413563 - protein, 18 aa, Mycobacterium
AATETELKERKESVEDAV

SEQ ID NO: 413564 - protein, 17 aa, Mycobacterium
AATETELKKRKESVEDA

SEQ ID NO: 413565 - protein, 7 aa, Mycobacterium
AATETQY

SEQ ID NO: 413566 - protein, 7 aa, Mycobacterium
AATFGTP

SEQ ID NO: 413567 - protein, 18 aa, Mycobacterium
AATFSSRDPLQEASSAPS

SEQ ID NO: 413568 - protein, 9 aa, Mycobacterium
AATFTAGPN

SEQ ID NO: 413569 - protein, 7 aa, Mycobacterium
AATGAAA

SEQ ID NO: 413570 - protein, 9 aa, Mycobacterium
AATGADKTI

SEQ ID NO: 413571 - protein, 10 aa, Mycobacterium
AATGADPVFP

SEQ ID NO: 413572 - protein, 10 aa, Mycobacterium
AATGAEIGGF

SEQ ID NO: 413573 - protein, 17 aa, Mycobacterium
AATGAEPQVAGKPAPAL

SEQ ID NO: 413574 - protein, 17 aa, Mycobacterium
AATGAEPQVAGKPGPQL

SEQ ID NO: 413575 - protein, 9 aa, Mycobacterium
AATGAERAE

SEQ ID NO: 413576 - protein, 7 aa, Mycobacterium
AATGAGL

SEQ ID NO: 413577 - protein, 7 aa, Mycobacterium
AATGANS

SEQ ID NO: 413578 - protein, 13 aa, Mycobacterium
AATGAPTAANEID

SEQ ID NO: 413579 - protein, 7 aa, Mycobacterium
AATGASL

SEQ ID NO: 413580 - protein, 13 aa, Mycobacterium
AATGATARDSAVD

SEQ ID NO: 413581 - protein, 7 aa, Mycobacterium
AATGATF

SEQ ID NO: 413582 - protein, 8 aa, Mycobacterium
AATGATPV

SEQ ID NO: 413583 - protein, 7 aa, Mycobacterium
AATGAVA

SEQ ID NO: 413584 - protein, 14 aa, Mycobacterium
AATGAVQVSSQAKA

SEQ ID NO: 413585 - protein, 9 aa, Mycobacterium
AATGDGPPL

SEQ ID NO: 413586 - protein, 9 aa, Mycobacterium
AATGDPDLH

SEQ ID NO: 413587 - protein, 6 aa, Mycobacterium
AATGDR

SEQ ID NO: 413588 - protein, 6 aa, Mycobacterium
AATGEN

SEQ ID NO: 413589 - protein, 12 aa, Mycobacterium
AATGEPQATPAY

SEQ ID NO: 413590 - protein, 6 aa, Mycobacterium
AATGEQ

SEQ ID NO: 413591 - protein, 8 aa, Mycobacterium
AATGETIG

SEQ ID NO: 413592 - protein, 7 aa, Mycobacterium
AATGGAG

SEQ ID NO: 413593 - protein, 25 aa, Mycobacterium
AATGGAGGDGGSGGTGRGGTGGVGG

SEQ ID NO: 413594 - protein, 8 aa, Mycobacterium
AATGGETV

SEQ ID NO: 413595 - protein, 16 aa, Mycobacterium
AATGGGSARASGIGAG

SEQ ID NO: 413596 - protein, 8 aa, Mycobacterium
AATGGGVA

SEQ ID NO: 413597 - protein, 6 aa, Mycobacterium
AATGGV

SEQ ID NO: 413598 - protein, 9 aa, Mycobacterium
AATGGVARG

SEQ ID NO: 413599 - protein, 10 aa, Mycobacterium
AATGGVARGA

SEQ ID NO: 413600 - protein, 9 aa, Mycobacterium
AATGGVRRG

SEQ ID NO: 413601 - protein, 11 aa, Mycobacterium
AATGHSAAAAR

SEQ ID NO: 413602 - protein, 9 aa, Mycobacterium
AATGKPTFS

SEQ ID NO: 413603 - protein, 19 aa, Mycobacterium
AATGKQVKVETDTPRGPAG

SEQ ID NO: 413604 - protein, 8 aa, Mycobacterium
AATGLAER

SEQ ID NO: 413605 - protein, 11 aa, Mycobacterium
AATGLDTAAQT

SEQ ID NO: 413606 - protein, 13 aa, Mycobacterium
AATGLGDAPITDA

SEQ ID NO: 413607 - protein, 7 aa, Mycobacterium
AATGLNR

SEQ ID NO: 413608 - protein, 8 aa, Mycobacterium
AATGLRPA

SEQ ID NO: 413609 - protein, 14 aa, Mycobacterium
AATGLTSITPKNDR

SEQ ID NO: 413610 - protein, 5 aa, Mycobacterium
AATGM

SEQ ID NO: 413611 - protein, 8 aa, Mycobacterium
AATGMQPG

SEQ ID NO: 413612 - protein, 7 aa, Mycobacterium
AATGNKD

SEQ ID NO: 413613 - protein, 8 aa, Mycobacterium
AATGNVRG

SEQ ID NO: 413614 - protein, 12 aa, Mycobacterium
AATGPAPEHQPD

SEQ ID NO: 413615 - protein, 10 aa, Mycobacterium
AATGPARQDG

SEQ ID NO: 413616 - protein, 10 aa, Mycobacterium
AATGPGPACE

SEQ ID NO: 413617 - protein, 16 aa, Mycobacterium
AATGPLGGEAAAGARG

SEQ ID NO: 413618 - protein, 10 aa, Mycobacterium
AATGPLSEGP

SEQ ID NO: 413619 - protein, 9 aa, Mycobacterium
AATGPPAPA

SEQ ID NO: 413620 - protein, 16 aa, Mycobacterium
AATGQPAQADAERAAF

SEQ ID NO: 413621 - protein, 15 aa, Mycobacterium
AATGQPTDLDPELAT

SEQ ID NO: 413622 - protein, 12 aa, Mycobacterium
AATGQTARAHGL

SEQ ID NO: 413623 - protein, 5 aa, Mycobacterium
AATGR

SEQ ID NO: 413624 - protein, 6 aa, Mycobacterium
AATGRA

SEQ ID NO: 413625 - protein, 10 aa, Mycobacterium
AATGRDAAHP

SEQ ID NO: 413626 - protein, 7 aa, Mycobacterium
AATGRED

SEQ ID NO: 413627 - protein, 7 aa, Mycobacterium
AATGRGA

SEQ ID NO: 413628 - protein, 8 aa, Mycobacterium
AATGRPVY

SEQ ID NO: 413629 - protein, 6 aa, Mycobacterium
AATGRR

SEQ ID NO: 413630 - protein, 7 aa, Mycobacterium
AATGRRD

SEQ ID NO: 413631 - protein, 9 aa, Mycobacterium
AATGSAPGT

SEQ ID NO: 413632 - protein, 7 aa, Mycobacterium
AATGSDL

SEQ ID NO: 413633 - protein, 7 aa, Mycobacterium
AATGSFE

SEQ ID NO: 413634 - protein, 8 aa, Mycobacterium
AATGSGQH

SEQ ID NO: 413635 - protein, 8 aa, Mycobacterium
AATGSPPA

SEQ ID NO: 413636 - protein, 10 aa, Mycobacterium
AATGSSGPGL

SEQ ID NO: 413637 - protein, 5 aa, Mycobacterium
AATGT

SEQ ID NO: 413638 - protein, 6 aa, Mycobacterium
AATGTA

SEQ ID NO: 413639 - protein, 6 aa, Mycobacterium
AATGTG

SEQ ID NO: 413640 - protein, 8 aa, Mycobacterium
AATGTQYR

SEQ ID NO: 413641 - protein, 6 aa, Mycobacterium
AATGTT

SEQ ID NO: 413642 - protein, 6 aa, Mycobacterium
AATGVT

SEQ ID NO: 413643 - protein, 9 aa, Mycobacterium
AATGYSDQA

SEQ ID NO: 413644 - protein, 5 aa, Mycobacterium
AATHA

SEQ ID NO: 413645 - protein, 7 aa, Mycobacterium
AATHPTG

SEQ ID NO: 413646 - protein, 4 aa, Mycobacterium
AATI

SEQ ID NO: 413647 - protein, 8 aa, Mycobacterium
AATITPPG

SEQ ID NO: 413648 - protein, 31 aa, Mycobacterium
AATITPPGTPGMVGPPGPAYGDTISGTNLAG

SEQ ID NO: 413649 - protein, 13 aa, Mycobacterium
AATKAAAERGLGN

SEQ ID NO: 413650 - protein, 6 aa, Mycobacterium
AATKAL

SEQ ID NO: 413651 - protein, 18 aa, Mycobacterium
AATKDLQDPTLDAKSRRA

SEQ ID NO: 413652 - protein, 20 aa, Mycobacterium
AATKKPPGDSFKDGSYDPSR

SEQ ID NO: 413653 - protein, 20 aa, Mycobacterium
AATKKPPGESFKDGSYDPSR

SEQ ID NO: 413654 - protein, 13 aa, Mycobacterium
AATKLESGDQGTS

SEQ ID NO: 413655 - protein, 8 aa, Mycobacterium
AATKPDRL

SEQ ID NO: 413656 - protein, 7 aa, Mycobacterium
AATKPGS

SEQ ID NO: 413657 - protein, 20 aa, Mycobacterium
AATKRPPGESFRDGSYDPSR

SEQ ID NO: 413658 - protein, 6 aa, Mycobacterium
AATKSH

SEQ ID NO: 413659 - protein, 8 aa, Mycobacterium
AATLAEAG

SEQ ID NO: 413660 - protein, 10 aa, Mycobacterium
AATLDTAGLG

SEQ ID NO: 413661 - protein, 8 aa, Mycobacterium
AATLNDGD

SEQ ID NO: 413662 - protein, 5 aa, Mycobacterium
AATLP

SEQ ID NO: 413663 - protein, 10 aa, Mycobacterium
AATLSGGEAQ

SEQ ID NO: 413664 - protein, 9 aa, Mycobacterium
AATLTREAG

SEQ ID NO: 413665 - protein, 9 aa, Mycobacterium
AATMTGGAA

SEQ ID NO: 413666 - protein, 6 aa, Mycobacterium
AATNAA

SEQ ID NO: 413667 - protein, 8 aa, Mycobacterium
AATNAGGL

SEQ ID NO: 413668 - protein, 7 aa, Mycobacterium
AATNDAD

SEQ ID NO: 413669 - protein, 11 aa, Mycobacterium
AATNGDAVTLS

SEQ ID NO: 413670 - protein, 10 aa, Mycobacterium
AATNGIEDID

SEQ ID NO: 413671 - protein, 7 aa, Mycobacterium
AATNGQT

SEQ ID NO: 413672 - protein, 10 aa, Mycobacterium
AATNPAASAI

SEQ ID NO: 413673 - protein, 8 aa, Mycobacterium
AATNPPQQ

SEQ ID NO: 413674 - protein, 8 aa, Mycobacterium
AATNPTIA

SEQ ID NO: 413675 - protein, 7 aa, Mycobacterium
AATNPTV

SEQ ID NO: 413676 - protein, 6 aa, Mycobacterium
AATNTV

SEQ ID NO: 413677 - protein, 16 aa, Mycobacterium
AATNVDAPLRSRSLAT

SEQ ID NO: 413678 - protein, 12 aa, Mycobacterium
AATPAADGHPSG

SEQ ID NO: 413679 - protein, 7 aa, Mycobacterium
AATPAAQ

SEQ ID NO: 413680 - protein, 7 aa, Mycobacterium
AATPAAS

SEQ ID NO: 413681 - protein, 16 aa, Mycobacterium
AATPAAVEASGSPIPQ

SEQ ID NO: 413682 - protein, 6 aa, Mycobacterium
AATPAE

SEQ ID NO: 413683 - protein, 8 aa, Mycobacterium
AATPAGGV

SEQ ID NO: 413684 - protein, 18 aa, Mycobacterium
AATPAGSTPAAPPQQSLP

SEQ ID NO: 413685 - protein, 17 aa, Mycobacterium
AATPAPARVDVDGKGDV

SEQ ID NO: 413686 - protein, 8 aa, Mycobacterium
AATPARAY

SEQ ID NO: 413687 - protein, 10 aa, Mycobacterium
AATPARTRGE

SEQ ID NO: 413688 - protein, 8 aa, Mycobacterium
AATPASPV

SEQ ID NO: 413689 - protein, 6 aa, Mycobacterium
AATPAV

SEQ ID NO: 413690 - protein, 7 aa, Mycobacterium
AATPAVE

SEQ ID NO: 413691 - protein, 5 aa, Mycobacterium
AATPC

SEQ ID NO: 413692 - protein, 8 aa, Mycobacterium
AATPDAKT

SEQ ID NO: 413693 - protein, 15 aa, Mycobacterium
AATPDVDEELSAAAD

SEQ ID NO: 413694 - protein, 9 aa, Mycobacterium
AATPEDAYE

SEQ ID NO: 413695 - protein, 15 aa, Mycobacterium
AATPEPVAHAVADEH

SEQ ID NO: 413696 - protein, 9 aa, Mycobacterium
AATPGEAVD

SEQ ID NO: 413697 - protein, 10 aa, Mycobacterium
AATPGKPDVP

SEQ ID NO: 413698 - protein, 7 aa, Mycobacterium
AATPGLA

SEQ ID NO: 413699 - protein, 14 aa, Mycobacterium
AATPGPEIVDLSKP

SEQ ID NO: 413700 - protein, 11 aa, Mycobacterium
AATPGQPQPYR

SEQ ID NO: 413701 - protein, 6 aa, Mycobacterium
AATPGR

SEQ ID NO: 413702 - protein, 7 aa, Mycobacterium
AATPGRD

SEQ ID NO: 413703 - protein, 8 aa, Mycobacterium
AATPGTAQ

SEQ ID NO: 413704 - protein, 6 aa, Mycobacterium
AATPHG

SEQ ID NO: 413705 - protein, 8 aa, Mycobacterium
AATPLGGD

SEQ ID NO: 413706 - protein, 7 aa, Mycobacterium
AATPMPG

SEQ ID NO: 413707 - protein, 8 aa, Mycobacterium
AATPMTET

SEQ ID NO: 413708 - protein, 7 aa, Mycobacterium
AATPNGI

SEQ ID NO: 413709 - protein, 8 aa, Mycobacterium
AATPPEYL

SEQ ID NO: 413710 - protein, 7 aa, Mycobacterium
AATPPLP

SEQ ID NO: 413711 - protein, 17 aa, Mycobacterium
AATPPPATVGAPETVPD

SEQ ID NO: 413712 - protein, 8 aa, Mycobacterium
AATPPQMS

SEQ ID NO: 413713 - protein, 5 aa, Mycobacterium
AATPQ

SEQ ID NO: 413714 - protein, 48 aa, Mycobacterium
AATPRDVPAPAALDAPLDAPGINGEPAPLAPPPGDDVPPPADPAPPVE

SEQ ID NO: 413715 - protein, 7 aa, Mycobacterium
AATPREA

SEQ ID NO: 413716 - protein, 9 aa, Mycobacterium
AATPRLTRR

SEQ ID NO: 413717 - protein, 7 aa, Mycobacterium
AATPRNV

SEQ ID NO: 413718 - protein, 14 aa, Mycobacterium
AATPRRPLGDVLQI

SEQ ID NO: 413719 - protein, 12 aa, Mycobacterium
AATPSASTTGLQ

SEQ ID NO: 413720 - protein, 7 aa, Mycobacterium
AATPSGW

SEQ ID NO: 413721 - protein, 8 aa, Mycobacterium
AATPSLRT

SEQ ID NO: 413722 - protein, 12 aa, Mycobacterium
AATPSLTGGTPA

SEQ ID NO: 413723 - protein, 9 aa, Mycobacterium
AATPSRAYA

SEQ ID NO: 413724 - protein, 9 aa, Mycobacterium
AATPTDAAK

SEQ ID NO: 413725 - protein, 19 aa, Mycobacterium
AATPTDAAKKAVPDTAAEQ

SEQ ID NO: 413726 - protein, 18 aa, Mycobacterium
AATPTDAAKKLVPDAAAE

SEQ ID NO: 413727 - protein, 10 aa, Mycobacterium
AATPTDAAKR

SEQ ID NO: 413728 - protein, 18 aa, Mycobacterium
AATPTDAAKRVVPDTAAE

SEQ ID NO: 413729 - protein, 11 aa, Mycobacterium
AATPTDDSRTL

SEQ ID NO: 413730 - protein, 8 aa, Mycobacterium
AATPTGAL

SEQ ID NO: 413731 - protein, 6 aa, Mycobacterium
AATPTI

SEQ ID NO: 413732 - protein, 12 aa, Mycobacterium
AATPTIEMKGLL

SEQ ID NO: 413733 - protein, 6 aa, Mycobacterium
AATPVD

SEQ ID NO: 413734 - protein, 13 aa, Mycobacterium
AATPVNPIDQYGQ

SEQ ID NO: 413735 - protein, 15 aa, Mycobacterium
AATPVPAAAPIPLPP

SEQ ID NO: 413736 - protein, 31 aa, Mycobacterium
AATPVTDDESAAVGEARSVTPRTRAGRSLPP

SEQ ID NO: 413737 - protein, 4 aa, Mycobacterium
AATQ

SEQ ID NO: 413738 - protein, 7 aa, Mycobacterium
AATQAQI

SEQ ID NO: 413739 - protein, 7 aa, Mycobacterium
AATQATL

SEQ ID NO: 413740 - protein, 7 aa, Mycobacterium
AATQGAP

SEQ ID NO: 413741 - protein, 20 aa, Mycobacterium
AATQKPPGESFKDGSYDPSR

SEQ ID NO: 413742 - protein, 5 aa, Mycobacterium
AATQL

SEQ ID NO: 413743 - protein, 12 aa, Mycobacterium
AATQLGDAHDPA

SEQ ID NO: 413744 - protein, 6 aa, Mycobacterium
AATQPF

SEQ ID NO: 413745 - protein, 8 aa, Mycobacterium
AATQPSIE

SEQ ID NO: 413746 - protein, 6 aa, Mycobacterium
AATQPV

SEQ ID NO: 413747 - protein, 9 aa, Mycobacterium
AATQRGDYR

SEQ ID NO: 413748 - protein, 7 aa, Mycobacterium
AATQRWS

SEQ ID NO: 413749 - protein, 11 aa, Mycobacterium
AATQSSPATFS

SEQ ID NO: 413750 - protein, 11 aa, Mycobacterium
AATQTRRTPEH

SEQ ID NO: 413751 - protein, 12 aa, Mycobacterium
AATRAANGRSPV

SEQ ID NO: 413752 - protein, 13 aa, Mycobacterium
AATRAAQERGLST

SEQ ID NO: 413753 - protein, 13 aa, Mycobacterium
AATRAARERGLTT

SEQ ID NO: 413754 - protein, 8 aa, Mycobacterium
AATRAEEG

SEQ ID NO: 413755 - protein, 8 aa, Mycobacterium
AATRAFGP

SEQ ID NO: 413756 - protein, 6 aa, Mycobacterium
AATRAL

SEQ ID NO: 413757 - protein, 7 aa, Mycobacterium
AATRARG

SEQ ID NO: 413758 - protein, 6 aa, Mycobacterium
AATRAT

SEQ ID NO: 413759 - protein, 5 aa, Mycobacterium
AATRD

SEQ ID NO: 413760 - protein, 8 aa, Mycobacterium
AATRDEPG

SEQ ID NO: 413761 - protein, 11 aa, Mycobacterium
AATRDGAEGRI

SEQ ID NO: 413762 - protein, 13 aa, Mycobacterium
AATRDPRAYDQPD

SEQ ID NO: 413763 - protein, 5 aa, Mycobacterium
AATRE

SEQ ID NO: 413764 - protein, 8 aa, Mycobacterium
AATREPGR

SEQ ID NO: 413765 - protein, 7 aa, Mycobacterium
AATRGAW

SEQ ID NO: 413766 - protein, 13 aa, Mycobacterium
AATRGELAPGADS

SEQ ID NO: 413767 - protein, 8 aa, Mycobacterium
AATRGGWR

SEQ ID NO: 413768 - protein, 28 aa, Mycobacterium
AATRGGWRAAGDRDGKAGTLTPGAPASY

SEQ ID NO: 413769 - protein, 27 aa, Mycobacterium
AATRGGWRAGGVRDGVSGTLTPGAPAS

SEQ ID NO: 413770 - protein, 8 aa, Mycobacterium
AATRGKEM

SEQ ID NO: 413771 - protein, 8 aa, Mycobacterium
AATRITGI

SEQ ID NO: 413772 - protein, 5 aa, Mycobacterium
AATRL

SEQ ID NO: 413773 - protein, 5 aa, Mycobacterium
AATRM

SEQ ID NO: 413774 - protein, 13 aa, Mycobacterium
AATRNSAGFGAPR

SEQ ID NO: 413775 - protein, 6 aa, Mycobacterium
AATRPP

SEQ ID NO: 413776 - protein, 12 aa, Mycobacterium
AATRPVGGAATA

SEQ ID NO: 413777 - protein, 19 aa, Mycobacterium
AATRQGRGWPTDPQLGESV

SEQ ID NO: 413778 - protein, 9 aa, Mycobacterium
AATRQRAQE

SEQ ID NO: 413779 - protein, 7 aa, Mycobacterium
AATRRES

SEQ ID NO: 413780 - protein, 7 aa, Mycobacterium
AATRRPD

SEQ ID NO: 413781 - protein, 14 aa, Mycobacterium
AATRRTGGHPAKRT

SEQ ID NO: 413782 - protein, 8 aa, Mycobacterium
AATRSPDV

SEQ ID NO: 413783 - protein, 6 aa, Mycobacterium
AATRSR

SEQ ID NO: 413784 - protein, 15 aa, Mycobacterium
AATRSRSAPPDALGR

SEQ ID NO: 413785 - protein, 15 aa, Mycobacterium
AATRSSGQNSAGYGR

SEQ ID NO: 413786 - protein, 15 aa, Mycobacterium
AATRSSGQSSAGYGR

SEQ ID NO: 413787 - protein, 7 aa, Mycobacterium
AATSAED

SEQ ID NO: 413788 - protein, 11 aa, Mycobacterium
AATSAGHVDPG

SEQ ID NO: 413789 - protein, 14 aa, Mycobacterium
AATSAHGLATPSGI

SEQ ID NO: 413790 - protein, 6 aa, Mycobacterium
AATSAK

SEQ ID NO: 413791 - protein, 10 aa, Mycobacterium
AATSARRNER

SEQ ID NO: 413792 - protein, 6 aa, Mycobacterium
AATSAS

SEQ ID NO: 413793 - protein, 13 aa, Mycobacterium
AATSASAATAHTS

SEQ ID NO: 413794 - protein, 7 aa, Mycobacterium
AATSASK

SEQ ID NO: 413795 - protein, 8 aa, Mycobacterium
AATSDSGV

SEQ ID NO: 413796 - protein, 11 aa, Mycobacterium
AATSDTRDSPA

SEQ ID NO: 413797 - protein, 13 aa, Mycobacterium
AATSEGRSPDGVV

SEQ ID NO: 413798 - protein, 12 aa, Mycobacterium
AATSEGRSPHGL

SEQ ID NO: 413799 - protein, 12 aa, Mycobacterium
AATSEGRSPQGL

SEQ ID NO: 413800 - protein, 12 aa, Mycobacterium
AATSFSSVTSEL

SEQ ID NO: 413801 - protein, 11 aa, Mycobacterium
AATSGAAARKA

SEQ ID NO: 413802 - protein, 6 aa, Mycobacterium
AATSID

SEQ ID NO: 413803 - protein, 5 aa, Mycobacterium
AATSL

SEQ ID NO: 413804 - protein, 21 aa, Mycobacterium
AATSLDTAAQTVTLDDGTTLR

SEQ ID NO: 413805 - protein, 15 aa, Mycobacterium
AATSNTLPEQLGEGR

SEQ ID NO: 413806 - protein, 24 aa, Mycobacterium
AATSPTSSPSPAGCRGQPASTTRG

SEQ ID NO: 413807 - protein, 6 aa, Mycobacterium
AATSQG

SEQ ID NO: 413808 - protein, 5 aa, Mycobacterium
AATSR

SEQ ID NO: 413809 - protein, 9 aa, Mycobacterium
AATSRDELQ

SEQ ID NO: 413810 - protein, 11 aa, Mycobacterium
AATSRDIGEAE

SEQ ID NO: 413811 - protein, 6 aa, Mycobacterium
AATSRL

SEQ ID NO: 413812 - protein, 7 aa, Mycobacterium
AATSRPA

SEQ ID NO: 413813 - protein, 13 aa, Mycobacterium
AATSRRPKVRYPA

SEQ ID NO: 413814 - protein, 5 aa, Mycobacterium
AATSS

SEQ ID NO: 413815 - protein, 8 aa, Mycobacterium
AATSSELP

SEQ ID NO: 413816 - protein, 10 aa, Mycobacterium
AATSSPSDNL

SEQ ID NO: 413817 - protein, 6 aa, Mycobacterium
AATSTI

SEQ ID NO: 413818 - protein, 5 aa, Mycobacterium
AATSV

SEQ ID NO: 413819 - protein, 6 aa, Mycobacterium
AATSVA

SEQ ID NO: 413820 - protein, 12 aa, Mycobacterium
AATSVAERVAGA

SEQ ID NO: 413821 - protein, 8 aa, Mycobacterium
AATSVLPG

SEQ ID NO: 413822 - protein, 12 aa, Mycobacterium
AATSYASAEATN

SEQ ID NO: 413823 - protein, 6 aa, Mycobacterium
AATTAA

SEQ ID NO: 413824 - protein, 12 aa, Mycobacterium
AATTAAAAQTTS

SEQ ID NO: 413825 - protein, 9 aa, Mycobacterium
AATTAAPED

SEQ ID NO: 413826 - protein, 6 aa, Mycobacterium
AATTAD

SEQ ID NO: 413827 - protein, 8 aa, Mycobacterium
AATTADGR

SEQ ID NO: 413828 - protein, 11 aa, Mycobacterium
AATTAESDEDR

SEQ ID NO: 413829 - protein, 16 aa, Mycobacterium
AATTAGDGAGVGTPVP

SEQ ID NO: 413830 - protein, 11 aa, Mycobacterium
AATTAGNPEIR

SEQ ID NO: 413831 - protein, 6 aa, Mycobacterium
AATTAL

SEQ ID NO: 413832 - protein, 8 aa, Mycobacterium
AATTATRK

SEQ ID NO: 413833 - protein, 5 aa, Mycobacterium
AATTD

SEQ ID NO: 413834 - protein, 6 aa, Mycobacterium
AATTDI

SEQ ID NO: 413835 - protein, 22 aa, Mycobacterium
AATTDRLRRQKQAKRVRDDVPS

SEQ ID NO: 413836 - protein, 14 aa, Mycobacterium
AATTDTAEQERLYG

SEQ ID NO: 413837 - protein, 8 aa, Mycobacterium
AATTEADS

SEQ ID NO: 413838 - protein, 16 aa, Mycobacterium
AATTGDDIAAEAGLST

SEQ ID NO: 413839 - protein, 6 aa, Mycobacterium
AATTGI

SEQ ID NO: 413840 - protein, 7 aa, Mycobacterium
AATTGIA

SEQ ID NO: 413841 - protein, 10 aa, Mycobacterium
AATTGPDGSV

SEQ ID NO: 413842 - protein, 42 aa, Mycobacterium
AATTGTSCATGRGPRACTGTGATTRAGTATGTRTTDGTGRHV

SEQ ID NO: 413843 - protein, 8 aa, Mycobacterium
AATTKDQA

SEQ ID NO: 413844 - protein, 17 aa, Mycobacterium
AATTNHPPRMPHPPGPH

SEQ ID NO: 413845 - protein, 19 aa, Mycobacterium
AATTPAKGLPTITDAQPYG

SEQ ID NO: 413846 - protein, 10 aa, Mycobacterium
AATTPASDAG

SEQ ID NO: 413847 - protein, 6 aa, Mycobacterium
AATTPD

SEQ ID NO: 413848 - protein, 11 aa, Mycobacterium
AATTPDDPQPF

SEQ ID NO: 413849 - protein, 10 aa, Mycobacterium
AATTPDQPQP

SEQ ID NO: 413850 - protein, 8 aa, Mycobacterium
AATTPPQR

SEQ ID NO: 413851 - protein, 7 aa, Mycobacterium
AATTQAA

SEQ ID NO: 413852 - protein, 5 aa, Mycobacterium
AATTR

SEQ ID NO: 413853 - protein, 11 aa, Mycobacterium
AATTSEYAARG

SEQ ID NO: 413854 - protein, 8 aa, Mycobacterium
AATTSRGP

SEQ ID NO: 413855 - protein, 13 aa, Mycobacterium
AATTSSAQSQASL

SEQ ID NO: 413856 - protein, 6 aa, Mycobacterium
AATTST

SEQ ID NO: 413857 - protein, 8 aa, Mycobacterium
AATTTRRI

SEQ ID NO: 413858 - protein, 7 aa, Mycobacterium
AATTTSS

SEQ ID NO: 413859 - protein, 8 aa, Mycobacterium
AATTVDED

SEQ ID NO: 413860 - protein, 8 aa, Mycobacterium
AATTVPKD

SEQ ID NO: 413861 - protein, 5 aa, Mycobacterium
AATVA

SEQ ID NO: 413862 - protein, 13 aa, Mycobacterium
AATVAANHPDMAD

SEQ ID NO: 413863 - protein, 6 aa, Mycobacterium
AATVDA

SEQ ID NO: 413864 - protein, 10 aa, Mycobacterium
AATVDALSGG

SEQ ID NO: 413865 - protein, 9 aa, Mycobacterium
AATVDGESD

SEQ ID NO: 413866 - protein, 9 aa, Mycobacterium
AATVKPGSE

SEQ ID NO: 413867 - protein, 16 aa, Mycobacterium
AATVPAAAAAAAPAET

SEQ ID NO: 413868 - protein, 7 aa, Mycobacterium
AATVPPA

SEQ ID NO: 413869 - protein, 10 aa, Mycobacterium
AATVQANGSA

SEQ ID NO: 413870 - protein, 6 aa, Mycobacterium
AATVTA

SEQ ID NO: 413871 - protein, 14 aa, Mycobacterium
AATVTDTDGNTIDT

SEQ ID NO: 413872 - protein, 15 aa, Mycobacterium
AATYPGKAMPGNSAR

SEQ ID NO: 413873 - protein, 6 aa, Mycobacterium
AATYRS

SEQ ID NO: 413874 - protein, 6 aa, Mycobacterium
AAVAAG

SEQ ID NO: 413875 - protein, 29 aa, Mycobacterium
AAVAASDIAAEGLDTTRARAQEAGAADRL

SEQ ID NO: 413876 - protein, 12 aa, Mycobacterium
AAVADAQESPFA

SEQ ID NO: 413877 - protein, 5 aa, Mycobacterium
AAVAE

SEQ ID NO: 413878 - protein, 6 aa, Mycobacterium
AAVAGG

SEQ ID NO: 413879 - protein, 12 aa, Mycobacterium
AAVAGKESNNLL

SEQ ID NO: 413880 - protein, 20 aa, Mycobacterium
AAVAKAQAELDADAPEPDEE

SEQ ID NO: 413881 - protein, 5 aa, Mycobacterium
AAVAP

SEQ ID NO: 413882 - protein, 8 aa, Mycobacterium
AAVAPDDV

SEQ ID NO: 413883 - protein, 6 aa, Mycobacterium
AAVAPT

SEQ ID NO: 413884 - protein, 6 aa, Mycobacterium
AAVAQR

SEQ ID NO: 413885 - protein, 12 aa, Mycobacterium
AAVASGEELTPA

SEQ ID NO: 413886 - protein, 4 aa, Mycobacterium
AAVD

SEQ ID NO: 413887 - protein, 6 aa, Mycobacterium
AAVDAD

SEQ ID NO: 413888 - protein, 6 aa, Mycobacterium
AAVDET

SEQ ID NO: 413889 - protein, 5 aa, Mycobacterium
AAVDG

SEQ ID NO: 413890 - protein, 9 aa, Mycobacterium
AAVDGGDKI

SEQ ID NO: 413891 - protein, 9 aa, Mycobacterium
AAVDGGVEQ

SEQ ID NO: 413892 - protein, 8 aa, Mycobacterium
AAVDGSGL

SEQ ID NO: 413893 - protein, 16 aa, Mycobacterium
AAVDPARAGLPADSRV

SEQ ID NO: 413894 - protein, 8 aa, Mycobacterium
AAVDPDAD

SEQ ID NO: 413895 - protein, 11 aa, Mycobacterium
AAVDPDNNTVT

SEQ ID NO: 413896 - protein, 6 aa, Mycobacterium
AAVDTA

SEQ ID NO: 413897 - protein, 4 aa, Mycobacterium
AAVE

SEQ ID NO: 413898 - protein, 5 aa, Mycobacterium
AAVEA

SEQ ID NO: 413899 - protein, 10 aa, Mycobacterium
AAVEAAGGTV

SEQ ID NO: 413900 - protein, 7 aa, Mycobacterium
AAVEADG

SEQ ID NO: 413901 - protein, 15 aa, Mycobacterium
AAVEEPAPLESEAAA

SEQ ID NO: 413902 - protein, 8 aa, Mycobacterium
AAVEGLSG

SEQ ID NO: 413903 - protein, 12 aa, Mycobacterium
AAVEKAAKDGGY

SEQ ID NO: 413904 - protein, 8 aa, Mycobacterium
AAVEQSDD

SEQ ID NO: 413905 - protein, 10 aa, Mycobacterium
AAVEQTTSQL

SEQ ID NO: 413906 - protein, 8 aa, Mycobacterium
AAVGADSE

SEQ ID NO: 413907 - protein, 12 aa, Mycobacterium
AAVGAGQELTPT

SEQ ID NO: 413908 - protein, 5 aa, Mycobacterium
AAVGD

SEQ ID NO: 413909 - protein, 9 aa, Mycobacterium
AAVGDGAPE

SEQ ID NO: 413910 - protein, 6 aa, Mycobacterium
AAVGDP

SEQ ID NO: 413911 - protein, 7 aa, Mycobacterium
AAVGDRE

SEQ ID NO: 413912 - protein, 11 aa, Mycobacterium
AAVGDTVDGRS

SEQ ID NO: 413913 - protein, 18 aa, Mycobacterium
AAVGEDPDFGRGRSAYDR

SEQ ID NO: 413914 - protein, 10 aa, Mycobacterium
AAVGGEARAP

SEQ ID NO: 413915 - protein, 8 aa, Mycobacterium
AAVGGNAD

SEQ ID NO: 413916 - protein, 43 aa, Mycobacterium
AAVGGNGGTGGDGGGLSGSGGAGGNGAGGGTGGTGGDGGRARG

SEQ ID NO: 413917 - protein, 8 aa, Mycobacterium
AAVGGTPQ

SEQ ID NO: 413918 - protein, 14 aa, Mycobacterium
AAVGNGGSGGAGGA

SEQ ID NO: 413919 - protein, 9 aa, Mycobacterium
AAVGPTGSV

SEQ ID NO: 413920 - protein, 37 aa, Mycobacterium
AAVGQTQTSQTDTNQGAAVGHTDGMYPNTGEPTDGGL

SEQ ID NO: 413921 - protein, 11 aa, Mycobacterium
AAVGSGDAETI

SEQ ID NO: 413922 - protein, 8 aa, Mycobacterium
AAVGSRPA

SEQ ID NO: 413923 - protein, 14 aa, Mycobacterium
AAVGSTVAASPVAA

SEQ ID NO: 413924 - protein, 10 aa, Mycobacterium
AAVGTAAETA

SEQ ID NO: 413925 - protein, 11 aa, Mycobacterium
AAVGTAAETAG

SEQ ID NO: 413926 - protein, 12 aa, Mycobacterium
AAVGTAGETPAL

SEQ ID NO: 413927 - protein, 20 aa, Mycobacterium
AAVGTTAPAPPSEQLVNTSI

SEQ ID NO: 413928 - protein, 12 aa, Mycobacterium
AAVHRGSGPDRA

SEQ ID NO: 413929 - protein, 4 aa, Mycobacterium
AAVK

SEQ ID NO: 413930 - protein, 6 aa, Mycobacterium
AAVKAE

SEQ ID NO: 413931 - protein, 5 aa, Mycobacterium
AAVNA

SEQ ID NO: 413932 - protein, 13 aa, Mycobacterium
AAVNDDGVSVRPT

SEQ ID NO: 413933 - protein, 13 aa, Mycobacterium
AAVPAEAQQPPGI

SEQ ID NO: 413934 - protein, 5 aa, Mycobacterium
AAVPD

SEQ ID NO: 413935 - protein, 7 aa, Mycobacterium
AAVPDGD

SEQ ID NO: 413936 - protein, 13 aa, Mycobacterium
AAVPDPGEFTDED

SEQ ID NO: 413937 - protein, 6 aa, Mycobacterium
AAVPPP

SEQ ID NO: 413938 - protein, 10 aa, Mycobacterium
AAVPPPPDPF

SEQ ID NO: 413939 - protein, 39 aa, Mycobacterium
AAVPPQPSRASSSAVAADTAVAAGTSGTSDTAVAAGSAV

SEQ ID NO: 413940 - protein, 7 aa, Mycobacterium
AAVPPRP

SEQ ID NO: 413941 - protein, 13 aa, Mycobacterium
AAVPSGASTGEHE

SEQ ID NO: 413942 - protein, 8 aa, Mycobacterium
AAVPTASA

SEQ ID NO: 413943 - protein, 8 aa, Mycobacterium
AAVPTTGI

SEQ ID NO: 413944 - protein, 6 aa, Mycobacterium
AAVQPG

SEQ ID NO: 413945 - protein, 11 aa, Mycobacterium
AAVQTSEPTAT

SEQ ID NO: 413946 - protein, 4 aa, Mycobacterium
AAVR

SEQ ID NO: 413947 - protein, 5 aa, Mycobacterium
AAVRA

SEQ ID NO: 413948 - protein, 6 aa, Mycobacterium
AAVRDG

SEQ ID NO: 413949 - protein, 10 aa, Mycobacterium
AAVRDGRPTV

SEQ ID NO: 413950 - protein, 9 aa, Mycobacterium
AAVRDHDPS

SEQ ID NO: 413951 - protein, 12 aa, Mycobacterium
AAVREAGAPIEE

SEQ ID NO: 413952 - protein, 8 aa, Mycobacterium
AAVREHDA

SEQ ID NO: 413953 - protein, 7 aa, Mycobacterium
AAVRGAD

SEQ ID NO: 413954 - protein, 11 aa, Mycobacterium
AAVRGDPSRQV

SEQ ID NO: 413955 - protein, 10 aa, Mycobacterium
AAVRGEDPLL

SEQ ID NO: 413956 - protein, 7 aa, Mycobacterium
AAVRGER

SEQ ID NO: 413957 - protein, 10 aa, Mycobacterium
AAVRSERSLP

SEQ ID NO: 413958 - protein, 20 aa, Mycobacterium
AAVRSTAQGPPSGPPTAVAR

SEQ ID NO: 413959 - protein, 7 aa, Mycobacterium
AAVRTPS

SEQ ID NO: 413960 - protein, 10 aa, Mycobacterium
AAVSAGSLGG

SEQ ID NO: 413961 - protein, 11 aa, Mycobacterium
AAVSAPPDPET

SEQ ID NO: 413962 - protein, 21 aa, Mycobacterium
AAVSATADGTVEFSTGTSTRA

SEQ ID NO: 413963 - protein, 6 aa, Mycobacterium
AAVSGG

SEQ ID NO: 413964 - protein, 7 aa, Mycobacterium
AAVSGGL

SEQ ID NO: 413965 - protein, 9 aa, Mycobacterium
AAVSGGQGS

SEQ ID NO: 413966 - protein, 8 aa, Mycobacterium
AAVSPDDV

SEQ ID NO: 413967 - protein, 6 aa, Mycobacterium
AAVSPP

SEQ ID NO: 413968 - protein, 8 aa, Mycobacterium
AAVSPTTA

SEQ ID NO: 413969 - protein, 22 aa, Mycobacterium
AAVSPYGSGALAGSSLGLDPDA

SEQ ID NO: 413970 - protein, 16 aa, Mycobacterium
AAVSQAAGGGSAGNTA

SEQ ID NO: 413971 - protein, 14 aa, Mycobacterium
AAVSQEAPAEAAEP

SEQ ID NO: 413972 - protein, 23 aa, Mycobacterium
AAVSRAQAEADTIRAQADAKRVE

SEQ ID NO: 413973 - protein, 8 aa, Mycobacterium
AAVSRGSL

SEQ ID NO: 413974 - protein, 12 aa, Mycobacterium
AAVSTPEHGTSQ

SEQ ID NO: 413975 - protein, 7 aa, Mycobacterium
AAVTADD

SEQ ID NO: 413976 - protein, 17 aa, Mycobacterium
AAVTEAATASASSDITA

SEQ ID NO: 413977 - protein, 14 aa, Mycobacterium
AAVTGNGRADKAQV

SEQ ID NO: 413978 - protein, 14 aa, Mycobacterium
AAVTGNGRADKSQV

SEQ ID NO: 413979 - protein, 13 aa, Mycobacterium
AAVTGNGTADKAQ

SEQ ID NO: 413980 - protein, 15 aa, Mycobacterium
AAVTGSGRADKSQVT

SEQ ID NO: 413981 - protein, 10 aa, Mycobacterium
AAVTKTPDFG

SEQ ID NO: 413982 - protein, 8 aa, Mycobacterium
AAVTPDDV

SEQ ID NO: 413983 - protein, 8 aa, Mycobacterium
AAVTSNNR

SEQ ID NO: 413984 - protein, 6 aa, Mycobacterium
AAVTSR

SEQ ID NO: 413985 - protein, 11 aa, Mycobacterium
AAVTTINPDAT

SEQ ID NO: 413986 - protein, 4 aa, Mycobacterium
AAVY

SEQ ID NO: 413987 - protein, 9 aa, Mycobacterium
AAWETGDAV

SEQ ID NO: 413988 - protein, 5 aa, Mycobacterium
AAWGG

SEQ ID NO: 413989 - protein, 8 aa, Mycobacterium
AAWPGTDR

SEQ ID NO: 413990 - protein, 8 aa, Mycobacterium
AAWPSDAG

SEQ ID NO: 413991 - protein, 12 aa, Mycobacterium
AAWQDGTEASLD

SEQ ID NO: 413992 - protein, 12 aa, Mycobacterium
AAWQGPASAAMA

SEQ ID NO: 413993 - protein, 9 aa, Mycobacterium
AAWQGPSAA

SEQ ID NO: 413994 - protein, 4 aa, Mycobacterium
AAWR

SEQ ID NO: 413995 - protein, 5 aa, Mycobacterium
AAWTD

SEQ ID NO: 413996 - protein, 7 aa, Mycobacterium
AAWTDTD

SEQ ID NO: 413997 - protein, 8 aa, Mycobacterium
AAWTPQTS

SEQ ID NO: 413998 - protein, 15 aa, Mycobacterium
AAYAATADPRYAPPP

SEQ ID NO: 413999 - protein, 11 aa, Mycobacterium
AAYADNATGTV

SEQ ID NO: 414000 - protein, 6 aa, Mycobacterium
AAYADS

SEQ ID NO: 414001 - protein, 5 aa, Mycobacterium
AAYAE

SEQ ID NO: 414002 - protein, 11 aa, Mycobacterium
AAYAENARGDV

SEQ ID NO: 414003 - protein, 12 aa, Mycobacterium
AAYAGAEATAKQ

SEQ ID NO: 414004 - protein, 11 aa, Mycobacterium
AAYAGARDADR

SEQ ID NO: 414005 - protein, 14 aa, Mycobacterium
AAYAGEKAKDDPFT

SEQ ID NO: 414006 - protein, 7 aa, Mycobacterium
AAYAKTG

SEQ ID NO: 414007 - protein, 16 aa, Mycobacterium
AAYAPDSPQPDPRPME

SEQ ID NO: 414008 - protein, 10 aa, Mycobacterium
AAYAPSPRGR

SEQ ID NO: 414009 - protein, 6 aa, Mycobacterium
AAYAQA

SEQ ID NO: 414010 - protein, 9 aa, Mycobacterium
AAYAQADDT

SEQ ID NO: 414011 - protein, 9 aa, Mycobacterium
AAYAQADKT

SEQ ID NO: 414012 - protein, 6 aa, Mycobacterium
AAYARA

SEQ ID NO: 414013 - protein, 9 aa, Mycobacterium
AAYATSAEV

SEQ ID NO: 414014 - protein, 19 aa, Mycobacterium
AAYDGATAEIAAERTPTFD

SEQ ID NO: 414015 - protein, 5 aa, Mycobacterium
AAYDR

SEQ ID NO: 414016 - protein, 4 aa, Mycobacterium
AAYE

SEQ ID NO: 414017 - protein, 12 aa, Mycobacterium
AAYEAAGIGPED

SEQ ID NO: 414018 - protein, 12 aa, Mycobacterium
AAYEEKDKDRSV

SEQ ID NO: 414019 - protein, 8 aa, Mycobacterium
AAYEGESV

SEQ ID NO: 414020 - protein, 7 aa, Mycobacterium
AAYEGLP

SEQ ID NO: 414021 - protein, 5 aa, Mycobacterium
AAYGA

SEQ ID NO: 414022 - protein, 11 aa, Mycobacterium
AAYGAGRDADR

SEQ ID NO: 414023 - protein, 10 aa, Mycobacterium
AAYGDQDRAD

SEQ ID NO: 414024 - protein, 53 aa, Mycobacterium
AAYGEVEDESATALDNDGNGEVDAQSAGGAGAGQTESLEETPKVAAAGESDFT

SEQ ID NO: 414025 - protein, 8 aa, Mycobacterium
AAYGGDPD

SEQ ID NO: 414026 - protein, 10 aa, Mycobacterium
AAYGNEAAVG

SEQ ID NO: 414027 - protein, 10 aa, Mycobacterium
AAYGPDQQDG

SEQ ID NO: 414028 - protein, 14 aa, Mycobacterium
AAYGRPAPSEHSDV

SEQ ID NO: 414029 - protein, 5 aa, Mycobacterium
AAYGS

SEQ ID NO: 414030 - protein, 6 aa, Mycobacterium
AAYGSN

SEQ ID NO: 414031 - protein, 4 aa, Mycobacterium
AAYK

SEQ ID NO: 414032 - protein, 7 aa, Mycobacterium
AAYNSDM

SEQ ID NO: 414033 - protein, 10 aa, Mycobacterium
AAYPDPPRSR

SEQ ID NO: 414034 - protein, 7 aa, Mycobacterium
AAYPDSP

SEQ ID NO: 414035 - protein, 7 aa, Mycobacterium
AAYPEST

SEQ ID NO: 414036 - protein, 7 aa, Mycobacterium
AAYPGTV

SEQ ID NO: 414037 - protein, 14 aa, Mycobacterium
AAYPKDGPKRTVTV

SEQ ID NO: 414038 - protein, 8 aa, Mycobacterium
AAYPRPTD

SEQ ID NO: 414039 - protein, 9 aa, Mycobacterium
AAYQAEQQK

SEQ ID NO: 414040 - protein, 6 aa, Mycobacterium
AAYQTA

SEQ ID NO: 414041 - protein, 5 aa, Mycobacterium
AAYRA

SEQ ID NO: 414042 - protein, 18 aa, Mycobacterium
AAYRDAAQGFAEGTREGV

SEQ ID NO: 414043 - protein, 12 aa, Mycobacterium
AAYRDTPGRYAD

SEQ ID NO: 414044 - protein, 12 aa, Mycobacterium
AAYRSTDDDHRE

SEQ ID NO: 414045 - protein, 8 aa, Mycobacterium
AAYSASKA

SEQ ID NO: 414046 - protein, 10 aa, Mycobacterium
AAYSASKAAL

SEQ ID NO: 414047 - protein, 10 aa, Mycobacterium
AAYSPESAKR

SEQ ID NO: 414048 - protein, 11 aa, Mycobacterium
AAYSSQATIEV

SEQ ID NO: 414049 - protein, 4 aa, Mycobacterium
AAYT

SEQ ID NO: 414050 - protein, 12 aa, Mycobacterium
AAYTATKGAIES

SEQ ID NO: 414051 - protein, 7 aa, Mycobacterium
AAYTGSP

SEQ ID NO: 414052 - protein, 7 aa, Mycobacterium
AAYTPIP

SEQ ID NO: 414053 - protein, 7 aa, Mycobacterium
AAYTSQR

SEQ ID NO: 414054 - protein, 11 aa, Mycobacterium
AAYTVDPEIGD

SEQ ID NO: 414055 - protein, 5 aa, Mycobacterium
ACAAG

SEQ ID NO: 414056 - protein, 5 aa, Mycobacterium
ACAGG

SEQ ID NO: 414057 - protein, 4 aa, Mycobacterium
ACAQ

SEQ ID NO: 414058 - protein, 20 aa, Mycobacterium
ACASGTPGPASQSPSSAATD

SEQ ID NO: 414059 - protein, 15 aa, Mycobacterium
ACATGAATGGDEQRI

SEQ ID NO: 414060 - protein, 12 aa, Mycobacterium
ACATGNDAIRNG

SEQ ID NO: 414061 - protein, 13 aa, Mycobacterium
ACDEPGRRVASPP

SEQ ID NO: 414062 - protein, 6 aa, Mycobacterium
ACDEQR

SEQ ID NO: 414063 - protein, 7 aa, Mycobacterium
ACDPGRE

SEQ ID NO: 414064 - protein, 13 aa, Mycobacterium
ACEDPSPTNAAAA

SEQ ID NO: 414065 - protein, 15 aa, Mycobacterium
ACEPGRAPVTVKVEA

SEQ ID NO: 414066 - protein, 8 aa, Mycobacterium
ACEQGNSS

SEQ ID NO: 414067 - protein, 4 aa, Mycobacterium
ACER

SEQ ID NO: 414068 - protein, 9 aa, Mycobacterium
ACETGNSTI

SEQ ID NO: 414069 - protein, 9 aa, Mycobacterium
ACGAGTDCG

SEQ ID NO: 414070 - protein, 11 aa, Mycobacterium
ACGDARAAAPV

SEQ ID NO: 414071 - protein, 11 aa, Mycobacterium
ACGDASAAAPV

SEQ ID NO: 414072 - protein, 6 aa, Mycobacterium
ACGDNA

SEQ ID NO: 414073 - protein, 5 aa, Mycobacterium
ACGGD

SEQ ID NO: 414074 - protein, 5 aa, Mycobacterium
ACGGS

SEQ ID NO: 414075 - protein, 6 aa, Mycobacterium
ACGKSR

SEQ ID NO: 414076 - protein, 6 aa, Mycobacterium
ACGPAA

SEQ ID NO: 414077 - protein, 9 aa, Mycobacterium
ACGPDPEKH

SEQ ID NO: 414078 - protein, 5 aa, Mycobacterium
ACGRD

SEQ ID NO: 414079 - protein, 7 aa, Mycobacterium
ACGRDEQ

SEQ ID NO: 414080 - protein, 9 aa, Mycobacterium
ACGRSPQDL

SEQ ID NO: 414081 - protein, 12 aa, Mycobacterium
ACGRTREQHWGP

SEQ ID NO: 414082 - protein, 10 aa, Mycobacterium
ACGSDPEKHV

SEQ ID NO: 414083 - protein, 6 aa, Mycobacterium
ACGSRA

SEQ ID NO: 414084 - protein, 8 aa, Mycobacterium
ACGSTDLD

SEQ ID NO: 414085 - protein, 4 aa, Mycobacterium
ACGT

SEQ ID NO: 414086 - protein, 5 aa, Mycobacterium
ACHTG

SEQ ID NO: 414087 - protein, 11 aa, Mycobacterium
ACKADGNNRAL

SEQ ID NO: 414088 - protein, 7 aa, Mycobacterium
ACNGRDG

SEQ ID NO: 414089 - protein, 5 aa, Mycobacterium
ACNSN

SEQ ID NO: 414090 - protein, 8 aa, Mycobacterium
ACPADRRT

SEQ ID NO: 414091 - protein, 11 aa, Mycobacterium
ACPDDIDPANG

SEQ ID NO: 414092 - protein, 4 aa, Mycobacterium
ACPE

SEQ ID NO: 414093 - protein, 4 aa, Mycobacterium
ACPG

SEQ ID NO: 414094 - protein, 5 aa, Mycobacterium
ACPGQ

SEQ ID NO: 414095 - protein, 14 aa, Mycobacterium
ACPGVASGTAYTDV

SEQ ID NO: 414096 - protein, 9 aa, Mycobacterium
ACPKKNEIS

SEQ ID NO: 414097 - protein, 12 aa, Mycobacterium
ACPKKTEISDQV

SEQ ID NO: 414098 - protein, 11 aa, Mycobacterium
ACPKKTEISER

SEQ ID NO: 414099 - protein, 10 aa, Mycobacterium
ACPLGTDPTQ

SEQ ID NO: 414100 - protein, 5 aa, Mycobacterium
ACPPE

SEQ ID NO: 414101 - protein, 5 aa, Mycobacterium
ACPRE

SEQ ID NO: 414102 - protein, 4 aa, Mycobacterium
ACPS

SEQ ID NO: 414103 - protein, 5 aa, Mycobacterium
ACPTC

SEQ ID NO: 414104 - protein, 11 aa, Mycobacterium
ACQEGGTSFHG

SEQ ID NO: 414105 - protein, 5 aa, Mycobacterium
ACQGA

SEQ ID NO: 414106 - protein, 8 aa, Mycobacterium
ACQPGRPV

SEQ ID NO: 414107 - protein, 5 aa, Mycobacterium
ACQRT

SEQ ID NO: 414108 - protein, 4 aa, Mycobacterium
ACRA

SEQ ID NO: 414109 - protein, 6 aa, Mycobacterium
ACRDAG

SEQ ID NO: 414110 - protein, 10 aa, Mycobacterium
ACRDGRPRGQ

SEQ ID NO: 414111 - protein, 21 aa, Mycobacterium
ACRGAEACPDSAITVRRADAG

SEQ ID NO: 414112 - protein, 10 aa, Mycobacterium
ACRPDGTDAD

SEQ ID NO: 414113 - protein, 9 aa, Mycobacterium
ACRRPDAGR

SEQ ID NO: 414114 - protein, 4 aa, Mycobacterium
ACRT

SEQ ID NO: 414115 - protein, 6 aa, Mycobacterium
ACRTDG

SEQ ID NO: 414116 - protein, 7 aa, Mycobacterium
ACRTGGS

SEQ ID NO: 414117 - protein, 20 aa, Mycobacterium
ACSDRGADFEEEKDERDRRT

SEQ ID NO: 414118 - protein, 7 aa, Mycobacterium
ACSGAGA

SEQ ID NO: 414119 - protein, 13 aa, Mycobacterium
ACSKPVPNTSDNA

SEQ ID NO: 414120 - protein, 6 aa, Mycobacterium
ACSPEE

SEQ ID NO: 414121 - protein, 6 aa, Mycobacterium
ACSPNT

SEQ ID NO: 414122 - protein, 7 aa, Mycobacterium
ACSRQGL

SEQ ID NO: 414123 - protein, 7 aa, Mycobacterium
ACSRQSI

SEQ ID NO: 414124 - protein, 9 aa, Mycobacterium
ACSSGSEGI

SEQ ID NO: 414125 - protein, 6 aa, Mycobacterium
ACSTND

SEQ ID NO: 414126 - protein, 9 aa, Mycobacterium
ACTDPEEDG

SEQ ID NO: 414127 - protein, 15 aa, Mycobacterium
ACTPSARERSDRDGD

SEQ ID NO: 414128 - protein, 10 aa, Mycobacterium
ACTQSEPGRV

SEQ ID NO: 414129 - protein, 9 aa, Mycobacterium
ACTRGGSSM

SEQ ID NO: 414130 - protein, 5 aa, Mycobacterium
ACTSG

SEQ ID NO: 414131 - protein, 13 aa, Mycobacterium
ACTTEDRAPRNDV

SEQ ID NO: 414132 - protein, 5 aa, Mycobacterium
ADAAA

SEQ ID NO: 414133 - protein, 15 aa, Mycobacterium
ADAAAAAASDIGGNA

SEQ ID NO: 414134 - protein, 16 aa, Mycobacterium
ADAAAADRRRAAGDAA

SEQ ID NO: 414135 - protein, 17 aa, Mycobacterium
ADAAAADRRRAAGDTGP

SEQ ID NO: 414136 - protein, 8 aa, Mycobacterium
ADAAAAGY

SEQ ID NO: 414137 - protein, 8 aa, Mycobacterium
ADAAAATD

SEQ ID NO: 414138 - protein, 9 aa, Mycobacterium
ADAAADAQT

SEQ ID NO: 414139 - protein, 14 aa, Mycobacterium
ADAAAEAAAAREAL

SEQ ID NO: 414140 - protein, 15 aa, Mycobacterium
ADAAAGSNQPTYSRQ

SEQ ID NO: 414141 - protein, 15 aa, Mycobacterium
ADAAAPQPDIHTTAG

SEQ ID NO: 414142 - protein, 12 aa, Mycobacterium
ADAAAQAERAGG

SEQ ID NO: 414143 - protein, 24 aa, Mycobacterium
ADAAARTAAARTAAALGARSARLD

SEQ ID NO: 414144 - protein, 16 aa, Mycobacterium
ADAAATASGSTTQTAA

SEQ ID NO: 414145 - protein, 9 aa, Mycobacterium
ADAAAYTTL

SEQ ID NO: 414146 - protein, 8 aa, Mycobacterium
ADAADADV

SEQ ID NO: 414147 - protein, 7 aa, Mycobacterium
ADAADDA

SEQ ID NO: 414148 - protein, 13 aa, Mycobacterium
ADAADGPDAVSPN

SEQ ID NO: 414149 - protein, 8 aa, Mycobacterium
ADAADKDV

SEQ ID NO: 414150 - protein, 6 aa, Mycobacterium
ADAADL

SEQ ID NO: 414151 - protein, 14 aa, Mycobacterium
ADAADRAKVAERLS

SEQ ID NO: 414152 - protein, 9 aa, Mycobacterium
ADAADSMPE

SEQ ID NO: 414153 - protein, 12 aa, Mycobacterium
ADAADTAAQPCY

SEQ ID NO: 414154 - protein, 8 aa, Mycobacterium
ADAADTDV

SEQ ID NO: 414155 - protein, 9 aa, Mycobacterium
ADAAEADRL

SEQ ID NO: 414156 - protein, 19 aa, Mycobacterium
ADAAEDALGTTGSGALGGA

SEQ ID NO: 414157 - protein, 6 aa, Mycobacterium
ADAAEN

SEQ ID NO: 414158 - protein, 18 aa, Mycobacterium
ADAAERDAEQNPERIAER

SEQ ID NO: 414159 - protein, 15 aa, Mycobacterium
ADAAERFTGDPEGLK

SEQ ID NO: 414160 - protein, 8 aa, Mycobacterium
ADAAESLA

SEQ ID NO: 414161 - protein, 8 aa, Mycobacterium
ADAAGADM

SEQ ID NO: 414162 - protein, 7 aa, Mycobacterium
ADAAGEV

SEQ ID NO: 414163 - protein, 8 aa, Mycobacterium
ADAAGEYP

SEQ ID NO: 414164 - protein, 10 aa, Mycobacterium
ADAAGGTSGA

SEQ ID NO: 414165 - protein, 6 aa, Mycobacterium
ADAAGL

SEQ ID NO: 414166 - protein, 19 aa, Mycobacterium
ADAAGLAEDRYGAGKDQSG

SEQ ID NO: 414167 - protein, 19 aa, Mycobacterium
ADAAGLAEERYGAGKDNSG

SEQ ID NO: 414168 - protein, 6 aa, Mycobacterium
ADAAGP

SEQ ID NO: 414169 - protein, 8 aa, Mycobacterium
ADAAGRDK

SEQ ID NO: 414170 - protein, 13 aa, Mycobacterium
ADAAGRDKVAERL

SEQ ID NO: 414171 - protein, 7 aa, Mycobacterium
ADAAHAG

SEQ ID NO: 414172 - protein, 10 aa, Mycobacterium
ADAAHAGEYG

SEQ ID NO: 414173 - protein, 15 aa, Mycobacterium
ADAAKADRDRAAGKQ

SEQ ID NO: 414174 - protein, 19 aa, Mycobacterium
ADAAKAVAESDGSDSATQL

SEQ ID NO: 414175 - protein, 16 aa, Mycobacterium
ADAAKSSWPTVPGSVR

SEQ ID NO: 414176 - protein, 9 aa, Mycobacterium
ADAALGSPG

SEQ ID NO: 414177 - protein, 27 aa, Mycobacterium
ADAANAQAAGEDVPGDDEDVGAPPGSL

SEQ ID NO: 414178 - protein, 11 aa, Mycobacterium
ADAANASRDSV

SEQ ID NO: 414179 - protein, 9 aa, Mycobacterium
ADAANDARD

SEQ ID NO: 414180 - protein, 7 aa, Mycobacterium
ADAANGY

SEQ ID NO: 414181 - protein, 60 aa, Mycobacterium
ADAAPAAPAAPAAPAPEPAAAPAAAAAPPAPPAPAPAPAAPAPASTAPAANGAAGDNPYV

SEQ ID NO: 414182 - protein, 17 aa, Mycobacterium
ADAAPAHRINPSEPGTG

SEQ ID NO: 414183 - protein, 14 aa, Mycobacterium
ADAAPDWPTGNDND

SEQ ID NO: 414184 - protein, 6 aa, Mycobacterium
ADAAPE

SEQ ID NO: 414185 - protein, 10 aa, Mycobacterium
ADAAPERPTW

SEQ ID NO: 414186 - protein, 6 aa, Mycobacterium
ADAAPI

SEQ ID NO: 414187 - protein, 7 aa, Mycobacterium
ADAAPVE

SEQ ID NO: 414188 - protein, 8 aa, Mycobacterium
ADAAQATG

SEQ ID NO: 414189 - protein, 40 aa, Mycobacterium
ADAAQDASAAAAGVGSGLAAGPLASTGSVGSAVSAGLGNA

SEQ ID NO: 414190 - protein, 6 aa, Mycobacterium
ADAAQI

SEQ ID NO: 414191 - protein, 11 aa, Mycobacterium
ADAAQRVTGPA

SEQ ID NO: 414192 - protein, 6 aa, Mycobacterium
ADAAQV

SEQ ID NO: 414193 - protein, 5 aa, Mycobacterium
ADAAR

SEQ ID NO: 414194 - protein, 8 aa, Mycobacterium
ADAAREAV

SEQ ID NO: 414195 - protein, 16 aa, Mycobacterium
ADAARPHRVTHRKLTR

SEQ ID NO: 414196 - protein, 7 aa, Mycobacterium
ADAARSR

SEQ ID NO: 414197 - protein, 10 aa, Mycobacterium
ADAARTNKDV

SEQ ID NO: 414198 - protein, 11 aa, Mycobacterium
ADAARTRPWRE

SEQ ID NO: 414199 - protein, 5 aa, Mycobacterium
ADAAS

SEQ ID NO: 414200 - protein, 11 aa, Mycobacterium
ADAASALGDAS

SEQ ID NO: 414201 - protein, 9 aa, Mycobacterium
ADAASTKVF

SEQ ID NO: 414202 - protein, 9 aa, Mycobacterium
ADAASVAGR

SEQ ID NO: 414203 - protein, 10 aa, Mycobacterium
ADAATAQELR

SEQ ID NO: 414204 - protein, 6 aa, Mycobacterium
ADAATD

SEQ ID NO: 414205 - protein, 13 aa, Mycobacterium
ADAATDALTPGPV

SEQ ID NO: 414206 - protein, 6 aa, Mycobacterium
ADAATV

SEQ ID NO: 414207 - protein, 5 aa, Mycobacterium
ADAAV

SEQ ID NO: 414208 - protein, 6 aa, Mycobacterium
ADAAYD

SEQ ID NO: 414209 - protein, 13 aa, Mycobacterium
ADACPNDESHGSV

SEQ ID NO: 414210 - protein, 8 aa, Mycobacterium
ADACTGAG

SEQ ID NO: 414211 - protein, 6 aa, Mycobacterium
ADADAA

SEQ ID NO: 414212 - protein, 9 aa, Mycobacterium
ADADADQRH

SEQ ID NO: 414213 - protein, 7 aa, Mycobacterium
ADADAGM

SEQ ID NO: 414214 - protein, 17 aa, Mycobacterium
ADADAPARRPQVGTRTP

SEQ ID NO: 414215 - protein, 12 aa, Mycobacterium
ADADAQAAGLNR

SEQ ID NO: 414216 - protein, 8 aa, Mycobacterium
ADADDAVQ

SEQ ID NO: 414217 - protein, 12 aa, Mycobacterium
ADADDDHSDHDM

SEQ ID NO: 414218 - protein, 6 aa, Mycobacterium
ADADDR

SEQ ID NO: 414219 - protein, 6 aa, Mycobacterium
ADADEK

SEQ ID NO: 414220 - protein, 10 aa, Mycobacterium
ADADELPGLA

SEQ ID NO: 414221 - protein, 11 aa, Mycobacterium
ADADESGAAAL

SEQ ID NO: 414222 - protein, 7 aa, Mycobacterium
ADADEVA

SEQ ID NO: 414223 - protein, 5 aa, Mycobacterium
ADADG

SEQ ID NO: 414224 - protein, 11 aa, Mycobacterium
ADADGAGGNRF

SEQ ID NO: 414225 - protein, 8 aa, Mycobacterium
ADADGELT

SEQ ID NO: 414226 - protein, 7 aa, Mycobacterium
ADADGNQ

SEQ ID NO: 414227 - protein, 9 aa, Mycobacterium
ADADGRPDL

SEQ ID NO: 414228 - protein, 16 aa, Mycobacterium
ADADGSILALRPSARE

SEQ ID NO: 414229 - protein, 12 aa, Mycobacterium
ADADGYVRSEGA

SEQ ID NO: 414230 - protein, 9 aa, Mycobacterium
ADADHRAQA

SEQ ID NO: 414231 - protein, 15 aa, Mycobacterium
ADADLRARETAERRV

SEQ ID NO: 414232 - protein, 7 aa, Mycobacterium
ADADMTE

SEQ ID NO: 414233 - protein, 7 aa, Mycobacterium
ADADNMR

SEQ ID NO: 414234 - protein, 5 aa, Mycobacterium
ADADP

SEQ ID NO: 414235 - protein, 11 aa, Mycobacterium
ADADPAVSGRV

SEQ ID NO: 414236 - protein, 9 aa, Mycobacterium
ADADPAVSR

SEQ ID NO: 414237 - protein, 8 aa, Mycobacterium
ADADPFPV

SEQ ID NO: 414238 - protein, 9 aa, Mycobacterium
ADADPLSGR

SEQ ID NO: 414239 - protein, 10 aa, Mycobacterium
ADADPPVSQR

SEQ ID NO: 414240 - protein, 8 aa, Mycobacterium
ADADPSVA

SEQ ID NO: 414241 - protein, 8 aa, Mycobacterium
ADADPVHH

SEQ ID NO: 414242 - protein, 6 aa, Mycobacterium
ADADQA

SEQ ID NO: 414243 - protein, 9 aa, Mycobacterium
ADADQDTLK

SEQ ID NO: 414244 - protein, 8 aa, Mycobacterium
ADADQQSM

SEQ ID NO: 414245 - protein, 8 aa, Mycobacterium
ADADQVER

SEQ ID NO: 414246 - protein, 6 aa, Mycobacterium
ADADRP

SEQ ID NO: 414247 - protein, 7 aa, Mycobacterium
ADADRPA

SEQ ID NO: 414248 - protein, 58 aa, Mycobacterium
ADADRVADQIEPETVPEPLNRSGTEQNPTQTLPETVPEPLNGSRTLREPQGYGSGSGY

SEQ ID NO: 414249 - protein, 8 aa, Mycobacterium
ADADRYER

SEQ ID NO: 414250 - protein, 6 aa, Mycobacterium
ADADSL

SEQ ID NO: 414251 - protein, 5 aa, Mycobacterium
ADADT

SEQ ID NO: 414252 - protein, 11 aa, Mycobacterium
ADADTAPARQA

SEQ ID NO: 414253 - protein, 10 aa, Mycobacterium
ADADTTRRLT

SEQ ID NO: 414254 - protein, 10 aa, Mycobacterium
ADADVAGTQT

SEQ ID NO: 414255 - protein, 7 aa, Mycobacterium
ADADYQA

SEQ ID NO: 414256 - protein, 6 aa, Mycobacterium
ADAEAA

SEQ ID NO: 414257 - protein, 8 aa, Mycobacterium
ADAEAARA

SEQ ID NO: 414258 - protein, 38 aa, Mycobacterium
ADAEAEVAAAQEKVRAAEERAEQRIAERASERQAAEHR

SEQ ID NO: 414259 - protein, 24 aa, Mycobacterium
ADAEAMDEADVEKESVKVRKPAPK

SEQ ID NO: 414260 - protein, 17 aa, Mycobacterium
ADAEANERKAAGDKRSH

SEQ ID NO: 414261 - protein, 9 aa, Mycobacterium
ADAEAPDSE

SEQ ID NO: 414262 - protein, 13 aa, Mycobacterium
ADAEDDDSDHDMG

SEQ ID NO: 414263 - protein, 6 aa, Mycobacterium
ADAEEA

SEQ ID NO: 414264 - protein, 8 aa, Mycobacterium
ADAEEELG

SEQ ID NO: 414265 - protein, 6 aa, Mycobacterium
ADAEEL

SEQ ID NO: 414266 - protein, 8 aa, Mycobacterium
ADAEGPLR

SEQ ID NO: 414267 - protein, 14 aa, Mycobacterium
ADAEISAAEPLPGN

SEQ ID NO: 414268 - protein, 14 aa, Mycobacterium
ADAELDSRGEVGLP

SEQ ID NO: 414269 - protein, 9 aa, Mycobacterium
ADAELPADY

SEQ ID NO: 414270 - protein, 7 aa, Mycobacterium
ADAEPAV

SEQ ID NO: 414271 - protein, 9 aa, Mycobacterium
ADAEQPRVN

SEQ ID NO: 414272 - protein, 7 aa, Mycobacterium
ADAEQVE

SEQ ID NO: 414273 - protein, 12 aa, Mycobacterium
ADAERELESARP

SEQ ID NO: 414274 - protein, 8 aa, Mycobacterium
ADAERGLG

SEQ ID NO: 414275 - protein, 46 aa, Mycobacterium
ADAERLGDPQQSPEPDGEQQRPPQPLGDPSRQRKQVADREEGPVRE

SEQ ID NO: 414276 - protein, 13 aa, Mycobacterium
ADAERQGAEVSPR

SEQ ID NO: 414277 - protein, 7 aa, Mycobacterium
ADAESID

SEQ ID NO: 414278 - protein, 13 aa, Mycobacterium
ADAESRARLDQRG

SEQ ID NO: 414279 - protein, 12 aa, Mycobacterium
ADAESRCAQRRN

SEQ ID NO: 414280 - protein, 8 aa, Mycobacterium
ADAETLDT

SEQ ID NO: 414281 - protein, 10 aa, Mycobacterium
ADAETTGERI

SEQ ID NO: 414282 - protein, 4 aa, Mycobacterium
ADAF

SEQ ID NO: 414283 - protein, 8 aa, Mycobacterium
ADAFADGA

SEQ ID NO: 414284 - protein, 5 aa, Mycobacterium
ADAFD

SEQ ID NO: 414285 - protein, 12 aa, Mycobacterium
ADAFDAAAEEAG

SEQ ID NO: 414286 - protein, 8 aa, Mycobacterium
ADAFGGAP

SEQ ID NO: 414287 - protein, 7 aa, Mycobacterium
ADAGAAQ

SEQ ID NO: 414288 - protein, 9 aa, Mycobacterium
ADAGADDMD

SEQ ID NO: 414289 - protein, 11 aa, Mycobacterium
ADAGADMPDTW

SEQ ID NO: 414290 - protein, 8 aa, Mycobacterium
ADAGAELG

SEQ ID NO: 414291 - protein, 11 aa, Mycobacterium
ADAGAESVQET

SEQ ID NO: 414292 - protein, 6 aa, Mycobacterium
ADAGAG

SEQ ID NO: 414293 - protein, 13 aa, Mycobacterium
ADAGAGPSERALD

SEQ ID NO: 414294 - protein, 11 aa, Mycobacterium
ADAGAGSPVDD

SEQ ID NO: 414295 - protein, 6 aa, Mycobacterium
ADAGAR

SEQ ID NO: 414296 - protein, 16 aa, Mycobacterium
ADAGATIRRAGAPDLA

SEQ ID NO: 414297 - protein, 5 aa, Mycobacterium
ADAGD

SEQ ID NO: 414298 - protein, 6 aa, Mycobacterium
ADAGDA

SEQ ID NO: 414299 - protein, 7 aa, Mycobacterium
ADAGDAG

SEQ ID NO: 414300 - protein, 9 aa, Mycobacterium
ADAGDATER

SEQ ID NO: 414301 - protein, 8 aa, Mycobacterium
ADAGDEFQ

SEQ ID NO: 414302 - protein, 8 aa, Mycobacterium
ADAGDMPA

SEQ ID NO: 414303 - protein, 8 aa, Mycobacterium
ADAGDRTH

SEQ ID NO: 414304 - protein, 5 aa, Mycobacterium
ADAGE

SEQ ID NO: 414305 - protein, 6 aa, Mycobacterium
ADAGEF

SEQ ID NO: 414306 - protein, 8 aa, Mycobacterium
ADAGEGDL

SEQ ID NO: 414307 - protein, 7 aa, Mycobacterium
ADAGELT

SEQ ID NO: 414308 - protein, 6 aa, Mycobacterium
ADAGGF

SEQ ID NO: 414309 - protein, 9 aa, Mycobacterium
ADAGGPPRR

SEQ ID NO: 414310 - protein, 6 aa, Mycobacterium
ADAGGR

SEQ ID NO: 414311 - protein, 41 aa, Mycobacterium
ADAGGTAGRAKRRGTSTAGRAKRRGTSTAGRAKRRGTSSAV

SEQ ID NO: 414312 - protein, 21 aa, Mycobacterium
ADAGIDASRRSGRPRAAPPVR

SEQ ID NO: 414313 - protein, 7 aa, Mycobacterium
ADAGIGS

SEQ ID NO: 414314 - protein, 7 aa, Mycobacterium
ADAGLDP

SEQ ID NO: 414315 - protein, 6 aa, Mycobacterium
ADAGLG

SEQ ID NO: 414316 - protein, 12 aa, Mycobacterium
ADAGLPTAVPDS

SEQ ID NO: 414317 - protein, 12 aa, Mycobacterium
ADAGMAWKEIPR

SEQ ID NO: 414318 - protein, 18 aa, Mycobacterium
ADAGNGPDQFNSPAAPME

SEQ ID NO: 414319 - protein, 6 aa, Mycobacterium
ADAGNR

SEQ ID NO: 414320 - protein, 7 aa, Mycobacterium
ADAGPAL

SEQ ID NO: 414321 - protein, 9 aa, Mycobacterium
ADAGPPAEA

SEQ ID NO: 414322 - protein, 8 aa, Mycobacterium
ADAGPRAD

SEQ ID NO: 414323 - protein, 6 aa, Mycobacterium
ADAGPT

SEQ ID NO: 414324 - protein, 5 aa, Mycobacterium
ADAGQ

SEQ ID NO: 414325 - protein, 6 aa, Mycobacterium
ADAGRA

SEQ ID NO: 414326 - protein, 13 aa, Mycobacterium
ADAGRAGGVLRRV

SEQ ID NO: 414327 - protein, 11 aa, Mycobacterium
ADAGRALDDAS

SEQ ID NO: 414328 - protein, 8 aa, Mycobacterium
ADAGRATY

SEQ ID NO: 414329 - protein, 10 aa, Mycobacterium
ADAGRTTADL

SEQ ID NO: 414330 - protein, 8 aa, Mycobacterium
ADAGRVRT

SEQ ID NO: 414331 - protein, 7 aa, Mycobacterium
ADAGRVS

SEQ ID NO: 414332 - protein, 8 aa, Mycobacterium
ADAGSGLA

SEQ ID NO: 414333 - protein, 10 aa, Mycobacterium
ADAGSPATLE

SEQ ID NO: 414334 - protein, 15 aa, Mycobacterium
ADAGSQRRSDWPERD

SEQ ID NO: 414335 - protein, 10 aa, Mycobacterium
ADAGSRSAIS

SEQ ID NO: 414336 - protein, 9 aa, Mycobacterium
ADAGSRSQV

SEQ ID NO: 414337 - protein, 5 aa, Mycobacterium
ADAGT

SEQ ID NO: 414338 - protein, 17 aa, Mycobacterium
ADAGTEIARRSRGTPRI

SEQ ID NO: 414339 - protein, 16 aa, Mycobacterium
ADAGTGGSRSNGVQNY

SEQ ID NO: 414340 - protein, 19 aa, Mycobacterium
ADAGTPAGANGNGAGAGDA

SEQ ID NO: 414341 - protein, 8 aa, Mycobacterium
ADAGTQSG

SEQ ID NO: 414342 - protein, 7 aa, Mycobacterium
ADAGTWG

SEQ ID NO: 414343 - protein, 27 aa, Mycobacterium
ADAGVADVGEAQKQFERRTELNAERDR

SEQ ID NO: 414344 - protein, 21 aa, Mycobacterium
ADAGVDSSRRSGRPLAAPPVR

SEQ ID NO: 414345 - protein, 13 aa, Mycobacterium
ADAGVEAPAGGAA

SEQ ID NO: 414346 - protein, 6 aa, Mycobacterium
ADAGVP

SEQ ID NO: 414347 - protein, 6 aa, Mycobacterium
ADAGVS

SEQ ID NO: 414348 - protein, 8 aa, Mycobacterium
ADAGVSGS

SEQ ID NO: 414349 - protein, 14 aa, Mycobacterium
ADAGVTGSADPGLH

SEQ ID NO: 414350 - protein, 7 aa, Mycobacterium
ADAHAEY

SEQ ID NO: 414351 - protein, 8 aa, Mycobacterium
ADAHGGAG

SEQ ID NO: 414352 - protein, 14 aa, Mycobacterium
ADAHNAGLEPDGET

SEQ ID NO: 414353 - protein, 7 aa, Mycobacterium
ADAHPEQ

SEQ ID NO: 414354 - protein, 7 aa, Mycobacterium
ADAHSAA

SEQ ID NO: 414355 - protein, 8 aa, Mycobacterium
ADAHSRRR

SEQ ID NO: 414356 - protein, 4 aa, Mycobacterium
ADAI

SEQ ID NO: 414357 - protein, 13 aa, Mycobacterium
ADAIASEGTPADV

SEQ ID NO: 414358 - protein, 7 aa, Mycobacterium
ADAIDDN

SEQ ID NO: 414359 - protein, 15 aa, Mycobacterium
ADAIDGEVRRVEIPP

SEQ ID NO: 414360 - protein, 6 aa, Mycobacterium
ADAIGA

SEQ ID NO: 414361 - protein, 10 aa, Mycobacterium
ADAIGETDEY

SEQ ID NO: 414362 - protein, 6 aa, Mycobacterium
ADAIGV

SEQ ID NO: 414363 - protein, 7 aa, Mycobacterium
ADAKPAA

SEQ ID NO: 414364 - protein, 14 aa, Mycobacterium
ADAKQRRLKQGDEA

SEQ ID NO: 414365 - protein, 5 aa, Mycobacterium
ADALA

SEQ ID NO: 414366 - protein, 29 aa, Mycobacterium
ADALARGKAAESQRSAGLQPRTAAADSVA

SEQ ID NO: 414367 - protein, 34 aa, Mycobacterium
ADALDAKTSNPPQVARPTAGRQTSRGTTTLAEAD

SEQ ID NO: 414368 - protein, 5 aa, Mycobacterium
ADALG

SEQ ID NO: 414369 - protein, 6 aa, Mycobacterium
ADALGA

SEQ ID NO: 414370 - protein, 7 aa, Mycobacterium
ADALGAD

SEQ ID NO: 414371 - protein, 26 aa, Mycobacterium
ADALGRGKAAQSKRSLTLTPRTADAD

SEQ ID NO: 414372 - protein, 12 aa, Mycobacterium
ADALSSPVGRGR

SEQ ID NO: 414373 - protein, 7 aa, Mycobacterium
ADALTDD

SEQ ID NO: 414374 - protein, 4 aa, Mycobacterium
ADAM

SEQ ID NO: 414375 - protein, 15 aa, Mycobacterium
ADAMRPAAAERAEQL

SEQ ID NO: 414376 - protein, 16 aa, Mycobacterium
ADAMRPASAEKADEIA

SEQ ID NO: 414377 - protein, 6 aa, Mycobacterium
ADANGD

SEQ ID NO: 414378 - protein, 20 aa, Mycobacterium
ADANGGNRAEGTSGYDASAD

SEQ ID NO: 414379 - protein, 17 aa, Mycobacterium
ADANGGNRAQGTPGYDA

SEQ ID NO: 414380 - protein, 12 aa, Mycobacterium
ADANGYVRSEGA

SEQ ID NO: 414381 - protein, 5 aa, Mycobacterium
ADANL

SEQ ID NO: 414382 - protein, 10 aa, Mycobacterium
ADANNPRGYW

SEQ ID NO: 414383 - protein, 7 aa, Mycobacterium
ADANPLA

SEQ ID NO: 414384 - protein, 7 aa, Mycobacterium
ADANTPE

SEQ ID NO: 414385 - protein, 11 aa, Mycobacterium
ADANTPNDAAD

SEQ ID NO: 414386 - protein, 6 aa, Mycobacterium
ADAPAA

SEQ ID NO: 414387 - protein, 10 aa, Mycobacterium
ADAPAAATTL

SEQ ID NO: 414388 - protein, 18 aa, Mycobacterium
ADAPAADPPTQRRPSQRR

SEQ ID NO: 414389 - protein, 24 aa, Mycobacterium
ADAPAEDTERPPAGAGDDAAAEPF

SEQ ID NO: 414390 - protein, 8 aa, Mycobacterium
ADAPAGTR

SEQ ID NO: 414391 - protein, 7 aa, Mycobacterium
ADAPAID

SEQ ID NO: 414392 - protein, 9 aa, Mycobacterium
ADAPALAEA

SEQ ID NO: 414393 - protein, 17 aa, Mycobacterium
ADAPAQDRKAAGDKQSH

SEQ ID NO: 414394 - protein, 17 aa, Mycobacterium
ADAPASERKSAGDKRSH

SEQ ID NO: 414395 - protein, 6 aa, Mycobacterium
ADAPAV

SEQ ID NO: 414396 - protein, 11 aa, Mycobacterium
ADAPDAPPADL

SEQ ID NO: 414397 - protein, 13 aa, Mycobacterium
ADAPDDDTYDGAA

SEQ ID NO: 414398 - protein, 11 aa, Mycobacterium
ADAPDGADIPR

SEQ ID NO: 414399 - protein, 6 aa, Mycobacterium
ADAPDQ

SEQ ID NO: 414400 - protein, 6 aa, Mycobacterium
ADAPED

SEQ ID NO: 414401 - protein, 6 aa, Mycobacterium
ADAPEH

SEQ ID NO: 414402 - protein, 7 aa, Mycobacterium
ADAPESR

SEQ ID NO: 414403 - protein, 5 aa, Mycobacterium
ADAPG

SEQ ID NO: 414404 - protein, 7 aa, Mycobacterium
ADAPGAL

SEQ ID NO: 414405 - protein, 8 aa, Mycobacterium
ADAPGCTG

SEQ ID NO: 414406 - protein, 9 aa, Mycobacterium
ADAPGEKFR

SEQ ID NO: 414407 - protein, 8 aa, Mycobacterium
ADAPGGLS

SEQ ID NO: 414408 - protein, 8 aa, Mycobacterium
ADAPGGLT

SEQ ID NO: 414409 - protein, 7 aa, Mycobacterium
ADAPGPL

SEQ ID NO: 414410 - protein, 6 aa, Mycobacterium
ADAPHQ

SEQ ID NO: 414411 - protein, 7 aa, Mycobacterium
ADAPIAD

SEQ ID NO: 414412 - protein, 10 aa, Mycobacterium
ADAPKFDGVD

SEQ ID NO: 414413 - protein, 9 aa, Mycobacterium
ADAPKGDIE

SEQ ID NO: 414414 - protein, 5 aa, Mycobacterium
ADAPL

SEQ ID NO: 414415 - protein, 8 aa, Mycobacterium
ADAPLPAD

SEQ ID NO: 414416 - protein, 7 aa, Mycobacterium
ADAPLRD

SEQ ID NO: 414417 - protein, 5 aa, Mycobacterium
ADAPN

SEQ ID NO: 414418 - protein, 6 aa, Mycobacterium
ADAPNA

SEQ ID NO: 414419 - protein, 8 aa, Mycobacterium
ADAPNAVA

SEQ ID NO: 414420 - protein, 9 aa, Mycobacterium
ADAPNGRAA

SEQ ID NO: 414421 - protein, 19 aa, Mycobacterium
ADAPPADQIGRAPVEPGQA

SEQ ID NO: 414422 - protein, 10 aa, Mycobacterium
ADAPPDAPIS

SEQ ID NO: 414423 - protein, 8 aa, Mycobacterium
ADAPPEGM

SEQ ID NO: 414424 - protein, 7 aa, Mycobacterium
ADAPPEL

SEQ ID NO: 414425 - protein, 8 aa, Mycobacterium
ADAPPLAG

SEQ ID NO: 414426 - protein, 8 aa, Mycobacterium
ADAPPMDP

SEQ ID NO: 414427 - protein, 9 aa, Mycobacterium
ADAPPRTVA

SEQ ID NO: 414428 - protein, 7 aa, Mycobacterium
ADAPPRV

SEQ ID NO: 414429 - protein, 9 aa, Mycobacterium
ADAPQVAGR

SEQ ID NO: 414430 - protein, 8 aa, Mycobacterium
ADAPQVAS

SEQ ID NO: 414431 - protein, 5 aa, Mycobacterium
ADAPR

SEQ ID NO: 414432 - protein, 14 aa, Mycobacterium
ADAPRNPAETPNAS

SEQ ID NO: 414433 - protein, 6 aa, Mycobacterium
ADAPRP

SEQ ID NO: 414434 - protein, 11 aa, Mycobacterium
ADAPRVEQGTE

SEQ ID NO: 414435 - protein, 23 aa, Mycobacterium
ADAPRVERGTERYRIGADGQTVF

SEQ ID NO: 414436 - protein, 11 aa, Mycobacterium
ADAPRVESGTE

SEQ ID NO: 414437 - protein, 14 aa, Mycobacterium
ADAPSAPPGDDVAD

SEQ ID NO: 414438 - protein, 10 aa, Mycobacterium
ADAPSSTAEQ

SEQ ID NO: 414439 - protein, 9 aa, Mycobacterium
ADAPSTVND

SEQ ID NO: 414440 - protein, 9 aa, Mycobacterium
ADAPTGAGT

SEQ ID NO: 414441 - protein, 7 aa, Mycobacterium
ADAPTID

SEQ ID NO: 414442 - protein, 15 aa, Mycobacterium
ADAPVTIDSAEEPPT

SEQ ID NO: 414443 - protein, 6 aa, Mycobacterium
ADAPWD

SEQ ID NO: 414444 - protein, 6 aa, Mycobacterium
ADAQDR

SEQ ID NO: 414445 - protein, 8 aa, Mycobacterium
ADAQGAQP

SEQ ID NO: 414446 - protein, 6 aa, Mycobacterium
ADAQGT

SEQ ID NO: 414447 - protein, 10 aa, Mycobacterium
ADAQKAGAAR

SEQ ID NO: 414448 - protein, 10 aa, Mycobacterium
ADAQKQGARE

SEQ ID NO: 414449 - protein, 9 aa, Mycobacterium
ADAQNTQNF

SEQ ID NO: 414450 - protein, 6 aa, Mycobacterium
ADAQQR

SEQ ID NO: 414451 - protein, 14 aa, Mycobacterium
ADAQRAAQSSHATA

SEQ ID NO: 414452 - protein, 46 aa, Mycobacterium
ADAQRAARDTVRNAEQTIKREQRQRQQARERADRRSGNAARTLKDA

SEQ ID NO: 414453 - protein, 10 aa, Mycobacterium
ADAQSGGDVA

SEQ ID NO: 414454 - protein, 8 aa, Mycobacterium
ADAQSRAL

SEQ ID NO: 414455 - protein, 11 aa, Mycobacterium
ADAQSRARLEQ

SEQ ID NO: 414456 - protein, 8 aa, Mycobacterium
ADAQTRSV

SEQ ID NO: 414457 - protein, 5 aa, Mycobacterium
ADARA

SEQ ID NO: 414458 - protein, 6 aa, Mycobacterium
ADARAG

SEQ ID NO: 414459 - protein, 8 aa, Mycobacterium
ADARALED

SEQ ID NO: 414460 - protein, 6 aa, Mycobacterium
ADAREG

SEQ ID NO: 414461 - protein, 7 aa, Mycobacterium
ADAREGV

SEQ ID NO: 414462 - protein, 8 aa, Mycobacterium
ADAREKAL

SEQ ID NO: 414463 - protein, 8 aa, Mycobacterium
ADARERAG

SEQ ID NO: 414464 - protein, 6 aa, Mycobacterium
ADARGG

SEQ ID NO: 414465 - protein, 7 aa, Mycobacterium
ADARHPP

SEQ ID NO: 414466 - protein, 6 aa, Mycobacterium
ADARPD

SEQ ID NO: 414467 - protein, 8 aa, Mycobacterium
ADARPGML

SEQ ID NO: 414468 - protein, 12 aa, Mycobacterium
ADARPTQVSGNT

SEQ ID NO: 414469 - protein, 6 aa, Mycobacterium
ADARQG

SEQ ID NO: 414470 - protein, 6 aa, Mycobacterium
ADARQV

SEQ ID NO: 414471 - protein, 5 aa, Mycobacterium
ADARR

SEQ ID NO: 414472 - protein, 15 aa, Mycobacterium
ADARREKESAIDAQD

SEQ ID NO: 414473 - protein, 14 aa, Mycobacterium
ADARRGRGNDPHGS

SEQ ID NO: 414474 - protein, 16 aa, Mycobacterium
ADARRQRSRGTLPSRT

SEQ ID NO: 414475 - protein, 8 aa, Mycobacterium
ADARRREE

SEQ ID NO: 414476 - protein, 7 aa, Mycobacterium
ADARRRQ

SEQ ID NO: 414477 - protein, 15 aa, Mycobacterium
ADARRTVEAGRTPAG

SEQ ID NO: 414478 - protein, 6 aa, Mycobacterium
ADARRV

SEQ ID NO: 414479 - protein, 14 aa, Mycobacterium
ADARSGAAIKPVLL

SEQ ID NO: 414480 - protein, 13 aa, Mycobacterium
ADARSKSASVGAP

SEQ ID NO: 414481 - protein, 28 aa, Mycobacterium
ADARSNSGGSVVTDDEGIRRGTTAEKLS

SEQ ID NO: 414482 - protein, 6 aa, Mycobacterium
ADARSR

SEQ ID NO: 414483 - protein, 19 aa, Mycobacterium
ADARSVRKPITPDRASDLG

SEQ ID NO: 414484 - protein, 6 aa, Mycobacterium
ADARTD

SEQ ID NO: 414485 - protein, 8 aa, Mycobacterium
ADASAAAS

SEQ ID NO: 414486 - protein, 14 aa, Mycobacterium
ADASAAGDPAGDEY

SEQ ID NO: 414487 - protein, 6 aa, Mycobacterium
ADASAL

SEQ ID NO: 414488 - protein, 23 aa, Mycobacterium
ADASALGYAEADPTADVEGYDAA

SEQ ID NO: 414489 - protein, 7 aa, Mycobacterium
ADASALS

SEQ ID NO: 414490 - protein, 7 aa, Mycobacterium
ADASARD

SEQ ID NO: 414491 - protein, 9 aa, Mycobacterium
ADASATADI

SEQ ID NO: 414492 - protein, 6 aa, Mycobacterium
ADASDA

SEQ ID NO: 414493 - protein, 7 aa, Mycobacterium
ADASDDA

SEQ ID NO: 414494 - protein, 9 aa, Mycobacterium
ADASDESSL

SEQ ID NO: 414495 - protein, 9 aa, Mycobacterium
ADASDPAAA

SEQ ID NO: 414496 - protein, 10 aa, Mycobacterium
ADASDSEARE

SEQ ID NO: 414497 - protein, 10 aa, Mycobacterium
ADASEAAEPR

SEQ ID NO: 414498 - protein, 8 aa, Mycobacterium
ADASEKIR

SEQ ID NO: 414499 - protein, 7 aa, Mycobacterium
ADASGRV

SEQ ID NO: 414500 - protein, 6 aa, Mycobacterium
ADASGT

SEQ ID NO: 414501 - protein, 9 aa, Mycobacterium
ADASHPATT

SEQ ID NO: 414502 - protein, 8 aa, Mycobacterium
ADASKTDM

SEQ ID NO: 414503 - protein, 7 aa, Mycobacterium
ADASLAK

SEQ ID NO: 414504 - protein, 8 aa, Mycobacterium
ADASNLAD

SEQ ID NO: 414505 - protein, 9 aa, Mycobacterium
ADASNLADR

SEQ ID NO: 414506 - protein, 8 aa, Mycobacterium
ADASNYRA

SEQ ID NO: 414507 - protein, 8 aa, Mycobacterium
ADASPELK

SEQ ID NO: 414508 - protein, 17 aa, Mycobacterium
ADASPLTAKVVDVLRAT

SEQ ID NO: 414509 - protein, 11 aa, Mycobacterium
ADASQDSNRPA

SEQ ID NO: 414510 - protein, 8 aa, Mycobacterium
ADASRATY

SEQ ID NO: 414511 - protein, 10 aa, Mycobacterium
ADASSHSPAH

SEQ ID NO: 414512 - protein, 6 aa, Mycobacterium
ADASTH

SEQ ID NO: 414513 - protein, 7 aa, Mycobacterium
ADATAAD

SEQ ID NO: 414514 - protein, 7 aa, Mycobacterium
ADATAEV

SEQ ID NO: 414515 - protein, 6 aa, Mycobacterium
ADATAF

SEQ ID NO: 414516 - protein, 6 aa, Mycobacterium
ADATAQ

SEQ ID NO: 414517 - protein, 7 aa, Mycobacterium
ADATART

SEQ ID NO: 414518 - protein, 10 aa, Mycobacterium
ADATATAERV

SEQ ID NO: 414519 - protein, 8 aa, Mycobacterium
ADATATAG

SEQ ID NO: 414520 - protein, 8 aa, Mycobacterium
ADATDAEL

SEQ ID NO: 414521 - protein, 8 aa, Mycobacterium
ADATDEDA

SEQ ID NO: 414522 - protein, 7 aa, Mycobacterium
ADATDPY

SEQ ID NO: 414523 - protein, 7 aa, Mycobacterium
ADATEEF

SEQ ID NO: 414524 - protein, 8 aa, Mycobacterium
ADATEIRA

SEQ ID NO: 414525 - protein, 15 aa, Mycobacterium
ADATENRPHERAAQR

SEQ ID NO: 414526 - protein, 6 aa, Mycobacterium
ADATES

SEQ ID NO: 414527 - protein, 9 aa, Mycobacterium
ADATESQRT

SEQ ID NO: 414528 - protein, 6 aa, Mycobacterium
ADATEV

SEQ ID NO: 414529 - protein, 9 aa, Mycobacterium
ADATGAGHI

SEQ ID NO: 414530 - protein, 11 aa, Mycobacterium
ADATGATPATL

SEQ ID NO: 414531 - protein, 7 aa, Mycobacterium
ADATGDR

SEQ ID NO: 414532 - protein, 17 aa, Mycobacterium
ADATGGNGIVDIQPPLF

SEQ ID NO: 414533 - protein, 9 aa, Mycobacterium
ADATGPPTL

SEQ ID NO: 414534 - protein, 7 aa, Mycobacterium
ADATGRC

SEQ ID NO: 414535 - protein, 10 aa, Mycobacterium
ADATKVADDT

SEQ ID NO: 414536 - protein, 5 aa, Mycobacterium
ADATL

SEQ ID NO: 414537 - protein, 7 aa, Mycobacterium
ADATPAL

SEQ ID NO: 414538 - protein, 8 aa, Mycobacterium
ADATPEEI

SEQ ID NO: 414539 - protein, 10 aa, Mycobacterium
ADATPTEEEI

SEQ ID NO: 414540 - protein, 42 aa, Mycobacterium
ADATPTVADTDDEFGDDSEDDDSEDDDSEDDDSEDDDSDVDE

SEQ ID NO: 414541 - protein, 5 aa, Mycobacterium
ADATQ

SEQ ID NO: 414542 - protein, 8 aa, Mycobacterium
ADATQRTF

SEQ ID NO: 414543 - protein, 5 aa, Mycobacterium
ADATR

SEQ ID NO: 414544 - protein, 7 aa, Mycobacterium
ADATRAD

SEQ ID NO: 414545 - protein, 6 aa, Mycobacterium
ADATRI

SEQ ID NO: 414546 - protein, 13 aa, Mycobacterium
ADATRKELADQRD

SEQ ID NO: 414547 - protein, 18 aa, Mycobacterium
ADATRYPAEFSGGQKQRI

SEQ ID NO: 414548 - protein, 15 aa, Mycobacterium
ADATTARTVSAPTSH

SEQ ID NO: 414549 - protein, 8 aa, Mycobacterium
ADATTGTI

SEQ ID NO: 414550 - protein, 8 aa, Mycobacterium
ADATTRGQ

SEQ ID NO: 414551 - protein, 7 aa, Mycobacterium
ADAVAGP

SEQ ID NO: 414552 - protein, 6 aa, Mycobacterium
ADAVAQ

SEQ ID NO: 414553 - protein, 7 aa, Mycobacterium
ADAVDDE

SEQ ID NO: 414554 - protein, 8 aa, Mycobacterium
ADAVETNT

SEQ ID NO: 414555 - protein, 10 aa, Mycobacterium
ADAVGARRPR

SEQ ID NO: 414556 - protein, 6 aa, Mycobacterium
ADAVGT

SEQ ID NO: 414557 - protein, 8 aa, Mycobacterium
ADAVPADA

SEQ ID NO: 414558 - protein, 6 aa, Mycobacterium
ADAVPP

SEQ ID NO: 414559 - protein, 8 aa, Mycobacterium
ADAVPPGF

SEQ ID NO: 414560 - protein, 6 aa, Mycobacterium
ADAVPS

SEQ ID NO: 414561 - protein, 14 aa, Mycobacterium
ADAVRRRRDRATGR

SEQ ID NO: 414562 - protein, 10 aa, Mycobacterium
ADAVSRDPQV

SEQ ID NO: 414563 - protein, 5 aa, Mycobacterium
ADAVT

SEQ ID NO: 414564 - protein, 6 aa, Mycobacterium
ADAVTA

SEQ ID NO: 414565 - protein, 10 aa, Mycobacterium
ADAVTASDTD

SEQ ID NO: 414566 - protein, 7 aa, Mycobacterium
ADAVTAT

SEQ ID NO: 414567 - protein, 15 aa, Mycobacterium
ADAYAEAAAATAAKL

SEQ ID NO: 414568 - protein, 16 aa, Mycobacterium
ADAYGDEAATEIAAVL

SEQ ID NO: 414569 - protein, 16 aa, Mycobacterium
ADCGTDPIEAGTRVTV

SEQ ID NO: 414570 - protein, 19 aa, Mycobacterium
ADCPTRAGEHAREGEPTGA

SEQ ID NO: 414571 - protein, 12 aa, Mycobacterium
ADCRGPNPRELA

SEQ ID NO: 414572 - protein, 12 aa, Mycobacterium
ADCTAQPPQEES

SEQ ID NO: 414573 - protein, 10 aa, Mycobacterium
ADDAAAALAR

SEQ ID NO: 414574 - protein, 8 aa, Mycobacterium
ADDAAPDV

SEQ ID NO: 414575 - protein, 9 aa, Mycobacterium
ADDAAPSLA

SEQ ID NO: 414576 - protein, 8 aa, Mycobacterium
ADDAARQA

SEQ ID NO: 414577 - protein, 8 aa, Mycobacterium
ADDAARTR

SEQ ID NO: 414578 - protein, 21 aa, Mycobacterium
ADDAATGGERRRRRRHRPRRR

SEQ ID NO: 414579 - protein, 13 aa, Mycobacterium
ADDAAYAKLDANA

SEQ ID NO: 414580 - protein, 6 aa, Mycobacterium
ADDADA

SEQ ID NO: 414581 - protein, 11 aa, Mycobacterium
ADDADDADDHR

SEQ ID NO: 414582 - protein, 9 aa, Mycobacterium
ADDADDHRR

SEQ ID NO: 414583 - protein, 8 aa, Mycobacterium
ADDADPMA

SEQ ID NO: 414584 - protein, 6 aa, Mycobacterium
ADDADR

SEQ ID NO: 414585 - protein, 9 aa, Mycobacterium
ADDADSPHV

SEQ ID NO: 414586 - protein, 9 aa, Mycobacterium
ADDAEPEEQ

SEQ ID NO: 414587 - protein, 6 aa, Mycobacterium
ADDAES

SEQ ID NO: 414588 - protein, 5 aa, Mycobacterium
ADDAG

SEQ ID NO: 414589 - protein, 8 aa, Mycobacterium
ADDAGTRA

SEQ ID NO: 414590 - protein, 15 aa, Mycobacterium
ADDAGVAGRLSGSGV

SEQ ID NO: 414591 - protein, 6 aa, Mycobacterium
ADDAIP

SEQ ID NO: 414592 - protein, 7 aa, Mycobacterium
ADDAKGL

SEQ ID NO: 414593 - protein, 8 aa, Mycobacterium
ADDAKPKV

SEQ ID NO: 414594 - protein, 12 aa, Mycobacterium
ADDANARSFTPD

SEQ ID NO: 414595 - protein, 9 aa, Mycobacterium
ADDANTRVG

SEQ ID NO: 414596 - protein, 6 aa, Mycobacterium
ADDAQD

SEQ ID NO: 414597 - protein, 16 aa, Mycobacterium
ADDAREARRDSGVSDQ

SEQ ID NO: 414598 - protein, 8 aa, Mycobacterium
ADDARRAE

SEQ ID NO: 414599 - protein, 9 aa, Mycobacterium
ADDASAPTE

SEQ ID NO: 414600 - protein, 7 aa, Mycobacterium
ADDATKQ

SEQ ID NO: 414601 - protein, 5 aa, Mycobacterium
ADDAV

SEQ ID NO: 414602 - protein, 11 aa, Mycobacterium
ADDAWDGKTGD

SEQ ID NO: 414603 - protein, 17 aa, Mycobacterium
ADDAYVDSGPGTQPASL

SEQ ID NO: 414604 - protein, 8 aa, Mycobacterium
ADDDAADF

SEQ ID NO: 414605 - protein, 11 aa, Mycobacterium
ADDDAATYHRE

SEQ ID NO: 414606 - protein, 14 aa, Mycobacterium
ADDDAGTDADAPHE

SEQ ID NO: 414607 - protein, 16 aa, Mycobacterium
ADDDASDFVPSEPTVA

SEQ ID NO: 414608 - protein, 22 aa, Mycobacterium
ADDDATGFDPADPTIAKAAGRA

SEQ ID NO: 414609 - protein, 5 aa, Mycobacterium
ADDDD

SEQ ID NO: 414610 - protein, 10 aa, Mycobacterium
ADDDDFGQAG

SEQ ID NO: 414611 - protein, 7 aa, Mycobacterium
ADDDDLQ

SEQ ID NO: 414612 - protein, 7 aa, Mycobacterium
ADDDEDA

SEQ ID NO: 414613 - protein, 21 aa, Mycobacterium
ADDDFSRQPSRFRGDRNKEVE

SEQ ID NO: 414614 - protein, 21 aa, Mycobacterium
ADDDFSVQPSRFRGDRNQEVE

SEQ ID NO: 414615 - protein, 9 aa, Mycobacterium
ADDDGAGGW

SEQ ID NO: 414616 - protein, 8 aa, Mycobacterium
ADDDGPVE

SEQ ID NO: 414617 - protein, 10 aa, Mycobacterium
ADDDITTASE

SEQ ID NO: 414618 - protein, 5 aa, Mycobacterium
ADDDK

SEQ ID NO: 414619 - protein, 9 aa, Mycobacterium
ADDDPEDPI

SEQ ID NO: 414620 - protein, 6 aa, Mycobacterium
ADDDPP

SEQ ID NO: 414621 - protein, 8 aa, Mycobacterium
ADDDPTPA

SEQ ID NO: 414622 - protein, 11 aa, Mycobacterium
ADDDQRDKAVR

SEQ ID NO: 414623 - protein, 7 aa, Mycobacterium
ADDDSAE

SEQ ID NO: 414624 - protein, 6 aa, Mycobacterium
ADDDTA

SEQ ID NO: 414625 - protein, 8 aa, Mycobacterium
ADDDTFDR

SEQ ID NO: 414626 - protein, 9 aa, Mycobacterium
ADDDTGPLT

SEQ ID NO: 414627 - protein, 10 aa, Mycobacterium
ADDDTKWATL

SEQ ID NO: 414628 - protein, 9 aa, Mycobacterium
ADDDTTIGT

SEQ ID NO: 414629 - protein, 16 aa, Mycobacterium
ADDDVRSAISTAVKLV

SEQ ID NO: 414630 - protein, 7 aa, Mycobacterium
ADDDYRR

SEQ ID NO: 414631 - protein, 4 aa, Mycobacterium
ADDE

SEQ ID NO: 414632 - protein, 5 aa, Mycobacterium
ADDED

SEQ ID NO: 414633 - protein, 6 aa, Mycobacterium
ADDEEA

SEQ ID NO: 414634 - protein, 7 aa, Mycobacterium
ADDEEEA

SEQ ID NO: 414635 - protein, 13 aa, Mycobacterium
ADDEGDDAGADGI

SEQ ID NO: 414636 - protein, 11 aa, Mycobacterium
ADDEGDDPGLD

SEQ ID NO: 414637 - protein, 8 aa, Mycobacterium
ADDEGRPV

SEQ ID NO: 414638 - protein, 7 aa, Mycobacterium
ADDEGWG

SEQ ID NO: 414639 - protein, 5 aa, Mycobacterium
ADDEL

SEQ ID NO: 414640 - protein, 14 aa, Mycobacterium
ADDEPEALTPKHDT

SEQ ID NO: 414641 - protein, 7 aa, Mycobacterium
ADDEPIP

SEQ ID NO: 414642 - protein, 7 aa, Mycobacterium
ADDEPYQ

SEQ ID NO: 414643 - protein, 6 aa, Mycobacterium
ADDEQV

SEQ ID NO: 414644 - protein, 8 aa, Mycobacterium
ADDERGLG

SEQ ID NO: 414645 - protein, 9 aa, Mycobacterium
ADDERPDGA

SEQ ID NO: 414646 - protein, 4 aa, Mycobacterium
ADDF

SEQ ID NO: 414647 - protein, 7 aa, Mycobacterium
ADDFPRS

SEQ ID NO: 414648 - protein, 7 aa, Mycobacterium
ADDFPRT

SEQ ID NO: 414649 - protein, 6 aa, Mycobacterium
ADDFPS

SEQ ID NO: 414650 - protein, 7 aa, Mycobacterium
ADDFTGP

SEQ ID NO: 414651 - protein, 18 aa, Mycobacterium
ADDGADRYAAAADAALSS

SEQ ID NO: 414652 - protein, 8 aa, Mycobacterium
ADDGDLDA

SEQ ID NO: 414653 - protein, 28 aa, Mycobacterium
ADDGDLDLTGRPPKDIPEPKPLTSHGPA

SEQ ID NO: 414654 - protein, 8 aa, Mycobacterium
ADDGDLSN

SEQ ID NO: 414655 - protein, 9 aa, Mycobacterium
ADDGDPDWT

SEQ ID NO: 414656 - protein, 10 aa, Mycobacterium
ADDGDSYDLE

SEQ ID NO: 414657 - protein, 7 aa, Mycobacterium
ADDGDTF

SEQ ID NO: 414658 - protein, 8 aa, Mycobacterium
ADDGERGW

SEQ ID NO: 414659 - protein, 7 aa, Mycobacterium
ADDGGAL

SEQ ID NO: 414660 - protein, 7 aa, Mycobacterium
ADDGGFS

SEQ ID NO: 414661 - protein, 9 aa, Mycobacterium
ADDGGPLRR

SEQ ID NO: 414662 - protein, 7 aa, Mycobacterium
ADDGKTL

SEQ ID NO: 414663 - protein, 6 aa, Mycobacterium
ADDGLR

SEQ ID NO: 414664 - protein, 9 aa, Mycobacterium
ADDGLTREG

SEQ ID NO: 414665 - protein, 10 aa, Mycobacterium
ADDGQSQRQL

SEQ ID NO: 414666 - protein, 12 aa, Mycobacterium
ADDGRGQKRDRL

SEQ ID NO: 414667 - protein, 6 aa, Mycobacterium
ADDGRI

SEQ ID NO: 414668 - protein, 7 aa, Mycobacterium
ADDGRRR

SEQ ID NO: 414669 - protein, 18 aa, Mycobacterium
ADDGRSDDGRSDDDETLT

SEQ ID NO: 414670 - protein, 6 aa, Mycobacterium
ADDGRW

SEQ ID NO: 414671 - protein, 8 aa, Mycobacterium
ADDGSDLA

SEQ ID NO: 414672 - protein, 14 aa, Mycobacterium
ADDGSTGALLLADL

SEQ ID NO: 414673 - protein, 15 aa, Mycobacterium
ADDGTAPDIASEHRR

SEQ ID NO: 414674 - protein, 18 aa, Mycobacterium
ADDGTDERTSVDRAEAAA

SEQ ID NO: 414675 - protein, 7 aa, Mycobacterium
ADDGTDR

SEQ ID NO: 414676 - protein, 16 aa, Mycobacterium
ADDGTGAQTVFAGRVP

SEQ ID NO: 414677 - protein, 12 aa, Mycobacterium
ADDGTLNTVDEH

SEQ ID NO: 414678 - protein, 8 aa, Mycobacterium
ADDGTLSD

SEQ ID NO: 414679 - protein, 6 aa, Mycobacterium
ADDGTW

SEQ ID NO: 414680 - protein, 16 aa, Mycobacterium
ADDGVPGTSGNPNPNF

SEQ ID NO: 414681 - protein, 7 aa, Mycobacterium
ADDHPTP

SEQ ID NO: 414682 - protein, 8 aa, Mycobacterium
ADDHRARG

SEQ ID NO: 414683 - protein, 11 aa, Mycobacterium
ADDIAATRATM

SEQ ID NO: 414684 - protein, 16 aa, Mycobacterium
ADDIAKQARRHREAGA

SEQ ID NO: 414685 - protein, 7 aa, Mycobacterium
ADDIARA

SEQ ID NO: 414686 - protein, 9 aa, Mycobacterium
ADDIEPGNH

SEQ ID NO: 414687 - protein, 9 aa, Mycobacterium
ADDIEPTDL

SEQ ID NO: 414688 - protein, 6 aa, Mycobacterium
ADDIPP

SEQ ID NO: 414689 - protein, 6 aa, Mycobacterium
ADDKAI

SEQ ID NO: 414690 - protein, 12 aa, Mycobacterium
ADDKEVPPGNTG

SEQ ID NO: 414691 - protein, 9 aa, Mycobacterium
ADDKGAALE

SEQ ID NO: 414692 - protein, 15 aa, Mycobacterium
ADDKQAYSEFVTAER

SEQ ID NO: 414693 - protein, 6 aa, Mycobacterium
ADDKQL

SEQ ID NO: 414694 - protein, 31 aa, Mycobacterium
ADDKRTGDQPVAAHAAPSAADEQPDEDLQGP

SEQ ID NO: 414695 - protein, 6 aa, Mycobacterium
ADDLAA

SEQ ID NO: 414696 - protein, 8 aa, Mycobacterium
ADDLDETH

SEQ ID NO: 414697 - protein, 16 aa, Mycobacterium
ADDLDGAVASASREAM

SEQ ID NO: 414698 - protein, 5 aa, Mycobacterium
ADDLG

SEQ ID NO: 414699 - protein, 6 aa, Mycobacterium
ADDLGG

SEQ ID NO: 414700 - protein, 13 aa, Mycobacterium
ADDLGKSQQEAGI

SEQ ID NO: 414701 - protein, 8 aa, Mycobacterium
ADDLREEK

SEQ ID NO: 414702 - protein, 5 aa, Mycobacterium
ADDLS

SEQ ID NO: 414703 - protein, 10 aa, Mycobacterium
ADDLSTEARE

SEQ ID NO: 414704 - protein, 9 aa, Mycobacterium
ADDNDLDEG

SEQ ID NO: 414705 - protein, 7 aa, Mycobacterium
ADDNGMR

SEQ ID NO: 414706 - protein, 5 aa, Mycobacterium
ADDNR

SEQ ID NO: 414707 - protein, 9 aa, Mycobacterium
ADDPAAQVT

SEQ ID NO: 414708 - protein, 8 aa, Mycobacterium
ADDPAARR

SEQ ID NO: 414709 - protein, 7 aa, Mycobacterium
ADDPAAT

SEQ ID NO: 414710 - protein, 7 aa, Mycobacterium
ADDPAGK

SEQ ID NO: 414711 - protein, 8 aa, Mycobacterium
ADDPAGVA

SEQ ID NO: 414712 - protein, 9 aa, Mycobacterium
ADDPAGYQA

SEQ ID NO: 414713 - protein, 6 aa, Mycobacterium
ADDPAH

SEQ ID NO: 414714 - protein, 7 aa, Mycobacterium
ADDPAHA

SEQ ID NO: 414715 - protein, 19 aa, Mycobacterium
ADDPAHRTVEARKDKRDGR

SEQ ID NO: 414716 - protein, 6 aa, Mycobacterium
ADDPAR

SEQ ID NO: 414717 - protein, 20 aa, Mycobacterium
ADDPAVHTRPATALPPPADD

SEQ ID NO: 414718 - protein, 8 aa, Mycobacterium
ADDPAVPT

SEQ ID NO: 414719 - protein, 9 aa, Mycobacterium
ADDPDDTMK

SEQ ID NO: 414720 - protein, 7 aa, Mycobacterium
ADDPDFR

SEQ ID NO: 414721 - protein, 12 aa, Mycobacterium
ADDPDRTRDETR

SEQ ID NO: 414722 - protein, 7 aa, Mycobacterium
ADDPDSY

SEQ ID NO: 414723 - protein, 7 aa, Mycobacterium
ADDPEDR

SEQ ID NO: 414724 - protein, 11 aa, Mycobacterium
ADDPEGQLGST

SEQ ID NO: 414725 - protein, 6 aa, Mycobacterium
ADDPER

SEQ ID NO: 414726 - protein, 6 aa, Mycobacterium
ADDPES

SEQ ID NO: 414727 - protein, 8 aa, Mycobacterium
ADDPETGR

SEQ ID NO: 414728 - protein, 11 aa, Mycobacterium
ADDPGADVDVP

SEQ ID NO: 414729 - protein, 6 aa, Mycobacterium
ADDPGL

SEQ ID NO: 414730 - protein, 6 aa, Mycobacterium
ADDPGR

SEQ ID NO: 414731 - protein, 6 aa, Mycobacterium
ADDPHA

SEQ ID NO: 414732 - protein, 7 aa, Mycobacterium
ADDPHGT

SEQ ID NO: 414733 - protein, 8 aa, Mycobacterium
ADDPLAPY

SEQ ID NO: 414734 - protein, 7 aa, Mycobacterium
ADDPLHA

SEQ ID NO: 414735 - protein, 7 aa, Mycobacterium
ADDPNAR

SEQ ID NO: 414736 - protein, 9 aa, Mycobacterium
ADDPPPMGE

SEQ ID NO: 414737 - protein, 5 aa, Mycobacterium
ADDPQ

SEQ ID NO: 414738 - protein, 8 aa, Mycobacterium
ADDPQAQI

SEQ ID NO: 414739 - protein, 6 aa, Mycobacterium
ADDPQW

SEQ ID NO: 414740 - protein, 5 aa, Mycobacterium
ADDPR

SEQ ID NO: 414741 - protein, 6 aa, Mycobacterium
ADDPRA

SEQ ID NO: 414742 - protein, 8 aa, Mycobacterium
ADDPRFAT

SEQ ID NO: 414743 - protein, 8 aa, Mycobacterium
ADDPRRAR

SEQ ID NO: 414744 - protein, 9 aa, Mycobacterium
ADDPRRTTT

SEQ ID NO: 414745 - protein, 10 aa, Mycobacterium
ADDPRRTTTS

SEQ ID NO: 414746 - protein, 7 aa, Mycobacterium
ADDPRTV

SEQ ID NO: 414747 - protein, 9 aa, Mycobacterium
ADDPRWGPA

SEQ ID NO: 414748 - protein, 8 aa, Mycobacterium
ADDPSHEV

SEQ ID NO: 414749 - protein, 10 aa, Mycobacterium
ADDPSPDPVH

SEQ ID NO: 414750 - protein, 9 aa, Mycobacterium
ADDPTHPVP

SEQ ID NO: 414751 - protein, 7 aa, Mycobacterium
ADDPTKV

SEQ ID NO: 414752 - protein, 6 aa, Mycobacterium
ADDPTT

SEQ ID NO: 414753 - protein, 5 aa, Mycobacterium
ADDPV

SEQ ID NO: 414754 - protein, 7 aa, Mycobacterium
ADDPVGF

SEQ ID NO: 414755 - protein, 8 aa, Mycobacterium
ADDPVRTM

SEQ ID NO: 414756 - protein, 7 aa, Mycobacterium
ADDPVSV

SEQ ID NO: 414757 - protein, 4 aa, Mycobacterium
ADDQ

SEQ ID NO: 414758 - protein, 8 aa, Mycobacterium
ADDQDPAE

SEQ ID NO: 414759 - protein, 10 aa, Mycobacterium
ADDQGPDSDF

SEQ ID NO: 414760 - protein, 5 aa, Mycobacterium
ADDQR

SEQ ID NO: 414761 - protein, 6 aa, Mycobacterium
ADDQRL

SEQ ID NO: 414762 - protein, 9 aa, Mycobacterium
ADDQRRRTT

SEQ ID NO: 414763 - protein, 6 aa, Mycobacterium
ADDQRT

SEQ ID NO: 414764 - protein, 15 aa, Mycobacterium
ADDQTATATISPANG

SEQ ID NO: 414765 - protein, 5 aa, Mycobacterium
ADDQV

SEQ ID NO: 414766 - protein, 6 aa, Mycobacterium
ADDQVK

SEQ ID NO: 414767 - protein, 5 aa, Mycobacterium
ADDQW

SEQ ID NO: 414768 - protein, 5 aa, Mycobacterium
ADDRA

SEQ ID NO: 414769 - protein, 6 aa, Mycobacterium
ADDRAG

SEQ ID NO: 414770 - protein, 7 aa, Mycobacterium
ADDRATD

SEQ ID NO: 414771 - protein, 6 aa, Mycobacterium
ADDRDA

SEQ ID NO: 414772 - protein, 6 aa, Mycobacterium
ADDRDR

SEQ ID NO: 414773 - protein, 10 aa, Mycobacterium
ADDRDVPADT

SEQ ID NO: 414774 - protein, 5 aa, Mycobacterium
ADDRG

SEQ ID NO: 414775 - protein, 16 aa, Mycobacterium
ADDRGGARRQGRQHGP

SEQ ID NO: 414776 - protein, 8 aa, Mycobacterium
ADDRGKLR

SEQ ID NO: 414777 - protein, 7 aa, Mycobacterium
ADDRGRP

SEQ ID NO: 414778 - protein, 12 aa, Mycobacterium
ADDRGRRHGSDA

SEQ ID NO: 414779 - protein, 7 aa, Mycobacterium
ADDRGTD

SEQ ID NO: 414780 - protein, 8 aa, Mycobacterium
ADDRGVPA

SEQ ID NO: 414781 - protein, 9 aa, Mycobacterium
ADDRNRGQV

SEQ ID NO: 414782 - protein, 20 aa, Mycobacterium
ADDRPAPGLGRGESHDTPKT

SEQ ID NO: 414783 - protein, 6 aa, Mycobacterium
ADDRPD

SEQ ID NO: 414784 - protein, 6 aa, Mycobacterium
ADDRPE

SEQ ID NO: 414785 - protein, 7 aa, Mycobacterium
ADDRPGA

SEQ ID NO: 414786 - protein, 10 aa, Mycobacterium
ADDRRRDTTT

SEQ ID NO: 414787 - protein, 30 aa, Mycobacterium
ADDRRRGRPDGQDRGQRIGELGPGRRRQPG

SEQ ID NO: 414788 - protein, 6 aa, Mycobacterium
ADDRRV

SEQ ID NO: 414789 - protein, 10 aa, Mycobacterium
ADDRSLDESY

SEQ ID NO: 414790 - protein, 5 aa, Mycobacterium
ADDRT

SEQ ID NO: 414791 - protein, 5 aa, Mycobacterium
ADDRV

SEQ ID NO: 414792 - protein, 4 aa, Mycobacterium
ADDS

SEQ ID NO: 414793 - protein, 5 aa, Mycobacterium
ADDSA

SEQ ID NO: 414794 - protein, 6 aa, Mycobacterium
ADDSAD

SEQ ID NO: 414795 - protein, 8 aa, Mycobacterium
ADDSAYEY

SEQ ID NO: 414796 - protein, 13 aa, Mycobacterium
ADDSDPLPPALPG

SEQ ID NO: 414797 - protein, 6 aa, Mycobacterium
ADDSDY

SEQ ID NO: 414798 - protein, 7 aa, Mycobacterium
ADDSGRI

SEQ ID NO: 414799 - protein, 9 aa, Mycobacterium
ADDSGRTGR

SEQ ID NO: 414800 - protein, 24 aa, Mycobacterium
ADDSMDASRRRTHGPRARAKPPVR

SEQ ID NO: 414801 - protein, 6 aa, Mycobacterium
ADDSNR

SEQ ID NO: 414802 - protein, 8 aa, Mycobacterium
ADDSRAAE

SEQ ID NO: 414803 - protein, 7 aa, Mycobacterium
ADDSSAL

SEQ ID NO: 414804 - protein, 5 aa, Mycobacterium
ADDST

SEQ ID NO: 414805 - protein, 13 aa, Mycobacterium
ADDSTLLLERLAE

SEQ ID NO: 414806 - protein, 10 aa, Mycobacterium
ADDSVPEETS

SEQ ID NO: 414807 - protein, 9 aa, Mycobacterium
ADDTAEEYA

SEQ ID NO: 414808 - protein, 32 aa, Mycobacterium
ADDTAESDAPPAADEPVETEQPDTSDNADVPG

SEQ ID NO: 414809 - protein, 10 aa, Mycobacterium
ADDTAGADRP

SEQ ID NO: 414810 - protein, 11 aa, Mycobacterium
ADDTDPDGRIG

SEQ ID NO: 414811 - protein, 8 aa, Mycobacterium
ADDTDTWP

SEQ ID NO: 414812 - protein, 5 aa, Mycobacterium
ADDTE

SEQ ID NO: 414813 - protein, 18 aa, Mycobacterium
ADDTGPITQSAARHCARP

SEQ ID NO: 414814 - protein, 7 aa, Mycobacterium
ADDTGSV

SEQ ID NO: 414815 - protein, 21 aa, Mycobacterium
ADDTPAVPRTAADRRPPVAAG

SEQ ID NO: 414816 - protein, 14 aa, Mycobacterium
ADDTPLSGRDPGEV

SEQ ID NO: 414817 - protein, 9 aa, Mycobacterium
ADDTPSPLT

SEQ ID NO: 414818 - protein, 8 aa, Mycobacterium
ADDTRRRI

SEQ ID NO: 414819 - protein, 32 aa, Mycobacterium
ADDTSEAGSTQQPADSGEAGRPDTADNADAPA

SEQ ID NO: 414820 - protein, 8 aa, Mycobacterium
ADDTTADV

SEQ ID NO: 414821 - protein, 8 aa, Mycobacterium
ADDTVARP

SEQ ID NO: 414822 - protein, 8 aa, Mycobacterium
ADDVASTK

SEQ ID NO: 414823 - protein, 11 aa, Mycobacterium
ADDVETASGRV

SEQ ID NO: 414824 - protein, 7 aa, Mycobacterium
ADDVQGS

SEQ ID NO: 414825 - protein, 18 aa, Mycobacterium
ADDVTVDTPYGAPSAPVT

SEQ ID NO: 414826 - protein, 4 aa, Mycobacterium
ADDY

SEQ ID NO: 414827 - protein, 5 aa, Mycobacterium
ADDYQ

SEQ ID NO: 414828 - protein, 4 aa, Mycobacterium
ADEA

SEQ ID NO: 414829 - protein, 5 aa, Mycobacterium
ADEAA

SEQ ID NO: 414830 - protein, 6 aa, Mycobacterium
ADEAAA

SEQ ID NO: 414831 - protein, 14 aa, Mycobacterium
ADEAAAKLRAAIES

SEQ ID NO: 414832 - protein, 8 aa, Mycobacterium
ADEAAEKA

SEQ ID NO: 414833 - protein, 7 aa, Mycobacterium
ADEAAER

SEQ ID NO: 414834 - protein, 14 aa, Mycobacterium
ADEAARSLNRGTVG

SEQ ID NO: 414835 - protein, 5 aa, Mycobacterium
ADEAC

SEQ ID NO: 414836 - protein, 6 aa, Mycobacterium
ADEACY

SEQ ID NO: 414837 - protein, 6 aa, Mycobacterium
ADEADA

SEQ ID NO: 414838 - protein, 8 aa, Mycobacterium
ADEAEAAF

SEQ ID NO: 414839 - protein, 8 aa, Mycobacterium
ADEAEREA

SEQ ID NO: 414840 - protein, 5 aa, Mycobacterium
ADEAF

SEQ ID NO: 414841 - protein, 11 aa, Mycobacterium
ADEAGEPQRTV

SEQ ID NO: 414842 - protein, 16 aa, Mycobacterium
ADEAGRKGYVSTKPNI

SEQ ID NO: 414843 - protein, 8 aa, Mycobacterium
ADEAKELG

SEQ ID NO: 414844 - protein, 8 aa, Mycobacterium
ADEAKRKF

SEQ ID NO: 414845 - protein, 12 aa, Mycobacterium
ADEAPDPGNPGQ

SEQ ID NO: 414846 - protein, 12 aa, Mycobacterium
ADEARAADQEIP

SEQ ID NO: 414847 - protein, 13 aa, Mycobacterium
ADEARAAGRDAAD

SEQ ID NO: 414848 - protein, 11 aa, Mycobacterium
ADEARAAGRDI

SEQ ID NO: 414849 - protein, 11 aa, Mycobacterium
ADEARAAGRDV

SEQ ID NO: 414850 - protein, 10 aa, Mycobacterium
ADEAREGARL

SEQ ID NO: 414851 - protein, 8 aa, Mycobacterium
ADEARGAG

SEQ ID NO: 414852 - protein, 6 aa, Mycobacterium
ADEARS

SEQ ID NO: 414853 - protein, 9 aa, Mycobacterium
ADEASEAVA

SEQ ID NO: 414854 - protein, 12 aa, Mycobacterium
ADEASQLTRPAD

SEQ ID NO: 414855 - protein, 6 aa, Mycobacterium
ADEASR

SEQ ID NO: 414856 - protein, 7 aa, Mycobacterium
ADEASTA

SEQ ID NO: 414857 - protein, 10 aa, Mycobacterium
ADEATASATV

SEQ ID NO: 414858 - protein, 27 aa, Mycobacterium
ADEAVSRAGAHDAERARLQSGSSRLEE

SEQ ID NO: 414859 - protein, 5 aa, Mycobacterium
ADEDA

SEQ ID NO: 414860 - protein, 5 aa, Mycobacterium
ADEDD

SEQ ID NO: 414861 - protein, 7 aa, Mycobacterium
ADEDDAA

SEQ ID NO: 414862 - protein, 18 aa, Mycobacterium
ADEDDTLDSYGRRSNPTW

SEQ ID NO: 414863 - protein, 9 aa, Mycobacterium
ADEDETAGF

SEQ ID NO: 414864 - protein, 5 aa, Mycobacterium
ADEDG

SEQ ID NO: 414865 - protein, 8 aa, Mycobacterium
ADEDGARR

SEQ ID NO: 414866 - protein, 10 aa, Mycobacterium
ADEDGNRFSD

SEQ ID NO: 414867 - protein, 5 aa, Mycobacterium
ADEDQ

SEQ ID NO: 414868 - protein, 9 aa, Mycobacterium
ADEDQAEAL

SEQ ID NO: 414869 - protein, 6 aa, Mycobacterium
ADEDRR

SEQ ID NO: 414870 - protein, 12 aa, Mycobacterium
ADEDSAGGMAEL

SEQ ID NO: 414871 - protein, 8 aa, Mycobacterium
ADEDTARQ

SEQ ID NO: 414872 - protein, 9 aa, Mycobacterium
ADEDTARQV

SEQ ID NO: 414873 - protein, 19 aa, Mycobacterium
ADEDWDAPGPSPLPAAQRA

SEQ ID NO: 414874 - protein, 7 aa, Mycobacterium
ADEEAAH

SEQ ID NO: 414875 - protein, 8 aa, Mycobacterium
ADEEARAA

SEQ ID NO: 414876 - protein, 9 aa, Mycobacterium
ADEEDPAAR

SEQ ID NO: 414877 - protein, 6 aa, Mycobacterium
ADEEDR

SEQ ID NO: 414878 - protein, 7 aa, Mycobacterium
ADEEDRH

SEQ ID NO: 414879 - protein, 7 aa, Mycobacterium
ADEEGAR

SEQ ID NO: 414880 - protein, 8 aa, Mycobacterium
ADEEPAGI

SEQ ID NO: 414881 - protein, 5 aa, Mycobacterium
ADEER

SEQ ID NO: 414882 - protein, 8 aa, Mycobacterium
ADEERGLG

SEQ ID NO: 414883 - protein, 7 aa, Mycobacterium
ADEERGW

SEQ ID NO: 414884 - protein, 8 aa, Mycobacterium
ADEESAHA

SEQ ID NO: 414885 - protein, 10 aa, Mycobacterium
ADEESEGYDR

SEQ ID NO: 414886 - protein, 9 aa, Mycobacterium
ADEESKTLS

SEQ ID NO: 414887 - protein, 8 aa, Mycobacterium
ADEETAQT

SEQ ID NO: 414888 - protein, 5 aa, Mycobacterium
ADEEV

SEQ ID NO: 414889 - protein, 7 aa, Mycobacterium
ADEFAAE

SEQ ID NO: 414890 - protein, 5 aa, Mycobacterium
ADEFD

SEQ ID NO: 414891 - protein, 5 aa, Mycobacterium
ADEFE

SEQ ID NO: 414892 - protein, 8 aa, Mycobacterium
ADEFPAKS

SEQ ID NO: 414893 - protein, 12 aa, Mycobacterium
ADEFSTPEKPRY

SEQ ID NO: 414894 - protein, 7 aa, Mycobacterium
ADEFTKP

SEQ ID NO: 414895 - protein, 7 aa, Mycobacterium
ADEGAET

SEQ ID NO: 414896 - protein, 12 aa, Mycobacterium
ADEGAGLPAEPI

SEQ ID NO: 414897 - protein, 7 aa, Mycobacterium
ADEGAPY

SEQ ID NO: 414898 - protein, 8 aa, Mycobacterium
ADEGASGK

SEQ ID NO: 414899 - protein, 7 aa, Mycobacterium
ADEGDDR

SEQ ID NO: 414900 - protein, 7 aa, Mycobacterium
ADEGDPM

SEQ ID NO: 414901 - protein, 9 aa, Mycobacterium
ADEGDSGTF

SEQ ID NO: 414902 - protein, 10 aa, Mycobacterium
ADEGDTVLTE

SEQ ID NO: 414903 - protein, 6 aa, Mycobacterium
ADEGGR

SEQ ID NO: 414904 - protein, 11 aa, Mycobacterium
ADEGGSGKHIN

SEQ ID NO: 414905 - protein, 5 aa, Mycobacterium
ADEGI

SEQ ID NO: 414906 - protein, 5 aa, Mycobacterium
ADEGL

SEQ ID NO: 414907 - protein, 6 aa, Mycobacterium
ADEGLD

SEQ ID NO: 414908 - protein, 6 aa, Mycobacterium
ADEGLR

SEQ ID NO: 414909 - protein, 16 aa, Mycobacterium
ADEGQGPAGRTPDLPG

SEQ ID NO: 414910 - protein, 6 aa, Mycobacterium
ADEGRA

SEQ ID NO: 414911 - protein, 15 aa, Mycobacterium
ADEGRCAVLDVQLPQ

SEQ ID NO: 414912 - protein, 17 aa, Mycobacterium
ADEGRKDDIAFLREKTG

SEQ ID NO: 414913 - protein, 17 aa, Mycobacterium
ADEGRKDDIAFLREKTN

SEQ ID NO: 414914 - protein, 17 aa, Mycobacterium
ADEGRKDDIAFLREKVN

SEQ ID NO: 414915 - protein, 6 aa, Mycobacterium
ADEGRR

SEQ ID NO: 414916 - protein, 7 aa, Mycobacterium
ADEGRYS

SEQ ID NO: 414917 - protein, 11 aa, Mycobacterium
ADEGSGGTDRT

SEQ ID NO: 414918 - protein, 6 aa, Mycobacterium
ADEGSV

SEQ ID NO: 414919 - protein, 8 aa, Mycobacterium
ADEGSVDR

SEQ ID NO: 414920 - protein, 5 aa, Mycobacterium
ADEGT

SEQ ID NO: 414921 - protein, 14 aa, Mycobacterium
ADEGVPGTSGRPNP

SEQ ID NO: 414922 - protein, 15 aa, Mycobacterium
ADEGVPRTSGRPNPD

SEQ ID NO: 414923 - protein, 7 aa, Mycobacterium
ADEGVQK

SEQ ID NO: 414924 - protein, 8 aa, Mycobacterium
ADEGWSSP

SEQ ID NO: 414925 - protein, 4 aa, Mycobacterium
ADEH

SEQ ID NO: 414926 - protein, 5 aa, Mycobacterium
ADEHA

SEQ ID NO: 414927 - protein, 15 aa, Mycobacterium
ADEHRDAFAGTEKGK

SEQ ID NO: 414928 - protein, 6 aa, Mycobacterium
ADEHTA

SEQ ID NO: 414929 - protein, 13 aa, Mycobacterium
ADEHTGQPRPPAV

SEQ ID NO: 414930 - protein, 6 aa, Mycobacterium
ADEIEG

SEQ ID NO: 414931 - protein, 7 aa, Mycobacterium
ADEIRDE

SEQ ID NO: 414932 - protein, 15 aa, Mycobacterium
ADEIRPAAAERAEEF

SEQ ID NO: 414933 - protein, 10 aa, Mycobacterium
ADEITEALSG

SEQ ID NO: 414934 - protein, 8 aa, Mycobacterium
ADEITTSR

SEQ ID NO: 414935 - protein, 4 aa, Mycobacterium
ADEK

SEQ ID NO: 414936 - protein, 8 aa, Mycobacterium
ADEKEAEL

SEQ ID NO: 414937 - protein, 7 aa, Mycobacterium
ADEKERA

SEQ ID NO: 414938 - protein, 8 aa, Mycobacterium
ADEKESEL

SEQ ID NO: 414939 - protein, 16 aa, Mycobacterium
ADEKNLGYGDPATTVS

SEQ ID NO: 414940 - protein, 10 aa, Mycobacterium
ADEKNPSTAA

SEQ ID NO: 414941 - protein, 16 aa, Mycobacterium
ADEKPGGHGDRAAAAG

SEQ ID NO: 414942 - protein, 8 aa, Mycobacterium
ADEKRSLD

SEQ ID NO: 414943 - protein, 12 aa, Mycobacterium
ADELEPDDDNRY

SEQ ID NO: 414944 - protein, 7 aa, Mycobacterium
ADELESD

SEQ ID NO: 414945 - protein, 7 aa, Mycobacterium
ADELGDH

SEQ ID NO: 414946 - protein, 12 aa, Mycobacterium
ADELGEGTSPAG

SEQ ID NO: 414947 - protein, 14 aa, Mycobacterium
ADELGLDPTSQSAD

SEQ ID NO: 414948 - protein, 7 aa, Mycobacterium
ADELGPH

SEQ ID NO: 414949 - protein, 18 aa, Mycobacterium
ADELGQGHGSEDGDVTFS

SEQ ID NO: 414950 - protein, 15 aa, Mycobacterium
ADELPAGVDAGDGVG

SEQ ID NO: 414951 - protein, 6 aa, Mycobacterium
ADELPE

SEQ ID NO: 414952 - protein, 9 aa, Mycobacterium
ADELPEKAK

SEQ ID NO: 414953 - protein, 7 aa, Mycobacterium
ADELRQA

SEQ ID NO: 414954 - protein, 7 aa, Mycobacterium
ADELRSH

SEQ ID NO: 414955 - protein, 12 aa, Mycobacterium
ADELRSNPEELA

SEQ ID NO: 414956 - protein, 5 aa, Mycobacterium
ADELV

SEQ ID NO: 414957 - protein, 14 aa, Mycobacterium
ADEMARSAGDRQAA

SEQ ID NO: 414958 - protein, 4 aa, Mycobacterium
ADEN

SEQ ID NO: 414959 - protein, 10 aa, Mycobacterium
ADENAKSSAA

SEQ ID NO: 414960 - protein, 5 aa, Mycobacterium
ADEND

SEQ ID NO: 414961 - protein, 15 aa, Mycobacterium
ADENEQTLPQGDDTA

SEQ ID NO: 414962 - protein, 10 aa, Mycobacterium
ADENGEPRAE

SEQ ID NO: 414963 - protein, 8 aa, Mycobacterium
ADENGNVK

SEQ ID NO: 414964 - protein, 6 aa, Mycobacterium
ADENGV

SEQ ID NO: 414965 - protein, 5 aa, Mycobacterium
ADENL

SEQ ID NO: 414966 - protein, 8 aa, Mycobacterium
ADENRARD

SEQ ID NO: 414967 - protein, 7 aa, Mycobacterium
ADENRDP

SEQ ID NO: 414968 - protein, 12 aa, Mycobacterium
ADENRLNPNGGA

SEQ ID NO: 414969 - protein, 15 aa, Mycobacterium
ADENTPVEPTTADDP

SEQ ID NO: 414970 - protein, 33 aa, Mycobacterium
ADEPAAQHEPARGAAAIPRRDEKVSAATGLETE

SEQ ID NO: 414971 - protein, 9 aa, Mycobacterium
ADEPAAQVT

SEQ ID NO: 414972 - protein, 13 aa, Mycobacterium
ADEPAEPAPNSYT

SEQ ID NO: 414973 - protein, 12 aa, Mycobacterium
ADEPDAEKETVP

SEQ ID NO: 414974 - protein, 7 aa, Mycobacterium
ADEPDRS

SEQ ID NO: 414975 - protein, 6 aa, Mycobacterium
ADEPDT

SEQ ID NO: 414976 - protein, 6 aa, Mycobacterium
ADEPEV

SEQ ID NO: 414977 - protein, 8 aa, Mycobacterium
ADEPEVDE

SEQ ID NO: 414978 - protein, 31 aa, Mycobacterium
ADEPGIPAAAAEQPDGVAAGAATTSRAGRRI

SEQ ID NO: 414979 - protein, 9 aa, Mycobacterium
ADEPGKRKY

SEQ ID NO: 414980 - protein, 30 aa, Mycobacterium
ADEPGTTEGVGTSTEGAEVSTDGAEAPVED

SEQ ID NO: 414981 - protein, 8 aa, Mycobacterium
ADEPHDEI

SEQ ID NO: 414982 - protein, 17 aa, Mycobacterium
ADEPIGVSPPAVDDVGD

SEQ ID NO: 414983 - protein, 8 aa, Mycobacterium
ADEPKGRQ

SEQ ID NO: 414984 - protein, 6 aa, Mycobacterium
ADEPLE

SEQ ID NO: 414985 - protein, 8 aa, Mycobacterium
ADEPLEGG

SEQ ID NO: 414986 - protein, 9 aa, Mycobacterium
ADEPNISST

SEQ ID NO: 414987 - protein, 11 aa, Mycobacterium
ADEPPDGPQPL

SEQ ID NO: 414988 - protein, 8 aa, Mycobacterium
ADEPPDYD

SEQ ID NO: 414989 - protein, 6 aa, Mycobacterium
ADEPPH

SEQ ID NO: 414990 - protein, 9 aa, Mycobacterium
ADEPPPPAV

SEQ ID NO: 414991 - protein, 7 aa, Mycobacterium
ADEPRGR

SEQ ID NO: 414992 - protein, 21 aa, Mycobacterium
ADEPSDPGDVEEPAPESPVAA

SEQ ID NO: 414993 - protein, 10 aa, Mycobacterium
ADEQAARAAE

SEQ ID NO: 414994 - protein, 6 aa, Mycobacterium
ADEQAS

SEQ ID NO: 414995 - protein, 6 aa, Mycobacterium
ADEQKM

SEQ ID NO: 414996 - protein, 6 aa, Mycobacterium
ADEQQR

SEQ ID NO: 414997 - protein, 7 aa, Mycobacterium
ADEQQRL

SEQ ID NO: 414998 - protein, 7 aa, Mycobacterium
ADEQRPR

SEQ ID NO: 414999 - protein, 7 aa, Mycobacterium
ADEQSRL

SEQ ID NO: 415000 - protein, 17 aa, Mycobacterium
ADEQTHRIAPSREPDDG

SEQ ID NO: 415001 - protein, 9 aa, Mycobacterium
ADEQTPIDS

SEQ ID NO: 415002 - protein, 6 aa, Mycobacterium
ADEQTV

SEQ ID NO: 415003 - protein, 4 aa, Mycobacterium
ADER

SEQ ID NO: 415004 - protein, 6 aa, Mycobacterium
ADERAA

SEQ ID NO: 415005 - protein, 8 aa, Mycobacterium
ADERAGRR

SEQ ID NO: 415006 - protein, 7 aa, Mycobacterium
ADERAKT

SEQ ID NO: 415007 - protein, 7 aa, Mycobacterium
ADERARV

SEQ ID NO: 415008 - protein, 7 aa, Mycobacterium
ADEREAV

SEQ ID NO: 415009 - protein, 5 aa, Mycobacterium
ADERI

SEQ ID NO: 415010 - protein, 14 aa, Mycobacterium
ADERLRTARKDNKV

SEQ ID NO: 415011 - protein, 7 aa, Mycobacterium
ADERPDL

SEQ ID NO: 415012 - protein, 7 aa, Mycobacterium
ADERRED

SEQ ID NO: 415013 - protein, 6 aa, Mycobacterium
ADERRQ

SEQ ID NO: 415014 - protein, 13 aa, Mycobacterium
ADERSGNGPVADK

SEQ ID NO: 415015 - protein, 5 aa, Mycobacterium
ADERT

SEQ ID NO: 415016 - protein, 4 aa, Mycobacterium
ADES

SEQ ID NO: 415017 - protein, 24 aa, Mycobacterium
ADESAREEAVRQATAAAQENAKAI

SEQ ID NO: 415018 - protein, 19 aa, Mycobacterium
ADESASGGDGTAADATSAP

SEQ ID NO: 415019 - protein, 6 aa, Mycobacterium
ADESAV

SEQ ID NO: 415020 - protein, 7 aa, Mycobacterium
ADESDGS

SEQ ID NO: 415021 - protein, 6 aa, Mycobacterium
ADESDP

SEQ ID NO: 415022 - protein, 6 aa, Mycobacterium
ADESGA

SEQ ID NO: 415023 - protein, 10 aa, Mycobacterium
ADESGGGTVS

SEQ ID NO: 415024 - protein, 7 aa, Mycobacterium
ADESGRI

SEQ ID NO: 415025 - protein, 10 aa, Mycobacterium
ADESISPAER

SEQ ID NO: 415026 - protein, 8 aa, Mycobacterium
ADESKADQ

SEQ ID NO: 415027 - protein, 8 aa, Mycobacterium
ADESKTFT

SEQ ID NO: 415028 - protein, 9 aa, Mycobacterium
ADESLSEPA

SEQ ID NO: 415029 - protein, 7 aa, Mycobacterium
ADESPKL

SEQ ID NO: 415030 - protein, 8 aa, Mycobacterium
ADESPTAA

SEQ ID NO: 415031 - protein, 8 aa, Mycobacterium
ADESQRVT

SEQ ID NO: 415032 - protein, 6 aa, Mycobacterium
ADESSV

SEQ ID NO: 415033 - protein, 6 aa, Mycobacterium
ADESTT

SEQ ID NO: 415034 - protein, 11 aa, Mycobacterium
ADESVTGERKL

SEQ ID NO: 415035 - protein, 13 aa, Mycobacterium
ADESYQIGEEGHP

SEQ ID NO: 415036 - protein, 4 aa, Mycobacterium
ADET

SEQ ID NO: 415037 - protein, 5 aa, Mycobacterium
ADETA

SEQ ID NO: 415038 - protein, 7 aa, Mycobacterium
ADETAAA

SEQ ID NO: 415039 - protein, 12 aa, Mycobacterium
ADETAGSLGTRG

SEQ ID NO: 415040 - protein, 6 aa, Mycobacterium
ADETAS

SEQ ID NO: 415041 - protein, 8 aa, Mycobacterium
ADETDPYG

SEQ ID NO: 415042 - protein, 10 aa, Mycobacterium
ADETDTVPSV

SEQ ID NO: 415043 - protein, 7 aa, Mycobacterium
ADETEIE

SEQ ID NO: 415044 - protein, 7 aa, Mycobacterium
ADETERT

SEQ ID NO: 415045 - protein, 9 aa, Mycobacterium
ADETESTFG

SEQ ID NO: 415046 - protein, 12 aa, Mycobacterium
ADETGACPSREY

SEQ ID NO: 415047 - protein, 8 aa, Mycobacterium
ADETGAPP

SEQ ID NO: 415048 - protein, 6 aa, Mycobacterium
ADETGR

SEQ ID NO: 415049 - protein, 5 aa, Mycobacterium
ADETL

SEQ ID NO: 415050 - protein, 7 aa, Mycobacterium
ADETLEK

SEQ ID NO: 415051 - protein, 12 aa, Mycobacterium
ADETLTGAGGLP

SEQ ID NO: 415052 - protein, 9 aa, Mycobacterium
ADETPGLRP

SEQ ID NO: 415053 - protein, 11 aa, Mycobacterium
ADETPPPGKGP

SEQ ID NO: 415054 - protein, 16 aa, Mycobacterium
ADETPQPPGDPRPDEL

SEQ ID NO: 415055 - protein, 5 aa, Mycobacterium
ADETS

SEQ ID NO: 415056 - protein, 7 aa, Mycobacterium
ADETSAL

SEQ ID NO: 415057 - protein, 5 aa, Mycobacterium
ADETV

SEQ ID NO: 415058 - protein, 5 aa, Mycobacterium
ADEVA

SEQ ID NO: 415059 - protein, 6 aa, Mycobacterium
ADEVAD

SEQ ID NO: 415060 - protein, 7 aa, Mycobacterium
ADEVAES

SEQ ID NO: 415061 - protein, 5 aa, Mycobacterium
ADEVE

SEQ ID NO: 415062 - protein, 10 aa, Mycobacterium
ADEVERSGDR

SEQ ID NO: 415063 - protein, 15 aa, Mycobacterium
ADEVGGTWRDNTYPG

SEQ ID NO: 415064 - protein, 9 aa, Mycobacterium
ADEVGPRAH

SEQ ID NO: 415065 - protein, 6 aa, Mycobacterium
ADEVPD

SEQ ID NO: 415066 - protein, 7 aa, Mycobacterium
ADEVPDA

SEQ ID NO: 415067 - protein, 8 aa, Mycobacterium
ADEVPSQL

SEQ ID NO: 415068 - protein, 8 aa, Mycobacterium
ADEVPTAL

SEQ ID NO: 415069 - protein, 10 aa, Mycobacterium
ADEVRPQGRA

SEQ ID NO: 415070 - protein, 8 aa, Mycobacterium
ADEVRSGR

SEQ ID NO: 415071 - protein, 6 aa, Mycobacterium
ADEVSG

SEQ ID NO: 415072 - protein, 14 aa, Mycobacterium
ADEVSQSALDRLVA

SEQ ID NO: 415073 - protein, 7 aa, Mycobacterium
ADEVSTA

SEQ ID NO: 415074 - protein, 15 aa, Mycobacterium
ADEVTATELAGEPIT

SEQ ID NO: 415075 - protein, 21 aa, Mycobacterium
ADEVTGTNAEDGVARVLERWW

SEQ ID NO: 415076 - protein, 15 aa, Mycobacterium
ADEVTTYGSTPRQNA

SEQ ID NO: 415077 - protein, 11 aa, Mycobacterium
ADEWSSPSGRR

SEQ ID NO: 415078 - protein, 4 aa, Mycobacterium
ADEY

SEQ ID NO: 415079 - protein, 10 aa, Mycobacterium
ADEYDQPGNY

SEQ ID NO: 415080 - protein, 6 aa, Mycobacterium
ADEYYK

SEQ ID NO: 415081 - protein, 14 aa, Mycobacterium
ADFDGTNDAETALR

SEQ ID NO: 415082 - protein, 12 aa, Mycobacterium
ADFEARTTSPST

SEQ ID NO: 415083 - protein, 6 aa, Mycobacterium
ADFEHP

SEQ ID NO: 415084 - protein, 8 aa, Mycobacterium
ADFEPTRA

SEQ ID NO: 415085 - protein, 4 aa, Mycobacterium
ADFG

SEQ ID NO: 415086 - protein, 5 aa, Mycobacterium
ADFGG

SEQ ID NO: 415087 - protein, 12 aa, Mycobacterium
ADFHGPSYQHPP

SEQ ID NO: 415088 - protein, 13 aa, Mycobacterium
ADFHGPSYQHPPA

SEQ ID NO: 415089 - protein, 14 aa, Mycobacterium
ADFPAGPQTLDGPN

SEQ ID NO: 415090 - protein, 15 aa, Mycobacterium
ADFPDGAAAAGSTAV

SEQ ID NO: 415091 - protein, 29 aa, Mycobacterium
ADFPEEGGPGDTLNASEGTDSDELRNDDG

SEQ ID NO: 415092 - protein, 6 aa, Mycobacterium
ADFPGR

SEQ ID NO: 415093 - protein, 6 aa, Mycobacterium
ADFPNN

SEQ ID NO: 415094 - protein, 15 aa, Mycobacterium
ADFQRGGFTEEESRG

SEQ ID NO: 415095 - protein, 4 aa, Mycobacterium
ADFR

SEQ ID NO: 415096 - protein, 6 aa, Mycobacterium
ADFRAG

SEQ ID NO: 415097 - protein, 9 aa, Mycobacterium
ADFSDPQRR

SEQ ID NO: 415098 - protein, 7 aa, Mycobacterium
ADFSGPA

SEQ ID NO: 415099 - protein, 8 aa, Mycobacterium
ADFSPADV

SEQ ID NO: 415100 - protein, 9 aa, Mycobacterium
ADFSPDGSE

SEQ ID NO: 415101 - protein, 6 aa, Mycobacterium
ADFSQS

SEQ ID NO: 415102 - protein, 4 aa, Mycobacterium
ADFT

SEQ ID NO: 415103 - protein, 6 aa, Mycobacterium
ADFTGS

SEQ ID NO: 415104 - protein, 5 aa, Mycobacterium
ADGAA

SEQ ID NO: 415105 - protein, 8 aa, Mycobacterium
ADGAAART

SEQ ID NO: 415106 - protein, 8 aa, Mycobacterium
ADGAASYD

SEQ ID NO: 415107 - protein, 8 aa, Mycobacterium
ADGAAVNR

SEQ ID NO: 415108 - protein, 36 aa, Mycobacterium
ADGADCPPALGKPAQPGRHGTVQTHPKPKIATTERF

SEQ ID NO: 415109 - protein, 7 aa, Mycobacterium
ADGADGF

SEQ ID NO: 415110 - protein, 6 aa, Mycobacterium
ADGADI

SEQ ID NO: 415111 - protein, 9 aa, Mycobacterium
ADGADPGQA

SEQ ID NO: 415112 - protein, 15 aa, Mycobacterium
ADGAEDPDARYTPFD

SEQ ID NO: 415113 - protein, 9 aa, Mycobacterium
ADGAEPDAD

SEQ ID NO: 415114 - protein, 12 aa, Mycobacterium
ADGAEVARDKNL

SEQ ID NO: 415115 - protein, 6 aa, Mycobacterium
ADGAEY

SEQ ID NO: 415116 - protein, 5 aa, Mycobacterium
ADGAG

SEQ ID NO: 415117 - protein, 6 aa, Mycobacterium
ADGAGE

SEQ ID NO: 415118 - protein, 16 aa, Mycobacterium
ADGAGGKGLRWLGGRK

SEQ ID NO: 415119 - protein, 10 aa, Mycobacterium
ADGAGQDARA

SEQ ID NO: 415120 - protein, 8 aa, Mycobacterium
ADGAINRG

SEQ ID NO: 415121 - protein, 5 aa, Mycobacterium
ADGAK

SEQ ID NO: 415122 - protein, 5 aa, Mycobacterium
ADGAL

SEQ ID NO: 415123 - protein, 16 aa, Mycobacterium
ADGALHSTGTAGPGAE

SEQ ID NO: 415124 - protein, 10 aa, Mycobacterium
ADGANDARDH

SEQ ID NO: 415125 - protein, 11 aa, Mycobacterium
ADGANDASDHV

SEQ ID NO: 415126 - protein, 11 aa, Mycobacterium
ADGANDASNHI

SEQ ID NO: 415127 - protein, 10 aa, Mycobacterium
ADGANDASSH

SEQ ID NO: 415128 - protein, 8 aa, Mycobacterium
ADGANGCR

SEQ ID NO: 415129 - protein, 10 aa, Mycobacterium
ADGANGPSLA

SEQ ID NO: 415130 - protein, 11 aa, Mycobacterium
ADGANPYAGPV

SEQ ID NO: 415131 - protein, 6 aa, Mycobacterium
ADGAPL

SEQ ID NO: 415132 - protein, 12 aa, Mycobacterium
ADGAPLSGGDDN

SEQ ID NO: 415133 - protein, 14 aa, Mycobacterium
ADGAPLVSESGAGR

SEQ ID NO: 415134 - protein, 9 aa, Mycobacterium
ADGAPQRPA

SEQ ID NO: 415135 - protein, 12 aa, Mycobacterium
ADGAPQRPAKPV

SEQ ID NO: 415136 - protein, 8 aa, Mycobacterium
ADGAPTTA

SEQ ID NO: 415137 - protein, 11 aa, Mycobacterium
ADGAPVDDGTV

SEQ ID NO: 415138 - protein, 7 aa, Mycobacterium
ADGAQAA

SEQ ID NO: 415139 - protein, 6 aa, Mycobacterium
ADGAQI

SEQ ID NO: 415140 - protein, 7 aa, Mycobacterium
ADGARAQ

SEQ ID NO: 415141 - protein, 6 aa, Mycobacterium
ADGARV

SEQ ID NO: 415142 - protein, 5 aa, Mycobacterium
ADGAS

SEQ ID NO: 415143 - protein, 8 aa, Mycobacterium
ADGASAAL

SEQ ID NO: 415144 - protein, 9 aa, Mycobacterium
ADGASAQAA

SEQ ID NO: 415145 - protein, 6 aa, Mycobacterium
ADGASF

SEQ ID NO: 415146 - protein, 15 aa, Mycobacterium
ADGASKVDTAAVSTG

SEQ ID NO: 415147 - protein, 6 aa, Mycobacterium
ADGASY

SEQ ID NO: 415148 - protein, 9 aa, Mycobacterium
ADGATGRYT

SEQ ID NO: 415149 - protein, 6 aa, Mycobacterium
ADGATV

SEQ ID NO: 415150 - protein, 5 aa, Mycobacterium
ADGAV

SEQ ID NO: 415151 - protein, 29 aa, Mycobacterium
ADGAVAAEAAESDGLADSAFTAGPADPGV

SEQ ID NO: 415152 - protein, 8 aa, Mycobacterium
ADGAVEDP

SEQ ID NO: 415153 - protein, 5 aa, Mycobacterium
ADGDA

SEQ ID NO: 415154 - protein, 18 aa, Mycobacterium
ADGDADATDEGTGALPAT

SEQ ID NO: 415155 - protein, 9 aa, Mycobacterium
ADGDAGKQR

SEQ ID NO: 415156 - protein, 12 aa, Mycobacterium
ADGDAGPEARET

SEQ ID NO: 415157 - protein, 7 aa, Mycobacterium
ADGDAHS

SEQ ID NO: 415158 - protein, 39 aa, Mycobacterium
ADGDAPIPAESGPPVGPEGLTPTQLASDANEERLREERA

SEQ ID NO: 415159 - protein, 17 aa, Mycobacterium
ADGDAPYQPAVGQDDRG

SEQ ID NO: 415160 - protein, 9 aa, Mycobacterium
ADGDATTGM

SEQ ID NO: 415161 - protein, 6 aa, Mycobacterium
ADGDCR

SEQ ID NO: 415162 - protein, 8 aa, Mycobacterium
ADGDDHPL

SEQ ID NO: 415163 - protein, 5 aa, Mycobacterium
ADGDE

SEQ ID NO: 415164 - protein, 7 aa, Mycobacterium
ADGDEGT

SEQ ID NO: 415165 - protein, 7 aa, Mycobacterium
ADGDEIS

SEQ ID NO: 415166 - protein, 7 aa, Mycobacterium
ADGDELR

SEQ ID NO: 415167 - protein, 5 aa, Mycobacterium
ADGDG

SEQ ID NO: 415168 - protein, 10 aa, Mycobacterium
ADGDGGSITD

SEQ ID NO: 415169 - protein, 17 aa, Mycobacterium
ADGDGNADASHRGGNPG

SEQ ID NO: 415170 - protein, 9 aa, Mycobacterium
ADGDGPVAG

SEQ ID NO: 415171 - protein, 10 aa, Mycobacterium
ADGDGQHAAQ

SEQ ID NO: 415172 - protein, 12 aa, Mycobacterium
ADGDGSVLALQR

SEQ ID NO: 415173 - protein, 12 aa, Mycobacterium
ADGDGSVLAVSR

SEQ ID NO: 415174 - protein, 16 aa, Mycobacterium
ADGDGSVLSLRRSGGG

SEQ ID NO: 415175 - protein, 5 aa, Mycobacterium
ADGDI

SEQ ID NO: 415176 - protein, 6 aa, Mycobacterium
ADGDID

SEQ ID NO: 415177 - protein, 6 aa, Mycobacterium
ADGDLA

SEQ ID NO: 415178 - protein, 7 aa, Mycobacterium
ADGDLAP

SEQ ID NO: 415179 - protein, 8 aa, Mycobacterium
ADGDPGEA

SEQ ID NO: 415180 - protein, 10 aa, Mycobacterium
ADGDPHGARG

SEQ ID NO: 415181 - protein, 7 aa, Mycobacterium
ADGDPQL

SEQ ID NO: 415182 - protein, 6 aa, Mycobacterium
ADGDPT

SEQ ID NO: 415183 - protein, 18 aa, Mycobacterium
ADGDPVPFSTTPTAPLTG

SEQ ID NO: 415184 - protein, 5 aa, Mycobacterium
ADGDQ

SEQ ID NO: 415185 - protein, 14 aa, Mycobacterium
ADGDQDGGQDTVDA

SEQ ID NO: 415186 - protein, 8 aa, Mycobacterium
ADGDQEKL

SEQ ID NO: 415187 - protein, 12 aa, Mycobacterium
ADGDRGPSATSV

SEQ ID NO: 415188 - protein, 14 aa, Mycobacterium
ADGDRNGDGTLEAD

SEQ ID NO: 415189 - protein, 32 aa, Mycobacterium
ADGDSPIPAEAGAPVGPEGLTPTQRASDANEE

SEQ ID NO: 415190 - protein, 9 aa, Mycobacterium
ADGDSPLAG

SEQ ID NO: 415191 - protein, 5 aa, Mycobacterium
ADGDT

SEQ ID NO: 415192 - protein, 19 aa, Mycobacterium
ADGDTDESAGDPGDAAPAR

SEQ ID NO: 415193 - protein, 5 aa, Mycobacterium
ADGDV

SEQ ID NO: 415194 - protein, 14 aa, Mycobacterium
ADGDVVGAAPRSRV

SEQ ID NO: 415195 - protein, 9 aa, Mycobacterium
ADGEAADDP

SEQ ID NO: 415196 - protein, 8 aa, Mycobacterium
ADGEADDP

SEQ ID NO: 415197 - protein, 17 aa, Mycobacterium
ADGEDGVVDEGTGAITA

SEQ ID NO: 415198 - protein, 19 aa, Mycobacterium
ADGEDPDFGRGSSAYDGYW

SEQ ID NO: 415199 - protein, 9 aa, Mycobacterium
ADGEEAARR

SEQ ID NO: 415200 - protein, 13 aa, Mycobacterium
ADGEEADDDAVTH

SEQ ID NO: 415201 - protein, 6 aa, Mycobacterium
ADGEEL

SEQ ID NO: 415202 - protein, 6 aa, Mycobacterium
ADGEEV

SEQ ID NO: 415203 - protein, 15 aa, Mycobacterium
ADGEGGVVDEGTGPV

SEQ ID NO: 415204 - protein, 8 aa, Mycobacterium
ADGEGGYI

SEQ ID NO: 415205 - protein, 16 aa, Mycobacterium
ADGEGLASYDPSLDPA

SEQ ID NO: 415206 - protein, 14 aa, Mycobacterium
ADGEGSVLALRPTG

SEQ ID NO: 415207 - protein, 8 aa, Mycobacterium
ADGEHAIE

SEQ ID NO: 415208 - protein, 13 aa, Mycobacterium
ADGEKAAAAAGRT

SEQ ID NO: 415209 - protein, 12 aa, Mycobacterium
ADGEKACAAAGR

SEQ ID NO: 415210 - protein, 12 aa, Mycobacterium
ADGEKACAGAGR

SEQ ID NO: 415211 - protein, 12 aa, Mycobacterium
ADGEKASAAAGR

SEQ ID NO: 415212 - protein, 9 aa, Mycobacterium
ADGELDTEA

SEQ ID NO: 415213 - protein, 6 aa, Mycobacterium
ADGELT

SEQ ID NO: 415214 - protein, 10 aa, Mycobacterium
ADGEPEPRSI

SEQ ID NO: 415215 - protein, 8 aa, Mycobacterium
ADGEPGEI

SEQ ID NO: 415216 - protein, 7 aa, Mycobacterium
ADGEPRW

SEQ ID NO: 415217 - protein, 11 aa, Mycobacterium
ADGEPTDEHRY

SEQ ID NO: 415218 - protein, 9 aa, Mycobacterium
ADGEPVGES

SEQ ID NO: 415219 - protein, 8 aa, Mycobacterium
ADGEQKQI

SEQ ID NO: 415220 - protein, 7 aa, Mycobacterium
ADGEQLD

SEQ ID NO: 415221 - protein, 11 aa, Mycobacterium
ADGEQVDEDTP

SEQ ID NO: 415222 - protein, 8 aa, Mycobacterium
ADGERKSD

SEQ ID NO: 415223 - protein, 13 aa, Mycobacterium
ADGERQASAAGKR

SEQ ID NO: 415224 - protein, 10 aa, Mycobacterium
ADGERRSIRT

SEQ ID NO: 415225 - protein, 9 aa, Mycobacterium
ADGERTHRL

SEQ ID NO: 415226 - protein, 7 aa, Mycobacterium
ADGERVA

SEQ ID NO: 415227 - protein, 7 aa, Mycobacterium
ADGERYS

SEQ ID NO: 415228 - protein, 14 aa, Mycobacterium
ADGESHTTEGTTEG

SEQ ID NO: 415229 - protein, 6 aa, Mycobacterium
ADGESL

SEQ ID NO: 415230 - protein, 8 aa, Mycobacterium
ADGESPHE

SEQ ID NO: 415231 - protein, 7 aa, Mycobacterium
ADGESTV

SEQ ID NO: 415232 - protein, 6 aa, Mycobacterium
ADGESV

SEQ ID NO: 415233 - protein, 7 aa, Mycobacterium
ADGEVEQ

SEQ ID NO: 415234 - protein, 9 aa, Mycobacterium
ADGEVSDED

SEQ ID NO: 415235 - protein, 7 aa, Mycobacterium
ADGFAAG

SEQ ID NO: 415236 - protein, 5 aa, Mycobacterium
ADGFE

SEQ ID NO: 415237 - protein, 5 aa, Mycobacterium
ADGGA

SEQ ID NO: 415238 - protein, 6 aa, Mycobacterium
ADGGAD

SEQ ID NO: 415239 - protein, 15 aa, Mycobacterium
ADGGAPISLPEAGSY

SEQ ID NO: 415240 - protein, 9 aa, Mycobacterium
ADGGDGSVA

SEQ ID NO: 415241 - protein, 8 aa, Mycobacterium
ADGGDPNL

SEQ ID NO: 415242 - protein, 11 aa, Mycobacterium
ADGGEFDESGR

SEQ ID NO: 415243 - protein, 9 aa, Mycobacterium
ADGGEGTVD

SEQ ID NO: 415244 - protein, 18 aa, Mycobacterium
ADGGGEPAAAQAESAPRV

SEQ ID NO: 415245 - protein, 8 aa, Mycobacterium
ADGGGGSI

SEQ ID NO: 415246 - protein, 9 aa, Mycobacterium
ADGGGGSVE

SEQ ID NO: 415247 - protein, 53 aa, Mycobacterium
ADGGHGGAGGHGAAGGDGGAGGDGGPLAGAGGSGGTGGSGNAGGGAGGAGGNA

SEQ ID NO: 415248 - protein, 7 aa, Mycobacterium
ADGGIPD

SEQ ID NO: 415249 - protein, 7 aa, Mycobacterium
ADGGIPL

SEQ ID NO: 415250 - protein, 8 aa, Mycobacterium
ADGGLADR

SEQ ID NO: 415251 - protein, 8 aa, Mycobacterium
ADGGNAID

SEQ ID NO: 415252 - protein, 9 aa, Mycobacterium
ADGGPAGGH

SEQ ID NO: 415253 - protein, 6 aa, Mycobacterium
ADGGPF

SEQ ID NO: 415254 - protein, 6 aa, Mycobacterium
ADGGPI

SEQ ID NO: 415255 - protein, 7 aa, Mycobacterium
ADGGPLK

SEQ ID NO: 415256 - protein, 22 aa, Mycobacterium
ADGGPLPAPSGSSMGLGAGGRM

SEQ ID NO: 415257 - protein, 6 aa, Mycobacterium
ADGGQA

SEQ ID NO: 415258 - protein, 9 aa, Mycobacterium
ADGGQESQC

SEQ ID NO: 415259 - protein, 49 aa, Mycobacterium
ADGGQGQQPGNGGQQQHQQPSWGQHSGGTGGQIRPGEAGRAEAAKRFKT

SEQ ID NO: 415260 - protein, 14 aa, Mycobacterium
ADGGQISAGRAGEA

SEQ ID NO: 415261 - protein, 7 aa, Mycobacterium
ADGGQSV

SEQ ID NO: 415262 - protein, 13 aa, Mycobacterium
ADGGQVEVSTTEG

SEQ ID NO: 415263 - protein, 6 aa, Mycobacterium
ADGGRA

SEQ ID NO: 415264 - protein, 7 aa, Mycobacterium
ADGGRGA

SEQ ID NO: 415265 - protein, 10 aa, Mycobacterium
ADGGRGGDAG

SEQ ID NO: 415266 - protein, 8 aa, Mycobacterium
ADGGRQEV

SEQ ID NO: 415267 - protein, 8 aa, Mycobacterium
ADGGRSTV

SEQ ID NO: 415268 - protein, 9 aa, Mycobacterium
ADGGRSTVR

SEQ ID NO: 415269 - protein, 7 aa, Mycobacterium
ADGGSAF

SEQ ID NO: 415270 - protein, 11 aa, Mycobacterium
ADGGSAPLPDF

SEQ ID NO: 415271 - protein, 7 aa, Mycobacterium
ADGGSAR

SEQ ID NO: 415272 - protein, 8 aa, Mycobacterium
ADGGSARL

SEQ ID NO: 415273 - protein, 15 aa, Mycobacterium
ADGGSAVRLVNQTAY

SEQ ID NO: 415274 - protein, 9 aa, Mycobacterium
ADGGSITSV

SEQ ID NO: 415275 - protein, 13 aa, Mycobacterium
ADGGSRGNPGLAG

SEQ ID NO: 415276 - protein, 9 aa, Mycobacterium
ADGGSSITR

SEQ ID NO: 415277 - protein, 13 aa, Mycobacterium
ADGGSVTLTGRSD

SEQ ID NO: 415278 - protein, 7 aa, Mycobacterium
ADGGTAI

SEQ ID NO: 415279 - protein, 8 aa, Mycobacterium
ADGGTAPS

SEQ ID NO: 415280 - protein, 6 aa, Mycobacterium
ADGGTE

SEQ ID NO: 415281 - protein, 10 aa, Mycobacterium
ADGGTKPTSV

SEQ ID NO: 415282 - protein, 6 aa, Mycobacterium
ADGGTL

SEQ ID NO: 415283 - protein, 6 aa, Mycobacterium
ADGGTV

SEQ ID NO: 415284 - protein, 12 aa, Mycobacterium
ADGGVLGKVVLE

SEQ ID NO: 415285 - protein, 11 aa, Mycobacterium
ADGHKTSGPYT

SEQ ID NO: 415286 - protein, 14 aa, Mycobacterium
ADGHSRANVGISSA

SEQ ID NO: 415287 - protein, 19 aa, Mycobacterium
ADGHSRANVGRASAEATAQ

SEQ ID NO: 415288 - protein, 5 aa, Mycobacterium
ADGHT

SEQ ID NO: 415289 - protein, 12 aa, Mycobacterium
ADGHTPETEEYG

SEQ ID NO: 415290 - protein, 7 aa, Mycobacterium
ADGIAAG

SEQ ID NO: 415291 - protein, 26 aa, Mycobacterium
ADGIAAGRYESAAAGGVDTASDAPIA

SEQ ID NO: 415292 - protein, 8 aa, Mycobacterium
ADGIARGR

SEQ ID NO: 415293 - protein, 9 aa, Mycobacterium
ADGIPANPD

SEQ ID NO: 415294 - protein, 6 aa, Mycobacterium
ADGIPE

SEQ ID NO: 415295 - protein, 5 aa, Mycobacterium
ADGIT

SEQ ID NO: 415296 - protein, 4 aa, Mycobacterium
ADGK

SEQ ID NO: 415297 - protein, 5 aa, Mycobacterium
ADGKA

SEQ ID NO: 415298 - protein, 6 aa, Mycobacterium
ADGKAD

SEQ ID NO: 415299 - protein, 19 aa, Mycobacterium
ADGKAVSLEEKPKTPKSHY

SEQ ID NO: 415300 - protein, 8 aa, Mycobacterium
ADGKDSTL

SEQ ID NO: 415301 - protein, 8 aa, Mycobacterium
ADGKDVEA

SEQ ID NO: 415302 - protein, 8 aa, Mycobacterium
ADGKEDLD

SEQ ID NO: 415303 - protein, 6 aa, Mycobacterium
ADGKLT

SEQ ID NO: 415304 - protein, 7 aa, Mycobacterium
ADGKPAV

SEQ ID NO: 415305 - protein, 17 aa, Mycobacterium
ADGKPEPYEAGTWGPES

SEQ ID NO: 415306 - protein, 8 aa, Mycobacterium
ADGKPLPA

SEQ ID NO: 415307 - protein, 7 aa, Mycobacterium
ADGKPTV

SEQ ID NO: 415308 - protein, 7 aa, Mycobacterium
ADGKRRK

SEQ ID NO: 415309 - protein, 7 aa, Mycobacterium
ADGKRYH

SEQ ID NO: 415310 - protein, 16 aa, Mycobacterium
ADGKSLNVAGSENNLT

SEQ ID NO: 415311 - protein, 16 aa, Mycobacterium
ADGKSLNVAGSENTLT

SEQ ID NO: 415312 - protein, 7 aa, Mycobacterium
ADGKTAR

SEQ ID NO: 415313 - protein, 15 aa, Mycobacterium
ADGKTCRFNPWPFPI

SEQ ID NO: 415314 - protein, 8 aa, Mycobacterium
ADGKTNPV

SEQ ID NO: 415315 - protein, 8 aa, Mycobacterium
ADGLADER

SEQ ID NO: 415316 - protein, 20 aa, Mycobacterium
ADGLATTAARAAGAGTGGRF

SEQ ID NO: 415317 - protein, 5 aa, Mycobacterium
ADGLD

SEQ ID NO: 415318 - protein, 8 aa, Mycobacterium
ADGLDGER

SEQ ID NO: 415319 - protein, 5 aa, Mycobacterium
ADGLE

SEQ ID NO: 415320 - protein, 8 aa, Mycobacterium
ADGLGDIP

SEQ ID NO: 415321 - protein, 8 aa, Mycobacterium
ADGLGPGR

SEQ ID NO: 415322 - protein, 14 aa, Mycobacterium
ADGLPDDADPSFGE

SEQ ID NO: 415323 - protein, 9 aa, Mycobacterium
ADGLPGPTD

SEQ ID NO: 415324 - protein, 6 aa, Mycobacterium
ADGLQA

SEQ ID NO: 415325 - protein, 9 aa, Mycobacterium
ADGLRAGQA

SEQ ID NO: 415326 - protein, 21 aa, Mycobacterium
ADGLRPDAATGVFSGPEPIPG

SEQ ID NO: 415327 - protein, 13 aa, Mycobacterium
ADGLRQTENAGES

SEQ ID NO: 415328 - protein, 5 aa, Mycobacterium
ADGLS

SEQ ID NO: 415329 - protein, 6 aa, Mycobacterium
ADGLSQ

SEQ ID NO: 415330 - protein, 7 aa, Mycobacterium
ADGLTGE

SEQ ID NO: 415331 - protein, 13 aa, Mycobacterium
ADGMYDDESPGAG

SEQ ID NO: 415332 - protein, 4 aa, Mycobacterium
ADGN

SEQ ID NO: 415333 - protein, 7 aa, Mycobacterium
ADGNALS

SEQ ID NO: 415334 - protein, 24 aa, Mycobacterium
ADGNDLPGITTSDCGYKGGLAGVD

SEQ ID NO: 415335 - protein, 10 aa, Mycobacterium
ADGNDSQRLR

SEQ ID NO: 415336 - protein, 11 aa, Mycobacterium
ADGNEAPDGAV

SEQ ID NO: 415337 - protein, 8 aa, Mycobacterium
ADGNETVP

SEQ ID NO: 415338 - protein, 10 aa, Mycobacterium
ADGNGDGIGD

SEQ ID NO: 415339 - protein, 7 aa, Mycobacterium
ADGNGVA

SEQ ID NO: 415340 - protein, 17 aa, Mycobacterium
ADGNHLPEARSAARELS

SEQ ID NO: 415341 - protein, 15 aa, Mycobacterium
ADGNNGGAGGDGGGA

SEQ ID NO: 415342 - protein, 5 aa, Mycobacterium
ADGNP

SEQ ID NO: 415343 - protein, 7 aa, Mycobacterium
ADGNPSW

SEQ ID NO: 415344 - protein, 8 aa, Mycobacterium
ADGNPVGE

SEQ ID NO: 415345 - protein, 9 aa, Mycobacterium
ADGNPVGEA

SEQ ID NO: 415346 - protein, 11 aa, Mycobacterium
ADGNPVPQGEV

SEQ ID NO: 415347 - protein, 7 aa, Mycobacterium
ADGNPYG

SEQ ID NO: 415348 - protein, 8 aa, Mycobacterium
ADGNRQRA

SEQ ID NO: 415349 - protein, 17 aa, Mycobacterium
ADGNRQRAHYDGVPGDF

SEQ ID NO: 415350 - protein, 10 aa, Mycobacterium
ADGNRQRSHY

SEQ ID NO: 415351 - protein, 7 aa, Mycobacterium
ADGNSAA

SEQ ID NO: 415352 - protein, 8 aa, Mycobacterium
ADGNTASA

SEQ ID NO: 415353 - protein, 5 aa, Mycobacterium
ADGPA

SEQ ID NO: 415354 - protein, 25 aa, Mycobacterium
ADGPAAPVNGTGPKSATRKGSTKKV

SEQ ID NO: 415355 - protein, 8 aa, Mycobacterium
ADGPADAL

SEQ ID NO: 415356 - protein, 8 aa, Mycobacterium
ADGPATIE

SEQ ID NO: 415357 - protein, 8 aa, Mycobacterium
ADGPDEVH

SEQ ID NO: 415358 - protein, 9 aa, Mycobacterium
ADGPDLRRD

SEQ ID NO: 415359 - protein, 7 aa, Mycobacterium
ADGPDNA

SEQ ID NO: 415360 - protein, 14 aa, Mycobacterium
ADGPDRLPGDHPMS

SEQ ID NO: 415361 - protein, 8 aa, Mycobacterium
ADGPDSAA

SEQ ID NO: 415362 - protein, 6 aa, Mycobacterium
ADGPDV

SEQ ID NO: 415363 - protein, 11 aa, Mycobacterium
ADGPGGEKNWS

SEQ ID NO: 415364 - protein, 7 aa, Mycobacterium
ADGPGLK

SEQ ID NO: 415365 - protein, 7 aa, Mycobacterium
ADGPGTT

SEQ ID NO: 415366 - protein, 7 aa, Mycobacterium
ADGPHSS

SEQ ID NO: 415367 - protein, 5 aa, Mycobacterium
ADGPI

SEQ ID NO: 415368 - protein, 8 aa, Mycobacterium
ADGPLGEL

SEQ ID NO: 415369 - protein, 9 aa, Mycobacterium
ADGPLSGEA

SEQ ID NO: 415370 - protein, 5 aa, Mycobacterium
ADGPP

SEQ ID NO: 415371 - protein, 7 aa, Mycobacterium
ADGPPDV

SEQ ID NO: 415372 - protein, 7 aa, Mycobacterium
ADGPPES

SEQ ID NO: 415373 - protein, 9 aa, Mycobacterium
ADGPPFSET

SEQ ID NO: 415374 - protein, 10 aa, Mycobacterium
ADGPQNGYLG

SEQ ID NO: 415375 - protein, 6 aa, Mycobacterium
ADGPRT

SEQ ID NO: 415376 - protein, 5 aa, Mycobacterium
ADGPS

SEQ ID NO: 415377 - protein, 9 aa, Mycobacterium
ADGPSDALA

SEQ ID NO: 415378 - protein, 10 aa, Mycobacterium
ADGPSDALAA

SEQ ID NO: 415379 - protein, 8 aa, Mycobacterium
ADGPSGGR

SEQ ID NO: 415380 - protein, 12 aa, Mycobacterium
ADGPSNPEDHPE

SEQ ID NO: 415381 - protein, 7 aa, Mycobacterium
ADGPSTR

SEQ ID NO: 415382 - protein, 7 aa, Mycobacterium
ADGPTIS

SEQ ID NO: 415383 - protein, 18 aa, Mycobacterium
ADGPTRGGAHGGPRTRGQ

SEQ ID NO: 415384 - protein, 8 aa, Mycobacterium
ADGPTSTA

SEQ ID NO: 415385 - protein, 9 aa, Mycobacterium
ADGPVDAQG

SEQ ID NO: 415386 - protein, 9 aa, Mycobacterium
ADGPVDAQQ

SEQ ID NO: 415387 - protein, 6 aa, Mycobacterium
ADGPVE

SEQ ID NO: 415388 - protein, 6 aa, Mycobacterium
ADGPVG

SEQ ID NO: 415389 - protein, 11 aa, Mycobacterium
ADGPVGPPPFT

SEQ ID NO: 415390 - protein, 8 aa, Mycobacterium
ADGPVSNG

SEQ ID NO: 415391 - protein, 8 aa, Mycobacterium
ADGPVTNG

SEQ ID NO: 415392 - protein, 7 aa, Mycobacterium
ADGQAFK

SEQ ID NO: 415393 - protein, 44 aa, Mycobacterium
ADGQDPHQDPRGQRRRTQCDGGQPARPGALQQPPGRDQDRDQRH

SEQ ID NO: 415394 - protein, 22 aa, Mycobacterium
ADGQDRFTGDTGMAAGDERQVV

SEQ ID NO: 415395 - protein, 22 aa, Mycobacterium
ADGQDRFTGETGIAGGDERQVV

SEQ ID NO: 415396 - protein, 8 aa, Mycobacterium
ADGQEHAY

SEQ ID NO: 415397 - protein, 9 aa, Mycobacterium
ADGQEYART

SEQ ID NO: 415398 - protein, 15 aa, Mycobacterium
ADGQHPVVTELRSTR

SEQ ID NO: 415399 - protein, 6 aa, Mycobacterium
ADGQHR

SEQ ID NO: 415400 - protein, 7 aa, Mycobacterium
ADGQHRV

SEQ ID NO: 415401 - protein, 5 aa, Mycobacterium
ADGQL

SEQ ID NO: 415402 - protein, 7 aa, Mycobacterium
ADGQLGA

SEQ ID NO: 415403 - protein, 6 aa, Mycobacterium
ADGQLP

SEQ ID NO: 415404 - protein, 5 aa, Mycobacterium
ADGQP

SEQ ID NO: 415405 - protein, 8 aa, Mycobacterium
ADGQPGEI

SEQ ID NO: 415406 - protein, 8 aa, Mycobacterium
ADGQPGEV

SEQ ID NO: 415407 - protein, 9 aa, Mycobacterium
ADGQPSASV

SEQ ID NO: 415408 - protein, 9 aa, Mycobacterium
ADGQQHVAG

SEQ ID NO: 415409 - protein, 22 aa, Mycobacterium
ADGQQHVARQRDPLELSEDGVG

SEQ ID NO: 415410 - protein, 5 aa, Mycobacterium
ADGQR

SEQ ID NO: 415411 - protein, 8 aa, Mycobacterium
ADGQSGEV

SEQ ID NO: 415412 - protein, 5 aa, Mycobacterium
ADGQT

SEQ ID NO: 415413 - protein, 19 aa, Mycobacterium
ADGQTTIGTAEQDGQIPGQ

SEQ ID NO: 415414 - protein, 18 aa, Mycobacterium
ADGQVQRQTVTSIAMGET

SEQ ID NO: 415415 - protein, 7 aa, Mycobacterium
ADGQVSA

SEQ ID NO: 415416 - protein, 6 aa, Mycobacterium
ADGQVV

SEQ ID NO: 415417 - protein, 6 aa, Mycobacterium
ADGQYF

SEQ ID NO: 415418 - protein, 6 aa, Mycobacterium
ADGRAE

SEQ ID NO: 415419 - protein, 13 aa, Mycobacterium
ADGRAEPRTTGRP

SEQ ID NO: 415420 - protein, 6 aa, Mycobacterium
ADGRAP

SEQ ID NO: 415421 - protein, 7 aa, Mycobacterium
ADGRATI

SEQ ID NO: 415422 - protein, 10 aa, Mycobacterium
ADGRDSDLAA

SEQ ID NO: 415423 - protein, 7 aa, Mycobacterium
ADGRDSL

SEQ ID NO: 415424 - protein, 7 aa, Mycobacterium
ADGRDVK

SEQ ID NO: 415425 - protein, 5 aa, Mycobacterium
ADGRE

SEQ ID NO: 415426 - protein, 7 aa, Mycobacterium
ADGRERE

SEQ ID NO: 415427 - protein, 7 aa, Mycobacterium
ADGRERR

SEQ ID NO: 415428 - protein, 6 aa, Mycobacterium
ADGRFE

SEQ ID NO: 415429 - protein, 6 aa, Mycobacterium
ADGRGA

SEQ ID NO: 415430 - protein, 9 aa, Mycobacterium
ADGRGKRRV

SEQ ID NO: 415431 - protein, 7 aa, Mycobacterium
ADGRGLP

SEQ ID NO: 415432 - protein, 19 aa, Mycobacterium
ADGRGRGALAHSRAPLTAL

SEQ ID NO: 415433 - protein, 11 aa, Mycobacterium
ADGRKSAVRAA

SEQ ID NO: 415434 - protein, 6 aa, Mycobacterium
ADGRLD

SEQ ID NO: 415435 - protein, 12 aa, Mycobacterium
ADGRNPPARGSR

SEQ ID NO: 415436 - protein, 9 aa, Mycobacterium
ADGRPASRS

SEQ ID NO: 415437 - protein, 6 aa, Mycobacterium
ADGRPC

SEQ ID NO: 415438 - protein, 6 aa, Mycobacterium
ADGRPG

SEQ ID NO: 415439 - protein, 14 aa, Mycobacterium
ADGRPKDTKAVMPE

SEQ ID NO: 415440 - protein, 6 aa, Mycobacterium
ADGRPL

SEQ ID NO: 415441 - protein, 7 aa, Mycobacterium
ADGRPLG

SEQ ID NO: 415442 - protein, 9 aa, Mycobacterium
ADGRPPLDQ

SEQ ID NO: 415443 - protein, 9 aa, Mycobacterium
ADGRPPLER

SEQ ID NO: 415444 - protein, 16 aa, Mycobacterium
ADGRPRNAPLRRESVA

SEQ ID NO: 415445 - protein, 8 aa, Mycobacterium
ADGRPTSR

SEQ ID NO: 415446 - protein, 5 aa, Mycobacterium
ADGRR

SEQ ID NO: 415447 - protein, 7 aa, Mycobacterium
ADGRRAR

SEQ ID NO: 415448 - protein, 9 aa, Mycobacterium
ADGRRDEAA

SEQ ID NO: 415449 - protein, 12 aa, Mycobacterium
ADGRRPPEKGSR

SEQ ID NO: 415450 - protein, 7 aa, Mycobacterium
ADGRRPR

SEQ ID NO: 415451 - protein, 6 aa, Mycobacterium
ADGRRR

SEQ ID NO: 415452 - protein, 15 aa, Mycobacterium
ADGRRRFADPATRYA

SEQ ID NO: 415453 - protein, 10 aa, Mycobacterium
ADGRSAPPGV

SEQ ID NO: 415454 - protein, 12 aa, Mycobacterium
ADGRSESPMESE

SEQ ID NO: 415455 - protein, 20 aa, Mycobacterium
ADGRSKSFDAAADGYGRGEG

SEQ ID NO: 415456 - protein, 8 aa, Mycobacterium
ADGRSRAT

SEQ ID NO: 415457 - protein, 19 aa, Mycobacterium
ADGRSRHESCPRSAEEVVL

SEQ ID NO: 415458 - protein, 14 aa, Mycobacterium
ADGRSTKVNEPGPF

SEQ ID NO: 415459 - protein, 5 aa, Mycobacterium
ADGRT

SEQ ID NO: 415460 - protein, 7 aa, Mycobacterium
ADGRTSR

SEQ ID NO: 415461 - protein, 5 aa, Mycobacterium
ADGRV

SEQ ID NO: 415462 - protein, 7 aa, Mycobacterium
ADGRVEQ

SEQ ID NO: 415463 - protein, 12 aa, Mycobacterium
ADGRVRGGVRGD

SEQ ID NO: 415464 - protein, 9 aa, Mycobacterium
ADGSAADVP

SEQ ID NO: 415465 - protein, 7 aa, Mycobacterium
ADGSAAY

SEQ ID NO: 415466 - protein, 9 aa, Mycobacterium
ADGSATSRP

SEQ ID NO: 415467 - protein, 5 aa, Mycobacterium
ADGSD

SEQ ID NO: 415468 - protein, 8 aa, Mycobacterium
ADGSDADL

SEQ ID NO: 415469 - protein, 6 aa, Mycobacterium
ADGSDP

SEQ ID NO: 415470 - protein, 9 aa, Mycobacterium
ADGSDTAGR

SEQ ID NO: 415471 - protein, 6 aa, Mycobacterium
ADGSDV

SEQ ID NO: 415472 - protein, 8 aa, Mycobacterium
ADGSDWQV

SEQ ID NO: 415473 - protein, 5 aa, Mycobacterium
ADGSE

SEQ ID NO: 415474 - protein, 8 aa, Mycobacterium
ADGSEKIR

SEQ ID NO: 415475 - protein, 6 aa, Mycobacterium
ADGSEP

SEQ ID NO: 415476 - protein, 7 aa, Mycobacterium
ADGSEVA

SEQ ID NO: 415477 - protein, 10 aa, Mycobacterium
ADGSEVSGEE

SEQ ID NO: 415478 - protein, 8 aa, Mycobacterium
ADGSGAMA

SEQ ID NO: 415479 - protein, 7 aa, Mycobacterium
ADGSGVD

SEQ ID NO: 415480 - protein, 9 aa, Mycobacterium
ADGSHAPED

SEQ ID NO: 415481 - protein, 10 aa, Mycobacterium
ADGSHAPEEL

SEQ ID NO: 415482 - protein, 6 aa, Mycobacterium
ADGSIA

SEQ ID NO: 415483 - protein, 13 aa, Mycobacterium
ADGSLEITGDADK

SEQ ID NO: 415484 - protein, 9 aa, Mycobacterium
ADGSLGQLP

SEQ ID NO: 415485 - protein, 6 aa, Mycobacterium
ADGSLV

SEQ ID NO: 415486 - protein, 9 aa, Mycobacterium
ADGSPASNA

SEQ ID NO: 415487 - protein, 9 aa, Mycobacterium
ADGSPDLGP

SEQ ID NO: 415488 - protein, 8 aa, Mycobacterium
ADGSPDTV

SEQ ID NO: 415489 - protein, 8 aa, Mycobacterium
ADGSPHGM

SEQ ID NO: 415490 - protein, 10 aa, Mycobacterium
ADGSPHSAGI

SEQ ID NO: 415491 - protein, 8 aa, Mycobacterium
ADGSPIGT

SEQ ID NO: 415492 - protein, 8 aa, Mycobacterium
ADGSPLDR

SEQ ID NO: 415493 - protein, 7 aa, Mycobacterium
ADGSPPY

SEQ ID NO: 415494 - protein, 22 aa, Mycobacterium
ADGSPSPDRPPSRYSRDLPPET

SEQ ID NO: 415495 - protein, 9 aa, Mycobacterium
ADGSPSSLS

SEQ ID NO: 415496 - protein, 18 aa, Mycobacterium
ADGSPTPERRYGRDLPAE

SEQ ID NO: 415497 - protein, 9 aa, Mycobacterium
ADGSPVAVS

SEQ ID NO: 415498 - protein, 9 aa, Mycobacterium
ADGSPVGDA

SEQ ID NO: 415499 - protein, 6 aa, Mycobacterium
ADGSQK

SEQ ID NO: 415500 - protein, 9 aa, Mycobacterium
ADGSRATTL

SEQ ID NO: 415501 - protein, 8 aa, Mycobacterium
ADGSRPRD

SEQ ID NO: 415502 - protein, 12 aa, Mycobacterium
ADGSSADGYYPQ

SEQ ID NO: 415503 - protein, 7 aa, Mycobacterium
ADGSSIN

SEQ ID NO: 415504 - protein, 7 aa, Mycobacterium
ADGSSLK

SEQ ID NO: 415505 - protein, 10 aa, Mycobacterium
ADGSSVTPVD

SEQ ID NO: 415506 - protein, 10 aa, Mycobacterium
ADGSTAAGAS

SEQ ID NO: 415507 - protein, 8 aa, Mycobacterium
ADGSTLDS

SEQ ID NO: 415508 - protein, 9 aa, Mycobacterium
ADGSTRIPG

SEQ ID NO: 415509 - protein, 6 aa, Mycobacterium
ADGSVL

SEQ ID NO: 415510 - protein, 7 aa, Mycobacterium
ADGSVNA

SEQ ID NO: 415511 - protein, 11 aa, Mycobacterium
ADGSVSPATGT

SEQ ID NO: 415512 - protein, 10 aa, Mycobacterium
ADGSVTDRAD

SEQ ID NO: 415513 - protein, 11 aa, Mycobacterium
ADGSVTDRADP

SEQ ID NO: 415514 - protein, 8 aa, Mycobacterium
ADGSVTGV

SEQ ID NO: 415515 - protein, 8 aa, Mycobacterium
ADGSVVDR

SEQ ID NO: 415516 - protein, 6 aa, Mycobacterium
ADGSYD

SEQ ID NO: 415517 - protein, 14 aa, Mycobacterium
ADGSYGLDEVNDEQ

SEQ ID NO: 415518 - protein, 7 aa, Mycobacterium
ADGTAAQ

SEQ ID NO: 415519 - protein, 8 aa, Mycobacterium
ADGTAARA

SEQ ID NO: 415520 - protein, 7 aa, Mycobacterium
ADGTAER

SEQ ID NO: 415521 - protein, 12 aa, Mycobacterium
ADGTAESTGVAR

SEQ ID NO: 415522 - protein, 7 aa, Mycobacterium
ADGTALS

SEQ ID NO: 415523 - protein, 10 aa, Mycobacterium
ADGTARPNEI

SEQ ID NO: 415524 - protein, 12 aa, Mycobacterium
ADGTAVRQLIRF

SEQ ID NO: 415525 - protein, 8 aa, Mycobacterium
ADGTDAAI

SEQ ID NO: 415526 - protein, 9 aa, Mycobacterium
ADGTDGPAS

SEQ ID NO: 415527 - protein, 12 aa, Mycobacterium
ADGTDKKDRYAA

SEQ ID NO: 415528 - protein, 6 aa, Mycobacterium
ADGTDP

SEQ ID NO: 415529 - protein, 6 aa, Mycobacterium
ADGTDV

SEQ ID NO: 415530 - protein, 8 aa, Mycobacterium
ADGTELSR

SEQ ID NO: 415531 - protein, 9 aa, Mycobacterium
ADGTERARA

SEQ ID NO: 415532 - protein, 14 aa, Mycobacterium
ADGTEVAISPLVYE

SEQ ID NO: 415533 - protein, 14 aa, Mycobacterium
ADGTEVATSPLATE

SEQ ID NO: 415534 - protein, 8 aa, Mycobacterium
ADGTEYDL

SEQ ID NO: 415535 - protein, 15 aa, Mycobacterium
ADGTFRRRARGRGIG

SEQ ID NO: 415536 - protein, 9 aa, Mycobacterium
ADGTGAQRY

SEQ ID NO: 415537 - protein, 8 aa, Mycobacterium
ADGTGARA

SEQ ID NO: 415538 - protein, 11 aa, Mycobacterium
ADGTGESTGVT

SEQ ID NO: 415539 - protein, 16 aa, Mycobacterium
ADGTGGNTGRDWNTLS

SEQ ID NO: 415540 - protein, 6 aa, Mycobacterium
ADGTIE

SEQ ID NO: 415541 - protein, 13 aa, Mycobacterium
ADGTIPNASGSLH

SEQ ID NO: 415542 - protein, 7 aa, Mycobacterium
ADGTITD

SEQ ID NO: 415543 - protein, 9 aa, Mycobacterium
ADGTKDPEF

SEQ ID NO: 415544 - protein, 14 aa, Mycobacterium
ADGTKFGKSTGGGN

SEQ ID NO: 415545 - protein, 5 aa, Mycobacterium
ADGTM

SEQ ID NO: 415546 - protein, 6 aa, Mycobacterium
ADGTMV

SEQ ID NO: 415547 - protein, 8 aa, Mycobacterium
ADGTPIKA

SEQ ID NO: 415548 - protein, 6 aa, Mycobacterium
ADGTPL

SEQ ID NO: 415549 - protein, 7 aa, Mycobacterium
ADGTPLG

SEQ ID NO: 415550 - protein, 7 aa, Mycobacterium
ADGTPLN

SEQ ID NO: 415551 - protein, 15 aa, Mycobacterium
ADGTPRPPDGRETAT

SEQ ID NO: 415552 - protein, 11 aa, Mycobacterium
ADGTPTPEHRY

SEQ ID NO: 415553 - protein, 8 aa, Mycobacterium
ADGTQANS

SEQ ID NO: 415554 - protein, 6 aa, Mycobacterium
ADGTQI

SEQ ID NO: 415555 - protein, 8 aa, Mycobacterium
ADGTRNLR

SEQ ID NO: 415556 - protein, 8 aa, Mycobacterium
ADGTRPRE

SEQ ID NO: 415557 - protein, 6 aa, Mycobacterium
ADGTRR

SEQ ID NO: 415558 - protein, 7 aa, Mycobacterium
ADGTRVA

SEQ ID NO: 415559 - protein, 7 aa, Mycobacterium
ADGTRVG

SEQ ID NO: 415560 - protein, 7 aa, Mycobacterium
ADGTSAG

SEQ ID NO: 415561 - protein, 13 aa, Mycobacterium
ADGTSAKALTGID

SEQ ID NO: 415562 - protein, 9 aa, Mycobacterium
ADGTSEGTV

SEQ ID NO: 415563 - protein, 6 aa, Mycobacterium
ADGTSL

SEQ ID NO: 415564 - protein, 16 aa, Mycobacterium
ADGTSSRAAPDDRSPF

SEQ ID NO: 415565 - protein, 6 aa, Mycobacterium
ADGTTA

SEQ ID NO: 415566 - protein, 7 aa, Mycobacterium
ADGTTAL

SEQ ID NO: 415567 - protein, 7 aa, Mycobacterium
ADGTTAV

SEQ ID NO: 415568 - protein, 8 aa, Mycobacterium
ADGTTEMS

SEQ ID NO: 415569 - protein, 7 aa, Mycobacterium
ADGTTRP

SEQ ID NO: 415570 - protein, 6 aa, Mycobacterium
ADGTTV

SEQ ID NO: 415571 - protein, 5 aa, Mycobacterium
ADGTV

SEQ ID NO: 415572 - protein, 7 aa, Mycobacterium
ADGTVEN

SEQ ID NO: 415573 - protein, 6 aa, Mycobacterium
ADGTVG

SEQ ID NO: 415574 - protein, 6 aa, Mycobacterium
ADGTVQ

SEQ ID NO: 415575 - protein, 7 aa, Mycobacterium
ADGTVTA

SEQ ID NO: 415576 - protein, 9 aa, Mycobacterium
ADGTVTTAE

SEQ ID NO: 415577 - protein, 14 aa, Mycobacterium
ADGVADPERRDDLE

SEQ ID NO: 415578 - protein, 17 aa, Mycobacterium
ADGVADPERRDDLESSG

SEQ ID NO: 415579 - protein, 10 aa, Mycobacterium
ADGVASAKRR

SEQ ID NO: 415580 - protein, 11 aa, Mycobacterium
ADGVASASRRA

SEQ ID NO: 415581 - protein, 11 aa, Mycobacterium
ADGVASSGRIA

SEQ ID NO: 415582 - protein, 5 aa, Mycobacterium
ADGVD

SEQ ID NO: 415583 - protein, 9 aa, Mycobacterium
ADGVDGDAG

SEQ ID NO: 415584 - protein, 9 aa, Mycobacterium
ADGVDPAEI

SEQ ID NO: 415585 - protein, 17 aa, Mycobacterium
ADGVGAEETAISHEPEA

SEQ ID NO: 415586 - protein, 6 aa, Mycobacterium
ADGVGG

SEQ ID NO: 415587 - protein, 15 aa, Mycobacterium
ADGVGGPTYRSEPLD

SEQ ID NO: 415588 - protein, 9 aa, Mycobacterium
ADGVGPPTA

SEQ ID NO: 415589 - protein, 5 aa, Mycobacterium
ADGVP

SEQ ID NO: 415590 - protein, 6 aa, Mycobacterium
ADGVPD

SEQ ID NO: 415591 - protein, 9 aa, Mycobacterium
ADGVRAGRA

SEQ ID NO: 415592 - protein, 6 aa, Mycobacterium
ADGVSE

SEQ ID NO: 415593 - protein, 7 aa, Mycobacterium
ADGVSPG

SEQ ID NO: 415594 - protein, 9 aa, Mycobacterium
ADGVSVEPL

SEQ ID NO: 415595 - protein, 7 aa, Mycobacterium
ADGWNSD

SEQ ID NO: 415596 - protein, 5 aa, Mycobacterium
ADGWQ

SEQ ID NO: 415597 - protein, 6 aa, Mycobacterium
ADGWQT

SEQ ID NO: 415598 - protein, 8 aa, Mycobacterium
ADGYDPPR

SEQ ID NO: 415599 - protein, 7 aa, Mycobacterium
ADGYERA

SEQ ID NO: 415600 - protein, 5 aa, Mycobacterium
ADGYH

SEQ ID NO: 415601 - protein, 10 aa, Mycobacterium
ADGYSRSGAG

SEQ ID NO: 415602 - protein, 11 aa, Mycobacterium
ADGYSRSGAGV

SEQ ID NO: 415603 - protein, 9 aa, Mycobacterium
ADGYSRSGC

SEQ ID NO: 415604 - protein, 8 aa, Mycobacterium
ADGYVRGE

SEQ ID NO: 415605 - protein, 7 aa, Mycobacterium
ADGYVRS

SEQ ID NO: 415606 - protein, 10 aa, Mycobacterium
ADHAHARAAT

SEQ ID NO: 415607 - protein, 5 aa, Mycobacterium
ADHAR

SEQ ID NO: 415608 - protein, 18 aa, Mycobacterium
ADHARQTAVQADAAAAAY

SEQ ID NO: 415609 - protein, 4 aa, Mycobacterium
ADHD

SEQ ID NO: 415610 - protein, 5 aa, Mycobacterium
ADHDA

SEQ ID NO: 415611 - protein, 8 aa, Mycobacterium
ADHDAQAA

SEQ ID NO: 415612 - protein, 6 aa, Mycobacterium
ADHDDY

SEQ ID NO: 415613 - protein, 12 aa, Mycobacterium
ADHDEKRLTSCG

SEQ ID NO: 415614 - protein, 5 aa, Mycobacterium
ADHDG

SEQ ID NO: 415615 - protein, 11 aa, Mycobacterium
ADHDRSRASMD

SEQ ID NO: 415616 - protein, 6 aa, Mycobacterium
ADHDRV

SEQ ID NO: 415617 - protein, 4 aa, Mycobacterium
ADHE

SEQ ID NO: 415618 - protein, 9 aa, Mycobacterium
ADHESGDDA

SEQ ID NO: 415619 - protein, 29 aa, Mycobacterium
ADHESKTAREVAEKAQAEGREMSEEEADV

SEQ ID NO: 415620 - protein, 7 aa, Mycobacterium
ADHGDHR

SEQ ID NO: 415621 - protein, 30 aa, Mycobacterium
ADHGDIAGARYDARADRYEPADDPATRRVA

SEQ ID NO: 415622 - protein, 7 aa, Mycobacterium
ADHGDTR

SEQ ID NO: 415623 - protein, 28 aa, Mycobacterium
ADHGGTVTARRGRENISDPTQNDASTNW

SEQ ID NO: 415624 - protein, 7 aa, Mycobacterium
ADHGPLR

SEQ ID NO: 415625 - protein, 9 aa, Mycobacterium
ADHGREPTN

SEQ ID NO: 415626 - protein, 33 aa, Mycobacterium
ADHGSNVGVDQSQTRVGGDYTNVSGHGSADIDK

SEQ ID NO: 415627 - protein, 6 aa, Mycobacterium
ADHGVT

SEQ ID NO: 415628 - protein, 8 aa, Mycobacterium
ADHHPPAG

SEQ ID NO: 415629 - protein, 4 aa, Mycobacterium
ADHK

SEQ ID NO: 415630 - protein, 10 aa, Mycobacterium
ADHKEKLSEL

SEQ ID NO: 415631 - protein, 5 aa, Mycobacterium
ADHLD

SEQ ID NO: 415632 - protein, 7 aa, Mycobacterium
ADHPAGQ

SEQ ID NO: 415633 - protein, 7 aa, Mycobacterium
ADHPDAR

SEQ ID NO: 415634 - protein, 14 aa, Mycobacterium
ADHPDLPVDTATDD

SEQ ID NO: 415635 - protein, 7 aa, Mycobacterium
ADHPDNP

SEQ ID NO: 415636 - protein, 5 aa, Mycobacterium
ADHPE

SEQ ID NO: 415637 - protein, 7 aa, Mycobacterium
ADHPEAD

SEQ ID NO: 415638 - protein, 9 aa, Mycobacterium
ADHPEQGGW

SEQ ID NO: 415639 - protein, 7 aa, Mycobacterium
ADHPERY

SEQ ID NO: 415640 - protein, 5 aa, Mycobacterium
ADHPH

SEQ ID NO: 415641 - protein, 7 aa, Mycobacterium
ADHPHRV

SEQ ID NO: 415642 - protein, 7 aa, Mycobacterium
ADHPQQV

SEQ ID NO: 415643 - protein, 8 aa, Mycobacterium
ADHQRRGI

SEQ ID NO: 415644 - protein, 4 aa, Mycobacterium
ADHR

SEQ ID NO: 415645 - protein, 5 aa, Mycobacterium
ADHRP

SEQ ID NO: 415646 - protein, 6 aa, Mycobacterium
ADHRPE

SEQ ID NO: 415647 - protein, 22 aa, Mycobacterium
ADHRPTETDRARAELAAMGIDT

SEQ ID NO: 415648 - protein, 7 aa, Mycobacterium
ADHSAGK

SEQ ID NO: 415649 - protein, 8 aa, Mycobacterium
ADHSAGRR

SEQ ID NO: 415650 - protein, 9 aa, Mycobacterium
ADHSSKAGF

SEQ ID NO: 415651 - protein, 9 aa, Mycobacterium
ADHSSTVGQ

SEQ ID NO: 415652 - protein, 4 aa, Mycobacterium
ADHT

SEQ ID NO: 415653 - protein, 6 aa, Mycobacterium
ADHTGV

SEQ ID NO: 415654 - protein, 6 aa, Mycobacterium
ADHTYG

SEQ ID NO: 415655 - protein, 6 aa, Mycobacterium
ADHVPE

SEQ ID NO: 415656 - protein, 6 aa, Mycobacterium
ADHYEA

SEQ ID NO: 415657 - protein, 12 aa, Mycobacterium
ADHYGPSYQHPP

SEQ ID NO: 415658 - protein, 5 aa, Mycobacterium
ADHYS

SEQ ID NO: 415659 - protein, 10 aa, Mycobacterium
ADIADDARAA

SEQ ID NO: 415660 - protein, 8 aa, Mycobacterium
ADIARAAG

SEQ ID NO: 415661 - protein, 8 aa, Mycobacterium
ADIARASG

SEQ ID NO: 415662 - protein, 8 aa, Mycobacterium
ADIARSAA

SEQ ID NO: 415663 - protein, 4 aa, Mycobacterium
ADID

SEQ ID NO: 415664 - protein, 8 aa, Mycobacterium
ADIDDDEL

SEQ ID NO: 415665 - protein, 17 aa, Mycobacterium
ADIDPDDLEDSDPFEEG

SEQ ID NO: 415666 - protein, 17 aa, Mycobacterium
ADIDPEDLEDSDPFEEG

SEQ ID NO: 415667 - protein, 7 aa, Mycobacterium
ADIDPSE

SEQ ID NO: 415668 - protein, 13 aa, Mycobacterium
ADIDQEPGQGPAS

SEQ ID NO: 415669 - protein, 4 aa, Mycobacterium
ADIE

SEQ ID NO: 415670 - protein, 18 aa, Mycobacterium
ADIEDESGGDLLDEGADE

SEQ ID NO: 415671 - protein, 14 aa, Mycobacterium
ADIEDTATSISGDA

SEQ ID NO: 415672 - protein, 6 aa, Mycobacterium
ADIEPD

SEQ ID NO: 415673 - protein, 12 aa, Mycobacterium
ADIEPNPRQPRQ

SEQ ID NO: 415674 - protein, 6 aa, Mycobacterium
ADIEQA

SEQ ID NO: 415675 - protein, 7 aa, Mycobacterium
ADIERSE

SEQ ID NO: 415676 - protein, 19 aa, Mycobacterium
ADIESDQVGPENESSAKAL

SEQ ID NO: 415677 - protein, 5 aa, Mycobacterium
ADIGA

SEQ ID NO: 415678 - protein, 11 aa, Mycobacterium
ADIGDDSNIGA

SEQ ID NO: 415679 - protein, 11 aa, Mycobacterium
ADIGDHSNIGA

SEQ ID NO: 415680 - protein, 6 aa, Mycobacterium
ADIGGI

SEQ ID NO: 415681 - protein, 10 aa, Mycobacterium
ADIGNRAGRL

SEQ ID NO: 415682 - protein, 5 aa, Mycobacterium
ADIGP

SEQ ID NO: 415683 - protein, 11 aa, Mycobacterium
ADIGSGAGLPG

SEQ ID NO: 415684 - protein, 9 aa, Mycobacterium
ADIGTGEQI

SEQ ID NO: 415685 - protein, 6 aa, Mycobacterium
ADIKGG

SEQ ID NO: 415686 - protein, 7 aa, Mycobacterium
ADIPTPA

SEQ ID NO: 415687 - protein, 8 aa, Mycobacterium
ADIQGEPT

SEQ ID NO: 415688 - protein, 11 aa, Mycobacterium
ADIQGGTTAEG

SEQ ID NO: 415689 - protein, 22 aa, Mycobacterium
ADIRDEGNGRKSIGAWLLSAHL

SEQ ID NO: 415690 - protein, 5 aa, Mycobacterium
ADIRP

SEQ ID NO: 415691 - protein, 8 aa, Mycobacterium
ADIRPGDD

SEQ ID NO: 415692 - protein, 7 aa, Mycobacterium
ADIRPGQ

SEQ ID NO: 415693 - protein, 8 aa, Mycobacterium
ADIRSPAP

SEQ ID NO: 415694 - protein, 11 aa, Mycobacterium
ADISGAANIGT

SEQ ID NO: 415695 - protein, 19 aa, Mycobacterium
ADISGDGLADTVQKAGDLA

SEQ ID NO: 415696 - protein, 9 aa, Mycobacterium
ADISRRSGL

SEQ ID NO: 415697 - protein, 6 aa, Mycobacterium
ADISTA

SEQ ID NO: 415698 - protein, 4 aa, Mycobacterium
ADIT

SEQ ID NO: 415699 - protein, 10 aa, Mycobacterium
ADITDGSSLA

SEQ ID NO: 415700 - protein, 8 aa, Mycobacterium
ADITRAAT

SEQ ID NO: 415701 - protein, 6 aa, Mycobacterium
ADITSE

SEQ ID NO: 415702 - protein, 9 aa, Mycobacterium
ADITTEQLN

SEQ ID NO: 415703 - protein, 4 aa, Mycobacterium
ADKA

SEQ ID NO: 415704 - protein, 8 aa, Mycobacterium
ADKAEEYR

SEQ ID NO: 415705 - protein, 9 aa, Mycobacterium
ADKAEGGEI

SEQ ID NO: 415706 - protein, 8 aa, Mycobacterium
ADKAEGVK

SEQ ID NO: 415707 - protein, 6 aa, Mycobacterium
ADKAGR

SEQ ID NO: 415708 - protein, 8 aa, Mycobacterium
ADKANTKD

SEQ ID NO: 415709 - protein, 11 aa, Mycobacterium
ADKARAVRETE

SEQ ID NO: 415710 - protein, 8 aa, Mycobacterium
ADKASYNP

SEQ ID NO: 415711 - protein, 5 aa, Mycobacterium
ADKDA

SEQ ID NO: 415712 - protein, 14 aa, Mycobacterium
ADKDELAAQKDTEI

SEQ ID NO: 415713 - protein, 10 aa, Mycobacterium
ADKGEALAKE

SEQ ID NO: 415714 - protein, 8 aa, Mycobacterium
ADKGEDDA

SEQ ID NO: 415715 - protein, 8 aa, Mycobacterium
ADKGEITY

SEQ ID NO: 415716 - protein, 8 aa, Mycobacterium
ADKGHRRL

SEQ ID NO: 415717 - protein, 18 aa, Mycobacterium
ADKGLDAARTDPDYADQD

SEQ ID NO: 415718 - protein, 6 aa, Mycobacterium
ADKGVD

SEQ ID NO: 415719 - protein, 7 aa, Mycobacterium
ADKIADG

SEQ ID NO: 415720 - protein, 6 aa, Mycobacterium
ADKIGE

SEQ ID NO: 415721 - protein, 8 aa, Mycobacterium
ADKIPDDK

SEQ ID NO: 415722 - protein, 14 aa, Mycobacterium
ADKISSKEVSSAEV

SEQ ID NO: 415723 - protein, 7 aa, Mycobacterium
ADKKKAI

SEQ ID NO: 415724 - protein, 4 aa, Mycobacterium
ADKL

SEQ ID NO: 415725 - protein, 32 aa, Mycobacterium
ADKLSAAADEIGALGPGSVRYEPADVTDEDEV

SEQ ID NO: 415726 - protein, 7 aa, Mycobacterium
ADKNDLY

SEQ ID NO: 415727 - protein, 6 aa, Mycobacterium
ADKNIT

SEQ ID NO: 415728 - protein, 4 aa, Mycobacterium
ADKP

SEQ ID NO: 415729 - protein, 7 aa, Mycobacterium
ADKPDSH

SEQ ID NO: 415730 - protein, 22 aa, Mycobacterium
ADKPEKAAAPVGDPTGGMGGMD

SEQ ID NO: 415731 - protein, 21 aa, Mycobacterium
ADKPEKEKAAMPGGGDMGGMD

SEQ ID NO: 415732 - protein, 9 aa, Mycobacterium
ADKPGDPGV

SEQ ID NO: 415733 - protein, 14 aa, Mycobacterium
ADKPHGTSSPVSGS

SEQ ID NO: 415734 - protein, 8 aa, Mycobacterium
ADKQADEL

SEQ ID NO: 415735 - protein, 8 aa, Mycobacterium
ADKQGGRF

SEQ ID NO: 415736 - protein, 5 aa, Mycobacterium
ADKQR

SEQ ID NO: 415737 - protein, 9 aa, Mycobacterium
ADKQRADRV

SEQ ID NO: 415738 - protein, 8 aa, Mycobacterium
ADKQTGGL

SEQ ID NO: 415739 - protein, 5 aa, Mycobacterium
ADKQV

SEQ ID NO: 415740 - protein, 4 aa, Mycobacterium
ADKR

SEQ ID NO: 415741 - protein, 12 aa, Mycobacterium
ADKRFSRANDRR

SEQ ID NO: 415742 - protein, 8 aa, Mycobacterium
ADKRNALS

SEQ ID NO: 415743 - protein, 8 aa, Mycobacterium
ADKRNARV

SEQ ID NO: 415744 - protein, 10 aa, Mycobacterium
ADKRVTTGRI

SEQ ID NO: 415745 - protein, 8 aa, Mycobacterium
ADKSDPLA

SEQ ID NO: 415746 - protein, 22 aa, Mycobacterium
ADKSGNTAPMTEAELEKLFLAL

SEQ ID NO: 415747 - protein, 7 aa, Mycobacterium
ADKTAPR

SEQ ID NO: 415748 - protein, 9 aa, Mycobacterium
ADKTLRDDV

SEQ ID NO: 415749 - protein, 8 aa, Mycobacterium
ADKTVAAV

SEQ ID NO: 415750 - protein, 7 aa, Mycobacterium
ADKVGVD

SEQ ID NO: 415751 - protein, 7 aa, Mycobacterium
ADKVGVN

SEQ ID NO: 415752 - protein, 12 aa, Mycobacterium
ADKVRGGYYTPA

SEQ ID NO: 415753 - protein, 13 aa, Mycobacterium
ADKVRPDPGKEAR

SEQ ID NO: 415754 - protein, 7 aa, Mycobacterium
ADKVSVN

SEQ ID NO: 415755 - protein, 5 aa, Mycobacterium
ADKYG

SEQ ID NO: 415756 - protein, 6 aa, Mycobacterium
ADKYTQ

SEQ ID NO: 415757 - protein, 9 aa, Mycobacterium
ADLAAGRAA

SEQ ID NO: 415758 - protein, 9 aa, Mycobacterium
ADLAAPATF

SEQ ID NO: 415759 - protein, 12 aa, Mycobacterium
ADLADAADRARV

SEQ ID NO: 415760 - protein, 11 aa, Mycobacterium
ADLADKAEEYR

SEQ ID NO: 415761 - protein, 10 aa, Mycobacterium
ADLADPGDRA

SEQ ID NO: 415762 - protein, 10 aa, Mycobacterium
ADLADPQERT

SEQ ID NO: 415763 - protein, 7 aa, Mycobacterium
ADLADSG

SEQ ID NO: 415764 - protein, 6 aa, Mycobacterium
ADLAGR

SEQ ID NO: 415765 - protein, 12 aa, Mycobacterium
ADLAGSNNTTIK

SEQ ID NO: 415766 - protein, 26 aa, Mycobacterium
ADLAGSNNTTIKGADSFGPPAISTDD

SEQ ID NO: 415767 - protein, 33 aa, Mycobacterium
ADLAGSNNTTIKGADSFGPTSIATSDWNAQPYG

SEQ ID NO: 415768 - protein, 26 aa, Mycobacterium
ADLAGSNNTTIKGANSFGPPSISTED

SEQ ID NO: 415769 - protein, 26 aa, Mycobacterium
ADLAGSNNTTMKGADSFGPPSISTKD

SEQ ID NO: 415770 - protein, 5 aa, Mycobacterium
ADLAQ

SEQ ID NO: 415771 - protein, 21 aa, Mycobacterium
ADLARAAAEGTGETTGVTKAT

SEQ ID NO: 415772 - protein, 6 aa, Mycobacterium
ADLARS

SEQ ID NO: 415773 - protein, 12 aa, Mycobacterium
ADLARSSEQHAV

SEQ ID NO: 415774 - protein, 5 aa, Mycobacterium
ADLDA

SEQ ID NO: 415775 - protein, 11 aa, Mycobacterium
ADLDAAAPEAT

SEQ ID NO: 415776 - protein, 9 aa, Mycobacterium
ADLDADTTA

SEQ ID NO: 415777 - protein, 5 aa, Mycobacterium
ADLDE

SEQ ID NO: 415778 - protein, 12 aa, Mycobacterium
ADLDENAAPETL

SEQ ID NO: 415779 - protein, 11 aa, Mycobacterium
ADLDETGSRAA

SEQ ID NO: 415780 - protein, 12 aa, Mycobacterium
ADLDNETYLVAH

SEQ ID NO: 415781 - protein, 7 aa, Mycobacterium
ADLDPAQ

SEQ ID NO: 415782 - protein, 14 aa, Mycobacterium
ADLDPDSPCAREGD

SEQ ID NO: 415783 - protein, 10 aa, Mycobacterium
ADLDPEERKA

SEQ ID NO: 415784 - protein, 6 aa, Mycobacterium
ADLDTA

SEQ ID NO: 415785 - protein, 28 aa, Mycobacterium
ADLDTGSASVSAATPGPAGAEPETEAFD

SEQ ID NO: 415786 - protein, 5 aa, Mycobacterium
ADLED

SEQ ID NO: 415787 - protein, 6 aa, Mycobacterium
ADLEGI

SEQ ID NO: 415788 - protein, 16 aa, Mycobacterium
ADLEGVTDAEDRVAEL

SEQ ID NO: 415789 - protein, 6 aa, Mycobacterium
ADLEPD

SEQ ID NO: 415790 - protein, 7 aa, Mycobacterium
ADLEPRD

SEQ ID NO: 415791 - protein, 6 aa, Mycobacterium
ADLESA

SEQ ID NO: 415792 - protein, 7 aa, Mycobacterium
ADLETAR

SEQ ID NO: 415793 - protein, 19 aa, Mycobacterium
ADLETGLTESRPWGTRGQS

SEQ ID NO: 415794 - protein, 13 aa, Mycobacterium
ADLETTGEQGLRD

SEQ ID NO: 415795 - protein, 10 aa, Mycobacterium
ADLETTVAEG

SEQ ID NO: 415796 - protein, 4 aa, Mycobacterium
ADLG

SEQ ID NO: 415797 - protein, 12 aa, Mycobacterium
ADLGAADTTPDN

SEQ ID NO: 415798 - protein, 5 aa, Mycobacterium
ADLGD

SEQ ID NO: 415799 - protein, 8 aa, Mycobacterium
ADLGDEDA

SEQ ID NO: 415800 - protein, 18 aa, Mycobacterium
ADLGDGDAELTVGDAQDH

SEQ ID NO: 415801 - protein, 15 aa, Mycobacterium
ADLGEPSPRHRGAGR

SEQ ID NO: 415802 - protein, 5 aa, Mycobacterium
ADLGG

SEQ ID NO: 415803 - protein, 6 aa, Mycobacterium
ADLGGT

SEQ ID NO: 415804 - protein, 12 aa, Mycobacterium
ADLGNETYLVAH

SEQ ID NO: 415805 - protein, 10 aa, Mycobacterium
ADLGNGPGIQ

SEQ ID NO: 415806 - protein, 5 aa, Mycobacterium
ADLGP

SEQ ID NO: 415807 - protein, 12 aa, Mycobacterium
ADLGPAPAHGPG

SEQ ID NO: 415808 - protein, 6 aa, Mycobacterium
ADLGPD

SEQ ID NO: 415809 - protein, 7 aa, Mycobacterium
ADLGPKQ

SEQ ID NO: 415810 - protein, 14 aa, Mycobacterium
ADLGPRRGLTGEPI

SEQ ID NO: 415811 - protein, 8 aa, Mycobacterium
ADLGPVNG

SEQ ID NO: 415812 - protein, 12 aa, Mycobacterium
ADLGRTVTAADT

SEQ ID NO: 415813 - protein, 8 aa, Mycobacterium
ADLGSSPL

SEQ ID NO: 415814 - protein, 4 aa, Mycobacterium
ADLK

SEQ ID NO: 415815 - protein, 5 aa, Mycobacterium
ADLNS

SEQ ID NO: 415816 - protein, 4 aa, Mycobacterium
ADLP

SEQ ID NO: 415817 - protein, 5 aa, Mycobacterium
ADLPA

SEQ ID NO: 415818 - protein, 12 aa, Mycobacterium
ADLPAAERDRDG

SEQ ID NO: 415819 - protein, 15 aa, Mycobacterium
ADLPAASDDNERNSV

SEQ ID NO: 415820 - protein, 8 aa, Mycobacterium
ADLPAQND

SEQ ID NO: 415821 - protein, 8 aa, Mycobacterium
ADLPDADL

SEQ ID NO: 415822 - protein, 7 aa, Mycobacterium
ADLPDAK

SEQ ID NO: 415823 - protein, 8 aa, Mycobacterium
ADLPDDAI

SEQ ID NO: 415824 - protein, 8 aa, Mycobacterium
ADLPDPPQ

SEQ ID NO: 415825 - protein, 10 aa, Mycobacterium
ADLPDRDDDN

SEQ ID NO: 415826 - protein, 5 aa, Mycobacterium
ADLPE

SEQ ID NO: 415827 - protein, 6 aa, Mycobacterium
ADLPED

SEQ ID NO: 415828 - protein, 7 aa, Mycobacterium
ADLPEKV

SEQ ID NO: 415829 - protein, 8 aa, Mycobacterium
ADLPEKVR

SEQ ID NO: 415830 - protein, 7 aa, Mycobacterium
ADLPERR

SEQ ID NO: 415831 - protein, 21 aa, Mycobacterium
ADLPGAAVSPRRGGNCNPAPS

SEQ ID NO: 415832 - protein, 11 aa, Mycobacterium
ADLPGGPPFDD

SEQ ID NO: 415833 - protein, 10 aa, Mycobacterium
ADLPGQNDVG

SEQ ID NO: 415834 - protein, 11 aa, Mycobacterium
ADLPGRAHTSG

SEQ ID NO: 415835 - protein, 10 aa, Mycobacterium
ADLPGRGAPD

SEQ ID NO: 415836 - protein, 9 aa, Mycobacterium
ADLPGTLRR

SEQ ID NO: 415837 - protein, 7 aa, Mycobacterium
ADLPPGE

SEQ ID NO: 415838 - protein, 10 aa, Mycobacterium
ADLPRDLGGV

SEQ ID NO: 415839 - protein, 5 aa, Mycobacterium
ADLPS

SEQ ID NO: 415840 - protein, 6 aa, Mycobacterium
ADLPSF

SEQ ID NO: 415841 - protein, 6 aa, Mycobacterium
ADLPST

SEQ ID NO: 415842 - protein, 7 aa, Mycobacterium
ADLQGRR

SEQ ID NO: 415843 - protein, 6 aa, Mycobacterium
ADLQRA

SEQ ID NO: 415844 - protein, 11 aa, Mycobacterium
ADLRAAPETVG

SEQ ID NO: 415845 - protein, 8 aa, Mycobacterium
ADLRESSR

SEQ ID NO: 415846 - protein, 7 aa, Mycobacterium
ADLRPAR

SEQ ID NO: 415847 - protein, 7 aa, Mycobacterium
ADLRPDA

SEQ ID NO: 415848 - protein, 8 aa, Mycobacterium
ADLRQAGN

SEQ ID NO: 415849 - protein, 10 aa, Mycobacterium
ADLRQQHRQG

SEQ ID NO: 415850 - protein, 5 aa, Mycobacterium
ADLSA

SEQ ID NO: 415851 - protein, 18 aa, Mycobacterium
ADLSARDPGPAAAPTSAS

SEQ ID NO: 415852 - protein, 12 aa, Mycobacterium
ADLSDSDHTGSA

SEQ ID NO: 415853 - protein, 11 aa, Mycobacterium
ADLSERNDRAS

SEQ ID NO: 415854 - protein, 7 aa, Mycobacterium
ADLSGIR

SEQ ID NO: 415855 - protein, 9 aa, Mycobacterium
ADLSPRAKA

SEQ ID NO: 415856 - protein, 6 aa, Mycobacterium
ADLSQA

SEQ ID NO: 415857 - protein, 6 aa, Mycobacterium
ADLSTP

SEQ ID NO: 415858 - protein, 7 aa, Mycobacterium
ADLSTPL

SEQ ID NO: 415859 - protein, 27 aa, Mycobacterium
ADLTDPAAIEKAAADAEIGVGSDPDVD

SEQ ID NO: 415860 - protein, 5 aa, Mycobacterium
ADLTG

SEQ ID NO: 415861 - protein, 6 aa, Mycobacterium
ADLTNR

SEQ ID NO: 415862 - protein, 11 aa, Mycobacterium
ADLTNTSPTDV

SEQ ID NO: 415863 - protein, 12 aa, Mycobacterium
ADLTPGSPGASV

SEQ ID NO: 415864 - protein, 5 aa, Mycobacterium
ADLTQ

SEQ ID NO: 415865 - protein, 5 aa, Mycobacterium
ADLTR

SEQ ID NO: 415866 - protein, 16 aa, Mycobacterium
ADLTSAPADTRTATPV

SEQ ID NO: 415867 - protein, 13 aa, Mycobacterium
ADLTSSPASSYAS

SEQ ID NO: 415868 - protein, 10 aa, Mycobacterium
ADLYGDPADQ

SEQ ID NO: 415869 - protein, 17 aa, Mycobacterium
ADMGNPATPASGSVQPA

SEQ ID NO: 415870 - protein, 6 aa, Mycobacterium
ADMGTL

SEQ ID NO: 415871 - protein, 6 aa, Mycobacterium
ADMKSG

SEQ ID NO: 415872 - protein, 10 aa, Mycobacterium
ADMPGLEPAY

SEQ ID NO: 415873 - protein, 6 aa, Mycobacterium
ADMPHD

SEQ ID NO: 415874 - protein, 4 aa, Mycobacterium
ADMR

SEQ ID NO: 415875 - protein, 4 aa, Mycobacterium
ADMS

SEQ ID NO: 415876 - protein, 4 aa, Mycobacterium
ADMT

SEQ ID NO: 415877 - protein, 7 aa, Mycobacterium
ADNAADA

SEQ ID NO: 415878 - protein, 6 aa, Mycobacterium
ADNAEY

SEQ ID NO: 415879 - protein, 5 aa, Mycobacterium
ADNAG

SEQ ID NO: 415880 - protein, 5 aa, Mycobacterium
ADNAP

SEQ ID NO: 415881 - protein, 10 aa, Mycobacterium
ADNAPETRSE

SEQ ID NO: 415882 - protein, 12 aa, Mycobacterium
ADNAPGACPASR

SEQ ID NO: 415883 - protein, 9 aa, Mycobacterium
ADNAQETRS

SEQ ID NO: 415884 - protein, 7 aa, Mycobacterium
ADNAQTL

SEQ ID NO: 415885 - protein, 5 aa, Mycobacterium
ADNAR

SEQ ID NO: 415886 - protein, 7 aa, Mycobacterium
ADNASAA

SEQ ID NO: 415887 - protein, 9 aa, Mycobacterium
ADNASPEID

SEQ ID NO: 415888 - protein, 11 aa, Mycobacterium
ADNATDPQTQR

SEQ ID NO: 415889 - protein, 6 aa, Mycobacterium
ADNATG

SEQ ID NO: 415890 - protein, 8 aa, Mycobacterium
ADNDAGAL

SEQ ID NO: 415891 - protein, 10 aa, Mycobacterium
ADNDDEPYYP

SEQ ID NO: 415892 - protein, 8 aa, Mycobacterium
ADNDERLT

SEQ ID NO: 415893 - protein, 10 aa, Mycobacterium
ADNDGRGNTR

SEQ ID NO: 415894 - protein, 10 aa, Mycobacterium
ADNDQKPCGH

SEQ ID NO: 415895 - protein, 9 aa, Mycobacterium
ADNEPSVRD

SEQ ID NO: 415896 - protein, 15 aa, Mycobacterium
ADNFRKEHGGTGDIG

SEQ ID NO: 415897 - protein, 10 aa, Mycobacterium
ADNGAAPGLD

SEQ ID NO: 415898 - protein, 10 aa, Mycobacterium
ADNGATTGAV

SEQ ID NO: 415899 - protein, 6 aa, Mycobacterium
ADNGAW

SEQ ID NO: 415900 - protein, 8 aa, Mycobacterium
ADNGGGSI

SEQ ID NO: 415901 - protein, 12 aa, Mycobacterium
ADNGHNAADTVV

SEQ ID NO: 415902 - protein, 7 aa, Mycobacterium
ADNGMAE

SEQ ID NO: 415903 - protein, 8 aa, Mycobacterium
ADNGPGAF

SEQ ID NO: 415904 - protein, 7 aa, Mycobacterium
ADNGRGC

SEQ ID NO: 415905 - protein, 9 aa, Mycobacterium
ADNGSVADT

SEQ ID NO: 415906 - protein, 5 aa, Mycobacterium
ADNGY

SEQ ID NO: 415907 - protein, 8 aa, Mycobacterium
ADNIDPQQ

SEQ ID NO: 415908 - protein, 13 aa, Mycobacterium
ADNLGSGNIGSGN

SEQ ID NO: 415909 - protein, 8 aa, Mycobacterium
ADNMDPQQ

SEQ ID NO: 415910 - protein, 4 aa, Mycobacterium
ADNN

SEQ ID NO: 415911 - protein, 23 aa, Mycobacterium
ADNNIPNSKEASMGKAKAARVAS

SEQ ID NO: 415912 - protein, 6 aa, Mycobacterium
ADNPAE

SEQ ID NO: 415913 - protein, 8 aa, Mycobacterium
ADNPAYGQ

SEQ ID NO: 415914 - protein, 11 aa, Mycobacterium
ADNPDQVGVNE

SEQ ID NO: 415915 - protein, 8 aa, Mycobacterium
ADNPDSYL

SEQ ID NO: 415916 - protein, 15 aa, Mycobacterium
ADNPEGPLSKTQAAQ

SEQ ID NO: 415917 - protein, 6 aa, Mycobacterium
ADNPER

SEQ ID NO: 415918 - protein, 7 aa, Mycobacterium
ADNPERA

SEQ ID NO: 415919 - protein, 6 aa, Mycobacterium
ADNPGQ

SEQ ID NO: 415920 - protein, 14 aa, Mycobacterium
ADNPMEGLPPAETW

SEQ ID NO: 415921 - protein, 8 aa, Mycobacterium
ADNPPGWD

SEQ ID NO: 415922 - protein, 10 aa, Mycobacterium
ADNPPTKPWQ

SEQ ID NO: 415923 - protein, 6 aa, Mycobacterium
ADNPQR

SEQ ID NO: 415924 - protein, 6 aa, Mycobacterium
ADNPRE

SEQ ID NO: 415925 - protein, 8 aa, Mycobacterium
ADNPRERV

SEQ ID NO: 415926 - protein, 5 aa, Mycobacterium
ADNPS

SEQ ID NO: 415927 - protein, 22 aa, Mycobacterium
ADNPSPLTEDVPARGSDEHYYS

SEQ ID NO: 415928 - protein, 8 aa, Mycobacterium
ADNPSTLA

SEQ ID NO: 415929 - protein, 8 aa, Mycobacterium
ADNPTVTS

SEQ ID NO: 415930 - protein, 7 aa, Mycobacterium
ADNPVTT

SEQ ID NO: 415931 - protein, 11 aa, Mycobacterium
ADNQKSPQEFS

SEQ ID NO: 415932 - protein, 6 aa, Mycobacterium
ADNQPT

SEQ ID NO: 415933 - protein, 7 aa, Mycobacterium
ADNRRAI

SEQ ID NO: 415934 - protein, 5 aa, Mycobacterium
ADNRV

SEQ ID NO: 415935 - protein, 7 aa, Mycobacterium
ADNSANL

SEQ ID NO: 415936 - protein, 7 aa, Mycobacterium
ADNSARV

SEQ ID NO: 415937 - protein, 15 aa, Mycobacterium
ADNSEEERFSPGERY

SEQ ID NO: 415938 - protein, 34 aa, Mycobacterium
ADNSGRGDRKRGRGDRKRGAAGRSGSPPSGSGGH

SEQ ID NO: 415939 - protein, 13 aa, Mycobacterium
ADNSIDATASRDF

SEQ ID NO: 415940 - protein, 12 aa, Mycobacterium
ADNSPGACRATG

SEQ ID NO: 415941 - protein, 9 aa, Mycobacterium
ADNSRTAAD

SEQ ID NO: 415942 - protein, 4 aa, Mycobacterium
ADNT

SEQ ID NO: 415943 - protein, 7 aa, Mycobacterium
ADNTAEL

SEQ ID NO: 415944 - protein, 17 aa, Mycobacterium
ADNTEAERFSPGERYGR

SEQ ID NO: 415945 - protein, 15 aa, Mycobacterium
ADNTEAERYSPGERY

SEQ ID NO: 415946 - protein, 11 aa, Mycobacterium
ADNTSERTRRQ

SEQ ID NO: 415947 - protein, 14 aa, Mycobacterium
ADNVSQDGRVRAEP

SEQ ID NO: 415948 - protein, 14 aa, Mycobacterium
ADPAAAARQGAAAA

SEQ ID NO: 415949 - protein, 15 aa, Mycobacterium
ADPAAADSPQSAGTI

SEQ ID NO: 415950 - protein, 9 aa, Mycobacterium
ADPAAAEAV

SEQ ID NO: 415951 - protein, 10 aa, Mycobacterium
ADPAADHAQR

SEQ ID NO: 415952 - protein, 9 aa, Mycobacterium
ADPAANAES

SEQ ID NO: 415953 - protein, 6 aa, Mycobacterium
ADPAAR

SEQ ID NO: 415954 - protein, 14 aa, Mycobacterium
ADPAAVTGTPVPGG

SEQ ID NO: 415955 - protein, 6 aa, Mycobacterium
ADPACP

SEQ ID NO: 415956 - protein, 8 aa, Mycobacterium
ADPADAAM

SEQ ID NO: 415957 - protein, 15 aa, Mycobacterium
ADPADADAPIPPAAD

SEQ ID NO: 415958 - protein, 11 aa, Mycobacterium
ADPADGADAAV

SEQ ID NO: 415959 - protein, 9 aa, Mycobacterium
ADPADLPSG

SEQ ID NO: 415960 - protein, 8 aa, Mycobacterium
ADPADWAE

SEQ ID NO: 415961 - protein, 7 aa, Mycobacterium
ADPAEDL

SEQ ID NO: 415962 - protein, 7 aa, Mycobacterium
ADPAELA

SEQ ID NO: 415963 - protein, 8 aa, Mycobacterium
ADPAGDHS

SEQ ID NO: 415964 - protein, 9 aa, Mycobacterium
ADPAGDQTR

SEQ ID NO: 415965 - protein, 7 aa, Mycobacterium
ADPAGDV

SEQ ID NO: 415966 - protein, 7 aa, Mycobacterium
ADPAGFA

SEQ ID NO: 415967 - protein, 7 aa, Mycobacterium
ADPAGIN

SEQ ID NO: 415968 - protein, 9 aa, Mycobacterium
ADPAGQQRR

SEQ ID NO: 415969 - protein, 9 aa, Mycobacterium
ADPAGRDQL

SEQ ID NO: 415970 - protein, 11 aa, Mycobacterium
ADPAGRHTGRY

SEQ ID NO: 415971 - protein, 9 aa, Mycobacterium
ADPAHHGRP

SEQ ID NO: 415972 - protein, 8 aa, Mycobacterium
ADPAHRPT

SEQ ID NO: 415973 - protein, 10 aa, Mycobacterium
ADPAKAATSH

SEQ ID NO: 415974 - protein, 15 aa, Mycobacterium
ADPAKAERYGQAGRQ

SEQ ID NO: 415975 - protein, 9 aa, Mycobacterium
ADPAKASEV

SEQ ID NO: 415976 - protein, 24 aa, Mycobacterium
ADPANTAPVQTPAAPGWTGRRDTA

SEQ ID NO: 415977 - protein, 6 aa, Mycobacterium
ADPAPA

SEQ ID NO: 415978 - protein, 11 aa, Mycobacterium
ADPAPGRRRDA

SEQ ID NO: 415979 - protein, 6 aa, Mycobacterium
ADPAPL

SEQ ID NO: 415980 - protein, 6 aa, Mycobacterium
ADPAPM

SEQ ID NO: 415981 - protein, 13 aa, Mycobacterium
ADPAPPGASQLPA

SEQ ID NO: 415982 - protein, 8 aa, Mycobacterium
ADPAQAAN

SEQ ID NO: 415983 - protein, 8 aa, Mycobacterium
ADPAQAVA

SEQ ID NO: 415984 - protein, 6 aa, Mycobacterium
ADPAQQ

SEQ ID NO: 415985 - protein, 7 aa, Mycobacterium
ADPAQRL

SEQ ID NO: 415986 - protein, 8 aa, Mycobacterium
ADPARDAR

SEQ ID NO: 415987 - protein, 6 aa, Mycobacterium
ADPARE

SEQ ID NO: 415988 - protein, 11 aa, Mycobacterium
ADPAREPSQGT

SEQ ID NO: 415989 - protein, 6 aa, Mycobacterium
ADPARF

SEQ ID NO: 415990 - protein, 12 aa, Mycobacterium
ADPARGEFTDGQ

SEQ ID NO: 415991 - protein, 7 aa, Mycobacterium
ADPARLR

SEQ ID NO: 415992 - protein, 6 aa, Mycobacterium
ADPARR

SEQ ID NO: 415993 - protein, 7 aa, Mycobacterium
ADPARRD

SEQ ID NO: 415994 - protein, 8 aa, Mycobacterium
ADPARRGQ

SEQ ID NO: 415995 - protein, 7 aa, Mycobacterium
ADPARSA

SEQ ID NO: 415996 - protein, 8 aa, Mycobacterium
ADPARSAH

SEQ ID NO: 415997 - protein, 6 aa, Mycobacterium
ADPARV

SEQ ID NO: 415998 - protein, 5 aa, Mycobacterium
ADPAS

SEQ ID NO: 415999 - protein, 6 aa, Mycobacterium
ADPASA

SEQ ID NO: 416000 - protein, 8 aa, Mycobacterium
ADPASADQ

SEQ ID NO: 416001 - protein, 9 aa, Mycobacterium
ADPASADRP

SEQ ID NO: 416002 - protein, 10 aa, Mycobacterium
ADPASAKPGY

SEQ ID NO: 416003 - protein, 9 aa, Mycobacterium
ADPASGQQA

SEQ ID NO: 416004 - protein, 15 aa, Mycobacterium
ADPASGSSRSAPPPW

SEQ ID NO: 416005 - protein, 7 aa, Mycobacterium
ADPASGV

SEQ ID NO: 416006 - protein, 6 aa, Mycobacterium
ADPASY

SEQ ID NO: 416007 - protein, 8 aa, Mycobacterium
ADPATAEA

SEQ ID NO: 416008 - protein, 15 aa, Mycobacterium
ADPATAERYGQAGRQ

SEQ ID NO: 416009 - protein, 12 aa, Mycobacterium
ADPATANATVTV

SEQ ID NO: 416010 - protein, 8 aa, Mycobacterium
ADPATGDY

SEQ ID NO: 416011 - protein, 8 aa, Mycobacterium
ADPATGFA

SEQ ID NO: 416012 - protein, 8 aa, Mycobacterium
ADPATGLA

SEQ ID NO: 416013 - protein, 10 aa, Mycobacterium
ADPATLPDAI

SEQ ID NO: 416014 - protein, 9 aa, Mycobacterium
ADPATPVPT

SEQ ID NO: 416015 - protein, 9 aa, Mycobacterium
ADPATRREL

SEQ ID NO: 416016 - protein, 15 aa, Mycobacterium
ADPATSKDATAQRAF

SEQ ID NO: 416017 - protein, 7 aa, Mycobacterium
ADPATTT

SEQ ID NO: 416018 - protein, 5 aa, Mycobacterium
ADPAV

SEQ ID NO: 416019 - protein, 9 aa, Mycobacterium
ADPAVTARR

SEQ ID NO: 416020 - protein, 25 aa, Mycobacterium
ADPAVTARRGATAEVDARSYARPDP

SEQ ID NO: 416021 - protein, 7 aa, Mycobacterium
ADPAYAQ

SEQ ID NO: 416022 - protein, 13 aa, Mycobacterium
ADPAYPGAPNGRV

SEQ ID NO: 416023 - protein, 8 aa, Mycobacterium
ADPAYQTE

SEQ ID NO: 416024 - protein, 6 aa, Mycobacterium
ADPDAA

SEQ ID NO: 416025 - protein, 7 aa, Mycobacterium
ADPDAAL

SEQ ID NO: 416026 - protein, 11 aa, Mycobacterium
ADPDAAQDAAA

SEQ ID NO: 416027 - protein, 16 aa, Mycobacterium
ADPDAARERRVAAEED

SEQ ID NO: 416028 - protein, 13 aa, Mycobacterium
ADPDADPGARETP

SEQ ID NO: 416029 - protein, 6 aa, Mycobacterium
ADPDAI

SEQ ID NO: 416030 - protein, 8 aa, Mycobacterium
ADPDARAE

SEQ ID NO: 416031 - protein, 10 aa, Mycobacterium
ADPDASDARM

SEQ ID NO: 416032 - protein, 6 aa, Mycobacterium
ADPDAV

SEQ ID NO: 416033 - protein, 6 aa, Mycobacterium
ADPDDG

SEQ ID NO: 416034 - protein, 20 aa, Mycobacterium
ADPDDLARGQDADSAARTGY

SEQ ID NO: 416035 - protein, 9 aa, Mycobacterium
ADPDDLART

SEQ ID NO: 416036 - protein, 10 aa, Mycobacterium
ADPDDPAATA

SEQ ID NO: 416037 - protein, 12 aa, Mycobacterium
ADPDDTDALTAG

SEQ ID NO: 416038 - protein, 8 aa, Mycobacterium
ADPDDVQY

SEQ ID NO: 416039 - protein, 6 aa, Mycobacterium
ADPDEL

SEQ ID NO: 416040 - protein, 8 aa, Mycobacterium
ADPDEPGR

SEQ ID NO: 416041 - protein, 7 aa, Mycobacterium
ADPDETV

SEQ ID NO: 416042 - protein, 8 aa, Mycobacterium
ADPDFDQR

SEQ ID NO: 416043 - protein, 8 aa, Mycobacterium
ADPDGAGF

SEQ ID NO: 416044 - protein, 7 aa, Mycobacterium
ADPDGGV

SEQ ID NO: 416045 - protein, 7 aa, Mycobacterium
ADPDGLN

SEQ ID NO: 416046 - protein, 13 aa, Mycobacterium
ADPDGLTPPGSRL

SEQ ID NO: 416047 - protein, 7 aa, Mycobacterium
ADPDGRD

SEQ ID NO: 416048 - protein, 8 aa, Mycobacterium
ADPDGVPG

SEQ ID NO: 416049 - protein, 5 aa, Mycobacterium
ADPDH

SEQ ID NO: 416050 - protein, 6 aa, Mycobacterium
ADPDHK

SEQ ID NO: 416051 - protein, 5 aa, Mycobacterium
ADPDI

SEQ ID NO: 416052 - protein, 7 aa, Mycobacterium
ADPDIGA

SEQ ID NO: 416053 - protein, 15 aa, Mycobacterium
ADPDKAKRYGEAGRQ

SEQ ID NO: 416054 - protein, 9 aa, Mycobacterium
ADPDKIADG

SEQ ID NO: 416055 - protein, 7 aa, Mycobacterium
ADPDNAE

SEQ ID NO: 416056 - protein, 13 aa, Mycobacterium
ADPDPETGQGGFS

SEQ ID NO: 416057 - protein, 16 aa, Mycobacterium
ADPDPSTGEEPLPRDR

SEQ ID NO: 416058 - protein, 5 aa, Mycobacterium
ADPDQ

SEQ ID NO: 416059 - protein, 6 aa, Mycobacterium
ADPDQD

SEQ ID NO: 416060 - protein, 10 aa, Mycobacterium
ADPDQPSDEV

SEQ ID NO: 416061 - protein, 7 aa, Mycobacterium
ADPDQRV

SEQ ID NO: 416062 - protein, 7 aa, Mycobacterium
ADPDQVN

SEQ ID NO: 416063 - protein, 5 aa, Mycobacterium
ADPDR

SEQ ID NO: 416064 - protein, 12 aa, Mycobacterium
ADPDRAREYGVA

SEQ ID NO: 416065 - protein, 6 aa, Mycobacterium
ADPDRG

SEQ ID NO: 416066 - protein, 6 aa, Mycobacterium
ADPDRP

SEQ ID NO: 416067 - protein, 9 aa, Mycobacterium
ADPDSVDAA

SEQ ID NO: 416068 - protein, 8 aa, Mycobacterium
ADPDTAQR

SEQ ID NO: 416069 - protein, 8 aa, Mycobacterium
ADPDTARA

SEQ ID NO: 416070 - protein, 9 aa, Mycobacterium
ADPDTGSSF

SEQ ID NO: 416071 - protein, 7 aa, Mycobacterium
ADPDTGY

SEQ ID NO: 416072 - protein, 6 aa, Mycobacterium
ADPDTI

SEQ ID NO: 416073 - protein, 8 aa, Mycobacterium
ADPDTPPW

SEQ ID NO: 416074 - protein, 7 aa, Mycobacterium
ADPDTVQ

SEQ ID NO: 416075 - protein, 6 aa, Mycobacterium
ADPDVA

SEQ ID NO: 416076 - protein, 7 aa, Mycobacterium
ADPDVAP

SEQ ID NO: 416077 - protein, 9 aa, Mycobacterium
ADPDVPAGA

SEQ ID NO: 416078 - protein, 6 aa, Mycobacterium
ADPDVQ

SEQ ID NO: 416079 - protein, 21 aa, Mycobacterium
ADPDWQGGDYHGTGRAPTEGM

SEQ ID NO: 416080 - protein, 8 aa, Mycobacterium
ADPDYPPS

SEQ ID NO: 416081 - protein, 6 aa, Mycobacterium
ADPDYT

SEQ ID NO: 416082 - protein, 10 aa, Mycobacterium
ADPEAAKSPT

SEQ ID NO: 416083 - protein, 8 aa, Mycobacterium
ADPEAGSS

SEQ ID NO: 416084 - protein, 22 aa, Mycobacterium
ADPEAGTGESPGIGGSTGQPIV

SEQ ID NO: 416085 - protein, 8 aa, Mycobacterium
ADPEATVP

SEQ ID NO: 416086 - protein, 15 aa, Mycobacterium
ADPEAVDDALSDDPR

SEQ ID NO: 416087 - protein, 16 aa, Mycobacterium
ADPEAVDEALGADAGL

SEQ ID NO: 416088 - protein, 5 aa, Mycobacterium
ADPED

SEQ ID NO: 416089 - protein, 9 aa, Mycobacterium
ADPEDPAAP

SEQ ID NO: 416090 - protein, 9 aa, Mycobacterium
ADPEEAAAG

SEQ ID NO: 416091 - protein, 18 aa, Mycobacterium
ADPEEAAPARRKDLSGLP

SEQ ID NO: 416092 - protein, 8 aa, Mycobacterium
ADPEEGGV

SEQ ID NO: 416093 - protein, 5 aa, Mycobacterium
ADPEG

SEQ ID NO: 416094 - protein, 9 aa, Mycobacterium
ADPEGELGS

SEQ ID NO: 416095 - protein, 9 aa, Mycobacterium
ADPEGSAMS

SEQ ID NO: 416096 - protein, 15 aa, Mycobacterium
ADPEGSEFGIVHDTW

SEQ ID NO: 416097 - protein, 15 aa, Mycobacterium
ADPEGSVYSGGAGRP

SEQ ID NO: 416098 - protein, 13 aa, Mycobacterium
ADPEIAAKAAPVP

SEQ ID NO: 416099 - protein, 6 aa, Mycobacterium
ADPEKL

SEQ ID NO: 416100 - protein, 12 aa, Mycobacterium
ADPENADLAESE

SEQ ID NO: 416101 - protein, 11 aa, Mycobacterium
ADPENPGRTLR

SEQ ID NO: 416102 - protein, 10 aa, Mycobacterium
ADPENTAQAF

SEQ ID NO: 416103 - protein, 8 aa, Mycobacterium
ADPEPVRD

SEQ ID NO: 416104 - protein, 5 aa, Mycobacterium
ADPEQ

SEQ ID NO: 416105 - protein, 18 aa, Mycobacterium
ADPEQAAPARRGDLSGLP

SEQ ID NO: 416106 - protein, 9 aa, Mycobacterium
ADPEQATSD

SEQ ID NO: 416107 - protein, 10 aa, Mycobacterium
ADPEQGAKPI

SEQ ID NO: 416108 - protein, 7 aa, Mycobacterium
ADPEQLA

SEQ ID NO: 416109 - protein, 7 aa, Mycobacterium
ADPERDG

SEQ ID NO: 416110 - protein, 7 aa, Mycobacterium
ADPERPL

SEQ ID NO: 416111 - protein, 7 aa, Mycobacterium
ADPERRK

SEQ ID NO: 416112 - protein, 7 aa, Mycobacterium
ADPERSV

SEQ ID NO: 416113 - protein, 7 aa, Mycobacterium
ADPESFD

SEQ ID NO: 416114 - protein, 10 aa, Mycobacterium
ADPESGEPKV

SEQ ID NO: 416115 - protein, 7 aa, Mycobacterium
ADPESGL

SEQ ID NO: 416116 - protein, 8 aa, Mycobacterium
ADPESGSA

SEQ ID NO: 416117 - protein, 6 aa, Mycobacterium
ADPESI

SEQ ID NO: 416118 - protein, 8 aa, Mycobacterium
ADPESPGA

SEQ ID NO: 416119 - protein, 13 aa, Mycobacterium
ADPESTAALPGGA

SEQ ID NO: 416120 - protein, 6 aa, Mycobacterium
ADPETA

SEQ ID NO: 416121 - protein, 8 aa, Mycobacterium
ADPETGSS

SEQ ID NO: 416122 - protein, 7 aa, Mycobacterium
ADPETPP

SEQ ID NO: 416123 - protein, 13 aa, Mycobacterium
ADPEVAGSLTTAQ

SEQ ID NO: 416124 - protein, 6 aa, Mycobacterium
ADPEVR

SEQ ID NO: 416125 - protein, 16 aa, Mycobacterium
ADPEVVAGRRNLANAL

SEQ ID NO: 416126 - protein, 5 aa, Mycobacterium
ADPEW

SEQ ID NO: 416127 - protein, 8 aa, Mycobacterium
ADPEYPAS

SEQ ID NO: 416128 - protein, 29 aa, Mycobacterium
ADPGAGDQSGIVGADPESRASAAGDLSNA

SEQ ID NO: 416129 - protein, 18 aa, Mycobacterium
ADPGAKRPGEINHNDGGR

SEQ ID NO: 416130 - protein, 8 aa, Mycobacterium
ADPGAPPV

SEQ ID NO: 416131 - protein, 7 aa, Mycobacterium
ADPGARD

SEQ ID NO: 416132 - protein, 7 aa, Mycobacterium
ADPGARL

SEQ ID NO: 416133 - protein, 8 aa, Mycobacterium
ADPGASHA

SEQ ID NO: 416134 - protein, 17 aa, Mycobacterium
ADPGATPQDTRCPEGTP

SEQ ID NO: 416135 - protein, 8 aa, Mycobacterium
ADPGAWPG

SEQ ID NO: 416136 - protein, 15 aa, Mycobacterium
ADPGDAPQPQADPSV

SEQ ID NO: 416137 - protein, 10 aa, Mycobacterium
ADPGDFPDDT

SEQ ID NO: 416138 - protein, 10 aa, Mycobacterium
ADPGDLARTD

SEQ ID NO: 416139 - protein, 6 aa, Mycobacterium
ADPGEI

SEQ ID NO: 416140 - protein, 8 aa, Mycobacterium
ADPGEPGT

SEQ ID NO: 416141 - protein, 9 aa, Mycobacterium
ADPGFSDPI

SEQ ID NO: 416142 - protein, 7 aa, Mycobacterium
ADPGGRD

SEQ ID NO: 416143 - protein, 5 aa, Mycobacterium
ADPGH

SEQ ID NO: 416144 - protein, 8 aa, Mycobacterium
ADPGIRAA

SEQ ID NO: 416145 - protein, 7 aa, Mycobacterium
ADPGKAL

SEQ ID NO: 416146 - protein, 7 aa, Mycobacterium
ADPGKVG

SEQ ID NO: 416147 - protein, 7 aa, Mycobacterium
ADPGLAG

SEQ ID NO: 416148 - protein, 7 aa, Mycobacterium
ADPGLEP

SEQ ID NO: 416149 - protein, 6 aa, Mycobacterium
ADPGLM

SEQ ID NO: 416150 - protein, 8 aa, Mycobacterium
ADPGNGQS

SEQ ID NO: 416151 - protein, 14 aa, Mycobacterium
ADPGPADGYSAAGY

SEQ ID NO: 416152 - protein, 7 aa, Mycobacterium
ADPGPGF

SEQ ID NO: 416153 - protein, 12 aa, Mycobacterium
ADPGPNDPATKA

SEQ ID NO: 416154 - protein, 9 aa, Mycobacterium
ADPGQAREW

SEQ ID NO: 416155 - protein, 18 aa, Mycobacterium
ADPGQRLEPQPAQPGDLR

SEQ ID NO: 416156 - protein, 12 aa, Mycobacterium
ADPGRIDAAGRR

SEQ ID NO: 416157 - protein, 9 aa, Mycobacterium
ADPGRKAAY

SEQ ID NO: 416158 - protein, 16 aa, Mycobacterium
ADPGRPATPELPPPLA

SEQ ID NO: 416159 - protein, 8 aa, Mycobacterium
ADPGRPTN

SEQ ID NO: 416160 - protein, 13 aa, Mycobacterium
ADPGRRDQVHRSA

SEQ ID NO: 416161 - protein, 9 aa, Mycobacterium
ADPGRSNGN

SEQ ID NO: 416162 - protein, 5 aa, Mycobacterium
ADPGS

SEQ ID NO: 416163 - protein, 15 aa, Mycobacterium
ADPGSAPAPVSDPSA

SEQ ID NO: 416164 - protein, 14 aa, Mycobacterium
ADPGSAPEPQADPS

SEQ ID NO: 416165 - protein, 15 aa, Mycobacterium
ADPGSAPEPQSDPSV

SEQ ID NO: 416166 - protein, 11 aa, Mycobacterium
ADPGSEQAKDT

SEQ ID NO: 416167 - protein, 7 aa, Mycobacterium
ADPGSVS

SEQ ID NO: 416168 - protein, 10 aa, Mycobacterium
ADPGTGETYA

SEQ ID NO: 416169 - protein, 7 aa, Mycobacterium
ADPGTPV

SEQ ID NO: 416170 - protein, 11 aa, Mycobacterium
ADPGTRAPAEQ

SEQ ID NO: 416171 - protein, 6 aa, Mycobacterium
ADPGVD

SEQ ID NO: 416172 - protein, 6 aa, Mycobacterium
ADPGVR

SEQ ID NO: 416173 - protein, 7 aa, Mycobacterium
ADPHDVP

SEQ ID NO: 416174 - protein, 18 aa, Mycobacterium
ADPHEGAPPPLIINQGTS

SEQ ID NO: 416175 - protein, 9 aa, Mycobacterium
ADPHGPGLA

SEQ ID NO: 416176 - protein, 17 aa, Mycobacterium
ADPHISGEAPPSRPITS

SEQ ID NO: 416177 - protein, 7 aa, Mycobacterium
ADPHRAE

SEQ ID NO: 416178 - protein, 13 aa, Mycobacterium
ADPHRSAVAPVGD

SEQ ID NO: 416179 - protein, 7 aa, Mycobacterium
ADPHTRA

SEQ ID NO: 416180 - protein, 5 aa, Mycobacterium
ADPIA

SEQ ID NO: 416181 - protein, 6 aa, Mycobacterium
ADPIEG

SEQ ID NO: 416182 - protein, 9 aa, Mycobacterium
ADPIGPVSV

SEQ ID NO: 416183 - protein, 7 aa, Mycobacterium
ADPITPL

SEQ ID NO: 416184 - protein, 5 aa, Mycobacterium
ADPKA

SEQ ID NO: 416185 - protein, 6 aa, Mycobacterium
ADPKDH

SEQ ID NO: 416186 - protein, 8 aa, Mycobacterium
ADPKGRDA

SEQ ID NO: 416187 - protein, 5 aa, Mycobacterium
ADPKL

SEQ ID NO: 416188 - protein, 7 aa, Mycobacterium
ADPKLAK

SEQ ID NO: 416189 - protein, 6 aa, Mycobacterium
ADPKLP

SEQ ID NO: 416190 - protein, 7 aa, Mycobacterium
ADPKQRF

SEQ ID NO: 416191 - protein, 6 aa, Mycobacterium
ADPKRL

SEQ ID NO: 416192 - protein, 6 aa, Mycobacterium
ADPKTE

SEQ ID NO: 416193 - protein, 7 aa, Mycobacterium
ADPKTEL

SEQ ID NO: 416194 - protein, 13 aa, Mycobacterium
ADPKTIPTDQHDG

SEQ ID NO: 416195 - protein, 9 aa, Mycobacterium
ADPKTQTMG

SEQ ID NO: 416196 - protein, 7 aa, Mycobacterium
ADPKTRA

SEQ ID NO: 416197 - protein, 7 aa, Mycobacterium
ADPKTYE

SEQ ID NO: 416198 - protein, 7 aa, Mycobacterium
ADPKVTA

SEQ ID NO: 416199 - protein, 6 aa, Mycobacterium
ADPLAD

SEQ ID NO: 416200 - protein, 13 aa, Mycobacterium
ADPLCGDGSHMRL

SEQ ID NO: 416201 - protein, 6 aa, Mycobacterium
ADPLDA

SEQ ID NO: 416202 - protein, 6 aa, Mycobacterium
ADPLDT

SEQ ID NO: 416203 - protein, 5 aa, Mycobacterium
ADPLE

SEQ ID NO: 416204 - protein, 14 aa, Mycobacterium
ADPLGAPLAGRPAP

SEQ ID NO: 416205 - protein, 7 aa, Mycobacterium
ADPLGEK

SEQ ID NO: 416206 - protein, 7 aa, Mycobacterium
ADPLGGA

SEQ ID NO: 416207 - protein, 12 aa, Mycobacterium
ADPLGKRSPGLK

SEQ ID NO: 416208 - protein, 6 aa, Mycobacterium
ADPLPD

SEQ ID NO: 416209 - protein, 8 aa, Mycobacterium
ADPLPPAA

SEQ ID NO: 416210 - protein, 12 aa, Mycobacterium
ADPLPSTPRRDL

SEQ ID NO: 416211 - protein, 9 aa, Mycobacterium
ADPLRAAPD

SEQ ID NO: 416212 - protein, 10 aa, Mycobacterium
ADPLRGDAYG

SEQ ID NO: 416213 - protein, 7 aa, Mycobacterium
ADPLRSG

SEQ ID NO: 416214 - protein, 5 aa, Mycobacterium
ADPLT

SEQ ID NO: 416215 - protein, 7 aa, Mycobacterium
ADPLTGR

SEQ ID NO: 416216 - protein, 6 aa, Mycobacterium
ADPLTN

SEQ ID NO: 416217 - protein, 6 aa, Mycobacterium
ADPLTT

SEQ ID NO: 416218 - protein, 11 aa, Mycobacterium
ADPMHTSGART

SEQ ID NO: 416219 - protein, 7 aa, Mycobacterium
ADPMPAI

SEQ ID NO: 416220 - protein, 5 aa, Mycobacterium
ADPMT

SEQ ID NO: 416221 - protein, 8 aa, Mycobacterium
ADPNFDER

SEQ ID NO: 416222 - protein, 9 aa, Mycobacterium
ADPNFESRD

SEQ ID NO: 416223 - protein, 11 aa, Mycobacterium
ADPNGKLTPLR

SEQ ID NO: 416224 - protein, 7 aa, Mycobacterium
ADPNGLN

SEQ ID NO: 416225 - protein, 6 aa, Mycobacterium
ADPNPA

SEQ ID NO: 416226 - protein, 7 aa, Mycobacterium
ADPNREA

SEQ ID NO: 416227 - protein, 7 aa, Mycobacterium
ADPNRRA

SEQ ID NO: 416228 - protein, 6 aa, Mycobacterium
ADPNSP

SEQ ID NO: 416229 - protein, 14 aa, Mycobacterium
ADPNSVLVEALAAV

SEQ ID NO: 416230 - protein, 7 aa, Mycobacterium
ADPNTVG

SEQ ID NO: 416231 - protein, 6 aa, Mycobacterium
ADPNVE

SEQ ID NO: 416232 - protein, 21 aa, Mycobacterium
ADPNWAGGDYHDTGRSPDAGL

SEQ ID NO: 416233 - protein, 21 aa, Mycobacterium
ADPNWQGGDYHDTGRKPEAGL

SEQ ID NO: 416234 - protein, 21 aa, Mycobacterium
ADPNWQGGDYHGTGRTPDTGL

SEQ ID NO: 416235 - protein, 7 aa, Mycobacterium
ADPNWRN

SEQ ID NO: 416236 - protein, 4 aa, Mycobacterium
ADPP

SEQ ID NO: 416237 - protein, 5 aa, Mycobacterium
ADPPA

SEQ ID NO: 416238 - protein, 7 aa, Mycobacterium
ADPPACR

SEQ ID NO: 416239 - protein, 9 aa, Mycobacterium
ADPPADPFA

SEQ ID NO: 416240 - protein, 15 aa, Mycobacterium
ADPPAGRRGDVERGA

SEQ ID NO: 416241 - protein, 8 aa, Mycobacterium
ADPPAPGS

SEQ ID NO: 416242 - protein, 12 aa, Mycobacterium
ADPPAPQQVFRP

SEQ ID NO: 416243 - protein, 7 aa, Mycobacterium
ADPPARL

SEQ ID NO: 416244 - protein, 9 aa, Mycobacterium
ADPPASRKA

SEQ ID NO: 416245 - protein, 9 aa, Mycobacterium
ADPPATPVR

SEQ ID NO: 416246 - protein, 10 aa, Mycobacterium
ADPPDGSGCV

SEQ ID NO: 416247 - protein, 6 aa, Mycobacterium
ADPPEC

SEQ ID NO: 416248 - protein, 9 aa, Mycobacterium
ADPPEREPE

SEQ ID NO: 416249 - protein, 6 aa, Mycobacterium
ADPPHL

SEQ ID NO: 416250 - protein, 6 aa, Mycobacterium
ADPPID

SEQ ID NO: 416251 - protein, 6 aa, Mycobacterium
ADPPIG

SEQ ID NO: 416252 - protein, 6 aa, Mycobacterium
ADPPMP

SEQ ID NO: 416253 - protein, 10 aa, Mycobacterium
ADPPPDSPLR

SEQ ID NO: 416254 - protein, 8 aa, Mycobacterium
ADPPPGLP

SEQ ID NO: 416255 - protein, 9 aa, Mycobacterium
ADPPPGQYR

SEQ ID NO: 416256 - protein, 6 aa, Mycobacterium
ADPPPL

SEQ ID NO: 416257 - protein, 9 aa, Mycobacterium
ADPPPNCTT

SEQ ID NO: 416258 - protein, 9 aa, Mycobacterium
ADPPPPPGS

SEQ ID NO: 416259 - protein, 9 aa, Mycobacterium
ADPPPQSPL

SEQ ID NO: 416260 - protein, 17 aa, Mycobacterium
ADPPPTAGEHNDIFLTE

SEQ ID NO: 416261 - protein, 12 aa, Mycobacterium
ADPPPTTSPEAG

SEQ ID NO: 416262 - protein, 8 aa, Mycobacterium
ADPPQRLS

SEQ ID NO: 416263 - protein, 7 aa, Mycobacterium
ADPPRGV

SEQ ID NO: 416264 - protein, 8 aa, Mycobacterium
ADPPRRAS

SEQ ID NO: 416265 - protein, 7 aa, Mycobacterium
ADPPTRR

SEQ ID NO: 416266 - protein, 5 aa, Mycobacterium
ADPPV

SEQ ID NO: 416267 - protein, 6 aa, Mycobacterium
ADPPVD

SEQ ID NO: 416268 - protein, 8 aa, Mycobacterium
ADPPVDPK

SEQ ID NO: 416269 - protein, 7 aa, Mycobacterium
ADPQAAH

SEQ ID NO: 416270 - protein, 13 aa, Mycobacterium
ADPQAHPLGTPSG

SEQ ID NO: 416271 - protein, 9 aa, Mycobacterium
ADPQDPGTL

SEQ ID NO: 416272 - protein, 10 aa, Mycobacterium
ADPQEARGAL

SEQ ID NO: 416273 - protein, 7 aa, Mycobacterium
ADPQGSA

SEQ ID NO: 416274 - protein, 8 aa, Mycobacterium
ADPQGSAL

SEQ ID NO: 416275 - protein, 5 aa, Mycobacterium
ADPQH

SEQ ID NO: 416276 - protein, 12 aa, Mycobacterium
ADPQPLDTGGTK

SEQ ID NO: 416277 - protein, 7 aa, Mycobacterium
ADPQQAG

SEQ ID NO: 416278 - protein, 6 aa, Mycobacterium
ADPQQG

SEQ ID NO: 416279 - protein, 10 aa, Mycobacterium
ADPQRAREYG

SEQ ID NO: 416280 - protein, 9 aa, Mycobacterium
ADPQRDGCA

SEQ ID NO: 416281 - protein, 8 aa, Mycobacterium
ADPQRLAT

SEQ ID NO: 416282 - protein, 17 aa, Mycobacterium
ADPQRRRRYQQARGKGG

SEQ ID NO: 416283 - protein, 8 aa, Mycobacterium
ADPQRSVG

SEQ ID NO: 416284 - protein, 8 aa, Mycobacterium
ADPQRTAK

SEQ ID NO: 416285 - protein, 7 aa, Mycobacterium
ADPQSPL

SEQ ID NO: 416286 - protein, 8 aa, Mycobacterium
ADPQSSVP

SEQ ID NO: 416287 - protein, 10 aa, Mycobacterium
ADPQTAAQLG

SEQ ID NO: 416288 - protein, 12 aa, Mycobacterium
ADPQTAAQLGGP

SEQ ID NO: 416289 - protein, 7 aa, Mycobacterium
ADPQTAG

SEQ ID NO: 416290 - protein, 7 aa, Mycobacterium
ADPQTGA

SEQ ID NO: 416291 - protein, 7 aa, Mycobacterium
ADPQTGV

SEQ ID NO: 416292 - protein, 7 aa, Mycobacterium
ADPQTRL

SEQ ID NO: 416293 - protein, 5 aa, Mycobacterium
ADPQV

SEQ ID NO: 416294 - protein, 6 aa, Mycobacterium
ADPQVR

SEQ ID NO: 416295 - protein, 18 aa, Mycobacterium
ADPQVSVTGGAIRGTTAG

SEQ ID NO: 416296 - protein, 6 aa, Mycobacterium
ADPQWG

SEQ ID NO: 416297 - protein, 6 aa, Mycobacterium
ADPQYV

SEQ ID NO: 416298 - protein, 8 aa, Mycobacterium
ADPRAADG

SEQ ID NO: 416299 - protein, 8 aa, Mycobacterium
ADPRAAEG

SEQ ID NO: 416300 - protein, 6 aa, Mycobacterium
ADPRAT

SEQ ID NO: 416301 - protein, 7 aa, Mycobacterium
ADPRDGR

SEQ ID NO: 416302 - protein, 7 aa, Mycobacterium
ADPREGL

SEQ ID NO: 416303 - protein, 5 aa, Mycobacterium
ADPRF

SEQ ID NO: 416304 - protein, 12 aa, Mycobacterium
ADPRGAMRRSGA

SEQ ID NO: 416305 - protein, 44 aa, Mycobacterium
ADPRGARRGLGGAGLGATGAGSRTGSRTGRRRLGRGRRSRGRRR

SEQ ID NO: 416306 - protein, 10 aa, Mycobacterium
ADPRGIGERR

SEQ ID NO: 416307 - protein, 6 aa, Mycobacterium
ADPRLT

SEQ ID NO: 416308 - protein, 7 aa, Mycobacterium
ADPRNGQ

SEQ ID NO: 416309 - protein, 6 aa, Mycobacterium
ADPRPH

SEQ ID NO: 416310 - protein, 5 aa, Mycobacterium
ADPRQ

SEQ ID NO: 416311 - protein, 8 aa, Mycobacterium
ADPRQALT

SEQ ID NO: 416312 - protein, 8 aa, Mycobacterium
ADPRQYPE

SEQ ID NO: 416313 - protein, 8 aa, Mycobacterium
ADPRRTRL

SEQ ID NO: 416314 - protein, 8 aa, Mycobacterium
ADPRSAIA

SEQ ID NO: 416315 - protein, 9 aa, Mycobacterium
ADPRSPAEI

SEQ ID NO: 416316 - protein, 6 aa, Mycobacterium
ADPRSR

SEQ ID NO: 416317 - protein, 10 aa, Mycobacterium
ADPRSRGAED

SEQ ID NO: 416318 - protein, 6 aa, Mycobacterium
ADPRSV

SEQ ID NO: 416319 - protein, 6 aa, Mycobacterium
ADPRTA

SEQ ID NO: 416320 - protein, 9 aa, Mycobacterium
ADPRTGPGV

SEQ ID NO: 416321 - protein, 8 aa, Mycobacterium
ADPRTGVS

SEQ ID NO: 416322 - protein, 13 aa, Mycobacterium
ADPRTREQRRADA

SEQ ID NO: 416323 - protein, 13 aa, Mycobacterium
ADPRTRKQRRADA

SEQ ID NO: 416324 - protein, 10 aa, Mycobacterium
ADPRTRPNGV

SEQ ID NO: 416325 - protein, 8 aa, Mycobacterium
ADPRTSGA

SEQ ID NO: 416326 - protein, 5 aa, Mycobacterium
ADPRV

SEQ ID NO: 416327 - protein, 12 aa, Mycobacterium
ADPRVKEGAAAA

SEQ ID NO: 416328 - protein, 8 aa, Mycobacterium
ADPRVSTA

SEQ ID NO: 416329 - protein, 6 aa, Mycobacterium
ADPRWG

SEQ ID NO: 416330 - protein, 5 aa, Mycobacterium
ADPSA

SEQ ID NO: 416331 - protein, 19 aa, Mycobacterium
ADPSAAAAELAGSRAEYAG

SEQ ID NO: 416332 - protein, 11 aa, Mycobacterium
ADPSAGNDEIT

SEQ ID NO: 416333 - protein, 29 aa, Mycobacterium
ADPSAGSMSSWEGASPLPHPEQPSGAPDL

SEQ ID NO: 416334 - protein, 12 aa, Mycobacterium
ADPSAGTPEGPW

SEQ ID NO: 416335 - protein, 13 aa, Mycobacterium
ADPSAHPLATPSG

SEQ ID NO: 416336 - protein, 6 aa, Mycobacterium
ADPSAL

SEQ ID NO: 416337 - protein, 13 aa, Mycobacterium
ADPSARAGNAAEN

SEQ ID NO: 416338 - protein, 17 aa, Mycobacterium
ADPSARLQASREANTQM

SEQ ID NO: 416339 - protein, 7 aa, Mycobacterium
ADPSATV

SEQ ID NO: 416340 - protein, 7 aa, Mycobacterium
ADPSAVD

SEQ ID NO: 416341 - protein, 10 aa, Mycobacterium
ADPSDEDDAE

SEQ ID NO: 416342 - protein, 6 aa, Mycobacterium
ADPSEE

SEQ ID NO: 416343 - protein, 6 aa, Mycobacterium
ADPSGR

SEQ ID NO: 416344 - protein, 8 aa, Mycobacterium
ADPSGTPL

SEQ ID NO: 416345 - protein, 10 aa, Mycobacterium
ADPSIEDGRE

SEQ ID NO: 416346 - protein, 6 aa, Mycobacterium
ADPSIT

SEQ ID NO: 416347 - protein, 6 aa, Mycobacterium
ADPSLM

SEQ ID NO: 416348 - protein, 9 aa, Mycobacterium
ADPSLNPSD

SEQ ID NO: 416349 - protein, 7 aa, Mycobacterium
ADPSLTS

SEQ ID NO: 416350 - protein, 9 aa, Mycobacterium
ADPSPAAQV

SEQ ID NO: 416351 - protein, 9 aa, Mycobacterium
ADPSPASVN

SEQ ID NO: 416352 - protein, 8 aa, Mycobacterium
ADPSPEID

SEQ ID NO: 416353 - protein, 8 aa, Mycobacterium
ADPSPENA

SEQ ID NO: 416354 - protein, 11 aa, Mycobacterium
ADPSPGTPAGP

SEQ ID NO: 416355 - protein, 7 aa, Mycobacterium
ADPSPYA

SEQ ID NO: 416356 - protein, 8 aa, Mycobacterium
ADPSRRVS

SEQ ID NO: 416357 - protein, 10 aa, Mycobacterium
ADPSRSAGNV

SEQ ID NO: 416358 - protein, 10 aa, Mycobacterium
ADPSRSAGSI

SEQ ID NO: 416359 - protein, 11 aa, Mycobacterium
ADPSSASRATL

SEQ ID NO: 416360 - protein, 11 aa, Mycobacterium
ADPSSLSGMGD

SEQ ID NO: 416361 - protein, 13 aa, Mycobacterium
ADPSTAAPARRAD

SEQ ID NO: 416362 - protein, 9 aa, Mycobacterium
ADPSTARTD

SEQ ID NO: 416363 - protein, 7 aa, Mycobacterium
ADPSTGV

SEQ ID NO: 416364 - protein, 33 aa, Mycobacterium
ADPSTSGVVSDTGAAVPAPSPIITAGSDDPKCV

SEQ ID NO: 416365 - protein, 9 aa, Mycobacterium
ADPSTVGDN

SEQ ID NO: 416366 - protein, 9 aa, Mycobacterium
ADPSWPEQA

SEQ ID NO: 416367 - protein, 5 aa, Mycobacterium
ADPTA

SEQ ID NO: 416368 - protein, 8 aa, Mycobacterium
ADPTALPT

SEQ ID NO: 416369 - protein, 8 aa, Mycobacterium
ADPTARRQ

SEQ ID NO: 416370 - protein, 27 aa, Mycobacterium
ADPTASASTAATPAGGASMAPAAAGTR

SEQ ID NO: 416371 - protein, 6 aa, Mycobacterium
ADPTAV

SEQ ID NO: 416372 - protein, 10 aa, Mycobacterium
ADPTDFPDDT

SEQ ID NO: 416373 - protein, 8 aa, Mycobacterium
ADPTEAGA

SEQ ID NO: 416374 - protein, 11 aa, Mycobacterium
ADPTEARDRGA

SEQ ID NO: 416375 - protein, 7 aa, Mycobacterium
ADPTENL

SEQ ID NO: 416376 - protein, 8 aa, Mycobacterium
ADPTGISE

SEQ ID NO: 416377 - protein, 9 aa, Mycobacterium
ADPTGQLGA

SEQ ID NO: 416378 - protein, 12 aa, Mycobacterium
ADPTGSYRIETG

SEQ ID NO: 416379 - protein, 5 aa, Mycobacterium
ADPTH

SEQ ID NO: 416380 - protein, 6 aa, Mycobacterium
ADPTHQ

SEQ ID NO: 416381 - protein, 8 aa, Mycobacterium
ADPTHSGY

SEQ ID NO: 416382 - protein, 7 aa, Mycobacterium
ADPTKRI

SEQ ID NO: 416383 - protein, 5 aa, Mycobacterium
ADPTL

SEQ ID NO: 416384 - protein, 6 aa, Mycobacterium
ADPTLR

SEQ ID NO: 416385 - protein, 12 aa, Mycobacterium
ADPTLSRADLPG

SEQ ID NO: 416386 - protein, 12 aa, Mycobacterium
ADPTNADQRKTL

SEQ ID NO: 416387 - protein, 13 aa, Mycobacterium
ADPTPAGHRDPLN

SEQ ID NO: 416388 - protein, 9 aa, Mycobacterium
ADPTPAPGW

SEQ ID NO: 416389 - protein, 12 aa, Mycobacterium
ADPTPEGHADPL

SEQ ID NO: 416390 - protein, 11 aa, Mycobacterium
ADPTPEGHHNP

SEQ ID NO: 416391 - protein, 8 aa, Mycobacterium
ADPTPGKH

SEQ ID NO: 416392 - protein, 13 aa, Mycobacterium
ADPTPPGSSQLPA

SEQ ID NO: 416393 - protein, 13 aa, Mycobacterium
ADPTPQDDADPLN

SEQ ID NO: 416394 - protein, 7 aa, Mycobacterium
ADPTPQL

SEQ ID NO: 416395 - protein, 9 aa, Mycobacterium
ADPTPSAQS

SEQ ID NO: 416396 - protein, 7 aa, Mycobacterium
ADPTPVN

SEQ ID NO: 416397 - protein, 7 aa, Mycobacterium
ADPTQVN

SEQ ID NO: 416398 - protein, 7 aa, Mycobacterium
ADPTRLE

SEQ ID NO: 416399 - protein, 9 aa, Mycobacterium
ADPTSARGS

SEQ ID NO: 416400 - protein, 6 aa, Mycobacterium
ADPTSD

SEQ ID NO: 416401 - protein, 8 aa, Mycobacterium
ADPTSGRR

SEQ ID NO: 416402 - protein, 6 aa, Mycobacterium
ADPTSI

SEQ ID NO: 416403 - protein, 16 aa, Mycobacterium
ADPTSKMSKSAATDAG

SEQ ID NO: 416404 - protein, 10 aa, Mycobacterium
ADPTSNKPGY

SEQ ID NO: 416405 - protein, 10 aa, Mycobacterium
ADPTSSQGRL

SEQ ID NO: 416406 - protein, 14 aa, Mycobacterium
ADPTTELGTGQTGG

SEQ ID NO: 416407 - protein, 7 aa, Mycobacterium
ADPTTFA

SEQ ID NO: 416408 - protein, 9 aa, Mycobacterium
ADPTTHDEI

SEQ ID NO: 416409 - protein, 8 aa, Mycobacterium
ADPTTIGY

SEQ ID NO: 416410 - protein, 8 aa, Mycobacterium
ADPTTRAD

SEQ ID NO: 416411 - protein, 5 aa, Mycobacterium
ADPTW

SEQ ID NO: 416412 - protein, 6 aa, Mycobacterium
ADPTWS

SEQ ID NO: 416413 - protein, 5 aa, Mycobacterium
ADPVA

SEQ ID NO: 416414 - protein, 22 aa, Mycobacterium
ADPVAAAPEPTPPTTRDGHRQS

SEQ ID NO: 416415 - protein, 7 aa, Mycobacterium
ADPVAAT

SEQ ID NO: 416416 - protein, 7 aa, Mycobacterium
ADPVAKQ

SEQ ID NO: 416417 - protein, 11 aa, Mycobacterium
ADPVARADTEW

SEQ ID NO: 416418 - protein, 7 aa, Mycobacterium
ADPVEAG

SEQ ID NO: 416419 - protein, 7 aa, Mycobacterium
ADPVEAR

SEQ ID NO: 416420 - protein, 6 aa, Mycobacterium
ADPVGE

SEQ ID NO: 416421 - protein, 56 aa, Mycobacterium
ADPVGPGTETPSAATFTARRGETGRDPGGPANRRDPHGTGHSPRPVGNGATGRSIT

SEQ ID NO: 416422 - protein, 6 aa, Mycobacterium
ADPVHK

SEQ ID NO: 416423 - protein, 5 aa, Mycobacterium
ADPVP

SEQ ID NO: 416424 - protein, 7 aa, Mycobacterium
ADPVPDS

SEQ ID NO: 416425 - protein, 7 aa, Mycobacterium
ADPVRGS

SEQ ID NO: 416426 - protein, 7 aa, Mycobacterium
ADPVTTR

SEQ ID NO: 416427 - protein, 4 aa, Mycobacterium
ADPY

SEQ ID NO: 416428 - protein, 17 aa, Mycobacterium
ADPYGTDASHRGGHPGF

SEQ ID NO: 416429 - protein, 7 aa, Mycobacterium
ADPYPDP

SEQ ID NO: 416430 - protein, 6 aa, Mycobacterium
ADPYPT

SEQ ID NO: 416431 - protein, 7 aa, Mycobacterium
ADQAAAA

SEQ ID NO: 416432 - protein, 10 aa, Mycobacterium
ADQAAAEALK

SEQ ID NO: 416433 - protein, 12 aa, Mycobacterium
ADQAASSAPSPA

SEQ ID NO: 416434 - protein, 5 aa, Mycobacterium
ADQAD

SEQ ID NO: 416435 - protein, 7 aa, Mycobacterium
ADQADAA

SEQ ID NO: 416436 - protein, 7 aa, Mycobacterium
ADQALGD

SEQ ID NO: 416437 - protein, 10 aa, Mycobacterium
ADQANEASLP

SEQ ID NO: 416438 - protein, 13 aa, Mycobacterium
ADQARAAAAGDDE

SEQ ID NO: 416439 - protein, 15 aa, Mycobacterium
ADQARAAAAGDDEAM

SEQ ID NO: 416440 - protein, 10 aa, Mycobacterium
ADQARAAIDN

SEQ ID NO: 416441 - protein, 12 aa, Mycobacterium
ADQARKTDPQLA

SEQ ID NO: 416442 - protein, 11 aa, Mycobacterium
ADQARTHGIPE

SEQ ID NO: 416443 - protein, 12 aa, Mycobacterium
ADQASWSEAPGL

SEQ ID NO: 416444 - protein, 10 aa, Mycobacterium
ADQATPVSRP

SEQ ID NO: 416445 - protein, 15 aa, Mycobacterium
ADQATTRLQAAIGAL

SEQ ID NO: 416446 - protein, 4 aa, Mycobacterium
ADQD

SEQ ID NO: 416447 - protein, 8 aa, Mycobacterium
ADQDAATG

SEQ ID NO: 416448 - protein, 5 aa, Mycobacterium
ADQDD

SEQ ID NO: 416449 - protein, 7 aa, Mycobacterium
ADQDPGP

SEQ ID NO: 416450 - protein, 9 aa, Mycobacterium
ADQEAGRWS

SEQ ID NO: 416451 - protein, 5 aa, Mycobacterium
ADQED

SEQ ID NO: 416452 - protein, 10 aa, Mycobacterium
ADQEGKPLSA

SEQ ID NO: 416453 - protein, 8 aa, Mycobacterium
ADQEGNGD

SEQ ID NO: 416454 - protein, 5 aa, Mycobacterium
ADQEQ

SEQ ID NO: 416455 - protein, 18 aa, Mycobacterium
ADQEQAEREKVRAARTPR

SEQ ID NO: 416456 - protein, 8 aa, Mycobacterium
ADQGAAPL

SEQ ID NO: 416457 - protein, 7 aa, Mycobacterium
ADQGADQ

SEQ ID NO: 416458 - protein, 9 aa, Mycobacterium
ADQGGALGG

SEQ ID NO: 416459 - protein, 23 aa, Mycobacterium
ADQGGVAAATAGGIERATGSRVP

SEQ ID NO: 416460 - protein, 5 aa, Mycobacterium
ADQGH

SEQ ID NO: 416461 - protein, 6 aa, Mycobacterium
ADQGLQ

SEQ ID NO: 416462 - protein, 6 aa, Mycobacterium
ADQGLT

SEQ ID NO: 416463 - protein, 10 aa, Mycobacterium
ADQGRDREAA

SEQ ID NO: 416464 - protein, 14 aa, Mycobacterium
ADQHEDSGEAAKPG

SEQ ID NO: 416465 - protein, 6 aa, Mycobacterium
ADQIDD

SEQ ID NO: 416466 - protein, 14 aa, Mycobacterium
ADQIDSAAAESSDG

SEQ ID NO: 416467 - protein, 8 aa, Mycobacterium
ADQIGADA

SEQ ID NO: 416468 - protein, 14 aa, Mycobacterium
ADQKPHQPIAPAPH

SEQ ID NO: 416469 - protein, 10 aa, Mycobacterium
ADQKSDEAFR

SEQ ID NO: 416470 - protein, 11 aa, Mycobacterium
ADQLGAATPCS

SEQ ID NO: 416471 - protein, 6 aa, Mycobacterium
ADQLGG

SEQ ID NO: 416472 - protein, 5 aa, Mycobacterium
ADQLR

SEQ ID NO: 416473 - protein, 26 aa, Mycobacterium
ADQMANPLGSLPGEVKDAVNDPAGFA

SEQ ID NO: 416474 - protein, 6 aa, Mycobacterium
ADQMTQ

SEQ ID NO: 416475 - protein, 5 aa, Mycobacterium
ADQNR

SEQ ID NO: 416476 - protein, 7 aa, Mycobacterium
ADQPADA

SEQ ID NO: 416477 - protein, 13 aa, Mycobacterium
ADQPAEHTDSGVA

SEQ ID NO: 416478 - protein, 18 aa, Mycobacterium
ADQPAGYNADSSDKSTMN

SEQ ID NO: 416479 - protein, 16 aa, Mycobacterium
ADQPASPTKIRTAPED

SEQ ID NO: 416480 - protein, 10 aa, Mycobacterium
ADQPEVSDRI

SEQ ID NO: 416481 - protein, 5 aa, Mycobacterium
ADQPG

SEQ ID NO: 416482 - protein, 6 aa, Mycobacterium
ADQPGC

SEQ ID NO: 416483 - protein, 10 aa, Mycobacterium
ADQPGPGGGR

SEQ ID NO: 416484 - protein, 8 aa, Mycobacterium
ADQPGRSH

SEQ ID NO: 416485 - protein, 6 aa, Mycobacterium
ADQPNA

SEQ ID NO: 416486 - protein, 15 aa, Mycobacterium
ADQPNAVNSTAKYGE

SEQ ID NO: 416487 - protein, 8 aa, Mycobacterium
ADQPPDEI

SEQ ID NO: 416488 - protein, 11 aa, Mycobacterium
ADQPPDYETSG

SEQ ID NO: 416489 - protein, 6 aa, Mycobacterium
ADQPTA

SEQ ID NO: 416490 - protein, 7 aa, Mycobacterium
ADQPVTA

SEQ ID NO: 416491 - protein, 9 aa, Mycobacterium
ADQPVTAEL

SEQ ID NO: 416492 - protein, 5 aa, Mycobacterium
ADQPY

SEQ ID NO: 416493 - protein, 14 aa, Mycobacterium
ADQQLTGSRAGGLH

SEQ ID NO: 416494 - protein, 7 aa, Mycobacterium
ADQQRSR

SEQ ID NO: 416495 - protein, 14 aa, Mycobacterium
ADQRATLIGQDMDC

SEQ ID NO: 416496 - protein, 13 aa, Mycobacterium
ADQRGVGAAASAT

SEQ ID NO: 416497 - protein, 6 aa, Mycobacterium
ADQRLS

SEQ ID NO: 416498 - protein, 9 aa, Mycobacterium
ADQRPNDAG

SEQ ID NO: 416499 - protein, 7 aa, Mycobacterium
ADQRRDH

SEQ ID NO: 416500 - protein, 19 aa, Mycobacterium
ADQRRQDTVTTVADGATVT

SEQ ID NO: 416501 - protein, 7 aa, Mycobacterium
ADQRRQH

SEQ ID NO: 416502 - protein, 14 aa, Mycobacterium
ADQRRSAPADDLTT

SEQ ID NO: 416503 - protein, 7 aa, Mycobacterium
ADQRRTD

SEQ ID NO: 416504 - protein, 6 aa, Mycobacterium
ADQRTR

SEQ ID NO: 416505 - protein, 5 aa, Mycobacterium
ADQSA

SEQ ID NO: 416506 - protein, 17 aa, Mycobacterium
ADQSAASGKKFTEAEQE

SEQ ID NO: 416507 - protein, 8 aa, Mycobacterium
ADQSARRE

SEQ ID NO: 416508 - protein, 13 aa, Mycobacterium
ADQSERSDAASRR

SEQ ID NO: 416509 - protein, 6 aa, Mycobacterium
ADQSGV

SEQ ID NO: 416510 - protein, 8 aa, Mycobacterium
ADQSLGEQ

SEQ ID NO: 416511 - protein, 7 aa, Mycobacterium
ADQSLSS

SEQ ID NO: 416512 - protein, 7 aa, Mycobacterium
ADQSPLA

SEQ ID NO: 416513 - protein, 20 aa, Mycobacterium
ADQSPTAARDASAAKVAAAK

SEQ ID NO: 416514 - protein, 33 aa, Mycobacterium
ADQSSGLSAITRSKSGWTGGADPRREGVVMGDT

SEQ ID NO: 416515 - protein, 10 aa, Mycobacterium
ADQSTPVPSC

SEQ ID NO: 416516 - protein, 6 aa, Mycobacterium
ADQSVP

SEQ ID NO: 416517 - protein, 4 aa, Mycobacterium
ADQT

SEQ ID NO: 416518 - protein, 8 aa, Mycobacterium
ADQTEADH

SEQ ID NO: 416519 - protein, 5 aa, Mycobacterium
ADQTF

SEQ ID NO: 416520 - protein, 6 aa, Mycobacterium
ADQTFD

SEQ ID NO: 416521 - protein, 19 aa, Mycobacterium
ADQTLAADEAATATAAGPG

SEQ ID NO: 416522 - protein, 6 aa, Mycobacterium
ADQTPR

SEQ ID NO: 416523 - protein, 7 aa, Mycobacterium
ADQTRTY

SEQ ID NO: 416524 - protein, 5 aa, Mycobacterium
ADQVG

SEQ ID NO: 416525 - protein, 7 aa, Mycobacterium
ADQVPDA

SEQ ID NO: 416526 - protein, 8 aa, Mycobacterium
ADQVPSQL

SEQ ID NO: 416527 - protein, 11 aa, Mycobacterium
ADQVQGRADLA

SEQ ID NO: 416528 - protein, 5 aa, Mycobacterium
ADQVR

SEQ ID NO: 416529 - protein, 8 aa, Mycobacterium
ADQVSDAE

SEQ ID NO: 416530 - protein, 21 aa, Mycobacterium
ADQVTSPVADPPVEPKARTVR

SEQ ID NO: 416531 - protein, 7 aa, Mycobacterium
ADQYDTP

SEQ ID NO: 416532 - protein, 5 aa, Mycobacterium
ADRAA

SEQ ID NO: 416533 - protein, 7 aa, Mycobacterium
ADRAAAE

SEQ ID NO: 416534 - protein, 7 aa, Mycobacterium
ADRAAAG

SEQ ID NO: 416535 - protein, 8 aa, Mycobacterium
ADRAAAQK

SEQ ID NO: 416536 - protein, 6 aa, Mycobacterium
ADRAAD

SEQ ID NO: 416537 - protein, 15 aa, Mycobacterium
ADRAAGAGYGPGCGS

SEQ ID NO: 416538 - protein, 9 aa, Mycobacterium
ADRAAGAHP

SEQ ID NO: 416539 - protein, 7 aa, Mycobacterium
ADRAAGT

SEQ ID NO: 416540 - protein, 7 aa, Mycobacterium
ADRAAHR

SEQ ID NO: 416541 - protein, 8 aa, Mycobacterium
ADRAARMG

SEQ ID NO: 416542 - protein, 6 aa, Mycobacterium
ADRAAT

SEQ ID NO: 416543 - protein, 7 aa, Mycobacterium
ADRADHL

SEQ ID NO: 416544 - protein, 9 aa, Mycobacterium
ADRADTLRT

SEQ ID NO: 416545 - protein, 10 aa, Mycobacterium
ADRADWSERD

SEQ ID NO: 416546 - protein, 8 aa, Mycobacterium
ADRAEAPL

SEQ ID NO: 416547 - protein, 17 aa, Mycobacterium
ADRAELEGVSADRAPQI

SEQ ID NO: 416548 - protein, 16 aa, Mycobacterium
ADRAELEGVSAERAPQ

SEQ ID NO: 416549 - protein, 11 aa, Mycobacterium
ADRAEQDVAKA

SEQ ID NO: 416550 - protein, 7 aa, Mycobacterium
ADRAERD

SEQ ID NO: 416551 - protein, 8 aa, Mycobacterium
ADRAGDHA

SEQ ID NO: 416552 - protein, 7 aa, Mycobacterium
ADRAGDT

SEQ ID NO: 416553 - protein, 13 aa, Mycobacterium
ADRAGGLADQGAD

SEQ ID NO: 416554 - protein, 6 aa, Mycobacterium
ADRAGR

SEQ ID NO: 416555 - protein, 7 aa, Mycobacterium
ADRAGRV

SEQ ID NO: 416556 - protein, 10 aa, Mycobacterium
ADRAGWSETD

SEQ ID NO: 416557 - protein, 7 aa, Mycobacterium
ADRALSD

SEQ ID NO: 416558 - protein, 16 aa, Mycobacterium
ADRAPKVVDTDAGGQT

SEQ ID NO: 416559 - protein, 11 aa, Mycobacterium
ADRAPSEGGSI

SEQ ID NO: 416560 - protein, 14 aa, Mycobacterium
ADRAPTVVETDDGR

SEQ ID NO: 416561 - protein, 12 aa, Mycobacterium
ADRAQRSASVKR

SEQ ID NO: 416562 - protein, 6 aa, Mycobacterium
ADRARF

SEQ ID NO: 416563 - protein, 8 aa, Mycobacterium
ADRARLGR

SEQ ID NO: 416564 - protein, 9 aa, Mycobacterium
ADRARMSRA

SEQ ID NO: 416565 - protein, 8 aa, Mycobacterium
ADRASHSR

SEQ ID NO: 416566 - protein, 6 aa, Mycobacterium
ADRASR

SEQ ID NO: 416567 - protein, 7 aa, Mycobacterium
ADRATDG

SEQ ID NO: 416568 - protein, 21 aa, Mycobacterium
ADRATGEVSGVGKGKHTSTQS

SEQ ID NO: 416569 - protein, 13 aa, Mycobacterium
ADRATSEAADKYR

SEQ ID NO: 416570 - protein, 6 aa, Mycobacterium
ADRATV

SEQ ID NO: 416571 - protein, 5 aa, Mycobacterium
ADRAV

SEQ ID NO: 416572 - protein, 13 aa, Mycobacterium
ADRAVARSVSDEM

SEQ ID NO: 416573 - protein, 6 aa, Mycobacterium
ADRAVD

SEQ ID NO: 416574 - protein, 8 aa, Mycobacterium
ADRAVGDV

SEQ ID NO: 416575 - protein, 8 aa, Mycobacterium
ADRAVGEV

SEQ ID NO: 416576 - protein, 8 aa, Mycobacterium
ADRCPTAS

SEQ ID NO: 416577 - protein, 8 aa, Mycobacterium
ADRCRRRG

SEQ ID NO: 416578 - protein, 4 aa, Mycobacterium
ADRD

SEQ ID NO: 416579 - protein, 6 aa, Mycobacterium
ADRDAA

SEQ ID NO: 416580 - protein, 9 aa, Mycobacterium
ADRDAADAL

SEQ ID NO: 416581 - protein, 9 aa, Mycobacterium
ADRDAARAH

SEQ ID NO: 416582 - protein, 9 aa, Mycobacterium
ADRDAASEL

SEQ ID NO: 416583 - protein, 16 aa, Mycobacterium
ADRDAVRRARERQAER

SEQ ID NO: 416584 - protein, 6 aa, Mycobacterium
ADRDDQ

SEQ ID NO: 416585 - protein, 5 aa, Mycobacterium
ADRDE

SEQ ID NO: 416586 - protein, 5 aa, Mycobacterium
ADRDG

SEQ ID NO: 416587 - protein, 13 aa, Mycobacterium
ADRDGAEHSEARD

SEQ ID NO: 416588 - protein, 10 aa, Mycobacterium
ADRDGAEQTV

SEQ ID NO: 416589 - protein, 8 aa, Mycobacterium
ADRDGAEV

SEQ ID NO: 416590 - protein, 10 aa, Mycobacterium
ADRDGAQQTV

SEQ ID NO: 416591 - protein, 6 aa, Mycobacterium
ADRDGI

SEQ ID NO: 416592 - protein, 6 aa, Mycobacterium
ADRDGR

SEQ ID NO: 416593 - protein, 6 aa, Mycobacterium
ADRDGW

SEQ ID NO: 416594 - protein, 6 aa, Mycobacterium
ADRDKD

SEQ ID NO: 416595 - protein, 6 aa, Mycobacterium
ADRDKE

SEQ ID NO: 416596 - protein, 5 aa, Mycobacterium
ADRDL

SEQ ID NO: 416597 - protein, 8 aa, Mycobacterium
ADRDRAAR

SEQ ID NO: 416598 - protein, 6 aa, Mycobacterium
ADRDRE

SEQ ID NO: 416599 - protein, 11 aa, Mycobacterium
ADRDRTNVHGS

SEQ ID NO: 416600 - protein, 7 aa, Mycobacterium
ADRDSAI

SEQ ID NO: 416601 - protein, 12 aa, Mycobacterium
ADRDSGGRGAQT

SEQ ID NO: 416602 - protein, 14 aa, Mycobacterium
ADRDTGRNCRPTNT

SEQ ID NO: 416603 - protein, 5 aa, Mycobacterium
ADREA

SEQ ID NO: 416604 - protein, 9 aa, Mycobacterium
ADREANEAD

SEQ ID NO: 416605 - protein, 9 aa, Mycobacterium
ADREDAPGR

SEQ ID NO: 416606 - protein, 7 aa, Mycobacterium
ADREDKG

SEQ ID NO: 416607 - protein, 11 aa, Mycobacterium
ADREDKPDFTE

SEQ ID NO: 416608 - protein, 23 aa, Mycobacterium
ADREDQVREAAQSCPEQAIMITE

SEQ ID NO: 416609 - protein, 10 aa, Mycobacterium
ADREGGPARA

SEQ ID NO: 416610 - protein, 7 aa, Mycobacterium
ADREGPV

SEQ ID NO: 416611 - protein, 7 aa, Mycobacterium
ADREHAR

SEQ ID NO: 416612 - protein, 9 aa, Mycobacterium
ADREQAQRL

SEQ ID NO: 416613 - protein, 5 aa, Mycobacterium
ADRER

SEQ ID NO: 416614 - protein, 6 aa, Mycobacterium
ADRERM

SEQ ID NO: 416615 - protein, 9 aa, Mycobacterium
ADRESADRV

SEQ ID NO: 416616 - protein, 9 aa, Mycobacterium
ADRETARAM

SEQ ID NO: 416617 - protein, 9 aa, Mycobacterium
ADRGAARAH

SEQ ID NO: 416618 - protein, 8 aa, Mycobacterium
ADRGAEHA

SEQ ID NO: 416619 - protein, 8 aa, Mycobacterium
ADRGAGPY

SEQ ID NO: 416620 - protein, 7 aa, Mycobacterium
ADRGALP

SEQ ID NO: 416621 - protein, 7 aa, Mycobacterium
ADRGEDI

SEQ ID NO: 416622 - protein, 8 aa, Mycobacterium
ADRGEDTP

SEQ ID NO: 416623 - protein, 6 aa, Mycobacterium
ADRGEQ

SEQ ID NO: 416624 - protein, 10 aa, Mycobacterium
ADRGGETEFA

SEQ ID NO: 416625 - protein, 8 aa, Mycobacterium
ADRGGRRG

SEQ ID NO: 416626 - protein, 6 aa, Mycobacterium
ADRGGT

SEQ ID NO: 416627 - protein, 5 aa, Mycobacterium
ADRGH

SEQ ID NO: 416628 - protein, 12 aa, Mycobacterium
ADRGIEEGKPAQ

SEQ ID NO: 416629 - protein, 6 aa, Mycobacterium
ADRGKV

SEQ ID NO: 416630 - protein, 6 aa, Mycobacterium
ADRGLP

SEQ ID NO: 416631 - protein, 10 aa, Mycobacterium
ADRGLPAAGL

SEQ ID NO: 416632 - protein, 10 aa, Mycobacterium
ADRGPRADDA

SEQ ID NO: 416633 - protein, 6 aa, Mycobacterium
ADRGRA

SEQ ID NO: 416634 - protein, 5 aa, Mycobacterium
ADRGS

SEQ ID NO: 416635 - protein, 12 aa, Mycobacterium
ADRGSSRICPNG

SEQ ID NO: 416636 - protein, 8 aa, Mycobacterium
ADRGTTRA

SEQ ID NO: 416637 - protein, 15 aa, Mycobacterium
ADRGVPFNQVRHGQA

SEQ ID NO: 416638 - protein, 10 aa, Mycobacterium
ADRGVRPETP

SEQ ID NO: 416639 - protein, 6 aa, Mycobacterium
ADRGWG

SEQ ID NO: 416640 - protein, 4 aa, Mycobacterium
ADRH

SEQ ID NO: 416641 - protein, 5 aa, Mycobacterium
ADRHT

SEQ ID NO: 416642 - protein, 8 aa, Mycobacterium
ADRIPKQR

SEQ ID NO: 416643 - protein, 5 aa, Mycobacterium
ADRIS

SEQ ID NO: 416644 - protein, 11 aa, Mycobacterium
ADRKASDGPLT

SEQ ID NO: 416645 - protein, 8 aa, Mycobacterium
ADRKGGHV

SEQ ID NO: 416646 - protein, 15 aa, Mycobacterium
ADRKPRQLSGGQAQR

SEQ ID NO: 416647 - protein, 4 aa, Mycobacterium
ADRL

SEQ ID NO: 416648 - protein, 7 aa, Mycobacterium
ADRLATG

SEQ ID NO: 416649 - protein, 5 aa, Mycobacterium
ADRLD

SEQ ID NO: 416650 - protein, 12 aa, Mycobacterium
ADRLGTVGGEAR

SEQ ID NO: 416651 - protein, 5 aa, Mycobacterium
ADRLP

SEQ ID NO: 416652 - protein, 12 aa, Mycobacterium
ADRNENETEELK

SEQ ID NO: 416653 - protein, 5 aa, Mycobacterium
ADRNG

SEQ ID NO: 416654 - protein, 10 aa, Mycobacterium
ADRNGADELR

SEQ ID NO: 416655 - protein, 10 aa, Mycobacterium
ADRNNDAVAG

SEQ ID NO: 416656 - protein, 8 aa, Mycobacterium
ADRNPPVF

SEQ ID NO: 416657 - protein, 9 aa, Mycobacterium
ADRNRDPAS

SEQ ID NO: 416658 - protein, 6 aa, Mycobacterium
ADRNRW

SEQ ID NO: 416659 - protein, 15 aa, Mycobacterium
ADRNTGSGKVLIQLN

SEQ ID NO: 416660 - protein, 7 aa, Mycobacterium
ADRPADR

SEQ ID NO: 416661 - protein, 16 aa, Mycobacterium
ADRPAGWQPASGESIA

SEQ ID NO: 416662 - protein, 17 aa, Mycobacterium
ADRPAGYNAAPDDPSTM

SEQ ID NO: 416663 - protein, 7 aa, Mycobacterium
ADRPALA

SEQ ID NO: 416664 - protein, 8 aa, Mycobacterium
ADRPALGK

SEQ ID NO: 416665 - protein, 8 aa, Mycobacterium
ADRPALGQ

SEQ ID NO: 416666 - protein, 8 aa, Mycobacterium
ADRPANTS

SEQ ID NO: 416667 - protein, 6 aa, Mycobacterium
ADRPAV

SEQ ID NO: 416668 - protein, 9 aa, Mycobacterium
ADRPDAVNE

SEQ ID NO: 416669 - protein, 7 aa, Mycobacterium
ADRPDRD

SEQ ID NO: 416670 - protein, 14 aa, Mycobacterium
ADRPDSTGSSPFTE

SEQ ID NO: 416671 - protein, 7 aa, Mycobacterium
ADRPERV

SEQ ID NO: 416672 - protein, 8 aa, Mycobacterium
ADRPGARV

SEQ ID NO: 416673 - protein, 6 aa, Mycobacterium
ADRPGG

SEQ ID NO: 416674 - protein, 7 aa, Mycobacterium
ADRPGPE

SEQ ID NO: 416675 - protein, 5 aa, Mycobacterium
ADRPH

SEQ ID NO: 416676 - protein, 7 aa, Mycobacterium
ADRPHAA

SEQ ID NO: 416677 - protein, 7 aa, Mycobacterium
ADRPLAG

SEQ ID NO: 416678 - protein, 14 aa, Mycobacterium
ADRPLKREGTVEDV

SEQ ID NO: 416679 - protein, 5 aa, Mycobacterium
ADRPP

SEQ ID NO: 416680 - protein, 6 aa, Mycobacterium
ADRPPF

SEQ ID NO: 416681 - protein, 7 aa, Mycobacterium
ADRPQVD

SEQ ID NO: 416682 - protein, 5 aa, Mycobacterium
ADRPR

SEQ ID NO: 416683 - protein, 13 aa, Mycobacterium
ADRPRSTTDPELS

SEQ ID NO: 416684 - protein, 12 aa, Mycobacterium
ADRPYEAEALRP

SEQ ID NO: 416685 - protein, 6 aa, Mycobacterium
ADRPYS

SEQ ID NO: 416686 - protein, 5 aa, Mycobacterium
ADRQA

SEQ ID NO: 416687 - protein, 11 aa, Mycobacterium
ADRQAADPRLQ

SEQ ID NO: 416688 - protein, 11 aa, Mycobacterium
ADRQELPSEPI

SEQ ID NO: 416689 - protein, 5 aa, Mycobacterium
ADRQL

SEQ ID NO: 416690 - protein, 6 aa, Mycobacterium
ADRQPV

SEQ ID NO: 416691 - protein, 7 aa, Mycobacterium
ADRQQRR

SEQ ID NO: 416692 - protein, 5 aa, Mycobacterium
ADRQR

SEQ ID NO: 416693 - protein, 11 aa, Mycobacterium
ADRQRAPENPM

SEQ ID NO: 416694 - protein, 20 aa, Mycobacterium
ADRQSEKDRRLLDKSRYFDE

SEQ ID NO: 416695 - protein, 6 aa, Mycobacterium
ADRQSV

SEQ ID NO: 416696 - protein, 17 aa, Mycobacterium
ADRQTGQTPRNRRQEET

SEQ ID NO: 416697 - protein, 14 aa, Mycobacterium
ADRQVRPVAPGNTA

SEQ ID NO: 416698 - protein, 14 aa, Mycobacterium
ADRQVRPVTTGPTA

SEQ ID NO: 416699 - protein, 11 aa, Mycobacterium
ADRRANPTEDL

SEQ ID NO: 416700 - protein, 11 aa, Mycobacterium
ADRRAQGRREA

SEQ ID NO: 416701 - protein, 6 aa, Mycobacterium
ADRRDA

SEQ ID NO: 416702 - protein, 6 aa, Mycobacterium
ADRRDY

SEQ ID NO: 416703 - protein, 11 aa, Mycobacterium
ADRRENPTEDL

SEQ ID NO: 416704 - protein, 9 aa, Mycobacterium
ADRRGAGYR

SEQ ID NO: 416705 - protein, 14 aa, Mycobacterium
ADRRLRESAQAVGA

SEQ ID NO: 416706 - protein, 8 aa, Mycobacterium
ADRRLSTY

SEQ ID NO: 416707 - protein, 7 aa, Mycobacterium
ADRRNPD

SEQ ID NO: 416708 - protein, 16 aa, Mycobacterium
ADRRNRSRRVAPSDHQ

SEQ ID NO: 416709 - protein, 7 aa, Mycobacterium
ADRRNYS

SEQ ID NO: 416710 - protein, 5 aa, Mycobacterium
ADRRQ

SEQ ID NO: 416711 - protein, 21 aa, Mycobacterium
ADRRQRQHEEEKQRAERLVKA

SEQ ID NO: 416712 - protein, 16 aa, Mycobacterium
ADRRRLGAAGQGDPHQ

SEQ ID NO: 416713 - protein, 6 aa, Mycobacterium
ADRRRQ

SEQ ID NO: 416714 - protein, 8 aa, Mycobacterium
ADRRSRAT

SEQ ID NO: 416715 - protein, 5 aa, Mycobacterium
ADRRT

SEQ ID NO: 416716 - protein, 6 aa, Mycobacterium
ADRRTA

SEQ ID NO: 416717 - protein, 7 aa, Mycobacterium
ADRRTVR

SEQ ID NO: 416718 - protein, 8 aa, Mycobacterium
ADRSAAAR

SEQ ID NO: 416719 - protein, 12 aa, Mycobacterium
ADRSAMGGSYQQ

SEQ ID NO: 416720 - protein, 9 aa, Mycobacterium
ADRSARPVR

SEQ ID NO: 416721 - protein, 7 aa, Mycobacterium
ADRSELA

SEQ ID NO: 416722 - protein, 12 aa, Mycobacterium
ADRSEPGRPGVL

SEQ ID NO: 416723 - protein, 8 aa, Mycobacterium
ADRSESAR

SEQ ID NO: 416724 - protein, 8 aa, Mycobacterium
ADRSGAPT

SEQ ID NO: 416725 - protein, 10 aa, Mycobacterium
ADRSGHDVAT

SEQ ID NO: 416726 - protein, 7 aa, Mycobacterium
ADRSGPG

SEQ ID NO: 416727 - protein, 6 aa, Mycobacterium
ADRSGR

SEQ ID NO: 416728 - protein, 7 aa, Mycobacterium
ADRSGRI

SEQ ID NO: 416729 - protein, 16 aa, Mycobacterium
ADRSGRSRGPSIPGHE

SEQ ID NO: 416730 - protein, 7 aa, Mycobacterium
ADRSPHT

SEQ ID NO: 416731 - protein, 9 aa, Mycobacterium
ADRSQPGHW

SEQ ID NO: 416732 - protein, 5 aa, Mycobacterium
ADRSR

SEQ ID NO: 416733 - protein, 9 aa, Mycobacterium
ADRSRAGGG

SEQ ID NO: 416734 - protein, 40 aa, Mycobacterium
ADRSRRDEHRATQTARKEALATEAEDLAANSTQWKAAGDR

SEQ ID NO: 416735 - protein, 8 aa, Mycobacterium
ADRSRTMS

SEQ ID NO: 416736 - protein, 5 aa, Mycobacterium
ADRSS

SEQ ID NO: 416737 - protein, 16 aa, Mycobacterium
ADRSSLRALHASIKAG

SEQ ID NO: 416738 - protein, 16 aa, Mycobacterium
ADRSSLRQLHAAIRAA

SEQ ID NO: 416739 - protein, 16 aa, Mycobacterium
ADRSSLRSLHASIKAA

SEQ ID NO: 416740 - protein, 6 aa, Mycobacterium
ADRSTD

SEQ ID NO: 416741 - protein, 16 aa, Mycobacterium
ADRSTLRELHAAIRAA

SEQ ID NO: 416742 - protein, 8 aa, Mycobacterium
ADRSTSAI

SEQ ID NO: 416743 - protein, 7 aa, Mycobacterium
ADRSTTV

SEQ ID NO: 416744 - protein, 5 aa, Mycobacterium
ADRSW

SEQ ID NO: 416745 - protein, 4 aa, Mycobacterium
ADRT

SEQ ID NO: 416746 - protein, 5 aa, Mycobacterium
ADRTA

SEQ ID NO: 416747 - protein, 6 aa, Mycobacterium
ADRTAG

SEQ ID NO: 416748 - protein, 7 aa, Mycobacterium
ADRTAGA

SEQ ID NO: 416749 - protein, 9 aa, Mycobacterium
ADRTAGAHP

SEQ ID NO: 416750 - protein, 18 aa, Mycobacterium
ADRTAPRPDVRSSGRSIG

SEQ ID NO: 416751 - protein, 6 aa, Mycobacterium
ADRTDE

SEQ ID NO: 416752 - protein, 18 aa, Mycobacterium
ADRTEPRPDARASGRSIG

SEQ ID NO: 416753 - protein, 8 aa, Mycobacterium
ADRTGELV

SEQ ID NO: 416754 - protein, 9 aa, Mycobacterium
ADRTGPSAI

SEQ ID NO: 416755 - protein, 9 aa, Mycobacterium
ADRTGPSAL

SEQ ID NO: 416756 - protein, 5 aa, Mycobacterium
ADRTK

SEQ ID NO: 416757 - protein, 40 aa, Mycobacterium
ADRTKRDEHRAAQTSRKEALAAEAEELAANSTQWKAAGDR

SEQ ID NO: 416758 - protein, 13 aa, Mycobacterium
ADRTMAAEDPDAV

SEQ ID NO: 416759 - protein, 9 aa, Mycobacterium
ADRTNPESL

SEQ ID NO: 416760 - protein, 7 aa, Mycobacterium
ADRTPDE

SEQ ID NO: 416761 - protein, 7 aa, Mycobacterium
ADRTPEA

SEQ ID NO: 416762 - protein, 13 aa, Mycobacterium
ADRTPVVGADPGV

SEQ ID NO: 416763 - protein, 5 aa, Mycobacterium
ADRTR

SEQ ID NO: 416764 - protein, 9 aa, Mycobacterium
ADRTRAGGG

SEQ ID NO: 416765 - protein, 13 aa, Mycobacterium
ADRTRTYAQSAQR

SEQ ID NO: 416766 - protein, 7 aa, Mycobacterium
ADRTSQP

SEQ ID NO: 416767 - protein, 5 aa, Mycobacterium
ADRTY

SEQ ID NO: 416768 - protein, 5 aa, Mycobacterium
ADRVG

SEQ ID NO: 416769 - protein, 9 aa, Mycobacterium
ADRVGAEQT

SEQ ID NO: 416770 - protein, 7 aa, Mycobacterium
ADRVGEP

SEQ ID NO: 416771 - protein, 6 aa, Mycobacterium
ADRVGR

SEQ ID NO: 416772 - protein, 8 aa, Mycobacterium
ADRVPAPN

SEQ ID NO: 416773 - protein, 15 aa, Mycobacterium
ADRVQATQDELGDGS

SEQ ID NO: 416774 - protein, 25 aa, Mycobacterium
ADRVRSTEGATPKARGNRLPRDERR

SEQ ID NO: 416775 - protein, 13 aa, Mycobacterium
ADRVSDPKERVTE

SEQ ID NO: 416776 - protein, 7 aa, Mycobacterium
ADRVSGQ

SEQ ID NO: 416777 - protein, 8 aa, Mycobacterium
ADRVTPTT

SEQ ID NO: 416778 - protein, 6 aa, Mycobacterium
ADRVTQ

SEQ ID NO: 416779 - protein, 14 aa, Mycobacterium
ADRYGPPHRAAQQN

SEQ ID NO: 416780 - protein, 7 aa, Mycobacterium
ADRYPEA

SEQ ID NO: 416781 - protein, 10 aa, Mycobacterium
ADRYPPGAGE

SEQ ID NO: 416782 - protein, 7 aa, Mycobacterium
ADRYTGA

SEQ ID NO: 416783 - protein, 7 aa, Mycobacterium
ADSAARL

SEQ ID NO: 416784 - protein, 8 aa, Mycobacterium
ADSAATAS

SEQ ID NO: 416785 - protein, 20 aa, Mycobacterium
ADSADADDFRSRVSDSENAS

SEQ ID NO: 416786 - protein, 10 aa, Mycobacterium
ADSADGREGV

SEQ ID NO: 416787 - protein, 8 aa, Mycobacterium
ADSADKNE

SEQ ID NO: 416788 - protein, 9 aa, Mycobacterium
ADSADPASQ

SEQ ID NO: 416789 - protein, 17 aa, Mycobacterium
ADSADTRAALAAGATGV

SEQ ID NO: 416790 - protein, 6 aa, Mycobacterium
ADSADV

SEQ ID NO: 416791 - protein, 13 aa, Mycobacterium
ADSAEATPRDAQG

SEQ ID NO: 416792 - protein, 9 aa, Mycobacterium
ADSAERELH

SEQ ID NO: 416793 - protein, 10 aa, Mycobacterium
ADSAGAEFPD

SEQ ID NO: 416794 - protein, 7 aa, Mycobacterium
ADSAGDG

SEQ ID NO: 416795 - protein, 6 aa, Mycobacterium
ADSAGR

SEQ ID NO: 416796 - protein, 8 aa, Mycobacterium
ADSAGTEF

SEQ ID NO: 416797 - protein, 8 aa, Mycobacterium
ADSAGVRQ

SEQ ID NO: 416798 - protein, 7 aa, Mycobacterium
ADSAGVT

SEQ ID NO: 416799 - protein, 8 aa, Mycobacterium
ADSALSAS

SEQ ID NO: 416800 - protein, 8 aa, Mycobacterium
ADSANEEL

SEQ ID NO: 416801 - protein, 14 aa, Mycobacterium
ADSAPDLPSPWPRE

SEQ ID NO: 416802 - protein, 16 aa, Mycobacterium
ADSAPKAFDSNEDWTQ

SEQ ID NO: 416803 - protein, 11 aa, Mycobacterium
ADSAPSARDLR

SEQ ID NO: 416804 - protein, 16 aa, Mycobacterium
ADSAPTTRPLIIDRIS

SEQ ID NO: 416805 - protein, 7 aa, Mycobacterium
ADSARAR

SEQ ID NO: 416806 - protein, 5 aa, Mycobacterium
ADSAS

SEQ ID NO: 416807 - protein, 9 aa, Mycobacterium
ADSASGVDG

SEQ ID NO: 416808 - protein, 14 aa, Mycobacterium
ADSATARAELGADG

SEQ ID NO: 416809 - protein, 8 aa, Mycobacterium
ADSATGGR

SEQ ID NO: 416810 - protein, 8 aa, Mycobacterium
ADSATSGR

SEQ ID NO: 416811 - protein, 14 aa, Mycobacterium
ADSAVQKKGNDFAT

SEQ ID NO: 416812 - protein, 14 aa, Mycobacterium
ADSAVRKKGNDFAT

SEQ ID NO: 416813 - protein, 8 aa, Mycobacterium
ADSCEGNF

SEQ ID NO: 416814 - protein, 8 aa, Mycobacterium
ADSDAAPW

SEQ ID NO: 416815 - protein, 8 aa, Mycobacterium
ADSDAVDD

SEQ ID NO: 416816 - protein, 11 aa, Mycobacterium
ADSDDDGERHR

SEQ ID NO: 416817 - protein, 9 aa, Mycobacterium
ADSDEEPIV

SEQ ID NO: 416818 - protein, 6 aa, Mycobacterium
ADSDER

SEQ ID NO: 416819 - protein, 9 aa, Mycobacterium
ADSDERGYD

SEQ ID NO: 416820 - protein, 9 aa, Mycobacterium
ADSDGLSGV

SEQ ID NO: 416821 - protein, 16 aa, Mycobacterium
ADSDGQSFSTFTTGTK

SEQ ID NO: 416822 - protein, 8 aa, Mycobacterium
ADSDHPGA

SEQ ID NO: 416823 - protein, 11 aa, Mycobacterium
ADSDPDPARDQ

SEQ ID NO: 416824 - protein, 11 aa, Mycobacterium
ADSDRSDGSFD

SEQ ID NO: 416825 - protein, 8 aa, Mycobacterium
ADSDSAAA

SEQ ID NO: 416826 - protein, 9 aa, Mycobacterium
ADSDSPLAG

SEQ ID NO: 416827 - protein, 6 aa, Mycobacterium
ADSDVK

SEQ ID NO: 416828 - protein, 4 aa, Mycobacterium
ADSE

SEQ ID NO: 416829 - protein, 8 aa, Mycobacterium
ADSEAAAR

SEQ ID NO: 416830 - protein, 9 aa, Mycobacterium
ADSEAEEQV

SEQ ID NO: 416831 - protein, 6 aa, Mycobacterium
ADSEAP

SEQ ID NO: 416832 - protein, 8 aa, Mycobacterium
ADSEARPE

SEQ ID NO: 416833 - protein, 8 aa, Mycobacterium
ADSEDAAD

SEQ ID NO: 416834 - protein, 6 aa, Mycobacterium
ADSEDI

SEQ ID NO: 416835 - protein, 5 aa, Mycobacterium
ADSEE

SEQ ID NO: 416836 - protein, 10 aa, Mycobacterium
ADSEGPSFGT

SEQ ID NO: 416837 - protein, 6 aa, Mycobacterium
ADSEGT

SEQ ID NO: 416838 - protein, 8 aa, Mycobacterium
ADSEKGSL

SEQ ID NO: 416839 - protein, 14 aa, Mycobacterium
ADSELHQASTQQEA

SEQ ID NO: 416840 - protein, 6 aa, Mycobacterium
ADSEPE

SEQ ID NO: 416841 - protein, 9 aa, Mycobacterium
ADSEPGVRS

SEQ ID NO: 416842 - protein, 7 aa, Mycobacterium
ADSEQNW

SEQ ID NO: 416843 - protein, 7 aa, Mycobacterium
ADSERGW

SEQ ID NO: 416844 - protein, 18 aa, Mycobacterium
ADSETFGPADESQSTCCA

SEQ ID NO: 416845 - protein, 22 aa, Mycobacterium
ADSETFSSETGGGRDGGGTTLE

SEQ ID NO: 416846 - protein, 8 aa, Mycobacterium
ADSFAGPS

SEQ ID NO: 416847 - protein, 5 aa, Mycobacterium
ADSFS

SEQ ID NO: 416848 - protein, 8 aa, Mycobacterium
ADSGADEA

SEQ ID NO: 416849 - protein, 7 aa, Mycobacterium
ADSGAGH

SEQ ID NO: 416850 - protein, 6 aa, Mycobacterium
ADSGAK

SEQ ID NO: 416851 - protein, 6 aa, Mycobacterium
ADSGAN

SEQ ID NO: 416852 - protein, 7 aa, Mycobacterium
ADSGARG

SEQ ID NO: 416853 - protein, 5 aa, Mycobacterium
ADSGC

SEQ ID NO: 416854 - protein, 8 aa, Mycobacterium
ADSGEGGT

SEQ ID NO: 416855 - protein, 7 aa, Mycobacterium
ADSGFDN

SEQ ID NO: 416856 - protein, 7 aa, Mycobacterium
ADSGGDG

SEQ ID NO: 416857 - protein, 6 aa, Mycobacterium
ADSGGS

SEQ ID NO: 416858 - protein, 5 aa, Mycobacterium
ADSGL

SEQ ID NO: 416859 - protein, 10 aa, Mycobacterium
ADSGLATDPL

SEQ ID NO: 416860 - protein, 7 aa, Mycobacterium
ADSGLSA

SEQ ID NO: 416861 - protein, 13 aa, Mycobacterium
ADSGNNRVMLWGR

SEQ ID NO: 416862 - protein, 9 aa, Mycobacterium
ADSGPDALE

SEQ ID NO: 416863 - protein, 13 aa, Mycobacterium
ADSGQLPEELRPD

SEQ ID NO: 416864 - protein, 5 aa, Mycobacterium
ADSGR

SEQ ID NO: 416865 - protein, 8 aa, Mycobacterium
ADSGRQRE

SEQ ID NO: 416866 - protein, 6 aa, Mycobacterium
ADSGRR

SEQ ID NO: 416867 - protein, 8 aa, Mycobacterium
ADSGSSAN

SEQ ID NO: 416868 - protein, 9 aa, Mycobacterium
ADSGSSANW

SEQ ID NO: 416869 - protein, 79 aa, Mycobacterium
ADSGSSGAALGGAGGAGASGGAQGGAGGNGGEGGYASAASANYAATATGGHGGVGGAGASGAVGLDGGTGGAGGNGGHG

SEQ ID NO: 416870 - protein, 5 aa, Mycobacterium
ADSGT

SEQ ID NO: 416871 - protein, 18 aa, Mycobacterium
ADSGTKKPAPDRSRFIDT

SEQ ID NO: 416872 - protein, 7 aa, Mycobacterium
ADSGTPI

SEQ ID NO: 416873 - protein, 9 aa, Mycobacterium
ADSGVDETF

SEQ ID NO: 416874 - protein, 5 aa, Mycobacterium
ADSGY

SEQ ID NO: 416875 - protein, 7 aa, Mycobacterium
ADSHEGQ

SEQ ID NO: 416876 - protein, 8 aa, Mycobacterium
ADSHSAAT

SEQ ID NO: 416877 - protein, 19 aa, Mycobacterium
ADSHSKANVGRSSAEATAQ

SEQ ID NO: 416878 - protein, 9 aa, Mycobacterium
ADSIEPGGE

SEQ ID NO: 416879 - protein, 38 aa, Mycobacterium
ADSISDSETKAEASTVAGKADDLAKVQEKYSAPVPDAQ

SEQ ID NO: 416880 - protein, 6 aa, Mycobacterium
ADSLAG

SEQ ID NO: 416881 - protein, 10 aa, Mycobacterium
ADSLATGPGV

SEQ ID NO: 416882 - protein, 8 aa, Mycobacterium
ADSLGGPT

SEQ ID NO: 416883 - protein, 13 aa, Mycobacterium
ADSLRKDSAEVSI

SEQ ID NO: 416884 - protein, 19 aa, Mycobacterium
ADSLRKDSAKVSIKDGPWG

SEQ ID NO: 416885 - protein, 19 aa, Mycobacterium
ADSLRKDSAQVSIKDGPWG

SEQ ID NO: 416886 - protein, 10 aa, Mycobacterium
ADSLTESGYP

SEQ ID NO: 416887 - protein, 7 aa, Mycobacterium
ADSLTTR

SEQ ID NO: 416888 - protein, 7 aa, Mycobacterium
ADSMGNS

SEQ ID NO: 416889 - protein, 7 aa, Mycobacterium
ADSMPTP

SEQ ID NO: 416890 - protein, 7 aa, Mycobacterium
ADSNERL

SEQ ID NO: 416891 - protein, 8 aa, Mycobacterium
ADSNIPPV

SEQ ID NO: 416892 - protein, 8 aa, Mycobacterium
ADSNLAPL

SEQ ID NO: 416893 - protein, 17 aa, Mycobacterium
ADSNMPATTVKNRKYGN

SEQ ID NO: 416894 - protein, 7 aa, Mycobacterium
ADSNVAQ

SEQ ID NO: 416895 - protein, 4 aa, Mycobacterium
ADSP

SEQ ID NO: 416896 - protein, 5 aa, Mycobacterium
ADSPA

SEQ ID NO: 416897 - protein, 8 aa, Mycobacterium
ADSPAAVD

SEQ ID NO: 416898 - protein, 10 aa, Mycobacterium
ADSPAGLTSA

SEQ ID NO: 416899 - protein, 7 aa, Mycobacterium
ADSPALN

SEQ ID NO: 416900 - protein, 6 aa, Mycobacterium
ADSPAV

SEQ ID NO: 416901 - protein, 7 aa, Mycobacterium
ADSPDAL

SEQ ID NO: 416902 - protein, 10 aa, Mycobacterium
ADSPDGNEGI

SEQ ID NO: 416903 - protein, 10 aa, Mycobacterium
ADSPDGPQVR

SEQ ID NO: 416904 - protein, 9 aa, Mycobacterium
ADSPDQTCG

SEQ ID NO: 416905 - protein, 11 aa, Mycobacterium
ADSPDVEGIPP

SEQ ID NO: 416906 - protein, 7 aa, Mycobacterium
ADSPETM

SEQ ID NO: 416907 - protein, 10 aa, Mycobacterium
ADSPEVEDIP

SEQ ID NO: 416908 - protein, 10 aa, Mycobacterium
ADSPFGRAPG

SEQ ID NO: 416909 - protein, 14 aa, Mycobacterium
ADSPGVTIAPREDT

SEQ ID NO: 416910 - protein, 16 aa, Mycobacterium
ADSPHARRGTTAPIVT

SEQ ID NO: 416911 - protein, 5 aa, Mycobacterium
ADSPI

SEQ ID NO: 416912 - protein, 8 aa, Mycobacterium
ADSPLSSQ

SEQ ID NO: 416913 - protein, 9 aa, Mycobacterium
ADSPNLEQA

SEQ ID NO: 416914 - protein, 9 aa, Mycobacterium
ADSPPLDLP

SEQ ID NO: 416915 - protein, 7 aa, Mycobacterium
ADSPQQL

SEQ ID NO: 416916 - protein, 7 aa, Mycobacterium
ADSPQSA

SEQ ID NO: 416917 - protein, 6 aa, Mycobacterium
ADSPRL

SEQ ID NO: 416918 - protein, 10 aa, Mycobacterium
ADSPSADELE

SEQ ID NO: 416919 - protein, 9 aa, Mycobacterium
ADSPSAVEE

SEQ ID NO: 416920 - protein, 9 aa, Mycobacterium
ADSPSGKAE

SEQ ID NO: 416921 - protein, 8 aa, Mycobacterium
ADSPSIDE

SEQ ID NO: 416922 - protein, 11 aa, Mycobacterium
ADSPSKDDEAF

SEQ ID NO: 416923 - protein, 7 aa, Mycobacterium
ADSPVSL

SEQ ID NO: 416924 - protein, 7 aa, Mycobacterium
ADSPVTR

SEQ ID NO: 416925 - protein, 7 aa, Mycobacterium
ADSPVVR

SEQ ID NO: 416926 - protein, 8 aa, Mycobacterium
ADSPYGRV

SEQ ID NO: 416927 - protein, 5 aa, Mycobacterium
ADSQE

SEQ ID NO: 416928 - protein, 8 aa, Mycobacterium
ADSQNFGG

SEQ ID NO: 416929 - protein, 10 aa, Mycobacterium
ADSQPTAEDI

SEQ ID NO: 416930 - protein, 12 aa, Mycobacterium
ADSRDAAEQAKA

SEQ ID NO: 416931 - protein, 6 aa, Mycobacterium
ADSRFD

SEQ ID NO: 416932 - protein, 5 aa, Mycobacterium
ADSRG

SEQ ID NO: 416933 - protein, 12 aa, Mycobacterium
ADSRPNDSADAA

SEQ ID NO: 416934 - protein, 8 aa, Mycobacterium
ADSRSARK

SEQ ID NO: 416935 - protein, 11 aa, Mycobacterium
ADSRTAVEASE

SEQ ID NO: 416936 - protein, 8 aa, Mycobacterium
ADSRTERL

SEQ ID NO: 416937 - protein, 9 aa, Mycobacterium
ADSRTPEEV

SEQ ID NO: 416938 - protein, 6 aa, Mycobacterium
ADSRTT

SEQ ID NO: 416939 - protein, 10 aa, Mycobacterium
ADSRVRTGEQ

SEQ ID NO: 416940 - protein, 12 aa, Mycobacterium
ADSRYEKAARVR

SEQ ID NO: 416941 - protein, 6 aa, Mycobacterium
ADSSAN

SEQ ID NO: 416942 - protein, 8 aa, Mycobacterium
ADSSAVGK

SEQ ID NO: 416943 - protein, 16 aa, Mycobacterium
ADSSDAGGEAPTPSRL

SEQ ID NO: 416944 - protein, 10 aa, Mycobacterium
ADSSGETEVD

SEQ ID NO: 416945 - protein, 22 aa, Mycobacterium
ADSSGGPTPPPIERTGAANGAH

SEQ ID NO: 416946 - protein, 6 aa, Mycobacterium
ADSSGL

SEQ ID NO: 416947 - protein, 8 aa, Mycobacterium
ADSSGREA

SEQ ID NO: 416948 - protein, 9 aa, Mycobacterium
ADSSPKQVE

SEQ ID NO: 416949 - protein, 7 aa, Mycobacterium
ADSSQSA

SEQ ID NO: 416950 - protein, 15 aa, Mycobacterium
ADSSRDGLGDGYSAD

SEQ ID NO: 416951 - protein, 8 aa, Mycobacterium
ADSSRRIG

SEQ ID NO: 416952 - protein, 6 aa, Mycobacterium
ADSSSP

SEQ ID NO: 416953 - protein, 5 aa, Mycobacterium
ADSSV

SEQ ID NO: 416954 - protein, 10 aa, Mycobacterium
ADSTADHGPP

SEQ ID NO: 416955 - protein, 7 aa, Mycobacterium
ADSTALE

SEQ ID NO: 416956 - protein, 6 aa, Mycobacterium
ADSTDH

SEQ ID NO: 416957 - protein, 10 aa, Mycobacterium
ADSTGNPTAR

SEQ ID NO: 416958 - protein, 7 aa, Mycobacterium
ADSTGRE

SEQ ID NO: 416959 - protein, 12 aa, Mycobacterium
ADSTLGSGWATG

SEQ ID NO: 416960 - protein, 8 aa, Mycobacterium
ADSTPMSA

SEQ ID NO: 416961 - protein, 12 aa, Mycobacterium
ADSTPPADWDRP

SEQ ID NO: 416962 - protein, 13 aa, Mycobacterium
ADSTPPADWDRPL

SEQ ID NO: 416963 - protein, 12 aa, Mycobacterium
ADSTPPADWERP

SEQ ID NO: 416964 - protein, 12 aa, Mycobacterium
ADSTPPGDWERP

SEQ ID NO: 416965 - protein, 8 aa, Mycobacterium
ADSTRQAV

SEQ ID NO: 416966 - protein, 10 aa, Mycobacterium
ADSTRQTKDS

SEQ ID NO: 416967 - protein, 6 aa, Mycobacterium
ADSTSA

SEQ ID NO: 416968 - protein, 7 aa, Mycobacterium
ADSTSRI

SEQ ID NO: 416969 - protein, 9 aa, Mycobacterium
ADSVDAADA

SEQ ID NO: 416970 - protein, 9 aa, Mycobacterium
ADSVNQTKD

SEQ ID NO: 416971 - protein, 8 aa, Mycobacterium
ADSVPATA

SEQ ID NO: 416972 - protein, 12 aa, Mycobacterium
ADSVPKPDDDHR

SEQ ID NO: 416973 - protein, 8 aa, Mycobacterium
ADSVQKQA

SEQ ID NO: 416974 - protein, 7 aa, Mycobacterium
ADSVQPA

SEQ ID NO: 416975 - protein, 8 aa, Mycobacterium
ADSVQPAK

SEQ ID NO: 416976 - protein, 6 aa, Mycobacterium
ADSVSQ

SEQ ID NO: 416977 - protein, 6 aa, Mycobacterium
ADSVTS

SEQ ID NO: 416978 - protein, 15 aa, Mycobacterium
ADSYALTEAANAVAA

SEQ ID NO: 416979 - protein, 15 aa, Mycobacterium
ADSYAVTEAANAAAA

SEQ ID NO: 416980 - protein, 8 aa, Mycobacterium
ADSYDDQG

SEQ ID NO: 416981 - protein, 5 aa, Mycobacterium
ADSYI

SEQ ID NO: 416982 - protein, 6 aa, Mycobacterium
ADTAAA

SEQ ID NO: 416983 - protein, 7 aa, Mycobacterium
ADTAAAK

SEQ ID NO: 416984 - protein, 7 aa, Mycobacterium
ADTAADD

SEQ ID NO: 416985 - protein, 6 aa, Mycobacterium
ADTAAR

SEQ ID NO: 416986 - protein, 27 aa, Mycobacterium
ADTADDAAAEVEGAADTADAAEDADKK

SEQ ID NO: 416987 - protein, 10 aa, Mycobacterium
ADTADEIEGN

SEQ ID NO: 416988 - protein, 6 aa, Mycobacterium
ADTADG

SEQ ID NO: 416989 - protein, 8 aa, Mycobacterium
ADTADGFT

SEQ ID NO: 416990 - protein, 10 aa, Mycobacterium
ADTADNIEGN

SEQ ID NO: 416991 - protein, 8 aa, Mycobacterium
ADTAENYP

SEQ ID NO: 416992 - protein, 6 aa, Mycobacterium
ADTAEP

SEQ ID NO: 416993 - protein, 21 aa, Mycobacterium
ADTAESYEYNQDLGEAAPMGI

SEQ ID NO: 416994 - protein, 22 aa, Mycobacterium
ADTAESYEYNQDLGEASPMGIP

SEQ ID NO: 416995 - protein, 9 aa, Mycobacterium
ADTAGDRAF

SEQ ID NO: 416996 - protein, 9 aa, Mycobacterium
ADTAGKPSL

SEQ ID NO: 416997 - protein, 7 aa, Mycobacterium
ADTAKEA

SEQ ID NO: 416998 - protein, 7 aa, Mycobacterium
ADTALGR

SEQ ID NO: 416999 - protein, 5 aa, Mycobacterium
ADTAN

SEQ ID NO: 417000 - protein, 5 aa, Mycobacterium
ADTAP

SEQ ID NO: 417001 - protein, 7 aa, Mycobacterium
ADTAPEP

SEQ ID NO: 417002 - protein, 10 aa, Mycobacterium
ADTAPEPGEH

SEQ ID NO: 417003 - protein, 10 aa, Mycobacterium
ADTAPESLTD

SEQ ID NO: 417004 - protein, 14 aa, Mycobacterium
ADTAPLSLAPPGDL

SEQ ID NO: 417005 - protein, 7 aa, Mycobacterium
ADTAQMD

SEQ ID NO: 417006 - protein, 8 aa, Mycobacterium
ADTARAEA

SEQ ID NO: 417007 - protein, 28 aa, Mycobacterium
ADTARTTGSGGTHGRAGAAGAGRAAGAA

SEQ ID NO: 417008 - protein, 6 aa, Mycobacterium
ADTASE

SEQ ID NO: 417009 - protein, 5 aa, Mycobacterium
ADTAT

SEQ ID NO: 417010 - protein, 6 aa, Mycobacterium
ADTATA

SEQ ID NO: 417011 - protein, 8 aa, Mycobacterium
ADTATAEE

SEQ ID NO: 417012 - protein, 25 aa, Mycobacterium
ADTATDTAALPYTSSSGQRDKPYRH

SEQ ID NO: 417013 - protein, 6 aa, Mycobacterium
ADTATG

SEQ ID NO: 417014 - protein, 6 aa, Mycobacterium
ADTATT

SEQ ID NO: 417015 - protein, 13 aa, Mycobacterium
ADTATVTAEERRA

SEQ ID NO: 417016 - protein, 8 aa, Mycobacterium
ADTATYSL

SEQ ID NO: 417017 - protein, 5 aa, Mycobacterium
ADTDA

SEQ ID NO: 417018 - protein, 6 aa, Mycobacterium
ADTDAD

SEQ ID NO: 417019 - protein, 5 aa, Mycobacterium
ADTDD

SEQ ID NO: 417020 - protein, 8 aa, Mycobacterium
ADTDEDVH

SEQ ID NO: 417021 - protein, 6 aa, Mycobacterium
ADTDEF

SEQ ID NO: 417022 - protein, 8 aa, Mycobacterium
ADTDEGRS

SEQ ID NO: 417023 - protein, 9 aa, Mycobacterium
ADTDEYPRD

SEQ ID NO: 417024 - protein, 14 aa, Mycobacterium
ADTDFDTDSDSRNV

SEQ ID NO: 417025 - protein, 5 aa, Mycobacterium
ADTDG

SEQ ID NO: 417026 - protein, 11 aa, Mycobacterium
ADTDGAGRPAI

SEQ ID NO: 417027 - protein, 12 aa, Mycobacterium
ADTDLPPQTSAE

SEQ ID NO: 417028 - protein, 9 aa, Mycobacterium
ADTDPATGI

SEQ ID NO: 417029 - protein, 23 aa, Mycobacterium
ADTDPSGFKTTEPPTEDVDGNTV

SEQ ID NO: 417030 - protein, 6 aa, Mycobacterium
ADTDRA

SEQ ID NO: 417031 - protein, 6 aa, Mycobacterium
ADTDRP

SEQ ID NO: 417032 - protein, 6 aa, Mycobacterium
ADTDTD

SEQ ID NO: 417033 - protein, 9 aa, Mycobacterium
ADTDTDADF

SEQ ID NO: 417034 - protein, 14 aa, Mycobacterium
ADTDVPDGFPTATA

SEQ ID NO: 417035 - protein, 5 aa, Mycobacterium
ADTDW

SEQ ID NO: 417036 - protein, 4 aa, Mycobacterium
ADTE

SEQ ID NO: 417037 - protein, 6 aa, Mycobacterium
ADTEAA

SEQ ID NO: 417038 - protein, 6 aa, Mycobacterium
ADTEAD

SEQ ID NO: 417039 - protein, 8 aa, Mycobacterium
ADTEAQAD

SEQ ID NO: 417040 - protein, 5 aa, Mycobacterium
ADTEE

SEQ ID NO: 417041 - protein, 6 aa, Mycobacterium
ADTEEE

SEQ ID NO: 417042 - protein, 11 aa, Mycobacterium
ADTEEQETQRA

SEQ ID NO: 417043 - protein, 10 aa, Mycobacterium
ADTEGKPSLA

SEQ ID NO: 417044 - protein, 7 aa, Mycobacterium
ADTEPAP

SEQ ID NO: 417045 - protein, 11 aa, Mycobacterium
ADTEQRRNAAL

SEQ ID NO: 417046 - protein, 5 aa, Mycobacterium
ADTER

SEQ ID NO: 417047 - protein, 8 aa, Mycobacterium
ADTERAAA

SEQ ID NO: 417048 - protein, 12 aa, Mycobacterium
ADTERTRALLTG

SEQ ID NO: 417049 - protein, 8 aa, Mycobacterium
ADTESSRR

SEQ ID NO: 417050 - protein, 16 aa, Mycobacterium
ADTETLNAARRQARAL

SEQ ID NO: 417051 - protein, 9 aa, Mycobacterium
ADTETPPGG

SEQ ID NO: 417052 - protein, 6 aa, Mycobacterium
ADTETQ

SEQ ID NO: 417053 - protein, 6 aa, Mycobacterium
ADTETR

SEQ ID NO: 417054 - protein, 6 aa, Mycobacterium
ADTEVS

SEQ ID NO: 417055 - protein, 8 aa, Mycobacterium
ADTFEGPS

SEQ ID NO: 417056 - protein, 8 aa, Mycobacterium
ADTFEGPT

SEQ ID NO: 417057 - protein, 5 aa, Mycobacterium
ADTFS

SEQ ID NO: 417058 - protein, 17 aa, Mycobacterium
ADTGAATATMSSATQRV

SEQ ID NO: 417059 - protein, 7 aa, Mycobacterium
ADTGAEV

SEQ ID NO: 417060 - protein, 7 aa, Mycobacterium
ADTGAIP

SEQ ID NO: 417061 - protein, 7 aa, Mycobacterium
ADTGDGD

SEQ ID NO: 417062 - protein, 7 aa, Mycobacterium
ADTGDRA

SEQ ID NO: 417063 - protein, 10 aa, Mycobacterium
ADTGDTPPAD

SEQ ID NO: 417064 - protein, 7 aa, Mycobacterium
ADTGDTY

SEQ ID NO: 417065 - protein, 5 aa, Mycobacterium
ADTGE

SEQ ID NO: 417066 - protein, 8 aa, Mycobacterium
ADTGEAAA

SEQ ID NO: 417067 - protein, 20 aa, Mycobacterium
ADTGERVRRTREAANLAKES

SEQ ID NO: 417068 - protein, 8 aa, Mycobacterium
ADTGETAE

SEQ ID NO: 417069 - protein, 5 aa, Mycobacterium
ADTGF

SEQ ID NO: 417070 - protein, 7 aa, Mycobacterium
ADTGLDA

SEQ ID NO: 417071 - protein, 35 aa, Mycobacterium
ADTGQDGAQGAGGDGGAGGNGGTPGDGGNGTNGFD

SEQ ID NO: 417072 - protein, 9 aa, Mycobacterium
ADTGRSPAD

SEQ ID NO: 417073 - protein, 6 aa, Mycobacterium
ADTGTS

SEQ ID NO: 417074 - protein, 7 aa, Mycobacterium
ADTGVFP

SEQ ID NO: 417075 - protein, 9 aa, Mycobacterium
ADTGVFPSD

SEQ ID NO: 417076 - protein, 5 aa, Mycobacterium
ADTGY

SEQ ID NO: 417077 - protein, 7 aa, Mycobacterium
ADTGYGA

SEQ ID NO: 417078 - protein, 10 aa, Mycobacterium
ADTGYGAPKN

SEQ ID NO: 417079 - protein, 20 aa, Mycobacterium
ADTHDYKLDPDRTTTPASKY

SEQ ID NO: 417080 - protein, 6 aa, Mycobacterium
ADTHED

SEQ ID NO: 417081 - protein, 7 aa, Mycobacterium
ADTHEDG

SEQ ID NO: 417082 - protein, 5 aa, Mycobacterium
ADTIG

SEQ ID NO: 417083 - protein, 6 aa, Mycobacterium
ADTIGA

SEQ ID NO: 417084 - protein, 10 aa, Mycobacterium
ADTIGEPDEY

SEQ ID NO: 417085 - protein, 5 aa, Mycobacterium
ADTIT

SEQ ID NO: 417086 - protein, 4 aa, Mycobacterium
ADTK

SEQ ID NO: 417087 - protein, 7 aa, Mycobacterium
ADTKARV

SEQ ID NO: 417088 - protein, 7 aa, Mycobacterium
ADTKLAD

SEQ ID NO: 417089 - protein, 6 aa, Mycobacterium
ADTKRL

SEQ ID NO: 417090 - protein, 7 aa, Mycobacterium
ADTKSRV

SEQ ID NO: 417091 - protein, 5 aa, Mycobacterium
ADTLG

SEQ ID NO: 417092 - protein, 6 aa, Mycobacterium
ADTLQP

SEQ ID NO: 417093 - protein, 14 aa, Mycobacterium
ADTLSGKSQQPGYV

SEQ ID NO: 417094 - protein, 7 aa, Mycobacterium
ADTLTDP

SEQ ID NO: 417095 - protein, 8 aa, Mycobacterium
ADTLTDPE

SEQ ID NO: 417096 - protein, 8 aa, Mycobacterium
ADTLTDPR

SEQ ID NO: 417097 - protein, 4 aa, Mycobacterium
ADTN

SEQ ID NO: 417098 - protein, 21 aa, Mycobacterium
ADTNGSPSQPLPTDPQWAGGS

SEQ ID NO: 417099 - protein, 6 aa, Mycobacterium
ADTNID

SEQ ID NO: 417100 - protein, 6 aa, Mycobacterium
ADTNSD

SEQ ID NO: 417101 - protein, 7 aa, Mycobacterium
ADTNTTA

SEQ ID NO: 417102 - protein, 5 aa, Mycobacterium
ADTPA

SEQ ID NO: 417103 - protein, 6 aa, Mycobacterium
ADTPAA

SEQ ID NO: 417104 - protein, 7 aa, Mycobacterium
ADTPAEL

SEQ ID NO: 417105 - protein, 9 aa, Mycobacterium
ADTPAESTE

SEQ ID NO: 417106 - protein, 22 aa, Mycobacterium
ADTPAGPNPGDVAEDLTGGPTF

SEQ ID NO: 417107 - protein, 7 aa, Mycobacterium
ADTPANI

SEQ ID NO: 417108 - protein, 9 aa, Mycobacterium
ADTPATIRS

SEQ ID NO: 417109 - protein, 7 aa, Mycobacterium
ADTPFPQ

SEQ ID NO: 417110 - protein, 5 aa, Mycobacterium
ADTPG

SEQ ID NO: 417111 - protein, 14 aa, Mycobacterium
ADTPGGAGKVVVTF

SEQ ID NO: 417112 - protein, 7 aa, Mycobacterium
ADTPGRL

SEQ ID NO: 417113 - protein, 7 aa, Mycobacterium
ADTPGVA

SEQ ID NO: 417114 - protein, 9 aa, Mycobacterium
ADTPGVATS

SEQ ID NO: 417115 - protein, 11 aa, Mycobacterium
ADTPHGRDPEI

SEQ ID NO: 417116 - protein, 7 aa, Mycobacterium
ADTPPDA

SEQ ID NO: 417117 - protein, 7 aa, Mycobacterium
ADTPPEL

SEQ ID NO: 417118 - protein, 8 aa, Mycobacterium
ADTPPELS

SEQ ID NO: 417119 - protein, 13 aa, Mycobacterium
ADTPPRSSGQGRA

SEQ ID NO: 417120 - protein, 31 aa, Mycobacterium
ADTPPVAGRSPYAQTKAYADRAARRLQDTGA

SEQ ID NO: 417121 - protein, 7 aa, Mycobacterium
ADTPQGQ

SEQ ID NO: 417122 - protein, 7 aa, Mycobacterium
ADTPRPS

SEQ ID NO: 417123 - protein, 8 aa, Mycobacterium
ADTPSEDL

SEQ ID NO: 417124 - protein, 8 aa, Mycobacterium
ADTPTGQA

SEQ ID NO: 417125 - protein, 18 aa, Mycobacterium
ADTPTPGPRQPQPKENSH

SEQ ID NO: 417126 - protein, 7 aa, Mycobacterium
ADTPTSL

SEQ ID NO: 417127 - protein, 7 aa, Mycobacterium
ADTPTTL

SEQ ID NO: 417128 - protein, 7 aa, Mycobacterium
ADTPVPA

SEQ ID NO: 417129 - protein, 9 aa, Mycobacterium
ADTPVRDGH

SEQ ID NO: 417130 - protein, 20 aa, Mycobacterium
ADTPVTPQANDADAENADAA

SEQ ID NO: 417131 - protein, 10 aa, Mycobacterium
ADTPWKSAGR

SEQ ID NO: 417132 - protein, 6 aa, Mycobacterium
ADTQGL

SEQ ID NO: 417133 - protein, 6 aa, Mycobacterium
ADTQGT

SEQ ID NO: 417134 - protein, 8 aa, Mycobacterium
ADTQQRRG

SEQ ID NO: 417135 - protein, 15 aa, Mycobacterium
ADTQVPPPNASPEDV

SEQ ID NO: 417136 - protein, 8 aa, Mycobacterium
ADTRASGK

SEQ ID NO: 417137 - protein, 12 aa, Mycobacterium
ADTRCDGRSRGQ

SEQ ID NO: 417138 - protein, 6 aa, Mycobacterium
ADTRDH

SEQ ID NO: 417139 - protein, 6 aa, Mycobacterium
ADTRDL

SEQ ID NO: 417140 - protein, 8 aa, Mycobacterium
ADTRDRGW

SEQ ID NO: 417141 - protein, 7 aa, Mycobacterium
ADTREEA

SEQ ID NO: 417142 - protein, 13 aa, Mycobacterium
ADTRGDIEGPQGV

SEQ ID NO: 417143 - protein, 8 aa, Mycobacterium
ADTRGGDL

SEQ ID NO: 417144 - protein, 6 aa, Mycobacterium
ADTRPN

SEQ ID NO: 417145 - protein, 16 aa, Mycobacterium
ADTRRPAVAGADRHPG

SEQ ID NO: 417146 - protein, 6 aa, Mycobacterium
ADTRRT

SEQ ID NO: 417147 - protein, 8 aa, Mycobacterium
ADTSAPAL

SEQ ID NO: 417148 - protein, 12 aa, Mycobacterium
ADTSDAADPAQL

SEQ ID NO: 417149 - protein, 12 aa, Mycobacterium
ADTSETADADSG

SEQ ID NO: 417150 - protein, 9 aa, Mycobacterium
ADTSGDGDT

SEQ ID NO: 417151 - protein, 11 aa, Mycobacterium
ADTSGQRTASV

SEQ ID NO: 417152 - protein, 8 aa, Mycobacterium
ADTSGVAV

SEQ ID NO: 417153 - protein, 5 aa, Mycobacterium
ADTSI

SEQ ID NO: 417154 - protein, 5 aa, Mycobacterium
ADTSM

SEQ ID NO: 417155 - protein, 6 aa, Mycobacterium
ADTSPS

SEQ ID NO: 417156 - protein, 9 aa, Mycobacterium
ADTSRGTVG

SEQ ID NO: 417157 - protein, 12 aa, Mycobacterium
ADTSRVPVTGDL

SEQ ID NO: 417158 - protein, 18 aa, Mycobacterium
ADTSSAAAEITRATREHN

SEQ ID NO: 417159 - protein, 5 aa, Mycobacterium
ADTSV

SEQ ID NO: 417160 - protein, 4 aa, Mycobacterium
ADTT

SEQ ID NO: 417161 - protein, 7 aa, Mycobacterium
ADTTDYR

SEQ ID NO: 417162 - protein, 8 aa, Mycobacterium
ADTTGDLD

SEQ ID NO: 417163 - protein, 7 aa, Mycobacterium
ADTTGRR

SEQ ID NO: 417164 - protein, 8 aa, Mycobacterium
ADTTKALG

SEQ ID NO: 417165 - protein, 7 aa, Mycobacterium
ADTTKPY

SEQ ID NO: 417166 - protein, 5 aa, Mycobacterium
ADTTN

SEQ ID NO: 417167 - protein, 9 aa, Mycobacterium
ADTTPEDLP

SEQ ID NO: 417168 - protein, 22 aa, Mycobacterium
ADTTPKGAFAPVGGERKNDPDW

SEQ ID NO: 417169 - protein, 5 aa, Mycobacterium
ADTTR

SEQ ID NO: 417170 - protein, 9 aa, Mycobacterium
ADTTRGSVG

SEQ ID NO: 417171 - protein, 5 aa, Mycobacterium
ADTTS

SEQ ID NO: 417172 - protein, 12 aa, Mycobacterium
ADTTTTAVTALI

SEQ ID NO: 417173 - protein, 5 aa, Mycobacterium
ADTTV

SEQ ID NO: 417174 - protein, 8 aa, Mycobacterium
ADTTVTVD

SEQ ID NO: 417175 - protein, 7 aa, Mycobacterium
ADTVADA

SEQ ID NO: 417176 - protein, 11 aa, Mycobacterium
ADTVERARETV

SEQ ID NO: 417177 - protein, 5 aa, Mycobacterium
ADTVG

SEQ ID NO: 417178 - protein, 8 aa, Mycobacterium
ADTVGATA

SEQ ID NO: 417179 - protein, 8 aa, Mycobacterium
ADTVGEPD

SEQ ID NO: 417180 - protein, 10 aa, Mycobacterium
ADTVNGRAHG

SEQ ID NO: 417181 - protein, 8 aa, Mycobacterium
ADTVPQRT

SEQ ID NO: 417182 - protein, 13 aa, Mycobacterium
ADTVRGKVGDSLR

SEQ ID NO: 417183 - protein, 8 aa, Mycobacterium
ADTWTPPE

SEQ ID NO: 417184 - protein, 4 aa, Mycobacterium
ADTY

SEQ ID NO: 417185 - protein, 8 aa, Mycobacterium
ADTYADDI

SEQ ID NO: 417186 - protein, 6 aa, Mycobacterium
ADTYSQ

SEQ ID NO: 417187 - protein, 19 aa, Mycobacterium
ADVAAADAARAAAESDDQQ

SEQ ID NO: 417188 - protein, 10 aa, Mycobacterium
ADVADPDQLG

SEQ ID NO: 417189 - protein, 5 aa, Mycobacterium
ADVAE

SEQ ID NO: 417190 - protein, 5 aa, Mycobacterium
ADVAG

SEQ ID NO: 417191 - protein, 11 aa, Mycobacterium
ADVAGDPASGL

SEQ ID NO: 417192 - protein, 10 aa, Mycobacterium
ADVAGGANPV

SEQ ID NO: 417193 - protein, 5 aa, Mycobacterium
ADVAP

SEQ ID NO: 417194 - protein, 6 aa, Mycobacterium
ADVAPE

SEQ ID NO: 417195 - protein, 6 aa, Mycobacterium
ADVAPS

SEQ ID NO: 417196 - protein, 6 aa, Mycobacterium
ADVARE

SEQ ID NO: 417197 - protein, 12 aa, Mycobacterium
ADVARSGVEPDR

SEQ ID NO: 417198 - protein, 9 aa, Mycobacterium
ADVASRPDE

SEQ ID NO: 417199 - protein, 27 aa, Mycobacterium
ADVDAAAKAVEASGGGIVKGPYDDAHE

SEQ ID NO: 417200 - protein, 14 aa, Mycobacterium
ADVDADDNEPNAAD

SEQ ID NO: 417201 - protein, 5 aa, Mycobacterium
ADVDD

SEQ ID NO: 417202 - protein, 10 aa, Mycobacterium
ADVDDARAHA

SEQ ID NO: 417203 - protein, 9 aa, Mycobacterium
ADVDDHESG

SEQ ID NO: 417204 - protein, 5 aa, Mycobacterium
ADVDE

SEQ ID NO: 417205 - protein, 35 aa, Mycobacterium
ADVDEALDGHPRIGERPDNAASRREQSGVTGADTE

SEQ ID NO: 417206 - protein, 12 aa, Mycobacterium
ADVDENARFPQE

SEQ ID NO: 417207 - protein, 12 aa, Mycobacterium
ADVDENSRFPEE

SEQ ID NO: 417208 - protein, 16 aa, Mycobacterium
ADVDGITDAEERITEL

SEQ ID NO: 417209 - protein, 16 aa, Mycobacterium
ADVDGVTDAEDRVSEL

SEQ ID NO: 417210 - protein, 7 aa, Mycobacterium
ADVDPAD

SEQ ID NO: 417211 - protein, 9 aa, Mycobacterium
ADVDPDGFR

SEQ ID NO: 417212 - protein, 7 aa, Mycobacterium
ADVDPGR

SEQ ID NO: 417213 - protein, 19 aa, Mycobacterium
ADVDQEPRTEAADGYTGTA

SEQ ID NO: 417214 - protein, 8 aa, Mycobacterium
ADVDRPDG

SEQ ID NO: 417215 - protein, 12 aa, Mycobacterium
ADVDSSKAKREL

SEQ ID NO: 417216 - protein, 16 aa, Mycobacterium
ADVEGHTDAEDRAAEL

SEQ ID NO: 417217 - protein, 16 aa, Mycobacterium
ADVEGVTDAEDRVSEL

SEQ ID NO: 417218 - protein, 16 aa, Mycobacterium
ADVEGVTDAEERITEL

SEQ ID NO: 417219 - protein, 6 aa, Mycobacterium
ADVEPR

SEQ ID NO: 417220 - protein, 10 aa, Mycobacterium
ADVESAGGKA

SEQ ID NO: 417221 - protein, 7 aa, Mycobacterium
ADVGAAD

SEQ ID NO: 417222 - protein, 12 aa, Mycobacterium
ADVGAKPVGATV

SEQ ID NO: 417223 - protein, 8 aa, Mycobacterium
ADVGAPAA

SEQ ID NO: 417224 - protein, 9 aa, Mycobacterium
ADVGAPPQV

SEQ ID NO: 417225 - protein, 12 aa, Mycobacterium
ADVGDTTSPIGA

SEQ ID NO: 417226 - protein, 11 aa, Mycobacterium
ADVGERRGDPD

SEQ ID NO: 417227 - protein, 5 aa, Mycobacterium
ADVGG

SEQ ID NO: 417228 - protein, 15 aa, Mycobacterium
ADVGPRRALSGQPVG

SEQ ID NO: 417229 - protein, 5 aa, Mycobacterium
ADVGR

SEQ ID NO: 417230 - protein, 11 aa, Mycobacterium
ADVGSGAGLPG

SEQ ID NO: 417231 - protein, 6 aa, Mycobacterium
ADVGSR

SEQ ID NO: 417232 - protein, 7 aa, Mycobacterium
ADVKPEG

SEQ ID NO: 417233 - protein, 5 aa, Mycobacterium
ADVNA

SEQ ID NO: 417234 - protein, 14 aa, Mycobacterium
ADVNAKNTKGETPL

SEQ ID NO: 417235 - protein, 7 aa, Mycobacterium
ADVNPDS

SEQ ID NO: 417236 - protein, 15 aa, Mycobacterium
ADVNRANDKGQTPLA

SEQ ID NO: 417237 - protein, 7 aa, Mycobacterium
ADVPDPE

SEQ ID NO: 417238 - protein, 6 aa, Mycobacterium
ADVPDS

SEQ ID NO: 417239 - protein, 11 aa, Mycobacterium
ADVPEDQLRDA

SEQ ID NO: 417240 - protein, 5 aa, Mycobacterium
ADVPG

SEQ ID NO: 417241 - protein, 7 aa, Mycobacterium
ADVPGSG

SEQ ID NO: 417242 - protein, 8 aa, Mycobacterium
ADVPGYEP

SEQ ID NO: 417243 - protein, 8 aa, Mycobacterium
ADVPPEAI

SEQ ID NO: 417244 - protein, 8 aa, Mycobacterium
ADVPPGSE

SEQ ID NO: 417245 - protein, 7 aa, Mycobacterium
ADVPRGA

SEQ ID NO: 417246 - protein, 5 aa, Mycobacterium
ADVPS

SEQ ID NO: 417247 - protein, 7 aa, Mycobacterium
ADVPVGS

SEQ ID NO: 417248 - protein, 8 aa, Mycobacterium
ADVPVGST

SEQ ID NO: 417249 - protein, 6 aa, Mycobacterium
ADVQGE

SEQ ID NO: 417250 - protein, 9 aa, Mycobacterium
ADVQTEEPV

SEQ ID NO: 417251 - protein, 13 aa, Mycobacterium
ADVRADAAQALDA

SEQ ID NO: 417252 - protein, 16 aa, Mycobacterium
ADVRADAAQALEADSG

SEQ ID NO: 417253 - protein, 9 aa, Mycobacterium
ADVRAGRPF

SEQ ID NO: 417254 - protein, 8 aa, Mycobacterium
ADVRDAAQ

SEQ ID NO: 417255 - protein, 9 aa, Mycobacterium
ADVRDGPAL

SEQ ID NO: 417256 - protein, 7 aa, Mycobacterium
ADVRDKA

SEQ ID NO: 417257 - protein, 7 aa, Mycobacterium
ADVRDRE

SEQ ID NO: 417258 - protein, 7 aa, Mycobacterium
ADVRDSA

SEQ ID NO: 417259 - protein, 21 aa, Mycobacterium
ADVREQYSRVKRDADAGADGD

SEQ ID NO: 417260 - protein, 12 aa, Mycobacterium
ADVRGQATTTAR

SEQ ID NO: 417261 - protein, 7 aa, Mycobacterium
ADVRKDG

SEQ ID NO: 417262 - protein, 8 aa, Mycobacterium
ADVRNGAA

SEQ ID NO: 417263 - protein, 13 aa, Mycobacterium
ADVRNGRRPRGEA

SEQ ID NO: 417264 - protein, 7 aa, Mycobacterium
ADVRPGD

SEQ ID NO: 417265 - protein, 8 aa, Mycobacterium
ADVRPGDD

SEQ ID NO: 417266 - protein, 6 aa, Mycobacterium
ADVRQP

SEQ ID NO: 417267 - protein, 6 aa, Mycobacterium
ADVRRA

SEQ ID NO: 417268 - protein, 20 aa, Mycobacterium
ADVRRAASTGARATRAPELE

SEQ ID NO: 417269 - protein, 20 aa, Mycobacterium
ADVRSAGDGTAAPAGDLGDE

SEQ ID NO: 417270 - protein, 6 aa, Mycobacterium
ADVRSG

SEQ ID NO: 417271 - protein, 7 aa, Mycobacterium
ADVRSGN

SEQ ID NO: 417272 - protein, 9 aa, Mycobacterium
ADVSDKDDC

SEQ ID NO: 417273 - protein, 12 aa, Mycobacterium
ADVSGTGSPLSA

SEQ ID NO: 417274 - protein, 6 aa, Mycobacterium
ADVSPR

SEQ ID NO: 417275 - protein, 6 aa, Mycobacterium
ADVSPS

SEQ ID NO: 417276 - protein, 5 aa, Mycobacterium
ADVSR

SEQ ID NO: 417277 - protein, 21 aa, Mycobacterium
ADVSSGPVSPQRSDGSAMKRA

SEQ ID NO: 417278 - protein, 9 aa, Mycobacterium
ADVSTADGV

SEQ ID NO: 417279 - protein, 5 aa, Mycobacterium
ADVTA

SEQ ID NO: 417280 - protein, 33 aa, Mycobacterium
ADVTADDVARARETVRPSLDPAQVESLRQFADT

SEQ ID NO: 417281 - protein, 10 aa, Mycobacterium
ADVTDEAAVT

SEQ ID NO: 417282 - protein, 9 aa, Mycobacterium
ADVTDEDAV

SEQ ID NO: 417283 - protein, 6 aa, Mycobacterium
ADVTDH

SEQ ID NO: 417284 - protein, 18 aa, Mycobacterium
ADVTGDQRAAPVGEEPVN

SEQ ID NO: 417285 - protein, 6 aa, Mycobacterium
ADVTGG

SEQ ID NO: 417286 - protein, 7 aa, Mycobacterium
ADVTGGV

SEQ ID NO: 417287 - protein, 86 aa, Mycobacterium
ADVTGSIGEKFSGGPKRREPRGERAEGEKPKRTRTRRRTRAGQPTDESAAEAPAPEAATADGDQQAPARRRRRRRRPNATAATTAS

SEQ ID NO: 417288 - protein, 11 aa, Mycobacterium
ADVTPEDPAVS

SEQ ID NO: 417289 - protein, 7 aa, Mycobacterium
ADVTPGS

SEQ ID NO: 417290 - protein, 9 aa, Mycobacterium
ADVTPGTRI

SEQ ID NO: 417291 - protein, 6 aa, Mycobacterium
ADVTST

SEQ ID NO: 417292 - protein, 4 aa, Mycobacterium
ADVY

SEQ ID NO: 417293 - protein, 10 aa, Mycobacterium
ADVYRSGKSL

SEQ ID NO: 417294 - protein, 28 aa, Mycobacterium
ADWDPAGAADDDLSGIGADAKPPAIDPT

SEQ ID NO: 417295 - protein, 9 aa, Mycobacterium
ADWDSATDT

SEQ ID NO: 417296 - protein, 9 aa, Mycobacterium
ADWDSSTDT

SEQ ID NO: 417297 - protein, 4 aa, Mycobacterium
ADWG

SEQ ID NO: 417298 - protein, 5 aa, Mycobacterium
ADWGQ

SEQ ID NO: 417299 - protein, 14 aa, Mycobacterium
ADWGRSDPLKTVKT

SEQ ID NO: 417300 - protein, 4 aa, Mycobacterium
ADWP

SEQ ID NO: 417301 - protein, 8 aa, Mycobacterium
ADWPGRSI

SEQ ID NO: 417302 - protein, 5 aa, Mycobacterium
ADWQE

SEQ ID NO: 417303 - protein, 4 aa, Mycobacterium
ADWS

SEQ ID NO: 417304 - protein, 10 aa, Mycobacterium
ADYAEAAQEV

SEQ ID NO: 417305 - protein, 7 aa, Mycobacterium
ADYAGTG

SEQ ID NO: 417306 - protein, 5 aa, Mycobacterium
ADYAK

SEQ ID NO: 417307 - protein, 5 aa, Mycobacterium
ADYAR

SEQ ID NO: 417308 - protein, 6 aa, Mycobacterium
ADYARQ

SEQ ID NO: 417309 - protein, 6 aa, Mycobacterium
ADYARR

SEQ ID NO: 417310 - protein, 7 aa, Mycobacterium
ADYASGF

SEQ ID NO: 417311 - protein, 5 aa, Mycobacterium
ADYDD

SEQ ID NO: 417312 - protein, 9 aa, Mycobacterium
ADYEAADAA

SEQ ID NO: 417313 - protein, 8 aa, Mycobacterium
ADYEAANA

SEQ ID NO: 417314 - protein, 6 aa, Mycobacterium
ADYEEQ

SEQ ID NO: 417315 - protein, 14 aa, Mycobacterium
ADYERAGATIGDPW

SEQ ID NO: 417316 - protein, 8 aa, Mycobacterium
ADYETNTY

SEQ ID NO: 417317 - protein, 6 aa, Mycobacterium
ADYETY

SEQ ID NO: 417318 - protein, 7 aa, Mycobacterium
ADYGERG

SEQ ID NO: 417319 - protein, 19 aa, Mycobacterium
ADYGRNAPPAFESGRDGAS

SEQ ID NO: 417320 - protein, 5 aa, Mycobacterium
ADYGS

SEQ ID NO: 417321 - protein, 9 aa, Mycobacterium
ADYGSEHND

SEQ ID NO: 417322 - protein, 8 aa, Mycobacterium
ADYGSGPL

SEQ ID NO: 417323 - protein, 4 aa, Mycobacterium
ADYN

SEQ ID NO: 417324 - protein, 6 aa, Mycobacterium
ADYPAA

SEQ ID NO: 417325 - protein, 8 aa, Mycobacterium
ADYPELDQ

SEQ ID NO: 417326 - protein, 8 aa, Mycobacterium
ADYPEQRR

SEQ ID NO: 417327 - protein, 6 aa, Mycobacterium
ADYPET

SEQ ID NO: 417328 - protein, 5 aa, Mycobacterium
ADYPL

SEQ ID NO: 417329 - protein, 13 aa, Mycobacterium
ADYPRPVELPSGE

SEQ ID NO: 417330 - protein, 10 aa, Mycobacterium
ADYPYTPDGS

SEQ ID NO: 417331 - protein, 11 aa, Mycobacterium
ADYPYTPDGSR

SEQ ID NO: 417332 - protein, 4 aa, Mycobacterium
ADYQ

SEQ ID NO: 417333 - protein, 11 aa, Mycobacterium
ADYQRAADAGI

SEQ ID NO: 417334 - protein, 6 aa, Mycobacterium
ADYQSL

SEQ ID NO: 417335 - protein, 4 aa, Mycobacterium
ADYR

SEQ ID NO: 417336 - protein, 8 aa, Mycobacterium
ADYRAEGA

SEQ ID NO: 417337 - protein, 18 aa, Mycobacterium
ADYRDAAQGFANGSPEGV

SEQ ID NO: 417338 - protein, 9 aa, Mycobacterium
ADYRRAADE

SEQ ID NO: 417339 - protein, 11 aa, Mycobacterium
ADYRRAEAGGI

SEQ ID NO: 417340 - protein, 7 aa, Mycobacterium
ADYSDPL

SEQ ID NO: 417341 - protein, 14 aa, Mycobacterium
ADYTATLADSPAEL

SEQ ID NO: 417342 - protein, 7 aa, Mycobacterium
ADYTGSG

SEQ ID NO: 417343 - protein, 6 aa, Mycobacterium
ADYTQV

SEQ ID NO: 417344 - protein, 6 aa, Mycobacterium
ADYTQY

SEQ ID NO: 417345 - protein, 7 aa, Mycobacterium
ADYTSRG

SEQ ID NO: 417346 - protein, 15 aa, Mycobacterium
AEAAAAALDAFESRV

SEQ ID NO: 417347 - protein, 11 aa, Mycobacterium
AEAAAATGEKR

SEQ ID NO: 417348 - protein, 9 aa, Mycobacterium
AEAAAKQAE

SEQ ID NO: 417349 - protein, 6 aa, Mycobacterium
AEAAAR

SEQ ID NO: 417350 - protein, 8 aa, Mycobacterium
AEAAASHN

SEQ ID NO: 417351 - protein, 9 aa, Mycobacterium
AEAAASHNR

SEQ ID NO: 417352 - protein, 9 aa, Mycobacterium
AEAAATAGL

SEQ ID NO: 417353 - protein, 19 aa, Mycobacterium
AEAAATARAEADDAKARRY

SEQ ID NO: 417354 - protein, 5 aa, Mycobacterium
AEAAD

SEQ ID NO: 417355 - protein, 9 aa, Mycobacterium
AEAADDRYG

SEQ ID NO: 417356 - protein, 11 aa, Mycobacterium
AEAADNLSAQA

SEQ ID NO: 417357 - protein, 14 aa, Mycobacterium
AEAADNLSDPAYQA

SEQ ID NO: 417358 - protein, 17 aa, Mycobacterium
AEAADPATDMPESATQG

SEQ ID NO: 417359 - protein, 9 aa, Mycobacterium
AEAADRRRT

SEQ ID NO: 417360 - protein, 7 aa, Mycobacterium
AEAADSV

SEQ ID NO: 417361 - protein, 5 aa, Mycobacterium
AEAAE

SEQ ID NO: 417362 - protein, 8 aa, Mycobacterium
AEAAEGVA

SEQ ID NO: 417363 - protein, 12 aa, Mycobacterium
AEAAEGVPADTD

SEQ ID NO: 417364 - protein, 12 aa, Mycobacterium
AEAAEHVSGGAR

SEQ ID NO: 417365 - protein, 10 aa, Mycobacterium
AEAAEKTAKQ

SEQ ID NO: 417366 - protein, 9 aa, Mycobacterium
AEAAENYDR

SEQ ID NO: 417367 - protein, 8 aa, Mycobacterium
AEAAERGL

SEQ ID NO: 417368 - protein, 7 aa, Mycobacterium
AEAAERQ

SEQ ID NO: 417369 - protein, 7 aa, Mycobacterium
AEAAESV

SEQ ID NO: 417370 - protein, 9 aa, Mycobacterium
AEAAGAAAL

SEQ ID NO: 417371 - protein, 9 aa, Mycobacterium
AEAAGAPDG

SEQ ID NO: 417372 - protein, 31 aa, Mycobacterium
AEAAGHAEQSSGNGGAREEKSAGGSLASDAQ

SEQ ID NO: 417373 - protein, 32 aa, Mycobacterium
AEAAGHGGGEQPSGSQASTEKAAGGSLASDAQ

SEQ ID NO: 417374 - protein, 11 aa, Mycobacterium
AEAAGRDPANI

SEQ ID NO: 417375 - protein, 8 aa, Mycobacterium
AEAAGSNR

SEQ ID NO: 417376 - protein, 6 aa, Mycobacterium
AEAAGV

SEQ ID NO: 417377 - protein, 7 aa, Mycobacterium
AEAAGVS

SEQ ID NO: 417378 - protein, 6 aa, Mycobacterium
AEAAGY

SEQ ID NO: 417379 - protein, 8 aa, Mycobacterium
AEAAGYDG

SEQ ID NO: 417380 - protein, 8 aa, Mycobacterium
AEAAGYSS

SEQ ID NO: 417381 - protein, 5 aa, Mycobacterium
AEAAI

SEQ ID NO: 417382 - protein, 6 aa, Mycobacterium
AEAAIT

SEQ ID NO: 417383 - protein, 26 aa, Mycobacterium
AEAAKAPAAAPAPAAPAASAPAAVAP

SEQ ID NO: 417384 - protein, 10 aa, Mycobacterium
AEAAKEGKDV

SEQ ID NO: 417385 - protein, 6 aa, Mycobacterium
AEAAKL

SEQ ID NO: 417386 - protein, 11 aa, Mycobacterium
AEAAKNGDDVD

SEQ ID NO: 417387 - protein, 10 aa, Mycobacterium
AEAAKRGLSN

SEQ ID NO: 417388 - protein, 9 aa, Mycobacterium
AEAAKTASE

SEQ ID NO: 417389 - protein, 10 aa, Mycobacterium
AEAAKYQPKP

SEQ ID NO: 417390 - protein, 12 aa, Mycobacterium
AEAAKYSPRPLT

SEQ ID NO: 417391 - protein, 5 aa, Mycobacterium
AEAAL

SEQ ID NO: 417392 - protein, 5 aa, Mycobacterium
AEAAN

SEQ ID NO: 417393 - protein, 11 aa, Mycobacterium
AEAANASPLQT

SEQ ID NO: 417394 - protein, 19 aa, Mycobacterium
AEAANATPLQTAAAPASMA

SEQ ID NO: 417395 - protein, 7 aa, Mycobacterium
AEAAPAS

SEQ ID NO: 417396 - protein, 9 aa, Mycobacterium
AEAAPEPDM

SEQ ID NO: 417397 - protein, 11 aa, Mycobacterium
AEAAPTAGLMP

SEQ ID NO: 417398 - protein, 9 aa, Mycobacterium
AEAAPTRYE

SEQ ID NO: 417399 - protein, 7 aa, Mycobacterium
AEAAPVD

SEQ ID NO: 417400 - protein, 6 aa, Mycobacterium
AEAAQG

SEQ ID NO: 417401 - protein, 12 aa, Mycobacterium
AEAARAGADGAE

SEQ ID NO: 417402 - protein, 13 aa, Mycobacterium
AEAARAGADGSEV

SEQ ID NO: 417403 - protein, 9 aa, Mycobacterium
AEAARDTPQ

SEQ ID NO: 417404 - protein, 10 aa, Mycobacterium
AEAARERSAH

SEQ ID NO: 417405 - protein, 16 aa, Mycobacterium
AEAARPHRVTHRRLTR

SEQ ID NO: 417406 - protein, 10 aa, Mycobacterium
AEAARQGYSD

SEQ ID NO: 417407 - protein, 6 aa, Mycobacterium
AEAARR

SEQ ID NO: 417408 - protein, 9 aa, Mycobacterium
AEAARRGLT

SEQ ID NO: 417409 - protein, 10 aa, Mycobacterium
AEAARRSREL

SEQ ID NO: 417410 - protein, 20 aa, Mycobacterium
AEAARTPASNDLQSHSDSNA

SEQ ID NO: 417411 - protein, 8 aa, Mycobacterium
AEAASRCT

SEQ ID NO: 417412 - protein, 9 aa, Mycobacterium
AEAATASNA

SEQ ID NO: 417413 - protein, 10 aa, Mycobacterium
AEAATATATA

SEQ ID NO: 417414 - protein, 7 aa, Mycobacterium
AEAATGS

SEQ ID NO: 417415 - protein, 6 aa, Mycobacterium
AEAATP

SEQ ID NO: 417416 - protein, 13 aa, Mycobacterium
AEAATTDKYDEAL

SEQ ID NO: 417417 - protein, 14 aa, Mycobacterium
AEAAVQAATDEPGE

SEQ ID NO: 417418 - protein, 18 aa, Mycobacterium
AEAAVSASSPSASTAATG

SEQ ID NO: 417419 - protein, 5 aa, Mycobacterium
AEAAY

SEQ ID NO: 417420 - protein, 8 aa, Mycobacterium
AEADAADE

SEQ ID NO: 417421 - protein, 7 aa, Mycobacterium
AEADAER

SEQ ID NO: 417422 - protein, 8 aa, Mycobacterium
AEADAHEN

SEQ ID NO: 417423 - protein, 7 aa, Mycobacterium
AEADALP

SEQ ID NO: 417424 - protein, 12 aa, Mycobacterium
AEADDAEEAASV

SEQ ID NO: 417425 - protein, 6 aa, Mycobacterium
AEADDF

SEQ ID NO: 417426 - protein, 5 aa, Mycobacterium
AEADE

SEQ ID NO: 417427 - protein, 7 aa, Mycobacterium
AEADESV

SEQ ID NO: 417428 - protein, 7 aa, Mycobacterium
AEADETA

SEQ ID NO: 417429 - protein, 11 aa, Mycobacterium
AEADGAEPLTE

SEQ ID NO: 417430 - protein, 8 aa, Mycobacterium
AEADGATV

SEQ ID NO: 417431 - protein, 7 aa, Mycobacterium
AEADGEA

SEQ ID NO: 417432 - protein, 7 aa, Mycobacterium
AEADGFR

SEQ ID NO: 417433 - protein, 8 aa, Mycobacterium
AEADGGFT

SEQ ID NO: 417434 - protein, 7 aa, Mycobacterium
AEADKQA

SEQ ID NO: 417435 - protein, 11 aa, Mycobacterium
AEADNAGGNRF

SEQ ID NO: 417436 - protein, 6 aa, Mycobacterium
AEADPD

SEQ ID NO: 417437 - protein, 14 aa, Mycobacterium
AEADPDTAPTVRTP

SEQ ID NO: 417438 - protein, 10 aa, Mycobacterium
AEADPTADVE

SEQ ID NO: 417439 - protein, 7 aa, Mycobacterium
AEADPYT

SEQ ID NO: 417440 - protein, 8 aa, Mycobacterium
AEADQNDM

SEQ ID NO: 417441 - protein, 52 aa, Mycobacterium
AEADQNSTISQGDGDASAVGGSADSAASADSGGTTDSASGGTDSGSSDTDSA

SEQ ID NO: 417442 - protein, 9 aa, Mycobacterium
AEADQPPPE

SEQ ID NO: 417443 - protein, 7 aa, Mycobacterium
AEADQTA

SEQ ID NO: 417444 - protein, 6 aa, Mycobacterium
AEADRR

SEQ ID NO: 417445 - protein, 8 aa, Mycobacterium
AEADRREG

SEQ ID NO: 417446 - protein, 5 aa, Mycobacterium
AEADS

SEQ ID NO: 417447 - protein, 10 aa, Mycobacterium
AEADSGAALR

SEQ ID NO: 417448 - protein, 6 aa, Mycobacterium
AEADSL

SEQ ID NO: 417449 - protein, 10 aa, Mycobacterium
AEADSLGADG

SEQ ID NO: 417450 - protein, 5 aa, Mycobacterium
AEADT

SEQ ID NO: 417451 - protein, 18 aa, Mycobacterium
AEADTADTADTADTSDTV

SEQ ID NO: 417452 - protein, 11 aa, Mycobacterium
AEADTAGGNRF

SEQ ID NO: 417453 - protein, 11 aa, Mycobacterium
AEADTDGNEYR

SEQ ID NO: 417454 - protein, 14 aa, Mycobacterium
AEADTLPGLDGADG

SEQ ID NO: 417455 - protein, 8 aa, Mycobacterium
AEADYEAA

SEQ ID NO: 417456 - protein, 16 aa, Mycobacterium
AEAEAAGGKMPKELTE

SEQ ID NO: 417457 - protein, 9 aa, Mycobacterium
AEAEADYPK

SEQ ID NO: 417458 - protein, 15 aa, Mycobacterium
AEAEAENEARYGGPL

SEQ ID NO: 417459 - protein, 9 aa, Mycobacterium
AEAEAMRRR

SEQ ID NO: 417460 - protein, 8 aa, Mycobacterium
AEAEARGA

SEQ ID NO: 417461 - protein, 12 aa, Mycobacterium
AEAEASTGAGDP

SEQ ID NO: 417462 - protein, 5 aa, Mycobacterium
AEAED

SEQ ID NO: 417463 - protein, 5 aa, Mycobacterium
AEAEE

SEQ ID NO: 417464 - protein, 32 aa, Mycobacterium
AEAEEAAKPASSNGSSRSEESSGGGSLASDAQ

SEQ ID NO: 417465 - protein, 9 aa, Mycobacterium
AEAEETERF

SEQ ID NO: 417466 - protein, 5 aa, Mycobacterium
AEAEG

SEQ ID NO: 417467 - protein, 7 aa, Mycobacterium
AEAEGND

SEQ ID NO: 417468 - protein, 17 aa, Mycobacterium
AEAEGQAPAGRTPDLPG

SEQ ID NO: 417469 - protein, 9 aa, Mycobacterium
AEAEGTDRA

SEQ ID NO: 417470 - protein, 20 aa, Mycobacterium
AEAEHRREHRQRADRPGGAM

SEQ ID NO: 417471 - protein, 5 aa, Mycobacterium
AEAEK

SEQ ID NO: 417472 - protein, 19 aa, Mycobacterium
AEAEKLATAHDQAKAANAP

SEQ ID NO: 417473 - protein, 7 aa, Mycobacterium
AEAENLR

SEQ ID NO: 417474 - protein, 20 aa, Mycobacterium
AEAEPAGEPDVEEVPDDLTP

SEQ ID NO: 417475 - protein, 9 aa, Mycobacterium
AEAEPLPVP

SEQ ID NO: 417476 - protein, 6 aa, Mycobacterium
AEAEPT

SEQ ID NO: 417477 - protein, 7 aa, Mycobacterium
AEAEQLG

SEQ ID NO: 417478 - protein, 8 aa, Mycobacterium
AEAEQPPW

SEQ ID NO: 417479 - protein, 5 aa, Mycobacterium
AEAER

SEQ ID NO: 417480 - protein, 35 aa, Mycobacterium
AEAERAKTEADDRLSEREAQRDEARRRRDEAARAL

SEQ ID NO: 417481 - protein, 10 aa, Mycobacterium
AEAERDGASG

SEQ ID NO: 417482 - protein, 10 aa, Mycobacterium
AEAERGRGHA

SEQ ID NO: 417483 - protein, 12 aa, Mycobacterium
AEAERPIAPEAA

SEQ ID NO: 417484 - protein, 6 aa, Mycobacterium
AEAERT

SEQ ID NO: 417485 - protein, 9 aa, Mycobacterium
AEAESAAGR

SEQ ID NO: 417486 - protein, 12 aa, Mycobacterium
AEAESQAGVDDL

SEQ ID NO: 417487 - protein, 17 aa, Mycobacterium
AEAESTRAGDARFGERP

SEQ ID NO: 417488 - protein, 8 aa, Mycobacterium
AEAETGLH

SEQ ID NO: 417489 - protein, 7 aa, Mycobacterium
AEAEVGP

SEQ ID NO: 417490 - protein, 7 aa, Mycobacterium
AEAEYET

SEQ ID NO: 417491 - protein, 4 aa, Mycobacterium
AEAF

SEQ ID NO: 417492 - protein, 14 aa, Mycobacterium
AEAFDDAGSEPLDE

SEQ ID NO: 417493 - protein, 8 aa, Mycobacterium
AEAGADSL

SEQ ID NO: 417494 - protein, 15 aa, Mycobacterium
AEAGAESPAGATGLG

SEQ ID NO: 417495 - protein, 17 aa, Mycobacterium
AEAGAGGWDGVAGNPPY

SEQ ID NO: 417496 - protein, 14 aa, Mycobacterium
AEAGAGTDGPLPET

SEQ ID NO: 417497 - protein, 13 aa, Mycobacterium
AEAGAGVDPAELE

SEQ ID NO: 417498 - protein, 7 aa, Mycobacterium
AEAGAGW

SEQ ID NO: 417499 - protein, 7 aa, Mycobacterium
AEAGAID

SEQ ID NO: 417500 - protein, 9 aa, Mycobacterium
AEAGAPAGH

SEQ ID NO: 417501 - protein, 8 aa, Mycobacterium
AEAGARGY

SEQ ID NO: 417502 - protein, 7 aa, Mycobacterium
AEAGARI

SEQ ID NO: 417503 - protein, 12 aa, Mycobacterium
AEAGASAAASVA

SEQ ID NO: 417504 - protein, 20 aa, Mycobacterium
AEAGDASDAGDAAPAADAPA

SEQ ID NO: 417505 - protein, 7 aa, Mycobacterium
AEAGDEF

SEQ ID NO: 417506 - protein, 6 aa, Mycobacterium
AEAGDL

SEQ ID NO: 417507 - protein, 11 aa, Mycobacterium
AEAGEGGVPRR

SEQ ID NO: 417508 - protein, 7 aa, Mycobacterium
AEAGELR

SEQ ID NO: 417509 - protein, 7 aa, Mycobacterium
AEAGGGS

SEQ ID NO: 417510 - protein, 10 aa, Mycobacterium
AEAGGPDKPH

SEQ ID NO: 417511 - protein, 26 aa, Mycobacterium
AEAGGQIADEGTISGTGASGSARAAV

SEQ ID NO: 417512 - protein, 34 aa, Mycobacterium
AEAGHPLAAKDSEDSENSEDNAAGAAAAAEASAV

SEQ ID NO: 417513 - protein, 9 aa, Mycobacterium
AEAGHPPTR

SEQ ID NO: 417514 - protein, 6 aa, Mycobacterium
AEAGKD

SEQ ID NO: 417515 - protein, 7 aa, Mycobacterium
AEAGKQA

SEQ ID NO: 417516 - protein, 12 aa, Mycobacterium
AEAGKSVARDQL

SEQ ID NO: 417517 - protein, 5 aa, Mycobacterium
AEAGL

SEQ ID NO: 417518 - protein, 7 aa, Mycobacterium
AEAGLPP

SEQ ID NO: 417519 - protein, 7 aa, Mycobacterium
AEAGLTP

SEQ ID NO: 417520 - protein, 6 aa, Mycobacterium
AEAGNQ

SEQ ID NO: 417521 - protein, 5 aa, Mycobacterium
AEAGP

SEQ ID NO: 417522 - protein, 7 aa, Mycobacterium
AEAGPAP

SEQ ID NO: 417523 - protein, 6 aa, Mycobacterium
AEAGPN

SEQ ID NO: 417524 - protein, 8 aa, Mycobacterium
AEAGPNSA

SEQ ID NO: 417525 - protein, 9 aa, Mycobacterium
AEAGPQLAQ

SEQ ID NO: 417526 - protein, 10 aa, Mycobacterium
AEAGPRPVGA

SEQ ID NO: 417527 - protein, 7 aa, Mycobacterium
AEAGPVS

SEQ ID NO: 417528 - protein, 7 aa, Mycobacterium
AEAGQGL

SEQ ID NO: 417529 - protein, 29 aa, Mycobacterium
AEAGQGNWQTVPGSEREAGFAGGRQTQIS

SEQ ID NO: 417530 - protein, 5 aa, Mycobacterium
AEAGR

SEQ ID NO: 417531 - protein, 6 aa, Mycobacterium
AEAGRA

SEQ ID NO: 417532 - protein, 8 aa, Mycobacterium
AEAGRAGA

SEQ ID NO: 417533 - protein, 16 aa, Mycobacterium
AEAGRKDDIAFLREHA

SEQ ID NO: 417534 - protein, 6 aa, Mycobacterium
AEAGRQ

SEQ ID NO: 417535 - protein, 10 aa, Mycobacterium
AEAGRTQGSI

SEQ ID NO: 417536 - protein, 7 aa, Mycobacterium
AEAGSFD

SEQ ID NO: 417537 - protein, 7 aa, Mycobacterium
AEAGSGW

SEQ ID NO: 417538 - protein, 13 aa, Mycobacterium
AEAGSPSKWVQGS

SEQ ID NO: 417539 - protein, 7 aa, Mycobacterium
AEAGSPT

SEQ ID NO: 417540 - protein, 10 aa, Mycobacterium
AEAGTAGDPV

SEQ ID NO: 417541 - protein, 8 aa, Mycobacterium
AEAGTDTW

SEQ ID NO: 417542 - protein, 13 aa, Mycobacterium
AEAGTGSSPVPVG

SEQ ID NO: 417543 - protein, 6 aa, Mycobacterium
AEAGTK

SEQ ID NO: 417544 - protein, 7 aa, Mycobacterium
AEAGTPT

SEQ ID NO: 417545 - protein, 9 aa, Mycobacterium
AEAGTRQRR

SEQ ID NO: 417546 - protein, 9 aa, Mycobacterium
AEAGTSASS

SEQ ID NO: 417547 - protein, 6 aa, Mycobacterium
AEAGTT

SEQ ID NO: 417548 - protein, 8 aa, Mycobacterium
AEAGVGKG

SEQ ID NO: 417549 - protein, 9 aa, Mycobacterium
AEAGYPPTR

SEQ ID NO: 417550 - protein, 13 aa, Mycobacterium
AEAHGPENSEGES

SEQ ID NO: 417551 - protein, 6 aa, Mycobacterium
AEAHRD

SEQ ID NO: 417552 - protein, 6 aa, Mycobacterium
AEAHRH

SEQ ID NO: 417553 - protein, 6 aa, Mycobacterium
AEAKFH

SEQ ID NO: 417554 - protein, 20 aa, Mycobacterium
AEAKGLTGSDIDDAIMAASN

SEQ ID NO: 417555 - protein, 10 aa, Mycobacterium
AEAKGTGTLR

SEQ ID NO: 417556 - protein, 15 aa, Mycobacterium
AEAKPAERRVRVQSV

SEQ ID NO: 417557 - protein, 11 aa, Mycobacterium
AEAKPDARQGL

SEQ ID NO: 417558 - protein, 7 aa, Mycobacterium
AEALDSR

SEQ ID NO: 417559 - protein, 5 aa, Mycobacterium
AEALG

SEQ ID NO: 417560 - protein, 6 aa, Mycobacterium
AEALGG

SEQ ID NO: 417561 - protein, 5 aa, Mycobacterium
AEALQ

SEQ ID NO: 417562 - protein, 13 aa, Mycobacterium
AEALRSATETRPD

SEQ ID NO: 417563 - protein, 16 aa, Mycobacterium
AEANAGLNSEGGPACA

SEQ ID NO: 417564 - protein, 19 aa, Mycobacterium
AEANDEGSVRYSGTALDGQ

SEQ ID NO: 417565 - protein, 21 aa, Mycobacterium
AEANEGAGRFAAGAGRHGAAA

SEQ ID NO: 417566 - protein, 5 aa, Mycobacterium
AEANG

SEQ ID NO: 417567 - protein, 5 aa, Mycobacterium
AEANM

SEQ ID NO: 417568 - protein, 9 aa, Mycobacterium
AEANRSTAS

SEQ ID NO: 417569 - protein, 18 aa, Mycobacterium
AEANSSRRQLMLSLVRKT

SEQ ID NO: 417570 - protein, 9 aa, Mycobacterium
AEANSTLDE

SEQ ID NO: 417571 - protein, 9 aa, Mycobacterium
AEAPAAGQV

SEQ ID NO: 417572 - protein, 8 aa, Mycobacterium
AEAPAAVD

SEQ ID NO: 417573 - protein, 10 aa, Mycobacterium
AEAPAGQPCF

SEQ ID NO: 417574 - protein, 11 aa, Mycobacterium
AEAPAGTRARE

SEQ ID NO: 417575 - protein, 6 aa, Mycobacterium
AEAPAR

SEQ ID NO: 417576 - protein, 7 aa, Mycobacterium
AEAPARF

SEQ ID NO: 417577 - protein, 7 aa, Mycobacterium
AEAPDAA

SEQ ID NO: 417578 - protein, 27 aa, Mycobacterium
AEAPDAQTADDLERSAERARARGGLSA

SEQ ID NO: 417579 - protein, 6 aa, Mycobacterium
AEAPEE

SEQ ID NO: 417580 - protein, 6 aa, Mycobacterium
AEAPGA

SEQ ID NO: 417581 - protein, 14 aa, Mycobacterium
AEAPGADSLAPQYP

SEQ ID NO: 417582 - protein, 9 aa, Mycobacterium
AEAPGATGY

SEQ ID NO: 417583 - protein, 7 aa, Mycobacterium
AEAPGAV

SEQ ID NO: 417584 - protein, 14 aa, Mycobacterium
AEAPGQFEGAPTPA

SEQ ID NO: 417585 - protein, 8 aa, Mycobacterium
AEAPGQRM

SEQ ID NO: 417586 - protein, 7 aa, Mycobacterium
AEAPGWD

SEQ ID NO: 417587 - protein, 13 aa, Mycobacterium
AEAPHSAATHDTT

SEQ ID NO: 417588 - protein, 16 aa, Mycobacterium
AEAPHSAATHDTTAQY

SEQ ID NO: 417589 - protein, 14 aa, Mycobacterium
AEAPHSAATHDTTE

SEQ ID NO: 417590 - protein, 5 aa, Mycobacterium
AEAPN

SEQ ID NO: 417591 - protein, 22 aa, Mycobacterium
AEAPPGLSTDGLTETQRRWTEE

SEQ ID NO: 417592 - protein, 7 aa, Mycobacterium
AEAPPLA

SEQ ID NO: 417593 - protein, 8 aa, Mycobacterium
AEAPPNVD

SEQ ID NO: 417594 - protein, 8 aa, Mycobacterium
AEAPPTPV

SEQ ID NO: 417595 - protein, 5 aa, Mycobacterium
AEAPQ

SEQ ID NO: 417596 - protein, 10 aa, Mycobacterium
AEAPQRGEGI

SEQ ID NO: 417597 - protein, 12 aa, Mycobacterium
AEAPRLPAANTQ

SEQ ID NO: 417598 - protein, 6 aa, Mycobacterium
AEAPRV

SEQ ID NO: 417599 - protein, 14 aa, Mycobacterium
AEAPSRRGRHKNIP

SEQ ID NO: 417600 - protein, 7 aa, Mycobacterium
AEAPSSQ

SEQ ID NO: 417601 - protein, 7 aa, Mycobacterium
AEAPSTI

SEQ ID NO: 417602 - protein, 7 aa, Mycobacterium
AEAPTTL

SEQ ID NO: 417603 - protein, 9 aa, Mycobacterium
AEAPTVGPT

SEQ ID NO: 417604 - protein, 15 aa, Mycobacterium
AEAQEQAKKRKKNRP

SEQ ID NO: 417605 - protein, 11 aa, Mycobacterium
AEAQKAGAQEI

SEQ ID NO: 417606 - protein, 11 aa, Mycobacterium
AEAQKAGAQRI

SEQ ID NO: 417607 - protein, 10 aa, Mycobacterium
AEAQKGAAGR

SEQ ID NO: 417608 - protein, 11 aa, Mycobacterium
AEAQKSAAGQI

SEQ ID NO: 417609 - protein, 13 aa, Mycobacterium
AEAQLPNARGLSG

SEQ ID NO: 417610 - protein, 5 aa, Mycobacterium
AEAQP

SEQ ID NO: 417611 - protein, 8 aa, Mycobacterium
AEAQPSGV

SEQ ID NO: 417612 - protein, 5 aa, Mycobacterium
AEAQR

SEQ ID NO: 417613 - protein, 8 aa, Mycobacterium
AEAQRGPM

SEQ ID NO: 417614 - protein, 15 aa, Mycobacterium
AEAQSAVASAQEQLA

SEQ ID NO: 417615 - protein, 10 aa, Mycobacterium
AEAQSLDGAP

SEQ ID NO: 417616 - protein, 7 aa, Mycobacterium
AEAQSRD

SEQ ID NO: 417617 - protein, 6 aa, Mycobacterium
AEAQTG

SEQ ID NO: 417618 - protein, 5 aa, Mycobacterium
AEAQY

SEQ ID NO: 417619 - protein, 6 aa, Mycobacterium
AEARAA

SEQ ID NO: 417620 - protein, 8 aa, Mycobacterium
AEARAEAD

SEQ ID NO: 417621 - protein, 6 aa, Mycobacterium
AEARAG

SEQ ID NO: 417622 - protein, 17 aa, Mycobacterium
AEARALGDRELTPADVP

SEQ ID NO: 417623 - protein, 47 aa, Mycobacterium
AEARARGANQSPVAAEDGEAASKQSTGLAQRRKPAEEAKDAEQSDAE

SEQ ID NO: 417624 - protein, 10 aa, Mycobacterium
AEARGGATQF

SEQ ID NO: 417625 - protein, 5 aa, Mycobacterium
AEARH

SEQ ID NO: 417626 - protein, 6 aa, Mycobacterium
AEARKG

SEQ ID NO: 417627 - protein, 9 aa, Mycobacterium
AEARPLDET

SEQ ID NO: 417628 - protein, 6 aa, Mycobacterium
AEARQA

SEQ ID NO: 417629 - protein, 6 aa, Mycobacterium
AEARQG

SEQ ID NO: 417630 - protein, 13 aa, Mycobacterium
AEARQLAGTQRVT

SEQ ID NO: 417631 - protein, 10 aa, Mycobacterium
AEARRANRAE

SEQ ID NO: 417632 - protein, 16 aa, Mycobacterium
AEARREKESAIDAQDF

SEQ ID NO: 417633 - protein, 8 aa, Mycobacterium
AEARRGPM

SEQ ID NO: 417634 - protein, 9 aa, Mycobacterium
AEARRGRRF

SEQ ID NO: 417635 - protein, 10 aa, Mycobacterium
AEARRQADAA

SEQ ID NO: 417636 - protein, 6 aa, Mycobacterium
AEARRR

SEQ ID NO: 417637 - protein, 6 aa, Mycobacterium
AEARRW

SEQ ID NO: 417638 - protein, 6 aa, Mycobacterium
AEARSA

SEQ ID NO: 417639 - protein, 19 aa, Mycobacterium
AEARSAEQLGRYGQPPHSA

SEQ ID NO: 417640 - protein, 7 aa, Mycobacterium
AEARSKD

SEQ ID NO: 417641 - protein, 5 aa, Mycobacterium
AEART

SEQ ID NO: 417642 - protein, 8 aa, Mycobacterium
AEARTAAL

SEQ ID NO: 417643 - protein, 25 aa, Mycobacterium
AEARTATAAQGATEWHDPRNDGLTP

SEQ ID NO: 417644 - protein, 10 aa, Mycobacterium
AEASADYAPE

SEQ ID NO: 417645 - protein, 11 aa, Mycobacterium
AEASAKTGLDE

SEQ ID NO: 417646 - protein, 9 aa, Mycobacterium
AEASASPDS

SEQ ID NO: 417647 - protein, 16 aa, Mycobacterium
AEASATVDDDEDYNPD

SEQ ID NO: 417648 - protein, 11 aa, Mycobacterium
AEASDTEPASV

SEQ ID NO: 417649 - protein, 11 aa, Mycobacterium
AEASELGNKMG

SEQ ID NO: 417650 - protein, 12 aa, Mycobacterium
AEASGALRPGGT

SEQ ID NO: 417651 - protein, 23 aa, Mycobacterium
AEASGELKPGGTIVEPTSGNTGV

SEQ ID NO: 417652 - protein, 6 aa, Mycobacterium
AEASGL

SEQ ID NO: 417653 - protein, 9 aa, Mycobacterium
AEASGNDAA

SEQ ID NO: 417654 - protein, 12 aa, Mycobacterium
AEASGQLRPGGT

SEQ ID NO: 417655 - protein, 10 aa, Mycobacterium
AEASGRDPAE

SEQ ID NO: 417656 - protein, 6 aa, Mycobacterium
AEASLR

SEQ ID NO: 417657 - protein, 5 aa, Mycobacterium
AEASP

SEQ ID NO: 417658 - protein, 16 aa, Mycobacterium
AEASQIQQRAADGEDR

SEQ ID NO: 417659 - protein, 5 aa, Mycobacterium
AEASR

SEQ ID NO: 417660 - protein, 11 aa, Mycobacterium
AEASRADRERY

SEQ ID NO: 417661 - protein, 8 aa, Mycobacterium
AEASRAEL

SEQ ID NO: 417662 - protein, 9 aa, Mycobacterium
AEASRPDGY

SEQ ID NO: 417663 - protein, 8 aa, Mycobacterium
AEASRRVA

SEQ ID NO: 417664 - protein, 40 aa, Mycobacterium
AEASRRVGEAAELGERRAMTGEPLAPQLSATAAAQRAGHL

SEQ ID NO: 417665 - protein, 6 aa, Mycobacterium
AEASRY

SEQ ID NO: 417666 - protein, 10 aa, Mycobacterium
AEASSSRAGL

SEQ ID NO: 417667 - protein, 8 aa, Mycobacterium
AEATAGPR

SEQ ID NO: 417668 - protein, 10 aa, Mycobacterium
AEATAGRGDE

SEQ ID NO: 417669 - protein, 14 aa, Mycobacterium
AEATASGDVAVGSG

SEQ ID NO: 417670 - protein, 10 aa, Mycobacterium
AEATASIQGT

SEQ ID NO: 417671 - protein, 12 aa, Mycobacterium
AEATASYTNHGP

SEQ ID NO: 417672 - protein, 8 aa, Mycobacterium
AEATDETF

SEQ ID NO: 417673 - protein, 6 aa, Mycobacterium
AEATDL

SEQ ID NO: 417674 - protein, 8 aa, Mycobacterium
AEATENGC

SEQ ID NO: 417675 - protein, 8 aa, Mycobacterium
AEATERTF

SEQ ID NO: 417676 - protein, 15 aa, Mycobacterium
AEATEYVSGPAARSY

SEQ ID NO: 417677 - protein, 11 aa, Mycobacterium
AEATGAPTAAH

SEQ ID NO: 417678 - protein, 9 aa, Mycobacterium
AEATGDSRD

SEQ ID NO: 417679 - protein, 7 aa, Mycobacterium
AEATGEI

SEQ ID NO: 417680 - protein, 6 aa, Mycobacterium
AEATGF

SEQ ID NO: 417681 - protein, 7 aa, Mycobacterium
AEATGTV

SEQ ID NO: 417682 - protein, 15 aa, Mycobacterium
AEATIGESAQHVGRV

SEQ ID NO: 417683 - protein, 17 aa, Mycobacterium
AEATKEAESLRERYEEA

SEQ ID NO: 417684 - protein, 7 aa, Mycobacterium
AEATKIT

SEQ ID NO: 417685 - protein, 15 aa, Mycobacterium
AEATLQAATECDDEG

SEQ ID NO: 417686 - protein, 13 aa, Mycobacterium
AEATLSQPNADNV

SEQ ID NO: 417687 - protein, 16 aa, Mycobacterium
AEATPEERKAAGDKRA

SEQ ID NO: 417688 - protein, 14 aa, Mycobacterium
AEATPPVVPPDPEG

SEQ ID NO: 417689 - protein, 6 aa, Mycobacterium
AEATPR

SEQ ID NO: 417690 - protein, 8 aa, Mycobacterium
AEATRNPA

SEQ ID NO: 417691 - protein, 112 aa, Mycobacterium
AEATRNTREADAELREAQAEAAEDLKDARADREQNVKEARSTALQRKQAAEQARQKRTQTAKAKTDEVAAKRKEVAQTAKQRKEEAINTVEQAKTKNARAKLADAQETRVEA

SEQ ID NO: 417692 - protein, 7 aa, Mycobacterium
AEATRRR

SEQ ID NO: 417693 - protein, 14 aa, Mycobacterium
AEATSQTPSQWGGA

SEQ ID NO: 417694 - protein, 13 aa, Mycobacterium
AEATSTSRAPHVT

SEQ ID NO: 417695 - protein, 16 aa, Mycobacterium
AEATSVRSSPASKSAK

SEQ ID NO: 417696 - protein, 46 aa, Mycobacterium
AEATVAADRSRREEHRAAQTARKEALAAEAEELAATATQWKAAGDR

SEQ ID NO: 417697 - protein, 5 aa, Mycobacterium
AEATY

SEQ ID NO: 417698 - protein, 5 aa, Mycobacterium
AEAVE

SEQ ID NO: 417699 - protein, 7 aa, Mycobacterium
AEAVEAG

SEQ ID NO: 417700 - protein, 6 aa, Mycobacterium
AEAVPG

SEQ ID NO: 417701 - protein, 11 aa, Mycobacterium
AEAVQRARESV

SEQ ID NO: 417702 - protein, 12 aa, Mycobacterium
AEAVQRARESVD

SEQ ID NO: 417703 - protein, 5 aa, Mycobacterium
AEAVT

SEQ ID NO: 417704 - protein, 4 aa, Mycobacterium
AEAY

SEQ ID NO: 417705 - protein, 12 aa, Mycobacterium
AEAYDDGPQARD

SEQ ID NO: 417706 - protein, 7 aa, Mycobacterium
AEAYDGP

SEQ ID NO: 417707 - protein, 12 aa, Mycobacterium
AEAYEQSGGDED

SEQ ID NO: 417708 - protein, 8 aa, Mycobacterium
AECGTTHR

SEQ ID NO: 417709 - protein, 4 aa, Mycobacterium
AECP

SEQ ID NO: 417710 - protein, 12 aa, Mycobacterium
AECRDDRPQEFP

SEQ ID NO: 417711 - protein, 20 aa, Mycobacterium
AECTPGYYNNEGGGGGEGIR

SEQ ID NO: 417712 - protein, 7 aa, Mycobacterium
AEDAAAA

SEQ ID NO: 417713 - protein, 12 aa, Mycobacterium
AEDAAAASTYPA

SEQ ID NO: 417714 - protein, 6 aa, Mycobacterium
AEDAAD

SEQ ID NO: 417715 - protein, 7 aa, Mycobacterium
AEDAAER

SEQ ID NO: 417716 - protein, 22 aa, Mycobacterium
AEDAAIAASSGLGGAAPGLGGF

SEQ ID NO: 417717 - protein, 6 aa, Mycobacterium
AEDAAV

SEQ ID NO: 417718 - protein, 7 aa, Mycobacterium
AEDADDR

SEQ ID NO: 417719 - protein, 8 aa, Mycobacterium
AEDADGVT

SEQ ID NO: 417720 - protein, 11 aa, Mycobacterium
AEDADSGSRSR

SEQ ID NO: 417721 - protein, 6 aa, Mycobacterium
AEDAEL

SEQ ID NO: 417722 - protein, 11 aa, Mycobacterium
AEDAESERELA

SEQ ID NO: 417723 - protein, 7 aa, Mycobacterium
AEDAEWP

SEQ ID NO: 417724 - protein, 5 aa, Mycobacterium
AEDAG

SEQ ID NO: 417725 - protein, 7 aa, Mycobacterium
AEDAGAD

SEQ ID NO: 417726 - protein, 8 aa, Mycobacterium
AEDAGADF

SEQ ID NO: 417727 - protein, 6 aa, Mycobacterium
AEDAGF

SEQ ID NO: 417728 - protein, 9 aa, Mycobacterium
AEDAGGELR

SEQ ID NO: 417729 - protein, 11 aa, Mycobacterium
AEDAGLAPESG

SEQ ID NO: 417730 - protein, 10 aa, Mycobacterium
AEDAGRDPAT

SEQ ID NO: 417731 - protein, 8 aa, Mycobacterium
AEDAHSLR

SEQ ID NO: 417732 - protein, 9 aa, Mycobacterium
AEDAKRFGP

SEQ ID NO: 417733 - protein, 9 aa, Mycobacterium
AEDAPTPLP

SEQ ID NO: 417734 - protein, 28 aa, Mycobacterium
AEDAQAGRQERDRQQRGEAHRGEDRVGQ

SEQ ID NO: 417735 - protein, 9 aa, Mycobacterium
AEDAQRPDN

SEQ ID NO: 417736 - protein, 8 aa, Mycobacterium
AEDAQRRE

SEQ ID NO: 417737 - protein, 13 aa, Mycobacterium
AEDARPQPARDAD

SEQ ID NO: 417738 - protein, 15 aa, Mycobacterium
AEDATASGDVAVGSG

SEQ ID NO: 417739 - protein, 9 aa, Mycobacterium
AEDATQVSA

SEQ ID NO: 417740 - protein, 5 aa, Mycobacterium
AEDDD

SEQ ID NO: 417741 - protein, 6 aa, Mycobacterium
AEDDDA

SEQ ID NO: 417742 - protein, 9 aa, Mycobacterium
AEDDDFTQA

SEQ ID NO: 417743 - protein, 6 aa, Mycobacterium
AEDDEA

SEQ ID NO: 417744 - protein, 8 aa, Mycobacterium
AEDDGDRL

SEQ ID NO: 417745 - protein, 10 aa, Mycobacterium
AEDDGDRLSS

SEQ ID NO: 417746 - protein, 11 aa, Mycobacterium
AEDDPAGGNRF

SEQ ID NO: 417747 - protein, 8 aa, Mycobacterium
AEDDPSKF

SEQ ID NO: 417748 - protein, 8 aa, Mycobacterium
AEDDPSTF

SEQ ID NO: 417749 - protein, 8 aa, Mycobacterium
AEDDRPPA

SEQ ID NO: 417750 - protein, 8 aa, Mycobacterium
AEDDSAAR

SEQ ID NO: 417751 - protein, 9 aa, Mycobacterium
AEDDSKEKF

SEQ ID NO: 417752 - protein, 10 aa, Mycobacterium
AEDDVGAPRR

SEQ ID NO: 417753 - protein, 6 aa, Mycobacterium
AEDEAR

SEQ ID NO: 417754 - protein, 10 aa, Mycobacterium
AEDEATGSAA

SEQ ID NO: 417755 - protein, 6 aa, Mycobacterium
AEDEDL

SEQ ID NO: 417756 - protein, 9 aa, Mycobacterium
AEDEGDRLD

SEQ ID NO: 417757 - protein, 15 aa, Mycobacterium
AEDEIARSDSLSRTL

SEQ ID NO: 417758 - protein, 6 aa, Mycobacterium
AEDEKA

SEQ ID NO: 417759 - protein, 8 aa, Mycobacterium
AEDEKDRA

SEQ ID NO: 417760 - protein, 11 aa, Mycobacterium
AEDEKRSTTAT

SEQ ID NO: 417761 - protein, 5 aa, Mycobacterium
AEDEQ

SEQ ID NO: 417762 - protein, 8 aa, Mycobacterium
AEDERPKG

SEQ ID NO: 417763 - protein, 6 aa, Mycobacterium
AEDESV

SEQ ID NO: 417764 - protein, 7 aa, Mycobacterium
AEDEVSA

SEQ ID NO: 417765 - protein, 7 aa, Mycobacterium
AEDEVSE

SEQ ID NO: 417766 - protein, 7 aa, Mycobacterium
AEDEVSR

SEQ ID NO: 417767 - protein, 5 aa, Mycobacterium
AEDGA

SEQ ID NO: 417768 - protein, 7 aa, Mycobacterium
AEDGAKT

SEQ ID NO: 417769 - protein, 9 aa, Mycobacterium
AEDGATGIA

SEQ ID NO: 417770 - protein, 8 aa, Mycobacterium
AEDGATYE

SEQ ID NO: 417771 - protein, 7 aa, Mycobacterium
AEDGDDV

SEQ ID NO: 417772 - protein, 8 aa, Mycobacterium
AEDGDGPL

SEQ ID NO: 417773 - protein, 15 aa, Mycobacterium
AEDGEVLTQSNTNLD

SEQ ID NO: 417774 - protein, 11 aa, Mycobacterium
AEDGGDRLDAG

SEQ ID NO: 417775 - protein, 8 aa, Mycobacterium
AEDGGNPV

SEQ ID NO: 417776 - protein, 7 aa, Mycobacterium
AEDGGTL

SEQ ID NO: 417777 - protein, 17 aa, Mycobacterium
AEDGLPLPSGPDDPLTS

SEQ ID NO: 417778 - protein, 11 aa, Mycobacterium
AEDGPARVTPT

SEQ ID NO: 417779 - protein, 10 aa, Mycobacterium
AEDGPHEAPL

SEQ ID NO: 417780 - protein, 5 aa, Mycobacterium
AEDGR

SEQ ID NO: 417781 - protein, 6 aa, Mycobacterium
AEDGRE

SEQ ID NO: 417782 - protein, 7 aa, Mycobacterium
AEDGREY

SEQ ID NO: 417783 - protein, 9 aa, Mycobacterium
AEDGRSPVT

SEQ ID NO: 417784 - protein, 17 aa, Mycobacterium
AEDGTDDRSRVDEIDQQ

SEQ ID NO: 417785 - protein, 19 aa, Mycobacterium
AEDGTDERAAVDQTEAAAR

SEQ ID NO: 417786 - protein, 19 aa, Mycobacterium
AEDGTDERASVDRAEAAAR

SEQ ID NO: 417787 - protein, 17 aa, Mycobacterium
AEDGTDERTSVDATETV

SEQ ID NO: 417788 - protein, 6 aa, Mycobacterium
AEDGTR

SEQ ID NO: 417789 - protein, 6 aa, Mycobacterium
AEDGVD

SEQ ID NO: 417790 - protein, 10 aa, Mycobacterium
AEDGVDPSPL

SEQ ID NO: 417791 - protein, 5 aa, Mycobacterium
AEDHE

SEQ ID NO: 417792 - protein, 14 aa, Mycobacterium
AEDHPTTGAYADAK

SEQ ID NO: 417793 - protein, 9 aa, Mycobacterium
AEDHSEIDS

SEQ ID NO: 417794 - protein, 10 aa, Mycobacterium
AEDHTTTDST

SEQ ID NO: 417795 - protein, 10 aa, Mycobacterium
AEDIESSSEH

SEQ ID NO: 417796 - protein, 12 aa, Mycobacterium
AEDIKSGVQAIN

SEQ ID NO: 417797 - protein, 10 aa, Mycobacterium
AEDIPKPGDW

SEQ ID NO: 417798 - protein, 5 aa, Mycobacterium
AEDIT

SEQ ID NO: 417799 - protein, 17 aa, Mycobacterium
AEDKGFLGDTERQIAAT

SEQ ID NO: 417800 - protein, 4 aa, Mycobacterium
AEDL

SEQ ID NO: 417801 - protein, 15 aa, Mycobacterium
AEDLDAARAADTPAA

SEQ ID NO: 417802 - protein, 15 aa, Mycobacterium
AEDLDAARAAGTPAA

SEQ ID NO: 417803 - protein, 9 aa, Mycobacterium
AEDLGGGTV

SEQ ID NO: 417804 - protein, 5 aa, Mycobacterium
AEDLP

SEQ ID NO: 417805 - protein, 5 aa, Mycobacterium
AEDLS

SEQ ID NO: 417806 - protein, 15 aa, Mycobacterium
AEDLSAAEAAGTPAA

SEQ ID NO: 417807 - protein, 9 aa, Mycobacterium
AEDLSPAPL

SEQ ID NO: 417808 - protein, 9 aa, Mycobacterium
AEDLTGDAG

SEQ ID NO: 417809 - protein, 55 aa, Mycobacterium
AEDNKCAADTPPGGAPPPGIPQTPPLPGPEGPPPGAPAPFGGPNVQGGVASVNGN

SEQ ID NO: 417810 - protein, 9 aa, Mycobacterium
AEDNSGRRR

SEQ ID NO: 417811 - protein, 4 aa, Mycobacterium
AEDP

SEQ ID NO: 417812 - protein, 13 aa, Mycobacterium
AEDPAAGFLPTGG

SEQ ID NO: 417813 - protein, 7 aa, Mycobacterium
AEDPAAT

SEQ ID NO: 417814 - protein, 18 aa, Mycobacterium
AEDPAGRATLNALSRKGE

SEQ ID NO: 417815 - protein, 13 aa, Mycobacterium
AEDPAKDWQPQAG

SEQ ID NO: 417816 - protein, 8 aa, Mycobacterium
AEDPANPE

SEQ ID NO: 417817 - protein, 5 aa, Mycobacterium
AEDPD

SEQ ID NO: 417818 - protein, 13 aa, Mycobacterium
AEDPDAALEAGQA

SEQ ID NO: 417819 - protein, 17 aa, Mycobacterium
AEDPDEDDSSPRSNYTK

SEQ ID NO: 417820 - protein, 7 aa, Mycobacterium
AEDPDGD

SEQ ID NO: 417821 - protein, 6 aa, Mycobacterium
AEDPDL

SEQ ID NO: 417822 - protein, 5 aa, Mycobacterium
AEDPE

SEQ ID NO: 417823 - protein, 16 aa, Mycobacterium
AEDPEEDVDTAEANYA

SEQ ID NO: 417824 - protein, 6 aa, Mycobacterium
AEDPEL

SEQ ID NO: 417825 - protein, 14 aa, Mycobacterium
AEDPETGERLSDED

SEQ ID NO: 417826 - protein, 14 aa, Mycobacterium
AEDPETGKRLSDDE

SEQ ID NO: 417827 - protein, 6 aa, Mycobacterium
AEDPEY

SEQ ID NO: 417828 - protein, 7 aa, Mycobacterium
AEDPGRA

SEQ ID NO: 417829 - protein, 5 aa, Mycobacterium
AEDPH

SEQ ID NO: 417830 - protein, 6 aa, Mycobacterium
AEDPHD

SEQ ID NO: 417831 - protein, 7 aa, Mycobacterium
AEDPIQA

SEQ ID NO: 417832 - protein, 10 aa, Mycobacterium
AEDPNRKPEF

SEQ ID NO: 417833 - protein, 8 aa, Mycobacterium
AEDPPARA

SEQ ID NO: 417834 - protein, 9 aa, Mycobacterium
AEDPPARAR

SEQ ID NO: 417835 - protein, 7 aa, Mycobacterium
AEDPPSR

SEQ ID NO: 417836 - protein, 8 aa, Mycobacterium
AEDPPSRI

SEQ ID NO: 417837 - protein, 6 aa, Mycobacterium
AEDPQP

SEQ ID NO: 417838 - protein, 16 aa, Mycobacterium
AEDPQPSGKTYKVTGT

SEQ ID NO: 417839 - protein, 8 aa, Mycobacterium
AEDPQVTV

SEQ ID NO: 417840 - protein, 6 aa, Mycobacterium
AEDPQW

SEQ ID NO: 417841 - protein, 10 aa, Mycobacterium
AEDPRRMRRD

SEQ ID NO: 417842 - protein, 6 aa, Mycobacterium
AEDPRV

SEQ ID NO: 417843 - protein, 16 aa, Mycobacterium
AEDPSEDDSTPDANYA

SEQ ID NO: 417844 - protein, 8 aa, Mycobacterium
AEDPTFSP

SEQ ID NO: 417845 - protein, 14 aa, Mycobacterium
AEDPTKGYLPQTGT

SEQ ID NO: 417846 - protein, 6 aa, Mycobacterium
AEDPTL

SEQ ID NO: 417847 - protein, 5 aa, Mycobacterium
AEDPV

SEQ ID NO: 417848 - protein, 7 aa, Mycobacterium
AEDQQRQ

SEQ ID NO: 417849 - protein, 5 aa, Mycobacterium
AEDQV

SEQ ID NO: 417850 - protein, 7 aa, Mycobacterium
AEDRPRT

SEQ ID NO: 417851 - protein, 7 aa, Mycobacterium
AEDRRIG

SEQ ID NO: 417852 - protein, 11 aa, Mycobacterium
AEDRVTQHRDL

SEQ ID NO: 417853 - protein, 5 aa, Mycobacterium
AEDSD

SEQ ID NO: 417854 - protein, 8 aa, Mycobacterium
AEDSDPHV

SEQ ID NO: 417855 - protein, 9 aa, Mycobacterium
AEDSDPNVS

SEQ ID NO: 417856 - protein, 8 aa, Mycobacterium
AEDSPARA

SEQ ID NO: 417857 - protein, 10 aa, Mycobacterium
AEDSRTDQRH

SEQ ID NO: 417858 - protein, 6 aa, Mycobacterium
AEDSVA

SEQ ID NO: 417859 - protein, 4 aa, Mycobacterium
AEDT

SEQ ID NO: 417860 - protein, 12 aa, Mycobacterium
AEDTASATPENP

SEQ ID NO: 417861 - protein, 9 aa, Mycobacterium
AEDTDLPAV

SEQ ID NO: 417862 - protein, 7 aa, Mycobacterium
AEDTEVR

SEQ ID NO: 417863 - protein, 6 aa, Mycobacterium
AEDTLG

SEQ ID NO: 417864 - protein, 7 aa, Mycobacterium
AEDTMKG

SEQ ID NO: 417865 - protein, 12 aa, Mycobacterium
AEDTPEAAEVKG

SEQ ID NO: 417866 - protein, 11 aa, Mycobacterium
AEDTPGVSADQ

SEQ ID NO: 417867 - protein, 8 aa, Mycobacterium
AEDTPYGR

SEQ ID NO: 417868 - protein, 7 aa, Mycobacterium
AEDTRRI

SEQ ID NO: 417869 - protein, 7 aa, Mycobacterium
AEDTRRV

SEQ ID NO: 417870 - protein, 13 aa, Mycobacterium
AEDTRTARNPITD

SEQ ID NO: 417871 - protein, 11 aa, Mycobacterium
AEDTSGASPEH

SEQ ID NO: 417872 - protein, 6 aa, Mycobacterium
AEDTTG

SEQ ID NO: 417873 - protein, 6 aa, Mycobacterium
AEDTVR

SEQ ID NO: 417874 - protein, 4 aa, Mycobacterium
AEDV

SEQ ID NO: 417875 - protein, 7 aa, Mycobacterium
AEDVAKS

SEQ ID NO: 417876 - protein, 15 aa, Mycobacterium
AEDVEAARAAGTPTA

SEQ ID NO: 417877 - protein, 4 aa, Mycobacterium
AEDW

SEQ ID NO: 417878 - protein, 6 aa, Mycobacterium
AEDYAQ

SEQ ID NO: 417879 - protein, 6 aa, Mycobacterium
AEDYES

SEQ ID NO: 417880 - protein, 7 aa, Mycobacterium
AEDYRAA

SEQ ID NO: 417881 - protein, 5 aa, Mycobacterium
AEEAA

SEQ ID NO: 417882 - protein, 26 aa, Mycobacterium
AEEAAEKAARRAKQSGSGPAEPSGAP

SEQ ID NO: 417883 - protein, 6 aa, Mycobacterium
AEEAAH

SEQ ID NO: 417884 - protein, 9 aa, Mycobacterium
AEEAETARE

SEQ ID NO: 417885 - protein, 12 aa, Mycobacterium
AEEAGGKGANLG

SEQ ID NO: 417886 - protein, 7 aa, Mycobacterium
AEEAGPD

SEQ ID NO: 417887 - protein, 10 aa, Mycobacterium
AEEAGTAKPK

SEQ ID NO: 417888 - protein, 7 aa, Mycobacterium
AEEAGVS

SEQ ID NO: 417889 - protein, 6 aa, Mycobacterium
AEEAGY

SEQ ID NO: 417890 - protein, 6 aa, Mycobacterium
AEEAHE

SEQ ID NO: 417891 - protein, 7 aa, Mycobacterium
AEEAKDY

SEQ ID NO: 417892 - protein, 7 aa, Mycobacterium
AEEAKEY

SEQ ID NO: 417893 - protein, 20 aa, Mycobacterium
AEEALPAEAAEAIEALIRQI

SEQ ID NO: 417894 - protein, 8 aa, Mycobacterium
AEEANNAG

SEQ ID NO: 417895 - protein, 7 aa, Mycobacterium
AEEAPQP

SEQ ID NO: 417896 - protein, 12 aa, Mycobacterium
AEEAPSGRAPVH

SEQ ID NO: 417897 - protein, 13 aa, Mycobacterium
AEEAQGDSNEYRQ

SEQ ID NO: 417898 - protein, 9 aa, Mycobacterium
AEEAQRGDG

SEQ ID NO: 417899 - protein, 10 aa, Mycobacterium
AEEAQRRAAR

SEQ ID NO: 417900 - protein, 5 aa, Mycobacterium
AEEAR

SEQ ID NO: 417901 - protein, 9 aa, Mycobacterium
AEEARRGDG

SEQ ID NO: 417902 - protein, 14 aa, Mycobacterium
AEEARSAAGAAEQS

SEQ ID NO: 417903 - protein, 11 aa, Mycobacterium
AEEATAGLADL

SEQ ID NO: 417904 - protein, 12 aa, Mycobacterium
AEEATDAYEGAR

SEQ ID NO: 417905 - protein, 14 aa, Mycobacterium
AEEAVDASIALLNP

SEQ ID NO: 417906 - protein, 7 aa, Mycobacterium
AEEAVTD

SEQ ID NO: 417907 - protein, 11 aa, Mycobacterium
AEEAYQKARRV

SEQ ID NO: 417908 - protein, 4 aa, Mycobacterium
AEED

SEQ ID NO: 417909 - protein, 10 aa, Mycobacterium
AEEDATVPVG

SEQ ID NO: 417910 - protein, 5 aa, Mycobacterium
AEEDD

SEQ ID NO: 417911 - protein, 12 aa, Mycobacterium
AEEDDEENEGDA

SEQ ID NO: 417912 - protein, 8 aa, Mycobacterium
AEEDDPAA

SEQ ID NO: 417913 - protein, 10 aa, Mycobacterium
AEEDDTVEVG

SEQ ID NO: 417914 - protein, 11 aa, Mycobacterium
AEEDGGTTSID

SEQ ID NO: 417915 - protein, 35 aa, Mycobacterium
AEEDGSDRPNALRDRAQQRAAARQRAASRRKVGPR

SEQ ID NO: 417916 - protein, 6 aa, Mycobacterium
AEEDKQ

SEQ ID NO: 417917 - protein, 6 aa, Mycobacterium
AEEDLP

SEQ ID NO: 417918 - protein, 14 aa, Mycobacterium
AEEDPITGSYRRTH

SEQ ID NO: 417919 - protein, 6 aa, Mycobacterium
AEEDQL

SEQ ID NO: 417920 - protein, 20 aa, Mycobacterium
AEEDRIKTGRNMSNPPGRAI

SEQ ID NO: 417921 - protein, 16 aa, Mycobacterium
AEEDRTLPPRLESPEP

SEQ ID NO: 417922 - protein, 18 aa, Mycobacterium
AEEEGEAAAEALAEADAE

SEQ ID NO: 417923 - protein, 16 aa, Mycobacterium
AEEERFSRRKHGKQAV

SEQ ID NO: 417924 - protein, 7 aa, Mycobacterium
AEEERQR

SEQ ID NO: 417925 - protein, 17 aa, Mycobacterium
AEEGEGAAEALAEADAE

SEQ ID NO: 417926 - protein, 10 aa, Mycobacterium
AEEGFSPTAS

SEQ ID NO: 417927 - protein, 6 aa, Mycobacterium
AEEGGF

SEQ ID NO: 417928 - protein, 11 aa, Mycobacterium
AEEGGSVDRAE

SEQ ID NO: 417929 - protein, 12 aa, Mycobacterium
AEEGKTKAEGIA

SEQ ID NO: 417930 - protein, 8 aa, Mycobacterium
AEEGLAAQ

SEQ ID NO: 417931 - protein, 6 aa, Mycobacterium
AEEGLP

SEQ ID NO: 417932 - protein, 8 aa, Mycobacterium
AEEGLQAQ

SEQ ID NO: 417933 - protein, 7 aa, Mycobacterium
AEEGLRA

SEQ ID NO: 417934 - protein, 13 aa, Mycobacterium
AEEGPLPAARRAR

SEQ ID NO: 417935 - protein, 6 aa, Mycobacterium
AEEGPS

SEQ ID NO: 417936 - protein, 10 aa, Mycobacterium
AEEGRDPVGI

SEQ ID NO: 417937 - protein, 6 aa, Mycobacterium
AEEGRH

SEQ ID NO: 417938 - protein, 17 aa, Mycobacterium
AEEGRKDDIAFLREKLN

SEQ ID NO: 417939 - protein, 6 aa, Mycobacterium
AEEGSD

SEQ ID NO: 417940 - protein, 15 aa, Mycobacterium
AEEGSEKIEAQNPHW

SEQ ID NO: 417941 - protein, 9 aa, Mycobacterium
AEEGSVSTG

SEQ ID NO: 417942 - protein, 7 aa, Mycobacterium
AEEGTDP

SEQ ID NO: 417943 - protein, 6 aa, Mycobacterium
AEEGTS

SEQ ID NO: 417944 - protein, 5 aa, Mycobacterium
AEEGV

SEQ ID NO: 417945 - protein, 9 aa, Mycobacterium
AEEGVDPSP

SEQ ID NO: 417946 - protein, 17 aa, Mycobacterium
AEEGWTTRKNAKGDTEW

SEQ ID NO: 417947 - protein, 4 aa, Mycobacterium
AEEH

SEQ ID NO: 417948 - protein, 7 aa, Mycobacterium
AEEHDGD

SEQ ID NO: 417949 - protein, 4 aa, Mycobacterium
AEEI

SEQ ID NO: 417950 - protein, 12 aa, Mycobacterium
AEEIAAEGTPAA

SEQ ID NO: 417951 - protein, 8 aa, Mycobacterium
AEEKARVD

SEQ ID NO: 417952 - protein, 14 aa, Mycobacterium
AEEKFADKLAGIPR

SEQ ID NO: 417953 - protein, 37 aa, Mycobacterium
AEEKQRQSQAPKAPAPPQAPAVDGKAAQQAPPTPAPA

SEQ ID NO: 417954 - protein, 16 aa, Mycobacterium
AEEKSKVAQPTPEQVR

SEQ ID NO: 417955 - protein, 11 aa, Mycobacterium
AEELAARPPGE

SEQ ID NO: 417956 - protein, 15 aa, Mycobacterium
AEELADSEQGADAYS

SEQ ID NO: 417957 - protein, 8 aa, Mycobacterium
AEELAKND

SEQ ID NO: 417958 - protein, 9 aa, Mycobacterium
AEELAKSDQ

SEQ ID NO: 417959 - protein, 9 aa, Mycobacterium
AEELAKTDE

SEQ ID NO: 417960 - protein, 12 aa, Mycobacterium
AEELGADPHLTS

SEQ ID NO: 417961 - protein, 7 aa, Mycobacterium
AEELTQQ

SEQ ID NO: 417962 - protein, 7 aa, Mycobacterium
AEENDGE

SEQ ID NO: 417963 - protein, 7 aa, Mycobacterium
AEENDRL

SEQ ID NO: 417964 - protein, 6 aa, Mycobacterium
AEENKI

SEQ ID NO: 417965 - protein, 5 aa, Mycobacterium
AEENR

SEQ ID NO: 417966 - protein, 6 aa, Mycobacterium
AEEPAA

SEQ ID NO: 417967 - protein, 11 aa, Mycobacterium
AEEPAGTRARE

SEQ ID NO: 417968 - protein, 21 aa, Mycobacterium
AEEPATEAETAQIKDLIAALG

SEQ ID NO: 417969 - protein, 6 aa, Mycobacterium
AEEPDQ

SEQ ID NO: 417970 - protein, 10 aa, Mycobacterium
AEEPEVAPPE

SEQ ID NO: 417971 - protein, 8 aa, Mycobacterium
AEEPGRRL

SEQ ID NO: 417972 - protein, 7 aa, Mycobacterium
AEEPGTI

SEQ ID NO: 417973 - protein, 13 aa, Mycobacterium
AEEPPRGENGYDG

SEQ ID NO: 417974 - protein, 7 aa, Mycobacterium
AEEPRLT

SEQ ID NO: 417975 - protein, 5 aa, Mycobacterium
AEEPT

SEQ ID NO: 417976 - protein, 5 aa, Mycobacterium
AEEPV

SEQ ID NO: 417977 - protein, 12 aa, Mycobacterium
AEEPVPAAAQLT

SEQ ID NO: 417978 - protein, 20 aa, Mycobacterium
AEEQAEADASADRASQIRTV

SEQ ID NO: 417979 - protein, 7 aa, Mycobacterium
AEEQAER

SEQ ID NO: 417980 - protein, 20 aa, Mycobacterium
AEEQAQADASAGRASQIRTV

SEQ ID NO: 417981 - protein, 19 aa, Mycobacterium
AEEQASADASADRASQIRT

SEQ ID NO: 417982 - protein, 7 aa, Mycobacterium
AEEQLRG

SEQ ID NO: 417983 - protein, 7 aa, Mycobacterium
AEEQNLG

SEQ ID NO: 417984 - protein, 7 aa, Mycobacterium
AEEQRRG

SEQ ID NO: 417985 - protein, 10 aa, Mycobacterium
AEEQRTPHAR

SEQ ID NO: 417986 - protein, 4 aa, Mycobacterium
AEER

SEQ ID NO: 417987 - protein, 12 aa, Mycobacterium
AEERAATAQGDQ

SEQ ID NO: 417988 - protein, 21 aa, Mycobacterium
AEERARRRNAQNVANGLPDDY

SEQ ID NO: 417989 - protein, 8 aa, Mycobacterium
AEEREIRD

SEQ ID NO: 417990 - protein, 8 aa, Mycobacterium
AEERETGN

SEQ ID NO: 417991 - protein, 7 aa, Mycobacterium
AEERGRT

SEQ ID NO: 417992 - protein, 15 aa, Mycobacterium
AEERGYTATRHQREV

SEQ ID NO: 417993 - protein, 12 aa, Mycobacterium
AEERISSPTQIR

SEQ ID NO: 417994 - protein, 6 aa, Mycobacterium
AEERKI

SEQ ID NO: 417995 - protein, 5 aa, Mycobacterium
AEERP

SEQ ID NO: 417996 - protein, 9 aa, Mycobacterium
AEERQRARR

SEQ ID NO: 417997 - protein, 8 aa, Mycobacterium
AEERRQKM

SEQ ID NO: 417998 - protein, 8 aa, Mycobacterium
AEERRQRY

SEQ ID NO: 417999 - protein, 15 aa, Mycobacterium
AEERRSSARDIAETE

SEQ ID NO: 418000 - protein, 5 aa, Mycobacterium
AEESA

SEQ ID NO: 418001 - protein, 9 aa, Mycobacterium
AEESAADEM

SEQ ID NO: 418002 - protein, 11 aa, Mycobacterium
AEESAASGAGD

SEQ ID NO: 418003 - protein, 13 aa, Mycobacterium
AEESADLAKAAPI

SEQ ID NO: 418004 - protein, 9 aa, Mycobacterium
AEESDDGRR

SEQ ID NO: 418005 - protein, 10 aa, Mycobacterium
AEESDHAKAG

SEQ ID NO: 418006 - protein, 7 aa, Mycobacterium
AEESERV

SEQ ID NO: 418007 - protein, 13 aa, Mycobacterium
AEESGVSSEPEIA

SEQ ID NO: 418008 - protein, 7 aa, Mycobacterium
AEESLSE

SEQ ID NO: 418009 - protein, 6 aa, Mycobacterium
AEESRD

SEQ ID NO: 418010 - protein, 11 aa, Mycobacterium
AEESRTGAPVT

SEQ ID NO: 418011 - protein, 9 aa, Mycobacterium
AEESSVAQA

SEQ ID NO: 418012 - protein, 6 aa, Mycobacterium
AEESTW

SEQ ID NO: 418013 - protein, 10 aa, Mycobacterium
AEESVDAYGG

SEQ ID NO: 418014 - protein, 15 aa, Mycobacterium
AEETADAVGSSAGAV

SEQ ID NO: 418015 - protein, 14 aa, Mycobacterium
AEETASAVGSTTGA

SEQ ID NO: 418016 - protein, 13 aa, Mycobacterium
AEETASQGRAAAA

SEQ ID NO: 418017 - protein, 6 aa, Mycobacterium
AEETDH

SEQ ID NO: 418018 - protein, 12 aa, Mycobacterium
AEETDRNPPRLQ

SEQ ID NO: 418019 - protein, 7 aa, Mycobacterium
AEETDYQ

SEQ ID NO: 418020 - protein, 9 aa, Mycobacterium
AEETEIDEP

SEQ ID NO: 418021 - protein, 13 aa, Mycobacterium
AEETELQDKDVIA

SEQ ID NO: 418022 - protein, 6 aa, Mycobacterium
AEETGA

SEQ ID NO: 418023 - protein, 11 aa, Mycobacterium
AEETGEGARGM

SEQ ID NO: 418024 - protein, 6 aa, Mycobacterium
AEETGF

SEQ ID NO: 418025 - protein, 7 aa, Mycobacterium
AEETGIK

SEQ ID NO: 418026 - protein, 7 aa, Mycobacterium
AEETGIQ

SEQ ID NO: 418027 - protein, 11 aa, Mycobacterium
AEETGRHSYGP

SEQ ID NO: 418028 - protein, 8 aa, Mycobacterium
AEETGRPL

SEQ ID NO: 418029 - protein, 18 aa, Mycobacterium
AEETGYDFDPDSPDLEGT

SEQ ID NO: 418030 - protein, 5 aa, Mycobacterium
AEETR

SEQ ID NO: 418031 - protein, 8 aa, Mycobacterium
AEETRGTC

SEQ ID NO: 418032 - protein, 6 aa, Mycobacterium
AEETSV

SEQ ID NO: 418033 - protein, 10 aa, Mycobacterium
AEETTDDPAL

SEQ ID NO: 418034 - protein, 12 aa, Mycobacterium
AEETTEPSAVAG

SEQ ID NO: 418035 - protein, 7 aa, Mycobacterium
AEETYGP

SEQ ID NO: 418036 - protein, 5 aa, Mycobacterium
AEEVD

SEQ ID NO: 418037 - protein, 7 aa, Mycobacterium
AEEVGDR

SEQ ID NO: 418038 - protein, 4 aa, Mycobacterium
AEEW

SEQ ID NO: 418039 - protein, 6 aa, Mycobacterium
AEEYGG

SEQ ID NO: 418040 - protein, 5 aa, Mycobacterium
AEEYR

SEQ ID NO: 418041 - protein, 13 aa, Mycobacterium
AEEYRRNRFARLD

SEQ ID NO: 418042 - protein, 4 aa, Mycobacterium
AEFA

SEQ ID NO: 418043 - protein, 11 aa, Mycobacterium
AEFADAEEEAH

SEQ ID NO: 418044 - protein, 7 aa, Mycobacterium
AEFAERE

SEQ ID NO: 418045 - protein, 11 aa, Mycobacterium
AEFASEGAPED

SEQ ID NO: 418046 - protein, 12 aa, Mycobacterium
AEFASQGAPKDL

SEQ ID NO: 418047 - protein, 14 aa, Mycobacterium
AEFDDTDQAETTLR

SEQ ID NO: 418048 - protein, 6 aa, Mycobacterium
AEFDER

SEQ ID NO: 418049 - protein, 13 aa, Mycobacterium
AEFDPEADPNYTA

SEQ ID NO: 418050 - protein, 7 aa, Mycobacterium
AEFDPGK

SEQ ID NO: 418051 - protein, 19 aa, Mycobacterium
AEFDSRREGFTPPSPRYQT

SEQ ID NO: 418052 - protein, 15 aa, Mycobacterium
AEFEPKAQRPTPGSA

SEQ ID NO: 418053 - protein, 6 aa, Mycobacterium
AEFESG

SEQ ID NO: 418054 - protein, 8 aa, Mycobacterium
AEFGEADL

SEQ ID NO: 418055 - protein, 14 aa, Mycobacterium
AEFGESTFAGSSMN

SEQ ID NO: 418056 - protein, 7 aa, Mycobacterium
AEFPDGA

SEQ ID NO: 418057 - protein, 8 aa, Mycobacterium
AEFPEADL

SEQ ID NO: 418058 - protein, 4 aa, Mycobacterium
AEFT

SEQ ID NO: 418059 - protein, 6 aa, Mycobacterium
AEFTGS

SEQ ID NO: 418060 - protein, 11 aa, Mycobacterium
AEFTTQGAPHD

SEQ ID NO: 418061 - protein, 17 aa, Mycobacterium
AEGAAAAAVPAIPAIRA

SEQ ID NO: 418062 - protein, 11 aa, Mycobacterium
AEGAAAGGNQF

SEQ ID NO: 418063 - protein, 10 aa, Mycobacterium
AEGAAAKEAG

SEQ ID NO: 418064 - protein, 12 aa, Mycobacterium
AEGAAGVAEGEQ

SEQ ID NO: 418065 - protein, 12 aa, Mycobacterium
AEGAAKAGRSVS

SEQ ID NO: 418066 - protein, 8 aa, Mycobacterium
AEGAAQGA

SEQ ID NO: 418067 - protein, 10 aa, Mycobacterium
AEGAAWDPAQ

SEQ ID NO: 418068 - protein, 5 aa, Mycobacterium
AEGAD

SEQ ID NO: 418069 - protein, 6 aa, Mycobacterium
AEGADI

SEQ ID NO: 418070 - protein, 9 aa, Mycobacterium
AEGADIEYS

SEQ ID NO: 418071 - protein, 6 aa, Mycobacterium
AEGADS

SEQ ID NO: 418072 - protein, 7 aa, Mycobacterium
AEGAELP

SEQ ID NO: 418073 - protein, 6 aa, Mycobacterium
AEGAER

SEQ ID NO: 418074 - protein, 10 aa, Mycobacterium
AEGAERPAVG

SEQ ID NO: 418075 - protein, 45 aa, Mycobacterium
AEGAGDPSGPDDPDGGGTDPEYRSPFPPPPSSQSTGYQPIPVDIG

SEQ ID NO: 418076 - protein, 13 aa, Mycobacterium
AEGAGKLTPTQRS

SEQ ID NO: 418077 - protein, 23 aa, Mycobacterium
AEGAGLKPSDTDDTRSPLRKPKF

SEQ ID NO: 418078 - protein, 6 aa, Mycobacterium
AEGAGT

SEQ ID NO: 418079 - protein, 6 aa, Mycobacterium
AEGAGV

SEQ ID NO: 418080 - protein, 6 aa, Mycobacterium
AEGAGY

SEQ ID NO: 418081 - protein, 5 aa, Mycobacterium
AEGAK

SEQ ID NO: 418082 - protein, 20 aa, Mycobacterium
AEGALDAARHADAELARGHD

SEQ ID NO: 418083 - protein, 6 aa, Mycobacterium
AEGANA

SEQ ID NO: 418084 - protein, 7 aa, Mycobacterium
AEGAPGS

SEQ ID NO: 418085 - protein, 13 aa, Mycobacterium
AEGAQKSGRSPSE

SEQ ID NO: 418086 - protein, 15 aa, Mycobacterium
AEGARDRDLDDENPF

SEQ ID NO: 418087 - protein, 11 aa, Mycobacterium
AEGARGDGAAA

SEQ ID NO: 418088 - protein, 11 aa, Mycobacterium
AEGARGNAEAA

SEQ ID NO: 418089 - protein, 10 aa, Mycobacterium
AEGARLGDDA

SEQ ID NO: 418090 - protein, 7 aa, Mycobacterium
AEGARLP

SEQ ID NO: 418091 - protein, 11 aa, Mycobacterium
AEGARLPDGIA

SEQ ID NO: 418092 - protein, 5 aa, Mycobacterium
AEGAS

SEQ ID NO: 418093 - protein, 5 aa, Mycobacterium
AEGAW

SEQ ID NO: 418094 - protein, 6 aa, Mycobacterium
AEGAYT

SEQ ID NO: 418095 - protein, 9 aa, Mycobacterium
AEGCDPQDV

SEQ ID NO: 418096 - protein, 8 aa, Mycobacterium
AEGDAWPS

SEQ ID NO: 418097 - protein, 7 aa, Mycobacterium
AEGDDFD

SEQ ID NO: 418098 - protein, 6 aa, Mycobacterium
AEGDDL

SEQ ID NO: 418099 - protein, 9 aa, Mycobacterium
AEGDDLETR

SEQ ID NO: 418100 - protein, 6 aa, Mycobacterium
AEGDGA

SEQ ID NO: 418101 - protein, 6 aa, Mycobacterium
AEGDLD

SEQ ID NO: 418102 - protein, 12 aa, Mycobacterium
AEGDLRDDVDPE

SEQ ID NO: 418103 - protein, 7 aa, Mycobacterium
AEGDPHR

SEQ ID NO: 418104 - protein, 13 aa, Mycobacterium
AEGDPLSGTYQRT

SEQ ID NO: 418105 - protein, 5 aa, Mycobacterium
AEGDQ

SEQ ID NO: 418106 - protein, 11 aa, Mycobacterium
AEGDQNAGNSI

SEQ ID NO: 418107 - protein, 8 aa, Mycobacterium
AEGDRAAA

SEQ ID NO: 418108 - protein, 9 aa, Mycobacterium
AEGDRQAGE

SEQ ID NO: 418109 - protein, 6 aa, Mycobacterium
AEGDRY

SEQ ID NO: 418110 - protein, 7 aa, Mycobacterium
AEGDRYR

SEQ ID NO: 418111 - protein, 12 aa, Mycobacterium
AEGDSVDAGQTI

SEQ ID NO: 418112 - protein, 16 aa, Mycobacterium
AEGDSVNNYRAGKQAD

SEQ ID NO: 418113 - protein, 9 aa, Mycobacterium
AEGDVDRAR

SEQ ID NO: 418114 - protein, 6 aa, Mycobacterium
AEGDVE

SEQ ID NO: 418115 - protein, 7 aa, Mycobacterium
AEGDWKT

SEQ ID NO: 418116 - protein, 7 aa, Mycobacterium
AEGEAYR

SEQ ID NO: 418117 - protein, 5 aa, Mycobacterium
AEGED

SEQ ID NO: 418118 - protein, 7 aa, Mycobacterium
AEGEDAQ

SEQ ID NO: 418119 - protein, 5 aa, Mycobacterium
AEGEG

SEQ ID NO: 418120 - protein, 18 aa, Mycobacterium
AEGEGGKLVDNGDTTYGG

SEQ ID NO: 418121 - protein, 7 aa, Mycobacterium
AEGEGVD

SEQ ID NO: 418122 - protein, 11 aa, Mycobacterium
AEGEHPDQESD

SEQ ID NO: 418123 - protein, 13 aa, Mycobacterium
AEGEKACAGAGRS

SEQ ID NO: 418124 - protein, 12 aa, Mycobacterium
AEGEKPSRVGEL

SEQ ID NO: 418125 - protein, 16 aa, Mycobacterium
AEGENGTTTLTAPFDG

SEQ ID NO: 418126 - protein, 13 aa, Mycobacterium
AEGEPDLEHEEQD

SEQ ID NO: 418127 - protein, 9 aa, Mycobacterium
AEGEPNPTI

SEQ ID NO: 418128 - protein, 5 aa, Mycobacterium
AEGEV

SEQ ID NO: 418129 - protein, 11 aa, Mycobacterium
AEGEVNPELDP

SEQ ID NO: 418130 - protein, 6 aa, Mycobacterium
AEGEYS

SEQ ID NO: 418131 - protein, 4 aa, Mycobacterium
AEGF

SEQ ID NO: 418132 - protein, 8 aa, Mycobacterium
AEGFGGAA

SEQ ID NO: 418133 - protein, 5 aa, Mycobacterium
AEGFP

SEQ ID NO: 418134 - protein, 6 aa, Mycobacterium
AEGFPS

SEQ ID NO: 418135 - protein, 5 aa, Mycobacterium
AEGFR

SEQ ID NO: 418136 - protein, 8 aa, Mycobacterium
AEGFSPES

SEQ ID NO: 418137 - protein, 5 aa, Mycobacterium
AEGGA

SEQ ID NO: 418138 - protein, 9 aa, Mycobacterium
AEGGAGLDP

SEQ ID NO: 418139 - protein, 8 aa, Mycobacterium
AEGGAGTR

SEQ ID NO: 418140 - protein, 24 aa, Mycobacterium
AEGGAHQSIKTPSIGLEQPGCQSY

SEQ ID NO: 418141 - protein, 23 aa, Mycobacterium
AEGGDDADQKLAEASAAIARLVR

SEQ ID NO: 418142 - protein, 23 aa, Mycobacterium
AEGGDEADTKLSEASAAIARLVR

SEQ ID NO: 418143 - protein, 7 aa, Mycobacterium
AEGGDIP

SEQ ID NO: 418144 - protein, 11 aa, Mycobacterium
AEGGELGAESS

SEQ ID NO: 418145 - protein, 8 aa, Mycobacterium
AEGGGNPV

SEQ ID NO: 418146 - protein, 7 aa, Mycobacterium
AEGGGVQ

SEQ ID NO: 418147 - protein, 5 aa, Mycobacterium
AEGGK

SEQ ID NO: 418148 - protein, 5 aa, Mycobacterium
AEGGL

SEQ ID NO: 418149 - protein, 7 aa, Mycobacterium
AEGGPQT

SEQ ID NO: 418150 - protein, 5 aa, Mycobacterium
AEGGQ

SEQ ID NO: 418151 - protein, 5 aa, Mycobacterium
AEGGR

SEQ ID NO: 418152 - protein, 12 aa, Mycobacterium
AEGGSSPTRGQL

SEQ ID NO: 418153 - protein, 23 aa, Mycobacterium
AEGGTDADGKLAEASAAIARLVR

SEQ ID NO: 418154 - protein, 23 aa, Mycobacterium
AEGGTEADSKLAEASAAIARLVR

SEQ ID NO: 418155 - protein, 6 aa, Mycobacterium
AEGGTS

SEQ ID NO: 418156 - protein, 6 aa, Mycobacterium
AEGGYA

SEQ ID NO: 418157 - protein, 4 aa, Mycobacterium
AEGH

SEQ ID NO: 418158 - protein, 8 aa, Mycobacterium
AEGHERDA

SEQ ID NO: 418159 - protein, 7 aa, Mycobacterium
AEGHPQK

SEQ ID NO: 418160 - protein, 7 aa, Mycobacterium
AEGHRGA

SEQ ID NO: 418161 - protein, 11 aa, Mycobacterium
AEGHSRVAPEP

SEQ ID NO: 418162 - protein, 38 aa, Mycobacterium
AEGHTEDRTGQAVPQPPEAPAPADLPADEAEPPAGNRT

SEQ ID NO: 418163 - protein, 9 aa, Mycobacterium
AEGHTPSVQ

SEQ ID NO: 418164 - protein, 13 aa, Mycobacterium
AEGIDAGAVKGGT

SEQ ID NO: 418165 - protein, 5 aa, Mycobacterium
AEGIP

SEQ ID NO: 418166 - protein, 11 aa, Mycobacterium
AEGKAKRDPAL

SEQ ID NO: 418167 - protein, 11 aa, Mycobacterium
AEGKATELANR

SEQ ID NO: 418168 - protein, 5 aa, Mycobacterium
AEGKF

SEQ ID NO: 418169 - protein, 10 aa, Mycobacterium
AEGKGDSLGV

SEQ ID NO: 418170 - protein, 5 aa, Mycobacterium
AEGKL

SEQ ID NO: 418171 - protein, 6 aa, Mycobacterium
AEGKNA

SEQ ID NO: 418172 - protein, 9 aa, Mycobacterium
AEGKPLGGI

SEQ ID NO: 418173 - protein, 6 aa, Mycobacterium
AEGKPV

SEQ ID NO: 418174 - protein, 9 aa, Mycobacterium
AEGKQHPSV

SEQ ID NO: 418175 - protein, 15 aa, Mycobacterium
AEGKSVVAGEPAKSI

SEQ ID NO: 418176 - protein, 8 aa, Mycobacterium
AEGKVSQF

SEQ ID NO: 418177 - protein, 14 aa, Mycobacterium
AEGLDTGARLSPTF

SEQ ID NO: 418178 - protein, 8 aa, Mycobacterium
AEGLGGPA

SEQ ID NO: 418179 - protein, 7 aa, Mycobacterium
AEGLNAD

SEQ ID NO: 418180 - protein, 7 aa, Mycobacterium
AEGLPGR

SEQ ID NO: 418181 - protein, 5 aa, Mycobacterium
AEGLR

SEQ ID NO: 418182 - protein, 13 aa, Mycobacterium
AEGLRETQKTGES

SEQ ID NO: 418183 - protein, 14 aa, Mycobacterium
AEGLRGEAQIIAAY

SEQ ID NO: 418184 - protein, 6 aa, Mycobacterium
AEGLSQ

SEQ ID NO: 418185 - protein, 6 aa, Mycobacterium
AEGLTE

SEQ ID NO: 418186 - protein, 12 aa, Mycobacterium
AEGMADSVLPAT

SEQ ID NO: 418187 - protein, 16 aa, Mycobacterium
AEGNATAQQLATARQQ

SEQ ID NO: 418188 - protein, 8 aa, Mycobacterium
AEGNEEQR

SEQ ID NO: 418189 - protein, 8 aa, Mycobacterium
AEGNEGFS

SEQ ID NO: 418190 - protein, 8 aa, Mycobacterium
AEGNGAGA

SEQ ID NO: 418191 - protein, 8 aa, Mycobacterium
AEGNHLGP

SEQ ID NO: 418192 - protein, 8 aa, Mycobacterium
AEGNHMGP

SEQ ID NO: 418193 - protein, 17 aa, Mycobacterium
AEGNLGRKTGQGFFRWS

SEQ ID NO: 418194 - protein, 11 aa, Mycobacterium
AEGNPESGMED

SEQ ID NO: 418195 - protein, 9 aa, Mycobacterium
AEGNPTGGR

SEQ ID NO: 418196 - protein, 14 aa, Mycobacterium
AEGNRGGGDGHSGF

SEQ ID NO: 418197 - protein, 9 aa, Mycobacterium
AEGNRQSAH

SEQ ID NO: 418198 - protein, 8 aa, Mycobacterium
AEGNSARA

SEQ ID NO: 418199 - protein, 7 aa, Mycobacterium
AEGPAAV

SEQ ID NO: 418200 - protein, 6 aa, Mycobacterium
AEGPAM

SEQ ID NO: 418201 - protein, 8 aa, Mycobacterium
AEGPASTL

SEQ ID NO: 418202 - protein, 8 aa, Mycobacterium
AEGPEADA

SEQ ID NO: 418203 - protein, 9 aa, Mycobacterium
AEGPGLTPA

SEQ ID NO: 418204 - protein, 6 aa, Mycobacterium
AEGPHM

SEQ ID NO: 418205 - protein, 6 aa, Mycobacterium
AEGPHS

SEQ ID NO: 418206 - protein, 7 aa, Mycobacterium
AEGPKNV

SEQ ID NO: 418207 - protein, 6 aa, Mycobacterium
AEGPVA

SEQ ID NO: 418208 - protein, 4 aa, Mycobacterium
AEGQ

SEQ ID NO: 418209 - protein, 6 aa, Mycobacterium
AEGQAE

SEQ ID NO: 418210 - protein, 7 aa, Mycobacterium
AEGQANE

SEQ ID NO: 418211 - protein, 8 aa, Mycobacterium
AEGQANEL

SEQ ID NO: 418212 - protein, 10 aa, Mycobacterium
AEGQGADGNH

SEQ ID NO: 418213 - protein, 7 aa, Mycobacterium
AEGQGMT

SEQ ID NO: 418214 - protein, 11 aa, Mycobacterium
AEGQPRGGPAL

SEQ ID NO: 418215 - protein, 9 aa, Mycobacterium
AEGQRARSA

SEQ ID NO: 418216 - protein, 21 aa, Mycobacterium
AEGQRGAREAAHRNSTRRLRR

SEQ ID NO: 418217 - protein, 7 aa, Mycobacterium
AEGQRVA

SEQ ID NO: 418218 - protein, 5 aa, Mycobacterium
AEGQS

SEQ ID NO: 418219 - protein, 5 aa, Mycobacterium
AEGRA

SEQ ID NO: 418220 - protein, 7 aa, Mycobacterium
AEGRASA

SEQ ID NO: 418221 - protein, 8 aa, Mycobacterium
AEGRDDEA

SEQ ID NO: 418222 - protein, 10 aa, Mycobacterium
AEGRDGPDVE

SEQ ID NO: 418223 - protein, 5 aa, Mycobacterium
AEGRE

SEQ ID NO: 418224 - protein, 10 aa, Mycobacterium
AEGRGDEAAS

SEQ ID NO: 418225 - protein, 8 aa, Mycobacterium
AEGRGPAW

SEQ ID NO: 418226 - protein, 7 aa, Mycobacterium
AEGRGTR

SEQ ID NO: 418227 - protein, 5 aa, Mycobacterium
AEGRK

SEQ ID NO: 418228 - protein, 5 aa, Mycobacterium
AEGRL

SEQ ID NO: 418229 - protein, 13 aa, Mycobacterium
AEGRNTGKPNHVT

SEQ ID NO: 418230 - protein, 11 aa, Mycobacterium
AEGRPALERTE

SEQ ID NO: 418231 - protein, 6 aa, Mycobacterium
AEGRPC

SEQ ID NO: 418232 - protein, 10 aa, Mycobacterium
AEGRPENATA

SEQ ID NO: 418233 - protein, 9 aa, Mycobacterium
AEGRPGSDV

SEQ ID NO: 418234 - protein, 5 aa, Mycobacterium
AEGRQ

SEQ ID NO: 418235 - protein, 8 aa, Mycobacterium
AEGRRGGE

SEQ ID NO: 418236 - protein, 8 aa, Mycobacterium
AEGRRTAR

SEQ ID NO: 418237 - protein, 8 aa, Mycobacterium
AEGRRTDP

SEQ ID NO: 418238 - protein, 6 aa, Mycobacterium
AEGRSR

SEQ ID NO: 418239 - protein, 7 aa, Mycobacterium
AEGRTDA

SEQ ID NO: 418240 - protein, 9 aa, Mycobacterium
AEGRTPAGV

SEQ ID NO: 418241 - protein, 5 aa, Mycobacterium
AEGSA

SEQ ID NO: 418242 - protein, 8 aa, Mycobacterium
AEGSAACE

SEQ ID NO: 418243 - protein, 14 aa, Mycobacterium
AEGSAGEGGEVSPK

SEQ ID NO: 418244 - protein, 10 aa, Mycobacterium
AEGSDGPRVG

SEQ ID NO: 418245 - protein, 10 aa, Mycobacterium
AEGSEDRRIS

SEQ ID NO: 418246 - protein, 16 aa, Mycobacterium
AEGSEPPEEESTESYF

SEQ ID NO: 418247 - protein, 7 aa, Mycobacterium
AEGSGGR

SEQ ID NO: 418248 - protein, 14 aa, Mycobacterium
AEGSGPPDDETGQT

SEQ ID NO: 418249 - protein, 9 aa, Mycobacterium
AEGSGSAGA

SEQ ID NO: 418250 - protein, 11 aa, Mycobacterium
AEGSHGGPREV

SEQ ID NO: 418251 - protein, 7 aa, Mycobacterium
AEGSISE

SEQ ID NO: 418252 - protein, 8 aa, Mycobacterium
AEGSISED

SEQ ID NO: 418253 - protein, 11 aa, Mycobacterium
AEGSNTARGGV

SEQ ID NO: 418254 - protein, 7 aa, Mycobacterium
AEGSPDT

SEQ ID NO: 418255 - protein, 6 aa, Mycobacterium
AEGSRF

SEQ ID NO: 418256 - protein, 6 aa, Mycobacterium
AEGSRG

SEQ ID NO: 418257 - protein, 9 aa, Mycobacterium
AEGSSADSF

SEQ ID NO: 418258 - protein, 11 aa, Mycobacterium
AEGSSSKAGLG

SEQ ID NO: 418259 - protein, 26 aa, Mycobacterium
AEGSTHGYDVTDPTTVSPALGGPDGL

SEQ ID NO: 418260 - protein, 11 aa, Mycobacterium
AEGSVGHADAE

SEQ ID NO: 418261 - protein, 14 aa, Mycobacterium
AEGSYGSSDQYAGR

SEQ ID NO: 418262 - protein, 7 aa, Mycobacterium
AEGSYTA

SEQ ID NO: 418263 - protein, 5 aa, Mycobacterium
AEGTA

SEQ ID NO: 418264 - protein, 7 aa, Mycobacterium
AEGTAED

SEQ ID NO: 418265 - protein, 7 aa, Mycobacterium
AEGTAYG

SEQ ID NO: 418266 - protein, 17 aa, Mycobacterium
AEGTDEPYYPINTESDR

SEQ ID NO: 418267 - protein, 6 aa, Mycobacterium
AEGTDR

SEQ ID NO: 418268 - protein, 6 aa, Mycobacterium
AEGTEF

SEQ ID NO: 418269 - protein, 7 aa, Mycobacterium
AEGTEGH

SEQ ID NO: 418270 - protein, 7 aa, Mycobacterium
AEGTGEQ

SEQ ID NO: 418271 - protein, 6 aa, Mycobacterium
AEGTGL

SEQ ID NO: 418272 - protein, 32 aa, Mycobacterium
AEGTGSTAEGTATGGDGGHSTGTGIGGNGGIG

SEQ ID NO: 418273 - protein, 5 aa, Mycobacterium
AEGTN

SEQ ID NO: 418274 - protein, 8 aa, Mycobacterium
AEGTPEDI

SEQ ID NO: 418275 - protein, 9 aa, Mycobacterium
AEGTPEDVA

SEQ ID NO: 418276 - protein, 16 aa, Mycobacterium
AEGTPFPADERRPGQT

SEQ ID NO: 418277 - protein, 17 aa, Mycobacterium
AEGTPLPADERRPGQSV

SEQ ID NO: 418278 - protein, 10 aa, Mycobacterium
AEGTPQQMGA

SEQ ID NO: 418279 - protein, 7 aa, Mycobacterium
AEGTQFR

SEQ ID NO: 418280 - protein, 5 aa, Mycobacterium
AEGTS

SEQ ID NO: 418281 - protein, 7 aa, Mycobacterium
AEGTVAG

SEQ ID NO: 418282 - protein, 24 aa, Mycobacterium
AEGTVDTAGSDPDAAADEQSDPVD

SEQ ID NO: 418283 - protein, 23 aa, Mycobacterium
AEGTVSAGADDEPVTEGDPIDET

SEQ ID NO: 418284 - protein, 6 aa, Mycobacterium
AEGTVT

SEQ ID NO: 418285 - protein, 5 aa, Mycobacterium
AEGVA

SEQ ID NO: 418286 - protein, 8 aa, Mycobacterium
AEGVATGT

SEQ ID NO: 418287 - protein, 15 aa, Mycobacterium
AEGVAVEPSAATDFS

SEQ ID NO: 418288 - protein, 9 aa, Mycobacterium
AEGVGASET

SEQ ID NO: 418289 - protein, 7 aa, Mycobacterium
AEGVGGA

SEQ ID NO: 418290 - protein, 6 aa, Mycobacterium
AEGVKA

SEQ ID NO: 418291 - protein, 10 aa, Mycobacterium
AEGVKAEYPD

SEQ ID NO: 418292 - protein, 10 aa, Mycobacterium
AEGVKSEFPD

SEQ ID NO: 418293 - protein, 7 aa, Mycobacterium
AEGVNPA

SEQ ID NO: 418294 - protein, 8 aa, Mycobacterium
AEGVPTSS

SEQ ID NO: 418295 - protein, 13 aa, Mycobacterium
AEGVTDDHRRDDL

SEQ ID NO: 418296 - protein, 7 aa, Mycobacterium
AEGWSSP

SEQ ID NO: 418297 - protein, 4 aa, Mycobacterium
AEGY

SEQ ID NO: 418298 - protein, 27 aa, Mycobacterium
AEGYDGAPLHGADADGVAPPSPAQQAA

SEQ ID NO: 418299 - protein, 11 aa, Mycobacterium
AEGYEVTGTAN

SEQ ID NO: 418300 - protein, 7 aa, Mycobacterium
AEGYGGA

SEQ ID NO: 418301 - protein, 8 aa, Mycobacterium
AEGYPGRR

SEQ ID NO: 418302 - protein, 6 aa, Mycobacterium
AEGYRD

SEQ ID NO: 418303 - protein, 4 aa, Mycobacterium
AEHA

SEQ ID NO: 418304 - protein, 13 aa, Mycobacterium
AEHADAAARDNAA

SEQ ID NO: 418305 - protein, 7 aa, Mycobacterium
AEHADSV

SEQ ID NO: 418306 - protein, 5 aa, Mycobacterium
AEHAG

SEQ ID NO: 418307 - protein, 13 aa, Mycobacterium
AEHAGPGIPPHHR

SEQ ID NO: 418308 - protein, 5 aa, Mycobacterium
AEHAR

SEQ ID NO: 418309 - protein, 7 aa, Mycobacterium
AEHARSA

SEQ ID NO: 418310 - protein, 7 aa, Mycobacterium
AEHASAQ

SEQ ID NO: 418311 - protein, 5 aa, Mycobacterium
AEHDD

SEQ ID NO: 418312 - protein, 9 aa, Mycobacterium
AEHDGERAA

SEQ ID NO: 418313 - protein, 6 aa, Mycobacterium
AEHDGP

SEQ ID NO: 418314 - protein, 6 aa, Mycobacterium
AEHDPA

SEQ ID NO: 418315 - protein, 18 aa, Mycobacterium
AEHDPDFGRGASAYDGYW

SEQ ID NO: 418316 - protein, 4 aa, Mycobacterium
AEHE

SEQ ID NO: 418317 - protein, 6 aa, Mycobacterium
AEHEAQ

SEQ ID NO: 418318 - protein, 9 aa, Mycobacterium
AEHEESEEF

SEQ ID NO: 418319 - protein, 6 aa, Mycobacterium
AEHEGK

SEQ ID NO: 418320 - protein, 9 aa, Mycobacterium
AEHGAEPAC

SEQ ID NO: 418321 - protein, 6 aa, Mycobacterium
AEHGER

SEQ ID NO: 418322 - protein, 5 aa, Mycobacterium
AEHGG

SEQ ID NO: 418323 - protein, 12 aa, Mycobacterium
AEHGNGAARQRR

SEQ ID NO: 418324 - protein, 8 aa, Mycobacterium
AEHGPDSP

SEQ ID NO: 418325 - protein, 14 aa, Mycobacterium
AEHGPIERKDGEMR

SEQ ID NO: 418326 - protein, 11 aa, Mycobacterium
AEHGPRARSAW

SEQ ID NO: 418327 - protein, 11 aa, Mycobacterium
AEHGPRSRSAW

SEQ ID NO: 418328 - protein, 7 aa, Mycobacterium
AEHGSPA

SEQ ID NO: 418329 - protein, 7 aa, Mycobacterium
AEHGTPS

SEQ ID NO: 418330 - protein, 13 aa, Mycobacterium
AEHGTVERDASGL

SEQ ID NO: 418331 - protein, 9 aa, Mycobacterium
AEHGVSRSV

SEQ ID NO: 418332 - protein, 10 aa, Mycobacterium
AEHGVSRSVA

SEQ ID NO: 418333 - protein, 4 aa, Mycobacterium
AEHI

SEQ ID NO: 418334 - protein, 5 aa, Mycobacterium
AEHIS

SEQ ID NO: 418335 - protein, 13 aa, Mycobacterium
AEHKKGKLDSDQM

SEQ ID NO: 418336 - protein, 5 aa, Mycobacterium
AEHNR

SEQ ID NO: 418337 - protein, 8 aa, Mycobacterium
AEHPAAGA

SEQ ID NO: 418338 - protein, 5 aa, Mycobacterium
AEHPG

SEQ ID NO: 418339 - protein, 6 aa, Mycobacterium
AEHPGL

SEQ ID NO: 418340 - protein, 19 aa, Mycobacterium
AEHPHAAQQPIPFEIKQVA

SEQ ID NO: 418341 - protein, 7 aa, Mycobacterium
AEHPKAG

SEQ ID NO: 418342 - protein, 11 aa, Mycobacterium
AEHPPVPLPGV

SEQ ID NO: 418343 - protein, 6 aa, Mycobacterium
AEHPRL

SEQ ID NO: 418344 - protein, 7 aa, Mycobacterium
AEHPRLG

SEQ ID NO: 418345 - protein, 8 aa, Mycobacterium
AEHPRLGP

SEQ ID NO: 418346 - protein, 6 aa, Mycobacterium
AEHPRP

SEQ ID NO: 418347 - protein, 7 aa, Mycobacterium
AEHPSTG

SEQ ID NO: 418348 - protein, 8 aa, Mycobacterium
AEHPTRNA

SEQ ID NO: 418349 - protein, 14 aa, Mycobacterium
AEHPTTENTVPGTV

SEQ ID NO: 418350 - protein, 4 aa, Mycobacterium
AEHQ

SEQ ID NO: 418351 - protein, 4 aa, Mycobacterium
AEHR

SEQ ID NO: 418352 - protein, 16 aa, Mycobacterium
AEHRAASSVKEKNDWS

SEQ ID NO: 418353 - protein, 15 aa, Mycobacterium
AEHRAQIAQEYRAAD

SEQ ID NO: 418354 - protein, 6 aa, Mycobacterium
AEHRAS

SEQ ID NO: 418355 - protein, 5 aa, Mycobacterium
AEHRD

SEQ ID NO: 418356 - protein, 8 aa, Mycobacterium
AEHRDPEA

SEQ ID NO: 418357 - protein, 17 aa, Mycobacterium
AEHRGGHHQPAPGRTAV

SEQ ID NO: 418358 - protein, 9 aa, Mycobacterium
AEHRHDANA

SEQ ID NO: 418359 - protein, 8 aa, Mycobacterium
AEHSEGLV

SEQ ID NO: 418360 - protein, 8 aa, Mycobacterium
AEHSGARD

SEQ ID NO: 418361 - protein, 5 aa, Mycobacterium
AEHSR

SEQ ID NO: 418362 - protein, 12 aa, Mycobacterium
AEHSVDPVDSPV

SEQ ID NO: 418363 - protein, 4 aa, Mycobacterium
AEHT

SEQ ID NO: 418364 - protein, 7 aa, Mycobacterium
AEHTARE

SEQ ID NO: 418365 - protein, 9 aa, Mycobacterium
AEHTATRTT

SEQ ID NO: 418366 - protein, 7 aa, Mycobacterium
AEHTGGP

SEQ ID NO: 418367 - protein, 6 aa, Mycobacterium
AEHTPE

SEQ ID NO: 418368 - protein, 4 aa, Mycobacterium
AEHV

SEQ ID NO: 418369 - protein, 12 aa, Mycobacterium
AEHVESRHAETS

SEQ ID NO: 418370 - protein, 4 aa, Mycobacterium
AEIA

SEQ ID NO: 418371 - protein, 7 aa, Mycobacterium
AEIAEAT

SEQ ID NO: 418372 - protein, 13 aa, Mycobacterium
AEIAEPSKAASAE

SEQ ID NO: 418373 - protein, 9 aa, Mycobacterium
AEIAGHGGE

SEQ ID NO: 418374 - protein, 5 aa, Mycobacterium
AEIAR

SEQ ID NO: 418375 - protein, 6 aa, Mycobacterium
AEIARK

SEQ ID NO: 418376 - protein, 4 aa, Mycobacterium
AEID

SEQ ID NO: 418377 - protein, 11 aa, Mycobacterium
AEIDGEKLEDE

SEQ ID NO: 418378 - protein, 11 aa, Mycobacterium
AEIDGQKLEDE

SEQ ID NO: 418379 - protein, 17 aa, Mycobacterium
AEIDPDDLEDAEPFEEG

SEQ ID NO: 418380 - protein, 4 aa, Mycobacterium
AEIE

SEQ ID NO: 418381 - protein, 7 aa, Mycobacterium
AEIERER

SEQ ID NO: 418382 - protein, 4 aa, Mycobacterium
AEIG

SEQ ID NO: 418383 - protein, 9 aa, Mycobacterium
AEIGDGNKL

SEQ ID NO: 418384 - protein, 9 aa, Mycobacterium
AEIGEGNKI

SEQ ID NO: 418385 - protein, 5 aa, Mycobacterium
AEIGP

SEQ ID NO: 418386 - protein, 6 aa, Mycobacterium
AEIGPT

SEQ ID NO: 418387 - protein, 13 aa, Mycobacterium
AEIGTASESPNHR

SEQ ID NO: 418388 - protein, 8 aa, Mycobacterium
AEIGTSAC

SEQ ID NO: 418389 - protein, 10 aa, Mycobacterium
AEIKKRGARY

SEQ ID NO: 418390 - protein, 4 aa, Mycobacterium
AEIN

SEQ ID NO: 418391 - protein, 6 aa, Mycobacterium
AEINGK

SEQ ID NO: 418392 - protein, 5 aa, Mycobacterium
AEINR

SEQ ID NO: 418393 - protein, 5 aa, Mycobacterium
AEIPG

SEQ ID NO: 418394 - protein, 7 aa, Mycobacterium
AEIPGAQ

SEQ ID NO: 418395 - protein, 8 aa, Mycobacterium
AEIPGARQ

SEQ ID NO: 418396 - protein, 12 aa, Mycobacterium
AEIPPPDQRRAY

SEQ ID NO: 418397 - protein, 6 aa, Mycobacterium
AEIPPQ

SEQ ID NO: 418398 - protein, 4 aa, Mycobacterium
AEIQ

SEQ ID NO: 418399 - protein, 5 aa, Mycobacterium
AEIRE

SEQ ID NO: 418400 - protein, 5 aa, Mycobacterium
AEIRG

SEQ ID NO: 418401 - protein, 8 aa, Mycobacterium
AEIRQGAK

SEQ ID NO: 418402 - protein, 6 aa, Mycobacterium
AEIRQR

SEQ ID NO: 418403 - protein, 7 aa, Mycobacterium
AEIRSRA

SEQ ID NO: 418404 - protein, 6 aa, Mycobacterium
AEISDG

SEQ ID NO: 418405 - protein, 6 aa, Mycobacterium
AEISPS

SEQ ID NO: 418406 - protein, 4 aa, Mycobacterium
AEIT

SEQ ID NO: 418407 - protein, 5 aa, Mycobacterium
AEITA

SEQ ID NO: 418408 - protein, 13 aa, Mycobacterium
AEITTADAANLEE

SEQ ID NO: 418409 - protein, 10 aa, Mycobacterium
AEKADGPKRV

SEQ ID NO: 418410 - protein, 19 aa, Mycobacterium
AEKAGKATAAASGASATER

SEQ ID NO: 418411 - protein, 8 aa, Mycobacterium
AEKAGSNR

SEQ ID NO: 418412 - protein, 33 aa, Mycobacterium
AEKAKEAKQAPAASPAAAAPAAPAAASATPAPA

SEQ ID NO: 418413 - protein, 8 aa, Mycobacterium
AEKAKELG

SEQ ID NO: 418414 - protein, 7 aa, Mycobacterium
AEKAKKT

SEQ ID NO: 418415 - protein, 8 aa, Mycobacterium
AEKAKQAG

SEQ ID NO: 418416 - protein, 54 aa, Mycobacterium
AEKARERSEKLADKARKRSEKLADKARKRGEELASTALDRGEDLADTARARSTY

SEQ ID NO: 418417 - protein, 8 aa, Mycobacterium
AEKATGGV

SEQ ID NO: 418418 - protein, 4 aa, Mycobacterium
AEKD

SEQ ID NO: 418419 - protein, 12 aa, Mycobacterium
AEKDSGATLDPA

SEQ ID NO: 418420 - protein, 8 aa, Mycobacterium
AEKDSNGY

SEQ ID NO: 418421 - protein, 20 aa, Mycobacterium
AEKEARKVEPAPWGDREEAR

SEQ ID NO: 418422 - protein, 8 aa, Mycobacterium
AEKEEAEK

SEQ ID NO: 418423 - protein, 6 aa, Mycobacterium
AEKEGL

SEQ ID NO: 418424 - protein, 5 aa, Mycobacterium
AEKEL

SEQ ID NO: 418425 - protein, 6 aa, Mycobacterium
AEKELE

SEQ ID NO: 418426 - protein, 7 aa, Mycobacterium
AEKELER

SEQ ID NO: 418427 - protein, 5 aa, Mycobacterium
AEKEQ

SEQ ID NO: 418428 - protein, 18 aa, Mycobacterium
AEKERIREATTPTDELPE

SEQ ID NO: 418429 - protein, 19 aa, Mycobacterium
AEKERIREATTPTDELPED

SEQ ID NO: 418430 - protein, 5 aa, Mycobacterium
AEKFD

SEQ ID NO: 418431 - protein, 9 aa, Mycobacterium
AEKGAAQGV

SEQ ID NO: 418432 - protein, 12 aa, Mycobacterium
AEKGEKLTTAQR

SEQ ID NO: 418433 - protein, 9 aa, Mycobacterium
AEKGKLPAE

SEQ ID NO: 418434 - protein, 10 aa, Mycobacterium
AEKGPAATSI

SEQ ID NO: 418435 - protein, 7 aa, Mycobacterium
AEKGQPV

SEQ ID NO: 418436 - protein, 5 aa, Mycobacterium
AEKGR

SEQ ID NO: 418437 - protein, 12 aa, Mycobacterium
AEKGSAEVDVSS

SEQ ID NO: 418438 - protein, 7 aa, Mycobacterium
AEKIDRD

SEQ ID NO: 418439 - protein, 15 aa, Mycobacterium
AEKKAAKNLLVGSSA

SEQ ID NO: 418440 - protein, 8 aa, Mycobacterium
AEKKKAIG

SEQ ID NO: 418441 - protein, 16 aa, Mycobacterium
AEKKPAAKDHPITEGP

SEQ ID NO: 418442 - protein, 5 aa, Mycobacterium
AEKLD

SEQ ID NO: 418443 - protein, 8 aa, Mycobacterium
AEKLDGER

SEQ ID NO: 418444 - protein, 7 aa, Mycobacterium
AEKLGGL

SEQ ID NO: 418445 - protein, 20 aa, Mycobacterium
AEKLGLSSADPDESPHRDLD

SEQ ID NO: 418446 - protein, 8 aa, Mycobacterium
AEKLTRES

SEQ ID NO: 418447 - protein, 5 aa, Mycobacterium
AEKNR

SEQ ID NO: 418448 - protein, 7 aa, Mycobacterium
AEKPDSH

SEQ ID NO: 418449 - protein, 7 aa, Mycobacterium
AEKPEEW

SEQ ID NO: 418450 - protein, 6 aa, Mycobacterium
AEKPEN

SEQ ID NO: 418451 - protein, 5 aa, Mycobacterium
AEKPQ

SEQ ID NO: 418452 - protein, 7 aa, Mycobacterium
AEKPRDE

SEQ ID NO: 418453 - protein, 10 aa, Mycobacterium
AEKPRGDGGL

SEQ ID NO: 418454 - protein, 5 aa, Mycobacterium
AEKQV

SEQ ID NO: 418455 - protein, 25 aa, Mycobacterium
AEKRAQSTGASVTVTADAGAAAAGA

SEQ ID NO: 418456 - protein, 21 aa, Mycobacterium
AEKRPTKGANPLGDSSAPNAL

SEQ ID NO: 418457 - protein, 16 aa, Mycobacterium
AEKRQRRERGSINPED

SEQ ID NO: 418458 - protein, 10 aa, Mycobacterium
AEKRRSESTD

SEQ ID NO: 418459 - protein, 12 aa, Mycobacterium
AEKRSAQRDLGR

SEQ ID NO: 418460 - protein, 6 aa, Mycobacterium
AEKSGS

SEQ ID NO: 418461 - protein, 6 aa, Mycobacterium
AEKSLD

SEQ ID NO: 418462 - protein, 5 aa, Mycobacterium
AEKSQ

SEQ ID NO: 418463 - protein, 18 aa, Mycobacterium
AEKSYATEPNDKQAGQQL

SEQ ID NO: 418464 - protein, 16 aa, Mycobacterium
AEKTAELARGRGIRPG

SEQ ID NO: 418465 - protein, 14 aa, Mycobacterium
AEKTASSRDARGWK

SEQ ID NO: 418466 - protein, 13 aa, Mycobacterium
AEKTEAPHADAHG

SEQ ID NO: 418467 - protein, 9 aa, Mycobacterium
AEKTGDARG

SEQ ID NO: 418468 - protein, 6 aa, Mycobacterium
AEKTGR

SEQ ID NO: 418469 - protein, 7 aa, Mycobacterium
AEKTRDE

SEQ ID NO: 418470 - protein, 6 aa, Mycobacterium
AEKTRK

SEQ ID NO: 418471 - protein, 7 aa, Mycobacterium
AEKVDRE

SEQ ID NO: 418472 - protein, 7 aa, Mycobacterium
AEKVDRN

SEQ ID NO: 418473 - protein, 8 aa, Mycobacterium
AEKVDRNS

SEQ ID NO: 418474 - protein, 7 aa, Mycobacterium
AEKVDRT

SEQ ID NO: 418475 - protein, 10 aa, Mycobacterium
AEKVNTNGGA

SEQ ID NO: 418476 - protein, 12 aa, Mycobacterium
AEKVRGGYYTPP

SEQ ID NO: 418477 - protein, 5 aa, Mycobacterium
AEKYT

SEQ ID NO: 418478 - protein, 8 aa, Mycobacterium
AELAATEG

SEQ ID NO: 418479 - protein, 16 aa, Mycobacterium
AELAEREQIAADAERA

SEQ ID NO: 418480 - protein, 11 aa, Mycobacterium
AELAGASDERT

SEQ ID NO: 418481 - protein, 9 aa, Mycobacterium
AELAGDEKN

SEQ ID NO: 418482 - protein, 8 aa, Mycobacterium
AELAGDVD

SEQ ID NO: 418483 - protein, 12 aa, Mycobacterium
AELAGDVDEQKY

SEQ ID NO: 418484 - protein, 10 aa, Mycobacterium
AELAGGPPPR

SEQ ID NO: 418485 - protein, 8 aa, Mycobacterium
AELAGTAD

SEQ ID NO: 418486 - protein, 14 aa, Mycobacterium
AELAPDVAAETARR

SEQ ID NO: 418487 - protein, 6 aa, Mycobacterium
AELAPR

SEQ ID NO: 418488 - protein, 9 aa, Mycobacterium
AELAQSSVQ

SEQ ID NO: 418489 - protein, 17 aa, Mycobacterium
AELATAYPETRDEPQPI

SEQ ID NO: 418490 - protein, 9 aa, Mycobacterium
AELATPRGA

SEQ ID NO: 418491 - protein, 11 aa, Mycobacterium
AELDAEPGEDL

SEQ ID NO: 418492 - protein, 11 aa, Mycobacterium
AELDDEEANGQ

SEQ ID NO: 418493 - protein, 7 aa, Mycobacterium
AELDDSA

SEQ ID NO: 418494 - protein, 11 aa, Mycobacterium
AELDDTERAQI

SEQ ID NO: 418495 - protein, 5 aa, Mycobacterium
AELDE

SEQ ID NO: 418496 - protein, 13 aa, Mycobacterium
AELDGKARNRAIR

SEQ ID NO: 418497 - protein, 11 aa, Mycobacterium
AELDNDPDRLS

SEQ ID NO: 418498 - protein, 7 aa, Mycobacterium
AELDTSK

SEQ ID NO: 418499 - protein, 9 aa, Mycobacterium
AELEAGNVG

SEQ ID NO: 418500 - protein, 13 aa, Mycobacterium
AELEARSEVGLPP

SEQ ID NO: 418501 - protein, 7 aa, Mycobacterium
AELEEDE

SEQ ID NO: 418502 - protein, 15 aa, Mycobacterium
AELEEGDFDAARGSY

SEQ ID NO: 418503 - protein, 13 aa, Mycobacterium
AELEGRTVRERGE

SEQ ID NO: 418504 - protein, 9 aa, Mycobacterium
AELEGSPQL

SEQ ID NO: 418505 - protein, 8 aa, Mycobacterium
AELEPYRA

SEQ ID NO: 418506 - protein, 8 aa, Mycobacterium
AELERTGY

SEQ ID NO: 418507 - protein, 7 aa, Mycobacterium
AELETAA

SEQ ID NO: 418508 - protein, 4 aa, Mycobacterium
AELG

SEQ ID NO: 418509 - protein, 21 aa, Mycobacterium
AELGADPERVAVGGDSAGGNL

SEQ ID NO: 418510 - protein, 10 aa, Mycobacterium
AELGAKTGID

SEQ ID NO: 418511 - protein, 13 aa, Mycobacterium
AELGASPSAERRT

SEQ ID NO: 418512 - protein, 5 aa, Mycobacterium
AELGD

SEQ ID NO: 418513 - protein, 11 aa, Mycobacterium
AELGDKPPSEA

SEQ ID NO: 418514 - protein, 6 aa, Mycobacterium
AELGDT

SEQ ID NO: 418515 - protein, 12 aa, Mycobacterium
AELGEHESPGEA

SEQ ID NO: 418516 - protein, 10 aa, Mycobacterium
AELGGDPGRI

SEQ ID NO: 418517 - protein, 21 aa, Mycobacterium
AELGGDPNRLGVAGDSAGGTI

SEQ ID NO: 418518 - protein, 6 aa, Mycobacterium
AELGGK

SEQ ID NO: 418519 - protein, 8 aa, Mycobacterium
AELGGRPA

SEQ ID NO: 418520 - protein, 6 aa, Mycobacterium
AELGLS

SEQ ID NO: 418521 - protein, 6 aa, Mycobacterium
AELGNP

SEQ ID NO: 418522 - protein, 6 aa, Mycobacterium
AELGPV

SEQ ID NO: 418523 - protein, 6 aa, Mycobacterium
AELGQE

SEQ ID NO: 418524 - protein, 6 aa, Mycobacterium
AELGRP

SEQ ID NO: 418525 - protein, 11 aa, Mycobacterium
AELGSAASSFS

SEQ ID NO: 418526 - protein, 8 aa, Mycobacterium
AELGTAAE

SEQ ID NO: 418527 - protein, 11 aa, Mycobacterium
AELGTAASGYA

SEQ ID NO: 418528 - protein, 7 aa, Mycobacterium
AELGVSD

SEQ ID NO: 418529 - protein, 5 aa, Mycobacterium
AELHG

SEQ ID NO: 418530 - protein, 9 aa, Mycobacterium
AELHGPGDG

SEQ ID NO: 418531 - protein, 17 aa, Mycobacterium
AELKPNSPYGASKAAAD

SEQ ID NO: 418532 - protein, 6 aa, Mycobacterium
AELKTV

SEQ ID NO: 418533 - protein, 13 aa, Mycobacterium
AELNAAEPLPGNE

SEQ ID NO: 418534 - protein, 11 aa, Mycobacterium
AELPAGTPTHD

SEQ ID NO: 418535 - protein, 10 aa, Mycobacterium
AELPAQTSAE

SEQ ID NO: 418536 - protein, 7 aa, Mycobacterium
AELPDDD

SEQ ID NO: 418537 - protein, 7 aa, Mycobacterium
AELPEKV

SEQ ID NO: 418538 - protein, 6 aa, Mycobacterium
AELPET

SEQ ID NO: 418539 - protein, 6 aa, Mycobacterium
AELPGA

SEQ ID NO: 418540 - protein, 7 aa, Mycobacterium
AELPGER

SEQ ID NO: 418541 - protein, 6 aa, Mycobacterium
AELPHS

SEQ ID NO: 418542 - protein, 10 aa, Mycobacterium
AELPKQDAKG

SEQ ID NO: 418543 - protein, 8 aa, Mycobacterium
AELPQDDP

SEQ ID NO: 418544 - protein, 5 aa, Mycobacterium
AELPR

SEQ ID NO: 418545 - protein, 19 aa, Mycobacterium
AELPTRRAPDGTLTVVTTP

SEQ ID NO: 418546 - protein, 6 aa, Mycobacterium
AELQPA

SEQ ID NO: 418547 - protein, 5 aa, Mycobacterium
AELQQ

SEQ ID NO: 418548 - protein, 4 aa, Mycobacterium
AELR

SEQ ID NO: 418549 - protein, 20 aa, Mycobacterium
AELRAKTDEFKKRHADGESL

SEQ ID NO: 418550 - protein, 6 aa, Mycobacterium
AELRAS

SEQ ID NO: 418551 - protein, 6 aa, Mycobacterium
AELRDA

SEQ ID NO: 418552 - protein, 6 aa, Mycobacterium
AELRDS

SEQ ID NO: 418553 - protein, 6 aa, Mycobacterium
AELRPD

SEQ ID NO: 418554 - protein, 7 aa, Mycobacterium
AELRSGA

SEQ ID NO: 418555 - protein, 4 aa, Mycobacterium
AELS

SEQ ID NO: 418556 - protein, 5 aa, Mycobacterium
AELSA

SEQ ID NO: 418557 - protein, 15 aa, Mycobacterium
AELSADGVADAGGDG

SEQ ID NO: 418558 - protein, 13 aa, Mycobacterium
AELSAGPVPDRQP

SEQ ID NO: 418559 - protein, 10 aa, Mycobacterium
AELSAPDPDV

SEQ ID NO: 418560 - protein, 10 aa, Mycobacterium
AELSDDTRAV

SEQ ID NO: 418561 - protein, 6 aa, Mycobacterium
AELSDG

SEQ ID NO: 418562 - protein, 23 aa, Mycobacterium
AELSDRELAEQAEDLDTAVRNLG

SEQ ID NO: 418563 - protein, 15 aa, Mycobacterium
AELSDRPDEAKTALN

SEQ ID NO: 418564 - protein, 10 aa, Mycobacterium
AELSGGQKQR

SEQ ID NO: 418565 - protein, 10 aa, Mycobacterium
AELSGGQRQR

SEQ ID NO: 418566 - protein, 8 aa, Mycobacterium
AELSGSAA

SEQ ID NO: 418567 - protein, 9 aa, Mycobacterium
AELSGSPAL

SEQ ID NO: 418568 - protein, 5 aa, Mycobacterium
AELSP

SEQ ID NO: 418569 - protein, 7 aa, Mycobacterium
AELSPAA

SEQ ID NO: 418570 - protein, 19 aa, Mycobacterium
AELSPTSTVRGWDSLPVIV

SEQ ID NO: 418571 - protein, 13 aa, Mycobacterium
AELSQAKNAIQQQ

SEQ ID NO: 418572 - protein, 13 aa, Mycobacterium
AELSRQAGVTPQA

SEQ ID NO: 418573 - protein, 4 aa, Mycobacterium
AELT

SEQ ID NO: 418574 - protein, 19 aa, Mycobacterium
AELTAGESFGEVESTKSVS

SEQ ID NO: 418575 - protein, 6 aa, Mycobacterium
AELTDA

SEQ ID NO: 418576 - protein, 10 aa, Mycobacterium
AELTDTPGID

SEQ ID NO: 418577 - protein, 5 aa, Mycobacterium
AELTE

SEQ ID NO: 418578 - protein, 6 aa, Mycobacterium
AELTER

SEQ ID NO: 418579 - protein, 17 aa, Mycobacterium
AELTGGDVNEAIMAAAR

SEQ ID NO: 418580 - protein, 15 aa, Mycobacterium
AELTPEEKDAVSHRG

SEQ ID NO: 418581 - protein, 12 aa, Mycobacterium
AELTRPGEPASS

SEQ ID NO: 418582 - protein, 12 aa, Mycobacterium
AELTTAADCLDP

SEQ ID NO: 418583 - protein, 7 aa, Mycobacterium
AELTTDP

SEQ ID NO: 418584 - protein, 11 aa, Mycobacterium
AELVPDDADFA

SEQ ID NO: 418585 - protein, 6 aa, Mycobacterium
AEMDGS

SEQ ID NO: 418586 - protein, 6 aa, Mycobacterium
AEMGEQ

SEQ ID NO: 418587 - protein, 6 aa, Mycobacterium
AEMGES

SEQ ID NO: 418588 - protein, 11 aa, Mycobacterium
AEMGGDPPESP

SEQ ID NO: 418589 - protein, 11 aa, Mycobacterium
AEMGKSRRPFE

SEQ ID NO: 418590 - protein, 16 aa, Mycobacterium
AEMGPELKERSKQGEW

SEQ ID NO: 418591 - protein, 16 aa, Mycobacterium
AEMPSGRDGNKTPAVP

SEQ ID NO: 418592 - protein, 15 aa, Mycobacterium
AEMPSGRQGNTTPAV

SEQ ID NO: 418593 - protein, 14 aa, Mycobacterium
AEMRERRPEDRPDA

SEQ ID NO: 418594 - protein, 9 aa, Mycobacterium
AEMSGTDLD

SEQ ID NO: 418595 - protein, 9 aa, Mycobacterium
AEMTPTSAT

SEQ ID NO: 418596 - protein, 8 aa, Mycobacterium
AENAAGLA

SEQ ID NO: 418597 - protein, 8 aa, Mycobacterium
AENADDLA

SEQ ID NO: 418598 - protein, 19 aa, Mycobacterium
AENADQTGGGRRTYPGSKA

SEQ ID NO: 418599 - protein, 13 aa, Mycobacterium
AENAHTGAPVHEW

SEQ ID NO: 418600 - protein, 8 aa, Mycobacterium
AENAPRAG

SEQ ID NO: 418601 - protein, 9 aa, Mycobacterium
AENAQEARQ

SEQ ID NO: 418602 - protein, 10 aa, Mycobacterium
AENASQAKQL

SEQ ID NO: 418603 - protein, 16 aa, Mycobacterium
AENATGSGPLRPQGAD

SEQ ID NO: 418604 - protein, 6 aa, Mycobacterium
AENATI

SEQ ID NO: 418605 - protein, 15 aa, Mycobacterium
AENAVQADIDMAWPG

SEQ ID NO: 418606 - protein, 11 aa, Mycobacterium
AENAYAAREAE

SEQ ID NO: 418607 - protein, 13 aa, Mycobacterium
AENDAKRVKKMLT

SEQ ID NO: 418608 - protein, 24 aa, Mycobacterium
AENDASFTEDDAKRLEDALSGASV

SEQ ID NO: 418609 - protein, 5 aa, Mycobacterium
AENDG

SEQ ID NO: 418610 - protein, 15 aa, Mycobacterium
AENDNVNRYKASKQA

SEQ ID NO: 418611 - protein, 15 aa, Mycobacterium
AENDSVNNYKASKQA

SEQ ID NO: 418612 - protein, 8 aa, Mycobacterium
AENEEPNW

SEQ ID NO: 418613 - protein, 15 aa, Mycobacterium
AENEPGQAERDTHDA

SEQ ID NO: 418614 - protein, 15 aa, Mycobacterium
AENERTYGEFSTREG

SEQ ID NO: 418615 - protein, 9 aa, Mycobacterium
AENGADSDP

SEQ ID NO: 418616 - protein, 13 aa, Mycobacterium
AENGAGAPDPHSR

SEQ ID NO: 418617 - protein, 9 aa, Mycobacterium
AENGAITAP

SEQ ID NO: 418618 - protein, 5 aa, Mycobacterium
AENGD

SEQ ID NO: 418619 - protein, 11 aa, Mycobacterium
AENGEAEPESI

SEQ ID NO: 418620 - protein, 5 aa, Mycobacterium
AENGI

SEQ ID NO: 418621 - protein, 6 aa, Mycobacterium
AENGIG

SEQ ID NO: 418622 - protein, 15 aa, Mycobacterium
AENGPVPHYPAPGGV

SEQ ID NO: 418623 - protein, 8 aa, Mycobacterium
AENGPVTR

SEQ ID NO: 418624 - protein, 6 aa, Mycobacterium
AENGRV

SEQ ID NO: 418625 - protein, 7 aa, Mycobacterium
AENGTGA

SEQ ID NO: 418626 - protein, 6 aa, Mycobacterium
AENGTV

SEQ ID NO: 418627 - protein, 5 aa, Mycobacterium
AENGV

SEQ ID NO: 418628 - protein, 10 aa, Mycobacterium
AENGYAGTNM

SEQ ID NO: 418629 - protein, 6 aa, Mycobacterium
AENHRP

SEQ ID NO: 418630 - protein, 7 aa, Mycobacterium
AENKAAA

SEQ ID NO: 418631 - protein, 5 aa, Mycobacterium
AENMA

SEQ ID NO: 418632 - protein, 16 aa, Mycobacterium
AENMPAQRRRAAHSAI

SEQ ID NO: 418633 - protein, 13 aa, Mycobacterium
AENMPSARRRAAH

SEQ ID NO: 418634 - protein, 5 aa, Mycobacterium
AENNA

SEQ ID NO: 418635 - protein, 12 aa, Mycobacterium
AENNEEDDEAGA

SEQ ID NO: 418636 - protein, 5 aa, Mycobacterium
AENNV

SEQ ID NO: 418637 - protein, 4 aa, Mycobacterium
AENP

SEQ ID NO: 418638 - protein, 6 aa, Mycobacterium
AENPDA

SEQ ID NO: 418639 - protein, 8 aa, Mycobacterium
AENPDQRD

SEQ ID NO: 418640 - protein, 9 aa, Mycobacterium
AENPDQRSA

SEQ ID NO: 418641 - protein, 6 aa, Mycobacterium
AENPFP

SEQ ID NO: 418642 - protein, 5 aa, Mycobacterium
AENPG

SEQ ID NO: 418643 - protein, 6 aa, Mycobacterium
AENPGA

SEQ ID NO: 418644 - protein, 7 aa, Mycobacterium
AENPGSV

SEQ ID NO: 418645 - protein, 8 aa, Mycobacterium
AENPNDPL

SEQ ID NO: 418646 - protein, 6 aa, Mycobacterium
AENPRD

SEQ ID NO: 418647 - protein, 9 aa, Mycobacterium
AENPSGRAE

SEQ ID NO: 418648 - protein, 6 aa, Mycobacterium
AENPTT

SEQ ID NO: 418649 - protein, 6 aa, Mycobacterium
AENPTW

SEQ ID NO: 418650 - protein, 7 aa, Mycobacterium
AENPTWE

SEQ ID NO: 418651 - protein, 6 aa, Mycobacterium
AENQGV

SEQ ID NO: 418652 - protein, 6 aa, Mycobacterium
AENQRA

SEQ ID NO: 418653 - protein, 9 aa, Mycobacterium
AENQRRRGL

SEQ ID NO: 418654 - protein, 6 aa, Mycobacterium
AENQTL

SEQ ID NO: 418655 - protein, 6 aa, Mycobacterium
AENQTV

SEQ ID NO: 418656 - protein, 4 aa, Mycobacterium
AENR

SEQ ID NO: 418657 - protein, 13 aa, Mycobacterium
AENRATAATGPRA

SEQ ID NO: 418658 - protein, 4 aa, Mycobacterium
AENS

SEQ ID NO: 418659 - protein, 11 aa, Mycobacterium
AENSDGPDAIT

SEQ ID NO: 418660 - protein, 6 aa, Mycobacterium
AENSGF

SEQ ID NO: 418661 - protein, 10 aa, Mycobacterium
AENSGRERTA

SEQ ID NO: 418662 - protein, 6 aa, Mycobacterium
AENSGW

SEQ ID NO: 418663 - protein, 14 aa, Mycobacterium
AENSPADGRPWSSN

SEQ ID NO: 418664 - protein, 7 aa, Mycobacterium
AENSQRM

SEQ ID NO: 418665 - protein, 8 aa, Mycobacterium
AENSRYGG

SEQ ID NO: 418666 - protein, 7 aa, Mycobacterium
AENSTTV

SEQ ID NO: 418667 - protein, 8 aa, Mycobacterium
AENTAELQ

SEQ ID NO: 418668 - protein, 20 aa, Mycobacterium
AENTDDAKAETILDEVLAAA

SEQ ID NO: 418669 - protein, 20 aa, Mycobacterium
AENTDDAKASTILDEVLAAA

SEQ ID NO: 418670 - protein, 6 aa, Mycobacterium
AENTDG

SEQ ID NO: 418671 - protein, 20 aa, Mycobacterium
AENTGPAPEPTVGPPAGVRG

SEQ ID NO: 418672 - protein, 6 aa, Mycobacterium
AENTTY

SEQ ID NO: 418673 - protein, 4 aa, Mycobacterium
AENV

SEQ ID NO: 418674 - protein, 6 aa, Mycobacterium
AENVDR

SEQ ID NO: 418675 - protein, 69 aa, Mycobacterium
AENVPGGGYPGQGGYPETAHRDYDYGQQAEYAQPSEYGAPADYGQPADYGQPAGGYGGYGGGYGAAGTT

SEQ ID NO: 418676 - protein, 4 aa, Mycobacterium
AENW

SEQ ID NO: 418677 - protein, 7 aa, Mycobacterium
AENYTDS

SEQ ID NO: 418678 - protein, 5 aa, Mycobacterium
AEPAA

SEQ ID NO: 418679 - protein, 14 aa, Mycobacterium
AEPAAASLDGAVNS

SEQ ID NO: 418680 - protein, 6 aa, Mycobacterium
AEPAAL

SEQ ID NO: 418681 - protein, 7 aa, Mycobacterium
AEPAATL

SEQ ID NO: 418682 - protein, 11 aa, Mycobacterium
AEPADGTGPSY

SEQ ID NO: 418683 - protein, 7 aa, Mycobacterium
AEPAENL

SEQ ID NO: 418684 - protein, 11 aa, Mycobacterium
AEPAEPEPNTL

SEQ ID NO: 418685 - protein, 5 aa, Mycobacterium
AEPAG

SEQ ID NO: 418686 - protein, 16 aa, Mycobacterium
AEPAGGRPNHVRTTPE

SEQ ID NO: 418687 - protein, 18 aa, Mycobacterium
AEPAGPRDAADPGDLLIR

SEQ ID NO: 418688 - protein, 6 aa, Mycobacterium
AEPAGR

SEQ ID NO: 418689 - protein, 8 aa, Mycobacterium
AEPAGTAG

SEQ ID NO: 418690 - protein, 12 aa, Mycobacterium
AEPAHSTKERGK

SEQ ID NO: 418691 - protein, 5 aa, Mycobacterium
AEPAI

SEQ ID NO: 418692 - protein, 15 aa, Mycobacterium
AEPAIDASIALLGPR

SEQ ID NO: 418693 - protein, 11 aa, Mycobacterium
AEPAKRKPGYA

SEQ ID NO: 418694 - protein, 23 aa, Mycobacterium
AEPAKSAGLPGTDTERRSDFARD

SEQ ID NO: 418695 - protein, 7 aa, Mycobacterium
AEPAPAP

SEQ ID NO: 418696 - protein, 9 aa, Mycobacterium
AEPAPGTAN

SEQ ID NO: 418697 - protein, 15 aa, Mycobacterium
AEPAPHDESSPSGAD

SEQ ID NO: 418698 - protein, 19 aa, Mycobacterium
AEPAPPAPEPVTEPPAAVR

SEQ ID NO: 418699 - protein, 17 aa, Mycobacterium
AEPAPPEPAAEPAPRTY

SEQ ID NO: 418700 - protein, 18 aa, Mycobacterium
AEPAPPGRGVSSAMPHKR

SEQ ID NO: 418701 - protein, 6 aa, Mycobacterium
AEPARL

SEQ ID NO: 418702 - protein, 7 aa, Mycobacterium
AEPARPG

SEQ ID NO: 418703 - protein, 5 aa, Mycobacterium
AEPAS

SEQ ID NO: 418704 - protein, 6 aa, Mycobacterium
AEPASL

SEQ ID NO: 418705 - protein, 6 aa, Mycobacterium
AEPASV

SEQ ID NO: 418706 - protein, 5 aa, Mycobacterium
AEPAT

SEQ ID NO: 418707 - protein, 9 aa, Mycobacterium
AEPATTHGQ

SEQ ID NO: 418708 - protein, 5 aa, Mycobacterium
AEPAV

SEQ ID NO: 418709 - protein, 6 aa, Mycobacterium
AEPAVD

SEQ ID NO: 418710 - protein, 6 aa, Mycobacterium
AEPAVS

SEQ ID NO: 418711 - protein, 8 aa, Mycobacterium
AEPDADAP

SEQ ID NO: 418712 - protein, 9 aa, Mycobacterium
AEPDAEAPH

SEQ ID NO: 418713 - protein, 23 aa, Mycobacterium
AEPDAEHNWNSDRRNSELDADGI

SEQ ID NO: 418714 - protein, 16 aa, Mycobacterium
AEPDAGAKAVAAGRAW

SEQ ID NO: 418715 - protein, 8 aa, Mycobacterium
AEPDAKTL

SEQ ID NO: 418716 - protein, 11 aa, Mycobacterium
AEPDAPAELAR

SEQ ID NO: 418717 - protein, 25 aa, Mycobacterium
AEPDAQVAAGPAGAAVAEAGSWDRG

SEQ ID NO: 418718 - protein, 8 aa, Mycobacterium
AEPDARDA

SEQ ID NO: 418719 - protein, 10 aa, Mycobacterium
AEPDASGPRV

SEQ ID NO: 418720 - protein, 5 aa, Mycobacterium
AEPDD

SEQ ID NO: 418721 - protein, 8 aa, Mycobacterium
AEPDGAQA

SEQ ID NO: 418722 - protein, 6 aa, Mycobacterium
AEPDGD

SEQ ID NO: 418723 - protein, 7 aa, Mycobacterium
AEPDGGD

SEQ ID NO: 418724 - protein, 13 aa, Mycobacterium
AEPDGPATLDTDA

SEQ ID NO: 418725 - protein, 6 aa, Mycobacterium
AEPDGQ

SEQ ID NO: 418726 - protein, 9 aa, Mycobacterium
AEPDHEETY

SEQ ID NO: 418727 - protein, 6 aa, Mycobacterium
AEPDPP

SEQ ID NO: 418728 - protein, 6 aa, Mycobacterium
AEPDQT

SEQ ID NO: 418729 - protein, 6 aa, Mycobacterium
AEPDRI

SEQ ID NO: 418730 - protein, 7 aa, Mycobacterium
AEPDRTR

SEQ ID NO: 418731 - protein, 6 aa, Mycobacterium
AEPDSF

SEQ ID NO: 418732 - protein, 19 aa, Mycobacterium
AEPDSGAEETHSAHPSVSE

SEQ ID NO: 418733 - protein, 8 aa, Mycobacterium
AEPDSGAG

SEQ ID NO: 418734 - protein, 10 aa, Mycobacterium
AEPDTPKARV

SEQ ID NO: 418735 - protein, 6 aa, Mycobacterium
AEPDVR

SEQ ID NO: 418736 - protein, 4 aa, Mycobacterium
AEPE

SEQ ID NO: 418737 - protein, 6 aa, Mycobacterium
AEPEAH

SEQ ID NO: 418738 - protein, 6 aa, Mycobacterium
AEPEAV

SEQ ID NO: 418739 - protein, 6 aa, Mycobacterium
AEPEDI

SEQ ID NO: 418740 - protein, 12 aa, Mycobacterium
AEPEDLGGSGPA

SEQ ID NO: 418741 - protein, 5 aa, Mycobacterium
AEPEG

SEQ ID NO: 418742 - protein, 6 aa, Mycobacterium
AEPEGL

SEQ ID NO: 418743 - protein, 7 aa, Mycobacterium
AEPEGLT

SEQ ID NO: 418744 - protein, 7 aa, Mycobacterium
AEPEHNP

SEQ ID NO: 418745 - protein, 6 aa, Mycobacterium
AEPEKS

SEQ ID NO: 418746 - protein, 7 aa, Mycobacterium
AEPEPAA

SEQ ID NO: 418747 - protein, 8 aa, Mycobacterium
AEPEPVRN

SEQ ID NO: 418748 - protein, 12 aa, Mycobacterium
AEPERKHPRPVD

SEQ ID NO: 418749 - protein, 10 aa, Mycobacterium
AEPERQHPRP

SEQ ID NO: 418750 - protein, 9 aa, Mycobacterium
AEPERSRIE

SEQ ID NO: 418751 - protein, 9 aa, Mycobacterium
AEPESDGTL

SEQ ID NO: 418752 - protein, 10 aa, Mycobacterium
AEPESNRSKV

SEQ ID NO: 418753 - protein, 7 aa, Mycobacterium
AEPETAD

SEQ ID NO: 418754 - protein, 8 aa, Mycobacterium
AEPETGDR

SEQ ID NO: 418755 - protein, 8 aa, Mycobacterium
AEPETSAV

SEQ ID NO: 418756 - protein, 14 aa, Mycobacterium
AEPEWGDPDGPDRP

SEQ ID NO: 418757 - protein, 5 aa, Mycobacterium
AEPFP

SEQ ID NO: 418758 - protein, 7 aa, Mycobacterium
AEPGAAA

SEQ ID NO: 418759 - protein, 5 aa, Mycobacterium
AEPGD

SEQ ID NO: 418760 - protein, 6 aa, Mycobacterium
AEPGDT

SEQ ID NO: 418761 - protein, 6 aa, Mycobacterium
AEPGDV

SEQ ID NO: 418762 - protein, 6 aa, Mycobacterium
AEPGEI

SEQ ID NO: 418763 - protein, 8 aa, Mycobacterium
AEPGEPHA

SEQ ID NO: 418764 - protein, 25 aa, Mycobacterium
AEPGERTSTTTDDTATDDTDLIGAQ

SEQ ID NO: 418765 - protein, 10 aa, Mycobacterium
AEPGETAGFS

SEQ ID NO: 418766 - protein, 6 aa, Mycobacterium
AEPGGP

SEQ ID NO: 418767 - protein, 8 aa, Mycobacterium
AEPGHQHD

SEQ ID NO: 418768 - protein, 6 aa, Mycobacterium
AEPGHV

SEQ ID NO: 418769 - protein, 5 aa, Mycobacterium
AEPGI

SEQ ID NO: 418770 - protein, 7 aa, Mycobacterium
AEPGKRE

SEQ ID NO: 418771 - protein, 8 aa, Mycobacterium
AEPGLRPR

SEQ ID NO: 418772 - protein, 8 aa, Mycobacterium
AEPGNVEA

SEQ ID NO: 418773 - protein, 5 aa, Mycobacterium
AEPGP

SEQ ID NO: 418774 - protein, 28 aa, Mycobacterium
AEPGPDAPALTGDRAARSAAPKVDELGP

SEQ ID NO: 418775 - protein, 8 aa, Mycobacterium
AEPGPDES

SEQ ID NO: 418776 - protein, 10 aa, Mycobacterium
AEPGPDRDDA

SEQ ID NO: 418777 - protein, 7 aa, Mycobacterium
AEPGPDV

SEQ ID NO: 418778 - protein, 9 aa, Mycobacterium
AEPGPDVHE

SEQ ID NO: 418779 - protein, 7 aa, Mycobacterium
AEPGPGF

SEQ ID NO: 418780 - protein, 8 aa, Mycobacterium
AEPGPRGL

SEQ ID NO: 418781 - protein, 10 aa, Mycobacterium
AEPGPRSAKE

SEQ ID NO: 418782 - protein, 7 aa, Mycobacterium
AEPGPTR

SEQ ID NO: 418783 - protein, 10 aa, Mycobacterium
AEPGQGTTPF

SEQ ID NO: 418784 - protein, 7 aa, Mycobacterium
AEPGRAA

SEQ ID NO: 418785 - protein, 9 aa, Mycobacterium
AEPGRPPRS

SEQ ID NO: 418786 - protein, 6 aa, Mycobacterium
AEPGRQ

SEQ ID NO: 418787 - protein, 6 aa, Mycobacterium
AEPGSA

SEQ ID NO: 418788 - protein, 7 aa, Mycobacterium
AEPGSAL

SEQ ID NO: 418789 - protein, 10 aa, Mycobacterium
AEPGSPSEEA

SEQ ID NO: 418790 - protein, 20 aa, Mycobacterium
AEPGSSDPAAPRTTARPEGD

SEQ ID NO: 418791 - protein, 7 aa, Mycobacterium
AEPGSYD

SEQ ID NO: 418792 - protein, 6 aa, Mycobacterium
AEPGTL

SEQ ID NO: 418793 - protein, 10 aa, Mycobacterium
AEPGTPSADA

SEQ ID NO: 418794 - protein, 6 aa, Mycobacterium
AEPGTR

SEQ ID NO: 418795 - protein, 7 aa, Mycobacterium
AEPGTRG

SEQ ID NO: 418796 - protein, 6 aa, Mycobacterium
AEPGTV

SEQ ID NO: 418797 - protein, 5 aa, Mycobacterium
AEPGV

SEQ ID NO: 418798 - protein, 6 aa, Mycobacterium
AEPGVK

SEQ ID NO: 418799 - protein, 6 aa, Mycobacterium
AEPGVR

SEQ ID NO: 418800 - protein, 6 aa, Mycobacterium
AEPGWG

SEQ ID NO: 418801 - protein, 13 aa, Mycobacterium
AEPGWGDPQQPDR

SEQ ID NO: 418802 - protein, 9 aa, Mycobacterium
AEPHAAATA

SEQ ID NO: 418803 - protein, 8 aa, Mycobacterium
AEPHTEEL

SEQ ID NO: 418804 - protein, 5 aa, Mycobacterium
AEPHY

SEQ ID NO: 418805 - protein, 7 aa, Mycobacterium
AEPIAGA

SEQ ID NO: 418806 - protein, 7 aa, Mycobacterium
AEPIDPA

SEQ ID NO: 418807 - protein, 5 aa, Mycobacterium
AEPIG

SEQ ID NO: 418808 - protein, 6 aa, Mycobacterium
AEPIRA

SEQ ID NO: 418809 - protein, 6 aa, Mycobacterium
AEPKAL

SEQ ID NO: 418810 - protein, 7 aa, Mycobacterium
AEPKHEP

SEQ ID NO: 418811 - protein, 5 aa, Mycobacterium
AEPKQ

SEQ ID NO: 418812 - protein, 5 aa, Mycobacterium
AEPLA

SEQ ID NO: 418813 - protein, 14 aa, Mycobacterium
AEPLDETTSRGQYA

SEQ ID NO: 418814 - protein, 6 aa, Mycobacterium
AEPLDG

SEQ ID NO: 418815 - protein, 6 aa, Mycobacterium
AEPLES

SEQ ID NO: 418816 - protein, 5 aa, Mycobacterium
AEPLG

SEQ ID NO: 418817 - protein, 6 aa, Mycobacterium
AEPLGD

SEQ ID NO: 418818 - protein, 14 aa, Mycobacterium
AEPLGEAADASEAI

SEQ ID NO: 418819 - protein, 7 aa, Mycobacterium
AEPLGVS

SEQ ID NO: 418820 - protein, 12 aa, Mycobacterium
AEPLTAPSVGIW

SEQ ID NO: 418821 - protein, 9 aa, Mycobacterium
AEPLTQEQT

SEQ ID NO: 418822 - protein, 4 aa, Mycobacterium
AEPM

SEQ ID NO: 418823 - protein, 13 aa, Mycobacterium
AEPMPEPEGPPEV

SEQ ID NO: 418824 - protein, 4 aa, Mycobacterium
AEPN

SEQ ID NO: 418825 - protein, 8 aa, Mycobacterium
AEPNGEQA

SEQ ID NO: 418826 - protein, 7 aa, Mycobacterium
AEPNGVN

SEQ ID NO: 418827 - protein, 5 aa, Mycobacterium
AEPNT

SEQ ID NO: 418828 - protein, 4 aa, Mycobacterium
AEPP

SEQ ID NO: 418829 - protein, 14 aa, Mycobacterium
AEPPAAQSDSSTDA

SEQ ID NO: 418830 - protein, 10 aa, Mycobacterium
AEPPAAQTDA

SEQ ID NO: 418831 - protein, 10 aa, Mycobacterium
AEPPAGSDLK

SEQ ID NO: 418832 - protein, 19 aa, Mycobacterium
AEPPASWGDDGQKVRTPAE

SEQ ID NO: 418833 - protein, 6 aa, Mycobacterium
AEPPCP

SEQ ID NO: 418834 - protein, 5 aa, Mycobacterium
AEPPD

SEQ ID NO: 418835 - protein, 7 aa, Mycobacterium
AEPPESA

SEQ ID NO: 418836 - protein, 54 aa, Mycobacterium
AEPPFAAPADRAPAPVEEPVEPVENGRHHAPAEEPAEDTRDEPAAVSQEVPVEP

SEQ ID NO: 418837 - protein, 8 aa, Mycobacterium
AEPPHGPE

SEQ ID NO: 418838 - protein, 8 aa, Mycobacterium
AEPPMTKD

SEQ ID NO: 418839 - protein, 8 aa, Mycobacterium
AEPPPDAT

SEQ ID NO: 418840 - protein, 6 aa, Mycobacterium
AEPPRW

SEQ ID NO: 418841 - protein, 24 aa, Mycobacterium
AEPPSATSMHTRQPTALPATGETV

SEQ ID NO: 418842 - protein, 6 aa, Mycobacterium
AEPPVG

SEQ ID NO: 418843 - protein, 8 aa, Mycobacterium
AEPPVGRD

SEQ ID NO: 418844 - protein, 8 aa, Mycobacterium
AEPPVGTR

SEQ ID NO: 418845 - protein, 7 aa, Mycobacterium
AEPPVRR

SEQ ID NO: 418846 - protein, 4 aa, Mycobacterium
AEPQ

SEQ ID NO: 418847 - protein, 6 aa, Mycobacterium
AEPQAQ

SEQ ID NO: 418848 - protein, 7 aa, Mycobacterium
AEPQARK

SEQ ID NO: 418849 - protein, 5 aa, Mycobacterium
AEPQE

SEQ ID NO: 418850 - protein, 9 aa, Mycobacterium
AEPQGRPEL

SEQ ID NO: 418851 - protein, 7 aa, Mycobacterium
AEPQLSR

SEQ ID NO: 418852 - protein, 7 aa, Mycobacterium
AEPQPRD

SEQ ID NO: 418853 - protein, 7 aa, Mycobacterium
AEPQRAR

SEQ ID NO: 418854 - protein, 8 aa, Mycobacterium
AEPQRGKS

SEQ ID NO: 418855 - protein, 7 aa, Mycobacterium
AEPQRGM

SEQ ID NO: 418856 - protein, 6 aa, Mycobacterium
AEPRDG

SEQ ID NO: 418857 - protein, 12 aa, Mycobacterium
AEPRFDPARQRV

SEQ ID NO: 418858 - protein, 10 aa, Mycobacterium
AEPRGGQGPW

SEQ ID NO: 418859 - protein, 10 aa, Mycobacterium
AEPRGRKGPW

SEQ ID NO: 418860 - protein, 7 aa, Mycobacterium
AEPRHDP

SEQ ID NO: 418861 - protein, 20 aa, Mycobacterium
AEPRLSRGPAESLSGQTVSS

SEQ ID NO: 418862 - protein, 9 aa, Mycobacterium
AEPRNEHKK

SEQ ID NO: 418863 - protein, 9 aa, Mycobacterium
AEPRNEHKR

SEQ ID NO: 418864 - protein, 8 aa, Mycobacterium
AEPRRKKG

SEQ ID NO: 418865 - protein, 10 aa, Mycobacterium
AEPRSEHKNH

SEQ ID NO: 418866 - protein, 7 aa, Mycobacterium
AEPRTAE

SEQ ID NO: 418867 - protein, 8 aa, Mycobacterium
AEPRTPVD

SEQ ID NO: 418868 - protein, 6 aa, Mycobacterium
AEPRVA

SEQ ID NO: 418869 - protein, 9 aa, Mycobacterium
AEPRYTPSA

SEQ ID NO: 418870 - protein, 4 aa, Mycobacterium
AEPS

SEQ ID NO: 418871 - protein, 5 aa, Mycobacterium
AEPSA

SEQ ID NO: 418872 - protein, 9 aa, Mycobacterium
AEPSAALSE

SEQ ID NO: 418873 - protein, 9 aa, Mycobacterium
AEPSADDTA

SEQ ID NO: 418874 - protein, 7 aa, Mycobacterium
AEPSAKT

SEQ ID NO: 418875 - protein, 9 aa, Mycobacterium
AEPSAPLEE

SEQ ID NO: 418876 - protein, 12 aa, Mycobacterium
AEPSAPLSDVRG

SEQ ID NO: 418877 - protein, 10 aa, Mycobacterium
AEPSASLSEV

SEQ ID NO: 418878 - protein, 5 aa, Mycobacterium
AEPSE

SEQ ID NO: 418879 - protein, 6 aa, Mycobacterium
AEPSGA

SEQ ID NO: 418880 - protein, 7 aa, Mycobacterium
AEPSGAV

SEQ ID NO: 418881 - protein, 17 aa, Mycobacterium
AEPSGPQALAGPSGGRG

SEQ ID NO: 418882 - protein, 9 aa, Mycobacterium
AEPSGTGIR

SEQ ID NO: 418883 - protein, 12 aa, Mycobacterium
AEPSLSGPGRDE

SEQ ID NO: 418884 - protein, 10 aa, Mycobacterium
AEPSMKGRNG

SEQ ID NO: 418885 - protein, 5 aa, Mycobacterium
AEPSP

SEQ ID NO: 418886 - protein, 5 aa, Mycobacterium
AEPSR

SEQ ID NO: 418887 - protein, 6 aa, Mycobacterium
AEPSRG

SEQ ID NO: 418888 - protein, 6 aa, Mycobacterium
AEPSVD

SEQ ID NO: 418889 - protein, 18 aa, Mycobacterium
AEPTAHDPDARGHFGPYG

SEQ ID NO: 418890 - protein, 15 aa, Mycobacterium
AEPTAPAAPSGGNPL

SEQ ID NO: 418891 - protein, 23 aa, Mycobacterium
AEPTAPLPPPTSTQEPSDKSAMM

SEQ ID NO: 418892 - protein, 12 aa, Mycobacterium
AEPTAPQPDNPV

SEQ ID NO: 418893 - protein, 12 aa, Mycobacterium
AEPTASARGAEA

SEQ ID NO: 418894 - protein, 12 aa, Mycobacterium
AEPTASEAQMTE

SEQ ID NO: 418895 - protein, 6 aa, Mycobacterium
AEPTCR

SEQ ID NO: 418896 - protein, 6 aa, Mycobacterium
AEPTDL

SEQ ID NO: 418897 - protein, 5 aa, Mycobacterium
AEPTE

SEQ ID NO: 418898 - protein, 7 aa, Mycobacterium
AEPTGDA

SEQ ID NO: 418899 - protein, 7 aa, Mycobacterium
AEPTGDN

SEQ ID NO: 418900 - protein, 7 aa, Mycobacterium
AEPTGDP

SEQ ID NO: 418901 - protein, 7 aa, Mycobacterium
AEPTGLN

SEQ ID NO: 418902 - protein, 17 aa, Mycobacterium
AEPTPAARTATRRADRA

SEQ ID NO: 418903 - protein, 9 aa, Mycobacterium
AEPTPAPGW

SEQ ID NO: 418904 - protein, 7 aa, Mycobacterium
AEPTPLR

SEQ ID NO: 418905 - protein, 6 aa, Mycobacterium
AEPTQM

SEQ ID NO: 418906 - protein, 7 aa, Mycobacterium
AEPTREN

SEQ ID NO: 418907 - protein, 5 aa, Mycobacterium
AEPTV

SEQ ID NO: 418908 - protein, 6 aa, Mycobacterium
AEPVAE

SEQ ID NO: 418909 - protein, 6 aa, Mycobacterium
AEPVAP

SEQ ID NO: 418910 - protein, 15 aa, Mycobacterium
AEPVAPPAVLPDDGV

SEQ ID NO: 418911 - protein, 9 aa, Mycobacterium
AEPVDGPWA

SEQ ID NO: 418912 - protein, 6 aa, Mycobacterium
AEPVDP

SEQ ID NO: 418913 - protein, 8 aa, Mycobacterium
AEPVEPSD

SEQ ID NO: 418914 - protein, 7 aa, Mycobacterium
AEPVGDP

SEQ ID NO: 418915 - protein, 6 aa, Mycobacterium
AEPVPA

SEQ ID NO: 418916 - protein, 6 aa, Mycobacterium
AEPVPH

SEQ ID NO: 418917 - protein, 7 aa, Mycobacterium
AEPVPPE

SEQ ID NO: 418918 - protein, 10 aa, Mycobacterium
AEPVPSGATV

SEQ ID NO: 418919 - protein, 6 aa, Mycobacterium
AEPVPT

SEQ ID NO: 418920 - protein, 8 aa, Mycobacterium
AEPVSSAE

SEQ ID NO: 418921 - protein, 4 aa, Mycobacterium
AEPW

SEQ ID NO: 418922 - protein, 4 aa, Mycobacterium
AEPY

SEQ ID NO: 418923 - protein, 6 aa, Mycobacterium
AEPYEV

SEQ ID NO: 418924 - protein, 8 aa, Mycobacterium
AEPYKEEW

SEQ ID NO: 418925 - protein, 8 aa, Mycobacterium
AEPYQADP

SEQ ID NO: 418926 - protein, 9 aa, Mycobacterium
AEPYQADPE

SEQ ID NO: 418927 - protein, 6 aa, Mycobacterium
AEPYSG

SEQ ID NO: 418928 - protein, 7 aa, Mycobacterium
AEQAAAA

SEQ ID NO: 418929 - protein, 14 aa, Mycobacterium
AEQAAAEESTDVED

SEQ ID NO: 418930 - protein, 8 aa, Mycobacterium
AEQAAESE

SEQ ID NO: 418931 - protein, 11 aa, Mycobacterium
AEQAAQAAGDY

SEQ ID NO: 418932 - protein, 9 aa, Mycobacterium
AEQAARAGH

SEQ ID NO: 418933 - protein, 6 aa, Mycobacterium
AEQAAW

SEQ ID NO: 418934 - protein, 7 aa, Mycobacterium
AEQAEAA

SEQ ID NO: 418935 - protein, 15 aa, Mycobacterium
AEQAEAAAAKIGTGE

SEQ ID NO: 418936 - protein, 10 aa, Mycobacterium
AEQAERMGTR

SEQ ID NO: 418937 - protein, 8 aa, Mycobacterium
AEQAGGAK

SEQ ID NO: 418938 - protein, 11 aa, Mycobacterium
AEQAGNDQWQA

SEQ ID NO: 418939 - protein, 6 aa, Mycobacterium
AEQAGV

SEQ ID NO: 418940 - protein, 10 aa, Mycobacterium
AEQAGVDVED

SEQ ID NO: 418941 - protein, 20 aa, Mycobacterium
AEQAHRDLQGRRTVGSVVLI

SEQ ID NO: 418942 - protein, 20 aa, Mycobacterium
AEQAKGATTTFGRPADDEDA

SEQ ID NO: 418943 - protein, 9 aa, Mycobacterium
AEQAKGPEV

SEQ ID NO: 418944 - protein, 8 aa, Mycobacterium
AEQAKGQE

SEQ ID NO: 418945 - protein, 5 aa, Mycobacterium
AEQAL

SEQ ID NO: 418946 - protein, 18 aa, Mycobacterium
AEQAMAEGDINEQCDPQD

SEQ ID NO: 418947 - protein, 11 aa, Mycobacterium
AEQANAGEELY

SEQ ID NO: 418948 - protein, 11 aa, Mycobacterium
AEQANAGEGLY

SEQ ID NO: 418949 - protein, 15 aa, Mycobacterium
AEQARQSRALAAAPA

SEQ ID NO: 418950 - protein, 9 aa, Mycobacterium
AEQARRGDG

SEQ ID NO: 418951 - protein, 12 aa, Mycobacterium
AEQASEEELGGR

SEQ ID NO: 418952 - protein, 17 aa, Mycobacterium
AEQASQVETVKRSEAGM

SEQ ID NO: 418953 - protein, 6 aa, Mycobacterium
AEQATW

SEQ ID NO: 418954 - protein, 16 aa, Mycobacterium
AEQCQQAAAQATAAAA

SEQ ID NO: 418955 - protein, 8 aa, Mycobacterium
AEQDAREL

SEQ ID NO: 418956 - protein, 10 aa, Mycobacterium
AEQDATTSGA

SEQ ID NO: 418957 - protein, 6 aa, Mycobacterium
AEQDGL

SEQ ID NO: 418958 - protein, 11 aa, Mycobacterium
AEQDGRLSPGA

SEQ ID NO: 418959 - protein, 15 aa, Mycobacterium
AEQDPRKSFPAPTEL

SEQ ID NO: 418960 - protein, 9 aa, Mycobacterium
AEQEEPEGL

SEQ ID NO: 418961 - protein, 12 aa, Mycobacterium
AEQEERDEDEKV

SEQ ID NO: 418962 - protein, 15 aa, Mycobacterium
AEQEGDASNSPFKSL

SEQ ID NO: 418963 - protein, 12 aa, Mycobacterium
AEQEQELGTTHA

SEQ ID NO: 418964 - protein, 6 aa, Mycobacterium
AEQEQT

SEQ ID NO: 418965 - protein, 13 aa, Mycobacterium
AEQESGVGSEPEV

SEQ ID NO: 418966 - protein, 7 aa, Mycobacterium
AEQEVGE

SEQ ID NO: 418967 - protein, 5 aa, Mycobacterium
AEQFR

SEQ ID NO: 418968 - protein, 5 aa, Mycobacterium
AEQGA

SEQ ID NO: 418969 - protein, 7 aa, Mycobacterium
AEQGADT

SEQ ID NO: 418970 - protein, 5 aa, Mycobacterium
AEQGE

SEQ ID NO: 418971 - protein, 9 aa, Mycobacterium
AEQGGFGAS

SEQ ID NO: 418972 - protein, 9 aa, Mycobacterium
AEQGKSDWA

SEQ ID NO: 418973 - protein, 5 aa, Mycobacterium
AEQGQ

SEQ ID NO: 418974 - protein, 10 aa, Mycobacterium
AEQGRDPAGF

SEQ ID NO: 418975 - protein, 8 aa, Mycobacterium
AEQGRTGP

SEQ ID NO: 418976 - protein, 6 aa, Mycobacterium
AEQGRY

SEQ ID NO: 418977 - protein, 23 aa, Mycobacterium
AEQGTDASSDRSITAAGPPVQPG

SEQ ID NO: 418978 - protein, 5 aa, Mycobacterium
AEQGV

SEQ ID NO: 418979 - protein, 17 aa, Mycobacterium
AEQHAASDHALIWADLE

SEQ ID NO: 418980 - protein, 6 aa, Mycobacterium
AEQHGR

SEQ ID NO: 418981 - protein, 6 aa, Mycobacterium
AEQHPD

SEQ ID NO: 418982 - protein, 7 aa, Mycobacterium
AEQHPEG

SEQ ID NO: 418983 - protein, 8 aa, Mycobacterium
AEQHQRTV

SEQ ID NO: 418984 - protein, 7 aa, Mycobacterium
AEQHTPH

SEQ ID NO: 418985 - protein, 6 aa, Mycobacterium
AEQIPG

SEQ ID NO: 418986 - protein, 7 aa, Mycobacterium
AEQIRTG

SEQ ID NO: 418987 - protein, 12 aa, Mycobacterium
AEQKAADERAQH

SEQ ID NO: 418988 - protein, 87 aa, Mycobacterium
AEQKAAKKAQAARKQPAKKATARSAAKKQPAKKAPAKSAAKKAAKTTSGKANPRRASKAAVTDGEAQQPGIDQADAPESSSPGPEGL

SEQ ID NO: 418989 - protein, 9 aa, Mycobacterium
AEQKARNRA

SEQ ID NO: 418990 - protein, 8 aa, Mycobacterium
AEQKARNV

SEQ ID NO: 418991 - protein, 6 aa, Mycobacterium
AEQKAV

SEQ ID NO: 418992 - protein, 14 aa, Mycobacterium
AEQKAYEQSSWTGV

SEQ ID NO: 418993 - protein, 5 aa, Mycobacterium
AEQKP

SEQ ID NO: 418994 - protein, 9 aa, Mycobacterium
AEQKSAPTS

SEQ ID NO: 418995 - protein, 6 aa, Mycobacterium
AEQKTL

SEQ ID NO: 418996 - protein, 16 aa, Mycobacterium
AEQLAHTGSRGFPADQ

SEQ ID NO: 418997 - protein, 7 aa, Mycobacterium
AEQLGGS

SEQ ID NO: 418998 - protein, 6 aa, Mycobacterium
AEQLGP

SEQ ID NO: 418999 - protein, 5 aa, Mycobacterium
AEQNA

SEQ ID NO: 419000 - protein, 18 aa, Mycobacterium
AEQNGYPVGERRVYYADI

SEQ ID NO: 419001 - protein, 11 aa, Mycobacterium
AEQNVAPGSRT

SEQ ID NO: 419002 - protein, 9 aa, Mycobacterium
AEQPDGARV

SEQ ID NO: 419003 - protein, 7 aa, Mycobacterium
AEQPDGG

SEQ ID NO: 419004 - protein, 8 aa, Mycobacterium
AEQPDKLE

SEQ ID NO: 419005 - protein, 17 aa, Mycobacterium
AEQPDLQLPTDEEIGSA

SEQ ID NO: 419006 - protein, 17 aa, Mycobacterium
AEQPDLQLPTEEEIGSA

SEQ ID NO: 419007 - protein, 7 aa, Mycobacterium
AEQPDRV

SEQ ID NO: 419008 - protein, 6 aa, Mycobacterium
AEQPDT

SEQ ID NO: 419009 - protein, 7 aa, Mycobacterium
AEQPGFR

SEQ ID NO: 419010 - protein, 10 aa, Mycobacterium
AEQPGIAASA

SEQ ID NO: 419011 - protein, 15 aa, Mycobacterium
AEQPITEATPDSPAA

SEQ ID NO: 419012 - protein, 11 aa, Mycobacterium
AEQPPRPLAEA

SEQ ID NO: 419013 - protein, 9 aa, Mycobacterium
AEQPPSPRI

SEQ ID NO: 419014 - protein, 8 aa, Mycobacterium
AEQPRPGT

SEQ ID NO: 419015 - protein, 8 aa, Mycobacterium
AEQPSAVA

SEQ ID NO: 419016 - protein, 7 aa, Mycobacterium
AEQPTAV

SEQ ID NO: 419017 - protein, 11 aa, Mycobacterium
AEQPTLQLPSE

SEQ ID NO: 419018 - protein, 5 aa, Mycobacterium
AEQPV

SEQ ID NO: 419019 - protein, 4 aa, Mycobacterium
AEQQ

SEQ ID NO: 419020 - protein, 13 aa, Mycobacterium
AEQQAADERARSR

SEQ ID NO: 419021 - protein, 8 aa, Mycobacterium
AEQQGVSR

SEQ ID NO: 419022 - protein, 13 aa, Mycobacterium
AEQQIAGTQQRDF

SEQ ID NO: 419023 - protein, 6 aa, Mycobacterium
AEQQRI

SEQ ID NO: 419024 - protein, 12 aa, Mycobacterium
AEQQRPGLPAAR

SEQ ID NO: 419025 - protein, 9 aa, Mycobacterium
AEQQRRGRN

SEQ ID NO: 419026 - protein, 15 aa, Mycobacterium
AEQQRRSYTAKLKAA

SEQ ID NO: 419027 - protein, 7 aa, Mycobacterium
AEQQSLE

SEQ ID NO: 419028 - protein, 7 aa, Mycobacterium
AEQRADY

SEQ ID NO: 419029 - protein, 11 aa, Mycobacterium
AEQRADYRQRA

SEQ ID NO: 419030 - protein, 12 aa, Mycobacterium
AEQRAQARQNPE

SEQ ID NO: 419031 - protein, 9 aa, Mycobacterium
AEQRAQATQ

SEQ ID NO: 419032 - protein, 7 aa, Mycobacterium
AEQRASQ

SEQ ID NO: 419033 - protein, 7 aa, Mycobacterium
AEQRATV

SEQ ID NO: 419034 - protein, 10 aa, Mycobacterium
AEQRDPANRR

SEQ ID NO: 419035 - protein, 10 aa, Mycobacterium
AEQRDPRNRR

SEQ ID NO: 419036 - protein, 7 aa, Mycobacterium
AEQRERA

SEQ ID NO: 419037 - protein, 6 aa, Mycobacterium
AEQRFG

SEQ ID NO: 419038 - protein, 5 aa, Mycobacterium
AEQRG

SEQ ID NO: 419039 - protein, 6 aa, Mycobacterium
AEQRGA

SEQ ID NO: 419040 - protein, 8 aa, Mycobacterium
AEQRGHPK

SEQ ID NO: 419041 - protein, 9 aa, Mycobacterium
AEQRGRDAV

SEQ ID NO: 419042 - protein, 17 aa, Mycobacterium
AEQRHADQLRKSGDPYI

SEQ ID NO: 419043 - protein, 6 aa, Mycobacterium
AEQRHE

SEQ ID NO: 419044 - protein, 5 aa, Mycobacterium
AEQRL

SEQ ID NO: 419045 - protein, 7 aa, Mycobacterium
AEQRLGD

SEQ ID NO: 419046 - protein, 8 aa, Mycobacterium
AEQRPDAP

SEQ ID NO: 419047 - protein, 8 aa, Mycobacterium
AEQRPDDL

SEQ ID NO: 419048 - protein, 11 aa, Mycobacterium
AEQRPTYRDAQ

SEQ ID NO: 419049 - protein, 5 aa, Mycobacterium
AEQRQ

SEQ ID NO: 419050 - protein, 5 aa, Mycobacterium
AEQRR

SEQ ID NO: 419051 - protein, 8 aa, Mycobacterium
AEQRRDET

SEQ ID NO: 419052 - protein, 10 aa, Mycobacterium
AEQRSDDAAL

SEQ ID NO: 419053 - protein, 6 aa, Mycobacterium
AEQRSR

SEQ ID NO: 419054 - protein, 7 aa, Mycobacterium
AEQRSTV

SEQ ID NO: 419055 - protein, 5 aa, Mycobacterium
AEQRT

SEQ ID NO: 419056 - protein, 4 aa, Mycobacterium
AEQS

SEQ ID NO: 419057 - protein, 12 aa, Mycobacterium
AEQSDDAQPGVR

SEQ ID NO: 419058 - protein, 13 aa, Mycobacterium
AEQSDDDLRDPIT

SEQ ID NO: 419059 - protein, 6 aa, Mycobacterium
AEQSEN

SEQ ID NO: 419060 - protein, 7 aa, Mycobacterium
AEQSGFG

SEQ ID NO: 419061 - protein, 5 aa, Mycobacterium
AEQSL

SEQ ID NO: 419062 - protein, 7 aa, Mycobacterium
AEQSNTS

SEQ ID NO: 419063 - protein, 12 aa, Mycobacterium
AEQSQLGPASAQ

SEQ ID NO: 419064 - protein, 5 aa, Mycobacterium
AEQSR

SEQ ID NO: 419065 - protein, 6 aa, Mycobacterium
AEQSRA

SEQ ID NO: 419066 - protein, 12 aa, Mycobacterium
AEQSRQRTIERR

SEQ ID NO: 419067 - protein, 7 aa, Mycobacterium
AEQSSCG

SEQ ID NO: 419068 - protein, 16 aa, Mycobacterium
AEQSSEEQLGGRLPSA

SEQ ID NO: 419069 - protein, 7 aa, Mycobacterium
AEQSSQL

SEQ ID NO: 419070 - protein, 13 aa, Mycobacterium
AEQSTPGAAEPGW

SEQ ID NO: 419071 - protein, 12 aa, Mycobacterium
AEQSVNDTGRIA

SEQ ID NO: 419072 - protein, 7 aa, Mycobacterium
AEQTANA

SEQ ID NO: 419073 - protein, 14 aa, Mycobacterium
AEQTARQAAAAAGA

SEQ ID NO: 419074 - protein, 13 aa, Mycobacterium
AEQTARQDTAEQA

SEQ ID NO: 419075 - protein, 6 aa, Mycobacterium
AEQTDA

SEQ ID NO: 419076 - protein, 8 aa, Mycobacterium
AEQTDDAE

SEQ ID NO: 419077 - protein, 9 aa, Mycobacterium
AEQTDDKEL

SEQ ID NO: 419078 - protein, 8 aa, Mycobacterium
AEQTDLAT

SEQ ID NO: 419079 - protein, 5 aa, Mycobacterium
AEQTE

SEQ ID NO: 419080 - protein, 9 aa, Mycobacterium
AEQTEDAEL

SEQ ID NO: 419081 - protein, 7 aa, Mycobacterium
AEQTESA

SEQ ID NO: 419082 - protein, 7 aa, Mycobacterium
AEQTGRR

SEQ ID NO: 419083 - protein, 6 aa, Mycobacterium
AEQTGS

SEQ ID NO: 419084 - protein, 8 aa, Mycobacterium
AEQTPGAR

SEQ ID NO: 419085 - protein, 8 aa, Mycobacterium
AEQTQQAA

SEQ ID NO: 419086 - protein, 11 aa, Mycobacterium
AEQTQQTATQC

SEQ ID NO: 419087 - protein, 6 aa, Mycobacterium
AEQTQW

SEQ ID NO: 419088 - protein, 12 aa, Mycobacterium
AEQTRLARLDRM

SEQ ID NO: 419089 - protein, 17 aa, Mycobacterium
AEQTRQGIADYLERLRR

SEQ ID NO: 419090 - protein, 8 aa, Mycobacterium
AEQTRTPI

SEQ ID NO: 419091 - protein, 11 aa, Mycobacterium
AEQTSELDDAR

SEQ ID NO: 419092 - protein, 5 aa, Mycobacterium
AEQVA

SEQ ID NO: 419093 - protein, 11 aa, Mycobacterium
AEQVAKNKSVE

SEQ ID NO: 419094 - protein, 13 aa, Mycobacterium
AEQVAKSKAQELT

SEQ ID NO: 419095 - protein, 9 aa, Mycobacterium
AEQVDPDDV

SEQ ID NO: 419096 - protein, 17 aa, Mycobacterium
AEQVENGLAPAEVTVSS

SEQ ID NO: 419097 - protein, 14 aa, Mycobacterium
AEQVKGATYPNPPV

SEQ ID NO: 419098 - protein, 12 aa, Mycobacterium
AEQVPGERYEHG

SEQ ID NO: 419099 - protein, 5 aa, Mycobacterium
AEQVS

SEQ ID NO: 419100 - protein, 5 aa, Mycobacterium
AEQWS

SEQ ID NO: 419101 - protein, 5 aa, Mycobacterium
AEQYG

SEQ ID NO: 419102 - protein, 5 aa, Mycobacterium
AERAA

SEQ ID NO: 419103 - protein, 7 aa, Mycobacterium
AERAAAA

SEQ ID NO: 419104 - protein, 9 aa, Mycobacterium
AERAAGAHP

SEQ ID NO: 419105 - protein, 7 aa, Mycobacterium
AERAAGN

SEQ ID NO: 419106 - protein, 10 aa, Mycobacterium
AERAARRRGR

SEQ ID NO: 419107 - protein, 19 aa, Mycobacterium
AERADGAATRLDASATASV

SEQ ID NO: 419108 - protein, 7 aa, Mycobacterium
AERADHR

SEQ ID NO: 419109 - protein, 7 aa, Mycobacterium
AERADQV

SEQ ID NO: 419110 - protein, 15 aa, Mycobacterium
AERADRRREPAQSSS

SEQ ID NO: 419111 - protein, 6 aa, Mycobacterium
AERAEA

SEQ ID NO: 419112 - protein, 12 aa, Mycobacterium
AERAEALRRYQS

SEQ ID NO: 419113 - protein, 9 aa, Mycobacterium
AERAEDLRS

SEQ ID NO: 419114 - protein, 7 aa, Mycobacterium
AERAEEK

SEQ ID NO: 419115 - protein, 9 aa, Mycobacterium
AERAEGGTA

SEQ ID NO: 419116 - protein, 10 aa, Mycobacterium
AERAELSRSM

SEQ ID NO: 419117 - protein, 31 aa, Mycobacterium
AERAERELRATGAKVRKRSASSEKALTAQEA

SEQ ID NO: 419118 - protein, 8 aa, Mycobacterium
AERAERID

SEQ ID NO: 419119 - protein, 7 aa, Mycobacterium
AERAERL

SEQ ID NO: 419120 - protein, 6 aa, Mycobacterium
AERAEV

SEQ ID NO: 419121 - protein, 20 aa, Mycobacterium
AERAGADENGVAEAIMAAAN

SEQ ID NO: 419122 - protein, 17 aa, Mycobacterium
AERAGAGPLRPGPDDVR

SEQ ID NO: 419123 - protein, 10 aa, Mycobacterium
AERAGEGRGS

SEQ ID NO: 419124 - protein, 11 aa, Mycobacterium
AERAGISSGVS

SEQ ID NO: 419125 - protein, 6 aa, Mycobacterium
AERAGM

SEQ ID NO: 419126 - protein, 6 aa, Mycobacterium
AERAGQ

SEQ ID NO: 419127 - protein, 10 aa, Mycobacterium
AERAGRPRPR

SEQ ID NO: 419128 - protein, 9 aa, Mycobacterium
AERAGSGVR

SEQ ID NO: 419129 - protein, 8 aa, Mycobacterium
AERAGTRL

SEQ ID NO: 419130 - protein, 9 aa, Mycobacterium
AERAKHDPA

SEQ ID NO: 419131 - protein, 6 aa, Mycobacterium
AERAKI

SEQ ID NO: 419132 - protein, 13 aa, Mycobacterium
AERAMSQDSGDAA

SEQ ID NO: 419133 - protein, 22 aa, Mycobacterium
AERAPDSGRCKQRSRAGTATQH

SEQ ID NO: 419134 - protein, 7 aa, Mycobacterium
AERAQGL

SEQ ID NO: 419135 - protein, 10 aa, Mycobacterium
AERAQSQRRY

SEQ ID NO: 419136 - protein, 7 aa, Mycobacterium
AERAQTL

SEQ ID NO: 419137 - protein, 7 aa, Mycobacterium
AERARAA

SEQ ID NO: 419138 - protein, 11 aa, Mycobacterium
AERARDLKQRP

SEQ ID NO: 419139 - protein, 9 aa, Mycobacterium
AERARDLQQ

SEQ ID NO: 419140 - protein, 13 aa, Mycobacterium
AERARGAAPSVVP

SEQ ID NO: 419141 - protein, 8 aa, Mycobacterium
AERARNEA

SEQ ID NO: 419142 - protein, 12 aa, Mycobacterium
AERARPHTGRTV

SEQ ID NO: 419143 - protein, 10 aa, Mycobacterium
AERARQTAAR

SEQ ID NO: 419144 - protein, 10 aa, Mycobacterium
AERARRDADP

SEQ ID NO: 419145 - protein, 13 aa, Mycobacterium
AERARRELSATGE

SEQ ID NO: 419146 - protein, 11 aa, Mycobacterium
AERARVKGRYR

SEQ ID NO: 419147 - protein, 11 aa, Mycobacterium
AERASDAASLD

SEQ ID NO: 419148 - protein, 8 aa, Mycobacterium
AERASGFR

SEQ ID NO: 419149 - protein, 6 aa, Mycobacterium
AERATS

SEQ ID NO: 419150 - protein, 17 aa, Mycobacterium
AERATSSCTEVPAKASV

SEQ ID NO: 419151 - protein, 6 aa, Mycobacterium
AERAVG

SEQ ID NO: 419152 - protein, 11 aa, Mycobacterium
AERAYAEREKQ

SEQ ID NO: 419153 - protein, 8 aa, Mycobacterium
AERAYDGE

SEQ ID NO: 419154 - protein, 13 aa, Mycobacterium
AERAYRDKQAPLA

SEQ ID NO: 419155 - protein, 14 aa, Mycobacterium
AERDAKANGWQPPS

SEQ ID NO: 419156 - protein, 6 aa, Mycobacterium
AERDAV

SEQ ID NO: 419157 - protein, 11 aa, Mycobacterium
AERDDDADNPL

SEQ ID NO: 419158 - protein, 5 aa, Mycobacterium
AERDG

SEQ ID NO: 419159 - protein, 10 aa, Mycobacterium
AERDGAQAGL

SEQ ID NO: 419160 - protein, 6 aa, Mycobacterium
AERDGD

SEQ ID NO: 419161 - protein, 6 aa, Mycobacterium
AERDGG

SEQ ID NO: 419162 - protein, 9 aa, Mycobacterium
AERDGGRKV

SEQ ID NO: 419163 - protein, 6 aa, Mycobacterium
AERDGI

SEQ ID NO: 419164 - protein, 8 aa, Mycobacterium
AERDGLLQ

SEQ ID NO: 419165 - protein, 12 aa, Mycobacterium
AERDGTGQLGDT

SEQ ID NO: 419166 - protein, 7 aa, Mycobacterium
AERDGTY

SEQ ID NO: 419167 - protein, 6 aa, Mycobacterium
AERDGV

SEQ ID NO: 419168 - protein, 5 aa, Mycobacterium
AERDI

SEQ ID NO: 419169 - protein, 11 aa, Mycobacterium
AERDPAGCSDD

SEQ ID NO: 419170 - protein, 11 aa, Mycobacterium
AERDPAGCTDG

SEQ ID NO: 419171 - protein, 8 aa, Mycobacterium
AERDPETA

SEQ ID NO: 419172 - protein, 6 aa, Mycobacterium
AERDPT

SEQ ID NO: 419173 - protein, 6 aa, Mycobacterium
AERDQL

SEQ ID NO: 419174 - protein, 5 aa, Mycobacterium
AERDR

SEQ ID NO: 419175 - protein, 5 aa, Mycobacterium
AERDS

SEQ ID NO: 419176 - protein, 53 aa, Mycobacterium
AERDSAQARLGAARPVAGTATAPTVPQPGAAQAPGDQWDRSDSLPADNSGAGL

SEQ ID NO: 419177 - protein, 55 aa, Mycobacterium
AERDSAQTRLTTARPVAATTRQPTAAQPGTPVPPSGQWDRSSPAPADSSGTGQWD

SEQ ID NO: 419178 - protein, 8 aa, Mycobacterium
AERDSGID

SEQ ID NO: 419179 - protein, 5 aa, Mycobacterium
AERDT

SEQ ID NO: 419180 - protein, 6 aa, Mycobacterium
AEREAR

SEQ ID NO: 419181 - protein, 15 aa, Mycobacterium
AEREARARAARAAAA

SEQ ID NO: 419182 - protein, 13 aa, Mycobacterium
AEREASDDVEDAE

SEQ ID NO: 419183 - protein, 5 aa, Mycobacterium
AEREE

SEQ ID NO: 419184 - protein, 9 aa, Mycobacterium
AEREENEEF

SEQ ID NO: 419185 - protein, 6 aa, Mycobacterium
AEREGA

SEQ ID NO: 419186 - protein, 6 aa, Mycobacterium
AEREGR

SEQ ID NO: 419187 - protein, 14 aa, Mycobacterium
AEREGRDEDARELR

SEQ ID NO: 419188 - protein, 7 aa, Mycobacterium
AEREGRE

SEQ ID NO: 419189 - protein, 8 aa, Mycobacterium
AEREGRLH

SEQ ID NO: 419190 - protein, 12 aa, Mycobacterium
AEREKASRSRFR

SEQ ID NO: 419191 - protein, 35 aa, Mycobacterium
AERELGSAEHNYERAEEASRTAADSLAEAKARLKR

SEQ ID NO: 419192 - protein, 17 aa, Mycobacterium
AEREPDDEDEAASEESK

SEQ ID NO: 419193 - protein, 8 aa, Mycobacterium
AEREPERK

SEQ ID NO: 419194 - protein, 9 aa, Mycobacterium
AEREPRGAK

SEQ ID NO: 419195 - protein, 5 aa, Mycobacterium
AEREQ

SEQ ID NO: 419196 - protein, 6 aa, Mycobacterium
AEREQG

SEQ ID NO: 419197 - protein, 11 aa, Mycobacterium
AERERDAPDPI

SEQ ID NO: 419198 - protein, 9 aa, Mycobacterium
AEREREAAR

SEQ ID NO: 419199 - protein, 10 aa, Mycobacterium
AERERGAAPV

SEQ ID NO: 419200 - protein, 14 aa, Mycobacterium
AERESGRAPDGVDP

SEQ ID NO: 419201 - protein, 7 aa, Mycobacterium
AERETPK

SEQ ID NO: 419202 - protein, 8 aa, Mycobacterium
AERETPKS

SEQ ID NO: 419203 - protein, 6 aa, Mycobacterium
AERETY

SEQ ID NO: 419204 - protein, 5 aa, Mycobacterium
AEREV

SEQ ID NO: 419205 - protein, 5 aa, Mycobacterium
AERGA

SEQ ID NO: 419206 - protein, 14 aa, Mycobacterium
AERGAAELADASAE

SEQ ID NO: 419207 - protein, 14 aa, Mycobacterium
AERGAAELGEHATA

SEQ ID NO: 419208 - protein, 19 aa, Mycobacterium
AERGADVDSAIRTATTDDV

SEQ ID NO: 419209 - protein, 10 aa, Mycobacterium
AERGAEGPLP

SEQ ID NO: 419210 - protein, 30 aa, Mycobacterium
AERGCASAEGSSSGDVGTGDEDAASDEDFD

SEQ ID NO: 419211 - protein, 6 aa, Mycobacterium
AERGDP

SEQ ID NO: 419212 - protein, 6 aa, Mycobacterium
AERGDQ

SEQ ID NO: 419213 - protein, 13 aa, Mycobacterium
AERGDSEVLPTPR

SEQ ID NO: 419214 - protein, 5 aa, Mycobacterium
AERGE

SEQ ID NO: 419215 - protein, 11 aa, Mycobacterium
AERGEHELKGV

SEQ ID NO: 419216 - protein, 7 aa, Mycobacterium
AERGELR

SEQ ID NO: 419217 - protein, 8 aa, Mycobacterium
AERGGAEV

SEQ ID NO: 419218 - protein, 12 aa, Mycobacterium
AERGGDVEATRA

SEQ ID NO: 419219 - protein, 15 aa, Mycobacterium
AERGGPAAAQAERDL

SEQ ID NO: 419220 - protein, 15 aa, Mycobacterium
AERGGPAGAQATRDL

SEQ ID NO: 419221 - protein, 5 aa, Mycobacterium
AERGI

SEQ ID NO: 419222 - protein, 8 aa, Mycobacterium
AERGKAPL

SEQ ID NO: 419223 - protein, 6 aa, Mycobacterium
AERGKK

SEQ ID NO: 419224 - protein, 5 aa, Mycobacterium
AERGL

SEQ ID NO: 419225 - protein, 19 aa, Mycobacterium
AERGNWPPGFPEGKRPTYS

SEQ ID NO: 419226 - protein, 6 aa, Mycobacterium
AERGPA

SEQ ID NO: 419227 - protein, 9 aa, Mycobacterium
AERGPDGTL

SEQ ID NO: 419228 - protein, 8 aa, Mycobacterium
AERGPRVS

SEQ ID NO: 419229 - protein, 6 aa, Mycobacterium
AERGQE

SEQ ID NO: 419230 - protein, 7 aa, Mycobacterium
AERGQGE

SEQ ID NO: 419231 - protein, 13 aa, Mycobacterium
AERGQIRASEGSV

SEQ ID NO: 419232 - protein, 5 aa, Mycobacterium
AERGR

SEQ ID NO: 419233 - protein, 7 aa, Mycobacterium
AERGRAA

SEQ ID NO: 419234 - protein, 6 aa, Mycobacterium
AERGRE

SEQ ID NO: 419235 - protein, 8 aa, Mycobacterium
AERGRGGQ

SEQ ID NO: 419236 - protein, 6 aa, Mycobacterium
AERGRM

SEQ ID NO: 419237 - protein, 6 aa, Mycobacterium
AERGRQ

SEQ ID NO: 419238 - protein, 17 aa, Mycobacterium
AERGRQADAAEARRRNL

SEQ ID NO: 419239 - protein, 8 aa, Mycobacterium
AERGRTGL

SEQ ID NO: 419240 - protein, 9 aa, Mycobacterium
AERGRTPDA

SEQ ID NO: 419241 - protein, 9 aa, Mycobacterium
AERGTSVSQ

SEQ ID NO: 419242 - protein, 10 aa, Mycobacterium
AERGTSVSQL

SEQ ID NO: 419243 - protein, 4 aa, Mycobacterium
AERH

SEQ ID NO: 419244 - protein, 11 aa, Mycobacterium
AERHGGSGATW

SEQ ID NO: 419245 - protein, 14 aa, Mycobacterium
AERHGSKKSGKLKD

SEQ ID NO: 419246 - protein, 36 aa, Mycobacterium
AERHVRDERGQRGTRGEGRRRGAGRARRRRPGGGVG

SEQ ID NO: 419247 - protein, 4 aa, Mycobacterium
AERI

SEQ ID NO: 419248 - protein, 15 aa, Mycobacterium
AERIDGDPFDRSGTA

SEQ ID NO: 419249 - protein, 5 aa, Mycobacterium
AERIE

SEQ ID NO: 419250 - protein, 5 aa, Mycobacterium
AERIG

SEQ ID NO: 419251 - protein, 8 aa, Mycobacterium
AERIPYDD

SEQ ID NO: 419252 - protein, 5 aa, Mycobacterium
AERIT

SEQ ID NO: 419253 - protein, 13 aa, Mycobacterium
AERKAGQSAEQAR

SEQ ID NO: 419254 - protein, 7 aa, Mycobacterium
AERKGAL

SEQ ID NO: 419255 - protein, 8 aa, Mycobacterium
AERKGSLA

SEQ ID NO: 419256 - protein, 8 aa, Mycobacterium
AERKGSLD

SEQ ID NO: 419257 - protein, 8 aa, Mycobacterium
AERKGSLR

SEQ ID NO: 419258 - protein, 9 aa, Mycobacterium
AERKITDSA

SEQ ID NO: 419259 - protein, 15 aa, Mycobacterium
AERKPAQLSGGQQQR

SEQ ID NO: 419260 - protein, 11 aa, Mycobacterium
AERKRRHPDST

SEQ ID NO: 419261 - protein, 10 aa, Mycobacterium
AERKSNAEKA

SEQ ID NO: 419262 - protein, 7 aa, Mycobacterium
AERLAEE

SEQ ID NO: 419263 - protein, 16 aa, Mycobacterium
AERLDAAASSGDGAAA

SEQ ID NO: 419264 - protein, 8 aa, Mycobacterium
AERLERPD

SEQ ID NO: 419265 - protein, 17 aa, Mycobacterium
AERLEVQGKKDQKLQKR

SEQ ID NO: 419266 - protein, 6 aa, Mycobacterium
AERLPG

SEQ ID NO: 419267 - protein, 20 aa, Mycobacterium
AERLPRGADPNTHTKLGRGG

SEQ ID NO: 419268 - protein, 21 aa, Mycobacterium
AERLPRGADPNTNTKLGRGGL

SEQ ID NO: 419269 - protein, 5 aa, Mycobacterium
AERLS

SEQ ID NO: 419270 - protein, 8 aa, Mycobacterium
AERLSAPR

SEQ ID NO: 419271 - protein, 17 aa, Mycobacterium
AERLSVQGRKDAKLQKR

SEQ ID NO: 419272 - protein, 7 aa, Mycobacterium
AERLTEE

SEQ ID NO: 419273 - protein, 5 aa, Mycobacterium
AERMT

SEQ ID NO: 419274 - protein, 6 aa, Mycobacterium
AERMTQ

SEQ ID NO: 419275 - protein, 4 aa, Mycobacterium
AERN

SEQ ID NO: 419276 - protein, 15 aa, Mycobacterium
AERNAAAKDHAAAMG

SEQ ID NO: 419277 - protein, 6 aa, Mycobacterium
AERNGA

SEQ ID NO: 419278 - protein, 7 aa, Mycobacterium
AERNGYP

SEQ ID NO: 419279 - protein, 16 aa, Mycobacterium
AERNGYPVRERVVAQS

SEQ ID NO: 419280 - protein, 10 aa, Mycobacterium
AERNQVPWPK

SEQ ID NO: 419281 - protein, 11 aa, Mycobacterium
AERNSSEDAEA

SEQ ID NO: 419282 - protein, 5 aa, Mycobacterium
AERNY

SEQ ID NO: 419283 - protein, 7 aa, Mycobacterium
AERNYRK

SEQ ID NO: 419284 - protein, 5 aa, Mycobacterium
AERPA

SEQ ID NO: 419285 - protein, 7 aa, Mycobacterium
AERPADA

SEQ ID NO: 419286 - protein, 21 aa, Mycobacterium
AERPADAAPDPAFADGSTMGK

SEQ ID NO: 419287 - protein, 10 aa, Mycobacterium
AERPADAGSV

SEQ ID NO: 419288 - protein, 16 aa, Mycobacterium
AERPADEISAGLESDV

SEQ ID NO: 419289 - protein, 6 aa, Mycobacterium
AERPDA

SEQ ID NO: 419290 - protein, 7 aa, Mycobacterium
AERPDDA

SEQ ID NO: 419291 - protein, 10 aa, Mycobacterium
AERPDLDRER

SEQ ID NO: 419292 - protein, 10 aa, Mycobacterium
AERPDVDPSR

SEQ ID NO: 419293 - protein, 7 aa, Mycobacterium
AERPEDA

SEQ ID NO: 419294 - protein, 6 aa, Mycobacterium
AERPEF

SEQ ID NO: 419295 - protein, 10 aa, Mycobacterium
AERPEGDELA

SEQ ID NO: 419296 - protein, 11 aa, Mycobacterium
AERPERLPLSS

SEQ ID NO: 419297 - protein, 7 aa, Mycobacterium
AERPGDV

SEQ ID NO: 419298 - protein, 11 aa, Mycobacterium
AERPHERAAQR

SEQ ID NO: 419299 - protein, 8 aa, Mycobacterium
AERPHPGV

SEQ ID NO: 419300 - protein, 9 aa, Mycobacterium
AERPNDADA

SEQ ID NO: 419301 - protein, 18 aa, Mycobacterium
AERPPDPALYPGASPHDL

SEQ ID NO: 419302 - protein, 9 aa, Mycobacterium
AERPPRAGS

SEQ ID NO: 419303 - protein, 6 aa, Mycobacterium
AERPRL

SEQ ID NO: 419304 - protein, 12 aa, Mycobacterium
AERPRSDSGGRL

SEQ ID NO: 419305 - protein, 10 aa, Mycobacterium
AERPSDADYT

SEQ ID NO: 419306 - protein, 10 aa, Mycobacterium
AERPSVDPNR

SEQ ID NO: 419307 - protein, 9 aa, Mycobacterium
AERPTDDPL

SEQ ID NO: 419308 - protein, 9 aa, Mycobacterium
AERPTVGPN

SEQ ID NO: 419309 - protein, 13 aa, Mycobacterium
AERPYQATAPVRQ

SEQ ID NO: 419310 - protein, 7 aa, Mycobacterium
AERQGAG

SEQ ID NO: 419311 - protein, 6 aa, Mycobacterium
AERQGD

SEQ ID NO: 419312 - protein, 11 aa, Mycobacterium
AERQGSKRPTF

SEQ ID NO: 419313 - protein, 9 aa, Mycobacterium
AERQGSWSA

SEQ ID NO: 419314 - protein, 6 aa, Mycobacterium
AERQGV

SEQ ID NO: 419315 - protein, 14 aa, Mycobacterium
AERQIGTGRQRFEQ

SEQ ID NO: 419316 - protein, 7 aa, Mycobacterium
AERQPGD

SEQ ID NO: 419317 - protein, 9 aa, Mycobacterium
AERQQRSAA

SEQ ID NO: 419318 - protein, 8 aa, Mycobacterium
AERQRTHG

SEQ ID NO: 419319 - protein, 6 aa, Mycobacterium
AERQVR

SEQ ID NO: 419320 - protein, 9 aa, Mycobacterium
AERQVRKAQ

SEQ ID NO: 419321 - protein, 6 aa, Mycobacterium
AERRAG

SEQ ID NO: 419322 - protein, 10 aa, Mycobacterium
AERRAGKKKL

SEQ ID NO: 419323 - protein, 13 aa, Mycobacterium
AERRAGRKKRFGK

SEQ ID NO: 419324 - protein, 8 aa, Mycobacterium
AERRANVE

SEQ ID NO: 419325 - protein, 6 aa, Mycobacterium
AERRAY

SEQ ID NO: 419326 - protein, 10 aa, Mycobacterium
AERRDHPGDD

SEQ ID NO: 419327 - protein, 9 aa, Mycobacterium
AERREHPGD

SEQ ID NO: 419328 - protein, 16 aa, Mycobacterium
AERREQVAKDGALAEK

SEQ ID NO: 419329 - protein, 6 aa, Mycobacterium
AERRGD

SEQ ID NO: 419330 - protein, 19 aa, Mycobacterium
AERRGELPSNAVSGGPLPE

SEQ ID NO: 419331 - protein, 9 aa, Mycobacterium
AERRGQQRT

SEQ ID NO: 419332 - protein, 7 aa, Mycobacterium
AERRNAV

SEQ ID NO: 419333 - protein, 8 aa, Mycobacterium
AERRPETA

SEQ ID NO: 419334 - protein, 18 aa, Mycobacterium
AERRPQQAAAETPMERPG

SEQ ID NO: 419335 - protein, 7 aa, Mycobacterium
AERRPRL

SEQ ID NO: 419336 - protein, 8 aa, Mycobacterium
AERRPRVD

SEQ ID NO: 419337 - protein, 8 aa, Mycobacterium
AERRPSDI

SEQ ID NO: 419338 - protein, 7 aa, Mycobacterium
AERRQFG

SEQ ID NO: 419339 - protein, 5 aa, Mycobacterium
AERRR

SEQ ID NO: 419340 - protein, 7 aa, Mycobacterium
AERRRRR

SEQ ID NO: 419341 - protein, 9 aa, Mycobacterium
AERRTGELS

SEQ ID NO: 419342 - protein, 13 aa, Mycobacterium
AERRYGGAEGWPA

SEQ ID NO: 419343 - protein, 12 aa, Mycobacterium
AERSAAHPLQGP

SEQ ID NO: 419344 - protein, 7 aa, Mycobacterium
AERSADR

SEQ ID NO: 419345 - protein, 11 aa, Mycobacterium
AERSAGADDGR

SEQ ID NO: 419346 - protein, 7 aa, Mycobacterium
AERSAGV

SEQ ID NO: 419347 - protein, 10 aa, Mycobacterium
AERSATLRRE

SEQ ID NO: 419348 - protein, 6 aa, Mycobacterium
AERSDR

SEQ ID NO: 419349 - protein, 6 aa, Mycobacterium
AERSGD

SEQ ID NO: 419350 - protein, 15 aa, Mycobacterium
AERSGELDPAFSDGT

SEQ ID NO: 419351 - protein, 15 aa, Mycobacterium
AERSGEPDPAFSGGT

SEQ ID NO: 419352 - protein, 8 aa, Mycobacterium
AERSGLSR

SEQ ID NO: 419353 - protein, 8 aa, Mycobacterium
AERSGLTS

SEQ ID NO: 419354 - protein, 8 aa, Mycobacterium
AERSGRRT

SEQ ID NO: 419355 - protein, 7 aa, Mycobacterium
AERSGSL

SEQ ID NO: 419356 - protein, 8 aa, Mycobacterium
AERSKQTM

SEQ ID NO: 419357 - protein, 5 aa, Mycobacterium
AERSL

SEQ ID NO: 419358 - protein, 6 aa, Mycobacterium
AERSLQ

SEQ ID NO: 419359 - protein, 6 aa, Mycobacterium
AERSPT

SEQ ID NO: 419360 - protein, 5 aa, Mycobacterium
AERSQ

SEQ ID NO: 419361 - protein, 5 aa, Mycobacterium
AERST

SEQ ID NO: 419362 - protein, 6 aa, Mycobacterium
AERSTT

SEQ ID NO: 419363 - protein, 17 aa, Mycobacterium
AERSVNEGFSGGEKKRH

SEQ ID NO: 419364 - protein, 5 aa, Mycobacterium
AERTA

SEQ ID NO: 419365 - protein, 26 aa, Mycobacterium
AERTAAGVAAARAAGRHPGRPGLTAD

SEQ ID NO: 419366 - protein, 13 aa, Mycobacterium
AERTAGASAEQAR

SEQ ID NO: 419367 - protein, 14 aa, Mycobacterium
AERTATELTASTGV

SEQ ID NO: 419368 - protein, 6 aa, Mycobacterium
AERTDE

SEQ ID NO: 419369 - protein, 6 aa, Mycobacterium
AERTEI

SEQ ID NO: 419370 - protein, 6 aa, Mycobacterium
AERTGA

SEQ ID NO: 419371 - protein, 11 aa, Mycobacterium
AERTGDAPPRL

SEQ ID NO: 419372 - protein, 11 aa, Mycobacterium
AERTGGRTSTQ

SEQ ID NO: 419373 - protein, 6 aa, Mycobacterium
AERTGR

SEQ ID NO: 419374 - protein, 12 aa, Mycobacterium
AERTGTDPENDM

SEQ ID NO: 419375 - protein, 8 aa, Mycobacterium
AERTIDER

SEQ ID NO: 419376 - protein, 10 aa, Mycobacterium
AERTNQGRKT

SEQ ID NO: 419377 - protein, 6 aa, Mycobacterium
AERTPP

SEQ ID NO: 419378 - protein, 7 aa, Mycobacterium
AERTPPI

SEQ ID NO: 419379 - protein, 16 aa, Mycobacterium
AERTPTPRLTETEQSP

SEQ ID NO: 419380 - protein, 5 aa, Mycobacterium
AERTQ

SEQ ID NO: 419381 - protein, 6 aa, Mycobacterium
AERTQT

SEQ ID NO: 419382 - protein, 5 aa, Mycobacterium
AERTR

SEQ ID NO: 419383 - protein, 21 aa, Mycobacterium
AERTRNAAHRTDSPRGNDPPP

SEQ ID NO: 419384 - protein, 7 aa, Mycobacterium
AERTSGN

SEQ ID NO: 419385 - protein, 24 aa, Mycobacterium
AERTSHDPDSGGHFGGPGGYGGRY

SEQ ID NO: 419386 - protein, 5 aa, Mycobacterium
AERTT

SEQ ID NO: 419387 - protein, 6 aa, Mycobacterium
AERTTE

SEQ ID NO: 419388 - protein, 12 aa, Mycobacterium
AERVETNRRVQG

SEQ ID NO: 419389 - protein, 5 aa, Mycobacterium
AERVG

SEQ ID NO: 419390 - protein, 6 aa, Mycobacterium
AERVGD

SEQ ID NO: 419391 - protein, 6 aa, Mycobacterium
AERVGR

SEQ ID NO: 419392 - protein, 9 aa, Mycobacterium
AERVRREHD

SEQ ID NO: 419393 - protein, 8 aa, Mycobacterium
AERVRSEH

SEQ ID NO: 419394 - protein, 16 aa, Mycobacterium
AERVSASKNWKPPHNA

SEQ ID NO: 419395 - protein, 9 aa, Mycobacterium
AERVSPDPA

SEQ ID NO: 419396 - protein, 7 aa, Mycobacterium
AERVSRA

SEQ ID NO: 419397 - protein, 7 aa, Mycobacterium
AERVTPD

SEQ ID NO: 419398 - protein, 4 aa, Mycobacterium
AERY

SEQ ID NO: 419399 - protein, 5 aa, Mycobacterium
AERYP

SEQ ID NO: 419400 - protein, 8 aa, Mycobacterium
AERYPEVD

SEQ ID NO: 419401 - protein, 16 aa, Mycobacterium
AERYPRQLSGGQQQRV

SEQ ID NO: 419402 - protein, 18 aa, Mycobacterium
AERYTRRHGHRPKNDYGS

SEQ ID NO: 419403 - protein, 4 aa, Mycobacterium
AESA

SEQ ID NO: 419404 - protein, 5 aa, Mycobacterium
AESAA

SEQ ID NO: 419405 - protein, 26 aa, Mycobacterium
AESAAAATLPPFDPAAPATNPAGVAA

SEQ ID NO: 419406 - protein, 11 aa, Mycobacterium
AESAAPSADGD

SEQ ID NO: 419407 - protein, 6 aa, Mycobacterium
AESAAQ

SEQ ID NO: 419408 - protein, 9 aa, Mycobacterium
AESAARTDR

SEQ ID NO: 419409 - protein, 6 aa, Mycobacterium
AESADA

SEQ ID NO: 419410 - protein, 6 aa, Mycobacterium
AESADQ

SEQ ID NO: 419411 - protein, 8 aa, Mycobacterium
AESADQFR

SEQ ID NO: 419412 - protein, 9 aa, Mycobacterium
AESADRSSA

SEQ ID NO: 419413 - protein, 5 aa, Mycobacterium
AESAE

SEQ ID NO: 419414 - protein, 8 aa, Mycobacterium
AESAEEAV

SEQ ID NO: 419415 - protein, 17 aa, Mycobacterium
AESAGAASPRPGKGSRR

SEQ ID NO: 419416 - protein, 16 aa, Mycobacterium
AESAGAAVAGGALGTG

SEQ ID NO: 419417 - protein, 11 aa, Mycobacterium
AESAGLHRPDG

SEQ ID NO: 419418 - protein, 11 aa, Mycobacterium
AESAGLSPENG

SEQ ID NO: 419419 - protein, 7 aa, Mycobacterium
AESAGRA

SEQ ID NO: 419420 - protein, 9 aa, Mycobacterium
AESAGVGTV

SEQ ID NO: 419421 - protein, 6 aa, Mycobacterium
AESAGY

SEQ ID NO: 419422 - protein, 8 aa, Mycobacterium
AESAHKSL

SEQ ID NO: 419423 - protein, 8 aa, Mycobacterium
AESAHSVE

SEQ ID NO: 419424 - protein, 12 aa, Mycobacterium
AESAHTPGTPEW

SEQ ID NO: 419425 - protein, 14 aa, Mycobacterium
AESAPELRTPWPRE

SEQ ID NO: 419426 - protein, 8 aa, Mycobacterium
AESAPGRI

SEQ ID NO: 419427 - protein, 9 aa, Mycobacterium
AESAPKPVS

SEQ ID NO: 419428 - protein, 9 aa, Mycobacterium
AESAPLGPN

SEQ ID NO: 419429 - protein, 20 aa, Mycobacterium
AESAPPAPVETGYTADGVPT

SEQ ID NO: 419430 - protein, 12 aa, Mycobacterium
AESAPSGRSPIH

SEQ ID NO: 419431 - protein, 9 aa, Mycobacterium
AESAPTAGL

SEQ ID NO: 419432 - protein, 9 aa, Mycobacterium
AESAQRYNT

SEQ ID NO: 419433 - protein, 7 aa, Mycobacterium
AESAQTG

SEQ ID NO: 419434 - protein, 6 aa, Mycobacterium
AESARD

SEQ ID NO: 419435 - protein, 12 aa, Mycobacterium
AESARGVAAEGT

SEQ ID NO: 419436 - protein, 20 aa, Mycobacterium
AESARIPGEPVDRSGLPTDV

SEQ ID NO: 419437 - protein, 24 aa, Mycobacterium
AESASAASKVISPPPISGGQGNQV

SEQ ID NO: 419438 - protein, 9 aa, Mycobacterium
AESASGKAE

SEQ ID NO: 419439 - protein, 7 aa, Mycobacterium
AESATSA

SEQ ID NO: 419440 - protein, 13 aa, Mycobacterium
AESAVQSERKPVE

SEQ ID NO: 419441 - protein, 5 aa, Mycobacterium
AESCT

SEQ ID NO: 419442 - protein, 5 aa, Mycobacterium
AESDA

SEQ ID NO: 419443 - protein, 11 aa, Mycobacterium
AESDDPATTMT

SEQ ID NO: 419444 - protein, 6 aa, Mycobacterium
AESDEA

SEQ ID NO: 419445 - protein, 6 aa, Mycobacterium
AESDEL

SEQ ID NO: 419446 - protein, 6 aa, Mycobacterium
AESDEN

SEQ ID NO: 419447 - protein, 23 aa, Mycobacterium
AESDENRAPGLQTRTEVDTTAAE

SEQ ID NO: 419448 - protein, 11 aa, Mycobacterium
AESDESSQGRW

SEQ ID NO: 419449 - protein, 8 aa, Mycobacterium
AESDETAA

SEQ ID NO: 419450 - protein, 11 aa, Mycobacterium
AESDHERGTQH

SEQ ID NO: 419451 - protein, 9 aa, Mycobacterium
AESDKPIST

SEQ ID NO: 419452 - protein, 5 aa, Mycobacterium
AESDP

SEQ ID NO: 419453 - protein, 11 aa, Mycobacterium
AESDPDLGERT

SEQ ID NO: 419454 - protein, 20 aa, Mycobacterium
AESDPEAPTLSGDRPARTVA

SEQ ID NO: 419455 - protein, 8 aa, Mycobacterium
AESDPGAA

SEQ ID NO: 419456 - protein, 13 aa, Mycobacterium
AESDPQDELSETT

SEQ ID NO: 419457 - protein, 10 aa, Mycobacterium
AESDRLGDDL

SEQ ID NO: 419458 - protein, 10 aa, Mycobacterium
AESDRRDAPW

SEQ ID NO: 419459 - protein, 9 aa, Mycobacterium
AESDSAAVA

SEQ ID NO: 419460 - protein, 10 aa, Mycobacterium
AESDSPRRKE

SEQ ID NO: 419461 - protein, 5 aa, Mycobacterium
AESDV

SEQ ID NO: 419462 - protein, 15 aa, Mycobacterium
AESDVLGDRSPEIDD

SEQ ID NO: 419463 - protein, 12 aa, Mycobacterium
AESDVTATGREH

SEQ ID NO: 419464 - protein, 16 aa, Mycobacterium
AESDVTPAADTPMGRR

SEQ ID NO: 419465 - protein, 5 aa, Mycobacterium
AESEA

SEQ ID NO: 419466 - protein, 6 aa, Mycobacterium
AESEAA

SEQ ID NO: 419467 - protein, 11 aa, Mycobacterium
AESEAKAGGKC

SEQ ID NO: 419468 - protein, 10 aa, Mycobacterium
AESEATGSPP

SEQ ID NO: 419469 - protein, 6 aa, Mycobacterium
AESEDI

SEQ ID NO: 419470 - protein, 8 aa, Mycobacterium
AESEEHGT

SEQ ID NO: 419471 - protein, 6 aa, Mycobacterium
AESEGA

SEQ ID NO: 419472 - protein, 7 aa, Mycobacterium
AESEGKF

SEQ ID NO: 419473 - protein, 9 aa, Mycobacterium
AESEKPLST

SEQ ID NO: 419474 - protein, 8 aa, Mycobacterium
AESELDPA

SEQ ID NO: 419475 - protein, 5 aa, Mycobacterium
AESEP

SEQ ID NO: 419476 - protein, 6 aa, Mycobacterium
AESERF

SEQ ID NO: 419477 - protein, 7 aa, Mycobacterium
AESERPA

SEQ ID NO: 419478 - protein, 5 aa, Mycobacterium
AESES

SEQ ID NO: 419479 - protein, 24 aa, Mycobacterium
AESESDADVGDRANDPVRVNGSQV

SEQ ID NO: 419480 - protein, 18 aa, Mycobacterium
AESESDADVGDRANNPVR

SEQ ID NO: 419481 - protein, 18 aa, Mycobacterium
AESESDSDVGDRANDPVR

SEQ ID NO: 419482 - protein, 24 aa, Mycobacterium
AESESDSDVGDRANDPVRVNGSQV

SEQ ID NO: 419483 - protein, 24 aa, Mycobacterium
AESESQADVGDKANDAVRVNGNQV

SEQ ID NO: 419484 - protein, 12 aa, Mycobacterium
AESFDRRNQTAT

SEQ ID NO: 419485 - protein, 17 aa, Mycobacterium
AESFRDADAGHGERFLP

SEQ ID NO: 419486 - protein, 7 aa, Mycobacterium
AESFSAQ

SEQ ID NO: 419487 - protein, 6 aa, Mycobacterium
AESFSS

SEQ ID NO: 419488 - protein, 8 aa, Mycobacterium
AESGAAQE

SEQ ID NO: 419489 - protein, 6 aa, Mycobacterium
AESGAD

SEQ ID NO: 419490 - protein, 10 aa, Mycobacterium
AESGADNPAF

SEQ ID NO: 419491 - protein, 7 aa, Mycobacterium
AESGADV

SEQ ID NO: 419492 - protein, 16 aa, Mycobacterium
AESGASARKVASGSAL

SEQ ID NO: 419493 - protein, 5 aa, Mycobacterium
AESGD

SEQ ID NO: 419494 - protein, 9 aa, Mycobacterium
AESGDASGG

SEQ ID NO: 419495 - protein, 7 aa, Mycobacterium
AESGDDA

SEQ ID NO: 419496 - protein, 10 aa, Mycobacterium
AESGDGPPLV

SEQ ID NO: 419497 - protein, 10 aa, Mycobacterium
AESGEPAAGR

SEQ ID NO: 419498 - protein, 9 aa, Mycobacterium
AESGEPAWG

SEQ ID NO: 419499 - protein, 9 aa, Mycobacterium
AESGGAAAK

SEQ ID NO: 419500 - protein, 11 aa, Mycobacterium
AESGGATKTLR

SEQ ID NO: 419501 - protein, 10 aa, Mycobacterium
AESGGPNGRG

SEQ ID NO: 419502 - protein, 6 aa, Mycobacterium
AESGID

SEQ ID NO: 419503 - protein, 12 aa, Mycobacterium
AESGKPLAESRA

SEQ ID NO: 419504 - protein, 7 aa, Mycobacterium
AESGKRG

SEQ ID NO: 419505 - protein, 7 aa, Mycobacterium
AESGLDG

SEQ ID NO: 419506 - protein, 6 aa, Mycobacterium
AESGLG

SEQ ID NO: 419507 - protein, 10 aa, Mycobacterium
AESGLGSGTA

SEQ ID NO: 419508 - protein, 7 aa, Mycobacterium
AESGLPD

SEQ ID NO: 419509 - protein, 14 aa, Mycobacterium
AESGNPLPAAPETL

SEQ ID NO: 419510 - protein, 8 aa, Mycobacterium
AESGPDAL

SEQ ID NO: 419511 - protein, 9 aa, Mycobacterium
AESGPDALE

SEQ ID NO: 419512 - protein, 10 aa, Mycobacterium
AESGPDALGT

SEQ ID NO: 419513 - protein, 15 aa, Mycobacterium
AESGPQSDDAAEPAR

SEQ ID NO: 419514 - protein, 17 aa, Mycobacterium
AESGPSERAAERGDAAR

SEQ ID NO: 419515 - protein, 5 aa, Mycobacterium
AESGR

SEQ ID NO: 419516 - protein, 10 aa, Mycobacterium
AESGRSDSPV

SEQ ID NO: 419517 - protein, 14 aa, Mycobacterium
AESGSPLPPPPAGH

SEQ ID NO: 419518 - protein, 10 aa, Mycobacterium
AESGTAVSEG

SEQ ID NO: 419519 - protein, 6 aa, Mycobacterium
AESGTL

SEQ ID NO: 419520 - protein, 14 aa, Mycobacterium
AESGVETDEPDPAR

SEQ ID NO: 419521 - protein, 17 aa, Mycobacterium
AESGWDRGGDQPPPPLP

SEQ ID NO: 419522 - protein, 4 aa, Mycobacterium
AESH

SEQ ID NO: 419523 - protein, 10 aa, Mycobacterium
AESHEYARQR

SEQ ID NO: 419524 - protein, 18 aa, Mycobacterium
AESHPGREYDREMILFMA

SEQ ID NO: 419525 - protein, 7 aa, Mycobacterium
AESIATS

SEQ ID NO: 419526 - protein, 5 aa, Mycobacterium
AESID

SEQ ID NO: 419527 - protein, 9 aa, Mycobacterium
AESKGEVTY

SEQ ID NO: 419528 - protein, 7 aa, Mycobacterium
AESLEGA

SEQ ID NO: 419529 - protein, 11 aa, Mycobacterium
AESLKGGHGDV

SEQ ID NO: 419530 - protein, 7 aa, Mycobacterium
AESLPTA

SEQ ID NO: 419531 - protein, 5 aa, Mycobacterium
AESLR

SEQ ID NO: 419532 - protein, 19 aa, Mycobacterium
AESLRKDATSVSVQDGPWG

SEQ ID NO: 419533 - protein, 19 aa, Mycobacterium
AESLRNDSAQVSIKDGPWG

SEQ ID NO: 419534 - protein, 8 aa, Mycobacterium
AESLRQSA

SEQ ID NO: 419535 - protein, 7 aa, Mycobacterium
AESLRRT

SEQ ID NO: 419536 - protein, 17 aa, Mycobacterium
AESLSRAGVSSPQVDAE

SEQ ID NO: 419537 - protein, 10 aa, Mycobacterium
AESLTGTTGL

SEQ ID NO: 419538 - protein, 10 aa, Mycobacterium
AESLTSGDPL

SEQ ID NO: 419539 - protein, 5 aa, Mycobacterium
AESMA

SEQ ID NO: 419540 - protein, 15 aa, Mycobacterium
AESMDAGDKATAKAH

SEQ ID NO: 419541 - protein, 7 aa, Mycobacterium
AESNGAQ

SEQ ID NO: 419542 - protein, 14 aa, Mycobacterium
AESNPDDEVDETTT

SEQ ID NO: 419543 - protein, 8 aa, Mycobacterium
AESNSGLS

SEQ ID NO: 419544 - protein, 5 aa, Mycobacterium
AESPC

SEQ ID NO: 419545 - protein, 9 aa, Mycobacterium
AESPDRAPS

SEQ ID NO: 419546 - protein, 11 aa, Mycobacterium
AESPFPDAPST

SEQ ID NO: 419547 - protein, 5 aa, Mycobacterium
AESPL

SEQ ID NO: 419548 - protein, 9 aa, Mycobacterium
AESPLPPPT

SEQ ID NO: 419549 - protein, 16 aa, Mycobacterium
AESPNRVAQTNDPTAH

SEQ ID NO: 419550 - protein, 9 aa, Mycobacterium
AESPPDTDL

SEQ ID NO: 419551 - protein, 19 aa, Mycobacterium
AESPQVSDRHPASRYRGMF

SEQ ID NO: 419552 - protein, 6 aa, Mycobacterium
AESPRV

SEQ ID NO: 419553 - protein, 9 aa, Mycobacterium
AESPSGKAE

SEQ ID NO: 419554 - protein, 10 aa, Mycobacterium
AESPTAKRKP

SEQ ID NO: 419555 - protein, 8 aa, Mycobacterium
AESPTIGP

SEQ ID NO: 419556 - protein, 5 aa, Mycobacterium
AESPV

SEQ ID NO: 419557 - protein, 6 aa, Mycobacterium
AESPVD

SEQ ID NO: 419558 - protein, 5 aa, Mycobacterium
AESQA

SEQ ID NO: 419559 - protein, 12 aa, Mycobacterium
AESQAPSPDRAT

SEQ ID NO: 419560 - protein, 27 aa, Mycobacterium
AESQERLEAAREELAEREQAAAEAERA

SEQ ID NO: 419561 - protein, 8 aa, Mycobacterium
AESQNERL

SEQ ID NO: 419562 - protein, 8 aa, Mycobacterium
AESQRAAA

SEQ ID NO: 419563 - protein, 8 aa, Mycobacterium
AESQRTRP

SEQ ID NO: 419564 - protein, 13 aa, Mycobacterium
AESQTGERAPKHR

SEQ ID NO: 419565 - protein, 13 aa, Mycobacterium
AESQTGERAPKHT

SEQ ID NO: 419566 - protein, 4 aa, Mycobacterium
AESR

SEQ ID NO: 419567 - protein, 9 aa, Mycobacterium
AESRATLGR

SEQ ID NO: 419568 - protein, 12 aa, Mycobacterium
AESRDQEATAKI

SEQ ID NO: 419569 - protein, 7 aa, Mycobacterium
AESRDVS

SEQ ID NO: 419570 - protein, 7 aa, Mycobacterium
AESRDVT

SEQ ID NO: 419571 - protein, 5 aa, Mycobacterium
AESRE

SEQ ID NO: 419572 - protein, 17 aa, Mycobacterium
AESRHAEQFRKSGDPYI

SEQ ID NO: 419573 - protein, 9 aa, Mycobacterium
AESRHRGSA

SEQ ID NO: 419574 - protein, 13 aa, Mycobacterium
AESRISGTAIKVD

SEQ ID NO: 419575 - protein, 14 aa, Mycobacterium
AESRPRRPDDRPDA

SEQ ID NO: 419576 - protein, 9 aa, Mycobacterium
AESRQTRDR

SEQ ID NO: 419577 - protein, 17 aa, Mycobacterium
AESRRRSTATGGESQIP

SEQ ID NO: 419578 - protein, 6 aa, Mycobacterium
AESRSR

SEQ ID NO: 419579 - protein, 10 aa, Mycobacterium
AESSAEIDSG

SEQ ID NO: 419580 - protein, 8 aa, Mycobacterium
AESSAGRT

SEQ ID NO: 419581 - protein, 9 aa, Mycobacterium
AESSAPDRL

SEQ ID NO: 419582 - protein, 18 aa, Mycobacterium
AESSEAGSDLTQLVEIVG

SEQ ID NO: 419583 - protein, 13 aa, Mycobacterium
AESSGRPCDDASV

SEQ ID NO: 419584 - protein, 9 aa, Mycobacterium
AESSNDARV

SEQ ID NO: 419585 - protein, 6 aa, Mycobacterium
AESSRY

SEQ ID NO: 419586 - protein, 24 aa, Mycobacterium
AESSTPAHSDATEFPGSTEMIGAP

SEQ ID NO: 419587 - protein, 22 aa, Mycobacterium
AESSTPAHSDATEIPGEDSDSA

SEQ ID NO: 419588 - protein, 14 aa, Mycobacterium
AESTDAAIAPEEGA

SEQ ID NO: 419589 - protein, 13 aa, Mycobacterium
AESTELAARTDAL

SEQ ID NO: 419590 - protein, 15 aa, Mycobacterium
AESTGKGGDVAPTIG

SEQ ID NO: 419591 - protein, 12 aa, Mycobacterium
AESTGVKASTDL

SEQ ID NO: 419592 - protein, 7 aa, Mycobacterium
AESTHAQ

SEQ ID NO: 419593 - protein, 20 aa, Mycobacterium
AESTKTGDRDELKPGVPDRS

SEQ ID NO: 419594 - protein, 15 aa, Mycobacterium
AESTLAPPHQRKESM

SEQ ID NO: 419595 - protein, 10 aa, Mycobacterium
AESTPEREFE

SEQ ID NO: 419596 - protein, 8 aa, Mycobacterium
AESTPGGL

SEQ ID NO: 419597 - protein, 8 aa, Mycobacterium
AESTPTAR

SEQ ID NO: 419598 - protein, 7 aa, Mycobacterium
AESTPTI

SEQ ID NO: 419599 - protein, 6 aa, Mycobacterium
AESTVK

SEQ ID NO: 419600 - protein, 12 aa, Mycobacterium
AESTVRQSDYGV

SEQ ID NO: 419601 - protein, 73 aa, Mycobacterium
AESVAEPATASANGHAAPAPAPTPAAPAPAPAPAAAPAPAPAVKPASAPSTAPAAPKPAAPPIPTAEGDEAQV

SEQ ID NO: 419602 - protein, 5 aa, Mycobacterium
AESVD

SEQ ID NO: 419603 - protein, 5 aa, Mycobacterium
AESVE

SEQ ID NO: 419604 - protein, 18 aa, Mycobacterium
AESVGKTIAGATIKGQGN

SEQ ID NO: 419605 - protein, 9 aa, Mycobacterium
AESVGSGQA

SEQ ID NO: 419606 - protein, 5 aa, Mycobacterium
AESVN

SEQ ID NO: 419607 - protein, 15 aa, Mycobacterium
AESVPADEHRGRRAW

SEQ ID NO: 419608 - protein, 6 aa, Mycobacterium
AESVQT

SEQ ID NO: 419609 - protein, 5 aa, Mycobacterium
AESVV

SEQ ID NO: 419610 - protein, 4 aa, Mycobacterium
AESW

SEQ ID NO: 419611 - protein, 14 aa, Mycobacterium
AESYGVDSQQQLDA

SEQ ID NO: 419612 - protein, 5 aa, Mycobacterium
AESYR

SEQ ID NO: 419613 - protein, 7 aa, Mycobacterium
AESYSGE

SEQ ID NO: 419614 - protein, 11 aa, Mycobacterium
AETAADARVTD

SEQ ID NO: 419615 - protein, 6 aa, Mycobacterium
AETAAE

SEQ ID NO: 419616 - protein, 8 aa, Mycobacterium
AETAAPVH

SEQ ID NO: 419617 - protein, 15 aa, Mycobacterium
AETAARAKENAELAD

SEQ ID NO: 419618 - protein, 9 aa, Mycobacterium
AETAASYEV

SEQ ID NO: 419619 - protein, 14 aa, Mycobacterium
AETAATATVTTGGF

SEQ ID NO: 419620 - protein, 6 aa, Mycobacterium
AETADD

SEQ ID NO: 419621 - protein, 9 aa, Mycobacterium
AETADDRAF

SEQ ID NO: 419622 - protein, 6 aa, Mycobacterium
AETADE

SEQ ID NO: 419623 - protein, 6 aa, Mycobacterium
AETADG

SEQ ID NO: 419624 - protein, 9 aa, Mycobacterium
AETAEDRAF

SEQ ID NO: 419625 - protein, 7 aa, Mycobacterium
AETAEND

SEQ ID NO: 419626 - protein, 6 aa, Mycobacterium
AETAEP

SEQ ID NO: 419627 - protein, 8 aa, Mycobacterium
AETAEQQQ

SEQ ID NO: 419628 - protein, 20 aa, Mycobacterium
AETAGADAAIGSVGAGVGAR

SEQ ID NO: 419629 - protein, 14 aa, Mycobacterium
AETAGEKKTLATNW

SEQ ID NO: 419630 - protein, 13 aa, Mycobacterium
AETAGGGGADRTL

SEQ ID NO: 419631 - protein, 18 aa, Mycobacterium
AETAGKAKMAGAASIPGT

SEQ ID NO: 419632 - protein, 10 aa, Mycobacterium
AETAGLDSTS

SEQ ID NO: 419633 - protein, 7 aa, Mycobacterium
AETAGPD

SEQ ID NO: 419634 - protein, 6 aa, Mycobacterium
AETAGV

SEQ ID NO: 419635 - protein, 7 aa, Mycobacterium
AETAGVS

SEQ ID NO: 419636 - protein, 7 aa, Mycobacterium
AETAKES

SEQ ID NO: 419637 - protein, 8 aa, Mycobacterium
AETAKESK

SEQ ID NO: 419638 - protein, 5 aa, Mycobacterium
AETAL

SEQ ID NO: 419639 - protein, 5 aa, Mycobacterium
AETAP

SEQ ID NO: 419640 - protein, 14 aa, Mycobacterium
AETAPELRTPWPSQ

SEQ ID NO: 419641 - protein, 6 aa, Mycobacterium
AETAPL

SEQ ID NO: 419642 - protein, 12 aa, Mycobacterium
AETAPSGRSPIH

SEQ ID NO: 419643 - protein, 16 aa, Mycobacterium
AETAPTASSAYGGDDV

SEQ ID NO: 419644 - protein, 23 aa, Mycobacterium
AETAQAAGVSEDAIARTEAEYPV

SEQ ID NO: 419645 - protein, 14 aa, Mycobacterium
AETAQRAFGDPDAV

SEQ ID NO: 419646 - protein, 8 aa, Mycobacterium
AETARADD

SEQ ID NO: 419647 - protein, 10 aa, Mycobacterium
AETARHQGTH

SEQ ID NO: 419648 - protein, 16 aa, Mycobacterium
AETARTPDVSLPGAVS

SEQ ID NO: 419649 - protein, 15 aa, Mycobacterium
AETASRGASGETWSA

SEQ ID NO: 419650 - protein, 21 aa, Mycobacterium
AETATRSGRAARGSARTGTAA

SEQ ID NO: 419651 - protein, 6 aa, Mycobacterium
AETATV

SEQ ID NO: 419652 - protein, 7 aa, Mycobacterium
AETDDAR

SEQ ID NO: 419653 - protein, 6 aa, Mycobacterium
AETDDD

SEQ ID NO: 419654 - protein, 6 aa, Mycobacterium
AETDEE

SEQ ID NO: 419655 - protein, 12 aa, Mycobacterium
AETDEQAEPQAT

SEQ ID NO: 419656 - protein, 7 aa, Mycobacterium
AETDGNP

SEQ ID NO: 419657 - protein, 7 aa, Mycobacterium
AETDKPL

SEQ ID NO: 419658 - protein, 12 aa, Mycobacterium
AETDLNSAEGRV

SEQ ID NO: 419659 - protein, 11 aa, Mycobacterium
AETDRAEHGDW

SEQ ID NO: 419660 - protein, 7 aa, Mycobacterium
AETDSGT

SEQ ID NO: 419661 - protein, 8 aa, Mycobacterium
AETDSYRT

SEQ ID NO: 419662 - protein, 12 aa, Mycobacterium
AETDTAAPELPE

SEQ ID NO: 419663 - protein, 9 aa, Mycobacterium
AETDTERSR

SEQ ID NO: 419664 - protein, 5 aa, Mycobacterium
AETDY

SEQ ID NO: 419665 - protein, 5 aa, Mycobacterium
AETEA

SEQ ID NO: 419666 - protein, 12 aa, Mycobacterium
AETEAAAPELGP

SEQ ID NO: 419667 - protein, 24 aa, Mycobacterium
AETEADADVGDRANDPVRVNGNQV

SEQ ID NO: 419668 - protein, 16 aa, Mycobacterium
AETEADADVGDRANDQ

SEQ ID NO: 419669 - protein, 8 aa, Mycobacterium
AETEDSRQ

SEQ ID NO: 419670 - protein, 11 aa, Mycobacterium
AETEEQESQRA

SEQ ID NO: 419671 - protein, 5 aa, Mycobacterium
AETEM

SEQ ID NO: 419672 - protein, 5 aa, Mycobacterium
AETEN

SEQ ID NO: 419673 - protein, 5 aa, Mycobacterium
AETEP

SEQ ID NO: 419674 - protein, 6 aa, Mycobacterium
AETEPG

SEQ ID NO: 419675 - protein, 12 aa, Mycobacterium
AETEPSAFRTRE

SEQ ID NO: 419676 - protein, 14 aa, Mycobacterium
AETEPYSLDNERPA

SEQ ID NO: 419677 - protein, 6 aa, Mycobacterium
AETERP

SEQ ID NO: 419678 - protein, 7 aa, Mycobacterium
AETETGT

SEQ ID NO: 419679 - protein, 12 aa, Mycobacterium
AETETTKPSPFA

SEQ ID NO: 419680 - protein, 20 aa, Mycobacterium
AETEVNDKIAEDVRTGMEKQ

SEQ ID NO: 419681 - protein, 11 aa, Mycobacterium
AETFADNTEPH

SEQ ID NO: 419682 - protein, 12 aa, Mycobacterium
AETFTENTEPHI

SEQ ID NO: 419683 - protein, 4 aa, Mycobacterium
AETG

SEQ ID NO: 419684 - protein, 11 aa, Mycobacterium
AETGAAAVAAG

SEQ ID NO: 419685 - protein, 9 aa, Mycobacterium
AETGAAPAQ

SEQ ID NO: 419686 - protein, 7 aa, Mycobacterium
AETGADL

SEQ ID NO: 419687 - protein, 14 aa, Mycobacterium
AETGADPAKLNPLG

SEQ ID NO: 419688 - protein, 19 aa, Mycobacterium
AETGADSAAEATLQASERA

SEQ ID NO: 419689 - protein, 12 aa, Mycobacterium
AETGAGQHGVAT

SEQ ID NO: 419690 - protein, 13 aa, Mycobacterium
AETGAGVTDWSAG

SEQ ID NO: 419691 - protein, 6 aa, Mycobacterium
AETGAQ

SEQ ID NO: 419692 - protein, 7 aa, Mycobacterium
AETGAQT

SEQ ID NO: 419693 - protein, 6 aa, Mycobacterium
AETGAR

SEQ ID NO: 419694 - protein, 6 aa, Mycobacterium
AETGDA

SEQ ID NO: 419695 - protein, 8 aa, Mycobacterium
AETGDASG

SEQ ID NO: 419696 - protein, 5 aa, Mycobacterium
AETGE

SEQ ID NO: 419697 - protein, 9 aa, Mycobacterium
AETGEFDDA

SEQ ID NO: 419698 - protein, 8 aa, Mycobacterium
AETGFSDQ

SEQ ID NO: 419699 - protein, 5 aa, Mycobacterium
AETGG

SEQ ID NO: 419700 - protein, 6 aa, Mycobacterium
AETGGK

SEQ ID NO: 419701 - protein, 10 aa, Mycobacterium
AETGGSSGGV

SEQ ID NO: 419702 - protein, 7 aa, Mycobacterium
AETGITK

SEQ ID NO: 419703 - protein, 25 aa, Mycobacterium
AETGLDGVDPPQRYAPTAVPAPTPL

SEQ ID NO: 419704 - protein, 7 aa, Mycobacterium
AETGLSP

SEQ ID NO: 419705 - protein, 5 aa, Mycobacterium
AETGM

SEQ ID NO: 419706 - protein, 9 aa, Mycobacterium
AETGNGRLK

SEQ ID NO: 419707 - protein, 10 aa, Mycobacterium
AETGNRPAVA

SEQ ID NO: 419708 - protein, 13 aa, Mycobacterium
AETGPDDEHLAPD

SEQ ID NO: 419709 - protein, 7 aa, Mycobacterium
AETGQTP

SEQ ID NO: 419710 - protein, 7 aa, Mycobacterium
AETGRSY

SEQ ID NO: 419711 - protein, 9 aa, Mycobacterium
AETGSETGE

SEQ ID NO: 419712 - protein, 6 aa, Mycobacterium
AETGSG

SEQ ID NO: 419713 - protein, 11 aa, Mycobacterium
AETGTQSGLTE

SEQ ID NO: 419714 - protein, 6 aa, Mycobacterium
AETGTV

SEQ ID NO: 419715 - protein, 6 aa, Mycobacterium
AETGVT

SEQ ID NO: 419716 - protein, 12 aa, Mycobacterium
AETGYLPDTATA

SEQ ID NO: 419717 - protein, 6 aa, Mycobacterium
AETHGQ

SEQ ID NO: 419718 - protein, 6 aa, Mycobacterium
AETHRP

SEQ ID NO: 419719 - protein, 33 aa, Mycobacterium
AETIATRTNKWDPATETSRDARAAAALASERQE

SEQ ID NO: 419720 - protein, 7 aa, Mycobacterium
AETKEPV

SEQ ID NO: 419721 - protein, 9 aa, Mycobacterium
AETKRRGAT

SEQ ID NO: 419722 - protein, 14 aa, Mycobacterium
AETKRRTAEQLGRE

SEQ ID NO: 419723 - protein, 4 aa, Mycobacterium
AETL

SEQ ID NO: 419724 - protein, 5 aa, Mycobacterium
AETLA

SEQ ID NO: 419725 - protein, 6 aa, Mycobacterium
AETLAE

SEQ ID NO: 419726 - protein, 5 aa, Mycobacterium
AETLP

SEQ ID NO: 419727 - protein, 6 aa, Mycobacterium
AETLRR

SEQ ID NO: 419728 - protein, 15 aa, Mycobacterium
AETLRRTTTGNRQQL

SEQ ID NO: 419729 - protein, 15 aa, Mycobacterium
AETLRRTTTGTRQPL

SEQ ID NO: 419730 - protein, 6 aa, Mycobacterium
AETLRS

SEQ ID NO: 419731 - protein, 5 aa, Mycobacterium
AETLS

SEQ ID NO: 419732 - protein, 12 aa, Mycobacterium
AETLTEPGAGRD

SEQ ID NO: 419733 - protein, 5 aa, Mycobacterium
AETMA

SEQ ID NO: 419734 - protein, 5 aa, Mycobacterium
AETNA

SEQ ID NO: 419735 - protein, 5 aa, Mycobacterium
AETNG

SEQ ID NO: 419736 - protein, 6 aa, Mycobacterium
AETNGS

SEQ ID NO: 419737 - protein, 9 aa, Mycobacterium
AETNGWSET

SEQ ID NO: 419738 - protein, 9 aa, Mycobacterium
AETNRPPEV

SEQ ID NO: 419739 - protein, 4 aa, Mycobacterium
AETP

SEQ ID NO: 419740 - protein, 5 aa, Mycobacterium
AETPA

SEQ ID NO: 419741 - protein, 31 aa, Mycobacterium
AETPAAPVDPGASTPGGSRQTEINPSRELKG

SEQ ID NO: 419742 - protein, 7 aa, Mycobacterium
AETPAEL

SEQ ID NO: 419743 - protein, 8 aa, Mycobacterium
AETPAPTI

SEQ ID NO: 419744 - protein, 7 aa, Mycobacterium
AETPAVH

SEQ ID NO: 419745 - protein, 8 aa, Mycobacterium
AETPDAAQ

SEQ ID NO: 419746 - protein, 6 aa, Mycobacterium
AETPDC

SEQ ID NO: 419747 - protein, 8 aa, Mycobacterium
AETPDPTF

SEQ ID NO: 419748 - protein, 9 aa, Mycobacterium
AETPEARQW

SEQ ID NO: 419749 - protein, 6 aa, Mycobacterium
AETPEF

SEQ ID NO: 419750 - protein, 8 aa, Mycobacterium
AETPEGRI

SEQ ID NO: 419751 - protein, 7 aa, Mycobacterium
AETPELT

SEQ ID NO: 419752 - protein, 8 aa, Mycobacterium
AETPEQQQ

SEQ ID NO: 419753 - protein, 6 aa, Mycobacterium
AETPGR

SEQ ID NO: 419754 - protein, 8 aa, Mycobacterium
AETPIERK

SEQ ID NO: 419755 - protein, 11 aa, Mycobacterium
AETPIERKPPW

SEQ ID NO: 419756 - protein, 6 aa, Mycobacterium
AETPLD

SEQ ID NO: 419757 - protein, 6 aa, Mycobacterium
AETPNL

SEQ ID NO: 419758 - protein, 8 aa, Mycobacterium
AETPPALP

SEQ ID NO: 419759 - protein, 6 aa, Mycobacterium
AETPQG

SEQ ID NO: 419760 - protein, 8 aa, Mycobacterium
AETPSLPE

SEQ ID NO: 419761 - protein, 6 aa, Mycobacterium
AETPTV

SEQ ID NO: 419762 - protein, 4 aa, Mycobacterium
AETQ

SEQ ID NO: 419763 - protein, 15 aa, Mycobacterium
AETQAAIDEARRNAE

SEQ ID NO: 419764 - protein, 7 aa, Mycobacterium
AETQGAQ

SEQ ID NO: 419765 - protein, 6 aa, Mycobacterium
AETQGV

SEQ ID NO: 419766 - protein, 11 aa, Mycobacterium
AETQPASSAVD

SEQ ID NO: 419767 - protein, 7 aa, Mycobacterium
AETQPGA

SEQ ID NO: 419768 - protein, 8 aa, Mycobacterium
AETQPPDL

SEQ ID NO: 419769 - protein, 11 aa, Mycobacterium
AETQPRPQGPA

SEQ ID NO: 419770 - protein, 7 aa, Mycobacterium
AETQQEA

SEQ ID NO: 419771 - protein, 8 aa, Mycobacterium
AETQRSRD

SEQ ID NO: 419772 - protein, 12 aa, Mycobacterium
AETQSAAPELGP

SEQ ID NO: 419773 - protein, 11 aa, Mycobacterium
AETQYGAPDRG

SEQ ID NO: 419774 - protein, 14 aa, Mycobacterium
AETRARRRNDQNVA

SEQ ID NO: 419775 - protein, 15 aa, Mycobacterium
AETRARRRNDQNVAA

SEQ ID NO: 419776 - protein, 19 aa, Mycobacterium
AETRARRRNDQNVASGLAD

SEQ ID NO: 419777 - protein, 9 aa, Mycobacterium
AETRDPASF

SEQ ID NO: 419778 - protein, 8 aa, Mycobacterium
AETREAAA

SEQ ID NO: 419779 - protein, 7 aa, Mycobacterium
AETRGKA

SEQ ID NO: 419780 - protein, 13 aa, Mycobacterium
AETRGYQTDDSRA

SEQ ID NO: 419781 - protein, 8 aa, Mycobacterium
AETRPETV

SEQ ID NO: 419782 - protein, 13 aa, Mycobacterium
AETRRSSARPSSG

SEQ ID NO: 419783 - protein, 8 aa, Mycobacterium
AETRSTEY

SEQ ID NO: 419784 - protein, 6 aa, Mycobacterium
AETRTA

SEQ ID NO: 419785 - protein, 16 aa, Mycobacterium
AETRTYRDAKSDTEVR

SEQ ID NO: 419786 - protein, 5 aa, Mycobacterium
AETSA

SEQ ID NO: 419787 - protein, 18 aa, Mycobacterium
AETSAGNVQSTVARTPQA

SEQ ID NO: 419788 - protein, 9 aa, Mycobacterium
AETSAGTID

SEQ ID NO: 419789 - protein, 6 aa, Mycobacterium
AETSDA

SEQ ID NO: 419790 - protein, 8 aa, Mycobacterium
AETSDPVA

SEQ ID NO: 419791 - protein, 9 aa, Mycobacterium
AETSEEAHQ

SEQ ID NO: 419792 - protein, 17 aa, Mycobacterium
AETSGAAAKPSGAGGGD

SEQ ID NO: 419793 - protein, 6 aa, Mycobacterium
AETSGD

SEQ ID NO: 419794 - protein, 20 aa, Mycobacterium
AETSGGLPGFGKPLDSETLS

SEQ ID NO: 419795 - protein, 13 aa, Mycobacterium
AETSNGALTSGAL

SEQ ID NO: 419796 - protein, 8 aa, Mycobacterium
AETSPGPS

SEQ ID NO: 419797 - protein, 13 aa, Mycobacterium
AETSRKLKEANAE

SEQ ID NO: 419798 - protein, 11 aa, Mycobacterium
AETSRPRDFPK

SEQ ID NO: 419799 - protein, 5 aa, Mycobacterium
AETSS

SEQ ID NO: 419800 - protein, 8 aa, Mycobacterium
AETSTAPA

SEQ ID NO: 419801 - protein, 5 aa, Mycobacterium
AETSV

SEQ ID NO: 419802 - protein, 20 aa, Mycobacterium
AETSVAQDGSLSIGSLKGTT

SEQ ID NO: 419803 - protein, 7 aa, Mycobacterium
AETTAGG

SEQ ID NO: 419804 - protein, 6 aa, Mycobacterium
AETTAN

SEQ ID NO: 419805 - protein, 7 aa, Mycobacterium
AETTARG

SEQ ID NO: 419806 - protein, 7 aa, Mycobacterium
AETTASL

SEQ ID NO: 419807 - protein, 7 aa, Mycobacterium
AETTEEA

SEQ ID NO: 419808 - protein, 10 aa, Mycobacterium
AETTGDLDAQ

SEQ ID NO: 419809 - protein, 15 aa, Mycobacterium
AETTIPEASEGSREC

SEQ ID NO: 419810 - protein, 8 aa, Mycobacterium
AETTNERH

SEQ ID NO: 419811 - protein, 9 aa, Mycobacterium
AETTPAQTA

SEQ ID NO: 419812 - protein, 6 aa, Mycobacterium
AETTPD

SEQ ID NO: 419813 - protein, 9 aa, Mycobacterium
AETTPKGAK

SEQ ID NO: 419814 - protein, 7 aa, Mycobacterium
AETTPPI

SEQ ID NO: 419815 - protein, 11 aa, Mycobacterium
AETTQSGGGED

SEQ ID NO: 419816 - protein, 7 aa, Mycobacterium
AETTRAL

SEQ ID NO: 419817 - protein, 7 aa, Mycobacterium
AETTSGE

SEQ ID NO: 419818 - protein, 10 aa, Mycobacterium
AETTSTLANT

SEQ ID NO: 419819 - protein, 20 aa, Mycobacterium
AETTTEPADTQQSARSRAAA

SEQ ID NO: 419820 - protein, 7 aa, Mycobacterium
AETVGGS

SEQ ID NO: 419821 - protein, 12 aa, Mycobacterium
AETVHDADTGTG

SEQ ID NO: 419822 - protein, 12 aa, Mycobacterium
AETVNADRDVND

SEQ ID NO: 419823 - protein, 7 aa, Mycobacterium
AETVPPD

SEQ ID NO: 419824 - protein, 6 aa, Mycobacterium
AETVSD

SEQ ID NO: 419825 - protein, 5 aa, Mycobacterium
AETYA

SEQ ID NO: 419826 - protein, 6 aa, Mycobacterium
AETYGD

SEQ ID NO: 419827 - protein, 20 aa, Mycobacterium
AEVAAADAARAAADSDAGQL

SEQ ID NO: 419828 - protein, 22 aa, Mycobacterium
AEVAAADAARAAGEAGDPDNRQ

SEQ ID NO: 419829 - protein, 9 aa, Mycobacterium
AEVAAAGNA

SEQ ID NO: 419830 - protein, 7 aa, Mycobacterium
AEVAAGR

SEQ ID NO: 419831 - protein, 8 aa, Mycobacterium
AEVAAGTG

SEQ ID NO: 419832 - protein, 20 aa, Mycobacterium
AEVAASDAARAAADGDASQF

SEQ ID NO: 419833 - protein, 6 aa, Mycobacterium
AEVAEA

SEQ ID NO: 419834 - protein, 10 aa, Mycobacterium
AEVAGAGEET

SEQ ID NO: 419835 - protein, 12 aa, Mycobacterium
AEVAPDNRAGDA

SEQ ID NO: 419836 - protein, 7 aa, Mycobacterium
AEVAPTD

SEQ ID NO: 419837 - protein, 10 aa, Mycobacterium
AEVARGDLGD

SEQ ID NO: 419838 - protein, 6 aa, Mycobacterium
AEVDAG

SEQ ID NO: 419839 - protein, 5 aa, Mycobacterium
AEVDE

SEQ ID NO: 419840 - protein, 7 aa, Mycobacterium
AEVDGGA

SEQ ID NO: 419841 - protein, 6 aa, Mycobacterium
AEVDPR

SEQ ID NO: 419842 - protein, 13 aa, Mycobacterium
AEVEAARRKHEEE

SEQ ID NO: 419843 - protein, 13 aa, Mycobacterium
AEVEATEQRTAPS

SEQ ID NO: 419844 - protein, 10 aa, Mycobacterium
AEVEIPSPHA

SEQ ID NO: 419845 - protein, 30 aa, Mycobacterium
AEVEPAKAESVPAKAETAPAEASPAETEQA

SEQ ID NO: 419846 - protein, 7 aa, Mycobacterium
AEVEPPT

SEQ ID NO: 419847 - protein, 6 aa, Mycobacterium
AEVEQR

SEQ ID NO: 419848 - protein, 5 aa, Mycobacterium
AEVER

SEQ ID NO: 419849 - protein, 6 aa, Mycobacterium
AEVERT

SEQ ID NO: 419850 - protein, 5 aa, Mycobacterium
AEVGA

SEQ ID NO: 419851 - protein, 5 aa, Mycobacterium
AEVGD

SEQ ID NO: 419852 - protein, 7 aa, Mycobacterium
AEVGDED

SEQ ID NO: 419853 - protein, 7 aa, Mycobacterium
AEVGGSQ

SEQ ID NO: 419854 - protein, 7 aa, Mycobacterium
AEVGRGG

SEQ ID NO: 419855 - protein, 5 aa, Mycobacterium
AEVGS

SEQ ID NO: 419856 - protein, 8 aa, Mycobacterium
AEVGSGCG

SEQ ID NO: 419857 - protein, 9 aa, Mycobacterium
AEVGTPEIA

SEQ ID NO: 419858 - protein, 5 aa, Mycobacterium
AEVKN

SEQ ID NO: 419859 - protein, 7 aa, Mycobacterium
AEVKPGE

SEQ ID NO: 419860 - protein, 11 aa, Mycobacterium
AEVNRPDGTEA

SEQ ID NO: 419861 - protein, 13 aa, Mycobacterium
AEVNYRPNPHAAS

SEQ ID NO: 419862 - protein, 9 aa, Mycobacterium
AEVPAADGA

SEQ ID NO: 419863 - protein, 6 aa, Mycobacterium
AEVPAG

SEQ ID NO: 419864 - protein, 9 aa, Mycobacterium
AEVPAPDEG

SEQ ID NO: 419865 - protein, 6 aa, Mycobacterium
AEVPAS

SEQ ID NO: 419866 - protein, 7 aa, Mycobacterium
AEVPATA

SEQ ID NO: 419867 - protein, 6 aa, Mycobacterium
AEVPDA

SEQ ID NO: 419868 - protein, 5 aa, Mycobacterium
AEVPE

SEQ ID NO: 419869 - protein, 8 aa, Mycobacterium
AEVPEGAR

SEQ ID NO: 419870 - protein, 8 aa, Mycobacterium
AEVPESPR

SEQ ID NO: 419871 - protein, 5 aa, Mycobacterium
AEVPG

SEQ ID NO: 419872 - protein, 7 aa, Mycobacterium
AEVPGEL

SEQ ID NO: 419873 - protein, 8 aa, Mycobacterium
AEVPGPSG

SEQ ID NO: 419874 - protein, 11 aa, Mycobacterium
AEVPGTPSREW

SEQ ID NO: 419875 - protein, 5 aa, Mycobacterium
AEVPN

SEQ ID NO: 419876 - protein, 22 aa, Mycobacterium
AEVPPEPRRTKGPAQQAEAAAT

SEQ ID NO: 419877 - protein, 6 aa, Mycobacterium
AEVPPR

SEQ ID NO: 419878 - protein, 11 aa, Mycobacterium
AEVPRRSLSPA

SEQ ID NO: 419879 - protein, 14 aa, Mycobacterium
AEVQETDADGNPKV

SEQ ID NO: 419880 - protein, 11 aa, Mycobacterium
AEVQKAEQAGL

SEQ ID NO: 419881 - protein, 10 aa, Mycobacterium
AEVQKAERAK

SEQ ID NO: 419882 - protein, 12 aa, Mycobacterium
AEVQRAGGGTGY

SEQ ID NO: 419883 - protein, 4 aa, Mycobacterium
AEVR

SEQ ID NO: 419884 - protein, 16 aa, Mycobacterium
AEVRDGDPSPDGAGPL

SEQ ID NO: 419885 - protein, 15 aa, Mycobacterium
AEVRDGDPSPDGAGQ

SEQ ID NO: 419886 - protein, 9 aa, Mycobacterium
AEVREKEAQ

SEQ ID NO: 419887 - protein, 6 aa, Mycobacterium
AEVRSG

SEQ ID NO: 419888 - protein, 34 aa, Mycobacterium
AEVRSQQQPDDESADALRQAAPEARAEILEPVPL

SEQ ID NO: 419889 - protein, 6 aa, Mycobacterium
AEVRSR

SEQ ID NO: 419890 - protein, 10 aa, Mycobacterium
AEVSAGGLER

SEQ ID NO: 419891 - protein, 9 aa, Mycobacterium
AEVSAGRPG

SEQ ID NO: 419892 - protein, 11 aa, Mycobacterium
AEVSDAGTETA

SEQ ID NO: 419893 - protein, 20 aa, Mycobacterium
AEVSEPDDEVDSLEKAEPDT

SEQ ID NO: 419894 - protein, 6 aa, Mycobacterium
AEVSPD

SEQ ID NO: 419895 - protein, 12 aa, Mycobacterium
AEVSPEGGAGDA

SEQ ID NO: 419896 - protein, 18 aa, Mycobacterium
AEVTAGETFGEVESTKSV

SEQ ID NO: 419897 - protein, 5 aa, Mycobacterium
AEVTD

SEQ ID NO: 419898 - protein, 12 aa, Mycobacterium
AEVTDENGDPVA

SEQ ID NO: 419899 - protein, 13 aa, Mycobacterium
AEVTEVSQREPGR

SEQ ID NO: 419900 - protein, 6 aa, Mycobacterium
AEVTRP

SEQ ID NO: 419901 - protein, 6 aa, Mycobacterium
AEVTSR

SEQ ID NO: 419902 - protein, 15 aa, Mycobacterium
AEVTTEANPESTSPA

SEQ ID NO: 419903 - protein, 15 aa, Mycobacterium
AEVTTEANPESTSPE

SEQ ID NO: 419904 - protein, 14 aa, Mycobacterium
AEVVDADRPQAGPR

SEQ ID NO: 419905 - protein, 12 aa, Mycobacterium
AEWAPGEPPPAA

SEQ ID NO: 419906 - protein, 10 aa, Mycobacterium
AEWDEREETP

SEQ ID NO: 419907 - protein, 5 aa, Mycobacterium
AEWGS

SEQ ID NO: 419908 - protein, 6 aa, Mycobacterium
AEWPPG

SEQ ID NO: 419909 - protein, 4 aa, Mycobacterium
AEWR

SEQ ID NO: 419910 - protein, 6 aa, Mycobacterium
AEWRGA

SEQ ID NO: 419911 - protein, 6 aa, Mycobacterium
AEWSEQ

SEQ ID NO: 419912 - protein, 5 aa, Mycobacterium
AEYAE

SEQ ID NO: 419913 - protein, 8 aa, Mycobacterium
AEYAEDRE

SEQ ID NO: 419914 - protein, 7 aa, Mycobacterium
AEYAGTG

SEQ ID NO: 419915 - protein, 6 aa, Mycobacterium
AEYAKT

SEQ ID NO: 419916 - protein, 10 aa, Mycobacterium
AEYANPPRWS

SEQ ID NO: 419917 - protein, 6 aa, Mycobacterium
AEYANS

SEQ ID NO: 419918 - protein, 9 aa, Mycobacterium
AEYARRQTS

SEQ ID NO: 419919 - protein, 10 aa, Mycobacterium
AEYASAAEQL

SEQ ID NO: 419920 - protein, 5 aa, Mycobacterium
AEYDA

SEQ ID NO: 419921 - protein, 18 aa, Mycobacterium
AEYDEFRRSGDAPTRADD

SEQ ID NO: 419922 - protein, 9 aa, Mycobacterium
AEYDGDQHR

SEQ ID NO: 419923 - protein, 17 aa, Mycobacterium
AEYDGDQHRTDRRRYAH

SEQ ID NO: 419924 - protein, 15 aa, Mycobacterium
AEYDGDQHRTSRRQY

SEQ ID NO: 419925 - protein, 13 aa, Mycobacterium
AEYDGEQHLTSRG

SEQ ID NO: 419926 - protein, 11 aa, Mycobacterium
AEYDGEQHRRD

SEQ ID NO: 419927 - protein, 5 aa, Mycobacterium
AEYDP

SEQ ID NO: 419928 - protein, 10 aa, Mycobacterium
AEYEQSDDYR

SEQ ID NO: 419929 - protein, 6 aa, Mycobacterium
AEYGLK

SEQ ID NO: 419930 - protein, 6 aa, Mycobacterium
AEYGPQ

SEQ ID NO: 419931 - protein, 9 aa, Mycobacterium
AEYGTPSYA

SEQ ID NO: 419932 - protein, 10 aa, Mycobacterium
AEYGVGTGSV

SEQ ID NO: 419933 - protein, 4 aa, Mycobacterium
AEYH

SEQ ID NO: 419934 - protein, 6 aa, Mycobacterium
AEYPAT

SEQ ID NO: 419935 - protein, 5 aa, Mycobacterium
AEYPD

SEQ ID NO: 419936 - protein, 14 aa, Mycobacterium
AEYPDAAVYSPGAI

SEQ ID NO: 419937 - protein, 26 aa, Mycobacterium
AEYPNDNFTDEVPRAGNASGGGQPGW

SEQ ID NO: 419938 - protein, 4 aa, Mycobacterium
AEYR

SEQ ID NO: 419939 - protein, 11 aa, Mycobacterium
AEYREPTTASE

SEQ ID NO: 419940 - protein, 7 aa, Mycobacterium
AEYRRRK

SEQ ID NO: 419941 - protein, 4 aa, Mycobacterium
AEYS

SEQ ID NO: 419942 - protein, 8 aa, Mycobacterium
AEYSPDVD

SEQ ID NO: 419943 - protein, 4 aa, Mycobacterium
AFAA

SEQ ID NO: 419944 - protein, 5 aa, Mycobacterium
AFAAE

SEQ ID NO: 419945 - protein, 5 aa, Mycobacterium
AFAAG

SEQ ID NO: 419946 - protein, 12 aa, Mycobacterium
AFAAQARDDGVS

SEQ ID NO: 419947 - protein, 5 aa, Mycobacterium
AFAAR

SEQ ID NO: 419948 - protein, 20 aa, Mycobacterium
AFAASADGENVKVLVSMGNP

SEQ ID NO: 419949 - protein, 8 aa, Mycobacterium
AFADKEQV

SEQ ID NO: 419950 - protein, 5 aa, Mycobacterium
AFADP

SEQ ID NO: 419951 - protein, 11 aa, Mycobacterium
AFADSDEEAER

SEQ ID NO: 419952 - protein, 6 aa, Mycobacterium
AFAERE

SEQ ID NO: 419953 - protein, 5 aa, Mycobacterium
AFAPG

SEQ ID NO: 419954 - protein, 13 aa, Mycobacterium
AFAPPKDLQPGEY

SEQ ID NO: 419955 - protein, 6 aa, Mycobacterium
AFAPQD

SEQ ID NO: 419956 - protein, 6 aa, Mycobacterium
AFAPTD

SEQ ID NO: 419957 - protein, 8 aa, Mycobacterium
AFARRTGA

SEQ ID NO: 419958 - protein, 10 aa, Mycobacterium
AFASRGPDAL

SEQ ID NO: 419959 - protein, 11 aa, Mycobacterium
AFATERADREK

SEQ ID NO: 419960 - protein, 5 aa, Mycobacterium
AFDAG

SEQ ID NO: 419961 - protein, 8 aa, Mycobacterium
AFDDGGSM

SEQ ID NO: 419962 - protein, 9 aa, Mycobacterium
AFDDSGWSR

SEQ ID NO: 419963 - protein, 10 aa, Mycobacterium
AFDDTDWSRN

SEQ ID NO: 419964 - protein, 12 aa, Mycobacterium
AFDDTDWSTDTE

SEQ ID NO: 419965 - protein, 6 aa, Mycobacterium
AFDEGS

SEQ ID NO: 419966 - protein, 5 aa, Mycobacterium
AFDEP

SEQ ID NO: 419967 - protein, 9 aa, Mycobacterium
AFDESGYAA

SEQ ID NO: 419968 - protein, 10 aa, Mycobacterium
AFDGDQQVAG

SEQ ID NO: 419969 - protein, 7 aa, Mycobacterium
AFDGDRI

SEQ ID NO: 419970 - protein, 5 aa, Mycobacterium
AFDGE

SEQ ID NO: 419971 - protein, 8 aa, Mycobacterium
AFDGSNRS

SEQ ID NO: 419972 - protein, 11 aa, Mycobacterium
AFDGTEGGTEV

SEQ ID NO: 419973 - protein, 5 aa, Mycobacterium
AFDPD

SEQ ID NO: 419974 - protein, 7 aa, Mycobacterium
AFDPSGK

SEQ ID NO: 419975 - protein, 6 aa, Mycobacterium
AFDPTG

SEQ ID NO: 419976 - protein, 6 aa, Mycobacterium
AFDQGG

SEQ ID NO: 419977 - protein, 12 aa, Mycobacterium
AFDRDDPRGGEA

SEQ ID NO: 419978 - protein, 9 aa, Mycobacterium
AFDSDPDAL

SEQ ID NO: 419979 - protein, 6 aa, Mycobacterium
AFDSGA

SEQ ID NO: 419980 - protein, 7 aa, Mycobacterium
AFDSGPW

SEQ ID NO: 419981 - protein, 6 aa, Mycobacterium
AFDSTA

SEQ ID NO: 419982 - protein, 10 aa, Mycobacterium
AFDSTDWSTN

SEQ ID NO: 419983 - protein, 5 aa, Mycobacterium
AFEGA

SEQ ID NO: 419984 - protein, 5 aa, Mycobacterium
AFEGP

SEQ ID NO: 419985 - protein, 9 aa, Mycobacterium
AFEGPEGPV

SEQ ID NO: 419986 - protein, 9 aa, Mycobacterium
AFEGSDSKS

SEQ ID NO: 419987 - protein, 11 aa, Mycobacterium
AFEKAGVAPED

SEQ ID NO: 419988 - protein, 7 aa, Mycobacterium
AFENPDE

SEQ ID NO: 419989 - protein, 12 aa, Mycobacterium
AFERDDPRGGEA

SEQ ID NO: 419990 - protein, 6 aa, Mycobacterium
AFERTA

SEQ ID NO: 419991 - protein, 12 aa, Mycobacterium
AFESDDPRGGEA

SEQ ID NO: 419992 - protein, 6 aa, Mycobacterium
AFESGS

SEQ ID NO: 419993 - protein, 11 aa, Mycobacterium
AFESQTSPPAP

SEQ ID NO: 419994 - protein, 5 aa, Mycobacterium
AFETG

SEQ ID NO: 419995 - protein, 4 aa, Mycobacterium
AFGA

SEQ ID NO: 419996 - protein, 6 aa, Mycobacterium
AFGANE

SEQ ID NO: 419997 - protein, 10 aa, Mycobacterium
AFGDPPSDVQ

SEQ ID NO: 419998 - protein, 6 aa, Mycobacterium
AFGDSY

SEQ ID NO: 419999 - protein, 6 aa, Mycobacterium
AFGEPS

SEQ ID NO: 420000 - protein, 8 aa, Mycobacterium
AFGGATRT

SEQ ID NO: 420001 - protein, 9 aa, Mycobacterium
AFGGDPGNV

SEQ ID NO: 420002 - protein, 18 aa, Mycobacterium
AFGGDPSAVTVAGQSSGA

SEQ ID NO: 420003 - protein, 9 aa, Mycobacterium
AFGGDPTRV

SEQ ID NO: 420004 - protein, 5 aa, Mycobacterium
AFGGG

SEQ ID NO: 420005 - protein, 7 aa, Mycobacterium
AFGGGGH

SEQ ID NO: 420006 - protein, 30 aa, Mycobacterium
AFGGGGHPHAAGYSATGSADDVVQALARAL

SEQ ID NO: 420007 - protein, 7 aa, Mycobacterium
AFGGGKN

SEQ ID NO: 420008 - protein, 8 aa, Mycobacterium
AFGGPGGN

SEQ ID NO: 420009 - protein, 5 aa, Mycobacterium
AFGGR

SEQ ID NO: 420010 - protein, 9 aa, Mycobacterium
AFGNPPARW

SEQ ID NO: 420011 - protein, 6 aa, Mycobacterium
AFGPGA

SEQ ID NO: 420012 - protein, 7 aa, Mycobacterium
AFGPKAS

SEQ ID NO: 420013 - protein, 6 aa, Mycobacterium
AFGPNA

SEQ ID NO: 420014 - protein, 8 aa, Mycobacterium
AFGPNEEV

SEQ ID NO: 420015 - protein, 6 aa, Mycobacterium
AFGPSA

SEQ ID NO: 420016 - protein, 8 aa, Mycobacterium
AFGPTGPW

SEQ ID NO: 420017 - protein, 5 aa, Mycobacterium
AFGPV

SEQ ID NO: 420018 - protein, 6 aa, Mycobacterium
AFGQGS

SEQ ID NO: 420019 - protein, 7 aa, Mycobacterium
AFGQNTA

SEQ ID NO: 420020 - protein, 6 aa, Mycobacterium
AFGQPI

SEQ ID NO: 420021 - protein, 5 aa, Mycobacterium
AFGQR

SEQ ID NO: 420022 - protein, 9 aa, Mycobacterium
AFGRDPEIK

SEQ ID NO: 420023 - protein, 33 aa, Mycobacterium
AFGRGDRGDPRDAQGGGRLPADRPRAARGAPRV

SEQ ID NO: 420024 - protein, 15 aa, Mycobacterium
AFGRGGSPKPPTPMD

SEQ ID NO: 420025 - protein, 13 aa, Mycobacterium
AFGRNKSVSREDQ

SEQ ID NO: 420026 - protein, 13 aa, Mycobacterium
AFGSGKGNDAIGS

SEQ ID NO: 420027 - protein, 9 aa, Mycobacterium
AFGSRPDRW

SEQ ID NO: 420028 - protein, 9 aa, Mycobacterium
AFGTDPDKL

SEQ ID NO: 420029 - protein, 7 aa, Mycobacterium
AFGTGEM

SEQ ID NO: 420030 - protein, 22 aa, Mycobacterium
AFGTPEANQVHREGPGPMGPSR

SEQ ID NO: 420031 - protein, 16 aa, Mycobacterium
AFHGPGRAQVGYNEHN

SEQ ID NO: 420032 - protein, 17 aa, Mycobacterium
AFHGPGRAQVGYNEHNQ

SEQ ID NO: 420033 - protein, 8 aa, Mycobacterium
AFHGTAGA

SEQ ID NO: 420034 - protein, 11 aa, Mycobacterium
AFHNKGASASW

SEQ ID NO: 420035 - protein, 5 aa, Mycobacterium
AFKAR

SEQ ID NO: 420036 - protein, 20 aa, Mycobacterium
AFKGEDAAPASAATTPTSTV

SEQ ID NO: 420037 - protein, 6 aa, Mycobacterium
AFNSGG

SEQ ID NO: 420038 - protein, 8 aa, Mycobacterium
AFNSTESA

SEQ ID NO: 420039 - protein, 14 aa, Mycobacterium
AFPADTEQGPNEVS

SEQ ID NO: 420040 - protein, 19 aa, Mycobacterium
AFPAEPSAFTEGSRALSEG

SEQ ID NO: 420041 - protein, 9 aa, Mycobacterium
AFPAPPPRE

SEQ ID NO: 420042 - protein, 12 aa, Mycobacterium
AFPASASACGAE

SEQ ID NO: 420043 - protein, 4 aa, Mycobacterium
AFPD

SEQ ID NO: 420044 - protein, 10 aa, Mycobacterium
AFPDPAEDVR

SEQ ID NO: 420045 - protein, 6 aa, Mycobacterium
AFPDPT

SEQ ID NO: 420046 - protein, 5 aa, Mycobacterium
AFPDQ

SEQ ID NO: 420047 - protein, 5 aa, Mycobacterium
AFPDS

SEQ ID NO: 420048 - protein, 10 aa, Mycobacterium
AFPDSHRQNM

SEQ ID NO: 420049 - protein, 10 aa, Mycobacterium
AFPEDPGYPI

SEQ ID NO: 420050 - protein, 8 aa, Mycobacterium
AFPEGGTV

SEQ ID NO: 420051 - protein, 7 aa, Mycobacterium
AFPEPDK

SEQ ID NO: 420052 - protein, 10 aa, Mycobacterium
AFPERSPDAY

SEQ ID NO: 420053 - protein, 18 aa, Mycobacterium
AFPGGRIEARNDPSPHAS

SEQ ID NO: 420054 - protein, 9 aa, Mycobacterium
AFPGPTGAL

SEQ ID NO: 420055 - protein, 13 aa, Mycobacterium
AFPKRLGKPEEYA

SEQ ID NO: 420056 - protein, 12 aa, Mycobacterium
AFPNHSRKHASR

SEQ ID NO: 420057 - protein, 16 aa, Mycobacterium
AFPNYSGSATGRTFPS

SEQ ID NO: 420058 - protein, 6 aa, Mycobacterium
AFPPAN

SEQ ID NO: 420059 - protein, 13 aa, Mycobacterium
AFPPGSALPPERE

SEQ ID NO: 420060 - protein, 15 aa, Mycobacterium
AFPPNAEFGPRPFTE

SEQ ID NO: 420061 - protein, 17 aa, Mycobacterium
AFPPPPPGYDRPASCEP

SEQ ID NO: 420062 - protein, 4 aa, Mycobacterium
AFPQ

SEQ ID NO: 420063 - protein, 9 aa, Mycobacterium
AFPQGGTVG

SEQ ID NO: 420064 - protein, 7 aa, Mycobacterium
AFPRAKS

SEQ ID NO: 420065 - protein, 6 aa, Mycobacterium
AFPSAG

SEQ ID NO: 420066 - protein, 13 aa, Mycobacterium
AFPSRKAASSTAL

SEQ ID NO: 420067 - protein, 5 aa, Mycobacterium
AFQDG

SEQ ID NO: 420068 - protein, 8 aa, Mycobacterium
AFQPSKAL

SEQ ID NO: 420069 - protein, 12 aa, Mycobacterium
AFQQNRRPEFTD

SEQ ID NO: 420070 - protein, 20 aa, Mycobacterium
AFQRASTRTFTDGMPFRRSQ

SEQ ID NO: 420071 - protein, 14 aa, Mycobacterium
AFQTGNPQAAQESI

SEQ ID NO: 420072 - protein, 5 aa, Mycobacterium
AFRAR

SEQ ID NO: 420073 - protein, 4 aa, Mycobacterium
AFRD

SEQ ID NO: 420074 - protein, 18 aa, Mycobacterium
AFRDDANGSGKDATVNGA

SEQ ID NO: 420075 - protein, 11 aa, Mycobacterium
AFRDDQARQTL

SEQ ID NO: 420076 - protein, 18 aa, Mycobacterium
AFRDGDDDPKGNINGGNM

SEQ ID NO: 420077 - protein, 5 aa, Mycobacterium
AFRGA

SEQ ID NO: 420078 - protein, 5 aa, Mycobacterium
AFRGG

SEQ ID NO: 420079 - protein, 7 aa, Mycobacterium
AFRGRSP

SEQ ID NO: 420080 - protein, 6 aa, Mycobacterium
AFRGTD

SEQ ID NO: 420081 - protein, 7 aa, Mycobacterium
AFRPASA

SEQ ID NO: 420082 - protein, 5 aa, Mycobacterium
AFRPT

SEQ ID NO: 420083 - protein, 12 aa, Mycobacterium
AFRQGADPGPWD

SEQ ID NO: 420084 - protein, 4 aa, Mycobacterium
AFRS

SEQ ID NO: 420085 - protein, 6 aa, Mycobacterium
AFRSGG

SEQ ID NO: 420086 - protein, 10 aa, Mycobacterium
AFRSPTDDMQ

SEQ ID NO: 420087 - protein, 5 aa, Mycobacterium
AFSAG

SEQ ID NO: 420088 - protein, 7 aa, Mycobacterium
AFSDGDI

SEQ ID NO: 420089 - protein, 9 aa, Mycobacterium
AFSDPPSNV

SEQ ID NO: 420090 - protein, 19 aa, Mycobacterium
AFSERSVNEGFSGGEKKRH

SEQ ID NO: 420091 - protein, 12 aa, Mycobacterium
AFSGETKATGDV

SEQ ID NO: 420092 - protein, 8 aa, Mycobacterium
AFSGGDPE

SEQ ID NO: 420093 - protein, 14 aa, Mycobacterium
AFSGRDGESTAQVR

SEQ ID NO: 420094 - protein, 8 aa, Mycobacterium
AFSGREND

SEQ ID NO: 420095 - protein, 7 aa, Mycobacterium
AFSPDHT

SEQ ID NO: 420096 - protein, 8 aa, Mycobacterium
AFSPSGRF

SEQ ID NO: 420097 - protein, 9 aa, Mycobacterium
AFSQDSRAT

SEQ ID NO: 420098 - protein, 52 aa, Mycobacterium
AFSSNPGGNGGNGGAGGAGGNGGIQAGNGGDGGAGGHGGAGATGGSGTNGFD

SEQ ID NO: 420099 - protein, 5 aa, Mycobacterium
AFSSR

SEQ ID NO: 420100 - protein, 10 aa, Mycobacterium
AFSSTKTPIT

SEQ ID NO: 420101 - protein, 5 aa, Mycobacterium
AFSYT

SEQ ID NO: 420102 - protein, 5 aa, Mycobacterium
AFTAP

SEQ ID NO: 420103 - protein, 32 aa, Mycobacterium
AFTEDENRALDDAPPVTGAAYERGERPSPTGS

SEQ ID NO: 420104 - protein, 5 aa, Mycobacterium
AFTEP

SEQ ID NO: 420105 - protein, 6 aa, Mycobacterium
AFTGEE

SEQ ID NO: 420106 - protein, 14 aa, Mycobacterium
AFTGGDAESTAQVR

SEQ ID NO: 420107 - protein, 9 aa, Mycobacterium
AFTNQQSDL

SEQ ID NO: 420108 - protein, 14 aa, Mycobacterium
AFTPEAAESSADVR

SEQ ID NO: 420109 - protein, 7 aa, Mycobacterium
AFTPEQR

SEQ ID NO: 420110 - protein, 5 aa, Mycobacterium
AFTPG

SEQ ID NO: 420111 - protein, 8 aa, Mycobacterium
AFTPGRPD

SEQ ID NO: 420112 - protein, 9 aa, Mycobacterium
AFTPRPVPT

SEQ ID NO: 420113 - protein, 9 aa, Mycobacterium
AFTSGDDGI

SEQ ID NO: 420114 - protein, 9 aa, Mycobacterium
AFTSKTYDK

SEQ ID NO: 420115 - protein, 10 aa, Mycobacterium
AFTSSRASHI

SEQ ID NO: 420116 - protein, 10 aa, Mycobacterium
AFTSTSTDHT

SEQ ID NO: 420117 - protein, 8 aa, Mycobacterium
AGAAAAAA

SEQ ID NO: 420118 - protein, 17 aa, Mycobacterium
AGAAAAGGVPPVTSAPM

SEQ ID NO: 420119 - protein, 19 aa, Mycobacterium
AGAAADSPCTASASVAKEP

SEQ ID NO: 420120 - protein, 6 aa, Mycobacterium
AGAAAE

SEQ ID NO: 420121 - protein, 15 aa, Mycobacterium
AGAAAGPADTPLAAA

SEQ ID NO: 420122 - protein, 9 aa, Mycobacterium
AGAAAGPGT

SEQ ID NO: 420123 - protein, 12 aa, Mycobacterium
AGAAANLVAGQW

SEQ ID NO: 420124 - protein, 10 aa, Mycobacterium
AGAAARGGTA

SEQ ID NO: 420125 - protein, 16 aa, Mycobacterium
AGAAASAADIAATGAD

SEQ ID NO: 420126 - protein, 7 aa, Mycobacterium
AGAAATP

SEQ ID NO: 420127 - protein, 16 aa, Mycobacterium
AGAAAYSAGAARATVA

SEQ ID NO: 420128 - protein, 7 aa, Mycobacterium
AGAADLS

SEQ ID NO: 420129 - protein, 7 aa, Mycobacterium
AGAADLT

SEQ ID NO: 420130 - protein, 11 aa, Mycobacterium
AGAADRLDADG

SEQ ID NO: 420131 - protein, 13 aa, Mycobacterium
AGAADRLGPSSGG

SEQ ID NO: 420132 - protein, 19 aa, Mycobacterium
AGAADTAAAAGSDASLDEA

SEQ ID NO: 420133 - protein, 16 aa, Mycobacterium
AGAADVPGSALNRPDQ

SEQ ID NO: 420134 - protein, 5 aa, Mycobacterium
AGAAE

SEQ ID NO: 420135 - protein, 6 aa, Mycobacterium
AGAAEA

SEQ ID NO: 420136 - protein, 14 aa, Mycobacterium
AGAAEATSIADTAA

SEQ ID NO: 420137 - protein, 19 aa, Mycobacterium
AGAAEDSFRKEHGGTGNVG

SEQ ID NO: 420138 - protein, 19 aa, Mycobacterium
AGAAEDSFRKERGGTGNVG

SEQ ID NO: 420139 - protein, 10 aa, Mycobacterium
AGAAEESSLD

SEQ ID NO: 420140 - protein, 6 aa, Mycobacterium
AGAAEN

SEQ ID NO: 420141 - protein, 11 aa, Mycobacterium
AGAAERARDVG

SEQ ID NO: 420142 - protein, 10 aa, Mycobacterium
AGAAESGRTL

SEQ ID NO: 420143 - protein, 27 aa, Mycobacterium
AGAAESVPAEVPAAEPAADSAPPAIAQ

SEQ ID NO: 420144 - protein, 6 aa, Mycobacterium
AGAAGA

SEQ ID NO: 420145 - protein, 7 aa, Mycobacterium
AGAAGAG

SEQ ID NO: 420146 - protein, 19 aa, Mycobacterium
AGAAGATEREQDPLTPDKR

SEQ ID NO: 420147 - protein, 22 aa, Mycobacterium
AGAAGAVEREQDPLTADAGDEW

SEQ ID NO: 420148 - protein, 8 aa, Mycobacterium
AGAAGGLA

SEQ ID NO: 420149 - protein, 9 aa, Mycobacterium
AGAAGLTSR

SEQ ID NO: 420150 - protein, 9 aa, Mycobacterium
AGAAGTGCV

SEQ ID NO: 420151 - protein, 8 aa, Mycobacterium
AGAAGTSN

SEQ ID NO: 420152 - protein, 7 aa, Mycobacterium
AGAAGVE

SEQ ID NO: 420153 - protein, 5 aa, Mycobacterium
AGAAI

SEQ ID NO: 420154 - protein, 11 aa, Mycobacterium
AGAAKRDPALG

SEQ ID NO: 420155 - protein, 11 aa, Mycobacterium
AGAAKRDPDLD

SEQ ID NO: 420156 - protein, 19 aa, Mycobacterium
AGAALAAGASAAADATASV

SEQ ID NO: 420157 - protein, 10 aa, Mycobacterium
AGAALDAATR

SEQ ID NO: 420158 - protein, 15 aa, Mycobacterium
AGAALSKEAEEGGLA

SEQ ID NO: 420159 - protein, 6 aa, Mycobacterium
AGAAMA

SEQ ID NO: 420160 - protein, 11 aa, Mycobacterium
AGAANRDPALG

SEQ ID NO: 420161 - protein, 6 aa, Mycobacterium
AGAAPA

SEQ ID NO: 420162 - protein, 18 aa, Mycobacterium
AGAAPAGGAAEAAEEQSE

SEQ ID NO: 420163 - protein, 9 aa, Mycobacterium
AGAAPALPA

SEQ ID NO: 420164 - protein, 11 aa, Mycobacterium
AGAAPAQRRTK

SEQ ID NO: 420165 - protein, 41 aa, Mycobacterium
AGAAPGAAMGSGGAGMAPMGAPGAGQAPGQAGKGKRAEPGD

SEQ ID NO: 420166 - protein, 8 aa, Mycobacterium
AGAAPGDV

SEQ ID NO: 420167 - protein, 9 aa, Mycobacterium
AGAAPIGGQ

SEQ ID NO: 420168 - protein, 13 aa, Mycobacterium
AGAAPPEPTPATL

SEQ ID NO: 420169 - protein, 10 aa, Mycobacterium
AGAAPPVGPQ

SEQ ID NO: 420170 - protein, 27 aa, Mycobacterium
AGAAPSGAGFGATADSGSAGPATGWGA

SEQ ID NO: 420171 - protein, 6 aa, Mycobacterium
AGAAQA

SEQ ID NO: 420172 - protein, 5 aa, Mycobacterium
AGAAR

SEQ ID NO: 420173 - protein, 7 aa, Mycobacterium
AGAARAR

SEQ ID NO: 420174 - protein, 7 aa, Mycobacterium
AGAARGI

SEQ ID NO: 420175 - protein, 15 aa, Mycobacterium
AGAARHGSVRTATQR

SEQ ID NO: 420176 - protein, 16 aa, Mycobacterium
AGAARNQADAARPRAT

SEQ ID NO: 420177 - protein, 6 aa, Mycobacterium
AGAARS

SEQ ID NO: 420178 - protein, 9 aa, Mycobacterium
AGAARSLDE

SEQ ID NO: 420179 - protein, 11 aa, Mycobacterium
AGAASAGQGHE

SEQ ID NO: 420180 - protein, 9 aa, Mycobacterium
AGAASAKLA

SEQ ID NO: 420181 - protein, 9 aa, Mycobacterium
AGAASASRM

SEQ ID NO: 420182 - protein, 8 aa, Mycobacterium
AGAASGQV

SEQ ID NO: 420183 - protein, 8 aa, Mycobacterium
AGAASNNI

SEQ ID NO: 420184 - protein, 9 aa, Mycobacterium
AGAASNNIE

SEQ ID NO: 420185 - protein, 14 aa, Mycobacterium
AGAASQATKVAGRE

SEQ ID NO: 420186 - protein, 11 aa, Mycobacterium
AGAASRPLDEQ

SEQ ID NO: 420187 - protein, 8 aa, Mycobacterium
AGAASTGC

SEQ ID NO: 420188 - protein, 5 aa, Mycobacterium
AGAAT

SEQ ID NO: 420189 - protein, 38 aa, Mycobacterium
AGAATAAGATSAAGAAAGSADAGPAGAASAADAARPAV

SEQ ID NO: 420190 - protein, 17 aa, Mycobacterium
AGAATDRGLAALKKALH

SEQ ID NO: 420191 - protein, 25 aa, Mycobacterium
AGAATGGRGAAGPAGIANTTRLEAA

SEQ ID NO: 420192 - protein, 13 aa, Mycobacterium
AGAATKTEPKVQA

SEQ ID NO: 420193 - protein, 9 aa, Mycobacterium
AGAATNNVE

SEQ ID NO: 420194 - protein, 6 aa, Mycobacterium
AGAATP

SEQ ID NO: 420195 - protein, 7 aa, Mycobacterium
AGAATPQ

SEQ ID NO: 420196 - protein, 6 aa, Mycobacterium
AGAAVE

SEQ ID NO: 420197 - protein, 5 aa, Mycobacterium
AGAAY

SEQ ID NO: 420198 - protein, 6 aa, Mycobacterium
AGAAYA

SEQ ID NO: 420199 - protein, 14 aa, Mycobacterium
AGAAYAAAEAANIS

SEQ ID NO: 420200 - protein, 13 aa, Mycobacterium
AGAAYAQAEAANA

SEQ ID NO: 420201 - protein, 5 aa, Mycobacterium
AGACR

SEQ ID NO: 420202 - protein, 10 aa, Mycobacterium
AGADAAYSSS

SEQ ID NO: 420203 - protein, 6 aa, Mycobacterium
AGADAS

SEQ ID NO: 420204 - protein, 16 aa, Mycobacterium
AGADASERKAAGDKRS

SEQ ID NO: 420205 - protein, 12 aa, Mycobacterium
AGADATDAEEGT

SEQ ID NO: 420206 - protein, 23 aa, Mycobacterium
AGADAVDGASAPMAGTTSQPALS

SEQ ID NO: 420207 - protein, 7 aa, Mycobacterium
AGADAYD

SEQ ID NO: 420208 - protein, 17 aa, Mycobacterium
AGADAYSSAEASTAATL

SEQ ID NO: 420209 - protein, 5 aa, Mycobacterium
AGADD

SEQ ID NO: 420210 - protein, 8 aa, Mycobacterium
AGADDRLT

SEQ ID NO: 420211 - protein, 10 aa, Mycobacterium
AGADDRSCHG

SEQ ID NO: 420212 - protein, 12 aa, Mycobacterium
AGADEPGPADSV

SEQ ID NO: 420213 - protein, 12 aa, Mycobacterium
AGADEPGRLPPA

SEQ ID NO: 420214 - protein, 10 aa, Mycobacterium
AGADERGIPS

SEQ ID NO: 420215 - protein, 6 aa, Mycobacterium
AGADEV

SEQ ID NO: 420216 - protein, 16 aa, Mycobacterium
AGADEVGEEHAGDNAP

SEQ ID NO: 420217 - protein, 9 aa, Mycobacterium
AGADEVSAQ

SEQ ID NO: 420218 - protein, 5 aa, Mycobacterium
AGADG

SEQ ID NO: 420219 - protein, 8 aa, Mycobacterium
AGADGADI

SEQ ID NO: 420220 - protein, 9 aa, Mycobacterium
AGADGALHS

SEQ ID NO: 420221 - protein, 26 aa, Mycobacterium
AGADGDPSSSVGVTTTAAHEAWRDPE

SEQ ID NO: 420222 - protein, 6 aa, Mycobacterium
AGADGE

SEQ ID NO: 420223 - protein, 7 aa, Mycobacterium
AGADGEL

SEQ ID NO: 420224 - protein, 13 aa, Mycobacterium
AGADGGQRGADQA

SEQ ID NO: 420225 - protein, 6 aa, Mycobacterium
AGADGH

SEQ ID NO: 420226 - protein, 12 aa, Mycobacterium
AGADGLGSNAEF

SEQ ID NO: 420227 - protein, 9 aa, Mycobacterium
AGADGPELL

SEQ ID NO: 420228 - protein, 10 aa, Mycobacterium
AGADGRPNRV

SEQ ID NO: 420229 - protein, 8 aa, Mycobacterium
AGADGSAV

SEQ ID NO: 420230 - protein, 33 aa, Mycobacterium
AGADGSTGGNGGVGGNGGVGGNGGNGGNGGAAG

SEQ ID NO: 420231 - protein, 5 aa, Mycobacterium
AGADH

SEQ ID NO: 420232 - protein, 5 aa, Mycobacterium
AGADL

SEQ ID NO: 420233 - protein, 7 aa, Mycobacterium
AGADLPG

SEQ ID NO: 420234 - protein, 6 aa, Mycobacterium
AGADLS

SEQ ID NO: 420235 - protein, 6 aa, Mycobacterium
AGADPA

SEQ ID NO: 420236 - protein, 18 aa, Mycobacterium
AGADPAAPPSGPDGDHDA

SEQ ID NO: 420237 - protein, 8 aa, Mycobacterium
AGADPAEL

SEQ ID NO: 420238 - protein, 8 aa, Mycobacterium
AGADPARP

SEQ ID NO: 420239 - protein, 8 aa, Mycobacterium
AGADPDGW

SEQ ID NO: 420240 - protein, 6 aa, Mycobacterium
AGADPE

SEQ ID NO: 420241 - protein, 19 aa, Mycobacterium
AGADPEKAVSREALQDPDA

SEQ ID NO: 420242 - protein, 8 aa, Mycobacterium
AGADPELP

SEQ ID NO: 420243 - protein, 8 aa, Mycobacterium
AGADPGLA

SEQ ID NO: 420244 - protein, 7 aa, Mycobacterium
AGADPLT

SEQ ID NO: 420245 - protein, 8 aa, Mycobacterium
AGADPMDE

SEQ ID NO: 420246 - protein, 9 aa, Mycobacterium
AGADPMDPR

SEQ ID NO: 420247 - protein, 8 aa, Mycobacterium
AGADPMDT

SEQ ID NO: 420248 - protein, 16 aa, Mycobacterium
AGADPRQVELPPSTQA

SEQ ID NO: 420249 - protein, 9 aa, Mycobacterium
AGADQRDKL

SEQ ID NO: 420250 - protein, 59 aa, Mycobacterium
AGADQTRISTGTTDTAGTSKALTTGSTGSAGTPQPGPSAGAAGTATQRALSASTAGAAA

SEQ ID NO: 420251 - protein, 5 aa, Mycobacterium
AGADR

SEQ ID NO: 420252 - protein, 7 aa, Mycobacterium
AGADRAT

SEQ ID NO: 420253 - protein, 8 aa, Mycobacterium
AGADRGDL

SEQ ID NO: 420254 - protein, 10 aa, Mycobacterium
AGADRGDLRS

SEQ ID NO: 420255 - protein, 7 aa, Mycobacterium
AGADRPL

SEQ ID NO: 420256 - protein, 8 aa, Mycobacterium
AGADRRSA

SEQ ID NO: 420257 - protein, 6 aa, Mycobacterium
AGADRS

SEQ ID NO: 420258 - protein, 10 aa, Mycobacterium
AGADRSESPW

SEQ ID NO: 420259 - protein, 8 aa, Mycobacterium
AGADSGTI

SEQ ID NO: 420260 - protein, 6 aa, Mycobacterium
AGADSM

SEQ ID NO: 420261 - protein, 9 aa, Mycobacterium
AGADSPRET

SEQ ID NO: 420262 - protein, 8 aa, Mycobacterium
AGADSTEL

SEQ ID NO: 420263 - protein, 5 aa, Mycobacterium
AGADT

SEQ ID NO: 420264 - protein, 10 aa, Mycobacterium
AGADTHAGDI

SEQ ID NO: 420265 - protein, 14 aa, Mycobacterium
AGADTQALDSARQQ

SEQ ID NO: 420266 - protein, 6 aa, Mycobacterium
AGADTS

SEQ ID NO: 420267 - protein, 6 aa, Mycobacterium
AGADVD

SEQ ID NO: 420268 - protein, 6 aa, Mycobacterium
AGADVG

SEQ ID NO: 420269 - protein, 7 aa, Mycobacterium
AGADVGQ

SEQ ID NO: 420270 - protein, 7 aa, Mycobacterium
AGADYGH

SEQ ID NO: 420271 - protein, 6 aa, Mycobacterium
AGAEAE

SEQ ID NO: 420272 - protein, 17 aa, Mycobacterium
AGAEAVDEGYAGGADDY

SEQ ID NO: 420273 - protein, 15 aa, Mycobacterium
AGAEAVSDGFAGGAD

SEQ ID NO: 420274 - protein, 17 aa, Mycobacterium
AGAEAVSEGLAGGADDY

SEQ ID NO: 420275 - protein, 11 aa, Mycobacterium
AGAEDSPERAA

SEQ ID NO: 420276 - protein, 6 aa, Mycobacterium
AGAEEK

SEQ ID NO: 420277 - protein, 8 aa, Mycobacterium
AGAEEVSA

SEQ ID NO: 420278 - protein, 6 aa, Mycobacterium
AGAEGA

SEQ ID NO: 420279 - protein, 7 aa, Mycobacterium
AGAEGEP

SEQ ID NO: 420280 - protein, 7 aa, Mycobacterium
AGAEGKV

SEQ ID NO: 420281 - protein, 10 aa, Mycobacterium
AGAEGLSDKE

SEQ ID NO: 420282 - protein, 6 aa, Mycobacterium
AGAEGP

SEQ ID NO: 420283 - protein, 8 aa, Mycobacterium
AGAEGQDD

SEQ ID NO: 420284 - protein, 7 aa, Mycobacterium
AGAEGTV

SEQ ID NO: 420285 - protein, 7 aa, Mycobacterium
AGAEGVN

SEQ ID NO: 420286 - protein, 9 aa, Mycobacterium
AGAEHHAGP

SEQ ID NO: 420287 - protein, 7 aa, Mycobacterium
AGAEIRG

SEQ ID NO: 420288 - protein, 6 aa, Mycobacterium
AGAEKS

SEQ ID NO: 420289 - protein, 9 aa, Mycobacterium
AGAELTPDD

SEQ ID NO: 420290 - protein, 12 aa, Mycobacterium
AGAENPDPGHYS

SEQ ID NO: 420291 - protein, 13 aa, Mycobacterium
AGAENPDPGPCSD

SEQ ID NO: 420292 - protein, 14 aa, Mycobacterium
AGAENPDPGPDSSE

SEQ ID NO: 420293 - protein, 9 aa, Mycobacterium
AGAEPAARK

SEQ ID NO: 420294 - protein, 8 aa, Mycobacterium
AGAEPDPI

SEQ ID NO: 420295 - protein, 7 aa, Mycobacterium
AGAEPDY

SEQ ID NO: 420296 - protein, 7 aa, Mycobacterium
AGAEPET

SEQ ID NO: 420297 - protein, 8 aa, Mycobacterium
AGAEPGGA

SEQ ID NO: 420298 - protein, 13 aa, Mycobacterium
AGAEPPERPIPGP

SEQ ID NO: 420299 - protein, 6 aa, Mycobacterium
AGAEPQ

SEQ ID NO: 420300 - protein, 8 aa, Mycobacterium
AGAEPSNI

SEQ ID NO: 420301 - protein, 10 aa, Mycobacterium
AGAEPTDDRS

SEQ ID NO: 420302 - protein, 6 aa, Mycobacterium
AGAEPV

SEQ ID NO: 420303 - protein, 42 aa, Mycobacterium
AGAEPVGVARPPDDGGGQPGRGSAGARAAARRTADPRAAPAV

SEQ ID NO: 420304 - protein, 14 aa, Mycobacterium
AGAERAHDVASKTV

SEQ ID NO: 420305 - protein, 12 aa, Mycobacterium
AGAERALDQAAA

SEQ ID NO: 420306 - protein, 23 aa, Mycobacterium
AGAERGRELASTAAEKSAPYAEA

SEQ ID NO: 420307 - protein, 12 aa, Mycobacterium
AGAESGPVPDEL

SEQ ID NO: 420308 - protein, 13 aa, Mycobacterium
AGAESPEQGKWGS

SEQ ID NO: 420309 - protein, 9 aa, Mycobacterium
AGAESPRET

SEQ ID NO: 420310 - protein, 8 aa, Mycobacterium
AGAESRIP

SEQ ID NO: 420311 - protein, 5 aa, Mycobacterium
AGAET

SEQ ID NO: 420312 - protein, 7 aa, Mycobacterium
AGAETRT

SEQ ID NO: 420313 - protein, 12 aa, Mycobacterium
AGAETTSRSTAS

SEQ ID NO: 420314 - protein, 15 aa, Mycobacterium
AGAEVHGTASPAKHR

SEQ ID NO: 420315 - protein, 17 aa, Mycobacterium
AGAEVHGTASPGKHPKL

SEQ ID NO: 420316 - protein, 6 aa, Mycobacterium
AGAEVS

SEQ ID NO: 420317 - protein, 8 aa, Mycobacterium
AGAEVSEG

SEQ ID NO: 420318 - protein, 5 aa, Mycobacterium
AGAEY

SEQ ID NO: 420319 - protein, 4 aa, Mycobacterium
AGAF

SEQ ID NO: 420320 - protein, 10 aa, Mycobacterium
AGAGAAGGIG

SEQ ID NO: 420321 - protein, 18 aa, Mycobacterium
AGAGAASGYPATAGTARL

SEQ ID NO: 420322 - protein, 11 aa, Mycobacterium
AGAGAASPERF

SEQ ID NO: 420323 - protein, 14 aa, Mycobacterium
AGAGADFPASDGSE

SEQ ID NO: 420324 - protein, 7 aa, Mycobacterium
AGAGADG

SEQ ID NO: 420325 - protein, 8 aa, Mycobacterium
AGAGADLT

SEQ ID NO: 420326 - protein, 10 aa, Mycobacterium
AGAGAETGTL

SEQ ID NO: 420327 - protein, 11 aa, Mycobacterium
AGAGAGGGMPG

SEQ ID NO: 420328 - protein, 15 aa, Mycobacterium
AGAGAGGHAGVGPKY

SEQ ID NO: 420329 - protein, 9 aa, Mycobacterium
AGAGALRGS

SEQ ID NO: 420330 - protein, 9 aa, Mycobacterium
AGAGANGAH

SEQ ID NO: 420331 - protein, 32 aa, Mycobacterium
AGAGAPAASGGAFSASPAGFGVGPGAPGMPMP

SEQ ID NO: 420332 - protein, 10 aa, Mycobacterium
AGAGAPFAPG

SEQ ID NO: 420333 - protein, 14 aa, Mycobacterium
AGAGAPSSDFEGPA

SEQ ID NO: 420334 - protein, 9 aa, Mycobacterium
AGAGATIGP

SEQ ID NO: 420335 - protein, 12 aa, Mycobacterium
AGAGATPGAEIG

SEQ ID NO: 420336 - protein, 6 aa, Mycobacterium
AGAGAY

SEQ ID NO: 420337 - protein, 17 aa, Mycobacterium
AGAGAYAAAEAANASPI

SEQ ID NO: 420338 - protein, 12 aa, Mycobacterium
AGAGAYASAETT

SEQ ID NO: 420339 - protein, 15 aa, Mycobacterium
AGAGAYASTEAANVE

SEQ ID NO: 420340 - protein, 13 aa, Mycobacterium
AGAGDERGAPGTI

SEQ ID NO: 420341 - protein, 7 aa, Mycobacterium
AGAGDHD

SEQ ID NO: 420342 - protein, 8 aa, Mycobacterium
AGAGDPAT

SEQ ID NO: 420343 - protein, 11 aa, Mycobacterium
AGAGDQETVRR

SEQ ID NO: 420344 - protein, 9 aa, Mycobacterium
AGAGEAIRA

SEQ ID NO: 420345 - protein, 6 aa, Mycobacterium
AGAGEG

SEQ ID NO: 420346 - protein, 11 aa, Mycobacterium
AGAGEGSSIAD

SEQ ID NO: 420347 - protein, 14 aa, Mycobacterium
AGAGEGSSIPDEEF

SEQ ID NO: 420348 - protein, 8 aa, Mycobacterium
AGAGENDA

SEQ ID NO: 420349 - protein, 8 aa, Mycobacterium
AGAGERRR

SEQ ID NO: 420350 - protein, 7 aa, Mycobacterium
AGAGESI

SEQ ID NO: 420351 - protein, 5 aa, Mycobacterium
AGAGG

SEQ ID NO: 420352 - protein, 31 aa, Mycobacterium
AGAGGAGGAGGHGGQLYGDGGGGGAGGVGGS

SEQ ID NO: 420353 - protein, 23 aa, Mycobacterium
AGAGGAGGEGTAAGGDGGNGGNG

SEQ ID NO: 420354 - protein, 13 aa, Mycobacterium
AGAGGAGGHGGHG

SEQ ID NO: 420355 - protein, 11 aa, Mycobacterium
AGAGGAGGNAP

SEQ ID NO: 420356 - protein, 23 aa, Mycobacterium
AGAGGAGGSANSGTGGAGGIGGA

SEQ ID NO: 420357 - protein, 26 aa, Mycobacterium
AGAGGAGGVGLSGPGGAGGRGGDAGW

SEQ ID NO: 420358 - protein, 17 aa, Mycobacterium
AGAGGDGAFGGNGGNGG

SEQ ID NO: 420359 - protein, 7 aa, Mycobacterium
AGAGGFG

SEQ ID NO: 420360 - protein, 22 aa, Mycobacterium
AGAGGFGGFGSTAGGTGGTGGN

SEQ ID NO: 420361 - protein, 24 aa, Mycobacterium
AGAGGFGGYGTTGGGTGGAGGDAG

SEQ ID NO: 420362 - protein, 21 aa, Mycobacterium
AGAGGPGGSGGAGTYISPSGR

SEQ ID NO: 420363 - protein, 34 aa, Mycobacterium
AGAGGQGGLGGDGNYAGQGSYGGVGGAGGAGGAA

SEQ ID NO: 420364 - protein, 18 aa, Mycobacterium
AGAGGQGGNAAPGAYSDN

SEQ ID NO: 420365 - protein, 36 aa, Mycobacterium
AGAGGQGGTGGAANDPLVGGSTGGSGGAGGNGGTAG

SEQ ID NO: 420366 - protein, 36 aa, Mycobacterium
AGAGGQGGTGGAANDPLVTSSTGGSGGAGGNGGAAG

SEQ ID NO: 420367 - protein, 6 aa, Mycobacterium
AGAGGS

SEQ ID NO: 420368 - protein, 16 aa, Mycobacterium
AGAGGSSGFGNNGSGL

SEQ ID NO: 420369 - protein, 13 aa, Mycobacterium
AGAGGTGGSGGAA

SEQ ID NO: 420370 - protein, 7 aa, Mycobacterium
AGAGGYA

SEQ ID NO: 420371 - protein, 8 aa, Mycobacterium
AGAGGYSA

SEQ ID NO: 420372 - protein, 5 aa, Mycobacterium
AGAGI

SEQ ID NO: 420373 - protein, 9 aa, Mycobacterium
AGAGISPGS

SEQ ID NO: 420374 - protein, 9 aa, Mycobacterium
AGAGLSSAH

SEQ ID NO: 420375 - protein, 8 aa, Mycobacterium
AGAGMNQE

SEQ ID NO: 420376 - protein, 19 aa, Mycobacterium
AGAGNCAPTGARIELSLKG

SEQ ID NO: 420377 - protein, 7 aa, Mycobacterium
AGAGNDQ

SEQ ID NO: 420378 - protein, 8 aa, Mycobacterium
AGAGNRYG

SEQ ID NO: 420379 - protein, 7 aa, Mycobacterium
AGAGPAQ

SEQ ID NO: 420380 - protein, 7 aa, Mycobacterium
AGAGPEV

SEQ ID NO: 420381 - protein, 17 aa, Mycobacterium
AGAGPGSGPARKDTVDR

SEQ ID NO: 420382 - protein, 8 aa, Mycobacterium
AGAGPGSL

SEQ ID NO: 420383 - protein, 6 aa, Mycobacterium
AGAGPR

SEQ ID NO: 420384 - protein, 6 aa, Mycobacterium
AGAGPS

SEQ ID NO: 420385 - protein, 6 aa, Mycobacterium
AGAGPT

SEQ ID NO: 420386 - protein, 30 aa, Mycobacterium
AGAGPTGGTGAGGAGGNGGAGGNADGGGIV

SEQ ID NO: 420387 - protein, 7 aa, Mycobacterium
AGAGPVS

SEQ ID NO: 420388 - protein, 8 aa, Mycobacterium
AGAGPVSR

SEQ ID NO: 420389 - protein, 7 aa, Mycobacterium
AGAGQAS

SEQ ID NO: 420390 - protein, 16 aa, Mycobacterium
AGAGQGPRGAASIGRG

SEQ ID NO: 420391 - protein, 10 aa, Mycobacterium
AGAGQMPARQ

SEQ ID NO: 420392 - protein, 7 aa, Mycobacterium
AGAGQPF

SEQ ID NO: 420393 - protein, 5 aa, Mycobacterium
AGAGR

SEQ ID NO: 420394 - protein, 7 aa, Mycobacterium
AGAGRAE

SEQ ID NO: 420395 - protein, 7 aa, Mycobacterium
AGAGRGV

SEQ ID NO: 420396 - protein, 23 aa, Mycobacterium
AGAGRRTPNTVAAPGQVRSENGA

SEQ ID NO: 420397 - protein, 8 aa, Mycobacterium
AGAGRSPW

SEQ ID NO: 420398 - protein, 12 aa, Mycobacterium
AGAGRVRGIGDS

SEQ ID NO: 420399 - protein, 17 aa, Mycobacterium
AGAGSATYASGAGGATL

SEQ ID NO: 420400 - protein, 11 aa, Mycobacterium
AGAGSLSVGTT

SEQ ID NO: 420401 - protein, 35 aa, Mycobacterium
AGAGSNVAVGKDNDIEDNSQTAGGDLISGNDGPVI

SEQ ID NO: 420402 - protein, 16 aa, Mycobacterium
AGAGSPEMPMDQPASN

SEQ ID NO: 420403 - protein, 6 aa, Mycobacterium
AGAGST

SEQ ID NO: 420404 - protein, 16 aa, Mycobacterium
AGAGSYATAEASNVAQ

SEQ ID NO: 420405 - protein, 13 aa, Mycobacterium
AGAGSYSSAEAAA

SEQ ID NO: 420406 - protein, 6 aa, Mycobacterium
AGAGTA

SEQ ID NO: 420407 - protein, 21 aa, Mycobacterium
AGAGTASQTAEQKAYTDGNAY

SEQ ID NO: 420408 - protein, 7 aa, Mycobacterium
AGAGTGL

SEQ ID NO: 420409 - protein, 8 aa, Mycobacterium
AGAGTLSI

SEQ ID NO: 420410 - protein, 7 aa, Mycobacterium
AGAGTTH

SEQ ID NO: 420411 - protein, 6 aa, Mycobacterium
AGAGVA

SEQ ID NO: 420412 - protein, 6 aa, Mycobacterium
AGAGVD

SEQ ID NO: 420413 - protein, 8 aa, Mycobacterium
AGAGVGKD

SEQ ID NO: 420414 - protein, 12 aa, Mycobacterium
AGAGVQPRAGPH

SEQ ID NO: 420415 - protein, 6 aa, Mycobacterium
AGAGVR

SEQ ID NO: 420416 - protein, 6 aa, Mycobacterium
AGAGVS

SEQ ID NO: 420417 - protein, 9 aa, Mycobacterium
AGAGVTRGD

SEQ ID NO: 420418 - protein, 18 aa, Mycobacterium
AGAHAAASSGAGARAAVD

SEQ ID NO: 420419 - protein, 10 aa, Mycobacterium
AGAHAATAGV

SEQ ID NO: 420420 - protein, 8 aa, Mycobacterium
AGAHARSA

SEQ ID NO: 420421 - protein, 9 aa, Mycobacterium
AGAHGSTMR

SEQ ID NO: 420422 - protein, 7 aa, Mycobacterium
AGAHGVR

SEQ ID NO: 420423 - protein, 32 aa, Mycobacterium
AGAHPGEQVGEGGIAGQVDPQHQGVDEEADQL

SEQ ID NO: 420424 - protein, 8 aa, Mycobacterium
AGAHPGGG

SEQ ID NO: 420425 - protein, 4 aa, Mycobacterium
AGAI

SEQ ID NO: 420426 - protein, 17 aa, Mycobacterium
AGAIDHPGNPLSDAATE

SEQ ID NO: 420427 - protein, 5 aa, Mycobacterium
AGAIG

SEQ ID NO: 420428 - protein, 16 aa, Mycobacterium
AGAIGDGGKYLFEYGG

SEQ ID NO: 420429 - protein, 8 aa, Mycobacterium
AGAIHSPG

SEQ ID NO: 420430 - protein, 5 aa, Mycobacterium
AGAKA

SEQ ID NO: 420431 - protein, 13 aa, Mycobacterium
AGAKASAEAQSQL

SEQ ID NO: 420432 - protein, 9 aa, Mycobacterium
AGAKDETQV

SEQ ID NO: 420433 - protein, 5 aa, Mycobacterium
AGAKE

SEQ ID NO: 420434 - protein, 15 aa, Mycobacterium
AGAKEALAIADSMSN

SEQ ID NO: 420435 - protein, 5 aa, Mycobacterium
AGAKG

SEQ ID NO: 420436 - protein, 22 aa, Mycobacterium
AGAKQIDGSTRRFGAGAGNAPV

SEQ ID NO: 420437 - protein, 7 aa, Mycobacterium
AGAKTGT

SEQ ID NO: 420438 - protein, 7 aa, Mycobacterium
AGAKTQT

SEQ ID NO: 420439 - protein, 13 aa, Mycobacterium
AGAKVSSDGAGES

SEQ ID NO: 420440 - protein, 10 aa, Mycobacterium
AGALDEAGNV

SEQ ID NO: 420441 - protein, 10 aa, Mycobacterium
AGALEGDEAG

SEQ ID NO: 420442 - protein, 5 aa, Mycobacterium
AGALG

SEQ ID NO: 420443 - protein, 5 aa, Mycobacterium
AGALK

SEQ ID NO: 420444 - protein, 6 aa, Mycobacterium
AGALKG

SEQ ID NO: 420445 - protein, 8 aa, Mycobacterium
AGALQEGD

SEQ ID NO: 420446 - protein, 12 aa, Mycobacterium
AGALQGARGNSG

SEQ ID NO: 420447 - protein, 13 aa, Mycobacterium
AGALQRDGVTPGD

SEQ ID NO: 420448 - protein, 14 aa, Mycobacterium
AGALRDGAATTEDV

SEQ ID NO: 420449 - protein, 6 aa, Mycobacterium
AGALSE

SEQ ID NO: 420450 - protein, 10 aa, Mycobacterium
AGALSETRRE

SEQ ID NO: 420451 - protein, 6 aa, Mycobacterium
AGALTD

SEQ ID NO: 420452 - protein, 14 aa, Mycobacterium
AGALTDPPRKPSAL

SEQ ID NO: 420453 - protein, 10 aa, Mycobacterium
AGAMGGGMGG

SEQ ID NO: 420454 - protein, 9 aa, Mycobacterium
AGANDHPEA

SEQ ID NO: 420455 - protein, 17 aa, Mycobacterium
AGANDTAEAVRAAGAEA

SEQ ID NO: 420456 - protein, 71 aa, Mycobacterium
AGANGNGGAGGAGGNPGAPGNGGIGGVGPDAATSGGMGGTGGDPGAVGGGGNGGAAGGAGAVAGASGAAGT

SEQ ID NO: 420457 - protein, 86 aa, Mycobacterium
AGANGNGGAGGAGGVSEGEGGTGGHGGDGGRGGDGALGGNGGTGGVGLGNGGKGGNGGNGGNGGTYVDPSHTGAGGNGGNGGAGRI

SEQ ID NO: 420458 - protein, 13 aa, Mycobacterium
AGANGVRADPAGL

SEQ ID NO: 420459 - protein, 12 aa, Mycobacterium
AGANPANPRGYW

SEQ ID NO: 420460 - protein, 20 aa, Mycobacterium
AGANPEVTVESGVDSTGMSS

SEQ ID NO: 420461 - protein, 6 aa, Mycobacterium
AGANPI

SEQ ID NO: 420462 - protein, 10 aa, Mycobacterium
AGANQYPPGM

SEQ ID NO: 420463 - protein, 5 aa, Mycobacterium
AGANS

SEQ ID NO: 420464 - protein, 11 aa, Mycobacterium
AGANTSRAAAV

SEQ ID NO: 420465 - protein, 9 aa, Mycobacterium
AGANTSTGI

SEQ ID NO: 420466 - protein, 8 aa, Mycobacterium
AGANVSPL

SEQ ID NO: 420467 - protein, 7 aa, Mycobacterium
AGAPAAF

SEQ ID NO: 420468 - protein, 15 aa, Mycobacterium
AGAPAFGAGPQGWDG

SEQ ID NO: 420469 - protein, 11 aa, Mycobacterium
AGAPAGAAPRQ

SEQ ID NO: 420470 - protein, 6 aa, Mycobacterium
AGAPAI

SEQ ID NO: 420471 - protein, 14 aa, Mycobacterium
AGAPALKAGGEAAF

SEQ ID NO: 420472 - protein, 14 aa, Mycobacterium
AGAPAPTLGAGGDV

SEQ ID NO: 420473 - protein, 25 aa, Mycobacterium
AGAPARHPQVGTRTPVLSDDGSDLA

SEQ ID NO: 420474 - protein, 6 aa, Mycobacterium
AGAPAV

SEQ ID NO: 420475 - protein, 5 aa, Mycobacterium
AGAPD

SEQ ID NO: 420476 - protein, 8 aa, Mycobacterium
AGAPDAGG

SEQ ID NO: 420477 - protein, 6 aa, Mycobacterium
AGAPDH

SEQ ID NO: 420478 - protein, 7 aa, Mycobacterium
AGAPELT

SEQ ID NO: 420479 - protein, 6 aa, Mycobacterium
AGAPEM

SEQ ID NO: 420480 - protein, 11 aa, Mycobacterium
AGAPERDRDGN

SEQ ID NO: 420481 - protein, 9 aa, Mycobacterium
AGAPEVDPD

SEQ ID NO: 420482 - protein, 8 aa, Mycobacterium
AGAPEVDT

SEQ ID NO: 420483 - protein, 15 aa, Mycobacterium
AGAPFEPGQRVSGTT

SEQ ID NO: 420484 - protein, 15 aa, Mycobacterium
AGAPGAPMPGAGGGM

SEQ ID NO: 420485 - protein, 10 aa, Mycobacterium
AGAPGAYDTP

SEQ ID NO: 420486 - protein, 6 aa, Mycobacterium
AGAPGG

SEQ ID NO: 420487 - protein, 7 aa, Mycobacterium
AGAPGRA

SEQ ID NO: 420488 - protein, 8 aa, Mycobacterium
AGAPGRGN

SEQ ID NO: 420489 - protein, 27 aa, Mycobacterium
AGAPGRRGNHRIPGAAYNSKQRRDQEN

SEQ ID NO: 420490 - protein, 8 aa, Mycobacterium
AGAPGTAA

SEQ ID NO: 420491 - protein, 13 aa, Mycobacterium
AGAPGTGQNGGAG

SEQ ID NO: 420492 - protein, 8 aa, Mycobacterium
AGAPGWDV

SEQ ID NO: 420493 - protein, 6 aa, Mycobacterium
AGAPHY

SEQ ID NO: 420494 - protein, 5 aa, Mycobacterium
AGAPI

SEQ ID NO: 420495 - protein, 6 aa, Mycobacterium
AGAPIG

SEQ ID NO: 420496 - protein, 11 aa, Mycobacterium
AGAPLTAHGPA

SEQ ID NO: 420497 - protein, 7 aa, Mycobacterium
AGAPNLT

SEQ ID NO: 420498 - protein, 7 aa, Mycobacterium
AGAPNVA

SEQ ID NO: 420499 - protein, 13 aa, Mycobacterium
AGAPNYRPTGSPD

SEQ ID NO: 420500 - protein, 8 aa, Mycobacterium
AGAPPADL

SEQ ID NO: 420501 - protein, 14 aa, Mycobacterium
AGAPPAQADRNLGA

SEQ ID NO: 420502 - protein, 17 aa, Mycobacterium
AGAPPAVESRGERGEVR

SEQ ID NO: 420503 - protein, 6 aa, Mycobacterium
AGAPPF

SEQ ID NO: 420504 - protein, 10 aa, Mycobacterium
AGAPPGPDRV

SEQ ID NO: 420505 - protein, 10 aa, Mycobacterium
AGAPPGTDRV

SEQ ID NO: 420506 - protein, 7 aa, Mycobacterium
AGAPPGW

SEQ ID NO: 420507 - protein, 7 aa, Mycobacterium
AGAPPIT

SEQ ID NO: 420508 - protein, 7 aa, Mycobacterium
AGAPPLD

SEQ ID NO: 420509 - protein, 9 aa, Mycobacterium
AGAPPRPSV

SEQ ID NO: 420510 - protein, 23 aa, Mycobacterium
AGAPPSPLDVPSDPGLPVVKAQV

SEQ ID NO: 420511 - protein, 16 aa, Mycobacterium
AGAPPTEFARTLAPGG

SEQ ID NO: 420512 - protein, 13 aa, Mycobacterium
AGAPPVFDGHEAT

SEQ ID NO: 420513 - protein, 7 aa, Mycobacterium
AGAPQEI

SEQ ID NO: 420514 - protein, 10 aa, Mycobacterium
AGAPQEVKHT

SEQ ID NO: 420515 - protein, 8 aa, Mycobacterium
AGAPQGSR

SEQ ID NO: 420516 - protein, 6 aa, Mycobacterium
AGAPQK

SEQ ID NO: 420517 - protein, 5 aa, Mycobacterium
AGAPR

SEQ ID NO: 420518 - protein, 7 aa, Mycobacterium
AGAPRGE

SEQ ID NO: 420519 - protein, 12 aa, Mycobacterium
AGAPRGLTAERA

SEQ ID NO: 420520 - protein, 6 aa, Mycobacterium
AGAPRH

SEQ ID NO: 420521 - protein, 10 aa, Mycobacterium
AGAPRTAGTV

SEQ ID NO: 420522 - protein, 14 aa, Mycobacterium
AGAPSALAAEGEGS

SEQ ID NO: 420523 - protein, 6 aa, Mycobacterium
AGAPSF

SEQ ID NO: 420524 - protein, 6 aa, Mycobacterium
AGAPSI

SEQ ID NO: 420525 - protein, 7 aa, Mycobacterium
AGAPTRR

SEQ ID NO: 420526 - protein, 7 aa, Mycobacterium
AGAPTSA

SEQ ID NO: 420527 - protein, 7 aa, Mycobacterium
AGAPTVK

SEQ ID NO: 420528 - protein, 5 aa, Mycobacterium
AGAPV

SEQ ID NO: 420529 - protein, 11 aa, Mycobacterium
AGAPVAPGAEG

SEQ ID NO: 420530 - protein, 17 aa, Mycobacterium
AGAPVPGAITGRTRAAG

SEQ ID NO: 420531 - protein, 16 aa, Mycobacterium
AGAPVQVRNPDGAGVR

SEQ ID NO: 420532 - protein, 15 aa, Mycobacterium
AGAPVSVSSPQGRFA

SEQ ID NO: 420533 - protein, 13 aa, Mycobacterium
AGAPVTPSAGDHT

SEQ ID NO: 420534 - protein, 13 aa, Mycobacterium
AGAQAAQAGGQAR

SEQ ID NO: 420535 - protein, 18 aa, Mycobacterium
AGAQAEQAASQARAAAAA

SEQ ID NO: 420536 - protein, 23 aa, Mycobacterium
AGAQDSEASADDSPAPQEQPEED

SEQ ID NO: 420537 - protein, 15 aa, Mycobacterium
AGAQEALAIANSVPR

SEQ ID NO: 420538 - protein, 15 aa, Mycobacterium
AGAQEALSIADALPR

SEQ ID NO: 420539 - protein, 15 aa, Mycobacterium
AGAQEALTIADSLSS

SEQ ID NO: 420540 - protein, 10 aa, Mycobacterium
AGAQLPPRDL

SEQ ID NO: 420541 - protein, 21 aa, Mycobacterium
AGAQLTDAQGNPHTHKSASTV

SEQ ID NO: 420542 - protein, 9 aa, Mycobacterium
AGAQNARIE

SEQ ID NO: 420543 - protein, 7 aa, Mycobacterium
AGAQPMV

SEQ ID NO: 420544 - protein, 6 aa, Mycobacterium
AGAQPY

SEQ ID NO: 420545 - protein, 14 aa, Mycobacterium
AGAQRAAAAAGAPV

SEQ ID NO: 420546 - protein, 6 aa, Mycobacterium
AGAQRT

SEQ ID NO: 420547 - protein, 8 aa, Mycobacterium
AGAQSADM

SEQ ID NO: 420548 - protein, 10 aa, Mycobacterium
AGAQSAGAAR

SEQ ID NO: 420549 - protein, 10 aa, Mycobacterium
AGAQSGSTQL

SEQ ID NO: 420550 - protein, 17 aa, Mycobacterium
AGAQSYEAAEAANVIAA

SEQ ID NO: 420551 - protein, 6 aa, Mycobacterium
AGAQTG

SEQ ID NO: 420552 - protein, 8 aa, Mycobacterium
AGAQTGVD

SEQ ID NO: 420553 - protein, 6 aa, Mycobacterium
AGAQTR

SEQ ID NO: 420554 - protein, 6 aa, Mycobacterium
AGAQVG

SEQ ID NO: 420555 - protein, 15 aa, Mycobacterium
AGAQVHGTASPGKHQ

SEQ ID NO: 420556 - protein, 10 aa, Mycobacterium
AGARAAGLTP

SEQ ID NO: 420557 - protein, 19 aa, Mycobacterium
AGARAGLGPDHRVVPAGGM

SEQ ID NO: 420558 - protein, 7 aa, Mycobacterium
AGARDEI

SEQ ID NO: 420559 - protein, 5 aa, Mycobacterium
AGARE

SEQ ID NO: 420560 - protein, 17 aa, Mycobacterium
AGAREAAKAAERGGQSA

SEQ ID NO: 420561 - protein, 6 aa, Mycobacterium
AGARFD

SEQ ID NO: 420562 - protein, 6 aa, Mycobacterium
AGARFS

SEQ ID NO: 420563 - protein, 5 aa, Mycobacterium
AGARG

SEQ ID NO: 420564 - protein, 6 aa, Mycobacterium
AGARGD

SEQ ID NO: 420565 - protein, 9 aa, Mycobacterium
AGARGPGPT

SEQ ID NO: 420566 - protein, 8 aa, Mycobacterium
AGARGQRA

SEQ ID NO: 420567 - protein, 6 aa, Mycobacterium
AGARGR

SEQ ID NO: 420568 - protein, 9 aa, Mycobacterium
AGARGREAV

SEQ ID NO: 420569 - protein, 9 aa, Mycobacterium
AGARGSGAN

SEQ ID NO: 420570 - protein, 12 aa, Mycobacterium
AGARGVADGVGG

SEQ ID NO: 420571 - protein, 8 aa, Mycobacterium
AGARKALD

SEQ ID NO: 420572 - protein, 8 aa, Mycobacterium
AGARKVEK

SEQ ID NO: 420573 - protein, 9 aa, Mycobacterium
AGARNPETV

SEQ ID NO: 420574 - protein, 8 aa, Mycobacterium
AGARPAAQ

SEQ ID NO: 420575 - protein, 9 aa, Mycobacterium
AGARPARVG

SEQ ID NO: 420576 - protein, 8 aa, Mycobacterium
AGARPGDQ

SEQ ID NO: 420577 - protein, 10 aa, Mycobacterium
AGARPPASAR

SEQ ID NO: 420578 - protein, 5 aa, Mycobacterium
AGARQ

SEQ ID NO: 420579 - protein, 6 aa, Mycobacterium
AGARQI

SEQ ID NO: 420580 - protein, 8 aa, Mycobacterium
AGARRGHY

SEQ ID NO: 420581 - protein, 6 aa, Mycobacterium
AGARRH

SEQ ID NO: 420582 - protein, 7 aa, Mycobacterium
AGARRIT

SEQ ID NO: 420583 - protein, 6 aa, Mycobacterium
AGARRK

SEQ ID NO: 420584 - protein, 6 aa, Mycobacterium
AGARRR

SEQ ID NO: 420585 - protein, 7 aa, Mycobacterium
AGARRTL

SEQ ID NO: 420586 - protein, 6 aa, Mycobacterium
AGARRV

SEQ ID NO: 420587 - protein, 7 aa, Mycobacterium
AGARSAD

SEQ ID NO: 420588 - protein, 8 aa, Mycobacterium
AGARSALT

SEQ ID NO: 420589 - protein, 6 aa, Mycobacterium
AGARSL

SEQ ID NO: 420590 - protein, 8 aa, Mycobacterium
AGARSSEM

SEQ ID NO: 420591 - protein, 12 aa, Mycobacterium
AGARTPTRLQPK

SEQ ID NO: 420592 - protein, 25 aa, Mycobacterium
AGARTPTRLQPRQAARVQTGAPLPT

SEQ ID NO: 420593 - protein, 13 aa, Mycobacterium
AGARTSGISEDEI

SEQ ID NO: 420594 - protein, 10 aa, Mycobacterium
AGASAAAAQL

SEQ ID NO: 420595 - protein, 13 aa, Mycobacterium
AGASAAIEAADRG

SEQ ID NO: 420596 - protein, 12 aa, Mycobacterium
AGASADTTNEAL

SEQ ID NO: 420597 - protein, 8 aa, Mycobacterium
AGASADTV

SEQ ID NO: 420598 - protein, 6 aa, Mycobacterium
AGASAL

SEQ ID NO: 420599 - protein, 8 aa, Mycobacterium
AGASAPPR

SEQ ID NO: 420600 - protein, 9 aa, Mycobacterium
AGASAPRYD

SEQ ID NO: 420601 - protein, 14 aa, Mycobacterium
AGASARHAEPLPAY

SEQ ID NO: 420602 - protein, 22 aa, Mycobacterium
AGASASNIAQDGKGYSSGTRLG

SEQ ID NO: 420603 - protein, 6 aa, Mycobacterium
AGASAV

SEQ ID NO: 420604 - protein, 18 aa, Mycobacterium
AGASAYAGAESASAASIA

SEQ ID NO: 420605 - protein, 20 aa, Mycobacterium
AGASAYTGAEATNASPLQTV

SEQ ID NO: 420606 - protein, 17 aa, Mycobacterium
AGASAYTQAEAASASPL

SEQ ID NO: 420607 - protein, 5 aa, Mycobacterium
AGASD

SEQ ID NO: 420608 - protein, 7 aa, Mycobacterium
AGASDDD

SEQ ID NO: 420609 - protein, 8 aa, Mycobacterium
AGASDDGI

SEQ ID NO: 420610 - protein, 11 aa, Mycobacterium
AGASDGGGSIR

SEQ ID NO: 420611 - protein, 9 aa, Mycobacterium
AGASDGSKK

SEQ ID NO: 420612 - protein, 9 aa, Mycobacterium
AGASDQPQV

SEQ ID NO: 420613 - protein, 8 aa, Mycobacterium
AGASDSDL

SEQ ID NO: 420614 - protein, 19 aa, Mycobacterium
AGASERTPVSAGARDSRTL

SEQ ID NO: 420615 - protein, 5 aa, Mycobacterium
AGASG

SEQ ID NO: 420616 - protein, 11 aa, Mycobacterium
AGASGAEQDAL

SEQ ID NO: 420617 - protein, 60 aa, Mycobacterium
AGASGGSFGAIGGTGGDSGLFGNGGPGGNGGLGGAGQAATGDFTTAGQGGGGGFGGNGAT

SEQ ID NO: 420618 - protein, 16 aa, Mycobacterium
AGASGPEWTLYAWEPD

SEQ ID NO: 420619 - protein, 6 aa, Mycobacterium
AGASGY

SEQ ID NO: 420620 - protein, 8 aa, Mycobacterium
AGASKNDA

SEQ ID NO: 420621 - protein, 5 aa, Mycobacterium
AGASL

SEQ ID NO: 420622 - protein, 8 aa, Mycobacterium
AGASNSWQ

SEQ ID NO: 420623 - protein, 5 aa, Mycobacterium
AGASP

SEQ ID NO: 420624 - protein, 9 aa, Mycobacterium
AGASPGQAV

SEQ ID NO: 420625 - protein, 6 aa, Mycobacterium
AGASPL

SEQ ID NO: 420626 - protein, 15 aa, Mycobacterium
AGASPMRQSKTDEGF

SEQ ID NO: 420627 - protein, 6 aa, Mycobacterium
AGASPP

SEQ ID NO: 420628 - protein, 11 aa, Mycobacterium
AGASQNGGPRV

SEQ ID NO: 420629 - protein, 5 aa, Mycobacterium
AGASR

SEQ ID NO: 420630 - protein, 8 aa, Mycobacterium
AGASRISA

SEQ ID NO: 420631 - protein, 23 aa, Mycobacterium
AGASRPRLAAPKPPVPGRKPKPT

SEQ ID NO: 420632 - protein, 11 aa, Mycobacterium
AGASRRDPALG

SEQ ID NO: 420633 - protein, 9 aa, Mycobacterium
AGASSFGGF

SEQ ID NO: 420634 - protein, 6 aa, Mycobacterium
AGASSM

SEQ ID NO: 420635 - protein, 9 aa, Mycobacterium
AGASSQSLA

SEQ ID NO: 420636 - protein, 8 aa, Mycobacterium
AGASSRAL

SEQ ID NO: 420637 - protein, 11 aa, Mycobacterium
AGASSSGSAVA

SEQ ID NO: 420638 - protein, 16 aa, Mycobacterium
AGASSVHGSGLNPGNL

SEQ ID NO: 420639 - protein, 6 aa, Mycobacterium
AGASTV

SEQ ID NO: 420640 - protein, 5 aa, Mycobacterium
AGASV

SEQ ID NO: 420641 - protein, 6 aa, Mycobacterium
AGASVE

SEQ ID NO: 420642 - protein, 13 aa, Mycobacterium
AGASVQMSGSRAA

SEQ ID NO: 420643 - protein, 11 aa, Mycobacterium
AGASVTLDGDQ

SEQ ID NO: 420644 - protein, 10 aa, Mycobacterium
AGASYTDATG

SEQ ID NO: 420645 - protein, 24 aa, Mycobacterium
AGATAAGAYSFGNGTEAQAADDTV

SEQ ID NO: 420646 - protein, 10 aa, Mycobacterium
AGATAATSIT

SEQ ID NO: 420647 - protein, 6 aa, Mycobacterium
AGATAD

SEQ ID NO: 420648 - protein, 8 aa, Mycobacterium
AGATADQA

SEQ ID NO: 420649 - protein, 11 aa, Mycobacterium
AGATAGDGGRR

SEQ ID NO: 420650 - protein, 6 aa, Mycobacterium
AGATAQ

SEQ ID NO: 420651 - protein, 8 aa, Mycobacterium
AGATATRV

SEQ ID NO: 420652 - protein, 20 aa, Mycobacterium
AGATCGDLGRAATAAAGGHK

SEQ ID NO: 420653 - protein, 8 aa, Mycobacterium
AGATDARA

SEQ ID NO: 420654 - protein, 9 aa, Mycobacterium
AGATDARAR

SEQ ID NO: 420655 - protein, 7 aa, Mycobacterium
AGATEVF

SEQ ID NO: 420656 - protein, 5 aa, Mycobacterium
AGATF

SEQ ID NO: 420657 - protein, 12 aa, Mycobacterium
AGATGADKSFYE

SEQ ID NO: 420658 - protein, 10 aa, Mycobacterium
AGATGDERSF

SEQ ID NO: 420659 - protein, 10 aa, Mycobacterium
AGATGEERAY

SEQ ID NO: 420660 - protein, 9 aa, Mycobacterium
AGATGFTSV

SEQ ID NO: 420661 - protein, 9 aa, Mycobacterium
AGATGLKSQ

SEQ ID NO: 420662 - protein, 8 aa, Mycobacterium
AGATGSFN

SEQ ID NO: 420663 - protein, 9 aa, Mycobacterium
AGATGSRLV

SEQ ID NO: 420664 - protein, 14 aa, Mycobacterium
AGATKVAASPSVAA

SEQ ID NO: 420665 - protein, 8 aa, Mycobacterium
AGATNETL

SEQ ID NO: 420666 - protein, 7 aa, Mycobacterium
AGATPGL

SEQ ID NO: 420667 - protein, 7 aa, Mycobacterium
AGATPRV

SEQ ID NO: 420668 - protein, 7 aa, Mycobacterium
AGATPSM

SEQ ID NO: 420669 - protein, 8 aa, Mycobacterium
AGATPSRV

SEQ ID NO: 420670 - protein, 13 aa, Mycobacterium
AGATPTDDEAARI

SEQ ID NO: 420671 - protein, 23 aa, Mycobacterium
AGATPTSAGDGAVRSKSTPTDPV

SEQ ID NO: 420672 - protein, 8 aa, Mycobacterium
AGATRPGP

SEQ ID NO: 420673 - protein, 23 aa, Mycobacterium
AGATSYAGAESAAAAALANPAQV

SEQ ID NO: 420674 - protein, 8 aa, Mycobacterium
AGATTAGG

SEQ ID NO: 420675 - protein, 6 aa, Mycobacterium
AGATTL

SEQ ID NO: 420676 - protein, 9 aa, Mycobacterium
AGATTPDAF

SEQ ID NO: 420677 - protein, 11 aa, Mycobacterium
AGATTTSHPEG

SEQ ID NO: 420678 - protein, 6 aa, Mycobacterium
AGATVE

SEQ ID NO: 420679 - protein, 11 aa, Mycobacterium
AGATVTQNDNG

SEQ ID NO: 420680 - protein, 10 aa, Mycobacterium
AGATVTQTDD

SEQ ID NO: 420681 - protein, 11 aa, Mycobacterium
AGATVTQTDNS

SEQ ID NO: 420682 - protein, 11 aa, Mycobacterium
AGATVTQTESS

SEQ ID NO: 420683 - protein, 9 aa, Mycobacterium
AGATWGNNP

SEQ ID NO: 420684 - protein, 6 aa, Mycobacterium
AGATYA

SEQ ID NO: 420685 - protein, 7 aa, Mycobacterium
AGAVDPR

SEQ ID NO: 420686 - protein, 9 aa, Mycobacterium
AGAVEGATN

SEQ ID NO: 420687 - protein, 15 aa, Mycobacterium
AGAVGAADADADVRD

SEQ ID NO: 420688 - protein, 8 aa, Mycobacterium
AGAVGGDE

SEQ ID NO: 420689 - protein, 27 aa, Mycobacterium
AGAVGPPAGNSGNVGVNGVGGLLFGSS

SEQ ID NO: 420690 - protein, 7 aa, Mycobacterium
AGAVGTE

SEQ ID NO: 420691 - protein, 5 aa, Mycobacterium
AGAVP

SEQ ID NO: 420692 - protein, 7 aa, Mycobacterium
AGAVPGP

SEQ ID NO: 420693 - protein, 6 aa, Mycobacterium
AGAVPR

SEQ ID NO: 420694 - protein, 10 aa, Mycobacterium
AGAVPRKEHD

SEQ ID NO: 420695 - protein, 7 aa, Mycobacterium
AGAVQPN

SEQ ID NO: 420696 - protein, 6 aa, Mycobacterium
AGAVST

SEQ ID NO: 420697 - protein, 5 aa, Mycobacterium
AGAVT

SEQ ID NO: 420698 - protein, 7 aa, Mycobacterium
AGAVTRN

SEQ ID NO: 420699 - protein, 4 aa, Mycobacterium
AGAW

SEQ ID NO: 420700 - protein, 4 aa, Mycobacterium
AGAY

SEQ ID NO: 420701 - protein, 8 aa, Mycobacterium
AGAYGASK

SEQ ID NO: 420702 - protein, 9 aa, Mycobacterium
AGAYGNHSP

SEQ ID NO: 420703 - protein, 14 aa, Mycobacterium
AGAYNTAARGLGTD

SEQ ID NO: 420704 - protein, 10 aa, Mycobacterium
AGAYPSTEQA

SEQ ID NO: 420705 - protein, 17 aa, Mycobacterium
AGAYSGAEAANASPLQT

SEQ ID NO: 420706 - protein, 7 aa, Mycobacterium
AGCDDGS

SEQ ID NO: 420707 - protein, 4 aa, Mycobacterium
AGCG

SEQ ID NO: 420708 - protein, 8 aa, Mycobacterium
AGCGDGTY

SEQ ID NO: 420709 - protein, 7 aa, Mycobacterium
AGCGEAE

SEQ ID NO: 420710 - protein, 5 aa, Mycobacterium
AGCGP

SEQ ID NO: 420711 - protein, 5 aa, Mycobacterium
AGCGR

SEQ ID NO: 420712 - protein, 49 aa, Mycobacterium
AGCGTTADTPAIDSATSTTTSTTRSGPTDGPAITASAPAGVRGKGKVVG

SEQ ID NO: 420713 - protein, 10 aa, Mycobacterium
AGCISTAGRA

SEQ ID NO: 420714 - protein, 4 aa, Mycobacterium
AGCP

SEQ ID NO: 420715 - protein, 8 aa, Mycobacterium
AGCPGGGT

SEQ ID NO: 420716 - protein, 10 aa, Mycobacterium
AGCPSDEAEN

SEQ ID NO: 420717 - protein, 7 aa, Mycobacterium
AGCRDGA

SEQ ID NO: 420718 - protein, 4 aa, Mycobacterium
AGCS

SEQ ID NO: 420719 - protein, 7 aa, Mycobacterium
AGCSDPV

SEQ ID NO: 420720 - protein, 5 aa, Mycobacterium
AGCTN

SEQ ID NO: 420721 - protein, 5 aa, Mycobacterium
AGDAA

SEQ ID NO: 420722 - protein, 14 aa, Mycobacterium
AGDAAAGNRTAEQT

SEQ ID NO: 420723 - protein, 9 aa, Mycobacterium
AGDAADAAN

SEQ ID NO: 420724 - protein, 9 aa, Mycobacterium
AGDAAPGRK

SEQ ID NO: 420725 - protein, 7 aa, Mycobacterium
AGDAARF

SEQ ID NO: 420726 - protein, 7 aa, Mycobacterium
AGDACPS

SEQ ID NO: 420727 - protein, 5 aa, Mycobacterium
AGDAD

SEQ ID NO: 420728 - protein, 11 aa, Mycobacterium
AGDADAAGDLT

SEQ ID NO: 420729 - protein, 12 aa, Mycobacterium
AGDADAVAKRRD

SEQ ID NO: 420730 - protein, 11 aa, Mycobacterium
AGDADAVAQRR

SEQ ID NO: 420731 - protein, 9 aa, Mycobacterium
AGDADEATL

SEQ ID NO: 420732 - protein, 12 aa, Mycobacterium
AGDADKGKEAAH

SEQ ID NO: 420733 - protein, 9 aa, Mycobacterium
AGDADRFSS

SEQ ID NO: 420734 - protein, 11 aa, Mycobacterium
AGDADTGNTVA

SEQ ID NO: 420735 - protein, 5 aa, Mycobacterium
AGDAE

SEQ ID NO: 420736 - protein, 11 aa, Mycobacterium
AGDAEAVAERR

SEQ ID NO: 420737 - protein, 6 aa, Mycobacterium
AGDAEQ

SEQ ID NO: 420738 - protein, 23 aa, Mycobacterium
AGDAESAPAAPWQQAGRGRPAKR

SEQ ID NO: 420739 - protein, 62 aa, Mycobacterium
AGDAFGGAAGKGGTGVVGGNGGSGGAAYNYGTGNATGADGAAGTDGTTGAGGSGGSGGAASV

SEQ ID NO: 420740 - protein, 14 aa, Mycobacterium
AGDAGPDEKIAPGA

SEQ ID NO: 420741 - protein, 11 aa, Mycobacterium
AGDAGVPTSVT

SEQ ID NO: 420742 - protein, 9 aa, Mycobacterium
AGDAKSWGE

SEQ ID NO: 420743 - protein, 5 aa, Mycobacterium
AGDAN

SEQ ID NO: 420744 - protein, 12 aa, Mycobacterium
AGDANRTGDGPL

SEQ ID NO: 420745 - protein, 7 aa, Mycobacterium
AGDAPAA

SEQ ID NO: 420746 - protein, 9 aa, Mycobacterium
AGDAPAGRT

SEQ ID NO: 420747 - protein, 10 aa, Mycobacterium
AGDAPEPGPH

SEQ ID NO: 420748 - protein, 8 aa, Mycobacterium
AGDAPFPS

SEQ ID NO: 420749 - protein, 9 aa, Mycobacterium
AGDAPPDRK

SEQ ID NO: 420750 - protein, 8 aa, Mycobacterium
AGDAPPNT

SEQ ID NO: 420751 - protein, 8 aa, Mycobacterium
AGDAPTLL

SEQ ID NO: 420752 - protein, 5 aa, Mycobacterium
AGDAQ

SEQ ID NO: 420753 - protein, 10 aa, Mycobacterium
AGDAQASAAA

SEQ ID NO: 420754 - protein, 7 aa, Mycobacterium
AGDAQVE

SEQ ID NO: 420755 - protein, 7 aa, Mycobacterium
AGDARGV

SEQ ID NO: 420756 - protein, 17 aa, Mycobacterium
AGDASDYSVIDNPKRLV

SEQ ID NO: 420757 - protein, 7 aa, Mycobacterium
AGDASGL

SEQ ID NO: 420758 - protein, 14 aa, Mycobacterium
AGDASPGRASHSAV

SEQ ID NO: 420759 - protein, 8 aa, Mycobacterium
AGDATFDA

SEQ ID NO: 420760 - protein, 17 aa, Mycobacterium
AGDATLHGTGIAPGGIS

SEQ ID NO: 420761 - protein, 7 aa, Mycobacterium
AGDATRL

SEQ ID NO: 420762 - protein, 11 aa, Mycobacterium
AGDATTNVPDG

SEQ ID NO: 420763 - protein, 12 aa, Mycobacterium
AGDATTSVPDGE

SEQ ID NO: 420764 - protein, 12 aa, Mycobacterium
AGDATTSVPDGQ

SEQ ID NO: 420765 - protein, 18 aa, Mycobacterium
AGDCAPDAEAIDKALQNA

SEQ ID NO: 420766 - protein, 17 aa, Mycobacterium
AGDCAPSREAVEDVLDA

SEQ ID NO: 420767 - protein, 17 aa, Mycobacterium
AGDDADAAASQPVSAPR

SEQ ID NO: 420768 - protein, 14 aa, Mycobacterium
AGDDAERSDEKERR

SEQ ID NO: 420769 - protein, 6 aa, Mycobacterium
AGDDDA

SEQ ID NO: 420770 - protein, 6 aa, Mycobacterium
AGDDDG

SEQ ID NO: 420771 - protein, 26 aa, Mycobacterium
AGDDDNAATKIGRPRCDGRNYTRPKS

SEQ ID NO: 420772 - protein, 9 aa, Mycobacterium
AGDDDTARV

SEQ ID NO: 420773 - protein, 5 aa, Mycobacterium
AGDDE

SEQ ID NO: 420774 - protein, 9 aa, Mycobacterium
AGDDEAAVE

SEQ ID NO: 420775 - protein, 7 aa, Mycobacterium
AGDDFGE

SEQ ID NO: 420776 - protein, 10 aa, Mycobacterium
AGDDGTHSAE

SEQ ID NO: 420777 - protein, 6 aa, Mycobacterium
AGDDGV

SEQ ID NO: 420778 - protein, 7 aa, Mycobacterium
AGDDIAT

SEQ ID NO: 420779 - protein, 6 aa, Mycobacterium
AGDDID

SEQ ID NO: 420780 - protein, 9 aa, Mycobacterium
AGDDIPRKK

SEQ ID NO: 420781 - protein, 5 aa, Mycobacterium
AGDDK

SEQ ID NO: 420782 - protein, 8 aa, Mycobacterium
AGDDLAGE

SEQ ID NO: 420783 - protein, 9 aa, Mycobacterium
AGDDLGSGA

SEQ ID NO: 420784 - protein, 8 aa, Mycobacterium
AGDDPANV

SEQ ID NO: 420785 - protein, 28 aa, Mycobacterium
AGDDPDRDKNKKDPDSGSGSGNPGSDPF

SEQ ID NO: 420786 - protein, 26 aa, Mycobacterium
AGDDPDRDKRNKDNSGSGPGSGADPF

SEQ ID NO: 420787 - protein, 14 aa, Mycobacterium
AGDDPERSDGEERR

SEQ ID NO: 420788 - protein, 7 aa, Mycobacterium
AGDDPQR

SEQ ID NO: 420789 - protein, 9 aa, Mycobacterium
AGDDPRGVT

SEQ ID NO: 420790 - protein, 9 aa, Mycobacterium
AGDDPVGAA

SEQ ID NO: 420791 - protein, 8 aa, Mycobacterium
AGDDPVTR

SEQ ID NO: 420792 - protein, 8 aa, Mycobacterium
AGDDRREH

SEQ ID NO: 420793 - protein, 8 aa, Mycobacterium
AGDDRTRT

SEQ ID NO: 420794 - protein, 6 aa, Mycobacterium
AGDDSL

SEQ ID NO: 420795 - protein, 10 aa, Mycobacterium
AGDDSSPGLE

SEQ ID NO: 420796 - protein, 6 aa, Mycobacterium
AGDDTF

SEQ ID NO: 420797 - protein, 9 aa, Mycobacterium
AGDDVDPAR

SEQ ID NO: 420798 - protein, 6 aa, Mycobacterium
AGDDVE

SEQ ID NO: 420799 - protein, 10 aa, Mycobacterium
AGDDVQPGDV

SEQ ID NO: 420800 - protein, 10 aa, Mycobacterium
AGDDVSTNTD

SEQ ID NO: 420801 - protein, 6 aa, Mycobacterium
AGDDYT

SEQ ID NO: 420802 - protein, 5 aa, Mycobacterium
AGDEA

SEQ ID NO: 420803 - protein, 8 aa, Mycobacterium
AGDEEDTA

SEQ ID NO: 420804 - protein, 6 aa, Mycobacterium
AGDEEF

SEQ ID NO: 420805 - protein, 6 aa, Mycobacterium
AGDEES

SEQ ID NO: 420806 - protein, 6 aa, Mycobacterium
AGDEFE

SEQ ID NO: 420807 - protein, 31 aa, Mycobacterium
AGDEGDLDEARLSRGNAREQTPARYYLFQRR

SEQ ID NO: 420808 - protein, 8 aa, Mycobacterium
AGDEGYTV

SEQ ID NO: 420809 - protein, 13 aa, Mycobacterium
AGDEIEVQPPSGN

SEQ ID NO: 420810 - protein, 6 aa, Mycobacterium
AGDEIS

SEQ ID NO: 420811 - protein, 8 aa, Mycobacterium
AGDEITGA

SEQ ID NO: 420812 - protein, 19 aa, Mycobacterium
AGDEPDDSGIVDNDGGNPY

SEQ ID NO: 420813 - protein, 9 aa, Mycobacterium
AGDEPEVNE

SEQ ID NO: 420814 - protein, 8 aa, Mycobacterium
AGDEQERN

SEQ ID NO: 420815 - protein, 5 aa, Mycobacterium
AGDER

SEQ ID NO: 420816 - protein, 10 aa, Mycobacterium
AGDERRRARE

SEQ ID NO: 420817 - protein, 6 aa, Mycobacterium
AGDERS

SEQ ID NO: 420818 - protein, 5 aa, Mycobacterium
AGDES

SEQ ID NO: 420819 - protein, 12 aa, Mycobacterium
AGDESPQRLTGE

SEQ ID NO: 420820 - protein, 14 aa, Mycobacterium
AGDETATELGSATL

SEQ ID NO: 420821 - protein, 10 aa, Mycobacterium
AGDETPYQAA

SEQ ID NO: 420822 - protein, 5 aa, Mycobacterium
AGDEV

SEQ ID NO: 420823 - protein, 7 aa, Mycobacterium
AGDEVKP

SEQ ID NO: 420824 - protein, 7 aa, Mycobacterium
AGDEVSA

SEQ ID NO: 420825 - protein, 8 aa, Mycobacterium
AGDEVSAA

SEQ ID NO: 420826 - protein, 7 aa, Mycobacterium
AGDEVSG

SEQ ID NO: 420827 - protein, 7 aa, Mycobacterium
AGDEVST

SEQ ID NO: 420828 - protein, 9 aa, Mycobacterium
AGDEVTGAT

SEQ ID NO: 420829 - protein, 7 aa, Mycobacterium
AGDFNAR

SEQ ID NO: 420830 - protein, 8 aa, Mycobacterium
AGDFNARS

SEQ ID NO: 420831 - protein, 5 aa, Mycobacterium
AGDFQ

SEQ ID NO: 420832 - protein, 5 aa, Mycobacterium
AGDGA

SEQ ID NO: 420833 - protein, 8 aa, Mycobacterium
AGDGAAAA

SEQ ID NO: 420834 - protein, 7 aa, Mycobacterium
AGDGAAL

SEQ ID NO: 420835 - protein, 7 aa, Mycobacterium
AGDGAAT

SEQ ID NO: 420836 - protein, 7 aa, Mycobacterium
AGDGADH

SEQ ID NO: 420837 - protein, 15 aa, Mycobacterium
AGDGAPADRAPDQTA

SEQ ID NO: 420838 - protein, 17 aa, Mycobacterium
AGDGAPFRPGQRVSGTT

SEQ ID NO: 420839 - protein, 9 aa, Mycobacterium
AGDGATRNE

SEQ ID NO: 420840 - protein, 5 aa, Mycobacterium
AGDGD

SEQ ID NO: 420841 - protein, 11 aa, Mycobacterium
AGDGDHGQGMS

SEQ ID NO: 420842 - protein, 11 aa, Mycobacterium
AGDGDHGRGMV

SEQ ID NO: 420843 - protein, 9 aa, Mycobacterium
AGDGDLHPT

SEQ ID NO: 420844 - protein, 10 aa, Mycobacterium
AGDGDSTVGP

SEQ ID NO: 420845 - protein, 7 aa, Mycobacterium
AGDGDVA

SEQ ID NO: 420846 - protein, 6 aa, Mycobacterium
AGDGEA

SEQ ID NO: 420847 - protein, 11 aa, Mycobacterium
AGDGEATTSSA

SEQ ID NO: 420848 - protein, 10 aa, Mycobacterium
AGDGFSPSAS

SEQ ID NO: 420849 - protein, 17 aa, Mycobacterium
AGDGGAGAGGGDGGRGG

SEQ ID NO: 420850 - protein, 40 aa, Mycobacterium
AGDGGAGGAGGLGGQGGAAAAGANGGVAGNGGNGGHGPFG

SEQ ID NO: 420851 - protein, 25 aa, Mycobacterium
AGDGGAGGAGNINSVAGGQGGNGGD

SEQ ID NO: 420852 - protein, 52 aa, Mycobacterium
AGDGGDGGGGGQAFAGGAGGAGGTGSTQGSAGTTGAWRAGGDGGSGGDGGDG

SEQ ID NO: 420853 - protein, 23 aa, Mycobacterium
AGDGGNGGFGAGGRGGSGGAGGD

SEQ ID NO: 420854 - protein, 16 aa, Mycobacterium
AGDGGSGVFGGGNGGR

SEQ ID NO: 420855 - protein, 9 aa, Mycobacterium
AGDGGTPLR

SEQ ID NO: 420856 - protein, 5 aa, Mycobacterium
AGDGH

SEQ ID NO: 420857 - protein, 5 aa, Mycobacterium
AGDGK

SEQ ID NO: 420858 - protein, 6 aa, Mycobacterium
AGDGKA

SEQ ID NO: 420859 - protein, 5 aa, Mycobacterium
AGDGP

SEQ ID NO: 420860 - protein, 12 aa, Mycobacterium
AGDGPEENRDEV

SEQ ID NO: 420861 - protein, 7 aa, Mycobacterium
AGDGPEP

SEQ ID NO: 420862 - protein, 7 aa, Mycobacterium
AGDGPID

SEQ ID NO: 420863 - protein, 7 aa, Mycobacterium
AGDGPIR

SEQ ID NO: 420864 - protein, 9 aa, Mycobacterium
AGDGPLGEI

SEQ ID NO: 420865 - protein, 6 aa, Mycobacterium
AGDGPP

SEQ ID NO: 420866 - protein, 12 aa, Mycobacterium
AGDGPRTTDDPT

SEQ ID NO: 420867 - protein, 8 aa, Mycobacterium
AGDGPSRA

SEQ ID NO: 420868 - protein, 6 aa, Mycobacterium
AGDGPV

SEQ ID NO: 420869 - protein, 7 aa, Mycobacterium
AGDGPVD

SEQ ID NO: 420870 - protein, 10 aa, Mycobacterium
AGDGPVVPGT

SEQ ID NO: 420871 - protein, 11 aa, Mycobacterium
AGDGPVVSSTA

SEQ ID NO: 420872 - protein, 6 aa, Mycobacterium
AGDGRA

SEQ ID NO: 420873 - protein, 6 aa, Mycobacterium
AGDGRR

SEQ ID NO: 420874 - protein, 13 aa, Mycobacterium
AGDGRSADSIERR

SEQ ID NO: 420875 - protein, 7 aa, Mycobacterium
AGDGRTV

SEQ ID NO: 420876 - protein, 6 aa, Mycobacterium
AGDGSI

SEQ ID NO: 420877 - protein, 6 aa, Mycobacterium
AGDGSV

SEQ ID NO: 420878 - protein, 7 aa, Mycobacterium
AGDGSVD

SEQ ID NO: 420879 - protein, 9 aa, Mycobacterium
AGDGSVDGR

SEQ ID NO: 420880 - protein, 10 aa, Mycobacterium
AGDGTASARS

SEQ ID NO: 420881 - protein, 9 aa, Mycobacterium
AGDGTPGVR

SEQ ID NO: 420882 - protein, 6 aa, Mycobacterium
AGDGTQ

SEQ ID NO: 420883 - protein, 7 aa, Mycobacterium
AGDGTQQ

SEQ ID NO: 420884 - protein, 9 aa, Mycobacterium
AGDGTTGRA

SEQ ID NO: 420885 - protein, 15 aa, Mycobacterium
AGDGTVARVNGSGID

SEQ ID NO: 420886 - protein, 5 aa, Mycobacterium
AGDGV

SEQ ID NO: 420887 - protein, 6 aa, Mycobacterium
AGDGVQ

SEQ ID NO: 420888 - protein, 6 aa, Mycobacterium
AGDGVS

SEQ ID NO: 420889 - protein, 9 aa, Mycobacterium
AGDHADQAW

SEQ ID NO: 420890 - protein, 10 aa, Mycobacterium
AGDHAGRDAE

SEQ ID NO: 420891 - protein, 11 aa, Mycobacterium
AGDHDGADDHV

SEQ ID NO: 420892 - protein, 8 aa, Mycobacterium
AGDHEGAR

SEQ ID NO: 420893 - protein, 9 aa, Mycobacterium
AGDHPGSDA

SEQ ID NO: 420894 - protein, 11 aa, Mycobacterium
AGDHPQSGPKF

SEQ ID NO: 420895 - protein, 7 aa, Mycobacterium
AGDHREE

SEQ ID NO: 420896 - protein, 9 aa, Mycobacterium
AGDHTGERK

SEQ ID NO: 420897 - protein, 13 aa, Mycobacterium
AGDHTLTAADPSS

SEQ ID NO: 420898 - protein, 18 aa, Mycobacterium
AGDIASGEHPAPQPLSGD

SEQ ID NO: 420899 - protein, 8 aa, Mycobacterium
AGDIATDD

SEQ ID NO: 420900 - protein, 9 aa, Mycobacterium
AGDIEPVEE

SEQ ID NO: 420901 - protein, 10 aa, Mycobacterium
AGDINTGGFN

SEQ ID NO: 420902 - protein, 7 aa, Mycobacterium
AGDIPGA

SEQ ID NO: 420903 - protein, 7 aa, Mycobacterium
AGDKASL

SEQ ID NO: 420904 - protein, 9 aa, Mycobacterium
AGDKGEPHL

SEQ ID NO: 420905 - protein, 7 aa, Mycobacterium
AGDKHRV

SEQ ID NO: 420906 - protein, 6 aa, Mycobacterium
AGDKKI

SEQ ID NO: 420907 - protein, 8 aa, Mycobacterium
AGDKPIRV

SEQ ID NO: 420908 - protein, 8 aa, Mycobacterium
AGDKRGPL

SEQ ID NO: 420909 - protein, 5 aa, Mycobacterium
AGDKY

SEQ ID NO: 420910 - protein, 19 aa, Mycobacterium
AGDLAKGHPHAQERDNALS

SEQ ID NO: 420911 - protein, 17 aa, Mycobacterium
AGDLAKRRGWSSRVSEG

SEQ ID NO: 420912 - protein, 8 aa, Mycobacterium
AGDLARSE

SEQ ID NO: 420913 - protein, 6 aa, Mycobacterium
AGDLDR

SEQ ID NO: 420914 - protein, 8 aa, Mycobacterium
AGDLGGKW

SEQ ID NO: 420915 - protein, 8 aa, Mycobacterium
AGDLPDGS

SEQ ID NO: 420916 - protein, 11 aa, Mycobacterium
AGDLPEGIEGG

SEQ ID NO: 420917 - protein, 6 aa, Mycobacterium
AGDLPN

SEQ ID NO: 420918 - protein, 13 aa, Mycobacterium
AGDLQAPGADIDA

SEQ ID NO: 420919 - protein, 5 aa, Mycobacterium
AGDLS

SEQ ID NO: 420920 - protein, 8 aa, Mycobacterium
AGDLSANG

SEQ ID NO: 420921 - protein, 13 aa, Mycobacterium
AGDLSEAGSRSEM

SEQ ID NO: 420922 - protein, 7 aa, Mycobacterium
AGDLTGI

SEQ ID NO: 420923 - protein, 10 aa, Mycobacterium
AGDMPGPEAS

SEQ ID NO: 420924 - protein, 12 aa, Mycobacterium
AGDMSEVGSRAE

SEQ ID NO: 420925 - protein, 6 aa, Mycobacterium
AGDNIV

SEQ ID NO: 420926 - protein, 8 aa, Mycobacterium
AGDNVPQS

SEQ ID NO: 420927 - protein, 9 aa, Mycobacterium
AGDPAARDR

SEQ ID NO: 420928 - protein, 10 aa, Mycobacterium
AGDPADEERY

SEQ ID NO: 420929 - protein, 8 aa, Mycobacterium
AGDPAEAV

SEQ ID NO: 420930 - protein, 7 aa, Mycobacterium
AGDPAGI

SEQ ID NO: 420931 - protein, 6 aa, Mycobacterium
AGDPAL

SEQ ID NO: 420932 - protein, 7 aa, Mycobacterium
AGDPALQ

SEQ ID NO: 420933 - protein, 7 aa, Mycobacterium
AGDPARD

SEQ ID NO: 420934 - protein, 6 aa, Mycobacterium
AGDPAS

SEQ ID NO: 420935 - protein, 7 aa, Mycobacterium
AGDPAST

SEQ ID NO: 420936 - protein, 6 aa, Mycobacterium
AGDPAV

SEQ ID NO: 420937 - protein, 5 aa, Mycobacterium
AGDPC

SEQ ID NO: 420938 - protein, 6 aa, Mycobacterium
AGDPCG

SEQ ID NO: 420939 - protein, 9 aa, Mycobacterium
AGDPDAGRK

SEQ ID NO: 420940 - protein, 7 aa, Mycobacterium
AGDPDAP

SEQ ID NO: 420941 - protein, 13 aa, Mycobacterium
AGDPDAPVRSDPA

SEQ ID NO: 420942 - protein, 8 aa, Mycobacterium
AGDPDGAE

SEQ ID NO: 420943 - protein, 10 aa, Mycobacterium
AGDPDGGAAT

SEQ ID NO: 420944 - protein, 8 aa, Mycobacterium
AGDPDGNE

SEQ ID NO: 420945 - protein, 9 aa, Mycobacterium
AGDPDGPEL

SEQ ID NO: 420946 - protein, 12 aa, Mycobacterium
AGDPDLAARTAG

SEQ ID NO: 420947 - protein, 8 aa, Mycobacterium
AGDPDQSV

SEQ ID NO: 420948 - protein, 14 aa, Mycobacterium
AGDPEPGPSGGTDS

SEQ ID NO: 420949 - protein, 6 aa, Mycobacterium
AGDPEQ

SEQ ID NO: 420950 - protein, 7 aa, Mycobacterium
AGDPEQL

SEQ ID NO: 420951 - protein, 9 aa, Mycobacterium
AGDPETAAA

SEQ ID NO: 420952 - protein, 8 aa, Mycobacterium
AGDPEVVS

SEQ ID NO: 420953 - protein, 5 aa, Mycobacterium
AGDPG

SEQ ID NO: 420954 - protein, 10 aa, Mycobacterium
AGDPGATAQR

SEQ ID NO: 420955 - protein, 6 aa, Mycobacterium
AGDPGL

SEQ ID NO: 420956 - protein, 7 aa, Mycobacterium
AGDPGRI

SEQ ID NO: 420957 - protein, 10 aa, Mycobacterium
AGDPHPAGAE

SEQ ID NO: 420958 - protein, 7 aa, Mycobacterium
AGDPHPQ

SEQ ID NO: 420959 - protein, 18 aa, Mycobacterium
AGDPKAVDTQVGPLASQE

SEQ ID NO: 420960 - protein, 7 aa, Mycobacterium
AGDPKVT

SEQ ID NO: 420961 - protein, 9 aa, Mycobacterium
AGDPKVTVT

SEQ ID NO: 420962 - protein, 7 aa, Mycobacterium
AGDPNAP

SEQ ID NO: 420963 - protein, 6 aa, Mycobacterium
AGDPNQ

SEQ ID NO: 420964 - protein, 8 aa, Mycobacterium
AGDPPEIP

SEQ ID NO: 420965 - protein, 7 aa, Mycobacterium
AGDPPLA

SEQ ID NO: 420966 - protein, 5 aa, Mycobacterium
AGDPQ

SEQ ID NO: 420967 - protein, 10 aa, Mycobacterium
AGDPQDPGTL

SEQ ID NO: 420968 - protein, 6 aa, Mycobacterium
AGDPQL

SEQ ID NO: 420969 - protein, 10 aa, Mycobacterium
AGDPQPSGKT

SEQ ID NO: 420970 - protein, 7 aa, Mycobacterium
AGDPQQL

SEQ ID NO: 420971 - protein, 5 aa, Mycobacterium
AGDPR

SEQ ID NO: 420972 - protein, 8 aa, Mycobacterium
AGDPRAPA

SEQ ID NO: 420973 - protein, 10 aa, Mycobacterium
AGDPRDVELP

SEQ ID NO: 420974 - protein, 14 aa, Mycobacterium
AGDPRTREQRRADA

SEQ ID NO: 420975 - protein, 6 aa, Mycobacterium
AGDPSA

SEQ ID NO: 420976 - protein, 7 aa, Mycobacterium
AGDPSAQ

SEQ ID NO: 420977 - protein, 12 aa, Mycobacterium
AGDPSSQFTGTA

SEQ ID NO: 420978 - protein, 5 aa, Mycobacterium
AGDPT

SEQ ID NO: 420979 - protein, 7 aa, Mycobacterium
AGDPTLT

SEQ ID NO: 420980 - protein, 7 aa, Mycobacterium
AGDPTWP

SEQ ID NO: 420981 - protein, 5 aa, Mycobacterium
AGDPV

SEQ ID NO: 420982 - protein, 6 aa, Mycobacterium
AGDPVA

SEQ ID NO: 420983 - protein, 8 aa, Mycobacterium
AGDPVRRD

SEQ ID NO: 420984 - protein, 9 aa, Mycobacterium
AGDQGAGAY

SEQ ID NO: 420985 - protein, 14 aa, Mycobacterium
AGDQNGPLTNSRTG

SEQ ID NO: 420986 - protein, 5 aa, Mycobacterium
AGDQR

SEQ ID NO: 420987 - protein, 10 aa, Mycobacterium
AGDQSAAPVE

SEQ ID NO: 420988 - protein, 18 aa, Mycobacterium
AGDQTSPGVEISGDPQAL

SEQ ID NO: 420989 - protein, 5 aa, Mycobacterium
AGDQV

SEQ ID NO: 420990 - protein, 6 aa, Mycobacterium
AGDQVS

SEQ ID NO: 420991 - protein, 7 aa, Mycobacterium
AGDQVSA

SEQ ID NO: 420992 - protein, 4 aa, Mycobacterium
AGDR

SEQ ID NO: 420993 - protein, 9 aa, Mycobacterium
AGDRAGADV

SEQ ID NO: 420994 - protein, 9 aa, Mycobacterium
AGDRAPDGC

SEQ ID NO: 420995 - protein, 7 aa, Mycobacterium
AGDRARA

SEQ ID NO: 420996 - protein, 32 aa, Mycobacterium
AGDRARAGRSGVAGADSHGLRSPRRVERGTRP

SEQ ID NO: 420997 - protein, 7 aa, Mycobacterium
AGDRASE

SEQ ID NO: 420998 - protein, 6 aa, Mycobacterium
AGDRDA

SEQ ID NO: 420999 - protein, 8 aa, Mycobacterium
AGDRDAAR

SEQ ID NO: 421000 - protein, 11 aa, Mycobacterium
AGDRDGSTPPH

SEQ ID NO: 421001 - protein, 12 aa, Mycobacterium
AGDRDGVVPPVK

SEQ ID NO: 421002 - protein, 7 aa, Mycobacterium
AGDREGM

SEQ ID NO: 421003 - protein, 6 aa, Mycobacterium
AGDRGA

SEQ ID NO: 421004 - protein, 12 aa, Mycobacterium
AGDRGKGSDAAA

SEQ ID NO: 421005 - protein, 8 aa, Mycobacterium
AGDRGRGV

SEQ ID NO: 421006 - protein, 9 aa, Mycobacterium
AGDRGSRES

SEQ ID NO: 421007 - protein, 6 aa, Mycobacterium
AGDRGT

SEQ ID NO: 421008 - protein, 6 aa, Mycobacterium
AGDRGV

SEQ ID NO: 421009 - protein, 13 aa, Mycobacterium
AGDRHAAAVSRST

SEQ ID NO: 421010 - protein, 7 aa, Mycobacterium
AGDRITE

SEQ ID NO: 421011 - protein, 6 aa, Mycobacterium
AGDRLT

SEQ ID NO: 421012 - protein, 8 aa, Mycobacterium
AGDRPVQV

SEQ ID NO: 421013 - protein, 5 aa, Mycobacterium
AGDRR

SEQ ID NO: 421014 - protein, 11 aa, Mycobacterium
AGDRSATIRTT

SEQ ID NO: 421015 - protein, 10 aa, Mycobacterium
AGDRSSAPIE

SEQ ID NO: 421016 - protein, 14 aa, Mycobacterium
AGDRYNAEHLARLE

SEQ ID NO: 421017 - protein, 4 aa, Mycobacterium
AGDS

SEQ ID NO: 421018 - protein, 5 aa, Mycobacterium
AGDSA

SEQ ID NO: 421019 - protein, 11 aa, Mycobacterium
AGDSAAPSGLP

SEQ ID NO: 421020 - protein, 10 aa, Mycobacterium
AGDSAGGSLA

SEQ ID NO: 421021 - protein, 8 aa, Mycobacterium
AGDSALPT

SEQ ID NO: 421022 - protein, 11 aa, Mycobacterium
AGDSDAGGYNT

SEQ ID NO: 421023 - protein, 9 aa, Mycobacterium
AGDSEAYRD

SEQ ID NO: 421024 - protein, 6 aa, Mycobacterium
AGDSEQ

SEQ ID NO: 421025 - protein, 5 aa, Mycobacterium
AGDSG

SEQ ID NO: 421026 - protein, 9 aa, Mycobacterium
AGDSGGVAA

SEQ ID NO: 421027 - protein, 6 aa, Mycobacterium
AGDSGL

SEQ ID NO: 421028 - protein, 16 aa, Mycobacterium
AGDSGPEWTLYAWEPA

SEQ ID NO: 421029 - protein, 16 aa, Mycobacterium
AGDSGPEWTLYAWEPD

SEQ ID NO: 421030 - protein, 8 aa, Mycobacterium
AGDSGTPI

SEQ ID NO: 421031 - protein, 10 aa, Mycobacterium
AGDSNTGFGN

SEQ ID NO: 421032 - protein, 8 aa, Mycobacterium
AGDSNTGL

SEQ ID NO: 421033 - protein, 8 aa, Mycobacterium
AGDSPLAA

SEQ ID NO: 421034 - protein, 15 aa, Mycobacterium
AGDSPLASDAVTASP

SEQ ID NO: 421035 - protein, 6 aa, Mycobacterium
AGDSQW

SEQ ID NO: 421036 - protein, 5 aa, Mycobacterium
AGDSR

SEQ ID NO: 421037 - protein, 13 aa, Mycobacterium
AGDSRAPGPAPGE

SEQ ID NO: 421038 - protein, 28 aa, Mycobacterium
AGDSRGIVGSSHASSQHSVPDNYRAPTR

SEQ ID NO: 421039 - protein, 6 aa, Mycobacterium
AGDSRP

SEQ ID NO: 421040 - protein, 9 aa, Mycobacterium
AGDSRTRIS

SEQ ID NO: 421041 - protein, 12 aa, Mycobacterium
AGDSSDGRDFGA

SEQ ID NO: 421042 - protein, 9 aa, Mycobacterium
AGDSSGANL

SEQ ID NO: 421043 - protein, 9 aa, Mycobacterium
AGDSSIEQN

SEQ ID NO: 421044 - protein, 7 aa, Mycobacterium
AGDSVEL

SEQ ID NO: 421045 - protein, 13 aa, Mycobacterium
AGDSYAITEASNA

SEQ ID NO: 421046 - protein, 5 aa, Mycobacterium
AGDTA

SEQ ID NO: 421047 - protein, 7 aa, Mycobacterium
AGDTAAS

SEQ ID NO: 421048 - protein, 9 aa, Mycobacterium
AGDTAPGRK

SEQ ID NO: 421049 - protein, 6 aa, Mycobacterium
AGDTAV

SEQ ID NO: 421050 - protein, 8 aa, Mycobacterium
AGDTDAYR

SEQ ID NO: 421051 - protein, 10 aa, Mycobacterium
AGDTDEQARD

SEQ ID NO: 421052 - protein, 6 aa, Mycobacterium
AGDTDF

SEQ ID NO: 421053 - protein, 7 aa, Mycobacterium
AGDTDRR

SEQ ID NO: 421054 - protein, 8 aa, Mycobacterium
AGDTDSGV

SEQ ID NO: 421055 - protein, 5 aa, Mycobacterium
AGDTE

SEQ ID NO: 421056 - protein, 7 aa, Mycobacterium
AGDTESA

SEQ ID NO: 421057 - protein, 8 aa, Mycobacterium
AGDTETAI

SEQ ID NO: 421058 - protein, 24 aa, Mycobacterium
AGDTFERPSAGGGGLGDPLRRAPE

SEQ ID NO: 421059 - protein, 7 aa, Mycobacterium
AGDTGLA

SEQ ID NO: 421060 - protein, 18 aa, Mycobacterium
AGDTGVLPPGPPSPAIPQ

SEQ ID NO: 421061 - protein, 5 aa, Mycobacterium
AGDTL

SEQ ID NO: 421062 - protein, 6 aa, Mycobacterium
AGDTLE

SEQ ID NO: 421063 - protein, 5 aa, Mycobacterium
AGDTM

SEQ ID NO: 421064 - protein, 6 aa, Mycobacterium
AGDTPP

SEQ ID NO: 421065 - protein, 5 aa, Mycobacterium
AGDTR

SEQ ID NO: 421066 - protein, 8 aa, Mycobacterium
AGDTRPSR

SEQ ID NO: 421067 - protein, 11 aa, Mycobacterium
AGDTSGGRTPS

SEQ ID NO: 421068 - protein, 10 aa, Mycobacterium
AGDTSGLATE

SEQ ID NO: 421069 - protein, 5 aa, Mycobacterium
AGDTV

SEQ ID NO: 421070 - protein, 6 aa, Mycobacterium
AGDTVT

SEQ ID NO: 421071 - protein, 9 aa, Mycobacterium
AGDTVTGAT

SEQ ID NO: 421072 - protein, 16 aa, Mycobacterium
AGDTWSAGVSADTGVD

SEQ ID NO: 421073 - protein, 13 aa, Mycobacterium
AGDVAGARAAAEQ

SEQ ID NO: 421074 - protein, 6 aa, Mycobacterium
AGDVDG

SEQ ID NO: 421075 - protein, 14 aa, Mycobacterium
AGDVGGDASPIGGP

SEQ ID NO: 421076 - protein, 7 aa, Mycobacterium
AGDVRPA

SEQ ID NO: 421077 - protein, 6 aa, Mycobacterium
AGDVTP

SEQ ID NO: 421078 - protein, 13 aa, Mycobacterium
AGDWASGEGPPLE

SEQ ID NO: 421079 - protein, 10 aa, Mycobacterium
AGDWEKDATI

SEQ ID NO: 421080 - protein, 10 aa, Mycobacterium
AGDWKGRTPN

SEQ ID NO: 421081 - protein, 5 aa, Mycobacterium
AGDWT

SEQ ID NO: 421082 - protein, 6 aa, Mycobacterium
AGDYLS

SEQ ID NO: 421083 - protein, 7 aa, Mycobacterium
AGDYPAA

SEQ ID NO: 421084 - protein, 8 aa, Mycobacterium
AGEAAARA

SEQ ID NO: 421085 - protein, 28 aa, Mycobacterium
AGEAAGPLADEVRRSAARARNRTSDRAL

SEQ ID NO: 421086 - protein, 7 aa, Mycobacterium
AGEAAGV

SEQ ID NO: 421087 - protein, 8 aa, Mycobacterium
AGEAAGVH

SEQ ID NO: 421088 - protein, 8 aa, Mycobacterium
AGEAARQR

SEQ ID NO: 421089 - protein, 9 aa, Mycobacterium
AGEADLGGT

SEQ ID NO: 421090 - protein, 14 aa, Mycobacterium
AGEADQRATNVEGT

SEQ ID NO: 421091 - protein, 6 aa, Mycobacterium
AGEADR

SEQ ID NO: 421092 - protein, 8 aa, Mycobacterium
AGEADVEL

SEQ ID NO: 421093 - protein, 9 aa, Mycobacterium
AGEAEHQAR

SEQ ID NO: 421094 - protein, 6 aa, Mycobacterium
AGEAER

SEQ ID NO: 421095 - protein, 17 aa, Mycobacterium
AGEAERAPVPADPRGGI

SEQ ID NO: 421096 - protein, 5 aa, Mycobacterium
AGEAG

SEQ ID NO: 421097 - protein, 6 aa, Mycobacterium
AGEAGI

SEQ ID NO: 421098 - protein, 8 aa, Mycobacterium
AGEAGKDA

SEQ ID NO: 421099 - protein, 9 aa, Mycobacterium
AGEAGKEAA

SEQ ID NO: 421100 - protein, 7 aa, Mycobacterium
AGEAGLT

SEQ ID NO: 421101 - protein, 7 aa, Mycobacterium
AGEAKAK

SEQ ID NO: 421102 - protein, 6 aa, Mycobacterium
AGEALG

SEQ ID NO: 421103 - protein, 5 aa, Mycobacterium
AGEAM

SEQ ID NO: 421104 - protein, 14 aa, Mycobacterium
AGEANGPLTNSRTG

SEQ ID NO: 421105 - protein, 14 aa, Mycobacterium
AGEANPAPPVGPAL

SEQ ID NO: 421106 - protein, 8 aa, Mycobacterium
AGEAPISA

SEQ ID NO: 421107 - protein, 7 aa, Mycobacterium
AGEAQRL

SEQ ID NO: 421108 - protein, 5 aa, Mycobacterium
AGEAR

SEQ ID NO: 421109 - protein, 18 aa, Mycobacterium
AGEARSDAEARVEESRAR

SEQ ID NO: 421110 - protein, 6 aa, Mycobacterium
AGEASE

SEQ ID NO: 421111 - protein, 9 aa, Mycobacterium
AGEASPSEL

SEQ ID NO: 421112 - protein, 15 aa, Mycobacterium
AGEATDRIASAVRTA

SEQ ID NO: 421113 - protein, 8 aa, Mycobacterium
AGEATGVN

SEQ ID NO: 421114 - protein, 6 aa, Mycobacterium
AGEAVT

SEQ ID NO: 421115 - protein, 8 aa, Mycobacterium
AGEAYDDQ

SEQ ID NO: 421116 - protein, 6 aa, Mycobacterium
AGECRT

SEQ ID NO: 421117 - protein, 5 aa, Mycobacterium
AGEDA

SEQ ID NO: 421118 - protein, 6 aa, Mycobacterium
AGEDAA

SEQ ID NO: 421119 - protein, 9 aa, Mycobacterium
AGEDDPTDA

SEQ ID NO: 421120 - protein, 6 aa, Mycobacterium
AGEDFG

SEQ ID NO: 421121 - protein, 13 aa, Mycobacterium
AGEDGGPDTKSGP

SEQ ID NO: 421122 - protein, 8 aa, Mycobacterium
AGEDGPNR

SEQ ID NO: 421123 - protein, 7 aa, Mycobacterium
AGEDIDD

SEQ ID NO: 421124 - protein, 10 aa, Mycobacterium
AGEDISDDDM

SEQ ID NO: 421125 - protein, 8 aa, Mycobacterium
AGEDLGAG

SEQ ID NO: 421126 - protein, 12 aa, Mycobacterium
AGEDLGAYPRTL

SEQ ID NO: 421127 - protein, 6 aa, Mycobacterium
AGEDPR

SEQ ID NO: 421128 - protein, 10 aa, Mycobacterium
AGEDPRASGD

SEQ ID NO: 421129 - protein, 14 aa, Mycobacterium
AGEDQQRAANVDGT

SEQ ID NO: 421130 - protein, 7 aa, Mycobacterium
AGEDRQG

SEQ ID NO: 421131 - protein, 6 aa, Mycobacterium
AGEDRR

SEQ ID NO: 421132 - protein, 9 aa, Mycobacterium
AGEDRRPTL

SEQ ID NO: 421133 - protein, 10 aa, Mycobacterium
AGEDVAPGTT

SEQ ID NO: 421134 - protein, 8 aa, Mycobacterium
AGEDVPHG

SEQ ID NO: 421135 - protein, 9 aa, Mycobacterium
AGEDVTAGT

SEQ ID NO: 421136 - protein, 9 aa, Mycobacterium
AGEDVTEGT

SEQ ID NO: 421137 - protein, 8 aa, Mycobacterium
AGEDYPAA

SEQ ID NO: 421138 - protein, 6 aa, Mycobacterium
AGEEAG

SEQ ID NO: 421139 - protein, 10 aa, Mycobacterium
AGEEAVDSAE

SEQ ID NO: 421140 - protein, 6 aa, Mycobacterium
AGEEGL

SEQ ID NO: 421141 - protein, 6 aa, Mycobacterium
AGEEGS

SEQ ID NO: 421142 - protein, 8 aa, Mycobacterium
AGEEKAKA

SEQ ID NO: 421143 - protein, 10 aa, Mycobacterium
AGEELGITNN

SEQ ID NO: 421144 - protein, 8 aa, Mycobacterium
AGEEMTTA

SEQ ID NO: 421145 - protein, 10 aa, Mycobacterium
AGEENSADTY

SEQ ID NO: 421146 - protein, 14 aa, Mycobacterium
AGEEPAADLAASAS

SEQ ID NO: 421147 - protein, 9 aa, Mycobacterium
AGEEPSGVA

SEQ ID NO: 421148 - protein, 7 aa, Mycobacterium
AGEERAK

SEQ ID NO: 421149 - protein, 11 aa, Mycobacterium
AGEERELRQGR

SEQ ID NO: 421150 - protein, 6 aa, Mycobacterium
AGEETA

SEQ ID NO: 421151 - protein, 6 aa, Mycobacterium
AGEETL

SEQ ID NO: 421152 - protein, 8 aa, Mycobacterium
AGEEVDPE

SEQ ID NO: 421153 - protein, 12 aa, Mycobacterium
AGEEVNDVPKET

SEQ ID NO: 421154 - protein, 4 aa, Mycobacterium
AGEF

SEQ ID NO: 421155 - protein, 12 aa, Mycobacterium
AGEFEAKRRRQQ

SEQ ID NO: 421156 - protein, 9 aa, Mycobacterium
AGEFEARRR

SEQ ID NO: 421157 - protein, 7 aa, Mycobacterium
AGEGAGS

SEQ ID NO: 421158 - protein, 30 aa, Mycobacterium
AGEGATATAGTTIPAGTAGLAREASLTGEQ

SEQ ID NO: 421159 - protein, 10 aa, Mycobacterium
AGEGDAPGQF

SEQ ID NO: 421160 - protein, 11 aa, Mycobacterium
AGEGDGKGDGV

SEQ ID NO: 421161 - protein, 27 aa, Mycobacterium
AGEGDHEHAEPAPGVHQARRGDSHQAA

SEQ ID NO: 421162 - protein, 17 aa, Mycobacterium
AGEGDKLVSEGATSLGG

SEQ ID NO: 421163 - protein, 10 aa, Mycobacterium
AGEGDPEQVM

SEQ ID NO: 421164 - protein, 6 aa, Mycobacterium
AGEGEG

SEQ ID NO: 421165 - protein, 9 aa, Mycobacterium
AGEGEPDQV

SEQ ID NO: 421166 - protein, 9 aa, Mycobacterium
AGEGEPEEV

SEQ ID NO: 421167 - protein, 10 aa, Mycobacterium
AGEGEPEQVM

SEQ ID NO: 421168 - protein, 9 aa, Mycobacterium
AGEGEPGQV

SEQ ID NO: 421169 - protein, 10 aa, Mycobacterium
AGEGESPSAR

SEQ ID NO: 421170 - protein, 20 aa, Mycobacterium
AGEGFGDPAPAGLSPSAGRE

SEQ ID NO: 421171 - protein, 21 aa, Mycobacterium
AGEGFQANEAGSARAERAVRD

SEQ ID NO: 421172 - protein, 5 aa, Mycobacterium
AGEGG

SEQ ID NO: 421173 - protein, 6 aa, Mycobacterium
AGEGGA

SEQ ID NO: 421174 - protein, 9 aa, Mycobacterium
AGEGKIDDL

SEQ ID NO: 421175 - protein, 7 aa, Mycobacterium
AGEGKLT

SEQ ID NO: 421176 - protein, 10 aa, Mycobacterium
AGEGLDTPGN

SEQ ID NO: 421177 - protein, 7 aa, Mycobacterium
AGEGLRD

SEQ ID NO: 421178 - protein, 10 aa, Mycobacterium
AGEGPDIPLG

SEQ ID NO: 421179 - protein, 6 aa, Mycobacterium
AGEGPV

SEQ ID NO: 421180 - protein, 13 aa, Mycobacterium
AGEGQGQAWLLAR

SEQ ID NO: 421181 - protein, 5 aa, Mycobacterium
AGEGR

SEQ ID NO: 421182 - protein, 6 aa, Mycobacterium
AGEGRL

SEQ ID NO: 421183 - protein, 11 aa, Mycobacterium
AGEGRTADLSR

SEQ ID NO: 421184 - protein, 27 aa, Mycobacterium
AGEGRTTTSDGCGGPGSTVTRPFRLTK

SEQ ID NO: 421185 - protein, 9 aa, Mycobacterium
AGEGSDEHY

SEQ ID NO: 421186 - protein, 5 aa, Mycobacterium
AGEGT

SEQ ID NO: 421187 - protein, 7 aa, Mycobacterium
AGEGTQR

SEQ ID NO: 421188 - protein, 14 aa, Mycobacterium
AGEGVRWSPGVTVP

SEQ ID NO: 421189 - protein, 15 aa, Mycobacterium
AGEHAARRAGEHAAR

SEQ ID NO: 421190 - protein, 10 aa, Mycobacterium
AGEHAGQDAQ

SEQ ID NO: 421191 - protein, 10 aa, Mycobacterium
AGEHAGRDAE

SEQ ID NO: 421192 - protein, 12 aa, Mycobacterium
AGEHEQGHARGD

SEQ ID NO: 421193 - protein, 6 aa, Mycobacterium
AGEHGR

SEQ ID NO: 421194 - protein, 9 aa, Mycobacterium
AGEHGTKSI

SEQ ID NO: 421195 - protein, 5 aa, Mycobacterium
AGEHM

SEQ ID NO: 421196 - protein, 6 aa, Mycobacterium
AGEHMT

SEQ ID NO: 421197 - protein, 12 aa, Mycobacterium
AGEHQVQGARKA

SEQ ID NO: 421198 - protein, 7 aa, Mycobacterium
AGEHSTS

SEQ ID NO: 421199 - protein, 4 aa, Mycobacterium
AGEI

SEQ ID NO: 421200 - protein, 6 aa, Mycobacterium
AGEIGG

SEQ ID NO: 421201 - protein, 6 aa, Mycobacterium
AGEIPR

SEQ ID NO: 421202 - protein, 12 aa, Mycobacterium
AGEKADGDAPPE

SEQ ID NO: 421203 - protein, 6 aa, Mycobacterium
AGEKAG

SEQ ID NO: 421204 - protein, 20 aa, Mycobacterium
AGEKFKDDKYKDGHGEGFGG

SEQ ID NO: 421205 - protein, 8 aa, Mycobacterium
AGEKPDLG

SEQ ID NO: 421206 - protein, 8 aa, Mycobacterium
AGEKPELG

SEQ ID NO: 421207 - protein, 5 aa, Mycobacterium
AGEKQ

SEQ ID NO: 421208 - protein, 6 aa, Mycobacterium
AGEKTI

SEQ ID NO: 421209 - protein, 6 aa, Mycobacterium
AGEKTV

SEQ ID NO: 421210 - protein, 5 aa, Mycobacterium
AGELA

SEQ ID NO: 421211 - protein, 8 aa, Mycobacterium
AGELASDA

SEQ ID NO: 421212 - protein, 8 aa, Mycobacterium
AGELDVDP

SEQ ID NO: 421213 - protein, 9 aa, Mycobacterium
AGELEDRTD

SEQ ID NO: 421214 - protein, 16 aa, Mycobacterium
AGELPDELKRGDSPVQ

SEQ ID NO: 421215 - protein, 6 aa, Mycobacterium
AGELQS

SEQ ID NO: 421216 - protein, 6 aa, Mycobacterium
AGELTA

SEQ ID NO: 421217 - protein, 10 aa, Mycobacterium
AGELTEAGRA

SEQ ID NO: 421218 - protein, 8 aa, Mycobacterium
AGELTPHR

SEQ ID NO: 421219 - protein, 5 aa, Mycobacterium
AGEMD

SEQ ID NO: 421220 - protein, 5 aa, Mycobacterium
AGEND

SEQ ID NO: 421221 - protein, 7 aa, Mycobacterium
AGENESR

SEQ ID NO: 421222 - protein, 10 aa, Mycobacterium
AGENGAGKST

SEQ ID NO: 421223 - protein, 18 aa, Mycobacterium
AGENGAPVRRSAGSEAGR

SEQ ID NO: 421224 - protein, 13 aa, Mycobacterium
AGENGGGDDEYDE

SEQ ID NO: 421225 - protein, 9 aa, Mycobacterium
AGENNPWQE

SEQ ID NO: 421226 - protein, 8 aa, Mycobacterium
AGENPDRV

SEQ ID NO: 421227 - protein, 10 aa, Mycobacterium
AGENPGADEI

SEQ ID NO: 421228 - protein, 6 aa, Mycobacterium
AGENPL

SEQ ID NO: 421229 - protein, 6 aa, Mycobacterium
AGENPV

SEQ ID NO: 421230 - protein, 6 aa, Mycobacterium
AGENPW

SEQ ID NO: 421231 - protein, 7 aa, Mycobacterium
AGENQDF

SEQ ID NO: 421232 - protein, 7 aa, Mycobacterium
AGENTYT

SEQ ID NO: 421233 - protein, 5 aa, Mycobacterium
AGEPA

SEQ ID NO: 421234 - protein, 6 aa, Mycobacterium
AGEPAA

SEQ ID NO: 421235 - protein, 7 aa, Mycobacterium
AGEPADD

SEQ ID NO: 421236 - protein, 9 aa, Mycobacterium
AGEPAESSW

SEQ ID NO: 421237 - protein, 9 aa, Mycobacterium
AGEPAKVSE

SEQ ID NO: 421238 - protein, 19 aa, Mycobacterium
AGEPARADARPVPADPQWA

SEQ ID NO: 421239 - protein, 14 aa, Mycobacterium
AGEPARRDDIESET

SEQ ID NO: 421240 - protein, 7 aa, Mycobacterium
AGEPATG

SEQ ID NO: 421241 - protein, 8 aa, Mycobacterium
AGEPDGKE

SEQ ID NO: 421242 - protein, 10 aa, Mycobacterium
AGEPDKIRTG

SEQ ID NO: 421243 - protein, 6 aa, Mycobacterium
AGEPDR

SEQ ID NO: 421244 - protein, 18 aa, Mycobacterium
AGEPDSPFITGERGGPVP

SEQ ID NO: 421245 - protein, 5 aa, Mycobacterium
AGEPE

SEQ ID NO: 421246 - protein, 8 aa, Mycobacterium
AGEPELSA

SEQ ID NO: 421247 - protein, 6 aa, Mycobacterium
AGEPEY

SEQ ID NO: 421248 - protein, 5 aa, Mycobacterium
AGEPF

SEQ ID NO: 421249 - protein, 15 aa, Mycobacterium
AGEPFQPYARDPETL

SEQ ID NO: 421250 - protein, 15 aa, Mycobacterium
AGEPGPHGGSAVATN

SEQ ID NO: 421251 - protein, 8 aa, Mycobacterium
AGEPGQPA

SEQ ID NO: 421252 - protein, 9 aa, Mycobacterium
AGEPIGPKA

SEQ ID NO: 421253 - protein, 10 aa, Mycobacterium
AGEPKAIKSG

SEQ ID NO: 421254 - protein, 11 aa, Mycobacterium
AGEPKAIKTGS

SEQ ID NO: 421255 - protein, 5 aa, Mycobacterium
AGEPL

SEQ ID NO: 421256 - protein, 6 aa, Mycobacterium
AGEPLA

SEQ ID NO: 421257 - protein, 11 aa, Mycobacterium
AGEPLDDDDRY

SEQ ID NO: 421258 - protein, 15 aa, Mycobacterium
AGEPLDDEADARPRQ

SEQ ID NO: 421259 - protein, 13 aa, Mycobacterium
AGEPLDDEDFRPR

SEQ ID NO: 421260 - protein, 7 aa, Mycobacterium
AGEPLSR

SEQ ID NO: 421261 - protein, 7 aa, Mycobacterium
AGEPLTE

SEQ ID NO: 421262 - protein, 11 aa, Mycobacterium
AGEPMPPGEEG

SEQ ID NO: 421263 - protein, 10 aa, Mycobacterium
AGEPNRDRGD

SEQ ID NO: 421264 - protein, 7 aa, Mycobacterium
AGEPPGW

SEQ ID NO: 421265 - protein, 11 aa, Mycobacterium
AGEPPPDSTLA

SEQ ID NO: 421266 - protein, 10 aa, Mycobacterium
AGEPPQDSSL

SEQ ID NO: 421267 - protein, 11 aa, Mycobacterium
AGEPPQDSSLA

SEQ ID NO: 421268 - protein, 14 aa, Mycobacterium
AGEPPQDSSLAATY

SEQ ID NO: 421269 - protein, 11 aa, Mycobacterium
AGEPPQQTAAR

SEQ ID NO: 421270 - protein, 28 aa, Mycobacterium
AGEPQASGKAYKVSGTLKQGIDSEHAKK

SEQ ID NO: 421271 - protein, 28 aa, Mycobacterium
AGEPQASGKTYKVSGSLKQGISSENAKK

SEQ ID NO: 421272 - protein, 8 aa, Mycobacterium
AGEPQYKT

SEQ ID NO: 421273 - protein, 16 aa, Mycobacterium
AGEPRLPQIPATTEEV

SEQ ID NO: 421274 - protein, 12 aa, Mycobacterium
AGEPRRKTREES

SEQ ID NO: 421275 - protein, 9 aa, Mycobacterium
AGEPSEKSW

SEQ ID NO: 421276 - protein, 5 aa, Mycobacterium
AGEPT

SEQ ID NO: 421277 - protein, 16 aa, Mycobacterium
AGEPTAVASAPQGLRA

SEQ ID NO: 421278 - protein, 9 aa, Mycobacterium
AGEPTQVGI

SEQ ID NO: 421279 - protein, 8 aa, Mycobacterium
AGEPTRDR

SEQ ID NO: 421280 - protein, 5 aa, Mycobacterium
AGEPV

SEQ ID NO: 421281 - protein, 10 aa, Mycobacterium
AGEPVGVEGD

SEQ ID NO: 421282 - protein, 6 aa, Mycobacterium
AGEPVR

SEQ ID NO: 421283 - protein, 6 aa, Mycobacterium
AGEPVT

SEQ ID NO: 421284 - protein, 6 aa, Mycobacterium
AGEPWS

SEQ ID NO: 421285 - protein, 4 aa, Mycobacterium
AGEQ

SEQ ID NO: 421286 - protein, 8 aa, Mycobacterium
AGEQDAKS

SEQ ID NO: 421287 - protein, 5 aa, Mycobacterium
AGEQG

SEQ ID NO: 421288 - protein, 14 aa, Mycobacterium
AGEQGSPDSWRDPR

SEQ ID NO: 421289 - protein, 5 aa, Mycobacterium
AGEQP

SEQ ID NO: 421290 - protein, 7 aa, Mycobacterium
AGEQSQA

SEQ ID NO: 421291 - protein, 9 aa, Mycobacterium
AGEQSVSTL

SEQ ID NO: 421292 - protein, 8 aa, Mycobacterium
AGEQVGGA

SEQ ID NO: 421293 - protein, 5 aa, Mycobacterium
AGEQW

SEQ ID NO: 421294 - protein, 9 aa, Mycobacterium
AGERAAGGT

SEQ ID NO: 421295 - protein, 9 aa, Mycobacterium
AGERAARAE

SEQ ID NO: 421296 - protein, 6 aa, Mycobacterium
AGERAG

SEQ ID NO: 421297 - protein, 15 aa, Mycobacterium
AGERARRPQGALTQS

SEQ ID NO: 421298 - protein, 9 aa, Mycobacterium
AGERDPGRL

SEQ ID NO: 421299 - protein, 6 aa, Mycobacterium
AGERDS

SEQ ID NO: 421300 - protein, 6 aa, Mycobacterium
AGERER

SEQ ID NO: 421301 - protein, 10 aa, Mycobacterium
AGERERAQAA

SEQ ID NO: 421302 - protein, 5 aa, Mycobacterium
AGERF

SEQ ID NO: 421303 - protein, 8 aa, Mycobacterium
AGERGSAG

SEQ ID NO: 421304 - protein, 8 aa, Mycobacterium
AGERGSEL

SEQ ID NO: 421305 - protein, 7 aa, Mycobacterium
AGERGVR

SEQ ID NO: 421306 - protein, 15 aa, Mycobacterium
AGERNAGALEKSDKL

SEQ ID NO: 421307 - protein, 5 aa, Mycobacterium
AGERP

SEQ ID NO: 421308 - protein, 14 aa, Mycobacterium
AGERPADLGDDERV

SEQ ID NO: 421309 - protein, 10 aa, Mycobacterium
AGERPPPGST

SEQ ID NO: 421310 - protein, 5 aa, Mycobacterium
AGERQ

SEQ ID NO: 421311 - protein, 6 aa, Mycobacterium
AGERRT

SEQ ID NO: 421312 - protein, 7 aa, Mycobacterium
AGERRVP

SEQ ID NO: 421313 - protein, 5 aa, Mycobacterium
AGERV

SEQ ID NO: 421314 - protein, 6 aa, Mycobacterium
AGERVR

SEQ ID NO: 421315 - protein, 5 aa, Mycobacterium
AGERY

SEQ ID NO: 421316 - protein, 4 aa, Mycobacterium
AGES

SEQ ID NO: 421317 - protein, 17 aa, Mycobacterium
AGESAASLKLDGTETYD

SEQ ID NO: 421318 - protein, 8 aa, Mycobacterium
AGESAPRT

SEQ ID NO: 421319 - protein, 14 aa, Mycobacterium
AGESDSTSKLSREH

SEQ ID NO: 421320 - protein, 8 aa, Mycobacterium
AGESEVRD

SEQ ID NO: 421321 - protein, 8 aa, Mycobacterium
AGESFAPS

SEQ ID NO: 421322 - protein, 11 aa, Mycobacterium
AGESGARSVDT

SEQ ID NO: 421323 - protein, 9 aa, Mycobacterium
AGESGATGL

SEQ ID NO: 421324 - protein, 9 aa, Mycobacterium
AGESGGEDH

SEQ ID NO: 421325 - protein, 7 aa, Mycobacterium
AGESGPE

SEQ ID NO: 421326 - protein, 10 aa, Mycobacterium
AGESGSGKST

SEQ ID NO: 421327 - protein, 11 aa, Mycobacterium
AGESGSGKSTL

SEQ ID NO: 421328 - protein, 8 aa, Mycobacterium
AGESGSRT

SEQ ID NO: 421329 - protein, 5 aa, Mycobacterium
AGESI

SEQ ID NO: 421330 - protein, 6 aa, Mycobacterium
AGESLQ

SEQ ID NO: 421331 - protein, 6 aa, Mycobacterium
AGESMA

SEQ ID NO: 421332 - protein, 7 aa, Mycobacterium
AGESPQY

SEQ ID NO: 421333 - protein, 7 aa, Mycobacterium
AGESQIG

SEQ ID NO: 421334 - protein, 12 aa, Mycobacterium
AGESRAESAAAA

SEQ ID NO: 421335 - protein, 11 aa, Mycobacterium
AGESRARAREA

SEQ ID NO: 421336 - protein, 7 aa, Mycobacterium
AGESRPV

SEQ ID NO: 421337 - protein, 6 aa, Mycobacterium
AGESTE

SEQ ID NO: 421338 - protein, 8 aa, Mycobacterium
AGESTESL

SEQ ID NO: 421339 - protein, 9 aa, Mycobacterium
AGESVEPAE

SEQ ID NO: 421340 - protein, 11 aa, Mycobacterium
AGESVPTPSGV

SEQ ID NO: 421341 - protein, 5 aa, Mycobacterium
AGETE

SEQ ID NO: 421342 - protein, 16 aa, Mycobacterium
AGETGGNCELTEPGQT

SEQ ID NO: 421343 - protein, 15 aa, Mycobacterium
AGETGGNCELTEPGR

SEQ ID NO: 421344 - protein, 16 aa, Mycobacterium
AGETGGNCELTEPGRT

SEQ ID NO: 421345 - protein, 9 aa, Mycobacterium
AGETGGTSS

SEQ ID NO: 421346 - protein, 7 aa, Mycobacterium
AGETGLP

SEQ ID NO: 421347 - protein, 8 aa, Mycobacterium
AGETHPSA

SEQ ID NO: 421348 - protein, 7 aa, Mycobacterium
AGETLAD

SEQ ID NO: 421349 - protein, 6 aa, Mycobacterium
AGETLD

SEQ ID NO: 421350 - protein, 5 aa, Mycobacterium
AGETN

SEQ ID NO: 421351 - protein, 27 aa, Mycobacterium
AGETNTGSFNSADHNSGGFNSGRYNTG

SEQ ID NO: 421352 - protein, 6 aa, Mycobacterium
AGETPA

SEQ ID NO: 421353 - protein, 11 aa, Mycobacterium
AGETPDEHRDR

SEQ ID NO: 421354 - protein, 10 aa, Mycobacterium
AGETPDEHRR

SEQ ID NO: 421355 - protein, 8 aa, Mycobacterium
AGETPPHH

SEQ ID NO: 421356 - protein, 13 aa, Mycobacterium
AGETPQQAARRGG

SEQ ID NO: 421357 - protein, 7 aa, Mycobacterium
AGETTLD

SEQ ID NO: 421358 - protein, 5 aa, Mycobacterium
AGETV

SEQ ID NO: 421359 - protein, 6 aa, Mycobacterium
AGETVG

SEQ ID NO: 421360 - protein, 7 aa, Mycobacterium
AGETVGR

SEQ ID NO: 421361 - protein, 4 aa, Mycobacterium
AGEV

SEQ ID NO: 421362 - protein, 5 aa, Mycobacterium
AGEVA

SEQ ID NO: 421363 - protein, 16 aa, Mycobacterium
AGEVDEAKLGKTTSAA

SEQ ID NO: 421364 - protein, 17 aa, Mycobacterium
AGEVEAARREAQSAFGD

SEQ ID NO: 421365 - protein, 19 aa, Mycobacterium
AGEVGAKTEGSAEASTPEV

SEQ ID NO: 421366 - protein, 18 aa, Mycobacterium
AGEVGAKTEGSMDASTPQ

SEQ ID NO: 421367 - protein, 7 aa, Mycobacterium
AGEVGDG

SEQ ID NO: 421368 - protein, 13 aa, Mycobacterium
AGEVLSDDPDLTL

SEQ ID NO: 421369 - protein, 5 aa, Mycobacterium
AGEVR

SEQ ID NO: 421370 - protein, 6 aa, Mycobacterium
AGEVRP

SEQ ID NO: 421371 - protein, 8 aa, Mycobacterium
AGEVSTSE

SEQ ID NO: 421372 - protein, 7 aa, Mycobacterium
AGEVSYT

SEQ ID NO: 421373 - protein, 10 aa, Mycobacterium
AGEVTEPKGQ

SEQ ID NO: 421374 - protein, 13 aa, Mycobacterium
AGEVTRRGRGATT

SEQ ID NO: 421375 - protein, 9 aa, Mycobacterium
AGEVTTAAD

SEQ ID NO: 421376 - protein, 4 aa, Mycobacterium
AGEW

SEQ ID NO: 421377 - protein, 16 aa, Mycobacterium
AGEWPVDDNPLRGAPH

SEQ ID NO: 421378 - protein, 5 aa, Mycobacterium
AGEWS

SEQ ID NO: 421379 - protein, 4 aa, Mycobacterium
AGEY

SEQ ID NO: 421380 - protein, 9 aa, Mycobacterium
AGEYGKTPA

SEQ ID NO: 421381 - protein, 7 aa, Mycobacterium
AGEYNSM

SEQ ID NO: 421382 - protein, 10 aa, Mycobacterium
AGEYPTTEQT

SEQ ID NO: 421383 - protein, 10 aa, Mycobacterium
AGEYRAPAGA

SEQ ID NO: 421384 - protein, 7 aa, Mycobacterium
AGEYRDH

SEQ ID NO: 421385 - protein, 6 aa, Mycobacterium
AGEYTE

SEQ ID NO: 421386 - protein, 8 aa, Mycobacterium
AGEYTEDD

SEQ ID NO: 421387 - protein, 10 aa, Mycobacterium
AGFADPSAQF

SEQ ID NO: 421388 - protein, 12 aa, Mycobacterium
AGFAEGRPLPEG

SEQ ID NO: 421389 - protein, 12 aa, Mycobacterium
AGFASKTPANQA

SEQ ID NO: 421390 - protein, 4 aa, Mycobacterium
AGFD

SEQ ID NO: 421391 - protein, 13 aa, Mycobacterium
AGFDASAPTAWSA

SEQ ID NO: 421392 - protein, 13 aa, Mycobacterium
AGFDASKPAAWSA

SEQ ID NO: 421393 - protein, 11 aa, Mycobacterium
AGFDDGAVRSG

SEQ ID NO: 421394 - protein, 17 aa, Mycobacterium
AGFDGLPGEPPDIPPIG

SEQ ID NO: 421395 - protein, 12 aa, Mycobacterium
AGFDPAQPTAWS

SEQ ID NO: 421396 - protein, 7 aa, Mycobacterium
AGFDPDL

SEQ ID NO: 421397 - protein, 6 aa, Mycobacterium
AGFDTG

SEQ ID NO: 421398 - protein, 10 aa, Mycobacterium
AGFDTTAPTA

SEQ ID NO: 421399 - protein, 15 aa, Mycobacterium
AGFEARRRESAARGR

SEQ ID NO: 421400 - protein, 14 aa, Mycobacterium
AGFEGNNAPPGATV

SEQ ID NO: 421401 - protein, 6 aa, Mycobacterium
AGFEPL

SEQ ID NO: 421402 - protein, 6 aa, Mycobacterium
AGFEQG

SEQ ID NO: 421403 - protein, 9 aa, Mycobacterium
AGFGETGAA

SEQ ID NO: 421404 - protein, 6 aa, Mycobacterium
AGFGGG

SEQ ID NO: 421405 - protein, 10 aa, Mycobacterium
AGFGNGVGPG

SEQ ID NO: 421406 - protein, 14 aa, Mycobacterium
AGFGPSRQIRTDET

SEQ ID NO: 421407 - protein, 8 aa, Mycobacterium
AGFGSDGL

SEQ ID NO: 421408 - protein, 7 aa, Mycobacterium
AGFGTSG

SEQ ID NO: 421409 - protein, 4 aa, Mycobacterium
AGFK

SEQ ID NO: 421410 - protein, 23 aa, Mycobacterium
AGFKQAGDGIATSGGSAPSSMPL

SEQ ID NO: 421411 - protein, 4 aa, Mycobacterium
AGFN

SEQ ID NO: 421412 - protein, 13 aa, Mycobacterium
AGFNPNKANANRV

SEQ ID NO: 421413 - protein, 6 aa, Mycobacterium
AGFPGF

SEQ ID NO: 421414 - protein, 15 aa, Mycobacterium
AGFQPFPGQSGYAAT

SEQ ID NO: 421415 - protein, 16 aa, Mycobacterium
AGFRTPVPAAGHDEPY

SEQ ID NO: 421416 - protein, 4 aa, Mycobacterium
AGFS

SEQ ID NO: 421417 - protein, 51 aa, Mycobacterium
AGFSANGAQQSAVAAQGVEELGRSGVGVGESGVSYATGDAQAAASYLTARG

SEQ ID NO: 421418 - protein, 6 aa, Mycobacterium
AGFSDR

SEQ ID NO: 421419 - protein, 6 aa, Mycobacterium
AGFSGG

SEQ ID NO: 421420 - protein, 8 aa, Mycobacterium
AGFSGQGV

SEQ ID NO: 421421 - protein, 7 aa, Mycobacterium
AGFSPIG

SEQ ID NO: 421422 - protein, 5 aa, Mycobacterium
AGFSR

SEQ ID NO: 421423 - protein, 12 aa, Mycobacterium
AGFTKEEAENSL

SEQ ID NO: 421424 - protein, 14 aa, Mycobacterium
AGFTNSGGKSGDKL

SEQ ID NO: 421425 - protein, 17 aa, Mycobacterium
AGFTPGPECSDAALPEA

SEQ ID NO: 421426 - protein, 16 aa, Mycobacterium
AGFTPGRKIGAGLDET

SEQ ID NO: 421427 - protein, 5 aa, Mycobacterium
AGFTR

SEQ ID NO: 421428 - protein, 9 aa, Mycobacterium
AGGAAGPAS

SEQ ID NO: 421429 - protein, 6 aa, Mycobacterium
AGGAAH

SEQ ID NO: 421430 - protein, 8 aa, Mycobacterium
AGGAAPGL

SEQ ID NO: 421431 - protein, 9 aa, Mycobacterium
AGGAAQGSV

SEQ ID NO: 421432 - protein, 8 aa, Mycobacterium
AGGAAQPA

SEQ ID NO: 421433 - protein, 9 aa, Mycobacterium
AGGAARELR

SEQ ID NO: 421434 - protein, 10 aa, Mycobacterium
AGGAASTTGF

SEQ ID NO: 421435 - protein, 8 aa, Mycobacterium
AGGAATEQ

SEQ ID NO: 421436 - protein, 8 aa, Mycobacterium
AGGAATQA

SEQ ID NO: 421437 - protein, 9 aa, Mycobacterium
AGGADPSTW

SEQ ID NO: 421438 - protein, 6 aa, Mycobacterium
AGGADQ

SEQ ID NO: 421439 - protein, 10 aa, Mycobacterium
AGGADRTTSV

SEQ ID NO: 421440 - protein, 11 aa, Mycobacterium
AGGAGDSLSKA

SEQ ID NO: 421441 - protein, 8 aa, Mycobacterium
AGGAGEGA

SEQ ID NO: 421442 - protein, 42 aa, Mycobacterium
AGGAGGAAGTGGAGISGYPNGFGGSGGTGGNGGNGGGGGTGG

SEQ ID NO: 421443 - protein, 10 aa, Mycobacterium
AGGAGGAGAI

SEQ ID NO: 421444 - protein, 28 aa, Mycobacterium
AGGAGGAGGAGADGAAGTLGSAGVTGQI

SEQ ID NO: 421445 - protein, 70 aa, Mycobacterium
AGGAGGAGGAGATPGGAGGAGGTGGANGLVGGGNGGAGGAGGVGGTGATGTTGGVGGDGGAGGAGGVGGV

SEQ ID NO: 421446 - protein, 12 aa, Mycobacterium
AGGAGGAGGDGG

SEQ ID NO: 421447 - protein, 13 aa, Mycobacterium
AGGAGGAGGDSGL

SEQ ID NO: 421448 - protein, 25 aa, Mycobacterium
AGGAGGAGGFGQVSGGAGGAGGNSG

SEQ ID NO: 421449 - protein, 30 aa, Mycobacterium
AGGAGGAGGGGGVNNPLGSGGGGGAGGNAG

SEQ ID NO: 421450 - protein, 20 aa, Mycobacterium
AGGAGGAGGIGGLAGPTDNG

SEQ ID NO: 421451 - protein, 11 aa, Mycobacterium
AGGAGGAGGMA

SEQ ID NO: 421452 - protein, 26 aa, Mycobacterium
AGGAGGAGGQTDPLGGSTGGSGGVGG

SEQ ID NO: 421453 - protein, 72 aa, Mycobacterium
AGGAGGAGGSATTPGGAGGAGGTGGANGLIGGGNGGVGGAGGAGAAGGAGAVGSTAQAGGAGGDGGAGGANR

SEQ ID NO: 421454 - protein, 29 aa, Mycobacterium
AGGAGGAGGTSLGNSGDAGGTGGAGGAGG

SEQ ID NO: 421455 - protein, 26 aa, Mycobacterium
AGGAGGDGGNGQPATGGDGGAGGAAG

SEQ ID NO: 421456 - protein, 21 aa, Mycobacterium
AGGAGGEGGGGQSGGAGGAGG

SEQ ID NO: 421457 - protein, 8 aa, Mycobacterium
AGGAGGMG

SEQ ID NO: 421458 - protein, 46 aa, Mycobacterium
AGGAGGNGDFNGSGGHGGTGGLVTGSDGADGTESFDGGNGGSGGFA

SEQ ID NO: 421459 - protein, 192 aa, Mycobacterium
AGGAGGQGGQGAQGPDAVNPGPVSPTGQATSGTGGGVGENGGPGDSSTVTGEEGGDGGSGGQGSPGASTASGGTGGDGGLAGDGGPGAPGGTGGGGGNGGAGANNFSGGSATSGGAGGNGNNGGTGGDGAAGGDGGNGGNGGSGGTTTSKVSNAGSGANGGDGGDGGDGGAGAVGGNGGNGGKGGDSGSGGF

SEQ ID NO: 421460 - protein, 99 aa, Mycobacterium
AGGAGGTGDINGGGGGNGGNSLGVGGAGGAGGEGSTEDGGAGGTGGNGVVTGGAGGAGGNGDINGGVGGNGGTGGFAAGTGGAGGNGDNIGGDGGNGGD

SEQ ID NO: 421461 - protein, 15 aa, Mycobacterium
AGGAGGTGGTAGAGI

SEQ ID NO: 421462 - protein, 14 aa, Mycobacterium
AGGAGGTGGTAGDG

SEQ ID NO: 421463 - protein, 31 aa, Mycobacterium
AGGAGGTGGTGGNGNAPAGGDAGHGGQGGYG

SEQ ID NO: 421464 - protein, 21 aa, Mycobacterium
AGGAGGTGGVGASGGTGGAGG

SEQ ID NO: 421465 - protein, 11 aa, Mycobacterium
AGGAGGVGGTG

SEQ ID NO: 421466 - protein, 8 aa, Mycobacterium
AGGAGRTE

SEQ ID NO: 421467 - protein, 8 aa, Mycobacterium
AGGAGRTR

SEQ ID NO: 421468 - protein, 7 aa, Mycobacterium
AGGAGRV

SEQ ID NO: 421469 - protein, 9 aa, Mycobacterium
AGGAGTASW

SEQ ID NO: 421470 - protein, 7 aa, Mycobacterium
AGGAGTR

SEQ ID NO: 421471 - protein, 6 aa, Mycobacterium
AGGAGV

SEQ ID NO: 421472 - protein, 6 aa, Mycobacterium
AGGALG

SEQ ID NO: 421473 - protein, 10 aa, Mycobacterium
AGGALGGAVP

SEQ ID NO: 421474 - protein, 6 aa, Mycobacterium
AGGALS

SEQ ID NO: 421475 - protein, 6 aa, Mycobacterium
AGGANL

SEQ ID NO: 421476 - protein, 5 aa, Mycobacterium
AGGAP

SEQ ID NO: 421477 - protein, 11 aa, Mycobacterium
AGGAPADGEIP

SEQ ID NO: 421478 - protein, 7 aa, Mycobacterium
AGGAPLD

SEQ ID NO: 421479 - protein, 12 aa, Mycobacterium
AGGAQVDESLPE

SEQ ID NO: 421480 - protein, 5 aa, Mycobacterium
AGGAR

SEQ ID NO: 421481 - protein, 6 aa, Mycobacterium
AGGARD

SEQ ID NO: 421482 - protein, 6 aa, Mycobacterium
AGGARG

SEQ ID NO: 421483 - protein, 8 aa, Mycobacterium
AGGARGGL

SEQ ID NO: 421484 - protein, 7 aa, Mycobacterium
AGGARGY

SEQ ID NO: 421485 - protein, 10 aa, Mycobacterium
AGGARPKDLN

SEQ ID NO: 421486 - protein, 8 aa, Mycobacterium
AGGARRSA

SEQ ID NO: 421487 - protein, 7 aa, Mycobacterium
AGGARSL

SEQ ID NO: 421488 - protein, 7 aa, Mycobacterium
AGGASAV

SEQ ID NO: 421489 - protein, 8 aa, Mycobacterium
AGGASDQD

SEQ ID NO: 421490 - protein, 19 aa, Mycobacterium
AGGASGAPLADAAAGARRW

SEQ ID NO: 421491 - protein, 22 aa, Mycobacterium
AGGASSVTVAGPTQAKLDTASA

SEQ ID NO: 421492 - protein, 14 aa, Mycobacterium
AGGASVAARTGVPG

SEQ ID NO: 421493 - protein, 5 aa, Mycobacterium
AGGAT

SEQ ID NO: 421494 - protein, 8 aa, Mycobacterium
AGGATDEF

SEQ ID NO: 421495 - protein, 8 aa, Mycobacterium
AGGATLDA

SEQ ID NO: 421496 - protein, 18 aa, Mycobacterium
AGGATPAAVGAGGDDDSW

SEQ ID NO: 421497 - protein, 16 aa, Mycobacterium
AGGATPAAVGAGGVDD

SEQ ID NO: 421498 - protein, 24 aa, Mycobacterium
AGGATTTCEGQGGHEGEGAGNGTA

SEQ ID NO: 421499 - protein, 7 aa, Mycobacterium
AGGAVGG

SEQ ID NO: 421500 - protein, 6 aa, Mycobacterium
AGGAVT

SEQ ID NO: 421501 - protein, 5 aa, Mycobacterium
AGGAW

SEQ ID NO: 421502 - protein, 16 aa, Mycobacterium
AGGAYAGAEAANVSPL

SEQ ID NO: 421503 - protein, 4 aa, Mycobacterium
AGGC

SEQ ID NO: 421504 - protein, 12 aa, Mycobacterium
AGGCPAGDAPGF

SEQ ID NO: 421505 - protein, 6 aa, Mycobacterium
AGGCPN

SEQ ID NO: 421506 - protein, 9 aa, Mycobacterium
AGGDAALYP

SEQ ID NO: 421507 - protein, 8 aa, Mycobacterium
AGGDAGVR

SEQ ID NO: 421508 - protein, 11 aa, Mycobacterium
AGGDAHAGHTE

SEQ ID NO: 421509 - protein, 11 aa, Mycobacterium
AGGDALRQRTG

SEQ ID NO: 421510 - protein, 8 aa, Mycobacterium
AGGDARTE

SEQ ID NO: 421511 - protein, 12 aa, Mycobacterium
AGGDDESVTAAC

SEQ ID NO: 421512 - protein, 7 aa, Mycobacterium
AGGDEIS

SEQ ID NO: 421513 - protein, 6 aa, Mycobacterium
AGGDEV

SEQ ID NO: 421514 - protein, 8 aa, Mycobacterium
AGGDEVST

SEQ ID NO: 421515 - protein, 5 aa, Mycobacterium
AGGDG

SEQ ID NO: 421516 - protein, 22 aa, Mycobacterium
AGGDGGAGGSGLTQGGDGGIGG

SEQ ID NO: 421517 - protein, 6 aa, Mycobacterium
AGGDGN

SEQ ID NO: 421518 - protein, 10 aa, Mycobacterium
AGGDGTAESI

SEQ ID NO: 421519 - protein, 10 aa, Mycobacterium
AGGDGTAESV

SEQ ID NO: 421520 - protein, 5 aa, Mycobacterium
AGGDI

SEQ ID NO: 421521 - protein, 18 aa, Mycobacterium
AGGDIDAATEAGDAARER

SEQ ID NO: 421522 - protein, 10 aa, Mycobacterium
AGGDPAPVDE

SEQ ID NO: 421523 - protein, 8 aa, Mycobacterium
AGGDPARS

SEQ ID NO: 421524 - protein, 7 aa, Mycobacterium
AGGDPAV

SEQ ID NO: 421525 - protein, 16 aa, Mycobacterium
AGGDPDALPVKPRPYR

SEQ ID NO: 421526 - protein, 7 aa, Mycobacterium
AGGDPEV

SEQ ID NO: 421527 - protein, 9 aa, Mycobacterium
AGGDPGATA

SEQ ID NO: 421528 - protein, 8 aa, Mycobacterium
AGGDPLGA

SEQ ID NO: 421529 - protein, 9 aa, Mycobacterium
AGGDQDHRI

SEQ ID NO: 421530 - protein, 10 aa, Mycobacterium
AGGDRGHHRA

SEQ ID NO: 421531 - protein, 11 aa, Mycobacterium
AGGDRLPERVA

SEQ ID NO: 421532 - protein, 9 aa, Mycobacterium
AGGDSASIS

SEQ ID NO: 421533 - protein, 22 aa, Mycobacterium
AGGDSGPSVINAGDGTHEHPTQ

SEQ ID NO: 421534 - protein, 10 aa, Mycobacterium
AGGDSSRGLV

SEQ ID NO: 421535 - protein, 14 aa, Mycobacterium
AGGDTAIDDLDGSD

SEQ ID NO: 421536 - protein, 9 aa, Mycobacterium
AGGDTASAL

SEQ ID NO: 421537 - protein, 10 aa, Mycobacterium
AGGDTELDNL

SEQ ID NO: 421538 - protein, 7 aa, Mycobacterium
AGGDTTC

SEQ ID NO: 421539 - protein, 8 aa, Mycobacterium
AGGDTTID

SEQ ID NO: 421540 - protein, 8 aa, Mycobacterium
AGGDTTLD

SEQ ID NO: 421541 - protein, 14 aa, Mycobacterium
AGGDTTLDDLDGTD

SEQ ID NO: 421542 - protein, 6 aa, Mycobacterium
AGGDTV

SEQ ID NO: 421543 - protein, 7 aa, Mycobacterium
AGGDYDP

SEQ ID NO: 421544 - protein, 5 aa, Mycobacterium
AGGEA

SEQ ID NO: 421545 - protein, 7 aa, Mycobacterium
AGGEAAE

SEQ ID NO: 421546 - protein, 23 aa, Mycobacterium
AGGEAKLGAPSGQPEKVGDGTVQ

SEQ ID NO: 421547 - protein, 12 aa, Mycobacterium
AGGEALRARTGG

SEQ ID NO: 421548 - protein, 5 aa, Mycobacterium
AGGEC

SEQ ID NO: 421549 - protein, 19 aa, Mycobacterium
AGGEDGEDADEAQPSRATL

SEQ ID NO: 421550 - protein, 7 aa, Mycobacterium
AGGEDVR

SEQ ID NO: 421551 - protein, 9 aa, Mycobacterium
AGGEETGRR

SEQ ID NO: 421552 - protein, 12 aa, Mycobacterium
AGGEGDAATGMN

SEQ ID NO: 421553 - protein, 11 aa, Mycobacterium
AGGEGDAQTGM

SEQ ID NO: 421554 - protein, 10 aa, Mycobacterium
AGGEGDARTA

SEQ ID NO: 421555 - protein, 11 aa, Mycobacterium
AGGEGDGPGVR

SEQ ID NO: 421556 - protein, 8 aa, Mycobacterium
AGGEGPAA

SEQ ID NO: 421557 - protein, 6 aa, Mycobacterium
AGGEGS

SEQ ID NO: 421558 - protein, 5 aa, Mycobacterium
AGGEI

SEQ ID NO: 421559 - protein, 14 aa, Mycobacterium
AGGEITNAVENQRR

SEQ ID NO: 421560 - protein, 5 aa, Mycobacterium
AGGEL

SEQ ID NO: 421561 - protein, 10 aa, Mycobacterium
AGGELGAESS

SEQ ID NO: 421562 - protein, 6 aa, Mycobacterium
AGGELQ

SEQ ID NO: 421563 - protein, 7 aa, Mycobacterium
AGGELSP

SEQ ID NO: 421564 - protein, 6 aa, Mycobacterium
AGGENI

SEQ ID NO: 421565 - protein, 14 aa, Mycobacterium
AGGEPADRPGAADL

SEQ ID NO: 421566 - protein, 7 aa, Mycobacterium
AGGEPED

SEQ ID NO: 421567 - protein, 8 aa, Mycobacterium
AGGEPIDP

SEQ ID NO: 421568 - protein, 15 aa, Mycobacterium
AGGEPMYQRPPDRRF

SEQ ID NO: 421569 - protein, 6 aa, Mycobacterium
AGGEPR

SEQ ID NO: 421570 - protein, 5 aa, Mycobacterium
AGGEQ

SEQ ID NO: 421571 - protein, 15 aa, Mycobacterium
AGGEQQPLRQRGPTG

SEQ ID NO: 421572 - protein, 9 aa, Mycobacterium
AGGEQSAEE

SEQ ID NO: 421573 - protein, 7 aa, Mycobacterium
AGGEQTV

SEQ ID NO: 421574 - protein, 9 aa, Mycobacterium
AGGESDEDL

SEQ ID NO: 421575 - protein, 9 aa, Mycobacterium
AGGESTAGL

SEQ ID NO: 421576 - protein, 9 aa, Mycobacterium
AGGESTTSL

SEQ ID NO: 421577 - protein, 10 aa, Mycobacterium
AGGEYDDSEG

SEQ ID NO: 421578 - protein, 10 aa, Mycobacterium
AGGEYDDSQG

SEQ ID NO: 421579 - protein, 6 aa, Mycobacterium
AGGEYL

SEQ ID NO: 421580 - protein, 5 aa, Mycobacterium
AGGFE

SEQ ID NO: 421581 - protein, 10 aa, Mycobacterium
AGGFGSGADY

SEQ ID NO: 421582 - protein, 6 aa, Mycobacterium
AGGFTN

SEQ ID NO: 421583 - protein, 5 aa, Mycobacterium
AGGGA

SEQ ID NO: 421584 - protein, 13 aa, Mycobacterium
AGGGAAPYPDPDD

SEQ ID NO: 421585 - protein, 20 aa, Mycobacterium
AGGGADIPLGTPVAGRTEAE

SEQ ID NO: 421586 - protein, 59 aa, Mycobacterium
AGGGAGGNGGAGFGGTPGNGGAGGDAGLLGGPGGTGGAGGYNTSGPGGNGGSGGNAGTL

SEQ ID NO: 421587 - protein, 14 aa, Mycobacterium
AGGGAGGTGGGAGM

SEQ ID NO: 421588 - protein, 9 aa, Mycobacterium
AGGGASAAD

SEQ ID NO: 421589 - protein, 18 aa, Mycobacterium
AGGGAVPYPDSEHLPPLT

SEQ ID NO: 421590 - protein, 20 aa, Mycobacterium
AGGGAYGAKDDPRTKEQADY

SEQ ID NO: 421591 - protein, 5 aa, Mycobacterium
AGGGC

SEQ ID NO: 421592 - protein, 10 aa, Mycobacterium
AGGGDAAIPA

SEQ ID NO: 421593 - protein, 45 aa, Mycobacterium
AGGGDGGAGGFTGGIDGAGGVGGAGGNAGLLGGPGGSGGSGGDGI

SEQ ID NO: 421594 - protein, 27 aa, Mycobacterium
AGGGDGGAGGSGVNHEGGAGGAGGAGG

SEQ ID NO: 421595 - protein, 56 aa, Mycobacterium
AGGGDGGIGGMGQDNGGAGGTGGSAGVLGGPGGAGGTGGYGGVTGGSGGSGGDAGG

SEQ ID NO: 421596 - protein, 25 aa, Mycobacterium
AGGGDGGSGGLGAAGGDGGNGGRAG

SEQ ID NO: 421597 - protein, 7 aa, Mycobacterium
AGGGDYA

SEQ ID NO: 421598 - protein, 6 aa, Mycobacterium
AGGGEF

SEQ ID NO: 421599 - protein, 11 aa, Mycobacterium
AGGGEGSDEHY

SEQ ID NO: 421600 - protein, 8 aa, Mycobacterium
AGGGEISA

SEQ ID NO: 421601 - protein, 17 aa, Mycobacterium
AGGGFDKRIPSAGPDGV

SEQ ID NO: 421602 - protein, 19 aa, Mycobacterium
AGGGFNPPEPTTRGGPDYG

SEQ ID NO: 421603 - protein, 8 aa, Mycobacterium
AGGGFRRG

SEQ ID NO: 421604 - protein, 5 aa, Mycobacterium
AGGGG

SEQ ID NO: 421605 - protein, 14 aa, Mycobacterium
AGGGGAGGNGGAAG

SEQ ID NO: 421606 - protein, 10 aa, Mycobacterium
AGGGGDDLGV

SEQ ID NO: 421607 - protein, 12 aa, Mycobacterium
AGGGGDPRGRSH

SEQ ID NO: 421608 - protein, 11 aa, Mycobacterium
AGGGGDSARRL

SEQ ID NO: 421609 - protein, 7 aa, Mycobacterium
AGGGGFG

SEQ ID NO: 421610 - protein, 8 aa, Mycobacterium
AGGGGGKV

SEQ ID NO: 421611 - protein, 8 aa, Mycobacterium
AGGGGGSI

SEQ ID NO: 421612 - protein, 6 aa, Mycobacterium
AGGGGL

SEQ ID NO: 421613 - protein, 12 aa, Mycobacterium
AGGGGLTPSDIA

SEQ ID NO: 421614 - protein, 15 aa, Mycobacterium
AGGGGLTPSDIAPAR

SEQ ID NO: 421615 - protein, 19 aa, Mycobacterium
AGGGGLTPSDIAPARLDQQ

SEQ ID NO: 421616 - protein, 19 aa, Mycobacterium
AGGGGLTPSDIAPARLSQQ

SEQ ID NO: 421617 - protein, 17 aa, Mycobacterium
AGGGGLTPSDIAPARLT

SEQ ID NO: 421618 - protein, 10 aa, Mycobacterium
AGGGGMTPSD

SEQ ID NO: 421619 - protein, 8 aa, Mycobacterium
AGGGGQIK

SEQ ID NO: 421620 - protein, 11 aa, Mycobacterium
AGGGGRGMRPV

SEQ ID NO: 421621 - protein, 15 aa, Mycobacterium
AGGGGTAGDPRARSH

SEQ ID NO: 421622 - protein, 15 aa, Mycobacterium
AGGGGTGGDPRARSH

SEQ ID NO: 421623 - protein, 45 aa, Mycobacterium
AGGGGTGGSGGDAGWLGSGGAGGAGGISVNGDAGAGGAGGTSGQL

SEQ ID NO: 421624 - protein, 7 aa, Mycobacterium
AGGGGTL

SEQ ID NO: 421625 - protein, 51 aa, Mycobacterium
AGGGHGGAGGLGVSPSTPAALAGGGIGGAGGDAGLLGGAGGAGGTGGSGAF

SEQ ID NO: 421626 - protein, 60 aa, Mycobacterium
AGGGHGGAGGTAISNSGAGGAGGAGGDAGLLGGPGGAGGTGGPGDFGTTHGGAGGAGGNA

SEQ ID NO: 421627 - protein, 53 aa, Mycobacterium
AGGGHGGTGGAGSGTGGAGGAGGPAGLLGGPGGAGGDGGYGDTGGAGGAGGAG

SEQ ID NO: 421628 - protein, 27 aa, Mycobacterium
AGGGHGGTGGFGAGGTGGDGGAGGNAG

SEQ ID NO: 421629 - protein, 23 aa, Mycobacterium
AGGGHGGTGGYGGGAGGAGGNAG

SEQ ID NO: 421630 - protein, 8 aa, Mycobacterium
AGGGIAKR

SEQ ID NO: 421631 - protein, 6 aa, Mycobacterium
AGGGKP

SEQ ID NO: 421632 - protein, 5 aa, Mycobacterium
AGGGL

SEQ ID NO: 421633 - protein, 6 aa, Mycobacterium
AGGGLD

SEQ ID NO: 421634 - protein, 7 aa, Mycobacterium
AGGGLRV

SEQ ID NO: 421635 - protein, 5 aa, Mycobacterium
AGGGM

SEQ ID NO: 421636 - protein, 10 aa, Mycobacterium
AGGGNESAER

SEQ ID NO: 421637 - protein, 7 aa, Mycobacterium
AGGGNFG

SEQ ID NO: 421638 - protein, 41 aa, Mycobacterium
AGGGNGGTGGGATAISGLGGAGGDGGLLGGPGGSGGAGGFS

SEQ ID NO: 421639 - protein, 7 aa, Mycobacterium
AGGGNRA

SEQ ID NO: 421640 - protein, 7 aa, Mycobacterium
AGGGNRD

SEQ ID NO: 421641 - protein, 41 aa, Mycobacterium
AGGGNTGFGNAGFTNTGFGNAGDTNTGFGNAGRLNAGYGNA

SEQ ID NO: 421642 - protein, 6 aa, Mycobacterium
AGGGNV

SEQ ID NO: 421643 - protein, 5 aa, Mycobacterium
AGGGP

SEQ ID NO: 421644 - protein, 7 aa, Mycobacterium
AGGGPAD

SEQ ID NO: 421645 - protein, 7 aa, Mycobacterium
AGGGPAG

SEQ ID NO: 421646 - protein, 8 aa, Mycobacterium
AGGGPDDV

SEQ ID NO: 421647 - protein, 7 aa, Mycobacterium
AGGGPED

SEQ ID NO: 421648 - protein, 16 aa, Mycobacterium
AGGGPFGGANVYSKEH

SEQ ID NO: 421649 - protein, 11 aa, Mycobacterium
AGGGPGAGQLQ

SEQ ID NO: 421650 - protein, 8 aa, Mycobacterium
AGGGPRPV

SEQ ID NO: 421651 - protein, 9 aa, Mycobacterium
AGGGPVAAE

SEQ ID NO: 421652 - protein, 12 aa, Mycobacterium
AGGGQGGGVVIE

SEQ ID NO: 421653 - protein, 7 aa, Mycobacterium
AGGGQLN

SEQ ID NO: 421654 - protein, 8 aa, Mycobacterium
AGGGRSRM

SEQ ID NO: 421655 - protein, 17 aa, Mycobacterium
AGGGRTQHGSQRGDATW

SEQ ID NO: 421656 - protein, 5 aa, Mycobacterium
AGGGS

SEQ ID NO: 421657 - protein, 20 aa, Mycobacterium
AGGGSAAGDVAVSGDETAVQ

SEQ ID NO: 421658 - protein, 8 aa, Mycobacterium
AGGGSGGV

SEQ ID NO: 421659 - protein, 9 aa, Mycobacterium
AGGGSPRDT

SEQ ID NO: 421660 - protein, 7 aa, Mycobacterium
AGGGSTV

SEQ ID NO: 421661 - protein, 8 aa, Mycobacterium
AGGGSTVR

SEQ ID NO: 421662 - protein, 6 aa, Mycobacterium
AGGGSV

SEQ ID NO: 421663 - protein, 6 aa, Mycobacterium
AGGGTA

SEQ ID NO: 421664 - protein, 8 aa, Mycobacterium
AGGGTLDE

SEQ ID NO: 421665 - protein, 6 aa, Mycobacterium
AGGGTV

SEQ ID NO: 421666 - protein, 5 aa, Mycobacterium
AGGGV

SEQ ID NO: 421667 - protein, 11 aa, Mycobacterium
AGGGVAGHNGL

SEQ ID NO: 421668 - protein, 15 aa, Mycobacterium
AGGGVGGTGDKPLAH

SEQ ID NO: 421669 - protein, 7 aa, Mycobacterium
AGGGVRA

SEQ ID NO: 421670 - protein, 19 aa, Mycobacterium
AGGGVRPAKVPARARNEAD

SEQ ID NO: 421671 - protein, 19 aa, Mycobacterium
AGGGVTEAKVPARARNDAD

SEQ ID NO: 421672 - protein, 17 aa, Mycobacterium
AGGGVYSKEQKSIPISP

SEQ ID NO: 421673 - protein, 21 aa, Mycobacterium
AGGGWTDGRQRLGTSPEKDVG

SEQ ID NO: 421674 - protein, 24 aa, Mycobacterium
AGGGYAAQSAGNVREAEDELLRLC

SEQ ID NO: 421675 - protein, 18 aa, Mycobacterium
AGGHASDLNGEPWTPESP

SEQ ID NO: 421676 - protein, 5 aa, Mycobacterium
AGGHD

SEQ ID NO: 421677 - protein, 14 aa, Mycobacterium
AGGHEFDDQTDPFE

SEQ ID NO: 421678 - protein, 6 aa, Mycobacterium
AGGHGG

SEQ ID NO: 421679 - protein, 17 aa, Mycobacterium
AGGHNLEEEGYQSVGSG

SEQ ID NO: 421680 - protein, 7 aa, Mycobacterium
AGGHSYG

SEQ ID NO: 421681 - protein, 5 aa, Mycobacterium
AGGHT

SEQ ID NO: 421682 - protein, 7 aa, Mycobacterium
AGGHTGP

SEQ ID NO: 421683 - protein, 7 aa, Mycobacterium
AGGHTPG

SEQ ID NO: 421684 - protein, 6 aa, Mycobacterium
AGGHVP

SEQ ID NO: 421685 - protein, 6 aa, Mycobacterium
AGGIED

SEQ ID NO: 421686 - protein, 6 aa, Mycobacterium
AGGIEP

SEQ ID NO: 421687 - protein, 13 aa, Mycobacterium
AGGIGGTYAGNPV

SEQ ID NO: 421688 - protein, 6 aa, Mycobacterium
AGGIGS

SEQ ID NO: 421689 - protein, 7 aa, Mycobacterium
AGGIGTA

SEQ ID NO: 421690 - protein, 7 aa, Mycobacterium
AGGIPEV

SEQ ID NO: 421691 - protein, 5 aa, Mycobacterium
AGGIR

SEQ ID NO: 421692 - protein, 7 aa, Mycobacterium
AGGISHA

SEQ ID NO: 421693 - protein, 7 aa, Mycobacterium
AGGITEK

SEQ ID NO: 421694 - protein, 23 aa, Mycobacterium
AGGITQAPRLQSRRARSVVQHSS

SEQ ID NO: 421695 - protein, 7 aa, Mycobacterium
AGGITQN

SEQ ID NO: 421696 - protein, 9 aa, Mycobacterium
AGGKARPDI

SEQ ID NO: 421697 - protein, 9 aa, Mycobacterium
AGGKARPDV

SEQ ID NO: 421698 - protein, 6 aa, Mycobacterium
AGGKNL

SEQ ID NO: 421699 - protein, 6 aa, Mycobacterium
AGGKQG

SEQ ID NO: 421700 - protein, 7 aa, Mycobacterium
AGGKSTL

SEQ ID NO: 421701 - protein, 9 aa, Mycobacterium
AGGKSTPDM

SEQ ID NO: 421702 - protein, 5 aa, Mycobacterium
AGGKV

SEQ ID NO: 421703 - protein, 9 aa, Mycobacterium
AGGLAPRGA

SEQ ID NO: 421704 - protein, 5 aa, Mycobacterium
AGGLD

SEQ ID NO: 421705 - protein, 9 aa, Mycobacterium
AGGLDDPSI

SEQ ID NO: 421706 - protein, 101 aa, Mycobacterium
AGGLEATPTAAPGQTTPGAPLGATPTGTIPPAAGGLSAAQPAGSSASLTPHPVQAQPPTVPQHPEPQSAAARQPSPLPSVGPTDASAQPQEAKTEAGETPC

SEQ ID NO: 421707 - protein, 6 aa, Mycobacterium
AGGLGG

SEQ ID NO: 421708 - protein, 7 aa, Mycobacterium
AGGLGGP

SEQ ID NO: 421709 - protein, 9 aa, Mycobacterium
AGGLNPAGL

SEQ ID NO: 421710 - protein, 6 aa, Mycobacterium
AGGLRE

SEQ ID NO: 421711 - protein, 7 aa, Mycobacterium
AGGLRPD

SEQ ID NO: 421712 - protein, 9 aa, Mycobacterium
AGGLSANGK

SEQ ID NO: 421713 - protein, 8 aa, Mycobacterium
AGGLSEDD

SEQ ID NO: 421714 - protein, 17 aa, Mycobacterium
AGGLTRERPTITRVRLF

SEQ ID NO: 421715 - protein, 9 aa, Mycobacterium
AGGLYASRD

SEQ ID NO: 421716 - protein, 7 aa, Mycobacterium
AGGMGGS

SEQ ID NO: 421717 - protein, 26 aa, Mycobacterium
AGGMGGSATAVTPHTGGTGGVGGEGG

SEQ ID NO: 421718 - protein, 10 aa, Mycobacterium
AGGMGSGADY

SEQ ID NO: 421719 - protein, 13 aa, Mycobacterium
AGGMTNKPHLTAD

SEQ ID NO: 421720 - protein, 15 aa, Mycobacterium
AGGNAAAKDHAAAMG

SEQ ID NO: 421721 - protein, 9 aa, Mycobacterium
AGGNARPDI

SEQ ID NO: 421722 - protein, 28 aa, Mycobacterium
AGGNGGAGGAGLGNPGFGGAGGNGGAGG

SEQ ID NO: 421723 - protein, 29 aa, Mycobacterium
AGGNGGAGGNAVIPGGDGGMGGAGGAAGL

SEQ ID NO: 421724 - protein, 34 aa, Mycobacterium
AGGNGGNGGPGTAKGDPGSGGAGGPLGVDGLNGL

SEQ ID NO: 421725 - protein, 33 aa, Mycobacterium
AGGNGGNGGTGVTAGTGGTGGSGGLLGPDGING

SEQ ID NO: 421726 - protein, 16 aa, Mycobacterium
AGGNGGSGGVGGSAGL

SEQ ID NO: 421727 - protein, 9 aa, Mycobacterium
AGGNGGTGG

SEQ ID NO: 421728 - protein, 7 aa, Mycobacterium
AGGNSPV

SEQ ID NO: 421729 - protein, 16 aa, Mycobacterium
AGGNTDEVRADAPEPG

SEQ ID NO: 421730 - protein, 7 aa, Mycobacterium
AGGNTDI

SEQ ID NO: 421731 - protein, 5 aa, Mycobacterium
AGGPA

SEQ ID NO: 421732 - protein, 6 aa, Mycobacterium
AGGPAA

SEQ ID NO: 421733 - protein, 9 aa, Mycobacterium
AGGPAANAA

SEQ ID NO: 421734 - protein, 10 aa, Mycobacterium
AGGPADERTE

SEQ ID NO: 421735 - protein, 10 aa, Mycobacterium
AGGPAGAPPR

SEQ ID NO: 421736 - protein, 10 aa, Mycobacterium
AGGPAGGGQR

SEQ ID NO: 421737 - protein, 10 aa, Mycobacterium
AGGPAPALAA

SEQ ID NO: 421738 - protein, 5 aa, Mycobacterium
AGGPD

SEQ ID NO: 421739 - protein, 10 aa, Mycobacterium
AGGPDAALDA

SEQ ID NO: 421740 - protein, 7 aa, Mycobacterium
AGGPDDY

SEQ ID NO: 421741 - protein, 10 aa, Mycobacterium
AGGPDKIKTG

SEQ ID NO: 421742 - protein, 6 aa, Mycobacterium
AGGPDV

SEQ ID NO: 421743 - protein, 8 aa, Mycobacterium
AGGPEAQL

SEQ ID NO: 421744 - protein, 7 aa, Mycobacterium
AGGPEAT

SEQ ID NO: 421745 - protein, 10 aa, Mycobacterium
AGGPEDDGGE

SEQ ID NO: 421746 - protein, 6 aa, Mycobacterium
AGGPEK

SEQ ID NO: 421747 - protein, 10 aa, Mycobacterium
AGGPEKIRDT

SEQ ID NO: 421748 - protein, 8 aa, Mycobacterium
AGGPELAD

SEQ ID NO: 421749 - protein, 7 aa, Mycobacterium
AGGPETQ

SEQ ID NO: 421750 - protein, 7 aa, Mycobacterium
AGGPFSS

SEQ ID NO: 421751 - protein, 13 aa, Mycobacterium
AGGPGATGRSYSD

SEQ ID NO: 421752 - protein, 15 aa, Mycobacterium
AGGPGGAAAGAGPRY

SEQ ID NO: 421753 - protein, 15 aa, Mycobacterium
AGGPGGGWGRPPTPL

SEQ ID NO: 421754 - protein, 9 aa, Mycobacterium
AGGPGGPAR

SEQ ID NO: 421755 - protein, 8 aa, Mycobacterium
AGGPGLSG

SEQ ID NO: 421756 - protein, 7 aa, Mycobacterium
AGGPKHP

SEQ ID NO: 421757 - protein, 5 aa, Mycobacterium
AGGPL

SEQ ID NO: 421758 - protein, 6 aa, Mycobacterium
AGGPLE

SEQ ID NO: 421759 - protein, 24 aa, Mycobacterium
AGGPNESSPESIAAAAGPDSDTPC

SEQ ID NO: 421760 - protein, 8 aa, Mycobacterium
AGGPPAPD

SEQ ID NO: 421761 - protein, 9 aa, Mycobacterium
AGGPPEPGA

SEQ ID NO: 421762 - protein, 13 aa, Mycobacterium
AGGPPGPDRVDAA

SEQ ID NO: 421763 - protein, 10 aa, Mycobacterium
AGGPPSPTYF

SEQ ID NO: 421764 - protein, 8 aa, Mycobacterium
AGGPPTTE

SEQ ID NO: 421765 - protein, 7 aa, Mycobacterium
AGGPPVA

SEQ ID NO: 421766 - protein, 5 aa, Mycobacterium
AGGPQ

SEQ ID NO: 421767 - protein, 8 aa, Mycobacterium
AGGPQAAR

SEQ ID NO: 421768 - protein, 6 aa, Mycobacterium
AGGPQK

SEQ ID NO: 421769 - protein, 5 aa, Mycobacterium
AGGPR

SEQ ID NO: 421770 - protein, 11 aa, Mycobacterium
AGGPSAATATA

SEQ ID NO: 421771 - protein, 7 aa, Mycobacterium
AGGPSAV

SEQ ID NO: 421772 - protein, 8 aa, Mycobacterium
AGGPSDAL

SEQ ID NO: 421773 - protein, 6 aa, Mycobacterium
AGGPSN

SEQ ID NO: 421774 - protein, 8 aa, Mycobacterium
AGGPSSQM

SEQ ID NO: 421775 - protein, 19 aa, Mycobacterium
AGGPSTPALAAAGSNAGGL

SEQ ID NO: 421776 - protein, 19 aa, Mycobacterium
AGGPSTPELAAAGSAAGGL

SEQ ID NO: 421777 - protein, 7 aa, Mycobacterium
AGGPTEL

SEQ ID NO: 421778 - protein, 7 aa, Mycobacterium
AGGPTLP

SEQ ID NO: 421779 - protein, 5 aa, Mycobacterium
AGGPV

SEQ ID NO: 421780 - protein, 6 aa, Mycobacterium
AGGPVP

SEQ ID NO: 421781 - protein, 34 aa, Mycobacterium
AGGPVQPGTEGTGPSGDHGGFGGSGGIGGHGGQA

SEQ ID NO: 421782 - protein, 7 aa, Mycobacterium
AGGPVRL

SEQ ID NO: 421783 - protein, 5 aa, Mycobacterium
AGGPY

SEQ ID NO: 421784 - protein, 20 aa, Mycobacterium
AGGPYAGQKDEWDPDGYAGS

SEQ ID NO: 421785 - protein, 16 aa, Mycobacterium
AGGPYPAGDEYDPDGY

SEQ ID NO: 421786 - protein, 8 aa, Mycobacterium
AGGQADED

SEQ ID NO: 421787 - protein, 8 aa, Mycobacterium
AGGQASED

SEQ ID NO: 421788 - protein, 5 aa, Mycobacterium
AGGQE

SEQ ID NO: 421789 - protein, 13 aa, Mycobacterium
AGGQGAPLPLEDG

SEQ ID NO: 421790 - protein, 7 aa, Mycobacterium
AGGQGRY

SEQ ID NO: 421791 - protein, 9 aa, Mycobacterium
AGGQGRYGS

SEQ ID NO: 421792 - protein, 11 aa, Mycobacterium
AGGQGRYGSAY

SEQ ID NO: 421793 - protein, 9 aa, Mycobacterium
AGGQGSREV

SEQ ID NO: 421794 - protein, 24 aa, Mycobacterium
AGGQIADEGTISGTGASGTARAAV

SEQ ID NO: 421795 - protein, 7 aa, Mycobacterium
AGGQKDT

SEQ ID NO: 421796 - protein, 15 aa, Mycobacterium
AGGQLAGLGARDTLR

SEQ ID NO: 421797 - protein, 7 aa, Mycobacterium
AGGQLTE

SEQ ID NO: 421798 - protein, 5 aa, Mycobacterium
AGGQM

SEQ ID NO: 421799 - protein, 6 aa, Mycobacterium
AGGQND

SEQ ID NO: 421800 - protein, 7 aa, Mycobacterium
AGGQPGR

SEQ ID NO: 421801 - protein, 6 aa, Mycobacterium
AGGQQF

SEQ ID NO: 421802 - protein, 7 aa, Mycobacterium
AGGQSQF

SEQ ID NO: 421803 - protein, 14 aa, Mycobacterium
AGGQVGTGYTYGGT

SEQ ID NO: 421804 - protein, 19 aa, Mycobacterium
AGGRAAGIAGAADHEDTAN

SEQ ID NO: 421805 - protein, 7 aa, Mycobacterium
AGGRAAV

SEQ ID NO: 421806 - protein, 8 aa, Mycobacterium
AGGRASAY

SEQ ID NO: 421807 - protein, 8 aa, Mycobacterium
AGGRAVAD

SEQ ID NO: 421808 - protein, 5 aa, Mycobacterium
AGGRD

SEQ ID NO: 421809 - protein, 8 aa, Mycobacterium
AGGRDGAD

SEQ ID NO: 421810 - protein, 12 aa, Mycobacterium
AGGRENPACSST

SEQ ID NO: 421811 - protein, 5 aa, Mycobacterium
AGGRI

SEQ ID NO: 421812 - protein, 8 aa, Mycobacterium
AGGRKPRR

SEQ ID NO: 421813 - protein, 17 aa, Mycobacterium
AGGRPAPEVRPHQEIRR

SEQ ID NO: 421814 - protein, 7 aa, Mycobacterium
AGGRPCI

SEQ ID NO: 421815 - protein, 25 aa, Mycobacterium
AGGRPMYEKPADRRFNHDEPEKRQE

SEQ ID NO: 421816 - protein, 15 aa, Mycobacterium
AGGRPMYERPDGRRF

SEQ ID NO: 421817 - protein, 16 aa, Mycobacterium
AGGRRAPVTTPEAAGR

SEQ ID NO: 421818 - protein, 7 aa, Mycobacterium
AGGRRKP

SEQ ID NO: 421819 - protein, 12 aa, Mycobacterium
AGGRRLDQTAEG

SEQ ID NO: 421820 - protein, 6 aa, Mycobacterium
AGGRRP

SEQ ID NO: 421821 - protein, 5 aa, Mycobacterium
AGGRS

SEQ ID NO: 421822 - protein, 8 aa, Mycobacterium
AGGRSIGE

SEQ ID NO: 421823 - protein, 8 aa, Mycobacterium
AGGRSVGR

SEQ ID NO: 421824 - protein, 6 aa, Mycobacterium
AGGRTA

SEQ ID NO: 421825 - protein, 30 aa, Mycobacterium
AGGRTAGRTTPPRAEPVDEGGWFDRQPIAD

SEQ ID NO: 421826 - protein, 13 aa, Mycobacterium
AGGRTAVHSGAKN

SEQ ID NO: 421827 - protein, 9 aa, Mycobacterium
AGGRTDTRT

SEQ ID NO: 421828 - protein, 8 aa, Mycobacterium
AGGRTVGR

SEQ ID NO: 421829 - protein, 14 aa, Mycobacterium
AGGRTVGSGDDELT

SEQ ID NO: 421830 - protein, 5 aa, Mycobacterium
AGGRY

SEQ ID NO: 421831 - protein, 6 aa, Mycobacterium
AGGRYR

SEQ ID NO: 421832 - protein, 14 aa, Mycobacterium
AGGSAAALPNPRPY

SEQ ID NO: 421833 - protein, 12 aa, Mycobacterium
AGGSAPQGMSPR

SEQ ID NO: 421834 - protein, 8 aa, Mycobacterium
AGGSARTI

SEQ ID NO: 421835 - protein, 5 aa, Mycobacterium
AGGSD

SEQ ID NO: 421836 - protein, 8 aa, Mycobacterium
AGGSDEIA

SEQ ID NO: 421837 - protein, 9 aa, Mycobacterium
AGGSDGGLK

SEQ ID NO: 421838 - protein, 9 aa, Mycobacterium
AGGSDISPQ

SEQ ID NO: 421839 - protein, 12 aa, Mycobacterium
AGGSDKKQSTLE

SEQ ID NO: 421840 - protein, 8 aa, Mycobacterium
AGGSDRNP

SEQ ID NO: 421841 - protein, 15 aa, Mycobacterium
AGGSEQDRADAHRRA

SEQ ID NO: 421842 - protein, 8 aa, Mycobacterium
AGGSFEPV

SEQ ID NO: 421843 - protein, 13 aa, Mycobacterium
AGGSGDEHTQRAN

SEQ ID NO: 421844 - protein, 6 aa, Mycobacterium
AGGSGG

SEQ ID NO: 421845 - protein, 34 aa, Mycobacterium
AGGSGGAGGAGTASVYPGLSGGNGGNGGNGGAAQ

SEQ ID NO: 421846 - protein, 13 aa, Mycobacterium
AGGSGGDGGQGGD

SEQ ID NO: 421847 - protein, 94 aa, Mycobacterium
AGGSGGRDDDEESGESESAEEAAGRPDEQKQRDVADVEDTDREDFEESDEDTDDSDEDDDDSDEDSDDDLDEDDEDIDDEEDLGDDDDDLEMDD

SEQ ID NO: 421848 - protein, 30 aa, Mycobacterium
AGGSGGSGGIGATGTGSGGAAGNGGNGGAG

SEQ ID NO: 421849 - protein, 7 aa, Mycobacterium
AGGSGSI

SEQ ID NO: 421850 - protein, 7 aa, Mycobacterium
AGGSNAG

SEQ ID NO: 421851 - protein, 6 aa, Mycobacterium
AGGSNL

SEQ ID NO: 421852 - protein, 10 aa, Mycobacterium
AGGSPAAQYV

SEQ ID NO: 421853 - protein, 8 aa, Mycobacterium
AGGSPLPS

SEQ ID NO: 421854 - protein, 11 aa, Mycobacterium
AGGSPQPSRRD

SEQ ID NO: 421855 - protein, 10 aa, Mycobacterium
AGGSPRGRDF

SEQ ID NO: 421856 - protein, 8 aa, Mycobacterium
AGGSQSIT

SEQ ID NO: 421857 - protein, 10 aa, Mycobacterium
AGGSQSITDA

SEQ ID NO: 421858 - protein, 5 aa, Mycobacterium
AGGSR

SEQ ID NO: 421859 - protein, 6 aa, Mycobacterium
AGGSSE

SEQ ID NO: 421860 - protein, 11 aa, Mycobacterium
AGGSSESGSQM

SEQ ID NO: 421861 - protein, 13 aa, Mycobacterium
AGGSSESGSQMGQ

SEQ ID NO: 421862 - protein, 10 aa, Mycobacterium
AGGSSGPAVQ

SEQ ID NO: 421863 - protein, 7 aa, Mycobacterium
AGGSSPL

SEQ ID NO: 421864 - protein, 8 aa, Mycobacterium
AGGSSRGL

SEQ ID NO: 421865 - protein, 17 aa, Mycobacterium
AGGSSVVTGDGSEALAA

SEQ ID NO: 421866 - protein, 12 aa, Mycobacterium
AGGSTDGKRLAS

SEQ ID NO: 421867 - protein, 6 aa, Mycobacterium
AGGSTG

SEQ ID NO: 421868 - protein, 8 aa, Mycobacterium
AGGSTGAR

SEQ ID NO: 421869 - protein, 7 aa, Mycobacterium
AGGSTVT

SEQ ID NO: 421870 - protein, 6 aa, Mycobacterium
AGGSVG

SEQ ID NO: 421871 - protein, 6 aa, Mycobacterium
AGGSVS

SEQ ID NO: 421872 - protein, 7 aa, Mycobacterium
AGGSWAD

SEQ ID NO: 421873 - protein, 7 aa, Mycobacterium
AGGTAAG

SEQ ID NO: 421874 - protein, 12 aa, Mycobacterium
AGGTANTTIIER

SEQ ID NO: 421875 - protein, 8 aa, Mycobacterium
AGGTARPA

SEQ ID NO: 421876 - protein, 10 aa, Mycobacterium
AGGTDPNTTK

SEQ ID NO: 421877 - protein, 16 aa, Mycobacterium
AGGTDPVDKATPGTIR

SEQ ID NO: 421878 - protein, 16 aa, Mycobacterium
AGGTDPVEKAATGSIR

SEQ ID NO: 421879 - protein, 15 aa, Mycobacterium
AGGTDPVEKAVPGTI

SEQ ID NO: 421880 - protein, 6 aa, Mycobacterium
AGGTEE

SEQ ID NO: 421881 - protein, 7 aa, Mycobacterium
AGGTEKN

SEQ ID NO: 421882 - protein, 11 aa, Mycobacterium
AGGTEKTRLDT

SEQ ID NO: 421883 - protein, 9 aa, Mycobacterium
AGGTERPEA

SEQ ID NO: 421884 - protein, 7 aa, Mycobacterium
AGGTETV

SEQ ID NO: 421885 - protein, 6 aa, Mycobacterium
AGGTFN

SEQ ID NO: 421886 - protein, 15 aa, Mycobacterium
AGGTGAGEGPDGEAS

SEQ ID NO: 421887 - protein, 7 aa, Mycobacterium
AGGTGDV

SEQ ID NO: 421888 - protein, 30 aa, Mycobacterium
AGGTGGAGGDGGGGNQGAAAGDGGSGGTAA

SEQ ID NO: 421889 - protein, 15 aa, Mycobacterium
AGGTGGNGGAGGAAG

SEQ ID NO: 421890 - protein, 35 aa, Mycobacterium
AGGTGGTGGTGGTTTANGGTGGAAGVGGSGGDASS

SEQ ID NO: 421891 - protein, 12 aa, Mycobacterium
AGGTGRPDGLDT

SEQ ID NO: 421892 - protein, 9 aa, Mycobacterium
AGGTHDDWD

SEQ ID NO: 421893 - protein, 8 aa, Mycobacterium
AGGTHDNW

SEQ ID NO: 421894 - protein, 5 aa, Mycobacterium
AGGTL

SEQ ID NO: 421895 - protein, 14 aa, Mycobacterium
AGGTLEGGSGGELP

SEQ ID NO: 421896 - protein, 6 aa, Mycobacterium
AGGTLR

SEQ ID NO: 421897 - protein, 7 aa, Mycobacterium
AGGTLRD

SEQ ID NO: 421898 - protein, 7 aa, Mycobacterium
AGGTLRE

SEQ ID NO: 421899 - protein, 6 aa, Mycobacterium
AGGTLT

SEQ ID NO: 421900 - protein, 5 aa, Mycobacterium
AGGTP

SEQ ID NO: 421901 - protein, 12 aa, Mycobacterium
AGGTPMYERPAD

SEQ ID NO: 421902 - protein, 7 aa, Mycobacterium
AGGTPRT

SEQ ID NO: 421903 - protein, 7 aa, Mycobacterium
AGGTREI

SEQ ID NO: 421904 - protein, 8 aa, Mycobacterium
AGGTREPL

SEQ ID NO: 421905 - protein, 7 aa, Mycobacterium
AGGTRGI

SEQ ID NO: 421906 - protein, 6 aa, Mycobacterium
AGGTRK

SEQ ID NO: 421907 - protein, 7 aa, Mycobacterium
AGGTSEI

SEQ ID NO: 421908 - protein, 10 aa, Mycobacterium
AGGTSEITRN

SEQ ID NO: 421909 - protein, 9 aa, Mycobacterium
AGGTSEREH

SEQ ID NO: 421910 - protein, 7 aa, Mycobacterium
AGGTSGA

SEQ ID NO: 421911 - protein, 5 aa, Mycobacterium
AGGTV

SEQ ID NO: 421912 - protein, 8 aa, Mycobacterium
AGGTVPAP

SEQ ID NO: 421913 - protein, 12 aa, Mycobacterium
AGGTVPAPHAES

SEQ ID NO: 421914 - protein, 9 aa, Mycobacterium
AGGTVTQET

SEQ ID NO: 421915 - protein, 5 aa, Mycobacterium
AGGVA

SEQ ID NO: 421916 - protein, 6 aa, Mycobacterium
AGGVAR

SEQ ID NO: 421917 - protein, 5 aa, Mycobacterium
AGGVD

SEQ ID NO: 421918 - protein, 19 aa, Mycobacterium
AGGVDAAEGADIGAAETHR

SEQ ID NO: 421919 - protein, 6 aa, Mycobacterium
AGGVDL

SEQ ID NO: 421920 - protein, 19 aa, Mycobacterium
AGGVDPGAAGDAAAETQRS

SEQ ID NO: 421921 - protein, 13 aa, Mycobacterium
AGGVDTASDAPIA

SEQ ID NO: 421922 - protein, 14 aa, Mycobacterium
AGGVDTTSDAPIGL

SEQ ID NO: 421923 - protein, 13 aa, Mycobacterium
AGGVDTTSDPPIA

SEQ ID NO: 421924 - protein, 5 aa, Mycobacterium
AGGVG

SEQ ID NO: 421925 - protein, 6 aa, Mycobacterium
AGGVGA

SEQ ID NO: 421926 - protein, 12 aa, Mycobacterium
AGGVGGAGGAAG

SEQ ID NO: 421927 - protein, 15 aa, Mycobacterium
AGGVGGDGGAGGTAG

SEQ ID NO: 421928 - protein, 21 aa, Mycobacterium
AGGVGGISGNDTGGVGGMGGT

SEQ ID NO: 421929 - protein, 21 aa, Mycobacterium
AGGVGGLGGATGGDGGQGGNA

SEQ ID NO: 421930 - protein, 7 aa, Mycobacterium
AGGVGGV

SEQ ID NO: 421931 - protein, 6 aa, Mycobacterium
AGGVGQ

SEQ ID NO: 421932 - protein, 7 aa, Mycobacterium
AGGVGQA

SEQ ID NO: 421933 - protein, 6 aa, Mycobacterium
AGGVGT

SEQ ID NO: 421934 - protein, 7 aa, Mycobacterium
AGGVGTA

SEQ ID NO: 421935 - protein, 5 aa, Mycobacterium
AGGVP

SEQ ID NO: 421936 - protein, 8 aa, Mycobacterium
AGGVPAAL

SEQ ID NO: 421937 - protein, 11 aa, Mycobacterium
AGGVPQDEGAK

SEQ ID NO: 421938 - protein, 5 aa, Mycobacterium
AGGVR

SEQ ID NO: 421939 - protein, 7 aa, Mycobacterium
AGGVRDT

SEQ ID NO: 421940 - protein, 7 aa, Mycobacterium
AGGVRGT

SEQ ID NO: 421941 - protein, 6 aa, Mycobacterium
AGGVRP

SEQ ID NO: 421942 - protein, 9 aa, Mycobacterium
AGGVSDYDR

SEQ ID NO: 421943 - protein, 9 aa, Mycobacterium
AGGVTDKMG

SEQ ID NO: 421944 - protein, 30 aa, Mycobacterium
AGGVYAGSTQPPFSESTKPRPLSPYGETKL

SEQ ID NO: 421945 - protein, 4 aa, Mycobacterium
AGGW

SEQ ID NO: 421946 - protein, 9 aa, Mycobacterium
AGGWEAEYP

SEQ ID NO: 421947 - protein, 5 aa, Mycobacterium
AGGWT

SEQ ID NO: 421948 - protein, 5 aa, Mycobacterium
AGGYD

SEQ ID NO: 421949 - protein, 5 aa, Mycobacterium
AGGYG

SEQ ID NO: 421950 - protein, 6 aa, Mycobacterium
AGGYHP

SEQ ID NO: 421951 - protein, 8 aa, Mycobacterium
AGGYRGSM

SEQ ID NO: 421952 - protein, 16 aa, Mycobacterium
AGGYTAHPHRDPRTGE

SEQ ID NO: 421953 - protein, 11 aa, Mycobacterium
AGGYTPNPTYE

SEQ ID NO: 421954 - protein, 13 aa, Mycobacterium
AGHADGRAVDRDR

SEQ ID NO: 421955 - protein, 8 aa, Mycobacterium
AGHAEPPV

SEQ ID NO: 421956 - protein, 9 aa, Mycobacterium
AGHAGISGR

SEQ ID NO: 421957 - protein, 51 aa, Mycobacterium
AGHAPPCAASQDSTEPPAPSPEQGAAPAAPSASERAQEQLKAGTSVTVDQG

SEQ ID NO: 421958 - protein, 19 aa, Mycobacterium
AGHAQEQSRSGLDRERRRE

SEQ ID NO: 421959 - protein, 8 aa, Mycobacterium
AGHARGKA

SEQ ID NO: 421960 - protein, 13 aa, Mycobacterium
AGHASGAAAQARA

SEQ ID NO: 421961 - protein, 5 aa, Mycobacterium
AGHAT

SEQ ID NO: 421962 - protein, 5 aa, Mycobacterium
AGHDA

SEQ ID NO: 421963 - protein, 16 aa, Mycobacterium
AGHDMGATEMRNQGKF

SEQ ID NO: 421964 - protein, 6 aa, Mycobacterium
AGHDPG

SEQ ID NO: 421965 - protein, 7 aa, Mycobacterium
AGHDPRR

SEQ ID NO: 421966 - protein, 11 aa, Mycobacterium
AGHDTTSAGIA

SEQ ID NO: 421967 - protein, 12 aa, Mycobacterium
AGHDTTSATIAG

SEQ ID NO: 421968 - protein, 12 aa, Mycobacterium
AGHDTTSATISG

SEQ ID NO: 421969 - protein, 8 aa, Mycobacterium
AGHDVSRN

SEQ ID NO: 421970 - protein, 4 aa, Mycobacterium
AGHE

SEQ ID NO: 421971 - protein, 17 aa, Mycobacterium
AGHEADDNAARKVRERA

SEQ ID NO: 421972 - protein, 5 aa, Mycobacterium
AGHEI

SEQ ID NO: 421973 - protein, 15 aa, Mycobacterium
AGHELGSGTGLGGRV

SEQ ID NO: 421974 - protein, 6 aa, Mycobacterium
AGHEPR

SEQ ID NO: 421975 - protein, 5 aa, Mycobacterium
AGHES

SEQ ID NO: 421976 - protein, 8 aa, Mycobacterium
AGHESGQD

SEQ ID NO: 421977 - protein, 11 aa, Mycobacterium
AGHGAAQAAEA

SEQ ID NO: 421978 - protein, 10 aa, Mycobacterium
AGHGAGAGNC

SEQ ID NO: 421979 - protein, 12 aa, Mycobacterium
AGHGDTGRLPSD

SEQ ID NO: 421980 - protein, 152 aa, Mycobacterium
AGHGGDGGAGGHGGQGGSGGSGSRGADGVTGPNPNGGGGGDGGAGGAGGQGGNGGLAGHAQAAGYSDGVQGVGGAGGKGGAGGLAGDGGTGAAGTFASGGNGIGGTGGDGGDNGAGGAGGTGGSGSTTGSDGASGTTTTSGGNGGNGGRGAD

SEQ ID NO: 421981 - protein, 9 aa, Mycobacterium
AGHGGGASY

SEQ ID NO: 421982 - protein, 9 aa, Mycobacterium
AGHGGISGR

SEQ ID NO: 421983 - protein, 16 aa, Mycobacterium
AGHGHGADTDVSIDDG

SEQ ID NO: 421984 - protein, 9 aa, Mycobacterium
AGHGPDEAA

SEQ ID NO: 421985 - protein, 9 aa, Mycobacterium
AGHGPNEAA

SEQ ID NO: 421986 - protein, 10 aa, Mycobacterium
AGHGPNEAAL

SEQ ID NO: 421987 - protein, 6 aa, Mycobacterium
AGHGPT

SEQ ID NO: 421988 - protein, 12 aa, Mycobacterium
AGHGRGPRSTPS

SEQ ID NO: 421989 - protein, 18 aa, Mycobacterium
AGHGSDGFPRIIESIRSA

SEQ ID NO: 421990 - protein, 14 aa, Mycobacterium
AGHGSEPDGDSETV

SEQ ID NO: 421991 - protein, 7 aa, Mycobacterium
AGHGSRA

SEQ ID NO: 421992 - protein, 16 aa, Mycobacterium
AGHHDGGVKEVEGVPP

SEQ ID NO: 421993 - protein, 28 aa, Mycobacterium
AGHHRADRQHRQAQPVGELDRDRGRTPV

SEQ ID NO: 421994 - protein, 7 aa, Mycobacterium
AGHHRVD

SEQ ID NO: 421995 - protein, 5 aa, Mycobacterium
AGHLT

SEQ ID NO: 421996 - protein, 5 aa, Mycobacterium
AGHPD

SEQ ID NO: 421997 - protein, 23 aa, Mycobacterium
AGHPDGRLPSADSGWSDGLPRRE

SEQ ID NO: 421998 - protein, 14 aa, Mycobacterium
AGHPEASAEYRKPY

SEQ ID NO: 421999 - protein, 14 aa, Mycobacterium
AGHPESAKRYDKPY

SEQ ID NO: 422000 - protein, 6 aa, Mycobacterium
AGHPGA

SEQ ID NO: 422001 - protein, 10 aa, Mycobacterium
AGHPGQRRPH

SEQ ID NO: 422002 - protein, 10 aa, Mycobacterium
AGHPLDDEDR

SEQ ID NO: 422003 - protein, 8 aa, Mycobacterium
AGHPPEVP

SEQ ID NO: 422004 - protein, 20 aa, Mycobacterium
AGHPQGLSTTLTASSTDAMT

SEQ ID NO: 422005 - protein, 5 aa, Mycobacterium
AGHQI

SEQ ID NO: 422006 - protein, 4 aa, Mycobacterium
AGHR

SEQ ID NO: 422007 - protein, 6 aa, Mycobacterium
AGHRCD

SEQ ID NO: 422008 - protein, 12 aa, Mycobacterium
AGHRDALPDHGA

SEQ ID NO: 422009 - protein, 10 aa, Mycobacterium
AGHREQARAR

SEQ ID NO: 422010 - protein, 5 aa, Mycobacterium
AGHRG

SEQ ID NO: 422011 - protein, 6 aa, Mycobacterium
AGHRGP

SEQ ID NO: 422012 - protein, 10 aa, Mycobacterium
AGHRKEGKTV

SEQ ID NO: 422013 - protein, 12 aa, Mycobacterium
AGHRRQSTESAA

SEQ ID NO: 422014 - protein, 24 aa, Mycobacterium
AGHRSARPEHLGTEAPQADSGVQN

SEQ ID NO: 422015 - protein, 9 aa, Mycobacterium
AGHRTDNES

SEQ ID NO: 422016 - protein, 6 aa, Mycobacterium
AGHSAP

SEQ ID NO: 422017 - protein, 8 aa, Mycobacterium
AGHSDGDV

SEQ ID NO: 422018 - protein, 7 aa, Mycobacterium
AGHSEIA

SEQ ID NO: 422019 - protein, 7 aa, Mycobacterium
AGHSPLR

SEQ ID NO: 422020 - protein, 8 aa, Mycobacterium
AGHSTAQI

SEQ ID NO: 422021 - protein, 13 aa, Mycobacterium
AGHTAAGDDNDAF

SEQ ID NO: 422022 - protein, 14 aa, Mycobacterium
AGHTAAGDDNDAFS

SEQ ID NO: 422023 - protein, 23 aa, Mycobacterium
AGHTAAGDDNDAFSDAVVKFVQR

SEQ ID NO: 422024 - protein, 22 aa, Mycobacterium
AGHTAAGDDNDAFTQVVVEFVN

SEQ ID NO: 422025 - protein, 6 aa, Mycobacterium
AGHTDD

SEQ ID NO: 422026 - protein, 6 aa, Mycobacterium
AGHTED

SEQ ID NO: 422027 - protein, 6 aa, Mycobacterium
AGHTGR

SEQ ID NO: 422028 - protein, 8 aa, Mycobacterium
AGHTPEGM

SEQ ID NO: 422029 - protein, 15 aa, Mycobacterium
AGHTPETTPRVRTRP

SEQ ID NO: 422030 - protein, 8 aa, Mycobacterium
AGHTPGHQ

SEQ ID NO: 422031 - protein, 7 aa, Mycobacterium
AGHTSIG

SEQ ID NO: 422032 - protein, 20 aa, Mycobacterium
AGHVGGDGDAAAAARDGDDA

SEQ ID NO: 422033 - protein, 5 aa, Mycobacterium
AGIAD

SEQ ID NO: 422034 - protein, 7 aa, Mycobacterium
AGIADGD

SEQ ID NO: 422035 - protein, 5 aa, Mycobacterium
AGIAE

SEQ ID NO: 422036 - protein, 8 aa, Mycobacterium
AGIAENSG

SEQ ID NO: 422037 - protein, 5 aa, Mycobacterium
AGIAG

SEQ ID NO: 422038 - protein, 12 aa, Mycobacterium
AGIAGQAVGGNV

SEQ ID NO: 422039 - protein, 6 aa, Mycobacterium
AGIAKH

SEQ ID NO: 422040 - protein, 6 aa, Mycobacterium
AGIANR

SEQ ID NO: 422041 - protein, 11 aa, Mycobacterium
AGIANSGNATF

SEQ ID NO: 422042 - protein, 6 aa, Mycobacterium
AGIASD

SEQ ID NO: 422043 - protein, 6 aa, Mycobacterium
AGIASR

SEQ ID NO: 422044 - protein, 7 aa, Mycobacterium
AGIASRR

SEQ ID NO: 422045 - protein, 4 aa, Mycobacterium
AGID

SEQ ID NO: 422046 - protein, 18 aa, Mycobacterium
AGIDAEPDIGLPEPDAEG

SEQ ID NO: 422047 - protein, 11 aa, Mycobacterium
AGIDDAGQGPY

SEQ ID NO: 422048 - protein, 8 aa, Mycobacterium
AGIDGGEQ

SEQ ID NO: 422049 - protein, 14 aa, Mycobacterium
AGIDKTEPQFKARS

SEQ ID NO: 422050 - protein, 17 aa, Mycobacterium
AGIDNTGAFNSGGNGVS

SEQ ID NO: 422051 - protein, 5 aa, Mycobacterium
AGIDP

SEQ ID NO: 422052 - protein, 7 aa, Mycobacterium
AGIDPDS

SEQ ID NO: 422053 - protein, 6 aa, Mycobacterium
AGIDPG

SEQ ID NO: 422054 - protein, 8 aa, Mycobacterium
AGIDPGDV

SEQ ID NO: 422055 - protein, 8 aa, Mycobacterium
AGIDPGSV

SEQ ID NO: 422056 - protein, 13 aa, Mycobacterium
AGIDPKALRGSAT

SEQ ID NO: 422057 - protein, 13 aa, Mycobacterium
AGIDPQALRGSST

SEQ ID NO: 422058 - protein, 13 aa, Mycobacterium
AGIDPQSLRGSTT

SEQ ID NO: 422059 - protein, 6 aa, Mycobacterium
AGIDPR

SEQ ID NO: 422060 - protein, 13 aa, Mycobacterium
AGIDPRSLRGTAT

SEQ ID NO: 422061 - protein, 8 aa, Mycobacterium
AGIDPSAV

SEQ ID NO: 422062 - protein, 14 aa, Mycobacterium
AGIDPSGLRGSATG

SEQ ID NO: 422063 - protein, 6 aa, Mycobacterium
AGIDQS

SEQ ID NO: 422064 - protein, 9 aa, Mycobacterium
AGIDTAAEV

SEQ ID NO: 422065 - protein, 4 aa, Mycobacterium
AGIE

SEQ ID NO: 422066 - protein, 8 aa, Mycobacterium
AGIEDGQR

SEQ ID NO: 422067 - protein, 5 aa, Mycobacterium
AGIEG

SEQ ID NO: 422068 - protein, 27 aa, Mycobacterium
AGIENTKANYGGRSRASGSRLTSAHTA

SEQ ID NO: 422069 - protein, 8 aa, Mycobacterium
AGIEPRRP

SEQ ID NO: 422070 - protein, 7 aa, Mycobacterium
AGIEPSD

SEQ ID NO: 422071 - protein, 6 aa, Mycobacterium
AGIESD

SEQ ID NO: 422072 - protein, 6 aa, Mycobacterium
AGIETE

SEQ ID NO: 422073 - protein, 17 aa, Mycobacterium
AGIGADDVSGTGVPPDE

SEQ ID NO: 422074 - protein, 6 aa, Mycobacterium
AGIGAP

SEQ ID NO: 422075 - protein, 11 aa, Mycobacterium
AGIGDDQEVPD

SEQ ID NO: 422076 - protein, 5 aa, Mycobacterium
AGIGG

SEQ ID NO: 422077 - protein, 6 aa, Mycobacterium
AGIGGA

SEQ ID NO: 422078 - protein, 11 aa, Mycobacterium
AGIGGDSAGEV

SEQ ID NO: 422079 - protein, 9 aa, Mycobacterium
AGIGGGGSF

SEQ ID NO: 422080 - protein, 6 aa, Mycobacterium
AGIGHG

SEQ ID NO: 422081 - protein, 5 aa, Mycobacterium
AGIGK

SEQ ID NO: 422082 - protein, 6 aa, Mycobacterium
AGIGKT

SEQ ID NO: 422083 - protein, 9 aa, Mycobacterium
AGIGLTSPE

SEQ ID NO: 422084 - protein, 5 aa, Mycobacterium
AGIGN

SEQ ID NO: 422085 - protein, 15 aa, Mycobacterium
AGIGPAGQDGTTDIP

SEQ ID NO: 422086 - protein, 6 aa, Mycobacterium
AGIGPD

SEQ ID NO: 422087 - protein, 8 aa, Mycobacterium
AGIGPGAA

SEQ ID NO: 422088 - protein, 8 aa, Mycobacterium
AGIGPGDA

SEQ ID NO: 422089 - protein, 8 aa, Mycobacterium
AGIGPSRT

SEQ ID NO: 422090 - protein, 6 aa, Mycobacterium
AGIGRA

SEQ ID NO: 422091 - protein, 16 aa, Mycobacterium
AGIGRATAKEFGQRGA

SEQ ID NO: 422092 - protein, 5 aa, Mycobacterium
AGIGS

SEQ ID NO: 422093 - protein, 6 aa, Mycobacterium
AGIGSG

SEQ ID NO: 422094 - protein, 10 aa, Mycobacterium
AGINPDTLAG

SEQ ID NO: 422095 - protein, 13 aa, Mycobacterium
AGINPRSLRGSAT

SEQ ID NO: 422096 - protein, 4 aa, Mycobacterium
AGIP

SEQ ID NO: 422097 - protein, 7 aa, Mycobacterium
AGIPAAP

SEQ ID NO: 422098 - protein, 7 aa, Mycobacterium
AGIPDGA

SEQ ID NO: 422099 - protein, 7 aa, Mycobacterium
AGIPDPV

SEQ ID NO: 422100 - protein, 5 aa, Mycobacterium
AGIPE

SEQ ID NO: 422101 - protein, 7 aa, Mycobacterium
AGIPGRG

SEQ ID NO: 422102 - protein, 6 aa, Mycobacterium
AGIPKA

SEQ ID NO: 422103 - protein, 8 aa, Mycobacterium
AGIPKPGR

SEQ ID NO: 422104 - protein, 9 aa, Mycobacterium
AGIPKPGRQ

SEQ ID NO: 422105 - protein, 10 aa, Mycobacterium
AGIPPGSRDE

SEQ ID NO: 422106 - protein, 12 aa, Mycobacterium
AGIPPQTIRGTQ

SEQ ID NO: 422107 - protein, 13 aa, Mycobacterium
AGIPSQAPAGRPH

SEQ ID NO: 422108 - protein, 14 aa, Mycobacterium
AGIPSQAPASRPHA

SEQ ID NO: 422109 - protein, 4 aa, Mycobacterium
AGIQ

SEQ ID NO: 422110 - protein, 8 aa, Mycobacterium
AGIQDGPG

SEQ ID NO: 422111 - protein, 8 aa, Mycobacterium
AGIQRAKR

SEQ ID NO: 422112 - protein, 4 aa, Mycobacterium
AGIR

SEQ ID NO: 422113 - protein, 7 aa, Mycobacterium
AGIRAED

SEQ ID NO: 422114 - protein, 5 aa, Mycobacterium
AGIRN

SEQ ID NO: 422115 - protein, 6 aa, Mycobacterium
AGIRSS

SEQ ID NO: 422116 - protein, 6 aa, Mycobacterium
AGISEN

SEQ ID NO: 422117 - protein, 6 aa, Mycobacterium
AGISKG

SEQ ID NO: 422118 - protein, 6 aa, Mycobacterium
AGISNR

SEQ ID NO: 422119 - protein, 7 aa, Mycobacterium
AGISPGS

SEQ ID NO: 422120 - protein, 7 aa, Mycobacterium
AGISPSL

SEQ ID NO: 422121 - protein, 7 aa, Mycobacterium
AGISREE

SEQ ID NO: 422122 - protein, 6 aa, Mycobacterium
AGISRP

SEQ ID NO: 422123 - protein, 13 aa, Mycobacterium
AGISRSRTITAER

SEQ ID NO: 422124 - protein, 5 aa, Mycobacterium
AGISS

SEQ ID NO: 422125 - protein, 23 aa, Mycobacterium
AGISTDSGIPDYRGPDSPPSNPM

SEQ ID NO: 422126 - protein, 6 aa, Mycobacterium
AGITAE

SEQ ID NO: 422127 - protein, 7 aa, Mycobacterium
AGITDEQ

SEQ ID NO: 422128 - protein, 13 aa, Mycobacterium
AGITEKTAESTDA

SEQ ID NO: 422129 - protein, 6 aa, Mycobacterium
AGITGS

SEQ ID NO: 422130 - protein, 5 aa, Mycobacterium
AGITP

SEQ ID NO: 422131 - protein, 5 aa, Mycobacterium
AGITS

SEQ ID NO: 422132 - protein, 11 aa, Mycobacterium
AGITTDPSVEA

SEQ ID NO: 422133 - protein, 4 aa, Mycobacterium
AGKA

SEQ ID NO: 422134 - protein, 14 aa, Mycobacterium
AGKAAGSPGPREDA

SEQ ID NO: 422135 - protein, 10 aa, Mycobacterium
AGKAARHAPL

SEQ ID NO: 422136 - protein, 9 aa, Mycobacterium
AGKAATAGL

SEQ ID NO: 422137 - protein, 6 aa, Mycobacterium
AGKAAV

SEQ ID NO: 422138 - protein, 28 aa, Mycobacterium
AGKADAAAAAIGGAAPVSVPAAGAIGQE

SEQ ID NO: 422139 - protein, 16 aa, Mycobacterium
AGKADGARLSQAVRER

SEQ ID NO: 422140 - protein, 8 aa, Mycobacterium
AGKADIDA

SEQ ID NO: 422141 - protein, 8 aa, Mycobacterium
AGKADVVT

SEQ ID NO: 422142 - protein, 11 aa, Mycobacterium
AGKAEKEVGDQ

SEQ ID NO: 422143 - protein, 13 aa, Mycobacterium
AGKAERDEKTDEI

SEQ ID NO: 422144 - protein, 10 aa, Mycobacterium
AGKAEREVGD

SEQ ID NO: 422145 - protein, 7 aa, Mycobacterium
AGKAERG

SEQ ID NO: 422146 - protein, 8 aa, Mycobacterium
AGKAGLVP

SEQ ID NO: 422147 - protein, 9 aa, Mycobacterium
AGKAGQVPA

SEQ ID NO: 422148 - protein, 7 aa, Mycobacterium
AGKAGTL

SEQ ID NO: 422149 - protein, 10 aa, Mycobacterium
AGKAGTPKFS

SEQ ID NO: 422150 - protein, 8 aa, Mycobacterium
AGKAGTVE

SEQ ID NO: 422151 - protein, 8 aa, Mycobacterium
AGKAGVDA

SEQ ID NO: 422152 - protein, 19 aa, Mycobacterium
AGKAKGHGRHVKQSGGHGQ

SEQ ID NO: 422153 - protein, 8 aa, Mycobacterium
AGKAQGDR

SEQ ID NO: 422154 - protein, 16 aa, Mycobacterium
AGKAQGGMASGRSQLG

SEQ ID NO: 422155 - protein, 9 aa, Mycobacterium
AGKASHDVA

SEQ ID NO: 422156 - protein, 9 aa, Mycobacterium
AGKASVDAD

SEQ ID NO: 422157 - protein, 5 aa, Mycobacterium
AGKAT

SEQ ID NO: 422158 - protein, 19 aa, Mycobacterium
AGKATGHGRHVKQSGGHGQ

SEQ ID NO: 422159 - protein, 13 aa, Mycobacterium
AGKDGDGWKGRTP

SEQ ID NO: 422160 - protein, 12 aa, Mycobacterium
AGKDGVRIVAAG

SEQ ID NO: 422161 - protein, 9 aa, Mycobacterium
AGKETVTTM

SEQ ID NO: 422162 - protein, 8 aa, Mycobacterium
AGKFEQAS

SEQ ID NO: 422163 - protein, 9 aa, Mycobacterium
AGKFEQASQ

SEQ ID NO: 422164 - protein, 5 aa, Mycobacterium
AGKFG

SEQ ID NO: 422165 - protein, 8 aa, Mycobacterium
AGKGDASC

SEQ ID NO: 422166 - protein, 11 aa, Mycobacterium
AGKGGGFAGPR

SEQ ID NO: 422167 - protein, 10 aa, Mycobacterium
AGKGSDDLSK

SEQ ID NO: 422168 - protein, 6 aa, Mycobacterium
AGKGTH

SEQ ID NO: 422169 - protein, 25 aa, Mycobacterium
AGKGTHGNSAPSACETCGGRGEVQT

SEQ ID NO: 422170 - protein, 24 aa, Mycobacterium
AGKGTISVGSTPLSLKEAKPLPAS

SEQ ID NO: 422171 - protein, 8 aa, Mycobacterium
AGKGTKYL

SEQ ID NO: 422172 - protein, 14 aa, Mycobacterium
AGKGYTEGAGEAKA

SEQ ID NO: 422173 - protein, 6 aa, Mycobacterium
AGKINA

SEQ ID NO: 422174 - protein, 13 aa, Mycobacterium
AGKKINKEDGIQR

SEQ ID NO: 422175 - protein, 8 aa, Mycobacterium
AGKKPSTV

SEQ ID NO: 422176 - protein, 9 aa, Mycobacterium
AGKLPPPVH

SEQ ID NO: 422177 - protein, 17 aa, Mycobacterium
AGKMPQDTSFDGRSDYD

SEQ ID NO: 422178 - protein, 18 aa, Mycobacterium
AGKMTDGTYHSGGSQSLG

SEQ ID NO: 422179 - protein, 6 aa, Mycobacterium
AGKNGL

SEQ ID NO: 422180 - protein, 4 aa, Mycobacterium
AGKP

SEQ ID NO: 422181 - protein, 9 aa, Mycobacterium
AGKPAPDSF

SEQ ID NO: 422182 - protein, 7 aa, Mycobacterium
AGKPDRP

SEQ ID NO: 422183 - protein, 8 aa, Mycobacterium
AGKPDTRA

SEQ ID NO: 422184 - protein, 5 aa, Mycobacterium
AGKPG

SEQ ID NO: 422185 - protein, 6 aa, Mycobacterium
AGKPGE

SEQ ID NO: 422186 - protein, 5 aa, Mycobacterium
AGKPL

SEQ ID NO: 422187 - protein, 10 aa, Mycobacterium
AGKPLASSPR

SEQ ID NO: 422188 - protein, 10 aa, Mycobacterium
AGKPLASSSR

SEQ ID NO: 422189 - protein, 11 aa, Mycobacterium
AGKPLDDDDRR

SEQ ID NO: 422190 - protein, 8 aa, Mycobacterium
AGKPLGAL

SEQ ID NO: 422191 - protein, 7 aa, Mycobacterium
AGKPLRG

SEQ ID NO: 422192 - protein, 8 aa, Mycobacterium
AGKPPEEW

SEQ ID NO: 422193 - protein, 6 aa, Mycobacterium
AGKPPF

SEQ ID NO: 422194 - protein, 13 aa, Mycobacterium
AGKPPQDSSLAAT

SEQ ID NO: 422195 - protein, 11 aa, Mycobacterium
AGKPQEQTADD

SEQ ID NO: 422196 - protein, 29 aa, Mycobacterium
AGKPQQDIGRTSLSEDDAAATASGKERQA

SEQ ID NO: 422197 - protein, 28 aa, Mycobacterium
AGKPSADRPAEPADAPADAGRSGEDEPF

SEQ ID NO: 422198 - protein, 5 aa, Mycobacterium
AGKPV

SEQ ID NO: 422199 - protein, 18 aa, Mycobacterium
AGKPVDEDHTITGPGVAA

SEQ ID NO: 422200 - protein, 7 aa, Mycobacterium
AGKPVLS

SEQ ID NO: 422201 - protein, 6 aa, Mycobacterium
AGKPYA

SEQ ID NO: 422202 - protein, 6 aa, Mycobacterium
AGKQGG

SEQ ID NO: 422203 - protein, 12 aa, Mycobacterium
AGKQGLSGGNEH

SEQ ID NO: 422204 - protein, 5 aa, Mycobacterium
AGKQI

SEQ ID NO: 422205 - protein, 6 aa, Mycobacterium
AGKQTV

SEQ ID NO: 422206 - protein, 6 aa, Mycobacterium
AGKRDI

SEQ ID NO: 422207 - protein, 5 aa, Mycobacterium
AGKRG

SEQ ID NO: 422208 - protein, 6 aa, Mycobacterium
AGKRGA

SEQ ID NO: 422209 - protein, 6 aa, Mycobacterium
AGKRGR

SEQ ID NO: 422210 - protein, 8 aa, Mycobacterium
AGKRRAFA

SEQ ID NO: 422211 - protein, 25 aa, Mycobacterium
AGKRTEPHERPLDGTPVVDTDRGGK

SEQ ID NO: 422212 - protein, 10 aa, Mycobacterium
AGKSALSSTF

SEQ ID NO: 422213 - protein, 6 aa, Mycobacterium
AGKSDS

SEQ ID NO: 422214 - protein, 8 aa, Mycobacterium
AGKSKYVD

SEQ ID NO: 422215 - protein, 7 aa, Mycobacterium
AGKSLRR

SEQ ID NO: 422216 - protein, 8 aa, Mycobacterium
AGKSPEDY

SEQ ID NO: 422217 - protein, 9 aa, Mycobacterium
AGKSTVSRT

SEQ ID NO: 422218 - protein, 8 aa, Mycobacterium
AGKSVPLS

SEQ ID NO: 422219 - protein, 6 aa, Mycobacterium
AGKTDR

SEQ ID NO: 422220 - protein, 7 aa, Mycobacterium
AGKTGSM

SEQ ID NO: 422221 - protein, 17 aa, Mycobacterium
AGKTGTSVAATQAEATF

SEQ ID NO: 422222 - protein, 6 aa, Mycobacterium
AGKTMG

SEQ ID NO: 422223 - protein, 15 aa, Mycobacterium
AGKTPWPGGAPYAAL

SEQ ID NO: 422224 - protein, 7 aa, Mycobacterium
AGKTSAV

SEQ ID NO: 422225 - protein, 8 aa, Mycobacterium
AGKTSREM

SEQ ID NO: 422226 - protein, 9 aa, Mycobacterium
AGKTTGVPA

SEQ ID NO: 422227 - protein, 7 aa, Mycobacterium
AGKVGRS

SEQ ID NO: 422228 - protein, 8 aa, Mycobacterium
AGKVGRSV

SEQ ID NO: 422229 - protein, 10 aa, Mycobacterium
AGKYGTTAEQ

SEQ ID NO: 422230 - protein, 8 aa, Mycobacterium
AGKYGTTV

SEQ ID NO: 422231 - protein, 5 aa, Mycobacterium
AGLAA

SEQ ID NO: 422232 - protein, 10 aa, Mycobacterium
AGLAASEKRG

SEQ ID NO: 422233 - protein, 8 aa, Mycobacterium
AGLADRDR

SEQ ID NO: 422234 - protein, 5 aa, Mycobacterium
AGLAE

SEQ ID NO: 422235 - protein, 9 aa, Mycobacterium
AGLAEAPDD

SEQ ID NO: 422236 - protein, 6 aa, Mycobacterium
AGLAGA

SEQ ID NO: 422237 - protein, 7 aa, Mycobacterium
AGLAGAP

SEQ ID NO: 422238 - protein, 6 aa, Mycobacterium
AGLAGG

SEQ ID NO: 422239 - protein, 8 aa, Mycobacterium
AGLAGGPN

SEQ ID NO: 422240 - protein, 12 aa, Mycobacterium
AGLAGNPNWSTP

SEQ ID NO: 422241 - protein, 17 aa, Mycobacterium
AGLAGTAERARGTGARM

SEQ ID NO: 422242 - protein, 10 aa, Mycobacterium
AGLANQAAAV

SEQ ID NO: 422243 - protein, 5 aa, Mycobacterium
AGLAP

SEQ ID NO: 422244 - protein, 10 aa, Mycobacterium
AGLAPDTVGD

SEQ ID NO: 422245 - protein, 7 aa, Mycobacterium
AGLAPGD

SEQ ID NO: 422246 - protein, 17 aa, Mycobacterium
AGLAPGSGASDESATVS

SEQ ID NO: 422247 - protein, 8 aa, Mycobacterium
AGLAPKDV

SEQ ID NO: 422248 - protein, 11 aa, Mycobacterium
AGLAPQPRGAA

SEQ ID NO: 422249 - protein, 6 aa, Mycobacterium
AGLAPS

SEQ ID NO: 422250 - protein, 7 aa, Mycobacterium
AGLAPSD

SEQ ID NO: 422251 - protein, 22 aa, Mycobacterium
AGLAPTATAAAGTRITVPGAGP

SEQ ID NO: 422252 - protein, 10 aa, Mycobacterium
AGLAQPYRAR

SEQ ID NO: 422253 - protein, 7 aa, Mycobacterium
AGLAQTG

SEQ ID NO: 422254 - protein, 7 aa, Mycobacterium
AGLARPE

SEQ ID NO: 422255 - protein, 7 aa, Mycobacterium
AGLDADA

SEQ ID NO: 422256 - protein, 8 aa, Mycobacterium
AGLDADTY

SEQ ID NO: 422257 - protein, 6 aa, Mycobacterium
AGLDAG

SEQ ID NO: 422258 - protein, 12 aa, Mycobacterium
AGLDDAGYRNTV

SEQ ID NO: 422259 - protein, 7 aa, Mycobacterium
AGLDDSL

SEQ ID NO: 422260 - protein, 5 aa, Mycobacterium
AGLDE

SEQ ID NO: 422261 - protein, 6 aa, Mycobacterium
AGLDEE

SEQ ID NO: 422262 - protein, 7 aa, Mycobacterium
AGLDEPR

SEQ ID NO: 422263 - protein, 6 aa, Mycobacterium
AGLDET

SEQ ID NO: 422264 - protein, 6 aa, Mycobacterium
AGLDGG

SEQ ID NO: 422265 - protein, 9 aa, Mycobacterium
AGLDGQKET

SEQ ID NO: 422266 - protein, 6 aa, Mycobacterium
AGLDPE

SEQ ID NO: 422267 - protein, 7 aa, Mycobacterium
AGLDPSS

SEQ ID NO: 422268 - protein, 14 aa, Mycobacterium
AGLDQTGKFNKSTV

SEQ ID NO: 422269 - protein, 5 aa, Mycobacterium
AGLDR

SEQ ID NO: 422270 - protein, 7 aa, Mycobacterium
AGLDRPV

SEQ ID NO: 422271 - protein, 10 aa, Mycobacterium
AGLDSDSQAR

SEQ ID NO: 422272 - protein, 7 aa, Mycobacterium
AGLDSTA

SEQ ID NO: 422273 - protein, 5 aa, Mycobacterium
AGLEA

SEQ ID NO: 422274 - protein, 7 aa, Mycobacterium
AGLEERR

SEQ ID NO: 422275 - protein, 8 aa, Mycobacterium
AGLEERRD

SEQ ID NO: 422276 - protein, 8 aa, Mycobacterium
AGLEPSDV

SEQ ID NO: 422277 - protein, 7 aa, Mycobacterium
AGLEPTA

SEQ ID NO: 422278 - protein, 7 aa, Mycobacterium
AGLETKR

SEQ ID NO: 422279 - protein, 5 aa, Mycobacterium
AGLGA

SEQ ID NO: 422280 - protein, 24 aa, Mycobacterium
AGLGAAPTSPPPVAPPTSDMTGGV

SEQ ID NO: 422281 - protein, 7 aa, Mycobacterium
AGLGAPV

SEQ ID NO: 422282 - protein, 7 aa, Mycobacterium
AGLGASD

SEQ ID NO: 422283 - protein, 19 aa, Mycobacterium
AGLGATAYPPGGPPTHEGW

SEQ ID NO: 422284 - protein, 6 aa, Mycobacterium
AGLGEI

SEQ ID NO: 422285 - protein, 10 aa, Mycobacterium
AGLGEPGRHG

SEQ ID NO: 422286 - protein, 10 aa, Mycobacterium
AGLGGAAGGG

SEQ ID NO: 422287 - protein, 25 aa, Mycobacterium
AGLGGAVEPVSASAAGSASASAATV

SEQ ID NO: 422288 - protein, 12 aa, Mycobacterium
AGLGGLPNGLGG

SEQ ID NO: 422289 - protein, 14 aa, Mycobacterium
AGLGGNGGAGGSAG

SEQ ID NO: 422290 - protein, 16 aa, Mycobacterium
AGLGGSNRKIEQALKS

SEQ ID NO: 422291 - protein, 72 aa, Mycobacterium
AGLGGTAGNDNFGNGNLGSGNTGSGNIGNQNQGWGNQGDNNVGLANRGSDNMGFGNTGNNNVGFGNTGSGNI

SEQ ID NO: 422292 - protein, 8 aa, Mycobacterium
AGLGGTQV

SEQ ID NO: 422293 - protein, 8 aa, Mycobacterium
AGLGKGDP

SEQ ID NO: 422294 - protein, 6 aa, Mycobacterium
AGLGNY

SEQ ID NO: 422295 - protein, 7 aa, Mycobacterium
AGLGPAA

SEQ ID NO: 422296 - protein, 6 aa, Mycobacterium
AGLGPE

SEQ ID NO: 422297 - protein, 7 aa, Mycobacterium
AGLGPEQ

SEQ ID NO: 422298 - protein, 6 aa, Mycobacterium
AGLGPF

SEQ ID NO: 422299 - protein, 14 aa, Mycobacterium
AGLGPTELADDSVG

SEQ ID NO: 422300 - protein, 10 aa, Mycobacterium
AGLGRDSKGI

SEQ ID NO: 422301 - protein, 12 aa, Mycobacterium
AGLGREVSAADT

SEQ ID NO: 422302 - protein, 6 aa, Mycobacterium
AGLGSQ

SEQ ID NO: 422303 - protein, 7 aa, Mycobacterium
AGLGSQD

SEQ ID NO: 422304 - protein, 5 aa, Mycobacterium
AGLGT

SEQ ID NO: 422305 - protein, 6 aa, Mycobacterium
AGLGTD

SEQ ID NO: 422306 - protein, 9 aa, Mycobacterium
AGLGTSEDL

SEQ ID NO: 422307 - protein, 7 aa, Mycobacterium
AGLGTSG

SEQ ID NO: 422308 - protein, 4 aa, Mycobacterium
AGLH

SEQ ID NO: 422309 - protein, 4 aa, Mycobacterium
AGLI

SEQ ID NO: 422310 - protein, 7 aa, Mycobacterium
AGLKARD

SEQ ID NO: 422311 - protein, 12 aa, Mycobacterium
AGLKATPGNAHY

SEQ ID NO: 422312 - protein, 7 aa, Mycobacterium
AGLNAPQ

SEQ ID NO: 422313 - protein, 8 aa, Mycobacterium
AGLNDPAY

SEQ ID NO: 422314 - protein, 10 aa, Mycobacterium
AGLNSQRARG

SEQ ID NO: 422315 - protein, 8 aa, Mycobacterium
AGLPAAPA

SEQ ID NO: 422316 - protein, 6 aa, Mycobacterium
AGLPAD

SEQ ID NO: 422317 - protein, 7 aa, Mycobacterium
AGLPAEL

SEQ ID NO: 422318 - protein, 8 aa, Mycobacterium
AGLPAPKY

SEQ ID NO: 422319 - protein, 13 aa, Mycobacterium
AGLPAPKYGTATT

SEQ ID NO: 422320 - protein, 15 aa, Mycobacterium
AGLPARERDFAPGDV

SEQ ID NO: 422321 - protein, 6 aa, Mycobacterium
AGLPAS

SEQ ID NO: 422322 - protein, 6 aa, Mycobacterium
AGLPDA

SEQ ID NO: 422323 - protein, 8 aa, Mycobacterium
AGLPDGAD

SEQ ID NO: 422324 - protein, 8 aa, Mycobacterium
AGLPDPER

SEQ ID NO: 422325 - protein, 7 aa, Mycobacterium
AGLPDQV

SEQ ID NO: 422326 - protein, 7 aa, Mycobacterium
AGLPDRA

SEQ ID NO: 422327 - protein, 7 aa, Mycobacterium
AGLPEEV

SEQ ID NO: 422328 - protein, 6 aa, Mycobacterium
AGLPEG

SEQ ID NO: 422329 - protein, 6 aa, Mycobacterium
AGLPEP

SEQ ID NO: 422330 - protein, 13 aa, Mycobacterium
AGLPEPAKPGEQR

SEQ ID NO: 422331 - protein, 14 aa, Mycobacterium
AGLPEPTKRKEKTR

SEQ ID NO: 422332 - protein, 13 aa, Mycobacterium
AGLPEPTRKKAAH

SEQ ID NO: 422333 - protein, 16 aa, Mycobacterium
AGLPESAEDKGAQATL

SEQ ID NO: 422334 - protein, 18 aa, Mycobacterium
AGLPESVEDKGAQAAAAA

SEQ ID NO: 422335 - protein, 5 aa, Mycobacterium
AGLPG

SEQ ID NO: 422336 - protein, 6 aa, Mycobacterium
AGLPGA

SEQ ID NO: 422337 - protein, 22 aa, Mycobacterium
AGLPGEWPTGYDDATQQNTPAW

SEQ ID NO: 422338 - protein, 10 aa, Mycobacterium
AGLPGQPQPV

SEQ ID NO: 422339 - protein, 19 aa, Mycobacterium
AGLPGSAEDKGAQAAAAAL

SEQ ID NO: 422340 - protein, 13 aa, Mycobacterium
AGLPGTKKACDHG

SEQ ID NO: 422341 - protein, 15 aa, Mycobacterium
AGLPGTKKGCDQGAC

SEQ ID NO: 422342 - protein, 20 aa, Mycobacterium
AGLPGVNGGNGGNGGAGGAA

SEQ ID NO: 422343 - protein, 6 aa, Mycobacterium
AGLPKG

SEQ ID NO: 422344 - protein, 7 aa, Mycobacterium
AGLPKPG

SEQ ID NO: 422345 - protein, 7 aa, Mycobacterium
AGLPKQV

SEQ ID NO: 422346 - protein, 5 aa, Mycobacterium
AGLPP

SEQ ID NO: 422347 - protein, 7 aa, Mycobacterium
AGLPPAT

SEQ ID NO: 422348 - protein, 10 aa, Mycobacterium
AGLPPDSTQI

SEQ ID NO: 422349 - protein, 7 aa, Mycobacterium
AGLPPGQ

SEQ ID NO: 422350 - protein, 10 aa, Mycobacterium
AGLPPGSAHT

SEQ ID NO: 422351 - protein, 38 aa, Mycobacterium
AGLPPKAAPDKPDEEPDKVQTESVGGVPSGDAVVGGST

SEQ ID NO: 422352 - protein, 8 aa, Mycobacterium
AGLPPKEF

SEQ ID NO: 422353 - protein, 8 aa, Mycobacterium
AGLPPVRG

SEQ ID NO: 422354 - protein, 14 aa, Mycobacterium
AGLPQAAYASSKAG

SEQ ID NO: 422355 - protein, 5 aa, Mycobacterium
AGLPS

SEQ ID NO: 422356 - protein, 8 aa, Mycobacterium
AGLPSSPW

SEQ ID NO: 422357 - protein, 7 aa, Mycobacterium
AGLPTEI

SEQ ID NO: 422358 - protein, 9 aa, Mycobacterium
AGLPTPRRT

SEQ ID NO: 422359 - protein, 18 aa, Mycobacterium
AGLPTSAEDKGAQATAAA

SEQ ID NO: 422360 - protein, 18 aa, Mycobacterium
AGLPTSDEDKGAQATAAA

SEQ ID NO: 422361 - protein, 5 aa, Mycobacterium
AGLPV

SEQ ID NO: 422362 - protein, 24 aa, Mycobacterium
AGLPVQPASPRGAERSSRDSAGAI

SEQ ID NO: 422363 - protein, 7 aa, Mycobacterium
AGLQNLT

SEQ ID NO: 422364 - protein, 6 aa, Mycobacterium
AGLQPD

SEQ ID NO: 422365 - protein, 6 aa, Mycobacterium
AGLQPE

SEQ ID NO: 422366 - protein, 9 aa, Mycobacterium
AGLQPGTQA

SEQ ID NO: 422367 - protein, 5 aa, Mycobacterium
AGLQS

SEQ ID NO: 422368 - protein, 5 aa, Mycobacterium
AGLRD

SEQ ID NO: 422369 - protein, 5 aa, Mycobacterium
AGLRE

SEQ ID NO: 422370 - protein, 8 aa, Mycobacterium
AGLRGSGQ

SEQ ID NO: 422371 - protein, 10 aa, Mycobacterium
AGLRGSGRPV

SEQ ID NO: 422372 - protein, 9 aa, Mycobacterium
AGLRGTERV

SEQ ID NO: 422373 - protein, 7 aa, Mycobacterium
AGLRPAD

SEQ ID NO: 422374 - protein, 6 aa, Mycobacterium
AGLRPE

SEQ ID NO: 422375 - protein, 7 aa, Mycobacterium
AGLRPGD

SEQ ID NO: 422376 - protein, 8 aa, Mycobacterium
AGLRPRPE

SEQ ID NO: 422377 - protein, 11 aa, Mycobacterium
AGLRPSEARAA

SEQ ID NO: 422378 - protein, 7 aa, Mycobacterium
AGLRRGD

SEQ ID NO: 422379 - protein, 12 aa, Mycobacterium
AGLRSGGQAVRP

SEQ ID NO: 422380 - protein, 10 aa, Mycobacterium
AGLSAAPAAS

SEQ ID NO: 422381 - protein, 8 aa, Mycobacterium
AGLSEGED

SEQ ID NO: 422382 - protein, 9 aa, Mycobacterium
AGLSEPSAV

SEQ ID NO: 422383 - protein, 11 aa, Mycobacterium
AGLSGPSEPLA

SEQ ID NO: 422384 - protein, 7 aa, Mycobacterium
AGLSGPV

SEQ ID NO: 422385 - protein, 6 aa, Mycobacterium
AGLSGQ

SEQ ID NO: 422386 - protein, 5 aa, Mycobacterium
AGLSK

SEQ ID NO: 422387 - protein, 12 aa, Mycobacterium
AGLSNETYLAAY

SEQ ID NO: 422388 - protein, 5 aa, Mycobacterium
AGLSP

SEQ ID NO: 422389 - protein, 11 aa, Mycobacterium
AGLSPAQASAQ

SEQ ID NO: 422390 - protein, 11 aa, Mycobacterium
AGLSPAQSPTA

SEQ ID NO: 422391 - protein, 10 aa, Mycobacterium
AGLSPDDGLP

SEQ ID NO: 422392 - protein, 10 aa, Mycobacterium
AGLSPDGSSS

SEQ ID NO: 422393 - protein, 7 aa, Mycobacterium
AGLSPGD

SEQ ID NO: 422394 - protein, 8 aa, Mycobacterium
AGLSPKDI

SEQ ID NO: 422395 - protein, 8 aa, Mycobacterium
AGLSPSDV

SEQ ID NO: 422396 - protein, 9 aa, Mycobacterium
AGLSPSVRD

SEQ ID NO: 422397 - protein, 5 aa, Mycobacterium
AGLSR

SEQ ID NO: 422398 - protein, 13 aa, Mycobacterium
AGLSREGKRGPMD

SEQ ID NO: 422399 - protein, 6 aa, Mycobacterium
AGLSRQ

SEQ ID NO: 422400 - protein, 8 aa, Mycobacterium
AGLSRQEL

SEQ ID NO: 422401 - protein, 11 aa, Mycobacterium
AGLSRQGRHGP

SEQ ID NO: 422402 - protein, 12 aa, Mycobacterium
AGLSRQGRRGPI

SEQ ID NO: 422403 - protein, 12 aa, Mycobacterium
AGLSRQGRRGPM

SEQ ID NO: 422404 - protein, 18 aa, Mycobacterium
AGLSRTQARTAEAGTGAR

SEQ ID NO: 422405 - protein, 6 aa, Mycobacterium
AGLSRV

SEQ ID NO: 422406 - protein, 5 aa, Mycobacterium
AGLSS

SEQ ID NO: 422407 - protein, 10 aa, Mycobacterium
AGLSSGQKQR

SEQ ID NO: 422408 - protein, 9 aa, Mycobacterium
AGLSSKDKV

SEQ ID NO: 422409 - protein, 23 aa, Mycobacterium
AGLSTDSGIPDYRGPDSPPSNPM

SEQ ID NO: 422410 - protein, 22 aa, Mycobacterium
AGLSTGLGDEGGFAPDVASTTA

SEQ ID NO: 422411 - protein, 27 aa, Mycobacterium
AGLSTPDVGGSAGTREFTDGVLTALRP

SEQ ID NO: 422412 - protein, 15 aa, Mycobacterium
AGLSVDDGATVTYPS

SEQ ID NO: 422413 - protein, 10 aa, Mycobacterium
AGLTADGLRR

SEQ ID NO: 422414 - protein, 6 aa, Mycobacterium
AGLTAG

SEQ ID NO: 422415 - protein, 5 aa, Mycobacterium
AGLTD

SEQ ID NO: 422416 - protein, 6 aa, Mycobacterium
AGLTDE

SEQ ID NO: 422417 - protein, 6 aa, Mycobacterium
AGLTEE

SEQ ID NO: 422418 - protein, 8 aa, Mycobacterium
AGLTGGAA

SEQ ID NO: 422419 - protein, 7 aa, Mycobacterium
AGLTGGD

SEQ ID NO: 422420 - protein, 9 aa, Mycobacterium
AGLTGPEAE

SEQ ID NO: 422421 - protein, 16 aa, Mycobacterium
AGLTGTAVGAAGGGFA

SEQ ID NO: 422422 - protein, 8 aa, Mycobacterium
AGLTPADV

SEQ ID NO: 422423 - protein, 7 aa, Mycobacterium
AGLTPEY

SEQ ID NO: 422424 - protein, 9 aa, Mycobacterium
AGLTPGSGG

SEQ ID NO: 422425 - protein, 6 aa, Mycobacterium
AGLTPQ

SEQ ID NO: 422426 - protein, 8 aa, Mycobacterium
AGLTQSQG

SEQ ID NO: 422427 - protein, 10 aa, Mycobacterium
AGLTRNGPDV

SEQ ID NO: 422428 - protein, 8 aa, Mycobacterium
AGLTSGDP

SEQ ID NO: 422429 - protein, 7 aa, Mycobacterium
AGLTTAD

SEQ ID NO: 422430 - protein, 4 aa, Mycobacterium
AGLV

SEQ ID NO: 422431 - protein, 13 aa, Mycobacterium
AGLYDKDHRSSPV

SEQ ID NO: 422432 - protein, 12 aa, Mycobacterium
AGMAGTDNGAHA

SEQ ID NO: 422433 - protein, 6 aa, Mycobacterium
AGMDER

SEQ ID NO: 422434 - protein, 8 aa, Mycobacterium
AGMDGESL

SEQ ID NO: 422435 - protein, 6 aa, Mycobacterium
AGMDKE

SEQ ID NO: 422436 - protein, 7 aa, Mycobacterium
AGMDKQQ

SEQ ID NO: 422437 - protein, 8 aa, Mycobacterium
AGMDTGGV

SEQ ID NO: 422438 - protein, 6 aa, Mycobacterium
AGMEKT

SEQ ID NO: 422439 - protein, 11 aa, Mycobacterium
AGMETRSAAEL

SEQ ID NO: 422440 - protein, 11 aa, Mycobacterium
AGMGAGAGNAP

SEQ ID NO: 422441 - protein, 9 aa, Mycobacterium
AGMGGGLAG

SEQ ID NO: 422442 - protein, 51 aa, Mycobacterium
AGMGGGSTIGGGAIGGGSTGAAAMGASGSGGGAMGGGGGGGAYGPPAHTGS

SEQ ID NO: 422443 - protein, 9 aa, Mycobacterium
AGMGPDGKR

SEQ ID NO: 422444 - protein, 12 aa, Mycobacterium
AGMHDTEKEVNR

SEQ ID NO: 422445 - protein, 4 aa, Mycobacterium
AGMP

SEQ ID NO: 422446 - protein, 13 aa, Mycobacterium
AGMPDPGRQAHRY

SEQ ID NO: 422447 - protein, 8 aa, Mycobacterium
AGMPDSAT

SEQ ID NO: 422448 - protein, 15 aa, Mycobacterium
AGMPGGGGGVGAQTP

SEQ ID NO: 422449 - protein, 8 aa, Mycobacterium
AGMPNPAN

SEQ ID NO: 422450 - protein, 20 aa, Mycobacterium
AGMPPEQAGPLREDEQRRSA

SEQ ID NO: 422451 - protein, 5 aa, Mycobacterium
AGMRP

SEQ ID NO: 422452 - protein, 6 aa, Mycobacterium
AGMSAE

SEQ ID NO: 422453 - protein, 14 aa, Mycobacterium
AGMSSPQGQATAAD

SEQ ID NO: 422454 - protein, 8 aa, Mycobacterium
AGMTDEQF

SEQ ID NO: 422455 - protein, 7 aa, Mycobacterium
AGMTNPE

SEQ ID NO: 422456 - protein, 7 aa, Mycobacterium
AGMTNPT

SEQ ID NO: 422457 - protein, 8 aa, Mycobacterium
AGMTSGAG

SEQ ID NO: 422458 - protein, 8 aa, Mycobacterium
AGMTTEKA

SEQ ID NO: 422459 - protein, 4 aa, Mycobacterium
AGNA

SEQ ID NO: 422460 - protein, 9 aa, Mycobacterium
AGNADAHTA

SEQ ID NO: 422461 - protein, 7 aa, Mycobacterium
AGNADQQ

SEQ ID NO: 422462 - protein, 12 aa, Mycobacterium
AGNAEAANGASL

SEQ ID NO: 422463 - protein, 6 aa, Mycobacterium
AGNAEE

SEQ ID NO: 422464 - protein, 7 aa, Mycobacterium
AGNAERR

SEQ ID NO: 422465 - protein, 10 aa, Mycobacterium
AGNAGAAEVR

SEQ ID NO: 422466 - protein, 12 aa, Mycobacterium
AGNAGAEGFASR

SEQ ID NO: 422467 - protein, 36 aa, Mycobacterium
AGNAGPRPAHGGGTPSRSRVRAASGPDRRPNPAGGR

SEQ ID NO: 422468 - protein, 9 aa, Mycobacterium
AGNAGQSSS

SEQ ID NO: 422469 - protein, 16 aa, Mycobacterium
AGNAGRGMASGCRRGP

SEQ ID NO: 422470 - protein, 13 aa, Mycobacterium
AGNAGTGGDGGAG

SEQ ID NO: 422471 - protein, 20 aa, Mycobacterium
AGNAKGHGRHVKQSGGHGQY

SEQ ID NO: 422472 - protein, 12 aa, Mycobacterium
AGNASGTNDAAA

SEQ ID NO: 422473 - protein, 17 aa, Mycobacterium
AGNATLHGTGIAPGGIS

SEQ ID NO: 422474 - protein, 5 aa, Mycobacterium
AGNAV

SEQ ID NO: 422475 - protein, 18 aa, Mycobacterium
AGNCAPDSEAIDAALAST

SEQ ID NO: 422476 - protein, 6 aa, Mycobacterium
AGNCSR

SEQ ID NO: 422477 - protein, 6 aa, Mycobacterium
AGNDAN

SEQ ID NO: 422478 - protein, 10 aa, Mycobacterium
AGNDGETTAM

SEQ ID NO: 422479 - protein, 7 aa, Mycobacterium
AGNDPRR

SEQ ID NO: 422480 - protein, 7 aa, Mycobacterium
AGNDPST

SEQ ID NO: 422481 - protein, 12 aa, Mycobacterium
AGNDSTLSTAAA

SEQ ID NO: 422482 - protein, 8 aa, Mycobacterium
AGNDTEDI

SEQ ID NO: 422483 - protein, 12 aa, Mycobacterium
AGNDTTKQTTTH

SEQ ID NO: 422484 - protein, 8 aa, Mycobacterium
AGNEATRR

SEQ ID NO: 422485 - protein, 10 aa, Mycobacterium
AGNEDSRWAT

SEQ ID NO: 422486 - protein, 6 aa, Mycobacterium
AGNEKN

SEQ ID NO: 422487 - protein, 10 aa, Mycobacterium
AGNEMRPPEP

SEQ ID NO: 422488 - protein, 13 aa, Mycobacterium
AGNEQKPEPAPAH

SEQ ID NO: 422489 - protein, 7 aa, Mycobacterium
AGNERDR

SEQ ID NO: 422490 - protein, 7 aa, Mycobacterium
AGNESAV

SEQ ID NO: 422491 - protein, 9 aa, Mycobacterium
AGNEVTASY

SEQ ID NO: 422492 - protein, 13 aa, Mycobacterium
AGNGGAGGNGGVR

SEQ ID NO: 422493 - protein, 20 aa, Mycobacterium
AGNGGAGGSGAVGQRGGNGG

SEQ ID NO: 422494 - protein, 29 aa, Mycobacterium
AGNGGDGGQGGEADRTGGVGGMGGAGGAA

SEQ ID NO: 422495 - protein, 10 aa, Mycobacterium
AGNGGDGGTG

SEQ ID NO: 422496 - protein, 20 aa, Mycobacterium
AGNGGDSGGGGGSDETQSGV

SEQ ID NO: 422497 - protein, 49 aa, Mycobacterium
AGNGGIGGDGIGGGYGGDGGGGLTIGGAGGAGGEGSMGDGGIGGDGGFG

SEQ ID NO: 422498 - protein, 50 aa, Mycobacterium
AGNGGNGGVGGNASLVGNGGAGGAGGAGGTGSSLSYGGHGGNGGNGGTDG

SEQ ID NO: 422499 - protein, 12 aa, Mycobacterium
AGNGGNGGYGPT

SEQ ID NO: 422500 - protein, 9 aa, Mycobacterium
AGNGGNGVS

SEQ ID NO: 422501 - protein, 7 aa, Mycobacterium
AGNGGSS

SEQ ID NO: 422502 - protein, 12 aa, Mycobacterium
AGNGKSQILRTS

SEQ ID NO: 422503 - protein, 6 aa, Mycobacterium
AGNGLG

SEQ ID NO: 422504 - protein, 6 aa, Mycobacterium
AGNGMA

SEQ ID NO: 422505 - protein, 10 aa, Mycobacterium
AGNGMAGHTA

SEQ ID NO: 422506 - protein, 8 aa, Mycobacterium
AGNGMAGL

SEQ ID NO: 422507 - protein, 7 aa, Mycobacterium
AGNGMGR

SEQ ID NO: 422508 - protein, 9 aa, Mycobacterium
AGNGPDGRS

SEQ ID NO: 422509 - protein, 7 aa, Mycobacterium
AGNGPGV

SEQ ID NO: 422510 - protein, 8 aa, Mycobacterium
AGNGPSFC

SEQ ID NO: 422511 - protein, 7 aa, Mycobacterium
AGNGTKA

SEQ ID NO: 422512 - protein, 9 aa, Mycobacterium
AGNGVTAGQ

SEQ ID NO: 422513 - protein, 7 aa, Mycobacterium
AGNHGPG

SEQ ID NO: 422514 - protein, 6 aa, Mycobacterium
AGNIGN

SEQ ID NO: 422515 - protein, 4 aa, Mycobacterium
AGNK

SEQ ID NO: 422516 - protein, 4 aa, Mycobacterium
AGNL

SEQ ID NO: 422517 - protein, 7 aa, Mycobacterium
AGNLGGP

SEQ ID NO: 422518 - protein, 12 aa, Mycobacterium
AGNLTPAGTTAR

SEQ ID NO: 422519 - protein, 15 aa, Mycobacterium
AGNMGTPTQAASSAS

SEQ ID NO: 422520 - protein, 5 aa, Mycobacterium
AGNMP

SEQ ID NO: 422521 - protein, 11 aa, Mycobacterium
AGNMSKRQSAT

SEQ ID NO: 422522 - protein, 11 aa, Mycobacterium
AGNNGSGGEFE

SEQ ID NO: 422523 - protein, 8 aa, Mycobacterium
AGNNQTYT

SEQ ID NO: 422524 - protein, 7 aa, Mycobacterium
AGNNRAR

SEQ ID NO: 422525 - protein, 14 aa, Mycobacterium
AGNNSGAADDGRIS

SEQ ID NO: 422526 - protein, 7 aa, Mycobacterium
AGNPAQR

SEQ ID NO: 422527 - protein, 8 aa, Mycobacterium
AGNPDVTG

SEQ ID NO: 422528 - protein, 7 aa, Mycobacterium
AGNPEGE

SEQ ID NO: 422529 - protein, 9 aa, Mycobacterium
AGNPELDPD

SEQ ID NO: 422530 - protein, 11 aa, Mycobacterium
AGNPEPKPPRV

SEQ ID NO: 422531 - protein, 8 aa, Mycobacterium
AGNPEVDT

SEQ ID NO: 422532 - protein, 8 aa, Mycobacterium
AGNPFAPG

SEQ ID NO: 422533 - protein, 5 aa, Mycobacterium
AGNPH

SEQ ID NO: 422534 - protein, 7 aa, Mycobacterium
AGNPHAW

SEQ ID NO: 422535 - protein, 5 aa, Mycobacterium
AGNPI

SEQ ID NO: 422536 - protein, 15 aa, Mycobacterium
AGNPLPSDGKAVGEL

SEQ ID NO: 422537 - protein, 8 aa, Mycobacterium
AGNPNWGA

SEQ ID NO: 422538 - protein, 7 aa, Mycobacterium
AGNPPEI

SEQ ID NO: 422539 - protein, 10 aa, Mycobacterium
AGNPPGDDRV

SEQ ID NO: 422540 - protein, 7 aa, Mycobacterium
AGNPRNP

SEQ ID NO: 422541 - protein, 6 aa, Mycobacterium
AGNPRV

SEQ ID NO: 422542 - protein, 13 aa, Mycobacterium
AGNPSASNVGAAN

SEQ ID NO: 422543 - protein, 11 aa, Mycobacterium
AGNPSDDAITR

SEQ ID NO: 422544 - protein, 14 aa, Mycobacterium
AGNPTAAGGTGYGM

SEQ ID NO: 422545 - protein, 8 aa, Mycobacterium
AGNPTGAM

SEQ ID NO: 422546 - protein, 7 aa, Mycobacterium
AGNPWGT

SEQ ID NO: 422547 - protein, 43 aa, Mycobacterium
AGNQAAGPARAASAADQPRASGAAVSSVTEQSGISAATPRLAR

SEQ ID NO: 422548 - protein, 7 aa, Mycobacterium
AGNQEIT

SEQ ID NO: 422549 - protein, 8 aa, Mycobacterium
AGNQPMPN

SEQ ID NO: 422550 - protein, 7 aa, Mycobacterium
AGNQQAR

SEQ ID NO: 422551 - protein, 29 aa, Mycobacterium
AGNRAGPRAATRDGARPGPARYPARARAA

SEQ ID NO: 422552 - protein, 10 aa, Mycobacterium
AGNRGPAAVP

SEQ ID NO: 422553 - protein, 12 aa, Mycobacterium
AGNRGPTAAPQN

SEQ ID NO: 422554 - protein, 13 aa, Mycobacterium
AGNRQVKDARTAV

SEQ ID NO: 422555 - protein, 7 aa, Mycobacterium
AGNSAAM

SEQ ID NO: 422556 - protein, 8 aa, Mycobacterium
AGNSAAMA

SEQ ID NO: 422557 - protein, 21 aa, Mycobacterium
AGNSAGTAGPDGGSDTGAVAP

SEQ ID NO: 422558 - protein, 8 aa, Mycobacterium
AGNSGKQA

SEQ ID NO: 422559 - protein, 7 aa, Mycobacterium
AGNSGRI

SEQ ID NO: 422560 - protein, 14 aa, Mycobacterium
AGNSNTGAFNGGNV

SEQ ID NO: 422561 - protein, 9 aa, Mycobacterium
AGNSPSFQE

SEQ ID NO: 422562 - protein, 11 aa, Mycobacterium
AGNSSPLSDGS

SEQ ID NO: 422563 - protein, 6 aa, Mycobacterium
AGNSTV

SEQ ID NO: 422564 - protein, 5 aa, Mycobacterium
AGNSV

SEQ ID NO: 422565 - protein, 6 aa, Mycobacterium
AGNTAQ

SEQ ID NO: 422566 - protein, 5 aa, Mycobacterium
AGNTE

SEQ ID NO: 422567 - protein, 9 aa, Mycobacterium
AGNTELGPI

SEQ ID NO: 422568 - protein, 5 aa, Mycobacterium
AGNTF

SEQ ID NO: 422569 - protein, 19 aa, Mycobacterium
AGNTGGSAPCPPQRSDATW

SEQ ID NO: 422570 - protein, 6 aa, Mycobacterium
AGNTGY

SEQ ID NO: 422571 - protein, 11 aa, Mycobacterium
AGNTPEDRQWT

SEQ ID NO: 422572 - protein, 15 aa, Mycobacterium
AGNTSALPDAPRPYR

SEQ ID NO: 422573 - protein, 11 aa, Mycobacterium
AGNTSAPPAIW

SEQ ID NO: 422574 - protein, 7 aa, Mycobacterium
AGNVEEG

SEQ ID NO: 422575 - protein, 6 aa, Mycobacterium
AGNVGR

SEQ ID NO: 422576 - protein, 12 aa, Mycobacterium
AGNVGSANRGSF

SEQ ID NO: 422577 - protein, 6 aa, Mycobacterium
AGNVQG

SEQ ID NO: 422578 - protein, 7 aa, Mycobacterium
AGNVSSN

SEQ ID NO: 422579 - protein, 4 aa, Mycobacterium
AGNY

SEQ ID NO: 422580 - protein, 16 aa, Mycobacterium
AGNYEQQEQASQQILG

SEQ ID NO: 422581 - protein, 7 aa, Mycobacterium
AGPAAAA

SEQ ID NO: 422582 - protein, 8 aa, Mycobacterium
AGPAAAPR

SEQ ID NO: 422583 - protein, 12 aa, Mycobacterium
AGPAADESAVGD

SEQ ID NO: 422584 - protein, 9 aa, Mycobacterium
AGPAAGNGA

SEQ ID NO: 422585 - protein, 6 aa, Mycobacterium
AGPAAR

SEQ ID NO: 422586 - protein, 12 aa, Mycobacterium
AGPAATVDDGTG

SEQ ID NO: 422587 - protein, 8 aa, Mycobacterium
AGPADAPP

SEQ ID NO: 422588 - protein, 12 aa, Mycobacterium
AGPADDAEPMSA

SEQ ID NO: 422589 - protein, 7 aa, Mycobacterium
AGPADGP

SEQ ID NO: 422590 - protein, 8 aa, Mycobacterium
AGPADRTH

SEQ ID NO: 422591 - protein, 5 aa, Mycobacterium
AGPAE

SEQ ID NO: 422592 - protein, 8 aa, Mycobacterium
AGPAECPG

SEQ ID NO: 422593 - protein, 15 aa, Mycobacterium
AGPAEDGADGGQFGA

SEQ ID NO: 422594 - protein, 25 aa, Mycobacterium
AGPAEHRRTRAGDAHAEGRTPKTGV

SEQ ID NO: 422595 - protein, 12 aa, Mycobacterium
AGPAELAAGRDA

SEQ ID NO: 422596 - protein, 13 aa, Mycobacterium
AGPAEPGGSAPGM

SEQ ID NO: 422597 - protein, 12 aa, Mycobacterium
AGPAERAAAERR

SEQ ID NO: 422598 - protein, 11 aa, Mycobacterium
AGPAERLPPRA

SEQ ID NO: 422599 - protein, 8 aa, Mycobacterium
AGPAGAPR

SEQ ID NO: 422600 - protein, 8 aa, Mycobacterium
AGPAGATA

SEQ ID NO: 422601 - protein, 24 aa, Mycobacterium
AGPAGGPQSDAPFDAREAGKVGLS

SEQ ID NO: 422602 - protein, 7 aa, Mycobacterium
AGPAGIA

SEQ ID NO: 422603 - protein, 6 aa, Mycobacterium
AGPAGL

SEQ ID NO: 422604 - protein, 9 aa, Mycobacterium
AGPAGLKSA

SEQ ID NO: 422605 - protein, 8 aa, Mycobacterium
AGPAGLSA

SEQ ID NO: 422606 - protein, 21 aa, Mycobacterium
AGPAGPGRGGVPPPRLNPADV

SEQ ID NO: 422607 - protein, 9 aa, Mycobacterium
AGPAGRTEV

SEQ ID NO: 422608 - protein, 9 aa, Mycobacterium
AGPAGTAAP

SEQ ID NO: 422609 - protein, 12 aa, Mycobacterium
AGPAHAGGPGSF

SEQ ID NO: 422610 - protein, 14 aa, Mycobacterium
AGPAHYAGRASPGH

SEQ ID NO: 422611 - protein, 16 aa, Mycobacterium
AGPAIDIGPGDPVRTI

SEQ ID NO: 422612 - protein, 6 aa, Mycobacterium
AGPAIG

SEQ ID NO: 422613 - protein, 16 aa, Mycobacterium
AGPAKIPLPGPGPGQT

SEQ ID NO: 422614 - protein, 16 aa, Mycobacterium
AGPAKIPSPGPGPGQT

SEQ ID NO: 422615 - protein, 16 aa, Mycobacterium
AGPAKIPTPGPGPGQT

SEQ ID NO: 422616 - protein, 5 aa, Mycobacterium
AGPAL

SEQ ID NO: 422617 - protein, 6 aa, Mycobacterium
AGPALG

SEQ ID NO: 422618 - protein, 15 aa, Mycobacterium
AGPALSADAEQGGLA

SEQ ID NO: 422619 - protein, 16 aa, Mycobacterium
AGPALSADAEQGGLAG

SEQ ID NO: 422620 - protein, 16 aa, Mycobacterium
AGPALSAEAEEGGLAG

SEQ ID NO: 422621 - protein, 17 aa, Mycobacterium
AGPALSAEAEQGGLAGQ

SEQ ID NO: 422622 - protein, 16 aa, Mycobacterium
AGPALSTEAEEGGLAG

SEQ ID NO: 422623 - protein, 16 aa, Mycobacterium
AGPALSTEAEQGGLAG

SEQ ID NO: 422624 - protein, 5 aa, Mycobacterium
AGPAN

SEQ ID NO: 422625 - protein, 9 aa, Mycobacterium
AGPAPEVPG

SEQ ID NO: 422626 - protein, 6 aa, Mycobacterium
AGPAPM

SEQ ID NO: 422627 - protein, 8 aa, Mycobacterium
AGPAPQDM

SEQ ID NO: 422628 - protein, 7 aa, Mycobacterium
AGPAPQF

SEQ ID NO: 422629 - protein, 8 aa, Mycobacterium
AGPAPSAV

SEQ ID NO: 422630 - protein, 8 aa, Mycobacterium
AGPAQASI

SEQ ID NO: 422631 - protein, 7 aa, Mycobacterium
AGPARAA

SEQ ID NO: 422632 - protein, 17 aa, Mycobacterium
AGPARAGYTATKAASSA

SEQ ID NO: 422633 - protein, 12 aa, Mycobacterium
AGPARRGSARTT

SEQ ID NO: 422634 - protein, 6 aa, Mycobacterium
AGPARV

SEQ ID NO: 422635 - protein, 19 aa, Mycobacterium
AGPARWPAASATAAPTNSR

SEQ ID NO: 422636 - protein, 11 aa, Mycobacterium
AGPASDGPAPT

SEQ ID NO: 422637 - protein, 8 aa, Mycobacterium
AGPASTAR

SEQ ID NO: 422638 - protein, 27 aa, Mycobacterium
AGPATAGTDGASPKGPPVPAGAVGKPL

SEQ ID NO: 422639 - protein, 7 aa, Mycobacterium
AGPATDI

SEQ ID NO: 422640 - protein, 7 aa, Mycobacterium
AGPATGQ

SEQ ID NO: 422641 - protein, 9 aa, Mycobacterium
AGPATGSSA

SEQ ID NO: 422642 - protein, 22 aa, Mycobacterium
AGPATRLDEDGRIDSATTTDGR

SEQ ID NO: 422643 - protein, 7 aa, Mycobacterium
AGPATTM

SEQ ID NO: 422644 - protein, 7 aa, Mycobacterium
AGPAVPR

SEQ ID NO: 422645 - protein, 5 aa, Mycobacterium
AGPAW

SEQ ID NO: 422646 - protein, 5 aa, Mycobacterium
AGPAY

SEQ ID NO: 422647 - protein, 4 aa, Mycobacterium
AGPD

SEQ ID NO: 422648 - protein, 6 aa, Mycobacterium
AGPDAE

SEQ ID NO: 422649 - protein, 14 aa, Mycobacterium
AGPDAGSSAAGEQA

SEQ ID NO: 422650 - protein, 6 aa, Mycobacterium
AGPDAM

SEQ ID NO: 422651 - protein, 6 aa, Mycobacterium
AGPDDE

SEQ ID NO: 422652 - protein, 7 aa, Mycobacterium
AGPDDEL

SEQ ID NO: 422653 - protein, 8 aa, Mycobacterium
AGPDDVGA

SEQ ID NO: 422654 - protein, 5 aa, Mycobacterium
AGPDE

SEQ ID NO: 422655 - protein, 6 aa, Mycobacterium
AGPDED

SEQ ID NO: 422656 - protein, 7 aa, Mycobacterium
AGPDESD

SEQ ID NO: 422657 - protein, 13 aa, Mycobacterium
AGPDFASGSVPRQ

SEQ ID NO: 422658 - protein, 15 aa, Mycobacterium
AGPDFDADNAPHDDL

SEQ ID NO: 422659 - protein, 5 aa, Mycobacterium
AGPDG

SEQ ID NO: 422660 - protein, 8 aa, Mycobacterium
AGPDGADA

SEQ ID NO: 422661 - protein, 8 aa, Mycobacterium
AGPDGATI

SEQ ID NO: 422662 - protein, 17 aa, Mycobacterium
AGPDGATRPPAGRETAT

SEQ ID NO: 422663 - protein, 17 aa, Mycobacterium
AGPDGAVRPPDGRETAT

SEQ ID NO: 422664 - protein, 7 aa, Mycobacterium
AGPDGGR

SEQ ID NO: 422665 - protein, 8 aa, Mycobacterium
AGPDGIEA

SEQ ID NO: 422666 - protein, 17 aa, Mycobacterium
AGPDGIRRSQADHTYGY

SEQ ID NO: 422667 - protein, 7 aa, Mycobacterium
AGPDGPR

SEQ ID NO: 422668 - protein, 13 aa, Mycobacterium
AGPDGRPAPAGEV

SEQ ID NO: 422669 - protein, 17 aa, Mycobacterium
AGPDGSPRPPDGRETAT

SEQ ID NO: 422670 - protein, 17 aa, Mycobacterium
AGPDGSPRPPGGRETAT

SEQ ID NO: 422671 - protein, 27 aa, Mycobacterium
AGPDGTIQTGSPTLAGKDQTVGPSGAC

SEQ ID NO: 422672 - protein, 10 aa, Mycobacterium
AGPDHGLPQE

SEQ ID NO: 422673 - protein, 10 aa, Mycobacterium
AGPDHGVPQD

SEQ ID NO: 422674 - protein, 21 aa, Mycobacterium
AGPDHPHAAQQPIPFEIKQVA

SEQ ID NO: 422675 - protein, 16 aa, Mycobacterium
AGPDIASRGLDPQAQA

SEQ ID NO: 422676 - protein, 8 aa, Mycobacterium
AGPDKGSN

SEQ ID NO: 422677 - protein, 6 aa, Mycobacterium
AGPDLR

SEQ ID NO: 422678 - protein, 10 aa, Mycobacterium
AGPDNAEADE

SEQ ID NO: 422679 - protein, 7 aa, Mycobacterium
AGPDNDE

SEQ ID NO: 422680 - protein, 14 aa, Mycobacterium
AGPDPANPADPNYS

SEQ ID NO: 422681 - protein, 10 aa, Mycobacterium
AGPDPDDDAL

SEQ ID NO: 422682 - protein, 10 aa, Mycobacterium
AGPDPDEVRS

SEQ ID NO: 422683 - protein, 11 aa, Mycobacterium
AGPDPQTASNP

SEQ ID NO: 422684 - protein, 18 aa, Mycobacterium
AGPDPTPTPEDGDTEDPL

SEQ ID NO: 422685 - protein, 10 aa, Mycobacterium
AGPDQRDKLG

SEQ ID NO: 422686 - protein, 8 aa, Mycobacterium
AGPDRADK

SEQ ID NO: 422687 - protein, 7 aa, Mycobacterium
AGPDRAE

SEQ ID NO: 422688 - protein, 8 aa, Mycobacterium
AGPDRAEK

SEQ ID NO: 422689 - protein, 8 aa, Mycobacterium
AGPDRGEK

SEQ ID NO: 422690 - protein, 6 aa, Mycobacterium
AGPDRP

SEQ ID NO: 422691 - protein, 12 aa, Mycobacterium
AGPDRPAQARGL

SEQ ID NO: 422692 - protein, 10 aa, Mycobacterium
AGPDSGLTAP

SEQ ID NO: 422693 - protein, 9 aa, Mycobacterium
AGPDTDARY

SEQ ID NO: 422694 - protein, 11 aa, Mycobacterium
AGPDTDLDGDG

SEQ ID NO: 422695 - protein, 11 aa, Mycobacterium
AGPDTDTYPAG

SEQ ID NO: 422696 - protein, 9 aa, Mycobacterium
AGPDTEVPP

SEQ ID NO: 422697 - protein, 9 aa, Mycobacterium
AGPDTPPVQ

SEQ ID NO: 422698 - protein, 29 aa, Mycobacterium
AGPDWRPDRPEAPGDDLSTVGADVTGPAV

SEQ ID NO: 422699 - protein, 6 aa, Mycobacterium
AGPDYA

SEQ ID NO: 422700 - protein, 4 aa, Mycobacterium
AGPE

SEQ ID NO: 422701 - protein, 7 aa, Mycobacterium
AGPEAAA

SEQ ID NO: 422702 - protein, 9 aa, Mycobacterium
AGPEAATDL

SEQ ID NO: 422703 - protein, 8 aa, Mycobacterium
AGPEADEA

SEQ ID NO: 422704 - protein, 9 aa, Mycobacterium
AGPEAQEEL

SEQ ID NO: 422705 - protein, 9 aa, Mycobacterium
AGPEATPSF

SEQ ID NO: 422706 - protein, 12 aa, Mycobacterium
AGPEDAGQSFDT

SEQ ID NO: 422707 - protein, 7 aa, Mycobacterium
AGPEDVD

SEQ ID NO: 422708 - protein, 7 aa, Mycobacterium
AGPEEAE

SEQ ID NO: 422709 - protein, 5 aa, Mycobacterium
AGPEG

SEQ ID NO: 422710 - protein, 11 aa, Mycobacterium
AGPEGSDRAER

SEQ ID NO: 422711 - protein, 10 aa, Mycobacterium
AGPEGSDRPE

SEQ ID NO: 422712 - protein, 11 aa, Mycobacterium
AGPEGSDRPER

SEQ ID NO: 422713 - protein, 12 aa, Mycobacterium
AGPEGSDRPQRH

SEQ ID NO: 422714 - protein, 5 aa, Mycobacterium
AGPEH

SEQ ID NO: 422715 - protein, 21 aa, Mycobacterium
AGPEHPHTAQQPVPFEIKQVA

SEQ ID NO: 422716 - protein, 10 aa, Mycobacterium
AGPEKATEAI

SEQ ID NO: 422717 - protein, 19 aa, Mycobacterium
AGPEKRAQTAQDVANAPAF

SEQ ID NO: 422718 - protein, 6 aa, Mycobacterium
AGPELE

SEQ ID NO: 422719 - protein, 9 aa, Mycobacterium
AGPENPEAD

SEQ ID NO: 422720 - protein, 13 aa, Mycobacterium
AGPEPGPAPGPVS

SEQ ID NO: 422721 - protein, 5 aa, Mycobacterium
AGPEQ

SEQ ID NO: 422722 - protein, 8 aa, Mycobacterium
AGPEQATG

SEQ ID NO: 422723 - protein, 6 aa, Mycobacterium
AGPEQM

SEQ ID NO: 422724 - protein, 6 aa, Mycobacterium
AGPERA

SEQ ID NO: 422725 - protein, 10 aa, Mycobacterium
AGPESGSPQA

SEQ ID NO: 422726 - protein, 21 aa, Mycobacterium
AGPESQDGTAPEQLPRTLPRG

SEQ ID NO: 422727 - protein, 6 aa, Mycobacterium
AGPEVA

SEQ ID NO: 422728 - protein, 6 aa, Mycobacterium
AGPEVR

SEQ ID NO: 422729 - protein, 7 aa, Mycobacterium
AGPEYGG

SEQ ID NO: 422730 - protein, 7 aa, Mycobacterium
AGPFGED

SEQ ID NO: 422731 - protein, 14 aa, Mycobacterium
AGPGAAAVRGPSRI

SEQ ID NO: 422732 - protein, 9 aa, Mycobacterium
AGPGAALDA

SEQ ID NO: 422733 - protein, 6 aa, Mycobacterium
AGPGAE

SEQ ID NO: 422734 - protein, 10 aa, Mycobacterium
AGPGAGEYPT

SEQ ID NO: 422735 - protein, 7 aa, Mycobacterium
AGPGAGL

SEQ ID NO: 422736 - protein, 43 aa, Mycobacterium
AGPGAGRPAAHRPDRVPGGGAAADRRPGARHGGLPNHPGDNGF

SEQ ID NO: 422737 - protein, 8 aa, Mycobacterium
AGPGAGSL

SEQ ID NO: 422738 - protein, 6 aa, Mycobacterium
AGPGAH

SEQ ID NO: 422739 - protein, 8 aa, Mycobacterium
AGPGAPID

SEQ ID NO: 422740 - protein, 7 aa, Mycobacterium
AGPGAPL

SEQ ID NO: 422741 - protein, 12 aa, Mycobacterium
AGPGAPNQPDDH

SEQ ID NO: 422742 - protein, 7 aa, Mycobacterium
AGPGASY

SEQ ID NO: 422743 - protein, 17 aa, Mycobacterium
AGPGATESTTESAARLE

SEQ ID NO: 422744 - protein, 8 aa, Mycobacterium
AGPGDEID

SEQ ID NO: 422745 - protein, 7 aa, Mycobacterium
AGPGDSI

SEQ ID NO: 422746 - protein, 10 aa, Mycobacterium
AGPGDSPGKL

SEQ ID NO: 422747 - protein, 6 aa, Mycobacterium
AGPGDY

SEQ ID NO: 422748 - protein, 9 aa, Mycobacterium
AGPGEGSIG

SEQ ID NO: 422749 - protein, 16 aa, Mycobacterium
AGPGFGNSSTSPSSGF

SEQ ID NO: 422750 - protein, 9 aa, Mycobacterium
AGPGFRPSA

SEQ ID NO: 422751 - protein, 7 aa, Mycobacterium
AGPGGIA

SEQ ID NO: 422752 - protein, 11 aa, Mycobacterium
AGPGGNGGDAR

SEQ ID NO: 422753 - protein, 8 aa, Mycobacterium
AGPGGSGV

SEQ ID NO: 422754 - protein, 15 aa, Mycobacterium
AGPGGSRGTGGMASK

SEQ ID NO: 422755 - protein, 6 aa, Mycobacterium
AGPGGT

SEQ ID NO: 422756 - protein, 8 aa, Mycobacterium
AGPGGTPL

SEQ ID NO: 422757 - protein, 14 aa, Mycobacterium
AGPGGYGTGPRYGV

SEQ ID NO: 422758 - protein, 10 aa, Mycobacterium
AGPGGYLTPE

SEQ ID NO: 422759 - protein, 5 aa, Mycobacterium
AGPGI

SEQ ID NO: 422760 - protein, 7 aa, Mycobacterium
AGPGIPE

SEQ ID NO: 422761 - protein, 7 aa, Mycobacterium
AGPGKGF

SEQ ID NO: 422762 - protein, 6 aa, Mycobacterium
AGPGKK

SEQ ID NO: 422763 - protein, 6 aa, Mycobacterium
AGPGKR

SEQ ID NO: 422764 - protein, 16 aa, Mycobacterium
AGPGLPSTFGGEVTTA

SEQ ID NO: 422765 - protein, 8 aa, Mycobacterium
AGPGLRVS

SEQ ID NO: 422766 - protein, 7 aa, Mycobacterium
AGPGNAD

SEQ ID NO: 422767 - protein, 7 aa, Mycobacterium
AGPGNAY

SEQ ID NO: 422768 - protein, 7 aa, Mycobacterium
AGPGNKY

SEQ ID NO: 422769 - protein, 5 aa, Mycobacterium
AGPGP

SEQ ID NO: 422770 - protein, 9 aa, Mycobacterium
AGPGPGSLA

SEQ ID NO: 422771 - protein, 14 aa, Mycobacterium
AGPGPGSLSAAAAG

SEQ ID NO: 422772 - protein, 6 aa, Mycobacterium
AGPGPL

SEQ ID NO: 422773 - protein, 6 aa, Mycobacterium
AGPGPM

SEQ ID NO: 422774 - protein, 9 aa, Mycobacterium
AGPGQPTGE

SEQ ID NO: 422775 - protein, 8 aa, Mycobacterium
AGPGQVDV

SEQ ID NO: 422776 - protein, 15 aa, Mycobacterium
AGPGRAGRSGTSGAA

SEQ ID NO: 422777 - protein, 7 aa, Mycobacterium
AGPGRDV

SEQ ID NO: 422778 - protein, 6 aa, Mycobacterium
AGPGRF

SEQ ID NO: 422779 - protein, 11 aa, Mycobacterium
AGPGRPNQPDA

SEQ ID NO: 422780 - protein, 8 aa, Mycobacterium
AGPGSGPM

SEQ ID NO: 422781 - protein, 12 aa, Mycobacterium
AGPGSGPSEDGD

SEQ ID NO: 422782 - protein, 7 aa, Mycobacterium
AGPGSID

SEQ ID NO: 422783 - protein, 12 aa, Mycobacterium
AGPGSPNDPDTH

SEQ ID NO: 422784 - protein, 7 aa, Mycobacterium
AGPGSTN

SEQ ID NO: 422785 - protein, 8 aa, Mycobacterium
AGPGTQRK

SEQ ID NO: 422786 - protein, 6 aa, Mycobacterium
AGPGTR

SEQ ID NO: 422787 - protein, 15 aa, Mycobacterium
AGPGVNAAGSAPRYG

SEQ ID NO: 422788 - protein, 19 aa, Mycobacterium
AGPGWYQSDDNTARVPGSP

SEQ ID NO: 422789 - protein, 16 aa, Mycobacterium
AGPGYLNSSATPSSGF

SEQ ID NO: 422790 - protein, 12 aa, Mycobacterium
AGPHAGGVDPKI

SEQ ID NO: 422791 - protein, 10 aa, Mycobacterium
AGPHAPAPEL

SEQ ID NO: 422792 - protein, 6 aa, Mycobacterium
AGPHDR

SEQ ID NO: 422793 - protein, 7 aa, Mycobacterium
AGPHPLR

SEQ ID NO: 422794 - protein, 14 aa, Mycobacterium
AGPHPNAAKANLGQ

SEQ ID NO: 422795 - protein, 5 aa, Mycobacterium
AGPHV

SEQ ID NO: 422796 - protein, 12 aa, Mycobacterium
AGPIDAPDPKVD

SEQ ID NO: 422797 - protein, 9 aa, Mycobacterium
AGPIDENAK

SEQ ID NO: 422798 - protein, 10 aa, Mycobacterium
AGPIDKGENS

SEQ ID NO: 422799 - protein, 11 aa, Mycobacterium
AGPIDLPGGTI

SEQ ID NO: 422800 - protein, 5 aa, Mycobacterium
AGPIG

SEQ ID NO: 422801 - protein, 7 aa, Mycobacterium
AGPIGDD

SEQ ID NO: 422802 - protein, 8 aa, Mycobacterium
AGPIGDDD

SEQ ID NO: 422803 - protein, 7 aa, Mycobacterium
AGPITSA

SEQ ID NO: 422804 - protein, 8 aa, Mycobacterium
AGPKDKDM

SEQ ID NO: 422805 - protein, 6 aa, Mycobacterium
AGPKEA

SEQ ID NO: 422806 - protein, 7 aa, Mycobacterium
AGPKESR

SEQ ID NO: 422807 - protein, 7 aa, Mycobacterium
AGPKGIA

SEQ ID NO: 422808 - protein, 12 aa, Mycobacterium
AGPKIVEPSCGD

SEQ ID NO: 422809 - protein, 10 aa, Mycobacterium
AGPKKLADRI

SEQ ID NO: 422810 - protein, 42 aa, Mycobacterium
AGPKPASRSGQSSAPGAGNPDGFSDRPRYAPGEKVATRAAYG

SEQ ID NO: 422811 - protein, 10 aa, Mycobacterium
AGPKPLPTPA

SEQ ID NO: 422812 - protein, 10 aa, Mycobacterium
AGPKQAASAS

SEQ ID NO: 422813 - protein, 9 aa, Mycobacterium
AGPKVTDNP

SEQ ID NO: 422814 - protein, 5 aa, Mycobacterium
AGPLA

SEQ ID NO: 422815 - protein, 7 aa, Mycobacterium
AGPLAAR

SEQ ID NO: 422816 - protein, 16 aa, Mycobacterium
AGPLADSAAADLGIDG

SEQ ID NO: 422817 - protein, 5 aa, Mycobacterium
AGPLD

SEQ ID NO: 422818 - protein, 7 aa, Mycobacterium
AGPLDRD

SEQ ID NO: 422819 - protein, 8 aa, Mycobacterium
AGPLGAAQ

SEQ ID NO: 422820 - protein, 6 aa, Mycobacterium
AGPLPA

SEQ ID NO: 422821 - protein, 6 aa, Mycobacterium
AGPLPE

SEQ ID NO: 422822 - protein, 9 aa, Mycobacterium
AGPLPEGMR

SEQ ID NO: 422823 - protein, 11 aa, Mycobacterium
AGPLPTKPGAR

SEQ ID NO: 422824 - protein, 7 aa, Mycobacterium
AGPLPVR

SEQ ID NO: 422825 - protein, 13 aa, Mycobacterium
AGPLQADAQVRSS

SEQ ID NO: 422826 - protein, 5 aa, Mycobacterium
AGPLR

SEQ ID NO: 422827 - protein, 5 aa, Mycobacterium
AGPLT

SEQ ID NO: 422828 - protein, 7 aa, Mycobacterium
AGPLTGR

SEQ ID NO: 422829 - protein, 18 aa, Mycobacterium
AGPLTTGSIEIPTGESDS

SEQ ID NO: 422830 - protein, 5 aa, Mycobacterium
AGPMG

SEQ ID NO: 422831 - protein, 7 aa, Mycobacterium
AGPMGAG

SEQ ID NO: 422832 - protein, 10 aa, Mycobacterium
AGPMGAQAAN

SEQ ID NO: 422833 - protein, 9 aa, Mycobacterium
AGPMNRPPD

SEQ ID NO: 422834 - protein, 9 aa, Mycobacterium
AGPMSDDDA

SEQ ID NO: 422835 - protein, 4 aa, Mycobacterium
AGPN

SEQ ID NO: 422836 - protein, 6 aa, Mycobacterium
AGPNAR

SEQ ID NO: 422837 - protein, 6 aa, Mycobacterium
AGPNCD

SEQ ID NO: 422838 - protein, 14 aa, Mycobacterium
AGPNDPKDSACERA

SEQ ID NO: 422839 - protein, 5 aa, Mycobacterium
AGPNG

SEQ ID NO: 422840 - protein, 8 aa, Mycobacterium
AGPNHGVS

SEQ ID NO: 422841 - protein, 11 aa, Mycobacterium
AGPNNAALSAA

SEQ ID NO: 422842 - protein, 7 aa, Mycobacterium
AGPNNAL

SEQ ID NO: 422843 - protein, 8 aa, Mycobacterium
AGPNNRYE

SEQ ID NO: 422844 - protein, 6 aa, Mycobacterium
AGPNPP

SEQ ID NO: 422845 - protein, 8 aa, Mycobacterium
AGPNQRDK

SEQ ID NO: 422846 - protein, 7 aa, Mycobacterium
AGPNSAI

SEQ ID NO: 422847 - protein, 19 aa, Mycobacterium
AGPNSAIPHHRPTDAALAT

SEQ ID NO: 422848 - protein, 18 aa, Mycobacterium
AGPNSAIPHHRPTDATLA

SEQ ID NO: 422849 - protein, 9 aa, Mycobacterium
AGPPAGDAW

SEQ ID NO: 422850 - protein, 7 aa, Mycobacterium
AGPPAQV

SEQ ID NO: 422851 - protein, 7 aa, Mycobacterium
AGPPDAL

SEQ ID NO: 422852 - protein, 11 aa, Mycobacterium
AGPPDDPRIPE

SEQ ID NO: 422853 - protein, 7 aa, Mycobacterium
AGPPDQV

SEQ ID NO: 422854 - protein, 6 aa, Mycobacterium
AGPPEA

SEQ ID NO: 422855 - protein, 7 aa, Mycobacterium
AGPPESV

SEQ ID NO: 422856 - protein, 9 aa, Mycobacterium
AGPPGAGTR

SEQ ID NO: 422857 - protein, 6 aa, Mycobacterium
AGPPGF

SEQ ID NO: 422858 - protein, 17 aa, Mycobacterium
AGPPGGGRTAGQFDGGV

SEQ ID NO: 422859 - protein, 17 aa, Mycobacterium
AGPPGGGRVAGQFAGRQ

SEQ ID NO: 422860 - protein, 9 aa, Mycobacterium
AGPPGQHAG

SEQ ID NO: 422861 - protein, 8 aa, Mycobacterium
AGPPGSLG

SEQ ID NO: 422862 - protein, 10 aa, Mycobacterium
AGPPGSPGKL

SEQ ID NO: 422863 - protein, 6 aa, Mycobacterium
AGPPLE

SEQ ID NO: 422864 - protein, 6 aa, Mycobacterium
AGPPPC

SEQ ID NO: 422865 - protein, 6 aa, Mycobacterium
AGPPPE

SEQ ID NO: 422866 - protein, 39 aa, Mycobacterium
AGPPPETQPAPGAVEPSHPNNSGEPTSDDGRPRFSPPEA

SEQ ID NO: 422867 - protein, 9 aa, Mycobacterium
AGPPPMPSF

SEQ ID NO: 422868 - protein, 13 aa, Mycobacterium
AGPPPRSTGPAKT

SEQ ID NO: 422869 - protein, 6 aa, Mycobacterium
AGPPRN

SEQ ID NO: 422870 - protein, 6 aa, Mycobacterium
AGPPRQ

SEQ ID NO: 422871 - protein, 24 aa, Mycobacterium
AGPPTAHRRASRRPCDSTPRLHEQ

SEQ ID NO: 422872 - protein, 8 aa, Mycobacterium
AGPPTGDA

SEQ ID NO: 422873 - protein, 10 aa, Mycobacterium
AGPPTGSAGF

SEQ ID NO: 422874 - protein, 7 aa, Mycobacterium
AGPPTTE

SEQ ID NO: 422875 - protein, 9 aa, Mycobacterium
AGPPTTLYS

SEQ ID NO: 422876 - protein, 7 aa, Mycobacterium
AGPQAWA

SEQ ID NO: 422877 - protein, 7 aa, Mycobacterium
AGPQDGR

SEQ ID NO: 422878 - protein, 10 aa, Mycobacterium
AGPQGSDRPH

SEQ ID NO: 422879 - protein, 6 aa, Mycobacterium
AGPQLG

SEQ ID NO: 422880 - protein, 6 aa, Mycobacterium
AGPQPM

SEQ ID NO: 422881 - protein, 7 aa, Mycobacterium
AGPQQVD

SEQ ID NO: 422882 - protein, 5 aa, Mycobacterium
AGPQS

SEQ ID NO: 422883 - protein, 10 aa, Mycobacterium
AGPQSEDERV

SEQ ID NO: 422884 - protein, 8 aa, Mycobacterium
AGPQSGWA

SEQ ID NO: 422885 - protein, 7 aa, Mycobacterium
AGPQSLS

SEQ ID NO: 422886 - protein, 5 aa, Mycobacterium
AGPQV

SEQ ID NO: 422887 - protein, 7 aa, Mycobacterium
AGPRAGW

SEQ ID NO: 422888 - protein, 5 aa, Mycobacterium
AGPRD

SEQ ID NO: 422889 - protein, 6 aa, Mycobacterium
AGPREP

SEQ ID NO: 422890 - protein, 5 aa, Mycobacterium
AGPRG

SEQ ID NO: 422891 - protein, 7 aa, Mycobacterium
AGPRGGL

SEQ ID NO: 422892 - protein, 9 aa, Mycobacterium
AGPRGPRGS

SEQ ID NO: 422893 - protein, 7 aa, Mycobacterium
AGPRIGR

SEQ ID NO: 422894 - protein, 6 aa, Mycobacterium
AGPRLG

SEQ ID NO: 422895 - protein, 5 aa, Mycobacterium
AGPRP

SEQ ID NO: 422896 - protein, 6 aa, Mycobacterium
AGPRPA

SEQ ID NO: 422897 - protein, 15 aa, Mycobacterium
AGPRPAWRARTDGRP

SEQ ID NO: 422898 - protein, 8 aa, Mycobacterium
AGPRPDRE

SEQ ID NO: 422899 - protein, 11 aa, Mycobacterium
AGPRQAQEAGI

SEQ ID NO: 422900 - protein, 7 aa, Mycobacterium
AGPRRYA

SEQ ID NO: 422901 - protein, 6 aa, Mycobacterium
AGPRST

SEQ ID NO: 422902 - protein, 12 aa, Mycobacterium
AGPRSTDAGWPF

SEQ ID NO: 422903 - protein, 14 aa, Mycobacterium
AGPRTQAPASGTAV

SEQ ID NO: 422904 - protein, 5 aa, Mycobacterium
AGPRV

SEQ ID NO: 422905 - protein, 6 aa, Mycobacterium
AGPRYT

SEQ ID NO: 422906 - protein, 8 aa, Mycobacterium
AGPSAEGG

SEQ ID NO: 422907 - protein, 6 aa, Mycobacterium
AGPSCD

SEQ ID NO: 422908 - protein, 9 aa, Mycobacterium
AGPSDDPFG

SEQ ID NO: 422909 - protein, 10 aa, Mycobacterium
AGPSEQGAAS

SEQ ID NO: 422910 - protein, 7 aa, Mycobacterium
AGPSGAH

SEQ ID NO: 422911 - protein, 11 aa, Mycobacterium
AGPSGGFGDPA

SEQ ID NO: 422912 - protein, 11 aa, Mycobacterium
AGPSHGRDKPS

SEQ ID NO: 422913 - protein, 7 aa, Mycobacterium
AGPSKFH

SEQ ID NO: 422914 - protein, 10 aa, Mycobacterium
AGPSLVPGDV

SEQ ID NO: 422915 - protein, 7 aa, Mycobacterium
AGPSPRG

SEQ ID NO: 422916 - protein, 18 aa, Mycobacterium
AGPSSDIEEALRRFGAWL

SEQ ID NO: 422917 - protein, 13 aa, Mycobacterium
AGPSSGALKNNPA

SEQ ID NO: 422918 - protein, 6 aa, Mycobacterium
AGPSSM

SEQ ID NO: 422919 - protein, 6 aa, Mycobacterium
AGPSST

SEQ ID NO: 422920 - protein, 6 aa, Mycobacterium
AGPSTR

SEQ ID NO: 422921 - protein, 6 aa, Mycobacterium
AGPSVS

SEQ ID NO: 422922 - protein, 6 aa, Mycobacterium
AGPSWA

SEQ ID NO: 422923 - protein, 8 aa, Mycobacterium
AGPSWAGD

SEQ ID NO: 422924 - protein, 6 aa, Mycobacterium
AGPSYY

SEQ ID NO: 422925 - protein, 6 aa, Mycobacterium
AGPTAE

SEQ ID NO: 422926 - protein, 13 aa, Mycobacterium
AGPTAGSLPLKPS

SEQ ID NO: 422927 - protein, 12 aa, Mycobacterium
AGPTAGSLPLQP

SEQ ID NO: 422928 - protein, 10 aa, Mycobacterium
AGPTAGSLSL

SEQ ID NO: 422929 - protein, 10 aa, Mycobacterium
AGPTAGSLTC

SEQ ID NO: 422930 - protein, 23 aa, Mycobacterium
AGPTARRVPGRSGEQLTAQETQV

SEQ ID NO: 422931 - protein, 9 aa, Mycobacterium
AGPTATLRD

SEQ ID NO: 422932 - protein, 10 aa, Mycobacterium
AGPTAVPYGP

SEQ ID NO: 422933 - protein, 5 aa, Mycobacterium
AGPTC

SEQ ID NO: 422934 - protein, 11 aa, Mycobacterium
AGPTDDDDAVA

SEQ ID NO: 422935 - protein, 16 aa, Mycobacterium
AGPTDSTVDPSSAWQS

SEQ ID NO: 422936 - protein, 6 aa, Mycobacterium
AGPTEF

SEQ ID NO: 422937 - protein, 9 aa, Mycobacterium
AGPTEQPKG

SEQ ID NO: 422938 - protein, 21 aa, Mycobacterium
AGPTERARHKSRRRQPRPPQI

SEQ ID NO: 422939 - protein, 5 aa, Mycobacterium
AGPTG

SEQ ID NO: 422940 - protein, 6 aa, Mycobacterium
AGPTGF

SEQ ID NO: 422941 - protein, 7 aa, Mycobacterium
AGPTGGG

SEQ ID NO: 422942 - protein, 6 aa, Mycobacterium
AGPTGH

SEQ ID NO: 422943 - protein, 6 aa, Mycobacterium
AGPTGR

SEQ ID NO: 422944 - protein, 8 aa, Mycobacterium
AGPTGVTA

SEQ ID NO: 422945 - protein, 8 aa, Mycobacterium
AGPTHTAG

SEQ ID NO: 422946 - protein, 7 aa, Mycobacterium
AGPTIAS

SEQ ID NO: 422947 - protein, 7 aa, Mycobacterium
AGPTPRI

SEQ ID NO: 422948 - protein, 7 aa, Mycobacterium
AGPTRDP

SEQ ID NO: 422949 - protein, 7 aa, Mycobacterium
AGPTSIE

SEQ ID NO: 422950 - protein, 8 aa, Mycobacterium
AGPTSLGD

SEQ ID NO: 422951 - protein, 9 aa, Mycobacterium
AGPTTAQAQ

SEQ ID NO: 422952 - protein, 14 aa, Mycobacterium
AGPTTGRALAEQGA

SEQ ID NO: 422953 - protein, 7 aa, Mycobacterium
AGPTTLG

SEQ ID NO: 422954 - protein, 5 aa, Mycobacterium
AGPTW

SEQ ID NO: 422955 - protein, 6 aa, Mycobacterium
AGPVAG

SEQ ID NO: 422956 - protein, 5 aa, Mycobacterium
AGPVE

SEQ ID NO: 422957 - protein, 6 aa, Mycobacterium
AGPVGA

SEQ ID NO: 422958 - protein, 10 aa, Mycobacterium
AGPVGAPPMA

SEQ ID NO: 422959 - protein, 6 aa, Mycobacterium
AGPVGT

SEQ ID NO: 422960 - protein, 41 aa, Mycobacterium
AGPVHARSGPTEGAGDEPRRGQAGPADIPCGDTGSGDVQLA

SEQ ID NO: 422961 - protein, 6 aa, Mycobacterium
AGPVNA

SEQ ID NO: 422962 - protein, 8 aa, Mycobacterium
AGPVPQAD

SEQ ID NO: 422963 - protein, 8 aa, Mycobacterium
AGPVPQAE

SEQ ID NO: 422964 - protein, 15 aa, Mycobacterium
AGPVPVGPAEATRAR

SEQ ID NO: 422965 - protein, 8 aa, Mycobacterium
AGPVQEDT

SEQ ID NO: 422966 - protein, 14 aa, Mycobacterium
AGPVTAPGERTPGL

SEQ ID NO: 422967 - protein, 8 aa, Mycobacterium
AGPVTGPL

SEQ ID NO: 422968 - protein, 10 aa, Mycobacterium
AGPWAGPSSL

SEQ ID NO: 422969 - protein, 11 aa, Mycobacterium
AGPWEGSSAEQ

SEQ ID NO: 422970 - protein, 12 aa, Mycobacterium
AGPWESQQTHDS

SEQ ID NO: 422971 - protein, 18 aa, Mycobacterium
AGPYAALGSRAPDAVDKG

SEQ ID NO: 422972 - protein, 7 aa, Mycobacterium
AGPYAST

SEQ ID NO: 422973 - protein, 9 aa, Mycobacterium
AGPYETTLA

SEQ ID NO: 422974 - protein, 6 aa, Mycobacterium
AGPYGT

SEQ ID NO: 422975 - protein, 11 aa, Mycobacterium
AGPYQRDRGPS

SEQ ID NO: 422976 - protein, 10 aa, Mycobacterium
AGQAAAHAGI

SEQ ID NO: 422977 - protein, 6 aa, Mycobacterium
AGQAAG

SEQ ID NO: 422978 - protein, 10 aa, Mycobacterium
AGQAANAIPQ

SEQ ID NO: 422979 - protein, 7 aa, Mycobacterium
AGQAAPI

SEQ ID NO: 422980 - protein, 8 aa, Mycobacterium
AGQAAQRD

SEQ ID NO: 422981 - protein, 5 aa, Mycobacterium
AGQAD

SEQ ID NO: 422982 - protein, 12 aa, Mycobacterium
AGQADDGGDWRE

SEQ ID NO: 422983 - protein, 9 aa, Mycobacterium
AGQADLGGT

SEQ ID NO: 422984 - protein, 23 aa, Mycobacterium
AGQADPGAAQAESGSGAPTGVGG

SEQ ID NO: 422985 - protein, 21 aa, Mycobacterium
AGQADPGESLTASGAPTGVGG

SEQ ID NO: 422986 - protein, 9 aa, Mycobacterium
AGQADSNLP

SEQ ID NO: 422987 - protein, 5 aa, Mycobacterium
AGQAE

SEQ ID NO: 422988 - protein, 11 aa, Mycobacterium
AGQAEKEVGDQ

SEQ ID NO: 422989 - protein, 10 aa, Mycobacterium
AGQAEQAAAQ

SEQ ID NO: 422990 - protein, 16 aa, Mycobacterium
AGQAESTAGQATAAAA

SEQ ID NO: 422991 - protein, 8 aa, Mycobacterium
AGQAETAG

SEQ ID NO: 422992 - protein, 9 aa, Mycobacterium
AGQAGGANI

SEQ ID NO: 422993 - protein, 9 aa, Mycobacterium
AGQAGPSLA

SEQ ID NO: 422994 - protein, 6 aa, Mycobacterium
AGQAGV

SEQ ID NO: 422995 - protein, 15 aa, Mycobacterium
AGQALPEHRPAHTPV

SEQ ID NO: 422996 - protein, 108 aa, Mycobacterium
AGQALQAATQAGAQAAQLAGQAAAAPDVDRADTDEDTDKDPDAEGDKDSDKRDGEGKEDGTAPRDRESTDAMGADDDDRNAHPQAGSGTDSAGEDDKKPAMTLPPDLQ

SEQ ID NO: 422997 - protein, 6 aa, Mycobacterium
AGQANE

SEQ ID NO: 422998 - protein, 6 aa, Mycobacterium
AGQAPF

SEQ ID NO: 422999 - protein, 7 aa, Mycobacterium
AGQAPGW

SEQ ID NO: 423000 - protein, 7 aa, Mycobacterium
AGQAPIK

SEQ ID NO: 423001 - protein, 6 aa, Mycobacterium
AGQASV

SEQ ID NO: 423002 - protein, 5 aa, Mycobacterium
AGQAT

SEQ ID NO: 423003 - protein, 6 aa, Mycobacterium
AGQATL

SEQ ID NO: 423004 - protein, 11 aa, Mycobacterium
AGQATTGGPRV

SEQ ID NO: 423005 - protein, 10 aa, Mycobacterium
AGQAWQGAAS

SEQ ID NO: 423006 - protein, 13 aa, Mycobacterium
AGQAYAAESARKV

SEQ ID NO: 423007 - protein, 6 aa, Mycobacterium
AGQDCP

SEQ ID NO: 423008 - protein, 7 aa, Mycobacterium
AGQDCTA

SEQ ID NO: 423009 - protein, 20 aa, Mycobacterium
AGQDEDKKNERETPKPAEQT

SEQ ID NO: 423010 - protein, 9 aa, Mycobacterium
AGQDEGDVR

SEQ ID NO: 423011 - protein, 6 aa, Mycobacterium
AGQDEL

SEQ ID NO: 423012 - protein, 9 aa, Mycobacterium
AGQDGVTEP

SEQ ID NO: 423013 - protein, 12 aa, Mycobacterium
AGQDHQAQGGSS

SEQ ID NO: 423014 - protein, 5 aa, Mycobacterium
AGQDL

SEQ ID NO: 423015 - protein, 6 aa, Mycobacterium
AGQDLP

SEQ ID NO: 423016 - protein, 7 aa, Mycobacterium
AGQDNGA

SEQ ID NO: 423017 - protein, 10 aa, Mycobacterium
AGQDQPERRV

SEQ ID NO: 423018 - protein, 7 aa, Mycobacterium
AGQDSER

SEQ ID NO: 423019 - protein, 8 aa, Mycobacterium
AGQDSSSM

SEQ ID NO: 423020 - protein, 7 aa, Mycobacterium
AGQDTDA

SEQ ID NO: 423021 - protein, 6 aa, Mycobacterium
AGQDTR

SEQ ID NO: 423022 - protein, 12 aa, Mycobacterium
AGQERVDAARGA

SEQ ID NO: 423023 - protein, 6 aa, Mycobacterium
AGQESL

SEQ ID NO: 423024 - protein, 13 aa, Mycobacterium
AGQESVRGSDYAD

SEQ ID NO: 423025 - protein, 5 aa, Mycobacterium
AGQET

SEQ ID NO: 423026 - protein, 6 aa, Mycobacterium
AGQETL

SEQ ID NO: 423027 - protein, 6 aa, Mycobacterium
AGQEVN

SEQ ID NO: 423028 - protein, 15 aa, Mycobacterium
AGQGEAGLRGAPSGD

SEQ ID NO: 423029 - protein, 13 aa, Mycobacterium
AGQGGGDRADPGG

SEQ ID NO: 423030 - protein, 7 aa, Mycobacterium
AGQGGTL

SEQ ID NO: 423031 - protein, 9 aa, Mycobacterium
AGQGPAAWP

SEQ ID NO: 423032 - protein, 5 aa, Mycobacterium
AGQGQ

SEQ ID NO: 423033 - protein, 6 aa, Mycobacterium
AGQGQP

SEQ ID NO: 423034 - protein, 7 aa, Mycobacterium
AGQGRDS

SEQ ID NO: 423035 - protein, 6 aa, Mycobacterium
AGQGRT

SEQ ID NO: 423036 - protein, 10 aa, Mycobacterium
AGQGSGEYPT

SEQ ID NO: 423037 - protein, 11 aa, Mycobacterium
AGQGSRGPSKF

SEQ ID NO: 423038 - protein, 10 aa, Mycobacterium
AGQGSSSAQS

SEQ ID NO: 423039 - protein, 8 aa, Mycobacterium
AGQGTAGL

SEQ ID NO: 423040 - protein, 65 aa, Mycobacterium
AGQGTAHADTDSGSAKTSSKESSKESSTAGSASRGSSGVNAGPKADTKTGSKAAGKTERPRPLSK

SEQ ID NO: 423041 - protein, 6 aa, Mycobacterium
AGQGTI

SEQ ID NO: 423042 - protein, 5 aa, Mycobacterium
AGQGV

SEQ ID NO: 423043 - protein, 7 aa, Mycobacterium
AGQGVGR

SEQ ID NO: 423044 - protein, 10 aa, Mycobacterium
AGQHDGGVEE

SEQ ID NO: 423045 - protein, 6 aa, Mycobacterium
AGQHGL

SEQ ID NO: 423046 - protein, 11 aa, Mycobacterium
AGQHGVPDPDN

SEQ ID NO: 423047 - protein, 8 aa, Mycobacterium
AGQHNDAH

SEQ ID NO: 423048 - protein, 8 aa, Mycobacterium
AGQHSPGV

SEQ ID NO: 423049 - protein, 6 aa, Mycobacterium
AGQIAA

SEQ ID NO: 423050 - protein, 9 aa, Mycobacterium
AGQIAAASN

SEQ ID NO: 423051 - protein, 13 aa, Mycobacterium
AGQIGADAPRDSV

SEQ ID NO: 423052 - protein, 7 aa, Mycobacterium
AGQIPNP

SEQ ID NO: 423053 - protein, 17 aa, Mycobacterium
AGQKAGKKINKDDGIQR

SEQ ID NO: 423054 - protein, 10 aa, Mycobacterium
AGQKSDNPFG

SEQ ID NO: 423055 - protein, 6 aa, Mycobacterium
AGQKTG

SEQ ID NO: 423056 - protein, 7 aa, Mycobacterium
AGQKVGS

SEQ ID NO: 423057 - protein, 8 aa, Mycobacterium
AGQKVGST

SEQ ID NO: 423058 - protein, 10 aa, Mycobacterium
AGQLDRGGVP

SEQ ID NO: 423059 - protein, 5 aa, Mycobacterium
AGQLE

SEQ ID NO: 423060 - protein, 7 aa, Mycobacterium
AGQLGRS

SEQ ID NO: 423061 - protein, 9 aa, Mycobacterium
AGQLNRGEE

SEQ ID NO: 423062 - protein, 15 aa, Mycobacterium
AGQLTSSISVDGQEL

SEQ ID NO: 423063 - protein, 6 aa, Mycobacterium
AGQNGK

SEQ ID NO: 423064 - protein, 8 aa, Mycobacterium
AGQNHGPA

SEQ ID NO: 423065 - protein, 7 aa, Mycobacterium
AGQNSVA

SEQ ID NO: 423066 - protein, 8 aa, Mycobacterium
AGQPAAGD

SEQ ID NO: 423067 - protein, 8 aa, Mycobacterium
AGQPAAPS

SEQ ID NO: 423068 - protein, 11 aa, Mycobacterium
AGQPADERASS

SEQ ID NO: 423069 - protein, 8 aa, Mycobacterium
AGQPADKY

SEQ ID NO: 423070 - protein, 18 aa, Mycobacterium
AGQPAQRPNLRPDRLTPR

SEQ ID NO: 423071 - protein, 6 aa, Mycobacterium
AGQPGA

SEQ ID NO: 423072 - protein, 6 aa, Mycobacterium
AGQPGD

SEQ ID NO: 423073 - protein, 7 aa, Mycobacterium
AGQPGPG

SEQ ID NO: 423074 - protein, 11 aa, Mycobacterium
AGQPGTPIDDE

SEQ ID NO: 423075 - protein, 7 aa, Mycobacterium
AGQPGVE

SEQ ID NO: 423076 - protein, 9 aa, Mycobacterium
AGQPHSGVS

SEQ ID NO: 423077 - protein, 7 aa, Mycobacterium
AGQPISR

SEQ ID NO: 423078 - protein, 5 aa, Mycobacterium
AGQPL

SEQ ID NO: 423079 - protein, 10 aa, Mycobacterium
AGQPLDDQDR

SEQ ID NO: 423080 - protein, 7 aa, Mycobacterium
AGQPLSR

SEQ ID NO: 423081 - protein, 24 aa, Mycobacterium
AGQPPLDAPARPVQKYAGTDRQVR

SEQ ID NO: 423082 - protein, 8 aa, Mycobacterium
AGQPPSRY

SEQ ID NO: 423083 - protein, 8 aa, Mycobacterium
AGQPRKVP

SEQ ID NO: 423084 - protein, 26 aa, Mycobacterium
AGQPRMPAPETPTPQVARPEPVQAAL

SEQ ID NO: 423085 - protein, 6 aa, Mycobacterium
AGQPRV

SEQ ID NO: 423086 - protein, 10 aa, Mycobacterium
AGQPSTGAPA

SEQ ID NO: 423087 - protein, 7 aa, Mycobacterium
AGQPSTI

SEQ ID NO: 423088 - protein, 14 aa, Mycobacterium
AGQPSVGAPAPVRA

SEQ ID NO: 423089 - protein, 14 aa, Mycobacterium
AGQPSVGAPEPIRA

SEQ ID NO: 423090 - protein, 10 aa, Mycobacterium
AGQPTSTNPI

SEQ ID NO: 423091 - protein, 5 aa, Mycobacterium
AGQPV

SEQ ID NO: 423092 - protein, 6 aa, Mycobacterium
AGQPVE

SEQ ID NO: 423093 - protein, 5 aa, Mycobacterium
AGQQI

SEQ ID NO: 423094 - protein, 14 aa, Mycobacterium
AGQQPGGNAALGDL

SEQ ID NO: 423095 - protein, 6 aa, Mycobacterium
AGQQQE

SEQ ID NO: 423096 - protein, 8 aa, Mycobacterium
AGQQRKVP

SEQ ID NO: 423097 - protein, 5 aa, Mycobacterium
AGQQT

SEQ ID NO: 423098 - protein, 5 aa, Mycobacterium
AGQQV

SEQ ID NO: 423099 - protein, 7 aa, Mycobacterium
AGQRDGL

SEQ ID NO: 423100 - protein, 7 aa, Mycobacterium
AGQRETV

SEQ ID NO: 423101 - protein, 50 aa, Mycobacterium
AGQRGDRVDRAHQRDGQAGLRGERPHRPVRGRARPVQGQDRGQQHPRREH

SEQ ID NO: 423102 - protein, 8 aa, Mycobacterium
AGQRGERV

SEQ ID NO: 423103 - protein, 13 aa, Mycobacterium
AGQRGQLLGRQGE

SEQ ID NO: 423104 - protein, 16 aa, Mycobacterium
AGQRLQRAGGPRRSRH

SEQ ID NO: 423105 - protein, 15 aa, Mycobacterium
AGQRLRNKPGEPLPV

SEQ ID NO: 423106 - protein, 13 aa, Mycobacterium
AGQRPDAATGARV

SEQ ID NO: 423107 - protein, 9 aa, Mycobacterium
AGQRPTADQ

SEQ ID NO: 423108 - protein, 9 aa, Mycobacterium
AGQRRTQPV

SEQ ID NO: 423109 - protein, 6 aa, Mycobacterium
AGQRTV

SEQ ID NO: 423110 - protein, 7 aa, Mycobacterium
AGQRVGS

SEQ ID NO: 423111 - protein, 6 aa, Mycobacterium
AGQSAA

SEQ ID NO: 423112 - protein, 11 aa, Mycobacterium
AGQSAAATKVA

SEQ ID NO: 423113 - protein, 8 aa, Mycobacterium
AGQSAAEA

SEQ ID NO: 423114 - protein, 10 aa, Mycobacterium
AGQSATSTKL

SEQ ID NO: 423115 - protein, 11 aa, Mycobacterium
AGQSDGGPSVI

SEQ ID NO: 423116 - protein, 18 aa, Mycobacterium
AGQSEAELSRDTAAEASL

SEQ ID NO: 423117 - protein, 14 aa, Mycobacterium
AGQSEAGPRRDPEE

SEQ ID NO: 423118 - protein, 6 aa, Mycobacterium
AGQSGV

SEQ ID NO: 423119 - protein, 7 aa, Mycobacterium
AGQSNTS

SEQ ID NO: 423120 - protein, 14 aa, Mycobacterium
AGQSPGPGTGNGRA

SEQ ID NO: 423121 - protein, 9 aa, Mycobacterium
AGQSPTTAL

SEQ ID NO: 423122 - protein, 7 aa, Mycobacterium
AGQSRED

SEQ ID NO: 423123 - protein, 19 aa, Mycobacterium
AGQSRERMRRRGGGPGPAI

SEQ ID NO: 423124 - protein, 8 aa, Mycobacterium
AGQSRHVD

SEQ ID NO: 423125 - protein, 9 aa, Mycobacterium
AGQSRHVDG

SEQ ID NO: 423126 - protein, 8 aa, Mycobacterium
AGQSSGVR

SEQ ID NO: 423127 - protein, 6 aa, Mycobacterium
AGQSSL

SEQ ID NO: 423128 - protein, 7 aa, Mycobacterium
AGQSSSR

SEQ ID NO: 423129 - protein, 7 aa, Mycobacterium
AGQSTAV

SEQ ID NO: 423130 - protein, 4 aa, Mycobacterium
AGQT

SEQ ID NO: 423131 - protein, 19 aa, Mycobacterium
AGQTAAARERRESADAAAA

SEQ ID NO: 423132 - protein, 9 aa, Mycobacterium
AGQTAPGVV

SEQ ID NO: 423133 - protein, 8 aa, Mycobacterium
AGQTCSAG

SEQ ID NO: 423134 - protein, 6 aa, Mycobacterium
AGQTDM

SEQ ID NO: 423135 - protein, 7 aa, Mycobacterium
AGQTDTS

SEQ ID NO: 423136 - protein, 13 aa, Mycobacterium
AGQTGDEDSGSGA

SEQ ID NO: 423137 - protein, 8 aa, Mycobacterium
AGQTGQSI

SEQ ID NO: 423138 - protein, 11 aa, Mycobacterium
AGQTGSSNEEV

SEQ ID NO: 423139 - protein, 7 aa, Mycobacterium
AGQTGVT

SEQ ID NO: 423140 - protein, 5 aa, Mycobacterium
AGQTH

SEQ ID NO: 423141 - protein, 7 aa, Mycobacterium
AGQTKPT

SEQ ID NO: 423142 - protein, 7 aa, Mycobacterium
AGQTKST

SEQ ID NO: 423143 - protein, 6 aa, Mycobacterium
AGQTPD

SEQ ID NO: 423144 - protein, 7 aa, Mycobacterium
AGQTPSL

SEQ ID NO: 423145 - protein, 17 aa, Mycobacterium
AGQTQSRRLTRFDGPPG

SEQ ID NO: 423146 - protein, 8 aa, Mycobacterium
AGQTSVER

SEQ ID NO: 423147 - protein, 8 aa, Mycobacterium
AGQTTLGG

SEQ ID NO: 423148 - protein, 7 aa, Mycobacterium
AGQTVGS

SEQ ID NO: 423149 - protein, 6 aa, Mycobacterium
AGQVAE

SEQ ID NO: 423150 - protein, 5 aa, Mycobacterium
AGQVD

SEQ ID NO: 423151 - protein, 14 aa, Mycobacterium
AGQVDAEDQGVDEE

SEQ ID NO: 423152 - protein, 10 aa, Mycobacterium
AGQVGADDGL

SEQ ID NO: 423153 - protein, 16 aa, Mycobacterium
AGQVGGAVSASPIGAA

SEQ ID NO: 423154 - protein, 9 aa, Mycobacterium
AGQVGSSAM

SEQ ID NO: 423155 - protein, 5 aa, Mycobacterium
AGQVP

SEQ ID NO: 423156 - protein, 13 aa, Mycobacterium
AGQVRKAGRQTKG

SEQ ID NO: 423157 - protein, 20 aa, Mycobacterium
AGQWNNAARSDAVDRSAELE

SEQ ID NO: 423158 - protein, 6 aa, Mycobacterium
AGQYPA

SEQ ID NO: 423159 - protein, 7 aa, Mycobacterium
AGQYPNR

SEQ ID NO: 423160 - protein, 14 aa, Mycobacterium
AGRAAAEAIETPPW

SEQ ID NO: 423161 - protein, 7 aa, Mycobacterium
AGRAAAR

SEQ ID NO: 423162 - protein, 6 aa, Mycobacterium
AGRAAG

SEQ ID NO: 423163 - protein, 7 aa, Mycobacterium
AGRAAGA

SEQ ID NO: 423164 - protein, 9 aa, Mycobacterium
AGRAAGKRI

SEQ ID NO: 423165 - protein, 7 aa, Mycobacterium
AGRAAGP

SEQ ID NO: 423166 - protein, 6 aa, Mycobacterium
AGRAAK

SEQ ID NO: 423167 - protein, 7 aa, Mycobacterium
AGRAAPC

SEQ ID NO: 423168 - protein, 10 aa, Mycobacterium
AGRAAPGLDE

SEQ ID NO: 423169 - protein, 9 aa, Mycobacterium
AGRAAPSAE

SEQ ID NO: 423170 - protein, 6 aa, Mycobacterium
AGRAAR

SEQ ID NO: 423171 - protein, 8 aa, Mycobacterium
AGRAARDV

SEQ ID NO: 423172 - protein, 11 aa, Mycobacterium
AGRAARGAPVD

SEQ ID NO: 423173 - protein, 11 aa, Mycobacterium
AGRAATGVVGP

SEQ ID NO: 423174 - protein, 5 aa, Mycobacterium
AGRAD

SEQ ID NO: 423175 - protein, 10 aa, Mycobacterium
AGRADKPDFT

SEQ ID NO: 423176 - protein, 8 aa, Mycobacterium
AGRADPAL

SEQ ID NO: 423177 - protein, 9 aa, Mycobacterium
AGRAEPGAE

SEQ ID NO: 423178 - protein, 7 aa, Mycobacterium
AGRAEPT

SEQ ID NO: 423179 - protein, 12 aa, Mycobacterium
AGRAEQATAAYD

SEQ ID NO: 423180 - protein, 12 aa, Mycobacterium
AGRAEQLDPIGP

SEQ ID NO: 423181 - protein, 9 aa, Mycobacterium
AGRAFSAGG

SEQ ID NO: 423182 - protein, 16 aa, Mycobacterium
AGRAGDDGEEGFSDAT

SEQ ID NO: 423183 - protein, 16 aa, Mycobacterium
AGRAGEDGEEGFSDAT

SEQ ID NO: 423184 - protein, 16 aa, Mycobacterium
AGRAGEDGEVGFSDGA

SEQ ID NO: 423185 - protein, 6 aa, Mycobacterium
AGRAGI

SEQ ID NO: 423186 - protein, 9 aa, Mycobacterium
AGRAGKKRW

SEQ ID NO: 423187 - protein, 7 aa, Mycobacterium
AGRAGRA

SEQ ID NO: 423188 - protein, 11 aa, Mycobacterium
AGRAGSPEEGI

SEQ ID NO: 423189 - protein, 6 aa, Mycobacterium
AGRAGV

SEQ ID NO: 423190 - protein, 6 aa, Mycobacterium
AGRAKL

SEQ ID NO: 423191 - protein, 10 aa, Mycobacterium
AGRAKRDPAL

SEQ ID NO: 423192 - protein, 6 aa, Mycobacterium
AGRANA

SEQ ID NO: 423193 - protein, 17 aa, Mycobacterium
AGRANKARLNRSPVRST

SEQ ID NO: 423194 - protein, 18 aa, Mycobacterium
AGRANKARVNRSPVRSPR

SEQ ID NO: 423195 - protein, 12 aa, Mycobacterium
AGRANVGAPPPI

SEQ ID NO: 423196 - protein, 40 aa, Mycobacterium
AGRAPACAAPEPRRRSRSRQRSARITQARTHNREQRPINA

SEQ ID NO: 423197 - protein, 8 aa, Mycobacterium
AGRAPEEP

SEQ ID NO: 423198 - protein, 7 aa, Mycobacterium
AGRAPGW

SEQ ID NO: 423199 - protein, 9 aa, Mycobacterium
AGRAPKPGE

SEQ ID NO: 423200 - protein, 6 aa, Mycobacterium
AGRAPL

SEQ ID NO: 423201 - protein, 13 aa, Mycobacterium
AGRAPQAGLSASI

SEQ ID NO: 423202 - protein, 7 aa, Mycobacterium
AGRAPRL

SEQ ID NO: 423203 - protein, 8 aa, Mycobacterium
AGRAPSTE

SEQ ID NO: 423204 - protein, 7 aa, Mycobacterium
AGRAPSW

SEQ ID NO: 423205 - protein, 6 aa, Mycobacterium
AGRAPT

SEQ ID NO: 423206 - protein, 7 aa, Mycobacterium
AGRAPVD

SEQ ID NO: 423207 - protein, 5 aa, Mycobacterium
AGRAQ

SEQ ID NO: 423208 - protein, 8 aa, Mycobacterium
AGRAQAAA

SEQ ID NO: 423209 - protein, 8 aa, Mycobacterium
AGRAQPGY

SEQ ID NO: 423210 - protein, 6 aa, Mycobacterium
AGRARG

SEQ ID NO: 423211 - protein, 7 aa, Mycobacterium
AGRARGV

SEQ ID NO: 423212 - protein, 13 aa, Mycobacterium
AGRARGVTTRTVG

SEQ ID NO: 423213 - protein, 15 aa, Mycobacterium
AGRARLNASSDNVRD

SEQ ID NO: 423214 - protein, 7 aa, Mycobacterium
AGRARNV

SEQ ID NO: 423215 - protein, 18 aa, Mycobacterium
AGRARSGNLKPDELSGGT

SEQ ID NO: 423216 - protein, 7 aa, Mycobacterium
AGRARSV

SEQ ID NO: 423217 - protein, 8 aa, Mycobacterium
AGRASGLR

SEQ ID NO: 423218 - protein, 10 aa, Mycobacterium
AGRASPLAPP

SEQ ID NO: 423219 - protein, 8 aa, Mycobacterium
AGRASPLE

SEQ ID NO: 423220 - protein, 6 aa, Mycobacterium
AGRATA

SEQ ID NO: 423221 - protein, 6 aa, Mycobacterium
AGRATD

SEQ ID NO: 423222 - protein, 11 aa, Mycobacterium
AGRATDGATLA

SEQ ID NO: 423223 - protein, 13 aa, Mycobacterium
AGRATISSHGETY

SEQ ID NO: 423224 - protein, 8 aa, Mycobacterium
AGRATREV

SEQ ID NO: 423225 - protein, 4 aa, Mycobacterium
AGRC

SEQ ID NO: 423226 - protein, 5 aa, Mycobacterium
AGRCR

SEQ ID NO: 423227 - protein, 11 aa, Mycobacterium
AGRDAEERGVE

SEQ ID NO: 423228 - protein, 8 aa, Mycobacterium
AGRDDALE

SEQ ID NO: 423229 - protein, 10 aa, Mycobacterium
AGRDDLAADA

SEQ ID NO: 423230 - protein, 13 aa, Mycobacterium
AGRDDLTAAPDRR

SEQ ID NO: 423231 - protein, 7 aa, Mycobacterium
AGRDDPG

SEQ ID NO: 423232 - protein, 9 aa, Mycobacterium
AGRDDPIEP

SEQ ID NO: 423233 - protein, 9 aa, Mycobacterium
AGRDEDERG

SEQ ID NO: 423234 - protein, 7 aa, Mycobacterium
AGRDEPL

SEQ ID NO: 423235 - protein, 8 aa, Mycobacterium
AGRDEPPV

SEQ ID NO: 423236 - protein, 14 aa, Mycobacterium
AGRDEPVPSTIEDP

SEQ ID NO: 423237 - protein, 12 aa, Mycobacterium
AGRDEREYPDPD

SEQ ID NO: 423238 - protein, 7 aa, Mycobacterium
AGRDERS

SEQ ID NO: 423239 - protein, 14 aa, Mycobacterium
AGRDEVNPRAGQEC

SEQ ID NO: 423240 - protein, 8 aa, Mycobacterium
AGRDFRDE

SEQ ID NO: 423241 - protein, 5 aa, Mycobacterium
AGRDG

SEQ ID NO: 423242 - protein, 13 aa, Mycobacterium
AGRDGAPLPIEDG

SEQ ID NO: 423243 - protein, 9 aa, Mycobacterium
AGRDGGQIG

SEQ ID NO: 423244 - protein, 9 aa, Mycobacterium
AGRDGKSQY

SEQ ID NO: 423245 - protein, 17 aa, Mycobacterium
AGRDGKVRTAAATGEYP

SEQ ID NO: 423246 - protein, 6 aa, Mycobacterium
AGRDGV

SEQ ID NO: 423247 - protein, 13 aa, Mycobacterium
AGRDHAAAAVTMD

SEQ ID NO: 423248 - protein, 6 aa, Mycobacterium
AGRDHG

SEQ ID NO: 423249 - protein, 5 aa, Mycobacterium
AGRDL

SEQ ID NO: 423250 - protein, 7 aa, Mycobacterium
AGRDNTA

SEQ ID NO: 423251 - protein, 9 aa, Mycobacterium
AGRDPAPAV

SEQ ID NO: 423252 - protein, 8 aa, Mycobacterium
AGRDPDSI

SEQ ID NO: 423253 - protein, 6 aa, Mycobacterium
AGRDPW

SEQ ID NO: 423254 - protein, 9 aa, Mycobacterium
AGRDRDDRS

SEQ ID NO: 423255 - protein, 9 aa, Mycobacterium
AGRDSDLDR

SEQ ID NO: 423256 - protein, 5 aa, Mycobacterium
AGRDT

SEQ ID NO: 423257 - protein, 5 aa, Mycobacterium
AGRDV

SEQ ID NO: 423258 - protein, 14 aa, Mycobacterium
AGRDVQARVAEVLD

SEQ ID NO: 423259 - protein, 7 aa, Mycobacterium
AGRDVQT

SEQ ID NO: 423260 - protein, 6 aa, Mycobacterium
AGRDVS

SEQ ID NO: 423261 - protein, 8 aa, Mycobacterium
AGRDYADV

SEQ ID NO: 423262 - protein, 10 aa, Mycobacterium
AGRDYSDVPP

SEQ ID NO: 423263 - protein, 10 aa, Mycobacterium
AGRDYTDVPP

SEQ ID NO: 423264 - protein, 7 aa, Mycobacterium
AGREAAR

SEQ ID NO: 423265 - protein, 10 aa, Mycobacterium
AGREASASNM

SEQ ID NO: 423266 - protein, 6 aa, Mycobacterium
AGREAT

SEQ ID NO: 423267 - protein, 6 aa, Mycobacterium
AGREAV

SEQ ID NO: 423268 - protein, 5 aa, Mycobacterium
AGREC

SEQ ID NO: 423269 - protein, 6 aa, Mycobacterium
AGRECA

SEQ ID NO: 423270 - protein, 5 aa, Mycobacterium
AGRED

SEQ ID NO: 423271 - protein, 7 aa, Mycobacterium
AGREDDA

SEQ ID NO: 423272 - protein, 13 aa, Mycobacterium
AGREGAALPLEDG

SEQ ID NO: 423273 - protein, 8 aa, Mycobacterium
AGREGAPQ

SEQ ID NO: 423274 - protein, 8 aa, Mycobacterium
AGREHAAP

SEQ ID NO: 423275 - protein, 7 aa, Mycobacterium
AGREHSG

SEQ ID NO: 423276 - protein, 8 aa, Mycobacterium
AGRENGAL

SEQ ID NO: 423277 - protein, 6 aa, Mycobacterium
AGREPA

SEQ ID NO: 423278 - protein, 6 aa, Mycobacterium
AGREPD

SEQ ID NO: 423279 - protein, 8 aa, Mycobacterium
AGREPDQP

SEQ ID NO: 423280 - protein, 8 aa, Mycobacterium
AGREPTAT

SEQ ID NO: 423281 - protein, 18 aa, Mycobacterium
AGREQGRREAAAIARFLG

SEQ ID NO: 423282 - protein, 9 aa, Mycobacterium
AGRERQTAY

SEQ ID NO: 423283 - protein, 8 aa, Mycobacterium
AGRESATR

SEQ ID NO: 423284 - protein, 5 aa, Mycobacterium
AGRET

SEQ ID NO: 423285 - protein, 9 aa, Mycobacterium
AGRFDGASR

SEQ ID NO: 423286 - protein, 7 aa, Mycobacterium
AGRFPAR

SEQ ID NO: 423287 - protein, 11 aa, Mycobacterium
AGRFPGNPELD

SEQ ID NO: 423288 - protein, 6 aa, Mycobacterium
AGRGAD

SEQ ID NO: 423289 - protein, 17 aa, Mycobacterium
AGRGAGSTYAHSGGNVG

SEQ ID NO: 423290 - protein, 14 aa, Mycobacterium
AGRGARSVVCFGSP

SEQ ID NO: 423291 - protein, 6 aa, Mycobacterium
AGRGDD

SEQ ID NO: 423292 - protein, 6 aa, Mycobacterium
AGRGDH

SEQ ID NO: 423293 - protein, 8 aa, Mycobacterium
AGRGDPAL

SEQ ID NO: 423294 - protein, 9 aa, Mycobacterium
AGRGDQSAL

SEQ ID NO: 423295 - protein, 13 aa, Mycobacterium
AGRGERSDGGSGG

SEQ ID NO: 423296 - protein, 13 aa, Mycobacterium
AGRGFGPEVSEEQ

SEQ ID NO: 423297 - protein, 12 aa, Mycobacterium
AGRGFSAGTDLG

SEQ ID NO: 423298 - protein, 13 aa, Mycobacterium
AGRGFSAGTDLGE

SEQ ID NO: 423299 - protein, 20 aa, Mycobacterium
AGRGFSSGADHKSAGAVPNV

SEQ ID NO: 423300 - protein, 21 aa, Mycobacterium
AGRGFSSGADHKSAGAVPNVG

SEQ ID NO: 423301 - protein, 5 aa, Mycobacterium
AGRGG

SEQ ID NO: 423302 - protein, 8 aa, Mycobacterium
AGRGGAPA

SEQ ID NO: 423303 - protein, 6 aa, Mycobacterium
AGRGGS

SEQ ID NO: 423304 - protein, 7 aa, Mycobacterium
AGRGGSL

SEQ ID NO: 423305 - protein, 6 aa, Mycobacterium
AGRGHV

SEQ ID NO: 423306 - protein, 5 aa, Mycobacterium
AGRGI

SEQ ID NO: 423307 - protein, 30 aa, Mycobacterium
AGRGIGATGTPSVRDAAPEEGEGQPKRRPT

SEQ ID NO: 423308 - protein, 6 aa, Mycobacterium
AGRGKA

SEQ ID NO: 423309 - protein, 5 aa, Mycobacterium
AGRGL

SEQ ID NO: 423310 - protein, 6 aa, Mycobacterium
AGRGNE

SEQ ID NO: 423311 - protein, 10 aa, Mycobacterium
AGRGPDPASQ

SEQ ID NO: 423312 - protein, 6 aa, Mycobacterium
AGRGPR

SEQ ID NO: 423313 - protein, 11 aa, Mycobacterium
AGRGQPQTARV

SEQ ID NO: 423314 - protein, 47 aa, Mycobacterium
AGRGRPVAAGGLRPPRDQRGDHPDAERHRRRRAGAPHPDRNRHRQHD

SEQ ID NO: 423315 - protein, 7 aa, Mycobacterium
AGRGRSH

SEQ ID NO: 423316 - protein, 5 aa, Mycobacterium
AGRGS

SEQ ID NO: 423317 - protein, 7 aa, Mycobacterium
AGRGSFG

SEQ ID NO: 423318 - protein, 6 aa, Mycobacterium
AGRGSI

SEQ ID NO: 423319 - protein, 15 aa, Mycobacterium
AGRGSSLGTGGMASK

SEQ ID NO: 423320 - protein, 5 aa, Mycobacterium
AGRGV

SEQ ID NO: 423321 - protein, 15 aa, Mycobacterium
AGRGVGTTAEATAHH

SEQ ID NO: 423322 - protein, 16 aa, Mycobacterium
AGRGWPDDEPVQAGGR

SEQ ID NO: 423323 - protein, 5 aa, Mycobacterium
AGRGY

SEQ ID NO: 423324 - protein, 4 aa, Mycobacterium
AGRH

SEQ ID NO: 423325 - protein, 13 aa, Mycobacterium
AGRHADDMETEGD

SEQ ID NO: 423326 - protein, 6 aa, Mycobacterium
AGRHDD

SEQ ID NO: 423327 - protein, 18 aa, Mycobacterium
AGRHERRRAGRHRPDPQR

SEQ ID NO: 423328 - protein, 11 aa, Mycobacterium
AGRHESDPVPI

SEQ ID NO: 423329 - protein, 7 aa, Mycobacterium
AGRHGPS

SEQ ID NO: 423330 - protein, 5 aa, Mycobacterium
AGRHL

SEQ ID NO: 423331 - protein, 7 aa, Mycobacterium
AGRHPDA

SEQ ID NO: 423332 - protein, 8 aa, Mycobacterium
AGRHPDSD

SEQ ID NO: 423333 - protein, 7 aa, Mycobacterium
AGRHPGT

SEQ ID NO: 423334 - protein, 8 aa, Mycobacterium
AGRHQGGG

SEQ ID NO: 423335 - protein, 36 aa, Mycobacterium
AGRHRAQPSVQHEQGGPGHRRPDRHRSGARRQRRRH

SEQ ID NO: 423336 - protein, 7 aa, Mycobacterium
AGRHSAA

SEQ ID NO: 423337 - protein, 9 aa, Mycobacterium
AGRHTAEAD

SEQ ID NO: 423338 - protein, 4 aa, Mycobacterium
AGRI

SEQ ID NO: 423339 - protein, 5 aa, Mycobacterium
AGRIA

SEQ ID NO: 423340 - protein, 6 aa, Mycobacterium
AGRIGD

SEQ ID NO: 423341 - protein, 8 aa, Mycobacterium
AGRIQDQQ

SEQ ID NO: 423342 - protein, 7 aa, Mycobacterium
AGRIQQQ

SEQ ID NO: 423343 - protein, 11 aa, Mycobacterium
AGRISGNETPP

SEQ ID NO: 423344 - protein, 5 aa, Mycobacterium
AGRKA

SEQ ID NO: 423345 - protein, 11 aa, Mycobacterium
AGRKASTVAPW

SEQ ID NO: 423346 - protein, 6 aa, Mycobacterium
AGRKGY

SEQ ID NO: 423347 - protein, 10 aa, Mycobacterium
AGRKNKGALA

SEQ ID NO: 423348 - protein, 28 aa, Mycobacterium
AGRKPGDTVTYSTPQGENQVELIAVKLP

SEQ ID NO: 423349 - protein, 17 aa, Mycobacterium
AGRKYDPAVRLARRLFR

SEQ ID NO: 423350 - protein, 5 aa, Mycobacterium
AGRLA

SEQ ID NO: 423351 - protein, 35 aa, Mycobacterium
AGRLAAERASVSDEELAASADSALRAAQAADQRVG

SEQ ID NO: 423352 - protein, 5 aa, Mycobacterium
AGRLQ

SEQ ID NO: 423353 - protein, 6 aa, Mycobacterium
AGRLTE

SEQ ID NO: 423354 - protein, 19 aa, Mycobacterium
AGRLTGTDSGSGRLPEAEE

SEQ ID NO: 423355 - protein, 6 aa, Mycobacterium
AGRLTT

SEQ ID NO: 423356 - protein, 6 aa, Mycobacterium
AGRMPR

SEQ ID NO: 423357 - protein, 12 aa, Mycobacterium
AGRMRDERWGPR

SEQ ID NO: 423358 - protein, 4 aa, Mycobacterium
AGRN

SEQ ID NO: 423359 - protein, 6 aa, Mycobacterium
AGRNAA

SEQ ID NO: 423360 - protein, 20 aa, Mycobacterium
AGRNAAPAGGARQISTDDSP

SEQ ID NO: 423361 - protein, 6 aa, Mycobacterium
AGRNAE

SEQ ID NO: 423362 - protein, 5 aa, Mycobacterium
AGRND

SEQ ID NO: 423363 - protein, 11 aa, Mycobacterium
AGRNGCDDDTV

SEQ ID NO: 423364 - protein, 9 aa, Mycobacterium
AGRNHPSVE

SEQ ID NO: 423365 - protein, 5 aa, Mycobacterium
AGRNI

SEQ ID NO: 423366 - protein, 6 aa, Mycobacterium
AGRNPQ

SEQ ID NO: 423367 - protein, 9 aa, Mycobacterium
AGRNTAVAE

SEQ ID NO: 423368 - protein, 13 aa, Mycobacterium
AGRNTGPTEGPAI

SEQ ID NO: 423369 - protein, 5 aa, Mycobacterium
AGRPA

SEQ ID NO: 423370 - protein, 6 aa, Mycobacterium
AGRPAD

SEQ ID NO: 423371 - protein, 7 aa, Mycobacterium
AGRPADA

SEQ ID NO: 423372 - protein, 8 aa, Mycobacterium
AGRPAGEI

SEQ ID NO: 423373 - protein, 10 aa, Mycobacterium
AGRPAGHGSV

SEQ ID NO: 423374 - protein, 10 aa, Mycobacterium
AGRPAPVDGV

SEQ ID NO: 423375 - protein, 6 aa, Mycobacterium
AGRPAQ

SEQ ID NO: 423376 - protein, 7 aa, Mycobacterium
AGRPARK

SEQ ID NO: 423377 - protein, 10 aa, Mycobacterium
AGRPATADAI

SEQ ID NO: 423378 - protein, 5 aa, Mycobacterium
AGRPD

SEQ ID NO: 423379 - protein, 9 aa, Mycobacterium
AGRPDDGLA

SEQ ID NO: 423380 - protein, 11 aa, Mycobacterium
AGRPDPEAGES

SEQ ID NO: 423381 - protein, 5 aa, Mycobacterium
AGRPE

SEQ ID NO: 423382 - protein, 7 aa, Mycobacterium
AGRPEHE

SEQ ID NO: 423383 - protein, 7 aa, Mycobacterium
AGRPEWQ

SEQ ID NO: 423384 - protein, 7 aa, Mycobacterium
AGRPGDT

SEQ ID NO: 423385 - protein, 6 aa, Mycobacterium
AGRPGE

SEQ ID NO: 423386 - protein, 6 aa, Mycobacterium
AGRPGG

SEQ ID NO: 423387 - protein, 7 aa, Mycobacterium
AGRPGHP

SEQ ID NO: 423388 - protein, 10 aa, Mycobacterium
AGRPGLPEST

SEQ ID NO: 423389 - protein, 27 aa, Mycobacterium
AGRPGPRRVDRSRPDGLGAAAGGQPVL

SEQ ID NO: 423390 - protein, 9 aa, Mycobacterium
AGRPGRLGG

SEQ ID NO: 423391 - protein, 5 aa, Mycobacterium
AGRPH

SEQ ID NO: 423392 - protein, 8 aa, Mycobacterium
AGRPHDEF

SEQ ID NO: 423393 - protein, 6 aa, Mycobacterium
AGRPIS

SEQ ID NO: 423394 - protein, 9 aa, Mycobacterium
AGRPKATKL

SEQ ID NO: 423395 - protein, 14 aa, Mycobacterium
AGRPKEEYGLEPQG

SEQ ID NO: 423396 - protein, 12 aa, Mycobacterium
AGRPLKDRTREH

SEQ ID NO: 423397 - protein, 9 aa, Mycobacterium
AGRPLPSEY

SEQ ID NO: 423398 - protein, 10 aa, Mycobacterium
AGRPMTSGDL

SEQ ID NO: 423399 - protein, 14 aa, Mycobacterium
AGRPMVTDDGSAGA

SEQ ID NO: 423400 - protein, 5 aa, Mycobacterium
AGRPP

SEQ ID NO: 423401 - protein, 10 aa, Mycobacterium
AGRPPATTEP

SEQ ID NO: 423402 - protein, 9 aa, Mycobacterium
AGRPPATTG

SEQ ID NO: 423403 - protein, 7 aa, Mycobacterium
AGRPPDW

SEQ ID NO: 423404 - protein, 8 aa, Mycobacterium
AGRPPLDV

SEQ ID NO: 423405 - protein, 7 aa, Mycobacterium
AGRPPMR

SEQ ID NO: 423406 - protein, 11 aa, Mycobacterium
AGRPPPESGLD

SEQ ID NO: 423407 - protein, 7 aa, Mycobacterium
AGRPPTW

SEQ ID NO: 423408 - protein, 6 aa, Mycobacterium
AGRPPY

SEQ ID NO: 423409 - protein, 8 aa, Mycobacterium
AGRPRAEA

SEQ ID NO: 423410 - protein, 10 aa, Mycobacterium
AGRPREEYGI

SEQ ID NO: 423411 - protein, 10 aa, Mycobacterium
AGRPRPGEHA

SEQ ID NO: 423412 - protein, 15 aa, Mycobacterium
AGRPRSRRRPGGLGR

SEQ ID NO: 423413 - protein, 7 aa, Mycobacterium
AGRPSEF

SEQ ID NO: 423414 - protein, 10 aa, Mycobacterium
AGRPSPFPLS

SEQ ID NO: 423415 - protein, 5 aa, Mycobacterium
AGRPV

SEQ ID NO: 423416 - protein, 6 aa, Mycobacterium
AGRPVL

SEQ ID NO: 423417 - protein, 6 aa, Mycobacterium
AGRPVQ

SEQ ID NO: 423418 - protein, 6 aa, Mycobacterium
AGRPVS

SEQ ID NO: 423419 - protein, 15 aa, Mycobacterium
AGRPVTSTSFPTAQR

SEQ ID NO: 423420 - protein, 6 aa, Mycobacterium
AGRPVV

SEQ ID NO: 423421 - protein, 14 aa, Mycobacterium
AGRPVVTDAGNVGT

SEQ ID NO: 423422 - protein, 28 aa, Mycobacterium
AGRQAGDTVTYSTPRGPSQVELLSIKLP

SEQ ID NO: 423423 - protein, 6 aa, Mycobacterium
AGRQAK

SEQ ID NO: 423424 - protein, 7 aa, Mycobacterium
AGRQDAG

SEQ ID NO: 423425 - protein, 7 aa, Mycobacterium
AGRQGAQ

SEQ ID NO: 423426 - protein, 8 aa, Mycobacterium
AGRQGQTD

SEQ ID NO: 423427 - protein, 10 aa, Mycobacterium
AGRQGQTDQL

SEQ ID NO: 423428 - protein, 9 aa, Mycobacterium
AGRQGQTEH

SEQ ID NO: 423429 - protein, 13 aa, Mycobacterium
AGRQGREHREPLG

SEQ ID NO: 423430 - protein, 11 aa, Mycobacterium
AGRQPDVDEPA

SEQ ID NO: 423431 - protein, 28 aa, Mycobacterium
AGRQPGDTVTYSTPRGPSQVELIAMKLP

SEQ ID NO: 423432 - protein, 12 aa, Mycobacterium
AGRQPGEHGEPL

SEQ ID NO: 423433 - protein, 12 aa, Mycobacterium
AGRQPQRGGQKS

SEQ ID NO: 423434 - protein, 7 aa, Mycobacterium
AGRQQGV

SEQ ID NO: 423435 - protein, 16 aa, Mycobacterium
AGRQREPGRPRPVPED

SEQ ID NO: 423436 - protein, 12 aa, Mycobacterium
AGRQRWRAQKPK

SEQ ID NO: 423437 - protein, 17 aa, Mycobacterium
AGRQTRSGAVRPGPDDV

SEQ ID NO: 423438 - protein, 5 aa, Mycobacterium
AGRRA

SEQ ID NO: 423439 - protein, 11 aa, Mycobacterium
AGRRAAGVDRG

SEQ ID NO: 423440 - protein, 15 aa, Mycobacterium
AGRRAARRARRGTAR

SEQ ID NO: 423441 - protein, 6 aa, Mycobacterium
AGRRAD

SEQ ID NO: 423442 - protein, 11 aa, Mycobacterium
AGRRAKPTDDL

SEQ ID NO: 423443 - protein, 11 aa, Mycobacterium
AGRRDAQRALA

SEQ ID NO: 423444 - protein, 20 aa, Mycobacterium
AGRRDEPRGDRGRSPPSVGA

SEQ ID NO: 423445 - protein, 6 aa, Mycobacterium
AGRRDQ

SEQ ID NO: 423446 - protein, 21 aa, Mycobacterium
AGRRDRDAAARALSPTATITL

SEQ ID NO: 423447 - protein, 6 aa, Mycobacterium
AGRREP

SEQ ID NO: 423448 - protein, 7 aa, Mycobacterium
AGRREPI

SEQ ID NO: 423449 - protein, 7 aa, Mycobacterium
AGRREPL

SEQ ID NO: 423450 - protein, 6 aa, Mycobacterium
AGRRGA

SEQ ID NO: 423451 - protein, 8 aa, Mycobacterium
AGRRGASR

SEQ ID NO: 423452 - protein, 6 aa, Mycobacterium
AGRRGD

SEQ ID NO: 423453 - protein, 7 aa, Mycobacterium
AGRRGDH

SEQ ID NO: 423454 - protein, 6 aa, Mycobacterium
AGRRGE

SEQ ID NO: 423455 - protein, 11 aa, Mycobacterium
AGRRGEAPRGE

SEQ ID NO: 423456 - protein, 6 aa, Mycobacterium
AGRRGG

SEQ ID NO: 423457 - protein, 9 aa, Mycobacterium
AGRRGIARA

SEQ ID NO: 423458 - protein, 9 aa, Mycobacterium
AGRRGMVGG

SEQ ID NO: 423459 - protein, 8 aa, Mycobacterium
AGRRGPGA

SEQ ID NO: 423460 - protein, 12 aa, Mycobacterium
AGRRGPGATHTP

SEQ ID NO: 423461 - protein, 9 aa, Mycobacterium
AGRRGPVDR

SEQ ID NO: 423462 - protein, 23 aa, Mycobacterium
AGRRGRRSSICPSDAARAVGGGS

SEQ ID NO: 423463 - protein, 5 aa, Mycobacterium
AGRRL

SEQ ID NO: 423464 - protein, 11 aa, Mycobacterium
AGRRLTGTVSP

SEQ ID NO: 423465 - protein, 13 aa, Mycobacterium
AGRRNPAVTAQAA

SEQ ID NO: 423466 - protein, 7 aa, Mycobacterium
AGRRNTV

SEQ ID NO: 423467 - protein, 14 aa, Mycobacterium
AGRRPDGDRDPGRV

SEQ ID NO: 423468 - protein, 8 aa, Mycobacterium
AGRRPDLA

SEQ ID NO: 423469 - protein, 14 aa, Mycobacterium
AGRRPPVTEPSRPL

SEQ ID NO: 423470 - protein, 7 aa, Mycobacterium
AGRRPTW

SEQ ID NO: 423471 - protein, 13 aa, Mycobacterium
AGRRRAESNRQVS

SEQ ID NO: 423472 - protein, 26 aa, Mycobacterium
AGRRRKVRDPVAARKPRRWTARRGVG

SEQ ID NO: 423473 - protein, 6 aa, Mycobacterium
AGRRRR

SEQ ID NO: 423474 - protein, 14 aa, Mycobacterium
AGRRSAGRVEDSFT

SEQ ID NO: 423475 - protein, 7 aa, Mycobacterium
AGRRTEA

SEQ ID NO: 423476 - protein, 25 aa, Mycobacterium
AGRRTEPHERPADGTPVVDTDRGGK

SEQ ID NO: 423477 - protein, 13 aa, Mycobacterium
AGRRTEPHERPGP

SEQ ID NO: 423478 - protein, 28 aa, Mycobacterium
AGRRTEPHERPVNDTAGTPVVDTDRGGK

SEQ ID NO: 423479 - protein, 15 aa, Mycobacterium
AGRRTEPQERPINGA

SEQ ID NO: 423480 - protein, 9 aa, Mycobacterium
AGRRTGNPP

SEQ ID NO: 423481 - protein, 7 aa, Mycobacterium
AGRRTRP

SEQ ID NO: 423482 - protein, 12 aa, Mycobacterium
AGRRYERSVDPA

SEQ ID NO: 423483 - protein, 7 aa, Mycobacterium
AGRRYGK

SEQ ID NO: 423484 - protein, 8 aa, Mycobacterium
AGRRYGKP

SEQ ID NO: 423485 - protein, 8 aa, Mycobacterium
AGRSAATV

SEQ ID NO: 423486 - protein, 7 aa, Mycobacterium
AGRSAEI

SEQ ID NO: 423487 - protein, 19 aa, Mycobacterium
AGRSAEKLQAARDSIGGAA

SEQ ID NO: 423488 - protein, 21 aa, Mycobacterium
AGRSAEQAYDGLTRTPPSVAD

SEQ ID NO: 423489 - protein, 10 aa, Mycobacterium
AGRSAGGALA

SEQ ID NO: 423490 - protein, 11 aa, Mycobacterium
AGRSANGPAAS

SEQ ID NO: 423491 - protein, 11 aa, Mycobacterium
AGRSANTGRIA

SEQ ID NO: 423492 - protein, 10 aa, Mycobacterium
AGRSAPPLDG

SEQ ID NO: 423493 - protein, 9 aa, Mycobacterium
AGRSASALH

SEQ ID NO: 423494 - protein, 5 aa, Mycobacterium
AGRSD

SEQ ID NO: 423495 - protein, 7 aa, Mycobacterium
AGRSDYR

SEQ ID NO: 423496 - protein, 18 aa, Mycobacterium
AGRSEGVDLDDKGRGQAA

SEQ ID NO: 423497 - protein, 7 aa, Mycobacterium
AGRSEHA

SEQ ID NO: 423498 - protein, 8 aa, Mycobacterium
AGRSEPDK

SEQ ID NO: 423499 - protein, 9 aa, Mycobacterium
AGRSGGANI

SEQ ID NO: 423500 - protein, 16 aa, Mycobacterium
AGRSGHRDRREDPHRV

SEQ ID NO: 423501 - protein, 17 aa, Mycobacterium
AGRSGNLGLAPAEAAES

SEQ ID NO: 423502 - protein, 7 aa, Mycobacterium
AGRSGPH

SEQ ID NO: 423503 - protein, 9 aa, Mycobacterium
AGRSGQPRL

SEQ ID NO: 423504 - protein, 12 aa, Mycobacterium
AGRSIRRKTYES

SEQ ID NO: 423505 - protein, 16 aa, Mycobacterium
AGRSIRRSVANSTDRL

SEQ ID NO: 423506 - protein, 15 aa, Mycobacterium
AGRSIRRSVTASTDR

SEQ ID NO: 423507 - protein, 5 aa, Mycobacterium
AGRSL

SEQ ID NO: 423508 - protein, 6 aa, Mycobacterium
AGRSNA

SEQ ID NO: 423509 - protein, 16 aa, Mycobacterium
AGRSPAHMSGGQRRRA

SEQ ID NO: 423510 - protein, 10 aa, Mycobacterium
AGRSPDPVRA

SEQ ID NO: 423511 - protein, 8 aa, Mycobacterium
AGRSPEDF

SEQ ID NO: 423512 - protein, 19 aa, Mycobacterium
AGRSPGVELDEKGQSQARG

SEQ ID NO: 423513 - protein, 7 aa, Mycobacterium
AGRSPSA

SEQ ID NO: 423514 - protein, 10 aa, Mycobacterium
AGRSRARSRY

SEQ ID NO: 423515 - protein, 10 aa, Mycobacterium
AGRSRPGARV

SEQ ID NO: 423516 - protein, 12 aa, Mycobacterium
AGRSRPGARVQH

SEQ ID NO: 423517 - protein, 10 aa, Mycobacterium
AGRSRPGDRV

SEQ ID NO: 423518 - protein, 12 aa, Mycobacterium
AGRSRPGEAVQH

SEQ ID NO: 423519 - protein, 13 aa, Mycobacterium
AGRSRPGERVQAG

SEQ ID NO: 423520 - protein, 13 aa, Mycobacterium
AGRSRQHTHDGTV

SEQ ID NO: 423521 - protein, 6 aa, Mycobacterium
AGRSTE

SEQ ID NO: 423522 - protein, 8 aa, Mycobacterium
AGRSTEKL

SEQ ID NO: 423523 - protein, 6 aa, Mycobacterium
AGRSTR

SEQ ID NO: 423524 - protein, 13 aa, Mycobacterium
AGRSTTEADTAFE

SEQ ID NO: 423525 - protein, 6 aa, Mycobacterium
AGRSVG

SEQ ID NO: 423526 - protein, 6 aa, Mycobacterium
AGRTAG

SEQ ID NO: 423527 - protein, 8 aa, Mycobacterium
AGRTAGSA

SEQ ID NO: 423528 - protein, 9 aa, Mycobacterium
AGRTAKNPV

SEQ ID NO: 423529 - protein, 8 aa, Mycobacterium
AGRTAPPV

SEQ ID NO: 423530 - protein, 13 aa, Mycobacterium
AGRTDAGVHASGQ

SEQ ID NO: 423531 - protein, 12 aa, Mycobacterium
AGRTDAGVHATG

SEQ ID NO: 423532 - protein, 7 aa, Mycobacterium
AGRTDAP

SEQ ID NO: 423533 - protein, 8 aa, Mycobacterium
AGRTDDGG

SEQ ID NO: 423534 - protein, 22 aa, Mycobacterium
AGRTDRTGRDRGCAAGGPMSPR

SEQ ID NO: 423535 - protein, 14 aa, Mycobacterium
AGRTDSPDRSTPVR

SEQ ID NO: 423536 - protein, 12 aa, Mycobacterium
AGRTDTGVHATG

SEQ ID NO: 423537 - protein, 6 aa, Mycobacterium
AGRTEA

SEQ ID NO: 423538 - protein, 11 aa, Mycobacterium
AGRTEAARDAS

SEQ ID NO: 423539 - protein, 7 aa, Mycobacterium
AGRTEAP

SEQ ID NO: 423540 - protein, 15 aa, Mycobacterium
AGRTESSEPRRDPEE

SEQ ID NO: 423541 - protein, 13 aa, Mycobacterium
AGRTGEPQWATPP

SEQ ID NO: 423542 - protein, 8 aa, Mycobacterium
AGRTGTDI

SEQ ID NO: 423543 - protein, 21 aa, Mycobacterium
AGRTGVAGRHPLDTGRPLAES

SEQ ID NO: 423544 - protein, 7 aa, Mycobacterium
AGRTIDQ

SEQ ID NO: 423545 - protein, 6 aa, Mycobacterium
AGRTKT

SEQ ID NO: 423546 - protein, 12 aa, Mycobacterium
AGRTLSAAERDG

SEQ ID NO: 423547 - protein, 5 aa, Mycobacterium
AGRTP

SEQ ID NO: 423548 - protein, 6 aa, Mycobacterium
AGRTPQ

SEQ ID NO: 423549 - protein, 7 aa, Mycobacterium
AGRTPQL

SEQ ID NO: 423550 - protein, 6 aa, Mycobacterium
AGRTPV

SEQ ID NO: 423551 - protein, 8 aa, Mycobacterium
AGRTQAHY

SEQ ID NO: 423552 - protein, 7 aa, Mycobacterium
AGRTRGV

SEQ ID NO: 423553 - protein, 6 aa, Mycobacterium
AGRTRS

SEQ ID NO: 423554 - protein, 7 aa, Mycobacterium
AGRTSAP

SEQ ID NO: 423555 - protein, 9 aa, Mycobacterium
AGRTSPGLD

SEQ ID NO: 423556 - protein, 10 aa, Mycobacterium
AGRTSPTVED

SEQ ID NO: 423557 - protein, 13 aa, Mycobacterium
AGRTTSSAGTAVA

SEQ ID NO: 423558 - protein, 8 aa, Mycobacterium
AGRTVAET

SEQ ID NO: 423559 - protein, 8 aa, Mycobacterium
AGRTVENE

SEQ ID NO: 423560 - protein, 7 aa, Mycobacterium
AGRVAEE

SEQ ID NO: 423561 - protein, 5 aa, Mycobacterium
AGRVD

SEQ ID NO: 423562 - protein, 11 aa, Mycobacterium
AGRVEAVGPDV

SEQ ID NO: 423563 - protein, 16 aa, Mycobacterium
AGRVEAVGPGVTAVEP

SEQ ID NO: 423564 - protein, 6 aa, Mycobacterium
AGRVES

SEQ ID NO: 423565 - protein, 5 aa, Mycobacterium
AGRVG

SEQ ID NO: 423566 - protein, 10 aa, Mycobacterium
AGRVGAPSDV

SEQ ID NO: 423567 - protein, 8 aa, Mycobacterium
AGRVGDGS

SEQ ID NO: 423568 - protein, 24 aa, Mycobacterium
AGRVKVENGTAPPLPALPEADASD

SEQ ID NO: 423569 - protein, 12 aa, Mycobacterium
AGRVNNPAVPAG

SEQ ID NO: 423570 - protein, 8 aa, Mycobacterium
AGRVPSQA

SEQ ID NO: 423571 - protein, 12 aa, Mycobacterium
AGRVRGERWGPR

SEQ ID NO: 423572 - protein, 7 aa, Mycobacterium
AGRVSSA

SEQ ID NO: 423573 - protein, 4 aa, Mycobacterium
AGRY

SEQ ID NO: 423574 - protein, 7 aa, Mycobacterium
AGRYADP

SEQ ID NO: 423575 - protein, 15 aa, Mycobacterium
AGRYAGRAVVKVAGG

SEQ ID NO: 423576 - protein, 17 aa, Mycobacterium
AGRYATAEAAAASPLQT

SEQ ID NO: 423577 - protein, 5 aa, Mycobacterium
AGRYD

SEQ ID NO: 423578 - protein, 6 aa, Mycobacterium
AGRYEE

SEQ ID NO: 423579 - protein, 5 aa, Mycobacterium
AGRYG

SEQ ID NO: 423580 - protein, 11 aa, Mycobacterium
AGRYQRDRGPS

SEQ ID NO: 423581 - protein, 7 aa, Mycobacterium
AGRYRHQ

SEQ ID NO: 423582 - protein, 21 aa, Mycobacterium
AGRYRHQRDQHPAPLDPNFTG

SEQ ID NO: 423583 - protein, 7 aa, Mycobacterium
AGRYSDP

SEQ ID NO: 423584 - protein, 6 aa, Mycobacterium
AGSAAA

SEQ ID NO: 423585 - protein, 8 aa, Mycobacterium
AGSAAGAV

SEQ ID NO: 423586 - protein, 27 aa, Mycobacterium
AGSAALTGEPGGPPTLPGYSSADNSTG

SEQ ID NO: 423587 - protein, 10 aa, Mycobacterium
AGSAAPGKAR

SEQ ID NO: 423588 - protein, 9 aa, Mycobacterium
AGSADEEDQ

SEQ ID NO: 423589 - protein, 9 aa, Mycobacterium
AGSADTHDD

SEQ ID NO: 423590 - protein, 8 aa, Mycobacterium
AGSADTVV

SEQ ID NO: 423591 - protein, 15 aa, Mycobacterium
AGSAEDGSGGADRRD

SEQ ID NO: 423592 - protein, 6 aa, Mycobacterium
AGSAEL

SEQ ID NO: 423593 - protein, 6 aa, Mycobacterium
AGSAET

SEQ ID NO: 423594 - protein, 7 aa, Mycobacterium
AGSAEYG

SEQ ID NO: 423595 - protein, 5 aa, Mycobacterium
AGSAG

SEQ ID NO: 423596 - protein, 16 aa, Mycobacterium
AGSAGESRADTDPWSG

SEQ ID NO: 423597 - protein, 6 aa, Mycobacterium
AGSAGH

SEQ ID NO: 423598 - protein, 6 aa, Mycobacterium
AGSAGM

SEQ ID NO: 423599 - protein, 15 aa, Mycobacterium
AGSAGMAGDDPVGAA

SEQ ID NO: 423600 - protein, 26 aa, Mycobacterium
AGSAGSAGAASPAGAAVSAGSVGAAE

SEQ ID NO: 423601 - protein, 9 aa, Mycobacterium
AGSAGTATA

SEQ ID NO: 423602 - protein, 18 aa, Mycobacterium
AGSAGTFPTVNPATEETL

SEQ ID NO: 423603 - protein, 6 aa, Mycobacterium
AGSAGV

SEQ ID NO: 423604 - protein, 16 aa, Mycobacterium
AGSAIADQRTSVFGLV

SEQ ID NO: 423605 - protein, 6 aa, Mycobacterium
AGSAIE

SEQ ID NO: 423606 - protein, 8 aa, Mycobacterium
AGSAIGSE

SEQ ID NO: 423607 - protein, 5 aa, Mycobacterium
AGSAK

SEQ ID NO: 423608 - protein, 9 aa, Mycobacterium
AGSALGDGM

SEQ ID NO: 423609 - protein, 18 aa, Mycobacterium
AGSALGDTTRGAVASASA

SEQ ID NO: 423610 - protein, 18 aa, Mycobacterium
AGSALGPAAASAPLSAAP

SEQ ID NO: 423611 - protein, 8 aa, Mycobacterium
AGSANIGD

SEQ ID NO: 423612 - protein, 15 aa, Mycobacterium
AGSANLQSVTEEQAK

SEQ ID NO: 423613 - protein, 9 aa, Mycobacterium
AGSANPSSV

SEQ ID NO: 423614 - protein, 6 aa, Mycobacterium
AGSAPL

SEQ ID NO: 423615 - protein, 6 aa, Mycobacterium
AGSAPM

SEQ ID NO: 423616 - protein, 10 aa, Mycobacterium
AGSAPPPTAA

SEQ ID NO: 423617 - protein, 29 aa, Mycobacterium
AGSAPRAADPDVDAANGAALAGSAKDRHE

SEQ ID NO: 423618 - protein, 16 aa, Mycobacterium
AGSAPRAADPEIDAAN

SEQ ID NO: 423619 - protein, 10 aa, Mycobacterium
AGSAPRRNAQ

SEQ ID NO: 423620 - protein, 16 aa, Mycobacterium
AGSAPRSADPEIDAAN

SEQ ID NO: 423621 - protein, 14 aa, Mycobacterium
AGSAPVTKASGRSI

SEQ ID NO: 423622 - protein, 9 aa, Mycobacterium
AGSAQHPSR

SEQ ID NO: 423623 - protein, 8 aa, Mycobacterium
AGSAQRIG

SEQ ID NO: 423624 - protein, 6 aa, Mycobacterium
AGSARD

SEQ ID NO: 423625 - protein, 7 aa, Mycobacterium
AGSARPV

SEQ ID NO: 423626 - protein, 6 aa, Mycobacterium
AGSART

SEQ ID NO: 423627 - protein, 6 aa, Mycobacterium
AGSASI

SEQ ID NO: 423628 - protein, 6 aa, Mycobacterium
AGSASR

SEQ ID NO: 423629 - protein, 11 aa, Mycobacterium
AGSATSSEADG

SEQ ID NO: 423630 - protein, 5 aa, Mycobacterium
AGSAV

SEQ ID NO: 423631 - protein, 15 aa, Mycobacterium
AGSAVTTANAVGTSV

SEQ ID NO: 423632 - protein, 12 aa, Mycobacterium
AGSCGTAKERMD

SEQ ID NO: 423633 - protein, 14 aa, Mycobacterium
AGSCGTAKERMEGQ

SEQ ID NO: 423634 - protein, 10 aa, Mycobacterium
AGSDAGSTVR

SEQ ID NO: 423635 - protein, 10 aa, Mycobacterium
AGSDDSRSYL

SEQ ID NO: 423636 - protein, 10 aa, Mycobacterium
AGSDEDETAW

SEQ ID NO: 423637 - protein, 18 aa, Mycobacterium
AGSDEQFRTAAGGGTASQ

SEQ ID NO: 423638 - protein, 11 aa, Mycobacterium
AGSDEQKAAYR

SEQ ID NO: 423639 - protein, 6 aa, Mycobacterium
AGSDFE

SEQ ID NO: 423640 - protein, 7 aa, Mycobacterium
AGSDGEG

SEQ ID NO: 423641 - protein, 26 aa, Mycobacterium
AGSDGRPVGVEAGDARAREALRRWSL

SEQ ID NO: 423642 - protein, 8 aa, Mycobacterium
AGSDGSNA

SEQ ID NO: 423643 - protein, 6 aa, Mycobacterium
AGSDGV

SEQ ID NO: 423644 - protein, 7 aa, Mycobacterium
AGSDGVP

SEQ ID NO: 423645 - protein, 8 aa, Mycobacterium
AGSDGVPS

SEQ ID NO: 423646 - protein, 9 aa, Mycobacterium
AGSDGVPTP

SEQ ID NO: 423647 - protein, 5 aa, Mycobacterium
AGSDH

SEQ ID NO: 423648 - protein, 10 aa, Mycobacterium
AGSDHTGRPG

SEQ ID NO: 423649 - protein, 5 aa, Mycobacterium
AGSDI

SEQ ID NO: 423650 - protein, 6 aa, Mycobacterium
AGSDKT

SEQ ID NO: 423651 - protein, 5 aa, Mycobacterium
AGSDL

SEQ ID NO: 423652 - protein, 27 aa, Mycobacterium
AGSDLPGPAQTAYGTPHAPTGPAVTLP

SEQ ID NO: 423653 - protein, 7 aa, Mycobacterium
AGSDNQT

SEQ ID NO: 423654 - protein, 8 aa, Mycobacterium
AGSDPGLN

SEQ ID NO: 423655 - protein, 9 aa, Mycobacterium
AGSDPSHPG

SEQ ID NO: 423656 - protein, 9 aa, Mycobacterium
AGSDRAQSI

SEQ ID NO: 423657 - protein, 10 aa, Mycobacterium
AGSDRKTQRS

SEQ ID NO: 423658 - protein, 8 aa, Mycobacterium
AGSDSRQY

SEQ ID NO: 423659 - protein, 10 aa, Mycobacterium
AGSDTDAARA

SEQ ID NO: 423660 - protein, 11 aa, Mycobacterium
AGSDTTDVAAT

SEQ ID NO: 423661 - protein, 11 aa, Mycobacterium
AGSDTTPGRHI

SEQ ID NO: 423662 - protein, 6 aa, Mycobacterium
AGSDVR

SEQ ID NO: 423663 - protein, 7 aa, Mycobacterium
AGSEDAA

SEQ ID NO: 423664 - protein, 6 aa, Mycobacterium
AGSEDE

SEQ ID NO: 423665 - protein, 8 aa, Mycobacterium
AGSEEEAV

SEQ ID NO: 423666 - protein, 8 aa, Mycobacterium
AGSEGDHV

SEQ ID NO: 423667 - protein, 10 aa, Mycobacterium
AGSEHGSAKT

SEQ ID NO: 423668 - protein, 13 aa, Mycobacterium
AGSEHGSAKTAAE

SEQ ID NO: 423669 - protein, 11 aa, Mycobacterium
AGSEHGSAKTI

SEQ ID NO: 423670 - protein, 11 aa, Mycobacterium
AGSEHGSAKTV

SEQ ID NO: 423671 - protein, 13 aa, Mycobacterium
AGSEHGSAKTVEE

SEQ ID NO: 423672 - protein, 5 aa, Mycobacterium
AGSEL

SEQ ID NO: 423673 - protein, 6 aa, Mycobacterium
AGSELG

SEQ ID NO: 423674 - protein, 23 aa, Mycobacterium
AGSELGAVSGDELAAPAIDLDLT

SEQ ID NO: 423675 - protein, 11 aa, Mycobacterium
AGSENGSAKSV

SEQ ID NO: 423676 - protein, 11 aa, Mycobacterium
AGSENGSAKTV

SEQ ID NO: 423677 - protein, 8 aa, Mycobacterium
AGSENPDV

SEQ ID NO: 423678 - protein, 9 aa, Mycobacterium
AGSEPAQKR

SEQ ID NO: 423679 - protein, 7 aa, Mycobacterium
AGSEPAT

SEQ ID NO: 423680 - protein, 7 aa, Mycobacterium
AGSEQRR

SEQ ID NO: 423681 - protein, 5 aa, Mycobacterium
AGSER

SEQ ID NO: 423682 - protein, 23 aa, Mycobacterium
AGSERSAAELRPEEKDASSHRGR

SEQ ID NO: 423683 - protein, 9 aa, Mycobacterium
AGSERSARL

SEQ ID NO: 423684 - protein, 9 aa, Mycobacterium
AGSERTVQD

SEQ ID NO: 423685 - protein, 6 aa, Mycobacterium
AGSESA

SEQ ID NO: 423686 - protein, 7 aa, Mycobacterium
AGSESGM

SEQ ID NO: 423687 - protein, 7 aa, Mycobacterium
AGSETTT

SEQ ID NO: 423688 - protein, 9 aa, Mycobacterium
AGSETTTRA

SEQ ID NO: 423689 - protein, 5 aa, Mycobacterium
AGSEV

SEQ ID NO: 423690 - protein, 6 aa, Mycobacterium
AGSEYK

SEQ ID NO: 423691 - protein, 7 aa, Mycobacterium
AGSFGGS

SEQ ID NO: 423692 - protein, 23 aa, Mycobacterium
AGSFRAPTPGGGPAGDAAPTERL

SEQ ID NO: 423693 - protein, 19 aa, Mycobacterium
AGSFTTGYGSVGGNTPQSL

SEQ ID NO: 423694 - protein, 4 aa, Mycobacterium
AGSG

SEQ ID NO: 423695 - protein, 15 aa, Mycobacterium
AGSGAALRAANATGL

SEQ ID NO: 423696 - protein, 20 aa, Mycobacterium
AGSGADTATLDSLKSDDGDL

SEQ ID NO: 423697 - protein, 6 aa, Mycobacterium
AGSGAM

SEQ ID NO: 423698 - protein, 13 aa, Mycobacterium
AGSGAPPIGSPVS

SEQ ID NO: 423699 - protein, 13 aa, Mycobacterium
AGSGATSASRDKF

SEQ ID NO: 423700 - protein, 14 aa, Mycobacterium
AGSGATSASRDKFP

SEQ ID NO: 423701 - protein, 9 aa, Mycobacterium
AGSGCQRSA

SEQ ID NO: 423702 - protein, 9 aa, Mycobacterium
AGSGDESAR

SEQ ID NO: 423703 - protein, 6 aa, Mycobacterium
AGSGDL

SEQ ID NO: 423704 - protein, 13 aa, Mycobacterium
AGSGDQARAASTL

SEQ ID NO: 423705 - protein, 7 aa, Mycobacterium
AGSGDRA

SEQ ID NO: 423706 - protein, 7 aa, Mycobacterium
AGSGEEA

SEQ ID NO: 423707 - protein, 6 aa, Mycobacterium
AGSGEF

SEQ ID NO: 423708 - protein, 9 aa, Mycobacterium
AGSGEGYGA

SEQ ID NO: 423709 - protein, 7 aa, Mycobacterium
AGSGEPT

SEQ ID NO: 423710 - protein, 22 aa, Mycobacterium
AGSGGFGGSSTKTAGDGGMGGA

SEQ ID NO: 423711 - protein, 24 aa, Mycobacterium
AGSGGGDPGPGSYPAQMLVDWVRV

SEQ ID NO: 423712 - protein, 9 aa, Mycobacterium
AGSGGNGCA

SEQ ID NO: 423713 - protein, 16 aa, Mycobacterium
AGSGGNGGAGGSVSGI

SEQ ID NO: 423714 - protein, 30 aa, Mycobacterium
AGSGGNGGAGGSVTGVGEVGGAGGAGGSAP

SEQ ID NO: 423715 - protein, 13 aa, Mycobacterium
AGSGGSGGTGGAA

SEQ ID NO: 423716 - protein, 9 aa, Mycobacterium
AGSGGSGNP

SEQ ID NO: 423717 - protein, 15 aa, Mycobacterium
AGSGGVVGQPGEGLQ

SEQ ID NO: 423718 - protein, 5 aa, Mycobacterium
AGSGH

SEQ ID NO: 423719 - protein, 190 aa, Mycobacterium
AGSGHDGAQGAGGAGGSGGMGGVAGDGGKGAAGAFAGGGGGGNDGVGGAGGRGGDPGLGGAGGAGGAGSTTGAPGADGTRPTTGGNGGEGGRGADAVGAGGSGAAGGAGGDGGLVGDGGHGGDGGHGATGAAGASAVAPGASGGNGQTGGSGGAGGAGGAGGTLAGHGGDGGAGGNGANGGIGANGAHGT

SEQ ID NO: 423720 - protein, 6 aa, Mycobacterium
AGSGIG

SEQ ID NO: 423721 - protein, 7 aa, Mycobacterium
AGSGIGA

SEQ ID NO: 423722 - protein, 9 aa, Mycobacterium
AGSGIGGTA

SEQ ID NO: 423723 - protein, 7 aa, Mycobacterium
AGSGIGQ

SEQ ID NO: 423724 - protein, 8 aa, Mycobacterium
AGSGIGQA

SEQ ID NO: 423725 - protein, 9 aa, Mycobacterium
AGSGIGQAT

SEQ ID NO: 423726 - protein, 8 aa, Mycobacterium
AGSGIGRA

SEQ ID NO: 423727 - protein, 9 aa, Mycobacterium
AGSGIGRET

SEQ ID NO: 423728 - protein, 10 aa, Mycobacterium
AGSGKGGTKY

SEQ ID NO: 423729 - protein, 7 aa, Mycobacterium
AGSGKLA

SEQ ID NO: 423730 - protein, 7 aa, Mycobacterium
AGSGKTQ

SEQ ID NO: 423731 - protein, 10 aa, Mycobacterium
AGSGLNGLDP

SEQ ID NO: 423732 - protein, 6 aa, Mycobacterium
AGSGLR

SEQ ID NO: 423733 - protein, 8 aa, Mycobacterium
AGSGNASI

SEQ ID NO: 423734 - protein, 13 aa, Mycobacterium
AGSGNASIPAAAA

SEQ ID NO: 423735 - protein, 10 aa, Mycobacterium
AGSGNESANR

SEQ ID NO: 423736 - protein, 10 aa, Mycobacterium
AGSGNESASR

SEQ ID NO: 423737 - protein, 16 aa, Mycobacterium
AGSGNISLPAAAAGAA

SEQ ID NO: 423738 - protein, 17 aa, Mycobacterium
AGSGNISLPAAATGADV

SEQ ID NO: 423739 - protein, 17 aa, Mycobacterium
AGSGNISLPAAKAGATV

SEQ ID NO: 423740 - protein, 17 aa, Mycobacterium
AGSGNISLPAAKSGATV

SEQ ID NO: 423741 - protein, 6 aa, Mycobacterium
AGSGNV

SEQ ID NO: 423742 - protein, 14 aa, Mycobacterium
AGSGPDDEKQAKDI

SEQ ID NO: 423743 - protein, 14 aa, Mycobacterium
AGSGPDSATGTPEQ

SEQ ID NO: 423744 - protein, 6 aa, Mycobacterium
AGSGPE

SEQ ID NO: 423745 - protein, 14 aa, Mycobacterium
AGSGPGDDRVGATR

SEQ ID NO: 423746 - protein, 9 aa, Mycobacterium
AGSGPGGTV

SEQ ID NO: 423747 - protein, 7 aa, Mycobacterium
AGSGPLL

SEQ ID NO: 423748 - protein, 7 aa, Mycobacterium
AGSGPML

SEQ ID NO: 423749 - protein, 8 aa, Mycobacterium
AGSGPTLA

SEQ ID NO: 423750 - protein, 8 aa, Mycobacterium
AGSGPTLT

SEQ ID NO: 423751 - protein, 7 aa, Mycobacterium
AGSGPVR

SEQ ID NO: 423752 - protein, 8 aa, Mycobacterium
AGSGQGRV

SEQ ID NO: 423753 - protein, 8 aa, Mycobacterium
AGSGQNCS

SEQ ID NO: 423754 - protein, 7 aa, Mycobacterium
AGSGQSS

SEQ ID NO: 423755 - protein, 6 aa, Mycobacterium
AGSGRH

SEQ ID NO: 423756 - protein, 7 aa, Mycobacterium
AGSGRHT

SEQ ID NO: 423757 - protein, 8 aa, Mycobacterium
AGSGSGKT

SEQ ID NO: 423758 - protein, 7 aa, Mycobacterium
AGSGSLT

SEQ ID NO: 423759 - protein, 7 aa, Mycobacterium
AGSGSNV

SEQ ID NO: 423760 - protein, 6 aa, Mycobacterium
AGSGSV

SEQ ID NO: 423761 - protein, 5 aa, Mycobacterium
AGSGT

SEQ ID NO: 423762 - protein, 13 aa, Mycobacterium
AGSGTAPIGRPLP

SEQ ID NO: 423763 - protein, 8 aa, Mycobacterium
AGSGTATV

SEQ ID NO: 423764 - protein, 9 aa, Mycobacterium
AGSGTATVE

SEQ ID NO: 423765 - protein, 13 aa, Mycobacterium
AGSGTDAAAAERI

SEQ ID NO: 423766 - protein, 7 aa, Mycobacterium
AGSGTPL

SEQ ID NO: 423767 - protein, 8 aa, Mycobacterium
AGSGTSPF

SEQ ID NO: 423768 - protein, 10 aa, Mycobacterium
AGSGVDTSDY

SEQ ID NO: 423769 - protein, 4 aa, Mycobacterium
AGSH

SEQ ID NO: 423770 - protein, 18 aa, Mycobacterium
AGSHAEKSQGLEQAPQQG

SEQ ID NO: 423771 - protein, 7 aa, Mycobacterium
AGSHGGS

SEQ ID NO: 423772 - protein, 27 aa, Mycobacterium
AGSHSGIERYDPTAARYDRHGDLPGLT

SEQ ID NO: 423773 - protein, 8 aa, Mycobacterium
AGSIAENN

SEQ ID NO: 423774 - protein, 5 aa, Mycobacterium
AGSIG

SEQ ID NO: 423775 - protein, 9 aa, Mycobacterium
AGSISGSDG

SEQ ID NO: 423776 - protein, 6 aa, Mycobacterium
AGSKEQ

SEQ ID NO: 423777 - protein, 10 aa, Mycobacterium
AGSKERQRHR

SEQ ID NO: 423778 - protein, 10 aa, Mycobacterium
AGSKTEGEAI

SEQ ID NO: 423779 - protein, 13 aa, Mycobacterium
AGSLAPGDALPPV

SEQ ID NO: 423780 - protein, 8 aa, Mycobacterium
AGSLARER

SEQ ID NO: 423781 - protein, 24 aa, Mycobacterium
AGSLARPPTQPPPTVPPYPGPIGE

SEQ ID NO: 423782 - protein, 6 aa, Mycobacterium
AGSLEG

SEQ ID NO: 423783 - protein, 5 aa, Mycobacterium
AGSLG

SEQ ID NO: 423784 - protein, 7 aa, Mycobacterium
AGSLQEV

SEQ ID NO: 423785 - protein, 7 aa, Mycobacterium
AGSLQSI

SEQ ID NO: 423786 - protein, 9 aa, Mycobacterium
AGSLRTASG

SEQ ID NO: 423787 - protein, 8 aa, Mycobacterium
AGSLSAAD

SEQ ID NO: 423788 - protein, 10 aa, Mycobacterium
AGSLTESGYP

SEQ ID NO: 423789 - protein, 7 aa, Mycobacterium
AGSMGSL

SEQ ID NO: 423790 - protein, 6 aa, Mycobacterium
AGSMPD

SEQ ID NO: 423791 - protein, 6 aa, Mycobacterium
AGSMPP

SEQ ID NO: 423792 - protein, 8 aa, Mycobacterium
AGSNAGSS

SEQ ID NO: 423793 - protein, 13 aa, Mycobacterium
AGSNGGGGGDPWG

SEQ ID NO: 423794 - protein, 10 aa, Mycobacterium
AGSNPTDPRE

SEQ ID NO: 423795 - protein, 8 aa, Mycobacterium
AGSNPWGA

SEQ ID NO: 423796 - protein, 8 aa, Mycobacterium
AGSNSQTV

SEQ ID NO: 423797 - protein, 10 aa, Mycobacterium
AGSNTPSTLP

SEQ ID NO: 423798 - protein, 6 aa, Mycobacterium
AGSNVA

SEQ ID NO: 423799 - protein, 8 aa, Mycobacterium
AGSPAARG

SEQ ID NO: 423800 - protein, 7 aa, Mycobacterium
AGSPAEI

SEQ ID NO: 423801 - protein, 6 aa, Mycobacterium
AGSPAI

SEQ ID NO: 423802 - protein, 10 aa, Mycobacterium
AGSPAPTAQE

SEQ ID NO: 423803 - protein, 14 aa, Mycobacterium
AGSPATASYTNHGP

SEQ ID NO: 423804 - protein, 14 aa, Mycobacterium
AGSPATATYTNHGP

SEQ ID NO: 423805 - protein, 16 aa, Mycobacterium
AGSPCRSLPVQPMLAD

SEQ ID NO: 423806 - protein, 10 aa, Mycobacterium
AGSPDTSGVN

SEQ ID NO: 423807 - protein, 9 aa, Mycobacterium
AGSPDVDPN

SEQ ID NO: 423808 - protein, 8 aa, Mycobacterium
AGSPEQKK

SEQ ID NO: 423809 - protein, 8 aa, Mycobacterium
AGSPEQKR

SEQ ID NO: 423810 - protein, 8 aa, Mycobacterium
AGSPERKT

SEQ ID NO: 423811 - protein, 9 aa, Mycobacterium
AGSPEVDPD

SEQ ID NO: 423812 - protein, 7 aa, Mycobacterium
AGSPFDA

SEQ ID NO: 423813 - protein, 23 aa, Mycobacterium
AGSPFTETTTYGGEGTVSAPKGV

SEQ ID NO: 423814 - protein, 15 aa, Mycobacterium
AGSPGADFRPDLDTS

SEQ ID NO: 423815 - protein, 10 aa, Mycobacterium
AGSPGAGKST

SEQ ID NO: 423816 - protein, 13 aa, Mycobacterium
AGSPGAPETRAAS

SEQ ID NO: 423817 - protein, 14 aa, Mycobacterium
AGSPGAPETRADSA

SEQ ID NO: 423818 - protein, 7 aa, Mycobacterium
AGSPGGV

SEQ ID NO: 423819 - protein, 24 aa, Mycobacterium
AGSPGPAGHPTSCHRGQRRCQPAR

SEQ ID NO: 423820 - protein, 7 aa, Mycobacterium
AGSPGTT

SEQ ID NO: 423821 - protein, 7 aa, Mycobacterium
AGSPGYD

SEQ ID NO: 423822 - protein, 6 aa, Mycobacterium
AGSPIG

SEQ ID NO: 423823 - protein, 6 aa, Mycobacterium
AGSPKH

SEQ ID NO: 423824 - protein, 16 aa, Mycobacterium
AGSPLDTRSLDDREDL

SEQ ID NO: 423825 - protein, 6 aa, Mycobacterium
AGSPLR

SEQ ID NO: 423826 - protein, 24 aa, Mycobacterium
AGSPPAPATAPSFTPLPCNASIPA

SEQ ID NO: 423827 - protein, 8 aa, Mycobacterium
AGSPPEFA

SEQ ID NO: 423828 - protein, 30 aa, Mycobacterium
AGSPREALAAASSSAVTASWPTSRANTPDI

SEQ ID NO: 423829 - protein, 8 aa, Mycobacterium
AGSPRPTV

SEQ ID NO: 423830 - protein, 10 aa, Mycobacterium
AGSPRRGPLD

SEQ ID NO: 423831 - protein, 8 aa, Mycobacterium
AGSPRSSM

SEQ ID NO: 423832 - protein, 15 aa, Mycobacterium
AGSPSALTVRDGQSA

SEQ ID NO: 423833 - protein, 8 aa, Mycobacterium
AGSPTRSV

SEQ ID NO: 423834 - protein, 15 aa, Mycobacterium
AGSPVDTRGFDERED

SEQ ID NO: 423835 - protein, 15 aa, Mycobacterium
AGSPVDTRSLDDRAD

SEQ ID NO: 423836 - protein, 12 aa, Mycobacterium
AGSPVKAEQGPA

SEQ ID NO: 423837 - protein, 4 aa, Mycobacterium
AGSQ

SEQ ID NO: 423838 - protein, 6 aa, Mycobacterium
AGSQEV

SEQ ID NO: 423839 - protein, 8 aa, Mycobacterium
AGSQGITY

SEQ ID NO: 423840 - protein, 10 aa, Mycobacterium
AGSQGSRRAA

SEQ ID NO: 423841 - protein, 5 aa, Mycobacterium
AGSQI

SEQ ID NO: 423842 - protein, 5 aa, Mycobacterium
AGSQL

SEQ ID NO: 423843 - protein, 19 aa, Mycobacterium
AGSQPVGSGTPADIAAPAP

SEQ ID NO: 423844 - protein, 7 aa, Mycobacterium
AGSQTAE

SEQ ID NO: 423845 - protein, 8 aa, Mycobacterium
AGSRAGTL

SEQ ID NO: 423846 - protein, 7 aa, Mycobacterium
AGSRAPK

SEQ ID NO: 423847 - protein, 17 aa, Mycobacterium
AGSRDTVRSRSFTGKPA

SEQ ID NO: 423848 - protein, 7 aa, Mycobacterium
AGSRDVT

SEQ ID NO: 423849 - protein, 8 aa, Mycobacterium
AGSREAVG

SEQ ID NO: 423850 - protein, 15 aa, Mycobacterium
AGSRGAPETKADTAP

SEQ ID NO: 423851 - protein, 7 aa, Mycobacterium
AGSRGGV

SEQ ID NO: 423852 - protein, 12 aa, Mycobacterium
AGSRGTPTPGFG

SEQ ID NO: 423853 - protein, 6 aa, Mycobacterium
AGSRNK

SEQ ID NO: 423854 - protein, 7 aa, Mycobacterium
AGSRPLE

SEQ ID NO: 423855 - protein, 8 aa, Mycobacterium
AGSRRGPL

SEQ ID NO: 423856 - protein, 18 aa, Mycobacterium
AGSRRPASYQGGSQTQIS

SEQ ID NO: 423857 - protein, 14 aa, Mycobacterium
AGSRSGDNVKVMLR

SEQ ID NO: 423858 - protein, 9 aa, Mycobacterium
AGSRSPAHT

SEQ ID NO: 423859 - protein, 12 aa, Mycobacterium
AGSRSPRAERED

SEQ ID NO: 423860 - protein, 10 aa, Mycobacterium
AGSRSPTKTF

SEQ ID NO: 423861 - protein, 7 aa, Mycobacterium
AGSRTSV

SEQ ID NO: 423862 - protein, 7 aa, Mycobacterium
AGSRTTF

SEQ ID NO: 423863 - protein, 7 aa, Mycobacterium
AGSRYAS

SEQ ID NO: 423864 - protein, 5 aa, Mycobacterium
AGSSA

SEQ ID NO: 423865 - protein, 10 aa, Mycobacterium
AGSSAAAAQL

SEQ ID NO: 423866 - protein, 8 aa, Mycobacterium
AGSSAAAT

SEQ ID NO: 423867 - protein, 10 aa, Mycobacterium
AGSSAAATQL

SEQ ID NO: 423868 - protein, 9 aa, Mycobacterium
AGSSADGEH

SEQ ID NO: 423869 - protein, 10 aa, Mycobacterium
AGSSAEGQQI

SEQ ID NO: 423870 - protein, 7 aa, Mycobacterium
AGSSAEI

SEQ ID NO: 423871 - protein, 8 aa, Mycobacterium
AGSSAGAA

SEQ ID NO: 423872 - protein, 9 aa, Mycobacterium
AGSSAGAAL

SEQ ID NO: 423873 - protein, 8 aa, Mycobacterium
AGSSAGAT

SEQ ID NO: 423874 - protein, 9 aa, Mycobacterium
AGSSAGATL

SEQ ID NO: 423875 - protein, 9 aa, Mycobacterium
AGSSAGGAL

SEQ ID NO: 423876 - protein, 8 aa, Mycobacterium
AGSSAGSV

SEQ ID NO: 423877 - protein, 23 aa, Mycobacterium
AGSSAHHSAGGRGVGRTSSDGIR

SEQ ID NO: 423878 - protein, 7 aa, Mycobacterium
AGSSARH

SEQ ID NO: 423879 - protein, 32 aa, Mycobacterium
AGSSASAAQLTPYTPPPHITSPAAAATQSAAV

SEQ ID NO: 423880 - protein, 8 aa, Mycobacterium
AGSSASAG

SEQ ID NO: 423881 - protein, 11 aa, Mycobacterium
AGSSASATQLT

SEQ ID NO: 423882 - protein, 10 aa, Mycobacterium
AGSSATAAQL

SEQ ID NO: 423883 - protein, 27 aa, Mycobacterium
AGSSATASQVTPFSEPPQIANPAGTEW

SEQ ID NO: 423884 - protein, 8 aa, Mycobacterium
AGSSATAT

SEQ ID NO: 423885 - protein, 10 aa, Mycobacterium
AGSSDARARH

SEQ ID NO: 423886 - protein, 9 aa, Mycobacterium
AGSSEAAQA

SEQ ID NO: 423887 - protein, 10 aa, Mycobacterium
AGSSEQGKNL

SEQ ID NO: 423888 - protein, 10 aa, Mycobacterium
AGSSETGKDF

SEQ ID NO: 423889 - protein, 10 aa, Mycobacterium
AGSSGAAGAL

SEQ ID NO: 423890 - protein, 10 aa, Mycobacterium
AGSSGRGRDF

SEQ ID NO: 423891 - protein, 7 aa, Mycobacterium
AGSSGSV

SEQ ID NO: 423892 - protein, 6 aa, Mycobacterium
AGSSGV

SEQ ID NO: 423893 - protein, 7 aa, Mycobacterium
AGSSGVQ

SEQ ID NO: 423894 - protein, 5 aa, Mycobacterium
AGSSI

SEQ ID NO: 423895 - protein, 21 aa, Mycobacterium
AGSSLGPGRGDGEPEESGEEF

SEQ ID NO: 423896 - protein, 6 aa, Mycobacterium
AGSSLR

SEQ ID NO: 423897 - protein, 11 aa, Mycobacterium
AGSSNLEAERR

SEQ ID NO: 423898 - protein, 11 aa, Mycobacterium
AGSSNLEAQRR

SEQ ID NO: 423899 - protein, 14 aa, Mycobacterium
AGSSPGAERVADTR

SEQ ID NO: 423900 - protein, 7 aa, Mycobacterium
AGSSPML

SEQ ID NO: 423901 - protein, 8 aa, Mycobacterium
AGSSQVQR

SEQ ID NO: 423902 - protein, 15 aa, Mycobacterium
AGSSRGSAGAGPRYG

SEQ ID NO: 423903 - protein, 7 aa, Mycobacterium
AGSSRLE

SEQ ID NO: 423904 - protein, 10 aa, Mycobacterium
AGSSRTSPAS

SEQ ID NO: 423905 - protein, 10 aa, Mycobacterium
AGSSSAATTL

SEQ ID NO: 423906 - protein, 11 aa, Mycobacterium
AGSSSPNHSGL

SEQ ID NO: 423907 - protein, 6 aa, Mycobacterium
AGSSSR

SEQ ID NO: 423908 - protein, 8 aa, Mycobacterium
AGSSSSRS

SEQ ID NO: 423909 - protein, 20 aa, Mycobacterium
AGSSTATAPVTNPATGAVTG

SEQ ID NO: 423910 - protein, 9 aa, Mycobacterium
AGSSTIPGV

SEQ ID NO: 423911 - protein, 9 aa, Mycobacterium
AGSSTTAAF

SEQ ID NO: 423912 - protein, 11 aa, Mycobacterium
AGSSVGDAPWD

SEQ ID NO: 423913 - protein, 4 aa, Mycobacterium
AGST

SEQ ID NO: 423914 - protein, 47 aa, Mycobacterium
AGSTDSRVGASGSAGSSGSTGASGAADVSAESAAGSCVGAGGSGAAI

SEQ ID NO: 423915 - protein, 20 aa, Mycobacterium
AGSTDSTSESDDSAEDDNHA

SEQ ID NO: 423916 - protein, 11 aa, Mycobacterium
AGSTEMREDST

SEQ ID NO: 423917 - protein, 11 aa, Mycobacterium
AGSTGNSSGPH

SEQ ID NO: 423918 - protein, 8 aa, Mycobacterium
AGSTGPYL

SEQ ID NO: 423919 - protein, 18 aa, Mycobacterium
AGSTGRAVGTTEQTRGAV

SEQ ID NO: 423920 - protein, 14 aa, Mycobacterium
AGSTGSRLVTGNTE

SEQ ID NO: 423921 - protein, 10 aa, Mycobacterium
AGSTGTGGTS

SEQ ID NO: 423922 - protein, 5 aa, Mycobacterium
AGSTL

SEQ ID NO: 423923 - protein, 17 aa, Mycobacterium
AGSTNTGSFNAGSSNTL

SEQ ID NO: 423924 - protein, 13 aa, Mycobacterium
AGSTPDSNGVSRR

SEQ ID NO: 423925 - protein, 8 aa, Mycobacterium
AGSTPGAS

SEQ ID NO: 423926 - protein, 7 aa, Mycobacterium
AGSTPML

SEQ ID NO: 423927 - protein, 7 aa, Mycobacterium
AGSTSSG

SEQ ID NO: 423928 - protein, 7 aa, Mycobacterium
AGSTSTI

SEQ ID NO: 423929 - protein, 10 aa, Mycobacterium
AGSTTGGVAR

SEQ ID NO: 423930 - protein, 20 aa, Mycobacterium
AGSVASRDARGGTAPERVAE

SEQ ID NO: 423931 - protein, 11 aa, Mycobacterium
AGSVDDGKSTL

SEQ ID NO: 423932 - protein, 7 aa, Mycobacterium
AGSVEEG

SEQ ID NO: 423933 - protein, 8 aa, Mycobacterium
AGSVEEGM

SEQ ID NO: 423934 - protein, 17 aa, Mycobacterium
AGSVEQDVKVAEAGVAA

SEQ ID NO: 423935 - protein, 7 aa, Mycobacterium
AGSVGRN

SEQ ID NO: 423936 - protein, 7 aa, Mycobacterium
AGSVPDE

SEQ ID NO: 423937 - protein, 6 aa, Mycobacterium
AGSVPE

SEQ ID NO: 423938 - protein, 16 aa, Mycobacterium
AGSVPFGAPGSATADV

SEQ ID NO: 423939 - protein, 7 aa, Mycobacterium
AGSVQEG

SEQ ID NO: 423940 - protein, 27 aa, Mycobacterium
AGSVRAAAGATPPRPAPLSEGTPVSPA

SEQ ID NO: 423941 - protein, 6 aa, Mycobacterium
AGSVSE

SEQ ID NO: 423942 - protein, 7 aa, Mycobacterium
AGSVSEA

SEQ ID NO: 423943 - protein, 14 aa, Mycobacterium
AGSVSEAKARIPAL

SEQ ID NO: 423944 - protein, 10 aa, Mycobacterium
AGSVTDGSTV

SEQ ID NO: 423945 - protein, 7 aa, Mycobacterium
AGSVTHG

SEQ ID NO: 423946 - protein, 9 aa, Mycobacterium
AGSVTPELG

SEQ ID NO: 423947 - protein, 13 aa, Mycobacterium
AGSWDGPSAAEYA

SEQ ID NO: 423948 - protein, 14 aa, Mycobacterium
AGSYAAAEATNAAQ

SEQ ID NO: 423949 - protein, 15 aa, Mycobacterium
AGSYAATEAINTIAA

SEQ ID NO: 423950 - protein, 15 aa, Mycobacterium
AGSYAATELANAAAV

SEQ ID NO: 423951 - protein, 6 aa, Mycobacterium
AGSYDE

SEQ ID NO: 423952 - protein, 7 aa, Mycobacterium
AGSYDTA

SEQ ID NO: 423953 - protein, 9 aa, Mycobacterium
AGSYSDDEL

SEQ ID NO: 423954 - protein, 4 aa, Mycobacterium
AGTA

SEQ ID NO: 423955 - protein, 5 aa, Mycobacterium
AGTAA

SEQ ID NO: 423956 - protein, 21 aa, Mycobacterium
AGTAAAAAVSEAGLPRRGTPD

SEQ ID NO: 423957 - protein, 8 aa, Mycobacterium
AGTAAKEP

SEQ ID NO: 423958 - protein, 6 aa, Mycobacterium
AGTAAT

SEQ ID NO: 423959 - protein, 6 aa, Mycobacterium
AGTAAV

SEQ ID NO: 423960 - protein, 6 aa, Mycobacterium
AGTADD

SEQ ID NO: 423961 - protein, 7 aa, Mycobacterium
AGTADDA

SEQ ID NO: 423962 - protein, 12 aa, Mycobacterium
AGTADDDPWSPE

SEQ ID NO: 423963 - protein, 16 aa, Mycobacterium
AGTADDYASLRNNTAA

SEQ ID NO: 423964 - protein, 6 aa, Mycobacterium
AGTADT

SEQ ID NO: 423965 - protein, 11 aa, Mycobacterium
AGTADTEEGPR

SEQ ID NO: 423966 - protein, 8 aa, Mycobacterium
AGTAEDKQ

SEQ ID NO: 423967 - protein, 12 aa, Mycobacterium
AGTAEQRDARRG

SEQ ID NO: 423968 - protein, 8 aa, Mycobacterium
AGTAGEGE

SEQ ID NO: 423969 - protein, 11 aa, Mycobacterium
AGTAGQGMGGA

SEQ ID NO: 423970 - protein, 10 aa, Mycobacterium
AGTAGTAGTV

SEQ ID NO: 423971 - protein, 50 aa, Mycobacterium
AGTAGTQTESDSTSAPTTSPPSTPAPSSRTATPSTSLPPPLPAEVGGGEE

SEQ ID NO: 423972 - protein, 6 aa, Mycobacterium
AGTAGV

SEQ ID NO: 423973 - protein, 5 aa, Mycobacterium
AGTAI

SEQ ID NO: 423974 - protein, 7 aa, Mycobacterium
AGTAKRV

SEQ ID NO: 423975 - protein, 11 aa, Mycobacterium
AGTALDKARSL

SEQ ID NO: 423976 - protein, 8 aa, Mycobacterium
AGTALRDG

SEQ ID NO: 423977 - protein, 13 aa, Mycobacterium
AGTANAVARGSTL

SEQ ID NO: 423978 - protein, 9 aa, Mycobacterium
AGTAPGAAV

SEQ ID NO: 423979 - protein, 14 aa, Mycobacterium
AGTAPGARAHDAPT

SEQ ID NO: 423980 - protein, 10 aa, Mycobacterium
AGTAPRKRGE

SEQ ID NO: 423981 - protein, 13 aa, Mycobacterium
AGTAPSGGGAGPI

SEQ ID NO: 423982 - protein, 10 aa, Mycobacterium
AGTAPTTGSV

SEQ ID NO: 423983 - protein, 10 aa, Mycobacterium
AGTARSAQTQ

SEQ ID NO: 423984 - protein, 37 aa, Mycobacterium
AGTASAGAADAAGLATLDGGGFGDPPSLPMLPGSWAP

SEQ ID NO: 423985 - protein, 8 aa, Mycobacterium
AGTASFER

SEQ ID NO: 423986 - protein, 8 aa, Mycobacterium
AGTASGAT

SEQ ID NO: 423987 - protein, 12 aa, Mycobacterium
AGTASNESGASD

SEQ ID NO: 423988 - protein, 12 aa, Mycobacterium
AGTASNESSASE

SEQ ID NO: 423989 - protein, 10 aa, Mycobacterium
AGTATDERPL

SEQ ID NO: 423990 - protein, 7 aa, Mycobacterium
AGTATFG

SEQ ID NO: 423991 - protein, 12 aa, Mycobacterium
AGTATLDGPDAR

SEQ ID NO: 423992 - protein, 6 aa, Mycobacterium
AGTATT

SEQ ID NO: 423993 - protein, 6 aa, Mycobacterium
AGTATV

SEQ ID NO: 423994 - protein, 5 aa, Mycobacterium
AGTAV

SEQ ID NO: 423995 - protein, 12 aa, Mycobacterium
AGTAVADGERID

SEQ ID NO: 423996 - protein, 20 aa, Mycobacterium
AGTAVSTGDAVTTATGATVP

SEQ ID NO: 423997 - protein, 16 aa, Mycobacterium
AGTAYAGAEAVNTATI

SEQ ID NO: 423998 - protein, 4 aa, Mycobacterium
AGTD

SEQ ID NO: 423999 - protein, 9 aa, Mycobacterium
AGTDAHAGG

SEQ ID NO: 424000 - protein, 9 aa, Mycobacterium
AGTDAQRNR

SEQ ID NO: 424001 - protein, 13 aa, Mycobacterium
AGTDDPATPPDRL

SEQ ID NO: 424002 - protein, 19 aa, Mycobacterium
AGTDDTGHPRLRMVADIAL

SEQ ID NO: 424003 - protein, 8 aa, Mycobacterium
AGTDDVRY

SEQ ID NO: 424004 - protein, 5 aa, Mycobacterium
AGTDE

SEQ ID NO: 424005 - protein, 8 aa, Mycobacterium
AGTDEALA

SEQ ID NO: 424006 - protein, 14 aa, Mycobacterium
AGTDEQHPDGQGRI

SEQ ID NO: 424007 - protein, 14 aa, Mycobacterium
AGTDEQHPDSQGRI

SEQ ID NO: 424008 - protein, 6 aa, Mycobacterium
AGTDES

SEQ ID NO: 424009 - protein, 10 aa, Mycobacterium
AGTDGAIAPG

SEQ ID NO: 424010 - protein, 8 aa, Mycobacterium
AGTDGFGG

SEQ ID NO: 424011 - protein, 25 aa, Mycobacterium
AGTDGLAASAASAAGAADPACGAGR

SEQ ID NO: 424012 - protein, 19 aa, Mycobacterium
AGTDGQPVGPDGRVQSPWR

SEQ ID NO: 424013 - protein, 5 aa, Mycobacterium
AGTDI

SEQ ID NO: 424014 - protein, 6 aa, Mycobacterium
AGTDKQ

SEQ ID NO: 424015 - protein, 11 aa, Mycobacterium
AGTDKTRTSID

SEQ ID NO: 424016 - protein, 6 aa, Mycobacterium
AGTDPA

SEQ ID NO: 424017 - protein, 15 aa, Mycobacterium
AGTDPAGSFAAATDG

SEQ ID NO: 424018 - protein, 7 aa, Mycobacterium
AGTDPIE

SEQ ID NO: 424019 - protein, 6 aa, Mycobacterium
AGTDPK

SEQ ID NO: 424020 - protein, 5 aa, Mycobacterium
AGTDR

SEQ ID NO: 424021 - protein, 6 aa, Mycobacterium
AGTDRA

SEQ ID NO: 424022 - protein, 6 aa, Mycobacterium
AGTDRG

SEQ ID NO: 424023 - protein, 12 aa, Mycobacterium
AGTDTIAGSTAT

SEQ ID NO: 424024 - protein, 17 aa, Mycobacterium
AGTDVATGTVGAGVGAR

SEQ ID NO: 424025 - protein, 6 aa, Mycobacterium
AGTDVQ

SEQ ID NO: 424026 - protein, 10 aa, Mycobacterium
AGTEASPTYL

SEQ ID NO: 424027 - protein, 5 aa, Mycobacterium
AGTED

SEQ ID NO: 424028 - protein, 6 aa, Mycobacterium
AGTEDF

SEQ ID NO: 424029 - protein, 6 aa, Mycobacterium
AGTEDL

SEQ ID NO: 424030 - protein, 11 aa, Mycobacterium
AGTEGANASFG

SEQ ID NO: 424031 - protein, 10 aa, Mycobacterium
AGTEGANESF

SEQ ID NO: 424032 - protein, 10 aa, Mycobacterium
AGTEGANSSF

SEQ ID NO: 424033 - protein, 9 aa, Mycobacterium
AGTEGANTA

SEQ ID NO: 424034 - protein, 5 aa, Mycobacterium
AGTEN

SEQ ID NO: 424035 - protein, 7 aa, Mycobacterium
AGTEPEP

SEQ ID NO: 424036 - protein, 6 aa, Mycobacterium
AGTEPG

SEQ ID NO: 424037 - protein, 8 aa, Mycobacterium
AGTEPGGA

SEQ ID NO: 424038 - protein, 5 aa, Mycobacterium
AGTER

SEQ ID NO: 424039 - protein, 6 aa, Mycobacterium
AGTERP

SEQ ID NO: 424040 - protein, 19 aa, Mycobacterium
AGTERPFTGEYTDTKTQGV

SEQ ID NO: 424041 - protein, 7 aa, Mycobacterium
AGTESEV

SEQ ID NO: 424042 - protein, 12 aa, Mycobacterium
AGTFDDPTPAEL

SEQ ID NO: 424043 - protein, 5 aa, Mycobacterium
AGTFT

SEQ ID NO: 424044 - protein, 13 aa, Mycobacterium
AGTGAKAAERHGS

SEQ ID NO: 424045 - protein, 6 aa, Mycobacterium
AGTGAR

SEQ ID NO: 424046 - protein, 8 aa, Mycobacterium
AGTGCGSA

SEQ ID NO: 424047 - protein, 5 aa, Mycobacterium
AGTGD

SEQ ID NO: 424048 - protein, 8 aa, Mycobacterium
AGTGDAAA

SEQ ID NO: 424049 - protein, 10 aa, Mycobacterium
AGTGEARQLG

SEQ ID NO: 424050 - protein, 7 aa, Mycobacterium
AGTGEGA

SEQ ID NO: 424051 - protein, 10 aa, Mycobacterium
AGTGEGGEEG

SEQ ID NO: 424052 - protein, 10 aa, Mycobacterium
AGTGEPAGLD

SEQ ID NO: 424053 - protein, 5 aa, Mycobacterium
AGTGF

SEQ ID NO: 424054 - protein, 20 aa, Mycobacterium
AGTGFKQSLGADGPPGSYED

SEQ ID NO: 424055 - protein, 7 aa, Mycobacterium
AGTGGAA

SEQ ID NO: 424056 - protein, 10 aa, Mycobacterium
AGTGGAGGLP

SEQ ID NO: 424057 - protein, 42 aa, Mycobacterium
AGTGGASSAPTTAASAPVDDTVHDTAGGAAARAAEALVSGGA

SEQ ID NO: 424058 - protein, 27 aa, Mycobacterium
AGTGGNGGAGGTDAYSRGGAGGAGGDA

SEQ ID NO: 424059 - protein, 9 aa, Mycobacterium
AGTGGNSGF

SEQ ID NO: 424060 - protein, 9 aa, Mycobacterium
AGTGGSGGF

SEQ ID NO: 424061 - protein, 23 aa, Mycobacterium
AGTGGSGGTGGYGGGAGGAGGNA

SEQ ID NO: 424062 - protein, 8 aa, Mycobacterium
AGTGGTCA

SEQ ID NO: 424063 - protein, 129 aa, Mycobacterium
AGTGGTGGNGGTGGDGGAGGAGGAPGTGLIPGSTGAAGATGRAGTGGFGGNGGLGSAFGPGGTGGNGGSGGSSSTSAGGGGGTGGAGGTGFDGSAGGAGGNGGQGGDGLGTAGDGGNGGTGGKGSNAPI

SEQ ID NO: 424064 - protein, 8 aa, Mycobacterium
AGTGGVSE

SEQ ID NO: 424065 - protein, 18 aa, Mycobacterium
AGTGHGRARAAANRAGVE

SEQ ID NO: 424066 - protein, 6 aa, Mycobacterium
AGTGHT

SEQ ID NO: 424067 - protein, 6 aa, Mycobacterium
AGTGIA

SEQ ID NO: 424068 - protein, 16 aa, Mycobacterium
AGTGIGAATARRALAE

SEQ ID NO: 424069 - protein, 16 aa, Mycobacterium
AGTGIGSATARRALAE

SEQ ID NO: 424070 - protein, 12 aa, Mycobacterium
AGTGIGSSTARR

SEQ ID NO: 424071 - protein, 12 aa, Mycobacterium
AGTGKSSVSKGL

SEQ ID NO: 424072 - protein, 6 aa, Mycobacterium
AGTGLR

SEQ ID NO: 424073 - protein, 11 aa, Mycobacterium
AGTGLSDPVPK

SEQ ID NO: 424074 - protein, 6 aa, Mycobacterium
AGTGLT

SEQ ID NO: 424075 - protein, 8 aa, Mycobacterium
AGTGNDHA

SEQ ID NO: 424076 - protein, 11 aa, Mycobacterium
AGTGNRAEDQL

SEQ ID NO: 424077 - protein, 17 aa, Mycobacterium
AGTGPEIVRNGTKQGHE

SEQ ID NO: 424078 - protein, 6 aa, Mycobacterium
AGTGPM

SEQ ID NO: 424079 - protein, 7 aa, Mycobacterium
AGTGPMA

SEQ ID NO: 424080 - protein, 17 aa, Mycobacterium
AGTGQHARQREFAQSSK

SEQ ID NO: 424081 - protein, 5 aa, Mycobacterium
AGTGR

SEQ ID NO: 424082 - protein, 6 aa, Mycobacterium
AGTGRN

SEQ ID NO: 424083 - protein, 7 aa, Mycobacterium
AGTGRNT

SEQ ID NO: 424084 - protein, 7 aa, Mycobacterium
AGTGRSH

SEQ ID NO: 424085 - protein, 8 aa, Mycobacterium
AGTGSVDG

SEQ ID NO: 424086 - protein, 13 aa, Mycobacterium
AGTGTATADYGIG

SEQ ID NO: 424087 - protein, 8 aa, Mycobacterium
AGTGTFGP

SEQ ID NO: 424088 - protein, 11 aa, Mycobacterium
AGTGTGTGAEV

SEQ ID NO: 424089 - protein, 8 aa, Mycobacterium
AGTGVGKD

SEQ ID NO: 424090 - protein, 12 aa, Mycobacterium
AGTGVTSNTVAP

SEQ ID NO: 424091 - protein, 21 aa, Mycobacterium
AGTGYAQSLGADGPPGSYSDI

SEQ ID NO: 424092 - protein, 19 aa, Mycobacterium
AGTGYKQSLGSDGPPGSYT

SEQ ID NO: 424093 - protein, 7 aa, Mycobacterium
AGTGYRH

SEQ ID NO: 424094 - protein, 4 aa, Mycobacterium
AGTH

SEQ ID NO: 424095 - protein, 6 aa, Mycobacterium
AGTHEA

SEQ ID NO: 424096 - protein, 6 aa, Mycobacterium
AGTHGA

SEQ ID NO: 424097 - protein, 7 aa, Mycobacterium
AGTHPLS

SEQ ID NO: 424098 - protein, 9 aa, Mycobacterium
AGTHPTGGI

SEQ ID NO: 424099 - protein, 9 aa, Mycobacterium
AGTHQSNTT

SEQ ID NO: 424100 - protein, 4 aa, Mycobacterium
AGTI

SEQ ID NO: 424101 - protein, 12 aa, Mycobacterium
AGTIDDRDFGGP

SEQ ID NO: 424102 - protein, 6 aa, Mycobacterium
AGTIPH

SEQ ID NO: 424103 - protein, 8 aa, Mycobacterium
AGTISASD

SEQ ID NO: 424104 - protein, 6 aa, Mycobacterium
AGTITG

SEQ ID NO: 424105 - protein, 15 aa, Mycobacterium
AGTKAKIRDTRKTLP

SEQ ID NO: 424106 - protein, 7 aa, Mycobacterium
AGTKAPV

SEQ ID NO: 424107 - protein, 6 aa, Mycobacterium
AGTKER

SEQ ID NO: 424108 - protein, 7 aa, Mycobacterium
AGTKERM

SEQ ID NO: 424109 - protein, 7 aa, Mycobacterium
AGTKGVA

SEQ ID NO: 424110 - protein, 12 aa, Mycobacterium
AGTKPNPYRERS

SEQ ID NO: 424111 - protein, 7 aa, Mycobacterium
AGTKRGA

SEQ ID NO: 424112 - protein, 14 aa, Mycobacterium
AGTLARTHEGRANS

SEQ ID NO: 424113 - protein, 5 aa, Mycobacterium
AGTLD

SEQ ID NO: 424114 - protein, 8 aa, Mycobacterium
AGTLGTEP

SEQ ID NO: 424115 - protein, 15 aa, Mycobacterium
AGTLKERLEDRARGS

SEQ ID NO: 424116 - protein, 5 aa, Mycobacterium
AGTLP

SEQ ID NO: 424117 - protein, 10 aa, Mycobacterium
AGTLRDPNNF

SEQ ID NO: 424118 - protein, 6 aa, Mycobacterium
AGTLRG

SEQ ID NO: 424119 - protein, 9 aa, Mycobacterium
AGTLSANGR

SEQ ID NO: 424120 - protein, 5 aa, Mycobacterium
AGTLT

SEQ ID NO: 424121 - protein, 6 aa, Mycobacterium
AGTLTD

SEQ ID NO: 424122 - protein, 4 aa, Mycobacterium
AGTM

SEQ ID NO: 424123 - protein, 12 aa, Mycobacterium
AGTMDTAAGPEL

SEQ ID NO: 424124 - protein, 14 aa, Mycobacterium
AGTMDTDKGPSLQA

SEQ ID NO: 424125 - protein, 11 aa, Mycobacterium
AGTMDTEAGPH

SEQ ID NO: 424126 - protein, 12 aa, Mycobacterium
AGTMDTEDGPQL

SEQ ID NO: 424127 - protein, 11 aa, Mycobacterium
AGTMDTEEGPH

SEQ ID NO: 424128 - protein, 6 aa, Mycobacterium
AGTNAS

SEQ ID NO: 424129 - protein, 6 aa, Mycobacterium
AGTNAV

SEQ ID NO: 424130 - protein, 7 aa, Mycobacterium
AGTNPAF

SEQ ID NO: 424131 - protein, 7 aa, Mycobacterium
AGTNPAY

SEQ ID NO: 424132 - protein, 8 aa, Mycobacterium
AGTNPAYG

SEQ ID NO: 424133 - protein, 9 aa, Mycobacterium
AGTNPAYGP

SEQ ID NO: 424134 - protein, 8 aa, Mycobacterium
AGTNPSLA

SEQ ID NO: 424135 - protein, 4 aa, Mycobacterium
AGTP

SEQ ID NO: 424136 - protein, 9 aa, Mycobacterium
AGTPADDLE

SEQ ID NO: 424137 - protein, 8 aa, Mycobacterium
AGTPAPGV

SEQ ID NO: 424138 - protein, 32 aa, Mycobacterium
AGTPAQAAANPLTPQPEEPAPEPDSARRAEEE

SEQ ID NO: 424139 - protein, 8 aa, Mycobacterium
AGTPAQRA

SEQ ID NO: 424140 - protein, 10 aa, Mycobacterium
AGTPARRLGT

SEQ ID NO: 424141 - protein, 10 aa, Mycobacterium
AGTPASAGGR

SEQ ID NO: 424142 - protein, 14 aa, Mycobacterium
AGTPASTLPRSRRI

SEQ ID NO: 424143 - protein, 6 aa, Mycobacterium
AGTPDA

SEQ ID NO: 424144 - protein, 9 aa, Mycobacterium
AGTPDDVTR

SEQ ID NO: 424145 - protein, 7 aa, Mycobacterium
AGTPDEV

SEQ ID NO: 424146 - protein, 10 aa, Mycobacterium
AGTPDPAADY

SEQ ID NO: 424147 - protein, 9 aa, Mycobacterium
AGTPDRFSR

SEQ ID NO: 424148 - protein, 15 aa, Mycobacterium
AGTPDSKVGTDSQVR

SEQ ID NO: 424149 - protein, 5 aa, Mycobacterium
AGTPE

SEQ ID NO: 424150 - protein, 7 aa, Mycobacterium
AGTPEAD

SEQ ID NO: 424151 - protein, 8 aa, Mycobacterium
AGTPEADD

SEQ ID NO: 424152 - protein, 10 aa, Mycobacterium
AGTPEARHDE

SEQ ID NO: 424153 - protein, 7 aa, Mycobacterium
AGTPEKL

SEQ ID NO: 424154 - protein, 8 aa, Mycobacterium
AGTPELRN

SEQ ID NO: 424155 - protein, 20 aa, Mycobacterium
AGTPEPAADLDPATPLPAYL

SEQ ID NO: 424156 - protein, 8 aa, Mycobacterium
AGTPEQKK

SEQ ID NO: 424157 - protein, 5 aa, Mycobacterium
AGTPF

SEQ ID NO: 424158 - protein, 6 aa, Mycobacterium
AGTPGA

SEQ ID NO: 424159 - protein, 14 aa, Mycobacterium
AGTPGAADKVVVTF

SEQ ID NO: 424160 - protein, 7 aa, Mycobacterium
AGTPGEV

SEQ ID NO: 424161 - protein, 8 aa, Mycobacterium
AGTPGKRL

SEQ ID NO: 424162 - protein, 6 aa, Mycobacterium
AGTPGL

SEQ ID NO: 424163 - protein, 10 aa, Mycobacterium
AGTPGTRDGG

SEQ ID NO: 424164 - protein, 7 aa, Mycobacterium
AGTPIDR

SEQ ID NO: 424165 - protein, 10 aa, Mycobacterium
AGTPIRDGHP

SEQ ID NO: 424166 - protein, 8 aa, Mycobacterium
AGTPLAEA

SEQ ID NO: 424167 - protein, 8 aa, Mycobacterium
AGTPLDRS

SEQ ID NO: 424168 - protein, 10 aa, Mycobacterium
AGTPLQPGQI

SEQ ID NO: 424169 - protein, 6 aa, Mycobacterium
AGTPLR

SEQ ID NO: 424170 - protein, 8 aa, Mycobacterium
AGTPLTPA

SEQ ID NO: 424171 - protein, 10 aa, Mycobacterium
AGTPLTPAQL

SEQ ID NO: 424172 - protein, 6 aa, Mycobacterium
AGTPMT

SEQ ID NO: 424173 - protein, 7 aa, Mycobacterium
AGTPPEA

SEQ ID NO: 424174 - protein, 7 aa, Mycobacterium
AGTPPSE

SEQ ID NO: 424175 - protein, 8 aa, Mycobacterium
AGTPPTRT

SEQ ID NO: 424176 - protein, 6 aa, Mycobacterium
AGTPQC

SEQ ID NO: 424177 - protein, 5 aa, Mycobacterium
AGTPR

SEQ ID NO: 424178 - protein, 7 aa, Mycobacterium
AGTPRGR

SEQ ID NO: 424179 - protein, 6 aa, Mycobacterium
AGTPRN

SEQ ID NO: 424180 - protein, 7 aa, Mycobacterium
AGTPSAG

SEQ ID NO: 424181 - protein, 7 aa, Mycobacterium
AGTPSAT

SEQ ID NO: 424182 - protein, 10 aa, Mycobacterium
AGTPSGESPL

SEQ ID NO: 424183 - protein, 5 aa, Mycobacterium
AGTPV

SEQ ID NO: 424184 - protein, 6 aa, Mycobacterium
AGTPVG

SEQ ID NO: 424185 - protein, 9 aa, Mycobacterium
AGTPVPAAD

SEQ ID NO: 424186 - protein, 10 aa, Mycobacterium
AGTPVTPAQL

SEQ ID NO: 424187 - protein, 8 aa, Mycobacterium
AGTPVTRT

SEQ ID NO: 424188 - protein, 7 aa, Mycobacterium
AGTQEGI

SEQ ID NO: 424189 - protein, 12 aa, Mycobacterium
AGTQGNQLSSDQ

SEQ ID NO: 424190 - protein, 8 aa, Mycobacterium
AGTQQGIV

SEQ ID NO: 424191 - protein, 7 aa, Mycobacterium
AGTQQRP

SEQ ID NO: 424192 - protein, 7 aa, Mycobacterium
AGTQSGL

SEQ ID NO: 424193 - protein, 12 aa, Mycobacterium
AGTRADRLSGGT

SEQ ID NO: 424194 - protein, 8 aa, Mycobacterium
AGTRAHSA

SEQ ID NO: 424195 - protein, 10 aa, Mycobacterium
AGTRAHSARP

SEQ ID NO: 424196 - protein, 7 aa, Mycobacterium
AGTRARV

SEQ ID NO: 424197 - protein, 7 aa, Mycobacterium
AGTRDPD

SEQ ID NO: 424198 - protein, 7 aa, Mycobacterium
AGTRDTG

SEQ ID NO: 424199 - protein, 6 aa, Mycobacterium
AGTREA

SEQ ID NO: 424200 - protein, 6 aa, Mycobacterium
AGTREH

SEQ ID NO: 424201 - protein, 15 aa, Mycobacterium
AGTRGDLRPDADTDT

SEQ ID NO: 424202 - protein, 36 aa, Mycobacterium
AGTRGGNAGLLGNGGPGGAGGPGATGGSGGSGGWLL

SEQ ID NO: 424203 - protein, 6 aa, Mycobacterium
AGTRGW

SEQ ID NO: 424204 - protein, 5 aa, Mycobacterium
AGTRI

SEQ ID NO: 424205 - protein, 16 aa, Mycobacterium
AGTRKSHCDDEELSEL

SEQ ID NO: 424206 - protein, 6 aa, Mycobacterium
AGTRMR

SEQ ID NO: 424207 - protein, 11 aa, Mycobacterium
AGTRMRSDTPK

SEQ ID NO: 424208 - protein, 6 aa, Mycobacterium
AGTRPT

SEQ ID NO: 424209 - protein, 11 aa, Mycobacterium
AGTRSEPADAA

SEQ ID NO: 424210 - protein, 11 aa, Mycobacterium
AGTRSGDPEAR

SEQ ID NO: 424211 - protein, 6 aa, Mycobacterium
AGTRTG

SEQ ID NO: 424212 - protein, 5 aa, Mycobacterium
AGTRW

SEQ ID NO: 424213 - protein, 6 aa, Mycobacterium
AGTRYT

SEQ ID NO: 424214 - protein, 4 aa, Mycobacterium
AGTS

SEQ ID NO: 424215 - protein, 8 aa, Mycobacterium
AGTSAAAR

SEQ ID NO: 424216 - protein, 7 aa, Mycobacterium
AGTSAGA

SEQ ID NO: 424217 - protein, 12 aa, Mycobacterium
AGTSDARARTDL

SEQ ID NO: 424218 - protein, 13 aa, Mycobacterium
AGTSDDKARADLH

SEQ ID NO: 424219 - protein, 7 aa, Mycobacterium
AGTSDIP

SEQ ID NO: 424220 - protein, 8 aa, Mycobacterium
AGTSDPAA

SEQ ID NO: 424221 - protein, 13 aa, Mycobacterium
AGTSDPYAQSDLR

SEQ ID NO: 424222 - protein, 8 aa, Mycobacterium
AGTSDRRA

SEQ ID NO: 424223 - protein, 17 aa, Mycobacterium
AGTSGAKGIKNAEPADI

SEQ ID NO: 424224 - protein, 15 aa, Mycobacterium
AGTSGPDSATGTPEQ

SEQ ID NO: 424225 - protein, 6 aa, Mycobacterium
AGTSHP

SEQ ID NO: 424226 - protein, 5 aa, Mycobacterium
AGTSI

SEQ ID NO: 424227 - protein, 15 aa, Mycobacterium
AGTSMSGGTSGGPVN

SEQ ID NO: 424228 - protein, 10 aa, Mycobacterium
AGTSNDRAHA

SEQ ID NO: 424229 - protein, 9 aa, Mycobacterium
AGTSPEGLD

SEQ ID NO: 424230 - protein, 10 aa, Mycobacterium
AGTSPSRAAY

SEQ ID NO: 424231 - protein, 9 aa, Mycobacterium
AGTSPVGTF

SEQ ID NO: 424232 - protein, 12 aa, Mycobacterium
AGTSPVGTFPPN

SEQ ID NO: 424233 - protein, 9 aa, Mycobacterium
AGTSQPATR

SEQ ID NO: 424234 - protein, 7 aa, Mycobacterium
AGTSRGG

SEQ ID NO: 424235 - protein, 6 aa, Mycobacterium
AGTSRH

SEQ ID NO: 424236 - protein, 8 aa, Mycobacterium
AGTSRVDQ

SEQ ID NO: 424237 - protein, 6 aa, Mycobacterium
AGTSSV

SEQ ID NO: 424238 - protein, 8 aa, Mycobacterium
AGTSTAGS

SEQ ID NO: 424239 - protein, 10 aa, Mycobacterium
AGTSTPDDVR

SEQ ID NO: 424240 - protein, 11 aa, Mycobacterium
AGTSVPRPSWR

SEQ ID NO: 424241 - protein, 5 aa, Mycobacterium
AGTTA

SEQ ID NO: 424242 - protein, 21 aa, Mycobacterium
AGTTAGQAVRDAGLPSRGAPD

SEQ ID NO: 424243 - protein, 8 aa, Mycobacterium
AGTTAGQR

SEQ ID NO: 424244 - protein, 7 aa, Mycobacterium
AGTTATD

SEQ ID NO: 424245 - protein, 10 aa, Mycobacterium
AGTTDARNEE

SEQ ID NO: 424246 - protein, 7 aa, Mycobacterium
AGTTDDP

SEQ ID NO: 424247 - protein, 11 aa, Mycobacterium
AGTTDEGEAWR

SEQ ID NO: 424248 - protein, 10 aa, Mycobacterium
AGTTEPDADL

SEQ ID NO: 424249 - protein, 12 aa, Mycobacterium
AGTTEVRDSTTD

SEQ ID NO: 424250 - protein, 11 aa, Mycobacterium
AGTTEVRETTT

SEQ ID NO: 424251 - protein, 18 aa, Mycobacterium
AGTTGAGPATDIAAQTRD

SEQ ID NO: 424252 - protein, 18 aa, Mycobacterium
AGTTGNGPAGDIAAQTRD

SEQ ID NO: 424253 - protein, 12 aa, Mycobacterium
AGTTGPAGARGA

SEQ ID NO: 424254 - protein, 7 aa, Mycobacterium
AGTTGSL

SEQ ID NO: 424255 - protein, 19 aa, Mycobacterium
AGTTGTGPAGDIAAQTRDA

SEQ ID NO: 424256 - protein, 7 aa, Mycobacterium
AGTTGYD

SEQ ID NO: 424257 - protein, 9 aa, Mycobacterium
AGTTGYSER

SEQ ID NO: 424258 - protein, 12 aa, Mycobacterium
AGTTIDATPTGT

SEQ ID NO: 424259 - protein, 16 aa, Mycobacterium
AGTTKAAGAKAISGND

SEQ ID NO: 424260 - protein, 15 aa, Mycobacterium
AGTTKAKGATVVSGS

SEQ ID NO: 424261 - protein, 16 aa, Mycobacterium
AGTTKASGAKAISGSD

SEQ ID NO: 424262 - protein, 9 aa, Mycobacterium
AGTTKGTGL

SEQ ID NO: 424263 - protein, 7 aa, Mycobacterium
AGTTKTL

SEQ ID NO: 424264 - protein, 6 aa, Mycobacterium
AGTTNR

SEQ ID NO: 424265 - protein, 13 aa, Mycobacterium
AGTTPGSKVHEAP

SEQ ID NO: 424266 - protein, 13 aa, Mycobacterium
AGTTPSDAAREAR

SEQ ID NO: 424267 - protein, 10 aa, Mycobacterium
AGTTRKDNAF

SEQ ID NO: 424268 - protein, 6 aa, Mycobacterium
AGTTRP

SEQ ID NO: 424269 - protein, 6 aa, Mycobacterium
AGTTRR

SEQ ID NO: 424270 - protein, 11 aa, Mycobacterium
AGTTRSSGVSV

SEQ ID NO: 424271 - protein, 9 aa, Mycobacterium
AGTTSMPRS

SEQ ID NO: 424272 - protein, 7 aa, Mycobacterium
AGTTSYN

SEQ ID NO: 424273 - protein, 7 aa, Mycobacterium
AGTTTAR

SEQ ID NO: 424274 - protein, 6 aa, Mycobacterium
AGTTTL

SEQ ID NO: 424275 - protein, 8 aa, Mycobacterium
AGTTTTEL

SEQ ID NO: 424276 - protein, 9 aa, Mycobacterium
AGTTYAEEA

SEQ ID NO: 424277 - protein, 4 aa, Mycobacterium
AGTV

SEQ ID NO: 424278 - protein, 5 aa, Mycobacterium
AGTVA

SEQ ID NO: 424279 - protein, 6 aa, Mycobacterium
AGTVAH

SEQ ID NO: 424280 - protein, 14 aa, Mycobacterium
AGTVALPGAETPVS

SEQ ID NO: 424281 - protein, 6 aa, Mycobacterium
AGTVDS

SEQ ID NO: 424282 - protein, 5 aa, Mycobacterium
AGTVE

SEQ ID NO: 424283 - protein, 16 aa, Mycobacterium
AGTVEAVGPGVTNVEP

SEQ ID NO: 424284 - protein, 19 aa, Mycobacterium
AGTVGAAGAPAGAGAAPVG

SEQ ID NO: 424285 - protein, 15 aa, Mycobacterium
AGTVGPGGTASGPVN

SEQ ID NO: 424286 - protein, 5 aa, Mycobacterium
AGTVK

SEQ ID NO: 424287 - protein, 7 aa, Mycobacterium
AGTVKPA

SEQ ID NO: 424288 - protein, 7 aa, Mycobacterium
AGTVNVD

SEQ ID NO: 424289 - protein, 13 aa, Mycobacterium
AGTVPAGTPIPEA

SEQ ID NO: 424290 - protein, 6 aa, Mycobacterium
AGTVRG

SEQ ID NO: 424291 - protein, 8 aa, Mycobacterium
AGTVTPGA

SEQ ID NO: 424292 - protein, 8 aa, Mycobacterium
AGTWDEAT

SEQ ID NO: 424293 - protein, 10 aa, Mycobacterium
AGTWEDASDL

SEQ ID NO: 424294 - protein, 9 aa, Mycobacterium
AGTWPQPSA

SEQ ID NO: 424295 - protein, 10 aa, Mycobacterium
AGTWRDPNNF

SEQ ID NO: 424296 - protein, 5 aa, Mycobacterium
AGTWT

SEQ ID NO: 424297 - protein, 4 aa, Mycobacterium
AGTY

SEQ ID NO: 424298 - protein, 20 aa, Mycobacterium
AGTYAAAETANSSAAASPLS

SEQ ID NO: 424299 - protein, 8 aa, Mycobacterium
AGTYADPT

SEQ ID NO: 424300 - protein, 6 aa, Mycobacterium
AGTYDT

SEQ ID NO: 424301 - protein, 24 aa, Mycobacterium
AGTYGATESLNSAAADSPLSGLTS

SEQ ID NO: 424302 - protein, 11 aa, Mycobacterium
AGTYRSAGGDS

SEQ ID NO: 424303 - protein, 6 aa, Mycobacterium
AGVAAD

SEQ ID NO: 424304 - protein, 9 aa, Mycobacterium
AGVAARDGH

SEQ ID NO: 424305 - protein, 10 aa, Mycobacterium
AGVAARSGRR

SEQ ID NO: 424306 - protein, 11 aa, Mycobacterium
AGVAAYPKNPF

SEQ ID NO: 424307 - protein, 19 aa, Mycobacterium
AGVAEGTPGQRHASVDPSR

SEQ ID NO: 424308 - protein, 6 aa, Mycobacterium
AGVAGA

SEQ ID NO: 424309 - protein, 10 aa, Mycobacterium
AGVAGADPAG

SEQ ID NO: 424310 - protein, 6 aa, Mycobacterium
AGVAGK

SEQ ID NO: 424311 - protein, 5 aa, Mycobacterium
AGVAK

SEQ ID NO: 424312 - protein, 6 aa, Mycobacterium
AGVAPD

SEQ ID NO: 424313 - protein, 7 aa, Mycobacterium
AGVAPED

SEQ ID NO: 424314 - protein, 7 aa, Mycobacterium
AGVAPGD

SEQ ID NO: 424315 - protein, 12 aa, Mycobacterium
AGVAPPAGEAPD

SEQ ID NO: 424316 - protein, 12 aa, Mycobacterium
AGVAPPKHEAPD

SEQ ID NO: 424317 - protein, 7 aa, Mycobacterium
AGVAPSS

SEQ ID NO: 424318 - protein, 6 aa, Mycobacterium
AGVAPT

SEQ ID NO: 424319 - protein, 15 aa, Mycobacterium
AGVAQTQTRIALRSQ

SEQ ID NO: 424320 - protein, 6 aa, Mycobacterium
AGVARR

SEQ ID NO: 424321 - protein, 6 aa, Mycobacterium
AGVASR

SEQ ID NO: 424322 - protein, 6 aa, Mycobacterium
AGVASS

SEQ ID NO: 424323 - protein, 14 aa, Mycobacterium
AGVATAPTSVAAEQ

SEQ ID NO: 424324 - protein, 9 aa, Mycobacterium
AGVATDARG

SEQ ID NO: 424325 - protein, 9 aa, Mycobacterium
AGVATSDRE

SEQ ID NO: 424326 - protein, 6 aa, Mycobacterium
AGVDAR

SEQ ID NO: 424327 - protein, 5 aa, Mycobacterium
AGVDD

SEQ ID NO: 424328 - protein, 13 aa, Mycobacterium
AGVDDDSGATTFA

SEQ ID NO: 424329 - protein, 10 aa, Mycobacterium
AGVDDDTGAV

SEQ ID NO: 424330 - protein, 8 aa, Mycobacterium
AGVDDPDG

SEQ ID NO: 424331 - protein, 10 aa, Mycobacterium
AGVDEETAAA

SEQ ID NO: 424332 - protein, 9 aa, Mycobacterium
AGVDESRIG

SEQ ID NO: 424333 - protein, 10 aa, Mycobacterium
AGVDGAGEAP

SEQ ID NO: 424334 - protein, 22 aa, Mycobacterium
AGVDGIGSAVSAAGTAAAGPTA

SEQ ID NO: 424335 - protein, 11 aa, Mycobacterium
AGVDGSNVDRS

SEQ ID NO: 424336 - protein, 11 aa, Mycobacterium
AGVDGSNVDSN

SEQ ID NO: 424337 - protein, 11 aa, Mycobacterium
AGVDGSNVGST

SEQ ID NO: 424338 - protein, 11 aa, Mycobacterium
AGVDGSNVNRN

SEQ ID NO: 424339 - protein, 5 aa, Mycobacterium
AGVDH

SEQ ID NO: 424340 - protein, 6 aa, Mycobacterium
AGVDHR

SEQ ID NO: 424341 - protein, 6 aa, Mycobacterium
AGVDKS

SEQ ID NO: 424342 - protein, 5 aa, Mycobacterium
AGVDP

SEQ ID NO: 424343 - protein, 6 aa, Mycobacterium
AGVDPA

SEQ ID NO: 424344 - protein, 7 aa, Mycobacterium
AGVDPAR

SEQ ID NO: 424345 - protein, 8 aa, Mycobacterium
AGVDPARI

SEQ ID NO: 424346 - protein, 8 aa, Mycobacterium
AGVDPASV

SEQ ID NO: 424347 - protein, 7 aa, Mycobacterium
AGVDPAT

SEQ ID NO: 424348 - protein, 7 aa, Mycobacterium
AGVDPDT

SEQ ID NO: 424349 - protein, 7 aa, Mycobacterium
AGVDPEA

SEQ ID NO: 424350 - protein, 6 aa, Mycobacterium
AGVDPG

SEQ ID NO: 424351 - protein, 9 aa, Mycobacterium
AGVDPGRVG

SEQ ID NO: 424352 - protein, 44 aa, Mycobacterium
AGVDPGSAGSAVPRQHRAGDRRPVRGTAEHQHRRPARPEPPARR

SEQ ID NO: 424353 - protein, 6 aa, Mycobacterium
AGVDPL

SEQ ID NO: 424354 - protein, 7 aa, Mycobacterium
AGVDPNQ

SEQ ID NO: 424355 - protein, 6 aa, Mycobacterium
AGVDPR

SEQ ID NO: 424356 - protein, 6 aa, Mycobacterium
AGVDRD

SEQ ID NO: 424357 - protein, 9 aa, Mycobacterium
AGVDTGARL

SEQ ID NO: 424358 - protein, 7 aa, Mycobacterium
AGVDTRD

SEQ ID NO: 424359 - protein, 14 aa, Mycobacterium
AGVDTSARLNRSYG

SEQ ID NO: 424360 - protein, 8 aa, Mycobacterium
AGVEADTV

SEQ ID NO: 424361 - protein, 60 aa, Mycobacterium
AGVEAGRGAPDRPRRERPAGTRPRRSGSSGTTATSTEAGRAAAETPASDGASAPSAETTE

SEQ ID NO: 424362 - protein, 7 aa, Mycobacterium
AGVEGAD

SEQ ID NO: 424363 - protein, 5 aa, Mycobacterium
AGVEP

SEQ ID NO: 424364 - protein, 7 aa, Mycobacterium
AGVEPDP

SEQ ID NO: 424365 - protein, 11 aa, Mycobacterium
AGVEPDPRRAR

SEQ ID NO: 424366 - protein, 7 aa, Mycobacterium
AGVEPGD

SEQ ID NO: 424367 - protein, 8 aa, Mycobacterium
AGVEPGSV

SEQ ID NO: 424368 - protein, 7 aa, Mycobacterium
AGVEPGT

SEQ ID NO: 424369 - protein, 7 aa, Mycobacterium
AGVEPND

SEQ ID NO: 424370 - protein, 6 aa, Mycobacterium
AGVEPR

SEQ ID NO: 424371 - protein, 9 aa, Mycobacterium
AGVEPSSEL

SEQ ID NO: 424372 - protein, 7 aa, Mycobacterium
AGVEPTG

SEQ ID NO: 424373 - protein, 6 aa, Mycobacterium
AGVEQQ

SEQ ID NO: 424374 - protein, 5 aa, Mycobacterium
AGVER

SEQ ID NO: 424375 - protein, 14 aa, Mycobacterium
AGVERALRARAFDV

SEQ ID NO: 424376 - protein, 6 aa, Mycobacterium
AGVERD

SEQ ID NO: 424377 - protein, 14 aa, Mycobacterium
AGVERSLRAREFDV

SEQ ID NO: 424378 - protein, 8 aa, Mycobacterium
AGVESGDR

SEQ ID NO: 424379 - protein, 8 aa, Mycobacterium
AGVETDKR

SEQ ID NO: 424380 - protein, 30 aa, Mycobacterium
AGVETPGPASFPPPFADPPVPAAPVDQTTL

SEQ ID NO: 424381 - protein, 5 aa, Mycobacterium
AGVGA

SEQ ID NO: 424382 - protein, 7 aa, Mycobacterium
AGVGAAG

SEQ ID NO: 424383 - protein, 7 aa, Mycobacterium
AGVGAEG

SEQ ID NO: 424384 - protein, 13 aa, Mycobacterium
AGVGAKGVRRTRL

SEQ ID NO: 424385 - protein, 6 aa, Mycobacterium
AGVGAP

SEQ ID NO: 424386 - protein, 12 aa, Mycobacterium
AGVGAPPLSEAD

SEQ ID NO: 424387 - protein, 6 aa, Mycobacterium
AGVGAQ

SEQ ID NO: 424388 - protein, 6 aa, Mycobacterium
AGVGAS

SEQ ID NO: 424389 - protein, 12 aa, Mycobacterium
AGVGDANPYAGR

SEQ ID NO: 424390 - protein, 6 aa, Mycobacterium
AGVGDD

SEQ ID NO: 424391 - protein, 6 aa, Mycobacterium
AGVGGA

SEQ ID NO: 424392 - protein, 8 aa, Mycobacterium
AGVGGADS

SEQ ID NO: 424393 - protein, 8 aa, Mycobacterium
AGVGGADT

SEQ ID NO: 424394 - protein, 8 aa, Mycobacterium
AGVGGGGP

SEQ ID NO: 424395 - protein, 6 aa, Mycobacterium
AGVGGP

SEQ ID NO: 424396 - protein, 7 aa, Mycobacterium
AGVGGSQ

SEQ ID NO: 424397 - protein, 6 aa, Mycobacterium
AGVGGT

SEQ ID NO: 424398 - protein, 6 aa, Mycobacterium
AGVGHG

SEQ ID NO: 424399 - protein, 7 aa, Mycobacterium
AGVGKPD

SEQ ID NO: 424400 - protein, 6 aa, Mycobacterium
AGVGKT

SEQ ID NO: 424401 - protein, 15 aa, Mycobacterium
AGVGNAGASVSAGLG

SEQ ID NO: 424402 - protein, 9 aa, Mycobacterium
AGVGNRSGL

SEQ ID NO: 424403 - protein, 5 aa, Mycobacterium
AGVGP

SEQ ID NO: 424404 - protein, 8 aa, Mycobacterium
AGVGPDGS

SEQ ID NO: 424405 - protein, 8 aa, Mycobacterium
AGVGPGDA

SEQ ID NO: 424406 - protein, 6 aa, Mycobacterium
AGVGRS

SEQ ID NO: 424407 - protein, 6 aa, Mycobacterium
AGVGSD

SEQ ID NO: 424408 - protein, 20 aa, Mycobacterium
AGVGSGRARIRQEARRRRRA

SEQ ID NO: 424409 - protein, 6 aa, Mycobacterium
AGVGSP

SEQ ID NO: 424410 - protein, 6 aa, Mycobacterium
AGVGST

SEQ ID NO: 424411 - protein, 7 aa, Mycobacterium
AGVGTEV

SEQ ID NO: 424412 - protein, 10 aa, Mycobacterium
AGVGTQIADG

SEQ ID NO: 424413 - protein, 12 aa, Mycobacterium
AGVGVDDPGDWH

SEQ ID NO: 424414 - protein, 12 aa, Mycobacterium
AGVIGTPQRARA

SEQ ID NO: 424415 - protein, 6 aa, Mycobacterium
AGVKAV

SEQ ID NO: 424416 - protein, 7 aa, Mycobacterium
AGVKPDE

SEQ ID NO: 424417 - protein, 13 aa, Mycobacterium
AGVNGTGSARRRL

SEQ ID NO: 424418 - protein, 7 aa, Mycobacterium
AGVNNGD

SEQ ID NO: 424419 - protein, 11 aa, Mycobacterium
AGVNPGALEGE

SEQ ID NO: 424420 - protein, 6 aa, Mycobacterium
AGVNPR

SEQ ID NO: 424421 - protein, 5 aa, Mycobacterium
AGVNR

SEQ ID NO: 424422 - protein, 12 aa, Mycobacterium
AGVPAAAADQVS

SEQ ID NO: 424423 - protein, 8 aa, Mycobacterium
AGVPAGLS

SEQ ID NO: 424424 - protein, 14 aa, Mycobacterium
AGVPAGPMNRPPDI

SEQ ID NO: 424425 - protein, 10 aa, Mycobacterium
AGVPAPPLSA

SEQ ID NO: 424426 - protein, 9 aa, Mycobacterium
AGVPAPTKK

SEQ ID NO: 424427 - protein, 7 aa, Mycobacterium
AGVPARG

SEQ ID NO: 424428 - protein, 37 aa, Mycobacterium
AGVPDAAGPTAEAGWDGPLSRKRETYAPKPDANRVDS

SEQ ID NO: 424429 - protein, 14 aa, Mycobacterium
AGVPDGLPRPANAT

SEQ ID NO: 424430 - protein, 5 aa, Mycobacterium
AGVPE

SEQ ID NO: 424431 - protein, 6 aa, Mycobacterium
AGVPED

SEQ ID NO: 424432 - protein, 6 aa, Mycobacterium
AGVPER

SEQ ID NO: 424433 - protein, 5 aa, Mycobacterium
AGVPG

SEQ ID NO: 424434 - protein, 11 aa, Mycobacterium
AGVPGADPESW

SEQ ID NO: 424435 - protein, 10 aa, Mycobacterium
AGVPGADPSQ

SEQ ID NO: 424436 - protein, 8 aa, Mycobacterium
AGVPGDAP

SEQ ID NO: 424437 - protein, 55 aa, Mycobacterium
AGVPGDCGASTGAAIATGATDAPQSSAAATAAVTAATKTAETVAGPVPADRTGPA

SEQ ID NO: 424438 - protein, 57 aa, Mycobacterium
AGVPGDGGTGGVAPDDGVTTEAGGLPGTGGVPAEDDELAGGLTTGGAGFGGSVNERA

SEQ ID NO: 424439 - protein, 8 aa, Mycobacterium
AGVPGDGW

SEQ ID NO: 424440 - protein, 6 aa, Mycobacterium
AGVPGG

SEQ ID NO: 424441 - protein, 10 aa, Mycobacterium
AGVPGPLARS

SEQ ID NO: 424442 - protein, 6 aa, Mycobacterium
AGVPIP

SEQ ID NO: 424443 - protein, 6 aa, Mycobacterium
AGVPKG

SEQ ID NO: 424444 - protein, 13 aa, Mycobacterium
AGVPPDLPRPANA

SEQ ID NO: 424445 - protein, 8 aa, Mycobacterium
AGVPPETI

SEQ ID NO: 424446 - protein, 8 aa, Mycobacterium
AGVPPETV

SEQ ID NO: 424447 - protein, 7 aa, Mycobacterium
AGVPPHP

SEQ ID NO: 424448 - protein, 8 aa, Mycobacterium
AGVPPRDC

SEQ ID NO: 424449 - protein, 10 aa, Mycobacterium
AGVPPRDTGL

SEQ ID NO: 424450 - protein, 7 aa, Mycobacterium
AGVPQDQ

SEQ ID NO: 424451 - protein, 8 aa, Mycobacterium
AGVPQEGR

SEQ ID NO: 424452 - protein, 7 aa, Mycobacterium
AGVPQSR

SEQ ID NO: 424453 - protein, 5 aa, Mycobacterium
AGVPR

SEQ ID NO: 424454 - protein, 44 aa, Mycobacterium
AGVPRPATGEWASTATAPVPLDAEPEPAPALAAAGSPAAGGASL

SEQ ID NO: 424455 - protein, 6 aa, Mycobacterium
AGVPSD

SEQ ID NO: 424456 - protein, 8 aa, Mycobacterium
AGVPSGPI

SEQ ID NO: 424457 - protein, 13 aa, Mycobacterium
AGVPSRTTPSVTP

SEQ ID NO: 424458 - protein, 10 aa, Mycobacterium
AGVPSTQALS

SEQ ID NO: 424459 - protein, 7 aa, Mycobacterium
AGVPTDY

SEQ ID NO: 424460 - protein, 7 aa, Mycobacterium
AGVPTGS

SEQ ID NO: 424461 - protein, 5 aa, Mycobacterium
AGVPV

SEQ ID NO: 424462 - protein, 4 aa, Mycobacterium
AGVQ

SEQ ID NO: 424463 - protein, 15 aa, Mycobacterium
AGVQADSTAADNSFS

SEQ ID NO: 424464 - protein, 6 aa, Mycobacterium
AGVQEP

SEQ ID NO: 424465 - protein, 7 aa, Mycobacterium
AGVQGEK

SEQ ID NO: 424466 - protein, 9 aa, Mycobacterium
AGVQGLQNG

SEQ ID NO: 424467 - protein, 7 aa, Mycobacterium
AGVQPAD

SEQ ID NO: 424468 - protein, 6 aa, Mycobacterium
AGVQPE

SEQ ID NO: 424469 - protein, 8 aa, Mycobacterium
AGVQPGDR

SEQ ID NO: 424470 - protein, 5 aa, Mycobacterium
AGVQQ

SEQ ID NO: 424471 - protein, 10 aa, Mycobacterium
AGVQTTATRY

SEQ ID NO: 424472 - protein, 7 aa, Mycobacterium
AGVQTTS

SEQ ID NO: 424473 - protein, 17 aa, Mycobacterium
AGVQVGAKDAKMGQEGA

SEQ ID NO: 424474 - protein, 4 aa, Mycobacterium
AGVR

SEQ ID NO: 424475 - protein, 18 aa, Mycobacterium
AGVRADGSPTLSDNGTPV

SEQ ID NO: 424476 - protein, 37 aa, Mycobacterium
AGVRAKEAACGDRPGGGGGHPAELAGSAPRDPDRARG

SEQ ID NO: 424477 - protein, 11 aa, Mycobacterium
AGVRAPDAEDI

SEQ ID NO: 424478 - protein, 5 aa, Mycobacterium
AGVRD

SEQ ID NO: 424479 - protein, 6 aa, Mycobacterium
AGVRDQ

SEQ ID NO: 424480 - protein, 11 aa, Mycobacterium
AGVRDSSEAAR

SEQ ID NO: 424481 - protein, 5 aa, Mycobacterium
AGVRG

SEQ ID NO: 424482 - protein, 7 aa, Mycobacterium
AGVRGGD

SEQ ID NO: 424483 - protein, 21 aa, Mycobacterium
AGVRGQPATAPYSAAKGALER

SEQ ID NO: 424484 - protein, 21 aa, Mycobacterium
AGVRGQPGTAPYSAAKGALER

SEQ ID NO: 424485 - protein, 16 aa, Mycobacterium
AGVRKDSAAPLKGELE

SEQ ID NO: 424486 - protein, 5 aa, Mycobacterium
AGVRP

SEQ ID NO: 424487 - protein, 6 aa, Mycobacterium
AGVRPD

SEQ ID NO: 424488 - protein, 7 aa, Mycobacterium
AGVRPGD

SEQ ID NO: 424489 - protein, 14 aa, Mycobacterium
AGVRRGNALPSHTH

SEQ ID NO: 424490 - protein, 10 aa, Mycobacterium
AGVRSRLDGS

SEQ ID NO: 424491 - protein, 10 aa, Mycobacterium
AGVRSRQQRG

SEQ ID NO: 424492 - protein, 13 aa, Mycobacterium
AGVRTGKVDPKIT

SEQ ID NO: 424493 - protein, 17 aa, Mycobacterium
AGVRTGPQKGGVDPKIT

SEQ ID NO: 424494 - protein, 14 aa, Mycobacterium
AGVSAETAAAENPV

SEQ ID NO: 424495 - protein, 10 aa, Mycobacterium
AGVSAGEGVR

SEQ ID NO: 424496 - protein, 8 aa, Mycobacterium
AGVSAPYS

SEQ ID NO: 424497 - protein, 9 aa, Mycobacterium
AGVSDDTPL

SEQ ID NO: 424498 - protein, 7 aa, Mycobacterium
AGVSEDT

SEQ ID NO: 424499 - protein, 6 aa, Mycobacterium
AGVSGD

SEQ ID NO: 424500 - protein, 7 aa, Mycobacterium
AGVSGER

SEQ ID NO: 424501 - protein, 9 aa, Mycobacterium
AGVSGWPRR

SEQ ID NO: 424502 - protein, 9 aa, Mycobacterium
AGVSNDTPL

SEQ ID NO: 424503 - protein, 5 aa, Mycobacterium
AGVSP

SEQ ID NO: 424504 - protein, 7 aa, Mycobacterium
AGVSPAS

SEQ ID NO: 424505 - protein, 7 aa, Mycobacterium
AGVSPAT

SEQ ID NO: 424506 - protein, 6 aa, Mycobacterium
AGVSPD

SEQ ID NO: 424507 - protein, 9 aa, Mycobacterium
AGVSPGSPR

SEQ ID NO: 424508 - protein, 7 aa, Mycobacterium
AGVSRAT

SEQ ID NO: 424509 - protein, 7 aa, Mycobacterium
AGVSREE

SEQ ID NO: 424510 - protein, 5 aa, Mycobacterium
AGVSS

SEQ ID NO: 424511 - protein, 12 aa, Mycobacterium
AGVSSPASGAWS

SEQ ID NO: 424512 - protein, 5 aa, Mycobacterium
AGVST

SEQ ID NO: 424513 - protein, 23 aa, Mycobacterium
AGVSTDSGIPDYRGPDSPPSNPM

SEQ ID NO: 424514 - protein, 10 aa, Mycobacterium
AGVSTQRGDR

SEQ ID NO: 424515 - protein, 9 aa, Mycobacterium
AGVTAADLG

SEQ ID NO: 424516 - protein, 6 aa, Mycobacterium
AGVTAG

SEQ ID NO: 424517 - protein, 7 aa, Mycobacterium
AGVTAGD

SEQ ID NO: 424518 - protein, 8 aa, Mycobacterium
AGVTDGDV

SEQ ID NO: 424519 - protein, 14 aa, Mycobacterium
AGVTDSPATRTAAD

SEQ ID NO: 424520 - protein, 8 aa, Mycobacterium
AGVTDTEP

SEQ ID NO: 424521 - protein, 6 aa, Mycobacterium
AGVTED

SEQ ID NO: 424522 - protein, 12 aa, Mycobacterium
AGVTEDGIEASY

SEQ ID NO: 424523 - protein, 9 aa, Mycobacterium
AGVTGGEAD

SEQ ID NO: 424524 - protein, 8 aa, Mycobacterium
AGVTGGRG

SEQ ID NO: 424525 - protein, 9 aa, Mycobacterium
AGVTGKWSS

SEQ ID NO: 424526 - protein, 6 aa, Mycobacterium
AGVTGN

SEQ ID NO: 424527 - protein, 9 aa, Mycobacterium
AGVTGPLGP

SEQ ID NO: 424528 - protein, 12 aa, Mycobacterium
AGVTGPSQGDDR

SEQ ID NO: 424529 - protein, 5 aa, Mycobacterium
AGVTP

SEQ ID NO: 424530 - protein, 18 aa, Mycobacterium
AGVTPATGTRLDTHSEET

SEQ ID NO: 424531 - protein, 8 aa, Mycobacterium
AGVTPGER

SEQ ID NO: 424532 - protein, 7 aa, Mycobacterium
AGVTPQA

SEQ ID NO: 424533 - protein, 7 aa, Mycobacterium
AGVTREE

SEQ ID NO: 424534 - protein, 13 aa, Mycobacterium
AGVTSASTPARLA

SEQ ID NO: 424535 - protein, 8 aa, Mycobacterium
AGVTSGDL

SEQ ID NO: 424536 - protein, 8 aa, Mycobacterium
AGVTTPAE

SEQ ID NO: 424537 - protein, 8 aa, Mycobacterium
AGVTTPYS

SEQ ID NO: 424538 - protein, 9 aa, Mycobacterium
AGVTTYSTA

SEQ ID NO: 424539 - protein, 9 aa, Mycobacterium
AGVTTYSTE

SEQ ID NO: 424540 - protein, 9 aa, Mycobacterium
AGVTTYTTD

SEQ ID NO: 424541 - protein, 14 aa, Mycobacterium
AGVTVTSDQGQAEA

SEQ ID NO: 424542 - protein, 11 aa, Mycobacterium
AGVVGKNGLGP

SEQ ID NO: 424543 - protein, 7 aa, Mycobacterium
AGWAGPD

SEQ ID NO: 424544 - protein, 8 aa, Mycobacterium
AGWASPGT

SEQ ID NO: 424545 - protein, 20 aa, Mycobacterium
AGWEAARGTSTTAASALSHE

SEQ ID NO: 424546 - protein, 8 aa, Mycobacterium
AGWEPPNR

SEQ ID NO: 424547 - protein, 6 aa, Mycobacterium
AGWETR

SEQ ID NO: 424548 - protein, 12 aa, Mycobacterium
AGWGDTTLPLPD

SEQ ID NO: 424549 - protein, 5 aa, Mycobacterium
AGWGG

SEQ ID NO: 424550 - protein, 10 aa, Mycobacterium
AGWGGDPAPL

SEQ ID NO: 424551 - protein, 6 aa, Mycobacterium
AGWGGP

SEQ ID NO: 424552 - protein, 4 aa, Mycobacterium
AGWN

SEQ ID NO: 424553 - protein, 5 aa, Mycobacterium
AGWNG

SEQ ID NO: 424554 - protein, 4 aa, Mycobacterium
AGWP

SEQ ID NO: 424555 - protein, 6 aa, Mycobacterium
AGWPAG

SEQ ID NO: 424556 - protein, 10 aa, Mycobacterium
AGWPDNDGGE

SEQ ID NO: 424557 - protein, 6 aa, Mycobacterium
AGWPEE

SEQ ID NO: 424558 - protein, 6 aa, Mycobacterium
AGWPGN

SEQ ID NO: 424559 - protein, 19 aa, Mycobacterium
AGWPRPKSSAACGPGPQSF

SEQ ID NO: 424560 - protein, 12 aa, Mycobacterium
AGWQGPSSAAMA

SEQ ID NO: 424561 - protein, 5 aa, Mycobacterium
AGWQP

SEQ ID NO: 424562 - protein, 15 aa, Mycobacterium
AGWSGQAQATSYDTM

SEQ ID NO: 424563 - protein, 11 aa, Mycobacterium
AGWSPTAAATT

SEQ ID NO: 424564 - protein, 6 aa, Mycobacterium
AGWSRT

SEQ ID NO: 424565 - protein, 11 aa, Mycobacterium
AGWSSAPRSRY

SEQ ID NO: 424566 - protein, 18 aa, Mycobacterium
AGWSSAPRSRYTKKEMAD

SEQ ID NO: 424567 - protein, 16 aa, Mycobacterium
AGWSSAPRTSYTKAEM

SEQ ID NO: 424568 - protein, 13 aa, Mycobacterium
AGWSTANANPGAN

SEQ ID NO: 424569 - protein, 4 aa, Mycobacterium
AGYA

SEQ ID NO: 424570 - protein, 7 aa, Mycobacterium
AGYAAAS

SEQ ID NO: 424571 - protein, 6 aa, Mycobacterium
AGYAAS

SEQ ID NO: 424572 - protein, 5 aa, Mycobacterium
AGYAD

SEQ ID NO: 424573 - protein, 6 aa, Mycobacterium
AGYAGK

SEQ ID NO: 424574 - protein, 12 aa, Mycobacterium
AGYAKPARRTAS

SEQ ID NO: 424575 - protein, 13 aa, Mycobacterium
AGYAPAALRGSPT

SEQ ID NO: 424576 - protein, 13 aa, Mycobacterium
AGYAPSALRGSRT

SEQ ID NO: 424577 - protein, 14 aa, Mycobacterium
AGYAPSDLRGSRTG

SEQ ID NO: 424578 - protein, 6 aa, Mycobacterium
AGYARD

SEQ ID NO: 424579 - protein, 13 aa, Mycobacterium
AGYASSPHAGGAV

SEQ ID NO: 424580 - protein, 8 aa, Mycobacterium
AGYATPTR

SEQ ID NO: 424581 - protein, 5 aa, Mycobacterium
AGYDA

SEQ ID NO: 424582 - protein, 5 aa, Mycobacterium
AGYDD

SEQ ID NO: 424583 - protein, 16 aa, Mycobacterium
AGYDDDTSEYARYGSA

SEQ ID NO: 424584 - protein, 8 aa, Mycobacterium
AGYDGSAR

SEQ ID NO: 424585 - protein, 11 aa, Mycobacterium
AGYDPARVGDL

SEQ ID NO: 424586 - protein, 9 aa, Mycobacterium
AGYDPKGLE

SEQ ID NO: 424587 - protein, 7 aa, Mycobacterium
AGYDRPG

SEQ ID NO: 424588 - protein, 9 aa, Mycobacterium
AGYDTSPGM

SEQ ID NO: 424589 - protein, 4 aa, Mycobacterium
AGYE

SEQ ID NO: 424590 - protein, 9 aa, Mycobacterium
AGYEAARAA

SEQ ID NO: 424591 - protein, 6 aa, Mycobacterium
AGYEDR

SEQ ID NO: 424592 - protein, 6 aa, Mycobacterium
AGYEGQ

SEQ ID NO: 424593 - protein, 15 aa, Mycobacterium
AGYERGERPATRGPV

SEQ ID NO: 424594 - protein, 5 aa, Mycobacterium
AGYES

SEQ ID NO: 424595 - protein, 17 aa, Mycobacterium
AGYESAWAGPDGFTGQL

SEQ ID NO: 424596 - protein, 6 aa, Mycobacterium
AGYEYK

SEQ ID NO: 424597 - protein, 4 aa, Mycobacterium
AGYG

SEQ ID NO: 424598 - protein, 14 aa, Mycobacterium
AGYGDCGRPPTVGR

SEQ ID NO: 424599 - protein, 7 aa, Mycobacterium
AGYGDNF

SEQ ID NO: 424600 - protein, 6 aa, Mycobacterium
AGYGEQ

SEQ ID NO: 424601 - protein, 6 aa, Mycobacterium
AGYGET

SEQ ID NO: 424602 - protein, 399 aa, Mycobacterium
AGYGGNAGGGGQGADGAAGPAGGNGYDGGQGGAGGTGGQGGDAVAGATNGYGGQGGIGGTGGQGGGGGADDGSDNAGAGGSGGAGGLGGQSGAASTGGIVGTGGTGFAGDGGDGGAGGQGGATAVSGHTAGAGGTGGTGGTGGDGIDGPADRPGGRGGQGGHGGDGGSGGSAVAGATNGSGGAGGAGGTGGQGGNGYDDDGSDAAGAGGAGGDGGVGGTAGAVGSGGSGGTAGTAGTGGDGGDGGKGGATTTIGSSAGSGGDGGNGGLGGAGAIGPAGADGSTGGQGGAGGQGGDGGDAVAGATNGLGGNGGDGGSGGQGGAGGVDDGGGAGTGGQGGEGGQAGDGGVSGSGGLFGGGGDGGHGGQGGLGGTGGDSALGTGGDGGQGGQGGTGGTGGYG

SEQ ID NO: 424603 - protein, 5 aa, Mycobacterium
AGYGP

SEQ ID NO: 424604 - protein, 18 aa, Mycobacterium
AGYGQRSSERTNSRNGYR

SEQ ID NO: 424605 - protein, 6 aa, Mycobacterium
AGYGRY

SEQ ID NO: 424606 - protein, 6 aa, Mycobacterium
AGYGSA

SEQ ID NO: 424607 - protein, 14 aa, Mycobacterium
AGYGSSTVVPPGGY

SEQ ID NO: 424608 - protein, 10 aa, Mycobacterium
AGYGSVTSSL

SEQ ID NO: 424609 - protein, 8 aa, Mycobacterium
AGYGTPAG

SEQ ID NO: 424610 - protein, 10 aa, Mycobacterium
AGYHSRSESL

SEQ ID NO: 424611 - protein, 5 aa, Mycobacterium
AGYKP

SEQ ID NO: 424612 - protein, 36 aa, Mycobacterium
AGYLKQKGSDALNKAVDGALDKAGIESDSGKQLAKD

SEQ ID NO: 424613 - protein, 5 aa, Mycobacterium
AGYMD

SEQ ID NO: 424614 - protein, 8 aa, Mycobacterium
AGYNDEEL

SEQ ID NO: 424615 - protein, 6 aa, Mycobacterium
AGYPAE

SEQ ID NO: 424616 - protein, 6 aa, Mycobacterium
AGYPAQ

SEQ ID NO: 424617 - protein, 8 aa, Mycobacterium
AGYPDTDA

SEQ ID NO: 424618 - protein, 9 aa, Mycobacterium
AGYPDTGSE

SEQ ID NO: 424619 - protein, 8 aa, Mycobacterium
AGYPDTRI

SEQ ID NO: 424620 - protein, 13 aa, Mycobacterium
AGYPMAGREELDE

SEQ ID NO: 424621 - protein, 24 aa, Mycobacterium
AGYPPAQGPPRRAQAYAGTDRQVR

SEQ ID NO: 424622 - protein, 8 aa, Mycobacterium
AGYPSQAE

SEQ ID NO: 424623 - protein, 12 aa, Mycobacterium
AGYQMDKNESEF

SEQ ID NO: 424624 - protein, 6 aa, Mycobacterium
AGYQNP

SEQ ID NO: 424625 - protein, 16 aa, Mycobacterium
AGYQPDPATGAVNTPI

SEQ ID NO: 424626 - protein, 6 aa, Mycobacterium
AGYQPG

SEQ ID NO: 424627 - protein, 12 aa, Mycobacterium
AGYQRAAEGTDA

SEQ ID NO: 424628 - protein, 11 aa, Mycobacterium
AGYQRAGAGVD

SEQ ID NO: 424629 - protein, 9 aa, Mycobacterium
AGYQRSAAA

SEQ ID NO: 424630 - protein, 7 aa, Mycobacterium
AGYRGSV

SEQ ID NO: 424631 - protein, 12 aa, Mycobacterium
AGYRNDPQRTAR

SEQ ID NO: 424632 - protein, 6 aa, Mycobacterium
AGYRQP

SEQ ID NO: 424633 - protein, 13 aa, Mycobacterium
AGYRRKTTQKPPP

SEQ ID NO: 424634 - protein, 15 aa, Mycobacterium
AGYRSGAHLTPDNAV

SEQ ID NO: 424635 - protein, 11 aa, Mycobacterium
AGYRSPTVDSA

SEQ ID NO: 424636 - protein, 7 aa, Mycobacterium
AGYRSTL

SEQ ID NO: 424637 - protein, 9 aa, Mycobacterium
AGYRTRAGR

SEQ ID NO: 424638 - protein, 8 aa, Mycobacterium
AGYSDESL

SEQ ID NO: 424639 - protein, 7 aa, Mycobacterium
AGYSDSL

SEQ ID NO: 424640 - protein, 12 aa, Mycobacterium
AGYSPADPAPDE

SEQ ID NO: 424641 - protein, 10 aa, Mycobacterium
AGYSPQSPTA

SEQ ID NO: 424642 - protein, 16 aa, Mycobacterium
AGYSPVDGSPTIPAKG

SEQ ID NO: 424643 - protein, 20 aa, Mycobacterium
AGYSTSGPIDDAVASLRAAL

SEQ ID NO: 424644 - protein, 20 aa, Mycobacterium
AGYSTSGSIDDVVASLLAAL

SEQ ID NO: 424645 - protein, 4 aa, Mycobacterium
AGYT

SEQ ID NO: 424646 - protein, 8 aa, Mycobacterium
AGYTELSE

SEQ ID NO: 424647 - protein, 12 aa, Mycobacterium
AGYTGAAQAAGS

SEQ ID NO: 424648 - protein, 10 aa, Mycobacterium
AGYTPGDTDL

SEQ ID NO: 424649 - protein, 12 aa, Mycobacterium
AGYTPSDESRAA

SEQ ID NO: 424650 - protein, 6 aa, Mycobacterium
AGYTRD

SEQ ID NO: 424651 - protein, 8 aa, Mycobacterium
AGYTSESL

SEQ ID NO: 424652 - protein, 19 aa, Mycobacterium
AGYTSQWREDPPGRARQAN

SEQ ID NO: 424653 - protein, 6 aa, Mycobacterium
AGYTST

SEQ ID NO: 424654 - protein, 13 aa, Mycobacterium
AGYVGRDDAANLT

SEQ ID NO: 424655 - protein, 13 aa, Mycobacterium
AHAAAAGGRVPDP

SEQ ID NO: 424656 - protein, 9 aa, Mycobacterium
AHAADPQFA

SEQ ID NO: 424657 - protein, 9 aa, Mycobacterium
AHAAENAGA

SEQ ID NO: 424658 - protein, 9 aa, Mycobacterium
AHAAGEDTF

SEQ ID NO: 424659 - protein, 36 aa, Mycobacterium
AHAAGPAGATDPAGAVGAGAANTTGAADPATPGGGI

SEQ ID NO: 424660 - protein, 5 aa, Mycobacterium
AHAAT

SEQ ID NO: 424661 - protein, 9 aa, Mycobacterium
AHADAADGY

SEQ ID NO: 424662 - protein, 10 aa, Mycobacterium
AHADASDGHP

SEQ ID NO: 424663 - protein, 14 aa, Mycobacterium
AHADGRVSKPVRVR

SEQ ID NO: 424664 - protein, 9 aa, Mycobacterium
AHADPAAEM

SEQ ID NO: 424665 - protein, 14 aa, Mycobacterium
AHADPPLASNVKNN

SEQ ID NO: 424666 - protein, 8 aa, Mycobacterium
AHADSADI

SEQ ID NO: 424667 - protein, 4 aa, Mycobacterium
AHAE

SEQ ID NO: 424668 - protein, 5 aa, Mycobacterium
AHAEA

SEQ ID NO: 424669 - protein, 7 aa, Mycobacterium
AHAEGAR

SEQ ID NO: 424670 - protein, 10 aa, Mycobacterium
AHAEQAAAQA

SEQ ID NO: 424671 - protein, 17 aa, Mycobacterium
AHAEQTAVQAKAAAGAY

SEQ ID NO: 424672 - protein, 9 aa, Mycobacterium
AHAESDRLR

SEQ ID NO: 424673 - protein, 10 aa, Mycobacterium
AHAGDKEKAA

SEQ ID NO: 424674 - protein, 5 aa, Mycobacterium
AHAGG

SEQ ID NO: 424675 - protein, 10 aa, Mycobacterium
AHAGGEAQLG

SEQ ID NO: 424676 - protein, 7 aa, Mycobacterium
AHAGQLD

SEQ ID NO: 424677 - protein, 16 aa, Mycobacterium
AHAGQRRGDENEHYSP

SEQ ID NO: 424678 - protein, 6 aa, Mycobacterium
AHAGTL

SEQ ID NO: 424679 - protein, 20 aa, Mycobacterium
AHAGTTAHTTATQWASSVPQ

SEQ ID NO: 424680 - protein, 8 aa, Mycobacterium
AHAKARGA

SEQ ID NO: 424681 - protein, 13 aa, Mycobacterium
AHALPGPGTGEAR

SEQ ID NO: 424682 - protein, 5 aa, Mycobacterium
AHANA

SEQ ID NO: 424683 - protein, 13 aa, Mycobacterium
AHAPAGKDQPEVG

SEQ ID NO: 424684 - protein, 8 aa, Mycobacterium
AHAPFGGQ

SEQ ID NO: 424685 - protein, 7 aa, Mycobacterium
AHAPGEH

SEQ ID NO: 424686 - protein, 16 aa, Mycobacterium
AHAPGTGTPEAGGMSS

SEQ ID NO: 424687 - protein, 16 aa, Mycobacterium
AHAPGTGTPEAGGMTS

SEQ ID NO: 424688 - protein, 15 aa, Mycobacterium
AHAPGTGTPEPGGIT

SEQ ID NO: 424689 - protein, 16 aa, Mycobacterium
AHAPGTGTPEPGGITS

SEQ ID NO: 424690 - protein, 6 aa, Mycobacterium
AHAPTL

SEQ ID NO: 424691 - protein, 17 aa, Mycobacterium
AHAQPPYVGQGGGTAMN

SEQ ID NO: 424692 - protein, 9 aa, Mycobacterium
AHAQRSTTL

SEQ ID NO: 424693 - protein, 11 aa, Mycobacterium
AHARANDAALR

SEQ ID NO: 424694 - protein, 15 aa, Mycobacterium
AHARGADGIDGRGER

SEQ ID NO: 424695 - protein, 5 aa, Mycobacterium
AHARS

SEQ ID NO: 424696 - protein, 4 aa, Mycobacterium
AHAS

SEQ ID NO: 424697 - protein, 6 aa, Mycobacterium
AHASAD

SEQ ID NO: 424698 - protein, 11 aa, Mycobacterium
AHASAGGPPRL

SEQ ID NO: 424699 - protein, 6 aa, Mycobacterium
AHASEL

SEQ ID NO: 424700 - protein, 6 aa, Mycobacterium
AHASPP

SEQ ID NO: 424701 - protein, 5 aa, Mycobacterium
AHASS

SEQ ID NO: 424702 - protein, 9 aa, Mycobacterium
AHASSRGAA

SEQ ID NO: 424703 - protein, 15 aa, Mycobacterium
AHASVPARAQAQPTP

SEQ ID NO: 424704 - protein, 4 aa, Mycobacterium
AHAT

SEQ ID NO: 424705 - protein, 15 aa, Mycobacterium
AHATGDLPKSANPAA

SEQ ID NO: 424706 - protein, 5 aa, Mycobacterium
AHATP

SEQ ID NO: 424707 - protein, 6 aa, Mycobacterium
AHATPD

SEQ ID NO: 424708 - protein, 8 aa, Mycobacterium
AHATTADH

SEQ ID NO: 424709 - protein, 7 aa, Mycobacterium
AHAVETN

SEQ ID NO: 424710 - protein, 12 aa, Mycobacterium
AHAYPDAARGHA

SEQ ID NO: 424711 - protein, 13 aa, Mycobacterium
AHAYPDAARTRAE

SEQ ID NO: 424712 - protein, 9 aa, Mycobacterium
AHDADEAIS

SEQ ID NO: 424713 - protein, 5 aa, Mycobacterium
AHDAG

SEQ ID NO: 424714 - protein, 9 aa, Mycobacterium
AHDATRRAI

SEQ ID NO: 424715 - protein, 9 aa, Mycobacterium
AHDDEDPRP

SEQ ID NO: 424716 - protein, 5 aa, Mycobacterium
AHDDG

SEQ ID NO: 424717 - protein, 11 aa, Mycobacterium
AHDDPDALPRD

SEQ ID NO: 424718 - protein, 6 aa, Mycobacterium
AHDEGE

SEQ ID NO: 424719 - protein, 10 aa, Mycobacterium
AHDERGVGGP

SEQ ID NO: 424720 - protein, 7 aa, Mycobacterium
AHDGDAD

SEQ ID NO: 424721 - protein, 8 aa, Mycobacterium
AHDGEDVT

SEQ ID NO: 424722 - protein, 5 aa, Mycobacterium
AHDGG

SEQ ID NO: 424723 - protein, 9 aa, Mycobacterium
AHDGGELPR

SEQ ID NO: 424724 - protein, 5 aa, Mycobacterium
AHDGL

SEQ ID NO: 424725 - protein, 5 aa, Mycobacterium
AHDGP

SEQ ID NO: 424726 - protein, 13 aa, Mycobacterium
AHDHSSPSTGARD

SEQ ID NO: 424727 - protein, 5 aa, Mycobacterium
AHDKS

SEQ ID NO: 424728 - protein, 6 aa, Mycobacterium
AHDPAL

SEQ ID NO: 424729 - protein, 8 aa, Mycobacterium
AHDPAREA

SEQ ID NO: 424730 - protein, 9 aa, Mycobacterium
AHDPATRDK

SEQ ID NO: 424731 - protein, 11 aa, Mycobacterium
AHDPDAALAAD

SEQ ID NO: 424732 - protein, 7 aa, Mycobacterium
AHDPHRR

SEQ ID NO: 424733 - protein, 13 aa, Mycobacterium
AHDPKSGLSKAHR

SEQ ID NO: 424734 - protein, 6 aa, Mycobacterium
AHDPRA

SEQ ID NO: 424735 - protein, 7 aa, Mycobacterium
AHDPRPR

SEQ ID NO: 424736 - protein, 9 aa, Mycobacterium
AHDPTAEPL

SEQ ID NO: 424737 - protein, 21 aa, Mycobacterium
AHDPTPPGPADHGREGGMATR

SEQ ID NO: 424738 - protein, 15 aa, Mycobacterium
AHDQGQHGAADRPAT

SEQ ID NO: 424739 - protein, 5 aa, Mycobacterium
AHDRI

SEQ ID NO: 424740 - protein, 35 aa, Mycobacterium
AHDRPSRQLSAQPAEDNWSTSRYPHRRSTSHPAGT

SEQ ID NO: 424741 - protein, 10 aa, Mycobacterium
AHDRSAHASD

SEQ ID NO: 424742 - protein, 11 aa, Mycobacterium
AHDRSAHASDR

SEQ ID NO: 424743 - protein, 5 aa, Mycobacterium
AHDRT

SEQ ID NO: 424744 - protein, 4 aa, Mycobacterium
AHDT

SEQ ID NO: 424745 - protein, 17 aa, Mycobacterium
AHDTAARTLAAKTGDRF

SEQ ID NO: 424746 - protein, 6 aa, Mycobacterium
AHDTDK

SEQ ID NO: 424747 - protein, 7 aa, Mycobacterium
AHDTSSG

SEQ ID NO: 424748 - protein, 11 aa, Mycobacterium
AHDYGGAAAEI

SEQ ID NO: 424749 - protein, 14 aa, Mycobacterium
AHDYPDDRRTAAER

SEQ ID NO: 424750 - protein, 4 aa, Mycobacterium
AHEA

SEQ ID NO: 424751 - protein, 13 aa, Mycobacterium
AHEAGQAVAAGAA

SEQ ID NO: 424752 - protein, 11 aa, Mycobacterium
AHEASSSGRPL

SEQ ID NO: 424753 - protein, 30 aa, Mycobacterium
AHEDASALTKPARPSKKPAAGASVSQPAVA

SEQ ID NO: 424754 - protein, 7 aa, Mycobacterium
AHEDDAR

SEQ ID NO: 424755 - protein, 6 aa, Mycobacterium
AHEEAE

SEQ ID NO: 424756 - protein, 7 aa, Mycobacterium
AHEEGGE

SEQ ID NO: 424757 - protein, 5 aa, Mycobacterium
AHEEI

SEQ ID NO: 424758 - protein, 17 aa, Mycobacterium
AHEENFSAATDETLRDI

SEQ ID NO: 424759 - protein, 7 aa, Mycobacterium
AHEETGI

SEQ ID NO: 424760 - protein, 7 aa, Mycobacterium
AHEETGL

SEQ ID NO: 424761 - protein, 9 aa, Mycobacterium
AHEETGLDP

SEQ ID NO: 424762 - protein, 9 aa, Mycobacterium
AHEGANAAR

SEQ ID NO: 424763 - protein, 10 aa, Mycobacterium
AHEGNAGQAA

SEQ ID NO: 424764 - protein, 9 aa, Mycobacterium
AHEGPNAAR

SEQ ID NO: 424765 - protein, 4 aa, Mycobacterium
AHEH

SEQ ID NO: 424766 - protein, 6 aa, Mycobacterium
AHELDS

SEQ ID NO: 424767 - protein, 6 aa, Mycobacterium
AHEMSG

SEQ ID NO: 424768 - protein, 12 aa, Mycobacterium
AHENAVRQSRAT

SEQ ID NO: 424769 - protein, 8 aa, Mycobacterium
AHENTDTG

SEQ ID NO: 424770 - protein, 5 aa, Mycobacterium
AHENV

SEQ ID NO: 424771 - protein, 4 aa, Mycobacterium
AHEP

SEQ ID NO: 424772 - protein, 6 aa, Mycobacterium
AHEPNA

SEQ ID NO: 424773 - protein, 11 aa, Mycobacterium
AHEPRGDGGFG

SEQ ID NO: 424774 - protein, 21 aa, Mycobacterium
AHEPRPGVARGPVSVDGGDPL

SEQ ID NO: 424775 - protein, 8 aa, Mycobacterium
AHEPTTHE

SEQ ID NO: 424776 - protein, 8 aa, Mycobacterium
AHEQRGRR

SEQ ID NO: 424777 - protein, 5 aa, Mycobacterium
AHERA

SEQ ID NO: 424778 - protein, 8 aa, Mycobacterium
AHERDPLG

SEQ ID NO: 424779 - protein, 9 aa, Mycobacterium
AHERDPLGS

SEQ ID NO: 424780 - protein, 5 aa, Mycobacterium
AHERK

SEQ ID NO: 424781 - protein, 14 aa, Mycobacterium
AHESRGADDELAGT

SEQ ID NO: 424782 - protein, 23 aa, Mycobacterium
AHESTDTGSAEPAAARPDPRDPT

SEQ ID NO: 424783 - protein, 10 aa, Mycobacterium
AHETDVRDRE

SEQ ID NO: 424784 - protein, 10 aa, Mycobacterium
AHETEADELT

SEQ ID NO: 424785 - protein, 16 aa, Mycobacterium
AHETTINHASGHRHCD

SEQ ID NO: 424786 - protein, 9 aa, Mycobacterium
AHEVSDGVP

SEQ ID NO: 424787 - protein, 4 aa, Mycobacterium
AHGA

SEQ ID NO: 424788 - protein, 5 aa, Mycobacterium
AHGAA

SEQ ID NO: 424789 - protein, 9 aa, Mycobacterium
AHGAAQGHD

SEQ ID NO: 424790 - protein, 12 aa, Mycobacterium
AHGAGSACGKNL

SEQ ID NO: 424791 - protein, 5 aa, Mycobacterium
AHGAR

SEQ ID NO: 424792 - protein, 7 aa, Mycobacterium
AHGATGN

SEQ ID NO: 424793 - protein, 14 aa, Mycobacterium
AHGDAEPRFQTATA

SEQ ID NO: 424794 - protein, 7 aa, Mycobacterium
AHGDQRR

SEQ ID NO: 424795 - protein, 24 aa, Mycobacterium
AHGDRSANRDGSGPILVLKHRTGS

SEQ ID NO: 424796 - protein, 6 aa, Mycobacterium
AHGDSL

SEQ ID NO: 424797 - protein, 5 aa, Mycobacterium
AHGDT

SEQ ID NO: 424798 - protein, 5 aa, Mycobacterium
AHGEA

SEQ ID NO: 424799 - protein, 20 aa, Mycobacterium
AHGEDTAHEANAPGRPNGHW

SEQ ID NO: 424800 - protein, 7 aa, Mycobacterium
AHGERQR

SEQ ID NO: 424801 - protein, 15 aa, Mycobacterium
AHGFGGGGMHGGGGH

SEQ ID NO: 424802 - protein, 4 aa, Mycobacterium
AHGG

SEQ ID NO: 424803 - protein, 14 aa, Mycobacterium
AHGGCDTEPVAGQP

SEQ ID NO: 424804 - protein, 11 aa, Mycobacterium
AHGGDHVEAGR

SEQ ID NO: 424805 - protein, 9 aa, Mycobacterium
AHGGDQSAG

SEQ ID NO: 424806 - protein, 16 aa, Mycobacterium
AHGGGAGEKKRNPQLS

SEQ ID NO: 424807 - protein, 9 aa, Mycobacterium
AHGGGGKGM

SEQ ID NO: 424808 - protein, 18 aa, Mycobacterium
AHGGGSEFTGFSSAERSF

SEQ ID NO: 424809 - protein, 8 aa, Mycobacterium
AHGGHRET

SEQ ID NO: 424810 - protein, 5 aa, Mycobacterium
AHGGL

SEQ ID NO: 424811 - protein, 6 aa, Mycobacterium
AHGGPA

SEQ ID NO: 424812 - protein, 19 aa, Mycobacterium
AHGGPAHAADAVEDVAAGR

SEQ ID NO: 424813 - protein, 10 aa, Mycobacterium
AHGGPGGAPG

SEQ ID NO: 424814 - protein, 12 aa, Mycobacterium
AHGGPGLPASTK

SEQ ID NO: 424815 - protein, 6 aa, Mycobacterium
AHGGPH

SEQ ID NO: 424816 - protein, 21 aa, Mycobacterium
AHGGQAVASHESVGSPEGGQA

SEQ ID NO: 424817 - protein, 8 aa, Mycobacterium
AHGGSRPP

SEQ ID NO: 424818 - protein, 33 aa, Mycobacterium
AHGGTGGDGGAGGTGGHGGAGGAGGAGGVGGDG

SEQ ID NO: 424819 - protein, 5 aa, Mycobacterium
AHGHG

SEQ ID NO: 424820 - protein, 22 aa, Mycobacterium
AHGKHSNIGYDAPKGLEETKSK

SEQ ID NO: 424821 - protein, 6 aa, Mycobacterium
AHGLPE

SEQ ID NO: 424822 - protein, 6 aa, Mycobacterium
AHGNAK

SEQ ID NO: 424823 - protein, 5 aa, Mycobacterium
AHGNE

SEQ ID NO: 424824 - protein, 7 aa, Mycobacterium
AHGNELK

SEQ ID NO: 424825 - protein, 31 aa, Mycobacterium
AHGNGGDGGAGGNAGIYGGNGGAGGTGGVGV

SEQ ID NO: 424826 - protein, 19 aa, Mycobacterium
AHGNPTARGSARRGGPHDG

SEQ ID NO: 424827 - protein, 18 aa, Mycobacterium
AHGNTATLPPSLAPRVPA

SEQ ID NO: 424828 - protein, 4 aa, Mycobacterium
AHGP

SEQ ID NO: 424829 - protein, 18 aa, Mycobacterium
AHGPAGSLDGLGNPLGAL

SEQ ID NO: 424830 - protein, 6 aa, Mycobacterium
AHGPEE

SEQ ID NO: 424831 - protein, 8 aa, Mycobacterium
AHGPNPVL

SEQ ID NO: 424832 - protein, 9 aa, Mycobacterium
AHGPVDPAA

SEQ ID NO: 424833 - protein, 5 aa, Mycobacterium
AHGPY

SEQ ID NO: 424834 - protein, 5 aa, Mycobacterium
AHGQA

SEQ ID NO: 424835 - protein, 6 aa, Mycobacterium
AHGQAA

SEQ ID NO: 424836 - protein, 8 aa, Mycobacterium
AHGQPEVT

SEQ ID NO: 424837 - protein, 7 aa, Mycobacterium
AHGQVPR

SEQ ID NO: 424838 - protein, 5 aa, Mycobacterium
AHGRE

SEQ ID NO: 424839 - protein, 7 aa, Mycobacterium
AHGRGSL

SEQ ID NO: 424840 - protein, 6 aa, Mycobacterium
AHGRPG

SEQ ID NO: 424841 - protein, 6 aa, Mycobacterium
AHGRTA

SEQ ID NO: 424842 - protein, 7 aa, Mycobacterium
AHGRTPA

SEQ ID NO: 424843 - protein, 5 aa, Mycobacterium
AHGRW

SEQ ID NO: 424844 - protein, 8 aa, Mycobacterium
AHGSGDVP

SEQ ID NO: 424845 - protein, 5 aa, Mycobacterium
AHGSK

SEQ ID NO: 424846 - protein, 5 aa, Mycobacterium
AHGSP

SEQ ID NO: 424847 - protein, 14 aa, Mycobacterium
AHGSPGARLAQQAT

SEQ ID NO: 424848 - protein, 15 aa, Mycobacterium
AHGSPTAKLAQQATG

SEQ ID NO: 424849 - protein, 12 aa, Mycobacterium
AHGSPVAKAVQD

SEQ ID NO: 424850 - protein, 9 aa, Mycobacterium
AHGSRGHGA

SEQ ID NO: 424851 - protein, 9 aa, Mycobacterium
AHGSTPPPW

SEQ ID NO: 424852 - protein, 7 aa, Mycobacterium
AHGTAEW

SEQ ID NO: 424853 - protein, 7 aa, Mycobacterium
AHGTAGE

SEQ ID NO: 424854 - protein, 16 aa, Mycobacterium
AHGTATPIGDTAEANA

SEQ ID NO: 424855 - protein, 11 aa, Mycobacterium
AHGTDEQRDIT

SEQ ID NO: 424856 - protein, 11 aa, Mycobacterium
AHGTGTPIGDP

SEQ ID NO: 424857 - protein, 16 aa, Mycobacterium
AHGTGTRIGDPAEAAA

SEQ ID NO: 424858 - protein, 16 aa, Mycobacterium
AHGTLSKKVSAGSGVK

SEQ ID NO: 424859 - protein, 9 aa, Mycobacterium
AHGTPARGF

SEQ ID NO: 424860 - protein, 12 aa, Mycobacterium
AHGTPYETAAGR

SEQ ID NO: 424861 - protein, 9 aa, Mycobacterium
AHGTQGVTS

SEQ ID NO: 424862 - protein, 16 aa, Mycobacterium
AHGTSTPLSDAAETAA

SEQ ID NO: 424863 - protein, 10 aa, Mycobacterium
AHGTVTGAAG

SEQ ID NO: 424864 - protein, 9 aa, Mycobacterium
AHHDATKTF

SEQ ID NO: 424865 - protein, 4 aa, Mycobacterium
AHHG

SEQ ID NO: 424866 - protein, 8 aa, Mycobacterium
AHHGREPT

SEQ ID NO: 424867 - protein, 9 aa, Mycobacterium
AHHGRKATA

SEQ ID NO: 424868 - protein, 13 aa, Mycobacterium
AHHQENRSQYVTD

SEQ ID NO: 424869 - protein, 5 aa, Mycobacterium
AHHQG

SEQ ID NO: 424870 - protein, 7 aa, Mycobacterium
AHHQQTS

SEQ ID NO: 424871 - protein, 9 aa, Mycobacterium
AHHRPGDES

SEQ ID NO: 424872 - protein, 6 aa, Mycobacterium
AHHRVD

SEQ ID NO: 424873 - protein, 8 aa, Mycobacterium
AHHSPTAD

SEQ ID NO: 424874 - protein, 12 aa, Mycobacterium
AHIGSGTSGPGA

SEQ ID NO: 424875 - protein, 4 aa, Mycobacterium
AHIP

SEQ ID NO: 424876 - protein, 5 aa, Mycobacterium
AHIPY

SEQ ID NO: 424877 - protein, 8 aa, Mycobacterium
AHKAASDR

SEQ ID NO: 424878 - protein, 5 aa, Mycobacterium
AHKEE

SEQ ID NO: 424879 - protein, 5 aa, Mycobacterium
AHKEV

SEQ ID NO: 424880 - protein, 6 aa, Mycobacterium
AHKEVT

SEQ ID NO: 424881 - protein, 14 aa, Mycobacterium
AHKGAEPQRVAIES

SEQ ID NO: 424882 - protein, 7 aa, Mycobacterium
AHKNRQR

SEQ ID NO: 424883 - protein, 9 aa, Mycobacterium
AHKPPAINN

SEQ ID NO: 424884 - protein, 93 aa, Mycobacterium
AHKPTPQTKPSLTTHASSTTEATADRTTSTTAGLTTHASPTTEATADRTTSTTADRTTHASSTTEATADRTASATADRTTGLATNTDASLTTQ

SEQ ID NO: 424885 - protein, 21 aa, Mycobacterium
AHKRAQQSAAQQAEKRAERRA

SEQ ID NO: 424886 - protein, 9 aa, Mycobacterium
AHKRSGAEI

SEQ ID NO: 424887 - protein, 9 aa, Mycobacterium
AHKSGTTTY

SEQ ID NO: 424888 - protein, 15 aa, Mycobacterium
AHKSSLDQRRTDEER

SEQ ID NO: 424889 - protein, 16 aa, Mycobacterium
AHKTGRTWAKSTTVAE

SEQ ID NO: 424890 - protein, 6 aa, Mycobacterium
AHLGPN

SEQ ID NO: 424891 - protein, 15 aa, Mycobacterium
AHLGTGGKPVDQQTL

SEQ ID NO: 424892 - protein, 7 aa, Mycobacterium
AHLSPEE

SEQ ID NO: 424893 - protein, 11 aa, Mycobacterium
AHMPRSGVSGP

SEQ ID NO: 424894 - protein, 5 aa, Mycobacterium
AHNAA

SEQ ID NO: 424895 - protein, 10 aa, Mycobacterium
AHNARRTGLP

SEQ ID NO: 424896 - protein, 9 aa, Mycobacterium
AHNGELRDT

SEQ ID NO: 424897 - protein, 48 aa, Mycobacterium
AHNGNNGGSGGDGGNGGSGGNAGLFGNGGNAGGGGSGGSGGGANTGIN

SEQ ID NO: 424898 - protein, 14 aa, Mycobacterium
AHNIQGGDINTAGP

SEQ ID NO: 424899 - protein, 8 aa, Mycobacterium
AHNNGDAD

SEQ ID NO: 424900 - protein, 5 aa, Mycobacterium
AHNNT

SEQ ID NO: 424901 - protein, 6 aa, Mycobacterium
AHNPDM

SEQ ID NO: 424902 - protein, 10 aa, Mycobacterium
AHNPNGMKDR

SEQ ID NO: 424903 - protein, 6 aa, Mycobacterium
AHNPTG

SEQ ID NO: 424904 - protein, 5 aa, Mycobacterium
AHNQA

SEQ ID NO: 424905 - protein, 7 aa, Mycobacterium
AHPADGR

SEQ ID NO: 424906 - protein, 6 aa, Mycobacterium
AHPAGA

SEQ ID NO: 424907 - protein, 19 aa, Mycobacterium
AHPANTTKPEFAQGPRAAR

SEQ ID NO: 424908 - protein, 19 aa, Mycobacterium
AHPATSNGTATSAAIRIPS

SEQ ID NO: 424909 - protein, 13 aa, Mycobacterium
AHPATSPANHPAA

SEQ ID NO: 424910 - protein, 5 aa, Mycobacterium
AHPDA

SEQ ID NO: 424911 - protein, 7 aa, Mycobacterium
AHPDAAE

SEQ ID NO: 424912 - protein, 9 aa, Mycobacterium
AHPDAAEGL

SEQ ID NO: 424913 - protein, 6 aa, Mycobacterium
AHPDAL

SEQ ID NO: 424914 - protein, 11 aa, Mycobacterium
AHPDAPSPQDV

SEQ ID NO: 424915 - protein, 6 aa, Mycobacterium
AHPDAT

SEQ ID NO: 424916 - protein, 12 aa, Mycobacterium
AHPDDVGNVQPN

SEQ ID NO: 424917 - protein, 9 aa, Mycobacterium
AHPDGAGAH

SEQ ID NO: 424918 - protein, 9 aa, Mycobacterium
AHPDMSDQQ

SEQ ID NO: 424919 - protein, 7 aa, Mycobacterium
AHPDPDD

SEQ ID NO: 424920 - protein, 10 aa, Mycobacterium
AHPDPTAIDP

SEQ ID NO: 424921 - protein, 6 aa, Mycobacterium
AHPDRP

SEQ ID NO: 424922 - protein, 7 aa, Mycobacterium
AHPDRPL

SEQ ID NO: 424923 - protein, 9 aa, Mycobacterium
AHPDTRGNL

SEQ ID NO: 424924 - protein, 5 aa, Mycobacterium
AHPDY

SEQ ID NO: 424925 - protein, 4 aa, Mycobacterium
AHPE

SEQ ID NO: 424926 - protein, 6 aa, Mycobacterium
AHPEAT

SEQ ID NO: 424927 - protein, 11 aa, Mycobacterium
AHPEATAQLAG

SEQ ID NO: 424928 - protein, 5 aa, Mycobacterium
AHPED

SEQ ID NO: 424929 - protein, 12 aa, Mycobacterium
AHPENTRRRRQF

SEQ ID NO: 424930 - protein, 127 aa, Mycobacterium
AHPEPAQPAPAHAPPPSGGEPAGLPPSGEIPSPPSPPHLPQPPSVPMSGAPAEAPAGLGEVPHGGEPGGQPPEMRPPHDGPPHPPGDGGQPHQPVEGSPHPPDEANGPHDGNDHAPHDPNADHGSDH

SEQ ID NO: 424931 - protein, 7 aa, Mycobacterium
AHPERDP

SEQ ID NO: 424932 - protein, 11 aa, Mycobacterium
AHPERLEPRTR

SEQ ID NO: 424933 - protein, 5 aa, Mycobacterium
AHPES

SEQ ID NO: 424934 - protein, 7 aa, Mycobacterium
AHPESAT

SEQ ID NO: 424935 - protein, 8 aa, Mycobacterium
AHPESGHR

SEQ ID NO: 424936 - protein, 11 aa, Mycobacterium
AHPESTAELAG

SEQ ID NO: 424937 - protein, 5 aa, Mycobacterium
AHPEV

SEQ ID NO: 424938 - protein, 7 aa, Mycobacterium
AHPEVSG

SEQ ID NO: 424939 - protein, 11 aa, Mycobacterium
AHPGAAAALDG

SEQ ID NO: 424940 - protein, 7 aa, Mycobacterium
AHPGARG

SEQ ID NO: 424941 - protein, 9 aa, Mycobacterium
AHPGASGTE

SEQ ID NO: 424942 - protein, 5 aa, Mycobacterium
AHPGD

SEQ ID NO: 424943 - protein, 7 aa, Mycobacterium
AHPGDAA

SEQ ID NO: 424944 - protein, 8 aa, Mycobacterium
AHPGDNIP

SEQ ID NO: 424945 - protein, 8 aa, Mycobacterium
AHPGDPVT

SEQ ID NO: 424946 - protein, 7 aa, Mycobacterium
AHPGGGD

SEQ ID NO: 424947 - protein, 15 aa, Mycobacterium
AHPGGIGGTFSGNPL

SEQ ID NO: 424948 - protein, 13 aa, Mycobacterium
AHPGGSNTELARN

SEQ ID NO: 424949 - protein, 12 aa, Mycobacterium
AHPGGSNTELTR

SEQ ID NO: 424950 - protein, 7 aa, Mycobacterium
AHPGHQL

SEQ ID NO: 424951 - protein, 8 aa, Mycobacterium
AHPGIADD

SEQ ID NO: 424952 - protein, 5 aa, Mycobacterium
AHPGP

SEQ ID NO: 424953 - protein, 15 aa, Mycobacterium
AHPGRNGSSHDGFPD

SEQ ID NO: 424954 - protein, 12 aa, Mycobacterium
AHPGSPADPAVA

SEQ ID NO: 424955 - protein, 8 aa, Mycobacterium
AHPGTGDV

SEQ ID NO: 424956 - protein, 10 aa, Mycobacterium
AHPGTSTTEL

SEQ ID NO: 424957 - protein, 10 aa, Mycobacterium
AHPGTSYRGR

SEQ ID NO: 424958 - protein, 5 aa, Mycobacterium
AHPGV

SEQ ID NO: 424959 - protein, 6 aa, Mycobacterium
AHPGVN

SEQ ID NO: 424960 - protein, 7 aa, Mycobacterium
AHPGYRS

SEQ ID NO: 424961 - protein, 21 aa, Mycobacterium
AHPGYSATNLQGHSGNPLGEK

SEQ ID NO: 424962 - protein, 21 aa, Mycobacterium
AHPGYSATNLQGHSGNRFGTA

SEQ ID NO: 424963 - protein, 11 aa, Mycobacterium
AHPHRDPQTGE

SEQ ID NO: 424964 - protein, 8 aa, Mycobacterium
AHPHSDTE

SEQ ID NO: 424965 - protein, 6 aa, Mycobacterium
AHPKAV

SEQ ID NO: 424966 - protein, 10 aa, Mycobacterium
AHPKNDDRTG

SEQ ID NO: 424967 - protein, 10 aa, Mycobacterium
AHPKVDNKTG

SEQ ID NO: 424968 - protein, 10 aa, Mycobacterium
AHPLDPAPEF

SEQ ID NO: 424969 - protein, 14 aa, Mycobacterium
AHPLDPSDTFDTGP

SEQ ID NO: 424970 - protein, 7 aa, Mycobacterium
AHPLGAK

SEQ ID NO: 424971 - protein, 12 aa, Mycobacterium
AHPLSDQQARDQ

SEQ ID NO: 424972 - protein, 7 aa, Mycobacterium
AHPLSTA

SEQ ID NO: 424973 - protein, 4 aa, Mycobacterium
AHPM

SEQ ID NO: 424974 - protein, 9 aa, Mycobacterium
AHPNDSLSS

SEQ ID NO: 424975 - protein, 6 aa, Mycobacterium
AHPNPT

SEQ ID NO: 424976 - protein, 14 aa, Mycobacterium
AHPNPTLFAQAAHR

SEQ ID NO: 424977 - protein, 7 aa, Mycobacterium
AHPPESY

SEQ ID NO: 424978 - protein, 10 aa, Mycobacterium
AHPPTSVDET

SEQ ID NO: 424979 - protein, 4 aa, Mycobacterium
AHPQ

SEQ ID NO: 424980 - protein, 7 aa, Mycobacterium
AHPQGAN

SEQ ID NO: 424981 - protein, 10 aa, Mycobacterium
AHPQPGNPAP

SEQ ID NO: 424982 - protein, 19 aa, Mycobacterium
AHPQPNQAEGADDPAETGE

SEQ ID NO: 424983 - protein, 4 aa, Mycobacterium
AHPR

SEQ ID NO: 424984 - protein, 7 aa, Mycobacterium
AHPRPAV

SEQ ID NO: 424985 - protein, 11 aa, Mycobacterium
AHPRPLSSPHP

SEQ ID NO: 424986 - protein, 6 aa, Mycobacterium
AHPRQA

SEQ ID NO: 424987 - protein, 12 aa, Mycobacterium
AHPSAAQAAEGY

SEQ ID NO: 424988 - protein, 13 aa, Mycobacterium
AHPSAAQAAEGYL

SEQ ID NO: 424989 - protein, 15 aa, Mycobacterium
AHPSAAQAQEGFERE

SEQ ID NO: 424990 - protein, 9 aa, Mycobacterium
AHPSAEQAI

SEQ ID NO: 424991 - protein, 9 aa, Mycobacterium
AHPSAEQAV

SEQ ID NO: 424992 - protein, 7 aa, Mycobacterium
AHPSAGQ

SEQ ID NO: 424993 - protein, 7 aa, Mycobacterium
AHPSAQQ

SEQ ID NO: 424994 - protein, 23 aa, Mycobacterium
AHPSAQQAADGFAREEAAGVPLN

SEQ ID NO: 424995 - protein, 8 aa, Mycobacterium
AHPSARSK

SEQ ID NO: 424996 - protein, 6 aa, Mycobacterium
AHPSAS

SEQ ID NO: 424997 - protein, 9 aa, Mycobacterium
AHPSTEQAV

SEQ ID NO: 424998 - protein, 6 aa, Mycobacterium
AHPTAE

SEQ ID NO: 424999 - protein, 9 aa, Mycobacterium
AHPTAQRTL

SEQ ID NO: 425000 - protein, 7 aa, Mycobacterium
AHPTDSE

SEQ ID NO: 425001 - protein, 6 aa, Mycobacterium
AHPTEQ

SEQ ID NO: 425002 - protein, 4 aa, Mycobacterium
AHPV

SEQ ID NO: 425003 - protein, 7 aa, Mycobacterium
AHPVAGE

SEQ ID NO: 425004 - protein, 13 aa, Mycobacterium
AHPVRNDGPAVST

SEQ ID NO: 425005 - protein, 11 aa, Mycobacterium
AHQAAKPNPII

SEQ ID NO: 425006 - protein, 9 aa, Mycobacterium
AHQAPLGAT

SEQ ID NO: 425007 - protein, 5 aa, Mycobacterium
AHQDA

SEQ ID NO: 425008 - protein, 6 aa, Mycobacterium
AHQDGA

SEQ ID NO: 425009 - protein, 6 aa, Mycobacterium
AHQDPL

SEQ ID NO: 425010 - protein, 13 aa, Mycobacterium
AHQDRSDDPSIAE

SEQ ID NO: 425011 - protein, 5 aa, Mycobacterium
AHQEG

SEQ ID NO: 425012 - protein, 7 aa, Mycobacterium
AHQGGRL

SEQ ID NO: 425013 - protein, 13 aa, Mycobacterium
AHQNRSHRLTPSV

SEQ ID NO: 425014 - protein, 11 aa, Mycobacterium
AHQPGRPAYTG

SEQ ID NO: 425015 - protein, 6 aa, Mycobacterium
AHQPPG

SEQ ID NO: 425016 - protein, 37 aa, Mycobacterium
AHQPPVGGQPAQDIGGHPQPQAESGRHFGSGERGVGA

SEQ ID NO: 425017 - protein, 15 aa, Mycobacterium
AHQRGELADPDARAT

SEQ ID NO: 425018 - protein, 21 aa, Mycobacterium
AHQRQHGMTQPPGVREPLDDQ

SEQ ID NO: 425019 - protein, 14 aa, Mycobacterium
AHQSAARCEPPRSV

SEQ ID NO: 425020 - protein, 7 aa, Mycobacterium
AHQTASD

SEQ ID NO: 425021 - protein, 5 aa, Mycobacterium
AHQTP

SEQ ID NO: 425022 - protein, 6 aa, Mycobacterium
AHQVPP

SEQ ID NO: 425023 - protein, 15 aa, Mycobacterium
AHRAAARNRAEPTDV

SEQ ID NO: 425024 - protein, 7 aa, Mycobacterium
AHRAAGR

SEQ ID NO: 425025 - protein, 14 aa, Mycobacterium
AHRADGVQHRRDPL

SEQ ID NO: 425026 - protein, 6 aa, Mycobacterium
AHRADY

SEQ ID NO: 425027 - protein, 7 aa, Mycobacterium
AHRAEAK

SEQ ID NO: 425028 - protein, 7 aa, Mycobacterium
AHRAEPD

SEQ ID NO: 425029 - protein, 16 aa, Mycobacterium
AHRAGQDALGETGGSP

SEQ ID NO: 425030 - protein, 16 aa, Mycobacterium
AHRASQDALGDEAGSP

SEQ ID NO: 425031 - protein, 10 aa, Mycobacterium
AHRDDDKARA

SEQ ID NO: 425032 - protein, 6 aa, Mycobacterium
AHRDEV

SEQ ID NO: 425033 - protein, 5 aa, Mycobacterium
AHRDK

SEQ ID NO: 425034 - protein, 19 aa, Mycobacterium
AHRDPDAVDRPDEFDPDRE

SEQ ID NO: 425035 - protein, 5 aa, Mycobacterium
AHRDR

SEQ ID NO: 425036 - protein, 12 aa, Mycobacterium
AHREGNRPPSSA

SEQ ID NO: 425037 - protein, 9 aa, Mycobacterium
AHRENGNGR

SEQ ID NO: 425038 - protein, 5 aa, Mycobacterium
AHREQ

SEQ ID NO: 425039 - protein, 7 aa, Mycobacterium
AHREQQG

SEQ ID NO: 425040 - protein, 5 aa, Mycobacterium
AHRFT

SEQ ID NO: 425041 - protein, 6 aa, Mycobacterium
AHRGAD

SEQ ID NO: 425042 - protein, 24 aa, Mycobacterium
AHRGADPRTATARDTTLELLAKEL

SEQ ID NO: 425043 - protein, 6 aa, Mycobacterium
AHRGAP

SEQ ID NO: 425044 - protein, 7 aa, Mycobacterium
AHRGGDL

SEQ ID NO: 425045 - protein, 7 aa, Mycobacterium
AHRGPRL

SEQ ID NO: 425046 - protein, 15 aa, Mycobacterium
AHRGQPDVAAGVGPE

SEQ ID NO: 425047 - protein, 7 aa, Mycobacterium
AHRGRPL

SEQ ID NO: 425048 - protein, 13 aa, Mycobacterium
AHRGTDPATAPAR

SEQ ID NO: 425049 - protein, 12 aa, Mycobacterium
AHRGTGKSDAFD

SEQ ID NO: 425050 - protein, 10 aa, Mycobacterium
AHRGTYDGGE

SEQ ID NO: 425051 - protein, 13 aa, Mycobacterium
AHRHGNKGSIEGP

SEQ ID NO: 425052 - protein, 26 aa, Mycobacterium
AHRKGTARDAAIDRANAAEGKVNAAC

SEQ ID NO: 425053 - protein, 15 aa, Mycobacterium
AHRLSGAQPHGEPAG

SEQ ID NO: 425054 - protein, 6 aa, Mycobacterium
AHRNGA

SEQ ID NO: 425055 - protein, 7 aa, Mycobacterium
AHRNGEG

SEQ ID NO: 425056 - protein, 9 aa, Mycobacterium
AHRNGFGPA

SEQ ID NO: 425057 - protein, 4 aa, Mycobacterium
AHRP

SEQ ID NO: 425058 - protein, 5 aa, Mycobacterium
AHRPK

SEQ ID NO: 425059 - protein, 7 aa, Mycobacterium
AHRPPGQ

SEQ ID NO: 425060 - protein, 11 aa, Mycobacterium
AHRPTTGGGLP

SEQ ID NO: 425061 - protein, 5 aa, Mycobacterium
AHRPV

SEQ ID NO: 425062 - protein, 10 aa, Mycobacterium
AHRPVERSEV

SEQ ID NO: 425063 - protein, 6 aa, Mycobacterium
AHRQGA

SEQ ID NO: 425064 - protein, 7 aa, Mycobacterium
AHRQGAA

SEQ ID NO: 425065 - protein, 8 aa, Mycobacterium
AHRQGAAS

SEQ ID NO: 425066 - protein, 7 aa, Mycobacterium
AHRQGPT

SEQ ID NO: 425067 - protein, 6 aa, Mycobacterium
AHRQSR

SEQ ID NO: 425068 - protein, 4 aa, Mycobacterium
AHRR

SEQ ID NO: 425069 - protein, 8 aa, Mycobacterium
AHRRAPDV

SEQ ID NO: 425070 - protein, 8 aa, Mycobacterium
AHRRETYT

SEQ ID NO: 425071 - protein, 10 aa, Mycobacterium
AHRRQGLAGR

SEQ ID NO: 425072 - protein, 12 aa, Mycobacterium
AHRRRGASWPWG

SEQ ID NO: 425073 - protein, 9 aa, Mycobacterium
AHRRTSVTG

SEQ ID NO: 425074 - protein, 4 aa, Mycobacterium
AHRS

SEQ ID NO: 425075 - protein, 10 aa, Mycobacterium
AHRSATEAIS

SEQ ID NO: 425076 - protein, 5 aa, Mycobacterium
AHRSD

SEQ ID NO: 425077 - protein, 5 aa, Mycobacterium
AHRSG

SEQ ID NO: 425078 - protein, 10 aa, Mycobacterium
AHRSGDGRSV

SEQ ID NO: 425079 - protein, 7 aa, Mycobacterium
AHRSGFD

SEQ ID NO: 425080 - protein, 9 aa, Mycobacterium
AHRSPSRTA

SEQ ID NO: 425081 - protein, 17 aa, Mycobacterium
AHRSSKGLNTGEPHSPV

SEQ ID NO: 425082 - protein, 9 aa, Mycobacterium
AHRTDQDAW

SEQ ID NO: 425083 - protein, 9 aa, Mycobacterium
AHSAARESV

SEQ ID NO: 425084 - protein, 13 aa, Mycobacterium
AHSADAAGSAKAL

SEQ ID NO: 425085 - protein, 11 aa, Mycobacterium
AHSAHQKCPDT

SEQ ID NO: 425086 - protein, 7 aa, Mycobacterium
AHSAKPK

SEQ ID NO: 425087 - protein, 16 aa, Mycobacterium
AHSAKRDAQARPTQRT

SEQ ID NO: 425088 - protein, 11 aa, Mycobacterium
AHSAPGSRFAT

SEQ ID NO: 425089 - protein, 6 aa, Mycobacterium
AHSAYP

SEQ ID NO: 425090 - protein, 19 aa, Mycobacterium
AHSDADDHRRGPMRQRSTG

SEQ ID NO: 425091 - protein, 6 aa, Mycobacterium
AHSDDR

SEQ ID NO: 425092 - protein, 5 aa, Mycobacterium
AHSDE

SEQ ID NO: 425093 - protein, 7 aa, Mycobacterium
AHSDGRV

SEQ ID NO: 425094 - protein, 19 aa, Mycobacterium
AHSDTPAAAGTGSPLYDPY

SEQ ID NO: 425095 - protein, 10 aa, Mycobacterium
AHSDTPQPVN

SEQ ID NO: 425096 - protein, 5 aa, Mycobacterium
AHSEN

SEQ ID NO: 425097 - protein, 11 aa, Mycobacterium
AHSGAEQDDPM

SEQ ID NO: 425098 - protein, 8 aa, Mycobacterium
AHSGGGTG

SEQ ID NO: 425099 - protein, 5 aa, Mycobacterium
AHSGK

SEQ ID NO: 425100 - protein, 8 aa, Mycobacterium
AHSGPRGS

SEQ ID NO: 425101 - protein, 8 aa, Mycobacterium
AHSGPVPE

SEQ ID NO: 425102 - protein, 5 aa, Mycobacterium
AHSGR

SEQ ID NO: 425103 - protein, 6 aa, Mycobacterium
AHSGRD

SEQ ID NO: 425104 - protein, 6 aa, Mycobacterium
AHSGSW

SEQ ID NO: 425105 - protein, 15 aa, Mycobacterium
AHSGVEAEGLRDNPR

SEQ ID NO: 425106 - protein, 18 aa, Mycobacterium
AHSHNGAEVDDGHGPGQI

SEQ ID NO: 425107 - protein, 10 aa, Mycobacterium
AHSKVGNDAA

SEQ ID NO: 425108 - protein, 7 aa, Mycobacterium
AHSNDKE

SEQ ID NO: 425109 - protein, 7 aa, Mycobacterium
AHSNNKE

SEQ ID NO: 425110 - protein, 7 aa, Mycobacterium
AHSPARL

SEQ ID NO: 425111 - protein, 10 aa, Mycobacterium
AHSPGPLGAT

SEQ ID NO: 425112 - protein, 8 aa, Mycobacterium
AHSPKRLE

SEQ ID NO: 425113 - protein, 7 aa, Mycobacterium
AHSPPEA

SEQ ID NO: 425114 - protein, 16 aa, Mycobacterium
AHSQGRYPAERPPRVA

SEQ ID NO: 425115 - protein, 7 aa, Mycobacterium
AHSQQSL

SEQ ID NO: 425116 - protein, 9 aa, Mycobacterium
AHSQSVRNR

SEQ ID NO: 425117 - protein, 4 aa, Mycobacterium
AHSR

SEQ ID NO: 425118 - protein, 6 aa, Mycobacterium
AHSRGG

SEQ ID NO: 425119 - protein, 6 aa, Mycobacterium
AHSRRD

SEQ ID NO: 425120 - protein, 12 aa, Mycobacterium
AHSRVGSEEERS

SEQ ID NO: 425121 - protein, 9 aa, Mycobacterium
AHSSPEENS

SEQ ID NO: 425122 - protein, 8 aa, Mycobacterium
AHSSPEEY

SEQ ID NO: 425123 - protein, 13 aa, Mycobacterium
AHSSQPHAAVSAG

SEQ ID NO: 425124 - protein, 13 aa, Mycobacterium
AHSSSTETAYGAP

SEQ ID NO: 425125 - protein, 8 aa, Mycobacterium
AHSTGGRQ

SEQ ID NO: 425126 - protein, 6 aa, Mycobacterium
AHSTPE

SEQ ID NO: 425127 - protein, 6 aa, Mycobacterium
AHSTQG

SEQ ID NO: 425128 - protein, 7 aa, Mycobacterium
AHSTRPI

SEQ ID NO: 425129 - protein, 13 aa, Mycobacterium
AHSYPDDARTAAE

SEQ ID NO: 425130 - protein, 12 aa, Mycobacterium
AHSYPDERRTAA

SEQ ID NO: 425131 - protein, 4 aa, Mycobacterium
AHTA

SEQ ID NO: 425132 - protein, 5 aa, Mycobacterium
AHTAD

SEQ ID NO: 425133 - protein, 10 aa, Mycobacterium
AHTAEAGGGT

SEQ ID NO: 425134 - protein, 11 aa, Mycobacterium
AHTAGGASAIS

SEQ ID NO: 425135 - protein, 10 aa, Mycobacterium
AHTAHAPAPR

SEQ ID NO: 425136 - protein, 9 aa, Mycobacterium
AHTAPQSMA

SEQ ID NO: 425137 - protein, 7 aa, Mycobacterium
AHTARAA

SEQ ID NO: 425138 - protein, 7 aa, Mycobacterium
AHTASRT

SEQ ID NO: 425139 - protein, 4 aa, Mycobacterium
AHTD

SEQ ID NO: 425140 - protein, 5 aa, Mycobacterium
AHTDA

SEQ ID NO: 425141 - protein, 10 aa, Mycobacterium
AHTDGGTGLT

SEQ ID NO: 425142 - protein, 5 aa, Mycobacterium
AHTDL

SEQ ID NO: 425143 - protein, 9 aa, Mycobacterium
AHTDRGSHF

SEQ ID NO: 425144 - protein, 8 aa, Mycobacterium
AHTEATQA

SEQ ID NO: 425145 - protein, 6 aa, Mycobacterium
AHTEHN

SEQ ID NO: 425146 - protein, 5 aa, Mycobacterium
AHTEP

SEQ ID NO: 425147 - protein, 9 aa, Mycobacterium
AHTEPPDLT

SEQ ID NO: 425148 - protein, 7 aa, Mycobacterium
AHTESEL

SEQ ID NO: 425149 - protein, 5 aa, Mycobacterium
AHTET

SEQ ID NO: 425150 - protein, 8 aa, Mycobacterium
AHTEYDTG

SEQ ID NO: 425151 - protein, 4 aa, Mycobacterium
AHTG

SEQ ID NO: 425152 - protein, 15 aa, Mycobacterium
AHTGARPAVTLPPGA

SEQ ID NO: 425153 - protein, 11 aa, Mycobacterium
AHTGDQVADPA

SEQ ID NO: 425154 - protein, 6 aa, Mycobacterium
AHTGPW

SEQ ID NO: 425155 - protein, 6 aa, Mycobacterium
AHTGRA

SEQ ID NO: 425156 - protein, 11 aa, Mycobacterium
AHTGTSEYGRT

SEQ ID NO: 425157 - protein, 13 aa, Mycobacterium
AHTKSIGERGRET

SEQ ID NO: 425158 - protein, 46 aa, Mycobacterium
AHTLNSPPQPAAPPPPTPYPATPPGDAPGPPTGSDGPNGSGSPGAQ

SEQ ID NO: 425159 - protein, 11 aa, Mycobacterium
AHTPDYPELDQ

SEQ ID NO: 425160 - protein, 7 aa, Mycobacterium
AHTPLDG

SEQ ID NO: 425161 - protein, 7 aa, Mycobacterium
AHTPMDG

SEQ ID NO: 425162 - protein, 10 aa, Mycobacterium
AHTPSPNTVR

SEQ ID NO: 425163 - protein, 5 aa, Mycobacterium
AHTPT

SEQ ID NO: 425164 - protein, 7 aa, Mycobacterium
AHTPYDG

SEQ ID NO: 425165 - protein, 15 aa, Mycobacterium
AHTQSGVRVAKPRDD

SEQ ID NO: 425166 - protein, 8 aa, Mycobacterium
AHTRATQA

SEQ ID NO: 425167 - protein, 15 aa, Mycobacterium
AHTRGTTAFNASGDL

SEQ ID NO: 425168 - protein, 5 aa, Mycobacterium
AHTRK

SEQ ID NO: 425169 - protein, 7 aa, Mycobacterium
AHTRPWQ

SEQ ID NO: 425170 - protein, 4 aa, Mycobacterium
AHTS

SEQ ID NO: 425171 - protein, 10 aa, Mycobacterium
AHTSQNGKTR

SEQ ID NO: 425172 - protein, 7 aa, Mycobacterium
AHTSTED

SEQ ID NO: 425173 - protein, 10 aa, Mycobacterium
AHTSTPYVGP

SEQ ID NO: 425174 - protein, 4 aa, Mycobacterium
AHTT

SEQ ID NO: 425175 - protein, 8 aa, Mycobacterium
AHTTGANQ

SEQ ID NO: 425176 - protein, 7 aa, Mycobacterium
AHTTGDL

SEQ ID NO: 425177 - protein, 8 aa, Mycobacterium
AHTTGFSQ

SEQ ID NO: 425178 - protein, 5 aa, Mycobacterium
AHTTI

SEQ ID NO: 425179 - protein, 5 aa, Mycobacterium
AHTTR

SEQ ID NO: 425180 - protein, 5 aa, Mycobacterium
AHTVP

SEQ ID NO: 425181 - protein, 13 aa, Mycobacterium
AHTYPDGARTQAE

SEQ ID NO: 425182 - protein, 4 aa, Mycobacterium
AHVD

SEQ ID NO: 425183 - protein, 20 aa, Mycobacterium
AHVGPGVSADQAKLSGETAH

SEQ ID NO: 425184 - protein, 6 aa, Mycobacterium
AHVPDA

SEQ ID NO: 425185 - protein, 8 aa, Mycobacterium
AHVSADPI

SEQ ID NO: 425186 - protein, 7 aa, Mycobacterium
AHVTGTE

SEQ ID NO: 425187 - protein, 14 aa, Mycobacterium
AHYGEGASRTLGIS

SEQ ID NO: 425188 - protein, 13 aa, Mycobacterium
AHYGGSTARSGGG

SEQ ID NO: 425189 - protein, 10 aa, Mycobacterium
AHYPEESPLR

SEQ ID NO: 425190 - protein, 5 aa, Mycobacterium
AHYPG

SEQ ID NO: 425191 - protein, 4 aa, Mycobacterium
AIAA

SEQ ID NO: 425192 - protein, 14 aa, Mycobacterium
AIAAPEADPPPNHC

SEQ ID NO: 425193 - protein, 14 aa, Mycobacterium
AIAAPEADPPPNYC

SEQ ID NO: 425194 - protein, 5 aa, Mycobacterium
AIAAT

SEQ ID NO: 425195 - protein, 6 aa, Mycobacterium
AIAATE

SEQ ID NO: 425196 - protein, 9 aa, Mycobacterium
AIAATEAEY

SEQ ID NO: 425197 - protein, 9 aa, Mycobacterium
AIAATEAQY

SEQ ID NO: 425198 - protein, 15 aa, Mycobacterium
AIAATKSELPQAVPQ

SEQ ID NO: 425199 - protein, 10 aa, Mycobacterium
AIADEEVDAG

SEQ ID NO: 425200 - protein, 5 aa, Mycobacterium
AIADG

SEQ ID NO: 425201 - protein, 16 aa, Mycobacterium
AIADGDTVTILPAVAG

SEQ ID NO: 425202 - protein, 6 aa, Mycobacterium
AIADGK

SEQ ID NO: 425203 - protein, 8 aa, Mycobacterium
AIADGTNR

SEQ ID NO: 425204 - protein, 10 aa, Mycobacterium
AIADGTSRIH

SEQ ID NO: 425205 - protein, 9 aa, Mycobacterium
AIADRGDDP

SEQ ID NO: 425206 - protein, 4 aa, Mycobacterium
AIAE

SEQ ID NO: 425207 - protein, 9 aa, Mycobacterium
AIAEAGPGW

SEQ ID NO: 425208 - protein, 14 aa, Mycobacterium
AIAEDGNTIGTPEG

SEQ ID NO: 425209 - protein, 21 aa, Mycobacterium
AIAEEGGVDIDGAPAAKSDKL

SEQ ID NO: 425210 - protein, 7 aa, Mycobacterium
AIAENGV

SEQ ID NO: 425211 - protein, 16 aa, Mycobacterium
AIAESGESFAATTGMG

SEQ ID NO: 425212 - protein, 5 aa, Mycobacterium
AIAGG

SEQ ID NO: 425213 - protein, 6 aa, Mycobacterium
AIAGGT

SEQ ID NO: 425214 - protein, 8 aa, Mycobacterium
AIAGNTSL

SEQ ID NO: 425215 - protein, 7 aa, Mycobacterium
AIAGPLT

SEQ ID NO: 425216 - protein, 12 aa, Mycobacterium
AIAGRPAPSELA

SEQ ID NO: 425217 - protein, 12 aa, Mycobacterium
AIAGRSPPATPT

SEQ ID NO: 425218 - protein, 10 aa, Mycobacterium
AIAGRTTYRQ

SEQ ID NO: 425219 - protein, 5 aa, Mycobacterium
AIAGT

SEQ ID NO: 425220 - protein, 5 aa, Mycobacterium
AIAKS

SEQ ID NO: 425221 - protein, 6 aa, Mycobacterium
AIANGK

SEQ ID NO: 425222 - protein, 10 aa, Mycobacterium
AIANGSEPWR

SEQ ID NO: 425223 - protein, 9 aa, Mycobacterium
AIANSDGSV

SEQ ID NO: 425224 - protein, 8 aa, Mycobacterium
AIAPDGTS

SEQ ID NO: 425225 - protein, 8 aa, Mycobacterium
AIAPGASI

SEQ ID NO: 425226 - protein, 7 aa, Mycobacterium
AIAPQAA

SEQ ID NO: 425227 - protein, 13 aa, Mycobacterium
AIAPTRPHAGVES

SEQ ID NO: 425228 - protein, 20 aa, Mycobacterium
AIAPTRPHAGVESPAANMAA

SEQ ID NO: 425229 - protein, 13 aa, Mycobacterium
AIAPTRPHPGVES

SEQ ID NO: 425230 - protein, 6 aa, Mycobacterium
AIAQNA

SEQ ID NO: 425231 - protein, 5 aa, Mycobacterium
AIARG

SEQ ID NO: 425232 - protein, 8 aa, Mycobacterium
AIARGRRA

SEQ ID NO: 425233 - protein, 15 aa, Mycobacterium
AIARQARTRRHSPGE

SEQ ID NO: 425234 - protein, 4 aa, Mycobacterium
AIAS

SEQ ID NO: 425235 - protein, 34 aa, Mycobacterium
AIASAAASTAAAASGGLGGGRAPLPGGLETAGGA

SEQ ID NO: 425236 - protein, 16 aa, Mycobacterium
AIASAAQPGEAGRRHR

SEQ ID NO: 425237 - protein, 9 aa, Mycobacterium
AIASAEAQY

SEQ ID NO: 425238 - protein, 12 aa, Mycobacterium
AIASGDERATAL

SEQ ID NO: 425239 - protein, 10 aa, Mycobacterium
AIASQGPNPL

SEQ ID NO: 425240 - protein, 15 aa, Mycobacterium
AIASTDEVIHAIAGM

SEQ ID NO: 425241 - protein, 12 aa, Mycobacterium
AIATEPTDALSA

SEQ ID NO: 425242 - protein, 10 aa, Mycobacterium
AIATEPTESL

SEQ ID NO: 425243 - protein, 12 aa, Mycobacterium
AIATERAGKPVD

SEQ ID NO: 425244 - protein, 61 aa, Mycobacterium
AIATGAAGRTGAAGSDRVRTSTAGAAVATAARGGSGRARRGATAASAGTAGPARAAGAGVT

SEQ ID NO: 425245 - protein, 15 aa, Mycobacterium
AIATPEADASQDYCG

SEQ ID NO: 425246 - protein, 6 aa, Mycobacterium
AIATTE

SEQ ID NO: 425247 - protein, 8 aa, Mycobacterium
AIATTEAE

SEQ ID NO: 425248 - protein, 4 aa, Mycobacterium
AIDA

SEQ ID NO: 425249 - protein, 14 aa, Mycobacterium
AIDAEPQAAAGEQV

SEQ ID NO: 425250 - protein, 8 aa, Mycobacterium
AIDATEGK

SEQ ID NO: 425251 - protein, 4 aa, Mycobacterium
AIDD

SEQ ID NO: 425252 - protein, 6 aa, Mycobacterium
AIDEQS

SEQ ID NO: 425253 - protein, 4 aa, Mycobacterium
AIDG

SEQ ID NO: 425254 - protein, 11 aa, Mycobacterium
AIDGDKKAHSV

SEQ ID NO: 425255 - protein, 6 aa, Mycobacterium
AIDGER

SEQ ID NO: 425256 - protein, 10 aa, Mycobacterium
AIDGKANKAA

SEQ ID NO: 425257 - protein, 7 aa, Mycobacterium
AIDGNAN

SEQ ID NO: 425258 - protein, 9 aa, Mycobacterium
AIDGPGGSI

SEQ ID NO: 425259 - protein, 6 aa, Mycobacterium
AIDGSA

SEQ ID NO: 425260 - protein, 4 aa, Mycobacterium
AIDP

SEQ ID NO: 425261 - protein, 5 aa, Mycobacterium
AIDPD

SEQ ID NO: 425262 - protein, 7 aa, Mycobacterium
AIDPERL

SEQ ID NO: 425263 - protein, 14 aa, Mycobacterium
AIDPGAARKELGEA

SEQ ID NO: 425264 - protein, 15 aa, Mycobacterium
AIDPHPARPSPPGDT

SEQ ID NO: 425265 - protein, 16 aa, Mycobacterium
AIDPKAAAKELGPDAA

SEQ ID NO: 425266 - protein, 17 aa, Mycobacterium
AIDPKAAAKELGPDAAP

SEQ ID NO: 425267 - protein, 18 aa, Mycobacterium
AIDPKAAAKELGPDAGPV

SEQ ID NO: 425268 - protein, 17 aa, Mycobacterium
AIDPKAAAKELGPDSAT

SEQ ID NO: 425269 - protein, 5 aa, Mycobacterium
AIDPN

SEQ ID NO: 425270 - protein, 19 aa, Mycobacterium
AIDRDTQTASAGSVTPHRT

SEQ ID NO: 425271 - protein, 5 aa, Mycobacterium
AIDRG

SEQ ID NO: 425272 - protein, 4 aa, Mycobacterium
AIDS

SEQ ID NO: 425273 - protein, 6 aa, Mycobacterium
AIDSPS

SEQ ID NO: 425274 - protein, 5 aa, Mycobacterium
AIDST

SEQ ID NO: 425275 - protein, 13 aa, Mycobacterium
AIDTAADPPLRDE

SEQ ID NO: 425276 - protein, 5 aa, Mycobacterium
AIDTS

SEQ ID NO: 425277 - protein, 7 aa, Mycobacterium
AIEAAPK

SEQ ID NO: 425278 - protein, 12 aa, Mycobacterium
AIEAEPSDGAGE

SEQ ID NO: 425279 - protein, 5 aa, Mycobacterium
AIEAP

SEQ ID NO: 425280 - protein, 18 aa, Mycobacterium
AIEDQRDADLEARAQKLE

SEQ ID NO: 425281 - protein, 6 aa, Mycobacterium
AIEEAV

SEQ ID NO: 425282 - protein, 12 aa, Mycobacterium
AIEKAAKDGGYN

SEQ ID NO: 425283 - protein, 7 aa, Mycobacterium
AIENGEL

SEQ ID NO: 425284 - protein, 9 aa, Mycobacterium
AIENGQEVG

SEQ ID NO: 425285 - protein, 4 aa, Mycobacterium
AIEP

SEQ ID NO: 425286 - protein, 9 aa, Mycobacterium
AIEPDPQTL

SEQ ID NO: 425287 - protein, 8 aa, Mycobacterium
AIEPPGFA

SEQ ID NO: 425288 - protein, 9 aa, Mycobacterium
AIEQQAGRS

SEQ ID NO: 425289 - protein, 9 aa, Mycobacterium
AIEQRTGRR

SEQ ID NO: 425290 - protein, 10 aa, Mycobacterium
AIEQRTGRTI

SEQ ID NO: 425291 - protein, 6 aa, Mycobacterium
AIERAE

SEQ ID NO: 425292 - protein, 4 aa, Mycobacterium
AIES

SEQ ID NO: 425293 - protein, 7 aa, Mycobacterium
AIETEYP

SEQ ID NO: 425294 - protein, 7 aa, Mycobacterium
AIGAAPG

SEQ ID NO: 425295 - protein, 13 aa, Mycobacterium
AIGADASPTPTAH

SEQ ID NO: 425296 - protein, 10 aa, Mycobacterium
AIGAPGATGV

SEQ ID NO: 425297 - protein, 11 aa, Mycobacterium
AIGAPPENPTL

SEQ ID NO: 425298 - protein, 16 aa, Mycobacterium
AIGARAAGDSLDTAPW

SEQ ID NO: 425299 - protein, 7 aa, Mycobacterium
AIGERGQ

SEQ ID NO: 425300 - protein, 4 aa, Mycobacterium
AIGG

SEQ ID NO: 425301 - protein, 6 aa, Mycobacterium
AIGGDK

SEQ ID NO: 425302 - protein, 8 aa, Mycobacterium
AIGGEPRA

SEQ ID NO: 425303 - protein, 9 aa, Mycobacterium
AIGGGDPAI

SEQ ID NO: 425304 - protein, 24 aa, Mycobacterium
AIGGGDQTAIGGAGTAPCGAGNGG

SEQ ID NO: 425305 - protein, 6 aa, Mycobacterium
AIGGGH

SEQ ID NO: 425306 - protein, 16 aa, Mycobacterium
AIGGGNTVAASSTGLT

SEQ ID NO: 425307 - protein, 10 aa, Mycobacterium
AIGGGTSEIQ

SEQ ID NO: 425308 - protein, 28 aa, Mycobacterium
AIGGNGGNGGNGSTTAAGGNGGTGGTGR

SEQ ID NO: 425309 - protein, 5 aa, Mycobacterium
AIGGT

SEQ ID NO: 425310 - protein, 6 aa, Mycobacterium
AIGGTT

SEQ ID NO: 425311 - protein, 4 aa, Mycobacterium
AIGL

SEQ ID NO: 425312 - protein, 4 aa, Mycobacterium
AIGP

SEQ ID NO: 425313 - protein, 9 aa, Mycobacterium
AIGPDGEAG

SEQ ID NO: 425314 - protein, 7 aa, Mycobacterium
AIGPEGL

SEQ ID NO: 425315 - protein, 12 aa, Mycobacterium
AIGPGRTRSYGE

SEQ ID NO: 425316 - protein, 9 aa, Mycobacterium
AIGPKDNES

SEQ ID NO: 425317 - protein, 6 aa, Mycobacterium
AIGPNT

SEQ ID NO: 425318 - protein, 4 aa, Mycobacterium
AIGR

SEQ ID NO: 425319 - protein, 9 aa, Mycobacterium
AIGREKELQ

SEQ ID NO: 425320 - protein, 6 aa, Mycobacterium
AIGRES

SEQ ID NO: 425321 - protein, 11 aa, Mycobacterium
AIGRTPRSTLA

SEQ ID NO: 425322 - protein, 7 aa, Mycobacterium
AIGSASR

SEQ ID NO: 425323 - protein, 7 aa, Mycobacterium
AIGSENL

SEQ ID NO: 425324 - protein, 8 aa, Mycobacterium
AIGSGAPS

SEQ ID NO: 425325 - protein, 8 aa, Mycobacterium
AIGSGEPQ

SEQ ID NO: 425326 - protein, 20 aa, Mycobacterium
AIGSGNSQVSAEAGGAGGNI

SEQ ID NO: 425327 - protein, 8 aa, Mycobacterium
AIGSKATT

SEQ ID NO: 425328 - protein, 27 aa, Mycobacterium
AIGSPSWATDPGLATAAARRERADAID

SEQ ID NO: 425329 - protein, 5 aa, Mycobacterium
AIGSS

SEQ ID NO: 425330 - protein, 6 aa, Mycobacterium
AIGSSP

SEQ ID NO: 425331 - protein, 6 aa, Mycobacterium
AIGSST

SEQ ID NO: 425332 - protein, 5 aa, Mycobacterium
AIGTD

SEQ ID NO: 425333 - protein, 14 aa, Mycobacterium
AIGTGGAGSAGALT

SEQ ID NO: 425334 - protein, 9 aa, Mycobacterium
AIGTGSTGV

SEQ ID NO: 425335 - protein, 21 aa, Mycobacterium
AIGTMTAKGPAAGGTRYEAER

SEQ ID NO: 425336 - protein, 7 aa, Mycobacterium
AIGTPDG

SEQ ID NO: 425337 - protein, 7 aa, Mycobacterium
AIGYPPN

SEQ ID NO: 425338 - protein, 4 aa, Mycobacterium
AIHD

SEQ ID NO: 425339 - protein, 5 aa, Mycobacterium
AIHPQ

SEQ ID NO: 425340 - protein, 6 aa, Mycobacterium
AIHPRQ

SEQ ID NO: 425341 - protein, 22 aa, Mycobacterium
AIKAAAASSPLQSKYGQTVDSR

SEQ ID NO: 425342 - protein, 10 aa, Mycobacterium
AIKGTATGLD

SEQ ID NO: 425343 - protein, 12 aa, Mycobacterium
AIKNPDGSNSYV

SEQ ID NO: 425344 - protein, 13 aa, Mycobacterium
AIKPGAAALTEDQ

SEQ ID NO: 425345 - protein, 5 aa, Mycobacterium
AIKPR

SEQ ID NO: 425346 - protein, 7 aa, Mycobacterium
AIKPSYG

SEQ ID NO: 425347 - protein, 4 aa, Mycobacterium
AIND

SEQ ID NO: 425348 - protein, 8 aa, Mycobacterium
AINDTKAA

SEQ ID NO: 425349 - protein, 12 aa, Mycobacterium
AINGEYPDEIAE

SEQ ID NO: 425350 - protein, 13 aa, Mycobacterium
AINGMASGRSQLG

SEQ ID NO: 425351 - protein, 10 aa, Mycobacterium
AINKPSNSDI

SEQ ID NO: 425352 - protein, 10 aa, Mycobacterium
AINNDGSRKH

SEQ ID NO: 425353 - protein, 6 aa, Mycobacterium
AINNNV

SEQ ID NO: 425354 - protein, 4 aa, Mycobacterium
AINP

SEQ ID NO: 425355 - protein, 7 aa, Mycobacterium
AINPADP

SEQ ID NO: 425356 - protein, 12 aa, Mycobacterium
AINPEGPLPDSA

SEQ ID NO: 425357 - protein, 10 aa, Mycobacterium
AINPNPHREA

SEQ ID NO: 425358 - protein, 20 aa, Mycobacterium
AINQDGASKRLTAPNGRAQE

SEQ ID NO: 425359 - protein, 18 aa, Mycobacterium
AINQDGASNGLTAPNGLA

SEQ ID NO: 425360 - protein, 21 aa, Mycobacterium
AINQDGASNGLTAPNGPSQQR

SEQ ID NO: 425361 - protein, 20 aa, Mycobacterium
AINQDGASNGLTAPSGPAQQ

SEQ ID NO: 425362 - protein, 19 aa, Mycobacterium
AINQDGRSAGLSAPSGDAQ

SEQ ID NO: 425363 - protein, 20 aa, Mycobacterium
AINQDGRSNGMTAPNAAAQR

SEQ ID NO: 425364 - protein, 11 aa, Mycobacterium
AINQNRSGGLL

SEQ ID NO: 425365 - protein, 5 aa, Mycobacterium
AINSP

SEQ ID NO: 425366 - protein, 5 aa, Mycobacterium
AIPAA

SEQ ID NO: 425367 - protein, 5 aa, Mycobacterium
AIPAD

SEQ ID NO: 425368 - protein, 9 aa, Mycobacterium
AIPADEKAQ

SEQ ID NO: 425369 - protein, 7 aa, Mycobacterium
AIPADEQ

SEQ ID NO: 425370 - protein, 9 aa, Mycobacterium
AIPADPDGR

SEQ ID NO: 425371 - protein, 10 aa, Mycobacterium
AIPADPNGAW

SEQ ID NO: 425372 - protein, 5 aa, Mycobacterium
AIPAG

SEQ ID NO: 425373 - protein, 9 aa, Mycobacterium
AIPAGAATV

SEQ ID NO: 425374 - protein, 7 aa, Mycobacterium
AIPAGER

SEQ ID NO: 425375 - protein, 14 aa, Mycobacterium
AIPAPDERGQRVSD

SEQ ID NO: 425376 - protein, 20 aa, Mycobacterium
AIPAPRGHKVPKPGDTGGAG

SEQ ID NO: 425377 - protein, 10 aa, Mycobacterium
AIPAPTPRRP

SEQ ID NO: 425378 - protein, 4 aa, Mycobacterium
AIPD

SEQ ID NO: 425379 - protein, 14 aa, Mycobacterium
AIPDDEVAGSAEAS

SEQ ID NO: 425380 - protein, 12 aa, Mycobacterium
AIPDERSDAEPP

SEQ ID NO: 425381 - protein, 12 aa, Mycobacterium
AIPDERSQAEPP

SEQ ID NO: 425382 - protein, 5 aa, Mycobacterium
AIPDG

SEQ ID NO: 425383 - protein, 12 aa, Mycobacterium
AIPDGAQSARQA

SEQ ID NO: 425384 - protein, 6 aa, Mycobacterium
AIPDGS

SEQ ID NO: 425385 - protein, 24 aa, Mycobacterium
AIPDRPLDSAGPANVQETSADPVL

SEQ ID NO: 425386 - protein, 6 aa, Mycobacterium
AIPDSK

SEQ ID NO: 425387 - protein, 7 aa, Mycobacterium
AIPEGDE

SEQ ID NO: 425388 - protein, 14 aa, Mycobacterium
AIPEPNARGERVSG

SEQ ID NO: 425389 - protein, 5 aa, Mycobacterium
AIPES

SEQ ID NO: 425390 - protein, 4 aa, Mycobacterium
AIPG

SEQ ID NO: 425391 - protein, 6 aa, Mycobacterium
AIPGDG

SEQ ID NO: 425392 - protein, 5 aa, Mycobacterium
AIPGE

SEQ ID NO: 425393 - protein, 8 aa, Mycobacterium
AIPGEGST

SEQ ID NO: 425394 - protein, 8 aa, Mycobacterium
AIPGELDD

SEQ ID NO: 425395 - protein, 6 aa, Mycobacterium
AIPGGG

SEQ ID NO: 425396 - protein, 6 aa, Mycobacterium
AIPGGL

SEQ ID NO: 425397 - protein, 11 aa, Mycobacterium
AIPGGNVKRGD

SEQ ID NO: 425398 - protein, 8 aa, Mycobacterium
AIPGPRSQ

SEQ ID NO: 425399 - protein, 8 aa, Mycobacterium
AIPGPRSV

SEQ ID NO: 425400 - protein, 17 aa, Mycobacterium
AIPGQDRPVGTEPDNGA

SEQ ID NO: 425401 - protein, 7 aa, Mycobacterium
AIPGQQS

SEQ ID NO: 425402 - protein, 6 aa, Mycobacterium
AIPGSD

SEQ ID NO: 425403 - protein, 9 aa, Mycobacterium
AIPKTNPEL

SEQ ID NO: 425404 - protein, 19 aa, Mycobacterium
AIPKTPSGKLRRGYALPLV

SEQ ID NO: 425405 - protein, 11 aa, Mycobacterium
AIPKTSSGKIQ

SEQ ID NO: 425406 - protein, 10 aa, Mycobacterium
AIPNKGDHVE

SEQ ID NO: 425407 - protein, 16 aa, Mycobacterium
AIPNPDLIHPGQVLTI

SEQ ID NO: 425408 - protein, 7 aa, Mycobacterium
AIPNPGI

SEQ ID NO: 425409 - protein, 11 aa, Mycobacterium
AIPPADGQDGR

SEQ ID NO: 425410 - protein, 6 aa, Mycobacterium
AIPPEL

SEQ ID NO: 425411 - protein, 6 aa, Mycobacterium
AIPPER

SEQ ID NO: 425412 - protein, 13 aa, Mycobacterium
AIPPGARRMRPGP

SEQ ID NO: 425413 - protein, 12 aa, Mycobacterium
AIPPHASYEPKW

SEQ ID NO: 425414 - protein, 13 aa, Mycobacterium
AIPPPRKTPQRVA

SEQ ID NO: 425415 - protein, 5 aa, Mycobacterium
AIPPQ

SEQ ID NO: 425416 - protein, 5 aa, Mycobacterium
AIPPT

SEQ ID NO: 425417 - protein, 29 aa, Mycobacterium
AIPPTSETRELGPVPEPAVAPPDPGPTVR

SEQ ID NO: 425418 - protein, 5 aa, Mycobacterium
AIPQG

SEQ ID NO: 425419 - protein, 18 aa, Mycobacterium
AIPQGRSSYYKNTIGGGC

SEQ ID NO: 425420 - protein, 10 aa, Mycobacterium
AIPQTNDSVS

SEQ ID NO: 425421 - protein, 4 aa, Mycobacterium
AIPR

SEQ ID NO: 425422 - protein, 9 aa, Mycobacterium
AIPRDASRM

SEQ ID NO: 425423 - protein, 7 aa, Mycobacterium
AIPRNAQ

SEQ ID NO: 425424 - protein, 13 aa, Mycobacterium
AIPRTSSGKIGRR

SEQ ID NO: 425425 - protein, 12 aa, Mycobacterium
AIPRTTSGKIAR

SEQ ID NO: 425426 - protein, 4 aa, Mycobacterium
AIPS

SEQ ID NO: 425427 - protein, 9 aa, Mycobacterium
AIPSDRSGA

SEQ ID NO: 425428 - protein, 11 aa, Mycobacterium
AIPSGVAREAD

SEQ ID NO: 425429 - protein, 6 aa, Mycobacterium
AIPSTV

SEQ ID NO: 425430 - protein, 12 aa, Mycobacterium
AIPTPDARGERV

SEQ ID NO: 425431 - protein, 5 aa, Mycobacterium
AIPTQ

SEQ ID NO: 425432 - protein, 10 aa, Mycobacterium
AIPVPDDVPP

SEQ ID NO: 425433 - protein, 6 aa, Mycobacterium
AIPVQD

SEQ ID NO: 425434 - protein, 13 aa, Mycobacterium
AIQADSADPDQVA

SEQ ID NO: 425435 - protein, 12 aa, Mycobacterium
AIQDTAASDEKT

SEQ ID NO: 425436 - protein, 13 aa, Mycobacterium
AIQEAREACGGAG

SEQ ID NO: 425437 - protein, 5 aa, Mycobacterium
AIQEG

SEQ ID NO: 425438 - protein, 13 aa, Mycobacterium
AIQESREACGGAG

SEQ ID NO: 425439 - protein, 13 aa, Mycobacterium
AIQKDDAERPDPV

SEQ ID NO: 425440 - protein, 8 aa, Mycobacterium
AIQPGQVA

SEQ ID NO: 425441 - protein, 7 aa, Mycobacterium
AIQPPAV

SEQ ID NO: 425442 - protein, 6 aa, Mycobacterium
AIQPVT

SEQ ID NO: 425443 - protein, 5 aa, Mycobacterium
AIQQQ

SEQ ID NO: 425444 - protein, 10 aa, Mycobacterium
AIQSPPGDIA

SEQ ID NO: 425445 - protein, 5 aa, Mycobacterium
AIRDA

SEQ ID NO: 425446 - protein, 16 aa, Mycobacterium
AIRDGAAQRPAPAAFS

SEQ ID NO: 425447 - protein, 6 aa, Mycobacterium
AIRDGD

SEQ ID NO: 425448 - protein, 8 aa, Mycobacterium
AIRDSDGR

SEQ ID NO: 425449 - protein, 6 aa, Mycobacterium
AIRDTQ

SEQ ID NO: 425450 - protein, 10 aa, Mycobacterium
AIREATEQRH

SEQ ID NO: 425451 - protein, 7 aa, Mycobacterium
AIRETDP

SEQ ID NO: 425452 - protein, 7 aa, Mycobacterium
AIRGEAP

SEQ ID NO: 425453 - protein, 4 aa, Mycobacterium
AIRP

SEQ ID NO: 425454 - protein, 14 aa, Mycobacterium
AIRPAGEAFATPDA

SEQ ID NO: 425455 - protein, 6 aa, Mycobacterium
AIRPGA

SEQ ID NO: 425456 - protein, 7 aa, Mycobacterium
AIRPPSD

SEQ ID NO: 425457 - protein, 6 aa, Mycobacterium
AIRPQD

SEQ ID NO: 425458 - protein, 17 aa, Mycobacterium
AIRPQTTTVGGGTPMGG

SEQ ID NO: 425459 - protein, 11 aa, Mycobacterium
AIRPSGDDREQ

SEQ ID NO: 425460 - protein, 6 aa, Mycobacterium
AIRPSY

SEQ ID NO: 425461 - protein, 6 aa, Mycobacterium
AIRQAS

SEQ ID NO: 425462 - protein, 11 aa, Mycobacterium
AIRQGDPLDTE

SEQ ID NO: 425463 - protein, 8 aa, Mycobacterium
AIRSQQSA

SEQ ID NO: 425464 - protein, 9 aa, Mycobacterium
AIRSQQSGY

SEQ ID NO: 425465 - protein, 33 aa, Mycobacterium
AISAAAAGPAVAAETTGADKPGAAADTAVAAGT

SEQ ID NO: 425466 - protein, 26 aa, Mycobacterium
AISAAAKASPLQATYGQTVDRDSAYE

SEQ ID NO: 425467 - protein, 15 aa, Mycobacterium
AISAAGAAAAGSTTN

SEQ ID NO: 425468 - protein, 7 aa, Mycobacterium
AISAATG

SEQ ID NO: 425469 - protein, 10 aa, Mycobacterium
AISAATGHAP

SEQ ID NO: 425470 - protein, 6 aa, Mycobacterium
AISAEQ

SEQ ID NO: 425471 - protein, 5 aa, Mycobacterium
AISAG

SEQ ID NO: 425472 - protein, 6 aa, Mycobacterium
AISAGD

SEQ ID NO: 425473 - protein, 9 aa, Mycobacterium
AISAGDQSI

SEQ ID NO: 425474 - protein, 14 aa, Mycobacterium
AISAGSALSTKASV

SEQ ID NO: 425475 - protein, 6 aa, Mycobacterium
AISASY

SEQ ID NO: 425476 - protein, 13 aa, Mycobacterium
AISDAKAALAGTD

SEQ ID NO: 425477 - protein, 13 aa, Mycobacterium
AISEANSAAVAQT

SEQ ID NO: 425478 - protein, 7 aa, Mycobacterium
AISEGNN

SEQ ID NO: 425479 - protein, 9 aa, Mycobacterium
AISEVPQDR

SEQ ID NO: 425480 - protein, 7 aa, Mycobacterium
AISGNSG

SEQ ID NO: 425481 - protein, 10 aa, Mycobacterium
AISGSAQAQR

SEQ ID NO: 425482 - protein, 7 aa, Mycobacterium
AISGSGP

SEQ ID NO: 425483 - protein, 5 aa, Mycobacterium
AISGT

SEQ ID NO: 425484 - protein, 8 aa, Mycobacterium
AISKPGRT

SEQ ID NO: 425485 - protein, 7 aa, Mycobacterium
AISNSHG

SEQ ID NO: 425486 - protein, 7 aa, Mycobacterium
AISPERA

SEQ ID NO: 425487 - protein, 10 aa, Mycobacterium
AISPGGRTRM

SEQ ID NO: 425488 - protein, 22 aa, Mycobacterium
AISPTTVDGEVAKRQQSHAGVT

SEQ ID NO: 425489 - protein, 21 aa, Mycobacterium
AISPYGSGALAGSSLGLDPGA

SEQ ID NO: 425490 - protein, 6 aa, Mycobacterium
AISRAA

SEQ ID NO: 425491 - protein, 9 aa, Mycobacterium
AISRPEDFS

SEQ ID NO: 425492 - protein, 10 aa, Mycobacterium
AISSGRSGTI

SEQ ID NO: 425493 - protein, 14 aa, Mycobacterium
AISSKTLSSPATLG

SEQ ID NO: 425494 - protein, 15 aa, Mycobacterium
AISTAGTAAAGPTSS

SEQ ID NO: 425495 - protein, 6 aa, Mycobacterium
AISTDE

SEQ ID NO: 425496 - protein, 15 aa, Mycobacterium
AISTNQRGAKSGGIV

SEQ ID NO: 425497 - protein, 8 aa, Mycobacterium
AISTPGRA

SEQ ID NO: 425498 - protein, 5 aa, Mycobacterium
AISTT

SEQ ID NO: 425499 - protein, 6 aa, Mycobacterium
AISYAS

SEQ ID NO: 425500 - protein, 4 aa, Mycobacterium
AITA

SEQ ID NO: 425501 - protein, 11 aa, Mycobacterium
AITAATARTAL

SEQ ID NO: 425502 - protein, 8 aa, Mycobacterium
AITADSAN

SEQ ID NO: 425503 - protein, 21 aa, Mycobacterium
AITAGDPVQVGAGGTAVTATT

SEQ ID NO: 425504 - protein, 8 aa, Mycobacterium
AITAPDAP

SEQ ID NO: 425505 - protein, 7 aa, Mycobacterium
AITAPPL

SEQ ID NO: 425506 - protein, 4 aa, Mycobacterium
AITD

SEQ ID NO: 425507 - protein, 8 aa, Mycobacterium
AITDPGAL

SEQ ID NO: 425508 - protein, 12 aa, Mycobacterium
AITDTYRQRTAE

SEQ ID NO: 425509 - protein, 20 aa, Mycobacterium
AITETTATRYQQASKRAKSR

SEQ ID NO: 425510 - protein, 6 aa, Mycobacterium
AITGEN

SEQ ID NO: 425511 - protein, 7 aa, Mycobacterium
AITGEQL

SEQ ID NO: 425512 - protein, 7 aa, Mycobacterium
AITGGPG

SEQ ID NO: 425513 - protein, 5 aa, Mycobacterium
AITGQ

SEQ ID NO: 425514 - protein, 12 aa, Mycobacterium
AITGRTAGPAVA

SEQ ID NO: 425515 - protein, 9 aa, Mycobacterium
AITKANPKL

SEQ ID NO: 425516 - protein, 5 aa, Mycobacterium
AITNP

SEQ ID NO: 425517 - protein, 10 aa, Mycobacterium
AITPATKAFS

SEQ ID NO: 425518 - protein, 12 aa, Mycobacterium
AITPGASLATDV

SEQ ID NO: 425519 - protein, 13 aa, Mycobacterium
AITPGLESPTIAP

SEQ ID NO: 425520 - protein, 7 aa, Mycobacterium
AITPKRQ

SEQ ID NO: 425521 - protein, 8 aa, Mycobacterium
AITPQPHR

SEQ ID NO: 425522 - protein, 15 aa, Mycobacterium
AITPRAAVRSPKTAE

SEQ ID NO: 425523 - protein, 6 aa, Mycobacterium
AITPRT

SEQ ID NO: 425524 - protein, 14 aa, Mycobacterium
AITPSRAPAVTTRS

SEQ ID NO: 425525 - protein, 5 aa, Mycobacterium
AITRP

SEQ ID NO: 425526 - protein, 4 aa, Mycobacterium
AITT

SEQ ID NO: 425527 - protein, 9 aa, Mycobacterium
AITTQGERA

SEQ ID NO: 425528 - protein, 4 aa, Mycobacterium
AIVE

SEQ ID NO: 425529 - protein, 16 aa, Mycobacterium
AIVSKEAGDFASHGVP

SEQ ID NO: 425530 - protein, 4 aa, Mycobacterium
AIYG

SEQ ID NO: 425531 - protein, 6 aa, Mycobacterium
AIYPPG

SEQ ID NO: 425532 - protein, 12 aa, Mycobacterium
AIYRGSDSGYAT

SEQ ID NO: 425533 - protein, 5 aa, Mycobacterium
AKAAA

SEQ ID NO: 425534 - protein, 8 aa, Mycobacterium
AKAAAAAG

SEQ ID NO: 425535 - protein, 9 aa, Mycobacterium
AKAAAAEAL

SEQ ID NO: 425536 - protein, 17 aa, Mycobacterium
AKAAAAPATPAAAPTLS

SEQ ID NO: 425537 - protein, 24 aa, Mycobacterium
AKAAAARRARAELKEKLKKGGTNL

SEQ ID NO: 425538 - protein, 12 aa, Mycobacterium
AKAAAASGTGDF

SEQ ID NO: 425539 - protein, 8 aa, Mycobacterium
AKAAADAH

SEQ ID NO: 425540 - protein, 9 aa, Mycobacterium
AKAAADEHL

SEQ ID NO: 425541 - protein, 9 aa, Mycobacterium
AKAAADTGI

SEQ ID NO: 425542 - protein, 19 aa, Mycobacterium
AKAAAGAARRSDRRPGQTI

SEQ ID NO: 425543 - protein, 9 aa, Mycobacterium
AKAAARELS

SEQ ID NO: 425544 - protein, 8 aa, Mycobacterium
AKAAASDA

SEQ ID NO: 425545 - protein, 8 aa, Mycobacterium
AKAAATAA

SEQ ID NO: 425546 - protein, 7 aa, Mycobacterium
AKAAATP

SEQ ID NO: 425547 - protein, 7 aa, Mycobacterium
AKAAAVA

SEQ ID NO: 425548 - protein, 10 aa, Mycobacterium
AKAADAPDEV

SEQ ID NO: 425549 - protein, 8 aa, Mycobacterium
AKAADAVS

SEQ ID NO: 425550 - protein, 8 aa, Mycobacterium
AKAAEAAK

SEQ ID NO: 425551 - protein, 9 aa, Mycobacterium
AKAAEDGGF

SEQ ID NO: 425552 - protein, 16 aa, Mycobacterium
AKAAEKEIADGKYRGP

SEQ ID NO: 425553 - protein, 10 aa, Mycobacterium
AKAAEVKERY

SEQ ID NO: 425554 - protein, 8 aa, Mycobacterium
AKAAGAAG

SEQ ID NO: 425555 - protein, 9 aa, Mycobacterium
AKAAGAAGV

SEQ ID NO: 425556 - protein, 8 aa, Mycobacterium
AKAAGASI

SEQ ID NO: 425557 - protein, 11 aa, Mycobacterium
AKAAGDAVRNG

SEQ ID NO: 425558 - protein, 8 aa, Mycobacterium
AKAAGGQA

SEQ ID NO: 425559 - protein, 9 aa, Mycobacterium
AKAAGGSIN

SEQ ID NO: 425560 - protein, 7 aa, Mycobacterium
AKAAGID

SEQ ID NO: 425561 - protein, 10 aa, Mycobacterium
AKAAGPQSWP

SEQ ID NO: 425562 - protein, 8 aa, Mycobacterium
AKAAGRPA

SEQ ID NO: 425563 - protein, 10 aa, Mycobacterium
AKAAKSRAAR

SEQ ID NO: 425564 - protein, 13 aa, Mycobacterium
AKAALAGPPVTLS

SEQ ID NO: 425565 - protein, 10 aa, Mycobacterium
AKAAPGANPY

SEQ ID NO: 425566 - protein, 9 aa, Mycobacterium
AKAAPLSRQ

SEQ ID NO: 425567 - protein, 8 aa, Mycobacterium
AKAAQTAL

SEQ ID NO: 425568 - protein, 13 aa, Mycobacterium
AKAARGEEDVPAQ

SEQ ID NO: 425569 - protein, 18 aa, Mycobacterium
AKAARKAAVRHQSWMANR

SEQ ID NO: 425570 - protein, 5 aa, Mycobacterium
AKAAT

SEQ ID NO: 425571 - protein, 6 aa, Mycobacterium
AKAATR

SEQ ID NO: 425572 - protein, 15 aa, Mycobacterium
AKAATSSASAAAHAE

SEQ ID NO: 425573 - protein, 5 aa, Mycobacterium
AKAAV

SEQ ID NO: 425574 - protein, 10 aa, Mycobacterium
AKADAEAMRT

SEQ ID NO: 425575 - protein, 16 aa, Mycobacterium
AKADALPSVDTPLGRR

SEQ ID NO: 425576 - protein, 6 aa, Mycobacterium
AKADCP

SEQ ID NO: 425577 - protein, 9 aa, Mycobacterium
AKADLPSGA

SEQ ID NO: 425578 - protein, 14 aa, Mycobacterium
AKADMANTASSMAT

SEQ ID NO: 425579 - protein, 15 aa, Mycobacterium
AKADNGTDNPHHNQK

SEQ ID NO: 425580 - protein, 14 aa, Mycobacterium
AKADPSAGKKTLKA

SEQ ID NO: 425581 - protein, 7 aa, Mycobacterium
AKADRAP

SEQ ID NO: 425582 - protein, 15 aa, Mycobacterium
AKAEARRRGVQKGEL

SEQ ID NO: 425583 - protein, 6 aa, Mycobacterium
AKAEDL

SEQ ID NO: 425584 - protein, 8 aa, Mycobacterium
AKAEEGRT

SEQ ID NO: 425585 - protein, 9 aa, Mycobacterium
AKAEGSGNF

SEQ ID NO: 425586 - protein, 8 aa, Mycobacterium
AKAERERT

SEQ ID NO: 425587 - protein, 10 aa, Mycobacterium
AKAESAGDDI

SEQ ID NO: 425588 - protein, 12 aa, Mycobacterium
AKAEVELPSPYA

SEQ ID NO: 425589 - protein, 7 aa, Mycobacterium
AKAFGES

SEQ ID NO: 425590 - protein, 14 aa, Mycobacterium
AKAGADGAPETKGP

SEQ ID NO: 425591 - protein, 10 aa, Mycobacterium
AKAGAPARPS

SEQ ID NO: 425592 - protein, 9 aa, Mycobacterium
AKAGASGDL

SEQ ID NO: 425593 - protein, 5 aa, Mycobacterium
AKAGD

SEQ ID NO: 425594 - protein, 9 aa, Mycobacterium
AKAGDGQRL

SEQ ID NO: 425595 - protein, 14 aa, Mycobacterium
AKAGEDGAPETKGP

SEQ ID NO: 425596 - protein, 14 aa, Mycobacterium
AKAGEVVKPVLVTR

SEQ ID NO: 425597 - protein, 9 aa, Mycobacterium
AKAGFAERE

SEQ ID NO: 425598 - protein, 8 aa, Mycobacterium
AKAGGADA

SEQ ID NO: 425599 - protein, 8 aa, Mycobacterium
AKAGGLPE

SEQ ID NO: 425600 - protein, 7 aa, Mycobacterium
AKAGGLV

SEQ ID NO: 425601 - protein, 5 aa, Mycobacterium
AKAGI

SEQ ID NO: 425602 - protein, 8 aa, Mycobacterium
AKAGLDGF

SEQ ID NO: 425603 - protein, 6 aa, Mycobacterium
AKAGLN

SEQ ID NO: 425604 - protein, 9 aa, Mycobacterium
AKAGLNNLT

SEQ ID NO: 425605 - protein, 5 aa, Mycobacterium
AKAGN

SEQ ID NO: 425606 - protein, 8 aa, Mycobacterium
AKAGNPHR

SEQ ID NO: 425607 - protein, 7 aa, Mycobacterium
AKAGNRV

SEQ ID NO: 425608 - protein, 14 aa, Mycobacterium
AKAGPDGGLPDTKG

SEQ ID NO: 425609 - protein, 9 aa, Mycobacterium
AKAGPPAEA

SEQ ID NO: 425610 - protein, 7 aa, Mycobacterium
AKAGRDV

SEQ ID NO: 425611 - protein, 11 aa, Mycobacterium
AKAGRLGRDGR

SEQ ID NO: 425612 - protein, 8 aa, Mycobacterium
AKAGSDLV

SEQ ID NO: 425613 - protein, 16 aa, Mycobacterium
AKAGTASDTGTRPTEI

SEQ ID NO: 425614 - protein, 7 aa, Mycobacterium
AKAGTNI

SEQ ID NO: 425615 - protein, 8 aa, Mycobacterium
AKAGVGKQ

SEQ ID NO: 425616 - protein, 5 aa, Mycobacterium
AKAHG

SEQ ID NO: 425617 - protein, 19 aa, Mycobacterium
AKAHTDNPGTGGAANASSA

SEQ ID NO: 425618 - protein, 10 aa, Mycobacterium
AKAIEDASKN

SEQ ID NO: 425619 - protein, 7 aa, Mycobacterium
AKAITQS

SEQ ID NO: 425620 - protein, 11 aa, Mycobacterium
AKAKAGRVGSD

SEQ ID NO: 425621 - protein, 6 aa, Mycobacterium
AKAKAL

SEQ ID NO: 425622 - protein, 5 aa, Mycobacterium
AKAKN

SEQ ID NO: 425623 - protein, 5 aa, Mycobacterium
AKAKQ

SEQ ID NO: 425624 - protein, 11 aa, Mycobacterium
AKAKRGNPQAR

SEQ ID NO: 425625 - protein, 7 aa, Mycobacterium
AKAKSPM

SEQ ID NO: 425626 - protein, 4 aa, Mycobacterium
AKAL

SEQ ID NO: 425627 - protein, 8 aa, Mycobacterium
AKALAPAP

SEQ ID NO: 425628 - protein, 8 aa, Mycobacterium
AKALATAE

SEQ ID NO: 425629 - protein, 7 aa, Mycobacterium
AKALEAS

SEQ ID NO: 425630 - protein, 11 aa, Mycobacterium
AKALEGPYGFT

SEQ ID NO: 425631 - protein, 7 aa, Mycobacterium
AKALGLK

SEQ ID NO: 425632 - protein, 11 aa, Mycobacterium
AKALSDTVTPA

SEQ ID NO: 425633 - protein, 11 aa, Mycobacterium
AKALSDTVTPS

SEQ ID NO: 425634 - protein, 12 aa, Mycobacterium
AKALSSPSSLSP

SEQ ID NO: 425635 - protein, 8 aa, Mycobacterium
AKANDIET

SEQ ID NO: 425636 - protein, 6 aa, Mycobacterium
AKANGA

SEQ ID NO: 425637 - protein, 7 aa, Mycobacterium
AKANGAN

SEQ ID NO: 425638 - protein, 6 aa, Mycobacterium
AKANLA

SEQ ID NO: 425639 - protein, 15 aa, Mycobacterium
AKANPETGKKTLKAK

SEQ ID NO: 425640 - protein, 5 aa, Mycobacterium
AKANR

SEQ ID NO: 425641 - protein, 11 aa, Mycobacterium
AKANRSPKTPV

SEQ ID NO: 425642 - protein, 10 aa, Mycobacterium
AKANSKLDQL

SEQ ID NO: 425643 - protein, 9 aa, Mycobacterium
AKAPATRVT

SEQ ID NO: 425644 - protein, 7 aa, Mycobacterium
AKAPDGS

SEQ ID NO: 425645 - protein, 7 aa, Mycobacterium
AKAPEGS

SEQ ID NO: 425646 - protein, 8 aa, Mycobacterium
AKAPEGSR

SEQ ID NO: 425647 - protein, 7 aa, Mycobacterium
AKAPGAF

SEQ ID NO: 425648 - protein, 8 aa, Mycobacterium
AKAPGTPV

SEQ ID NO: 425649 - protein, 9 aa, Mycobacterium
AKAPGWPTS

SEQ ID NO: 425650 - protein, 10 aa, Mycobacterium
AKAPKPSTIR

SEQ ID NO: 425651 - protein, 9 aa, Mycobacterium
AKAPKPSVI

SEQ ID NO: 425652 - protein, 7 aa, Mycobacterium
AKAPLHQ

SEQ ID NO: 425653 - protein, 8 aa, Mycobacterium
AKAPPRIG

SEQ ID NO: 425654 - protein, 5 aa, Mycobacterium
AKAPR

SEQ ID NO: 425655 - protein, 14 aa, Mycobacterium
AKAPRARMTGSERR

SEQ ID NO: 425656 - protein, 7 aa, Mycobacterium
AKAPRGE

SEQ ID NO: 425657 - protein, 6 aa, Mycobacterium
AKAPRL

SEQ ID NO: 425658 - protein, 30 aa, Mycobacterium
AKAPSGGVLAPPEHRNGRRRGHLRVLPDPP

SEQ ID NO: 425659 - protein, 9 aa, Mycobacterium
AKAPTPTEG

SEQ ID NO: 425660 - protein, 5 aa, Mycobacterium
AKAPW

SEQ ID NO: 425661 - protein, 7 aa, Mycobacterium
AKAQAEL

SEQ ID NO: 425662 - protein, 37 aa, Mycobacterium
AKAQGKHSNIGYDAPEDLEATKSKIRLGTGADPRVST

SEQ ID NO: 425663 - protein, 24 aa, Mycobacterium
AKAQGKHSNIGYDAPKDMEATKSK

SEQ ID NO: 425664 - protein, 5 aa, Mycobacterium
AKAQR

SEQ ID NO: 425665 - protein, 13 aa, Mycobacterium
AKAQRYGKAGRRR

SEQ ID NO: 425666 - protein, 4 aa, Mycobacterium
AKAR

SEQ ID NO: 425667 - protein, 10 aa, Mycobacterium
AKARAGAHPD

SEQ ID NO: 425668 - protein, 8 aa, Mycobacterium
AKARALAE

SEQ ID NO: 425669 - protein, 9 aa, Mycobacterium
AKARALSEP

SEQ ID NO: 425670 - protein, 8 aa, Mycobacterium
AKARDAFA

SEQ ID NO: 425671 - protein, 9 aa, Mycobacterium
AKARDAFAA

SEQ ID NO: 425672 - protein, 7 aa, Mycobacterium
AKARDGR

SEQ ID NO: 425673 - protein, 24 aa, Mycobacterium
AKAREDLESRAAKSNEIDDEDDPN

SEQ ID NO: 425674 - protein, 23 aa, Mycobacterium
AKARENAAVADEDETVEDEAADH

SEQ ID NO: 425675 - protein, 11 aa, Mycobacterium
AKARERGYQPV

SEQ ID NO: 425676 - protein, 23 aa, Mycobacterium
AKARERSASGEDDDPEAPEAEGS

SEQ ID NO: 425677 - protein, 6 aa, Mycobacterium
AKARGS

SEQ ID NO: 425678 - protein, 5 aa, Mycobacterium
AKARL

SEQ ID NO: 425679 - protein, 13 aa, Mycobacterium
AKARPSWEHSESA

SEQ ID NO: 425680 - protein, 12 aa, Mycobacterium
AKARQQDPGWQQ

SEQ ID NO: 425681 - protein, 7 aa, Mycobacterium
AKARQWR

SEQ ID NO: 425682 - protein, 6 aa, Mycobacterium
AKARSS

SEQ ID NO: 425683 - protein, 8 aa, Mycobacterium
AKASAGEC

SEQ ID NO: 425684 - protein, 7 aa, Mycobacterium
AKASANY

SEQ ID NO: 425685 - protein, 6 aa, Mycobacterium
AKASAT

SEQ ID NO: 425686 - protein, 8 aa, Mycobacterium
AKASDAMR

SEQ ID NO: 425687 - protein, 5 aa, Mycobacterium
AKASE

SEQ ID NO: 425688 - protein, 10 aa, Mycobacterium
AKASESDTEV

SEQ ID NO: 425689 - protein, 10 aa, Mycobacterium
AKASESPNHR

SEQ ID NO: 425690 - protein, 18 aa, Mycobacterium
AKASFEDGSWSRATPQER

SEQ ID NO: 425691 - protein, 5 aa, Mycobacterium
AKASG

SEQ ID NO: 425692 - protein, 10 aa, Mycobacterium
AKASGAPAGT

SEQ ID NO: 425693 - protein, 6 aa, Mycobacterium
AKASGD

SEQ ID NO: 425694 - protein, 15 aa, Mycobacterium
AKASPAGACEKVSGL

SEQ ID NO: 425695 - protein, 7 aa, Mycobacterium
AKASPYV

SEQ ID NO: 425696 - protein, 8 aa, Mycobacterium
AKASSAEV

SEQ ID NO: 425697 - protein, 12 aa, Mycobacterium
AKASSILSRGAP

SEQ ID NO: 425698 - protein, 10 aa, Mycobacterium
AKASTKDDAV

SEQ ID NO: 425699 - protein, 5 aa, Mycobacterium
AKASV

SEQ ID NO: 425700 - protein, 12 aa, Mycobacterium
AKATDGPGGPDG

SEQ ID NO: 425701 - protein, 8 aa, Mycobacterium
AKATDTSI

SEQ ID NO: 425702 - protein, 6 aa, Mycobacterium
AKATDV

SEQ ID NO: 425703 - protein, 5 aa, Mycobacterium
AKATE

SEQ ID NO: 425704 - protein, 6 aa, Mycobacterium
AKATET

SEQ ID NO: 425705 - protein, 14 aa, Mycobacterium
AKATGAPTAANEID

SEQ ID NO: 425706 - protein, 9 aa, Mycobacterium
AKATGRELT

SEQ ID NO: 425707 - protein, 7 aa, Mycobacterium
AKATGRL

SEQ ID NO: 425708 - protein, 7 aa, Mycobacterium
AKATGVG

SEQ ID NO: 425709 - protein, 6 aa, Mycobacterium
AKATRE

SEQ ID NO: 425710 - protein, 7 aa, Mycobacterium
AKATRET

SEQ ID NO: 425711 - protein, 12 aa, Mycobacterium
AKATRPEVRGGL

SEQ ID NO: 425712 - protein, 4 aa, Mycobacterium
AKAV

SEQ ID NO: 425713 - protein, 10 aa, Mycobacterium
AKAVADKAAR

SEQ ID NO: 425714 - protein, 11 aa, Mycobacterium
AKAVAEEATKR

SEQ ID NO: 425715 - protein, 14 aa, Mycobacterium
AKAVAEEATKRRVT

SEQ ID NO: 425716 - protein, 14 aa, Mycobacterium
AKAVAEEATKRTVT

SEQ ID NO: 425717 - protein, 13 aa, Mycobacterium
AKAVAEEATRRTV

SEQ ID NO: 425718 - protein, 13 aa, Mycobacterium
AKAVAEEATTRTV

SEQ ID NO: 425719 - protein, 10 aa, Mycobacterium
AKAVETAARD

SEQ ID NO: 425720 - protein, 8 aa, Mycobacterium
AKAVSERV

SEQ ID NO: 425721 - protein, 9 aa, Mycobacterium
AKAVTDKPS

SEQ ID NO: 425722 - protein, 8 aa, Mycobacterium
AKAYEEVD

SEQ ID NO: 425723 - protein, 7 aa, Mycobacterium
AKAYGPD

SEQ ID NO: 425724 - protein, 8 aa, Mycobacterium
AKAYTSSA

SEQ ID NO: 425725 - protein, 14 aa, Mycobacterium
AKCTDNPERGSEVP

SEQ ID NO: 425726 - protein, 8 aa, Mycobacterium
AKDAAESA

SEQ ID NO: 425727 - protein, 10 aa, Mycobacterium
AKDAAGSGVT

SEQ ID NO: 425728 - protein, 10 aa, Mycobacterium
AKDAAGTGVT

SEQ ID NO: 425729 - protein, 32 aa, Mycobacterium
AKDAELAERRAGEARERAAHAGLSAARSLEES

SEQ ID NO: 425730 - protein, 9 aa, Mycobacterium
AKDAELQSY

SEQ ID NO: 425731 - protein, 5 aa, Mycobacterium
AKDAG

SEQ ID NO: 425732 - protein, 9 aa, Mycobacterium
AKDAGKEYD

SEQ ID NO: 425733 - protein, 5 aa, Mycobacterium
AKDAP

SEQ ID NO: 425734 - protein, 8 aa, Mycobacterium
AKDAPPEH

SEQ ID NO: 425735 - protein, 13 aa, Mycobacterium
AKDAQKKGDFAGY

SEQ ID NO: 425736 - protein, 5 aa, Mycobacterium
AKDAR

SEQ ID NO: 425737 - protein, 7 aa, Mycobacterium
AKDATSR

SEQ ID NO: 425738 - protein, 10 aa, Mycobacterium
AKDDTREDAA

SEQ ID NO: 425739 - protein, 5 aa, Mycobacterium
AKDDV

SEQ ID NO: 425740 - protein, 22 aa, Mycobacterium
AKDGAGAGTIPDPFGGAGRAPT

SEQ ID NO: 425741 - protein, 21 aa, Mycobacterium
AKDGAGAGTIPDPFGGPGRAP

SEQ ID NO: 425742 - protein, 22 aa, Mycobacterium
AKDGAGAGTIPDPFGGPGRNPT

SEQ ID NO: 425743 - protein, 20 aa, Mycobacterium
AKDGAGAGTIPDPFGGPGRV

SEQ ID NO: 425744 - protein, 9 aa, Mycobacterium
AKDGAPVTV

SEQ ID NO: 425745 - protein, 20 aa, Mycobacterium
AKDGATFKPHKKSGAEATTI

SEQ ID NO: 425746 - protein, 9 aa, Mycobacterium
AKDGGTYYS

SEQ ID NO: 425747 - protein, 6 aa, Mycobacterium
AKDGKG

SEQ ID NO: 425748 - protein, 9 aa, Mycobacterium
AKDGPFGGT

SEQ ID NO: 425749 - protein, 11 aa, Mycobacterium
AKDGSAEQKSR

SEQ ID NO: 425750 - protein, 17 aa, Mycobacterium
AKDGVGTGISASDRATT

SEQ ID NO: 425751 - protein, 11 aa, Mycobacterium
AKDHDGEGEPL

SEQ ID NO: 425752 - protein, 17 aa, Mycobacterium
AKDIATNAVEKASDIVE

SEQ ID NO: 425753 - protein, 6 aa, Mycobacterium
AKDKAL

SEQ ID NO: 425754 - protein, 10 aa, Mycobacterium
AKDKDAGTRQ

SEQ ID NO: 425755 - protein, 21 aa, Mycobacterium
AKDKKLLKDKDPNLTGDDIRE

SEQ ID NO: 425756 - protein, 21 aa, Mycobacterium
AKDKKLLKEKDPNLTGDDIRE

SEQ ID NO: 425757 - protein, 12 aa, Mycobacterium
AKDKLTDGAADT

SEQ ID NO: 425758 - protein, 7 aa, Mycobacterium
AKDLGGD

SEQ ID NO: 425759 - protein, 37 aa, Mycobacterium
AKDPAAAQTLTQSYSETLAKSPAAQAASPVPGLPASR

SEQ ID NO: 425760 - protein, 6 aa, Mycobacterium
AKDPAI

SEQ ID NO: 425761 - protein, 7 aa, Mycobacterium
AKDPAVL

SEQ ID NO: 425762 - protein, 8 aa, Mycobacterium
AKDPDSVQ

SEQ ID NO: 425763 - protein, 9 aa, Mycobacterium
AKDPDSVQW

SEQ ID NO: 425764 - protein, 5 aa, Mycobacterium
AKDPL

SEQ ID NO: 425765 - protein, 6 aa, Mycobacterium
AKDPQR

SEQ ID NO: 425766 - protein, 15 aa, Mycobacterium
AKDQANGQEPDTPKH

SEQ ID NO: 425767 - protein, 5 aa, Mycobacterium
AKDQG

SEQ ID NO: 425768 - protein, 16 aa, Mycobacterium
AKDRAQAAGAQNIDER

SEQ ID NO: 425769 - protein, 14 aa, Mycobacterium
AKDSFEAQAARDGL

SEQ ID NO: 425770 - protein, 7 aa, Mycobacterium
AKDSHHQ

SEQ ID NO: 425771 - protein, 9 aa, Mycobacterium
AKDSRVSAE

SEQ ID NO: 425772 - protein, 11 aa, Mycobacterium
AKDTADPQTRR

SEQ ID NO: 425773 - protein, 6 aa, Mycobacterium
AKDTDD

SEQ ID NO: 425774 - protein, 9 aa, Mycobacterium
AKDTGEREE

SEQ ID NO: 425775 - protein, 10 aa, Mycobacterium
AKDTRTPGVD

SEQ ID NO: 425776 - protein, 7 aa, Mycobacterium
AKDVEPS

SEQ ID NO: 425777 - protein, 15 aa, Mycobacterium
AKDVGKRAERATAEG

SEQ ID NO: 425778 - protein, 8 aa, Mycobacterium
AKDVSPAE

SEQ ID NO: 425779 - protein, 5 aa, Mycobacterium
AKDWP

SEQ ID NO: 425780 - protein, 4 aa, Mycobacterium
AKDY

SEQ ID NO: 425781 - protein, 9 aa, Mycobacterium
AKEAAHPNN

SEQ ID NO: 425782 - protein, 10 aa, Mycobacterium
AKEAANDDSR

SEQ ID NO: 425783 - protein, 6 aa, Mycobacterium
AKEAAS

SEQ ID NO: 425784 - protein, 14 aa, Mycobacterium
AKEADERSAGITVG

SEQ ID NO: 425785 - protein, 9 aa, Mycobacterium
AKEADTSGF

SEQ ID NO: 425786 - protein, 8 aa, Mycobacterium
AKEAEDAG

SEQ ID NO: 425787 - protein, 13 aa, Mycobacterium
AKEAEKQARKNAR

SEQ ID NO: 425788 - protein, 14 aa, Mycobacterium
AKEAFGTQKRQRQM

SEQ ID NO: 425789 - protein, 5 aa, Mycobacterium
AKEAG

SEQ ID NO: 425790 - protein, 9 aa, Mycobacterium
AKEAGLQSY

SEQ ID NO: 425791 - protein, 7 aa, Mycobacterium
AKEAKEL

SEQ ID NO: 425792 - protein, 8 aa, Mycobacterium
AKEAKTGQ

SEQ ID NO: 425793 - protein, 7 aa, Mycobacterium
AKEALAD

SEQ ID NO: 425794 - protein, 11 aa, Mycobacterium
AKEALKERKTI

SEQ ID NO: 425795 - protein, 6 aa, Mycobacterium
AKEAPG

SEQ ID NO: 425796 - protein, 7 aa, Mycobacterium
AKEAPGW

SEQ ID NO: 425797 - protein, 8 aa, Mycobacterium
AKEAPGWT

SEQ ID NO: 425798 - protein, 16 aa, Mycobacterium
AKEATAAPPPPSRDHH

SEQ ID NO: 425799 - protein, 10 aa, Mycobacterium
AKEATTSPSV

SEQ ID NO: 425800 - protein, 7 aa, Mycobacterium
AKEDAGA

SEQ ID NO: 425801 - protein, 5 aa, Mycobacterium
AKEEA

SEQ ID NO: 425802 - protein, 8 aa, Mycobacterium
AKEGGTVE

SEQ ID NO: 425803 - protein, 9 aa, Mycobacterium
AKEGSTSQL

SEQ ID NO: 425804 - protein, 8 aa, Mycobacterium
AKEGTNIE

SEQ ID NO: 425805 - protein, 5 aa, Mycobacterium
AKEHA

SEQ ID NO: 425806 - protein, 7 aa, Mycobacterium
AKEHDPY

SEQ ID NO: 425807 - protein, 7 aa, Mycobacterium
AKEHGAA

SEQ ID NO: 425808 - protein, 6 aa, Mycobacterium
AKEHNA

SEQ ID NO: 425809 - protein, 9 aa, Mycobacterium
AKEHSESVI

SEQ ID NO: 425810 - protein, 10 aa, Mycobacterium
AKEIADQHGK

SEQ ID NO: 425811 - protein, 5 aa, Mycobacterium
AKEIQ

SEQ ID NO: 425812 - protein, 18 aa, Mycobacterium
AKEKITARLESEGRGQAR

SEQ ID NO: 425813 - protein, 4 aa, Mycobacterium
AKEL

SEQ ID NO: 425814 - protein, 5 aa, Mycobacterium
AKELG

SEQ ID NO: 425815 - protein, 6 aa, Mycobacterium
AKENAY

SEQ ID NO: 425816 - protein, 6 aa, Mycobacterium
AKENDD

SEQ ID NO: 425817 - protein, 8 aa, Mycobacterium
AKENPEEL

SEQ ID NO: 425818 - protein, 16 aa, Mycobacterium
AKENRLNTGGHGAQAC

SEQ ID NO: 425819 - protein, 11 aa, Mycobacterium
AKEPAPHGPGL

SEQ ID NO: 425820 - protein, 8 aa, Mycobacterium
AKEPEPSA

SEQ ID NO: 425821 - protein, 6 aa, Mycobacterium
AKEPEQ

SEQ ID NO: 425822 - protein, 7 aa, Mycobacterium
AKEPGFS

SEQ ID NO: 425823 - protein, 22 aa, Mycobacterium
AKEPGGEKAAAKRDKKGIPSAR

SEQ ID NO: 425824 - protein, 22 aa, Mycobacterium
AKEPGGEKAVAKREKKGIPSAR

SEQ ID NO: 425825 - protein, 23 aa, Mycobacterium
AKEPGGEKAVAKREKKGIPSARA

SEQ ID NO: 425826 - protein, 10 aa, Mycobacterium
AKEPGSGGRL

SEQ ID NO: 425827 - protein, 8 aa, Mycobacterium
AKEPPPSI

SEQ ID NO: 425828 - protein, 13 aa, Mycobacterium
AKEPSGVRVVVTP

SEQ ID NO: 425829 - protein, 9 aa, Mycobacterium
AKEQAEQFR

SEQ ID NO: 425830 - protein, 5 aa, Mycobacterium
AKEQL

SEQ ID NO: 425831 - protein, 8 aa, Mycobacterium
AKEQLRGL

SEQ ID NO: 425832 - protein, 9 aa, Mycobacterium
AKEQLRGLP

SEQ ID NO: 425833 - protein, 11 aa, Mycobacterium
AKEQLRSVPDG

SEQ ID NO: 425834 - protein, 4 aa, Mycobacterium
AKER

SEQ ID NO: 425835 - protein, 6 aa, Mycobacterium
AKERAE

SEQ ID NO: 425836 - protein, 9 aa, Mycobacterium
AKERAGEEV

SEQ ID NO: 425837 - protein, 17 aa, Mycobacterium
AKERAHKAGAKNVEERP

SEQ ID NO: 425838 - protein, 15 aa, Mycobacterium
AKERAKAAGAENIEE

SEQ ID NO: 425839 - protein, 6 aa, Mycobacterium
AKERGI

SEQ ID NO: 425840 - protein, 10 aa, Mycobacterium
AKERKAFGQQ

SEQ ID NO: 425841 - protein, 12 aa, Mycobacterium
AKERQSFGQPIG

SEQ ID NO: 425842 - protein, 8 aa, Mycobacterium
AKERRPFG

SEQ ID NO: 425843 - protein, 10 aa, Mycobacterium
AKERRRPDGS

SEQ ID NO: 425844 - protein, 23 aa, Mycobacterium
AKERTHDRHDCKNGQSWPQSLAR

SEQ ID NO: 425845 - protein, 17 aa, Mycobacterium
AKESAGVTDFGDDTLPE

SEQ ID NO: 425846 - protein, 9 aa, Mycobacterium
AKESEPRDK

SEQ ID NO: 425847 - protein, 7 aa, Mycobacterium
AKESGSP

SEQ ID NO: 425848 - protein, 13 aa, Mycobacterium
AKESGTNALTDAG

SEQ ID NO: 425849 - protein, 9 aa, Mycobacterium
AKESSPDTK

SEQ ID NO: 425850 - protein, 4 aa, Mycobacterium
AKET

SEQ ID NO: 425851 - protein, 9 aa, Mycobacterium
AKETGLQSY

SEQ ID NO: 425852 - protein, 7 aa, Mycobacterium
AKETITT

SEQ ID NO: 425853 - protein, 6 aa, Mycobacterium
AKETPL

SEQ ID NO: 425854 - protein, 12 aa, Mycobacterium
AKEVETKDQIAA

SEQ ID NO: 425855 - protein, 10 aa, Mycobacterium
AKEVETKEQI

SEQ ID NO: 425856 - protein, 16 aa, Mycobacterium
AKEVGRTLAEEAEAAG

SEQ ID NO: 425857 - protein, 9 aa, Mycobacterium
AKEVSATEL

SEQ ID NO: 425858 - protein, 10 aa, Mycobacterium
AKEVSSTEVT

SEQ ID NO: 425859 - protein, 13 aa, Mycobacterium
AKFAGEDGEIDEE

SEQ ID NO: 425860 - protein, 4 aa, Mycobacterium
AKFG

SEQ ID NO: 425861 - protein, 9 aa, Mycobacterium
AKFGASEGD

SEQ ID NO: 425862 - protein, 6 aa, Mycobacterium
AKFGDS

SEQ ID NO: 425863 - protein, 13 aa, Mycobacterium
AKFGGTTAYSGGG

SEQ ID NO: 425864 - protein, 6 aa, Mycobacterium
AKFGQP

SEQ ID NO: 425865 - protein, 13 aa, Mycobacterium
AKFSPAREALDNP

SEQ ID NO: 425866 - protein, 4 aa, Mycobacterium
AKFT

SEQ ID NO: 425867 - protein, 13 aa, Mycobacterium
AKGAAKAGRSPAD

SEQ ID NO: 425868 - protein, 17 aa, Mycobacterium
AKGAAREGFPPGTAWDD

SEQ ID NO: 425869 - protein, 14 aa, Mycobacterium
AKGAARTGRDPDDV

SEQ ID NO: 425870 - protein, 8 aa, Mycobacterium
AKGADVPE

SEQ ID NO: 425871 - protein, 11 aa, Mycobacterium
AKGAGEAGVGG

SEQ ID NO: 425872 - protein, 8 aa, Mycobacterium
AKGAGLSR

SEQ ID NO: 425873 - protein, 7 aa, Mycobacterium
AKGAHRS

SEQ ID NO: 425874 - protein, 15 aa, Mycobacterium
AKGAPAERIQHDPLG

SEQ ID NO: 425875 - protein, 15 aa, Mycobacterium
AKGAPPERIQHDPLS

SEQ ID NO: 425876 - protein, 16 aa, Mycobacterium
AKGAPPERIQHDPLTA

SEQ ID NO: 425877 - protein, 17 aa, Mycobacterium
AKGAPREGFPPGTPFSD

SEQ ID NO: 425878 - protein, 14 aa, Mycobacterium
AKGAPRERIQHDPL

SEQ ID NO: 425879 - protein, 14 aa, Mycobacterium
AKGAQRTGRDPNGV

SEQ ID NO: 425880 - protein, 20 aa, Mycobacterium
AKGARALTGGTRGAGSGSFY

SEQ ID NO: 425881 - protein, 5 aa, Mycobacterium
AKGAV

SEQ ID NO: 425882 - protein, 8 aa, Mycobacterium
AKGAVAAA

SEQ ID NO: 425883 - protein, 7 aa, Mycobacterium
AKGDELD

SEQ ID NO: 425884 - protein, 8 aa, Mycobacterium
AKGDPAAR

SEQ ID NO: 425885 - protein, 10 aa, Mycobacterium
AKGDSGGPVY

SEQ ID NO: 425886 - protein, 8 aa, Mycobacterium
AKGDTEIE

SEQ ID NO: 425887 - protein, 4 aa, Mycobacterium
AKGE

SEQ ID NO: 425888 - protein, 14 aa, Mycobacterium
AKGEANLGLDPGTW

SEQ ID NO: 425889 - protein, 8 aa, Mycobacterium
AKGEARIG

SEQ ID NO: 425890 - protein, 13 aa, Mycobacterium
AKGEATPEDGYAG

SEQ ID NO: 425891 - protein, 9 aa, Mycobacterium
AKGEDAASL

SEQ ID NO: 425892 - protein, 5 aa, Mycobacterium
AKGEE

SEQ ID NO: 425893 - protein, 14 aa, Mycobacterium
AKGEEGAEVAPGLA

SEQ ID NO: 425894 - protein, 6 aa, Mycobacterium
AKGEEI

SEQ ID NO: 425895 - protein, 13 aa, Mycobacterium
AKGEPAPEDGYAG

SEQ ID NO: 425896 - protein, 14 aa, Mycobacterium
AKGEPTPADGYAGS

SEQ ID NO: 425897 - protein, 14 aa, Mycobacterium
AKGEPTPDDGYAGT

SEQ ID NO: 425898 - protein, 12 aa, Mycobacterium
AKGEPTPEDGYA

SEQ ID NO: 425899 - protein, 13 aa, Mycobacterium
AKGEPTPEDGYAG

SEQ ID NO: 425900 - protein, 13 aa, Mycobacterium
AKGERHSNTAPQY

SEQ ID NO: 425901 - protein, 8 aa, Mycobacterium
AKGESTDR

SEQ ID NO: 425902 - protein, 9 aa, Mycobacterium
AKGEWGTPN

SEQ ID NO: 425903 - protein, 12 aa, Mycobacterium
AKGEYFENESPV

SEQ ID NO: 425904 - protein, 22 aa, Mycobacterium
AKGFRGAQTVENSGHSVQSDQP

SEQ ID NO: 425905 - protein, 13 aa, Mycobacterium
AKGGAPPIGSAVP

SEQ ID NO: 425906 - protein, 7 aa, Mycobacterium
AKGGFEA

SEQ ID NO: 425907 - protein, 8 aa, Mycobacterium
AKGGGNAW

SEQ ID NO: 425908 - protein, 14 aa, Mycobacterium
AKGGTSLGEAPAKA

SEQ ID NO: 425909 - protein, 21 aa, Mycobacterium
AKGGVQGNPTVERERETDPAH

SEQ ID NO: 425910 - protein, 11 aa, Mycobacterium
AKGGVTVHPND

SEQ ID NO: 425911 - protein, 7 aa, Mycobacterium
AKGHDDD

SEQ ID NO: 425912 - protein, 14 aa, Mycobacterium
AKGHDKDSRGGSSF

SEQ ID NO: 425913 - protein, 5 aa, Mycobacterium
AKGHE

SEQ ID NO: 425914 - protein, 5 aa, Mycobacterium
AKGHS

SEQ ID NO: 425915 - protein, 4 aa, Mycobacterium
AKGI

SEQ ID NO: 425916 - protein, 15 aa, Mycobacterium
AKGIEATLRRLQARY

SEQ ID NO: 425917 - protein, 15 aa, Mycobacterium
AKGITAHPKPLTTPH

SEQ ID NO: 425918 - protein, 14 aa, Mycobacterium
AKGKAALLREIADV

SEQ ID NO: 425919 - protein, 14 aa, Mycobacterium
AKGKAALLRELSDA

SEQ ID NO: 425920 - protein, 12 aa, Mycobacterium
AKGKLSETDKSG

SEQ ID NO: 425921 - protein, 5 aa, Mycobacterium
AKGLM

SEQ ID NO: 425922 - protein, 13 aa, Mycobacterium
AKGLQELREQKTR

SEQ ID NO: 425923 - protein, 7 aa, Mycobacterium
AKGLRGP

SEQ ID NO: 425924 - protein, 14 aa, Mycobacterium
AKGLRPRVSRRFRR

SEQ ID NO: 425925 - protein, 18 aa, Mycobacterium
AKGLSAAGTFSSTGAGEE

SEQ ID NO: 425926 - protein, 8 aa, Mycobacterium
AKGLSNKE

SEQ ID NO: 425927 - protein, 8 aa, Mycobacterium
AKGLSSQR

SEQ ID NO: 425928 - protein, 10 aa, Mycobacterium
AKGLTSGYSP

SEQ ID NO: 425929 - protein, 13 aa, Mycobacterium
AKGLTVKADPSMG

SEQ ID NO: 425930 - protein, 4 aa, Mycobacterium
AKGM

SEQ ID NO: 425931 - protein, 5 aa, Mycobacterium
AKGMR

SEQ ID NO: 425932 - protein, 16 aa, Mycobacterium
AKGNADGWPDTKNPLY

SEQ ID NO: 425933 - protein, 7 aa, Mycobacterium
AKGNGGV

SEQ ID NO: 425934 - protein, 11 aa, Mycobacterium
AKGNTASVDAA

SEQ ID NO: 425935 - protein, 4 aa, Mycobacterium
AKGP

SEQ ID NO: 425936 - protein, 10 aa, Mycobacterium
AKGPGCNPLG

SEQ ID NO: 425937 - protein, 11 aa, Mycobacterium
AKGPGVNPFGD

SEQ ID NO: 425938 - protein, 5 aa, Mycobacterium
AKGPI

SEQ ID NO: 425939 - protein, 7 aa, Mycobacterium
AKGPSAG

SEQ ID NO: 425940 - protein, 5 aa, Mycobacterium
AKGPV

SEQ ID NO: 425941 - protein, 6 aa, Mycobacterium
AKGPVR

SEQ ID NO: 425942 - protein, 6 aa, Mycobacterium
AKGPWQ

SEQ ID NO: 425943 - protein, 11 aa, Mycobacterium
AKGPYRNADES

SEQ ID NO: 425944 - protein, 6 aa, Mycobacterium
AKGQDP

SEQ ID NO: 425945 - protein, 8 aa, Mycobacterium
AKGQPGPV

SEQ ID NO: 425946 - protein, 10 aa, Mycobacterium
AKGRDADQVS

SEQ ID NO: 425947 - protein, 27 aa, Mycobacterium
AKGRGIAAASNSGTDNRTASVTLHRQV

SEQ ID NO: 425948 - protein, 16 aa, Mycobacterium
AKGRGYPPAEADESDR

SEQ ID NO: 425949 - protein, 9 aa, Mycobacterium
AKGRNPEQV

SEQ ID NO: 425950 - protein, 8 aa, Mycobacterium
AKGRPADA

SEQ ID NO: 425951 - protein, 9 aa, Mycobacterium
AKGRPYPDH

SEQ ID NO: 425952 - protein, 12 aa, Mycobacterium
AKGRQTRQAIEQ

SEQ ID NO: 425953 - protein, 8 aa, Mycobacterium
AKGRTADQ

SEQ ID NO: 425954 - protein, 8 aa, Mycobacterium
AKGRTLTS

SEQ ID NO: 425955 - protein, 4 aa, Mycobacterium
AKGS

SEQ ID NO: 425956 - protein, 14 aa, Mycobacterium
AKGSADSWPDTKNS

SEQ ID NO: 425957 - protein, 6 aa, Mycobacterium
AKGSEA

SEQ ID NO: 425958 - protein, 9 aa, Mycobacterium
AKGSFAERE

SEQ ID NO: 425959 - protein, 9 aa, Mycobacterium
AKGSGAGSV

SEQ ID NO: 425960 - protein, 11 aa, Mycobacterium
AKGSGDTSGYG

SEQ ID NO: 425961 - protein, 7 aa, Mycobacterium
AKGSGGI

SEQ ID NO: 425962 - protein, 12 aa, Mycobacterium
AKGSGQREGGTA

SEQ ID NO: 425963 - protein, 6 aa, Mycobacterium
AKGSIS

SEQ ID NO: 425964 - protein, 11 aa, Mycobacterium
AKGSNTIERNR

SEQ ID NO: 425965 - protein, 12 aa, Mycobacterium
AKGSRTANAGPV

SEQ ID NO: 425966 - protein, 9 aa, Mycobacterium
AKGSVPVDQ

SEQ ID NO: 425967 - protein, 13 aa, Mycobacterium
AKGSVSDAADPAA

SEQ ID NO: 425968 - protein, 11 aa, Mycobacterium
AKGTGDTSGYG

SEQ ID NO: 425969 - protein, 16 aa, Mycobacterium
AKGTPNGAAGGYGGNA

SEQ ID NO: 425970 - protein, 8 aa, Mycobacterium
AKGTRDAW

SEQ ID NO: 425971 - protein, 10 aa, Mycobacterium
AKGTSQQHGQ

SEQ ID NO: 425972 - protein, 5 aa, Mycobacterium
AKGTT

SEQ ID NO: 425973 - protein, 4 aa, Mycobacterium
AKGV

SEQ ID NO: 425974 - protein, 5 aa, Mycobacterium
AKGVA

SEQ ID NO: 425975 - protein, 7 aa, Mycobacterium
AKGVDQD

SEQ ID NO: 425976 - protein, 12 aa, Mycobacterium
AKGVMDTATRGL

SEQ ID NO: 425977 - protein, 5 aa, Mycobacterium
AKGVR

SEQ ID NO: 425978 - protein, 12 aa, Mycobacterium
AKGWDGFAVAVI

SEQ ID NO: 425979 - protein, 4 aa, Mycobacterium
AKGY

SEQ ID NO: 425980 - protein, 5 aa, Mycobacterium
AKGYD

SEQ ID NO: 425981 - protein, 13 aa, Mycobacterium
AKGYHDEPTGVYT

SEQ ID NO: 425982 - protein, 15 aa, Mycobacterium
AKGYRNPVDPDPFAE

SEQ ID NO: 425983 - protein, 14 aa, Mycobacterium
AKGYRNPVQPDPFA

SEQ ID NO: 425984 - protein, 4 aa, Mycobacterium
AKHA

SEQ ID NO: 425985 - protein, 8 aa, Mycobacterium
AKHAPAVT

SEQ ID NO: 425986 - protein, 8 aa, Mycobacterium
AKHATDGA

SEQ ID NO: 425987 - protein, 10 aa, Mycobacterium
AKHDKPTVAE

SEQ ID NO: 425988 - protein, 12 aa, Mycobacterium
AKHEDGSTPDIE

SEQ ID NO: 425989 - protein, 12 aa, Mycobacterium
AKHGAKPADSVE

SEQ ID NO: 425990 - protein, 9 aa, Mycobacterium
AKHGDEPLY

SEQ ID NO: 425991 - protein, 7 aa, Mycobacterium
AKHGDSI

SEQ ID NO: 425992 - protein, 5 aa, Mycobacterium
AKHGI

SEQ ID NO: 425993 - protein, 6 aa, Mycobacterium
AKHGNP

SEQ ID NO: 425994 - protein, 5 aa, Mycobacterium
AKHGP

SEQ ID NO: 425995 - protein, 7 aa, Mycobacterium
AKHGPLD

SEQ ID NO: 425996 - protein, 11 aa, Mycobacterium
AKHGSPSGRQY

SEQ ID NO: 425997 - protein, 5 aa, Mycobacterium
AKHGV

SEQ ID NO: 425998 - protein, 16 aa, Mycobacterium
AKHRGEIGGDVDATEA

SEQ ID NO: 425999 - protein, 8 aa, Mycobacterium
AKHRPGPE

SEQ ID NO: 426000 - protein, 16 aa, Mycobacterium
AKHSAATERPEPGGPV

SEQ ID NO: 426001 - protein, 5 aa, Mycobacterium
AKHSG

SEQ ID NO: 426002 - protein, 8 aa, Mycobacterium
AKHSGEDL

SEQ ID NO: 426003 - protein, 6 aa, Mycobacterium
AKHSSL

SEQ ID NO: 426004 - protein, 18 aa, Mycobacterium
AKHTGKTAAARPVPPPRV

SEQ ID NO: 426005 - protein, 22 aa, Mycobacterium
AKHTHAGTSALAEQRAKGEQPF

SEQ ID NO: 426006 - protein, 8 aa, Mycobacterium
AKIAARDN

SEQ ID NO: 426007 - protein, 5 aa, Mycobacterium
AKIAD

SEQ ID NO: 426008 - protein, 6 aa, Mycobacterium
AKIATD

SEQ ID NO: 426009 - protein, 5 aa, Mycobacterium
AKIDG

SEQ ID NO: 426010 - protein, 10 aa, Mycobacterium
AKIGADEDIP

SEQ ID NO: 426011 - protein, 12 aa, Mycobacterium
AKIGADNDIPHV

SEQ ID NO: 426012 - protein, 16 aa, Mycobacterium
AKIGPDGDDPDIPRVS

SEQ ID NO: 426013 - protein, 10 aa, Mycobacterium
AKIGPDKDIP

SEQ ID NO: 426014 - protein, 12 aa, Mycobacterium
AKIGPDKDIPHV

SEQ ID NO: 426015 - protein, 9 aa, Mycobacterium
AKIGPDNDI

SEQ ID NO: 426016 - protein, 10 aa, Mycobacterium
AKIGRDNDIP

SEQ ID NO: 426017 - protein, 11 aa, Mycobacterium
AKIGSDHDIPQ

SEQ ID NO: 426018 - protein, 10 aa, Mycobacterium
AKIGSDQDIP

SEQ ID NO: 426019 - protein, 6 aa, Mycobacterium
AKIGYP

SEQ ID NO: 426020 - protein, 6 aa, Mycobacterium
AKINSR

SEQ ID NO: 426021 - protein, 5 aa, Mycobacterium
AKIRT

SEQ ID NO: 426022 - protein, 4 aa, Mycobacterium
AKIS

SEQ ID NO: 426023 - protein, 9 aa, Mycobacterium
AKISPDGTR

SEQ ID NO: 426024 - protein, 9 aa, Mycobacterium
AKITSEGER

SEQ ID NO: 426025 - protein, 9 aa, Mycobacterium
AKKAARELS

SEQ ID NO: 426026 - protein, 12 aa, Mycobacterium
AKKAETFGAKLD

SEQ ID NO: 426027 - protein, 10 aa, Mycobacterium
AKKAGATVSD

SEQ ID NO: 426028 - protein, 6 aa, Mycobacterium
AKKAGV

SEQ ID NO: 426029 - protein, 7 aa, Mycobacterium
AKKAGYR

SEQ ID NO: 426030 - protein, 76 aa, Mycobacterium
AKKAKADDGRVTRKAARARKPAEAKAASKAESNGTSNGVSKRASNRALKAAAAKGAPKRKASSRRTASKTGSSQLR

SEQ ID NO: 426031 - protein, 8 aa, Mycobacterium
AKKATDFS

SEQ ID NO: 426032 - protein, 13 aa, Mycobacterium
AKKAYKAREAEID

SEQ ID NO: 426033 - protein, 17 aa, Mycobacterium
AKKDVGTGISASDRATT

SEQ ID NO: 426034 - protein, 7 aa, Mycobacterium
AKKEEAI

SEQ ID NO: 426035 - protein, 5 aa, Mycobacterium
AKKGM

SEQ ID NO: 426036 - protein, 22 aa, Mycobacterium
AKKGQKGQKTRRREKKNVPHGA

SEQ ID NO: 426037 - protein, 13 aa, Mycobacterium
AKKGSTGRAAPHT

SEQ ID NO: 426038 - protein, 6 aa, Mycobacterium
AKKNAI

SEQ ID NO: 426039 - protein, 19 aa, Mycobacterium
AKKPDSWPKDTQDPPDRHY

SEQ ID NO: 426040 - protein, 7 aa, Mycobacterium
AKKPGFS

SEQ ID NO: 426041 - protein, 17 aa, Mycobacterium
AKKPGGPHKPPKPEAAI

SEQ ID NO: 426042 - protein, 10 aa, Mycobacterium
AKKPPAATPG

SEQ ID NO: 426043 - protein, 5 aa, Mycobacterium
AKKPV

SEQ ID NO: 426044 - protein, 9 aa, Mycobacterium
AKKRGGTPD

SEQ ID NO: 426045 - protein, 8 aa, Mycobacterium
AKKRYQTG

SEQ ID NO: 426046 - protein, 8 aa, Mycobacterium
AKKSGDLS

SEQ ID NO: 426047 - protein, 15 aa, Mycobacterium
AKKSGLGPKEQGGAA

SEQ ID NO: 426048 - protein, 5 aa, Mycobacterium
AKKSI

SEQ ID NO: 426049 - protein, 8 aa, Mycobacterium
AKKTGVKV

SEQ ID NO: 426050 - protein, 17 aa, Mycobacterium
AKKTRESLQATAQLTQT

SEQ ID NO: 426051 - protein, 17 aa, Mycobacterium
AKKTRESLQETAQLTQT

SEQ ID NO: 426052 - protein, 12 aa, Mycobacterium
AKKTRESLQTTA

SEQ ID NO: 426053 - protein, 6 aa, Mycobacterium
AKKVTE

SEQ ID NO: 426054 - protein, 6 aa, Mycobacterium
AKLADA

SEQ ID NO: 426055 - protein, 17 aa, Mycobacterium
AKLAEQDDAAGEATAHT

SEQ ID NO: 426056 - protein, 10 aa, Mycobacterium
AKLAEQPLEG

SEQ ID NO: 426057 - protein, 7 aa, Mycobacterium
AKLASGD

SEQ ID NO: 426058 - protein, 27 aa, Mycobacterium
AKLATAAAAAPAGAAPAAAAPAAASPV

SEQ ID NO: 426059 - protein, 10 aa, Mycobacterium
AKLDDGAAAA

SEQ ID NO: 426060 - protein, 4 aa, Mycobacterium
AKLE

SEQ ID NO: 426061 - protein, 5 aa, Mycobacterium
AKLEA

SEQ ID NO: 426062 - protein, 13 aa, Mycobacterium
AKLEARLSAKNEV

SEQ ID NO: 426063 - protein, 8 aa, Mycobacterium
AKLEPDDA

SEQ ID NO: 426064 - protein, 8 aa, Mycobacterium
AKLEPEDA

SEQ ID NO: 426065 - protein, 17 aa, Mycobacterium
AKLGADDARAVRESLTQ

SEQ ID NO: 426066 - protein, 10 aa, Mycobacterium
AKLGADNDIP

SEQ ID NO: 426067 - protein, 11 aa, Mycobacterium
AKLGATSKADL

SEQ ID NO: 426068 - protein, 10 aa, Mycobacterium
AKLGDTTVEQ

SEQ ID NO: 426069 - protein, 8 aa, Mycobacterium
AKLGGRGA

SEQ ID NO: 426070 - protein, 14 aa, Mycobacterium
AKLGPDKDNPDIPH

SEQ ID NO: 426071 - protein, 27 aa, Mycobacterium
AKLGSSATEYSHTEQQNADAVDRQMPP

SEQ ID NO: 426072 - protein, 15 aa, Mycobacterium
AKLKTGEYRQISGNT

SEQ ID NO: 426073 - protein, 8 aa, Mycobacterium
AKLNARGE

SEQ ID NO: 426074 - protein, 11 aa, Mycobacterium
AKLPEGADTSV

SEQ ID NO: 426075 - protein, 7 aa, Mycobacterium
AKLPPMA

SEQ ID NO: 426076 - protein, 7 aa, Mycobacterium
AKLPQDR

SEQ ID NO: 426077 - protein, 19 aa, Mycobacterium
AKLPRVKPDLPAPRPAPDD

SEQ ID NO: 426078 - protein, 7 aa, Mycobacterium
AKLPTHE

SEQ ID NO: 426079 - protein, 6 aa, Mycobacterium
AKLQPM

SEQ ID NO: 426080 - protein, 8 aa, Mycobacterium
AKLQPSDL

SEQ ID NO: 426081 - protein, 8 aa, Mycobacterium
AKLRRTEP

SEQ ID NO: 426082 - protein, 7 aa, Mycobacterium
AKLSAAG

SEQ ID NO: 426083 - protein, 63 aa, Mycobacterium
AKLSAKAADELAEEREDEDTGDAEDADDTEDTENAEEPDAEAEAESDEPVAAEDDEEPRAAGD

SEQ ID NO: 426084 - protein, 24 aa, Mycobacterium
AKLSAKNEARRIKSAQKATDKALK

SEQ ID NO: 426085 - protein, 10 aa, Mycobacterium
AKLSAKPGIY

SEQ ID NO: 426086 - protein, 15 aa, Mycobacterium
AKLSEHRAGAAPSRG

SEQ ID NO: 426087 - protein, 8 aa, Mycobacterium
AKLSGSGI

SEQ ID NO: 426088 - protein, 19 aa, Mycobacterium
AKLSPTSTVRGWESMPAVF

SEQ ID NO: 426089 - protein, 19 aa, Mycobacterium
AKLSPTSTVRGWETMPAVI

SEQ ID NO: 426090 - protein, 6 aa, Mycobacterium
AKLSRE

SEQ ID NO: 426091 - protein, 7 aa, Mycobacterium
AKLSRTV

SEQ ID NO: 426092 - protein, 6 aa, Mycobacterium
AKLTAT

SEQ ID NO: 426093 - protein, 7 aa, Mycobacterium
AKLTPAD

SEQ ID NO: 426094 - protein, 7 aa, Mycobacterium
AKLTPDY

SEQ ID NO: 426095 - protein, 7 aa, Mycobacterium
AKMGRDE

SEQ ID NO: 426096 - protein, 7 aa, Mycobacterium
AKMGRDS

SEQ ID NO: 426097 - protein, 8 aa, Mycobacterium
AKMGRGPM

SEQ ID NO: 426098 - protein, 5 aa, Mycobacterium
AKMPA

SEQ ID NO: 426099 - protein, 10 aa, Mycobacterium
AKMSRGKAAA

SEQ ID NO: 426100 - protein, 20 aa, Mycobacterium
AKNAAGETKRTEDLPASTEQ

SEQ ID NO: 426101 - protein, 7 aa, Mycobacterium
AKNAAQQ

SEQ ID NO: 426102 - protein, 7 aa, Mycobacterium
AKNAGLD

SEQ ID NO: 426103 - protein, 7 aa, Mycobacterium
AKNAGMD

SEQ ID NO: 426104 - protein, 33 aa, Mycobacterium; identical to SEQ ID NO: 445

SEQ ID NO: 426105 - protein, 5 aa, Mycobacterium
AKNDA

SEQ ID NO: 426106 - protein, 11 aa, Mycobacterium
AKNEAAPSPLT

SEQ ID NO: 426107 - protein, 12 aa, Mycobacterium
AKNEAEAARVSK

SEQ ID NO: 426108 - protein, 19 aa, Mycobacterium
AKNEARRIKADRKAEQKAL

SEQ ID NO: 426109 - protein, 10 aa, Mycobacterium
AKNEPEDDER

SEQ ID NO: 426110 - protein, 19 aa, Mycobacterium
AKNEVRRAKSAQRAENKAL

SEQ ID NO: 426111 - protein, 7 aa, Mycobacterium
AKNGIDA

SEQ ID NO: 426112 - protein, 16 aa, Mycobacterium
AKNGIGTGISASDRAA

SEQ ID NO: 426113 - protein, 6 aa, Mycobacterium
AKNGLG

SEQ ID NO: 426114 - protein, 9 aa, Mycobacterium
AKNGQEGPF

SEQ ID NO: 426115 - protein, 7 aa, Mycobacterium
AKNGRAA

SEQ ID NO: 426116 - protein, 7 aa, Mycobacterium
AKNGTNI

SEQ ID NO: 426117 - protein, 16 aa, Mycobacterium
AKNGVGTGISASDRAT

SEQ ID NO: 426118 - protein, 10 aa, Mycobacterium
AKNIGPHAAT

SEQ ID NO: 426119 - protein, 4 aa, Mycobacterium
AKNL

SEQ ID NO: 426120 - protein, 9 aa, Mycobacterium
AKNPADRYA

SEQ ID NO: 426121 - protein, 8 aa, Mycobacterium
AKNPAPAV

SEQ ID NO: 426122 - protein, 10 aa, Mycobacterium
AKNPDANPTL

SEQ ID NO: 426123 - protein, 14 aa, Mycobacterium
AKNPFSSSPVERSV

SEQ ID NO: 426124 - protein, 7 aa, Mycobacterium
AKNPGAF

SEQ ID NO: 426125 - protein, 11 aa, Mycobacterium
AKNPQIEESAA

SEQ ID NO: 426126 - protein, 7 aa, Mycobacterium
AKNPRTG

SEQ ID NO: 426127 - protein, 7 aa, Mycobacterium
AKNPSDD

SEQ ID NO: 426128 - protein, 8 aa, Mycobacterium
AKNSAVRS

SEQ ID NO: 426129 - protein, 7 aa, Mycobacterium
AKNSGAE

SEQ ID NO: 426130 - protein, 9 aa, Mycobacterium
AKNTGIDEP

SEQ ID NO: 426131 - protein, 9 aa, Mycobacterium
AKNTTGAPD

SEQ ID NO: 426132 - protein, 13 aa, Mycobacterium
AKNYRNGAMNPNA

SEQ ID NO: 426133 - protein, 14 aa, Mycobacterium
AKPAAQILEEWISR

SEQ ID NO: 426134 - protein, 11 aa, Mycobacterium
AKPAAQQPSWP

SEQ ID NO: 426135 - protein, 14 aa, Mycobacterium
AKPAAQQPSWPADQ

SEQ ID NO: 426136 - protein, 15 aa, Mycobacterium
AKPAAQQPSWPADQA

SEQ ID NO: 426137 - protein, 17 aa, Mycobacterium
AKPAAQQPSWPADQASA

SEQ ID NO: 426138 - protein, 15 aa, Mycobacterium
AKPAAQQPSWPANQA

SEQ ID NO: 426139 - protein, 6 aa, Mycobacterium
AKPAAV

SEQ ID NO: 426140 - protein, 7 aa, Mycobacterium
AKPADIE

SEQ ID NO: 426141 - protein, 12 aa, Mycobacterium
AKPADLPDAKDD

SEQ ID NO: 426142 - protein, 7 aa, Mycobacterium
AKPAELA

SEQ ID NO: 426143 - protein, 14 aa, Mycobacterium
AKPAETAELIRRQL

SEQ ID NO: 426144 - protein, 7 aa, Mycobacterium
AKPAETF

SEQ ID NO: 426145 - protein, 6 aa, Mycobacterium
AKPAEV

SEQ ID NO: 426146 - protein, 23 aa, Mycobacterium
AKPAGEADPYRDRGSADEPSDAG

SEQ ID NO: 426147 - protein, 13 aa, Mycobacterium
AKPAGLPDAADEA

SEQ ID NO: 426148 - protein, 13 aa, Mycobacterium
AKPAGLPDAPDVE

SEQ ID NO: 426149 - protein, 16 aa, Mycobacterium
AKPALQQPSWDAGQAA

SEQ ID NO: 426150 - protein, 10 aa, Mycobacterium
AKPAPNLPPG

SEQ ID NO: 426151 - protein, 10 aa, Mycobacterium
AKPAPRGHSV

SEQ ID NO: 426152 - protein, 7 aa, Mycobacterium
AKPASAF

SEQ ID NO: 426153 - protein, 13 aa, Mycobacterium
AKPASAGSPRGGT

SEQ ID NO: 426154 - protein, 15 aa, Mycobacterium
AKPASPAFKANYDSQ

SEQ ID NO: 426155 - protein, 9 aa, Mycobacterium
AKPATADEV

SEQ ID NO: 426156 - protein, 7 aa, Mycobacterium
AKPATIS

SEQ ID NO: 426157 - protein, 26 aa, Mycobacterium
AKPAVGEDPRSGRWRGRTKTECGLHA

SEQ ID NO: 426158 - protein, 17 aa, Mycobacterium
AKPAVQQPSWDPDAAKA

SEQ ID NO: 426159 - protein, 4 aa, Mycobacterium
AKPD

SEQ ID NO: 426160 - protein, 5 aa, Mycobacterium
AKPDA

SEQ ID NO: 426161 - protein, 16 aa, Mycobacterium
AKPDDVAALARELLEA

SEQ ID NO: 426162 - protein, 8 aa, Mycobacterium
AKPDGDRG

SEQ ID NO: 426163 - protein, 5 aa, Mycobacterium
AKPDQ

SEQ ID NO: 426164 - protein, 7 aa, Mycobacterium
AKPEDAA

SEQ ID NO: 426165 - protein, 8 aa, Mycobacterium
AKPEDGAF

SEQ ID NO: 426166 - protein, 11 aa, Mycobacterium
AKPEGGELRGG

SEQ ID NO: 426167 - protein, 9 aa, Mycobacterium
AKPEYAETF

SEQ ID NO: 426168 - protein, 4 aa, Mycobacterium
AKPG

SEQ ID NO: 426169 - protein, 5 aa, Mycobacterium
AKPGA

SEQ ID NO: 426170 - protein, 6 aa, Mycobacterium
AKPGAS

SEQ ID NO: 426171 - protein, 9 aa, Mycobacterium
AKPGEPGAL

SEQ ID NO: 426172 - protein, 18 aa, Mycobacterium
AKPGEPSWPTPWGPGRPG

SEQ ID NO: 426173 - protein, 16 aa, Mycobacterium
AKPGEPSWPTPWGRGR

SEQ ID NO: 426174 - protein, 18 aa, Mycobacterium
AKPGEPSWPTPWGRGRPG

SEQ ID NO: 426175 - protein, 19 aa, Mycobacterium
AKPGEPSWPTPWGRGRPGW

SEQ ID NO: 426176 - protein, 12 aa, Mycobacterium
AKPGGDGVTPID

SEQ ID NO: 426177 - protein, 7 aa, Mycobacterium
AKPGLND

SEQ ID NO: 426178 - protein, 8 aa, Mycobacterium
AKPGLNDD

SEQ ID NO: 426179 - protein, 8 aa, Mycobacterium
AKPGLSDD

SEQ ID NO: 426180 - protein, 7 aa, Mycobacterium
AKPGLVS

SEQ ID NO: 426181 - protein, 7 aa, Mycobacterium
AKPGNSW

SEQ ID NO: 426182 - protein, 18 aa, Mycobacterium
AKPGPHVHEPASAATVQP

SEQ ID NO: 426183 - protein, 14 aa, Mycobacterium
AKPGPQGAPEGKGP

SEQ ID NO: 426184 - protein, 6 aa, Mycobacterium
AKPGQI

SEQ ID NO: 426185 - protein, 7 aa, Mycobacterium
AKPGQIV

SEQ ID NO: 426186 - protein, 14 aa, Mycobacterium
AKPGQPTHGTGMPA

SEQ ID NO: 426187 - protein, 6 aa, Mycobacterium
AKPGQR

SEQ ID NO: 426188 - protein, 7 aa, Mycobacterium
AKPGQTL

SEQ ID NO: 426189 - protein, 12 aa, Mycobacterium
AKPGRLAGPDPS

SEQ ID NO: 426190 - protein, 12 aa, Mycobacterium
AKPGRLEGPDPS

SEQ ID NO: 426191 - protein, 12 aa, Mycobacterium
AKPGRLVGPDPS

SEQ ID NO: 426192 - protein, 11 aa, Mycobacterium
AKPGRMVGPDP

SEQ ID NO: 426193 - protein, 8 aa, Mycobacterium
AKPGSAQT

SEQ ID NO: 426194 - protein, 7 aa, Mycobacterium
AKPGTAA

SEQ ID NO: 426195 - protein, 16 aa, Mycobacterium
AKPGTEVPEVRNGGTW

SEQ ID NO: 426196 - protein, 7 aa, Mycobacterium
AKPGTRR

SEQ ID NO: 426197 - protein, 8 aa, Mycobacterium
AKPGVPHA

SEQ ID NO: 426198 - protein, 16 aa, Mycobacterium
AKPHPDREIPQAQSAH

SEQ ID NO: 426199 - protein, 6 aa, Mycobacterium
AKPIGG

SEQ ID NO: 426200 - protein, 7 aa, Mycobacterium
AKPIPGS

SEQ ID NO: 426201 - protein, 7 aa, Mycobacterium
AKPISPA

SEQ ID NO: 426202 - protein, 4 aa, Mycobacterium
AKPK

SEQ ID NO: 426203 - protein, 5 aa, Mycobacterium
AKPKD

SEQ ID NO: 426204 - protein, 6 aa, Mycobacterium
AKPKIA

SEQ ID NO: 426205 - protein, 8 aa, Mycobacterium
AKPKSTRR

SEQ ID NO: 426206 - protein, 9 aa, Mycobacterium
AKPKTTKRL

SEQ ID NO: 426207 - protein, 9 aa, Mycobacterium
AKPLDETGC

SEQ ID NO: 426208 - protein, 9 aa, Mycobacterium
AKPLPPNTR

SEQ ID NO: 426209 - protein, 7 aa, Mycobacterium
AKPLSEG

SEQ ID NO: 426210 - protein, 7 aa, Mycobacterium
AKPPAGV

SEQ ID NO: 426211 - protein, 9 aa, Mycobacterium
AKPPDLPDM

SEQ ID NO: 426212 - protein, 8 aa, Mycobacterium
AKPPDQGD

SEQ ID NO: 426213 - protein, 15 aa, Mycobacterium
AKPPFGAWEQLSEWP

SEQ ID NO: 426214 - protein, 14 aa, Mycobacterium
AKPPGLPDIEDTET

SEQ ID NO: 426215 - protein, 11 aa, Mycobacterium
AKPPGLPDTSD

SEQ ID NO: 426216 - protein, 10 aa, Mycobacterium
AKPPHPADDE

SEQ ID NO: 426217 - protein, 9 aa, Mycobacterium
AKPPKGQEF

SEQ ID NO: 426218 - protein, 10 aa, Mycobacterium
AKPPPGESPG

SEQ ID NO: 426219 - protein, 10 aa, Mycobacterium
AKPPQPGSAE

SEQ ID NO: 426220 - protein, 9 aa, Mycobacterium
AKPPSGPLS

SEQ ID NO: 426221 - protein, 7 aa, Mycobacterium
AKPPSTF

SEQ ID NO: 426222 - protein, 10 aa, Mycobacterium
AKPPTATQGT

SEQ ID NO: 426223 - protein, 10 aa, Mycobacterium
AKPPTPASPV

SEQ ID NO: 426224 - protein, 7 aa, Mycobacterium
AKPPVER

SEQ ID NO: 426225 - protein, 6 aa, Mycobacterium
AKPPVG

SEQ ID NO: 426226 - protein, 7 aa, Mycobacterium
AKPQIGV

SEQ ID NO: 426227 - protein, 18 aa, Mycobacterium
AKPREVRATTPMSYAKWA

SEQ ID NO: 426228 - protein, 5 aa, Mycobacterium
AKPRK

SEQ ID NO: 426229 - protein, 4 aa, Mycobacterium
AKPS

SEQ ID NO: 426230 - protein, 15 aa, Mycobacterium
AKPSAAATDPNAVAS

SEQ ID NO: 426231 - protein, 13 aa, Mycobacterium
AKPSGEAPSCDTG

SEQ ID NO: 426232 - protein, 10 aa, Mycobacterium
AKPSSAKGRY

SEQ ID NO: 426233 - protein, 7 aa, Mycobacterium
AKPSVAA

SEQ ID NO: 426234 - protein, 8 aa, Mycobacterium
AKPSVSNY

SEQ ID NO: 426235 - protein, 7 aa, Mycobacterium
AKPTAHR

SEQ ID NO: 426236 - protein, 15 aa, Mycobacterium
AKPTALTTDARLGPD

SEQ ID NO: 426237 - protein, 6 aa, Mycobacterium
AKPTDV

SEQ ID NO: 426238 - protein, 20 aa, Mycobacterium
AKPTETSAVEAPVDDHEPGR

SEQ ID NO: 426239 - protein, 16 aa, Mycobacterium
AKPTEVATLIREQLKT

SEQ ID NO: 426240 - protein, 21 aa, Mycobacterium
AKPTGSLRDFPSSKQPAPSER

SEQ ID NO: 426241 - protein, 5 aa, Mycobacterium
AKPTL

SEQ ID NO: 426242 - protein, 9 aa, Mycobacterium
AKPTPRSAI

SEQ ID NO: 426243 - protein, 9 aa, Mycobacterium
AKPTSAEAV

SEQ ID NO: 426244 - protein, 14 aa, Mycobacterium
AKPVAGADPRSGRW

SEQ ID NO: 426245 - protein, 12 aa, Mycobacterium
AKPVGAESGLGT

SEQ ID NO: 426246 - protein, 6 aa, Mycobacterium
AKPVGK

SEQ ID NO: 426247 - protein, 10 aa, Mycobacterium
AKQAASLDRM

SEQ ID NO: 426248 - protein, 6 aa, Mycobacterium
AKQAEA

SEQ ID NO: 426249 - protein, 14 aa, Mycobacterium
AKQAFGTQKRQRQM

SEQ ID NO: 426250 - protein, 13 aa, Mycobacterium
AKQALAEKKTIRQ

SEQ ID NO: 426251 - protein, 6 aa, Mycobacterium
AKQAMT

SEQ ID NO: 426252 - protein, 8 aa, Mycobacterium
AKQAPGWQ

SEQ ID NO: 426253 - protein, 8 aa, Mycobacterium
AKQAQEGR

SEQ ID NO: 426254 - protein, 9 aa, Mycobacterium
AKQATAREA

SEQ ID NO: 426255 - protein, 6 aa, Mycobacterium
AKQAVK

SEQ ID NO: 426256 - protein, 9 aa, Mycobacterium
AKQDLAAED

SEQ ID NO: 426257 - protein, 23 aa, Mycobacterium
AKQDTTRERRIRRTQEELEEGKR

SEQ ID NO: 426258 - protein, 8 aa, Mycobacterium
AKQEETEE

SEQ ID NO: 426259 - protein, 11 aa, Mycobacterium
AKQESTRRRRI

SEQ ID NO: 426260 - protein, 4 aa, Mycobacterium
AKQF

SEQ ID NO: 426261 - protein, 6 aa, Mycobacterium
AKQGDR

SEQ ID NO: 426262 - protein, 7 aa, Mycobacterium
AKQGGQH

SEQ ID NO: 426263 - protein, 8 aa, Mycobacterium
AKQGTNIE

SEQ ID NO: 426264 - protein, 7 aa, Mycobacterium
AKQIPAD

SEQ ID NO: 426265 - protein, 18 aa, Mycobacterium
AKQISSRAAMSQTVKTSP

SEQ ID NO: 426266 - protein, 12 aa, Mycobacterium
AKQLADIGADDN

SEQ ID NO: 426267 - protein, 7 aa, Mycobacterium
AKQLGSD

SEQ ID NO: 426268 - protein, 19 aa, Mycobacterium
AKQLSEKKTAGKGGSGKPL

SEQ ID NO: 426269 - protein, 7 aa, Mycobacterium
AKQLSPR

SEQ ID NO: 426270 - protein, 25 aa, Mycobacterium
AKQLSSDLSQDGAQRLKTAATARRA

SEQ ID NO: 426271 - protein, 9 aa, Mycobacterium
AKQNEHLRD

SEQ ID NO: 426272 - protein, 6 aa, Mycobacterium
AKQPDV

SEQ ID NO: 426273 - protein, 8 aa, Mycobacterium
AKQPGITT

SEQ ID NO: 426274 - protein, 24 aa, Mycobacterium
AKQPTTRERRIRRTQEELEEGKRR

SEQ ID NO: 426275 - protein, 8 aa, Mycobacterium
AKQQEDPL

SEQ ID NO: 426276 - protein, 7 aa, Mycobacterium
AKQQKVD

SEQ ID NO: 426277 - protein, 12 aa, Mycobacterium
AKQQRQERDMTD

SEQ ID NO: 426278 - protein, 5 aa, Mycobacterium
AKQRE

SEQ ID NO: 426279 - protein, 5 aa, Mycobacterium
AKQRG

SEQ ID NO: 426280 - protein, 5 aa, Mycobacterium
AKQRR

SEQ ID NO: 426281 - protein, 7 aa, Mycobacterium
AKQRRSA

SEQ ID NO: 426282 - protein, 7 aa, Mycobacterium
AKQRSQF

SEQ ID NO: 426283 - protein, 12 aa, Mycobacterium
AKQRSQFGRPIG

SEQ ID NO: 426284 - protein, 8 aa, Mycobacterium
AKQRTAGY

SEQ ID NO: 426285 - protein, 6 aa, Mycobacterium
AKQRTQ

SEQ ID NO: 426286 - protein, 7 aa, Mycobacterium
AKQRTQF

SEQ ID NO: 426287 - protein, 7 aa, Mycobacterium
AKQSSAE

SEQ ID NO: 426288 - protein, 9 aa, Mycobacterium
AKQTGAQAI

SEQ ID NO: 426289 - protein, 7 aa, Mycobacterium
AKQTPQQ

SEQ ID NO: 426290 - protein, 4 aa, Mycobacterium
AKQV

SEQ ID NO: 426291 - protein, 6 aa, Mycobacterium
AKQVQE

SEQ ID NO: 426292 - protein, 5 aa, Mycobacterium
AKRAA

SEQ ID NO: 426293 - protein, 7 aa, Mycobacterium
AKRAASD

SEQ ID NO: 426294 - protein, 8 aa, Mycobacterium
AKRAEDAG

SEQ ID NO: 426295 - protein, 7 aa, Mycobacterium
AKRAELK

SEQ ID NO: 426296 - protein, 10 aa, Mycobacterium
AKRAGAGKGA

SEQ ID NO: 426297 - protein, 7 aa, Mycobacterium
AKRAGSP

SEQ ID NO: 426298 - protein, 7 aa, Mycobacterium
AKRAGTA

SEQ ID NO: 426299 - protein, 8 aa, Mycobacterium
AKRAGTAT

SEQ ID NO: 426300 - protein, 10 aa, Mycobacterium
AKRAHPNEAH

SEQ ID NO: 426301 - protein, 7 aa, Mycobacterium
AKRAPGA

SEQ ID NO: 426302 - protein, 8 aa, Mycobacterium
AKRAQPRA

SEQ ID NO: 426303 - protein, 6 aa, Mycobacterium
AKRARA

SEQ ID NO: 426304 - protein, 18 aa, Mycobacterium
AKRARGERIGRPRLAKPG

SEQ ID NO: 426305 - protein, 18 aa, Mycobacterium
AKRARRDQKTLAAQEARA

SEQ ID NO: 426306 - protein, 7 aa, Mycobacterium
AKRAVDA

SEQ ID NO: 426307 - protein, 4 aa, Mycobacterium
AKRC

SEQ ID NO: 426308 - protein, 7 aa, Mycobacterium
AKRCADE

SEQ ID NO: 426309 - protein, 8 aa, Mycobacterium
AKRCDRGA

SEQ ID NO: 426310 - protein, 7 aa, Mycobacterium
AKRCKER

SEQ ID NO: 426311 - protein, 7 aa, Mycobacterium
AKRCQKR

SEQ ID NO: 426312 - protein, 7 aa, Mycobacterium
AKRDADA

SEQ ID NO: 426313 - protein, 6 aa, Mycobacterium
AKRDDR

SEQ ID NO: 426314 - protein, 7 aa, Mycobacterium
AKRDGGD

SEQ ID NO: 426315 - protein, 8 aa, Mycobacterium
AKRDNGFG

SEQ ID NO: 426316 - protein, 8 aa, Mycobacterium
AKRDPEFS

SEQ ID NO: 426317 - protein, 4 aa, Mycobacterium
AKRE

SEQ ID NO: 426318 - protein, 6 aa, Mycobacterium
AKREGG

SEQ ID NO: 426319 - protein, 8 aa, Mycobacterium
AKRERAVE

SEQ ID NO: 426320 - protein, 15 aa, Mycobacterium
AKREYEASMSRAKSE

SEQ ID NO: 426321 - protein, 17 aa, Mycobacterium
AKREYEASVGRAQAEAD

SEQ ID NO: 426322 - protein, 7 aa, Mycobacterium
AKRFARD

SEQ ID NO: 426323 - protein, 8 aa, Mycobacterium
AKRGAAGA

SEQ ID NO: 426324 - protein, 6 aa, Mycobacterium
AKRGAQ

SEQ ID NO: 426325 - protein, 13 aa, Mycobacterium
AKRGASDTAGSAE

SEQ ID NO: 426326 - protein, 15 aa, Mycobacterium
AKRGGGAIVNQSSTA

SEQ ID NO: 426327 - protein, 9 aa, Mycobacterium
AKRGGGSDK

SEQ ID NO: 426328 - protein, 6 aa, Mycobacterium
AKRGGQ

SEQ ID NO: 426329 - protein, 7 aa, Mycobacterium
AKRGGQH

SEQ ID NO: 426330 - protein, 6 aa, Mycobacterium
AKRGPV

SEQ ID NO: 426331 - protein, 5 aa, Mycobacterium
AKRGQ

SEQ ID NO: 426332 - protein, 8 aa, Mycobacterium
AKRGQASL

SEQ ID NO: 426333 - protein, 22 aa, Mycobacterium
AKRGRKKRSRKHNAANHGKRPN

SEQ ID NO: 426334 - protein, 17 aa, Mycobacterium
AKRGRKTVNIVPVARPE

SEQ ID NO: 426335 - protein, 7 aa, Mycobacterium
AKRGVGS

SEQ ID NO: 426336 - protein, 14 aa, Mycobacterium
AKRHKQDRRTAREN

SEQ ID NO: 426337 - protein, 13 aa, Mycobacterium
AKRKAYEARARGQ

SEQ ID NO: 426338 - protein, 7 aa, Mycobacterium
AKRKGKR

SEQ ID NO: 426339 - protein, 10 aa, Mycobacterium
AKRKLSDGAA

SEQ ID NO: 426340 - protein, 15 aa, Mycobacterium
AKRKPAQLSGGQQQR

SEQ ID NO: 426341 - protein, 9 aa, Mycobacterium
AKRKTTRNL

SEQ ID NO: 426342 - protein, 7 aa, Mycobacterium
AKRLAGQ

SEQ ID NO: 426343 - protein, 14 aa, Mycobacterium
AKRLGAKTTGYDVR

SEQ ID NO: 426344 - protein, 14 aa, Mycobacterium
AKRLPAEQFAHWDT

SEQ ID NO: 426345 - protein, 7 aa, Mycobacterium
AKRLQTR

SEQ ID NO: 426346 - protein, 10 aa, Mycobacterium
AKRNGARDGT

SEQ ID NO: 426347 - protein, 6 aa, Mycobacterium
AKRNPR

SEQ ID NO: 426348 - protein, 7 aa, Mycobacterium
AKRPEET

SEQ ID NO: 426349 - protein, 10 aa, Mycobacterium
AKRPPSGSPG

SEQ ID NO: 426350 - protein, 9 aa, Mycobacterium
AKRPRGEGQ

SEQ ID NO: 426351 - protein, 8 aa, Mycobacterium
AKRPTISN

SEQ ID NO: 426352 - protein, 12 aa, Mycobacterium
AKRPTVPGLPNR

SEQ ID NO: 426353 - protein, 8 aa, Mycobacterium
AKRQADPN

SEQ ID NO: 426354 - protein, 10 aa, Mycobacterium
AKRQDTRREH

SEQ ID NO: 426355 - protein, 10 aa, Mycobacterium
AKRQGEVSSS

SEQ ID NO: 426356 - protein, 12 aa, Mycobacterium
AKRQGTHATKTR

SEQ ID NO: 426357 - protein, 62 aa, Mycobacterium
AKRQGTHSTKTRGEVSGGGKKPYRQKGTGRARQGSTRAPQFTGGGTVHGPKPRDYSQRTPKK

SEQ ID NO: 426358 - protein, 17 aa, Mycobacterium
AKRRAKSSIVSTTNTSA

SEQ ID NO: 426359 - protein, 6 aa, Mycobacterium
AKRRGR

SEQ ID NO: 426360 - protein, 15 aa, Mycobacterium
AKRRGRGDADGEFHD

SEQ ID NO: 426361 - protein, 7 aa, Mycobacterium
AKRRNTV

SEQ ID NO: 426362 - protein, 24 aa, Mycobacterium
AKRRRRTGGSERWETARRRGSETD

SEQ ID NO: 426363 - protein, 4 aa, Mycobacterium
AKRS

SEQ ID NO: 426364 - protein, 5 aa, Mycobacterium
AKRSA

SEQ ID NO: 426365 - protein, 8 aa, Mycobacterium
AKRSGPQL

SEQ ID NO: 426366 - protein, 5 aa, Mycobacterium
AKRSK

SEQ ID NO: 426367 - protein, 8 aa, Mycobacterium
AKRSPAYG

SEQ ID NO: 426368 - protein, 14 aa, Mycobacterium
AKRSRDLLSPNESL

SEQ ID NO: 426369 - protein, 13 aa, Mycobacterium
AKRSSHKESHGGH

SEQ ID NO: 426370 - protein, 16 aa, Mycobacterium
AKRSSSKESHGGRKEA

SEQ ID NO: 426371 - protein, 13 aa, Mycobacterium
AKRSTNRDKTRAA

SEQ ID NO: 426372 - protein, 5 aa, Mycobacterium
AKRTD

SEQ ID NO: 426373 - protein, 11 aa, Mycobacterium
AKRTEGRSGAD

SEQ ID NO: 426374 - protein, 6 aa, Mycobacterium
AKRTGA

SEQ ID NO: 426375 - protein, 7 aa, Mycobacterium
AKRTGRA

SEQ ID NO: 426376 - protein, 15 aa, Mycobacterium
AKRTGRGRALGSRQR

SEQ ID NO: 426377 - protein, 7 aa, Mycobacterium
AKRTPGS

SEQ ID NO: 426378 - protein, 9 aa, Mycobacterium
AKRTPKLAR

SEQ ID NO: 426379 - protein, 17 aa, Mycobacterium
AKRTPKTARTRSWETDV

SEQ ID NO: 426380 - protein, 4 aa, Mycobacterium
AKSA

SEQ ID NO: 426381 - protein, 8 aa, Mycobacterium
AKSAARAY

SEQ ID NO: 426382 - protein, 35 aa, Mycobacterium
AKSADAEDDATTGTGTETEPEKSEKPVEKSKKPLV

SEQ ID NO: 426383 - protein, 9 aa, Mycobacterium
AKSAFAERE

SEQ ID NO: 426384 - protein, 18 aa, Mycobacterium
AKSALDPAGILNPGVLVD

SEQ ID NO: 426385 - protein, 10 aa, Mycobacterium
AKSANASEHH

SEQ ID NO: 426386 - protein, 14 aa, Mycobacterium
AKSAPPPGWPAGDV

SEQ ID NO: 426387 - protein, 10 aa, Mycobacterium
AKSARALAAQ

SEQ ID NO: 426388 - protein, 18 aa, Mycobacterium
AKSARVEHRRPGADASPY

SEQ ID NO: 426389 - protein, 9 aa, Mycobacterium
AKSAVNGLT

SEQ ID NO: 426390 - protein, 11 aa, Mycobacterium
AKSAVTTSGAL

SEQ ID NO: 426391 - protein, 7 aa, Mycobacterium
AKSAWDY

SEQ ID NO: 426392 - protein, 8 aa, Mycobacterium
AKSAYSVR

SEQ ID NO: 426393 - protein, 20 aa, Mycobacterium
AKSDARSTVDRYDRDDDPAL

SEQ ID NO: 426394 - protein, 8 aa, Mycobacterium
AKSDISEH

SEQ ID NO: 426395 - protein, 15 aa, Mycobacterium
AKSDLERQESRDKTG

SEQ ID NO: 426396 - protein, 15 aa, Mycobacterium
AKSDLERQESREKTG

SEQ ID NO: 426397 - protein, 6 aa, Mycobacterium
AKSDLR

SEQ ID NO: 426398 - protein, 10 aa, Mycobacterium
AKSDPALASP

SEQ ID NO: 426399 - protein, 10 aa, Mycobacterium
AKSDPTLASP

SEQ ID NO: 426400 - protein, 5 aa, Mycobacterium
AKSDQ

SEQ ID NO: 426401 - protein, 15 aa, Mycobacterium
AKSDTAMKSAPDADI

SEQ ID NO: 426402 - protein, 7 aa, Mycobacterium
AKSDTED

SEQ ID NO: 426403 - protein, 7 aa, Mycobacterium
AKSEELA

SEQ ID NO: 426404 - protein, 7 aa, Mycobacterium
AKSEIGN

SEQ ID NO: 426405 - protein, 5 aa, Mycobacterium
AKSEL

SEQ ID NO: 426406 - protein, 13 aa, Mycobacterium
AKSELARQIAGGT

SEQ ID NO: 426407 - protein, 22 aa, Mycobacterium
AKSGADLPDRVERDTAPASDIL

SEQ ID NO: 426408 - protein, 13 aa, Mycobacterium
AKSGGGIGRGEGV

SEQ ID NO: 426409 - protein, 10 aa, Mycobacterium
AKSGGGMNAA

SEQ ID NO: 426410 - protein, 8 aa, Mycobacterium
AKSGINGA

SEQ ID NO: 426411 - protein, 7 aa, Mycobacterium
AKSGIQR

SEQ ID NO: 426412 - protein, 8 aa, Mycobacterium
AKSGKTTI

SEQ ID NO: 426413 - protein, 8 aa, Mycobacterium
AKSGQIRK

SEQ ID NO: 426414 - protein, 10 aa, Mycobacterium
AKSGQLKGTV

SEQ ID NO: 426415 - protein, 10 aa, Mycobacterium
AKSGQPRQNP

SEQ ID NO: 426416 - protein, 7 aa, Mycobacterium
AKSGQPV

SEQ ID NO: 426417 - protein, 12 aa, Mycobacterium
AKSGTCPGHDGR

SEQ ID NO: 426418 - protein, 6 aa, Mycobacterium
AKSGVD

SEQ ID NO: 426419 - protein, 7 aa, Mycobacterium
AKSGVQR

SEQ ID NO: 426420 - protein, 6 aa, Mycobacterium
AKSGVR

SEQ ID NO: 426421 - protein, 8 aa, Mycobacterium
AKSHAESM

SEQ ID NO: 426422 - protein, 9 aa, Mycobacterium
AKSIADGAS

SEQ ID NO: 426423 - protein, 8 aa, Mycobacterium
AKSIADGP

SEQ ID NO: 426424 - protein, 11 aa, Mycobacterium
AKSISNAPYPA

SEQ ID NO: 426425 - protein, 12 aa, Mycobacterium
AKSKPYKSGFGP

SEQ ID NO: 426426 - protein, 5 aa, Mycobacterium
AKSLE

SEQ ID NO: 426427 - protein, 7 aa, Mycobacterium
AKSMSRA

SEQ ID NO: 426428 - protein, 7 aa, Mycobacterium
AKSNADE

SEQ ID NO: 426429 - protein, 13 aa, Mycobacterium
AKSNGAADDPAIR

SEQ ID NO: 426430 - protein, 9 aa, Mycobacterium
AKSNGLSVT

SEQ ID NO: 426431 - protein, 6 aa, Mycobacterium
AKSNVQ

SEQ ID NO: 426432 - protein, 7 aa, Mycobacterium
AKSPDLK

SEQ ID NO: 426433 - protein, 6 aa, Mycobacterium
AKSPHW

SEQ ID NO: 426434 - protein, 16 aa, Mycobacterium
AKSPHWTGARNSARTY

SEQ ID NO: 426435 - protein, 16 aa, Mycobacterium
AKSPHWTGTRNSARTY

SEQ ID NO: 426436 - protein, 8 aa, Mycobacterium
AKSPLPGW

SEQ ID NO: 426437 - protein, 8 aa, Mycobacterium
AKSPQAAG

SEQ ID NO: 426438 - protein, 15 aa, Mycobacterium
AKSPTPSESRTRTGD

SEQ ID NO: 426439 - protein, 5 aa, Mycobacterium
AKSQR

SEQ ID NO: 426440 - protein, 13 aa, Mycobacterium
AKSQTAAYGSLPA

SEQ ID NO: 426441 - protein, 14 aa, Mycobacterium
AKSQTAAYGSLPAA

SEQ ID NO: 426442 - protein, 15 aa, Mycobacterium
AKSQTAAYGSLPAEG

SEQ ID NO: 426443 - protein, 14 aa, Mycobacterium
AKSQTAAYGSLPAR

SEQ ID NO: 426444 - protein, 15 aa, Mycobacterium
AKSQTAAYGSLPASG

SEQ ID NO: 426445 - protein, 15 aa, Mycobacterium
AKSQTAAYGSLPKEG

SEQ ID NO: 426446 - protein, 8 aa, Mycobacterium
AKSRNEID

SEQ ID NO: 426447 - protein, 8 aa, Mycobacterium
AKSRPTVP

SEQ ID NO: 426448 - protein, 9 aa, Mycobacterium
AKSRSPEEL

SEQ ID NO: 426449 - protein, 21 aa, Mycobacterium
AKSRYLEPSGGGPLGSATGFP

SEQ ID NO: 426450 - protein, 4 aa, Mycobacterium
AKSS

SEQ ID NO: 426451 - protein, 34 aa, Mycobacterium
AKSSADADSSLTKTSRTLKDTDRDFDSAGNSAHG

SEQ ID NO: 426452 - protein, 45 aa, Mycobacterium
AKSSAHDAAQAQTTSGPTSMAGATAAATTGAVTGDSAKRSAEQQR

SEQ ID NO: 426453 - protein, 13 aa, Mycobacterium
AKSSDVRGAQFQT

SEQ ID NO: 426454 - protein, 5 aa, Mycobacterium
AKSSG

SEQ ID NO: 426455 - protein, 7 aa, Mycobacterium
AKSSLGR

SEQ ID NO: 426456 - protein, 11 aa, Mycobacterium
AKSSRDPGHER

SEQ ID NO: 426457 - protein, 6 aa, Mycobacterium
AKSTAR

SEQ ID NO: 426458 - protein, 6 aa, Mycobacterium
AKSTFR

SEQ ID NO: 426459 - protein, 14 aa, Mycobacterium
AKSTGATLTGTGYQ

SEQ ID NO: 426460 - protein, 11 aa, Mycobacterium
AKSTNKQNPPH

SEQ ID NO: 426461 - protein, 17 aa, Mycobacterium
AKSTRKAVEDLPADPER

SEQ ID NO: 426462 - protein, 4 aa, Mycobacterium
AKSV

SEQ ID NO: 426463 - protein, 8 aa, Mycobacterium
AKSVAAGT

SEQ ID NO: 426464 - protein, 8 aa, Mycobacterium
AKSVEEQD

SEQ ID NO: 426465 - protein, 9 aa, Mycobacterium
AKSVKTPDE

SEQ ID NO: 426466 - protein, 6 aa, Mycobacterium
AKTAAE

SEQ ID NO: 426467 - protein, 9 aa, Mycobacterium
AKTAAHGRA

SEQ ID NO: 426468 - protein, 7 aa, Mycobacterium
AKTAEKL

SEQ ID NO: 426469 - protein, 5 aa, Mycobacterium
AKTAG

SEQ ID NO: 426470 - protein, 35 aa, Mycobacterium
AKTAGAIGPAAAAPAATVAATGAAEAVGAGPVSAS

SEQ ID NO: 426471 - protein, 9 aa, Mycobacterium
AKTAHPNSL

SEQ ID NO: 426472 - protein, 9 aa, Mycobacterium
AKTAPGRRI

SEQ ID NO: 426473 - protein, 9 aa, Mycobacterium
AKTAPKDAG

SEQ ID NO: 426474 - protein, 10 aa, Mycobacterium
AKTAPKDAGL

SEQ ID NO: 426475 - protein, 10 aa, Mycobacterium
AKTAPKDEGL

SEQ ID NO: 426476 - protein, 14 aa, Mycobacterium
AKTAPLAGNSIATD

SEQ ID NO: 426477 - protein, 10 aa, Mycobacterium
AKTAPTDAGI

SEQ ID NO: 426478 - protein, 8 aa, Mycobacterium
AKTAQCRS

SEQ ID NO: 426479 - protein, 5 aa, Mycobacterium
AKTAR

SEQ ID NO: 426480 - protein, 9 aa, Mycobacterium
AKTATAENI

SEQ ID NO: 426481 - protein, 8 aa, Mycobacterium
AKTDEDKL

SEQ ID NO: 426482 - protein, 11 aa, Mycobacterium
AKTDGSMRDDV

SEQ ID NO: 426483 - protein, 19 aa, Mycobacterium
AKTDNGFELTPSAGAAPIA

SEQ ID NO: 426484 - protein, 15 aa, Mycobacterium
AKTDRAALAAGATAY

SEQ ID NO: 426485 - protein, 14 aa, Mycobacterium
AKTDRAALAGGTPY

SEQ ID NO: 426486 - protein, 13 aa, Mycobacterium
AKTDRSAMTGGTP

SEQ ID NO: 426487 - protein, 10 aa, Mycobacterium
AKTDTGPNPH

SEQ ID NO: 426488 - protein, 4 aa, Mycobacterium
AKTE

SEQ ID NO: 426489 - protein, 9 aa, Mycobacterium
AKTEHLGDR

SEQ ID NO: 426490 - protein, 11 aa, Mycobacterium
AKTEHLGDRSP

SEQ ID NO: 426491 - protein, 10 aa, Mycobacterium
AKTELGPSEL

SEQ ID NO: 426492 - protein, 18 aa, Mycobacterium
AKTELQAPQAQPTPEGVS

SEQ ID NO: 426493 - protein, 14 aa, Mycobacterium
AKTEPIGPETSPER

SEQ ID NO: 426494 - protein, 13 aa, Mycobacterium
AKTEPIGPNGEER

SEQ ID NO: 426495 - protein, 10 aa, Mycobacterium
AKTEPSGTKA

SEQ ID NO: 426496 - protein, 7 aa, Mycobacterium
AKTEQGC

SEQ ID NO: 426497 - protein, 11 aa, Mycobacterium
AKTEYLGDRSP

SEQ ID NO: 426498 - protein, 6 aa, Mycobacterium
AKTEYR

SEQ ID NO: 426499 - protein, 7 aa, Mycobacterium
AKTFTKD

SEQ ID NO: 426500 - protein, 7 aa, Mycobacterium
AKTGASN

SEQ ID NO: 426501 - protein, 8 aa, Mycobacterium
AKTGDGVE

SEQ ID NO: 426502 - protein, 8 aa, Mycobacterium
AKTGDVAT

SEQ ID NO: 426503 - protein, 9 aa, Mycobacterium
AKTGGESKI

SEQ ID NO: 426504 - protein, 8 aa, Mycobacterium
AKTGGGVA

SEQ ID NO: 426505 - protein, 9 aa, Mycobacterium
AKTGGNVSE

SEQ ID NO: 426506 - protein, 7 aa, Mycobacterium
AKTGGRN

SEQ ID NO: 426507 - protein, 11 aa, Mycobacterium
AKTGIDPGGLA

SEQ ID NO: 426508 - protein, 10 aa, Mycobacterium
AKTGKRRSNT

SEQ ID NO: 426509 - protein, 11 aa, Mycobacterium
AKTGKRRTTSL

SEQ ID NO: 426510 - protein, 5 aa, Mycobacterium
AKTGL

SEQ ID NO: 426511 - protein, 5 aa, Mycobacterium
AKTGM

SEQ ID NO: 426512 - protein, 10 aa, Mycobacterium
AKTGQARTTS

SEQ ID NO: 426513 - protein, 9 aa, Mycobacterium
AKTGQHRAS

SEQ ID NO: 426514 - protein, 10 aa, Mycobacterium
AKTGQPRTTS

SEQ ID NO: 426515 - protein, 8 aa, Mycobacterium
AKTGQTLG

SEQ ID NO: 426516 - protein, 8 aa, Mycobacterium
AKTGRTTA

SEQ ID NO: 426517 - protein, 5 aa, Mycobacterium
AKTGV

SEQ ID NO: 426518 - protein, 7 aa, Mycobacterium
AKTHRPE

SEQ ID NO: 426519 - protein, 8 aa, Mycobacterium
AKTHSESM

SEQ ID NO: 426520 - protein, 6 aa, Mycobacterium
AKTIPD

SEQ ID NO: 426521 - protein, 7 aa, Mycobacterium
AKTIRDG

SEQ ID NO: 426522 - protein, 4 aa, Mycobacterium
AKTL

SEQ ID NO: 426523 - protein, 7 aa, Mycobacterium
AKTLSDK

SEQ ID NO: 426524 - protein, 6 aa, Mycobacterium
AKTLSE

SEQ ID NO: 426525 - protein, 12 aa, Mycobacterium
AKTLTRSASEQL

SEQ ID NO: 426526 - protein, 7 aa, Mycobacterium
AKTPAEI

SEQ ID NO: 426527 - protein, 7 aa, Mycobacterium
AKTPARV

SEQ ID NO: 426528 - protein, 18 aa, Mycobacterium
AKTPDDSGLMRDALLDLT

SEQ ID NO: 426529 - protein, 11 aa, Mycobacterium
AKTPDELSDAA

SEQ ID NO: 426530 - protein, 5 aa, Mycobacterium
AKTPE

SEQ ID NO: 426531 - protein, 11 aa, Mycobacterium
AKTPGDPDALY

SEQ ID NO: 426532 - protein, 11 aa, Mycobacterium
AKTPGDPNALY

SEQ ID NO: 426533 - protein, 7 aa, Mycobacterium
AKTPGEG

SEQ ID NO: 426534 - protein, 12 aa, Mycobacterium
AKTPGPDIVNLA

SEQ ID NO: 426535 - protein, 10 aa, Mycobacterium
AKTPNDPTAL

SEQ ID NO: 426536 - protein, 10 aa, Mycobacterium
AKTPQQKRDR

SEQ ID NO: 426537 - protein, 9 aa, Mycobacterium
AKTPRQKRD

SEQ ID NO: 426538 - protein, 8 aa, Mycobacterium
AKTPRRGV

SEQ ID NO: 426539 - protein, 14 aa, Mycobacterium
AKTPVSKDDAQQNA

SEQ ID NO: 426540 - protein, 7 aa, Mycobacterium
AKTPYHY

SEQ ID NO: 426541 - protein, 13 aa, Mycobacterium
AKTPYPSGGPIPR

SEQ ID NO: 426542 - protein, 4 aa, Mycobacterium
AKTQ

SEQ ID NO: 426543 - protein, 5 aa, Mycobacterium
AKTQG

SEQ ID NO: 426544 - protein, 6 aa, Mycobacterium
AKTQKA

SEQ ID NO: 426545 - protein, 9 aa, Mycobacterium
AKTQRTSSD

SEQ ID NO: 426546 - protein, 7 aa, Mycobacterium
AKTRAHS

SEQ ID NO: 426547 - protein, 9 aa, Mycobacterium
AKTRAQNRA

SEQ ID NO: 426548 - protein, 7 aa, Mycobacterium
AKTRDGR

SEQ ID NO: 426549 - protein, 15 aa, Mycobacterium
AKTRRRGADGKPLYS

SEQ ID NO: 426550 - protein, 10 aa, Mycobacterium
AKTRTQFGQP

SEQ ID NO: 426551 - protein, 10 aa, Mycobacterium
AKTSAEDDSL

SEQ ID NO: 426552 - protein, 10 aa, Mycobacterium
AKTSGAPAGT

SEQ ID NO: 426553 - protein, 7 aa, Mycobacterium
AKTSKRA

SEQ ID NO: 426554 - protein, 9 aa, Mycobacterium
AKTSTAENI

SEQ ID NO: 426555 - protein, 8 aa, Mycobacterium
AKTSVRAA

SEQ ID NO: 426556 - protein, 4 aa, Mycobacterium
AKTT

SEQ ID NO: 426557 - protein, 11 aa, Mycobacterium
AKTVTAAGVSA

SEQ ID NO: 426558 - protein, 20 aa, Mycobacterium
AKTWGDQATQLDTAVNGAQG

SEQ ID NO: 426559 - protein, 9 aa, Mycobacterium
AKTYAAQGA

SEQ ID NO: 426560 - protein, 6 aa, Mycobacterium
AKTYDA

SEQ ID NO: 426561 - protein, 4 aa, Mycobacterium
AKVA

SEQ ID NO: 426562 - protein, 7 aa, Mycobacterium
AKVAAGD

SEQ ID NO: 426563 - protein, 8 aa, Mycobacterium
AKVDDDVA

SEQ ID NO: 426564 - protein, 9 aa, Mycobacterium
AKVDDDVAD

SEQ ID NO: 426565 - protein, 10 aa, Mycobacterium
AKVDDDVADE

SEQ ID NO: 426566 - protein, 11 aa, Mycobacterium
AKVDDDVSDQI

SEQ ID NO: 426567 - protein, 20 aa, Mycobacterium
AKVEGIPDTESAVTPDLLED

SEQ ID NO: 426568 - protein, 11 aa, Mycobacterium
AKVGDSGEIPH

SEQ ID NO: 426569 - protein, 7 aa, Mycobacterium
AKVGEEI

SEQ ID NO: 426570 - protein, 10 aa, Mycobacterium
AKVGPDNDIP

SEQ ID NO: 426571 - protein, 8 aa, Mycobacterium
AKVGPGDI

SEQ ID NO: 426572 - protein, 11 aa, Mycobacterium
AKVGRDEPDRR

SEQ ID NO: 426573 - protein, 6 aa, Mycobacterium
AKVGRP

SEQ ID NO: 426574 - protein, 10 aa, Mycobacterium
AKVKESGADL

SEQ ID NO: 426575 - protein, 7 aa, Mycobacterium
AKVKPSE

SEQ ID NO: 426576 - protein, 21 aa, Mycobacterium
AKVKQGRVPLEDPESGYRPSV

SEQ ID NO: 426577 - protein, 15 aa, Mycobacterium
AKVKSQNKTRDAEQA

SEQ ID NO: 426578 - protein, 4 aa, Mycobacterium
AKVN

SEQ ID NO: 426579 - protein, 7 aa, Mycobacterium
AKVNPEA

SEQ ID NO: 426580 - protein, 6 aa, Mycobacterium
AKVPAA

SEQ ID NO: 426581 - protein, 10 aa, Mycobacterium
AKVPDGVSAE

SEQ ID NO: 426582 - protein, 6 aa, Mycobacterium
AKVPET

SEQ ID NO: 426583 - protein, 10 aa, Mycobacterium
AKVPTERPQI

SEQ ID NO: 426584 - protein, 6 aa, Mycobacterium
AKVPTI

SEQ ID NO: 426585 - protein, 6 aa, Mycobacterium
AKVQGG

SEQ ID NO: 426586 - protein, 9 aa, Mycobacterium
AKVQSGELT

SEQ ID NO: 426587 - protein, 7 aa, Mycobacterium
AKVSAGQ

SEQ ID NO: 426588 - protein, 7 aa, Mycobacterium
AKVSGDL

SEQ ID NO: 426589 - protein, 7 aa, Mycobacterium
AKVSSTY

SEQ ID NO: 426590 - protein, 34 aa, Mycobacterium
AKVTGKAKGPSTQARAQSRKKTARDTAGQRRREK

SEQ ID NO: 426591 - protein, 9 aa, Mycobacterium
AKVTPDTDD

SEQ ID NO: 426592 - protein, 17 aa, Mycobacterium
AKVTPGENRVRADPNGL

SEQ ID NO: 426593 - protein, 10 aa, Mycobacterium
AKVTRDGEPV

SEQ ID NO: 426594 - protein, 13 aa, Mycobacterium
AKWAGSAGVTDPL

SEQ ID NO: 426595 - protein, 18 aa, Mycobacterium
AKWPSRAAASLSTHDLPT

SEQ ID NO: 426596 - protein, 6 aa, Mycobacterium
AKWTDS

SEQ ID NO: 426597 - protein, 9 aa, Mycobacterium
AKYGEGSPF

SEQ ID NO: 426598 - protein, 6 aa, Mycobacterium
AKYGGS

SEQ ID NO: 426599 - protein, 8 aa, Mycobacterium
AKYKDRAP

SEQ ID NO: 426600 - protein, 5 aa, Mycobacterium
AKYPA

SEQ ID NO: 426601 - protein, 5 aa, Mycobacterium
AKYPD

SEQ ID NO: 426602 - protein, 10 aa, Mycobacterium
AKYPDASTPD

SEQ ID NO: 426603 - protein, 11 aa, Mycobacterium
AKYPDGSTPPV

SEQ ID NO: 426604 - protein, 6 aa, Mycobacterium
AKYPDR

SEQ ID NO: 426605 - protein, 9 aa, Mycobacterium
AKYPGIGSG

SEQ ID NO: 426606 - protein, 15 aa, Mycobacterium
AKYQQERDKRLRPDG

SEQ ID NO: 426607 - protein, 8 aa, Mycobacterium
AKYRDEAP

SEQ ID NO: 426608 - protein, 7 aa, Mycobacterium
AKYSPKP

SEQ ID NO: 426609 - protein, 30 aa, Mycobacterium
AKYSSASESQKQALGKPLTGDHNAGTRESG

SEQ ID NO: 426610 - protein, 30 aa, Mycobacterium
AKYSSATQDQKQALGKPLTGDRNAGKRESG

SEQ ID NO: 426611 - protein, 8 aa, Mycobacterium
ALAAANKG

SEQ ID NO: 426612 - protein, 15 aa, Mycobacterium
ALAAATAAAVPGNRL

SEQ ID NO: 426613 - protein, 11 aa, Mycobacterium
ALAADGGADQS

SEQ ID NO: 426614 - protein, 7 aa, Mycobacterium
ALAAETP

SEQ ID NO: 426615 - protein, 5 aa, Mycobacterium
ALAAG

SEQ ID NO: 426616 - protein, 13 aa, Mycobacterium
ALAAGDAPEPPLR

SEQ ID NO: 426617 - protein, 14 aa, Mycobacterium
ALAAGDAPEPPLRT

SEQ ID NO: 426618 - protein, 9 aa, Mycobacterium
ALAAGDPTF

SEQ ID NO: 426619 - protein, 17 aa, Mycobacterium
ALAAGGAAAFARDTRQR

SEQ ID NO: 426620 - protein, 5 aa, Mycobacterium
ALAAK

SEQ ID NO: 426621 - protein, 6 aa, Mycobacterium
ALAAKG

SEQ ID NO: 426622 - protein, 8 aa, Mycobacterium
ALAANPRS

SEQ ID NO: 426623 - protein, 13 aa, Mycobacterium
ALAAPATNGVTGV

SEQ ID NO: 426624 - protein, 12 aa, Mycobacterium
ALAAPGPKRQAT

SEQ ID NO: 426625 - protein, 7 aa, Mycobacterium
ALAASAA

SEQ ID NO: 426626 - protein, 12 aa, Mycobacterium
ALAASDGEMGRG

SEQ ID NO: 426627 - protein, 4 aa, Mycobacterium
ALAD

SEQ ID NO: 426628 - protein, 12 aa, Mycobacterium
ALADAGGPGLPV

SEQ ID NO: 426629 - protein, 6 aa, Mycobacterium
ALADDA

SEQ ID NO: 426630 - protein, 5 aa, Mycobacterium
ALADE

SEQ ID NO: 426631 - protein, 12 aa, Mycobacterium
ALADGDAPEPPL

SEQ ID NO: 426632 - protein, 7 aa, Mycobacterium
ALADGDR

SEQ ID NO: 426633 - protein, 7 aa, Mycobacterium
ALADPDE

SEQ ID NO: 426634 - protein, 12 aa, Mycobacterium
ALADPTAYADDA

SEQ ID NO: 426635 - protein, 20 aa, Mycobacterium
ALADPTSNADPAVDPAEAYS

SEQ ID NO: 426636 - protein, 5 aa, Mycobacterium
ALADR

SEQ ID NO: 426637 - protein, 9 aa, Mycobacterium
ALADSGADG

SEQ ID NO: 426638 - protein, 9 aa, Mycobacterium
ALADTGDGH

SEQ ID NO: 426639 - protein, 21 aa, Mycobacterium
ALAEAAARARQDALTKPRGAL

SEQ ID NO: 426640 - protein, 18 aa, Mycobacterium
ALAEAGKAVAPGVSTDEL

SEQ ID NO: 426641 - protein, 16 aa, Mycobacterium
ALAEAGKAVAPGVTTD

SEQ ID NO: 426642 - protein, 17 aa, Mycobacterium
ALAEAGKAVAPGVTTDE

SEQ ID NO: 426643 - protein, 9 aa, Mycobacterium
ALAEEHSAA

SEQ ID NO: 426644 - protein, 15 aa, Mycobacterium
ALAEESRESGWNKPS

SEQ ID NO: 426645 - protein, 5 aa, Mycobacterium
ALAEG

SEQ ID NO: 426646 - protein, 18 aa, Mycobacterium
ALAEGDEDAQDEDVPDTG

SEQ ID NO: 426647 - protein, 8 aa, Mycobacterium
ALAEGGGQ

SEQ ID NO: 426648 - protein, 6 aa, Mycobacterium
ALAEKG

SEQ ID NO: 426649 - protein, 15 aa, Mycobacterium
ALAEQSARQDAAEQA

SEQ ID NO: 426650 - protein, 6 aa, Mycobacterium
ALAERG

SEQ ID NO: 426651 - protein, 9 aa, Mycobacterium
ALAESKGSI

SEQ ID NO: 426652 - protein, 5 aa, Mycobacterium
ALAGA

SEQ ID NO: 426653 - protein, 13 aa, Mycobacterium
ALAGAAGKETAEY

SEQ ID NO: 426654 - protein, 22 aa, Mycobacterium
ALAGDASRLGRAVGGRGGARRG

SEQ ID NO: 426655 - protein, 13 aa, Mycobacterium
ALAGEDNTTGVSS

SEQ ID NO: 426656 - protein, 8 aa, Mycobacterium
ALAGGGEK

SEQ ID NO: 426657 - protein, 17 aa, Mycobacterium
ALAGGTGGTGGDGGHGA

SEQ ID NO: 426658 - protein, 11 aa, Mycobacterium
ALAGNGDSRVT

SEQ ID NO: 426659 - protein, 5 aa, Mycobacterium
ALAGP

SEQ ID NO: 426660 - protein, 10 aa, Mycobacterium
ALAGPDTNRR

SEQ ID NO: 426661 - protein, 11 aa, Mycobacterium
ALAGPGEEQIR

SEQ ID NO: 426662 - protein, 8 aa, Mycobacterium
ALAGPGGV

SEQ ID NO: 426663 - protein, 6 aa, Mycobacterium
ALAGPQ

SEQ ID NO: 426664 - protein, 7 aa, Mycobacterium
ALAGPRA

SEQ ID NO: 426665 - protein, 32 aa, Mycobacterium
ALAGRAPAKPATELSAEDTAALADAGATRRAT

SEQ ID NO: 426666 - protein, 19 aa, Mycobacterium
ALAGRPPAKPQVELGAEDE

SEQ ID NO: 426667 - protein, 13 aa, Mycobacterium
ALAGSGDEGGADE

SEQ ID NO: 426668 - protein, 13 aa, Mycobacterium
ALAGSGDFSVVGP

SEQ ID NO: 426669 - protein, 8 aa, Mycobacterium
ALAGSGVI

SEQ ID NO: 426670 - protein, 10 aa, Mycobacterium
ALAGSSPTVG

SEQ ID NO: 426671 - protein, 12 aa, Mycobacterium
ALAGTEPAGPLT

SEQ ID NO: 426672 - protein, 15 aa, Mycobacterium
ALAGTEVAELVWEKR

SEQ ID NO: 426673 - protein, 12 aa, Mycobacterium
ALAGTGAGNGDL

SEQ ID NO: 426674 - protein, 13 aa, Mycobacterium
ALAGTTAAAALSP

SEQ ID NO: 426675 - protein, 4 aa, Mycobacterium
ALAH

SEQ ID NO: 426676 - protein, 20 aa, Mycobacterium
ALAKADPATLARVKEYMAAR

SEQ ID NO: 426677 - protein, 6 aa, Mycobacterium
ALAKPG

SEQ ID NO: 426678 - protein, 14 aa, Mycobacterium
ALAKPTTPTQEPNP

SEQ ID NO: 426679 - protein, 7 aa, Mycobacterium
ALAKTKK

SEQ ID NO: 426680 - protein, 8 aa, Mycobacterium
ALAKTKPG

SEQ ID NO: 426681 - protein, 13 aa, Mycobacterium
ALANGDAPEPPLR

SEQ ID NO: 426682 - protein, 6 aa, Mycobacterium
ALANGN

SEQ ID NO: 426683 - protein, 7 aa, Mycobacterium
ALANPGR

SEQ ID NO: 426684 - protein, 8 aa, Mycobacterium
ALANSSGL

SEQ ID NO: 426685 - protein, 6 aa, Mycobacterium
ALAPAA

SEQ ID NO: 426686 - protein, 8 aa, Mycobacterium
ALAPAAGA

SEQ ID NO: 426687 - protein, 9 aa, Mycobacterium
ALAPDERDA

SEQ ID NO: 426688 - protein, 6 aa, Mycobacterium
ALAPDG

SEQ ID NO: 426689 - protein, 7 aa, Mycobacterium
ALAPDGR

SEQ ID NO: 426690 - protein, 6 aa, Mycobacterium
ALAPEG

SEQ ID NO: 426691 - protein, 7 aa, Mycobacterium
ALAPGAA

SEQ ID NO: 426692 - protein, 17 aa, Mycobacterium
ALAPGAAGRRHRDPSFT

SEQ ID NO: 426693 - protein, 6 aa, Mycobacterium
ALAPGG

SEQ ID NO: 426694 - protein, 13 aa, Mycobacterium
ALAPGRFATPEQL

SEQ ID NO: 426695 - protein, 8 aa, Mycobacterium
ALAPGSRA

SEQ ID NO: 426696 - protein, 8 aa, Mycobacterium
ALAPKGAG

SEQ ID NO: 426697 - protein, 5 aa, Mycobacterium
ALAPL

SEQ ID NO: 426698 - protein, 7 aa, Mycobacterium
ALAPPSQ

SEQ ID NO: 426699 - protein, 5 aa, Mycobacterium
ALAPS

SEQ ID NO: 426700 - protein, 7 aa, Mycobacterium
ALAPTVS

SEQ ID NO: 426701 - protein, 6 aa, Mycobacterium
ALAPYA

SEQ ID NO: 426702 - protein, 6 aa, Mycobacterium
ALAQEA

SEQ ID NO: 426703 - protein, 9 aa, Mycobacterium
ALAQEKTGE

SEQ ID NO: 426704 - protein, 14 aa, Mycobacterium
ALAQPPGASPADDN

SEQ ID NO: 426705 - protein, 6 aa, Mycobacterium
ALAQSA

SEQ ID NO: 426706 - protein, 8 aa, Mycobacterium
ALARAATD

SEQ ID NO: 426707 - protein, 8 aa, Mycobacterium
ALAREQER

SEQ ID NO: 426708 - protein, 10 aa, Mycobacterium
ALARPGWSTT

SEQ ID NO: 426709 - protein, 12 aa, Mycobacterium
ALARQDSQAAQE

SEQ ID NO: 426710 - protein, 4 aa, Mycobacterium
ALAS

SEQ ID NO: 426711 - protein, 6 aa, Mycobacterium
ALASDR

SEQ ID NO: 426712 - protein, 11 aa, Mycobacterium
ALASEGGGTPI

SEQ ID NO: 426713 - protein, 8 aa, Mycobacterium
ALASGGPA

SEQ ID NO: 426714 - protein, 10 aa, Mycobacterium
ALASGGTNPI

SEQ ID NO: 426715 - protein, 8 aa, Mycobacterium
ALASHSSP

SEQ ID NO: 426716 - protein, 10 aa, Mycobacterium
ALASNGGAVR

SEQ ID NO: 426717 - protein, 14 aa, Mycobacterium
ALASNGIDTPRIPG

SEQ ID NO: 426718 - protein, 10 aa, Mycobacterium
ALASPGDERE

SEQ ID NO: 426719 - protein, 10 aa, Mycobacterium
ALASPTGTLG

SEQ ID NO: 426720 - protein, 8 aa, Mycobacterium
ALASQSAA

SEQ ID NO: 426721 - protein, 10 aa, Mycobacterium
ALASREPDPL

SEQ ID NO: 426722 - protein, 6 aa, Mycobacterium
ALASRP

SEQ ID NO: 426723 - protein, 6 aa, Mycobacterium
ALASRV

SEQ ID NO: 426724 - protein, 11 aa, Mycobacterium
ALASTNTGSTL

SEQ ID NO: 426725 - protein, 6 aa, Mycobacterium
ALATGN

SEQ ID NO: 426726 - protein, 19 aa, Mycobacterium
ALATSGRPDRFLDIMLAPA

SEQ ID NO: 426727 - protein, 6 aa, Mycobacterium
ALATYT

SEQ ID NO: 426728 - protein, 12 aa, Mycobacterium
ALDADGDDPNNW

SEQ ID NO: 426729 - protein, 9 aa, Mycobacterium
ALDADGNLQ

SEQ ID NO: 426730 - protein, 11 aa, Mycobacterium
ALDAEGDDPAN

SEQ ID NO: 426731 - protein, 9 aa, Mycobacterium
ALDAGDEPF

SEQ ID NO: 426732 - protein, 5 aa, Mycobacterium
ALDAR

SEQ ID NO: 426733 - protein, 12 aa, Mycobacterium
ALDASGDDPNNW

SEQ ID NO: 426734 - protein, 11 aa, Mycobacterium
ALDASGDGELV

SEQ ID NO: 426735 - protein, 17 aa, Mycobacterium
ALDASRTGHATGKIVVV

SEQ ID NO: 426736 - protein, 21 aa, Mycobacterium
ALDATPPPTPRRALADVLRPA

SEQ ID NO: 426737 - protein, 4 aa, Mycobacterium
ALDD

SEQ ID NO: 426738 - protein, 7 aa, Mycobacterium
ALDDADG

SEQ ID NO: 426739 - protein, 12 aa, Mycobacterium
ALDDAGLSAEQV

SEQ ID NO: 426740 - protein, 7 aa, Mycobacterium
ALDDDEI

SEQ ID NO: 426741 - protein, 8 aa, Mycobacterium
ALDDEQRQ

SEQ ID NO: 426742 - protein, 5 aa, Mycobacterium
ALDDG

SEQ ID NO: 426743 - protein, 10 aa, Mycobacterium
ALDDGDAEAA

SEQ ID NO: 426744 - protein, 10 aa, Mycobacterium
ALDDGDEPFG

SEQ ID NO: 426745 - protein, 9 aa, Mycobacterium
ALDDPAERT

SEQ ID NO: 426746 - protein, 13 aa, Mycobacterium
ALDDQSPKHTTDF

SEQ ID NO: 426747 - protein, 6 aa, Mycobacterium
ALDDRA

SEQ ID NO: 426748 - protein, 14 aa, Mycobacterium
ALDDSKKLNESERE

SEQ ID NO: 426749 - protein, 9 aa, Mycobacterium
ALDEAGLRA

SEQ ID NO: 426750 - protein, 9 aa, Mycobacterium
ALDEDDADK

SEQ ID NO: 426751 - protein, 8 aa, Mycobacterium
ALDEDEVG

SEQ ID NO: 426752 - protein, 8 aa, Mycobacterium
ALDEDSPH

SEQ ID NO: 426753 - protein, 14 aa, Mycobacterium
ALDEDTPGLNPDYG

SEQ ID NO: 426754 - protein, 10 aa, Mycobacterium
ALDEGADRAE

SEQ ID NO: 426755 - protein, 9 aa, Mycobacterium
ALDEGAGVD

SEQ ID NO: 426756 - protein, 28 aa, Mycobacterium
ALDEGRVRRPQPGKRRTDGRHGDADADL

SEQ ID NO: 426757 - protein, 9 aa, Mycobacterium
ALDEGSPDV

SEQ ID NO: 426758 - protein, 7 aa, Mycobacterium
ALDEPAA

SEQ ID NO: 426759 - protein, 8 aa, Mycobacterium
ALDEPGSG

SEQ ID NO: 426760 - protein, 7 aa, Mycobacterium
ALDEPID

SEQ ID NO: 426761 - protein, 5 aa, Mycobacterium
ALDET

SEQ ID NO: 426762 - protein, 7 aa, Mycobacterium
ALDETGC

SEQ ID NO: 426763 - protein, 10 aa, Mycobacterium
ALDGAAGSRA

SEQ ID NO: 426764 - protein, 8 aa, Mycobacterium
ALDGDPAG

SEQ ID NO: 426765 - protein, 8 aa, Mycobacterium
ALDGDVGR

SEQ ID NO: 426766 - protein, 8 aa, Mycobacterium
ALDGEPVG

SEQ ID NO: 426767 - protein, 10 aa, Mycobacterium
ALDGEQNLAG

SEQ ID NO: 426768 - protein, 5 aa, Mycobacterium
ALDGG

SEQ ID NO: 426769 - protein, 7 aa, Mycobacterium
ALDGGAA

SEQ ID NO: 426770 - protein, 7 aa, Mycobacterium
ALDGGPP

SEQ ID NO: 426771 - protein, 8 aa, Mycobacterium
ALDGPDGP

SEQ ID NO: 426772 - protein, 6 aa, Mycobacterium
ALDGQE

SEQ ID NO: 426773 - protein, 31 aa, Mycobacterium
ALDGRGPVKPEQPLTADDEKALATPGAERQA

SEQ ID NO: 426774 - protein, 8 aa, Mycobacterium
ALDGSSVT

SEQ ID NO: 426775 - protein, 9 aa, Mycobacterium
ALDGSVGDE

SEQ ID NO: 426776 - protein, 21 aa, Mycobacterium
ALDGTPPPTPRRALADVLRRK

SEQ ID NO: 426777 - protein, 9 aa, Mycobacterium
ALDKGGPGI

SEQ ID NO: 426778 - protein, 6 aa, Mycobacterium
ALDKPG

SEQ ID NO: 426779 - protein, 10 aa, Mycobacterium
ALDNDDPDKV

SEQ ID NO: 426780 - protein, 5 aa, Mycobacterium
ALDNG

SEQ ID NO: 426781 - protein, 4 aa, Mycobacterium
ALDP

SEQ ID NO: 426782 - protein, 7 aa, Mycobacterium
ALDPASD

SEQ ID NO: 426783 - protein, 8 aa, Mycobacterium
ALDPATGS

SEQ ID NO: 426784 - protein, 6 aa, Mycobacterium
ALDPDA

SEQ ID NO: 426785 - protein, 7 aa, Mycobacterium
ALDPDAA

SEQ ID NO: 426786 - protein, 12 aa, Mycobacterium
ALDPDGEDTTMP

SEQ ID NO: 426787 - protein, 11 aa, Mycobacterium
ALDPDGPAQRR

SEQ ID NO: 426788 - protein, 10 aa, Mycobacterium
ALDPDPGKPS

SEQ ID NO: 426789 - protein, 6 aa, Mycobacterium
ALDPES

SEQ ID NO: 426790 - protein, 8 aa, Mycobacterium
ALDPGEPF

SEQ ID NO: 426791 - protein, 8 aa, Mycobacterium
ALDPGKLP

SEQ ID NO: 426792 - protein, 14 aa, Mycobacterium
ALDPGPDGAPTSAS

SEQ ID NO: 426793 - protein, 14 aa, Mycobacterium
ALDPGSVPAATPAV

SEQ ID NO: 426794 - protein, 6 aa, Mycobacterium
ALDPQG

SEQ ID NO: 426795 - protein, 10 aa, Mycobacterium
ALDPQTYDPK

SEQ ID NO: 426796 - protein, 6 aa, Mycobacterium
ALDPRD

SEQ ID NO: 426797 - protein, 8 aa, Mycobacterium
ALDPRRTA

SEQ ID NO: 426798 - protein, 6 aa, Mycobacterium
ALDPSR

SEQ ID NO: 426799 - protein, 6 aa, Mycobacterium
ALDPTA

SEQ ID NO: 426800 - protein, 7 aa, Mycobacterium
ALDPTGR

SEQ ID NO: 426801 - protein, 14 aa, Mycobacterium
ALDPTGYLNPAVLF

SEQ ID NO: 426802 - protein, 8 aa, Mycobacterium
ALDQDTSM

SEQ ID NO: 426803 - protein, 6 aa, Mycobacterium
ALDQHG

SEQ ID NO: 426804 - protein, 17 aa, Mycobacterium
ALDQTARDRNIRRRSRE

SEQ ID NO: 426805 - protein, 14 aa, Mycobacterium
ALDRAGRNRDIRRR

SEQ ID NO: 426806 - protein, 10 aa, Mycobacterium
ALDRDGPKIA

SEQ ID NO: 426807 - protein, 15 aa, Mycobacterium
ALDRGDGTARRSFPG

SEQ ID NO: 426808 - protein, 21 aa, Mycobacterium
ALDRGQAALTGPVARGDGAAI

SEQ ID NO: 426809 - protein, 17 aa, Mycobacterium
ALDRTRKSLRENGNLSS

SEQ ID NO: 426810 - protein, 10 aa, Mycobacterium
ALDSDGVDLS

SEQ ID NO: 426811 - protein, 598 aa, Mycobacterium
ALDSGAGAQGGGIPSTTGVPGADGGKGGTGGTAGAAGVGVDGGAAGSIGAGGVGGTGGNGGAGADNDVNGTSGTAPTAGGQGGQGGQGGQGGDGGSGIGGVGGGAGGHGGIGGSGGAGSNGGNNTGSTGGVGADGGKGGTGGTAGAAGVGVDGGAAGSIGTGGVGGTGGNGGAGADNDVNGTSGTAPTAGGQGGQGGQGGQGGDGGSGIGGVGGGAGGHGGVGGSGGAGSNGGNNTGSTGGVGADGGKGGTGGTAGAAGVGVDGGAAGSIGTGGVGGQGGDGGSGGTGALGADGTNPTGGGRGGQGGQGGQGGDGGSGIGGVGGGAGGHGGVGGSGGTGGTGGSNTASTGGVGADGGKGGTGGTAGAAGVGVDGGAAGSIGTGGVGGTGGEGGSGGTGVAGASGITPAVGGPGGQGGAGGTGGDGGAGIDGVGGGAGGQGGQGGAGGNGGMGGTYTGTGPGSSASGGTGGAGGAGGDGGAPGAGSTTGGVGGNGGKGGNGGFGAGNSSGSSAGFGFGGGGGGGGAGGHGGNGGGGGASGGQGGAGGDGGLGGTAVSPTTGSAAGGGFGGGGGGGGNATGAAGGTGGGGGGGGAGAAAA

SEQ ID NO: 426812 - protein, 8 aa, Mycobacterium
ALDSGGPG

SEQ ID NO: 426813 - protein, 9 aa, Mycobacterium
ALDSGKPVR

SEQ ID NO: 426814 - protein, 9 aa, Mycobacterium
ALDSGSPVR

SEQ ID NO: 426815 - protein, 10 aa, Mycobacterium
ALDSNPADRV

SEQ ID NO: 426816 - protein, 8 aa, Mycobacterium
ALDSSARA

SEQ ID NO: 426817 - protein, 16 aa, Mycobacterium
ALDSSGGDTGAAAREL

SEQ ID NO: 426818 - protein, 7 aa, Mycobacterium
ALDSTGD

SEQ ID NO: 426819 - protein, 6 aa, Mycobacterium
ALDSTS

SEQ ID NO: 426820 - protein, 10 aa, Mycobacterium
ALDTDDPDKV

SEQ ID NO: 426821 - protein, 14 aa, Mycobacterium
ALDVPPSPPAACHN

SEQ ID NO: 426822 - protein, 5 aa, Mycobacterium
ALEAA

SEQ ID NO: 426823 - protein, 11 aa, Mycobacterium
ALEAPAGDIAA

SEQ ID NO: 426824 - protein, 16 aa, Mycobacterium
ALEAQKGWAATNPQRR

SEQ ID NO: 426825 - protein, 9 aa, Mycobacterium
ALEARKPHP

SEQ ID NO: 426826 - protein, 8 aa, Mycobacterium
ALEATDDA

SEQ ID NO: 426827 - protein, 13 aa, Mycobacterium
ALEATKPAPLAAD

SEQ ID NO: 426828 - protein, 5 aa, Mycobacterium
ALEDD

SEQ ID NO: 426829 - protein, 10 aa, Mycobacterium
ALEEGAEATE

SEQ ID NO: 426830 - protein, 11 aa, Mycobacterium
ALEEGAQATEL

SEQ ID NO: 426831 - protein, 6 aa, Mycobacterium
ALEEGR

SEQ ID NO: 426832 - protein, 8 aa, Mycobacterium
ALEESKGA

SEQ ID NO: 426833 - protein, 9 aa, Mycobacterium
ALEGAAPRG

SEQ ID NO: 426834 - protein, 6 aa, Mycobacterium
ALEGAG

SEQ ID NO: 426835 - protein, 7 aa, Mycobacterium
ALEGDEK

SEQ ID NO: 426836 - protein, 11 aa, Mycobacterium
ALEGDTDLPGA

SEQ ID NO: 426837 - protein, 11 aa, Mycobacterium
ALEGEAEAFSG

SEQ ID NO: 426838 - protein, 16 aa, Mycobacterium
ALEGGGYRPRHRERPV

SEQ ID NO: 426839 - protein, 10 aa, Mycobacterium
ALEGGPHGVT

SEQ ID NO: 426840 - protein, 13 aa, Mycobacterium
ALEGNGSPQESSP

SEQ ID NO: 426841 - protein, 6 aa, Mycobacterium
ALEGPA

SEQ ID NO: 426842 - protein, 5 aa, Mycobacterium
ALEGS

SEQ ID NO: 426843 - protein, 30 aa, Mycobacterium
ALEGTSAAAAAALGPTALTAAGSALPAAAT

SEQ ID NO: 426844 - protein, 12 aa, Mycobacterium
ALEISTESVHPP

SEQ ID NO: 426845 - protein, 8 aa, Mycobacterium
ALEKAGYG

SEQ ID NO: 426846 - protein, 23 aa, Mycobacterium
ALEKGAKALTGGKRPEDGGSFYP

SEQ ID NO: 426847 - protein, 10 aa, Mycobacterium
ALEKGSNKRF

SEQ ID NO: 426848 - protein, 11 aa, Mycobacterium
ALEKGSNKRFA

SEQ ID NO: 426849 - protein, 4 aa, Mycobacterium
ALEN

SEQ ID NO: 426850 - protein, 8 aa, Mycobacterium
ALENEGKP

SEQ ID NO: 426851 - protein, 6 aa, Mycobacterium
ALEPAD

SEQ ID NO: 426852 - protein, 5 aa, Mycobacterium
ALEPD

SEQ ID NO: 426853 - protein, 6 aa, Mycobacterium
ALEPGE

SEQ ID NO: 426854 - protein, 8 aa, Mycobacterium
ALEPGNPE

SEQ ID NO: 426855 - protein, 10 aa, Mycobacterium
ALEPGPDGRE

SEQ ID NO: 426856 - protein, 6 aa, Mycobacterium
ALEPGR

SEQ ID NO: 426857 - protein, 8 aa, Mycobacterium
ALEPGRPL

SEQ ID NO: 426858 - protein, 6 aa, Mycobacterium
ALEPGT

SEQ ID NO: 426859 - protein, 6 aa, Mycobacterium
ALEPLE

SEQ ID NO: 426860 - protein, 5 aa, Mycobacterium
ALEPQ

SEQ ID NO: 426861 - protein, 7 aa, Mycobacterium
ALEPRPE

SEQ ID NO: 426862 - protein, 6 aa, Mycobacterium
ALEPTL

SEQ ID NO: 426863 - protein, 5 aa, Mycobacterium
ALEQA

SEQ ID NO: 426864 - protein, 7 aa, Mycobacterium
ALEQGKG

SEQ ID NO: 426865 - protein, 7 aa, Mycobacterium
ALEQGRR

SEQ ID NO: 426866 - protein, 6 aa, Mycobacterium
ALEQQH

SEQ ID NO: 426867 - protein, 4 aa, Mycobacterium
ALER

SEQ ID NO: 426868 - protein, 7 aa, Mycobacterium
ALERAAS

SEQ ID NO: 426869 - protein, 7 aa, Mycobacterium
ALERAKG

SEQ ID NO: 426870 - protein, 14 aa, Mycobacterium
ALERGRTTKEKSDA

SEQ ID NO: 426871 - protein, 18 aa, Mycobacterium
ALERNGYDGGWTAETSHD

SEQ ID NO: 426872 - protein, 20 aa, Mycobacterium
ALERSTRRSSMDDIPTAQPA

SEQ ID NO: 426873 - protein, 9 aa, Mycobacterium
ALESDRPTV

SEQ ID NO: 426874 - protein, 14 aa, Mycobacterium
ALESGRSVSETAGM

SEQ ID NO: 426875 - protein, 19 aa, Mycobacterium
ALESNARAVQHGAAAGAYS

SEQ ID NO: 426876 - protein, 10 aa, Mycobacterium
ALESSDDATL

SEQ ID NO: 426877 - protein, 10 aa, Mycobacterium
ALESTDDPKL

SEQ ID NO: 426878 - protein, 10 aa, Mycobacterium
ALESTDDTAL

SEQ ID NO: 426879 - protein, 9 aa, Mycobacterium
ALESTRAAY

SEQ ID NO: 426880 - protein, 5 aa, Mycobacterium
ALETG

SEQ ID NO: 426881 - protein, 8 aa, Mycobacterium
ALETNRPL

SEQ ID NO: 426882 - protein, 10 aa, Mycobacterium
ALEVNGSKRT

SEQ ID NO: 426883 - protein, 5 aa, Mycobacterium
ALGAA

SEQ ID NO: 426884 - protein, 6 aa, Mycobacterium
ALGAAG

SEQ ID NO: 426885 - protein, 15 aa, Mycobacterium
ALGAAGGDKAETGLQ

SEQ ID NO: 426886 - protein, 14 aa, Mycobacterium
ALGAAGGGAAETGL

SEQ ID NO: 426887 - protein, 9 aa, Mycobacterium
ALGAASALT

SEQ ID NO: 426888 - protein, 8 aa, Mycobacterium
ALGAASGD

SEQ ID NO: 426889 - protein, 7 aa, Mycobacterium
ALGAGDA

SEQ ID NO: 426890 - protein, 8 aa, Mycobacterium
ALGAGDKG

SEQ ID NO: 426891 - protein, 19 aa, Mycobacterium
ALGAGGTGKGAATALRGSA

SEQ ID NO: 426892 - protein, 21 aa, Mycobacterium
ALGAGGTGKGTAGTMRGAAGA

SEQ ID NO: 426893 - protein, 10 aa, Mycobacterium
ALGAKGGEGL

SEQ ID NO: 426894 - protein, 5 aa, Mycobacterium
ALGAP

SEQ ID NO: 426895 - protein, 7 aa, Mycobacterium
ALGAPKS

SEQ ID NO: 426896 - protein, 18 aa, Mycobacterium
ALGAPSNPVSKPLPGRLP

SEQ ID NO: 426897 - protein, 5 aa, Mycobacterium
ALGAR

SEQ ID NO: 426898 - protein, 9 aa, Mycobacterium
ALGDASPAR

SEQ ID NO: 426899 - protein, 10 aa, Mycobacterium
ALGDDGEAQR

SEQ ID NO: 426900 - protein, 11 aa, Mycobacterium
ALGDDGESQRY

SEQ ID NO: 426901 - protein, 7 aa, Mycobacterium
ALGDDQS

SEQ ID NO: 426902 - protein, 8 aa, Mycobacterium
ALGDDRAD

SEQ ID NO: 426903 - protein, 6 aa, Mycobacterium
ALGDDS

SEQ ID NO: 426904 - protein, 5 aa, Mycobacterium
ALGDE

SEQ ID NO: 426905 - protein, 6 aa, Mycobacterium
ALGDEG

SEQ ID NO: 426906 - protein, 12 aa, Mycobacterium
ALGDGNEARSLT

SEQ ID NO: 426907 - protein, 10 aa, Mycobacterium
ALGDKKGIRR

SEQ ID NO: 426908 - protein, 22 aa, Mycobacterium
ALGDLGEGEVDADGQPPLTAKG

SEQ ID NO: 426909 - protein, 9 aa, Mycobacterium
ALGDPADMA

SEQ ID NO: 426910 - protein, 9 aa, Mycobacterium
ALGDPADVA

SEQ ID NO: 426911 - protein, 12 aa, Mycobacterium
ALGDPQRWPGPR

SEQ ID NO: 426912 - protein, 12 aa, Mycobacterium
ALGDSVTGFDPN

SEQ ID NO: 426913 - protein, 12 aa, Mycobacterium
ALGDYDGAAELD

SEQ ID NO: 426914 - protein, 4 aa, Mycobacterium
ALGE

SEQ ID NO: 426915 - protein, 13 aa, Mycobacterium
ALGEATAAAAAPT

SEQ ID NO: 426916 - protein, 9 aa, Mycobacterium
ALGEDATAR

SEQ ID NO: 426917 - protein, 8 aa, Mycobacterium
ALGEDPAT

SEQ ID NO: 426918 - protein, 5 aa, Mycobacterium
ALGEG

SEQ ID NO: 426919 - protein, 224 aa, Mycobacterium
ALGEGGTNGYIGGNGGNGGAGGAALGGGAAGDGGQGGHGGAGGMGGAGANGITGGGVTGAGGNGGDGGQGGEPGTGGAAGSGGGGQTGSLGIGGTGGHGGAGGDGTPGGNGAAGPTAGTGDPGVDGGAGGNGGAGGQGGSNGTGGDGGTGGSGATGGDGGTGGAGTATDAGGTGGQGGVGGAGGAPGAAGLAGTGGQAGNEGVGGNGGQGGHGGAGGNGVDGAD

SEQ ID NO: 426920 - protein, 5 aa, Mycobacterium
ALGEK

SEQ ID NO: 426921 - protein, 10 aa, Mycobacterium
ALGENGNGGM

SEQ ID NO: 426922 - protein, 13 aa, Mycobacterium
ALGENGSAGTNPM

SEQ ID NO: 426923 - protein, 10 aa, Mycobacterium
ALGGAAGDTL

SEQ ID NO: 426924 - protein, 10 aa, Mycobacterium
ALGGAGPVSR

SEQ ID NO: 426925 - protein, 11 aa, Mycobacterium
ALGGAPPERSR

SEQ ID NO: 426926 - protein, 6 aa, Mycobacterium
ALGGDP

SEQ ID NO: 426927 - protein, 6 aa, Mycobacterium
ALGGGA

SEQ ID NO: 426928 - protein, 8 aa, Mycobacterium
ALGGGAEV

SEQ ID NO: 426929 - protein, 9 aa, Mycobacterium
ALGGGDEAR

SEQ ID NO: 426930 - protein, 21 aa, Mycobacterium
ALGGGLPRPAPNPSGRSAGSR

SEQ ID NO: 426931 - protein, 8 aa, Mycobacterium
ALGGKENL

SEQ ID NO: 426932 - protein, 6 aa, Mycobacterium
ALGGKV

SEQ ID NO: 426933 - protein, 6 aa, Mycobacterium
ALGGLN

SEQ ID NO: 426934 - protein, 5 aa, Mycobacterium
ALGGN

SEQ ID NO: 426935 - protein, 13 aa, Mycobacterium
ALGGNERARERHV

SEQ ID NO: 426936 - protein, 7 aa, Mycobacterium
ALGGNSH

SEQ ID NO: 426937 - protein, 7 aa, Mycobacterium
ALGGPAA

SEQ ID NO: 426938 - protein, 8 aa, Mycobacterium
ALGGPAAL

SEQ ID NO: 426939 - protein, 6 aa, Mycobacterium
ALGGPE

SEQ ID NO: 426940 - protein, 10 aa, Mycobacterium
ALGGPEYGSP

SEQ ID NO: 426941 - protein, 26 aa, Mycobacterium
ALGGPGSIRYEPTDVTNEEEAARAVD

SEQ ID NO: 426942 - protein, 18 aa, Mycobacterium
ALGGQPPATRIPNLSGQY

SEQ ID NO: 426943 - protein, 18 aa, Mycobacterium
ALGGQPPATRVPNLSGQY

SEQ ID NO: 426944 - protein, 7 aa, Mycobacterium
ALGGQSS

SEQ ID NO: 426945 - protein, 5 aa, Mycobacterium
ALGGR

SEQ ID NO: 426946 - protein, 7 aa, Mycobacterium
ALGGRPV

SEQ ID NO: 426947 - protein, 9 aa, Mycobacterium
ALGGTGPLA

SEQ ID NO: 426948 - protein, 11 aa, Mycobacterium
ALGGTYARKQT

SEQ ID NO: 426949 - protein, 10 aa, Mycobacterium
ALGKAGGETA

SEQ ID NO: 426950 - protein, 10 aa, Mycobacterium
ALGKDGVSSN

SEQ ID NO: 426951 - protein, 11 aa, Mycobacterium
ALGKPKPKDYL

SEQ ID NO: 426952 - protein, 7 aa, Mycobacterium
ALGNAGR

SEQ ID NO: 426953 - protein, 17 aa, Mycobacterium
ALGNGQADTERDDQAAD

SEQ ID NO: 426954 - protein, 7 aa, Mycobacterium
ALGNGYQ

SEQ ID NO: 426955 - protein, 6 aa, Mycobacterium
ALGNNT

SEQ ID NO: 426956 - protein, 7 aa, Mycobacterium
ALGNSGF

SEQ ID NO: 426957 - protein, 9 aa, Mycobacterium
ALGNTATVA

SEQ ID NO: 426958 - protein, 9 aa, Mycobacterium
ALGPADDVY

SEQ ID NO: 426959 - protein, 8 aa, Mycobacterium
ALGPADDY

SEQ ID NO: 426960 - protein, 10 aa, Mycobacterium
ALGPDEAGMT

SEQ ID NO: 426961 - protein, 17 aa, Mycobacterium
ALGPDEQDAHAGAAGRP

SEQ ID NO: 426962 - protein, 19 aa, Mycobacterium
ALGPDEQDAHAGSAGRPVA

SEQ ID NO: 426963 - protein, 11 aa, Mycobacterium
ALGPDSAADAL

SEQ ID NO: 426964 - protein, 10 aa, Mycobacterium
ALGPDTDPDV

SEQ ID NO: 426965 - protein, 19 aa, Mycobacterium
ALGPGAAFRPTDVSDPEQV

SEQ ID NO: 426966 - protein, 10 aa, Mycobacterium
ALGPGAEPPD

SEQ ID NO: 426967 - protein, 11 aa, Mycobacterium
ALGPGAGHRGA

SEQ ID NO: 426968 - protein, 7 aa, Mycobacterium
ALGPGER

SEQ ID NO: 426969 - protein, 13 aa, Mycobacterium
ALGPGGLTRDRAG

SEQ ID NO: 426970 - protein, 20 aa, Mycobacterium
ALGPHGGNAAVYAPKAALGH

SEQ ID NO: 426971 - protein, 5 aa, Mycobacterium
ALGPI

SEQ ID NO: 426972 - protein, 7 aa, Mycobacterium
ALGPNAD

SEQ ID NO: 426973 - protein, 17 aa, Mycobacterium
ALGPQPPDFSASPILRV

SEQ ID NO: 426974 - protein, 8 aa, Mycobacterium
ALGPSAAE

SEQ ID NO: 426975 - protein, 8 aa, Mycobacterium
ALGPSAPL

SEQ ID NO: 426976 - protein, 17 aa, Mycobacterium
ALGPTEPPDPETAAAVK

SEQ ID NO: 426977 - protein, 13 aa, Mycobacterium
ALGPTGAAEGGFN

SEQ ID NO: 426978 - protein, 19 aa, Mycobacterium
ALGQDAHQGHLDDQTVAAA

SEQ ID NO: 426979 - protein, 5 aa, Mycobacterium
ALGQG

SEQ ID NO: 426980 - protein, 7 aa, Mycobacterium
ALGQGAY

SEQ ID NO: 426981 - protein, 9 aa, Mycobacterium
ALGQGEYSD

SEQ ID NO: 426982 - protein, 8 aa, Mycobacterium
ALGQPAKQ

SEQ ID NO: 426983 - protein, 8 aa, Mycobacterium
ALGQTGAL

SEQ ID NO: 426984 - protein, 8 aa, Mycobacterium
ALGRGDIG

SEQ ID NO: 426985 - protein, 6 aa, Mycobacterium
ALGRGK

SEQ ID NO: 426986 - protein, 40 aa, Mycobacterium
ALGRGPEPADTGDERTPWQSDYTRGRHSDGEAGADDHQTR

SEQ ID NO: 426987 - protein, 5 aa, Mycobacterium
ALGRP

SEQ ID NO: 426988 - protein, 7 aa, Mycobacterium
ALGRRDL

SEQ ID NO: 426989 - protein, 11 aa, Mycobacterium
ALGRRGAAAGY

SEQ ID NO: 426990 - protein, 11 aa, Mycobacterium
ALGRRGAAGGY

SEQ ID NO: 426991 - protein, 4 aa, Mycobacterium
ALGS

SEQ ID NO: 426992 - protein, 16 aa, Mycobacterium
ALGSADDGLELSTEAG

SEQ ID NO: 426993 - protein, 9 aa, Mycobacterium
ALGSADSIG

SEQ ID NO: 426994 - protein, 6 aa, Mycobacterium
ALGSAQ

SEQ ID NO: 426995 - protein, 10 aa, Mycobacterium
ALGSGGPTVV

SEQ ID NO: 426996 - protein, 11 aa, Mycobacterium
ALGSGGRSVTS

SEQ ID NO: 426997 - protein, 71 aa, Mycobacterium
ALGSGQDGAEGAGGNGGRGEVGGLPGNGGDGGNGALGGGAGGNGGNGGNPGDSGTGGAGGTGSTTGMNGVS

SEQ ID NO: 426998 - protein, 6 aa, Mycobacterium
ALGSKD

SEQ ID NO: 426999 - protein, 15 aa, Mycobacterium
ALGSLPKDQRAEAGK

SEQ ID NO: 427000 - protein, 11 aa, Mycobacterium
ALGSNGSTSMG

SEQ ID NO: 427001 - protein, 8 aa, Mycobacterium
ALGSPRAR

SEQ ID NO: 427002 - protein, 9 aa, Mycobacterium
ALGSPTPRD

SEQ ID NO: 427003 - protein, 8 aa, Mycobacterium
ALGSQGGA

SEQ ID NO: 427004 - protein, 9 aa, Mycobacterium
ALGSRSERR

SEQ ID NO: 427005 - protein, 7 aa, Mycobacterium
ALGSRTV

SEQ ID NO: 427006 - protein, 10 aa, Mycobacterium
ALGSSDVDRD

SEQ ID NO: 427007 - protein, 13 aa, Mycobacterium
ALGSSSPHDAPAD

SEQ ID NO: 427008 - protein, 7 aa, Mycobacterium
ALGSTDD

SEQ ID NO: 427009 - protein, 7 aa, Mycobacterium
ALGSTSA

SEQ ID NO: 427010 - protein, 17 aa, Mycobacterium
ALGSTYDGKRTGSFGDT

SEQ ID NO: 427011 - protein, 13 aa, Mycobacterium
ALGSYADPAWAAE

SEQ ID NO: 427012 - protein, 18 aa, Mycobacterium
ALGSYADPEWATTEGWPG

SEQ ID NO: 427013 - protein, 4 aa, Mycobacterium
ALGT

SEQ ID NO: 427014 - protein, 6 aa, Mycobacterium
ALGTAA

SEQ ID NO: 427015 - protein, 12 aa, Mycobacterium
ALGTDAKHARQA

SEQ ID NO: 427016 - protein, 7 aa, Mycobacterium
ALGTEGT

SEQ ID NO: 427017 - protein, 10 aa, Mycobacterium
ALGTESHARE

SEQ ID NO: 427018 - protein, 11 aa, Mycobacterium
ALGTGGGIANV

SEQ ID NO: 427019 - protein, 7 aa, Mycobacterium
ALGTGLT

SEQ ID NO: 427020 - protein, 10 aa, Mycobacterium
ALGTGSTGRR

SEQ ID NO: 427021 - protein, 6 aa, Mycobacterium
ALGTKD

SEQ ID NO: 427022 - protein, 34 aa, Mycobacterium
ALGTSEAAARQLASRARKAVAAEPPPEPDPSHNE

SEQ ID NO: 427023 - protein, 7 aa, Mycobacterium
ALGTTSD

SEQ ID NO: 427024 - protein, 25 aa, Mycobacterium
ALGVKGKKKADSKASSSSKDSAGSE

SEQ ID NO: 427025 - protein, 10 aa, Mycobacterium
ALGVSQSTLS

SEQ ID NO: 427026 - protein, 11 aa, Mycobacterium
ALGVSQSTLSQ

SEQ ID NO: 427027 - protein, 11 aa, Mycobacterium
ALGVTGKQLDA

SEQ ID NO: 427028 - protein, 10 aa, Mycobacterium
ALHAPASARV

SEQ ID NO: 427029 - protein, 7 aa, Mycobacterium
ALHPGNV

SEQ ID NO: 427030 - protein, 8 aa, Mycobacterium
ALKAGKGV

SEQ ID NO: 427031 - protein, 28 aa, Mycobacterium
ALKDPSYRLKTTNAEQIASRSDPWDPTS

SEQ ID NO: 427032 - protein, 9 aa, Mycobacterium
ALKDRAGRV

SEQ ID NO: 427033 - protein, 10 aa, Mycobacterium
ALKDSSGDLD

SEQ ID NO: 427034 - protein, 5 aa, Mycobacterium
ALKEH

SEQ ID NO: 427035 - protein, 13 aa, Mycobacterium
ALKGDGGSSWGNQ

SEQ ID NO: 427036 - protein, 10 aa, Mycobacterium
ALKGKIADSL

SEQ ID NO: 427037 - protein, 7 aa, Mycobacterium
ALKGPAT

SEQ ID NO: 427038 - protein, 11 aa, Mycobacterium
ALKGRGLRPGD

SEQ ID NO: 427039 - protein, 13 aa, Mycobacterium
ALKKGSGKQEVAT

SEQ ID NO: 427040 - protein, 13 aa, Mycobacterium
ALKPAGSLTAPMP

SEQ ID NO: 427041 - protein, 5 aa, Mycobacterium
ALKPD

SEQ ID NO: 427042 - protein, 5 aa, Mycobacterium
ALKPQ

SEQ ID NO: 427043 - protein, 11 aa, Mycobacterium
ALKPSVQPEQV

SEQ ID NO: 427044 - protein, 11 aa, Mycobacterium
ALKQGSAERGV

SEQ ID NO: 427045 - protein, 14 aa, Mycobacterium
ALKSGDAASGLNGI

SEQ ID NO: 427046 - protein, 11 aa, Mycobacterium
ALKTHGGAPAI

SEQ ID NO: 427047 - protein, 12 aa, Mycobacterium
ALLNPGNLPHSR

SEQ ID NO: 427048 - protein, 4 aa, Mycobacterium
ALLP

SEQ ID NO: 427049 - protein, 10 aa, Mycobacterium
ALNADGGQCT

SEQ ID NO: 427050 - protein, 10 aa, Mycobacterium
ALNAERRAAE

SEQ ID NO: 427051 - protein, 7 aa, Mycobacterium
ALNAGKG

SEQ ID NO: 427052 - protein, 9 aa, Mycobacterium
ALNAGPSRD

SEQ ID NO: 427053 - protein, 8 aa, Mycobacterium
ALNAPDFG

SEQ ID NO: 427054 - protein, 13 aa, Mycobacterium
ALNASGDDTVRTR

SEQ ID NO: 427055 - protein, 4 aa, Mycobacterium
ALNE

SEQ ID NO: 427056 - protein, 5 aa, Mycobacterium
ALNEV

SEQ ID NO: 427057 - protein, 10 aa, Mycobacterium
ALNGATEEAR

SEQ ID NO: 427058 - protein, 10 aa, Mycobacterium
ALNKPSNSDI

SEQ ID NO: 427059 - protein, 11 aa, Mycobacterium
ALNNDGATKMT

SEQ ID NO: 427060 - protein, 4 aa, Mycobacterium
ALNP

SEQ ID NO: 427061 - protein, 8 aa, Mycobacterium
ALNPAKPL

SEQ ID NO: 427062 - protein, 5 aa, Mycobacterium
ALNPE

SEQ ID NO: 427063 - protein, 7 aa, Mycobacterium
ALNPYRG

SEQ ID NO: 427064 - protein, 8 aa, Mycobacterium
ALNQAAKE

SEQ ID NO: 427065 - protein, 20 aa, Mycobacterium
ALNQDGRSAGLAAPSSAAQR

SEQ ID NO: 427066 - protein, 20 aa, Mycobacterium
ALNQDGRTTGLTAPSGAAQE

SEQ ID NO: 427067 - protein, 4 aa, Mycobacterium
ALNS

SEQ ID NO: 427068 - protein, 7 aa, Mycobacterium
ALNSAED

SEQ ID NO: 427069 - protein, 6 aa, Mycobacterium
ALNSGR

SEQ ID NO: 427070 - protein, 9 aa, Mycobacterium
ALNTAEPAD

SEQ ID NO: 427071 - protein, 5 aa, Mycobacterium
ALNTE

SEQ ID NO: 427072 - protein, 5 aa, Mycobacterium
ALPAA

SEQ ID NO: 427073 - protein, 12 aa, Mycobacterium
ALPADDNGDSPH

SEQ ID NO: 427074 - protein, 8 aa, Mycobacterium
ALPADGHS

SEQ ID NO: 427075 - protein, 11 aa, Mycobacterium
ALPADTPDRSV

SEQ ID NO: 427076 - protein, 13 aa, Mycobacterium
ALPADVNAPSGEA

SEQ ID NO: 427077 - protein, 5 aa, Mycobacterium
ALPAG

SEQ ID NO: 427078 - protein, 17 aa, Mycobacterium
ALPAGAAASESIADSAV

SEQ ID NO: 427079 - protein, 9 aa, Mycobacterium
ALPAGPDAA

SEQ ID NO: 427080 - protein, 6 aa, Mycobacterium
ALPAGQ

SEQ ID NO: 427081 - protein, 6 aa, Mycobacterium
ALPAGS

SEQ ID NO: 427082 - protein, 9 aa, Mycobacterium
ALPAGSAHR

SEQ ID NO: 427083 - protein, 6 aa, Mycobacterium
ALPAGV

SEQ ID NO: 427084 - protein, 10 aa, Mycobacterium
ALPAKAADSL

SEQ ID NO: 427085 - protein, 7 aa, Mycobacterium
ALPAKPV

SEQ ID NO: 427086 - protein, 21 aa, Mycobacterium
ALPANDNQGLGQGTKTLGQLS

SEQ ID NO: 427087 - protein, 6 aa, Mycobacterium
ALPAPA

SEQ ID NO: 427088 - protein, 8 aa, Mycobacterium
ALPAPAAD

SEQ ID NO: 427089 - protein, 20 aa, Mycobacterium
ALPAPEYSDADRYRAPGTPV

SEQ ID NO: 427090 - protein, 7 aa, Mycobacterium
ALPAPGR

SEQ ID NO: 427091 - protein, 22 aa, Mycobacterium
ALPAPGTGPVASDDRTGGRSGQ

SEQ ID NO: 427092 - protein, 23 aa, Mycobacterium
ALPAPREPQARTGPSAPAAGDTV

SEQ ID NO: 427093 - protein, 9 aa, Mycobacterium
ALPAPRTPR

SEQ ID NO: 427094 - protein, 19 aa, Mycobacterium
ALPAPSARVGTIGSPAPLP

SEQ ID NO: 427095 - protein, 9 aa, Mycobacterium
ALPAPTPIA

SEQ ID NO: 427096 - protein, 6 aa, Mycobacterium
ALPAQT

SEQ ID NO: 427097 - protein, 5 aa, Mycobacterium
ALPAR

SEQ ID NO: 427098 - protein, 6 aa, Mycobacterium
ALPARP

SEQ ID NO: 427099 - protein, 5 aa, Mycobacterium
ALPAS

SEQ ID NO: 427100 - protein, 13 aa, Mycobacterium
ALPASKDDAGRKV

SEQ ID NO: 427101 - protein, 6 aa, Mycobacterium
ALPASR

SEQ ID NO: 427102 - protein, 16 aa, Mycobacterium
ALPASSPKEVADRTET

SEQ ID NO: 427103 - protein, 12 aa, Mycobacterium
ALPATASSLPSE

SEQ ID NO: 427104 - protein, 12 aa, Mycobacterium
ALPATEGVLTHA

SEQ ID NO: 427105 - protein, 16 aa, Mycobacterium
ALPATSAAAAAAAGFP

SEQ ID NO: 427106 - protein, 7 aa, Mycobacterium
ALPDARE

SEQ ID NO: 427107 - protein, 6 aa, Mycobacterium
ALPDDA

SEQ ID NO: 427108 - protein, 6 aa, Mycobacterium
ALPDDP

SEQ ID NO: 427109 - protein, 14 aa, Mycobacterium
ALPDGELPQTGSAY

SEQ ID NO: 427110 - protein, 17 aa, Mycobacterium
ALPDGELPQTVSPYGTP

SEQ ID NO: 427111 - protein, 6 aa, Mycobacterium
ALPDGT

SEQ ID NO: 427112 - protein, 7 aa, Mycobacterium
ALPDGTD

SEQ ID NO: 427113 - protein, 12 aa, Mycobacterium
ALPDGVSQATIG

SEQ ID NO: 427114 - protein, 6 aa, Mycobacterium
ALPDPA

SEQ ID NO: 427115 - protein, 16 aa, Mycobacterium
ALPDPDAAGADRRSAG

SEQ ID NO: 427116 - protein, 11 aa, Mycobacterium
ALPDPRGGETV

SEQ ID NO: 427117 - protein, 6 aa, Mycobacterium
ALPDQS

SEQ ID NO: 427118 - protein, 6 aa, Mycobacterium
ALPDSA

SEQ ID NO: 427119 - protein, 6 aa, Mycobacterium
ALPDSP

SEQ ID NO: 427120 - protein, 7 aa, Mycobacterium
ALPDTEP

SEQ ID NO: 427121 - protein, 4 aa, Mycobacterium
ALPE

SEQ ID NO: 427122 - protein, 12 aa, Mycobacterium
ALPEAKAGAGLH

SEQ ID NO: 427123 - protein, 7 aa, Mycobacterium
ALPEDGN

SEQ ID NO: 427124 - protein, 13 aa, Mycobacterium
ALPEDVNAPAGEA

SEQ ID NO: 427125 - protein, 6 aa, Mycobacterium
ALPEED

SEQ ID NO: 427126 - protein, 5 aa, Mycobacterium
ALPEG

SEQ ID NO: 427127 - protein, 12 aa, Mycobacterium
ALPEGDGDDDGL

SEQ ID NO: 427128 - protein, 7 aa, Mycobacterium
ALPEGHR

SEQ ID NO: 427129 - protein, 7 aa, Mycobacterium
ALPEGTN

SEQ ID NO: 427130 - protein, 5 aa, Mycobacterium
ALPEK

SEQ ID NO: 427131 - protein, 7 aa, Mycobacterium
ALPENAD

SEQ ID NO: 427132 - protein, 9 aa, Mycobacterium
ALPENSNQV

SEQ ID NO: 427133 - protein, 7 aa, Mycobacterium
ALPENVS

SEQ ID NO: 427134 - protein, 5 aa, Mycobacterium
ALPEP

SEQ ID NO: 427135 - protein, 15 aa, Mycobacterium
ALPEPRGSESRRDAI

SEQ ID NO: 427136 - protein, 10 aa, Mycobacterium
ALPEQAARVG

SEQ ID NO: 427137 - protein, 5 aa, Mycobacterium
ALPER

SEQ ID NO: 427138 - protein, 6 aa, Mycobacterium
ALPERQ

SEQ ID NO: 427139 - protein, 6 aa, Mycobacterium
ALPERV

SEQ ID NO: 427140 - protein, 5 aa, Mycobacterium
ALPES

SEQ ID NO: 427141 - protein, 6 aa, Mycobacterium
ALPESV

SEQ ID NO: 427142 - protein, 7 aa, Mycobacterium
ALPETEP

SEQ ID NO: 427143 - protein, 12 aa, Mycobacterium
ALPEYQPPGLAP

SEQ ID NO: 427144 - protein, 14 aa, Mycobacterium
ALPEYQPPGRPPIG

SEQ ID NO: 427145 - protein, 7 aa, Mycobacterium
ALPFGTD

SEQ ID NO: 427146 - protein, 6 aa, Mycobacterium
ALPFPD

SEQ ID NO: 427147 - protein, 6 aa, Mycobacterium
ALPGAA

SEQ ID NO: 427148 - protein, 39 aa, Mycobacterium
ALPGAGTATAPEASAAMPGVPGVPAPGAYARSYGTGPRY

SEQ ID NO: 427149 - protein, 7 aa, Mycobacterium
ALPGDPT

SEQ ID NO: 427150 - protein, 8 aa, Mycobacterium
ALPGDQLR

SEQ ID NO: 427151 - protein, 5 aa, Mycobacterium
ALPGE

SEQ ID NO: 427152 - protein, 21 aa, Mycobacterium
ALPGEETGSGEGDTTPPDTSA

SEQ ID NO: 427153 - protein, 9 aa, Mycobacterium
ALPGEPGYE

SEQ ID NO: 427154 - protein, 6 aa, Mycobacterium
ALPGER

SEQ ID NO: 427155 - protein, 7 aa, Mycobacterium
ALPGETD

SEQ ID NO: 427156 - protein, 28 aa, Mycobacterium
ALPGGARDSHESAEEAALREAAEEAGVD

SEQ ID NO: 427157 - protein, 6 aa, Mycobacterium
ALPGGE

SEQ ID NO: 427158 - protein, 6 aa, Mycobacterium
ALPGGG

SEQ ID NO: 427159 - protein, 17 aa, Mycobacterium
ALPGGGLGADEDLTSSV

SEQ ID NO: 427160 - protein, 6 aa, Mycobacterium
ALPGGY

SEQ ID NO: 427161 - protein, 5 aa, Mycobacterium
ALPGK

SEQ ID NO: 427162 - protein, 6 aa, Mycobacterium
ALPGKA

SEQ ID NO: 427163 - protein, 10 aa, Mycobacterium
ALPGKGEPLT

SEQ ID NO: 427164 - protein, 11 aa, Mycobacterium
ALPGNDYAGDD

SEQ ID NO: 427165 - protein, 6 aa, Mycobacterium
ALPGNG

SEQ ID NO: 427166 - protein, 7 aa, Mycobacterium
ALPGNRL

SEQ ID NO: 427167 - protein, 7 aa, Mycobacterium
ALPGPEE

SEQ ID NO: 427168 - protein, 9 aa, Mycobacterium
ALPGPGDEA

SEQ ID NO: 427169 - protein, 7 aa, Mycobacterium
ALPGPGR

SEQ ID NO: 427170 - protein, 25 aa, Mycobacterium
ALPGPGSPSREQVLSPSGSSPRIDD

SEQ ID NO: 427171 - protein, 7 aa, Mycobacterium
ALPGPPV

SEQ ID NO: 427172 - protein, 6 aa, Mycobacterium
ALPGPV

SEQ ID NO: 427173 - protein, 6 aa, Mycobacterium
ALPGQG

SEQ ID NO: 427174 - protein, 5 aa, Mycobacterium
ALPGS

SEQ ID NO: 427175 - protein, 6 aa, Mycobacterium
ALPGSL

SEQ ID NO: 427176 - protein, 25 aa, Mycobacterium
ALPGSPALATAATTALNTKLPKNGA

SEQ ID NO: 427177 - protein, 15 aa, Mycobacterium
ALPGSRTTSAAGTAA

SEQ ID NO: 427178 - protein, 17 aa, Mycobacterium
ALPGSRTTTAAGTPGLD

SEQ ID NO: 427179 - protein, 10 aa, Mycobacterium
ALPGSVDGDG

SEQ ID NO: 427180 - protein, 5 aa, Mycobacterium
ALPGT

SEQ ID NO: 427181 - protein, 8 aa, Mycobacterium
ALPGTDEH

SEQ ID NO: 427182 - protein, 8 aa, Mycobacterium
ALPGTDID

SEQ ID NO: 427183 - protein, 9 aa, Mycobacterium
ALPGTDIDP

SEQ ID NO: 427184 - protein, 8 aa, Mycobacterium
ALPGTGVD

SEQ ID NO: 427185 - protein, 11 aa, Mycobacterium
ALPGTGVDPDS

SEQ ID NO: 427186 - protein, 6 aa, Mycobacterium
ALPGTI

SEQ ID NO: 427187 - protein, 14 aa, Mycobacterium
ALPGWKGATPAERS

SEQ ID NO: 427188 - protein, 4 aa, Mycobacterium
ALPI

SEQ ID NO: 427189 - protein, 5 aa, Mycobacterium
ALPKG

SEQ ID NO: 427190 - protein, 10 aa, Mycobacterium
ALPKPKRYPR

SEQ ID NO: 427191 - protein, 13 aa, Mycobacterium
ALPKTASARSGAS

SEQ ID NO: 427192 - protein, 14 aa, Mycobacterium
ALPLDGPGTQAPGR

SEQ ID NO: 427193 - protein, 13 aa, Mycobacterium
ALPNAYSRAPHVG

SEQ ID NO: 427194 - protein, 8 aa, Mycobacterium
ALPNPGTS

SEQ ID NO: 427195 - protein, 6 aa, Mycobacterium
ALPPAS

SEQ ID NO: 427196 - protein, 7 aa, Mycobacterium
ALPPDHP

SEQ ID NO: 427197 - protein, 18 aa, Mycobacterium
ALPPDREERRAAARRQSR

SEQ ID NO: 427198 - protein, 8 aa, Mycobacterium
ALPPDSGF

SEQ ID NO: 427199 - protein, 7 aa, Mycobacterium
ALPPEDL

SEQ ID NO: 427200 - protein, 9 aa, Mycobacterium
ALPPEGAAT

SEQ ID NO: 427201 - protein, 6 aa, Mycobacterium
ALPPEL

SEQ ID NO: 427202 - protein, 6 aa, Mycobacterium
ALPPEN

SEQ ID NO: 427203 - protein, 14 aa, Mycobacterium
ALPPEPMYTGDTDQ

SEQ ID NO: 427204 - protein, 6 aa, Mycobacterium
ALPPES

SEQ ID NO: 427205 - protein, 6 aa, Mycobacterium
ALPPET

SEQ ID NO: 427206 - protein, 34 aa, Mycobacterium
ALPPGAPLPPPPPGAPVPPPPPGMPVPPPPPGAP

SEQ ID NO: 427207 - protein, 14 aa, Mycobacterium
ALPPGEYRQISGNT

SEQ ID NO: 427208 - protein, 7 aa, Mycobacterium
ALPPGGE

SEQ ID NO: 427209 - protein, 9 aa, Mycobacterium
ALPPGGEPI

SEQ ID NO: 427210 - protein, 19 aa, Mycobacterium
ALPPGIGKPGPHGHGTGQY

SEQ ID NO: 427211 - protein, 16 aa, Mycobacterium
ALPPGMGKPGHGHGQY

SEQ ID NO: 427212 - protein, 22 aa, Mycobacterium
ALPPGMGVPGQRGPSHPGTGQY

SEQ ID NO: 427213 - protein, 6 aa, Mycobacterium
ALPPGN

SEQ ID NO: 427214 - protein, 19 aa, Mycobacterium
ALPPGPAYYPDGELTDEPE

SEQ ID NO: 427215 - protein, 9 aa, Mycobacterium
ALPPGPPIP

SEQ ID NO: 427216 - protein, 11 aa, Mycobacterium
ALPPGRDAQYT

SEQ ID NO: 427217 - protein, 6 aa, Mycobacterium
ALPPGT

SEQ ID NO: 427218 - protein, 7 aa, Mycobacterium
ALPPGTD

SEQ ID NO: 427219 - protein, 7 aa, Mycobacterium
ALPPISD

SEQ ID NO: 427220 - protein, 8 aa, Mycobacterium
ALPPKQRQ

SEQ ID NO: 427221 - protein, 15 aa, Mycobacterium
ALPPKTESMKVPIKV

SEQ ID NO: 427222 - protein, 7 aa, Mycobacterium
ALPPPGV

SEQ ID NO: 427223 - protein, 8 aa, Mycobacterium
ALPPPLPG

SEQ ID NO: 427224 - protein, 48 aa, Mycobacterium
ALPPPPDAALPPDALPPPPDAPPPADALPPPPDAPAPADAPAPPPEEP

SEQ ID NO: 427225 - protein, 7 aa, Mycobacterium
ALPPRPE

SEQ ID NO: 427226 - protein, 6 aa, Mycobacterium
ALPPRQ

SEQ ID NO: 427227 - protein, 7 aa, Mycobacterium
ALPPRQR

SEQ ID NO: 427228 - protein, 9 aa, Mycobacterium
ALPPRSAQA

SEQ ID NO: 427229 - protein, 7 aa, Mycobacterium
ALPPRSE

SEQ ID NO: 427230 - protein, 6 aa, Mycobacterium
ALPPSE

SEQ ID NO: 427231 - protein, 11 aa, Mycobacterium
ALPPSSWGSGK

SEQ ID NO: 427232 - protein, 5 aa, Mycobacterium
ALPPT

SEQ ID NO: 427233 - protein, 33 aa, Mycobacterium
ALPPTDPRYVDGGPGSRVPSVSGLTEEAARQRL

SEQ ID NO: 427234 - protein, 12 aa, Mycobacterium
ALPPTGDNVNTA

SEQ ID NO: 427235 - protein, 12 aa, Mycobacterium
ALPPTPNGLTRT

SEQ ID NO: 427236 - protein, 8 aa, Mycobacterium
ALPQAKPL

SEQ ID NO: 427237 - protein, 5 aa, Mycobacterium
ALPQG

SEQ ID NO: 427238 - protein, 5 aa, Mycobacterium
ALPQP

SEQ ID NO: 427239 - protein, 6 aa, Mycobacterium
ALPQPD

SEQ ID NO: 427240 - protein, 21 aa, Mycobacterium
ALPQPQLAAGTEYRDPTTPTE

SEQ ID NO: 427241 - protein, 8 aa, Mycobacterium
ALPRDGEK

SEQ ID NO: 427242 - protein, 9 aa, Mycobacterium
ALPRGGADV

SEQ ID NO: 427243 - protein, 7 aa, Mycobacterium
ALPRPAR

SEQ ID NO: 427244 - protein, 12 aa, Mycobacterium
ALPRPDQPRTSV

SEQ ID NO: 427245 - protein, 6 aa, Mycobacterium
ALPRQP

SEQ ID NO: 427246 - protein, 23 aa, Mycobacterium
ALPRQSRRRVAREQQSAVTETRY

SEQ ID NO: 427247 - protein, 10 aa, Mycobacterium
ALPRSGTKRP

SEQ ID NO: 427248 - protein, 11 aa, Mycobacterium
ALPRSLPAEAA

SEQ ID NO: 427249 - protein, 12 aa, Mycobacterium
ALPRSQAGRSVP

SEQ ID NO: 427250 - protein, 15 aa, Mycobacterium
ALPRYKDGTVAEQID

SEQ ID NO: 427251 - protein, 15 aa, Mycobacterium
ALPRYKDGTVDEQIE

SEQ ID NO: 427252 - protein, 15 aa, Mycobacterium
ALPRYKDGTVGEQIE

SEQ ID NO: 427253 - protein, 15 aa, Mycobacterium
ALPRYPEGTVQDQIE

SEQ ID NO: 427254 - protein, 17 aa, Mycobacterium
ALPSAGLDGLPQAGAVA

SEQ ID NO: 427255 - protein, 9 aa, Mycobacterium
ALPSAGLGG

SEQ ID NO: 427256 - protein, 11 aa, Mycobacterium
ALPSASGANPM

SEQ ID NO: 427257 - protein, 8 aa, Mycobacterium
ALPSATEP

SEQ ID NO: 427258 - protein, 9 aa, Mycobacterium
ALPSEADGL

SEQ ID NO: 427259 - protein, 9 aa, Mycobacterium
ALPSEETPQ

SEQ ID NO: 427260 - protein, 6 aa, Mycobacterium
ALPSEK

SEQ ID NO: 427261 - protein, 13 aa, Mycobacterium
ALPSEKEIARRAE

SEQ ID NO: 427262 - protein, 16 aa, Mycobacterium
ALPSEKEIARRSEAGI

SEQ ID NO: 427263 - protein, 19 aa, Mycobacterium
ALPSEKEIQRRSEAGIGLT

SEQ ID NO: 427264 - protein, 13 aa, Mycobacterium
ALPSEKEIRRRAD

SEQ ID NO: 427265 - protein, 12 aa, Mycobacterium
ALPSLPEETGAL

SEQ ID NO: 427266 - protein, 8 aa, Mycobacterium
ALPSPAHR

SEQ ID NO: 427267 - protein, 8 aa, Mycobacterium
ALPSPDEL

SEQ ID NO: 427268 - protein, 7 aa, Mycobacterium
ALPSPGR

SEQ ID NO: 427269 - protein, 9 aa, Mycobacterium
ALPSPGRPR

SEQ ID NO: 427270 - protein, 8 aa, Mycobacterium
ALPSPGRV

SEQ ID NO: 427271 - protein, 10 aa, Mycobacterium
ALPSPGSDAQ

SEQ ID NO: 427272 - protein, 10 aa, Mycobacterium
ALPSPGSDGQ

SEQ ID NO: 427273 - protein, 11 aa, Mycobacterium
ALPSPGSDGQL

SEQ ID NO: 427274 - protein, 10 aa, Mycobacterium
ALPSPGSDTQ

SEQ ID NO: 427275 - protein, 7 aa, Mycobacterium
ALPSPKR

SEQ ID NO: 427276 - protein, 17 aa, Mycobacterium
ALPSPPRGYSPAPPPEW

SEQ ID NO: 427277 - protein, 6 aa, Mycobacterium
ALPSRP

SEQ ID NO: 427278 - protein, 7 aa, Mycobacterium
ALPSTLG

SEQ ID NO: 427279 - protein, 5 aa, Mycobacterium
ALPTA

SEQ ID NO: 427280 - protein, 6 aa, Mycobacterium
ALPTAE

SEQ ID NO: 427281 - protein, 7 aa, Mycobacterium
ALPTAGL

SEQ ID NO: 427282 - protein, 21 aa, Mycobacterium
ALPTDAAPAPLSARTESEAVT

SEQ ID NO: 427283 - protein, 8 aa, Mycobacterium
ALPTGATS

SEQ ID NO: 427284 - protein, 18 aa, Mycobacterium
ALPTGRAGLAGTSVPVPA

SEQ ID NO: 427285 - protein, 7 aa, Mycobacterium
ALPTPAA

SEQ ID NO: 427286 - protein, 7 aa, Mycobacterium
ALPTPAG

SEQ ID NO: 427287 - protein, 19 aa, Mycobacterium
ALPTPGATVTGSGGAPGSL

SEQ ID NO: 427288 - protein, 8 aa, Mycobacterium
ALPTPREA

SEQ ID NO: 427289 - protein, 7 aa, Mycobacterium
ALPTQQP

SEQ ID NO: 427290 - protein, 5 aa, Mycobacterium
ALPTR

SEQ ID NO: 427291 - protein, 12 aa, Mycobacterium
ALPTRPEDAAAG

SEQ ID NO: 427292 - protein, 8 aa, Mycobacterium
ALPTTDRR

SEQ ID NO: 427293 - protein, 10 aa, Mycobacterium
ALPTTPGWPS

SEQ ID NO: 427294 - protein, 6 aa, Mycobacterium
ALPTYN

SEQ ID NO: 427295 - protein, 7 aa, Mycobacterium
ALPVDAA

SEQ ID NO: 427296 - protein, 13 aa, Mycobacterium
ALPVDGAQEGSGG

SEQ ID NO: 427297 - protein, 15 aa, Mycobacterium
ALPVGTDGAADDGAA

SEQ ID NO: 427298 - protein, 6 aa, Mycobacterium
ALPVKP

SEQ ID NO: 427299 - protein, 12 aa, Mycobacterium
ALPYQRPPLSKS

SEQ ID NO: 427300 - protein, 6 aa, Mycobacterium
ALPYRP

SEQ ID NO: 427301 - protein, 4 aa, Mycobacterium
ALQA

SEQ ID NO: 427302 - protein, 7 aa, Mycobacterium
ALQADGP

SEQ ID NO: 427303 - protein, 9 aa, Mycobacterium
ALQAPAGDI

SEQ ID NO: 427304 - protein, 7 aa, Mycobacterium
ALQAPSG

SEQ ID NO: 427305 - protein, 11 aa, Mycobacterium
ALQAQGPPSIP

SEQ ID NO: 427306 - protein, 9 aa, Mycobacterium
ALQATGDNG

SEQ ID NO: 427307 - protein, 7 aa, Mycobacterium
ALQDNGI

SEQ ID NO: 427308 - protein, 15 aa, Mycobacterium
ALQDSGRLSADADAL

SEQ ID NO: 427309 - protein, 9 aa, Mycobacterium
ALQESRNRV

SEQ ID NO: 427310 - protein, 15 aa, Mycobacterium
ALQGDPASDKPDTHT

SEQ ID NO: 427311 - protein, 17 aa, Mycobacterium
ALQGDTSTDTAESSADD

SEQ ID NO: 427312 - protein, 12 aa, Mycobacterium
ALQGGASTKPDV

SEQ ID NO: 427313 - protein, 7 aa, Mycobacterium
ALQGGDI

SEQ ID NO: 427314 - protein, 13 aa, Mycobacterium
ALQGNTQALTTQA

SEQ ID NO: 427315 - protein, 7 aa, Mycobacterium
ALQGPRH

SEQ ID NO: 427316 - protein, 10 aa, Mycobacterium
ALQGQAGDAA

SEQ ID NO: 427317 - protein, 12 aa, Mycobacterium
ALQGRGLSRPDA

SEQ ID NO: 427318 - protein, 13 aa, Mycobacterium
ALQGRGPARPVEK

SEQ ID NO: 427319 - protein, 23 aa, Mycobacterium
ALQGVSTDIGQGLAEGSAALAAA

SEQ ID NO: 427320 - protein, 4 aa, Mycobacterium
ALQP

SEQ ID NO: 427321 - protein, 7 aa, Mycobacterium
ALQPDAV

SEQ ID NO: 427322 - protein, 8 aa, Mycobacterium
ALQPDDEA

SEQ ID NO: 427323 - protein, 5 aa, Mycobacterium
ALQPE

SEQ ID NO: 427324 - protein, 7 aa, Mycobacterium
ALQPEMG

SEQ ID NO: 427325 - protein, 8 aa, Mycobacterium
ALQPETGL

SEQ ID NO: 427326 - protein, 6 aa, Mycobacterium
ALQPGE

SEQ ID NO: 427327 - protein, 8 aa, Mycobacterium
ALQPGSRL

SEQ ID NO: 427328 - protein, 6 aa, Mycobacterium
ALQPPS

SEQ ID NO: 427329 - protein, 6 aa, Mycobacterium
ALQPQE

SEQ ID NO: 427330 - protein, 13 aa, Mycobacterium
ALQPRPGGPNPVA

SEQ ID NO: 427331 - protein, 30 aa, Mycobacterium
ALQPRRDALSTRRQALERSNVKHSKQAEAL

SEQ ID NO: 427332 - protein, 7 aa, Mycobacterium
ALQPTSA

SEQ ID NO: 427333 - protein, 8 aa, Mycobacterium
ALQQQIPG

SEQ ID NO: 427334 - protein, 16 aa, Mycobacterium
ALQRASEDALDAARAD

SEQ ID NO: 427335 - protein, 16 aa, Mycobacterium
ALQRASEDALNAAGAD

SEQ ID NO: 427336 - protein, 9 aa, Mycobacterium
ALQRRDDGR

SEQ ID NO: 427337 - protein, 12 aa, Mycobacterium
ALQRSGRRRRRR

SEQ ID NO: 427338 - protein, 6 aa, Mycobacterium
ALQSKQ

SEQ ID NO: 427339 - protein, 6 aa, Mycobacterium
ALQSTY

SEQ ID NO: 427340 - protein, 16 aa, Mycobacterium
ALQTGKPQNEIKQTGR

SEQ ID NO: 427341 - protein, 13 aa, Mycobacterium
ALQTHGGMGYSEE

SEQ ID NO: 427342 - protein, 6 aa, Mycobacterium
ALQTTG

SEQ ID NO: 427343 - protein, 4 aa, Mycobacterium
ALRA

SEQ ID NO: 427344 - protein, 7 aa, Mycobacterium
ALRADPR

SEQ ID NO: 427345 - protein, 5 aa, Mycobacterium
ALRAE

SEQ ID NO: 427346 - protein, 23 aa, Mycobacterium
ALRAEQKAASKSVGGASPDERPA

SEQ ID NO: 427347 - protein, 16 aa, Mycobacterium
ALRAGEGATTIATDPR

SEQ ID NO: 427348 - protein, 13 aa, Mycobacterium
ALRDAAATRRGGL

SEQ ID NO: 427349 - protein, 9 aa, Mycobacterium
ALRDAGADA

SEQ ID NO: 427350 - protein, 8 aa, Mycobacterium
ALRDAGGS

SEQ ID NO: 427351 - protein, 13 aa, Mycobacterium
ALRDDARAAKISS

SEQ ID NO: 427352 - protein, 6 aa, Mycobacterium
ALRDDG

SEQ ID NO: 427353 - protein, 14 aa, Mycobacterium
ALRDDSKQAGVSPS

SEQ ID NO: 427354 - protein, 8 aa, Mycobacterium
ALRDGAGE

SEQ ID NO: 427355 - protein, 8 aa, Mycobacterium
ALRDGPRS

SEQ ID NO: 427356 - protein, 12 aa, Mycobacterium
ALRDGSADADDL

SEQ ID NO: 427357 - protein, 7 aa, Mycobacterium
ALRDNGF

SEQ ID NO: 427358 - protein, 5 aa, Mycobacterium
ALRDR

SEQ ID NO: 427359 - protein, 6 aa, Mycobacterium
ALRDRA

SEQ ID NO: 427360 - protein, 24 aa, Mycobacterium
ALRDSGGDPREAEVRPPDEVEGYL

SEQ ID NO: 427361 - protein, 7 aa, Mycobacterium
ALRDSQP

SEQ ID NO: 427362 - protein, 6 aa, Mycobacterium
ALRDVK

SEQ ID NO: 427363 - protein, 6 aa, Mycobacterium
ALRDVS

SEQ ID NO: 427364 - protein, 4 aa, Mycobacterium
ALRE

SEQ ID NO: 427365 - protein, 6 aa, Mycobacterium
ALREDT

SEQ ID NO: 427366 - protein, 8 aa, Mycobacterium
ALREERDG

SEQ ID NO: 427367 - protein, 5 aa, Mycobacterium
ALREH

SEQ ID NO: 427368 - protein, 18 aa, Mycobacterium
ALRGARASSVLDGGPTRL

SEQ ID NO: 427369 - protein, 10 aa, Mycobacterium
ALRGARGNSG

SEQ ID NO: 427370 - protein, 12 aa, Mycobacterium
ALRGDGKTLQPF

SEQ ID NO: 427371 - protein, 11 aa, Mycobacterium
ALRGNPTSSDR

SEQ ID NO: 427372 - protein, 17 aa, Mycobacterium
ALRGSEDSKDENHNGAN

SEQ ID NO: 427373 - protein, 10 aa, Mycobacterium
ALRGSHGDLA

SEQ ID NO: 427374 - protein, 8 aa, Mycobacterium
ALRGVSGR

SEQ ID NO: 427375 - protein, 7 aa, Mycobacterium
ALRIGPA

SEQ ID NO: 427376 - protein, 8 aa, Mycobacterium
ALRNSAGR

SEQ ID NO: 427377 - protein, 14 aa, Mycobacterium
ALRPAKKSSPRRSA

SEQ ID NO: 427378 - protein, 6 aa, Mycobacterium
ALRPDT

SEQ ID NO: 427379 - protein, 17 aa, Mycobacterium
ALRPGGSLPTNTDGGGL

SEQ ID NO: 427380 - protein, 6 aa, Mycobacterium
ALRPGY

SEQ ID NO: 427381 - protein, 6 aa, Mycobacterium
ALRPQG

SEQ ID NO: 427382 - protein, 8 aa, Mycobacterium
ALRPQGDV

SEQ ID NO: 427383 - protein, 6 aa, Mycobacterium
ALRPSQ

SEQ ID NO: 427384 - protein, 7 aa, Mycobacterium
ALRPVTP

SEQ ID NO: 427385 - protein, 17 aa, Mycobacterium
ALRQPRARAQNRPQGHV

SEQ ID NO: 427386 - protein, 18 aa, Mycobacterium
ALRRGKQTLEVETSTALR

SEQ ID NO: 427387 - protein, 6 aa, Mycobacterium
ALRRNR

SEQ ID NO: 427388 - protein, 7 aa, Mycobacterium
ALRRPTA

SEQ ID NO: 427389 - protein, 11 aa, Mycobacterium
ALRRSREHGGP

SEQ ID NO: 427390 - protein, 4 aa, Mycobacterium
ALRS

SEQ ID NO: 427391 - protein, 10 aa, Mycobacterium
ALRSAEPNQI

SEQ ID NO: 427392 - protein, 12 aa, Mycobacterium
ALRSDGYDTSGI

SEQ ID NO: 427393 - protein, 7 aa, Mycobacterium
ALRSGPL

SEQ ID NO: 427394 - protein, 5 aa, Mycobacterium
ALRSN

SEQ ID NO: 427395 - protein, 17 aa, Mycobacterium
ALRSPTTTTMSGAPMGG

SEQ ID NO: 427396 - protein, 6 aa, Mycobacterium
ALRSTY

SEQ ID NO: 427397 - protein, 4 aa, Mycobacterium
ALRT

SEQ ID NO: 427398 - protein, 10 aa, Mycobacterium
ALRTDSEGSL

SEQ ID NO: 427399 - protein, 6 aa, Mycobacterium
ALRTPE

SEQ ID NO: 427400 - protein, 6 aa, Mycobacterium
ALRTST

SEQ ID NO: 427401 - protein, 20 aa, Mycobacterium
ALRTTPVSQKSVKPSLSDNG

SEQ ID NO: 427402 - protein, 5 aa, Mycobacterium
ALSAG

SEQ ID NO: 427403 - protein, 12 aa, Mycobacterium
ALSAKDSDSIPT

SEQ ID NO: 427404 - protein, 6 aa, Mycobacterium
ALSAPI

SEQ ID NO: 427405 - protein, 11 aa, Mycobacterium
ALSAPTPAAAI

SEQ ID NO: 427406 - protein, 11 aa, Mycobacterium
ALSARGAAPTY

SEQ ID NO: 427407 - protein, 9 aa, Mycobacterium
ALSARKRGL

SEQ ID NO: 427408 - protein, 12 aa, Mycobacterium
ALSASGGRYSYR

SEQ ID NO: 427409 - protein, 7 aa, Mycobacterium
ALSASPV

SEQ ID NO: 427410 - protein, 12 aa, Mycobacterium
ALSATTGATGGA

SEQ ID NO: 427411 - protein, 4 aa, Mycobacterium
ALSD

SEQ ID NO: 427412 - protein, 9 aa, Mycobacterium
ALSDASEAT

SEQ ID NO: 427413 - protein, 9 aa, Mycobacterium
ALSDATAKG

SEQ ID NO: 427414 - protein, 5 aa, Mycobacterium
ALSDE

SEQ ID NO: 427415 - protein, 13 aa, Mycobacterium
ALSDESAPPINGR

SEQ ID NO: 427416 - protein, 18 aa, Mycobacterium
ALSDGTAADFVPSRSGRV

SEQ ID NO: 427417 - protein, 8 aa, Mycobacterium
ALSDPAAE

SEQ ID NO: 427418 - protein, 9 aa, Mycobacterium
ALSDRARND

SEQ ID NO: 427419 - protein, 10 aa, Mycobacterium
ALSDRARNDR

SEQ ID NO: 427420 - protein, 10 aa, Mycobacterium
ALSDRESSPL

SEQ ID NO: 427421 - protein, 9 aa, Mycobacterium
ALSDSDAER

SEQ ID NO: 427422 - protein, 10 aa, Mycobacterium
ALSDSGDAPR

SEQ ID NO: 427423 - protein, 40 aa, Mycobacterium
ALSDTRAPSDIPASAPATPSDAPTLSGTPTTTAPPEPAPG

SEQ ID NO: 427424 - protein, 5 aa, Mycobacterium
ALSEA

SEQ ID NO: 427425 - protein, 9 aa, Mycobacterium
ALSEAAGDK

SEQ ID NO: 427426 - protein, 6 aa, Mycobacterium
ALSEED

SEQ ID NO: 427427 - protein, 6 aa, Mycobacterium
ALSEKD

SEQ ID NO: 427428 - protein, 6 aa, Mycobacterium
ALSEKT

SEQ ID NO: 427429 - protein, 10 aa, Mycobacterium
ALSEPGPVTE

SEQ ID NO: 427430 - protein, 8 aa, Mycobacterium
ALSEPSDL

SEQ ID NO: 427431 - protein, 10 aa, Mycobacterium
ALSEPSSGRY

SEQ ID NO: 427432 - protein, 5 aa, Mycobacterium
ALSES

SEQ ID NO: 427433 - protein, 12 aa, Mycobacterium
ALSESEADHRNS

SEQ ID NO: 427434 - protein, 5 aa, Mycobacterium
ALSET

SEQ ID NO: 427435 - protein, 9 aa, Mycobacterium
ALSEVTGRR

SEQ ID NO: 427436 - protein, 4 aa, Mycobacterium
ALSG

SEQ ID NO: 427437 - protein, 8 aa, Mycobacterium
ALSGAASA

SEQ ID NO: 427438 - protein, 9 aa, Mycobacterium
ALSGAGEVR

SEQ ID NO: 427439 - protein, 7 aa, Mycobacterium
ALSGASK

SEQ ID NO: 427440 - protein, 10 aa, Mycobacterium
ALSGDAQAAH

SEQ ID NO: 427441 - protein, 17 aa, Mycobacterium
ALSGDGPINGVTEEELR

SEQ ID NO: 427442 - protein, 11 aa, Mycobacterium
ALSGDGTPVPG

SEQ ID NO: 427443 - protein, 8 aa, Mycobacterium
ALSGDKLQ

SEQ ID NO: 427444 - protein, 13 aa, Mycobacterium
ALSGDSDPGDAPL

SEQ ID NO: 427445 - protein, 5 aa, Mycobacterium
ALSGE

SEQ ID NO: 427446 - protein, 6 aa, Mycobacterium
ALSGEA

SEQ ID NO: 427447 - protein, 8 aa, Mycobacterium
ALSGEPAA

SEQ ID NO: 427448 - protein, 11 aa, Mycobacterium
ALSGETARAEV

SEQ ID NO: 427449 - protein, 8 aa, Mycobacterium
ALSGGAPR

SEQ ID NO: 427450 - protein, 17 aa, Mycobacterium
ALSGGAVGEQAQPATAT

SEQ ID NO: 427451 - protein, 7 aa, Mycobacterium
ALSGGHP

SEQ ID NO: 427452 - protein, 6 aa, Mycobacterium
ALSGGM

SEQ ID NO: 427453 - protein, 11 aa, Mycobacterium
ALSGHPEAARQ

SEQ ID NO: 427454 - protein, 18 aa, Mycobacterium
ALSGHSAESALDEATHAQ

SEQ ID NO: 427455 - protein, 11 aa, Mycobacterium
ALSGKGGTYNI

SEQ ID NO: 427456 - protein, 9 aa, Mycobacterium
ALSGKLNPN

SEQ ID NO: 427457 - protein, 9 aa, Mycobacterium
ALSGKLNPQ

SEQ ID NO: 427458 - protein, 16 aa, Mycobacterium
ALSGPDEVAPLIARRG

SEQ ID NO: 427459 - protein, 18 aa, Mycobacterium
ALSGPGANGYGVESPAER

SEQ ID NO: 427460 - protein, 8 aa, Mycobacterium
ALSGPGGV

SEQ ID NO: 427461 - protein, 9 aa, Mycobacterium
ALSGPGTRA

SEQ ID NO: 427462 - protein, 8 aa, Mycobacterium
ALSGPPLT

SEQ ID NO: 427463 - protein, 12 aa, Mycobacterium
ALSGSGVGGRIR

SEQ ID NO: 427464 - protein, 7 aa, Mycobacterium
ALSGSQS

SEQ ID NO: 427465 - protein, 6 aa, Mycobacterium
ALSGSV

SEQ ID NO: 427466 - protein, 5 aa, Mycobacterium
ALSGT

SEQ ID NO: 427467 - protein, 15 aa, Mycobacterium
ALSGTRRGYEPAAGP

SEQ ID NO: 427468 - protein, 21 aa, Mycobacterium
ALSHGHGGHLPRGVQGAADPN

SEQ ID NO: 427469 - protein, 10 aa, Mycobacterium
ALSKNKGQFD

SEQ ID NO: 427470 - protein, 6 aa, Mycobacterium
ALSMDP

SEQ ID NO: 427471 - protein, 8 aa, Mycobacterium
ALSNPGRA

SEQ ID NO: 427472 - protein, 5 aa, Mycobacterium
ALSPA

SEQ ID NO: 427473 - protein, 7 aa, Mycobacterium
ALSPADG

SEQ ID NO: 427474 - protein, 25 aa, Mycobacterium
ALSPAGLTTIPGTEEAGAGAPGVPG

SEQ ID NO: 427475 - protein, 9 aa, Mycobacterium
ALSPDQARA

SEQ ID NO: 427476 - protein, 19 aa, Mycobacterium
ALSPDRPSIRGTAQNPDTY

SEQ ID NO: 427477 - protein, 5 aa, Mycobacterium
ALSPE

SEQ ID NO: 427478 - protein, 9 aa, Mycobacterium
ALSPEKARN

SEQ ID NO: 427479 - protein, 8 aa, Mycobacterium
ALSPELSN

SEQ ID NO: 427480 - protein, 19 aa, Mycobacterium
ALSPERPGIRGTAQNPDTY

SEQ ID NO: 427481 - protein, 7 aa, Mycobacterium
ALSPETG

SEQ ID NO: 427482 - protein, 12 aa, Mycobacterium
ALSPFSKTGLTD

SEQ ID NO: 427483 - protein, 6 aa, Mycobacterium
ALSPPR

SEQ ID NO: 427484 - protein, 6 aa, Mycobacterium
ALSPQR

SEQ ID NO: 427485 - protein, 8 aa, Mycobacterium
ALSPRPDL

SEQ ID NO: 427486 - protein, 8 aa, Mycobacterium
ALSPTAAE

SEQ ID NO: 427487 - protein, 7 aa, Mycobacterium
ALSPTGN

SEQ ID NO: 427488 - protein, 7 aa, Mycobacterium
ALSPTGR

SEQ ID NO: 427489 - protein, 8 aa, Mycobacterium
ALSPTGRC

SEQ ID NO: 427490 - protein, 7 aa, Mycobacterium
ALSPTNR

SEQ ID NO: 427491 - protein, 8 aa, Mycobacterium
ALSQADRD

SEQ ID NO: 427492 - protein, 5 aa, Mycobacterium
ALSQR

SEQ ID NO: 427493 - protein, 9 aa, Mycobacterium
ALSQTGASL

SEQ ID NO: 427494 - protein, 10 aa, Mycobacterium
ALSRSSADEL

SEQ ID NO: 427495 - protein, 8 aa, Mycobacterium
ALSSAGTS

SEQ ID NO: 427496 - protein, 7 aa, Mycobacterium
ALSSGTG

SEQ ID NO: 427497 - protein, 9 aa, Mycobacterium
ALSSIGGEI

SEQ ID NO: 427498 - protein, 9 aa, Mycobacterium
ALSSPSGLG

SEQ ID NO: 427499 - protein, 5 aa, Mycobacterium
ALSSR

SEQ ID NO: 427500 - protein, 12 aa, Mycobacterium
ALSSSEGEMGRG

SEQ ID NO: 427501 - protein, 18 aa, Mycobacterium
ALSSSKGMVTGEPDTPVR

SEQ ID NO: 427502 - protein, 8 aa, Mycobacterium
ALSSTPAG

SEQ ID NO: 427503 - protein, 19 aa, Mycobacterium
ALSSTPVHPVGDSPAGAAD

SEQ ID NO: 427504 - protein, 13 aa, Mycobacterium
ALSSVQGEYGTGN

SEQ ID NO: 427505 - protein, 9 aa, Mycobacterium
ALSSYAEPA

SEQ ID NO: 427506 - protein, 4 aa, Mycobacterium
ALST

SEQ ID NO: 427507 - protein, 5 aa, Mycobacterium
ALSTA

SEQ ID NO: 427508 - protein, 6 aa, Mycobacterium
ALSTGQ

SEQ ID NO: 427509 - protein, 7 aa, Mycobacterium
ALSTGYG

SEQ ID NO: 427510 - protein, 5 aa, Mycobacterium
ALSTR

SEQ ID NO: 427511 - protein, 11 aa, Mycobacterium
ALSTTTDNRRR

SEQ ID NO: 427512 - protein, 10 aa, Mycobacterium
ALSTVSTTEA

SEQ ID NO: 427513 - protein, 6 aa, Mycobacterium
ALSYPD

SEQ ID NO: 427514 - protein, 8 aa, Mycobacterium
ALTAADRD

SEQ ID NO: 427515 - protein, 8 aa, Mycobacterium
ALTAAGAA

SEQ ID NO: 427516 - protein, 7 aa, Mycobacterium
ALTAAQQ

SEQ ID NO: 427517 - protein, 7 aa, Mycobacterium
ALTADGE

SEQ ID NO: 427518 - protein, 7 aa, Mycobacterium
ALTADGP

SEQ ID NO: 427519 - protein, 5 aa, Mycobacterium
ALTAG

SEQ ID NO: 427520 - protein, 14 aa, Mycobacterium
ALTAGGGCVTWSNN

SEQ ID NO: 427521 - protein, 10 aa, Mycobacterium
ALTAGGPGAV

SEQ ID NO: 427522 - protein, 12 aa, Mycobacterium
ALTAGTAVTAAA

SEQ ID NO: 427523 - protein, 10 aa, Mycobacterium
ALTAPAPHHT

SEQ ID NO: 427524 - protein, 11 aa, Mycobacterium
ALTAPAPHHTR

SEQ ID NO: 427525 - protein, 9 aa, Mycobacterium
ALTAPGPED

SEQ ID NO: 427526 - protein, 17 aa, Mycobacterium
ALTAPRGTSAPPEGAPV

SEQ ID NO: 427527 - protein, 10 aa, Mycobacterium
ALTASGAAAD

SEQ ID NO: 427528 - protein, 6 aa, Mycobacterium
ALTDDG

SEQ ID NO: 427529 - protein, 5 aa, Mycobacterium
ALTDE

SEQ ID NO: 427530 - protein, 7 aa, Mycobacterium
ALTDEQV

SEQ ID NO: 427531 - protein, 7 aa, Mycobacterium
ALTDGER

SEQ ID NO: 427532 - protein, 7 aa, Mycobacterium
ALTDGRG

SEQ ID NO: 427533 - protein, 8 aa, Mycobacterium
ALTDPDAA

SEQ ID NO: 427534 - protein, 7 aa, Mycobacterium
ALTDPST

SEQ ID NO: 427535 - protein, 10 aa, Mycobacterium
ALTDSDTERL

SEQ ID NO: 427536 - protein, 8 aa, Mycobacterium
ALTDSETE

SEQ ID NO: 427537 - protein, 6 aa, Mycobacterium
ALTEAE

SEQ ID NO: 427538 - protein, 6 aa, Mycobacterium
ALTEDG

SEQ ID NO: 427539 - protein, 14 aa, Mycobacterium
ALTEEDATAIAAGY

SEQ ID NO: 427540 - protein, 22 aa, Mycobacterium
ALTEGATQTAPAQHGGLVPAHS

SEQ ID NO: 427541 - protein, 6 aa, Mycobacterium
ALTEPG

SEQ ID NO: 427542 - protein, 9 aa, Mycobacterium
ALTEPVPAP

SEQ ID NO: 427543 - protein, 5 aa, Mycobacterium
ALTER

SEQ ID NO: 427544 - protein, 6 aa, Mycobacterium
ALTERQ

SEQ ID NO: 427545 - protein, 5 aa, Mycobacterium
ALTET

SEQ ID NO: 427546 - protein, 16 aa, Mycobacterium
ALTGASRSGYTEGAVD

SEQ ID NO: 427547 - protein, 5 aa, Mycobacterium
ALTGD

SEQ ID NO: 427548 - protein, 5 aa, Mycobacterium
ALTGE

SEQ ID NO: 427549 - protein, 9 aa, Mycobacterium
ALTGEQAEA

SEQ ID NO: 427550 - protein, 8 aa, Mycobacterium
ALTGETSV

SEQ ID NO: 427551 - protein, 49 aa, Mycobacterium
ALTGGDAGRQRPRGCSGQDVSDMSSSAARPAGAPPSESHRASASNFSRR

SEQ ID NO: 427552 - protein, 12 aa, Mycobacterium
ALTGGDTPMQKS

SEQ ID NO: 427553 - protein, 9 aa, Mycobacterium
ALTGGSPTA

SEQ ID NO: 427554 - protein, 9 aa, Mycobacterium
ALTGGTPQQ

SEQ ID NO: 427555 - protein, 6 aa, Mycobacterium
ALTGPC

SEQ ID NO: 427556 - protein, 7 aa, Mycobacterium
ALTGPED

SEQ ID NO: 427557 - protein, 9 aa, Mycobacterium
ALTGPHAQL

SEQ ID NO: 427558 - protein, 10 aa, Mycobacterium
ALTGPQAQLG

SEQ ID NO: 427559 - protein, 6 aa, Mycobacterium
ALTGRQ

SEQ ID NO: 427560 - protein, 6 aa, Mycobacterium
ALTGSD

SEQ ID NO: 427561 - protein, 10 aa, Mycobacterium
ALTGSPDSPQ

SEQ ID NO: 427562 - protein, 7 aa, Mycobacterium
ALTGTQS

SEQ ID NO: 427563 - protein, 5 aa, Mycobacterium
ALTGY

SEQ ID NO: 427564 - protein, 8 aa, Mycobacterium
ALTHRGDD

SEQ ID NO: 427565 - protein, 10 aa, Mycobacterium
ALTNPTAAEQ

SEQ ID NO: 427566 - protein, 10 aa, Mycobacterium
ALTNSLGDTR

SEQ ID NO: 427567 - protein, 11 aa, Mycobacterium
ALTPAPKLGQL

SEQ ID NO: 427568 - protein, 5 aa, Mycobacterium
ALTPD

SEQ ID NO: 427569 - protein, 8 aa, Mycobacterium
ALTPDAGA

SEQ ID NO: 427570 - protein, 8 aa, Mycobacterium
ALTPDGRP

SEQ ID NO: 427571 - protein, 8 aa, Mycobacterium
ALTPDNTH

SEQ ID NO: 427572 - protein, 9 aa, Mycobacterium
ALTPDQAAG

SEQ ID NO: 427573 - protein, 18 aa, Mycobacterium
ALTPDTPPAPAEQGELPE

SEQ ID NO: 427574 - protein, 7 aa, Mycobacterium
ALTPEEA

SEQ ID NO: 427575 - protein, 8 aa, Mycobacterium
ALTPEQAA

SEQ ID NO: 427576 - protein, 7 aa, Mycobacterium
ALTPEQR

SEQ ID NO: 427577 - protein, 29 aa, Mycobacterium
ALTPETTRAAHDPATAETGTSASSRLSPR

SEQ ID NO: 427578 - protein, 34 aa, Mycobacterium
ALTPGAPSADVSARSAGSAGPADRGVGGSGAAVA

SEQ ID NO: 427579 - protein, 5 aa, Mycobacterium
ALTPK

SEQ ID NO: 427580 - protein, 14 aa, Mycobacterium
ALTPPDRARSLEEL

SEQ ID NO: 427581 - protein, 8 aa, Mycobacterium
ALTPPPTP

SEQ ID NO: 427582 - protein, 6 aa, Mycobacterium
ALTPPS

SEQ ID NO: 427583 - protein, 6 aa, Mycobacterium
ALTPPT

SEQ ID NO: 427584 - protein, 6 aa, Mycobacterium
ALTPRE

SEQ ID NO: 427585 - protein, 10 aa, Mycobacterium
ALTPSSRRAL

SEQ ID NO: 427586 - protein, 11 aa, Mycobacterium
ALTQRRTETVD

SEQ ID NO: 427587 - protein, 6 aa, Mycobacterium
ALTQTN

SEQ ID NO: 427588 - protein, 4 aa, Mycobacterium
ALTR

SEQ ID NO: 427589 - protein, 16 aa, Mycobacterium
ALTRTTRRSDEKPRPL

SEQ ID NO: 427590 - protein, 16 aa, Mycobacterium
ALTSAGVQGNTPEAQA

SEQ ID NO: 427591 - protein, 5 aa, Mycobacterium
ALTSG

SEQ ID NO: 427592 - protein, 16 aa, Mycobacterium
ALTSGAGPLALPAAGS

SEQ ID NO: 427593 - protein, 7 aa, Mycobacterium
ALTSGRD

SEQ ID NO: 427594 - protein, 5 aa, Mycobacterium
ALTSP

SEQ ID NO: 427595 - protein, 19 aa, Mycobacterium
ALTSRSARKTARPRLSGVT

SEQ ID NO: 427596 - protein, 7 aa, Mycobacterium
ALTSTPK

SEQ ID NO: 427597 - protein, 4 aa, Mycobacterium
ALTT

SEQ ID NO: 427598 - protein, 13 aa, Mycobacterium
ALTTAGRDRITKS

SEQ ID NO: 427599 - protein, 12 aa, Mycobacterium
ALTTGPGPASLL

SEQ ID NO: 427600 - protein, 11 aa, Mycobacterium
ALTTNNSEGLV

SEQ ID NO: 427601 - protein, 7 aa, Mycobacterium
ALTTSPD

SEQ ID NO: 427602 - protein, 8 aa, Mycobacterium
ALTTSTDG

SEQ ID NO: 427603 - protein, 5 aa, Mycobacterium
ALTTT

SEQ ID NO: 427604 - protein, 6 aa, Mycobacterium
ALTTTV

SEQ ID NO: 427605 - protein, 4 aa, Mycobacterium
ALTY

SEQ ID NO: 427606 - protein, 15 aa, Mycobacterium
ALTYTPDGGFTGTDE

SEQ ID NO: 427607 - protein, 5 aa, Mycobacterium
ALVSP

SEQ ID NO: 427608 - protein, 13 aa, Mycobacterium
ALVSTGSAGADTA

SEQ ID NO: 427609 - protein, 7 aa, Mycobacterium
ALYPEAD

SEQ ID NO: 427610 - protein, 8 aa, Mycobacterium
ALYSSTKA

SEQ ID NO: 427611 - protein, 10 aa, Mycobacterium
AMAAGAAPYT

SEQ ID NO: 427612 - protein, 18 aa, Mycobacterium
AMAEEQRRKFQAKIKAAR

SEQ ID NO: 427613 - protein, 7 aa, Mycobacterium
AMAERGH

SEQ ID NO: 427614 - protein, 18 aa, Mycobacterium
AMAGATGKAYGGAGGTIG

SEQ ID NO: 427615 - protein, 13 aa, Mycobacterium
AMAGEDKTTGVSS

SEQ ID NO: 427616 - protein, 18 aa, Mycobacterium
AMAGGPSGGGDGGKVTGQ

SEQ ID NO: 427617 - protein, 6 aa, Mycobacterium
AMAGGS

SEQ ID NO: 427618 - protein, 20 aa, Mycobacterium
AMAGREQGRREAATLARFLG

SEQ ID NO: 427619 - protein, 37 aa, Mycobacterium
AMAGTGGAAARSTGMGGAAPAAGEATTANIFVIHEAA

SEQ ID NO: 427620 - protein, 18 aa, Mycobacterium
AMAGVTGKAYGGAGGTLG

SEQ ID NO: 427621 - protein, 6 aa, Mycobacterium
AMANPA

SEQ ID NO: 427622 - protein, 11 aa, Mycobacterium
AMAPEKRPAPL

SEQ ID NO: 427623 - protein, 27 aa, Mycobacterium
AMAQDEGSQTTAGGATTGGTPAGADPF

SEQ ID NO: 427624 - protein, 9 aa, Mycobacterium
AMATKDPRG

SEQ ID NO: 427625 - protein, 11 aa, Mycobacterium
AMDARDIPGGQ

SEQ ID NO: 427626 - protein, 4 aa, Mycobacterium
AMDD

SEQ ID NO: 427627 - protein, 5 aa, Mycobacterium
AMDNS

SEQ ID NO: 427628 - protein, 16 aa, Mycobacterium
AMDPASHDEAAAAELG

SEQ ID NO: 427629 - protein, 4 aa, Mycobacterium
AMDS

SEQ ID NO: 427630 - protein, 4 aa, Mycobacterium
AMDT

SEQ ID NO: 427631 - protein, 7 aa, Mycobacterium
AMDTGTP

SEQ ID NO: 427632 - protein, 15 aa, Mycobacterium
AMEGAGNSLRARTRA

SEQ ID NO: 427633 - protein, 8 aa, Mycobacterium
AMEKTGAD

SEQ ID NO: 427634 - protein, 22 aa, Mycobacterium
AMEPGGEKAVAKREKKGIPSAR

SEQ ID NO: 427635 - protein, 6 aa, Mycobacterium
AMESGD

SEQ ID NO: 427636 - protein, 28 aa, Mycobacterium
AMESGDYKDLDEVPEQVASTTAAAARNA

SEQ ID NO: 427637 - protein, 8 aa, Mycobacterium
AMETAAGR

SEQ ID NO: 427638 - protein, 7 aa, Mycobacterium
AMETNPQ

SEQ ID NO: 427639 - protein, 9 aa, Mycobacterium
AMGAAGDEL

SEQ ID NO: 427640 - protein, 14 aa, Mycobacterium
AMGDSANATQTPTS

SEQ ID NO: 427641 - protein, 11 aa, Mycobacterium
AMGEERDTQEF

SEQ ID NO: 427642 - protein, 6 aa, Mycobacterium
AMGESG

SEQ ID NO: 427643 - protein, 4 aa, Mycobacterium
AMGG

SEQ ID NO: 427644 - protein, 12 aa, Mycobacterium
AMGGEPKFEGSQ

SEQ ID NO: 427645 - protein, 5 aa, Mycobacterium
AMGGP

SEQ ID NO: 427646 - protein, 7 aa, Mycobacterium
AMGGSTA

SEQ ID NO: 427647 - protein, 18 aa, Mycobacterium
AMGGVTGRAYGGAGGTLG

SEQ ID NO: 427648 - protein, 18 aa, Mycobacterium
AMGPAADAVAAENPAAAH

SEQ ID NO: 427649 - protein, 10 aa, Mycobacterium
AMGPDADPRV

SEQ ID NO: 427650 - protein, 11 aa, Mycobacterium
AMGPDADPTAV

SEQ ID NO: 427651 - protein, 12 aa, Mycobacterium
AMGPNADPTTVS

SEQ ID NO: 427652 - protein, 9 aa, Mycobacterium
AMGPPLASE

SEQ ID NO: 427653 - protein, 5 aa, Mycobacterium
AMGPR

SEQ ID NO: 427654 - protein, 6 aa, Mycobacterium
AMGQGS

SEQ ID NO: 427655 - protein, 11 aa, Mycobacterium
AMGSDSQGMGR

SEQ ID NO: 427656 - protein, 21 aa, Mycobacterium
AMGSEKYQNDGDPRTSGPGFG

SEQ ID NO: 427657 - protein, 6 aa, Mycobacterium
AMGSYP

SEQ ID NO: 427658 - protein, 20 aa, Mycobacterium
AMGTADSNPVHRTGPGPMGP

SEQ ID NO: 427659 - protein, 7 aa, Mycobacterium
AMGTDAP

SEQ ID NO: 427660 - protein, 21 aa, Mycobacterium
AMGTDRGNELHPHGPGPMGPS

SEQ ID NO: 427661 - protein, 14 aa, Mycobacterium
AMGTKGGPRTDRDG

SEQ ID NO: 427662 - protein, 5 aa, Mycobacterium
AMGTQ

SEQ ID NO: 427663 - protein, 12 aa, Mycobacterium
AMHRPETAQFPT

SEQ ID NO: 427664 - protein, 8 aa, Mycobacterium
AMKGNLNK

SEQ ID NO: 427665 - protein, 9 aa, Mycobacterium
AMKGNLSKA

SEQ ID NO: 427666 - protein, 4 aa, Mycobacterium
AMKP

SEQ ID NO: 427667 - protein, 5 aa, Mycobacterium
AMKQA

SEQ ID NO: 427668 - protein, 8 aa, Mycobacterium
AMKSGGAI

SEQ ID NO: 427669 - protein, 10 aa, Mycobacterium
AMKSQDKLRT

SEQ ID NO: 427670 - protein, 10 aa, Mycobacterium
AMKTQDKLRT

SEQ ID NO: 427671 - protein, 11 aa, Mycobacterium
AMMPPDAPTTL

SEQ ID NO: 427672 - protein, 9 aa, Mycobacterium
AMNASNAAA

SEQ ID NO: 427673 - protein, 5 aa, Mycobacterium
AMNYP

SEQ ID NO: 427674 - protein, 22 aa, Mycobacterium
AMPAPGGKGANQAVAAARAGAS

SEQ ID NO: 427675 - protein, 5 aa, Mycobacterium
AMPAS

SEQ ID NO: 427676 - protein, 4 aa, Mycobacterium
AMPD

SEQ ID NO: 427677 - protein, 5 aa, Mycobacterium
AMPDD

SEQ ID NO: 427678 - protein, 5 aa, Mycobacterium
AMPDE

SEQ ID NO: 427679 - protein, 6 aa, Mycobacterium
AMPDQG

SEQ ID NO: 427680 - protein, 11 aa, Mycobacterium
AMPEVDGSRPY

SEQ ID NO: 427681 - protein, 7 aa, Mycobacterium
AMPGAGD

SEQ ID NO: 427682 - protein, 24 aa, Mycobacterium
AMPGERARPGHGSAVPVRSSNVSA

SEQ ID NO: 427683 - protein, 5 aa, Mycobacterium
AMPGG

SEQ ID NO: 427684 - protein, 11 aa, Mycobacterium
AMPGGGSATRE

SEQ ID NO: 427685 - protein, 15 aa, Mycobacterium
AMPGKGGDPRPSSTT

SEQ ID NO: 427686 - protein, 6 aa, Mycobacterium
AMPGQG

SEQ ID NO: 427687 - protein, 6 aa, Mycobacterium
AMPGRS

SEQ ID NO: 427688 - protein, 5 aa, Mycobacterium
AMPGT

SEQ ID NO: 427689 - protein, 6 aa, Mycobacterium
AMPGVD

SEQ ID NO: 427690 - protein, 11 aa, Mycobacterium
AMPGYDGGSQI

SEQ ID NO: 427691 - protein, 12 aa, Mycobacterium
AMPNITSGNTNA

SEQ ID NO: 427692 - protein, 5 aa, Mycobacterium
AMPNT

SEQ ID NO: 427693 - protein, 5 aa, Mycobacterium
AMPPA

SEQ ID NO: 427694 - protein, 10 aa, Mycobacterium
AMPPEPEVAG

SEQ ID NO: 427695 - protein, 10 aa, Mycobacterium
AMPPESDPDF

SEQ ID NO: 427696 - protein, 9 aa, Mycobacterium
AMPPGPTRD

SEQ ID NO: 427697 - protein, 13 aa, Mycobacterium
AMPPGRVHPGDER

SEQ ID NO: 427698 - protein, 6 aa, Mycobacterium
AMPPGS

SEQ ID NO: 427699 - protein, 8 aa, Mycobacterium
AMPQRLTP

SEQ ID NO: 427700 - protein, 5 aa, Mycobacterium
AMPSP

SEQ ID NO: 427701 - protein, 11 aa, Mycobacterium
AMPSTASAGRA

SEQ ID NO: 427702 - protein, 4 aa, Mycobacterium
AMPT

SEQ ID NO: 427703 - protein, 5 aa, Mycobacterium
AMPTA

SEQ ID NO: 427704 - protein, 12 aa, Mycobacterium
AMPTITSGNTNA

SEQ ID NO: 427705 - protein, 4 aa, Mycobacterium
AMQE

SEQ ID NO: 427706 - protein, 5 aa, Mycobacterium
AMQGS

SEQ ID NO: 427707 - protein, 27 aa, Mycobacterium
AMQGTDYTDLDDVPDAVASATANAARN

SEQ ID NO: 427708 - protein, 4 aa, Mycobacterium
AMQP

SEQ ID NO: 427709 - protein, 11 aa, Mycobacterium
AMQPRPSGGQT

SEQ ID NO: 427710 - protein, 9 aa, Mycobacterium
AMQSNDPAT

SEQ ID NO: 427711 - protein, 4 aa, Mycobacterium
AMRD

SEQ ID NO: 427712 - protein, 16 aa, Mycobacterium
AMRERSELARKGIARG

SEQ ID NO: 427713 - protein, 17 aa, Mycobacterium
AMRERSELARKGIARGR

SEQ ID NO: 427714 - protein, 7 aa, Mycobacterium
AMRGTRR

SEQ ID NO: 427715 - protein, 5 aa, Mycobacterium
AMRPA

SEQ ID NO: 427716 - protein, 17 aa, Mycobacterium
AMRPSRSVRPPEDDGPL

SEQ ID NO: 427717 - protein, 6 aa, Mycobacterium
AMRQPN

SEQ ID NO: 427718 - protein, 11 aa, Mycobacterium
AMRREHDEAAA

SEQ ID NO: 427719 - protein, 5 aa, Mycobacterium
AMSAA

SEQ ID NO: 427720 - protein, 13 aa, Mycobacterium
AMSDSTDWTATSA

SEQ ID NO: 427721 - protein, 7 aa, Mycobacterium
AMSEKDI

SEQ ID NO: 427722 - protein, 8 aa, Mycobacterium
AMSGGQAR

SEQ ID NO: 427723 - protein, 5 aa, Mycobacterium
AMSGL

SEQ ID NO: 427724 - protein, 11 aa, Mycobacterium
AMSNGQPESRF

SEQ ID NO: 427725 - protein, 11 aa, Mycobacterium
AMSNGRADSRF

SEQ ID NO: 427726 - protein, 11 aa, Mycobacterium
AMSNGRPESRF

SEQ ID NO: 427727 - protein, 11 aa, Mycobacterium
AMSNGRPETRF

SEQ ID NO: 427728 - protein, 5 aa, Mycobacterium
AMSNT

SEQ ID NO: 427729 - protein, 11 aa, Mycobacterium
AMSPEDRAKAQ

SEQ ID NO: 427730 - protein, 6 aa, Mycobacterium
AMSPSQ

SEQ ID NO: 427731 - protein, 7 aa, Mycobacterium
AMSQSGY

SEQ ID NO: 427732 - protein, 12 aa, Mycobacterium
AMSSGDDAQAAA

SEQ ID NO: 427733 - protein, 12 aa, Mycobacterium
AMSTGRAETRFT

SEQ ID NO: 427734 - protein, 7 aa, Mycobacterium
AMTAGGS

SEQ ID NO: 427735 - protein, 12 aa, Mycobacterium
AMTAGQSSGPVN

SEQ ID NO: 427736 - protein, 4 aa, Mycobacterium
AMTD

SEQ ID NO: 427737 - protein, 5 aa, Mycobacterium
AMTDP

SEQ ID NO: 427738 - protein, 7 aa, Mycobacterium
AMTDSGA

SEQ ID NO: 427739 - protein, 4 aa, Mycobacterium
AMTE

SEQ ID NO: 427740 - protein, 4 aa, Mycobacterium
AMTG

SEQ ID NO: 427741 - protein, 6 aa, Mycobacterium
AMTGAL

SEQ ID NO: 427742 - protein, 7 aa, Mycobacterium
AMTGARE

SEQ ID NO: 427743 - protein, 11 aa, Mycobacterium
AMTGDAAASIG

SEQ ID NO: 427744 - protein, 25 aa, Mycobacterium
AMTGDPDGPPTLPGYSSADNSTGLT

SEQ ID NO: 427745 - protein, 10 aa, Mycobacterium
AMTGEAGADT

SEQ ID NO: 427746 - protein, 5 aa, Mycobacterium
AMTGG

SEQ ID NO: 427747 - protein, 7 aa, Mycobacterium
AMTGGLG

SEQ ID NO: 427748 - protein, 6 aa, Mycobacterium
AMTGGP

SEQ ID NO: 427749 - protein, 9 aa, Mycobacterium
AMTGSSSPA

SEQ ID NO: 427750 - protein, 8 aa, Mycobacterium
AMTKGVGQ

SEQ ID NO: 427751 - protein, 9 aa, Mycobacterium
AMTNADPVN

SEQ ID NO: 427752 - protein, 7 aa, Mycobacterium
AMTPAAT

SEQ ID NO: 427753 - protein, 6 aa, Mycobacterium
AMTPGA

SEQ ID NO: 427754 - protein, 4 aa, Mycobacterium
AMTQ

SEQ ID NO: 427755 - protein, 12 aa, Mycobacterium
AMTSGQSSGPVN

SEQ ID NO: 427756 - protein, 9 aa, Mycobacterium
AMTTRSGVT

SEQ ID NO: 427757 - protein, 4 aa, Mycobacterium
AMTY

SEQ ID NO: 427758 - protein, 11 aa, Mycobacterium
ANAAAAAPTTG

SEQ ID NO: 427759 - protein, 9 aa, Mycobacterium
ANAAAATPM

SEQ ID NO: 427760 - protein, 10 aa, Mycobacterium
ANAAANAAAD

SEQ ID NO: 427761 - protein, 17 aa, Mycobacterium
ANAAATAHESAAAGYTS

SEQ ID NO: 427762 - protein, 5 aa, Mycobacterium
ANAAE

SEQ ID NO: 427763 - protein, 6 aa, Mycobacterium
ANAAEL

SEQ ID NO: 427764 - protein, 12 aa, Mycobacterium
ANAAEPETEPGA

SEQ ID NO: 427765 - protein, 5 aa, Mycobacterium
ANAAG

SEQ ID NO: 427766 - protein, 8 aa, Mycobacterium
ANAAGGDI

SEQ ID NO: 427767 - protein, 15 aa, Mycobacterium
ANAAGNGAPAAGRTY

SEQ ID NO: 427768 - protein, 8 aa, Mycobacterium
ANAAPSAH

SEQ ID NO: 427769 - protein, 7 aa, Mycobacterium
ANAAQGW

SEQ ID NO: 427770 - protein, 5 aa, Mycobacterium
ANAAR

SEQ ID NO: 427771 - protein, 9 aa, Mycobacterium
ANAARGAEI

SEQ ID NO: 427772 - protein, 8 aa, Mycobacterium
ANAARRAT

SEQ ID NO: 427773 - protein, 17 aa, Mycobacterium
ANAASKVSAASASSGGW

SEQ ID NO: 427774 - protein, 18 aa, Mycobacterium
ANAATTPVGRTASAISQL

SEQ ID NO: 427775 - protein, 4 aa, Mycobacterium
ANAD

SEQ ID NO: 427776 - protein, 9 aa, Mycobacterium
ANADEATRR

SEQ ID NO: 427777 - protein, 7 aa, Mycobacterium
ANADEAV

SEQ ID NO: 427778 - protein, 10 aa, Mycobacterium
ANADGPGPTL

SEQ ID NO: 427779 - protein, 10 aa, Mycobacterium
ANADLDKPFT

SEQ ID NO: 427780 - protein, 8 aa, Mycobacterium
ANADLTGR

SEQ ID NO: 427781 - protein, 8 aa, Mycobacterium
ANADPATV

SEQ ID NO: 427782 - protein, 7 aa, Mycobacterium
ANADQIR

SEQ ID NO: 427783 - protein, 5 aa, Mycobacterium
ANADR

SEQ ID NO: 427784 - protein, 6 aa, Mycobacterium
ANADTG

SEQ ID NO: 427785 - protein, 4 aa, Mycobacterium
ANAE

SEQ ID NO: 427786 - protein, 10 aa, Mycobacterium
ANAEAPGPRA

SEQ ID NO: 427787 - protein, 8 aa, Mycobacterium
ANAEHPIE

SEQ ID NO: 427788 - protein, 7 aa, Mycobacterium
ANAELNP

SEQ ID NO: 427789 - protein, 8 aa, Mycobacterium
ANAELNPT

SEQ ID NO: 427790 - protein, 5 aa, Mycobacterium
ANAEP

SEQ ID NO: 427791 - protein, 9 aa, Mycobacterium
ANAEPPERL

SEQ ID NO: 427792 - protein, 8 aa, Mycobacterium
ANAEPRFE

SEQ ID NO: 427793 - protein, 5 aa, Mycobacterium
ANAEQ

SEQ ID NO: 427794 - protein, 9 aa, Mycobacterium
ANAEQASIS

SEQ ID NO: 427795 - protein, 19 aa, Mycobacterium
ANAEQPEQITPAIIEHLEQ

SEQ ID NO: 427796 - protein, 10 aa, Mycobacterium
ANAERAEGIA

SEQ ID NO: 427797 - protein, 6 aa, Mycobacterium
ANAFNR

SEQ ID NO: 427798 - protein, 9 aa, Mycobacterium
ANAGATEVR

SEQ ID NO: 427799 - protein, 9 aa, Mycobacterium
ANAGDTGEV

SEQ ID NO: 427800 - protein, 10 aa, Mycobacterium
ANAGGGNGVS

SEQ ID NO: 427801 - protein, 11 aa, Mycobacterium
ANAGGGNQGFG

SEQ ID NO: 427802 - protein, 8 aa, Mycobacterium
ANAGGSPI

SEQ ID NO: 427803 - protein, 6 aa, Mycobacterium
ANAGGY

SEQ ID NO: 427804 - protein, 5 aa, Mycobacterium
ANAGH

SEQ ID NO: 427805 - protein, 8 aa, Mycobacterium
ANAGPNMT

SEQ ID NO: 427806 - protein, 6 aa, Mycobacterium
ANAGPP

SEQ ID NO: 427807 - protein, 8 aa, Mycobacterium
ANAGPSLT

SEQ ID NO: 427808 - protein, 5 aa, Mycobacterium
ANAGR

SEQ ID NO: 427809 - protein, 8 aa, Mycobacterium
ANAGRPDL

SEQ ID NO: 427810 - protein, 11 aa, Mycobacterium
ANAGSASRFDQ

SEQ ID NO: 427811 - protein, 8 aa, Mycobacterium
ANAGSNNF

SEQ ID NO: 427812 - protein, 5 aa, Mycobacterium
ANAGT

SEQ ID NO: 427813 - protein, 10 aa, Mycobacterium
ANAGTGGKRH

SEQ ID NO: 427814 - protein, 13 aa, Mycobacterium
ANAGTTARPLPET

SEQ ID NO: 427815 - protein, 9 aa, Mycobacterium
ANAGVQPRE

SEQ ID NO: 427816 - protein, 14 aa, Mycobacterium
ANAIPTAGAPAQAF

SEQ ID NO: 427817 - protein, 6 aa, Mycobacterium
ANAKAR

SEQ ID NO: 427818 - protein, 12 aa, Mycobacterium
ANAKSTGGGAMR

SEQ ID NO: 427819 - protein, 4 aa, Mycobacterium
ANAL

SEQ ID NO: 427820 - protein, 9 aa, Mycobacterium
ANALAGGLR

SEQ ID NO: 427821 - protein, 8 aa, Mycobacterium
ANANGGDI

SEQ ID NO: 427822 - protein, 35 aa, Mycobacterium
ANANRRQQTQVDNHHTARTQTVDADEVHDELGGRV

SEQ ID NO: 427823 - protein, 10 aa, Mycobacterium
ANANVAAPIN

SEQ ID NO: 427824 - protein, 7 aa, Mycobacterium
ANAPALR

SEQ ID NO: 427825 - protein, 8 aa, Mycobacterium
ANAPDDAP

SEQ ID NO: 427826 - protein, 7 aa, Mycobacterium
ANAPEGG

SEQ ID NO: 427827 - protein, 5 aa, Mycobacterium
ANAPG

SEQ ID NO: 427828 - protein, 9 aa, Mycobacterium
ANAPGATLG

SEQ ID NO: 427829 - protein, 7 aa, Mycobacterium
ANAPGIN

SEQ ID NO: 427830 - protein, 8 aa, Mycobacterium
ANAPGIRE

SEQ ID NO: 427831 - protein, 8 aa, Mycobacterium
ANAPGMQE

SEQ ID NO: 427832 - protein, 6 aa, Mycobacterium
ANAPQY

SEQ ID NO: 427833 - protein, 7 aa, Mycobacterium
ANAPRGI

SEQ ID NO: 427834 - protein, 5 aa, Mycobacterium
ANAPS

SEQ ID NO: 427835 - protein, 5 aa, Mycobacterium
ANAPV

SEQ ID NO: 427836 - protein, 6 aa, Mycobacterium
ANAPVA

SEQ ID NO: 427837 - protein, 8 aa, Mycobacterium
ANAQAAAR

SEQ ID NO: 427838 - protein, 6 aa, Mycobacterium
ANAQPS

SEQ ID NO: 427839 - protein, 5 aa, Mycobacterium
ANAQT

SEQ ID NO: 427840 - protein, 16 aa, Mycobacterium
ANAQYTPANDAKRADI

SEQ ID NO: 427841 - protein, 17 aa, Mycobacterium
ANAQYTPANDAKRADIH

SEQ ID NO: 427842 - protein, 8 aa, Mycobacterium
ANAQYTPV

SEQ ID NO: 427843 - protein, 18 aa, Mycobacterium
ANARAAGTGTLRRGRRSR

SEQ ID NO: 427844 - protein, 20 aa, Mycobacterium
ANARADAALGGRDDRPLEPA

SEQ ID NO: 427845 - protein, 9 aa, Mycobacterium
ANARDEVGA

SEQ ID NO: 427846 - protein, 8 aa, Mycobacterium
ANARDSRE

SEQ ID NO: 427847 - protein, 7 aa, Mycobacterium
ANAREDL

SEQ ID NO: 427848 - protein, 5 aa, Mycobacterium
ANARG

SEQ ID NO: 427849 - protein, 6 aa, Mycobacterium
ANARPG

SEQ ID NO: 427850 - protein, 8 aa, Mycobacterium
ANARPYPV

SEQ ID NO: 427851 - protein, 5 aa, Mycobacterium
ANARR

SEQ ID NO: 427852 - protein, 5 aa, Mycobacterium
ANARV

SEQ ID NO: 427853 - protein, 5 aa, Mycobacterium
ANASA

SEQ ID NO: 427854 - protein, 7 aa, Mycobacterium
ANASDRS

SEQ ID NO: 427855 - protein, 7 aa, Mycobacterium
ANASGIE

SEQ ID NO: 427856 - protein, 14 aa, Mycobacterium
ANASHATTGEDIAD

SEQ ID NO: 427857 - protein, 7 aa, Mycobacterium
ANASKER

SEQ ID NO: 427858 - protein, 6 aa, Mycobacterium
ANASNT

SEQ ID NO: 427859 - protein, 10 aa, Mycobacterium
ANASNTDPSR

SEQ ID NO: 427860 - protein, 11 aa, Mycobacterium
ANASQGTPSRG

SEQ ID NO: 427861 - protein, 7 aa, Mycobacterium
ANASSNA

SEQ ID NO: 427862 - protein, 6 aa, Mycobacterium
ANATAD

SEQ ID NO: 427863 - protein, 7 aa, Mycobacterium
ANATFTA

SEQ ID NO: 427864 - protein, 11 aa, Mycobacterium
ANATGQDTPAI

SEQ ID NO: 427865 - protein, 9 aa, Mycobacterium
ANATKHAHA

SEQ ID NO: 427866 - protein, 5 aa, Mycobacterium
ANATL

SEQ ID NO: 427867 - protein, 8 aa, Mycobacterium
ANATPEAA

SEQ ID NO: 427868 - protein, 6 aa, Mycobacterium
ANATPL

SEQ ID NO: 427869 - protein, 8 aa, Mycobacterium
ANATSPDL

SEQ ID NO: 427870 - protein, 14 aa, Mycobacterium
ANATTFAAAKGAPV

SEQ ID NO: 427871 - protein, 6 aa, Mycobacterium
ANAVAG

SEQ ID NO: 427872 - protein, 8 aa, Mycobacterium
ANAVEKTR

SEQ ID NO: 427873 - protein, 10 aa, Mycobacterium
ANCPAPVDGP

SEQ ID NO: 427874 - protein, 6 aa, Mycobacterium
ANCPDT

SEQ ID NO: 427875 - protein, 12 aa, Mycobacterium
ANCPSRTSSEEL

SEQ ID NO: 427876 - protein, 4 aa, Mycobacterium
ANDA

SEQ ID NO: 427877 - protein, 6 aa, Mycobacterium
ANDADD

SEQ ID NO: 427878 - protein, 7 aa, Mycobacterium
ANDAERA

SEQ ID NO: 427879 - protein, 5 aa, Mycobacterium
ANDAG

SEQ ID NO: 427880 - protein, 6 aa, Mycobacterium
ANDAGQ

SEQ ID NO: 427881 - protein, 9 aa, Mycobacterium
ANDAGTDNQ

SEQ ID NO: 427882 - protein, 17 aa, Mycobacterium
ANDAHDAHCTGPPGQRR

SEQ ID NO: 427883 - protein, 16 aa, Mycobacterium
ANDAQGDEDPAAGGRY

SEQ ID NO: 427884 - protein, 12 aa, Mycobacterium
ANDAQRINRLLN

SEQ ID NO: 427885 - protein, 7 aa, Mycobacterium
ANDATRS

SEQ ID NO: 427886 - protein, 8 aa, Mycobacterium
ANDAVRGQ

SEQ ID NO: 427887 - protein, 9 aa, Mycobacterium
ANDDPTGTV

SEQ ID NO: 427888 - protein, 10 aa, Mycobacterium
ANDDQDEANA

SEQ ID NO: 427889 - protein, 5 aa, Mycobacterium
ANDDR

SEQ ID NO: 427890 - protein, 8 aa, Mycobacterium
ANDDRNDR

SEQ ID NO: 427891 - protein, 7 aa, Mycobacterium
ANDEGQM

SEQ ID NO: 427892 - protein, 7 aa, Mycobacterium
ANDEQKA

SEQ ID NO: 427893 - protein, 7 aa, Mycobacterium
ANDEQKE

SEQ ID NO: 427894 - protein, 7 aa, Mycobacterium
ANDEQLQ

SEQ ID NO: 427895 - protein, 7 aa, Mycobacterium
ANDEQRR

SEQ ID NO: 427896 - protein, 5 aa, Mycobacterium
ANDER

SEQ ID NO: 427897 - protein, 9 aa, Mycobacterium
ANDERPDGA

SEQ ID NO: 427898 - protein, 9 aa, Mycobacterium
ANDERPDGS

SEQ ID NO: 427899 - protein, 6 aa, Mycobacterium
ANDGAQ

SEQ ID NO: 427900 - protein, 7 aa, Mycobacterium
ANDGDLS

SEQ ID NO: 427901 - protein, 16 aa, Mycobacterium
ANDGQGGEDPADGGRY

SEQ ID NO: 427902 - protein, 5 aa, Mycobacterium
ANDKV

SEQ ID NO: 427903 - protein, 4 aa, Mycobacterium
ANDL

SEQ ID NO: 427904 - protein, 13 aa, Mycobacterium
ANDLRKSNKRVRE

SEQ ID NO: 427905 - protein, 7 aa, Mycobacterium
ANDNSVE

SEQ ID NO: 427906 - protein, 8 aa, Mycobacterium
ANDPAAGI

SEQ ID NO: 427907 - protein, 8 aa, Mycobacterium
ANDPADPS

SEQ ID NO: 427908 - protein, 6 aa, Mycobacterium
ANDPAV

SEQ ID NO: 427909 - protein, 7 aa, Mycobacterium
ANDPDGE

SEQ ID NO: 427910 - protein, 8 aa, Mycobacterium
ANDPDPLG

SEQ ID NO: 427911 - protein, 21 aa, Mycobacterium
ANDPEATTSSALRAALSMLGK

SEQ ID NO: 427912 - protein, 6 aa, Mycobacterium
ANDPER

SEQ ID NO: 427913 - protein, 5 aa, Mycobacterium
ANDPG

SEQ ID NO: 427914 - protein, 8 aa, Mycobacterium
ANDPGDDV

SEQ ID NO: 427915 - protein, 13 aa, Mycobacterium
ANDPGGQRPRTGD

SEQ ID NO: 427916 - protein, 12 aa, Mycobacterium
ANDPIPTDRDTF

SEQ ID NO: 427917 - protein, 9 aa, Mycobacterium
ANDPLTPRF

SEQ ID NO: 427918 - protein, 11 aa, Mycobacterium
ANDPSLRKSGS

SEQ ID NO: 427919 - protein, 5 aa, Mycobacterium
ANDPV

SEQ ID NO: 427920 - protein, 20 aa, Mycobacterium
ANDPYRTLPTGTTVGPNGER

SEQ ID NO: 427921 - protein, 4 aa, Mycobacterium
ANDR

SEQ ID NO: 427922 - protein, 17 aa, Mycobacterium
ANDRAKAAGATDIEERP

SEQ ID NO: 427923 - protein, 6 aa, Mycobacterium
ANDRER

SEQ ID NO: 427924 - protein, 5 aa, Mycobacterium
ANDRP

SEQ ID NO: 427925 - protein, 8 aa, Mycobacterium
ANDRPRGR

SEQ ID NO: 427926 - protein, 10 aa, Mycobacterium
ANDRSSDGAK

SEQ ID NO: 427927 - protein, 5 aa, Mycobacterium
ANDSA

SEQ ID NO: 427928 - protein, 7 aa, Mycobacterium
ANDSGNN

SEQ ID NO: 427929 - protein, 8 aa, Mycobacterium
ANDSNYGL

SEQ ID NO: 427930 - protein, 5 aa, Mycobacterium
ANDTA

SEQ ID NO: 427931 - protein, 6 aa, Mycobacterium
ANDTAA

SEQ ID NO: 427932 - protein, 8 aa, Mycobacterium
ANDTEAYE

SEQ ID NO: 427933 - protein, 7 aa, Mycobacterium
ANDTGGG

SEQ ID NO: 427934 - protein, 15 aa, Mycobacterium
ANDTGGLGGQGGDAT

SEQ ID NO: 427935 - protein, 8 aa, Mycobacterium
ANDTPAAT

SEQ ID NO: 427936 - protein, 8 aa, Mycobacterium
ANDTQRRR

SEQ ID NO: 427937 - protein, 13 aa, Mycobacterium
ANDTRVVQAESDN

SEQ ID NO: 427938 - protein, 11 aa, Mycobacterium
ANDTTRQTTSH

SEQ ID NO: 427939 - protein, 6 aa, Mycobacterium
ANDVND

SEQ ID NO: 427940 - protein, 4 aa, Mycobacterium
ANDY

SEQ ID NO: 427941 - protein, 9 aa, Mycobacterium
ANEADDGAK

SEQ ID NO: 427942 - protein, 10 aa, Mycobacterium
ANEAERAAPG

SEQ ID NO: 427943 - protein, 9 aa, Mycobacterium
ANEAERVAP

SEQ ID NO: 427944 - protein, 7 aa, Mycobacterium
ANEAGIG

SEQ ID NO: 427945 - protein, 14 aa, Mycobacterium
ANEAGRSLSRGTVG

SEQ ID NO: 427946 - protein, 7 aa, Mycobacterium
ANEAGVE

SEQ ID NO: 427947 - protein, 6 aa, Mycobacterium
ANEANV

SEQ ID NO: 427948 - protein, 8 aa, Mycobacterium
ANEAQARA

SEQ ID NO: 427949 - protein, 11 aa, Mycobacterium
ANEAQRSDGVL

SEQ ID NO: 427950 - protein, 17 aa, Mycobacterium
ANEARPDGRRLAAGDRS

SEQ ID NO: 427951 - protein, 9 aa, Mycobacterium
ANEARRPDG

SEQ ID NO: 427952 - protein, 4 aa, Mycobacterium
ANED

SEQ ID NO: 427953 - protein, 12 aa, Mycobacterium
ANEDAADTLTEQ

SEQ ID NO: 427954 - protein, 5 aa, Mycobacterium
ANEDD

SEQ ID NO: 427955 - protein, 9 aa, Mycobacterium
ANEDDTVAV

SEQ ID NO: 427956 - protein, 12 aa, Mycobacterium
ANEDQKASEAKL

SEQ ID NO: 427957 - protein, 6 aa, Mycobacterium
ANEEAA

SEQ ID NO: 427958 - protein, 7 aa, Mycobacterium
ANEEAAE

SEQ ID NO: 427959 - protein, 6 aa, Mycobacterium
ANEEAR

SEQ ID NO: 427960 - protein, 9 aa, Mycobacterium
ANEEGGGTV

SEQ ID NO: 427961 - protein, 8 aa, Mycobacterium
ANEGLTIT

SEQ ID NO: 427962 - protein, 10 aa, Mycobacterium
ANEGSAEQKA

SEQ ID NO: 427963 - protein, 20 aa, Mycobacterium
ANEHPTDDSRNPGLAHGSQR

SEQ ID NO: 427964 - protein, 5 aa, Mycobacterium
ANEIE

SEQ ID NO: 427965 - protein, 7 aa, Mycobacterium
ANEIGKS

SEQ ID NO: 427966 - protein, 5 aa, Mycobacterium
ANEKA

SEQ ID NO: 427967 - protein, 9 aa, Mycobacterium
ANEKAEADR

SEQ ID NO: 427968 - protein, 5 aa, Mycobacterium
ANEKQ

SEQ ID NO: 427969 - protein, 7 aa, Mycobacterium
ANENGVE

SEQ ID NO: 427970 - protein, 5 aa, Mycobacterium
ANENW

SEQ ID NO: 427971 - protein, 6 aa, Mycobacterium
ANEPAD

SEQ ID NO: 427972 - protein, 7 aa, Mycobacterium
ANEPDEL

SEQ ID NO: 427973 - protein, 7 aa, Mycobacterium
ANEPELA

SEQ ID NO: 427974 - protein, 6 aa, Mycobacterium
ANEPER

SEQ ID NO: 427975 - protein, 8 aa, Mycobacterium
ANEPFTRS

SEQ ID NO: 427976 - protein, 7 aa, Mycobacterium
ANEPGHT

SEQ ID NO: 427977 - protein, 6 aa, Mycobacterium
ANEPGV

SEQ ID NO: 427978 - protein, 9 aa, Mycobacterium
ANEPPPRDS

SEQ ID NO: 427979 - protein, 7 aa, Mycobacterium
ANEPVRS

SEQ ID NO: 427980 - protein, 12 aa, Mycobacterium
ANEQALGNGARL

SEQ ID NO: 427981 - protein, 8 aa, Mycobacterium
ANERPVPP

SEQ ID NO: 427982 - protein, 9 aa, Mycobacterium
ANERRAERR

SEQ ID NO: 427983 - protein, 6 aa, Mycobacterium
ANERRD

SEQ ID NO: 427984 - protein, 8 aa, Mycobacterium
ANERRRTA

SEQ ID NO: 427985 - protein, 4 aa, Mycobacterium
ANES

SEQ ID NO: 427986 - protein, 10 aa, Mycobacterium
ANESGDQANS

SEQ ID NO: 427987 - protein, 12 aa, Mycobacterium
ANESKEEAAERL

SEQ ID NO: 427988 - protein, 6 aa, Mycobacterium
ANESNS

SEQ ID NO: 427989 - protein, 9 aa, Mycobacterium
ANETGSTTR

SEQ ID NO: 427990 - protein, 9 aa, Mycobacterium
ANETPAEPQ

SEQ ID NO: 427991 - protein, 7 aa, Mycobacterium
ANEVATE

SEQ ID NO: 427992 - protein, 13 aa, Mycobacterium
ANEVGAALSADPR

SEQ ID NO: 427993 - protein, 13 aa, Mycobacterium
ANEVGAALSSDPR

SEQ ID NO: 427994 - protein, 8 aa, Mycobacterium
ANEVGKSS

SEQ ID NO: 427995 - protein, 8 aa, Mycobacterium
ANEVGKTS

SEQ ID NO: 427996 - protein, 4 aa, Mycobacterium
ANEY

SEQ ID NO: 427997 - protein, 14 aa, Mycobacterium
ANEYSGQRKPPAVP

SEQ ID NO: 427998 - protein, 13 aa, Mycobacterium
ANEYSGQRRPPAV

SEQ ID NO: 427999 - protein, 5 aa, Mycobacterium
ANFGA

SEQ ID NO: 428000 - protein, 18 aa, Mycobacterium
ANFGADPRVPRAAATTAR

SEQ ID NO: 428001 - protein, 4 aa, Mycobacterium
ANFT

SEQ ID NO: 428002 - protein, 9 aa, Mycobacterium
ANGADRGPL

SEQ ID NO: 428003 - protein, 6 aa, Mycobacterium
ANGAEI

SEQ ID NO: 428004 - protein, 8 aa, Mycobacterium
ANGAGGDI

SEQ ID NO: 428005 - protein, 7 aa, Mycobacterium
ANGAGVT

SEQ ID NO: 428006 - protein, 5 aa, Mycobacterium
ANGAP

SEQ ID NO: 428007 - protein, 8 aa, Mycobacterium
ANGASHEH

SEQ ID NO: 428008 - protein, 5 aa, Mycobacterium
ANGAT

SEQ ID NO: 428009 - protein, 6 aa, Mycobacterium
ANGCPR

SEQ ID NO: 428010 - protein, 6 aa, Mycobacterium
ANGDEK

SEQ ID NO: 428011 - protein, 10 aa, Mycobacterium
ANGDEPLGLP

SEQ ID NO: 428012 - protein, 7 aa, Mycobacterium
ANGDGNQ

SEQ ID NO: 428013 - protein, 9 aa, Mycobacterium
ANGDGTLTV

SEQ ID NO: 428014 - protein, 19 aa, Mycobacterium
ANGDLDSDPQLVNSDPYGE

SEQ ID NO: 428015 - protein, 5 aa, Mycobacterium
ANGDP

SEQ ID NO: 428016 - protein, 8 aa, Mycobacterium
ANGDPSVD

SEQ ID NO: 428017 - protein, 16 aa, Mycobacterium
ANGDSQAVAAPPVSAP

SEQ ID NO: 428018 - protein, 14 aa, Mycobacterium
ANGDTSWVFDASAL

SEQ ID NO: 428019 - protein, 15 aa, Mycobacterium
ANGEADDDAGGAGRL

SEQ ID NO: 428020 - protein, 6 aa, Mycobacterium
ANGEED

SEQ ID NO: 428021 - protein, 7 aa, Mycobacterium
ANGEERH

SEQ ID NO: 428022 - protein, 7 aa, Mycobacterium
ANGEERS

SEQ ID NO: 428023 - protein, 7 aa, Mycobacterium
ANGENTM

SEQ ID NO: 428024 - protein, 8 aa, Mycobacterium
ANGEPEPF

SEQ ID NO: 428025 - protein, 10 aa, Mycobacterium
ANGEPVGASG

SEQ ID NO: 428026 - protein, 6 aa, Mycobacterium
ANGEQL

SEQ ID NO: 428027 - protein, 8 aa, Mycobacterium
ANGESEEA

SEQ ID NO: 428028 - protein, 5 aa, Mycobacterium
ANGET

SEQ ID NO: 428029 - protein, 7 aa, Mycobacterium
ANGEVAD

SEQ ID NO: 428030 - protein, 12 aa, Mycobacterium
ANGFDKGRTNAR

SEQ ID NO: 428031 - protein, 6 aa, Mycobacterium
ANGFGG

SEQ ID NO: 428032 - protein, 7 aa, Mycobacterium
ANGFSEK

SEQ ID NO: 428033 - protein, 12 aa, Mycobacterium
ANGFSKTDTHAR

SEQ ID NO: 428034 - protein, 8 aa, Mycobacterium
ANGFSSGA

SEQ ID NO: 428035 - protein, 7 aa, Mycobacterium
ANGGARS

SEQ ID NO: 428036 - protein, 14 aa, Mycobacterium
ANGGAVRANHPDMA

SEQ ID NO: 428037 - protein, 9 aa, Mycobacterium
ANGGDDDGT

SEQ ID NO: 428038 - protein, 29 aa, Mycobacterium
ANGGDGGGGGLAGVGAAGGNGGTGGGAGV

SEQ ID NO: 428039 - protein, 19 aa, Mycobacterium
ANGGDIASYKAPSSYTGPA

SEQ ID NO: 428040 - protein, 11 aa, Mycobacterium
ANGGELGAESS

SEQ ID NO: 428041 - protein, 5 aa, Mycobacterium
ANGGG

SEQ ID NO: 428042 - protein, 6 aa, Mycobacterium
ANGGGA

SEQ ID NO: 428043 - protein, 9 aa, Mycobacterium
ANGGGGEKY

SEQ ID NO: 428044 - protein, 6 aa, Mycobacterium
ANGGGR

SEQ ID NO: 428045 - protein, 8 aa, Mycobacterium
ANGGGRDG

SEQ ID NO: 428046 - protein, 14 aa, Mycobacterium
ANGGGSGGAGGNAG

SEQ ID NO: 428047 - protein, 6 aa, Mycobacterium
ANGGKI

SEQ ID NO: 428048 - protein, 12 aa, Mycobacterium
ANGGKVGGPFAG

SEQ ID NO: 428049 - protein, 11 aa, Mycobacterium
ANGGKVGGPFE

SEQ ID NO: 428050 - protein, 5 aa, Mycobacterium
ANGGL

SEQ ID NO: 428051 - protein, 16 aa, Mycobacterium
ANGGNGGQGGNGGNAL

SEQ ID NO: 428052 - protein, 8 aa, Mycobacterium
ANGGPDST

SEQ ID NO: 428053 - protein, 5 aa, Mycobacterium
ANGGS

SEQ ID NO: 428054 - protein, 17 aa, Mycobacterium
ANGGSGSPAGASREEQI

SEQ ID NO: 428055 - protein, 8 aa, Mycobacterium
ANGGSPAV

SEQ ID NO: 428056 - protein, 10 aa, Mycobacterium
ANGGTNPITG

SEQ ID NO: 428057 - protein, 5 aa, Mycobacterium
ANGGW

SEQ ID NO: 428058 - protein, 7 aa, Mycobacterium
ANGGWSV

SEQ ID NO: 428059 - protein, 5 aa, Mycobacterium
ANGGY

SEQ ID NO: 428060 - protein, 6 aa, Mycobacterium
ANGGYA

SEQ ID NO: 428061 - protein, 14 aa, Mycobacterium
ANGGYRDDGRLASR

SEQ ID NO: 428062 - protein, 26 aa, Mycobacterium
ANGHHEDDEDADVNEDALDDDALEEV

SEQ ID NO: 428063 - protein, 6 aa, Mycobacterium
ANGHTI

SEQ ID NO: 428064 - protein, 4 aa, Mycobacterium
ANGI

SEQ ID NO: 428065 - protein, 7 aa, Mycobacterium
ANGIGAA

SEQ ID NO: 428066 - protein, 112 aa, Mycobacterium
ANGISRDGKTAGSRLPSDHSTGTAADSGSAKKPKTSAAIKTNDTPAAAAETSTHTNDSATHTVTPSSPGAPPSSGATGSAAETKAAHTQTDSGSGGHTKSSGGTAHEHSAGG

SEQ ID NO: 428067 - protein, 8 aa, Mycobacterium
ANGKAGIT

SEQ ID NO: 428068 - protein, 7 aa, Mycobacterium
ANGKEAI

SEQ ID NO: 428069 - protein, 7 aa, Mycobacterium
ANGKEKL

SEQ ID NO: 428070 - protein, 8 aa, Mycobacterium
ANGKEKLT

SEQ ID NO: 428071 - protein, 8 aa, Mycobacterium
ANGKESIT

SEQ ID NO: 428072 - protein, 7 aa, Mycobacterium
ANGKESV

SEQ ID NO: 428073 - protein, 5 aa, Mycobacterium
ANGKL

SEQ ID NO: 428074 - protein, 16 aa, Mycobacterium
ANGKLDKRALPAPEFT

SEQ ID NO: 428075 - protein, 8 aa, Mycobacterium
ANGKLDRR

SEQ ID NO: 428076 - protein, 5 aa, Mycobacterium
ANGLG

SEQ ID NO: 428077 - protein, 8 aa, Mycobacterium
ANGLQGTG

SEQ ID NO: 428078 - protein, 5 aa, Mycobacterium
ANGLS

SEQ ID NO: 428079 - protein, 7 aa, Mycobacterium
ANGLTPA

SEQ ID NO: 428080 - protein, 4 aa, Mycobacterium
ANGM

SEQ ID NO: 428081 - protein, 13 aa, Mycobacterium
ANGMYDDDAPGAS

SEQ ID NO: 428082 - protein, 20 aa, Mycobacterium
ANGNAIPDGTDGATLPARRE

SEQ ID NO: 428083 - protein, 11 aa, Mycobacterium
ANGNASSSVTI

SEQ ID NO: 428084 - protein, 7 aa, Mycobacterium
ANGNGSP

SEQ ID NO: 428085 - protein, 5 aa, Mycobacterium
ANGNP

SEQ ID NO: 428086 - protein, 4 aa, Mycobacterium
ANGP

SEQ ID NO: 428087 - protein, 7 aa, Mycobacterium
ANGPAYA

SEQ ID NO: 428088 - protein, 9 aa, Mycobacterium
ANGPDRDTE

SEQ ID NO: 428089 - protein, 8 aa, Mycobacterium
ANGPDYDL

SEQ ID NO: 428090 - protein, 14 aa, Mycobacterium
ANGPESLPLVFDVV

SEQ ID NO: 428091 - protein, 10 aa, Mycobacterium
ANGPKEFHRR

SEQ ID NO: 428092 - protein, 7 aa, Mycobacterium
ANGPMTA

SEQ ID NO: 428093 - protein, 7 aa, Mycobacterium
ANGPPLP

SEQ ID NO: 428094 - protein, 8 aa, Mycobacterium
ANGPSGGQ

SEQ ID NO: 428095 - protein, 11 aa, Mycobacterium
ANGPSKDDEAF

SEQ ID NO: 428096 - protein, 11 aa, Mycobacterium
ANGPTKADFGT

SEQ ID NO: 428097 - protein, 9 aa, Mycobacterium
ANGQDAPGA

SEQ ID NO: 428098 - protein, 6 aa, Mycobacterium
ANGQLD

SEQ ID NO: 428099 - protein, 6 aa, Mycobacterium
ANGRFD

SEQ ID NO: 428100 - protein, 12 aa, Mycobacterium
ANGRFDRAQATR

SEQ ID NO: 428101 - protein, 9 aa, Mycobacterium
ANGRFDRSA

SEQ ID NO: 428102 - protein, 6 aa, Mycobacterium
ANGRMM

SEQ ID NO: 428103 - protein, 5 aa, Mycobacterium
ANGRN

SEQ ID NO: 428104 - protein, 6 aa, Mycobacterium
ANGRNP

SEQ ID NO: 428105 - protein, 8 aa, Mycobacterium
ANGRPEIT

SEQ ID NO: 428106 - protein, 8 aa, Mycobacterium
ANGRSVDV

SEQ ID NO: 428107 - protein, 16 aa, Mycobacterium
ANGSAISGASPDNSQA

SEQ ID NO: 428108 - protein, 10 aa, Mycobacterium
ANGSAPEHNK

SEQ ID NO: 428109 - protein, 6 aa, Mycobacterium
ANGSDA

SEQ ID NO: 428110 - protein, 8 aa, Mycobacterium
ANGSEGTG

SEQ ID NO: 428111 - protein, 10 aa, Mycobacterium
ANGSEPEEQI

SEQ ID NO: 428112 - protein, 31 aa, Mycobacterium
ANGSGAAGVSATGAQAGSAAGGAGGGSSVEA

SEQ ID NO: 428113 - protein, 8 aa, Mycobacterium
ANGSGDAH

SEQ ID NO: 428114 - protein, 10 aa, Mycobacterium
ANGSGDGFAD

SEQ ID NO: 428115 - protein, 9 aa, Mycobacterium
ANGSGKSTL

SEQ ID NO: 428116 - protein, 8 aa, Mycobacterium
ANGSGQAT

SEQ ID NO: 428117 - protein, 8 aa, Mycobacterium
ANGSGSPV

SEQ ID NO: 428118 - protein, 7 aa, Mycobacterium
ANGSGTR

SEQ ID NO: 428119 - protein, 7 aa, Mycobacterium
ANGSNEV

SEQ ID NO: 428120 - protein, 5 aa, Mycobacterium
ANGSP

SEQ ID NO: 428121 - protein, 11 aa, Mycobacterium
ANGSPGANTNV

SEQ ID NO: 428122 - protein, 12 aa, Mycobacterium
ANGSRDLPAGHP

SEQ ID NO: 428123 - protein, 14 aa, Mycobacterium
ANGSRDLPPGDPKA

SEQ ID NO: 428124 - protein, 8 aa, Mycobacterium
ANGSSTAT

SEQ ID NO: 428125 - protein, 11 aa, Mycobacterium
ANGTEGGTTDI

SEQ ID NO: 428126 - protein, 8 aa, Mycobacterium
ANGTGIYQ

SEQ ID NO: 428127 - protein, 15 aa, Mycobacterium
ANGTQTTSSLPVGSS

SEQ ID NO: 428128 - protein, 15 aa, Mycobacterium
ANGTSGAGGAGGSGA

SEQ ID NO: 428129 - protein, 12 aa, Mycobacterium
ANGTTCQQRSVE

SEQ ID NO: 428130 - protein, 13 aa, Mycobacterium
ANGTTCQQRSVET

SEQ ID NO: 428131 - protein, 6 aa, Mycobacterium
ANGTVT

SEQ ID NO: 428132 - protein, 4 aa, Mycobacterium
ANGV

SEQ ID NO: 428133 - protein, 6 aa, Mycobacterium
ANGVDE

SEQ ID NO: 428134 - protein, 8 aa, Mycobacterium
ANGVESSA

SEQ ID NO: 428135 - protein, 5 aa, Mycobacterium
ANGVG

SEQ ID NO: 428136 - protein, 9 aa, Mycobacterium
ANGVGAALD

SEQ ID NO: 428137 - protein, 13 aa, Mycobacterium
ANGVSTPIGTVPG

SEQ ID NO: 428138 - protein, 8 aa, Mycobacterium
ANGVTTPF

SEQ ID NO: 428139 - protein, 4 aa, Mycobacterium
ANGW

SEQ ID NO: 428140 - protein, 5 aa, Mycobacterium
ANGWS

SEQ ID NO: 428141 - protein, 4 aa, Mycobacterium
ANGY

SEQ ID NO: 428142 - protein, 7 aa, Mycobacterium
ANGYGEE

SEQ ID NO: 428143 - protein, 5 aa, Mycobacterium
ANGYN

SEQ ID NO: 428144 - protein, 6 aa, Mycobacterium
ANGYPM

SEQ ID NO: 428145 - protein, 8 aa, Mycobacterium
ANGYTTSK

SEQ ID NO: 428146 - protein, 5 aa, Mycobacterium
ANHAD

SEQ ID NO: 428147 - protein, 9 aa, Mycobacterium
ANHADPKQL

SEQ ID NO: 428148 - protein, 5 aa, Mycobacterium
ANHAN

SEQ ID NO: 428149 - protein, 5 aa, Mycobacterium
ANHDP

SEQ ID NO: 428150 - protein, 20 aa, Mycobacterium
ANHEPQLQSARDLRAAAAAR

SEQ ID NO: 428151 - protein, 5 aa, Mycobacterium
ANHGA

SEQ ID NO: 428152 - protein, 8 aa, Mycobacterium
ANHGGSKH

SEQ ID NO: 428153 - protein, 8 aa, Mycobacterium
ANHGGSPL

SEQ ID NO: 428154 - protein, 7 aa, Mycobacterium
ANHGPHD

SEQ ID NO: 428155 - protein, 8 aa, Mycobacterium
ANHLTDNA

SEQ ID NO: 428156 - protein, 12 aa, Mycobacterium
ANHNDSRGLTTG

SEQ ID NO: 428157 - protein, 7 aa, Mycobacterium
ANHPGSD

SEQ ID NO: 428158 - protein, 6 aa, Mycobacterium
ANHTEG

SEQ ID NO: 428159 - protein, 13 aa, Mycobacterium
ANIAEDGSRDIRR

SEQ ID NO: 428160 - protein, 11 aa, Mycobacterium
ANIDNNVDGAH

SEQ ID NO: 428161 - protein, 7 aa, Mycobacterium
ANIEERR

SEQ ID NO: 428162 - protein, 5 aa, Mycobacterium
ANIEG

SEQ ID NO: 428163 - protein, 4 aa, Mycobacterium
ANIG

SEQ ID NO: 428164 - protein, 29 aa, Mycobacterium
ANIGNGNIGTANIGTGNSGVGNTPITPGI

SEQ ID NO: 428165 - protein, 14 aa, Mycobacterium
ANIGNSAVTSSIAE

SEQ ID NO: 428166 - protein, 5 aa, Mycobacterium
ANIGR

SEQ ID NO: 428167 - protein, 8 aa, Mycobacterium
ANIGSIDS

SEQ ID NO: 428168 - protein, 7 aa, Mycobacterium
ANIGSSN

SEQ ID NO: 428169 - protein, 7 aa, Mycobacterium
ANIPGDP

SEQ ID NO: 428170 - protein, 9 aa, Mycobacterium
ANIPPERYQ

SEQ ID NO: 428171 - protein, 19 aa, Mycobacterium
ANISGRPAAGTATEAREQL

SEQ ID NO: 428172 - protein, 20 aa, Mycobacterium
ANISGSPAAVTAAQAREQLG

SEQ ID NO: 428173 - protein, 10 aa, Mycobacterium
ANISTGGTAV

SEQ ID NO: 428174 - protein, 9 aa, Mycobacterium
ANITGPGPI

SEQ ID NO: 428175 - protein, 14 aa, Mycobacterium
ANKAGARDRADDLA

SEQ ID NO: 428176 - protein, 10 aa, Mycobacterium
ANKAKAGVTN

SEQ ID NO: 428177 - protein, 8 aa, Mycobacterium
ANKDFSQQ

SEQ ID NO: 428178 - protein, 9 aa, Mycobacterium
ANKDTENGI

SEQ ID NO: 428179 - protein, 7 aa, Mycobacterium
ANKENRA

SEQ ID NO: 428180 - protein, 10 aa, Mycobacterium
ANKFTKDGQI

SEQ ID NO: 428181 - protein, 9 aa, Mycobacterium
ANKGDSQQL

SEQ ID NO: 428182 - protein, 12 aa, Mycobacterium
ANKIHNKGDQGK

SEQ ID NO: 428183 - protein, 6 aa, Mycobacterium
ANKLGK

SEQ ID NO: 428184 - protein, 9 aa, Mycobacterium
ANKLGPGEA

SEQ ID NO: 428185 - protein, 10 aa, Mycobacterium
ANKNAGEGTR

SEQ ID NO: 428186 - protein, 7 aa, Mycobacterium
ANKNLGD

SEQ ID NO: 428187 - protein, 9 aa, Mycobacterium
ANKNPDNGL

SEQ ID NO: 428188 - protein, 8 aa, Mycobacterium
ANKPAVEG

SEQ ID NO: 428189 - protein, 8 aa, Mycobacterium
ANKPDGRV

SEQ ID NO: 428190 - protein, 5 aa, Mycobacterium
ANKPK

SEQ ID NO: 428191 - protein, 21 aa, Mycobacterium
ANKPVIRPADQGEGPPTTESG

SEQ ID NO: 428192 - protein, 5 aa, Mycobacterium
ANKRS

SEQ ID NO: 428193 - protein, 6 aa, Mycobacterium
ANKRSA

SEQ ID NO: 428194 - protein, 4 aa, Mycobacterium
ANKS

SEQ ID NO: 428195 - protein, 7 aa, Mycobacterium
ANKSART

SEQ ID NO: 428196 - protein, 8 aa, Mycobacterium
ANKSARTL

SEQ ID NO: 428197 - protein, 10 aa, Mycobacterium
ANKSDGSRAE

SEQ ID NO: 428198 - protein, 28 aa, Mycobacterium
ANKSTLGGVRRGSGTMAPMTGRAATPIS

SEQ ID NO: 428199 - protein, 5 aa, Mycobacterium
ANKTL

SEQ ID NO: 428200 - protein, 12 aa, Mycobacterium
ANLDKAAKAATR

SEQ ID NO: 428201 - protein, 7 aa, Mycobacterium
ANLEQRR

SEQ ID NO: 428202 - protein, 8 aa, Mycobacterium
ANLESGAR

SEQ ID NO: 428203 - protein, 4 aa, Mycobacterium
ANLG

SEQ ID NO: 428204 - protein, 10 aa, Mycobacterium
ANLGDAAGTY

SEQ ID NO: 428205 - protein, 26 aa, Mycobacterium
ANLGGDARRPAPVGAYPAGASAYGAE

SEQ ID NO: 428206 - protein, 13 aa, Mycobacterium
ANLGGGALRPAPV

SEQ ID NO: 428207 - protein, 7 aa, Mycobacterium
ANLGGYN

SEQ ID NO: 428208 - protein, 13 aa, Mycobacterium
ANLGSGNHSSNNF

SEQ ID NO: 428209 - protein, 9 aa, Mycobacterium
ANLKSDEDR

SEQ ID NO: 428210 - protein, 4 aa, Mycobacterium
ANLP

SEQ ID NO: 428211 - protein, 7 aa, Mycobacterium
ANLPAPD

SEQ ID NO: 428212 - protein, 11 aa, Mycobacterium
ANLPQRPPRVP

SEQ ID NO: 428213 - protein, 5 aa, Mycobacterium
ANLPV

SEQ ID NO: 428214 - protein, 5 aa, Mycobacterium
ANLQT

SEQ ID NO: 428215 - protein, 4 aa, Mycobacterium
ANLR

SEQ ID NO: 428216 - protein, 5 aa, Mycobacterium
ANLRR

SEQ ID NO: 428217 - protein, 8 aa, Mycobacterium
ANLSPAQQ

SEQ ID NO: 428218 - protein, 14 aa, Mycobacterium
ANLSTSETAQAAGV

SEQ ID NO: 428219 - protein, 6 aa, Mycobacterium
ANLTPT

SEQ ID NO: 428220 - protein, 6 aa, Mycobacterium
ANLTRN

SEQ ID NO: 428221 - protein, 12 aa, Mycobacterium
ANLTRNAADFGG

SEQ ID NO: 428222 - protein, 18 aa, Mycobacterium
ANLTSSSAGSGGGPVTGA

SEQ ID NO: 428223 - protein, 6 aa, Mycobacterium
ANMAST

SEQ ID NO: 428224 - protein, 7 aa, Mycobacterium
ANMDQPE

SEQ ID NO: 428225 - protein, 7 aa, Mycobacterium
ANNAEAM

SEQ ID NO: 428226 - protein, 6 aa, Mycobacterium
ANNAER

SEQ ID NO: 428227 - protein, 5 aa, Mycobacterium
ANNAK

SEQ ID NO: 428228 - protein, 14 aa, Mycobacterium
ANNCPNPGCASDTL

SEQ ID NO: 428229 - protein, 11 aa, Mycobacterium
ANNCPNPSCDS

SEQ ID NO: 428230 - protein, 17 aa, Mycobacterium
ANNDGIVSPDNIDDAAL

SEQ ID NO: 428231 - protein, 13 aa, Mycobacterium
ANNDGKVDPDNFD

SEQ ID NO: 428232 - protein, 18 aa, Mycobacterium
ANNDGVVSPDNVDDAALS

SEQ ID NO: 428233 - protein, 10 aa, Mycobacterium
ANNEPEDDER

SEQ ID NO: 428234 - protein, 4 aa, Mycobacterium
ANNF

SEQ ID NO: 428235 - protein, 17 aa, Mycobacterium
ANNGKDTLWKPGGPAQP

SEQ ID NO: 428236 - protein, 19 aa, Mycobacterium
ANNNEYRPDDPNSEEQSDL

SEQ ID NO: 428237 - protein, 6 aa, Mycobacterium
ANNPRG

SEQ ID NO: 428238 - protein, 7 aa, Mycobacterium
ANNPSGH

SEQ ID NO: 428239 - protein, 9 aa, Mycobacterium
ANNPTAAHS

SEQ ID NO: 428240 - protein, 6 aa, Mycobacterium
ANNRDL

SEQ ID NO: 428241 - protein, 5 aa, Mycobacterium
ANNRE

SEQ ID NO: 428242 - protein, 6 aa, Mycobacterium
ANNSGF

SEQ ID NO: 428243 - protein, 16 aa, Mycobacterium
ANNSGFANTGIGGLGN

SEQ ID NO: 428244 - protein, 27 aa, Mycobacterium
ANNSPKTNVGGEHPSIDARDNGADDPL

SEQ ID NO: 428245 - protein, 9 aa, Mycobacterium
ANNSSYGLG

SEQ ID NO: 428246 - protein, 9 aa, Mycobacterium
ANNSYGRAG

SEQ ID NO: 428247 - protein, 16 aa, Mycobacterium
ANNYESQEQASQQILS

SEQ ID NO: 428248 - protein, 5 aa, Mycobacterium
ANNYP

SEQ ID NO: 428249 - protein, 5 aa, Mycobacterium
ANPAA

SEQ ID NO: 428250 - protein, 13 aa, Mycobacterium
ANPAAAATTARIR

SEQ ID NO: 428251 - protein, 6 aa, Mycobacterium
ANPAAQ

SEQ ID NO: 428252 - protein, 8 aa, Mycobacterium
ANPAAQEL

SEQ ID NO: 428253 - protein, 6 aa, Mycobacterium
ANPAAS

SEQ ID NO: 428254 - protein, 6 aa, Mycobacterium
ANPAED

SEQ ID NO: 428255 - protein, 9 aa, Mycobacterium
ANPAEDAVS

SEQ ID NO: 428256 - protein, 7 aa, Mycobacterium
ANPAGGA

SEQ ID NO: 428257 - protein, 7 aa, Mycobacterium
ANPAHSL

SEQ ID NO: 428258 - protein, 8 aa, Mycobacterium
ANPAHSLA

SEQ ID NO: 428259 - protein, 5 aa, Mycobacterium
ANPAP

SEQ ID NO: 428260 - protein, 9 aa, Mycobacterium
ANPAPIPNA

SEQ ID NO: 428261 - protein, 43 aa, Mycobacterium
ANPAPPEQIPRPTIRPRTRRTGEHSAGEHRCTTARQLQRPPPT

SEQ ID NO: 428262 - protein, 10 aa, Mycobacterium
ANPARARRRA

SEQ ID NO: 428263 - protein, 17 aa, Mycobacterium
ANPARESDPDKLRGAVA

SEQ ID NO: 428264 - protein, 24 aa, Mycobacterium
ANPARPSAAEEARTVAASTNTATL

SEQ ID NO: 428265 - protein, 11 aa, Mycobacterium
ANPASAEAKGA

SEQ ID NO: 428266 - protein, 19 aa, Mycobacterium
ANPATGGTAGGRQPTGPDG

SEQ ID NO: 428267 - protein, 6 aa, Mycobacterium
ANPATP

SEQ ID NO: 428268 - protein, 7 aa, Mycobacterium
ANPATRI

SEQ ID NO: 428269 - protein, 11 aa, Mycobacterium
ANPAVPEPAGL

SEQ ID NO: 428270 - protein, 4 aa, Mycobacterium
ANPD

SEQ ID NO: 428271 - protein, 5 aa, Mycobacterium
ANPDA

SEQ ID NO: 428272 - protein, 10 aa, Mycobacterium
ANPDDLARTD

SEQ ID NO: 428273 - protein, 13 aa, Mycobacterium
ANPDDLARTDISD

SEQ ID NO: 428274 - protein, 9 aa, Mycobacterium
ANPDDRATV

SEQ ID NO: 428275 - protein, 6 aa, Mycobacterium
ANPDEI

SEQ ID NO: 428276 - protein, 6 aa, Mycobacterium
ANPDFG

SEQ ID NO: 428277 - protein, 5 aa, Mycobacterium
ANPDG

SEQ ID NO: 428278 - protein, 10 aa, Mycobacterium
ANPDGAKEVA

SEQ ID NO: 428279 - protein, 6 aa, Mycobacterium
ANPDGD

SEQ ID NO: 428280 - protein, 15 aa, Mycobacterium
ANPDGDVLWQPGGQT

SEQ ID NO: 428281 - protein, 7 aa, Mycobacterium
ANPDGSL

SEQ ID NO: 428282 - protein, 7 aa, Mycobacterium
ANPDHGR

SEQ ID NO: 428283 - protein, 5 aa, Mycobacterium
ANPDI

SEQ ID NO: 428284 - protein, 5 aa, Mycobacterium
ANPDK

SEQ ID NO: 428285 - protein, 8 aa, Mycobacterium
ANPDMEAQ

SEQ ID NO: 428286 - protein, 21 aa, Mycobacterium
ANPDPASMARRADTEKITRAT

SEQ ID NO: 428287 - protein, 16 aa, Mycobacterium
ANPDPDAVKPPALTAS

SEQ ID NO: 428288 - protein, 16 aa, Mycobacterium
ANPDPDAVNPPALAGT

SEQ ID NO: 428289 - protein, 15 aa, Mycobacterium
ANPDPEAARPPALST

SEQ ID NO: 428290 - protein, 15 aa, Mycobacterium
ANPDPEAVKPPQLAN

SEQ ID NO: 428291 - protein, 10 aa, Mycobacterium
ANPDPPTAAQ

SEQ ID NO: 428292 - protein, 11 aa, Mycobacterium
ANPDPPTSAQV

SEQ ID NO: 428293 - protein, 9 aa, Mycobacterium
ANPDRGTLA

SEQ ID NO: 428294 - protein, 10 aa, Mycobacterium
ANPDRGTLSQ

SEQ ID NO: 428295 - protein, 12 aa, Mycobacterium
ANPDSHEQPWDK

SEQ ID NO: 428296 - protein, 21 aa, Mycobacterium
ANPDTAAQERRVASEKVTKTL

SEQ ID NO: 428297 - protein, 6 aa, Mycobacterium
ANPDVE

SEQ ID NO: 428298 - protein, 13 aa, Mycobacterium
ANPEAHTQPWDQK

SEQ ID NO: 428299 - protein, 6 aa, Mycobacterium
ANPEAV

SEQ ID NO: 428300 - protein, 7 aa, Mycobacterium
ANPEAVT

SEQ ID NO: 428301 - protein, 6 aa, Mycobacterium
ANPEGD

SEQ ID NO: 428302 - protein, 14 aa, Mycobacterium
ANPEGDVLWKPGAN

SEQ ID NO: 428303 - protein, 5 aa, Mycobacterium
ANPEL

SEQ ID NO: 428304 - protein, 7 aa, Mycobacterium
ANPENAE

SEQ ID NO: 428305 - protein, 12 aa, Mycobacterium
ANPEPPTKAQID

SEQ ID NO: 428306 - protein, 10 aa, Mycobacterium
ANPEPPTQAQ

SEQ ID NO: 428307 - protein, 6 aa, Mycobacterium
ANPERA

SEQ ID NO: 428308 - protein, 8 aa, Mycobacterium
ANPERMGR

SEQ ID NO: 428309 - protein, 10 aa, Mycobacterium
ANPETGDNRP

SEQ ID NO: 428310 - protein, 7 aa, Mycobacterium
ANPETGY

SEQ ID NO: 428311 - protein, 6 aa, Mycobacterium
ANPEVS

SEQ ID NO: 428312 - protein, 6 aa, Mycobacterium
ANPEVT

SEQ ID NO: 428313 - protein, 5 aa, Mycobacterium
ANPFA

SEQ ID NO: 428314 - protein, 29 aa, Mycobacterium
ANPFGAGGGHASSTAGGTSSGLGSANASA

SEQ ID NO: 428315 - protein, 4 aa, Mycobacterium
ANPG

SEQ ID NO: 428316 - protein, 6 aa, Mycobacterium
ANPGAA

SEQ ID NO: 428317 - protein, 159 aa, Mycobacterium
ANPGAAGQDVTTTDDPAANPLTGGNGSEGAAGSTIQNGGVGGQGGSATSTNQNSALGGEGGKGGDGANGGMGGNGGSGDTSGQTDAPQPSATGGNGGNGGDAQVAGGAGGAGGWGGDGHANQGDAVGGVGGRGGAGFASSAAGGAGGTGGTGGQGGNGG

SEQ ID NO: 428318 - protein, 7 aa, Mycobacterium
ANPGAAR

SEQ ID NO: 428319 - protein, 14 aa, Mycobacterium
ANPGATPDGRGPLG

SEQ ID NO: 428320 - protein, 8 aa, Mycobacterium
ANPGDDSV

SEQ ID NO: 428321 - protein, 8 aa, Mycobacterium
ANPGESAT

SEQ ID NO: 428322 - protein, 9 aa, Mycobacterium
ANPGFSDRA

SEQ ID NO: 428323 - protein, 6 aa, Mycobacterium
ANPGKI

SEQ ID NO: 428324 - protein, 6 aa, Mycobacterium
ANPGLG

SEQ ID NO: 428325 - protein, 6 aa, Mycobacterium
ANPGLR

SEQ ID NO: 428326 - protein, 10 aa, Mycobacterium
ANPGNPAGRE

SEQ ID NO: 428327 - protein, 6 aa, Mycobacterium
ANPGQT

SEQ ID NO: 428328 - protein, 7 aa, Mycobacterium
ANPGRRD

SEQ ID NO: 428329 - protein, 11 aa, Mycobacterium
ANPGSTEDETA

SEQ ID NO: 428330 - protein, 14 aa, Mycobacterium
ANPGSVADDFTKPG

SEQ ID NO: 428331 - protein, 9 aa, Mycobacterium
ANPGTSEDE

SEQ ID NO: 428332 - protein, 8 aa, Mycobacterium
ANPGTVTG

SEQ ID NO: 428333 - protein, 6 aa, Mycobacterium
ANPGVT

SEQ ID NO: 428334 - protein, 5 aa, Mycobacterium
ANPGY

SEQ ID NO: 428335 - protein, 8 aa, Mycobacterium
ANPHADTE

SEQ ID NO: 428336 - protein, 5 aa, Mycobacterium
ANPHD

SEQ ID NO: 428337 - protein, 8 aa, Mycobacterium
ANPHKAPR

SEQ ID NO: 428338 - protein, 6 aa, Mycobacterium
ANPHLN

SEQ ID NO: 428339 - protein, 4 aa, Mycobacterium
ANPI

SEQ ID NO: 428340 - protein, 12 aa, Mycobacterium
ANPIDGEPPYSP

SEQ ID NO: 428341 - protein, 5 aa, Mycobacterium
ANPIE

SEQ ID NO: 428342 - protein, 5 aa, Mycobacterium
ANPIG

SEQ ID NO: 428343 - protein, 4 aa, Mycobacterium
ANPK

SEQ ID NO: 428344 - protein, 6 aa, Mycobacterium
ANPKGL

SEQ ID NO: 428345 - protein, 5 aa, Mycobacterium
ANPKT

SEQ ID NO: 428346 - protein, 7 aa, Mycobacterium
ANPKTNL

SEQ ID NO: 428347 - protein, 6 aa, Mycobacterium
ANPKTR

SEQ ID NO: 428348 - protein, 9 aa, Mycobacterium
ANPKVAGDM

SEQ ID NO: 428349 - protein, 4 aa, Mycobacterium
ANPL

SEQ ID NO: 428350 - protein, 6 aa, Mycobacterium
ANPLAG

SEQ ID NO: 428351 - protein, 6 aa, Mycobacterium
ANPLAT

SEQ ID NO: 428352 - protein, 7 aa, Mycobacterium
ANPLATE

SEQ ID NO: 428353 - protein, 6 aa, Mycobacterium
ANPLGG

SEQ ID NO: 428354 - protein, 7 aa, Mycobacterium
ANPLTGR

SEQ ID NO: 428355 - protein, 4 aa, Mycobacterium
ANPM

SEQ ID NO: 428356 - protein, 4 aa, Mycobacterium
ANPN

SEQ ID NO: 428357 - protein, 20 aa, Mycobacterium
ANPNGALAKSPFPRSVPTSQ

SEQ ID NO: 428358 - protein, 6 aa, Mycobacterium
ANPNGI

SEQ ID NO: 428359 - protein, 6 aa, Mycobacterium
ANPNKF

SEQ ID NO: 428360 - protein, 9 aa, Mycobacterium
ANPNSGIRG

SEQ ID NO: 428361 - protein, 9 aa, Mycobacterium
ANPNSVEAK

SEQ ID NO: 428362 - protein, 5 aa, Mycobacterium
ANPNT

SEQ ID NO: 428363 - protein, 6 aa, Mycobacterium
ANPNTG

SEQ ID NO: 428364 - protein, 7 aa, Mycobacterium
ANPNVKA

SEQ ID NO: 428365 - protein, 7 aa, Mycobacterium
ANPNWSA

SEQ ID NO: 428366 - protein, 4 aa, Mycobacterium
ANPP

SEQ ID NO: 428367 - protein, 5 aa, Mycobacterium
ANPPA

SEQ ID NO: 428368 - protein, 15 aa, Mycobacterium
ANPPAGDNNRSHRHR

SEQ ID NO: 428369 - protein, 17 aa, Mycobacterium
ANPPDRSAGGVDLTPPM

SEQ ID NO: 428370 - protein, 6 aa, Mycobacterium
ANPPGF

SEQ ID NO: 428371 - protein, 14 aa, Mycobacterium
ANPPRLGAESDEIL

SEQ ID NO: 428372 - protein, 6 aa, Mycobacterium
ANPPSF

SEQ ID NO: 428373 - protein, 10 aa, Mycobacterium
ANPPTDKRDR

SEQ ID NO: 428374 - protein, 21 aa, Mycobacterium
ANPPWAGTPALPPSTSPASSI

SEQ ID NO: 428375 - protein, 6 aa, Mycobacterium
ANPQAK

SEQ ID NO: 428376 - protein, 6 aa, Mycobacterium
ANPQAR

SEQ ID NO: 428377 - protein, 105 aa, Mycobacterium
ANPQASGTATDGHGGSGINGGHGGNGGQGTIEANGPSAVASGIGAGGNGGDGIDGGLGGNGGDGVVNTTANAANPGSATGTATGGDGGKATGTASQGGNGGPSWV

SEQ ID NO: 428378 - protein, 7 aa, Mycobacterium
ANPQDTD

SEQ ID NO: 428379 - protein, 8 aa, Mycobacterium
ANPQEVTR

SEQ ID NO: 428380 - protein, 14 aa, Mycobacterium
ANPQGTVSVSTDMG

SEQ ID NO: 428381 - protein, 8 aa, Mycobacterium
ANPQLPKV

SEQ ID NO: 428382 - protein, 9 aa, Mycobacterium
ANPQQGNAY

SEQ ID NO: 428383 - protein, 8 aa, Mycobacterium
ANPQTGEF

SEQ ID NO: 428384 - protein, 5 aa, Mycobacterium
ANPQV

SEQ ID NO: 428385 - protein, 6 aa, Mycobacterium
ANPQVA

SEQ ID NO: 428386 - protein, 8 aa, Mycobacterium
ANPQVKDE

SEQ ID NO: 428387 - protein, 6 aa, Mycobacterium
ANPREA

SEQ ID NO: 428388 - protein, 22 aa, Mycobacterium
ANPRPNGPRTHERVDANDGLLP

SEQ ID NO: 428389 - protein, 9 aa, Mycobacterium
ANPSAPPPH

SEQ ID NO: 428390 - protein, 10 aa, Mycobacterium
ANPSARVEVG

SEQ ID NO: 428391 - protein, 6 aa, Mycobacterium
ANPSDD

SEQ ID NO: 428392 - protein, 6 aa, Mycobacterium
ANPSEI

SEQ ID NO: 428393 - protein, 9 aa, Mycobacterium
ANPSGLKSI

SEQ ID NO: 428394 - protein, 9 aa, Mycobacterium
ANPSGVPMS

SEQ ID NO: 428395 - protein, 5 aa, Mycobacterium
ANPSH

SEQ ID NO: 428396 - protein, 8 aa, Mycobacterium
ANPSTQLR

SEQ ID NO: 428397 - protein, 8 aa, Mycobacterium
ANPSTTAR

SEQ ID NO: 428398 - protein, 6 aa, Mycobacterium
ANPSVT

SEQ ID NO: 428399 - protein, 8 aa, Mycobacterium
ANPTDDTL

SEQ ID NO: 428400 - protein, 9 aa, Mycobacterium
ANPTSEIDR

SEQ ID NO: 428401 - protein, 7 aa, Mycobacterium
ANPTSIA

SEQ ID NO: 428402 - protein, 6 aa, Mycobacterium
ANPTTV

SEQ ID NO: 428403 - protein, 6 aa, Mycobacterium
ANPTVS

SEQ ID NO: 428404 - protein, 27 aa, Mycobacterium
ANPTVSVQDGDKVLPDRTARELEGEER

SEQ ID NO: 428405 - protein, 18 aa, Mycobacterium
ANPTVTLQDGDKDATLTA

SEQ ID NO: 428406 - protein, 4 aa, Mycobacterium
ANPV

SEQ ID NO: 428407 - protein, 5 aa, Mycobacterium
ANPVA

SEQ ID NO: 428408 - protein, 17 aa, Mycobacterium
ANPVAQPMGSYTPEALG

SEQ ID NO: 428409 - protein, 17 aa, Mycobacterium
ANPVGISTDPPAKQARF

SEQ ID NO: 428410 - protein, 5 aa, Mycobacterium
ANPVI

SEQ ID NO: 428411 - protein, 10 aa, Mycobacterium
ANPVPSADGK

SEQ ID NO: 428412 - protein, 6 aa, Mycobacterium
ANPVRK

SEQ ID NO: 428413 - protein, 12 aa, Mycobacterium
ANPVRSAHPADR

SEQ ID NO: 428414 - protein, 7 aa, Mycobacterium
ANPYPTY

SEQ ID NO: 428415 - protein, 7 aa, Mycobacterium
ANQAATA

SEQ ID NO: 428416 - protein, 5 aa, Mycobacterium
ANQAD

SEQ ID NO: 428417 - protein, 11 aa, Mycobacterium
ANQAGEDNRNV

SEQ ID NO: 428418 - protein, 6 aa, Mycobacterium
ANQAGY

SEQ ID NO: 428419 - protein, 12 aa, Mycobacterium
ANQATKPGPGSV

SEQ ID NO: 428420 - protein, 7 aa, Mycobacterium
ANQATNL

SEQ ID NO: 428421 - protein, 7 aa, Mycobacterium
ANQDTSV

SEQ ID NO: 428422 - protein, 12 aa, Mycobacterium
ANQEKLASGDVK

SEQ ID NO: 428423 - protein, 7 aa, Mycobacterium
ANQEQTL

SEQ ID NO: 428424 - protein, 7 aa, Mycobacterium
ANQFGAG

SEQ ID NO: 428425 - protein, 6 aa, Mycobacterium
ANQGAG

SEQ ID NO: 428426 - protein, 5 aa, Mycobacterium
ANQGE

SEQ ID NO: 428427 - protein, 23 aa, Mycobacterium
ANQGTSSQKELETKGREAGRAAT

SEQ ID NO: 428428 - protein, 7 aa, Mycobacterium
ANQGYPD

SEQ ID NO: 428429 - protein, 13 aa, Mycobacterium
ANQHPRSFPNDPV

SEQ ID NO: 428430 - protein, 14 aa, Mycobacterium
ANQHPRSFPNDPVD

SEQ ID NO: 428431 - protein, 4 aa, Mycobacterium
ANQI

SEQ ID NO: 428432 - protein, 13 aa, Mycobacterium
ANQINDSRYNPDY

SEQ ID NO: 428433 - protein, 5 aa, Mycobacterium
ANQKR

SEQ ID NO: 428434 - protein, 7 aa, Mycobacterium
ANQNGKR

SEQ ID NO: 428435 - protein, 5 aa, Mycobacterium
ANQPA

SEQ ID NO: 428436 - protein, 6 aa, Mycobacterium
ANQPHP

SEQ ID NO: 428437 - protein, 10 aa, Mycobacterium
ANQPPDPGEH

SEQ ID NO: 428438 - protein, 5 aa, Mycobacterium
ANQPY

SEQ ID NO: 428439 - protein, 6 aa, Mycobacterium
ANQSAH

SEQ ID NO: 428440 - protein, 9 aa, Mycobacterium
ANQSDDEEL

SEQ ID NO: 428441 - protein, 6 aa, Mycobacterium
ANQSIT

SEQ ID NO: 428442 - protein, 6 aa, Mycobacterium
ANQSPS

SEQ ID NO: 428443 - protein, 6 aa, Mycobacterium
ANQTDG

SEQ ID NO: 428444 - protein, 4 aa, Mycobacterium
ANRA

SEQ ID NO: 428445 - protein, 8 aa, Mycobacterium
ANRADPYP

SEQ ID NO: 428446 - protein, 14 aa, Mycobacterium
ANRAGLQPSTDDVR

SEQ ID NO: 428447 - protein, 18 aa, Mycobacterium
ANRAGSGCLDSTDAGLTG

SEQ ID NO: 428448 - protein, 14 aa, Mycobacterium
ANRAKVSTTTDTVR

SEQ ID NO: 428449 - protein, 11 aa, Mycobacterium
ANRANGPATGI

SEQ ID NO: 428450 - protein, 11 aa, Mycobacterium
ANRAPSAANNQ

SEQ ID NO: 428451 - protein, 11 aa, Mycobacterium
ANRAPSVGNAQ

SEQ ID NO: 428452 - protein, 7 aa, Mycobacterium
ANRATTA

SEQ ID NO: 428453 - protein, 7 aa, Mycobacterium
ANRAVEE

SEQ ID NO: 428454 - protein, 11 aa, Mycobacterium
ANRCRPKPTDK

SEQ ID NO: 428455 - protein, 6 aa, Mycobacterium
ANRDAD

SEQ ID NO: 428456 - protein, 11 aa, Mycobacterium
ANRDAREFDEP

SEQ ID NO: 428457 - protein, 7 aa, Mycobacterium
ANRDEAT

SEQ ID NO: 428458 - protein, 6 aa, Mycobacterium
ANRDED

SEQ ID NO: 428459 - protein, 7 aa, Mycobacterium
ANRDEDI

SEQ ID NO: 428460 - protein, 6 aa, Mycobacterium
ANRDEE

SEQ ID NO: 428461 - protein, 12 aa, Mycobacterium
ANRDEGRWTDPN

SEQ ID NO: 428462 - protein, 7 aa, Mycobacterium
ANRDEHR

SEQ ID NO: 428463 - protein, 13 aa, Mycobacterium
ANRDEREYGNDAA

SEQ ID NO: 428464 - protein, 11 aa, Mycobacterium
ANRDEREYPDP

SEQ ID NO: 428465 - protein, 11 aa, Mycobacterium
ANRDEREYPEP

SEQ ID NO: 428466 - protein, 11 aa, Mycobacterium
ANRDEREYPQP

SEQ ID NO: 428467 - protein, 11 aa, Mycobacterium
ANRDERQFDDP

SEQ ID NO: 428468 - protein, 14 aa, Mycobacterium
ANRDERQYGPDAAE

SEQ ID NO: 428469 - protein, 14 aa, Mycobacterium
ANRDERQYGPDAGE

SEQ ID NO: 428470 - protein, 16 aa, Mycobacterium
ANRDERQYGPDAGELD

SEQ ID NO: 428471 - protein, 15 aa, Mycobacterium
ANRDERQYGSDAGEL

SEQ ID NO: 428472 - protein, 8 aa, Mycobacterium
ANRDERRF

SEQ ID NO: 428473 - protein, 10 aa, Mycobacterium
ANRDERRFDN

SEQ ID NO: 428474 - protein, 9 aa, Mycobacterium
ANRDERRWE

SEQ ID NO: 428475 - protein, 12 aa, Mycobacterium
ANRDESRWPDPN

SEQ ID NO: 428476 - protein, 8 aa, Mycobacterium
ANRDESTF

SEQ ID NO: 428477 - protein, 10 aa, Mycobacterium
ANRDETRWTD

SEQ ID NO: 428478 - protein, 12 aa, Mycobacterium
ANRDETRWTDPD

SEQ ID NO: 428479 - protein, 8 aa, Mycobacterium
ANRDGAPE

SEQ ID NO: 428480 - protein, 10 aa, Mycobacterium
ANRDGHRWER

SEQ ID NO: 428481 - protein, 12 aa, Mycobacterium
ANRDHRRFPPDG

SEQ ID NO: 428482 - protein, 6 aa, Mycobacterium
ANRDPA

SEQ ID NO: 428483 - protein, 10 aa, Mycobacterium
ANRDPAAFEN

SEQ ID NO: 428484 - protein, 12 aa, Mycobacterium
ANRDPAEFDDPD

SEQ ID NO: 428485 - protein, 11 aa, Mycobacterium
ANRDPAEYDRP

SEQ ID NO: 428486 - protein, 11 aa, Mycobacterium
ANRDPAKFDDP

SEQ ID NO: 428487 - protein, 9 aa, Mycobacterium
ANRDPAKFS

SEQ ID NO: 428488 - protein, 8 aa, Mycobacterium
ANRDPALY

SEQ ID NO: 428489 - protein, 11 aa, Mycobacterium
ANRDPDAFTNA

SEQ ID NO: 428490 - protein, 9 aa, Mycobacterium
ANRDPDAWT

SEQ ID NO: 428491 - protein, 10 aa, Mycobacterium
ANRDPEAFTD

SEQ ID NO: 428492 - protein, 10 aa, Mycobacterium
ANRDPHAWTD

SEQ ID NO: 428493 - protein, 7 aa, Mycobacterium
ANRDPNV

SEQ ID NO: 428494 - protein, 6 aa, Mycobacterium
ANRDPQ

SEQ ID NO: 428495 - protein, 12 aa, Mycobacterium
ANRDPQAWTDPD

SEQ ID NO: 428496 - protein, 13 aa, Mycobacterium
ANRDPQNRYNAPA

SEQ ID NO: 428497 - protein, 9 aa, Mycobacterium
ANRDPRAFD

SEQ ID NO: 428498 - protein, 21 aa, Mycobacterium
ANRDPRKFDNPNEFRPDRKNV

SEQ ID NO: 428499 - protein, 11 aa, Mycobacterium
ANRDPRKFEDP

SEQ ID NO: 428500 - protein, 12 aa, Mycobacterium
ANRDPRKFENPN

SEQ ID NO: 428501 - protein, 23 aa, Mycobacterium
ANRDPRQFDDPESFDADRPRNPH

SEQ ID NO: 428502 - protein, 7 aa, Mycobacterium
ANRDPRR

SEQ ID NO: 428503 - protein, 8 aa, Mycobacterium
ANRDPRRF

SEQ ID NO: 428504 - protein, 10 aa, Mycobacterium
ANRDPRRFDE

SEQ ID NO: 428505 - protein, 23 aa, Mycobacterium
ANRDPRRFEDPATFDPARKNARQ

SEQ ID NO: 428506 - protein, 23 aa, Mycobacterium
ANRDPRRFEDPTTFDPARKNARQ

SEQ ID NO: 428507 - protein, 13 aa, Mycobacterium
ANRDPRTRYGPPA

SEQ ID NO: 428508 - protein, 7 aa, Mycobacterium
ANRDPSV

SEQ ID NO: 428509 - protein, 8 aa, Mycobacterium
ANRDPSVF

SEQ ID NO: 428510 - protein, 6 aa, Mycobacterium
ANRDQS

SEQ ID NO: 428511 - protein, 5 aa, Mycobacterium
ANRDR

SEQ ID NO: 428512 - protein, 7 aa, Mycobacterium
ANREDHR

SEQ ID NO: 428513 - protein, 5 aa, Mycobacterium
ANRER

SEQ ID NO: 428514 - protein, 10 aa, Mycobacterium
ANRERQAQIT

SEQ ID NO: 428515 - protein, 10 aa, Mycobacterium
ANRFSKDGQI

SEQ ID NO: 428516 - protein, 12 aa, Mycobacterium
ANRGAPGRPGVL

SEQ ID NO: 428517 - protein, 8 aa, Mycobacterium
ANRGDGPA

SEQ ID NO: 428518 - protein, 5 aa, Mycobacterium
ANRGI

SEQ ID NO: 428519 - protein, 16 aa, Mycobacterium
ANRGQDGEDPADGGRY

SEQ ID NO: 428520 - protein, 9 aa, Mycobacterium
ANRGRDEQR

SEQ ID NO: 428521 - protein, 12 aa, Mycobacterium
ANRGRDEQRAAM

SEQ ID NO: 428522 - protein, 11 aa, Mycobacterium
ANRGRDEQRRA

SEQ ID NO: 428523 - protein, 10 aa, Mycobacterium
ANRGRDEQRV

SEQ ID NO: 428524 - protein, 8 aa, Mycobacterium
ANRGTGLG

SEQ ID NO: 428525 - protein, 5 aa, Mycobacterium
ANRGV

SEQ ID NO: 428526 - protein, 9 aa, Mycobacterium
ANRIGTGTA

SEQ ID NO: 428527 - protein, 12 aa, Mycobacterium
ANRKGSGPRPGR

SEQ ID NO: 428528 - protein, 4 aa, Mycobacterium
ANRL

SEQ ID NO: 428529 - protein, 7 aa, Mycobacterium
ANRLEQA

SEQ ID NO: 428530 - protein, 10 aa, Mycobacterium
ANRLGPEGGG

SEQ ID NO: 428531 - protein, 4 aa, Mycobacterium
ANRN

SEQ ID NO: 428532 - protein, 7 aa, Mycobacterium
ANRNAAG

SEQ ID NO: 428533 - protein, 6 aa, Mycobacterium
ANRNKR

SEQ ID NO: 428534 - protein, 8 aa, Mycobacterium
ANRNPLTR

SEQ ID NO: 428535 - protein, 7 aa, Mycobacterium
ANRNPQA

SEQ ID NO: 428536 - protein, 8 aa, Mycobacterium
ANRPAGVT

SEQ ID NO: 428537 - protein, 7 aa, Mycobacterium
ANRPAVE

SEQ ID NO: 428538 - protein, 6 aa, Mycobacterium
ANRPIS

SEQ ID NO: 428539 - protein, 5 aa, Mycobacterium
ANRPP

SEQ ID NO: 428540 - protein, 8 aa, Mycobacterium
ANRPPIET

SEQ ID NO: 428541 - protein, 10 aa, Mycobacterium
ANRPQGYTKK

SEQ ID NO: 428542 - protein, 16 aa, Mycobacterium
ANRPRPEASTGDRERY

SEQ ID NO: 428543 - protein, 10 aa, Mycobacterium
ANRPTDPDWA

SEQ ID NO: 428544 - protein, 12 aa, Mycobacterium
ANRQEDRHPDPD

SEQ ID NO: 428545 - protein, 12 aa, Mycobacterium
ANRQEDRYPEPD

SEQ ID NO: 428546 - protein, 7 aa, Mycobacterium
ANRRAAE

SEQ ID NO: 428547 - protein, 8 aa, Mycobacterium
ANRRGGPE

SEQ ID NO: 428548 - protein, 8 aa, Mycobacterium
ANRRPDAV

SEQ ID NO: 428549 - protein, 26 aa, Mycobacterium
ANRRQVAAGSGLPSDRATESPTEPPT

SEQ ID NO: 428550 - protein, 9 aa, Mycobacterium
ANRRTAASY

SEQ ID NO: 428551 - protein, 7 aa, Mycobacterium
ANRRTSH

SEQ ID NO: 428552 - protein, 4 aa, Mycobacterium
ANRS

SEQ ID NO: 428553 - protein, 16 aa, Mycobacterium
ANRSDAPKPAPRRKPM

SEQ ID NO: 428554 - protein, 6 aa, Mycobacterium
ANRSDE

SEQ ID NO: 428555 - protein, 17 aa, Mycobacterium
ANRSGATAPTPPRRKPI

SEQ ID NO: 428556 - protein, 7 aa, Mycobacterium
ANRSGDV

SEQ ID NO: 428557 - protein, 7 aa, Mycobacterium
ANRSIDN

SEQ ID NO: 428558 - protein, 20 aa, Mycobacterium
ANRTAAELSPAEKDAVSHRG

SEQ ID NO: 428559 - protein, 4 aa, Mycobacterium
ANRV

SEQ ID NO: 428560 - protein, 7 aa, Mycobacterium
ANSAALR

SEQ ID NO: 428561 - protein, 8 aa, Mycobacterium
ANSAESAL

SEQ ID NO: 428562 - protein, 13 aa, Mycobacterium
ANSAGLAGTQAAG

SEQ ID NO: 428563 - protein, 10 aa, Mycobacterium
ANSAKDHVRQ

SEQ ID NO: 428564 - protein, 7 aa, Mycobacterium
ANSAQQC

SEQ ID NO: 428565 - protein, 15 aa, Mycobacterium
ANSAQSRKKNRLARA

SEQ ID NO: 428566 - protein, 6 aa, Mycobacterium
ANSARA

SEQ ID NO: 428567 - protein, 6 aa, Mycobacterium
ANSASA

SEQ ID NO: 428568 - protein, 5 aa, Mycobacterium
ANSDG

SEQ ID NO: 428569 - protein, 10 aa, Mycobacterium
ANSDGEPNDL

SEQ ID NO: 428570 - protein, 8 aa, Mycobacterium
ANSDGHTV

SEQ ID NO: 428571 - protein, 6 aa, Mycobacterium
ANSDGS

SEQ ID NO: 428572 - protein, 5 aa, Mycobacterium
ANSDL

SEQ ID NO: 428573 - protein, 9 aa, Mycobacterium
ANSDNPAGS

SEQ ID NO: 428574 - protein, 13 aa, Mycobacterium
ANSEAGSALGAGD

SEQ ID NO: 428575 - protein, 7 aa, Mycobacterium
ANSEDAA

SEQ ID NO: 428576 - protein, 9 aa, Mycobacterium
ANSENPAGS

SEQ ID NO: 428577 - protein, 10 aa, Mycobacterium
ANSFADTPIA

SEQ ID NO: 428578 - protein, 6 aa, Mycobacterium
ANSGAK

SEQ ID NO: 428579 - protein, 10 aa, Mycobacterium
ANSGDRTPID

SEQ ID NO: 428580 - protein, 10 aa, Mycobacterium
ANSGDTNSGF

SEQ ID NO: 428581 - protein, 10 aa, Mycobacterium
ANSGDTNTGL

SEQ ID NO: 428582 - protein, 8 aa, Mycobacterium
ANSGEPHE

SEQ ID NO: 428583 - protein, 8 aa, Mycobacterium
ANSGLGEV

SEQ ID NO: 428584 - protein, 8 aa, Mycobacterium
ANSGLGLE

SEQ ID NO: 428585 - protein, 9 aa, Mycobacterium
ANSGQYASD

SEQ ID NO: 428586 - protein, 5 aa, Mycobacterium
ANSGR

SEQ ID NO: 428587 - protein, 26 aa, Mycobacterium
ANSHGQKVQSAGNNMASTDSAVGSSW

SEQ ID NO: 428588 - protein, 4 aa, Mycobacterium
ANSI

SEQ ID NO: 428589 - protein, 8 aa, Mycobacterium
ANSIPRRG

SEQ ID NO: 428590 - protein, 9 aa, Mycobacterium
ANSISREAA

SEQ ID NO: 428591 - protein, 9 aa, Mycobacterium
ANSLPDDRF

SEQ ID NO: 428592 - protein, 19 aa, Mycobacterium
ANSNAAAAEDVKAERADAG

SEQ ID NO: 428593 - protein, 10 aa, Mycobacterium
ANSNSRYGAT

SEQ ID NO: 428594 - protein, 10 aa, Mycobacterium
ANSPAGALSG

SEQ ID NO: 428595 - protein, 6 aa, Mycobacterium
ANSPAV

SEQ ID NO: 428596 - protein, 8 aa, Mycobacterium
ANSPDRRY

SEQ ID NO: 428597 - protein, 15 aa, Mycobacterium
ANSPEAQLSRQDETD

SEQ ID NO: 428598 - protein, 7 aa, Mycobacterium
ANSPEHD

SEQ ID NO: 428599 - protein, 11 aa, Mycobacterium
ANSPGGLTSAE

SEQ ID NO: 428600 - protein, 8 aa, Mycobacterium
ANSPIDAE

SEQ ID NO: 428601 - protein, 13 aa, Mycobacterium
ANSPIDAKGRFEE

SEQ ID NO: 428602 - protein, 8 aa, Mycobacterium
ANSPIDAQ

SEQ ID NO: 428603 - protein, 13 aa, Mycobacterium
ANSPIDASGRFEE

SEQ ID NO: 428604 - protein, 12 aa, Mycobacterium
ANSPKPGRAPTG

SEQ ID NO: 428605 - protein, 13 aa, Mycobacterium
ANSPKPGRAPTGL

SEQ ID NO: 428606 - protein, 5 aa, Mycobacterium
ANSPL

SEQ ID NO: 428607 - protein, 13 aa, Mycobacterium
ANSPLDGDGRFEE

SEQ ID NO: 428608 - protein, 8 aa, Mycobacterium
ANSPPQFR

SEQ ID NO: 428609 - protein, 8 aa, Mycobacterium
ANSPTAET

SEQ ID NO: 428610 - protein, 12 aa, Mycobacterium
ANSPTDENGRFT

SEQ ID NO: 428611 - protein, 12 aa, Mycobacterium
ANSPVDANGRFT

SEQ ID NO: 428612 - protein, 8 aa, Mycobacterium
ANSQRSEL

SEQ ID NO: 428613 - protein, 4 aa, Mycobacterium
ANSR

SEQ ID NO: 428614 - protein, 12 aa, Mycobacterium
ANSRAGAADPQI

SEQ ID NO: 428615 - protein, 8 aa, Mycobacterium
ANSRASGV

SEQ ID NO: 428616 - protein, 6 aa, Mycobacterium
ANSREV

SEQ ID NO: 428617 - protein, 10 aa, Mycobacterium
ANSREYGNQS

SEQ ID NO: 428618 - protein, 9 aa, Mycobacterium
ANSRSPETL

SEQ ID NO: 428619 - protein, 6 aa, Mycobacterium
ANSRSQ

SEQ ID NO: 428620 - protein, 6 aa, Mycobacterium
ANSSIS

SEQ ID NO: 428621 - protein, 9 aa, Mycobacterium
ANSTATVAQ

SEQ ID NO: 428622 - protein, 17 aa, Mycobacterium
ANSTEPLPAPDKSGGSV

SEQ ID NO: 428623 - protein, 11 aa, Mycobacterium
ANSTLEKMPDG

SEQ ID NO: 428624 - protein, 7 aa, Mycobacterium
ANSTVQN

SEQ ID NO: 428625 - protein, 7 aa, Mycobacterium
ANSVGPG

SEQ ID NO: 428626 - protein, 24 aa, Mycobacterium
ANSYAATEAANATHAGGGSTSGVP

SEQ ID NO: 428627 - protein, 14 aa, Mycobacterium
ANSYASAEATNAAD

SEQ ID NO: 428628 - protein, 11 aa, Mycobacterium
ANSYGSTAPRL

SEQ ID NO: 428629 - protein, 11 aa, Mycobacterium
ANTAAAGSTTG

SEQ ID NO: 428630 - protein, 6 aa, Mycobacterium
ANTAEA

SEQ ID NO: 428631 - protein, 17 aa, Mycobacterium
ANTAEGQQPRRVEARTR

SEQ ID NO: 428632 - protein, 5 aa, Mycobacterium
ANTAI

SEQ ID NO: 428633 - protein, 13 aa, Mycobacterium
ANTAKPGRAPTGL

SEQ ID NO: 428634 - protein, 9 aa, Mycobacterium
ANTAPGAAK

SEQ ID NO: 428635 - protein, 6 aa, Mycobacterium
ANTAPM

SEQ ID NO: 428636 - protein, 8 aa, Mycobacterium
ANTASQTY

SEQ ID NO: 428637 - protein, 13 aa, Mycobacterium
ANTATVDSGGRRP

SEQ ID NO: 428638 - protein, 6 aa, Mycobacterium
ANTCSK

SEQ ID NO: 428639 - protein, 11 aa, Mycobacterium
ANTDAANAGAA

SEQ ID NO: 428640 - protein, 15 aa, Mycobacterium
ANTDATLVDGRVGSL

SEQ ID NO: 428641 - protein, 9 aa, Mycobacterium
ANTDDGRSV

SEQ ID NO: 428642 - protein, 7 aa, Mycobacterium
ANTDGNP

SEQ ID NO: 428643 - protein, 5 aa, Mycobacterium
ANTDH

SEQ ID NO: 428644 - protein, 6 aa, Mycobacterium
ANTDPI

SEQ ID NO: 428645 - protein, 17 aa, Mycobacterium
ANTELTAKQAAGLEPSR

SEQ ID NO: 428646 - protein, 6 aa, Mycobacterium
ANTGAA

SEQ ID NO: 428647 - protein, 7 aa, Mycobacterium
ANTGAAV

SEQ ID NO: 428648 - protein, 6 aa, Mycobacterium
ANTGAI

SEQ ID NO: 428649 - protein, 6 aa, Mycobacterium
ANTGDG

SEQ ID NO: 428650 - protein, 8 aa, Mycobacterium
ANTGDGNI

SEQ ID NO: 428651 - protein, 9 aa, Mycobacterium
ANTGEGGIA

SEQ ID NO: 428652 - protein, 6 aa, Mycobacterium
ANTGFY

SEQ ID NO: 428653 - protein, 7 aa, Mycobacterium
ANTGGRP

SEQ ID NO: 428654 - protein, 14 aa, Mycobacterium
ANTGIANSGNYDTG

SEQ ID NO: 428655 - protein, 7 aa, Mycobacterium
ANTGIPT

SEQ ID NO: 428656 - protein, 7 aa, Mycobacterium
ANTGLGL

SEQ ID NO: 428657 - protein, 8 aa, Mycobacterium
ANTGLGYE

SEQ ID NO: 428658 - protein, 12 aa, Mycobacterium
ANTGLQAIPQDN

SEQ ID NO: 428659 - protein, 28 aa, Mycobacterium
ANTGNHNVGAGNTGDGNIGFGNTGNGNI

SEQ ID NO: 428660 - protein, 7 aa, Mycobacterium
ANTGNNN

SEQ ID NO: 428661 - protein, 9 aa, Mycobacterium
ANTGPSLTP

SEQ ID NO: 428662 - protein, 8 aa, Mycobacterium
ANTGQYAK

SEQ ID NO: 428663 - protein, 8 aa, Mycobacterium
ANTGRSYG

SEQ ID NO: 428664 - protein, 7 aa, Mycobacterium
ANTGSNN

SEQ ID NO: 428665 - protein, 14 aa, Mycobacterium
ANTGSSVTPDYDPP

SEQ ID NO: 428666 - protein, 9 aa, Mycobacterium
ANTGSTNWG

SEQ ID NO: 428667 - protein, 33 aa, Mycobacterium
ANTGVANAGSYNTGNLNAGDINTGSFNTGVSNT

SEQ ID NO: 428668 - protein, 13 aa, Mycobacterium
ANTGYSGGAQTGW

SEQ ID NO: 428669 - protein, 26 aa, Mycobacterium
ANTHGANVQAAGANMAQTDGAVGSSW

SEQ ID NO: 428670 - protein, 7 aa, Mycobacterium
ANTHPAA

SEQ ID NO: 428671 - protein, 4 aa, Mycobacterium
ANTI

SEQ ID NO: 428672 - protein, 7 aa, Mycobacterium
ANTIAEN

SEQ ID NO: 428673 - protein, 5 aa, Mycobacterium
ANTIE

SEQ ID NO: 428674 - protein, 6 aa, Mycobacterium
ANTIEE

SEQ ID NO: 428675 - protein, 10 aa, Mycobacterium
ANTIEGGTSD

SEQ ID NO: 428676 - protein, 10 aa, Mycobacterium
ANTIEGGTSE

SEQ ID NO: 428677 - protein, 9 aa, Mycobacterium
ANTKDTGLR

SEQ ID NO: 428678 - protein, 13 aa, Mycobacterium
ANTLEATQTQINT

SEQ ID NO: 428679 - protein, 9 aa, Mycobacterium
ANTLGPGDA

SEQ ID NO: 428680 - protein, 14 aa, Mycobacterium
ANTLGSGGPAFEAT

SEQ ID NO: 428681 - protein, 6 aa, Mycobacterium
ANTLRR

SEQ ID NO: 428682 - protein, 9 aa, Mycobacterium
ANTLSGGQQ

SEQ ID NO: 428683 - protein, 32 aa, Mycobacterium
ANTNGTGGVGGAGGDSGLLGAGGAGGSGGTAL

SEQ ID NO: 428684 - protein, 5 aa, Mycobacterium
ANTNI

SEQ ID NO: 428685 - protein, 10 aa, Mycobacterium
ANTNPATDAV

SEQ ID NO: 428686 - protein, 5 aa, Mycobacterium
ANTPA

SEQ ID NO: 428687 - protein, 7 aa, Mycobacterium
ANTPADG

SEQ ID NO: 428688 - protein, 7 aa, Mycobacterium
ANTPASE

SEQ ID NO: 428689 - protein, 7 aa, Mycobacterium
ANTPATP

SEQ ID NO: 428690 - protein, 6 aa, Mycobacterium
ANTPGS

SEQ ID NO: 428691 - protein, 7 aa, Mycobacterium
ANTPKAE

SEQ ID NO: 428692 - protein, 6 aa, Mycobacterium
ANTPQA

SEQ ID NO: 428693 - protein, 15 aa, Mycobacterium
ANTPQDDEDPLTGGR

SEQ ID NO: 428694 - protein, 6 aa, Mycobacterium
ANTPQS

SEQ ID NO: 428695 - protein, 14 aa, Mycobacterium
ANTPRRRSEKSRTA

SEQ ID NO: 428696 - protein, 6 aa, Mycobacterium
ANTPTV

SEQ ID NO: 428697 - protein, 8 aa, Mycobacterium
ANTPVQQA

SEQ ID NO: 428698 - protein, 6 aa, Mycobacterium
ANTPWG

SEQ ID NO: 428699 - protein, 5 aa, Mycobacterium
ANTRG

SEQ ID NO: 428700 - protein, 12 aa, Mycobacterium
ANTSATSAAPRV

SEQ ID NO: 428701 - protein, 6 aa, Mycobacterium
ANTSAV

SEQ ID NO: 428702 - protein, 8 aa, Mycobacterium
ANTSGAMG

SEQ ID NO: 428703 - protein, 10 aa, Mycobacterium
ANTSRGSVGV

SEQ ID NO: 428704 - protein, 9 aa, Mycobacterium
ANTTDGGIA

SEQ ID NO: 428705 - protein, 8 aa, Mycobacterium
ANTTELTE

SEQ ID NO: 428706 - protein, 11 aa, Mycobacterium
ANTTGAAAADT

SEQ ID NO: 428707 - protein, 8 aa, Mycobacterium
ANTTRGAV

SEQ ID NO: 428708 - protein, 5 aa, Mycobacterium
ANTVA

SEQ ID NO: 428709 - protein, 5 aa, Mycobacterium
ANTVG

SEQ ID NO: 428710 - protein, 7 aa, Mycobacterium
ANTYGEL

SEQ ID NO: 428711 - protein, 10 aa, Mycobacterium
ANTYTAEDAT

SEQ ID NO: 428712 - protein, 9 aa, Mycobacterium
ANTYTAEGV

SEQ ID NO: 428713 - protein, 10 aa, Mycobacterium
ANTYTAQGAT

SEQ ID NO: 428714 - protein, 11 aa, Mycobacterium
ANVAGKHGTDT

SEQ ID NO: 428715 - protein, 16 aa, Mycobacterium
ANVARRSKTDVLIVHT

SEQ ID NO: 428716 - protein, 5 aa, Mycobacterium
ANVDA

SEQ ID NO: 428717 - protein, 5 aa, Mycobacterium
ANVDP

SEQ ID NO: 428718 - protein, 5 aa, Mycobacterium
ANVDT

SEQ ID NO: 428719 - protein, 9 aa, Mycobacterium
ANVEGAGEV

SEQ ID NO: 428720 - protein, 6 aa, Mycobacterium
ANVEGV

SEQ ID NO: 428721 - protein, 6 aa, Mycobacterium
ANVERG

SEQ ID NO: 428722 - protein, 15 aa, Mycobacterium
ANVGDQIQPSAFTED

SEQ ID NO: 428723 - protein, 7 aa, Mycobacterium
ANVKTRS

SEQ ID NO: 428724 - protein, 4 aa, Mycobacterium
ANVN

SEQ ID NO: 428725 - protein, 5 aa, Mycobacterium
ANVPA

SEQ ID NO: 428726 - protein, 7 aa, Mycobacterium
ANVPDDD

SEQ ID NO: 428727 - protein, 13 aa, Mycobacterium
ANVPPPDAYAPLP

SEQ ID NO: 428728 - protein, 7 aa, Mycobacterium
ANVPPSV

SEQ ID NO: 428729 - protein, 7 aa, Mycobacterium
ANVPTPA

SEQ ID NO: 428730 - protein, 7 aa, Mycobacterium
ANVQPDA

SEQ ID NO: 428731 - protein, 4 aa, Mycobacterium
ANVS

SEQ ID NO: 428732 - protein, 11 aa, Mycobacterium
ANVSGQPPAVD

SEQ ID NO: 428733 - protein, 20 aa, Mycobacterium
ANVSGRPAALTAAEARGQLD

SEQ ID NO: 428734 - protein, 19 aa, Mycobacterium
ANVSGRPAAVDAAEARDQL

SEQ ID NO: 428735 - protein, 5 aa, Mycobacterium
ANVTG

SEQ ID NO: 428736 - protein, 5 aa, Mycobacterium
ANVTH

SEQ ID NO: 428737 - protein, 10 aa, Mycobacterium
ANVTPEEGKA

SEQ ID NO: 428738 - protein, 5 aa, Mycobacterium
ANVTS

SEQ ID NO: 428739 - protein, 6 aa, Mycobacterium
ANVTSA

SEQ ID NO: 428740 - protein, 10 aa, Mycobacterium
ANVTSKADDL

SEQ ID NO: 428741 - protein, 9 aa, Mycobacterium
ANVTTDAKA

SEQ ID NO: 428742 - protein, 14 aa, Mycobacterium
ANVVSAGRTNLDNA

SEQ ID NO: 428743 - protein, 11 aa, Mycobacterium
ANWAPATGEPL

SEQ ID NO: 428744 - protein, 4 aa, Mycobacterium
ANWD

SEQ ID NO: 428745 - protein, 13 aa, Mycobacterium
ANWDGADAIRELS

SEQ ID NO: 428746 - protein, 13 aa, Mycobacterium
ANWDPQAYPEPDK

SEQ ID NO: 428747 - protein, 4 aa, Mycobacterium
ANWS

SEQ ID NO: 428748 - protein, 11 aa, Mycobacterium
ANYAGRPSPLY

SEQ ID NO: 428749 - protein, 6 aa, Mycobacterium
ANYDED

SEQ ID NO: 428750 - protein, 15 aa, Mycobacterium
ANYEATKDLPAATGD

SEQ ID NO: 428751 - protein, 15 aa, Mycobacterium
ANYEATKDLPAATGE

SEQ ID NO: 428752 - protein, 4 aa, Mycobacterium
ANYF

SEQ ID NO: 428753 - protein, 5 aa, Mycobacterium
ANYGA

SEQ ID NO: 428754 - protein, 10 aa, Mycobacterium
ANYGPGHVPN

SEQ ID NO: 428755 - protein, 7 aa, Mycobacterium
ANYGRAN

SEQ ID NO: 428756 - protein, 5 aa, Mycobacterium
ANYPG

SEQ ID NO: 428757 - protein, 9 aa, Mycobacterium
ANYRATTST

SEQ ID NO: 428758 - protein, 7 aa, Mycobacterium
ANYTPEQ

SEQ ID NO: 428759 - protein, 5 aa, Mycobacterium
APAAA

SEQ ID NO: 428760 - protein, 8 aa, Mycobacterium
APAAAATR

SEQ ID NO: 428761 - protein, 21 aa, Mycobacterium
APAAAGTEGAVSGVEGLPSGS

SEQ ID NO: 428762 - protein, 7 aa, Mycobacterium
APAAAIP

SEQ ID NO: 428763 - protein, 7 aa, Mycobacterium
APAAAKA

SEQ ID NO: 428764 - protein, 18 aa, Mycobacterium
APAAAPPAGEGPASAQLS

SEQ ID NO: 428765 - protein, 12 aa, Mycobacterium
APAAAPTHEDAR

SEQ ID NO: 428766 - protein, 7 aa, Mycobacterium
APAAAPV

SEQ ID NO: 428767 - protein, 40 aa, Mycobacterium
APAAAQAVESAVESGARAMGSLGSGLGTSGIGGSGVAAGL

SEQ ID NO: 428768 - protein, 16 aa, Mycobacterium
APAAAQERATAARARL

SEQ ID NO: 428769 - protein, 15 aa, Mycobacterium
APAAATCHDPADSAA

SEQ ID NO: 428770 - protein, 35 aa, Mycobacterium
APAAATSAPAPDPEPAFAASPAVPAGIAPAPGAGL

SEQ ID NO: 428771 - protein, 5 aa, Mycobacterium
APAAC

SEQ ID NO: 428772 - protein, 5 aa, Mycobacterium
APAAD

SEQ ID NO: 428773 - protein, 9 aa, Mycobacterium
APAADDPRL

SEQ ID NO: 428774 - protein, 10 aa, Mycobacterium
APAADDPRLV

SEQ ID NO: 428775 - protein, 6 aa, Mycobacterium
APAAEV

SEQ ID NO: 428776 - protein, 61 aa, Mycobacterium
APAAEVTDAGKSEPAASKPATPAAAPRPKPPAAPAPAPEARPPAPEPAAPAPAPAAPAPVA

SEQ ID NO: 428777 - protein, 6 aa, Mycobacterium
APAAGN

SEQ ID NO: 428778 - protein, 8 aa, Mycobacterium
APAAGSAR

SEQ ID NO: 428779 - protein, 54 aa, Mycobacterium
APAAGSPSDTTAGGGGQEQAVAAESVKNEPAPAPEADVPARSGTAETDPEATDA

SEQ ID NO: 428780 - protein, 8 aa, Mycobacterium
APAAGYDD

SEQ ID NO: 428781 - protein, 5 aa, Mycobacterium
APAAI

SEQ ID NO: 428782 - protein, 7 aa, Mycobacterium
APAAKAV

SEQ ID NO: 428783 - protein, 21 aa, Mycobacterium
APAAKSLRATVGADGSFAPAK

SEQ ID NO: 428784 - protein, 13 aa, Mycobacterium
APAALKDREDDLT

SEQ ID NO: 428785 - protein, 14 aa, Mycobacterium
APAALPAPQPDTDV

SEQ ID NO: 428786 - protein, 12 aa, Mycobacterium
APAANAVATAPA

SEQ ID NO: 428787 - protein, 14 aa, Mycobacterium
APAANKRATDWPER

SEQ ID NO: 428788 - protein, 9 aa, Mycobacterium
APAAPGTPA

SEQ ID NO: 428789 - protein, 6 aa, Mycobacterium
APAAPP

SEQ ID NO: 428790 - protein, 17 aa, Mycobacterium
APAAPPTGAGMGTGGGA

SEQ ID NO: 428791 - protein, 17 aa, Mycobacterium
APAAPSVPDATADTTPA

SEQ ID NO: 428792 - protein, 13 aa, Mycobacterium
APAAPYQAGRRGA

SEQ ID NO: 428793 - protein, 5 aa, Mycobacterium
APAAQ

SEQ ID NO: 428794 - protein, 12 aa, Mycobacterium
APAAQGANRTGR

SEQ ID NO: 428795 - protein, 8 aa, Mycobacterium
APAAQPGP

SEQ ID NO: 428796 - protein, 9 aa, Mycobacterium
APAAQSGER

SEQ ID NO: 428797 - protein, 10 aa, Mycobacterium
APAARAAIGS

SEQ ID NO: 428798 - protein, 8 aa, Mycobacterium
APAARPVS

SEQ ID NO: 428799 - protein, 9 aa, Mycobacterium
APAARQPAV

SEQ ID NO: 428800 - protein, 9 aa, Mycobacterium
APAARRRAY

SEQ ID NO: 428801 - protein, 15 aa, Mycobacterium
APAASESSESVQSAA

SEQ ID NO: 428802 - protein, 11 aa, Mycobacterium
APAATPAAATL

SEQ ID NO: 428803 - protein, 14 aa, Mycobacterium
APAATQSSTTSAPF

SEQ ID NO: 428804 - protein, 6 aa, Mycobacterium
APAATS

SEQ ID NO: 428805 - protein, 11 aa, Mycobacterium
APAATTSPGGL

SEQ ID NO: 428806 - protein, 6 aa, Mycobacterium
APAATV

SEQ ID NO: 428807 - protein, 6 aa, Mycobacterium
APAAVG

SEQ ID NO: 428808 - protein, 9 aa, Mycobacterium
APAAVGAAG

SEQ ID NO: 428809 - protein, 23 aa, Mycobacterium
APAAVPAPGAPDPGAALGGATTS

SEQ ID NO: 428810 - protein, 5 aa, Mycobacterium
APADA

SEQ ID NO: 428811 - protein, 7 aa, Mycobacterium
APADANG

SEQ ID NO: 428812 - protein, 5 aa, Mycobacterium
APADD

SEQ ID NO: 428813 - protein, 7 aa, Mycobacterium
APADEAA

SEQ ID NO: 428814 - protein, 13 aa, Mycobacterium
APADEAPQGRLEE

SEQ ID NO: 428815 - protein, 11 aa, Mycobacterium
APADEEARDQL

SEQ ID NO: 428816 - protein, 24 aa, Mycobacterium
APADEPWDAATSADGDGEDETPAP

SEQ ID NO: 428817 - protein, 5 aa, Mycobacterium
APADF

SEQ ID NO: 428818 - protein, 6 aa, Mycobacterium
APADGA

SEQ ID NO: 428819 - protein, 11 aa, Mycobacterium
APADGETNPIR

SEQ ID NO: 428820 - protein, 16 aa, Mycobacterium
APADGHDDDAVEAAAE

SEQ ID NO: 428821 - protein, 6 aa, Mycobacterium
APADGL

SEQ ID NO: 428822 - protein, 11 aa, Mycobacterium
APADGSAGSLD

SEQ ID NO: 428823 - protein, 6 aa, Mycobacterium
APADGV

SEQ ID NO: 428824 - protein, 6 aa, Mycobacterium
APADKA

SEQ ID NO: 428825 - protein, 5 aa, Mycobacterium
APADL

SEQ ID NO: 428826 - protein, 24 aa, Mycobacterium
APADLDARSSTGQAPTNDEWTGTG

SEQ ID NO: 428827 - protein, 7 aa, Mycobacterium
APADLPA

SEQ ID NO: 428828 - protein, 15 aa, Mycobacterium
APADNSIDATASRDF

SEQ ID NO: 428829 - protein, 36 aa, Mycobacterium
APADPAAATETDLTAEEQQPDVHDDEEAADSGRPKS

SEQ ID NO: 428830 - protein, 8 aa, Mycobacterium
APADPAAL

SEQ ID NO: 428831 - protein, 8 aa, Mycobacterium
APADPDAY

SEQ ID NO: 428832 - protein, 15 aa, Mycobacterium
APADPGKENTTITPI

SEQ ID NO: 428833 - protein, 19 aa, Mycobacterium
APADPPPQPEPLPAGPTRR

SEQ ID NO: 428834 - protein, 6 aa, Mycobacterium
APADPQ

SEQ ID NO: 428835 - protein, 6 aa, Mycobacterium
APADPR

SEQ ID NO: 428836 - protein, 16 aa, Mycobacterium
APADPRRAVSYRVFTA

SEQ ID NO: 428837 - protein, 5 aa, Mycobacterium
APADQ

SEQ ID NO: 428838 - protein, 8 aa, Mycobacterium
APADQPDF

SEQ ID NO: 428839 - protein, 7 aa, Mycobacterium
APADQPQ

SEQ ID NO: 428840 - protein, 11 aa, Mycobacterium
APADRDQKARL

SEQ ID NO: 428841 - protein, 10 aa, Mycobacterium
APADREQKAR

SEQ ID NO: 428842 - protein, 9 aa, Mycobacterium
APADRGAAL

SEQ ID NO: 428843 - protein, 8 aa, Mycobacterium
APADRPES

SEQ ID NO: 428844 - protein, 8 aa, Mycobacterium
APADSAAG

SEQ ID NO: 428845 - protein, 10 aa, Mycobacterium
APADSSPAIA

SEQ ID NO: 428846 - protein, 9 aa, Mycobacterium
APADTDPAL

SEQ ID NO: 428847 - protein, 5 aa, Mycobacterium
APADV

SEQ ID NO: 428848 - protein, 8 aa, Mycobacterium
APADVDGV

SEQ ID NO: 428849 - protein, 22 aa, Mycobacterium
APADVIGDQPDRRGRHGAGDRI

SEQ ID NO: 428850 - protein, 5 aa, Mycobacterium
APADY

SEQ ID NO: 428851 - protein, 5 aa, Mycobacterium
APAEA

SEQ ID NO: 428852 - protein, 8 aa, Mycobacterium
APAEAGYG

SEQ ID NO: 428853 - protein, 8 aa, Mycobacterium
APAEDKPV

SEQ ID NO: 428854 - protein, 16 aa, Mycobacterium
APAEFGGAGIGRAGDR

SEQ ID NO: 428855 - protein, 7 aa, Mycobacterium
APAEGRN

SEQ ID NO: 428856 - protein, 7 aa, Mycobacterium
APAEGTC

SEQ ID NO: 428857 - protein, 6 aa, Mycobacterium
APAEHS

SEQ ID NO: 428858 - protein, 8 aa, Mycobacterium
APAEIAEK

SEQ ID NO: 428859 - protein, 6 aa, Mycobacterium
APAELR

SEQ ID NO: 428860 - protein, 8 aa, Mycobacterium
APAENSTL

SEQ ID NO: 428861 - protein, 17 aa, Mycobacterium
APAEPNDVPAAHDGSNP

SEQ ID NO: 428862 - protein, 9 aa, Mycobacterium
APAEQGDQI

SEQ ID NO: 428863 - protein, 17 aa, Mycobacterium
APAEQGDQIAGCSPAEA

SEQ ID NO: 428864 - protein, 21 aa, Mycobacterium
APAEQTASRPGHDHADNARRI

SEQ ID NO: 428865 - protein, 5 aa, Mycobacterium
APAER

SEQ ID NO: 428866 - protein, 6 aa, Mycobacterium
APAERA

SEQ ID NO: 428867 - protein, 10 aa, Mycobacterium
APAESPTTRG

SEQ ID NO: 428868 - protein, 18 aa, Mycobacterium
APAESVPGHGSDSGAASA

SEQ ID NO: 428869 - protein, 5 aa, Mycobacterium
APAET

SEQ ID NO: 428870 - protein, 6 aa, Mycobacterium
APAETA

SEQ ID NO: 428871 - protein, 7 aa, Mycobacterium
APAETPP

SEQ ID NO: 428872 - protein, 5 aa, Mycobacterium
APAEV

SEQ ID NO: 428873 - protein, 6 aa, Mycobacterium
APAEVA

SEQ ID NO: 428874 - protein, 4 aa, Mycobacterium
APAF

SEQ ID NO: 428875 - protein, 18 aa, Mycobacterium
APAGAAALSGPAIDGTGK

SEQ ID NO: 428876 - protein, 8 aa, Mycobacterium
APAGAAEA

SEQ ID NO: 428877 - protein, 8 aa, Mycobacterium
APAGADEV

SEQ ID NO: 428878 - protein, 6 aa, Mycobacterium
APAGAH

SEQ ID NO: 428879 - protein, 8 aa, Mycobacterium
APAGAHTR

SEQ ID NO: 428880 - protein, 9 aa, Mycobacterium
APAGANETD

SEQ ID NO: 428881 - protein, 23 aa, Mycobacterium
APAGATGPDSGAVRTKSTPTDPV

SEQ ID NO: 428882 - protein, 8 aa, Mycobacterium
APAGATPL

SEQ ID NO: 428883 - protein, 8 aa, Mycobacterium
APAGAVSQ

SEQ ID NO: 428884 - protein, 10 aa, Mycobacterium
APAGDGAGRL

SEQ ID NO: 428885 - protein, 16 aa, Mycobacterium
APAGDRRMSANPHANG

SEQ ID NO: 428886 - protein, 9 aa, Mycobacterium
APAGDSRGL

SEQ ID NO: 428887 - protein, 10 aa, Mycobacterium
APAGDVSGPT

SEQ ID NO: 428888 - protein, 5 aa, Mycobacterium
APAGF

SEQ ID NO: 428889 - protein, 37 aa, Mycobacterium
APAGGAGGGMPAGTSAELTSAAHQAAANLSKDPGMKP

SEQ ID NO: 428890 - protein, 10 aa, Mycobacterium
APAGGESSTV

SEQ ID NO: 428891 - protein, 9 aa, Mycobacterium
APAGGGPPA

SEQ ID NO: 428892 - protein, 12 aa, Mycobacterium
APAGGSSLRGPV

SEQ ID NO: 428893 - protein, 7 aa, Mycobacterium
APAGGTF

SEQ ID NO: 428894 - protein, 5 aa, Mycobacterium
APAGH

SEQ ID NO: 428895 - protein, 8 aa, Mycobacterium
APAGHQTR

SEQ ID NO: 428896 - protein, 6 aa, Mycobacterium
APAGIE

SEQ ID NO: 428897 - protein, 8 aa, Mycobacterium
APAGKDAV

SEQ ID NO: 428898 - protein, 12 aa, Mycobacterium
APAGLASKYQKD

SEQ ID NO: 428899 - protein, 11 aa, Mycobacterium
APAGNPAPNPF

SEQ ID NO: 428900 - protein, 8 aa, Mycobacterium
APAGPDAV

SEQ ID NO: 428901 - protein, 18 aa, Mycobacterium
APAGPGERRWNPDDPHPE

SEQ ID NO: 428902 - protein, 24 aa, Mycobacterium
APAGPGGTGGGGGSGGTGGSGGHS

SEQ ID NO: 428903 - protein, 10 aa, Mycobacterium
APAGPGSSVT

SEQ ID NO: 428904 - protein, 8 aa, Mycobacterium
APAGPSAV

SEQ ID NO: 428905 - protein, 11 aa, Mycobacterium
APAGPSGGRIT

SEQ ID NO: 428906 - protein, 5 aa, Mycobacterium
APAGQ

SEQ ID NO: 428907 - protein, 8 aa, Mycobacterium
APAGQARQ

SEQ ID NO: 428908 - protein, 6 aa, Mycobacterium
APAGRA

SEQ ID NO: 428909 - protein, 8 aa, Mycobacterium
APAGRAGF

SEQ ID NO: 428910 - protein, 6 aa, Mycobacterium
APAGRD

SEQ ID NO: 428911 - protein, 8 aa, Mycobacterium
APAGREWT

SEQ ID NO: 428912 - protein, 19 aa, Mycobacterium
APAGRSDPLSEIERAVWAQ

SEQ ID NO: 428913 - protein, 5 aa, Mycobacterium
APAGS

SEQ ID NO: 428914 - protein, 6 aa, Mycobacterium
APAGSD

SEQ ID NO: 428915 - protein, 11 aa, Mycobacterium
APAGSGKTTAM

SEQ ID NO: 428916 - protein, 8 aa, Mycobacterium
APAGSQIA

SEQ ID NO: 428917 - protein, 18 aa, Mycobacterium
APAGSTEFSGSKIDGTAK

SEQ ID NO: 428918 - protein, 5 aa, Mycobacterium
APAGT

SEQ ID NO: 428919 - protein, 8 aa, Mycobacterium
APAGTDPR

SEQ ID NO: 428920 - protein, 13 aa, Mycobacterium
APAGTEPAAGHRG

SEQ ID NO: 428921 - protein, 9 aa, Mycobacterium
APAGTEPPG

SEQ ID NO: 428922 - protein, 8 aa, Mycobacterium
APAGTGAV

SEQ ID NO: 428923 - protein, 11 aa, Mycobacterium
APAGTGKTTAM

SEQ ID NO: 428924 - protein, 9 aa, Mycobacterium
APAGTGPGS

SEQ ID NO: 428925 - protein, 8 aa, Mycobacterium
APAGTLPG

SEQ ID NO: 428926 - protein, 8 aa, Mycobacterium
APAGTRAT

SEQ ID NO: 428927 - protein, 8 aa, Mycobacterium
APAGTRTT

SEQ ID NO: 428928 - protein, 6 aa, Mycobacterium
APAGTT

SEQ ID NO: 428929 - protein, 6 aa, Mycobacterium
APAGVD

SEQ ID NO: 428930 - protein, 13 aa, Mycobacterium
APAGVGAGRAAGA

SEQ ID NO: 428931 - protein, 8 aa, Mycobacterium
APAGVPPL

SEQ ID NO: 428932 - protein, 15 aa, Mycobacterium
APAGVPRELKGANHN

SEQ ID NO: 428933 - protein, 11 aa, Mycobacterium
APAGVRSSATA

SEQ ID NO: 428934 - protein, 10 aa, Mycobacterium
APAGVTPKPL

SEQ ID NO: 428935 - protein, 4 aa, Mycobacterium
APAH

SEQ ID NO: 428936 - protein, 5 aa, Mycobacterium
APAHA

SEQ ID NO: 428937 - protein, 6 aa, Mycobacterium
APAHPS

SEQ ID NO: 428938 - protein, 6 aa, Mycobacterium
APAHTP

SEQ ID NO: 428939 - protein, 17 aa, Mycobacterium
APAIEAATASVGSRRPT

SEQ ID NO: 428940 - protein, 5 aa, Mycobacterium
APAIR

SEQ ID NO: 428941 - protein, 11 aa, Mycobacterium
APAISPSQGVR

SEQ ID NO: 428942 - protein, 6 aa, Mycobacterium
APAITQ

SEQ ID NO: 428943 - protein, 4 aa, Mycobacterium
APAK

SEQ ID NO: 428944 - protein, 10 aa, Mycobacterium
APAKGPAPQL

SEQ ID NO: 428945 - protein, 9 aa, Mycobacterium
APAKGRGVD

SEQ ID NO: 428946 - protein, 23 aa, Mycobacterium
APAKPTGVRATAPNGEPDDRDHK

SEQ ID NO: 428947 - protein, 9 aa, Mycobacterium
APAKRDMST

SEQ ID NO: 428948 - protein, 5 aa, Mycobacterium
APAKT

SEQ ID NO: 428949 - protein, 7 aa, Mycobacterium
APAKTSA

SEQ ID NO: 428950 - protein, 13 aa, Mycobacterium
APAKVKGPIAGTG

SEQ ID NO: 428951 - protein, 13 aa, Mycobacterium
APAKVKGPLEGTG

SEQ ID NO: 428952 - protein, 14 aa, Mycobacterium
APAKVSGAEQSNTS

SEQ ID NO: 428953 - protein, 5 aa, Mycobacterium
APALA

SEQ ID NO: 428954 - protein, 12 aa, Mycobacterium
APALADKGVRNV

SEQ ID NO: 428955 - protein, 13 aa, Mycobacterium
APALAGNDEAARH

SEQ ID NO: 428956 - protein, 6 aa, Mycobacterium
APALDD

SEQ ID NO: 428957 - protein, 14 aa, Mycobacterium
APALDDPGADSEQT

SEQ ID NO: 428958 - protein, 14 aa, Mycobacterium
APALDGGEHRSRRS

SEQ ID NO: 428959 - protein, 9 aa, Mycobacterium
APALEDVTT

SEQ ID NO: 428960 - protein, 9 aa, Mycobacterium
APALGDDTA

SEQ ID NO: 428961 - protein, 15 aa, Mycobacterium
APALGSTVSATVGQA

SEQ ID NO: 428962 - protein, 5 aa, Mycobacterium
APALL

SEQ ID NO: 428963 - protein, 13 aa, Mycobacterium
APALSAQAGADAQ

SEQ ID NO: 428964 - protein, 8 aa, Mycobacterium
APALSEKD

SEQ ID NO: 428965 - protein, 10 aa, Mycobacterium
APANADGRLP

SEQ ID NO: 428966 - protein, 18 aa, Mycobacterium
APANELPDAGDTDDSSPR

SEQ ID NO: 428967 - protein, 8 aa, Mycobacterium
APANENTR

SEQ ID NO: 428968 - protein, 7 aa, Mycobacterium
APANGGS

SEQ ID NO: 428969 - protein, 11 aa, Mycobacterium
APANGRADQGI

SEQ ID NO: 428970 - protein, 9 aa, Mycobacterium
APANIKQKD

SEQ ID NO: 428971 - protein, 18 aa, Mycobacterium
APANPGAVDAGAGAGLPA

SEQ ID NO: 428972 - protein, 7 aa, Mycobacterium
APANPGI

SEQ ID NO: 428973 - protein, 16 aa, Mycobacterium
APANPGPAAGPGGLPE

SEQ ID NO: 428974 - protein, 8 aa, Mycobacterium
APANPVTT

SEQ ID NO: 428975 - protein, 15 aa, Mycobacterium
APAPADGDPNPLRDN

SEQ ID NO: 428976 - protein, 17 aa, Mycobacterium
APAPAGSGLKAVRGDAG

SEQ ID NO: 428977 - protein, 15 aa, Mycobacterium
APAPAGVPDPTNGDG

SEQ ID NO: 428978 - protein, 7 aa, Mycobacterium
APAPAHT

SEQ ID NO: 428979 - protein, 10 aa, Mycobacterium
APAPAPARHR

SEQ ID NO: 428980 - protein, 10 aa, Mycobacterium
APAPAPESFP

SEQ ID NO: 428981 - protein, 19 aa, Mycobacterium
APAPAPLPPAPETLPPAPV

SEQ ID NO: 428982 - protein, 8 aa, Mycobacterium
APAPAPPE

SEQ ID NO: 428983 - protein, 24 aa, Mycobacterium
APAPAPVAAPAPVAAVTKDSDAQA

SEQ ID NO: 428984 - protein, 17 aa, Mycobacterium
APAPASTPDPEPPVEDH

SEQ ID NO: 428985 - protein, 8 aa, Mycobacterium
APAPDGIG

SEQ ID NO: 428986 - protein, 8 aa, Mycobacterium
APAPDGTE

SEQ ID NO: 428987 - protein, 8 aa, Mycobacterium
APAPDPLN

SEQ ID NO: 428988 - protein, 23 aa, Mycobacterium
APAPDTSPPLPPQRGPAPAPTTD

SEQ ID NO: 428989 - protein, 6 aa, Mycobacterium
APAPFP

SEQ ID NO: 428990 - protein, 13 aa, Mycobacterium
APAPGADAAAHAE

SEQ ID NO: 428991 - protein, 18 aa, Mycobacterium
APAPGEDSEVAGAAPEVE

SEQ ID NO: 428992 - protein, 11 aa, Mycobacterium
APAPGPAPGEA

SEQ ID NO: 428993 - protein, 33 aa, Mycobacterium
APAPGQPAQTSPGAGELAPATALAGSATGDDGA

SEQ ID NO: 428994 - protein, 5 aa, Mycobacterium
APAPL

SEQ ID NO: 428995 - protein, 6 aa, Mycobacterium
APAPLG

SEQ ID NO: 428996 - protein, 24 aa, Mycobacterium
APAPLPAPEALPPAPLPAPAPEAV

SEQ ID NO: 428997 - protein, 25 aa, Mycobacterium
APAPLPPAPEALPPAPLDAPAPAQT

SEQ ID NO: 428998 - protein, 12 aa, Mycobacterium
APAPMSNSLPGQ

SEQ ID NO: 428999 - protein, 7 aa, Mycobacterium
APAPNAV

SEQ ID NO: 429000 - protein, 5 aa, Mycobacterium
APAPP

SEQ ID NO: 429001 - protein, 8 aa, Mycobacterium
APAPPPAL

SEQ ID NO: 429002 - protein, 9 aa, Mycobacterium
APAPPRDDE

SEQ ID NO: 429003 - protein, 9 aa, Mycobacterium
APAPPRGSE

SEQ ID NO: 429004 - protein, 31 aa, Mycobacterium
APAPPSAEVAPPAEVAPPAAAGQSTALPGMG

SEQ ID NO: 429005 - protein, 9 aa, Mycobacterium
APAPPTDDD

SEQ ID NO: 429006 - protein, 6 aa, Mycobacterium
APAPPV

SEQ ID NO: 429007 - protein, 15 aa, Mycobacterium
APAPQGASTATAPKS

SEQ ID NO: 429008 - protein, 7 aa, Mycobacterium
APAPQID

SEQ ID NO: 429009 - protein, 7 aa, Mycobacterium
APAPQPE

SEQ ID NO: 429010 - protein, 6 aa, Mycobacterium
APAPQV

SEQ ID NO: 429011 - protein, 5 aa, Mycobacterium
APAPR

SEQ ID NO: 429012 - protein, 25 aa, Mycobacterium
APAPRDLDAQRPARRRRTAPAPRVS

SEQ ID NO: 429013 - protein, 10 aa, Mycobacterium
APAPSGTGLG

SEQ ID NO: 429014 - protein, 13 aa, Mycobacterium
APAPSLPPAPVPR

SEQ ID NO: 429015 - protein, 8 aa, Mycobacterium
APAPSQNR

SEQ ID NO: 429016 - protein, 7 aa, Mycobacterium
APAPSVE

SEQ ID NO: 429017 - protein, 6 aa, Mycobacterium
APAPSY

SEQ ID NO: 429018 - protein, 5 aa, Mycobacterium
APAPT

SEQ ID NO: 429019 - protein, 8 aa, Mycobacterium
APAPTDAA

SEQ ID NO: 429020 - protein, 10 aa, Mycobacterium
APAPTPRPRV

SEQ ID NO: 429021 - protein, 77 aa, Mycobacterium
APAPVAQPAAKKPDHGRGSRNGGSGGHGRSGGEHQRRGGGGGRGRDGQGGGSSSTSRGPRRRGQRPAGQSQRGVNTG

SEQ ID NO: 429022 - protein, 6 aa, Mycobacterium
APAPVE

SEQ ID NO: 429023 - protein, 9 aa, Mycobacterium
APAPVSARG

SEQ ID NO: 429024 - protein, 8 aa, Mycobacterium
APAPVSID

SEQ ID NO: 429025 - protein, 15 aa, Mycobacterium
APAPVTAARQDPVPA

SEQ ID NO: 429026 - protein, 13 aa, Mycobacterium
APAPYDGDSATEV

SEQ ID NO: 429027 - protein, 5 aa, Mycobacterium
APAQA

SEQ ID NO: 429028 - protein, 14 aa, Mycobacterium
APAQAEPRYTPSAG

SEQ ID NO: 429029 - protein, 18 aa, Mycobacterium
APAQAPPVPARTAATGPQ

SEQ ID NO: 429030 - protein, 9 aa, Mycobacterium
APAQATASA

SEQ ID NO: 429031 - protein, 12 aa, Mycobacterium
APAQATRASDGA

SEQ ID NO: 429032 - protein, 6 aa, Mycobacterium
APAQAW

SEQ ID NO: 429033 - protein, 5 aa, Mycobacterium
APAQL

SEQ ID NO: 429034 - protein, 32 aa, Mycobacterium
APAQNPADIPAGRISGRPDHHRAADQPTIAGS

SEQ ID NO: 429035 - protein, 13 aa, Mycobacterium
APAQPAPAPERTK

SEQ ID NO: 429036 - protein, 15 aa, Mycobacterium
APAQPQPAGDRKAER

SEQ ID NO: 429037 - protein, 6 aa, Mycobacterium
APAQQR

SEQ ID NO: 429038 - protein, 9 aa, Mycobacterium
APAQRGSAE

SEQ ID NO: 429039 - protein, 15 aa, Mycobacterium
APAQRRAGYSPNPDD

SEQ ID NO: 429040 - protein, 15 aa, Mycobacterium
APAQRREGHVPSPDG

SEQ ID NO: 429041 - protein, 16 aa, Mycobacterium
APAQRREGYAPEPEGV

SEQ ID NO: 429042 - protein, 15 aa, Mycobacterium
APAQRREGYAPSPED

SEQ ID NO: 429043 - protein, 7 aa, Mycobacterium
APAQRVA

SEQ ID NO: 429044 - protein, 5 aa, Mycobacterium
APAQT

SEQ ID NO: 429045 - protein, 6 aa, Mycobacterium
APAQTD

SEQ ID NO: 429046 - protein, 35 aa, Mycobacterium
APAQWQPDRSAELQTQIDSGASQPVTEQADGPATI

SEQ ID NO: 429047 - protein, 5 aa, Mycobacterium
APAQY

SEQ ID NO: 429048 - protein, 31 aa, Mycobacterium
APARAASADRHPVDDDATESTDRARDGQPSV

SEQ ID NO: 429049 - protein, 22 aa, Mycobacterium
APAREVRQGAAKTGLVLVSGVP

SEQ ID NO: 429050 - protein, 9 aa, Mycobacterium
APARGTARV

SEQ ID NO: 429051 - protein, 17 aa, Mycobacterium
APARPALRTGSAGSAIA

SEQ ID NO: 429052 - protein, 8 aa, Mycobacterium
APARPAPQ

SEQ ID NO: 429053 - protein, 8 aa, Mycobacterium
APARPARP

SEQ ID NO: 429054 - protein, 12 aa, Mycobacterium
APARPNRRQRRR

SEQ ID NO: 429055 - protein, 10 aa, Mycobacterium
APARPSPAGH

SEQ ID NO: 429056 - protein, 8 aa, Mycobacterium
APARQGAE

SEQ ID NO: 429057 - protein, 7 aa, Mycobacterium
APARQGC

SEQ ID NO: 429058 - protein, 8 aa, Mycobacterium
APARQGCP

SEQ ID NO: 429059 - protein, 9 aa, Mycobacterium
APARQGSQW

SEQ ID NO: 429060 - protein, 11 aa, Mycobacterium
APARQPQIGTR

SEQ ID NO: 429061 - protein, 7 aa, Mycobacterium
APARREV

SEQ ID NO: 429062 - protein, 8 aa, Mycobacterium
APARRGAT

SEQ ID NO: 429063 - protein, 9 aa, Mycobacterium
APARRQVDD

SEQ ID NO: 429064 - protein, 17 aa, Mycobacterium
APARRSMQPMPAAPATP

SEQ ID NO: 429065 - protein, 10 aa, Mycobacterium
APARSARRFG

SEQ ID NO: 429066 - protein, 9 aa, Mycobacterium
APARSSSVN

SEQ ID NO: 429067 - protein, 7 aa, Mycobacterium
APARSYS

SEQ ID NO: 429068 - protein, 5 aa, Mycobacterium
APART

SEQ ID NO: 429069 - protein, 9 aa, Mycobacterium
APARTVTAD

SEQ ID NO: 429070 - protein, 8 aa, Mycobacterium
APARVAER

SEQ ID NO: 429071 - protein, 4 aa, Mycobacterium
APAS

SEQ ID NO: 429072 - protein, 15 aa, Mycobacterium
APASAAAADRITSAS

SEQ ID NO: 429073 - protein, 7 aa, Mycobacterium
APASADM

SEQ ID NO: 429074 - protein, 8 aa, Mycobacterium
APASADMS

SEQ ID NO: 429075 - protein, 8 aa, Mycobacterium
APASDHGL

SEQ ID NO: 429076 - protein, 9 aa, Mycobacterium
APASENVKA

SEQ ID NO: 429077 - protein, 6 aa, Mycobacterium
APASES

SEQ ID NO: 429078 - protein, 16 aa, Mycobacterium
APASGAKAAPSGYAGD

SEQ ID NO: 429079 - protein, 13 aa, Mycobacterium
APASGSGKTTVST

SEQ ID NO: 429080 - protein, 8 aa, Mycobacterium
APASGSYR

SEQ ID NO: 429081 - protein, 6 aa, Mycobacterium
APASHR

SEQ ID NO: 429082 - protein, 6 aa, Mycobacterium
APASIS

SEQ ID NO: 429083 - protein, 10 aa, Mycobacterium
APASKPAPRH

SEQ ID NO: 429084 - protein, 8 aa, Mycobacterium
APASNSTV

SEQ ID NO: 429085 - protein, 38 aa, Mycobacterium
APASPEPEGLPQTAPVAPRGSVPDTTAAPSAATTAAGV

SEQ ID NO: 429086 - protein, 8 aa, Mycobacterium
APASPKTF

SEQ ID NO: 429087 - protein, 5 aa, Mycobacterium
APASQ

SEQ ID NO: 429088 - protein, 8 aa, Mycobacterium
APASRSRA

SEQ ID NO: 429089 - protein, 7 aa, Mycobacterium
APASSDS

SEQ ID NO: 429090 - protein, 5 aa, Mycobacterium
APAST

SEQ ID NO: 429091 - protein, 6 aa, Mycobacterium
APASTD

SEQ ID NO: 429092 - protein, 24 aa, Mycobacterium
APASTSSSVATSPSSATASMPAPR

SEQ ID NO: 429093 - protein, 13 aa, Mycobacterium
APASVTISGAEAA

SEQ ID NO: 429094 - protein, 5 aa, Mycobacterium
APASW

SEQ ID NO: 429095 - protein, 6 aa, Mycobacterium
APASWT

SEQ ID NO: 429096 - protein, 8 aa, Mycobacterium
APATAAAT

SEQ ID NO: 429097 - protein, 12 aa, Mycobacterium
APATAGTGVLGG

SEQ ID NO: 429098 - protein, 11 aa, Mycobacterium
APATALPAATD

SEQ ID NO: 429099 - protein, 9 aa, Mycobacterium
APATASAAA

SEQ ID NO: 429100 - protein, 8 aa, Mycobacterium
APATATGA

SEQ ID NO: 429101 - protein, 12 aa, Mycobacterium
APATDAAEKVTD

SEQ ID NO: 429102 - protein, 17 aa, Mycobacterium
APATESAAMPRVNKSTG

SEQ ID NO: 429103 - protein, 6 aa, Mycobacterium
APATGA

SEQ ID NO: 429104 - protein, 17 aa, Mycobacterium
APATGDPRVHPKPFKRN

SEQ ID NO: 429105 - protein, 8 aa, Mycobacterium
APATHNEP

SEQ ID NO: 429106 - protein, 8 aa, Mycobacterium
APATLPES

SEQ ID NO: 429107 - protein, 10 aa, Mycobacterium
APATNPASVT

SEQ ID NO: 429108 - protein, 7 aa, Mycobacterium
APATPAL

SEQ ID NO: 429109 - protein, 7 aa, Mycobacterium
APATREP

SEQ ID NO: 429110 - protein, 8 aa, Mycobacterium
APATSEPV

SEQ ID NO: 429111 - protein, 9 aa, Mycobacterium
APATSGAAS

SEQ ID NO: 429112 - protein, 5 aa, Mycobacterium
APATT

SEQ ID NO: 429113 - protein, 7 aa, Mycobacterium
APATTNV

SEQ ID NO: 429114 - protein, 14 aa, Mycobacterium
APATVLSETGTRVE

SEQ ID NO: 429115 - protein, 5 aa, Mycobacterium
APAVA

SEQ ID NO: 429116 - protein, 6 aa, Mycobacterium
APAVAG

SEQ ID NO: 429117 - protein, 8 aa, Mycobacterium
APAVEEQD

SEQ ID NO: 429118 - protein, 6 aa, Mycobacterium
APAVHS

SEQ ID NO: 429119 - protein, 5 aa, Mycobacterium
APAVK

SEQ ID NO: 429120 - protein, 5 aa, Mycobacterium
APAVP

SEQ ID NO: 429121 - protein, 5 aa, Mycobacterium
APAVR

SEQ ID NO: 429122 - protein, 6 aa, Mycobacterium
APAVRK

SEQ ID NO: 429123 - protein, 5 aa, Mycobacterium
APAVS

SEQ ID NO: 429124 - protein, 8 aa, Mycobacterium
APAWRNKP

SEQ ID NO: 429125 - protein, 5 aa, Mycobacterium
APAYT

SEQ ID NO: 429126 - protein, 5 aa, Mycobacterium
APCDS

SEQ ID NO: 429127 - protein, 12 aa, Mycobacterium
APCGPWGSGRRA

SEQ ID NO: 429128 - protein, 7 aa, Mycobacterium
APCPPDV

SEQ ID NO: 429129 - protein, 6 aa, Mycobacterium
APCPPE

SEQ ID NO: 429130 - protein, 11 aa, Mycobacterium
APCQTRSIQQT

SEQ ID NO: 429131 - protein, 7 aa, Mycobacterium
APCSPAE

SEQ ID NO: 429132 - protein, 5 aa, Mycobacterium
APCTG

SEQ ID NO: 429133 - protein, 6 aa, Mycobacterium
APDAAA

SEQ ID NO: 429134 - protein, 6 aa, Mycobacterium
APDAAK

SEQ ID NO: 429135 - protein, 8 aa, Mycobacterium
APDAANGK

SEQ ID NO: 429136 - protein, 8 aa, Mycobacterium
APDADANI

SEQ ID NO: 429137 - protein, 6 aa, Mycobacterium
APDADG

SEQ ID NO: 429138 - protein, 18 aa, Mycobacterium
APDADPGATSSGSPIVTV

SEQ ID NO: 429139 - protein, 8 aa, Mycobacterium
APDADPHI

SEQ ID NO: 429140 - protein, 8 aa, Mycobacterium
APDADRDT

SEQ ID NO: 429141 - protein, 6 aa, Mycobacterium
APDAEG

SEQ ID NO: 429142 - protein, 7 aa, Mycobacterium
APDAEIG

SEQ ID NO: 429143 - protein, 6 aa, Mycobacterium
APDAEP

SEQ ID NO: 429144 - protein, 8 aa, Mycobacterium
APDAEPSV

SEQ ID NO: 429145 - protein, 6 aa, Mycobacterium
APDAEW

SEQ ID NO: 429146 - protein, 6 aa, Mycobacterium
APDAGF

SEQ ID NO: 429147 - protein, 11 aa, Mycobacterium
APDAGTAEARA

SEQ ID NO: 429148 - protein, 7 aa, Mycobacterium
APDAGTD

SEQ ID NO: 429149 - protein, 9 aa, Mycobacterium
APDAGTGMP

SEQ ID NO: 429150 - protein, 7 aa, Mycobacterium
APDAGTV

SEQ ID NO: 429151 - protein, 12 aa, Mycobacterium
APDAKDLDERTE

SEQ ID NO: 429152 - protein, 20 aa, Mycobacterium
APDALREDPRPLEQRTAEHA

SEQ ID NO: 429153 - protein, 12 aa, Mycobacterium
APDALSLPDPEM

SEQ ID NO: 429154 - protein, 6 aa, Mycobacterium
APDAPL

SEQ ID NO: 429155 - protein, 6 aa, Mycobacterium
APDAPP

SEQ ID NO: 429156 - protein, 8 aa, Mycobacterium
APDAPTAV

SEQ ID NO: 429157 - protein, 5 aa, Mycobacterium
APDAS

SEQ ID NO: 429158 - protein, 16 aa, Mycobacterium
APDASADLDSVAPPAW

SEQ ID NO: 429159 - protein, 13 aa, Mycobacterium
APDASVADAEAAV

SEQ ID NO: 429160 - protein, 12 aa, Mycobacterium
APDASVSQVGDA

SEQ ID NO: 429161 - protein, 12 aa, Mycobacterium
APDATLREHDPS

SEQ ID NO: 429162 - protein, 10 aa, Mycobacterium
APDATPPDSV

SEQ ID NO: 429163 - protein, 6 aa, Mycobacterium
APDATT

SEQ ID NO: 429164 - protein, 13 aa, Mycobacterium
APDATVADAEAAV

SEQ ID NO: 429165 - protein, 6 aa, Mycobacterium
APDAVD

SEQ ID NO: 429166 - protein, 15 aa, Mycobacterium
APDCPTSLNEHPKAA

SEQ ID NO: 429167 - protein, 17 aa, Mycobacterium
APDDAERATSSNRDEVG

SEQ ID NO: 429168 - protein, 25 aa, Mycobacterium
APDDAGASQIPVTGDGGQPLPESDE

SEQ ID NO: 429169 - protein, 8 aa, Mycobacterium
APDDAQDP

SEQ ID NO: 429170 - protein, 14 aa, Mycobacterium
APDDDAGRDRVSAP

SEQ ID NO: 429171 - protein, 14 aa, Mycobacterium
APDDDPGASGARRG

SEQ ID NO: 429172 - protein, 8 aa, Mycobacterium
APDDELGS

SEQ ID NO: 429173 - protein, 8 aa, Mycobacterium
APDDFEQA

SEQ ID NO: 429174 - protein, 7 aa, Mycobacterium
APDDFSP

SEQ ID NO: 429175 - protein, 7 aa, Mycobacterium
APDDGAP

SEQ ID NO: 429176 - protein, 17 aa, Mycobacterium
APDDHPDDPQGRRRGRD

SEQ ID NO: 429177 - protein, 13 aa, Mycobacterium
APDDLAKAADGVV

SEQ ID NO: 429178 - protein, 7 aa, Mycobacterium
APDDPEG

SEQ ID NO: 429179 - protein, 8 aa, Mycobacterium
APDDPLEG

SEQ ID NO: 429180 - protein, 7 aa, Mycobacterium
APDDQEG

SEQ ID NO: 429181 - protein, 8 aa, Mycobacterium
APDDQVGD

SEQ ID NO: 429182 - protein, 18 aa, Mycobacterium
APDDTENRRVLAVLRYLE

SEQ ID NO: 429183 - protein, 5 aa, Mycobacterium
APDEA

SEQ ID NO: 429184 - protein, 6 aa, Mycobacterium
APDEAD

SEQ ID NO: 429185 - protein, 6 aa, Mycobacterium
APDEAH

SEQ ID NO: 429186 - protein, 5 aa, Mycobacterium
APDED

SEQ ID NO: 429187 - protein, 6 aa, Mycobacterium
APDEDA

SEQ ID NO: 429188 - protein, 5 aa, Mycobacterium
APDEG

SEQ ID NO: 429189 - protein, 6 aa, Mycobacterium
APDEGA

SEQ ID NO: 429190 - protein, 15 aa, Mycobacterium
APDEGPLADSGAGRA

SEQ ID NO: 429191 - protein, 5 aa, Mycobacterium
APDEI

SEQ ID NO: 429192 - protein, 6 aa, Mycobacterium
APDEID

SEQ ID NO: 429193 - protein, 20 aa, Mycobacterium
APDEIPDQPAHDGGFGGHGP

SEQ ID NO: 429194 - protein, 8 aa, Mycobacterium
APDEKWGE

SEQ ID NO: 429195 - protein, 6 aa, Mycobacterium
APDELD

SEQ ID NO: 429196 - protein, 7 aa, Mycobacterium
APDEPES

SEQ ID NO: 429197 - protein, 10 aa, Mycobacterium
APDEPGTGNE

SEQ ID NO: 429198 - protein, 11 aa, Mycobacterium
APDEPRPVTPL

SEQ ID NO: 429199 - protein, 6 aa, Mycobacterium
APDERT

SEQ ID NO: 429200 - protein, 18 aa, Mycobacterium
APDESENRRVLAVLRFLE

SEQ ID NO: 429201 - protein, 7 aa, Mycobacterium
APDESIA

SEQ ID NO: 429202 - protein, 22 aa, Mycobacterium
APDESVAKYRGRYDDGPDALRE

SEQ ID NO: 429203 - protein, 7 aa, Mycobacterium
APDETTY

SEQ ID NO: 429204 - protein, 8 aa, Mycobacterium
APDEVDYE

SEQ ID NO: 429205 - protein, 7 aa, Mycobacterium
APDFEDR

SEQ ID NO: 429206 - protein, 6 aa, Mycobacterium
APDFES

SEQ ID NO: 429207 - protein, 18 aa, Mycobacterium
APDFGSSGGTLSDPARRA

SEQ ID NO: 429208 - protein, 6 aa, Mycobacterium
APDFPT

SEQ ID NO: 429209 - protein, 5 aa, Mycobacterium
APDFS

SEQ ID NO: 429210 - protein, 5 aa, Mycobacterium
APDGA

SEQ ID NO: 429211 - protein, 14 aa, Mycobacterium
APDGAAAASPIPVE

SEQ ID NO: 429212 - protein, 7 aa, Mycobacterium
APDGCGG

SEQ ID NO: 429213 - protein, 8 aa, Mycobacterium
APDGDGVL

SEQ ID NO: 429214 - protein, 16 aa, Mycobacterium
APDGEPRPPAGRETAT

SEQ ID NO: 429215 - protein, 11 aa, Mycobacterium
APDGETTDVTS

SEQ ID NO: 429216 - protein, 8 aa, Mycobacterium
APDGEVIS

SEQ ID NO: 429217 - protein, 11 aa, Mycobacterium
APDGFDGLDSP

SEQ ID NO: 429218 - protein, 5 aa, Mycobacterium
APDGG

SEQ ID NO: 429219 - protein, 9 aa, Mycobacterium
APDGGGAGN

SEQ ID NO: 429220 - protein, 8 aa, Mycobacterium
APDGGGGY

SEQ ID NO: 429221 - protein, 6 aa, Mycobacterium
APDGGS

SEQ ID NO: 429222 - protein, 9 aa, Mycobacterium
APDGGSDRP

SEQ ID NO: 429223 - protein, 11 aa, Mycobacterium
APDGKEDAGSK

SEQ ID NO: 429224 - protein, 11 aa, Mycobacterium
APDGLQETRSQ

SEQ ID NO: 429225 - protein, 23 aa, Mycobacterium
APDGPAARRTPRSDEEAAQQRGD

SEQ ID NO: 429226 - protein, 8 aa, Mycobacterium
APDGPYEL

SEQ ID NO: 429227 - protein, 6 aa, Mycobacterium
APDGQS

SEQ ID NO: 429228 - protein, 6 aa, Mycobacterium
APDGRE

SEQ ID NO: 429229 - protein, 6 aa, Mycobacterium
APDGRI

SEQ ID NO: 429230 - protein, 9 aa, Mycobacterium
APDGRQAYA

SEQ ID NO: 429231 - protein, 8 aa, Mycobacterium
APDGSRLT

SEQ ID NO: 429232 - protein, 8 aa, Mycobacterium
APDGSTWS

SEQ ID NO: 429233 - protein, 6 aa, Mycobacterium
APDGTA

SEQ ID NO: 429234 - protein, 11 aa, Mycobacterium
APDGTHHQNDA

SEQ ID NO: 429235 - protein, 18 aa, Mycobacterium
APDGTHHQNDAAAAATPV

SEQ ID NO: 429236 - protein, 15 aa, Mycobacterium
APDGTHHQNDAAATA

SEQ ID NO: 429237 - protein, 11 aa, Mycobacterium
APDGTHHQNEA

SEQ ID NO: 429238 - protein, 12 aa, Mycobacterium
APDGTHHQNEAA

SEQ ID NO: 429239 - protein, 6 aa, Mycobacterium
APDGTL

SEQ ID NO: 429240 - protein, 8 aa, Mycobacterium
APDGTQVA

SEQ ID NO: 429241 - protein, 6 aa, Mycobacterium
APDGTV

SEQ ID NO: 429242 - protein, 5 aa, Mycobacterium
APDGV

SEQ ID NO: 429243 - protein, 4 aa, Mycobacterium
APDH

SEQ ID NO: 429244 - protein, 8 aa, Mycobacterium
APDHDAGY

SEQ ID NO: 429245 - protein, 5 aa, Mycobacterium
APDHG

SEQ ID NO: 429246 - protein, 6 aa, Mycobacterium
APDHGG

SEQ ID NO: 429247 - protein, 9 aa, Mycobacterium
APDHGPDAV

SEQ ID NO: 429248 - protein, 9 aa, Mycobacterium
APDHPNTKR

SEQ ID NO: 429249 - protein, 8 aa, Mycobacterium
APDHQHTK

SEQ ID NO: 429250 - protein, 9 aa, Mycobacterium
APDHQNTKR

SEQ ID NO: 429251 - protein, 9 aa, Mycobacterium
APDHQQTKR

SEQ ID NO: 429252 - protein, 6 aa, Mycobacterium
APDIAT

SEQ ID NO: 429253 - protein, 6 aa, Mycobacterium
APDIES

SEQ ID NO: 429254 - protein, 6 aa, Mycobacterium
APDIPR

SEQ ID NO: 429255 - protein, 13 aa, Mycobacterium
APDISDELGSAAS

SEQ ID NO: 429256 - protein, 20 aa, Mycobacterium
APDKRAPHAEGNFPTPSGKC

SEQ ID NO: 429257 - protein, 5 aa, Mycobacterium
APDLA

SEQ ID NO: 429258 - protein, 8 aa, Mycobacterium
APDLDRPA

SEQ ID NO: 429259 - protein, 14 aa, Mycobacterium
APDLPDDLAASAQQ

SEQ ID NO: 429260 - protein, 13 aa, Mycobacterium
APDLPGDVSAEAQ

SEQ ID NO: 429261 - protein, 7 aa, Mycobacterium
APDLTER

SEQ ID NO: 429262 - protein, 9 aa, Mycobacterium
APDNERTAT

SEQ ID NO: 429263 - protein, 14 aa, Mycobacterium
APDNGDRDEKSAVR

SEQ ID NO: 429264 - protein, 8 aa, Mycobacterium
APDNPAAI

SEQ ID NO: 429265 - protein, 5 aa, Mycobacterium
APDNR

SEQ ID NO: 429266 - protein, 18 aa, Mycobacterium
APDPAALRTQGVRPGQVR

SEQ ID NO: 429267 - protein, 8 aa, Mycobacterium
APDPADAR

SEQ ID NO: 429268 - protein, 7 aa, Mycobacterium
APDPADL

SEQ ID NO: 429269 - protein, 12 aa, Mycobacterium
APDPADLDARTE

SEQ ID NO: 429270 - protein, 12 aa, Mycobacterium
APDPADLDERTE

SEQ ID NO: 429271 - protein, 7 aa, Mycobacterium
APDPADM

SEQ ID NO: 429272 - protein, 8 aa, Mycobacterium
APDPAGFN

SEQ ID NO: 429273 - protein, 7 aa, Mycobacterium
APDPAPL

SEQ ID NO: 429274 - protein, 15 aa, Mycobacterium
APDPAPVPRDAAPAV

SEQ ID NO: 429275 - protein, 11 aa, Mycobacterium
APDPDELADDE

SEQ ID NO: 429276 - protein, 6 aa, Mycobacterium
APDPDR

SEQ ID NO: 429277 - protein, 7 aa, Mycobacterium
APDPDRG

SEQ ID NO: 429278 - protein, 8 aa, Mycobacterium
APDPDTTV

SEQ ID NO: 429279 - protein, 8 aa, Mycobacterium
APDPEGDI

SEQ ID NO: 429280 - protein, 9 aa, Mycobacterium
APDPEGPRP

SEQ ID NO: 429281 - protein, 5 aa, Mycobacterium
APDPF

SEQ ID NO: 429282 - protein, 8 aa, Mycobacterium
APDPGFPV

SEQ ID NO: 429283 - protein, 9 aa, Mycobacterium
APDPGTVQA

SEQ ID NO: 429284 - protein, 6 aa, Mycobacterium
APDPHP

SEQ ID NO: 429285 - protein, 8 aa, Mycobacterium
APDPIPVQ

SEQ ID NO: 429286 - protein, 15 aa, Mycobacterium
APDPIRHGDAETAAR

SEQ ID NO: 429287 - protein, 12 aa, Mycobacterium
APDPKDLDERTE

SEQ ID NO: 429288 - protein, 5 aa, Mycobacterium
APDPL

SEQ ID NO: 429289 - protein, 17 aa, Mycobacterium
APDPLPPGKPGDLIRTE

SEQ ID NO: 429290 - protein, 24 aa, Mycobacterium
APDPNGDPGATKAAAAGADTQANY

SEQ ID NO: 429291 - protein, 8 aa, Mycobacterium
APDPNPIA

SEQ ID NO: 429292 - protein, 7 aa, Mycobacterium
APDPPRK

SEQ ID NO: 429293 - protein, 9 aa, Mycobacterium
APDPQVGPK

SEQ ID NO: 429294 - protein, 6 aa, Mycobacterium
APDPRR

SEQ ID NO: 429295 - protein, 9 aa, Mycobacterium
APDPRRDPV

SEQ ID NO: 429296 - protein, 10 aa, Mycobacterium
APDPRSDPIG

SEQ ID NO: 429297 - protein, 10 aa, Mycobacterium
APDPSRDPVG

SEQ ID NO: 429298 - protein, 9 aa, Mycobacterium
APDPTALKP

SEQ ID NO: 429299 - protein, 14 aa, Mycobacterium
APDPVAPRLVSEAV

SEQ ID NO: 429300 - protein, 7 aa, Mycobacterium
APDPVDA

SEQ ID NO: 429301 - protein, 8 aa, Mycobacterium
APDPVEAG

SEQ ID NO: 429302 - protein, 8 aa, Mycobacterium
APDPVGSL

SEQ ID NO: 429303 - protein, 19 aa, Mycobacterium
APDPVVSTTTPEDVDAAAA

SEQ ID NO: 429304 - protein, 6 aa, Mycobacterium
APDPYA

SEQ ID NO: 429305 - protein, 4 aa, Mycobacterium
APDQ

SEQ ID NO: 429306 - protein, 5 aa, Mycobacterium
APDQA

SEQ ID NO: 429307 - protein, 11 aa, Mycobacterium
APDQDLEARER

SEQ ID NO: 429308 - protein, 7 aa, Mycobacterium
APDQGLT

SEQ ID NO: 429309 - protein, 6 aa, Mycobacterium
APDQGV

SEQ ID NO: 429310 - protein, 5 aa, Mycobacterium
APDQI

SEQ ID NO: 429311 - protein, 9 aa, Mycobacterium
APDQLEHDA

SEQ ID NO: 429312 - protein, 9 aa, Mycobacterium
APDQPDSTI

SEQ ID NO: 429313 - protein, 9 aa, Mycobacterium
APDQQRAAG

SEQ ID NO: 429314 - protein, 6 aa, Mycobacterium
APDQSI

SEQ ID NO: 429315 - protein, 7 aa, Mycobacterium
APDQTPL

SEQ ID NO: 429316 - protein, 4 aa, Mycobacterium
APDR

SEQ ID NO: 429317 - protein, 5 aa, Mycobacterium
APDRA

SEQ ID NO: 429318 - protein, 6 aa, Mycobacterium
APDRAR

SEQ ID NO: 429319 - protein, 7 aa, Mycobacterium
APDRAVD

SEQ ID NO: 429320 - protein, 6 aa, Mycobacterium
APDRGV

SEQ ID NO: 429321 - protein, 6 aa, Mycobacterium
APDRHC

SEQ ID NO: 429322 - protein, 13 aa, Mycobacterium
APDRIKAAGDMKS

SEQ ID NO: 429323 - protein, 8 aa, Mycobacterium
APDRLPDA

SEQ ID NO: 429324 - protein, 6 aa, Mycobacterium
APDRNQ

SEQ ID NO: 429325 - protein, 13 aa, Mycobacterium
APDRNYRDPSHKP

SEQ ID NO: 429326 - protein, 12 aa, Mycobacterium
APDRRAGPPAQR

SEQ ID NO: 429327 - protein, 8 aa, Mycobacterium
APDRRERM

SEQ ID NO: 429328 - protein, 7 aa, Mycobacterium
APDRREV

SEQ ID NO: 429329 - protein, 5 aa, Mycobacterium
APDRV

SEQ ID NO: 429330 - protein, 9 aa, Mycobacterium
APDSAARSD

SEQ ID NO: 429331 - protein, 6 aa, Mycobacterium
APDSAL

SEQ ID NO: 429332 - protein, 7 aa, Mycobacterium
APDSAVG

SEQ ID NO: 429333 - protein, 8 aa, Mycobacterium
APDSEFGQ

SEQ ID NO: 429334 - protein, 5 aa, Mycobacterium
APDSF

SEQ ID NO: 429335 - protein, 6 aa, Mycobacterium
APDSIS

SEQ ID NO: 429336 - protein, 10 aa, Mycobacterium
APDSKLTPEQ

SEQ ID NO: 429337 - protein, 5 aa, Mycobacterium
APDSL

SEQ ID NO: 429338 - protein, 10 aa, Mycobacterium
APDSPAGKEL

SEQ ID NO: 429339 - protein, 11 aa, Mycobacterium
APDSPAGKELR

SEQ ID NO: 429340 - protein, 7 aa, Mycobacterium
APDSPTV

SEQ ID NO: 429341 - protein, 9 aa, Mycobacterium
APDSPVGKA

SEQ ID NO: 429342 - protein, 8 aa, Mycobacterium
APDSRLDS

SEQ ID NO: 429343 - protein, 8 aa, Mycobacterium
APDSRLES

SEQ ID NO: 429344 - protein, 16 aa, Mycobacterium
APDSSPSLTTDEPGRL

SEQ ID NO: 429345 - protein, 5 aa, Mycobacterium
APDTA

SEQ ID NO: 429346 - protein, 7 aa, Mycobacterium
APDTAGL

SEQ ID NO: 429347 - protein, 9 aa, Mycobacterium
APDTATARD

SEQ ID NO: 429348 - protein, 5 aa, Mycobacterium
APDTG

SEQ ID NO: 429349 - protein, 10 aa, Mycobacterium
APDTGAPATH

SEQ ID NO: 429350 - protein, 9 aa, Mycobacterium
APDTGSLRG

SEQ ID NO: 429351 - protein, 12 aa, Mycobacterium
APDTKGSEAHER

SEQ ID NO: 429352 - protein, 5 aa, Mycobacterium
APDTL

SEQ ID NO: 429353 - protein, 6 aa, Mycobacterium
APDTLD

SEQ ID NO: 429354 - protein, 13 aa, Mycobacterium
APDTLTDAEGPVD

SEQ ID NO: 429355 - protein, 5 aa, Mycobacterium
APDTP

SEQ ID NO: 429356 - protein, 6 aa, Mycobacterium
APDTPA

SEQ ID NO: 429357 - protein, 21 aa, Mycobacterium
APDTPDPTVSFTERSGRKVPD

SEQ ID NO: 429358 - protein, 13 aa, Mycobacterium
APDTPPDSQAEGD

SEQ ID NO: 429359 - protein, 11 aa, Mycobacterium
APDTPQIAEEV

SEQ ID NO: 429360 - protein, 6 aa, Mycobacterium
APDTRA

SEQ ID NO: 429361 - protein, 8 aa, Mycobacterium
APDTRLDS

SEQ ID NO: 429362 - protein, 8 aa, Mycobacterium
APDTRLDT

SEQ ID NO: 429363 - protein, 8 aa, Mycobacterium
APDTRLEP

SEQ ID NO: 429364 - protein, 6 aa, Mycobacterium
APDTTL

SEQ ID NO: 429365 - protein, 9 aa, Mycobacterium
APDTTLQEP

SEQ ID NO: 429366 - protein, 7 aa, Mycobacterium
APDTTVT

SEQ ID NO: 429367 - protein, 16 aa, Mycobacterium
APDTVTNSDGTTDAPN

SEQ ID NO: 429368 - protein, 5 aa, Mycobacterium
APDVE

SEQ ID NO: 429369 - protein, 7 aa, Mycobacterium
APDVEGT

SEQ ID NO: 429370 - protein, 6 aa, Mycobacterium
APDVER

SEQ ID NO: 429371 - protein, 6 aa, Mycobacterium
APDVES

SEQ ID NO: 429372 - protein, 14 aa, Mycobacterium
APDVGAASSDRHTR

SEQ ID NO: 429373 - protein, 8 aa, Mycobacterium
APDVGGTD

SEQ ID NO: 429374 - protein, 6 aa, Mycobacterium
APDVGV

SEQ ID NO: 429375 - protein, 9 aa, Mycobacterium
APDVHDEGD

SEQ ID NO: 429376 - protein, 6 aa, Mycobacterium
APDVNG

SEQ ID NO: 429377 - protein, 10 aa, Mycobacterium
APDVNGTTQT

SEQ ID NO: 429378 - protein, 13 aa, Mycobacterium
APDWPASDFDATD

SEQ ID NO: 429379 - protein, 6 aa, Mycobacterium
APDWPQ

SEQ ID NO: 429380 - protein, 13 aa, Mycobacterium
APDWPTSESDATY

SEQ ID NO: 429381 - protein, 5 aa, Mycobacterium
APDWQ

SEQ ID NO: 429382 - protein, 6 aa, Mycobacterium
APDWTG

SEQ ID NO: 429383 - protein, 4 aa, Mycobacterium
APDY

SEQ ID NO: 429384 - protein, 6 aa, Mycobacterium
APDYGD

SEQ ID NO: 429385 - protein, 5 aa, Mycobacterium
APDYR

SEQ ID NO: 429386 - protein, 11 aa, Mycobacterium
APEAARKKTLQ

SEQ ID NO: 429387 - protein, 24 aa, Mycobacterium
APEADAVDQRRSVRVDDDEANLDT

SEQ ID NO: 429388 - protein, 6 aa, Mycobacterium
APEADV

SEQ ID NO: 429389 - protein, 7 aa, Mycobacterium
APEAEDA

SEQ ID NO: 429390 - protein, 18 aa, Mycobacterium
APEAEDPRVRGTATTRDN

SEQ ID NO: 429391 - protein, 21 aa, Mycobacterium
APEAGGKAKSLRRPDGHPTEH

SEQ ID NO: 429392 - protein, 9 aa, Mycobacterium
APEAHPSGR

SEQ ID NO: 429393 - protein, 8 aa, Mycobacterium
APEAISAA

SEQ ID NO: 429394 - protein, 54 aa, Mycobacterium
APEAKAAPAEPEAKAAPEATAPTAPTQPSPAKPAAKAEPEEPAEQPVKAAPDQW

SEQ ID NO: 429395 - protein, 8 aa, Mycobacterium
APEAKERG

SEQ ID NO: 429396 - protein, 5 aa, Mycobacterium
APEAM

SEQ ID NO: 429397 - protein, 5 aa, Mycobacterium
APEAP

SEQ ID NO: 429398 - protein, 6 aa, Mycobacterium
APEAQR

SEQ ID NO: 429399 - protein, 6 aa, Mycobacterium
APEAQV

SEQ ID NO: 429400 - protein, 6 aa, Mycobacterium
APEARR

SEQ ID NO: 429401 - protein, 7 aa, Mycobacterium
APEARTH

SEQ ID NO: 429402 - protein, 5 aa, Mycobacterium
APEAT

SEQ ID NO: 429403 - protein, 10 aa, Mycobacterium
APEATDGGFY

SEQ ID NO: 429404 - protein, 13 aa, Mycobacterium
APEAVEPGVTSDR

SEQ ID NO: 429405 - protein, 8 aa, Mycobacterium
APEAVREP

SEQ ID NO: 429406 - protein, 15 aa, Mycobacterium
APEDARQATEEQRRL

SEQ ID NO: 429407 - protein, 5 aa, Mycobacterium
APEDC

SEQ ID NO: 429408 - protein, 5 aa, Mycobacterium
APEDD

SEQ ID NO: 429409 - protein, 14 aa, Mycobacterium
APEDDAPEGAADDV

SEQ ID NO: 429410 - protein, 5 aa, Mycobacterium
APEDI

SEQ ID NO: 429411 - protein, 6 aa, Mycobacterium
APEDPD

SEQ ID NO: 429412 - protein, 11 aa, Mycobacterium
APEDPKTLNSN

SEQ ID NO: 429413 - protein, 15 aa, Mycobacterium
APEDTAAAIADFALR

SEQ ID NO: 429414 - protein, 6 aa, Mycobacterium
APEDVV

SEQ ID NO: 429415 - protein, 8 aa, Mycobacterium
APEEARSG

SEQ ID NO: 429416 - protein, 19 aa, Mycobacterium
APEEDWRERPDMDPHGTVD

SEQ ID NO: 429417 - protein, 5 aa, Mycobacterium
APEEF

SEQ ID NO: 429418 - protein, 6 aa, Mycobacterium
APEELP

SEQ ID NO: 429419 - protein, 6 aa, Mycobacterium
APEEND

SEQ ID NO: 429420 - protein, 6 aa, Mycobacterium
APEEQH

SEQ ID NO: 429421 - protein, 7 aa, Mycobacterium
APEETPA

SEQ ID NO: 429422 - protein, 4 aa, Mycobacterium
APEF

SEQ ID NO: 429423 - protein, 12 aa, Mycobacterium
APEGAPTGGDPL

SEQ ID NO: 429424 - protein, 10 aa, Mycobacterium
APEGAQYAAG

SEQ ID NO: 429425 - protein, 6 aa, Mycobacterium
APEGAR

SEQ ID NO: 429426 - protein, 8 aa, Mycobacterium
APEGATRS

SEQ ID NO: 429427 - protein, 7 aa, Mycobacterium
APEGDAV

SEQ ID NO: 429428 - protein, 22 aa, Mycobacterium
APEGGGGAGQRLSGGELPQPGG

SEQ ID NO: 429429 - protein, 8 aa, Mycobacterium
APEGGTRS

SEQ ID NO: 429430 - protein, 10 aa, Mycobacterium
APEGLEGSDD

SEQ ID NO: 429431 - protein, 7 aa, Mycobacterium
APEGPAV

SEQ ID NO: 429432 - protein, 8 aa, Mycobacterium
APEGPTGQ

SEQ ID NO: 429433 - protein, 9 aa, Mycobacterium
APEGRARPV

SEQ ID NO: 429434 - protein, 10 aa, Mycobacterium
APEGRHTPSA

SEQ ID NO: 429435 - protein, 19 aa, Mycobacterium
APEGSPAPGPVDADRNDRY

SEQ ID NO: 429436 - protein, 12 aa, Mycobacterium
APEGSRPTDPAR

SEQ ID NO: 429437 - protein, 10 aa, Mycobacterium
APEGTELGAD

SEQ ID NO: 429438 - protein, 6 aa, Mycobacterium
APEGTI

SEQ ID NO: 429439 - protein, 6 aa, Mycobacterium
APEGTM

SEQ ID NO: 429440 - protein, 8 aa, Mycobacterium
APEGTPQQ

SEQ ID NO: 429441 - protein, 5 aa, Mycobacterium
APEGV

SEQ ID NO: 429442 - protein, 18 aa, Mycobacterium
APEGVGPANRVADEPANG

SEQ ID NO: 429443 - protein, 7 aa, Mycobacterium
APEGVSQ

SEQ ID NO: 429444 - protein, 7 aa, Mycobacterium
APEHPAT

SEQ ID NO: 429445 - protein, 7 aa, Mycobacterium
APEHPGI

SEQ ID NO: 429446 - protein, 8 aa, Mycobacterium
APEHPPTT

SEQ ID NO: 429447 - protein, 6 aa, Mycobacterium
APEHPR

SEQ ID NO: 429448 - protein, 7 aa, Mycobacterium
APEHPVP

SEQ ID NO: 429449 - protein, 13 aa, Mycobacterium
APEHRDAQSSLNE

SEQ ID NO: 429450 - protein, 12 aa, Mycobacterium
APEIATGDAKAT

SEQ ID NO: 429451 - protein, 7 aa, Mycobacterium
APEIESQ

SEQ ID NO: 429452 - protein, 5 aa, Mycobacterium
APEIG

SEQ ID NO: 429453 - protein, 13 aa, Mycobacterium
APEIGRTDEDTPL

SEQ ID NO: 429454 - protein, 7 aa, Mycobacterium
APEIPGR

SEQ ID NO: 429455 - protein, 4 aa, Mycobacterium
APEK

SEQ ID NO: 429456 - protein, 5 aa, Mycobacterium
APEKA

SEQ ID NO: 429457 - protein, 11 aa, Mycobacterium
APEKEGDADIR

SEQ ID NO: 429458 - protein, 8 aa, Mycobacterium
APEKPIND

SEQ ID NO: 429459 - protein, 8 aa, Mycobacterium
APEKPVKT

SEQ ID NO: 429460 - protein, 8 aa, Mycobacterium
APEKRDMA

SEQ ID NO: 429461 - protein, 5 aa, Mycobacterium
APELG

SEQ ID NO: 429462 - protein, 11 aa, Mycobacterium
APELPAPTNGE

SEQ ID NO: 429463 - protein, 5 aa, Mycobacterium
APELQ

SEQ ID NO: 429464 - protein, 6 aa, Mycobacterium
APELSD

SEQ ID NO: 429465 - protein, 5 aa, Mycobacterium
APELT

SEQ ID NO: 429466 - protein, 14 aa, Mycobacterium
APELTGDSAAAAQQ

SEQ ID NO: 429467 - protein, 5 aa, Mycobacterium
APEMP

SEQ ID NO: 429468 - protein, 5 aa, Mycobacterium
APENA

SEQ ID NO: 429469 - protein, 13 aa, Mycobacterium
APENADATGRSVG

SEQ ID NO: 429470 - protein, 14 aa, Mycobacterium
APENEGAPPDFETG

SEQ ID NO: 429471 - protein, 5 aa, Mycobacterium
APENG

SEQ ID NO: 429472 - protein, 9 aa, Mycobacterium
APENPYPAA

SEQ ID NO: 429473 - protein, 14 aa, Mycobacterium
APENRQRAANVEGT

SEQ ID NO: 429474 - protein, 4 aa, Mycobacterium
APEP

SEQ ID NO: 429475 - protein, 5 aa, Mycobacterium
APEPA

SEQ ID NO: 429476 - protein, 6 aa, Mycobacterium
APEPAA

SEQ ID NO: 429477 - protein, 19 aa, Mycobacterium
APEPADASAVNASQAYAQY

SEQ ID NO: 429478 - protein, 16 aa, Mycobacterium
APEPAEVPAAQQEPPV

SEQ ID NO: 429479 - protein, 12 aa, Mycobacterium
APEPDDWPPDAR

SEQ ID NO: 429480 - protein, 8 aa, Mycobacterium
APEPDERL

SEQ ID NO: 429481 - protein, 6 aa, Mycobacterium
APEPDV

SEQ ID NO: 429482 - protein, 8 aa, Mycobacterium
APEPELTG

SEQ ID NO: 429483 - protein, 10 aa, Mycobacterium
APEPETGKST

SEQ ID NO: 429484 - protein, 13 aa, Mycobacterium
APEPETTPEQVTE

SEQ ID NO: 429485 - protein, 7 aa, Mycobacterium
APEPGFA

SEQ ID NO: 429486 - protein, 10 aa, Mycobacterium
APEPGFTEDT

SEQ ID NO: 429487 - protein, 16 aa, Mycobacterium
APEPGKPGPRPPRRSW

SEQ ID NO: 429488 - protein, 15 aa, Mycobacterium
APEPGSAEPSPWQNR

SEQ ID NO: 429489 - protein, 10 aa, Mycobacterium
APEPGTAPRT

SEQ ID NO: 429490 - protein, 6 aa, Mycobacterium
APEPGV

SEQ ID NO: 429491 - protein, 11 aa, Mycobacterium
APEPPAGERNP

SEQ ID NO: 429492 - protein, 7 aa, Mycobacterium
APEPPAS

SEQ ID NO: 429493 - protein, 17 aa, Mycobacterium
APEPPPAWTEPRDATRV

SEQ ID NO: 429494 - protein, 10 aa, Mycobacterium
APEPPPEIAP

SEQ ID NO: 429495 - protein, 9 aa, Mycobacterium
APEPQPGER

SEQ ID NO: 429496 - protein, 7 aa, Mycobacterium
APEPQTV

SEQ ID NO: 429497 - protein, 5 aa, Mycobacterium
APEPR

SEQ ID NO: 429498 - protein, 8 aa, Mycobacterium
APEPRTRD

SEQ ID NO: 429499 - protein, 7 aa, Mycobacterium
APEPSAV

SEQ ID NO: 429500 - protein, 7 aa, Mycobacterium
APEPSHD

SEQ ID NO: 429501 - protein, 7 aa, Mycobacterium
APEPSRR

SEQ ID NO: 429502 - protein, 21 aa, Mycobacterium
APEPSTGAEAAVSRTVRGSLE

SEQ ID NO: 429503 - protein, 8 aa, Mycobacterium
APEPTARP

SEQ ID NO: 429504 - protein, 7 aa, Mycobacterium
APEPTHD

SEQ ID NO: 429505 - protein, 12 aa, Mycobacterium
APEPVRNSQYTR

SEQ ID NO: 429506 - protein, 21 aa, Mycobacterium
APEQAVSAPAVPAPVDAPGGR

SEQ ID NO: 429507 - protein, 12 aa, Mycobacterium
APEQDQHPVRTG

SEQ ID NO: 429508 - protein, 8 aa, Mycobacterium
APEQGVEE

SEQ ID NO: 429509 - protein, 11 aa, Mycobacterium
APEQLPPPRAV

SEQ ID NO: 429510 - protein, 16 aa, Mycobacterium
APEQLTGAEIDGRADQ

SEQ ID NO: 429511 - protein, 5 aa, Mycobacterium
APEQP

SEQ ID NO: 429512 - protein, 13 aa, Mycobacterium
APEQRADYQRRAD

SEQ ID NO: 429513 - protein, 6 aa, Mycobacterium
APEQRE

SEQ ID NO: 429514 - protein, 5 aa, Mycobacterium
APEQV

SEQ ID NO: 429515 - protein, 6 aa, Mycobacterium
APERAE

SEQ ID NO: 429516 - protein, 13 aa, Mycobacterium
APERAEATMPGAA

SEQ ID NO: 429517 - protein, 8 aa, Mycobacterium
APERDPGT

SEQ ID NO: 429518 - protein, 5 aa, Mycobacterium
APERF

SEQ ID NO: 429519 - protein, 14 aa, Mycobacterium
APERFRGDTEPVDP

SEQ ID NO: 429520 - protein, 11 aa, Mycobacterium
APERIGGRRRY

SEQ ID NO: 429521 - protein, 10 aa, Mycobacterium
APERNAEAFT

SEQ ID NO: 429522 - protein, 13 aa, Mycobacterium
APERRTADGEQQV

SEQ ID NO: 429523 - protein, 9 aa, Mycobacterium
APERRTRQT

SEQ ID NO: 429524 - protein, 7 aa, Mycobacterium
APERSDL

SEQ ID NO: 429525 - protein, 5 aa, Mycobacterium
APERT

SEQ ID NO: 429526 - protein, 7 aa, Mycobacterium
APERTAE

SEQ ID NO: 429527 - protein, 8 aa, Mycobacterium
APERVGQN

SEQ ID NO: 429528 - protein, 12 aa, Mycobacterium
APESAAAARTIP

SEQ ID NO: 429529 - protein, 9 aa, Mycobacterium
APESAAKQR

SEQ ID NO: 429530 - protein, 8 aa, Mycobacterium
APESAAKR

SEQ ID NO: 429531 - protein, 6 aa, Mycobacterium
APESAC

SEQ ID NO: 429532 - protein, 11 aa, Mycobacterium
APESAPPAQFD

SEQ ID NO: 429533 - protein, 5 aa, Mycobacterium
APESD

SEQ ID NO: 429534 - protein, 11 aa, Mycobacterium
APESDGDSVTT

SEQ ID NO: 429535 - protein, 25 aa, Mycobacterium
APESGKPVRLDNADEDSRMTDVLRL

SEQ ID NO: 429536 - protein, 8 aa, Mycobacterium
APESGTQE

SEQ ID NO: 429537 - protein, 6 aa, Mycobacterium
APESIG

SEQ ID NO: 429538 - protein, 6 aa, Mycobacterium
APESKS

SEQ ID NO: 429539 - protein, 5 aa, Mycobacterium
APESL

SEQ ID NO: 429540 - protein, 11 aa, Mycobacterium
APESLGGAGAT

SEQ ID NO: 429541 - protein, 8 aa, Mycobacterium
APESPYPM

SEQ ID NO: 429542 - protein, 17 aa, Mycobacterium
APESRNNEADGESRPIT

SEQ ID NO: 429543 - protein, 9 aa, Mycobacterium
APESSDNRP

SEQ ID NO: 429544 - protein, 7 aa, Mycobacterium
APESSGW

SEQ ID NO: 429545 - protein, 6 aa, Mycobacterium
APESTA

SEQ ID NO: 429546 - protein, 5 aa, Mycobacterium
APESV

SEQ ID NO: 429547 - protein, 7 aa, Mycobacterium
APESYGG

SEQ ID NO: 429548 - protein, 16 aa, Mycobacterium
APETATHDAEPVSPAI

SEQ ID NO: 429549 - protein, 5 aa, Mycobacterium
APETD

SEQ ID NO: 429550 - protein, 6 aa, Mycobacterium
APETEA

SEQ ID NO: 429551 - protein, 10 aa, Mycobacterium
APETGGPEPV

SEQ ID NO: 429552 - protein, 26 aa, Mycobacterium
APETPEAPAAASSDRAGKERRGDGLG

SEQ ID NO: 429553 - protein, 8 aa, Mycobacterium
APETSAAV

SEQ ID NO: 429554 - protein, 9 aa, Mycobacterium
APETSDDTV

SEQ ID NO: 429555 - protein, 11 aa, Mycobacterium
APETSWDGAPG

SEQ ID NO: 429556 - protein, 16 aa, Mycobacterium
APETTESLKDAARGHA

SEQ ID NO: 429557 - protein, 5 aa, Mycobacterium
APEVD

SEQ ID NO: 429558 - protein, 5 aa, Mycobacterium
APEVE

SEQ ID NO: 429559 - protein, 14 aa, Mycobacterium
APEVEPGGIDPLSP

SEQ ID NO: 429560 - protein, 14 aa, Mycobacterium
APEVETGEITPQTC

SEQ ID NO: 429561 - protein, 5 aa, Mycobacterium
APEVG

SEQ ID NO: 429562 - protein, 8 aa, Mycobacterium
APEVGEGV

SEQ ID NO: 429563 - protein, 6 aa, Mycobacterium
APEVGG

SEQ ID NO: 429564 - protein, 5 aa, Mycobacterium
APEVS

SEQ ID NO: 429565 - protein, 6 aa, Mycobacterium
APEVSS

SEQ ID NO: 429566 - protein, 5 aa, Mycobacterium
APEVT

SEQ ID NO: 429567 - protein, 16 aa, Mycobacterium
APEVTNYDDVESDPGH

SEQ ID NO: 429568 - protein, 15 aa, Mycobacterium
APEYAEGDTRGERMG

SEQ ID NO: 429569 - protein, 12 aa, Mycobacterium
APEYDGKSGYGV

SEQ ID NO: 429570 - protein, 6 aa, Mycobacterium
APEYDM

SEQ ID NO: 429571 - protein, 6 aa, Mycobacterium
APEYDP

SEQ ID NO: 429572 - protein, 4 aa, Mycobacterium
APFA

SEQ ID NO: 429573 - protein, 5 aa, Mycobacterium
APFAD

SEQ ID NO: 429574 - protein, 5 aa, Mycobacterium
APFAE

SEQ ID NO: 429575 - protein, 11 aa, Mycobacterium
APFAETAPEDW

SEQ ID NO: 429576 - protein, 8 aa, Mycobacterium
APFAPKGR

SEQ ID NO: 429577 - protein, 8 aa, Mycobacterium
APFAPSGR

SEQ ID NO: 429578 - protein, 18 aa, Mycobacterium
APFASGATSASDHRGHED

SEQ ID NO: 429579 - protein, 4 aa, Mycobacterium
APFD

SEQ ID NO: 429580 - protein, 9 aa, Mycobacterium
APFDDPDRT

SEQ ID NO: 429581 - protein, 9 aa, Mycobacterium
APFDNPDGL

SEQ ID NO: 429582 - protein, 19 aa, Mycobacterium
APFDPPPNTTNPDAAADQA

SEQ ID NO: 429583 - protein, 4 aa, Mycobacterium
APFE

SEQ ID NO: 429584 - protein, 14 aa, Mycobacterium
APFEAPFEAARSLT

SEQ ID NO: 429585 - protein, 4 aa, Mycobacterium
APFG

SEQ ID NO: 429586 - protein, 5 aa, Mycobacterium
APFGG

SEQ ID NO: 429587 - protein, 13 aa, Mycobacterium
APFGGVGRSGMGA

SEQ ID NO: 429588 - protein, 14 aa, Mycobacterium
APFGGVGRSGMGAY

SEQ ID NO: 429589 - protein, 14 aa, Mycobacterium
APFGGYKNSGVGRQ

SEQ ID NO: 429590 - protein, 14 aa, Mycobacterium
APFGGYKQSGNGRE

SEQ ID NO: 429591 - protein, 14 aa, Mycobacterium
APFGGYKQSGVGRE

SEQ ID NO: 429592 - protein, 13 aa, Mycobacterium
APFGGYKSSGVGR

SEQ ID NO: 429593 - protein, 7 aa, Mycobacterium
APFPDDS

SEQ ID NO: 429594 - protein, 14 aa, Mycobacterium
APFPDDSFKAGARQ

SEQ ID NO: 429595 - protein, 8 aa, Mycobacterium
APFPGDEW

SEQ ID NO: 429596 - protein, 5 aa, Mycobacterium
APFPN

SEQ ID NO: 429597 - protein, 11 aa, Mycobacterium
APFPPPPPGYD

SEQ ID NO: 429598 - protein, 6 aa, Mycobacterium
APFPPT

SEQ ID NO: 429599 - protein, 5 aa, Mycobacterium
APFQP

SEQ ID NO: 429600 - protein, 7 aa, Mycobacterium
APFSGDE

SEQ ID NO: 429601 - protein, 8 aa, Mycobacterium
APFSGGGY

SEQ ID NO: 429602 - protein, 13 aa, Mycobacterium
APFSGHTDGRSKQ

SEQ ID NO: 429603 - protein, 14 aa, Mycobacterium
APFTDSDKVQYLDM

SEQ ID NO: 429604 - protein, 6 aa, Mycobacterium
APFTSL

SEQ ID NO: 429605 - protein, 5 aa, Mycobacterium
APGAA

SEQ ID NO: 429606 - protein, 6 aa, Mycobacterium
APGAAA

SEQ ID NO: 429607 - protein, 11 aa, Mycobacterium
APGAAGDGPSS

SEQ ID NO: 429608 - protein, 6 aa, Mycobacterium
APGAAL

SEQ ID NO: 429609 - protein, 7 aa, Mycobacterium
APGAALT

SEQ ID NO: 429610 - protein, 9 aa, Mycobacterium
APGAAPTPV

SEQ ID NO: 429611 - protein, 8 aa, Mycobacterium
APGAATRS

SEQ ID NO: 429612 - protein, 36 aa, Mycobacterium
APGACNPDDQTPVIDTTPDADAVDRDTRSQAQRNHD

SEQ ID NO: 429613 - protein, 35 aa, Mycobacterium
APGACNPDDQTPVVDATPDADAVRRDARSQAQRNH

SEQ ID NO: 429614 - protein, 6 aa, Mycobacterium
APGADA

SEQ ID NO: 429615 - protein, 9 aa, Mycobacterium
APGADEVSA

SEQ ID NO: 429616 - protein, 6 aa, Mycobacterium
APGADV

SEQ ID NO: 429617 - protein, 5 aa, Mycobacterium
APGAE

SEQ ID NO: 429618 - protein, 16 aa, Mycobacterium
APGAELPRIDPDARRR

SEQ ID NO: 429619 - protein, 18 aa, Mycobacterium
APGAENSLTQVSSGRMAR

SEQ ID NO: 429620 - protein, 11 aa, Mycobacterium
APGAESVCTTN

SEQ ID NO: 429621 - protein, 5 aa, Mycobacterium
APGAG

SEQ ID NO: 429622 - protein, 6 aa, Mycobacterium
APGAGD

SEQ ID NO: 429623 - protein, 11 aa, Mycobacterium
APGAGISEMSP

SEQ ID NO: 429624 - protein, 21 aa, Mycobacterium
APGAGSRPLRSTNARPEGARE

SEQ ID NO: 429625 - protein, 25 aa, Mycobacterium
APGAGTSGFAGTHGTVASSSPAGLT

SEQ ID NO: 429626 - protein, 5 aa, Mycobacterium
APGAI

SEQ ID NO: 429627 - protein, 6 aa, Mycobacterium
APGAID

SEQ ID NO: 429628 - protein, 7 aa, Mycobacterium
APGAKTD

SEQ ID NO: 429629 - protein, 5 aa, Mycobacterium
APGAP

SEQ ID NO: 429630 - protein, 9 aa, Mycobacterium
APGAPAAQA

SEQ ID NO: 429631 - protein, 8 aa, Mycobacterium
APGAPASY

SEQ ID NO: 429632 - protein, 7 aa, Mycobacterium
APGAPDL

SEQ ID NO: 429633 - protein, 8 aa, Mycobacterium
APGAPEAG

SEQ ID NO: 429634 - protein, 37 aa, Mycobacterium
APGAPSGAAPAPLADPAANVSRETSHEFDTPIGAAAE

SEQ ID NO: 429635 - protein, 8 aa, Mycobacterium
APGARPGW

SEQ ID NO: 429636 - protein, 6 aa, Mycobacterium
APGARR

SEQ ID NO: 429637 - protein, 5 aa, Mycobacterium
APGAS

SEQ ID NO: 429638 - protein, 7 aa, Mycobacterium
APGASGA

SEQ ID NO: 429639 - protein, 8 aa, Mycobacterium
APGASRDE

SEQ ID NO: 429640 - protein, 6 aa, Mycobacterium
APGASS

SEQ ID NO: 429641 - protein, 5 aa, Mycobacterium
APGAT

SEQ ID NO: 429642 - protein, 9 aa, Mycobacterium
APGATGNIA

SEQ ID NO: 429643 - protein, 6 aa, Mycobacterium
APGATH

SEQ ID NO: 429644 - protein, 7 aa, Mycobacterium
APGATVA

SEQ ID NO: 429645 - protein, 18 aa, Mycobacterium
APGAVAPAPLGRKREGRD

SEQ ID NO: 429646 - protein, 16 aa, Mycobacterium
APGAVSTGKFTAGPDT

SEQ ID NO: 429647 - protein, 4 aa, Mycobacterium
APGC

SEQ ID NO: 429648 - protein, 6 aa, Mycobacterium
APGCDQ

SEQ ID NO: 429649 - protein, 6 aa, Mycobacterium
APGCDR

SEQ ID NO: 429650 - protein, 7 aa, Mycobacterium
APGCDRP

SEQ ID NO: 429651 - protein, 19 aa, Mycobacterium
APGDAANRYSGSPVRQPGF

SEQ ID NO: 429652 - protein, 17 aa, Mycobacterium
APGDATATVEGGETRTL

SEQ ID NO: 429653 - protein, 17 aa, Mycobacterium
APGDATTVRQSAESTLR

SEQ ID NO: 429654 - protein, 11 aa, Mycobacterium
APGDDPELRTE

SEQ ID NO: 429655 - protein, 10 aa, Mycobacterium
APGDEGSIST

SEQ ID NO: 429656 - protein, 7 aa, Mycobacterium
APGDETQ

SEQ ID NO: 429657 - protein, 5 aa, Mycobacterium
APGDG

SEQ ID NO: 429658 - protein, 5 aa, Mycobacterium
APGDI

SEQ ID NO: 429659 - protein, 5 aa, Mycobacterium
APGDL

SEQ ID NO: 429660 - protein, 13 aa, Mycobacterium
APGDPADARPGGV

SEQ ID NO: 429661 - protein, 11 aa, Mycobacterium
APGDPKTLTSN

SEQ ID NO: 429662 - protein, 8 aa, Mycobacterium
APGDPSGR

SEQ ID NO: 429663 - protein, 6 aa, Mycobacterium
APGDPV

SEQ ID NO: 429664 - protein, 6 aa, Mycobacterium
APGDRA

SEQ ID NO: 429665 - protein, 6 aa, Mycobacterium
APGDRS

SEQ ID NO: 429666 - protein, 7 aa, Mycobacterium
APGDSET

SEQ ID NO: 429667 - protein, 20 aa, Mycobacterium
APGDTGQLNDGGPSAARTAL

SEQ ID NO: 429668 - protein, 10 aa, Mycobacterium
APGDTPTAAA

SEQ ID NO: 429669 - protein, 10 aa, Mycobacterium
APGDTPTADV

SEQ ID NO: 429670 - protein, 12 aa, Mycobacterium
APGDTPTVTEDG

SEQ ID NO: 429671 - protein, 6 aa, Mycobacterium
APGDVD

SEQ ID NO: 429672 - protein, 14 aa, Mycobacterium
APGEAVQQSSIDRP

SEQ ID NO: 429673 - protein, 10 aa, Mycobacterium
APGEDSATVT

SEQ ID NO: 429674 - protein, 19 aa, Mycobacterium
APGEGVTPLGSEPVSGTSF

SEQ ID NO: 429675 - protein, 5 aa, Mycobacterium
APGEI

SEQ ID NO: 429676 - protein, 34 aa, Mycobacterium
APGEKKAKTRVGRGEGSKGKTAGRGTKGTKARKN

SEQ ID NO: 429677 - protein, 6 aa, Mycobacterium
APGELR

SEQ ID NO: 429678 - protein, 13 aa, Mycobacterium
APGEPAIPTQTIS

SEQ ID NO: 429679 - protein, 11 aa, Mycobacterium
APGEPQSLTSN

SEQ ID NO: 429680 - protein, 9 aa, Mycobacterium
APGEQGPLQ

SEQ ID NO: 429681 - protein, 7 aa, Mycobacterium
APGERID

SEQ ID NO: 429682 - protein, 6 aa, Mycobacterium
APGESA

SEQ ID NO: 429683 - protein, 9 aa, Mycobacterium
APGETPAAA

SEQ ID NO: 429684 - protein, 7 aa, Mycobacterium
APGETSR

SEQ ID NO: 429685 - protein, 5 aa, Mycobacterium
APGFC

SEQ ID NO: 429686 - protein, 11 aa, Mycobacterium
APGFDGQPGVI

SEQ ID NO: 429687 - protein, 5 aa, Mycobacterium
APGFG

SEQ ID NO: 429688 - protein, 12 aa, Mycobacterium
APGFGGQPGVVN

SEQ ID NO: 429689 - protein, 15 aa, Mycobacterium
APGFGNSTSAPSSGF

SEQ ID NO: 429690 - protein, 14 aa, Mycobacterium
APGFGNSTTNPSSG

SEQ ID NO: 429691 - protein, 15 aa, Mycobacterium
APGFGNSTTSPSSGF

SEQ ID NO: 429692 - protein, 14 aa, Mycobacterium
APGFGNSTTTASSG

SEQ ID NO: 429693 - protein, 14 aa, Mycobacterium
APGFGNTTAGPSSG

SEQ ID NO: 429694 - protein, 15 aa, Mycobacterium
APGFGNTTATPSSGF

SEQ ID NO: 429695 - protein, 13 aa, Mycobacterium
APGFTGQPGVVNG

SEQ ID NO: 429696 - protein, 12 aa, Mycobacterium
APGGAGPRTGDS

SEQ ID NO: 429697 - protein, 7 aa, Mycobacterium
APGGAGV

SEQ ID NO: 429698 - protein, 6 aa, Mycobacterium
APGGDA

SEQ ID NO: 429699 - protein, 9 aa, Mycobacterium
APGGDAKAH

SEQ ID NO: 429700 - protein, 8 aa, Mycobacterium
APGGDARA

SEQ ID NO: 429701 - protein, 17 aa, Mycobacterium
APGGDSERAERKAAEFG

SEQ ID NO: 429702 - protein, 5 aa, Mycobacterium
APGGE

SEQ ID NO: 429703 - protein, 17 aa, Mycobacterium
APGGERGRRSVRHAQAN

SEQ ID NO: 429704 - protein, 14 aa, Mycobacterium
APGGERSARAFSQS

SEQ ID NO: 429705 - protein, 25 aa, Mycobacterium
APGGEYAKNTKGPDRQYPGSDPDVA

SEQ ID NO: 429706 - protein, 21 aa, Mycobacterium
APGGEYAPNAEGPNREYPGSS

SEQ ID NO: 429707 - protein, 24 aa, Mycobacterium
APGGEYAPNTEGPDGQYPGSDPEF

SEQ ID NO: 429708 - protein, 23 aa, Mycobacterium
APGGEYAPNTEGPDRQYPGSDPD

SEQ ID NO: 429709 - protein, 24 aa, Mycobacterium
APGGEYAPRTEGPDGQYPGSDPEL

SEQ ID NO: 429710 - protein, 14 aa, Mycobacterium
APGGGDAITVSSDR

SEQ ID NO: 429711 - protein, 8 aa, Mycobacterium
APGGGDGV

SEQ ID NO: 429712 - protein, 7 aa, Mycobacterium
APGGGVT

SEQ ID NO: 429713 - protein, 9 aa, Mycobacterium
APGGIDSPA

SEQ ID NO: 429714 - protein, 8 aa, Mycobacterium
APGGIDTA

SEQ ID NO: 429715 - protein, 8 aa, Mycobacterium
APGGIDTP

SEQ ID NO: 429716 - protein, 9 aa, Mycobacterium
APGGIDTPD

SEQ ID NO: 429717 - protein, 9 aa, Mycobacterium
APGGIENAE

SEQ ID NO: 429718 - protein, 19 aa, Mycobacterium
APGGKGGNQAVAAARAGAD

SEQ ID NO: 429719 - protein, 11 aa, Mycobacterium
APGGKTDGSIE

SEQ ID NO: 429720 - protein, 5 aa, Mycobacterium
APGGQ

SEQ ID NO: 429721 - protein, 13 aa, Mycobacterium
APGGQLAARAASQ

SEQ ID NO: 429722 - protein, 5 aa, Mycobacterium
APGGR

SEQ ID NO: 429723 - protein, 8 aa, Mycobacterium
APGGRREL

SEQ ID NO: 429724 - protein, 17 aa, Mycobacterium
APGGRRSATAFSQSERW

SEQ ID NO: 429725 - protein, 8 aa, Mycobacterium
APGGRSGW

SEQ ID NO: 429726 - protein, 7 aa, Mycobacterium
APGGRTD

SEQ ID NO: 429727 - protein, 8 aa, Mycobacterium
APGGRTDG

SEQ ID NO: 429728 - protein, 13 aa, Mycobacterium
APGGSLPRPHTHP

SEQ ID NO: 429729 - protein, 5 aa, Mycobacterium
APGGV

SEQ ID NO: 429730 - protein, 8 aa, Mycobacterium
APGGVDTA

SEQ ID NO: 429731 - protein, 6 aa, Mycobacterium
APGGVG

SEQ ID NO: 429732 - protein, 8 aa, Mycobacterium
APGGVSTG

SEQ ID NO: 429733 - protein, 9 aa, Mycobacterium
APGGVTTAD

SEQ ID NO: 429734 - protein, 4 aa, Mycobacterium
APGH

SEQ ID NO: 429735 - protein, 6 aa, Mycobacterium
APGHEG

SEQ ID NO: 429736 - protein, 20 aa, Mycobacterium
APGHGDTGDLPPDADGFSER

SEQ ID NO: 429737 - protein, 10 aa, Mycobacterium
APGHGGGYHD

SEQ ID NO: 429738 - protein, 6 aa, Mycobacterium
APGHGP

SEQ ID NO: 429739 - protein, 12 aa, Mycobacterium
APGIGSTATGTL

SEQ ID NO: 429740 - protein, 7 aa, Mycobacterium
APGIPNN

SEQ ID NO: 429741 - protein, 21 aa, Mycobacterium
APGISSTADIAAHPGSHMAAQ

SEQ ID NO: 429742 - protein, 4 aa, Mycobacterium
APGK

SEQ ID NO: 429743 - protein, 13 aa, Mycobacterium
APGKASNAGGVAT

SEQ ID NO: 429744 - protein, 23 aa, Mycobacterium
APGKSPGFEAAKSTVTQQFAVII

SEQ ID NO: 429745 - protein, 7 aa, Mycobacterium
APGLAPG

SEQ ID NO: 429746 - protein, 9 aa, Mycobacterium
APGLDRATD

SEQ ID NO: 429747 - protein, 11 aa, Mycobacterium
APGLGRAETPI

SEQ ID NO: 429748 - protein, 12 aa, Mycobacterium
APGLNSAAAGTL

SEQ ID NO: 429749 - protein, 6 aa, Mycobacterium
APGLPA

SEQ ID NO: 429750 - protein, 8 aa, Mycobacterium
APGLPESV

SEQ ID NO: 429751 - protein, 7 aa, Mycobacterium
APGLPVG

SEQ ID NO: 429752 - protein, 13 aa, Mycobacterium
APGLTDADREAVD

SEQ ID NO: 429753 - protein, 4 aa, Mycobacterium
APGM

SEQ ID NO: 429754 - protein, 17 aa, Mycobacterium
APGMATNPERVANQKRV

SEQ ID NO: 429755 - protein, 34 aa, Mycobacterium
APGMCNPTDQTPCISGTPSQQQIDSDQRGAPERR

SEQ ID NO: 429756 - protein, 13 aa, Mycobacterium
APGMPGGNGGPAG

SEQ ID NO: 429757 - protein, 8 aa, Mycobacterium
APGMPTDG

SEQ ID NO: 429758 - protein, 6 aa, Mycobacterium
APGMPY

SEQ ID NO: 429759 - protein, 11 aa, Mycobacterium
APGNAGTARLA

SEQ ID NO: 429760 - protein, 13 aa, Mycobacterium
APGNAGTSSIADQ

SEQ ID NO: 429761 - protein, 5 aa, Mycobacterium
APGNE

SEQ ID NO: 429762 - protein, 5 aa, Mycobacterium
APGNI

SEQ ID NO: 429763 - protein, 8 aa, Mycobacterium
APGNIDGR

SEQ ID NO: 429764 - protein, 8 aa, Mycobacterium
APGNIETP

SEQ ID NO: 429765 - protein, 6 aa, Mycobacterium
APGNIP

SEQ ID NO: 429766 - protein, 12 aa, Mycobacterium
APGNPAAADPRR

SEQ ID NO: 429767 - protein, 8 aa, Mycobacterium
APGNPKRI

SEQ ID NO: 429768 - protein, 5 aa, Mycobacterium
APGNT

SEQ ID NO: 429769 - protein, 5 aa, Mycobacterium
APGPA

SEQ ID NO: 429770 - protein, 11 aa, Mycobacterium
APGPAAAGRPP

SEQ ID NO: 429771 - protein, 8 aa, Mycobacterium
APGPAAPL

SEQ ID NO: 429772 - protein, 7 aa, Mycobacterium
APGPAGR

SEQ ID NO: 429773 - protein, 9 aa, Mycobacterium
APGPAGSDE

SEQ ID NO: 429774 - protein, 7 aa, Mycobacterium
APGPCDT

SEQ ID NO: 429775 - protein, 13 aa, Mycobacterium
APGPDGAPRPVAR

SEQ ID NO: 429776 - protein, 7 aa, Mycobacterium
APGPDGY

SEQ ID NO: 429777 - protein, 8 aa, Mycobacterium
APGPGESW

SEQ ID NO: 429778 - protein, 29 aa, Mycobacterium
APGPGGATPARFPAGPVNRDTSTLLCIIR

SEQ ID NO: 429779 - protein, 8 aa, Mycobacterium
APGPGGQL

SEQ ID NO: 429780 - protein, 11 aa, Mycobacterium
APGPGLKRNRK

SEQ ID NO: 429781 - protein, 7 aa, Mycobacterium
APGPGQI

SEQ ID NO: 429782 - protein, 7 aa, Mycobacterium
APGPGRR

SEQ ID NO: 429783 - protein, 40 aa, Mycobacterium
APGPGSTAEGQTPAGATTLPNTAGQSAYQGPCPPNGTGTH

SEQ ID NO: 429784 - protein, 5 aa, Mycobacterium
APGPH

SEQ ID NO: 429785 - protein, 13 aa, Mycobacterium
APGPHDDKYTQGV

SEQ ID NO: 429786 - protein, 6 aa, Mycobacterium
APGPIA

SEQ ID NO: 429787 - protein, 17 aa, Mycobacterium
APGPIDTEANRTTTPQE

SEQ ID NO: 429788 - protein, 17 aa, Mycobacterium
APGPIDTEATRTVTPGE

SEQ ID NO: 429789 - protein, 6 aa, Mycobacterium
APGPIE

SEQ ID NO: 429790 - protein, 6 aa, Mycobacterium
APGPIT

SEQ ID NO: 429791 - protein, 6 aa, Mycobacterium
APGPLH

SEQ ID NO: 429792 - protein, 8 aa, Mycobacterium
APGPNGAP

SEQ ID NO: 429793 - protein, 6 aa, Mycobacterium
APGPQE

SEQ ID NO: 429794 - protein, 7 aa, Mycobacterium
APGPQEW

SEQ ID NO: 429795 - protein, 8 aa, Mycobacterium
APGPQGTH

SEQ ID NO: 429796 - protein, 5 aa, Mycobacterium
APGPR

SEQ ID NO: 429797 - protein, 8 aa, Mycobacterium
APGPSGTA

SEQ ID NO: 429798 - protein, 17 aa, Mycobacterium
APGPTDTEATRGTVPEQ

SEQ ID NO: 429799 - protein, 6 aa, Mycobacterium
APGPTI

SEQ ID NO: 429800 - protein, 6 aa, Mycobacterium
APGPVA

SEQ ID NO: 429801 - protein, 7 aa, Mycobacterium
APGPVDT

SEQ ID NO: 429802 - protein, 19 aa, Mycobacterium
APGQADPGVRSELAGRDGD

SEQ ID NO: 429803 - protein, 13 aa, Mycobacterium
APGQESSLNGPVT

SEQ ID NO: 429804 - protein, 8 aa, Mycobacterium
APGQHSIE

SEQ ID NO: 429805 - protein, 8 aa, Mycobacterium
APGQHSLE

SEQ ID NO: 429806 - protein, 5 aa, Mycobacterium
APGQL

SEQ ID NO: 429807 - protein, 5 aa, Mycobacterium
APGQP

SEQ ID NO: 429808 - protein, 8 aa, Mycobacterium
APGQPAEN

SEQ ID NO: 429809 - protein, 7 aa, Mycobacterium
APGQQNG

SEQ ID NO: 429810 - protein, 27 aa, Mycobacterium
APGQQPADDEAPEIGEGGEPDDDDDSF

SEQ ID NO: 429811 - protein, 8 aa, Mycobacterium
APGQRDES

SEQ ID NO: 429812 - protein, 20 aa, Mycobacterium
APGQSAEANYDGLDSTEDAH

SEQ ID NO: 429813 - protein, 10 aa, Mycobacterium
APGQTTADGR

SEQ ID NO: 429814 - protein, 5 aa, Mycobacterium
APGQY

SEQ ID NO: 429815 - protein, 13 aa, Mycobacterium
APGRAADADPAPP

SEQ ID NO: 429816 - protein, 24 aa, Mycobacterium
APGRAQPAFDQRETATYAATRQCN

SEQ ID NO: 429817 - protein, 9 aa, Mycobacterium
APGRASAQA

SEQ ID NO: 429818 - protein, 7 aa, Mycobacterium
APGRDDV

SEQ ID NO: 429819 - protein, 6 aa, Mycobacterium
APGRDN

SEQ ID NO: 429820 - protein, 8 aa, Mycobacterium
APGREAAH

SEQ ID NO: 429821 - protein, 6 aa, Mycobacterium
APGRGP

SEQ ID NO: 429822 - protein, 15 aa, Mycobacterium
APGRGRDNFSYSASK

SEQ ID NO: 429823 - protein, 5 aa, Mycobacterium
APGRL

SEQ ID NO: 429824 - protein, 6 aa, Mycobacterium
APGRLP

SEQ ID NO: 429825 - protein, 5 aa, Mycobacterium
APGRN

SEQ ID NO: 429826 - protein, 46 aa, Mycobacterium
APGRNPGSPGPARTTGATNTAEAAGATGADQPTTEPAGTTVAGTAA

SEQ ID NO: 429827 - protein, 7 aa, Mycobacterium
APGRPFG

SEQ ID NO: 429828 - protein, 9 aa, Mycobacterium
APGRPQAPN

SEQ ID NO: 429829 - protein, 10 aa, Mycobacterium
APGRPQGRGK

SEQ ID NO: 429830 - protein, 19 aa, Mycobacterium
APGRPTNAYSLTGDGIAPD

SEQ ID NO: 429831 - protein, 5 aa, Mycobacterium
APGRR

SEQ ID NO: 429832 - protein, 6 aa, Mycobacterium
APGRRY

SEQ ID NO: 429833 - protein, 16 aa, Mycobacterium
APGRSGVARPTRAYRK

SEQ ID NO: 429834 - protein, 7 aa, Mycobacterium
APGRSTQ

SEQ ID NO: 429835 - protein, 8 aa, Mycobacterium
APGRTETY

SEQ ID NO: 429836 - protein, 11 aa, Mycobacterium
APGRYTRRGLP

SEQ ID NO: 429837 - protein, 5 aa, Mycobacterium
APGSA

SEQ ID NO: 429838 - protein, 6 aa, Mycobacterium
APGSAE

SEQ ID NO: 429839 - protein, 9 aa, Mycobacterium
APGSAEFTE

SEQ ID NO: 429840 - protein, 9 aa, Mycobacterium
APGSEGGAD

SEQ ID NO: 429841 - protein, 6 aa, Mycobacterium
APGSEL

SEQ ID NO: 429842 - protein, 23 aa, Mycobacterium
APGSEYAPNTEGPDRQYPGSDPK

SEQ ID NO: 429843 - protein, 15 aa, Mycobacterium
APGSGLDDRRQLQEP

SEQ ID NO: 429844 - protein, 11 aa, Mycobacterium
APGSGLDDRRR

SEQ ID NO: 429845 - protein, 13 aa, Mycobacterium
APGSGNASWDRPS

SEQ ID NO: 429846 - protein, 8 aa, Mycobacterium
APGSGQTI

SEQ ID NO: 429847 - protein, 8 aa, Mycobacterium
APGSGQTV

SEQ ID NO: 429848 - protein, 17 aa, Mycobacterium
APGSGSTADGQTPAGAT

SEQ ID NO: 429849 - protein, 12 aa, Mycobacterium
APGSGVSAEDAS

SEQ ID NO: 429850 - protein, 8 aa, Mycobacterium
APGSIPTP

SEQ ID NO: 429851 - protein, 9 aa, Mycobacterium
APGSIPTPI

SEQ ID NO: 429852 - protein, 5 aa, Mycobacterium
APGSL

SEQ ID NO: 429853 - protein, 8 aa, Mycobacterium
APGSLDPQ

SEQ ID NO: 429854 - protein, 7 aa, Mycobacterium
APGSLPG

SEQ ID NO: 429855 - protein, 28 aa, Mycobacterium
APGSRAASISYRSSLGADAAADIAGGDR

SEQ ID NO: 429856 - protein, 13 aa, Mycobacterium
APGSRIAAETAAR

SEQ ID NO: 429857 - protein, 6 aa, Mycobacterium
APGSSS

SEQ ID NO: 429858 - protein, 7 aa, Mycobacterium
APGSSTS

SEQ ID NO: 429859 - protein, 9 aa, Mycobacterium
APGSSVSQV

SEQ ID NO: 429860 - protein, 8 aa, Mycobacterium
APGSTDTP

SEQ ID NO: 429861 - protein, 8 aa, Mycobacterium
APGSVDGR

SEQ ID NO: 429862 - protein, 8 aa, Mycobacterium
APGTAAPL

SEQ ID NO: 429863 - protein, 6 aa, Mycobacterium
APGTAD

SEQ ID NO: 429864 - protein, 6 aa, Mycobacterium
APGTAV

SEQ ID NO: 429865 - protein, 8 aa, Mycobacterium
APGTEDQW

SEQ ID NO: 429866 - protein, 7 aa, Mycobacterium
APGTERT

SEQ ID NO: 429867 - protein, 8 aa, Mycobacterium
APGTETEL

SEQ ID NO: 429868 - protein, 6 aa, Mycobacterium
APGTGI

SEQ ID NO: 429869 - protein, 7 aa, Mycobacterium
APGTGIP

SEQ ID NO: 429870 - protein, 13 aa, Mycobacterium
APGTGKSTNPNAM

SEQ ID NO: 429871 - protein, 7 aa, Mycobacterium
APGTGLP

SEQ ID NO: 429872 - protein, 7 aa, Mycobacterium
APGTGLR

SEQ ID NO: 429873 - protein, 8 aa, Mycobacterium
APGTGLRD

SEQ ID NO: 429874 - protein, 7 aa, Mycobacterium
APGTIRT

SEQ ID NO: 429875 - protein, 8 aa, Mycobacterium
APGTKPRW

SEQ ID NO: 429876 - protein, 5 aa, Mycobacterium
APGTL

SEQ ID NO: 429877 - protein, 5 aa, Mycobacterium
APGTM

SEQ ID NO: 429878 - protein, 11 aa, Mycobacterium
APGTNPDDLQD

SEQ ID NO: 429879 - protein, 7 aa, Mycobacterium
APGTPDA

SEQ ID NO: 429880 - protein, 8 aa, Mycobacterium
APGTPGAR

SEQ ID NO: 429881 - protein, 20 aa, Mycobacterium
APGTPGSRSLDIGRVLPVWR

SEQ ID NO: 429882 - protein, 8 aa, Mycobacterium
APGTPLRD

SEQ ID NO: 429883 - protein, 7 aa, Mycobacterium
APGTPPV

SEQ ID NO: 429884 - protein, 11 aa, Mycobacterium
APGTPSDAPKD

SEQ ID NO: 429885 - protein, 13 aa, Mycobacterium
APGTQGQGNQCAP

SEQ ID NO: 429886 - protein, 10 aa, Mycobacterium
APGTQGRGYG

SEQ ID NO: 429887 - protein, 8 aa, Mycobacterium
APGTQITA

SEQ ID NO: 429888 - protein, 13 aa, Mycobacterium
APGTQPPESVRSS

SEQ ID NO: 429889 - protein, 15 aa, Mycobacterium
APGTTATTLTATTTH

SEQ ID NO: 429890 - protein, 5 aa, Mycobacterium
APGTV

SEQ ID NO: 429891 - protein, 8 aa, Mycobacterium
APGTVEPT

SEQ ID NO: 429892 - protein, 8 aa, Mycobacterium
APGTVPGY

SEQ ID NO: 429893 - protein, 4 aa, Mycobacterium
APGV

SEQ ID NO: 429894 - protein, 5 aa, Mycobacterium
APGVA

SEQ ID NO: 429895 - protein, 5 aa, Mycobacterium
APGVD

SEQ ID NO: 429896 - protein, 10 aa, Mycobacterium
APGVDPDPAE

SEQ ID NO: 429897 - protein, 8 aa, Mycobacterium
APGVESQI

SEQ ID NO: 429898 - protein, 13 aa, Mycobacterium
APGVGNSTINPTS

SEQ ID NO: 429899 - protein, 11 aa, Mycobacterium
APGVGQPGGSI

SEQ ID NO: 429900 - protein, 6 aa, Mycobacterium
APGVPD

SEQ ID NO: 429901 - protein, 7 aa, Mycobacterium
APGVQSA

SEQ ID NO: 429902 - protein, 15 aa, Mycobacterium
APGVQTDGPAPDLAE

SEQ ID NO: 429903 - protein, 6 aa, Mycobacterium
APGVRG

SEQ ID NO: 429904 - protein, 12 aa, Mycobacterium
APGVRTDPDQAA

SEQ ID NO: 429905 - protein, 6 aa, Mycobacterium
APGVSV

SEQ ID NO: 429906 - protein, 5 aa, Mycobacterium
APGVT

SEQ ID NO: 429907 - protein, 24 aa, Mycobacterium
APGVTETAASATYVDADPERDGRA

SEQ ID NO: 429908 - protein, 23 aa, Mycobacterium
APGVTETAASRTYVDEDPERDRQ

SEQ ID NO: 429909 - protein, 8 aa, Mycobacterium
APGVTETP

SEQ ID NO: 429910 - protein, 11 aa, Mycobacterium
APGVTGTQHPR

SEQ ID NO: 429911 - protein, 4 aa, Mycobacterium
APGW

SEQ ID NO: 429912 - protein, 7 aa, Mycobacterium
APGWPRE

SEQ ID NO: 429913 - protein, 4 aa, Mycobacterium
APGY

SEQ ID NO: 429914 - protein, 7 aa, Mycobacterium
APGYADY

SEQ ID NO: 429915 - protein, 5 aa, Mycobacterium
APGYG

SEQ ID NO: 429916 - protein, 14 aa, Mycobacterium
APGYRAAARRAAAS

SEQ ID NO: 429917 - protein, 6 aa, Mycobacterium
APGYSQ

SEQ ID NO: 429918 - protein, 5 aa, Mycobacterium
APHAA

SEQ ID NO: 429919 - protein, 6 aa, Mycobacterium
APHAKR

SEQ ID NO: 429920 - protein, 8 aa, Mycobacterium
APHAQGGA

SEQ ID NO: 429921 - protein, 5 aa, Mycobacterium
APHAR

SEQ ID NO: 429922 - protein, 12 aa, Mycobacterium
APHARAGQGGTP

SEQ ID NO: 429923 - protein, 7 aa, Mycobacterium
APHDDVS

SEQ ID NO: 429924 - protein, 7 aa, Mycobacterium
APHDGRR

SEQ ID NO: 429925 - protein, 8 aa, Mycobacterium
APHDGSTI

SEQ ID NO: 429926 - protein, 6 aa, Mycobacterium
APHDGT

SEQ ID NO: 429927 - protein, 6 aa, Mycobacterium
APHDPR

SEQ ID NO: 429928 - protein, 4 aa, Mycobacterium
APHE

SEQ ID NO: 429929 - protein, 5 aa, Mycobacterium
APHEN

SEQ ID NO: 429930 - protein, 6 aa, Mycobacterium
APHESF

SEQ ID NO: 429931 - protein, 13 aa, Mycobacterium
APHGAGRRFSRTK

SEQ ID NO: 429932 - protein, 16 aa, Mycobacterium
APHGDFGGSARPAATG

SEQ ID NO: 429933 - protein, 8 aa, Mycobacterium
APHGGAPG

SEQ ID NO: 429934 - protein, 8 aa, Mycobacterium
APHGGQAQ

SEQ ID NO: 429935 - protein, 16 aa, Mycobacterium
APHGGWKGSGLGSRFG

SEQ ID NO: 429936 - protein, 6 aa, Mycobacterium
APHGKT

SEQ ID NO: 429937 - protein, 10 aa, Mycobacterium
APHGKTTMSP

SEQ ID NO: 429938 - protein, 11 aa, Mycobacterium
APHGPAEAQGG

SEQ ID NO: 429939 - protein, 9 aa, Mycobacterium
APHGSAVRE

SEQ ID NO: 429940 - protein, 5 aa, Mycobacterium
APHGT

SEQ ID NO: 429941 - protein, 4 aa, Mycobacterium
APHH

SEQ ID NO: 429942 - protein, 5 aa, Mycobacterium
APHHT

SEQ ID NO: 429943 - protein, 7 aa, Mycobacterium
APHIESE

SEQ ID NO: 429944 - protein, 4 aa, Mycobacterium
APHK

SEQ ID NO: 429945 - protein, 5 aa, Mycobacterium
APHNA

SEQ ID NO: 429946 - protein, 5 aa, Mycobacterium
APHPA

SEQ ID NO: 429947 - protein, 18 aa, Mycobacterium
APHPASAVPGPSGEEERE

SEQ ID NO: 429948 - protein, 7 aa, Mycobacterium
APHPEGG

SEQ ID NO: 429949 - protein, 20 aa, Mycobacterium
APHPEGHDGGFEISPESSYR

SEQ ID NO: 429950 - protein, 12 aa, Mycobacterium
APHPGTADGGLE

SEQ ID NO: 429951 - protein, 16 aa, Mycobacterium
APHPGWYDTESGDLVD

SEQ ID NO: 429952 - protein, 7 aa, Mycobacterium
APHPIDG

SEQ ID NO: 429953 - protein, 6 aa, Mycobacterium
APHPPQ

SEQ ID NO: 429954 - protein, 9 aa, Mycobacterium
APHPQGGGS

SEQ ID NO: 429955 - protein, 5 aa, Mycobacterium
APHPV

SEQ ID NO: 429956 - protein, 7 aa, Mycobacterium
APHPVDG

SEQ ID NO: 429957 - protein, 7 aa, Mycobacterium
APHPVSG

SEQ ID NO: 429958 - protein, 4 aa, Mycobacterium
APHQ

SEQ ID NO: 429959 - protein, 15 aa, Mycobacterium
APHQNVERGAPTLLP

SEQ ID NO: 429960 - protein, 9 aa, Mycobacterium
APHQPSPYR

SEQ ID NO: 429961 - protein, 5 aa, Mycobacterium
APHQQ

SEQ ID NO: 429962 - protein, 4 aa, Mycobacterium
APHR

SEQ ID NO: 429963 - protein, 9 aa, Mycobacterium
APHRDRESL

SEQ ID NO: 429964 - protein, 13 aa, Mycobacterium
APHRHAAGEYAAR

SEQ ID NO: 429965 - protein, 19 aa, Mycobacterium
APHRHATGEYAQRRASCER

SEQ ID NO: 429966 - protein, 12 aa, Mycobacterium
APHRPTMSTALH

SEQ ID NO: 429967 - protein, 6 aa, Mycobacterium
APHSGL

SEQ ID NO: 429968 - protein, 10 aa, Mycobacterium
APHSPERGRL

SEQ ID NO: 429969 - protein, 10 aa, Mycobacterium
APHSPERSRL

SEQ ID NO: 429970 - protein, 5 aa, Mycobacterium
APHSQ

SEQ ID NO: 429971 - protein, 8 aa, Mycobacterium
APHSRTPI

SEQ ID NO: 429972 - protein, 14 aa, Mycobacterium
APHSSRRPALNNDA

SEQ ID NO: 429973 - protein, 5 aa, Mycobacterium
APHSV

SEQ ID NO: 429974 - protein, 13 aa, Mycobacterium
APHTAAGSATVPS

SEQ ID NO: 429975 - protein, 9 aa, Mycobacterium
APHTASPAG

SEQ ID NO: 429976 - protein, 6 aa, Mycobacterium
APHTCG

SEQ ID NO: 429977 - protein, 14 aa, Mycobacterium
APHTGPAPGFAEQT

SEQ ID NO: 429978 - protein, 14 aa, Mycobacterium
APHYGGSTARSGGG

SEQ ID NO: 429979 - protein, 4 aa, Mycobacterium
APIA

SEQ ID NO: 429980 - protein, 11 aa, Mycobacterium
APIAADSRGGM

SEQ ID NO: 429981 - protein, 6 aa, Mycobacterium
APIATE

SEQ ID NO: 429982 - protein, 6 aa, Mycobacterium
APIATQ

SEQ ID NO: 429983 - protein, 7 aa, Mycobacterium
APIDDAA

SEQ ID NO: 429984 - protein, 6 aa, Mycobacterium
APIDEA

SEQ ID NO: 429985 - protein, 6 aa, Mycobacterium
APIDKT

SEQ ID NO: 429986 - protein, 10 aa, Mycobacterium
APIDKTRASF

SEQ ID NO: 429987 - protein, 5 aa, Mycobacterium
APIDP

SEQ ID NO: 429988 - protein, 8 aa, Mycobacterium
APIDPKSY

SEQ ID NO: 429989 - protein, 6 aa, Mycobacterium
APIDSP

SEQ ID NO: 429990 - protein, 7 aa, Mycobacterium
APIDSPL

SEQ ID NO: 429991 - protein, 5 aa, Mycobacterium
APIEG

SEQ ID NO: 429992 - protein, 13 aa, Mycobacterium
APIEGTSNFGVFR

SEQ ID NO: 429993 - protein, 6 aa, Mycobacterium
APIGGV

SEQ ID NO: 429994 - protein, 6 aa, Mycobacterium
APIGRT

SEQ ID NO: 429995 - protein, 22 aa, Mycobacterium
APINARAKAGLSQLARTATDRS

SEQ ID NO: 429996 - protein, 22 aa, Mycobacterium
APINTAAKAGLSELAKIATNRS

SEQ ID NO: 429997 - protein, 4 aa, Mycobacterium
APIP

SEQ ID NO: 429998 - protein, 22 aa, Mycobacterium
APIPAAPAVSGPAVAAGPLPAY

SEQ ID NO: 429999 - protein, 52 aa, Mycobacterium
APIPAQPTIPLGPPPPDSPERGPGMPYDQAQQQVADAGRTDSAKPSFDPSQY

SEQ ID NO: 430000 - protein, 12 aa, Mycobacterium
APIPDGVDARTA

SEQ ID NO: 430001 - protein, 7 aa, Mycobacterium
APIPEPG

SEQ ID NO: 430002 - protein, 11 aa, Mycobacterium
APIPGGDQRKN

SEQ ID NO: 430003 - protein, 8 aa, Mycobacterium
APIPGNRK

SEQ ID NO: 430004 - protein, 9 aa, Mycobacterium
APIPRPPSI

SEQ ID NO: 430005 - protein, 4 aa, Mycobacterium
APIQ

SEQ ID NO: 430006 - protein, 7 aa, Mycobacterium
APIQGKR

SEQ ID NO: 430007 - protein, 8 aa, Mycobacterium
APIQGSAA

SEQ ID NO: 430008 - protein, 13 aa, Mycobacterium
APIRAAGESALQR

SEQ ID NO: 430009 - protein, 8 aa, Mycobacterium
APIRDPRT

SEQ ID NO: 430010 - protein, 35 aa, Mycobacterium
APIRGRNAGDAAGKEPAVGGDSFGPGERGAAAHTP

SEQ ID NO: 430011 - protein, 16 aa, Mycobacterium
APIRRGPSAPSPATVT

SEQ ID NO: 430012 - protein, 6 aa, Mycobacterium
APISAA

SEQ ID NO: 430013 - protein, 22 aa, Mycobacterium
APISAAAKAGLSELARMATDRS

SEQ ID NO: 430014 - protein, 6 aa, Mycobacterium
APISDG

SEQ ID NO: 430015 - protein, 5 aa, Mycobacterium
APISG

SEQ ID NO: 430016 - protein, 10 aa, Mycobacterium
APISPDAPLR

SEQ ID NO: 430017 - protein, 12 aa, Mycobacterium
APISSGYSGTKA

SEQ ID NO: 430018 - protein, 7 aa, Mycobacterium
APITDGD

SEQ ID NO: 430019 - protein, 8 aa, Mycobacterium
APITEDSD

SEQ ID NO: 430020 - protein, 6 aa, Mycobacterium
APITGA

SEQ ID NO: 430021 - protein, 13 aa, Mycobacterium
APIYGDGETAPQF

SEQ ID NO: 430022 - protein, 4 aa, Mycobacterium
APKA

SEQ ID NO: 430023 - protein, 9 aa, Mycobacterium
APKAAPPWD

SEQ ID NO: 430024 - protein, 6 aa, Mycobacterium
APKAAT

SEQ ID NO: 430025 - protein, 8 aa, Mycobacterium
APKAAVSR

SEQ ID NO: 430026 - protein, 7 aa, Mycobacterium
APKAEVS

SEQ ID NO: 430027 - protein, 6 aa, Mycobacterium
APKARA

SEQ ID NO: 430028 - protein, 8 aa, Mycobacterium
APKARADG

SEQ ID NO: 430029 - protein, 5 aa, Mycobacterium
APKAS

SEQ ID NO: 430030 - protein, 8 aa, Mycobacterium
APKAYGAS

SEQ ID NO: 430031 - protein, 6 aa, Mycobacterium
APKDLQ

SEQ ID NO: 430032 - protein, 8 aa, Mycobacterium
APKDTGLA

SEQ ID NO: 430033 - protein, 8 aa, Mycobacterium
APKEEGSV

SEQ ID NO: 430034 - protein, 8 aa, Mycobacterium
APKETGLR

SEQ ID NO: 430035 - protein, 8 aa, Mycobacterium
APKEYEKA

SEQ ID NO: 430036 - protein, 11 aa, Mycobacterium
APKFAESQNLP

SEQ ID NO: 430037 - protein, 12 aa, Mycobacterium
APKFAESQTLPD

SEQ ID NO: 430038 - protein, 7 aa, Mycobacterium
APKFPPS

SEQ ID NO: 430039 - protein, 4 aa, Mycobacterium
APKG

SEQ ID NO: 430040 - protein, 8 aa, Mycobacterium
APKGALGH

SEQ ID NO: 430041 - protein, 5 aa, Mycobacterium
APKGD

SEQ ID NO: 430042 - protein, 6 aa, Mycobacterium
APKGDA

SEQ ID NO: 430043 - protein, 10 aa, Mycobacterium
APKGSGTDVT

SEQ ID NO: 430044 - protein, 13 aa, Mycobacterium
APKGVPDYLPPDS

SEQ ID NO: 430045 - protein, 12 aa, Mycobacterium
APKGVRSSSRYR

SEQ ID NO: 430046 - protein, 8 aa, Mycobacterium
APKHRRRA

SEQ ID NO: 430047 - protein, 4 aa, Mycobacterium
APKK

SEQ ID NO: 430048 - protein, 10 aa, Mycobacterium
APKLDATQRR

SEQ ID NO: 430049 - protein, 6 aa, Mycobacterium
APKLGA

SEQ ID NO: 430050 - protein, 7 aa, Mycobacterium
APKNPLP

SEQ ID NO: 430051 - protein, 7 aa, Mycobacterium
APKNSPW

SEQ ID NO: 430052 - protein, 8 aa, Mycobacterium
APKNTGLR

SEQ ID NO: 430053 - protein, 6 aa, Mycobacterium
APKNTL

SEQ ID NO: 430054 - protein, 5 aa, Mycobacterium
APKPD

SEQ ID NO: 430055 - protein, 17 aa, Mycobacterium
APKPEFEDRIDSDPGSV

SEQ ID NO: 430056 - protein, 17 aa, Mycobacterium
APKPELEDRIESDPGSV

SEQ ID NO: 430057 - protein, 16 aa, Mycobacterium
APKPGTGPSAATRERG

SEQ ID NO: 430058 - protein, 5 aa, Mycobacterium
APKPM

SEQ ID NO: 430059 - protein, 9 aa, Mycobacterium
APKPRQHVT

SEQ ID NO: 430060 - protein, 5 aa, Mycobacterium
APKRE

SEQ ID NO: 430061 - protein, 9 aa, Mycobacterium
APKRGTANS

SEQ ID NO: 430062 - protein, 11 aa, Mycobacterium
APKRVRRQSRE

SEQ ID NO: 430063 - protein, 5 aa, Mycobacterium
APKRY

SEQ ID NO: 430064 - protein, 6 aa, Mycobacterium
APKRYK

SEQ ID NO: 430065 - protein, 7 aa, Mycobacterium
APKSAGA

SEQ ID NO: 430066 - protein, 10 aa, Mycobacterium
APKSAGAEAY

SEQ ID NO: 430067 - protein, 23 aa, Mycobacterium
APKSDASADTTEETLDAPRPTAV

SEQ ID NO: 430068 - protein, 6 aa, Mycobacterium
APKSLL

SEQ ID NO: 430069 - protein, 9 aa, Mycobacterium
APKSLTPYD

SEQ ID NO: 430070 - protein, 19 aa, Mycobacterium
APKSMVSRTGNQCRDPKGK

SEQ ID NO: 430071 - protein, 8 aa, Mycobacterium
APKSVPLA

SEQ ID NO: 430072 - protein, 4 aa, Mycobacterium
APKT

SEQ ID NO: 430073 - protein, 29 aa, Mycobacterium
APKTEANADAGDPVADTPAPAAVSDANQW

SEQ ID NO: 430074 - protein, 8 aa, Mycobacterium
APKTGIEP

SEQ ID NO: 430075 - protein, 7 aa, Mycobacterium
APKTSVR

SEQ ID NO: 430076 - protein, 4 aa, Mycobacterium
APKY

SEQ ID NO: 430077 - protein, 17 aa, Mycobacterium
APLAAGSGPPGIGSPVD

SEQ ID NO: 430078 - protein, 7 aa, Mycobacterium
APLADAT

SEQ ID NO: 430079 - protein, 227 aa, Mycobacterium
APLAEGEPGGDGGAGGNGGTGGAGGAGGVISGDGGAGGRGGGGGNGGNGAAGANGTNATISGTNGGNAGAGGNGGNGGTGGNGGAGGAATHGSAGANGAGGAGGNGGDGAIAGDGGTGANGDATHFDGGNGGNGANPGIGGLGGAGGTSGDGTTPAAHGTNGTTPTTTNGSGGRGGDGYTSTDPTLNGGKGGTGGNGGDYGNGGAGGNGGNGATGTTGTNPTPHPIT

SEQ ID NO: 430080 - protein, 9 aa, Mycobacterium
APLAGGPTV

SEQ ID NO: 430081 - protein, 6 aa, Mycobacterium
APLANV

SEQ ID NO: 430082 - protein, 12 aa, Mycobacterium
APLAPDDADAFT

SEQ ID NO: 430083 - protein, 11 aa, Mycobacterium
APLAPGQSDVP

SEQ ID NO: 430084 - protein, 10 aa, Mycobacterium
APLAPGSSVV

SEQ ID NO: 430085 - protein, 16 aa, Mycobacterium
APLAPNGRGLPTEGGV

SEQ ID NO: 430086 - protein, 16 aa, Mycobacterium
APLAPTGRGVPADGGV

SEQ ID NO: 430087 - protein, 17 aa, Mycobacterium
APLAPTGRGVPADGGVR

SEQ ID NO: 430088 - protein, 8 aa, Mycobacterium
APLASGSW

SEQ ID NO: 430089 - protein, 14 aa, Mycobacterium
APLAVSATKQSAVE

SEQ ID NO: 430090 - protein, 16 aa, Mycobacterium
APLDAGSGFPPIGSPV

SEQ ID NO: 430091 - protein, 10 aa, Mycobacterium
APLDAPGSGA

SEQ ID NO: 430092 - protein, 11 aa, Mycobacterium
APLDDASRSRL

SEQ ID NO: 430093 - protein, 11 aa, Mycobacterium
APLDEASRGRL

SEQ ID NO: 430094 - protein, 11 aa, Mycobacterium
APLDEASRNRL

SEQ ID NO: 430095 - protein, 7 aa, Mycobacterium
APLDGGA

SEQ ID NO: 430096 - protein, 5 aa, Mycobacterium
APLDH

SEQ ID NO: 430097 - protein, 11 aa, Mycobacterium
APLDKKQDSMK

SEQ ID NO: 430098 - protein, 14 aa, Mycobacterium
APLDPATAEAAERR

SEQ ID NO: 430099 - protein, 6 aa, Mycobacterium
APLDPD

SEQ ID NO: 430100 - protein, 9 aa, Mycobacterium
APLDPERRH

SEQ ID NO: 430101 - protein, 13 aa, Mycobacterium
APLDPIGEPQRTR

SEQ ID NO: 430102 - protein, 6 aa, Mycobacterium
APLDPR

SEQ ID NO: 430103 - protein, 8 aa, Mycobacterium
APLDQPRQ

SEQ ID NO: 430104 - protein, 6 aa, Mycobacterium
APLDRT

SEQ ID NO: 430105 - protein, 6 aa, Mycobacterium
APLDSG

SEQ ID NO: 430106 - protein, 6 aa, Mycobacterium
APLDTQ

SEQ ID NO: 430107 - protein, 6 aa, Mycobacterium
APLEDG

SEQ ID NO: 430108 - protein, 9 aa, Mycobacterium
APLEDGQAD

SEQ ID NO: 430109 - protein, 14 aa, Mycobacterium
APLEPAAAAADAGA

SEQ ID NO: 430110 - protein, 9 aa, Mycobacterium
APLEPGQAD

SEQ ID NO: 430111 - protein, 9 aa, Mycobacterium
APLEPGQED

SEQ ID NO: 430112 - protein, 9 aa, Mycobacterium
APLEPGQKD

SEQ ID NO: 430113 - protein, 9 aa, Mycobacterium
APLEPGQQD

SEQ ID NO: 430114 - protein, 7 aa, Mycobacterium
APLEPTE

SEQ ID NO: 430115 - protein, 8 aa, Mycobacterium
APLEPTEY

SEQ ID NO: 430116 - protein, 12 aa, Mycobacterium
APLEPVSYGVFR

SEQ ID NO: 430117 - protein, 8 aa, Mycobacterium
APLESNAP

SEQ ID NO: 430118 - protein, 22 aa, Mycobacterium
APLGADSSGTPRSVADSVGDID

SEQ ID NO: 430119 - protein, 7 aa, Mycobacterium
APLGDHS

SEQ ID NO: 430120 - protein, 6 aa, Mycobacterium
APLGDP

SEQ ID NO: 430121 - protein, 8 aa, Mycobacterium
APLGEAAR

SEQ ID NO: 430122 - protein, 12 aa, Mycobacterium
APLGGASDERVG

SEQ ID NO: 430123 - protein, 8 aa, Mycobacterium
APLGGSVG

SEQ ID NO: 430124 - protein, 11 aa, Mycobacterium
APLGKKQDSMK

SEQ ID NO: 430125 - protein, 6 aa, Mycobacterium
APLGLG

SEQ ID NO: 430126 - protein, 11 aa, Mycobacterium
APLGNDRDKHA

SEQ ID NO: 430127 - protein, 9 aa, Mycobacterium
APLGNPERL

SEQ ID NO: 430128 - protein, 6 aa, Mycobacterium
APLGRQ

SEQ ID NO: 430129 - protein, 8 aa, Mycobacterium
APLGRTRE

SEQ ID NO: 430130 - protein, 6 aa, Mycobacterium
APLHET

SEQ ID NO: 430131 - protein, 6 aa, Mycobacterium
APLHPA

SEQ ID NO: 430132 - protein, 12 aa, Mycobacterium
APLHPPSTATTV

SEQ ID NO: 430133 - protein, 8 aa, Mycobacterium
APLKAGSN

SEQ ID NO: 430134 - protein, 6 aa, Mycobacterium
APLKGL

SEQ ID NO: 430135 - protein, 5 aa, Mycobacterium
APLKV

SEQ ID NO: 430136 - protein, 5 aa, Mycobacterium
APLNT

SEQ ID NO: 430137 - protein, 7 aa, Mycobacterium
APLNTPD

SEQ ID NO: 430138 - protein, 8 aa, Mycobacterium
APLPAEGE

SEQ ID NO: 430139 - protein, 14 aa, Mycobacterium
APLPAQQGPARAPS

SEQ ID NO: 430140 - protein, 35 aa, Mycobacterium
APLPDASRSVSCSSPRPSATRSPSTLRPASAGSAP

SEQ ID NO: 430141 - protein, 13 aa, Mycobacterium
APLPDGVSQATIG

SEQ ID NO: 430142 - protein, 9 aa, Mycobacterium
APLPDQRGG

SEQ ID NO: 430143 - protein, 6 aa, Mycobacterium
APLPEE

SEQ ID NO: 430144 - protein, 11 aa, Mycobacterium
APLPELPQRPI

SEQ ID NO: 430145 - protein, 45 aa, Mycobacterium
APLPEPLPEPLPKPPPEPRPGARGGQPATGEGGGAGTPANQRPPC

SEQ ID NO: 430146 - protein, 11 aa, Mycobacterium
APLPGHGELTD

SEQ ID NO: 430147 - protein, 15 aa, Mycobacterium
APLPGPRSEARNRNL

SEQ ID NO: 430148 - protein, 5 aa, Mycobacterium
APLPL

SEQ ID NO: 430149 - protein, 7 aa, Mycobacterium
APLPPGY

SEQ ID NO: 430150 - protein, 7 aa, Mycobacterium
APLPPLP

SEQ ID NO: 430151 - protein, 15 aa, Mycobacterium
APLPPPDELAQATPW

SEQ ID NO: 430152 - protein, 9 aa, Mycobacterium
APLPPQGKS

SEQ ID NO: 430153 - protein, 11 aa, Mycobacterium
APLPPSGSARA

SEQ ID NO: 430154 - protein, 49 aa, Mycobacterium
APLPQGAAPSGAATAPALPSMPSLGDGSGAATPSGAGSVPNLPAGPALS

SEQ ID NO: 430155 - protein, 6 aa, Mycobacterium
APLPRG

SEQ ID NO: 430156 - protein, 15 aa, Mycobacterium
APLPRPRAEAHDRNL

SEQ ID NO: 430157 - protein, 8 aa, Mycobacterium
APLPSFTP

SEQ ID NO: 430158 - protein, 5 aa, Mycobacterium
APLPT

SEQ ID NO: 430159 - protein, 7 aa, Mycobacterium
APLPTGA

SEQ ID NO: 430160 - protein, 7 aa, Mycobacterium
APLPTGR

SEQ ID NO: 430161 - protein, 8 aa, Mycobacterium
APLPTPTT

SEQ ID NO: 430162 - protein, 8 aa, Mycobacterium
APLQGADE

SEQ ID NO: 430163 - protein, 5 aa, Mycobacterium
APLQP

SEQ ID NO: 430164 - protein, 8 aa, Mycobacterium
APLQPDEY

SEQ ID NO: 430165 - protein, 5 aa, Mycobacterium
APLQQ

SEQ ID NO: 430166 - protein, 4 aa, Mycobacterium
APLR

SEQ ID NO: 430167 - protein, 5 aa, Mycobacterium
APLRE

SEQ ID NO: 430168 - protein, 7 aa, Mycobacterium
APLRPID

SEQ ID NO: 430169 - protein, 6 aa, Mycobacterium
APLRPL

SEQ ID NO: 430170 - protein, 16 aa, Mycobacterium
APLRRRGDARARAAAL

SEQ ID NO: 430171 - protein, 6 aa, Mycobacterium
APLRTQ

SEQ ID NO: 430172 - protein, 14 aa, Mycobacterium
APLSAGSEGHGVPI

SEQ ID NO: 430173 - protein, 6 aa, Mycobacterium
APLSDD

SEQ ID NO: 430174 - protein, 8 aa, Mycobacterium
APLSDPST

SEQ ID NO: 430175 - protein, 5 aa, Mycobacterium
APLSE

SEQ ID NO: 430176 - protein, 6 aa, Mycobacterium
APLSEE

SEQ ID NO: 430177 - protein, 6 aa, Mycobacterium
APLSEP

SEQ ID NO: 430178 - protein, 8 aa, Mycobacterium
APLSETGR

SEQ ID NO: 430179 - protein, 9 aa, Mycobacterium
APLSPESRA

SEQ ID NO: 430180 - protein, 12 aa, Mycobacterium
APLSSRAAAENL

SEQ ID NO: 430181 - protein, 8 aa, Mycobacterium
APLSTPEN

SEQ ID NO: 430182 - protein, 16 aa, Mycobacterium
APLTAGAGAPIGSPVS

SEQ ID NO: 430183 - protein, 5 aa, Mycobacterium
APLTE

SEQ ID NO: 430184 - protein, 6 aa, Mycobacterium
APLTEE

SEQ ID NO: 430185 - protein, 7 aa, Mycobacterium
APLTETA

SEQ ID NO: 430186 - protein, 17 aa, Mycobacterium
APLTGDSGAPPIGSPVP

SEQ ID NO: 430187 - protein, 8 aa, Mycobacterium
APLTPETA

SEQ ID NO: 430188 - protein, 17 aa, Mycobacterium
APLTPGPEAPPIGSPVS

SEQ ID NO: 430189 - protein, 8 aa, Mycobacterium
APLTPGSG

SEQ ID NO: 430190 - protein, 29 aa, Mycobacterium
APLTQPPPAPANDTGLGYKPASREQPFGQ

SEQ ID NO: 430191 - protein, 5 aa, Mycobacterium
APLTS

SEQ ID NO: 430192 - protein, 11 aa, Mycobacterium
APLTSGANAVK

SEQ ID NO: 430193 - protein, 5 aa, Mycobacterium
APLTT

SEQ ID NO: 430194 - protein, 14 aa, Mycobacterium
APLVPGTPDPVKNA

SEQ ID NO: 430195 - protein, 4 aa, Mycobacterium
APLY

SEQ ID NO: 430196 - protein, 5 aa, Mycobacterium
APLYR

SEQ ID NO: 430197 - protein, 5 aa, Mycobacterium
APMDQ

SEQ ID NO: 430198 - protein, 4 aa, Mycobacterium
APMG

SEQ ID NO: 430199 - protein, 6 aa, Mycobacterium
APMGAA

SEQ ID NO: 430200 - protein, 11 aa, Mycobacterium
APMGAATDPRA

SEQ ID NO: 430201 - protein, 13 aa, Mycobacterium
APMGTDSSGTPRL

SEQ ID NO: 430202 - protein, 4 aa, Mycobacterium
APMP

SEQ ID NO: 430203 - protein, 6 aa, Mycobacterium
APMPDQ

SEQ ID NO: 430204 - protein, 5 aa, Mycobacterium
APMPE

SEQ ID NO: 430205 - protein, 6 aa, Mycobacterium
APMPNS

SEQ ID NO: 430206 - protein, 13 aa, Mycobacterium
APMPTAESAPVPS

SEQ ID NO: 430207 - protein, 21 aa, Mycobacterium
APMPYDRATQERRAKRAEREL

SEQ ID NO: 430208 - protein, 10 aa, Mycobacterium
APMQSGADGW

SEQ ID NO: 430209 - protein, 4 aa, Mycobacterium
APMR

SEQ ID NO: 430210 - protein, 5 aa, Mycobacterium
APMRP

SEQ ID NO: 430211 - protein, 6 aa, Mycobacterium
APMRPD

SEQ ID NO: 430212 - protein, 14 aa, Mycobacterium
APMRPDADLTEQGV

SEQ ID NO: 430213 - protein, 12 aa, Mycobacterium
APMRRGRHKNIP

SEQ ID NO: 430214 - protein, 4 aa, Mycobacterium
APMS

SEQ ID NO: 430215 - protein, 27 aa, Mycobacterium
APMSATSSSSGAAAAPIPVSQARAERD

SEQ ID NO: 430216 - protein, 8 aa, Mycobacterium
APNAAVSR

SEQ ID NO: 430217 - protein, 8 aa, Mycobacterium
APNADSGC

SEQ ID NO: 430218 - protein, 6 aa, Mycobacterium
APNALG

SEQ ID NO: 430219 - protein, 18 aa, Mycobacterium
APNALTSTDWRDPYAGTP

SEQ ID NO: 430220 - protein, 18 aa, Mycobacterium
APNALTSTGWRDPYAGTP

SEQ ID NO: 430221 - protein, 11 aa, Mycobacterium
APNAPADARLP

SEQ ID NO: 430222 - protein, 11 aa, Mycobacterium
APNAPDRAHEP

SEQ ID NO: 430223 - protein, 8 aa, Mycobacterium
APNAPGSI

SEQ ID NO: 430224 - protein, 13 aa, Mycobacterium
APNATIGHSQGEI

SEQ ID NO: 430225 - protein, 5 aa, Mycobacterium
APNDG

SEQ ID NO: 430226 - protein, 8 aa, Mycobacterium
APNDGPIE

SEQ ID NO: 430227 - protein, 6 aa, Mycobacterium
APNDPA

SEQ ID NO: 430228 - protein, 17 aa, Mycobacterium
APNDPAEPDYSLNPPPV

SEQ ID NO: 430229 - protein, 9 aa, Mycobacterium
APNDRARRS

SEQ ID NO: 430230 - protein, 12 aa, Mycobacterium
APNDRITPEEGA

SEQ ID NO: 430231 - protein, 6 aa, Mycobacterium
APNDVD

SEQ ID NO: 430232 - protein, 7 aa, Mycobacterium
APNEQGV

SEQ ID NO: 430233 - protein, 18 aa, Mycobacterium
APNETGIIPTSGVSVGKT

SEQ ID NO: 430234 - protein, 7 aa, Mycobacterium
APNGAFG

SEQ ID NO: 430235 - protein, 9 aa, Mycobacterium
APNGDDVNA

SEQ ID NO: 430236 - protein, 6 aa, Mycobacterium
APNGFD

SEQ ID NO: 430237 - protein, 6 aa, Mycobacterium
APNGFS

SEQ ID NO: 430238 - protein, 7 aa, Mycobacterium
APNGGAQ

SEQ ID NO: 430239 - protein, 6 aa, Mycobacterium
APNGGK

SEQ ID NO: 430240 - protein, 8 aa, Mycobacterium
APNGHEQT

SEQ ID NO: 430241 - protein, 8 aa, Mycobacterium
APNGPGNM

SEQ ID NO: 430242 - protein, 8 aa, Mycobacterium
APNGPGNV

SEQ ID NO: 430243 - protein, 7 aa, Mycobacterium
APNGRGL

SEQ ID NO: 430244 - protein, 7 aa, Mycobacterium
APNGSGI

SEQ ID NO: 430245 - protein, 8 aa, Mycobacterium
APNGSGNV

SEQ ID NO: 430246 - protein, 18 aa, Mycobacterium
APNGTQGMGGHRNGANGD

SEQ ID NO: 430247 - protein, 13 aa, Mycobacterium
APNHESWERDGQW

SEQ ID NO: 430248 - protein, 21 aa, Mycobacterium
APNHTQSGKALATVGDSRSVT

SEQ ID NO: 430249 - protein, 4 aa, Mycobacterium
APNI

SEQ ID NO: 430250 - protein, 7 aa, Mycobacterium
APNINNP

SEQ ID NO: 430251 - protein, 5 aa, Mycobacterium
APNLA

SEQ ID NO: 430252 - protein, 7 aa, Mycobacterium
APNLERG

SEQ ID NO: 430253 - protein, 6 aa, Mycobacterium
APNLQN

SEQ ID NO: 430254 - protein, 18 aa, Mycobacterium
APNLRPQDDFATAREGRD

SEQ ID NO: 430255 - protein, 4 aa, Mycobacterium
APNM

SEQ ID NO: 430256 - protein, 19 aa, Mycobacterium
APNMASPDTAVSTEVPADA

SEQ ID NO: 430257 - protein, 7 aa, Mycobacterium
APNNGFR

SEQ ID NO: 430258 - protein, 4 aa, Mycobacterium
APNP

SEQ ID NO: 430259 - protein, 6 aa, Mycobacterium
APNPAA

SEQ ID NO: 430260 - protein, 8 aa, Mycobacterium
APNPAAQQ

SEQ ID NO: 430261 - protein, 13 aa, Mycobacterium
APNPADEPPERDE

SEQ ID NO: 430262 - protein, 6 aa, Mycobacterium
APNPAW

SEQ ID NO: 430263 - protein, 7 aa, Mycobacterium
APNPDAS

SEQ ID NO: 430264 - protein, 7 aa, Mycobacterium
APNPGHQ

SEQ ID NO: 430265 - protein, 18 aa, Mycobacterium
APNPHATAEEVEAARHDS

SEQ ID NO: 430266 - protein, 11 aa, Mycobacterium
APNPPQDPLAN

SEQ ID NO: 430267 - protein, 7 aa, Mycobacterium
APNPQDL

SEQ ID NO: 430268 - protein, 6 aa, Mycobacterium
APNPRA

SEQ ID NO: 430269 - protein, 6 aa, Mycobacterium
APNPRW

SEQ ID NO: 430270 - protein, 9 aa, Mycobacterium
APNPTDQAS

SEQ ID NO: 430271 - protein, 7 aa, Mycobacterium
APNPTSL

SEQ ID NO: 430272 - protein, 21 aa, Mycobacterium
APNPVVSTTTADDVDATAAGA

SEQ ID NO: 430273 - protein, 12 aa, Mycobacterium
APNREELARTGE

SEQ ID NO: 430274 - protein, 9 aa, Mycobacterium
APNRGKRSV

SEQ ID NO: 430275 - protein, 10 aa, Mycobacterium
APNRRQRKSC

SEQ ID NO: 430276 - protein, 4 aa, Mycobacterium
APNS

SEQ ID NO: 430277 - protein, 5 aa, Mycobacterium
APNSA

SEQ ID NO: 430278 - protein, 6 aa, Mycobacterium
APNSPV

SEQ ID NO: 430279 - protein, 5 aa, Mycobacterium
APNSV

SEQ ID NO: 430280 - protein, 9 aa, Mycobacterium
APNTETGLA

SEQ ID NO: 430281 - protein, 10 aa, Mycobacterium
APNTETGPLP

SEQ ID NO: 430282 - protein, 13 aa, Mycobacterium
APNTGNAIRTAAA

SEQ ID NO: 430283 - protein, 14 aa, Mycobacterium
APNTGNAIRTAAAT

SEQ ID NO: 430284 - protein, 8 aa, Mycobacterium
APNTGSLR

SEQ ID NO: 430285 - protein, 10 aa, Mycobacterium
APNTPERDRL

SEQ ID NO: 430286 - protein, 8 aa, Mycobacterium
APNTSRDN

SEQ ID NO: 430287 - protein, 6 aa, Mycobacterium
APNTTT

SEQ ID NO: 430288 - protein, 5 aa, Mycobacterium
APNTV

SEQ ID NO: 430289 - protein, 4 aa, Mycobacterium
APNV

SEQ ID NO: 430290 - protein, 8 aa, Mycobacterium
APNVDKPA

SEQ ID NO: 430291 - protein, 14 aa, Mycobacterium
APNWPQPAHEGGTY

SEQ ID NO: 430292 - protein, 8 aa, Mycobacterium
APPAAAAQ

SEQ ID NO: 430293 - protein, 12 aa, Mycobacterium
APPAAAPPQGRL

SEQ ID NO: 430294 - protein, 13 aa, Mycobacterium
APPAAAPTLTGGA

SEQ ID NO: 430295 - protein, 6 aa, Mycobacterium
APPAAK

SEQ ID NO: 430296 - protein, 6 aa, Mycobacterium
APPAAL

SEQ ID NO: 430297 - protein, 16 aa, Mycobacterium
APPAAPSGGDRAGDEA

SEQ ID NO: 430298 - protein, 9 aa, Mycobacterium
APPAATDPV

SEQ ID NO: 430299 - protein, 22 aa, Mycobacterium
APPADDPRLAPGYAATGDPQID

SEQ ID NO: 430300 - protein, 8 aa, Mycobacterium
APPADRTE

SEQ ID NO: 430301 - protein, 5 aa, Mycobacterium
APPAF

SEQ ID NO: 430302 - protein, 15 aa, Mycobacterium
APPAGAAGLGQPGLF

SEQ ID NO: 430303 - protein, 8 aa, Mycobacterium
APPAGHGP

SEQ ID NO: 430304 - protein, 9 aa, Mycobacterium
APPAGKSLD

SEQ ID NO: 430305 - protein, 9 aa, Mycobacterium
APPAGPAAD

SEQ ID NO: 430306 - protein, 9 aa, Mycobacterium
APPAGPGAD

SEQ ID NO: 430307 - protein, 10 aa, Mycobacterium
APPAGPSSPR

SEQ ID NO: 430308 - protein, 13 aa, Mycobacterium
APPAGSAPLPEPP

SEQ ID NO: 430309 - protein, 8 aa, Mycobacterium
APPAGYDD

SEQ ID NO: 430310 - protein, 7 aa, Mycobacterium
APPAGYR

SEQ ID NO: 430311 - protein, 5 aa, Mycobacterium
APPAI

SEQ ID NO: 430312 - protein, 5 aa, Mycobacterium
APPAL

SEQ ID NO: 430313 - protein, 6 aa, Mycobacterium
APPALV

SEQ ID NO: 430314 - protein, 12 aa, Mycobacterium
APPANAPTPAER

SEQ ID NO: 430315 - protein, 13 aa, Mycobacterium
APPANAPTPAERD

SEQ ID NO: 430316 - protein, 13 aa, Mycobacterium
APPANAPTPAERK

SEQ ID NO: 430317 - protein, 11 aa, Mycobacterium
APPANAPTPLE

SEQ ID NO: 430318 - protein, 16 aa, Mycobacterium
APPAPIAATGGDPVSA

SEQ ID NO: 430319 - protein, 13 aa, Mycobacterium
APPAPPGARGVES

SEQ ID NO: 430320 - protein, 7 aa, Mycobacterium
APPAPRV

SEQ ID NO: 430321 - protein, 20 aa, Mycobacterium
APPAPTASGPLAPDAEPAQP

SEQ ID NO: 430322 - protein, 11 aa, Mycobacterium
APPAQAGPRGV

SEQ ID NO: 430323 - protein, 6 aa, Mycobacterium
APPAQH

SEQ ID NO: 430324 - protein, 6 aa, Mycobacterium
APPARA

SEQ ID NO: 430325 - protein, 9 aa, Mycobacterium
APPARQGEK

SEQ ID NO: 430326 - protein, 7 aa, Mycobacterium
APPARSA

SEQ ID NO: 430327 - protein, 16 aa, Mycobacterium
APPASGLYTSGPALQP

SEQ ID NO: 430328 - protein, 9 aa, Mycobacterium
APPASPGLR

SEQ ID NO: 430329 - protein, 109 aa, Mycobacterium
APPATAAPADSAATAARAPTTPPRSAPAPKAPPEAPAAQAAKVEPAAQPEPAPAVPKAPAAKAAPAEPEAKAAPEAPAPTAPTQPSSAKPAAKAAPEEPAERPVKAAPD

SEQ ID NO: 430330 - protein, 19 aa, Mycobacterium
APPAVAQQTADAEPELSDE

SEQ ID NO: 430331 - protein, 7 aa, Mycobacterium
APPDAEA

SEQ ID NO: 430332 - protein, 14 aa, Mycobacterium
APPDAQGNYPKPGY

SEQ ID NO: 430333 - protein, 6 aa, Mycobacterium
APPDDA

SEQ ID NO: 430334 - protein, 9 aa, Mycobacterium
APPDDDADD

SEQ ID NO: 430335 - protein, 52 aa, Mycobacterium
APPDDPEPPNQTRTTATEPVEDQAIDDPETDAPPPLDDPGEPGGPAPPDNRA

SEQ ID NO: 430336 - protein, 6 aa, Mycobacterium
APPDDW

SEQ ID NO: 430337 - protein, 5 aa, Mycobacterium
APPDE

SEQ ID NO: 430338 - protein, 7 aa, Mycobacterium
APPDEPD

SEQ ID NO: 430339 - protein, 6 aa, Mycobacterium
APPDFR

SEQ ID NO: 430340 - protein, 7 aa, Mycobacterium
APPDGAV

SEQ ID NO: 430341 - protein, 21 aa, Mycobacterium
APPDGGAPVSNSASFLIVARG

SEQ ID NO: 430342 - protein, 8 aa, Mycobacterium
APPDLGGL

SEQ ID NO: 430343 - protein, 6 aa, Mycobacterium
APPDLR

SEQ ID NO: 430344 - protein, 14 aa, Mycobacterium
APPDMGGSAHTSSA

SEQ ID NO: 430345 - protein, 10 aa, Mycobacterium
APPDNGGAGL

SEQ ID NO: 430346 - protein, 8 aa, Mycobacterium
APPDPFGS

SEQ ID NO: 430347 - protein, 17 aa, Mycobacterium
APPDPSRPNLDHPARQL

SEQ ID NO: 430348 - protein, 6 aa, Mycobacterium
APPDSL

SEQ ID NO: 430349 - protein, 11 aa, Mycobacterium
APPDVTEKQYQ

SEQ ID NO: 430350 - protein, 5 aa, Mycobacterium
APPEA

SEQ ID NO: 430351 - protein, 13 aa, Mycobacterium
APPEAGLGRPRPG

SEQ ID NO: 430352 - protein, 5 aa, Mycobacterium
APPED

SEQ ID NO: 430353 - protein, 21 aa, Mycobacterium
APPEDPEPPDQTRSTATEPAA

SEQ ID NO: 430354 - protein, 6 aa, Mycobacterium
APPEFG

SEQ ID NO: 430355 - protein, 6 aa, Mycobacterium
APPELA

SEQ ID NO: 430356 - protein, 6 aa, Mycobacterium
APPELQ

SEQ ID NO: 430357 - protein, 6 aa, Mycobacterium
APPERA

SEQ ID NO: 430358 - protein, 5 aa, Mycobacterium
APPEV

SEQ ID NO: 430359 - protein, 5 aa, Mycobacterium
APPEW

SEQ ID NO: 430360 - protein, 12 aa, Mycobacterium
APPEYGGAGGTL

SEQ ID NO: 430361 - protein, 5 aa, Mycobacterium
APPGA

SEQ ID NO: 430362 - protein, 7 aa, Mycobacterium
APPGAAM

SEQ ID NO: 430363 - protein, 12 aa, Mycobacterium
APPGADDEEQSL

SEQ ID NO: 430364 - protein, 9 aa, Mycobacterium
APPGAPDGF

SEQ ID NO: 430365 - protein, 5 aa, Mycobacterium
APPGE

SEQ ID NO: 430366 - protein, 7 aa, Mycobacterium
APPGGYQ

SEQ ID NO: 430367 - protein, 12 aa, Mycobacterium
APPGHGPARSRQ

SEQ ID NO: 430368 - protein, 6 aa, Mycobacterium
APPGIL

SEQ ID NO: 430369 - protein, 9 aa, Mycobacterium
APPGKIGRR

SEQ ID NO: 430370 - protein, 13 aa, Mycobacterium
APPGLAQTAGTAA

SEQ ID NO: 430371 - protein, 6 aa, Mycobacterium
APPGLL

SEQ ID NO: 430372 - protein, 13 aa, Mycobacterium
APPGNAPEPAERA

SEQ ID NO: 430373 - protein, 5 aa, Mycobacterium
APPGP

SEQ ID NO: 430374 - protein, 8 aa, Mycobacterium
APPGPSDI

SEQ ID NO: 430375 - protein, 10 aa, Mycobacterium
APPGPSTSDI

SEQ ID NO: 430376 - protein, 9 aa, Mycobacterium
APPGQDAAR

SEQ ID NO: 430377 - protein, 9 aa, Mycobacterium
APPGSFDDS

SEQ ID NO: 430378 - protein, 7 aa, Mycobacterium
APPGSFN

SEQ ID NO: 430379 - protein, 8 aa, Mycobacterium
APPGSGEI

SEQ ID NO: 430380 - protein, 9 aa, Mycobacterium
APPGSPAAG

SEQ ID NO: 430381 - protein, 16 aa, Mycobacterium
APPGSVSKTTSGKVQR

SEQ ID NO: 430382 - protein, 7 aa, Mycobacterium
APPGTDV

SEQ ID NO: 430383 - protein, 9 aa, Mycobacterium
APPGTTGAV

SEQ ID NO: 430384 - protein, 14 aa, Mycobacterium
APPGWPSPKGRDEV

SEQ ID NO: 430385 - protein, 6 aa, Mycobacterium
APPGYI

SEQ ID NO: 430386 - protein, 4 aa, Mycobacterium
APPH

SEQ ID NO: 430387 - protein, 8 aa, Mycobacterium
APPHGRST

SEQ ID NO: 430388 - protein, 9 aa, Mycobacterium
APPHSSEPI

SEQ ID NO: 430389 - protein, 11 aa, Mycobacterium
APPHTAVRRGG

SEQ ID NO: 430390 - protein, 7 aa, Mycobacterium
APPIAPR

SEQ ID NO: 430391 - protein, 5 aa, Mycobacterium
APPIE

SEQ ID NO: 430392 - protein, 6 aa, Mycobacterium
APPIPA

SEQ ID NO: 430393 - protein, 8 aa, Mycobacterium
APPIPLGP

SEQ ID NO: 430394 - protein, 18 aa, Mycobacterium
APPIPPRAGVRSAENEAE

SEQ ID NO: 430395 - protein, 8 aa, Mycobacterium
APPKLGRA

SEQ ID NO: 430396 - protein, 11 aa, Mycobacterium
APPKNTGTAAT

SEQ ID NO: 430397 - protein, 11 aa, Mycobacterium
APPKPAAANTK

SEQ ID NO: 430398 - protein, 21 aa, Mycobacterium
APPKPPSPPAPPMPPIPPKPP

SEQ ID NO: 430399 - protein, 8 aa, Mycobacterium
APPKTAAK

SEQ ID NO: 430400 - protein, 10 aa, Mycobacterium
APPKTPEEGY

SEQ ID NO: 430401 - protein, 5 aa, Mycobacterium
APPLA

SEQ ID NO: 430402 - protein, 7 aa, Mycobacterium
APPLADA

SEQ ID NO: 430403 - protein, 5 aa, Mycobacterium
APPLP

SEQ ID NO: 430404 - protein, 12 aa, Mycobacterium
APPLPQRGQRQK

SEQ ID NO: 430405 - protein, 5 aa, Mycobacterium
APPLV

SEQ ID NO: 430406 - protein, 4 aa, Mycobacterium
APPM

SEQ ID NO: 430407 - protein, 7 aa, Mycobacterium
APPMPPG

SEQ ID NO: 430408 - protein, 5 aa, Mycobacterium
APPMS

SEQ ID NO: 430409 - protein, 4 aa, Mycobacterium
APPN

SEQ ID NO: 430410 - protein, 7 aa, Mycobacterium
APPNAKQ

SEQ ID NO: 430411 - protein, 7 aa, Mycobacterium
APPNGFG

SEQ ID NO: 430412 - protein, 5 aa, Mycobacterium
APPNK

SEQ ID NO: 430413 - protein, 8 aa, Mycobacterium
APPNKEEV

SEQ ID NO: 430414 - protein, 23 aa, Mycobacterium
APPNSEPVKNRREGRARPDDRKK

SEQ ID NO: 430415 - protein, 6 aa, Mycobacterium
APPNVV

SEQ ID NO: 430416 - protein, 4 aa, Mycobacterium
APPP

SEQ ID NO: 430417 - protein, 6 aa, Mycobacterium
APPPAA

SEQ ID NO: 430418 - protein, 14 aa, Mycobacterium
APPPADDDDDSVAA

SEQ ID NO: 430419 - protein, 6 aa, Mycobacterium
APPPAM

SEQ ID NO: 430420 - protein, 11 aa, Mycobacterium
APPPAPAARTV

SEQ ID NO: 430421 - protein, 7 aa, Mycobacterium
APPPAVA

SEQ ID NO: 430422 - protein, 7 aa, Mycobacterium
APPPDDV

SEQ ID NO: 430423 - protein, 8 aa, Mycobacterium
APPPDPCG

SEQ ID NO: 430424 - protein, 6 aa, Mycobacterium
APPPDV

SEQ ID NO: 430425 - protein, 10 aa, Mycobacterium
APPPEPAPVT

SEQ ID NO: 430426 - protein, 8 aa, Mycobacterium
APPPEVTS

SEQ ID NO: 430427 - protein, 9 aa, Mycobacterium
APPPGGLTG

SEQ ID NO: 430428 - protein, 10 aa, Mycobacterium
APPPGGLTGY

SEQ ID NO: 430429 - protein, 6 aa, Mycobacterium
APPPLP

SEQ ID NO: 430430 - protein, 6 aa, Mycobacterium
APPPLQ

SEQ ID NO: 430431 - protein, 9 aa, Mycobacterium
APPPNDPRL

SEQ ID NO: 430432 - protein, 53 aa, Mycobacterium
APPPPTTDADEGAQPADDSGLEMSRETSPETPEAPGDTDDADETAGGPRPGWP

SEQ ID NO: 430433 - protein, 7 aa, Mycobacterium
APPPPVA

SEQ ID NO: 430434 - protein, 5 aa, Mycobacterium
APPPQ

SEQ ID NO: 430435 - protein, 8 aa, Mycobacterium
APPPQEAL

SEQ ID NO: 430436 - protein, 10 aa, Mycobacterium
APPPQEAPPR

SEQ ID NO: 430437 - protein, 10 aa, Mycobacterium
APPPQPSAAQ

SEQ ID NO: 430438 - protein, 14 aa, Mycobacterium
APPPRLERSEASCA

SEQ ID NO: 430439 - protein, 8 aa, Mycobacterium
APPPRPLA

SEQ ID NO: 430440 - protein, 12 aa, Mycobacterium
APPPTAAAGMPG

SEQ ID NO: 430441 - protein, 12 aa, Mycobacterium
APPPTLAPRRQT

SEQ ID NO: 430442 - protein, 7 aa, Mycobacterium
APPPTRT

SEQ ID NO: 430443 - protein, 6 aa, Mycobacterium
APPPWA

SEQ ID NO: 430444 - protein, 4 aa, Mycobacterium
APPQ

SEQ ID NO: 430445 - protein, 8 aa, Mycobacterium
APPQAEFG

SEQ ID NO: 430446 - protein, 7 aa, Mycobacterium
APPQLHT

SEQ ID NO: 430447 - protein, 13 aa, Mycobacterium
APPQPGSQTTNPP

SEQ ID NO: 430448 - protein, 31 aa, Mycobacterium
APPQPSAHEGELPPALGGDAVRPDSRARRKR

SEQ ID NO: 430449 - protein, 6 aa, Mycobacterium
APPQPW

SEQ ID NO: 430450 - protein, 5 aa, Mycobacterium
APPQR

SEQ ID NO: 430451 - protein, 13 aa, Mycobacterium
APPQRSTRRRKAT

SEQ ID NO: 430452 - protein, 7 aa, Mycobacterium
APPQSTV

SEQ ID NO: 430453 - protein, 8 aa, Mycobacterium
APPQTVTY

SEQ ID NO: 430454 - protein, 15 aa, Mycobacterium
APPRAEERISTPTQV

SEQ ID NO: 430455 - protein, 7 aa, Mycobacterium
APPRAGL

SEQ ID NO: 430456 - protein, 8 aa, Mycobacterium
APPRDRRS

SEQ ID NO: 430457 - protein, 7 aa, Mycobacterium
APPRELY

SEQ ID NO: 430458 - protein, 6 aa, Mycobacterium
APPRGL

SEQ ID NO: 430459 - protein, 16 aa, Mycobacterium
APPRGRKPPTAAQRVR

SEQ ID NO: 430460 - protein, 9 aa, Mycobacterium
APPRGSPRN

SEQ ID NO: 430461 - protein, 7 aa, Mycobacterium
APPRGYL

SEQ ID NO: 430462 - protein, 5 aa, Mycobacterium
APPRI

SEQ ID NO: 430463 - protein, 6 aa, Mycobacterium
APPRIR

SEQ ID NO: 430464 - protein, 5 aa, Mycobacterium
APPRL

SEQ ID NO: 430465 - protein, 12 aa, Mycobacterium
APPRLAQTAGTA

SEQ ID NO: 430466 - protein, 17 aa, Mycobacterium
APPRQEPPNERGDAARN

SEQ ID NO: 430467 - protein, 9 aa, Mycobacterium
APPRQRPTY

SEQ ID NO: 430468 - protein, 10 aa, Mycobacterium
APPRRIGPAP

SEQ ID NO: 430469 - protein, 6 aa, Mycobacterium
APPRRL

SEQ ID NO: 430470 - protein, 5 aa, Mycobacterium
APPRS

SEQ ID NO: 430471 - protein, 7 aa, Mycobacterium
APPRSGL

SEQ ID NO: 430472 - protein, 4 aa, Mycobacterium
APPS

SEQ ID NO: 430473 - protein, 15 aa, Mycobacterium
APPSADEVGKLRSGQ

SEQ ID NO: 430474 - protein, 21 aa, Mycobacterium
APPSARQAEARVDELPETELV

SEQ ID NO: 430475 - protein, 8 aa, Mycobacterium
APPSDRRG

SEQ ID NO: 430476 - protein, 14 aa, Mycobacterium
APPSEALAARRESA

SEQ ID NO: 430477 - protein, 7 aa, Mycobacterium
APPSGPR

SEQ ID NO: 430478 - protein, 5 aa, Mycobacterium
APPSI

SEQ ID NO: 430479 - protein, 8 aa, Mycobacterium
APPSLPAE

SEQ ID NO: 430480 - protein, 33 aa, Mycobacterium
APPSMPSAPAGPISGAPVAPSPASSPSAGGPLV

SEQ ID NO: 430481 - protein, 6 aa, Mycobacterium
APPSPL

SEQ ID NO: 430482 - protein, 8 aa, Mycobacterium
APPSTPLE

SEQ ID NO: 430483 - protein, 7 aa, Mycobacterium
APPSVAS

SEQ ID NO: 430484 - protein, 24 aa, Mycobacterium
APPSVQKTRRESSGPVNHKHTTDE

SEQ ID NO: 430485 - protein, 7 aa, Mycobacterium
APPTAAE

SEQ ID NO: 430486 - protein, 8 aa, Mycobacterium
APPTADEV

SEQ ID NO: 430487 - protein, 5 aa, Mycobacterium
APPTD

SEQ ID NO: 430488 - protein, 21 aa, Mycobacterium
APPTDRPSSIASPTPSSGYPV

SEQ ID NO: 430489 - protein, 9 aa, Mycobacterium
APPTDTHPD

SEQ ID NO: 430490 - protein, 5 aa, Mycobacterium
APPTE

SEQ ID NO: 430491 - protein, 6 aa, Mycobacterium
APPTEF

SEQ ID NO: 430492 - protein, 8 aa, Mycobacterium
APPTGSGL

SEQ ID NO: 430493 - protein, 13 aa, Mycobacterium
APPTLSDDGSKVY

SEQ ID NO: 430494 - protein, 10 aa, Mycobacterium
APPTLTNTEG

SEQ ID NO: 430495 - protein, 35 aa, Mycobacterium
APPTMPNMGGGGSKGPVAQQPIGHGSGVGVTGGGA

SEQ ID NO: 430496 - protein, 6 aa, Mycobacterium
APPTSI

SEQ ID NO: 430497 - protein, 8 aa, Mycobacterium
APPTTEEV

SEQ ID NO: 430498 - protein, 6 aa, Mycobacterium
APPTVN

SEQ ID NO: 430499 - protein, 6 aa, Mycobacterium
APPTVT

SEQ ID NO: 430500 - protein, 15 aa, Mycobacterium
APPVDEETQARARAG

SEQ ID NO: 430501 - protein, 6 aa, Mycobacterium
APPVGR

SEQ ID NO: 430502 - protein, 5 aa, Mycobacterium
APPVP

SEQ ID NO: 430503 - protein, 9 aa, Mycobacterium
APPVPRREL

SEQ ID NO: 430504 - protein, 11 aa, Mycobacterium
APPVQADGGLT

SEQ ID NO: 430505 - protein, 6 aa, Mycobacterium
APPVTG

SEQ ID NO: 430506 - protein, 5 aa, Mycobacterium
APPWP

SEQ ID NO: 430507 - protein, 15 aa, Mycobacterium
APPWSERGLPGGPWE

SEQ ID NO: 430508 - protein, 4 aa, Mycobacterium
APPY

SEQ ID NO: 430509 - protein, 13 aa, Mycobacterium
APPYANSRDDYTT

SEQ ID NO: 430510 - protein, 20 aa, Mycobacterium
APPYGQGPAAARAGATAMTD

SEQ ID NO: 430511 - protein, 7 aa, Mycobacterium
APPYGST

SEQ ID NO: 430512 - protein, 8 aa, Mycobacterium
APPYNRKS

SEQ ID NO: 430513 - protein, 12 aa, Mycobacterium
APPYNRRSKAPK

SEQ ID NO: 430514 - protein, 12 aa, Mycobacterium
APPYRAGAATHG

SEQ ID NO: 430515 - protein, 4 aa, Mycobacterium
APQA

SEQ ID NO: 430516 - protein, 6 aa, Mycobacterium
APQAAE

SEQ ID NO: 430517 - protein, 7 aa, Mycobacterium
APQADVA

SEQ ID NO: 430518 - protein, 8 aa, Mycobacterium
APQAGETV

SEQ ID NO: 430519 - protein, 7 aa, Mycobacterium
APQAKTP

SEQ ID NO: 430520 - protein, 5 aa, Mycobacterium
APQAP

SEQ ID NO: 430521 - protein, 8 aa, Mycobacterium
APQAQETY

SEQ ID NO: 430522 - protein, 21 aa, Mycobacterium
APQARADAGPTKSRRNRGPAA

SEQ ID NO: 430523 - protein, 7 aa, Mycobacterium
APQARPS

SEQ ID NO: 430524 - protein, 56 aa, Mycobacterium
APQASPEGARHEQRAAPPPPARRPIPAPPPSHSYAESSDQRTAAQPAQPSAASMGN

SEQ ID NO: 430525 - protein, 5 aa, Mycobacterium
APQAT

SEQ ID NO: 430526 - protein, 8 aa, Mycobacterium
APQAVGYP

SEQ ID NO: 430527 - protein, 16 aa, Mycobacterium
APQDARKTTEEQRKLQ

SEQ ID NO: 430528 - protein, 5 aa, Mycobacterium
APQDD

SEQ ID NO: 430529 - protein, 8 aa, Mycobacterium
APQDDPIG

SEQ ID NO: 430530 - protein, 10 aa, Mycobacterium
APQDDTAAER

SEQ ID NO: 430531 - protein, 18 aa, Mycobacterium
APQDEREDPPAGCDDPST

SEQ ID NO: 430532 - protein, 7 aa, Mycobacterium
APQDGAS

SEQ ID NO: 430533 - protein, 7 aa, Mycobacterium
APQDGTF

SEQ ID NO: 430534 - protein, 9 aa, Mycobacterium
APQDKGPWG

SEQ ID NO: 430535 - protein, 5 aa, Mycobacterium
APQDL

SEQ ID NO: 430536 - protein, 7 aa, Mycobacterium
APQDNGP

SEQ ID NO: 430537 - protein, 12 aa, Mycobacterium
APQDPQAAAAEL

SEQ ID NO: 430538 - protein, 8 aa, Mycobacterium
APQDPYTQ

SEQ ID NO: 430539 - protein, 5 aa, Mycobacterium
APQDS

SEQ ID NO: 430540 - protein, 18 aa, Mycobacterium
APQEDPEDHVAPAAQRVR

SEQ ID NO: 430541 - protein, 8 aa, Mycobacterium
APQEGRAK

SEQ ID NO: 430542 - protein, 7 aa, Mycobacterium
APQEITD

SEQ ID NO: 430543 - protein, 14 aa, Mycobacterium
APQESTADPSPSDV

SEQ ID NO: 430544 - protein, 4 aa, Mycobacterium
APQG

SEQ ID NO: 430545 - protein, 6 aa, Mycobacterium
APQGEL

SEQ ID NO: 430546 - protein, 8 aa, Mycobacterium
APQGHEET

SEQ ID NO: 430547 - protein, 6 aa, Mycobacterium
APQGLA

SEQ ID NO: 430548 - protein, 7 aa, Mycobacterium
APQGPGI

SEQ ID NO: 430549 - protein, 9 aa, Mycobacterium
APQGRGIDR

SEQ ID NO: 430550 - protein, 7 aa, Mycobacterium
APQGSAA

SEQ ID NO: 430551 - protein, 6 aa, Mycobacterium
APQGSV

SEQ ID NO: 430552 - protein, 11 aa, Mycobacterium
APQHDRNRDIA

SEQ ID NO: 430553 - protein, 11 aa, Mycobacterium
APQHGAGGTAG

SEQ ID NO: 430554 - protein, 6 aa, Mycobacterium
APQHIP

SEQ ID NO: 430555 - protein, 5 aa, Mycobacterium
APQHQ

SEQ ID NO: 430556 - protein, 5 aa, Mycobacterium
APQHR

SEQ ID NO: 430557 - protein, 8 aa, Mycobacterium
APQIGNTG

SEQ ID NO: 430558 - protein, 20 aa, Mycobacterium
APQIGNTGWNDEDDESRGGK

SEQ ID NO: 430559 - protein, 19 aa, Mycobacterium
APQIGNTGWNDEDGESRGD

SEQ ID NO: 430560 - protein, 19 aa, Mycobacterium
APQIGNTGWNGEDAESRGD

SEQ ID NO: 430561 - protein, 15 aa, Mycobacterium
APQISAEEQASNRAG

SEQ ID NO: 430562 - protein, 4 aa, Mycobacterium
APQL

SEQ ID NO: 430563 - protein, 6 aa, Mycobacterium
APQLDG

SEQ ID NO: 430564 - protein, 5 aa, Mycobacterium
APQLP

SEQ ID NO: 430565 - protein, 6 aa, Mycobacterium
APQLPE

SEQ ID NO: 430566 - protein, 8 aa, Mycobacterium
APQLPEAP

SEQ ID NO: 430567 - protein, 6 aa, Mycobacterium
APQLPG

SEQ ID NO: 430568 - protein, 12 aa, Mycobacterium
APQLSSSDGRGP

SEQ ID NO: 430569 - protein, 6 aa, Mycobacterium
APQPAL

SEQ ID NO: 430570 - protein, 9 aa, Mycobacterium
APQPAPRAG

SEQ ID NO: 430571 - protein, 49 aa, Mycobacterium
APQPAQPAAPPQPAQAVPTPEPAPAPEQEPEPAPAPAPKRSRKARATVP

SEQ ID NO: 430572 - protein, 5 aa, Mycobacterium
APQPD

SEQ ID NO: 430573 - protein, 7 aa, Mycobacterium
APQPDDL

SEQ ID NO: 430574 - protein, 8 aa, Mycobacterium
APQPDGTP

SEQ ID NO: 430575 - protein, 6 aa, Mycobacterium
APQPDI

SEQ ID NO: 430576 - protein, 14 aa, Mycobacterium
APQPDLDHKTQSSE

SEQ ID NO: 430577 - protein, 10 aa, Mycobacterium
APQPDSSPVF

SEQ ID NO: 430578 - protein, 5 aa, Mycobacterium
APQPE

SEQ ID NO: 430579 - protein, 6 aa, Mycobacterium
APQPEL

SEQ ID NO: 430580 - protein, 5 aa, Mycobacterium
APQPG

SEQ ID NO: 430581 - protein, 9 aa, Mycobacterium
APQPGAEVT

SEQ ID NO: 430582 - protein, 6 aa, Mycobacterium
APQPGG

SEQ ID NO: 430583 - protein, 7 aa, Mycobacterium
APQPISE

SEQ ID NO: 430584 - protein, 8 aa, Mycobacterium
APQPPQPW

SEQ ID NO: 430585 - protein, 8 aa, Mycobacterium
APQPPQRW

SEQ ID NO: 430586 - protein, 10 aa, Mycobacterium
APQPPRITPE

SEQ ID NO: 430587 - protein, 20 aa, Mycobacterium
APQPQATPDEDDASTPQSAP

SEQ ID NO: 430588 - protein, 6 aa, Mycobacterium
APQPRT

SEQ ID NO: 430589 - protein, 9 aa, Mycobacterium
APQPSPPTP

SEQ ID NO: 430590 - protein, 6 aa, Mycobacterium
APQPVE

SEQ ID NO: 430591 - protein, 11 aa, Mycobacterium
APQPVRNAEYT

SEQ ID NO: 430592 - protein, 13 aa, Mycobacterium
APQPVRNAEYTST

SEQ ID NO: 430593 - protein, 11 aa, Mycobacterium
APQPVRNSEYT

SEQ ID NO: 430594 - protein, 8 aa, Mycobacterium
APQQGKGY

SEQ ID NO: 430595 - protein, 7 aa, Mycobacterium
APQQPIN

SEQ ID NO: 430596 - protein, 43 aa, Mycobacterium
APQQQQFGPGARHEQPATLPPPAQRLAPGPAPSQLSDIDPEIS

SEQ ID NO: 430597 - protein, 9 aa, Mycobacterium
APQQRESEL

SEQ ID NO: 430598 - protein, 4 aa, Mycobacterium
APQR

SEQ ID NO: 430599 - protein, 6 aa, Mycobacterium
APQRAQ

SEQ ID NO: 430600 - protein, 10 aa, Mycobacterium
APQRDNPFQG

SEQ ID NO: 430601 - protein, 8 aa, Mycobacterium
APQRGQDV

SEQ ID NO: 430602 - protein, 7 aa, Mycobacterium
APQRGTL

SEQ ID NO: 430603 - protein, 14 aa, Mycobacterium
APQRPAPQAGQDTR

SEQ ID NO: 430604 - protein, 9 aa, Mycobacterium
APQRPASTL

SEQ ID NO: 430605 - protein, 6 aa, Mycobacterium
APQRSG

SEQ ID NO: 430606 - protein, 10 aa, Mycobacterium
APQRTTGRSP

SEQ ID NO: 430607 - protein, 8 aa, Mycobacterium
APQSDGAA

SEQ ID NO: 430608 - protein, 9 aa, Mycobacterium
APQSDGGPG

SEQ ID NO: 430609 - protein, 6 aa, Mycobacterium
APQSGS

SEQ ID NO: 430610 - protein, 7 aa, Mycobacterium
APQSGSI

SEQ ID NO: 430611 - protein, 5 aa, Mycobacterium
APQSI

SEQ ID NO: 430612 - protein, 9 aa, Mycobacterium
APQSPTEET

SEQ ID NO: 430613 - protein, 22 aa, Mycobacterium
APQSQRDDGPSRSRKPRGPAPR

SEQ ID NO: 430614 - protein, 9 aa, Mycobacterium
APQSVGAAL

SEQ ID NO: 430615 - protein, 7 aa, Mycobacterium
APQTAGQ

SEQ ID NO: 430616 - protein, 7 aa, Mycobacterium
APQTAGR

SEQ ID NO: 430617 - protein, 23 aa, Mycobacterium
APQTENSSSGPDRPRRQRGPAPR

SEQ ID NO: 430618 - protein, 8 aa, Mycobacterium
APQTGAAN

SEQ ID NO: 430619 - protein, 8 aa, Mycobacterium
APQTGAAR

SEQ ID NO: 430620 - protein, 15 aa, Mycobacterium
APQTGAATAEISSTG

SEQ ID NO: 430621 - protein, 14 aa, Mycobacterium
APQTGPAPAFAEQT

SEQ ID NO: 430622 - protein, 5 aa, Mycobacterium
APQTI

SEQ ID NO: 430623 - protein, 7 aa, Mycobacterium
APQTPAM

SEQ ID NO: 430624 - protein, 19 aa, Mycobacterium
APQTRADPGPAKNRRNRGP

SEQ ID NO: 430625 - protein, 20 aa, Mycobacterium
APQTRAEPGAGKARRNRTTA

SEQ ID NO: 430626 - protein, 9 aa, Mycobacterium
APQTRSGRK

SEQ ID NO: 430627 - protein, 12 aa, Mycobacterium
APQTVAGQDRVQ

SEQ ID NO: 430628 - protein, 9 aa, Mycobacterium
APQTYPPEV

SEQ ID NO: 430629 - protein, 6 aa, Mycobacterium
APQVGQ

SEQ ID NO: 430630 - protein, 4 aa, Mycobacterium
APQW

SEQ ID NO: 430631 - protein, 4 aa, Mycobacterium
APQY

SEQ ID NO: 430632 - protein, 7 aa, Mycobacterium
APRAAAD

SEQ ID NO: 430633 - protein, 8 aa, Mycobacterium
APRAAELD

SEQ ID NO: 430634 - protein, 8 aa, Mycobacterium
APRAAKDV

SEQ ID NO: 430635 - protein, 6 aa, Mycobacterium
APRACT

SEQ ID NO: 430636 - protein, 6 aa, Mycobacterium
APRAGL

SEQ ID NO: 430637 - protein, 8 aa, Mycobacterium
APRAPAGW

SEQ ID NO: 430638 - protein, 13 aa, Mycobacterium
APRARMTGSERRQ

SEQ ID NO: 430639 - protein, 6 aa, Mycobacterium
APRASN

SEQ ID NO: 430640 - protein, 6 aa, Mycobacterium
APRATA

SEQ ID NO: 430641 - protein, 6 aa, Mycobacterium
APRATV

SEQ ID NO: 430642 - protein, 4 aa, Mycobacterium
APRC

SEQ ID NO: 430643 - protein, 6 aa, Mycobacterium
APRCGS

SEQ ID NO: 430644 - protein, 11 aa, Mycobacterium
APRDASRLREE

SEQ ID NO: 430645 - protein, 8 aa, Mycobacterium
APRDDTRI

SEQ ID NO: 430646 - protein, 8 aa, Mycobacterium
APRDDYTA

SEQ ID NO: 430647 - protein, 6 aa, Mycobacterium
APRDEE

SEQ ID NO: 430648 - protein, 7 aa, Mycobacterium
APRDGAR

SEQ ID NO: 430649 - protein, 8 aa, Mycobacterium
APRDGARL

SEQ ID NO: 430650 - protein, 13 aa, Mycobacterium
APRDGETRSPDQV

SEQ ID NO: 430651 - protein, 9 aa, Mycobacterium
APRDGRSSY

SEQ ID NO: 430652 - protein, 5 aa, Mycobacterium
APRDM

SEQ ID NO: 430653 - protein, 7 aa, Mycobacterium
APRDRET

SEQ ID NO: 430654 - protein, 5 aa, Mycobacterium
APRDT

SEQ ID NO: 430655 - protein, 8 aa, Mycobacterium
APRDTGLG

SEQ ID NO: 430656 - protein, 7 aa, Mycobacterium
APRDTNA

SEQ ID NO: 430657 - protein, 8 aa, Mycobacterium
APRDVSQS

SEQ ID NO: 430658 - protein, 14 aa, Mycobacterium
APREARDPVNQPTI

SEQ ID NO: 430659 - protein, 15 aa, Mycobacterium
APREGVQERTGDMGT

SEQ ID NO: 430660 - protein, 8 aa, Mycobacterium
APREPGRH

SEQ ID NO: 430661 - protein, 11 aa, Mycobacterium
APRGDSPSRRL

SEQ ID NO: 430662 - protein, 44 aa, Mycobacterium
APRGEQTRARTGAGQKVVPTGPAGPGADERAPVPAAAPQRPRKH

SEQ ID NO: 430663 - protein, 10 aa, Mycobacterium
APRGGGPGPH

SEQ ID NO: 430664 - protein, 6 aa, Mycobacterium
APRGHG

SEQ ID NO: 430665 - protein, 12 aa, Mycobacterium
APRGKAKSVDGG

SEQ ID NO: 430666 - protein, 6 aa, Mycobacterium
APRGLY

SEQ ID NO: 430667 - protein, 11 aa, Mycobacterium
APRGPAPTLGD

SEQ ID NO: 430668 - protein, 27 aa, Mycobacterium
APRGPQGDNATIRDATDYDDSVAPAAG

SEQ ID NO: 430669 - protein, 7 aa, Mycobacterium
APRGPVT

SEQ ID NO: 430670 - protein, 9 aa, Mycobacterium
APRGQARTE

SEQ ID NO: 430671 - protein, 15 aa, Mycobacterium
APRGSEPGLRDASAD

SEQ ID NO: 430672 - protein, 11 aa, Mycobacterium
APRGTARSVDG

SEQ ID NO: 430673 - protein, 13 aa, Mycobacterium
APRGYGQGNHEDD

SEQ ID NO: 430674 - protein, 13 aa, Mycobacterium
APRGYGQGNHTDD

SEQ ID NO: 430675 - protein, 4 aa, Mycobacterium
APRH

SEQ ID NO: 430676 - protein, 6 aa, Mycobacterium
APRIGK

SEQ ID NO: 430677 - protein, 5 aa, Mycobacterium
APRIP

SEQ ID NO: 430678 - protein, 10 aa, Mycobacterium
APRKAANPNM

SEQ ID NO: 430679 - protein, 9 aa, Mycobacterium
APRKGVNTT

SEQ ID NO: 430680 - protein, 10 aa, Mycobacterium
APRKQADPNM

SEQ ID NO: 430681 - protein, 10 aa, Mycobacterium
APRKQADPQM

SEQ ID NO: 430682 - protein, 24 aa, Mycobacterium
APRKQPPKTVPPLRRPEVRARLNL

SEQ ID NO: 430683 - protein, 10 aa, Mycobacterium
APRKRGNPEM

SEQ ID NO: 430684 - protein, 8 aa, Mycobacterium
APRKRPAH

SEQ ID NO: 430685 - protein, 10 aa, Mycobacterium
APRKRTNPDM

SEQ ID NO: 430686 - protein, 5 aa, Mycobacterium
APRLA

SEQ ID NO: 430687 - protein, 6 aa, Mycobacterium
APRLAP

SEQ ID NO: 430688 - protein, 10 aa, Mycobacterium
APRLPDGTPF

SEQ ID NO: 430689 - protein, 5 aa, Mycobacterium
APRMA

SEQ ID NO: 430690 - protein, 12 aa, Mycobacterium
APRMKTPGDSTA

SEQ ID NO: 430691 - protein, 6 aa, Mycobacterium
APRNDP

SEQ ID NO: 430692 - protein, 7 aa, Mycobacterium
APRNGDF

SEQ ID NO: 430693 - protein, 6 aa, Mycobacterium
APRNPL

SEQ ID NO: 430694 - protein, 9 aa, Mycobacterium
APRNRPGRR

SEQ ID NO: 430695 - protein, 10 aa, Mycobacterium
APRNTYQTAD

SEQ ID NO: 430696 - protein, 10 aa, Mycobacterium
APRNTYRTAD

SEQ ID NO: 430697 - protein, 6 aa, Mycobacterium
APRPAL

SEQ ID NO: 430698 - protein, 6 aa, Mycobacterium
APRPAR

SEQ ID NO: 430699 - protein, 5 aa, Mycobacterium
APRPD

SEQ ID NO: 430700 - protein, 23 aa, Mycobacterium
APRPDASAHQPDPRLANANPALA

SEQ ID NO: 430701 - protein, 7 aa, Mycobacterium
APRPDVG

SEQ ID NO: 430702 - protein, 10 aa, Mycobacterium
APRPEKRSAA

SEQ ID NO: 430703 - protein, 12 aa, Mycobacterium
APRPENESISDG

SEQ ID NO: 430704 - protein, 7 aa, Mycobacterium
APRPERE

SEQ ID NO: 430705 - protein, 6 aa, Mycobacterium
APRPGA

SEQ ID NO: 430706 - protein, 25 aa, Mycobacterium
APRPGAITHQPDPRLRNANPSLSTL

SEQ ID NO: 430707 - protein, 11 aa, Mycobacterium
APRPGANVGSL

SEQ ID NO: 430708 - protein, 8 aa, Mycobacterium
APRPGAQG

SEQ ID NO: 430709 - protein, 9 aa, Mycobacterium
APRPGDPPY

SEQ ID NO: 430710 - protein, 8 aa, Mycobacterium
APRPGDTV

SEQ ID NO: 430711 - protein, 11 aa, Mycobacterium
APRPGESLDPR

SEQ ID NO: 430712 - protein, 7 aa, Mycobacterium
APRPGRE

SEQ ID NO: 430713 - protein, 8 aa, Mycobacterium
APRPGREV

SEQ ID NO: 430714 - protein, 7 aa, Mycobacterium
APRPGRR

SEQ ID NO: 430715 - protein, 11 aa, Mycobacterium
APRPGSRPSLA

SEQ ID NO: 430716 - protein, 14 aa, Mycobacterium
APRPGTAQAGKGWS

SEQ ID NO: 430717 - protein, 7 aa, Mycobacterium
APRPGTD

SEQ ID NO: 430718 - protein, 10 aa, Mycobacterium
APRPNATGSL

SEQ ID NO: 430719 - protein, 6 aa, Mycobacterium
APRPNR

SEQ ID NO: 430720 - protein, 5 aa, Mycobacterium
APRPP

SEQ ID NO: 430721 - protein, 6 aa, Mycobacterium
APRPPE

SEQ ID NO: 430722 - protein, 24 aa, Mycobacterium
APRPPEARRPKRTPSTRKSARTAS

SEQ ID NO: 430723 - protein, 9 aa, Mycobacterium
APRPPQPWS

SEQ ID NO: 430724 - protein, 21 aa, Mycobacterium
APRPQSRAKPPSANGSQTFQS

SEQ ID NO: 430725 - protein, 6 aa, Mycobacterium
APRPRI

SEQ ID NO: 430726 - protein, 5 aa, Mycobacterium
APRPS

SEQ ID NO: 430727 - protein, 18 aa, Mycobacterium
APRPSSAPCGPGAPDTAF

SEQ ID NO: 430728 - protein, 8 aa, Mycobacterium
APRPSTDH

SEQ ID NO: 430729 - protein, 18 aa, Mycobacterium
APRPTAQATTAGTQARFK

SEQ ID NO: 430730 - protein, 9 aa, Mycobacterium
APRPTPEPD

SEQ ID NO: 430731 - protein, 8 aa, Mycobacterium
APRPVQPW

SEQ ID NO: 430732 - protein, 5 aa, Mycobacterium
APRPY

SEQ ID NO: 430733 - protein, 11 aa, Mycobacterium
APRPYAESRPL

SEQ ID NO: 430734 - protein, 10 aa, Mycobacterium
APRPYARSRP

SEQ ID NO: 430735 - protein, 9 aa, Mycobacterium
APRQEGSTA

SEQ ID NO: 430736 - protein, 8 aa, Mycobacterium
APRQLPAA

SEQ ID NO: 430737 - protein, 5 aa, Mycobacterium
APRQV

SEQ ID NO: 430738 - protein, 35 aa, Mycobacterium
APRQVSPASAAAPTGAPPPPPSSAASGPGTPLPPG

SEQ ID NO: 430739 - protein, 7 aa, Mycobacterium
APRQYTR

SEQ ID NO: 430740 - protein, 4 aa, Mycobacterium
APRR

SEQ ID NO: 430741 - protein, 5 aa, Mycobacterium
APRRA

SEQ ID NO: 430742 - protein, 46 aa, Mycobacterium
APRRAGGRRPRAPADRAGRGGRGRTGRRRRAGPGAAGGQDGVRVPR

SEQ ID NO: 430743 - protein, 12 aa, Mycobacterium
APRRDPRQDDRD

SEQ ID NO: 430744 - protein, 7 aa, Mycobacterium
APRRGGR

SEQ ID NO: 430745 - protein, 5 aa, Mycobacterium
APRRL

SEQ ID NO: 430746 - protein, 7 aa, Mycobacterium
APRRNPA

SEQ ID NO: 430747 - protein, 8 aa, Mycobacterium
APRRPPPA

SEQ ID NO: 430748 - protein, 6 aa, Mycobacterium
APRRQK

SEQ ID NO: 430749 - protein, 14 aa, Mycobacterium
APRRQPPKTVPPLR

SEQ ID NO: 430750 - protein, 24 aa, Mycobacterium
APRRQPPKTVPPLRRPEVRARMAA

SEQ ID NO: 430751 - protein, 5 aa, Mycobacterium
APRRR

SEQ ID NO: 430752 - protein, 5 aa, Mycobacterium
APRRT

SEQ ID NO: 430753 - protein, 5 aa, Mycobacterium
APRRV

SEQ ID NO: 430754 - protein, 6 aa, Mycobacterium
APRSAG

SEQ ID NO: 430755 - protein, 16 aa, Mycobacterium
APRSAGAARRIASASS

SEQ ID NO: 430756 - protein, 8 aa, Mycobacterium
APRSARAA

SEQ ID NO: 430757 - protein, 6 aa, Mycobacterium
APRSEL

SEQ ID NO: 430758 - protein, 8 aa, Mycobacterium
APRSGESI

SEQ ID NO: 430759 - protein, 14 aa, Mycobacterium
APRSGRDSAAGEAR

SEQ ID NO: 430760 - protein, 7 aa, Mycobacterium
APRSNFG

SEQ ID NO: 430761 - protein, 15 aa, Mycobacterium
APRSNTNGLGATPAE

SEQ ID NO: 430762 - protein, 6 aa, Mycobacterium
APRSPA

SEQ ID NO: 430763 - protein, 6 aa, Mycobacterium
APRSPF

SEQ ID NO: 430764 - protein, 5 aa, Mycobacterium
APRSR

SEQ ID NO: 430765 - protein, 7 aa, Mycobacterium
APRSTGA

SEQ ID NO: 430766 - protein, 16 aa, Mycobacterium
APRTANAGSAPATENT

SEQ ID NO: 430767 - protein, 6 aa, Mycobacterium
APRTAT

SEQ ID NO: 430768 - protein, 8 aa, Mycobacterium
APRTESPW

SEQ ID NO: 430769 - protein, 8 aa, Mycobacterium
APRTGQSI

SEQ ID NO: 430770 - protein, 8 aa, Mycobacterium
APRTHSRA

SEQ ID NO: 430771 - protein, 6 aa, Mycobacterium
APRTPC

SEQ ID NO: 430772 - protein, 9 aa, Mycobacterium
APRTPRERV

SEQ ID NO: 430773 - protein, 7 aa, Mycobacterium
APRTQAT

SEQ ID NO: 430774 - protein, 5 aa, Mycobacterium
APRTR

SEQ ID NO: 430775 - protein, 14 aa, Mycobacterium
APRTRSGSALPRGA

SEQ ID NO: 430776 - protein, 10 aa, Mycobacterium
APRTSSPAGT

SEQ ID NO: 430777 - protein, 16 aa, Mycobacterium
APRTSVGAGGTYYNNS

SEQ ID NO: 430778 - protein, 4 aa, Mycobacterium
APRV

SEQ ID NO: 430779 - protein, 12 aa, Mycobacterium
APRVGGTDEDDG

SEQ ID NO: 430780 - protein, 5 aa, Mycobacterium
APRVK

SEQ ID NO: 430781 - protein, 4 aa, Mycobacterium
APRY

SEQ ID NO: 430782 - protein, 5 aa, Mycobacterium
APRYE

SEQ ID NO: 430783 - protein, 4 aa, Mycobacterium
APSA

SEQ ID NO: 430784 - protein, 10 aa, Mycobacterium
APSAAAASPY

SEQ ID NO: 430785 - protein, 7 aa, Mycobacterium
APSAAAR

SEQ ID NO: 430786 - protein, 25 aa, Mycobacterium
APSAADTERPVRSITTGPRGYEGEG

SEQ ID NO: 430787 - protein, 31 aa, Mycobacterium
APSAEALEEEGAGETGAAEAPAEEAPAEEPA

SEQ ID NO: 430788 - protein, 18 aa, Mycobacterium
APSAEQTFSSLSGGQQGR

SEQ ID NO: 430789 - protein, 10 aa, Mycobacterium
APSAETDPVG

SEQ ID NO: 430790 - protein, 21 aa, Mycobacterium
APSAFNQKKRTTGKTIVRVTE

SEQ ID NO: 430791 - protein, 7 aa, Mycobacterium
APSAGAI

SEQ ID NO: 430792 - protein, 8 aa, Mycobacterium
APSAGERV

SEQ ID NO: 430793 - protein, 9 aa, Mycobacterium
APSAGPANT

SEQ ID NO: 430794 - protein, 51 aa, Mycobacterium
APSAGRPTDQVPDPAADTPLQQPQPADPEQQAAGAMRAPEQLQADHEPTVP

SEQ ID NO: 430795 - protein, 7 aa, Mycobacterium
APSAHLN

SEQ ID NO: 430796 - protein, 13 aa, Mycobacterium
APSAHREDPRIWV

SEQ ID NO: 430797 - protein, 10 aa, Mycobacterium
APSAKPVAAQ

SEQ ID NO: 430798 - protein, 17 aa, Mycobacterium
APSANRWKPQHNASPAE

SEQ ID NO: 430799 - protein, 24 aa, Mycobacterium
APSAPAPGHAARPRRHPSAGSGNA

SEQ ID NO: 430800 - protein, 8 aa, Mycobacterium
APSAPGSI

SEQ ID NO: 430801 - protein, 30 aa, Mycobacterium
APSAPNPAASPASAPVPPSSAGAAASVEAS

SEQ ID NO: 430802 - protein, 9 aa, Mycobacterium
APSAQGTGL

SEQ ID NO: 430803 - protein, 15 aa, Mycobacterium
APSARAPRRPQPRVS

SEQ ID NO: 430804 - protein, 9 aa, Mycobacterium
APSARDDEL

SEQ ID NO: 430805 - protein, 9 aa, Mycobacterium
APSASAADV

SEQ ID NO: 430806 - protein, 16 aa, Mycobacterium
APSAWPAMTGKTVFAR

SEQ ID NO: 430807 - protein, 4 aa, Mycobacterium
APSC

SEQ ID NO: 430808 - protein, 9 aa, Mycobacterium
APSCPTDPA

SEQ ID NO: 430809 - protein, 8 aa, Mycobacterium
APSDEWAP

SEQ ID NO: 430810 - protein, 9 aa, Mycobacterium
APSDGGRVN

SEQ ID NO: 430811 - protein, 17 aa, Mycobacterium
APSDGGRVNLSPKGYRD

SEQ ID NO: 430812 - protein, 5 aa, Mycobacterium
APSDI

SEQ ID NO: 430813 - protein, 9 aa, Mycobacterium
APSDKTWKP

SEQ ID NO: 430814 - protein, 11 aa, Mycobacterium
APSDPEERDTL

SEQ ID NO: 430815 - protein, 7 aa, Mycobacterium
APSDPHR

SEQ ID NO: 430816 - protein, 6 aa, Mycobacterium
APSDTA

SEQ ID NO: 430817 - protein, 10 aa, Mycobacterium
APSDTPADAA

SEQ ID NO: 430818 - protein, 13 aa, Mycobacterium
APSDVPNYGPQKT

SEQ ID NO: 430819 - protein, 11 aa, Mycobacterium
APSEAGRGRPF

SEQ ID NO: 430820 - protein, 6 aa, Mycobacterium
APSEAQ

SEQ ID NO: 430821 - protein, 11 aa, Mycobacterium
APSEARSIDPQ

SEQ ID NO: 430822 - protein, 9 aa, Mycobacterium
APSEGGRIN

SEQ ID NO: 430823 - protein, 12 aa, Mycobacterium
APSELTGTTGLG

SEQ ID NO: 430824 - protein, 10 aa, Mycobacterium
APSENGYARP

SEQ ID NO: 430825 - protein, 8 aa, Mycobacterium
APSFAPGR

SEQ ID NO: 430826 - protein, 5 aa, Mycobacterium
APSFK

SEQ ID NO: 430827 - protein, 8 aa, Mycobacterium
APSFTPGR

SEQ ID NO: 430828 - protein, 5 aa, Mycobacterium
APSGA

SEQ ID NO: 430829 - protein, 8 aa, Mycobacterium
APSGAGRT

SEQ ID NO: 430830 - protein, 10 aa, Mycobacterium
APSGEKANRR

SEQ ID NO: 430831 - protein, 6 aa, Mycobacterium
APSGGA

SEQ ID NO: 430832 - protein, 7 aa, Mycobacterium
APSGGRL

SEQ ID NO: 430833 - protein, 7 aa, Mycobacterium
APSGGRV

SEQ ID NO: 430834 - protein, 10 aa, Mycobacterium
APSGGSSLRG

SEQ ID NO: 430835 - protein, 8 aa, Mycobacterium
APSGGYQD

SEQ ID NO: 430836 - protein, 8 aa, Mycobacterium
APSGLTAE

SEQ ID NO: 430837 - protein, 16 aa, Mycobacterium
APSGNRRMSANPHANG

SEQ ID NO: 430838 - protein, 7 aa, Mycobacterium
APSGPDV

SEQ ID NO: 430839 - protein, 6 aa, Mycobacterium
APSGPE

SEQ ID NO: 430840 - protein, 6 aa, Mycobacterium
APSGSC

SEQ ID NO: 430841 - protein, 8 aa, Mycobacterium
APSGSRAW

SEQ ID NO: 430842 - protein, 6 aa, Mycobacterium
APSGVS

SEQ ID NO: 430843 - protein, 7 aa, Mycobacterium
APSGVTE

SEQ ID NO: 430844 - protein, 14 aa, Mycobacterium
APSGYAGVNQSRVT

SEQ ID NO: 430845 - protein, 15 aa, Mycobacterium
APSIDASRSASNGIG

SEQ ID NO: 430846 - protein, 6 aa, Mycobacterium
APSKDL

SEQ ID NO: 430847 - protein, 10 aa, Mycobacterium
APSKDSQAAR

SEQ ID NO: 430848 - protein, 10 aa, Mycobacterium
APSKPIPTPG

SEQ ID NO: 430849 - protein, 17 aa, Mycobacterium
APSKSLRSALTDTRWAT

SEQ ID NO: 430850 - protein, 8 aa, Mycobacterium
APSLAEKG

SEQ ID NO: 430851 - protein, 7 aa, Mycobacterium
APSLDDL

SEQ ID NO: 430852 - protein, 5 aa, Mycobacterium
APSLE

SEQ ID NO: 430853 - protein, 9 aa, Mycobacterium
APSLGLPAP

SEQ ID NO: 430854 - protein, 8 aa, Mycobacterium
APSLPDGL

SEQ ID NO: 430855 - protein, 12 aa, Mycobacterium
APSLSEIPTGTA

SEQ ID NO: 430856 - protein, 9 aa, Mycobacterium
APSLSREEV

SEQ ID NO: 430857 - protein, 23 aa, Mycobacterium
APSLTARRPAPNRPQLRPPGQDD

SEQ ID NO: 430858 - protein, 9 aa, Mycobacterium
APSNAAPVH

SEQ ID NO: 430859 - protein, 8 aa, Mycobacterium
APSNPVAT

SEQ ID NO: 430860 - protein, 7 aa, Mycobacterium
APSNSNV

SEQ ID NO: 430861 - protein, 8 aa, Mycobacterium
APSNSNVQ

SEQ ID NO: 430862 - protein, 4 aa, Mycobacterium
APSP

SEQ ID NO: 430863 - protein, 9 aa, Mycobacterium
APSPAATSA

SEQ ID NO: 430864 - protein, 23 aa, Mycobacterium
APSPAATSQLDSSRAADADIAGS

SEQ ID NO: 430865 - protein, 13 aa, Mycobacterium
APSPADGERNPLR

SEQ ID NO: 430866 - protein, 9 aa, Mycobacterium
APSPADISE

SEQ ID NO: 430867 - protein, 6 aa, Mycobacterium
APSPAG

SEQ ID NO: 430868 - protein, 11 aa, Mycobacterium
APSPAIPEHPG

SEQ ID NO: 430869 - protein, 13 aa, Mycobacterium
APSPALQGQRGEQ

SEQ ID NO: 430870 - protein, 11 aa, Mycobacterium
APSPALTHQRG

SEQ ID NO: 430871 - protein, 8 aa, Mycobacterium
APSPAPSV

SEQ ID NO: 430872 - protein, 5 aa, Mycobacterium
APSPD

SEQ ID NO: 430873 - protein, 16 aa, Mycobacterium
APSPDPNNRRATSADT

SEQ ID NO: 430874 - protein, 6 aa, Mycobacterium
APSPEA

SEQ ID NO: 430875 - protein, 7 aa, Mycobacterium
APSPEAG

SEQ ID NO: 430876 - protein, 26 aa, Mycobacterium
APSPEAGAERISRSGGGLNISPKGYE

SEQ ID NO: 430877 - protein, 17 aa, Mycobacterium
APSPEAIRTAASRAGLP

SEQ ID NO: 430878 - protein, 8 aa, Mycobacterium
APSPFVPP

SEQ ID NO: 430879 - protein, 18 aa, Mycobacterium
APSPHDPPGQTGQTKSDR

SEQ ID NO: 430880 - protein, 5 aa, Mycobacterium
APSPL

SEQ ID NO: 430881 - protein, 9 aa, Mycobacterium
APSPNGALD

SEQ ID NO: 430882 - protein, 27 aa, Mycobacterium
APSPPAAAVPPVPDGATTLSPAKSAAL

SEQ ID NO: 430883 - protein, 7 aa, Mycobacterium
APSPPAR

SEQ ID NO: 430884 - protein, 7 aa, Mycobacterium
APSPQKR

SEQ ID NO: 430885 - protein, 8 aa, Mycobacterium
APSPRSRA

SEQ ID NO: 430886 - protein, 7 aa, Mycobacterium
APSPRVD

SEQ ID NO: 430887 - protein, 18 aa, Mycobacterium
APSPSAWSAALDAVVRLL

SEQ ID NO: 430888 - protein, 8 aa, Mycobacterium
APSPSEAA

SEQ ID NO: 430889 - protein, 12 aa, Mycobacterium
APSPSVRSRRRP

SEQ ID NO: 430890 - protein, 16 aa, Mycobacterium
APSPTLPGGPERAPEL

SEQ ID NO: 430891 - protein, 8 aa, Mycobacterium
APSPVTAE

SEQ ID NO: 430892 - protein, 17 aa, Mycobacterium
APSQFTTENHGGAPPFA

SEQ ID NO: 430893 - protein, 11 aa, Mycobacterium
APSQPSPGVQP

SEQ ID NO: 430894 - protein, 10 aa, Mycobacterium
APSRAALSAA

SEQ ID NO: 430895 - protein, 8 aa, Mycobacterium
APSRDTPA

SEQ ID NO: 430896 - protein, 15 aa, Mycobacterium
APSREFDRPAPRLGS

SEQ ID NO: 430897 - protein, 10 aa, Mycobacterium
APSRIPGPWN

SEQ ID NO: 430898 - protein, 5 aa, Mycobacterium
APSRL

SEQ ID NO: 430899 - protein, 5 aa, Mycobacterium
APSRP

SEQ ID NO: 430900 - protein, 12 aa, Mycobacterium
APSRPDPSVQPG

SEQ ID NO: 430901 - protein, 9 aa, Mycobacterium
APSRPDQRR

SEQ ID NO: 430902 - protein, 8 aa, Mycobacterium
APSRPQAA

SEQ ID NO: 430903 - protein, 8 aa, Mycobacterium
APSRRTRM

SEQ ID NO: 430904 - protein, 9 aa, Mycobacterium
APSRSPLGS

SEQ ID NO: 430905 - protein, 7 aa, Mycobacterium
APSRSRL

SEQ ID NO: 430906 - protein, 16 aa, Mycobacterium
APSRTDGGTRRYSDED

SEQ ID NO: 430907 - protein, 6 aa, Mycobacterium
APSSAM

SEQ ID NO: 430908 - protein, 5 aa, Mycobacterium
APSSE

SEQ ID NO: 430909 - protein, 12 aa, Mycobacterium
APSSGSGKTTVA

SEQ ID NO: 430910 - protein, 9 aa, Mycobacterium
APSSHGTTF

SEQ ID NO: 430911 - protein, 8 aa, Mycobacterium
APSSIPAD

SEQ ID NO: 430912 - protein, 6 aa, Mycobacterium
APSSPI

SEQ ID NO: 430913 - protein, 7 aa, Mycobacterium
APSSPIA

SEQ ID NO: 430914 - protein, 8 aa, Mycobacterium
APSSRQAL

SEQ ID NO: 430915 - protein, 9 aa, Mycobacterium
APSSRRTKA

SEQ ID NO: 430916 - protein, 8 aa, Mycobacterium
APSSSDLE

SEQ ID NO: 430917 - protein, 21 aa, Mycobacterium
APSSSPQPYGVSAPAGPLGGE

SEQ ID NO: 430918 - protein, 4 aa, Mycobacterium
APST

SEQ ID NO: 430919 - protein, 7 aa, Mycobacterium
APSTANG

SEQ ID NO: 430920 - protein, 9 aa, Mycobacterium
APSTEDQAR

SEQ ID NO: 430921 - protein, 13 aa, Mycobacterium
APSTGAVTGEPDV

SEQ ID NO: 430922 - protein, 5 aa, Mycobacterium
APSTI

SEQ ID NO: 430923 - protein, 9 aa, Mycobacterium
APSTPAPVR

SEQ ID NO: 430924 - protein, 24 aa, Mycobacterium
APSTPEPLQPNADDEGRHAPTEEP

SEQ ID NO: 430925 - protein, 14 aa, Mycobacterium
APSTPFNAPLTSDR

SEQ ID NO: 430926 - protein, 8 aa, Mycobacterium
APSTPVEE

SEQ ID NO: 430927 - protein, 12 aa, Mycobacterium
APSTRQSGKGKH

SEQ ID NO: 430928 - protein, 8 aa, Mycobacterium
APSTSKLY

SEQ ID NO: 430929 - protein, 8 aa, Mycobacterium
APSTTGVP

SEQ ID NO: 430930 - protein, 10 aa, Mycobacterium
APSVGAPRRA

SEQ ID NO: 430931 - protein, 11 aa, Mycobacterium
APSVHSAAAER

SEQ ID NO: 430932 - protein, 9 aa, Mycobacterium
APSVRSGAN

SEQ ID NO: 430933 - protein, 15 aa, Mycobacterium
APSWDAGDPRTYSLS

SEQ ID NO: 430934 - protein, 13 aa, Mycobacterium
APSWEAGDPRTYS

SEQ ID NO: 430935 - protein, 13 aa, Mycobacterium
APSWTADYGSETL

SEQ ID NO: 430936 - protein, 7 aa, Mycobacterium
APSYTIG

SEQ ID NO: 430937 - protein, 30 aa, Mycobacterium
APTAADLESEGAGEEGAEAPADEAAEGSTE

SEQ ID NO: 430938 - protein, 5 aa, Mycobacterium
APTAD

SEQ ID NO: 430939 - protein, 5 aa, Mycobacterium
APTAE

SEQ ID NO: 430940 - protein, 6 aa, Mycobacterium
APTAEA

SEQ ID NO: 430941 - protein, 8 aa, Mycobacterium
APTAEAAA

SEQ ID NO: 430942 - protein, 17 aa, Mycobacterium
APTAEDLAEEGAGEVAE

SEQ ID NO: 430943 - protein, 40 aa, Mycobacterium
APTAEDLEEEGAGEGAEAEAAPAQEEAGEATDSGAAADES

SEQ ID NO: 430944 - protein, 32 aa, Mycobacterium
APTAEDLEQAGGEEGAESAAAEGEGGRAEAES

SEQ ID NO: 430945 - protein, 41 aa, Mycobacterium
APTAEDLESEGGGESAEEAAEGADEAAEGEGASEGEAAAES

SEQ ID NO: 430946 - protein, 39 aa, Mycobacterium
APTAEELAEEGAGEVTEEAAPAEGEAEEAGEEEASEAES

SEQ ID NO: 430947 - protein, 7 aa, Mycobacterium
APTAEKQ

SEQ ID NO: 430948 - protein, 5 aa, Mycobacterium
APTAG

SEQ ID NO: 430949 - protein, 7 aa, Mycobacterium
APTAGAA

SEQ ID NO: 430950 - protein, 14 aa, Mycobacterium
APTAPMEPSPYLPT

SEQ ID NO: 430951 - protein, 8 aa, Mycobacterium
APTASNAQ

SEQ ID NO: 430952 - protein, 8 aa, Mycobacterium
APTASNTQ

SEQ ID NO: 430953 - protein, 9 aa, Mycobacterium
APTASTGRA

SEQ ID NO: 430954 - protein, 9 aa, Mycobacterium
APTATQPLD

SEQ ID NO: 430955 - protein, 9 aa, Mycobacterium
APTATSPLN

SEQ ID NO: 430956 - protein, 9 aa, Mycobacterium
APTATTAPR

SEQ ID NO: 430957 - protein, 5 aa, Mycobacterium
APTAV

SEQ ID NO: 430958 - protein, 7 aa, Mycobacterium
APTAVPD

SEQ ID NO: 430959 - protein, 13 aa, Mycobacterium
APTAYDGDSPAEV

SEQ ID NO: 430960 - protein, 5 aa, Mycobacterium
APTDA

SEQ ID NO: 430961 - protein, 6 aa, Mycobacterium
APTDAD

SEQ ID NO: 430962 - protein, 8 aa, Mycobacterium
APTDALRR

SEQ ID NO: 430963 - protein, 9 aa, Mycobacterium
APTDALRRG

SEQ ID NO: 430964 - protein, 10 aa, Mycobacterium
APTDALRRGG

SEQ ID NO: 430965 - protein, 27 aa, Mycobacterium
APTDALRRGGYRSARPGEPAVTQFSIR

SEQ ID NO: 430966 - protein, 28 aa, Mycobacterium
APTDALRRGTYPVAAPGAAQTSVFSITV

SEQ ID NO: 430967 - protein, 6 aa, Mycobacterium
APTDAS

SEQ ID NO: 430968 - protein, 13 aa, Mycobacterium
APTDASELQARAD

SEQ ID NO: 430969 - protein, 7 aa, Mycobacterium
APTDASV

SEQ ID NO: 430970 - protein, 5 aa, Mycobacterium
APTDD

SEQ ID NO: 430971 - protein, 6 aa, Mycobacterium
APTDDD

SEQ ID NO: 430972 - protein, 10 aa, Mycobacterium
APTDDSGSQL

SEQ ID NO: 430973 - protein, 5 aa, Mycobacterium
APTDG

SEQ ID NO: 430974 - protein, 30 aa, Mycobacterium
APTDLAGPTEPTAPAEPVDEDAAADPAPAP

SEQ ID NO: 430975 - protein, 5 aa, Mycobacterium
APTDP

SEQ ID NO: 430976 - protein, 11 aa, Mycobacterium
APTDPEARDTL

SEQ ID NO: 430977 - protein, 7 aa, Mycobacterium
APTDPTA

SEQ ID NO: 430978 - protein, 20 aa, Mycobacterium
APTDQSDGGDVAAGPGDADL

SEQ ID NO: 430979 - protein, 5 aa, Mycobacterium
APTDR

SEQ ID NO: 430980 - protein, 9 aa, Mycobacterium
APTDRQPDS

SEQ ID NO: 430981 - protein, 12 aa, Mycobacterium
APTDSAEQEAQI

SEQ ID NO: 430982 - protein, 11 aa, Mycobacterium
APTDSPSVSPA

SEQ ID NO: 430983 - protein, 5 aa, Mycobacterium
APTDT

SEQ ID NO: 430984 - protein, 10 aa, Mycobacterium
APTDYDTPAK

SEQ ID NO: 430985 - protein, 9 aa, Mycobacterium
APTEDASAT

SEQ ID NO: 430986 - protein, 8 aa, Mycobacterium
APTEGSPA

SEQ ID NO: 430987 - protein, 14 aa, Mycobacterium
APTEPHGVCGTCQP

SEQ ID NO: 430988 - protein, 6 aa, Mycobacterium
APTERD

SEQ ID NO: 430989 - protein, 7 aa, Mycobacterium
APTERGA

SEQ ID NO: 430990 - protein, 12 aa, Mycobacterium
APTETGKTTGVL

SEQ ID NO: 430991 - protein, 4 aa, Mycobacterium
APTF

SEQ ID NO: 430992 - protein, 22 aa, Mycobacterium
APTGAAPELTPRRPLRDVLEIR

SEQ ID NO: 430993 - protein, 8 aa, Mycobacterium
APTGANGQ

SEQ ID NO: 430994 - protein, 5 aa, Mycobacterium
APTGD

SEQ ID NO: 430995 - protein, 13 aa, Mycobacterium
APTGDIAAAEDAL

SEQ ID NO: 430996 - protein, 5 aa, Mycobacterium
APTGE

SEQ ID NO: 430997 - protein, 19 aa, Mycobacterium
APTGELGSLSGHADAPPIS

SEQ ID NO: 430998 - protein, 10 aa, Mycobacterium
APTGERAPTR

SEQ ID NO: 430999 - protein, 9 aa, Mycobacterium
APTGEWGKS

SEQ ID NO: 431000 - protein, 5 aa, Mycobacterium
APTGG

SEQ ID NO: 431001 - protein, 21 aa, Mycobacterium
APTGGGNAGTRAGTSSPSVSA

SEQ ID NO: 431002 - protein, 8 aa, Mycobacterium
APTGGYDD

SEQ ID NO: 431003 - protein, 5 aa, Mycobacterium
APTGH

SEQ ID NO: 431004 - protein, 9 aa, Mycobacterium
APTGHKPAT

SEQ ID NO: 431005 - protein, 7 aa, Mycobacterium
APTGKAA

SEQ ID NO: 431006 - protein, 8 aa, Mycobacterium
APTGLAAD

SEQ ID NO: 431007 - protein, 9 aa, Mycobacterium
APTGPDDHR

SEQ ID NO: 431008 - protein, 8 aa, Mycobacterium
APTGPGVR

SEQ ID NO: 431009 - protein, 7 aa, Mycobacterium
APTGPRP

SEQ ID NO: 431010 - protein, 7 aa, Mycobacterium
APTGPTH

SEQ ID NO: 431011 - protein, 42 aa, Mycobacterium
APTGPVPAYPRASNDQSATPAPAPAASVSRPTAPRSADPGIE

SEQ ID NO: 431012 - protein, 11 aa, Mycobacterium
APTGQRTGDVM

SEQ ID NO: 431013 - protein, 6 aa, Mycobacterium
APTGRA

SEQ ID NO: 431014 - protein, 20 aa, Mycobacterium
APTGRKLKASQLEWSAYAEK

SEQ ID NO: 431015 - protein, 8 aa, Mycobacterium
APTGSGEP

SEQ ID NO: 431016 - protein, 8 aa, Mycobacterium
APTGSGKT

SEQ ID NO: 431017 - protein, 8 aa, Mycobacterium
APTGSNAQ

SEQ ID NO: 431018 - protein, 8 aa, Mycobacterium
APTGSNHQ

SEQ ID NO: 431019 - protein, 5 aa, Mycobacterium
APTGY

SEQ ID NO: 431020 - protein, 14 aa, Mycobacterium
APTGYRNPGQLPEG

SEQ ID NO: 431021 - protein, 5 aa, Mycobacterium
APTHP

SEQ ID NO: 431022 - protein, 11 aa, Mycobacterium
APTHPHPGVES

SEQ ID NO: 431023 - protein, 5 aa, Mycobacterium
APTHT

SEQ ID NO: 431024 - protein, 7 aa, Mycobacterium
APTIAPP

SEQ ID NO: 431025 - protein, 12 aa, Mycobacterium
APTIGGTTAVSG

SEQ ID NO: 431026 - protein, 7 aa, Mycobacterium
APTINDR

SEQ ID NO: 431027 - protein, 5 aa, Mycobacterium
APTKE

SEQ ID NO: 431028 - protein, 4 aa, Mycobacterium
APTL

SEQ ID NO: 431029 - protein, 6 aa, Mycobacterium
APTLAA

SEQ ID NO: 431030 - protein, 5 aa, Mycobacterium
APTLG

SEQ ID NO: 431031 - protein, 9 aa, Mycobacterium
APTLGGDPA

SEQ ID NO: 431032 - protein, 7 aa, Mycobacterium
APTLGQH

SEQ ID NO: 431033 - protein, 6 aa, Mycobacterium
APTLGS

SEQ ID NO: 431034 - protein, 6 aa, Mycobacterium
APTLSD

SEQ ID NO: 431035 - protein, 10 aa, Mycobacterium
APTLSPRRTT

SEQ ID NO: 431036 - protein, 17 aa, Mycobacterium
APTLSTAEFDGDAQEAL

SEQ ID NO: 431037 - protein, 5 aa, Mycobacterium
APTLT

SEQ ID NO: 431038 - protein, 6 aa, Mycobacterium
APTMGL

SEQ ID NO: 431039 - protein, 5 aa, Mycobacterium
APTMR

SEQ ID NO: 431040 - protein, 4 aa, Mycobacterium
APTN

SEQ ID NO: 431041 - protein, 7 aa, Mycobacterium
APTNAPL

SEQ ID NO: 431042 - protein, 8 aa, Mycobacterium
APTNAVPT

SEQ ID NO: 431043 - protein, 5 aa, Mycobacterium
APTNC

SEQ ID NO: 431044 - protein, 18 aa, Mycobacterium
APTNPGPCAQGPAAGLPA

SEQ ID NO: 431045 - protein, 12 aa, Mycobacterium
APTNVPAEGRLR

SEQ ID NO: 431046 - protein, 7 aa, Mycobacterium
APTPADE

SEQ ID NO: 431047 - protein, 7 aa, Mycobacterium
APTPAGL

SEQ ID NO: 431048 - protein, 6 aa, Mycobacterium
APTPAP

SEQ ID NO: 431049 - protein, 12 aa, Mycobacterium
APTPAPAELGPG

SEQ ID NO: 431050 - protein, 9 aa, Mycobacterium
APTPAQADA

SEQ ID NO: 431051 - protein, 8 aa, Mycobacterium
APTPAQAS

SEQ ID NO: 431052 - protein, 38 aa, Mycobacterium
APTPAYAAPGRMSSSGGGGIGFGSPRPSPNRPGGGRNK

SEQ ID NO: 431053 - protein, 8 aa, Mycobacterium
APTPEMSA

SEQ ID NO: 431054 - protein, 6 aa, Mycobacterium
APTPEN

SEQ ID NO: 431055 - protein, 20 aa, Mycobacterium
APTPESEATFDTDPGSALSN

SEQ ID NO: 431056 - protein, 17 aa, Mycobacterium
APTPGRPGARAAATGGY

SEQ ID NO: 431057 - protein, 7 aa, Mycobacterium
APTPGRR

SEQ ID NO: 431058 - protein, 12 aa, Mycobacterium
APTPGSPNGGPF

SEQ ID NO: 431059 - protein, 8 aa, Mycobacterium
APTPLQSN

SEQ ID NO: 431060 - protein, 12 aa, Mycobacterium
APTPPAPDSQNS

SEQ ID NO: 431061 - protein, 8 aa, Mycobacterium
APTPPVHS

SEQ ID NO: 431062 - protein, 7 aa, Mycobacterium
APTPPVS

SEQ ID NO: 431063 - protein, 6 aa, Mycobacterium
APTPQV

SEQ ID NO: 431064 - protein, 7 aa, Mycobacterium
APTPRAV

SEQ ID NO: 431065 - protein, 6 aa, Mycobacterium
APTPRI

SEQ ID NO: 431066 - protein, 11 aa, Mycobacterium
APTPSGNTRTY

SEQ ID NO: 431067 - protein, 8 aa, Mycobacterium
APTPSRPH

SEQ ID NO: 431068 - protein, 19 aa, Mycobacterium
APTPSSGSPEPAGRPQHGA

SEQ ID NO: 431069 - protein, 8 aa, Mycobacterium
APTPTDAA

SEQ ID NO: 431070 - protein, 5 aa, Mycobacterium
APTPV

SEQ ID NO: 431071 - protein, 8 aa, Mycobacterium
APTPVSDI

SEQ ID NO: 431072 - protein, 4 aa, Mycobacterium
APTQ

SEQ ID NO: 431073 - protein, 14 aa, Mycobacterium
APTQAEPRYTPSAG

SEQ ID NO: 431074 - protein, 8 aa, Mycobacterium
APTQALTG

SEQ ID NO: 431075 - protein, 17 aa, Mycobacterium
APTQHERRAQDSGQRAL

SEQ ID NO: 431076 - protein, 9 aa, Mycobacterium
APTQPEEAD

SEQ ID NO: 431077 - protein, 6 aa, Mycobacterium
APTQSH

SEQ ID NO: 431078 - protein, 5 aa, Mycobacterium
APTRD

SEQ ID NO: 431079 - protein, 6 aa, Mycobacterium
APTREG

SEQ ID NO: 431080 - protein, 6 aa, Mycobacterium
APTREN

SEQ ID NO: 431081 - protein, 8 aa, Mycobacterium
APTRGTVT

SEQ ID NO: 431082 - protein, 11 aa, Mycobacterium
APTRPHAGVES

SEQ ID NO: 431083 - protein, 11 aa, Mycobacterium
APTRPHPGVES

SEQ ID NO: 431084 - protein, 17 aa, Mycobacterium
APTRRAAARRRGGDPIT

SEQ ID NO: 431085 - protein, 7 aa, Mycobacterium
APTRRQV

SEQ ID NO: 431086 - protein, 7 aa, Mycobacterium
APTRRRA

SEQ ID NO: 431087 - protein, 8 aa, Mycobacterium
APTRRRVD

SEQ ID NO: 431088 - protein, 15 aa, Mycobacterium
APTRRSAARRRGGDP

SEQ ID NO: 431089 - protein, 18 aa, Mycobacterium
APTRRSAARRRGGDPVTR

SEQ ID NO: 431090 - protein, 16 aa, Mycobacterium
APTRRTAARRRGGDPV

SEQ ID NO: 431091 - protein, 5 aa, Mycobacterium
APTRS

SEQ ID NO: 431092 - protein, 6 aa, Mycobacterium
APTRSL

SEQ ID NO: 431093 - protein, 5 aa, Mycobacterium
APTRT

SEQ ID NO: 431094 - protein, 7 aa, Mycobacterium
APTRTEA

SEQ ID NO: 431095 - protein, 9 aa, Mycobacterium
APTSASVSD

SEQ ID NO: 431096 - protein, 5 aa, Mycobacterium
APTSD

SEQ ID NO: 431097 - protein, 5 aa, Mycobacterium
APTSL

SEQ ID NO: 431098 - protein, 6 aa, Mycobacterium
APTSPT

SEQ ID NO: 431099 - protein, 7 aa, Mycobacterium
APTSPYT

SEQ ID NO: 431100 - protein, 10 aa, Mycobacterium
APTSRFGTPD

SEQ ID NO: 431101 - protein, 9 aa, Mycobacterium
APTSSRVSE

SEQ ID NO: 431102 - protein, 6 aa, Mycobacterium
APTSTA

SEQ ID NO: 431103 - protein, 16 aa, Mycobacterium
APTSTVRGWERLRVLV

SEQ ID NO: 431104 - protein, 6 aa, Mycobacterium
APTTDG

SEQ ID NO: 431105 - protein, 7 aa, Mycobacterium
APTTDPV

SEQ ID NO: 431106 - protein, 10 aa, Mycobacterium
APTTGDAPYA

SEQ ID NO: 431107 - protein, 12 aa, Mycobacterium
APTTGGDAPGLG

SEQ ID NO: 431108 - protein, 13 aa, Mycobacterium
APTTGSPAVAEGP

SEQ ID NO: 431109 - protein, 9 aa, Mycobacterium
APTTGSPYG

SEQ ID NO: 431110 - protein, 11 aa, Mycobacterium
APTTGWAGSED

SEQ ID NO: 431111 - protein, 33 aa, Mycobacterium
APTTPGRRGAAPGPNLPRAPRAYAAPDLTRARR

SEQ ID NO: 431112 - protein, 14 aa, Mycobacterium
APTTQAAKRSTTER

SEQ ID NO: 431113 - protein, 9 aa, Mycobacterium
APTTQAHKR

SEQ ID NO: 431114 - protein, 8 aa, Mycobacterium
APTTQSAD

SEQ ID NO: 431115 - protein, 15 aa, Mycobacterium
APTTSLPEEIGGERN

SEQ ID NO: 431116 - protein, 12 aa, Mycobacterium
APTTVVDSDEND

SEQ ID NO: 431117 - protein, 10 aa, Mycobacterium
APTVAQSGGD

SEQ ID NO: 431118 - protein, 10 aa, Mycobacterium
APTVAQTGSE

SEQ ID NO: 431119 - protein, 7 aa, Mycobacterium
APTVATE

SEQ ID NO: 431120 - protein, 53 aa, Mycobacterium
APTVGGQGGNGGSANLIGNGGNGGNGGFAKTPGAGGAGGAGGRLLGQNGLNGL

SEQ ID NO: 431121 - protein, 11 aa, Mycobacterium
APTVGGTTAVS

SEQ ID NO: 431122 - protein, 11 aa, Mycobacterium
APTVHQSAAER

SEQ ID NO: 431123 - protein, 10 aa, Mycobacterium
APTVQGTRST

SEQ ID NO: 431124 - protein, 13 aa, Mycobacterium
APTWDAGDPRTYS

SEQ ID NO: 431125 - protein, 13 aa, Mycobacterium
APTWEAGDPRTYS

SEQ ID NO: 431126 - protein, 5 aa, Mycobacterium
APTYI

SEQ ID NO: 431127 - protein, 4 aa, Mycobacterium
APVA

SEQ ID NO: 431128 - protein, 6 aa, Mycobacterium
APVAAV

SEQ ID NO: 431129 - protein, 5 aa, Mycobacterium
APVAG

SEQ ID NO: 431130 - protein, 7 aa, Mycobacterium
APVAGER

SEQ ID NO: 431131 - protein, 7 aa, Mycobacterium
APVAGGY

SEQ ID NO: 431132 - protein, 8 aa, Mycobacterium
APVANGAN

SEQ ID NO: 431133 - protein, 10 aa, Mycobacterium
APVAPRDTYK

SEQ ID NO: 431134 - protein, 10 aa, Mycobacterium
APVASASRAG

SEQ ID NO: 431135 - protein, 5 aa, Mycobacterium
APVAT

SEQ ID NO: 431136 - protein, 5 aa, Mycobacterium
APVDA

SEQ ID NO: 431137 - protein, 9 aa, Mycobacterium
APVDAAGDL

SEQ ID NO: 431138 - protein, 6 aa, Mycobacterium
APVDDQ

SEQ ID NO: 431139 - protein, 6 aa, Mycobacterium
APVDEC

SEQ ID NO: 431140 - protein, 6 aa, Mycobacterium
APVDHS

SEQ ID NO: 431141 - protein, 11 aa, Mycobacterium
APVDLTNEAGD

SEQ ID NO: 431142 - protein, 6 aa, Mycobacterium
APVDPA

SEQ ID NO: 431143 - protein, 8 aa, Mycobacterium
APVDPDHR

SEQ ID NO: 431144 - protein, 6 aa, Mycobacterium
APVDPP

SEQ ID NO: 431145 - protein, 10 aa, Mycobacterium
APVDPTDRHA

SEQ ID NO: 431146 - protein, 5 aa, Mycobacterium
APVDR

SEQ ID NO: 431147 - protein, 5 aa, Mycobacterium
APVEA

SEQ ID NO: 431148 - protein, 6 aa, Mycobacterium
APVEAD

SEQ ID NO: 431149 - protein, 14 aa, Mycobacterium
APVEGDADVDEGET

SEQ ID NO: 431150 - protein, 13 aa, Mycobacterium
APVEGTSNFGVFR

SEQ ID NO: 431151 - protein, 6 aa, Mycobacterium
APVEPA

SEQ ID NO: 431152 - protein, 37 aa, Mycobacterium
APVEPTAPSEPTEETTEPTEESAEPTQETSEAQPESV

SEQ ID NO: 431153 - protein, 7 aa, Mycobacterium
APVEPTP

SEQ ID NO: 431154 - protein, 5 aa, Mycobacterium
APVGA

SEQ ID NO: 431155 - protein, 10 aa, Mycobacterium
APVGAGGQEF

SEQ ID NO: 431156 - protein, 9 aa, Mycobacterium
APVGDARPD

SEQ ID NO: 431157 - protein, 12 aa, Mycobacterium
APVGDEAARAAG

SEQ ID NO: 431158 - protein, 12 aa, Mycobacterium
APVGDVTGPGRQ

SEQ ID NO: 431159 - protein, 6 aa, Mycobacterium
APVGEA

SEQ ID NO: 431160 - protein, 11 aa, Mycobacterium
APVGPVPPGES

SEQ ID NO: 431161 - protein, 4 aa, Mycobacterium
APVI

SEQ ID NO: 431162 - protein, 7 aa, Mycobacterium
APVKEPY

SEQ ID NO: 431163 - protein, 4 aa, Mycobacterium
APVN

SEQ ID NO: 431164 - protein, 6 aa, Mycobacterium
APVNGY

SEQ ID NO: 431165 - protein, 9 aa, Mycobacterium
APVNTDSPV

SEQ ID NO: 431166 - protein, 7 aa, Mycobacterium
APVPAGA

SEQ ID NO: 431167 - protein, 8 aa, Mycobacterium
APVPAGAS

SEQ ID NO: 431168 - protein, 13 aa, Mycobacterium
APVPARDAYKPRQ

SEQ ID NO: 431169 - protein, 10 aa, Mycobacterium
APVPASATET

SEQ ID NO: 431170 - protein, 25 aa, Mycobacterium
APVPASSGKTTRHRLSRGGDRTANN

SEQ ID NO: 431171 - protein, 6 aa, Mycobacterium
APVPAY

SEQ ID NO: 431172 - protein, 6 aa, Mycobacterium
APVPDE

SEQ ID NO: 431173 - protein, 10 aa, Mycobacterium
APVPEGAPAA

SEQ ID NO: 431174 - protein, 8 aa, Mycobacterium
APVPEIAD

SEQ ID NO: 431175 - protein, 6 aa, Mycobacterium
APVPEL

SEQ ID NO: 431176 - protein, 8 aa, Mycobacterium
APVPELRS

SEQ ID NO: 431177 - protein, 16 aa, Mycobacterium
APVPERDDGGYTPGLP

SEQ ID NO: 431178 - protein, 15 aa, Mycobacterium
APVPGEVRPRSLGDP

SEQ ID NO: 431179 - protein, 20 aa, Mycobacterium
APVPGIPKNRSLGHRSHDPA

SEQ ID NO: 431180 - protein, 6 aa, Mycobacterium
APVPGR

SEQ ID NO: 431181 - protein, 16 aa, Mycobacterium
APVPGVPRNRSLGHRS

SEQ ID NO: 431182 - protein, 10 aa, Mycobacterium
APVPGYRGPR

SEQ ID NO: 431183 - protein, 10 aa, Mycobacterium
APVPGYRGSR

SEQ ID NO: 431184 - protein, 6 aa, Mycobacterium
APVPLR

SEQ ID NO: 431185 - protein, 6 aa, Mycobacterium
APVPPE

SEQ ID NO: 431186 - protein, 7 aa, Mycobacterium
APVPPGD

SEQ ID NO: 431187 - protein, 7 aa, Mycobacterium
APVPQAE

SEQ ID NO: 431188 - protein, 18 aa, Mycobacterium
APVPQTRRTRHTLPGDDE

SEQ ID NO: 431189 - protein, 5 aa, Mycobacterium
APVPR

SEQ ID NO: 431190 - protein, 10 aa, Mycobacterium
APVPRPGPGE

SEQ ID NO: 431191 - protein, 16 aa, Mycobacterium
APVPRRRPTLRRPRVK

SEQ ID NO: 431192 - protein, 6 aa, Mycobacterium
APVPRT

SEQ ID NO: 431193 - protein, 13 aa, Mycobacterium
APVPSRFGGSRSM

SEQ ID NO: 431194 - protein, 25 aa, Mycobacterium
APVPSVKSDAKGTFTSSSSLRNPFP

SEQ ID NO: 431195 - protein, 15 aa, Mycobacterium
APVPVRQARGDGEDW

SEQ ID NO: 431196 - protein, 6 aa, Mycobacterium
APVPVT

SEQ ID NO: 431197 - protein, 6 aa, Mycobacterium
APVQQR

SEQ ID NO: 431198 - protein, 9 aa, Mycobacterium
APVQSATEY

SEQ ID NO: 431199 - protein, 5 aa, Mycobacterium
APVRA

SEQ ID NO: 431200 - protein, 20 aa, Mycobacterium
APVRAANPQFQRGDGVTLSD

SEQ ID NO: 431201 - protein, 6 aa, Mycobacterium
APVRAS

SEQ ID NO: 431202 - protein, 8 aa, Mycobacterium
APVRDRGG

SEQ ID NO: 431203 - protein, 21 aa, Mycobacterium
APVRPDDEHSGDAELTSPMPG

SEQ ID NO: 431204 - protein, 6 aa, Mycobacterium
APVRPE

SEQ ID NO: 431205 - protein, 12 aa, Mycobacterium
APVRPRGSPRCP

SEQ ID NO: 431206 - protein, 11 aa, Mycobacterium
APVRSDGPHYP

SEQ ID NO: 431207 - protein, 6 aa, Mycobacterium
APVRTA

SEQ ID NO: 431208 - protein, 6 aa, Mycobacterium
APVRTS

SEQ ID NO: 431209 - protein, 30 aa, Mycobacterium
APVSATAPAPATALTAGGPPPVPPAAGGAG

SEQ ID NO: 431210 - protein, 8 aa, Mycobacterium
APVSDPGQ

SEQ ID NO: 431211 - protein, 10 aa, Mycobacterium
APVSDPTQQR

SEQ ID NO: 431212 - protein, 10 aa, Mycobacterium
APVSDPTRQR

SEQ ID NO: 431213 - protein, 11 aa, Mycobacterium
APVSELRSGGL

SEQ ID NO: 431214 - protein, 13 aa, Mycobacterium
APVSGGVKGAAAG

SEQ ID NO: 431215 - protein, 11 aa, Mycobacterium
APVSGGVNGAV

SEQ ID NO: 431216 - protein, 13 aa, Mycobacterium
APVSGGVPGATAA

SEQ ID NO: 431217 - protein, 7 aa, Mycobacterium
APVSSDT

SEQ ID NO: 431218 - protein, 9 aa, Mycobacterium
APVSWPDGK

SEQ ID NO: 431219 - protein, 5 aa, Mycobacterium
APVTE

SEQ ID NO: 431220 - protein, 8 aa, Mycobacterium
APVTEENN

SEQ ID NO: 431221 - protein, 12 aa, Mycobacterium
APVTFSTPTDTL

SEQ ID NO: 431222 - protein, 8 aa, Mycobacterium
APVTPDGD

SEQ ID NO: 431223 - protein, 13 aa, Mycobacterium
APVTPVDAKGRFD

SEQ ID NO: 431224 - protein, 14 aa, Mycobacterium
APVTPVDAKGRFDA

SEQ ID NO: 431225 - protein, 21 aa, Mycobacterium
APVTPVDSKGRFDASVPDYQG

SEQ ID NO: 431226 - protein, 6 aa, Mycobacterium
APVTPY

SEQ ID NO: 431227 - protein, 5 aa, Mycobacterium
APVTR

SEQ ID NO: 431228 - protein, 10 aa, Mycobacterium
APVTSAGPHY

SEQ ID NO: 431229 - protein, 10 aa, Mycobacterium
APVTTTAGSI

SEQ ID NO: 431230 - protein, 20 aa, Mycobacterium
APVTTTNGPVTTSAAGCAGN

SEQ ID NO: 431231 - protein, 6 aa, Mycobacterium
APVTVT

SEQ ID NO: 431232 - protein, 4 aa, Mycobacterium
APVV

SEQ ID NO: 431233 - protein, 5 aa, Mycobacterium
APVYR

SEQ ID NO: 431234 - protein, 17 aa, Mycobacterium
APWDSDPVGAEQVSGPH

SEQ ID NO: 431235 - protein, 8 aa, Mycobacterium
APWGEPTT

SEQ ID NO: 431236 - protein, 6 aa, Mycobacterium
APWGPV

SEQ ID NO: 431237 - protein, 5 aa, Mycobacterium
APWND

SEQ ID NO: 431238 - protein, 6 aa, Mycobacterium
APWNDM

SEQ ID NO: 431239 - protein, 5 aa, Mycobacterium
APWPA

SEQ ID NO: 431240 - protein, 5 aa, Mycobacterium
APWPP

SEQ ID NO: 431241 - protein, 4 aa, Mycobacterium
APWQ

SEQ ID NO: 431242 - protein, 24 aa, Mycobacterium
APWRDGSTPVNVSGGLQSKGHPIA

SEQ ID NO: 431243 - protein, 8 aa, Mycobacterium
APWSSGSV

SEQ ID NO: 431244 - protein, 7 aa, Mycobacterium
APWSTGH

SEQ ID NO: 431245 - protein, 4 aa, Mycobacterium
APWT

SEQ ID NO: 431246 - protein, 6 aa, Mycobacterium
APWTDS

SEQ ID NO: 431247 - protein, 9 aa, Mycobacterium
APYAADETR

SEQ ID NO: 431248 - protein, 12 aa, Mycobacterium
APYAEGDDFHPE

SEQ ID NO: 431249 - protein, 6 aa, Mycobacterium
APYAPR

SEQ ID NO: 431250 - protein, 14 aa, Mycobacterium
APYDESPETGATFE

SEQ ID NO: 431251 - protein, 13 aa, Mycobacterium
APYDGRTGNAGHA

SEQ ID NO: 431252 - protein, 9 aa, Mycobacterium
APYDPASQR

SEQ ID NO: 431253 - protein, 5 aa, Mycobacterium
APYDR

SEQ ID NO: 431254 - protein, 11 aa, Mycobacterium
APYDRQKIEDN

SEQ ID NO: 431255 - protein, 6 aa, Mycobacterium
APYEAT

SEQ ID NO: 431256 - protein, 9 aa, Mycobacterium
APYEPDSPR

SEQ ID NO: 431257 - protein, 5 aa, Mycobacterium
APYET

SEQ ID NO: 431258 - protein, 7 aa, Mycobacterium
APYGPDG

SEQ ID NO: 431259 - protein, 9 aa, Mycobacterium
APYGPEPHE

SEQ ID NO: 431260 - protein, 7 aa, Mycobacterium
APYGPGD

SEQ ID NO: 431261 - protein, 9 aa, Mycobacterium
APYGRAADS

SEQ ID NO: 431262 - protein, 11 aa, Mycobacterium
APYGRGASPAE

SEQ ID NO: 431263 - protein, 8 aa, Mycobacterium
APYGVEPA

SEQ ID NO: 431264 - protein, 9 aa, Mycobacterium
APYGVEPQQ

SEQ ID NO: 431265 - protein, 10 aa, Mycobacterium
APYGVEPQRA

SEQ ID NO: 431266 - protein, 7 aa, Mycobacterium
APYNASK

SEQ ID NO: 431267 - protein, 6 aa, Mycobacterium
APYPAE

SEQ ID NO: 431268 - protein, 8 aa, Mycobacterium
APYPAMPT

SEQ ID NO: 431269 - protein, 6 aa, Mycobacterium
APYPDY

SEQ ID NO: 431270 - protein, 7 aa, Mycobacterium
APYPGAS

SEQ ID NO: 431271 - protein, 6 aa, Mycobacterium
APYPRA

SEQ ID NO: 431272 - protein, 5 aa, Mycobacterium
APYQD

SEQ ID NO: 431273 - protein, 11 aa, Mycobacterium
APYQIPTDGSC

SEQ ID NO: 431274 - protein, 12 aa, Mycobacterium
APYRGADEQEPA

SEQ ID NO: 431275 - protein, 9 aa, Mycobacterium
APYSDGGIP

SEQ ID NO: 431276 - protein, 8 aa, Mycobacterium
APYSESGI

SEQ ID NO: 431277 - protein, 5 aa, Mycobacterium
APYSG

SEQ ID NO: 431278 - protein, 5 aa, Mycobacterium
APYTE

SEQ ID NO: 431279 - protein, 4 aa, Mycobacterium
APYY

SEQ ID NO: 431280 - protein, 5 aa, Mycobacterium
AQAAA

SEQ ID NO: 431281 - protein, 9 aa, Mycobacterium
AQAAAAPID

SEQ ID NO: 431282 - protein, 8 aa, Mycobacterium
AQAAAEHL

SEQ ID NO: 431283 - protein, 11 aa, Mycobacterium
AQAAALADGDI

SEQ ID NO: 431284 - protein, 7 aa, Mycobacterium
AQAAASE

SEQ ID NO: 431285 - protein, 10 aa, Mycobacterium
AQAAASPEFS

SEQ ID NO: 431286 - protein, 16 aa, Mycobacterium
AQAAAVAAQTKRDERA

SEQ ID NO: 431287 - protein, 9 aa, Mycobacterium
AQAADGYEA

SEQ ID NO: 431288 - protein, 17 aa, Mycobacterium
AQAAEASAAGDPAGDEY

SEQ ID NO: 431289 - protein, 8 aa, Mycobacterium
AQAAEEGC

SEQ ID NO: 431290 - protein, 5 aa, Mycobacterium
AQAAG

SEQ ID NO: 431291 - protein, 13 aa, Mycobacterium
AQAAGAAAPTITA

SEQ ID NO: 431292 - protein, 12 aa, Mycobacterium
AQAAGGQVSDEQ

SEQ ID NO: 431293 - protein, 10 aa, Mycobacterium
AQAAGISREE

SEQ ID NO: 431294 - protein, 8 aa, Mycobacterium
AQAAGKLG

SEQ ID NO: 431295 - protein, 9 aa, Mycobacterium
AQAAGSAMA

SEQ ID NO: 431296 - protein, 10 aa, Mycobacterium
AQAAGSAMSG

SEQ ID NO: 431297 - protein, 5 aa, Mycobacterium
AQAAI

SEQ ID NO: 431298 - protein, 7 aa, Mycobacterium
AQAAIPG

SEQ ID NO: 431299 - protein, 5 aa, Mycobacterium
AQAAN

SEQ ID NO: 431300 - protein, 10 aa, Mycobacterium
AQAANTTGLA

SEQ ID NO: 431301 - protein, 12 aa, Mycobacterium
AQAAPGQDAYTN

SEQ ID NO: 431302 - protein, 8 aa, Mycobacterium
AQAAPTRF

SEQ ID NO: 431303 - protein, 8 aa, Mycobacterium
AQAARAGR

SEQ ID NO: 431304 - protein, 9 aa, Mycobacterium
AQAARAQEQ

SEQ ID NO: 431305 - protein, 11 aa, Mycobacterium
AQAARDGIPRA

SEQ ID NO: 431306 - protein, 9 aa, Mycobacterium
AQAARDYNN

SEQ ID NO: 431307 - protein, 6 aa, Mycobacterium
AQAARN

SEQ ID NO: 431308 - protein, 9 aa, Mycobacterium
AQAARNESI

SEQ ID NO: 431309 - protein, 15 aa, Mycobacterium
AQAARTAQKSFDDAQ

SEQ ID NO: 431310 - protein, 8 aa, Mycobacterium
AQAASGAT

SEQ ID NO: 431311 - protein, 9 aa, Mycobacterium
AQAASPRPL

SEQ ID NO: 431312 - protein, 10 aa, Mycobacterium
AQAATSMDQG

SEQ ID NO: 431313 - protein, 26 aa, Mycobacterium
AQAAVSPPVTQQPDGQVRPLASPGQA

SEQ ID NO: 431314 - protein, 4 aa, Mycobacterium
AQAC

SEQ ID NO: 431315 - protein, 9 aa, Mycobacterium
AQACGTDPI

SEQ ID NO: 431316 - protein, 6 aa, Mycobacterium
AQADDE

SEQ ID NO: 431317 - protein, 6 aa, Mycobacterium
AQADGA

SEQ ID NO: 431318 - protein, 11 aa, Mycobacterium
AQADGALTPDH

SEQ ID NO: 431319 - protein, 12 aa, Mycobacterium
AQADGSHYTSTG

SEQ ID NO: 431320 - protein, 10 aa, Mycobacterium
AQADGTLTPD

SEQ ID NO: 431321 - protein, 8 aa, Mycobacterium
AQADQARP

SEQ ID NO: 431322 - protein, 8 aa, Mycobacterium
AQADRGEL

SEQ ID NO: 431323 - protein, 8 aa, Mycobacterium
AQADRSLQ

SEQ ID NO: 431324 - protein, 9 aa, Mycobacterium
AQADRVAEG

SEQ ID NO: 431325 - protein, 12 aa, Mycobacterium
AQADSDAADDVT

SEQ ID NO: 431326 - protein, 19 aa, Mycobacterium
AQADSRKGAELAKQLLAQR

SEQ ID NO: 431327 - protein, 15 aa, Mycobacterium
AQADSVSEAMAGAAE

SEQ ID NO: 431328 - protein, 17 aa, Mycobacterium
AQADTARPATAADARSW

SEQ ID NO: 431329 - protein, 6 aa, Mycobacterium
AQADTL

SEQ ID NO: 431330 - protein, 8 aa, Mycobacterium
AQADTVDA

SEQ ID NO: 431331 - protein, 8 aa, Mycobacterium
AQADTVEE

SEQ ID NO: 431332 - protein, 6 aa, Mycobacterium
AQAEAA

SEQ ID NO: 431333 - protein, 8 aa, Mycobacterium
AQAEAERE

SEQ ID NO: 431334 - protein, 10 aa, Mycobacterium
AQAEALTAGD

SEQ ID NO: 431335 - protein, 8 aa, Mycobacterium
AQAEDEGL

SEQ ID NO: 431336 - protein, 12 aa, Mycobacterium
AQAEEAASQGRV

SEQ ID NO: 431337 - protein, 7 aa, Mycobacterium
AQAEERH

SEQ ID NO: 431338 - protein, 6 aa, Mycobacterium
AQAEES

SEQ ID NO: 431339 - protein, 8 aa, Mycobacterium
AQAEHQNE

SEQ ID NO: 431340 - protein, 6 aa, Mycobacterium
AQAEHT

SEQ ID NO: 431341 - protein, 9 aa, Mycobacterium
AQAEKGNKI

SEQ ID NO: 431342 - protein, 17 aa, Mycobacterium
AQAELAGSQAKVAASAY

SEQ ID NO: 431343 - protein, 5 aa, Mycobacterium
AQAEN

SEQ ID NO: 431344 - protein, 8 aa, Mycobacterium
AQAENFPT

SEQ ID NO: 431345 - protein, 8 aa, Mycobacterium
AQAENPGR

SEQ ID NO: 431346 - protein, 6 aa, Mycobacterium
AQAEPS

SEQ ID NO: 431347 - protein, 7 aa, Mycobacterium
AQAEPYR

SEQ ID NO: 431348 - protein, 9 aa, Mycobacterium
AQAEQAAMS

SEQ ID NO: 431349 - protein, 14 aa, Mycobacterium
AQAEQAASQARAAA

SEQ ID NO: 431350 - protein, 7 aa, Mycobacterium
AQAEQPG

SEQ ID NO: 431351 - protein, 14 aa, Mycobacterium
AQAEQTASQARGAA

SEQ ID NO: 431352 - protein, 5 aa, Mycobacterium
AQAER

SEQ ID NO: 431353 - protein, 6 aa, Mycobacterium
AQAERA

SEQ ID NO: 431354 - protein, 6 aa, Mycobacterium
AQAERG

SEQ ID NO: 431355 - protein, 23 aa, Mycobacterium
AQAERGPHPTDVDTTTLRPAGDG

SEQ ID NO: 431356 - protein, 9 aa, Mycobacterium
AQAERGQHR

SEQ ID NO: 431357 - protein, 11 aa, Mycobacterium
AQAERSGEPIA

SEQ ID NO: 431358 - protein, 20 aa, Mycobacterium
AQAERSRQPITPLTDGNPDI

SEQ ID NO: 431359 - protein, 18 aa, Mycobacterium
AQAERSRQPITPLTPSYP

SEQ ID NO: 431360 - protein, 7 aa, Mycobacterium
AQAESAR

SEQ ID NO: 431361 - protein, 6 aa, Mycobacterium
AQAESL

SEQ ID NO: 431362 - protein, 9 aa, Mycobacterium
AQAESLTGA

SEQ ID NO: 431363 - protein, 6 aa, Mycobacterium
AQAESS

SEQ ID NO: 431364 - protein, 9 aa, Mycobacterium
AQAETERDA

SEQ ID NO: 431365 - protein, 14 aa, Mycobacterium
AQAETSQGVGAHRD

SEQ ID NO: 431366 - protein, 5 aa, Mycobacterium
AQAFP

SEQ ID NO: 431367 - protein, 7 aa, Mycobacterium
AQAGAAE

SEQ ID NO: 431368 - protein, 13 aa, Mycobacterium
AQAGAPNQKSKGD

SEQ ID NO: 431369 - protein, 13 aa, Mycobacterium
AQAGAWEGPSAEQ

SEQ ID NO: 431370 - protein, 8 aa, Mycobacterium
AQAGEAVG

SEQ ID NO: 431371 - protein, 10 aa, Mycobacterium
AQAGGGAPVA

SEQ ID NO: 431372 - protein, 8 aa, Mycobacterium
AQAGGSTV

SEQ ID NO: 431373 - protein, 8 aa, Mycobacterium
AQAGNATL

SEQ ID NO: 431374 - protein, 12 aa, Mycobacterium
AQAGPGGDELTQ

SEQ ID NO: 431375 - protein, 22 aa, Mycobacterium
AQAGPKADARPVPVPAGPADEP

SEQ ID NO: 431376 - protein, 10 aa, Mycobacterium
AQAGPKRQAA

SEQ ID NO: 431377 - protein, 8 aa, Mycobacterium
AQAGPRAP

SEQ ID NO: 431378 - protein, 7 aa, Mycobacterium
AQAGQLG

SEQ ID NO: 431379 - protein, 5 aa, Mycobacterium
AQAGR

SEQ ID NO: 431380 - protein, 11 aa, Mycobacterium
AQAGRAVTAAP

SEQ ID NO: 431381 - protein, 8 aa, Mycobacterium
AQAGRGEP

SEQ ID NO: 431382 - protein, 8 aa, Mycobacterium
AQAGRRAV

SEQ ID NO: 431383 - protein, 7 aa, Mycobacterium
AQAGRSI

SEQ ID NO: 431384 - protein, 7 aa, Mycobacterium
AQAGSDI

SEQ ID NO: 431385 - protein, 17 aa, Mycobacterium
AQAGSSSSAASSASTPV

SEQ ID NO: 431386 - protein, 21 aa, Mycobacterium
AQAGTDIATRQTSVNPRRAVG

SEQ ID NO: 431387 - protein, 5 aa, Mycobacterium
AQAGV

SEQ ID NO: 431388 - protein, 11 aa, Mycobacterium
AQAGYRSRSTG

SEQ ID NO: 431389 - protein, 37 aa, Mycobacterium
AQAGYSSHARRAGDRAGRRARLGASPELAGARAALDK

SEQ ID NO: 431390 - protein, 7 aa, Mycobacterium
AQAHPES

SEQ ID NO: 431391 - protein, 6 aa, Mycobacterium
AQAHPK

SEQ ID NO: 431392 - protein, 25 aa, Mycobacterium
AQAKANQAAAEAEQESQRKQAEFAR

SEQ ID NO: 431393 - protein, 9 aa, Mycobacterium
AQAKDAGAQ

SEQ ID NO: 431394 - protein, 14 aa, Mycobacterium
AQAKIEKASAPDLF

SEQ ID NO: 431395 - protein, 6 aa, Mycobacterium
AQAKKE

SEQ ID NO: 431396 - protein, 11 aa, Mycobacterium
AQAKPSKWPGA

SEQ ID NO: 431397 - protein, 5 aa, Mycobacterium
AQAKR

SEQ ID NO: 431398 - protein, 11 aa, Mycobacterium
AQAKSAVTESG

SEQ ID NO: 431399 - protein, 6 aa, Mycobacterium
AQALNQ

SEQ ID NO: 431400 - protein, 8 aa, Mycobacterium
AQALQSPK

SEQ ID NO: 431401 - protein, 8 aa, Mycobacterium
AQALSTSP

SEQ ID NO: 431402 - protein, 5 aa, Mycobacterium
AQAMQ

SEQ ID NO: 431403 - protein, 13 aa, Mycobacterium
AQAMTGTTEASTY

SEQ ID NO: 431404 - protein, 4 aa, Mycobacterium
AQAN

SEQ ID NO: 431405 - protein, 9 aa, Mycobacterium
AQANADETI

SEQ ID NO: 431406 - protein, 10 aa, Mycobacterium
AQANATANRY

SEQ ID NO: 431407 - protein, 7 aa, Mycobacterium
AQANDGT

SEQ ID NO: 431408 - protein, 6 aa, Mycobacterium
AQANDK

SEQ ID NO: 431409 - protein, 6 aa, Mycobacterium
AQANDT

SEQ ID NO: 431410 - protein, 8 aa, Mycobacterium
AQANGDAP

SEQ ID NO: 431411 - protein, 8 aa, Mycobacterium
AQANGIKP

SEQ ID NO: 431412 - protein, 16 aa, Mycobacterium
AQAPASDRDGRQSAAR

SEQ ID NO: 431413 - protein, 9 aa, Mycobacterium
AQAPDAAGY

SEQ ID NO: 431414 - protein, 19 aa, Mycobacterium
AQAPDPTKGFQSPIRGHEG

SEQ ID NO: 431415 - protein, 5 aa, Mycobacterium
AQAPE

SEQ ID NO: 431416 - protein, 8 aa, Mycobacterium
AQAPEAAG

SEQ ID NO: 431417 - protein, 15 aa, Mycobacterium
AQAPEAQPLTYGQSV

SEQ ID NO: 431418 - protein, 10 aa, Mycobacterium
AQAPGDGASR

SEQ ID NO: 431419 - protein, 6 aa, Mycobacterium
AQAPGL

SEQ ID NO: 431420 - protein, 10 aa, Mycobacterium
AQAPGYPTSL

SEQ ID NO: 431421 - protein, 7 aa, Mycobacterium
AQAPKID

SEQ ID NO: 431422 - protein, 13 aa, Mycobacterium
AQAPLGADGGDVT

SEQ ID NO: 431423 - protein, 6 aa, Mycobacterium
AQAPLP

SEQ ID NO: 431424 - protein, 10 aa, Mycobacterium
AQAPPRLTTP

SEQ ID NO: 431425 - protein, 7 aa, Mycobacterium
AQAPPVA

SEQ ID NO: 431426 - protein, 21 aa, Mycobacterium
AQAPQAAASGLQGLQSAGGLG

SEQ ID NO: 431427 - protein, 18 aa, Mycobacterium
AQAPRAPHAPEGAYPGTC

SEQ ID NO: 431428 - protein, 10 aa, Mycobacterium
AQAPSTPISS

SEQ ID NO: 431429 - protein, 7 aa, Mycobacterium
AQAPSWR

SEQ ID NO: 431430 - protein, 18 aa, Mycobacterium
AQAPTPSAPSTATATQGL

SEQ ID NO: 431431 - protein, 4 aa, Mycobacterium
AQAQ

SEQ ID NO: 431432 - protein, 5 aa, Mycobacterium
AQAQA

SEQ ID NO: 431433 - protein, 12 aa, Mycobacterium
AQAQAHRANAGA

SEQ ID NO: 431434 - protein, 46 aa, Mycobacterium
AQAQAMAQAEAEAPAQEPAPQDDPTPAARRSVAGSAMQQLRSTITG

SEQ ID NO: 431435 - protein, 24 aa, Mycobacterium
AQAQANQAAAEAEQESQRKQAEFA

SEQ ID NO: 431436 - protein, 24 aa, Mycobacterium
AQAQANQLSAEAEQESQRKQAEFA

SEQ ID NO: 431437 - protein, 16 aa, Mycobacterium
AQAQDRGEIDPGVSPM

SEQ ID NO: 431438 - protein, 7 aa, Mycobacterium
AQAQGIP

SEQ ID NO: 431439 - protein, 8 aa, Mycobacterium
AQAQKSLK

SEQ ID NO: 431440 - protein, 15 aa, Mycobacterium
AQAQPGAERRDITPD

SEQ ID NO: 431441 - protein, 11 aa, Mycobacterium
AQAQQAAGQAG

SEQ ID NO: 431442 - protein, 10 aa, Mycobacterium
AQAQQGHGTH

SEQ ID NO: 431443 - protein, 5 aa, Mycobacterium
AQAQT

SEQ ID NO: 431444 - protein, 12 aa, Mycobacterium
AQARAAAAGDDE

SEQ ID NO: 431445 - protein, 13 aa, Mycobacterium
AQARAAAAGDDEA

SEQ ID NO: 431446 - protein, 10 aa, Mycobacterium
AQARAFNGNN

SEQ ID NO: 431447 - protein, 6 aa, Mycobacterium
AQARAQ

SEQ ID NO: 431448 - protein, 22 aa, Mycobacterium
AQARAQRRNAQNVSGGGDDEYE

SEQ ID NO: 431449 - protein, 10 aa, Mycobacterium
AQARARDAAY

SEQ ID NO: 431450 - protein, 5 aa, Mycobacterium
AQARD

SEQ ID NO: 431451 - protein, 6 aa, Mycobacterium
AQARDG

SEQ ID NO: 431452 - protein, 10 aa, Mycobacterium
AQARDRAPKV

SEQ ID NO: 431453 - protein, 7 aa, Mycobacterium
AQARGKL

SEQ ID NO: 431454 - protein, 20 aa, Mycobacterium
AQARGYDVDKPRNLAKSVTV

SEQ ID NO: 431455 - protein, 10 aa, Mycobacterium
AQARNAAAQR

SEQ ID NO: 431456 - protein, 9 aa, Mycobacterium
AQARNDGVS

SEQ ID NO: 431457 - protein, 8 aa, Mycobacterium
AQARPGQT

SEQ ID NO: 431458 - protein, 6 aa, Mycobacterium
AQARPV

SEQ ID NO: 431459 - protein, 13 aa, Mycobacterium
AQARQGAVSPFSQ

SEQ ID NO: 431460 - protein, 8 aa, Mycobacterium
AQARQRER

SEQ ID NO: 431461 - protein, 14 aa, Mycobacterium
AQARRDGAIRPADG

SEQ ID NO: 431462 - protein, 7 aa, Mycobacterium
AQARRGD

SEQ ID NO: 431463 - protein, 8 aa, Mycobacterium
AQARSAEA

SEQ ID NO: 431464 - protein, 28 aa, Mycobacterium
AQARSEAQLRQAQEKADALQADAERKHS

SEQ ID NO: 431465 - protein, 28 aa, Mycobacterium
AQARSESQLRQAQEKADALQADAERKHS

SEQ ID NO: 431466 - protein, 21 aa, Mycobacterium
AQARSFTGSQAGVVTTGTHGN

SEQ ID NO: 431467 - protein, 11 aa, Mycobacterium
AQARSRADLTG

SEQ ID NO: 431468 - protein, 8 aa, Mycobacterium
AQARTATT

SEQ ID NO: 431469 - protein, 4 aa, Mycobacterium
AQAS

SEQ ID NO: 431470 - protein, 21 aa, Mycobacterium
AQASAAVSTIPADAAAGYAPT

SEQ ID NO: 431471 - protein, 17 aa, Mycobacterium
AQASADDDAKKAAVSET

SEQ ID NO: 431472 - protein, 10 aa, Mycobacterium
AQASADPVTE

SEQ ID NO: 431473 - protein, 9 aa, Mycobacterium
AQASAGAGN

SEQ ID NO: 431474 - protein, 9 aa, Mycobacterium
AQASDEQRR

SEQ ID NO: 431475 - protein, 13 aa, Mycobacterium
AQASEDDLGGKLP

SEQ ID NO: 431476 - protein, 10 aa, Mycobacterium
AQASELGDIP

SEQ ID NO: 431477 - protein, 10 aa, Mycobacterium
AQASFDANTA

SEQ ID NO: 431478 - protein, 8 aa, Mycobacterium
AQASFDNS

SEQ ID NO: 431479 - protein, 10 aa, Mycobacterium
AQASGADAIH

SEQ ID NO: 431480 - protein, 7 aa, Mycobacterium
AQASGAE

SEQ ID NO: 431481 - protein, 7 aa, Mycobacterium
AQASHDL

SEQ ID NO: 431482 - protein, 7 aa, Mycobacterium
AQASKNI

SEQ ID NO: 431483 - protein, 16 aa, Mycobacterium
AQASLPTTNRARADED

SEQ ID NO: 431484 - protein, 7 aa, Mycobacterium
AQASMPP

SEQ ID NO: 431485 - protein, 8 aa, Mycobacterium
AQASNDQL

SEQ ID NO: 431486 - protein, 8 aa, Mycobacterium
AQASNDQY

SEQ ID NO: 431487 - protein, 7 aa, Mycobacterium
AQASPST

SEQ ID NO: 431488 - protein, 5 aa, Mycobacterium
AQAST

SEQ ID NO: 431489 - protein, 7 aa, Mycobacterium
AQASTVG

SEQ ID NO: 431490 - protein, 14 aa, Mycobacterium
AQASVGTQIQSQAG

SEQ ID NO: 431491 - protein, 4 aa, Mycobacterium
AQAT

SEQ ID NO: 431492 - protein, 8 aa, Mycobacterium
AQATAAPD

SEQ ID NO: 431493 - protein, 11 aa, Mycobacterium
AQATAGAAQAG

SEQ ID NO: 431494 - protein, 7 aa, Mycobacterium
AQATAIS

SEQ ID NO: 431495 - protein, 8 aa, Mycobacterium
AQATASAA

SEQ ID NO: 431496 - protein, 6 aa, Mycobacterium
AQATAT

SEQ ID NO: 431497 - protein, 11 aa, Mycobacterium
AQATATDGTPL

SEQ ID NO: 431498 - protein, 20 aa, Mycobacterium
AQATDTTLATTQTQPDGRGL

SEQ ID NO: 431499 - protein, 6 aa, Mycobacterium
AQATEL

SEQ ID NO: 431500 - protein, 8 aa, Mycobacterium
AQATEPEY

SEQ ID NO: 431501 - protein, 6 aa, Mycobacterium
AQATFP

SEQ ID NO: 431502 - protein, 9 aa, Mycobacterium
AQATGAGGS

SEQ ID NO: 431503 - protein, 12 aa, Mycobacterium
AQATGALPASER

SEQ ID NO: 431504 - protein, 7 aa, Mycobacterium
AQATGGN

SEQ ID NO: 431505 - protein, 8 aa, Mycobacterium
AQATGKPA

SEQ ID NO: 431506 - protein, 6 aa, Mycobacterium
AQATPP

SEQ ID NO: 431507 - protein, 12 aa, Mycobacterium
AQATRMLGGRLP

SEQ ID NO: 431508 - protein, 7 aa, Mycobacterium
AQATRVT

SEQ ID NO: 431509 - protein, 7 aa, Mycobacterium
AQATSTL

SEQ ID NO: 431510 - protein, 6 aa, Mycobacterium
AQATTL

SEQ ID NO: 431511 - protein, 6 aa, Mycobacterium
AQAVAP

SEQ ID NO: 431512 - protein, 61 aa, Mycobacterium
AQAVATEESIEAREAAEKRAADQAALQRATAEKSRAELDAQQQVQRAKAEERAEIREASED

SEQ ID NO: 431513 - protein, 19 aa, Mycobacterium
AQAVGDDGKTALLARVTAY

SEQ ID NO: 431514 - protein, 14 aa, Mycobacterium
AQAVGRGDAGAAAD

SEQ ID NO: 431515 - protein, 13 aa, Mycobacterium
AQAYAAAEANAER

SEQ ID NO: 431516 - protein, 8 aa, Mycobacterium
AQAYPDPA

SEQ ID NO: 431517 - protein, 8 aa, Mycobacterium
AQAYPDPS

SEQ ID NO: 431518 - protein, 6 aa, Mycobacterium
AQAYRT

SEQ ID NO: 431519 - protein, 12 aa, Mycobacterium
AQAYSGAEAANA

SEQ ID NO: 431520 - protein, 7 aa, Mycobacterium
AQAYSSA

SEQ ID NO: 431521 - protein, 4 aa, Mycobacterium
AQCT

SEQ ID NO: 431522 - protein, 8 aa, Mycobacterium
AQDAARGD

SEQ ID NO: 431523 - protein, 7 aa, Mycobacterium
AQDADHA

SEQ ID NO: 431524 - protein, 8 aa, Mycobacterium
AQDAEQEL

SEQ ID NO: 431525 - protein, 6 aa, Mycobacterium
AQDAFG

SEQ ID NO: 431526 - protein, 34 aa, Mycobacterium
AQDAGQTGGQTAFQASAKTMTTAADQTSQQPTSI

SEQ ID NO: 431527 - protein, 6 aa, Mycobacterium
AQDAGR

SEQ ID NO: 431528 - protein, 10 aa, Mycobacterium
AQDAIGNENT

SEQ ID NO: 431529 - protein, 7 aa, Mycobacterium
AQDARTG

SEQ ID NO: 431530 - protein, 8 aa, Mycobacterium
AQDATAGD

SEQ ID NO: 431531 - protein, 9 aa, Mycobacterium
AQDATPGDR

SEQ ID NO: 431532 - protein, 11 aa, Mycobacterium
AQDATQWSDED

SEQ ID NO: 431533 - protein, 9 aa, Mycobacterium
AQDATSPDS

SEQ ID NO: 431534 - protein, 6 aa, Mycobacterium
AQDAVS

SEQ ID NO: 431535 - protein, 4 aa, Mycobacterium
AQDD

SEQ ID NO: 431536 - protein, 5 aa, Mycobacterium
AQDDA

SEQ ID NO: 431537 - protein, 9 aa, Mycobacterium
AQDDAQEKF

SEQ ID NO: 431538 - protein, 6 aa, Mycobacterium
AQDDAV

SEQ ID NO: 431539 - protein, 8 aa, Mycobacterium
AQDDDGVS

SEQ ID NO: 431540 - protein, 10 aa, Mycobacterium
AQDDGDRLSN

SEQ ID NO: 431541 - protein, 6 aa, Mycobacterium
AQDDKY

SEQ ID NO: 431542 - protein, 8 aa, Mycobacterium
AQDDNAGK

SEQ ID NO: 431543 - protein, 6 aa, Mycobacterium
AQDDPL

SEQ ID NO: 431544 - protein, 15 aa, Mycobacterium
AQDEGQVPADADAAE

SEQ ID NO: 431545 - protein, 10 aa, Mycobacterium
AQDENGWYDT

SEQ ID NO: 431546 - protein, 10 aa, Mycobacterium
AQDEPVDGAT

SEQ ID NO: 431547 - protein, 14 aa, Mycobacterium
AQDEVWGDDPTVRV

SEQ ID NO: 431548 - protein, 6 aa, Mycobacterium
AQDFES

SEQ ID NO: 431549 - protein, 9 aa, Mycobacterium
AQDGANGAH

SEQ ID NO: 431550 - protein, 10 aa, Mycobacterium
AQDGAYSPPT

SEQ ID NO: 431551 - protein, 7 aa, Mycobacterium
AQDGEAD

SEQ ID NO: 431552 - protein, 7 aa, Mycobacterium
AQDGGAD

SEQ ID NO: 431553 - protein, 9 aa, Mycobacterium
AQDGGGLGD

SEQ ID NO: 431554 - protein, 6 aa, Mycobacterium
AQDGLA

SEQ ID NO: 431555 - protein, 9 aa, Mycobacterium
AQDGLASTD

SEQ ID NO: 431556 - protein, 5 aa, Mycobacterium
AQDGR

SEQ ID NO: 431557 - protein, 6 aa, Mycobacterium
AQDGRE

SEQ ID NO: 431558 - protein, 9 aa, Mycobacterium
AQDGWSSRT

SEQ ID NO: 431559 - protein, 4 aa, Mycobacterium
AQDH

SEQ ID NO: 431560 - protein, 6 aa, Mycobacterium
AQDHTG

SEQ ID NO: 431561 - protein, 4 aa, Mycobacterium
AQDI

SEQ ID NO: 431562 - protein, 14 aa, Mycobacterium
AQDISDDDLAGRYE

SEQ ID NO: 431563 - protein, 7 aa, Mycobacterium
AQDISDT

SEQ ID NO: 431564 - protein, 14 aa, Mycobacterium
AQDISDTDLAGRYE

SEQ ID NO: 431565 - protein, 9 aa, Mycobacterium
AQDLGGGQI

SEQ ID NO: 431566 - protein, 13 aa, Mycobacterium
AQDNPGDTGADVS

SEQ ID NO: 431567 - protein, 11 aa, Mycobacterium
AQDNTNPPTPP

SEQ ID NO: 431568 - protein, 8 aa, Mycobacterium
AQDPAAAV

SEQ ID NO: 431569 - protein, 7 aa, Mycobacterium
AQDPAHP

SEQ ID NO: 431570 - protein, 7 aa, Mycobacterium
AQDPDQY

SEQ ID NO: 431571 - protein, 6 aa, Mycobacterium
AQDPEG

SEQ ID NO: 431572 - protein, 8 aa, Mycobacterium
AQDPGDDV

SEQ ID NO: 431573 - protein, 10 aa, Mycobacterium
AQDPGGGYAL

SEQ ID NO: 431574 - protein, 6 aa, Mycobacterium
AQDPGV

SEQ ID NO: 431575 - protein, 5 aa, Mycobacterium
AQDPH

SEQ ID NO: 431576 - protein, 6 aa, Mycobacterium
AQDPKI

SEQ ID NO: 431577 - protein, 10 aa, Mycobacterium
AQDPNGGYAL

SEQ ID NO: 431578 - protein, 9 aa, Mycobacterium
AQDPQFGKA

SEQ ID NO: 431579 - protein, 26 aa, Mycobacterium
AQDPQKGAWSLPGGRLRNDEDLTTSV

SEQ ID NO: 431580 - protein, 8 aa, Mycobacterium
AQDPRDLD

SEQ ID NO: 431581 - protein, 6 aa, Mycobacterium
AQDPRL

SEQ ID NO: 431582 - protein, 9 aa, Mycobacterium
AQDPTDSTM

SEQ ID NO: 431583 - protein, 5 aa, Mycobacterium
AQDPY

SEQ ID NO: 431584 - protein, 6 aa, Mycobacterium
AQDQRT

SEQ ID NO: 431585 - protein, 9 aa, Mycobacterium
AQDRDDPRP

SEQ ID NO: 431586 - protein, 8 aa, Mycobacterium
AQDREENI

SEQ ID NO: 431587 - protein, 6 aa, Mycobacterium
AQDRNT

SEQ ID NO: 431588 - protein, 7 aa, Mycobacterium
AQDRPAA

SEQ ID NO: 431589 - protein, 9 aa, Mycobacterium
AQDRPPAHD

SEQ ID NO: 431590 - protein, 9 aa, Mycobacterium
AQDRTTREW

SEQ ID NO: 431591 - protein, 10 aa, Mycobacterium
AQDSRSGRTT

SEQ ID NO: 431592 - protein, 4 aa, Mycobacterium
AQDT

SEQ ID NO: 431593 - protein, 6 aa, Mycobacterium
AQDTDK

SEQ ID NO: 431594 - protein, 7 aa, Mycobacterium
AQDTNRY

SEQ ID NO: 431595 - protein, 8 aa, Mycobacterium
AQDTSRYL

SEQ ID NO: 431596 - protein, 5 aa, Mycobacterium
AQDYH

SEQ ID NO: 431597 - protein, 6 aa, Mycobacterium
AQDYPQ

SEQ ID NO: 431598 - protein, 7 aa, Mycobacterium
AQEAAAE

SEQ ID NO: 431599 - protein, 6 aa, Mycobacterium
AQEADA

SEQ ID NO: 431600 - protein, 8 aa, Mycobacterium
AQEAEDTY

SEQ ID NO: 431601 - protein, 6 aa, Mycobacterium
AQEAEL

SEQ ID NO: 431602 - protein, 7 aa, Mycobacterium
AQEAFGD

SEQ ID NO: 431603 - protein, 6 aa, Mycobacterium
AQEAGA

SEQ ID NO: 431604 - protein, 7 aa, Mycobacterium
AQEAGNF

SEQ ID NO: 431605 - protein, 6 aa, Mycobacterium
AQEAPD

SEQ ID NO: 431606 - protein, 19 aa, Mycobacterium
AQEARRAAKEGDLRSDIDP

SEQ ID NO: 431607 - protein, 16 aa, Mycobacterium
AQEATGLSDYGDPTLP

SEQ ID NO: 431608 - protein, 13 aa, Mycobacterium
AQEAVDGKINPAR

SEQ ID NO: 431609 - protein, 6 aa, Mycobacterium
AQEAVK

SEQ ID NO: 431610 - protein, 13 aa, Mycobacterium
AQEAVTGQLPAGA

SEQ ID NO: 431611 - protein, 6 aa, Mycobacterium
AQEDDS

SEQ ID NO: 431612 - protein, 10 aa, Mycobacterium
AQEDDTVEVG

SEQ ID NO: 431613 - protein, 11 aa, Mycobacterium
AQEDGSAPANW

SEQ ID NO: 431614 - protein, 9 aa, Mycobacterium
AQEDGTGEL

SEQ ID NO: 431615 - protein, 4 aa, Mycobacterium
AQEE

SEQ ID NO: 431616 - protein, 6 aa, Mycobacterium
AQEEHD

SEQ ID NO: 431617 - protein, 7 aa, Mycobacterium
AQEEHDE

SEQ ID NO: 431618 - protein, 7 aa, Mycobacterium
AQEEHDQ

SEQ ID NO: 431619 - protein, 6 aa, Mycobacterium
AQEELD

SEQ ID NO: 431620 - protein, 11 aa, Mycobacterium
AQEELRRAGEA

SEQ ID NO: 431621 - protein, 5 aa, Mycobacterium
AQEEQ

SEQ ID NO: 431622 - protein, 7 aa, Mycobacterium
AQEESAK

SEQ ID NO: 431623 - protein, 21 aa, Mycobacterium
AQEEVWGEDPKTRVSSSYAPM

SEQ ID NO: 431624 - protein, 7 aa, Mycobacterium
AQEFARE

SEQ ID NO: 431625 - protein, 7 aa, Mycobacterium
AQEFTDR

SEQ ID NO: 431626 - protein, 4 aa, Mycobacterium
AQEG

SEQ ID NO: 431627 - protein, 6 aa, Mycobacterium
AQEGAK

SEQ ID NO: 431628 - protein, 14 aa, Mycobacterium
AQEGGSVRAGDARQ

SEQ ID NO: 431629 - protein, 5 aa, Mycobacterium
AQEGL

SEQ ID NO: 431630 - protein, 8 aa, Mycobacterium
AQEGRSEP

SEQ ID NO: 431631 - protein, 7 aa, Mycobacterium
AQEGRSH

SEQ ID NO: 431632 - protein, 7 aa, Mycobacterium
AQEGRTH

SEQ ID NO: 431633 - protein, 9 aa, Mycobacterium
AQEGSGQLG

SEQ ID NO: 431634 - protein, 11 aa, Mycobacterium
AQEGSIGGEQG

SEQ ID NO: 431635 - protein, 9 aa, Mycobacterium
AQEGSISEI

SEQ ID NO: 431636 - protein, 11 aa, Mycobacterium
AQEGSLSQIDQ

SEQ ID NO: 431637 - protein, 12 aa, Mycobacterium
AQEGSLSQIDSD

SEQ ID NO: 431638 - protein, 12 aa, Mycobacterium
AQEGTLSQIDED

SEQ ID NO: 431639 - protein, 4 aa, Mycobacterium
AQEH

SEQ ID NO: 431640 - protein, 14 aa, Mycobacterium
AQEHETSDSMPKGY

SEQ ID NO: 431641 - protein, 8 aa, Mycobacterium
AQEKQQPL

SEQ ID NO: 431642 - protein, 14 aa, Mycobacterium
AQELARSGDPARAL

SEQ ID NO: 431643 - protein, 7 aa, Mycobacterium
AQELPEP

SEQ ID NO: 431644 - protein, 12 aa, Mycobacterium
AQENGTTLYPAQ

SEQ ID NO: 431645 - protein, 8 aa, Mycobacterium
AQENPAEL

SEQ ID NO: 431646 - protein, 5 aa, Mycobacterium
AQEPC

SEQ ID NO: 431647 - protein, 13 aa, Mycobacterium
AQEPDYDAVLGAL

SEQ ID NO: 431648 - protein, 14 aa, Mycobacterium
AQEPDYEAALAAVG

SEQ ID NO: 431649 - protein, 8 aa, Mycobacterium
AQEPEQLR

SEQ ID NO: 431650 - protein, 22 aa, Mycobacterium
AQEPGGEKAVAKRDKKGIPSAR

SEQ ID NO: 431651 - protein, 5 aa, Mycobacterium
AQEPP

SEQ ID NO: 431652 - protein, 10 aa, Mycobacterium
AQEPRGAGGF

SEQ ID NO: 431653 - protein, 7 aa, Mycobacterium
AQEPTDQ

SEQ ID NO: 431654 - protein, 13 aa, Mycobacterium
AQEPTKLFRVTVG

SEQ ID NO: 431655 - protein, 11 aa, Mycobacterium
AQEPVGTRARE

SEQ ID NO: 431656 - protein, 6 aa, Mycobacterium
AQEQGA

SEQ ID NO: 431657 - protein, 14 aa, Mycobacterium
AQEQRAVRRPKRPA

SEQ ID NO: 431658 - protein, 6 aa, Mycobacterium
AQEQRD

SEQ ID NO: 431659 - protein, 10 aa, Mycobacterium
AQERAQREAR

SEQ ID NO: 431660 - protein, 8 aa, Mycobacterium
AQERESFG

SEQ ID NO: 431661 - protein, 23 aa, Mycobacterium
AQERNTDPPPPGTSTDTRVPSPA

SEQ ID NO: 431662 - protein, 8 aa, Mycobacterium
AQERRETL

SEQ ID NO: 431663 - protein, 22 aa, Mycobacterium
AQERSAKAAEGAEEWHDPREDG

SEQ ID NO: 431664 - protein, 25 aa, Mycobacterium
AQERSQAAAAGADEWHDPRADGNLP

SEQ ID NO: 431665 - protein, 25 aa, Mycobacterium
AQERTAAAAAGAEEWHDPRADGNLP

SEQ ID NO: 431666 - protein, 8 aa, Mycobacterium
AQERVPDT

SEQ ID NO: 431667 - protein, 11 aa, Mycobacterium
AQESAAAKSGI

SEQ ID NO: 431668 - protein, 10 aa, Mycobacterium
AQESAPQAGP

SEQ ID NO: 431669 - protein, 5 aa, Mycobacterium
AQESD

SEQ ID NO: 431670 - protein, 8 aa, Mycobacterium
AQESEVAE

SEQ ID NO: 431671 - protein, 8 aa, Mycobacterium
AQESFDRG

SEQ ID NO: 431672 - protein, 6 aa, Mycobacterium
AQESFG

SEQ ID NO: 431673 - protein, 10 aa, Mycobacterium
AQESPARRTL

SEQ ID NO: 431674 - protein, 6 aa, Mycobacterium
AQESVD

SEQ ID NO: 431675 - protein, 5 aa, Mycobacterium
AQESW

SEQ ID NO: 431676 - protein, 9 aa, Mycobacterium
AQETKVGTK

SEQ ID NO: 431677 - protein, 4 aa, Mycobacterium
AQEV

SEQ ID NO: 431678 - protein, 5 aa, Mycobacterium
AQEVQ

SEQ ID NO: 431679 - protein, 14 aa, Mycobacterium
AQEVTQQGRDTQIK

SEQ ID NO: 431680 - protein, 8 aa, Mycobacterium
AQEVTTAD

SEQ ID NO: 431681 - protein, 6 aa, Mycobacterium
AQEYPD

SEQ ID NO: 431682 - protein, 12 aa, Mycobacterium
AQEYQAAAAQAA

SEQ ID NO: 431683 - protein, 9 aa, Mycobacterium
AQFASPATV

SEQ ID NO: 431684 - protein, 11 aa, Mycobacterium
AQFDKTSADPR

SEQ ID NO: 431685 - protein, 4 aa, Mycobacterium
AQFG

SEQ ID NO: 431686 - protein, 6 aa, Mycobacterium
AQFGAP

SEQ ID NO: 431687 - protein, 12 aa, Mycobacterium
AQFGDPSGAQRL

SEQ ID NO: 431688 - protein, 11 aa, Mycobacterium
AQFGSKAADKF

SEQ ID NO: 431689 - protein, 6 aa, Mycobacterium
AQFPDG

SEQ ID NO: 431690 - protein, 5 aa, Mycobacterium
AQFPG

SEQ ID NO: 431691 - protein, 20 aa, Mycobacterium
AQFSGDPTATLVGGGRASVD

SEQ ID NO: 431692 - protein, 7 aa, Mycobacterium
AQFTEDG

SEQ ID NO: 431693 - protein, 9 aa, Mycobacterium
AQGAAAEGE

SEQ ID NO: 431694 - protein, 9 aa, Mycobacterium
AQGAAANGE

SEQ ID NO: 431695 - protein, 18 aa, Mycobacterium
AQGAAGGLPTLPGNAAGA

SEQ ID NO: 431696 - protein, 17 aa, Mycobacterium
AQGAARAGASKEEAAEA

SEQ ID NO: 431697 - protein, 10 aa, Mycobacterium
AQGAASDGEM

SEQ ID NO: 431698 - protein, 17 aa, Mycobacterium
AQGAATAQRADGGPAVV

SEQ ID NO: 431699 - protein, 8 aa, Mycobacterium
AQGAAYDG

SEQ ID NO: 431700 - protein, 7 aa, Mycobacterium
AQGAAYN

SEQ ID NO: 431701 - protein, 5 aa, Mycobacterium
AQGAD

SEQ ID NO: 431702 - protein, 12 aa, Mycobacterium
AQGAEPFREASR

SEQ ID NO: 431703 - protein, 8 aa, Mycobacterium
AQGAGADQ

SEQ ID NO: 431704 - protein, 6 aa, Mycobacterium
AQGAGD

SEQ ID NO: 431705 - protein, 7 aa, Mycobacterium
AQGAGLG

SEQ ID NO: 431706 - protein, 7 aa, Mycobacterium
AQGAHAP

SEQ ID NO: 431707 - protein, 18 aa, Mycobacterium
AQGAPAPKRSGEFGDGRG

SEQ ID NO: 431708 - protein, 16 aa, Mycobacterium
AQGAPVPRSSWQGAAS

SEQ ID NO: 431709 - protein, 7 aa, Mycobacterium
AQGAVSG

SEQ ID NO: 431710 - protein, 7 aa, Mycobacterium
AQGDDRV

SEQ ID NO: 431711 - protein, 5 aa, Mycobacterium
AQGDG

SEQ ID NO: 431712 - protein, 7 aa, Mycobacterium
AQGDGDR

SEQ ID NO: 431713 - protein, 11 aa, Mycobacterium
AQGDGPTPRLP

SEQ ID NO: 431714 - protein, 13 aa, Mycobacterium
AQGDIDEGCDPAD

SEQ ID NO: 431715 - protein, 10 aa, Mycobacterium
AQGDITYSTN

SEQ ID NO: 431716 - protein, 5 aa, Mycobacterium
AQGDL

SEQ ID NO: 431717 - protein, 6 aa, Mycobacterium
AQGDPD

SEQ ID NO: 431718 - protein, 8 aa, Mycobacterium
AQGDPEQI

SEQ ID NO: 431719 - protein, 9 aa, Mycobacterium
AQGDTVTAG

SEQ ID NO: 431720 - protein, 8 aa, Mycobacterium
AQGEAGAI

SEQ ID NO: 431721 - protein, 7 aa, Mycobacterium
AQGEARI

SEQ ID NO: 431722 - protein, 10 aa, Mycobacterium
AQGEAYRDGL

SEQ ID NO: 431723 - protein, 10 aa, Mycobacterium
AQGEDDEATE

SEQ ID NO: 431724 - protein, 6 aa, Mycobacterium
AQGELE

SEQ ID NO: 431725 - protein, 5 aa, Mycobacterium
AQGER

SEQ ID NO: 431726 - protein, 7 aa, Mycobacterium
AQGERDI

SEQ ID NO: 431727 - protein, 7 aa, Mycobacterium
AQGESIR

SEQ ID NO: 431728 - protein, 9 aa, Mycobacterium
AQGESLRRA

SEQ ID NO: 431729 - protein, 6 aa, Mycobacterium
AQGEYV

SEQ ID NO: 431730 - protein, 10 aa, Mycobacterium
AQGGAGGALG

SEQ ID NO: 431731 - protein, 7 aa, Mycobacterium
AQGGARS

SEQ ID NO: 431732 - protein, 8 aa, Mycobacterium
AQGGAVDD

SEQ ID NO: 431733 - protein, 27 aa, Mycobacterium
AQGGAVTTQDAAPAASPEAQARTAGCT

SEQ ID NO: 431734 - protein, 7 aa, Mycobacterium
AQGGDIP

SEQ ID NO: 431735 - protein, 6 aa, Mycobacterium
AQGGDL

SEQ ID NO: 431736 - protein, 11 aa, Mycobacterium
AQGGDLSKPLP

SEQ ID NO: 431737 - protein, 8 aa, Mycobacterium
AQGGDVDS

SEQ ID NO: 431738 - protein, 6 aa, Mycobacterium
AQGGGD

SEQ ID NO: 431739 - protein, 6 aa, Mycobacterium
AQGGGR

SEQ ID NO: 431740 - protein, 6 aa, Mycobacterium
AQGGGS

SEQ ID NO: 431741 - protein, 6 aa, Mycobacterium
AQGGID

SEQ ID NO: 431742 - protein, 9 aa, Mycobacterium
AQGGLGQAG

SEQ ID NO: 431743 - protein, 7 aa, Mycobacterium
AQGGPVV

SEQ ID NO: 431744 - protein, 8 aa, Mycobacterium
AQGGRDLS

SEQ ID NO: 431745 - protein, 6 aa, Mycobacterium
AQGGRQ

SEQ ID NO: 431746 - protein, 10 aa, Mycobacterium
AQGGSGSISR

SEQ ID NO: 431747 - protein, 10 aa, Mycobacterium
AQGGSGSITR

SEQ ID NO: 431748 - protein, 9 aa, Mycobacterium
AQGGSLSGT

SEQ ID NO: 431749 - protein, 8 aa, Mycobacterium
AQGGTETA

SEQ ID NO: 431750 - protein, 7 aa, Mycobacterium
AQGGTSF

SEQ ID NO: 431751 - protein, 5 aa, Mycobacterium
AQGHD

SEQ ID NO: 431752 - protein, 14 aa, Mycobacterium
AQGHEKDSRGGSSF

SEQ ID NO: 431753 - protein, 5 aa, Mycobacterium
AQGHP

SEQ ID NO: 431754 - protein, 5 aa, Mycobacterium
AQGHR

SEQ ID NO: 431755 - protein, 9 aa, Mycobacterium
AQGHTNTSH

SEQ ID NO: 431756 - protein, 4 aa, Mycobacterium
AQGI

SEQ ID NO: 431757 - protein, 6 aa, Mycobacterium
AQGIGE

SEQ ID NO: 431758 - protein, 8 aa, Mycobacterium
AQGIGEHT

SEQ ID NO: 431759 - protein, 9 aa, Mycobacterium
AQGIGERTA

SEQ ID NO: 431760 - protein, 7 aa, Mycobacterium
AQGIGQA

SEQ ID NO: 431761 - protein, 5 aa, Mycobacterium
AQGIR

SEQ ID NO: 431762 - protein, 6 aa, Mycobacterium
AQGIRS

SEQ ID NO: 431763 - protein, 5 aa, Mycobacterium
AQGIS

SEQ ID NO: 431764 - protein, 5 aa, Mycobacterium
AQGIT

SEQ ID NO: 431765 - protein, 7 aa, Mycobacterium
AQGKDRD

SEQ ID NO: 431766 - protein, 16 aa, Mycobacterium
AQGKGLGEAQLANASD

SEQ ID NO: 431767 - protein, 6 aa, Mycobacterium
AQGKVG

SEQ ID NO: 431768 - protein, 31 aa, Mycobacterium
AQGLANGAAAAVQGAAAGAASSGASALGSLG

SEQ ID NO: 431769 - protein, 27 aa, Mycobacterium
AQGLASGAAAAAQAAAEGAAGAVSSGA

SEQ ID NO: 431770 - protein, 6 aa, Mycobacterium
AQGMTT

SEQ ID NO: 431771 - protein, 6 aa, Mycobacterium
AQGNGD

SEQ ID NO: 431772 - protein, 9 aa, Mycobacterium
AQGNSPSLG

SEQ ID NO: 431773 - protein, 10 aa, Mycobacterium
AQGNTVMQGS

SEQ ID NO: 431774 - protein, 8 aa, Mycobacterium
AQGPAGGL

SEQ ID NO: 431775 - protein, 16 aa, Mycobacterium
AQGPDQPCYFPACLPG

SEQ ID NO: 431776 - protein, 10 aa, Mycobacterium
AQGPGESAQH

SEQ ID NO: 431777 - protein, 7 aa, Mycobacterium
AQGPGRI

SEQ ID NO: 431778 - protein, 7 aa, Mycobacterium
AQGPPAL

SEQ ID NO: 431779 - protein, 10 aa, Mycobacterium
AQGPQGWGAR

SEQ ID NO: 431780 - protein, 10 aa, Mycobacterium
AQGPTATPCG

SEQ ID NO: 431781 - protein, 7 aa, Mycobacterium
AQGQEHS

SEQ ID NO: 431782 - protein, 5 aa, Mycobacterium
AQGQL

SEQ ID NO: 431783 - protein, 14 aa, Mycobacterium
AQGQPDTQDAAAGA

SEQ ID NO: 431784 - protein, 9 aa, Mycobacterium
AQGQQDAWS

SEQ ID NO: 431785 - protein, 132 aa, Mycobacterium
AQGQQGAGGAGGNGGTGGIAGDGGTGGAGDATHLDGGKGGNGGNPGLGGTGGAGGTGASTGTHGSAGATPTTVAGNGGKGGDGYTPTTPGADGGNGGAGGNGGLYGNGGNGGNGGNGTVGAAGVNPTPNPVL

SEQ ID NO: 431786 - protein, 5 aa, Mycobacterium
AQGRA

SEQ ID NO: 431787 - protein, 10 aa, Mycobacterium
AQGRADKEEF

SEQ ID NO: 431788 - protein, 10 aa, Mycobacterium
AQGRASPVDQ

SEQ ID NO: 431789 - protein, 8 aa, Mycobacterium
AQGREAGG

SEQ ID NO: 431790 - protein, 5 aa, Mycobacterium
AQGRG

SEQ ID NO: 431791 - protein, 9 aa, Mycobacterium
AQGRGAEAV

SEQ ID NO: 431792 - protein, 20 aa, Mycobacterium
AQGRGETGEIRTPDAVRDGR

SEQ ID NO: 431793 - protein, 8 aa, Mycobacterium
AQGRGIGE

SEQ ID NO: 431794 - protein, 14 aa, Mycobacterium
AQGRGVGASPSVAA

SEQ ID NO: 431795 - protein, 17 aa, Mycobacterium
AQGRLDPARADAARKEM

SEQ ID NO: 431796 - protein, 8 aa, Mycobacterium
AQGRNPDD

SEQ ID NO: 431797 - protein, 10 aa, Mycobacterium
AQGRPAADTL

SEQ ID NO: 431798 - protein, 8 aa, Mycobacterium
AQGRPAGA

SEQ ID NO: 431799 - protein, 9 aa, Mycobacterium
AQGRPGLEL

SEQ ID NO: 431800 - protein, 23 aa, Mycobacterium
AQGRPVETGASSRIEGIGRPRVE

SEQ ID NO: 431801 - protein, 13 aa, Mycobacterium
AQGRRISPETRDA

SEQ ID NO: 431802 - protein, 8 aa, Mycobacterium
AQGRSDAV

SEQ ID NO: 431803 - protein, 8 aa, Mycobacterium
AQGSASGR

SEQ ID NO: 431804 - protein, 12 aa, Mycobacterium
AQGSDAEPTPDE

SEQ ID NO: 431805 - protein, 7 aa, Mycobacterium
AQGSELD

SEQ ID NO: 431806 - protein, 11 aa, Mycobacterium
AQGSESSPESL

SEQ ID NO: 431807 - protein, 10 aa, Mycobacterium
AQGSFDSGRD

SEQ ID NO: 431808 - protein, 8 aa, Mycobacterium
AQGSGEDQ

SEQ ID NO: 431809 - protein, 7 aa, Mycobacterium
AQGSGGL

SEQ ID NO: 431810 - protein, 7 aa, Mycobacterium
AQGSGSR

SEQ ID NO: 431811 - protein, 11 aa, Mycobacterium
AQGSLTPRTDR

SEQ ID NO: 431812 - protein, 15 aa, Mycobacterium
AQGSPERDFEERSPD

SEQ ID NO: 431813 - protein, 15 aa, Mycobacterium
AQGSPERDFGERSAD

SEQ ID NO: 431814 - protein, 11 aa, Mycobacterium
AQGSREDGTRV

SEQ ID NO: 431815 - protein, 26 aa, Mycobacterium
AQGTADPVPNPINPLGPGVSSATVET

SEQ ID NO: 431816 - protein, 9 aa, Mycobacterium
AQGTATSTS

SEQ ID NO: 431817 - protein, 11 aa, Mycobacterium
AQGTDGGGSIR

SEQ ID NO: 431818 - protein, 7 aa, Mycobacterium
AQGTGIQ

SEQ ID NO: 431819 - protein, 6 aa, Mycobacterium
AQGTGQ

SEQ ID NO: 431820 - protein, 14 aa, Mycobacterium
AQGTGSVRAGDPRK

SEQ ID NO: 431821 - protein, 9 aa, Mycobacterium
AQGTLDPNR

SEQ ID NO: 431822 - protein, 17 aa, Mycobacterium
AQGTPEDVAANPDSYTG

SEQ ID NO: 431823 - protein, 8 aa, Mycobacterium
AQGTPEEV

SEQ ID NO: 431824 - protein, 8 aa, Mycobacterium
AQGTPRRP

SEQ ID NO: 431825 - protein, 9 aa, Mycobacterium
AQGTQASAR

SEQ ID NO: 431826 - protein, 8 aa, Mycobacterium
AQGTTATI

SEQ ID NO: 431827 - protein, 12 aa, Mycobacterium
AQGTTCAQRTVE

SEQ ID NO: 431828 - protein, 12 aa, Mycobacterium
AQGTTDSDGRIP

SEQ ID NO: 431829 - protein, 19 aa, Mycobacterium
AQGVASVGGDIGSGLSEGL

SEQ ID NO: 431830 - protein, 8 aa, Mycobacterium
AQGVDPSA

SEQ ID NO: 431831 - protein, 5 aa, Mycobacterium
AQGVE

SEQ ID NO: 431832 - protein, 6 aa, Mycobacterium
AQGVEP

SEQ ID NO: 431833 - protein, 8 aa, Mycobacterium
AQGVEPSA

SEQ ID NO: 431834 - protein, 6 aa, Mycobacterium
AQGVPA

SEQ ID NO: 431835 - protein, 6 aa, Mycobacterium
AQGVPS

SEQ ID NO: 431836 - protein, 6 aa, Mycobacterium
AQGVRS

SEQ ID NO: 431837 - protein, 5 aa, Mycobacterium
AQGVS

SEQ ID NO: 431838 - protein, 12 aa, Mycobacterium
AQGVSSGRIPAR

SEQ ID NO: 431839 - protein, 13 aa, Mycobacterium
AQGVSSGRIPARE

SEQ ID NO: 431840 - protein, 19 aa, Mycobacterium
AQGVTGTAGDGGTGGAGGL

SEQ ID NO: 431841 - protein, 14 aa, Mycobacterium
AQGWAQDREENEPS

SEQ ID NO: 431842 - protein, 14 aa, Mycobacterium
AQGWPEDGIAPGTR

SEQ ID NO: 431843 - protein, 6 aa, Mycobacterium
AQGWQE

SEQ ID NO: 431844 - protein, 8 aa, Mycobacterium
AQGYPDIP

SEQ ID NO: 431845 - protein, 7 aa, Mycobacterium
AQGYQGI

SEQ ID NO: 431846 - protein, 12 aa, Mycobacterium
AQGYSDSKGILP

SEQ ID NO: 431847 - protein, 11 aa, Mycobacterium
AQGYSDSKGIV

SEQ ID NO: 431848 - protein, 11 aa, Mycobacterium
AQGYSDSQGIL

SEQ ID NO: 431849 - protein, 9 aa, Mycobacterium
AQHADSASL

SEQ ID NO: 431850 - protein, 7 aa, Mycobacterium
AQHAEGA

SEQ ID NO: 431851 - protein, 13 aa, Mycobacterium
AQHAEQTAGQARM

SEQ ID NO: 431852 - protein, 10 aa, Mycobacterium
AQHANQRGTT

SEQ ID NO: 431853 - protein, 8 aa, Mycobacterium
AQHDGSLG

SEQ ID NO: 431854 - protein, 5 aa, Mycobacterium
AQHDP

SEQ ID NO: 431855 - protein, 6 aa, Mycobacterium
AQHDPR

SEQ ID NO: 431856 - protein, 11 aa, Mycobacterium
AQHDRNRDLAR

SEQ ID NO: 431857 - protein, 14 aa, Mycobacterium
AQHDRSDDASLAET

SEQ ID NO: 431858 - protein, 5 aa, Mycobacterium
AQHEE

SEQ ID NO: 431859 - protein, 7 aa, Mycobacterium
AQHEREE

SEQ ID NO: 431860 - protein, 6 aa, Mycobacterium
AQHGAR

SEQ ID NO: 431861 - protein, 6 aa, Mycobacterium
AQHGDE

SEQ ID NO: 431862 - protein, 6 aa, Mycobacterium
AQHGDG

SEQ ID NO: 431863 - protein, 6 aa, Mycobacterium
AQHGKL

SEQ ID NO: 431864 - protein, 6 aa, Mycobacterium
AQHGLP

SEQ ID NO: 431865 - protein, 7 aa, Mycobacterium
AQHGPPA

SEQ ID NO: 431866 - protein, 6 aa, Mycobacterium
AQHGRR

SEQ ID NO: 431867 - protein, 7 aa, Mycobacterium
AQHGSPA

SEQ ID NO: 431868 - protein, 7 aa, Mycobacterium
AQHGTPA

SEQ ID NO: 431869 - protein, 10 aa, Mycobacterium
AQHGTRDQAR

SEQ ID NO: 431870 - protein, 9 aa, Mycobacterium
AQHKDPAGF

SEQ ID NO: 431871 - protein, 8 aa, Mycobacterium
AQHNDDSL

SEQ ID NO: 431872 - protein, 4 aa, Mycobacterium
AQHP

SEQ ID NO: 431873 - protein, 14 aa, Mycobacterium
AQHPAAENAVTGSV

SEQ ID NO: 431874 - protein, 12 aa, Mycobacterium
AQHPASENTVTG

SEQ ID NO: 431875 - protein, 7 aa, Mycobacterium
AQHPDKL

SEQ ID NO: 431876 - protein, 7 aa, Mycobacterium
AQHPDRL

SEQ ID NO: 431877 - protein, 8 aa, Mycobacterium
AQHPEQPQ

SEQ ID NO: 431878 - protein, 11 aa, Mycobacterium
AQHPGDSVEEK

SEQ ID NO: 431879 - protein, 15 aa, Mycobacterium
AQHPPEVIDGNWNPA

SEQ ID NO: 431880 - protein, 21 aa, Mycobacterium
AQHPRGSEPLRTSTLTSAAGS

SEQ ID NO: 431881 - protein, 17 aa, Mycobacterium
AQHPTITSSPSGDGPDL

SEQ ID NO: 431882 - protein, 17 aa, Mycobacterium
AQHPTVTASPSGDGPDL

SEQ ID NO: 431883 - protein, 6 aa, Mycobacterium
AQHPYT

SEQ ID NO: 431884 - protein, 6 aa, Mycobacterium
AQHQTS

SEQ ID NO: 431885 - protein, 4 aa, Mycobacterium
AQHR

SEQ ID NO: 431886 - protein, 10 aa, Mycobacterium
AQHRARPGAG

SEQ ID NO: 431887 - protein, 5 aa, Mycobacterium
AQHRG

SEQ ID NO: 431888 - protein, 13 aa, Mycobacterium
AQHRGEILKAVLT

SEQ ID NO: 431889 - protein, 6 aa, Mycobacterium
AQHRPT

SEQ ID NO: 431890 - protein, 17 aa, Mycobacterium
AQHRRGVRPHQRTPRCG

SEQ ID NO: 431891 - protein, 9 aa, Mycobacterium
AQHRTDTVD

SEQ ID NO: 431892 - protein, 8 aa, Mycobacterium
AQHSASHR

SEQ ID NO: 431893 - protein, 4 aa, Mycobacterium
AQHT

SEQ ID NO: 431894 - protein, 27 aa, Mycobacterium
AQHTDAIRASGAAPVALPDAGDPDADR

SEQ ID NO: 431895 - protein, 5 aa, Mycobacterium
AQHTG

SEQ ID NO: 431896 - protein, 6 aa, Mycobacterium
AQHTTG

SEQ ID NO: 431897 - protein, 6 aa, Mycobacterium
AQHTTV

SEQ ID NO: 431898 - protein, 10 aa, Mycobacterium
AQIAARGASQ

SEQ ID NO: 431899 - protein, 6 aa, Mycobacterium
AQIAGA

SEQ ID NO: 431900 - protein, 7 aa, Mycobacterium
AQIAGPD

SEQ ID NO: 431901 - protein, 8 aa, Mycobacterium
AQIAGPDA

SEQ ID NO: 431902 - protein, 6 aa, Mycobacterium
AQIASA

SEQ ID NO: 431903 - protein, 12 aa, Mycobacterium
AQIATQPGTFSL

SEQ ID NO: 431904 - protein, 10 aa, Mycobacterium
AQIDASATHR

SEQ ID NO: 431905 - protein, 8 aa, Mycobacterium
AQIDSAGD

SEQ ID NO: 431906 - protein, 4 aa, Mycobacterium
AQIE

SEQ ID NO: 431907 - protein, 12 aa, Mycobacterium
AQIEEKRKQDPM

SEQ ID NO: 431908 - protein, 6 aa, Mycobacterium
AQIETA

SEQ ID NO: 431909 - protein, 9 aa, Mycobacterium
AQIGDDDPR

SEQ ID NO: 431910 - protein, 6 aa, Mycobacterium
AQIGGA

SEQ ID NO: 431911 - protein, 7 aa, Mycobacterium
AQIGPDD

SEQ ID NO: 431912 - protein, 7 aa, Mycobacterium
AQIGRTA

SEQ ID NO: 431913 - protein, 11 aa, Mycobacterium
AQIGRTEPLPP

SEQ ID NO: 431914 - protein, 13 aa, Mycobacterium
AQIPASGQAGGEV

SEQ ID NO: 431915 - protein, 7 aa, Mycobacterium
AQIPDGA

SEQ ID NO: 431916 - protein, 12 aa, Mycobacterium
AQIPPPDQRRSY

SEQ ID NO: 431917 - protein, 5 aa, Mycobacterium
AQIPS

SEQ ID NO: 431918 - protein, 9 aa, Mycobacterium
AQIRPSTGP

SEQ ID NO: 431919 - protein, 10 aa, Mycobacterium
AQIRQRSGEL

SEQ ID NO: 431920 - protein, 6 aa, Mycobacterium
AQISAD

SEQ ID NO: 431921 - protein, 10 aa, Mycobacterium
AQISDQARGE

SEQ ID NO: 431922 - protein, 8 aa, Mycobacterium
AQISSGRR

SEQ ID NO: 431923 - protein, 4 aa, Mycobacterium
AQIT

SEQ ID NO: 431924 - protein, 24 aa, Mycobacterium
AQITPETGTRLDTTRESPDHTEES

SEQ ID NO: 431925 - protein, 6 aa, Mycobacterium
AQITTR

SEQ ID NO: 431926 - protein, 10 aa, Mycobacterium
AQKAAGKNTD

SEQ ID NO: 431927 - protein, 15 aa, Mycobacterium
AQKAGREALSAGAEL

SEQ ID NO: 431928 - protein, 9 aa, Mycobacterium
AQKAQGVNT

SEQ ID NO: 431929 - protein, 8 aa, Mycobacterium
AQKARERF

SEQ ID NO: 431930 - protein, 7 aa, Mycobacterium
AQKARQL

SEQ ID NO: 431931 - protein, 7 aa, Mycobacterium
AQKASVG

SEQ ID NO: 431932 - protein, 6 aa, Mycobacterium
AQKATA

SEQ ID NO: 431933 - protein, 10 aa, Mycobacterium
AQKDPAAESA

SEQ ID NO: 431934 - protein, 9 aa, Mycobacterium
AQKEGSAEI

SEQ ID NO: 431935 - protein, 9 aa, Mycobacterium
AQKGDGAFE

SEQ ID NO: 431936 - protein, 10 aa, Mycobacterium
AQKGEEWTRD

SEQ ID NO: 431937 - protein, 7 aa, Mycobacterium
AQKGGAV

SEQ ID NO: 431938 - protein, 116 aa, Mycobacterium
AQKLPADGPAVKRGVTAGPAKKAAKKAPAKKAAAKKTATKAAAKKAPAKKAATKAPAKKAATKAPAKKAATKAPAKKAATKAPAKKAAAKAPAKKAATKAPAKKAAAKKAPAKKGR

SEQ ID NO: 431939 - protein, 14 aa, Mycobacterium
AQKLPAEGPAVKRG

SEQ ID NO: 431940 - protein, 12 aa, Mycobacterium
AQKNNDQPDGRP

SEQ ID NO: 431941 - protein, 12 aa, Mycobacterium
AQKPADVSGEAV

SEQ ID NO: 431942 - protein, 8 aa, Mycobacterium
AQKPEKLE

SEQ ID NO: 431943 - protein, 11 aa, Mycobacterium
AQKPIDPERGP

SEQ ID NO: 431944 - protein, 7 aa, Mycobacterium
AQKPLDG

SEQ ID NO: 431945 - protein, 9 aa, Mycobacterium
AQKQARRWS

SEQ ID NO: 431946 - protein, 9 aa, Mycobacterium
AQKQARRWT

SEQ ID NO: 431947 - protein, 15 aa, Mycobacterium
AQKQMENTTKLPEGF

SEQ ID NO: 431948 - protein, 10 aa, Mycobacterium
AQKRGDPAPR

SEQ ID NO: 431949 - protein, 7 aa, Mycobacterium
AQKRGLP

SEQ ID NO: 431950 - protein, 13 aa, Mycobacterium
AQLAADAKDTIRS

SEQ ID NO: 431951 - protein, 7 aa, Mycobacterium
AQLAAGR

SEQ ID NO: 431952 - protein, 8 aa, Mycobacterium
AQLAGQSV

SEQ ID NO: 431953 - protein, 13 aa, Mycobacterium
AQLAGSGSRRDTR

SEQ ID NO: 431954 - protein, 7 aa, Mycobacterium
AQLDDEQ

SEQ ID NO: 431955 - protein, 8 aa, Mycobacterium
AQLDERAN

SEQ ID NO: 431956 - protein, 7 aa, Mycobacterium
AQLEEDP

SEQ ID NO: 431957 - protein, 7 aa, Mycobacterium
AQLEGPI

SEQ ID NO: 431958 - protein, 11 aa, Mycobacterium
AQLETDTPAEV

SEQ ID NO: 431959 - protein, 4 aa, Mycobacterium
AQLG

SEQ ID NO: 431960 - protein, 12 aa, Mycobacterium
AQLGAQGGSNGG

SEQ ID NO: 431961 - protein, 6 aa, Mycobacterium
AQLGDS

SEQ ID NO: 431962 - protein, 11 aa, Mycobacterium
AQLGGDRGAHR

SEQ ID NO: 431963 - protein, 10 aa, Mycobacterium
AQLGGEHEQR

SEQ ID NO: 431964 - protein, 10 aa, Mycobacterium
AQLGKGPGDR

SEQ ID NO: 431965 - protein, 10 aa, Mycobacterium
AQLGPEEGKA

SEQ ID NO: 431966 - protein, 5 aa, Mycobacterium
AQLGT

SEQ ID NO: 431967 - protein, 8 aa, Mycobacterium
AQLGTSGA

SEQ ID NO: 431968 - protein, 10 aa, Mycobacterium
AQLGTTGASV

SEQ ID NO: 431969 - protein, 8 aa, Mycobacterium
AQLNPEDV

SEQ ID NO: 431970 - protein, 6 aa, Mycobacterium
AQLNSE

SEQ ID NO: 431971 - protein, 4 aa, Mycobacterium
AQLP

SEQ ID NO: 431972 - protein, 15 aa, Mycobacterium
AQLPPDEDSEPRATP

SEQ ID NO: 431973 - protein, 8 aa, Mycobacterium
AQLPTAER

SEQ ID NO: 431974 - protein, 5 aa, Mycobacterium
AQLQD

SEQ ID NO: 431975 - protein, 6 aa, Mycobacterium
AQLQQG

SEQ ID NO: 431976 - protein, 11 aa, Mycobacterium
AQLQRESRGMA

SEQ ID NO: 431977 - protein, 5 aa, Mycobacterium
AQLRD

SEQ ID NO: 431978 - protein, 6 aa, Mycobacterium
AQLRPE

SEQ ID NO: 431979 - protein, 15 aa, Mycobacterium
AQLSAAAAARTGGGE

SEQ ID NO: 431980 - protein, 21 aa, Mycobacterium
AQLSDAPSAALSGDQSPGDRV

SEQ ID NO: 431981 - protein, 6 aa, Mycobacterium
AQLSDL

SEQ ID NO: 431982 - protein, 9 aa, Mycobacterium
AQLSDPANT

SEQ ID NO: 431983 - protein, 10 aa, Mycobacterium
AQLSEEEETL

SEQ ID NO: 431984 - protein, 10 aa, Mycobacterium
AQLSGGQQQR

SEQ ID NO: 431985 - protein, 10 aa, Mycobacterium
AQLSGGQRQR

SEQ ID NO: 431986 - protein, 7 aa, Mycobacterium
AQLSPSE

SEQ ID NO: 431987 - protein, 20 aa, Mycobacterium
AQLSREDQTSSTPAASSRRD

SEQ ID NO: 431988 - protein, 12 aa, Mycobacterium
AQLTARQKHQAR

SEQ ID NO: 431989 - protein, 8 aa, Mycobacterium
AQLTGSEE

SEQ ID NO: 431990 - protein, 7 aa, Mycobacterium
AQMAEAA

SEQ ID NO: 431991 - protein, 18 aa, Mycobacterium
AQMATSAEAAASAFSATR

SEQ ID NO: 431992 - protein, 4 aa, Mycobacterium
AQMP

SEQ ID NO: 431993 - protein, 17 aa, Mycobacterium
AQMPAHEEERQDAQREG

SEQ ID NO: 431994 - protein, 7 aa, Mycobacterium
AQMSTSE

SEQ ID NO: 431995 - protein, 7 aa, Mycobacterium
AQMTDDE

SEQ ID NO: 431996 - protein, 12 aa, Mycobacterium
AQMTSPTDSVTK

SEQ ID NO: 431997 - protein, 7 aa, Mycobacterium
AQNADKV

SEQ ID NO: 431998 - protein, 6 aa, Mycobacterium
AQNATS

SEQ ID NO: 431999 - protein, 4 aa, Mycobacterium
AQND

SEQ ID NO: 432000 - protein, 4 aa, Mycobacterium
AQNE

SEQ ID NO: 432001 - protein, 22 aa, Mycobacterium
AQNEGMPDGPGGVVPRRSSPTR

SEQ ID NO: 432002 - protein, 7 aa, Mycobacterium
AQNEHPG

SEQ ID NO: 432003 - protein, 7 aa, Mycobacterium
AQNEHPN

SEQ ID NO: 432004 - protein, 13 aa, Mycobacterium
AQNESLSASQIRS

SEQ ID NO: 432005 - protein, 8 aa, Mycobacterium
AQNGDTEF

SEQ ID NO: 432006 - protein, 53 aa, Mycobacterium
AQNGPPEGDRKGTEIDSQIGTQISSSSVGQKLPGGHMSDADARPNRHQRGERA

SEQ ID NO: 432007 - protein, 7 aa, Mycobacterium
AQNKAAA

SEQ ID NO: 432008 - protein, 8 aa, Mycobacterium
AQNKSRIP

SEQ ID NO: 432009 - protein, 8 aa, Mycobacterium
AQNNDLGA

SEQ ID NO: 432010 - protein, 5 aa, Mycobacterium
AQNPA

SEQ ID NO: 432011 - protein, 6 aa, Mycobacterium
AQNPAT

SEQ ID NO: 432012 - protein, 7 aa, Mycobacterium
AQNPERF

SEQ ID NO: 432013 - protein, 5 aa, Mycobacterium
AQNPG

SEQ ID NO: 432014 - protein, 8 aa, Mycobacterium
AQNPGSLL

SEQ ID NO: 432015 - protein, 8 aa, Mycobacterium
AQNPGTVT

SEQ ID NO: 432016 - protein, 7 aa, Mycobacterium
AQNPQLR

SEQ ID NO: 432017 - protein, 5 aa, Mycobacterium
AQNPS

SEQ ID NO: 432018 - protein, 8 aa, Mycobacterium
AQNPSDDL

SEQ ID NO: 432019 - protein, 8 aa, Mycobacterium
AQNQDQAA

SEQ ID NO: 432020 - protein, 7 aa, Mycobacterium
AQNRGAA

SEQ ID NO: 432021 - protein, 10 aa, Mycobacterium
AQNRNLDDGD

SEQ ID NO: 432022 - protein, 19 aa, Mycobacterium
AQNRPSWPGWPNETSPGAR

SEQ ID NO: 432023 - protein, 9 aa, Mycobacterium
AQNRSDDDT

SEQ ID NO: 432024 - protein, 11 aa, Mycobacterium
AQNTKDDGGAR

SEQ ID NO: 432025 - protein, 11 aa, Mycobacterium
AQNTKDSSGAR

SEQ ID NO: 432026 - protein, 12 aa, Mycobacterium
AQNTKDSSGARL

SEQ ID NO: 432027 - protein, 8 aa, Mycobacterium
AQNTTGEQ

SEQ ID NO: 432028 - protein, 4 aa, Mycobacterium
AQPA

SEQ ID NO: 432029 - protein, 5 aa, Mycobacterium
AQPAA

SEQ ID NO: 432030 - protein, 8 aa, Mycobacterium
AQPAASAA

SEQ ID NO: 432031 - protein, 5 aa, Mycobacterium
AQPAD

SEQ ID NO: 432032 - protein, 6 aa, Mycobacterium
AQPADF

SEQ ID NO: 432033 - protein, 8 aa, Mycobacterium
AQPAEAYE

SEQ ID NO: 432034 - protein, 21 aa, Mycobacterium
AQPAEERAQGRRQRSKTERLG

SEQ ID NO: 432035 - protein, 9 aa, Mycobacterium
AQPAGADPL

SEQ ID NO: 432036 - protein, 6 aa, Mycobacterium
AQPAGV

SEQ ID NO: 432037 - protein, 5 aa, Mycobacterium
AQPAP

SEQ ID NO: 432038 - protein, 8 aa, Mycobacterium
AQPAPRGH

SEQ ID NO: 432039 - protein, 9 aa, Mycobacterium
AQPARTPVS

SEQ ID NO: 432040 - protein, 7 aa, Mycobacterium
AQPATAG

SEQ ID NO: 432041 - protein, 6 aa, Mycobacterium
AQPATD

SEQ ID NO: 432042 - protein, 9 aa, Mycobacterium
AQPATPGDV

SEQ ID NO: 432043 - protein, 5 aa, Mycobacterium
AQPAW

SEQ ID NO: 432044 - protein, 10 aa, Mycobacterium
AQPDDSNPLY

SEQ ID NO: 432045 - protein, 5 aa, Mycobacterium
AQPDE

SEQ ID NO: 432046 - protein, 23 aa, Mycobacterium
AQPDEDMPEEAFPAASATSMSSS

SEQ ID NO: 432047 - protein, 24 aa, Mycobacterium
AQPDGGAEGAGSENAQAAAEEPES

SEQ ID NO: 432048 - protein, 7 aa, Mycobacterium
AQPDLAD

SEQ ID NO: 432049 - protein, 6 aa, Mycobacterium
AQPDLN

SEQ ID NO: 432050 - protein, 19 aa, Mycobacterium
AQPDPVLQPPGPARGPPAV

SEQ ID NO: 432051 - protein, 5 aa, Mycobacterium
AQPDR

SEQ ID NO: 432052 - protein, 6 aa, Mycobacterium
AQPDSI

SEQ ID NO: 432053 - protein, 6 aa, Mycobacterium
AQPDSR

SEQ ID NO: 432054 - protein, 9 aa, Mycobacterium
AQPDSRGRL

SEQ ID NO: 432055 - protein, 5 aa, Mycobacterium
AQPDT

SEQ ID NO: 432056 - protein, 6 aa, Mycobacterium
AQPDVR

SEQ ID NO: 432057 - protein, 10 aa, Mycobacterium
AQPEASPESR

SEQ ID NO: 432058 - protein, 12 aa, Mycobacterium
AQPEFDPADQDR

SEQ ID NO: 432059 - protein, 5 aa, Mycobacterium
AQPEG

SEQ ID NO: 432060 - protein, 9 aa, Mycobacterium
AQPEGETPC

SEQ ID NO: 432061 - protein, 5 aa, Mycobacterium
AQPEH

SEQ ID NO: 432062 - protein, 17 aa, Mycobacterium
AQPEPGGAVRSAELTPG

SEQ ID NO: 432063 - protein, 10 aa, Mycobacterium
AQPEPRRPRT

SEQ ID NO: 432064 - protein, 5 aa, Mycobacterium
AQPES

SEQ ID NO: 432065 - protein, 10 aa, Mycobacterium
AQPESGSTEW

SEQ ID NO: 432066 - protein, 12 aa, Mycobacterium
AQPESSTQDSLN

SEQ ID NO: 432067 - protein, 4 aa, Mycobacterium
AQPF

SEQ ID NO: 432068 - protein, 6 aa, Mycobacterium
AQPFRS

SEQ ID NO: 432069 - protein, 7 aa, Mycobacterium
AQPGAAA

SEQ ID NO: 432070 - protein, 6 aa, Mycobacterium
AQPGAG

SEQ ID NO: 432071 - protein, 7 aa, Mycobacterium
AQPGAVE

SEQ ID NO: 432072 - protein, 7 aa, Mycobacterium
AQPGAVR

SEQ ID NO: 432073 - protein, 10 aa, Mycobacterium
AQPGDAASLN

SEQ ID NO: 432074 - protein, 5 aa, Mycobacterium
AQPGG

SEQ ID NO: 432075 - protein, 7 aa, Mycobacterium
AQPGGEL

SEQ ID NO: 432076 - protein, 7 aa, Mycobacterium
AQPGGGT

SEQ ID NO: 432077 - protein, 7 aa, Mycobacterium
AQPGGLR

SEQ ID NO: 432078 - protein, 12 aa, Mycobacterium
AQPGGMTKEQRG

SEQ ID NO: 432079 - protein, 7 aa, Mycobacterium
AQPGGRT

SEQ ID NO: 432080 - protein, 10 aa, Mycobacterium
AQPGIDPTRK

SEQ ID NO: 432081 - protein, 6 aa, Mycobacterium
AQPGIS

SEQ ID NO: 432082 - protein, 6 aa, Mycobacterium
AQPGLG

SEQ ID NO: 432083 - protein, 6 aa, Mycobacterium
AQPGPE

SEQ ID NO: 432084 - protein, 7 aa, Mycobacterium
AQPGPID

SEQ ID NO: 432085 - protein, 10 aa, Mycobacterium
AQPGPKRQAA

SEQ ID NO: 432086 - protein, 7 aa, Mycobacterium
AQPGQGE

SEQ ID NO: 432087 - protein, 11 aa, Mycobacterium
AQPGRDRDDAL

SEQ ID NO: 432088 - protein, 7 aa, Mycobacterium
AQPGSER

SEQ ID NO: 432089 - protein, 11 aa, Mycobacterium
AQPGSKKSIGT

SEQ ID NO: 432090 - protein, 11 aa, Mycobacterium
AQPGSMTQEQR

SEQ ID NO: 432091 - protein, 13 aa, Mycobacterium
AQPGSRRNPQFGS

SEQ ID NO: 432092 - protein, 10 aa, Mycobacterium
AQPGTGDAGG

SEQ ID NO: 432093 - protein, 12 aa, Mycobacterium
AQPGTRSAFSAA

SEQ ID NO: 432094 - protein, 8 aa, Mycobacterium
AQPHGGFT

SEQ ID NO: 432095 - protein, 9 aa, Mycobacterium
AQPHGPAPE

SEQ ID NO: 432096 - protein, 7 aa, Mycobacterium
AQPHSGI

SEQ ID NO: 432097 - protein, 16 aa, Mycobacterium
AQPHTSSGRVPTEKGY

SEQ ID NO: 432098 - protein, 14 aa, Mycobacterium
AQPIAEGDRANPAH

SEQ ID NO: 432099 - protein, 6 aa, Mycobacterium
AQPIGT

SEQ ID NO: 432100 - protein, 5 aa, Mycobacterium
AQPIP

SEQ ID NO: 432101 - protein, 15 aa, Mycobacterium
AQPISSFQGPQPADQ

SEQ ID NO: 432102 - protein, 4 aa, Mycobacterium
AQPK

SEQ ID NO: 432103 - protein, 10 aa, Mycobacterium
AQPKAGATTA

SEQ ID NO: 432104 - protein, 6 aa, Mycobacterium
AQPKAL

SEQ ID NO: 432105 - protein, 29 aa, Mycobacterium
AQPKKRGRHASTAEPDEEPTSSDPQAAAT

SEQ ID NO: 432106 - protein, 11 aa, Mycobacterium
AQPKTNEVASA

SEQ ID NO: 432107 - protein, 8 aa, Mycobacterium
AQPKYVQG

SEQ ID NO: 432108 - protein, 21 aa, Mycobacterium
AQPLDETTSRGQYTGGWQGGE

SEQ ID NO: 432109 - protein, 7 aa, Mycobacterium
AQPLDGP

SEQ ID NO: 432110 - protein, 10 aa, Mycobacterium
AQPLDGPWAD

SEQ ID NO: 432111 - protein, 8 aa, Mycobacterium
AQPLETAD

SEQ ID NO: 432112 - protein, 5 aa, Mycobacterium
AQPLG

SEQ ID NO: 432113 - protein, 11 aa, Mycobacterium
AQPLGRAARTA

SEQ ID NO: 432114 - protein, 17 aa, Mycobacterium
AQPMSLPGDRATPSDVD

SEQ ID NO: 432115 - protein, 9 aa, Mycobacterium
AQPNDASNA

SEQ ID NO: 432116 - protein, 16 aa, Mycobacterium
AQPPAATADLAAPRPP

SEQ ID NO: 432117 - protein, 8 aa, Mycobacterium
AQPPAQPL

SEQ ID NO: 432118 - protein, 12 aa, Mycobacterium
AQPPASAYPGDE

SEQ ID NO: 432119 - protein, 14 aa, Mycobacterium
AQPPDPDGSVPPFV

SEQ ID NO: 432120 - protein, 11 aa, Mycobacterium
AQPPDSYRNDH

SEQ ID NO: 432121 - protein, 7 aa, Mycobacterium
AQPPEDQ

SEQ ID NO: 432122 - protein, 12 aa, Mycobacterium
AQPPEEARPEIE

SEQ ID NO: 432123 - protein, 12 aa, Mycobacterium
AQPPELSPSQAI

SEQ ID NO: 432124 - protein, 8 aa, Mycobacterium
AQPPENAA

SEQ ID NO: 432125 - protein, 9 aa, Mycobacterium
AQPPENAGE

SEQ ID NO: 432126 - protein, 18 aa, Mycobacterium
AQPPGAGGPQGPGGAGYS

SEQ ID NO: 432127 - protein, 15 aa, Mycobacterium
AQPPGEDADDDHGGA

SEQ ID NO: 432128 - protein, 20 aa, Mycobacterium
AQPPKPKPERSPLNASAPTE

SEQ ID NO: 432129 - protein, 9 aa, Mycobacterium
AQPPPPQQY

SEQ ID NO: 432130 - protein, 8 aa, Mycobacterium
AQPPQNHG

SEQ ID NO: 432131 - protein, 6 aa, Mycobacterium
AQPPRV

SEQ ID NO: 432132 - protein, 12 aa, Mycobacterium
AQPPSAMYAGVE

SEQ ID NO: 432133 - protein, 8 aa, Mycobacterium
AQPPSNHA

SEQ ID NO: 432134 - protein, 21 aa, Mycobacterium
AQPPTGENRFRSPRPVNPWGG

SEQ ID NO: 432135 - protein, 7 aa, Mycobacterium
AQPQADR

SEQ ID NO: 432136 - protein, 14 aa, Mycobacterium
AQPQESPDAATEPV

SEQ ID NO: 432137 - protein, 8 aa, Mycobacterium
AQPQGDAS

SEQ ID NO: 432138 - protein, 13 aa, Mycobacterium
AQPQLGEQVERGG

SEQ ID NO: 432139 - protein, 8 aa, Mycobacterium
AQPQPRQT

SEQ ID NO: 432140 - protein, 5 aa, Mycobacterium
AQPRA

SEQ ID NO: 432141 - protein, 13 aa, Mycobacterium
AQPRAARGYGDVR

SEQ ID NO: 432142 - protein, 9 aa, Mycobacterium
AQPRAGATT

SEQ ID NO: 432143 - protein, 5 aa, Mycobacterium
AQPRE

SEQ ID NO: 432144 - protein, 7 aa, Mycobacterium
AQPRGSW

SEQ ID NO: 432145 - protein, 5 aa, Mycobacterium
AQPRI

SEQ ID NO: 432146 - protein, 17 aa, Mycobacterium
AQPRLAAAQKAAEEITE

SEQ ID NO: 432147 - protein, 8 aa, Mycobacterium
AQPRNAAT

SEQ ID NO: 432148 - protein, 9 aa, Mycobacterium
AQPRQSNAE

SEQ ID NO: 432149 - protein, 10 aa, Mycobacterium
AQPRSVDPTV

SEQ ID NO: 432150 - protein, 8 aa, Mycobacterium
AQPRTEVP

SEQ ID NO: 432151 - protein, 6 aa, Mycobacterium
AQPSAA

SEQ ID NO: 432152 - protein, 8 aa, Mycobacterium
AQPSAALE

SEQ ID NO: 432153 - protein, 8 aa, Mycobacterium
AQPSAELQ

SEQ ID NO: 432154 - protein, 28 aa, Mycobacterium
AQPSAPQHRAPGLGPSAQPPSAYPAQQR

SEQ ID NO: 432155 - protein, 12 aa, Mycobacterium
AQPSASLSDVKR

SEQ ID NO: 432156 - protein, 9 aa, Mycobacterium
AQPSPERRA

SEQ ID NO: 432157 - protein, 9 aa, Mycobacterium
AQPSPQPGV

SEQ ID NO: 432158 - protein, 18 aa, Mycobacterium
AQPTAGGGARTLPDPEFS

SEQ ID NO: 432159 - protein, 6 aa, Mycobacterium
AQPTDP

SEQ ID NO: 432160 - protein, 6 aa, Mycobacterium
AQPTEL

SEQ ID NO: 432161 - protein, 12 aa, Mycobacterium
AQPTHDQGQITG

SEQ ID NO: 432162 - protein, 9 aa, Mycobacterium
AQPTRRDRW

SEQ ID NO: 432163 - protein, 9 aa, Mycobacterium
AQPTVAASG

SEQ ID NO: 432164 - protein, 14 aa, Mycobacterium
AQPVAEGDRANPGH

SEQ ID NO: 432165 - protein, 7 aa, Mycobacterium
AQPVDSP

SEQ ID NO: 432166 - protein, 14 aa, Mycobacterium
AQPVEAGDRADPAQ

SEQ ID NO: 432167 - protein, 14 aa, Mycobacterium
AQPVGDGNTVEDRD

SEQ ID NO: 432168 - protein, 7 aa, Mycobacterium
AQPVNGR

SEQ ID NO: 432169 - protein, 13 aa, Mycobacterium
AQPVQVSPPRPTI

SEQ ID NO: 432170 - protein, 14 aa, Mycobacterium
AQPVRDGNTVEDRD

SEQ ID NO: 432171 - protein, 14 aa, Mycobacterium
AQPVSTSRLARLLA

SEQ ID NO: 432172 - protein, 13 aa, Mycobacterium
AQPVTDGDRANPA

SEQ ID NO: 432173 - protein, 15 aa, Mycobacterium
AQPWADGGATTADNG

SEQ ID NO: 432174 - protein, 15 aa, Mycobacterium
AQPWADGGPTTAGNG

SEQ ID NO: 432175 - protein, 5 aa, Mycobacterium
AQPYG

SEQ ID NO: 432176 - protein, 6 aa, Mycobacterium
AQPYGG

SEQ ID NO: 432177 - protein, 17 aa, Mycobacterium
AQPYRGTLDGGAPSDPT

SEQ ID NO: 432178 - protein, 22 aa, Mycobacterium
AQPYSRRRAERTTRLIVDALTR

SEQ ID NO: 432179 - protein, 21 aa, Mycobacterium
AQPYSRRRAERTTRLIVEALT

SEQ ID NO: 432180 - protein, 4 aa, Mycobacterium
AQQA

SEQ ID NO: 432181 - protein, 5 aa, Mycobacterium
AQQAA

SEQ ID NO: 432182 - protein, 6 aa, Mycobacterium
AQQAAG

SEQ ID NO: 432183 - protein, 8 aa, Mycobacterium
AQQAAGSA

SEQ ID NO: 432184 - protein, 11 aa, Mycobacterium
AQQAAKRPKTA

SEQ ID NO: 432185 - protein, 6 aa, Mycobacterium
AQQAAT

SEQ ID NO: 432186 - protein, 8 aa, Mycobacterium
AQQADQDL

SEQ ID NO: 432187 - protein, 5 aa, Mycobacterium
AQQAG

SEQ ID NO: 432188 - protein, 9 aa, Mycobacterium
AQQAGDGGT

SEQ ID NO: 432189 - protein, 14 aa, Mycobacterium
AQQAGREALRPGAE

SEQ ID NO: 432190 - protein, 9 aa, Mycobacterium
AQQAGTVRS

SEQ ID NO: 432191 - protein, 6 aa, Mycobacterium
AQQAGV

SEQ ID NO: 432192 - protein, 11 aa, Mycobacterium
AQQAIQDDGLT

SEQ ID NO: 432193 - protein, 6 aa, Mycobacterium
AQQALG

SEQ ID NO: 432194 - protein, 9 aa, Mycobacterium
AQQALSRSD

SEQ ID NO: 432195 - protein, 7 aa, Mycobacterium
AQQAPPL

SEQ ID NO: 432196 - protein, 9 aa, Mycobacterium
AQQAQAHPD

SEQ ID NO: 432197 - protein, 17 aa, Mycobacterium
AQQAQQMAASAESAAAA

SEQ ID NO: 432198 - protein, 9 aa, Mycobacterium
AQQASQQVQ

SEQ ID NO: 432199 - protein, 9 aa, Mycobacterium
AQQATQSVA

SEQ ID NO: 432200 - protein, 15 aa, Mycobacterium
AQQAVDGKIKPNRIT

SEQ ID NO: 432201 - protein, 8 aa, Mycobacterium
AQQAVSDA

SEQ ID NO: 432202 - protein, 4 aa, Mycobacterium
AQQD

SEQ ID NO: 432203 - protein, 9 aa, Mycobacterium
AQQDAGQHL

SEQ ID NO: 432204 - protein, 6 aa, Mycobacterium
AQQDAI

SEQ ID NO: 432205 - protein, 7 aa, Mycobacterium
AQQDPAS

SEQ ID NO: 432206 - protein, 10 aa, Mycobacterium
AQQDRPAPHA

SEQ ID NO: 432207 - protein, 9 aa, Mycobacterium
AQQDRPPGV

SEQ ID NO: 432208 - protein, 8 aa, Mycobacterium
AQQDTEVR

SEQ ID NO: 432209 - protein, 4 aa, Mycobacterium
AQQE

SEQ ID NO: 432210 - protein, 7 aa, Mycobacterium
AQQEPRA

SEQ ID NO: 432211 - protein, 6 aa, Mycobacterium
AQQESA

SEQ ID NO: 432212 - protein, 10 aa, Mycobacterium
AQQGDPGYKA

SEQ ID NO: 432213 - protein, 22 aa, Mycobacterium
AQQGKSREEFETETRTAAETDV

SEQ ID NO: 432214 - protein, 7 aa, Mycobacterium
AQQGNPT

SEQ ID NO: 432215 - protein, 8 aa, Mycobacterium
AQQGNPTR

SEQ ID NO: 432216 - protein, 17 aa, Mycobacterium
AQQGPAQPVAHSVAPAP

SEQ ID NO: 432217 - protein, 21 aa, Mycobacterium
AQQGPGTAPEPAEDGPVLQLE

SEQ ID NO: 432218 - protein, 9 aa, Mycobacterium
AQQGSGTRV

SEQ ID NO: 432219 - protein, 8 aa, Mycobacterium
AQQGTTGP

SEQ ID NO: 432220 - protein, 4 aa, Mycobacterium
AQQI

SEQ ID NO: 432221 - protein, 8 aa, Mycobacterium
AQQIGTPQ

SEQ ID NO: 432222 - protein, 6 aa, Mycobacterium
AQQIRT

SEQ ID NO: 432223 - protein, 15 aa, Mycobacterium
AQQKARAGEIPPEQV

SEQ ID NO: 432224 - protein, 6 aa, Mycobacterium
AQQLGD

SEQ ID NO: 432225 - protein, 7 aa, Mycobacterium
AQQLGDA

SEQ ID NO: 432226 - protein, 6 aa, Mycobacterium
AQQNEK

SEQ ID NO: 432227 - protein, 6 aa, Mycobacterium
AQQNQS

SEQ ID NO: 432228 - protein, 4 aa, Mycobacterium
AQQP

SEQ ID NO: 432229 - protein, 5 aa, Mycobacterium
AQQPA

SEQ ID NO: 432230 - protein, 9 aa, Mycobacterium
AQQPADHTG

SEQ ID NO: 432231 - protein, 8 aa, Mycobacterium
AQQPAKAY

SEQ ID NO: 432232 - protein, 11 aa, Mycobacterium
AQQPDGAPGLA

SEQ ID NO: 432233 - protein, 8 aa, Mycobacterium
AQQPLTGD

SEQ ID NO: 432234 - protein, 8 aa, Mycobacterium
AQQPNGYT

SEQ ID NO: 432235 - protein, 7 aa, Mycobacterium
AQQPPAR

SEQ ID NO: 432236 - protein, 8 aa, Mycobacterium
AQQPPELG

SEQ ID NO: 432237 - protein, 6 aa, Mycobacterium
AQQPPI

SEQ ID NO: 432238 - protein, 17 aa, Mycobacterium
AQQPPRLRTETRFESAP

SEQ ID NO: 432239 - protein, 6 aa, Mycobacterium
AQQPRR

SEQ ID NO: 432240 - protein, 5 aa, Mycobacterium
AQQPT

SEQ ID NO: 432241 - protein, 7 aa, Mycobacterium
AQQPTDI

SEQ ID NO: 432242 - protein, 12 aa, Mycobacterium
AQQPTSAHPGDE

SEQ ID NO: 432243 - protein, 5 aa, Mycobacterium
AQQPV

SEQ ID NO: 432244 - protein, 4 aa, Mycobacterium
AQQQ

SEQ ID NO: 432245 - protein, 22 aa, Mycobacterium
AQQQGTAAAGSLPGGLTSPQIA

SEQ ID NO: 432246 - protein, 21 aa, Mycobacterium
AQQQPQQLPPAGYAPQQYPAQ

SEQ ID NO: 432247 - protein, 5 aa, Mycobacterium
AQQQT

SEQ ID NO: 432248 - protein, 4 aa, Mycobacterium
AQQR

SEQ ID NO: 432249 - protein, 14 aa, Mycobacterium
AQQRARAGEIEPDQ

SEQ ID NO: 432250 - protein, 7 aa, Mycobacterium
AQQRDPG

SEQ ID NO: 432251 - protein, 12 aa, Mycobacterium
AQQRDWNAEKQR

SEQ ID NO: 432252 - protein, 8 aa, Mycobacterium
AQQRGGSL

SEQ ID NO: 432253 - protein, 7 aa, Mycobacterium
AQQRNPV

SEQ ID NO: 432254 - protein, 7 aa, Mycobacterium
AQQRPDA

SEQ ID NO: 432255 - protein, 6 aa, Mycobacterium
AQQRPE

SEQ ID NO: 432256 - protein, 8 aa, Mycobacterium
AQQRPNEI

SEQ ID NO: 432257 - protein, 36 aa, Mycobacterium
AQQRQHRMPEPARVGQPFEDQHPDALGEAGAIGGAG

SEQ ID NO: 432258 - protein, 7 aa, Mycobacterium
AQQRTTF

SEQ ID NO: 432259 - protein, 11 aa, Mycobacterium
AQQSQGGPDMG

SEQ ID NO: 432260 - protein, 5 aa, Mycobacterium
AQQTA

SEQ ID NO: 432261 - protein, 7 aa, Mycobacterium
AQQTGVP

SEQ ID NO: 432262 - protein, 20 aa, Mycobacterium
AQQTRRGAVVGEGAKQFGGG

SEQ ID NO: 432263 - protein, 10 aa, Mycobacterium
AQQVDPTDSV

SEQ ID NO: 432264 - protein, 7 aa, Mycobacterium
AQQVGRT

SEQ ID NO: 432265 - protein, 12 aa, Mycobacterium
AQRAAEQAREAV

SEQ ID NO: 432266 - protein, 6 aa, Mycobacterium
AQRADG

SEQ ID NO: 432267 - protein, 9 aa, Mycobacterium
AQRADQALT

SEQ ID NO: 432268 - protein, 9 aa, Mycobacterium
AQRADQDLK

SEQ ID NO: 432269 - protein, 8 aa, Mycobacterium
AQRADRPL

SEQ ID NO: 432270 - protein, 10 aa, Mycobacterium
AQRADYQRRA

SEQ ID NO: 432271 - protein, 8 aa, Mycobacterium
AQRAEAQA

SEQ ID NO: 432272 - protein, 7 aa, Mycobacterium
AQRAEAT

SEQ ID NO: 432273 - protein, 9 aa, Mycobacterium
AQRAEEDGF

SEQ ID NO: 432274 - protein, 31 aa, Mycobacterium
AQRAEHRANTEADRAKDAYERDDGLQRRTGE

SEQ ID NO: 432275 - protein, 14 aa, Mycobacterium
AQRAENDYVGAPTG

SEQ ID NO: 432276 - protein, 13 aa, Mycobacterium
AQRAENEYVGAPT

SEQ ID NO: 432277 - protein, 21 aa, Mycobacterium
AQRAEQDRSRHITDPDEDPAA

SEQ ID NO: 432278 - protein, 7 aa, Mycobacterium
AQRAGHN

SEQ ID NO: 432279 - protein, 15 aa, Mycobacterium
AQRAGREALRPGASL

SEQ ID NO: 432280 - protein, 10 aa, Mycobacterium
AQRAGTPDEA

SEQ ID NO: 432281 - protein, 8 aa, Mycobacterium
AQRAGTRL

SEQ ID NO: 432282 - protein, 11 aa, Mycobacterium
AQRAGVDPPHL

SEQ ID NO: 432283 - protein, 6 aa, Mycobacterium
AQRAGY

SEQ ID NO: 432284 - protein, 7 aa, Mycobacterium
AQRAHEV

SEQ ID NO: 432285 - protein, 6 aa, Mycobacterium
AQRAHT

SEQ ID NO: 432286 - protein, 12 aa, Mycobacterium
AQRAKGRKVTAG

SEQ ID NO: 432287 - protein, 12 aa, Mycobacterium
AQRAKGRKVTAS

SEQ ID NO: 432288 - protein, 14 aa, Mycobacterium
AQRAKSRGHRSAQA

SEQ ID NO: 432289 - protein, 7 aa, Mycobacterium
AQRALDE

SEQ ID NO: 432290 - protein, 8 aa, Mycobacterium
AQRAPELS

SEQ ID NO: 432291 - protein, 7 aa, Mycobacterium
AQRARRR

SEQ ID NO: 432292 - protein, 5 aa, Mycobacterium
AQRAS

SEQ ID NO: 432293 - protein, 10 aa, Mycobacterium
AQRASEAEHP

SEQ ID NO: 432294 - protein, 13 aa, Mycobacterium
AQRASLDGPLPRD

SEQ ID NO: 432295 - protein, 7 aa, Mycobacterium
AQRASRE

SEQ ID NO: 432296 - protein, 7 aa, Mycobacterium
AQRATGI

SEQ ID NO: 432297 - protein, 6 aa, Mycobacterium
AQRATP

SEQ ID NO: 432298 - protein, 6 aa, Mycobacterium
AQRAYD

SEQ ID NO: 432299 - protein, 7 aa, Mycobacterium
AQRCPDR

SEQ ID NO: 432300 - protein, 8 aa, Mycobacterium
AQRCPDRP

SEQ ID NO: 432301 - protein, 4 aa, Mycobacterium
AQRD

SEQ ID NO: 432302 - protein, 12 aa, Mycobacterium
AQRDDASSASAC

SEQ ID NO: 432303 - protein, 7 aa, Mycobacterium
AQRDGAP

SEQ ID NO: 432304 - protein, 7 aa, Mycobacterium
AQRDGID

SEQ ID NO: 432305 - protein, 7 aa, Mycobacterium
AQRDGIG

SEQ ID NO: 432306 - protein, 7 aa, Mycobacterium
AQRDGTW

SEQ ID NO: 432307 - protein, 21 aa, Mycobacterium
AQRDGWPRDGLHGTGPAGAAV

SEQ ID NO: 432308 - protein, 5 aa, Mycobacterium
AQRDN

SEQ ID NO: 432309 - protein, 6 aa, Mycobacterium
AQRDPD

SEQ ID NO: 432310 - protein, 6 aa, Mycobacterium
AQRDPI

SEQ ID NO: 432311 - protein, 6 aa, Mycobacterium
AQRDPS

SEQ ID NO: 432312 - protein, 5 aa, Mycobacterium
AQRDT

SEQ ID NO: 432313 - protein, 10 aa, Mycobacterium
AQRDYPAPPG

SEQ ID NO: 432314 - protein, 6 aa, Mycobacterium
AQREAA

SEQ ID NO: 432315 - protein, 12 aa, Mycobacterium
AQREARRGTPER

SEQ ID NO: 432316 - protein, 5 aa, Mycobacterium
AQREP

SEQ ID NO: 432317 - protein, 8 aa, Mycobacterium
AQREPAPT

SEQ ID NO: 432318 - protein, 11 aa, Mycobacterium
AQREPSSHADP

SEQ ID NO: 432319 - protein, 5 aa, Mycobacterium
AQRET

SEQ ID NO: 432320 - protein, 6 aa, Mycobacterium
AQRGEL

SEQ ID NO: 432321 - protein, 7 aa, Mycobacterium
AQRGERV

SEQ ID NO: 432322 - protein, 13 aa, Mycobacterium
AQRGEVSAAAEAA

SEQ ID NO: 432323 - protein, 5 aa, Mycobacterium
AQRGG

SEQ ID NO: 432324 - protein, 21 aa, Mycobacterium
AQRGGLGGVRPRHPDRGQRAA

SEQ ID NO: 432325 - protein, 6 aa, Mycobacterium
AQRGGT

SEQ ID NO: 432326 - protein, 7 aa, Mycobacterium
AQRGKSL

SEQ ID NO: 432327 - protein, 11 aa, Mycobacterium
AQRGNVKGATT

SEQ ID NO: 432328 - protein, 13 aa, Mycobacterium
AQRGPDETRSTAR

SEQ ID NO: 432329 - protein, 21 aa, Mycobacterium
AQRGRGERKRASSGWESLTPA

SEQ ID NO: 432330 - protein, 15 aa, Mycobacterium
AQRGRGERKRPASGW

SEQ ID NO: 432331 - protein, 23 aa, Mycobacterium
AQRGRLTDAGGRRPAGRHRSAAI

SEQ ID NO: 432332 - protein, 8 aa, Mycobacterium
AQRGRPGL

SEQ ID NO: 432333 - protein, 5 aa, Mycobacterium
AQRGS

SEQ ID NO: 432334 - protein, 11 aa, Mycobacterium
AQRGSDAPPVC

SEQ ID NO: 432335 - protein, 12 aa, Mycobacterium
AQRGSGAAGPSF

SEQ ID NO: 432336 - protein, 10 aa, Mycobacterium
AQRGVGPGDR

SEQ ID NO: 432337 - protein, 13 aa, Mycobacterium
AQRGVPKDGAGID

SEQ ID NO: 432338 - protein, 21 aa, Mycobacterium
AQRHAQSVQTRHDAATEGLRE

SEQ ID NO: 432339 - protein, 5 aa, Mycobacterium
AQRIE

SEQ ID NO: 432340 - protein, 7 aa, Mycobacterium
AQRIPDN

SEQ ID NO: 432341 - protein, 6 aa, Mycobacterium
AQRIPT

SEQ ID NO: 432342 - protein, 7 aa, Mycobacterium
AQRIPTD

SEQ ID NO: 432343 - protein, 12 aa, Mycobacterium
AQRISAGRHPGV

SEQ ID NO: 432344 - protein, 10 aa, Mycobacterium
AQRISTPGGR

SEQ ID NO: 432345 - protein, 11 aa, Mycobacterium
AQRKAAGDKRS

SEQ ID NO: 432346 - protein, 5 aa, Mycobacterium
AQRKG

SEQ ID NO: 432347 - protein, 8 aa, Mycobacterium
AQRKKPWQ

SEQ ID NO: 432348 - protein, 7 aa, Mycobacterium
AQRKNPW

SEQ ID NO: 432349 - protein, 8 aa, Mycobacterium
AQRKNPWD

SEQ ID NO: 432350 - protein, 9 aa, Mycobacterium
AQRKNPWDR

SEQ ID NO: 432351 - protein, 12 aa, Mycobacterium
AQRKPTIGRDGG

SEQ ID NO: 432352 - protein, 9 aa, Mycobacterium
AQRKSSQLT

SEQ ID NO: 432353 - protein, 24 aa, Mycobacterium
AQRKVSRKPAAGRSLGGKRGRKGS

SEQ ID NO: 432354 - protein, 7 aa, Mycobacterium
AQRLAEE

SEQ ID NO: 432355 - protein, 7 aa, Mycobacterium
AQRLDDA

SEQ ID NO: 432356 - protein, 5 aa, Mycobacterium
AQRLG

SEQ ID NO: 432357 - protein, 7 aa, Mycobacterium
AQRLGAP

SEQ ID NO: 432358 - protein, 5 aa, Mycobacterium
AQRLP

SEQ ID NO: 432359 - protein, 7 aa, Mycobacterium
AQRLPPT

SEQ ID NO: 432360 - protein, 12 aa, Mycobacterium
AQRLPSDGPAVK

SEQ ID NO: 432361 - protein, 12 aa, Mycobacterium
AQRLPSEGPAVK

SEQ ID NO: 432362 - protein, 25 aa, Mycobacterium
AQRLTSKRSRAAATVGGPGPEGSVG

SEQ ID NO: 432363 - protein, 27 aa, Mycobacterium
AQRNPVKSFPAPAGPPRVRSRRASPLT

SEQ ID NO: 432364 - protein, 12 aa, Mycobacterium
AQRNYRDSGAGT

SEQ ID NO: 432365 - protein, 6 aa, Mycobacterium
AQRPDV

SEQ ID NO: 432366 - protein, 7 aa, Mycobacterium
AQRPEER

SEQ ID NO: 432367 - protein, 13 aa, Mycobacterium
AQRPGAVAGRTAT

SEQ ID NO: 432368 - protein, 7 aa, Mycobacterium
AQRPGDA

SEQ ID NO: 432369 - protein, 10 aa, Mycobacterium
AQRPHAAPDY

SEQ ID NO: 432370 - protein, 11 aa, Mycobacterium
AQRPPTARWPE

SEQ ID NO: 432371 - protein, 8 aa, Mycobacterium
AQRPPTFG

SEQ ID NO: 432372 - protein, 12 aa, Mycobacterium
AQRPQGNIDESP

SEQ ID NO: 432373 - protein, 47 aa, Mycobacterium
AQRPQRQVQGHQRRGTGRVDRNGRTLQTQRVGDPARRHAQRRPAQPV

SEQ ID NO: 432374 - protein, 7 aa, Mycobacterium
AQRPRLG

SEQ ID NO: 432375 - protein, 16 aa, Mycobacterium
AQRPRLGVDTDERTIP

SEQ ID NO: 432376 - protein, 17 aa, Mycobacterium
AQRQARTALRDSGAIRV

SEQ ID NO: 432377 - protein, 6 aa, Mycobacterium
AQRQES

SEQ ID NO: 432378 - protein, 6 aa, Mycobacterium
AQRQHD

SEQ ID NO: 432379 - protein, 6 aa, Mycobacterium
AQRQQS

SEQ ID NO: 432380 - protein, 5 aa, Mycobacterium
AQRRA

SEQ ID NO: 432381 - protein, 12 aa, Mycobacterium
AQRRAEDRQRAE

SEQ ID NO: 432382 - protein, 6 aa, Mycobacterium
AQRRAP

SEQ ID NO: 432383 - protein, 12 aa, Mycobacterium
AQRRASGPGRPR

SEQ ID NO: 432384 - protein, 5 aa, Mycobacterium
AQRRD

SEQ ID NO: 432385 - protein, 8 aa, Mycobacterium
AQRRDPDA

SEQ ID NO: 432386 - protein, 11 aa, Mycobacterium
AQRRDPGLSES

SEQ ID NO: 432387 - protein, 18 aa, Mycobacterium
AQRRGELPSNAVSGGPLH

SEQ ID NO: 432388 - protein, 6 aa, Mycobacterium
AQRRGT

SEQ ID NO: 432389 - protein, 6 aa, Mycobacterium
AQRRNI

SEQ ID NO: 432390 - protein, 7 aa, Mycobacterium
AQRRNVD

SEQ ID NO: 432391 - protein, 7 aa, Mycobacterium
AQRRPAE

SEQ ID NO: 432392 - protein, 6 aa, Mycobacterium
AQRRPD

SEQ ID NO: 432393 - protein, 7 aa, Mycobacterium
AQRRPEA

SEQ ID NO: 432394 - protein, 14 aa, Mycobacterium
AQRRPSDAVLNGEN

SEQ ID NO: 432395 - protein, 8 aa, Mycobacterium
AQRRQRES

SEQ ID NO: 432396 - protein, 12 aa, Mycobacterium
AQRRRDGVRLFA

SEQ ID NO: 432397 - protein, 16 aa, Mycobacterium
AQRRYETAARQRDATT

SEQ ID NO: 432398 - protein, 4 aa, Mycobacterium
AQRS

SEQ ID NO: 432399 - protein, 5 aa, Mycobacterium
AQRSA

SEQ ID NO: 432400 - protein, 10 aa, Mycobacterium
AQRSAGAHPY

SEQ ID NO: 432401 - protein, 12 aa, Mycobacterium
AQRSAKAGWPAG

SEQ ID NO: 432402 - protein, 8 aa, Mycobacterium
AQRSDAVH

SEQ ID NO: 432403 - protein, 8 aa, Mycobacterium
AQRSDTRF

SEQ ID NO: 432404 - protein, 6 aa, Mycobacterium
AQRSFD

SEQ ID NO: 432405 - protein, 17 aa, Mycobacterium
AQRSGDHPESDGPGNLR

SEQ ID NO: 432406 - protein, 14 aa, Mycobacterium
AQRSGSVRAGDPRQ

SEQ ID NO: 432407 - protein, 6 aa, Mycobacterium
AQRSGV

SEQ ID NO: 432408 - protein, 14 aa, Mycobacterium
AQRSHSEPHWDTKR

SEQ ID NO: 432409 - protein, 6 aa, Mycobacterium
AQRSLA

SEQ ID NO: 432410 - protein, 7 aa, Mycobacterium
AQRSLRE

SEQ ID NO: 432411 - protein, 8 aa, Mycobacterium
AQRSPGDS

SEQ ID NO: 432412 - protein, 5 aa, Mycobacterium
AQRSR

SEQ ID NO: 432413 - protein, 9 aa, Mycobacterium
AQRSRRSEA

SEQ ID NO: 432414 - protein, 10 aa, Mycobacterium
AQRSRRSEED

SEQ ID NO: 432415 - protein, 16 aa, Mycobacterium
AQRSSDAPEADGPRNL

SEQ ID NO: 432416 - protein, 6 aa, Mycobacterium
AQRSTT

SEQ ID NO: 432417 - protein, 6 aa, Mycobacterium
AQRTAA

SEQ ID NO: 432418 - protein, 11 aa, Mycobacterium
AQRTAETNTEQ

SEQ ID NO: 432419 - protein, 12 aa, Mycobacterium
AQRTAGDRRPSF

SEQ ID NO: 432420 - protein, 8 aa, Mycobacterium
AQRTAQVA

SEQ ID NO: 432421 - protein, 15 aa, Mycobacterium
AQRTDDADLEPTQQE

SEQ ID NO: 432422 - protein, 10 aa, Mycobacterium
AQRTGAADDP

SEQ ID NO: 432423 - protein, 12 aa, Mycobacterium
AQRTGAATQPTF

SEQ ID NO: 432424 - protein, 12 aa, Mycobacterium
AQRTGPRNNQAL

SEQ ID NO: 432425 - protein, 12 aa, Mycobacterium
AQRTGPRRNKTL

SEQ ID NO: 432426 - protein, 12 aa, Mycobacterium
AQRTNPDGRTGG

SEQ ID NO: 432427 - protein, 7 aa, Mycobacterium
AQRTNPE

SEQ ID NO: 432428 - protein, 12 aa, Mycobacterium
AQRTNPEGLTGS

SEQ ID NO: 432429 - protein, 6 aa, Mycobacterium
AQRTTR

SEQ ID NO: 432430 - protein, 19 aa, Mycobacterium
AQRVGNPEFGVGDTADVPA

SEQ ID NO: 432431 - protein, 6 aa, Mycobacterium
AQRVPT

SEQ ID NO: 432432 - protein, 13 aa, Mycobacterium
AQRVRSDDCPNLD

SEQ ID NO: 432433 - protein, 5 aa, Mycobacterium
AQRWS

SEQ ID NO: 432434 - protein, 4 aa, Mycobacterium
AQSA

SEQ ID NO: 432435 - protein, 5 aa, Mycobacterium
AQSAA

SEQ ID NO: 432436 - protein, 11 aa, Mycobacterium
AQSAATSSNLQ

SEQ ID NO: 432437 - protein, 8 aa, Mycobacterium
AQSADRID

SEQ ID NO: 432438 - protein, 5 aa, Mycobacterium
AQSAG

SEQ ID NO: 432439 - protein, 6 aa, Mycobacterium
AQSAGA

SEQ ID NO: 432440 - protein, 13 aa, Mycobacterium
AQSAGFDPKQRRA

SEQ ID NO: 432441 - protein, 10 aa, Mycobacterium
AQSAGQDARL

SEQ ID NO: 432442 - protein, 14 aa, Mycobacterium
AQSAGQVSPGADAT

SEQ ID NO: 432443 - protein, 23 aa, Mycobacterium
AQSANLPRQAHHAPSDDARRRRY

SEQ ID NO: 432444 - protein, 15 aa, Mycobacterium
AQSAPDDDDFRNSRN

SEQ ID NO: 432445 - protein, 7 aa, Mycobacterium
AQSAPES

SEQ ID NO: 432446 - protein, 7 aa, Mycobacterium
AQSAPEV

SEQ ID NO: 432447 - protein, 9 aa, Mycobacterium
AQSAPGSDH

SEQ ID NO: 432448 - protein, 10 aa, Mycobacterium
AQSARDSEIP

SEQ ID NO: 432449 - protein, 8 aa, Mycobacterium
AQSAYPGR

SEQ ID NO: 432450 - protein, 7 aa, Mycobacterium
AQSAYRG

SEQ ID NO: 432451 - protein, 10 aa, Mycobacterium
AQSDAKQKFA

SEQ ID NO: 432452 - protein, 9 aa, Mycobacterium
AQSDGTANN

SEQ ID NO: 432453 - protein, 17 aa, Mycobacterium
AQSDKPLNIPGENLPGS

SEQ ID NO: 432454 - protein, 8 aa, Mycobacterium
AQSDNGER

SEQ ID NO: 432455 - protein, 8 aa, Mycobacterium
AQSDPRHA

SEQ ID NO: 432456 - protein, 6 aa, Mycobacterium
AQSDRA

SEQ ID NO: 432457 - protein, 19 aa, Mycobacterium
AQSDRALGIPGEDLPGSVP

SEQ ID NO: 432458 - protein, 18 aa, Mycobacterium
AQSDRPLNIPGEDLPGSV

SEQ ID NO: 432459 - protein, 19 aa, Mycobacterium
AQSDSRKGAELAKTLLSSR

SEQ ID NO: 432460 - protein, 19 aa, Mycobacterium
AQSDSRKGAEMAEQLLAKR

SEQ ID NO: 432461 - protein, 7 aa, Mycobacterium
AQSECCD

SEQ ID NO: 432462 - protein, 9 aa, Mycobacterium
AQSEQLPKI

SEQ ID NO: 432463 - protein, 10 aa, Mycobacterium
AQSEREDGLN

SEQ ID NO: 432464 - protein, 23 aa, Mycobacterium
AQSESGAGATPVETGSTTAADPL

SEQ ID NO: 432465 - protein, 7 aa, Mycobacterium
AQSETTG

SEQ ID NO: 432466 - protein, 14 aa, Mycobacterium
AQSGARANPIIAPA

SEQ ID NO: 432467 - protein, 8 aa, Mycobacterium
AQSGATTA

SEQ ID NO: 432468 - protein, 5 aa, Mycobacterium
AQSGI

SEQ ID NO: 432469 - protein, 8 aa, Mycobacterium
AQSGKADV

SEQ ID NO: 432470 - protein, 8 aa, Mycobacterium
AQSGNATL

SEQ ID NO: 432471 - protein, 8 aa, Mycobacterium
AQSGNELT

SEQ ID NO: 432472 - protein, 6 aa, Mycobacterium
AQSGNV

SEQ ID NO: 432473 - protein, 8 aa, Mycobacterium
AQSGPGVA

SEQ ID NO: 432474 - protein, 12 aa, Mycobacterium
AQSGQPEEPQAT

SEQ ID NO: 432475 - protein, 6 aa, Mycobacterium
AQSGQR

SEQ ID NO: 432476 - protein, 12 aa, Mycobacterium
AQSGRAPQRGPV

SEQ ID NO: 432477 - protein, 8 aa, Mycobacterium
AQSGSVAE

SEQ ID NO: 432478 - protein, 8 aa, Mycobacterium
AQSGVGEE

SEQ ID NO: 432479 - protein, 8 aa, Mycobacterium
AQSGWQGA

SEQ ID NO: 432480 - protein, 7 aa, Mycobacterium
AQSGYTG

SEQ ID NO: 432481 - protein, 13 aa, Mycobacterium
AQSHGHDAEIELV

SEQ ID NO: 432482 - protein, 14 aa, Mycobacterium
AQSHTGATAIADRQ

SEQ ID NO: 432483 - protein, 19 aa, Mycobacterium
AQSISNSSLTGNADSAFTT

SEQ ID NO: 432484 - protein, 4 aa, Mycobacterium
AQSK

SEQ ID NO: 432485 - protein, 18 aa, Mycobacterium
AQSKDDGPARPSLTERET

SEQ ID NO: 432486 - protein, 9 aa, Mycobacterium
AQSKQGKFM

SEQ ID NO: 432487 - protein, 6 aa, Mycobacterium
AQSLAG

SEQ ID NO: 432488 - protein, 14 aa, Mycobacterium
AQSLATDKYRGQLA

SEQ ID NO: 432489 - protein, 17 aa, Mycobacterium
AQSLERARDTEGPGRDE

SEQ ID NO: 432490 - protein, 8 aa, Mycobacterium
AQSLYTPA

SEQ ID NO: 432491 - protein, 4 aa, Mycobacterium
AQSM

SEQ ID NO: 432492 - protein, 6 aa, Mycobacterium
AQSNHV

SEQ ID NO: 432493 - protein, 11 aa, Mycobacterium
AQSPADGARST

SEQ ID NO: 432494 - protein, 8 aa, Mycobacterium
AQSPASGM

SEQ ID NO: 432495 - protein, 8 aa, Mycobacterium
AQSPDGPA

SEQ ID NO: 432496 - protein, 33 aa, Mycobacterium
AQSPDIAQGVDTAHETRVEGKADPLDLQGAGDQ

SEQ ID NO: 432497 - protein, 25 aa, Mycobacterium
AQSPEAKAKAAAAEQRMAARGRKPG

SEQ ID NO: 432498 - protein, 7 aa, Mycobacterium
AQSPEQL

SEQ ID NO: 432499 - protein, 6 aa, Mycobacterium
AQSPFN

SEQ ID NO: 432500 - protein, 17 aa, Mycobacterium
AQSPIPAESAGTRPARR

SEQ ID NO: 432501 - protein, 8 aa, Mycobacterium
AQSPSADV

SEQ ID NO: 432502 - protein, 6 aa, Mycobacterium
AQSPTI

SEQ ID NO: 432503 - protein, 8 aa, Mycobacterium
AQSPTTDV

SEQ ID NO: 432504 - protein, 8 aa, Mycobacterium
AQSQARQS

SEQ ID NO: 432505 - protein, 7 aa, Mycobacterium
AQSQGES

SEQ ID NO: 432506 - protein, 5 aa, Mycobacterium
AQSQL

SEQ ID NO: 432507 - protein, 7 aa, Mycobacterium
AQSQQRE

SEQ ID NO: 432508 - protein, 7 aa, Mycobacterium
AQSQTDL

SEQ ID NO: 432509 - protein, 4 aa, Mycobacterium
AQSR

SEQ ID NO: 432510 - protein, 6 aa, Mycobacterium
AQSREQ

SEQ ID NO: 432511 - protein, 8 aa, Mycobacterium
AQSRHDGP

SEQ ID NO: 432512 - protein, 6 aa, Mycobacterium
AQSRPD

SEQ ID NO: 432513 - protein, 8 aa, Mycobacterium
AQSRSDPP

SEQ ID NO: 432514 - protein, 28 aa, Mycobacterium
AQSRSETQLRQAQEKADALQADAERKHS

SEQ ID NO: 432515 - protein, 8 aa, Mycobacterium
AQSSFDSG

SEQ ID NO: 432516 - protein, 18 aa, Mycobacterium
AQSSPATSVYDAERSRRV

SEQ ID NO: 432517 - protein, 16 aa, Mycobacterium
AQSSPATSVYDRDRAR

SEQ ID NO: 432518 - protein, 19 aa, Mycobacterium
AQSSPATSVYDRSRAERVA

SEQ ID NO: 432519 - protein, 15 aa, Mycobacterium
AQSSPERDFGPRSAD

SEQ ID NO: 432520 - protein, 17 aa, Mycobacterium
AQSSVTTLTAAGDGTAH

SEQ ID NO: 432521 - protein, 4 aa, Mycobacterium
AQST

SEQ ID NO: 432522 - protein, 6 aa, Mycobacterium
AQSTAG

SEQ ID NO: 432523 - protein, 11 aa, Mycobacterium
AQSTDKRVNLT

SEQ ID NO: 432524 - protein, 5 aa, Mycobacterium
AQSTG

SEQ ID NO: 432525 - protein, 7 aa, Mycobacterium
AQSTGSG

SEQ ID NO: 432526 - protein, 7 aa, Mycobacterium
AQSTGVH

SEQ ID NO: 432527 - protein, 8 aa, Mycobacterium
AQSTQTPV

SEQ ID NO: 432528 - protein, 8 aa, Mycobacterium
AQSTREQR

SEQ ID NO: 432529 - protein, 5 aa, Mycobacterium
AQSTV

SEQ ID NO: 432530 - protein, 17 aa, Mycobacterium
AQSTVAGAGAGPGRDQL

SEQ ID NO: 432531 - protein, 8 aa, Mycobacterium
AQSTVDRT

SEQ ID NO: 432532 - protein, 6 aa, Mycobacterium
AQSTVE

SEQ ID NO: 432533 - protein, 5 aa, Mycobacterium
AQSVK

SEQ ID NO: 432534 - protein, 8 aa, Mycobacterium
AQSVTGEL

SEQ ID NO: 432535 - protein, 5 aa, Mycobacterium
AQTAD

SEQ ID NO: 432536 - protein, 6 aa, Mycobacterium
AQTADS

SEQ ID NO: 432537 - protein, 7 aa, Mycobacterium
AQTAEAL

SEQ ID NO: 432538 - protein, 11 aa, Mycobacterium
AQTAGDRRVTD

SEQ ID NO: 432539 - protein, 17 aa, Mycobacterium
AQTAGERKTLDTNWRSD

SEQ ID NO: 432540 - protein, 8 aa, Mycobacterium
AQTAGGGS

SEQ ID NO: 432541 - protein, 7 aa, Mycobacterium
AQTAKEA

SEQ ID NO: 432542 - protein, 5 aa, Mycobacterium
AQTAL

SEQ ID NO: 432543 - protein, 10 aa, Mycobacterium
AQTANGTQLP

SEQ ID NO: 432544 - protein, 5 aa, Mycobacterium
AQTAP

SEQ ID NO: 432545 - protein, 26 aa, Mycobacterium
AQTAPTAQVSPFTEPTQNTNPAGQAM

SEQ ID NO: 432546 - protein, 10 aa, Mycobacterium
AQTAQAAAHG

SEQ ID NO: 432547 - protein, 7 aa, Mycobacterium
AQTAQDI

SEQ ID NO: 432548 - protein, 9 aa, Mycobacterium
AQTAQDIDG

SEQ ID NO: 432549 - protein, 8 aa, Mycobacterium
AQTAQDIN

SEQ ID NO: 432550 - protein, 8 aa, Mycobacterium
AQTARDFA

SEQ ID NO: 432551 - protein, 20 aa, Mycobacterium
AQTARSNYSDAVTKNSEMWD

SEQ ID NO: 432552 - protein, 12 aa, Mycobacterium
AQTASLDGPIPR

SEQ ID NO: 432553 - protein, 7 aa, Mycobacterium
AQTATNA

SEQ ID NO: 432554 - protein, 7 aa, Mycobacterium
AQTATPE

SEQ ID NO: 432555 - protein, 4 aa, Mycobacterium
AQTD

SEQ ID NO: 432556 - protein, 8 aa, Mycobacterium
AQTDEDKR

SEQ ID NO: 432557 - protein, 9 aa, Mycobacterium
AQTDERARR

SEQ ID NO: 432558 - protein, 8 aa, Mycobacterium
AQTDGATV

SEQ ID NO: 432559 - protein, 5 aa, Mycobacterium
AQTDP

SEQ ID NO: 432560 - protein, 10 aa, Mycobacterium
AQTDSRPLSE

SEQ ID NO: 432561 - protein, 4 aa, Mycobacterium
AQTE

SEQ ID NO: 432562 - protein, 6 aa, Mycobacterium
AQTEAA

SEQ ID NO: 432563 - protein, 11 aa, Mycobacterium
AQTEAPGNARD

SEQ ID NO: 432564 - protein, 8 aa, Mycobacterium
AQTEASSV

SEQ ID NO: 432565 - protein, 6 aa, Mycobacterium
AQTEDA

SEQ ID NO: 432566 - protein, 6 aa, Mycobacterium
AQTEDV

SEQ ID NO: 432567 - protein, 13 aa, Mycobacterium
AQTEEARRWIIDG

SEQ ID NO: 432568 - protein, 7 aa, Mycobacterium
AQTEHSG

SEQ ID NO: 432569 - protein, 7 aa, Mycobacterium
AQTENPG

SEQ ID NO: 432570 - protein, 4 aa, Mycobacterium
AQTF

SEQ ID NO: 432571 - protein, 6 aa, Mycobacterium
AQTGAT

SEQ ID NO: 432572 - protein, 7 aa, Mycobacterium
AQTGDSW

SEQ ID NO: 432573 - protein, 8 aa, Mycobacterium
AQTGKSLA

SEQ ID NO: 432574 - protein, 6 aa, Mycobacterium
AQTGLP

SEQ ID NO: 432575 - protein, 13 aa, Mycobacterium
AQTGLSAGDVEPA

SEQ ID NO: 432576 - protein, 8 aa, Mycobacterium
AQTGNPVG

SEQ ID NO: 432577 - protein, 5 aa, Mycobacterium
AQTGR

SEQ ID NO: 432578 - protein, 6 aa, Mycobacterium
AQTGRE

SEQ ID NO: 432579 - protein, 13 aa, Mycobacterium
AQTGSASGAGNAL

SEQ ID NO: 432580 - protein, 6 aa, Mycobacterium
AQTGSS

SEQ ID NO: 432581 - protein, 8 aa, Mycobacterium
AQTGSSLA

SEQ ID NO: 432582 - protein, 11 aa, Mycobacterium
AQTGSYAPPTN

SEQ ID NO: 432583 - protein, 6 aa, Mycobacterium
AQTGTR

SEQ ID NO: 432584 - protein, 6 aa, Mycobacterium
AQTGTW

SEQ ID NO: 432585 - protein, 22 aa, Mycobacterium
AQTGVRVSDGSTNVVPEGTEEQ

SEQ ID NO: 432586 - protein, 8 aa, Mycobacterium
AQTHATNR

SEQ ID NO: 432587 - protein, 22 aa, Mycobacterium
AQTHSRPYQKNDQAHVESKNNH

SEQ ID NO: 432588 - protein, 7 aa, Mycobacterium
AQTIRAG

SEQ ID NO: 432589 - protein, 11 aa, Mycobacterium
AQTLAGEYRGS

SEQ ID NO: 432590 - protein, 25 aa, Mycobacterium
AQTLGLTDGGRARISTAAGSAEATV

SEQ ID NO: 432591 - protein, 12 aa, Mycobacterium
AQTLPDPSGAVA

SEQ ID NO: 432592 - protein, 9 aa, Mycobacterium
AQTLPPGAR

SEQ ID NO: 432593 - protein, 6 aa, Mycobacterium
AQTMAG

SEQ ID NO: 432594 - protein, 6 aa, Mycobacterium
AQTPAG

SEQ ID NO: 432595 - protein, 8 aa, Mycobacterium
AQTPDEVE

SEQ ID NO: 432596 - protein, 8 aa, Mycobacterium
AQTPDNAI

SEQ ID NO: 432597 - protein, 6 aa, Mycobacterium
AQTPDT

SEQ ID NO: 432598 - protein, 5 aa, Mycobacterium
AQTPE

SEQ ID NO: 432599 - protein, 6 aa, Mycobacterium
AQTPEF

SEQ ID NO: 432600 - protein, 22 aa, Mycobacterium
AQTPEPLRPTEEDENAHAPTAE

SEQ ID NO: 432601 - protein, 14 aa, Mycobacterium
AQTPGAADKVVVTF

SEQ ID NO: 432602 - protein, 7 aa, Mycobacterium
AQTPGEG

SEQ ID NO: 432603 - protein, 7 aa, Mycobacterium
AQTPGEV

SEQ ID NO: 432604 - protein, 6 aa, Mycobacterium
AQTPGV

SEQ ID NO: 432605 - protein, 7 aa, Mycobacterium
AQTPIDG

SEQ ID NO: 432606 - protein, 9 aa, Mycobacterium
AQTPIERKP

SEQ ID NO: 432607 - protein, 11 aa, Mycobacterium
AQTPIERKPPW

SEQ ID NO: 432608 - protein, 6 aa, Mycobacterium
AQTPKA

SEQ ID NO: 432609 - protein, 8 aa, Mycobacterium
AQTPKGGL

SEQ ID NO: 432610 - protein, 9 aa, Mycobacterium
AQTPNDETA

SEQ ID NO: 432611 - protein, 15 aa, Mycobacterium
AQTPQAQTEDESGDM

SEQ ID NO: 432612 - protein, 7 aa, Mycobacterium
AQTPRTL

SEQ ID NO: 432613 - protein, 12 aa, Mycobacterium
AQTPTPDGDAET

SEQ ID NO: 432614 - protein, 7 aa, Mycobacterium
AQTPTVE

SEQ ID NO: 432615 - protein, 5 aa, Mycobacterium
AQTPV

SEQ ID NO: 432616 - protein, 7 aa, Mycobacterium
AQTQIGG

SEQ ID NO: 432617 - protein, 16 aa, Mycobacterium
AQTQQRIAGYLERLRR

SEQ ID NO: 432618 - protein, 6 aa, Mycobacterium
AQTRAS

SEQ ID NO: 432619 - protein, 8 aa, Mycobacterium
AQTREQFD

SEQ ID NO: 432620 - protein, 8 aa, Mycobacterium
AQTRESLQ

SEQ ID NO: 432621 - protein, 13 aa, Mycobacterium
AQTRGTDPTVSGR

SEQ ID NO: 432622 - protein, 6 aa, Mycobacterium
AQTRLR

SEQ ID NO: 432623 - protein, 11 aa, Mycobacterium
AQTRPADPTVA

SEQ ID NO: 432624 - protein, 28 aa, Mycobacterium
AQTRSEAQLRQAQEKADALQADAERKHS

SEQ ID NO: 432625 - protein, 22 aa, Mycobacterium
AQTSAANVRAAEDELMRLCGDP

SEQ ID NO: 432626 - protein, 6 aa, Mycobacterium
AQTSAG

SEQ ID NO: 432627 - protein, 7 aa, Mycobacterium
AQTSDDE

SEQ ID NO: 432628 - protein, 4 aa, Mycobacterium
AQTT

SEQ ID NO: 432629 - protein, 7 aa, Mycobacterium
AQTTEDL

SEQ ID NO: 432630 - protein, 5 aa, Mycobacterium
AQTTG

SEQ ID NO: 432631 - protein, 7 aa, Mycobacterium
AQTTPTA

SEQ ID NO: 432632 - protein, 6 aa, Mycobacterium
AQTTPW

SEQ ID NO: 432633 - protein, 8 aa, Mycobacterium
AQTTRPGK

SEQ ID NO: 432634 - protein, 16 aa, Mycobacterium
AQTTSQPTSPADATTV

SEQ ID NO: 432635 - protein, 6 aa, Mycobacterium
AQTTTR

SEQ ID NO: 432636 - protein, 5 aa, Mycobacterium
AQTTV

SEQ ID NO: 432637 - protein, 12 aa, Mycobacterium
AQTTVQDIGSLI

SEQ ID NO: 432638 - protein, 10 aa, Mycobacterium
AQTVAGADDI

SEQ ID NO: 432639 - protein, 7 aa, Mycobacterium
AQTVPAQ

SEQ ID NO: 432640 - protein, 5 aa, Mycobacterium
AQTYD

SEQ ID NO: 432641 - protein, 9 aa, Mycobacterium
AQVAANRTQ

SEQ ID NO: 432642 - protein, 9 aa, Mycobacterium
AQVADAAEG

SEQ ID NO: 432643 - protein, 14 aa, Mycobacterium
AQVAEQRRVQGRRR

SEQ ID NO: 432644 - protein, 14 aa, Mycobacterium
AQVDADPFDRSGTA

SEQ ID NO: 432645 - protein, 13 aa, Mycobacterium
AQVDADPFDRTGT

SEQ ID NO: 432646 - protein, 12 aa, Mycobacterium
AQVDAGDAAPRV

SEQ ID NO: 432647 - protein, 16 aa, Mycobacterium
AQVDKGKVVSTATVDD

SEQ ID NO: 432648 - protein, 8 aa, Mycobacterium
AQVDSESL

SEQ ID NO: 432649 - protein, 6 aa, Mycobacterium
AQVEEL

SEQ ID NO: 432650 - protein, 8 aa, Mycobacterium
AQVEIPSP

SEQ ID NO: 432651 - protein, 9 aa, Mycobacterium
AQVEPVPGT

SEQ ID NO: 432652 - protein, 6 aa, Mycobacterium
AQVGGA

SEQ ID NO: 432653 - protein, 13 aa, Mycobacterium
AQVGHRDAARQVA

SEQ ID NO: 432654 - protein, 8 aa, Mycobacterium
AQVGPDAD

SEQ ID NO: 432655 - protein, 9 aa, Mycobacterium
AQVKETAYQ

SEQ ID NO: 432656 - protein, 40 aa, Mycobacterium
AQVKTNTPLGLGPGTGRPLAAGRERSNATISPSPTDGTHL

SEQ ID NO: 432657 - protein, 4 aa, Mycobacterium
AQVN

SEQ ID NO: 432658 - protein, 5 aa, Mycobacterium
AQVNR

SEQ ID NO: 432659 - protein, 14 aa, Mycobacterium
AQVPAADGSGPTPW

SEQ ID NO: 432660 - protein, 6 aa, Mycobacterium
AQVPDD

SEQ ID NO: 432661 - protein, 6 aa, Mycobacterium
AQVPHS

SEQ ID NO: 432662 - protein, 18 aa, Mycobacterium
AQVPRTATNNVNADAALA

SEQ ID NO: 432663 - protein, 13 aa, Mycobacterium
AQVPTADGKEAEF

SEQ ID NO: 432664 - protein, 27 aa, Mycobacterium
AQVPTAGTADARSVDGAVNSSEIPERD

SEQ ID NO: 432665 - protein, 5 aa, Mycobacterium
AQVPV

SEQ ID NO: 432666 - protein, 4 aa, Mycobacterium
AQVR

SEQ ID NO: 432667 - protein, 5 aa, Mycobacterium
AQVRD

SEQ ID NO: 432668 - protein, 5 aa, Mycobacterium
AQVRQ

SEQ ID NO: 432669 - protein, 11 aa, Mycobacterium
AQVRSGPQSPV

SEQ ID NO: 432670 - protein, 8 aa, Mycobacterium
AQVSAAAT

SEQ ID NO: 432671 - protein, 5 aa, Mycobacterium
AQVSD

SEQ ID NO: 432672 - protein, 13 aa, Mycobacterium
AQVSGSDAKESRG

SEQ ID NO: 432673 - protein, 10 aa, Mycobacterium
AQVSPWSPRE

SEQ ID NO: 432674 - protein, 9 aa, Mycobacterium
AQVTDPREA

SEQ ID NO: 432675 - protein, 7 aa, Mycobacterium
AQVTEGK

SEQ ID NO: 432676 - protein, 6 aa, Mycobacterium
AQVTLD

SEQ ID NO: 432677 - protein, 10 aa, Mycobacterium
AQVYGASARD

SEQ ID NO: 432678 - protein, 44 aa, Mycobacterium
AQWAQPPQPPSPRRGPVKRAPKPAKPATKKTAKTATKPASTTGR

SEQ ID NO: 432679 - protein, 4 aa, Mycobacterium
AQWP

SEQ ID NO: 432680 - protein, 4 aa, Mycobacterium
AQWS

SEQ ID NO: 432681 - protein, 4 aa, Mycobacterium
AQWT

SEQ ID NO: 432682 - protein, 5 aa, Mycobacterium
AQYAK

SEQ ID NO: 432683 - protein, 9 aa, Mycobacterium
AQYATAAGE

SEQ ID NO: 432684 - protein, 4 aa, Mycobacterium
AQYD

SEQ ID NO: 432685 - protein, 6 aa, Mycobacterium
AQYDPG

SEQ ID NO: 432686 - protein, 4 aa, Mycobacterium
AQYE

SEQ ID NO: 432687 - protein, 12 aa, Mycobacterium
AQYEDQGNPYYS

SEQ ID NO: 432688 - protein, 12 aa, Mycobacterium
AQYESQGNPYYS

SEQ ID NO: 432689 - protein, 19 aa, Mycobacterium
AQYGDAANSSYTATSGASQ

SEQ ID NO: 432690 - protein, 6 aa, Mycobacterium
AQYKED

SEQ ID NO: 432691 - protein, 4 aa, Mycobacterium
AQYP

SEQ ID NO: 432692 - protein, 10 aa, Mycobacterium
AQYPDNDTKR

SEQ ID NO: 432693 - protein, 16 aa, Mycobacterium
AQYPESDIGSLAPEEL

SEQ ID NO: 432694 - protein, 10 aa, Mycobacterium
AQYPPPSAAE

SEQ ID NO: 432695 - protein, 4 aa, Mycobacterium
AQYQ

SEQ ID NO: 432696 - protein, 9 aa, Mycobacterium
AQYQQATQD

SEQ ID NO: 432697 - protein, 6 aa, Mycobacterium
AQYRAA

SEQ ID NO: 432698 - protein, 19 aa, Mycobacterium
AQYRDRYPRELSGGQQQRV

SEQ ID NO: 432699 - protein, 6 aa, Mycobacterium
AQYSKS

SEQ ID NO: 432700 - protein, 5 aa, Mycobacterium
AQYSQ

SEQ ID NO: 432701 - protein, 8 aa, Mycobacterium
ARAAAAQR

SEQ ID NO: 432702 - protein, 8 aa, Mycobacterium
ARAAADGA

SEQ ID NO: 432703 - protein, 7 aa, Mycobacterium
ARAAARA

SEQ ID NO: 432704 - protein, 46 aa, Mycobacterium
ARAAARARGQDPGRGFAAGPAPRRVAGRRRSWSGPGPDTRDPQPLG

SEQ ID NO: 432705 - protein, 8 aa, Mycobacterium
ARAAARTG

SEQ ID NO: 432706 - protein, 9 aa, Mycobacterium
ARAAARTGV

SEQ ID NO: 432707 - protein, 20 aa, Mycobacterium
ARAAARYGADTCARGDEDAA

SEQ ID NO: 432708 - protein, 21 aa, Mycobacterium
ARAAATAAAAETAAAITTQGQ

SEQ ID NO: 432709 - protein, 11 aa, Mycobacterium
ARAADAPDDVI

SEQ ID NO: 432710 - protein, 11 aa, Mycobacterium
ARAADAPDEVI

SEQ ID NO: 432711 - protein, 22 aa, Mycobacterium
ARAADDDGEHARSTMRAGPRFP

SEQ ID NO: 432712 - protein, 10 aa, Mycobacterium
ARAADGPFGG

SEQ ID NO: 432713 - protein, 7 aa, Mycobacterium
ARAADRG

SEQ ID NO: 432714 - protein, 7 aa, Mycobacterium
ARAAELA

SEQ ID NO: 432715 - protein, 10 aa, Mycobacterium
ARAAESADEK

SEQ ID NO: 432716 - protein, 8 aa, Mycobacterium
ARAAESAG

SEQ ID NO: 432717 - protein, 9 aa, Mycobacterium
ARAAESDAH

SEQ ID NO: 432718 - protein, 11 aa, Mycobacterium
ARAAETAQADP

SEQ ID NO: 432719 - protein, 9 aa, Mycobacterium
ARAAETASQ

SEQ ID NO: 432720 - protein, 10 aa, Mycobacterium
ARAAETRSQH

SEQ ID NO: 432721 - protein, 5 aa, Mycobacterium
ARAAF

SEQ ID NO: 432722 - protein, 6 aa, Mycobacterium
ARAAGA

SEQ ID NO: 432723 - protein, 12 aa, Mycobacterium
ARAAGAADQANA

SEQ ID NO: 432724 - protein, 10 aa, Mycobacterium
ARAAGAAEIR

SEQ ID NO: 432725 - protein, 10 aa, Mycobacterium
ARAAGAATIA

SEQ ID NO: 432726 - protein, 23 aa, Mycobacterium
ARAAGAGASLDDVEAAARAAAQR

SEQ ID NO: 432727 - protein, 7 aa, Mycobacterium
ARAAGAK

SEQ ID NO: 432728 - protein, 9 aa, Mycobacterium
ARAAGDSAA

SEQ ID NO: 432729 - protein, 8 aa, Mycobacterium
ARAAGGRT

SEQ ID NO: 432730 - protein, 9 aa, Mycobacterium
ARAAGHGSK

SEQ ID NO: 432731 - protein, 11 aa, Mycobacterium
ARAAGLDGDHV

SEQ ID NO: 432732 - protein, 9 aa, Mycobacterium
ARAAGPDGL

SEQ ID NO: 432733 - protein, 8 aa, Mycobacterium
ARAAGPEG

SEQ ID NO: 432734 - protein, 10 aa, Mycobacterium
ARAAGQITDA

SEQ ID NO: 432735 - protein, 8 aa, Mycobacterium
ARAAGRGV

SEQ ID NO: 432736 - protein, 12 aa, Mycobacterium
ARAAGRNPAEVT

SEQ ID NO: 432737 - protein, 15 aa, Mycobacterium
ARAAGSGTVTRGRKK

SEQ ID NO: 432738 - protein, 7 aa, Mycobacterium
ARAAGSV

SEQ ID NO: 432739 - protein, 7 aa, Mycobacterium
ARAAGVR

SEQ ID NO: 432740 - protein, 13 aa, Mycobacterium
ARAAHEAATAAGH

SEQ ID NO: 432741 - protein, 14 aa, Mycobacterium
ARAAHESLTGRAGS

SEQ ID NO: 432742 - protein, 10 aa, Mycobacterium
ARAAHGGDAL

SEQ ID NO: 432743 - protein, 5 aa, Mycobacterium
ARAAI

SEQ ID NO: 432744 - protein, 8 aa, Mycobacterium
ARAAIAGK

SEQ ID NO: 432745 - protein, 14 aa, Mycobacterium
ARAAKKAVKRNGWG

SEQ ID NO: 432746 - protein, 8 aa, Mycobacterium
ARAALPPD

SEQ ID NO: 432747 - protein, 6 aa, Mycobacterium
ARAALT

SEQ ID NO: 432748 - protein, 6 aa, Mycobacterium
ARAANT

SEQ ID NO: 432749 - protein, 13 aa, Mycobacterium
ARAAPPGPQPARP

SEQ ID NO: 432750 - protein, 15 aa, Mycobacterium
ARAAQADWANRPVSE

SEQ ID NO: 432751 - protein, 8 aa, Mycobacterium
ARAAQGLR

SEQ ID NO: 432752 - protein, 7 aa, Mycobacterium
ARAAQRG

SEQ ID NO: 432753 - protein, 14 aa, Mycobacterium
ARAARDAAEAGAQA

SEQ ID NO: 432754 - protein, 13 aa, Mycobacterium
ARAARGDEDVPAQ

SEQ ID NO: 432755 - protein, 12 aa, Mycobacterium
ARAARGEQDTAS

SEQ ID NO: 432756 - protein, 11 aa, Mycobacterium
ARAARKPPLPD

SEQ ID NO: 432757 - protein, 9 aa, Mycobacterium
ARAARSGRT

SEQ ID NO: 432758 - protein, 11 aa, Mycobacterium
ARAARVDGATL

SEQ ID NO: 432759 - protein, 5 aa, Mycobacterium
ARAAS

SEQ ID NO: 432760 - protein, 10 aa, Mycobacterium
ARAASHADLP

SEQ ID NO: 432761 - protein, 10 aa, Mycobacterium
ARAASHGGIS

SEQ ID NO: 432762 - protein, 9 aa, Mycobacterium
ARAASRTAH

SEQ ID NO: 432763 - protein, 12 aa, Mycobacterium
ARAASSGGGLRQ

SEQ ID NO: 432764 - protein, 9 aa, Mycobacterium
ARAASSTLA

SEQ ID NO: 432765 - protein, 11 aa, Mycobacterium
ARAASVTRTGD

SEQ ID NO: 432766 - protein, 8 aa, Mycobacterium
ARAATGLD

SEQ ID NO: 432767 - protein, 14 aa, Mycobacterium
ARAATGRDESVLTG

SEQ ID NO: 432768 - protein, 10 aa, Mycobacterium
ARAATTGPIG

SEQ ID NO: 432769 - protein, 9 aa, Mycobacterium
ARAATTGPL

SEQ ID NO: 432770 - protein, 5 aa, Mycobacterium
ARADA

SEQ ID NO: 432771 - protein, 7 aa, Mycobacterium
ARADAAP

SEQ ID NO: 432772 - protein, 6 aa, Mycobacterium
ARADAD

SEQ ID NO: 432773 - protein, 11 aa, Mycobacterium
ARADAGSGAAV

SEQ ID NO: 432774 - protein, 14 aa, Mycobacterium
ARADANRVRAGADR

SEQ ID NO: 432775 - protein, 14 aa, Mycobacterium
ARADANRVRSGADR

SEQ ID NO: 432776 - protein, 15 aa, Mycobacterium
ARADATKVRSGSDRA

SEQ ID NO: 432777 - protein, 15 aa, Mycobacterium
ARADATRVRSGADRA

SEQ ID NO: 432778 - protein, 14 aa, Mycobacterium
ARADATRVRSGAER

SEQ ID NO: 432779 - protein, 15 aa, Mycobacterium
ARADATRVRSGSERA

SEQ ID NO: 432780 - protein, 19 aa, Mycobacterium
ARADATTRPSTPLAQREEM

SEQ ID NO: 432781 - protein, 5 aa, Mycobacterium
ARADD

SEQ ID NO: 432782 - protein, 6 aa, Mycobacterium
ARADDL

SEQ ID NO: 432783 - protein, 6 aa, Mycobacterium
ARADDP

SEQ ID NO: 432784 - protein, 14 aa, Mycobacterium
ARADDPALDPARSS

SEQ ID NO: 432785 - protein, 10 aa, Mycobacterium
ARADDPEALT

SEQ ID NO: 432786 - protein, 12 aa, Mycobacterium
ARADDSAPLELP

SEQ ID NO: 432787 - protein, 5 aa, Mycobacterium
ARADG

SEQ ID NO: 432788 - protein, 7 aa, Mycobacterium
ARADGCP

SEQ ID NO: 432789 - protein, 7 aa, Mycobacterium
ARADGDG

SEQ ID NO: 432790 - protein, 9 aa, Mycobacterium
ARADGEQRT

SEQ ID NO: 432791 - protein, 10 aa, Mycobacterium
ARADGHDHAA

SEQ ID NO: 432792 - protein, 11 aa, Mycobacterium
ARADGSLTGER

SEQ ID NO: 432793 - protein, 22 aa, Mycobacterium
ARADGYAITTGEREDSASGLSA

SEQ ID NO: 432794 - protein, 8 aa, Mycobacterium
ARADNLTD

SEQ ID NO: 432795 - protein, 10 aa, Mycobacterium
ARADPEDRTA

SEQ ID NO: 432796 - protein, 15 aa, Mycobacterium
ARADPTRVRSGADRA

SEQ ID NO: 432797 - protein, 11 aa, Mycobacterium
ARADQGPLKRN

SEQ ID NO: 432798 - protein, 5 aa, Mycobacterium
ARADR

SEQ ID NO: 432799 - protein, 8 aa, Mycobacterium
ARADRNAK

SEQ ID NO: 432800 - protein, 11 aa, Mycobacterium
ARADSAAAGTA

SEQ ID NO: 432801 - protein, 11 aa, Mycobacterium
ARADSGGGFDE

SEQ ID NO: 432802 - protein, 8 aa, Mycobacterium
ARADSNRL

SEQ ID NO: 432803 - protein, 13 aa, Mycobacterium
ARADSVARTDTGV

SEQ ID NO: 432804 - protein, 11 aa, Mycobacterium
ARADTATPVTP

SEQ ID NO: 432805 - protein, 5 aa, Mycobacterium
ARADV

SEQ ID NO: 432806 - protein, 5 aa, Mycobacterium
ARAEA

SEQ ID NO: 432807 - protein, 18 aa, Mycobacterium
ARAEAAAARALAQTPAHT

SEQ ID NO: 432808 - protein, 9 aa, Mycobacterium
ARAEAARTY

SEQ ID NO: 432809 - protein, 6 aa, Mycobacterium
ARAEAD

SEQ ID NO: 432810 - protein, 18 aa, Mycobacterium
ARAEAERSSRAATAAREL

SEQ ID NO: 432811 - protein, 23 aa, Mycobacterium
ARAEAGSGAAVRDQDGRTYAGAP

SEQ ID NO: 432812 - protein, 7 aa, Mycobacterium
ARAEAQP

SEQ ID NO: 432813 - protein, 10 aa, Mycobacterium
ARAEARAAAE

SEQ ID NO: 432814 - protein, 9 aa, Mycobacterium
ARAEARRRY

SEQ ID NO: 432815 - protein, 10 aa, Mycobacterium
ARAEERTPGV

SEQ ID NO: 432816 - protein, 6 aa, Mycobacterium
ARAEES

SEQ ID NO: 432817 - protein, 5 aa, Mycobacterium
ARAEG

SEQ ID NO: 432818 - protein, 7 aa, Mycobacterium
ARAEGDV

SEQ ID NO: 432819 - protein, 7 aa, Mycobacterium
ARAEGIS

SEQ ID NO: 432820 - protein, 16 aa, Mycobacterium
ARAEGNRALDAGDHDA

SEQ ID NO: 432821 - protein, 17 aa, Mycobacterium
ARAEGNRALDSGDHDGA

SEQ ID NO: 432822 - protein, 22 aa, Mycobacterium
ARAEGNRALDSGDHQTAMQQAS

SEQ ID NO: 432823 - protein, 13 aa, Mycobacterium
ARAEKRPAVFTDD

SEQ ID NO: 432824 - protein, 13 aa, Mycobacterium
ARAEKRPPAFTDD

SEQ ID NO: 432825 - protein, 13 aa, Mycobacterium
ARAEKRPPVFTDD

SEQ ID NO: 432826 - protein, 5 aa, Mycobacterium
ARAEL

SEQ ID NO: 432827 - protein, 10 aa, Mycobacterium
ARAELAAQDD

SEQ ID NO: 432828 - protein, 10 aa, Mycobacterium
ARAELDARGR

SEQ ID NO: 432829 - protein, 10 aa, Mycobacterium
ARAEMAAQSD

SEQ ID NO: 432830 - protein, 19 aa, Mycobacterium
ARAENESAPRTLSTEPVSV

SEQ ID NO: 432831 - protein, 5 aa, Mycobacterium
ARAEP

SEQ ID NO: 432832 - protein, 11 aa, Mycobacterium
ARAEPPKVPEL

SEQ ID NO: 432833 - protein, 6 aa, Mycobacterium
ARAEPS

SEQ ID NO: 432834 - protein, 11 aa, Mycobacterium
ARAEQAGMQAR

SEQ ID NO: 432835 - protein, 8 aa, Mycobacterium
ARAEQERT

SEQ ID NO: 432836 - protein, 7 aa, Mycobacterium
ARAEQGL

SEQ ID NO: 432837 - protein, 5 aa, Mycobacterium
ARAER

SEQ ID NO: 432838 - protein, 9 aa, Mycobacterium
ARAERAPAP

SEQ ID NO: 432839 - protein, 25 aa, Mycobacterium
ARAERDAIAEASTADAARRNGADPL

SEQ ID NO: 432840 - protein, 17 aa, Mycobacterium
ARAEREAAAAARRSGVE

SEQ ID NO: 432841 - protein, 9 aa, Mycobacterium
ARAERGEGN

SEQ ID NO: 432842 - protein, 8 aa, Mycobacterium
ARAERGEK

SEQ ID NO: 432843 - protein, 9 aa, Mycobacterium
ARAERGEQN

SEQ ID NO: 432844 - protein, 9 aa, Mycobacterium
ARAERGESN

SEQ ID NO: 432845 - protein, 8 aa, Mycobacterium
ARAERPDT

SEQ ID NO: 432846 - protein, 7 aa, Mycobacterium
ARAERRA

SEQ ID NO: 432847 - protein, 8 aa, Mycobacterium
ARAERRAI

SEQ ID NO: 432848 - protein, 18 aa, Mycobacterium
ARAERRAIPSKGLTGTGY

SEQ ID NO: 432849 - protein, 19 aa, Mycobacterium
ARAERRAIPSKGLTGTGYD

SEQ ID NO: 432850 - protein, 8 aa, Mycobacterium
ARAERRGA

SEQ ID NO: 432851 - protein, 13 aa, Mycobacterium
ARAERRPAVFTDD

SEQ ID NO: 432852 - protein, 13 aa, Mycobacterium
ARAERRPPVFTDD

SEQ ID NO: 432853 - protein, 8 aa, Mycobacterium
ARAESDDN

SEQ ID NO: 432854 - protein, 11 aa, Mycobacterium
ARAESPGESAA

SEQ ID NO: 432855 - protein, 11 aa, Mycobacterium
ARAESVTRTDT

SEQ ID NO: 432856 - protein, 11 aa, Mycobacterium
ARAESVTRTGD

SEQ ID NO: 432857 - protein, 8 aa, Mycobacterium
ARAETAQQ

SEQ ID NO: 432858 - protein, 8 aa, Mycobacterium
ARAETRGI

SEQ ID NO: 432859 - protein, 8 aa, Mycobacterium
ARAETRGL

SEQ ID NO: 432860 - protein, 8 aa, Mycobacterium
ARAETVEG

SEQ ID NO: 432861 - protein, 5 aa, Mycobacterium
ARAEY

SEQ ID NO: 432862 - protein, 10 aa, Mycobacterium
ARAFGGDPKN

SEQ ID NO: 432863 - protein, 8 aa, Mycobacterium
ARAGAAAA

SEQ ID NO: 432864 - protein, 11 aa, Mycobacterium
ARAGAAAQAGE

SEQ ID NO: 432865 - protein, 8 aa, Mycobacterium
ARAGADGV

SEQ ID NO: 432866 - protein, 18 aa, Mycobacterium
ARAGADSGAAVRDHEGRT

SEQ ID NO: 432867 - protein, 8 aa, Mycobacterium
ARAGADTA

SEQ ID NO: 432868 - protein, 10 aa, Mycobacterium
ARAGAEPHAH

SEQ ID NO: 432869 - protein, 10 aa, Mycobacterium
ARAGAPPRPS

SEQ ID NO: 432870 - protein, 11 aa, Mycobacterium
ARAGAPPRPSL

SEQ ID NO: 432871 - protein, 11 aa, Mycobacterium
ARAGAPPRPSV

SEQ ID NO: 432872 - protein, 8 aa, Mycobacterium
ARAGARSP

SEQ ID NO: 432873 - protein, 6 aa, Mycobacterium
ARAGAS

SEQ ID NO: 432874 - protein, 9 aa, Mycobacterium
ARAGASGDL

SEQ ID NO: 432875 - protein, 9 aa, Mycobacterium
ARAGASRRE

SEQ ID NO: 432876 - protein, 21 aa, Mycobacterium
ARAGASSRRDSVRGEQKLRTR

SEQ ID NO: 432877 - protein, 10 aa, Mycobacterium
ARAGATGDLK

SEQ ID NO: 432878 - protein, 6 aa, Mycobacterium
ARAGDI

SEQ ID NO: 432879 - protein, 6 aa, Mycobacterium
ARAGDL

SEQ ID NO: 432880 - protein, 11 aa, Mycobacterium
ARAGDPDRPRR

SEQ ID NO: 432881 - protein, 10 aa, Mycobacterium
ARAGDTATSL

SEQ ID NO: 432882 - protein, 14 aa, Mycobacterium
ARAGDTESATDAQA

SEQ ID NO: 432883 - protein, 23 aa, Mycobacterium
ARAGDTINPYRNPSATPVLAPDA

SEQ ID NO: 432884 - protein, 6 aa, Mycobacterium
ARAGDV

SEQ ID NO: 432885 - protein, 10 aa, Mycobacterium
ARAGEAAPVP

SEQ ID NO: 432886 - protein, 9 aa, Mycobacterium
ARAGEDDQK

SEQ ID NO: 432887 - protein, 8 aa, Mycobacterium
ARAGEFDD

SEQ ID NO: 432888 - protein, 6 aa, Mycobacterium
ARAGEI

SEQ ID NO: 432889 - protein, 7 aa, Mycobacterium
ARAGEIS

SEQ ID NO: 432890 - protein, 7 aa, Mycobacterium
ARAGELK

SEQ ID NO: 432891 - protein, 14 aa, Mycobacterium
ARAGEPDTPVDWSA

SEQ ID NO: 432892 - protein, 7 aa, Mycobacterium
ARAGETD

SEQ ID NO: 432893 - protein, 9 aa, Mycobacterium
ARAGGDHRR

SEQ ID NO: 432894 - protein, 6 aa, Mycobacterium
ARAGGE

SEQ ID NO: 432895 - protein, 6 aa, Mycobacterium
ARAGGF

SEQ ID NO: 432896 - protein, 20 aa, Mycobacterium
ARAGGPDLQRESAAKAPIGL

SEQ ID NO: 432897 - protein, 20 aa, Mycobacterium
ARAGGPEVQRESNEKAPIGL

SEQ ID NO: 432898 - protein, 7 aa, Mycobacterium
ARAGGTA

SEQ ID NO: 432899 - protein, 10 aa, Mycobacterium
ARAGGVADPD

SEQ ID NO: 432900 - protein, 6 aa, Mycobacterium
ARAGHG

SEQ ID NO: 432901 - protein, 7 aa, Mycobacterium
ARAGKLD

SEQ ID NO: 432902 - protein, 9 aa, Mycobacterium
ARAGKPKPH

SEQ ID NO: 432903 - protein, 5 aa, Mycobacterium
ARAGL

SEQ ID NO: 432904 - protein, 11 aa, Mycobacterium
ARAGLAEGGIP

SEQ ID NO: 432905 - protein, 8 aa, Mycobacterium
ARAGLGDP

SEQ ID NO: 432906 - protein, 6 aa, Mycobacterium
ARAGLT

SEQ ID NO: 432907 - protein, 10 aa, Mycobacterium
ARAGNQQAGD

SEQ ID NO: 432908 - protein, 6 aa, Mycobacterium
ARAGPR

SEQ ID NO: 432909 - protein, 6 aa, Mycobacterium
ARAGQA

SEQ ID NO: 432910 - protein, 7 aa, Mycobacterium
ARAGQDG

SEQ ID NO: 432911 - protein, 10 aa, Mycobacterium
ARAGQEPATE

SEQ ID NO: 432912 - protein, 10 aa, Mycobacterium
ARAGQGTPAR

SEQ ID NO: 432913 - protein, 8 aa, Mycobacterium
ARAGQHTT

SEQ ID NO: 432914 - protein, 20 aa, Mycobacterium
ARAGRAAKAHPTTTRGARVE

SEQ ID NO: 432915 - protein, 10 aa, Mycobacterium
ARAGRAPDEI

SEQ ID NO: 432916 - protein, 6 aa, Mycobacterium
ARAGRL

SEQ ID NO: 432917 - protein, 7 aa, Mycobacterium
ARAGRSR

SEQ ID NO: 432918 - protein, 9 aa, Mycobacterium
ARAGSAALN

SEQ ID NO: 432919 - protein, 28 aa, Mycobacterium
ARAGSEPDPEPDPPGGGRGRATPAAASS

SEQ ID NO: 432920 - protein, 7 aa, Mycobacterium
ARAGSPE

SEQ ID NO: 432921 - protein, 20 aa, Mycobacterium
ARAGSTTTYSWGDEATSAGR

SEQ ID NO: 432922 - protein, 15 aa, Mycobacterium
ARAGTLSPAELTGST

SEQ ID NO: 432923 - protein, 7 aa, Mycobacterium
ARAGTRE

SEQ ID NO: 432924 - protein, 9 aa, Mycobacterium
ARAGTREAT

SEQ ID NO: 432925 - protein, 9 aa, Mycobacterium
ARAGTSKPA

SEQ ID NO: 432926 - protein, 7 aa, Mycobacterium
ARAGTTA

SEQ ID NO: 432927 - protein, 8 aa, Mycobacterium
ARAGVGKK

SEQ ID NO: 432928 - protein, 8 aa, Mycobacterium
ARAGVSRS

SEQ ID NO: 432929 - protein, 4 aa, Mycobacterium
ARAH

SEQ ID NO: 432930 - protein, 13 aa, Mycobacterium
ARAHARAQAGTIT

SEQ ID NO: 432931 - protein, 6 aa, Mycobacterium
ARAHED

SEQ ID NO: 432932 - protein, 8 aa, Mycobacterium
ARAHPDGR

SEQ ID NO: 432933 - protein, 19 aa, Mycobacterium
ARAHQDLQGRKTAGSIVLL

SEQ ID NO: 432934 - protein, 19 aa, Mycobacterium
ARAHQDLQGRKTTGSIVLL

SEQ ID NO: 432935 - protein, 18 aa, Mycobacterium
ARAHQDRRGLVPGSARNA

SEQ ID NO: 432936 - protein, 6 aa, Mycobacterium
ARAHQS

SEQ ID NO: 432937 - protein, 6 aa, Mycobacterium
ARAHRE

SEQ ID NO: 432938 - protein, 17 aa, Mycobacterium
ARAKAAGGADRVISGDD

SEQ ID NO: 432939 - protein, 12 aa, Mycobacterium
ARAKDAEAAARE

SEQ ID NO: 432940 - protein, 7 aa, Mycobacterium
ARAKDEF

SEQ ID NO: 432941 - protein, 8 aa, Mycobacterium
ARAKDEFD

SEQ ID NO: 432942 - protein, 6 aa, Mycobacterium
ARAKDG

SEQ ID NO: 432943 - protein, 13 aa, Mycobacterium
ARAKEAIDSGAAE

SEQ ID NO: 432944 - protein, 9 aa, Mycobacterium
ARAKEQDAE

SEQ ID NO: 432945 - protein, 9 aa, Mycobacterium
ARAKESFGV

SEQ ID NO: 432946 - protein, 26 aa, Mycobacterium
ARAKGARVESVAPAGESLPDPGTRKI

SEQ ID NO: 432947 - protein, 9 aa, Mycobacterium
ARAKGDAAL

SEQ ID NO: 432948 - protein, 5 aa, Mycobacterium
ARAKM

SEQ ID NO: 432949 - protein, 8 aa, Mycobacterium
ARAKMSGL

SEQ ID NO: 432950 - protein, 8 aa, Mycobacterium
ARAKNGDT

SEQ ID NO: 432951 - protein, 15 aa, Mycobacterium
ARAKSAATAEWSGTE

SEQ ID NO: 432952 - protein, 8 aa, Mycobacterium
ARAKYSPA

SEQ ID NO: 432953 - protein, 9 aa, Mycobacterium
ARAKYSPSQ

SEQ ID NO: 432954 - protein, 11 aa, Mycobacterium
ARALADGDAAA

SEQ ID NO: 432955 - protein, 17 aa, Mycobacterium
ARALAEESRESGWDKPS

SEQ ID NO: 432956 - protein, 17 aa, Mycobacterium
ARALAEESRETGWDKPS

SEQ ID NO: 432957 - protein, 18 aa, Mycobacterium
ARALDREDTFGNLDAGKE

SEQ ID NO: 432958 - protein, 9 aa, Mycobacterium
ARALDSPQP

SEQ ID NO: 432959 - protein, 6 aa, Mycobacterium
ARALEG

SEQ ID NO: 432960 - protein, 10 aa, Mycobacterium
ARALPAPEYH

SEQ ID NO: 432961 - protein, 5 aa, Mycobacterium
ARALS

SEQ ID NO: 432962 - protein, 8 aa, Mycobacterium
ARANADQI

SEQ ID NO: 432963 - protein, 9 aa, Mycobacterium
ARANESHTK

SEQ ID NO: 432964 - protein, 8 aa, Mycobacterium
ARANGELP

SEQ ID NO: 432965 - protein, 8 aa, Mycobacterium
ARANGEVN

SEQ ID NO: 432966 - protein, 12 aa, Mycobacterium
ARANGGEPDAGR

SEQ ID NO: 432967 - protein, 9 aa, Mycobacterium
ARANGGYRA

SEQ ID NO: 432968 - protein, 12 aa, Mycobacterium
ARANKPPAMLRI

SEQ ID NO: 432969 - protein, 6 aa, Mycobacterium
ARANNC

SEQ ID NO: 432970 - protein, 9 aa, Mycobacterium
ARANPLAQT

SEQ ID NO: 432971 - protein, 6 aa, Mycobacterium
ARANQV

SEQ ID NO: 432972 - protein, 12 aa, Mycobacterium
ARANRGEPDAGR

SEQ ID NO: 432973 - protein, 8 aa, Mycobacterium
ARANRTPV

SEQ ID NO: 432974 - protein, 7 aa, Mycobacterium
ARANTAV

SEQ ID NO: 432975 - protein, 4 aa, Mycobacterium
ARAP

SEQ ID NO: 432976 - protein, 5 aa, Mycobacterium
ARAPA

SEQ ID NO: 432977 - protein, 9 aa, Mycobacterium
ARAPACAPA

SEQ ID NO: 432978 - protein, 5 aa, Mycobacterium
ARAPE

SEQ ID NO: 432979 - protein, 7 aa, Mycobacterium
ARAPEKV

SEQ ID NO: 432980 - protein, 8 aa, Mycobacterium
ARAPEKVG

SEQ ID NO: 432981 - protein, 8 aa, Mycobacterium
ARAPERID

SEQ ID NO: 432982 - protein, 10 aa, Mycobacterium
ARAPGATGEI

SEQ ID NO: 432983 - protein, 7 aa, Mycobacterium
ARAPGLA

SEQ ID NO: 432984 - protein, 9 aa, Mycobacterium
ARAPGQDLE

SEQ ID NO: 432985 - protein, 8 aa, Mycobacterium
ARAPGTVL

SEQ ID NO: 432986 - protein, 9 aa, Mycobacterium
ARAPHPSRE

SEQ ID NO: 432987 - protein, 12 aa, Mycobacterium
ARAPKGTNGERQ

SEQ ID NO: 432988 - protein, 7 aa, Mycobacterium
ARAPQAA

SEQ ID NO: 432989 - protein, 9 aa, Mycobacterium
ARAPQGREP

SEQ ID NO: 432990 - protein, 19 aa, Mycobacterium
ARAPRGYGLSGPEGNHDDD

SEQ ID NO: 432991 - protein, 7 aa, Mycobacterium
ARAPRVS

SEQ ID NO: 432992 - protein, 7 aa, Mycobacterium
ARAQADQ

SEQ ID NO: 432993 - protein, 12 aa, Mycobacterium
ARAQAESRRQAR

SEQ ID NO: 432994 - protein, 15 aa, Mycobacterium
ARAQARQSIKAATDD

SEQ ID NO: 432995 - protein, 15 aa, Mycobacterium
ARAQARQSVKAATDE

SEQ ID NO: 432996 - protein, 6 aa, Mycobacterium
ARAQEA

SEQ ID NO: 432997 - protein, 7 aa, Mycobacterium
ARAQGAR

SEQ ID NO: 432998 - protein, 10 aa, Mycobacterium
ARAQNPASGA

SEQ ID NO: 432999 - protein, 7 aa, Mycobacterium
ARAQPGA

SEQ ID NO: 433000 - protein, 11 aa, Mycobacterium
ARAQPQRARSG

SEQ ID NO: 433001 - protein, 8 aa, Mycobacterium
ARAQQAAR

SEQ ID NO: 433002 - protein, 30 aa, Mycobacterium
ARAQQAGGSCQITSSAGSGTHVRWSAPLSG

SEQ ID NO: 433003 - protein, 9 aa, Mycobacterium
ARAQQTRAE

SEQ ID NO: 433004 - protein, 6 aa, Mycobacterium
ARAQRA

SEQ ID NO: 433005 - protein, 8 aa, Mycobacterium
ARAQREMK

SEQ ID NO: 433006 - protein, 10 aa, Mycobacterium
ARAQRPGTYY

SEQ ID NO: 433007 - protein, 8 aa, Mycobacterium
ARAQRRDV

SEQ ID NO: 433008 - protein, 12 aa, Mycobacterium
ARAQRVGDPLPF

SEQ ID NO: 433009 - protein, 16 aa, Mycobacterium
ARAQSAAGQAKTVAST

SEQ ID NO: 433010 - protein, 25 aa, Mycobacterium
ARAQSALGGQHPPDCEPDPAAPAIP

SEQ ID NO: 433011 - protein, 11 aa, Mycobacterium
ARAQSVTRTDD

SEQ ID NO: 433012 - protein, 8 aa, Mycobacterium
ARAQTGKA

SEQ ID NO: 433013 - protein, 7 aa, Mycobacterium
ARAQTRR

SEQ ID NO: 433014 - protein, 10 aa, Mycobacterium
ARARAEPGDP

SEQ ID NO: 433015 - protein, 8 aa, Mycobacterium
ARARDEGL

SEQ ID NO: 433016 - protein, 10 aa, Mycobacterium
ARAREAAAQQ

SEQ ID NO: 433017 - protein, 13 aa, Mycobacterium
ARAREAAGPGAPE

SEQ ID NO: 433018 - protein, 7 aa, Mycobacterium
ARAREAG

SEQ ID NO: 433019 - protein, 9 aa, Mycobacterium
ARAREPDDQ

SEQ ID NO: 433020 - protein, 19 aa, Mycobacterium
ARARGDGDEGGDNDPMNAH

SEQ ID NO: 433021 - protein, 6 aa, Mycobacterium
ARARGG

SEQ ID NO: 433022 - protein, 11 aa, Mycobacterium
ARARNLRQPPA

SEQ ID NO: 433023 - protein, 14 aa, Mycobacterium
ARARPGGEKLRRQK

SEQ ID NO: 433024 - protein, 14 aa, Mycobacterium
ARARPPLTLPSGTA

SEQ ID NO: 433025 - protein, 10 aa, Mycobacterium
ARARPRSPRT

SEQ ID NO: 433026 - protein, 9 aa, Mycobacterium
ARARPTAPL

SEQ ID NO: 433027 - protein, 10 aa, Mycobacterium
ARARQHGRRD

SEQ ID NO: 433028 - protein, 5 aa, Mycobacterium
ARARR

SEQ ID NO: 433029 - protein, 8 aa, Mycobacterium
ARARRAPT

SEQ ID NO: 433030 - protein, 9 aa, Mycobacterium
ARARRNTRG

SEQ ID NO: 433031 - protein, 16 aa, Mycobacterium
ARARRRGESVAAEPPT

SEQ ID NO: 433032 - protein, 14 aa, Mycobacterium
ARARRRKRQPVDST

SEQ ID NO: 433033 - protein, 11 aa, Mycobacterium
ARARSEEVQQR

SEQ ID NO: 433034 - protein, 17 aa, Mycobacterium
ARARSGDLKPDELSGGT

SEQ ID NO: 433035 - protein, 8 aa, Mycobacterium
ARARSPEV

SEQ ID NO: 433036 - protein, 9 aa, Mycobacterium
ARARSSDAL

SEQ ID NO: 433037 - protein, 9 aa, Mycobacterium
ARARTGKAS

SEQ ID NO: 433038 - protein, 26 aa, Mycobacterium
ARARYERPGDVEERPAPRRSDPADRI

SEQ ID NO: 433039 - protein, 6 aa, Mycobacterium
ARASAA

SEQ ID NO: 433040 - protein, 15 aa, Mycobacterium
ARASAAAQGLSGTDR

SEQ ID NO: 433041 - protein, 6 aa, Mycobacterium
ARASAE

SEQ ID NO: 433042 - protein, 9 aa, Mycobacterium
ARASAETGL

SEQ ID NO: 433043 - protein, 5 aa, Mycobacterium
ARASE

SEQ ID NO: 433044 - protein, 8 aa, Mycobacterium
ARASELSR

SEQ ID NO: 433045 - protein, 7 aa, Mycobacterium
ARASESI

SEQ ID NO: 433046 - protein, 13 aa, Mycobacterium
ARASEVADADKPE

SEQ ID NO: 433047 - protein, 9 aa, Mycobacterium
ARASGADGA

SEQ ID NO: 433048 - protein, 8 aa, Mycobacterium
ARASGANY

SEQ ID NO: 433049 - protein, 9 aa, Mycobacterium
ARASGEASL

SEQ ID NO: 433050 - protein, 9 aa, Mycobacterium
ARASGKNYR

SEQ ID NO: 433051 - protein, 9 aa, Mycobacterium
ARASGMPTE

SEQ ID NO: 433052 - protein, 8 aa, Mycobacterium
ARASIEQA

SEQ ID NO: 433053 - protein, 11 aa, Mycobacterium
ARASKLPHNEA

SEQ ID NO: 433054 - protein, 8 aa, Mycobacterium
ARASLSTR

SEQ ID NO: 433055 - protein, 9 aa, Mycobacterium
ARASNSFDR

SEQ ID NO: 433056 - protein, 13 aa, Mycobacterium
ARASPSSRRLVRG

SEQ ID NO: 433057 - protein, 11 aa, Mycobacterium
ARASQLAATRS

SEQ ID NO: 433058 - protein, 6 aa, Mycobacterium
ARASQT

SEQ ID NO: 433059 - protein, 10 aa, Mycobacterium
ARASSGERAM

SEQ ID NO: 433060 - protein, 8 aa, Mycobacterium
ARASTAPI

SEQ ID NO: 433061 - protein, 7 aa, Mycobacterium
ARASTDD

SEQ ID NO: 433062 - protein, 11 aa, Mycobacterium
ARASTRTGRAA

SEQ ID NO: 433063 - protein, 5 aa, Mycobacterium
ARATA

SEQ ID NO: 433064 - protein, 7 aa, Mycobacterium
ARATAEA

SEQ ID NO: 433065 - protein, 9 aa, Mycobacterium
ARATAGALG

SEQ ID NO: 433066 - protein, 8 aa, Mycobacterium
ARATAQRD

SEQ ID NO: 433067 - protein, 10 aa, Mycobacterium
ARATASTGKG

SEQ ID NO: 433068 - protein, 8 aa, Mycobacterium
ARATASTT

SEQ ID NO: 433069 - protein, 12 aa, Mycobacterium
ARATDAYEDARE

SEQ ID NO: 433070 - protein, 14 aa, Mycobacterium
ARATDAYEDARGAA

SEQ ID NO: 433071 - protein, 12 aa, Mycobacterium
ARATDAYEEARD

SEQ ID NO: 433072 - protein, 39 aa, Mycobacterium
ARATDEQRRRRERANAERKATALRTQAAKLGAKATKAVA

SEQ ID NO: 433073 - protein, 15 aa, Mycobacterium
ARATDPGPSHVDPDD

SEQ ID NO: 433074 - protein, 12 aa, Mycobacterium
ARATEQPHNDAR

SEQ ID NO: 433075 - protein, 7 aa, Mycobacterium
ARATETL

SEQ ID NO: 433076 - protein, 14 aa, Mycobacterium
ARATGDQIGTQSTQ

SEQ ID NO: 433077 - protein, 6 aa, Mycobacterium
ARATGK

SEQ ID NO: 433078 - protein, 6 aa, Mycobacterium
ARATHG

SEQ ID NO: 433079 - protein, 9 aa, Mycobacterium
ARATKNGFV

SEQ ID NO: 433080 - protein, 24 aa, Mycobacterium
ARATKTESARQEAQRAEERAAAQQ

SEQ ID NO: 433081 - protein, 7 aa, Mycobacterium
ARATPDV

SEQ ID NO: 433082 - protein, 6 aa, Mycobacterium
ARATPE

SEQ ID NO: 433083 - protein, 9 aa, Mycobacterium
ARATPEPAM

SEQ ID NO: 433084 - protein, 7 aa, Mycobacterium
ARATPLG

SEQ ID NO: 433085 - protein, 9 aa, Mycobacterium
ARATQVSDD

SEQ ID NO: 433086 - protein, 6 aa, Mycobacterium
ARATRD

SEQ ID NO: 433087 - protein, 7 aa, Mycobacterium
ARATSAV

SEQ ID NO: 433088 - protein, 15 aa, Mycobacterium
ARATSRQSVKAATDG

SEQ ID NO: 433089 - protein, 6 aa, Mycobacterium
ARATTA

SEQ ID NO: 433090 - protein, 12 aa, Mycobacterium
ARATTAAAQAKV

SEQ ID NO: 433091 - protein, 8 aa, Mycobacterium
ARATTDEQ

SEQ ID NO: 433092 - protein, 6 aa, Mycobacterium
ARATVP

SEQ ID NO: 433093 - protein, 5 aa, Mycobacterium
ARAVA

SEQ ID NO: 433094 - protein, 5 aa, Mycobacterium
ARAVD

SEQ ID NO: 433095 - protein, 5 aa, Mycobacterium
ARAVG

SEQ ID NO: 433096 - protein, 11 aa, Mycobacterium
ARAVGASAQAR

SEQ ID NO: 433097 - protein, 8 aa, Mycobacterium
ARAVGGPL

SEQ ID NO: 433098 - protein, 5 aa, Mycobacterium
ARAVR

SEQ ID NO: 433099 - protein, 7 aa, Mycobacterium
ARAVSEE

SEQ ID NO: 433100 - protein, 11 aa, Mycobacterium
ARAYPRSDRGA

SEQ ID NO: 433101 - protein, 8 aa, Mycobacterium
ARCDGGGL

SEQ ID NO: 433102 - protein, 8 aa, Mycobacterium
ARCDTPAT

SEQ ID NO: 433103 - protein, 19 aa, Mycobacterium
ARCEEPAPDTTASHRGAGT

SEQ ID NO: 433104 - protein, 11 aa, Mycobacterium
ARCESRAAAER

SEQ ID NO: 433105 - protein, 4 aa, Mycobacterium
ARCP

SEQ ID NO: 433106 - protein, 23 aa, Mycobacterium
ARCRPRSGHRARLPDGVADPAYA

SEQ ID NO: 433107 - protein, 5 aa, Mycobacterium
ARCSP

SEQ ID NO: 433108 - protein, 4 aa, Mycobacterium
ARDA

SEQ ID NO: 433109 - protein, 8 aa, Mycobacterium
ARDAAGPL

SEQ ID NO: 433110 - protein, 8 aa, Mycobacterium
ARDAAHEG

SEQ ID NO: 433111 - protein, 5 aa, Mycobacterium
ARDAD

SEQ ID NO: 433112 - protein, 9 aa, Mycobacterium
ARDADAAEH

SEQ ID NO: 433113 - protein, 15 aa, Mycobacterium
ARDADDDAHADRGGD

SEQ ID NO: 433114 - protein, 9 aa, Mycobacterium
ARDADDPRP

SEQ ID NO: 433115 - protein, 7 aa, Mycobacterium
ARDADDT

SEQ ID NO: 433116 - protein, 8 aa, Mycobacterium
ARDADSAR

SEQ ID NO: 433117 - protein, 7 aa, Mycobacterium
ARDADTL

SEQ ID NO: 433118 - protein, 5 aa, Mycobacterium
ARDAE

SEQ ID NO: 433119 - protein, 7 aa, Mycobacterium
ARDAEGV

SEQ ID NO: 433120 - protein, 6 aa, Mycobacterium
ARDAEP

SEQ ID NO: 433121 - protein, 5 aa, Mycobacterium
ARDAF

SEQ ID NO: 433122 - protein, 10 aa, Mycobacterium
ARDAGEPMAE

SEQ ID NO: 433123 - protein, 34 aa, Mycobacterium
ARDAGERSASRRKRNATHAYRDSHTDVSDGTAAT

SEQ ID NO: 433124 - protein, 10 aa, Mycobacterium
ARDAGETMAE

SEQ ID NO: 433125 - protein, 10 aa, Mycobacterium
ARDAGTELAA

SEQ ID NO: 433126 - protein, 7 aa, Mycobacterium
ARDAHSQ

SEQ ID NO: 433127 - protein, 5 aa, Mycobacterium
ARDAL

SEQ ID NO: 433128 - protein, 6 aa, Mycobacterium
ARDARA

SEQ ID NO: 433129 - protein, 14 aa, Mycobacterium
ARDASAGPLTVRPV

SEQ ID NO: 433130 - protein, 9 aa, Mycobacterium
ARDASRARA

SEQ ID NO: 433131 - protein, 7 aa, Mycobacterium
ARDAVDS

SEQ ID NO: 433132 - protein, 7 aa, Mycobacterium
ARDDAGR

SEQ ID NO: 433133 - protein, 18 aa, Mycobacterium
ARDDAQVSATTAARQARD

SEQ ID NO: 433134 - protein, 8 aa, Mycobacterium
ARDDCRPE

SEQ ID NO: 433135 - protein, 5 aa, Mycobacterium
ARDDG

SEQ ID NO: 433136 - protein, 11 aa, Mycobacterium
ARDDGAGELAD

SEQ ID NO: 433137 - protein, 11 aa, Mycobacterium
ARDDGDRGARL

SEQ ID NO: 433138 - protein, 11 aa, Mycobacterium
ARDDGKLPASV

SEQ ID NO: 433139 - protein, 30 aa, Mycobacterium
ARDDREGGEAGRSGSSPLPEGSANSDGGMG

SEQ ID NO: 433140 - protein, 9 aa, Mycobacterium
ARDDRSGWD

SEQ ID NO: 433141 - protein, 10 aa, Mycobacterium
ARDDTAPGWA

SEQ ID NO: 433142 - protein, 7 aa, Mycobacterium
ARDDTGV

SEQ ID NO: 433143 - protein, 5 aa, Mycobacterium
ARDEA

SEQ ID NO: 433144 - protein, 7 aa, Mycobacterium
ARDEDLA

SEQ ID NO: 433145 - protein, 11 aa, Mycobacterium
ARDEDTADELV

SEQ ID NO: 433146 - protein, 6 aa, Mycobacterium
ARDEES

SEQ ID NO: 433147 - protein, 5 aa, Mycobacterium
ARDEG

SEQ ID NO: 433148 - protein, 7 aa, Mycobacterium
ARDEGAA

SEQ ID NO: 433149 - protein, 9 aa, Mycobacterium
ARDEGAPAP

SEQ ID NO: 433150 - protein, 6 aa, Mycobacterium
ARDEGD

SEQ ID NO: 433151 - protein, 9 aa, Mycobacterium
ARDEGGPAP

SEQ ID NO: 433152 - protein, 6 aa, Mycobacterium
ARDEGL

SEQ ID NO: 433153 - protein, 10 aa, Mycobacterium
ARDEGLPVPG

SEQ ID NO: 433154 - protein, 6 aa, Mycobacterium
ARDEGV

SEQ ID NO: 433155 - protein, 5 aa, Mycobacterium
ARDEI

SEQ ID NO: 433156 - protein, 8 aa, Mycobacterium
ARDEKDPR

SEQ ID NO: 433157 - protein, 6 aa, Mycobacterium
ARDEKS

SEQ ID NO: 433158 - protein, 5 aa, Mycobacterium
ARDEL

SEQ ID NO: 433159 - protein, 20 aa, Mycobacterium
ARDEPEGRKSVGAWLLSAHL

SEQ ID NO: 433160 - protein, 26 aa, Mycobacterium
ARDERKTGKNRVGSPSDHAPVVVDLR

SEQ ID NO: 433161 - protein, 18 aa, Mycobacterium
ARDESAASMATEAGRAAI

SEQ ID NO: 433162 - protein, 18 aa, Mycobacterium
ARDESAASMATEAGREAI

SEQ ID NO: 433163 - protein, 8 aa, Mycobacterium
ARDESGEL

SEQ ID NO: 433164 - protein, 6 aa, Mycobacterium
ARDESV

SEQ ID NO: 433165 - protein, 12 aa, Mycobacterium
ARDEVDGGSLGA

SEQ ID NO: 433166 - protein, 5 aa, Mycobacterium
ARDGA

SEQ ID NO: 433167 - protein, 11 aa, Mycobacterium
ARDGADLAGEA

SEQ ID NO: 433168 - protein, 9 aa, Mycobacterium
ARDGAEAEA

SEQ ID NO: 433169 - protein, 8 aa, Mycobacterium
ARDGARAQ

SEQ ID NO: 433170 - protein, 14 aa, Mycobacterium
ARDGASRDGRLNSN

SEQ ID NO: 433171 - protein, 12 aa, Mycobacterium
ARDGCARTTPRA

SEQ ID NO: 433172 - protein, 11 aa, Mycobacterium
ARDGDSDARLR

SEQ ID NO: 433173 - protein, 9 aa, Mycobacterium
ARDGEDPRP

SEQ ID NO: 433174 - protein, 42 aa, Mycobacterium
ARDGEHAAGVRQRSQQLAAQRDHPSGVAQRQRAGDIRRGDLP

SEQ ID NO: 433175 - protein, 15 aa, Mycobacterium
ARDGGTESESMDGGG

SEQ ID NO: 433176 - protein, 18 aa, Mycobacterium
ARDGKKCKETRALRATRS

SEQ ID NO: 433177 - protein, 10 aa, Mycobacterium
ARDGKLTGED

SEQ ID NO: 433178 - protein, 8 aa, Mycobacterium
ARDGKPGL

SEQ ID NO: 433179 - protein, 5 aa, Mycobacterium
ARDGL

SEQ ID NO: 433180 - protein, 15 aa, Mycobacterium
ARDGPPRKRGGEPAL

SEQ ID NO: 433181 - protein, 11 aa, Mycobacterium
ARDGQIDPATL

SEQ ID NO: 433182 - protein, 11 aa, Mycobacterium
ARDGQPGVSRY

SEQ ID NO: 433183 - protein, 5 aa, Mycobacterium
ARDGR

SEQ ID NO: 433184 - protein, 6 aa, Mycobacterium
ARDGSL

SEQ ID NO: 433185 - protein, 8 aa, Mycobacterium
ARDGSPKI

SEQ ID NO: 433186 - protein, 10 aa, Mycobacterium
ARDGSPQTWP

SEQ ID NO: 433187 - protein, 22 aa, Mycobacterium
ARDGSRAPVDDAAAADPPIRDE

SEQ ID NO: 433188 - protein, 6 aa, Mycobacterium
ARDGTD

SEQ ID NO: 433189 - protein, 6 aa, Mycobacterium
ARDGTG

SEQ ID NO: 433190 - protein, 5 aa, Mycobacterium
ARDGV

SEQ ID NO: 433191 - protein, 6 aa, Mycobacterium
ARDGVP

SEQ ID NO: 433192 - protein, 6 aa, Mycobacterium
ARDGVQ

SEQ ID NO: 433193 - protein, 4 aa, Mycobacterium
ARDH

SEQ ID NO: 433194 - protein, 10 aa, Mycobacterium
ARDHPKPLPE

SEQ ID NO: 433195 - protein, 13 aa, Mycobacterium
ARDHRNDRLDTTE

SEQ ID NO: 433196 - protein, 6 aa, Mycobacterium
ARDKAA

SEQ ID NO: 433197 - protein, 9 aa, Mycobacterium
ARDKAQAVA

SEQ ID NO: 433198 - protein, 7 aa, Mycobacterium
ARDKPLS

SEQ ID NO: 433199 - protein, 9 aa, Mycobacterium
ARDKREDLI

SEQ ID NO: 433200 - protein, 14 aa, Mycobacterium
ARDKSDPAENLPEQ

SEQ ID NO: 433201 - protein, 10 aa, Mycobacterium
ARDKTGTDPV

SEQ ID NO: 433202 - protein, 14 aa, Mycobacterium
ARDKTTDLAPSEHR

SEQ ID NO: 433203 - protein, 13 aa, Mycobacterium
ARDKTTDLAPTEH

SEQ ID NO: 433204 - protein, 6 aa, Mycobacterium
ARDLAK

SEQ ID NO: 433205 - protein, 7 aa, Mycobacterium
ARDLAKP

SEQ ID NO: 433206 - protein, 10 aa, Mycobacterium
ARDLAKPPAV

SEQ ID NO: 433207 - protein, 8 aa, Mycobacterium
ARDLDPAQ

SEQ ID NO: 433208 - protein, 8 aa, Mycobacterium
ARDLEQRP

SEQ ID NO: 433209 - protein, 5 aa, Mycobacterium
ARDLN

SEQ ID NO: 433210 - protein, 8 aa, Mycobacterium
ARDLPRPP

SEQ ID NO: 433211 - protein, 6 aa, Mycobacterium
ARDLQE

SEQ ID NO: 433212 - protein, 5 aa, Mycobacterium
ARDLT

SEQ ID NO: 433213 - protein, 7 aa, Mycobacterium
ARDLTSD

SEQ ID NO: 433214 - protein, 11 aa, Mycobacterium
ARDNDNDERLR

SEQ ID NO: 433215 - protein, 9 aa, Mycobacterium
ARDNLGAAG

SEQ ID NO: 433216 - protein, 6 aa, Mycobacterium
ARDNPE

SEQ ID NO: 433217 - protein, 9 aa, Mycobacterium
ARDNPYSGA

SEQ ID NO: 433218 - protein, 10 aa, Mycobacterium
ARDNQVEGRD

SEQ ID NO: 433219 - protein, 6 aa, Mycobacterium
ARDNRK

SEQ ID NO: 433220 - protein, 8 aa, Mycobacterium
ARDNWERS

SEQ ID NO: 433221 - protein, 14 aa, Mycobacterium
ARDPADRPDSAAAF

SEQ ID NO: 433222 - protein, 6 aa, Mycobacterium
ARDPAL

SEQ ID NO: 433223 - protein, 8 aa, Mycobacterium
ARDPASGK

SEQ ID NO: 433224 - protein, 11 aa, Mycobacterium
ARDPATGRAAT

SEQ ID NO: 433225 - protein, 7 aa, Mycobacterium
ARDPATV

SEQ ID NO: 433226 - protein, 12 aa, Mycobacterium
ARDPDGVSATVT

SEQ ID NO: 433227 - protein, 8 aa, Mycobacterium
ARDPDSGE

SEQ ID NO: 433228 - protein, 8 aa, Mycobacterium
ARDPDSSG

SEQ ID NO: 433229 - protein, 9 aa, Mycobacterium
ARDPETGMA

SEQ ID NO: 433230 - protein, 13 aa, Mycobacterium
ARDPETGRGLTDD

SEQ ID NO: 433231 - protein, 7 aa, Mycobacterium
ARDPETL

SEQ ID NO: 433232 - protein, 7 aa, Mycobacterium
ARDPEVL

SEQ ID NO: 433233 - protein, 8 aa, Mycobacterium
ARDPGTGG

SEQ ID NO: 433234 - protein, 5 aa, Mycobacterium
ARDPI

SEQ ID NO: 433235 - protein, 11 aa, Mycobacterium
ARDPKSKMAKG

SEQ ID NO: 433236 - protein, 16 aa, Mycobacterium
ARDPLGRGAPEKLRET

SEQ ID NO: 433237 - protein, 7 aa, Mycobacterium
ARDPQRA

SEQ ID NO: 433238 - protein, 8 aa, Mycobacterium
ARDPQRSV

SEQ ID NO: 433239 - protein, 6 aa, Mycobacterium
ARDPRA

SEQ ID NO: 433240 - protein, 9 aa, Mycobacterium
ARDPRGHDP

SEQ ID NO: 433241 - protein, 6 aa, Mycobacterium
ARDPRL

SEQ ID NO: 433242 - protein, 6 aa, Mycobacterium
ARDPSL

SEQ ID NO: 433243 - protein, 6 aa, Mycobacterium
ARDPTV

SEQ ID NO: 433244 - protein, 20 aa, Mycobacterium
ARDQGQAALAGAGRAAARAE

SEQ ID NO: 433245 - protein, 7 aa, Mycobacterium
ARDQGVR

SEQ ID NO: 433246 - protein, 6 aa, Mycobacterium
ARDQQF

SEQ ID NO: 433247 - protein, 12 aa, Mycobacterium
ARDQTTDLAPRQ

SEQ ID NO: 433248 - protein, 6 aa, Mycobacterium
ARDRAR

SEQ ID NO: 433249 - protein, 17 aa, Mycobacterium
ARDRARSAVERESAGSR

SEQ ID NO: 433250 - protein, 6 aa, Mycobacterium
ARDRGA

SEQ ID NO: 433251 - protein, 8 aa, Mycobacterium
ARDRGADR

SEQ ID NO: 433252 - protein, 9 aa, Mycobacterium
ARDRGELRE

SEQ ID NO: 433253 - protein, 9 aa, Mycobacterium
ARDRGGPPI

SEQ ID NO: 433254 - protein, 14 aa, Mycobacterium
ARDRGPAATPVTTQ

SEQ ID NO: 433255 - protein, 7 aa, Mycobacterium
ARDRGTE

SEQ ID NO: 433256 - protein, 7 aa, Mycobacterium
ARDRGTT

SEQ ID NO: 433257 - protein, 5 aa, Mycobacterium
ARDRI

SEQ ID NO: 433258 - protein, 21 aa, Mycobacterium
ARDRIGDDASLPVDPVAEDCC

SEQ ID NO: 433259 - protein, 9 aa, Mycobacterium
ARDRNSAKA

SEQ ID NO: 433260 - protein, 9 aa, Mycobacterium
ARDRSPRIR

SEQ ID NO: 433261 - protein, 13 aa, Mycobacterium
ARDRYGPNAPRAY

SEQ ID NO: 433262 - protein, 9 aa, Mycobacterium
ARDSADPRP

SEQ ID NO: 433263 - protein, 10 aa, Mycobacterium
ARDSATVGGM

SEQ ID NO: 433264 - protein, 18 aa, Mycobacterium
ARDSATVGGMASTNAGGL

SEQ ID NO: 433265 - protein, 9 aa, Mycobacterium
ARDSGGPAP

SEQ ID NO: 433266 - protein, 9 aa, Mycobacterium
ARDSGSTPH

SEQ ID NO: 433267 - protein, 7 aa, Mycobacterium
ARDSGTG

SEQ ID NO: 433268 - protein, 6 aa, Mycobacterium
ARDSLG

SEQ ID NO: 433269 - protein, 7 aa, Mycobacterium
ARDSPGV

SEQ ID NO: 433270 - protein, 5 aa, Mycobacterium
ARDTA

SEQ ID NO: 433271 - protein, 11 aa, Mycobacterium
ARDTADIGDRE

SEQ ID NO: 433272 - protein, 7 aa, Mycobacterium
ARDTDDR

SEQ ID NO: 433273 - protein, 7 aa, Mycobacterium
ARDTDGV

SEQ ID NO: 433274 - protein, 7 aa, Mycobacterium
ARDTEGR

SEQ ID NO: 433275 - protein, 7 aa, Mycobacterium
ARDTEGS

SEQ ID NO: 433276 - protein, 7 aa, Mycobacterium
ARDTEGY

SEQ ID NO: 433277 - protein, 5 aa, Mycobacterium
ARDTG

SEQ ID NO: 433278 - protein, 6 aa, Mycobacterium
ARDTGA

SEQ ID NO: 433279 - protein, 7 aa, Mycobacterium
ARDTGEI

SEQ ID NO: 433280 - protein, 7 aa, Mycobacterium
ARDTGES

SEQ ID NO: 433281 - protein, 7 aa, Mycobacterium
ARDTGGV

SEQ ID NO: 433282 - protein, 6 aa, Mycobacterium
ARDTNG

SEQ ID NO: 433283 - protein, 10 aa, Mycobacterium
ARDTPGRTYY

SEQ ID NO: 433284 - protein, 8 aa, Mycobacterium
ARDTPVQA

SEQ ID NO: 433285 - protein, 5 aa, Mycobacterium
ARDTS

SEQ ID NO: 433286 - protein, 6 aa, Mycobacterium
ARDTTA

SEQ ID NO: 433287 - protein, 8 aa, Mycobacterium
ARDTTSLS

SEQ ID NO: 433288 - protein, 6 aa, Mycobacterium
ARDVGD

SEQ ID NO: 433289 - protein, 5 aa, Mycobacterium
ARDVQ

SEQ ID NO: 433290 - protein, 15 aa, Mycobacterium
ARDVSAAKAAASEAG

SEQ ID NO: 433291 - protein, 14 aa, Mycobacterium
ARDYAGKGVTANTI

SEQ ID NO: 433292 - protein, 11 aa, Mycobacterium
ARDYATADRTE

SEQ ID NO: 433293 - protein, 11 aa, Mycobacterium
ARDYTSPERHD

SEQ ID NO: 433294 - protein, 4 aa, Mycobacterium
AREA

SEQ ID NO: 433295 - protein, 5 aa, Mycobacterium
AREAA

SEQ ID NO: 433296 - protein, 6 aa, Mycobacterium
AREAAD

SEQ ID NO: 433297 - protein, 8 aa, Mycobacterium
AREAADPR

SEQ ID NO: 433298 - protein, 7 aa, Mycobacterium
AREAADT

SEQ ID NO: 433299 - protein, 10 aa, Mycobacterium
AREAANPPVE

SEQ ID NO: 433300 - protein, 8 aa, Mycobacterium
AREAEAAG

SEQ ID NO: 433301 - protein, 9 aa, Mycobacterium
AREAEAAGY

SEQ ID NO: 433302 - protein, 17 aa, Mycobacterium
AREAEGTSAYEDEGLMI

SEQ ID NO: 433303 - protein, 6 aa, Mycobacterium
AREAEL

SEQ ID NO: 433304 - protein, 8 aa, Mycobacterium
AREAESAG

SEQ ID NO: 433305 - protein, 8 aa, Mycobacterium
AREAFNRR

SEQ ID NO: 433306 - protein, 7 aa, Mycobacterium
AREAGKP

SEQ ID NO: 433307 - protein, 7 aa, Mycobacterium
AREAGLS

SEQ ID NO: 433308 - protein, 12 aa, Mycobacterium
AREAGTAVARAQ

SEQ ID NO: 433309 - protein, 6 aa, Mycobacterium
AREAHA

SEQ ID NO: 433310 - protein, 10 aa, Mycobacterium
AREAKSRELA

SEQ ID NO: 433311 - protein, 5 aa, Mycobacterium
AREAL

SEQ ID NO: 433312 - protein, 11 aa, Mycobacterium
AREALGDPTAH

SEQ ID NO: 433313 - protein, 5 aa, Mycobacterium
AREAQ

SEQ ID NO: 433314 - protein, 5 aa, Mycobacterium
AREAR

SEQ ID NO: 433315 - protein, 14 aa, Mycobacterium
AREASRREAAAAAE

SEQ ID NO: 433316 - protein, 10 aa, Mycobacterium
AREATASGAS

SEQ ID NO: 433317 - protein, 16 aa, Mycobacterium
AREATGLDDFGPDDYR

SEQ ID NO: 433318 - protein, 6 aa, Mycobacterium
AREDAR

SEQ ID NO: 433319 - protein, 6 aa, Mycobacterium
AREDAY

SEQ ID NO: 433320 - protein, 5 aa, Mycobacterium
AREDF

SEQ ID NO: 433321 - protein, 6 aa, Mycobacterium
AREDGE

SEQ ID NO: 433322 - protein, 15 aa, Mycobacterium
AREDGPLADGTEPVP

SEQ ID NO: 433323 - protein, 8 aa, Mycobacterium
AREDGQLP

SEQ ID NO: 433324 - protein, 4 aa, Mycobacterium
AREE

SEQ ID NO: 433325 - protein, 8 aa, Mycobacterium
AREEAEVA

SEQ ID NO: 433326 - protein, 8 aa, Mycobacterium
AREEAGPD

SEQ ID NO: 433327 - protein, 7 aa, Mycobacterium
AREEANQ

SEQ ID NO: 433328 - protein, 13 aa, Mycobacterium
AREEDSATAVDAQ

SEQ ID NO: 433329 - protein, 6 aa, Mycobacterium
AREEGL

SEQ ID NO: 433330 - protein, 12 aa, Mycobacterium
AREEHGTATDEL

SEQ ID NO: 433331 - protein, 10 aa, Mycobacterium
AREELGDPTA

SEQ ID NO: 433332 - protein, 6 aa, Mycobacterium
AREEQG

SEQ ID NO: 433333 - protein, 6 aa, Mycobacterium
AREERS

SEQ ID NO: 433334 - protein, 35 aa, Mycobacterium
AREESNANTTGEDQAGGYAQERDAVADGLSGDPRL

SEQ ID NO: 433335 - protein, 7 aa, Mycobacterium
AREFPDD

SEQ ID NO: 433336 - protein, 6 aa, Mycobacterium
AREFTG

SEQ ID NO: 433337 - protein, 8 aa, Mycobacterium
AREGAAAQ

SEQ ID NO: 433338 - protein, 5 aa, Mycobacterium
AREGD

SEQ ID NO: 433339 - protein, 12 aa, Mycobacterium
AREGDPAPGGVG

SEQ ID NO: 433340 - protein, 8 aa, Mycobacterium
AREGDPKA

SEQ ID NO: 433341 - protein, 8 aa, Mycobacterium
AREGETGL

SEQ ID NO: 433342 - protein, 8 aa, Mycobacterium
AREGGGPP

SEQ ID NO: 433343 - protein, 18 aa, Mycobacterium
AREGGTSTVSGALRSRDT

SEQ ID NO: 433344 - protein, 6 aa, Mycobacterium
AREGKL

SEQ ID NO: 433345 - protein, 7 aa, Mycobacterium
AREGNAR

SEQ ID NO: 433346 - protein, 6 aa, Mycobacterium
AREGQP

SEQ ID NO: 433347 - protein, 7 aa, Mycobacterium
AREGQRL

SEQ ID NO: 433348 - protein, 5 aa, Mycobacterium
AREGR

SEQ ID NO: 433349 - protein, 11 aa, Mycobacterium
AREGSAVTPAT

SEQ ID NO: 433350 - protein, 9 aa, Mycobacterium
AREGSGPTL

SEQ ID NO: 433351 - protein, 17 aa, Mycobacterium
AREGSSRISGALRSRDT

SEQ ID NO: 433352 - protein, 8 aa, Mycobacterium
AREGTPEQ

SEQ ID NO: 433353 - protein, 7 aa, Mycobacterium
AREGTPV

SEQ ID NO: 433354 - protein, 17 aa, Mycobacterium
AREGVGPSNRVPSLPGA

SEQ ID NO: 433355 - protein, 5 aa, Mycobacterium
AREHD

SEQ ID NO: 433356 - protein, 7 aa, Mycobacterium
AREHDPR

SEQ ID NO: 433357 - protein, 5 aa, Mycobacterium
AREHN

SEQ ID NO: 433358 - protein, 6 aa, Mycobacterium
AREHNN

SEQ ID NO: 433359 - protein, 5 aa, Mycobacterium
AREHP

SEQ ID NO: 433360 - protein, 6 aa, Mycobacterium
AREHPG

SEQ ID NO: 433361 - protein, 7 aa, Mycobacterium
AREHSGP

SEQ ID NO: 433362 - protein, 7 aa, Mycobacterium
AREHTGD

SEQ ID NO: 433363 - protein, 6 aa, Mycobacterium
AREHTP

SEQ ID NO: 433364 - protein, 6 aa, Mycobacterium
AREIPQ

SEQ ID NO: 433365 - protein, 9 aa, Mycobacterium
AREKARQLG

SEQ ID NO: 433366 - protein, 11 aa, Mycobacterium
ARELADDPTVV

SEQ ID NO: 433367 - protein, 13 aa, Mycobacterium
ARELAGDDTLRPR

SEQ ID NO: 433368 - protein, 18 aa, Mycobacterium
ARELAREGESPAPGTDIS

SEQ ID NO: 433369 - protein, 9 aa, Mycobacterium
ARELEAPSG

SEQ ID NO: 433370 - protein, 5 aa, Mycobacterium
ARELN

SEQ ID NO: 433371 - protein, 5 aa, Mycobacterium
ARELR

SEQ ID NO: 433372 - protein, 7 aa, Mycobacterium
ARELRDG

SEQ ID NO: 433373 - protein, 5 aa, Mycobacterium
ARENF

SEQ ID NO: 433374 - protein, 6 aa, Mycobacterium
ARENGR

SEQ ID NO: 433375 - protein, 6 aa, Mycobacterium
ARENND

SEQ ID NO: 433376 - protein, 7 aa, Mycobacterium
ARENNGG

SEQ ID NO: 433377 - protein, 7 aa, Mycobacterium
ARENPQC

SEQ ID NO: 433378 - protein, 21 aa, Mycobacterium
ARENQNPPEVTESANGPPLPA

SEQ ID NO: 433379 - protein, 10 aa, Mycobacterium
ARENYTRTRA

SEQ ID NO: 433380 - protein, 6 aa, Mycobacterium
AREPDR

SEQ ID NO: 433381 - protein, 7 aa, Mycobacterium
AREPERK

SEQ ID NO: 433382 - protein, 10 aa, Mycobacterium
AREPGDRPSA

SEQ ID NO: 433383 - protein, 10 aa, Mycobacterium
AREPGERRPQ

SEQ ID NO: 433384 - protein, 8 aa, Mycobacterium
AREPGPGL

SEQ ID NO: 433385 - protein, 6 aa, Mycobacterium
AREPHL

SEQ ID NO: 433386 - protein, 11 aa, Mycobacterium
AREPQAADQNA

SEQ ID NO: 433387 - protein, 10 aa, Mycobacterium
AREPRAERGT

SEQ ID NO: 433388 - protein, 19 aa, Mycobacterium
AREPSGPWGRGRTADVTDA

SEQ ID NO: 433389 - protein, 17 aa, Mycobacterium
AREPVDSDRVRPLTPDN

SEQ ID NO: 433390 - protein, 4 aa, Mycobacterium
AREQ

SEQ ID NO: 433391 - protein, 5 aa, Mycobacterium
AREQD

SEQ ID NO: 433392 - protein, 18 aa, Mycobacterium
AREQGATVAYGGEPASDL

SEQ ID NO: 433393 - protein, 5 aa, Mycobacterium
AREQH

SEQ ID NO: 433394 - protein, 5 aa, Mycobacterium
AREQL

SEQ ID NO: 433395 - protein, 8 aa, Mycobacterium
AREQLAGK

SEQ ID NO: 433396 - protein, 9 aa, Mycobacterium
AREQLEAGN

SEQ ID NO: 433397 - protein, 18 aa, Mycobacterium
AREQLTATQRAQARQAAL

SEQ ID NO: 433398 - protein, 6 aa, Mycobacterium
AREQNR

SEQ ID NO: 433399 - protein, 6 aa, Mycobacterium
AREQTY

SEQ ID NO: 433400 - protein, 16 aa, Mycobacterium
ARERADDIGAGAVTPA

SEQ ID NO: 433401 - protein, 22 aa, Mycobacterium
ARERAGEDTEPAIVTSPGDGHD

SEQ ID NO: 433402 - protein, 11 aa, Mycobacterium
ARERAQRQGSE

SEQ ID NO: 433403 - protein, 23 aa, Mycobacterium
ARERATAAGAGSVEERSIEGAPV

SEQ ID NO: 433404 - protein, 6 aa, Mycobacterium
ARERDD

SEQ ID NO: 433405 - protein, 6 aa, Mycobacterium
ARERDG

SEQ ID NO: 433406 - protein, 13 aa, Mycobacterium
ARERDRQRRAAAS

SEQ ID NO: 433407 - protein, 5 aa, Mycobacterium
ARERE

SEQ ID NO: 433408 - protein, 7 aa, Mycobacterium
AREREGQ

SEQ ID NO: 433409 - protein, 11 aa, Mycobacterium
ARERETFGRPL

SEQ ID NO: 433410 - protein, 8 aa, Mycobacterium
ARERFGPD

SEQ ID NO: 433411 - protein, 6 aa, Mycobacterium
ARERGA

SEQ ID NO: 433412 - protein, 8 aa, Mycobacterium
ARERGADR

SEQ ID NO: 433413 - protein, 8 aa, Mycobacterium
ARERGELR

SEQ ID NO: 433414 - protein, 8 aa, Mycobacterium
ARERGGKW

SEQ ID NO: 433415 - protein, 8 aa, Mycobacterium
ARERGHRS

SEQ ID NO: 433416 - protein, 5 aa, Mycobacterium
ARERR

SEQ ID NO: 433417 - protein, 6 aa, Mycobacterium
ARERRD

SEQ ID NO: 433418 - protein, 9 aa, Mycobacterium
ARERTAEEY

SEQ ID NO: 433419 - protein, 8 aa, Mycobacterium
ARERTEAQ

SEQ ID NO: 433420 - protein, 7 aa, Mycobacterium
ARERTER

SEQ ID NO: 433421 - protein, 15 aa, Mycobacterium
ARERTKPDPAVRAAT

SEQ ID NO: 433422 - protein, 15 aa, Mycobacterium
ARERVEKALATGHDD

SEQ ID NO: 433423 - protein, 21 aa, Mycobacterium
ARERVGEEAPTPAVGHAHDHD

SEQ ID NO: 433424 - protein, 18 aa, Mycobacterium
ARERYGSTERSPRARKAY

SEQ ID NO: 433425 - protein, 18 aa, Mycobacterium
ARESATVGGMASTNAGGL

SEQ ID NO: 433426 - protein, 8 aa, Mycobacterium
ARESDPGR

SEQ ID NO: 433427 - protein, 7 aa, Mycobacterium
ARESGAA

SEQ ID NO: 433428 - protein, 8 aa, Mycobacterium
ARESGTGQ

SEQ ID NO: 433429 - protein, 13 aa, Mycobacterium
ARESGTKALADAG

SEQ ID NO: 433430 - protein, 12 aa, Mycobacterium
ARESGTKALEDA

SEQ ID NO: 433431 - protein, 8 aa, Mycobacterium
ARESGTNA

SEQ ID NO: 433432 - protein, 11 aa, Mycobacterium
ARESGTNALAD

SEQ ID NO: 433433 - protein, 11 aa, Mycobacterium
ARESGTNALND

SEQ ID NO: 433434 - protein, 11 aa, Mycobacterium
ARESGTNALRD

SEQ ID NO: 433435 - protein, 8 aa, Mycobacterium
ARESGTPV

SEQ ID NO: 433436 - protein, 6 aa, Mycobacterium
ARESLS

SEQ ID NO: 433437 - protein, 8 aa, Mycobacterium
ARESRVTE

SEQ ID NO: 433438 - protein, 6 aa, Mycobacterium
ARESWP

SEQ ID NO: 433439 - protein, 9 aa, Mycobacterium
ARESYPALD

SEQ ID NO: 433440 - protein, 5 aa, Mycobacterium
ARETA

SEQ ID NO: 433441 - protein, 15 aa, Mycobacterium
ARETAAEPVITGPST

SEQ ID NO: 433442 - protein, 7 aa, Mycobacterium
ARETANP

SEQ ID NO: 433443 - protein, 5 aa, Mycobacterium
ARETD

SEQ ID NO: 433444 - protein, 7 aa, Mycobacterium
ARETEEL

SEQ ID NO: 433445 - protein, 5 aa, Mycobacterium
ARETF

SEQ ID NO: 433446 - protein, 24 aa, Mycobacterium
ARETFGQGAPTDGSQFDQSRSLTQ

SEQ ID NO: 433447 - protein, 7 aa, Mycobacterium
ARETGAR

SEQ ID NO: 433448 - protein, 7 aa, Mycobacterium
ARETGER

SEQ ID NO: 433449 - protein, 8 aa, Mycobacterium
ARETGHDD

SEQ ID NO: 433450 - protein, 16 aa, Mycobacterium
ARETGVSGYIGDGANR

SEQ ID NO: 433451 - protein, 5 aa, Mycobacterium
ARETL

SEQ ID NO: 433452 - protein, 6 aa, Mycobacterium
ARETLA

SEQ ID NO: 433453 - protein, 6 aa, Mycobacterium
ARETLD

SEQ ID NO: 433454 - protein, 7 aa, Mycobacterium
ARETLDG

SEQ ID NO: 433455 - protein, 6 aa, Mycobacterium
ARETLT

SEQ ID NO: 433456 - protein, 7 aa, Mycobacterium
ARETRAR

SEQ ID NO: 433457 - protein, 7 aa, Mycobacterium
ARETSAR

SEQ ID NO: 433458 - protein, 11 aa, Mycobacterium
ARETSKDDAER

SEQ ID NO: 433459 - protein, 12 aa, Mycobacterium
ARETSKDDSERL

SEQ ID NO: 433460 - protein, 6 aa, Mycobacterium
ARETSS

SEQ ID NO: 433461 - protein, 14 aa, Mycobacterium
ARETSSESSESVQA

SEQ ID NO: 433462 - protein, 8 aa, Mycobacterium
ARETTKGM

SEQ ID NO: 433463 - protein, 4 aa, Mycobacterium
AREV

SEQ ID NO: 433464 - protein, 11 aa, Mycobacterium
AREVNKRKNEQ

SEQ ID NO: 433465 - protein, 4 aa, Mycobacterium
AREY

SEQ ID NO: 433466 - protein, 15 aa, Mycobacterium
AREYRQAASGSGVSR

SEQ ID NO: 433467 - protein, 11 aa, Mycobacterium
ARFDESRSGQW

SEQ ID NO: 433468 - protein, 10 aa, Mycobacterium
ARFDETSPGR

SEQ ID NO: 433469 - protein, 6 aa, Mycobacterium
ARFDGD

SEQ ID NO: 433470 - protein, 6 aa, Mycobacterium
ARFGER

SEQ ID NO: 433471 - protein, 16 aa, Mycobacterium
ARFGESDLGSVAPEEL

SEQ ID NO: 433472 - protein, 6 aa, Mycobacterium
ARFGPS

SEQ ID NO: 433473 - protein, 12 aa, Mycobacterium
ARFNRSASQWED

SEQ ID NO: 433474 - protein, 8 aa, Mycobacterium
ARFNSPNP

SEQ ID NO: 433475 - protein, 7 aa, Mycobacterium
ARFNSTN

SEQ ID NO: 433476 - protein, 9 aa, Mycobacterium
ARFPGDDNR

SEQ ID NO: 433477 - protein, 9 aa, Mycobacterium
ARFPGDESR

SEQ ID NO: 433478 - protein, 6 aa, Mycobacterium
ARFPSD

SEQ ID NO: 433479 - protein, 9 aa, Mycobacterium
ARFPSDEDV

SEQ ID NO: 433480 - protein, 22 aa, Mycobacterium
ARFPYDPKSLPVNRRADGSVHD

SEQ ID NO: 433481 - protein, 6 aa, Mycobacterium
ARFRRD

SEQ ID NO: 433482 - protein, 6 aa, Mycobacterium
ARGAAA

SEQ ID NO: 433483 - protein, 44 aa, Mycobacterium
ARGAAAKSHTRAAGGAAAQPGGHSAARTGMGPYARTTGRPQGRG

SEQ ID NO: 433484 - protein, 9 aa, Mycobacterium
ARGAATHSR

SEQ ID NO: 433485 - protein, 7 aa, Mycobacterium
ARGADAA

SEQ ID NO: 433486 - protein, 13 aa, Mycobacterium
ARGADELDGASAT

SEQ ID NO: 433487 - protein, 9 aa, Mycobacterium
ARGADISEA

SEQ ID NO: 433488 - protein, 8 aa, Mycobacterium
ARGADPGE

SEQ ID NO: 433489 - protein, 14 aa, Mycobacterium
ARGADPRDATRPLT

SEQ ID NO: 433490 - protein, 13 aa, Mycobacterium
ARGADPRDATRPM

SEQ ID NO: 433491 - protein, 11 aa, Mycobacterium
ARGADQPLTGQ

SEQ ID NO: 433492 - protein, 8 aa, Mycobacterium
ARGAEGAD

SEQ ID NO: 433493 - protein, 10 aa, Mycobacterium
ARGAEKTPEG

SEQ ID NO: 433494 - protein, 17 aa, Mycobacterium
ARGAELGDVATDEVPIG

SEQ ID NO: 433495 - protein, 7 aa, Mycobacterium
ARGAEPV

SEQ ID NO: 433496 - protein, 8 aa, Mycobacterium
ARGAGATP

SEQ ID NO: 433497 - protein, 7 aa, Mycobacterium
ARGAGFD

SEQ ID NO: 433498 - protein, 8 aa, Mycobacterium
ARGAGISR

SEQ ID NO: 433499 - protein, 17 aa, Mycobacterium
ARGAGLDDLAAGEVPVV

SEQ ID NO: 433500 - protein, 8 aa, Mycobacterium
ARGAGLSR

SEQ ID NO: 433501 - protein, 7 aa, Mycobacterium
ARGAKAT

SEQ ID NO: 433502 - protein, 6 aa, Mycobacterium
ARGAKP

SEQ ID NO: 433503 - protein, 5 aa, Mycobacterium
ARGAP

SEQ ID NO: 433504 - protein, 6 aa, Mycobacterium
ARGAPT

SEQ ID NO: 433505 - protein, 11 aa, Mycobacterium
ARGAQADRERM

SEQ ID NO: 433506 - protein, 7 aa, Mycobacterium
ARGAQGE

SEQ ID NO: 433507 - protein, 6 aa, Mycobacterium
ARGAQN

SEQ ID NO: 433508 - protein, 9 aa, Mycobacterium
ARGAQPSLP

SEQ ID NO: 433509 - protein, 7 aa, Mycobacterium
ARGAQVN

SEQ ID NO: 433510 - protein, 12 aa, Mycobacterium
ARGARAEDIRRA

SEQ ID NO: 433511 - protein, 18 aa, Mycobacterium
ARGARGAAQDVDQRPVDE

SEQ ID NO: 433512 - protein, 7 aa, Mycobacterium
ARGARGE

SEQ ID NO: 433513 - protein, 12 aa, Mycobacterium
ARGARLDAEVHA

SEQ ID NO: 433514 - protein, 6 aa, Mycobacterium
ARGARR

SEQ ID NO: 433515 - protein, 11 aa, Mycobacterium
ARGARVRAEDG

SEQ ID NO: 433516 - protein, 11 aa, Mycobacterium
ARGARYAGADG

SEQ ID NO: 433517 - protein, 17 aa, Mycobacterium
ARGASLSSVEDELPEKT

SEQ ID NO: 433518 - protein, 17 aa, Mycobacterium
ARGASSAASAASATIDA

SEQ ID NO: 433519 - protein, 10 aa, Mycobacterium
ARGATASAGV

SEQ ID NO: 433520 - protein, 7 aa, Mycobacterium
ARGATGF

SEQ ID NO: 433521 - protein, 6 aa, Mycobacterium
ARGATS

SEQ ID NO: 433522 - protein, 6 aa, Mycobacterium
ARGAVK

SEQ ID NO: 433523 - protein, 31 aa, Mycobacterium
ARGCAPQRSQAANGEGIAAEQAATAAAGGHY

SEQ ID NO: 433524 - protein, 4 aa, Mycobacterium
ARGD

SEQ ID NO: 433525 - protein, 5 aa, Mycobacterium
ARGDA

SEQ ID NO: 433526 - protein, 10 aa, Mycobacterium
ARGDAEERRI

SEQ ID NO: 433527 - protein, 9 aa, Mycobacterium
ARGDAEPAR

SEQ ID NO: 433528 - protein, 6 aa, Mycobacterium
ARGDAF

SEQ ID NO: 433529 - protein, 9 aa, Mycobacterium
ARGDAGWDA

SEQ ID NO: 433530 - protein, 12 aa, Mycobacterium
ARGDAQRSYDGR

SEQ ID NO: 433531 - protein, 17 aa, Mycobacterium
ARGDARLGQAGVPSDRV

SEQ ID NO: 433532 - protein, 8 aa, Mycobacterium
ARGDATTA

SEQ ID NO: 433533 - protein, 8 aa, Mycobacterium
ARGDDRPV

SEQ ID NO: 433534 - protein, 15 aa, Mycobacterium
ARGDEAKALTGDAAD

SEQ ID NO: 433535 - protein, 11 aa, Mycobacterium
ARGDEERYREC

SEQ ID NO: 433536 - protein, 11 aa, Mycobacterium
ARGDERARAAA

SEQ ID NO: 433537 - protein, 5 aa, Mycobacterium
ARGDG

SEQ ID NO: 433538 - protein, 6 aa, Mycobacterium
ARGDGG

SEQ ID NO: 433539 - protein, 11 aa, Mycobacterium
ARGDGKAVASV

SEQ ID NO: 433540 - protein, 7 aa, Mycobacterium
ARGDGNR

SEQ ID NO: 433541 - protein, 8 aa, Mycobacterium
ARGDGPLA

SEQ ID NO: 433542 - protein, 9 aa, Mycobacterium
ARGDGPLAG

SEQ ID NO: 433543 - protein, 6 aa, Mycobacterium
ARGDGV

SEQ ID NO: 433544 - protein, 5 aa, Mycobacterium
ARGDI

SEQ ID NO: 433545 - protein, 47 aa, Mycobacterium
ARGDKPGGRKDYRSGTAATLGQPTQRAGDAARRDFTAGSAADQDSQS

SEQ ID NO: 433546 - protein, 5 aa, Mycobacterium
ARGDL

SEQ ID NO: 433547 - protein, 6 aa, Mycobacterium
ARGDLD

SEQ ID NO: 433548 - protein, 7 aa, Mycobacterium
ARGDLGD

SEQ ID NO: 433549 - protein, 12 aa, Mycobacterium
ARGDLPGAAEYA

SEQ ID NO: 433550 - protein, 8 aa, Mycobacterium
ARGDLSDL

SEQ ID NO: 433551 - protein, 5 aa, Mycobacterium
ARGDM

SEQ ID NO: 433552 - protein, 11 aa, Mycobacterium
ARGDNVPPPAP

SEQ ID NO: 433553 - protein, 15 aa, Mycobacterium
ARGDPVHSEAGAGTM

SEQ ID NO: 433554 - protein, 8 aa, Mycobacterium
ARGDRRDA

SEQ ID NO: 433555 - protein, 7 aa, Mycobacterium
ARGDSAA

SEQ ID NO: 433556 - protein, 7 aa, Mycobacterium
ARGDSGR

SEQ ID NO: 433557 - protein, 7 aa, Mycobacterium
ARGDSPG

SEQ ID NO: 433558 - protein, 6 aa, Mycobacterium
ARGDSQ

SEQ ID NO: 433559 - protein, 6 aa, Mycobacterium
ARGDSV

SEQ ID NO: 433560 - protein, 7 aa, Mycobacterium
ARGDSYL

SEQ ID NO: 433561 - protein, 8 aa, Mycobacterium
ARGDTGAR

SEQ ID NO: 433562 - protein, 20 aa, Mycobacterium
ARGDTHQPPEPSRDAGHAGG

SEQ ID NO: 433563 - protein, 6 aa, Mycobacterium
ARGEAN

SEQ ID NO: 433564 - protein, 6 aa, Mycobacterium
ARGEAP

SEQ ID NO: 433565 - protein, 13 aa, Mycobacterium
ARGEAPAGTDAAA

SEQ ID NO: 433566 - protein, 5 aa, Mycobacterium
ARGED

SEQ ID NO: 433567 - protein, 10 aa, Mycobacterium
ARGEDTQQDF

SEQ ID NO: 433568 - protein, 5 aa, Mycobacterium
ARGEE

SEQ ID NO: 433569 - protein, 5 aa, Mycobacterium
ARGEG

SEQ ID NO: 433570 - protein, 28 aa, Mycobacterium
ARGEGGFGGDRGPSGGGAADAAPQRAPD

SEQ ID NO: 433571 - protein, 5 aa, Mycobacterium
ARGEL

SEQ ID NO: 433572 - protein, 12 aa, Mycobacterium
ARGELPAGHDPH

SEQ ID NO: 433573 - protein, 12 aa, Mycobacterium
ARGENQKGSAGR

SEQ ID NO: 433574 - protein, 7 aa, Mycobacterium
ARGEPGA

SEQ ID NO: 433575 - protein, 8 aa, Mycobacterium
ARGEQRAR

SEQ ID NO: 433576 - protein, 7 aa, Mycobacterium
ARGERAE

SEQ ID NO: 433577 - protein, 8 aa, Mycobacterium
ARGETPNP

SEQ ID NO: 433578 - protein, 6 aa, Mycobacterium
ARGETQ

SEQ ID NO: 433579 - protein, 6 aa, Mycobacterium
ARGETT

SEQ ID NO: 433580 - protein, 6 aa, Mycobacterium
ARGETV

SEQ ID NO: 433581 - protein, 6 aa, Mycobacterium
ARGEVR

SEQ ID NO: 433582 - protein, 7 aa, Mycobacterium
ARGEVRS

SEQ ID NO: 433583 - protein, 7 aa, Mycobacterium
ARGFEAE

SEQ ID NO: 433584 - protein, 5 aa, Mycobacterium
ARGFT

SEQ ID NO: 433585 - protein, 6 aa, Mycobacterium
ARGGAA

SEQ ID NO: 433586 - protein, 5 aa, Mycobacterium
ARGGD

SEQ ID NO: 433587 - protein, 6 aa, Mycobacterium
ARGGDI

SEQ ID NO: 433588 - protein, 7 aa, Mycobacterium
ARGGEDI

SEQ ID NO: 433589 - protein, 7 aa, Mycobacterium
ARGGEHL

SEQ ID NO: 433590 - protein, 9 aa, Mycobacterium
ARGGEPATR

SEQ ID NO: 433591 - protein, 8 aa, Mycobacterium
ARGGETEF

SEQ ID NO: 433592 - protein, 15 aa, Mycobacterium
ARGGGDRRGNPELNE

SEQ ID NO: 433593 - protein, 12 aa, Mycobacterium
ARGGGTAPATPD

SEQ ID NO: 433594 - protein, 9 aa, Mycobacterium
ARGGGVSGG

SEQ ID NO: 433595 - protein, 6 aa, Mycobacterium
ARGGIS

SEQ ID NO: 433596 - protein, 14 aa, Mycobacterium
ARGGKAAGSVSKKT

SEQ ID NO: 433597 - protein, 16 aa, Mycobacterium
ARGGKAAGSVSKKTDY

SEQ ID NO: 433598 - protein, 16 aa, Mycobacterium
ARGGKAAGSVSKKTSY

SEQ ID NO: 433599 - protein, 13 aa, Mycobacterium
ARGGKSASSVSKK

SEQ ID NO: 433600 - protein, 14 aa, Mycobacterium
ARGGMNPVTGRRVT

SEQ ID NO: 433601 - protein, 13 aa, Mycobacterium
ARGGMRPSARQRR

SEQ ID NO: 433602 - protein, 8 aa, Mycobacterium
ARGGNEKA

SEQ ID NO: 433603 - protein, 5 aa, Mycobacterium
ARGGP

SEQ ID NO: 433604 - protein, 8 aa, Mycobacterium
ARGGPDIG

SEQ ID NO: 433605 - protein, 8 aa, Mycobacterium
ARGGPGAG

SEQ ID NO: 433606 - protein, 8 aa, Mycobacterium
ARGGPKGG

SEQ ID NO: 433607 - protein, 7 aa, Mycobacterium
ARGGQKK

SEQ ID NO: 433608 - protein, 5 aa, Mycobacterium
ARGGR

SEQ ID NO: 433609 - protein, 8 aa, Mycobacterium
ARGGSLSP

SEQ ID NO: 433610 - protein, 5 aa, Mycobacterium
ARGGT

SEQ ID NO: 433611 - protein, 15 aa, Mycobacterium
ARGGTLTPGELRGST

SEQ ID NO: 433612 - protein, 8 aa, Mycobacterium
ARGGTPGV

SEQ ID NO: 433613 - protein, 7 aa, Mycobacterium
ARGGTPY

SEQ ID NO: 433614 - protein, 14 aa, Mycobacterium
ARGGTSLGDGPARA

SEQ ID NO: 433615 - protein, 15 aa, Mycobacterium
ARGGTSLGEGPARAW

SEQ ID NO: 433616 - protein, 16 aa, Mycobacterium
ARGGTTGTGSPGTRRL

SEQ ID NO: 433617 - protein, 6 aa, Mycobacterium
ARGGVV

SEQ ID NO: 433618 - protein, 12 aa, Mycobacterium
ARGGYGDAYQTA

SEQ ID NO: 433619 - protein, 23 aa, Mycobacterium
ARGGYGDAYQTAQAFSTSARAAG

SEQ ID NO: 433620 - protein, 5 aa, Mycobacterium
ARGHD

SEQ ID NO: 433621 - protein, 15 aa, Mycobacterium
ARGHGDSDWDPDGRY

SEQ ID NO: 433622 - protein, 21 aa, Mycobacterium
ARGHTVDTAPWSAHAATANNL

SEQ ID NO: 433623 - protein, 4 aa, Mycobacterium
ARGI

SEQ ID NO: 433624 - protein, 5 aa, Mycobacterium
ARGID

SEQ ID NO: 433625 - protein, 6 aa, Mycobacterium
ARGIGE

SEQ ID NO: 433626 - protein, 6 aa, Mycobacterium
ARGIGK

SEQ ID NO: 433627 - protein, 5 aa, Mycobacterium
ARGIR

SEQ ID NO: 433628 - protein, 8 aa, Mycobacterium
ARGKAKDV

SEQ ID NO: 433629 - protein, 5 aa, Mycobacterium
ARGKK

SEQ ID NO: 433630 - protein, 8 aa, Mycobacterium
ARGKLTAR

SEQ ID NO: 433631 - protein, 9 aa, Mycobacterium
ARGKLTARE

SEQ ID NO: 433632 - protein, 5 aa, Mycobacterium
ARGKP

SEQ ID NO: 433633 - protein, 7 aa, Mycobacterium
ARGKRTD

SEQ ID NO: 433634 - protein, 7 aa, Mycobacterium
ARGKTGR

SEQ ID NO: 433635 - protein, 8 aa, Mycobacterium
ARGKTNRL

SEQ ID NO: 433636 - protein, 6 aa, Mycobacterium
ARGLAG

SEQ ID NO: 433637 - protein, 13 aa, Mycobacterium
ARGLAGGTTASAA

SEQ ID NO: 433638 - protein, 6 aa, Mycobacterium
ARGLAN

SEQ ID NO: 433639 - protein, 6 aa, Mycobacterium
ARGLGA

SEQ ID NO: 433640 - protein, 8 aa, Mycobacterium
ARGLGTPS

SEQ ID NO: 433641 - protein, 13 aa, Mycobacterium
ARGLPDGSDPETL

SEQ ID NO: 433642 - protein, 6 aa, Mycobacterium
ARGLTG

SEQ ID NO: 433643 - protein, 8 aa, Mycobacterium
ARGLTGEA

SEQ ID NO: 433644 - protein, 8 aa, Mycobacterium
ARGLTNQE

SEQ ID NO: 433645 - protein, 6 aa, Mycobacterium
ARGLTP

SEQ ID NO: 433646 - protein, 4 aa, Mycobacterium
ARGM

SEQ ID NO: 433647 - protein, 6 aa, Mycobacterium
ARGMGA

SEQ ID NO: 433648 - protein, 7 aa, Mycobacterium
ARGMGAP

SEQ ID NO: 433649 - protein, 12 aa, Mycobacterium
ARGNAASLTTTV

SEQ ID NO: 433650 - protein, 9 aa, Mycobacterium
ARGNAEGTA

SEQ ID NO: 433651 - protein, 11 aa, Mycobacterium
ARGNPTATGGL

SEQ ID NO: 433652 - protein, 7 aa, Mycobacterium
ARGNRQR

SEQ ID NO: 433653 - protein, 9 aa, Mycobacterium
ARGNSDVAP

SEQ ID NO: 433654 - protein, 60 aa, Mycobacterium
ARGPAPGPELGRAAGPELGQAAAAGRGRSNCPHPKRSGRCSSGPTAKRSPARDSRTGARR

SEQ ID NO: 433655 - protein, 6 aa, Mycobacterium
ARGPAR

SEQ ID NO: 433656 - protein, 7 aa, Mycobacterium
ARGPDAF

SEQ ID NO: 433657 - protein, 8 aa, Mycobacterium
ARGPERID

SEQ ID NO: 433658 - protein, 7 aa, Mycobacterium
ARGPEVA

SEQ ID NO: 433659 - protein, 6 aa, Mycobacterium
ARGPFH

SEQ ID NO: 433660 - protein, 10 aa, Mycobacterium
ARGPGSKAAR

SEQ ID NO: 433661 - protein, 10 aa, Mycobacterium
ARGPGSPPAT

SEQ ID NO: 433662 - protein, 8 aa, Mycobacterium
ARGPHGQL

SEQ ID NO: 433663 - protein, 11 aa, Mycobacterium
ARGPKATGAIR

SEQ ID NO: 433664 - protein, 14 aa, Mycobacterium
ARGPLTVPRTPQGR

SEQ ID NO: 433665 - protein, 5 aa, Mycobacterium
ARGPR

SEQ ID NO: 433666 - protein, 5 aa, Mycobacterium
ARGPS

SEQ ID NO: 433667 - protein, 11 aa, Mycobacterium
ARGPSRIAAAR

SEQ ID NO: 433668 - protein, 10 aa, Mycobacterium
ARGPVQAAPP

SEQ ID NO: 433669 - protein, 8 aa, Mycobacterium
ARGPYDDQ

SEQ ID NO: 433670 - protein, 9 aa, Mycobacterium
ARGPYRSAD

SEQ ID NO: 433671 - protein, 4 aa, Mycobacterium
ARGQ

SEQ ID NO: 433672 - protein, 6 aa, Mycobacterium
ARGQAP

SEQ ID NO: 433673 - protein, 9 aa, Mycobacterium
ARGQAYADA

SEQ ID NO: 433674 - protein, 7 aa, Mycobacterium
ARGQGRA

SEQ ID NO: 433675 - protein, 7 aa, Mycobacterium
ARGQGRS

SEQ ID NO: 433676 - protein, 9 aa, Mycobacterium
ARGQQDSRF

SEQ ID NO: 433677 - protein, 11 aa, Mycobacterium
ARGQQDSRYPL

SEQ ID NO: 433678 - protein, 9 aa, Mycobacterium
ARGQRAASS

SEQ ID NO: 433679 - protein, 7 aa, Mycobacterium
ARGQRDL

SEQ ID NO: 433680 - protein, 7 aa, Mycobacterium
ARGQRTD

SEQ ID NO: 433681 - protein, 11 aa, Mycobacterium
ARGQSPSAELH

SEQ ID NO: 433682 - protein, 9 aa, Mycobacterium
ARGQTESVV

SEQ ID NO: 433683 - protein, 6 aa, Mycobacterium
ARGRAA

SEQ ID NO: 433684 - protein, 5 aa, Mycobacterium
ARGRD

SEQ ID NO: 433685 - protein, 18 aa, Mycobacterium
ARGRDLPAAPLPSADPDA

SEQ ID NO: 433686 - protein, 5 aa, Mycobacterium
ARGRG

SEQ ID NO: 433687 - protein, 26 aa, Mycobacterium
ARGRGAELAETAREAAPELAETARAH

SEQ ID NO: 433688 - protein, 8 aa, Mycobacterium
ARGRGPVV

SEQ ID NO: 433689 - protein, 26 aa, Mycobacterium
ARGRIGDDAPRPPAAKADDDDCCQVM

SEQ ID NO: 433690 - protein, 12 aa, Mycobacterium
ARGRKGQKTPTV

SEQ ID NO: 433691 - protein, 14 aa, Mycobacterium
ARGRLAEASQLTES

SEQ ID NO: 433692 - protein, 6 aa, Mycobacterium
ARGRNL

SEQ ID NO: 433693 - protein, 9 aa, Mycobacterium
ARGRPRSAA

SEQ ID NO: 433694 - protein, 12 aa, Mycobacterium
ARGRPTESTGEM

SEQ ID NO: 433695 - protein, 10 aa, Mycobacterium
ARGRQTQAAI

SEQ ID NO: 433696 - protein, 34 aa, Mycobacterium
ARGRRSEGANTANETEDGNSDSAARDEPTAPPLR

SEQ ID NO: 433697 - protein, 10 aa, Mycobacterium
ARGRTTAGGK

SEQ ID NO: 433698 - protein, 12 aa, Mycobacterium
ARGRTTAGGRHH

SEQ ID NO: 433699 - protein, 14 aa, Mycobacterium
ARGRTTAGGRHHPV

SEQ ID NO: 433700 - protein, 13 aa, Mycobacterium
ARGRTTAGGRHYP

SEQ ID NO: 433701 - protein, 16 aa, Mycobacterium
ARGRTTTSTPSPGRRC

SEQ ID NO: 433702 - protein, 12 aa, Mycobacterium
ARGSAAAPEGNT

SEQ ID NO: 433703 - protein, 8 aa, Mycobacterium
ARGSAASL

SEQ ID NO: 433704 - protein, 8 aa, Mycobacterium
ARGSAEVP

SEQ ID NO: 433705 - protein, 7 aa, Mycobacterium
ARGSATT

SEQ ID NO: 433706 - protein, 10 aa, Mycobacterium
ARGSDPGTTV

SEQ ID NO: 433707 - protein, 8 aa, Mycobacterium
ARGSEALA

SEQ ID NO: 433708 - protein, 11 aa, Mycobacterium
ARGSGAGASGV

SEQ ID NO: 433709 - protein, 8 aa, Mycobacterium
ARGSGCGL

SEQ ID NO: 433710 - protein, 5 aa, Mycobacterium
ARGSL

SEQ ID NO: 433711 - protein, 9 aa, Mycobacterium
ARGSLRSRT

SEQ ID NO: 433712 - protein, 8 aa, Mycobacterium
ARGSQTKN

SEQ ID NO: 433713 - protein, 5 aa, Mycobacterium
ARGSR

SEQ ID NO: 433714 - protein, 8 aa, Mycobacterium
ARGSTGAY

SEQ ID NO: 433715 - protein, 9 aa, Mycobacterium
ARGTDAPEE

SEQ ID NO: 433716 - protein, 25 aa, Mycobacterium
ARGTDAPPQSQAPQTPRRLQPGLER

SEQ ID NO: 433717 - protein, 12 aa, Mycobacterium
ARGTDKADLAAT

SEQ ID NO: 433718 - protein, 7 aa, Mycobacterium
ARGTDYG

SEQ ID NO: 433719 - protein, 6 aa, Mycobacterium
ARGTEL

SEQ ID NO: 433720 - protein, 6 aa, Mycobacterium
ARGTFG

SEQ ID NO: 433721 - protein, 8 aa, Mycobacterium
ARGTGVNA

SEQ ID NO: 433722 - protein, 6 aa, Mycobacterium
ARGTGY

SEQ ID NO: 433723 - protein, 11 aa, Mycobacterium
ARGTKYPDEVA

SEQ ID NO: 433724 - protein, 12 aa, Mycobacterium
ARGTKYPDEVER

SEQ ID NO: 433725 - protein, 6 aa, Mycobacterium
ARGTLD

SEQ ID NO: 433726 - protein, 6 aa, Mycobacterium
ARGTRT

SEQ ID NO: 433727 - protein, 8 aa, Mycobacterium
ARGTSAAE

SEQ ID NO: 433728 - protein, 8 aa, Mycobacterium
ARGTSGAV

SEQ ID NO: 433729 - protein, 9 aa, Mycobacterium
ARGTSTLQT

SEQ ID NO: 433730 - protein, 6 aa, Mycobacterium
ARGTTG

SEQ ID NO: 433731 - protein, 6 aa, Mycobacterium
ARGTTW

SEQ ID NO: 433732 - protein, 5 aa, Mycobacterium
ARGVA

SEQ ID NO: 433733 - protein, 15 aa, Mycobacterium
ARGVDDPPQAPQEPP

SEQ ID NO: 433734 - protein, 15 aa, Mycobacterium
ARGVEPGAPGPPGDL

SEQ ID NO: 433735 - protein, 7 aa, Mycobacterium
ARGVGEE

SEQ ID NO: 433736 - protein, 7 aa, Mycobacterium
ARGVGKG

SEQ ID NO: 433737 - protein, 7 aa, Mycobacterium
ARGVGPG

SEQ ID NO: 433738 - protein, 5 aa, Mycobacterium
ARGVP

SEQ ID NO: 433739 - protein, 10 aa, Mycobacterium
ARGVPEPSWS

SEQ ID NO: 433740 - protein, 9 aa, Mycobacterium
ARGVPETSW

SEQ ID NO: 433741 - protein, 13 aa, Mycobacterium
ARGVPKPGSPPLD

SEQ ID NO: 433742 - protein, 7 aa, Mycobacterium
ARGVPQS

SEQ ID NO: 433743 - protein, 6 aa, Mycobacterium
ARGVQP

SEQ ID NO: 433744 - protein, 35 aa, Mycobacterium
ARGVRPDWTRQDDTVPVAPGGDDNVPMAGDAENRI

SEQ ID NO: 433745 - protein, 8 aa, Mycobacterium
ARGVTGPL

SEQ ID NO: 433746 - protein, 6 aa, Mycobacterium
ARGVTP

SEQ ID NO: 433747 - protein, 6 aa, Mycobacterium
ARGWAP

SEQ ID NO: 433748 - protein, 8 aa, Mycobacterium
ARGWSGRV

SEQ ID NO: 433749 - protein, 4 aa, Mycobacterium
ARGY

SEQ ID NO: 433750 - protein, 5 aa, Mycobacterium
ARGYA

SEQ ID NO: 433751 - protein, 11 aa, Mycobacterium
ARGYAGKPAVT

SEQ ID NO: 433752 - protein, 12 aa, Mycobacterium
ARGYRGKPDLTA

SEQ ID NO: 433753 - protein, 4 aa, Mycobacterium
ARHA

SEQ ID NO: 433754 - protein, 9 aa, Mycobacterium
ARHADGSWG

SEQ ID NO: 433755 - protein, 7 aa, Mycobacterium
ARHATQR

SEQ ID NO: 433756 - protein, 4 aa, Mycobacterium
ARHD

SEQ ID NO: 433757 - protein, 28 aa, Mycobacterium
ARHDASDSDAPRPAVEEAGAPTDELDPE

SEQ ID NO: 433758 - protein, 17 aa, Mycobacterium
ARHDDETPTGRIPVAGE

SEQ ID NO: 433759 - protein, 7 aa, Mycobacterium
ARHDGPP

SEQ ID NO: 433760 - protein, 6 aa, Mycobacterium
ARHDPE

SEQ ID NO: 433761 - protein, 20 aa, Mycobacterium
ARHDPSEGARVAADGHVVWD

SEQ ID NO: 433762 - protein, 13 aa, Mycobacterium
ARHDPSRGGLPSW

SEQ ID NO: 433763 - protein, 14 aa, Mycobacterium
ARHEGRADEQRTAQ

SEQ ID NO: 433764 - protein, 6 aa, Mycobacterium
ARHERR

SEQ ID NO: 433765 - protein, 8 aa, Mycobacterium
ARHGAPAN

SEQ ID NO: 433766 - protein, 8 aa, Mycobacterium
ARHGATAA

SEQ ID NO: 433767 - protein, 11 aa, Mycobacterium
ARHGDSTTQRR

SEQ ID NO: 433768 - protein, 13 aa, Mycobacterium
ARHGHKSRARTFD

SEQ ID NO: 433769 - protein, 13 aa, Mycobacterium
ARHGPADGELNEE

SEQ ID NO: 433770 - protein, 13 aa, Mycobacterium
ARHGPAGDRRYRY

SEQ ID NO: 433771 - protein, 6 aa, Mycobacterium
ARHGRT

SEQ ID NO: 433772 - protein, 11 aa, Mycobacterium
ARHGTGGQTTV

SEQ ID NO: 433773 - protein, 16 aa, Mycobacterium
ARHGTLDADGAELSES

SEQ ID NO: 433774 - protein, 13 aa, Mycobacterium
ARHGTLDAEGVEV

SEQ ID NO: 433775 - protein, 8 aa, Mycobacterium
ARHGTQRR

SEQ ID NO: 433776 - protein, 7 aa, Mycobacterium
ARHGTSA

SEQ ID NO: 433777 - protein, 9 aa, Mycobacterium
ARHNDPLDT

SEQ ID NO: 433778 - protein, 15 aa, Mycobacterium
ARHNQQRSTHVDPDA

SEQ ID NO: 433779 - protein, 10 aa, Mycobacterium
ARHPGDEATR

SEQ ID NO: 433780 - protein, 6 aa, Mycobacterium
ARHPMG

SEQ ID NO: 433781 - protein, 22 aa, Mycobacterium
ARHPRPAARRSGRRFSMRRGVR

SEQ ID NO: 433782 - protein, 10 aa, Mycobacterium
ARHQDTEPTD

SEQ ID NO: 433783 - protein, 8 aa, Mycobacterium
ARHQETSE

SEQ ID NO: 433784 - protein, 7 aa, Mycobacterium
ARHQGSP

SEQ ID NO: 433785 - protein, 15 aa, Mycobacterium
ARHQRPDAQGQGIGH

SEQ ID NO: 433786 - protein, 8 aa, Mycobacterium
ARHRAGQQ

SEQ ID NO: 433787 - protein, 5 aa, Mycobacterium
ARHRD

SEQ ID NO: 433788 - protein, 25 aa, Mycobacterium
ARHRDAQAGSGDEETGESRSGERAY

SEQ ID NO: 433789 - protein, 7 aa, Mycobacterium
ARHRTRG

SEQ ID NO: 433790 - protein, 8 aa, Mycobacterium
ARHRTSVP

SEQ ID NO: 433791 - protein, 8 aa, Mycobacterium
ARHSEAPD

SEQ ID NO: 433792 - protein, 30 aa, Mycobacterium
ARHSGQAPAGDRGPGTRGSLRPQSCSPVTR

SEQ ID NO: 433793 - protein, 7 aa, Mycobacterium
ARHSGYD

SEQ ID NO: 433794 - protein, 9 aa, Mycobacterium
ARHSNPQNR

SEQ ID NO: 433795 - protein, 6 aa, Mycobacterium
ARHSSG

SEQ ID NO: 433796 - protein, 9 aa, Mycobacterium
ARHSSVTNR

SEQ ID NO: 433797 - protein, 11 aa, Mycobacterium
ARHTAADTARF

SEQ ID NO: 433798 - protein, 13 aa, Mycobacterium
ARHTQARRGIDRA

SEQ ID NO: 433799 - protein, 6 aa, Mycobacterium
ARHTTA

SEQ ID NO: 433800 - protein, 7 aa, Mycobacterium
ARHTTAH

SEQ ID NO: 433801 - protein, 19 aa, Mycobacterium
ARHTTGTSALAEQRKAGEL

SEQ ID NO: 433802 - protein, 12 aa, Mycobacterium
ARHYTGKNPQGL

SEQ ID NO: 433803 - protein, 4 aa, Mycobacterium
ARIA

SEQ ID NO: 433804 - protein, 8 aa, Mycobacterium
ARIAETEA

SEQ ID NO: 433805 - protein, 6 aa, Mycobacterium
ARIARD

SEQ ID NO: 433806 - protein, 7 aa, Mycobacterium
ARIARDG

SEQ ID NO: 433807 - protein, 14 aa, Mycobacterium
ARIARGAPDLGEDT

SEQ ID NO: 433808 - protein, 6 aa, Mycobacterium
ARIDEP

SEQ ID NO: 433809 - protein, 5 aa, Mycobacterium
ARIDR

SEQ ID NO: 433810 - protein, 25 aa, Mycobacterium
ARIDREERKGKAASDHAPVLVDLRV

SEQ ID NO: 433811 - protein, 8 aa, Mycobacterium
ARIGATRD

SEQ ID NO: 433812 - protein, 9 aa, Mycobacterium
ARIGDSSWG

SEQ ID NO: 433813 - protein, 13 aa, Mycobacterium
ARIGQSSQPHAAV

SEQ ID NO: 433814 - protein, 5 aa, Mycobacterium
ARING

SEQ ID NO: 433815 - protein, 12 aa, Mycobacterium
ARIPASSLKGES

SEQ ID NO: 433816 - protein, 10 aa, Mycobacterium
ARIPDGADPL

SEQ ID NO: 433817 - protein, 9 aa, Mycobacterium
ARIPDGVDP

SEQ ID NO: 433818 - protein, 5 aa, Mycobacterium
ARIPN

SEQ ID NO: 433819 - protein, 6 aa, Mycobacterium
ARIPNS

SEQ ID NO: 433820 - protein, 4 aa, Mycobacterium
ARIQ

SEQ ID NO: 433821 - protein, 7 aa, Mycobacterium
ARIQDGP

SEQ ID NO: 433822 - protein, 11 aa, Mycobacterium
ARIQSDARQAA

SEQ ID NO: 433823 - protein, 6 aa, Mycobacterium
ARIRKE

SEQ ID NO: 433824 - protein, 14 aa, Mycobacterium
ARISRSDSRVTHDR

SEQ ID NO: 433825 - protein, 4 aa, Mycobacterium
ARIT

SEQ ID NO: 433826 - protein, 7 aa, Mycobacterium
ARITDPT

SEQ ID NO: 433827 - protein, 7 aa, Mycobacterium
ARITSDA

SEQ ID NO: 433828 - protein, 16 aa, Mycobacterium
ARKAADEYSTADKPRY

SEQ ID NO: 433829 - protein, 16 aa, Mycobacterium
ARKAADEYSTPDKPRY

SEQ ID NO: 433830 - protein, 16 aa, Mycobacterium
ARKAADEYSTPEKPRY

SEQ ID NO: 433831 - protein, 23 aa, Mycobacterium
ARKAADRLRSNATTGKTVLTMEH

SEQ ID NO: 433832 - protein, 9 aa, Mycobacterium
ARKADPGER

SEQ ID NO: 433833 - protein, 14 aa, Mycobacterium
ARKAGGLAGPGQTR

SEQ ID NO: 433834 - protein, 6 aa, Mycobacterium
ARKAGL

SEQ ID NO: 433835 - protein, 16 aa, Mycobacterium
ARKAKTGTLTRGRHSE

SEQ ID NO: 433836 - protein, 6 aa, Mycobacterium
ARKAME

SEQ ID NO: 433837 - protein, 9 aa, Mycobacterium
ARKARGAKP

SEQ ID NO: 433838 - protein, 7 aa, Mycobacterium
ARKARQT

SEQ ID NO: 433839 - protein, 7 aa, Mycobacterium
ARKATRD

SEQ ID NO: 433840 - protein, 9 aa, Mycobacterium
ARKATTGPL

SEQ ID NO: 433841 - protein, 6 aa, Mycobacterium
ARKDEA

SEQ ID NO: 433842 - protein, 7 aa, Mycobacterium
ARKDGPP

SEQ ID NO: 433843 - protein, 14 aa, Mycobacterium
ARKDRISGGDREGL

SEQ ID NO: 433844 - protein, 10 aa, Mycobacterium
ARKEADDGDA

SEQ ID NO: 433845 - protein, 6 aa, Mycobacterium
ARKEAR

SEQ ID NO: 433846 - protein, 14 aa, Mycobacterium
ARKEATAALAELLQ

SEQ ID NO: 433847 - protein, 10 aa, Mycobacterium
ARKEAVGPQT

SEQ ID NO: 433848 - protein, 15 aa, Mycobacterium
ARKEERYEDAAEIEG

SEQ ID NO: 433849 - protein, 5 aa, Mycobacterium
ARKEI

SEQ ID NO: 433850 - protein, 4 aa, Mycobacterium
ARKG

SEQ ID NO: 433851 - protein, 9 aa, Mycobacterium
ARKGDSDQL

SEQ ID NO: 433852 - protein, 10 aa, Mycobacterium
ARKGEGLYGK

SEQ ID NO: 433853 - protein, 6 aa, Mycobacterium
ARKGGV

SEQ ID NO: 433854 - protein, 8 aa, Mycobacterium
ARKGSDTA

SEQ ID NO: 433855 - protein, 5 aa, Mycobacterium
ARKHG

SEQ ID NO: 433856 - protein, 5 aa, Mycobacterium
ARKHK

SEQ ID NO: 433857 - protein, 5 aa, Mycobacterium
ARKHP

SEQ ID NO: 433858 - protein, 4 aa, Mycobacterium
ARKI

SEQ ID NO: 433859 - protein, 17 aa, Mycobacterium
ARKKIKAGTATRADKRR

SEQ ID NO: 433860 - protein, 8 aa, Mycobacterium
ARKKTVRR

SEQ ID NO: 433861 - protein, 6 aa, Mycobacterium
ARKNGL

SEQ ID NO: 433862 - protein, 6 aa, Mycobacterium
ARKNYD

SEQ ID NO: 433863 - protein, 9 aa, Mycobacterium
ARKPDAPVI

SEQ ID NO: 433864 - protein, 10 aa, Mycobacterium
ARKPEPLARD

SEQ ID NO: 433865 - protein, 11 aa, Mycobacterium
ARKPGSSRPTF

SEQ ID NO: 433866 - protein, 26 aa, Mycobacterium
ARKPGSYRSLKGPDRSELIASTAVPV

SEQ ID NO: 433867 - protein, 30 aa, Mycobacterium
ARKPITSQDVERATDRAGHAHDRDHDAHHR

SEQ ID NO: 433868 - protein, 21 aa, Mycobacterium
ARKPPAEPDLAKAGAHAAPET

SEQ ID NO: 433869 - protein, 25 aa, Mycobacterium
ARKPPAEPDLAKAGAHSADGSASAG

SEQ ID NO: 433870 - protein, 8 aa, Mycobacterium
ARKPPEIS

SEQ ID NO: 433871 - protein, 9 aa, Mycobacterium
ARKPSPPDL

SEQ ID NO: 433872 - protein, 9 aa, Mycobacterium
ARKPSPPPM

SEQ ID NO: 433873 - protein, 6 aa, Mycobacterium
ARKPVQ

SEQ ID NO: 433874 - protein, 8 aa, Mycobacterium
ARKQELKD

SEQ ID NO: 433875 - protein, 7 aa, Mycobacterium
ARKQPGA

SEQ ID NO: 433876 - protein, 8 aa, Mycobacterium
ARKQPGAE

SEQ ID NO: 433877 - protein, 5 aa, Mycobacterium
ARKQY

SEQ ID NO: 433878 - protein, 33 aa, Mycobacterium
ARKRAAHRRTTVATAEQAARDESSPPHTALAAL

SEQ ID NO: 433879 - protein, 11 aa, Mycobacterium
ARKRAGNDADI

SEQ ID NO: 433880 - protein, 8 aa, Mycobacterium
ARKRFGDR

SEQ ID NO: 433881 - protein, 8 aa, Mycobacterium
ARKRGATA

SEQ ID NO: 433882 - protein, 16 aa, Mycobacterium
ARKRIERKRAAREELD

SEQ ID NO: 433883 - protein, 5 aa, Mycobacterium
ARKRL

SEQ ID NO: 433884 - protein, 8 aa, Mycobacterium
ARKRPPEL

SEQ ID NO: 433885 - protein, 15 aa, Mycobacterium
ARKRRAEQPLAEPDA

SEQ ID NO: 433886 - protein, 15 aa, Mycobacterium
ARKRRAQESAARADD

SEQ ID NO: 433887 - protein, 9 aa, Mycobacterium
ARKRRGDKP

SEQ ID NO: 433888 - protein, 11 aa, Mycobacterium
ARKRSEPGDDI

SEQ ID NO: 433889 - protein, 9 aa, Mycobacterium
ARKRSMSEA

SEQ ID NO: 433890 - protein, 8 aa, Mycobacterium
ARKRSPIA

SEQ ID NO: 433891 - protein, 9 aa, Mycobacterium
ARKSDISNG

SEQ ID NO: 433892 - protein, 5 aa, Mycobacterium
ARKSG

SEQ ID NO: 433893 - protein, 7 aa, Mycobacterium
ARKSGAD

SEQ ID NO: 433894 - protein, 8 aa, Mycobacterium
ARKSGADL

SEQ ID NO: 433895 - protein, 8 aa, Mycobacterium
ARKSLDDA

SEQ ID NO: 433896 - protein, 14 aa, Mycobacterium
ARKSTASRNPQEFD

SEQ ID NO: 433897 - protein, 6 aa, Mycobacterium
ARKTAA

SEQ ID NO: 433898 - protein, 9 aa, Mycobacterium
ARKTDDGRI

SEQ ID NO: 433899 - protein, 5 aa, Mycobacterium
ARKTG

SEQ ID NO: 433900 - protein, 10 aa, Mycobacterium
ARKTGAKVTD

SEQ ID NO: 433901 - protein, 9 aa, Mycobacterium
ARKTQDGRI

SEQ ID NO: 433902 - protein, 10 aa, Mycobacterium
ARKTSDADLT

SEQ ID NO: 433903 - protein, 10 aa, Mycobacterium
ARKTTDKDLA

SEQ ID NO: 433904 - protein, 4 aa, Mycobacterium
ARKY

SEQ ID NO: 433905 - protein, 5 aa, Mycobacterium
ARLAD

SEQ ID NO: 433906 - protein, 7 aa, Mycobacterium
ARLADSG

SEQ ID NO: 433907 - protein, 6 aa, Mycobacterium
ARLAQG

SEQ ID NO: 433908 - protein, 17 aa, Mycobacterium
ARLAQRAENEYVGAPTG

SEQ ID NO: 433909 - protein, 10 aa, Mycobacterium
ARLASGVSKA

SEQ ID NO: 433910 - protein, 7 aa, Mycobacterium
ARLATAG

SEQ ID NO: 433911 - protein, 5 aa, Mycobacterium
ARLDH

SEQ ID NO: 433912 - protein, 10 aa, Mycobacterium
ARLDPASDRM

SEQ ID NO: 433913 - protein, 6 aa, Mycobacterium
ARLEHP

SEQ ID NO: 433914 - protein, 7 aa, Mycobacterium
ARLEPAD

SEQ ID NO: 433915 - protein, 7 aa, Mycobacterium
ARLEPSD

SEQ ID NO: 433916 - protein, 9 aa, Mycobacterium
ARLETERPH

SEQ ID NO: 433917 - protein, 6 aa, Mycobacterium
ARLGAT

SEQ ID NO: 433918 - protein, 6 aa, Mycobacterium
ARLGDR

SEQ ID NO: 433919 - protein, 7 aa, Mycobacterium
ARLGKSI

SEQ ID NO: 433920 - protein, 8 aa, Mycobacterium
ARLGPDTS

SEQ ID NO: 433921 - protein, 12 aa, Mycobacterium
ARLNEKDSGPIE

SEQ ID NO: 433922 - protein, 5 aa, Mycobacterium
ARLNP

SEQ ID NO: 433923 - protein, 5 aa, Mycobacterium
ARLNT

SEQ ID NO: 433924 - protein, 4 aa, Mycobacterium
ARLP

SEQ ID NO: 433925 - protein, 16 aa, Mycobacterium
ARLPAQTPLPNQQHTP

SEQ ID NO: 433926 - protein, 24 aa, Mycobacterium
ARLPDGDPADPADDLAPDTPDGRA

SEQ ID NO: 433927 - protein, 12 aa, Mycobacterium
ARLPRDRSTSEV

SEQ ID NO: 433928 - protein, 9 aa, Mycobacterium
ARLPSEREL

SEQ ID NO: 433929 - protein, 4 aa, Mycobacterium
ARLQ

SEQ ID NO: 433930 - protein, 4 aa, Mycobacterium
ARLR

SEQ ID NO: 433931 - protein, 9 aa, Mycobacterium
ARLRDSEKQ

SEQ ID NO: 433932 - protein, 7 aa, Mycobacterium
ARLRPDH

SEQ ID NO: 433933 - protein, 15 aa, Mycobacterium
ARLSEQSAHAGPATV

SEQ ID NO: 433934 - protein, 10 aa, Mycobacterium
ARLSETAPDL

SEQ ID NO: 433935 - protein, 13 aa, Mycobacterium
ARLSGAGATLGDI

SEQ ID NO: 433936 - protein, 7 aa, Mycobacterium
ARLSNGR

SEQ ID NO: 433937 - protein, 12 aa, Mycobacterium
ARLSNGSPGATL

SEQ ID NO: 433938 - protein, 8 aa, Mycobacterium
ARLSRDGV

SEQ ID NO: 433939 - protein, 6 aa, Mycobacterium
ARLSTT

SEQ ID NO: 433940 - protein, 4 aa, Mycobacterium
ARLT

SEQ ID NO: 433941 - protein, 5 aa, Mycobacterium
ARLTG

SEQ ID NO: 433942 - protein, 11 aa, Mycobacterium
ARLTGKDSELS

SEQ ID NO: 433943 - protein, 7 aa, Mycobacterium
ARLTPDG

SEQ ID NO: 433944 - protein, 7 aa, Mycobacterium
ARLTPEE

SEQ ID NO: 433945 - protein, 11 aa, Mycobacterium
ARLTPRSDGRQ

SEQ ID NO: 433946 - protein, 11 aa, Mycobacterium
ARLTPRSDSRQ

SEQ ID NO: 433947 - protein, 11 aa, Mycobacterium
ARLTPRSNNRQ

SEQ ID NO: 433948 - protein, 11 aa, Mycobacterium
ARLTPRSNSRQ

SEQ ID NO: 433949 - protein, 11 aa, Mycobacterium
ARLTPRSNTRQ

SEQ ID NO: 433950 - protein, 23 aa, Mycobacterium
ARLTQGRPALADTEPELAARPSR

SEQ ID NO: 433951 - protein, 12 aa, Mycobacterium
ARMADGSDRPYW

SEQ ID NO: 433952 - protein, 6 aa, Mycobacterium
ARMDRG

SEQ ID NO: 433953 - protein, 9 aa, Mycobacterium
ARMESSGLQ

SEQ ID NO: 433954 - protein, 9 aa, Mycobacterium
ARMGSNGEL

SEQ ID NO: 433955 - protein, 13 aa, Mycobacterium
ARMPARPKHGCRP

SEQ ID NO: 433956 - protein, 4 aa, Mycobacterium
ARMS

SEQ ID NO: 433957 - protein, 14 aa, Mycobacterium
ARMSTDATPGQGDD

SEQ ID NO: 433958 - protein, 7 aa, Mycobacterium
ARMTPGS

SEQ ID NO: 433959 - protein, 8 aa, Mycobacterium
ARNAADPR

SEQ ID NO: 433960 - protein, 8 aa, Mycobacterium
ARNADPGE

SEQ ID NO: 433961 - protein, 13 aa, Mycobacterium
ARNAGAAEGLDAE

SEQ ID NO: 433962 - protein, 14 aa, Mycobacterium
ARNANGASAAAAAT

SEQ ID NO: 433963 - protein, 11 aa, Mycobacterium
ARNANPPSPQL

SEQ ID NO: 433964 - protein, 10 aa, Mycobacterium
ARNAQPGDTI

SEQ ID NO: 433965 - protein, 18 aa, Mycobacterium
ARNARAAGAGTLRKGRKI

SEQ ID NO: 433966 - protein, 11 aa, Mycobacterium
ARNASGETEGG

SEQ ID NO: 433967 - protein, 12 aa, Mycobacterium
ARNATAAEGLDA

SEQ ID NO: 433968 - protein, 13 aa, Mycobacterium
ARNATAAEGLDRE

SEQ ID NO: 433969 - protein, 13 aa, Mycobacterium
ARNATAAEGLDSD

SEQ ID NO: 433970 - protein, 11 aa, Mycobacterium
ARNAVDGPTAA

SEQ ID NO: 433971 - protein, 4 aa, Mycobacterium
ARNC

SEQ ID NO: 433972 - protein, 4 aa, Mycobacterium
ARND

SEQ ID NO: 433973 - protein, 6 aa, Mycobacterium
ARNDDG

SEQ ID NO: 433974 - protein, 41 aa, Mycobacterium
ARNDGADAGAGCHGGRAGRRRSRKAAARAVRAAAGGPVAGA

SEQ ID NO: 433975 - protein, 8 aa, Mycobacterium
ARNDPRVN

SEQ ID NO: 433976 - protein, 13 aa, Mycobacterium
ARNEPKGPQQPHP

SEQ ID NO: 433977 - protein, 13 aa, Mycobacterium
ARNEPKGPQRPHP

SEQ ID NO: 433978 - protein, 7 aa, Mycobacterium
ARNEPVA

SEQ ID NO: 433979 - protein, 12 aa, Mycobacterium
ARNESASPNTVR

SEQ ID NO: 433980 - protein, 10 aa, Mycobacterium
ARNESKRASK

SEQ ID NO: 433981 - protein, 8 aa, Mycobacterium
ARNESRGC

SEQ ID NO: 433982 - protein, 6 aa, Mycobacterium
ARNGAG

SEQ ID NO: 433983 - protein, 6 aa, Mycobacterium
ARNGDD

SEQ ID NO: 433984 - protein, 8 aa, Mycobacterium
ARNGDIGQ

SEQ ID NO: 433985 - protein, 13 aa, Mycobacterium
ARNGERDDLNSGA

SEQ ID NO: 433986 - protein, 6 aa, Mycobacterium
ARNGHP

SEQ ID NO: 433987 - protein, 5 aa, Mycobacterium
ARNGL

SEQ ID NO: 433988 - protein, 8 aa, Mycobacterium
ARNGRPRS

SEQ ID NO: 433989 - protein, 6 aa, Mycobacterium
ARNGSE

SEQ ID NO: 433990 - protein, 5 aa, Mycobacterium
ARNGV

SEQ ID NO: 433991 - protein, 6 aa, Mycobacterium
ARNGVG

SEQ ID NO: 433992 - protein, 17 aa, Mycobacterium
ARNGVGTGISASDRATT

SEQ ID NO: 433993 - protein, 13 aa, Mycobacterium
ARNHAEALQDEGR

SEQ ID NO: 433994 - protein, 17 aa, Mycobacterium
ARNHDLTESELADAERD

SEQ ID NO: 433995 - protein, 17 aa, Mycobacterium
ARNHDLTESELAEAERD

SEQ ID NO: 433996 - protein, 19 aa, Mycobacterium
ARNITTTGQIGDGREAAAA

SEQ ID NO: 433997 - protein, 8 aa, Mycobacterium
ARNKEGAE

SEQ ID NO: 433998 - protein, 5 aa, Mycobacterium
ARNKG

SEQ ID NO: 433999 - protein, 8 aa, Mycobacterium
ARNKGGNA

SEQ ID NO: 434000 - protein, 7 aa, Mycobacterium
ARNKGID

SEQ ID NO: 434001 - protein, 6 aa, Mycobacterium
ARNLGS

SEQ ID NO: 434002 - protein, 13 aa, Mycobacterium
ARNLTRDRHDGDF

SEQ ID NO: 434003 - protein, 6 aa, Mycobacterium
ARNNLE

SEQ ID NO: 434004 - protein, 8 aa, Mycobacterium
ARNNTEAR

SEQ ID NO: 434005 - protein, 4 aa, Mycobacterium
ARNP

SEQ ID NO: 434006 - protein, 5 aa, Mycobacterium
ARNPA

SEQ ID NO: 434007 - protein, 7 aa, Mycobacterium
ARNPDRV

SEQ ID NO: 434008 - protein, 6 aa, Mycobacterium
ARNPEL

SEQ ID NO: 434009 - protein, 6 aa, Mycobacterium
ARNPER

SEQ ID NO: 434010 - protein, 8 aa, Mycobacterium
ARNPEVAD

SEQ ID NO: 434011 - protein, 6 aa, Mycobacterium
ARNPHA

SEQ ID NO: 434012 - protein, 9 aa, Mycobacterium
ARNPLTPRA

SEQ ID NO: 434013 - protein, 7 aa, Mycobacterium
ARNPQRV

SEQ ID NO: 434014 - protein, 10 aa, Mycobacterium
ARNPRTGETV

SEQ ID NO: 434015 - protein, 6 aa, Mycobacterium
ARNPVP

SEQ ID NO: 434016 - protein, 4 aa, Mycobacterium
ARNQ

SEQ ID NO: 434017 - protein, 5 aa, Mycobacterium
ARNQF

SEQ ID NO: 434018 - protein, 5 aa, Mycobacterium
ARNQG

SEQ ID NO: 434019 - protein, 6 aa, Mycobacterium
ARNQHG

SEQ ID NO: 434020 - protein, 8 aa, Mycobacterium
ARNQPQTY

SEQ ID NO: 434021 - protein, 6 aa, Mycobacterium
ARNRAV

SEQ ID NO: 434022 - protein, 23 aa, Mycobacterium
ARNRDIAGRPQEPYGKLKPTRPG

SEQ ID NO: 434023 - protein, 9 aa, Mycobacterium
ARNRGGTPD

SEQ ID NO: 434024 - protein, 6 aa, Mycobacterium
ARNRGI

SEQ ID NO: 434025 - protein, 10 aa, Mycobacterium
ARNRGRSTRA

SEQ ID NO: 434026 - protein, 5 aa, Mycobacterium
ARNRL

SEQ ID NO: 434027 - protein, 5 aa, Mycobacterium
ARNRP

SEQ ID NO: 434028 - protein, 7 aa, Mycobacterium
ARNRTTA

SEQ ID NO: 434029 - protein, 4 aa, Mycobacterium
ARNS

SEQ ID NO: 434030 - protein, 6 aa, Mycobacterium
ARNSGA

SEQ ID NO: 434031 - protein, 9 aa, Mycobacterium
ARNSGRRDK

SEQ ID NO: 434032 - protein, 9 aa, Mycobacterium
ARNSGRREK

SEQ ID NO: 434033 - protein, 6 aa, Mycobacterium
ARNSQS

SEQ ID NO: 434034 - protein, 14 aa, Mycobacterium
ARNSSPGVSDRPGA

SEQ ID NO: 434035 - protein, 8 aa, Mycobacterium
ARNSVESA

SEQ ID NO: 434036 - protein, 5 aa, Mycobacterium
ARNSY

SEQ ID NO: 434037 - protein, 4 aa, Mycobacterium
ARNT

SEQ ID NO: 434038 - protein, 13 aa, Mycobacterium
ARNTAADSGIDNP

SEQ ID NO: 434039 - protein, 5 aa, Mycobacterium
ARNTD

SEQ ID NO: 434040 - protein, 7 aa, Mycobacterium
ARNTKQP

SEQ ID NO: 434041 - protein, 7 aa, Mycobacterium
ARNTPDC

SEQ ID NO: 434042 - protein, 11 aa, Mycobacterium
ARNTTSERLQA

SEQ ID NO: 434043 - protein, 5 aa, Mycobacterium
ARNVS

SEQ ID NO: 434044 - protein, 12 aa, Mycobacterium
ARPAAGDPELGQ

SEQ ID NO: 434045 - protein, 20 aa, Mycobacterium
ARPAAPRPINSRDRRARRPH

SEQ ID NO: 434046 - protein, 29 aa, Mycobacterium
ARPAAPTETAAPEQSRTAAAAAGAAGSAW

SEQ ID NO: 434047 - protein, 8 aa, Mycobacterium
ARPADEPI

SEQ ID NO: 434048 - protein, 20 aa, Mycobacterium
ARPADPRAPRTDPQGTQCLS

SEQ ID NO: 434049 - protein, 14 aa, Mycobacterium
ARPAESQRDPETLR

SEQ ID NO: 434050 - protein, 8 aa, Mycobacterium
ARPAGEPI

SEQ ID NO: 434051 - protein, 8 aa, Mycobacterium
ARPAGLPP

SEQ ID NO: 434052 - protein, 9 aa, Mycobacterium
ARPAGPLAP

SEQ ID NO: 434053 - protein, 11 aa, Mycobacterium
ARPAGRSDRSN

SEQ ID NO: 434054 - protein, 6 aa, Mycobacterium
ARPAGV

SEQ ID NO: 434055 - protein, 8 aa, Mycobacterium
ARPAGVPE

SEQ ID NO: 434056 - protein, 8 aa, Mycobacterium
ARPAHNEA

SEQ ID NO: 434057 - protein, 11 aa, Mycobacterium
ARPAHRADATR

SEQ ID NO: 434058 - protein, 10 aa, Mycobacterium
ARPAHTGDPA

SEQ ID NO: 434059 - protein, 6 aa, Mycobacterium
ARPAHV

SEQ ID NO: 434060 - protein, 6 aa, Mycobacterium
ARPALP

SEQ ID NO: 434061 - protein, 13 aa, Mycobacterium
ARPAPDTETSNPA

SEQ ID NO: 434062 - protein, 6 aa, Mycobacterium
ARPAPH

SEQ ID NO: 434063 - protein, 9 aa, Mycobacterium
ARPAPHSVD

SEQ ID NO: 434064 - protein, 11 aa, Mycobacterium
ARPAPLHPNAA

SEQ ID NO: 434065 - protein, 12 aa, Mycobacterium
ARPAPPTTEYTR

SEQ ID NO: 434066 - protein, 9 aa, Mycobacterium
ARPAPRGHS

SEQ ID NO: 434067 - protein, 20 aa, Mycobacterium
ARPAQQGDARPGPGAGGSGC

SEQ ID NO: 434068 - protein, 5 aa, Mycobacterium
ARPAR

SEQ ID NO: 434069 - protein, 25 aa, Mycobacterium
ARPARAAADAAGAAVPAEAQQPSTV

SEQ ID NO: 434070 - protein, 12 aa, Mycobacterium
ARPARAPRTPAS

SEQ ID NO: 434071 - protein, 30 aa, Mycobacterium
ARPARPARPPRAPRGAARTRTARNGARTAS

SEQ ID NO: 434072 - protein, 24 aa, Mycobacterium
ARPARPPRGTGGKRTARNGARTAS

SEQ ID NO: 434073 - protein, 6 aa, Mycobacterium
ARPARR

SEQ ID NO: 434074 - protein, 24 aa, Mycobacterium
ARPASPPRGSGRSRAARNGARTAT

SEQ ID NO: 434075 - protein, 14 aa, Mycobacterium
ARPASSPHEVADRA

SEQ ID NO: 434076 - protein, 8 aa, Mycobacterium
ARPATPVS

SEQ ID NO: 434077 - protein, 8 aa, Mycobacterium
ARPAVAQA

SEQ ID NO: 434078 - protein, 11 aa, Mycobacterium
ARPAVGTERAG

SEQ ID NO: 434079 - protein, 18 aa, Mycobacterium
ARPAVPSRAAAPAPTPAV

SEQ ID NO: 434080 - protein, 7 aa, Mycobacterium
ARPCDPV

SEQ ID NO: 434081 - protein, 9 aa, Mycobacterium
ARPDAGLPD

SEQ ID NO: 434082 - protein, 9 aa, Mycobacterium
ARPDAPPGT

SEQ ID NO: 434083 - protein, 10 aa, Mycobacterium
ARPDASEAQM

SEQ ID NO: 434084 - protein, 7 aa, Mycobacterium
ARPDDFP

SEQ ID NO: 434085 - protein, 8 aa, Mycobacterium
ARPDGDEI

SEQ ID NO: 434086 - protein, 6 aa, Mycobacterium
ARPDGE

SEQ ID NO: 434087 - protein, 9 aa, Mycobacterium
ARPDGEGGW

SEQ ID NO: 434088 - protein, 14 aa, Mycobacterium
ARPDHPNIRRSSGQ

SEQ ID NO: 434089 - protein, 5 aa, Mycobacterium
ARPDI

SEQ ID NO: 434090 - protein, 8 aa, Mycobacterium
ARPDLPDR

SEQ ID NO: 434091 - protein, 12 aa, Mycobacterium
ARPDPALPGPDG

SEQ ID NO: 434092 - protein, 7 aa, Mycobacterium
ARPDPST

SEQ ID NO: 434093 - protein, 10 aa, Mycobacterium
ARPDPSYDPN

SEQ ID NO: 434094 - protein, 14 aa, Mycobacterium
ARPDQSDPASYGPL

SEQ ID NO: 434095 - protein, 8 aa, Mycobacterium
ARPDRPYG

SEQ ID NO: 434096 - protein, 5 aa, Mycobacterium
ARPDS

SEQ ID NO: 434097 - protein, 6 aa, Mycobacterium
ARPDSF

SEQ ID NO: 434098 - protein, 6 aa, Mycobacterium
ARPDSI

SEQ ID NO: 434099 - protein, 5 aa, Mycobacterium
ARPDT

SEQ ID NO: 434100 - protein, 13 aa, Mycobacterium
ARPDTGPGAGGGA

SEQ ID NO: 434101 - protein, 11 aa, Mycobacterium
ARPDTGRAQDD

SEQ ID NO: 434102 - protein, 34 aa, Mycobacterium
ARPDTNAREPGDRTPAAPPAATPAATTDQLPEDR

SEQ ID NO: 434103 - protein, 9 aa, Mycobacterium
ARPDTPEPL

SEQ ID NO: 434104 - protein, 10 aa, Mycobacterium
ARPDVKEVTE

SEQ ID NO: 434105 - protein, 10 aa, Mycobacterium
ARPEAHHEEA

SEQ ID NO: 434106 - protein, 8 aa, Mycobacterium
ARPEDAGD

SEQ ID NO: 434107 - protein, 6 aa, Mycobacterium
ARPEDF

SEQ ID NO: 434108 - protein, 9 aa, Mycobacterium
ARPEDLDET

SEQ ID NO: 434109 - protein, 10 aa, Mycobacterium
ARPEDTAGLA

SEQ ID NO: 434110 - protein, 5 aa, Mycobacterium
ARPEE

SEQ ID NO: 434111 - protein, 8 aa, Mycobacterium
ARPEGANA

SEQ ID NO: 434112 - protein, 10 aa, Mycobacterium
ARPENPDPLG

SEQ ID NO: 434113 - protein, 6 aa, Mycobacterium
ARPEPM

SEQ ID NO: 434114 - protein, 5 aa, Mycobacterium
ARPEQ

SEQ ID NO: 434115 - protein, 6 aa, Mycobacterium
ARPERE

SEQ ID NO: 434116 - protein, 13 aa, Mycobacterium
ARPESLPIDGQPD

SEQ ID NO: 434117 - protein, 11 aa, Mycobacterium
ARPESPGGSLD

SEQ ID NO: 434118 - protein, 12 aa, Mycobacterium
ARPESTTQDSLN

SEQ ID NO: 434119 - protein, 5 aa, Mycobacterium
ARPET

SEQ ID NO: 434120 - protein, 26 aa, Mycobacterium
ARPETQDALNADSSKSLPRPATGDEL

SEQ ID NO: 434121 - protein, 13 aa, Mycobacterium
ARPETRPIDGQPE

SEQ ID NO: 434122 - protein, 10 aa, Mycobacterium
ARPETRPIEG

SEQ ID NO: 434123 - protein, 5 aa, Mycobacterium
ARPEY

SEQ ID NO: 434124 - protein, 10 aa, Mycobacterium
ARPFSSTTRE

SEQ ID NO: 434125 - protein, 4 aa, Mycobacterium
ARPG

SEQ ID NO: 434126 - protein, 10 aa, Mycobacterium
ARPGARHTRD

SEQ ID NO: 434127 - protein, 10 aa, Mycobacterium
ARPGARRSRA

SEQ ID NO: 434128 - protein, 23 aa, Mycobacterium
ARPGDDDVAARARAAADGPGPLR

SEQ ID NO: 434129 - protein, 9 aa, Mycobacterium
ARPGDGDVG

SEQ ID NO: 434130 - protein, 13 aa, Mycobacterium
ARPGDIYGPGSRP

SEQ ID NO: 434131 - protein, 6 aa, Mycobacterium
ARPGDT

SEQ ID NO: 434132 - protein, 7 aa, Mycobacterium
ARPGDTW

SEQ ID NO: 434133 - protein, 16 aa, Mycobacterium
ARPGEHREYETPTGAR

SEQ ID NO: 434134 - protein, 14 aa, Mycobacterium
ARPGEPAIAQFSIR

SEQ ID NO: 434135 - protein, 6 aa, Mycobacterium
ARPGER

SEQ ID NO: 434136 - protein, 7 aa, Mycobacterium
ARPGERE

SEQ ID NO: 434137 - protein, 7 aa, Mycobacterium
ARPGERR

SEQ ID NO: 434138 - protein, 9 aa, Mycobacterium
ARPGGAVPD

SEQ ID NO: 434139 - protein, 9 aa, Mycobacterium
ARPGGNKQR

SEQ ID NO: 434140 - protein, 7 aa, Mycobacterium
ARPGGQC

SEQ ID NO: 434141 - protein, 5 aa, Mycobacterium
ARPGH

SEQ ID NO: 434142 - protein, 14 aa, Mycobacterium
ARPGIGAHRRRCRP

SEQ ID NO: 434143 - protein, 9 aa, Mycobacterium
ARPGIPPTH

SEQ ID NO: 434144 - protein, 10 aa, Mycobacterium
ARPGIPPTHP

SEQ ID NO: 434145 - protein, 5 aa, Mycobacterium
ARPGL

SEQ ID NO: 434146 - protein, 23 aa, Mycobacterium
ARPGLPGDWPTGFDDATRPYTPA

SEQ ID NO: 434147 - protein, 7 aa, Mycobacterium
ARPGLSD

SEQ ID NO: 434148 - protein, 12 aa, Mycobacterium
ARPGNQPRVTQD

SEQ ID NO: 434149 - protein, 9 aa, Mycobacterium
ARPGPHGQR

SEQ ID NO: 434150 - protein, 6 aa, Mycobacterium
ARPGQI

SEQ ID NO: 434151 - protein, 7 aa, Mycobacterium
ARPGSAE

SEQ ID NO: 434152 - protein, 7 aa, Mycobacterium
ARPGSDR

SEQ ID NO: 434153 - protein, 11 aa, Mycobacterium
ARPGTPLHDPG

SEQ ID NO: 434154 - protein, 7 aa, Mycobacterium
ARPGTRR

SEQ ID NO: 434155 - protein, 12 aa, Mycobacterium
ARPGTVSRNGVS

SEQ ID NO: 434156 - protein, 13 aa, Mycobacterium
ARPGVTAESVDAA

SEQ ID NO: 434157 - protein, 7 aa, Mycobacterium
ARPGVTR

SEQ ID NO: 434158 - protein, 13 aa, Mycobacterium
ARPHEISGGQQQR

SEQ ID NO: 434159 - protein, 10 aa, Mycobacterium
ARPHPPGQPM

SEQ ID NO: 434160 - protein, 9 aa, Mycobacterium
ARPHSAEEA

SEQ ID NO: 434161 - protein, 6 aa, Mycobacterium
ARPIGD

SEQ ID NO: 434162 - protein, 5 aa, Mycobacterium
ARPIS

SEQ ID NO: 434163 - protein, 9 aa, Mycobacterium
ARPITAPEE

SEQ ID NO: 434164 - protein, 13 aa, Mycobacterium
ARPITERKERAVI

SEQ ID NO: 434165 - protein, 5 aa, Mycobacterium
ARPKD

SEQ ID NO: 434166 - protein, 10 aa, Mycobacterium
ARPKDDTATA

SEQ ID NO: 434167 - protein, 6 aa, Mycobacterium
ARPKRY

SEQ ID NO: 434168 - protein, 7 aa, Mycobacterium
ARPKRYA

SEQ ID NO: 434169 - protein, 4 aa, Mycobacterium
ARPL

SEQ ID NO: 434170 - protein, 9 aa, Mycobacterium
ARPLSNATR

SEQ ID NO: 434171 - protein, 13 aa, Mycobacterium
ARPLTGEGVKNGM

SEQ ID NO: 434172 - protein, 7 aa, Mycobacterium
ARPLTSA

SEQ ID NO: 434173 - protein, 16 aa, Mycobacterium
ARPMPAPRTVRRSDGG

SEQ ID NO: 434174 - protein, 4 aa, Mycobacterium
ARPN

SEQ ID NO: 434175 - protein, 12 aa, Mycobacterium
ARPNAKDVDGPT

SEQ ID NO: 434176 - protein, 13 aa, Mycobacterium
ARPNEVDEDELRD

SEQ ID NO: 434177 - protein, 15 aa, Mycobacterium
ARPNGTTVCLDYTTR

SEQ ID NO: 434178 - protein, 7 aa, Mycobacterium
ARPNKPR

SEQ ID NO: 434179 - protein, 10 aa, Mycobacterium
ARPNNQPRIA

SEQ ID NO: 434180 - protein, 6 aa, Mycobacterium
ARPNQV

SEQ ID NO: 434181 - protein, 9 aa, Mycobacterium
ARPNSAEEA

SEQ ID NO: 434182 - protein, 7 aa, Mycobacterium
ARPPAAG

SEQ ID NO: 434183 - protein, 6 aa, Mycobacterium
ARPPAF

SEQ ID NO: 434184 - protein, 6 aa, Mycobacterium
ARPPAR

SEQ ID NO: 434185 - protein, 8 aa, Mycobacterium
ARPPEKFT

SEQ ID NO: 434186 - protein, 6 aa, Mycobacterium
ARPPER

SEQ ID NO: 434187 - protein, 8 aa, Mycobacterium
ARPPEVAD

SEQ ID NO: 434188 - protein, 6 aa, Mycobacterium
ARPPGC

SEQ ID NO: 434189 - protein, 9 aa, Mycobacterium
ARPPGPDVG

SEQ ID NO: 434190 - protein, 14 aa, Mycobacterium
ARPPGTTITEQQPT

SEQ ID NO: 434191 - protein, 5 aa, Mycobacterium
ARPPH

SEQ ID NO: 434192 - protein, 10 aa, Mycobacterium
ARPPHRADAT

SEQ ID NO: 434193 - protein, 21 aa, Mycobacterium
ARPPKGTRGTRTARNGARTAI

SEQ ID NO: 434194 - protein, 15 aa, Mycobacterium
ARPPLKKTIDETDRA

SEQ ID NO: 434195 - protein, 5 aa, Mycobacterium
ARPPM

SEQ ID NO: 434196 - protein, 5 aa, Mycobacterium
ARPPR

SEQ ID NO: 434197 - protein, 7 aa, Mycobacterium
ARPPRGL

SEQ ID NO: 434198 - protein, 16 aa, Mycobacterium
ARPPRQQPTRSGKAGN

SEQ ID NO: 434199 - protein, 15 aa, Mycobacterium
ARPPRRQPRTPSGQL

SEQ ID NO: 434200 - protein, 7 aa, Mycobacterium
ARPPRSA

SEQ ID NO: 434201 - protein, 6 aa, Mycobacterium
ARPPTL

SEQ ID NO: 434202 - protein, 14 aa, Mycobacterium
ARPPVTVTDPPAGL

SEQ ID NO: 434203 - protein, 19 aa, Mycobacterium
ARPQAGAKRRGSSHAPSLN

SEQ ID NO: 434204 - protein, 6 aa, Mycobacterium
ARPQDW

SEQ ID NO: 434205 - protein, 7 aa, Mycobacterium
ARPQHPA

SEQ ID NO: 434206 - protein, 6 aa, Mycobacterium
ARPQRL

SEQ ID NO: 434207 - protein, 6 aa, Mycobacterium
ARPQRR

SEQ ID NO: 434208 - protein, 8 aa, Mycobacterium
ARPQSPAV

SEQ ID NO: 434209 - protein, 6 aa, Mycobacterium
ARPQTQ

SEQ ID NO: 434210 - protein, 6 aa, Mycobacterium
ARPQTV

SEQ ID NO: 434211 - protein, 5 aa, Mycobacterium
ARPRA

SEQ ID NO: 434212 - protein, 18 aa, Mycobacterium
ARPRAADAHPEEPAEATA

SEQ ID NO: 434213 - protein, 7 aa, Mycobacterium
ARPRDAA

SEQ ID NO: 434214 - protein, 5 aa, Mycobacterium
ARPRG

SEQ ID NO: 434215 - protein, 7 aa, Mycobacterium
ARPRGTA

SEQ ID NO: 434216 - protein, 7 aa, Mycobacterium
ARPRPRS

SEQ ID NO: 434217 - protein, 16 aa, Mycobacterium
ARPRPTRPDLDARRGT

SEQ ID NO: 434218 - protein, 7 aa, Mycobacterium
ARPRPTS

SEQ ID NO: 434219 - protein, 15 aa, Mycobacterium
ARPRQPRSRVPRSAA

SEQ ID NO: 434220 - protein, 5 aa, Mycobacterium
ARPRR

SEQ ID NO: 434221 - protein, 12 aa, Mycobacterium
ARPRRLPTPGAD

SEQ ID NO: 434222 - protein, 7 aa, Mycobacterium
ARPRSGP

SEQ ID NO: 434223 - protein, 5 aa, Mycobacterium
ARPRT

SEQ ID NO: 434224 - protein, 8 aa, Mycobacterium
ARPRYTDP

SEQ ID NO: 434225 - protein, 8 aa, Mycobacterium
ARPRYTEP

SEQ ID NO: 434226 - protein, 4 aa, Mycobacterium
ARPS

SEQ ID NO: 434227 - protein, 7 aa, Mycobacterium
ARPSGMQ

SEQ ID NO: 434228 - protein, 8 aa, Mycobacterium
ARPSNHGT

SEQ ID NO: 434229 - protein, 6 aa, Mycobacterium
ARPSRQ

SEQ ID NO: 434230 - protein, 7 aa, Mycobacterium
ARPSTTV

SEQ ID NO: 434231 - protein, 6 aa, Mycobacterium
ARPSVD

SEQ ID NO: 434232 - protein, 24 aa, Mycobacterium
ARPTAPDWKPPKEWPSNARAVTGQ

SEQ ID NO: 434233 - protein, 6 aa, Mycobacterium
ARPTDL

SEQ ID NO: 434234 - protein, 8 aa, Mycobacterium
ARPTGDEP

SEQ ID NO: 434235 - protein, 9 aa, Mycobacterium
ARPTGSPAV

SEQ ID NO: 434236 - protein, 7 aa, Mycobacterium
ARPTHEN

SEQ ID NO: 434237 - protein, 10 aa, Mycobacterium
ARPTSKASIG

SEQ ID NO: 434238 - protein, 6 aa, Mycobacterium
ARPTST

SEQ ID NO: 434239 - protein, 20 aa, Mycobacterium
ARPTSVSSGRALPATLTGQG

SEQ ID NO: 434240 - protein, 6 aa, Mycobacterium
ARPTVD

SEQ ID NO: 434241 - protein, 7 aa, Mycobacterium
ARPTVDC

SEQ ID NO: 434242 - protein, 5 aa, Mycobacterium
ARPVD

SEQ ID NO: 434243 - protein, 8 aa, Mycobacterium
ARPVPAGP

SEQ ID NO: 434244 - protein, 9 aa, Mycobacterium
ARPVPDSSD

SEQ ID NO: 434245 - protein, 7 aa, Mycobacterium
ARPVPVP

SEQ ID NO: 434246 - protein, 7 aa, Mycobacterium
ARPVSSP

SEQ ID NO: 434247 - protein, 13 aa, Mycobacterium
ARPVTERKEAAVI

SEQ ID NO: 434248 - protein, 13 aa, Mycobacterium
ARPVTERKQAAVI

SEQ ID NO: 434249 - protein, 7 aa, Mycobacterium
ARPWPAR

SEQ ID NO: 434250 - protein, 6 aa, Mycobacterium
ARPWTN

SEQ ID NO: 434251 - protein, 17 aa, Mycobacterium
ARPWTNREANDSSDVPN

SEQ ID NO: 434252 - protein, 4 aa, Mycobacterium
ARPY

SEQ ID NO: 434253 - protein, 6 aa, Mycobacterium
ARPYDS

SEQ ID NO: 434254 - protein, 5 aa, Mycobacterium
ARQAA

SEQ ID NO: 434255 - protein, 15 aa, Mycobacterium
ARQAAAEPVSRTVIM

SEQ ID NO: 434256 - protein, 7 aa, Mycobacterium
ARQAADA

SEQ ID NO: 434257 - protein, 14 aa, Mycobacterium
ARQAAQSGSHRGQV

SEQ ID NO: 434258 - protein, 6 aa, Mycobacterium
ARQAAR

SEQ ID NO: 434259 - protein, 13 aa, Mycobacterium
ARQADQAGNPAAA

SEQ ID NO: 434260 - protein, 7 aa, Mycobacterium
ARQADRP

SEQ ID NO: 434261 - protein, 9 aa, Mycobacterium
ARQAEASGF

SEQ ID NO: 434262 - protein, 12 aa, Mycobacterium
ARQAGVSGPLPT

SEQ ID NO: 434263 - protein, 5 aa, Mycobacterium
ARQAL

SEQ ID NO: 434264 - protein, 6 aa, Mycobacterium
ARQAPG

SEQ ID NO: 434265 - protein, 11 aa, Mycobacterium
ARQAPSQDLGG

SEQ ID NO: 434266 - protein, 5 aa, Mycobacterium
ARQAS

SEQ ID NO: 434267 - protein, 6 aa, Mycobacterium
ARQATQ

SEQ ID NO: 434268 - protein, 9 aa, Mycobacterium
ARQATTDTL

SEQ ID NO: 434269 - protein, 9 aa, Mycobacterium
ARQAVDDGY

SEQ ID NO: 434270 - protein, 10 aa, Mycobacterium
ARQDAWSGDA

SEQ ID NO: 434271 - protein, 6 aa, Mycobacterium
ARQDGA

SEQ ID NO: 434272 - protein, 6 aa, Mycobacterium
ARQDRE

SEQ ID NO: 434273 - protein, 6 aa, Mycobacterium
ARQDSA

SEQ ID NO: 434274 - protein, 6 aa, Mycobacterium
ARQEIQ

SEQ ID NO: 434275 - protein, 11 aa, Mycobacterium
ARQEQRPERGS

SEQ ID NO: 434276 - protein, 6 aa, Mycobacterium
ARQGAG

SEQ ID NO: 434277 - protein, 13 aa, Mycobacterium
ARQGAKDAGTTLE

SEQ ID NO: 434278 - protein, 13 aa, Mycobacterium
ARQGAKPNASGIE

SEQ ID NO: 434279 - protein, 8 aa, Mycobacterium
ARQGDDEE

SEQ ID NO: 434280 - protein, 7 aa, Mycobacterium
ARQGDEH

SEQ ID NO: 434281 - protein, 12 aa, Mycobacterium
ARQGDPAPGGVG

SEQ ID NO: 434282 - protein, 7 aa, Mycobacterium
ARQGEEM

SEQ ID NO: 434283 - protein, 6 aa, Mycobacterium
ARQGER

SEQ ID NO: 434284 - protein, 6 aa, Mycobacterium
ARQGGL

SEQ ID NO: 434285 - protein, 6 aa, Mycobacterium
ARQGLT

SEQ ID NO: 434286 - protein, 5 aa, Mycobacterium
ARQGN

SEQ ID NO: 434287 - protein, 6 aa, Mycobacterium
ARQGND

SEQ ID NO: 434288 - protein, 6 aa, Mycobacterium
ARQGNS

SEQ ID NO: 434289 - protein, 10 aa, Mycobacterium
ARQGPLPDEL

SEQ ID NO: 434290 - protein, 12 aa, Mycobacterium
ARQGPSKADWAD

SEQ ID NO: 434291 - protein, 10 aa, Mycobacterium
ARQGQRAGSI

SEQ ID NO: 434292 - protein, 6 aa, Mycobacterium
ARQGRM

SEQ ID NO: 434293 - protein, 11 aa, Mycobacterium
ARQGRSAPELA

SEQ ID NO: 434294 - protein, 6 aa, Mycobacterium
ARQGSA

SEQ ID NO: 434295 - protein, 6 aa, Mycobacterium
ARQGSL

SEQ ID NO: 434296 - protein, 7 aa, Mycobacterium
ARQGTNI

SEQ ID NO: 434297 - protein, 14 aa, Mycobacterium
ARQGVKPEPNQCDP

SEQ ID NO: 434298 - protein, 6 aa, Mycobacterium
ARQHAT

SEQ ID NO: 434299 - protein, 9 aa, Mycobacterium
ARQHERDQQ

SEQ ID NO: 434300 - protein, 20 aa, Mycobacterium
ARQHGLSPDNLTRDARGNLD

SEQ ID NO: 434301 - protein, 5 aa, Mycobacterium
ARQHR

SEQ ID NO: 434302 - protein, 6 aa, Mycobacterium
ARQHSE

SEQ ID NO: 434303 - protein, 4 aa, Mycobacterium
ARQI

SEQ ID NO: 434304 - protein, 10 aa, Mycobacterium
ARQIASPGSE

SEQ ID NO: 434305 - protein, 11 aa, Mycobacterium
ARQKAKELGVD

SEQ ID NO: 434306 - protein, 17 aa, Mycobacterium
ARQKGLKAPASCETGSC

SEQ ID NO: 434307 - protein, 5 aa, Mycobacterium
ARQLS

SEQ ID NO: 434308 - protein, 4 aa, Mycobacterium
ARQN

SEQ ID NO: 434309 - protein, 7 aa, Mycobacterium
ARQNDDL

SEQ ID NO: 434310 - protein, 5 aa, Mycobacterium
ARQNG

SEQ ID NO: 434311 - protein, 4 aa, Mycobacterium
ARQP

SEQ ID NO: 434312 - protein, 6 aa, Mycobacterium
ARQPAF

SEQ ID NO: 434313 - protein, 9 aa, Mycobacterium
ARQPDAVDA

SEQ ID NO: 434314 - protein, 6 aa, Mycobacterium
ARQPDV

SEQ ID NO: 434315 - protein, 6 aa, Mycobacterium
ARQPET

SEQ ID NO: 434316 - protein, 7 aa, Mycobacterium
ARQPGNG

SEQ ID NO: 434317 - protein, 10 aa, Mycobacterium
ARQPGPSGGR

SEQ ID NO: 434318 - protein, 5 aa, Mycobacterium
ARQPK

SEQ ID NO: 434319 - protein, 13 aa, Mycobacterium
ARQPKGHAGEADI

SEQ ID NO: 434320 - protein, 5 aa, Mycobacterium
ARQPS

SEQ ID NO: 434321 - protein, 6 aa, Mycobacterium
ARQPSK

SEQ ID NO: 434322 - protein, 7 aa, Mycobacterium
ARQPSPE

SEQ ID NO: 434323 - protein, 7 aa, Mycobacterium
ARQPWQP

SEQ ID NO: 434324 - protein, 5 aa, Mycobacterium
ARQQD

SEQ ID NO: 434325 - protein, 13 aa, Mycobacterium
ARQQGRTEFTKEE

SEQ ID NO: 434326 - protein, 8 aa, Mycobacterium
ARQQGYGQ

SEQ ID NO: 434327 - protein, 18 aa, Mycobacterium
ARQQLEDGDFEAAKASYQ

SEQ ID NO: 434328 - protein, 5 aa, Mycobacterium
ARQQY

SEQ ID NO: 434329 - protein, 16 aa, Mycobacterium
ARQRAGAGAGPGADDV

SEQ ID NO: 434330 - protein, 7 aa, Mycobacterium
ARQRAGL

SEQ ID NO: 434331 - protein, 7 aa, Mycobacterium
ARQRAGQ

SEQ ID NO: 434332 - protein, 13 aa, Mycobacterium
ARQRAGSHNEPDV

SEQ ID NO: 434333 - protein, 7 aa, Mycobacterium
ARQRARD

SEQ ID NO: 434334 - protein, 6 aa, Mycobacterium
ARQRER

SEQ ID NO: 434335 - protein, 9 aa, Mycobacterium
ARQRERGQA

SEQ ID NO: 434336 - protein, 5 aa, Mycobacterium
ARQRG

SEQ ID NO: 434337 - protein, 14 aa, Mycobacterium
ARQRGETAADVTPM

SEQ ID NO: 434338 - protein, 17 aa, Mycobacterium
ARQRHQDDHAARAATAD

SEQ ID NO: 434339 - protein, 12 aa, Mycobacterium
ARQRKAKNPFAT

SEQ ID NO: 434340 - protein, 9 aa, Mycobacterium
ARQRMPERA

SEQ ID NO: 434341 - protein, 5 aa, Mycobacterium
ARQRP

SEQ ID NO: 434342 - protein, 7 aa, Mycobacterium
ARQRQDI

SEQ ID NO: 434343 - protein, 6 aa, Mycobacterium
ARQRRL

SEQ ID NO: 434344 - protein, 17 aa, Mycobacterium
ARQRRRPPAGAGVPARG

SEQ ID NO: 434345 - protein, 21 aa, Mycobacterium
ARQRTAHRRTAAAAAEQAARD

SEQ ID NO: 434346 - protein, 18 aa, Mycobacterium
ARQRTAQRRTAEAAAEQA

SEQ ID NO: 434347 - protein, 13 aa, Mycobacterium
ARQRTGARDRDFE

SEQ ID NO: 434348 - protein, 6 aa, Mycobacterium
ARQSGA

SEQ ID NO: 434349 - protein, 13 aa, Mycobacterium
ARQSPTVGQASPQ

SEQ ID NO: 434350 - protein, 8 aa, Mycobacterium
ARQSRSQV

SEQ ID NO: 434351 - protein, 16 aa, Mycobacterium
ARQTAETTVTEARQRA

SEQ ID NO: 434352 - protein, 10 aa, Mycobacterium
ARQTAGRYRN

SEQ ID NO: 434353 - protein, 6 aa, Mycobacterium
ARQTGA

SEQ ID NO: 434354 - protein, 13 aa, Mycobacterium
ARQTHAAARAALA

SEQ ID NO: 434355 - protein, 33 aa, Mycobacterium
ARQTKNPPADAEPPNGPPPPARWSRRKPEAAAR

SEQ ID NO: 434356 - protein, 20 aa, Mycobacterium
ARQTLNESRGRIAQRTTLSP

SEQ ID NO: 434357 - protein, 7 aa, Mycobacterium
ARQTPCS

SEQ ID NO: 434358 - protein, 6 aa, Mycobacterium
ARQTRA

SEQ ID NO: 434359 - protein, 8 aa, Mycobacterium
ARQTTTGR

SEQ ID NO: 434360 - protein, 9 aa, Mycobacterium
ARQTVRPSL

SEQ ID NO: 434361 - protein, 9 aa, Mycobacterium
ARQVRPDTM

SEQ ID NO: 434362 - protein, 7 aa, Mycobacterium
ARQYADE

SEQ ID NO: 434363 - protein, 8 aa, Mycobacterium
ARQYPEPL

SEQ ID NO: 434364 - protein, 6 aa, Mycobacterium
ARRAAE

SEQ ID NO: 434365 - protein, 15 aa, Mycobacterium
ARRAAEEADRDPDAL

SEQ ID NO: 434366 - protein, 57 aa, Mycobacterium
ARRAAESGQGHDDSEKFRGRADERTYRPVSGSTPGRTNRKDKTMAKGHHRSATTGRY

SEQ ID NO: 434367 - protein, 8 aa, Mycobacterium
ARRAAGDT

SEQ ID NO: 434368 - protein, 22 aa, Mycobacterium
ARRAASDHSMSAAVEPSLAMPG

SEQ ID NO: 434369 - protein, 11 aa, Mycobacterium
ARRAASDQPRR

SEQ ID NO: 434370 - protein, 6 aa, Mycobacterium
ARRADD

SEQ ID NO: 434371 - protein, 7 aa, Mycobacterium
ARRADDI

SEQ ID NO: 434372 - protein, 9 aa, Mycobacterium
ARRADDPLR

SEQ ID NO: 434373 - protein, 10 aa, Mycobacterium
ARRADPGPDI

SEQ ID NO: 434374 - protein, 6 aa, Mycobacterium
ARRADR

SEQ ID NO: 434375 - protein, 9 aa, Mycobacterium
ARRAEPTED

SEQ ID NO: 434376 - protein, 13 aa, Mycobacterium
ARRAERAKSPDLA

SEQ ID NO: 434377 - protein, 9 aa, Mycobacterium
ARRAESERR

SEQ ID NO: 434378 - protein, 6 aa, Mycobacterium
ARRAGA

SEQ ID NO: 434379 - protein, 24 aa, Mycobacterium
ARRAGDVGGADGTRYALPHDDRLG

SEQ ID NO: 434380 - protein, 10 aa, Mycobacterium
ARRAGEAPAW

SEQ ID NO: 434381 - protein, 10 aa, Mycobacterium
ARRAGEAPTW

SEQ ID NO: 434382 - protein, 11 aa, Mycobacterium
ARRAGHDVGRD

SEQ ID NO: 434383 - protein, 9 aa, Mycobacterium
ARRAGLDPP

SEQ ID NO: 434384 - protein, 6 aa, Mycobacterium
ARRAGV

SEQ ID NO: 434385 - protein, 15 aa, Mycobacterium
ARRAHAPADVVEVLA

SEQ ID NO: 434386 - protein, 10 aa, Mycobacterium
ARRAHPTDDL

SEQ ID NO: 434387 - protein, 10 aa, Mycobacterium
ARRAKDPLRG

SEQ ID NO: 434388 - protein, 14 aa, Mycobacterium
ARRAKSAGGESRAS

SEQ ID NO: 434389 - protein, 13 aa, Mycobacterium
ARRALGDDGESQR

SEQ ID NO: 434390 - protein, 7 aa, Mycobacterium
ARRANPA

SEQ ID NO: 434391 - protein, 13 aa, Mycobacterium
ARRAPAPQPGQDT

SEQ ID NO: 434392 - protein, 8 aa, Mycobacterium
ARRAPHAD

SEQ ID NO: 434393 - protein, 6 aa, Mycobacterium
ARRAPQ

SEQ ID NO: 434394 - protein, 13 aa, Mycobacterium
ARRAPRAELEAEA

SEQ ID NO: 434395 - protein, 6 aa, Mycobacterium
ARRAQT

SEQ ID NO: 434396 - protein, 7 aa, Mycobacterium
ARRAQTR

SEQ ID NO: 434397 - protein, 6 aa, Mycobacterium
ARRARV

SEQ ID NO: 434398 - protein, 10 aa, Mycobacterium
ARRASAAKTS

SEQ ID NO: 434399 - protein, 10 aa, Mycobacterium
ARRASADTAV

SEQ ID NO: 434400 - protein, 5 aa, Mycobacterium
ARRAT

SEQ ID NO: 434401 - protein, 11 aa, Mycobacterium
ARRATAAAGGV

SEQ ID NO: 434402 - protein, 6 aa, Mycobacterium
ARRATG

SEQ ID NO: 434403 - protein, 12 aa, Mycobacterium
ARRATPTTHLHG

SEQ ID NO: 434404 - protein, 13 aa, Mycobacterium
ARRAVTAATVDPA

SEQ ID NO: 434405 - protein, 6 aa, Mycobacterium
ARRAYP

SEQ ID NO: 434406 - protein, 7 aa, Mycobacterium
ARRDADD

SEQ ID NO: 434407 - protein, 15 aa, Mycobacterium
ARRDAIDRDGAWAAK

SEQ ID NO: 434408 - protein, 12 aa, Mycobacterium
ARRDASDRPGMS

SEQ ID NO: 434409 - protein, 9 aa, Mycobacterium
ARRDDEPVE

SEQ ID NO: 434410 - protein, 6 aa, Mycobacterium
ARRDDG

SEQ ID NO: 434411 - protein, 10 aa, Mycobacterium
ARRDDGKARA

SEQ ID NO: 434412 - protein, 7 aa, Mycobacterium
ARRDDGV

SEQ ID NO: 434413 - protein, 5 aa, Mycobacterium
ARRDE

SEQ ID NO: 434414 - protein, 6 aa, Mycobacterium
ARRDEA

SEQ ID NO: 434415 - protein, 8 aa, Mycobacterium
ARRDEETQ

SEQ ID NO: 434416 - protein, 7 aa, Mycobacterium
ARRDEQG

SEQ ID NO: 434417 - protein, 8 aa, Mycobacterium
ARRDESTR

SEQ ID NO: 434418 - protein, 8 aa, Mycobacterium
ARRDETTR

SEQ ID NO: 434419 - protein, 7 aa, Mycobacterium
ARRDGAK

SEQ ID NO: 434420 - protein, 7 aa, Mycobacterium
ARRDGAP

SEQ ID NO: 434421 - protein, 7 aa, Mycobacterium
ARRDGAT

SEQ ID NO: 434422 - protein, 9 aa, Mycobacterium
ARRDGATRV

SEQ ID NO: 434423 - protein, 6 aa, Mycobacterium
ARRDGD

SEQ ID NO: 434424 - protein, 16 aa, Mycobacterium
ARRDGDDPAAAARERW

SEQ ID NO: 434425 - protein, 8 aa, Mycobacterium
ARRDGDDY

SEQ ID NO: 434426 - protein, 7 aa, Mycobacterium
ARRDGDG

SEQ ID NO: 434427 - protein, 13 aa, Mycobacterium
ARRDGQAKVTGAA

SEQ ID NO: 434428 - protein, 8 aa, Mycobacterium
ARRDGSPE

SEQ ID NO: 434429 - protein, 16 aa, Mycobacterium
ARRDGTGGTPQDATSR

SEQ ID NO: 434430 - protein, 8 aa, Mycobacterium
ARRDGTRQ

SEQ ID NO: 434431 - protein, 7 aa, Mycobacterium
ARRDPAA

SEQ ID NO: 434432 - protein, 11 aa, Mycobacterium
ARRDPEERRVE

SEQ ID NO: 434433 - protein, 7 aa, Mycobacterium
ARRDPGR

SEQ ID NO: 434434 - protein, 13 aa, Mycobacterium
ARRDQVRATGRSI

SEQ ID NO: 434435 - protein, 11 aa, Mycobacterium
ARRDRDDPELQ

SEQ ID NO: 434436 - protein, 6 aa, Mycobacterium
ARRDSA

SEQ ID NO: 434437 - protein, 12 aa, Mycobacterium
ARRDSGDSHSQA

SEQ ID NO: 434438 - protein, 5 aa, Mycobacterium
ARRDT

SEQ ID NO: 434439 - protein, 13 aa, Mycobacterium
ARRDTEPAAAAAV

SEQ ID NO: 434440 - protein, 11 aa, Mycobacterium
ARREAASAFGD

SEQ ID NO: 434441 - protein, 11 aa, Mycobacterium
ARREAASSFGD

SEQ ID NO: 434442 - protein, 10 aa, Mycobacterium
ARREAGAAFG

SEQ ID NO: 434443 - protein, 11 aa, Mycobacterium
ARREAGSSFGD

SEQ ID NO: 434444 - protein, 6 aa, Mycobacterium
ARREAI

SEQ ID NO: 434445 - protein, 6 aa, Mycobacterium
ARREAL

SEQ ID NO: 434446 - protein, 24 aa, Mycobacterium
ARREAPVAASEAALASTAGSLSGI

SEQ ID NO: 434447 - protein, 11 aa, Mycobacterium
ARREAQSAFGD

SEQ ID NO: 434448 - protein, 21 aa, Mycobacterium
ARREEEAANGVPRRRQGAGVA

SEQ ID NO: 434449 - protein, 11 aa, Mycobacterium
ARREEKGSDVN

SEQ ID NO: 434450 - protein, 11 aa, Mycobacterium
ARREEQTERYR

SEQ ID NO: 434451 - protein, 6 aa, Mycobacterium
ARREGA

SEQ ID NO: 434452 - protein, 7 aa, Mycobacterium
ARREGAP

SEQ ID NO: 434453 - protein, 9 aa, Mycobacterium
ARREGATRV

SEQ ID NO: 434454 - protein, 10 aa, Mycobacterium
ARREGGYGTT

SEQ ID NO: 434455 - protein, 10 aa, Mycobacterium
ARREHPTDDL

SEQ ID NO: 434456 - protein, 13 aa, Mycobacterium
ARREKRAPRFSDD

SEQ ID NO: 434457 - protein, 6 aa, Mycobacterium
ARREKT

SEQ ID NO: 434458 - protein, 30 aa, Mycobacterium
ARRELQATGETARKRTAGVDGEKLTAQETQ

SEQ ID NO: 434459 - protein, 8 aa, Mycobacterium
ARREPDGT

SEQ ID NO: 434460 - protein, 7 aa, Mycobacterium
ARREPGV

SEQ ID NO: 434461 - protein, 7 aa, Mycobacterium
ARREPVD

SEQ ID NO: 434462 - protein, 7 aa, Mycobacterium
ARRERGD

SEQ ID NO: 434463 - protein, 10 aa, Mycobacterium
ARRETTRSAA

SEQ ID NO: 434464 - protein, 6 aa, Mycobacterium
ARRGAG

SEQ ID NO: 434465 - protein, 12 aa, Mycobacterium
ARRGAGITGPGH

SEQ ID NO: 434466 - protein, 6 aa, Mycobacterium
ARRGAP

SEQ ID NO: 434467 - protein, 6 aa, Mycobacterium
ARRGAR

SEQ ID NO: 434468 - protein, 19 aa, Mycobacterium
ARRGARSTTALPLTPTPAL

SEQ ID NO: 434469 - protein, 18 aa, Mycobacterium
ARRGASAAHYESAGGEAT

SEQ ID NO: 434470 - protein, 18 aa, Mycobacterium
ARRGATAAHYERDGDRAA

SEQ ID NO: 434471 - protein, 9 aa, Mycobacterium
ARRGDDGRV

SEQ ID NO: 434472 - protein, 6 aa, Mycobacterium
ARRGDE

SEQ ID NO: 434473 - protein, 18 aa, Mycobacterium
ARRGDLSGLRSSDEIGGA

SEQ ID NO: 434474 - protein, 6 aa, Mycobacterium
ARRGDP

SEQ ID NO: 434475 - protein, 7 aa, Mycobacterium
ARRGDVE

SEQ ID NO: 434476 - protein, 12 aa, Mycobacterium
ARRGEGSVAATL

SEQ ID NO: 434477 - protein, 12 aa, Mycobacterium
ARRGEGSVAGTL

SEQ ID NO: 434478 - protein, 7 aa, Mycobacterium
ARRGELR

SEQ ID NO: 434479 - protein, 6 aa, Mycobacterium
ARRGES

SEQ ID NO: 434480 - protein, 6 aa, Mycobacterium
ARRGEV

SEQ ID NO: 434481 - protein, 10 aa, Mycobacterium
ARRGGEAPSW

SEQ ID NO: 434482 - protein, 11 aa, Mycobacterium
ARRGGQRRLGA

SEQ ID NO: 434483 - protein, 6 aa, Mycobacterium
ARRGIR

SEQ ID NO: 434484 - protein, 6 aa, Mycobacterium
ARRGLD

SEQ ID NO: 434485 - protein, 12 aa, Mycobacterium
ARRGLEQQEYPS

SEQ ID NO: 434486 - protein, 8 aa, Mycobacterium
ARRGLTPG

SEQ ID NO: 434487 - protein, 9 aa, Mycobacterium
ARRGNRKGV

SEQ ID NO: 434488 - protein, 9 aa, Mycobacterium
ARRGPANST

SEQ ID NO: 434489 - protein, 14 aa, Mycobacterium
ARRGPATDGLLGPT

SEQ ID NO: 434490 - protein, 9 aa, Mycobacterium
ARRGPGLVP

SEQ ID NO: 434491 - protein, 8 aa, Mycobacterium
ARRGPGRV

SEQ ID NO: 434492 - protein, 8 aa, Mycobacterium
ARRGPQPL

SEQ ID NO: 434493 - protein, 19 aa, Mycobacterium
ARRGQPPHRKSARTGKART

SEQ ID NO: 434494 - protein, 9 aa, Mycobacterium
ARRGQRGGR

SEQ ID NO: 434495 - protein, 5 aa, Mycobacterium
ARRGR

SEQ ID NO: 434496 - protein, 8 aa, Mycobacterium
ARRGRAAD

SEQ ID NO: 434497 - protein, 11 aa, Mycobacterium
ARRGRDIGGDR

SEQ ID NO: 434498 - protein, 6 aa, Mycobacterium
ARRGRH

SEQ ID NO: 434499 - protein, 6 aa, Mycobacterium
ARRGRL

SEQ ID NO: 434500 - protein, 11 aa, Mycobacterium
ARRGRRAPKAA

SEQ ID NO: 434501 - protein, 8 aa, Mycobacterium
ARRGSAGR

SEQ ID NO: 434502 - protein, 12 aa, Mycobacterium
ARRGSGSASRSV

SEQ ID NO: 434503 - protein, 10 aa, Mycobacterium
ARRGTDDPYR

SEQ ID NO: 434504 - protein, 8 aa, Mycobacterium
ARRGTDTL

SEQ ID NO: 434505 - protein, 20 aa, Mycobacterium
ARRGTGDLPRRGRRRRPGDR

SEQ ID NO: 434506 - protein, 8 aa, Mycobacterium
ARRGTKAA

SEQ ID NO: 434507 - protein, 6 aa, Mycobacterium
ARRGTP

SEQ ID NO: 434508 - protein, 7 aa, Mycobacterium
ARRGTTP

SEQ ID NO: 434509 - protein, 7 aa, Mycobacterium
ARRGVSP

SEQ ID NO: 434510 - protein, 13 aa, Mycobacterium
ARRGWQGAPANAV

SEQ ID NO: 434511 - protein, 5 aa, Mycobacterium
ARRGY

SEQ ID NO: 434512 - protein, 4 aa, Mycobacterium
ARRH

SEQ ID NO: 434513 - protein, 6 aa, Mycobacterium
ARRHGC

SEQ ID NO: 434514 - protein, 6 aa, Mycobacterium
ARRHPD

SEQ ID NO: 434515 - protein, 8 aa, Mycobacterium
ARRHPDNT

SEQ ID NO: 434516 - protein, 7 aa, Mycobacterium
ARRHPGD

SEQ ID NO: 434517 - protein, 5 aa, Mycobacterium
ARRIT

SEQ ID NO: 434518 - protein, 4 aa, Mycobacterium
ARRK

SEQ ID NO: 434519 - protein, 11 aa, Mycobacterium
ARRKASAAIRA

SEQ ID NO: 434520 - protein, 16 aa, Mycobacterium
ARRKEALTDWGPGEFE

SEQ ID NO: 434521 - protein, 7 aa, Mycobacterium
ARRKNTA

SEQ ID NO: 434522 - protein, 8 aa, Mycobacterium
ARRKRGLG

SEQ ID NO: 434523 - protein, 16 aa, Mycobacterium
ARRKRYGARPVDPQRH

SEQ ID NO: 434524 - protein, 6 aa, Mycobacterium
ARRLGT

SEQ ID NO: 434525 - protein, 8 aa, Mycobacterium
ARRLKQKT

SEQ ID NO: 434526 - protein, 17 aa, Mycobacterium
ARRNAAAARGERRFPTS

SEQ ID NO: 434527 - protein, 11 aa, Mycobacterium
ARRNAHDSTAQ

SEQ ID NO: 434528 - protein, 10 aa, Mycobacterium
ARRNGAADDP

SEQ ID NO: 434529 - protein, 10 aa, Mycobacterium
ARRNPGATSR

SEQ ID NO: 434530 - protein, 11 aa, Mycobacterium
ARRNPNAQTRA

SEQ ID NO: 434531 - protein, 11 aa, Mycobacterium
ARRNPNAQTRG

SEQ ID NO: 434532 - protein, 11 aa, Mycobacterium
ARRNPNAQTRT

SEQ ID NO: 434533 - protein, 6 aa, Mycobacterium
ARRNRY

SEQ ID NO: 434534 - protein, 20 aa, Mycobacterium
ARRNTLAAASQKTIEAKLIS

SEQ ID NO: 434535 - protein, 9 aa, Mycobacterium
ARRNTTHGL

SEQ ID NO: 434536 - protein, 5 aa, Mycobacterium
ARRPA

SEQ ID NO: 434537 - protein, 7 aa, Mycobacterium
ARRPAAE

SEQ ID NO: 434538 - protein, 14 aa, Mycobacterium
ARRPAESRPIDGDL

SEQ ID NO: 434539 - protein, 10 aa, Mycobacterium
ARRPAGVPDS

SEQ ID NO: 434540 - protein, 9 aa, Mycobacterium
ARRPDAPAI

SEQ ID NO: 434541 - protein, 6 aa, Mycobacterium
ARRPDG

SEQ ID NO: 434542 - protein, 9 aa, Mycobacterium
ARRPDRADT

SEQ ID NO: 434543 - protein, 9 aa, Mycobacterium
ARRPDRAET

SEQ ID NO: 434544 - protein, 8 aa, Mycobacterium
ARRPENAG

SEQ ID NO: 434545 - protein, 11 aa, Mycobacterium
ARRPETRPFGA

SEQ ID NO: 434546 - protein, 7 aa, Mycobacterium
ARRPGAP

SEQ ID NO: 434547 - protein, 10 aa, Mycobacterium
ARRPGGDADE

SEQ ID NO: 434548 - protein, 7 aa, Mycobacterium
ARRPGNI

SEQ ID NO: 434549 - protein, 7 aa, Mycobacterium
ARRPGNQ

SEQ ID NO: 434550 - protein, 7 aa, Mycobacterium
ARRPGRP

SEQ ID NO: 434551 - protein, 9 aa, Mycobacterium
ARRPGTAAE

SEQ ID NO: 434552 - protein, 6 aa, Mycobacterium
ARRPGW

SEQ ID NO: 434553 - protein, 8 aa, Mycobacterium
ARRPHGQH

SEQ ID NO: 434554 - protein, 7 aa, Mycobacterium
ARRPHPV

SEQ ID NO: 434555 - protein, 5 aa, Mycobacterium
ARRPI

SEQ ID NO: 434556 - protein, 5 aa, Mycobacterium
ARRPM

SEQ ID NO: 434557 - protein, 15 aa, Mycobacterium
ARRPMTGERDIRSED

SEQ ID NO: 434558 - protein, 9 aa, Mycobacterium
ARRPNGVQG

SEQ ID NO: 434559 - protein, 10 aa, Mycobacterium
ARRPPADGFA

SEQ ID NO: 434560 - protein, 13 aa, Mycobacterium
ARRPPGLDADAEV

SEQ ID NO: 434561 - protein, 6 aa, Mycobacterium
ARRPPR

SEQ ID NO: 434562 - protein, 37 aa, Mycobacterium
ARRPPSCATPSHRHRAGRPGSVERRTRRQRPCGRPRP

SEQ ID NO: 434563 - protein, 8 aa, Mycobacterium
ARRPQGRP

SEQ ID NO: 434564 - protein, 14 aa, Mycobacterium
ARRPSIDTEDTVTP

SEQ ID NO: 434565 - protein, 7 aa, Mycobacterium
ARRPTKF

SEQ ID NO: 434566 - protein, 7 aa, Mycobacterium
ARRPTSR

SEQ ID NO: 434567 - protein, 8 aa, Mycobacterium
ARRQARRD

SEQ ID NO: 434568 - protein, 8 aa, Mycobacterium
ARRQEDGW

SEQ ID NO: 434569 - protein, 12 aa, Mycobacterium
ARRQESNAPQFD

SEQ ID NO: 434570 - protein, 6 aa, Mycobacterium
ARRQGK

SEQ ID NO: 434571 - protein, 9 aa, Mycobacterium
ARRQGRADE

SEQ ID NO: 434572 - protein, 10 aa, Mycobacterium
ARRQLPRPER

SEQ ID NO: 434573 - protein, 5 aa, Mycobacterium
ARRQP

SEQ ID NO: 434574 - protein, 7 aa, Mycobacterium
ARRQPGA

SEQ ID NO: 434575 - protein, 13 aa, Mycobacterium
ARRQQSELPPRQR

SEQ ID NO: 434576 - protein, 10 aa, Mycobacterium
ARRQRGTGRQ

SEQ ID NO: 434577 - protein, 5 aa, Mycobacterium
ARRQS

SEQ ID NO: 434578 - protein, 10 aa, Mycobacterium
ARRQTTRSAA

SEQ ID NO: 434579 - protein, 6 aa, Mycobacterium
ARRQTV

SEQ ID NO: 434580 - protein, 7 aa, Mycobacterium
ARRQVED

SEQ ID NO: 434581 - protein, 6 aa, Mycobacterium
ARRRAA

SEQ ID NO: 434582 - protein, 6 aa, Mycobacterium
ARRRAD

SEQ ID NO: 434583 - protein, 6 aa, Mycobacterium
ARRRAE

SEQ ID NO: 434584 - protein, 9 aa, Mycobacterium
ARRRAGDAA

SEQ ID NO: 434585 - protein, 9 aa, Mycobacterium
ARRRAGDEA

SEQ ID NO: 434586 - protein, 10 aa, Mycobacterium
ARRRAGDPDA

SEQ ID NO: 434587 - protein, 9 aa, Mycobacterium
ARRRAGREL

SEQ ID NO: 434588 - protein, 19 aa, Mycobacterium
ARRRAGRGDHDGAYQDPEL

SEQ ID NO: 434589 - protein, 17 aa, Mycobacterium
ARRRAPDATEEPDRTAL

SEQ ID NO: 434590 - protein, 6 aa, Mycobacterium
ARRRAR

SEQ ID NO: 434591 - protein, 18 aa, Mycobacterium
ARRRARATRRRRAGRMAQ

SEQ ID NO: 434592 - protein, 5 aa, Mycobacterium
ARRRC

SEQ ID NO: 434593 - protein, 15 aa, Mycobacterium
ARRRDAAQAQPGPPA

SEQ ID NO: 434594 - protein, 8 aa, Mycobacterium
ARRRDDPL

SEQ ID NO: 434595 - protein, 10 aa, Mycobacterium
ARRRDGDPAA

SEQ ID NO: 434596 - protein, 14 aa, Mycobacterium
ARRRDGSAPPGPVR

SEQ ID NO: 434597 - protein, 11 aa, Mycobacterium
ARRRDPGLSEA

SEQ ID NO: 434598 - protein, 11 aa, Mycobacterium
ARRREKAEQQL

SEQ ID NO: 434599 - protein, 9 aa, Mycobacterium
ARRRESPRQ

SEQ ID NO: 434600 - protein, 5 aa, Mycobacterium
ARRRG

SEQ ID NO: 434601 - protein, 11 aa, Mycobacterium
ARRRGDKQRQA

SEQ ID NO: 434602 - protein, 16 aa, Mycobacterium
ARRRGELAEQADTAGA

SEQ ID NO: 434603 - protein, 20 aa, Mycobacterium
ARRRGGRRRLRPADYQPPLG

SEQ ID NO: 434604 - protein, 14 aa, Mycobacterium
ARRRGGTAPPGPLR

SEQ ID NO: 434605 - protein, 15 aa, Mycobacterium
ARRRGGTAPPGPLRP

SEQ ID NO: 434606 - protein, 14 aa, Mycobacterium
ARRRGTGGAGQDAG

SEQ ID NO: 434607 - protein, 9 aa, Mycobacterium
ARRRGTGSA

SEQ ID NO: 434608 - protein, 5 aa, Mycobacterium
ARRRI

SEQ ID NO: 434609 - protein, 17 aa, Mycobacterium
ARRRIERKRAMRRELEE

SEQ ID NO: 434610 - protein, 6 aa, Mycobacterium
ARRRKR

SEQ ID NO: 434611 - protein, 11 aa, Mycobacterium
ARRRNASGEST

SEQ ID NO: 434612 - protein, 10 aa, Mycobacterium
ARRRNPPAEL

SEQ ID NO: 434613 - protein, 6 aa, Mycobacterium
ARRRPD

SEQ ID NO: 434614 - protein, 6 aa, Mycobacterium
ARRRPS

SEQ ID NO: 434615 - protein, 6 aa, Mycobacterium
ARRRRA

SEQ ID NO: 434616 - protein, 8 aa, Mycobacterium
ARRRRGRG

SEQ ID NO: 434617 - protein, 6 aa, Mycobacterium
ARRRRP

SEQ ID NO: 434618 - protein, 6 aa, Mycobacterium
ARRRRS

SEQ ID NO: 434619 - protein, 14 aa, Mycobacterium
ARRRSCQELTALLH

SEQ ID NO: 434620 - protein, 10 aa, Mycobacterium
ARRRSVTAGA

SEQ ID NO: 434621 - protein, 10 aa, Mycobacterium
ARRRTPPAEL

SEQ ID NO: 434622 - protein, 8 aa, Mycobacterium
ARRRYQTG

SEQ ID NO: 434623 - protein, 12 aa, Mycobacterium
ARRSAAAPEESR

SEQ ID NO: 434624 - protein, 11 aa, Mycobacterium
ARRSAAGDGPP

SEQ ID NO: 434625 - protein, 14 aa, Mycobacterium
ARRSAEQGGDPRQT

SEQ ID NO: 434626 - protein, 13 aa, Mycobacterium
ARRSASRRAGKEW

SEQ ID NO: 434627 - protein, 6 aa, Mycobacterium
ARRSDA

SEQ ID NO: 434628 - protein, 13 aa, Mycobacterium
ARRSDASGADPRY

SEQ ID NO: 434629 - protein, 9 aa, Mycobacterium
ARRSDDIAH

SEQ ID NO: 434630 - protein, 7 aa, Mycobacterium
ARRSDPV

SEQ ID NO: 434631 - protein, 5 aa, Mycobacterium
ARRSE

SEQ ID NO: 434632 - protein, 18 aa, Mycobacterium
ARRSGAKPRPKSYVPRRI

SEQ ID NO: 434633 - protein, 25 aa, Mycobacterium
ARRSGASWSEIGSSMGVSKQAAQKR

SEQ ID NO: 434634 - protein, 10 aa, Mycobacterium
ARRSGDAGAL

SEQ ID NO: 434635 - protein, 10 aa, Mycobacterium
ARRSGDSGAI

SEQ ID NO: 434636 - protein, 15 aa, Mycobacterium
ARRSGRRFSMRRGVR

SEQ ID NO: 434637 - protein, 9 aa, Mycobacterium
ARRSGSGKT

SEQ ID NO: 434638 - protein, 11 aa, Mycobacterium
ARRSGSRRRFD

SEQ ID NO: 434639 - protein, 12 aa, Mycobacterium
ARRSGTKCVKVG

SEQ ID NO: 434640 - protein, 19 aa, Mycobacterium
ARRSKGRRRFSPADYQPGL

SEQ ID NO: 434641 - protein, 10 aa, Mycobacterium
ARRSNPEDDL

SEQ ID NO: 434642 - protein, 9 aa, Mycobacterium
ARRSPNESF

SEQ ID NO: 434643 - protein, 18 aa, Mycobacterium
ARRSRDVPEVRSTHAGGG

SEQ ID NO: 434644 - protein, 6 aa, Mycobacterium
ARRSRL

SEQ ID NO: 434645 - protein, 6 aa, Mycobacterium
ARRSTK

SEQ ID NO: 434646 - protein, 6 aa, Mycobacterium
ARRSTW

SEQ ID NO: 434647 - protein, 8 aa, Mycobacterium
ARRSTYPL

SEQ ID NO: 434648 - protein, 14 aa, Mycobacterium
ARRSYYKGEQPTAE

SEQ ID NO: 434649 - protein, 7 aa, Mycobacterium
ARRTDDI

SEQ ID NO: 434650 - protein, 8 aa, Mycobacterium
ARRTGGGA

SEQ ID NO: 434651 - protein, 9 aa, Mycobacterium
ARRTGTTAT

SEQ ID NO: 434652 - protein, 5 aa, Mycobacterium
ARRTL

SEQ ID NO: 434653 - protein, 19 aa, Mycobacterium
ARRTPANQAHCTSARDNPL

SEQ ID NO: 434654 - protein, 10 aa, Mycobacterium
ARRTPGGQRI

SEQ ID NO: 434655 - protein, 14 aa, Mycobacterium
ARRTPSNQAHVTNQ

SEQ ID NO: 434656 - protein, 5 aa, Mycobacterium
ARRTS

SEQ ID NO: 434657 - protein, 8 aa, Mycobacterium
ARRTTGGT

SEQ ID NO: 434658 - protein, 16 aa, Mycobacterium
ARRVDGAREAVSGPIN

SEQ ID NO: 434659 - protein, 13 aa, Mycobacterium
ARRVGSNKELSKA

SEQ ID NO: 434660 - protein, 15 aa, Mycobacterium
ARRVPGHVKGDGRHT

SEQ ID NO: 434661 - protein, 6 aa, Mycobacterium
ARRVPR

SEQ ID NO: 434662 - protein, 6 aa, Mycobacterium
ARRVTD

SEQ ID NO: 434663 - protein, 4 aa, Mycobacterium
ARRY

SEQ ID NO: 434664 - protein, 5 aa, Mycobacterium
ARRYG

SEQ ID NO: 434665 - protein, 14 aa, Mycobacterium
ARRYGPPERAPKAY

SEQ ID NO: 434666 - protein, 6 aa, Mycobacterium
ARRYRT

SEQ ID NO: 434667 - protein, 10 aa, Mycobacterium
ARRYSERAGK

SEQ ID NO: 434668 - protein, 10 aa, Mycobacterium
ARRYTGDGSV

SEQ ID NO: 434669 - protein, 20 aa, Mycobacterium
ARSAAAAALESRAAGGGLGE

SEQ ID NO: 434670 - protein, 28 aa, Mycobacterium
ARSAAAAALESRAAGGGLGEYYSESETR

SEQ ID NO: 434671 - protein, 6 aa, Mycobacterium
ARSAAD

SEQ ID NO: 434672 - protein, 14 aa, Mycobacterium
ARSAAIDRGTGATR

SEQ ID NO: 434673 - protein, 8 aa, Mycobacterium
ARSAAQEA

SEQ ID NO: 434674 - protein, 11 aa, Mycobacterium
ARSAARQSRRA

SEQ ID NO: 434675 - protein, 7 aa, Mycobacterium
ARSADQA

SEQ ID NO: 434676 - protein, 10 aa, Mycobacterium
ARSADRPAGT

SEQ ID NO: 434677 - protein, 10 aa, Mycobacterium
ARSAEESGGR

SEQ ID NO: 434678 - protein, 11 aa, Mycobacterium
ARSAEPGDREA

SEQ ID NO: 434679 - protein, 6 aa, Mycobacterium
ARSAET

SEQ ID NO: 434680 - protein, 18 aa, Mycobacterium
ARSAFDTGPWPTAEPAER

SEQ ID NO: 434681 - protein, 36 aa, Mycobacterium
ARSAGAAGSAAAVGAAAGSAGACGPAVPAGAASATF

SEQ ID NO: 434682 - protein, 8 aa, Mycobacterium
ARSAGKKL

SEQ ID NO: 434683 - protein, 6 aa, Mycobacterium
ARSAGR

SEQ ID NO: 434684 - protein, 10 aa, Mycobacterium
ARSAGRAPGW

SEQ ID NO: 434685 - protein, 22 aa, Mycobacterium
ARSAGYESTPARDETAAGQPGR

SEQ ID NO: 434686 - protein, 7 aa, Mycobacterium
ARSAGYP

SEQ ID NO: 434687 - protein, 5 aa, Mycobacterium
ARSAL

SEQ ID NO: 434688 - protein, 6 aa, Mycobacterium
ARSAPG

SEQ ID NO: 434689 - protein, 9 aa, Mycobacterium
ARSAPGGQR

SEQ ID NO: 434690 - protein, 19 aa, Mycobacterium
ARSAPNSKPPSTPSTKNWP

SEQ ID NO: 434691 - protein, 29 aa, Mycobacterium
ARSARGNRGHPPAAAPRRSRTVAPLSGAD

SEQ ID NO: 434692 - protein, 10 aa, Mycobacterium
ARSASPERIA

SEQ ID NO: 434693 - protein, 7 aa, Mycobacterium
ARSASSR

SEQ ID NO: 434694 - protein, 7 aa, Mycobacterium
ARSATAP

SEQ ID NO: 434695 - protein, 5 aa, Mycobacterium
ARSAW

SEQ ID NO: 434696 - protein, 4 aa, Mycobacterium
ARSC

SEQ ID NO: 434697 - protein, 10 aa, Mycobacterium
ARSDAAEARR

SEQ ID NO: 434698 - protein, 9 aa, Mycobacterium
ARSDDGTSI

SEQ ID NO: 434699 - protein, 7 aa, Mycobacterium
ARSDDHT

SEQ ID NO: 434700 - protein, 8 aa, Mycobacterium
ARSDDLAD

SEQ ID NO: 434701 - protein, 9 aa, Mycobacterium
ARSDDTDDR

SEQ ID NO: 434702 - protein, 9 aa, Mycobacterium
ARSDEADIE

SEQ ID NO: 434703 - protein, 10 aa, Mycobacterium
ARSDEHDAAA

SEQ ID NO: 434704 - protein, 7 aa, Mycobacterium
ARSDEIH

SEQ ID NO: 434705 - protein, 11 aa, Mycobacterium
ARSDPDFTDRG

SEQ ID NO: 434706 - protein, 6 aa, Mycobacterium
ARSDRI

SEQ ID NO: 434707 - protein, 6 aa, Mycobacterium
ARSDYK

SEQ ID NO: 434708 - protein, 13 aa, Mycobacterium
ARSEAAEAEDARA

SEQ ID NO: 434709 - protein, 6 aa, Mycobacterium
ARSEAD

SEQ ID NO: 434710 - protein, 12 aa, Mycobacterium
ARSEAEGGGPNV

SEQ ID NO: 434711 - protein, 6 aa, Mycobacterium
ARSEDF

SEQ ID NO: 434712 - protein, 6 aa, Mycobacterium
ARSEEA

SEQ ID NO: 434713 - protein, 23 aa, Mycobacterium
ARSEEPGSGMNRAARRASGARGR

SEQ ID NO: 434714 - protein, 13 aa, Mycobacterium
ARSEFGEDGVEPI

SEQ ID NO: 434715 - protein, 7 aa, Mycobacterium
ARSEGKK

SEQ ID NO: 434716 - protein, 41 aa, Mycobacterium
ARSEGRLGGDGGPGGTGHDGGVPGGGGGAGGAGGAGGHGGL

SEQ ID NO: 434717 - protein, 8 aa, Mycobacterium
ARSEPPNV

SEQ ID NO: 434718 - protein, 5 aa, Mycobacterium
ARSER

SEQ ID NO: 434719 - protein, 14 aa, Mycobacterium
ARSERPGKLPGTID

SEQ ID NO: 434720 - protein, 7 aa, Mycobacterium
ARSERRF

SEQ ID NO: 434721 - protein, 11 aa, Mycobacterium
ARSERSTGTRE

SEQ ID NO: 434722 - protein, 7 aa, Mycobacterium
ARSESEG

SEQ ID NO: 434723 - protein, 10 aa, Mycobacterium
ARSESGRGFE

SEQ ID NO: 434724 - protein, 13 aa, Mycobacterium
ARSETAGAGDPVS

SEQ ID NO: 434725 - protein, 5 aa, Mycobacterium
ARSEW

SEQ ID NO: 434726 - protein, 13 aa, Mycobacterium
ARSGADGSAVDAQ

SEQ ID NO: 434727 - protein, 6 aa, Mycobacterium
ARSGAK

SEQ ID NO: 434728 - protein, 12 aa, Mycobacterium
ARSGAPVHEWPL

SEQ ID NO: 434729 - protein, 10 aa, Mycobacterium
ARSGDDSIGE

SEQ ID NO: 434730 - protein, 11 aa, Mycobacterium
ARSGDKGGNAN

SEQ ID NO: 434731 - protein, 11 aa, Mycobacterium
ARSGDKGGSAY

SEQ ID NO: 434732 - protein, 7 aa, Mycobacterium
ARSGDLD

SEQ ID NO: 434733 - protein, 7 aa, Mycobacterium
ARSGDPD

SEQ ID NO: 434734 - protein, 6 aa, Mycobacterium
ARSGEA

SEQ ID NO: 434735 - protein, 24 aa, Mycobacterium
ARSGEGSPCGRPPVAAAPVTSSVT

SEQ ID NO: 434736 - protein, 6 aa, Mycobacterium
ARSGER

SEQ ID NO: 434737 - protein, 9 aa, Mycobacterium
ARSGESEDV

SEQ ID NO: 434738 - protein, 7 aa, Mycobacterium
ARSGESV

SEQ ID NO: 434739 - protein, 8 aa, Mycobacterium
ARSGETGK

SEQ ID NO: 434740 - protein, 8 aa, Mycobacterium
ARSGETIG

SEQ ID NO: 434741 - protein, 6 aa, Mycobacterium
ARSGFG

SEQ ID NO: 434742 - protein, 6 aa, Mycobacterium
ARSGGR

SEQ ID NO: 434743 - protein, 24 aa, Mycobacterium
ARSGGRINTDALDNSAGVDCSDRE

SEQ ID NO: 434744 - protein, 8 aa, Mycobacterium
ARSGGRLG

SEQ ID NO: 434745 - protein, 10 aa, Mycobacterium
ARSGKFSSDR

SEQ ID NO: 434746 - protein, 11 aa, Mycobacterium
ARSGKFSSDRA

SEQ ID NO: 434747 - protein, 9 aa, Mycobacterium
ARSGKTKLS

SEQ ID NO: 434748 - protein, 8 aa, Mycobacterium
ARSGLRTD

SEQ ID NO: 434749 - protein, 9 aa, Mycobacterium
ARSGLRTDP

SEQ ID NO: 434750 - protein, 7 aa, Mycobacterium
ARSGLSR

SEQ ID NO: 434751 - protein, 9 aa, Mycobacterium
ARSGLSTDA

SEQ ID NO: 434752 - protein, 6 aa, Mycobacterium
ARSGLT

SEQ ID NO: 434753 - protein, 8 aa, Mycobacterium
ARSGNGPG

SEQ ID NO: 434754 - protein, 8 aa, Mycobacterium
ARSGPARA

SEQ ID NO: 434755 - protein, 6 aa, Mycobacterium
ARSGPD

SEQ ID NO: 434756 - protein, 9 aa, Mycobacterium
ARSGPGGKR

SEQ ID NO: 434757 - protein, 8 aa, Mycobacterium
ARSGPSAV

SEQ ID NO: 434758 - protein, 10 aa, Mycobacterium
ARSGQLKGTV

SEQ ID NO: 434759 - protein, 8 aa, Mycobacterium
ARSGQTKL

SEQ ID NO: 434760 - protein, 21 aa, Mycobacterium
ARSGRAEGARHEPRRGQGGAL

SEQ ID NO: 434761 - protein, 9 aa, Mycobacterium
ARSGRAHEQ

SEQ ID NO: 434762 - protein, 18 aa, Mycobacterium
ARSGRDEDFKRGESAYDR

SEQ ID NO: 434763 - protein, 8 aa, Mycobacterium
ARSGRDVT

SEQ ID NO: 434764 - protein, 9 aa, Mycobacterium
ARSGRQHEQ

SEQ ID NO: 434765 - protein, 9 aa, Mycobacterium
ARSGRTFDE

SEQ ID NO: 434766 - protein, 7 aa, Mycobacterium
ARSGSAL

SEQ ID NO: 434767 - protein, 6 aa, Mycobacterium
ARSGSD

SEQ ID NO: 434768 - protein, 8 aa, Mycobacterium
ARSGTDIN

SEQ ID NO: 434769 - protein, 6 aa, Mycobacterium
ARSGTS

SEQ ID NO: 434770 - protein, 8 aa, Mycobacterium
ARSHSNSL

SEQ ID NO: 434771 - protein, 17 aa, Mycobacterium
ARSIGAAEAATAAGITP

SEQ ID NO: 434772 - protein, 6 aa, Mycobacterium
ARSINP

SEQ ID NO: 434773 - protein, 10 aa, Mycobacterium
ARSKAARKVW

SEQ ID NO: 434774 - protein, 7 aa, Mycobacterium
ARSKADK

SEQ ID NO: 434775 - protein, 11 aa, Mycobacterium
ARSKDQTQSDI

SEQ ID NO: 434776 - protein, 5 aa, Mycobacterium
ARSKG

SEQ ID NO: 434777 - protein, 8 aa, Mycobacterium
ARSKGGNA

SEQ ID NO: 434778 - protein, 21 aa, Mycobacterium
ARSKGIDPVTGTRYSANDPAS

SEQ ID NO: 434779 - protein, 6 aa, Mycobacterium
ARSKSG

SEQ ID NO: 434780 - protein, 10 aa, Mycobacterium
ARSKSGALIG

SEQ ID NO: 434781 - protein, 10 aa, Mycobacterium
ARSKSGTLVG

SEQ ID NO: 434782 - protein, 4 aa, Mycobacterium
ARSL

SEQ ID NO: 434783 - protein, 6 aa, Mycobacterium
ARSLDD

SEQ ID NO: 434784 - protein, 12 aa, Mycobacterium
ARSLGKDPQPGE

SEQ ID NO: 434785 - protein, 6 aa, Mycobacterium
ARSLGT

SEQ ID NO: 434786 - protein, 14 aa, Mycobacterium
ARSLGTTEGPQPFS

SEQ ID NO: 434787 - protein, 15 aa, Mycobacterium
ARSLHTNEEIAEAEE

SEQ ID NO: 434788 - protein, 7 aa, Mycobacterium
ARSMGAP

SEQ ID NO: 434789 - protein, 14 aa, Mycobacterium
ARSMRTDEEIAEAE

SEQ ID NO: 434790 - protein, 4 aa, Mycobacterium
ARSN

SEQ ID NO: 434791 - protein, 7 aa, Mycobacterium
ARSNAAQ

SEQ ID NO: 434792 - protein, 6 aa, Mycobacterium
ARSNPD

SEQ ID NO: 434793 - protein, 13 aa, Mycobacterium
ARSPACPLGTDPA

SEQ ID NO: 434794 - protein, 6 aa, Mycobacterium
ARSPDA

SEQ ID NO: 434795 - protein, 15 aa, Mycobacterium
ARSPEAEALTGEDAD

SEQ ID NO: 434796 - protein, 7 aa, Mycobacterium
ARSPHSR

SEQ ID NO: 434797 - protein, 7 aa, Mycobacterium
ARSPIGR

SEQ ID NO: 434798 - protein, 7 aa, Mycobacterium
ARSPLGA

SEQ ID NO: 434799 - protein, 6 aa, Mycobacterium
ARSPQA

SEQ ID NO: 434800 - protein, 10 aa, Mycobacterium
ARSPQKVGQD

SEQ ID NO: 434801 - protein, 9 aa, Mycobacterium
ARSPRELSS

SEQ ID NO: 434802 - protein, 6 aa, Mycobacterium
ARSPRG

SEQ ID NO: 434803 - protein, 7 aa, Mycobacterium
ARSPSEH

SEQ ID NO: 434804 - protein, 5 aa, Mycobacterium
ARSPT

SEQ ID NO: 434805 - protein, 11 aa, Mycobacterium
ARSPYQRPPLS

SEQ ID NO: 434806 - protein, 14 aa, Mycobacterium
ARSQAAAAAAGAPV

SEQ ID NO: 434807 - protein, 7 aa, Mycobacterium
ARSQAPI

SEQ ID NO: 434808 - protein, 8 aa, Mycobacterium
ARSQGRKL

SEQ ID NO: 434809 - protein, 6 aa, Mycobacterium
ARSQLD

SEQ ID NO: 434810 - protein, 7 aa, Mycobacterium
ARSQLGT

SEQ ID NO: 434811 - protein, 7 aa, Mycobacterium
ARSQPGA

SEQ ID NO: 434812 - protein, 15 aa, Mycobacterium
ARSQRNDSEKPAKSI

SEQ ID NO: 434813 - protein, 8 aa, Mycobacterium
ARSQSDWR

SEQ ID NO: 434814 - protein, 7 aa, Mycobacterium
ARSQTGI

SEQ ID NO: 434815 - protein, 7 aa, Mycobacterium
ARSQTMS

SEQ ID NO: 434816 - protein, 13 aa, Mycobacterium
ARSQVSGADESTM

SEQ ID NO: 434817 - protein, 6 aa, Mycobacterium
ARSRAR

SEQ ID NO: 434818 - protein, 21 aa, Mycobacterium
ARSRAYATEGVNAAARANRAR

SEQ ID NO: 434819 - protein, 5 aa, Mycobacterium
ARSRE

SEQ ID NO: 434820 - protein, 12 aa, Mycobacterium
ARSREPGTSEDG

SEQ ID NO: 434821 - protein, 9 aa, Mycobacterium
ARSRESAKS

SEQ ID NO: 434822 - protein, 5 aa, Mycobacterium
ARSRG

SEQ ID NO: 434823 - protein, 7 aa, Mycobacterium
ARSRGIA

SEQ ID NO: 434824 - protein, 7 aa, Mycobacterium
ARSRGKL

SEQ ID NO: 434825 - protein, 6 aa, Mycobacterium
ARSRGR

SEQ ID NO: 434826 - protein, 5 aa, Mycobacterium
ARSRP

SEQ ID NO: 434827 - protein, 7 aa, Mycobacterium
ARSRQQA

SEQ ID NO: 434828 - protein, 15 aa, Mycobacterium
ARSRRGAAIGHGQRE

SEQ ID NO: 434829 - protein, 15 aa, Mycobacterium
ARSRRGADAEGGTGE

SEQ ID NO: 434830 - protein, 7 aa, Mycobacterium
ARSRRGE

SEQ ID NO: 434831 - protein, 10 aa, Mycobacterium
ARSSAGLSAQ

SEQ ID NO: 434832 - protein, 14 aa, Mycobacterium
ARSSDSMEISCRTA

SEQ ID NO: 434833 - protein, 6 aa, Mycobacterium
ARSSEV

SEQ ID NO: 434834 - protein, 6 aa, Mycobacterium
ARSSGC

SEQ ID NO: 434835 - protein, 8 aa, Mycobacterium
ARSSHTTV

SEQ ID NO: 434836 - protein, 7 aa, Mycobacterium
ARSSLQA

SEQ ID NO: 434837 - protein, 6 aa, Mycobacterium
ARSSQL

SEQ ID NO: 434838 - protein, 7 aa, Mycobacterium
ARSSRPY

SEQ ID NO: 434839 - protein, 8 aa, Mycobacterium
ARSSRTTI

SEQ ID NO: 434840 - protein, 18 aa, Mycobacterium
ARSSTKALAASPDQPLVE

SEQ ID NO: 434841 - protein, 4 aa, Mycobacterium
ARST

SEQ ID NO: 434842 - protein, 5 aa, Mycobacterium
ARSTA

SEQ ID NO: 434843 - protein, 9 aa, Mycobacterium
ARSTAGGYR

SEQ ID NO: 434844 - protein, 15 aa, Mycobacterium
ARSTDPSSDDPDYSR

SEQ ID NO: 434845 - protein, 10 aa, Mycobacterium
ARSTGAPSGS

SEQ ID NO: 434846 - protein, 13 aa, Mycobacterium
ARSTGDDAEDARG

SEQ ID NO: 434847 - protein, 20 aa, Mycobacterium
ARSTGDGSAGASPAPADGPL

SEQ ID NO: 434848 - protein, 9 aa, Mycobacterium
ARSTGRQAI

SEQ ID NO: 434849 - protein, 5 aa, Mycobacterium
ARSTL

SEQ ID NO: 434850 - protein, 8 aa, Mycobacterium
ARSTSGER

SEQ ID NO: 434851 - protein, 8 aa, Mycobacterium
ARSTTGAA

SEQ ID NO: 434852 - protein, 6 aa, Mycobacterium
ARSTTT

SEQ ID NO: 434853 - protein, 5 aa, Mycobacterium
ARSTY

SEQ ID NO: 434854 - protein, 15 aa, Mycobacterium
ARSVEGAGPGPEGNI

SEQ ID NO: 434855 - protein, 13 aa, Mycobacterium
ARSVPAENGTLAD

SEQ ID NO: 434856 - protein, 24 aa, Mycobacterium
ARSVPTGAAGSAGSLGRGNVPRGP

SEQ ID NO: 434857 - protein, 4 aa, Mycobacterium
ARSW

SEQ ID NO: 434858 - protein, 5 aa, Mycobacterium
ARSWA

SEQ ID NO: 434859 - protein, 12 aa, Mycobacterium
ARSYRDGNKTAR

SEQ ID NO: 434860 - protein, 13 aa, Mycobacterium
ARSYTSAERHDRD

SEQ ID NO: 434861 - protein, 6 aa, Mycobacterium
ARTAAE

SEQ ID NO: 434862 - protein, 9 aa, Mycobacterium
ARTAARDSA

SEQ ID NO: 434863 - protein, 15 aa, Mycobacterium
ARTAARLGEARAHGD

SEQ ID NO: 434864 - protein, 15 aa, Mycobacterium
ARTAASLASSQQIQD

SEQ ID NO: 434865 - protein, 6 aa, Mycobacterium
ARTAAT

SEQ ID NO: 434866 - protein, 7 aa, Mycobacterium
ARTAATV

SEQ ID NO: 434867 - protein, 15 aa, Mycobacterium
ARTACGGQPAGPDLQ

SEQ ID NO: 434868 - protein, 11 aa, Mycobacterium
ARTADAEGDPL

SEQ ID NO: 434869 - protein, 7 aa, Mycobacterium
ARTADAR

SEQ ID NO: 434870 - protein, 8 aa, Mycobacterium
ARTADGGA

SEQ ID NO: 434871 - protein, 9 aa, Mycobacterium
ARTAEDNGF

SEQ ID NO: 434872 - protein, 7 aa, Mycobacterium
ARTAEEV

SEQ ID NO: 434873 - protein, 6 aa, Mycobacterium
ARTAEQ

SEQ ID NO: 434874 - protein, 5 aa, Mycobacterium
ARTAF

SEQ ID NO: 434875 - protein, 5 aa, Mycobacterium
ARTAG

SEQ ID NO: 434876 - protein, 17 aa, Mycobacterium
ARTAGAAAAAANKSVKS

SEQ ID NO: 434877 - protein, 7 aa, Mycobacterium
ARTAGAE

SEQ ID NO: 434878 - protein, 10 aa, Mycobacterium
ARTAGGAATG

SEQ ID NO: 434879 - protein, 6 aa, Mycobacterium
ARTAGH

SEQ ID NO: 434880 - protein, 8 aa, Mycobacterium
ARTAGSRV

SEQ ID NO: 434881 - protein, 14 aa, Mycobacterium
ARTAKRGGKILFTF

SEQ ID NO: 434882 - protein, 18 aa, Mycobacterium
ARTAQGRTLREVSDSARV

SEQ ID NO: 434883 - protein, 5 aa, Mycobacterium
ARTAR

SEQ ID NO: 434884 - protein, 11 aa, Mycobacterium
ARTARDEGDYI

SEQ ID NO: 434885 - protein, 6 aa, Mycobacterium
ARTARG

SEQ ID NO: 434886 - protein, 10 aa, Mycobacterium
ARTARGEDDV

SEQ ID NO: 434887 - protein, 7 aa, Mycobacterium
ARTARRD

SEQ ID NO: 434888 - protein, 11 aa, Mycobacterium
ARTARSPQRAY

SEQ ID NO: 434889 - protein, 8 aa, Mycobacterium
ARTARVSD

SEQ ID NO: 434890 - protein, 12 aa, Mycobacterium
ARTASESAGRQL

SEQ ID NO: 434891 - protein, 7 aa, Mycobacterium
ARTASRQ

SEQ ID NO: 434892 - protein, 5 aa, Mycobacterium
ARTAT

SEQ ID NO: 434893 - protein, 9 aa, Mycobacterium
ARTATDAER

SEQ ID NO: 434894 - protein, 17 aa, Mycobacterium
ARTATPAPPSASGPATH

SEQ ID NO: 434895 - protein, 9 aa, Mycobacterium
ARTATRDVT

SEQ ID NO: 434896 - protein, 5 aa, Mycobacterium
ARTAV

SEQ ID NO: 434897 - protein, 4 aa, Mycobacterium
ARTD

SEQ ID NO: 434898 - protein, 6 aa, Mycobacterium
ARTDAA

SEQ ID NO: 434899 - protein, 9 aa, Mycobacterium
ARTDADLAE

SEQ ID NO: 434900 - protein, 19 aa, Mycobacterium
ARTDAERLRDEDVSTEPDA

SEQ ID NO: 434901 - protein, 10 aa, Mycobacterium
ARTDALRRTA

SEQ ID NO: 434902 - protein, 8 aa, Mycobacterium
ARTDAPVS

SEQ ID NO: 434903 - protein, 6 aa, Mycobacterium
ARTDAS

SEQ ID NO: 434904 - protein, 6 aa, Mycobacterium
ARTDDA

SEQ ID NO: 434905 - protein, 6 aa, Mycobacterium
ARTDDL

SEQ ID NO: 434906 - protein, 6 aa, Mycobacterium
ARTDDN

SEQ ID NO: 434907 - protein, 7 aa, Mycobacterium
ARTDEDV

SEQ ID NO: 434908 - protein, 9 aa, Mycobacterium
ARTDEPSRT

SEQ ID NO: 434909 - protein, 5 aa, Mycobacterium
ARTDG

SEQ ID NO: 434910 - protein, 7 aa, Mycobacterium
ARTDGEG

SEQ ID NO: 434911 - protein, 9 aa, Mycobacterium
ARTDLSPET

SEQ ID NO: 434912 - protein, 16 aa, Mycobacterium
ARTDPGGEAAPRTPKI

SEQ ID NO: 434913 - protein, 11 aa, Mycobacterium
ARTDPRANIDQ

SEQ ID NO: 434914 - protein, 8 aa, Mycobacterium
ARTDRKSL

SEQ ID NO: 434915 - protein, 8 aa, Mycobacterium
ARTDSLRR

SEQ ID NO: 434916 - protein, 7 aa, Mycobacterium
ARTDTAD

SEQ ID NO: 434917 - protein, 7 aa, Mycobacterium
ARTDTDR

SEQ ID NO: 434918 - protein, 5 aa, Mycobacterium
ARTDW

SEQ ID NO: 434919 - protein, 4 aa, Mycobacterium
ARTE

SEQ ID NO: 434920 - protein, 6 aa, Mycobacterium
ARTEAD

SEQ ID NO: 434921 - protein, 10 aa, Mycobacterium
ARTEADAEDL

SEQ ID NO: 434922 - protein, 10 aa, Mycobacterium
ARTEALDPTV

SEQ ID NO: 434923 - protein, 10 aa, Mycobacterium
ARTEAQTAYD

SEQ ID NO: 434924 - protein, 13 aa, Mycobacterium
ARTEATDQPDRER

SEQ ID NO: 434925 - protein, 11 aa, Mycobacterium
ARTEDSTDLKA

SEQ ID NO: 434926 - protein, 5 aa, Mycobacterium
ARTEE

SEQ ID NO: 434927 - protein, 11 aa, Mycobacterium
ARTEEERNTAL

SEQ ID NO: 434928 - protein, 6 aa, Mycobacterium
ARTEEV

SEQ ID NO: 434929 - protein, 12 aa, Mycobacterium
ARTEGGAGGTVR

SEQ ID NO: 434930 - protein, 13 aa, Mycobacterium
ARTEGTDPHPVRD

SEQ ID NO: 434931 - protein, 13 aa, Mycobacterium
ARTEHSDPHPVRD

SEQ ID NO: 434932 - protein, 13 aa, Mycobacterium
ARTEHTDPHPVRD

SEQ ID NO: 434933 - protein, 12 aa, Mycobacterium
ARTELCGEKSAD

SEQ ID NO: 434934 - protein, 10 aa, Mycobacterium
ARTEPETAAE

SEQ ID NO: 434935 - protein, 11 aa, Mycobacterium
ARTEPLEEGGR

SEQ ID NO: 434936 - protein, 13 aa, Mycobacterium
ARTEQEGRLPGTI

SEQ ID NO: 434937 - protein, 5 aa, Mycobacterium
ARTER

SEQ ID NO: 434938 - protein, 7 aa, Mycobacterium
ARTERGD

SEQ ID NO: 434939 - protein, 7 aa, Mycobacterium
ARTERGE

SEQ ID NO: 434940 - protein, 7 aa, Mycobacterium
ARTESGW

SEQ ID NO: 434941 - protein, 8 aa, Mycobacterium
ARTESRGC

SEQ ID NO: 434942 - protein, 13 aa, Mycobacterium
ARTFGDPVGPEDL

SEQ ID NO: 434943 - protein, 13 aa, Mycobacterium
ARTFTEEPRNMDD

SEQ ID NO: 434944 - protein, 5 aa, Mycobacterium
ARTGA

SEQ ID NO: 434945 - protein, 17 aa, Mycobacterium
ARTGAALATGAALPDDL

SEQ ID NO: 434946 - protein, 14 aa, Mycobacterium
ARTGAEAMASADAL

SEQ ID NO: 434947 - protein, 10 aa, Mycobacterium
ARTGAGGDLT

SEQ ID NO: 434948 - protein, 7 aa, Mycobacterium
ARTGAKG

SEQ ID NO: 434949 - protein, 9 aa, Mycobacterium
ARTGDADAL

SEQ ID NO: 434950 - protein, 15 aa, Mycobacterium
ARTGDGAATARNAPV

SEQ ID NO: 434951 - protein, 6 aa, Mycobacterium
ARTGDR

SEQ ID NO: 434952 - protein, 5 aa, Mycobacterium
ARTGE

SEQ ID NO: 434953 - protein, 7 aa, Mycobacterium
ARTGEAI

SEQ ID NO: 434954 - protein, 7 aa, Mycobacterium
ARTGEFR

SEQ ID NO: 434955 - protein, 7 aa, Mycobacterium
ARTGEGM

SEQ ID NO: 434956 - protein, 6 aa, Mycobacterium
ARTGEL

SEQ ID NO: 434957 - protein, 8 aa, Mycobacterium
ARTGELGT

SEQ ID NO: 434958 - protein, 8 aa, Mycobacterium
ARTGFTGS

SEQ ID NO: 434959 - protein, 9 aa, Mycobacterium
ARTGFTGST

SEQ ID NO: 434960 - protein, 13 aa, Mycobacterium
ARTGGAGENGSGD

SEQ ID NO: 434961 - protein, 8 aa, Mycobacterium
ARTGGAIE

SEQ ID NO: 434962 - protein, 8 aa, Mycobacterium
ARTGGDIK

SEQ ID NO: 434963 - protein, 14 aa, Mycobacterium
ARTGGGDPGGNPTL

SEQ ID NO: 434964 - protein, 10 aa, Mycobacterium
ARTGGPGAAG

SEQ ID NO: 434965 - protein, 10 aa, Mycobacterium
ARTGGPGAGG

SEQ ID NO: 434966 - protein, 8 aa, Mycobacterium
ARTGGVAG

SEQ ID NO: 434967 - protein, 19 aa, Mycobacterium
ARTGHNPGSTPYGKHAARN

SEQ ID NO: 434968 - protein, 8 aa, Mycobacterium
ARTGIGAT

SEQ ID NO: 434969 - protein, 5 aa, Mycobacterium
ARTGL

SEQ ID NO: 434970 - protein, 20 aa, Mycobacterium
ARTGLPVSPADNDNASALRR

SEQ ID NO: 434971 - protein, 8 aa, Mycobacterium
ARTGLQAG

SEQ ID NO: 434972 - protein, 11 aa, Mycobacterium
ARTGLTDPAAL

SEQ ID NO: 434973 - protein, 6 aa, Mycobacterium
ARTGNH

SEQ ID NO: 434974 - protein, 9 aa, Mycobacterium
ARTGNPTRA

SEQ ID NO: 434975 - protein, 10 aa, Mycobacterium
ARTGPNLAER

SEQ ID NO: 434976 - protein, 11 aa, Mycobacterium
ARTGQAGPDSV

SEQ ID NO: 434977 - protein, 6 aa, Mycobacterium
ARTGQI

SEQ ID NO: 434978 - protein, 8 aa, Mycobacterium
ARTGQQTD

SEQ ID NO: 434979 - protein, 9 aa, Mycobacterium
ARTGRTATV

SEQ ID NO: 434980 - protein, 12 aa, Mycobacterium
ARTGRTSSLQPR

SEQ ID NO: 434981 - protein, 14 aa, Mycobacterium
ARTGRVAYSASKAA

SEQ ID NO: 434982 - protein, 13 aa, Mycobacterium
ARTGSGAGSENHA

SEQ ID NO: 434983 - protein, 13 aa, Mycobacterium
ARTGSKVRRRRKT

SEQ ID NO: 434984 - protein, 10 aa, Mycobacterium
ARTGSVDDGW

SEQ ID NO: 434985 - protein, 7 aa, Mycobacterium
ARTGTDQ

SEQ ID NO: 434986 - protein, 6 aa, Mycobacterium
ARTGTG

SEQ ID NO: 434987 - protein, 8 aa, Mycobacterium
ARTGTGQL

SEQ ID NO: 434988 - protein, 13 aa, Mycobacterium
ARTGTVPDSHTPL

SEQ ID NO: 434989 - protein, 5 aa, Mycobacterium
ARTGV

SEQ ID NO: 434990 - protein, 7 aa, Mycobacterium
ARTGVDP

SEQ ID NO: 434991 - protein, 10 aa, Mycobacterium
ARTHDDRHAP

SEQ ID NO: 434992 - protein, 9 aa, Mycobacterium
ARTHPGEPV

SEQ ID NO: 434993 - protein, 6 aa, Mycobacterium
ARTIEA

SEQ ID NO: 434994 - protein, 8 aa, Mycobacterium
ARTKETDL

SEQ ID NO: 434995 - protein, 13 aa, Mycobacterium
ARTKETDLSVPTR

SEQ ID NO: 434996 - protein, 8 aa, Mycobacterium
ARTKGKSV

SEQ ID NO: 434997 - protein, 11 aa, Mycobacterium
ARTKPDSPEYR

SEQ ID NO: 434998 - protein, 4 aa, Mycobacterium
ARTL

SEQ ID NO: 434999 - protein, 6 aa, Mycobacterium
ARTLRA

SEQ ID NO: 435000 - protein, 5 aa, Mycobacterium
ARTLT

SEQ ID NO: 435001 - protein, 7 aa, Mycobacterium
ARTLTDA

SEQ ID NO: 435002 - protein, 4 aa, Mycobacterium
ARTN

SEQ ID NO: 435003 - protein, 30 aa, Mycobacterium
ARTNDPPDAQEPSNGPPPASRWSRRKPEAA

SEQ ID NO: 435004 - protein, 6 aa, Mycobacterium
ARTNEL

SEQ ID NO: 435005 - protein, 7 aa, Mycobacterium
ARTNRTN

SEQ ID NO: 435006 - protein, 11 aa, Mycobacterium
ARTNTDPKGIE

SEQ ID NO: 435007 - protein, 6 aa, Mycobacterium
ARTNVK

SEQ ID NO: 435008 - protein, 7 aa, Mycobacterium
ARTPAAL

SEQ ID NO: 435009 - protein, 6 aa, Mycobacterium
ARTPAE

SEQ ID NO: 435010 - protein, 8 aa, Mycobacterium
ARTPAQLE

SEQ ID NO: 435011 - protein, 5 aa, Mycobacterium
ARTPD

SEQ ID NO: 435012 - protein, 7 aa, Mycobacterium
ARTPDAA

SEQ ID NO: 435013 - protein, 10 aa, Mycobacterium
ARTPDAPALG

SEQ ID NO: 435014 - protein, 7 aa, Mycobacterium
ARTPDEL

SEQ ID NO: 435015 - protein, 7 aa, Mycobacterium
ARTPDFG

SEQ ID NO: 435016 - protein, 15 aa, Mycobacterium
ARTPDTPDGALGPLT

SEQ ID NO: 435017 - protein, 15 aa, Mycobacterium
ARTPDTPEGALGPLT

SEQ ID NO: 435018 - protein, 6 aa, Mycobacterium
ARTPEA

SEQ ID NO: 435019 - protein, 6 aa, Mycobacterium
ARTPED

SEQ ID NO: 435020 - protein, 6 aa, Mycobacterium
ARTPEP

SEQ ID NO: 435021 - protein, 6 aa, Mycobacterium
ARTPEW

SEQ ID NO: 435022 - protein, 7 aa, Mycobacterium
ARTPEWQ

SEQ ID NO: 435023 - protein, 5 aa, Mycobacterium
ARTPF

SEQ ID NO: 435024 - protein, 14 aa, Mycobacterium
ARTPGDANAPYTDG

SEQ ID NO: 435025 - protein, 11 aa, Mycobacterium
ARTPGGADGQL

SEQ ID NO: 435026 - protein, 7 aa, Mycobacterium
ARTPGIG

SEQ ID NO: 435027 - protein, 7 aa, Mycobacterium
ARTPGVM

SEQ ID NO: 435028 - protein, 13 aa, Mycobacterium
ARTPHAPAVTTSE

SEQ ID NO: 435029 - protein, 15 aa, Mycobacterium
ARTPKDAWRSSRPSW

SEQ ID NO: 435030 - protein, 5 aa, Mycobacterium
ARTPN

SEQ ID NO: 435031 - protein, 6 aa, Mycobacterium
ARTPQA

SEQ ID NO: 435032 - protein, 8 aa, Mycobacterium
ARTPQPPE

SEQ ID NO: 435033 - protein, 5 aa, Mycobacterium
ARTPR

SEQ ID NO: 435034 - protein, 7 aa, Mycobacterium
ARTPRAV

SEQ ID NO: 435035 - protein, 9 aa, Mycobacterium
ARTPREQAT

SEQ ID NO: 435036 - protein, 8 aa, Mycobacterium
ARTPRERL

SEQ ID NO: 435037 - protein, 6 aa, Mycobacterium
ARTPRR

SEQ ID NO: 435038 - protein, 7 aa, Mycobacterium
ARTPTAL

SEQ ID NO: 435039 - protein, 8 aa, Mycobacterium
ARTPTATA

SEQ ID NO: 435040 - protein, 13 aa, Mycobacterium
ARTPTRGGKGSLR

SEQ ID NO: 435041 - protein, 13 aa, Mycobacterium
ARTPTSNGSDEYT

SEQ ID NO: 435042 - protein, 13 aa, Mycobacterium
ARTPYEPGTPWPD

SEQ ID NO: 435043 - protein, 4 aa, Mycobacterium
ARTQ

SEQ ID NO: 435044 - protein, 7 aa, Mycobacterium
ARTQAAG

SEQ ID NO: 435045 - protein, 8 aa, Mycobacterium
ARTQFGQP

SEQ ID NO: 435046 - protein, 5 aa, Mycobacterium
ARTQK

SEQ ID NO: 435047 - protein, 18 aa, Mycobacterium
ARTQPTAAAPPAKPDLPA

SEQ ID NO: 435048 - protein, 14 aa, Mycobacterium
ARTQTTSDATPQIA

SEQ ID NO: 435049 - protein, 7 aa, Mycobacterium
ARTRAEL

SEQ ID NO: 435050 - protein, 7 aa, Mycobacterium
ARTRAPL

SEQ ID NO: 435051 - protein, 9 aa, Mycobacterium
ARTRARAPH

SEQ ID NO: 435052 - protein, 8 aa, Mycobacterium
ARTRASLP

SEQ ID NO: 435053 - protein, 11 aa, Mycobacterium
ARTRDLTDKPF

SEQ ID NO: 435054 - protein, 7 aa, Mycobacterium
ARTRDRR

SEQ ID NO: 435055 - protein, 5 aa, Mycobacterium
ARTRE

SEQ ID NO: 435056 - protein, 6 aa, Mycobacterium
ARTREA

SEQ ID NO: 435057 - protein, 6 aa, Mycobacterium
ARTREQ

SEQ ID NO: 435058 - protein, 7 aa, Mycobacterium
ARTREQF

SEQ ID NO: 435059 - protein, 6 aa, Mycobacterium
ARTRES

SEQ ID NO: 435060 - protein, 20 aa, Mycobacterium
ARTRETPRPRADHSRKTGGP

SEQ ID NO: 435061 - protein, 5 aa, Mycobacterium
ARTRG

SEQ ID NO: 435062 - protein, 12 aa, Mycobacterium
ARTRGANGEEGK

SEQ ID NO: 435063 - protein, 10 aa, Mycobacterium
ARTRGRSTRA

SEQ ID NO: 435064 - protein, 5 aa, Mycobacterium
ARTRL

SEQ ID NO: 435065 - protein, 5 aa, Mycobacterium
ARTRN

SEQ ID NO: 435066 - protein, 7 aa, Mycobacterium
ARTRNDP

SEQ ID NO: 435067 - protein, 7 aa, Mycobacterium
ARTRPDS

SEQ ID NO: 435068 - protein, 9 aa, Mycobacterium
ARTRPGDRV

SEQ ID NO: 435069 - protein, 8 aa, Mycobacterium
ARTRRDGR

SEQ ID NO: 435070 - protein, 8 aa, Mycobacterium
ARTRREGR

SEQ ID NO: 435071 - protein, 8 aa, Mycobacterium
ARTRSNAP

SEQ ID NO: 435072 - protein, 10 aa, Mycobacterium
ARTRSQANTP

SEQ ID NO: 435073 - protein, 7 aa, Mycobacterium
ARTRTAE

SEQ ID NO: 435074 - protein, 5 aa, Mycobacterium
ARTSA

SEQ ID NO: 435075 - protein, 12 aa, Mycobacterium
ARTSADSHAGHR

SEQ ID NO: 435076 - protein, 6 aa, Mycobacterium
ARTSAE

SEQ ID NO: 435077 - protein, 6 aa, Mycobacterium
ARTSDE

SEQ ID NO: 435078 - protein, 6 aa, Mycobacterium
ARTSET

SEQ ID NO: 435079 - protein, 6 aa, Mycobacterium
ARTSGL

SEQ ID NO: 435080 - protein, 8 aa, Mycobacterium
ARTSIKAA

SEQ ID NO: 435081 - protein, 8 aa, Mycobacterium
ARTSPERA

SEQ ID NO: 435082 - protein, 8 aa, Mycobacterium
ARTSPQRA

SEQ ID NO: 435083 - protein, 6 aa, Mycobacterium
ARTSRR

SEQ ID NO: 435084 - protein, 7 aa, Mycobacterium
ARTSYAE

SEQ ID NO: 435085 - protein, 14 aa, Mycobacterium
ARTTDAADYPHATE

SEQ ID NO: 435086 - protein, 7 aa, Mycobacterium
ARTTEDV

SEQ ID NO: 435087 - protein, 11 aa, Mycobacterium
ARTTEEDRSRT

SEQ ID NO: 435088 - protein, 7 aa, Mycobacterium
ARTTEEV

SEQ ID NO: 435089 - protein, 14 aa, Mycobacterium
ARTTERKTKQATER

SEQ ID NO: 435090 - protein, 113 aa, Mycobacterium
ARTTGAASTTGAEYPGSTTTTTDPTGIGARTTKTTGPTIGEGQDARATARTTGTANTQSADTTRATNTTGAKQPRAPTSPASTPVKGPDAPGTTSTTATDQPSPSPTSPTHGT

SEQ ID NO: 435091 - protein, 9 aa, Mycobacterium
ARTTGRAAE

SEQ ID NO: 435092 - protein, 6 aa, Mycobacterium
ARTTGT

SEQ ID NO: 435093 - protein, 10 aa, Mycobacterium
ARTTPRGHGT

SEQ ID NO: 435094 - protein, 6 aa, Mycobacterium
ARTTRR

SEQ ID NO: 435095 - protein, 7 aa, Mycobacterium
ARTTSPH

SEQ ID NO: 435096 - protein, 6 aa, Mycobacterium
ARTTST

SEQ ID NO: 435097 - protein, 11 aa, Mycobacterium
ARTTTDSAFDR

SEQ ID NO: 435098 - protein, 11 aa, Mycobacterium
ARTTTESAFDR

SEQ ID NO: 435099 - protein, 6 aa, Mycobacterium
ARTTTP

SEQ ID NO: 435100 - protein, 7 aa, Mycobacterium
ARTTTPH

SEQ ID NO: 435101 - protein, 8 aa, Mycobacterium
ARTTTRDV

SEQ ID NO: 435102 - protein, 4 aa, Mycobacterium
ARTV

SEQ ID NO: 435103 - protein, 11 aa, Mycobacterium
ARTVDKEPRWR

SEQ ID NO: 435104 - protein, 5 aa, Mycobacterium
ARTVR

SEQ ID NO: 435105 - protein, 5 aa, Mycobacterium
ARTVS

SEQ ID NO: 435106 - protein, 5 aa, Mycobacterium
ARTYP

SEQ ID NO: 435107 - protein, 9 aa, Mycobacterium
ARTYSGDDA

SEQ ID NO: 435108 - protein, 8 aa, Mycobacterium
ARTYTDGA

SEQ ID NO: 435109 - protein, 13 aa, Mycobacterium
ARVADGVDPDLAP

SEQ ID NO: 435110 - protein, 14 aa, Mycobacterium
ARVAGPSVNAPADV

SEQ ID NO: 435111 - protein, 14 aa, Mycobacterium
ARVAPGKLTGRAGS

SEQ ID NO: 435112 - protein, 10 aa, Mycobacterium
ARVASNKVSR

SEQ ID NO: 435113 - protein, 4 aa, Mycobacterium
ARVD

SEQ ID NO: 435114 - protein, 6 aa, Mycobacterium
ARVDET

SEQ ID NO: 435115 - protein, 6 aa, Mycobacterium
ARVDPE

SEQ ID NO: 435116 - protein, 12 aa, Mycobacterium
ARVDPKASSLRA

SEQ ID NO: 435117 - protein, 7 aa, Mycobacterium
ARVDTDG

SEQ ID NO: 435118 - protein, 4 aa, Mycobacterium
ARVE

SEQ ID NO: 435119 - protein, 9 aa, Mycobacterium
ARVEATPAR

SEQ ID NO: 435120 - protein, 4 aa, Mycobacterium
ARVG

SEQ ID NO: 435121 - protein, 16 aa, Mycobacterium
ARVGAKADEQIRKGAA

SEQ ID NO: 435122 - protein, 6 aa, Mycobacterium
ARVGDG

SEQ ID NO: 435123 - protein, 9 aa, Mycobacterium
ARVGDSSWG

SEQ ID NO: 435124 - protein, 6 aa, Mycobacterium
ARVGEP

SEQ ID NO: 435125 - protein, 13 aa, Mycobacterium
ARVGGQTSRQGTA

SEQ ID NO: 435126 - protein, 7 aa, Mycobacterium
ARVGPRQ

SEQ ID NO: 435127 - protein, 44 aa, Mycobacterium
ARVGRAGRRRAGEEGQGSARHGGGDQPGDDSAAPGRAASGHGNS

SEQ ID NO: 435128 - protein, 6 aa, Mycobacterium
ARVGRG

SEQ ID NO: 435129 - protein, 10 aa, Mycobacterium
ARVKGGTTVP

SEQ ID NO: 435130 - protein, 6 aa, Mycobacterium
ARVKPA

SEQ ID NO: 435131 - protein, 4 aa, Mycobacterium
ARVN

SEQ ID NO: 435132 - protein, 4 aa, Mycobacterium
ARVP

SEQ ID NO: 435133 - protein, 5 aa, Mycobacterium
ARVPA

SEQ ID NO: 435134 - protein, 6 aa, Mycobacterium
ARVPDG

SEQ ID NO: 435135 - protein, 13 aa, Mycobacterium
ARVPGSHITDDGH

SEQ ID NO: 435136 - protein, 16 aa, Mycobacterium
ARVPQNHVSRDGTPLG

SEQ ID NO: 435137 - protein, 11 aa, Mycobacterium
ARVPSGTIPAG

SEQ ID NO: 435138 - protein, 23 aa, Mycobacterium
ARVPSPGRRRGYRQTTGPSDQTL

SEQ ID NO: 435139 - protein, 5 aa, Mycobacterium
ARVPT

SEQ ID NO: 435140 - protein, 10 aa, Mycobacterium
ARVQGPLTNG

SEQ ID NO: 435141 - protein, 14 aa, Mycobacterium
ARVQSGESAPLGAS

SEQ ID NO: 435142 - protein, 4 aa, Mycobacterium
ARVR

SEQ ID NO: 435143 - protein, 10 aa, Mycobacterium
ARVRAGSDAV

SEQ ID NO: 435144 - protein, 13 aa, Mycobacterium
ARVRGAGAEAAAA

SEQ ID NO: 435145 - protein, 8 aa, Mycobacterium
ARVRGRPD

SEQ ID NO: 435146 - protein, 8 aa, Mycobacterium
ARVRGRPE

SEQ ID NO: 435147 - protein, 8 aa, Mycobacterium
ARVRNDGT

SEQ ID NO: 435148 - protein, 9 aa, Mycobacterium
ARVSGGDAL

SEQ ID NO: 435149 - protein, 13 aa, Mycobacterium
ARVSGVRTPRARR

SEQ ID NO: 435150 - protein, 13 aa, Mycobacterium
ARVSPGSPDGQRS

SEQ ID NO: 435151 - protein, 8 aa, Mycobacterium
ARVSSRRR

SEQ ID NO: 435152 - protein, 4 aa, Mycobacterium
ARVT

SEQ ID NO: 435153 - protein, 8 aa, Mycobacterium
ARVTERRV

SEQ ID NO: 435154 - protein, 6 aa, Mycobacterium
ARVTGR

SEQ ID NO: 435155 - protein, 23 aa, Mycobacterium
ARVTGRNVASEAKAPYDPQRADR

SEQ ID NO: 435156 - protein, 5 aa, Mycobacterium
ARVTP

SEQ ID NO: 435157 - protein, 5 aa, Mycobacterium
ARVTR

SEQ ID NO: 435158 - protein, 19 aa, Mycobacterium
ARVTRGDAYPSGGAGMYGT

SEQ ID NO: 435159 - protein, 9 aa, Mycobacterium
ARVTTDEDI

SEQ ID NO: 435160 - protein, 13 aa, Mycobacterium
ARWADGGGDGHYV

SEQ ID NO: 435161 - protein, 5 aa, Mycobacterium
ARWAG

SEQ ID NO: 435162 - protein, 11 aa, Mycobacterium
ARWAPSAGEPM

SEQ ID NO: 435163 - protein, 5 aa, Mycobacterium
ARWDE

SEQ ID NO: 435164 - protein, 6 aa, Mycobacterium
ARWGDP

SEQ ID NO: 435165 - protein, 8 aa, Mycobacterium
ARWGDPVP

SEQ ID NO: 435166 - protein, 12 aa, Mycobacterium
ARWGSRSGNQTL

SEQ ID NO: 435167 - protein, 4 aa, Mycobacterium
ARWP

SEQ ID NO: 435168 - protein, 8 aa, Mycobacterium
ARWPQGEP

SEQ ID NO: 435169 - protein, 14 aa, Mycobacterium
ARWRDSAGEEHEAR

SEQ ID NO: 435170 - protein, 13 aa, Mycobacterium
ARWRGRPKNQDAY

SEQ ID NO: 435171 - protein, 9 aa, Mycobacterium
ARWRTAGDR

SEQ ID NO: 435172 - protein, 4 aa, Mycobacterium
ARWS

SEQ ID NO: 435173 - protein, 10 aa, Mycobacterium
ARWSDDPVRV

SEQ ID NO: 435174 - protein, 11 aa, Mycobacterium
ARWTDASREIS

SEQ ID NO: 435175 - protein, 11 aa, Mycobacterium
ARWTPSPEQIA

SEQ ID NO: 435176 - protein, 14 aa, Mycobacterium
ARYAARGGGPEQLR

SEQ ID NO: 435177 - protein, 13 aa, Mycobacterium
ARYAKPARRRSAA

SEQ ID NO: 435178 - protein, 5 aa, Mycobacterium
ARYAR

SEQ ID NO: 435179 - protein, 7 aa, Mycobacterium
ARYASTF

SEQ ID NO: 435180 - protein, 4 aa, Mycobacterium
ARYD

SEQ ID NO: 435181 - protein, 6 aa, Mycobacterium
ARYDEA

SEQ ID NO: 435182 - protein, 12 aa, Mycobacterium
ARYDKTPNQGVG

SEQ ID NO: 435183 - protein, 10 aa, Mycobacterium
ARYDPAHSPR

SEQ ID NO: 435184 - protein, 5 aa, Mycobacterium
ARYEG

SEQ ID NO: 435185 - protein, 5 aa, Mycobacterium
ARYGE

SEQ ID NO: 435186 - protein, 8 aa, Mycobacterium
ARYGGQQA

SEQ ID NO: 435187 - protein, 5 aa, Mycobacterium
ARYGQ

SEQ ID NO: 435188 - protein, 8 aa, Mycobacterium
ARYGRAGS

SEQ ID NO: 435189 - protein, 8 aa, Mycobacterium
ARYGRENS

SEQ ID NO: 435190 - protein, 4 aa, Mycobacterium
ARYN

SEQ ID NO: 435191 - protein, 5 aa, Mycobacterium
ARYPD

SEQ ID NO: 435192 - protein, 11 aa, Mycobacterium
ARYPDGTTPEV

SEQ ID NO: 435193 - protein, 11 aa, Mycobacterium
ARYPGDGPGVQ

SEQ ID NO: 435194 - protein, 10 aa, Mycobacterium
ARYPGSARTE

SEQ ID NO: 435195 - protein, 6 aa, Mycobacterium
ARYPQA

SEQ ID NO: 435196 - protein, 4 aa, Mycobacterium
ARYR

SEQ ID NO: 435197 - protein, 30 aa, Mycobacterium
ARYRDSGWPCERDGDAVTAPYSAQSAGPPP

SEQ ID NO: 435198 - protein, 7 aa, Mycobacterium
ARYRDTA

SEQ ID NO: 435199 - protein, 13 aa, Mycobacterium
ARYRPQPAARTAA

SEQ ID NO: 435200 - protein, 6 aa, Mycobacterium
ARYRRT

SEQ ID NO: 435201 - protein, 4 aa, Mycobacterium
ARYS

SEQ ID NO: 435202 - protein, 8 aa, Mycobacterium
ARYSEDGQ

SEQ ID NO: 435203 - protein, 5 aa, Mycobacterium
ARYSP

SEQ ID NO: 435204 - protein, 6 aa, Mycobacterium
ARYSSF

SEQ ID NO: 435205 - protein, 4 aa, Mycobacterium
ARYT

SEQ ID NO: 435206 - protein, 5 aa, Mycobacterium
ARYTA

SEQ ID NO: 435207 - protein, 6 aa, Mycobacterium
ARYTDK

SEQ ID NO: 435208 - protein, 6 aa, Mycobacterium
ARYTDQ

SEQ ID NO: 435209 - protein, 9 aa, Mycobacterium
ARYTGEQPI

SEQ ID NO: 435210 - protein, 20 aa, Mycobacterium
ARYTGEQPIPLAPAQRPSEL

SEQ ID NO: 435211 - protein, 9 aa, Mycobacterium
ARYTGSTVA

SEQ ID NO: 435212 - protein, 6 aa, Mycobacterium
ARYTGT

SEQ ID NO: 435213 - protein, 6 aa, Mycobacterium
ARYTQS

SEQ ID NO: 435214 - protein, 54 aa, Mycobacterium
ASAAAAKLSPLTSPAPTNNPGGLGAQAAAVSQAAATGAQTSGLQQTVTNAPNAV

SEQ ID NO: 435215 - protein, 7 aa, Mycobacterium
ASAAAAL

SEQ ID NO: 435216 - protein, 13 aa, Mycobacterium
ASAAADTPPLALT

SEQ ID NO: 435217 - protein, 9 aa, Mycobacterium
ASAAAEARK

SEQ ID NO: 435218 - protein, 7 aa, Mycobacterium
ASAAAKT

SEQ ID NO: 435219 - protein, 10 aa, Mycobacterium
ASAAAQISEL

SEQ ID NO: 435220 - protein, 8 aa, Mycobacterium
ASAAASAL

SEQ ID NO: 435221 - protein, 8 aa, Mycobacterium
ASAAASIA

SEQ ID NO: 435222 - protein, 9 aa, Mycobacterium
ASAAASRLT

SEQ ID NO: 435223 - protein, 5 aa, Mycobacterium
ASAAD

SEQ ID NO: 435224 - protein, 6 aa, Mycobacterium
ASAADE

SEQ ID NO: 435225 - protein, 10 aa, Mycobacterium
ASAADGVAPV

SEQ ID NO: 435226 - protein, 18 aa, Mycobacterium
ASAADHRDLGPGTHNPVS

SEQ ID NO: 435227 - protein, 7 aa, Mycobacterium
ASAADLD

SEQ ID NO: 435228 - protein, 9 aa, Mycobacterium
ASAADRDRV

SEQ ID NO: 435229 - protein, 8 aa, Mycobacterium
ASAADSIT

SEQ ID NO: 435230 - protein, 6 aa, Mycobacterium
ASAADV

SEQ ID NO: 435231 - protein, 7 aa, Mycobacterium
ASAADVR

SEQ ID NO: 435232 - protein, 5 aa, Mycobacterium
ASAAE

SEQ ID NO: 435233 - protein, 8 aa, Mycobacterium
ASAAEAEK

SEQ ID NO: 435234 - protein, 10 aa, Mycobacterium
ASAAEAQKGW

SEQ ID NO: 435235 - protein, 6 aa, Mycobacterium
ASAAEE

SEQ ID NO: 435236 - protein, 7 aa, Mycobacterium
ASAAEGA

SEQ ID NO: 435237 - protein, 19 aa, Mycobacterium
ASAAEPGEAGRHPSGPVGA

SEQ ID NO: 435238 - protein, 28 aa, Mycobacterium
ASAAGAELNRGVGTLDDPKAKDDPAGAA

SEQ ID NO: 435239 - protein, 9 aa, Mycobacterium
ASAAGDAGL

SEQ ID NO: 435240 - protein, 7 aa, Mycobacterium
ASAAGEV

SEQ ID NO: 435241 - protein, 8 aa, Mycobacterium
ASAAGEVA

SEQ ID NO: 435242 - protein, 13 aa, Mycobacterium
ASAAGGRHPGTGA

SEQ ID NO: 435243 - protein, 6 aa, Mycobacterium
ASAAGI

SEQ ID NO: 435244 - protein, 8 aa, Mycobacterium
ASAAGKRV

SEQ ID NO: 435245 - protein, 17 aa, Mycobacterium
ASAAGLATNVAAGSSAG

SEQ ID NO: 435246 - protein, 9 aa, Mycobacterium
ASAAGMSGS

SEQ ID NO: 435247 - protein, 11 aa, Mycobacterium
ASAAGPAGRPT

SEQ ID NO: 435248 - protein, 7 aa, Mycobacterium
ASAAGQT

SEQ ID NO: 435249 - protein, 9 aa, Mycobacterium
ASAAGTDAA

SEQ ID NO: 435250 - protein, 7 aa, Mycobacterium
ASAAGTG

SEQ ID NO: 435251 - protein, 5 aa, Mycobacterium
ASAAK

SEQ ID NO: 435252 - protein, 9 aa, Mycobacterium
ASAAKLADE

SEQ ID NO: 435253 - protein, 28 aa, Mycobacterium
ASAAKPGAAGRRIDSAAVKSDGLTELPA

SEQ ID NO: 435254 - protein, 7 aa, Mycobacterium
ASAALGT

SEQ ID NO: 435255 - protein, 9 aa, Mycobacterium
ASAANAAAA

SEQ ID NO: 435256 - protein, 9 aa, Mycobacterium
ASAANGIGV

SEQ ID NO: 435257 - protein, 5 aa, Mycobacterium
ASAAP

SEQ ID NO: 435258 - protein, 20 aa, Mycobacterium
ASAAPDEPGHGPGEKYTGPV

SEQ ID NO: 435259 - protein, 20 aa, Mycobacterium
ASAAPDEPGQGPGEKYTGPV

SEQ ID NO: 435260 - protein, 9 aa, Mycobacterium
ASAAPGGAS

SEQ ID NO: 435261 - protein, 6 aa, Mycobacterium
ASAAPN

SEQ ID NO: 435262 - protein, 12 aa, Mycobacterium
ASAAPPGEAGRR

SEQ ID NO: 435263 - protein, 8 aa, Mycobacterium
ASAAPVGG

SEQ ID NO: 435264 - protein, 67 aa, Mycobacterium
ASAAQPGEAGRRNKSAPIASAAQPGEAGRRNKSAPIASAAQPGEAGRRNKSAPIASAAQPGEAGRRN

SEQ ID NO: 435265 - protein, 12 aa, Mycobacterium
ASAAQPGRQGGE

SEQ ID NO: 435266 - protein, 7 aa, Mycobacterium
ASAAQQQ

SEQ ID NO: 435267 - protein, 6 aa, Mycobacterium
ASAAQR

SEQ ID NO: 435268 - protein, 8 aa, Mycobacterium
ASAAQRAE

SEQ ID NO: 435269 - protein, 9 aa, Mycobacterium
ASAARHDQL

SEQ ID NO: 435270 - protein, 21 aa, Mycobacterium
ASAARQARLANPDTGARSESI

SEQ ID NO: 435271 - protein, 8 aa, Mycobacterium
ASAASAAI

SEQ ID NO: 435272 - protein, 10 aa, Mycobacterium
ASAASAALSR

SEQ ID NO: 435273 - protein, 20 aa, Mycobacterium
ASAASDEHRGRPGAGAPGAN

SEQ ID NO: 435274 - protein, 13 aa, Mycobacterium
ASAASDIRNSKLL

SEQ ID NO: 435275 - protein, 8 aa, Mycobacterium
ASAASEVD

SEQ ID NO: 435276 - protein, 8 aa, Mycobacterium
ASAASGYE

SEQ ID NO: 435277 - protein, 17 aa, Mycobacterium
ASAASPAAMYSPPPAAL

SEQ ID NO: 435278 - protein, 8 aa, Mycobacterium
ASAASSIA

SEQ ID NO: 435279 - protein, 14 aa, Mycobacterium
ASAASVDERSDGGW

SEQ ID NO: 435280 - protein, 7 aa, Mycobacterium
ASAATAD

SEQ ID NO: 435281 - protein, 70 aa, Mycobacterium
ASAATATGGAGGAGGDGNDGGNAGVGGAASTRGTGNVTGGTGGDGGTGSTGIGGSGGDGGNVEVNNDAST

SEQ ID NO: 435282 - protein, 13 aa, Mycobacterium
ASAATISAGTPPY

SEQ ID NO: 435283 - protein, 6 aa, Mycobacterium
ASAATR

SEQ ID NO: 435284 - protein, 19 aa, Mycobacterium
ASAATSSVRESQRQQSLTT

SEQ ID NO: 435285 - protein, 5 aa, Mycobacterium
ASAAV

SEQ ID NO: 435286 - protein, 6 aa, Mycobacterium
ASAAVA

SEQ ID NO: 435287 - protein, 6 aa, Mycobacterium
ASADAA

SEQ ID NO: 435288 - protein, 8 aa, Mycobacterium
ASADAEEK

SEQ ID NO: 435289 - protein, 11 aa, Mycobacterium
ASADASTANAT

SEQ ID NO: 435290 - protein, 10 aa, Mycobacterium
ASADATLTGT

SEQ ID NO: 435291 - protein, 6 aa, Mycobacterium
ASADDR

SEQ ID NO: 435292 - protein, 14 aa, Mycobacterium
ASADDSSVTAARDE

SEQ ID NO: 435293 - protein, 11 aa, Mycobacterium
ASADEAARALQ

SEQ ID NO: 435294 - protein, 9 aa, Mycobacterium
ASADEADQK

SEQ ID NO: 435295 - protein, 7 aa, Mycobacterium
ASADENP

SEQ ID NO: 435296 - protein, 8 aa, Mycobacterium
ASADENPD

SEQ ID NO: 435297 - protein, 18 aa, Mycobacterium
ASADFDKEAADLNDEKLR

SEQ ID NO: 435298 - protein, 10 aa, Mycobacterium
ASADGDGAYI

SEQ ID NO: 435299 - protein, 11 aa, Mycobacterium
ASADGELSPVQ

SEQ ID NO: 435300 - protein, 8 aa, Mycobacterium
ASADGGKW

SEQ ID NO: 435301 - protein, 8 aa, Mycobacterium
ASADGRGP

SEQ ID NO: 435302 - protein, 7 aa, Mycobacterium
ASADGRR

SEQ ID NO: 435303 - protein, 11 aa, Mycobacterium
ASADGTGFGEG

SEQ ID NO: 435304 - protein, 8 aa, Mycobacterium
ASADGTLV

SEQ ID NO: 435305 - protein, 15 aa, Mycobacterium
ASADGVEVTAQQPLD

SEQ ID NO: 435306 - protein, 8 aa, Mycobacterium
ASADIGHQ

SEQ ID NO: 435307 - protein, 10 aa, Mycobacterium
ASADKIGKDA

SEQ ID NO: 435308 - protein, 6 aa, Mycobacterium
ASADNL

SEQ ID NO: 435309 - protein, 6 aa, Mycobacterium
ASADPA

SEQ ID NO: 435310 - protein, 7 aa, Mycobacterium
ASADPER

SEQ ID NO: 435311 - protein, 12 aa, Mycobacterium
ASADPGGRPWSE

SEQ ID NO: 435312 - protein, 28 aa, Mycobacterium
ASADPGLRSTRTEIGATPANNASKTGKN

SEQ ID NO: 435313 - protein, 12 aa, Mycobacterium
ASADPQGRPWSE

SEQ ID NO: 435314 - protein, 12 aa, Mycobacterium
ASADPRGRPWSE

SEQ ID NO: 435315 - protein, 7 aa, Mycobacterium
ASADPSI

SEQ ID NO: 435316 - protein, 10 aa, Mycobacterium
ASADQHTQTN

SEQ ID NO: 435317 - protein, 6 aa, Mycobacterium
ASADQV

SEQ ID NO: 435318 - protein, 5 aa, Mycobacterium
ASADR

SEQ ID NO: 435319 - protein, 14 aa, Mycobacterium
ASADRCARGGLPRR

SEQ ID NO: 435320 - protein, 10 aa, Mycobacterium
ASADRNPPVF

SEQ ID NO: 435321 - protein, 6 aa, Mycobacterium
ASADRQ

SEQ ID NO: 435322 - protein, 17 aa, Mycobacterium
ASADRYADAELYAAARI

SEQ ID NO: 435323 - protein, 19 aa, Mycobacterium
ASADSAAAAARHETAAAAY

SEQ ID NO: 435324 - protein, 19 aa, Mycobacterium
ASADSAGAAAQQEVAATAY

SEQ ID NO: 435325 - protein, 11 aa, Mycobacterium
ASADSATMAAQ

SEQ ID NO: 435326 - protein, 12 aa, Mycobacterium
ASADSDVGYRER

SEQ ID NO: 435327 - protein, 7 aa, Mycobacterium
ASADTAR

SEQ ID NO: 435328 - protein, 10 aa, Mycobacterium
ASADTASNAA

SEQ ID NO: 435329 - protein, 13 aa, Mycobacterium
ASADTATAATRHE

SEQ ID NO: 435330 - protein, 9 aa, Mycobacterium
ASADTGLPI

SEQ ID NO: 435331 - protein, 7 aa, Mycobacterium
ASAEAGA

SEQ ID NO: 435332 - protein, 7 aa, Mycobacterium
ASAEALT

SEQ ID NO: 435333 - protein, 7 aa, Mycobacterium
ASAEASE

SEQ ID NO: 435334 - protein, 10 aa, Mycobacterium
ASAEDGGNPV

SEQ ID NO: 435335 - protein, 9 aa, Mycobacterium
ASAEDRSAK

SEQ ID NO: 435336 - protein, 14 aa, Mycobacterium
ASAEEKPYTRRPYP

SEQ ID NO: 435337 - protein, 6 aa, Mycobacterium
ASAEET

SEQ ID NO: 435338 - protein, 5 aa, Mycobacterium
ASAEH

SEQ ID NO: 435339 - protein, 9 aa, Mycobacterium
ASAEIGGEV

SEQ ID NO: 435340 - protein, 8 aa, Mycobacterium
ASAEKHPD

SEQ ID NO: 435341 - protein, 6 aa, Mycobacterium
ASAELG

SEQ ID NO: 435342 - protein, 10 aa, Mycobacterium
ASAEPNAAAR

SEQ ID NO: 435343 - protein, 9 aa, Mycobacterium
ASAEQGSVT

SEQ ID NO: 435344 - protein, 6 aa, Mycobacterium
ASAEQI

SEQ ID NO: 435345 - protein, 19 aa, Mycobacterium
ASAEQLDDDDVAAASGDQR

SEQ ID NO: 435346 - protein, 15 aa, Mycobacterium
ASAERRAEVGDTADY

SEQ ID NO: 435347 - protein, 7 aa, Mycobacterium
ASAERSG

SEQ ID NO: 435348 - protein, 7 aa, Mycobacterium
ASAESVR

SEQ ID NO: 435349 - protein, 5 aa, Mycobacterium
ASAFE

SEQ ID NO: 435350 - protein, 7 aa, Mycobacterium
ASAFGSV

SEQ ID NO: 435351 - protein, 5 aa, Mycobacterium
ASAGA

SEQ ID NO: 435352 - protein, 7 aa, Mycobacterium
ASAGADA

SEQ ID NO: 435353 - protein, 6 aa, Mycobacterium
ASAGAH

SEQ ID NO: 435354 - protein, 11 aa, Mycobacterium
ASAGALASGLR

SEQ ID NO: 435355 - protein, 7 aa, Mycobacterium
ASAGAPD

SEQ ID NO: 435356 - protein, 12 aa, Mycobacterium
ASAGARPLPSTR

SEQ ID NO: 435357 - protein, 27 aa, Mycobacterium
ASAGAYDEQEVQSAGTLGSAGSGGAVR

SEQ ID NO: 435358 - protein, 9 aa, Mycobacterium
ASAGDATPA

SEQ ID NO: 435359 - protein, 8 aa, Mycobacterium
ASAGDPVV

SEQ ID NO: 435360 - protein, 8 aa, Mycobacterium
ASAGDVEI

SEQ ID NO: 435361 - protein, 6 aa, Mycobacterium
ASAGEG

SEQ ID NO: 435362 - protein, 9 aa, Mycobacterium
ASAGEPDRL

SEQ ID NO: 435363 - protein, 8 aa, Mycobacterium
ASAGETIA

SEQ ID NO: 435364 - protein, 9 aa, Mycobacterium
ASAGGGGRG

SEQ ID NO: 435365 - protein, 10 aa, Mycobacterium
ASAGGGVPDS

SEQ ID NO: 435366 - protein, 7 aa, Mycobacterium
ASAGGHG

SEQ ID NO: 435367 - protein, 7 aa, Mycobacterium
ASAGGIE

SEQ ID NO: 435368 - protein, 8 aa, Mycobacterium
ASAGGLDT

SEQ ID NO: 435369 - protein, 7 aa, Mycobacterium
ASAGGPI

SEQ ID NO: 435370 - protein, 17 aa, Mycobacterium
ASAGGRAGDPSANDPDV

SEQ ID NO: 435371 - protein, 7 aa, Mycobacterium
ASAGGVD

SEQ ID NO: 435372 - protein, 6 aa, Mycobacterium
ASAGGY

SEQ ID NO: 435373 - protein, 6 aa, Mycobacterium
ASAGHG

SEQ ID NO: 435374 - protein, 22 aa, Mycobacterium
ASAGIDGHPRVGNDQNHELPWR

SEQ ID NO: 435375 - protein, 7 aa, Mycobacterium
ASAGIDL

SEQ ID NO: 435376 - protein, 7 aa, Mycobacterium
ASAGIES

SEQ ID NO: 435377 - protein, 13 aa, Mycobacterium
ASAGIGAATAKTL

SEQ ID NO: 435378 - protein, 7 aa, Mycobacterium
ASAGIGR

SEQ ID NO: 435379 - protein, 9 aa, Mycobacterium
ASAGISPET

SEQ ID NO: 435380 - protein, 5 aa, Mycobacterium
ASAGK

SEQ ID NO: 435381 - protein, 6 aa, Mycobacterium
ASAGKA

SEQ ID NO: 435382 - protein, 9 aa, Mycobacterium
ASAGLGAET

SEQ ID NO: 435383 - protein, 13 aa, Mycobacterium
ASAGLGKTTAVED

SEQ ID NO: 435384 - protein, 5 aa, Mycobacterium
ASAGN

SEQ ID NO: 435385 - protein, 7 aa, Mycobacterium
ASAGNAG

SEQ ID NO: 435386 - protein, 9 aa, Mycobacterium
ASAGNHAQG

SEQ ID NO: 435387 - protein, 8 aa, Mycobacterium
ASAGPGNF

SEQ ID NO: 435388 - protein, 11 aa, Mycobacterium
ASAGPGQHTPR

SEQ ID NO: 435389 - protein, 8 aa, Mycobacterium
ASAGPYET

SEQ ID NO: 435390 - protein, 9 aa, Mycobacterium
ASAGQETGT

SEQ ID NO: 435391 - protein, 8 aa, Mycobacterium
ASAGRSSL

SEQ ID NO: 435392 - protein, 10 aa, Mycobacterium
ASAGSAEETI

SEQ ID NO: 435393 - protein, 9 aa, Mycobacterium
ASAGSAGNM

SEQ ID NO: 435394 - protein, 6 aa, Mycobacterium
ASAGSD

SEQ ID NO: 435395 - protein, 7 aa, Mycobacterium
ASAGSGF

SEQ ID NO: 435396 - protein, 8 aa, Mycobacterium
ASAGSQAA

SEQ ID NO: 435397 - protein, 10 aa, Mycobacterium
ASAGSSLRKA

SEQ ID NO: 435398 - protein, 17 aa, Mycobacterium
ASAGSYASAEAANAAPS

SEQ ID NO: 435399 - protein, 5 aa, Mycobacterium
ASAGT

SEQ ID NO: 435400 - protein, 8 aa, Mycobacterium
ASAGTGAR

SEQ ID NO: 435401 - protein, 7 aa, Mycobacterium
ASAGTGV

SEQ ID NO: 435402 - protein, 7 aa, Mycobacterium
ASAGTRL

SEQ ID NO: 435403 - protein, 10 aa, Mycobacterium
ASAGTSTTLG

SEQ ID NO: 435404 - protein, 7 aa, Mycobacterium
ASAGTVD

SEQ ID NO: 435405 - protein, 7 aa, Mycobacterium
ASAGVAP

SEQ ID NO: 435406 - protein, 12 aa, Mycobacterium
ASAGVAPRGVPP

SEQ ID NO: 435407 - protein, 6 aa, Mycobacterium
ASAGVD

SEQ ID NO: 435408 - protein, 7 aa, Mycobacterium
ASAGVEA

SEQ ID NO: 435409 - protein, 6 aa, Mycobacterium
ASAGVS

SEQ ID NO: 435410 - protein, 14 aa, Mycobacterium
ASAHAAEGTDQQRI

SEQ ID NO: 435411 - protein, 8 aa, Mycobacterium
ASAHAGGG

SEQ ID NO: 435412 - protein, 7 aa, Mycobacterium
ASAHGSG

SEQ ID NO: 435413 - protein, 8 aa, Mycobacterium
ASAHGSGI

SEQ ID NO: 435414 - protein, 9 aa, Mycobacterium
ASAHKRRVA

SEQ ID NO: 435415 - protein, 7 aa, Mycobacterium
ASAHNDG

SEQ ID NO: 435416 - protein, 9 aa, Mycobacterium
ASAHSERGP

SEQ ID NO: 435417 - protein, 5 aa, Mycobacterium
ASAIA

SEQ ID NO: 435418 - protein, 6 aa, Mycobacterium
ASAIDE

SEQ ID NO: 435419 - protein, 7 aa, Mycobacterium
ASAIDTA

SEQ ID NO: 435420 - protein, 8 aa, Mycobacterium
ASAIGGED

SEQ ID NO: 435421 - protein, 5 aa, Mycobacterium
ASAIK

SEQ ID NO: 435422 - protein, 7 aa, Mycobacterium
ASAIQGN

SEQ ID NO: 435423 - protein, 10 aa, Mycobacterium
ASAIQQTADT

SEQ ID NO: 435424 - protein, 7 aa, Mycobacterium
ASAIQSE

SEQ ID NO: 435425 - protein, 8 aa, Mycobacterium
ASAIRASA

SEQ ID NO: 435426 - protein, 12 aa, Mycobacterium
ASAITGTATLTY

SEQ ID NO: 435427 - protein, 18 aa, Mycobacterium
ASAKAGLSALARTATDRS

SEQ ID NO: 435428 - protein, 20 aa, Mycobacterium
ASAKARGVELNPDDPILLPT

SEQ ID NO: 435429 - protein, 6 aa, Mycobacterium
ASAKEV

SEQ ID NO: 435430 - protein, 6 aa, Mycobacterium
ASAKFS

SEQ ID NO: 435431 - protein, 10 aa, Mycobacterium
ASAKGGRPFR

SEQ ID NO: 435432 - protein, 10 aa, Mycobacterium
ASAKQRLTDS

SEQ ID NO: 435433 - protein, 6 aa, Mycobacterium
ASAKRQ

SEQ ID NO: 435434 - protein, 6 aa, Mycobacterium
ASAKRR

SEQ ID NO: 435435 - protein, 7 aa, Mycobacterium
ASAKTLD

SEQ ID NO: 435436 - protein, 17 aa, Mycobacterium
ASAKVRSGGPVDDPQDH

SEQ ID NO: 435437 - protein, 11 aa, Mycobacterium
ASALAPPVDGG

SEQ ID NO: 435438 - protein, 13 aa, Mycobacterium
ASALDSESTQWQG

SEQ ID NO: 435439 - protein, 13 aa, Mycobacterium
ASALDTGAGSAPV

SEQ ID NO: 435440 - protein, 7 aa, Mycobacterium
ASALGSR

SEQ ID NO: 435441 - protein, 5 aa, Mycobacterium
ASALH

SEQ ID NO: 435442 - protein, 12 aa, Mycobacterium
ASALKADGPPFA

SEQ ID NO: 435443 - protein, 7 aa, Mycobacterium
ASALRKA

SEQ ID NO: 435444 - protein, 15 aa, Mycobacterium
ASALTGGSANNTIRG

SEQ ID NO: 435445 - protein, 7 aa, Mycobacterium
ASAMRKT

SEQ ID NO: 435446 - protein, 13 aa, Mycobacterium
ASANAQAGRGNWD

SEQ ID NO: 435447 - protein, 10 aa, Mycobacterium
ASANGETPAM

SEQ ID NO: 435448 - protein, 7 aa, Mycobacterium
ASANHLS

SEQ ID NO: 435449 - protein, 6 aa, Mycobacterium
ASANMG

SEQ ID NO: 435450 - protein, 5 aa, Mycobacterium
ASANP

SEQ ID NO: 435451 - protein, 6 aa, Mycobacterium
ASANPY

SEQ ID NO: 435452 - protein, 16 aa, Mycobacterium
ASANRDASAALRGRST

SEQ ID NO: 435453 - protein, 6 aa, Mycobacterium
ASANST

SEQ ID NO: 435454 - protein, 17 aa, Mycobacterium
ASANSYEATEAANAIAA

SEQ ID NO: 435455 - protein, 10 aa, Mycobacterium
ASANTGLPIG

SEQ ID NO: 435456 - protein, 8 aa, Mycobacterium
ASANTSRA

SEQ ID NO: 435457 - protein, 5 aa, Mycobacterium
ASAPA

SEQ ID NO: 435458 - protein, 105 aa, Mycobacterium
ASAPAAAGAVPAPSPGPPSPPVSPLSPAASGNAVAPPSVAGAQPAAGTGLRATTAAGPAPAPGSVATTHAAAPSSRPVSNWSPHDRDPFSPPAAGVAGDGATGPI

SEQ ID NO: 435459 - protein, 8 aa, Mycobacterium
ASAPADEE

SEQ ID NO: 435460 - protein, 32 aa, Mycobacterium
ASAPADQPTATAPAASPAAATPEPGSPGSSEW

SEQ ID NO: 435461 - protein, 13 aa, Mycobacterium
ASAPAGDDAYDGT

SEQ ID NO: 435462 - protein, 12 aa, Mycobacterium
ASAPAGVLDAGQ

SEQ ID NO: 435463 - protein, 14 aa, Mycobacterium
ASAPARRLSAEEVA

SEQ ID NO: 435464 - protein, 17 aa, Mycobacterium
ASAPASNSSGASGGSLS

SEQ ID NO: 435465 - protein, 16 aa, Mycobacterium
ASAPATNPASASAVHA

SEQ ID NO: 435466 - protein, 14 aa, Mycobacterium
ASAPDAETHQDDDP

SEQ ID NO: 435467 - protein, 10 aa, Mycobacterium
ASAPDSGTVT

SEQ ID NO: 435468 - protein, 10 aa, Mycobacterium
ASAPDSPAVS

SEQ ID NO: 435469 - protein, 6 aa, Mycobacterium
ASAPDW

SEQ ID NO: 435470 - protein, 16 aa, Mycobacterium
ASAPEARAEILEPVPL

SEQ ID NO: 435471 - protein, 8 aa, Mycobacterium
ASAPEPLS

SEQ ID NO: 435472 - protein, 7 aa, Mycobacterium
ASAPEPM

SEQ ID NO: 435473 - protein, 13 aa, Mycobacterium
ASAPETSTPNPEL

SEQ ID NO: 435474 - protein, 6 aa, Mycobacterium
ASAPGA

SEQ ID NO: 435475 - protein, 18 aa, Mycobacterium
ASAPGALSAAAQLADKTG

SEQ ID NO: 435476 - protein, 12 aa, Mycobacterium
ASAPGAPKSRHA

SEQ ID NO: 435477 - protein, 16 aa, Mycobacterium
ASAPGDEGNEQDPIAD

SEQ ID NO: 435478 - protein, 40 aa, Mycobacterium
ASAPGSSVQERTVPTPTARSVDAARRDQAPPDRSRGDAPW

SEQ ID NO: 435479 - protein, 6 aa, Mycobacterium
ASAPGT

SEQ ID NO: 435480 - protein, 6 aa, Mycobacterium
ASAPIT

SEQ ID NO: 435481 - protein, 5 aa, Mycobacterium
ASAPK

SEQ ID NO: 435482 - protein, 9 aa, Mycobacterium
ASAPKAEHQ

SEQ ID NO: 435483 - protein, 5 aa, Mycobacterium
ASAPL

SEQ ID NO: 435484 - protein, 15 aa, Mycobacterium
ASAPNSSGKDVDDAF

SEQ ID NO: 435485 - protein, 7 aa, Mycobacterium
ASAPPDA

SEQ ID NO: 435486 - protein, 7 aa, Mycobacterium
ASAPPIS

SEQ ID NO: 435487 - protein, 14 aa, Mycobacterium
ASAPPLDGYPRPGK

SEQ ID NO: 435488 - protein, 11 aa, Mycobacterium
ASAPPSTPPPS

SEQ ID NO: 435489 - protein, 8 aa, Mycobacterium
ASAPPTGL

SEQ ID NO: 435490 - protein, 10 aa, Mycobacterium
ASAPQADPLD

SEQ ID NO: 435491 - protein, 7 aa, Mycobacterium
ASAPQGL

SEQ ID NO: 435492 - protein, 7 aa, Mycobacterium
ASAPRIG

SEQ ID NO: 435493 - protein, 9 aa, Mycobacterium
ASAPRIGAP

SEQ ID NO: 435494 - protein, 10 aa, Mycobacterium
ASAPRIGRPR

SEQ ID NO: 435495 - protein, 8 aa, Mycobacterium
ASAPRYNI

SEQ ID NO: 435496 - protein, 17 aa, Mycobacterium
ASAPSAIGNGDSAPPGW

SEQ ID NO: 435497 - protein, 16 aa, Mycobacterium
ASAPTAAADVGDHGVL

SEQ ID NO: 435498 - protein, 9 aa, Mycobacterium
ASAPTIGAP

SEQ ID NO: 435499 - protein, 7 aa, Mycobacterium
ASAPTLS

SEQ ID NO: 435500 - protein, 13 aa, Mycobacterium
ASAPVGLGSAEAA

SEQ ID NO: 435501 - protein, 15 aa, Mycobacterium
ASAPYDGPPPQPEDL

SEQ ID NO: 435502 - protein, 13 aa, Mycobacterium
ASAQAAAAAGQAQ

SEQ ID NO: 435503 - protein, 15 aa, Mycobacterium
ASAQAAGAAAQAQTV

SEQ ID NO: 435504 - protein, 13 aa, Mycobacterium
ASAQAANAAGQAQ

SEQ ID NO: 435505 - protein, 26 aa, Mycobacterium
ASAQAASPNTVRHKPSAIAQARPRGK

SEQ ID NO: 435506 - protein, 8 aa, Mycobacterium
ASAQADHA

SEQ ID NO: 435507 - protein, 13 aa, Mycobacterium
ASAQGAADPPPVP

SEQ ID NO: 435508 - protein, 21 aa, Mycobacterium
ASAQGAGPLGFAGTKQRQKAF

SEQ ID NO: 435509 - protein, 8 aa, Mycobacterium
ASAQGVGA

SEQ ID NO: 435510 - protein, 10 aa, Mycobacterium
ASAQKELGED

SEQ ID NO: 435511 - protein, 5 aa, Mycobacterium
ASAQL

SEQ ID NO: 435512 - protein, 28 aa, Mycobacterium
ASAQPPAAGEPAPESAAHTVSAAGSRAA

SEQ ID NO: 435513 - protein, 89 aa, Mycobacterium
ASAQQAADGPEDRAESRKPPSRRSGPVDTETPTTGSGSAPSRADEDADPADSAPEDSGLPDGDTADIDETAGTGELPDPSPASEPVAAR

SEQ ID NO: 435514 - protein, 7 aa, Mycobacterium
ASAQRLG

SEQ ID NO: 435515 - protein, 7 aa, Mycobacterium
ASAQTFR

SEQ ID NO: 435516 - protein, 7 aa, Mycobacterium
ASAQTYR

SEQ ID NO: 435517 - protein, 8 aa, Mycobacterium
ASARAEGY

SEQ ID NO: 435518 - protein, 13 aa, Mycobacterium
ASARAKARATQAL

SEQ ID NO: 435519 - protein, 15 aa, Mycobacterium
ASARDAETRSPNPLI

SEQ ID NO: 435520 - protein, 5 aa, Mycobacterium
ASARE

SEQ ID NO: 435521 - protein, 8 aa, Mycobacterium
ASARETAA

SEQ ID NO: 435522 - protein, 9 aa, Mycobacterium
ASARGSREL

SEQ ID NO: 435523 - protein, 7 aa, Mycobacterium
ASARPDR

SEQ ID NO: 435524 - protein, 7 aa, Mycobacterium
ASARQRV

SEQ ID NO: 435525 - protein, 6 aa, Mycobacterium
ASARRA

SEQ ID NO: 435526 - protein, 18 aa, Mycobacterium
ASARRDELSATRAQHTSA

SEQ ID NO: 435527 - protein, 7 aa, Mycobacterium
ASARRHG

SEQ ID NO: 435528 - protein, 7 aa, Mycobacterium
ASARSAR

SEQ ID NO: 435529 - protein, 10 aa, Mycobacterium
ASARSSRELA

SEQ ID NO: 435530 - protein, 7 aa, Mycobacterium
ASARSSS

SEQ ID NO: 435531 - protein, 15 aa, Mycobacterium
ASARSYQAQQQRAEE

SEQ ID NO: 435532 - protein, 13 aa, Mycobacterium
ASARTRGKSDPID

SEQ ID NO: 435533 - protein, 5 aa, Mycobacterium
ASASA

SEQ ID NO: 435534 - protein, 18 aa, Mycobacterium
ASASAAASQVTPFSEPPQ

SEQ ID NO: 435535 - protein, 10 aa, Mycobacterium
ASASAARRAG

SEQ ID NO: 435536 - protein, 9 aa, Mycobacterium
ASASAATAL

SEQ ID NO: 435537 - protein, 8 aa, Mycobacterium
ASASAPAR

SEQ ID NO: 435538 - protein, 13 aa, Mycobacterium
ASASASDSRRCAP

SEQ ID NO: 435539 - protein, 9 aa, Mycobacterium
ASASDGRTF

SEQ ID NO: 435540 - protein, 9 aa, Mycobacterium
ASASDGSKK

SEQ ID NO: 435541 - protein, 28 aa, Mycobacterium
ASASERAAAAGNAAQDGIEPLRVLPQLI

SEQ ID NO: 435542 - protein, 6 aa, Mycobacterium
ASASGL

SEQ ID NO: 435543 - protein, 18 aa, Mycobacterium
ASASGSPRRAVSGIDSSR

SEQ ID NO: 435544 - protein, 9 aa, Mycobacterium
ASASGSVDI

SEQ ID NO: 435545 - protein, 15 aa, Mycobacterium
ASASGSWLTDTSGER

SEQ ID NO: 435546 - protein, 17 aa, Mycobacterium
ASASGYSAAEAANTGPL

SEQ ID NO: 435547 - protein, 7 aa, Mycobacterium
ASASKID

SEQ ID NO: 435548 - protein, 8 aa, Mycobacterium
ASASKLDG

SEQ ID NO: 435549 - protein, 8 aa, Mycobacterium
ASASKLEG

SEQ ID NO: 435550 - protein, 22 aa, Mycobacterium
ASASNTATRLTDSRTGLPSDIN

SEQ ID NO: 435551 - protein, 12 aa, Mycobacterium
ASASPAAATMTE

SEQ ID NO: 435552 - protein, 9 aa, Mycobacterium
ASASRIPGY

SEQ ID NO: 435553 - protein, 7 aa, Mycobacterium
ASASSQF

SEQ ID NO: 435554 - protein, 8 aa, Mycobacterium
ASASTDAG

SEQ ID NO: 435555 - protein, 7 aa, Mycobacterium
ASASTQL

SEQ ID NO: 435556 - protein, 29 aa, Mycobacterium
ASASTYPAPPPSPPPPSGAAAELGADNDA

SEQ ID NO: 435557 - protein, 18 aa, Mycobacterium
ASASVTYPPATPEDLDET

SEQ ID NO: 435558 - protein, 9 aa, Mycobacterium
ASASYDPTT

SEQ ID NO: 435559 - protein, 12 aa, Mycobacterium
ASASYTNSGQVT

SEQ ID NO: 435560 - protein, 4 aa, Mycobacterium
ASAT

SEQ ID NO: 435561 - protein, 7 aa, Mycobacterium
ASATAAV

SEQ ID NO: 435562 - protein, 8 aa, Mycobacterium
ASATAEED

SEQ ID NO: 435563 - protein, 14 aa, Mycobacterium
ASATAGYQLIEAVL

SEQ ID NO: 435564 - protein, 8 aa, Mycobacterium
ASATASAV

SEQ ID NO: 435565 - protein, 10 aa, Mycobacterium
ASATATSRSI

SEQ ID NO: 435566 - protein, 10 aa, Mycobacterium
ASATDAGNQL

SEQ ID NO: 435567 - protein, 10 aa, Mycobacterium
ASATDDLQSK

SEQ ID NO: 435568 - protein, 7 aa, Mycobacterium
ASATDVA

SEQ ID NO: 435569 - protein, 7 aa, Mycobacterium
ASATDVS

SEQ ID NO: 435570 - protein, 8 aa, Mycobacterium
ASATDVSH

SEQ ID NO: 435571 - protein, 6 aa, Mycobacterium
ASATEL

SEQ ID NO: 435572 - protein, 5 aa, Mycobacterium
ASATG

SEQ ID NO: 435573 - protein, 7 aa, Mycobacterium
ASATGAD

SEQ ID NO: 435574 - protein, 8 aa, Mycobacterium
ASATGKGA

SEQ ID NO: 435575 - protein, 17 aa, Mycobacterium
ASATGLRDRVPDPPGGL

SEQ ID NO: 435576 - protein, 6 aa, Mycobacterium
ASATGS

SEQ ID NO: 435577 - protein, 7 aa, Mycobacterium
ASATGVN

SEQ ID NO: 435578 - protein, 30 aa, Mycobacterium
ASATIPPAATVTASRTTGAAGTTGTTGTTV

SEQ ID NO: 435579 - protein, 6 aa, Mycobacterium
ASATLG

SEQ ID NO: 435580 - protein, 8 aa, Mycobacterium
ASATLRTK

SEQ ID NO: 435581 - protein, 7 aa, Mycobacterium
ASATMGT

SEQ ID NO: 435582 - protein, 10 aa, Mycobacterium
ASATPDTAVT

SEQ ID NO: 435583 - protein, 11 aa, Mycobacterium
ASATPDTPVTE

SEQ ID NO: 435584 - protein, 18 aa, Mycobacterium
ASATPGSRPESPAPDRRS

SEQ ID NO: 435585 - protein, 7 aa, Mycobacterium
ASATQQP

SEQ ID NO: 435586 - protein, 5 aa, Mycobacterium
ASATR

SEQ ID NO: 435587 - protein, 13 aa, Mycobacterium
ASATRANGSAGAV

SEQ ID NO: 435588 - protein, 14 aa, Mycobacterium
ASATRNSAGFGAPR

SEQ ID NO: 435589 - protein, 8 aa, Mycobacterium
ASATRRGL

SEQ ID NO: 435590 - protein, 5 aa, Mycobacterium
ASATS

SEQ ID NO: 435591 - protein, 10 aa, Mycobacterium
ASATSATDAL

SEQ ID NO: 435592 - protein, 7 aa, Mycobacterium
ASATSLR

SEQ ID NO: 435593 - protein, 7 aa, Mycobacterium
ASATSTI

SEQ ID NO: 435594 - protein, 12 aa, Mycobacterium
ASATTDAALPPA

SEQ ID NO: 435595 - protein, 7 aa, Mycobacterium
ASATTGL

SEQ ID NO: 435596 - protein, 14 aa, Mycobacterium
ASATTLRQAQERLG

SEQ ID NO: 435597 - protein, 7 aa, Mycobacterium
ASATTSA

SEQ ID NO: 435598 - protein, 10 aa, Mycobacterium
ASATTSPSYC

SEQ ID NO: 435599 - protein, 5 aa, Mycobacterium
ASATV

SEQ ID NO: 435600 - protein, 19 aa, Mycobacterium
ASATVAGVADPEVQNAKQR

SEQ ID NO: 435601 - protein, 6 aa, Mycobacterium
ASATVP

SEQ ID NO: 435602 - protein, 6 aa, Mycobacterium
ASATYP

SEQ ID NO: 435603 - protein, 9 aa, Mycobacterium
ASAVAGNPA

SEQ ID NO: 435604 - protein, 14 aa, Mycobacterium
ASAVDSGTADPTVT

SEQ ID NO: 435605 - protein, 8 aa, Mycobacterium
ASAVLGSP

SEQ ID NO: 435606 - protein, 9 aa, Mycobacterium
ASAVRQGRI

SEQ ID NO: 435607 - protein, 11 aa, Mycobacterium
ASAVTPAQVGD

SEQ ID NO: 435608 - protein, 6 aa, Mycobacterium
ASAVTS

SEQ ID NO: 435609 - protein, 12 aa, Mycobacterium
ASAVYGQSRSLV

SEQ ID NO: 435610 - protein, 5 aa, Mycobacterium
ASAWN

SEQ ID NO: 435611 - protein, 4 aa, Mycobacterium
ASAY

SEQ ID NO: 435612 - protein, 7 aa, Mycobacterium
ASAYARE

SEQ ID NO: 435613 - protein, 6 aa, Mycobacterium
ASAYDE

SEQ ID NO: 435614 - protein, 10 aa, Mycobacterium
ASAYGNEAAV

SEQ ID NO: 435615 - protein, 6 aa, Mycobacterium
ASAYGT

SEQ ID NO: 435616 - protein, 5 aa, Mycobacterium
ASAYP

SEQ ID NO: 435617 - protein, 8 aa, Mycobacterium
ASAYPGDE

SEQ ID NO: 435618 - protein, 7 aa, Mycobacterium
ASAYQHR

SEQ ID NO: 435619 - protein, 7 aa, Mycobacterium
ASAYREN

SEQ ID NO: 435620 - protein, 12 aa, Mycobacterium
ASCAPPGGGPCY

SEQ ID NO: 435621 - protein, 18 aa, Mycobacterium
ASCDSGAHGARMTGGGFG

SEQ ID NO: 435622 - protein, 6 aa, Mycobacterium
ASCERA

SEQ ID NO: 435623 - protein, 6 aa, Mycobacterium
ASCGTP

SEQ ID NO: 435624 - protein, 66 aa, Mycobacterium
ASCNGGAGGAGGNPGAPGNGGIGGIGNATTDGGTGGNGGDPGSFGVGGTGGVAGGQGATAGANGAV

SEQ ID NO: 435625 - protein, 5 aa, Mycobacterium
ASCPN

SEQ ID NO: 435626 - protein, 20 aa, Mycobacterium
ASCRSGGDAGATEAAAGASA

SEQ ID NO: 435627 - protein, 6 aa, Mycobacterium
ASCTAG

SEQ ID NO: 435628 - protein, 7 aa, Mycobacterium
ASDAAAL

SEQ ID NO: 435629 - protein, 7 aa, Mycobacterium
ASDAAQQ

SEQ ID NO: 435630 - protein, 8 aa, Mycobacterium
ASDAAQQL

SEQ ID NO: 435631 - protein, 5 aa, Mycobacterium
ASDAD

SEQ ID NO: 435632 - protein, 12 aa, Mycobacterium
ASDADEKEIKRA

SEQ ID NO: 435633 - protein, 6 aa, Mycobacterium
ASDADG

SEQ ID NO: 435634 - protein, 6 aa, Mycobacterium
ASDAEA

SEQ ID NO: 435635 - protein, 21 aa, Mycobacterium
ASDAEDLAATTRAGMNRDRPV

SEQ ID NO: 435636 - protein, 5 aa, Mycobacterium
ASDAG

SEQ ID NO: 435637 - protein, 6 aa, Mycobacterium
ASDAGF

SEQ ID NO: 435638 - protein, 11 aa, Mycobacterium
ASDAGKLRAGV

SEQ ID NO: 435639 - protein, 8 aa, Mycobacterium
ASDAGPYL

SEQ ID NO: 435640 - protein, 13 aa, Mycobacterium
ASDAGVSSIPVGP

SEQ ID NO: 435641 - protein, 9 aa, Mycobacterium
ASDAHPAFS

SEQ ID NO: 435642 - protein, 8 aa, Mycobacterium
ASDAKGVR

SEQ ID NO: 435643 - protein, 5 aa, Mycobacterium
ASDAL

SEQ ID NO: 435644 - protein, 7 aa, Mycobacterium
ASDALGG

SEQ ID NO: 435645 - protein, 9 aa, Mycobacterium
ASDAPDQEV

SEQ ID NO: 435646 - protein, 31 aa, Mycobacterium
ASDAQRVVTSDSRPLTNVNTDAELRGLAQAR

SEQ ID NO: 435647 - protein, 9 aa, Mycobacterium
ASDARDSLP

SEQ ID NO: 435648 - protein, 9 aa, Mycobacterium
ASDASRTAV

SEQ ID NO: 435649 - protein, 12 aa, Mycobacterium
ASDASTALTDAS

SEQ ID NO: 435650 - protein, 8 aa, Mycobacterium
ASDASVRH

SEQ ID NO: 435651 - protein, 14 aa, Mycobacterium
ASDATDRGRPSLGE

SEQ ID NO: 435652 - protein, 8 aa, Mycobacterium
ASDATSAL

SEQ ID NO: 435653 - protein, 15 aa, Mycobacterium
ASDAVGGGGLAGART

SEQ ID NO: 435654 - protein, 7 aa, Mycobacterium
ASDCPTG

SEQ ID NO: 435655 - protein, 11 aa, Mycobacterium
ASDCSDATLTG

SEQ ID NO: 435656 - protein, 12 aa, Mycobacterium
ASDCSDSALGGT

SEQ ID NO: 435657 - protein, 8 aa, Mycobacterium
ASDCTDSS

SEQ ID NO: 435658 - protein, 8 aa, Mycobacterium
ASDDAQDQ

SEQ ID NO: 435659 - protein, 8 aa, Mycobacterium
ASDDDAGV

SEQ ID NO: 435660 - protein, 7 aa, Mycobacterium
ASDDDPY

SEQ ID NO: 435661 - protein, 7 aa, Mycobacterium
ASDDEAI

SEQ ID NO: 435662 - protein, 29 aa, Mycobacterium
ASDDEPQYKVRSDKTGADAVHKPGALRPA

SEQ ID NO: 435663 - protein, 5 aa, Mycobacterium
ASDDG

SEQ ID NO: 435664 - protein, 8 aa, Mycobacterium
ASDDGDLQ

SEQ ID NO: 435665 - protein, 8 aa, Mycobacterium
ASDDGRPQ

SEQ ID NO: 435666 - protein, 5 aa, Mycobacterium
ASDDI

SEQ ID NO: 435667 - protein, 7 aa, Mycobacterium
ASDDPDA

SEQ ID NO: 435668 - protein, 11 aa, Mycobacterium
ASDDPGQRPNQ

SEQ ID NO: 435669 - protein, 7 aa, Mycobacterium
ASDDRCE

SEQ ID NO: 435670 - protein, 6 aa, Mycobacterium
ASDDRM

SEQ ID NO: 435671 - protein, 6 aa, Mycobacterium
ASDDRR

SEQ ID NO: 435672 - protein, 7 aa, Mycobacterium
ASDDVEV

SEQ ID NO: 435673 - protein, 9 aa, Mycobacterium
ASDDYQDKA

SEQ ID NO: 435674 - protein, 4 aa, Mycobacterium
ASDE

SEQ ID NO: 435675 - protein, 6 aa, Mycobacterium
ASDEDI

SEQ ID NO: 435676 - protein, 7 aa, Mycobacterium
ASDEEEL

SEQ ID NO: 435677 - protein, 18 aa, Mycobacterium
ASDEEGAPVLRLTDAGRL

SEQ ID NO: 435678 - protein, 10 aa, Mycobacterium
ASDEENARAD

SEQ ID NO: 435679 - protein, 14 aa, Mycobacterium
ASDEHAARRSSSKA

SEQ ID NO: 435680 - protein, 6 aa, Mycobacterium
ASDELG

SEQ ID NO: 435681 - protein, 17 aa, Mycobacterium
ASDEQHGDVGDKVNDNV

SEQ ID NO: 435682 - protein, 8 aa, Mycobacterium
ASDERDDV

SEQ ID NO: 435683 - protein, 13 aa, Mycobacterium
ASDERIAAAVRRL

SEQ ID NO: 435684 - protein, 8 aa, Mycobacterium
ASDESGRA

SEQ ID NO: 435685 - protein, 6 aa, Mycobacterium
ASDESL

SEQ ID NO: 435686 - protein, 19 aa, Mycobacterium
ASDETEDRPVLDWRFTGLL

SEQ ID NO: 435687 - protein, 8 aa, Mycobacterium
ASDETKSV

SEQ ID NO: 435688 - protein, 4 aa, Mycobacterium
ASDF

SEQ ID NO: 435689 - protein, 10 aa, Mycobacterium
ASDGAAPRRW

SEQ ID NO: 435690 - protein, 17 aa, Mycobacterium
ASDGASDGASGADNRAQ

SEQ ID NO: 435691 - protein, 15 aa, Mycobacterium
ASDGDGDGKADPQNV

SEQ ID NO: 435692 - protein, 9 aa, Mycobacterium
ASDGEFGDD

SEQ ID NO: 435693 - protein, 8 aa, Mycobacterium
ASDGGAAF

SEQ ID NO: 435694 - protein, 6 aa, Mycobacterium
ASDGGF

SEQ ID NO: 435695 - protein, 9 aa, Mycobacterium
ASDGGGSIR

SEQ ID NO: 435696 - protein, 8 aa, Mycobacterium
ASDGGKPF

SEQ ID NO: 435697 - protein, 7 aa, Mycobacterium
ASDGHPL

SEQ ID NO: 435698 - protein, 6 aa, Mycobacterium
ASDGIA

SEQ ID NO: 435699 - protein, 6 aa, Mycobacterium
ASDGIE

SEQ ID NO: 435700 - protein, 8 aa, Mycobacterium
ASDGQPRR

SEQ ID NO: 435701 - protein, 11 aa, Mycobacterium
ASDGQRAGSAM

SEQ ID NO: 435702 - protein, 5 aa, Mycobacterium
ASDGS

SEQ ID NO: 435703 - protein, 10 aa, Mycobacterium
ASDGSQKIGP

SEQ ID NO: 435704 - protein, 10 aa, Mycobacterium
ASDGTAEATG

SEQ ID NO: 435705 - protein, 11 aa, Mycobacterium
ASDGTGPDAEN

SEQ ID NO: 435706 - protein, 7 aa, Mycobacterium
ASDGVAA

SEQ ID NO: 435707 - protein, 7 aa, Mycobacterium
ASDGVDV

SEQ ID NO: 435708 - protein, 5 aa, Mycobacterium
ASDHG

SEQ ID NO: 435709 - protein, 7 aa, Mycobacterium
ASDHSDL

SEQ ID NO: 435710 - protein, 4 aa, Mycobacterium
ASDI

SEQ ID NO: 435711 - protein, 9 aa, Mycobacterium
ASDIAPGRE

SEQ ID NO: 435712 - protein, 17 aa, Mycobacterium
ASDIPAAEKADRSNPDH

SEQ ID NO: 435713 - protein, 14 aa, Mycobacterium
ASDITGTGSPLSAG

SEQ ID NO: 435714 - protein, 4 aa, Mycobacterium
ASDK

SEQ ID NO: 435715 - protein, 26 aa, Mycobacterium
ASDKPRLAGRQPSNRGGVPRVMTRLS

SEQ ID NO: 435716 - protein, 8 aa, Mycobacterium
ASDLAGVA

SEQ ID NO: 435717 - protein, 12 aa, Mycobacterium
ASDLAPAEGMTD

SEQ ID NO: 435718 - protein, 8 aa, Mycobacterium
ASDLDGAR

SEQ ID NO: 435719 - protein, 5 aa, Mycobacterium
ASDLS

SEQ ID NO: 435720 - protein, 9 aa, Mycobacterium
ASDLTGRPR

SEQ ID NO: 435721 - protein, 10 aa, Mycobacterium
ASDMGPGTYT

SEQ ID NO: 435722 - protein, 5 aa, Mycobacterium
ASDND

SEQ ID NO: 435723 - protein, 6 aa, Mycobacterium
ASDNDI

SEQ ID NO: 435724 - protein, 6 aa, Mycobacterium
ASDNGR

SEQ ID NO: 435725 - protein, 26 aa, Mycobacterium
ASDNNVPVTARGSGTGLSGAAIPRSD

SEQ ID NO: 435726 - protein, 9 aa, Mycobacterium
ASDNPADAP

SEQ ID NO: 435727 - protein, 18 aa, Mycobacterium
ASDNQDETEQTNPTVGSS

SEQ ID NO: 435728 - protein, 4 aa, Mycobacterium
ASDP

SEQ ID NO: 435729 - protein, 7 aa, Mycobacterium
ASDPDEL

SEQ ID NO: 435730 - protein, 10 aa, Mycobacterium
ASDPDRDRRE

SEQ ID NO: 435731 - protein, 7 aa, Mycobacterium
ASDPDRK

SEQ ID NO: 435732 - protein, 20 aa, Mycobacterium
ASDPEATVTAGNSSGQNDAA

SEQ ID NO: 435733 - protein, 8 aa, Mycobacterium
ASDPEGDD

SEQ ID NO: 435734 - protein, 14 aa, Mycobacterium
ASDPEQRLQGGEAS

SEQ ID NO: 435735 - protein, 7 aa, Mycobacterium
ASDPERA

SEQ ID NO: 435736 - protein, 7 aa, Mycobacterium
ASDPEVT

SEQ ID NO: 435737 - protein, 6 aa, Mycobacterium
ASDPGE

SEQ ID NO: 435738 - protein, 9 aa, Mycobacterium
ASDPGFSPQ

SEQ ID NO: 435739 - protein, 9 aa, Mycobacterium
ASDPGHKPE

SEQ ID NO: 435740 - protein, 9 aa, Mycobacterium
ASDPGTATV

SEQ ID NO: 435741 - protein, 9 aa, Mycobacterium
ASDPGTGVG

SEQ ID NO: 435742 - protein, 9 aa, Mycobacterium
ASDPHNATT

SEQ ID NO: 435743 - protein, 6 aa, Mycobacterium
ASDPID

SEQ ID NO: 435744 - protein, 6 aa, Mycobacterium
ASDPIG

SEQ ID NO: 435745 - protein, 9 aa, Mycobacterium
ASDPKSKGI

SEQ ID NO: 435746 - protein, 9 aa, Mycobacterium
ASDPLAPYA

SEQ ID NO: 435747 - protein, 14 aa, Mycobacterium
ASDPLRSSARNRGD

SEQ ID NO: 435748 - protein, 16 aa, Mycobacterium
ASDPPESAAGEEPPQL

SEQ ID NO: 435749 - protein, 7 aa, Mycobacterium
ASDPPRK

SEQ ID NO: 435750 - protein, 6 aa, Mycobacterium
ASDPQA

SEQ ID NO: 435751 - protein, 6 aa, Mycobacterium
ASDPRF

SEQ ID NO: 435752 - protein, 12 aa, Mycobacterium
ASDPRRDGQAAA

SEQ ID NO: 435753 - protein, 8 aa, Mycobacterium
ASDPRSAG

SEQ ID NO: 435754 - protein, 15 aa, Mycobacterium
ASDPSPRAERVSVRR

SEQ ID NO: 435755 - protein, 6 aa, Mycobacterium
ASDPTA

SEQ ID NO: 435756 - protein, 7 aa, Mycobacterium
ASDPTAL

SEQ ID NO: 435757 - protein, 8 aa, Mycobacterium
ASDPTGAS

SEQ ID NO: 435758 - protein, 6 aa, Mycobacterium
ASDPTL

SEQ ID NO: 435759 - protein, 5 aa, Mycobacterium
ASDPV

SEQ ID NO: 435760 - protein, 22 aa, Mycobacterium
ASDPVYAPNSYGGPQADPARAA

SEQ ID NO: 435761 - protein, 4 aa, Mycobacterium
ASDQ

SEQ ID NO: 435762 - protein, 9 aa, Mycobacterium
ASDQPLSRR

SEQ ID NO: 435763 - protein, 7 aa, Mycobacterium
ASDQQGE

SEQ ID NO: 435764 - protein, 8 aa, Mycobacterium
ASDQQQLS

SEQ ID NO: 435765 - protein, 6 aa, Mycobacterium
ASDRAA

SEQ ID NO: 435766 - protein, 7 aa, Mycobacterium
ASDRDAE

SEQ ID NO: 435767 - protein, 8 aa, Mycobacterium
ASDRDDGY

SEQ ID NO: 435768 - protein, 8 aa, Mycobacterium
ASDREARG

SEQ ID NO: 435769 - protein, 9 aa, Mycobacterium
ASDRGDVER

SEQ ID NO: 435770 - protein, 6 aa, Mycobacterium
ASDRIE

SEQ ID NO: 435771 - protein, 9 aa, Mycobacterium
ASDRKRRVA

SEQ ID NO: 435772 - protein, 9 aa, Mycobacterium
ASDRLGGEA

SEQ ID NO: 435773 - protein, 8 aa, Mycobacterium
ASDRPDDL

SEQ ID NO: 435774 - protein, 7 aa, Mycobacterium
ASDRPDE

SEQ ID NO: 435775 - protein, 8 aa, Mycobacterium
ASDRPFDD

SEQ ID NO: 435776 - protein, 10 aa, Mycobacterium
ASDRRKADLE

SEQ ID NO: 435777 - protein, 9 aa, Mycobacterium
ASDRRSREF

SEQ ID NO: 435778 - protein, 6 aa, Mycobacterium
ASDRTE

SEQ ID NO: 435779 - protein, 10 aa, Mycobacterium
ASDRTGALSP

SEQ ID NO: 435780 - protein, 7 aa, Mycobacterium
ASDRTLG

SEQ ID NO: 435781 - protein, 7 aa, Mycobacterium
ASDRVAA

SEQ ID NO: 435782 - protein, 12 aa, Mycobacterium
ASDRVKTDARDA

SEQ ID NO: 435783 - protein, 4 aa, Mycobacterium
ASDS

SEQ ID NO: 435784 - protein, 13 aa, Mycobacterium
ASDSADDQEQACR

SEQ ID NO: 435785 - protein, 15 aa, Mycobacterium
ASDSALAKGLSTHDG

SEQ ID NO: 435786 - protein, 9 aa, Mycobacterium
ASDSFGPQV

SEQ ID NO: 435787 - protein, 8 aa, Mycobacterium
ASDSGAAG

SEQ ID NO: 435788 - protein, 8 aa, Mycobacterium
ASDSGRTV

SEQ ID NO: 435789 - protein, 7 aa, Mycobacterium
ASDSGYS

SEQ ID NO: 435790 - protein, 11 aa, Mycobacterium
ASDSLSKARFT

SEQ ID NO: 435791 - protein, 10 aa, Mycobacterium
ASDSPGAIEG

SEQ ID NO: 435792 - protein, 8 aa, Mycobacterium
ASDSPRGR

SEQ ID NO: 435793 - protein, 7 aa, Mycobacterium
ASDSPYG

SEQ ID NO: 435794 - protein, 5 aa, Mycobacterium
ASDSV

SEQ ID NO: 435795 - protein, 4 aa, Mycobacterium
ASDT

SEQ ID NO: 435796 - protein, 5 aa, Mycobacterium
ASDTA

SEQ ID NO: 435797 - protein, 15 aa, Mycobacterium
ASDTAPAWAKTVRVA

SEQ ID NO: 435798 - protein, 7 aa, Mycobacterium
ASDTARQ

SEQ ID NO: 435799 - protein, 8 aa, Mycobacterium
ASDTASVS

SEQ ID NO: 435800 - protein, 5 aa, Mycobacterium
ASDTD

SEQ ID NO: 435801 - protein, 7 aa, Mycobacterium
ASDTDGV

SEQ ID NO: 435802 - protein, 7 aa, Mycobacterium
ASDTDKF

SEQ ID NO: 435803 - protein, 7 aa, Mycobacterium
ASDTDSE

SEQ ID NO: 435804 - protein, 18 aa, Mycobacterium
ASDTFETGTRAAAFGGTT

SEQ ID NO: 435805 - protein, 6 aa, Mycobacterium
ASDTKG

SEQ ID NO: 435806 - protein, 18 aa, Mycobacterium
ASDTPDKPKRAAGKRTKT

SEQ ID NO: 435807 - protein, 8 aa, Mycobacterium
ASDTPEGQ

SEQ ID NO: 435808 - protein, 8 aa, Mycobacterium
ASDTPPMR

SEQ ID NO: 435809 - protein, 22 aa, Mycobacterium
ASDTPPSGIPQQAQQPPVGGSR

SEQ ID NO: 435810 - protein, 6 aa, Mycobacterium
ASDTQP

SEQ ID NO: 435811 - protein, 6 aa, Mycobacterium
ASDTRP

SEQ ID NO: 435812 - protein, 8 aa, Mycobacterium
ASDVQARR

SEQ ID NO: 435813 - protein, 29 aa, Mycobacterium
ASDVQARRAELTQSGMTPRDFVADSYMPP

SEQ ID NO: 435814 - protein, 5 aa, Mycobacterium
ASDYM

SEQ ID NO: 435815 - protein, 9 aa, Mycobacterium
ASDYPFDTD

SEQ ID NO: 435816 - protein, 7 aa, Mycobacterium
ASDYREG

SEQ ID NO: 435817 - protein, 11 aa, Mycobacterium
ASEAAARKTQP

SEQ ID NO: 435818 - protein, 30 aa, Mycobacterium
ASEAAARQLASRARKAVAAAPPPQPDPTHN

SEQ ID NO: 435819 - protein, 9 aa, Mycobacterium
ASEAAEDVA

SEQ ID NO: 435820 - protein, 12 aa, Mycobacterium
ASEAAERVAAAE

SEQ ID NO: 435821 - protein, 7 aa, Mycobacterium
ASEAELR

SEQ ID NO: 435822 - protein, 9 aa, Mycobacterium
ASEAELREK

SEQ ID NO: 435823 - protein, 5 aa, Mycobacterium
ASEAG

SEQ ID NO: 435824 - protein, 6 aa, Mycobacterium
ASEAGC

SEQ ID NO: 435825 - protein, 7 aa, Mycobacterium
ASEAGVE

SEQ ID NO: 435826 - protein, 7 aa, Mycobacterium
ASEAGVQ

SEQ ID NO: 435827 - protein, 6 aa, Mycobacterium
ASEALK

SEQ ID NO: 435828 - protein, 12 aa, Mycobacterium
ASEALSAVSGDS

SEQ ID NO: 435829 - protein, 11 aa, Mycobacterium
ASEAPFYRPAG

SEQ ID NO: 435830 - protein, 10 aa, Mycobacterium
ASEAPPPKHP

SEQ ID NO: 435831 - protein, 15 aa, Mycobacterium
ASEAPSDASLDRSKA

SEQ ID NO: 435832 - protein, 8 aa, Mycobacterium
ASEARAQG

SEQ ID NO: 435833 - protein, 7 aa, Mycobacterium
ASEARRL

SEQ ID NO: 435834 - protein, 9 aa, Mycobacterium
ASEARSAGV

SEQ ID NO: 435835 - protein, 5 aa, Mycobacterium
ASEAT

SEQ ID NO: 435836 - protein, 6 aa, Mycobacterium
ASEATV

SEQ ID NO: 435837 - protein, 38 aa, Mycobacterium
ASECSANGASGNHTGPQPSDGQEATSTGQPQASSAAAL

SEQ ID NO: 435838 - protein, 8 aa, Mycobacterium
ASECTPDE

SEQ ID NO: 435839 - protein, 6 aa, Mycobacterium
ASEDAR

SEQ ID NO: 435840 - protein, 6 aa, Mycobacterium
ASEDEV

SEQ ID NO: 435841 - protein, 5 aa, Mycobacterium
ASEDG

SEQ ID NO: 435842 - protein, 11 aa, Mycobacterium
ASEDGDRLSDD

SEQ ID NO: 435843 - protein, 6 aa, Mycobacterium
ASEDGH

SEQ ID NO: 435844 - protein, 7 aa, Mycobacterium
ASEDGQV

SEQ ID NO: 435845 - protein, 11 aa, Mycobacterium
ASEDPGDVGGP

SEQ ID NO: 435846 - protein, 10 aa, Mycobacterium
ASEDSAARAR

SEQ ID NO: 435847 - protein, 7 aa, Mycobacterium
ASEDSAS

SEQ ID NO: 435848 - protein, 4 aa, Mycobacterium
ASEE

SEQ ID NO: 435849 - protein, 6 aa, Mycobacterium
ASEEAE

SEQ ID NO: 435850 - protein, 9 aa, Mycobacterium
ASEEALARN

SEQ ID NO: 435851 - protein, 19 aa, Mycobacterium
ASEEDAQFAASEGIPMPKT

SEQ ID NO: 435852 - protein, 7 aa, Mycobacterium
ASEEDPQ

SEQ ID NO: 435853 - protein, 6 aa, Mycobacterium
ASEEDW

SEQ ID NO: 435854 - protein, 25 aa, Mycobacterium
ASEEEAPEPKAIEAGSSTPSDSDEI

SEQ ID NO: 435855 - protein, 6 aa, Mycobacterium
ASEEEL

SEQ ID NO: 435856 - protein, 5 aa, Mycobacterium
ASEEF

SEQ ID NO: 435857 - protein, 8 aa, Mycobacterium
ASEEGGDR

SEQ ID NO: 435858 - protein, 8 aa, Mycobacterium
ASEEGKGV

SEQ ID NO: 435859 - protein, 22 aa, Mycobacterium
ASEEGRAATSGASAEDFARASD

SEQ ID NO: 435860 - protein, 6 aa, Mycobacterium
ASEEHT

SEQ ID NO: 435861 - protein, 9 aa, Mycobacterium
ASEEIPPER

SEQ ID NO: 435862 - protein, 7 aa, Mycobacterium
ASEEQKK

SEQ ID NO: 435863 - protein, 11 aa, Mycobacterium
ASEEQRAPHSG

SEQ ID NO: 435864 - protein, 7 aa, Mycobacterium
ASEEQRR

SEQ ID NO: 435865 - protein, 8 aa, Mycobacterium
ASEERDAE

SEQ ID NO: 435866 - protein, 15 aa, Mycobacterium
ASEESDGYKPSDSVQ

SEQ ID NO: 435867 - protein, 6 aa, Mycobacterium
ASEEVE

SEQ ID NO: 435868 - protein, 11 aa, Mycobacterium
ASEFTPSQADL

SEQ ID NO: 435869 - protein, 6 aa, Mycobacterium
ASEGAD

SEQ ID NO: 435870 - protein, 14 aa, Mycobacterium
ASEGAGEVQTPLRG

SEQ ID NO: 435871 - protein, 11 aa, Mycobacterium
ASEGEPADMSA

SEQ ID NO: 435872 - protein, 6 aa, Mycobacterium
ASEGKF

SEQ ID NO: 435873 - protein, 5 aa, Mycobacterium
ASEGL

SEQ ID NO: 435874 - protein, 7 aa, Mycobacterium
ASEGRFG

SEQ ID NO: 435875 - protein, 10 aa, Mycobacterium
ASEGRGKRPV

SEQ ID NO: 435876 - protein, 20 aa, Mycobacterium
ASEGRPAATAGSAVADQPGI

SEQ ID NO: 435877 - protein, 8 aa, Mycobacterium
ASEGRSAD

SEQ ID NO: 435878 - protein, 7 aa, Mycobacterium
ASEGRTI

SEQ ID NO: 435879 - protein, 7 aa, Mycobacterium
ASEGSAV

SEQ ID NO: 435880 - protein, 8 aa, Mycobacterium
ASEGSDGI

SEQ ID NO: 435881 - protein, 13 aa, Mycobacterium
ASEGSKRPSGSVA

SEQ ID NO: 435882 - protein, 10 aa, Mycobacterium
ASEGSTAAIA

SEQ ID NO: 435883 - protein, 8 aa, Mycobacterium
ASEGTPLQ

SEQ ID NO: 435884 - protein, 13 aa, Mycobacterium
ASEGVKEDDIRGD

SEQ ID NO: 435885 - protein, 13 aa, Mycobacterium
ASEGVKEDDIRTD

SEQ ID NO: 435886 - protein, 13 aa, Mycobacterium
ASEGVKEEDIRSD

SEQ ID NO: 435887 - protein, 11 aa, Mycobacterium
ASEGVKEGDIR

SEQ ID NO: 435888 - protein, 12 aa, Mycobacterium
ASEGYTGGGAKA

SEQ ID NO: 435889 - protein, 4 aa, Mycobacterium
ASEH

SEQ ID NO: 435890 - protein, 7 aa, Mycobacterium
ASEHGGD

SEQ ID NO: 435891 - protein, 12 aa, Mycobacterium
ASEHPAPKPGDT

SEQ ID NO: 435892 - protein, 4 aa, Mycobacterium
ASEI

SEQ ID NO: 435893 - protein, 12 aa, Mycobacterium
ASEIAAASGADT

SEQ ID NO: 435894 - protein, 11 aa, Mycobacterium
ASEIAPSQADL

SEQ ID NO: 435895 - protein, 14 aa, Mycobacterium
ASEIDTKDAKNFEE

SEQ ID NO: 435896 - protein, 7 aa, Mycobacterium
ASEIGDS

SEQ ID NO: 435897 - protein, 40 aa, Mycobacterium
ASEISETSAAAAAAAAGAAPAALGGAGPVTAGLGNASALG

SEQ ID NO: 435898 - protein, 14 aa, Mycobacterium
ASEISNEVNALLSV

SEQ ID NO: 435899 - protein, 9 aa, Mycobacterium
ASEITPDAA

SEQ ID NO: 435900 - protein, 5 aa, Mycobacterium
ASEKA

SEQ ID NO: 435901 - protein, 9 aa, Mycobacterium
ASEKAGSLT

SEQ ID NO: 435902 - protein, 5 aa, Mycobacterium
ASEKE

SEQ ID NO: 435903 - protein, 8 aa, Mycobacterium
ASEKGITV

SEQ ID NO: 435904 - protein, 9 aa, Mycobacterium
ASEKGITVS

SEQ ID NO: 435905 - protein, 9 aa, Mycobacterium
ASEKGLTVS

SEQ ID NO: 435906 - protein, 15 aa, Mycobacterium
ASEKGQQLAATPYAS

SEQ ID NO: 435907 - protein, 10 aa, Mycobacterium
ASEKGVSVSD

SEQ ID NO: 435908 - protein, 9 aa, Mycobacterium
ASEKGVTVT

SEQ ID NO: 435909 - protein, 24 aa, Mycobacterium
ASELAGVGSTLSTATTAAAAQTTG

SEQ ID NO: 435910 - protein, 20 aa, Mycobacterium
ASELASRQRAMKSATDNADD

SEQ ID NO: 435911 - protein, 6 aa, Mycobacterium
ASELDG

SEQ ID NO: 435912 - protein, 8 aa, Mycobacterium
ASELDQKA

SEQ ID NO: 435913 - protein, 7 aa, Mycobacterium
ASELGEP

SEQ ID NO: 435914 - protein, 9 aa, Mycobacterium
ASELPQPRY

SEQ ID NO: 435915 - protein, 11 aa, Mycobacterium
ASELPSRSATD

SEQ ID NO: 435916 - protein, 7 aa, Mycobacterium
ASELQRA

SEQ ID NO: 435917 - protein, 6 aa, Mycobacterium
ASENDL

SEQ ID NO: 435918 - protein, 12 aa, Mycobacterium
ASENPAELAPGA

SEQ ID NO: 435919 - protein, 12 aa, Mycobacterium
ASENPAELAPGD

SEQ ID NO: 435920 - protein, 7 aa, Mycobacterium
ASENRPE

SEQ ID NO: 435921 - protein, 6 aa, Mycobacterium
ASEPAA

SEQ ID NO: 435922 - protein, 8 aa, Mycobacterium
ASEPAQKR

SEQ ID NO: 435923 - protein, 9 aa, Mycobacterium
ASEPAQKRA

SEQ ID NO: 435924 - protein, 5 aa, Mycobacterium
ASEPD

SEQ ID NO: 435925 - protein, 10 aa, Mycobacterium
ASEPDPRLNG

SEQ ID NO: 435926 - protein, 6 aa, Mycobacterium
ASEPEP

SEQ ID NO: 435927 - protein, 9 aa, Mycobacterium
ASEPGRAVP

SEQ ID NO: 435928 - protein, 6 aa, Mycobacterium
ASEPGV

SEQ ID NO: 435929 - protein, 8 aa, Mycobacterium
ASEPHESV

SEQ ID NO: 435930 - protein, 11 aa, Mycobacterium
ASEPLQPVPED

SEQ ID NO: 435931 - protein, 6 aa, Mycobacterium
ASEPLT

SEQ ID NO: 435932 - protein, 8 aa, Mycobacterium
ASEPPQKR

SEQ ID NO: 435933 - protein, 6 aa, Mycobacterium
ASEPRA

SEQ ID NO: 435934 - protein, 13 aa, Mycobacterium
ASEPYSLDNERPA

SEQ ID NO: 435935 - protein, 4 aa, Mycobacterium
ASEQ

SEQ ID NO: 435936 - protein, 13 aa, Mycobacterium
ASEQGRSGSSKFR

SEQ ID NO: 435937 - protein, 6 aa, Mycobacterium
ASEQLA

SEQ ID NO: 435938 - protein, 8 aa, Mycobacterium
ASEQPGLA

SEQ ID NO: 435939 - protein, 9 aa, Mycobacterium
ASEQPVPKA

SEQ ID NO: 435940 - protein, 9 aa, Mycobacterium
ASEQRASGW

SEQ ID NO: 435941 - protein, 22 aa, Mycobacterium
ASEQRRNSIGQAAQVFRRAIAA

SEQ ID NO: 435942 - protein, 16 aa, Mycobacterium
ASEQTPGGAAPGEAEI

SEQ ID NO: 435943 - protein, 8 aa, Mycobacterium
ASERAGQL

SEQ ID NO: 435944 - protein, 6 aa, Mycobacterium
ASERDR

SEQ ID NO: 435945 - protein, 8 aa, Mycobacterium
ASEREEVA

SEQ ID NO: 435946 - protein, 13 aa, Mycobacterium
ASERGGPAGVQAA

SEQ ID NO: 435947 - protein, 5 aa, Mycobacterium
ASERL

SEQ ID NO: 435948 - protein, 7 aa, Mycobacterium
ASERPNR

SEQ ID NO: 435949 - protein, 7 aa, Mycobacterium
ASERTGA

SEQ ID NO: 435950 - protein, 5 aa, Mycobacterium
ASESA

SEQ ID NO: 435951 - protein, 8 aa, Mycobacterium
ASESAGSK

SEQ ID NO: 435952 - protein, 8 aa, Mycobacterium
ASESAHPA

SEQ ID NO: 435953 - protein, 12 aa, Mycobacterium
ASESAQAAAESV

SEQ ID NO: 435954 - protein, 9 aa, Mycobacterium
ASESDGARD

SEQ ID NO: 435955 - protein, 9 aa, Mycobacterium
ASESEGARD

SEQ ID NO: 435956 - protein, 8 aa, Mycobacterium
ASESEGSK

SEQ ID NO: 435957 - protein, 7 aa, Mycobacterium
ASESEPY

SEQ ID NO: 435958 - protein, 8 aa, Mycobacterium
ASESERVG

SEQ ID NO: 435959 - protein, 14 aa, Mycobacterium
ASESGATGEPLTDR

SEQ ID NO: 435960 - protein, 9 aa, Mycobacterium
ASESLGRAG

SEQ ID NO: 435961 - protein, 7 aa, Mycobacterium
ASESNTA

SEQ ID NO: 435962 - protein, 7 aa, Mycobacterium
ASESPEF

SEQ ID NO: 435963 - protein, 13 aa, Mycobacterium
ASESQQSQPDITG

SEQ ID NO: 435964 - protein, 8 aa, Mycobacterium
ASESRRHT

SEQ ID NO: 435965 - protein, 15 aa, Mycobacterium
ASETANQATAAAAAY

SEQ ID NO: 435966 - protein, 8 aa, Mycobacterium
ASETDESV

SEQ ID NO: 435967 - protein, 12 aa, Mycobacterium
ASETGEPGSLVG

SEQ ID NO: 435968 - protein, 6 aa, Mycobacterium
ASETLN

SEQ ID NO: 435969 - protein, 9 aa, Mycobacterium
ASETSAQGF

SEQ ID NO: 435970 - protein, 8 aa, Mycobacterium
ASETTRTG

SEQ ID NO: 435971 - protein, 9 aa, Mycobacterium
ASETTTERE

SEQ ID NO: 435972 - protein, 12 aa, Mycobacterium
ASETVTAPRGGV

SEQ ID NO: 435973 - protein, 6 aa, Mycobacterium
ASEVDD

SEQ ID NO: 435974 - protein, 7 aa, Mycobacterium
ASEVPPV

SEQ ID NO: 435975 - protein, 8 aa, Mycobacterium
ASEVRREN

SEQ ID NO: 435976 - protein, 8 aa, Mycobacterium
ASFAAAPR

SEQ ID NO: 435977 - protein, 6 aa, Mycobacterium
ASFDGD

SEQ ID NO: 435978 - protein, 14 aa, Mycobacterium
ASFDPEPGTNIGGA

SEQ ID NO: 435979 - protein, 8 aa, Mycobacterium
ASFEGRSS

SEQ ID NO: 435980 - protein, 7 aa, Mycobacterium
ASFGAAP

SEQ ID NO: 435981 - protein, 8 aa, Mycobacterium
ASFGAAPR

SEQ ID NO: 435982 - protein, 14 aa, Mycobacterium
ASFGDASGYLTATL

SEQ ID NO: 435983 - protein, 14 aa, Mycobacterium
ASFGEDSGYLTAIL

SEQ ID NO: 435984 - protein, 6 aa, Mycobacterium
ASFGPH

SEQ ID NO: 435985 - protein, 8 aa, Mycobacterium
ASFGSAPR

SEQ ID NO: 435986 - protein, 9 aa, Mycobacterium
ASFPDSPIA

SEQ ID NO: 435987 - protein, 6 aa, Mycobacterium
ASFPGA

SEQ ID NO: 435988 - protein, 8 aa, Mycobacterium
ASFPNNPI

SEQ ID NO: 435989 - protein, 5 aa, Mycobacterium
ASFQT

SEQ ID NO: 435990 - protein, 15 aa, Mycobacterium
ASFRGTDKRGGANGA

SEQ ID NO: 435991 - protein, 4 aa, Mycobacterium
ASFS

SEQ ID NO: 435992 - protein, 5 aa, Mycobacterium
ASFSN

SEQ ID NO: 435993 - protein, 6 aa, Mycobacterium
ASFSTT

SEQ ID NO: 435994 - protein, 5 aa, Mycobacterium
ASFTD

SEQ ID NO: 435995 - protein, 13 aa, Mycobacterium
ASFTSSITNWVAS

SEQ ID NO: 435996 - protein, 4 aa, Mycobacterium
ASFV

SEQ ID NO: 435997 - protein, 6 aa, Mycobacterium
ASGAAA

SEQ ID NO: 435998 - protein, 9 aa, Mycobacterium
ASGAAAAAL

SEQ ID NO: 435999 - protein, 103 aa, Mycobacterium
ASGAAKKTAAKKAPAKKAAAKKTAAKKAPAKKAATKAPAKKAATKAPAKKAATKAPVKKAATKAPVKKAAAKKAATKAPVKKAAAKRPASKAPAKKATARRGR

SEQ ID NO: 436000 - protein, 16 aa, Mycobacterium
ASGAALASGAAGAALA

SEQ ID NO: 436001 - protein, 11 aa, Mycobacterium
ASGAANPASDT

SEQ ID NO: 436002 - protein, 8 aa, Mycobacterium
ASGAAPAV

SEQ ID NO: 436003 - protein, 7 aa, Mycobacterium
ASGAAQQ

SEQ ID NO: 436004 - protein, 7 aa, Mycobacterium
ASGAAQV

SEQ ID NO: 436005 - protein, 7 aa, Mycobacterium
ASGAARM

SEQ ID NO: 436006 - protein, 7 aa, Mycobacterium
ASGAARV

SEQ ID NO: 436007 - protein, 21 aa, Mycobacterium
ASGAASAASSGAGALGSIGSL

SEQ ID NO: 436008 - protein, 8 aa, Mycobacterium
ASGADAIH

SEQ ID NO: 436009 - protein, 13 aa, Mycobacterium
ASGADAYTMRREA

SEQ ID NO: 436010 - protein, 9 aa, Mycobacterium
ASGADPETD

SEQ ID NO: 436011 - protein, 6 aa, Mycobacterium
ASGADR

SEQ ID NO: 436012 - protein, 10 aa, Mycobacterium
ASGADRDDLT

SEQ ID NO: 436013 - protein, 9 aa, Mycobacterium
ASGAEPATR

SEQ ID NO: 436014 - protein, 18 aa, Mycobacterium
ASGAEPLGSMGTDTPAAV

SEQ ID NO: 436015 - protein, 8 aa, Mycobacterium
ASGAESIA

SEQ ID NO: 436016 - protein, 5 aa, Mycobacterium
ASGAF

SEQ ID NO: 436017 - protein, 7 aa, Mycobacterium
ASGAFDP

SEQ ID NO: 436018 - protein, 5 aa, Mycobacterium
ASGAG

SEQ ID NO: 436019 - protein, 9 aa, Mycobacterium
ASGAGAGTL

SEQ ID NO: 436020 - protein, 21 aa, Mycobacterium
ASGAGDARKIKSAASTLADTL

SEQ ID NO: 436021 - protein, 16 aa, Mycobacterium
ASGAGLQDKVPEPPGG

SEQ ID NO: 436022 - protein, 6 aa, Mycobacterium
ASGAGN

SEQ ID NO: 436023 - protein, 8 aa, Mycobacterium
ASGAGVAR

SEQ ID NO: 436024 - protein, 10 aa, Mycobacterium
ASGAKRGFGI

SEQ ID NO: 436025 - protein, 8 aa, Mycobacterium
ASGAKRSN

SEQ ID NO: 436026 - protein, 13 aa, Mycobacterium
ASGALAGRRDPPG

SEQ ID NO: 436027 - protein, 8 aa, Mycobacterium
ASGALEPD

SEQ ID NO: 436028 - protein, 11 aa, Mycobacterium
ASGANNGEKHP

SEQ ID NO: 436029 - protein, 11 aa, Mycobacterium
ASGAPAPSSWE

SEQ ID NO: 436030 - protein, 7 aa, Mycobacterium
ASGAPHV

SEQ ID NO: 436031 - protein, 7 aa, Mycobacterium
ASGAPQQ

SEQ ID NO: 436032 - protein, 9 aa, Mycobacterium
ASGAPTAQY

SEQ ID NO: 436033 - protein, 7 aa, Mycobacterium
ASGAPVD

SEQ ID NO: 436034 - protein, 8 aa, Mycobacterium
ASGAPVPA

SEQ ID NO: 436035 - protein, 6 aa, Mycobacterium
ASGAQD

SEQ ID NO: 436036 - protein, 11 aa, Mycobacterium
ASGAQGPLSGR

SEQ ID NO: 436037 - protein, 13 aa, Mycobacterium
ASGAQPDSVDPAQ

SEQ ID NO: 436038 - protein, 11 aa, Mycobacterium
ASGAQRDEDDS

SEQ ID NO: 436039 - protein, 5 aa, Mycobacterium
ASGAR

SEQ ID NO: 436040 - protein, 6 aa, Mycobacterium
ASGARG

SEQ ID NO: 436041 - protein, 7 aa, Mycobacterium
ASGASAQ

SEQ ID NO: 436042 - protein, 6 aa, Mycobacterium
ASGASI

SEQ ID NO: 436043 - protein, 9 aa, Mycobacterium
ASGASSALN

SEQ ID NO: 436044 - protein, 5 aa, Mycobacterium
ASGAT

SEQ ID NO: 436045 - protein, 6 aa, Mycobacterium
ASGATA

SEQ ID NO: 436046 - protein, 12 aa, Mycobacterium
ASGATAEIVNRL

SEQ ID NO: 436047 - protein, 13 aa, Mycobacterium
ASGATARLKRFRI

SEQ ID NO: 436048 - protein, 7 aa, Mycobacterium
ASGATDV

SEQ ID NO: 436049 - protein, 5 aa, Mycobacterium
ASGAV

SEQ ID NO: 436050 - protein, 18 aa, Mycobacterium
ASGAYASAEAANASPLQT

SEQ ID NO: 436051 - protein, 9 aa, Mycobacterium
ASGAYGARK

SEQ ID NO: 436052 - protein, 26 aa, Mycobacterium
ASGCQPDGGAKFGGGRGAEESARSVQ

SEQ ID NO: 436053 - protein, 5 aa, Mycobacterium
ASGDA

SEQ ID NO: 436054 - protein, 7 aa, Mycobacterium
ASGDAAR

SEQ ID NO: 436055 - protein, 6 aa, Mycobacterium
ASGDAE

SEQ ID NO: 436056 - protein, 13 aa, Mycobacterium
ASGDARTADTATA

SEQ ID NO: 436057 - protein, 9 aa, Mycobacterium
ASGDDARQT

SEQ ID NO: 436058 - protein, 9 aa, Mycobacterium
ASGDDPEKL

SEQ ID NO: 436059 - protein, 10 aa, Mycobacterium
ASGDDPGTDW

SEQ ID NO: 436060 - protein, 11 aa, Mycobacterium
ASGDDQVDEAA

SEQ ID NO: 436061 - protein, 9 aa, Mycobacterium
ASGDDRGPT

SEQ ID NO: 436062 - protein, 9 aa, Mycobacterium
ASGDEPATD

SEQ ID NO: 436063 - protein, 5 aa, Mycobacterium
ASGDF

SEQ ID NO: 436064 - protein, 14 aa, Mycobacterium
ASGDGAHAPPQAPI

SEQ ID NO: 436065 - protein, 7 aa, Mycobacterium
ASGDGAV

SEQ ID NO: 436066 - protein, 6 aa, Mycobacterium
ASGDGD

SEQ ID NO: 436067 - protein, 19 aa, Mycobacterium
ASGDGGAGGAGGAGGAGGL

SEQ ID NO: 436068 - protein, 10 aa, Mycobacterium
ASGDGGFRTE

SEQ ID NO: 436069 - protein, 8 aa, Mycobacterium
ASGDGRDQ

SEQ ID NO: 436070 - protein, 9 aa, Mycobacterium
ASGDIDRTE

SEQ ID NO: 436071 - protein, 8 aa, Mycobacterium
ASGDNGEI

SEQ ID NO: 436072 - protein, 7 aa, Mycobacterium
ASGDPAE

SEQ ID NO: 436073 - protein, 8 aa, Mycobacterium
ASGDPAQL

SEQ ID NO: 436074 - protein, 8 aa, Mycobacterium
ASGDPDMP

SEQ ID NO: 436075 - protein, 18 aa, Mycobacterium
ASGDPTSGPAGVPPARQE

SEQ ID NO: 436076 - protein, 7 aa, Mycobacterium
ASGDPTV

SEQ ID NO: 436077 - protein, 6 aa, Mycobacterium
ASGDRD

SEQ ID NO: 436078 - protein, 8 aa, Mycobacterium
ASGDRPTL

SEQ ID NO: 436079 - protein, 9 aa, Mycobacterium
ASGDRRVRS

SEQ ID NO: 436080 - protein, 8 aa, Mycobacterium
ASGDRTRD

SEQ ID NO: 436081 - protein, 8 aa, Mycobacterium
ASGDSGRA

SEQ ID NO: 436082 - protein, 5 aa, Mycobacterium
ASGDT

SEQ ID NO: 436083 - protein, 6 aa, Mycobacterium
ASGDTP

SEQ ID NO: 436084 - protein, 7 aa, Mycobacterium
ASGDVRD

SEQ ID NO: 436085 - protein, 7 aa, Mycobacterium
ASGDVYD

SEQ ID NO: 436086 - protein, 9 aa, Mycobacterium
ASGDWQVDG

SEQ ID NO: 436087 - protein, 4 aa, Mycobacterium
ASGE

SEQ ID NO: 436088 - protein, 9 aa, Mycobacterium
ASGEAAAPM

SEQ ID NO: 436089 - protein, 8 aa, Mycobacterium
ASGEAGTG

SEQ ID NO: 436090 - protein, 10 aa, Mycobacterium
ASGEARAADV

SEQ ID NO: 436091 - protein, 14 aa, Mycobacterium
ASGEASETADTPMP

SEQ ID NO: 436092 - protein, 9 aa, Mycobacterium
ASGEDSKNL

SEQ ID NO: 436093 - protein, 6 aa, Mycobacterium
ASGEDV

SEQ ID NO: 436094 - protein, 5 aa, Mycobacterium
ASGEE

SEQ ID NO: 436095 - protein, 10 aa, Mycobacterium
ASGEEGSDAV

SEQ ID NO: 436096 - protein, 8 aa, Mycobacterium
ASGEERKQ

SEQ ID NO: 436097 - protein, 6 aa, Mycobacterium
ASGEFN

SEQ ID NO: 436098 - protein, 6 aa, Mycobacterium
ASGEGA

SEQ ID NO: 436099 - protein, 6 aa, Mycobacterium
ASGEGI

SEQ ID NO: 436100 - protein, 7 aa, Mycobacterium
ASGEIAY

SEQ ID NO: 436101 - protein, 11 aa, Mycobacterium
ASGELNQGAVD

SEQ ID NO: 436102 - protein, 18 aa, Mycobacterium
ASGEPASGPAGEPPACKE

SEQ ID NO: 436103 - protein, 17 aa, Mycobacterium
ASGEPATATADDAARKQ

SEQ ID NO: 436104 - protein, 7 aa, Mycobacterium
ASGEPAV

SEQ ID NO: 436105 - protein, 7 aa, Mycobacterium
ASGEPGV

SEQ ID NO: 436106 - protein, 9 aa, Mycobacterium
ASGEPKQRV

SEQ ID NO: 436107 - protein, 13 aa, Mycobacterium
ASGEPLDDDDRRP

SEQ ID NO: 436108 - protein, 8 aa, Mycobacterium
ASGEPRLT

SEQ ID NO: 436109 - protein, 6 aa, Mycobacterium
ASGEPT

SEQ ID NO: 436110 - protein, 8 aa, Mycobacterium
ASGEPVSW

SEQ ID NO: 436111 - protein, 10 aa, Mycobacterium
ASGEQAGADG

SEQ ID NO: 436112 - protein, 11 aa, Mycobacterium
ASGERADPQAV

SEQ ID NO: 436113 - protein, 6 aa, Mycobacterium
ASGESL

SEQ ID NO: 436114 - protein, 5 aa, Mycobacterium
ASGET

SEQ ID NO: 436115 - protein, 6 aa, Mycobacterium
ASGEVD

SEQ ID NO: 436116 - protein, 7 aa, Mycobacterium
ASGEVRK

SEQ ID NO: 436117 - protein, 4 aa, Mycobacterium
ASGF

SEQ ID NO: 436118 - protein, 7 aa, Mycobacterium
ASGFGKD

SEQ ID NO: 436119 - protein, 18 aa, Mycobacterium
ASGFGRATAEALAKRGAT

SEQ ID NO: 436120 - protein, 6 aa, Mycobacterium
ASGFGV

SEQ ID NO: 436121 - protein, 14 aa, Mycobacterium
ASGFTDRAVQDGAD

SEQ ID NO: 436122 - protein, 5 aa, Mycobacterium
ASGGA

SEQ ID NO: 436123 - protein, 23 aa, Mycobacterium
ASGGAAAAAGAAAGAKSAAPDPL

SEQ ID NO: 436124 - protein, 23 aa, Mycobacterium
ASGGAAAAAGAMAGAKSAAPDPL

SEQ ID NO: 436125 - protein, 18 aa, Mycobacterium
ASGGAAGSSAAPTSAGSS

SEQ ID NO: 436126 - protein, 8 aa, Mycobacterium
ASGGATSV

SEQ ID NO: 436127 - protein, 6 aa, Mycobacterium
ASGGCT

SEQ ID NO: 436128 - protein, 7 aa, Mycobacterium
ASGGDRL

SEQ ID NO: 436129 - protein, 8 aa, Mycobacterium
ASGGDSGA

SEQ ID NO: 436130 - protein, 6 aa, Mycobacterium
ASGGGK

SEQ ID NO: 436131 - protein, 7 aa, Mycobacterium
ASGGGRR

SEQ ID NO: 436132 - protein, 7 aa, Mycobacterium
ASGGGVR

SEQ ID NO: 436133 - protein, 9 aa, Mycobacterium
ASGGIAEGR

SEQ ID NO: 436134 - protein, 10 aa, Mycobacterium
ASGGIRTARD

SEQ ID NO: 436135 - protein, 38 aa, Mycobacterium
ASGGNAYGGSGGTGGNGATGASGGTGGTGGTGGDGGHG

SEQ ID NO: 436136 - protein, 7 aa, Mycobacterium
ASGGPFR

SEQ ID NO: 436137 - protein, 8 aa, Mycobacterium
ASGGPFRG

SEQ ID NO: 436138 - protein, 8 aa, Mycobacterium
ASGGPGPQ

SEQ ID NO: 436139 - protein, 7 aa, Mycobacterium
ASGGPGW

SEQ ID NO: 436140 - protein, 6 aa, Mycobacterium
ASGGPI

SEQ ID NO: 436141 - protein, 12 aa, Mycobacterium
ASGGQAGRDAVE

SEQ ID NO: 436142 - protein, 6 aa, Mycobacterium
ASGGQE

SEQ ID NO: 436143 - protein, 9 aa, Mycobacterium
ASGGRGGTA

SEQ ID NO: 436144 - protein, 8 aa, Mycobacterium
ASGGRGTL

SEQ ID NO: 436145 - protein, 6 aa, Mycobacterium
ASGGRL

SEQ ID NO: 436146 - protein, 7 aa, Mycobacterium
ASGGRLD

SEQ ID NO: 436147 - protein, 12 aa, Mycobacterium
ASGGRTGARSVD

SEQ ID NO: 436148 - protein, 127 aa, Mycobacterium
ASGGSGGASGAGGAGGSGGADSNGTTSASGGTGAAGTWGNGGNGGNGADGAGGEAGGQGGRGGDSLYGTAGDGGDGGRGGDAYAGHNAGNGGNGGVGGASNVHSGDGGRGGAGGTGLPGVPPPFGSG

SEQ ID NO: 436149 - protein, 8 aa, Mycobacterium
ASGGSIGY

SEQ ID NO: 436150 - protein, 10 aa, Mycobacterium
ASGGSTGRPK

SEQ ID NO: 436151 - protein, 7 aa, Mycobacterium
ASGGSVF

SEQ ID NO: 436152 - protein, 9 aa, Mycobacterium
ASGGSVGYD

SEQ ID NO: 436153 - protein, 17 aa, Mycobacterium
ASGGSYAETEAANAIAA

SEQ ID NO: 436154 - protein, 5 aa, Mycobacterium
ASGGT

SEQ ID NO: 436155 - protein, 6 aa, Mycobacterium
ASGGTA

SEQ ID NO: 436156 - protein, 20 aa, Mycobacterium
ASGGTGQSGVTSGIGNTGIP

SEQ ID NO: 436157 - protein, 7 aa, Mycobacterium
ASGGTVN

SEQ ID NO: 436158 - protein, 8 aa, Mycobacterium
ASGGVSSL

SEQ ID NO: 436159 - protein, 5 aa, Mycobacterium
ASGGY

SEQ ID NO: 436160 - protein, 5 aa, Mycobacterium
ASGHG

SEQ ID NO: 436161 - protein, 17 aa, Mycobacterium
ASGHGQIRATATPTTLR

SEQ ID NO: 436162 - protein, 7 aa, Mycobacterium
ASGHMAG

SEQ ID NO: 436163 - protein, 5 aa, Mycobacterium
ASGHP

SEQ ID NO: 436164 - protein, 7 aa, Mycobacterium
ASGHPDV

SEQ ID NO: 436165 - protein, 10 aa, Mycobacterium
ASGHRERGVK

SEQ ID NO: 436166 - protein, 12 aa, Mycobacterium
ASGHRERGVKQE

SEQ ID NO: 436167 - protein, 9 aa, Mycobacterium
ASGHRERTV

SEQ ID NO: 436168 - protein, 7 aa, Mycobacterium
ASGIANP

SEQ ID NO: 436169 - protein, 6 aa, Mycobacterium
ASGIGK

SEQ ID NO: 436170 - protein, 9 aa, Mycobacterium
ASGIPAAPV

SEQ ID NO: 436171 - protein, 10 aa, Mycobacterium
ASGIPKADGV

SEQ ID NO: 436172 - protein, 9 aa, Mycobacterium
ASGIPKAEG

SEQ ID NO: 436173 - protein, 9 aa, Mycobacterium
ASGIPKAES

SEQ ID NO: 436174 - protein, 7 aa, Mycobacterium
ASGIPRD

SEQ ID NO: 436175 - protein, 5 aa, Mycobacterium
ASGIT

SEQ ID NO: 436176 - protein, 17 aa, Mycobacterium
ASGITGQALDVNCGEFH

SEQ ID NO: 436177 - protein, 17 aa, Mycobacterium
ASGITGQALDVNCGEYK

SEQ ID NO: 436178 - protein, 5 aa, Mycobacterium
ASGKA

SEQ ID NO: 436179 - protein, 13 aa, Mycobacterium
ASGKESVKVSLIP

SEQ ID NO: 436180 - protein, 6 aa, Mycobacterium
ASGKGR

SEQ ID NO: 436181 - protein, 7 aa, Mycobacterium
ASGKIDR

SEQ ID NO: 436182 - protein, 9 aa, Mycobacterium
ASGKLGAHR

SEQ ID NO: 436183 - protein, 5 aa, Mycobacterium
ASGKP

SEQ ID NO: 436184 - protein, 9 aa, Mycobacterium
ASGKPVPSR

SEQ ID NO: 436185 - protein, 9 aa, Mycobacterium
ASGKRGTVQ

SEQ ID NO: 436186 - protein, 6 aa, Mycobacterium
ASGKSL

SEQ ID NO: 436187 - protein, 6 aa, Mycobacterium
ASGKSV

SEQ ID NO: 436188 - protein, 5 aa, Mycobacterium
ASGKT

SEQ ID NO: 436189 - protein, 24 aa, Mycobacterium
ASGKTVGTKSLTSIASTSGATGDD

SEQ ID NO: 436190 - protein, 13 aa, Mycobacterium
ASGKVKQRTVDEY

SEQ ID NO: 436191 - protein, 6 aa, Mycobacterium
ASGLAS

SEQ ID NO: 436192 - protein, 11 aa, Mycobacterium
ASGLGREGGHD
